United States Patent 7,691,997 (FUNCTIONAL AND HYPERFUNCTIONAL SIRNA) - sequence listing, part 2

SEQ ID NO: 36829 - RNA, 19 nt, Homo sapiens
gggauaaaaugaacaguuu

SEQ ID NO: 36830 - RNA, 19 nt, Homo sapiens
cagcacaggcuauuugaaa

SEQ ID NO: 36831 - RNA, 19 nt, Homo sapiens
guaacaggccuucaguaaa

SEQ ID NO: 36832 - RNA, 19 nt, Homo sapiens
ggaaaggcagcuccacuga

SEQ ID NO: 36833 - RNA, 19 nt, Homo sapiens
cugugaagcuuacuggaua

SEQ ID NO: 36834 - RNA, 19 nt, Homo sapiens
ggguggcccuguugacuuu

SEQ ID NO: 36835 - RNA, 19 nt, Homo sapiens
uaggacaucuugcagaaug

SEQ ID NO: 36836 - RNA, 19 nt, Homo sapiens
cacagaagcaucauuggua

SEQ ID NO: 36837 - RNA, 19 nt, Homo sapiens
ucuguaggaugaaguguaa

SEQ ID NO: 36838 - RNA, 19 nt, Homo sapiens
gcacgacguucuuucuucu

SEQ ID NO: 36839 - RNA, 19 nt, Homo sapiens
gaaaagcggcgucgggaua

SEQ ID NO: 36840 - RNA, 19 nt, Homo sapiens
caaguagucccaguaauga

SEQ ID NO: 36841 - RNA, 19 nt, Homo sapiens
gaagcucacagucagauug

SEQ ID NO: 36842 - RNA, 19 nt, Homo sapiens
uaagccugcuccaguguuu

SEQ ID NO: 36843 - RNA, 19 nt, Homo sapiens
ccacagcacaggcuauuug

SEQ ID NO: 36844 - RNA, 19 nt, Homo sapiens
gugcauuacugguggaguu

SEQ ID NO: 36845 - RNA, 19 nt, Homo sapiens
ucaaguagucccaguaaug

SEQ ID NO: 36846 - RNA, 19 nt, Homo sapiens
gaccagagggcaacagcua

SEQ ID NO: 36847 - RNA, 19 nt, Homo sapiens
caaaccaacuuuucuauca

SEQ ID NO: 36848 - RNA, 19 nt, Homo sapiens
caucucagagccauugaua

SEQ ID NO: 36849 - RNA, 19 nt, Homo sapiens
caaacuacaaaccaacuuu

SEQ ID NO: 36850 - RNA, 19 nt, Homo sapiens
ugacaacgaccaaggauca

SEQ ID NO: 36851 - RNA, 19 nt, Homo sapiens
uguaacaggccuucaguaa

SEQ ID NO: 36852 - RNA, 19 nt, Homo sapiens
ccauugaacaucacgagua

SEQ ID NO: 36853 - RNA, 19 nt, Homo sapiens
ggagaagguggcccaaaga

SEQ ID NO: 36854 - RNA, 19 nt, Homo sapiens
gaagacaacgaaccagaca

SEQ ID NO: 36855 - RNA, 19 nt, Homo sapiens
aagaaagcauggacacaga

SEQ ID NO: 36856 - RNA, 19 nt, Homo sapiens
gacuucagaucauccaaug

SEQ ID NO: 36857 - RNA, 19 nt, Homo sapiens
ggauagcuugcauuaauug

SEQ ID NO: 36858 - RNA, 19 nt, Homo sapiens
cagguuauccauauucuga

SEQ ID NO: 36859 - RNA, 19 nt, Homo sapiens
cggagucgaugguucaguu

SEQ ID NO: 36860 - RNA, 19 nt, Homo sapiens
cacaucguguuaugaauau

SEQ ID NO: 36861 - RNA, 19 nt, Homo sapiens
aaaucagggugaaaucuau

SEQ ID NO: 36862 - RNA, 19 nt, Homo sapiens
cgacugcauucucauguag

SEQ ID NO: 36863 - RNA, 19 nt, Homo sapiens
gcuuugaggugaccaaguc

SEQ ID NO: 36864 - RNA, 19 nt, Homo sapiens
uguaagaacugugacuuca

SEQ ID NO: 36865 - RNA, 19 nt, Homo sapiens
gcacagaagcaucauuggu

SEQ ID NO: 36866 - RNA, 19 nt, Homo sapiens
uggauagcuugcauuaauu

SEQ ID NO: 36867 - RNA, 19 nt, Homo sapiens
agcaauggcugucaucaug

SEQ ID NO: 36868 - RNA, 19 nt, Homo sapiens
gacccaagcuuaacuuuuc

SEQ ID NO: 36869 - RNA, 19 nt, Homo sapiens
ccaggaggcaagaagauuu

SEQ ID NO: 36870 - RNA, 19 nt, Homo sapiens
gaaugucauaggcaaguuu

SEQ ID NO: 36871 - RNA, 19 nt, Homo sapiens
caagggaagcucacaguca

SEQ ID NO: 36872 - RNA, 19 nt, Homo sapiens
cguuuauucuuccuuguaa

SEQ ID NO: 36873 - RNA, 19 nt, Homo sapiens
ccauguggauauuucuuau

SEQ ID NO: 36874 - RNA, 19 nt, Homo sapiens
ucagagccauugauacaag

SEQ ID NO: 36875 - RNA, 19 nt, Homo sapiens
acaacgaaccagacaauga

SEQ ID NO: 36876 - RNA, 19 nt, Homo sapiens
cgacguucuuucuucugua

SEQ ID NO: 36877 - RNA, 19 nt, Homo sapiens
uugacuaccugcauccuaa

SEQ ID NO: 36878 - RNA, 19 nt, Homo sapiens
gcucacagucagauugaaa

SEQ ID NO: 36879 - RNA, 19 nt, Homo sapiens
guaucaaagugcauuacug

SEQ ID NO: 36880 - RNA, 19 nt, Homo sapiens
cacagaagcaaacuacaaa

SEQ ID NO: 36881 - RNA, 19 nt, Homo sapiens
gcaauguccaggaaauuag

SEQ ID NO: 36882 - RNA, 19 nt, Homo sapiens
gcauggacacagacaaaga

SEQ ID NO: 36883 - RNA, 19 nt, Homo sapiens
aaaggcagcuccacugacu

SEQ ID NO: 36884 - RNA, 19 nt, Homo sapiens
auaaauguuucccuuguuc

SEQ ID NO: 36885 - RNA, 19 nt, Homo sapiens
gauaaggagagaauagcuu

SEQ ID NO: 36886 - RNA, 19 nt, Homo sapiens
gggugaaaucuauggaaua

SEQ ID NO: 36887 - RNA, 19 nt, Homo sapiens
caacgaaccagacaaugag

SEQ ID NO: 36888 - RNA, 19 nt, Homo sapiens
cagggcagcagauggauuu

SEQ ID NO: 36889 - RNA, 19 nt, Homo sapiens
ucuaucagacgaugaauug

SEQ ID NO: 36890 - RNA, 19 nt, Homo sapiens
cugaggaaaucauggaaau

SEQ ID NO: 36891 - RNA, 19 nt, Homo sapiens
ggacgacugcauucucaug

SEQ ID NO: 36892 - RNA, 19 nt, Homo sapiens
ucaacuacagccagaauga

SEQ ID NO: 36893 - RNA, 19 nt, Homo sapiens
ccaccaauccauacacaga

SEQ ID NO: 36894 - RNA, 19 nt, Homo sapiens
ccagugguguggauugcaa

SEQ ID NO: 36895 - RNA, 19 nt, Homo sapiens
ggaaagcccugugggauug

SEQ ID NO: 36896 - RNA, 19 nt, Homo sapiens
gaaaguuguuugucauguu

SEQ ID NO: 36897 - RNA, 19 nt, Homo sapiens
gaacccaucucugucaaug

SEQ ID NO: 36898 - RNA, 19 nt, Homo sapiens
gcacuggauggcaaacuua

SEQ ID NO: 36899 - RNA, 19 nt, Homo sapiens
ucccagagcuuugcaguaa

SEQ ID NO: 36900 - RNA, 19 nt, Homo sapiens
uguauucacuagacaagua

SEQ ID NO: 36901 - RNA, 19 nt, Homo sapiens
ccaagacuguguucauuca

SEQ ID NO: 36902 - RNA, 19 nt, Homo sapiens
gaccgggaauggacaaaga

SEQ ID NO: 36903 - RNA, 19 nt, Homo sapiens
ugaccaaccugcccuguuc

SEQ ID NO: 36904 - RNA, 19 nt, Homo sapiens
gccucuagcacaauuauua

SEQ ID NO: 36905 - RNA, 19 nt, Homo sapiens
uguccaagguguuuaagaa

SEQ ID NO: 36906 - RNA, 19 nt, Homo sapiens
caccaagacuguguucauu

SEQ ID NO: 36907 - RNA, 19 nt, Homo sapiens
aaaguuguuugucauguug

SEQ ID NO: 36908 - RNA, 19 nt, Homo sapiens
gcucaacaucaacuauaua

SEQ ID NO: 36909 - RNA, 19 nt, Homo sapiens
gacaaugccuaccccuuua

SEQ ID NO: 36910 - RNA, 19 nt, Homo sapiens
gguugauccugaguacuua

SEQ ID NO: 36911 - RNA, 19 nt, Homo sapiens
ccugugggauugacuuuga

SEQ ID NO: 36912 - RNA, 19 nt, Homo sapiens
ugucgaaaguuguuuguca

SEQ ID NO: 36913 - RNA, 19 nt, Homo sapiens
ggaauucacggagacugua

SEQ ID NO: 36914 - RNA, 19 nt, Homo sapiens
gaccagaucacagauguug

SEQ ID NO: 36915 - RNA, 19 nt, Homo sapiens
ggacagggagguucacuac

SEQ ID NO: 36916 - RNA, 19 nt, Homo sapiens
ccacuguaacacucuaaua

SEQ ID NO: 36917 - RNA, 19 nt, Homo sapiens
cagauguuguccuguauuc

SEQ ID NO: 36918 - RNA, 19 nt, Homo sapiens
ggacaaugccuaccccuuu

SEQ ID NO: 36919 - RNA, 19 nt, Homo sapiens
cgaaaguuguuugucaugu

SEQ ID NO: 36920 - RNA, 19 nt, Homo sapiens
cacuguaacacucuaauaa

SEQ ID NO: 36921 - RNA, 19 nt, Homo sapiens
agaaaaggcucaacaucaa

SEQ ID NO: 36922 - RNA, 19 nt, Homo sapiens
gcaaguggucccagcugaa

SEQ ID NO: 36923 - RNA, 19 nt, Homo sapiens
ggcucaacaucaacuauau

SEQ ID NO: 36924 - RNA, 19 nt, Homo sapiens
cuagacaaguacaccaaga

SEQ ID NO: 36925 - RNA, 19 nt, Homo sapiens
gauuucaguugaccagauc

SEQ ID NO: 36926 - RNA, 19 nt, Homo sapiens
aaccugcccuguucuguga

SEQ ID NO: 36927 - RNA, 19 nt, Homo sapiens
ggcacuggauggcaaacuu

SEQ ID NO: 36928 - RNA, 19 nt, Homo sapiens
auaccaaccuggccucuag

SEQ ID NO: 36929 - RNA, 19 nt, Homo sapiens
ucaacuauauagccaacau

SEQ ID NO: 36930 - RNA, 19 nt, Homo sapiens
gacaugugccuuucgcuau

SEQ ID NO: 36931 - RNA, 19 nt, Homo sapiens
uccaagguguuuaagaaga

SEQ ID NO: 36932 - RNA, 19 nt, Homo sapiens
gcaaacuuaagcaugaaga

SEQ ID NO: 36933 - RNA, 19 nt, Homo sapiens
gcaccaacaaggucaucaa

SEQ ID NO: 36934 - RNA, 19 nt, Homo sapiens
acccaucucugucaauguu

SEQ ID NO: 36935 - RNA, 19 nt, Homo sapiens
acagggagguucacuacca

SEQ ID NO: 36936 - RNA, 19 nt, Homo sapiens
gaagaguuucugugcugaa

SEQ ID NO: 36937 - RNA, 19 nt, Homo sapiens
ggacacgguggaacccauu

SEQ ID NO: 36938 - RNA, 19 nt, Homo sapiens
aagaagaccagcuccaaug

SEQ ID NO: 36939 - RNA, 19 nt, Homo sapiens
acaaguacaccaagacugu

SEQ ID NO: 36940 - RNA, 19 nt, Homo sapiens
ugacgguguuguccugguu

SEQ ID NO: 36941 - RNA, 19 nt, Homo sapiens
caacaacugcaccaacaag

SEQ ID NO: 36942 - RNA, 19 nt, Homo sapiens
uaagaagaccagcuccaau

SEQ ID NO: 36943 - RNA, 19 nt, Homo sapiens
ggaacccauugacgguguu

SEQ ID NO: 36944 - RNA, 19 nt, Homo sapiens
gauccugguguccuacaaa

SEQ ID NO: 36945 - RNA, 19 nt, Homo sapiens
ggacuucguggaccaugug

SEQ ID NO: 36946 - RNA, 19 nt, Homo sapiens
auggcaaacuuaagcauga

SEQ ID NO: 36947 - RNA, 19 nt, Homo sapiens
cuauggccgugaugacuug

SEQ ID NO: 36948 - RNA, 19 nt, Homo sapiens
cuuaaaaugucgaaaguug

SEQ ID NO: 36949 - RNA, 19 nt, Homo sapiens
ccaagguguuuaagaagac

SEQ ID NO: 36950 - RNA, 19 nt, Homo sapiens
ucaguuuguucagauguga

SEQ ID NO: 36951 - RNA, 19 nt, Homo sapiens
cgcuagcucugaggacaua

SEQ ID NO: 36952 - RNA, 19 nt, Homo sapiens
uagccaacauguccaaggu

SEQ ID NO: 36953 - RNA, 19 nt, Homo sapiens
acaugugccuuucgcuaug

SEQ ID NO: 36954 - RNA, 19 nt, Homo sapiens
guccugugguggcauccua

SEQ ID NO: 36955 - RNA, 19 nt, Homo sapiens
ggauccugguguccuacaa

SEQ ID NO: 36956 - RNA, 19 nt, Homo sapiens
caccaacaaggucaucaaa

SEQ ID NO: 36957 - RNA, 19 nt, Homo sapiens
gcggcugguuguccggaaa

SEQ ID NO: 36958 - RNA, 19 nt, Homo sapiens
caaguggucccagcugaau

SEQ ID NO: 36959 - RNA, 19 nt, Homo sapiens
gcuauggccgugaugacuu

SEQ ID NO: 36960 - RNA, 19 nt, Homo sapiens
cagaaaaggcucaacauca

SEQ ID NO: 36961 - RNA, 19 nt, Homo sapiens
ggucugacguuccgaaaag

SEQ ID NO: 36962 - RNA, 19 nt, Homo sapiens
aaccuggccucuagcacaa

SEQ ID NO: 36963 - RNA, 19 nt, Homo sapiens
ccagaucacagauguuguc

SEQ ID NO: 36964 - RNA, 19 nt, Homo sapiens
acauagucaucgaggaguu

SEQ ID NO: 36965 - RNA, 19 nt, Homo sapiens
cauccgaagccaucucaug

SEQ ID NO: 36966 - RNA, 19 nt, Homo sapiens
ccuggccucuagcacaauu

SEQ ID NO: 36967 - RNA, 19 nt, Homo sapiens
ccaucucugucaauguuuc

SEQ ID NO: 36968 - RNA, 19 nt, Homo sapiens
guccggaaaguacaauuug

SEQ ID NO: 36969 - RNA, 19 nt, Homo sapiens
aggcucaacaucaacuaua

SEQ ID NO: 36970 - RNA, 19 nt, Homo sapiens
gucgaaaguuguuugucau

SEQ ID NO: 36971 - RNA, 19 nt, Homo sapiens
aaaucaguuuguucagaug

SEQ ID NO: 36972 - RNA, 19 nt, Homo sapiens
gauaccaaccuggccucua

SEQ ID NO: 36973 - RNA, 19 nt, Homo sapiens
gaaagcccugugggauuga

SEQ ID NO: 36974 - RNA, 19 nt, Homo sapiens
gggacuucguggaccaugu

SEQ ID NO: 36975 - RNA, 19 nt, Homo sapiens
gcgaggaggagagccagaa

SEQ ID NO: 36976 - RNA, 19 nt, Homo sapiens
cgauguugguguggagcua

SEQ ID NO: 36977 - RNA, 19 nt, Homo sapiens
ccugacagccagcgauguu

SEQ ID NO: 36978 - RNA, 19 nt, Homo sapiens
uggcaaacuuaagcaugaa

SEQ ID NO: 36979 - RNA, 19 nt, Homo sapiens
caguugaccagaucacaga

SEQ ID NO: 36980 - RNA, 19 nt, Homo sapiens
ggauggacagggagguuca

SEQ ID NO: 36981 - RNA, 19 nt, Homo sapiens
gauccugaguacuuaaaau

SEQ ID NO: 36982 - RNA, 19 nt, Homo sapiens
aggaaagcccugugggauu

SEQ ID NO: 36983 - RNA, 19 nt, Homo sapiens
guguggagcuacccuuggu

SEQ ID NO: 36984 - RNA, 19 nt, Homo sapiens
gaauucacggagacuguag

SEQ ID NO: 36985 - RNA, 19 nt, Homo sapiens
agauuucaguugaccagau

SEQ ID NO: 36986 - RNA, 19 nt, Homo sapiens
caacuauauagccaacaug

SEQ ID NO: 36987 - RNA, 19 nt, Homo sapiens
uuaagaagaccagcuccaa

SEQ ID NO: 36988 - RNA, 19 nt, Homo sapiens
cauagucaucgaggaguuu

SEQ ID NO: 36989 - RNA, 19 nt, Homo sapiens
gcucugaggacauagucau

SEQ ID NO: 36990 - RNA, 19 nt, Homo sapiens
cuacaaagucagagucaac

SEQ ID NO: 36991 - RNA, 19 nt, Homo sapiens
caaacuuaagcaugaagau

SEQ ID NO: 36992 - RNA, 19 nt, Homo sapiens
gaacugcccuucacccuaa

SEQ ID NO: 36993 - RNA, 19 nt, Homo sapiens
ucauagaacuugacacaaa

SEQ ID NO: 36994 - RNA, 19 nt, Homo sapiens
ggacuuugcucgccagaga

SEQ ID NO: 36995 - RNA, 19 nt, Homo sapiens
ggaagaggcugaugacacu

SEQ ID NO: 36996 - RNA, 19 nt, Homo sapiens
ugaaaggcaugaaggauga

SEQ ID NO: 36997 - RNA, 19 nt, Homo sapiens
gaacuugacacaaaugaug

SEQ ID NO: 36998 - RNA, 19 nt, Homo sapiens
caacacagcucaguacaag

SEQ ID NO: 36999 - RNA, 19 nt, Homo sapiens
ggagaucuauuaccaugga

SEQ ID NO: 37000 - RNA, 19 nt, Homo sapiens
cuagaagccucucuggaua

SEQ ID NO: 37001 - RNA, 19 nt, Homo sapiens
ggacgcgaguguucaagaa

SEQ ID NO: 37002 - RNA, 19 nt, Homo sapiens
uggauaaggagaucuauua

SEQ ID NO: 37003 - RNA, 19 nt, Homo sapiens
gagcggagagucuauguga

SEQ ID NO: 37004 - RNA, 19 nt, Homo sapiens
gaacgagacgccaguagau

SEQ ID NO: 37005 - RNA, 19 nt, Homo sapiens
gcacccagcucgacguucu

SEQ ID NO: 37006 - RNA, 19 nt, Homo sapiens
ccaacaagacggugaagaa

SEQ ID NO: 37007 - RNA, 19 nt, Homo sapiens
ugagaucccuccaaaccuu

SEQ ID NO: 37008 - RNA, 19 nt, Homo sapiens
cauagaacuugacacaaau

SEQ ID NO: 37009 - RNA, 19 nt, Homo sapiens
gcacgaagacacgaacuug

SEQ ID NO: 37010 - RNA, 19 nt, Homo sapiens
acaagacggugaagaagau

SEQ ID NO: 37011 - RNA, 19 nt, Homo sapiens
caagaaggccaguccaaau

SEQ ID NO: 37012 - RNA, 19 nt, Homo sapiens
cuccaaaccuuccauguuc

SEQ ID NO: 37013 - RNA, 19 nt, Homo sapiens
gcaugaaggaugacaagga

SEQ ID NO: 37014 - RNA, 19 nt, Homo sapiens
auaaggagaucuauuacca

SEQ ID NO: 37015 - RNA, 19 nt, Homo sapiens
cgagcacgcuuacccuuuc

SEQ ID NO: 37016 - RNA, 19 nt, Homo sapiens
caggaacgccucaucaaga

SEQ ID NO: 37017 - RNA, 19 nt, Homo sapiens
ucaaagagcggagagucua

SEQ ID NO: 37018 - RNA, 19 nt, Homo sapiens
caaagggacgcgaguguuc

SEQ ID NO: 37019 - RNA, 19 nt, Homo sapiens
gacacgaacuuggccucua

SEQ ID NO: 37020 - RNA, 19 nt, Homo sapiens
auggaaagcucaccgucua

SEQ ID NO: 37021 - RNA, 19 nt, Homo sapiens
aggaacgccucaucaagaa

SEQ ID NO: 37022 - RNA, 19 nt, Homo sapiens
caguacaagugcccuguug

SEQ ID NO: 37023 - RNA, 19 nt, Homo sapiens
cggagaauuuggaggagaa

SEQ ID NO: 37024 - RNA, 19 nt, Homo sapiens
gaccugcgccuuccgcuau

SEQ ID NO: 37025 - RNA, 19 nt, Homo sapiens
ugaugacgacauuguauuu

SEQ ID NO: 37026 - RNA, 19 nt, Homo sapiens
gaaggugccaaccgugaga

SEQ ID NO: 37027 - RNA, 19 nt, Homo sapiens
ccugguggauccugaguau

SEQ ID NO: 37028 - RNA, 19 nt, Homo sapiens
ccuacaaagugaaagugaa

SEQ ID NO: 37029 - RNA, 19 nt, Homo sapiens
acacgaacuuggccucuag

SEQ ID NO: 37030 - RNA, 19 nt, Homo sapiens
ugcaaggucuacacacuga

SEQ ID NO: 37031 - RNA, 19 nt, Homo sapiens
gcaggaacgccucaucaag

SEQ ID NO: 37032 - RNA, 19 nt, Homo sapiens
cauuguauuugaggacuuu

SEQ ID NO: 37033 - RNA, 19 nt, Homo sapiens
gaucuauuaccauggagaa

SEQ ID NO: 37034 - RNA, 19 nt, Homo sapiens
ucaagaaggccaguccaaa

SEQ ID NO: 37035 - RNA, 19 nt, Homo sapiens
uagaagccucucuggauaa

SEQ ID NO: 37036 - RNA, 19 nt, Homo sapiens
ccuagaagccucucuggau

SEQ ID NO: 37037 - RNA, 19 nt, Homo sapiens
aagccucucuggauaagga

SEQ ID NO: 37038 - RNA, 19 nt, Homo sapiens
gagcacgcuuacccuuuca

SEQ ID NO: 37039 - RNA, 19 nt, Homo sapiens
gcgagcacgcuuacccuuu

SEQ ID NO: 37040 - RNA, 19 nt, Homo sapiens
acacagcucaguacaagug

SEQ ID NO: 37041 - RNA, 19 nt, Homo sapiens
gaucucagugcgccaguau

SEQ ID NO: 37042 - RNA, 19 nt, Homo sapiens
aaccuuccauguucuguga

SEQ ID NO: 37043 - RNA, 19 nt, Homo sapiens
auaccaaucucauagaacu

SEQ ID NO: 37044 - RNA, 19 nt, Homo sapiens
gaugacgacauuguauuug

SEQ ID NO: 37045 - RNA, 19 nt, Homo sapiens
caacaagacggugaagaag

SEQ ID NO: 37046 - RNA, 19 nt, Homo sapiens
ccaaucucauagaacuuga

SEQ ID NO: 37047 - RNA, 19 nt, Homo sapiens
gacaaagggacgcgagugu

SEQ ID NO: 37048 - RNA, 19 nt, Homo sapiens
augacgacauuguauuuga

SEQ ID NO: 37049 - RNA, 19 nt, Homo sapiens
caaagagcggagagucuau

SEQ ID NO: 37050 - RNA, 19 nt, Homo sapiens
aagaaggccaguccaaaug

SEQ ID NO: 37051 - RNA, 19 nt, Homo sapiens
gcgccaguaugcagacauc

SEQ ID NO: 37052 - RNA, 19 nt, Homo sapiens
ugacgacauuguauuugag

SEQ ID NO: 37053 - RNA, 19 nt, Homo sapiens
gagaacccaucagcgucaa

SEQ ID NO: 37054 - RNA, 19 nt, Homo sapiens
ccuccaaaccuuccauguu

SEQ ID NO: 37055 - RNA, 19 nt, Homo sapiens
ucucauagaacuugacaca

SEQ ID NO: 37056 - RNA, 19 nt, Homo sapiens
ggauaaggagaucuauuac

SEQ ID NO: 37057 - RNA, 19 nt, Homo sapiens
ccaggcaguuccucauguc

SEQ ID NO: 37058 - RNA, 19 nt, Homo sapiens
cgcuuacccuuucaccuuu

SEQ ID NO: 37059 - RNA, 19 nt, Homo sapiens
ccacagcucaacaacagau

SEQ ID NO: 37060 - RNA, 19 nt, Homo sapiens
gaaggaugacaaggaggaa

SEQ ID NO: 37061 - RNA, 19 nt, Homo sapiens
gaagauccacaagcggaau

SEQ ID NO: 37062 - RNA, 19 nt, Homo sapiens
cuccacagcucaacaacag

SEQ ID NO: 37063 - RNA, 19 nt, Homo sapiens
ccauggaagaggcugauga

SEQ ID NO: 37064 - RNA, 19 nt, Homo sapiens
gaauuuggaggagaagauc

SEQ ID NO: 37065 - RNA, 19 nt, Homo sapiens
agaacgagacgccaguaga

SEQ ID NO: 37066 - RNA, 19 nt, Homo sapiens
ucaccaacaacaccaacaa

SEQ ID NO: 37067 - RNA, 19 nt, Homo sapiens
gcuuacccuuucaccuuug

SEQ ID NO: 37068 - RNA, 19 nt, Homo sapiens
gcucuccacagcucaacaa

SEQ ID NO: 37069 - RNA, 19 nt, Homo sapiens
gcucgacguucugcaaggu

SEQ ID NO: 37070 - RNA, 19 nt, Homo sapiens
ucaacacagcucaguacaa

SEQ ID NO: 37071 - RNA, 19 nt, Homo sapiens
cagcucaacaacagauaga

SEQ ID NO: 37072 - RNA, 19 nt, Homo sapiens
acacaaaugaugacgacau

SEQ ID NO: 37073 - RNA, 19 nt, Homo sapiens
gagaacgagacgccaguag

SEQ ID NO: 37074 - RNA, 19 nt, Homo sapiens
cuacaaagugaaagugaag

SEQ ID NO: 37075 - RNA, 19 nt, Homo sapiens
acgcuuacccuuucaccuu

SEQ ID NO: 37076 - RNA, 19 nt, Homo sapiens
uagaacuugacacaaauga

SEQ ID NO: 37077 - RNA, 19 nt, Homo sapiens
gggacgcgaguguucaaga

SEQ ID NO: 37078 - RNA, 19 nt, Homo sapiens
ccaacaacaccaacaagac

SEQ ID NO: 37079 - RNA, 19 nt, Homo sapiens
cuugcgguguggacuauga

SEQ ID NO: 37080 - RNA, 19 nt, Homo sapiens
gaacugcccuucacccuaa

SEQ ID NO: 37081 - RNA, 19 nt, Homo sapiens
ucauagaacuugacacaaa

SEQ ID NO: 37082 - RNA, 19 nt, Homo sapiens
ggacuuugcucgccagaga

SEQ ID NO: 37083 - RNA, 19 nt, Homo sapiens
ggaagaggcugaugacacu

SEQ ID NO: 37084 - RNA, 19 nt, Homo sapiens
ugaaaggcaugaaggauga

SEQ ID NO: 37085 - RNA, 19 nt, Homo sapiens
gaacuugacacaaaugaug

SEQ ID NO: 37086 - RNA, 19 nt, Homo sapiens
caacacagcucaguacaag

SEQ ID NO: 37087 - RNA, 19 nt, Homo sapiens
ggagaucuauuaccaugga

SEQ ID NO: 37088 - RNA, 19 nt, Homo sapiens
cuagaagccucucuggaua

SEQ ID NO: 37089 - RNA, 19 nt, Homo sapiens
ggacgcgaguguucaagaa

SEQ ID NO: 37090 - RNA, 19 nt, Homo sapiens
uggauaaggagaucuauua

SEQ ID NO: 37091 - RNA, 19 nt, Homo sapiens
gagcggagagucuauguga

SEQ ID NO: 37092 - RNA, 19 nt, Homo sapiens
gaacgagacgccaguagau

SEQ ID NO: 37093 - RNA, 19 nt, Homo sapiens
gcacccagcucgacguucu

SEQ ID NO: 37094 - RNA, 19 nt, Homo sapiens
ccaacaagacggugaagaa

SEQ ID NO: 37095 - RNA, 19 nt, Homo sapiens
ugagaucccuccaaaccuu

SEQ ID NO: 37096 - RNA, 19 nt, Homo sapiens
cauagaacuugacacaaau

SEQ ID NO: 37097 - RNA, 19 nt, Homo sapiens
gcacgaagacacgaacuug

SEQ ID NO: 37098 - RNA, 19 nt, Homo sapiens
acaagacggugaagaagau

SEQ ID NO: 37099 - RNA, 19 nt, Homo sapiens
caagaaggccaguccaaau

SEQ ID NO: 37100 - RNA, 19 nt, Homo sapiens
cuccaaaccuuccauguuc

SEQ ID NO: 37101 - RNA, 19 nt, Homo sapiens
gcaugaaggaugacaagga

SEQ ID NO: 37102 - RNA, 19 nt, Homo sapiens
auaaggagaucuauuacca

SEQ ID NO: 37103 - RNA, 19 nt, Homo sapiens
cgagcacgcuuacccuuuc

SEQ ID NO: 37104 - RNA, 19 nt, Homo sapiens
caggaacgccucaucaaga

SEQ ID NO: 37105 - RNA, 19 nt, Homo sapiens
ucaaagagcggagagucua

SEQ ID NO: 37106 - RNA, 19 nt, Homo sapiens
caaagggacgcgaguguuc

SEQ ID NO: 37107 - RNA, 19 nt, Homo sapiens
gacacgaacuuggccucua

SEQ ID NO: 37108 - RNA, 19 nt, Homo sapiens
auggaaagcucaccgucua

SEQ ID NO: 37109 - RNA, 19 nt, Homo sapiens
aggaacgccucaucaagaa

SEQ ID NO: 37110 - RNA, 19 nt, Homo sapiens
caguacaagugcccuguug

SEQ ID NO: 37111 - RNA, 19 nt, Homo sapiens
cggagaauuuggaggagaa

SEQ ID NO: 37112 - RNA, 19 nt, Homo sapiens
gaccugcgccuuccgcuau

SEQ ID NO: 37113 - RNA, 19 nt, Homo sapiens
ugaugacgacauuguauuu

SEQ ID NO: 37114 - RNA, 19 nt, Homo sapiens
gaaggugccaaccgugaga

SEQ ID NO: 37115 - RNA, 19 nt, Homo sapiens
ccugguggauccugaguau

SEQ ID NO: 37116 - RNA, 19 nt, Homo sapiens
ccuacaaagugaaagugaa

SEQ ID NO: 37117 - RNA, 19 nt, Homo sapiens
acacgaacuuggccucuag

SEQ ID NO: 37118 - RNA, 19 nt, Homo sapiens
ugcaaggucuacacacuga

SEQ ID NO: 37119 - RNA, 19 nt, Homo sapiens
gcaggaacgccucaucaag

SEQ ID NO: 37120 - RNA, 19 nt, Homo sapiens
cauuguauuugaggacuuu

SEQ ID NO: 37121 - RNA, 19 nt, Homo sapiens
gaucuauuaccauggagaa

SEQ ID NO: 37122 - RNA, 19 nt, Homo sapiens
ucaagaaggccaguccaaa

SEQ ID NO: 37123 - RNA, 19 nt, Homo sapiens
uagaagccucucuggauaa

SEQ ID NO: 37124 - RNA, 19 nt, Homo sapiens
ccuagaagccucucuggau

SEQ ID NO: 37125 - RNA, 19 nt, Homo sapiens
aagccucucuggauaagga

SEQ ID NO: 37126 - RNA, 19 nt, Homo sapiens
gagcacgcuuacccuuuca

SEQ ID NO: 37127 - RNA, 19 nt, Homo sapiens
gcgagcacgcuuacccuuu

SEQ ID NO: 37128 - RNA, 19 nt, Homo sapiens
acacagcucaguacaagug

SEQ ID NO: 37129 - RNA, 19 nt, Homo sapiens
gaucucagugcgccaguau

SEQ ID NO: 37130 - RNA, 19 nt, Homo sapiens
aaccuuccauguucuguga

SEQ ID NO: 37131 - RNA, 19 nt, Homo sapiens
auaccaaucucauagaacu

SEQ ID NO: 37132 - RNA, 19 nt, Homo sapiens
gaugacgacauuguauuug

SEQ ID NO: 37133 - RNA, 19 nt, Homo sapiens
caacaagacggugaagaag

SEQ ID NO: 37134 - RNA, 19 nt, Homo sapiens
ccaaucucauagaacuuga

SEQ ID NO: 37135 - RNA, 19 nt, Homo sapiens
gacaaagggacgcgagugu

SEQ ID NO: 37136 - RNA, 19 nt, Homo sapiens
augacgacauuguauuuga

SEQ ID NO: 37137 - RNA, 19 nt, Homo sapiens
caaagagcggagagucuau

SEQ ID NO: 37138 - RNA, 19 nt, Homo sapiens
aagaaggccaguccaaaug

SEQ ID NO: 37139 - RNA, 19 nt, Homo sapiens
gcgccaguaugcagacauc

SEQ ID NO: 37140 - RNA, 19 nt, Homo sapiens
ugacgacauuguauuugag

SEQ ID NO: 37141 - RNA, 19 nt, Homo sapiens
gagaacccaucagcgucaa

SEQ ID NO: 37142 - RNA, 19 nt, Homo sapiens
ccuccaaaccuuccauguu

SEQ ID NO: 37143 - RNA, 19 nt, Homo sapiens
ucucauagaacuugacaca

SEQ ID NO: 37144 - RNA, 19 nt, Homo sapiens
ggauaaggagaucuauuac

SEQ ID NO: 37145 - RNA, 19 nt, Homo sapiens
ccaggcaguuccucauguc

SEQ ID NO: 37146 - RNA, 19 nt, Homo sapiens
cgcuuacccuuucaccuuu

SEQ ID NO: 37147 - RNA, 19 nt, Homo sapiens
ccacagcucaacaacagau

SEQ ID NO: 37148 - RNA, 19 nt, Homo sapiens
gaaggaugacaaggaggaa

SEQ ID NO: 37149 - RNA, 19 nt, Homo sapiens
gaagauccacaagcggaau

SEQ ID NO: 37150 - RNA, 19 nt, Homo sapiens
cuccacagcucaacaacag

SEQ ID NO: 37151 - RNA, 19 nt, Homo sapiens
ccauggaagaggcugauga

SEQ ID NO: 37152 - RNA, 19 nt, Homo sapiens
gaauuuggaggagaagauc

SEQ ID NO: 37153 - RNA, 19 nt, Homo sapiens
agaacgagacgccaguaga

SEQ ID NO: 37154 - RNA, 19 nt, Homo sapiens
ucaccaacaacaccaacaa

SEQ ID NO: 37155 - RNA, 19 nt, Homo sapiens
gcuuacccuuucaccuuug

SEQ ID NO: 37156 - RNA, 19 nt, Homo sapiens
gcucuccacagcucaacaa

SEQ ID NO: 37157 - RNA, 19 nt, Homo sapiens
gcucgacguucugcaaggu

SEQ ID NO: 37158 - RNA, 19 nt, Homo sapiens
ucaacacagcucaguacaa

SEQ ID NO: 37159 - RNA, 19 nt, Homo sapiens
cagcucaacaacagauaga

SEQ ID NO: 37160 - RNA, 19 nt, Homo sapiens
acacaaaugaugacgacau

SEQ ID NO: 37161 - RNA, 19 nt, Homo sapiens
gagaacgagacgccaguag

SEQ ID NO: 37162 - RNA, 19 nt, Homo sapiens
cuacaaagugaaagugaag

SEQ ID NO: 37163 - RNA, 19 nt, Homo sapiens
acgcuuacccuuucaccuu

SEQ ID NO: 37164 - RNA, 19 nt, Homo sapiens
uagaacuugacacaaauga

SEQ ID NO: 37165 - RNA, 19 nt, Homo sapiens
gggacgcgaguguucaaga

SEQ ID NO: 37166 - RNA, 19 nt, Homo sapiens
ccaacaacaccaacaagac

SEQ ID NO: 37167 - RNA, 19 nt, Homo sapiens
cuugcgguguggacuauga

SEQ ID NO: 37168 - RNA, 19 nt, Homo sapiens
ggacaaggccguuucuuug

SEQ ID NO: 37169 - RNA, 19 nt, Homo sapiens
gaugaaggaugacgacuau

SEQ ID NO: 37170 - RNA, 19 nt, Homo sapiens
cgaacaagaugaccaggua

SEQ ID NO: 37171 - RNA, 19 nt, Homo sapiens
acaccaaccucauugaauu

SEQ ID NO: 37172 - RNA, 19 nt, Homo sapiens
gaaggagggugccaacaag

SEQ ID NO: 37173 - RNA, 19 nt, Homo sapiens
cuaaaucacuagaagagaa

SEQ ID NO: 37174 - RNA, 19 nt, Homo sapiens
ggacaaaguggacccugua

SEQ ID NO: 37175 - RNA, 19 nt, Homo sapiens
caaggccguuucuuuguuu

SEQ ID NO: 37176 - RNA, 19 nt, Homo sapiens
acaaggagcuguacuacca

SEQ ID NO: 37177 - RNA, 19 nt, Homo sapiens
guggcaagcuguguucaua

SEQ ID NO: 37178 - RNA, 19 nt, Homo sapiens
gaaggaccgcaaaguguuu

SEQ ID NO: 37179 - RNA, 19 nt, Homo sapiens
gggacaaggccguuucuuu

SEQ ID NO: 37180 - RNA, 19 nt, Homo sapiens
caagcuguguucauaccua

SEQ ID NO: 37181 - RNA, 19 nt, Homo sapiens
ccaagaccgucaagaagau

SEQ ID NO: 37182 - RNA, 19 nt, Homo sapiens
ggacaccaaccucauugaa

SEQ ID NO: 37183 - RNA, 19 nt, Homo sapiens
ccaccaagaccgucaagaa

SEQ ID NO: 37184 - RNA, 19 nt, Homo sapiens
caaaguggacccuguagau

SEQ ID NO: 37185 - RNA, 19 nt, Homo sapiens
gacccucucuugcugaaug

SEQ ID NO: 37186 - RNA, 19 nt, Homo sapiens
ggugagggcaggauuaaga

SEQ ID NO: 37187 - RNA, 19 nt, Homo sapiens
acaaggaggugcugggaau

SEQ ID NO: 37188 - RNA, 19 nt, Homo sapiens
uagaucaccuggacaaagu

SEQ ID NO: 37189 - RNA, 19 nt, Homo sapiens
acaccaacaccucccauua

SEQ ID NO: 37190 - RNA, 19 nt, Homo sapiens
ugaaggaugacgacuauga

SEQ ID NO: 37191 - RNA, 19 nt, Homo sapiens
ggaugaaggaugacgacua

SEQ ID NO: 37192 - RNA, 19 nt, Homo sapiens
ugccacagaugaugacauu

SEQ ID NO: 37193 - RNA, 19 nt, Homo sapiens
ccacagaugaugacauugu

SEQ ID NO: 37194 - RNA, 19 nt, Homo sapiens
ccaacuaugccacagauga

SEQ ID NO: 37195 - RNA, 19 nt, Homo sapiens
gagaaaagccacaaaagga

SEQ ID NO: 37196 - RNA, 19 nt, Homo sapiens
gaagagaaaagccacaaaa

SEQ ID NO: 37197 - RNA, 19 nt, Homo sapiens
cggcguagacuuugagauu

SEQ ID NO: 37198 - RNA, 19 nt, Homo sapiens
caaccucauugaauuugau

SEQ ID NO: 37199 - RNA, 19 nt, Homo sapiens
uggcucaacucgaacaaga

SEQ ID NO: 37200 - RNA, 19 nt, Homo sapiens
gaggugagggcaggauuaa

SEQ ID NO: 37201 - RNA, 19 nt, Homo sapiens
gaaggaugacgacuaugau

SEQ ID NO: 37202 - RNA, 19 nt, Homo sapiens
gaacaagaugaccagguau

SEQ ID NO: 37203 - RNA, 19 nt, Homo sapiens
augaugacauuguguuuga

SEQ ID NO: 37204 - RNA, 19 nt, Homo sapiens
gccgacaucugccucuuca

SEQ ID NO: 37205 - RNA, 19 nt, Homo sapiens
gcccagaggauacaggaaa

SEQ ID NO: 37206 - RNA, 19 nt, Homo sapiens
gggcuuguccuuccgcaaa

SEQ ID NO: 37207 - RNA, 19 nt, Homo sapiens
gggaggagcagggaucuug

SEQ ID NO: 37208 - RNA, 19 nt, Homo sapiens
caccaacaccucccauuau

SEQ ID NO: 37209 - RNA, 19 nt, Homo sapiens
ugaaggagggugccaacaa

SEQ ID NO: 37210 - RNA, 19 nt, Homo sapiens
acacgccacuuccucaugu

SEQ ID NO: 37211 - RNA, 19 nt, Homo sapiens
acugcaagcucaccgugua

SEQ ID NO: 37212 - RNA, 19 nt, Homo sapiens
caaccaaucccuucacacu

SEQ ID NO: 37213 - RNA, 19 nt, Homo sapiens
ccaaccucauugaauuuga

SEQ ID NO: 37214 - RNA, 19 nt, Homo sapiens
gccacuuccucaugucuga

SEQ ID NO: 37215 - RNA, 19 nt, Homo sapiens
ggccugcggcguagacuuu

SEQ ID NO: 37216 - RNA, 19 nt, Homo sapiens
ugaaggggaugaaggauga

SEQ ID NO: 37217 - RNA, 19 nt, Homo sapiens
gaugaugacauuguguuug

SEQ ID NO: 37218 - RNA, 19 nt, Homo sapiens
gggcaagcgggacuucgua

SEQ ID NO: 37219 - RNA, 19 nt, Homo sapiens
ugaaggaccgcaaaguguu

SEQ ID NO: 37220 - RNA, 19 nt, Homo sapiens
aagcuguguucauaccuaa

SEQ ID NO: 37221 - RNA, 19 nt, Homo sapiens
ggaugacgacuaugaugau

SEQ ID NO: 37222 - RNA, 19 nt, Homo sapiens
caacuaugccacagaugau

SEQ ID NO: 37223 - RNA, 19 nt, Homo sapiens
gagcugccuuuuguucuua

SEQ ID NO: 37224 - RNA, 19 nt, Homo sapiens
gcucaacucgaacaagaug

SEQ ID NO: 37225 - RNA, 19 nt, Homo sapiens
gcaccgcccaguacaagug

SEQ ID NO: 37226 - RNA, 19 nt, Homo sapiens
accaacaacuccaccaaga

SEQ ID NO: 37227 - RNA, 19 nt, Homo sapiens
cuucugugcuaaaucacua

SEQ ID NO: 37228 - RNA, 19 nt, Homo sapiens
gaugacgacuaugaugauc

SEQ ID NO: 37229 - RNA, 19 nt, Homo sapiens
ucaagaagucgagcccuaa

SEQ ID NO: 37230 - RNA, 19 nt, Homo sapiens
ggacaaggagcuguacuac

SEQ ID NO: 37231 - RNA, 19 nt, Homo sapiens
ccagcaccaucgugaagga

SEQ ID NO: 37232 - RNA, 19 nt, Homo sapiens
gacaccaaccucauugaau

SEQ ID NO: 37233 - RNA, 19 nt, Homo sapiens
ggcguagacuuugagauuc

SEQ ID NO: 37234 - RNA, 19 nt, Homo sapiens
caccaaccucauugaauuu

SEQ ID NO: 37235 - RNA, 19 nt, Homo sapiens
ugggaauccugguguccua

SEQ ID NO: 37236 - RNA, 19 nt, Homo sapiens
aggcuucccuggacaagga

SEQ ID NO: 37237 - RNA, 19 nt, Homo sapiens
cgaaaccacacgccacuuc

SEQ ID NO: 37238 - RNA, 19 nt, Homo sapiens
uaccaacuaugccacagau

SEQ ID NO: 37239 - RNA, 19 nt, Homo sapiens
gcaagcgggacuucguaga

SEQ ID NO: 37240 - RNA, 19 nt, Homo sapiens
caagcgggacuucguagau

SEQ ID NO: 37241 - RNA, 19 nt, Homo sapiens
agaggugagggcaggauua

SEQ ID NO: 37242 - RNA, 19 nt, Homo sapiens
auucgagccuucugugcua

SEQ ID NO: 37243 - RNA, 19 nt, Homo sapiens
guagaucaccuggacaaag

SEQ ID NO: 37244 - RNA, 19 nt, Homo sapiens
ccuacagggucaaggugaa

SEQ ID NO: 37245 - RNA, 19 nt, Homo sapiens
cagaugaugacauuguguu

SEQ ID NO: 37246 - RNA, 19 nt, Homo sapiens
accaacaccucccauuauc

SEQ ID NO: 37247 - RNA, 19 nt, Homo sapiens
uagauggcguggugcuugu

SEQ ID NO: 37248 - RNA, 19 nt, Homo sapiens
gaauuugauaccaacuaug

SEQ ID NO: 37249 - RNA, 19 nt, Homo sapiens
ggagcugccuuuuguucuu

SEQ ID NO: 37250 - RNA, 19 nt, Homo sapiens
gcaagcucaccguguacuu

SEQ ID NO: 37251 - RNA, 19 nt, Homo sapiens
gccguuucuuuguuucuga

SEQ ID NO: 37252 - RNA, 19 nt, Homo sapiens
gagaggugagggcaggauu

SEQ ID NO: 37253 - RNA, 19 nt, Homo sapiens
caccugcgccuuccgcuau

SEQ ID NO: 37254 - RNA, 19 nt, Homo sapiens
ucucccagcuccacauucu

SEQ ID NO: 37255 - RNA, 19 nt, Homo sapiens
caaguguccuguggcucaa

SEQ ID NO: 37256 - RNA, 19 nt, Homo sapiens
uaaauguccacgucaccaa

SEQ ID NO: 37257 - RNA, 19 nt, Homo sapiens
gcguagacuuugagauucg

SEQ ID NO: 37258 - RNA, 19 nt, Homo sapiens
cagccaggcccagaggaua

SEQ ID NO: 37259 - RNA, 19 nt, Homo sapiens
gcuguguucauaccuaaau

SEQ ID NO: 37260 - RNA, 19 nt, Homo sapiens
cauuguguuugaggacuuu

SEQ ID NO: 37261 - RNA, 19 nt, Homo sapiens
caacaccucccauuaucac

SEQ ID NO: 37262 - RNA, 19 nt, Homo sapiens
ccaacaccucccauuauca

SEQ ID NO: 37263 - RNA, 19 nt, Homo sapiens
ccacauucuguaaggugua

SEQ ID NO: 37264 - RNA, 19 nt, Homo sapiens
ccagcuccacauucuguaa

SEQ ID NO: 37265 - RNA, 19 nt, Homo sapiens
caccaagaccgucaagaag

SEQ ID NO: 37266 - RNA, 19 nt, Homo sapiens
gcuaaaucacuagaagaga

SEQ ID NO: 37267 - RNA, 19 nt, Homo sapiens
agccuucugugcuaaauca

SEQ ID NO: 37268 - RNA, 19 nt, Homo sapiens
guacaaggcucacuucuuc

SEQ ID NO: 37269 - RNA, 19 nt, Homo sapiens
uaacaccaguggagacuug

SEQ ID NO: 37270 - RNA, 19 nt, Homo sapiens
caucagggcuuccaucgau

SEQ ID NO: 37271 - RNA, 19 nt, Homo sapiens
ggcagucucucuucuucua

SEQ ID NO: 37272 - RNA, 19 nt, Homo sapiens
caucuucacugcagacaau

SEQ ID NO: 37273 - RNA, 19 nt, Homo sapiens
gggcuuccaucgauuucua

SEQ ID NO: 37274 - RNA, 19 nt, Homo sapiens
ucuaugaccuguccaagga

SEQ ID NO: 37275 - RNA, 19 nt, Homo sapiens
gaaagggaacgaccuacga

SEQ ID NO: 37276 - RNA, 19 nt, Homo sapiens
gccagaaccugaccugcuu

SEQ ID NO: 37277 - RNA, 19 nt, Homo sapiens
guuugugccugauaacgua

SEQ ID NO: 37278 - RNA, 19 nt, Homo sapiens
caacaucgugcugaucuuu

SEQ ID NO: 37279 - RNA, 19 nt, Homo sapiens
gaccugagaccaugcguau

SEQ ID NO: 37280 - RNA, 19 nt, Homo sapiens
caaggacccuggugagaac

SEQ ID NO: 37281 - RNA, 19 nt, Homo sapiens
gagacuugcacaucugaaa

SEQ ID NO: 37282 - RNA, 19 nt, Homo sapiens
gaagagacgcuggucaucu

SEQ ID NO: 37283 - RNA, 19 nt, Homo sapiens
caagagcccucggcagucu

SEQ ID NO: 37284 - RNA, 19 nt, Homo sapiens
ccacuacccucaguucagu

SEQ ID NO: 37285 - RNA, 19 nt, Homo sapiens
ccaaggacccuggugagaa

SEQ ID NO: 37286 - RNA, 19 nt, Homo sapiens
ggucugcgguaucggaaag

SEQ ID NO: 37287 - RNA, 19 nt, Homo sapiens
gggcugcgguucacagacu

SEQ ID NO: 37288 - RNA, 19 nt, Homo sapiens
gcagacaauggaccugaga

SEQ ID NO: 37289 - RNA, 19 nt, Homo sapiens
ccugagaccaugcguaugu

SEQ ID NO: 37290 - RNA, 19 nt, Homo sapiens
caaguagcccucccucucu

SEQ ID NO: 37291 - RNA, 19 nt, Homo sapiens
guggagacuugcacaucug

SEQ ID NO: 37292 - RNA, 19 nt, Homo sapiens
gcugcucaaggcccaguua

SEQ ID NO: 37293 - RNA, 19 nt, Homo sapiens
gcucucugacugcucauga

SEQ ID NO: 37294 - RNA, 19 nt, Homo sapiens
ucagggcuuccaucgauuu

SEQ ID NO: 37295 - RNA, 19 nt, Homo sapiens
ccaacaucgugcugaucuu

SEQ ID NO: 37296 - RNA, 19 nt, Homo sapiens
gcucaaggcccaguuagac

SEQ ID NO: 37297 - RNA, 19 nt, Homo sapiens
guggaaagggaacgaccua

SEQ ID NO: 37298 - RNA, 19 nt, Homo sapiens
ucggcagucucucuucuuc

SEQ ID NO: 37299 - RNA, 19 nt, Homo sapiens
gagccugccuuggccuucu

SEQ ID NO: 37300 - RNA, 19 nt, Homo sapiens
gaauugagcugcugcauaa

SEQ ID NO: 37301 - RNA, 19 nt, Homo sapiens
gaacuuaacuugaaauagg

SEQ ID NO: 37302 - RNA, 19 nt, Homo sapiens
gaagaugcuuuguaaauug

SEQ ID NO: 37303 - RNA, 19 nt, Homo sapiens
caugaacgcuguacauuaa

SEQ ID NO: 37304 - RNA, 19 nt, Homo sapiens
aaaccacggugcaaauuua

SEQ ID NO: 37305 - RNA, 19 nt, Homo sapiens
ucacuuaucucaucacaga

SEQ ID NO: 37306 - RNA, 19 nt, Homo sapiens
caacaaacauauucaccaa

SEQ ID NO: 37307 - RNA, 19 nt, Homo sapiens
agaaaugacuugcuagcua

SEQ ID NO: 37308 - RNA, 19 nt, Homo sapiens
gcugggaacuuaacuugaa

SEQ ID NO: 37309 - RNA, 19 nt, Homo sapiens
acucuugucucauuuguua

SEQ ID NO: 37310 - RNA, 19 nt, Homo sapiens
ucacgacucuugucucauu

SEQ ID NO: 37311 - RNA, 19 nt, Homo sapiens
aaaugucacugcagcuuua

SEQ ID NO: 37312 - RNA, 19 nt, Homo sapiens
cuauagcccucauaacuaa

SEQ ID NO: 37313 - RNA, 19 nt, Homo sapiens
gcccuuggauguaggauuu

SEQ ID NO: 37314 - RNA, 19 nt, Homo sapiens
ggaauggugucccuuaugg

SEQ ID NO: 37315 - RNA, 19 nt, Homo sapiens
gaaaccacggugcaaauuu

SEQ ID NO: 37316 - RNA, 19 nt, Homo sapiens
gcagugggcucuggaacaa

SEQ ID NO: 37317 - RNA, 19 nt, Homo sapiens
ccagauccguacagguuua

SEQ ID NO: 37318 - RNA, 19 nt, Homo sapiens
caaaaugccugcaccauga

SEQ ID NO: 37319 - RNA, 19 nt, Homo sapiens
gagcagacagugauuaaug

SEQ ID NO: 37320 - RNA, 19 nt, Homo sapiens
gcccuucucuugcucuuaa

SEQ ID NO: 37321 - RNA, 19 nt, Homo sapiens
gcaggaauggugucccuua

SEQ ID NO: 37322 - RNA, 19 nt, Homo sapiens
gaagccauaugacuuuauc

SEQ ID NO: 37323 - RNA, 19 nt, Homo sapiens
ugggacagcugggaacuua

SEQ ID NO: 37324 - RNA, 19 nt, Homo sapiens
cagcauggcuccagcaaag

SEQ ID NO: 37325 - RNA, 19 nt, Homo sapiens
gaaaugucacugcagcuuu

SEQ ID NO: 37326 - RNA, 19 nt, Homo sapiens
gcuauagcccucauaacua

SEQ ID NO: 37327 - RNA, 19 nt, Homo sapiens
gaauguaccggaaagaaug

SEQ ID NO: 37328 - RNA, 19 nt, Homo sapiens
aauaggaaguucucacuga

SEQ ID NO: 37329 - RNA, 19 nt, Homo sapiens
cauaugacuuuauccaaga

SEQ ID NO: 37330 - RNA, 19 nt, Homo sapiens
gcuguuggcuggagcaugu

SEQ ID NO: 37331 - RNA, 19 nt, Homo sapiens
ccaugaacgcuguacauua

SEQ ID NO: 37332 - RNA, 19 nt, Homo sapiens
gugaagcguuauuaaagaa

SEQ ID NO: 37333 - RNA, 19 nt, Homo sapiens
gacuguggcuuuuaaaaua

SEQ ID NO: 37334 - RNA, 19 nt, Homo sapiens
ucacuuggcccuucucuug

SEQ ID NO: 37335 - RNA, 19 nt, Homo sapiens
ggaugaagcaguaggaaau

SEQ ID NO: 37336 - RNA, 19 nt, Homo sapiens
uguaaauugugaagcguua

SEQ ID NO: 37337 - RNA, 19 nt, Homo sapiens
gaagggagcagacagugau

SEQ ID NO: 37338 - RNA, 19 nt, Homo sapiens
uaacacaucuguccaugcu

SEQ ID NO: 37339 - RNA, 19 nt, Homo sapiens
gaagauaacgggccuuggu

SEQ ID NO: 37340 - RNA, 19 nt, Homo sapiens
cagagaauauccucacauc

SEQ ID NO: 37341 - RNA, 19 nt, Homo sapiens
gugaagaugcuuuguaaau

SEQ ID NO: 37342 - RNA, 19 nt, Homo sapiens
ccuuauggaugaagcagua

SEQ ID NO: 37343 - RNA, 19 nt, Homo sapiens
aggaauacuugaagccaua

SEQ ID NO: 37344 - RNA, 19 nt, Homo sapiens
gaaguugcaacaggauaua

SEQ ID NO: 37345 - RNA, 19 nt, Homo sapiens
ggaaaccacggugcaaauu

SEQ ID NO: 37346 - RNA, 19 nt, Homo sapiens
gccuacaguucuaccauaa

SEQ ID NO: 37347 - RNA, 19 nt, Homo sapiens
gagaauauccucacaucgu

SEQ ID NO: 37348 - RNA, 19 nt, Homo sapiens
ugaacgcuguacauuaauu

SEQ ID NO: 37349 - RNA, 19 nt, Homo sapiens
ggaauguaccggaaagaau

SEQ ID NO: 37350 - RNA, 19 nt, Homo sapiens
gaagcguuauuaaagaaca

SEQ ID NO: 37351 - RNA, 19 nt, Homo sapiens
gcauuuaagaagcugauaa

SEQ ID NO: 37352 - RNA, 19 nt, Homo sapiens
cugugaagaugcuuuguaa

SEQ ID NO: 37353 - RNA, 19 nt, Homo sapiens
cagaauauucagccuuuaa

SEQ ID NO: 37354 - RNA, 19 nt, Homo sapiens
gagcugcugcauaauauug

SEQ ID NO: 37355 - RNA, 19 nt, Homo sapiens
gaacgcuguacauuaauug

SEQ ID NO: 37356 - RNA, 19 nt, Homo sapiens
gaaauaggaaguucucacu

SEQ ID NO: 37357 - RNA, 19 nt, Homo sapiens
ugugaagcguuauuaaaga

SEQ ID NO: 37358 - RNA, 19 nt, Homo sapiens
aaggaugacucuucucuuc

SEQ ID NO: 37359 - RNA, 19 nt, Homo sapiens
gggagcagacagugauuaa

SEQ ID NO: 37360 - RNA, 19 nt, Homo sapiens
caagucagacguucgauuc

SEQ ID NO: 37361 - RNA, 19 nt, Homo sapiens
cagcugaguuuccaagaag

SEQ ID NO: 37362 - RNA, 19 nt, Homo sapiens
cagcaaaggaugacucuuc

SEQ ID NO: 37363 - RNA, 19 nt, Homo sapiens
ccagaauauucagccuuua

SEQ ID NO: 37364 - RNA, 19 nt, Homo sapiens
uccagaauauucagccuuu

SEQ ID NO: 37365 - RNA, 19 nt, Homo sapiens
gaacuucguggacucuuca

SEQ ID NO: 37366 - RNA, 19 nt, Homo sapiens
gcugggcucuugugcuaga

SEQ ID NO: 37367 - RNA, 19 nt, Homo sapiens
gauaucuccuggguaguga

SEQ ID NO: 37368 - RNA, 19 nt, Homo sapiens
gcaccaugacuguggcuuu

SEQ ID NO: 37369 - RNA, 19 nt, Homo sapiens
gggaacuuaacuugaaaua

SEQ ID NO: 37370 - RNA, 19 nt, Homo sapiens
gaucgggacccugaagaaa

SEQ ID NO: 37371 - RNA, 19 nt, Homo sapiens
caagaacaggcaucacuau

SEQ ID NO: 37372 - RNA, 19 nt, Homo sapiens
aggcugggcucuugugcua

SEQ ID NO: 37373 - RNA, 19 nt, Homo sapiens
aaagaagcagguuauacua

SEQ ID NO: 37374 - RNA, 19 nt, Homo sapiens
ggaugacucuucucuucca

SEQ ID NO: 37375 - RNA, 19 nt, Homo sapiens
cagaguuguugcaggcuuu

SEQ ID NO: 37376 - RNA, 19 nt, Homo sapiens
ggaaaugucacugcagcuu

SEQ ID NO: 37377 - RNA, 19 nt, Homo sapiens
ucagcugaguuuccaagaa

SEQ ID NO: 37378 - RNA, 19 nt, Homo sapiens
gcugugaagaugcuuugua

SEQ ID NO: 37379 - RNA, 19 nt, Homo sapiens
ucucacgacucuugucuca

SEQ ID NO: 37380 - RNA, 19 nt, Homo sapiens
cgccuacaguucuaccaua

SEQ ID NO: 37381 - RNA, 19 nt, Homo sapiens
ccaagcgucagcugaguuu

SEQ ID NO: 37382 - RNA, 19 nt, Homo sapiens
caggaauggugucccuuau

SEQ ID NO: 37383 - RNA, 19 nt, Homo sapiens
uaauugacgcucugaaugu

SEQ ID NO: 37384 - RNA, 19 nt, Homo sapiens
gaaaauggcaccugggaau

SEQ ID NO: 37385 - RNA, 19 nt, Homo sapiens
uaccagauccguacagguu

SEQ ID NO: 37386 - RNA, 19 nt, Homo sapiens
gaugcuuuguaaauuguga

SEQ ID NO: 37387 - RNA, 19 nt, Homo sapiens
ucgggacccugaagaaaga

SEQ ID NO: 37388 - RNA, 19 nt, Homo sapiens
agaauugagcugcugcaua

SEQ ID NO: 37389 - RNA, 19 nt, Homo sapiens
ccucauaacuaaccaucca

SEQ ID NO: 37390 - RNA, 19 nt, Homo sapiens
gccgaggauuugauaccua

SEQ ID NO: 37391 - RNA, 19 nt, Homo sapiens
cagguuauacuacccauau

SEQ ID NO: 37392 - RNA, 19 nt, Homo sapiens
gcucuugugcuagaaauga

SEQ ID NO: 37393 - RNA, 19 nt, Homo sapiens
guucuaccauaaacacuca

SEQ ID NO: 37394 - RNA, 19 nt, Homo sapiens
cuacaguucuaccauaaac

SEQ ID NO: 37395 - RNA, 19 nt, Homo sapiens
caucagacccaccaaccaa

SEQ ID NO: 37396 - RNA, 19 nt, Homo sapiens
gaauauucagccuuuaaca

SEQ ID NO: 37397 - RNA, 19 nt, Homo sapiens
caaaggaugacucuucucu

SEQ ID NO: 37398 - RNA, 19 nt, Homo sapiens
gcagcccaguuccucauuc

SEQ ID NO: 37399 - RNA, 19 nt, Homo sapiens
gaagcaguaggaaauguca

SEQ ID NO: 37400 - RNA, 19 nt, Homo sapiens
gaauggaaguucugaauua

SEQ ID NO: 37401 - RNA, 19 nt, Homo sapiens
gaagagccuuuauagauua

SEQ ID NO: 37402 - RNA, 19 nt, Homo sapiens
ggacauauuuccuacagua

SEQ ID NO: 37403 - RNA, 19 nt, Homo sapiens
ggacaaagauucuccacuu

SEQ ID NO: 37404 - RNA, 19 nt, Homo sapiens
gaagaucccuuuccuccua

SEQ ID NO: 37405 - RNA, 19 nt, Homo sapiens
gcaauaaccagcauaauaa

SEQ ID NO: 37406 - RNA, 19 nt, Homo sapiens
gcaaucauuucuucagaua

SEQ ID NO: 37407 - RNA, 19 nt, Homo sapiens
caaagcaucucauucauau

SEQ ID NO: 37408 - RNA, 19 nt, Homo sapiens
gggauaaucuguauucuug

SEQ ID NO: 37409 - RNA, 19 nt, Homo sapiens
gaaagucucugauauuugg

SEQ ID NO: 37410 - RNA, 19 nt, Homo sapiens
gguacuagcuuacugauga

SEQ ID NO: 37411 - RNA, 19 nt, Homo sapiens
acaaugagaugcaugauuu

SEQ ID NO: 37412 - RNA, 19 nt, Homo sapiens
ggaaaaggcccgauuauua

SEQ ID NO: 37413 - RNA, 19 nt, Homo sapiens
gcaaaucucuccugaacug

SEQ ID NO: 37414 - RNA, 19 nt, Homo sapiens
gaaguaaugggaucuauaa

SEQ ID NO: 37415 - RNA, 19 nt, Homo sapiens
gaaggcaagucauuauuau

SEQ ID NO: 37416 - RNA, 19 nt, Homo sapiens
gauaaggucuguaguauac

SEQ ID NO: 37417 - RNA, 19 nt, Homo sapiens
gaaaugcagagaagaauaa

SEQ ID NO: 37418 - RNA, 19 nt, Homo sapiens
ggaaggcaagucauuauua

SEQ ID NO: 37419 - RNA, 19 nt, Homo sapiens
ccuagaagcuuaacacuau

SEQ ID NO: 37420 - RNA, 19 nt, Homo sapiens
gguccuaaauaaagucuua

SEQ ID NO: 37421 - RNA, 19 nt, Homo sapiens
gaucaggaauggcaucuug

SEQ ID NO: 37422 - RNA, 19 nt, Homo sapiens
gaugaaugcucccugauau

SEQ ID NO: 37423 - RNA, 19 nt, Homo sapiens
cgaucgagcuauucucuua

SEQ ID NO: 37424 - RNA, 19 nt, Homo sapiens
gcaaaugaaggaugaagua

SEQ ID NO: 37425 - RNA, 19 nt, Homo sapiens
ugaagagccuuuauagauu

SEQ ID NO: 37426 - RNA, 19 nt, Homo sapiens
ggagauaguuucaaagucu

SEQ ID NO: 37427 - RNA, 19 nt, Homo sapiens
caucacggcuucaauuauu

SEQ ID NO: 37428 - RNA, 19 nt, Homo sapiens
ggaaagguguugauuacau

SEQ ID NO: 37429 - RNA, 19 nt, Homo sapiens
gcaaauaccuaugucaaca

SEQ ID NO: 37430 - RNA, 19 nt, Homo sapiens
aaacauaacuccaucuaca

SEQ ID NO: 37431 - RNA, 19 nt, Homo sapiens
gaaagguguugauuacaug

SEQ ID NO: 37432 - RNA, 19 nt, Homo sapiens
ggaggaaagguguugauua

SEQ ID NO: 37433 - RNA, 19 nt, Homo sapiens
gcaccaacauagucauaaa

SEQ ID NO: 37434 - RNA, 19 nt, Homo sapiens
gaggaaagguguugauuac

SEQ ID NO: 37435 - RNA, 19 nt, Homo sapiens
ggacuugucugaccaccuu

SEQ ID NO: 37436 - RNA, 19 nt, Homo sapiens
ggaguuaugucacccauca

SEQ ID NO: 37437 - RNA, 19 nt, Homo sapiens
gagcugagauuggcuaaug

SEQ ID NO: 37438 - RNA, 19 nt, Homo sapiens
gaacagaggaugaacaagu

SEQ ID NO: 37439 - RNA, 19 nt, Homo sapiens
aggcauggcugcuuguuua

SEQ ID NO: 37440 - RNA, 19 nt, Homo sapiens
cgacccaccuuuacucuuu

SEQ ID NO: 37441 - RNA, 19 nt, Homo sapiens
gcuaauacccugcuuucua

SEQ ID NO: 37442 - RNA, 19 nt, Homo sapiens
ggaaauagaaugaauagag

SEQ ID NO: 37443 - RNA, 19 nt, Homo sapiens
ggaacaacuuucuuuggaa

SEQ ID NO: 37444 - RNA, 19 nt, Homo sapiens
guaagaaauuggagugaga

SEQ ID NO: 37445 - RNA, 19 nt, Homo sapiens
gcccagaguuugcucaauu

SEQ ID NO: 37446 - RNA, 19 nt, Homo sapiens
ggagaaaccucacaaaccu

SEQ ID NO: 37447 - RNA, 19 nt, Homo sapiens
cuaauacccugcuuucuau

SEQ ID NO: 37448 - RNA, 19 nt, Homo sapiens
ccuauaagaugacaauguu

SEQ ID NO: 37449 - RNA, 19 nt, Homo sapiens
guaaugggaucuauaaagg

SEQ ID NO: 37450 - RNA, 19 nt, Homo sapiens
ugcauuaagugaaggauua

SEQ ID NO: 37451 - RNA, 19 nt, Homo sapiens
aguagaagcucacaaauag

SEQ ID NO: 37452 - RNA, 19 nt, Homo sapiens
acaggaagaugguagguuu

SEQ ID NO: 37453 - RNA, 19 nt, Homo sapiens
gggauaaggucuguaguau

SEQ ID NO: 37454 - RNA, 19 nt, Homo sapiens
cagagaagaauaagacaua

SEQ ID NO: 37455 - RNA, 19 nt, Homo sapiens
caagagagaggcugagaaa

SEQ ID NO: 37456 - RNA, 19 nt, Homo sapiens
cauauuaccuguggaguug

SEQ ID NO: 37457 - RNA, 19 nt, Homo sapiens
aaaccaaacuaguaucaga

SEQ ID NO: 37458 - RNA, 19 nt, Homo sapiens
cagcaagacugacuucugu

SEQ ID NO: 37459 - RNA, 19 nt, Homo sapiens
gaaagccuccuauggaaug

SEQ ID NO: 37460 - RNA, 19 nt, Homo sapiens
uggcaaagcucaccaucuu

SEQ ID NO: 37461 - RNA, 19 nt, Homo sapiens
ggaaguaaugggaucuaua

SEQ ID NO: 37462 - RNA, 19 nt, Homo sapiens
gacaaagauucuccacuug

SEQ ID NO: 37463 - RNA, 19 nt, Homo sapiens
ggaaacacacacacacaaa

SEQ ID NO: 37464 - RNA, 19 nt, Homo sapiens
gcuuacugaugauguguua

SEQ ID NO: 37465 - RNA, 19 nt, Homo sapiens
ggaaacauaacuccaucua

SEQ ID NO: 37466 - RNA, 19 nt, Homo sapiens
gggagcacauguagaagaa

SEQ ID NO: 37467 - RNA, 19 nt, Homo sapiens
ggaucaagguuauucaaca

SEQ ID NO: 37468 - RNA, 19 nt, Homo sapiens
ggacuaggaucggcucuca

SEQ ID NO: 37469 - RNA, 19 nt, Homo sapiens
uagagaggguacuagcuua

SEQ ID NO: 37470 - RNA, 19 nt, Homo sapiens
ugggacaccuguaauguaa

SEQ ID NO: 37471 - RNA, 19 nt, Homo sapiens
gauauuuccucuugguaau

SEQ ID NO: 37472 - RNA, 19 nt, Homo sapiens
cuacguaucuaugguacua

SEQ ID NO: 37473 - RNA, 19 nt, Homo sapiens
gaucacauuucaggacauu

SEQ ID NO: 37474 - RNA, 19 nt, Homo sapiens
gagauaguuucaaagucua

SEQ ID NO: 37475 - RNA, 19 nt, Homo sapiens
uccaugaucuauacacaua

SEQ ID NO: 37476 - RNA, 19 nt, Homo sapiens
ucuauaaucugcagugaug

SEQ ID NO: 37477 - RNA, 19 nt, Homo sapiens
ggauaaggucuguaguaua

SEQ ID NO: 37478 - RNA, 19 nt, Homo sapiens
ucaugaugguccuaaauaa

SEQ ID NO: 37479 - RNA, 19 nt, Homo sapiens
ggaccuaaauaacuugaag

SEQ ID NO: 37480 - RNA, 19 nt, Homo sapiens
ccuagaaagucucugauau

SEQ ID NO: 37481 - RNA, 19 nt, Homo sapiens
gaauacaaguuccaguucu

SEQ ID NO: 37482 - RNA, 19 nt, Homo sapiens
gugauuggauuccuuuaug

SEQ ID NO: 37483 - RNA, 19 nt, Homo sapiens
ggaauggaaguucugaauu

SEQ ID NO: 37484 - RNA, 19 nt, Homo sapiens
gaacugcuuuccauuccau

SEQ ID NO: 37485 - RNA, 19 nt, Homo sapiens
caguagaagcucacaaaua

SEQ ID NO: 37486 - RNA, 19 nt, Homo sapiens
uuacaaagcaucucauuca

SEQ ID NO: 37487 - RNA, 19 nt, Homo sapiens
gcacagcuggagauaguuu

SEQ ID NO: 37488 - RNA, 19 nt, Homo sapiens
gauacaggcuggccagaag

SEQ ID NO: 37489 - RNA, 19 nt, Homo sapiens
ggugaugucuggucaacug

SEQ ID NO: 37490 - RNA, 19 nt, Homo sapiens
ggcaagaagucuauuaggu

SEQ ID NO: 37491 - RNA, 19 nt, Homo sapiens
gagagaggcugagaaaugc

SEQ ID NO: 37492 - RNA, 19 nt, Homo sapiens
gaugaaguauaucucuaga

SEQ ID NO: 37493 - RNA, 19 nt, Homo sapiens
guagugagguugcagugau

SEQ ID NO: 37494 - RNA, 19 nt, Homo sapiens
gggaggauuugacagcauu

SEQ ID NO: 37495 - RNA, 19 nt, Homo sapiens
gcaaagcucaccaucuuca

SEQ ID NO: 37496 - RNA, 19 nt, Homo sapiens
ccagggagcacauguagaa

SEQ ID NO: 37497 - RNA, 19 nt, Homo sapiens
gagauuaccuuugcuaagc

SEQ ID NO: 37498 - RNA, 19 nt, Homo sapiens
gcugagaaaugcagagaag

SEQ ID NO: 37499 - RNA, 19 nt, Homo sapiens
cagagaauguuagccauga

SEQ ID NO: 37500 - RNA, 19 nt, Homo sapiens
gcaaaugccuuuaaaccaa

SEQ ID NO: 37501 - RNA, 19 nt, Homo sapiens
gaacggaauuuacaaaggu

SEQ ID NO: 37502 - RNA, 19 nt, Homo sapiens
gcacaugaguuccuguuuc

SEQ ID NO: 37503 - RNA, 19 nt, Homo sapiens
gaagacgugugaaccuaaa

SEQ ID NO: 37504 - RNA, 19 nt, Homo sapiens
gaagcuguuuccuauauug

SEQ ID NO: 37505 - RNA, 19 nt, Homo sapiens
ccaaauauccuacugauca

SEQ ID NO: 37506 - RNA, 19 nt, Homo sapiens
gagauggacuggcucauag

SEQ ID NO: 37507 - RNA, 19 nt, Homo sapiens
gaacucaacauucacguau

SEQ ID NO: 37508 - RNA, 19 nt, Homo sapiens
caaaugccuuuaaaccaaa

SEQ ID NO: 37509 - RNA, 19 nt, Homo sapiens
caaccggccucauaggaaa

SEQ ID NO: 37510 - RNA, 19 nt, Homo sapiens
ucacguauuucaccucuga

SEQ ID NO: 37511 - RNA, 19 nt, Homo sapiens
ggagauggacuggcucaua

SEQ ID NO: 37512 - RNA, 19 nt, Homo sapiens
cagcgagucuuaugcuaaa

SEQ ID NO: 37513 - RNA, 19 nt, Homo sapiens
gugcgacgcuggaacugua

SEQ ID NO: 37514 - RNA, 19 nt, Homo sapiens
ugagaacgccgaauauuga

SEQ ID NO: 37515 - RNA, 19 nt, Homo sapiens
ugacugcguugcaaacaaa

SEQ ID NO: 37516 - RNA, 19 nt, Homo sapiens
gaagacaaugguuuaaaga

SEQ ID NO: 37517 - RNA, 19 nt, Homo sapiens
caucgaagacaaugguuua

SEQ ID NO: 37518 - RNA, 19 nt, Homo sapiens
ccacggauuugacuauuuc

SEQ ID NO: 37519 - RNA, 19 nt, Homo sapiens
cgaagacaaugguuuaaag

SEQ ID NO: 37520 - RNA, 19 nt, Homo sapiens
gaaccacggauuugacuau

SEQ ID NO: 37521 - RNA, 19 nt, Homo sapiens
ggaacggaauuuacaaagg

SEQ ID NO: 37522 - RNA, 19 nt, Homo sapiens
ggacauuucccguucuguu

SEQ ID NO: 37523 - RNA, 19 nt, Homo sapiens
acucaacauucacguauuu

SEQ ID NO: 37524 - RNA, 19 nt, Homo sapiens
gcucauagguaagguucuu

SEQ ID NO: 37525 - RNA, 19 nt, Homo sapiens
acacugagaacgccgaaua

SEQ ID NO: 37526 - RNA, 19 nt, Homo sapiens
gacaaugguuuaaagaacu

SEQ ID NO: 37527 - RNA, 19 nt, Homo sapiens
uggacuggcucauagguaa

SEQ ID NO: 37528 - RNA, 19 nt, Homo sapiens
gagaaaacagcgagucuua

SEQ ID NO: 37529 - RNA, 19 nt, Homo sapiens
cacaugaguuccuguuuca

SEQ ID NO: 37530 - RNA, 19 nt, Homo sapiens
gcaaccggccucauaggaa

SEQ ID NO: 37531 - RNA, 19 nt, Homo sapiens
caagcuugguucuaucuuc

SEQ ID NO: 37532 - RNA, 19 nt, Homo sapiens
guacuccuccuucggguuu

SEQ ID NO: 37533 - RNA, 19 nt, Homo sapiens
aaacugcaaaugccuuuaa

SEQ ID NO: 37534 - RNA, 19 nt, Homo sapiens
gugauaauguggaggagau

SEQ ID NO: 37535 - RNA, 19 nt, Homo sapiens
gaccugcgguuucuucucu

SEQ ID NO: 37536 - RNA, 19 nt, Homo sapiens
ggaacuguauccugaugag

SEQ ID NO: 37537 - RNA, 19 nt, Homo sapiens
caaauauccuacugaucau

SEQ ID NO: 37538 - RNA, 19 nt, Homo sapiens
aaagucagcauggcuuaua

SEQ ID NO: 37539 - RNA, 19 nt, Homo sapiens
ugagcaacauccuguggaa

SEQ ID NO: 37540 - RNA, 19 nt, Homo sapiens
gaaaacagcgagucuuaug

SEQ ID NO: 37541 - RNA, 19 nt, Homo sapiens
ggauggaacggaauuuaca

SEQ ID NO: 37542 - RNA, 19 nt, Homo sapiens
agacaaugguuuaaagaac

SEQ ID NO: 37543 - RNA, 19 nt, Homo sapiens
ccauuucuccucuuccuuu

SEQ ID NO: 37544 - RNA, 19 nt, Homo sapiens
uaaaccaaauauccuacug

SEQ ID NO: 37545 - RNA, 19 nt, Homo sapiens
gaaaagucagcauggcuua

SEQ ID NO: 37546 - RNA, 19 nt, Homo sapiens
cgaaaccacuuuugcaaga

SEQ ID NO: 37547 - RNA, 19 nt, Homo sapiens
uuaaugccaucgaagacaa

SEQ ID NO: 37548 - RNA, 19 nt, Homo sapiens
gaccauggaggacauuuag

SEQ ID NO: 37549 - RNA, 19 nt, Homo sapiens
gagccugacugcguugcaa

SEQ ID NO: 37550 - RNA, 19 nt, Homo sapiens
ggccagaccugcgguuucu

SEQ ID NO: 37551 - RNA, 19 nt, Homo sapiens
ggagacauuccuucagauc

SEQ ID NO: 37552 - RNA, 19 nt, Homo sapiens
agggagacauuccuucaga

SEQ ID NO: 37553 - RNA, 19 nt, Homo sapiens
cugaagacgugugaaccua

SEQ ID NO: 37554 - RNA, 19 nt, Homo sapiens
ugaccauggaggacauuua

SEQ ID NO: 37555 - RNA, 19 nt, Homo sapiens
gggagacauuccuucagau

SEQ ID NO: 37556 - RNA, 19 nt, Homo sapiens
ugaagacgugugaaccuaa

SEQ ID NO: 37557 - RNA, 19 nt, Homo sapiens
aaccaaauauccuacugau

SEQ ID NO: 37558 - RNA, 19 nt, Homo sapiens
gagacauuccuucagauca

SEQ ID NO: 37559 - RNA, 19 nt, Homo sapiens
gauggaacggaauuuacaa

SEQ ID NO: 37560 - RNA, 19 nt, Homo sapiens
aagcuugguucuaucuuca

SEQ ID NO: 37561 - RNA, 19 nt, Homo sapiens
cugagaacgccgaauauug

SEQ ID NO: 37562 - RNA, 19 nt, Homo sapiens
gacauuucccguucuguuc

SEQ ID NO: 37563 - RNA, 19 nt, Homo sapiens
aaaccaaauauccuacuga

SEQ ID NO: 37564 - RNA, 19 nt, Homo sapiens
gcgucuggaagguucauua

SEQ ID NO: 37565 - RNA, 19 nt, Homo sapiens
agauggacacagccaguua

SEQ ID NO: 37566 - RNA, 19 nt, Homo sapiens
cgagucuuaugcuaaagga

SEQ ID NO: 37567 - RNA, 19 nt, Homo sapiens
acuguauccugaugagaaa

SEQ ID NO: 37568 - RNA, 19 nt, Homo sapiens
gaacuguauccugaugaga

SEQ ID NO: 37569 - RNA, 19 nt, Homo sapiens
cgggaacaauacacugaga

SEQ ID NO: 37570 - RNA, 19 nt, Homo sapiens
gaaaccacuuuugcaagaa

SEQ ID NO: 37571 - RNA, 19 nt, Homo sapiens
gaacgaaaccacuuuugca

SEQ ID NO: 37572 - RNA, 19 nt, Homo sapiens
agacauuccuucagaucag

SEQ ID NO: 37573 - RNA, 19 nt, Homo sapiens
ugaccagcuugcagaggaa

SEQ ID NO: 37574 - RNA, 19 nt, Homo sapiens
gggaacaauacacugagaa

SEQ ID NO: 37575 - RNA, 19 nt, Homo sapiens
ggaacaauacacugagaac

SEQ ID NO: 37576 - RNA, 19 nt, Homo sapiens
gagauggacacagccaguu

SEQ ID NO: 37577 - RNA, 19 nt, Homo sapiens
acagcgagucuuaugcuaa

SEQ ID NO: 37578 - RNA, 19 nt, Homo sapiens
guuccuguuucauuacugu

SEQ ID NO: 37579 - RNA, 19 nt, Homo sapiens
caggacagggugauugaug

SEQ ID NO: 37580 - RNA, 19 nt, Homo sapiens
gcggacauuucccguucug

SEQ ID NO: 37581 - RNA, 19 nt, Homo sapiens
cugaaugccaggacuguga

SEQ ID NO: 37582 - RNA, 19 nt, Homo sapiens
gggauggaacggaauuuac

SEQ ID NO: 37583 - RNA, 19 nt, Homo sapiens
gauggacacagccaguuag

SEQ ID NO: 37584 - RNA, 19 nt, Homo sapiens
uuucaccucugaccaugga

SEQ ID NO: 37585 - RNA, 19 nt, Homo sapiens
ucacagggagacauuccuu

SEQ ID NO: 37586 - RNA, 19 nt, Homo sapiens
ucgaagacaaugguuuaaa

SEQ ID NO: 37587 - RNA, 19 nt, Homo sapiens
ggcgugggcugccuguuuu

SEQ ID NO: 37588 - RNA, 19 nt, Homo sapiens
ucuggaagguucauuacac

SEQ ID NO: 37589 - RNA, 19 nt, Homo sapiens
gaauauugaccagcuugca

SEQ ID NO: 37590 - RNA, 19 nt, Homo sapiens
agaacucaacauucacgua

SEQ ID NO: 37591 - RNA, 19 nt, Homo sapiens
ccagaccugcgguuucuuc

SEQ ID NO: 37592 - RNA, 19 nt, Homo sapiens
ccuucacgcucacaaacga

SEQ ID NO: 37593 - RNA, 19 nt, Homo sapiens
accacggauuugacuauuu

SEQ ID NO: 37594 - RNA, 19 nt, Homo sapiens
aaccacggauuugacuauu

SEQ ID NO: 37595 - RNA, 19 nt, Homo sapiens
aaacaaaauucuccaagcu

SEQ ID NO: 37596 - RNA, 19 nt, Homo sapiens
gggaagggcaugggaggau

SEQ ID NO: 37597 - RNA, 19 nt, Homo sapiens
guauuucaccucugaccau

SEQ ID NO: 37598 - RNA, 19 nt, Homo sapiens
aacugcaaaugccuuuaaa

SEQ ID NO: 37599 - RNA, 19 nt, Homo sapiens
aagucagcauggcuuauau

SEQ ID NO: 37600 - RNA, 19 nt, Homo sapiens
gcaaaugccuuuaaaccaa

SEQ ID NO: 37601 - RNA, 19 nt, Homo sapiens
ggacacacauccaaacuau

SEQ ID NO: 37602 - RNA, 19 nt, Homo sapiens
gaauaaaggacgcagaaua

SEQ ID NO: 37603 - RNA, 19 nt, Homo sapiens
gcagggagauggcuugaga

SEQ ID NO: 37604 - RNA, 19 nt, Homo sapiens
ugacuuaacagccucauua

SEQ ID NO: 37605 - RNA, 19 nt, Homo sapiens
gaagacgugugaaccuaaa

SEQ ID NO: 37606 - RNA, 19 nt, Homo sapiens
cuacacagccaaugacuua

SEQ ID NO: 37607 - RNA, 19 nt, Homo sapiens
gaagcuguuuccuauauug

SEQ ID NO: 37608 - RNA, 19 nt, Homo sapiens
ccaaauauccuacugauca

SEQ ID NO: 37609 - RNA, 19 nt, Homo sapiens
gcaauaaaguucggacaau

SEQ ID NO: 37610 - RNA, 19 nt, Homo sapiens
gagauggacuggcucauag

SEQ ID NO: 37611 - RNA, 19 nt, Homo sapiens
caaaugccuuuaaaccaaa

SEQ ID NO: 37612 - RNA, 19 nt, Homo sapiens
ggaugacaauuccacauga

SEQ ID NO: 37613 - RNA, 19 nt, Homo sapiens
gcgauaaaguuaauguuca

SEQ ID NO: 37614 - RNA, 19 nt, Homo sapiens
caaccggccucauaggaaa

SEQ ID NO: 37615 - RNA, 19 nt, Homo sapiens
ggagauggacuggcucaua

SEQ ID NO: 37616 - RNA, 19 nt, Homo sapiens
cagcgagucuuaugcuaaa

SEQ ID NO: 37617 - RNA, 19 nt, Homo sapiens
gugcgacgcuggaacugua

SEQ ID NO: 37618 - RNA, 19 nt, Homo sapiens
ugagaacgccgaauauuga

SEQ ID NO: 37619 - RNA, 19 nt, Homo sapiens
gcucauagccagugacuuc

SEQ ID NO: 37620 - RNA, 19 nt, Homo sapiens
ccacggauuugacuauuuc

SEQ ID NO: 37621 - RNA, 19 nt, Homo sapiens
caucagaaguuaccgaaag

SEQ ID NO: 37622 - RNA, 19 nt, Homo sapiens
caauaaaguucggacaaug

SEQ ID NO: 37623 - RNA, 19 nt, Homo sapiens
gaaccacggauuugacuau

SEQ ID NO: 37624 - RNA, 19 nt, Homo sapiens
cauccaaacuauauuguca

SEQ ID NO: 37625 - RNA, 19 nt, Homo sapiens
aggaagagccgcacacuuu

SEQ ID NO: 37626 - RNA, 19 nt, Homo sapiens
agacaagcaucgugauaga

SEQ ID NO: 37627 - RNA, 19 nt, Homo sapiens
gaaagugaagcgauaaagu

SEQ ID NO: 37628 - RNA, 19 nt, Homo sapiens
gaccugcgguuucuucugu

SEQ ID NO: 37629 - RNA, 19 nt, Homo sapiens
gauagaguucacagucuua

SEQ ID NO: 37630 - RNA, 19 nt, Homo sapiens
gugaagcgauaaaguuaau

SEQ ID NO: 37631 - RNA, 19 nt, Homo sapiens
uaccgaaagugaagcgaua

SEQ ID NO: 37632 - RNA, 19 nt, Homo sapiens
cugcaaugacugauaauua

SEQ ID NO: 37633 - RNA, 19 nt, Homo sapiens
acacacauccaaacuauau

SEQ ID NO: 37634 - RNA, 19 nt, Homo sapiens
acacugagaacgccgaaua

SEQ ID NO: 37635 - RNA, 19 nt, Homo sapiens
cuuaacagccucauuagaa

SEQ ID NO: 37636 - RNA, 19 nt, Homo sapiens
gagacuggguauuuuauaa

SEQ ID NO: 37637 - RNA, 19 nt, Homo sapiens
aaagugaagcgauaaaguu

SEQ ID NO: 37638 - RNA, 19 nt, Homo sapiens
gagaaaacagcgagucuua

SEQ ID NO: 37639 - RNA, 19 nt, Homo sapiens
gaaguuaccgaaagugaag

SEQ ID NO: 37640 - RNA, 19 nt, Homo sapiens
caaacuauauugucaaccu

SEQ ID NO: 37641 - RNA, 19 nt, Homo sapiens
gacgcugucuuccuucuau

SEQ ID NO: 37642 - RNA, 19 nt, Homo sapiens
gcaaccggccucauaggaa

SEQ ID NO: 37643 - RNA, 19 nt, Homo sapiens
guacuccuccuucggguuu

SEQ ID NO: 37644 - RNA, 19 nt, Homo sapiens
gaagcgauaaaguuaaugu

SEQ ID NO: 37645 - RNA, 19 nt, Homo sapiens
gugauaauguggaggagau

SEQ ID NO: 37646 - RNA, 19 nt, Homo sapiens
aaacugcaaaugccuuuaa

SEQ ID NO: 37647 - RNA, 19 nt, Homo sapiens
caaauauccuacugaucau

SEQ ID NO: 37648 - RNA, 19 nt, Homo sapiens
ggaacuguauccugaugag

SEQ ID NO: 37649 - RNA, 19 nt, Homo sapiens
gaagagccgcacacuuuua

SEQ ID NO: 37650 - RNA, 19 nt, Homo sapiens
aaagucagcauggcuuaua

SEQ ID NO: 37651 - RNA, 19 nt, Homo sapiens
gacaauuccacaugagauu

SEQ ID NO: 37652 - RNA, 19 nt, Homo sapiens
aggcugcaaugacugauaa

SEQ ID NO: 37653 - RNA, 19 nt, Homo sapiens
ccagugaggcugcagauuc

SEQ ID NO: 37654 - RNA, 19 nt, Homo sapiens
gaaaacagcgagucuuaug

SEQ ID NO: 37655 - RNA, 19 nt, Homo sapiens
ugauagaguucacagucuu

SEQ ID NO: 37656 - RNA, 19 nt, Homo sapiens
aagugaagcgauaaaguua

SEQ ID NO: 37657 - RNA, 19 nt, Homo sapiens
aauaaaggacgcagaauag

SEQ ID NO: 37658 - RNA, 19 nt, Homo sapiens
gaggugggaagaucauuug

SEQ ID NO: 37659 - RNA, 19 nt, Homo sapiens
ugagacaagcaucgugaua

SEQ ID NO: 37660 - RNA, 19 nt, Homo sapiens
ccauuucuccucuuccuuu

SEQ ID NO: 37661 - RNA, 19 nt, Homo sapiens
uaaaccaaauauccuacug

SEQ ID NO: 37662 - RNA, 19 nt, Homo sapiens
caacuguauuaguccauuc

SEQ ID NO: 37663 - RNA, 19 nt, Homo sapiens
gaaaagucagcauggcuua

SEQ ID NO: 37664 - RNA, 19 nt, Homo sapiens
cgaaaccacuuuugcaaga

SEQ ID NO: 37665 - RNA, 19 nt, Homo sapiens
cauuagaaguuacagaaac

SEQ ID NO: 37666 - RNA, 19 nt, Homo sapiens
gaugacaauuccacaugag

SEQ ID NO: 37667 - RNA, 19 nt, Homo sapiens
uuuauuugguccuucagua

SEQ ID NO: 37668 - RNA, 19 nt, Homo sapiens
caagcaucgugauagaguu

SEQ ID NO: 37669 - RNA, 19 nt, Homo sapiens
gugaggcugcagauucuua

SEQ ID NO: 37670 - RNA, 19 nt, Homo sapiens
gggacacacauccaaacua

SEQ ID NO: 37671 - RNA, 19 nt, Homo sapiens
ggacgcagaauagggagaa

SEQ ID NO: 37672 - RNA, 19 nt, Homo sapiens
gagacaagcaucgugauag

SEQ ID NO: 37673 - RNA, 19 nt, Homo sapiens
cauagccagugacuucaug

SEQ ID NO: 37674 - RNA, 19 nt, Homo sapiens
ggccagaccugcgguuucu

SEQ ID NO: 37675 - RNA, 19 nt, Homo sapiens
ggagacauuccuucagauc

SEQ ID NO: 37676 - RNA, 19 nt, Homo sapiens
agggagacauuccuucaga

SEQ ID NO: 37677 - RNA, 19 nt, Homo sapiens
cugaagacgugugaaccua

SEQ ID NO: 37678 - RNA, 19 nt, Homo sapiens
uuaacagccucauuagaag

SEQ ID NO: 37679 - RNA, 19 nt, Homo sapiens
acacauccaaacuauauug

SEQ ID NO: 37680 - RNA, 19 nt, Homo sapiens
uggauuggcucacguucug

SEQ ID NO: 37681 - RNA, 19 nt, Homo sapiens
ucaacuguauuaguccauu

SEQ ID NO: 37682 - RNA, 19 nt, Homo sapiens
cagaaguuaccgaaaguga

SEQ ID NO: 37683 - RNA, 19 nt, Homo sapiens
gggagacauuccuucagau

SEQ ID NO: 37684 - RNA, 19 nt, Homo sapiens
aaccaaauauccuacugau

SEQ ID NO: 37685 - RNA, 19 nt, Homo sapiens
ucauuuauuugguccuuca

SEQ ID NO: 37686 - RNA, 19 nt, Homo sapiens
caugucaucaucagaaguu

SEQ ID NO: 37687 - RNA, 19 nt, Homo sapiens
ugaagacgugugaaccuaa

SEQ ID NO: 37688 - RNA, 19 nt, Homo sapiens
gagacauuccuucagauca

SEQ ID NO: 37689 - RNA, 19 nt, Homo sapiens
gaggcugcaaugacugaua

SEQ ID NO: 37690 - RNA, 19 nt, Homo sapiens
cagugaggcugcagauucu

SEQ ID NO: 37691 - RNA, 19 nt, Homo sapiens
caauuccacaugagauuug

SEQ ID NO: 37692 - RNA, 19 nt, Homo sapiens
cgauaaaguuaauguucag

SEQ ID NO: 37693 - RNA, 19 nt, Homo sapiens
cugagaacgccgaauauug

SEQ ID NO: 37694 - RNA, 19 nt, Homo sapiens
aaaccaaauauccuacuga

SEQ ID NO: 37695 - RNA, 19 nt, Homo sapiens
cgagucuuaugcuaaagga

SEQ ID NO: 37696 - RNA, 19 nt, Homo sapiens
gacacacauccaaacuaua

SEQ ID NO: 37697 - RNA, 19 nt, Homo sapiens
gaggaagagccgcacacuu

SEQ ID NO: 37698 - RNA, 19 nt, Homo sapiens
gaccaagagaggagaggaa

SEQ ID NO: 37699 - RNA, 19 nt, Homo sapiens
ggcaggagaaggaccaaga

SEQ ID NO: 37700 - RNA, 19 nt, Homo sapiens
gaagaugacccacaauaaa

SEQ ID NO: 37701 - RNA, 19 nt, Homo sapiens
caacaaaugagacaacuuu

SEQ ID NO: 37702 - RNA, 19 nt, Homo sapiens
ggaagaugacccacaauaa

SEQ ID NO: 37703 - RNA, 19 nt, Homo sapiens
ggaauggaauuuauaaagg

SEQ ID NO: 37704 - RNA, 19 nt, Homo sapiens
caacagcacccucauuuau

SEQ ID NO: 37705 - RNA, 19 nt, Homo sapiens
ccacuggacucauuggaaa

SEQ ID NO: 37706 - RNA, 19 nt, Homo sapiens
auaaaugucugcagugaaa

SEQ ID NO: 37707 - RNA, 19 nt, Homo sapiens
ggaauaagcaugggccuuu

SEQ ID NO: 37708 - RNA, 19 nt, Homo sapiens
gcaacagcacccucauuua

SEQ ID NO: 37709 - RNA, 19 nt, Homo sapiens
caauaaaugucugcaguga

SEQ ID NO: 37710 - RNA, 19 nt, Homo sapiens
gaugcucgcuguacugcua

SEQ ID NO: 37711 - RNA, 19 nt, Homo sapiens
ggaaugccuuucuccuuga

SEQ ID NO: 37712 - RNA, 19 nt, Homo sapiens
caucauggcuuugagcauu

SEQ ID NO: 37713 - RNA, 19 nt, Homo sapiens
agagagagacaacauguua

SEQ ID NO: 37714 - RNA, 19 nt, Homo sapiens
acagcacccucauuuauuu

SEQ ID NO: 37715 - RNA, 19 nt, Homo sapiens
gaagcucacacaccugaua

SEQ ID NO: 37716 - RNA, 19 nt, Homo sapiens
gggaagaugacccacaaua

SEQ ID NO: 37717 - RNA, 19 nt, Homo sapiens
gcaccauucuuguuugugu

SEQ ID NO: 37718 - RNA, 19 nt, Homo sapiens
gccgauugcuuucugauga

SEQ ID NO: 37719 - RNA, 19 nt, Homo sapiens
gacggauccuugacacuuu

SEQ ID NO: 37720 - RNA, 19 nt, Homo sapiens
ggagauggacuggauggua

SEQ ID NO: 37721 - RNA, 19 nt, Homo sapiens
ccucagagcccguguucua

SEQ ID NO: 37722 - RNA, 19 nt, Homo sapiens
uaugguggcuggaauggaa

SEQ ID NO: 37723 - RNA, 19 nt, Homo sapiens
ucacaucccucuuaucacu

SEQ ID NO: 37724 - RNA, 19 nt, Homo sapiens
gaacaccagcggacacuca

SEQ ID NO: 37725 - RNA, 19 nt, Homo sapiens
acgaguuccugaugcauua

SEQ ID NO: 37726 - RNA, 19 nt, Homo sapiens
gcgugaagcugacccaaca

SEQ ID NO: 37727 - RNA, 19 nt, Homo sapiens
caugaggacuccgaauauu

SEQ ID NO: 37728 - RNA, 19 nt, Homo sapiens
guucacaucccucuuauca

SEQ ID NO: 37729 - RNA, 19 nt, Homo sapiens
ccaccacgauccaccuuug

SEQ ID NO: 37730 - RNA, 19 nt, Homo sapiens
ggacggauccuugacacuu

SEQ ID NO: 37731 - RNA, 19 nt, Homo sapiens
gagguugcguccuuucuca

SEQ ID NO: 37732 - RNA, 19 nt, Homo sapiens
gcgguucccuagagaauca

SEQ ID NO: 37733 - RNA, 19 nt, Homo sapiens
uagaggagauggacuggau

SEQ ID NO: 37734 - RNA, 19 nt, Homo sapiens
gaauaagcaugggccuuuc

SEQ ID NO: 37735 - RNA, 19 nt, Homo sapiens
gggaugguuuccagcauug

SEQ ID NO: 37736 - RNA, 19 nt, Homo sapiens
ggacagcccaacacucaga

SEQ ID NO: 37737 - RNA, 19 nt, Homo sapiens
gcuggaauggaauuuauaa

SEQ ID NO: 37738 - RNA, 19 nt, Homo sapiens
cagaggaaguagagagaga

SEQ ID NO: 37739 - RNA, 19 nt, Homo sapiens
acacaucucugccgcaucu

SEQ ID NO: 37740 - RNA, 19 nt, Homo sapiens
gaggaacaauguggaaagu

SEQ ID NO: 37741 - RNA, 19 nt, Homo sapiens
gcaucugggucucaacugu

SEQ ID NO: 37742 - RNA, 19 nt, Homo sapiens
ccgaacauccuucuucuga

SEQ ID NO: 37743 - RNA, 19 nt, Homo sapiens
ucgcuguacugcuaaguuu

SEQ ID NO: 37744 - RNA, 19 nt, Homo sapiens
ggaaguagagagagagaca

SEQ ID NO: 37745 - RNA, 19 nt, Homo sapiens
uagggaagaugacccacaa

SEQ ID NO: 37746 - RNA, 19 nt, Homo sapiens
cagcauugguuaccguguu

SEQ ID NO: 37747 - RNA, 19 nt, Homo sapiens
gagcaacagcacccucauu

SEQ ID NO: 37748 - RNA, 19 nt, Homo sapiens
cccaugugcuuccaaagaa

SEQ ID NO: 37749 - RNA, 19 nt, Homo sapiens
gaagcugacccaacacauc

SEQ ID NO: 37750 - RNA, 19 nt, Homo sapiens
ugaggacuccgaauauuga

SEQ ID NO: 37751 - RNA, 19 nt, Homo sapiens
ucaagagacccuucugaga

SEQ ID NO: 37752 - RNA, 19 nt, Homo sapiens
gauccaccuuugcucuuug

SEQ ID NO: 37753 - RNA, 19 nt, Homo sapiens
gaccgaacauccuucuucu

SEQ ID NO: 37754 - RNA, 19 nt, Homo sapiens
ggaggucuuccaacaaaug

SEQ ID NO: 37755 - RNA, 19 nt, Homo sapiens
gcauuauugugagagguuu

SEQ ID NO: 37756 - RNA, 19 nt, Homo sapiens
gagaaucaacuuggaaaca

SEQ ID NO: 37757 - RNA, 19 nt, Homo sapiens
uggcuggaauggaauuuau

SEQ ID NO: 37758 - RNA, 19 nt, Homo sapiens
ucacggcgguucccuagag

SEQ ID NO: 37759 - RNA, 19 nt, Homo sapiens
cagauacccugugcgauca

SEQ ID NO: 37760 - RNA, 19 nt, Homo sapiens
cagagcccguguucuauca

SEQ ID NO: 37761 - RNA, 19 nt, Homo sapiens
cgauccaccuuugcucuuu

SEQ ID NO: 37762 - RNA, 19 nt, Homo sapiens
gccggugccugcuauggaa

SEQ ID NO: 37763 - RNA, 19 nt, Homo sapiens
gcuggugccuuagggaaga

SEQ ID NO: 37764 - RNA, 19 nt, Homo sapiens
ccaugaggacuccgaauau

SEQ ID NO: 37765 - RNA, 19 nt, Homo sapiens
aagaugacccacaauaaau

SEQ ID NO: 37766 - RNA, 19 nt, Homo sapiens
cgaccgaacauccuucuuc

SEQ ID NO: 37767 - RNA, 19 nt, Homo sapiens
gcccaugugcuuccaaaga

SEQ ID NO: 37768 - RNA, 19 nt, Homo sapiens
ccuagagaaucaacuugga

SEQ ID NO: 37769 - RNA, 19 nt, Homo sapiens
gagagagagacaacauguu

SEQ ID NO: 37770 - RNA, 19 nt, Homo sapiens
cacguucacaucccucuua

SEQ ID NO: 37771 - RNA, 19 nt, Homo sapiens
ccucuuuguuuccuuucua

SEQ ID NO: 37772 - RNA, 19 nt, Homo sapiens
ggccuuuccuccucuuugu

SEQ ID NO: 37773 - RNA, 19 nt, Homo sapiens
ucacggagcagcccaugug

SEQ ID NO: 37774 - RNA, 19 nt, Homo sapiens
uguuacaucugcaccauuc

SEQ ID NO: 37775 - RNA, 19 nt, Homo sapiens
guagagagagagacaacau

SEQ ID NO: 37776 - RNA, 19 nt, Homo sapiens
ggacaacguagaggagaug

SEQ ID NO: 37777 - RNA, 19 nt, Homo sapiens
caaagaacgacaccccuua

SEQ ID NO: 37778 - RNA, 19 nt, Homo sapiens
cagcccaugugcuuccaaa

SEQ ID NO: 37779 - RNA, 19 nt, Homo sapiens
gaaugccuuucuccuugau

SEQ ID NO: 37780 - RNA, 19 nt, Homo sapiens
cuaugccacuggacucauu

SEQ ID NO: 37781 - RNA, 19 nt, Homo sapiens
ccaccacccucuccaucau

SEQ ID NO: 37782 - RNA, 19 nt, Homo sapiens
uagagaaucaacuuggaaa

SEQ ID NO: 37783 - RNA, 19 nt, Homo sapiens
gaauauugaccgccuugca

SEQ ID NO: 37784 - RNA, 19 nt, Homo sapiens
gaugacccacaauaaaugu

SEQ ID NO: 37785 - RNA, 19 nt, Homo sapiens
guggaggguuugagcaaca

SEQ ID NO: 37786 - RNA, 19 nt, Homo sapiens
cgaacauccuucuucugau

SEQ ID NO: 37787 - RNA, 19 nt, Homo sapiens
caacgggacagaggaacaa

SEQ ID NO: 37788 - RNA, 19 nt, Homo sapiens
caucugcaccauucuuguu

SEQ ID NO: 37789 - RNA, 19 nt, Homo sapiens
gggacaacguagaggagau

SEQ ID NO: 37790 - RNA, 19 nt, Homo sapiens
gaggucuuccaacaaauga

SEQ ID NO: 37791 - RNA, 19 nt, Homo sapiens
ccuccucuuuguuuccuuu

SEQ ID NO: 37792 - RNA, 19 nt, Homo sapiens
ggucuuccaacaaaugaga

SEQ ID NO: 37793 - RNA, 19 nt, Homo sapiens
cggagcaucuggaggucuu

SEQ ID NO: 37794 - RNA, 19 nt, Homo sapiens
agcaacagcacccucauuu

SEQ ID NO: 37795 - RNA, 19 nt, Homo sapiens
gaacgacaccccuuauucu

SEQ ID NO: 37796 - RNA, 19 nt, Homo sapiens
ggacaggcugggcaacauc

SEQ ID NO: 37797 - RNA, 19 nt, Homo sapiens
cccaggagcagaggaagua

SEQ ID NO: 37798 - RNA, 19 nt, Homo sapiens
gaaguagagagagagacaa

SEQ ID NO: 37799 - RNA, 19 nt, Homo sapiens
aacagcacccucauuuauu

SEQ ID NO: 37800 - RNA, 19 nt, Homo sapiens
uaaggaaccuacaaguuua

SEQ ID NO: 37801 - RNA, 19 nt, Homo sapiens
ggaauuagccuuugagagu

SEQ ID NO: 37802 - RNA, 19 nt, Homo sapiens
caacacccuugucuacuuu

SEQ ID NO: 37803 - RNA, 19 nt, Homo sapiens
ugaacgagcuggauccauu

SEQ ID NO: 37804 - RNA, 19 nt, Homo sapiens
gaucagguaugguuucuag

SEQ ID NO: 37805 - RNA, 19 nt, Homo sapiens
gaacgagcuggauccauua

SEQ ID NO: 37806 - RNA, 19 nt, Homo sapiens
gaaaggcacaguaaggaaa

SEQ ID NO: 37807 - RNA, 19 nt, Homo sapiens
gcacucggagcaugaauuu

SEQ ID NO: 37808 - RNA, 19 nt, Homo sapiens
uuaaggaaccuacaaguuu

SEQ ID NO: 37809 - RNA, 19 nt, Homo sapiens
gaaaccaucgugccuguga

SEQ ID NO: 37810 - RNA, 19 nt, Homo sapiens
ccuacaaguuuaauggaua

SEQ ID NO: 37811 - RNA, 19 nt, Homo sapiens
gguaugguuucuaguggua

SEQ ID NO: 37812 - RNA, 19 nt, Homo sapiens
ggaauggaauauacaaagg

SEQ ID NO: 37813 - RNA, 19 nt, Homo sapiens
uaauagacgugucauccaa

SEQ ID NO: 37814 - RNA, 19 nt, Homo sapiens
gggauaauguggaagagau

SEQ ID NO: 37815 - RNA, 19 nt, Homo sapiens
ccgcaggccucccucuuaa

SEQ ID NO: 37816 - RNA, 19 nt, Homo sapiens
gaaccuacaaguuuaaugg

SEQ ID NO: 37817 - RNA, 19 nt, Homo sapiens
ccgauggccuggaaaggua

SEQ ID NO: 37818 - RNA, 19 nt, Homo sapiens
gaacugcgacucccgaagu

SEQ ID NO: 37819 - RNA, 19 nt, Homo sapiens
gcugcuaugucaccucauu

SEQ ID NO: 37820 - RNA, 19 nt, Homo sapiens
ggacgacagugggucaguu

SEQ ID NO: 37821 - RNA, 19 nt, Homo sapiens
gccaccauccauauaauua

SEQ ID NO: 37822 - RNA, 19 nt, Homo sapiens
ccagcuggacgguugauua

SEQ ID NO: 37823 - RNA, 19 nt, Homo sapiens
uaacacggaauuagccuuu

SEQ ID NO: 37824 - RNA, 19 nt, Homo sapiens
ggccuaauauuguccuaau

SEQ ID NO: 37825 - RNA, 19 nt, Homo sapiens
ggaauccgcgucccaggaa

SEQ ID NO: 37826 - RNA, 19 nt, Homo sapiens
cuccugaucuucuccauga

SEQ ID NO: 37827 - RNA, 19 nt, Homo sapiens
ucacggagcagcccaugaa

SEQ ID NO: 37828 - RNA, 19 nt, Homo sapiens
gcaggccucccucuuaaug

SEQ ID NO: 37829 - RNA, 19 nt, Homo sapiens
acacggaauuagccuuuga

SEQ ID NO: 37830 - RNA, 19 nt, Homo sapiens
ccaacgcccugaaggaaca

SEQ ID NO: 37831 - RNA, 19 nt, Homo sapiens
cagcuggacgguugauuaa

SEQ ID NO: 37832 - RNA, 19 nt, Homo sapiens
uugaugcuaucgaugauuu

SEQ ID NO: 37833 - RNA, 19 nt, Homo sapiens
gcuggacgguugauuaagg

SEQ ID NO: 37834 - RNA, 19 nt, Homo sapiens
ggagggcauuuggaagcua

SEQ ID NO: 37835 - RNA, 19 nt, Homo sapiens
ucugguggcugcuauguca

SEQ ID NO: 37836 - RNA, 19 nt, Homo sapiens
ucacggagggcauuuggaa

SEQ ID NO: 37837 - RNA, 19 nt, Homo sapiens
gacagugggucaguuugga

SEQ ID NO: 37838 - RNA, 19 nt, Homo sapiens
gaauauacaaagguggaaa

SEQ ID NO: 37839 - RNA, 19 nt, Homo sapiens
caacuugguggauggaaug

SEQ ID NO: 37840 - RNA, 19 nt, Homo sapiens
augcagauguuucggagaa

SEQ ID NO: 37841 - RNA, 19 nt, Homo sapiens
gauggaauggaauauacaa

SEQ ID NO: 37842 - RNA, 19 nt, Homo sapiens
cauccucacccuaaccuuu

SEQ ID NO: 37843 - RNA, 19 nt, Homo sapiens
guccuaacgagaagagaua

SEQ ID NO: 37844 - RNA, 19 nt, Homo sapiens
gacgacagugggucaguuu

SEQ ID NO: 37845 - RNA, 19 nt, Homo sapiens
ugacgacaaggccuaauau

SEQ ID NO: 37846 - RNA, 19 nt, Homo sapiens
ccuaauauuguccuaauca

SEQ ID NO: 37847 - RNA, 19 nt, Homo sapiens
uaugucaccucauuaugca

SEQ ID NO: 37848 - RNA, 19 nt, Homo sapiens
uuggaaggcucacuaugug

SEQ ID NO: 37849 - RNA, 19 nt, Homo sapiens
gaauggaauauacaaaggu

SEQ ID NO: 37850 - RNA, 19 nt, Homo sapiens
uggauggaauggaauauac

SEQ ID NO: 37851 - RNA, 19 nt, Homo sapiens
guugaugaccuggguauug

SEQ ID NO: 37852 - RNA, 19 nt, Homo sapiens
auuauggguuugacuacua

SEQ ID NO: 37853 - RNA, 19 nt, Homo sapiens
gacgacaaggccuaauauu

SEQ ID NO: 37854 - RNA, 19 nt, Homo sapiens
cuucaugucuuuggugugu

SEQ ID NO: 37855 - RNA, 19 nt, Homo sapiens
ggguuugacuacuacuaug

SEQ ID NO: 37856 - RNA, 19 nt, Homo sapiens
guggauggaauggaauaua

SEQ ID NO: 37857 - RNA, 19 nt, Homo sapiens
acgacaaggccuaauauug

SEQ ID NO: 37858 - RNA, 19 nt, Homo sapiens
ggccaacgcccugaaggaa

SEQ ID NO: 37859 - RNA, 19 nt, Homo sapiens
gugccaccauccauauaau

SEQ ID NO: 37860 - RNA, 19 nt, Homo sapiens
cuugguggauggaauggaa

SEQ ID NO: 37861 - RNA, 19 nt, Homo sapiens
cauccgaucagguaugguu

SEQ ID NO: 37862 - RNA, 19 nt, Homo sapiens
uagaaaggcacaguaagga

SEQ ID NO: 37863 - RNA, 19 nt, Homo sapiens
ucuccaugauucuguuuau

SEQ ID NO: 37864 - RNA, 19 nt, Homo sapiens
ccagugccaccauccauau

SEQ ID NO: 37865 - RNA, 19 nt, Homo sapiens
uugcagccuugcuaaagaa

SEQ ID NO: 37866 - RNA, 19 nt, Homo sapiens
ugaccuggguauuggagau

SEQ ID NO: 37867 - RNA, 19 nt, Homo sapiens
gauuaaggaaccuacaagu

SEQ ID NO: 37868 - RNA, 19 nt, Homo sapiens
uuggagaucugggcugcua

SEQ ID NO: 37869 - RNA, 19 nt, Homo sapiens
ccaccauccauauaauuau

SEQ ID NO: 37870 - RNA, 19 nt, Homo sapiens
gcaucagugucaggaggaa

SEQ ID NO: 37871 - RNA, 19 nt, Homo sapiens
ucagguaugguuucuagug

SEQ ID NO: 37872 - RNA, 19 nt, Homo sapiens
gcuaaagaagcaaggauac

SEQ ID NO: 37873 - RNA, 19 nt, Homo sapiens
cuugcagccuugcuaaaga

SEQ ID NO: 37874 - RNA, 19 nt, Homo sapiens
ccugugaccuaccaacucu

SEQ ID NO: 37875 - RNA, 19 nt, Homo sapiens
gauucuugaugcuaucgau

SEQ ID NO: 37876 - RNA, 19 nt, Homo sapiens
agaaaggcacaguaaggaa

SEQ ID NO: 37877 - RNA, 19 nt, Homo sapiens
ugaaggaacaccaggaaac

SEQ ID NO: 37878 - RNA, 19 nt, Homo sapiens
gaauccgcgucccaggaau

SEQ ID NO: 37879 - RNA, 19 nt, Homo sapiens
ggaauauacaaagguggaa

SEQ ID NO: 37880 - RNA, 19 nt, Homo sapiens
gaucacggagggcauuugg

SEQ ID NO: 37881 - RNA, 19 nt, Homo sapiens
ggauaauguggaagagaug

SEQ ID NO: 37882 - RNA, 19 nt, Homo sapiens
guaauagacgugucaucca

SEQ ID NO: 37883 - RNA, 19 nt, Homo sapiens
gaccuaccaacucucagaa

SEQ ID NO: 37884 - RNA, 19 nt, Homo sapiens
gcuaugucaccucauuaug

SEQ ID NO: 37885 - RNA, 19 nt, Homo sapiens
ggaaccuacaaguuuaaug

SEQ ID NO: 37886 - RNA, 19 nt, Homo sapiens
ggauggaauggaauauaca

SEQ ID NO: 37887 - RNA, 19 nt, Homo sapiens
gcaugacgacaaggccuaa

SEQ ID NO: 37888 - RNA, 19 nt, Homo sapiens
uaaagaagcaaggauacag

SEQ ID NO: 37889 - RNA, 19 nt, Homo sapiens
acacuugcagccuugcuaa

SEQ ID NO: 37890 - RNA, 19 nt, Homo sapiens
ugaccuaccaacucucaga

SEQ ID NO: 37891 - RNA, 19 nt, Homo sapiens
uuuaccaacugucgcauca

SEQ ID NO: 37892 - RNA, 19 nt, Homo sapiens
cagggugcaugacgacaag

SEQ ID NO: 37893 - RNA, 19 nt, Homo sapiens
ggcacaguaaggaaacuuu

SEQ ID NO: 37894 - RNA, 19 nt, Homo sapiens
uuagaaaggcacaguaagg

SEQ ID NO: 37895 - RNA, 19 nt, Homo sapiens
ggauacagcacggggcuua

SEQ ID NO: 37896 - RNA, 19 nt, Homo sapiens
ccuaccaacucucagaacu

SEQ ID NO: 37897 - RNA, 19 nt, Homo sapiens
ccucuaugauuuugugauu

SEQ ID NO: 37898 - RNA, 19 nt, Homo sapiens
ccucugcucuucgaucucu

SEQ ID NO: 37899 - RNA, 19 nt, Homo sapiens
cuuaaugagacaacacuug

SEQ ID NO: 37900 - RNA, 19 nt, Homo sapiens
caugugugcuucaguguaa

SEQ ID NO: 37901 - RNA, 19 nt, Homo sapiens
gcgaguacaucaaagacaa

SEQ ID NO: 37902 - RNA, 19 nt, Homo sapiens
uaaccaagauuccugucaa

SEQ ID NO: 37903 - RNA, 19 nt, Homo sapiens
caacugcgaguacaucaaa

SEQ ID NO: 37904 - RNA, 19 nt, Homo sapiens
ucugggaccuucucuggua

SEQ ID NO: 37905 - RNA, 19 nt, Homo sapiens
uuugagaccuuccaaguga

SEQ ID NO: 37906 - RNA, 19 nt, Homo sapiens
gugagggccuuuccagaug

SEQ ID NO: 37907 - RNA, 19 nt, Homo sapiens
gugagacucugaauaaagg

SEQ ID NO: 37908 - RNA, 19 nt, Homo sapiens
gcacaaggaguucaaugca

SEQ ID NO: 37909 - RNA, 19 nt, Homo sapiens
guccaggccuccuuugaug

SEQ ID NO: 37910 - RNA, 19 nt, Homo sapiens
gcccuggccuccuuugaug

SEQ ID NO: 37911 - RNA, 19 nt, Homo sapiens
gcaagcacagcaccuacaa

SEQ ID NO: 37912 - RNA, 19 nt, Homo sapiens
ccacuucuccuucaagaca

SEQ ID NO: 37913 - RNA, 19 nt, Homo sapiens
ucaaagacaagaagugcaa

SEQ ID NO: 37914 - RNA, 19 nt, Homo sapiens
cagaccggcugguggagaa

SEQ ID NO: 37915 - RNA, 19 nt, Homo sapiens
ggugagggccuuuccagau

SEQ ID NO: 37916 - RNA, 19 nt, Homo sapiens
ggccuugccaucuggauaa

SEQ ID NO: 37917 - RNA, 19 nt, Homo sapiens
gcaccuacaacugcgagua

SEQ ID NO: 37918 - RNA, 19 nt, Homo sapiens
guacaucaaagacaagaag

SEQ ID NO: 37919 - RNA, 19 nt, Homo sapiens
cagcugcucucccggaucu

SEQ ID NO: 37920 - RNA, 19 nt, Homo sapiens
ugaugucucugcuucuugu

SEQ ID NO: 37921 - RNA, 19 nt, Homo sapiens
caccacuucuccuucaaga

SEQ ID NO: 37922 - RNA, 19 nt, Homo sapiens
uaugaugucucugcuucuu

SEQ ID NO: 37923 - RNA, 19 nt, Homo sapiens
gagacaaucuggggacuga

SEQ ID NO: 37924 - RNA, 19 nt, Homo sapiens
ggagaaacaggagacaauc

SEQ ID NO: 37925 - RNA, 19 nt, Homo sapiens
ucucugcagucuggucuuu

SEQ ID NO: 37926 - RNA, 19 nt, Homo sapiens
ucaagacacuccauuuccu

SEQ ID NO: 37927 - RNA, 19 nt, Homo sapiens
gagaaacaggagacaaucu

SEQ ID NO: 37928 - RNA, 19 nt, Homo sapiens
ggccuccuuugaugcauga

SEQ ID NO: 37929 - RNA, 19 nt, Homo sapiens
cuugccaucuggauaauuc

SEQ ID NO: 37930 - RNA, 19 nt, Homo sapiens
uccauuuccugcugacuga

SEQ ID NO: 37931 - RNA, 19 nt, Homo sapiens
gguccaggccuccuuugau

SEQ ID NO: 37932 - RNA, 19 nt, Homo sapiens
gaugguccaggccuccuuu

SEQ ID NO: 37933 - RNA, 19 nt, Homo sapiens
gggccuugccaucuggaua

SEQ ID NO: 37934 - RNA, 19 nt, Homo sapiens
gaggaaacugagacccaaa

SEQ ID NO: 37935 - RNA, 19 nt, Homo sapiens
cccacuaccuccaccacuu

SEQ ID NO: 37936 - RNA, 19 nt, Homo sapiens
aaccaagauuccugucaau

SEQ ID NO: 37937 - RNA, 19 nt, Homo sapiens
guaaccaagauuccuguca

SEQ ID NO: 37938 - RNA, 19 nt, Homo sapiens
caggacaaggccuagauga

SEQ ID NO: 37939 - RNA, 19 nt, Homo sapiens
uggagaaacaggagacaau

SEQ ID NO: 37940 - RNA, 19 nt, Homo sapiens
ccaugugugcuucagugua

SEQ ID NO: 37941 - RNA, 19 nt, Homo sapiens
gccuagaugaggaaacuga

SEQ ID NO: 37942 - RNA, 19 nt, Homo sapiens
gagaggaagaggugcugau

SEQ ID NO: 37943 - RNA, 19 nt, Homo sapiens
ccacuaccuccaccacuuc

SEQ ID NO: 37944 - RNA, 19 nt, Homo sapiens
agaaacaggagacaaucug

SEQ ID NO: 37945 - RNA, 19 nt, Homo sapiens
cuucaagacacuccauuuc

SEQ ID NO: 37946 - RNA, 19 nt, Homo sapiens
ccaaauaccugaagauaaa

SEQ ID NO: 37947 - RNA, 19 nt, Homo sapiens
gaaaguugguccagauaua

SEQ ID NO: 37948 - RNA, 19 nt, Homo sapiens
ggugaaggcugaaguguua

SEQ ID NO: 37949 - RNA, 19 nt, Homo sapiens
gaauagcccugauggcaua

SEQ ID NO: 37950 - RNA, 19 nt, Homo sapiens
ggaaauaucaacaauccua

SEQ ID NO: 37951 - RNA, 19 nt, Homo sapiens
ccagauauaugucacagaa

SEQ ID NO: 37952 - RNA, 19 nt, Homo sapiens
guaguuugaugcauuguuu

SEQ ID NO: 37953 - RNA, 19 nt, Homo sapiens
cuacaacccuggugagaaa

SEQ ID NO: 37954 - RNA, 19 nt, Homo sapiens
gauaaugcauuugaugaug

SEQ ID NO: 37955 - RNA, 19 nt, Homo sapiens
ucacagaacuuuucacuug

SEQ ID NO: 37956 - RNA, 19 nt, Homo sapiens
gaugaauaccugaaaugua

SEQ ID NO: 37957 - RNA, 19 nt, Homo sapiens
ugaagaccauggugugaaa

SEQ ID NO: 37958 - RNA, 19 nt, Homo sapiens
ugaagaccauggugagaaa

SEQ ID NO: 37959 - RNA, 19 nt, Homo sapiens
gcacuucauuuacauuugg

SEQ ID NO: 37960 - RNA, 19 nt, Homo sapiens
caaagucacuggauaaaau

SEQ ID NO: 37961 - RNA, 19 nt, Homo sapiens
caacaucccauccugaaga

SEQ ID NO: 37962 - RNA, 19 nt, Homo sapiens
gaugaugaauaccugaaau

SEQ ID NO: 37963 - RNA, 19 nt, Homo sapiens
cauggcagauaaugcauuu

SEQ ID NO: 37964 - RNA, 19 nt, Homo sapiens
ggauggaaauuaaauacgu

SEQ ID NO: 37965 - RNA, 19 nt, Homo sapiens
ggacaggauggaaauuaaa

SEQ ID NO: 37966 - RNA, 19 nt, Homo sapiens
cggacaggauggaaauuaa

SEQ ID NO: 37967 - RNA, 19 nt, Homo sapiens
ucagaaaguugguccagau

SEQ ID NO: 37968 - RNA, 19 nt, Homo sapiens
ugaagaccauagugagaaa

SEQ ID NO: 37969 - RNA, 19 nt, Homo sapiens
aacaagaccugcagccauu

SEQ ID NO: 37970 - RNA, 19 nt, Homo sapiens
gcuauaaaucucuuuguug

SEQ ID NO: 37971 - RNA, 19 nt, Homo sapiens
gcagauaaugcauuugaug

SEQ ID NO: 37972 - RNA, 19 nt, Homo sapiens
uguuagacauggcagauaa

SEQ ID NO: 37973 - RNA, 19 nt, Homo sapiens
ccagggcacuucauuuaca

SEQ ID NO: 37974 - RNA, 19 nt, Homo sapiens
gaacaagccagggcacuuc

SEQ ID NO: 37975 - RNA, 19 nt, Homo sapiens
acacaugccuuggaguuga

SEQ ID NO: 37976 - RNA, 19 nt, Homo sapiens
guauacuacucuuacaaug

SEQ ID NO: 37977 - RNA, 19 nt, Homo sapiens
aaucaguguuucugcuaua

SEQ ID NO: 37978 - RNA, 19 nt, Homo sapiens
gcccugauggcauauauuu

SEQ ID NO: 37979 - RNA, 19 nt, Homo sapiens
cuucaaagcauaaacaaga

SEQ ID NO: 37980 - RNA, 19 nt, Homo sapiens
ucaaaucuuucucccuaug

SEQ ID NO: 37981 - RNA, 19 nt, Homo sapiens
auacuacucuuacaaugga

SEQ ID NO: 37982 - RNA, 19 nt, Homo sapiens
ggccaaagucacuggauaa

SEQ ID NO: 37983 - RNA, 19 nt, Homo sapiens
cacuuaaacuuccuccaaa

SEQ ID NO: 37984 - RNA, 19 nt, Homo sapiens
cagugaagcugugaagaug

SEQ ID NO: 37985 - RNA, 19 nt, Homo sapiens
uaaggauaaccauggaaua

SEQ ID NO: 37986 - RNA, 19 nt, Homo sapiens
cagauaaugcauuugauga

SEQ ID NO: 37987 - RNA, 19 nt, Homo sapiens
ccaaaacugugguauauag

SEQ ID NO: 37988 - RNA, 19 nt, Homo sapiens
caagagcccugcaguugcu

SEQ ID NO: 37989 - RNA, 19 nt, Homo sapiens
uggccaaagucacuggaua

SEQ ID NO: 37990 - RNA, 19 nt, Homo sapiens
ccaaaccucaggcugcuaa

SEQ ID NO: 37991 - RNA, 19 nt, Homo sapiens
cacaagagcccugcaguug

SEQ ID NO: 37992 - RNA, 19 nt, Homo sapiens
augaauaccugaaauguac

SEQ ID NO: 37993 - RNA, 19 nt, Homo sapiens
gaagauaaaagucaaggaa

SEQ ID NO: 37994 - RNA, 19 nt, Homo sapiens
gggcacuucauuuacauuu

SEQ ID NO: 37995 - RNA, 19 nt, Homo sapiens
ucacuuaaacuuccuccaa

SEQ ID NO: 37996 - RNA, 19 nt, Homo sapiens
guacggacaggauggaaau

SEQ ID NO: 37997 - RNA, 19 nt, Homo sapiens
cagaaaguugguccagaua

SEQ ID NO: 37998 - RNA, 19 nt, Homo sapiens
caguguuucugcuauaaau

SEQ ID NO: 37999 - RNA, 19 nt, Homo sapiens
agccagggcacuucauuua

SEQ ID NO: 38000 - RNA, 19 nt, Homo sapiens
gcccugcaguugcugagaa

SEQ ID NO: 38001 - RNA, 19 nt, Homo sapiens
ccacccaaauaccugaaga

SEQ ID NO: 38002 - RNA, 19 nt, Homo sapiens
cccaaauaccugaagauaa

SEQ ID NO: 38003 - RNA, 19 nt, Homo sapiens
ccuuauccuucaaagcaua

SEQ ID NO: 38004 - RNA, 19 nt, Homo sapiens
ucacuguguuauccaucua

SEQ ID NO: 38005 - RNA, 19 nt, Homo sapiens
gcaagccaccagcaauuag

SEQ ID NO: 38006 - RNA, 19 nt, Homo sapiens
gaagacuugcuuaccacaa

SEQ ID NO: 38007 - RNA, 19 nt, Homo sapiens
uaaucaguguuucugcuau

SEQ ID NO: 38008 - RNA, 19 nt, Homo sapiens
ccuugaacccacccaaaua

SEQ ID NO: 38009 - RNA, 19 nt, Homo sapiens
cuaaugaccagcucacugu

SEQ ID NO: 38010 - RNA, 19 nt, Homo sapiens
ucacaagagcccugcaguu

SEQ ID NO: 38011 - RNA, 19 nt, Homo sapiens
uuuaccaucuguucaguga

SEQ ID NO: 38012 - RNA, 19 nt, Homo sapiens
gacaggauggaaauuaaau

SEQ ID NO: 38013 - RNA, 19 nt, Homo sapiens
ucacuuguauacuacucuu

SEQ ID NO: 38014 - RNA, 19 nt, Homo sapiens
cuacacaugccuuggaguu

SEQ ID NO: 38015 - RNA, 19 nt, Homo sapiens
ccugaagacuugcuuacca

SEQ ID NO: 38016 - RNA, 19 nt, Homo sapiens
caaaucuuucucccuauga

SEQ ID NO: 38017 - RNA, 19 nt, Homo sapiens
uggcagauaaugcauuuga

SEQ ID NO: 38018 - RNA, 19 nt, Homo sapiens
agauauaugucacagaacu

SEQ ID NO: 38019 - RNA, 19 nt, Homo sapiens
gaugcauuguuuaucuuuc

SEQ ID NO: 38020 - RNA, 19 nt, Homo sapiens
aaggaaauaucaacaaucc

SEQ ID NO: 38021 - RNA, 19 nt, Homo sapiens
ccuuggaguugacauugaa

SEQ ID NO: 38022 - RNA, 19 nt, Homo sapiens
ggcacuucauuuacauuug

SEQ ID NO: 38023 - RNA, 19 nt, Homo sapiens
ggccuagcaucacuuaaac

SEQ ID NO: 38024 - RNA, 19 nt, Homo sapiens
uuaugagugugcauuucua

SEQ ID NO: 38025 - RNA, 19 nt, Homo sapiens
cugcagccauuaugagugu

SEQ ID NO: 38026 - RNA, 19 nt, Homo sapiens
gccuuggaguugacauuga

SEQ ID NO: 38027 - RNA, 19 nt, Homo sapiens
caaggaaauaucaacaauc

SEQ ID NO: 38028 - RNA, 19 nt, Homo sapiens
caagccagggcacuucauu

SEQ ID NO: 38029 - RNA, 19 nt, Homo sapiens
ucagugaagcugugaagau

SEQ ID NO: 38030 - RNA, 19 nt, Homo sapiens
aaaucuuucucccuaugaa

SEQ ID NO: 38031 - RNA, 19 nt, Homo sapiens
ugaaauguacggacaggau

SEQ ID NO: 38032 - RNA, 19 nt, Homo sapiens
agacauggcagauaaugca

SEQ ID NO: 38033 - RNA, 19 nt, Homo sapiens
ccagaagcuugaagaccau

SEQ ID NO: 38034 - RNA, 19 nt, Homo sapiens
ccagaagcuugaagaccau

SEQ ID NO: 38035 - RNA, 19 nt, Homo sapiens
aaacugugguauauagaac

SEQ ID NO: 38036 - RNA, 19 nt, Homo sapiens
aagcaagccaccagcaauu

SEQ ID NO: 38037 - RNA, 19 nt, Homo sapiens
gccaaagucacuggauaaa

SEQ ID NO: 38038 - RNA, 19 nt, Homo sapiens
cacaggagaucaaaaggaa

SEQ ID NO: 38039 - RNA, 19 nt, Homo sapiens
caacccaucuaugucuaca

SEQ ID NO: 38040 - RNA, 19 nt, Homo sapiens
aaacuguauugagaaccua

SEQ ID NO: 38041 - RNA, 19 nt, Homo sapiens
gcauuucuagguggacuaa

SEQ ID NO: 38042 - RNA, 19 nt, Homo sapiens
caagccaccagcaauuaga

SEQ ID NO: 38043 - RNA, 19 nt, Homo sapiens
gauauaugucacagaacuu

SEQ ID NO: 38044 - RNA, 19 nt, Homo sapiens
aaaguugguccagauauau

SEQ ID NO: 38045 - RNA, 19 nt, Homo sapiens
ugaggccuagcaucacuua

SEQ ID NO: 38046 - RNA, 19 nt, Homo sapiens
gcaaacagguuauggagaa

SEQ ID NO: 38047 - RNA, 19 nt, Homo sapiens
cgaaggauguccacuuuaa

SEQ ID NO: 38048 - RNA, 19 nt, Homo sapiens
guucugagguugcaauuaa

SEQ ID NO: 38049 - RNA, 19 nt, Homo sapiens
ccacaucccuccugaaaga

SEQ ID NO: 38050 - RNA, 19 nt, Homo sapiens
gacgaaggauguccacuuu

SEQ ID NO: 38051 - RNA, 19 nt, Homo sapiens
ccuaugagcuguuuaaagu

SEQ ID NO: 38052 - RNA, 19 nt, Homo sapiens
ggagaacucugagaauuca

SEQ ID NO: 38053 - RNA, 19 nt, Homo sapiens
gaaaucuuguggcuccuuu

SEQ ID NO: 38054 - RNA, 19 nt, Homo sapiens
uagaagcccagaagaauua

SEQ ID NO: 38055 - RNA, 19 nt, Homo sapiens
gaacguucauuccacuuca

SEQ ID NO: 38056 - RNA, 19 nt, Homo sapiens
caaaggagaacucugagaa

SEQ ID NO: 38057 - RNA, 19 nt, Homo sapiens
ggaaagacagcaucaugga

SEQ ID NO: 38058 - RNA, 19 nt, Homo sapiens
ggacuccacagcaguauga

SEQ ID NO: 38059 - RNA, 19 nt, Homo sapiens
guucauuccacuucaaaua

SEQ ID NO: 38060 - RNA, 19 nt, Homo sapiens
aaggagaacucugagaauu

SEQ ID NO: 38061 - RNA, 19 nt, Homo sapiens
gaggaaagacagcaucaug

SEQ ID NO: 38062 - RNA, 19 nt, Homo sapiens
guaccaaggcuguagcaaa

SEQ ID NO: 38063 - RNA, 19 nt, Homo sapiens
caacagaugcaagaagauu

SEQ ID NO: 38064 - RNA, 19 nt, Homo sapiens
caaaggagaaguacuugug

SEQ ID NO: 38065 - RNA, 19 nt, Homo sapiens
gggcaaaggagaaguacuu

SEQ ID NO: 38066 - RNA, 19 nt, Homo sapiens
gggaaccagacacuauuua

SEQ ID NO: 38067 - RNA, 19 nt, Homo sapiens
cagacacuauuuaccauau

SEQ ID NO: 38068 - RNA, 19 nt, Homo sapiens
cggaugagacugaaagaaa

SEQ ID NO: 38069 - RNA, 19 nt, Homo sapiens
gacacuauuuaccauauuc

SEQ ID NO: 38070 - RNA, 19 nt, Homo sapiens
ggaugagacugaaagaaaa

SEQ ID NO: 38071 - RNA, 19 nt, Homo sapiens
gaaagaaaaccucaaagga

SEQ ID NO: 38072 - RNA, 19 nt, Homo sapiens
augcaucccugauccuaua

SEQ ID NO: 38073 - RNA, 19 nt, Homo sapiens
uauugcaucucucuccuuu

SEQ ID NO: 38074 - RNA, 19 nt, Homo sapiens
ccucaaaggagaacucuga

SEQ ID NO: 38075 - RNA, 19 nt, Homo sapiens
caagggcaaaggagaagua

SEQ ID NO: 38076 - RNA, 19 nt, Homo sapiens
ggaaccugagcacauauaa

SEQ ID NO: 38077 - RNA, 19 nt, Homo sapiens
gccaauuccuuuccacauc

SEQ ID NO: 38078 - RNA, 19 nt, Homo sapiens
caaacagguuauggagaaa

SEQ ID NO: 38079 - RNA, 19 nt, Homo sapiens
cauagaagcccagaagaau

SEQ ID NO: 38080 - RNA, 19 nt, Homo sapiens
gaaggauguccacuuuaau

SEQ ID NO: 38081 - RNA, 19 nt, Homo sapiens
cugggaaccugagcacaua

SEQ ID NO: 38082 - RNA, 19 nt, Homo sapiens
ccacagcaguaugaacguu

SEQ ID NO: 38083 - RNA, 19 nt, Homo sapiens
gggauuauuucacaaaaga

SEQ ID NO: 38084 - RNA, 19 nt, Homo sapiens
uaccaaggcuguagcaaac

SEQ ID NO: 38085 - RNA, 19 nt, Homo sapiens
guccauugaucaacagaug

SEQ ID NO: 38086 - RNA, 19 nt, Homo sapiens
gggaaccugagcacauaua

SEQ ID NO: 38087 - RNA, 19 nt, Homo sapiens
cgauuuggccaauuccuuu

SEQ ID NO: 38088 - RNA, 19 nt, Homo sapiens
ccacuuuaaugccuacaca

SEQ ID NO: 38089 - RNA, 19 nt, Homo sapiens
ccagacacuauuuaccaua

SEQ ID NO: 38090 - RNA, 19 nt, Homo sapiens
ccaggacuccacagcagua

SEQ ID NO: 38091 - RNA, 19 nt, Homo sapiens
gaccagugucaucaucuuu

SEQ ID NO: 38092 - RNA, 19 nt, Homo sapiens
agaagaggcacaggaguuu

SEQ ID NO: 38093 - RNA, 19 nt, Homo sapiens
acauagaagcccagaagaa

SEQ ID NO: 38094 - RNA, 19 nt, Homo sapiens
gcaaaggagaaguacuugu

SEQ ID NO: 38095 - RNA, 19 nt, Homo sapiens
gaucaacagaugcaagaag

SEQ ID NO: 38096 - RNA, 19 nt, Homo sapiens
ggaaccagacacuauuuac

SEQ ID NO: 38097 - RNA, 19 nt, Homo sapiens
gaagaggcacaggaguuug

SEQ ID NO: 38098 - RNA, 19 nt, Homo sapiens
gagaaucuggcuccuugga

SEQ ID NO: 38099 - RNA, 19 nt, Homo sapiens
aagcccagaagaauuauuu

SEQ ID NO: 38100 - RNA, 19 nt, Homo sapiens
agacauagaagcccagaag

SEQ ID NO: 38101 - RNA, 19 nt, Homo sapiens
guagcaaacagguuaugga

SEQ ID NO: 38102 - RNA, 19 nt, Homo sapiens
caagaaaugcaucccugau

SEQ ID NO: 38103 - RNA, 19 nt, Homo sapiens
aagaagaggcacaggaguu

SEQ ID NO: 38104 - RNA, 19 nt, Homo sapiens
cagguuauggagaaacuaa

SEQ ID NO: 38105 - RNA, 19 nt, Homo sapiens
gcaccagguucuuuugaug

SEQ ID NO: 38106 - RNA, 19 nt, Homo sapiens
caaaagcagaguauaaaga

SEQ ID NO: 38107 - RNA, 19 nt, Homo sapiens
aaaggagaaguacuuguga

SEQ ID NO: 38108 - RNA, 19 nt, Homo sapiens
cuauagcuauugcaucucu

SEQ ID NO: 38109 - RNA, 19 nt, Homo sapiens
gaucaguaccaaggcugua

SEQ ID NO: 38110 - RNA, 19 nt, Homo sapiens
aucaacagaugcaagaaga

SEQ ID NO: 38111 - RNA, 19 nt, Homo sapiens
cauucgauuuggccaauuc

SEQ ID NO: 38112 - RNA, 19 nt, Homo sapiens
uaacucaaggggauuauuu

SEQ ID NO: 38113 - RNA, 19 nt, Homo sapiens
aaggauguccacuuuaaug

SEQ ID NO: 38114 - RNA, 19 nt, Homo sapiens
aagacagcaucauggagaa

SEQ ID NO: 38115 - RNA, 19 nt, Homo sapiens
aaaggagaacucugagaau

SEQ ID NO: 38116 - RNA, 19 nt, Homo sapiens
caguacuucucccucaaga

SEQ ID NO: 38117 - RNA, 19 nt, Homo sapiens
caucccuccugaaagaaga

SEQ ID NO: 38118 - RNA, 19 nt, Homo sapiens
auagaagcccagaagaauu

SEQ ID NO: 38119 - RNA, 19 nt, Homo sapiens
ucaaggggauuauuucaca

SEQ ID NO: 38120 - RNA, 19 nt, Homo sapiens
uccuauagcuauugcaucu

SEQ ID NO: 38121 - RNA, 19 nt, Homo sapiens
gaaccugagcacauauaac

SEQ ID NO: 38122 - RNA, 19 nt, Homo sapiens
uuggaggccugcugccauu

SEQ ID NO: 38123 - RNA, 19 nt, Homo sapiens
cauucugacuuuacuagag

SEQ ID NO: 38124 - RNA, 19 nt, Homo sapiens
gcccagaagaauuauuuua

SEQ ID NO: 38125 - RNA, 19 nt, Homo sapiens
gacauagaagcccagaaga

SEQ ID NO: 38126 - RNA, 19 nt, Homo sapiens
gaagcccagaagaauuauu

SEQ ID NO: 38127 - RNA, 19 nt, Homo sapiens
gauccuauagcuauugcau

SEQ ID NO: 38128 - RNA, 19 nt, Homo sapiens
ucccugauccuauagcuau

SEQ ID NO: 38129 - RNA, 19 nt, Homo sapiens
ugggugcaccuguacagua

SEQ ID NO: 38130 - RNA, 19 nt, Homo sapiens
gaacucugagaauucaucu

SEQ ID NO: 38131 - RNA, 19 nt, Homo sapiens
ucaaaggagaacucugaga

SEQ ID NO: 38132 - RNA, 19 nt, Homo sapiens
cgacuucgcaccagguucu

SEQ ID NO: 38133 - RNA, 19 nt, Homo sapiens
gaaccagacacuauuuacc

SEQ ID NO: 38134 - RNA, 19 nt, Homo sapiens
ugugcuaugaggugcauua

SEQ ID NO: 38135 - RNA, 19 nt, Homo sapiens
gaugagaaucuggcuccuu

SEQ ID NO: 38136 - RNA, 19 nt, Homo sapiens
ccugagcacauauaacugu

SEQ ID NO: 38137 - RNA, 19 nt, Homo sapiens
uaugagcuaccacccaaga

SEQ ID NO: 38138 - RNA, 19 nt, Homo sapiens
cugccugggugcaccugua

SEQ ID NO: 38139 - RNA, 19 nt, Homo sapiens
uacaguacuucucccucaa

SEQ ID NO: 38140 - RNA, 19 nt, Homo sapiens
gacagcaucauggagaaug

SEQ ID NO: 38141 - RNA, 19 nt, Homo sapiens
ugaguuagcuguuuacuga

SEQ ID NO: 38142 - RNA, 19 nt, Homo sapiens
gaaggacacugacaacaag

SEQ ID NO: 38143 - RNA, 19 nt, Homo sapiens
aaagaaggauggugagaug

SEQ ID NO: 38144 - RNA, 19 nt, Homo sapiens
gaacuuggacuucuaaagg

SEQ ID NO: 38145 - RNA, 19 nt, Homo sapiens
ggaaggacacugacaacaa

SEQ ID NO: 38146 - RNA, 19 nt, Homo sapiens
ggccugaguuagcuguuua

SEQ ID NO: 38147 - RNA, 19 nt, Homo sapiens
gggcuuggaucguggaaga

SEQ ID NO: 38148 - RNA, 19 nt, Homo sapiens
gagauggaccggaacuuug

SEQ ID NO: 38149 - RNA, 19 nt, Homo sapiens
gaaagaaggauggugagau

SEQ ID NO: 38150 - RNA, 19 nt, Homo sapiens
gaacugcgugugcaucaug

SEQ ID NO: 38151 - RNA, 19 nt, Homo sapiens
uguggaaccugucauccua

SEQ ID NO: 38152 - RNA, 19 nt, Homo sapiens
gcuuugagcugcuguacca

SEQ ID NO: 38153 - RNA, 19 nt, Homo sapiens
ggugaccacucggacagua

SEQ ID NO: 38154 - RNA, 19 nt, Homo sapiens
acaagucgguggagaacug

SEQ ID NO: 38155 - RNA, 19 nt, Homo sapiens
ccacuucccaugugucuau

SEQ ID NO: 38156 - RNA, 19 nt, Homo sapiens
gcucaacaccauccacgaa

SEQ ID NO: 38157 - RNA, 19 nt, Homo sapiens
gcacacccacuucccaugu

SEQ ID NO: 38158 - RNA, 19 nt, Homo sapiens
gaugaugccagcugcuuug

SEQ ID NO: 38159 - RNA, 19 nt, Homo sapiens
gggcaaggaagcuuuggaa

SEQ ID NO: 38160 - RNA, 19 nt, Homo sapiens
ggaaagaaggauggugaga

SEQ ID NO: 38161 - RNA, 19 nt, Homo sapiens
gacuauugguaaacaccua

SEQ ID NO: 38162 - RNA, 19 nt, Homo sapiens
cgugguaccuugcagaaag

SEQ ID NO: 38163 - RNA, 19 nt, Homo sapiens
ucaacaccauccacgaaau

SEQ ID NO: 38164 - RNA, 19 nt, Homo sapiens
ugagauggaccggaacuuu

SEQ ID NO: 38165 - RNA, 19 nt, Homo sapiens
gaggcaagaaggccaaaga

SEQ ID NO: 38166 - RNA, 19 nt, Homo sapiens
gacauggugcuguguguga

SEQ ID NO: 38167 - RNA, 19 nt, Homo sapiens
ggaugaugccagcugcuuu

SEQ ID NO: 38168 - RNA, 19 nt, Homo sapiens
gagaacugcgugugcauca

SEQ ID NO: 38169 - RNA, 19 nt, Homo sapiens
aauuaaagcagcaaaggaa

SEQ ID NO: 38170 - RNA, 19 nt, Homo sapiens
cguauggcuuggaggauga

SEQ ID NO: 38171 - RNA, 19 nt, Homo sapiens
ugacucagaaacagaagaa

SEQ ID NO: 38172 - RNA, 19 nt, Homo sapiens
caacaccauccacgaaauc

SEQ ID NO: 38173 - RNA, 19 nt, Homo sapiens
ccgcgacacugacaacaag

SEQ ID NO: 38174 - RNA, 19 nt, Homo sapiens
gugguaccuugcagaaaga

SEQ ID NO: 38175 - RNA, 19 nt, Homo sapiens
caacgagguccgugagcuu

SEQ ID NO: 38176 - RNA, 19 nt, Homo sapiens
ucccaugugucuauuguca

SEQ ID NO: 38177 - RNA, 19 nt, Homo sapiens
ggucauggaggacugcaau

SEQ ID NO: 38178 - RNA, 19 nt, Homo sapiens
gcccagccucuuguucuua

SEQ ID NO: 38179 - RNA, 19 nt, Homo sapiens
ggcccagccucuuguucuu

SEQ ID NO: 38180 - RNA, 19 nt, Homo sapiens
gggaaagaacuuggacuuc

SEQ ID NO: 38181 - RNA, 19 nt, Homo sapiens
ccgccuaccugcagcaucu

SEQ ID NO: 38182 - RNA, 19 nt, Homo sapiens
uacaaggagcugcguggua

SEQ ID NO: 38183 - RNA, 19 nt, Homo sapiens
cgccauggcugagcuugug

SEQ ID NO: 38184 - RNA, 19 nt, Homo sapiens
agauggaccggaacuuuga

SEQ ID NO: 38185 - RNA, 19 nt, Homo sapiens
augcugaucuucccucaag

SEQ ID NO: 38186 - RNA, 19 nt, Homo sapiens
acaacaagucgguggagaa

SEQ ID NO: 38187 - RNA, 19 nt, Homo sapiens
ucacuggcacccuguggaa

SEQ ID NO: 38188 - RNA, 19 nt, Homo sapiens
aaauuaaagcagcaaagga

SEQ ID NO: 38189 - RNA, 19 nt, Homo sapiens
gucgggacaugcugaucuu

SEQ ID NO: 38190 - RNA, 19 nt, Homo sapiens
gcgcaacaaagaccucauc

SEQ ID NO: 38191 - RNA, 19 nt, Homo sapiens
ccuaccacgugcacaagga

SEQ ID NO: 38192 - RNA, 19 nt, Homo sapiens
guucgugacucagaaacag

SEQ ID NO: 38193 - RNA, 19 nt, Homo sapiens
gagccuugagggcgagaaa

SEQ ID NO: 38194 - RNA, 19 nt, Homo sapiens
ucaccaagacugucaagac

SEQ ID NO: 38195 - RNA, 19 nt, Homo sapiens
acggagagccggaacuuca

SEQ ID NO: 38196 - RNA, 19 nt, Homo sapiens
caacaagucgguggagaac

SEQ ID NO: 38197 - RNA, 19 nt, Homo sapiens
gaaugugagcuccgauggu

SEQ ID NO: 38198 - RNA, 19 nt, Homo sapiens
uggaaccugucauccuaug

SEQ ID NO: 38199 - RNA, 19 nt, Homo sapiens
ucacggagagccggaacuu

SEQ ID NO: 38200 - RNA, 19 nt, Homo sapiens
agaaggauggugagaugga

SEQ ID NO: 38201 - RNA, 19 nt, Homo sapiens
caccauaaaucuugacuua

SEQ ID NO: 38202 - RNA, 19 nt, Homo sapiens
gaaaucaaacugcuuauga

SEQ ID NO: 38203 - RNA, 19 nt, Homo sapiens
ucaacaagcugaccguaua

SEQ ID NO: 38204 - RNA, 19 nt, Homo sapiens
ggucauaacugagcaacua

SEQ ID NO: 38205 - RNA, 19 nt, Homo sapiens
uauaugaacucgaugcuaa

SEQ ID NO: 38206 - RNA, 19 nt, Homo sapiens
aaacacagccgcuuaauga

SEQ ID NO: 38207 - RNA, 19 nt, Homo sapiens
gaagugaacccauauuuua

SEQ ID NO: 38208 - RNA, 19 nt, Homo sapiens
uuucuaaccuucacgauua

SEQ ID NO: 38209 - RNA, 19 nt, Homo sapiens
gaaguaaucaguaugcaaa

SEQ ID NO: 38210 - RNA, 19 nt, Homo sapiens
gcaccaaugcuaaagguua

SEQ ID NO: 38211 - RNA, 19 nt, Homo sapiens
gacauucaccuguauauuu

SEQ ID NO: 38212 - RNA, 19 nt, Homo sapiens
ugaagaagccaagaauuua

SEQ ID NO: 38213 - RNA, 19 nt, Homo sapiens
gguggaacauaaauaauga

SEQ ID NO: 38214 - RNA, 19 nt, Homo sapiens
gaaaauagcacaaguuaug

SEQ ID NO: 38215 - RNA, 19 nt, Homo sapiens
uaauugaaguguucccuuu

SEQ ID NO: 38216 - RNA, 19 nt, Homo sapiens
gaacguuucaguauaaaug

SEQ ID NO: 38217 - RNA, 19 nt, Homo sapiens
ggacugcccugacccuugu

SEQ ID NO: 38218 - RNA, 19 nt, Homo sapiens
uaccaaaggucaauucgaa

SEQ ID NO: 38219 - RNA, 19 nt, Homo sapiens
gaagaagccaagaauuuau

SEQ ID NO: 38220 - RNA, 19 nt, Homo sapiens
uagcacaaguuaugaagaa

SEQ ID NO: 38221 - RNA, 19 nt, Homo sapiens
aaacagucaucuagaauuc

SEQ ID NO: 38222 - RNA, 19 nt, Homo sapiens
gaacacugcagcugucuga

SEQ ID NO: 38223 - RNA, 19 nt, Homo sapiens
guacagaggugcaguucca

SEQ ID NO: 38224 - RNA, 19 nt, Homo sapiens
gaggugcaguuccauggua

SEQ ID NO: 38225 - RNA, 19 nt, Homo sapiens
aauaggaagugaacccaua

SEQ ID NO: 38226 - RNA, 19 nt, Homo sapiens
ggacagaggacugcagaaa

SEQ ID NO: 38227 - RNA, 19 nt, Homo sapiens
ucagaaaucaaacugcuua

SEQ ID NO: 38228 - RNA, 19 nt, Homo sapiens
gaagacaccaucuccaugu

SEQ ID NO: 38229 - RNA, 19 nt, Homo sapiens
ggauguauaugaacucgau

SEQ ID NO: 38230 - RNA, 19 nt, Homo sapiens
caacaaaacugucuucaag

SEQ ID NO: 38231 - RNA, 19 nt, Homo sapiens
gaaagaugccauguggaua

SEQ ID NO: 38232 - RNA, 19 nt, Homo sapiens
aaacauggauuuuggagua

SEQ ID NO: 38233 - RNA, 19 nt, Homo sapiens
gaggaaacacagccgcuua

SEQ ID NO: 38234 - RNA, 19 nt, Homo sapiens
gaaagaaagaugccaugug

SEQ ID NO: 38235 - RNA, 19 nt, Homo sapiens
cuugauagauguuaccaaa

SEQ ID NO: 38236 - RNA, 19 nt, Homo sapiens
gaaacacagccgcuuaaug

SEQ ID NO: 38237 - RNA, 19 nt, Homo sapiens
gcuaaagguuauagugaau

SEQ ID NO: 38238 - RNA, 19 nt, Homo sapiens
guacgucauuugugcaaga

SEQ ID NO: 38239 - RNA, 19 nt, Homo sapiens
ggauaggguuccucacuag

SEQ ID NO: 38240 - RNA, 19 nt, Homo sapiens
guaaaacagucaucuagaa

SEQ ID NO: 38241 - RNA, 19 nt, Homo sapiens
gcacacgucuggccuacag

SEQ ID NO: 38242 - RNA, 19 nt, Homo sapiens
gaaaggaaucauuggaugu

SEQ ID NO: 38243 - RNA, 19 nt, Homo sapiens
gguaugugguacaaacaaa

SEQ ID NO: 38244 - RNA, 19 nt, Homo sapiens
ggaaucauuggauguauau

SEQ ID NO: 38245 - RNA, 19 nt, Homo sapiens
ugacaaggcaccaaugcua

SEQ ID NO: 38246 - RNA, 19 nt, Homo sapiens
cagaacgccugcaaagaug

SEQ ID NO: 38247 - RNA, 19 nt, Homo sapiens
ugacuuaccacccuacaaa

SEQ ID NO: 38248 - RNA, 19 nt, Homo sapiens
aauaguagcagaagacaaa

SEQ ID NO: 38249 - RNA, 19 nt, Homo sapiens
ggagagauuauuucauuca

SEQ ID NO: 38250 - RNA, 19 nt, Homo sapiens
gauuaacugugaaauguac

SEQ ID NO: 38251 - RNA, 19 nt, Homo sapiens
gugaguaacgggacaguaa

SEQ ID NO: 38252 - RNA, 19 nt, Homo sapiens
ugaccaagaccaagauauu

SEQ ID NO: 38253 - RNA, 19 nt, Homo sapiens
ccaagaauuuauugaccaa

SEQ ID NO: 38254 - RNA, 19 nt, Homo sapiens
cagcacgucugugugagua

SEQ ID NO: 38255 - RNA, 19 nt, Homo sapiens
guccaucuguugacaaaug

SEQ ID NO: 38256 - RNA, 19 nt, Homo sapiens
aaggucaauucgaaacuua

SEQ ID NO: 38257 - RNA, 19 nt, Homo sapiens
gaugguaugugguacaaac

SEQ ID NO: 38258 - RNA, 19 nt, Homo sapiens
uuucuuggguggaacauaa

SEQ ID NO: 38259 - RNA, 19 nt, Homo sapiens
gacaaggcaccaaugcuaa

SEQ ID NO: 38260 - RNA, 19 nt, Homo sapiens
caagaccguuuguccacuu

SEQ ID NO: 38261 - RNA, 19 nt, Homo sapiens
gauagggaguuuuaaagaa

SEQ ID NO: 38262 - RNA, 19 nt, Homo sapiens
aaugggcccuugccucuaa

SEQ ID NO: 38263 - RNA, 19 nt, Homo sapiens
agacagaaaggaaucauug

SEQ ID NO: 38264 - RNA, 19 nt, Homo sapiens
cauguuaacaggauucaaa

SEQ ID NO: 38265 - RNA, 19 nt, Homo sapiens
cccacguucuguuaauuua

SEQ ID NO: 38266 - RNA, 19 nt, Homo sapiens
uacacaaccuugauagaug

SEQ ID NO: 38267 - RNA, 19 nt, Homo sapiens
aagaggaaaugaaggguau

SEQ ID NO: 38268 - RNA, 19 nt, Homo sapiens
ugauagauguuaccaaagg

SEQ ID NO: 38269 - RNA, 19 nt, Homo sapiens
acacaaccuugauagaugu

SEQ ID NO: 38270 - RNA, 19 nt, Homo sapiens
gaaacaucccuucuuccuu

SEQ ID NO: 38271 - RNA, 19 nt, Homo sapiens
gauauaccuuuaggagaga

SEQ ID NO: 38272 - RNA, 19 nt, Homo sapiens
acgauuaacugugaaaugu

SEQ ID NO: 38273 - RNA, 19 nt, Homo sapiens
gaacuuguuaaccuuucua

SEQ ID NO: 38274 - RNA, 19 nt, Homo sapiens
acauucaccuguauauuuc

SEQ ID NO: 38275 - RNA, 19 nt, Homo sapiens
ucacuucuaccuacauauu

SEQ ID NO: 38276 - RNA, 19 nt, Homo sapiens
uggauaggguuccucacua

SEQ ID NO: 38277 - RNA, 19 nt, Homo sapiens
ggagaaacauggauuuugg

SEQ ID NO: 38278 - RNA, 19 nt, Homo sapiens
caccaaugcuaaagguuau

SEQ ID NO: 38279 - RNA, 19 nt, Homo sapiens
caaaagauggcaugaauug

SEQ ID NO: 38280 - RNA, 19 nt, Homo sapiens
guucaagaaguaaucagua

SEQ ID NO: 38281 - RNA, 19 nt, Homo sapiens
gcaccagccaagagaauau

SEQ ID NO: 38282 - RNA, 19 nt, Homo sapiens
aggaaucauuggauguaua

SEQ ID NO: 38283 - RNA, 19 nt, Homo sapiens
gaccaagaccaagauauug

SEQ ID NO: 38284 - RNA, 19 nt, Homo sapiens
caucuagaauucacugagu

SEQ ID NO: 38285 - RNA, 19 nt, Homo sapiens
cauuugaaaccauguauga

SEQ ID NO: 38286 - RNA, 19 nt, Homo sapiens
auaccugggucauaacuga

SEQ ID NO: 38287 - RNA, 19 nt, Homo sapiens
ucagauugauagggaguuu

SEQ ID NO: 38288 - RNA, 19 nt, Homo sapiens
gggaugagacagacauuca

SEQ ID NO: 38289 - RNA, 19 nt, Homo sapiens
gcaucgggcugggagagaa

SEQ ID NO: 38290 - RNA, 19 nt, Homo sapiens
aaaggaaucauuggaugua

SEQ ID NO: 38291 - RNA, 19 nt, Homo sapiens
augaagaagccaagaauuu

SEQ ID NO: 38292 - RNA, 19 nt, Homo sapiens
aaagauggcaugaauugau

SEQ ID NO: 38293 - RNA, 19 nt, Homo sapiens
ggaagugaacccauauuuu

SEQ ID NO: 38294 - RNA, 19 nt, Homo sapiens
ccaguaacccuaaggaagu

SEQ ID NO: 38295 - RNA, 19 nt, Homo sapiens
ccauaaaucuugacuuacc

SEQ ID NO: 38296 - RNA, 19 nt, Homo sapiens
gguacaccauaaaucuuga

SEQ ID NO: 38297 - RNA, 19 nt, Homo sapiens
acaguaaacacuccacauu

SEQ ID NO: 38298 - RNA, 19 nt, Homo sapiens
ggguggaacauaaauaaug

SEQ ID NO: 38299 - RNA, 19 nt, Homo sapiens
gaguauuucuuggguggaa

SEQ ID NO: 38300 - RNA, 19 nt, Homo sapiens
gaaggguauugccgcuguu

SEQ ID NO: 38301 - RNA, 19 nt, Homo sapiens
gaaacgaguuggugucuuu

SEQ ID NO: 38302 - RNA, 19 nt, Homo sapiens
ggaaagcucugccaagaug

SEQ ID NO: 38303 - RNA, 19 nt, Homo sapiens
gagcagcacacgcguuaua

SEQ ID NO: 38304 - RNA, 19 nt, Homo sapiens
gcaagagagcgcagccuua

SEQ ID NO: 38305 - RNA, 19 nt, Homo sapiens
uaacucccaucaccucuaa

SEQ ID NO: 38306 - RNA, 19 nt, Homo sapiens
gcucagaacaguaucuuug

SEQ ID NO: 38307 - RNA, 19 nt, Homo sapiens
gagcgcagccuuaguagga

SEQ ID NO: 38308 - RNA, 19 nt, Homo sapiens
ccaacaagaagaugaguaa

SEQ ID NO: 38309 - RNA, 19 nt, Homo sapiens
cgcacaaccugcaucuuua

SEQ ID NO: 38310 - RNA, 19 nt, Homo sapiens
gcacccaaguucucucugu

SEQ ID NO: 38311 - RNA, 19 nt, Homo sapiens
gggagcagcacacgcguua

SEQ ID NO: 38312 - RNA, 19 nt, Homo sapiens
caacuacuccaacgacuug

SEQ ID NO: 38313 - RNA, 19 nt, Homo sapiens
cagcacacgcguuauagua

SEQ ID NO: 38314 - RNA, 19 nt, Homo sapiens
gggaagcgcucagaacagu

SEQ ID NO: 38315 - RNA, 19 nt, Homo sapiens
gcccgcagccuguuucuuu

SEQ ID NO: 38316 - RNA, 19 nt, Homo sapiens
gaacugaugcgcugcaaac

SEQ ID NO: 38317 - RNA, 19 nt, Homo sapiens
agagagcgcagccuuagua

SEQ ID NO: 38318 - RNA, 19 nt, Homo sapiens
gcaggagcuucucgacuuc

SEQ ID NO: 38319 - RNA, 19 nt, Homo sapiens
gaagcgcucagaacaguau

SEQ ID NO: 38320 - RNA, 19 nt, Homo sapiens
gaagaaaagagaagaagaa

SEQ ID NO: 38321 - RNA, 19 nt, Homo sapiens
caucuuuagugcuuucuug

SEQ ID NO: 38322 - RNA, 19 nt, Homo sapiens
gcucgccggucucauccua

SEQ ID NO: 38323 - RNA, 19 nt, Homo sapiens
cgaauggacuuuggaagca

SEQ ID NO: 38324 - RNA, 19 nt, Homo sapiens
ucgcacaaccugcaucuuu

SEQ ID NO: 38325 - RNA, 19 nt, Homo sapiens
acaagaagaugaguaaggu

SEQ ID NO: 38326 - RNA, 19 nt, Homo sapiens
ucagggcucccgcuucaua

SEQ ID NO: 38327 - RNA, 19 nt, Homo sapiens
ugaguaagguggagacacu

SEQ ID NO: 38328 - RNA, 19 nt, Homo sapiens
gggcucccgcuucauauuu

SEQ ID NO: 38329 - RNA, 19 nt, Homo sapiens
gcacaaccugcaucuuuag

SEQ ID NO: 38330 - RNA, 19 nt, Homo sapiens
caagucagcgcccaagcaa

SEQ ID NO: 38331 - RNA, 19 nt, Homo sapiens
caagagagcgcagccuuag

SEQ ID NO: 38332 - RNA, 19 nt, Homo sapiens
ucuuugcacuccaaucauu

SEQ ID NO: 38333 - RNA, 19 nt, Homo sapiens
gcaacugggaccugaguca

SEQ ID NO: 38334 - RNA, 19 nt, Homo sapiens
ugagagacauggcuuucag

SEQ ID NO: 38335 - RNA, 19 nt, Homo sapiens
agcaggagcuucucgacuu

SEQ ID NO: 38336 - RNA, 19 nt, Homo sapiens
gcacagcugaaaguucuug

SEQ ID NO: 38337 - RNA, 19 nt, Homo sapiens
acgcacagcugaaaguucu

SEQ ID NO: 38338 - RNA, 19 nt, Homo sapiens
acggagauaugaagagcaa

SEQ ID NO: 38339 - RNA, 19 nt, Homo sapiens
ggaagcgcucagaacagua

SEQ ID NO: 38340 - RNA, 19 nt, Homo sapiens
auggaaagcucugccaaga

SEQ ID NO: 38341 - RNA, 19 nt, Homo sapiens
guaacucccaucaccucua

SEQ ID NO: 38342 - RNA, 19 nt, Homo sapiens
uaucuuugcacuccaauca

SEQ ID NO: 38343 - RNA, 19 nt, Homo sapiens
ucagaacaguaucuuugca

SEQ ID NO: 38344 - RNA, 19 nt, Homo sapiens
ggagaaaaggaaaagaaaa

SEQ ID NO: 38345 - RNA, 19 nt, Homo sapiens
cuuuagugcuuucuuguca

SEQ ID NO: 38346 - RNA, 19 nt, Homo sapiens
ccaacgacuugaacuccau

SEQ ID NO: 38347 - RNA, 19 nt, Homo sapiens
ggagauaugaagagcaacu

SEQ ID NO: 38348 - RNA, 19 nt, Homo sapiens
gaagaagaaaagagaagaa

SEQ ID NO: 38349 - RNA, 19 nt, Homo sapiens
gccaacaagaagaugagua

SEQ ID NO: 38350 - RNA, 19 nt, Homo sapiens
gcucaacuucagcggcuuu

SEQ ID NO: 38351 - RNA, 19 nt, Homo sapiens
gagcaacugggaccugagu

SEQ ID NO: 38352 - RNA, 19 nt, Homo sapiens
gagagacauggcuuucaga

SEQ ID NO: 38353 - RNA, 19 nt, Homo sapiens
caacugggaccugagucaa

SEQ ID NO: 38354 - RNA, 19 nt, Homo sapiens
ccaaucauucacggagaua

SEQ ID NO: 38355 - RNA, 19 nt, Homo sapiens
caguaucuuugcacuccaa

SEQ ID NO: 38356 - RNA, 19 nt, Homo sapiens
gcagcacacgcguuauagu

SEQ ID NO: 38357 - RNA, 19 nt, Homo sapiens
aaacgggaagcgcucagaa

SEQ ID NO: 38358 - RNA, 19 nt, Homo sapiens
gaagaagaagaaaagagaa

SEQ ID NO: 38359 - RNA, 19 nt, Homo sapiens
acugggaccugagucaaug

SEQ ID NO: 38360 - RNA, 19 nt, Homo sapiens
ggcucccgcuucauauuuc

SEQ ID NO: 38361 - RNA, 19 nt, Homo sapiens
ccaacuacuccaacgacuu

SEQ ID NO: 38362 - RNA, 19 nt, Homo sapiens
gcaguucuuagcccucuag

SEQ ID NO: 38363 - RNA, 19 nt, Homo sapiens
ucuuagagugcaguucuua

SEQ ID NO: 38364 - RNA, 19 nt, Homo sapiens
cuaacacgcacagcugaaa

SEQ ID NO: 38365 - RNA, 19 nt, Homo sapiens
agagacauggcuuucagaa

SEQ ID NO: 38366 - RNA, 19 nt, Homo sapiens
gagcgcaaccgcgucaagu

SEQ ID NO: 38367 - RNA, 19 nt, Homo sapiens
gcaagaagcugagcaaggu

SEQ ID NO: 38368 - RNA, 19 nt, Homo sapiens
ggaggaggguuaucuauac

SEQ ID NO: 38369 - RNA, 19 nt, Homo sapiens
ggaggguuaucuauacauu

SEQ ID NO: 38370 - RNA, 19 nt, Homo sapiens
gcgugaagcuggugaacuu

SEQ ID NO: 38371 - RNA, 19 nt, Homo sapiens
cgacuucuccagcugguua

SEQ ID NO: 38372 - RNA, 19 nt, Homo sapiens
gaggaggguuaucuauaca

SEQ ID NO: 38373 - RNA, 19 nt, Homo sapiens
gcucagccguggaguacau

SEQ ID NO: 38374 - RNA, 19 nt, Homo sapiens
cggaggaggguuaucuaua

SEQ ID NO: 38375 - RNA, 19 nt, Homo sapiens
gaggguuaucuauacauuu

SEQ ID NO: 38376 - RNA, 19 nt, Homo sapiens
gcggaggaggguuaucuau

SEQ ID NO: 38377 - RNA, 19 nt, Homo sapiens
acugagcgcccucgaccua

SEQ ID NO: 38378 - RNA, 19 nt, Homo sapiens
ccaccucuccuuuaauuua

SEQ ID NO: 38379 - RNA, 19 nt, Homo sapiens
gcacagcacugaagaaccu

SEQ ID NO: 38380 - RNA, 19 nt, Homo sapiens
ugaagcaguucgugucuga

SEQ ID NO: 38381 - RNA, 19 nt, Homo sapiens
ggcaauggcucagaaagga

SEQ ID NO: 38382 - RNA, 19 nt, Homo sapiens
ggaaggauagggugauguu

SEQ ID NO: 38383 - RNA, 19 nt, Homo sapiens
gggaggagcagaaauuugu

SEQ ID NO: 38384 - RNA, 19 nt, Homo sapiens
agaaggaccugagugaaga

SEQ ID NO: 38385 - RNA, 19 nt, Homo sapiens
gagacgggcuucaagaacu

SEQ ID NO: 38386 - RNA, 19 nt, Homo sapiens
gaggcaaugugggaagaaa

SEQ ID NO: 38387 - RNA, 19 nt, Homo sapiens
gagagacguucagcaacuu

SEQ ID NO: 38388 - RNA, 19 nt, Homo sapiens
gggcugacgccgacaacua

SEQ ID NO: 38389 - RNA, 19 nt, Homo sapiens
gaaagaugaagucgcuaga

SEQ ID NO: 38390 - RNA, 19 nt, Homo sapiens
gaagaaccugggaaucaga

SEQ ID NO: 38391 - RNA, 19 nt, Homo sapiens
ccagggcaauggcucagaa

SEQ ID NO: 38392 - RNA, 19 nt, Homo sapiens
ugagagagacguucagcaa

SEQ ID NO: 38393 - RNA, 19 nt, Homo sapiens
gguuaucauugugaacuuu

SEQ ID NO: 38394 - RNA, 19 nt, Homo sapiens
gaaggugaggagcuugaaa

SEQ ID NO: 38395 - RNA, 19 nt, Homo sapiens
agccaccucuccuuuaauu

SEQ ID NO: 38396 - RNA, 19 nt, Homo sapiens
cgaggacugugcccacuuc

SEQ ID NO: 38397 - RNA, 19 nt, Homo sapiens
gcagaaggaccugagugaa

SEQ ID NO: 38398 - RNA, 19 nt, Homo sapiens
uucagcaucuggacaauga

SEQ ID NO: 38399 - RNA, 19 nt, Homo sapiens
caccucuccuuuaauuuau

SEQ ID NO: 38400 - RNA, 19 nt, Homo sapiens
aagaugaagucgcuagagu

SEQ ID NO: 38401 - RNA, 19 nt, Homo sapiens
guuugcagguuaucauugu

SEQ ID NO: 38402 - RNA, 19 nt, Homo sapiens
gggaggcaaugugggaaga

SEQ ID NO: 38403 - RNA, 19 nt, Homo sapiens
agagagacguucagcaacu

SEQ ID NO: 38404 - RNA, 19 nt, Homo sapiens
ugaccaaggaguaucaaga

SEQ ID NO: 38405 - RNA, 19 nt, Homo sapiens
cagaaggaccugagugaag

SEQ ID NO: 38406 - RNA, 19 nt, Homo sapiens
ugaagaaccugggaaucag

SEQ ID NO: 38407 - RNA, 19 nt, Homo sapiens
ggcaaugugggaagaaaga

SEQ ID NO: 38408 - RNA, 19 nt, Homo sapiens
ccugggaggagcagaaauu

SEQ ID NO: 38409 - RNA, 19 nt, Homo sapiens
agucccagcuggagaaaca

SEQ ID NO: 38410 - RNA, 19 nt, Homo sapiens
gcccuaucaugaccaagga

SEQ ID NO: 38411 - RNA, 19 nt, Homo sapiens
gcaguuugcagguuaucau

SEQ ID NO: 38412 - RNA, 19 nt, Homo sapiens
cugaagaaccugggaauca

SEQ ID NO: 38413 - RNA, 19 nt, Homo sapiens
ccugagacccugagcaauc

SEQ ID NO: 38414 - RNA, 19 nt, Homo sapiens
uggagaaacagcagaagga

SEQ ID NO: 38415 - RNA, 19 nt, Homo sapiens
agacgggcuucaagaacug

SEQ ID NO: 38416 - RNA, 19 nt, Homo sapiens
gaccaaggaguaucaagac

SEQ ID NO: 38417 - RNA, 19 nt, Homo sapiens
aucaagaccuucagcaucu

SEQ ID NO: 38418 - RNA, 19 nt, Homo sapiens
uaucaugaccaaggaguau

SEQ ID NO: 38419 - RNA, 19 nt, Homo sapiens
gggcaauggcucagaaagg

SEQ ID NO: 38420 - RNA, 19 nt, Homo sapiens
ugaccaccaucagcucaga

SEQ ID NO: 38421 - RNA, 19 nt, Homo sapiens
ggaauuuucaucuaggauu

SEQ ID NO: 38422 - RNA, 19 nt, Homo sapiens
gaaggaccugagugaagau

SEQ ID NO: 38423 - RNA, 19 nt, Homo sapiens
ugaggagagugaccaccau

SEQ ID NO: 38424 - RNA, 19 nt, Homo sapiens
ucugcuuucucgggaauuu

SEQ ID NO: 38425 - RNA, 19 nt, Homo sapiens
uagagucccagcuggagaa

SEQ ID NO: 38426 - RNA, 19 nt, Homo sapiens
aaugugggaagaaagauga

SEQ ID NO: 38427 - RNA, 19 nt, Homo sapiens
caaugugggaagaaagaug

SEQ ID NO: 38428 - RNA, 19 nt, Homo sapiens
gaaaggagguaguuuaaga

SEQ ID NO: 38429 - RNA, 19 nt, Homo sapiens
gccaaggacuuucaagaua

SEQ ID NO: 38430 - RNA, 19 nt, Homo sapiens
gggaagagcugagcaaaga

SEQ ID NO: 38431 - RNA, 19 nt, Homo sapiens
gagccaagcuggagaaaca

SEQ ID NO: 38432 - RNA, 19 nt, Homo sapiens
gagcagaaauucauuguac

SEQ ID NO: 38433 - RNA, 19 nt, Homo sapiens
gagaaaggagguaguuuaa

SEQ ID NO: 38434 - RNA, 19 nt, Homo sapiens
ccaaggacuuucaagauau

SEQ ID NO: 38435 - RNA, 19 nt, Homo sapiens
gaucccaccuccuucugua

SEQ ID NO: 38436 - RNA, 19 nt, Homo sapiens
gggcugaggcggagaagua

SEQ ID NO: 38437 - RNA, 19 nt, Homo sapiens
agagaaaggagguaguuua

SEQ ID NO: 38438 - RNA, 19 nt, Homo sapiens
ucacucagccagauaauug

SEQ ID NO: 38439 - RNA, 19 nt, Homo sapiens
gcccugcucuuccaucuga

SEQ ID NO: 38440 - RNA, 19 nt, Homo sapiens
gaaauucauuguacaacac

SEQ ID NO: 38441 - RNA, 19 nt, Homo sapiens
agaaacaaaugcuugaauc

SEQ ID NO: 38442 - RNA, 19 nt, Homo sapiens
ggaaaggaagaaacacuga

SEQ ID NO: 38443 - RNA, 19 nt, Homo sapiens
gaagagcugagcaaagaga

SEQ ID NO: 38444 - RNA, 19 nt, Homo sapiens
gcagaaauucauuguacaa

SEQ ID NO: 38445 - RNA, 19 nt, Homo sapiens
ugacggagguccaggcaau

SEQ ID NO: 38446 - RNA, 19 nt, Homo sapiens
caagaucacaucccuagga

SEQ ID NO: 38447 - RNA, 19 nt, Homo sapiens
ggaaagaagaaacaaaugc

SEQ ID NO: 38448 - RNA, 19 nt, Homo sapiens
gaaacaaaugcuugaaucu

SEQ ID NO: 38449 - RNA, 19 nt, Homo sapiens
gaagaaacaaaugcuugaa

SEQ ID NO: 38450 - RNA, 19 nt, Homo sapiens
caaggacuuucaagauauc

SEQ ID NO: 38451 - RNA, 19 nt, Homo sapiens
caucauggccaaggacuuu

SEQ ID NO: 38452 - RNA, 19 nt, Homo sapiens
agugauggcucuuggaaau

SEQ ID NO: 38453 - RNA, 19 nt, Homo sapiens
gaaagaagaaacaaaugcu

SEQ ID NO: 38454 - RNA, 19 nt, Homo sapiens
gaagugaagacuguguuga

SEQ ID NO: 38455 - RNA, 19 nt, Homo sapiens
uacaagaacugggcuguca

SEQ ID NO: 38456 - RNA, 19 nt, Homo sapiens
gcucuggcuucucuguuga

SEQ ID NO: 38457 - RNA, 19 nt, Homo sapiens
cagcgugggugacaagauc

SEQ ID NO: 38458 - RNA, 19 nt, Homo sapiens
gcuucucuguugaggauuu

SEQ ID NO: 38459 - RNA, 19 nt, Homo sapiens
ggaagugaagacuguguug

SEQ ID NO: 38460 - RNA, 19 nt, Homo sapiens
ggagcagaaauucauugua

SEQ ID NO: 38461 - RNA, 19 nt, Homo sapiens
guaggaaagaagaaacaaa

SEQ ID NO: 38462 - RNA, 19 nt, Homo sapiens
gagcugagcaaagagagaa

SEQ ID NO: 38463 - RNA, 19 nt, Homo sapiens
gaccauccuuuccaucaag

SEQ ID NO: 38464 - RNA, 19 nt, Homo sapiens
ggguggaagugaagacugu

SEQ ID NO: 38465 - RNA, 19 nt, Homo sapiens
ggccaaggacuuucaagau

SEQ ID NO: 38466 - RNA, 19 nt, Homo sapiens
gggaggagcagaaauucau

SEQ ID NO: 38467 - RNA, 19 nt, Homo sapiens
agaagaaacaaaugcuuga

SEQ ID NO: 38468 - RNA, 19 nt, Homo sapiens
ccucuucaauggcguagga

SEQ ID NO: 38469 - RNA, 19 nt, Homo sapiens
gagagaaaggagguaguuu

SEQ ID NO: 38470 - RNA, 19 nt, Homo sapiens
ucaauggcguaggaaagaa

SEQ ID NO: 38471 - RNA, 19 nt, Homo sapiens
cgagcuggguggaagugaa

SEQ ID NO: 38472 - RNA, 19 nt, Homo sapiens
ggaggagcagaaauucauu

SEQ ID NO: 38473 - RNA, 19 nt, Homo sapiens
ugaccauccuuuccaucaa

SEQ ID NO: 38474 - RNA, 19 nt, Homo sapiens
gaggagcagaaauucauug

SEQ ID NO: 38475 - RNA, 19 nt, Homo sapiens
uggcuucucuguugaggau

SEQ ID NO: 38476 - RNA, 19 nt, Homo sapiens
cagacuauaggcacaacua

SEQ ID NO: 38477 - RNA, 19 nt, Homo sapiens
gcacagacuauaggcacaa

SEQ ID NO: 38478 - RNA, 19 nt, Homo sapiens
aaaggaagaaacacugaga

SEQ ID NO: 38479 - RNA, 19 nt, Homo sapiens
guggauggcacagacuaua

SEQ ID NO: 38480 - RNA, 19 nt, Homo sapiens
ccugggaggagcagaaauu

SEQ ID NO: 38481 - RNA, 19 nt, Homo sapiens
ccugaaagcagaucacgau

SEQ ID NO: 38482 - RNA, 19 nt, Homo sapiens
ccaccuccuucuguaauuc

SEQ ID NO: 38483 - RNA, 19 nt, Homo sapiens
agcaacggcucccaaagga

SEQ ID NO: 38484 - RNA, 19 nt, Homo sapiens
caaagagagaaaggaggua

SEQ ID NO: 38485 - RNA, 19 nt, Homo sapiens
gaggaaaggaagaaacacu

SEQ ID NO: 38486 - RNA, 19 nt, Homo sapiens
ugauggcucuuggaaaugg

SEQ ID NO: 38487 - RNA, 19 nt, Homo sapiens
cagcaacggcucccaaagg

SEQ ID NO: 38488 - RNA, 19 nt, Homo sapiens
aaacaaaugcuugaaucuc

SEQ ID NO: 38489 - RNA, 19 nt, Homo sapiens
cguccgcucuccacaccuu

SEQ ID NO: 38490 - RNA, 19 nt, Homo sapiens
acuauaggcacaacuacaa

SEQ ID NO: 38491 - RNA, 19 nt, Homo sapiens
aaaugaccauccuuuccau

SEQ ID NO: 38492 - RNA, 19 nt, Homo sapiens
uauaaucgucagccucuuc

SEQ ID NO: 38493 - RNA, 19 nt, Homo sapiens
agagagaaaggagguaguu

SEQ ID NO: 38494 - RNA, 19 nt, Homo sapiens
cagcacaccucuggcuaac

SEQ ID NO: 38495 - RNA, 19 nt, Homo sapiens
aagugaagacuguguugaa

SEQ ID NO: 38496 - RNA, 19 nt, Homo sapiens
cuccuucuguaauucauug

SEQ ID NO: 38497 - RNA, 19 nt, Homo sapiens
gaaaggagguaguuuaaga

SEQ ID NO: 38498 - RNA, 19 nt, Homo sapiens
gccaaggacuuucaagaua

SEQ ID NO: 38499 - RNA, 19 nt, Homo sapiens
gggaagagcugagcaaaga

SEQ ID NO: 38500 - RNA, 19 nt, Homo sapiens
gagccaagcuggagaaaca

SEQ ID NO: 38501 - RNA, 19 nt, Homo sapiens
gagcagaaauucauuguac

SEQ ID NO: 38502 - RNA, 19 nt, Homo sapiens
gagaaaggagguaguuuaa

SEQ ID NO: 38503 - RNA, 19 nt, Homo sapiens
ccaaggacuuucaagauau

SEQ ID NO: 38504 - RNA, 19 nt, Homo sapiens
gaucccaccuccuucugua

SEQ ID NO: 38505 - RNA, 19 nt, Homo sapiens
gggcugaggcggagaagua

SEQ ID NO: 38506 - RNA, 19 nt, Homo sapiens
agagaaaggagguaguuua

SEQ ID NO: 38507 - RNA, 19 nt, Homo sapiens
ucacucagccagauaauug

SEQ ID NO: 38508 - RNA, 19 nt, Homo sapiens
gcccugcucuuccaucuga

SEQ ID NO: 38509 - RNA, 19 nt, Homo sapiens
gaaauucauuguacaacac

SEQ ID NO: 38510 - RNA, 19 nt, Homo sapiens
agaaacaaaugcuugaauc

SEQ ID NO: 38511 - RNA, 19 nt, Homo sapiens
ggaaaggaagaaacacuga

SEQ ID NO: 38512 - RNA, 19 nt, Homo sapiens
gaagagcugagcaaagaga

SEQ ID NO: 38513 - RNA, 19 nt, Homo sapiens
gcagaaauucauuguacaa

SEQ ID NO: 38514 - RNA, 19 nt, Homo sapiens
ugacggagguccaggcaau

SEQ ID NO: 38515 - RNA, 19 nt, Homo sapiens
caagaucacaucccuagga

SEQ ID NO: 38516 - RNA, 19 nt, Homo sapiens
ggaaagaagaaacaaaugc

SEQ ID NO: 38517 - RNA, 19 nt, Homo sapiens
gaaacaaaugcuugaaucu

SEQ ID NO: 38518 - RNA, 19 nt, Homo sapiens
gaagaaacaaaugcuugaa

SEQ ID NO: 38519 - RNA, 19 nt, Homo sapiens
caaggacuuucaagauauc

SEQ ID NO: 38520 - RNA, 19 nt, Homo sapiens
agugauggcucuuggaaau

SEQ ID NO: 38521 - RNA, 19 nt, Homo sapiens
caucauggccaaggacuuu

SEQ ID NO: 38522 - RNA, 19 nt, Homo sapiens
gaaagaagaaacaaaugcu

SEQ ID NO: 38523 - RNA, 19 nt, Homo sapiens
gaagugaagacuguguuga

SEQ ID NO: 38524 - RNA, 19 nt, Homo sapiens
uacaagaacugggcuguca

SEQ ID NO: 38525 - RNA, 19 nt, Homo sapiens
gcucuggcuucucuguuga

SEQ ID NO: 38526 - RNA, 19 nt, Homo sapiens
cagcgugggugacaagauc

SEQ ID NO: 38527 - RNA, 19 nt, Homo sapiens
gcuucucuguugaggauuu

SEQ ID NO: 38528 - RNA, 19 nt, Homo sapiens
ggaagugaagacuguguug

SEQ ID NO: 38529 - RNA, 19 nt, Homo sapiens
ggagcagaaauucauugua

SEQ ID NO: 38530 - RNA, 19 nt, Homo sapiens
guaggaaagaagaaacaaa

SEQ ID NO: 38531 - RNA, 19 nt, Homo sapiens
gagcugagcaaagagagaa

SEQ ID NO: 38532 - RNA, 19 nt, Homo sapiens
ccaucaaccuccacgugaa

SEQ ID NO: 38533 - RNA, 19 nt, Homo sapiens
gaccauccuuuccaucaag

SEQ ID NO: 38534 - RNA, 19 nt, Homo sapiens
ggguggaagugaagacugu

SEQ ID NO: 38535 - RNA, 19 nt, Homo sapiens
gggaggagcagaaauucau

SEQ ID NO: 38536 - RNA, 19 nt, Homo sapiens
ggccaaggacuuucaagau

SEQ ID NO: 38537 - RNA, 19 nt, Homo sapiens
agaagaaacaaaugcuuga

SEQ ID NO: 38538 - RNA, 19 nt, Homo sapiens
ccucuucaauggcguagga

SEQ ID NO: 38539 - RNA, 19 nt, Homo sapiens
gagagaaaggagguaguuu

SEQ ID NO: 38540 - RNA, 19 nt, Homo sapiens
ucaauggcguaggaaagaa

SEQ ID NO: 38541 - RNA, 19 nt, Homo sapiens
cgagcuggguggaagugaa

SEQ ID NO: 38542 - RNA, 19 nt, Homo sapiens
ggaggagcagaaauucauu

SEQ ID NO: 38543 - RNA, 19 nt, Homo sapiens
ugaccauccuuuccaucaa

SEQ ID NO: 38544 - RNA, 19 nt, Homo sapiens
gaggagcagaaauucauug

SEQ ID NO: 38545 - RNA, 19 nt, Homo sapiens
uggcuucucuguugaggau

SEQ ID NO: 38546 - RNA, 19 nt, Homo sapiens
cagacuauaggcacaacua

SEQ ID NO: 38547 - RNA, 19 nt, Homo sapiens
gcacagacuauaggcacaa

SEQ ID NO: 38548 - RNA, 19 nt, Homo sapiens
aaaggaagaaacacugaga

SEQ ID NO: 38549 - RNA, 19 nt, Homo sapiens
guggauggcacagacuaua

SEQ ID NO: 38550 - RNA, 19 nt, Homo sapiens
ccugggaggagcagaaauu

SEQ ID NO: 38551 - RNA, 19 nt, Homo sapiens
ccugaaagcagaucacgau

SEQ ID NO: 38552 - RNA, 19 nt, Homo sapiens
ccaccuccuucuguaauuc

SEQ ID NO: 38553 - RNA, 19 nt, Homo sapiens
agcaacggcucccaaagga

SEQ ID NO: 38554 - RNA, 19 nt, Homo sapiens
caaagagagaaaggaggua

SEQ ID NO: 38555 - RNA, 19 nt, Homo sapiens
cuccacaccuuucacagau

SEQ ID NO: 38556 - RNA, 19 nt, Homo sapiens
gaggaaaggaagaaacacu

SEQ ID NO: 38557 - RNA, 19 nt, Homo sapiens
ugauggcucuuggaaaugg

SEQ ID NO: 38558 - RNA, 19 nt, Homo sapiens
cagcaacggcucccaaagg

SEQ ID NO: 38559 - RNA, 19 nt, Homo sapiens
aaacaaaugcuugaaucuc

SEQ ID NO: 38560 - RNA, 19 nt, Homo sapiens
cguccgcucuccacaccuu

SEQ ID NO: 38561 - RNA, 19 nt, Homo sapiens
acuauaggcacaacuacaa

SEQ ID NO: 38562 - RNA, 19 nt, Homo sapiens
caucaaccuccacgugaau

SEQ ID NO: 38563 - RNA, 19 nt, Homo sapiens
aaaugaccauccuuuccau

SEQ ID NO: 38564 - RNA, 19 nt, Homo sapiens
uauaaucgucagccucuuc

SEQ ID NO: 38565 - RNA, 19 nt, Homo sapiens
agagagaaaggagguaguu

SEQ ID NO: 38566 - RNA, 19 nt, Homo sapiens
cagcacaccucuggcuaac

SEQ ID NO: 38567 - RNA, 19 nt, Homo sapiens
aagugaagacuguguugaa

SEQ ID NO: 38568 - RNA, 19 nt, Homo sapiens
cuccuucuguaauucauug

SEQ ID NO: 38569 - RNA, 19 nt, Homo sapiens
gaaaggagguaguuuaaga

SEQ ID NO: 38570 - RNA, 19 nt, Homo sapiens
gccaaggacuuucaagaua

SEQ ID NO: 38571 - RNA, 19 nt, Homo sapiens
gggaagagcugagcaaaga

SEQ ID NO: 38572 - RNA, 19 nt, Homo sapiens
gagccaagcuggagaaaca

SEQ ID NO: 38573 - RNA, 19 nt, Homo sapiens
gagcagaaauucauuguac

SEQ ID NO: 38574 - RNA, 19 nt, Homo sapiens
gagaaaggagguaguuuaa

SEQ ID NO: 38575 - RNA, 19 nt, Homo sapiens
ccaaggacuuucaagauau

SEQ ID NO: 38576 - RNA, 19 nt, Homo sapiens
gaucccaccuccuucugua

SEQ ID NO: 38577 - RNA, 19 nt, Homo sapiens
gggcugaggcggagaagua

SEQ ID NO: 38578 - RNA, 19 nt, Homo sapiens
agagaaaggagguaguuua

SEQ ID NO: 38579 - RNA, 19 nt, Homo sapiens
ucacucagccagauaauug

SEQ ID NO: 38580 - RNA, 19 nt, Homo sapiens
gcccugcucuuccaucuga

SEQ ID NO: 38581 - RNA, 19 nt, Homo sapiens
gaaauucauuguacaacac

SEQ ID NO: 38582 - RNA, 19 nt, Homo sapiens
agaaacaaaugcuugaauc

SEQ ID NO: 38583 - RNA, 19 nt, Homo sapiens
ggaaaggaagaaacacuga

SEQ ID NO: 38584 - RNA, 19 nt, Homo sapiens
gaagagcugagcaaagaga

SEQ ID NO: 38585 - RNA, 19 nt, Homo sapiens
gcagaaauucauuguacaa

SEQ ID NO: 38586 - RNA, 19 nt, Homo sapiens
ugacggagguccaggcaau

SEQ ID NO: 38587 - RNA, 19 nt, Homo sapiens
caagaucacaucccuagga

SEQ ID NO: 38588 - RNA, 19 nt, Homo sapiens
ggaaagaagaaacaaaugc

SEQ ID NO: 38589 - RNA, 19 nt, Homo sapiens
gaaacaaaugcuugaaucu

SEQ ID NO: 38590 - RNA, 19 nt, Homo sapiens
gaagaaacaaaugcuugaa

SEQ ID NO: 38591 - RNA, 19 nt, Homo sapiens
caaggacuuucaagauauc

SEQ ID NO: 38592 - RNA, 19 nt, Homo sapiens
caucauggccaaggacuuu

SEQ ID NO: 38593 - RNA, 19 nt, Homo sapiens
agugauggcucuuggaaau

SEQ ID NO: 38594 - RNA, 19 nt, Homo sapiens
gaaagaagaaacaaaugcu

SEQ ID NO: 38595 - RNA, 19 nt, Homo sapiens
gaagugaagacuguguuga

SEQ ID NO: 38596 - RNA, 19 nt, Homo sapiens
uacaagaacugggcuguca

SEQ ID NO: 38597 - RNA, 19 nt, Homo sapiens
gcucuggcuucucuguuga

SEQ ID NO: 38598 - RNA, 19 nt, Homo sapiens
cagcgugggugacaagauc

SEQ ID NO: 38599 - RNA, 19 nt, Homo sapiens
gcuucucuguugaggauuu

SEQ ID NO: 38600 - RNA, 19 nt, Homo sapiens
ggaagugaagacuguguug

SEQ ID NO: 38601 - RNA, 19 nt, Homo sapiens
ggagcagaaauucauugua

SEQ ID NO: 38602 - RNA, 19 nt, Homo sapiens
guaggaaagaagaaacaaa

SEQ ID NO: 38603 - RNA, 19 nt, Homo sapiens
gagcugagcaaagagagaa

SEQ ID NO: 38604 - RNA, 19 nt, Homo sapiens
gaccauccuuuccaucaag

SEQ ID NO: 38605 - RNA, 19 nt, Homo sapiens
ggguggaagugaagacugu

SEQ ID NO: 38606 - RNA, 19 nt, Homo sapiens
ggccaaggacuuucaagau

SEQ ID NO: 38607 - RNA, 19 nt, Homo sapiens
gggaggagcagaaauucau

SEQ ID NO: 38608 - RNA, 19 nt, Homo sapiens
agaagaaacaaaugcuuga

SEQ ID NO: 38609 - RNA, 19 nt, Homo sapiens
ccucuucaauggcguagga

SEQ ID NO: 38610 - RNA, 19 nt, Homo sapiens
gagagaaaggagguaguuu

SEQ ID NO: 38611 - RNA, 19 nt, Homo sapiens
ucaauggcguaggaaagaa

SEQ ID NO: 38612 - RNA, 19 nt, Homo sapiens
cgagcuggguggaagugaa

SEQ ID NO: 38613 - RNA, 19 nt, Homo sapiens
ggaggagcagaaauucauu

SEQ ID NO: 38614 - RNA, 19 nt, Homo sapiens
ugaccauccuuuccaucaa

SEQ ID NO: 38615 - RNA, 19 nt, Homo sapiens
gaggagcagaaauucauug

SEQ ID NO: 38616 - RNA, 19 nt, Homo sapiens
uggcuucucuguugaggau

SEQ ID NO: 38617 - RNA, 19 nt, Homo sapiens
cagacuauaggcacaacua

SEQ ID NO: 38618 - RNA, 19 nt, Homo sapiens
gcacagacuauaggcacaa

SEQ ID NO: 38619 - RNA, 19 nt, Homo sapiens
aaaggaagaaacacugaga

SEQ ID NO: 38620 - RNA, 19 nt, Homo sapiens
guggauggcacagacuaua

SEQ ID NO: 38621 - RNA, 19 nt, Homo sapiens
ccugggaggagcagaaauu

SEQ ID NO: 38622 - RNA, 19 nt, Homo sapiens
ccugaaagcagaucacgau

SEQ ID NO: 38623 - RNA, 19 nt, Homo sapiens
ccaccuccuucuguaauuc

SEQ ID NO: 38624 - RNA, 19 nt, Homo sapiens
agcaacggcucccaaagga

SEQ ID NO: 38625 - RNA, 19 nt, Homo sapiens
caaagagagaaaggaggua

SEQ ID NO: 38626 - RNA, 19 nt, Homo sapiens
gaggaaaggaagaaacacu

SEQ ID NO: 38627 - RNA, 19 nt, Homo sapiens
ugauggcucuuggaaaugg

SEQ ID NO: 38628 - RNA, 19 nt, Homo sapiens
cagcaacggcucccaaagg

SEQ ID NO: 38629 - RNA, 19 nt, Homo sapiens
aaacaaaugcuugaaucuc

SEQ ID NO: 38630 - RNA, 19 nt, Homo sapiens
cguccgcucuccacaccuu

SEQ ID NO: 38631 - RNA, 19 nt, Homo sapiens
acuauaggcacaacuacaa

SEQ ID NO: 38632 - RNA, 19 nt, Homo sapiens
aaaugaccauccuuuccau

SEQ ID NO: 38633 - RNA, 19 nt, Homo sapiens
uauaaucgucagccucuuc

SEQ ID NO: 38634 - RNA, 19 nt, Homo sapiens
agagagaaaggagguaguu

SEQ ID NO: 38635 - RNA, 19 nt, Homo sapiens
cagcacaccucuggcuaac

SEQ ID NO: 38636 - RNA, 19 nt, Homo sapiens
aagugaagacuguguugaa

SEQ ID NO: 38637 - RNA, 19 nt, Homo sapiens
cuccuucuguaauucauug

SEQ ID NO: 38638 - RNA, 19 nt, Homo sapiens
gaaaggagguaguuuaaga

SEQ ID NO: 38639 - RNA, 19 nt, Homo sapiens
gccaaggacuuucaagaua

SEQ ID NO: 38640 - RNA, 19 nt, Homo sapiens
gggaagagcugagcaaaga

SEQ ID NO: 38641 - RNA, 19 nt, Homo sapiens
gagccaagcuggagaaaca

SEQ ID NO: 38642 - RNA, 19 nt, Homo sapiens
gagcagaaauucauuguac

SEQ ID NO: 38643 - RNA, 19 nt, Homo sapiens
gagaaaggagguaguuuaa

SEQ ID NO: 38644 - RNA, 19 nt, Homo sapiens
ccaaggacuuucaagauau

SEQ ID NO: 38645 - RNA, 19 nt, Homo sapiens
gaucccaccuccuucugua

SEQ ID NO: 38646 - RNA, 19 nt, Homo sapiens
gggcugaggcggagaagua

SEQ ID NO: 38647 - RNA, 19 nt, Homo sapiens
agagaaaggagguaguuua

SEQ ID NO: 38648 - RNA, 19 nt, Homo sapiens
ucacucagccagauaauug

SEQ ID NO: 38649 - RNA, 19 nt, Homo sapiens
gcccugcucuuccaucuga

SEQ ID NO: 38650 - RNA, 19 nt, Homo sapiens
gaaauucauuguacaacac

SEQ ID NO: 38651 - RNA, 19 nt, Homo sapiens
agaaacaaaugcuugaauc

SEQ ID NO: 38652 - RNA, 19 nt, Homo sapiens
ggaaaggaagaaacacuga

SEQ ID NO: 38653 - RNA, 19 nt, Homo sapiens
gaagagcugagcaaagaga

SEQ ID NO: 38654 - RNA, 19 nt, Homo sapiens
gcagaaauucauuguacaa

SEQ ID NO: 38655 - RNA, 19 nt, Homo sapiens
ugacggagguccaggcaau

SEQ ID NO: 38656 - RNA, 19 nt, Homo sapiens
caagaucacaucccuagga

SEQ ID NO: 38657 - RNA, 19 nt, Homo sapiens
ggaaagaagaaacaaaugc

SEQ ID NO: 38658 - RNA, 19 nt, Homo sapiens
gaaacaaaugcuugaaucu

SEQ ID NO: 38659 - RNA, 19 nt, Homo sapiens
gaagaaacaaaugcuugaa

SEQ ID NO: 38660 - RNA, 19 nt, Homo sapiens
caaggacuuucaagauauc

SEQ ID NO: 38661 - RNA, 19 nt, Homo sapiens
agugauggcucuuggaaau

SEQ ID NO: 38662 - RNA, 19 nt, Homo sapiens
caucauggccaaggacuuu

SEQ ID NO: 38663 - RNA, 19 nt, Homo sapiens
gaaagaagaaacaaaugcu

SEQ ID NO: 38664 - RNA, 19 nt, Homo sapiens
gaagugaagacuguguuga

SEQ ID NO: 38665 - RNA, 19 nt, Homo sapiens
uacaagaacugggcuguca

SEQ ID NO: 38666 - RNA, 19 nt, Homo sapiens
gcucuggcuucucuguuga

SEQ ID NO: 38667 - RNA, 19 nt, Homo sapiens
cagcgugggugacaagauc

SEQ ID NO: 38668 - RNA, 19 nt, Homo sapiens
gcuucucuguugaggauuu

SEQ ID NO: 38669 - RNA, 19 nt, Homo sapiens
ggaagugaagacuguguug

SEQ ID NO: 38670 - RNA, 19 nt, Homo sapiens
ggagcagaaauucauugua

SEQ ID NO: 38671 - RNA, 19 nt, Homo sapiens
guaggaaagaagaaacaaa

SEQ ID NO: 38672 - RNA, 19 nt, Homo sapiens
gagcugagcaaagagagaa

SEQ ID NO: 38673 - RNA, 19 nt, Homo sapiens
gaccauccuuuccaucaag

SEQ ID NO: 38674 - RNA, 19 nt, Homo sapiens
ggguggaagugaagacugu

SEQ ID NO: 38675 - RNA, 19 nt, Homo sapiens
ggccaaggacuuucaagau

SEQ ID NO: 38676 - RNA, 19 nt, Homo sapiens
gggaggagcagaaauucau

SEQ ID NO: 38677 - RNA, 19 nt, Homo sapiens
agaagaaacaaaugcuuga

SEQ ID NO: 38678 - RNA, 19 nt, Homo sapiens
ccucuucaauggcguagga

SEQ ID NO: 38679 - RNA, 19 nt, Homo sapiens
gagagaaaggagguaguuu

SEQ ID NO: 38680 - RNA, 19 nt, Homo sapiens
ucaauggcguaggaaagaa

SEQ ID NO: 38681 - RNA, 19 nt, Homo sapiens
cgagcuggguggaagugaa

SEQ ID NO: 38682 - RNA, 19 nt, Homo sapiens
ggaggagcagaaauucauu

SEQ ID NO: 38683 - RNA, 19 nt, Homo sapiens
ugaccauccuuuccaucaa

SEQ ID NO: 38684 - RNA, 19 nt, Homo sapiens
gaggagcagaaauucauug

SEQ ID NO: 38685 - RNA, 19 nt, Homo sapiens
uggcuucucuguugaggau

SEQ ID NO: 38686 - RNA, 19 nt, Homo sapiens
cagacuauaggcacaacua

SEQ ID NO: 38687 - RNA, 19 nt, Homo sapiens
gcacagacuauaggcacaa

SEQ ID NO: 38688 - RNA, 19 nt, Homo sapiens
aaaggaagaaacacugaga

SEQ ID NO: 38689 - RNA, 19 nt, Homo sapiens
guggauggcacagacuaua

SEQ ID NO: 38690 - RNA, 19 nt, Homo sapiens
ccugggaggagcagaaauu

SEQ ID NO: 38691 - RNA, 19 nt, Homo sapiens
ccugaaagcagaucacgau

SEQ ID NO: 38692 - RNA, 19 nt, Homo sapiens
ccaccuccuucuguaauuc

SEQ ID NO: 38693 - RNA, 19 nt, Homo sapiens
agcaacggcucccaaagga

SEQ ID NO: 38694 - RNA, 19 nt, Homo sapiens
caaagagagaaaggaggua

SEQ ID NO: 38695 - RNA, 19 nt, Homo sapiens
gaggaaaggaagaaacacu

SEQ ID NO: 38696 - RNA, 19 nt, Homo sapiens
ugauggcucuuggaaaugg

SEQ ID NO: 38697 - RNA, 19 nt, Homo sapiens
cagcaacggcucccaaagg

SEQ ID NO: 38698 - RNA, 19 nt, Homo sapiens
aaacaaaugcuugaaucuc

SEQ ID NO: 38699 - RNA, 19 nt, Homo sapiens
acuauaggcacaacuacaa

SEQ ID NO: 38700 - RNA, 19 nt, Homo sapiens
aaaugaccauccuuuccau

SEQ ID NO: 38701 - RNA, 19 nt, Homo sapiens
uauaaucgucagccucuuc

SEQ ID NO: 38702 - RNA, 19 nt, Homo sapiens
agagagaaaggagguaguu

SEQ ID NO: 38703 - RNA, 19 nt, Homo sapiens
cagcacaccucuggcuaac

SEQ ID NO: 38704 - RNA, 19 nt, Homo sapiens
aagugaagacuguguugaa

SEQ ID NO: 38705 - RNA, 19 nt, Homo sapiens
cuccuucuguaauucauug

SEQ ID NO: 38706 - RNA, 19 nt, Homo sapiens
ccaaacagaucggcagaaa

SEQ ID NO: 38707 - RNA, 19 nt, Homo sapiens
agaagcaacuccucuguga

SEQ ID NO: 38708 - RNA, 19 nt, Homo sapiens
caagaaauccaaacagauc

SEQ ID NO: 38709 - RNA, 19 nt, Homo sapiens
caacuccucugugaaccua

SEQ ID NO: 38710 - RNA, 19 nt, Homo sapiens
aacaagaaauccaaacaga

SEQ ID NO: 38711 - RNA, 19 nt, Homo sapiens
ggaugucccuucugucucu

SEQ ID NO: 38712 - RNA, 19 nt, Homo sapiens
gaacaagaaauccaaacag

SEQ ID NO: 38713 - RNA, 19 nt, Homo sapiens
gaaaagcagcagaaaagaa

SEQ ID NO: 38714 - RNA, 19 nt, Homo sapiens
gaagcaacuccucugugaa

SEQ ID NO: 38715 - RNA, 19 nt, Homo sapiens
agaccuggcuugggcuaaa

SEQ ID NO: 38716 - RNA, 19 nt, Homo sapiens
gagaagcuccgagaugaca

SEQ ID NO: 38717 - RNA, 19 nt, Homo sapiens
gcagaaaagcagcagaaaa

SEQ ID NO: 38718 - RNA, 19 nt, Homo sapiens
gggcuaaaaucgaaauaca

SEQ ID NO: 38719 - RNA, 19 nt, Homo sapiens
aaaagcagcagaaaagaaa

SEQ ID NO: 38720 - RNA, 19 nt, Homo sapiens
gauggaugucacccgcuua

SEQ ID NO: 38721 - RNA, 19 nt, Homo sapiens
ugaacaagaaauccaaaca

SEQ ID NO: 38722 - RNA, 19 nt, Homo sapiens
cagaaaagcagcagaaaag

SEQ ID NO: 38723 - RNA, 19 nt, Homo sapiens
ggaugucacccgcuuacuc

SEQ ID NO: 38724 - RNA, 19 nt, Homo sapiens
acaagaaauccaaacagau

SEQ ID NO: 38725 - RNA, 19 nt, Homo sapiens
gcugaacaagaaauccaaa

SEQ ID NO: 38726 - RNA, 19 nt, Homo sapiens
ggucuuccucugcuucuuc

SEQ ID NO: 38727 - RNA, 19 nt, Homo sapiens
aaacagaucggcagaaaag

SEQ ID NO: 38728 - RNA, 19 nt, Homo sapiens
ucccuucugucucuauugu

SEQ ID NO: 38729 - RNA, 19 nt, Homo sapiens
ccacugaccuugccuauua

SEQ ID NO: 38730 - RNA, 19 nt, Homo sapiens
gagcagaacucaacuuugg

SEQ ID NO: 38731 - RNA, 19 nt, Homo sapiens
aaacugaacuccaaugaug

SEQ ID NO: 38732 - RNA, 19 nt, Homo sapiens
caaggaagcuguguuugaa

SEQ ID NO: 38733 - RNA, 19 nt, Homo sapiens
ggacaaggaagcuguguuu

SEQ ID NO: 38734 - RNA, 19 nt, Homo sapiens
cagggcaccuucaaacuga

SEQ ID NO: 38735 - RNA, 19 nt, Homo sapiens
cgggaaagcuguguucaug

SEQ ID NO: 38736 - RNA, 19 nt, Homo sapiens
ucucuacgcugcagauuca

SEQ ID NO: 38737 - RNA, 19 nt, Homo sapiens
gaagcuguguuugaagugu

SEQ ID NO: 38738 - RNA, 19 nt, Homo sapiens
acaaggaagcuguguuuga

SEQ ID NO: 38739 - RNA, 19 nt, Homo sapiens
caacauggccucggagagu

SEQ ID NO: 38740 - RNA, 19 nt, Homo sapiens
ccacuggcgucaucucuac

SEQ ID NO: 38741 - RNA, 19 nt, Homo sapiens
gcaccuacaacaaagacuu

SEQ ID NO: 38742 - RNA, 19 nt, Homo sapiens
aggcagggcuccucaccaa

SEQ ID NO: 38743 - RNA, 19 nt, Homo sapiens
gaaguucaacgcguccauu

SEQ ID NO: 38744 - RNA, 19 nt, Homo sapiens
caccuacaacaaagacuua

SEQ ID NO: 38745 - RNA, 19 nt, Homo sapiens
uggagccacuggauucuga

SEQ ID NO: 38746 - RNA, 19 nt, Homo sapiens
ggacauccacacagccaau

SEQ ID NO: 38747 - RNA, 19 nt, Homo sapiens
ucaaacugaacuccaauga

SEQ ID NO: 38748 - RNA, 19 nt, Homo sapiens
ccgacaugcuggccacuga

SEQ ID NO: 38749 - RNA, 19 nt, Homo sapiens
gcaccaaggaauucagcuu

SEQ ID NO: 38750 - RNA, 19 nt, Homo sapiens
ggacuucccagcaccuaca

SEQ ID NO: 38751 - RNA, 19 nt, Homo sapiens
cuagugagcgggacuuugu

SEQ ID NO: 38752 - RNA, 19 nt, Homo sapiens
cgaggaaccgcccaacaug

SEQ ID NO: 38753 - RNA, 19 nt, Homo sapiens
ccgagcagaacucaacuuu

SEQ ID NO: 38754 - RNA, 19 nt, Homo sapiens
gauacuccauggccuagac

SEQ ID NO: 38755 - RNA, 19 nt, Homo sapiens
caaacugaacuccaaugau

SEQ ID NO: 38756 - RNA, 19 nt, Homo sapiens
ucccagcaccuacaacaaa

SEQ ID NO: 38757 - RNA, 19 nt, Homo sapiens
gugcggaagcggaucaaug

SEQ ID NO: 38758 - RNA, 19 nt, Homo sapiens
ccagggcaccuucaaacug

SEQ ID NO: 38759 - RNA, 19 nt, Homo sapiens
ucaccaaggccgagaugga

SEQ ID NO: 38760 - RNA, 19 nt, Homo sapiens
aggaagcuguguuugaagu

SEQ ID NO: 38761 - RNA, 19 nt, Homo sapiens
ggacuuuguggccgaguuc

SEQ ID NO: 38762 - RNA, 19 nt, Homo sapiens
gggacuuuguggccgaguu

SEQ ID NO: 38763 - RNA, 19 nt, Homo sapiens
gcagaggcggaacgugaug

SEQ ID NO: 38764 - RNA, 19 nt, Homo sapiens
gcagauucaccaagagaac

SEQ ID NO: 38765 - RNA, 19 nt, Homo sapiens
uuugggagguggauguuca

SEQ ID NO: 38766 - RNA, 19 nt, Homo sapiens
caaggcugggcguguguuu

SEQ ID NO: 38767 - RNA, 19 nt, Homo sapiens
ugacccaucucagcaggau

SEQ ID NO: 38768 - RNA, 19 nt, Homo sapiens
ggaagcuguguuugaagug

SEQ ID NO: 38769 - RNA, 19 nt, Homo sapiens
ccaucacucucaacagcau

SEQ ID NO: 38770 - RNA, 19 nt, Homo sapiens
ggauaaagcuggaaaccau

SEQ ID NO: 38771 - RNA, 19 nt, Homo sapiens
ucagagacuuccaguuuaa

SEQ ID NO: 38772 - RNA, 19 nt, Homo sapiens
gagaggaucuaccacacuu

SEQ ID NO: 38773 - RNA, 19 nt, Homo sapiens
caaagcagcacuucucauu

SEQ ID NO: 38774 - RNA, 19 nt, Homo sapiens
ucaaagcacacaagacaua

SEQ ID NO: 38775 - RNA, 19 nt, Homo sapiens
aaacaggagccauuuauga

SEQ ID NO: 38776 - RNA, 19 nt, Homo sapiens
gcacacaagacauaauaau

SEQ ID NO: 38777 - RNA, 19 nt, Homo sapiens
ucacgcagcucuacucucu

SEQ ID NO: 38778 - RNA, 19 nt, Homo sapiens
gauguaagaucaccguuuu

SEQ ID NO: 38779 - RNA, 19 nt, Homo sapiens
gagaaggaaggaaccagua

SEQ ID NO: 38780 - RNA, 19 nt, Homo sapiens
ccuaucgccuccuuaauga

SEQ ID NO: 38781 - RNA, 19 nt, Homo sapiens
cuucagagacuuccaguuu

SEQ ID NO: 38782 - RNA, 19 nt, Homo sapiens
gcucuacucucugaacaug

SEQ ID NO: 38783 - RNA, 19 nt, Homo sapiens
gaacaaaagcgcagagaga

SEQ ID NO: 38784 - RNA, 19 nt, Homo sapiens
uugaaagccuccuggauga

SEQ ID NO: 38785 - RNA, 19 nt, Homo sapiens
gaaaacaggagccauuuau

SEQ ID NO: 38786 - RNA, 19 nt, Homo sapiens
aagcacacaagacauaaua

SEQ ID NO: 38787 - RNA, 19 nt, Homo sapiens
ggauguaagaucaccguuu

SEQ ID NO: 38788 - RNA, 19 nt, Homo sapiens
uucagagacuuccaguuua

SEQ ID NO: 38789 - RNA, 19 nt, Homo sapiens
gcaaagagaagaacaaaag

SEQ ID NO: 38790 - RNA, 19 nt, Homo sapiens
ggugguggcauucugguaa

SEQ ID NO: 38791 - RNA, 19 nt, Homo sapiens
caaagcacacaagacauaa

SEQ ID NO: 38792 - RNA, 19 nt, Homo sapiens
cgucaaagcacacaagaca

SEQ ID NO: 38793 - RNA, 19 nt, Homo sapiens
aggaaugcaugucucugua

SEQ ID NO: 38794 - RNA, 19 nt, Homo sapiens
acgcagcucuacucucuga

SEQ ID NO: 38795 - RNA, 19 nt, Homo sapiens
gcagcaaagagaagaacaa

SEQ ID NO: 38796 - RNA, 19 nt, Homo sapiens
gaacuggagcagcaaagag

SEQ ID NO: 38797 - RNA, 19 nt, Homo sapiens
ggaagcugaucuguacauc

SEQ ID NO: 38798 - RNA, 19 nt, Homo sapiens
gccuaucgccuccuuaaug

SEQ ID NO: 38799 - RNA, 19 nt, Homo sapiens
gagacuuccaguuuaagaa

SEQ ID NO: 38800 - RNA, 19 nt, Homo sapiens
cagcaaagagaagaacaaa

SEQ ID NO: 38801 - RNA, 19 nt, Homo sapiens
ccaggaggaagaacagauu

SEQ ID NO: 38802 - RNA, 19 nt, Homo sapiens
gaaagccuccuggaugaag

SEQ ID NO: 38803 - RNA, 19 nt, Homo sapiens
aagaacagauugacuucca

SEQ ID NO: 38804 - RNA, 19 nt, Homo sapiens
ggaacuggagcagcaaaga

SEQ ID NO: 38805 - RNA, 19 nt, Homo sapiens
guggcauucugguaauuga

SEQ ID NO: 38806 - RNA, 19 nt, Homo sapiens
cuggagcucuggcuaagga

SEQ ID NO: 38807 - RNA, 19 nt, Homo sapiens
gggcuggagcucuggcuaa

SEQ ID NO: 38808 - RNA, 19 nt, Homo sapiens
cccugaagcugcugaaagu

SEQ ID NO: 38809 - RNA, 19 nt, Homo sapiens
agacuuccaguuuaagaaa

SEQ ID NO: 38810 - RNA, 19 nt, Homo sapiens
ggaucuaccacacuugcaa

SEQ ID NO: 38811 - RNA, 19 nt, Homo sapiens
uccggaagcugaucuguac

SEQ ID NO: 38812 - RNA, 19 nt, Homo sapiens
ggacggcaaagcagcacuu

SEQ ID NO: 38813 - RNA, 19 nt, Homo sapiens
uacccuggauguaagauca

SEQ ID NO: 38814 - RNA, 19 nt, Homo sapiens
ggcauucugguaauugaaa

SEQ ID NO: 38815 - RNA, 19 nt, Homo sapiens
uggccaggguccuccauga

SEQ ID NO: 38816 - RNA, 19 nt, Homo sapiens
aaccaucauucucagcaaa

SEQ ID NO: 38817 - RNA, 19 nt, Homo sapiens
aaaccaucauucucagcaa

SEQ ID NO: 38818 - RNA, 19 nt, Homo sapiens
gcgagcggcuacaguucau

SEQ ID NO: 38819 - RNA, 19 nt, Homo sapiens
cagcucuacucucugaaca

SEQ ID NO: 38820 - RNA, 19 nt, Homo sapiens
uaagaaaacaggagccauu

SEQ ID NO: 38821 - RNA, 19 nt, Homo sapiens
gcauucugguaauugaaag

SEQ ID NO: 38822 - RNA, 19 nt, Homo sapiens
aagcagcacuucucauucc

SEQ ID NO: 38823 - RNA, 19 nt, Homo sapiens
gcaaagcagcacuucucau

SEQ ID NO: 38824 - RNA, 19 nt, Homo sapiens
gagcucuggcuaaggaaug

SEQ ID NO: 38825 - RNA, 19 nt, Homo sapiens
gcagacgccgugagagaag

SEQ ID NO: 38826 - RNA, 19 nt, Homo sapiens
ugacugggcagacggaaag

SEQ ID NO: 38827 - RNA, 19 nt, Homo sapiens
aggaagaacagauugacuu

SEQ ID NO: 38828 - RNA, 19 nt, Homo sapiens
ggaaugcaugucucuguac

SEQ ID NO: 38829 - RNA, 19 nt, Homo sapiens
aagcugaucuguacauccu

SEQ ID NO: 38830 - RNA, 19 nt, Homo sapiens
ccgcguguucucacucaua

SEQ ID NO: 38831 - RNA, 19 nt, Homo sapiens
aaagccuccuggaugaaga

SEQ ID NO: 38832 - RNA, 19 nt, Homo sapiens
gugguggcauucugguaau

SEQ ID NO: 38833 - RNA, 19 nt, Homo sapiens
caggcucugugcuccuuga

SEQ ID NO: 38834 - RNA, 19 nt, Homo sapiens
uaacgucaaagcacacaag

SEQ ID NO: 38835 - RNA, 19 nt, Homo sapiens
ggagcagcaaagagaagaa

SEQ ID NO: 38836 - RNA, 19 nt, Homo sapiens
cuggaaaccaucauucuca

SEQ ID NO: 38837 - RNA, 19 nt, Homo sapiens
ggcagacgccgugagagaa

SEQ ID NO: 38838 - RNA, 19 nt, Homo sapiens
uggcagacgccgugagaga

SEQ ID NO: 38839 - RNA, 19 nt, Homo sapiens
acaggagccauuuaugaug

SEQ ID NO: 38840 - RNA, 19 nt, Homo sapiens
ggagaggaucuaccacacu

SEQ ID NO: 38841 - RNA, 19 nt, Homo sapiens
cggcaaagcagcacuucuc

SEQ ID NO: 38842 - RNA, 19 nt, Homo sapiens
ggcaaagcagcacuucuca

SEQ ID NO: 38843 - RNA, 19 nt, Homo sapiens
caucauucucagcaaacua

SEQ ID NO: 38844 - RNA, 19 nt, Homo sapiens
gaucagcccuuucaucuca

SEQ ID NO: 38845 - RNA, 19 nt, Homo sapiens
gagaagcccugcaagaugu

SEQ ID NO: 38846 - RNA, 19 nt, Homo sapiens
ggacgugccugacgaguuc

SEQ ID NO: 38847 - RNA, 19 nt, Homo sapiens
gaacuucucggugguggua

SEQ ID NO: 38848 - RNA, 19 nt, Homo sapiens
uggaggaccuguaugaaga

SEQ ID NO: 38849 - RNA, 19 nt, Homo sapiens
ucucaaaggugccuaccaa

SEQ ID NO: 38850 - RNA, 19 nt, Homo sapiens
ccacagacccagcacacaa

SEQ ID NO: 38851 - RNA, 19 nt, Homo sapiens
gcguaugcauugcugaguu

SEQ ID NO: 38852 - RNA, 19 nt, Homo sapiens
gacaaccucuuugcuaugg

SEQ ID NO: 38853 - RNA, 19 nt, Homo sapiens
cgagaagcccugcaagaug

SEQ ID NO: 38854 - RNA, 19 nt, Homo sapiens
gagcagacaacuuucaucu

SEQ ID NO: 38855 - RNA, 19 nt, Homo sapiens
gagcagcgcagccugaagu

SEQ ID NO: 38856 - RNA, 19 nt, Homo sapiens
cagaccagcuggccuccaa

SEQ ID NO: 38857 - RNA, 19 nt, Homo sapiens
uaugacaaccucuuugcua

SEQ ID NO: 38858 - RNA, 19 nt, Homo sapiens
gcucuucaauaaaugaucu

SEQ ID NO: 38859 - RNA, 19 nt, Homo sapiens
caagauccaggccaaguau

SEQ ID NO: 38860 - RNA, 19 nt, Homo sapiens
caaaggugccuaccaaggu

SEQ ID NO: 38861 - RNA, 19 nt, Homo sapiens
caaggacccugagcagaca

SEQ ID NO: 38862 - RNA, 19 nt, Homo sapiens
cccaaccgcugccauuuca

SEQ ID NO: 38863 - RNA, 19 nt, Homo sapiens
ccagauggaggaccuguau

SEQ ID NO: 38864 - RNA, 19 nt, Homo sapiens
ccgcuggagccuacacuua

SEQ ID NO: 38865 - RNA, 19 nt, Homo sapiens
agaaccagaucagcccuuu

SEQ ID NO: 38866 - RNA, 19 nt, Homo sapiens
ucucgguggugguauuuga

SEQ ID NO: 38867 - RNA, 19 nt, Homo sapiens
gagccuacacuuagcaaca

SEQ ID NO: 38868 - RNA, 19 nt, Homo sapiens
caacuuucaucugcguaug

SEQ ID NO: 38869 - RNA, 19 nt, Homo sapiens
gaugaggccaugagcuaug

SEQ ID NO: 38870 - RNA, 19 nt, Homo sapiens
ucgaugaggccaugagcua

SEQ ID NO: 38871 - RNA, 19 nt, Homo sapiens
gagcaugggcaagaagaug

SEQ ID NO: 38872 - RNA, 19 nt, Homo sapiens
acaagauccaggccaagua

SEQ ID NO: 38873 - RNA, 19 nt, Homo sapiens
ccucuuugcuauggagauu

SEQ ID NO: 38874 - RNA, 19 nt, Homo sapiens
ucgugaagcugccgcuguu

SEQ ID NO: 38875 - RNA, 19 nt, Homo sapiens
agauggaggaccuguauga

SEQ ID NO: 38876 - RNA, 19 nt, Homo sapiens
acccugagcagacaacuuu

SEQ ID NO: 38877 - RNA, 19 nt, Homo sapiens
gagcuaugccgaggucaug

SEQ ID NO: 38878 - RNA, 19 nt, Homo sapiens
gauggaggaccuguaugaa

SEQ ID NO: 38879 - RNA, 19 nt, Homo sapiens
gagcuggccaagugcaaga

SEQ ID NO: 38880 - RNA, 19 nt, Homo sapiens
cguaugcauugcugaguuc

SEQ ID NO: 38881 - RNA, 19 nt, Homo sapiens
cuaccucucccaccucuug

SEQ ID NO: 38882 - RNA, 19 nt, Homo sapiens
gcaagauugacacacacaa

SEQ ID NO: 38883 - RNA, 19 nt, Homo sapiens
augacaaccucuuugcuau

SEQ ID NO: 38884 - RNA, 19 nt, Homo sapiens
cugaguuccugucccugua

SEQ ID NO: 38885 - RNA, 19 nt, Homo sapiens
ccagaucagcccuuucauc

SEQ ID NO: 38886 - RNA, 19 nt, Homo sapiens
gugagaguguucugaucau

SEQ ID NO: 38887 - RNA, 19 nt, Homo sapiens
cagcacacaacaucucaga

SEQ ID NO: 38888 - RNA, 19 nt, Homo sapiens
ucuuugcuauggagauuga

SEQ ID NO: 38889 - RNA, 19 nt, Homo sapiens
gcgugagaguguucugauc

SEQ ID NO: 38890 - RNA, 19 nt, Homo sapiens
ccgagaagcccugcaagau

SEQ ID NO: 38891 - RNA, 19 nt, Homo sapiens
ugacaaccucuuugcuaug

SEQ ID NO: 38892 - RNA, 19 nt, Homo sapiens
caaccgcugccauuucaca

SEQ ID NO: 38893 - RNA, 19 nt, Homo sapiens
gagaguguucugaucaucu

SEQ ID NO: 38894 - RNA, 19 nt, Homo sapiens
gaguuccugucccuguaug

SEQ ID NO: 38895 - RNA, 19 nt, Homo sapiens
ccucuugcucuucaauaaa

SEQ ID NO: 38896 - RNA, 19 nt, Homo sapiens
aaccagaucagcccuuuca

SEQ ID NO: 38897 - RNA, 19 nt, Homo sapiens
cucuugcucuucaauaaau

SEQ ID NO: 38898 - RNA, 19 nt, Homo sapiens
accucuugcucuucaauaa

SEQ ID NO: 38899 - RNA, 19 nt, Homo sapiens
agugcaagauugacacaca

SEQ ID NO: 38900 - RNA, 19 nt, Homo sapiens
gaaccagaucagcccuuuc

SEQ ID NO: 38901 - RNA, 19 nt, Homo sapiens
cgugagaguguucugauca

SEQ ID NO: 38902 - RNA, 19 nt, Homo sapiens
uuaugcagaucaagaacca

SEQ ID NO: 38903 - RNA, 19 nt, Homo sapiens
cggcuuaugcagaucaaga

SEQ ID NO: 38904 - RNA, 19 nt, Homo sapiens
caaaguggauggugagaua

SEQ ID NO: 38905 - RNA, 19 nt, Homo sapiens
gaaaugagaauuccaaaga

SEQ ID NO: 38906 - RNA, 19 nt, Homo sapiens
gcaaauauuucuucguguu

SEQ ID NO: 38907 - RNA, 19 nt, Homo sapiens
ggugaaaucuacaaccaua

SEQ ID NO: 38908 - RNA, 19 nt, Homo sapiens
cuaaaggucuuguuacauu

SEQ ID NO: 38909 - RNA, 19 nt, Homo sapiens
guuaagaauuccugguuua

SEQ ID NO: 38910 - RNA, 19 nt, Homo sapiens
guaaagaaacguuugauga

SEQ ID NO: 38911 - RNA, 19 nt, Homo sapiens
gaagcuaaaggucuuguua

SEQ ID NO: 38912 - RNA, 19 nt, Homo sapiens
gaaagaagcccaaguacag

SEQ ID NO: 38913 - RNA, 19 nt, Homo sapiens
ggagucagaccuuuguuua

SEQ ID NO: 38914 - RNA, 19 nt, Homo sapiens
gaacugagagucccauuuc

SEQ ID NO: 38915 - RNA, 19 nt, Homo sapiens
caauucgagugaagaaaua

SEQ ID NO: 38916 - RNA, 19 nt, Homo sapiens
ugagggaacucuauuuguu

SEQ ID NO: 38917 - RNA, 19 nt, Homo sapiens
ccaaguauauucggaagaa

SEQ ID NO: 38918 - RNA, 19 nt, Homo sapiens
gaagugaacauuaugaagu

SEQ ID NO: 38919 - RNA, 19 nt, Homo sapiens
cuagaaagguggcagauca

SEQ ID NO: 38920 - RNA, 19 nt, Homo sapiens
gcuguaaugugaaagcaaa

SEQ ID NO: 38921 - RNA, 19 nt, Homo sapiens
gagagacguuugaggauuc

SEQ ID NO: 38922 - RNA, 19 nt, Homo sapiens
gcugaaagaagcccaagua

SEQ ID NO: 38923 - RNA, 19 nt, Homo sapiens
caacugcugcuuuggauuu

SEQ ID NO: 38924 - RNA, 19 nt, Homo sapiens
aagcuuagguggucuuuau

SEQ ID NO: 38925 - RNA, 19 nt, Homo sapiens
caaaugcagcccagaaauu

SEQ ID NO: 38926 - RNA, 19 nt, Homo sapiens
ccagaaauuucccuucaau

SEQ ID NO: 38927 - RNA, 19 nt, Homo sapiens
gguuaaauaucaucacugu

SEQ ID NO: 38928 - RNA, 19 nt, Homo sapiens
ccguggaaaugguuaaaua

SEQ ID NO: 38929 - RNA, 19 nt, Homo sapiens
uauguuggaugguguguuu

SEQ ID NO: 38930 - RNA, 19 nt, Homo sapiens
gcaacagcauuuugaauuu

SEQ ID NO: 38931 - RNA, 19 nt, Homo sapiens
uuacuaccgucaagucuuu

SEQ ID NO: 38932 - RNA, 19 nt, Homo sapiens
gaacucuauuuguuugaug

SEQ ID NO: 38933 - RNA, 19 nt, Homo sapiens
ggaaacuuaugacauuaca

SEQ ID NO: 38934 - RNA, 19 nt, Homo sapiens
gauagaaacugugaagaac

SEQ ID NO: 38935 - RNA, 19 nt, Homo sapiens
ccaaagaaggauauuacua

SEQ ID NO: 38936 - RNA, 19 nt, Homo sapiens
aagaauuccugguuuaaga

SEQ ID NO: 38937 - RNA, 19 nt, Homo sapiens
uagaaacugugaagaacaa

SEQ ID NO: 38938 - RNA, 19 nt, Homo sapiens
uuaaagcaaugacagaaga

SEQ ID NO: 38939 - RNA, 19 nt, Homo sapiens
cuuggaaacuuaugacauu

SEQ ID NO: 38940 - RNA, 19 nt, Homo sapiens
agucagaccuuuguuuaaa

SEQ ID NO: 38941 - RNA, 19 nt, Homo sapiens
gcacacagagguccagaug

SEQ ID NO: 38942 - RNA, 19 nt, Homo sapiens
caaagaaggauauuacuac

SEQ ID NO: 38943 - RNA, 19 nt, Homo sapiens
gagggaacucuauuuguuu

SEQ ID NO: 38944 - RNA, 19 nt, Homo sapiens
gcccagaaauuucccuuca

SEQ ID NO: 38945 - RNA, 19 nt, Homo sapiens
gaaagguggcagaucauau

SEQ ID NO: 38946 - RNA, 19 nt, Homo sapiens
gaugauugccuuucuguuc

SEQ ID NO: 38947 - RNA, 19 nt, Homo sapiens
uaaaggucuuguuacauug

SEQ ID NO: 38948 - RNA, 19 nt, Homo sapiens
acacagagguccagaugca

SEQ ID NO: 38949 - RNA, 19 nt, Homo sapiens
ccaaagaaugggauagaaa

SEQ ID NO: 38950 - RNA, 19 nt, Homo sapiens
ggaauacguugaacaucag

SEQ ID NO: 38951 - RNA, 19 nt, Homo sapiens
ggagaaggaucagaugaac

SEQ ID NO: 38952 - RNA, 19 nt, Homo sapiens
ggguagagauacauaugga

SEQ ID NO: 38953 - RNA, 19 nt, Homo sapiens
gaaauuucccuucaauacu

SEQ ID NO: 38954 - RNA, 19 nt, Homo sapiens
gcaaaugcagcccagaaau

SEQ ID NO: 38955 - RNA, 19 nt, Homo sapiens
aggaauacguugaacauca

SEQ ID NO: 38956 - RNA, 19 nt, Homo sapiens
gcauucaggcucuggauga

SEQ ID NO: 38957 - RNA, 19 nt, Homo sapiens
gguggcagaucauauugga

SEQ ID NO: 38958 - RNA, 19 nt, Homo sapiens
aaagaaacguuugaugaca

SEQ ID NO: 38959 - RNA, 19 nt, Homo sapiens
gaugguguguuugcauuug

SEQ ID NO: 38960 - RNA, 19 nt, Homo sapiens
cuacaagucagcugucaaa

SEQ ID NO: 38961 - RNA, 19 nt, Homo sapiens
cagaucauauuggaaguga

SEQ ID NO: 38962 - RNA, 19 nt, Homo sapiens
aaagguggcagaucauauu

SEQ ID NO: 38963 - RNA, 19 nt, Homo sapiens
gaaaucuacaaccauaaga

SEQ ID NO: 38964 - RNA, 19 nt, Homo sapiens
ggaacucuauuuguuugau

SEQ ID NO: 38965 - RNA, 19 nt, Homo sapiens
caaaguugcauccguggaa

SEQ ID NO: 38966 - RNA, 19 nt, Homo sapiens
cugaauaaaucacuugaag

SEQ ID NO: 38967 - RNA, 19 nt, Homo sapiens
gaugacagacagaaggauu

SEQ ID NO: 38968 - RNA, 19 nt, Homo sapiens
gagucagaccuuuguuuaa

SEQ ID NO: 38969 - RNA, 19 nt, Homo sapiens
ggauauuacuaccgucaag

SEQ ID NO: 38970 - RNA, 19 nt, Homo sapiens
ccaaucugauacccaaaga

SEQ ID NO: 38971 - RNA, 19 nt, Homo sapiens
gagagucccauuucuagau

SEQ ID NO: 38972 - RNA, 19 nt, Homo sapiens
ggauacugccaauaagaaa

SEQ ID NO: 38973 - RNA, 19 nt, Homo sapiens
agagagacguuugaggauu

SEQ ID NO: 38974 - RNA, 19 nt, Homo sapiens
uuacgcaggguuacauaua

SEQ ID NO: 38975 - RNA, 19 nt, Homo sapiens
ggaagacagccccgauuua

SEQ ID NO: 38976 - RNA, 19 nt, Homo sapiens
gcacuccgcgacucccuuu

SEQ ID NO: 38977 - RNA, 19 nt, Homo sapiens
cauauggagucagaccuuu

SEQ ID NO: 38978 - RNA, 19 nt, Homo sapiens
caaaggaggaauugagcaa

SEQ ID NO: 38979 - RNA, 19 nt, Homo sapiens
uuacaauggugaaaucuac

SEQ ID NO: 38980 - RNA, 19 nt, Homo sapiens
ucagguugaugaugcaaug

SEQ ID NO: 38981 - RNA, 19 nt, Homo sapiens
agaaggaucagaugaacuu

SEQ ID NO: 38982 - RNA, 19 nt, Homo sapiens
gcaauuggcauggaagaca

SEQ ID NO: 38983 - RNA, 19 nt, Homo sapiens
guaguugacccgcuguuug

SEQ ID NO: 38984 - RNA, 19 nt, Homo sapiens
caggcuaacuuggguguga

SEQ ID NO: 38985 - RNA, 19 nt, Homo sapiens
caaauauuucuucguguug

SEQ ID NO: 38986 - RNA, 19 nt, Homo sapiens
cagaaauuucccuucaaua

SEQ ID NO: 38987 - RNA, 19 nt, Homo sapiens
uaaaucacuugaagaaagc

SEQ ID NO: 38988 - RNA, 19 nt, Homo sapiens
agauagaaacugugaagaa

SEQ ID NO: 38989 - RNA, 19 nt, Homo sapiens
agauacauauggagucaga

SEQ ID NO: 38990 - RNA, 19 nt, Homo sapiens
ccaauucgagugaagaaau

SEQ ID NO: 38991 - RNA, 19 nt, Homo sapiens
guagauaggggaacaauga

SEQ ID NO: 38992 - RNA, 19 nt, Homo sapiens
aaauuucccuucaauacuc

SEQ ID NO: 38993 - RNA, 19 nt, Homo sapiens
gaauuccugguuuaagauu

SEQ ID NO: 38994 - RNA, 19 nt, Homo sapiens
agaaacguuugaugacaga

SEQ ID NO: 38995 - RNA, 19 nt, Homo sapiens
ucuuuaugcuguaauguga

SEQ ID NO: 38996 - RNA, 19 nt, Homo sapiens
ccagaaaugagaauuccaa

SEQ ID NO: 38997 - RNA, 19 nt, Homo sapiens
gagagugagaggcuucuga

SEQ ID NO: 38998 - RNA, 19 nt, Homo sapiens
gaaggaucagaugaacuua

SEQ ID NO: 38999 - RNA, 19 nt, Homo sapiens
ggaagugaacauuaugaag

SEQ ID NO: 39000 - RNA, 19 nt, Homo sapiens
gaacuuacgcaggguuaca

SEQ ID NO: 39001 - RNA, 19 nt, Homo sapiens
cuccagacauuugcaauug

SEQ ID NO: 39002 - RNA, 19 nt, Homo sapiens
caauguggagaaacucuuu

SEQ ID NO: 39003 - RNA, 19 nt, Homo sapiens
uuucuucaaucacaucuga

SEQ ID NO: 39004 - RNA, 19 nt, Homo sapiens
caaaguggauggugagaua

SEQ ID NO: 39005 - RNA, 19 nt, Homo sapiens
gaaaugagaauuccaaaga

SEQ ID NO: 39006 - RNA, 19 nt, Homo sapiens
gcaaauauuucuucguguu

SEQ ID NO: 39007 - RNA, 19 nt, Homo sapiens
ggugaaaucuacaaccaua

SEQ ID NO: 39008 - RNA, 19 nt, Homo sapiens
ggaagagacugcggccuua

SEQ ID NO: 39009 - RNA, 19 nt, Homo sapiens
cuaaaggucuuguuacauu

SEQ ID NO: 39010 - RNA, 19 nt, Homo sapiens
guuaagaauuccugguuua

SEQ ID NO: 39011 - RNA, 19 nt, Homo sapiens
guaaagaaacguuugauga

SEQ ID NO: 39012 - RNA, 19 nt, Homo sapiens
gaagcuaaaggucuuguua

SEQ ID NO: 39013 - RNA, 19 nt, Homo sapiens
gaaagaagcccaaguacag

SEQ ID NO: 39014 - RNA, 19 nt, Homo sapiens
ggagucagaccuuuguuua

SEQ ID NO: 39015 - RNA, 19 nt, Homo sapiens
gaacugagagucccauuuc

SEQ ID NO: 39016 - RNA, 19 nt, Homo sapiens
caauucgagugaagaaaua

SEQ ID NO: 39017 - RNA, 19 nt, Homo sapiens
ugagggaacucuauuuguu

SEQ ID NO: 39018 - RNA, 19 nt, Homo sapiens
gagcaaacccugccgagaa

SEQ ID NO: 39019 - RNA, 19 nt, Homo sapiens
ccaaguauauucggaagaa

SEQ ID NO: 39020 - RNA, 19 nt, Homo sapiens
gaagugaacauuaugaagu

SEQ ID NO: 39021 - RNA, 19 nt, Homo sapiens
cuagaaagguggcagauca

SEQ ID NO: 39022 - RNA, 19 nt, Homo sapiens
gcuguaaugugaaagcaaa

SEQ ID NO: 39023 - RNA, 19 nt, Homo sapiens
gagagacguuugaggauuc

SEQ ID NO: 39024 - RNA, 19 nt, Homo sapiens
gcugaaagaagcccaagua

SEQ ID NO: 39025 - RNA, 19 nt, Homo sapiens
caacugcugcuuuggauuu

SEQ ID NO: 39026 - RNA, 19 nt, Homo sapiens
aagcuuagguggucuuuau

SEQ ID NO: 39027 - RNA, 19 nt, Homo sapiens
caaaugcagcccagaaauu

SEQ ID NO: 39028 - RNA, 19 nt, Homo sapiens
ccagaaauuucccuucaau

SEQ ID NO: 39029 - RNA, 19 nt, Homo sapiens
gguuaaauaucaucacugu

SEQ ID NO: 39030 - RNA, 19 nt, Homo sapiens
ccguggaaaugguuaaaua

SEQ ID NO: 39031 - RNA, 19 nt, Homo sapiens
uauguuggaugguguguuu

SEQ ID NO: 39032 - RNA, 19 nt, Homo sapiens
gcaacagcauuuugaauuu

SEQ ID NO: 39033 - RNA, 19 nt, Homo sapiens
uuacuaccgucaagucuuu

SEQ ID NO: 39034 - RNA, 19 nt, Homo sapiens
gaacucuauuuguuugaug

SEQ ID NO: 39035 - RNA, 19 nt, Homo sapiens
ggaaacuuaugacauuaca

SEQ ID NO: 39036 - RNA, 19 nt, Homo sapiens
gauagaaacugugaagaac

SEQ ID NO: 39037 - RNA, 19 nt, Homo sapiens
ccaaagaaggauauuacua

SEQ ID NO: 39038 - RNA, 19 nt, Homo sapiens
aagaauuccugguuuaaga

SEQ ID NO: 39039 - RNA, 19 nt, Homo sapiens
uagaaacugugaagaacaa

SEQ ID NO: 39040 - RNA, 19 nt, Homo sapiens
uuaaagcaaugacagaaga

SEQ ID NO: 39041 - RNA, 19 nt, Homo sapiens
cuuggaaacuuaugacauu

SEQ ID NO: 39042 - RNA, 19 nt, Homo sapiens
agucagaccuuuguuuaaa

SEQ ID NO: 39043 - RNA, 19 nt, Homo sapiens
gcacacagagguccagaug

SEQ ID NO: 39044 - RNA, 19 nt, Homo sapiens
caaagaaggauauuacuac

SEQ ID NO: 39045 - RNA, 19 nt, Homo sapiens
gagggaacucuauuuguuu

SEQ ID NO: 39046 - RNA, 19 nt, Homo sapiens
ggaggcagcggcaguuuga

SEQ ID NO: 39047 - RNA, 19 nt, Homo sapiens
gcccagaaauuucccuuca

SEQ ID NO: 39048 - RNA, 19 nt, Homo sapiens
gaaagguggcagaucauau

SEQ ID NO: 39049 - RNA, 19 nt, Homo sapiens
gaugauugccuuucuguuc

SEQ ID NO: 39050 - RNA, 19 nt, Homo sapiens
uaaaggucuuguuacauug

SEQ ID NO: 39051 - RNA, 19 nt, Homo sapiens
acacagagguccagaugca

SEQ ID NO: 39052 - RNA, 19 nt, Homo sapiens
ccaaagaaugggauagaaa

SEQ ID NO: 39053 - RNA, 19 nt, Homo sapiens
ggaauacguugaacaucag

SEQ ID NO: 39054 - RNA, 19 nt, Homo sapiens
ggagaaggaucagaugaac

SEQ ID NO: 39055 - RNA, 19 nt, Homo sapiens
ggguagagauacauaugga

SEQ ID NO: 39056 - RNA, 19 nt, Homo sapiens
gaaauuucccuucaauacu

SEQ ID NO: 39057 - RNA, 19 nt, Homo sapiens
gcaaaugcagcccagaaau

SEQ ID NO: 39058 - RNA, 19 nt, Homo sapiens
aggaauacguugaacauca

SEQ ID NO: 39059 - RNA, 19 nt, Homo sapiens
gcauucaggcucuggauga

SEQ ID NO: 39060 - RNA, 19 nt, Homo sapiens
gguggcagaucauauugga

SEQ ID NO: 39061 - RNA, 19 nt, Homo sapiens
aaagaaacguuugaugaca

SEQ ID NO: 39062 - RNA, 19 nt, Homo sapiens
gaugguguguuugcauuug

SEQ ID NO: 39063 - RNA, 19 nt, Homo sapiens
cuacaagucagcugucaaa

SEQ ID NO: 39064 - RNA, 19 nt, Homo sapiens
cagaucauauuggaaguga

SEQ ID NO: 39065 - RNA, 19 nt, Homo sapiens
aaagguggcagaucauauu

SEQ ID NO: 39066 - RNA, 19 nt, Homo sapiens
gaaaucuacaaccauaaga

SEQ ID NO: 39067 - RNA, 19 nt, Homo sapiens
cugcaagacucaucaagug

SEQ ID NO: 39068 - RNA, 19 nt, Homo sapiens
ggaacucuauuuguuugau

SEQ ID NO: 39069 - RNA, 19 nt, Homo sapiens
caaaguugcauccguggaa

SEQ ID NO: 39070 - RNA, 19 nt, Homo sapiens
gaugacagacagaaggauu

SEQ ID NO: 39071 - RNA, 19 nt, Homo sapiens
gagucagaccuuuguuuaa

SEQ ID NO: 39072 - RNA, 19 nt, Homo sapiens
cugaauaaaucacuugaag

SEQ ID NO: 39073 - RNA, 19 nt, Homo sapiens
ggauauuacuaccgucaag

SEQ ID NO: 39074 - RNA, 19 nt, Homo sapiens
ccaaucugauacccaaaga

SEQ ID NO: 39075 - RNA, 19 nt, Homo sapiens
gagagucccauuucuagau

SEQ ID NO: 39076 - RNA, 19 nt, Homo sapiens
ggauacugccaauaagaaa

SEQ ID NO: 39077 - RNA, 19 nt, Homo sapiens
agagagacguuugaggauu

SEQ ID NO: 39078 - RNA, 19 nt, Homo sapiens
uuacgcaggguuacauaua

SEQ ID NO: 39079 - RNA, 19 nt, Homo sapiens
ggaagacagccccgauuua

SEQ ID NO: 39080 - RNA, 19 nt, Homo sapiens
gcacuccgcgacucccuuu

SEQ ID NO: 39081 - RNA, 19 nt, Homo sapiens
cauauggagucagaccuuu

SEQ ID NO: 39082 - RNA, 19 nt, Homo sapiens
caaaggaggaauugagcaa

SEQ ID NO: 39083 - RNA, 19 nt, Homo sapiens
uuacaauggugaaaucuac

SEQ ID NO: 39084 - RNA, 19 nt, Homo sapiens
ucagguugaugaugcaaug

SEQ ID NO: 39085 - RNA, 19 nt, Homo sapiens
agaaggaucagaugaacuu

SEQ ID NO: 39086 - RNA, 19 nt, Homo sapiens
gcaauuggcauggaagaca

SEQ ID NO: 39087 - RNA, 19 nt, Homo sapiens
guaguugacccgcuguuug

SEQ ID NO: 39088 - RNA, 19 nt, Homo sapiens
caggcuaacuuggguguga

SEQ ID NO: 39089 - RNA, 19 nt, Homo sapiens
caaauauuucuucguguug

SEQ ID NO: 39090 - RNA, 19 nt, Homo sapiens
uaaaucacuugaagaaagc

SEQ ID NO: 39091 - RNA, 19 nt, Homo sapiens
cagaaauuucccuucaaua

SEQ ID NO: 39092 - RNA, 19 nt, Homo sapiens
agauagaaacugugaagaa

SEQ ID NO: 39093 - RNA, 19 nt, Homo sapiens
agauacauauggagucaga

SEQ ID NO: 39094 - RNA, 19 nt, Homo sapiens
ccaauucgagugaagaaau

SEQ ID NO: 39095 - RNA, 19 nt, Homo sapiens
guagauaggggaacaauga

SEQ ID NO: 39096 - RNA, 19 nt, Homo sapiens
aaauuucccuucaauacuc

SEQ ID NO: 39097 - RNA, 19 nt, Homo sapiens
gaauuccugguuuaagauu

SEQ ID NO: 39098 - RNA, 19 nt, Homo sapiens
agaaacguuugaugacaga

SEQ ID NO: 39099 - RNA, 19 nt, Homo sapiens
ucuuuaugcuguaauguga

SEQ ID NO: 39100 - RNA, 19 nt, Homo sapiens
ccagaaaugagaauuccaa

SEQ ID NO: 39101 - RNA, 19 nt, Homo sapiens
gagagugagaggcuucuga

SEQ ID NO: 39102 - RNA, 19 nt, Homo sapiens
gaaggaucagaugaacuua

SEQ ID NO: 39103 - RNA, 19 nt, Homo sapiens
ggaagugaacauuaugaag

SEQ ID NO: 39104 - RNA, 19 nt, Homo sapiens
gagaagggcucaagaaaua

SEQ ID NO: 39105 - RNA, 19 nt, Homo sapiens
gaacagggcuggagguaaa

SEQ ID NO: 39106 - RNA, 19 nt, Homo sapiens
gaagauuccuaugacauua

SEQ ID NO: 39107 - RNA, 19 nt, Homo sapiens
agaaaucacuuccagcuua

SEQ ID NO: 39108 - RNA, 19 nt, Homo sapiens
gcaaagacaacuaaacuaa

SEQ ID NO: 39109 - RNA, 19 nt, Homo sapiens
ugaaugaggccgcauauua

SEQ ID NO: 39110 - RNA, 19 nt, Homo sapiens
ccagauauauugacuguga

SEQ ID NO: 39111 - RNA, 19 nt, Homo sapiens
gaagaaguguaccagauau

SEQ ID NO: 39112 - RNA, 19 nt, Homo sapiens
cagaagauuugccauauga

SEQ ID NO: 39113 - RNA, 19 nt, Homo sapiens
ucaaagaaguguuuccuau

SEQ ID NO: 39114 - RNA, 19 nt, Homo sapiens
guauguagcuuauucaaag

SEQ ID NO: 39115 - RNA, 19 nt, Homo sapiens
ucugagagcugauaucuug

SEQ ID NO: 39116 - RNA, 19 nt, Homo sapiens
ccacuacccugcuacguuu

SEQ ID NO: 39117 - RNA, 19 nt, Homo sapiens
caacuaaacuaacgcucaa

SEQ ID NO: 39118 - RNA, 19 nt, Homo sapiens
agaguaggguugugccuua

SEQ ID NO: 39119 - RNA, 19 nt, Homo sapiens
caagggaauucuguacuuu

SEQ ID NO: 39120 - RNA, 19 nt, Homo sapiens
ucacauugcugaagaacau

SEQ ID NO: 39121 - RNA, 19 nt, Homo sapiens
gauuaaacaugcucuugau

SEQ ID NO: 39122 - RNA, 19 nt, Homo sapiens
agaaauugcugcuaucauc

SEQ ID NO: 39123 - RNA, 19 nt, Homo sapiens
uaucuuggaucaaaugaga

SEQ ID NO: 39124 - RNA, 19 nt, Homo sapiens
guaggcaucuaagcaaauu

SEQ ID NO: 39125 - RNA, 19 nt, Homo sapiens
auaaacagccuuuguauuc

SEQ ID NO: 39126 - RNA, 19 nt, Homo sapiens
gaaaucacuuccagcuuac

SEQ ID NO: 39127 - RNA, 19 nt, Homo sapiens
gagcauccuucccucaaau

SEQ ID NO: 39128 - RNA, 19 nt, Homo sapiens
gaagggcucaagaaauaaa

SEQ ID NO: 39129 - RNA, 19 nt, Homo sapiens
caaagaaguguuuccuauu

SEQ ID NO: 39130 - RNA, 19 nt, Homo sapiens
ccaaguauccuguggguau

SEQ ID NO: 39131 - RNA, 19 nt, Homo sapiens
gaaguguaccagauauauu

SEQ ID NO: 39132 - RNA, 19 nt, Homo sapiens
ugaagaaguguaccagaua

SEQ ID NO: 39133 - RNA, 19 nt, Homo sapiens
ugagcuaaccggaguauuu

SEQ ID NO: 39134 - RNA, 19 nt, Homo sapiens
ucaagggaauucuguacuu

SEQ ID NO: 39135 - RNA, 19 nt, Homo sapiens
ggaugaaaauggagaaauu

SEQ ID NO: 39136 - RNA, 19 nt, Homo sapiens
caaguauccuguggguaua

SEQ ID NO: 39137 - RNA, 19 nt, Homo sapiens
caacaccaccucuaacaug

SEQ ID NO: 39138 - RNA, 19 nt, Homo sapiens
gugaagaaguguaccagau

SEQ ID NO: 39139 - RNA, 19 nt, Homo sapiens
ccagagcagugaagaagug

SEQ ID NO: 39140 - RNA, 19 nt, Homo sapiens
ccuuugaucucucuucuga

SEQ ID NO: 39141 - RNA, 19 nt, Homo sapiens
uaaacagccuuuguauuca

SEQ ID NO: 39142 - RNA, 19 nt, Homo sapiens
gaaugaggccgcauauuac

SEQ ID NO: 39143 - RNA, 19 nt, Homo sapiens
ugaucucucuucugaauug

SEQ ID NO: 39144 - RNA, 19 nt, Homo sapiens
ggugcacucuuauucuuga

SEQ ID NO: 39145 - RNA, 19 nt, Homo sapiens
gaauugcagaaaucagaua

SEQ ID NO: 39146 - RNA, 19 nt, Homo sapiens
cacggugucuuacaaauuc

SEQ ID NO: 39147 - RNA, 19 nt, Homo sapiens
gaguauuucugguuaagca

SEQ ID NO: 39148 - RNA, 19 nt, Homo sapiens
acuuccagcuuacaucuua

SEQ ID NO: 39149 - RNA, 19 nt, Homo sapiens
guaggguugugccuuauuc

SEQ ID NO: 39150 - RNA, 19 nt, Homo sapiens
gucagaagauuugccauau

SEQ ID NO: 39151 - RNA, 19 nt, Homo sapiens
ucagaagauuugccauaug

SEQ ID NO: 39152 - RNA, 19 nt, Homo sapiens
guuaagcauuggcuagaga

SEQ ID NO: 39153 - RNA, 19 nt, Homo sapiens
aaauucugcuagucuguaa

SEQ ID NO: 39154 - RNA, 19 nt, Homo sapiens
ugaagauuccuaugacauu

SEQ ID NO: 39155 - RNA, 19 nt, Homo sapiens
gaagauuugccauaugaag

SEQ ID NO: 39156 - RNA, 19 nt, Homo sapiens
ggguagcucaacauucuua

SEQ ID NO: 39157 - RNA, 19 nt, Homo sapiens
gaaguguuuccuauuucua

SEQ ID NO: 39158 - RNA, 19 nt, Homo sapiens
uaccagauauauugacugu

SEQ ID NO: 39159 - RNA, 19 nt, Homo sapiens
aaacuaacgcucaaugcaa

SEQ ID NO: 39160 - RNA, 19 nt, Homo sapiens
aaagacaacuaaacuaacg

SEQ ID NO: 39161 - RNA, 19 nt, Homo sapiens
gagaacagggcuggaggua

SEQ ID NO: 39162 - RNA, 19 nt, Homo sapiens
caaauucugcuagucugua

SEQ ID NO: 39163 - RNA, 19 nt, Homo sapiens
gaggaacccaugggaauga

SEQ ID NO: 39164 - RNA, 19 nt, Homo sapiens
aacuaacgcucaaugcaaa

SEQ ID NO: 39165 - RNA, 19 nt, Homo sapiens
gagcuaaccggaguauuuc

SEQ ID NO: 39166 - RNA, 19 nt, Homo sapiens
gcugaagaacauauacaaa

SEQ ID NO: 39167 - RNA, 19 nt, Homo sapiens
uaucauccauccuaaucug

SEQ ID NO: 39168 - RNA, 19 nt, Homo sapiens
ggagaaauugcugcuauca

SEQ ID NO: 39169 - RNA, 19 nt, Homo sapiens
cugcuacguuuaucugauu

SEQ ID NO: 39170 - RNA, 19 nt, Homo sapiens
ccauugaggucuauaaaau

SEQ ID NO: 39171 - RNA, 19 nt, Homo sapiens
ugucagaagauuugccaua

SEQ ID NO: 39172 - RNA, 19 nt, Homo sapiens
aagaaguguuuccuauuuc

SEQ ID NO: 39173 - RNA, 19 nt, Homo sapiens
aguauucgcugcuguuuac

SEQ ID NO: 39174 - RNA, 19 nt, Homo sapiens
gcuaucauccauccuaauc

SEQ ID NO: 39175 - RNA, 19 nt, Homo sapiens
acagugaagauuccuauga

SEQ ID NO: 39176 - RNA, 19 nt, Homo sapiens
aaucgaauuuccuuugauc

SEQ ID NO: 39177 - RNA, 19 nt, Homo sapiens
uuugaucucucuucugaau

SEQ ID NO: 39178 - RNA, 19 nt, Homo sapiens
cgaauuuccuuugaucucu

SEQ ID NO: 39179 - RNA, 19 nt, Homo sapiens
ggaggaacccaugggaaug

SEQ ID NO: 39180 - RNA, 19 nt, Homo sapiens
guugcuaucuuuggaggaa

SEQ ID NO: 39181 - RNA, 19 nt, Homo sapiens
uuggugaaaugacuucuug

SEQ ID NO: 39182 - RNA, 19 nt, Homo sapiens
ugauuaaacaugcucuuga

SEQ ID NO: 39183 - RNA, 19 nt, Homo sapiens
gaguaggguugugccuuau

SEQ ID NO: 39184 - RNA, 19 nt, Homo sapiens
guacuuugcccuuuuggua

SEQ ID NO: 39185 - RNA, 19 nt, Homo sapiens
gauuugccauaugaaguga

SEQ ID NO: 39186 - RNA, 19 nt, Homo sapiens
aaacagccuuuguauucag

SEQ ID NO: 39187 - RNA, 19 nt, Homo sapiens
uuggguagcucaacauucu

SEQ ID NO: 39188 - RNA, 19 nt, Homo sapiens
uaaacuaacgcucaaugca

SEQ ID NO: 39189 - RNA, 19 nt, Homo sapiens
gcugcuaucauccauccua

SEQ ID NO: 39190 - RNA, 19 nt, Homo sapiens
gagagcugauaucuuggau

SEQ ID NO: 39191 - RNA, 19 nt, Homo sapiens
caaaagacagugaagauuc

SEQ ID NO: 39192 - RNA, 19 nt, Homo sapiens
ucgcugcuguuuacauuag

SEQ ID NO: 39193 - RNA, 19 nt, Homo sapiens
caaagacaacuaaacuaac

SEQ ID NO: 39194 - RNA, 19 nt, Homo sapiens
ccacugggcggagacugua

SEQ ID NO: 39195 - RNA, 19 nt, Homo sapiens
ugcgaccacucguuccaua

SEQ ID NO: 39196 - RNA, 19 nt, Homo sapiens
aaguguaccagauauauug

SEQ ID NO: 39197 - RNA, 19 nt, Homo sapiens
cgguaggcaucuaagcaaa

SEQ ID NO: 39198 - RNA, 19 nt, Homo sapiens
gcugcuguuuacauuagaa

SEQ ID NO: 39199 - RNA, 19 nt, Homo sapiens
accggaguauuucugguua

SEQ ID NO: 39200 - RNA, 19 nt, Homo sapiens
agaaguguaccagauauau

SEQ ID NO: 39201 - RNA, 19 nt, Homo sapiens
gagcagugaagaaguguac

SEQ ID NO: 39202 - RNA, 19 nt, Homo sapiens
ccggaguauuucugguuaa

SEQ ID NO: 39203 - RNA, 19 nt, Homo sapiens
auggagaaauugcugcuau

SEQ ID NO: 39204 - RNA, 19 nt, Homo sapiens
gaagaggacagaucaaaua

SEQ ID NO: 39205 - RNA, 19 nt, Homo sapiens
gaucaaauauuccaucaug

SEQ ID NO: 39206 - RNA, 19 nt, Homo sapiens
gcaaggugcucaucuuuga

SEQ ID NO: 39207 - RNA, 19 nt, Homo sapiens
ugaaguaucucaugaagaa

SEQ ID NO: 39208 - RNA, 19 nt, Homo sapiens
gaggacagaucaaauauuc

SEQ ID NO: 39209 - RNA, 19 nt, Homo sapiens
gauaggagauaaugacaau

SEQ ID NO: 39210 - RNA, 19 nt, Homo sapiens
gaacaaagaggcauauaag

SEQ ID NO: 39211 - RNA, 19 nt, Homo sapiens
gagagcaucccauauuuaa

SEQ ID NO: 39212 - RNA, 19 nt, Homo sapiens
gaagaaaccgagcauaguu

SEQ ID NO: 39213 - RNA, 19 nt, Homo sapiens
acaagaggaugaugaguuu

SEQ ID NO: 39214 - RNA, 19 nt, Homo sapiens
ggaacaaagaggcauauaa

SEQ ID NO: 39215 - RNA, 19 nt, Homo sapiens
gagaagaggagaaguaaug

SEQ ID NO: 39216 - RNA, 19 nt, Homo sapiens
ggaacaagcaguauaugaa

SEQ ID NO: 39217 - RNA, 19 nt, Homo sapiens
uggaagagaugaugucuga

SEQ ID NO: 39218 - RNA, 19 nt, Homo sapiens
uguagaagauucacaggua

SEQ ID NO: 39219 - RNA, 19 nt, Homo sapiens
ggauagaaaucacagaagu

SEQ ID NO: 39220 - RNA, 19 nt, Homo sapiens
gaaacgggcuacacagagu

SEQ ID NO: 39221 - RNA, 19 nt, Homo sapiens
gguuugaucuuguugacua

SEQ ID NO: 39222 - RNA, 19 nt, Homo sapiens
gaagaggugcugaguguga

SEQ ID NO: 39223 - RNA, 19 nt, Homo sapiens
guagaagauucacagguaa

SEQ ID NO: 39224 - RNA, 19 nt, Homo sapiens
gcacaagagaggacacuuu

SEQ ID NO: 39225 - RNA, 19 nt, Homo sapiens
gaugaugaguuucuuaugg

SEQ ID NO: 39226 - RNA, 19 nt, Homo sapiens
caaggaagaagaaaugaaa

SEQ ID NO: 39227 - RNA, 19 nt, Homo sapiens
caaggaaggcugcaagauu

SEQ ID NO: 39228 - RNA, 19 nt, Homo sapiens
ccaaugauacuuccuuaaa

SEQ ID NO: 39229 - RNA, 19 nt, Homo sapiens
ggaaguaccaccagaaaca

SEQ ID NO: 39230 - RNA, 19 nt, Homo sapiens
gcagaggguugggaacaaa

SEQ ID NO: 39231 - RNA, 19 nt, Homo sapiens
gcaaagaaaguuuaugaag

SEQ ID NO: 39232 - RNA, 19 nt, Homo sapiens
gaaagauugcaccaugaua

SEQ ID NO: 39233 - RNA, 19 nt, Homo sapiens
gguaugagcuugggcacaa

SEQ ID NO: 39234 - RNA, 19 nt, Homo sapiens
gcugagagcaucccauauu

SEQ ID NO: 39235 - RNA, 19 nt, Homo sapiens
aguagaagaugaaagauug

SEQ ID NO: 39236 - RNA, 19 nt, Homo sapiens
gaaguuaauccgagaugaa

SEQ ID NO: 39237 - RNA, 19 nt, Homo sapiens
caaugugaauggacugaaa

SEQ ID NO: 39238 - RNA, 19 nt, Homo sapiens
gauagaaaucacagaagua

SEQ ID NO: 39239 - RNA, 19 nt, Homo sapiens
gaugaugucugagcaggaa

SEQ ID NO: 39240 - RNA, 19 nt, Homo sapiens
ggaagaacagcaggaagua

SEQ ID NO: 39241 - RNA, 19 nt, Homo sapiens
ggaaguuaauccgagauga

SEQ ID NO: 39242 - RNA, 19 nt, Homo sapiens
guucaacuauuucccaaug

SEQ ID NO: 39243 - RNA, 19 nt, Homo sapiens
cgacugauguagaugauag

SEQ ID NO: 39244 - RNA, 19 nt, Homo sapiens
guagaagaaguaagcauuu

SEQ ID NO: 39245 - RNA, 19 nt, Homo sapiens
gaagagacaguuucacaag

SEQ ID NO: 39246 - RNA, 19 nt, Homo sapiens
gcaauggcccagcguaaga

SEQ ID NO: 39247 - RNA, 19 nt, Homo sapiens
gagcaucccauauuuaaag

SEQ ID NO: 39248 - RNA, 19 nt, Homo sapiens
gaggaaaggcggacucuca

SEQ ID NO: 39249 - RNA, 19 nt, Homo sapiens
aaggaaggcugcaagauuc

SEQ ID NO: 39250 - RNA, 19 nt, Homo sapiens
gaugaaggccuugcaguga

SEQ ID NO: 39251 - RNA, 19 nt, Homo sapiens
gagauaaugacaaugcaaa

SEQ ID NO: 39252 - RNA, 19 nt, Homo sapiens
ggacuuaaagagagaucua

SEQ ID NO: 39253 - RNA, 19 nt, Homo sapiens
gcugagaagaggagaagua

SEQ ID NO: 39254 - RNA, 19 nt, Homo sapiens
acagguaauuguagaagaa

SEQ ID NO: 39255 - RNA, 19 nt, Homo sapiens
aaagagagaucuacuucag

SEQ ID NO: 39256 - RNA, 19 nt, Homo sapiens
uaugagagguucccugcuu

SEQ ID NO: 39257 - RNA, 19 nt, Homo sapiens
guacgcaaauacccucaga

SEQ ID NO: 39258 - RNA, 19 nt, Homo sapiens
ggaagagacaguuucacaa

SEQ ID NO: 39259 - RNA, 19 nt, Homo sapiens
gaggauagaauuucgaaca

SEQ ID NO: 39260 - RNA, 19 nt, Homo sapiens
acacagaguuaguaaaguc

SEQ ID NO: 39261 - RNA, 19 nt, Homo sapiens
ggaauagaauccggagauc

SEQ ID NO: 39262 - RNA, 19 nt, Homo sapiens
ugagagcaucccauauuua

SEQ ID NO: 39263 - RNA, 19 nt, Homo sapiens
caacuauuucccaaugaua

SEQ ID NO: 39264 - RNA, 19 nt, Homo sapiens
gcucagacaggcaacaauu

SEQ ID NO: 39265 - RNA, 19 nt, Homo sapiens
gagaaguaaugaggugcua

SEQ ID NO: 39266 - RNA, 19 nt, Homo sapiens
ggaagcagugaaugcauuu

SEQ ID NO: 39267 - RNA, 19 nt, Homo sapiens
gcaaggaagaagaaaugaa

SEQ ID NO: 39268 - RNA, 19 nt, Homo sapiens
gaggacacuuugcaucugu

SEQ ID NO: 39269 - RNA, 19 nt, Homo sapiens
cugagagcaucccauauuu

SEQ ID NO: 39270 - RNA, 19 nt, Homo sapiens
gaacaagcaguauaugaac

SEQ ID NO: 39271 - RNA, 19 nt, Homo sapiens
cccagaauaucgaagauga

SEQ ID NO: 39272 - RNA, 19 nt, Homo sapiens
guaaucaggauauggaaga

SEQ ID NO: 39273 - RNA, 19 nt, Homo sapiens
gaauaucgaagaugaagca

SEQ ID NO: 39274 - RNA, 19 nt, Homo sapiens
acaaagaggcauauaagug

SEQ ID NO: 39275 - RNA, 19 nt, Homo sapiens
gguaauuguagaagaagua

SEQ ID NO: 39276 - RNA, 19 nt, Homo sapiens
guauaugaaccucuagaaa

SEQ ID NO: 39277 - RNA, 19 nt, Homo sapiens
ggacagaucaaauauucca

SEQ ID NO: 39278 - RNA, 19 nt, Homo sapiens
caucccauauuuaaaggaa

SEQ ID NO: 39279 - RNA, 19 nt, Homo sapiens
gaaaaugaagggauagaaa

SEQ ID NO: 39280 - RNA, 19 nt, Homo sapiens
gcacugaugaugggagauu

SEQ ID NO: 39281 - RNA, 19 nt, Homo sapiens
ccaagucuaugaggaacaa

SEQ ID NO: 39282 - RNA, 19 nt, Homo sapiens
gaaccugaaguaucucaug

SEQ ID NO: 39283 - RNA, 19 nt, Homo sapiens
ccuggaaccugaaguaucu

SEQ ID NO: 39284 - RNA, 19 nt, Homo sapiens
gaggaugaugaguuucuua

SEQ ID NO: 39285 - RNA, 19 nt, Homo sapiens
cagaucaaauauuccauca

SEQ ID NO: 39286 - RNA, 19 nt, Homo sapiens
cagcaaggaagaagaaaug

SEQ ID NO: 39287 - RNA, 19 nt, Homo sapiens
gauaaugacaaugcaaaga

SEQ ID NO: 39288 - RNA, 19 nt, Homo sapiens
caacaauuucuaggucaua

SEQ ID NO: 39289 - RNA, 19 nt, Homo sapiens
gcaacaauuucuaggucau

SEQ ID NO: 39290 - RNA, 19 nt, Homo sapiens
uaucgaagaugaagcaaaa

SEQ ID NO: 39291 - RNA, 19 nt, Homo sapiens
ugauguggaugaugccaaa

SEQ ID NO: 39292 - RNA, 19 nt, Homo sapiens
gacaaugcaaagaaaguuu

SEQ ID NO: 39293 - RNA, 19 nt, Homo sapiens
gcaggaaguaccaccagaa

SEQ ID NO: 39294 - RNA, 19 nt, Homo sapiens
gaagauucacagguaauug

SEQ ID NO: 39295 - RNA, 19 nt, Homo sapiens
aagaaaccgagcauaguua

SEQ ID NO: 39296 - RNA, 19 nt, Homo sapiens
cuaaugauggcuuugcuaa

SEQ ID NO: 39297 - RNA, 19 nt, Homo sapiens
caauuucuaggucauauga

SEQ ID NO: 39298 - RNA, 19 nt, Homo sapiens
gugaaugcauuuaaagaac

SEQ ID NO: 39299 - RNA, 19 nt, Homo sapiens
guaccaccagaaacaaaua

SEQ ID NO: 39300 - RNA, 19 nt, Homo sapiens
cagaagaggacagaucaaa

SEQ ID NO: 39301 - RNA, 19 nt, Homo sapiens
gacaacaggaugcagaaga

SEQ ID NO: 39302 - RNA, 19 nt, Homo sapiens
uggcaacgcucacucuaca

SEQ ID NO: 39303 - RNA, 19 nt, Homo sapiens
acacaagaaugggaggaaa

SEQ ID NO: 39304 - RNA, 19 nt, Homo sapiens
gcaaaggacuuccguuaua

SEQ ID NO: 39305 - RNA, 19 nt, Homo sapiens
ggacuuccguuauaacuua

SEQ ID NO: 39306 - RNA, 19 nt, Homo sapiens
caacaaauaugaaggaugu

SEQ ID NO: 39307 - RNA, 19 nt, Homo sapiens
cauaaugccuuguaacuuu

SEQ ID NO: 39308 - RNA, 19 nt, Homo sapiens
ugaaggauguuucuaguaa

SEQ ID NO: 39309 - RNA, 19 nt, Homo sapiens
gaaagaggauguccgaaag

SEQ ID NO: 39310 - RNA, 19 nt, Homo sapiens
uaccagauaugcacacuua

SEQ ID NO: 39311 - RNA, 19 nt, Homo sapiens
caaaauggcugaagauaaa

SEQ ID NO: 39312 - RNA, 19 nt, Homo sapiens
caaaggacuuccguuauaa

SEQ ID NO: 39313 - RNA, 19 nt, Homo sapiens
aagaagagcucaagaagga

SEQ ID NO: 39314 - RNA, 19 nt, Homo sapiens
ggaaggaaaguaagaauga

SEQ ID NO: 39315 - RNA, 19 nt, Homo sapiens
gaaggauguuucuaguaaa

SEQ ID NO: 39316 - RNA, 19 nt, Homo sapiens
ggagauggauuugcucguu

SEQ ID NO: 39317 - RNA, 19 nt, Homo sapiens
agacaaagaugacagaaag

SEQ ID NO: 39318 - RNA, 19 nt, Homo sapiens
gaaggaaaguaagaaugaa

SEQ ID NO: 39319 - RNA, 19 nt, Homo sapiens
gguuugaucuuguugacua

SEQ ID NO: 39320 - RNA, 19 nt, Homo sapiens
gaggauguccgaaaggaua

SEQ ID NO: 39321 - RNA, 19 nt, Homo sapiens
gauaugcacacuuaacaaa

SEQ ID NO: 39322 - RNA, 19 nt, Homo sapiens
ggugaggguguguaaauua

SEQ ID NO: 39323 - RNA, 19 nt, Homo sapiens
cuaaagcucuggcaucauc

SEQ ID NO: 39324 - RNA, 19 nt, Homo sapiens
aaagggaaauacccagaaa

SEQ ID NO: 39325 - RNA, 19 nt, Homo sapiens
cagaggugcuucaaggaaa

SEQ ID NO: 39326 - RNA, 19 nt, Homo sapiens
ugaggaaguucuagccaaa

SEQ ID NO: 39327 - RNA, 19 nt, Homo sapiens
ggaaauacccagaaaagaa

SEQ ID NO: 39328 - RNA, 19 nt, Homo sapiens
gaaaggaaaguagaaguuc

SEQ ID NO: 39329 - RNA, 19 nt, Homo sapiens
gaggaaaggcggacucuca

SEQ ID NO: 39330 - RNA, 19 nt, Homo sapiens
gaaagagaaaccugaguca

SEQ ID NO: 39331 - RNA, 19 nt, Homo sapiens
aagcaaaggacuuccguua

SEQ ID NO: 39332 - RNA, 19 nt, Homo sapiens
caagaaggagaaagagaaa

SEQ ID NO: 39333 - RNA, 19 nt, Homo sapiens
gaaauacccagaaaagaaa

SEQ ID NO: 39334 - RNA, 19 nt, Homo sapiens
guaagaaugaagagagaaa

SEQ ID NO: 39335 - RNA, 19 nt, Homo sapiens
cuaaagaagagcucaagaa

SEQ ID NO: 39336 - RNA, 19 nt, Homo sapiens
aauguuacccugugcauaa

SEQ ID NO: 39337 - RNA, 19 nt, Homo sapiens
gaaaguaagaaugaagaga

SEQ ID NO: 39338 - RNA, 19 nt, Homo sapiens
ucaagaaggagaaagagaa

SEQ ID NO: 39339 - RNA, 19 nt, Homo sapiens
gagacaaagaugacagaaa

SEQ ID NO: 39340 - RNA, 19 nt, Homo sapiens
agaaagaggauguccgaaa

SEQ ID NO: 39341 - RNA, 19 nt, Homo sapiens
ggcuaaagcucuggcauca

SEQ ID NO: 39342 - RNA, 19 nt, Homo sapiens
uaaagaagagcucaagaag

SEQ ID NO: 39343 - RNA, 19 nt, Homo sapiens
aaagaugacagaaaggaaa

SEQ ID NO: 39344 - RNA, 19 nt, Homo sapiens
ugauguggaugaugccaaa

SEQ ID NO: 39345 - RNA, 19 nt, Homo sapiens
gagaaaguggaccuagaaa

SEQ ID NO: 39346 - RNA, 19 nt, Homo sapiens
aauauaccgucucauacuu

SEQ ID NO: 39347 - RNA, 19 nt, Homo sapiens
gugaggguguguaaauuag

SEQ ID NO: 39348 - RNA, 19 nt, Homo sapiens
cucaggaacuucauucuuc

SEQ ID NO: 39349 - RNA, 19 nt, Homo sapiens
gaugacagaaaggaaagua

SEQ ID NO: 39350 - RNA, 19 nt, Homo sapiens
acacaagaaugggaggaaa

SEQ ID NO: 39351 - RNA, 19 nt, Homo sapiens
aaacuaggaaucuaugaug

SEQ ID NO: 39352 - RNA, 19 nt, Homo sapiens
gaaguucuagccaaagcaa

SEQ ID NO: 39353 - RNA, 19 nt, Homo sapiens
gaagauaaagagacaaagc

SEQ ID NO: 39354 - RNA, 19 nt, Homo sapiens
ucaggaacuucauucuuca

SEQ ID NO: 39355 - RNA, 19 nt, Homo sapiens
caaagggaaauacccagaa

SEQ ID NO: 39356 - RNA, 19 nt, Homo sapiens
gcauggaggacacaagaau

SEQ ID NO: 39357 - RNA, 19 nt, Homo sapiens
ugacagaaaggaaaguaga

SEQ ID NO: 39358 - RNA, 19 nt, Homo sapiens
uaugaaggauguuucuagu

SEQ ID NO: 39359 - RNA, 19 nt, Homo sapiens
aagagaaaguggaccuaga

SEQ ID NO: 39360 - RNA, 19 nt, Homo sapiens
gcuaaauacucagggagau

SEQ ID NO: 39361 - RNA, 19 nt, Homo sapiens
ugucacagaauaugaugua

SEQ ID NO: 39362 - RNA, 19 nt, Homo sapiens
caaagaugacagaaaggaa

SEQ ID NO: 39363 - RNA, 19 nt, Homo sapiens
agaaaggaaaguagaaguu

SEQ ID NO: 39364 - RNA, 19 nt, Homo sapiens
gguuuauggugauugcauu

SEQ ID NO: 39365 - RNA, 19 nt, Homo sapiens
gacagaaaggaaaguagaa

SEQ ID NO: 39366 - RNA, 19 nt, Homo sapiens
uaaauauaccgucucauac

SEQ ID NO: 39367 - RNA, 19 nt, Homo sapiens
agagaaaguggaccuagaa

SEQ ID NO: 39368 - RNA, 19 nt, Homo sapiens
caaggaaggaaaguaagaa

SEQ ID NO: 39369 - RNA, 19 nt, Homo sapiens
guuaaagaacucacuaaag

SEQ ID NO: 39370 - RNA, 19 nt, Homo sapiens
caaauaugaaggauguuuc

SEQ ID NO: 39371 - RNA, 19 nt, Homo sapiens
ucaaggaaggaaaguaaga

SEQ ID NO: 39372 - RNA, 19 nt, Homo sapiens
uaacuuaucagaggugcuu

SEQ ID NO: 39373 - RNA, 19 nt, Homo sapiens
ucagggagauggauuugcu

SEQ ID NO: 39374 - RNA, 19 nt, Homo sapiens
gaaaagaaacggcuaaagc

SEQ ID NO: 39375 - RNA, 19 nt, Homo sapiens
augcagaccuauccaggaa

SEQ ID NO: 39376 - RNA, 19 nt, Homo sapiens
agucaaggaaggaaaguaa

SEQ ID NO: 39377 - RNA, 19 nt, Homo sapiens
guguguaaauuagccauug

SEQ ID NO: 39378 - RNA, 19 nt, Homo sapiens
uaauauugcucugauuggu

SEQ ID NO: 39379 - RNA, 19 nt, Homo sapiens
aaguaagaaugaagagaga

SEQ ID NO: 39380 - RNA, 19 nt, Homo sapiens
aaagaacucacuaaagaag

SEQ ID NO: 39381 - RNA, 19 nt, Homo sapiens
uaccgucucauacuucuaa

SEQ ID NO: 39382 - RNA, 19 nt, Homo sapiens
gcuaaaaccaaggaaaaua

SEQ ID NO: 39383 - RNA, 19 nt, Homo sapiens
cgucucauacuucuaaaug

SEQ ID NO: 39384 - RNA, 19 nt, Homo sapiens
gaaguucuaccagauaugc

SEQ ID NO: 39385 - RNA, 19 nt, Homo sapiens
ggaugaugccaaaguuuua

SEQ ID NO: 39386 - RNA, 19 nt, Homo sapiens
ucagaggugcuucaaggaa

SEQ ID NO: 39387 - RNA, 19 nt, Homo sapiens
uguguaaauuagccauuga

SEQ ID NO: 39388 - RNA, 19 nt, Homo sapiens
cagauaugcacacuuaaca

SEQ ID NO: 39389 - RNA, 19 nt, Homo sapiens
aagaggauguccgaaagga

SEQ ID NO: 39390 - RNA, 19 nt, Homo sapiens
agaacucacuaaagaagag

SEQ ID NO: 39391 - RNA, 19 nt, Homo sapiens
gcucaugugccaccaccuu

SEQ ID NO: 39392 - RNA, 19 nt, Homo sapiens
uguaauauugcucugauug

SEQ ID NO: 39393 - RNA, 19 nt, Homo sapiens
ggcugaagauaaagagaca

SEQ ID NO: 39394 - RNA, 19 nt, Homo sapiens
uguggaugaugccaaaguu

SEQ ID NO: 39395 - RNA, 19 nt, Homo sapiens
uaugcacacuuaacaaagg

SEQ ID NO: 39396 - RNA, 19 nt, Homo sapiens
ucaaaauggcugaagauaa

SEQ ID NO: 39397 - RNA, 19 nt, Homo sapiens
aagagaaaccugagucaag

SEQ ID NO: 39398 - RNA, 19 nt, Homo sapiens
ugacuaugaggaaguucua

SEQ ID NO: 39399 - RNA, 19 nt, Homo sapiens
gauuggugaggguguguaa

SEQ ID NO: 39400 - RNA, 19 nt, Homo sapiens
ggauguuucuaguaaaaug

SEQ ID NO: 39401 - RNA, 19 nt, Homo sapiens
acaaagaugacagaaagga

SEQ ID NO: 39402 - RNA, 19 nt, Homo sapiens
ggaaaguaagaaugaagag

SEQ ID NO: 39403 - RNA, 19 nt, Homo sapiens
guagcugucguuugguuug

SEQ ID NO: 39404 - RNA, 19 nt, Homo sapiens
guauauaccugcacugaua

SEQ ID NO: 39405 - RNA, 19 nt, Homo sapiens
uaacagagaucaucauuag

SEQ ID NO: 39406 - RNA, 19 nt, Homo sapiens
ugaaguaucucaugaagaa

SEQ ID NO: 39407 - RNA, 19 nt, Homo sapiens
aagaauggcccuacuauua

SEQ ID NO: 39408 - RNA, 19 nt, Homo sapiens
acauagaacugaugaauga

SEQ ID NO: 39409 - RNA, 19 nt, Homo sapiens
aagcugaaauuccuuguua

SEQ ID NO: 39410 - RNA, 19 nt, Homo sapiens
guagaacucuggacguuga

SEQ ID NO: 39411 - RNA, 19 nt, Homo sapiens
uauagucucuucagcauuu

SEQ ID NO: 39412 - RNA, 19 nt, Homo sapiens
gaagaaaccgagcauaguu

SEQ ID NO: 39413 - RNA, 19 nt, Homo sapiens
gaagugguuugaucgauau

SEQ ID NO: 39414 - RNA, 19 nt, Homo sapiens
gaaauuccuuguuaagaca

SEQ ID NO: 39415 - RNA, 19 nt, Homo sapiens
acaagaggaugaugaguuu

SEQ ID NO: 39416 - RNA, 19 nt, Homo sapiens
ggaacaagcaguauaugaa

SEQ ID NO: 39417 - RNA, 19 nt, Homo sapiens
uggaagagaugaugucuga

SEQ ID NO: 39418 - RNA, 19 nt, Homo sapiens
ggacguugaggauucauua

SEQ ID NO: 39419 - RNA, 19 nt, Homo sapiens
agaaauaauugcucuguug

SEQ ID NO: 39420 - RNA, 19 nt, Homo sapiens
ggaaggaacacuaaagaug

SEQ ID NO: 39421 - RNA, 19 nt, Homo sapiens
uguagaagauucacaggua

SEQ ID NO: 39422 - RNA, 19 nt, Homo sapiens
ggauagaaaucacagaagu

SEQ ID NO: 39423 - RNA, 19 nt, Homo sapiens
gguuugaucuuguugacua

SEQ ID NO: 39424 - RNA, 19 nt, Homo sapiens
gaaacuaaggagugacaua

SEQ ID NO: 39425 - RNA, 19 nt, Homo sapiens
gaaggaacacuaaagaugu

SEQ ID NO: 39426 - RNA, 19 nt, Homo sapiens
guagaagauucacagguaa

SEQ ID NO: 39427 - RNA, 19 nt, Homo sapiens
gaugaugaguuucuuaugg

SEQ ID NO: 39428 - RNA, 19 nt, Homo sapiens
cagagacgauacucaaauu

SEQ ID NO: 39429 - RNA, 19 nt, Homo sapiens
cauaagaagugguuugauc

SEQ ID NO: 39430 - RNA, 19 nt, Homo sapiens
gaaauaauugcucuguuga

SEQ ID NO: 39431 - RNA, 19 nt, Homo sapiens
gcucagugcucuuacuaga

SEQ ID NO: 39432 - RNA, 19 nt, Homo sapiens
uuaaugagccuuguguuua

SEQ ID NO: 39433 - RNA, 19 nt, Homo sapiens
gaaagauugcaccaugaua

SEQ ID NO: 39434 - RNA, 19 nt, Homo sapiens
agaagugguuugaucgaua

SEQ ID NO: 39435 - RNA, 19 nt, Homo sapiens
aguagaagaugaaagauug

SEQ ID NO: 39436 - RNA, 19 nt, Homo sapiens
aaagauggcugugauagau

SEQ ID NO: 39437 - RNA, 19 nt, Homo sapiens
gauagaaaucacagaagua

SEQ ID NO: 39438 - RNA, 19 nt, Homo sapiens
gaugaugucugagcaggaa

SEQ ID NO: 39439 - RNA, 19 nt, Homo sapiens
uuacaaauaugugccauug

SEQ ID NO: 39440 - RNA, 19 nt, Homo sapiens
ugauagaucuugugaagca

SEQ ID NO: 39441 - RNA, 19 nt, Homo sapiens
caccucagauuaaucauau

SEQ ID NO: 39442 - RNA, 19 nt, Homo sapiens
gaauggcccuacuauuauc

SEQ ID NO: 39443 - RNA, 19 nt, Homo sapiens
ggaagaacagcaggaagua

SEQ ID NO: 39444 - RNA, 19 nt, Homo sapiens
gcaccucagauuaaucaua

SEQ ID NO: 39445 - RNA, 19 nt, Homo sapiens
cgacugauguagaugauag

SEQ ID NO: 39446 - RNA, 19 nt, Homo sapiens
gguacucgauguguaauga

SEQ ID NO: 39447 - RNA, 19 nt, Homo sapiens
ucagugcucuuacuagaug

SEQ ID NO: 39448 - RNA, 19 nt, Homo sapiens
guagaagaaguaagcauuu

SEQ ID NO: 39449 - RNA, 19 nt, Homo sapiens
gaagagacaguuucacaag

SEQ ID NO: 39450 - RNA, 19 nt, Homo sapiens
gaggaaaggcggacucuca

SEQ ID NO: 39451 - RNA, 19 nt, Homo sapiens
ggaccaugagcaacuauaa

SEQ ID NO: 39452 - RNA, 19 nt, Homo sapiens
agucuuaccugaauuuaug

SEQ ID NO: 39453 - RNA, 19 nt, Homo sapiens
gcaauggcccagcguaaga

SEQ ID NO: 39454 - RNA, 19 nt, Homo sapiens
gagacgauacucaaauuau

SEQ ID NO: 39455 - RNA, 19 nt, Homo sapiens
gaaaggaccaugagcaacu

SEQ ID NO: 39456 - RNA, 19 nt, Homo sapiens
ggacuuaaagagagaucua

SEQ ID NO: 39457 - RNA, 19 nt, Homo sapiens
acagguaauuguagaagaa

SEQ ID NO: 39458 - RNA, 19 nt, Homo sapiens
aaagagagaucuacuucag

SEQ ID NO: 39459 - RNA, 19 nt, Homo sapiens
gcuuuaaguguucagauua

SEQ ID NO: 39460 - RNA, 19 nt, Homo sapiens
gcaggguuuucauauauua

SEQ ID NO: 39461 - RNA, 19 nt, Homo sapiens
ggaagagacaguuucacaa

SEQ ID NO: 39462 - RNA, 19 nt, Homo sapiens
gcuauagucucuucagcau

SEQ ID NO: 39463 - RNA, 19 nt, Homo sapiens
gaucaucauuagcugugaa

SEQ ID NO: 39464 - RNA, 19 nt, Homo sapiens
ggagugacauagaacugau

SEQ ID NO: 39465 - RNA, 19 nt, Homo sapiens
gccuuuggcuaauugagua

SEQ ID NO: 39466 - RNA, 19 nt, Homo sapiens
gugaagauuugaguuguau

SEQ ID NO: 39467 - RNA, 19 nt, Homo sapiens
gaacaagcaguauaugaac

SEQ ID NO: 39468 - RNA, 19 nt, Homo sapiens
cccagaauaucgaagauga

SEQ ID NO: 39469 - RNA, 19 nt, Homo sapiens
ugaaauuccuuguuaagac

SEQ ID NO: 39470 - RNA, 19 nt, Homo sapiens
cauuagcugugaagauuug

SEQ ID NO: 39471 - RNA, 19 nt, Homo sapiens
guaaucaggauauggaaga

SEQ ID NO: 39472 - RNA, 19 nt, Homo sapiens
gaauaucgaagaugaagca

SEQ ID NO: 39473 - RNA, 19 nt, Homo sapiens
gguaauuguagaagaagua

SEQ ID NO: 39474 - RNA, 19 nt, Homo sapiens
guauaugaaccucuagaaa

SEQ ID NO: 39475 - RNA, 19 nt, Homo sapiens
gaauuaaugagccuugugu

SEQ ID NO: 39476 - RNA, 19 nt, Homo sapiens
acuaaggagugacauagaa

SEQ ID NO: 39477 - RNA, 19 nt, Homo sapiens
uaauagcuauagucucuuc

SEQ ID NO: 39478 - RNA, 19 nt, Homo sapiens
ugugauagaucuugugaag

SEQ ID NO: 39479 - RNA, 19 nt, Homo sapiens
gaaaaugaagggauagaaa

SEQ ID NO: 39480 - RNA, 19 nt, Homo sapiens
uaaugagccuuguguuuac

SEQ ID NO: 39481 - RNA, 19 nt, Homo sapiens
gugguuugaucgauauauu

SEQ ID NO: 39482 - RNA, 19 nt, Homo sapiens
gcuaacagagaucaucauu

SEQ ID NO: 39483 - RNA, 19 nt, Homo sapiens
caagaucuuugggaaggaa

SEQ ID NO: 39484 - RNA, 19 nt, Homo sapiens
ccagauacuuaaagcuuca

SEQ ID NO: 39485 - RNA, 19 nt, Homo sapiens
ccaagucuaugaggaacaa

SEQ ID NO: 39486 - RNA, 19 nt, Homo sapiens
gaaccugaaguaucucaug

SEQ ID NO: 39487 - RNA, 19 nt, Homo sapiens
ccuggaaccugaaguaucu

SEQ ID NO: 39488 - RNA, 19 nt, Homo sapiens
gaggaugaugaguuucuua

SEQ ID NO: 39489 - RNA, 19 nt, Homo sapiens
gaacugaugaaugagcaaa

SEQ ID NO: 39490 - RNA, 19 nt, Homo sapiens
gccuugagcuggguugauu

SEQ ID NO: 39491 - RNA, 19 nt, Homo sapiens
caggaaguaccaccagaua

SEQ ID NO: 39492 - RNA, 19 nt, Homo sapiens
uaucgaagaugaagcaaaa

SEQ ID NO: 39493 - RNA, 19 nt, Homo sapiens
ugauguggaugaugccaaa

SEQ ID NO: 39494 - RNA, 19 nt, Homo sapiens
agaauggcccuacuauuau

SEQ ID NO: 39495 - RNA, 19 nt, Homo sapiens
gaagauucacagguaauug

SEQ ID NO: 39496 - RNA, 19 nt, Homo sapiens
aagaaaccgagcauaguua

SEQ ID NO: 39497 - RNA, 19 nt, Homo sapiens
aaaggaccaugagcaacua

SEQ ID NO: 39498 - RNA, 19 nt, Homo sapiens
uuacugagcagaucaagau

SEQ ID NO: 39499 - RNA, 19 nt, Homo sapiens
caacaucgguggauuuucu

SEQ ID NO: 39500 - RNA, 19 nt, Homo sapiens
acacaagaaugggaggaaa

SEQ ID NO: 39501 - RNA, 19 nt, Homo sapiens
cauggguacucgaugugua

SEQ ID NO: 39502 - RNA, 19 nt, Homo sapiens
ugugaagauuugaguugua

SEQ ID NO: 39503 - RNA, 19 nt, Homo sapiens
uaagaguacuuuguguuag

SEQ ID NO: 39504 - RNA, 19 nt, Homo sapiens
caacaaauaugaaggaugu

SEQ ID NO: 39505 - RNA, 19 nt, Homo sapiens
cauaaugccuuguaacuuu

SEQ ID NO: 39506 - RNA, 19 nt, Homo sapiens
ugaaggauguuucuaguaa

SEQ ID NO: 39507 - RNA, 19 nt, Homo sapiens
gaaagaggauguccgaaag

SEQ ID NO: 39508 - RNA, 19 nt, Homo sapiens
uaccagauaugcacacuua

SEQ ID NO: 39509 - RNA, 19 nt, Homo sapiens
caaaauggcugaagauaaa

SEQ ID NO: 39510 - RNA, 19 nt, Homo sapiens
aagaagagcucaagaagga

SEQ ID NO: 39511 - RNA, 19 nt, Homo sapiens
ggaaggaaaguaagaauga

SEQ ID NO: 39512 - RNA, 19 nt, Homo sapiens
gaaggauguuucuaguaaa

SEQ ID NO: 39513 - RNA, 19 nt, Homo sapiens
ggagauggauuugcucguu

SEQ ID NO: 39514 - RNA, 19 nt, Homo sapiens
agacaaagaugacagaaag

SEQ ID NO: 39515 - RNA, 19 nt, Homo sapiens
gaaggaaaguaagaaugaa

SEQ ID NO: 39516 - RNA, 19 nt, Homo sapiens
gguuugaucuuguugacua

SEQ ID NO: 39517 - RNA, 19 nt, Homo sapiens
gaggauguccgaaaggaua

SEQ ID NO: 39518 - RNA, 19 nt, Homo sapiens
gauaugcacacuuaacaaa

SEQ ID NO: 39519 - RNA, 19 nt, Homo sapiens
ggugaggguguguaaauua

SEQ ID NO: 39520 - RNA, 19 nt, Homo sapiens
cuaaagcucuggcaucauc

SEQ ID NO: 39521 - RNA, 19 nt, Homo sapiens
aaagggaaauacccagaaa

SEQ ID NO: 39522 - RNA, 19 nt, Homo sapiens
ggaaauacccagaaaagaa

SEQ ID NO: 39523 - RNA, 19 nt, Homo sapiens
gaaaggaaaguagaaguuc

SEQ ID NO: 39524 - RNA, 19 nt, Homo sapiens
gaggaaaggcggacucuca

SEQ ID NO: 39525 - RNA, 19 nt, Homo sapiens
gaaagagaaaccugaguca

SEQ ID NO: 39526 - RNA, 19 nt, Homo sapiens
caagaaggagaaagagaaa

SEQ ID NO: 39527 - RNA, 19 nt, Homo sapiens
gaaauacccagaaaagaaa

SEQ ID NO: 39528 - RNA, 19 nt, Homo sapiens
guaagaaugaagagagaaa

SEQ ID NO: 39529 - RNA, 19 nt, Homo sapiens
cuaaagaagagcucaagaa

SEQ ID NO: 39530 - RNA, 19 nt, Homo sapiens
aauguuacccugugcauaa

SEQ ID NO: 39531 - RNA, 19 nt, Homo sapiens
gaaaguaagaaugaagaga

SEQ ID NO: 39532 - RNA, 19 nt, Homo sapiens
ucaagaaggagaaagagaa

SEQ ID NO: 39533 - RNA, 19 nt, Homo sapiens
gagacaaagaugacagaaa

SEQ ID NO: 39534 - RNA, 19 nt, Homo sapiens
agaaagaggauguccgaaa

SEQ ID NO: 39535 - RNA, 19 nt, Homo sapiens
ggcuaaagcucuggcauca

SEQ ID NO: 39536 - RNA, 19 nt, Homo sapiens
uaaagaagagcucaagaag

SEQ ID NO: 39537 - RNA, 19 nt, Homo sapiens
aaagaugacagaaaggaaa

SEQ ID NO: 39538 - RNA, 19 nt, Homo sapiens
ugauguggaugaugccaaa

SEQ ID NO: 39539 - RNA, 19 nt, Homo sapiens
cgacaugcagugugccuaa

SEQ ID NO: 39540 - RNA, 19 nt, Homo sapiens
cagcaguacuuuugaguuu

SEQ ID NO: 39541 - RNA, 19 nt, Homo sapiens
gagaaaguggaccuagaaa

SEQ ID NO: 39542 - RNA, 19 nt, Homo sapiens
aauauaccgucucauacuu

SEQ ID NO: 39543 - RNA, 19 nt, Homo sapiens
gugaggguguguaaauuag

SEQ ID NO: 39544 - RNA, 19 nt, Homo sapiens
gaugacagaaaggaaagua

SEQ ID NO: 39545 - RNA, 19 nt, Homo sapiens
acacaagaaugggaggaaa

SEQ ID NO: 39546 - RNA, 19 nt, Homo sapiens
gaagauaaagagacaaagc

SEQ ID NO: 39547 - RNA, 19 nt, Homo sapiens
aaacuaggaaucuaugaug

SEQ ID NO: 39548 - RNA, 19 nt, Homo sapiens
cucaggaacuucauucuuc

SEQ ID NO: 39549 - RNA, 19 nt, Homo sapiens
caaagggaaauacccagaa

SEQ ID NO: 39550 - RNA, 19 nt, Homo sapiens
ugacagaaaggaaaguaga

SEQ ID NO: 39551 - RNA, 19 nt, Homo sapiens
gcauggaggacacaagaau

SEQ ID NO: 39552 - RNA, 19 nt, Homo sapiens
uaugaaggauguuucuagu

SEQ ID NO: 39553 - RNA, 19 nt, Homo sapiens
aagagaaaguggaccuaga

SEQ ID NO: 39554 - RNA, 19 nt, Homo sapiens
ucaggaacuucauucuuca

SEQ ID NO: 39555 - RNA, 19 nt, Homo sapiens
gcuaaauacucagggagau

SEQ ID NO: 39556 - RNA, 19 nt, Homo sapiens
ugucacagaauaugaugua

SEQ ID NO: 39557 - RNA, 19 nt, Homo sapiens
caaagaugacagaaaggaa

SEQ ID NO: 39558 - RNA, 19 nt, Homo sapiens
agaaaggaaaguagaaguu

SEQ ID NO: 39559 - RNA, 19 nt, Homo sapiens
gguuuauggugauugcauu

SEQ ID NO: 39560 - RNA, 19 nt, Homo sapiens
gacagaaaggaaaguagaa

SEQ ID NO: 39561 - RNA, 19 nt, Homo sapiens
gacaugcagugugccuaaa

SEQ ID NO: 39562 - RNA, 19 nt, Homo sapiens
uaaauauaccgucucauac

SEQ ID NO: 39563 - RNA, 19 nt, Homo sapiens
agagaaaguggaccuagaa

SEQ ID NO: 39564 - RNA, 19 nt, Homo sapiens
caaggaaggaaaguaagaa

SEQ ID NO: 39565 - RNA, 19 nt, Homo sapiens
guuaaagaacucacuaaag

SEQ ID NO: 39566 - RNA, 19 nt, Homo sapiens
caaauaugaaggauguuuc

SEQ ID NO: 39567 - RNA, 19 nt, Homo sapiens
ucaaggaaggaaaguaaga

SEQ ID NO: 39568 - RNA, 19 nt, Homo sapiens
ucagggagauggauuugcu

SEQ ID NO: 39569 - RNA, 19 nt, Homo sapiens
gaaaagaaacggcuaaagc

SEQ ID NO: 39570 - RNA, 19 nt, Homo sapiens
augcagaccuauccaggaa

SEQ ID NO: 39571 - RNA, 19 nt, Homo sapiens
agucaaggaaggaaaguaa

SEQ ID NO: 39572 - RNA, 19 nt, Homo sapiens
ugaggaaguucuaggaaaa

SEQ ID NO: 39573 - RNA, 19 nt, Homo sapiens
guguguaaauuagccauug

SEQ ID NO: 39574 - RNA, 19 nt, Homo sapiens
uaauauugcucugauuggu

SEQ ID NO: 39575 - RNA, 19 nt, Homo sapiens
aaguaagaaugaagagaga

SEQ ID NO: 39576 - RNA, 19 nt, Homo sapiens
aaagaacucacuaaagaag

SEQ ID NO: 39577 - RNA, 19 nt, Homo sapiens
uaccgucucauacuucuaa

SEQ ID NO: 39578 - RNA, 19 nt, Homo sapiens
gcuaaaaccaaggaaaaua

SEQ ID NO: 39579 - RNA, 19 nt, Homo sapiens
cgucucauacuucuaaaug

SEQ ID NO: 39580 - RNA, 19 nt, Homo sapiens
gaaguucuaccagauaugc

SEQ ID NO: 39581 - RNA, 19 nt, Homo sapiens
ggaugaugccaaaguuuua

SEQ ID NO: 39582 - RNA, 19 nt, Homo sapiens
augaggaaguucuaggaaa

SEQ ID NO: 39583 - RNA, 19 nt, Homo sapiens
uguguaaauuagccauuga

SEQ ID NO: 39584 - RNA, 19 nt, Homo sapiens
cagauaugcacacuuaaca

SEQ ID NO: 39585 - RNA, 19 nt, Homo sapiens
aagaggauguccgaaagga

SEQ ID NO: 39586 - RNA, 19 nt, Homo sapiens
agaacucacuaaagaagag

SEQ ID NO: 39587 - RNA, 19 nt, Homo sapiens
gcucaugugccaccaccuu

SEQ ID NO: 39588 - RNA, 19 nt, Homo sapiens
uguaauauugcucugauug

SEQ ID NO: 39589 - RNA, 19 nt, Homo sapiens
ggcugaagauaaagagaca

SEQ ID NO: 39590 - RNA, 19 nt, Homo sapiens
uguggaugaugccaaaguu

SEQ ID NO: 39591 - RNA, 19 nt, Homo sapiens
ucaaaauggcugaagauaa

SEQ ID NO: 39592 - RNA, 19 nt, Homo sapiens
uaugcacacuuaacaaagg

SEQ ID NO: 39593 - RNA, 19 nt, Homo sapiens
aagagaaaccugagucaag

SEQ ID NO: 39594 - RNA, 19 nt, Homo sapiens
ugacuaugaggaaguucua

SEQ ID NO: 39595 - RNA, 19 nt, Homo sapiens
gauuggugaggguguguaa

SEQ ID NO: 39596 - RNA, 19 nt, Homo sapiens
ggauguuucuaguaaaaug

SEQ ID NO: 39597 - RNA, 19 nt, Homo sapiens
guagcugucguuugguuug

SEQ ID NO: 39598 - RNA, 19 nt, Homo sapiens
acaaagaugacagaaagga

SEQ ID NO: 39599 - RNA, 19 nt, Homo sapiens
ggaaaguaagaaugaagag

SEQ ID NO: 39600 - RNA, 19 nt, Homo sapiens
guaauauugcucugauugg

SEQ ID NO: 39601 - RNA, 19 nt, Homo sapiens
ggcggacucucaggaacuu

SEQ ID NO: 39602 - RNA, 19 nt, Homo sapiens
aaauauaccgucucauacu

SEQ ID NO: 39603 - RNA, 19 nt, Homo sapiens
aauggcaucccgagacaaa

SEQ ID NO: 39604 - RNA, 19 nt, Homo sapiens
gcaaaggacuuccguuaua

SEQ ID NO: 39605 - RNA, 19 nt, Homo sapiens
ggacuuccguuauaacuua

SEQ ID NO: 39606 - RNA, 19 nt, Homo sapiens
guauauaccugcacugaua

SEQ ID NO: 39607 - RNA, 19 nt, Homo sapiens
uaacagagaucaucauuag

SEQ ID NO: 39608 - RNA, 19 nt, Homo sapiens
ugaaguaucucaugaagaa

SEQ ID NO: 39609 - RNA, 19 nt, Homo sapiens
aagaauggcccuacuauua

SEQ ID NO: 39610 - RNA, 19 nt, Homo sapiens
caaaggacuuccguuauaa

SEQ ID NO: 39611 - RNA, 19 nt, Homo sapiens
caaaauggcugaagauaaa

SEQ ID NO: 39612 - RNA, 19 nt, Homo sapiens
aagcugaaauuccuuguua

SEQ ID NO: 39613 - RNA, 19 nt, Homo sapiens
uauagucucuucagcauuu

SEQ ID NO: 39614 - RNA, 19 nt, Homo sapiens
gaagaaaccgagcauaguu

SEQ ID NO: 39615 - RNA, 19 nt, Homo sapiens
gaagugguuugaucgauau

SEQ ID NO: 39616 - RNA, 19 nt, Homo sapiens
gaaauuccuuguuaagaca

SEQ ID NO: 39617 - RNA, 19 nt, Homo sapiens
acaagaggaugaugaguuu

SEQ ID NO: 39618 - RNA, 19 nt, Homo sapiens
ggaacaagcaguauaugaa

SEQ ID NO: 39619 - RNA, 19 nt, Homo sapiens
uggaagagaugaugucuga

SEQ ID NO: 39620 - RNA, 19 nt, Homo sapiens
agaaauaauugcucuguug

SEQ ID NO: 39621 - RNA, 19 nt, Homo sapiens
ggaaggaacacuaaagaug

SEQ ID NO: 39622 - RNA, 19 nt, Homo sapiens
uguagaagauucacaggua

SEQ ID NO: 39623 - RNA, 19 nt, Homo sapiens
ggauagaaaucacagaagu

SEQ ID NO: 39624 - RNA, 19 nt, Homo sapiens
gguuugaucuuguugacua

SEQ ID NO: 39625 - RNA, 19 nt, Homo sapiens
gaaggaacacuaaagaugu

SEQ ID NO: 39626 - RNA, 19 nt, Homo sapiens
guagaagauucacagguaa

SEQ ID NO: 39627 - RNA, 19 nt, Homo sapiens
gaugaugaguuucuuaugg

SEQ ID NO: 39628 - RNA, 19 nt, Homo sapiens
cauaagaagugguuugauc

SEQ ID NO: 39629 - RNA, 19 nt, Homo sapiens
gaaauaauugcucuguuga

SEQ ID NO: 39630 - RNA, 19 nt, Homo sapiens
gcucagugcucuuacuaga

SEQ ID NO: 39631 - RNA, 19 nt, Homo sapiens
gaaagauugcaccaugaua

SEQ ID NO: 39632 - RNA, 19 nt, Homo sapiens
agaagugguuugaucgaua

SEQ ID NO: 39633 - RNA, 19 nt, Homo sapiens
aguagaagaugaaagauug

SEQ ID NO: 39634 - RNA, 19 nt, Homo sapiens
aaagauggcugugauagau

SEQ ID NO: 39635 - RNA, 19 nt, Homo sapiens
gauagaaaucacagaagua

SEQ ID NO: 39636 - RNA, 19 nt, Homo sapiens
gaugaugucugagcaggaa

SEQ ID NO: 39637 - RNA, 19 nt, Homo sapiens
ugauagaucuugugaagca

SEQ ID NO: 39638 - RNA, 19 nt, Homo sapiens
caccucagauuaaucauau

SEQ ID NO: 39639 - RNA, 19 nt, Homo sapiens
gaauggcccuacuauuauc

SEQ ID NO: 39640 - RNA, 19 nt, Homo sapiens
ggaagaacagcaggaagua

SEQ ID NO: 39641 - RNA, 19 nt, Homo sapiens
gcaccucagauuaaucaua

SEQ ID NO: 39642 - RNA, 19 nt, Homo sapiens
cgacugauguagaugauag

SEQ ID NO: 39643 - RNA, 19 nt, Homo sapiens
gguacucgauguguaauga

SEQ ID NO: 39644 - RNA, 19 nt, Homo sapiens
ucagugcucuuacuagaug

SEQ ID NO: 39645 - RNA, 19 nt, Homo sapiens
guagaagaaguaagcauuu

SEQ ID NO: 39646 - RNA, 19 nt, Homo sapiens
gaagagacaguuucacaag

SEQ ID NO: 39647 - RNA, 19 nt, Homo sapiens
cagaggugcuucaaggaaa

SEQ ID NO: 39648 - RNA, 19 nt, Homo sapiens
ugaggaaguucuagccaaa

SEQ ID NO: 39649 - RNA, 19 nt, Homo sapiens
ggaccaugagcaacuauaa

SEQ ID NO: 39650 - RNA, 19 nt, Homo sapiens
gaggaaaggcggacucuca

SEQ ID NO: 39651 - RNA, 19 nt, Homo sapiens
guacuuagcacucuuaaaa

SEQ ID NO: 39652 - RNA, 19 nt, Homo sapiens
agucuuaccugaauuuaug

SEQ ID NO: 39653 - RNA, 19 nt, Homo sapiens
gaaaggaccaugagcaacu

SEQ ID NO: 39654 - RNA, 19 nt, Homo sapiens
ggacuuaaagagagaucua

SEQ ID NO: 39655 - RNA, 19 nt, Homo sapiens
aagcaaaggacuuccguua

SEQ ID NO: 39656 - RNA, 19 nt, Homo sapiens
acagguaauuguagaagaa

SEQ ID NO: 39657 - RNA, 19 nt, Homo sapiens
aaagagagaucuacuucag

SEQ ID NO: 39658 - RNA, 19 nt, Homo sapiens
gcuuuaaguguucagauua

SEQ ID NO: 39659 - RNA, 19 nt, Homo sapiens
gcaggguuuucauauauua

SEQ ID NO: 39660 - RNA, 19 nt, Homo sapiens
ggaagagacaguuucacaa

SEQ ID NO: 39661 - RNA, 19 nt, Homo sapiens
gcuauagucucuucagcau

SEQ ID NO: 39662 - RNA, 19 nt, Homo sapiens
gaucaucauuagcugugaa

SEQ ID NO: 39663 - RNA, 19 nt, Homo sapiens
gccuuuggcuaauugagua

SEQ ID NO: 39664 - RNA, 19 nt, Homo sapiens
gugaagauuugaguuguau

SEQ ID NO: 39665 - RNA, 19 nt, Homo sapiens
gaacaagcaguauaugaac

SEQ ID NO: 39666 - RNA, 19 nt, Homo sapiens
cccagaauaucgaagauga

SEQ ID NO: 39667 - RNA, 19 nt, Homo sapiens
ugaaauuccuuguuaagac

SEQ ID NO: 39668 - RNA, 19 nt, Homo sapiens
cauuagcugugaagauuug

SEQ ID NO: 39669 - RNA, 19 nt, Homo sapiens
guaaucaggauauggaaga

SEQ ID NO: 39670 - RNA, 19 nt, Homo sapiens
gaauaucgaagaugaagca

SEQ ID NO: 39671 - RNA, 19 nt, Homo sapiens
gguaauuguagaagaagua

SEQ ID NO: 39672 - RNA, 19 nt, Homo sapiens
guauaugaaccucuagaaa

SEQ ID NO: 39673 - RNA, 19 nt, Homo sapiens
uaauagcuauagucucuuc

SEQ ID NO: 39674 - RNA, 19 nt, Homo sapiens
ugugauagaucuugugaag

SEQ ID NO: 39675 - RNA, 19 nt, Homo sapiens
gaaaaugaagggauagaaa

SEQ ID NO: 39676 - RNA, 19 nt, Homo sapiens
gugguuugaucgauauauu

SEQ ID NO: 39677 - RNA, 19 nt, Homo sapiens
gcuaacagagaucaucauu

SEQ ID NO: 39678 - RNA, 19 nt, Homo sapiens
caagaucuuugggaaggaa

SEQ ID NO: 39679 - RNA, 19 nt, Homo sapiens
ccaagucuaugaggaacaa

SEQ ID NO: 39680 - RNA, 19 nt, Homo sapiens
gaaccugaaguaucucaug

SEQ ID NO: 39681 - RNA, 19 nt, Homo sapiens
ccuggaaccugaaguaucu

SEQ ID NO: 39682 - RNA, 19 nt, Homo sapiens
gaggaugaugaguuucuua

SEQ ID NO: 39683 - RNA, 19 nt, Homo sapiens
gccuugagcuggguugauu

SEQ ID NO: 39684 - RNA, 19 nt, Homo sapiens
caggaaguaccaccagaua

SEQ ID NO: 39685 - RNA, 19 nt, Homo sapiens
uaucgaagaugaagcaaaa

SEQ ID NO: 39686 - RNA, 19 nt, Homo sapiens
ugauguggaugaugccaaa

SEQ ID NO: 39687 - RNA, 19 nt, Homo sapiens
agaauggcccuacuauuau

SEQ ID NO: 39688 - RNA, 19 nt, Homo sapiens
gaagauucacagguaauug

SEQ ID NO: 39689 - RNA, 19 nt, Homo sapiens
aagaaaccgagcauaguua

SEQ ID NO: 39690 - RNA, 19 nt, Homo sapiens
aaaggaccaugagcaacua

SEQ ID NO: 39691 - RNA, 19 nt, Homo sapiens
cagcaguacuuuugaguuu

SEQ ID NO: 39692 - RNA, 19 nt, Homo sapiens
uuacugagcagaucaagau

SEQ ID NO: 39693 - RNA, 19 nt, Homo sapiens
ugugaagauuugaguugua

SEQ ID NO: 39694 - RNA, 19 nt, Homo sapiens
cucaggaacuucauucuuc

SEQ ID NO: 39695 - RNA, 19 nt, Homo sapiens
uagcauuaguggauccauu

SEQ ID NO: 39696 - RNA, 19 nt, Homo sapiens
acacaagaaugggaggaaa

SEQ ID NO: 39697 - RNA, 19 nt, Homo sapiens
aaacuaggaaucuaugaug

SEQ ID NO: 39698 - RNA, 19 nt, Homo sapiens
gaaguucuagccaaagcaa

SEQ ID NO: 39699 - RNA, 19 nt, Homo sapiens
gaagauaaagagacaaagc

SEQ ID NO: 39700 - RNA, 19 nt, Homo sapiens
ucaggaacuucauucuuca

SEQ ID NO: 39701 - RNA, 19 nt, Homo sapiens
cuaacagagaucaucauua

SEQ ID NO: 39702 - RNA, 19 nt, Homo sapiens
gaggaccagccuaaccaua

SEQ ID NO: 39703 - RNA, 19 nt, Homo sapiens
gcaccaugauacagaugau

SEQ ID NO: 39704 - RNA, 19 nt, Homo sapiens
gcaaugaccugauggagua

SEQ ID NO: 39705 - RNA, 19 nt, Homo sapiens
ggaaugaagucccgaggua

SEQ ID NO: 39706 - RNA, 19 nt, Homo sapiens
gagaaccgcuucauuggaa

SEQ ID NO: 39707 - RNA, 19 nt, Homo sapiens
caaggucacugccaaauag

SEQ ID NO: 39708 - RNA, 19 nt, Homo sapiens
ggccugggcuugaaauuug

SEQ ID NO: 39709 - RNA, 19 nt, Homo sapiens
gcaaggucacugccaaaua

SEQ ID NO: 39710 - RNA, 19 nt, Homo sapiens
gaggaugccugaauucuac

SEQ ID NO: 39711 - RNA, 19 nt, Homo sapiens
ccuuggagcucuucaugua

SEQ ID NO: 39712 - RNA, 19 nt, Homo sapiens
caaauagacccguguacaa

SEQ ID NO: 39713 - RNA, 19 nt, Homo sapiens
guacaggcgcuaauuguug

SEQ ID NO: 39714 - RNA, 19 nt, Homo sapiens
guauugacaucguggagaa

SEQ ID NO: 39715 - RNA, 19 nt, Homo sapiens
ggaggaugccugaauucua

SEQ ID NO: 39716 - RNA, 19 nt, Homo sapiens
gaacgugcagggugauuau

SEQ ID NO: 39717 - RNA, 19 nt, Homo sapiens
gcugguguauaccgguuua

SEQ ID NO: 39718 - RNA, 19 nt, Homo sapiens
gaagaaggcacugaagcuu

SEQ ID NO: 39719 - RNA, 19 nt, Homo sapiens
ccuuuaccaugcucauuua

SEQ ID NO: 39720 - RNA, 19 nt, Homo sapiens
cagcaggcaccauccuuua

SEQ ID NO: 39721 - RNA, 19 nt, Homo sapiens
cagcaaaggcuccgugguu

SEQ ID NO: 39722 - RNA, 19 nt, Homo sapiens
guggagaaccgcuucauug

SEQ ID NO: 39723 - RNA, 19 nt, Homo sapiens
ccaggucucuacacgaaga

SEQ ID NO: 39724 - RNA, 19 nt, Homo sapiens
ccugaagccugcaaacguu

SEQ ID NO: 39725 - RNA, 19 nt, Homo sapiens
ggcgcuaauuguugugaua

SEQ ID NO: 39726 - RNA, 19 nt, Homo sapiens
cacugucucucuacaauga

SEQ ID NO: 39727 - RNA, 19 nt, Homo sapiens
uugcugagcugguguauac

SEQ ID NO: 39728 - RNA, 19 nt, Homo sapiens
ucauguaccugaacgaagu

SEQ ID NO: 39729 - RNA, 19 nt, Homo sapiens
gaacgaucagguccgguuu

SEQ ID NO: 39730 - RNA, 19 nt, Homo sapiens
ggagaaccgcuucauugga

SEQ ID NO: 39731 - RNA, 19 nt, Homo sapiens
caaguacaggcgcuaauug

SEQ ID NO: 39732 - RNA, 19 nt, Homo sapiens
ccuggaggaugccugaauu

SEQ ID NO: 39733 - RNA, 19 nt, Homo sapiens
gagaaccucaugcacauca

SEQ ID NO: 39734 - RNA, 19 nt, Homo sapiens
gcuggggccuccucaauuu

SEQ ID NO: 39735 - RNA, 19 nt, Homo sapiens
auagacccguguacaauga

SEQ ID NO: 39736 - RNA, 19 nt, Homo sapiens
ggaagaaggcacugaagcu

SEQ ID NO: 39737 - RNA, 19 nt, Homo sapiens
gagcaaggucacugccaaa

SEQ ID NO: 39738 - RNA, 19 nt, Homo sapiens
gggaguuuguggaggaguu

SEQ ID NO: 39739 - RNA, 19 nt, Homo sapiens
ccaaguacaggcgcuaauu

SEQ ID NO: 39740 - RNA, 19 nt, Homo sapiens
caacauuggccagaaggaa

SEQ ID NO: 39741 - RNA, 19 nt, Homo sapiens
gaggagcuggugagcauga

SEQ ID NO: 39742 - RNA, 19 nt, Homo sapiens
gcagguguccguccucaag

SEQ ID NO: 39743 - RNA, 19 nt, Homo sapiens
ccaaauagacccguguaca

SEQ ID NO: 39744 - RNA, 19 nt, Homo sapiens
gaacucacgccuccaaucc

SEQ ID NO: 39745 - RNA, 19 nt, Homo sapiens
gauuaugagccaacugaug

SEQ ID NO: 39746 - RNA, 19 nt, Homo sapiens
gugauuaugagccaacuga

SEQ ID NO: 39747 - RNA, 19 nt, Homo sapiens
gaaugaagucccgagguau

SEQ ID NO: 39748 - RNA, 19 nt, Homo sapiens
ugaaggaacaaggcuauga

SEQ ID NO: 39749 - RNA, 19 nt, Homo sapiens
ggccuagcccugaguguga

SEQ ID NO: 39750 - RNA, 19 nt, Homo sapiens
cuccaggucucuacacgaa

SEQ ID NO: 39751 - RNA, 19 nt, Homo sapiens
ugcaaacguugucaucgaa

SEQ ID NO: 39752 - RNA, 19 nt, Homo sapiens
gcgcuaauuguugugauaa

SEQ ID NO: 39753 - RNA, 19 nt, Homo sapiens
gcaaagcaacacgggauuc

SEQ ID NO: 39754 - RNA, 19 nt, Homo sapiens
cugcaaacguugucaucga

SEQ ID NO: 39755 - RNA, 19 nt, Homo sapiens
uacaggcgcuaauuguugu

SEQ ID NO: 39756 - RNA, 19 nt, Homo sapiens
ccaccggguucaucaacau

SEQ ID NO: 39757 - RNA, 19 nt, Homo sapiens
ggaacucacgccuccaauc

SEQ ID NO: 39758 - RNA, 19 nt, Homo sapiens
aaauagacccguguacaau

SEQ ID NO: 39759 - RNA, 19 nt, Homo sapiens
ggagcgaguggaagggaaa

SEQ ID NO: 39760 - RNA, 19 nt, Homo sapiens
ccagcaggcaccauccuuu

SEQ ID NO: 39761 - RNA, 19 nt, Homo sapiens
gcugaaggaacaaggcuau

SEQ ID NO: 39762 - RNA, 19 nt, Homo sapiens
gacgcuauguccagcaaag

SEQ ID NO: 39763 - RNA, 19 nt, Homo sapiens
ccaggaagaaggcacugaa

SEQ ID NO: 39764 - RNA, 19 nt, Homo sapiens
ugaacgugcagggugauua

SEQ ID NO: 39765 - RNA, 19 nt, Homo sapiens
gaaggaacaaggcuaugac

SEQ ID NO: 39766 - RNA, 19 nt, Homo sapiens
gaugucagcagggaguuug

SEQ ID NO: 39767 - RNA, 19 nt, Homo sapiens
cguggagcauggaugagaa

SEQ ID NO: 39768 - RNA, 19 nt, Homo sapiens
gauggaguacgcaaagcaa

SEQ ID NO: 39769 - RNA, 19 nt, Homo sapiens
cagacgcuauguccagcaa

SEQ ID NO: 39770 - RNA, 19 nt, Homo sapiens
ugacgucauugccuaucug

SEQ ID NO: 39771 - RNA, 19 nt, Homo sapiens
gcaaaggcuccgugguucu

SEQ ID NO: 39772 - RNA, 19 nt, Homo sapiens
cccacugucucucuacaau

SEQ ID NO: 39773 - RNA, 19 nt, Homo sapiens
uuaccaugcucauuuagac

SEQ ID NO: 39774 - RNA, 19 nt, Homo sapiens
augaggagcuggugagcau

SEQ ID NO: 39775 - RNA, 19 nt, Homo sapiens
acgaucagguccgguuuga

SEQ ID NO: 39776 - RNA, 19 nt, Homo sapiens
gacccaggacccagccaaa

SEQ ID NO: 39777 - RNA, 19 nt, Homo sapiens
aggcuggaauccuggagaa

SEQ ID NO: 39778 - RNA, 19 nt, Homo sapiens
caaaggcuccgugguucug

SEQ ID NO: 39779 - RNA, 19 nt, Homo sapiens
gcccugagugugaauuugu

SEQ ID NO: 39780 - RNA, 19 nt, Homo sapiens
ucguguggcugaaggaaca

SEQ ID NO: 39781 - RNA, 19 nt, Homo sapiens
ggaagugcgcaaaaucaaa

SEQ ID NO: 39782 - RNA, 19 nt, Homo sapiens
ccaagaacccguggagcau

SEQ ID NO: 39783 - RNA, 19 nt, Homo sapiens
aauagacccguguacaaug

SEQ ID NO: 39784 - RNA, 19 nt, Homo sapiens
ggguucaucaacaucaauu

SEQ ID NO: 39785 - RNA, 19 nt, Homo sapiens
ggaccgggaagugcgcaaa

SEQ ID NO: 39786 - RNA, 19 nt, Homo sapiens
gaagucccgagguaucuac

SEQ ID NO: 39787 - RNA, 19 nt, Homo sapiens
ggaugucagcagggaguuu

SEQ ID NO: 39788 - RNA, 19 nt, Homo sapiens
uugccuaucuggccaacau

SEQ ID NO: 39789 - RNA, 19 nt, Homo sapiens
gcaaugaccugauggagua

SEQ ID NO: 39790 - RNA, 19 nt, Homo sapiens
ggaaugaagucccgaggua

SEQ ID NO: 39791 - RNA, 19 nt, Homo sapiens
gagaaccgcuucauuggaa

SEQ ID NO: 39792 - RNA, 19 nt, Homo sapiens
caaggucacugccaaauag

SEQ ID NO: 39793 - RNA, 19 nt, Homo sapiens
ggccugggcuugaaauuug

SEQ ID NO: 39794 - RNA, 19 nt, Homo sapiens
gcaaggucacugccaaaua

SEQ ID NO: 39795 - RNA, 19 nt, Homo sapiens
gaggaugccugaauucuac

SEQ ID NO: 39796 - RNA, 19 nt, Homo sapiens
ccuuggagcucuucaugua

SEQ ID NO: 39797 - RNA, 19 nt, Homo sapiens
caaauagacccguguacaa

SEQ ID NO: 39798 - RNA, 19 nt, Homo sapiens
guacaggcgcuaauuguug

SEQ ID NO: 39799 - RNA, 19 nt, Homo sapiens
guauugacaucguggagaa

SEQ ID NO: 39800 - RNA, 19 nt, Homo sapiens
ggaggaugccugaauucua

SEQ ID NO: 39801 - RNA, 19 nt, Homo sapiens
gaacgugcagggugauuau

SEQ ID NO: 39802 - RNA, 19 nt, Homo sapiens
gaagaaggcacugaagcuu

SEQ ID NO: 39803 - RNA, 19 nt, Homo sapiens
cagcaggcaccauccuuua

SEQ ID NO: 39804 - RNA, 19 nt, Homo sapiens
cagcaaaggcuccgugguu

SEQ ID NO: 39805 - RNA, 19 nt, Homo sapiens
guggagaaccgcuucauug

SEQ ID NO: 39806 - RNA, 19 nt, Homo sapiens
ccaggucucuacacgaaga

SEQ ID NO: 39807 - RNA, 19 nt, Homo sapiens
ccugaagccugcaaacguu

SEQ ID NO: 39808 - RNA, 19 nt, Homo sapiens
ggcgcuaauuguugugaua

SEQ ID NO: 39809 - RNA, 19 nt, Homo sapiens
cacugucucucuacaauga

SEQ ID NO: 39810 - RNA, 19 nt, Homo sapiens
uugcugagcugguguauac

SEQ ID NO: 39811 - RNA, 19 nt, Homo sapiens
ucauguaccugaacgaagu

SEQ ID NO: 39812 - RNA, 19 nt, Homo sapiens
gaacgaucagguccgguuu

SEQ ID NO: 39813 - RNA, 19 nt, Homo sapiens
ggagaaccgcuucauugga

SEQ ID NO: 39814 - RNA, 19 nt, Homo sapiens
caaguacaggcgcuaauug

SEQ ID NO: 39815 - RNA, 19 nt, Homo sapiens
ccuggaggaugccugaauu

SEQ ID NO: 39816 - RNA, 19 nt, Homo sapiens
gagaaccucaugcacauca

SEQ ID NO: 39817 - RNA, 19 nt, Homo sapiens
gcuggggccuccucaauuu

SEQ ID NO: 39818 - RNA, 19 nt, Homo sapiens
auagacccguguacaauga

SEQ ID NO: 39819 - RNA, 19 nt, Homo sapiens
ggaagaaggcacugaagcu

SEQ ID NO: 39820 - RNA, 19 nt, Homo sapiens
gagcaaggucacugccaaa

SEQ ID NO: 39821 - RNA, 19 nt, Homo sapiens
gggaguuuguggaggaguu

SEQ ID NO: 39822 - RNA, 19 nt, Homo sapiens
ccaaguacaggcgcuaauu

SEQ ID NO: 39823 - RNA, 19 nt, Homo sapiens
caacauuggccagaaggaa

SEQ ID NO: 39824 - RNA, 19 nt, Homo sapiens
gaggagcuggugagcauga

SEQ ID NO: 39825 - RNA, 19 nt, Homo sapiens
gcagguguccguccucaag

SEQ ID NO: 39826 - RNA, 19 nt, Homo sapiens
ccaaauagacccguguaca

SEQ ID NO: 39827 - RNA, 19 nt, Homo sapiens
gauuaugagccaacugaug

SEQ ID NO: 39828 - RNA, 19 nt, Homo sapiens
gugauuaugagccaacuga

SEQ ID NO: 39829 - RNA, 19 nt, Homo sapiens
ugaaggaacaaggcuauga

SEQ ID NO: 39830 - RNA, 19 nt, Homo sapiens
gaaugaagucccgagguau

SEQ ID NO: 39831 - RNA, 19 nt, Homo sapiens
uuaccacgcucauuuagac

SEQ ID NO: 39832 - RNA, 19 nt, Homo sapiens
cuccaggucucuacacgaa

SEQ ID NO: 39833 - RNA, 19 nt, Homo sapiens
ugcaaacguugucaucgaa

SEQ ID NO: 39834 - RNA, 19 nt, Homo sapiens
gcgcuaauuguugugauaa

SEQ ID NO: 39835 - RNA, 19 nt, Homo sapiens
gcaaagcaacacgggauuc

SEQ ID NO: 39836 - RNA, 19 nt, Homo sapiens
cugcaaacguugucaucga

SEQ ID NO: 39837 - RNA, 19 nt, Homo sapiens
uacaggcgcuaauuguugu

SEQ ID NO: 39838 - RNA, 19 nt, Homo sapiens
ccaccggguucaucaacau

SEQ ID NO: 39839 - RNA, 19 nt, Homo sapiens
gcugaaggaacaaggcuau

SEQ ID NO: 39840 - RNA, 19 nt, Homo sapiens
aaauagacccguguacaau

SEQ ID NO: 39841 - RNA, 19 nt, Homo sapiens
ggagcgaguggaagggaaa

SEQ ID NO: 39842 - RNA, 19 nt, Homo sapiens
ccagcaggcaccauccuuu

SEQ ID NO: 39843 - RNA, 19 nt, Homo sapiens
ccaggaagaaggcacugaa

SEQ ID NO: 39844 - RNA, 19 nt, Homo sapiens
gacgcuauguccagcaaag

SEQ ID NO: 39845 - RNA, 19 nt, Homo sapiens
ugaacgugcagggugauua

SEQ ID NO: 39846 - RNA, 19 nt, Homo sapiens
gaaggaacaaggcuaugac

SEQ ID NO: 39847 - RNA, 19 nt, Homo sapiens
cguggagcauggaugagaa

SEQ ID NO: 39848 - RNA, 19 nt, Homo sapiens
gaugucagcagggaguuug

SEQ ID NO: 39849 - RNA, 19 nt, Homo sapiens
gauggaguacgcaaagcaa

SEQ ID NO: 39850 - RNA, 19 nt, Homo sapiens
ccacgcucauuuagacauc

SEQ ID NO: 39851 - RNA, 19 nt, Homo sapiens
ccuuuaccacgcucauuua

SEQ ID NO: 39852 - RNA, 19 nt, Homo sapiens
gcaaaggcuccgugguucu

SEQ ID NO: 39853 - RNA, 19 nt, Homo sapiens
ugacgucauugccuaucug

SEQ ID NO: 39854 - RNA, 19 nt, Homo sapiens
cccacugucucucuacaau

SEQ ID NO: 39855 - RNA, 19 nt, Homo sapiens
gcugguguauaccgguuuc

SEQ ID NO: 39856 - RNA, 19 nt, Homo sapiens
augaggagcuggugagcau

SEQ ID NO: 39857 - RNA, 19 nt, Homo sapiens
acgaucagguccgguuuga

SEQ ID NO: 39858 - RNA, 19 nt, Homo sapiens
gacccaggacccagccaaa

SEQ ID NO: 39859 - RNA, 19 nt, Homo sapiens
aggcuggaauccuggagaa

SEQ ID NO: 39860 - RNA, 19 nt, Homo sapiens
gcccugagugugaauuugu

SEQ ID NO: 39861 - RNA, 19 nt, Homo sapiens
ucguguggcugaaggaaca

SEQ ID NO: 39862 - RNA, 19 nt, Homo sapiens
ggaagugcgcaaaaucaaa

SEQ ID NO: 39863 - RNA, 19 nt, Homo sapiens
caaaggcuccgugguucug

SEQ ID NO: 39864 - RNA, 19 nt, Homo sapiens
ccaagaacccguggagcau

SEQ ID NO: 39865 - RNA, 19 nt, Homo sapiens
ggaugucagcagggaguuu

SEQ ID NO: 39866 - RNA, 19 nt, Homo sapiens
aauagacccguguacaaug

SEQ ID NO: 39867 - RNA, 19 nt, Homo sapiens
ggguucaucaacaucaauu

SEQ ID NO: 39868 - RNA, 19 nt, Homo sapiens
ggaccgggaagugcgcaaa

SEQ ID NO: 39869 - RNA, 19 nt, Homo sapiens
gaagucccgagguaucuac

SEQ ID NO: 39870 - RNA, 19 nt, Homo sapiens
uugccuaucuggccaacau

SEQ ID NO: 39871 - RNA, 19 nt, Homo sapiens
caacaaauccuccaaguua

SEQ ID NO: 39872 - RNA, 19 nt, Homo sapiens
acaaauggguguccaauaa

SEQ ID NO: 39873 - RNA, 19 nt, Homo sapiens
ggacaucagugaguuggua

SEQ ID NO: 39874 - RNA, 19 nt, Homo sapiens
gaggacggcuucaguuuga

SEQ ID NO: 39875 - RNA, 19 nt, Homo sapiens
gagcggccaucaacaaaug

SEQ ID NO: 39876 - RNA, 19 nt, Homo sapiens
gaaggcaaguuccguuauc

SEQ ID NO: 39877 - RNA, 19 nt, Homo sapiens
ucaaugagcucacuguucu

SEQ ID NO: 39878 - RNA, 19 nt, Homo sapiens
acaaaucccuuaccuucaa

SEQ ID NO: 39879 - RNA, 19 nt, Homo sapiens
ccaagaaugacaaugauaa

SEQ ID NO: 39880 - RNA, 19 nt, Homo sapiens
aaacugaacugccgacucu

SEQ ID NO: 39881 - RNA, 19 nt, Homo sapiens
guagccaacccuuguguua

SEQ ID NO: 39882 - RNA, 19 nt, Homo sapiens
uaaggcauuucuugaggua

SEQ ID NO: 39883 - RNA, 19 nt, Homo sapiens
gcaaguaccgcuguuguga

SEQ ID NO: 39884 - RNA, 19 nt, Homo sapiens
gaacacuauuaucuucaug

SEQ ID NO: 39885 - RNA, 19 nt, Homo sapiens
ugauggagguauuuaaguu

SEQ ID NO: 39886 - RNA, 19 nt, Homo sapiens
ugaaucccaugugcauuua

SEQ ID NO: 39887 - RNA, 19 nt, Homo sapiens
caacccuuguguuaaguaa

SEQ ID NO: 39888 - RNA, 19 nt, Homo sapiens
gaacuguaaccucuggaaa

SEQ ID NO: 39889 - RNA, 19 nt, Homo sapiens
caacugauggagguauuua

SEQ ID NO: 39890 - RNA, 19 nt, Homo sapiens
aggaguggcuggaugaauu

SEQ ID NO: 39891 - RNA, 19 nt, Homo sapiens
ucagugaguugguauaugg

SEQ ID NO: 39892 - RNA, 19 nt, Homo sapiens
gaagaaggcaacugaggau

SEQ ID NO: 39893 - RNA, 19 nt, Homo sapiens
cagauccacuucuucuuug

SEQ ID NO: 39894 - RNA, 19 nt, Homo sapiens
caaggccaauucccgcuuu

SEQ ID NO: 39895 - RNA, 19 nt, Homo sapiens
ugaaggagcagcugcaaga

SEQ ID NO: 39896 - RNA, 19 nt, Homo sapiens
ucagauccacuucuucuuu

SEQ ID NO: 39897 - RNA, 19 nt, Homo sapiens
ccaacagggugacuuucaa

SEQ ID NO: 39898 - RNA, 19 nt, Homo sapiens
gaaggcaacugaggaugag

SEQ ID NO: 39899 - RNA, 19 nt, Homo sapiens
gauggagguauuuaaguuu

SEQ ID NO: 39900 - RNA, 19 nt, Homo sapiens
aaauggguguccaauaaga

SEQ ID NO: 39901 - RNA, 19 nt, Homo sapiens
ucccuuaccuucaaugaga

SEQ ID NO: 39902 - RNA, 19 nt, Homo sapiens
uaacaccauuuacuucaag

SEQ ID NO: 39903 - RNA, 19 nt, Homo sapiens
ggagacaaaucccuuaccu

SEQ ID NO: 39904 - RNA, 19 nt, Homo sapiens
caaauccuccaaguuagua

SEQ ID NO: 39905 - RNA, 19 nt, Homo sapiens
ccgaaucaccgaugucauu

SEQ ID NO: 39906 - RNA, 19 nt, Homo sapiens
aaguaccgcuguugugauu

SEQ ID NO: 39907 - RNA, 19 nt, Homo sapiens
ucagaugcauuccauaagg

SEQ ID NO: 39908 - RNA, 19 nt, Homo sapiens
ucugaacacuauuaucuuc

SEQ ID NO: 39909 - RNA, 19 nt, Homo sapiens
gccaacaaauccuccaagu

SEQ ID NO: 39910 - RNA, 19 nt, Homo sapiens
caagcugggugccuguaau

SEQ ID NO: 39911 - RNA, 19 nt, Homo sapiens
ucucagaugcauuccauaa

SEQ ID NO: 39912 - RNA, 19 nt, Homo sapiens
ccucggaagccaucaauga

SEQ ID NO: 39913 - RNA, 19 nt, Homo sapiens
ccagagcggccaucaacaa

SEQ ID NO: 39914 - RNA, 19 nt, Homo sapiens
caaacucccagguauuguu

SEQ ID NO: 39915 - RNA, 19 nt, Homo sapiens
ggagagucguguucagcau

SEQ ID NO: 39916 - RNA, 19 nt, Homo sapiens
aggcauuucuugagguaaa

SEQ ID NO: 39917 - RNA, 19 nt, Homo sapiens
agaagagccuggccaaggu

SEQ ID NO: 39918 - RNA, 19 nt, Homo sapiens
ggaguggcuggaugaauug

SEQ ID NO: 39919 - RNA, 19 nt, Homo sapiens
caaaucccuuaccuucaau

SEQ ID NO: 39920 - RNA, 19 nt, Homo sapiens
ccaacaaauccuccaaguu

SEQ ID NO: 39921 - RNA, 19 nt, Homo sapiens
cgagaugaccucuaugucu

SEQ ID NO: 39922 - RNA, 19 nt, Homo sapiens
uggccaagguggagaagga

SEQ ID NO: 39923 - RNA, 19 nt, Homo sapiens
gaacugccgacucuaucga

SEQ ID NO: 39924 - RNA, 19 nt, Homo sapiens
cagaguagccaacccuugu

SEQ ID NO: 39925 - RNA, 19 nt, Homo sapiens
aggccgagaugaccucuau

SEQ ID NO: 39926 - RNA, 19 nt, Homo sapiens
cggagaagaaggcaacuga

SEQ ID NO: 39927 - RNA, 19 nt, Homo sapiens
guuaacaccauuuacuuca

SEQ ID NO: 39928 - RNA, 19 nt, Homo sapiens
caacaaauggguguccaau

SEQ ID NO: 39929 - RNA, 19 nt, Homo sapiens
gacaaaucccuuaccuuca

SEQ ID NO: 39930 - RNA, 19 nt, Homo sapiens
caaguuaguaucagccaau

SEQ ID NO: 39931 - RNA, 19 nt, Homo sapiens
ggaacuguaaccucuggaa

SEQ ID NO: 39932 - RNA, 19 nt, Homo sapiens
aguccaaacucccagguau

SEQ ID NO: 39933 - RNA, 19 nt, Homo sapiens
ucaagggccuguggaaguc

SEQ ID NO: 39934 - RNA, 19 nt, Homo sapiens
caaggaaaaugcagagcaa

SEQ ID NO: 39935 - RNA, 19 nt, Homo sapiens
gcaacugauggagguauuu

SEQ ID NO: 39936 - RNA, 19 nt, Homo sapiens
ugaccucuaugucucagau

SEQ ID NO: 39937 - RNA, 19 nt, Homo sapiens
gccaauucccgcuuugcua

SEQ ID NO: 39938 - RNA, 19 nt, Homo sapiens
gaacuguccaaggccaauu

SEQ ID NO: 39939 - RNA, 19 nt, Homo sapiens
gcccugagaacacaaggaa

SEQ ID NO: 39940 - RNA, 19 nt, Homo sapiens
agaaggcaacugaggauga

SEQ ID NO: 39941 - RNA, 19 nt, Homo sapiens
ccucugaacacuauuaucu

SEQ ID NO: 39942 - RNA, 19 nt, Homo sapiens
ugaagaaggcagugaagca

SEQ ID NO: 39943 - RNA, 19 nt, Homo sapiens
gugcuugaguugcccuuca

SEQ ID NO: 39944 - RNA, 19 nt, Homo sapiens
uaucagcaccuggcagauu

SEQ ID NO: 39945 - RNA, 19 nt, Homo sapiens
gguuaacaccauuuacuuc

SEQ ID NO: 39946 - RNA, 19 nt, Homo sapiens
aaugugauaggaacuguaa

SEQ ID NO: 39947 - RNA, 19 nt, Homo sapiens
cagagcggccaucaacaaa

SEQ ID NO: 39948 - RNA, 19 nt, Homo sapiens
guaccgcuguugugauugc

SEQ ID NO: 39949 - RNA, 19 nt, Homo sapiens
uaaaugaagaaggcaguga

SEQ ID NO: 39950 - RNA, 19 nt, Homo sapiens
caccaugguccucaucuug

SEQ ID NO: 39951 - RNA, 19 nt, Homo sapiens
gaacacaaggaaggaacug

SEQ ID NO: 39952 - RNA, 19 nt, Homo sapiens
caaauggguguccaauaag

SEQ ID NO: 39953 - RNA, 19 nt, Homo sapiens
ccaaugugauaggaacugu

SEQ ID NO: 39954 - RNA, 19 nt, Homo sapiens
gagacaaaucccuuaccuu

SEQ ID NO: 39955 - RNA, 19 nt, Homo sapiens
ugaggacggcuucaguuug

SEQ ID NO: 39956 - RNA, 19 nt, Homo sapiens
ucaccaugguccucaucuu

SEQ ID NO: 39957 - RNA, 19 nt, Homo sapiens
guaccaggaaggcaaguuc

SEQ ID NO: 39958 - RNA, 19 nt, Homo sapiens
acacaaggaaggaacuguu

SEQ ID NO: 39959 - RNA, 19 nt, Homo sapiens
uagccaacccuuguguuaa

SEQ ID NO: 39960 - RNA, 19 nt, Homo sapiens
ugucucagaugcauuccau

SEQ ID NO: 39961 - RNA, 19 nt, Homo sapiens
ccgcuuugcuaccacuuuc

SEQ ID NO: 39962 - RNA, 19 nt, Homo sapiens
gauggagagucguguucag

SEQ ID NO: 39963 - RNA, 19 nt, Homo sapiens
aacaaauccuccaaguuag

SEQ ID NO: 39964 - RNA, 19 nt, Homo sapiens
uggagguauuuaaguuuga

SEQ ID NO: 39965 - RNA, 19 nt, Homo sapiens
caacagggugacuuucaag

SEQ ID NO: 39966 - RNA, 19 nt, Homo sapiens
gccgagaugaccucuaugu

SEQ ID NO: 39967 - RNA, 19 nt, Homo sapiens
aggagcagcugcaagacau

SEQ ID NO: 39968 - RNA, 19 nt, Homo sapiens
uggaugaauuggaggagau

SEQ ID NO: 39969 - RNA, 19 nt, Homo sapiens
caucagugaguugguauau

SEQ ID NO: 39970 - RNA, 19 nt, Homo sapiens
guauuccaaugugauagga

SEQ ID NO: 39971 - RNA, 19 nt, Homo sapiens
cagcauaucuccaaaguua

SEQ ID NO: 39972 - RNA, 19 nt, Homo sapiens
ggaagaaacuggcagauau

SEQ ID NO: 39973 - RNA, 19 nt, Homo sapiens
gaacaagguuuacggacua

SEQ ID NO: 39974 - RNA, 19 nt, Homo sapiens
caucaacacuuuccacaua

SEQ ID NO: 39975 - RNA, 19 nt, Homo sapiens
gaggugagcuugccaguga

SEQ ID NO: 39976 - RNA, 19 nt, Homo sapiens
gaaaagaaguccaaguuaa

SEQ ID NO: 39977 - RNA, 19 nt, Homo sapiens
caaagacccugccaaagaa

SEQ ID NO: 39978 - RNA, 19 nt, Homo sapiens
ccaaagagcacccuaguuu

SEQ ID NO: 39979 - RNA, 19 nt, Homo sapiens
ggacaaagacagugagaaa

SEQ ID NO: 39980 - RNA, 19 nt, Homo sapiens
ggcgugagcuuacaaauga

SEQ ID NO: 39981 - RNA, 19 nt, Homo sapiens
caaauuaaccuuccgcuuu

SEQ ID NO: 39982 - RNA, 19 nt, Homo sapiens
aaacuaagcuggacaacga

SEQ ID NO: 39983 - RNA, 19 nt, Homo sapiens
ggaagggauugaagacuuu

SEQ ID NO: 39984 - RNA, 19 nt, Homo sapiens
gaagaaacgugugguacaa

SEQ ID NO: 39985 - RNA, 19 nt, Homo sapiens
gagaagagccucagagaga

SEQ ID NO: 39986 - RNA, 19 nt, Homo sapiens
gagagugacuuggaagaua

SEQ ID NO: 39987 - RNA, 19 nt, Homo sapiens
gcugugaguuucaaauuaa

SEQ ID NO: 39988 - RNA, 19 nt, Homo sapiens
ucaaacagcucgagagguu

SEQ ID NO: 39989 - RNA, 19 nt, Homo sapiens
gaacaaauuggucaucaaa

SEQ ID NO: 39990 - RNA, 19 nt, Homo sapiens
gaacggacaccuucagauu

SEQ ID NO: 39991 - RNA, 19 nt, Homo sapiens
gaagccagcuggacaagga

SEQ ID NO: 39992 - RNA, 19 nt, Homo sapiens
caaggaauaugacaaugaa

SEQ ID NO: 39993 - RNA, 19 nt, Homo sapiens
gagcaacucucuaauuuac

SEQ ID NO: 39994 - RNA, 19 nt, Homo sapiens
gcaccaggaucacagauga

SEQ ID NO: 39995 - RNA, 19 nt, Homo sapiens
caagagagcuggcuacaac

SEQ ID NO: 39996 - RNA, 19 nt, Homo sapiens
cagaggagcuugcuaagga

SEQ ID NO: 39997 - RNA, 19 nt, Homo sapiens
caaagacagugagaaagua

SEQ ID NO: 39998 - RNA, 19 nt, Homo sapiens
gaaacuggcagauaugauu

SEQ ID NO: 39999 - RNA, 19 nt, Homo sapiens
agaaggagcugacagauuc

SEQ ID NO: 40000 - RNA, 19 nt, Homo sapiens
gcaacuggcacuauaagua

SEQ ID NO: 40001 - RNA, 19 nt, Homo sapiens
gggaacagcagcaguauuu

SEQ ID NO: 40002 - RNA, 19 nt, Homo sapiens
aaagagagcccuucaagaa

SEQ ID NO: 40003 - RNA, 19 nt, Homo sapiens
ggaagagagugacuuggaa

SEQ ID NO: 40004 - RNA, 19 nt, Homo sapiens
gaacaucuccgcuaucauc

SEQ ID NO: 40005 - RNA, 19 nt, Homo sapiens
ugacgaaagugccaauaaa

SEQ ID NO: 40006 - RNA, 19 nt, Homo sapiens
cccaaaggaugaugaauuu

SEQ ID NO: 40007 - RNA, 19 nt, Homo sapiens
gauaaacuguacccacuga

SEQ ID NO: 40008 - RNA, 19 nt, Homo sapiens
caaggaaucuuucacucaa

SEQ ID NO: 40009 - RNA, 19 nt, Homo sapiens
gaacaggaggaaucguuua

SEQ ID NO: 40010 - RNA, 19 nt, Homo sapiens
caacaaaccuuuuaagugu

SEQ ID NO: 40011 - RNA, 19 nt, Homo sapiens
gcacucaaaugaccaaucu

SEQ ID NO: 40012 - RNA, 19 nt, Homo sapiens
gaacuggccaccuucaauu

SEQ ID NO: 40013 - RNA, 19 nt, Homo sapiens
caggaacacucucuucaaa

SEQ ID NO: 40014 - RNA, 19 nt, Homo sapiens
caacaaggauuaccugaac

SEQ ID NO: 40015 - RNA, 19 nt, Homo sapiens
guauaaaccaaacgaguua

SEQ ID NO: 40016 - RNA, 19 nt, Homo sapiens
aaaccuaccuccucagcua

SEQ ID NO: 40017 - RNA, 19 nt, Homo sapiens
caaagagcacccuaguuua

SEQ ID NO: 40018 - RNA, 19 nt, Homo sapiens
ccacuaugcuagaauguga

SEQ ID NO: 40019 - RNA, 19 nt, Homo sapiens
agaagaagcuguguuacaa

SEQ ID NO: 40020 - RNA, 19 nt, Homo sapiens
gaccauaccauaauuguug

SEQ ID NO: 40021 - RNA, 19 nt, Homo sapiens
gcaauggacugaacucaac

SEQ ID NO: 40022 - RNA, 19 nt, Homo sapiens
caagccaguuccuuccuua

SEQ ID NO: 40023 - RNA, 19 nt, Homo sapiens
gcaaggaauaugacaauga

SEQ ID NO: 40024 - RNA, 19 nt, Homo sapiens
acaaauuggucaucaaaga

SEQ ID NO: 40025 - RNA, 19 nt, Homo sapiens
gaccaggcuuucccgaaua

SEQ ID NO: 40026 - RNA, 19 nt, Homo sapiens
ggaggaagcucugagucaa

SEQ ID NO: 40027 - RNA, 19 nt, Homo sapiens
ggacggcuccgcauacauu

SEQ ID NO: 40028 - RNA, 19 nt, Homo sapiens
agagcacccuaguuuauua

SEQ ID NO: 40029 - RNA, 19 nt, Homo sapiens
gaguggaucugcaggcaaa

SEQ ID NO: 40030 - RNA, 19 nt, Homo sapiens
caacgggaauagcaacuga

SEQ ID NO: 40031 - RNA, 19 nt, Homo sapiens
gacaagcguuugagaacaa

SEQ ID NO: 40032 - RNA, 19 nt, Homo sapiens
ucucguaacucguguaaga

SEQ ID NO: 40033 - RNA, 19 nt, Homo sapiens
gaggaaucguuuaagcuuu

SEQ ID NO: 40034 - RNA, 19 nt, Homo sapiens
gggcauuccuccuguguug

SEQ ID NO: 40035 - RNA, 19 nt, Homo sapiens
gcaacucucuaauuuacug

SEQ ID NO: 40036 - RNA, 19 nt, Homo sapiens
ccaaagagaagaaagaguu

SEQ ID NO: 40037 - RNA, 19 nt, Homo sapiens
gauccagucucagcuguuu

SEQ ID NO: 40038 - RNA, 19 nt, Homo sapiens
ggcugugaguuucaaauua

SEQ ID NO: 40039 - RNA, 19 nt, Homo sapiens
gugagaagcacaugcauaa

SEQ ID NO: 40040 - RNA, 19 nt, Homo sapiens
ggugcgaggugugugauua

SEQ ID NO: 40041 - RNA, 19 nt, Homo sapiens
gggcacagcuucuacuagu

SEQ ID NO: 40042 - RNA, 19 nt, Homo sapiens
acaaagacccugccaaaga

SEQ ID NO: 40043 - RNA, 19 nt, Homo sapiens
aaauuaaccuuccgcuuug

SEQ ID NO: 40044 - RNA, 19 nt, Homo sapiens
cagaauuacuuuccuuuca

SEQ ID NO: 40045 - RNA, 19 nt, Homo sapiens
gcaugagagugguguagaa

SEQ ID NO: 40046 - RNA, 19 nt, Homo sapiens
acaagcacgugcagaagua

SEQ ID NO: 40047 - RNA, 19 nt, Homo sapiens
uugagcaacucucuaauuu

SEQ ID NO: 40048 - RNA, 19 nt, Homo sapiens
ccaaggcccugcuggagaa

SEQ ID NO: 40049 - RNA, 19 nt, Homo sapiens
aggccgagcucuaccaaua

SEQ ID NO: 40050 - RNA, 19 nt, Homo sapiens
gaacaugacccagauccaa

SEQ ID NO: 40051 - RNA, 19 nt, Homo sapiens
aggaaucguuuaagcuuua

SEQ ID NO: 40052 - RNA, 19 nt, Homo sapiens
gcauaucuccaaaguuaaa

SEQ ID NO: 40053 - RNA, 19 nt, Homo sapiens
gaaaccaaauccucuucug

SEQ ID NO: 40054 - RNA, 19 nt, Homo sapiens
ggaagaauuaugagaauca

SEQ ID NO: 40055 - RNA, 19 nt, Homo sapiens
guacagagaccacuacgau

SEQ ID NO: 40056 - RNA, 19 nt, Homo sapiens
gcacagcuuccgcguguuu

SEQ ID NO: 40057 - RNA, 19 nt, Homo sapiens
gcacccaccucccugacaa

SEQ ID NO: 40058 - RNA, 19 nt, Homo sapiens
ucaaagagaggcagcguaa

SEQ ID NO: 40059 - RNA, 19 nt, Homo sapiens
gcaaguggcagcagcaaug

SEQ ID NO: 40060 - RNA, 19 nt, Homo sapiens
gaguugggcuucauuuaca

SEQ ID NO: 40061 - RNA, 19 nt, Homo sapiens
gcacaaacacagaacaauc

SEQ ID NO: 40062 - RNA, 19 nt, Homo sapiens
gaccaaagcggccaugaug

SEQ ID NO: 40063 - RNA, 19 nt, Homo sapiens
ggagagcggcgugagcuua

SEQ ID NO: 40064 - RNA, 19 nt, Homo sapiens
aaagaaagccagagagaga

SEQ ID NO: 40065 - RNA, 19 nt, Homo sapiens
gcagaaccaacucucuaua

SEQ ID NO: 40066 - RNA, 19 nt, Homo sapiens
gcuccaagcucuaacuuac

SEQ ID NO: 40067 - RNA, 19 nt, Homo sapiens
agagugacuuggaagauaa

SEQ ID NO: 40068 - RNA, 19 nt, Homo sapiens
gagaaggagcugacagauu

SEQ ID NO: 40069 - RNA, 19 nt, Homo sapiens
guauucauaugcagucuga

SEQ ID NO: 40070 - RNA, 19 nt, Homo sapiens
gaaugacccugagcgaaga

SEQ ID NO: 40071 - RNA, 19 nt, Homo sapiens
gcagaaagaagaaagaaua

SEQ ID NO: 40072 - RNA, 19 nt, Homo sapiens
guacaacuauucuucagua

SEQ ID NO: 40073 - RNA, 19 nt, Homo sapiens
caacagguaucaucuuuau

SEQ ID NO: 40074 - RNA, 19 nt, Homo sapiens
gaaagaauaugugaaaugc

SEQ ID NO: 40075 - RNA, 19 nt, Homo sapiens
cagagaagcugcucgagaa

SEQ ID NO: 40076 - RNA, 19 nt, Homo sapiens
gguaucaucuuuaucagaa

SEQ ID NO: 40077 - RNA, 19 nt, Homo sapiens
ugaaggaucuuuauuccaa

SEQ ID NO: 40078 - RNA, 19 nt, Homo sapiens
ggacucauccgacagcaua

SEQ ID NO: 40079 - RNA, 19 nt, Homo sapiens
gcucacauuucucauauug

SEQ ID NO: 40080 - RNA, 19 nt, Homo sapiens
gagcucacauuucucauau

SEQ ID NO: 40081 - RNA, 19 nt, Homo sapiens
ucauauugcucaacaggua

SEQ ID NO: 40082 - RNA, 19 nt, Homo sapiens
gaagauucccacaagagua

SEQ ID NO: 40083 - RNA, 19 nt, Homo sapiens
gcaaucagguggucguaca

SEQ ID NO: 40084 - RNA, 19 nt, Homo sapiens
caaacugcaucaggagaua

SEQ ID NO: 40085 - RNA, 19 nt, Homo sapiens
caacuauucuucaguaugc

SEQ ID NO: 40086 - RNA, 19 nt, Homo sapiens
cuucagacauuaaccauga

SEQ ID NO: 40087 - RNA, 19 nt, Homo sapiens
ucagggagcucacauuucu

SEQ ID NO: 40088 - RNA, 19 nt, Homo sapiens
gaaugucgcagaaagaaga

SEQ ID NO: 40089 - RNA, 19 nt, Homo sapiens
ggagcucacauuucucaua

SEQ ID NO: 40090 - RNA, 19 nt, Homo sapiens
gauccgaacuacaccuuca

SEQ ID NO: 40091 - RNA, 19 nt, Homo sapiens
aaauggagccuuacaguug

SEQ ID NO: 40092 - RNA, 19 nt, Homo sapiens
gcucgagaaugucgcagaa

SEQ ID NO: 40093 - RNA, 19 nt, Homo sapiens
cauuaaccaugacaaauuc

SEQ ID NO: 40094 - RNA, 19 nt, Homo sapiens
gaaggaucuuuauuccaau

SEQ ID NO: 40095 - RNA, 19 nt, Homo sapiens
gagaaugucgcagaaagaa

SEQ ID NO: 40096 - RNA, 19 nt, Homo sapiens
acagggacuucagacauua

SEQ ID NO: 40097 - RNA, 19 nt, Homo sapiens
uacagggacuucagacauu

SEQ ID NO: 40098 - RNA, 19 nt, Homo sapiens
uaugugaaaugccuggaaa

SEQ ID NO: 40099 - RNA, 19 nt, Homo sapiens
caaauggagccuuacaguu

SEQ ID NO: 40100 - RNA, 19 nt, Homo sapiens
guucagggagcucacauuu

SEQ ID NO: 40101 - RNA, 19 nt, Homo sapiens
ucagcaagguacaacuauu

SEQ ID NO: 40102 - RNA, 19 nt, Homo sapiens
cauaggcuccucacagaaa

SEQ ID NO: 40103 - RNA, 19 nt, Homo sapiens
agaagcugcucgagaaugu

SEQ ID NO: 40104 - RNA, 19 nt, Homo sapiens
caagguacaacuauucuuc

SEQ ID NO: 40105 - RNA, 19 nt, Homo sapiens
gacaguacauugccauugc

SEQ ID NO: 40106 - RNA, 19 nt, Homo sapiens
ggacaguacauugccauug

SEQ ID NO: 40107 - RNA, 19 nt, Homo sapiens
cucaacagguaucaucuuu

SEQ ID NO: 40108 - RNA, 19 nt, Homo sapiens
acagguaucaucuuuauca

SEQ ID NO: 40109 - RNA, 19 nt, Homo sapiens
cgaacuacaccuucagcua

SEQ ID NO: 40110 - RNA, 19 nt, Homo sapiens
guacagggacuucagacau

SEQ ID NO: 40111 - RNA, 19 nt, Homo sapiens
ucacauuucucauauugcu

SEQ ID NO: 40112 - RNA, 19 nt, Homo sapiens
ucaccucucagacaacuaa

SEQ ID NO: 40113 - RNA, 19 nt, Homo sapiens
cuacuucucugccacaaac

SEQ ID NO: 40114 - RNA, 19 nt, Homo sapiens
gcaaguccaggcacagaug

SEQ ID NO: 40115 - RNA, 19 nt, Homo sapiens
agacaacuaagacagauga

SEQ ID NO: 40116 - RNA, 19 nt, Homo sapiens
ugacaucuccugugacucu

SEQ ID NO: 40117 - RNA, 19 nt, Homo sapiens
ucaacagguaucaucuuua

SEQ ID NO: 40118 - RNA, 19 nt, Homo sapiens
agacauuaaccaugacaaa

SEQ ID NO: 40119 - RNA, 19 nt, Homo sapiens
ccaaauggagccuuacagu

SEQ ID NO: 40120 - RNA, 19 nt, Homo sapiens
cagcaagguacaacuauuc

SEQ ID NO: 40121 - RNA, 19 nt, Homo sapiens
cauaucagauccgaacuac

SEQ ID NO: 40122 - RNA, 19 nt, Homo sapiens
gacauuaaccaugacaaau

SEQ ID NO: 40123 - RNA, 19 nt, Homo sapiens
ggaguacagggacuucaga

SEQ ID NO: 40124 - RNA, 19 nt, Homo sapiens
gaaagcccacgggauccua

SEQ ID NO: 40125 - RNA, 19 nt, Homo sapiens
gagaagcugcucgagaaug

SEQ ID NO: 40126 - RNA, 19 nt, Homo sapiens
agcauaggcuccucacaga

SEQ ID NO: 40127 - RNA, 19 nt, Homo sapiens
cgagaaugucgcagaaaga

SEQ ID NO: 40128 - RNA, 19 nt, Homo sapiens
ucagacaacuaagacagau

SEQ ID NO: 40129 - RNA, 19 nt, Homo sapiens
ucgagaaugucgcagaaag

SEQ ID NO: 40130 - RNA, 19 nt, Homo sapiens
gcgcccaucuuacagaaaa

SEQ ID NO: 40131 - RNA, 19 nt, Homo sapiens
gauggacagcagauacuug

SEQ ID NO: 40132 - RNA, 19 nt, Homo sapiens
gcauaggcuccucacagaa

SEQ ID NO: 40133 - RNA, 19 nt, Homo sapiens
ggacuucagacauuaacca

SEQ ID NO: 40134 - RNA, 19 nt, Homo sapiens
acucucaccucucagacaa

SEQ ID NO: 40135 - RNA, 19 nt, Homo sapiens
gcaagguacaacuauucuu

SEQ ID NO: 40136 - RNA, 19 nt, Homo sapiens
ccaacucccaucuaucaga

SEQ ID NO: 40137 - RNA, 19 nt, Homo sapiens
cugcugcugucacuucuau

SEQ ID NO: 40138 - RNA, 19 nt, Homo sapiens
gcucaacagguaucaucuu

SEQ ID NO: 40139 - RNA, 19 nt, Homo sapiens
aaaaggagacggagaaaau

SEQ ID NO: 40140 - RNA, 19 nt, Homo sapiens
uaucagauccgaacuacac

SEQ ID NO: 40141 - RNA, 19 nt, Homo sapiens
aagaguaccacgucagaga

SEQ ID NO: 40142 - RNA, 19 nt, Homo sapiens
acaagaguaccacgucaga

SEQ ID NO: 40143 - RNA, 19 nt, Homo sapiens
gaaaaggagacggagaaaa

SEQ ID NO: 40144 - RNA, 19 nt, Homo sapiens
caaauucaggcaguacuca

SEQ ID NO: 40145 - RNA, 19 nt, Homo sapiens
gaagauacacggggcagaa

SEQ ID NO: 40146 - RNA, 19 nt, Homo sapiens
ggucguacaaacugcauca

SEQ ID NO: 40147 - RNA, 19 nt, Homo sapiens
ggcaguacucagcaaggua

SEQ ID NO: 40148 - RNA, 19 nt, Homo sapiens
acucccaucuaucagacua

SEQ ID NO: 40149 - RNA, 19 nt, Homo sapiens
aggcacagauggaguacag

SEQ ID NO: 40150 - RNA, 19 nt, Homo sapiens
uuucucauauugcucaaca

SEQ ID NO: 40151 - RNA, 19 nt, Homo sapiens
gcugcugucacuucuaugu

SEQ ID NO: 40152 - RNA, 19 nt, Homo sapiens
acauaucagauccgaacua

SEQ ID NO: 40153 - RNA, 19 nt, Homo sapiens
gaguugcaguccuggaaaa

SEQ ID NO: 40154 - RNA, 19 nt, Homo sapiens
uagcagcggacaguacauu

SEQ ID NO: 40155 - RNA, 19 nt, Homo sapiens
uguuccaacucccaucuau

SEQ ID NO: 40156 - RNA, 19 nt, Homo sapiens
ucucagaucugguuucuaa

SEQ ID NO: 40157 - RNA, 19 nt, Homo sapiens
gguaccagguuuagcauua

SEQ ID NO: 40158 - RNA, 19 nt, Homo sapiens
gaagaaagcagaaaguuca

SEQ ID NO: 40159 - RNA, 19 nt, Homo sapiens
cagaagagcuugucagcaa

SEQ ID NO: 40160 - RNA, 19 nt, Homo sapiens
gaaauugugugugcaagaa

SEQ ID NO: 40161 - RNA, 19 nt, Homo sapiens
ugaagaagaugaaaggaaa

SEQ ID NO: 40162 - RNA, 19 nt, Homo sapiens
gaaauucucagaguguuua

SEQ ID NO: 40163 - RNA, 19 nt, Homo sapiens
gcuguuauguccagaaauu

SEQ ID NO: 40164 - RNA, 19 nt, Homo sapiens
gagcuaagcagucguggua

SEQ ID NO: 40165 - RNA, 19 nt, Homo sapiens
uggaagagccaaagaaaua

SEQ ID NO: 40166 - RNA, 19 nt, Homo sapiens
gcaaagugccgaaacaaga

SEQ ID NO: 40167 - RNA, 19 nt, Homo sapiens
caaggacgcuggcuacugu

SEQ ID NO: 40168 - RNA, 19 nt, Homo sapiens
gaaacaagaagaaggagaa

SEQ ID NO: 40169 - RNA, 19 nt, Homo sapiens
ggagugagaacagcauuua

SEQ ID NO: 40170 - RNA, 19 nt, Homo sapiens
gauggcagguccucuguug

SEQ ID NO: 40171 - RNA, 19 nt, Homo sapiens
gcaaauaugcuguuauguc

SEQ ID NO: 40172 - RNA, 19 nt, Homo sapiens
cggagaagcuggaaagugu

SEQ ID NO: 40173 - RNA, 19 nt, Homo sapiens
gagaacagcauuuagugaa

SEQ ID NO: 40174 - RNA, 19 nt, Homo sapiens
gggagggccugcagugauu

SEQ ID NO: 40175 - RNA, 19 nt, Homo sapiens
gaacagcauuuagugaagu

SEQ ID NO: 40176 - RNA, 19 nt, Homo sapiens
agaagcagcauuugauaua

SEQ ID NO: 40177 - RNA, 19 nt, Homo sapiens
gaucugguuucuaagaguu

SEQ ID NO: 40178 - RNA, 19 nt, Homo sapiens
gaagagccaaagaaauauu

SEQ ID NO: 40179 - RNA, 19 nt, Homo sapiens
ggucaggaguugugucuag

SEQ ID NO: 40180 - RNA, 19 nt, Homo sapiens
ggaagaaagcagaaaguuc

SEQ ID NO: 40181 - RNA, 19 nt, Homo sapiens
uuccuaaccugucagaaua

SEQ ID NO: 40182 - RNA, 19 nt, Homo sapiens
cgagaaagaaauaagauug

SEQ ID NO: 40183 - RNA, 19 nt, Homo sapiens
gcuaagcagucgugguaug

SEQ ID NO: 40184 - RNA, 19 nt, Homo sapiens
gagcggagccuggagcaaa

SEQ ID NO: 40185 - RNA, 19 nt, Homo sapiens
gcuggcuacugucuauuaa

SEQ ID NO: 40186 - RNA, 19 nt, Homo sapiens
gguuaggacucuccacuca

SEQ ID NO: 40187 - RNA, 19 nt, Homo sapiens
cggagugccugcagaaaga

SEQ ID NO: 40188 - RNA, 19 nt, Homo sapiens
gcaagaggaggaacagaau

SEQ ID NO: 40189 - RNA, 19 nt, Homo sapiens
gaagcagcauuugauauac

SEQ ID NO: 40190 - RNA, 19 nt, Homo sapiens
gagaagcagcauuugauau

SEQ ID NO: 40191 - RNA, 19 nt, Homo sapiens
cgagaagcagcauuugaua

SEQ ID NO: 40192 - RNA, 19 nt, Homo sapiens
gcacugcacagcucucuuc

SEQ ID NO: 40193 - RNA, 19 nt, Homo sapiens
ggauuuaggccuuaacaca

SEQ ID NO: 40194 - RNA, 19 nt, Homo sapiens
caaagugccgaaacaagaa

SEQ ID NO: 40195 - RNA, 19 nt, Homo sapiens
ucauguagcuguuuuaaga

SEQ ID NO: 40196 - RNA, 19 nt, Homo sapiens
gauaaaagaaggaacauug

SEQ ID NO: 40197 - RNA, 19 nt, Homo sapiens
ggaagagccaaagaaauau

SEQ ID NO: 40198 - RNA, 19 nt, Homo sapiens
ugccucaacuccaggauuu

SEQ ID NO: 40199 - RNA, 19 nt, Homo sapiens
ccaaaacccugaagccauu

SEQ ID NO: 40200 - RNA, 19 nt, Homo sapiens
guaccagguuuagcauuau

SEQ ID NO: 40201 - RNA, 19 nt, Homo sapiens
gcuggaagagccaaagaaa

SEQ ID NO: 40202 - RNA, 19 nt, Homo sapiens
gcaaaaugaugcuucaaca

SEQ ID NO: 40203 - RNA, 19 nt, Homo sapiens
gaacgagaagcagcauuug

SEQ ID NO: 40204 - RNA, 19 nt, Homo sapiens
gacgcuggcuacugucuau

SEQ ID NO: 40205 - RNA, 19 nt, Homo sapiens
ugucuuaggucaggaguug

SEQ ID NO: 40206 - RNA, 19 nt, Homo sapiens
ccucugcgcuggaaucagu

SEQ ID NO: 40207 - RNA, 19 nt, Homo sapiens
caaggaagagcugagguuu

SEQ ID NO: 40208 - RNA, 19 nt, Homo sapiens
aauguacucuuccgauguu

SEQ ID NO: 40209 - RNA, 19 nt, Homo sapiens
gagaaaccucuuuauccaa

SEQ ID NO: 40210 - RNA, 19 nt, Homo sapiens
cgacgagaaagaaauaaga

SEQ ID NO: 40211 - RNA, 19 nt, Homo sapiens
uuaggacucuccacucaau

SEQ ID NO: 40212 - RNA, 19 nt, Homo sapiens
caaagucacaggaagaaag

SEQ ID NO: 40213 - RNA, 19 nt, Homo sapiens
caagaaaacuaggcaaugu

SEQ ID NO: 40214 - RNA, 19 nt, Homo sapiens
agagcugucuuccugugua

SEQ ID NO: 40215 - RNA, 19 nt, Homo sapiens
agaacgagaagcagcauuu

SEQ ID NO: 40216 - RNA, 19 nt, Homo sapiens
gagaagcuggaaaguguga

SEQ ID NO: 40217 - RNA, 19 nt, Homo sapiens
gcugcaaagugccgaaaca

SEQ ID NO: 40218 - RNA, 19 nt, Homo sapiens
cugcacagcucucuucucu

SEQ ID NO: 40219 - RNA, 19 nt, Homo sapiens
ucacugguguuugaggauu

SEQ ID NO: 40220 - RNA, 19 nt, Homo sapiens
cagcaggcccuucccauuc

SEQ ID NO: 40221 - RNA, 19 nt, Homo sapiens
ucagaguguuuaauuguac

SEQ ID NO: 40222 - RNA, 19 nt, Homo sapiens
cucagaguguuuaauugua

SEQ ID NO: 40223 - RNA, 19 nt, Homo sapiens
caagaggaggaacagaauu

SEQ ID NO: 40224 - RNA, 19 nt, Homo sapiens
gaacauugcagagcuaagc

SEQ ID NO: 40225 - RNA, 19 nt, Homo sapiens
gaaaccucuuuauccaaca

SEQ ID NO: 40226 - RNA, 19 nt, Homo sapiens
caucggcccacguguauug

SEQ ID NO: 40227 - RNA, 19 nt, Homo sapiens
gcagaaagagucggagaag

SEQ ID NO: 40228 - RNA, 19 nt, Homo sapiens
ucagaucugguuucuaaga

SEQ ID NO: 40229 - RNA, 19 nt, Homo sapiens
gguuugccauccagaacaa

SEQ ID NO: 40230 - RNA, 19 nt, Homo sapiens
gauguccucugcgcuggaa

SEQ ID NO: 40231 - RNA, 19 nt, Homo sapiens
cagggcaagugcaucuuug

SEQ ID NO: 40232 - RNA, 19 nt, Homo sapiens
uauacaugcucaaccuuca

SEQ ID NO: 40233 - RNA, 19 nt, Homo sapiens
gugaaauucucagaguguu

SEQ ID NO: 40234 - RNA, 19 nt, Homo sapiens
acacugaugugacuuuuau

SEQ ID NO: 40235 - RNA, 19 nt, Homo sapiens
ugagaacagcauuuaguga

SEQ ID NO: 40236 - RNA, 19 nt, Homo sapiens
ccucauugaauccucauuu

SEQ ID NO: 40237 - RNA, 19 nt, Homo sapiens
cugggucacugguguuuga

SEQ ID NO: 40238 - RNA, 19 nt, Homo sapiens
cacagucaguggagagaug

SEQ ID NO: 40239 - RNA, 19 nt, Homo sapiens
gcagguccucuguugcaaa

SEQ ID NO: 40240 - RNA, 19 nt, Homo sapiens
gcugucaccacgugcagua

SEQ ID NO: 40241 - RNA, 19 nt, Homo sapiens
gagaaagaaauaagauugc

SEQ ID NO: 40242 - RNA, 19 nt, Homo sapiens
uaccagguuuagcauuauu

SEQ ID NO: 40243 - RNA, 19 nt, Homo sapiens
gccaaagaaauauuccauu

SEQ ID NO: 40244 - RNA, 19 nt, Homo sapiens
cagaauucucccagcguua

SEQ ID NO: 40245 - RNA, 19 nt, Homo sapiens
acacuggccauucuuaugu

SEQ ID NO: 40246 - RNA, 19 nt, Homo sapiens
aagcagcauuugauauaca

SEQ ID NO: 40247 - RNA, 19 nt, Homo sapiens
ugugaaugcugaacugaag

SEQ ID NO: 40248 - RNA, 19 nt, Homo sapiens
ucaaggaagagcugagguu

SEQ ID NO: 40249 - RNA, 19 nt, Homo sapiens
agaauucucccagcguuaa

SEQ ID NO: 40250 - RNA, 19 nt, Homo sapiens
ccagggcaagugcaucuuu

SEQ ID NO: 40251 - RNA, 19 nt, Homo sapiens
aaggaacauugcagagcua

SEQ ID NO: 40252 - RNA, 19 nt, Homo sapiens
gaagcuggaaagugugaau

SEQ ID NO: 40253 - RNA, 19 nt, Homo sapiens
ggacgcuggcuacugucua

SEQ ID NO: 40254 - RNA, 19 nt, Homo sapiens
cgagguagccccugaagaa

SEQ ID NO: 40255 - RNA, 19 nt, Homo sapiens
ccaggguugugcuuucuag

SEQ ID NO: 40256 - RNA, 19 nt, Homo sapiens
ucucagaucugguuucuaa

SEQ ID NO: 40257 - RNA, 19 nt, Homo sapiens
gguaccagguuuagcauua

SEQ ID NO: 40258 - RNA, 19 nt, Homo sapiens
gaagaaagcagaaaguuca

SEQ ID NO: 40259 - RNA, 19 nt, Homo sapiens
cagaagagcuugucagcaa

SEQ ID NO: 40260 - RNA, 19 nt, Homo sapiens
gaaauugugugugcaagaa

SEQ ID NO: 40261 - RNA, 19 nt, Homo sapiens
ugaagaagaugaaaggaaa

SEQ ID NO: 40262 - RNA, 19 nt, Homo sapiens
gccugcagcuucaguauua

SEQ ID NO: 40263 - RNA, 19 nt, Homo sapiens
gaaauucucagaguguuua

SEQ ID NO: 40264 - RNA, 19 nt, Homo sapiens
gcuguuauguccagaaauu

SEQ ID NO: 40265 - RNA, 19 nt, Homo sapiens
gagcuaagcagucguggua

SEQ ID NO: 40266 - RNA, 19 nt, Homo sapiens
uggaagagccaaagaaaua

SEQ ID NO: 40267 - RNA, 19 nt, Homo sapiens
gcaaagugccgaaacaaga

SEQ ID NO: 40268 - RNA, 19 nt, Homo sapiens
caaggacgcuggcuacugu

SEQ ID NO: 40269 - RNA, 19 nt, Homo sapiens
gaaacaagaagaaggagaa

SEQ ID NO: 40270 - RNA, 19 nt, Homo sapiens
ggagugagaacagcauuua

SEQ ID NO: 40271 - RNA, 19 nt, Homo sapiens
gauggcagguccucuguug

SEQ ID NO: 40272 - RNA, 19 nt, Homo sapiens
gcaaauaugcuguuauguc

SEQ ID NO: 40273 - RNA, 19 nt, Homo sapiens
cggagaagcuggaaagugu

SEQ ID NO: 40274 - RNA, 19 nt, Homo sapiens
gagaacagcauuuagugaa

SEQ ID NO: 40275 - RNA, 19 nt, Homo sapiens
gggagggccugcagugauu

SEQ ID NO: 40276 - RNA, 19 nt, Homo sapiens
gaacagcauuuagugaagu

SEQ ID NO: 40277 - RNA, 19 nt, Homo sapiens
agaagcagcauuugauaua

SEQ ID NO: 40278 - RNA, 19 nt, Homo sapiens
gaucugguuucuaagaguu

SEQ ID NO: 40279 - RNA, 19 nt, Homo sapiens
gaagagccaaagaaauauu

SEQ ID NO: 40280 - RNA, 19 nt, Homo sapiens
ggucaggaguugugucuag

SEQ ID NO: 40281 - RNA, 19 nt, Homo sapiens
ggaagaaagcagaaaguuc

SEQ ID NO: 40282 - RNA, 19 nt, Homo sapiens
uuccuaaccugucagaaua

SEQ ID NO: 40283 - RNA, 19 nt, Homo sapiens
cgagaaagaaauaagauug

SEQ ID NO: 40284 - RNA, 19 nt, Homo sapiens
gaagaagagggucugcauu

SEQ ID NO: 40285 - RNA, 19 nt, Homo sapiens
gcuaagcagucgugguaug

SEQ ID NO: 40286 - RNA, 19 nt, Homo sapiens
gcuggcuacugucuauuaa

SEQ ID NO: 40287 - RNA, 19 nt, Homo sapiens
gguuaggacucuccacuca

SEQ ID NO: 40288 - RNA, 19 nt, Homo sapiens
gagcggagccuggagcaaa

SEQ ID NO: 40289 - RNA, 19 nt, Homo sapiens
gcaagaggaggaacagaau

SEQ ID NO: 40290 - RNA, 19 nt, Homo sapiens
gaagcagcauuugauauac

SEQ ID NO: 40291 - RNA, 19 nt, Homo sapiens
gagaagcagcauuugauau

SEQ ID NO: 40292 - RNA, 19 nt, Homo sapiens
cgagaagcagcauuugaua

SEQ ID NO: 40293 - RNA, 19 nt, Homo sapiens
aagaagagggucugcauuu

SEQ ID NO: 40294 - RNA, 19 nt, Homo sapiens
gcacugcacagcucucuuc

SEQ ID NO: 40295 - RNA, 19 nt, Homo sapiens
ggauuuaggccuuaacaca

SEQ ID NO: 40296 - RNA, 19 nt, Homo sapiens
caaagugccgaaacaagaa

SEQ ID NO: 40297 - RNA, 19 nt, Homo sapiens
ucauguagcuguuuuaaga

SEQ ID NO: 40298 - RNA, 19 nt, Homo sapiens
gauaaaagaaggaacauug

SEQ ID NO: 40299 - RNA, 19 nt, Homo sapiens
ggaagagccaaagaaauau

SEQ ID NO: 40300 - RNA, 19 nt, Homo sapiens
ugccucaacuccaggauuu

SEQ ID NO: 40301 - RNA, 19 nt, Homo sapiens
ccaaaacccugaagccauu

SEQ ID NO: 40302 - RNA, 19 nt, Homo sapiens
guaccagguuuagcauuau

SEQ ID NO: 40303 - RNA, 19 nt, Homo sapiens
gcuggaagagccaaagaaa

SEQ ID NO: 40304 - RNA, 19 nt, Homo sapiens
gaacgagaagcagcauuug

SEQ ID NO: 40305 - RNA, 19 nt, Homo sapiens
gcaaaaugaugcuucaaca

SEQ ID NO: 40306 - RNA, 19 nt, Homo sapiens
gacgcuggcuacugucuau

SEQ ID NO: 40307 - RNA, 19 nt, Homo sapiens
ugucuuaggucaggaguug

SEQ ID NO: 40308 - RNA, 19 nt, Homo sapiens
ucaccaggguuucucugaa

SEQ ID NO: 40309 - RNA, 19 nt, Homo sapiens
ccucugcgcuggaaucagu

SEQ ID NO: 40310 - RNA, 19 nt, Homo sapiens
aauguacucuuccgauguu

SEQ ID NO: 40311 - RNA, 19 nt, Homo sapiens
caaggaagagcugagguuu

SEQ ID NO: 40312 - RNA, 19 nt, Homo sapiens
gagaaaccucuuuauccaa

SEQ ID NO: 40313 - RNA, 19 nt, Homo sapiens
cgacgagaaagaaauaaga

SEQ ID NO: 40314 - RNA, 19 nt, Homo sapiens
uuaggacucuccacucaau

SEQ ID NO: 40315 - RNA, 19 nt, Homo sapiens
caaagucacaggaagaaag

SEQ ID NO: 40316 - RNA, 19 nt, Homo sapiens
caagaaaacuaggcaaugu

SEQ ID NO: 40317 - RNA, 19 nt, Homo sapiens
agagcugucuuccugugua

SEQ ID NO: 40318 - RNA, 19 nt, Homo sapiens
agaacgagaagcagcauuu

SEQ ID NO: 40319 - RNA, 19 nt, Homo sapiens
gagaagcuggaaaguguga

SEQ ID NO: 40320 - RNA, 19 nt, Homo sapiens
gcugcaaagugccgaaaca

SEQ ID NO: 40321 - RNA, 19 nt, Homo sapiens
cugcacagcucucuucucu

SEQ ID NO: 40322 - RNA, 19 nt, Homo sapiens
ucacugguguuugaggauu

SEQ ID NO: 40323 - RNA, 19 nt, Homo sapiens
cagcaggcccuucccauuc

SEQ ID NO: 40324 - RNA, 19 nt, Homo sapiens
ucagaguguuuaauuguac

SEQ ID NO: 40325 - RNA, 19 nt, Homo sapiens
cucagaguguuuaauugua

SEQ ID NO: 40326 - RNA, 19 nt, Homo sapiens
caagaggaggaacagaauu

SEQ ID NO: 40327 - RNA, 19 nt, Homo sapiens
gaacauugcagagcuaagc

SEQ ID NO: 40328 - RNA, 19 nt, Homo sapiens
gaaaccucuuuauccaaca

SEQ ID NO: 40329 - RNA, 19 nt, Homo sapiens
caucggcccacguguauug

SEQ ID NO: 40330 - RNA, 19 nt, Homo sapiens
ucagaucugguuucuaaga

SEQ ID NO: 40331 - RNA, 19 nt, Homo sapiens
cagggcaagugcaucuuug

SEQ ID NO: 40332 - RNA, 19 nt, Homo sapiens
uauacaugcucaaccuuca

SEQ ID NO: 40333 - RNA, 19 nt, Homo sapiens
gguuugccauccagaacaa

SEQ ID NO: 40334 - RNA, 19 nt, Homo sapiens
gauguccucugcgcuggaa

SEQ ID NO: 40335 - RNA, 19 nt, Homo sapiens
cugggucacugguguuuga

SEQ ID NO: 40336 - RNA, 19 nt, Homo sapiens
gugaaauucucagaguguu

SEQ ID NO: 40337 - RNA, 19 nt, Homo sapiens
acacugaugugacuuuuau

SEQ ID NO: 40338 - RNA, 19 nt, Homo sapiens
ugagaacagcauuuaguga

SEQ ID NO: 40339 - RNA, 19 nt, Homo sapiens
ccucauugaauccucauuu

SEQ ID NO: 40340 - RNA, 19 nt, Homo sapiens
cacagucaguggagagaug

SEQ ID NO: 40341 - RNA, 19 nt, Homo sapiens
gcagguccucuguugcaaa

SEQ ID NO: 40342 - RNA, 19 nt, Homo sapiens
gcugucaccacgugcagua

SEQ ID NO: 40343 - RNA, 19 nt, Homo sapiens
gagaaagaaauaagauugc

SEQ ID NO: 40344 - RNA, 19 nt, Homo sapiens
uaccagguuuagcauuauu

SEQ ID NO: 40345 - RNA, 19 nt, Homo sapiens
gccaaagaaauauuccauu

SEQ ID NO: 40346 - RNA, 19 nt, Homo sapiens
cagaauucucccagcguua

SEQ ID NO: 40347 - RNA, 19 nt, Homo sapiens
acacuggccauucuuaugu

SEQ ID NO: 40348 - RNA, 19 nt, Homo sapiens
aagcagcauuugauauaca

SEQ ID NO: 40349 - RNA, 19 nt, Homo sapiens
ugugaaugcugaacugaag

SEQ ID NO: 40350 - RNA, 19 nt, Homo sapiens
cggagugccugcagcuuca

SEQ ID NO: 40351 - RNA, 19 nt, Homo sapiens
agaauucucccagcguuaa

SEQ ID NO: 40352 - RNA, 19 nt, Homo sapiens
ucaaggaagagcugagguu

SEQ ID NO: 40353 - RNA, 19 nt, Homo sapiens
ccagggcaagugcaucuuu

SEQ ID NO: 40354 - RNA, 19 nt, Homo sapiens
aaggaacauugcagagcua

SEQ ID NO: 40355 - RNA, 19 nt, Homo sapiens
gaagcuggaaagugugaau

SEQ ID NO: 40356 - RNA, 19 nt, Homo sapiens
caaagacaccuucgaauua

SEQ ID NO: 40357 - RNA, 19 nt, Homo sapiens
gcaaagagcuggaaaagaa

SEQ ID NO: 40358 - RNA, 19 nt, Homo sapiens
cagaacagcuaaccucuaa

SEQ ID NO: 40359 - RNA, 19 nt, Homo sapiens
gugagaaacuggauaagaa

SEQ ID NO: 40360 - RNA, 19 nt, Homo sapiens
gcaaagcaccgcaacauga

SEQ ID NO: 40361 - RNA, 19 nt, Homo sapiens
gaucauuccuuuaguuuag

SEQ ID NO: 40362 - RNA, 19 nt, Homo sapiens
gauaguggcaucuguauga

SEQ ID NO: 40363 - RNA, 19 nt, Homo sapiens
aaagacaccuucgaauuaa

SEQ ID NO: 40364 - RNA, 19 nt, Homo sapiens
ggaguuggcuucugauucu

SEQ ID NO: 40365 - RNA, 19 nt, Homo sapiens
gaacagcuaaccucuaaug

SEQ ID NO: 40366 - RNA, 19 nt, Homo sapiens
cgacuuggaugcccuguug

SEQ ID NO: 40367 - RNA, 19 nt, Homo sapiens
ggauaucacugaaggagau

SEQ ID NO: 40368 - RNA, 19 nt, Homo sapiens
gaagaaagccuaggucucu

SEQ ID NO: 40369 - RNA, 19 nt, Homo sapiens
ggguauagaugaccuggaa

SEQ ID NO: 40370 - RNA, 19 nt, Homo sapiens
guagcuguguguuccaaua

SEQ ID NO: 40371 - RNA, 19 nt, Homo sapiens
uccaguaccugaaagauuu

SEQ ID NO: 40372 - RNA, 19 nt, Homo sapiens
gagaagucccgccucauaa

SEQ ID NO: 40373 - RNA, 19 nt, Homo sapiens
ccugaaagauuugauagaa

SEQ ID NO: 40374 - RNA, 19 nt, Homo sapiens
ccagaucauuccuuuaguu

SEQ ID NO: 40375 - RNA, 19 nt, Homo sapiens
cagauuggauguuggagaa

SEQ ID NO: 40376 - RNA, 19 nt, Homo sapiens
gagcgucaaugugcuugua

SEQ ID NO: 40377 - RNA, 19 nt, Homo sapiens
agacuacacugcuuacguu

SEQ ID NO: 40378 - RNA, 19 nt, Homo sapiens
cgacaaagacaccuucgaa

SEQ ID NO: 40379 - RNA, 19 nt, Homo sapiens
aaauacaacugcccuguuc

SEQ ID NO: 40380 - RNA, 19 nt, Homo sapiens
caugaucccucagugcaua

SEQ ID NO: 40381 - RNA, 19 nt, Homo sapiens
ugacacuugugaucucuuu

SEQ ID NO: 40382 - RNA, 19 nt, Homo sapiens
acaaagacaccuucgaauu

SEQ ID NO: 40383 - RNA, 19 nt, Homo sapiens
guuuagagcugggcaguga

SEQ ID NO: 40384 - RNA, 19 nt, Homo sapiens
ugaaggaguucgacuugga

SEQ ID NO: 40385 - RNA, 19 nt, Homo sapiens
gccuaggucucuuagauga

SEQ ID NO: 40386 - RNA, 19 nt, Homo sapiens
ggagauccaguaccugaaa

SEQ ID NO: 40387 - RNA, 19 nt, Homo sapiens
agagaagucccgccucaua

SEQ ID NO: 40388 - RNA, 19 nt, Homo sapiens
guaccugaaagauuugaua

SEQ ID NO: 40389 - RNA, 19 nt, Homo sapiens
gaagaacgaggcucuaaaa

SEQ ID NO: 40390 - RNA, 19 nt, Homo sapiens
uggaaaccaugccagauga

SEQ ID NO: 40391 - RNA, 19 nt, Homo sapiens
ggacagauuggauguugga

SEQ ID NO: 40392 - RNA, 19 nt, Homo sapiens
ccaaggagauccaguaccu

SEQ ID NO: 40393 - RNA, 19 nt, Homo sapiens
gagauaggaagccagacua

SEQ ID NO: 40394 - RNA, 19 nt, Homo sapiens
uagaugaccuggaaaccau

SEQ ID NO: 40395 - RNA, 19 nt, Homo sapiens
cuaggucucuuagaugauu

SEQ ID NO: 40396 - RNA, 19 nt, Homo sapiens
acggagcgcuuuccucuug

SEQ ID NO: 40397 - RNA, 19 nt, Homo sapiens
gaugguagcagcaaaagua

SEQ ID NO: 40398 - RNA, 19 nt, Homo sapiens
uuaagcacauuccucgauu

SEQ ID NO: 40399 - RNA, 19 nt, Homo sapiens
ggaugacacuugugaucuc

SEQ ID NO: 40400 - RNA, 19 nt, Homo sapiens
aaugggaguuggcuucuga

SEQ ID NO: 40401 - RNA, 19 nt, Homo sapiens
uaaguggaaggaugaaauu

SEQ ID NO: 40402 - RNA, 19 nt, Homo sapiens
gcuguguguuccaauaaau

SEQ ID NO: 40403 - RNA, 19 nt, Homo sapiens
cggauucccuggccaagga

SEQ ID NO: 40404 - RNA, 19 nt, Homo sapiens
aagccuaggucucuuagau

SEQ ID NO: 40405 - RNA, 19 nt, Homo sapiens
agaaagccuaggucucuua

SEQ ID NO: 40406 - RNA, 19 nt, Homo sapiens
caaauacaacugcccuguu

SEQ ID NO: 40407 - RNA, 19 nt, Homo sapiens
agacagcagccacuaggua

SEQ ID NO: 40408 - RNA, 19 nt, Homo sapiens
ggugagaaacuggauaaga

SEQ ID NO: 40409 - RNA, 19 nt, Homo sapiens
cagaucauuccuuuaguuu

SEQ ID NO: 40410 - RNA, 19 nt, Homo sapiens
gauggccgaucuagagaag

SEQ ID NO: 40411 - RNA, 19 nt, Homo sapiens
cgggacagauuggauguug

SEQ ID NO: 40412 - RNA, 19 nt, Homo sapiens
gaaggaugaaauucucaga

SEQ ID NO: 40413 - RNA, 19 nt, Homo sapiens
gaacccaauuggccaucuc

SEQ ID NO: 40414 - RNA, 19 nt, Homo sapiens
uggaugcccuguuggguau

SEQ ID NO: 40415 - RNA, 19 nt, Homo sapiens
cuagguaccgccagaagaa

SEQ ID NO: 40416 - RNA, 19 nt, Homo sapiens
gacaaagacaccuucgaau

SEQ ID NO: 40417 - RNA, 19 nt, Homo sapiens
gaagucccgccucauaagu

SEQ ID NO: 40418 - RNA, 19 nt, Homo sapiens
agaagaugguagcagcaaa

SEQ ID NO: 40419 - RNA, 19 nt, Homo sapiens
gaaggaguucgacuuggau

SEQ ID NO: 40420 - RNA, 19 nt, Homo sapiens
uaagcacauuccucgauuc

SEQ ID NO: 40421 - RNA, 19 nt, Homo sapiens
guggaaggaugaaauucuc

SEQ ID NO: 40422 - RNA, 19 nt, Homo sapiens
gagaagaugguagcagcaa

SEQ ID NO: 40423 - RNA, 19 nt, Homo sapiens
ggccaucucccagaaaguu

SEQ ID NO: 40424 - RNA, 19 nt, Homo sapiens
gucagucccuccaacaaca

SEQ ID NO: 40425 - RNA, 19 nt, Homo sapiens
gaaagccuaggucucuuag

SEQ ID NO: 40426 - RNA, 19 nt, Homo sapiens
gagauccaguaccugaaag

SEQ ID NO: 40427 - RNA, 19 nt, Homo sapiens
gaagaugguagcagcaaaa

SEQ ID NO: 40428 - RNA, 19 nt, Homo sapiens
ccaucucccagaaaguuua

SEQ ID NO: 40429 - RNA, 19 nt, Homo sapiens
ggagguggccaagcacuuc

SEQ ID NO: 40430 - RNA, 19 nt, Homo sapiens
uaaugauaguggcaucugu

SEQ ID NO: 40431 - RNA, 19 nt, Homo sapiens
ggagauaggaagccagacu

SEQ ID NO: 40432 - RNA, 19 nt, Homo sapiens
ucagaacagcuaaccucua

SEQ ID NO: 40433 - RNA, 19 nt, Homo sapiens
gcugggcagugaaguggau

SEQ ID NO: 40434 - RNA, 19 nt, Homo sapiens
gaugacacuugugaucucu

SEQ ID NO: 40435 - RNA, 19 nt, Homo sapiens
ccacguuggaugacacuug

SEQ ID NO: 40436 - RNA, 19 nt, Homo sapiens
gcccacagauguaguuuuc

SEQ ID NO: 40437 - RNA, 19 nt, Homo sapiens
agaagaacgaggcucuaaa

SEQ ID NO: 40438 - RNA, 19 nt, Homo sapiens
aagaagaacgaggcucuaa

SEQ ID NO: 40439 - RNA, 19 nt, Homo sapiens
ucccagaaaguuuaacaaa

SEQ ID NO: 40440 - RNA, 19 nt, Homo sapiens
cagcaaagcaccgcaacau

SEQ ID NO: 40441 - RNA, 19 nt, Homo sapiens
gggaguuggcuucugauuc

SEQ ID NO: 40442 - RNA, 19 nt, Homo sapiens
uaaaagagagggcggauuc

SEQ ID NO: 40443 - RNA, 19 nt, Homo sapiens
cacuccagaucauuccuuu

SEQ ID NO: 40444 - RNA, 19 nt, Homo sapiens
cacguuggaugacacuugu

SEQ ID NO: 40445 - RNA, 19 nt, Homo sapiens
ucaggcuucucacggcauu

SEQ ID NO: 40446 - RNA, 19 nt, Homo sapiens
uagcuguguguuccaauaa

SEQ ID NO: 40447 - RNA, 19 nt, Homo sapiens
ccucccaucuccagguguu

SEQ ID NO: 40448 - RNA, 19 nt, Homo sapiens
aaugauaguggcaucugua

SEQ ID NO: 40449 - RNA, 19 nt, Homo sapiens
cugcuuacguugccaugau

SEQ ID NO: 40450 - RNA, 19 nt, Homo sapiens
ucacugaaggagauaggaa

SEQ ID NO: 40451 - RNA, 19 nt, Homo sapiens
cugaaagauuugauagaag

SEQ ID NO: 40452 - RNA, 19 nt, Homo sapiens
aaacgugcaggaaccaaga

SEQ ID NO: 40453 - RNA, 19 nt, Homo sapiens
accaggggcucuccaaaua

SEQ ID NO: 40454 - RNA, 19 nt, Homo sapiens
guaugagcccagaguccua

SEQ ID NO: 40455 - RNA, 19 nt, Homo sapiens
ucucugcgcgugugcguuu

SEQ ID NO: 40456 - RNA, 19 nt, Homo sapiens
gcaaagcccuaguaacaua

SEQ ID NO: 40457 - RNA, 19 nt, Homo sapiens
gaacuaggcugggaaguaa

SEQ ID NO: 40458 - RNA, 19 nt, Homo sapiens
gaaaguaucacucuguuua

SEQ ID NO: 40459 - RNA, 19 nt, Homo sapiens
caucaaagcuaaugaauga

SEQ ID NO: 40460 - RNA, 19 nt, Homo sapiens
gaaagagaauggauuagaa

SEQ ID NO: 40461 - RNA, 19 nt, Homo sapiens
gaaacuaguugucaauuug

SEQ ID NO: 40462 - RNA, 19 nt, Homo sapiens
gaaggcauuucucucauua

SEQ ID NO: 40463 - RNA, 19 nt, Homo sapiens
gcagaaacgugcuuagaaa

SEQ ID NO: 40464 - RNA, 19 nt, Homo sapiens
gaacagaggcugcaaauag

SEQ ID NO: 40465 - RNA, 19 nt, Homo sapiens
gcaagcagcugaaacaaau

SEQ ID NO: 40466 - RNA, 19 nt, Homo sapiens
ugaaauggcucuuauucua

SEQ ID NO: 40467 - RNA, 19 nt, Homo sapiens
caacuuauaugaucugcua

SEQ ID NO: 40468 - RNA, 19 nt, Homo sapiens
caacauaggcuuaaugauu

SEQ ID NO: 40469 - RNA, 19 nt, Homo sapiens
gagaugaauuucugacuaa

SEQ ID NO: 40470 - RNA, 19 nt, Homo sapiens
gguagaagauugugucaaa

SEQ ID NO: 40471 - RNA, 19 nt, Homo sapiens
caaaguauccugcaaguuu

SEQ ID NO: 40472 - RNA, 19 nt, Homo sapiens
cagcagaacuuguacauau

SEQ ID NO: 40473 - RNA, 19 nt, Homo sapiens
gagagaaugugguauagaa

SEQ ID NO: 40474 - RNA, 19 nt, Homo sapiens
caagcaagcucuccugaaa

SEQ ID NO: 40475 - RNA, 19 nt, Homo sapiens
gaacaucucugcuuucacu

SEQ ID NO: 40476 - RNA, 19 nt, Homo sapiens
gaaacucuguuaaccauug

SEQ ID NO: 40477 - RNA, 19 nt, Homo sapiens
cguaaacgcuucuuaugua

SEQ ID NO: 40478 - RNA, 19 nt, Homo sapiens
ggaagaagcacaaguauuc

SEQ ID NO: 40479 - RNA, 19 nt, Homo sapiens
ggugugaucuucaguauau

SEQ ID NO: 40480 - RNA, 19 nt, Homo sapiens
gaaugcagaugaccaagaa

SEQ ID NO: 40481 - RNA, 19 nt, Homo sapiens
caacaggucuuccagaugu

SEQ ID NO: 40482 - RNA, 19 nt, Homo sapiens
gaacagcuucugaauaauu

SEQ ID NO: 40483 - RNA, 19 nt, Homo sapiens
ccacuuugcuuuauauuug

SEQ ID NO: 40484 - RNA, 19 nt, Homo sapiens
ggaauuaugcauugguuua

SEQ ID NO: 40485 - RNA, 19 nt, Homo sapiens
gaagacaacuggaacuaca

SEQ ID NO: 40486 - RNA, 19 nt, Homo sapiens
uuacguagcuucucccuuu

SEQ ID NO: 40487 - RNA, 19 nt, Homo sapiens
guaaaucugugaaagagaa

SEQ ID NO: 40488 - RNA, 19 nt, Homo sapiens
gaauggcccuaguaaauug

SEQ ID NO: 40489 - RNA, 19 nt, Homo sapiens
gaaacccugucucuacuaa

SEQ ID NO: 40490 - RNA, 19 nt, Homo sapiens
ccaauuggcugcuagaaug

SEQ ID NO: 40491 - RNA, 19 nt, Homo sapiens
guacaaugcucuacaaucu

SEQ ID NO: 40492 - RNA, 19 nt, Homo sapiens
uguaauagcugaagaggaa

SEQ ID NO: 40493 - RNA, 19 nt, Homo sapiens
gagaggagacagcuuguua

SEQ ID NO: 40494 - RNA, 19 nt, Homo sapiens
uaucauggaugugucauua

SEQ ID NO: 40495 - RNA, 19 nt, Homo sapiens
gaaauaugaugcagcuaug

SEQ ID NO: 40496 - RNA, 19 nt, Homo sapiens
gaagugguguucuugaaug

SEQ ID NO: 40497 - RNA, 19 nt, Homo sapiens
caaaggagaggaaauauau

SEQ ID NO: 40498 - RNA, 19 nt, Homo sapiens
uaacaaaggagaggaaaua

SEQ ID NO: 40499 - RNA, 19 nt, Homo sapiens
ccaagaagaguccaaauaa

SEQ ID NO: 40500 - RNA, 19 nt, Homo sapiens
acaaacagauacacaguaa

SEQ ID NO: 40501 - RNA, 19 nt, Homo sapiens
uaaggaacaucucugcuuu

SEQ ID NO: 40502 - RNA, 19 nt, Homo sapiens
gaccaugaauccuuugaaa

SEQ ID NO: 40503 - RNA, 19 nt, Homo sapiens
guaaacgcuucuuauguaa

SEQ ID NO: 40504 - RNA, 19 nt, Homo sapiens
gaaggaagccagaguacaa

SEQ ID NO: 40505 - RNA, 19 nt, Homo sapiens
ggaggaaauuguuaauguu

SEQ ID NO: 40506 - RNA, 19 nt, Homo sapiens
gaagaaggaagccagagua

SEQ ID NO: 40507 - RNA, 19 nt, Homo sapiens
gaacuucaguggaccuuca

SEQ ID NO: 40508 - RNA, 19 nt, Homo sapiens
caucaaaugugcaaacaga

SEQ ID NO: 40509 - RNA, 19 nt, Homo sapiens
ggaaguaggucuccuuagg

SEQ ID NO: 40510 - RNA, 19 nt, Homo sapiens
guacaacuauuucuagcuu

SEQ ID NO: 40511 - RNA, 19 nt, Homo sapiens
gggagauucuuccagguua

SEQ ID NO: 40512 - RNA, 19 nt, Homo sapiens
gaaaguauucuucaggauu

SEQ ID NO: 40513 - RNA, 19 nt, Homo sapiens
gagcgaaacuccaucucaa

SEQ ID NO: 40514 - RNA, 19 nt, Homo sapiens
gaagagagacggaaugaag

SEQ ID NO: 40515 - RNA, 19 nt, Homo sapiens
agaagaaacuggaauaagu

SEQ ID NO: 40516 - RNA, 19 nt, Homo sapiens
ugagauaagucauauagga

SEQ ID NO: 40517 - RNA, 19 nt, Homo sapiens
gacuuuggcugucaacuuu

SEQ ID NO: 40518 - RNA, 19 nt, Homo sapiens
gcacugaccucugugacuu

SEQ ID NO: 40519 - RNA, 19 nt, Homo sapiens
gaaaacagauugaucacuu

SEQ ID NO: 40520 - RNA, 19 nt, Homo sapiens
gcucaaggacaguuucuua

SEQ ID NO: 40521 - RNA, 19 nt, Homo sapiens
gagaaaguaucacucuguu

SEQ ID NO: 40522 - RNA, 19 nt, Homo sapiens
gcucuuauucuaucaguua

SEQ ID NO: 40523 - RNA, 19 nt, Homo sapiens
aaaguauccugcaaguuua

SEQ ID NO: 40524 - RNA, 19 nt, Homo sapiens
ggaaguagaggaaaguauu

SEQ ID NO: 40525 - RNA, 19 nt, Homo sapiens
ggucaaauacuucaucaaa

SEQ ID NO: 40526 - RNA, 19 nt, Homo sapiens
gcauucagauuccaaacaa

SEQ ID NO: 40527 - RNA, 19 nt, Homo sapiens
ggaaaagucuucuaacaga

SEQ ID NO: 40528 - RNA, 19 nt, Homo sapiens
gaggugaaguccauugcua

SEQ ID NO: 40529 - RNA, 19 nt, Homo sapiens
ugaccaagauguuuguaaa

SEQ ID NO: 40530 - RNA, 19 nt, Homo sapiens
guaaagcugcaaugaauuu

SEQ ID NO: 40531 - RNA, 19 nt, Homo sapiens
gcaguaugcuguuugacuu

SEQ ID NO: 40532 - RNA, 19 nt, Homo sapiens
ggacaacucacaaagagaa

SEQ ID NO: 40533 - RNA, 19 nt, Homo sapiens
ucucaaauaugccagagua

SEQ ID NO: 40534 - RNA, 19 nt, Homo sapiens
gcagucagcagaacuugua

SEQ ID NO: 40535 - RNA, 19 nt, Homo sapiens
gaagaagcagaauaacuaa

SEQ ID NO: 40536 - RNA, 19 nt, Homo sapiens
ucaagcaaaugaucaagaa

SEQ ID NO: 40537 - RNA, 19 nt, Homo sapiens
gaaauggacaacucacaaa

SEQ ID NO: 40538 - RNA, 19 nt, Homo sapiens
aaacuuggauucagaguca

SEQ ID NO: 40539 - RNA, 19 nt, Homo sapiens
gaucagaugguggacauua

SEQ ID NO: 40540 - RNA, 19 nt, Homo sapiens
gcugucaacuuucgaauuc

SEQ ID NO: 40541 - RNA, 19 nt, Homo sapiens
agaagaagcagaauaacua

SEQ ID NO: 40542 - RNA, 19 nt, Homo sapiens
caagaucagucacacauag

SEQ ID NO: 40543 - RNA, 19 nt, Homo sapiens
uagaaucaauggaagauga

SEQ ID NO: 40544 - RNA, 19 nt, Homo sapiens
gaaguugcauugugucaag

SEQ ID NO: 40545 - RNA, 19 nt, Homo sapiens
gaccaagaaugcaaacgaa

SEQ ID NO: 40546 - RNA, 19 nt, Homo sapiens
ggauccagcuauuugguuu

SEQ ID NO: 40547 - RNA, 19 nt, Homo sapiens
agcaggagguguaaauuua

SEQ ID NO: 40548 - RNA, 19 nt, Homo sapiens
gaaaucuggugacuauaca

SEQ ID NO: 40549 - RNA, 19 nt, Homo sapiens
gaugggaggccuaggauuu

SEQ ID NO: 40550 - RNA, 19 nt, Homo sapiens
caaagagaauguauuaagg

SEQ ID NO: 40551 - RNA, 19 nt, Homo sapiens
caagcagcauggaggaaua

SEQ ID NO: 40552 - RNA, 19 nt, Homo sapiens
uauccaagauggcaauaaa

SEQ ID NO: 40553 - RNA, 19 nt, Homo sapiens
caaaggccuucuuguauca

SEQ ID NO: 40554 - RNA, 19 nt, Homo sapiens
cuaccaaggucuaugauau

SEQ ID NO: 40555 - RNA, 19 nt, Homo sapiens
ugagaacccugaaacuuug

SEQ ID NO: 40556 - RNA, 19 nt, Homo sapiens
gcaaagcccuaguaacaua

SEQ ID NO: 40557 - RNA, 19 nt, Homo sapiens
gaaacuaguugucaauuug

SEQ ID NO: 40558 - RNA, 19 nt, Homo sapiens
gaaggcauuucucucauua

SEQ ID NO: 40559 - RNA, 19 nt, Homo sapiens
gcagaaacgugcuuagaaa

SEQ ID NO: 40560 - RNA, 19 nt, Homo sapiens
gaacagaggcugcaaauag

SEQ ID NO: 40561 - RNA, 19 nt, Homo sapiens
gcaagcagcugaaacaaau

SEQ ID NO: 40562 - RNA, 19 nt, Homo sapiens
gagaugaauuucugacuaa

SEQ ID NO: 40563 - RNA, 19 nt, Homo sapiens
gguagaagauugugucaaa

SEQ ID NO: 40564 - RNA, 19 nt, Homo sapiens
cagcagaacuuguacauau

SEQ ID NO: 40565 - RNA, 19 nt, Homo sapiens
caagcaagcucuccugaaa

SEQ ID NO: 40566 - RNA, 19 nt, Homo sapiens
gaccugaagucuuauuuaa

SEQ ID NO: 40567 - RNA, 19 nt, Homo sapiens
gaacaucucugcuuucacu

SEQ ID NO: 40568 - RNA, 19 nt, Homo sapiens
gaaacucuguuaaccauug

SEQ ID NO: 40569 - RNA, 19 nt, Homo sapiens
cguaaacgcuucuuaugua

SEQ ID NO: 40570 - RNA, 19 nt, Homo sapiens
ggaagaagcacaaguauuc

SEQ ID NO: 40571 - RNA, 19 nt, Homo sapiens
ggugugaucuucaguauau

SEQ ID NO: 40572 - RNA, 19 nt, Homo sapiens
agacagaauucccaaauaa

SEQ ID NO: 40573 - RNA, 19 nt, Homo sapiens
gaaugcagaugaccaagaa

SEQ ID NO: 40574 - RNA, 19 nt, Homo sapiens
caacaggucuuccagaugu

SEQ ID NO: 40575 - RNA, 19 nt, Homo sapiens
gagacagaauucccaaaua

SEQ ID NO: 40576 - RNA, 19 nt, Homo sapiens
gcagauugaucacuuauuc

SEQ ID NO: 40577 - RNA, 19 nt, Homo sapiens
gaagacaacuggaacuaca

SEQ ID NO: 40578 - RNA, 19 nt, Homo sapiens
uuacguagcuucucccuuu

SEQ ID NO: 40579 - RNA, 19 nt, Homo sapiens
gaaacccugucucuacuaa

SEQ ID NO: 40580 - RNA, 19 nt, Homo sapiens
ccaauuggcugcuagaaug

SEQ ID NO: 40581 - RNA, 19 nt, Homo sapiens
guacaaugcucuacaaucu

SEQ ID NO: 40582 - RNA, 19 nt, Homo sapiens
gagaggagacagcuuguua

SEQ ID NO: 40583 - RNA, 19 nt, Homo sapiens
uaucauggaugugucauua

SEQ ID NO: 40584 - RNA, 19 nt, Homo sapiens
gaaauuugguuggcagaaa

SEQ ID NO: 40585 - RNA, 19 nt, Homo sapiens
gaagugguguucuugaaug

SEQ ID NO: 40586 - RNA, 19 nt, Homo sapiens
acaaacagauacacaguaa

SEQ ID NO: 40587 - RNA, 19 nt, Homo sapiens
uaaggaacaucucugcuuu

SEQ ID NO: 40588 - RNA, 19 nt, Homo sapiens
gaccaugaauccuuugaaa

SEQ ID NO: 40589 - RNA, 19 nt, Homo sapiens
guaaacgcuucuuauguaa

SEQ ID NO: 40590 - RNA, 19 nt, Homo sapiens
gaaggaagccagaguacaa

SEQ ID NO: 40591 - RNA, 19 nt, Homo sapiens
gaagaaggaagccagagua

SEQ ID NO: 40592 - RNA, 19 nt, Homo sapiens
gaacuucaguggaccuuca

SEQ ID NO: 40593 - RNA, 19 nt, Homo sapiens
ggaaguaggucuccuuagg

SEQ ID NO: 40594 - RNA, 19 nt, Homo sapiens
guacaacuauuucuagcuu

SEQ ID NO: 40595 - RNA, 19 nt, Homo sapiens
gagcgaaacuccaucucaa

SEQ ID NO: 40596 - RNA, 19 nt, Homo sapiens
gaagagagacggaaugaag

SEQ ID NO: 40597 - RNA, 19 nt, Homo sapiens
agaagaaacuggaauaagu

SEQ ID NO: 40598 - RNA, 19 nt, Homo sapiens
gcacugaccucugugacuu

SEQ ID NO: 40599 - RNA, 19 nt, Homo sapiens
ccaaauaaagucaagagua

SEQ ID NO: 40600 - RNA, 19 nt, Homo sapiens
ggacaacucacaaagagaa

SEQ ID NO: 40601 - RNA, 19 nt, Homo sapiens
ucucaaauaugccagagua

SEQ ID NO: 40602 - RNA, 19 nt, Homo sapiens
gcagucagcagaacuugua

SEQ ID NO: 40603 - RNA, 19 nt, Homo sapiens
gaagaagcagaauaacuaa

SEQ ID NO: 40604 - RNA, 19 nt, Homo sapiens
ucaagcaaaugaucaagaa

SEQ ID NO: 40605 - RNA, 19 nt, Homo sapiens
gaaauggacaacucacaaa

SEQ ID NO: 40606 - RNA, 19 nt, Homo sapiens
aaacuuggauucagaguca

SEQ ID NO: 40607 - RNA, 19 nt, Homo sapiens
gaucagaugguggacauua

SEQ ID NO: 40608 - RNA, 19 nt, Homo sapiens
agaagaagcagaauaacua

SEQ ID NO: 40609 - RNA, 19 nt, Homo sapiens
caagaucagucacacauag

SEQ ID NO: 40610 - RNA, 19 nt, Homo sapiens
gaccaagaaugcaaacgaa

SEQ ID NO: 40611 - RNA, 19 nt, Homo sapiens
ggauccagcuauuugguuu

SEQ ID NO: 40612 - RNA, 19 nt, Homo sapiens
gaggagcaguuauacauca

SEQ ID NO: 40613 - RNA, 19 nt, Homo sapiens
agcaggagguguaaauuua

SEQ ID NO: 40614 - RNA, 19 nt, Homo sapiens
gaaaucuggugacuauaca

SEQ ID NO: 40615 - RNA, 19 nt, Homo sapiens
gaugggaggccuaggauuu

SEQ ID NO: 40616 - RNA, 19 nt, Homo sapiens
caaagagaauguauuaagg

SEQ ID NO: 40617 - RNA, 19 nt, Homo sapiens
caagcagcauggaggaaua

SEQ ID NO: 40618 - RNA, 19 nt, Homo sapiens
uauccaagauggcaauaaa

SEQ ID NO: 40619 - RNA, 19 nt, Homo sapiens
caaaggccuucuuguauca

SEQ ID NO: 40620 - RNA, 19 nt, Homo sapiens
gaccagaguuucaacaaag

SEQ ID NO: 40621 - RNA, 19 nt, Homo sapiens
guagcuacuucuucuauug

SEQ ID NO: 40622 - RNA, 19 nt, Homo sapiens
gaagagaaauaugaagucu

SEQ ID NO: 40623 - RNA, 19 nt, Homo sapiens
gaaaagagccaaagaggaa

SEQ ID NO: 40624 - RNA, 19 nt, Homo sapiens
agaaguugcuggaaauuau

SEQ ID NO: 40625 - RNA, 19 nt, Homo sapiens
acaacucucugaaguauau

SEQ ID NO: 40626 - RNA, 19 nt, Homo sapiens
ggacagugauuuuaguuuu

SEQ ID NO: 40627 - RNA, 19 nt, Homo sapiens
gcacuuccgucagcaaaga

SEQ ID NO: 40628 - RNA, 19 nt, Homo sapiens
gccaaugugugaagugaaa

SEQ ID NO: 40629 - RNA, 19 nt, Homo sapiens
ggauaaagacacugacuug

SEQ ID NO: 40630 - RNA, 19 nt, Homo sapiens
gaaguggguccuauagauu

SEQ ID NO: 40631 - RNA, 19 nt, Homo sapiens
ccaaaggccuucuuguauc

SEQ ID NO: 40632 - RNA, 19 nt, Homo sapiens
aaacgaaaucucagugaua

SEQ ID NO: 40633 - RNA, 19 nt, Homo sapiens
guaaaguucuguaauugag

SEQ ID NO: 40634 - RNA, 19 nt, Homo sapiens
ccaaacaccuuguagaacu

SEQ ID NO: 40635 - RNA, 19 nt, Homo sapiens
gagcuucacccuacucuga

SEQ ID NO: 40636 - RNA, 19 nt, Homo sapiens
ccauggaagugaugagaaa

SEQ ID NO: 40637 - RNA, 19 nt, Homo sapiens
ugaagauggugcucauaaa

SEQ ID NO: 40638 - RNA, 19 nt, Homo sapiens
gcgaagugguguucuugaa

SEQ ID NO: 40639 - RNA, 19 nt, Homo sapiens
ggagccagauaguuuguau

SEQ ID NO: 40640 - RNA, 19 nt, Homo sapiens
ggacuuguugaaauacuua

SEQ ID NO: 40641 - RNA, 19 nt, Homo sapiens
guauuggacuuguugaaau

SEQ ID NO: 40642 - RNA, 19 nt, Homo sapiens
gccagaagaagcagaauaa

SEQ ID NO: 40643 - RNA, 19 nt, Homo sapiens
gaaguccucaauaaucuaa

SEQ ID NO: 40644 - RNA, 19 nt, Homo sapiens
gauacucaauaccaaagaa

SEQ ID NO: 40645 - RNA, 19 nt, Homo sapiens
agacaacucucugaaguau

SEQ ID NO: 40646 - RNA, 19 nt, Homo sapiens
gguaauauaugccuuuuga

SEQ ID NO: 40647 - RNA, 19 nt, Homo sapiens
agagaugaauuucugacua

SEQ ID NO: 40648 - RNA, 19 nt, Homo sapiens
ggaaauggacaacucacaa

SEQ ID NO: 40649 - RNA, 19 nt, Homo sapiens
ggacucugccauauucuuu

SEQ ID NO: 40650 - RNA, 19 nt, Homo sapiens
uacaggaucuucucuuaga

SEQ ID NO: 40651 - RNA, 19 nt, Homo sapiens
caaacgagccgauccacaa

SEQ ID NO: 40652 - RNA, 19 nt, Homo sapiens
cuacacauguucagggauu

SEQ ID NO: 40653 - RNA, 19 nt, Homo sapiens
guacuuccauacuugauuc

SEQ ID NO: 40654 - RNA, 19 nt, Homo sapiens
ucaccuguuuguuaguuua

SEQ ID NO: 40655 - RNA, 19 nt, Homo sapiens
gaaaauucuucuugccaua

SEQ ID NO: 40656 - RNA, 19 nt, Homo sapiens
gcaagcagcugaaacaaau

SEQ ID NO: 40657 - RNA, 19 nt, Homo sapiens
gaauguugcuuucugaauu

SEQ ID NO: 40658 - RNA, 19 nt, Homo sapiens
gaccugaagucuuauuuaa

SEQ ID NO: 40659 - RNA, 19 nt, Homo sapiens
agacagaauucccaaauaa

SEQ ID NO: 40660 - RNA, 19 nt, Homo sapiens
gcagauugaucacuuauuc

SEQ ID NO: 40661 - RNA, 19 nt, Homo sapiens
gagacagaauucccaaaua

SEQ ID NO: 40662 - RNA, 19 nt, Homo sapiens
caccaugccugacuaauuu

SEQ ID NO: 40663 - RNA, 19 nt, Homo sapiens
gaaauuugguuggcagaaa

SEQ ID NO: 40664 - RNA, 19 nt, Homo sapiens
aggcagagguuacagguua

SEQ ID NO: 40665 - RNA, 19 nt, Homo sapiens
gcacugaccucugugacuu

SEQ ID NO: 40666 - RNA, 19 nt, Homo sapiens
ccaaauaaagucaagagua

SEQ ID NO: 40667 - RNA, 19 nt, Homo sapiens
aaacauagcagaccucguu

SEQ ID NO: 40668 - RNA, 19 nt, Homo sapiens
gaggagcaguuauacauca

SEQ ID NO: 40669 - RNA, 19 nt, Homo sapiens
gcaugcaccuguagucuca

SEQ ID NO: 40670 - RNA, 19 nt, Homo sapiens
gaaaacccaucucuacaaa

SEQ ID NO: 40671 - RNA, 19 nt, Homo sapiens
guaaaguucuguaauugag

SEQ ID NO: 40672 - RNA, 19 nt, Homo sapiens
uagcagaccucguuucuac

SEQ ID NO: 40673 - RNA, 19 nt, Homo sapiens
gguaauauaugccuuuuga

SEQ ID NO: 40674 - RNA, 19 nt, Homo sapiens
ucaccuguuuguuaguuua

SEQ ID NO: 40675 - RNA, 19 nt, Homo sapiens
gaaaauucuucuugccaua

SEQ ID NO: 40676 - RNA, 19 nt, Homo sapiens
gcagaccucguuucuacua

SEQ ID NO: 40677 - RNA, 19 nt, Homo sapiens
caguaaaguucuguaauug

SEQ ID NO: 40678 - RNA, 19 nt, Homo sapiens
auacaucagugggaaauuu

SEQ ID NO: 40679 - RNA, 19 nt, Homo sapiens
ucagauagaggagcaguua

SEQ ID NO: 40680 - RNA, 19 nt, Homo sapiens
caaaagcccugauuccuau

SEQ ID NO: 40681 - RNA, 19 nt, Homo sapiens
uaccaggucauacaacuua

SEQ ID NO: 40682 - RNA, 19 nt, Homo sapiens
uauaucaccuguuuguuag

SEQ ID NO: 40683 - RNA, 19 nt, Homo sapiens
gacagaauucccaaauaaa

SEQ ID NO: 40684 - RNA, 19 nt, Homo sapiens
ccaccaugccugacuaauu

SEQ ID NO: 40685 - RNA, 19 nt, Homo sapiens
ggccuuguuuggcugauuu

SEQ ID NO: 40686 - RNA, 19 nt, Homo sapiens
ugagguagguagauugcuu

SEQ ID NO: 40687 - RNA, 19 nt, Homo sapiens
agauagaggagcaguuaua

SEQ ID NO: 40688 - RNA, 19 nt, Homo sapiens
gauaccagaauguugcuuu

SEQ ID NO: 40689 - RNA, 19 nt, Homo sapiens
uuacaggcaugagcuacua

SEQ ID NO: 40690 - RNA, 19 nt, Homo sapiens
gugguggaguuauugauga

SEQ ID NO: 40691 - RNA, 19 nt, Homo sapiens
cagguuggcugcauagaag

SEQ ID NO: 40692 - RNA, 19 nt, Homo sapiens
caaccaaagguaaauaaca

SEQ ID NO: 40693 - RNA, 19 nt, Homo sapiens
gucuugacguucacagaua

SEQ ID NO: 40694 - RNA, 19 nt, Homo sapiens
gcaaagauugugccacuac

SEQ ID NO: 40695 - RNA, 19 nt, Homo sapiens
uauaagaagcacagaauuc

SEQ ID NO: 40696 - RNA, 19 nt, Homo sapiens
ccuauaaucccagcacuuu

SEQ ID NO: 40697 - RNA, 19 nt, Homo sapiens
uauaagcagucuuucuauc

SEQ ID NO: 40698 - RNA, 19 nt, Homo sapiens
aggaggagcuugggccuuu

SEQ ID NO: 40699 - RNA, 19 nt, Homo sapiens
uuacagucaucgaauacuu

SEQ ID NO: 40700 - RNA, 19 nt, Homo sapiens
caaagauugugccacuaca

SEQ ID NO: 40701 - RNA, 19 nt, Homo sapiens
agacgaagacucacucugu

SEQ ID NO: 40702 - RNA, 19 nt, Homo sapiens
gugauuaaagcaacauuug

SEQ ID NO: 40703 - RNA, 19 nt, Homo sapiens
agaccucguuucuacuaaa

SEQ ID NO: 40704 - RNA, 19 nt, Homo sapiens
ccuccuggguucagauuau

SEQ ID NO: 40705 - RNA, 19 nt, Homo sapiens
cagcugaaacaaauaaugu

SEQ ID NO: 40706 - RNA, 19 nt, Homo sapiens
caaauucuagugccaguca

SEQ ID NO: 40707 - RNA, 19 nt, Homo sapiens
uacaugagccagcaaauuc

SEQ ID NO: 40708 - RNA, 19 nt, Homo sapiens
caaccuauccuguucuuuu

SEQ ID NO: 40709 - RNA, 19 nt, Homo sapiens
uaucaccuguuuguuaguu

SEQ ID NO: 40710 - RNA, 19 nt, Homo sapiens
gaagcacagaauucuuaaa

SEQ ID NO: 40711 - RNA, 19 nt, Homo sapiens
gcagcugaaacaaauaaug

SEQ ID NO: 40712 - RNA, 19 nt, Homo sapiens
ggaguuauugaugacguua

SEQ ID NO: 40713 - RNA, 19 nt, Homo sapiens
uagaggagcaguuauacau

SEQ ID NO: 40714 - RNA, 19 nt, Homo sapiens
cuucgagacguuauuuaua

SEQ ID NO: 40715 - RNA, 19 nt, Homo sapiens
gcaccuguagucucaccua

SEQ ID NO: 40716 - RNA, 19 nt, Homo sapiens
cagagauugugguggaguu

SEQ ID NO: 40717 - RNA, 19 nt, Homo sapiens
ugagcugucuugacguuca

SEQ ID NO: 40718 - RNA, 19 nt, Homo sapiens
uguaaaucuuggacuuuga

SEQ ID NO: 40719 - RNA, 19 nt, Homo sapiens
cuauaucaaccaaagguaa

SEQ ID NO: 40720 - RNA, 19 nt, Homo sapiens
agauugugguggaguuauu

SEQ ID NO: 40721 - RNA, 19 nt, Homo sapiens
gcucaggaggcagagguua

SEQ ID NO: 40722 - RNA, 19 nt, Homo sapiens
gagcuacuaugcccaaccu

SEQ ID NO: 40723 - RNA, 19 nt, Homo sapiens
ugagacagaauucccaaau

SEQ ID NO: 40724 - RNA, 19 nt, Homo sapiens
aagcagcugaaacaaauaa

SEQ ID NO: 40725 - RNA, 19 nt, Homo sapiens
gcaugugauuaaagcaaca

SEQ ID NO: 40726 - RNA, 19 nt, Homo sapiens
caucgcaugugauuaaagc

SEQ ID NO: 40727 - RNA, 19 nt, Homo sapiens
ucuacagguuggcugcaua

SEQ ID NO: 40728 - RNA, 19 nt, Homo sapiens
cagaccucguuucuacuaa

SEQ ID NO: 40729 - RNA, 19 nt, Homo sapiens
cuacuugccugggaaacau

SEQ ID NO: 40730 - RNA, 19 nt, Homo sapiens
uauaugcuucuaagaggua

SEQ ID NO: 40731 - RNA, 19 nt, Homo sapiens
gcuacuaugcccaaccuau

SEQ ID NO: 40732 - RNA, 19 nt, Homo sapiens
ggaggagcuugggccuuug

SEQ ID NO: 40733 - RNA, 19 nt, Homo sapiens
ugagcaagcagcugaaaca

SEQ ID NO: 40734 - RNA, 19 nt, Homo sapiens
gcuccuaauccaccucauu

SEQ ID NO: 40735 - RNA, 19 nt, Homo sapiens
uuacaugagccagcaaauu

SEQ ID NO: 40736 - RNA, 19 nt, Homo sapiens
ggaaauuugguuggcagaa

SEQ ID NO: 40737 - RNA, 19 nt, Homo sapiens
ggauuacaggcaugagcua

SEQ ID NO: 40738 - RNA, 19 nt, Homo sapiens
aaauucuucuugccauaug

SEQ ID NO: 40739 - RNA, 19 nt, Homo sapiens
ccaaaagcccugauuccua

SEQ ID NO: 40740 - RNA, 19 nt, Homo sapiens
cuugcagauugaucacuua

SEQ ID NO: 40741 - RNA, 19 nt, Homo sapiens
uuugugcccuugcagauug

SEQ ID NO: 40742 - RNA, 19 nt, Homo sapiens
uuacagugagcaaagauug

SEQ ID NO: 40743 - RNA, 19 nt, Homo sapiens
gcuugggccuuuguucuuc

SEQ ID NO: 40744 - RNA, 19 nt, Homo sapiens
gagcuugggccuuuguucu

SEQ ID NO: 40745 - RNA, 19 nt, Homo sapiens
caagcagcugaaacaaaua

SEQ ID NO: 40746 - RNA, 19 nt, Homo sapiens
uuccaucgcaugugauuaa

SEQ ID NO: 40747 - RNA, 19 nt, Homo sapiens
cagaauucccaaauaaagu

SEQ ID NO: 40748 - RNA, 19 nt, Homo sapiens
gauagaggagcaguuauac

SEQ ID NO: 40749 - RNA, 19 nt, Homo sapiens
gagcaagcagcugaaacaa

SEQ ID NO: 40750 - RNA, 19 nt, Homo sapiens
acagaauucccaaauaaag

SEQ ID NO: 40751 - RNA, 19 nt, Homo sapiens
guagcucacaccuauaauc

SEQ ID NO: 40752 - RNA, 19 nt, Homo sapiens
ugguagcucacaccuauaa

SEQ ID NO: 40753 - RNA, 19 nt, Homo sapiens
gggcucaagcgaacuguca

SEQ ID NO: 40754 - RNA, 19 nt, Homo sapiens
gcaauugucauaaaaccaa

SEQ ID NO: 40755 - RNA, 19 nt, Homo sapiens
auaccaccaugccugacua

SEQ ID NO: 40756 - RNA, 19 nt, Homo sapiens
gaagagaacuugucauuac

SEQ ID NO: 40757 - RNA, 19 nt, Homo sapiens
gacaagcaguuauaaguua

SEQ ID NO: 40758 - RNA, 19 nt, Homo sapiens
caucagaccucuuccauuu

SEQ ID NO: 40759 - RNA, 19 nt, Homo sapiens
ggaaggaggugauugucua

SEQ ID NO: 40760 - RNA, 19 nt, Homo sapiens
ggacaaagacaaagacaaa

SEQ ID NO: 40761 - RNA, 19 nt, Homo sapiens
gcgaacaccucacuauuga

SEQ ID NO: 40762 - RNA, 19 nt, Homo sapiens
ccagaaagcuucccugcaa

SEQ ID NO: 40763 - RNA, 19 nt, Homo sapiens
gaacacaacaucuaccauu

SEQ ID NO: 40764 - RNA, 19 nt, Homo sapiens
gagauaacauccuacauca

SEQ ID NO: 40765 - RNA, 19 nt, Homo sapiens
gguccaagcuggccaagaa

SEQ ID NO: 40766 - RNA, 19 nt, Homo sapiens
caagggagauccuggaguu

SEQ ID NO: 40767 - RNA, 19 nt, Homo sapiens
ccgaaacccucaccagaua

SEQ ID NO: 40768 - RNA, 19 nt, Homo sapiens
ggaggucucuucugccauu

SEQ ID NO: 40769 - RNA, 19 nt, Homo sapiens
gggagaagguggccucuga

SEQ ID NO: 40770 - RNA, 19 nt, Homo sapiens
gagaugagcuacccugaca

SEQ ID NO: 40771 - RNA, 19 nt, Homo sapiens
gaaggcacguggcgaauca

SEQ ID NO: 40772 - RNA, 19 nt, Homo sapiens
ccaaagggauguguuagaa

SEQ ID NO: 40773 - RNA, 19 nt, Homo sapiens
gaaaggaauuguggccauu

SEQ ID NO: 40774 - RNA, 19 nt, Homo sapiens
ggaagagaacuugucauua

SEQ ID NO: 40775 - RNA, 19 nt, Homo sapiens
gaagaguugcugauaguuu

SEQ ID NO: 40776 - RNA, 19 nt, Homo sapiens
cugauuacguugacacuua

SEQ ID NO: 40777 - RNA, 19 nt, Homo sapiens
gaaccgagagcucuucauu

SEQ ID NO: 40778 - RNA, 19 nt, Homo sapiens
caagucaggaagauuauua

SEQ ID NO: 40779 - RNA, 19 nt, Homo sapiens
caagagagagugagaauuc

SEQ ID NO: 40780 - RNA, 19 nt, Homo sapiens
gcaccucacccaucaauga

SEQ ID NO: 40781 - RNA, 19 nt, Homo sapiens
gcugauaguuugaucuaga

SEQ ID NO: 40782 - RNA, 19 nt, Homo sapiens
gagagagccugcccucguu

SEQ ID NO: 40783 - RNA, 19 nt, Homo sapiens
gaagaaagaaggugacaag

SEQ ID NO: 40784 - RNA, 19 nt, Homo sapiens
gcauccacuucaagaaaua

SEQ ID NO: 40785 - RNA, 19 nt, Homo sapiens
caaggaggcugaacaguac

SEQ ID NO: 40786 - RNA, 19 nt, Homo sapiens
cgaagaagaauaagaagaa

SEQ ID NO: 40787 - RNA, 19 nt, Homo sapiens
gaagauuuguggagagcuu

SEQ ID NO: 40788 - RNA, 19 nt, Homo sapiens
gaacaccucacuauugaug

SEQ ID NO: 40789 - RNA, 19 nt, Homo sapiens
gaauuguggccauuugaua

SEQ ID NO: 40790 - RNA, 19 nt, Homo sapiens
caucuaccauucaguuaaa

SEQ ID NO: 40791 - RNA, 19 nt, Homo sapiens
uaacucagcacacaaguga

SEQ ID NO: 40792 - RNA, 19 nt, Homo sapiens
gggagaacauccugcuuug

SEQ ID NO: 40793 - RNA, 19 nt, Homo sapiens
ccacgaagaagaauaagaa

SEQ ID NO: 40794 - RNA, 19 nt, Homo sapiens
caacaucuaccauucaguu

SEQ ID NO: 40795 - RNA, 19 nt, Homo sapiens
ucaggaagauuauuacagu

SEQ ID NO: 40796 - RNA, 19 nt, Homo sapiens
gcaggaagaguugcugaua

SEQ ID NO: 40797 - RNA, 19 nt, Homo sapiens
gccaguaccuccagcaaug

SEQ ID NO: 40798 - RNA, 19 nt, Homo sapiens
ugacauauuugcugcuaga

SEQ ID NO: 40799 - RNA, 19 nt, Homo sapiens
ucaugaacgucaaauggua

SEQ ID NO: 40800 - RNA, 19 nt, Homo sapiens
gcgcgaggcugagcagaaa

SEQ ID NO: 40801 - RNA, 19 nt, Homo sapiens
agacaaagacaaagacaaa

SEQ ID NO: 40802 - RNA, 19 nt, Homo sapiens
acaaauaacucagcacaca

SEQ ID NO: 40803 - RNA, 19 nt, Homo sapiens
ccacaugccuggccucuac

SEQ ID NO: 40804 - RNA, 19 nt, Homo sapiens
gcaugaaggucgccucagu

SEQ ID NO: 40805 - RNA, 19 nt, Homo sapiens
gagaagguggccucugaua

SEQ ID NO: 40806 - RNA, 19 nt, Homo sapiens
gagcugaucaccuucuauu

SEQ ID NO: 40807 - RNA, 19 nt, Homo sapiens
gauauaacccugagacaag

SEQ ID NO: 40808 - RNA, 19 nt, Homo sapiens
ccaggagacuguguguaua

SEQ ID NO: 40809 - RNA, 19 nt, Homo sapiens
gggauccacuuacagagaa

SEQ ID NO: 40810 - RNA, 19 nt, Homo sapiens
ggacugaacauccagaaag

SEQ ID NO: 40811 - RNA, 19 nt, Homo sapiens
ggucgcaccucacccauca

SEQ ID NO: 40812 - RNA, 19 nt, Homo sapiens
acaaggaggcugaacagua

SEQ ID NO: 40813 - RNA, 19 nt, Homo sapiens
gagaacuugucauuacaga

SEQ ID NO: 40814 - RNA, 19 nt, Homo sapiens
gaaaagagacaaagcaaga

SEQ ID NO: 40815 - RNA, 19 nt, Homo sapiens
guucaaacccgucaaggaa

SEQ ID NO: 40816 - RNA, 19 nt, Homo sapiens
cgagagcucuucauuucug

SEQ ID NO: 40817 - RNA, 19 nt, Homo sapiens
caccagcacucucacauuc

SEQ ID NO: 40818 - RNA, 19 nt, Homo sapiens
gaaacccucaccagauaaa

SEQ ID NO: 40819 - RNA, 19 nt, Homo sapiens
gaauuccuaccaacuauug

SEQ ID NO: 40820 - RNA, 19 nt, Homo sapiens
ccagccaugucacuaauug

SEQ ID NO: 40821 - RNA, 19 nt, Homo sapiens
aagcuucccugcaaucuug

SEQ ID NO: 40822 - RNA, 19 nt, Homo sapiens
acugugaccuccuuaugua

SEQ ID NO: 40823 - RNA, 19 nt, Homo sapiens
gggaccaucuccucaugaa

SEQ ID NO: 40824 - RNA, 19 nt, Homo sapiens
ggccaaacacaccguauuu

SEQ ID NO: 40825 - RNA, 19 nt, Homo sapiens
uaccaagucaggaagauua

SEQ ID NO: 40826 - RNA, 19 nt, Homo sapiens
gaagaagucggccaagaag

SEQ ID NO: 40827 - RNA, 19 nt, Homo sapiens
caaggagcauggcggcauu

SEQ ID NO: 40828 - RNA, 19 nt, Homo sapiens
uaacgacugugaccuccuu

SEQ ID NO: 40829 - RNA, 19 nt, Homo sapiens
cauccuacaucacugaaga

SEQ ID NO: 40830 - RNA, 19 nt, Homo sapiens
cagaauacagaguugauuu

SEQ ID NO: 40831 - RNA, 19 nt, Homo sapiens
gugaauuccuaccaacuau

SEQ ID NO: 40832 - RNA, 19 nt, Homo sapiens
gggaggaggccauugagaa

SEQ ID NO: 40833 - RNA, 19 nt, Homo sapiens
ucaaacccgucaaggaaga

SEQ ID NO: 40834 - RNA, 19 nt, Homo sapiens
gauaacauccuacaucacu

SEQ ID NO: 40835 - RNA, 19 nt, Homo sapiens
gacagauaccggugagaua

SEQ ID NO: 40836 - RNA, 19 nt, Homo sapiens
ccacuuacagagaagauuu

SEQ ID NO: 40837 - RNA, 19 nt, Homo sapiens
aaucgugacuucuguguuc

SEQ ID NO: 40838 - RNA, 19 nt, Homo sapiens
aagaguugcugauaguuug

SEQ ID NO: 40839 - RNA, 19 nt, Homo sapiens
cagcgagcauccaggguuu

SEQ ID NO: 40840 - RNA, 19 nt, Homo sapiens
cagcuagguucuacaaaca

SEQ ID NO: 40841 - RNA, 19 nt, Homo sapiens
ugaagaagucggccaagaa

SEQ ID NO: 40842 - RNA, 19 nt, Homo sapiens
ggagggagccuagguucaa

SEQ ID NO: 40843 - RNA, 19 nt, Homo sapiens
cgaggacaaugacaacaau

SEQ ID NO: 40844 - RNA, 19 nt, Homo sapiens
ggaccgagagagagagaaa

SEQ ID NO: 40845 - RNA, 19 nt, Homo sapiens
gcgaacggcugagauucuu

SEQ ID NO: 40846 - RNA, 19 nt, Homo sapiens
aggcaaagcugacaugaac

SEQ ID NO: 40847 - RNA, 19 nt, Homo sapiens
gagaacauccugcuuugca

SEQ ID NO: 40848 - RNA, 19 nt, Homo sapiens
uuaagggacucaggcagua

SEQ ID NO: 40849 - RNA, 19 nt, Homo sapiens
ggauauaacccugagacaa

SEQ ID NO: 40850 - RNA, 19 nt, Homo sapiens
aguguaacaucucccauuu

SEQ ID NO: 40851 - RNA, 19 nt, Homo sapiens
ccaaacacaccguauuuca

SEQ ID NO: 40852 - RNA, 19 nt, Homo sapiens
gugaagacgaggacaauga

SEQ ID NO: 40853 - RNA, 19 nt, Homo sapiens
ggucccaucccaagaauug

SEQ ID NO: 40854 - RNA, 19 nt, Homo sapiens
ugacaagcaguuauaaguu

SEQ ID NO: 40855 - RNA, 19 nt, Homo sapiens
aagaugacuucgacaguga

SEQ ID NO: 40856 - RNA, 19 nt, Homo sapiens
acaagaagcuguccaaaua

SEQ ID NO: 40857 - RNA, 19 nt, Homo sapiens
gaccagcugcgcaauguua

SEQ ID NO: 40858 - RNA, 19 nt, Homo sapiens
gggcugaagugaaggaguu

SEQ ID NO: 40859 - RNA, 19 nt, Homo sapiens
gcaauguuaucccgucguu

SEQ ID NO: 40860 - RNA, 19 nt, Homo sapiens
gcucugcacuucucgacuu

SEQ ID NO: 40861 - RNA, 19 nt, Homo sapiens
cgagagagcaucccgucua

SEQ ID NO: 40862 - RNA, 19 nt, Homo sapiens
aagaagcuguccaaauaug

SEQ ID NO: 40863 - RNA, 19 nt, Homo sapiens
gagagagcaucccgucuac

SEQ ID NO: 40864 - RNA, 19 nt, Homo sapiens
caagaagcuguccaaauau

SEQ ID NO: 40865 - RNA, 19 nt, Homo sapiens
gcuggacgcucugcacuuc

SEQ ID NO: 40866 - RNA, 19 nt, Homo sapiens
agagugggcugaagugaag

SEQ ID NO: 40867 - RNA, 19 nt, Homo sapiens
caacuuugcaggcgagaga

SEQ ID NO: 40868 - RNA, 19 nt, Homo sapiens
gcagaagagugggcugaag

SEQ ID NO: 40869 - RNA, 19 nt, Homo sapiens
gaagagugggcugaaguga

SEQ ID NO: 40870 - RNA, 19 nt, Homo sapiens
gcccaguauuugcuacauu

SEQ ID NO: 40871 - RNA, 19 nt, Homo sapiens
cccaguauuugcuacauuc

SEQ ID NO: 40872 - RNA, 19 nt, Homo sapiens
acucggaugaggcaaguua

SEQ ID NO: 40873 - RNA, 19 nt, Homo sapiens
uguccgagcugcuacaaac

SEQ ID NO: 40874 - RNA, 19 nt, Homo sapiens
gaggaaaacagcaaaacuu

SEQ ID NO: 40875 - RNA, 19 nt, Homo sapiens
gaagcuguccaaauaugag

SEQ ID NO: 40876 - RNA, 19 nt, Homo sapiens
aauaugagacccugcagau

SEQ ID NO: 40877 - RNA, 19 nt, Homo sapiens
ccagcaaacaggugaaugg

SEQ ID NO: 40878 - RNA, 19 nt, Homo sapiens
cagaagagugggcugaagu

SEQ ID NO: 40879 - RNA, 19 nt, Homo sapiens
guucaacaacgacaagaag

SEQ ID NO: 40880 - RNA, 19 nt, Homo sapiens
guuaucccgucguucaaca

SEQ ID NO: 40881 - RNA, 19 nt, Homo sapiens
ucgaccagcugcgcaaugu

SEQ ID NO: 40882 - RNA, 19 nt, Homo sapiens
gaugauggcgcaaaagaau

SEQ ID NO: 40883 - RNA, 19 nt, Homo sapiens
ucgccucggucccacagaa

SEQ ID NO: 40884 - RNA, 19 nt, Homo sapiens
agaagcuguccaaauauga

SEQ ID NO: 40885 - RNA, 19 nt, Homo sapiens
aauguuaucccgucguuca

SEQ ID NO: 40886 - RNA, 19 nt, Homo sapiens
ugacucggaugaggcaagu

SEQ ID NO: 40887 - RNA, 19 nt, Homo sapiens
ggaguugggagaccaccau

SEQ ID NO: 40888 - RNA, 19 nt, Homo sapiens
cuggcuggcucccacuuug

SEQ ID NO: 40889 - RNA, 19 nt, Homo sapiens
ggaguuaaguaugacauug

SEQ ID NO: 40890 - RNA, 19 nt, Homo sapiens
acaagaaggucugcauuga

SEQ ID NO: 40891 - RNA, 19 nt, Homo sapiens
aagaaggucugcauugaau

SEQ ID NO: 40892 - RNA, 19 nt, Homo sapiens
ucucucggguccucaauaa

SEQ ID NO: 40893 - RNA, 19 nt, Homo sapiens
caagaaggucugcauugaa

SEQ ID NO: 40894 - RNA, 19 nt, Homo sapiens
caacaagaaggucugcauu

SEQ ID NO: 40895 - RNA, 19 nt, Homo sapiens
caauaagcuuggaggaguu

SEQ ID NO: 40896 - RNA, 19 nt, Homo sapiens
acauugaccugcccaacaa

SEQ ID NO: 40897 - RNA, 19 nt, Homo sapiens
cgaguucucuguggacaug

SEQ ID NO: 40898 - RNA, 19 nt, Homo sapiens
gaguuaaguaugacauuga

SEQ ID NO: 40899 - RNA, 19 nt, Homo sapiens
gacccucaguuguccuauu

SEQ ID NO: 40900 - RNA, 19 nt, Homo sapiens
uuggaggaguuaaguauga

SEQ ID NO: 40901 - RNA, 19 nt, Homo sapiens
uagcuucccugcaauaaaa

SEQ ID NO: 40902 - RNA, 19 nt, Homo sapiens
gaaggucugcauugaaucu

SEQ ID NO: 40903 - RNA, 19 nt, Homo sapiens
cuuccuagcuucccugcaa

SEQ ID NO: 40904 - RNA, 19 nt, Homo sapiens
gcggagacccucaguuguc

SEQ ID NO: 40905 - RNA, 19 nt, Homo sapiens
gacauugaccugcccaaca

SEQ ID NO: 40906 - RNA, 19 nt, Homo sapiens
gcuuggaggaguuaaguau

SEQ ID NO: 40907 - RNA, 19 nt, Homo sapiens
guuguccuauuccuuccua

SEQ ID NO: 40908 - RNA, 19 nt, Homo sapiens
gaagaaaacaggaaagacu

SEQ ID NO: 40909 - RNA, 19 nt, Homo sapiens
aaagacuguuuccuaccuu

SEQ ID NO: 40910 - RNA, 19 nt, Homo sapiens
gagacccucaguuguccua

SEQ ID NO: 40911 - RNA, 19 nt, Homo sapiens
cugcggagacccucaguug

SEQ ID NO: 40912 - RNA, 19 nt, Homo sapiens
aacaagaaggucugcauug

SEQ ID NO: 40913 - RNA, 19 nt, Homo sapiens
cgaagcacgaguucucugu

SEQ ID NO: 40914 - RNA, 19 nt, Homo sapiens
acccucaguuguccuauuc

SEQ ID NO: 40915 - RNA, 19 nt, Homo sapiens
gcagucaugccgggugaug

SEQ ID NO: 40916 - RNA, 19 nt, Homo sapiens
aauaagcuuggaggaguua

SEQ ID NO: 40917 - RNA, 19 nt, Homo sapiens
gcuugcaacccugaagaaa

SEQ ID NO: 40918 - RNA, 19 nt, Homo sapiens
ccucagucaugccgaagca

SEQ ID NO: 40919 - RNA, 19 nt, Homo sapiens
ccaacaagaaggucugcau

SEQ ID NO: 40920 - RNA, 19 nt, Homo sapiens
gauaaucugugcuuuguug

SEQ ID NO: 40921 - RNA, 19 nt, Homo sapiens
gcuuauaccuuaaccagua

SEQ ID NO: 40922 - RNA, 19 nt, Homo sapiens
cggaaagacugaaagaaua

SEQ ID NO: 40923 - RNA, 19 nt, Homo sapiens
ggacauggaugaacugaag

SEQ ID NO: 40924 - RNA, 19 nt, Homo sapiens
gaagaaauccauugcuuau

SEQ ID NO: 40925 - RNA, 19 nt, Homo sapiens
gaaggaaaccuacuauuag

SEQ ID NO: 40926 - RNA, 19 nt, Homo sapiens
gcaagcugcugacaugauu

SEQ ID NO: 40927 - RNA, 19 nt, Homo sapiens
agaaggaaaccuacuauua

SEQ ID NO: 40928 - RNA, 19 nt, Homo sapiens
gaaugacucuccagcuuug

SEQ ID NO: 40929 - RNA, 19 nt, Homo sapiens
gcaaugagaccguggaaga

SEQ ID NO: 40930 - RNA, 19 nt, Homo sapiens
gaauuaaggucaucauggu

SEQ ID NO: 40931 - RNA, 19 nt, Homo sapiens
gaggaacauugccuucuuu

SEQ ID NO: 40932 - RNA, 19 nt, Homo sapiens
guucaaagaucauggaauc

SEQ ID NO: 40933 - RNA, 19 nt, Homo sapiens
cauccaagcugcuacagaa

SEQ ID NO: 40934 - RNA, 19 nt, Homo sapiens
gaauuucccuaucgauaau

SEQ ID NO: 40935 - RNA, 19 nt, Homo sapiens
gagaacgaguccuagguuu

SEQ ID NO: 40936 - RNA, 19 nt, Homo sapiens
uggaugaacugaagaaaga

SEQ ID NO: 40937 - RNA, 19 nt, Homo sapiens
guacuucagucuuggaguu

SEQ ID NO: 40938 - RNA, 19 nt, Homo sapiens
gaucauggaauccuucaaa

SEQ ID NO: 40939 - RNA, 19 nt, Homo sapiens
ggaaagcaccgcagcaugu

SEQ ID NO: 40940 - RNA, 19 nt, Homo sapiens
gaaguaccacacugagaua

SEQ ID NO: 40941 - RNA, 19 nt, Homo sapiens
gaaaaccuaccuauucuua

SEQ ID NO: 40942 - RNA, 19 nt, Homo sapiens
ugacaacuuugccucaauu

SEQ ID NO: 40943 - RNA, 19 nt, Homo sapiens
gcucagauguguccaagca

SEQ ID NO: 40944 - RNA, 19 nt, Homo sapiens
gcagugaucuaaaggacau

SEQ ID NO: 40945 - RNA, 19 nt, Homo sapiens
gaagcaagacguccuggaa

SEQ ID NO: 40946 - RNA, 19 nt, Homo sapiens
gaacuucaucguaaauaug

SEQ ID NO: 40947 - RNA, 19 nt, Homo sapiens
gaagagacagcccagaaau

SEQ ID NO: 40948 - RNA, 19 nt, Homo sapiens
ugaagaaauccauugcuua

SEQ ID NO: 40949 - RNA, 19 nt, Homo sapiens
ggaaggucgucugaucuuu

SEQ ID NO: 40950 - RNA, 19 nt, Homo sapiens
gaaggcaccgcacguggua

SEQ ID NO: 40951 - RNA, 19 nt, Homo sapiens
agaaauccauugcuuauac

SEQ ID NO: 40952 - RNA, 19 nt, Homo sapiens
ccucaucgguaucaucgua

SEQ ID NO: 40953 - RNA, 19 nt, Homo sapiens
gauucgaaauggugagaaa

SEQ ID NO: 40954 - RNA, 19 nt, Homo sapiens
gggaagaauugccacacuu

SEQ ID NO: 40955 - RNA, 19 nt, Homo sapiens
ggaauggguguugcucuua

SEQ ID NO: 40956 - RNA, 19 nt, Homo sapiens
gaacggcuuccucccaauu

SEQ ID NO: 40957 - RNA, 19 nt, Homo sapiens
gugaaugacucuccagcuu

SEQ ID NO: 40958 - RNA, 19 nt, Homo sapiens
gaugaacaguuuccugaag

SEQ ID NO: 40959 - RNA, 19 nt, Homo sapiens
gggcaguguuucaggcuaa

SEQ ID NO: 40960 - RNA, 19 nt, Homo sapiens
gaauugcaggucuuuguaa

SEQ ID NO: 40961 - RNA, 19 nt, Homo sapiens
gcuaucagccguuguaauc

SEQ ID NO: 40962 - RNA, 19 nt, Homo sapiens
gaaggucgucugaucuuug

SEQ ID NO: 40963 - RNA, 19 nt, Homo sapiens
cagcagaagcucaucauug

SEQ ID NO: 40964 - RNA, 19 nt, Homo sapiens
ugaauuucccuaucgauaa

SEQ ID NO: 40965 - RNA, 19 nt, Homo sapiens
ccaaacgcauggcaaggaa

SEQ ID NO: 40966 - RNA, 19 nt, Homo sapiens
gcuugaggcugucaucuuc

SEQ ID NO: 40967 - RNA, 19 nt, Homo sapiens
ggaagaauugccacacuug

SEQ ID NO: 40968 - RNA, 19 nt, Homo sapiens
gguuggacgugauaaguau

SEQ ID NO: 40969 - RNA, 19 nt, Homo sapiens
gaauggguguugcucuuag

SEQ ID NO: 40970 - RNA, 19 nt, Homo sapiens
uaccaguugucuauucaua

SEQ ID NO: 40971 - RNA, 19 nt, Homo sapiens
gacuaggucuccagauuuc

SEQ ID NO: 40972 - RNA, 19 nt, Homo sapiens
caaagaucauggaauccuu

SEQ ID NO: 40973 - RNA, 19 nt, Homo sapiens
ccaucucccuggcuuauga

SEQ ID NO: 40974 - RNA, 19 nt, Homo sapiens
guacacggcagugaucuaa

SEQ ID NO: 40975 - RNA, 19 nt, Homo sapiens
acacugacgaugugaauuu

SEQ ID NO: 40976 - RNA, 19 nt, Homo sapiens
ggagaacgaguccuagguu

SEQ ID NO: 40977 - RNA, 19 nt, Homo sapiens
aaaccuaccuauucuuaag

SEQ ID NO: 40978 - RNA, 19 nt, Homo sapiens
gcacugugaugggaagaau

SEQ ID NO: 40979 - RNA, 19 nt, Homo sapiens
gaacauugccuucuuuuca

SEQ ID NO: 40980 - RNA, 19 nt, Homo sapiens
cgaggaacauugccuucuu

SEQ ID NO: 40981 - RNA, 19 nt, Homo sapiens
gcaagacguccuggaauga

SEQ ID NO: 40982 - RNA, 19 nt, Homo sapiens
ugggaggcuucuuuacuua

SEQ ID NO: 40983 - RNA, 19 nt, Homo sapiens
caacuuugccucaauugug

SEQ ID NO: 40984 - RNA, 19 nt, Homo sapiens
ccaaugugccggaagguuu

SEQ ID NO: 40985 - RNA, 19 nt, Homo sapiens
gcuaaaaguucaaagauca

SEQ ID NO: 40986 - RNA, 19 nt, Homo sapiens
ggagaaggaaaccuacuau

SEQ ID NO: 40987 - RNA, 19 nt, Homo sapiens
gagagugacaucaugaaga

SEQ ID NO: 40988 - RNA, 19 nt, Homo sapiens
ccaguaacauucccgagau

SEQ ID NO: 40989 - RNA, 19 nt, Homo sapiens
gaugacaacuuugccucaa

SEQ ID NO: 40990 - RNA, 19 nt, Homo sapiens
uuggagcgauucuuuguuu

SEQ ID NO: 40991 - RNA, 19 nt, Homo sapiens
cuugauauuuggccucuuu

SEQ ID NO: 40992 - RNA, 19 nt, Homo sapiens
gaucaacgauguggaagac

SEQ ID NO: 40993 - RNA, 19 nt, Homo sapiens
auccauugcuuauaccuua

SEQ ID NO: 40994 - RNA, 19 nt, Homo sapiens
gaucuuugauaacuugaag

SEQ ID NO: 40995 - RNA, 19 nt, Homo sapiens
gugaauuucccuaucgaua

SEQ ID NO: 40996 - RNA, 19 nt, Homo sapiens
gagagaaagauacgccaaa

SEQ ID NO: 40997 - RNA, 19 nt, Homo sapiens
ugaaggagaugagagaaag

SEQ ID NO: 40998 - RNA, 19 nt, Homo sapiens
gagaaggaaaccuacuauu

SEQ ID NO: 40999 - RNA, 19 nt, Homo sapiens
cuaaagcuauugccaaagg

SEQ ID NO: 41000 - RNA, 19 nt, Homo sapiens
ucaaauccaugaagcugau

SEQ ID NO: 41001 - RNA, 19 nt, Homo sapiens
ggaaagacugaaagaauac

SEQ ID NO: 41002 - RNA, 19 nt, Homo sapiens
gaacacccggaaagacuga

SEQ ID NO: 41003 - RNA, 19 nt, Homo sapiens
gauauuuggccucuuugaa

SEQ ID NO: 41004 - RNA, 19 nt, Homo sapiens
gggcagcaguggaccuaug

SEQ ID NO: 41005 - RNA, 19 nt, Homo sapiens
gcauugacuugggcacuga

SEQ ID NO: 41006 - RNA, 19 nt, Homo sapiens
ggucgucugaucuuugaua

SEQ ID NO: 41007 - RNA, 19 nt, Homo sapiens
gaugugaauuucccuaucg

SEQ ID NO: 41008 - RNA, 19 nt, Homo sapiens
agaggaaggucgucugauc

SEQ ID NO: 41009 - RNA, 19 nt, Homo sapiens
ugacaugauucuucuggau

SEQ ID NO: 41010 - RNA, 19 nt, Homo sapiens
agcagaagcucaucauugu

SEQ ID NO: 41011 - RNA, 19 nt, Homo sapiens
ccugaaggguuccaguuug

SEQ ID NO: 41012 - RNA, 19 nt, Homo sapiens
gaacgaguccuagguuucu

SEQ ID NO: 41013 - RNA, 19 nt, Homo sapiens
ccaguugucuauucauaag

SEQ ID NO: 41014 - RNA, 19 nt, Homo sapiens
agaaucauaucugcaaaug

SEQ ID NO: 41015 - RNA, 19 nt, Homo sapiens
gagcgauucuuuguuucuu

SEQ ID NO: 41016 - RNA, 19 nt, Homo sapiens
guaaauauggaacagacuu

SEQ ID NO: 41017 - RNA, 19 nt, Homo sapiens
gccugcagcuguuucagaa

SEQ ID NO: 41018 - RNA, 19 nt, Homo sapiens
guaugagccugcagcuguu

SEQ ID NO: 41019 - RNA, 19 nt, Homo sapiens
guaccuggguguggugcua

SEQ ID NO: 41020 - RNA, 19 nt, Homo sapiens
gagcugagaucgugccauu

SEQ ID NO: 41021 - RNA, 19 nt, Homo sapiens
ugacaugagucuccagaua

SEQ ID NO: 41022 - RNA, 19 nt, Homo sapiens
gccaagagcuccaagauca

SEQ ID NO: 41023 - RNA, 19 nt, Homo sapiens
caaaggcugucauuucauu

SEQ ID NO: 41024 - RNA, 19 nt, Homo sapiens
gcacacgccuguaaucuca

SEQ ID NO: 41025 - RNA, 19 nt, Homo sapiens
gaaacccugucucuacuaa

SEQ ID NO: 41026 - RNA, 19 nt, Homo sapiens
gagagaagaugcagaucaa

SEQ ID NO: 41027 - RNA, 19 nt, Homo sapiens
gaacccaucuaaaccagaa

SEQ ID NO: 41028 - RNA, 19 nt, Homo sapiens
ggaaauaacggguggcauu

SEQ ID NO: 41029 - RNA, 19 nt, Homo sapiens
ggaauguccuguagagaga

SEQ ID NO: 41030 - RNA, 19 nt, Homo sapiens
gaucauggauuccuucaag

SEQ ID NO: 41031 - RNA, 19 nt, Homo sapiens
gaagugagguagugccaau

SEQ ID NO: 41032 - RNA, 19 nt, Homo sapiens
gaaggaagcccucucagau

SEQ ID NO: 41033 - RNA, 19 nt, Homo sapiens
cggacaagcuggugaauga

SEQ ID NO: 41034 - RNA, 19 nt, Homo sapiens
gaacauggucagaaccuuu

SEQ ID NO: 41035 - RNA, 19 nt, Homo sapiens
caacaaaggaagugaggua

SEQ ID NO: 41036 - RNA, 19 nt, Homo sapiens
gcagugggcugaccucauc

SEQ ID NO: 41037 - RNA, 19 nt, Homo sapiens
gaaucaggguggagaaguu

SEQ ID NO: 41038 - RNA, 19 nt, Homo sapiens
ggaugucacucauguacuu

SEQ ID NO: 41039 - RNA, 19 nt, Homo sapiens
ggacaggaguggaccuaug

SEQ ID NO: 41040 - RNA, 19 nt, Homo sapiens
gaaggagacauacuacuga

SEQ ID NO: 41041 - RNA, 19 nt, Homo sapiens
gcacuggaauuuugcuuua

SEQ ID NO: 41042 - RNA, 19 nt, Homo sapiens
ggaguucgcuggccauugg

SEQ ID NO: 41043 - RNA, 19 nt, Homo sapiens
gaaaucucuuccauaauuc

SEQ ID NO: 41044 - RNA, 19 nt, Homo sapiens
gcacggcucugaccugaag

SEQ ID NO: 41045 - RNA, 19 nt, Homo sapiens
ggacggcccugucucgaau

SEQ ID NO: 41046 - RNA, 19 nt, Homo sapiens
guagagagagaccuagaua

SEQ ID NO: 41047 - RNA, 19 nt, Homo sapiens
ggagagggauggaaauaac

SEQ ID NO: 41048 - RNA, 19 nt, Homo sapiens
uggaugagcugaagaagga

SEQ ID NO: 41049 - RNA, 19 nt, Homo sapiens
gaaggaaacaacaaaggaa

SEQ ID NO: 41050 - RNA, 19 nt, Homo sapiens
aaagaaacaucuacaggau

SEQ ID NO: 41051 - RNA, 19 nt, Homo sapiens
uaagugggagacaauauua

SEQ ID NO: 41052 - RNA, 19 nt, Homo sapiens
caaaggaagugagguagug

SEQ ID NO: 41053 - RNA, 19 nt, Homo sapiens
cgaggcagguggaucauga

SEQ ID NO: 41054 - RNA, 19 nt, Homo sapiens
gggagacaauauuaauuug

SEQ ID NO: 41055 - RNA, 19 nt, Homo sapiens
gcuccaugcuguucugaaa

SEQ ID NO: 41056 - RNA, 19 nt, Homo sapiens
cacuucaccuucuguaaua

SEQ ID NO: 41057 - RNA, 19 nt, Homo sapiens
gacaggacauuugacauga

SEQ ID NO: 41058 - RNA, 19 nt, Homo sapiens
gaugcaagaugccuuucaa

SEQ ID NO: 41059 - RNA, 19 nt, Homo sapiens
cuagauaggucaugcaagu

SEQ ID NO: 41060 - RNA, 19 nt, Homo sapiens
ggucagaaccuuuggacaa

SEQ ID NO: 41061 - RNA, 19 nt, Homo sapiens
caagaugccuuucaaaaug

SEQ ID NO: 41062 - RNA, 19 nt, Homo sapiens
gagaaagacaucugaggaa

SEQ ID NO: 41063 - RNA, 19 nt, Homo sapiens
gggacaagcuuaggucaug

SEQ ID NO: 41064 - RNA, 19 nt, Homo sapiens
gcaagaagaaacagaagga

SEQ ID NO: 41065 - RNA, 19 nt, Homo sapiens
ggaaggaaacaacaaagga

SEQ ID NO: 41066 - RNA, 19 nt, Homo sapiens
caacgacaaucuauaucug

SEQ ID NO: 41067 - RNA, 19 nt, Homo sapiens
ucugaggaauuaaggguua

SEQ ID NO: 41068 - RNA, 19 nt, Homo sapiens
ggcauuggguggcaacauu

SEQ ID NO: 41069 - RNA, 19 nt, Homo sapiens
gaaauaacggguggcauug

SEQ ID NO: 41070 - RNA, 19 nt, Homo sapiens
gcauugaccugggcacaga

SEQ ID NO: 41071 - RNA, 19 nt, Homo sapiens
gagauuccuuucaacucua

SEQ ID NO: 41072 - RNA, 19 nt, Homo sapiens
cccaaaggcugucauuuca

SEQ ID NO: 41073 - RNA, 19 nt, Homo sapiens
agaaagacaucugaggaaa

SEQ ID NO: 41074 - RNA, 19 nt, Homo sapiens
ggacaagcuuaggucauga

SEQ ID NO: 41075 - RNA, 19 nt, Homo sapiens
ggaggaaggaaacaacaaa

SEQ ID NO: 41076 - RNA, 19 nt, Homo sapiens
ccauagaccuaacugugaa

SEQ ID NO: 41077 - RNA, 19 nt, Homo sapiens
gaagaacaagauccugauu

SEQ ID NO: 41078 - RNA, 19 nt, Homo sapiens
gggcugaccucaucaucug

SEQ ID NO: 41079 - RNA, 19 nt, Homo sapiens
gcucugaccugaaggacau

SEQ ID NO: 41080 - RNA, 19 nt, Homo sapiens
uggcagagauuccuuucaa

SEQ ID NO: 41081 - RNA, 19 nt, Homo sapiens
uucaggcacuuuagaaaua

SEQ ID NO: 41082 - RNA, 19 nt, Homo sapiens
agaaggagguggcaaugga

SEQ ID NO: 41083 - RNA, 19 nt, Homo sapiens
gcacugggaauguccugua

SEQ ID NO: 41084 - RNA, 19 nt, Homo sapiens
ugaaagggauggccacaag

SEQ ID NO: 41085 - RNA, 19 nt, Homo sapiens
gaagaaccaggcauggaaa

SEQ ID NO: 41086 - RNA, 19 nt, Homo sapiens
acacagagaucgucuuugc

SEQ ID NO: 41087 - RNA, 19 nt, Homo sapiens
gaacaugguaccucagcaa

SEQ ID NO: 41088 - RNA, 19 nt, Homo sapiens
gcucugacgucucuaagca

SEQ ID NO: 41089 - RNA, 19 nt, Homo sapiens
cagcagaagcucaucauug

SEQ ID NO: 41090 - RNA, 19 nt, Homo sapiens
ggagagaagaugcagauca

SEQ ID NO: 41091 - RNA, 19 nt, Homo sapiens
auacuugccucccuccuaa

SEQ ID NO: 41092 - RNA, 19 nt, Homo sapiens
gcuguucccuccaggcaaa

SEQ ID NO: 41093 - RNA, 19 nt, Homo sapiens
caaaggcgugggcaucaua

SEQ ID NO: 41094 - RNA, 19 nt, Homo sapiens
agaacugccuggugaagaa

SEQ ID NO: 41095 - RNA, 19 nt, Homo sapiens
uaauagaucagcauccaaa

SEQ ID NO: 41096 - RNA, 19 nt, Homo sapiens
ggagaugcaagaugccuuu

SEQ ID NO: 41097 - RNA, 19 nt, Homo sapiens
gcuguaagguggauaacuc

SEQ ID NO: 41098 - RNA, 19 nt, Homo sapiens
gcagaucaacgcagaggaa

SEQ ID NO: 41099 - RNA, 19 nt, Homo sapiens
ccuccuaaaucgugauauu

SEQ ID NO: 41100 - RNA, 19 nt, Homo sapiens
ucaagagcuuccagaaaug

SEQ ID NO: 41101 - RNA, 19 nt, Homo sapiens
uccacuauguugucuauuu

SEQ ID NO: 41102 - RNA, 19 nt, Homo sapiens
gagaucgucuuugcucgaa

SEQ ID NO: 41103 - RNA, 19 nt, Homo sapiens
ccacacagagaucgucuuu

SEQ ID NO: 41104 - RNA, 19 nt, Homo sapiens
cggaucaucucuucucaug

SEQ ID NO: 41105 - RNA, 19 nt, Homo sapiens
gugcaugggcuaauuauca

SEQ ID NO: 41106 - RNA, 19 nt, Homo sapiens
gcgagugcaugggcuaauu

SEQ ID NO: 41107 - RNA, 19 nt, Homo sapiens
uaauaacacuucaccuucu

SEQ ID NO: 41108 - RNA, 19 nt, Homo sapiens
gcauguacccgcucaaagu

SEQ ID NO: 41109 - RNA, 19 nt, Homo sapiens
gcaggcagccgacaugauc

SEQ ID NO: 41110 - RNA, 19 nt, Homo sapiens
gaacaucuccgugucuaag

SEQ ID NO: 41111 - RNA, 19 nt, Homo sapiens
ggaaguaagggagucauug

SEQ ID NO: 41112 - RNA, 19 nt, Homo sapiens
ggcaauggaugaccacaag

SEQ ID NO: 41113 - RNA, 19 nt, Homo sapiens
aagcuuaggucaugaacau

SEQ ID NO: 41114 - RNA, 19 nt, Homo sapiens
agaaacaucuacaggaucu

SEQ ID NO: 41115 - RNA, 19 nt, Homo sapiens
gcaggagaauugcuugaac

SEQ ID NO: 41116 - RNA, 19 nt, Homo sapiens
uggcugccuuucucucuua

SEQ ID NO: 41117 - RNA, 19 nt, Homo sapiens
gcacugugaccauccuuug

SEQ ID NO: 41118 - RNA, 19 nt, Homo sapiens
agaacaaacucagaucuca

SEQ ID NO: 41119 - RNA, 19 nt, Homo sapiens
gacaggaguggaccuauga

SEQ ID NO: 41120 - RNA, 19 nt, Homo sapiens
gaaggaaaccuacuacuga

SEQ ID NO: 41121 - RNA, 19 nt, Homo sapiens
gaagaggucugccggaaau

SEQ ID NO: 41122 - RNA, 19 nt, Homo sapiens
gccaagagcuccaagauca

SEQ ID NO: 41123 - RNA, 19 nt, Homo sapiens
gcaggcagcugacaugauc

SEQ ID NO: 41124 - RNA, 19 nt, Homo sapiens
gcaccgaccucaaggacuu

SEQ ID NO: 41125 - RNA, 19 nt, Homo sapiens
gacaaggacucacccaaga

SEQ ID NO: 41126 - RNA, 19 nt, Homo sapiens
ucaauuccaccaacaaaua

SEQ ID NO: 41127 - RNA, 19 nt, Homo sapiens
ccacaucgcccaucucuuc

SEQ ID NO: 41128 - RNA, 19 nt, Homo sapiens
ggacauacgagcagaggaa

SEQ ID NO: 41129 - RNA, 19 nt, Homo sapiens
gaaagcgacaucaugaaga

SEQ ID NO: 41130 - RNA, 19 nt, Homo sapiens
caagaaaguggcugagauu

SEQ ID NO: 41131 - RNA, 19 nt, Homo sapiens
caacaucccugugcucaag

SEQ ID NO: 41132 - RNA, 19 nt, Homo sapiens
gaaccuggaggcuguagaa

SEQ ID NO: 41133 - RNA, 19 nt, Homo sapiens
gugagaagaugcaggugaa

SEQ ID NO: 41134 - RNA, 19 nt, Homo sapiens
guacgaggcugccgaaagc

SEQ ID NO: 41135 - RNA, 19 nt, Homo sapiens
ucagggaccucauuugaca

SEQ ID NO: 41136 - RNA, 19 nt, Homo sapiens
ggaccuggaugaccucaag

SEQ ID NO: 41137 - RNA, 19 nt, Homo sapiens
gagauucccuucaauucca

SEQ ID NO: 41138 - RNA, 19 nt, Homo sapiens
uggaugaccucaagaagga

SEQ ID NO: 41139 - RNA, 19 nt, Homo sapiens
gacgaaauccgcaaacuca

SEQ ID NO: 41140 - RNA, 19 nt, Homo sapiens
gcaucgaucugggcacuga

SEQ ID NO: 41141 - RNA, 19 nt, Homo sapiens
cagcagaagcucaucauug

SEQ ID NO: 41142 - RNA, 19 nt, Homo sapiens
gcuugaggcugucaucuuc

SEQ ID NO: 41143 - RNA, 19 nt, Homo sapiens
agaggaaggugguggaguu

SEQ ID NO: 41144 - RNA, 19 nt, Homo sapiens
ggacuucaccuccgagcaa

SEQ ID NO: 41145 - RNA, 19 nt, Homo sapiens
agaacugccuggugaagaa

SEQ ID NO: 41146 - RNA, 19 nt, Homo sapiens
ccaaaccucucuccucucu

SEQ ID NO: 41147 - RNA, 19 nt, Homo sapiens
gagacagggugcaauugug

SEQ ID NO: 41148 - RNA, 19 nt, Homo sapiens
gcucugacgucuccaagca

SEQ ID NO: 41149 - RNA, 19 nt, Homo sapiens
gauaccugcuggugaugaa

SEQ ID NO: 41150 - RNA, 19 nt, Homo sapiens
ccaccucccugggcucuuu

SEQ ID NO: 41151 - RNA, 19 nt, Homo sapiens
ggaagaggucugccggaaa

SEQ ID NO: 41152 - RNA, 19 nt, Homo sapiens
acaagaaaguggcugagau

SEQ ID NO: 41153 - RNA, 19 nt, Homo sapiens
ggacaacuccucccugacu

SEQ ID NO: 41154 - RNA, 19 nt, Homo sapiens
gcaucaaggucaucauggu

SEQ ID NO: 41155 - RNA, 19 nt, Homo sapiens
agcagaagcucaucauugu

SEQ ID NO: 41156 - RNA, 19 nt, Homo sapiens
gcacaagaugucaguggaa

SEQ ID NO: 41157 - RNA, 19 nt, Homo sapiens
gcugagauucccuucaauu

SEQ ID NO: 41158 - RNA, 19 nt, Homo sapiens
ggacaagaaagaugacaag

SEQ ID NO: 41159 - RNA, 19 nt, Homo sapiens
gacgagauccugcagaauc

SEQ ID NO: 41160 - RNA, 19 nt, Homo sapiens
uggcugagauucccuucaa

SEQ ID NO: 41161 - RNA, 19 nt, Homo sapiens
caaucgcgcugucuucaag

SEQ ID NO: 41162 - RNA, 19 nt, Homo sapiens
gugcuugguuucugccauu

SEQ ID NO: 41163 - RNA, 19 nt, Homo sapiens
ggaccucauuugacaagag

SEQ ID NO: 41164 - RNA, 19 nt, Homo sapiens
gcccaucgccaucgagauu

SEQ ID NO: 41165 - RNA, 19 nt, Homo sapiens
gccgaaagcgacaucauga

SEQ ID NO: 41166 - RNA, 19 nt, Homo sapiens
gcgagcgcgugcuugguuu

SEQ ID NO: 41167 - RNA, 19 nt, Homo sapiens
gaucauggaguccuucaag

SEQ ID NO: 41168 - RNA, 19 nt, Homo sapiens
aaaccucucuccucucucu

SEQ ID NO: 41169 - RNA, 19 nt, Homo sapiens
gaucuucgacaaccuaaag

SEQ ID NO: 41170 - RNA, 19 nt, Homo sapiens
cagacugugugcaggguuu

SEQ ID NO: 41171 - RNA, 19 nt, Homo sapiens
ccaucgagauugagcacuu

SEQ ID NO: 41172 - RNA, 19 nt, Homo sapiens
ucgguggcuucuucucuua

SEQ ID NO: 41173 - RNA, 19 nt, Homo sapiens
ucagagacagggugcaauu

SEQ ID NO: 41174 - RNA, 19 nt, Homo sapiens
ucgacgagauccugcagaa

SEQ ID NO: 41175 - RNA, 19 nt, Homo sapiens
cagcaaagcccaggagauc

SEQ ID NO: 41176 - RNA, 19 nt, Homo sapiens
cuucuucucuuacuuugug

SEQ ID NO: 41177 - RNA, 19 nt, Homo sapiens
ucaagaaggagguggcuau

SEQ ID NO: 41178 - RNA, 19 nt, Homo sapiens
ccaagaucauggaguccuu

SEQ ID NO: 41179 - RNA, 19 nt, Homo sapiens
aaagcgacaucaugaagag

SEQ ID NO: 41180 - RNA, 19 nt, Homo sapiens
ugaagaaggccgacauugg

SEQ ID NO: 41181 - RNA, 19 nt, Homo sapiens
ggaagaacugccuggugaa

SEQ ID NO: 41182 - RNA, 19 nt, Homo sapiens
gcacugucaugggccguau

SEQ ID NO: 41183 - RNA, 19 nt, Homo sapiens
cagcagggcaugaagaaca

SEQ ID NO: 41184 - RNA, 19 nt, Homo sapiens
ccagcaauaucccggagau

SEQ ID NO: 41185 - RNA, 19 nt, Homo sapiens
agaaggagguggcuaugac

SEQ ID NO: 41186 - RNA, 19 nt, Homo sapiens
gaaagaugacaaggacuca

SEQ ID NO: 41187 - RNA, 19 nt, Homo sapiens
gaccucauuugacaagagu

SEQ ID NO: 41188 - RNA, 19 nt, Homo sapiens
cgaaagcgacaucaugaag

SEQ ID NO: 41189 - RNA, 19 nt, Homo sapiens
gcugcaagguggacaacuc

SEQ ID NO: 41190 - RNA, 19 nt, Homo sapiens
cgacugugaugacgugaac

SEQ ID NO: 41191 - RNA, 19 nt, Homo sapiens
gggcuuugccuucgacugu

SEQ ID NO: 41192 - RNA, 19 nt, Homo sapiens
gaaggagguggcuaugaca

SEQ ID NO: 41193 - RNA, 19 nt, Homo sapiens
gaagaacugccuggugaag

SEQ ID NO: 41194 - RNA, 19 nt, Homo sapiens
ggagaaggaaaccuacuac

SEQ ID NO: 41195 - RNA, 19 nt, Homo sapiens
acaagaaagaugacaagga

SEQ ID NO: 41196 - RNA, 19 nt, Homo sapiens
caagcaggcagcugacaug

SEQ ID NO: 41197 - RNA, 19 nt, Homo sapiens
gcaaucgcgcugucuucaa

SEQ ID NO: 41198 - RNA, 19 nt, Homo sapiens
ccaucgccaucgagauuga

SEQ ID NO: 41199 - RNA, 19 nt, Homo sapiens
ucauggaguccuucaagaa

SEQ ID NO: 41200 - RNA, 19 nt, Homo sapiens
caagagcuccaagaucaug

SEQ ID NO: 41201 - RNA, 19 nt, Homo sapiens
guucuggacaauuaucaaa

SEQ ID NO: 41202 - RNA, 19 nt, Homo sapiens
cucugguucuggacaauua

SEQ ID NO: 41203 - RNA, 19 nt, Homo sapiens
ggaaggugguggaguucac

SEQ ID NO: 41204 - RNA, 19 nt, Homo sapiens
cagagugggucaaguuuug

SEQ ID NO: 41205 - RNA, 19 nt, Homo sapiens
gcgcaggcaucaaggucau

SEQ ID NO: 41206 - RNA, 19 nt, Homo sapiens
gcuuugccuucgacuguga

SEQ ID NO: 41207 - RNA, 19 nt, Homo sapiens
gcaucaucguggccaaugu

SEQ ID NO: 41208 - RNA, 19 nt, Homo sapiens
agaaggaaaccuacuacug

SEQ ID NO: 41209 - RNA, 19 nt, Homo sapiens
ggacggacaaauuggucaa

SEQ ID NO: 41210 - RNA, 19 nt, Homo sapiens
ugaagagacagcccaggaa

SEQ ID NO: 41211 - RNA, 19 nt, Homo sapiens
acaaauaccagcucuccau

SEQ ID NO: 41212 - RNA, 19 nt, Homo sapiens
agucugcccugcucaagug

SEQ ID NO: 41213 - RNA, 19 nt, Homo sapiens
agucagggaccucauuuga

SEQ ID NO: 41214 - RNA, 19 nt, Homo sapiens
ccagucagggaccucauuu

SEQ ID NO: 41215 - RNA, 19 nt, Homo sapiens
gcaugacagucgcccacau

SEQ ID NO: 41216 - RNA, 19 nt, Homo sapiens
gaagaaccuggaggcugua

SEQ ID NO: 41217 - RNA, 19 nt, Homo sapiens
acgagauccugcagaauca

SEQ ID NO: 41218 - RNA, 19 nt, Homo sapiens
gugugggcaucaucucuga

SEQ ID NO: 41219 - RNA, 19 nt, Homo sapiens
cuugguuucugccauuauu

SEQ ID NO: 41220 - RNA, 19 nt, Homo sapiens
gaagaaagcugugauugga

SEQ ID NO: 41221 - RNA, 19 nt, Homo sapiens
gagcuuuccuuguguauuu

SEQ ID NO: 41222 - RNA, 19 nt, Homo sapiens
gcacaucgccucaacauug

SEQ ID NO: 41223 - RNA, 19 nt, Homo sapiens
gggauaagaacauguauua

SEQ ID NO: 41224 - RNA, 19 nt, Homo sapiens
gaccaaagcucuaggacuu

SEQ ID NO: 41225 - RNA, 19 nt, Homo sapiens
ucaagaagacuauugcuua

SEQ ID NO: 41226 - RNA, 19 nt, Homo sapiens
ccagaaaccuacucauuug

SEQ ID NO: 41227 - RNA, 19 nt, Homo sapiens
cagggucucuucagaaaua

SEQ ID NO: 41228 - RNA, 19 nt, Homo sapiens
gaucuuugcuuauuaccaa

SEQ ID NO: 41229 - RNA, 19 nt, Homo sapiens
caagaagacuauugcuuau

SEQ ID NO: 41230 - RNA, 19 nt, Homo sapiens
gaaggucgccugaucuuug

SEQ ID NO: 41231 - RNA, 19 nt, Homo sapiens
gaucaagguuauuaugguu

SEQ ID NO: 41232 - RNA, 19 nt, Homo sapiens
gaacuaaggacaucgugaa

SEQ ID NO: 41233 - RNA, 19 nt, Homo sapiens
ggaggaaggucgccugauc

SEQ ID NO: 41234 - RNA, 19 nt, Homo sapiens
gcaggaugcucacugaugu

SEQ ID NO: 41235 - RNA, 19 nt, Homo sapiens
ccuggaagcuggugggaua

SEQ ID NO: 41236 - RNA, 19 nt, Homo sapiens
cuacacggcuuucuuuguu

SEQ ID NO: 41237 - RNA, 19 nt, Homo sapiens
gcagggaucaagguuauua

SEQ ID NO: 41238 - RNA, 19 nt, Homo sapiens
guggauaacucaucucuca

SEQ ID NO: 41239 - RNA, 19 nt, Homo sapiens
cagaacagcuggaugagau

SEQ ID NO: 41240 - RNA, 19 nt, Homo sapiens
gcauggagcugaaggacau

SEQ ID NO: 41241 - RNA, 19 nt, Homo sapiens
gauuggagaugccucagaa

SEQ ID NO: 41242 - RNA, 19 nt, Homo sapiens
gaagaacaacugccuggaa

SEQ ID NO: 41243 - RNA, 19 nt, Homo sapiens
gaaagugacaucaugaaca

SEQ ID NO: 41244 - RNA, 19 nt, Homo sapiens
gaaaauguccccaucauga

SEQ ID NO: 41245 - RNA, 19 nt, Homo sapiens
gaccacaaacucagcaaua

SEQ ID NO: 41246 - RNA, 19 nt, Homo sapiens
auacguacauuucgaggua

SEQ ID NO: 41247 - RNA, 19 nt, Homo sapiens
gugaaugacuugaaagaca

SEQ ID NO: 41248 - RNA, 19 nt, Homo sapiens
gcucagaacagcuggauga

SEQ ID NO: 41249 - RNA, 19 nt, Homo sapiens
gugggacucuugucaauga

SEQ ID NO: 41250 - RNA, 19 nt, Homo sapiens
cuacgugaaugacuugaaa

SEQ ID NO: 41251 - RNA, 19 nt, Homo sapiens
agaagacuauugcuuauuc

SEQ ID NO: 41252 - RNA, 19 nt, Homo sapiens
ggagaugccucagaaacug

SEQ ID NO: 41253 - RNA, 19 nt, Homo sapiens
ggagaaggacuacgugaau

SEQ ID NO: 41254 - RNA, 19 nt, Homo sapiens
uaacggggaucuuugcuua

SEQ ID NO: 41255 - RNA, 19 nt, Homo sapiens
gagaaggacuacgugaaug

SEQ ID NO: 41256 - RNA, 19 nt, Homo sapiens
gaaaccuacucauuugaca

SEQ ID NO: 41257 - RNA, 19 nt, Homo sapiens
ccucugaguuuacccauga

SEQ ID NO: 41258 - RNA, 19 nt, Homo sapiens
ggaauuggaagagaaauau

SEQ ID NO: 41259 - RNA, 19 nt, Homo sapiens
gauagcagguucugaugca

SEQ ID NO: 41260 - RNA, 19 nt, Homo sapiens
gugcagggaucaagguuau

SEQ ID NO: 41261 - RNA, 19 nt, Homo sapiens
ccaaagcuauugccaagag

SEQ ID NO: 41262 - RNA, 19 nt, Homo sapiens
ccagaucccugcagacauc

SEQ ID NO: 41263 - RNA, 19 nt, Homo sapiens
caagguaccagagggaaua

SEQ ID NO: 41264 - RNA, 19 nt, Homo sapiens
gaugagaucuuagccaacu

SEQ ID NO: 41265 - RNA, 19 nt, Homo sapiens
cagaugcagucaccaaaug

SEQ ID NO: 41266 - RNA, 19 nt, Homo sapiens
aaacaaagaacaucugcuu

SEQ ID NO: 41267 - RNA, 19 nt, Homo sapiens
ucaccauucuguucauuga

SEQ ID NO: 41268 - RNA, 19 nt, Homo sapiens
gaaggcagacauugggauu

SEQ ID NO: 41269 - RNA, 19 nt, Homo sapiens
ggaucaagguuauuauggu

SEQ ID NO: 41270 - RNA, 19 nt, Homo sapiens
agaacugccuggugaagaa

SEQ ID NO: 41271 - RNA, 19 nt, Homo sapiens
ucagcaagcucucgucauc

SEQ ID NO: 41272 - RNA, 19 nt, Homo sapiens
gaaaugcagcaccaucaug

SEQ ID NO: 41273 - RNA, 19 nt, Homo sapiens
ccauugagaucgagcacuu

SEQ ID NO: 41274 - RNA, 19 nt, Homo sapiens
cgccugagaucgucaaguu

SEQ ID NO: 41275 - RNA, 19 nt, Homo sapiens
gggaauuggaagagaaaua

SEQ ID NO: 41276 - RNA, 19 nt, Homo sapiens
acaaagaggaguuucagaa

SEQ ID NO: 41277 - RNA, 19 nt, Homo sapiens
ggaagcuggugggauaaga

SEQ ID NO: 41278 - RNA, 19 nt, Homo sapiens
gcacauuggccucaugcaa

SEQ ID NO: 41279 - RNA, 19 nt, Homo sapiens
cuuauucccugaccaagaa

SEQ ID NO: 41280 - RNA, 19 nt, Homo sapiens
gaggcaggaugcuguuguu

SEQ ID NO: 41281 - RNA, 19 nt, Homo sapiens
gagaaaugcagcaccauca

SEQ ID NO: 41282 - RNA, 19 nt, Homo sapiens
caaaacggauggccaagaa

SEQ ID NO: 41283 - RNA, 19 nt, Homo sapiens
gaagacgcccauugccauu

SEQ ID NO: 41284 - RNA, 19 nt, Homo sapiens
gggcuacacggcuuucuuu

SEQ ID NO: 41285 - RNA, 19 nt, Homo sapiens
ccugggagcuuuccuugug

SEQ ID NO: 41286 - RNA, 19 nt, Homo sapiens
acagcuggaugagaucuua

SEQ ID NO: 41287 - RNA, 19 nt, Homo sapiens
caucacagccaaagcuauu

SEQ ID NO: 41288 - RNA, 19 nt, Homo sapiens
ggugaugugauggaaauua

SEQ ID NO: 41289 - RNA, 19 nt, Homo sapiens
ggacuugggccuccuuauc

SEQ ID NO: 41290 - RNA, 19 nt, Homo sapiens
guucgacaaucagaucuuu

SEQ ID NO: 41291 - RNA, 19 nt, Homo sapiens
ggaagccucgccacaagaa

SEQ ID NO: 41292 - RNA, 19 nt, Homo sapiens
ugaaggacaugagcucaga

SEQ ID NO: 41293 - RNA, 19 nt, Homo sapiens
gcagcaccaucaugaucaa

SEQ ID NO: 41294 - RNA, 19 nt, Homo sapiens
ccagugaggaccauucaaa

SEQ ID NO: 41295 - RNA, 19 nt, Homo sapiens
ccucaggaguuggaaauga

SEQ ID NO: 41296 - RNA, 19 nt, Homo sapiens
ggucugauccucuccuaug

SEQ ID NO: 41297 - RNA, 19 nt, Homo sapiens
ccucacagaucaucauugg

SEQ ID NO: 41298 - RNA, 19 nt, Homo sapiens
gggcaggaauggacaaggu

SEQ ID NO: 41299 - RNA, 19 nt, Homo sapiens
gacaagagcacugccaaga

SEQ ID NO: 41300 - RNA, 19 nt, Homo sapiens
gaacaucugcuucuauucc

SEQ ID NO: 41301 - RNA, 19 nt, Homo sapiens
ucagggugcugucuucuca

SEQ ID NO: 41302 - RNA, 19 nt, Homo sapiens
caaaggaggagaccagauc

SEQ ID NO: 41303 - RNA, 19 nt, Homo sapiens
gggcacacuuguucaucuu

SEQ ID NO: 41304 - RNA, 19 nt, Homo sapiens
ccagagggaauaccuagaa

SEQ ID NO: 41305 - RNA, 19 nt, Homo sapiens
acucauaccugcacauugg

SEQ ID NO: 41306 - RNA, 19 nt, Homo sapiens
agcagaagcugaucauugu

SEQ ID NO: 41307 - RNA, 19 nt, Homo sapiens
cauaugggauucaguacuc

SEQ ID NO: 41308 - RNA, 19 nt, Homo sapiens
caccaucauuggccauauu

SEQ ID NO: 41309 - RNA, 19 nt, Homo sapiens
gaaauauggcacagacauc

SEQ ID NO: 41310 - RNA, 19 nt, Homo sapiens
gccuuucucuguuggauug

SEQ ID NO: 41311 - RNA, 19 nt, Homo sapiens
ccagcagggucucuucaga

SEQ ID NO: 41312 - RNA, 19 nt, Homo sapiens
aaagugacaucaugaacag

SEQ ID NO: 41313 - RNA, 19 nt, Homo sapiens
gcaggaugcuguuguugcu

SEQ ID NO: 41314 - RNA, 19 nt, Homo sapiens
ugaaacaguggaagacauu

SEQ ID NO: 41315 - RNA, 19 nt, Homo sapiens
uccagaaaccuacucauuu

SEQ ID NO: 41316 - RNA, 19 nt, Homo sapiens
gaugugauggaaauuagaa

SEQ ID NO: 41317 - RNA, 19 nt, Homo sapiens
uccaucaucuuccucauug

SEQ ID NO: 41318 - RNA, 19 nt, Homo sapiens
cauccgagauuccgagaag

SEQ ID NO: 41319 - RNA, 19 nt, Homo sapiens
gcacacuuguucaucuucu

SEQ ID NO: 41320 - RNA, 19 nt, Homo sapiens
ggacagggcuaauuaauuu

SEQ ID NO: 41321 - RNA, 19 nt, Homo sapiens
gcacaaaucuuucccacua

SEQ ID NO: 41322 - RNA, 19 nt, Homo sapiens
ggaaauugcucuggauuaa

SEQ ID NO: 41323 - RNA, 19 nt, Homo sapiens
ggcaaaccgugcauuauua

SEQ ID NO: 41324 - RNA, 19 nt, Homo sapiens
gaacugcccuuuaaauuuu

SEQ ID NO: 41325 - RNA, 19 nt, Homo sapiens
gaccuacacuuaaucuaua

SEQ ID NO: 41326 - RNA, 19 nt, Homo sapiens
ggaagaaauucaucuggaa

SEQ ID NO: 41327 - RNA, 19 nt, Homo sapiens
ggaacugcccuuuaaauuu

SEQ ID NO: 41328 - RNA, 19 nt, Homo sapiens
gaacaaacugucauacgua

SEQ ID NO: 41329 - RNA, 19 nt, Homo sapiens
gaauaaaacuggcauggua

SEQ ID NO: 41330 - RNA, 19 nt, Homo sapiens
gaggagacuuuaaucauga

SEQ ID NO: 41331 - RNA, 19 nt, Homo sapiens
guuaagagcugaucacaag

SEQ ID NO: 41332 - RNA, 19 nt, Homo sapiens
cgaaaggucugcagauuca

SEQ ID NO: 41333 - RNA, 19 nt, Homo sapiens
ccagagggaugacaugauu

SEQ ID NO: 41334 - RNA, 19 nt, Homo sapiens
ggauaaaguuggaaaugug

SEQ ID NO: 41335 - RNA, 19 nt, Homo sapiens
uaacacagauuccucagau

SEQ ID NO: 41336 - RNA, 19 nt, Homo sapiens
guacaguucaccaaucuua

SEQ ID NO: 41337 - RNA, 19 nt, Homo sapiens
guacagugcucuuguugau

SEQ ID NO: 41338 - RNA, 19 nt, Homo sapiens
gaagauaaggauaaaguug

SEQ ID NO: 41339 - RNA, 19 nt, Homo sapiens
uaacugaccuuguaguaag

SEQ ID NO: 41340 - RNA, 19 nt, Homo sapiens
gaaauucgcauagagugua

SEQ ID NO: 41341 - RNA, 19 nt, Homo sapiens
gagggcagcuggaagaaau

SEQ ID NO: 41342 - RNA, 19 nt, Homo sapiens
gagaugaagauaaggauaa

SEQ ID NO: 41343 - RNA, 19 nt, Homo sapiens
ggaguacagugcucuuguu

SEQ ID NO: 41344 - RNA, 19 nt, Homo sapiens
cgaggagacuuuaaucaug

SEQ ID NO: 41345 - RNA, 19 nt, Homo sapiens
gguuuaagauccuucuauu

SEQ ID NO: 41346 - RNA, 19 nt, Homo sapiens
gaaauaaaccaaagucacu

SEQ ID NO: 41347 - RNA, 19 nt, Homo sapiens
ggugauggguuguguuaug

SEQ ID NO: 41348 - RNA, 19 nt, Homo sapiens
ggaccuacacuuaaucuau

SEQ ID NO: 41349 - RNA, 19 nt, Homo sapiens
gggcaaaccgugcauuauu

SEQ ID NO: 41350 - RNA, 19 nt, Homo sapiens
ucaccaaucuuaccaugga

SEQ ID NO: 41351 - RNA, 19 nt, Homo sapiens
caagcgagaugaagauaag

SEQ ID NO: 41352 - RNA, 19 nt, Homo sapiens
gggaaauugcucuggauua

SEQ ID NO: 41353 - RNA, 19 nt, Homo sapiens
agacugguguuaaauguug

SEQ ID NO: 41354 - RNA, 19 nt, Homo sapiens
gaugaaguauaacccaaau

SEQ ID NO: 41355 - RNA, 19 nt, Homo sapiens
gggaacugcccuuuaaauu

SEQ ID NO: 41356 - RNA, 19 nt, Homo sapiens
gguguuaggucuuuauuuu

SEQ ID NO: 41357 - RNA, 19 nt, Homo sapiens
uacacuagcuuucugcauu

SEQ ID NO: 41358 - RNA, 19 nt, Homo sapiens
caaauguccuucccguuca

SEQ ID NO: 41359 - RNA, 19 nt, Homo sapiens
gagggcaaaccgugcauua

SEQ ID NO: 41360 - RNA, 19 nt, Homo sapiens
uguccaagguguaaauauu

SEQ ID NO: 41361 - RNA, 19 nt, Homo sapiens
cuaaugaucccaagagcua

SEQ ID NO: 41362 - RNA, 19 nt, Homo sapiens
acacuagcuuucugcauuu

SEQ ID NO: 41363 - RNA, 19 nt, Homo sapiens
gaacgaggagacuuuaauc

SEQ ID NO: 41364 - RNA, 19 nt, Homo sapiens
gguggcaguugguuuaaga

SEQ ID NO: 41365 - RNA, 19 nt, Homo sapiens
cguaugggaccuacacuua

SEQ ID NO: 41366 - RNA, 19 nt, Homo sapiens
gaaauugcucuggauuaaa

SEQ ID NO: 41367 - RNA, 19 nt, Homo sapiens
guaauaauugccaggagua

SEQ ID NO: 41368 - RNA, 19 nt, Homo sapiens
gguguuaaauguugucuac

SEQ ID NO: 41369 - RNA, 19 nt, Homo sapiens
ugaaacuuauggcuacaaa

SEQ ID NO: 41370 - RNA, 19 nt, Homo sapiens
cuagggacagggcuaauua

SEQ ID NO: 41371 - RNA, 19 nt, Homo sapiens
gcaagcgagaugaagauaa

SEQ ID NO: 41372 - RNA, 19 nt, Homo sapiens
gcaaaccgugcauuauuau

SEQ ID NO: 41373 - RNA, 19 nt, Homo sapiens
aaacuuauggcuacaaaga

SEQ ID NO: 41374 - RNA, 19 nt, Homo sapiens
uugaauggcugggaaauug

SEQ ID NO: 41375 - RNA, 19 nt, Homo sapiens
gaauuuaagcccacauauc

SEQ ID NO: 41376 - RNA, 19 nt, Homo sapiens
ugaacaaacugucauacgu

SEQ ID NO: 41377 - RNA, 19 nt, Homo sapiens
cccauagacugguguuaaa

SEQ ID NO: 41378 - RNA, 19 nt, Homo sapiens
gggacagggcuaauuaauu

SEQ ID NO: 41379 - RNA, 19 nt, Homo sapiens
guaacugaccuuguaguaa

SEQ ID NO: 41380 - RNA, 19 nt, Homo sapiens
gagcugaucacaagcacaa

SEQ ID NO: 41381 - RNA, 19 nt, Homo sapiens
gcucuggauuaaaugauga

SEQ ID NO: 41382 - RNA, 19 nt, Homo sapiens
uaagauccuucuauucuac

SEQ ID NO: 41383 - RNA, 19 nt, Homo sapiens
cuaaagcugugucugagau

SEQ ID NO: 41384 - RNA, 19 nt, Homo sapiens
acccagugaugaaguauaa

SEQ ID NO: 41385 - RNA, 19 nt, Homo sapiens
ucuauaugcuuuacacuag

SEQ ID NO: 41386 - RNA, 19 nt, Homo sapiens
gaggagggcagcuggaaga

SEQ ID NO: 41387 - RNA, 19 nt, Homo sapiens
cuacuagucuugaacaaac

SEQ ID NO: 41388 - RNA, 19 nt, Homo sapiens
cccacuagccauuuaauaa

SEQ ID NO: 41389 - RNA, 19 nt, Homo sapiens
acacugaaauucgcauaga

SEQ ID NO: 41390 - RNA, 19 nt, Homo sapiens
guucuaaagcugugucuga

SEQ ID NO: 41391 - RNA, 19 nt, Homo sapiens
uguauugaaugcugucuug

SEQ ID NO: 41392 - RNA, 19 nt, Homo sapiens
uuccguaacugaccuugua

SEQ ID NO: 41393 - RNA, 19 nt, Homo sapiens
guaugggaccuacacuuaa

SEQ ID NO: 41394 - RNA, 19 nt, Homo sapiens
gaagacugaaauuuccuuu

SEQ ID NO: 41395 - RNA, 19 nt, Homo sapiens
ccagaagacugaaauuucc

SEQ ID NO: 41396 - RNA, 19 nt, Homo sapiens
uaugggaccuacacuuaau

SEQ ID NO: 41397 - RNA, 19 nt, Homo sapiens
ugaaguauaacccaaaugu

SEQ ID NO: 41398 - RNA, 19 nt, Homo sapiens
uaacauacuccauagucuu

SEQ ID NO: 41399 - RNA, 19 nt, Homo sapiens
aaacuggcaugguaauuuu

SEQ ID NO: 41400 - RNA, 19 nt, Homo sapiens
ggacacugaaauucgcaua

SEQ ID NO: 41401 - RNA, 19 nt, Homo sapiens
gaaauucaucuggaacuca

SEQ ID NO: 41402 - RNA, 19 nt, Homo sapiens
guguuaugcuuguauugaa

SEQ ID NO: 41403 - RNA, 19 nt, Homo sapiens
cuaagccucccaagaauga

SEQ ID NO: 41404 - RNA, 19 nt, Homo sapiens
aaccuaagccucccaagaa

SEQ ID NO: 41405 - RNA, 19 nt, Homo sapiens
aauuuaagcccacauauca

SEQ ID NO: 41406 - RNA, 19 nt, Homo sapiens
caaaccgugcauuauuaua

SEQ ID NO: 41407 - RNA, 19 nt, Homo sapiens
caccaucagugaauuuaag

SEQ ID NO: 41408 - RNA, 19 nt, Homo sapiens
gcgaaaggucugcagauuc

SEQ ID NO: 41409 - RNA, 19 nt, Homo sapiens
ggugcugugucuuuaugaa

SEQ ID NO: 41410 - RNA, 19 nt, Homo sapiens
gaucacaagcacaaaucuu

SEQ ID NO: 41411 - RNA, 19 nt, Homo sapiens
agacuuacccagugaugaa

SEQ ID NO: 41412 - RNA, 19 nt, Homo sapiens
acagugcucuuguugaucu

SEQ ID NO: 41413 - RNA, 19 nt, Homo sapiens
guuaaauguugucuacagu

SEQ ID NO: 41414 - RNA, 19 nt, Homo sapiens
gauggguuguguuaugcuu

SEQ ID NO: 41415 - RNA, 19 nt, Homo sapiens
aacaaacugucauacguau

SEQ ID NO: 41416 - RNA, 19 nt, Homo sapiens
aaauucgcauagaguguaa

SEQ ID NO: 41417 - RNA, 19 nt, Homo sapiens
cgagaugaagauaaggaua

SEQ ID NO: 41418 - RNA, 19 nt, Homo sapiens
caucggaaccauccaagug

SEQ ID NO: 41419 - RNA, 19 nt, Homo sapiens
aaggugauggguuguguua

SEQ ID NO: 41420 - RNA, 19 nt, Homo sapiens
ggaaggaguucguguggaa

SEQ ID NO: 41421 - RNA, 19 nt, Homo sapiens
ggaggugaauguagaaugu

SEQ ID NO: 41422 - RNA, 19 nt, Homo sapiens
ggaaacaucggcuggcuuu

SEQ ID NO: 41423 - RNA, 19 nt, Homo sapiens
gggcuaagauggccacaga

SEQ ID NO: 41424 - RNA, 19 nt, Homo sapiens
uaacagagcuaugacuugu

SEQ ID NO: 41425 - RNA, 19 nt, Homo sapiens
gcaguuucuuucuuuguuu

SEQ ID NO: 41426 - RNA, 19 nt, Homo sapiens
aaccagagcaugaauguua

SEQ ID NO: 41427 - RNA, 19 nt, Homo sapiens
cagaauauccuucaaguuc

SEQ ID NO: 41428 - RNA, 19 nt, Homo sapiens
guuaggagccuuucuaguu

SEQ ID NO: 41429 - RNA, 19 nt, Homo sapiens
aaacgugccugccaauuca

SEQ ID NO: 41430 - RNA, 19 nt, Homo sapiens
gaaaugcaccccuuuguaa

SEQ ID NO: 41431 - RNA, 19 nt, Homo sapiens
ggaguuaggagccuuucua

SEQ ID NO: 41432 - RNA, 19 nt, Homo sapiens
gggaccagcugggccuuua

SEQ ID NO: 41433 - RNA, 19 nt, Homo sapiens
ccuauucccuccucugaaa

SEQ ID NO: 41434 - RNA, 19 nt, Homo sapiens
gaagugaggccuguguuga

SEQ ID NO: 41435 - RNA, 19 nt, Homo sapiens
gaaccuugaugucauuguc

SEQ ID NO: 41436 - RNA, 19 nt, Homo sapiens
gaagcgagaugaagaugcu

SEQ ID NO: 41437 - RNA, 19 nt, Homo sapiens
acagggagcugggcuaaga

SEQ ID NO: 41438 - RNA, 19 nt, Homo sapiens
uucagaagcucaacaaguu

SEQ ID NO: 41439 - RNA, 19 nt, Homo sapiens
ugagaaccuugaugucauu

SEQ ID NO: 41440 - RNA, 19 nt, Homo sapiens
ccacucuccugccugcaua

SEQ ID NO: 41441 - RNA, 19 nt, Homo sapiens
gauaacagagcuaugacuu

SEQ ID NO: 41442 - RNA, 19 nt, Homo sapiens
gugaagcuccugaauguga

SEQ ID NO: 41443 - RNA, 19 nt, Homo sapiens
ggagcaaaccagagcauga

SEQ ID NO: 41444 - RNA, 19 nt, Homo sapiens
acaccgggcuugaugauuc

SEQ ID NO: 41445 - RNA, 19 nt, Homo sapiens
cugaauauccacuuuguuu

SEQ ID NO: 41446 - RNA, 19 nt, Homo sapiens
gaccuaggcugaauaucca

SEQ ID NO: 41447 - RNA, 19 nt, Homo sapiens
cuuggugacuuugaauuua

SEQ ID NO: 41448 - RNA, 19 nt, Homo sapiens
gagcaaaccagagcaugaa

SEQ ID NO: 41449 - RNA, 19 nt, Homo sapiens
auaauggaguccucaacua

SEQ ID NO: 41450 - RNA, 19 nt, Homo sapiens
ggaccagcauguucagaag

SEQ ID NO: 41451 - RNA, 19 nt, Homo sapiens
ggccuucaguuucuuccua

SEQ ID NO: 41452 - RNA, 19 nt, Homo sapiens
gagauggaguuucgcucuu

SEQ ID NO: 41453 - RNA, 19 nt, Homo sapiens
gcauauccccugagaguua

SEQ ID NO: 41454 - RNA, 19 nt, Homo sapiens
gagaugaagaugcugagaa

SEQ ID NO: 41455 - RNA, 19 nt, Homo sapiens
agaugaagaugcugagaau

SEQ ID NO: 41456 - RNA, 19 nt, Homo sapiens
caaacgugccugccaauuc

SEQ ID NO: 41457 - RNA, 19 nt, Homo sapiens
ggaagugaggccuguguug

SEQ ID NO: 41458 - RNA, 19 nt, Homo sapiens
gcacacgcagucucauuug

SEQ ID NO: 41459 - RNA, 19 nt, Homo sapiens
gaauauccuucaaguucca

SEQ ID NO: 41460 - RNA, 19 nt, Homo sapiens
uuaggagccuuucuaguuc

SEQ ID NO: 41461 - RNA, 19 nt, Homo sapiens
aaaucuagccucugaaugu

SEQ ID NO: 41462 - RNA, 19 nt, Homo sapiens
cgacuucagcaguuucuuu

SEQ ID NO: 41463 - RNA, 19 nt, Homo sapiens
caacguggaggugaaugua

SEQ ID NO: 41464 - RNA, 19 nt, Homo sapiens
cugugaagcuccugaaugu

SEQ ID NO: 41465 - RNA, 19 nt, Homo sapiens
caaaccagagcaugaaugu

SEQ ID NO: 41466 - RNA, 19 nt, Homo sapiens
gcaaaccagagcaugaaug

SEQ ID NO: 41467 - RNA, 19 nt, Homo sapiens
uuccaaaucuagccucuga

SEQ ID NO: 41468 - RNA, 19 nt, Homo sapiens
ccggcuaauuucuuucuuu

SEQ ID NO: 41469 - RNA, 19 nt, Homo sapiens
cgccucagguucccgagua

SEQ ID NO: 41470 - RNA, 19 nt, Homo sapiens
cgaggacgcaccaguuuau

SEQ ID NO: 41471 - RNA, 19 nt, Homo sapiens
cggcuaauuucuuucuuuc

SEQ ID NO: 41472 - RNA, 19 nt, Homo sapiens
gaaaugcgggacuggaagu

SEQ ID NO: 41473 - RNA, 19 nt, Homo sapiens
cuacacagucgccaucuug

SEQ ID NO: 41474 - RNA, 19 nt, Homo sapiens
ggcacucccuccuuccauu

SEQ ID NO: 41475 - RNA, 19 nt, Homo sapiens
ugucuuggcuccaucucuu

SEQ ID NO: 41476 - RNA, 19 nt, Homo sapiens
gggaaaugcgggacuggaa

SEQ ID NO: 41477 - RNA, 19 nt, Homo sapiens
cuugaucucucauacuuuc

SEQ ID NO: 41478 - RNA, 19 nt, Homo sapiens
gaaccgggucaucaacuuc

SEQ ID NO: 41479 - RNA, 19 nt, Homo sapiens
ugaaccgggucaucaacuu

SEQ ID NO: 41480 - RNA, 19 nt, Homo sapiens
ccaaaucuagccucugaau

SEQ ID NO: 41481 - RNA, 19 nt, Homo sapiens
uuacaacgacucuauccaa

SEQ ID NO: 41482 - RNA, 19 nt, Homo sapiens
cauacuuucucccugucua

SEQ ID NO: 41483 - RNA, 19 nt, Homo sapiens
caaacuccgcaucaacaaa

SEQ ID NO: 41484 - RNA, 19 nt, Homo sapiens
gauaauggaguccucaacu

SEQ ID NO: 41485 - RNA, 19 nt, Homo sapiens
ggcugaauauccacuuugu

SEQ ID NO: 41486 - RNA, 19 nt, Homo sapiens
gauggaguuucgcucuugu

SEQ ID NO: 41487 - RNA, 19 nt, Homo sapiens
acagagcuaugacuugucu

SEQ ID NO: 41488 - RNA, 19 nt, Homo sapiens
gggugaugcugcagacugu

SEQ ID NO: 41489 - RNA, 19 nt, Homo sapiens
agacugagaaccuugaugu

SEQ ID NO: 41490 - RNA, 19 nt, Homo sapiens
guucagaagcucaacaagu

SEQ ID NO: 41491 - RNA, 19 nt, Homo sapiens
cuucagcaguuucuuucuu

SEQ ID NO: 41492 - RNA, 19 nt, Homo sapiens
gggaccagcauguucagaa

SEQ ID NO: 41493 - RNA, 19 nt, Homo sapiens
guguugacccuuccugaaa

SEQ ID NO: 41494 - RNA, 19 nt, Homo sapiens
cccuugaucucucauacuu

SEQ ID NO: 41495 - RNA, 19 nt, Homo sapiens
cacacgcagucucauuuga

SEQ ID NO: 41496 - RNA, 19 nt, Homo sapiens
gauggccacagaggaguua

SEQ ID NO: 41497 - RNA, 19 nt, Homo sapiens
gcugugaagcuccugaaug

SEQ ID NO: 41498 - RNA, 19 nt, Homo sapiens
ggcaacugcuccggcauug

SEQ ID NO: 41499 - RNA, 19 nt, Homo sapiens
gggcaacugcuccggcauu

SEQ ID NO: 41500 - RNA, 19 nt, Homo sapiens
uucagcaguuucuuucuuu

SEQ ID NO: 41501 - RNA, 19 nt, Homo sapiens
cccagaauauccuucaagu

SEQ ID NO: 41502 - RNA, 19 nt, Homo sapiens
uccuuucucuggcuucuuu

SEQ ID NO: 41503 - RNA, 19 nt, Homo sapiens
uaggcugaauauccacuuu

SEQ ID NO: 41504 - RNA, 19 nt, Homo sapiens
ccgccaacaucgccacaga

SEQ ID NO: 41505 - RNA, 19 nt, Homo sapiens
aauguagaaugucgcauca

SEQ ID NO: 41506 - RNA, 19 nt, Homo sapiens
ccgaggacgcaccaguuua

SEQ ID NO: 41507 - RNA, 19 nt, Homo sapiens
ggucaucaacuucuaugca

SEQ ID NO: 41508 - RNA, 19 nt, Homo sapiens
gcagcccugugucuucauc

SEQ ID NO: 41509 - RNA, 19 nt, Homo sapiens
ggacuccacccacuauggu

SEQ ID NO: 41510 - RNA, 19 nt, Homo sapiens
aucacuaacuccuuccuuu

SEQ ID NO: 41511 - RNA, 19 nt, Homo sapiens
ccagaauauccuucaaguu

SEQ ID NO: 41512 - RNA, 19 nt, Homo sapiens
gccguucugucacccaaau

SEQ ID NO: 41513 - RNA, 19 nt, Homo sapiens
gcgccuggccuucaguuuc

SEQ ID NO: 41514 - RNA, 19 nt, Homo sapiens
agauggaguuucgcucuug

SEQ ID NO: 41515 - RNA, 19 nt, Homo sapiens
ucagcaguuucuuucuuug

SEQ ID NO: 41516 - RNA, 19 nt, Homo sapiens
ccaucuuggugacuuugaa

SEQ ID NO: 41517 - RNA, 19 nt, Homo sapiens
ccugagaguuaucggaagu

SEQ ID NO: 41518 - RNA, 19 nt, Homo sapiens
uguggaugcuccuggaaug

SEQ ID NO: 41519 - RNA, 19 nt, Homo sapiens
gcacucccuccuuccauuc

SEQ ID NO: 41520 - RNA, 19 nt, Homo sapiens
ggaaagaaguaacaguuga

SEQ ID NO: 41521 - RNA, 19 nt, Homo sapiens
gacauuggguuacaucaua

SEQ ID NO: 41522 - RNA, 19 nt, Homo sapiens
gaacagaaggguccaguuu

SEQ ID NO: 41523 - RNA, 19 nt, Homo sapiens
gcaugucaguuuccuauuu

SEQ ID NO: 41524 - RNA, 19 nt, Homo sapiens
gaagauauaccaaauguag

SEQ ID NO: 41525 - RNA, 19 nt, Homo sapiens
uaacaacacugggaaagaa

SEQ ID NO: 41526 - RNA, 19 nt, Homo sapiens
ggaacugccucuuauuuua

SEQ ID NO: 41527 - RNA, 19 nt, Homo sapiens
uaucuuggguucuuuguaa

SEQ ID NO: 41528 - RNA, 19 nt, Homo sapiens
ggauauaacaacugucaua

SEQ ID NO: 41529 - RNA, 19 nt, Homo sapiens
ccaagugucuaaagcuuaa

SEQ ID NO: 41530 - RNA, 19 nt, Homo sapiens
ggaaacccuuguauucuug

SEQ ID NO: 41531 - RNA, 19 nt, Homo sapiens
caacagaguuuuagggaua

SEQ ID NO: 41532 - RNA, 19 nt, Homo sapiens
cagaguaaauguuguguug

SEQ ID NO: 41533 - RNA, 19 nt, Homo sapiens
ugaauuagccucgaucuuu

SEQ ID NO: 41534 - RNA, 19 nt, Homo sapiens
gugaacaccugauuccaaa

SEQ ID NO: 41535 - RNA, 19 nt, Homo sapiens
uugaagaccuuaagaaguu

SEQ ID NO: 41536 - RNA, 19 nt, Homo sapiens
uaccaaauguagcaguuua

SEQ ID NO: 41537 - RNA, 19 nt, Homo sapiens
ggauaucuccacagaguaa

SEQ ID NO: 41538 - RNA, 19 nt, Homo sapiens
aaggauagauuguguuuca

SEQ ID NO: 41539 - RNA, 19 nt, Homo sapiens
ucacagcacgugcauagua

SEQ ID NO: 41540 - RNA, 19 nt, Homo sapiens
ggaugaucgugacaaguuu

SEQ ID NO: 41541 - RNA, 19 nt, Homo sapiens
acagaaggguccaguuuau

SEQ ID NO: 41542 - RNA, 19 nt, Homo sapiens
ggucugauccaacuucgua

SEQ ID NO: 41543 - RNA, 19 nt, Homo sapiens
gaauuagccucgaucuuuu

SEQ ID NO: 41544 - RNA, 19 nt, Homo sapiens
aaaggugugugguacauga

SEQ ID NO: 41545 - RNA, 19 nt, Homo sapiens
aauaugccgugcuauguaa

SEQ ID NO: 41546 - RNA, 19 nt, Homo sapiens
gaguaaauguuguguuguc

SEQ ID NO: 41547 - RNA, 19 nt, Homo sapiens
uaggauaucuccacagagu

SEQ ID NO: 41548 - RNA, 19 nt, Homo sapiens
cuuuauagcugcaagaaau

SEQ ID NO: 41549 - RNA, 19 nt, Homo sapiens
uaaauguuguguugucugu

SEQ ID NO: 41550 - RNA, 19 nt, Homo sapiens
ggauagauuguguuucaaa

SEQ ID NO: 41551 - RNA, 19 nt, Homo sapiens
gaacaccugauuccaaaca

SEQ ID NO: 41552 - RNA, 19 nt, Homo sapiens
gauagauuguguuucaaag

SEQ ID NO: 41553 - RNA, 19 nt, Homo sapiens
ccaaggauagauuguguuu

SEQ ID NO: 41554 - RNA, 19 nt, Homo sapiens
uggcugcacucuucucauu

SEQ ID NO: 41555 - RNA, 19 nt, Homo sapiens
uaauaugccgugcuaugua

SEQ ID NO: 41556 - RNA, 19 nt, Homo sapiens
gccgugcuauguaaauauu

SEQ ID NO: 41557 - RNA, 19 nt, Homo sapiens
guuccuggcugcacucuuc

SEQ ID NO: 41558 - RNA, 19 nt, Homo sapiens
uguguugucugucuucauu

SEQ ID NO: 41559 - RNA, 19 nt, Homo sapiens
guagcaguuuauccucaua

SEQ ID NO: 41560 - RNA, 19 nt, Homo sapiens
gaaggagugccaaggauag

SEQ ID NO: 41561 - RNA, 19 nt, Homo sapiens
guaugaaugauccugauuu

SEQ ID NO: 41562 - RNA, 19 nt, Homo sapiens
cuucaagcaugcaguggua

SEQ ID NO: 41563 - RNA, 19 nt, Homo sapiens
acaguugagugcaagauug

SEQ ID NO: 41564 - RNA, 19 nt, Homo sapiens
caggucagcuuugcuccua

SEQ ID NO: 41565 - RNA, 19 nt, Homo sapiens
gauuaagagcacaaacuuu

SEQ ID NO: 41566 - RNA, 19 nt, Homo sapiens
gcugcacucuucucauuca

SEQ ID NO: 41567 - RNA, 19 nt, Homo sapiens
gggaaagaaguaacaguug

SEQ ID NO: 41568 - RNA, 19 nt, Homo sapiens
gaaggguccaguuuauguu

SEQ ID NO: 41569 - RNA, 19 nt, Homo sapiens
cagaagaaccucacagucu

SEQ ID NO: 41570 - RNA, 19 nt, Homo sapiens
gauuguguuucaaagaaug

SEQ ID NO: 41571 - RNA, 19 nt, Homo sapiens
ugaaggagugccaaggaua

SEQ ID NO: 41572 - RNA, 19 nt, Homo sapiens
caugucaguuuccuauuuc

SEQ ID NO: 41573 - RNA, 19 nt, Homo sapiens
caguuuauguugcauguca

SEQ ID NO: 41574 - RNA, 19 nt, Homo sapiens
acgaugagguuccaaaaua

SEQ ID NO: 41575 - RNA, 19 nt, Homo sapiens
ugugguauguggagaaguu

SEQ ID NO: 41576 - RNA, 19 nt, Homo sapiens
cgaguuauguucaaaauca

SEQ ID NO: 41577 - RNA, 19 nt, Homo sapiens
caacacugggaaagaagua

SEQ ID NO: 41578 - RNA, 19 nt, Homo sapiens
aggaaacccuuguauucuu

SEQ ID NO: 41579 - RNA, 19 nt, Homo sapiens
gccaagugucuaaagcuua

SEQ ID NO: 41580 - RNA, 19 nt, Homo sapiens
ggagugccaaggauagauu

SEQ ID NO: 41581 - RNA, 19 nt, Homo sapiens
gguuugaucuugcucuucu

SEQ ID NO: 41582 - RNA, 19 nt, Homo sapiens
gaucuugcucuucuaccua

SEQ ID NO: 41583 - RNA, 19 nt, Homo sapiens
gaaagaaguaacaguugag

SEQ ID NO: 41584 - RNA, 19 nt, Homo sapiens
uguggacuguaauaaagua

SEQ ID NO: 41585 - RNA, 19 nt, Homo sapiens
aguaggauaucuccacaga

SEQ ID NO: 41586 - RNA, 19 nt, Homo sapiens
cacagcacgugcauaguau

SEQ ID NO: 41587 - RNA, 19 nt, Homo sapiens
gggacgaguuauguucaaa

SEQ ID NO: 41588 - RNA, 19 nt, Homo sapiens
cgauguggguuaugcuuca

SEQ ID NO: 41589 - RNA, 19 nt, Homo sapiens
gugacuaugcaccuaauuu

SEQ ID NO: 41590 - RNA, 19 nt, Homo sapiens
acauuggguuacaucauaa

SEQ ID NO: 41591 - RNA, 19 nt, Homo sapiens
gccaagagcugggguuuga

SEQ ID NO: 41592 - RNA, 19 nt, Homo sapiens
uauaccaaauguagcaguu

SEQ ID NO: 41593 - RNA, 19 nt, Homo sapiens
ugaagaccuuaagaaguuu

SEQ ID NO: 41594 - RNA, 19 nt, Homo sapiens
cagcuuugcuccuaacaac

SEQ ID NO: 41595 - RNA, 19 nt, Homo sapiens
gacuguggacuguaauaaa

SEQ ID NO: 41596 - RNA, 19 nt, Homo sapiens
gagaccaccuuggagaaag

SEQ ID NO: 41597 - RNA, 19 nt, Homo sapiens
aacagaaggguccaguuua

SEQ ID NO: 41598 - RNA, 19 nt, Homo sapiens
gcccaggacucaugguuuu

SEQ ID NO: 41599 - RNA, 19 nt, Homo sapiens
ugcaagaaaugugguaugu

SEQ ID NO: 41600 - RNA, 19 nt, Homo sapiens
uuaauugccaagugucuaa

SEQ ID NO: 41601 - RNA, 19 nt, Homo sapiens
aguguacagucgccagaua

SEQ ID NO: 41602 - RNA, 19 nt, Homo sapiens
uguuggaacugccucuuau

SEQ ID NO: 41603 - RNA, 19 nt, Homo sapiens
uaacgugcuuccagaucau

SEQ ID NO: 41604 - RNA, 19 nt, Homo sapiens
aaaauaccgugaccagauu

SEQ ID NO: 41605 - RNA, 19 nt, Homo sapiens
uucagacucucaacgauga

SEQ ID NO: 41606 - RNA, 19 nt, Homo sapiens
caaaaccagugaccgcauu

SEQ ID NO: 41607 - RNA, 19 nt, Homo sapiens
auaacgugcuuccagauca

SEQ ID NO: 41608 - RNA, 19 nt, Homo sapiens
gguacaugacauuggguua

SEQ ID NO: 41609 - RNA, 19 nt, Homo sapiens
guacauugaagaccuuaag

SEQ ID NO: 41610 - RNA, 19 nt, Homo sapiens
ugauuaagagcacaaacuu

SEQ ID NO: 41611 - RNA, 19 nt, Homo sapiens
ggguuaugcuucagacucu

SEQ ID NO: 41612 - RNA, 19 nt, Homo sapiens
agaaggguccaguuuaugu

SEQ ID NO: 41613 - RNA, 19 nt, Homo sapiens
cgaagaacgagaagaaguc

SEQ ID NO: 41614 - RNA, 19 nt, Homo sapiens
acuguggacuguaauaaag

SEQ ID NO: 41615 - RNA, 19 nt, Homo sapiens
gcuuccagaucauaguguu

SEQ ID NO: 41616 - RNA, 19 nt, Homo sapiens
aaucacagcacgugcauag

SEQ ID NO: 41617 - RNA, 19 nt, Homo sapiens
uauguugcaugucaguuuc

SEQ ID NO: 41618 - RNA, 19 nt, Homo sapiens
gagcugggguuugaucuug

SEQ ID NO: 41619 - RNA, 19 nt, Homo sapiens
agcagacuguggacuguaa

SEQ ID NO: 41620 - RNA, 19 nt, Homo sapiens
gaaggaagcuccagacuca

SEQ ID NO: 41621 - RNA, 19 nt, Homo sapiens
gcaaaucaaugaagaugag

SEQ ID NO: 41622 - RNA, 19 nt, Homo sapiens
gcaggcaaaucaaugaaga

SEQ ID NO: 41623 - RNA, 19 nt, Homo sapiens
caaugaagaugagccguaa

SEQ ID NO: 41624 - RNA, 19 nt, Homo sapiens
ucuccaagcucaaguacaa

SEQ ID NO: 41625 - RNA, 19 nt, Homo sapiens
ugacuggguugucgaugga

SEQ ID NO: 41626 - RNA, 19 nt, Homo sapiens
ccaccucaugcuuauaaua

SEQ ID NO: 41627 - RNA, 19 nt, Homo sapiens
aagaagcgcaggcaaauca

SEQ ID NO: 41628 - RNA, 19 nt, Homo sapiens
aauaagaagcgcaggcaaa

SEQ ID NO: 41629 - RNA, 19 nt, Homo sapiens
ccaagcucaaguacaaaua

SEQ ID NO: 41630 - RNA, 19 nt, Homo sapiens
uaugagaccguucgcaaug

SEQ ID NO: 41631 - RNA, 19 nt, Homo sapiens
ucccugggcuuuagaccuu

SEQ ID NO: 41632 - RNA, 19 nt, Homo sapiens
guucuacuaugacuaugag

SEQ ID NO: 41633 - RNA, 19 nt, Homo sapiens
gaagcgcaggcaaaucaau

SEQ ID NO: 41634 - RNA, 19 nt, Homo sapiens
ccaccagccucuccaagcu

SEQ ID NO: 41635 - RNA, 19 nt, Homo sapiens
ggaagcuccagacucaaug

SEQ ID NO: 41636 - RNA, 19 nt, Homo sapiens
ggacguggacccguucuac

SEQ ID NO: 41637 - RNA, 19 nt, Homo sapiens
gaagcuccagacucaaugu

SEQ ID NO: 41638 - RNA, 19 nt, Homo sapiens
ugccaccucaugcuuauaa

SEQ ID NO: 41639 - RNA, 19 nt, Homo sapiens
uggacccguucuacuauga

SEQ ID NO: 41640 - RNA, 19 nt, Homo sapiens
ggcaaaucaaugaagauga

SEQ ID NO: 41641 - RNA, 19 nt, Homo sapiens
cgugccaccucaugcuuau

SEQ ID NO: 41642 - RNA, 19 nt, Homo sapiens
gaguggaggcagcccauuc

SEQ ID NO: 41643 - RNA, 19 nt, Homo sapiens
aagcucaaguacaaauaca

SEQ ID NO: 41644 - RNA, 19 nt, Homo sapiens
gcgcaggcaaaucaaugaa

SEQ ID NO: 41645 - RNA, 19 nt, Homo sapiens
guggacccguucuacuaug

SEQ ID NO: 41646 - RNA, 19 nt, Homo sapiens
caagcucaaguacaaauac

SEQ ID NO: 41647 - RNA, 19 nt, Homo sapiens
auaagaagcgcaggcaaau

SEQ ID NO: 41648 - RNA, 19 nt, Homo sapiens
gaaggaagcuccagacuca

SEQ ID NO: 41649 - RNA, 19 nt, Homo sapiens
gcaaaucaaugaagaugag

SEQ ID NO: 41650 - RNA, 19 nt, Homo sapiens
gcaggcaaaucaaugaaga

SEQ ID NO: 41651 - RNA, 19 nt, Homo sapiens
caaugaagaugagccguaa

SEQ ID NO: 41652 - RNA, 19 nt, Homo sapiens
ucuccaagcucaaguacaa

SEQ ID NO: 41653 - RNA, 19 nt, Homo sapiens
gcaccucccugcucuucug

SEQ ID NO: 41654 - RNA, 19 nt, Homo sapiens
ccaccucaugcuuauaaua

SEQ ID NO: 41655 - RNA, 19 nt, Homo sapiens
aagaagcgcaggcaaauca

SEQ ID NO: 41656 - RNA, 19 nt, Homo sapiens
aauaagaagcgcaggcaaa

SEQ ID NO: 41657 - RNA, 19 nt, Homo sapiens
ccaagcucaaguacaaaua

SEQ ID NO: 41658 - RNA, 19 nt, Homo sapiens
uaugagaccguucgcaaug

SEQ ID NO: 41659 - RNA, 19 nt, Homo sapiens
ucccugggcuuuagaccuu

SEQ ID NO: 41660 - RNA, 19 nt, Homo sapiens
guucuacuaugacuaugag

SEQ ID NO: 41661 - RNA, 19 nt, Homo sapiens
gaagcgcaggcaaaucaau

SEQ ID NO: 41662 - RNA, 19 nt, Homo sapiens
ccaccagccucuccaagcu

SEQ ID NO: 41663 - RNA, 19 nt, Homo sapiens
ggaagcuccagacucaaug

SEQ ID NO: 41664 - RNA, 19 nt, Homo sapiens
ggacguggacccguucuac

SEQ ID NO: 41665 - RNA, 19 nt, Homo sapiens
gaagcuccagacucaaugu

SEQ ID NO: 41666 - RNA, 19 nt, Homo sapiens
ugccaccucaugcuuauaa

SEQ ID NO: 41667 - RNA, 19 nt, Homo sapiens
ggcaaaucaaugaagauga

SEQ ID NO: 41668 - RNA, 19 nt, Homo sapiens
uggacccguucuacuauga

SEQ ID NO: 41669 - RNA, 19 nt, Homo sapiens
cgugccaccucaugcuuau

SEQ ID NO: 41670 - RNA, 19 nt, Homo sapiens
aagcucaaguacaaauaca

SEQ ID NO: 41671 - RNA, 19 nt, Homo sapiens
gcgcaggcaaaucaaugaa

SEQ ID NO: 41672 - RNA, 19 nt, Homo sapiens
guggacccguucuacuaug

SEQ ID NO: 41673 - RNA, 19 nt, Homo sapiens
caagcucaaguacaaauac

SEQ ID NO: 41674 - RNA, 19 nt, Homo sapiens
auaagaagcgcaggcaaau

SEQ ID NO: 41675 - RNA, 19 nt, Homo sapiens
gcgcugagcugcuuauuua

SEQ ID NO: 41676 - RNA, 19 nt, Homo sapiens
ggaacuaccuagagggaua

SEQ ID NO: 41677 - RNA, 19 nt, Homo sapiens
gaaaguccaugucugucua

SEQ ID NO: 41678 - RNA, 19 nt, Homo sapiens
gcaagauguuuaucauuga

SEQ ID NO: 41679 - RNA, 19 nt, Homo sapiens
gaccaucacugccuuuguu

SEQ ID NO: 41680 - RNA, 19 nt, Homo sapiens
ccaaaggugucuaugagaa

SEQ ID NO: 41681 - RNA, 19 nt, Homo sapiens
ggaggccgcucaugcuaaa

SEQ ID NO: 41682 - RNA, 19 nt, Homo sapiens
caaagucccugcagacauc

SEQ ID NO: 41683 - RNA, 19 nt, Homo sapiens
gaaaauaaacgacggaaaa

SEQ ID NO: 41684 - RNA, 19 nt, Homo sapiens
gaucaaggcucgggacauc

SEQ ID NO: 41685 - RNA, 19 nt, Homo sapiens
gcaagucagugcaaaggau

SEQ ID NO: 41686 - RNA, 19 nt, Homo sapiens
ucacagauccagaagauga

SEQ ID NO: 41687 - RNA, 19 nt, Homo sapiens
gcacagccauugccaucug

SEQ ID NO: 41688 - RNA, 19 nt, Homo sapiens
gcaccgagauugggaagau

SEQ ID NO: 41689 - RNA, 19 nt, Homo sapiens
gcaccucugucaucuguuc

SEQ ID NO: 41690 - RNA, 19 nt, Homo sapiens
ggagaaauacggccucaau

SEQ ID NO: 41691 - RNA, 19 nt, Homo sapiens
caacuucuccaccaucgua

SEQ ID NO: 41692 - RNA, 19 nt, Homo sapiens
gaagauccgagaccaaaug

SEQ ID NO: 41693 - RNA, 19 nt, Homo sapiens
ggaggaauguuuggccuau

SEQ ID NO: 41694 - RNA, 19 nt, Homo sapiens
ugcaagauguuuaucauug

SEQ ID NO: 41695 - RNA, 19 nt, Homo sapiens
agcggaaucuggagaaaua

SEQ ID NO: 41696 - RNA, 19 nt, Homo sapiens
uggaguaccugcaguccua

SEQ ID NO: 41697 - RNA, 19 nt, Homo sapiens
ggacaucugccuccugaau

SEQ ID NO: 41698 - RNA, 19 nt, Homo sapiens
ggacaacacccacuuugag

SEQ ID NO: 41699 - RNA, 19 nt, Homo sapiens
agaaauacggccucaauga

SEQ ID NO: 41700 - RNA, 19 nt, Homo sapiens
ugucaugugucuguuuaua

SEQ ID NO: 41701 - RNA, 19 nt, Homo sapiens
cgugucaugugucuguuua

SEQ ID NO: 41702 - RNA, 19 nt, Homo sapiens
ggccaaaggugucuaugag

SEQ ID NO: 41703 - RNA, 19 nt, Homo sapiens
ugugggagcuggugauaga

SEQ ID NO: 41704 - RNA, 19 nt, Homo sapiens
acaacaacaugaagcaguu

SEQ ID NO: 41705 - RNA, 19 nt, Homo sapiens
caacaagggcacagccauu

SEQ ID NO: 41706 - RNA, 19 nt, Homo sapiens
uggagaagaugaauguguu

SEQ ID NO: 41707 - RNA, 19 nt, Homo sapiens
aggaauguuuggccuauuu

SEQ ID NO: 41708 - RNA, 19 nt, Homo sapiens
gaugagaucacagccauga

SEQ ID NO: 41709 - RNA, 19 nt, Homo sapiens
gcagaagcuggaugaguuu

SEQ ID NO: 41710 - RNA, 19 nt, Homo sapiens
gucuguaucugucaucaaa

SEQ ID NO: 41711 - RNA, 19 nt, Homo sapiens
ugauagagcaguuugaaga

SEQ ID NO: 41712 - RNA, 19 nt, Homo sapiens
gaagaugaaagaaggaagu

SEQ ID NO: 41713 - RNA, 19 nt, Homo sapiens
ugucacagauccagaagau

SEQ ID NO: 41714 - RNA, 19 nt, Homo sapiens
ucauugggcucgacgaaau

SEQ ID NO: 41715 - RNA, 19 nt, Homo sapiens
ggucaucucccucaucugu

SEQ ID NO: 41716 - RNA, 19 nt, Homo sapiens
gggaagauccgagaccaaa

SEQ ID NO: 41717 - RNA, 19 nt, Homo sapiens
ucgaggcccugaaggagua

SEQ ID NO: 41718 - RNA, 19 nt, Homo sapiens
gaagaaacccaggcagaca

SEQ ID NO: 41719 - RNA, 19 nt, Homo sapiens
cgacugcgcugagcugcuu

SEQ ID NO: 41720 - RNA, 19 nt, Homo sapiens
gaaagaaggaagugagcau

SEQ ID NO: 41721 - RNA, 19 nt, Homo sapiens
ccagcugacucacuucaug

SEQ ID NO: 41722 - RNA, 19 nt, Homo sapiens
ucgcacaaguccaagauug

SEQ ID NO: 41723 - RNA, 19 nt, Homo sapiens
ggaauucacccuggaguuc

SEQ ID NO: 41724 - RNA, 19 nt, Homo sapiens
gcugagcugcuuauuuauu

SEQ ID NO: 41725 - RNA, 19 nt, Homo sapiens
gaacuaccuagagggauaa

SEQ ID NO: 41726 - RNA, 19 nt, Homo sapiens
agcagaagcuggaugaguu

SEQ ID NO: 41727 - RNA, 19 nt, Homo sapiens
cugagcugcuuauuuauug

SEQ ID NO: 41728 - RNA, 19 nt, Homo sapiens
gcaaugacuccuccuugga

SEQ ID NO: 41729 - RNA, 19 nt, Homo sapiens
gacaagaagaacaugcuuu

SEQ ID NO: 41730 - RNA, 19 nt, Homo sapiens
gaggacaacacccacuuug

SEQ ID NO: 41731 - RNA, 19 nt, Homo sapiens
ggaugggccucaugucaac

SEQ ID NO: 41732 - RNA, 19 nt, Homo sapiens
gacaggugauggcgucaau

SEQ ID NO: 41733 - RNA, 19 nt, Homo sapiens
gagaaauacggccucaaug

SEQ ID NO: 41734 - RNA, 19 nt, Homo sapiens
uaucaacauuggccacuuc

SEQ ID NO: 41735 - RNA, 19 nt, Homo sapiens
ucgacgaaauccucaaguu

SEQ ID NO: 41736 - RNA, 19 nt, Homo sapiens
caagacugccucugagaug

SEQ ID NO: 41737 - RNA, 19 nt, Homo sapiens
acaucugccuccugaauga

SEQ ID NO: 41738 - RNA, 19 nt, Homo sapiens
ugaagaaggcugagauugg

SEQ ID NO: 41739 - RNA, 19 nt, Homo sapiens
cgacgaaauccucaaguuc

SEQ ID NO: 41740 - RNA, 19 nt, Homo sapiens
gaaaugguccuggaugacu

SEQ ID NO: 41741 - RNA, 19 nt, Homo sapiens
ucauggcggugaucaagga

SEQ ID NO: 41742 - RNA, 19 nt, Homo sapiens
gaagcuugcccuccguaga

SEQ ID NO: 41743 - RNA, 19 nt, Homo sapiens
ggacaagaagaacaugcuu

SEQ ID NO: 41744 - RNA, 19 nt, Homo sapiens
ggaccaaguuaagcggaau

SEQ ID NO: 41745 - RNA, 19 nt, Homo sapiens
guucauccgcuaccucauu

SEQ ID NO: 41746 - RNA, 19 nt, Homo sapiens
gaggaauguuuggccuauu

SEQ ID NO: 41747 - RNA, 19 nt, Homo sapiens
agacggaccugacauucgu

SEQ ID NO: 41748 - RNA, 19 nt, Homo sapiens
cugaaugaguucuccauca

SEQ ID NO: 41749 - RNA, 19 nt, Homo sapiens
ugagcucccugcugaggaa

SEQ ID NO: 41750 - RNA, 19 nt, Homo sapiens
guggcugucuggcuuauca

SEQ ID NO: 41751 - RNA, 19 nt, Homo sapiens
ccacagaacaggacaagac

SEQ ID NO: 41752 - RNA, 19 nt, Homo sapiens
gcacuuccucauccucuau

SEQ ID NO: 41753 - RNA, 19 nt, Homo sapiens
ggacuucaacgaggccaaa

SEQ ID NO: 41754 - RNA, 19 nt, Homo sapiens
caucacugccuuuguugaa

SEQ ID NO: 41755 - RNA, 19 nt, Homo sapiens
uaagcggaaucuggagaaa

SEQ ID NO: 41756 - RNA, 19 nt, Homo sapiens
guucaacacggaugugaga

SEQ ID NO: 41757 - RNA, 19 nt, Homo sapiens
gccaucuacuacuuuaaga

SEQ ID NO: 41758 - RNA, 19 nt, Homo sapiens
gaccgcaagucagugcaaa

SEQ ID NO: 41759 - RNA, 19 nt, Homo sapiens
ccucucaaccuuguaaauu

SEQ ID NO: 41760 - RNA, 19 nt, Homo sapiens
ggugauagagcaguuugaa

SEQ ID NO: 41761 - RNA, 19 nt, Homo sapiens
guggagcccucgcacaagu

SEQ ID NO: 41762 - RNA, 19 nt, Homo sapiens
guccaugucugucuauugc

SEQ ID NO: 41763 - RNA, 19 nt, Homo sapiens
gugauccgccagcuaauga

SEQ ID NO: 41764 - RNA, 19 nt, Homo sapiens
gagcugcuuauuuauugaa

SEQ ID NO: 41765 - RNA, 19 nt, Homo sapiens
caacauuggccacuucaac

SEQ ID NO: 41766 - RNA, 19 nt, Homo sapiens
gaaggugaagagaccauca

SEQ ID NO: 41767 - RNA, 19 nt, Homo sapiens
gcucaugguccucaagauc

SEQ ID NO: 41768 - RNA, 19 nt, Homo sapiens
caggugauggcgucaauga

SEQ ID NO: 41769 - RNA, 19 nt, Homo sapiens
ggagcuggccaccaucugu

SEQ ID NO: 41770 - RNA, 19 nt, Homo sapiens
ccggcgaauuggcaucuuu

SEQ ID NO: 41771 - RNA, 19 nt, Homo sapiens
ucugugcccucugcaauga

SEQ ID NO: 41772 - RNA, 19 nt, Homo sapiens
ugaaugaguucuccaucac

SEQ ID NO: 41773 - RNA, 19 nt, Homo sapiens
gucaugugucuguuuauaa

SEQ ID NO: 41774 - RNA, 19 nt, Homo sapiens
caucgaccgcuguaacuau

SEQ ID NO: 41775 - RNA, 19 nt, Homo sapiens
gcgcugagcugcuuauuua

SEQ ID NO: 41776 - RNA, 19 nt, Homo sapiens
gaaaguccaugucugucua

SEQ ID NO: 41777 - RNA, 19 nt, Homo sapiens
gcaagauguuuaucauuga

SEQ ID NO: 41778 - RNA, 19 nt, Homo sapiens
gaccaucacugccuuuguu

SEQ ID NO: 41779 - RNA, 19 nt, Homo sapiens
ccaaaggugucuaugagaa

SEQ ID NO: 41780 - RNA, 19 nt, Homo sapiens
ggaggccgcucaugcuaaa

SEQ ID NO: 41781 - RNA, 19 nt, Homo sapiens
caaagucccugcagacauc

SEQ ID NO: 41782 - RNA, 19 nt, Homo sapiens
gaaaauaaacgacggaaaa

SEQ ID NO: 41783 - RNA, 19 nt, Homo sapiens
gaucaaggcucgggacauc

SEQ ID NO: 41784 - RNA, 19 nt, Homo sapiens
gcaagucagugcaaaggau

SEQ ID NO: 41785 - RNA, 19 nt, Homo sapiens
gcacagccauugccaucug

SEQ ID NO: 41786 - RNA, 19 nt, Homo sapiens
gcaccgagauugggaagau

SEQ ID NO: 41787 - RNA, 19 nt, Homo sapiens
gcaccucugucaucuguuc

SEQ ID NO: 41788 - RNA, 19 nt, Homo sapiens
ggagaaauacggccucaau

SEQ ID NO: 41789 - RNA, 19 nt, Homo sapiens
caacuucuccaccaucgua

SEQ ID NO: 41790 - RNA, 19 nt, Homo sapiens
gaagauccgagaccaaaug

SEQ ID NO: 41791 - RNA, 19 nt, Homo sapiens
ggaggaauguuuggccuau

SEQ ID NO: 41792 - RNA, 19 nt, Homo sapiens
ugcaagauguuuaucauug

SEQ ID NO: 41793 - RNA, 19 nt, Homo sapiens
agcggaaucuggagaaaua

SEQ ID NO: 41794 - RNA, 19 nt, Homo sapiens
uggaguaccugcaguccua

SEQ ID NO: 41795 - RNA, 19 nt, Homo sapiens
ggacaucugccuccugaau

SEQ ID NO: 41796 - RNA, 19 nt, Homo sapiens
ggacaacacccacuuugag

SEQ ID NO: 41797 - RNA, 19 nt, Homo sapiens
agaaauacggccucaauga

SEQ ID NO: 41798 - RNA, 19 nt, Homo sapiens
ugucaugugucuguuuaua

SEQ ID NO: 41799 - RNA, 19 nt, Homo sapiens
cgugucaugugucuguuua

SEQ ID NO: 41800 - RNA, 19 nt, Homo sapiens
ggccaaaggugucuaugag

SEQ ID NO: 41801 - RNA, 19 nt, Homo sapiens
ugugggagcuggugauaga

SEQ ID NO: 41802 - RNA, 19 nt, Homo sapiens
acaacaacaugaagcaguu

SEQ ID NO: 41803 - RNA, 19 nt, Homo sapiens
caacaagggcacagccauu

SEQ ID NO: 41804 - RNA, 19 nt, Homo sapiens
uggagaagaugaauguguu

SEQ ID NO: 41805 - RNA, 19 nt, Homo sapiens
aggaauguuuggccuauuu

SEQ ID NO: 41806 - RNA, 19 nt, Homo sapiens
gaugagaucacagccauga

SEQ ID NO: 41807 - RNA, 19 nt, Homo sapiens
gcagaagcuggaugaguuu

SEQ ID NO: 41808 - RNA, 19 nt, Homo sapiens
gucuguaucugucaucaaa

SEQ ID NO: 41809 - RNA, 19 nt, Homo sapiens
ugauagagcaguuugaaga

SEQ ID NO: 41810 - RNA, 19 nt, Homo sapiens
gaagaugaaagaaggaagu

SEQ ID NO: 41811 - RNA, 19 nt, Homo sapiens
ucauugggcucgacgaaau

SEQ ID NO: 41812 - RNA, 19 nt, Homo sapiens
ggucaucucccucaucugu

SEQ ID NO: 41813 - RNA, 19 nt, Homo sapiens
gggaagauccgagaccaaa

SEQ ID NO: 41814 - RNA, 19 nt, Homo sapiens
ucgaggcccugaaggagua

SEQ ID NO: 41815 - RNA, 19 nt, Homo sapiens
gaagaaacccaggcagaca

SEQ ID NO: 41816 - RNA, 19 nt, Homo sapiens
cgacugcgcugagcugcuu

SEQ ID NO: 41817 - RNA, 19 nt, Homo sapiens
gaaagaaggaagugagcau

SEQ ID NO: 41818 - RNA, 19 nt, Homo sapiens
ccagcugacucacuucaug

SEQ ID NO: 41819 - RNA, 19 nt, Homo sapiens
ucgcacaaguccaagauug

SEQ ID NO: 41820 - RNA, 19 nt, Homo sapiens
ggaauucacccuggaguuc

SEQ ID NO: 41821 - RNA, 19 nt, Homo sapiens
gcugagcugcuuauuuauu

SEQ ID NO: 41822 - RNA, 19 nt, Homo sapiens
agcagaagcuggaugaguu

SEQ ID NO: 41823 - RNA, 19 nt, Homo sapiens
cugagcugcuuauuuauug

SEQ ID NO: 41824 - RNA, 19 nt, Homo sapiens
gcaaugacuccuccuugga

SEQ ID NO: 41825 - RNA, 19 nt, Homo sapiens
gacaagaagaacaugcuuu

SEQ ID NO: 41826 - RNA, 19 nt, Homo sapiens
ccuagaggauccagaagau

SEQ ID NO: 41827 - RNA, 19 nt, Homo sapiens
uagaggauccagaagauga

SEQ ID NO: 41828 - RNA, 19 nt, Homo sapiens
gaggacaacacccacuuug

SEQ ID NO: 41829 - RNA, 19 nt, Homo sapiens
ggaugggccucaugucaac

SEQ ID NO: 41830 - RNA, 19 nt, Homo sapiens
gacaggugauggcgucaau

SEQ ID NO: 41831 - RNA, 19 nt, Homo sapiens
uaucaacauuggccacuuc

SEQ ID NO: 41832 - RNA, 19 nt, Homo sapiens
gagaaauacggccucaaug

SEQ ID NO: 41833 - RNA, 19 nt, Homo sapiens
ucgacgaaauccucaaguu

SEQ ID NO: 41834 - RNA, 19 nt, Homo sapiens
caagacugccucugagaug

SEQ ID NO: 41835 - RNA, 19 nt, Homo sapiens
acaucugccuccugaauga

SEQ ID NO: 41836 - RNA, 19 nt, Homo sapiens
ugaagaaggcugagauugg

SEQ ID NO: 41837 - RNA, 19 nt, Homo sapiens
cgacgaaauccucaaguuc

SEQ ID NO: 41838 - RNA, 19 nt, Homo sapiens
gaaaugguccuggaugacu

SEQ ID NO: 41839 - RNA, 19 nt, Homo sapiens
ucauggcggugaucaagga

SEQ ID NO: 41840 - RNA, 19 nt, Homo sapiens
gaagcuugcccuccguaga

SEQ ID NO: 41841 - RNA, 19 nt, Homo sapiens
ggacaagaagaacaugcuu

SEQ ID NO: 41842 - RNA, 19 nt, Homo sapiens
guucauccgcuaccucauu

SEQ ID NO: 41843 - RNA, 19 nt, Homo sapiens
ugagcucccugcugaggaa

SEQ ID NO: 41844 - RNA, 19 nt, Homo sapiens
agacggaccugacauucgu

SEQ ID NO: 41845 - RNA, 19 nt, Homo sapiens
ggaccaaguuaagcggaau

SEQ ID NO: 41846 - RNA, 19 nt, Homo sapiens
cugaaugaguucuccauca

SEQ ID NO: 41847 - RNA, 19 nt, Homo sapiens
guggcugucuggcuuauca

SEQ ID NO: 41848 - RNA, 19 nt, Homo sapiens
gaggaauguuuggccuauu

SEQ ID NO: 41849 - RNA, 19 nt, Homo sapiens
ccacagaacaggacaagac

SEQ ID NO: 41850 - RNA, 19 nt, Homo sapiens
gcacuuccucauccucuau

SEQ ID NO: 41851 - RNA, 19 nt, Homo sapiens
ggacuucaacgaggccaaa

SEQ ID NO: 41852 - RNA, 19 nt, Homo sapiens
caucacugccuuuguugaa

SEQ ID NO: 41853 - RNA, 19 nt, Homo sapiens
guucaacacggaugugaga

SEQ ID NO: 41854 - RNA, 19 nt, Homo sapiens
gccaucuacuacuuuaaga

SEQ ID NO: 41855 - RNA, 19 nt, Homo sapiens
uaagcggaaucuggagaaa

SEQ ID NO: 41856 - RNA, 19 nt, Homo sapiens
gaccgcaagucagugcaaa

SEQ ID NO: 41857 - RNA, 19 nt, Homo sapiens
ccucucaaccuuguaaauu

SEQ ID NO: 41858 - RNA, 19 nt, Homo sapiens
ggauccagaagaugaaaga

SEQ ID NO: 41859 - RNA, 19 nt, Homo sapiens
guggagcccucgcacaagu

SEQ ID NO: 41860 - RNA, 19 nt, Homo sapiens
guccaugucugucuauugc

SEQ ID NO: 41861 - RNA, 19 nt, Homo sapiens
gugauccgccagcuaauga

SEQ ID NO: 41862 - RNA, 19 nt, Homo sapiens
ggugauagagcaguuugaa

SEQ ID NO: 41863 - RNA, 19 nt, Homo sapiens
gagcugcuuauuuauugaa

SEQ ID NO: 41864 - RNA, 19 nt, Homo sapiens
caacauuggccacuucaac

SEQ ID NO: 41865 - RNA, 19 nt, Homo sapiens
gaaggugaagagaccauca

SEQ ID NO: 41866 - RNA, 19 nt, Homo sapiens
gcucaugguccucaagauc

SEQ ID NO: 41867 - RNA, 19 nt, Homo sapiens
caggugauggcgucaauga

SEQ ID NO: 41868 - RNA, 19 nt, Homo sapiens
ggagcuggccaccaucugu

SEQ ID NO: 41869 - RNA, 19 nt, Homo sapiens
ccggcgaauuggcaucuuu

SEQ ID NO: 41870 - RNA, 19 nt, Homo sapiens
ucugugcccucugcaauga

SEQ ID NO: 41871 - RNA, 19 nt, Homo sapiens
ugaaugaguucuccaucac

SEQ ID NO: 41872 - RNA, 19 nt, Homo sapiens
gucaugugucuguuuauaa

SEQ ID NO: 41873 - RNA, 19 nt, Homo sapiens
caucgaccgcuguaacuau

SEQ ID NO: 41874 - RNA, 19 nt, Homo sapiens
gggcugcugugggcaacaa

SEQ ID NO: 41875 - RNA, 19 nt, Homo sapiens
gaaagucaaugucgguuua

SEQ ID NO: 41876 - RNA, 19 nt, Homo sapiens
caaaguuccugcugauaua

SEQ ID NO: 41877 - RNA, 19 nt, Homo sapiens
gagaucaguuuguuucuuu

SEQ ID NO: 41878 - RNA, 19 nt, Homo sapiens
gagaagaaaugcaccuuga

SEQ ID NO: 41879 - RNA, 19 nt, Homo sapiens
aaagucaucucccuuauuu

SEQ ID NO: 41880 - RNA, 19 nt, Homo sapiens
gaacaggucaagaagcuua

SEQ ID NO: 41881 - RNA, 19 nt, Homo sapiens
gaucagaggugcuauuuac

SEQ ID NO: 41882 - RNA, 19 nt, Homo sapiens
ggugauacuuguucccuua

SEQ ID NO: 41883 - RNA, 19 nt, Homo sapiens
caucaaaucuaccacacua

SEQ ID NO: 41884 - RNA, 19 nt, Homo sapiens
gcauaaagaugauaaacca

SEQ ID NO: 41885 - RNA, 19 nt, Homo sapiens
gaaggugaagaaacaauua

SEQ ID NO: 41886 - RNA, 19 nt, Homo sapiens
ugaagaaggugaagaaaca

SEQ ID NO: 41887 - RNA, 19 nt, Homo sapiens
aaacauugcugcugggaaa

SEQ ID NO: 41888 - RNA, 19 nt, Homo sapiens
gaucaugucugucauucga

SEQ ID NO: 41889 - RNA, 19 nt, Homo sapiens
ucgaagcccuuaaggaaua

SEQ ID NO: 41890 - RNA, 19 nt, Homo sapiens
ggaaagaaaugcugaaaau

SEQ ID NO: 41891 - RNA, 19 nt, Homo sapiens
ccagaucccucuccaguga

SEQ ID NO: 41892 - RNA, 19 nt, Homo sapiens
ggaaauguguauuaccaau

SEQ ID NO: 41893 - RNA, 19 nt, Homo sapiens
gaucuggacaucaugaaua

SEQ ID NO: 41894 - RNA, 19 nt, Homo sapiens
gauauaagguuaacuucca

SEQ ID NO: 41895 - RNA, 19 nt, Homo sapiens
ugaggacucugccaacuuu

SEQ ID NO: 41896 - RNA, 19 nt, Homo sapiens
gcaacucagucauuaaaca

SEQ ID NO: 41897 - RNA, 19 nt, Homo sapiens
gaacaccccuucagcaaaa

SEQ ID NO: 41898 - RNA, 19 nt, Homo sapiens
ggacaucaaugagcaagau

SEQ ID NO: 41899 - RNA, 19 nt, Homo sapiens
uuugaagacuugcuaguua

SEQ ID NO: 41900 - RNA, 19 nt, Homo sapiens
gaagggugcuccugaaggu

SEQ ID NO: 41901 - RNA, 19 nt, Homo sapiens
gagaagugcauaaagauga

SEQ ID NO: 41902 - RNA, 19 nt, Homo sapiens
gaggaaauguguauuacca

SEQ ID NO: 41903 - RNA, 19 nt, Homo sapiens
gacagcagcccuuggauuu

SEQ ID NO: 41904 - RNA, 19 nt, Homo sapiens
gcaaaggguguguaugaaa

SEQ ID NO: 41905 - RNA, 19 nt, Homo sapiens
aagguuaacuuccaucaaa

SEQ ID NO: 41906 - RNA, 19 nt, Homo sapiens
caacucacuuuguguuaug

SEQ ID NO: 41907 - RNA, 19 nt, Homo sapiens
ggacaacccggacuuugaa

SEQ ID NO: 41908 - RNA, 19 nt, Homo sapiens
gacaagacugguacacuua

SEQ ID NO: 41909 - RNA, 19 nt, Homo sapiens
guaaauagagaucaguuug

SEQ ID NO: 41910 - RNA, 19 nt, Homo sapiens
gacagauguuggugcaaua

SEQ ID NO: 41911 - RNA, 19 nt, Homo sapiens
guacuaagguuccuaugac

SEQ ID NO: 41912 - RNA, 19 nt, Homo sapiens
caacaaaccagaugucagu

SEQ ID NO: 41913 - RNA, 19 nt, Homo sapiens
agacaagacugguacacuu

SEQ ID NO: 41914 - RNA, 19 nt, Homo sapiens
gaggugcuauuuacuacuu

SEQ ID NO: 41915 - RNA, 19 nt, Homo sapiens
ggaguuaacaccgaaauug

SEQ ID NO: 41916 - RNA, 19 nt, Homo sapiens
caucgaagcccuuaaggaa

SEQ ID NO: 41917 - RNA, 19 nt, Homo sapiens
agacaugguuucagguaaa

SEQ ID NO: 41918 - RNA, 19 nt, Homo sapiens
ggaguaaccgcuuccuaaa

SEQ ID NO: 41919 - RNA, 19 nt, Homo sapiens
cuacagguguugaaugguu

SEQ ID NO: 41920 - RNA, 19 nt, Homo sapiens
uaacuuccaucaaaucuac

SEQ ID NO: 41921 - RNA, 19 nt, Homo sapiens
cauaguuccuggugauauu

SEQ ID NO: 41922 - RNA, 19 nt, Homo sapiens
gcgcauguuugacuuuaga

SEQ ID NO: 41923 - RNA, 19 nt, Homo sapiens
gacaacuucuccaccauug

SEQ ID NO: 41924 - RNA, 19 nt, Homo sapiens
gaagaucaugucugucauu

SEQ ID NO: 41925 - RNA, 19 nt, Homo sapiens
guagagaagaugaauguau

SEQ ID NO: 41926 - RNA, 19 nt, Homo sapiens
ucacuugccuaguagagaa

SEQ ID NO: 41927 - RNA, 19 nt, Homo sapiens
gcagaaauguaaggguguu

SEQ ID NO: 41928 - RNA, 19 nt, Homo sapiens
gaauugaagggucuuucua

SEQ ID NO: 41929 - RNA, 19 nt, Homo sapiens
gaugauaaaccagugaauu

SEQ ID NO: 41930 - RNA, 19 nt, Homo sapiens
ugacaaaguuccugcugau

SEQ ID NO: 41931 - RNA, 19 nt, Homo sapiens
acaacaacaugaaacaguu

SEQ ID NO: 41932 - RNA, 19 nt, Homo sapiens
ccacaagucuaaaaucgua

SEQ ID NO: 41933 - RNA, 19 nt, Homo sapiens
gaagggucuuucuaaaaua

SEQ ID NO: 41934 - RNA, 19 nt, Homo sapiens
ugaauugucaccaguauga

SEQ ID NO: 41935 - RNA, 19 nt, Homo sapiens
ggugcuauuuacuacuuua

SEQ ID NO: 41936 - RNA, 19 nt, Homo sapiens
guaacgcccucaacagcuu

SEQ ID NO: 41937 - RNA, 19 nt, Homo sapiens
ccaagcaggacaucaauga

SEQ ID NO: 41938 - RNA, 19 nt, Homo sapiens
gauacuuguucccuuaaug

SEQ ID NO: 41939 - RNA, 19 nt, Homo sapiens
gcagucuggaucauaaaua

SEQ ID NO: 41940 - RNA, 19 nt, Homo sapiens
ccaaagucaucucccuuau

SEQ ID NO: 41941 - RNA, 19 nt, Homo sapiens
guggaggaaauguguauua

SEQ ID NO: 41942 - RNA, 19 nt, Homo sapiens
ggcgcucucuguucuagua

SEQ ID NO: 41943 - RNA, 19 nt, Homo sapiens
ugagcaagauguuugugaa

SEQ ID NO: 41944 - RNA, 19 nt, Homo sapiens
caauuugugcucuuuguaa

SEQ ID NO: 41945 - RNA, 19 nt, Homo sapiens
gaaucugucucugucauca

SEQ ID NO: 41946 - RNA, 19 nt, Homo sapiens
ggaauaugagccugaaaug

SEQ ID NO: 41947 - RNA, 19 nt, Homo sapiens
gaacccaaaggaaccauug

SEQ ID NO: 41948 - RNA, 19 nt, Homo sapiens
gcuauuucgcacuguauua

SEQ ID NO: 41949 - RNA, 19 nt, Homo sapiens
gaaguuugguuucuuugcu

SEQ ID NO: 41950 - RNA, 19 nt, Homo sapiens
gaaauguguauuaccaaug

SEQ ID NO: 41951 - RNA, 19 nt, Homo sapiens
gcacugcuguggccaucug

SEQ ID NO: 41952 - RNA, 19 nt, Homo sapiens
ggacucugccaacuuuauu

SEQ ID NO: 41953 - RNA, 19 nt, Homo sapiens
caaugucgguuuacuguac

SEQ ID NO: 41954 - RNA, 19 nt, Homo sapiens
caacagaacaggagagaac

SEQ ID NO: 41955 - RNA, 19 nt, Homo sapiens
agaaacaauuacagccuuu

SEQ ID NO: 41956 - RNA, 19 nt, Homo sapiens
ccaaaggaaccauugauca

SEQ ID NO: 41957 - RNA, 19 nt, Homo sapiens
ucaaugagcaagauguuug

SEQ ID NO: 41958 - RNA, 19 nt, Homo sapiens
caaaggguguguaugaaaa

SEQ ID NO: 41959 - RNA, 19 nt, Homo sapiens
caaagucaucucccuuauu

SEQ ID NO: 41960 - RNA, 19 nt, Homo sapiens
agacauaguuccuggugau

SEQ ID NO: 41961 - RNA, 19 nt, Homo sapiens
gaaaucagaagcaguagac

SEQ ID NO: 41962 - RNA, 19 nt, Homo sapiens
aaugaaaucagaagcagua

SEQ ID NO: 41963 - RNA, 19 nt, Homo sapiens
augaggcucuguaaccuua

SEQ ID NO: 41964 - RNA, 19 nt, Homo sapiens
cucaacagcuuguccgaaa

SEQ ID NO: 41965 - RNA, 19 nt, Homo sapiens
cgaguuaccggcugaagaa

SEQ ID NO: 41966 - RNA, 19 nt, Homo sapiens
gaaguacuaagguuccuau

SEQ ID NO: 41967 - RNA, 19 nt, Homo sapiens
gccugcaacucagucauua

SEQ ID NO: 41968 - RNA, 19 nt, Homo sapiens
ggcaaaggguguguaugaa

SEQ ID NO: 41969 - RNA, 19 nt, Homo sapiens
uaaugacucugcuuuggau

SEQ ID NO: 41970 - RNA, 19 nt, Homo sapiens
ucagaggugcuauuuacua

SEQ ID NO: 41971 - RNA, 19 nt, Homo sapiens
ugaaaugggcaaaguguau

SEQ ID NO: 41972 - RNA, 19 nt, Homo sapiens
cuguacaguuugcuuauuu

SEQ ID NO: 41973 - RNA, 19 nt, Homo sapiens
gaggaaugaggcucuguaa

SEQ ID NO: 41974 - RNA, 19 nt, Homo sapiens
ccaacucacuuuguguuau

SEQ ID NO: 41975 - RNA, 19 nt, Homo sapiens
gaaagucaaugucgguuua

SEQ ID NO: 41976 - RNA, 19 nt, Homo sapiens
caaaguuccugcugauaua

SEQ ID NO: 41977 - RNA, 19 nt, Homo sapiens
gagaagaaaugcaccuuga

SEQ ID NO: 41978 - RNA, 19 nt, Homo sapiens
aaagucaucucccuuauuu

SEQ ID NO: 41979 - RNA, 19 nt, Homo sapiens
gaacaggucaagaagcuua

SEQ ID NO: 41980 - RNA, 19 nt, Homo sapiens
gaucagaggugcuauuuac

SEQ ID NO: 41981 - RNA, 19 nt, Homo sapiens
uaaagcaacugucuauuuc

SEQ ID NO: 41982 - RNA, 19 nt, Homo sapiens
ccgcuuggcuucuucuuua

SEQ ID NO: 41983 - RNA, 19 nt, Homo sapiens
ggugauacuuguucccuua

SEQ ID NO: 41984 - RNA, 19 nt, Homo sapiens
caucaaaucuaccacacua

SEQ ID NO: 41985 - RNA, 19 nt, Homo sapiens
gcauaaagaugauaaacca

SEQ ID NO: 41986 - RNA, 19 nt, Homo sapiens
gaaggugaagaaacaauua

SEQ ID NO: 41987 - RNA, 19 nt, Homo sapiens
ugaagaaggugaagaaaca

SEQ ID NO: 41988 - RNA, 19 nt, Homo sapiens
aaacauugcugcugggaaa

SEQ ID NO: 41989 - RNA, 19 nt, Homo sapiens
gaucaugucugucauucga

SEQ ID NO: 41990 - RNA, 19 nt, Homo sapiens
ucgaagcccuuaaggaaua

SEQ ID NO: 41991 - RNA, 19 nt, Homo sapiens
ggaaagaaaugcugaaaau

SEQ ID NO: 41992 - RNA, 19 nt, Homo sapiens
uagcauguauugugucuuu

SEQ ID NO: 41993 - RNA, 19 nt, Homo sapiens
guacagagaacuaacacua

SEQ ID NO: 41994 - RNA, 19 nt, Homo sapiens
gaucuggacaucaugaaua

SEQ ID NO: 41995 - RNA, 19 nt, Homo sapiens
gauauaagguuaacuucca

SEQ ID NO: 41996 - RNA, 19 nt, Homo sapiens
ugaggacucugccaacuuu

SEQ ID NO: 41997 - RNA, 19 nt, Homo sapiens
gcaacucagucauuaaaca

SEQ ID NO: 41998 - RNA, 19 nt, Homo sapiens
gaacaccccuucagcaaaa

SEQ ID NO: 41999 - RNA, 19 nt, Homo sapiens
ggacaucaaugagcaagau

SEQ ID NO: 42000 - RNA, 19 nt, Homo sapiens
uuugaagacuugcuaguua

SEQ ID NO: 42001 - RNA, 19 nt, Homo sapiens
gaagggugcuccugaaggu

SEQ ID NO: 42002 - RNA, 19 nt, Homo sapiens
gagaagugcauaaagauga

SEQ ID NO: 42003 - RNA, 19 nt, Homo sapiens
gcaugaugauccggauuua

SEQ ID NO: 42004 - RNA, 19 nt, Homo sapiens
acagagaacuaacacuauu

SEQ ID NO: 42005 - RNA, 19 nt, Homo sapiens
gacagcagcccuuggauuu

SEQ ID NO: 42006 - RNA, 19 nt, Homo sapiens
gcaaaggguguguaugaaa

SEQ ID NO: 42007 - RNA, 19 nt, Homo sapiens
aagguuaacuuccaucaaa

SEQ ID NO: 42008 - RNA, 19 nt, Homo sapiens
ggacaacccggacuuugaa

SEQ ID NO: 42009 - RNA, 19 nt, Homo sapiens
gacaagacugguacacuua

SEQ ID NO: 42010 - RNA, 19 nt, Homo sapiens
gaaaugaaugugugugguu

SEQ ID NO: 42011 - RNA, 19 nt, Homo sapiens
guacuaagguuccuaugac

SEQ ID NO: 42012 - RNA, 19 nt, Homo sapiens
caacaaaccagaugucagu

SEQ ID NO: 42013 - RNA, 19 nt, Homo sapiens
agacaagacugguacacuu

SEQ ID NO: 42014 - RNA, 19 nt, Homo sapiens
gaggugcuauuuacuacuu

SEQ ID NO: 42015 - RNA, 19 nt, Homo sapiens
ggaguuaacaccgaaauug

SEQ ID NO: 42016 - RNA, 19 nt, Homo sapiens
caucgaagcccuuaaggaa

SEQ ID NO: 42017 - RNA, 19 nt, Homo sapiens
caacauugccuauuucagu

SEQ ID NO: 42018 - RNA, 19 nt, Homo sapiens
uaacuuccaucaaaucuac

SEQ ID NO: 42019 - RNA, 19 nt, Homo sapiens
cauaguuccuggugauauu

SEQ ID NO: 42020 - RNA, 19 nt, Homo sapiens
gacaacuucuccaccauug

SEQ ID NO: 42021 - RNA, 19 nt, Homo sapiens
gaagaucaugucugucauu

SEQ ID NO: 42022 - RNA, 19 nt, Homo sapiens
guagagaagaugaauguau

SEQ ID NO: 42023 - RNA, 19 nt, Homo sapiens
ucacuugccuaguagagaa

SEQ ID NO: 42024 - RNA, 19 nt, Homo sapiens
gaauugaagggucuuucua

SEQ ID NO: 42025 - RNA, 19 nt, Homo sapiens
gaugauaaaccagugaauu

SEQ ID NO: 42026 - RNA, 19 nt, Homo sapiens
ugacaaaguuccugcugau

SEQ ID NO: 42027 - RNA, 19 nt, Homo sapiens
gaugauccggauuuaauuu

SEQ ID NO: 42028 - RNA, 19 nt, Homo sapiens
ccauugacauguacagaga

SEQ ID NO: 42029 - RNA, 19 nt, Homo sapiens
acaacaacaugaaacaguu

SEQ ID NO: 42030 - RNA, 19 nt, Homo sapiens
ccacaagucuaaaaucgua

SEQ ID NO: 42031 - RNA, 19 nt, Homo sapiens
gaagggucuuucuaaaaua

SEQ ID NO: 42032 - RNA, 19 nt, Homo sapiens
ugaauugucaccaguauga

SEQ ID NO: 42033 - RNA, 19 nt, Homo sapiens
ggugcuauuuacuacuuua

SEQ ID NO: 42034 - RNA, 19 nt, Homo sapiens
guaacgcccucaacagcuu

SEQ ID NO: 42035 - RNA, 19 nt, Homo sapiens
ccaagcaggacaucaauga

SEQ ID NO: 42036 - RNA, 19 nt, Homo sapiens
gauacuuguucccuuaaug

SEQ ID NO: 42037 - RNA, 19 nt, Homo sapiens
gcagucuggaucauaaaua

SEQ ID NO: 42038 - RNA, 19 nt, Homo sapiens
ccaaagucaucucccuuau

SEQ ID NO: 42039 - RNA, 19 nt, Homo sapiens
ggcgcucucuguucuagua

SEQ ID NO: 42040 - RNA, 19 nt, Homo sapiens
ugagcaagauguuugugaa

SEQ ID NO: 42041 - RNA, 19 nt, Homo sapiens
caauuugugcucuuuguaa

SEQ ID NO: 42042 - RNA, 19 nt, Homo sapiens
gaaucugucucugucauca

SEQ ID NO: 42043 - RNA, 19 nt, Homo sapiens
ggaauaugagccugaaaug

SEQ ID NO: 42044 - RNA, 19 nt, Homo sapiens
gucuauuucugcugaauuu

SEQ ID NO: 42045 - RNA, 19 nt, Homo sapiens
gaacccaaaggaaccauug

SEQ ID NO: 42046 - RNA, 19 nt, Homo sapiens
gcacugcuguggccaucug

SEQ ID NO: 42047 - RNA, 19 nt, Homo sapiens
ggacucugccaacuuuauu

SEQ ID NO: 42048 - RNA, 19 nt, Homo sapiens
caaugucgguuuacuguac

SEQ ID NO: 42049 - RNA, 19 nt, Homo sapiens
caacagaacaggagagaac

SEQ ID NO: 42050 - RNA, 19 nt, Homo sapiens
agaaacaauuacagccuuu

SEQ ID NO: 42051 - RNA, 19 nt, Homo sapiens
cauacuggcuggugaugga

SEQ ID NO: 42052 - RNA, 19 nt, Homo sapiens
ccaaaggaaccauugauca

SEQ ID NO: 42053 - RNA, 19 nt, Homo sapiens
ucaaugagcaagauguuug

SEQ ID NO: 42054 - RNA, 19 nt, Homo sapiens
caaaggguguguaugaaaa

SEQ ID NO: 42055 - RNA, 19 nt, Homo sapiens
caaagucaucucccuuauu

SEQ ID NO: 42056 - RNA, 19 nt, Homo sapiens
agacauaguuccuggugau

SEQ ID NO: 42057 - RNA, 19 nt, Homo sapiens
cuacuucccucacccacuu

SEQ ID NO: 42058 - RNA, 19 nt, Homo sapiens
cgaguuaccggcugaagaa

SEQ ID NO: 42059 - RNA, 19 nt, Homo sapiens
uagcacagacacuaacuuu

SEQ ID NO: 42060 - RNA, 19 nt, Homo sapiens
gggauuuccuggccguuug

SEQ ID NO: 42061 - RNA, 19 nt, Homo sapiens
cucaacagcuuguccgaaa

SEQ ID NO: 42062 - RNA, 19 nt, Homo sapiens
gaaguacuaagguuccuau

SEQ ID NO: 42063 - RNA, 19 nt, Homo sapiens
gccugcaacucagucauua

SEQ ID NO: 42064 - RNA, 19 nt, Homo sapiens
ggcaaaggguguguaugaa

SEQ ID NO: 42065 - RNA, 19 nt, Homo sapiens
uaaugacucugcuuuggau

SEQ ID NO: 42066 - RNA, 19 nt, Homo sapiens
ucagaggugcuauuuacua

SEQ ID NO: 42067 - RNA, 19 nt, Homo sapiens
ugaaaugggcaaaguguau

SEQ ID NO: 42068 - RNA, 19 nt, Homo sapiens
uugccaacauugccuauuu

SEQ ID NO: 42069 - RNA, 19 nt, Homo sapiens
aaaugaaugugugugguuu

SEQ ID NO: 42070 - RNA, 19 nt, Homo sapiens
guucuggucuugacugaca

SEQ ID NO: 42071 - RNA, 19 nt, Homo sapiens
uugaugagauuacagcuau

SEQ ID NO: 42072 - RNA, 19 nt, Homo sapiens
ggagaagugcauaaagaug

SEQ ID NO: 42073 - RNA, 19 nt, Homo sapiens
uaccauaacuggaucaacu

SEQ ID NO: 42074 - RNA, 19 nt, Homo sapiens
cagucuggaucauaaauau

SEQ ID NO: 42075 - RNA, 19 nt, Homo sapiens
gaaaggaugucacuaagga

SEQ ID NO: 42076 - RNA, 19 nt, Homo sapiens
ggaaauccauguccgugua

SEQ ID NO: 42077 - RNA, 19 nt, Homo sapiens
ccaacgagcucccgaguga

SEQ ID NO: 42078 - RNA, 19 nt, Homo sapiens
gcagcaaguuugugcagua

SEQ ID NO: 42079 - RNA, 19 nt, Homo sapiens
gaagauggccucugaugga

SEQ ID NO: 42080 - RNA, 19 nt, Homo sapiens
gcagcaagauguuugugaa

SEQ ID NO: 42081 - RNA, 19 nt, Homo sapiens
gaacacgucauaucagaug

SEQ ID NO: 42082 - RNA, 19 nt, Homo sapiens
gcuguuugguagagaaaua

SEQ ID NO: 42083 - RNA, 19 nt, Homo sapiens
ucacaucccuuuccuaguc

SEQ ID NO: 42084 - RNA, 19 nt, Homo sapiens
gagcagauccuggcaaaga

SEQ ID NO: 42085 - RNA, 19 nt, Homo sapiens
gaugcgggcuccugccuuu

SEQ ID NO: 42086 - RNA, 19 nt, Homo sapiens
gcucgaggcugcuucuguu

SEQ ID NO: 42087 - RNA, 19 nt, Homo sapiens
guagagaaauaaagguugu

SEQ ID NO: 42088 - RNA, 19 nt, Homo sapiens
ggaggaacacgucauauca

SEQ ID NO: 42089 - RNA, 19 nt, Homo sapiens
ggaaccacaugcacgaaga

SEQ ID NO: 42090 - RNA, 19 nt, Homo sapiens
ugacuugccugguggagaa

SEQ ID NO: 42091 - RNA, 19 nt, Homo sapiens
gaccucacaucaacuucua

SEQ ID NO: 42092 - RNA, 19 nt, Homo sapiens
gggagcagauccuggcaaa

SEQ ID NO: 42093 - RNA, 19 nt, Homo sapiens
ccaaggguguguaugagaa

SEQ ID NO: 42094 - RNA, 19 nt, Homo sapiens
gaagcuggacguucacuug

SEQ ID NO: 42095 - RNA, 19 nt, Homo sapiens
gaagaaaugagccagaagu

SEQ ID NO: 42096 - RNA, 19 nt, Homo sapiens
gcagacugaugauuuuaua

SEQ ID NO: 42097 - RNA, 19 nt, Homo sapiens
gcaaguuugugcaguacga

SEQ ID NO: 42098 - RNA, 19 nt, Homo sapiens
ggacgacugcagcaaguuu

SEQ ID NO: 42099 - RNA, 19 nt, Homo sapiens
gcaagggcgugcagaggau

SEQ ID NO: 42100 - RNA, 19 nt, Homo sapiens
agaaauaaagguuguguga

SEQ ID NO: 42101 - RNA, 19 nt, Homo sapiens
ccacaugcacgaagaaaug

SEQ ID NO: 42102 - RNA, 19 nt, Homo sapiens
gggugaaccuggugacaga

SEQ ID NO: 42103 - RNA, 19 nt, Homo sapiens
guaacacggucaucaagca

SEQ ID NO: 42104 - RNA, 19 nt, Homo sapiens
aaauaaagguugugugacu

SEQ ID NO: 42105 - RNA, 19 nt, Homo sapiens
caccaaggauugucccuau

SEQ ID NO: 42106 - RNA, 19 nt, Homo sapiens
ccaccgacauccucagguu

SEQ ID NO: 42107 - RNA, 19 nt, Homo sapiens
uuaacgagaucacugcuau

SEQ ID NO: 42108 - RNA, 19 nt, Homo sapiens
acacggagcugggcaagau

SEQ ID NO: 42109 - RNA, 19 nt, Homo sapiens
gccgaaaggaugucacuaa

SEQ ID NO: 42110 - RNA, 19 nt, Homo sapiens
cgaggcugcuucuguuuau

SEQ ID NO: 42111 - RNA, 19 nt, Homo sapiens
cgagaucacugcuaugacu

SEQ ID NO: 42112 - RNA, 19 nt, Homo sapiens
acagcaacaugaagcaauu

SEQ ID NO: 42113 - RNA, 19 nt, Homo sapiens
gagaaccugcaguccuuua

SEQ ID NO: 42114 - RNA, 19 nt, Homo sapiens
ucgaggcccugaaggagua

SEQ ID NO: 42115 - RNA, 19 nt, Homo sapiens
gaagugagcgcugggaaca

SEQ ID NO: 42116 - RNA, 19 nt, Homo sapiens
uggagaagaugaacguguu

SEQ ID NO: 42117 - RNA, 19 nt, Homo sapiens
cgggagauguucagaguca

SEQ ID NO: 42118 - RNA, 19 nt, Homo sapiens
ccuggugguuuguguauga

SEQ ID NO: 42119 - RNA, 19 nt, Homo sapiens
ccgcaggcuuggcaucuuu

SEQ ID NO: 42120 - RNA, 19 nt, Homo sapiens
gaagugcuccgaagacaac

SEQ ID NO: 42121 - RNA, 19 nt, Homo sapiens
ucaagacucacaucccuuu

SEQ ID NO: 42122 - RNA, 19 nt, Homo sapiens
uggagaaccugcaguccuu

SEQ ID NO: 42123 - RNA, 19 nt, Homo sapiens
ccacucugcuuccacaaag

SEQ ID NO: 42124 - RNA, 19 nt, Homo sapiens
ccaccacacucgcccacuu

SEQ ID NO: 42125 - RNA, 19 nt, Homo sapiens
agauggugcugucagauga

SEQ ID NO: 42126 - RNA, 19 nt, Homo sapiens
cagagauggugcugucaga

SEQ ID NO: 42127 - RNA, 19 nt, Homo sapiens
ggauugucccuaugucuug

SEQ ID NO: 42128 - RNA, 19 nt, Homo sapiens
gcuggaggaacacgucaua

SEQ ID NO: 42129 - RNA, 19 nt, Homo sapiens
ggacucuccugggaaguuc

SEQ ID NO: 42130 - RNA, 19 nt, Homo sapiens
gaaccacaugcacgaagaa

SEQ ID NO: 42131 - RNA, 19 nt, Homo sapiens
uaccucaucuccuccaaug

SEQ ID NO: 42132 - RNA, 19 nt, Homo sapiens
gaaaccugcaccaaggauu

SEQ ID NO: 42133 - RNA, 19 nt, Homo sapiens
guccugagcucgggagaug

SEQ ID NO: 42134 - RNA, 19 nt, Homo sapiens
gaggcugcuucuguuuaua

SEQ ID NO: 42135 - RNA, 19 nt, Homo sapiens
gagauggugcugucagaug

SEQ ID NO: 42136 - RNA, 19 nt, Homo sapiens
ccgaaaggaugucacuaag

SEQ ID NO: 42137 - RNA, 19 nt, Homo sapiens
ccugggaggucuguaauuc

SEQ ID NO: 42138 - RNA, 19 nt, Homo sapiens
caaggaaggaggacaugga

SEQ ID NO: 42139 - RNA, 19 nt, Homo sapiens
aggaacacgucauaucaga

SEQ ID NO: 42140 - RNA, 19 nt, Homo sapiens
ccacggcucugggcuucaa

SEQ ID NO: 42141 - RNA, 19 nt, Homo sapiens
ccucaucuccuccaauguu

SEQ ID NO: 42142 - RNA, 19 nt, Homo sapiens
gcaccagcccugaagaaag

SEQ ID NO: 42143 - RNA, 19 nt, Homo sapiens
ucagagagacggacacaag

SEQ ID NO: 42144 - RNA, 19 nt, Homo sapiens
gcguggcgcugucuacuac

SEQ ID NO: 42145 - RNA, 19 nt, Homo sapiens
cacuaaggauggcugauuc

SEQ ID NO: 42146 - RNA, 19 nt, Homo sapiens
ucacuaaggauggcugauu

SEQ ID NO: 42147 - RNA, 19 nt, Homo sapiens
cgacacccaugagccgaaa

SEQ ID NO: 42148 - RNA, 19 nt, Homo sapiens
ggaguucacccuggaguuc

SEQ ID NO: 42149 - RNA, 19 nt, Homo sapiens
uagagcgugugcagacuga

SEQ ID NO: 42150 - RNA, 19 nt, Homo sapiens
ggagacaagucgggaaagc

SEQ ID NO: 42151 - RNA, 19 nt, Homo sapiens
agacggaccugaccuucgu

SEQ ID NO: 42152 - RNA, 19 nt, Homo sapiens
ccaaggauugucccuaugu

SEQ ID NO: 42153 - RNA, 19 nt, Homo sapiens
acgaagaaaugagccagaa

SEQ ID NO: 42154 - RNA, 19 nt, Homo sapiens
ccgagaagcccucaucagu

SEQ ID NO: 42155 - RNA, 19 nt, Homo sapiens
acucggcucuggacuacaa

SEQ ID NO: 42156 - RNA, 19 nt, Homo sapiens
cgacucggcucuggacuac

SEQ ID NO: 42157 - RNA, 19 nt, Homo sapiens
gcugaccugcuguuuggua

SEQ ID NO: 42158 - RNA, 19 nt, Homo sapiens
cugcugaccugcuguuugg

SEQ ID NO: 42159 - RNA, 19 nt, Homo sapiens
caccagcccugaagaaagc

SEQ ID NO: 42160 - RNA, 19 nt, Homo sapiens
gcgcaagcuggacgaguuu

SEQ ID NO: 42161 - RNA, 19 nt, Homo sapiens
ccacgcagagguccaacuu

SEQ ID NO: 42162 - RNA, 19 nt, Homo sapiens
ggccagggcagcaagaugu

SEQ ID NO: 42163 - RNA, 19 nt, Homo sapiens
guaaaucaagacucacauc

SEQ ID NO: 42164 - RNA, 19 nt, Homo sapiens
gugugcagacugaugauuu

SEQ ID NO: 42165 - RNA, 19 nt, Homo sapiens
caaggauugucccuauguc

SEQ ID NO: 42166 - RNA, 19 nt, Homo sapiens
ggaguaugagccugagaug

SEQ ID NO: 42167 - RNA, 19 nt, Homo sapiens
gcucaccaccaaucagaug

SEQ ID NO: 42168 - RNA, 19 nt, Homo sapiens
ugaaccaggacaagaagaa

SEQ ID NO: 42169 - RNA, 19 nt, Homo sapiens
aaaccugcaccaaggauug

SEQ ID NO: 42170 - RNA, 19 nt, Homo sapiens
ucgaggcugcuucuguuua

SEQ ID NO: 42171 - RNA, 19 nt, Homo sapiens
agaaaugagccagaaguga

SEQ ID NO: 42172 - RNA, 19 nt, Homo sapiens
uggcugcccuugucuccuu

SEQ ID NO: 42173 - RNA, 19 nt, Homo sapiens
ggugguggugcuccagaua

SEQ ID NO: 42174 - RNA, 19 nt, Homo sapiens
caucgacugugagguguuc

SEQ ID NO: 42175 - RNA, 19 nt, Homo sapiens
gaaaggaugucacuaagga

SEQ ID NO: 42176 - RNA, 19 nt, Homo sapiens
ggaaauccauguccgugua

SEQ ID NO: 42177 - RNA, 19 nt, Homo sapiens
ccaacgagcucccgaguga

SEQ ID NO: 42178 - RNA, 19 nt, Homo sapiens
gcagcaaguuugugcagua

SEQ ID NO: 42179 - RNA, 19 nt, Homo sapiens
gaagauggccucugaugga

SEQ ID NO: 42180 - RNA, 19 nt, Homo sapiens
gcagcaagauguuugugaa

SEQ ID NO: 42181 - RNA, 19 nt, Homo sapiens
gaacacgucauaucagaug

SEQ ID NO: 42182 - RNA, 19 nt, Homo sapiens
gcuguuugguagagaaaua

SEQ ID NO: 42183 - RNA, 19 nt, Homo sapiens
ucacaucccuuuccuaguc

SEQ ID NO: 42184 - RNA, 19 nt, Homo sapiens
gagcagauccuggcaaaga

SEQ ID NO: 42185 - RNA, 19 nt, Homo sapiens
gaugcgggcuccugccuuu

SEQ ID NO: 42186 - RNA, 19 nt, Homo sapiens
gcucgaggcugcuucuguu

SEQ ID NO: 42187 - RNA, 19 nt, Homo sapiens
guagagaaauaaagguugu

SEQ ID NO: 42188 - RNA, 19 nt, Homo sapiens
ggaggaacacgucauauca

SEQ ID NO: 42189 - RNA, 19 nt, Homo sapiens
gggaagaaaugagccagaa

SEQ ID NO: 42190 - RNA, 19 nt, Homo sapiens
ugacuugccugguggagaa

SEQ ID NO: 42191 - RNA, 19 nt, Homo sapiens
gaccucacaucaacuucua

SEQ ID NO: 42192 - RNA, 19 nt, Homo sapiens
gggagcagauccuggcaaa

SEQ ID NO: 42193 - RNA, 19 nt, Homo sapiens
ccaaggguguguaugagaa

SEQ ID NO: 42194 - RNA, 19 nt, Homo sapiens
gaagcuggacguucacuug

SEQ ID NO: 42195 - RNA, 19 nt, Homo sapiens
ggaggaagcagggaagaaa

SEQ ID NO: 42196 - RNA, 19 nt, Homo sapiens
gaagaaaugagccagaagu

SEQ ID NO: 42197 - RNA, 19 nt, Homo sapiens
gcagacugaugauuuuaua

SEQ ID NO: 42198 - RNA, 19 nt, Homo sapiens
gcaaguuugugcaguacga

SEQ ID NO: 42199 - RNA, 19 nt, Homo sapiens
ggacgacugcagcaaguuu

SEQ ID NO: 42200 - RNA, 19 nt, Homo sapiens
gcaagggcgugcagaggau

SEQ ID NO: 42201 - RNA, 19 nt, Homo sapiens
agaaauaaagguuguguga

SEQ ID NO: 42202 - RNA, 19 nt, Homo sapiens
gggugaaccuggugacaga

SEQ ID NO: 42203 - RNA, 19 nt, Homo sapiens
guaacacggucaucaagca

SEQ ID NO: 42204 - RNA, 19 nt, Homo sapiens
aaauaaagguugugugacu

SEQ ID NO: 42205 - RNA, 19 nt, Homo sapiens
caccaaggauugucccuau

SEQ ID NO: 42206 - RNA, 19 nt, Homo sapiens
ccaccgacauccucagguu

SEQ ID NO: 42207 - RNA, 19 nt, Homo sapiens
uuaacgagaucacugcuau

SEQ ID NO: 42208 - RNA, 19 nt, Homo sapiens
acacggagcugggcaagau

SEQ ID NO: 42209 - RNA, 19 nt, Homo sapiens
gccgaaaggaugucacuaa

SEQ ID NO: 42210 - RNA, 19 nt, Homo sapiens
cgaggcugcuucuguuuau

SEQ ID NO: 42211 - RNA, 19 nt, Homo sapiens
cgagaucacugcuaugacu

SEQ ID NO: 42212 - RNA, 19 nt, Homo sapiens
acagcaacaugaagcaauu

SEQ ID NO: 42213 - RNA, 19 nt, Homo sapiens
gagaaccugcaguccuuua

SEQ ID NO: 42214 - RNA, 19 nt, Homo sapiens
ucgaggcccugaaggagua

SEQ ID NO: 42215 - RNA, 19 nt, Homo sapiens
gaagugagcgcugggaaca

SEQ ID NO: 42216 - RNA, 19 nt, Homo sapiens
uggagaagaugaacguguu

SEQ ID NO: 42217 - RNA, 19 nt, Homo sapiens
cgggagauguucagaguca

SEQ ID NO: 42218 - RNA, 19 nt, Homo sapiens
ccuggugguuuguguauga

SEQ ID NO: 42219 - RNA, 19 nt, Homo sapiens
ccgcaggcuuggcaucuuu

SEQ ID NO: 42220 - RNA, 19 nt, Homo sapiens
ggaagcagggaagaaauga

SEQ ID NO: 42221 - RNA, 19 nt, Homo sapiens
gaagugcuccgaagacaac

SEQ ID NO: 42222 - RNA, 19 nt, Homo sapiens
ucaagacucacaucccuuu

SEQ ID NO: 42223 - RNA, 19 nt, Homo sapiens
uggagaaccugcaguccuu

SEQ ID NO: 42224 - RNA, 19 nt, Homo sapiens
ccacucugcuuccacaaag

SEQ ID NO: 42225 - RNA, 19 nt, Homo sapiens
ccaccacacucgcccacuu

SEQ ID NO: 42226 - RNA, 19 nt, Homo sapiens
agauggugcugucagauga

SEQ ID NO: 42227 - RNA, 19 nt, Homo sapiens
cagagauggugcugucaga

SEQ ID NO: 42228 - RNA, 19 nt, Homo sapiens
ggauugucccuaugucuug

SEQ ID NO: 42229 - RNA, 19 nt, Homo sapiens
gcuggaggaacacgucaua

SEQ ID NO: 42230 - RNA, 19 nt, Homo sapiens
ggacucuccugggaaguuc

SEQ ID NO: 42231 - RNA, 19 nt, Homo sapiens
acaccggguuggccucuuu

SEQ ID NO: 42232 - RNA, 19 nt, Homo sapiens
uaccucaucuccuccaaug

SEQ ID NO: 42233 - RNA, 19 nt, Homo sapiens
gaaaccugcaccaaggauu

SEQ ID NO: 42234 - RNA, 19 nt, Homo sapiens
guccugagcucgggagaug

SEQ ID NO: 42235 - RNA, 19 nt, Homo sapiens
gaggcugcuucuguuuaua

SEQ ID NO: 42236 - RNA, 19 nt, Homo sapiens
gagauggugcugucagaug

SEQ ID NO: 42237 - RNA, 19 nt, Homo sapiens
ccgaaaggaugucacuaag

SEQ ID NO: 42238 - RNA, 19 nt, Homo sapiens
ccugggaggucuguaauuc

SEQ ID NO: 42239 - RNA, 19 nt, Homo sapiens
caaggaaggaggacaugga

SEQ ID NO: 42240 - RNA, 19 nt, Homo sapiens
aggaacacgucauaucaga

SEQ ID NO: 42241 - RNA, 19 nt, Homo sapiens
ccacggcucugggcuucaa

SEQ ID NO: 42242 - RNA, 19 nt, Homo sapiens
ccucaucuccuccaauguu

SEQ ID NO: 42243 - RNA, 19 nt, Homo sapiens
gcaccagcccugaagaaag

SEQ ID NO: 42244 - RNA, 19 nt, Homo sapiens
ucagagagacggacacaag

SEQ ID NO: 42245 - RNA, 19 nt, Homo sapiens
gcacgccugucuuuaucca

SEQ ID NO: 42246 - RNA, 19 nt, Homo sapiens
gcguggcgcugucuacuac

SEQ ID NO: 42247 - RNA, 19 nt, Homo sapiens
cacuaaggauggcugauuc

SEQ ID NO: 42248 - RNA, 19 nt, Homo sapiens
ucacuaaggauggcugauu

SEQ ID NO: 42249 - RNA, 19 nt, Homo sapiens
cgacacccaugagccgaaa

SEQ ID NO: 42250 - RNA, 19 nt, Homo sapiens
ggaguucacccuggaguuc

SEQ ID NO: 42251 - RNA, 19 nt, Homo sapiens
uagagcgugugcagacuga

SEQ ID NO: 42252 - RNA, 19 nt, Homo sapiens
ggagacaagucgggaaagc

SEQ ID NO: 42253 - RNA, 19 nt, Homo sapiens
agacggaccugaccuucgu

SEQ ID NO: 42254 - RNA, 19 nt, Homo sapiens
ccaaggauugucccuaugu

SEQ ID NO: 42255 - RNA, 19 nt, Homo sapiens
ccgagaagcccucaucagu

SEQ ID NO: 42256 - RNA, 19 nt, Homo sapiens
acucggcucuggacuacaa

SEQ ID NO: 42257 - RNA, 19 nt, Homo sapiens
cgacucggcucuggacuac

SEQ ID NO: 42258 - RNA, 19 nt, Homo sapiens
gcugaccugcuguuuggua

SEQ ID NO: 42259 - RNA, 19 nt, Homo sapiens
cugcugaccugcuguuugg

SEQ ID NO: 42260 - RNA, 19 nt, Homo sapiens
caccagcccugaagaaagc

SEQ ID NO: 42261 - RNA, 19 nt, Homo sapiens
gcgcaagcuggacgaguuu

SEQ ID NO: 42262 - RNA, 19 nt, Homo sapiens
ccacgcagagguccaacuu

SEQ ID NO: 42263 - RNA, 19 nt, Homo sapiens
caugcacgccugucuuuau

SEQ ID NO: 42264 - RNA, 19 nt, Homo sapiens
ggccagggcagcaagaugu

SEQ ID NO: 42265 - RNA, 19 nt, Homo sapiens
guaaaucaagacucacauc

SEQ ID NO: 42266 - RNA, 19 nt, Homo sapiens
gugugcagacugaugauuu

SEQ ID NO: 42267 - RNA, 19 nt, Homo sapiens
caaggauugucccuauguc

SEQ ID NO: 42268 - RNA, 19 nt, Homo sapiens
ggaguaugagccugagaug

SEQ ID NO: 42269 - RNA, 19 nt, Homo sapiens
gaggaagcagggaagaaau

SEQ ID NO: 42270 - RNA, 19 nt, Homo sapiens
cacaugcacgccugucuuu

SEQ ID NO: 42271 - RNA, 19 nt, Homo sapiens
ugaaccaggacaagaagaa

SEQ ID NO: 42272 - RNA, 19 nt, Homo sapiens
gcucaccaccaaucagaug

SEQ ID NO: 42273 - RNA, 19 nt, Homo sapiens
aaaccugcaccaaggauug

SEQ ID NO: 42274 - RNA, 19 nt, Homo sapiens
ucgaggcugcuucuguuua

SEQ ID NO: 42275 - RNA, 19 nt, Homo sapiens
gaaaggaugucacuaagga

SEQ ID NO: 42276 - RNA, 19 nt, Homo sapiens
ggaaauccauguccgugua

SEQ ID NO: 42277 - RNA, 19 nt, Homo sapiens
ccaacgagcucccgaguga

SEQ ID NO: 42278 - RNA, 19 nt, Homo sapiens
gcagcaaguuugugcagua

SEQ ID NO: 42279 - RNA, 19 nt, Homo sapiens
gaagauggccucugaugga

SEQ ID NO: 42280 - RNA, 19 nt, Homo sapiens
gcagcaagauguuugugaa

SEQ ID NO: 42281 - RNA, 19 nt, Homo sapiens
gaacacgucauaucagaug

SEQ ID NO: 42282 - RNA, 19 nt, Homo sapiens
gcuguuugguagagaaaua

SEQ ID NO: 42283 - RNA, 19 nt, Homo sapiens
ucacaucccuuuccuaguc

SEQ ID NO: 42284 - RNA, 19 nt, Homo sapiens
gagcagauccuggcaaaga

SEQ ID NO: 42285 - RNA, 19 nt, Homo sapiens
gaugcgggcuccugccuuu

SEQ ID NO: 42286 - RNA, 19 nt, Homo sapiens
gcucgaggcugcuucuguu

SEQ ID NO: 42287 - RNA, 19 nt, Homo sapiens
guagagaaauaaagguugu

SEQ ID NO: 42288 - RNA, 19 nt, Homo sapiens
ggaggaacacgucauauca

SEQ ID NO: 42289 - RNA, 19 nt, Homo sapiens
gggaagaaaugagccagaa

SEQ ID NO: 42290 - RNA, 19 nt, Homo sapiens
ugacuugccugguggagaa

SEQ ID NO: 42291 - RNA, 19 nt, Homo sapiens
gaccucacaucaacuucua

SEQ ID NO: 42292 - RNA, 19 nt, Homo sapiens
gggagcagauccuggcaaa

SEQ ID NO: 42293 - RNA, 19 nt, Homo sapiens
ccaaggguguguaugagaa

SEQ ID NO: 42294 - RNA, 19 nt, Homo sapiens
gaagcuggacguucacuug

SEQ ID NO: 42295 - RNA, 19 nt, Homo sapiens
ggaggaagcagggaagaaa

SEQ ID NO: 42296 - RNA, 19 nt, Homo sapiens
gaagaaaugagccagaagu

SEQ ID NO: 42297 - RNA, 19 nt, Homo sapiens
gcagacugaugauuuuaua

SEQ ID NO: 42298 - RNA, 19 nt, Homo sapiens
gcaaguuugugcaguacga

SEQ ID NO: 42299 - RNA, 19 nt, Homo sapiens
ggacgacugcagcaaguuu

SEQ ID NO: 42300 - RNA, 19 nt, Homo sapiens
gcaagggcgugcagaggau

SEQ ID NO: 42301 - RNA, 19 nt, Homo sapiens
agaaauaaagguuguguga

SEQ ID NO: 42302 - RNA, 19 nt, Homo sapiens
gggugaaccuggugacaga

SEQ ID NO: 42303 - RNA, 19 nt, Homo sapiens
guaacacggucaucaagca

SEQ ID NO: 42304 - RNA, 19 nt, Homo sapiens
aaauaaagguugugugacu

SEQ ID NO: 42305 - RNA, 19 nt, Homo sapiens
caccaaggauugucccuau

SEQ ID NO: 42306 - RNA, 19 nt, Homo sapiens
ccaccgacauccucagguu

SEQ ID NO: 42307 - RNA, 19 nt, Homo sapiens
uuaacgagaucacugcuau

SEQ ID NO: 42308 - RNA, 19 nt, Homo sapiens
acacggagcugggcaagau

SEQ ID NO: 42309 - RNA, 19 nt, Homo sapiens
gccgaaaggaugucacuaa

SEQ ID NO: 42310 - RNA, 19 nt, Homo sapiens
cgaggcugcuucuguuuau

SEQ ID NO: 42311 - RNA, 19 nt, Homo sapiens
cgagaucacugcuaugacu

SEQ ID NO: 42312 - RNA, 19 nt, Homo sapiens
acagcaacaugaagcaauu

SEQ ID NO: 42313 - RNA, 19 nt, Homo sapiens
gagaaccugcaguccuuua

SEQ ID NO: 42314 - RNA, 19 nt, Homo sapiens
ucgaggcccugaaggagua

SEQ ID NO: 42315 - RNA, 19 nt, Homo sapiens
gaagugagcgcugggaaca

SEQ ID NO: 42316 - RNA, 19 nt, Homo sapiens
uggagaagaugaacguguu

SEQ ID NO: 42317 - RNA, 19 nt, Homo sapiens
cgggagauguucagaguca

SEQ ID NO: 42318 - RNA, 19 nt, Homo sapiens
ccuggugguuuguguauga

SEQ ID NO: 42319 - RNA, 19 nt, Homo sapiens
ccgcaggcuuggcaucuuu

SEQ ID NO: 42320 - RNA, 19 nt, Homo sapiens
ggaagcagggaagaaauga

SEQ ID NO: 42321 - RNA, 19 nt, Homo sapiens
gaagugcuccgaagacaac

SEQ ID NO: 42322 - RNA, 19 nt, Homo sapiens
ucaagacucacaucccuuu

SEQ ID NO: 42323 - RNA, 19 nt, Homo sapiens
uggagaaccugcaguccuu

SEQ ID NO: 42324 - RNA, 19 nt, Homo sapiens
ccacucugcuuccacaaag

SEQ ID NO: 42325 - RNA, 19 nt, Homo sapiens
ccaccacacucgcccacuu

SEQ ID NO: 42326 - RNA, 19 nt, Homo sapiens
agauggugcugucagauga

SEQ ID NO: 42327 - RNA, 19 nt, Homo sapiens
cagagauggugcugucaga

SEQ ID NO: 42328 - RNA, 19 nt, Homo sapiens
ggauugucccuaugucuug

SEQ ID NO: 42329 - RNA, 19 nt, Homo sapiens
gcuggaggaacacgucaua

SEQ ID NO: 42330 - RNA, 19 nt, Homo sapiens
ggacucuccugggaaguuc

SEQ ID NO: 42331 - RNA, 19 nt, Homo sapiens
uaccucaucuccuccaaug

SEQ ID NO: 42332 - RNA, 19 nt, Homo sapiens
gaaaccugcaccaaggauu

SEQ ID NO: 42333 - RNA, 19 nt, Homo sapiens
guccugagcucgggagaug

SEQ ID NO: 42334 - RNA, 19 nt, Homo sapiens
gaggcugcuucuguuuaua

SEQ ID NO: 42335 - RNA, 19 nt, Homo sapiens
gagauggugcugucagaug

SEQ ID NO: 42336 - RNA, 19 nt, Homo sapiens
ccgaaaggaugucacuaag

SEQ ID NO: 42337 - RNA, 19 nt, Homo sapiens
ccugggaggucuguaauuc

SEQ ID NO: 42338 - RNA, 19 nt, Homo sapiens
caaggaaggaggacaugga

SEQ ID NO: 42339 - RNA, 19 nt, Homo sapiens
aggaacacgucauaucaga

SEQ ID NO: 42340 - RNA, 19 nt, Homo sapiens
ccacggcucugggcuucaa

SEQ ID NO: 42341 - RNA, 19 nt, Homo sapiens
ccucaucuccuccaauguu

SEQ ID NO: 42342 - RNA, 19 nt, Homo sapiens
gcaccagcccugaagaaag

SEQ ID NO: 42343 - RNA, 19 nt, Homo sapiens
ucagagagacggacacaag

SEQ ID NO: 42344 - RNA, 19 nt, Homo sapiens
gcacgccugucuuuaucca

SEQ ID NO: 42345 - RNA, 19 nt, Homo sapiens
gcguggcgcugucuacuac

SEQ ID NO: 42346 - RNA, 19 nt, Homo sapiens
cacuaaggauggcugauuc

SEQ ID NO: 42347 - RNA, 19 nt, Homo sapiens
ucacuaaggauggcugauu

SEQ ID NO: 42348 - RNA, 19 nt, Homo sapiens
cgacacccaugagccgaaa

SEQ ID NO: 42349 - RNA, 19 nt, Homo sapiens
ggaguucacccuggaguuc

SEQ ID NO: 42350 - RNA, 19 nt, Homo sapiens
uagagcgugugcagacuga

SEQ ID NO: 42351 - RNA, 19 nt, Homo sapiens
ggagacaagucgggaaagc

SEQ ID NO: 42352 - RNA, 19 nt, Homo sapiens
agacggaccugaccuucgu

SEQ ID NO: 42353 - RNA, 19 nt, Homo sapiens
ccaaggauugucccuaugu

SEQ ID NO: 42354 - RNA, 19 nt, Homo sapiens
ccgagaagcccucaucagu

SEQ ID NO: 42355 - RNA, 19 nt, Homo sapiens
acucggcucuggacuacaa

SEQ ID NO: 42356 - RNA, 19 nt, Homo sapiens
cgacucggcucuggacuac

SEQ ID NO: 42357 - RNA, 19 nt, Homo sapiens
gcugaccugcuguuuggua

SEQ ID NO: 42358 - RNA, 19 nt, Homo sapiens
cugcugaccugcuguuugg

SEQ ID NO: 42359 - RNA, 19 nt, Homo sapiens
caccagcccugaagaaagc

SEQ ID NO: 42360 - RNA, 19 nt, Homo sapiens
gcgcaagcuggacgaguuu

SEQ ID NO: 42361 - RNA, 19 nt, Homo sapiens
ccacgcagagguccaacuu

SEQ ID NO: 42362 - RNA, 19 nt, Homo sapiens
caugcacgccugucuuuau

SEQ ID NO: 42363 - RNA, 19 nt, Homo sapiens
ggccagggcagcaagaugu

SEQ ID NO: 42364 - RNA, 19 nt, Homo sapiens
guaaaucaagacucacauc

SEQ ID NO: 42365 - RNA, 19 nt, Homo sapiens
gugugcagacugaugauuu

SEQ ID NO: 42366 - RNA, 19 nt, Homo sapiens
caaggauugucccuauguc

SEQ ID NO: 42367 - RNA, 19 nt, Homo sapiens
ggaguaugagccugagaug

SEQ ID NO: 42368 - RNA, 19 nt, Homo sapiens
gaggaagcagggaagaaau

SEQ ID NO: 42369 - RNA, 19 nt, Homo sapiens
cacaugcacgccugucuuu

SEQ ID NO: 42370 - RNA, 19 nt, Homo sapiens
gcucaccaccaaucagaug

SEQ ID NO: 42371 - RNA, 19 nt, Homo sapiens
ugaaccaggacaagaagaa

SEQ ID NO: 42372 - RNA, 19 nt, Homo sapiens
aaaccugcaccaaggauug

SEQ ID NO: 42373 - RNA, 19 nt, Homo sapiens
ucgaggcugcuucuguuua

SEQ ID NO: 42374 - RNA, 19 nt, Homo sapiens
agaaaugagccagaaguga

SEQ ID NO: 42375 - RNA, 19 nt, Homo sapiens
gaaaggaugucacuaagga

SEQ ID NO: 42376 - RNA, 19 nt, Homo sapiens
ggaaauccauguccgugua

SEQ ID NO: 42377 - RNA, 19 nt, Homo sapiens
ccaacgagcucccgaguga

SEQ ID NO: 42378 - RNA, 19 nt, Homo sapiens
gcagcaaguuugugcagua

SEQ ID NO: 42379 - RNA, 19 nt, Homo sapiens
gaagauggccucugaugga

SEQ ID NO: 42380 - RNA, 19 nt, Homo sapiens
gcagcaagauguuugugaa

SEQ ID NO: 42381 - RNA, 19 nt, Homo sapiens
gaacacgucauaucagaug

SEQ ID NO: 42382 - RNA, 19 nt, Homo sapiens
gcuguuugguagagaaaua

SEQ ID NO: 42383 - RNA, 19 nt, Homo sapiens
ucacaucccuuuccuaguc

SEQ ID NO: 42384 - RNA, 19 nt, Homo sapiens
gagcagauccuggcaaaga

SEQ ID NO: 42385 - RNA, 19 nt, Homo sapiens
gaugcgggcuccugccuuu

SEQ ID NO: 42386 - RNA, 19 nt, Homo sapiens
gcucgaggcugcuucuguu

SEQ ID NO: 42387 - RNA, 19 nt, Homo sapiens
guagagaaauaaagguugu

SEQ ID NO: 42388 - RNA, 19 nt, Homo sapiens
ggaggaacacgucauauca

SEQ ID NO: 42389 - RNA, 19 nt, Homo sapiens
ugacuugccugguggagaa

SEQ ID NO: 42390 - RNA, 19 nt, Homo sapiens
gaccucacaucaacuucua

SEQ ID NO: 42391 - RNA, 19 nt, Homo sapiens
gggagcagauccuggcaaa

SEQ ID NO: 42392 - RNA, 19 nt, Homo sapiens
ccaaggguguguaugagaa

SEQ ID NO: 42393 - RNA, 19 nt, Homo sapiens
gaagcuggacguucacuug

SEQ ID NO: 42394 - RNA, 19 nt, Homo sapiens
gaagaaaugagccagaagu

SEQ ID NO: 42395 - RNA, 19 nt, Homo sapiens
gcagacugaugauuuuaua

SEQ ID NO: 42396 - RNA, 19 nt, Homo sapiens
gcaaguuugugcaguacga

SEQ ID NO: 42397 - RNA, 19 nt, Homo sapiens
ggacgacugcagcaaguuu

SEQ ID NO: 42398 - RNA, 19 nt, Homo sapiens
gcaagggcgugcagaggau

SEQ ID NO: 42399 - RNA, 19 nt, Homo sapiens
agaaauaaagguuguguga

SEQ ID NO: 42400 - RNA, 19 nt, Homo sapiens
gggugaaccuggugacaga

SEQ ID NO: 42401 - RNA, 19 nt, Homo sapiens
guaacacggucaucaagca

SEQ ID NO: 42402 - RNA, 19 nt, Homo sapiens
aaauaaagguugugugacu

SEQ ID NO: 42403 - RNA, 19 nt, Homo sapiens
caccaaggauugucccuau

SEQ ID NO: 42404 - RNA, 19 nt, Homo sapiens
ccaccgacauccucagguu

SEQ ID NO: 42405 - RNA, 19 nt, Homo sapiens
uuaacgagaucacugcuau

SEQ ID NO: 42406 - RNA, 19 nt, Homo sapiens
acacggagcugggcaagau

SEQ ID NO: 42407 - RNA, 19 nt, Homo sapiens
gccgaaaggaugucacuaa

SEQ ID NO: 42408 - RNA, 19 nt, Homo sapiens
cgaggcugcuucuguuuau

SEQ ID NO: 42409 - RNA, 19 nt, Homo sapiens
cgagaucacugcuaugacu

SEQ ID NO: 42410 - RNA, 19 nt, Homo sapiens
acagcaacaugaagcaauu

SEQ ID NO: 42411 - RNA, 19 nt, Homo sapiens
gagaaccugcaguccuuua

SEQ ID NO: 42412 - RNA, 19 nt, Homo sapiens
ucgaggcccugaaggagua

SEQ ID NO: 42413 - RNA, 19 nt, Homo sapiens
gaagugagcgcugggaaca

SEQ ID NO: 42414 - RNA, 19 nt, Homo sapiens
gaccacaccggaagaaaug

SEQ ID NO: 42415 - RNA, 19 nt, Homo sapiens
uggagaagaugaacguguu

SEQ ID NO: 42416 - RNA, 19 nt, Homo sapiens
cgggagauguucagaguca

SEQ ID NO: 42417 - RNA, 19 nt, Homo sapiens
ccuggugguuuguguauga

SEQ ID NO: 42418 - RNA, 19 nt, Homo sapiens
ccgcaggcuuggcaucuuu

SEQ ID NO: 42419 - RNA, 19 nt, Homo sapiens
cggaagaaaugagccagaa

SEQ ID NO: 42420 - RNA, 19 nt, Homo sapiens
gaagugcuccgaagacaac

SEQ ID NO: 42421 - RNA, 19 nt, Homo sapiens
ucaagacucacaucccuuu

SEQ ID NO: 42422 - RNA, 19 nt, Homo sapiens
uggagaaccugcaguccuu

SEQ ID NO: 42423 - RNA, 19 nt, Homo sapiens
ccacucugcuuccacaaag

SEQ ID NO: 42424 - RNA, 19 nt, Homo sapiens
ccaccacacucgcccacuu

SEQ ID NO: 42425 - RNA, 19 nt, Homo sapiens
agauggugcugucagauga

SEQ ID NO: 42426 - RNA, 19 nt, Homo sapiens
cagagauggugcugucaga

SEQ ID NO: 42427 - RNA, 19 nt, Homo sapiens
ggauugucccuaugucuug

SEQ ID NO: 42428 - RNA, 19 nt, Homo sapiens
gcuggaggaacacgucaua

SEQ ID NO: 42429 - RNA, 19 nt, Homo sapiens
ggacucuccugggaaguuc

SEQ ID NO: 42430 - RNA, 19 nt, Homo sapiens
uaccucaucuccuccaaug

SEQ ID NO: 42431 - RNA, 19 nt, Homo sapiens
gaaaccugcaccaaggauu

SEQ ID NO: 42432 - RNA, 19 nt, Homo sapiens
guccugagcucgggagaug

SEQ ID NO: 42433 - RNA, 19 nt, Homo sapiens
gaggcugcuucuguuuaua

SEQ ID NO: 42434 - RNA, 19 nt, Homo sapiens
gagauggugcugucagaug

SEQ ID NO: 42435 - RNA, 19 nt, Homo sapiens
ccgaaaggaugucacuaag

SEQ ID NO: 42436 - RNA, 19 nt, Homo sapiens
ccugggaggucuguaauuc

SEQ ID NO: 42437 - RNA, 19 nt, Homo sapiens
caaggaaggaggacaugga

SEQ ID NO: 42438 - RNA, 19 nt, Homo sapiens
aggaacacgucauaucaga

SEQ ID NO: 42439 - RNA, 19 nt, Homo sapiens
ccacggcucugggcuucaa

SEQ ID NO: 42440 - RNA, 19 nt, Homo sapiens
ccucaucuccuccaauguu

SEQ ID NO: 42441 - RNA, 19 nt, Homo sapiens
gcaccagcccugaagaaag

SEQ ID NO: 42442 - RNA, 19 nt, Homo sapiens
ucagagagacggacacaag

SEQ ID NO: 42443 - RNA, 19 nt, Homo sapiens
gcacgccugucuuuaucca

SEQ ID NO: 42444 - RNA, 19 nt, Homo sapiens
gcguggcgcugucuacuac

SEQ ID NO: 42445 - RNA, 19 nt, Homo sapiens
cacuaaggauggcugauuc

SEQ ID NO: 42446 - RNA, 19 nt, Homo sapiens
ucacuaaggauggcugauu

SEQ ID NO: 42447 - RNA, 19 nt, Homo sapiens
cgacacccaugagccgaaa

SEQ ID NO: 42448 - RNA, 19 nt, Homo sapiens
ggaguucacccuggaguuc

SEQ ID NO: 42449 - RNA, 19 nt, Homo sapiens
uagagcgugugcagacuga

SEQ ID NO: 42450 - RNA, 19 nt, Homo sapiens
ggagacaagucgggaaagc

SEQ ID NO: 42451 - RNA, 19 nt, Homo sapiens
agacggaccugaccuucgu

SEQ ID NO: 42452 - RNA, 19 nt, Homo sapiens
ccaaggauugucccuaugu

SEQ ID NO: 42453 - RNA, 19 nt, Homo sapiens
ccgagaagcccucaucagu

SEQ ID NO: 42454 - RNA, 19 nt, Homo sapiens
acucggcucuggacuacaa

SEQ ID NO: 42455 - RNA, 19 nt, Homo sapiens
cgacucggcucuggacuac

SEQ ID NO: 42456 - RNA, 19 nt, Homo sapiens
gcugaccugcuguuuggua

SEQ ID NO: 42457 - RNA, 19 nt, Homo sapiens
cugcugaccugcuguuugg

SEQ ID NO: 42458 - RNA, 19 nt, Homo sapiens
caccagcccugaagaaagc

SEQ ID NO: 42459 - RNA, 19 nt, Homo sapiens
gcgcaagcuggacgaguuu

SEQ ID NO: 42460 - RNA, 19 nt, Homo sapiens
ccacgcagagguccaacuu

SEQ ID NO: 42461 - RNA, 19 nt, Homo sapiens
caugcacgccugucuuuau

SEQ ID NO: 42462 - RNA, 19 nt, Homo sapiens
ggccagggcagcaagaugu

SEQ ID NO: 42463 - RNA, 19 nt, Homo sapiens
guaaaucaagacucacauc

SEQ ID NO: 42464 - RNA, 19 nt, Homo sapiens
gugugcagacugaugauuu

SEQ ID NO: 42465 - RNA, 19 nt, Homo sapiens
caaggauugucccuauguc

SEQ ID NO: 42466 - RNA, 19 nt, Homo sapiens
ugaaccaggacaagaagaa

SEQ ID NO: 42467 - RNA, 19 nt, Homo sapiens
cacaugcacgccugucuuu

SEQ ID NO: 42468 - RNA, 19 nt, Homo sapiens
ggaguaugagccugagaug

SEQ ID NO: 42469 - RNA, 19 nt, Homo sapiens
gcucaccaccaaucagaug

SEQ ID NO: 42470 - RNA, 19 nt, Homo sapiens
uggcugcccuugucuccuu

SEQ ID NO: 42471 - RNA, 19 nt, Homo sapiens
aaaccugcaccaaggauug

SEQ ID NO: 42472 - RNA, 19 nt, Homo sapiens
ucgaggcugcuucuguuua

SEQ ID NO: 42473 - RNA, 19 nt, Homo sapiens
agaaaugagccagaaguga

SEQ ID NO: 42474 - RNA, 19 nt, Homo sapiens
ggugguggugcuccagaua

SEQ ID NO: 42475 - RNA, 19 nt, Homo sapiens
gaaaggaugucacuaagga

SEQ ID NO: 42476 - RNA, 19 nt, Homo sapiens
ggaaauccauguccgugua

SEQ ID NO: 42477 - RNA, 19 nt, Homo sapiens
ccaacgagcucccgaguga

SEQ ID NO: 42478 - RNA, 19 nt, Homo sapiens
gcagcaaguuugugcagua

SEQ ID NO: 42479 - RNA, 19 nt, Homo sapiens
gaagauggccucugaugga

SEQ ID NO: 42480 - RNA, 19 nt, Homo sapiens
gcagcaagauguuugugaa

SEQ ID NO: 42481 - RNA, 19 nt, Homo sapiens
gaacacgucauaucagaug

SEQ ID NO: 42482 - RNA, 19 nt, Homo sapiens
gcuguuugguagagaaaua

SEQ ID NO: 42483 - RNA, 19 nt, Homo sapiens
ucacaucccuuuccuaguc

SEQ ID NO: 42484 - RNA, 19 nt, Homo sapiens
gagcagauccuggcaaaga

SEQ ID NO: 42485 - RNA, 19 nt, Homo sapiens
gaugcgggcuccugccuuu

SEQ ID NO: 42486 - RNA, 19 nt, Homo sapiens
gcucgaggcugcuucuguu

SEQ ID NO: 42487 - RNA, 19 nt, Homo sapiens
guagagaaauaaagguugu

SEQ ID NO: 42488 - RNA, 19 nt, Homo sapiens
ggaggaacacgucauauca

SEQ ID NO: 42489 - RNA, 19 nt, Homo sapiens
ugacuugccugguggagaa

SEQ ID NO: 42490 - RNA, 19 nt, Homo sapiens
gaccucacaucaacuucua

SEQ ID NO: 42491 - RNA, 19 nt, Homo sapiens
gggagcagauccuggcaaa

SEQ ID NO: 42492 - RNA, 19 nt, Homo sapiens
ccaaggguguguaugagaa

SEQ ID NO: 42493 - RNA, 19 nt, Homo sapiens
gaagcuggacguucacuug

SEQ ID NO: 42494 - RNA, 19 nt, Homo sapiens
gaagaaaugagccagaagu

SEQ ID NO: 42495 - RNA, 19 nt, Homo sapiens
gcagacugaugauuuuaua

SEQ ID NO: 42496 - RNA, 19 nt, Homo sapiens
gcaaguuugugcaguacga

SEQ ID NO: 42497 - RNA, 19 nt, Homo sapiens
ggacgacugcagcaaguuu

SEQ ID NO: 42498 - RNA, 19 nt, Homo sapiens
gcaagggcgugcagaggau

SEQ ID NO: 42499 - RNA, 19 nt, Homo sapiens
agaaauaaagguuguguga

SEQ ID NO: 42500 - RNA, 19 nt, Homo sapiens
gggugaaccuggugacaga

SEQ ID NO: 42501 - RNA, 19 nt, Homo sapiens
guaacacggucaucaagca

SEQ ID NO: 42502 - RNA, 19 nt, Homo sapiens
aaauaaagguugugugacu

SEQ ID NO: 42503 - RNA, 19 nt, Homo sapiens
caccaaggauugucccuau

SEQ ID NO: 42504 - RNA, 19 nt, Homo sapiens
ccaccgacauccucagguu

SEQ ID NO: 42505 - RNA, 19 nt, Homo sapiens
uuaacgagaucacugcuau

SEQ ID NO: 42506 - RNA, 19 nt, Homo sapiens
acacggagcugggcaagau

SEQ ID NO: 42507 - RNA, 19 nt, Homo sapiens
gccgaaaggaugucacuaa

SEQ ID NO: 42508 - RNA, 19 nt, Homo sapiens
cgaggcugcuucuguuuau

SEQ ID NO: 42509 - RNA, 19 nt, Homo sapiens
cgagaucacugcuaugacu

SEQ ID NO: 42510 - RNA, 19 nt, Homo sapiens
acagcaacaugaagcaauu

SEQ ID NO: 42511 - RNA, 19 nt, Homo sapiens
gagaaccugcaguccuuua

SEQ ID NO: 42512 - RNA, 19 nt, Homo sapiens
ucgaggcccugaaggagua

SEQ ID NO: 42513 - RNA, 19 nt, Homo sapiens
gaagugagcgcugggaaca

SEQ ID NO: 42514 - RNA, 19 nt, Homo sapiens
uggagaagaugaacguguu

SEQ ID NO: 42515 - RNA, 19 nt, Homo sapiens
cgggagauguucagaguca

SEQ ID NO: 42516 - RNA, 19 nt, Homo sapiens
ccuggugguuuguguauga

SEQ ID NO: 42517 - RNA, 19 nt, Homo sapiens
ccgcaggcuuggcaucuuu

SEQ ID NO: 42518 - RNA, 19 nt, Homo sapiens
gaagugcuccgaagacaac

SEQ ID NO: 42519 - RNA, 19 nt, Homo sapiens
ucaagacucacaucccuuu

SEQ ID NO: 42520 - RNA, 19 nt, Homo sapiens
uggagaaccugcaguccuu

SEQ ID NO: 42521 - RNA, 19 nt, Homo sapiens
ccacucugcuuccacaaag

SEQ ID NO: 42522 - RNA, 19 nt, Homo sapiens
ccaccacacucgcccacuu

SEQ ID NO: 42523 - RNA, 19 nt, Homo sapiens
agauggugcugucagauga

SEQ ID NO: 42524 - RNA, 19 nt, Homo sapiens
cagagauggugcugucaga

SEQ ID NO: 42525 - RNA, 19 nt, Homo sapiens
ggauugucccuaugucuug

SEQ ID NO: 42526 - RNA, 19 nt, Homo sapiens
gcuggaggaacacgucaua

SEQ ID NO: 42527 - RNA, 19 nt, Homo sapiens
ggacucuccugggaaguuc

SEQ ID NO: 42528 - RNA, 19 nt, Homo sapiens
acaccggguuggccucuuu

SEQ ID NO: 42529 - RNA, 19 nt, Homo sapiens
uaccucaucuccuccaaug

SEQ ID NO: 42530 - RNA, 19 nt, Homo sapiens
gaaaccugcaccaaggauu

SEQ ID NO: 42531 - RNA, 19 nt, Homo sapiens
guccugagcucgggagaug

SEQ ID NO: 42532 - RNA, 19 nt, Homo sapiens
gaggcugcuucuguuuaua

SEQ ID NO: 42533 - RNA, 19 nt, Homo sapiens
gagauggugcugucagaug

SEQ ID NO: 42534 - RNA, 19 nt, Homo sapiens
ccgaaaggaugucacuaag

SEQ ID NO: 42535 - RNA, 19 nt, Homo sapiens
ccugggaggucuguaauuc

SEQ ID NO: 42536 - RNA, 19 nt, Homo sapiens
caaggaaggaggacaugga

SEQ ID NO: 42537 - RNA, 19 nt, Homo sapiens
aggaacacgucauaucaga

SEQ ID NO: 42538 - RNA, 19 nt, Homo sapiens
ccacggcucugggcuucaa

SEQ ID NO: 42539 - RNA, 19 nt, Homo sapiens
ccucaucuccuccaauguu

SEQ ID NO: 42540 - RNA, 19 nt, Homo sapiens
gcaccagcccugaagaaag

SEQ ID NO: 42541 - RNA, 19 nt, Homo sapiens
ucagagagacggacacaag

SEQ ID NO: 42542 - RNA, 19 nt, Homo sapiens
gcacgccugucuuuaucca

SEQ ID NO: 42543 - RNA, 19 nt, Homo sapiens
gcguggcgcugucuacuac

SEQ ID NO: 42544 - RNA, 19 nt, Homo sapiens
cacuaaggauggcugauuc

SEQ ID NO: 42545 - RNA, 19 nt, Homo sapiens
ucacuaaggauggcugauu

SEQ ID NO: 42546 - RNA, 19 nt, Homo sapiens
cgacacccaugagccgaaa

SEQ ID NO: 42547 - RNA, 19 nt, Homo sapiens
ggaguucacccuggaguuc

SEQ ID NO: 42548 - RNA, 19 nt, Homo sapiens
uagagcgugugcagacuga

SEQ ID NO: 42549 - RNA, 19 nt, Homo sapiens
ggagacaagucgggaaagc

SEQ ID NO: 42550 - RNA, 19 nt, Homo sapiens
agacggaccugaccuucgu

SEQ ID NO: 42551 - RNA, 19 nt, Homo sapiens
ccaaggauugucccuaugu

SEQ ID NO: 42552 - RNA, 19 nt, Homo sapiens
ccgagaagcccucaucagu

SEQ ID NO: 42553 - RNA, 19 nt, Homo sapiens
acucggcucuggacuacaa

SEQ ID NO: 42554 - RNA, 19 nt, Homo sapiens
cgacucggcucuggacuac

SEQ ID NO: 42555 - RNA, 19 nt, Homo sapiens
gcugaccugcuguuuggua

SEQ ID NO: 42556 - RNA, 19 nt, Homo sapiens
cugcugaccugcuguuugg

SEQ ID NO: 42557 - RNA, 19 nt, Homo sapiens
caccagcccugaagaaagc

SEQ ID NO: 42558 - RNA, 19 nt, Homo sapiens
gcgcaagcuggacgaguuu

SEQ ID NO: 42559 - RNA, 19 nt, Homo sapiens
ccacgcagagguccaacuu

SEQ ID NO: 42560 - RNA, 19 nt, Homo sapiens
uugaagaaaugagccagaa

SEQ ID NO: 42561 - RNA, 19 nt, Homo sapiens
caugcacgccugucuuuau

SEQ ID NO: 42562 - RNA, 19 nt, Homo sapiens
ggccagggcagcaagaugu

SEQ ID NO: 42563 - RNA, 19 nt, Homo sapiens
guaaaucaagacucacauc

SEQ ID NO: 42564 - RNA, 19 nt, Homo sapiens
gugugcagacugaugauuu

SEQ ID NO: 42565 - RNA, 19 nt, Homo sapiens
caaggauugucccuauguc

SEQ ID NO: 42566 - RNA, 19 nt, Homo sapiens
ugaaccaggacaagaagaa

SEQ ID NO: 42567 - RNA, 19 nt, Homo sapiens
cacaugcacgccugucuuu

SEQ ID NO: 42568 - RNA, 19 nt, Homo sapiens
ggaguaugagccugagaug

SEQ ID NO: 42569 - RNA, 19 nt, Homo sapiens
gcucaccaccaaucagaug

SEQ ID NO: 42570 - RNA, 19 nt, Homo sapiens
uggcugcccuugucuccuu

SEQ ID NO: 42571 - RNA, 19 nt, Homo sapiens
aaaccugcaccaaggauug

SEQ ID NO: 42572 - RNA, 19 nt, Homo sapiens
ucgaggcugcuucuguuua

SEQ ID NO: 42573 - RNA, 19 nt, Homo sapiens
agaaaugagccagaaguga

SEQ ID NO: 42574 - RNA, 19 nt, Homo sapiens
ggugguggugcuccagaua

SEQ ID NO: 42575 - RNA, 19 nt, Homo sapiens
gaaaggaugucacuaagga

SEQ ID NO: 42576 - RNA, 19 nt, Homo sapiens
ggaaauccauguccgugua

SEQ ID NO: 42577 - RNA, 19 nt, Homo sapiens
ccaacgagcucccgaguga

SEQ ID NO: 42578 - RNA, 19 nt, Homo sapiens
gcagcaaguuugugcagua

SEQ ID NO: 42579 - RNA, 19 nt, Homo sapiens
gaagauggccucugaugga

SEQ ID NO: 42580 - RNA, 19 nt, Homo sapiens
gcagcaagauguuugugaa

SEQ ID NO: 42581 - RNA, 19 nt, Homo sapiens
gaacacgucauaucagaug

SEQ ID NO: 42582 - RNA, 19 nt, Homo sapiens
gcuguuugguagagaaaua

SEQ ID NO: 42583 - RNA, 19 nt, Homo sapiens
ucacaucccuuuccuaguc

SEQ ID NO: 42584 - RNA, 19 nt, Homo sapiens
gagcagauccuggcaaaga

SEQ ID NO: 42585 - RNA, 19 nt, Homo sapiens
gaugcgggcuccugccuuu

SEQ ID NO: 42586 - RNA, 19 nt, Homo sapiens
gcucgaggcugcuucuguu

SEQ ID NO: 42587 - RNA, 19 nt, Homo sapiens
guagagaaauaaagguugu

SEQ ID NO: 42588 - RNA, 19 nt, Homo sapiens
ggaggaacacgucauauca

SEQ ID NO: 42589 - RNA, 19 nt, Homo sapiens
ugacuugccugguggagaa

SEQ ID NO: 42590 - RNA, 19 nt, Homo sapiens
ggaaccacaugcacgaaau

SEQ ID NO: 42591 - RNA, 19 nt, Homo sapiens
gaccucacaucaacuucua

SEQ ID NO: 42592 - RNA, 19 nt, Homo sapiens
gggagcagauccuggcaaa

SEQ ID NO: 42593 - RNA, 19 nt, Homo sapiens
ccaaggguguguaugagaa

SEQ ID NO: 42594 - RNA, 19 nt, Homo sapiens
gaagcuggacguucacuug

SEQ ID NO: 42595 - RNA, 19 nt, Homo sapiens
gcagacugaugauuuuaua

SEQ ID NO: 42596 - RNA, 19 nt, Homo sapiens
gcaaguuugugcaguacga

SEQ ID NO: 42597 - RNA, 19 nt, Homo sapiens
ggacgacugcagcaaguuu

SEQ ID NO: 42598 - RNA, 19 nt, Homo sapiens
gcaagggcgugcagaggau

SEQ ID NO: 42599 - RNA, 19 nt, Homo sapiens
agaaauaaagguuguguga

SEQ ID NO: 42600 - RNA, 19 nt, Homo sapiens
gggugaaccuggugacaga

SEQ ID NO: 42601 - RNA, 19 nt, Homo sapiens
guaacacggucaucaagca

SEQ ID NO: 42602 - RNA, 19 nt, Homo sapiens
aaauaaagguugugugacu

SEQ ID NO: 42603 - RNA, 19 nt, Homo sapiens
caccaaggauugucccuau

SEQ ID NO: 42604 - RNA, 19 nt, Homo sapiens
ccaccgacauccucagguu

SEQ ID NO: 42605 - RNA, 19 nt, Homo sapiens
uuaacgagaucacugcuau

SEQ ID NO: 42606 - RNA, 19 nt, Homo sapiens
acacggagcugggcaagau

SEQ ID NO: 42607 - RNA, 19 nt, Homo sapiens
gccgaaaggaugucacuaa

SEQ ID NO: 42608 - RNA, 19 nt, Homo sapiens
cgaggcugcuucuguuuau

SEQ ID NO: 42609 - RNA, 19 nt, Homo sapiens
cgagaucacugcuaugacu

SEQ ID NO: 42610 - RNA, 19 nt, Homo sapiens
acagcaacaugaagcaauu

SEQ ID NO: 42611 - RNA, 19 nt, Homo sapiens
gagaaccugcaguccuuua

SEQ ID NO: 42612 - RNA, 19 nt, Homo sapiens
ucgaggcccugaaggagua

SEQ ID NO: 42613 - RNA, 19 nt, Homo sapiens
gaagugagcgcugggaaca

SEQ ID NO: 42614 - RNA, 19 nt, Homo sapiens
uggagaagaugaacguguu

SEQ ID NO: 42615 - RNA, 19 nt, Homo sapiens
cgggagauguucagaguca

SEQ ID NO: 42616 - RNA, 19 nt, Homo sapiens
ccuggugguuuguguauga

SEQ ID NO: 42617 - RNA, 19 nt, Homo sapiens
ccgcaggcuuggcaucuuu

SEQ ID NO: 42618 - RNA, 19 nt, Homo sapiens
gaagugcuccgaagacaac

SEQ ID NO: 42619 - RNA, 19 nt, Homo sapiens
ucaagacucacaucccuuu

SEQ ID NO: 42620 - RNA, 19 nt, Homo sapiens
uggagaaccugcaguccuu

SEQ ID NO: 42621 - RNA, 19 nt, Homo sapiens
ccacucugcuuccacaaag

SEQ ID NO: 42622 - RNA, 19 nt, Homo sapiens
ccaccacacucgcccacuu

SEQ ID NO: 42623 - RNA, 19 nt, Homo sapiens
agauggugcugucagauga

SEQ ID NO: 42624 - RNA, 19 nt, Homo sapiens
cagagauggugcugucaga

SEQ ID NO: 42625 - RNA, 19 nt, Homo sapiens
ggauugucccuaugucuug

SEQ ID NO: 42626 - RNA, 19 nt, Homo sapiens
gcuggaggaacacgucaua

SEQ ID NO: 42627 - RNA, 19 nt, Homo sapiens
ggacucuccugggaaguuc

SEQ ID NO: 42628 - RNA, 19 nt, Homo sapiens
uaccucaucuccuccaaug

SEQ ID NO: 42629 - RNA, 19 nt, Homo sapiens
gaaaccugcaccaaggauu

SEQ ID NO: 42630 - RNA, 19 nt, Homo sapiens
guccugagcucgggagaug

SEQ ID NO: 42631 - RNA, 19 nt, Homo sapiens
gaggcugcuucuguuuaua

SEQ ID NO: 42632 - RNA, 19 nt, Homo sapiens
cgaaaugagccagaaguga

SEQ ID NO: 42633 - RNA, 19 nt, Homo sapiens
gaaccacaugcacgaaaug

SEQ ID NO: 42634 - RNA, 19 nt, Homo sapiens
gagauggugcugucagaug

SEQ ID NO: 42635 - RNA, 19 nt, Homo sapiens
ccgaaaggaugucacuaag

SEQ ID NO: 42636 - RNA, 19 nt, Homo sapiens
ccugggaggucuguaauuc

SEQ ID NO: 42637 - RNA, 19 nt, Homo sapiens
caaggaaggaggacaugga

SEQ ID NO: 42638 - RNA, 19 nt, Homo sapiens
aggaacacgucauaucaga

SEQ ID NO: 42639 - RNA, 19 nt, Homo sapiens
ccacggcucugggcuucaa

SEQ ID NO: 42640 - RNA, 19 nt, Homo sapiens
ccucaucuccuccaauguu

SEQ ID NO: 42641 - RNA, 19 nt, Homo sapiens
gcaccagcccugaagaaag

SEQ ID NO: 42642 - RNA, 19 nt, Homo sapiens
ucagagagacggacacaag

SEQ ID NO: 42643 - RNA, 19 nt, Homo sapiens
gcguggcgcugucuacuac

SEQ ID NO: 42644 - RNA, 19 nt, Homo sapiens
cacuaaggauggcugauuc

SEQ ID NO: 42645 - RNA, 19 nt, Homo sapiens
ucacuaaggauggcugauu

SEQ ID NO: 42646 - RNA, 19 nt, Homo sapiens
cgacacccaugagccgaaa

SEQ ID NO: 42647 - RNA, 19 nt, Homo sapiens
ggaguucacccuggaguuc

SEQ ID NO: 42648 - RNA, 19 nt, Homo sapiens
uagagcgugugcagacuga

SEQ ID NO: 42649 - RNA, 19 nt, Homo sapiens
ggagacaagucgggaaagc

SEQ ID NO: 42650 - RNA, 19 nt, Homo sapiens
agacggaccugaccuucgu

SEQ ID NO: 42651 - RNA, 19 nt, Homo sapiens
ccaaggauugucccuaugu

SEQ ID NO: 42652 - RNA, 19 nt, Homo sapiens
ccgagaagcccucaucagu

SEQ ID NO: 42653 - RNA, 19 nt, Homo sapiens
acucggcucuggacuacaa

SEQ ID NO: 42654 - RNA, 19 nt, Homo sapiens
cgacucggcucuggacuac

SEQ ID NO: 42655 - RNA, 19 nt, Homo sapiens
gcugaccugcuguuuggua

SEQ ID NO: 42656 - RNA, 19 nt, Homo sapiens
cugcugaccugcuguuugg

SEQ ID NO: 42657 - RNA, 19 nt, Homo sapiens
caccagcccugaagaaagc

SEQ ID NO: 42658 - RNA, 19 nt, Homo sapiens
gcgcaagcuggacgaguuu

SEQ ID NO: 42659 - RNA, 19 nt, Homo sapiens
ccacgcagagguccaacuu

SEQ ID NO: 42660 - RNA, 19 nt, Homo sapiens
ggccagggcagcaagaugu

SEQ ID NO: 42661 - RNA, 19 nt, Homo sapiens
guaaaucaagacucacauc

SEQ ID NO: 42662 - RNA, 19 nt, Homo sapiens
gugugcagacugaugauuu

SEQ ID NO: 42663 - RNA, 19 nt, Homo sapiens
caaggauugucccuauguc

SEQ ID NO: 42664 - RNA, 19 nt, Homo sapiens
ggaguaugagccugagaug

SEQ ID NO: 42665 - RNA, 19 nt, Homo sapiens
ugaaccaggacaagaagaa

SEQ ID NO: 42666 - RNA, 19 nt, Homo sapiens
gcucaccaccaaucagaug

SEQ ID NO: 42667 - RNA, 19 nt, Homo sapiens
uggcugcccuugucuccuu

SEQ ID NO: 42668 - RNA, 19 nt, Homo sapiens
aaaccugcaccaaggauug

SEQ ID NO: 42669 - RNA, 19 nt, Homo sapiens
ucgaggcugcuucuguuua

SEQ ID NO: 42670 - RNA, 19 nt, Homo sapiens
ggugguggugcuccagaua

SEQ ID NO: 42671 - RNA, 19 nt, Homo sapiens
caucgacugugagguguuc

SEQ ID NO: 42672 - RNA, 19 nt, Homo sapiens
gcaucuuccucacggcaau

SEQ ID NO: 42673 - RNA, 19 nt, Homo sapiens
caucucggguaccacguau

SEQ ID NO: 42674 - RNA, 19 nt, Homo sapiens
gcacgcucaccaccaauca

SEQ ID NO: 42675 - RNA, 19 nt, Homo sapiens
gaaaggaugucacuaagga

SEQ ID NO: 42676 - RNA, 19 nt, Homo sapiens
ggaaauccauguccgugua

SEQ ID NO: 42677 - RNA, 19 nt, Homo sapiens
ccaacgagcucccgaguga

SEQ ID NO: 42678 - RNA, 19 nt, Homo sapiens
gcagcaaguuugugcagua

SEQ ID NO: 42679 - RNA, 19 nt, Homo sapiens
gaagauggccucugaugga

SEQ ID NO: 42680 - RNA, 19 nt, Homo sapiens
gcagcaagauguuugugaa

SEQ ID NO: 42681 - RNA, 19 nt, Homo sapiens
gaacacgucauaucagaug

SEQ ID NO: 42682 - RNA, 19 nt, Homo sapiens
gcuguuugguagagaaaua

SEQ ID NO: 42683 - RNA, 19 nt, Homo sapiens
ucacaucccuuuccuaguc

SEQ ID NO: 42684 - RNA, 19 nt, Homo sapiens
gagcagauccuggcaaaga

SEQ ID NO: 42685 - RNA, 19 nt, Homo sapiens
gaugcgggcuccugccuuu

SEQ ID NO: 42686 - RNA, 19 nt, Homo sapiens
guagagaaauaaagguugu

SEQ ID NO: 42687 - RNA, 19 nt, Homo sapiens
ggaggaacacgucauauca

SEQ ID NO: 42688 - RNA, 19 nt, Homo sapiens
ugacuugccugguggagaa

SEQ ID NO: 42689 - RNA, 19 nt, Homo sapiens
gaccucacaucaacuucua

SEQ ID NO: 42690 - RNA, 19 nt, Homo sapiens
gggagcagauccuggcaaa

SEQ ID NO: 42691 - RNA, 19 nt, Homo sapiens
ccaaggguguguaugagaa

SEQ ID NO: 42692 - RNA, 19 nt, Homo sapiens
gaagaaaugagccagaagu

SEQ ID NO: 42693 - RNA, 19 nt, Homo sapiens
gcagacugaugauuuuaua

SEQ ID NO: 42694 - RNA, 19 nt, Homo sapiens
gcaaguuugugcaguacga

SEQ ID NO: 42695 - RNA, 19 nt, Homo sapiens
ggacgacugcagcaaguuu

SEQ ID NO: 42696 - RNA, 19 nt, Homo sapiens
gcaagggcgugcagaggau

SEQ ID NO: 42697 - RNA, 19 nt, Homo sapiens
agaaauaaagguuguguga

SEQ ID NO: 42698 - RNA, 19 nt, Homo sapiens
gggugaaccuggugacaga

SEQ ID NO: 42699 - RNA, 19 nt, Homo sapiens
guaacacggucaucaagca

SEQ ID NO: 42700 - RNA, 19 nt, Homo sapiens
aaauaaagguugugugacu

SEQ ID NO: 42701 - RNA, 19 nt, Homo sapiens
caccaaggauugucccuau

SEQ ID NO: 42702 - RNA, 19 nt, Homo sapiens
ccaccgacauccucagguu

SEQ ID NO: 42703 - RNA, 19 nt, Homo sapiens
uuaacgagaucacugcuau

SEQ ID NO: 42704 - RNA, 19 nt, Homo sapiens
acacggagcugggcaagau

SEQ ID NO: 42705 - RNA, 19 nt, Homo sapiens
gccgaaaggaugucacuaa

SEQ ID NO: 42706 - RNA, 19 nt, Homo sapiens
cgagaucacugcuaugacu

SEQ ID NO: 42707 - RNA, 19 nt, Homo sapiens
acagcaacaugaagcaauu

SEQ ID NO: 42708 - RNA, 19 nt, Homo sapiens
gagaaccugcaguccuuua

SEQ ID NO: 42709 - RNA, 19 nt, Homo sapiens
ucgaggcccugaaggagua

SEQ ID NO: 42710 - RNA, 19 nt, Homo sapiens
gaagugagcgcugggaaca

SEQ ID NO: 42711 - RNA, 19 nt, Homo sapiens
uggagaagaugaacguguu

SEQ ID NO: 42712 - RNA, 19 nt, Homo sapiens
cgggagauguucagaguca

SEQ ID NO: 42713 - RNA, 19 nt, Homo sapiens
ccuggugguuuguguauga

SEQ ID NO: 42714 - RNA, 19 nt, Homo sapiens
ccgcaggcuuggcaucuuu

SEQ ID NO: 42715 - RNA, 19 nt, Homo sapiens
gaagugcuccgaagacaac

SEQ ID NO: 42716 - RNA, 19 nt, Homo sapiens
ucaagacucacaucccuuu

SEQ ID NO: 42717 - RNA, 19 nt, Homo sapiens
uggagaaccugcaguccuu

SEQ ID NO: 42718 - RNA, 19 nt, Homo sapiens
agauggugcugucagauga

SEQ ID NO: 42719 - RNA, 19 nt, Homo sapiens
cagagauggugcugucaga

SEQ ID NO: 42720 - RNA, 19 nt, Homo sapiens
ggauugucccuaugucuug

SEQ ID NO: 42721 - RNA, 19 nt, Homo sapiens
gcuggaggaacacgucaua

SEQ ID NO: 42722 - RNA, 19 nt, Homo sapiens
acaccggguuggccucuuu

SEQ ID NO: 42723 - RNA, 19 nt, Homo sapiens
uaccucaucuccuccaaug

SEQ ID NO: 42724 - RNA, 19 nt, Homo sapiens
gaaaccugcaccaaggauu

SEQ ID NO: 42725 - RNA, 19 nt, Homo sapiens
guccugagcucgggagaug

SEQ ID NO: 42726 - RNA, 19 nt, Homo sapiens
gagauggugcugucagaug

SEQ ID NO: 42727 - RNA, 19 nt, Homo sapiens
ccgaaaggaugucacuaag

SEQ ID NO: 42728 - RNA, 19 nt, Homo sapiens
caaggaaggaggacaugga

SEQ ID NO: 42729 - RNA, 19 nt, Homo sapiens
aggaacacgucauaucaga

SEQ ID NO: 42730 - RNA, 19 nt, Homo sapiens
ccacggcucugggcuucaa

SEQ ID NO: 42731 - RNA, 19 nt, Homo sapiens
ccucaucuccuccaauguu

SEQ ID NO: 42732 - RNA, 19 nt, Homo sapiens
gcaccagcccugaagaaag

SEQ ID NO: 42733 - RNA, 19 nt, Homo sapiens
ucagagagacggacacaag

SEQ ID NO: 42734 - RNA, 19 nt, Homo sapiens
gcacgccugucuuuaucca

SEQ ID NO: 42735 - RNA, 19 nt, Homo sapiens
gcguggcgcugucuacuac

SEQ ID NO: 42736 - RNA, 19 nt, Homo sapiens
cacuaaggauggcugauuc

SEQ ID NO: 42737 - RNA, 19 nt, Homo sapiens
ucacuaaggauggcugauu

SEQ ID NO: 42738 - RNA, 19 nt, Homo sapiens
cgacacccaugagccgaaa

SEQ ID NO: 42739 - RNA, 19 nt, Homo sapiens
ggaguucacccuggaguuc

SEQ ID NO: 42740 - RNA, 19 nt, Homo sapiens
uagagcgugugcagacuga

SEQ ID NO: 42741 - RNA, 19 nt, Homo sapiens
ggagacaagucgggaaagc

SEQ ID NO: 42742 - RNA, 19 nt, Homo sapiens
agacggaccugaccuucgu

SEQ ID NO: 42743 - RNA, 19 nt, Homo sapiens
ccaaggauugucccuaugu

SEQ ID NO: 42744 - RNA, 19 nt, Homo sapiens
ccgagaagcccucaucagu

SEQ ID NO: 42745 - RNA, 19 nt, Homo sapiens
acucggcucuggacuacaa

SEQ ID NO: 42746 - RNA, 19 nt, Homo sapiens
cgacucggcucuggacuac

SEQ ID NO: 42747 - RNA, 19 nt, Homo sapiens
gcugaccugcuguuuggua

SEQ ID NO: 42748 - RNA, 19 nt, Homo sapiens
cugcugaccugcuguuugg

SEQ ID NO: 42749 - RNA, 19 nt, Homo sapiens
caccagcccugaagaaagc

SEQ ID NO: 42750 - RNA, 19 nt, Homo sapiens
gcgcaagcuggacgaguuu

SEQ ID NO: 42751 - RNA, 19 nt, Homo sapiens
ccacgcagagguccaacuu

SEQ ID NO: 42752 - RNA, 19 nt, Homo sapiens
uugaagaaaugagccagaa

SEQ ID NO: 42753 - RNA, 19 nt, Homo sapiens
caugcacgccugucuuuau

SEQ ID NO: 42754 - RNA, 19 nt, Homo sapiens
ggccagggcagcaagaugu

SEQ ID NO: 42755 - RNA, 19 nt, Homo sapiens
guaaaucaagacucacauc

SEQ ID NO: 42756 - RNA, 19 nt, Homo sapiens
gugugcagacugaugauuu

SEQ ID NO: 42757 - RNA, 19 nt, Homo sapiens
ggaguaugagccugagaug

SEQ ID NO: 42758 - RNA, 19 nt, Homo sapiens
caaggauugucccuauguc

SEQ ID NO: 42759 - RNA, 19 nt, Homo sapiens
cacaugcacgccugucuuu

SEQ ID NO: 42760 - RNA, 19 nt, Homo sapiens
gcucaccaccaaucagaug

SEQ ID NO: 42761 - RNA, 19 nt, Homo sapiens
ugaaccaggacaagaagaa

SEQ ID NO: 42762 - RNA, 19 nt, Homo sapiens
aaaccugcaccaaggauug

SEQ ID NO: 42763 - RNA, 19 nt, Homo sapiens
agaaaugagccagaaguga

SEQ ID NO: 42764 - RNA, 19 nt, Homo sapiens
ggugguggugcuccagaua

SEQ ID NO: 42765 - RNA, 19 nt, Homo sapiens
caucgacugugagguguuc

SEQ ID NO: 42766 - RNA, 19 nt, Homo sapiens
gcaucuuccucacggcaau

SEQ ID NO: 42767 - RNA, 19 nt, Homo sapiens
uggcugcccuugucuccuu

SEQ ID NO: 42768 - RNA, 19 nt, Homo sapiens
caucucggguaccacguau

SEQ ID NO: 42769 - RNA, 19 nt, Homo sapiens
gcacgcucaccaccaauca

SEQ ID NO: 42770 - RNA, 19 nt, Homo sapiens
gggcugcaccucagucauc

SEQ ID NO: 42771 - RNA, 19 nt, Homo sapiens
gcugucuacuacuucaaga

SEQ ID NO: 42772 - RNA, 19 nt, Homo sapiens
uaacucagcuuuugcuacu

SEQ ID NO: 42773 - RNA, 19 nt, Homo sapiens
gcaguccuuuaacgagauc

SEQ ID NO: 42774 - RNA, 19 nt, Homo sapiens
gcgcauggcacgcaagaac

SEQ ID NO: 42775 - RNA, 19 nt, Homo sapiens
gaaaugaacugacagauaa

SEQ ID NO: 42776 - RNA, 19 nt, Homo sapiens
gaaagcagauguuggauuu

SEQ ID NO: 42777 - RNA, 19 nt, Homo sapiens
ggaaauacaucaagugaaa

SEQ ID NO: 42778 - RNA, 19 nt, Homo sapiens
gaaggaaucuuuaacaaug

SEQ ID NO: 42779 - RNA, 19 nt, Homo sapiens
gaagaaagaugagaagaaa

SEQ ID NO: 42780 - RNA, 19 nt, Homo sapiens
gaaacaagauggagcuauu

SEQ ID NO: 42781 - RNA, 19 nt, Homo sapiens
ggccaaaucuugugguuua

SEQ ID NO: 42782 - RNA, 19 nt, Homo sapiens
gaacugauguagcuaaaga

SEQ ID NO: 42783 - RNA, 19 nt, Homo sapiens
gaaaugaaauaccagaaga

SEQ ID NO: 42784 - RNA, 19 nt, Homo sapiens
uagcagagcuuuaguuuau

SEQ ID NO: 42785 - RNA, 19 nt, Homo sapiens
caaagaagcuggucaugga

SEQ ID NO: 42786 - RNA, 19 nt, Homo sapiens
gauggagacuuuggaauua

SEQ ID NO: 42787 - RNA, 19 nt, Homo sapiens
gaaggaagcuaaucaugau

SEQ ID NO: 42788 - RNA, 19 nt, Homo sapiens
ggaauuaucuuuaccuuac

SEQ ID NO: 42789 - RNA, 19 nt, Homo sapiens
ggaagaaggugaaggugaa

SEQ ID NO: 42790 - RNA, 19 nt, Homo sapiens
ggagaugucuauggaauuu

SEQ ID NO: 42791 - RNA, 19 nt, Homo sapiens
gaauucaccuuacaauaga

SEQ ID NO: 42792 - RNA, 19 nt, Homo sapiens
ggaaggcucuggaagaaug

SEQ ID NO: 42793 - RNA, 19 nt, Homo sapiens
cgaaauaaaugcccggaaa

SEQ ID NO: 42794 - RNA, 19 nt, Homo sapiens
gaauugugcuuauacauca

SEQ ID NO: 42795 - RNA, 19 nt, Homo sapiens
gaaauauggugaucuucuu

SEQ ID NO: 42796 - RNA, 19 nt, Homo sapiens
aaagaagcauccgauauua

SEQ ID NO: 42797 - RNA, 19 nt, Homo sapiens
uggaaacccugcagauuua

SEQ ID NO: 42798 - RNA, 19 nt, Homo sapiens
gaagcuuccuuauaacuga

SEQ ID NO: 42799 - RNA, 19 nt, Homo sapiens
gaaaacaucucccaaugaa

SEQ ID NO: 42800 - RNA, 19 nt, Homo sapiens
cacacuagcugcauuguaa

SEQ ID NO: 42801 - RNA, 19 nt, Homo sapiens
ccaggaagcccacuacaua

SEQ ID NO: 42802 - RNA, 19 nt, Homo sapiens
uaaagaagcauccgauauu

SEQ ID NO: 42803 - RNA, 19 nt, Homo sapiens
gagaagcaguguuuggaaa

SEQ ID NO: 42804 - RNA, 19 nt, Homo sapiens
gaaaugaacaagucugcua

SEQ ID NO: 42805 - RNA, 19 nt, Homo sapiens
ggaauucaccuuacaauag

SEQ ID NO: 42806 - RNA, 19 nt, Homo sapiens
gaaauaagccucucaucuc

SEQ ID NO: 42807 - RNA, 19 nt, Homo sapiens
ggaccgugaugauauugua

SEQ ID NO: 42808 - RNA, 19 nt, Homo sapiens
gauggaaguuaucgaauau

SEQ ID NO: 42809 - RNA, 19 nt, Homo sapiens
gaugacaacuuuacaagca

SEQ ID NO: 42810 - RNA, 19 nt, Homo sapiens
gcacaccaauuuauauaca

SEQ ID NO: 42811 - RNA, 19 nt, Homo sapiens
gcaauccucuugucuguag

SEQ ID NO: 42812 - RNA, 19 nt, Homo sapiens
ggagagagagggaggagua

SEQ ID NO: 42813 - RNA, 19 nt, Homo sapiens
gcaacgaucuuaaaauuga

SEQ ID NO: 42814 - RNA, 19 nt, Homo sapiens
gaaacuggguggauugaag

SEQ ID NO: 42815 - RNA, 19 nt, Homo sapiens
gauuguaagcugaauguua

SEQ ID NO: 42816 - RNA, 19 nt, Homo sapiens
ucucacagaugacaacuuu

SEQ ID NO: 42817 - RNA, 19 nt, Homo sapiens
gcuguuggcuguuaauaau

SEQ ID NO: 42818 - RNA, 19 nt, Homo sapiens
caauagaaaugaacaaguc

SEQ ID NO: 42819 - RNA, 19 nt, Homo sapiens
gauugaagauccugugaga

SEQ ID NO: 42820 - RNA, 19 nt, Homo sapiens
guuaggaaguccaugagua

SEQ ID NO: 42821 - RNA, 19 nt, Homo sapiens
ugacagucguucaagcuua

SEQ ID NO: 42822 - RNA, 19 nt, Homo sapiens
ggaaagcuauggagauguc

SEQ ID NO: 42823 - RNA, 19 nt, Homo sapiens
ccaacuuacuguuaaugua

SEQ ID NO: 42824 - RNA, 19 nt, Homo sapiens
gagcucagguccacagaug

SEQ ID NO: 42825 - RNA, 19 nt, Homo sapiens
gugaaugcauuucguaguu

SEQ ID NO: 42826 - RNA, 19 nt, Homo sapiens
agaaauaccugaggaggaa

SEQ ID NO: 42827 - RNA, 19 nt, Homo sapiens
cagcuuauuucaacaauuc

SEQ ID NO: 42828 - RNA, 19 nt, Homo sapiens
acucaagacucaccgcuua

SEQ ID NO: 42829 - RNA, 19 nt, Homo sapiens
gaaagaggguggauuaccu

SEQ ID NO: 42830 - RNA, 19 nt, Homo sapiens
agagaaagaggguggauua

SEQ ID NO: 42831 - RNA, 19 nt, Homo sapiens
gagccgaauugaacaagaa

SEQ ID NO: 42832 - RNA, 19 nt, Homo sapiens
ggaauuagcagaggauguu

SEQ ID NO: 42833 - RNA, 19 nt, Homo sapiens
guaaaccucauaauggaua

SEQ ID NO: 42834 - RNA, 19 nt, Homo sapiens
ggguaaaccucauaaugga

SEQ ID NO: 42835 - RNA, 19 nt, Homo sapiens
gaaccagagugggauaaug

SEQ ID NO: 42836 - RNA, 19 nt, Homo sapiens
agauggaaguuaucgaaua

SEQ ID NO: 42837 - RNA, 19 nt, Homo sapiens
gggaaaugcuacagcuauu

SEQ ID NO: 42838 - RNA, 19 nt, Homo sapiens
gaaauugcagccauaguau

SEQ ID NO: 42839 - RNA, 19 nt, Homo sapiens
caaagcaggucuguugaug

SEQ ID NO: 42840 - RNA, 19 nt, Homo sapiens
agaaaugaacugacagaua

SEQ ID NO: 42841 - RNA, 19 nt, Homo sapiens
uaugacacauccugaguuu

SEQ ID NO: 42842 - RNA, 19 nt, Homo sapiens
gaagaaaugcuccuuugca

SEQ ID NO: 42843 - RNA, 19 nt, Homo sapiens
caacggaaccacccacuga

SEQ ID NO: 42844 - RNA, 19 nt, Homo sapiens
cagaagcuauuccaccaaa

SEQ ID NO: 42845 - RNA, 19 nt, Homo sapiens
ucaagaaguucgauucaca

SEQ ID NO: 42846 - RNA, 19 nt, Homo sapiens
guaguagucuuuacacucu

SEQ ID NO: 42847 - RNA, 19 nt, Homo sapiens
aaauaagccucucaucuca

SEQ ID NO: 42848 - RNA, 19 nt, Homo sapiens
agauauugcucaagugaaa

SEQ ID NO: 42849 - RNA, 19 nt, Homo sapiens
ggaguaaggagaaacaguu

SEQ ID NO: 42850 - RNA, 19 nt, Homo sapiens
gaagcaguguuuggaaaga

SEQ ID NO: 42851 - RNA, 19 nt, Homo sapiens
guggaaacccugcagauuu

SEQ ID NO: 42852 - RNA, 19 nt, Homo sapiens
caagguuuguagauacuuu

SEQ ID NO: 42853 - RNA, 19 nt, Homo sapiens
gauaagcauacacugguua

SEQ ID NO: 42854 - RNA, 19 nt, Homo sapiens
aaggagagauugagcaaga

SEQ ID NO: 42855 - RNA, 19 nt, Homo sapiens
acaggaacuuugacaauga

SEQ ID NO: 42856 - RNA, 19 nt, Homo sapiens
caucacaguuaucauucua

SEQ ID NO: 42857 - RNA, 19 nt, Homo sapiens
ggagauauugcucaaguga

SEQ ID NO: 42858 - RNA, 19 nt, Homo sapiens
caugaguacuguccugaaa

SEQ ID NO: 42859 - RNA, 19 nt, Homo sapiens
caaugaguguuugguuuaa

SEQ ID NO: 42860 - RNA, 19 nt, Homo sapiens
ucagaaggcuugagaacca

SEQ ID NO: 42861 - RNA, 19 nt, Homo sapiens
ugaaggaagcuaaucauga

SEQ ID NO: 42862 - RNA, 19 nt, Homo sapiens
ggaaguccaugaguacugu

SEQ ID NO: 42863 - RNA, 19 nt, Homo sapiens
aagaagcacuguacaaagu

SEQ ID NO: 42864 - RNA, 19 nt, Homo sapiens
gaacagaaugacagucguu

SEQ ID NO: 42865 - RNA, 19 nt, Homo sapiens
gaauugaacaagaacagaa

SEQ ID NO: 42866 - RNA, 19 nt, Homo sapiens
agaaauugcagccauagua

SEQ ID NO: 42867 - RNA, 19 nt, Homo sapiens
uacaaugaguguuugguuu

SEQ ID NO: 42868 - RNA, 19 nt, Homo sapiens
gacaguggaauucaccuua

SEQ ID NO: 42869 - RNA, 19 nt, Homo sapiens
aaaccggaaucaagaaguu

SEQ ID NO: 42870 - RNA, 19 nt, Homo sapiens
aaagaaagcagauguugga

SEQ ID NO: 42871 - RNA, 19 nt, Homo sapiens
gagaggauagacaagauuu

SEQ ID NO: 42872 - RNA, 19 nt, Homo sapiens
ggugccagaugcaauuaaa

SEQ ID NO: 42873 - RNA, 19 nt, Homo sapiens
caagggaccgugaugauau

SEQ ID NO: 42874 - RNA, 19 nt, Homo sapiens
gaagaagcacuguacaaag

SEQ ID NO: 42875 - RNA, 19 nt, Homo sapiens
gagcuuaacucgccuagua

SEQ ID NO: 42876 - RNA, 19 nt, Homo sapiens
gaugaaagcucccuaacug

SEQ ID NO: 42877 - RNA, 19 nt, Homo sapiens
ggacauagcccaggucaaa

SEQ ID NO: 42878 - RNA, 19 nt, Homo sapiens
gcacugacguggccaagga

SEQ ID NO: 42879 - RNA, 19 nt, Homo sapiens
gacgagagcuuccgcaugu

SEQ ID NO: 42880 - RNA, 19 nt, Homo sapiens
gaaccuccauccauaacuu

SEQ ID NO: 42881 - RNA, 19 nt, Homo sapiens
caaaucagcuaccucuuca

SEQ ID NO: 42882 - RNA, 19 nt, Homo sapiens
gggacgagaugguaaagaa

SEQ ID NO: 42883 - RNA, 19 nt, Homo sapiens
gagcaggaacagaaauuua

SEQ ID NO: 42884 - RNA, 19 nt, Homo sapiens
ccauauagauagguagaua

SEQ ID NO: 42885 - RNA, 19 nt, Homo sapiens
uaacucgccuaguagauuu

SEQ ID NO: 42886 - RNA, 19 nt, Homo sapiens
ggacaagcauacccugguu

SEQ ID NO: 42887 - RNA, 19 nt, Homo sapiens
ggucucaguuguauagauu

SEQ ID NO: 42888 - RNA, 19 nt, Homo sapiens
ccugacaccucucauuuaa

SEQ ID NO: 42889 - RNA, 19 nt, Homo sapiens
cgucaucccucaacaagaa

SEQ ID NO: 42890 - RNA, 19 nt, Homo sapiens
gaggagaaguuguacaaag

SEQ ID NO: 42891 - RNA, 19 nt, Homo sapiens
ucucgaaccuccauccaua

SEQ ID NO: 42892 - RNA, 19 nt, Homo sapiens
ccaauccacuggucuguga

SEQ ID NO: 42893 - RNA, 19 nt, Homo sapiens
gcgagaagauguuccagau

SEQ ID NO: 42894 - RNA, 19 nt, Homo sapiens
cauagacacucacaagguu

SEQ ID NO: 42895 - RNA, 19 nt, Homo sapiens
gcaaaucagcuaccucuuc

SEQ ID NO: 42896 - RNA, 19 nt, Homo sapiens
gacaagaucuggccaaagc

SEQ ID NO: 42897 - RNA, 19 nt, Homo sapiens
gcaacaaucggaaaccaaa

SEQ ID NO: 42898 - RNA, 19 nt, Homo sapiens
gccauucuccucucaguua

SEQ ID NO: 42899 - RNA, 19 nt, Homo sapiens
ucacaagguuauauccauu

SEQ ID NO: 42900 - RNA, 19 nt, Homo sapiens
ccaggaccaugaugaagaa

SEQ ID NO: 42901 - RNA, 19 nt, Homo sapiens
gggagagccucgugucuuc

SEQ ID NO: 42902 - RNA, 19 nt, Homo sapiens
gagcaaagagaaacaguuc

SEQ ID NO: 42903 - RNA, 19 nt, Homo sapiens
gagcaaggaccgcagcaaa

SEQ ID NO: 42904 - RNA, 19 nt, Homo sapiens
ccgcuuaaauugcucuauu

SEQ ID NO: 42905 - RNA, 19 nt, Homo sapiens
gaugcuguuugaacucuuu

SEQ ID NO: 42906 - RNA, 19 nt, Homo sapiens
gcgaugggcuccgcacuau

SEQ ID NO: 42907 - RNA, 19 nt, Homo sapiens
gaaggacaacaaccuggua

SEQ ID NO: 42908 - RNA, 19 nt, Homo sapiens
acaccgaccuggaagaaga

SEQ ID NO: 42909 - RNA, 19 nt, Homo sapiens
gaacauuacaccaucaucu

SEQ ID NO: 42910 - RNA, 19 nt, Homo sapiens
gacagcaucuccaaauucu

SEQ ID NO: 42911 - RNA, 19 nt, Homo sapiens
gucaaguucuucaucauug

SEQ ID NO: 42912 - RNA, 19 nt, Homo sapiens
gcacugaggcuguggucaa

SEQ ID NO: 42913 - RNA, 19 nt, Homo sapiens
ggcgggaacugcaaacaga

SEQ ID NO: 42914 - RNA, 19 nt, Homo sapiens
gcaaguccaugagcacugu

SEQ ID NO: 42915 - RNA, 19 nt, Homo sapiens
ugccacagcugaccaguga

SEQ ID NO: 42916 - RNA, 19 nt, Homo sapiens
caauggaaccgaagaacuu

SEQ ID NO: 42917 - RNA, 19 nt, Homo sapiens
ggaccaugaugaagaacau

SEQ ID NO: 42918 - RNA, 19 nt, Homo sapiens
agaaugacauccucaacga

SEQ ID NO: 42919 - RNA, 19 nt, Homo sapiens
gagaaguuguacaaagugu

SEQ ID NO: 42920 - RNA, 19 nt, Homo sapiens
cuauggagcugcugaucaa

SEQ ID NO: 42921 - RNA, 19 nt, Homo sapiens
cagacuggcaucaucuuua

SEQ ID NO: 42922 - RNA, 19 nt, Homo sapiens
caacagcgccaucgacagu

SEQ ID NO: 42923 - RNA, 19 nt, Homo sapiens
gggugaaccucaucaugga

SEQ ID NO: 42924 - RNA, 19 nt, Homo sapiens
ggagcgaauugacaagauc

SEQ ID NO: 42925 - RNA, 19 nt, Homo sapiens
caucaaguguggcaucauc

SEQ ID NO: 42926 - RNA, 19 nt, Homo sapiens
ggacugggacaaugagaau

SEQ ID NO: 42927 - RNA, 19 nt, Homo sapiens
ggaagagaagaaagacaaa

SEQ ID NO: 42928 - RNA, 19 nt, Homo sapiens
ggagauugccgccaucauc

SEQ ID NO: 42929 - RNA, 19 nt, Homo sapiens
gugcauauucauuggguua

SEQ ID NO: 42930 - RNA, 19 nt, Homo sapiens
cagcaucuccaaauucuug

SEQ ID NO: 42931 - RNA, 19 nt, Homo sapiens
cagcauggucucaguugua

SEQ ID NO: 42932 - RNA, 19 nt, Homo sapiens
ucagcuaccucuucaaguc

SEQ ID NO: 42933 - RNA, 19 nt, Homo sapiens
gcaggcaggcucacacaga

SEQ ID NO: 42934 - RNA, 19 nt, Homo sapiens
ugaugcagcucuucaacga

SEQ ID NO: 42935 - RNA, 19 nt, Homo sapiens
gcaacaagccgcucaucuc

SEQ ID NO: 42936 - RNA, 19 nt, Homo sapiens
gggcaaugaccucaagauu

SEQ ID NO: 42937 - RNA, 19 nt, Homo sapiens
gguuauauccauuucuuug

SEQ ID NO: 42938 - RNA, 19 nt, Homo sapiens
uggcugcgaugcuguuuga

SEQ ID NO: 42939 - RNA, 19 nt, Homo sapiens
caaggaggccucagacauc

SEQ ID NO: 42940 - RNA, 19 nt, Homo sapiens
gcaaggaccgcagcaaaca

SEQ ID NO: 42941 - RNA, 19 nt, Homo sapiens
caggcaggcucacacagaa

SEQ ID NO: 42942 - RNA, 19 nt, Homo sapiens
ucaacgaacucaccugcau

SEQ ID NO: 42943 - RNA, 19 nt, Homo sapiens
gcaucgagcaggaacagaa

SEQ ID NO: 42944 - RNA, 19 nt, Homo sapiens
cauggucacuggcgacaau

SEQ ID NO: 42945 - RNA, 19 nt, Homo sapiens
ucaaugccaucgccaucaa

SEQ ID NO: 42946 - RNA, 19 nt, Homo sapiens
acauagcccaggucaaaua

SEQ ID NO: 42947 - RNA, 19 nt, Homo sapiens
ggacgugacgcucaucauc

SEQ ID NO: 42948 - RNA, 19 nt, Homo sapiens
gagacuguauacguccaua

SEQ ID NO: 42949 - RNA, 19 nt, Homo sapiens
caguggauguggugcauau

SEQ ID NO: 42950 - RNA, 19 nt, Homo sapiens
gugaagaggaagagaagaa

SEQ ID NO: 42951 - RNA, 19 nt, Homo sapiens
ccuaguagauuugcaccaa

SEQ ID NO: 42952 - RNA, 19 nt, Homo sapiens
gcacagcauggucucaguu

SEQ ID NO: 42953 - RNA, 19 nt, Homo sapiens
gagcaacaaucggaaacca

SEQ ID NO: 42954 - RNA, 19 nt, Homo sapiens
gacacaagcaaaucagcua

SEQ ID NO: 42955 - RNA, 19 nt, Homo sapiens
ugaaucggauccagacaca

SEQ ID NO: 42956 - RNA, 19 nt, Homo sapiens
gacaagcauacccugguua

SEQ ID NO: 42957 - RNA, 19 nt, Homo sapiens
cagaggagaaguuguacaa

SEQ ID NO: 42958 - RNA, 19 nt, Homo sapiens
ccguagcucucucuaugaa

SEQ ID NO: 42959 - RNA, 19 nt, Homo sapiens
gagcaggagcgaauugaca

SEQ ID NO: 42960 - RNA, 19 nt, Homo sapiens
gagccggacugggacaaug

SEQ ID NO: 42961 - RNA, 19 nt, Homo sapiens
ugaagaaaaugaugaagga

SEQ ID NO: 42962 - RNA, 19 nt, Homo sapiens
caagcuggcugugcagauc

SEQ ID NO: 42963 - RNA, 19 nt, Homo sapiens
ucaagaucaaggagacuua

SEQ ID NO: 42964 - RNA, 19 nt, Homo sapiens
ugacagcaucuccaaauuc

SEQ ID NO: 42965 - RNA, 19 nt, Homo sapiens
ggagaaguuguacaaagug

SEQ ID NO: 42966 - RNA, 19 nt, Homo sapiens
gacguccacuauaaagaga

SEQ ID NO: 42967 - RNA, 19 nt, Homo sapiens
gaccaccaaucgcaugaca

SEQ ID NO: 42968 - RNA, 19 nt, Homo sapiens
ggagcaaagagaaacaguu

SEQ ID NO: 42969 - RNA, 19 nt, Homo sapiens
caucuucacccugcucuuu

SEQ ID NO: 42970 - RNA, 19 nt, Homo sapiens
caacgugguggccgugauu

SEQ ID NO: 42971 - RNA, 19 nt, Homo sapiens
gaaugacauccucaacgaa

SEQ ID NO: 42972 - RNA, 19 nt, Homo sapiens
aggagaaguuguacaaagu

SEQ ID NO: 42973 - RNA, 19 nt, Homo sapiens
gagcucaccaccacuguca

SEQ ID NO: 42974 - RNA, 19 nt, Homo sapiens
uaguagauuugcaccaaug

SEQ ID NO: 42975 - RNA, 19 nt, Homo sapiens
caacuaagguggcugaaga

SEQ ID NO: 42976 - RNA, 19 nt, Homo sapiens
gaacuugccucagcacaug

SEQ ID NO: 42977 - RNA, 19 nt, Homo sapiens
gaacagcaauggcgaacuc

SEQ ID NO: 42978 - RNA, 19 nt, Homo sapiens
gugaguaccuucaagagaa

SEQ ID NO: 42979 - RNA, 19 nt, Homo sapiens
ccaaugaccucaagaucga

SEQ ID NO: 42980 - RNA, 19 nt, Homo sapiens
gaauugagcaggagcagaa

SEQ ID NO: 42981 - RNA, 19 nt, Homo sapiens
gcaaggacccaaauccauu

SEQ ID NO: 42982 - RNA, 19 nt, Homo sapiens
caagucagcuaccucuuca

SEQ ID NO: 42983 - RNA, 19 nt, Homo sapiens
cauggaagguucuggaaga

SEQ ID NO: 42984 - RNA, 19 nt, Homo sapiens
ggaagacaagcuuuacaaa

SEQ ID NO: 42985 - RNA, 19 nt, Homo sapiens
ucaaagccgugcagauguu

SEQ ID NO: 42986 - RNA, 19 nt, Homo sapiens
agacgucccucuaacaaga

SEQ ID NO: 42987 - RNA, 19 nt, Homo sapiens
caagagaagcgguucaguu

SEQ ID NO: 42988 - RNA, 19 nt, Homo sapiens
gaaaguccaugagcacagu

SEQ ID NO: 42989 - RNA, 19 nt, Homo sapiens
ccgaguuucugaucaauga

SEQ ID NO: 42990 - RNA, 19 nt, Homo sapiens
gcaccaacaucuugaacag

SEQ ID NO: 42991 - RNA, 19 nt, Homo sapiens
gcgagcagaucccggaaga

SEQ ID NO: 42992 - RNA, 19 nt, Homo sapiens
gcacuacaccaucaucuuc

SEQ ID NO: 42993 - RNA, 19 nt, Homo sapiens
ccaaguuccugcaguuuca

SEQ ID NO: 42994 - RNA, 19 nt, Homo sapiens
gaagagaagaaagauaaga

SEQ ID NO: 42995 - RNA, 19 nt, Homo sapiens
gaacaacaacgccauagac

SEQ ID NO: 42996 - RNA, 19 nt, Homo sapiens
gagaagcgguucaguucag

SEQ ID NO: 42997 - RNA, 19 nt, Homo sapiens
ggagacgucccucuaacaa

SEQ ID NO: 42998 - RNA, 19 nt, Homo sapiens
gcaccaugaugaagaacau

SEQ ID NO: 42999 - RNA, 19 nt, Homo sapiens
ggacgugacccucaucauc

SEQ ID NO: 43000 - RNA, 19 nt, Homo sapiens
gaagucacacgcacacaug

SEQ ID NO: 43001 - RNA, 19 nt, Homo sapiens
ucagcuaccucuucagugu

SEQ ID NO: 43002 - RNA, 19 nt, Homo sapiens
ucagagcacuacaccauca

SEQ ID NO: 43003 - RNA, 19 nt, Homo sapiens
gcacgccggucuauguaca

SEQ ID NO: 43004 - RNA, 19 nt, Homo sapiens
gagaguagccagaccaaag

SEQ ID NO: 43005 - RNA, 19 nt, Homo sapiens
gagaggaggaagagaagaa

SEQ ID NO: 43006 - RNA, 19 nt, Homo sapiens
caaagcaacccaagaccuu

SEQ ID NO: 43007 - RNA, 19 nt, Homo sapiens
ugaugcagcucuuuaacga

SEQ ID NO: 43008 - RNA, 19 nt, Homo sapiens
gggacgacauggugaggaa

SEQ ID NO: 43009 - RNA, 19 nt, Homo sapiens
gaaagccaacgcacccaaa

SEQ ID NO: 43010 - RNA, 19 nt, Homo sapiens
cgacauggccaauaguuca

SEQ ID NO: 43011 - RNA, 19 nt, Homo sapiens
aggaagagaagaaagauaa

SEQ ID NO: 43012 - RNA, 19 nt, Homo sapiens
gaggaagagaagaaagaua

SEQ ID NO: 43013 - RNA, 19 nt, Homo sapiens
ggaggaagaggaggacaaa

SEQ ID NO: 43014 - RNA, 19 nt, Homo sapiens
ccgaggcgcugcagaagau

SEQ ID NO: 43015 - RNA, 19 nt, Homo sapiens
ugagaaaggcgagauagaa

SEQ ID NO: 43016 - RNA, 19 nt, Homo sapiens
ggacccaaauccauucaac

SEQ ID NO: 43017 - RNA, 19 nt, Homo sapiens
ccacgcaugucaccaaguc

SEQ ID NO: 43018 - RNA, 19 nt, Homo sapiens
gagaagcgcaggcagaucu

SEQ ID NO: 43019 - RNA, 19 nt, Homo sapiens
caucacaguccgcauggua

SEQ ID NO: 43020 - RNA, 19 nt, Homo sapiens
gagcagaucccggaagaca

SEQ ID NO: 43021 - RNA, 19 nt, Homo sapiens
uccaagaccuccauucaca

SEQ ID NO: 43022 - RNA, 19 nt, Homo sapiens
ggauucagauugucaucgu

SEQ ID NO: 43023 - RNA, 19 nt, Homo sapiens
aagcagggcuggugauguc

SEQ ID NO: 43024 - RNA, 19 nt, Homo sapiens
gaaagcagggcuggugaug

SEQ ID NO: 43025 - RNA, 19 nt, Homo sapiens
gagaagaaagauaagaaag

SEQ ID NO: 43026 - RNA, 19 nt, Homo sapiens
ggagcaaggagaagcaguu

SEQ ID NO: 43027 - RNA, 19 nt, Homo sapiens
gagugaagccugugggaau

SEQ ID NO: 43028 - RNA, 19 nt, Homo sapiens
cacaacaucccgcucauug

SEQ ID NO: 43029 - RNA, 19 nt, Homo sapiens
gcagauggagguagugagu

SEQ ID NO: 43030 - RNA, 19 nt, Homo sapiens
ggacuuccugugccuagaa

SEQ ID NO: 43031 - RNA, 19 nt, Homo sapiens
cgaggucccugaagcuauc

SEQ ID NO: 43032 - RNA, 19 nt, Homo sapiens
gcagaucccggaagacaag

SEQ ID NO: 43033 - RNA, 19 nt, Homo sapiens
gcggagaggaggaagagaa

SEQ ID NO: 43034 - RNA, 19 nt, Homo sapiens
gcacgcacacacacauaug

SEQ ID NO: 43035 - RNA, 19 nt, Homo sapiens
ccagaacaacaacgccaua

SEQ ID NO: 43036 - RNA, 19 nt, Homo sapiens
guagugaguaccuucaaga

SEQ ID NO: 43037 - RNA, 19 nt, Homo sapiens
caaugagaaaggcgagaua

SEQ ID NO: 43038 - RNA, 19 nt, Homo sapiens
ggacauugcccaggucaag

SEQ ID NO: 43039 - RNA, 19 nt, Homo sapiens
caucuucacccugcuguuu

SEQ ID NO: 43040 - RNA, 19 nt, Homo sapiens
aauacuaccuccugagaag

SEQ ID NO: 43041 - RNA, 19 nt, Homo sapiens
ggacacccacuacaaagag

SEQ ID NO: 43042 - RNA, 19 nt, Homo sapiens
gagaaaccagaauccaaga

SEQ ID NO: 43043 - RNA, 19 nt, Homo sapiens
aagagaagcgguucaguuc

SEQ ID NO: 43044 - RNA, 19 nt, Homo sapiens
agaccuccauucacaacuu

SEQ ID NO: 43045 - RNA, 19 nt, Homo sapiens
gacguaaccaaucuuucua

SEQ ID NO: 43046 - RNA, 19 nt, Homo sapiens
cagccagcuucaugacgua

SEQ ID NO: 43047 - RNA, 19 nt, Homo sapiens
gagaaaggcgagauagaac

SEQ ID NO: 43048 - RNA, 19 nt, Homo sapiens
aaagugcaccaacaucuug

SEQ ID NO: 43049 - RNA, 19 nt, Homo sapiens
uggaggagcgggagaagaa

SEQ ID NO: 43050 - RNA, 19 nt, Homo sapiens
ccaagucagcuaccucuuc

SEQ ID NO: 43051 - RNA, 19 nt, Homo sapiens
ugacuacacccacaacauc

SEQ ID NO: 43052 - RNA, 19 nt, Homo sapiens
ugacguaaccaaucuuucu

SEQ ID NO: 43053 - RNA, 19 nt, Homo sapiens
ggauucagacgcagaugga

SEQ ID NO: 43054 - RNA, 19 nt, Homo sapiens
caacacguucgucaugaug

SEQ ID NO: 43055 - RNA, 19 nt, Homo sapiens
ccugaccgaugacaacuuc

SEQ ID NO: 43056 - RNA, 19 nt, Homo sapiens
gaaaggcgagauagaacag

SEQ ID NO: 43057 - RNA, 19 nt, Homo sapiens
uagcuuacucugucaagaa

SEQ ID NO: 43058 - RNA, 19 nt, Homo sapiens
gucaugaugcagcucuuua

SEQ ID NO: 43059 - RNA, 19 nt, Homo sapiens
ucucaaagccgugcagaug

SEQ ID NO: 43060 - RNA, 19 nt, Homo sapiens
gacacccacuacaaagaga

SEQ ID NO: 43061 - RNA, 19 nt, Homo sapiens
gguccucuacuuugugauu

SEQ ID NO: 43062 - RNA, 19 nt, Homo sapiens
ccagacaggcaucaucuuc

SEQ ID NO: 43063 - RNA, 19 nt, Homo sapiens
gaccuccauucacaacuuc

SEQ ID NO: 43064 - RNA, 19 nt, Homo sapiens
agacgcagauggagguagu

SEQ ID NO: 43065 - RNA, 19 nt, Homo sapiens
gauugucaucguccaguuu

SEQ ID NO: 43066 - RNA, 19 nt, Homo sapiens
ucaacacguucgucaugau

SEQ ID NO: 43067 - RNA, 19 nt, Homo sapiens
ucuccaaguuccugcaguu

SEQ ID NO: 43068 - RNA, 19 nt, Homo sapiens
cggaagacaagcuuuacaa

SEQ ID NO: 43069 - RNA, 19 nt, Homo sapiens
caugccaucuccaucaaca

SEQ ID NO: 43070 - RNA, 19 nt, Homo sapiens
gccggucuauguacaauac

SEQ ID NO: 43071 - RNA, 19 nt, Homo sapiens
ugagacguuugucguggaa

SEQ ID NO: 43072 - RNA, 19 nt, Homo sapiens
uuccguagcucgcucuaug

SEQ ID NO: 43073 - RNA, 19 nt, Homo sapiens
ucaugaugcagcucuuuaa

SEQ ID NO: 43074 - RNA, 19 nt, Homo sapiens
gggugaacuugaucaugga

SEQ ID NO: 43075 - RNA, 19 nt, Homo sapiens
gaaaucaacucccgaaaga

SEQ ID NO: 43076 - RNA, 19 nt, Homo sapiens
ugacaaggcuucuaaguuu

SEQ ID NO: 43077 - RNA, 19 nt, Homo sapiens
gaaagacaauaaccuagua

SEQ ID NO: 43078 - RNA, 19 nt, Homo sapiens
gaacaccacuccuggauga

SEQ ID NO: 43079 - RNA, 19 nt, Homo sapiens
agacagagaugauauggua

SEQ ID NO: 43080 - RNA, 19 nt, Homo sapiens
gguaaacccuucaguugua

SEQ ID NO: 43081 - RNA, 19 nt, Homo sapiens
gaaggcaccucuacauuca

SEQ ID NO: 43082 - RNA, 19 nt, Homo sapiens
gcacagauguagcaaagga

SEQ ID NO: 43083 - RNA, 19 nt, Homo sapiens
gugcagauguuguggguua

SEQ ID NO: 43084 - RNA, 19 nt, Homo sapiens
gcacagacuuacaaggauu

SEQ ID NO: 43085 - RNA, 19 nt, Homo sapiens
gaaauaagccucugaucuc

SEQ ID NO: 43086 - RNA, 19 nt, Homo sapiens
gcacugacccagauuaaug

SEQ ID NO: 43087 - RNA, 19 nt, Homo sapiens
gaagaaaggaucuagacuu

SEQ ID NO: 43088 - RNA, 19 nt, Homo sapiens
ugaugcagcucuucaauga

SEQ ID NO: 43089 - RNA, 19 nt, Homo sapiens
uaagguugcugccauggua

SEQ ID NO: 43090 - RNA, 19 nt, Homo sapiens
ugaaauauguugcgguaga

SEQ ID NO: 43091 - RNA, 19 nt, Homo sapiens
ggacuagggugcuccuguu

SEQ ID NO: 43092 - RNA, 19 nt, Homo sapiens
caaacaagcuggcauuacu

SEQ ID NO: 43093 - RNA, 19 nt, Homo sapiens
gcuuauaccuccaagauuc

SEQ ID NO: 43094 - RNA, 19 nt, Homo sapiens
gacuuuggcugcacaguaa

SEQ ID NO: 43095 - RNA, 19 nt, Homo sapiens
cuacaagucugugccauuu

SEQ ID NO: 43096 - RNA, 19 nt, Homo sapiens
gaagaaagcggauguuggu

SEQ ID NO: 43097 - RNA, 19 nt, Homo sapiens
gaugaaagacaauaaccua

SEQ ID NO: 43098 - RNA, 19 nt, Homo sapiens
gcacuaugaugaagaacau

SEQ ID NO: 43099 - RNA, 19 nt, Homo sapiens
ucaccgaacugaccuguau

SEQ ID NO: 43100 - RNA, 19 nt, Homo sapiens
guagagauggaauguauaa

SEQ ID NO: 43101 - RNA, 19 nt, Homo sapiens
gagcacagacuuacaagga

SEQ ID NO: 43102 - RNA, 19 nt, Homo sapiens
ucaaagcguuccauaguuc

SEQ ID NO: 43103 - RNA, 19 nt, Homo sapiens
ggaaggcaccucuacauuc

SEQ ID NO: 43104 - RNA, 19 nt, Homo sapiens
ccucugaucucacgcacua

SEQ ID NO: 43105 - RNA, 19 nt, Homo sapiens
gacaagaucuggccuaagc

SEQ ID NO: 43106 - RNA, 19 nt, Homo sapiens
cagaaacccuacaaccaaa

SEQ ID NO: 43107 - RNA, 19 nt, Homo sapiens
ugaaagcugugcagauguu

SEQ ID NO: 43108 - RNA, 19 nt, Homo sapiens
guucagagggagacaaaua

SEQ ID NO: 43109 - RNA, 19 nt, Homo sapiens
ccuaacagaugacaacuuc

SEQ ID NO: 43110 - RNA, 19 nt, Homo sapiens
gaaagccggucugcucaug

SEQ ID NO: 43111 - RNA, 19 nt, Homo sapiens
gagcuuauugcacaagaua

SEQ ID NO: 43112 - RNA, 19 nt, Homo sapiens
gaaagcggauguugguuuu

SEQ ID NO: 43113 - RNA, 19 nt, Homo sapiens
gaauaaagacagagaugau

SEQ ID NO: 43114 - RNA, 19 nt, Homo sapiens
ugacugugguacaagcuua

SEQ ID NO: 43115 - RNA, 19 nt, Homo sapiens
ggcacaagcuggcuggauu

SEQ ID NO: 43116 - RNA, 19 nt, Homo sapiens
ggacuuuggcugcacagua

SEQ ID NO: 43117 - RNA, 19 nt, Homo sapiens
gaggaggaguugccacgaa

SEQ ID NO: 43118 - RNA, 19 nt, Homo sapiens
aaaggaggcuucagacauc

SEQ ID NO: 43119 - RNA, 19 nt, Homo sapiens
gaagcaagaaguaggaaga

SEQ ID NO: 43120 - RNA, 19 nt, Homo sapiens
aagaaaggaucuagacuuc

SEQ ID NO: 43121 - RNA, 19 nt, Homo sapiens
cagaugcuauugccaaaug

SEQ ID NO: 43122 - RNA, 19 nt, Homo sapiens
gugacugccuuuaaugauu

SEQ ID NO: 43123 - RNA, 19 nt, Homo sapiens
ggaaucauccuuacucucu

SEQ ID NO: 43124 - RNA, 19 nt, Homo sapiens
gauugugguuggugauauu

SEQ ID NO: 43125 - RNA, 19 nt, Homo sapiens
guuagugacugccuuuaau

SEQ ID NO: 43126 - RNA, 19 nt, Homo sapiens
cgguagagauggaauguau

SEQ ID NO: 43127 - RNA, 19 nt, Homo sapiens
gacaaggcuucuaaguuug

SEQ ID NO: 43128 - RNA, 19 nt, Homo sapiens
ggucaaagcguuccauagu

SEQ ID NO: 43129 - RNA, 19 nt, Homo sapiens
aagaggagaucaccaagga

SEQ ID NO: 43130 - RNA, 19 nt, Homo sapiens
ggguuaaucugaucaugga

SEQ ID NO: 43131 - RNA, 19 nt, Homo sapiens
gauaagacaggcacguuga

SEQ ID NO: 43132 - RNA, 19 nt, Homo sapiens
ggacaaagaccccauguug

SEQ ID NO: 43133 - RNA, 19 nt, Homo sapiens
ugacugccuuuaaugauug

SEQ ID NO: 43134 - RNA, 19 nt, Homo sapiens
ccagauuaauguccacuau

SEQ ID NO: 43135 - RNA, 19 nt, Homo sapiens
gguagucacuugucauuuu

SEQ ID NO: 43136 - RNA, 19 nt, Homo sapiens
gaaaggcgagguagagcaa

SEQ ID NO: 43137 - RNA, 19 nt, Homo sapiens
ggugacaggugacaacauc

SEQ ID NO: 43138 - RNA, 19 nt, Homo sapiens
caucugcucugauaagaca

SEQ ID NO: 43139 - RNA, 19 nt, Homo sapiens
gggaaacgcuacaucuucu

SEQ ID NO: 43140 - RNA, 19 nt, Homo sapiens
acaagucugugccauuuau

SEQ ID NO: 43141 - RNA, 19 nt, Homo sapiens
gcuguggugucucuucauu

SEQ ID NO: 43142 - RNA, 19 nt, Homo sapiens
gggaagcagugccauucaa

SEQ ID NO: 43143 - RNA, 19 nt, Homo sapiens
aaacaaggagucccugaaa

SEQ ID NO: 43144 - RNA, 19 nt, Homo sapiens
gagcaaaaguucuccauca

SEQ ID NO: 43145 - RNA, 19 nt, Homo sapiens
caagagcacagacuuacaa

SEQ ID NO: 43146 - RNA, 19 nt, Homo sapiens
gaagggaaacgcuacaucu

SEQ ID NO: 43147 - RNA, 19 nt, Homo sapiens
ucggacagcucucuacaga

SEQ ID NO: 43148 - RNA, 19 nt, Homo sapiens
gucaaagcguuccauaguu

SEQ ID NO: 43149 - RNA, 19 nt, Homo sapiens
ccaaagaggagaucaccaa

SEQ ID NO: 43150 - RNA, 19 nt, Homo sapiens
gaccgagugugcucugcua

SEQ ID NO: 43151 - RNA, 19 nt, Homo sapiens
cauccugauucuauacuuu

SEQ ID NO: 43152 - RNA, 19 nt, Homo sapiens
caagaaguaggaagaaguu

SEQ ID NO: 43153 - RNA, 19 nt, Homo sapiens
uaacagcagugugugugaa

SEQ ID NO: 43154 - RNA, 19 nt, Homo sapiens
ucagaaacccuacaaccaa

SEQ ID NO: 43155 - RNA, 19 nt, Homo sapiens
gggaugcacugacccagau

SEQ ID NO: 43156 - RNA, 19 nt, Homo sapiens
gcuuauugcacaagauaua

SEQ ID NO: 43157 - RNA, 19 nt, Homo sapiens
cuagagacaucaguuugaa

SEQ ID NO: 43158 - RNA, 19 nt, Homo sapiens
ccacgaaagcauucagaaa

SEQ ID NO: 43159 - RNA, 19 nt, Homo sapiens
caaaggaggcuucagacau

SEQ ID NO: 43160 - RNA, 19 nt, Homo sapiens
gaucuucucccacugacaa

SEQ ID NO: 43161 - RNA, 19 nt, Homo sapiens
guacggcacuuggaugcuu

SEQ ID NO: 43162 - RNA, 19 nt, Homo sapiens
ggccuacucugugaagaaa

SEQ ID NO: 43163 - RNA, 19 nt, Homo sapiens
gaaauauguugcgguagag

SEQ ID NO: 43164 - RNA, 19 nt, Homo sapiens
cgaaauaagccucugaucu

SEQ ID NO: 43165 - RNA, 19 nt, Homo sapiens
ccaagggaaugaucugaag

SEQ ID NO: 43166 - RNA, 19 nt, Homo sapiens
gagcaaagagaagcaauuc

SEQ ID NO: 43167 - RNA, 19 nt, Homo sapiens
gcaagaaguaggaagaagu

SEQ ID NO: 43168 - RNA, 19 nt, Homo sapiens
cuucugcucuguagucuug

SEQ ID NO: 43169 - RNA, 19 nt, Homo sapiens
aggagaagcucuacaaggu

SEQ ID NO: 43170 - RNA, 19 nt, Homo sapiens
gggcauccauuaccgucaa

SEQ ID NO: 43171 - RNA, 19 nt, Homo sapiens
ccgaaacggucaacucauc

SEQ ID NO: 43172 - RNA, 19 nt, Homo sapiens
gcagaucuggagaaacgua

SEQ ID NO: 43173 - RNA, 19 nt, Homo sapiens
cuauggagguguacagaau

SEQ ID NO: 43174 - RNA, 19 nt, Homo sapiens
gcacaagauauauucaauc

SEQ ID NO: 43175 - RNA, 19 nt, Homo sapiens
ggacuuguauccaugauug

SEQ ID NO: 43176 - RNA, 19 nt, Homo sapiens
agaaggagauggagauuaa

SEQ ID NO: 43177 - RNA, 19 nt, Homo sapiens
gaucaacgcugaccaacug

SEQ ID NO: 43178 - RNA, 19 nt, Homo sapiens
ggaauaagauccuggugau

SEQ ID NO: 43179 - RNA, 19 nt, Homo sapiens
ggagacaaauuccagauca

SEQ ID NO: 43180 - RNA, 19 nt, Homo sapiens
accaggaacucuacuauua

SEQ ID NO: 43181 - RNA, 19 nt, Homo sapiens
gccaugaacuuuccaucua

SEQ ID NO: 43182 - RNA, 19 nt, Homo sapiens
caaggcuucuucaggaaua

SEQ ID NO: 43183 - RNA, 19 nt, Homo sapiens
agacggcgcugcucaaguu

SEQ ID NO: 43184 - RNA, 19 nt, Homo sapiens
gggcaucgcuggcucagau

SEQ ID NO: 43185 - RNA, 19 nt, Homo sapiens
ccaagcgccuggccaguaa

SEQ ID NO: 43186 - RNA, 19 nt, Homo sapiens
ggaaggagaagcuggagaa

SEQ ID NO: 43187 - RNA, 19 nt, Homo sapiens
caagauaucugagcaacca

SEQ ID NO: 43188 - RNA, 19 nt, Homo sapiens
gaaggcagacaucggagua

SEQ ID NO: 43189 - RNA, 19 nt, Homo sapiens
gaggguguuucuguucuua

SEQ ID NO: 43190 - RNA, 19 nt, Homo sapiens
uggcggagcuggaacagaa

SEQ ID NO: 43191 - RNA, 19 nt, Homo sapiens
ggaaggccgagaacuauga

SEQ ID NO: 43192 - RNA, 19 nt, Homo sapiens
gcaugcagcugaaggacau

SEQ ID NO: 43193 - RNA, 19 nt, Homo sapiens
ucucuucggugccacauuu

SEQ ID NO: 43194 - RNA, 19 nt, Homo sapiens
gaacucugcacugacauuu

SEQ ID NO: 43195 - RNA, 19 nt, Homo sapiens
ugacaacuuugccuccauu

SEQ ID NO: 43196 - RNA, 19 nt, Homo sapiens
gagacaaauuccagaucaa

SEQ ID NO: 43197 - RNA, 19 nt, Homo sapiens
caacaucaucgccagcuuu

SEQ ID NO: 43198 - RNA, 19 nt, Homo sapiens
ggacagccaccaagauauc

SEQ ID NO: 43199 - RNA, 19 nt, Homo sapiens
aaaugcagcugacaugauc

SEQ ID NO: 43200 - RNA, 19 nt, Homo sapiens
gacacuugcuggugaugaa

SEQ ID NO: 43201 - RNA, 19 nt, Homo sapiens
cagggacucucacucagaa

SEQ ID NO: 43202 - RNA, 19 nt, Homo sapiens
ggagcagggucgacugauc

SEQ ID NO: 43203 - RNA, 19 nt, Homo sapiens
caacuuugccuccauugug

SEQ ID NO: 43204 - RNA, 19 nt, Homo sapiens
gcagcuccauccuuaucaa

SEQ ID NO: 43205 - RNA, 19 nt, Homo sapiens
gaagaaggagauggagauu

SEQ ID NO: 43206 - RNA, 19 nt, Homo sapiens
ccugggcgaugguaauaaa

SEQ ID NO: 43207 - RNA, 19 nt, Homo sapiens
ggaccaggaacucuacuau

SEQ ID NO: 43208 - RNA, 19 nt, Homo sapiens
gcauugaggugugccagau

SEQ ID NO: 43209 - RNA, 19 nt, Homo sapiens
gaacaucccagagcugaca

SEQ ID NO: 43210 - RNA, 19 nt, Homo sapiens
ucuauugccuacacauuga

SEQ ID NO: 43211 - RNA, 19 nt, Homo sapiens
uggagaacaugaagaagga

SEQ ID NO: 43212 - RNA, 19 nt, Homo sapiens
aggagaagcuggagaacau

SEQ ID NO: 43213 - RNA, 19 nt, Homo sapiens
gaagacacccaucgcuauc

SEQ ID NO: 43214 - RNA, 19 nt, Homo sapiens
ggaggguguuucuguucuu

SEQ ID NO: 43215 - RNA, 19 nt, Homo sapiens
accaguaucugcuucugua

SEQ ID NO: 43216 - RNA, 19 nt, Homo sapiens
ucaauggcaugcagcugaa

SEQ ID NO: 43217 - RNA, 19 nt, Homo sapiens
ggacuacccgccuggcuau

SEQ ID NO: 43218 - RNA, 19 nt, Homo sapiens
ggacaacuccucgcugaca

SEQ ID NO: 43219 - RNA, 19 nt, Homo sapiens
gaccaggaacucuacuauu

SEQ ID NO: 43220 - RNA, 19 nt, Homo sapiens
cccaacaucuucaacuuca

SEQ ID NO: 43221 - RNA, 19 nt, Homo sapiens
uggcuucacugacuacuuc

SEQ ID NO: 43222 - RNA, 19 nt, Homo sapiens
ccugcuggaugacaacuuu

SEQ ID NO: 43223 - RNA, 19 nt, Homo sapiens
cgcugcagcuccauccuua

SEQ ID NO: 43224 - RNA, 19 nt, Homo sapiens
ccugagggcccuucguuaa

SEQ ID NO: 43225 - RNA, 19 nt, Homo sapiens
caacaucuucaacuucaug

SEQ ID NO: 43226 - RNA, 19 nt, Homo sapiens
cccaaagcgugacagauug

SEQ ID NO: 43227 - RNA, 19 nt, Homo sapiens
gagaagcuggagaacauga

SEQ ID NO: 43228 - RNA, 19 nt, Homo sapiens
uggaggcgguggagacauu

SEQ ID NO: 43229 - RNA, 19 nt, Homo sapiens
agaacugcguggucaagaa

SEQ ID NO: 43230 - RNA, 19 nt, Homo sapiens
ccaugaacuuuccaucuag

SEQ ID NO: 43231 - RNA, 19 nt, Homo sapiens
gaacaugaagaaggagaug

SEQ ID NO: 43232 - RNA, 19 nt, Homo sapiens
caagagcaccaacaucauc

SEQ ID NO: 43233 - RNA, 19 nt, Homo sapiens
gagggcccuucguuaaaga

SEQ ID NO: 43234 - RNA, 19 nt, Homo sapiens
ggacgacugccuucaagca

SEQ ID NO: 43235 - RNA, 19 nt, Homo sapiens
ggugaucgccaucguguuc

SEQ ID NO: 43236 - RNA, 19 nt, Homo sapiens
ggaggaccaccaccuacaa

SEQ ID NO: 43237 - RNA, 19 nt, Homo sapiens
gcaugacugugucccaucu

SEQ ID NO: 43238 - RNA, 19 nt, Homo sapiens
gacaagacagggacucuca

SEQ ID NO: 43239 - RNA, 19 nt, Homo sapiens
ggccgagagugacaucaug

SEQ ID NO: 43240 - RNA, 19 nt, Homo sapiens
agacagggacucucacuca

SEQ ID NO: 43241 - RNA, 19 nt, Homo sapiens
ucaucgaacucugcacuga

SEQ ID NO: 43242 - RNA, 19 nt, Homo sapiens
cacccuaccucaucuacau

SEQ ID NO: 43243 - RNA, 19 nt, Homo sapiens
ccaagaugagcaagaagaa

SEQ ID NO: 43244 - RNA, 19 nt, Homo sapiens
guagaggccaugaacuuuc

SEQ ID NO: 43245 - RNA, 19 nt, Homo sapiens
ggaccaccaccuacaagau

SEQ ID NO: 43246 - RNA, 19 nt, Homo sapiens
gaagucuauugccuacaca

SEQ ID NO: 43247 - RNA, 19 nt, Homo sapiens
ucgacaaccugaagaaguc

SEQ ID NO: 43248 - RNA, 19 nt, Homo sapiens
gcuaugccuucgacguaga

SEQ ID NO: 43249 - RNA, 19 nt, Homo sapiens
gccuacacauugaccaaga

SEQ ID NO: 43250 - RNA, 19 nt, Homo sapiens
gaucugcucggacaagaca

SEQ ID NO: 43251 - RNA, 19 nt, Homo sapiens
gccaagaugagcaagaaga

SEQ ID NO: 43252 - RNA, 19 nt, Homo sapiens
gcugcaagguggacaacuc

SEQ ID NO: 43253 - RNA, 19 nt, Homo sapiens
gaugaaagguggggacaga

SEQ ID NO: 43254 - RNA, 19 nt, Homo sapiens
caucaucgccagcuuuaag

SEQ ID NO: 43255 - RNA, 19 nt, Homo sapiens
ugaagaaggagauggagau

SEQ ID NO: 43256 - RNA, 19 nt, Homo sapiens
gcaaggcuucuucaggaau

SEQ ID NO: 43257 - RNA, 19 nt, Homo sapiens
cuggacagccaccaagaua

SEQ ID NO: 43258 - RNA, 19 nt, Homo sapiens
acccaaagcgugacagauu

SEQ ID NO: 43259 - RNA, 19 nt, Homo sapiens
gcugacacccuaccucauc

SEQ ID NO: 43260 - RNA, 19 nt, Homo sapiens
gagcagggucgacugaucu

SEQ ID NO: 43261 - RNA, 19 nt, Homo sapiens
cgagaacuaugagcucuac

SEQ ID NO: 43262 - RNA, 19 nt, Homo sapiens
cagcugacaccacggaaga

SEQ ID NO: 43263 - RNA, 19 nt, Homo sapiens
gaacugcguggucaagaac

SEQ ID NO: 43264 - RNA, 19 nt, Homo sapiens
aagaugagcaagaagaaga

SEQ ID NO: 43265 - RNA, 19 nt, Homo sapiens
agaagacacccaucgcuau

SEQ ID NO: 43266 - RNA, 19 nt, Homo sapiens
gcuacuaccaggaauucaa

SEQ ID NO: 43267 - RNA, 19 nt, Homo sapiens
ugagggcccuucguuaaag

SEQ ID NO: 43268 - RNA, 19 nt, Homo sapiens
gaccaccaccuacaagauc

SEQ ID NO: 43269 - RNA, 19 nt, Homo sapiens
cugugucccuggcauauga

SEQ ID NO: 43270 - RNA, 19 nt, Homo sapiens
ggccugcagugccucaugu

SEQ ID NO: 43271 - RNA, 19 nt, Homo sapiens
gcaggcauccgggugauca

SEQ ID NO: 43272 - RNA, 19 nt, Homo sapiens
gagggacgacugccuucaa

SEQ ID NO: 43273 - RNA, 19 nt, Homo sapiens
gcaagaggaaggagaagcu

SEQ ID NO: 43274 - RNA, 19 nt, Homo sapiens
gcccgugccugugugauca

SEQ ID NO: 43275 - RNA, 19 nt, Homo sapiens
ggaauuugcugcuauaaga

SEQ ID NO: 43276 - RNA, 19 nt, Homo sapiens
ggaaagccauguuuuauua

SEQ ID NO: 43277 - RNA, 19 nt, Homo sapiens
ggcagcaacucucuaauua

SEQ ID NO: 43278 - RNA, 19 nt, Homo sapiens
agacaucacuuucuuacua

SEQ ID NO: 43279 - RNA, 19 nt, Homo sapiens
gaaacacggcuuacacuaa

SEQ ID NO: 43280 - RNA, 19 nt, Homo sapiens
cuaaugcacugauaugaaa

SEQ ID NO: 43281 - RNA, 19 nt, Homo sapiens
gagaagcgcccacaucuga

SEQ ID NO: 43282 - RNA, 19 nt, Homo sapiens
gauggaauuugcugcuaua

SEQ ID NO: 43283 - RNA, 19 nt, Homo sapiens
gagaaaggccuggaaauug

SEQ ID NO: 43284 - RNA, 19 nt, Homo sapiens
ggagaaaggccuggaaauu

SEQ ID NO: 43285 - RNA, 19 nt, Homo sapiens
aaacacggcuuacacuaau

SEQ ID NO: 43286 - RNA, 19 nt, Homo sapiens
cagcgaagcuccucaacau

SEQ ID NO: 43287 - RNA, 19 nt, Homo sapiens
gaaggaaagccauguuuua

SEQ ID NO: 43288 - RNA, 19 nt, Homo sapiens
agaaaggccuggaaauugu

SEQ ID NO: 43289 - RNA, 19 nt, Homo sapiens
uaucaguucuuccuuguug

SEQ ID NO: 43290 - RNA, 19 nt, Homo sapiens
gcacgugaccuucaacaau

SEQ ID NO: 43291 - RNA, 19 nt, Homo sapiens
ucaguucccugccaaauca

SEQ ID NO: 43292 - RNA, 19 nt, Homo sapiens
ugaacaggaucgucaaguu

SEQ ID NO: 43293 - RNA, 19 nt, Homo sapiens
gacaucacuuucuuacuau

SEQ ID NO: 43294 - RNA, 19 nt, Homo sapiens
gcagcaacucucuaauuaa

SEQ ID NO: 43295 - RNA, 19 nt, Homo sapiens
gcaacucucuaauuaacca

SEQ ID NO: 43296 - RNA, 19 nt, Homo sapiens
cagcaacucucuaauuaac

SEQ ID NO: 43297 - RNA, 19 nt, Homo sapiens
caaggcagcaacucucuaa

SEQ ID NO: 43298 - RNA, 19 nt, Homo sapiens
gaagaaggaaagccauguu

SEQ ID NO: 43299 - RNA, 19 nt, Homo sapiens
ucuacaacgucucugauaa

SEQ ID NO: 43300 - RNA, 19 nt, Homo sapiens
ugcacuacuucccuuauua

SEQ ID NO: 43301 - RNA, 19 nt, Homo sapiens
caaguucuccugcaaguuc

SEQ ID NO: 43302 - RNA, 19 nt, Homo sapiens
cagauaugcugcagaacug

SEQ ID NO: 43303 - RNA, 19 nt, Homo sapiens
cuaauuaaccaggucauaa

SEQ ID NO: 43304 - RNA, 19 nt, Homo sapiens
ccuuaaggccggauguuua

SEQ ID NO: 43305 - RNA, 19 nt, Homo sapiens
cuauaagaauguccagcua

SEQ ID NO: 43306 - RNA, 19 nt, Homo sapiens
guucuuccuuguugaauuc

SEQ ID NO: 43307 - RNA, 19 nt, Homo sapiens
gaucccaacuucggcuuug

SEQ ID NO: 43308 - RNA, 19 nt, Homo sapiens
ggacuaccaagaccagcua

SEQ ID NO: 43309 - RNA, 19 nt, Homo sapiens
ggugaugacugggcucuuc

SEQ ID NO: 43310 - RNA, 19 nt, Homo sapiens
gcaaguucacggcagauau

SEQ ID NO: 43311 - RNA, 19 nt, Homo sapiens
guacacaccggacuaccaa

SEQ ID NO: 43312 - RNA, 19 nt, Homo sapiens
cacgugaccuucaacaauc

SEQ ID NO: 43313 - RNA, 19 nt, Homo sapiens
gaauuugcugcuauaagaa

SEQ ID NO: 43314 - RNA, 19 nt, Homo sapiens
gcagagcacgugaccuuca

SEQ ID NO: 43315 - RNA, 19 nt, Homo sapiens
auugagaagugaaacguuu

SEQ ID NO: 43316 - RNA, 19 nt, Homo sapiens
cgauucgucuucuauguag

SEQ ID NO: 43317 - RNA, 19 nt, Homo sapiens
caaguucacggcagauaug

SEQ ID NO: 43318 - RNA, 19 nt, Homo sapiens
cuuccuuguugaauucuua

SEQ ID NO: 43319 - RNA, 19 nt, Homo sapiens
ugaaacacggcuuacacua

SEQ ID NO: 43320 - RNA, 19 nt, Homo sapiens
acaccaaguucuccugcaa

SEQ ID NO: 43321 - RNA, 19 nt, Homo sapiens
gcaaggcagcaacucucua

SEQ ID NO: 43322 - RNA, 19 nt, Homo sapiens
cagagcacgugaccuucaa

SEQ ID NO: 43323 - RNA, 19 nt, Homo sapiens
ugauaugaaacacggcuua

SEQ ID NO: 43324 - RNA, 19 nt, Homo sapiens
uagauggaauuugcugcua

SEQ ID NO: 43325 - RNA, 19 nt, Homo sapiens
gcacuacuucccuuauuac

SEQ ID NO: 43326 - RNA, 19 nt, Homo sapiens
uggcggcucugcaggagaa

SEQ ID NO: 43327 - RNA, 19 nt, Homo sapiens
gaccugcucgcgaguauca

SEQ ID NO: 43328 - RNA, 19 nt, Homo sapiens
cgacccguaugaagggaaa

SEQ ID NO: 43329 - RNA, 19 nt, Homo sapiens
uguacuacguggccuucua

SEQ ID NO: 43330 - RNA, 19 nt, Homo sapiens
ggaucagccuguacuacgu

SEQ ID NO: 43331 - RNA, 19 nt, Homo sapiens
gcaauuccuaaguuguaaa

SEQ ID NO: 43332 - RNA, 19 nt, Homo sapiens
guagacaucacuuucuuac

SEQ ID NO: 43333 - RNA, 19 nt, Homo sapiens
gaagggaaaguggaguuca

SEQ ID NO: 43334 - RNA, 19 nt, Homo sapiens
cugcacuacuucccuuauu

SEQ ID NO: 43335 - RNA, 19 nt, Homo sapiens
aagaaggaaagccauguuu

SEQ ID NO: 43336 - RNA, 19 nt, Homo sapiens
cuacuaaugcacugauaug

SEQ ID NO: 43337 - RNA, 19 nt, Homo sapiens
cagagaagcgcccacaucu

SEQ ID NO: 43338 - RNA, 19 nt, Homo sapiens
ccagagaagcgcccacauc

SEQ ID NO: 43339 - RNA, 19 nt, Homo sapiens
aagggaaaguggaguucaa

SEQ ID NO: 43340 - RNA, 19 nt, Homo sapiens
gcagcgaagcuccucaaca

SEQ ID NO: 43341 - RNA, 19 nt, Homo sapiens
aggcagcaacucucuaauu

SEQ ID NO: 43342 - RNA, 19 nt, Homo sapiens
agauggaauuugcugcuau

SEQ ID NO: 43343 - RNA, 19 nt, Homo sapiens
gaaaggccuggaaauuguc

SEQ ID NO: 43344 - RNA, 19 nt, Homo sapiens
gggagaaaggccuggaaau

SEQ ID NO: 43345 - RNA, 19 nt, Homo sapiens
ggguguggaucagccugua

SEQ ID NO: 43346 - RNA, 19 nt, Homo sapiens
gaagcgcccacaucugaag

SEQ ID NO: 43347 - RNA, 19 nt, Homo sapiens
uggcagagcacgugaccuu

SEQ ID NO: 43348 - RNA, 19 nt, Homo sapiens
uacaacgucucugauaaca

SEQ ID NO: 43349 - RNA, 19 nt, Homo sapiens
ugcaauuccuaaguuguaa

SEQ ID NO: 43350 - RNA, 19 nt, Homo sapiens
uugcaauuccuaaguugua

SEQ ID NO: 43351 - RNA, 19 nt, Homo sapiens
uguagacaucacuuucuua

SEQ ID NO: 43352 - RNA, 19 nt, Homo sapiens
cgcugcaggucaaguacua

SEQ ID NO: 43353 - RNA, 19 nt, Homo sapiens
gcaccuccgagcaguacuu

SEQ ID NO: 43354 - RNA, 19 nt, Homo sapiens
gucuacaacgucucugaua

SEQ ID NO: 43355 - RNA, 19 nt, Homo sapiens
gccagcgcauggaggaguu

SEQ ID NO: 43356 - RNA, 19 nt, Homo sapiens
acacggcuuacacuaauga

SEQ ID NO: 43357 - RNA, 19 nt, Homo sapiens
acuaaugcacugauaugaa

SEQ ID NO: 43358 - RNA, 19 nt, Homo sapiens
gcaccuucagucugcacua

SEQ ID NO: 43359 - RNA, 19 nt, Homo sapiens
gauugagaagugaaacguu

SEQ ID NO: 43360 - RNA, 19 nt, Homo sapiens
aguaucaguucuuccuugu

SEQ ID NO: 43361 - RNA, 19 nt, Homo sapiens
ugugcgaacuccagagaag

SEQ ID NO: 43362 - RNA, 19 nt, Homo sapiens
acacaccggacuaccaaga

SEQ ID NO: 43363 - RNA, 19 nt, Homo sapiens
ucuaauuaaccaggucaua

SEQ ID NO: 43364 - RNA, 19 nt, Homo sapiens
gagcacgugaccuucaaca

SEQ ID NO: 43365 - RNA, 19 nt, Homo sapiens
ccuucagucugcacuacuu

SEQ ID NO: 43366 - RNA, 19 nt, Homo sapiens
ccuggcggaucccaacuuc

SEQ ID NO: 43367 - RNA, 19 nt, Homo sapiens
guacuacguggccuucuac

SEQ ID NO: 43368 - RNA, 19 nt, Homo sapiens
ggacagaucuucuuggaaa

SEQ ID NO: 43369 - RNA, 19 nt, Homo sapiens
guacagaaaucacaugaaa

SEQ ID NO: 43370 - RNA, 19 nt, Homo sapiens
ggaaagaucucagaacaau

SEQ ID NO: 43371 - RNA, 19 nt, Homo sapiens
agaagaagcuguacuguau

SEQ ID NO: 43372 - RNA, 19 nt, Homo sapiens
gggcgugucuuaaguauug

SEQ ID NO: 43373 - RNA, 19 nt, Homo sapiens
ggaaggagauauagugaag

SEQ ID NO: 43374 - RNA, 19 nt, Homo sapiens
ucaaauaccaguucaguuu

SEQ ID NO: 43375 - RNA, 19 nt, Homo sapiens
acaaguggcuguuaucuau

SEQ ID NO: 43376 - RNA, 19 nt, Homo sapiens
caaaagagauccacuguug

SEQ ID NO: 43377 - RNA, 19 nt, Homo sapiens
guaaugcuauugauggaaa

SEQ ID NO: 43378 - RNA, 19 nt, Homo sapiens
cagaagaaaugguagaguu

SEQ ID NO: 43379 - RNA, 19 nt, Homo sapiens
gagauguccucuauucuug

SEQ ID NO: 43380 - RNA, 19 nt, Homo sapiens
ccagcaagauuacaaaguu

SEQ ID NO: 43381 - RNA, 19 nt, Homo sapiens
gcugagauguccucuauuc

SEQ ID NO: 43382 - RNA, 19 nt, Homo sapiens
ggaaaggguccaauugguu

SEQ ID NO: 43383 - RNA, 19 nt, Homo sapiens
aagaagcuguacuguauuu

SEQ ID NO: 43384 - RNA, 19 nt, Homo sapiens
gggaaaaccucaauugcua

SEQ ID NO: 43385 - RNA, 19 nt, Homo sapiens
gaagaggacaggagccauu

SEQ ID NO: 43386 - RNA, 19 nt, Homo sapiens
cggaguaacugcaaagaug

SEQ ID NO: 43387 - RNA, 19 nt, Homo sapiens
gaacuuggaaccugacaau

SEQ ID NO: 43388 - RNA, 19 nt, Homo sapiens
gaagagacuuacagaugca

SEQ ID NO: 43389 - RNA, 19 nt, Homo sapiens
cagcaagauuacaaaguuu

SEQ ID NO: 43390 - RNA, 19 nt, Homo sapiens
gguauccgcccugcaauua

SEQ ID NO: 43391 - RNA, 19 nt, Homo sapiens
gcuguugggucguguaguu

SEQ ID NO: 43392 - RNA, 19 nt, Homo sapiens
guaccuggcuccuuacucu

SEQ ID NO: 43393 - RNA, 19 nt, Homo sapiens
gaacuuccaugccucuaac

SEQ ID NO: 43394 - RNA, 19 nt, Homo sapiens
guacaugggcugaggaaug

SEQ ID NO: 43395 - RNA, 19 nt, Homo sapiens
ggaauuggcucaguaucgu

SEQ ID NO: 43396 - RNA, 19 nt, Homo sapiens
gugaagagacuuacagaug

SEQ ID NO: 43397 - RNA, 19 nt, Homo sapiens
gaagcuguacuguauuuau

SEQ ID NO: 43398 - RNA, 19 nt, Homo sapiens
gaggaauguucaagcagaa

SEQ ID NO: 43399 - RNA, 19 nt, Homo sapiens
gcugauaccucuguugauc

SEQ ID NO: 43400 - RNA, 19 nt, Homo sapiens
gagcugauaccucuguuga

SEQ ID NO: 43401 - RNA, 19 nt, Homo sapiens
gaaaugcuuuggguucauc

SEQ ID NO: 43402 - RNA, 19 nt, Homo sapiens
gaaacugggcgugucuuaa

SEQ ID NO: 43403 - RNA, 19 nt, Homo sapiens
uaaaaggguuacucucaua

SEQ ID NO: 43404 - RNA, 19 nt, Homo sapiens
gcaauuaacguuggucugu

SEQ ID NO: 43405 - RNA, 19 nt, Homo sapiens
guauuuauguugcuauugg

SEQ ID NO: 43406 - RNA, 19 nt, Homo sapiens
cugcuuacauuccaacaaa

SEQ ID NO: 43407 - RNA, 19 nt, Homo sapiens
gccaugaaguacaccauug

SEQ ID NO: 43408 - RNA, 19 nt, Homo sapiens
gcauuaaggcuguggauag

SEQ ID NO: 43409 - RNA, 19 nt, Homo sapiens
gauguccucuauucuugaa

SEQ ID NO: 43410 - RNA, 19 nt, Homo sapiens
caaauuucuuggcuggauu

SEQ ID NO: 43411 - RNA, 19 nt, Homo sapiens
ucccauggcuauugaagaa

SEQ ID NO: 43412 - RNA, 19 nt, Homo sapiens
uucaguaccuggcuccuua

SEQ ID NO: 43413 - RNA, 19 nt, Homo sapiens
cugcugagauguccucuau

SEQ ID NO: 43414 - RNA, 19 nt, Homo sapiens
acacaaucauuaaccagaa

SEQ ID NO: 43415 - RNA, 19 nt, Homo sapiens
augcaaagcugaaagagau

SEQ ID NO: 43416 - RNA, 19 nt, Homo sapiens
aaagaucucagaacaauca

SEQ ID NO: 43417 - RNA, 19 nt, Homo sapiens
gaagaagcuguacuguauu

SEQ ID NO: 43418 - RNA, 19 nt, Homo sapiens
uaacguuggucugucugua

SEQ ID NO: 43419 - RNA, 19 nt, Homo sapiens
cuggugaugugucugcuua

SEQ ID NO: 43420 - RNA, 19 nt, Homo sapiens
aaacaugcuuugaucaucu

SEQ ID NO: 43421 - RNA, 19 nt, Homo sapiens
ucaagcagaagaaauggua

SEQ ID NO: 43422 - RNA, 19 nt, Homo sapiens
uuucuuggcuggauuugaa

SEQ ID NO: 43423 - RNA, 19 nt, Homo sapiens
ggagagagcagccaaaaug

SEQ ID NO: 43424 - RNA, 19 nt, Homo sapiens
uaaggaaggagauauagug

SEQ ID NO: 43425 - RNA, 19 nt, Homo sapiens
gcugaggaauguucaagca

SEQ ID NO: 43426 - RNA, 19 nt, Homo sapiens
ggauucacaucaaauacca

SEQ ID NO: 43427 - RNA, 19 nt, Homo sapiens
aaugauggaucugaugaaa

SEQ ID NO: 43428 - RNA, 19 nt, Homo sapiens
uggcuggauuugaagcuua

SEQ ID NO: 43429 - RNA, 19 nt, Homo sapiens
gcuguacuguauuuauguu

SEQ ID NO: 43430 - RNA, 19 nt, Homo sapiens
cagcgugaacugauuauug

SEQ ID NO: 43431 - RNA, 19 nt, Homo sapiens
cagaaaugcuuuggguuca

SEQ ID NO: 43432 - RNA, 19 nt, Homo sapiens
aagaagaagcuguacugua

SEQ ID NO: 43433 - RNA, 19 nt, Homo sapiens
cuuggaaccugacaauguu

SEQ ID NO: 43434 - RNA, 19 nt, Homo sapiens
cacaaucauuaaccagaaa

SEQ ID NO: 43435 - RNA, 19 nt, Homo sapiens
aauaaagguuccauaaugc

SEQ ID NO: 43436 - RNA, 19 nt, Homo sapiens
aagcuguacuguauuuaug

SEQ ID NO: 43437 - RNA, 19 nt, Homo sapiens
ucauuaaccagaaacguuu

SEQ ID NO: 43438 - RNA, 19 nt, Homo sapiens
guuacucucauacuccuua

SEQ ID NO: 43439 - RNA, 19 nt, Homo sapiens
gcugaaagagauuguaaca

SEQ ID NO: 43440 - RNA, 19 nt, Homo sapiens
ugagauguccucuauucuu

SEQ ID NO: 43441 - RNA, 19 nt, Homo sapiens
gcuguuccaugggagagua

SEQ ID NO: 43442 - RNA, 19 nt, Homo sapiens
gcagaugccaugaaguaca

SEQ ID NO: 43443 - RNA, 19 nt, Homo sapiens
agaagaaaugguagaguuu

SEQ ID NO: 43444 - RNA, 19 nt, Homo sapiens
gaugcaaagcugaaagaga

SEQ ID NO: 43445 - RNA, 19 nt, Homo sapiens
ugauaccucuguugaucuu

SEQ ID NO: 43446 - RNA, 19 nt, Homo sapiens
gaagaaacugggcgugucu

SEQ ID NO: 43447 - RNA, 19 nt, Homo sapiens
gacugggacugcugagaug

SEQ ID NO: 43448 - RNA, 19 nt, Homo sapiens
uaggcgaguuggucugaaa

SEQ ID NO: 43449 - RNA, 19 nt, Homo sapiens
gcaaagcugaaagagauug

SEQ ID NO: 43450 - RNA, 19 nt, Homo sapiens
gacaauggcaaacaugcuu

SEQ ID NO: 43451 - RNA, 19 nt, Homo sapiens
ggcuggauuugaagcuuaa

SEQ ID NO: 43452 - RNA, 19 nt, Homo sapiens
aaagguauccgcccugcaa

SEQ ID NO: 43453 - RNA, 19 nt, Homo sapiens
ucaaugauggaucugauga

SEQ ID NO: 43454 - RNA, 19 nt, Homo sapiens
gcuuuggguucaucuuuca

SEQ ID NO: 43455 - RNA, 19 nt, Homo sapiens
ggaauguucaagcagaaga

SEQ ID NO: 43456 - RNA, 19 nt, Homo sapiens
agaaacugggcgugucuua

SEQ ID NO: 43457 - RNA, 19 nt, Homo sapiens
ucacaucaaauaccaguuc

SEQ ID NO: 43458 - RNA, 19 nt, Homo sapiens
ucagaacaaucagaugcaa

SEQ ID NO: 43459 - RNA, 19 nt, Homo sapiens
uagagacaauggcaaacau

SEQ ID NO: 43460 - RNA, 19 nt, Homo sapiens
uuaaggcuguggauagcuu

SEQ ID NO: 43461 - RNA, 19 nt, Homo sapiens
gaauguucaagcagaagaa

SEQ ID NO: 43462 - RNA, 19 nt, Homo sapiens
aaacugggcgugucuuaag

SEQ ID NO: 43463 - RNA, 19 nt, Homo sapiens
gagcccagcaagauuacaa

SEQ ID NO: 43464 - RNA, 19 nt, Homo sapiens
ccauggcuauugaagaaca

SEQ ID NO: 43465 - RNA, 19 nt, Homo sapiens
augcagaugccaugaagua

SEQ ID NO: 43466 - RNA, 19 nt, Homo sapiens
gaagaaaugguagaguuuu

SEQ ID NO: 43467 - RNA, 19 nt, Homo sapiens
acaaauuucuuggcuggau

SEQ ID NO: 43468 - RNA, 19 nt, Homo sapiens
gaacaucccuuaauuugag

SEQ ID NO: 43469 - RNA, 19 nt, Homo sapiens
gcacagcaauggccaaaga

SEQ ID NO: 43470 - RNA, 19 nt, Homo sapiens
ggaaucaaguuucaguaaa

SEQ ID NO: 43471 - RNA, 19 nt, Homo sapiens
ugacuaugcuguugguuua

SEQ ID NO: 43472 - RNA, 19 nt, Homo sapiens
gagaagacaaagaagauua

SEQ ID NO: 43473 - RNA, 19 nt, Homo sapiens
gcagugagcauguuucuug

SEQ ID NO: 43474 - RNA, 19 nt, Homo sapiens
gaaauaguaagacagauug

SEQ ID NO: 43475 - RNA, 19 nt, Homo sapiens
gaaucaaguuucaguaaag

SEQ ID NO: 43476 - RNA, 19 nt, Homo sapiens
ggaccuaucuugccuucug

SEQ ID NO: 43477 - RNA, 19 nt, Homo sapiens
gaacuuggaggaaacaaug

SEQ ID NO: 43478 - RNA, 19 nt, Homo sapiens
ggagaagucuguuggaacu

SEQ ID NO: 43479 - RNA, 19 nt, Homo sapiens
ugaaagaucuggccaugca

SEQ ID NO: 43480 - RNA, 19 nt, Homo sapiens
ggaagaagcaaagaaagaa

SEQ ID NO: 43481 - RNA, 19 nt, Homo sapiens
ccaaccacuucccucauua

SEQ ID NO: 43482 - RNA, 19 nt, Homo sapiens
ggagaaauaguaagacaga

SEQ ID NO: 43483 - RNA, 19 nt, Homo sapiens
caagcugccuggugcaauu

SEQ ID NO: 43484 - RNA, 19 nt, Homo sapiens
caacauagccauaguuacu

SEQ ID NO: 43485 - RNA, 19 nt, Homo sapiens
gaggagaaauaguaagaca

SEQ ID NO: 43486 - RNA, 19 nt, Homo sapiens
cagcuuaguuguuccauca

SEQ ID NO: 43487 - RNA, 19 nt, Homo sapiens
gcaauuuguuccuugacuu

SEQ ID NO: 43488 - RNA, 19 nt, Homo sapiens
gaccucagcuuaguuguuc

SEQ ID NO: 43489 - RNA, 19 nt, Homo sapiens
caaguagcaucuuuaccaa

SEQ ID NO: 43490 - RNA, 19 nt, Homo sapiens
ggaucgcccuggaaauuau

SEQ ID NO: 43491 - RNA, 19 nt, Homo sapiens
gccaugaucuguggaaaug

SEQ ID NO: 43492 - RNA, 19 nt, Homo sapiens
ggagaagauccaaguacua

SEQ ID NO: 43493 - RNA, 19 nt, Homo sapiens
gaagauccaaguacuagga

SEQ ID NO: 43494 - RNA, 19 nt, Homo sapiens
gagugaaccugcuguccuu

SEQ ID NO: 43495 - RNA, 19 nt, Homo sapiens
caacuacaguaaagaccuu

SEQ ID NO: 43496 - RNA, 19 nt, Homo sapiens
gauuggaggugccuuugga

SEQ ID NO: 43497 - RNA, 19 nt, Homo sapiens
gaagcuuggugucuuugga

SEQ ID NO: 43498 - RNA, 19 nt, Homo sapiens
gaagaaacuguaaagaaag

SEQ ID NO: 43499 - RNA, 19 nt, Homo sapiens
ccacucuccucaucaauca

SEQ ID NO: 43500 - RNA, 19 nt, Homo sapiens
augagaaggucuacuugua

SEQ ID NO: 43501 - RNA, 19 nt, Homo sapiens
caggagagguuugggagaa

SEQ ID NO: 43502 - RNA, 19 nt, Homo sapiens
gcuguugguuuaucaagga

SEQ ID NO: 43503 - RNA, 19 nt, Homo sapiens
ccgauucucuaugucuuua

SEQ ID NO: 43504 - RNA, 19 nt, Homo sapiens
gcagaccucagcuuaguug

SEQ ID NO: 43505 - RNA, 19 nt, Homo sapiens
gaaggucuacuuguacuau

SEQ ID NO: 43506 - RNA, 19 nt, Homo sapiens
gagaaggucuacuuguacu

SEQ ID NO: 43507 - RNA, 19 nt, Homo sapiens
gagaagauccaaguacuag

SEQ ID NO: 43508 - RNA, 19 nt, Homo sapiens
guaaagaaagcaagagaag

SEQ ID NO: 43509 - RNA, 19 nt, Homo sapiens
ccaagguucuggaggacaa

SEQ ID NO: 43510 - RNA, 19 nt, Homo sapiens
uaggaagcuuggugucuuu

SEQ ID NO: 43511 - RNA, 19 nt, Homo sapiens
gggagaagauccaaguacu

SEQ ID NO: 43512 - RNA, 19 nt, Homo sapiens
aaacgaggagaaauaguaa

SEQ ID NO: 43513 - RNA, 19 nt, Homo sapiens
cuacuuguacuaucaacua

SEQ ID NO: 43514 - RNA, 19 nt, Homo sapiens
gcuuggaccuaaaggauca

SEQ ID NO: 43515 - RNA, 19 nt, Homo sapiens
ggacccuaauguucucuau

SEQ ID NO: 43516 - RNA, 19 nt, Homo sapiens
gagguuguaaacagacuua

SEQ ID NO: 43517 - RNA, 19 nt, Homo sapiens
gauaauagccaagguucug

SEQ ID NO: 43518 - RNA, 19 nt, Homo sapiens
guggauaucugugacuaug

SEQ ID NO: 43519 - RNA, 19 nt, Homo sapiens
ggaaacaguacaugagaag

SEQ ID NO: 43520 - RNA, 19 nt, Homo sapiens
ggaucagacuguggcauug

SEQ ID NO: 43521 - RNA, 19 nt, Homo sapiens
uacaacauagccauaguua

SEQ ID NO: 43522 - RNA, 19 nt, Homo sapiens
guagaaccgacaauuguga

SEQ ID NO: 43523 - RNA, 19 nt, Homo sapiens
ggagaagacaaagaagauu

SEQ ID NO: 43524 - RNA, 19 nt, Homo sapiens
uaacaacgagccaauagca

SEQ ID NO: 43525 - RNA, 19 nt, Homo sapiens
ucaaguagcaucuuuacca

SEQ ID NO: 43526 - RNA, 19 nt, Homo sapiens
gauuggaggaccuaucuug

SEQ ID NO: 43527 - RNA, 19 nt, Homo sapiens
aaagaaagcaagagaagca

SEQ ID NO: 43528 - RNA, 19 nt, Homo sapiens
cgaggcgacuguuuauaca

SEQ ID NO: 43529 - RNA, 19 nt, Homo sapiens
cagcaauggccaaagauga

SEQ ID NO: 43530 - RNA, 19 nt, Homo sapiens
ggugcaauuuguuccuuga

SEQ ID NO: 43531 - RNA, 19 nt, Homo sapiens
guucaggaguauguggaua

SEQ ID NO: 43532 - RNA, 19 nt, Homo sapiens
gcagggagucuggcaguga

SEQ ID NO: 43533 - RNA, 19 nt, Homo sapiens
gcagauauuggcacagcaa

SEQ ID NO: 43534 - RNA, 19 nt, Homo sapiens
cuaggaagcuuggugucuu

SEQ ID NO: 43535 - RNA, 19 nt, Homo sapiens
caacgagccaauagcaaga

SEQ ID NO: 43536 - RNA, 19 nt, Homo sapiens
ugaugagguuguaaacaga

SEQ ID NO: 43537 - RNA, 19 nt, Homo sapiens
caaagauaauagccaaggu

SEQ ID NO: 43538 - RNA, 19 nt, Homo sapiens
caucacggcauucaauuuc

SEQ ID NO: 43539 - RNA, 19 nt, Homo sapiens
gaccuaucuugccuucuga

SEQ ID NO: 43540 - RNA, 19 nt, Homo sapiens
ggauaucugugacuaugcu

SEQ ID NO: 43541 - RNA, 19 nt, Homo sapiens
gcuaacaacgagccaauag

SEQ ID NO: 43542 - RNA, 19 nt, Homo sapiens
cccaaggaaucaaguuuca

SEQ ID NO: 43543 - RNA, 19 nt, Homo sapiens
ugcauggaauaaugaagua

SEQ ID NO: 43544 - RNA, 19 nt, Homo sapiens
gaagaagcaaagaaagaag

SEQ ID NO: 43545 - RNA, 19 nt, Homo sapiens
agagagcuuucuggucuuu

SEQ ID NO: 43546 - RNA, 19 nt, Homo sapiens
uggaaacaguacaugagaa

SEQ ID NO: 43547 - RNA, 19 nt, Homo sapiens
gcaggcagugagcauguuu

SEQ ID NO: 43548 - RNA, 19 nt, Homo sapiens
gcgaggcgacuguuuauac

SEQ ID NO: 43549 - RNA, 19 nt, Homo sapiens
uccaaccacuucccucauu

SEQ ID NO: 43550 - RNA, 19 nt, Homo sapiens
guugguuuaucaaggauga

SEQ ID NO: 43551 - RNA, 19 nt, Homo sapiens
ugaacaucccuuaauuuga

SEQ ID NO: 43552 - RNA, 19 nt, Homo sapiens
caaggaaucaaguuucagu

SEQ ID NO: 43553 - RNA, 19 nt, Homo sapiens
gcagugaugccuggaaaca

SEQ ID NO: 43554 - RNA, 19 nt, Homo sapiens
ggagagguuugggagaagu

SEQ ID NO: 43555 - RNA, 19 nt, Homo sapiens
caugaucuguggaaauguc

SEQ ID NO: 43556 - RNA, 19 nt, Homo sapiens
ggaaggugugggugaaguu

SEQ ID NO: 43557 - RNA, 19 nt, Homo sapiens
gauuaaaguuuucccugaa

SEQ ID NO: 43558 - RNA, 19 nt, Homo sapiens
gaaacuguaaagaaagcaa

SEQ ID NO: 43559 - RNA, 19 nt, Homo sapiens
gagggcguguauaauggaa

SEQ ID NO: 43560 - RNA, 19 nt, Homo sapiens
cccaaagcccugauuaaau

SEQ ID NO: 43561 - RNA, 19 nt, Homo sapiens
ucgcuccgauucucuaugu

SEQ ID NO: 43562 - RNA, 19 nt, Homo sapiens
cccuggaaauuauguagaa

SEQ ID NO: 43563 - RNA, 19 nt, Homo sapiens
uggaagaagcaaagaaaga

SEQ ID NO: 43564 - RNA, 19 nt, Homo sapiens
agaugcagaccucagcuua

SEQ ID NO: 43565 - RNA, 19 nt, Homo sapiens
aaagauaauagccaagguu

SEQ ID NO: 43566 - RNA, 19 nt, Homo sapiens
ggcagacuaugaagaaacu

SEQ ID NO: 43567 - RNA, 19 nt, Homo sapiens
gugacuaugcuguugguuu

SEQ ID NO: 43568 - RNA, 19 nt, Homo sapiens
gaacaggccuucuauaugg

SEQ ID NO: 43569 - RNA, 19 nt, Homo sapiens
ccaagaaggucaagaugua

SEQ ID NO: 43570 - RNA, 19 nt, Homo sapiens
ugaaagaggucccaucaaa

SEQ ID NO: 43571 - RNA, 19 nt, Homo sapiens
gcaaugauuuauaccauga

SEQ ID NO: 43572 - RNA, 19 nt, Homo sapiens
gauaacaucuuucgcuuca

SEQ ID NO: 43573 - RNA, 19 nt, Homo sapiens
caagauguacugcuauuua

SEQ ID NO: 43574 - RNA, 19 nt, Homo sapiens
ggacuaccaccaauucuaa

SEQ ID NO: 43575 - RNA, 19 nt, Homo sapiens
gaacaguauuuaagguuuc

SEQ ID NO: 43576 - RNA, 19 nt, Homo sapiens
uaucauggaucccaacauu

SEQ ID NO: 43577 - RNA, 19 nt, Homo sapiens
gaaauucuggugacuggua

SEQ ID NO: 43578 - RNA, 19 nt, Homo sapiens
gcugguauauggucaaaug

SEQ ID NO: 43579 - RNA, 19 nt, Homo sapiens
gcagugagcauuacgaugu

SEQ ID NO: 43580 - RNA, 19 nt, Homo sapiens
agaggugucugcauuauug

SEQ ID NO: 43581 - RNA, 19 nt, Homo sapiens
cuacuacguuugcccauuu

SEQ ID NO: 43582 - RNA, 19 nt, Homo sapiens
cugauaagcuggcugaaga

SEQ ID NO: 43583 - RNA, 19 nt, Homo sapiens
ggaugaacuuucugaggaa

SEQ ID NO: 43584 - RNA, 19 nt, Homo sapiens
ggaugcaaauuguucaaau

SEQ ID NO: 43585 - RNA, 19 nt, Homo sapiens
gagccuugauugaagauau

SEQ ID NO: 43586 - RNA, 19 nt, Homo sapiens
gauguacugcuauuuauug

SEQ ID NO: 43587 - RNA, 19 nt, Homo sapiens
gaauuaccacuaccaagaa

SEQ ID NO: 43588 - RNA, 19 nt, Homo sapiens
gguauauggucaaaugaau

SEQ ID NO: 43589 - RNA, 19 nt, Homo sapiens
gagaaccuauugaugaaag

SEQ ID NO: 43590 - RNA, 19 nt, Homo sapiens
aaacaucuccuucgccaaa

SEQ ID NO: 43591 - RNA, 19 nt, Homo sapiens
gaaggagaccaucaaagga

SEQ ID NO: 43592 - RNA, 19 nt, Homo sapiens
ugaaggcaaugauuuauac

SEQ ID NO: 43593 - RNA, 19 nt, Homo sapiens
gacuguggcugaauacuuc

SEQ ID NO: 43594 - RNA, 19 nt, Homo sapiens
uauauaggcugcacaagag

SEQ ID NO: 43595 - RNA, 19 nt, Homo sapiens
ccacugacaugggcacuau

SEQ ID NO: 43596 - RNA, 19 nt, Homo sapiens
guacugaucauggaguuaa

SEQ ID NO: 43597 - RNA, 19 nt, Homo sapiens
gcacuaugcaggaaagaau

SEQ ID NO: 43598 - RNA, 19 nt, Homo sapiens
uaagguagcgcugguauau

SEQ ID NO: 43599 - RNA, 19 nt, Homo sapiens
uaaggacuauugcuaugga

SEQ ID NO: 43600 - RNA, 19 nt, Homo sapiens
gggacaggaugcaaauugu

SEQ ID NO: 43601 - RNA, 19 nt, Homo sapiens
ccaaagcccauggugguua

SEQ ID NO: 43602 - RNA, 19 nt, Homo sapiens
aaucaacaaugucgccaaa

SEQ ID NO: 43603 - RNA, 19 nt, Homo sapiens
uggagaaccuauugaugaa

SEQ ID NO: 43604 - RNA, 19 nt, Homo sapiens
caggaaagaauuaccacua

SEQ ID NO: 43605 - RNA, 19 nt, Homo sapiens
gugaaggcaaugauuuaua

SEQ ID NO: 43606 - RNA, 19 nt, Homo sapiens
ggagguggcccagcauuug

SEQ ID NO: 43607 - RNA, 19 nt, Homo sapiens
uaaaagaugccaccucuaa

SEQ ID NO: 43608 - RNA, 19 nt, Homo sapiens
gcaagacuguacugaucau

SEQ ID NO: 43609 - RNA, 19 nt, Homo sapiens
gguuagaggccagaaagua

SEQ ID NO: 43610 - RNA, 19 nt, Homo sapiens
ugaagaagcuguggcaaaa

SEQ ID NO: 43611 - RNA, 19 nt, Homo sapiens
ggacaggaugcaaauuguu

SEQ ID NO: 43612 - RNA, 19 nt, Homo sapiens
gucaagauguacugcuauu

SEQ ID NO: 43613 - RNA, 19 nt, Homo sapiens
agaauuaccacuaccaaga

SEQ ID NO: 43614 - RNA, 19 nt, Homo sapiens
gaaagaauuaccacuacca

SEQ ID NO: 43615 - RNA, 19 nt, Homo sapiens
uggcaagacuguacugauc

SEQ ID NO: 43616 - RNA, 19 nt, Homo sapiens
uaagcuggcugaagagcau

SEQ ID NO: 43617 - RNA, 19 nt, Homo sapiens
ggguauggaugaacuuucu

SEQ ID NO: 43618 - RNA, 19 nt, Homo sapiens
guaucaagguugucgaucu

SEQ ID NO: 43619 - RNA, 19 nt, Homo sapiens
ugacugguaucaagguugu

SEQ ID NO: 43620 - RNA, 19 nt, Homo sapiens
gaugagggacuaccaccaa

SEQ ID NO: 43621 - RNA, 19 nt, Homo sapiens
caaaggauuccagcagauu

SEQ ID NO: 43622 - RNA, 19 nt, Homo sapiens
ucaaaggauuccagcagau

SEQ ID NO: 43623 - RNA, 19 nt, Homo sapiens
aaucugguguuaucaacuu

SEQ ID NO: 43624 - RNA, 19 nt, Homo sapiens
guacagaaggcuugguuag

SEQ ID NO: 43625 - RNA, 19 nt, Homo sapiens
ucauggaguuaaucaacaa

SEQ ID NO: 43626 - RNA, 19 nt, Homo sapiens
gaucauggaguuaaucaac

SEQ ID NO: 43627 - RNA, 19 nt, Homo sapiens
gaaagaggucccaucaaaa

SEQ ID NO: 43628 - RNA, 19 nt, Homo sapiens
cuauauaggcugcacaaga

SEQ ID NO: 43629 - RNA, 19 nt, Homo sapiens
ugaaggagaccaucaaagg

SEQ ID NO: 43630 - RNA, 19 nt, Homo sapiens
gcuacuacguuugcccauu

SEQ ID NO: 43631 - RNA, 19 nt, Homo sapiens
gggacuaccaccaauucua

SEQ ID NO: 43632 - RNA, 19 nt, Homo sapiens
ggcugacuguggcugaaua

SEQ ID NO: 43633 - RNA, 19 nt, Homo sapiens
ggugagagcacaguaagga

SEQ ID NO: 43634 - RNA, 19 nt, Homo sapiens
agacuguacugaucaugga

SEQ ID NO: 43635 - RNA, 19 nt, Homo sapiens
acaauuugcucccauucau

SEQ ID NO: 43636 - RNA, 19 nt, Homo sapiens
acagaaggcuugguuagag

SEQ ID NO: 43637 - RNA, 19 nt, Homo sapiens
gagagcacaguaaggacua

SEQ ID NO: 43638 - RNA, 19 nt, Homo sapiens
ggcagaaucaugaauguca

SEQ ID NO: 43639 - RNA, 19 nt, Homo sapiens
gagggacuaccaccaauuc

SEQ ID NO: 43640 - RNA, 19 nt, Homo sapiens
ccagguugcugaggucuuc

SEQ ID NO: 43641 - RNA, 19 nt, Homo sapiens
gacuccaccucucguauca

SEQ ID NO: 43642 - RNA, 19 nt, Homo sapiens
uugcugagcugggcaucua

SEQ ID NO: 43643 - RNA, 19 nt, Homo sapiens
gcgcugguauauggucaaa

SEQ ID NO: 43644 - RNA, 19 nt, Homo sapiens
ccgugaaggcaaugauuua

SEQ ID NO: 43645 - RNA, 19 nt, Homo sapiens
uaucaagguugucgaucug

SEQ ID NO: 43646 - RNA, 19 nt, Homo sapiens
uuggagaaccuauugauga

SEQ ID NO: 43647 - RNA, 19 nt, Homo sapiens
acaguaaggacuauugcua

SEQ ID NO: 43648 - RNA, 19 nt, Homo sapiens
ggucuucacaggucauaug

SEQ ID NO: 43649 - RNA, 19 nt, Homo sapiens
gacaggaugcaaauuguuc

SEQ ID NO: 43650 - RNA, 19 nt, Homo sapiens
gaggacccgugaaggcaau

SEQ ID NO: 43651 - RNA, 19 nt, Homo sapiens
ccaguuugaugagggacua

SEQ ID NO: 43652 - RNA, 19 nt, Homo sapiens
caaagcccauggugguuac

SEQ ID NO: 43653 - RNA, 19 nt, Homo sapiens
gguacagaaggcuugguua

SEQ ID NO: 43654 - RNA, 19 nt, Homo sapiens
aguaaggacuauugcuaug

SEQ ID NO: 43655 - RNA, 19 nt, Homo sapiens
ggagaaccuauugaugaaa

SEQ ID NO: 43656 - RNA, 19 nt, Homo sapiens
aaaggauuccagcagauuu

SEQ ID NO: 43657 - RNA, 19 nt, Homo sapiens
ucauggaucccaacauugu

SEQ ID NO: 43658 - RNA, 19 nt, Homo sapiens
ucaacaaugucgccaaagc

SEQ ID NO: 43659 - RNA, 19 nt, Homo sapiens
ggaguuggcaagacuguac

SEQ ID NO: 43660 - RNA, 19 nt, Homo sapiens
agccuugauugaagauaua

SEQ ID NO: 43661 - RNA, 19 nt, Homo sapiens
uggaguuaaucaacaaugu

SEQ ID NO: 43662 - RNA, 19 nt, Homo sapiens
gcaggaaauucuggugacu

SEQ ID NO: 43663 - RNA, 19 nt, Homo sapiens
cagugagcauuacgauguu

SEQ ID NO: 43664 - RNA, 19 nt, Homo sapiens
ggugguuacucuguguuug

SEQ ID NO: 43665 - RNA, 19 nt, Homo sapiens
ggugacugguaucaagguu

SEQ ID NO: 43666 - RNA, 19 nt, Homo sapiens
caguaaggacuauugcuau

SEQ ID NO: 43667 - RNA, 19 nt, Homo sapiens
aggaaagaauuaccacuac

SEQ ID NO: 43668 - RNA, 19 nt, Homo sapiens
gaaaccagcucgaauauau

SEQ ID NO: 43669 - RNA, 19 nt, Homo sapiens
ggaaagaaguuaugcuugu

SEQ ID NO: 43670 - RNA, 19 nt, Homo sapiens
gaagaaacaccuccuuauu

SEQ ID NO: 43671 - RNA, 19 nt, Homo sapiens
gaagacagcaagauauuug

SEQ ID NO: 43672 - RNA, 19 nt, Homo sapiens
gaaagaaguuaugcuuguu

SEQ ID NO: 43673 - RNA, 19 nt, Homo sapiens
ucaaagaagugggaagaaa

SEQ ID NO: 43674 - RNA, 19 nt, Homo sapiens
ggucugucaucuccuauaa

SEQ ID NO: 43675 - RNA, 19 nt, Homo sapiens
ugagaugauugacaaauug

SEQ ID NO: 43676 - RNA, 19 nt, Homo sapiens
ggagaugcgucagucauug

SEQ ID NO: 43677 - RNA, 19 nt, Homo sapiens
gauaucaccaggagacuaa

SEQ ID NO: 43678 - RNA, 19 nt, Homo sapiens
gcuccaucaucuuuaauaa

SEQ ID NO: 43679 - RNA, 19 nt, Homo sapiens
cgaaauauggcaacuuuga

SEQ ID NO: 43680 - RNA, 19 nt, Homo sapiens
agaaacuguuccuccauua

SEQ ID NO: 43681 - RNA, 19 nt, Homo sapiens
gccaagcugucaucacaaa

SEQ ID NO: 43682 - RNA, 19 nt, Homo sapiens
agucauugcccuugaauua

SEQ ID NO: 43683 - RNA, 19 nt, Homo sapiens
ggauucaaguucgaaauau

SEQ ID NO: 43684 - RNA, 19 nt, Homo sapiens
gaaauauggcaacuuugaa

SEQ ID NO: 43685 - RNA, 19 nt, Homo sapiens
gaaguuaugcuuguuggaa

SEQ ID NO: 43686 - RNA, 19 nt, Homo sapiens
agaaacaccuccuuauugg

SEQ ID NO: 43687 - RNA, 19 nt, Homo sapiens
ggacaaugccagcaagaau

SEQ ID NO: 43688 - RNA, 19 nt, Homo sapiens
gagcagagugccaggauga

SEQ ID NO: 43689 - RNA, 19 nt, Homo sapiens
gcuauucauuccuccauug

SEQ ID NO: 43690 - RNA, 19 nt, Homo sapiens
gcaauggauucaaguucga

SEQ ID NO: 43691 - RNA, 19 nt, Homo sapiens
gaaggcuccaucaucuuua

SEQ ID NO: 43692 - RNA, 19 nt, Homo sapiens
aagaaacaccuccuuauug

SEQ ID NO: 43693 - RNA, 19 nt, Homo sapiens
gauucaaguucgaaauaug

SEQ ID NO: 43694 - RNA, 19 nt, Homo sapiens
gaucuuuagcucuguauga

SEQ ID NO: 43695 - RNA, 19 nt, Homo sapiens
gaaacuguuccuccauuau

SEQ ID NO: 43696 - RNA, 19 nt, Homo sapiens
gaaugcuucugagaugauu

SEQ ID NO: 43697 - RNA, 19 nt, Homo sapiens
ucagaggcauacuuuauag

SEQ ID NO: 43698 - RNA, 19 nt, Homo sapiens
aagaaacuguuccuccauu

SEQ ID NO: 43699 - RNA, 19 nt, Homo sapiens
ucugucaucuccuauaaga

SEQ ID NO: 43700 - RNA, 19 nt, Homo sapiens
ugaaggcuccaucaucuuu

SEQ ID NO: 43701 - RNA, 19 nt, Homo sapiens
gacagcaagauauuuguaa

SEQ ID NO: 43702 - RNA, 19 nt, Homo sapiens
cuucugagaugauugacaa

SEQ ID NO: 43703 - RNA, 19 nt, Homo sapiens
ggauaugaauuugaugaag

SEQ ID NO: 43704 - RNA, 19 nt, Homo sapiens
aagaagaaacaccuccuua

SEQ ID NO: 43705 - RNA, 19 nt, Homo sapiens
aaacuguuccuccauuauu

SEQ ID NO: 43706 - RNA, 19 nt, Homo sapiens
cugagaugauugacaaauu

SEQ ID NO: 43707 - RNA, 19 nt, Homo sapiens
ucaggucugucaucuccua

SEQ ID NO: 43708 - RNA, 19 nt, Homo sapiens
gcagcucuguaaagaagga

SEQ ID NO: 43709 - RNA, 19 nt, Homo sapiens
ccgccaagcugucaucaca

SEQ ID NO: 43710 - RNA, 19 nt, Homo sapiens
ugacagccauggacaaugc

SEQ ID NO: 43711 - RNA, 19 nt, Homo sapiens
uggccaacaucaucuacua

SEQ ID NO: 43712 - RNA, 19 nt, Homo sapiens
cgagguugcuacacuaaca

SEQ ID NO: 43713 - RNA, 19 nt, Homo sapiens
ggacucauucugaccaguu

SEQ ID NO: 43714 - RNA, 19 nt, Homo sapiens
caaauugacauugacauuc

SEQ ID NO: 43715 - RNA, 19 nt, Homo sapiens
gacaaugccagcaagaaug

SEQ ID NO: 43716 - RNA, 19 nt, Homo sapiens
aaucagaggcauacuuuau

SEQ ID NO: 43717 - RNA, 19 nt, Homo sapiens
uucgaaauauggcaacuuu

SEQ ID NO: 43718 - RNA, 19 nt, Homo sapiens
gagaugauugacaaauuga

SEQ ID NO: 43719 - RNA, 19 nt, Homo sapiens
caaagaagugggaagaaag

SEQ ID NO: 43720 - RNA, 19 nt, Homo sapiens
gaagaaacuguuccuccau

SEQ ID NO: 43721 - RNA, 19 nt, Homo sapiens
aauacaaucuggccaacau

SEQ ID NO: 43722 - RNA, 19 nt, Homo sapiens
caacaucaucuacuacucu

SEQ ID NO: 43723 - RNA, 19 nt, Homo sapiens
gacucauucugaccaguuu

SEQ ID NO: 43724 - RNA, 19 nt, Homo sapiens
agaagaaacaccuccuuau

SEQ ID NO: 43725 - RNA, 19 nt, Homo sapiens
uauauggauugggaucuuu

SEQ ID NO: 43726 - RNA, 19 nt, Homo sapiens
guuccuccauuauuugaau

SEQ ID NO: 43727 - RNA, 19 nt, Homo sapiens
gcagggcuguggcuaccau

SEQ ID NO: 43728 - RNA, 19 nt, Homo sapiens
aagcgagguugcuacacua

SEQ ID NO: 43729 - RNA, 19 nt, Homo sapiens
cugcagcucuguaaagaag

SEQ ID NO: 43730 - RNA, 19 nt, Homo sapiens
ugaaaccagcucgaauaua

SEQ ID NO: 43731 - RNA, 19 nt, Homo sapiens
uggauucaaguucgaaaua

SEQ ID NO: 43732 - RNA, 19 nt, Homo sapiens
cugaaggaguccaccacua

SEQ ID NO: 43733 - RNA, 19 nt, Homo sapiens
ugaagacagcaagauauuu

SEQ ID NO: 43734 - RNA, 19 nt, Homo sapiens
gaugacagccauggacaau

SEQ ID NO: 43735 - RNA, 19 nt, Homo sapiens
ugaaggaguccaccacuag

SEQ ID NO: 43736 - RNA, 19 nt, Homo sapiens
aaggcuccaucaucuuuaa

SEQ ID NO: 43737 - RNA, 19 nt, Homo sapiens
gcagcugggaaagaaguua

SEQ ID NO: 43738 - RNA, 19 nt, Homo sapiens
agacagcaagauauuugua

SEQ ID NO: 43739 - RNA, 19 nt, Homo sapiens
gaaggaguccaccacuagu

SEQ ID NO: 43740 - RNA, 19 nt, Homo sapiens
aaagcgagguugcuacacu

SEQ ID NO: 43741 - RNA, 19 nt, Homo sapiens
aacuguuccuccauuauuu

SEQ ID NO: 43742 - RNA, 19 nt, Homo sapiens
cagcucgaauauauggauu

SEQ ID NO: 43743 - RNA, 19 nt, Homo sapiens
cgucagucauugcccuuga

SEQ ID NO: 43744 - RNA, 19 nt, Homo sapiens
gcucgaauauauggauugg

SEQ ID NO: 43745 - RNA, 19 nt, Homo sapiens
cgaggacuguguggugcua

SEQ ID NO: 43746 - RNA, 19 nt, Homo sapiens
caagaagaaacaccuccuu

SEQ ID NO: 43747 - RNA, 19 nt, Homo sapiens
ggccugaagacaagaagaa

SEQ ID NO: 43748 - RNA, 19 nt, Homo sapiens
auucauuccuccauugcua

SEQ ID NO: 43749 - RNA, 19 nt, Homo sapiens
gaugauugacaaauugaca

SEQ ID NO: 43750 - RNA, 19 nt, Homo sapiens
aaagaaguuaugcuuguug

SEQ ID NO: 43751 - RNA, 19 nt, Homo sapiens
cugaagacagcaagauauu

SEQ ID NO: 43752 - RNA, 19 nt, Homo sapiens
uuagcuuacugcugccuuu

SEQ ID NO: 43753 - RNA, 19 nt, Homo sapiens
uaaauucaggucugucauc

SEQ ID NO: 43754 - RNA, 19 nt, Homo sapiens
ggcuguggcuaccauguuc

SEQ ID NO: 43755 - RNA, 19 nt, Homo sapiens
gcugcaaaauuaccaagaa

SEQ ID NO: 43756 - RNA, 19 nt, Homo sapiens
cugacgugcugcaaaauua

SEQ ID NO: 43757 - RNA, 19 nt, Homo sapiens
ucauugcccuugaauuacu

SEQ ID NO: 43758 - RNA, 19 nt, Homo sapiens
ggcuccaucaucuuuaaua

SEQ ID NO: 43759 - RNA, 19 nt, Homo sapiens
uuuauaggacucauucuga

SEQ ID NO: 43760 - RNA, 19 nt, Homo sapiens
uguuggaauuggugacaaa

SEQ ID NO: 43761 - RNA, 19 nt, Homo sapiens
gaaacaccuccuuauuggu

SEQ ID NO: 43762 - RNA, 19 nt, Homo sapiens
cuccauugcuaaacagaug

SEQ ID NO: 43763 - RNA, 19 nt, Homo sapiens
ucacaaaagaguugauuga

SEQ ID NO: 43764 - RNA, 19 nt, Homo sapiens
ggaugacagccauggacaa

SEQ ID NO: 43765 - RNA, 19 nt, Homo sapiens
gaugcugacgugcugcaaa

SEQ ID NO: 43766 - RNA, 19 nt, Homo sapiens
aagcccaucuuuucccuua

SEQ ID NO: 43767 - RNA, 19 nt, Homo sapiens
cauugcccuugaauuacua

SEQ ID NO: 43768 - RNA, 19 nt, Homo sapiens
ccacgcagguguucuucaa

SEQ ID NO: 43769 - RNA, 19 nt, Homo sapiens
ggacggcaccaccuccaaa

SEQ ID NO: 43770 - RNA, 19 nt, Homo sapiens
ggagccaccucuggaugaa

SEQ ID NO: 43771 - RNA, 19 nt, Homo sapiens
ccgugacgcuggacauguu

SEQ ID NO: 43772 - RNA, 19 nt, Homo sapiens
acucuucggugcaguuguu

SEQ ID NO: 43773 - RNA, 19 nt, Homo sapiens
gcgguuccaucgcagugaa

SEQ ID NO: 43774 - RNA, 19 nt, Homo sapiens
caacgaggcccuggugaag

SEQ ID NO: 43775 - RNA, 19 nt, Homo sapiens
caccaccuccaaauacuuu

SEQ ID NO: 43776 - RNA, 19 nt, Homo sapiens
gcaccaccuccaaauacuu

SEQ ID NO: 43777 - RNA, 19 nt, Homo sapiens
ggcccugccuguguugaaa

SEQ ID NO: 43778 - RNA, 19 nt, Homo sapiens
ccaacgaggcccuggugaa

SEQ ID NO: 43779 - RNA, 19 nt, Homo sapiens
ggugaaggcccuggaguag

SEQ ID NO: 43780 - RNA, 19 nt, Homo sapiens
gggcagccaaggcaaacuu

SEQ ID NO: 43781 - RNA, 19 nt, Homo sapiens
gcagugaacgccgacucuu

SEQ ID NO: 43782 - RNA, 19 nt, Homo sapiens
ccaaccagauguccuucac

SEQ ID NO: 43783 - RNA, 19 nt, Homo sapiens
ggcaccaccuccaaauacu

SEQ ID NO: 43784 - RNA, 19 nt, Homo sapiens
gaaauaugguucacuguua

SEQ ID NO: 43785 - RNA, 19 nt, Homo sapiens
gagaugcacugaagacaga

SEQ ID NO: 43786 - RNA, 19 nt, Homo sapiens
ggaauaaucuacccugacu

SEQ ID NO: 43787 - RNA, 19 nt, Homo sapiens
agacagaauucaaagcaaa

SEQ ID NO: 43788 - RNA, 19 nt, Homo sapiens
gaagacagaauucaaagca

SEQ ID NO: 43789 - RNA, 19 nt, Homo sapiens
aauccugucuuguucauaa

SEQ ID NO: 43790 - RNA, 19 nt, Homo sapiens
gacuaaagcuugaaaugcu

SEQ ID NO: 43791 - RNA, 19 nt, Homo sapiens
gagcuccgcuuucgcuaca

SEQ ID NO: 43792 - RNA, 19 nt, Homo sapiens
aauaaucuacccugacuaa

SEQ ID NO: 43793 - RNA, 19 nt, Homo sapiens
gcacauguuauggcagauu

SEQ ID NO: 43794 - RNA, 19 nt, Homo sapiens
acuaaagcuugaaaugcua

SEQ ID NO: 43795 - RNA, 19 nt, Homo sapiens
cacauguuauggcagauug

SEQ ID NO: 43796 - RNA, 19 nt, Homo sapiens
aaauaugguucacuguuac

SEQ ID NO: 43797 - RNA, 19 nt, Homo sapiens
uaaucuacccugacuaaag

SEQ ID NO: 43798 - RNA, 19 nt, Homo sapiens
aaucuacccugacuaaagc

SEQ ID NO: 43799 - RNA, 19 nt, Homo sapiens
gaauaaucuacccugacua

SEQ ID NO: 43800 - RNA, 19 nt, Homo sapiens
gguucacuguuacucuuga

SEQ ID NO: 43801 - RNA, 19 nt, Homo sapiens
ccugucuuguucauaaauu

SEQ ID NO: 43802 - RNA, 19 nt, Homo sapiens
gcaaaugcugagaagacuu

SEQ ID NO: 43803 - RNA, 19 nt, Homo sapiens
gacagaauucaaagcaaau

SEQ ID NO: 43804 - RNA, 19 nt, Homo sapiens
aagacagaauucaaagcaa

SEQ ID NO: 43805 - RNA, 19 nt, Homo sapiens
uuuccaaggugaagaugug

SEQ ID NO: 43806 - RNA, 19 nt, Homo sapiens
uacccugacuaaagcuuga

SEQ ID NO: 43807 - RNA, 19 nt, Homo sapiens
ugacuaaagcuugaaaugc

SEQ ID NO: 43808 - RNA, 19 nt, Homo sapiens
gcaaaagcagugagagaug

SEQ ID NO: 43809 - RNA, 19 nt, Homo sapiens
ugaaaaggaucucauucca

SEQ ID NO: 43810 - RNA, 19 nt, Homo sapiens
gaacugggcuuaucuugua

SEQ ID NO: 43811 - RNA, 19 nt, Homo sapiens
gaacaagaacacaugauaa

SEQ ID NO: 43812 - RNA, 19 nt, Homo sapiens
gaacgacuguauagaguau

SEQ ID NO: 43813 - RNA, 19 nt, Homo sapiens
cgugaucacuucugaauaa

SEQ ID NO: 43814 - RNA, 19 nt, Homo sapiens
ggaacaagaacacaugaua

SEQ ID NO: 43815 - RNA, 19 nt, Homo sapiens
gacuaaagauuaacagguu

SEQ ID NO: 43816 - RNA, 19 nt, Homo sapiens
uaaagcugcuggcaaagaa

SEQ ID NO: 43817 - RNA, 19 nt, Homo sapiens
gaccuucacugcccuauca

SEQ ID NO: 43818 - RNA, 19 nt, Homo sapiens
gaaacuagucuauuugaca

SEQ ID NO: 43819 - RNA, 19 nt, Homo sapiens
uaaauuggguggagaagca

SEQ ID NO: 43820 - RNA, 19 nt, Homo sapiens
uaaagaaucgccuggacua

SEQ ID NO: 43821 - RNA, 19 nt, Homo sapiens
uaccaccucuuccugaaua

SEQ ID NO: 43822 - RNA, 19 nt, Homo sapiens
gcuauggcuuuggaaguua

SEQ ID NO: 43823 - RNA, 19 nt, Homo sapiens
gaucacuucugaauaagca

SEQ ID NO: 43824 - RNA, 19 nt, Homo sapiens
ggugucuacugaaguuaua

SEQ ID NO: 43825 - RNA, 19 nt, Homo sapiens
uaagcaguuugccuuuaua

SEQ ID NO: 43826 - RNA, 19 nt, Homo sapiens
gaauaagcaguuugccuuu

SEQ ID NO: 43827 - RNA, 19 nt, Homo sapiens
gcacagccaguuauguaaa

SEQ ID NO: 43828 - RNA, 19 nt, Homo sapiens
uaacauugcuauggcuuug

SEQ ID NO: 43829 - RNA, 19 nt, Homo sapiens
aauaagcaguuugccuuua

SEQ ID NO: 43830 - RNA, 19 nt, Homo sapiens
gcucaagcacagccaguua

SEQ ID NO: 43831 - RNA, 19 nt, Homo sapiens
ucacagggacgcuaagauu

SEQ ID NO: 43832 - RNA, 19 nt, Homo sapiens
ugagacagcuagaaacagu

SEQ ID NO: 43833 - RNA, 19 nt, Homo sapiens
gggaacgacuguauagagu

SEQ ID NO: 43834 - RNA, 19 nt, Homo sapiens
cagaagcgccauuaccuuu

SEQ ID NO: 43835 - RNA, 19 nt, Homo sapiens
gaaaggaacaagaacacau

SEQ ID NO: 43836 - RNA, 19 nt, Homo sapiens
caacacauccagaaugcaa

SEQ ID NO: 43837 - RNA, 19 nt, Homo sapiens
caauugagacagcuagaaa

SEQ ID NO: 43838 - RNA, 19 nt, Homo sapiens
agaaucgccuggacuauca

SEQ ID NO: 43839 - RNA, 19 nt, Homo sapiens
ggaacgacuguauagagua

SEQ ID NO: 43840 - RNA, 19 nt, Homo sapiens
uugcagacuuugcugauaa

SEQ ID NO: 43841 - RNA, 19 nt, Homo sapiens
gaaugcagccuuccuaggu

SEQ ID NO: 43842 - RNA, 19 nt, Homo sapiens
ucuaccaucuugcaauaaa

SEQ ID NO: 43843 - RNA, 19 nt, Homo sapiens
caugaugcgucgaaaggaa

SEQ ID NO: 43844 - RNA, 19 nt, Homo sapiens
cuuguacgcuuuauccaaa

SEQ ID NO: 43845 - RNA, 19 nt, Homo sapiens
ggacugaucccugaggaau

SEQ ID NO: 43846 - RNA, 19 nt, Homo sapiens
aagcacagccaguuaugua

SEQ ID NO: 43847 - RNA, 19 nt, Homo sapiens
gcaguuugccuuuauaaaa

SEQ ID NO: 43848 - RNA, 19 nt, Homo sapiens
guuggugucuacugaaguu

SEQ ID NO: 43849 - RNA, 19 nt, Homo sapiens
gugcaaaggaauaacauug

SEQ ID NO: 43850 - RNA, 19 nt, Homo sapiens
gcucugccuuugaguuguu

SEQ ID NO: 43851 - RNA, 19 nt, Homo sapiens
ccaguuauguaaauguauc

SEQ ID NO: 43852 - RNA, 19 nt, Homo sapiens
agacuuugcugauaaacuc

SEQ ID NO: 43853 - RNA, 19 nt, Homo sapiens
gaauucuuccaguuucuuu

SEQ ID NO: 43854 - RNA, 19 nt, Homo sapiens
guaucuaucccaauugaga

SEQ ID NO: 43855 - RNA, 19 nt, Homo sapiens
gaacaugaugcgucgaaag

SEQ ID NO: 43856 - RNA, 19 nt, Homo sapiens
cgccuggacuaucauauau

SEQ ID NO: 43857 - RNA, 19 nt, Homo sapiens
guugcagacuuugcugaua

SEQ ID NO: 43858 - RNA, 19 nt, Homo sapiens
ggaacugggcuuaucuugu

SEQ ID NO: 43859 - RNA, 19 nt, Homo sapiens
auucuaccaucuugcaaua

SEQ ID NO: 43860 - RNA, 19 nt, Homo sapiens
caaaggaauaacauugcua

SEQ ID NO: 43861 - RNA, 19 nt, Homo sapiens
ggaaacuagucuauuugac

SEQ ID NO: 43862 - RNA, 19 nt, Homo sapiens
cugccugacuaaagauuaa

SEQ ID NO: 43863 - RNA, 19 nt, Homo sapiens
guuccgugaucacuucuga

SEQ ID NO: 43864 - RNA, 19 nt, Homo sapiens
guccugcccugacagauuc

SEQ ID NO: 43865 - RNA, 19 nt, Homo sapiens
caacaggcacugguucaga

SEQ ID NO: 43866 - RNA, 19 nt, Homo sapiens
uccaguuucuuuauccuaa

SEQ ID NO: 43867 - RNA, 19 nt, Homo sapiens
ccagucagauguuucucau

SEQ ID NO: 43868 - RNA, 19 nt, Homo sapiens
accuaaagcugcuggcaaa

SEQ ID NO: 43869 - RNA, 19 nt, Homo sapiens
aacaggcacugguucagaa

SEQ ID NO: 43870 - RNA, 19 nt, Homo sapiens
aaauauggucccuuuguug

SEQ ID NO: 43871 - RNA, 19 nt, Homo sapiens
uguaauggucuauggaauu

SEQ ID NO: 43872 - RNA, 19 nt, Homo sapiens
gguccugcccugacagauu

SEQ ID NO: 43873 - RNA, 19 nt, Homo sapiens
guuguuccgugaucacuuc

SEQ ID NO: 43874 - RNA, 19 nt, Homo sapiens
cacagccaguuauguaaau

SEQ ID NO: 43875 - RNA, 19 nt, Homo sapiens
caagugcauugcggaccua

SEQ ID NO: 43876 - RNA, 19 nt, Homo sapiens
uaacaggacccuauguacu

SEQ ID NO: 43877 - RNA, 19 nt, Homo sapiens
ccugacagauucuccuauc

SEQ ID NO: 43878 - RNA, 19 nt, Homo sapiens
caauugauacggagaaguc

SEQ ID NO: 43879 - RNA, 19 nt, Homo sapiens
uguaacaggacccuaugua

SEQ ID NO: 43880 - RNA, 19 nt, Homo sapiens
aaaguucguuauggacuga

SEQ ID NO: 43881 - RNA, 19 nt, Homo sapiens
aaacuugcugccugacuaa

SEQ ID NO: 43882 - RNA, 19 nt, Homo sapiens
gguguaauggucuauggaa

SEQ ID NO: 43883 - RNA, 19 nt, Homo sapiens
guacucggaacugggcuua

SEQ ID NO: 43884 - RNA, 19 nt, Homo sapiens
aaaggaacaagaacacaug

SEQ ID NO: 43885 - RNA, 19 nt, Homo sapiens
cauccagaaugcaauugau

SEQ ID NO: 43886 - RNA, 19 nt, Homo sapiens
gcugccugacuaaagauua

SEQ ID NO: 43887 - RNA, 19 nt, Homo sapiens
cuaaauggaaacuagucua

SEQ ID NO: 43888 - RNA, 19 nt, Homo sapiens
cugacuaaauggaaacuag

SEQ ID NO: 43889 - RNA, 19 nt, Homo sapiens
agccaguuauguaaaugua

SEQ ID NO: 43890 - RNA, 19 nt, Homo sapiens
ccuggacuaucauauaucu

SEQ ID NO: 43891 - RNA, 19 nt, Homo sapiens
ucgccuggacuaucauaua

SEQ ID NO: 43892 - RNA, 19 nt, Homo sapiens
gcuuaucuuguacgcuuua

SEQ ID NO: 43893 - RNA, 19 nt, Homo sapiens
guaacaggacccuauguac

SEQ ID NO: 43894 - RNA, 19 nt, Homo sapiens
auaaggaaguaaagaaucg

SEQ ID NO: 43895 - RNA, 19 nt, Homo sapiens
gaugugcaaaggaauaaca

SEQ ID NO: 43896 - RNA, 19 nt, Homo sapiens
uggaaacuagucuauuuga

SEQ ID NO: 43897 - RNA, 19 nt, Homo sapiens
acugaucccugaggaauuc

SEQ ID NO: 43898 - RNA, 19 nt, Homo sapiens
cuugcugccugacuaaaga

SEQ ID NO: 43899 - RNA, 19 nt, Homo sapiens
cuaaagcugcuggcaaaga

SEQ ID NO: 43900 - RNA, 19 nt, Homo sapiens
gacaauugccaagugcauu

SEQ ID NO: 43901 - RNA, 19 nt, Homo sapiens
cagaacaugaugcgucgaa

SEQ ID NO: 43902 - RNA, 19 nt, Homo sapiens
gaggaaaaguucguuaugg

SEQ ID NO: 43903 - RNA, 19 nt, Homo sapiens
cuaccuggacuuucguuga

SEQ ID NO: 43904 - RNA, 19 nt, Homo sapiens
aaaacuugcugccugacua

SEQ ID NO: 43905 - RNA, 19 nt, Homo sapiens
uguaccaccucuuccugaa

SEQ ID NO: 43906 - RNA, 19 nt, Homo sapiens
ugcuauggcuuuggaaguu

SEQ ID NO: 43907 - RNA, 19 nt, Homo sapiens
acacauccagaaugcaauu

SEQ ID NO: 43908 - RNA, 19 nt, Homo sapiens
aaacuugcccaacuagaag

SEQ ID NO: 43909 - RNA, 19 nt, Homo sapiens
aaaauauggucccuuuguu

SEQ ID NO: 43910 - RNA, 19 nt, Homo sapiens
guguuaagcuuuaccauua

SEQ ID NO: 43911 - RNA, 19 nt, Homo sapiens
ugacacagcagccaaguuu

SEQ ID NO: 43912 - RNA, 19 nt, Homo sapiens
gcucugauccgcuguugua

SEQ ID NO: 43913 - RNA, 19 nt, Homo sapiens
cagcagcucuucuccuaug

SEQ ID NO: 43914 - RNA, 19 nt, Homo sapiens
caucuaaacagccuuccua

SEQ ID NO: 43915 - RNA, 19 nt, Homo sapiens
gcucuucuccuaugccauu

SEQ ID NO: 43916 - RNA, 19 nt, Homo sapiens
caacuccacaccauucuug

SEQ ID NO: 43917 - RNA, 19 nt, Homo sapiens
ccagugaauucaucuaaac

SEQ ID NO: 43918 - RNA, 19 nt, Homo sapiens
uuuggcagcuugaucauug

SEQ ID NO: 43919 - RNA, 19 nt, Homo sapiens
ccauggggcuuuucuguuu

SEQ ID NO: 43920 - RNA, 19 nt, Homo sapiens
ggucuaaucaggccugugu

SEQ ID NO: 43921 - RNA, 19 nt, Homo sapiens
acacagcagccaaguuuau

SEQ ID NO: 43922 - RNA, 19 nt, Homo sapiens
cuaaacagccuuccuacag

SEQ ID NO: 43923 - RNA, 19 nt, Homo sapiens
gcccagugaauucaucuaa

SEQ ID NO: 43924 - RNA, 19 nt, Homo sapiens
uugaauagcccagugaauu

SEQ ID NO: 43925 - RNA, 19 nt, Homo sapiens
agcagcagcucuucuccua

SEQ ID NO: 43926 - RNA, 19 nt, Homo sapiens
gccaggaacccgucucuca

SEQ ID NO: 43927 - RNA, 19 nt, Homo sapiens
cccagugaauucaucuaaa

SEQ ID NO: 43928 - RNA, 19 nt, Homo sapiens
gaaccguguuuggcagcuu

SEQ ID NO: 43929 - RNA, 19 nt, Homo sapiens
aacacaacguuucucuaaa

SEQ ID NO: 43930 - RNA, 19 nt, Homo sapiens
ccaggaacccgucucucaa

SEQ ID NO: 43931 - RNA, 19 nt, Homo sapiens
gacacagcagccaaguuua

SEQ ID NO: 43932 - RNA, 19 nt, Homo sapiens
guaggagugcagacugaaa

SEQ ID NO: 43933 - RNA, 19 nt, Homo sapiens
gcaacuccacaccauucuu

SEQ ID NO: 43934 - RNA, 19 nt, Homo sapiens
uguguuaagcuuuaccauu

SEQ ID NO: 43935 - RNA, 19 nt, Homo sapiens
gugucugccuccuucuuga

SEQ ID NO: 43936 - RNA, 19 nt, Homo sapiens
ggucaccggccuguugcua

SEQ ID NO: 43937 - RNA, 19 nt, Homo sapiens
ucugccuccuucuugaaua

SEQ ID NO: 43938 - RNA, 19 nt, Homo sapiens
gcauuggaaccguguuugg

SEQ ID NO: 43939 - RNA, 19 nt, Homo sapiens
cacagcagccaaguuuauu

SEQ ID NO: 43940 - RNA, 19 nt, Homo sapiens
gugcuaaacucaacaugga

SEQ ID NO: 43941 - RNA, 19 nt, Homo sapiens
gcucaggguuugacagaga

SEQ ID NO: 43942 - RNA, 19 nt, Homo sapiens
gaccggagauacugacaga

SEQ ID NO: 43943 - RNA, 19 nt, Homo sapiens
cgacacagcagccaaguuc

SEQ ID NO: 43944 - RNA, 19 nt, Homo sapiens
ggagccucaucauugguua

SEQ ID NO: 43945 - RNA, 19 nt, Homo sapiens
agcaacagcucuucuccua

SEQ ID NO: 43946 - RNA, 19 nt, Homo sapiens
gccaggaacccuucucuga

SEQ ID NO: 43947 - RNA, 19 nt, Homo sapiens
cggagauacugacagauga

SEQ ID NO: 43948 - RNA, 19 nt, Homo sapiens
gcucuucuccuacgccauu

SEQ ID NO: 43949 - RNA, 19 nt, Homo sapiens
ccaggaacccuucucugaa

SEQ ID NO: 43950 - RNA, 19 nt, Homo sapiens
gcuaaacucaacauggauu

SEQ ID NO: 43951 - RNA, 19 nt, Homo sapiens
ggguagugauggugcuaaa

SEQ ID NO: 43952 - RNA, 19 nt, Homo sapiens
caaaccagcgccauuucaa

SEQ ID NO: 43953 - RNA, 19 nt, Homo sapiens
gggcugggauuggaacugu

SEQ ID NO: 43954 - RNA, 19 nt, Homo sapiens
uuaccucacuugucucuag

SEQ ID NO: 43955 - RNA, 19 nt, Homo sapiens
gaaacgaccggagauacug

SEQ ID NO: 43956 - RNA, 19 nt, Homo sapiens
gcugagugccuucgugaga

SEQ ID NO: 43957 - RNA, 19 nt, Homo sapiens
cauccucuuugccauguga

SEQ ID NO: 43958 - RNA, 19 nt, Homo sapiens
gcugaaacgaccggagaua

SEQ ID NO: 43959 - RNA, 19 nt, Homo sapiens
gugguuggcucaggguuug

SEQ ID NO: 43960 - RNA, 19 nt, Homo sapiens
uaucugcaguggugcugaa

SEQ ID NO: 43961 - RNA, 19 nt, Homo sapiens
cagcuuggcagucucaugu

SEQ ID NO: 43962 - RNA, 19 nt, Homo sapiens
ucuugagucuccuguguau

SEQ ID NO: 43963 - RNA, 19 nt, Homo sapiens
uuugggagccucaucauug

SEQ ID NO: 43964 - RNA, 19 nt, Homo sapiens
ccaaaccagcgccauuuca

SEQ ID NO: 43965 - RNA, 19 nt, Homo sapiens
ugagucuccuguguauauu

SEQ ID NO: 43966 - RNA, 19 nt, Homo sapiens
uugagucuccuguguauau

SEQ ID NO: 43967 - RNA, 19 nt, Homo sapiens
cugcugagccguccgcuau

SEQ ID NO: 43968 - RNA, 19 nt, Homo sapiens
gcagucucauguccccuua

SEQ ID NO: 43969 - RNA, 19 nt, Homo sapiens
ccggagauacugacagaug

SEQ ID NO: 43970 - RNA, 19 nt, Homo sapiens
cuaaacucaacauggauuu

SEQ ID NO: 43971 - RNA, 19 nt, Homo sapiens
guagugauggugcuaaacu

SEQ ID NO: 43972 - RNA, 19 nt, Homo sapiens
ggauuggaacuguguuugg

SEQ ID NO: 43973 - RNA, 19 nt, Homo sapiens
gcugagccguccgcuaucu

SEQ ID NO: 43974 - RNA, 19 nt, Homo sapiens
gggagccucaucauugguu

SEQ ID NO: 43975 - RNA, 19 nt, Homo sapiens
guucgccugcuccaaguuu

SEQ ID NO: 43976 - RNA, 19 nt, Homo sapiens
gagauacugacagaugaga

SEQ ID NO: 43977 - RNA, 19 nt, Homo sapiens
gagucuccuguguauauuu

SEQ ID NO: 43978 - RNA, 19 nt, Homo sapiens
aaacgaccggagauacuga

SEQ ID NO: 43979 - RNA, 19 nt, Homo sapiens
agucuccuguguauauuuc

SEQ ID NO: 43980 - RNA, 19 nt, Homo sapiens
uuucuugagucuccugugu

SEQ ID NO: 43981 - RNA, 19 nt, Homo sapiens
gggauuggaacuguguuug

SEQ ID NO: 43982 - RNA, 19 nt, Homo sapiens
ggagggcacuugaccuuaa

SEQ ID NO: 43983 - RNA, 19 nt, Homo sapiens
gaauguacguuauuuccaa

SEQ ID NO: 43984 - RNA, 19 nt, Homo sapiens
gaugguugcuuucuugauu

SEQ ID NO: 43985 - RNA, 19 nt, Homo sapiens
cauguuggcauucauauua

SEQ ID NO: 43986 - RNA, 19 nt, Homo sapiens
ugauacugcugccaaauuu

SEQ ID NO: 43987 - RNA, 19 nt, Homo sapiens
ggauuugccuugucugaag

SEQ ID NO: 43988 - RNA, 19 nt, Homo sapiens
cagcuguucucauaugcua

SEQ ID NO: 43989 - RNA, 19 nt, Homo sapiens
gcagccuuaucauugguua

SEQ ID NO: 43990 - RNA, 19 nt, Homo sapiens
gcucuacgguauuuaaugg

SEQ ID NO: 43991 - RNA, 19 nt, Homo sapiens
ccagaaacccuucgcugaa

SEQ ID NO: 43992 - RNA, 19 nt, Homo sapiens
ugacauguuggcauucaua

SEQ ID NO: 43993 - RNA, 19 nt, Homo sapiens
caaauuacugcuugacaug

SEQ ID NO: 43994 - RNA, 19 nt, Homo sapiens
gauacugcugccaaauuua

SEQ ID NO: 43995 - RNA, 19 nt, Homo sapiens
acaaauuacugcuugacau

SEQ ID NO: 43996 - RNA, 19 nt, Homo sapiens
guagggacccauucauugu

SEQ ID NO: 43997 - RNA, 19 nt, Homo sapiens
cgucgccugucacccaaua

SEQ ID NO: 43998 - RNA, 19 nt, Homo sapiens
guacguuauuuccaaaguc

SEQ ID NO: 43999 - RNA, 19 nt, Homo sapiens
gauguaauucuguguaucu

SEQ ID NO: 44000 - RNA, 19 nt, Homo sapiens
aauggugugucucagcuaa

SEQ ID NO: 44001 - RNA, 19 nt, Homo sapiens
guauuggugucaugggaau

SEQ ID NO: 44002 - RNA, 19 nt, Homo sapiens
cggauguaauucuguguau

SEQ ID NO: 44003 - RNA, 19 nt, Homo sapiens
cgaagaguguaagauguuc

SEQ ID NO: 44004 - RNA, 19 nt, Homo sapiens
gucaugggaauguacguua

SEQ ID NO: 44005 - RNA, 19 nt, Homo sapiens
ugucucagcuaauccaaag

SEQ ID NO: 44006 - RNA, 19 nt, Homo sapiens
gauccagaguugcauacag

SEQ ID NO: 44007 - RNA, 19 nt, Homo sapiens
ucaugggaauguacguuau

SEQ ID NO: 44008 - RNA, 19 nt, Homo sapiens
uuugaugguugcuuucuug

SEQ ID NO: 44009 - RNA, 19 nt, Homo sapiens
ggauguaauucuguguauc

SEQ ID NO: 44010 - RNA, 19 nt, Homo sapiens
caguagggacccauucauu

SEQ ID NO: 44011 - RNA, 19 nt, Homo sapiens
ccagugcaaucagcagaga

SEQ ID NO: 44012 - RNA, 19 nt, Homo sapiens
uccgaaaacuguaguauug

SEQ ID NO: 44013 - RNA, 19 nt, Homo sapiens
cauugauacugcugccaaa

SEQ ID NO: 44014 - RNA, 19 nt, Homo sapiens
ccgaagaguguaagauguu

SEQ ID NO: 44015 - RNA, 19 nt, Homo sapiens
uacguuauuuccaaaguca

SEQ ID NO: 44016 - RNA, 19 nt, Homo sapiens
gagggcacuugaccuuaag

SEQ ID NO: 44017 - RNA, 19 nt, Homo sapiens
aauuacugcuugacauguu

SEQ ID NO: 44018 - RNA, 19 nt, Homo sapiens
gcgcagucccgaagagugu

SEQ ID NO: 44019 - RNA, 19 nt, Homo sapiens
gauuuuguuugccauguaa

SEQ ID NO: 44020 - RNA, 19 nt, Homo sapiens
cuaugggucucuuuuguuu

SEQ ID NO: 44021 - RNA, 19 nt, Homo sapiens
cagcagagacauugauacu

SEQ ID NO: 44022 - RNA, 19 nt, Homo sapiens
gcagucccgaagaguguaa

SEQ ID NO: 44023 - RNA, 19 nt, Homo sapiens
gaauggugugucucagcua

SEQ ID NO: 44024 - RNA, 19 nt, Homo sapiens
auccagaguugcauacaga

SEQ ID NO: 44025 - RNA, 19 nt, Homo sapiens
uuuguuugaugguugcuuu

SEQ ID NO: 44026 - RNA, 19 nt, Homo sapiens
ugccuugucugaagcuaug

SEQ ID NO: 44027 - RNA, 19 nt, Homo sapiens
cccgaagaguguaagaugu

SEQ ID NO: 44028 - RNA, 19 nt, Homo sapiens
gcuaauccaaagggaguuu

SEQ ID NO: 44029 - RNA, 19 nt, Homo sapiens
aguagggacccauucauug

SEQ ID NO: 44030 - RNA, 19 nt, Homo sapiens
auacugcugccaaauuuau

SEQ ID NO: 44031 - RNA, 19 nt, Homo sapiens
caugggaauguacguuauu

SEQ ID NO: 44032 - RNA, 19 nt, Homo sapiens
gaagcuaugggucucuuuu

SEQ ID NO: 44033 - RNA, 19 nt, Homo sapiens
uuuggcagccuuaucauug

SEQ ID NO: 44034 - RNA, 19 nt, Homo sapiens
gguauuggaacagucuuug

SEQ ID NO: 44035 - RNA, 19 nt, Homo sapiens
agaguugcauacagaccaa

SEQ ID NO: 44036 - RNA, 19 nt, Homo sapiens
gggauuugccuugucugaa

SEQ ID NO: 44037 - RNA, 19 nt, Homo sapiens
gacauguuggcauucauau

SEQ ID NO: 44038 - RNA, 19 nt, Homo sapiens
augggaauguacguuauuu

SEQ ID NO: 44039 - RNA, 19 nt, Homo sapiens
guugcauacagaccaauuu

SEQ ID NO: 44040 - RNA, 19 nt, Homo sapiens
gagccugggugggaagaac

SEQ ID NO: 44041 - RNA, 19 nt, Homo sapiens
gaauaaagcuuccuguguu

SEQ ID NO: 44042 - RNA, 19 nt, Homo sapiens
gaagaugacagcauauuaa

SEQ ID NO: 44043 - RNA, 19 nt, Homo sapiens
gaagcaggaugaacugaaa

SEQ ID NO: 44044 - RNA, 19 nt, Homo sapiens
ggcagaagaugacagcaua

SEQ ID NO: 44045 - RNA, 19 nt, Homo sapiens
gagccacgcgcuacaauua

SEQ ID NO: 44046 - RNA, 19 nt, Homo sapiens
gaaacggauugccagagaa

SEQ ID NO: 44047 - RNA, 19 nt, Homo sapiens
gaugacagcauauuaaagu

SEQ ID NO: 44048 - RNA, 19 nt, Homo sapiens
ccagagaauuggcagaaga

SEQ ID NO: 44049 - RNA, 19 nt, Homo sapiens
ugaaacggauugccagaga

SEQ ID NO: 44050 - RNA, 19 nt, Homo sapiens
gaccagcagcggaugaaua

SEQ ID NO: 44051 - RNA, 19 nt, Homo sapiens
agaagaugacagcauauua

SEQ ID NO: 44052 - RNA, 19 nt, Homo sapiens
gaggauagcagcagaagag

SEQ ID NO: 44053 - RNA, 19 nt, Homo sapiens
gugcggaggucauggacaa

SEQ ID NO: 44054 - RNA, 19 nt, Homo sapiens
gagaauuggcagaagauga

SEQ ID NO: 44055 - RNA, 19 nt, Homo sapiens
cagcagaagagaagaagaa

SEQ ID NO: 44056 - RNA, 19 nt, Homo sapiens
aauaaagcuuccuguguug

SEQ ID NO: 44057 - RNA, 19 nt, Homo sapiens
gaagaagcaggaugaacug

SEQ ID NO: 44058 - RNA, 19 nt, Homo sapiens
agaagaagaagcaggauga

SEQ ID NO: 44059 - RNA, 19 nt, Homo sapiens
gaagaggagaggaggauag

SEQ ID NO: 44060 - RNA, 19 nt, Homo sapiens
gcaggucucuccgcucauc

SEQ ID NO: 44061 - RNA, 19 nt, Homo sapiens
ugaauaaagcuuccugugu

SEQ ID NO: 44062 - RNA, 19 nt, Homo sapiens
gauagcagcagaagagaag

SEQ ID NO: 44063 - RNA, 19 nt, Homo sapiens
gcgcuacaauuaccuaaaa

SEQ ID NO: 44064 - RNA, 19 nt, Homo sapiens
gaagaagaagcaggaugaa

SEQ ID NO: 44065 - RNA, 19 nt, Homo sapiens
cagaagagaagaagaagca

SEQ ID NO: 44066 - RNA, 19 nt, Homo sapiens
ugacagcauauuaaaguga

SEQ ID NO: 44067 - RNA, 19 nt, Homo sapiens
ggagccacgcgcuacaauu

SEQ ID NO: 44068 - RNA, 19 nt, Homo sapiens
cagaagaugacagcauauu

SEQ ID NO: 44069 - RNA, 19 nt, Homo sapiens
gaugaacugaaacggauug

SEQ ID NO: 44070 - RNA, 19 nt, Homo sapiens
ggauagcagcagaagagaa

SEQ ID NO: 44071 - RNA, 19 nt, Homo sapiens
cagcagcggaugaauaaag

SEQ ID NO: 44072 - RNA, 19 nt, Homo sapiens
gcagaagaugacagcauau

SEQ ID NO: 44073 - RNA, 19 nt, Homo sapiens
agaagaagcaggaugaacu

SEQ ID NO: 44074 - RNA, 19 nt, Homo sapiens
accagcagcggaugaauaa

SEQ ID NO: 44075 - RNA, 19 nt, Homo sapiens
aaacggauugccagagaau

SEQ ID NO: 44076 - RNA, 19 nt, Homo sapiens
uaaagcuuccuguguugug

SEQ ID NO: 44077 - RNA, 19 nt, Homo sapiens
gaggaggauagcagcagaa

SEQ ID NO: 44078 - RNA, 19 nt, Homo sapiens
agaagcaggaugaacugaa

SEQ ID NO: 44079 - RNA, 19 nt, Homo sapiens
ccuaaaaccucgggcagaa

SEQ ID NO: 44080 - RNA, 19 nt, Homo sapiens
ggaugaacugaaacggauu

SEQ ID NO: 44081 - RNA, 19 nt, Homo sapiens
ggaggauagcagcagaaga

SEQ ID NO: 44082 - RNA, 19 nt, Homo sapiens
uuacagcaguggcauuuaa

SEQ ID NO: 44083 - RNA, 19 nt, Homo sapiens
ggacaagauuagagaauac

SEQ ID NO: 44084 - RNA, 19 nt, Homo sapiens
gaacuugauccuauacaga

SEQ ID NO: 44085 - RNA, 19 nt, Homo sapiens
gcaguggcauuuaauaagg

SEQ ID NO: 44086 - RNA, 19 nt, Homo sapiens
gggaaaggccacucaaaga

SEQ ID NO: 44087 - RNA, 19 nt, Homo sapiens
uggacaagauuagagaaua

SEQ ID NO: 44088 - RNA, 19 nt, Homo sapiens
ggaaaggccacucaaagag

SEQ ID NO: 44089 - RNA, 19 nt, Homo sapiens
ucauaacugucaaauguuc

SEQ ID NO: 44090 - RNA, 19 nt, Homo sapiens
gaagaucccaaauuugaag

SEQ ID NO: 44091 - RNA, 19 nt, Homo sapiens
cagcaguggcauuuaauaa

SEQ ID NO: 44092 - RNA, 19 nt, Homo sapiens
augcagacaugaauacauu

SEQ ID NO: 44093 - RNA, 19 nt, Homo sapiens
gguaaugcagacaugaaua

SEQ ID NO: 44094 - RNA, 19 nt, Homo sapiens
uugaagaucccaaauuuga

SEQ ID NO: 44095 - RNA, 19 nt, Homo sapiens
cacuuucccugcaccuuua

SEQ ID NO: 44096 - RNA, 19 nt, Homo sapiens
ggaacuugauccuauacag

SEQ ID NO: 44097 - RNA, 19 nt, Homo sapiens
ggucaaauuaggcgaagaa

SEQ ID NO: 44098 - RNA, 19 nt, Homo sapiens
caaauuugaagucaucgaa

SEQ ID NO: 44099 - RNA, 19 nt, Homo sapiens
aaaagaacgggucaaauua

SEQ ID NO: 44100 - RNA, 19 nt, Homo sapiens
gaucccaaauuugaaguca

SEQ ID NO: 44101 - RNA, 19 nt, Homo sapiens
guacagagcaagguuucaa

SEQ ID NO: 44102 - RNA, 19 nt, Homo sapiens
aacggaggcucacgaggua

SEQ ID NO: 44103 - RNA, 19 nt, Homo sapiens
ugaauacauuucccaccuu

SEQ ID NO: 44104 - RNA, 19 nt, Homo sapiens
gcgcaugcguacagagcaa

SEQ ID NO: 44105 - RNA, 19 nt, Homo sapiens
cuaguuagaaguuucagaa

SEQ ID NO: 44106 - RNA, 19 nt, Homo sapiens
ggccugaagaaauaaagua

SEQ ID NO: 44107 - RNA, 19 nt, Homo sapiens
gcagacaugaauacauuuc

SEQ ID NO: 44108 - RNA, 19 nt, Homo sapiens
ccacuuccuccuccuguuu

SEQ ID NO: 44109 - RNA, 19 nt, Homo sapiens
ccccaggccugaagaaaua

SEQ ID NO: 44110 - RNA, 19 nt, Homo sapiens
guucagaguaucagcaaga

SEQ ID NO: 44111 - RNA, 19 nt, Homo sapiens
cagguucuccucugucauu

SEQ ID NO: 44112 - RNA, 19 nt, Homo sapiens
caaauuaggcgaagaaaag

SEQ ID NO: 44113 - RNA, 19 nt, Homo sapiens
ucacuuucccugcaccuuu

SEQ ID NO: 44114 - RNA, 19 nt, Homo sapiens
gcagcucccgcgacuagaa

SEQ ID NO: 44115 - RNA, 19 nt, Homo sapiens
aaagaacgggucaaauuag

SEQ ID NO: 44116 - RNA, 19 nt, Homo sapiens
guaaugcagacaugaauac

SEQ ID NO: 44117 - RNA, 19 nt, Homo sapiens
uaagcucaagcaaauguuu

SEQ ID NO: 44118 - RNA, 19 nt, Homo sapiens
uuucccaccuucaaauuug

SEQ ID NO: 44119 - RNA, 19 nt, Homo sapiens
cgauaacccuaacgaacag

SEQ ID NO: 44120 - RNA, 19 nt, Homo sapiens
cagaauaaacaugcauuuc

SEQ ID NO: 44121 - RNA, 19 nt, Homo sapiens
gccugaagaaauaaaguaa

SEQ ID NO: 44122 - RNA, 19 nt, Homo sapiens
ucccaaauuugaagucauc

SEQ ID NO: 44123 - RNA, 19 nt, Homo sapiens
gcaccuuuauacacuucga

SEQ ID NO: 44124 - RNA, 19 nt, Homo sapiens
ucacggauuaguuguacaa

SEQ ID NO: 44125 - RNA, 19 nt, Homo sapiens
ugaagaucccaaauuugaa

SEQ ID NO: 44126 - RNA, 19 nt, Homo sapiens
gaugcuaguucagaguauc

SEQ ID NO: 44127 - RNA, 19 nt, Homo sapiens
cuguuuggcuucugucuca

SEQ ID NO: 44128 - RNA, 19 nt, Homo sapiens
cuccagagccggcugagaa

SEQ ID NO: 44129 - RNA, 19 nt, Homo sapiens
ucgauaacccuaacgaaca

SEQ ID NO: 44130 - RNA, 19 nt, Homo sapiens
acagcaguggcauuuaaua

SEQ ID NO: 44131 - RNA, 19 nt, Homo sapiens
gauccuauacagaaacucu

SEQ ID NO: 44132 - RNA, 19 nt, Homo sapiens
caguggcauuuaauaagga

SEQ ID NO: 44133 - RNA, 19 nt, Homo sapiens
aagaacgggucaaauuagg

SEQ ID NO: 44134 - RNA, 19 nt, Homo sapiens
uggaggaccuguugaugcu

SEQ ID NO: 44135 - RNA, 19 nt, Homo sapiens
aaagagcgcaugcguacag

SEQ ID NO: 44136 - RNA, 19 nt, Homo sapiens
gcauuucauaacugucaaa

SEQ ID NO: 44137 - RNA, 19 nt, Homo sapiens
acaugcauuucauaacugu

SEQ ID NO: 44138 - RNA, 19 nt, Homo sapiens
gcucacgagguacaaggaa

SEQ ID NO: 44139 - RNA, 19 nt, Homo sapiens
aaucuaagcgacagacauc

SEQ ID NO: 44140 - RNA, 19 nt, Homo sapiens
acacuucgauaacccuaac

SEQ ID NO: 44141 - RNA, 19 nt, Homo sapiens
gagguacaaggaagcacaa

SEQ ID NO: 44142 - RNA, 19 nt, Homo sapiens
cagagcaagguuucaagga

SEQ ID NO: 44143 - RNA, 19 nt, Homo sapiens
gagcaacauugucuuauua

SEQ ID NO: 44144 - RNA, 19 nt, Homo sapiens
ggaaagguauucuucuaua

SEQ ID NO: 44145 - RNA, 19 nt, Homo sapiens
gagcaacaguuucccauua

SEQ ID NO: 44146 - RNA, 19 nt, Homo sapiens
gaacauggcuaacaaucuu

SEQ ID NO: 44147 - RNA, 19 nt, Homo sapiens
gaaaugagaugucugaagu

SEQ ID NO: 44148 - RNA, 19 nt, Homo sapiens
gcucagauauucaucguaa

SEQ ID NO: 44149 - RNA, 19 nt, Homo sapiens
gcaaugguuuguugagaua

SEQ ID NO: 44150 - RNA, 19 nt, Homo sapiens
gaaacuagcucaacguaag

SEQ ID NO: 44151 - RNA, 19 nt, Homo sapiens
agaaaucucuggucguuua

SEQ ID NO: 44152 - RNA, 19 nt, Homo sapiens
uuagaagccuugaagauua

SEQ ID NO: 44153 - RNA, 19 nt, Homo sapiens
gaagaggccauauauauug

SEQ ID NO: 44154 - RNA, 19 nt, Homo sapiens
gaacagguacuuugugaaa

SEQ ID NO: 44155 - RNA, 19 nt, Homo sapiens
gaggaaagguauucuucua

SEQ ID NO: 44156 - RNA, 19 nt, Homo sapiens
gagaagauguuuaguagca

SEQ ID NO: 44157 - RNA, 19 nt, Homo sapiens
ugacagaaauuaugcaaug

SEQ ID NO: 44158 - RNA, 19 nt, Homo sapiens
ucaauuggcucaucagcua

SEQ ID NO: 44159 - RNA, 19 nt, Homo sapiens
gaaucacacugucagagua

SEQ ID NO: 44160 - RNA, 19 nt, Homo sapiens
caauggagguugaugguaa

SEQ ID NO: 44161 - RNA, 19 nt, Homo sapiens
gacgaaagcuaaggaaauu

SEQ ID NO: 44162 - RNA, 19 nt, Homo sapiens
gaauagaagaggccauaua

SEQ ID NO: 44163 - RNA, 19 nt, Homo sapiens
gaagaggacagcuuuggua

SEQ ID NO: 44164 - RNA, 19 nt, Homo sapiens
gauaucaaaugggacuuua

SEQ ID NO: 44165 - RNA, 19 nt, Homo sapiens
gaaccuaugcucagauauu

SEQ ID NO: 44166 - RNA, 19 nt, Homo sapiens
gaaagaagcaaucaguaga

SEQ ID NO: 44167 - RNA, 19 nt, Homo sapiens
caucacacccuguuuauuu

SEQ ID NO: 44168 - RNA, 19 nt, Homo sapiens
ggagguugaugguaaggua

SEQ ID NO: 44169 - RNA, 19 nt, Homo sapiens
guaaacgugucugcucuua

SEQ ID NO: 44170 - RNA, 19 nt, Homo sapiens
gaaucugggucacaugaaa

SEQ ID NO: 44171 - RNA, 19 nt, Homo sapiens
caaagaugauuuccuacaa

SEQ ID NO: 44172 - RNA, 19 nt, Homo sapiens
gaaagcacauuugguuaug

SEQ ID NO: 44173 - RNA, 19 nt, Homo sapiens
gaaauuaugcaaugguuug

SEQ ID NO: 44174 - RNA, 19 nt, Homo sapiens
ccucaucucuauuaaauug

SEQ ID NO: 44175 - RNA, 19 nt, Homo sapiens
gcgaaccuaugcucagaua

SEQ ID NO: 44176 - RNA, 19 nt, Homo sapiens
cagagaagauguuuaguag

SEQ ID NO: 44177 - RNA, 19 nt, Homo sapiens
gagaaaccauugggaacua

SEQ ID NO: 44178 - RNA, 19 nt, Homo sapiens
uaucugaaguggugaauau

SEQ ID NO: 44179 - RNA, 19 nt, Homo sapiens
ggaauuaugauaccucuga

SEQ ID NO: 44180 - RNA, 19 nt, Homo sapiens
caaaguggccuacucaaga

SEQ ID NO: 44181 - RNA, 19 nt, Homo sapiens
ucaaauacccaaauuguga

SEQ ID NO: 44182 - RNA, 19 nt, Homo sapiens
ggaauugcuuugcaggaaa

SEQ ID NO: 44183 - RNA, 19 nt, Homo sapiens
uagaagaggccauauauau

SEQ ID NO: 44184 - RNA, 19 nt, Homo sapiens
ugaaugguaugaugaagaa

SEQ ID NO: 44185 - RNA, 19 nt, Homo sapiens
ggcuaacaaucuucaaaua

SEQ ID NO: 44186 - RNA, 19 nt, Homo sapiens
gaaagggugugugaacaug

SEQ ID NO: 44187 - RNA, 19 nt, Homo sapiens
gcagguaaacuaacauuau

SEQ ID NO: 44188 - RNA, 19 nt, Homo sapiens
gggccucccucuuccuuua

SEQ ID NO: 44189 - RNA, 19 nt, Homo sapiens
ggugaaaugucuuggaaau

SEQ ID NO: 44190 - RNA, 19 nt, Homo sapiens
cgaauugguuggagagauu

SEQ ID NO: 44191 - RNA, 19 nt, Homo sapiens
ccacaucacacccuguuua

SEQ ID NO: 44192 - RNA, 19 nt, Homo sapiens
caaggacuauuacauacuu

SEQ ID NO: 44193 - RNA, 19 nt, Homo sapiens
gacauccucuauaaacuuu

SEQ ID NO: 44194 - RNA, 19 nt, Homo sapiens
ugggagacauccucuauaa

SEQ ID NO: 44195 - RNA, 19 nt, Homo sapiens
gaagaagaccuggcagaaa

SEQ ID NO: 44196 - RNA, 19 nt, Homo sapiens
gacaaacacuucacagagu

SEQ ID NO: 44197 - RNA, 19 nt, Homo sapiens
aaagaaagcacauuugguu

SEQ ID NO: 44198 - RNA, 19 nt, Homo sapiens
gccaauaccuccaauaugc

SEQ ID NO: 44199 - RNA, 19 nt, Homo sapiens
ccagagaagauguuuagua

SEQ ID NO: 44200 - RNA, 19 nt, Homo sapiens
aagaagaccuggcagaaau

SEQ ID NO: 44201 - RNA, 19 nt, Homo sapiens
ggacgaaagcuaaggaaau

SEQ ID NO: 44202 - RNA, 19 nt, Homo sapiens
ggaaagaagcaaucaguag

SEQ ID NO: 44203 - RNA, 19 nt, Homo sapiens
aaacaggacuacugcaugu

SEQ ID NO: 44204 - RNA, 19 nt, Homo sapiens
ggaugaauacuaugacaaa

SEQ ID NO: 44205 - RNA, 19 nt, Homo sapiens
ugaaaugccugcagauagu

SEQ ID NO: 44206 - RNA, 19 nt, Homo sapiens
gguaagguagagucaauua

SEQ ID NO: 44207 - RNA, 19 nt, Homo sapiens
gcaaugaaugguaugauga

SEQ ID NO: 44208 - RNA, 19 nt, Homo sapiens
gaagauguuuaguagcaau

SEQ ID NO: 44209 - RNA, 19 nt, Homo sapiens
uaugauaccucugauguug

SEQ ID NO: 44210 - RNA, 19 nt, Homo sapiens
uagcagagauaucaaaugg

SEQ ID NO: 44211 - RNA, 19 nt, Homo sapiens
gcaguucuguauuuauugu

SEQ ID NO: 44212 - RNA, 19 nt, Homo sapiens
ucagcaagcuccuaugugu

SEQ ID NO: 44213 - RNA, 19 nt, Homo sapiens
gggaugcuguccaacauga

SEQ ID NO: 44214 - RNA, 19 nt, Homo sapiens
gaagggagugucagcauug

SEQ ID NO: 44215 - RNA, 19 nt, Homo sapiens
cagguaaacuaacauuaug

SEQ ID NO: 44216 - RNA, 19 nt, Homo sapiens
gccagggacuauacucuuu

SEQ ID NO: 44217 - RNA, 19 nt, Homo sapiens
gaaggccagguuucuauaa

SEQ ID NO: 44218 - RNA, 19 nt, Homo sapiens
gaugauuuccuacaacaaa

SEQ ID NO: 44219 - RNA, 19 nt, Homo sapiens
cacagucucuauccaagua

SEQ ID NO: 44220 - RNA, 19 nt, Homo sapiens
agaacucgcuuaucaaaca

SEQ ID NO: 44221 - RNA, 19 nt, Homo sapiens
ggagacauuuauggaauug

SEQ ID NO: 44222 - RNA, 19 nt, Homo sapiens
gaagcaaucaguagagaau

SEQ ID NO: 44223 - RNA, 19 nt, Homo sapiens
gauaaagaaagcacauuug

SEQ ID NO: 44224 - RNA, 19 nt, Homo sapiens
gaaguggugaauauaguaa

SEQ ID NO: 44225 - RNA, 19 nt, Homo sapiens
ucuuggagcuugaauuuga

SEQ ID NO: 44226 - RNA, 19 nt, Homo sapiens
gcggagacauuuauggaau

SEQ ID NO: 44227 - RNA, 19 nt, Homo sapiens
ccauauauauugccuccuu

SEQ ID NO: 44228 - RNA, 19 nt, Homo sapiens
gaagauuacaacugugauu

SEQ ID NO: 44229 - RNA, 19 nt, Homo sapiens
uauaaacuuuccuccauga

SEQ ID NO: 44230 - RNA, 19 nt, Homo sapiens
ggagacauccucuauaaac

SEQ ID NO: 44231 - RNA, 19 nt, Homo sapiens
gaauugcuuugcaggaaau

SEQ ID NO: 44232 - RNA, 19 nt, Homo sapiens
ggaaggccagguuucuaua

SEQ ID NO: 44233 - RNA, 19 nt, Homo sapiens
gaggaaaugagaugucuga

SEQ ID NO: 44234 - RNA, 19 nt, Homo sapiens
agugagaacucgcuuauca

SEQ ID NO: 44235 - RNA, 19 nt, Homo sapiens
caagugugaugggcaguaa

SEQ ID NO: 44236 - RNA, 19 nt, Homo sapiens
gugccuauguguguuauuu

SEQ ID NO: 44237 - RNA, 19 nt, Homo sapiens
cauauauauugccuccuua

SEQ ID NO: 44238 - RNA, 19 nt, Homo sapiens
gaaauaguacccucuaaaa

SEQ ID NO: 44239 - RNA, 19 nt, Homo sapiens
acacuacuguaaacuugua

SEQ ID NO: 44240 - RNA, 19 nt, Homo sapiens
guuauuuguuucccuguuu

SEQ ID NO: 44241 - RNA, 19 nt, Homo sapiens
gaaagauggugaggcaaag

SEQ ID NO: 44242 - RNA, 19 nt, Homo sapiens
ccaaguauucuaacaguga

SEQ ID NO: 44243 - RNA, 19 nt, Homo sapiens
gaagaccacuugcgaauuu

SEQ ID NO: 44244 - RNA, 19 nt, Homo sapiens
ccaaggcugugcuggauua

SEQ ID NO: 44245 - RNA, 19 nt, Homo sapiens
gcggaggacuuucuggaua

SEQ ID NO: 44246 - RNA, 19 nt, Homo sapiens
gggaaggcaugacaagaaa

SEQ ID NO: 44247 - RNA, 19 nt, Homo sapiens
caacuucgccaucgucuuu

SEQ ID NO: 44248 - RNA, 19 nt, Homo sapiens
gacgggagcaucuguauuu

SEQ ID NO: 44249 - RNA, 19 nt, Homo sapiens
ggacaugaguuccuaugca

SEQ ID NO: 44250 - RNA, 19 nt, Homo sapiens
guuaaaagcccacaaaaua

SEQ ID NO: 44251 - RNA, 19 nt, Homo sapiens
ggaggucucugcugcuaga

SEQ ID NO: 44252 - RNA, 19 nt, Homo sapiens
ggagacagccagauucuuc

SEQ ID NO: 44253 - RNA, 19 nt, Homo sapiens
gcugaccacugcugaauuc

SEQ ID NO: 44254 - RNA, 19 nt, Homo sapiens
gaaaggaccauggagaugu

SEQ ID NO: 44255 - RNA, 19 nt, Homo sapiens
ggucaaguuugcccaguau

SEQ ID NO: 44256 - RNA, 19 nt, Homo sapiens
gaggauccaucacacagau

SEQ ID NO: 44257 - RNA, 19 nt, Homo sapiens
gaccacugcugaauuccuu

SEQ ID NO: 44258 - RNA, 19 nt, Homo sapiens
gcaccaaggcgauuguuca

SEQ ID NO: 44259 - RNA, 19 nt, Homo sapiens
acacagaccuggccaccau

SEQ ID NO: 44260 - RNA, 19 nt, Homo sapiens
ugacggacaugaguuccua

SEQ ID NO: 44261 - RNA, 19 nt, Homo sapiens
gccgaggguuuccuggaua

SEQ ID NO: 44262 - RNA, 19 nt, Homo sapiens
uggaauuccugcagaaguu

SEQ ID NO: 44263 - RNA, 19 nt, Homo sapiens
ggucauggcggaggacuuu

SEQ ID NO: 44264 - RNA, 19 nt, Homo sapiens
acagacagcuucacaacag

SEQ ID NO: 44265 - RNA, 19 nt, Homo sapiens
ugcagaaguuugagaagaa

SEQ ID NO: 44266 - RNA, 19 nt, Homo sapiens
cuggauauauguacacaga

SEQ ID NO: 44267 - RNA, 19 nt, Homo sapiens
ggaagaccacuugcgaauu

SEQ ID NO: 44268 - RNA, 19 nt, Homo sapiens
gggucaaguuugcccagua

SEQ ID NO: 44269 - RNA, 19 nt, Homo sapiens
ggacagacagcuucacaac

SEQ ID NO: 44270 - RNA, 19 nt, Homo sapiens
ucacagagggacagaucua

SEQ ID NO: 44271 - RNA, 19 nt, Homo sapiens
cggaggacuuucuggauau

SEQ ID NO: 44272 - RNA, 19 nt, Homo sapiens
ggaagcugcugcgcaucuu

SEQ ID NO: 44273 - RNA, 19 nt, Homo sapiens
agacgggcauuucuccuau

SEQ ID NO: 44274 - RNA, 19 nt, Homo sapiens
gaccugcucuaccuggaau

SEQ ID NO: 44275 - RNA, 19 nt, Homo sapiens
ugacgggcuucaucacaga

SEQ ID NO: 44276 - RNA, 19 nt, Homo sapiens
ggaauuccugcagaaguuu

SEQ ID NO: 44277 - RNA, 19 nt, Homo sapiens
gacaagaaaggaccaugga

SEQ ID NO: 44278 - RNA, 19 nt, Homo sapiens
ggauuaccaugacgacaac

SEQ ID NO: 44279 - RNA, 19 nt, Homo sapiens
gggcauuucuccuauugac

SEQ ID NO: 44280 - RNA, 19 nt, Homo sapiens
cugcagaaguuugagaaga

SEQ ID NO: 44281 - RNA, 19 nt, Homo sapiens
gcagaaguuugagaagaac

SEQ ID NO: 44282 - RNA, 19 nt, Homo sapiens
gcuaugccaucgggaagga

SEQ ID NO: 44283 - RNA, 19 nt, Homo sapiens
gcggagaucguccacuuca

SEQ ID NO: 44284 - RNA, 19 nt, Homo sapiens
gaaggcaugacaagaaagg

SEQ ID NO: 44285 - RNA, 19 nt, Homo sapiens
gacgggcauuucuccuauu

SEQ ID NO: 44286 - RNA, 19 nt, Homo sapiens
ggaggauccaucacacaga

SEQ ID NO: 44287 - RNA, 19 nt, Homo sapiens
ccacuucacccucccagau

SEQ ID NO: 44288 - RNA, 19 nt, Homo sapiens
ggaggacuuucuggauauc

SEQ ID NO: 44289 - RNA, 19 nt, Homo sapiens
gaggguuuccuggauauau

SEQ ID NO: 44290 - RNA, 19 nt, Homo sapiens
ggcgauuguucagguguuu

SEQ ID NO: 44291 - RNA, 19 nt, Homo sapiens
cgggaggucucugcugcua

SEQ ID NO: 44292 - RNA, 19 nt, Homo sapiens
aaaggaccauggagauguc

SEQ ID NO: 44293 - RNA, 19 nt, Homo sapiens
ccgaggguuuccuggauau

SEQ ID NO: 44294 - RNA, 19 nt, Homo sapiens
cagacgggcauuucuccua

SEQ ID NO: 44295 - RNA, 19 nt, Homo sapiens
aagaccacuugcgaauuua

SEQ ID NO: 44296 - RNA, 19 nt, Homo sapiens
ggaccugcucuaccuggaa

SEQ ID NO: 44297 - RNA, 19 nt, Homo sapiens
ugucgcggcugaugaaguc

SEQ ID NO: 44298 - RNA, 19 nt, Homo sapiens
cagacagcuucacaacaga

SEQ ID NO: 44299 - RNA, 19 nt, Homo sapiens
ccuacgaacuccgguguca

SEQ ID NO: 44300 - RNA, 19 nt, Homo sapiens
ggccaugaaggcaguaguu

SEQ ID NO: 44301 - RNA, 19 nt, Homo sapiens
acagccagauucuucaagu

SEQ ID NO: 44302 - RNA, 19 nt, Homo sapiens
caucacagagggacagauc

SEQ ID NO: 44303 - RNA, 19 nt, Homo sapiens
gagacagccagauucuuca

SEQ ID NO: 44304 - RNA, 19 nt, Homo sapiens
gaauuccugcagaaguuug

SEQ ID NO: 44305 - RNA, 19 nt, Homo sapiens
ggacgugcaggccaugaag

SEQ ID NO: 44306 - RNA, 19 nt, Homo sapiens
ggacuuucuggauaucaau

SEQ ID NO: 44307 - RNA, 19 nt, Homo sapiens
gacaugcugggucggguuu

SEQ ID NO: 44308 - RNA, 19 nt, Homo sapiens
aagaaaggaccauggagau

SEQ ID NO: 44309 - RNA, 19 nt, Homo sapiens
gacagacagcuucacaaca

SEQ ID NO: 44310 - RNA, 19 nt, Homo sapiens
augcggagaucguccacuu

SEQ ID NO: 44311 - RNA, 19 nt, Homo sapiens
cuauugacgucaugaacag

SEQ ID NO: 44312 - RNA, 19 nt, Homo sapiens
ugcaggcggucacccgaaa

SEQ ID NO: 44313 - RNA, 19 nt, Homo sapiens
gcgcugaccacugcugaau

SEQ ID NO: 44314 - RNA, 19 nt, Homo sapiens
acauggagacagccagauu

SEQ ID NO: 44315 - RNA, 19 nt, Homo sapiens
uggauuaccaugacgacaa

SEQ ID NO: 44316 - RNA, 19 nt, Homo sapiens
acgggcauuucuccuauug

SEQ ID NO: 44317 - RNA, 19 nt, Homo sapiens
cagcuucacaacagacaga

SEQ ID NO: 44318 - RNA, 19 nt, Homo sapiens
cagccagauucuucaaguc

SEQ ID NO: 44319 - RNA, 19 nt, Homo sapiens
gcacuuauguuuacggaua

SEQ ID NO: 44320 - RNA, 19 nt, Homo sapiens
uaacagacaugaguucuua

SEQ ID NO: 44321 - RNA, 19 nt, Homo sapiens
guaaagaaauccaaagaug

SEQ ID NO: 44322 - RNA, 19 nt, Homo sapiens
gcagaggagucacaugauu

SEQ ID NO: 44323 - RNA, 19 nt, Homo sapiens
gagaagggaugaccaggaa

SEQ ID NO: 44324 - RNA, 19 nt, Homo sapiens
gcagaagcacuuauguuua

SEQ ID NO: 44325 - RNA, 19 nt, Homo sapiens
guaguuaguuaccugauaa

SEQ ID NO: 44326 - RNA, 19 nt, Homo sapiens
guaccagucucugaaguua

SEQ ID NO: 44327 - RNA, 19 nt, Homo sapiens
gacaguaucuggagucaau

SEQ ID NO: 44328 - RNA, 19 nt, Homo sapiens
ggagucagcaugauuauau

SEQ ID NO: 44329 - RNA, 19 nt, Homo sapiens
caugaaagcugucguugga

SEQ ID NO: 44330 - RNA, 19 nt, Homo sapiens
gaaggaucaugccgaugua

SEQ ID NO: 44331 - RNA, 19 nt, Homo sapiens
gggagaaacggcucgauua

SEQ ID NO: 44332 - RNA, 19 nt, Homo sapiens
ugagaaacauguauugguu

SEQ ID NO: 44333 - RNA, 19 nt, Homo sapiens
ggacagaggagacaagaug

SEQ ID NO: 44334 - RNA, 19 nt, Homo sapiens
guacauaguggaguaguua

SEQ ID NO: 44335 - RNA, 19 nt, Homo sapiens
ccaaagaaaugcugaagag

SEQ ID NO: 44336 - RNA, 19 nt, Homo sapiens
gaaauccaaagauguagua

SEQ ID NO: 44337 - RNA, 19 nt, Homo sapiens
guacuuacguauugggauu

SEQ ID NO: 44338 - RNA, 19 nt, Homo sapiens
gauagcauuuccaagcuuu

SEQ ID NO: 44339 - RNA, 19 nt, Homo sapiens
ggagucacaugauuacaau

SEQ ID NO: 44340 - RNA, 19 nt, Homo sapiens
gcucuuuccuauauaauga

SEQ ID NO: 44341 - RNA, 19 nt, Homo sapiens
uaacagugguuuaaguuuc

SEQ ID NO: 44342 - RNA, 19 nt, Homo sapiens
gcuccgcgcucuugugaaa

SEQ ID NO: 44343 - RNA, 19 nt, Homo sapiens
gaagucugcuauuggagaa

SEQ ID NO: 44344 - RNA, 19 nt, Homo sapiens
agacuugacuggcuacauu

SEQ ID NO: 44345 - RNA, 19 nt, Homo sapiens
uuuccaagcuuuagaguuu

SEQ ID NO: 44346 - RNA, 19 nt, Homo sapiens
gguacaagaugagaagaaa

SEQ ID NO: 44347 - RNA, 19 nt, Homo sapiens
ggcaguaguucagguauuu

SEQ ID NO: 44348 - RNA, 19 nt, Homo sapiens
cagaagcacuuauguuuac

SEQ ID NO: 44349 - RNA, 19 nt, Homo sapiens
gagaaacauguauugguua

SEQ ID NO: 44350 - RNA, 19 nt, Homo sapiens
gaucuucucuacuuggaau

SEQ ID NO: 44351 - RNA, 19 nt, Homo sapiens
ggaaggaucaugccgaugu

SEQ ID NO: 44352 - RNA, 19 nt, Homo sapiens
gcagaucuauguggacaga

SEQ ID NO: 44353 - RNA, 19 nt, Homo sapiens
acucaaaucccuauucuaa

SEQ ID NO: 44354 - RNA, 19 nt, Homo sapiens
ugugacaucuggauauaaa

SEQ ID NO: 44355 - RNA, 19 nt, Homo sapiens
caucuuucauguuguguaa

SEQ ID NO: 44356 - RNA, 19 nt, Homo sapiens
gguccucagugcuauguuu

SEQ ID NO: 44357 - RNA, 19 nt, Homo sapiens
cgauguaucuaaccagcua

SEQ ID NO: 44358 - RNA, 19 nt, Homo sapiens
uuaaugaagucugcuauug

SEQ ID NO: 44359 - RNA, 19 nt, Homo sapiens
aaagagaagugggcaaguu

SEQ ID NO: 44360 - RNA, 19 nt, Homo sapiens
cagguuacauguauacaga

SEQ ID NO: 44361 - RNA, 19 nt, Homo sapiens
cagaggagucacaugauua

SEQ ID NO: 44362 - RNA, 19 nt, Homo sapiens
cacagaauccugcaacuuu

SEQ ID NO: 44363 - RNA, 19 nt, Homo sapiens
aagaaaugcugaagagaau

SEQ ID NO: 44364 - RNA, 19 nt, Homo sapiens
gcuaacagaccuuaaaaua

SEQ ID NO: 44365 - RNA, 19 nt, Homo sapiens
ugaaauacugguucuguuu

SEQ ID NO: 44366 - RNA, 19 nt, Homo sapiens
aagaagcccuuaccucaga

SEQ ID NO: 44367 - RNA, 19 nt, Homo sapiens
gggaugaacaguauugcua

SEQ ID NO: 44368 - RNA, 19 nt, Homo sapiens
gagcagaagcacuuauguu

SEQ ID NO: 44369 - RNA, 19 nt, Homo sapiens
ggagggagcagaagcacuu

SEQ ID NO: 44370 - RNA, 19 nt, Homo sapiens
aaagaaaugcugaagagaa

SEQ ID NO: 44371 - RNA, 19 nt, Homo sapiens
agacagauuuauccaccua

SEQ ID NO: 44372 - RNA, 19 nt, Homo sapiens
ccaguagaguuguuguuug

SEQ ID NO: 44373 - RNA, 19 nt, Homo sapiens
gaucuucuaugcaguucug

SEQ ID NO: 44374 - RNA, 19 nt, Homo sapiens
uaaccaugccuaaugauga

SEQ ID NO: 44375 - RNA, 19 nt, Homo sapiens
gaaacugcccgguucuuca

SEQ ID NO: 44376 - RNA, 19 nt, Homo sapiens
agguauagaugcuaagaaa

SEQ ID NO: 44377 - RNA, 19 nt, Homo sapiens
gcacaaacgauagcauuuc

SEQ ID NO: 44378 - RNA, 19 nt, Homo sapiens
gagacucugcaaagcauua

SEQ ID NO: 44379 - RNA, 19 nt, Homo sapiens
ccuacagccuuucuacauu

SEQ ID NO: 44380 - RNA, 19 nt, Homo sapiens
accagucucugaaguuaua

SEQ ID NO: 44381 - RNA, 19 nt, Homo sapiens
gugaaauacugguucuguu

SEQ ID NO: 44382 - RNA, 19 nt, Homo sapiens
gguuacauguauacagauu

SEQ ID NO: 44383 - RNA, 19 nt, Homo sapiens
gcagaaaauuccuaucuuc

SEQ ID NO: 44384 - RNA, 19 nt, Homo sapiens
gagucagcaugauuauauu

SEQ ID NO: 44385 - RNA, 19 nt, Homo sapiens
cuacagccuuucuacauuc

SEQ ID NO: 44386 - RNA, 19 nt, Homo sapiens
ccucucaacucccucaaga

SEQ ID NO: 44387 - RNA, 19 nt, Homo sapiens
auaguggaguaguuaguua

SEQ ID NO: 44388 - RNA, 19 nt, Homo sapiens
agaaacggcucgauuacuc

SEQ ID NO: 44389 - RNA, 19 nt, Homo sapiens
gcuaacagugguuuaaguu

SEQ ID NO: 44390 - RNA, 19 nt, Homo sapiens
ucagugcuauguuuaaagu

SEQ ID NO: 44391 - RNA, 19 nt, Homo sapiens
gauugcagcucagaucugu

SEQ ID NO: 44392 - RNA, 19 nt, Homo sapiens
ucgaugggaugaacaguau

SEQ ID NO: 44393 - RNA, 19 nt, Homo sapiens
gcuuuggucucuacauuag

SEQ ID NO: 44394 - RNA, 19 nt, Homo sapiens
gaaguuauaaugcuuuggu

SEQ ID NO: 44395 - RNA, 19 nt, Homo sapiens
guuggaguuuaccauguua

SEQ ID NO: 44396 - RNA, 19 nt, Homo sapiens
gcacaacagacagauuuau

SEQ ID NO: 44397 - RNA, 19 nt, Homo sapiens
caugaguucuuaugcugaa

SEQ ID NO: 44398 - RNA, 19 nt, Homo sapiens
gaauagaugagugaaagga

SEQ ID NO: 44399 - RNA, 19 nt, Homo sapiens
ucuuagaccuuaccucuca

SEQ ID NO: 44400 - RNA, 19 nt, Homo sapiens
ucccagguaugcugaaauu

SEQ ID NO: 44401 - RNA, 19 nt, Homo sapiens
aaugaagucugcuauugga

SEQ ID NO: 44402 - RNA, 19 nt, Homo sapiens
uuagagagcagccuuugaa

SEQ ID NO: 44403 - RNA, 19 nt, Homo sapiens
gcuaugcuauuggaaagga

SEQ ID NO: 44404 - RNA, 19 nt, Homo sapiens
acagacagcugcacaacag

SEQ ID NO: 44405 - RNA, 19 nt, Homo sapiens
gggcaaguucuggaaguua

SEQ ID NO: 44406 - RNA, 19 nt, Homo sapiens
gaaaauuccuaucuucucu

SEQ ID NO: 44407 - RNA, 19 nt, Homo sapiens
ggucggguauucaauggau

SEQ ID NO: 44408 - RNA, 19 nt, Homo sapiens
cauuccaucuuucauguug

SEQ ID NO: 44409 - RNA, 19 nt, Homo sapiens
uuacuugggugcaauagca

SEQ ID NO: 44410 - RNA, 19 nt, Homo sapiens
caagaugagaagaaagaaa

SEQ ID NO: 44411 - RNA, 19 nt, Homo sapiens
gauuacaauugccaguaga

SEQ ID NO: 44412 - RNA, 19 nt, Homo sapiens
ccucagugcuauguuuaaa

SEQ ID NO: 44413 - RNA, 19 nt, Homo sapiens
uaacauauugugccagugu

SEQ ID NO: 44414 - RNA, 19 nt, Homo sapiens
cuauaugcgugcuaugcua

SEQ ID NO: 44415 - RNA, 19 nt, Homo sapiens
gaaucuacccagaggaaau

SEQ ID NO: 44416 - RNA, 19 nt, Homo sapiens
ggugauccuuacuggguuu

SEQ ID NO: 44417 - RNA, 19 nt, Homo sapiens
ggcaagauccagucugaga

SEQ ID NO: 44418 - RNA, 19 nt, Homo sapiens
uauuguacauaguggagua

SEQ ID NO: 44419 - RNA, 19 nt, Homo sapiens
ccagcuaucuauaaccuua

SEQ ID NO: 44420 - RNA, 19 nt, Homo sapiens
caauaaaguucuuggaugu

SEQ ID NO: 44421 - RNA, 19 nt, Homo sapiens
gcggagcuguguccaauaa

SEQ ID NO: 44422 - RNA, 19 nt, Homo sapiens
ggucauggcuggcaucauc

SEQ ID NO: 44423 - RNA, 19 nt, Homo sapiens
auaaagaucuggccuguuc

SEQ ID NO: 44424 - RNA, 19 nt, Homo sapiens
caagagcgguaccggcauu

SEQ ID NO: 44425 - RNA, 19 nt, Homo sapiens
ucucuuuacuggauguuua

SEQ ID NO: 44426 - RNA, 19 nt, Homo sapiens
guaugcggaugauuuagaa

SEQ ID NO: 44427 - RNA, 19 nt, Homo sapiens
gacaucagccucuacaaga

SEQ ID NO: 44428 - RNA, 19 nt, Homo sapiens
acgaacagccugacacaua

SEQ ID NO: 44429 - RNA, 19 nt, Homo sapiens
gaacgaacagccugacaca

SEQ ID NO: 44430 - RNA, 19 nt, Homo sapiens
gcgcggagcuguguccaau

SEQ ID NO: 44431 - RNA, 19 nt, Homo sapiens
ggagcuguguccaauaaag

SEQ ID NO: 44432 - RNA, 19 nt, Homo sapiens
cccaguaguuggucuugua

SEQ ID NO: 44433 - RNA, 19 nt, Homo sapiens
caccagccacagaauauua

SEQ ID NO: 44434 - RNA, 19 nt, Homo sapiens
gccacagaauauuauguaa

SEQ ID NO: 44435 - RNA, 19 nt, Homo sapiens
gcccuugucucccagcuau

SEQ ID NO: 44436 - RNA, 19 nt, Homo sapiens
gauccugauucucaucuuc

SEQ ID NO: 44437 - RNA, 19 nt, Homo sapiens
cgaacagccugacacauac

SEQ ID NO: 44438 - RNA, 19 nt, Homo sapiens
ggcaugauccugauucuca

SEQ ID NO: 44439 - RNA, 19 nt, Homo sapiens
auaaaguucuuggauguga

SEQ ID NO: 44440 - RNA, 19 nt, Homo sapiens
ggacaucugggcccacuca

SEQ ID NO: 44441 - RNA, 19 nt, Homo sapiens
ucauuucucuuuacuggau

SEQ ID NO: 44442 - RNA, 19 nt, Homo sapiens
gcuagagugucgccuugug

SEQ ID NO: 44443 - RNA, 19 nt, Homo sapiens
guacaugcgcaguguccua

SEQ ID NO: 44444 - RNA, 19 nt, Homo sapiens
uaaaguucuuggaugugaa

SEQ ID NO: 44445 - RNA, 19 nt, Homo sapiens
ggccggagcagaucaugaa

SEQ ID NO: 44446 - RNA, 19 nt, Homo sapiens
cggagcagaucaugaaguc

SEQ ID NO: 44447 - RNA, 19 nt, Homo sapiens
gcauugcggccaugucugu

SEQ ID NO: 44448 - RNA, 19 nt, Homo sapiens
uguguaugcggaugauuua

SEQ ID NO: 44449 - RNA, 19 nt, Homo sapiens
gcccaccagccacagaaua

SEQ ID NO: 44450 - RNA, 19 nt, Homo sapiens
gcggaugauuuagaauugu

SEQ ID NO: 44451 - RNA, 19 nt, Homo sapiens
cgacaucagccucuacaag

SEQ ID NO: 44452 - RNA, 19 nt, Homo sapiens
gagcuguguccaauaaagu

SEQ ID NO: 44453 - RNA, 19 nt, Homo sapiens
ugcggaugauuuagaauug

SEQ ID NO: 44454 - RNA, 19 nt, Homo sapiens
cugcggugcugguauuuag

SEQ ID NO: 44455 - RNA, 19 nt, Homo sapiens
gagcccaccagccacagaa

SEQ ID NO: 44456 - RNA, 19 nt, Homo sapiens
uagugcccaucgucuguuu

SEQ ID NO: 44457 - RNA, 19 nt, Homo sapiens
aaaguucuuggaugugaaa

SEQ ID NO: 44458 - RNA, 19 nt, Homo sapiens
agccacagaauauuaugua

SEQ ID NO: 44459 - RNA, 19 nt, Homo sapiens
gcccucauccucuccacaa

SEQ ID NO: 44460 - RNA, 19 nt, Homo sapiens
caugcgcaguguccuagug

SEQ ID NO: 44461 - RNA, 19 nt, Homo sapiens
guaguuggucuuguacaug

SEQ ID NO: 44462 - RNA, 19 nt, Homo sapiens
cggaugauuuagaauuguc

SEQ ID NO: 44463 - RNA, 19 nt, Homo sapiens
ggugguggcaguccucauc

SEQ ID NO: 44464 - RNA, 19 nt, Homo sapiens
ccaccagccacagaauauu

SEQ ID NO: 44465 - RNA, 19 nt, Homo sapiens
caucaucccaguggucaug

SEQ ID NO: 44466 - RNA, 19 nt, Homo sapiens
gaaaguagcucaauacaug

SEQ ID NO: 44467 - RNA, 19 nt, Homo sapiens
ggaaauaccuaguaacaaa

SEQ ID NO: 44468 - RNA, 19 nt, Homo sapiens
gaaagcagauaaagaagaa

SEQ ID NO: 44469 - RNA, 19 nt, Homo sapiens
gaaaggaaaucuucagaau

SEQ ID NO: 44470 - RNA, 19 nt, Homo sapiens
gaagaaggaugacuuuguu

SEQ ID NO: 44471 - RNA, 19 nt, Homo sapiens
gaaauaaguugcaguaugg

SEQ ID NO: 44472 - RNA, 19 nt, Homo sapiens
gguaguaguucccaaguua

SEQ ID NO: 44473 - RNA, 19 nt, Homo sapiens
ggacuugguuacuuauaua

SEQ ID NO: 44474 - RNA, 19 nt, Homo sapiens
agacauaacuguugaauag

SEQ ID NO: 44475 - RNA, 19 nt, Homo sapiens
uaacaaacaugacugaguu

SEQ ID NO: 44476 - RNA, 19 nt, Homo sapiens
gaacacaaauuugaagaug

SEQ ID NO: 44477 - RNA, 19 nt, Homo sapiens
gaaacugagagaaguauua

SEQ ID NO: 44478 - RNA, 19 nt, Homo sapiens
gaugaaagcagauaaagaa

SEQ ID NO: 44479 - RNA, 19 nt, Homo sapiens
gaucaggucuguaaaugug

SEQ ID NO: 44480 - RNA, 19 nt, Homo sapiens
cagaguaucucgucacauu

SEQ ID NO: 44481 - RNA, 19 nt, Homo sapiens
uaaacuggaugcauuugua

SEQ ID NO: 44482 - RNA, 19 nt, Homo sapiens
acaauaaccugaaaggaaa

SEQ ID NO: 44483 - RNA, 19 nt, Homo sapiens
uagcagaaauugugaagaa

SEQ ID NO: 44484 - RNA, 19 nt, Homo sapiens
gaagaugacuuuucaguau

SEQ ID NO: 44485 - RNA, 19 nt, Homo sapiens
gaguggacuugguuacuua

SEQ ID NO: 44486 - RNA, 19 nt, Homo sapiens
ugaacaggcuuucuacuga

SEQ ID NO: 44487 - RNA, 19 nt, Homo sapiens
ugaauaaagucuagcagaa

SEQ ID NO: 44488 - RNA, 19 nt, Homo sapiens
aagagaaucuguuggcuaa

SEQ ID NO: 44489 - RNA, 19 nt, Homo sapiens
ggucagaacacaaauuuga

SEQ ID NO: 44490 - RNA, 19 nt, Homo sapiens
gauaucaugguaugcauua

SEQ ID NO: 44491 - RNA, 19 nt, Homo sapiens
ugagagaaguauuacauga

SEQ ID NO: 44492 - RNA, 19 nt, Homo sapiens
gaagaaacugagagaagua

SEQ ID NO: 44493 - RNA, 19 nt, Homo sapiens
guucgugacuuccaguaua

SEQ ID NO: 44494 - RNA, 19 nt, Homo sapiens
gagcaucugcauacaauaa

SEQ ID NO: 44495 - RNA, 19 nt, Homo sapiens
agacaaaguucaagagaau

SEQ ID NO: 44496 - RNA, 19 nt, Homo sapiens
gaaagaaugcaggaaguuu

SEQ ID NO: 44497 - RNA, 19 nt, Homo sapiens
gaacaggcuuucuacugau

SEQ ID NO: 44498 - RNA, 19 nt, Homo sapiens
gaagaaaugaacaggcuuu

SEQ ID NO: 44499 - RNA, 19 nt, Homo sapiens
ggaaggcaguugaugacuu

SEQ ID NO: 44500 - RNA, 19 nt, Homo sapiens
gagaaucuguuggcuaaug

SEQ ID NO: 44501 - RNA, 19 nt, Homo sapiens
gagaaaaccugucagcaaa

SEQ ID NO: 44502 - RNA, 19 nt, Homo sapiens
agaaauaaguugcaguaug

SEQ ID NO: 44503 - RNA, 19 nt, Homo sapiens
ccagugaacuuccaagcaa

SEQ ID NO: 44504 - RNA, 19 nt, Homo sapiens
gcugauguauuggaagaua

SEQ ID NO: 44505 - RNA, 19 nt, Homo sapiens
guucaauauuccugacuua

SEQ ID NO: 44506 - RNA, 19 nt, Homo sapiens
gugaaagcauuacggguuu

SEQ ID NO: 44507 - RNA, 19 nt, Homo sapiens
uagaaggagugguuaagaa

SEQ ID NO: 44508 - RNA, 19 nt, Homo sapiens
ggaguggacuugguuacuu

SEQ ID NO: 44509 - RNA, 19 nt, Homo sapiens
gcaaagacaaaguucaaga

SEQ ID NO: 44510 - RNA, 19 nt, Homo sapiens
caauauuccugacuuaaag

SEQ ID NO: 44511 - RNA, 19 nt, Homo sapiens
cagaugaacuggcuaaacu

SEQ ID NO: 44512 - RNA, 19 nt, Homo sapiens
guuauaugcugagguguaa

SEQ ID NO: 44513 - RNA, 19 nt, Homo sapiens
gaggaaauaccuaguaaca

SEQ ID NO: 44514 - RNA, 19 nt, Homo sapiens
ggagaugaaagcagauaaa

SEQ ID NO: 44515 - RNA, 19 nt, Homo sapiens
uggcuaaacuggaugcauu

SEQ ID NO: 44516 - RNA, 19 nt, Homo sapiens
aaaccugagucaacaagaa

SEQ ID NO: 44517 - RNA, 19 nt, Homo sapiens
ccaaauauccaaucaagca

SEQ ID NO: 44518 - RNA, 19 nt, Homo sapiens
ggccaaauauccaaucaag

SEQ ID NO: 44519 - RNA, 19 nt, Homo sapiens
gcaaacaugggagaaauug

SEQ ID NO: 44520 - RNA, 19 nt, Homo sapiens
gcagauaaagaagaaauga

SEQ ID NO: 44521 - RNA, 19 nt, Homo sapiens
cagaggaccaagacaguua

SEQ ID NO: 44522 - RNA, 19 nt, Homo sapiens
gaagauagcaaagacaaag

SEQ ID NO: 44523 - RNA, 19 nt, Homo sapiens
gagagaaguauuacaugaa

SEQ ID NO: 44524 - RNA, 19 nt, Homo sapiens
ugaagaaacugagagaagu

SEQ ID NO: 44525 - RNA, 19 nt, Homo sapiens
uaagcaguaugaaacacua

SEQ ID NO: 44526 - RNA, 19 nt, Homo sapiens
guuacugaaucaugaugua

SEQ ID NO: 44527 - RNA, 19 nt, Homo sapiens
guuccaaggucuagcaaug

SEQ ID NO: 44528 - RNA, 19 nt, Homo sapiens
agugggacauggccaaaua

SEQ ID NO: 44529 - RNA, 19 nt, Homo sapiens
gcugagguguaaccauuug

SEQ ID NO: 44530 - RNA, 19 nt, Homo sapiens
cagcaaacaugggagaaau

SEQ ID NO: 44531 - RNA, 19 nt, Homo sapiens
cagaaauugugaagaagga

SEQ ID NO: 44532 - RNA, 19 nt, Homo sapiens
uacaauaaccugaaaggaa

SEQ ID NO: 44533 - RNA, 19 nt, Homo sapiens
gauggguauuuacauuuga

SEQ ID NO: 44534 - RNA, 19 nt, Homo sapiens
gguguaaccauuuguguug

SEQ ID NO: 44535 - RNA, 19 nt, Homo sapiens
guugaugacuucagacaca

SEQ ID NO: 44536 - RNA, 19 nt, Homo sapiens
uguaaugucaccuuguuua

SEQ ID NO: 44537 - RNA, 19 nt, Homo sapiens
ggacauggccaaauaucca

SEQ ID NO: 44538 - RNA, 19 nt, Homo sapiens
ggaugcauuuguagaagga

SEQ ID NO: 44539 - RNA, 19 nt, Homo sapiens
gaauaguuacugaaucaug

SEQ ID NO: 44540 - RNA, 19 nt, Homo sapiens
gaaggaugacuuuguucuu

SEQ ID NO: 44541 - RNA, 19 nt, Homo sapiens
gaauuuggaacgaaagaau

SEQ ID NO: 44542 - RNA, 19 nt, Homo sapiens
ccugaaaucucgagcaucu

SEQ ID NO: 44543 - RNA, 19 nt, Homo sapiens
gauugauaaugaccugaaa

SEQ ID NO: 44544 - RNA, 19 nt, Homo sapiens
gaauagagccaguuuugaa

SEQ ID NO: 44545 - RNA, 19 nt, Homo sapiens
ugauggguauuuacauuug

SEQ ID NO: 44546 - RNA, 19 nt, Homo sapiens
ggucucuuccuuauugaua

SEQ ID NO: 44547 - RNA, 19 nt, Homo sapiens
gauaaugaccugaaaucuc

SEQ ID NO: 44548 - RNA, 19 nt, Homo sapiens
acagaaauaaguugcagua

SEQ ID NO: 44549 - RNA, 19 nt, Homo sapiens
gaaaugguaguuccaaggu

SEQ ID NO: 44550 - RNA, 19 nt, Homo sapiens
cuagcaauguucuuucaga

SEQ ID NO: 44551 - RNA, 19 nt, Homo sapiens
ggauuaagcaguaugaaac

SEQ ID NO: 44552 - RNA, 19 nt, Homo sapiens
ugacuuuguucuugauuca

SEQ ID NO: 44553 - RNA, 19 nt, Homo sapiens
gaccugaaaucucgagcau

SEQ ID NO: 44554 - RNA, 19 nt, Homo sapiens
uaagaaaguagcucaauac

SEQ ID NO: 44555 - RNA, 19 nt, Homo sapiens
ugacugaguucuggcuuau

SEQ ID NO: 44556 - RNA, 19 nt, Homo sapiens
gguaugcauuaauuccauu

SEQ ID NO: 44557 - RNA, 19 nt, Homo sapiens
guacgguggcugaaaguga

SEQ ID NO: 44558 - RNA, 19 nt, Homo sapiens
aaugucaccuuguuuagga

SEQ ID NO: 44559 - RNA, 19 nt, Homo sapiens
aaggaugacuuuguucuug

SEQ ID NO: 44560 - RNA, 19 nt, Homo sapiens
uugaggaaauaccuaguaa

SEQ ID NO: 44561 - RNA, 19 nt, Homo sapiens
aagacaaaguucaagagaa

SEQ ID NO: 44562 - RNA, 19 nt, Homo sapiens
ggaagauagcaaagacaaa

SEQ ID NO: 44563 - RNA, 19 nt, Homo sapiens
auccuuugcuugcuucuua

SEQ ID NO: 44564 - RNA, 19 nt, Homo sapiens
ugaagaaggaugacuuugu

SEQ ID NO: 44565 - RNA, 19 nt, Homo sapiens
ugaacuggcuaaacuggau

SEQ ID NO: 44566 - RNA, 19 nt, Homo sapiens
ucacagaccuacuaaauga

SEQ ID NO: 44567 - RNA, 19 nt, Homo sapiens
gagaugaccuuaucacaga

SEQ ID NO: 44568 - RNA, 19 nt, Homo sapiens
ugagaaagcagaagaaaua

SEQ ID NO: 44569 - RNA, 19 nt, Homo sapiens
gaagaagaguucaacauag

SEQ ID NO: 44570 - RNA, 19 nt, Homo sapiens
agacauagcugguggaguu

SEQ ID NO: 44571 - RNA, 19 nt, Homo sapiens
gccuaaaggugauguauuu

SEQ ID NO: 44572 - RNA, 19 nt, Homo sapiens
gaagaaagagaaacagauu

SEQ ID NO: 44573 - RNA, 19 nt, Homo sapiens
ggaagcuucugauauuuga

SEQ ID NO: 44574 - RNA, 19 nt, Homo sapiens
guggaaagcuucauguaau

SEQ ID NO: 44575 - RNA, 19 nt, Homo sapiens
gaguugagaucuauaaugg

SEQ ID NO: 44576 - RNA, 19 nt, Homo sapiens
gaaagcagaagaaauagau

SEQ ID NO: 44577 - RNA, 19 nt, Homo sapiens
uguggaagcuucugauauu

SEQ ID NO: 44578 - RNA, 19 nt, Homo sapiens
cagaagaaauagaugcaaa

SEQ ID NO: 44579 - RNA, 19 nt, Homo sapiens
gaacaagaagccaaugaga

SEQ ID NO: 44580 - RNA, 19 nt, Homo sapiens
cuaccugccugaagacaua

SEQ ID NO: 44581 - RNA, 19 nt, Homo sapiens
uggaaagcuucauguaaua

SEQ ID NO: 44582 - RNA, 19 nt, Homo sapiens
caguauugcucuguauuua

SEQ ID NO: 44583 - RNA, 19 nt, Homo sapiens
agaagaagaguucaacaua

SEQ ID NO: 44584 - RNA, 19 nt, Homo sapiens
aagaagaguucaacauaga

SEQ ID NO: 44585 - RNA, 19 nt, Homo sapiens
gcagauaaagcauaugaug

SEQ ID NO: 44586 - RNA, 19 nt, Homo sapiens
acucaugccuugccuaauu

SEQ ID NO: 44587 - RNA, 19 nt, Homo sapiens
aaacacgaaugucucugua

SEQ ID NO: 44588 - RNA, 19 nt, Homo sapiens
agaaggcaauuccuaugua

SEQ ID NO: 44589 - RNA, 19 nt, Homo sapiens
gugcaaacccaaagacuaa

SEQ ID NO: 44590 - RNA, 19 nt, Homo sapiens
ggugauguauuugguguuu

SEQ ID NO: 44591 - RNA, 19 nt, Homo sapiens
ggacccaccuccaguucuu

SEQ ID NO: 44592 - RNA, 19 nt, Homo sapiens
aaagaguuaugcggauuua

SEQ ID NO: 44593 - RNA, 19 nt, Homo sapiens
acaagaagccaaugagaaa

SEQ ID NO: 44594 - RNA, 19 nt, Homo sapiens
acccaaagacuaaagauua

SEQ ID NO: 44595 - RNA, 19 nt, Homo sapiens
gaaggcaauuccuauguac

SEQ ID NO: 44596 - RNA, 19 nt, Homo sapiens
caagauuucccucugguaa

SEQ ID NO: 44597 - RNA, 19 nt, Homo sapiens
gcuuuacuguuaccuguuu

SEQ ID NO: 44598 - RNA, 19 nt, Homo sapiens
guauugcucuguauuuauc

SEQ ID NO: 44599 - RNA, 19 nt, Homo sapiens
gaaucaagcgagacucaaa

SEQ ID NO: 44600 - RNA, 19 nt, Homo sapiens
gguggaaagcuucauguaa

SEQ ID NO: 44601 - RNA, 19 nt, Homo sapiens
cgauguugauguccaaauu

SEQ ID NO: 44602 - RNA, 19 nt, Homo sapiens
ucacaaugguggaaagcuu

SEQ ID NO: 44603 - RNA, 19 nt, Homo sapiens
gaaacacgaaugucucugu

SEQ ID NO: 44604 - RNA, 19 nt, Homo sapiens
gagaagaaagagaaacaga

SEQ ID NO: 44605 - RNA, 19 nt, Homo sapiens
gaaagcuucauguaauaug

SEQ ID NO: 44606 - RNA, 19 nt, Homo sapiens
uaucacagaccuacuaaau

SEQ ID NO: 44607 - RNA, 19 nt, Homo sapiens
auucagauguccaauuuga

SEQ ID NO: 44608 - RNA, 19 nt, Homo sapiens
agaaagagaaacagauuga

SEQ ID NO: 44609 - RNA, 19 nt, Homo sapiens
cccaaagacuaaagauuau

SEQ ID NO: 44610 - RNA, 19 nt, Homo sapiens
ggaguugagaucuauaaug

SEQ ID NO: 44611 - RNA, 19 nt, Homo sapiens
gaagaguucaacauagaga

SEQ ID NO: 44612 - RNA, 19 nt, Homo sapiens
uaaaggugauguauuuggu

SEQ ID NO: 44613 - RNA, 19 nt, Homo sapiens
gauguggaagcuucugaua

SEQ ID NO: 44614 - RNA, 19 nt, Homo sapiens
guacaaaauugccaccaaa

SEQ ID NO: 44615 - RNA, 19 nt, Homo sapiens
gcagaaggcaauuccuaug

SEQ ID NO: 44616 - RNA, 19 nt, Homo sapiens
ggaaagcuucauguaauau

SEQ ID NO: 44617 - RNA, 19 nt, Homo sapiens
uaaaggaacccgagaucug

SEQ ID NO: 44618 - RNA, 19 nt, Homo sapiens
aaauaaagguuuccaacac

SEQ ID NO: 44619 - RNA, 19 nt, Homo sapiens
guggaagcuucugauauuu

SEQ ID NO: 44620 - RNA, 19 nt, Homo sapiens
ccaguauugcucuguauuu

SEQ ID NO: 44621 - RNA, 19 nt, Homo sapiens
gcaaaugccaacaggaagu

SEQ ID NO: 44622 - RNA, 19 nt, Homo sapiens
gugcaaaugccaacaggaa

SEQ ID NO: 44623 - RNA, 19 nt, Homo sapiens
ccaaugagaaagcagaaga

SEQ ID NO: 44624 - RNA, 19 nt, Homo sapiens
gagcaagagaugaccuuau

SEQ ID NO: 44625 - RNA, 19 nt, Homo sapiens
ucucucaccucaccuuuca

SEQ ID NO: 44626 - RNA, 19 nt, Homo sapiens
aaacgauguugauguccaa

SEQ ID NO: 44627 - RNA, 19 nt, Homo sapiens
ggcaauuccuauguacaaa

SEQ ID NO: 44628 - RNA, 19 nt, Homo sapiens
ccucaccuuucaaaccuaa

SEQ ID NO: 44629 - RNA, 19 nt, Homo sapiens
ucacucaugccuugccuaa

SEQ ID NO: 44630 - RNA, 19 nt, Homo sapiens
gaaagccggcuggaucuca

SEQ ID NO: 44631 - RNA, 19 nt, Homo sapiens
gcugcuggauggacugguu

SEQ ID NO: 44632 - RNA, 19 nt, Homo sapiens
agagaaaggucggcuugug

SEQ ID NO: 44633 - RNA, 19 nt, Homo sapiens
gugcagaaggcaauuccua

SEQ ID NO: 44634 - RNA, 19 nt, Homo sapiens
agcaagagaugaccuuauc

SEQ ID NO: 44635 - RNA, 19 nt, Homo sapiens
ucagauguccaauuugaug

SEQ ID NO: 44636 - RNA, 19 nt, Homo sapiens
agauugagcagcagaagaa

SEQ ID NO: 44637 - RNA, 19 nt, Homo sapiens
uuaugcggauuuaauguga

SEQ ID NO: 44638 - RNA, 19 nt, Homo sapiens
gaguuaugcggauuuaaug

SEQ ID NO: 44639 - RNA, 19 nt, Homo sapiens
ugaagaaacacgaaugucu

SEQ ID NO: 44640 - RNA, 19 nt, Homo sapiens
gauguugauguccaaauug

SEQ ID NO: 44641 - RNA, 19 nt, Homo sapiens
uaaaagauacaaccaggua

SEQ ID NO: 44642 - RNA, 19 nt, Homo sapiens
aagcagauaaagcauauga

SEQ ID NO: 44643 - RNA, 19 nt, Homo sapiens
gauuguucguugcaggaaa

SEQ ID NO: 44644 - RNA, 19 nt, Homo sapiens
caaaagcagauaaagcaua

SEQ ID NO: 44645 - RNA, 19 nt, Homo sapiens
aguccuaccugccugaaga

SEQ ID NO: 44646 - RNA, 19 nt, Homo sapiens
gauguccaauuugaugaau

SEQ ID NO: 44647 - RNA, 19 nt, Homo sapiens
gaagaaauagaugcaaagg

SEQ ID NO: 44648 - RNA, 19 nt, Homo sapiens
ucucauagcccagcagaug

SEQ ID NO: 44649 - RNA, 19 nt, Homo sapiens
gcaagagaugaccuuauca

SEQ ID NO: 44650 - RNA, 19 nt, Homo sapiens
cagaaggcaauuccuaugu

SEQ ID NO: 44651 - RNA, 19 nt, Homo sapiens
caaagacuaaagauuaugg

SEQ ID NO: 44652 - RNA, 19 nt, Homo sapiens
caaugagaaagcagaagaa

SEQ ID NO: 44653 - RNA, 19 nt, Homo sapiens
caaaugccaacaggaaguu

SEQ ID NO: 44654 - RNA, 19 nt, Homo sapiens
guucaccggccuagcauug

SEQ ID NO: 44655 - RNA, 19 nt, Homo sapiens
gaaaggucggcuugugcaa

SEQ ID NO: 44656 - RNA, 19 nt, Homo sapiens
cagaagaagaguucaacau

SEQ ID NO: 44657 - RNA, 19 nt, Homo sapiens
agaguuaugcggauuuaau

SEQ ID NO: 44658 - RNA, 19 nt, Homo sapiens
uaaaagaguuaugcggauu

SEQ ID NO: 44659 - RNA, 19 nt, Homo sapiens
ucagcaaggugguaaaaga

SEQ ID NO: 44660 - RNA, 19 nt, Homo sapiens
gcaaacccaaagacuaaag

SEQ ID NO: 44661 - RNA, 19 nt, Homo sapiens
aacaagaagccaaugagaa

SEQ ID NO: 44662 - RNA, 19 nt, Homo sapiens
gcagaagaaauagaugcaa

SEQ ID NO: 44663 - RNA, 19 nt, Homo sapiens
caaaggcagaagaagaguu

SEQ ID NO: 44664 - RNA, 19 nt, Homo sapiens
caaacccaaagacuaaaga

SEQ ID NO: 44665 - RNA, 19 nt, Homo sapiens
gcagaagaagaguucaaca

SEQ ID NO: 44666 - RNA, 19 nt, Homo sapiens
gaagaugggugacuagaug

SEQ ID NO: 44667 - RNA, 19 nt, Homo sapiens
ggagucugcuacaccauuu

SEQ ID NO: 44668 - RNA, 19 nt, Homo sapiens
caacccaucuuccuagugu

SEQ ID NO: 44669 - RNA, 19 nt, Homo sapiens
cuucagaccuccagaguga

SEQ ID NO: 44670 - RNA, 19 nt, Homo sapiens
gauuugggcuuccgcuuug

SEQ ID NO: 44671 - RNA, 19 nt, Homo sapiens
ccaagaaccuggucagcau

SEQ ID NO: 44672 - RNA, 19 nt, Homo sapiens
gugacuagaugauaugugu

SEQ ID NO: 44673 - RNA, 19 nt, Homo sapiens
gagugaagaugggugacua

SEQ ID NO: 44674 - RNA, 19 nt, Homo sapiens
gcaauugucauuagcaaca

SEQ ID NO: 44675 - RNA, 19 nt, Homo sapiens
gcaggcuacuccauguuug

SEQ ID NO: 44676 - RNA, 19 nt, Homo sapiens
caucauggcaauugucauu

SEQ ID NO: 44677 - RNA, 19 nt, Homo sapiens
gcuuugauguggcaugguu

SEQ ID NO: 44678 - RNA, 19 nt, Homo sapiens
ccuaguguuugugaaauaa

SEQ ID NO: 44679 - RNA, 19 nt, Homo sapiens
gugaggcuguggccaucua

SEQ ID NO: 44680 - RNA, 19 nt, Homo sapiens
gaugggugacuagaugaua

SEQ ID NO: 44681 - RNA, 19 nt, Homo sapiens
ggucaucgucgcaauucuu

SEQ ID NO: 44682 - RNA, 19 nt, Homo sapiens
agacuucgcccuucaugug

SEQ ID NO: 44683 - RNA, 19 nt, Homo sapiens
ucauggcaauugucauuag

SEQ ID NO: 44684 - RNA, 19 nt, Homo sapiens
uccuaguguuugugaaaua

SEQ ID NO: 44685 - RNA, 19 nt, Homo sapiens
gggagucugcuacaccauu

SEQ ID NO: 44686 - RNA, 19 nt, Homo sapiens
gcaucaucauggcaauugu

SEQ ID NO: 44687 - RNA, 19 nt, Homo sapiens
ucagcaucaucuucuguga

SEQ ID NO: 44688 - RNA, 19 nt, Homo sapiens
gaaccuggucagcaucauc

SEQ ID NO: 44689 - RNA, 19 nt, Homo sapiens
gcauuggccuagcuaucuc

SEQ ID NO: 44690 - RNA, 19 nt, Homo sapiens
gcugugucccuuagccuuu

SEQ ID NO: 44691 - RNA, 19 nt, Homo sapiens
ugauuugggcuuccgcuuu

SEQ ID NO: 44692 - RNA, 19 nt, Homo sapiens
uggcaauugucauuagcaa

SEQ ID NO: 44693 - RNA, 19 nt, Homo sapiens
ggagacuucgcccuucaug

SEQ ID NO: 44694 - RNA, 19 nt, Homo sapiens
caucuacggcaucaucaug

SEQ ID NO: 44695 - RNA, 19 nt, Homo sapiens
ggcaucaucauggcaauug

SEQ ID NO: 44696 - RNA, 19 nt, Homo sapiens
gugccucacuuuuauuuau

SEQ ID NO: 44697 - RNA, 19 nt, Homo sapiens
uaccggcuccuccaucauu

SEQ ID NO: 44698 - RNA, 19 nt, Homo sapiens
ggccgugccucacuuuuau

SEQ ID NO: 44699 - RNA, 19 nt, Homo sapiens
gcuggagcugugucccuua

SEQ ID NO: 44700 - RNA, 19 nt, Homo sapiens
gggcuuccgcuuugaugug

SEQ ID NO: 44701 - RNA, 19 nt, Homo sapiens
ggcauuggccuagcuaucu

SEQ ID NO: 44702 - RNA, 19 nt, Homo sapiens
ggucagcaucaucuucugu

SEQ ID NO: 44703 - RNA, 19 nt, Homo sapiens
cauaaucccugucuucuuu

SEQ ID NO: 44704 - RNA, 19 nt, Homo sapiens
caacagaaauggccaguca

SEQ ID NO: 44705 - RNA, 19 nt, Homo sapiens
gaaacugggaugauaauaa

SEQ ID NO: 44706 - RNA, 19 nt, Homo sapiens
gaggagaugacuacauuua

SEQ ID NO: 44707 - RNA, 19 nt, Homo sapiens
gauacuguguucccucaua

SEQ ID NO: 44708 - RNA, 19 nt, Homo sapiens
gcucauugcuuucuaagau

SEQ ID NO: 44709 - RNA, 19 nt, Homo sapiens
gaggguugcuucaaugauu

SEQ ID NO: 44710 - RNA, 19 nt, Homo sapiens
gaggcaggauccaauaauu

SEQ ID NO: 44711 - RNA, 19 nt, Homo sapiens
ucaaagaaauccuccaauc

SEQ ID NO: 44712 - RNA, 19 nt, Homo sapiens
aagaggagaugacuacauu

SEQ ID NO: 44713 - RNA, 19 nt, Homo sapiens
uaaacccucugugaaauuu

SEQ ID NO: 44714 - RNA, 19 nt, Homo sapiens
agauggagguggagcaaua

SEQ ID NO: 44715 - RNA, 19 nt, Homo sapiens
ggagccaucugguacuuug

SEQ ID NO: 44716 - RNA, 19 nt, Homo sapiens
ccagguagauaacugcauu

SEQ ID NO: 44717 - RNA, 19 nt, Homo sapiens
guaaguagcaacccuguga

SEQ ID NO: 44718 - RNA, 19 nt, Homo sapiens
gcugaucuuugucuuuauu

SEQ ID NO: 44719 - RNA, 19 nt, Homo sapiens
ccaagucauucucaccuaa

SEQ ID NO: 44720 - RNA, 19 nt, Homo sapiens
uagcaacccugugauacua

SEQ ID NO: 44721 - RNA, 19 nt, Homo sapiens
caaagaaauccuccaauca

SEQ ID NO: 44722 - RNA, 19 nt, Homo sapiens
guagauaacugcauuuugu

SEQ ID NO: 44723 - RNA, 19 nt, Homo sapiens
aauaaugccuaccuuguga

SEQ ID NO: 44724 - RNA, 19 nt, Homo sapiens
aagaaauccuccaaucaaa

SEQ ID NO: 44725 - RNA, 19 nt, Homo sapiens
uaaauauccugcucacauc

SEQ ID NO: 44726 - RNA, 19 nt, Homo sapiens
aaagaaauccuccaaucaa

SEQ ID NO: 44727 - RNA, 19 nt, Homo sapiens
gaugcucauugcuuucuaa

SEQ ID NO: 44728 - RNA, 19 nt, Homo sapiens
gaggaccagucaucaauag

SEQ ID NO: 44729 - RNA, 19 nt, Homo sapiens
uugcugaucuuugucuuua

SEQ ID NO: 44730 - RNA, 19 nt, Homo sapiens
ggaggaccagucaucaaua

SEQ ID NO: 44731 - RNA, 19 nt, Homo sapiens
gcaacccugugauacuauu

SEQ ID NO: 44732 - RNA, 19 nt, Homo sapiens
ccugugacacuuauaaaua

SEQ ID NO: 44733 - RNA, 19 nt, Homo sapiens
ggagaugacuacauuuagc

SEQ ID NO: 44734 - RNA, 19 nt, Homo sapiens
cuauauccuugacaccuua

SEQ ID NO: 44735 - RNA, 19 nt, Homo sapiens
cccaaagacuuaucagaug

SEQ ID NO: 44736 - RNA, 19 nt, Homo sapiens
uaauuccacuuguucauuc

SEQ ID NO: 44737 - RNA, 19 nt, Homo sapiens
gccagucagucccaaggua

SEQ ID NO: 44738 - RNA, 19 nt, Homo sapiens
uagcagugauucaguaagu

SEQ ID NO: 44739 - RNA, 19 nt, Homo sapiens
uguaaagucuagcacaguu

SEQ ID NO: 44740 - RNA, 19 nt, Homo sapiens
aaaaucaccucccaccaua

SEQ ID NO: 44741 - RNA, 19 nt, Homo sapiens
guccaucacuggcucucua

SEQ ID NO: 44742 - RNA, 19 nt, Homo sapiens
ggaccagucaucaauagga

SEQ ID NO: 44743 - RNA, 19 nt, Homo sapiens
gguacugccugagcaagaa

SEQ ID NO: 44744 - RNA, 19 nt, Homo sapiens
gcacaguuccuugcauguu

SEQ ID NO: 44745 - RNA, 19 nt, Homo sapiens
ucaauaggaggaugagauu

SEQ ID NO: 44746 - RNA, 19 nt, Homo sapiens
ccaguucccucccucaaag

SEQ ID NO: 44747 - RNA, 19 nt, Homo sapiens
ggccauaacaacagaaaug

SEQ ID NO: 44748 - RNA, 19 nt, Homo sapiens
acaccuuacuuucccauug

SEQ ID NO: 44749 - RNA, 19 nt, Homo sapiens
cacaguuccuugcauguug

SEQ ID NO: 44750 - RNA, 19 nt, Homo sapiens
gauguccuccucugugaaa

SEQ ID NO: 44751 - RNA, 19 nt, Homo sapiens
ggaaguaggaauguggaaa

SEQ ID NO: 44752 - RNA, 19 nt, Homo sapiens
ccuaaacccucugugaaau

SEQ ID NO: 44753 - RNA, 19 nt, Homo sapiens
caaaggaggaggcacagau

SEQ ID NO: 44754 - RNA, 19 nt, Homo sapiens
gcagagcucccagcagaga

SEQ ID NO: 44755 - RNA, 19 nt, Homo sapiens
aggacaagcuacuuaacuu

SEQ ID NO: 44756 - RNA, 19 nt, Homo sapiens
gaaucuccuuguuguucuu

SEQ ID NO: 44757 - RNA, 19 nt, Homo sapiens
gagaggaggaccagucauc

SEQ ID NO: 44758 - RNA, 19 nt, Homo sapiens
ggaggcaggauccaauaau

SEQ ID NO: 44759 - RNA, 19 nt, Homo sapiens
aggguugcuucaaugauua

SEQ ID NO: 44760 - RNA, 19 nt, Homo sapiens
caucugaaucuccuuguug

SEQ ID NO: 44761 - RNA, 19 nt, Homo sapiens
gcaugcccuuccuuucuau

SEQ ID NO: 44762 - RNA, 19 nt, Homo sapiens
uaucagaugcucauugcuu

SEQ ID NO: 44763 - RNA, 19 nt, Homo sapiens
caucacuggcucucuaauu

SEQ ID NO: 44764 - RNA, 19 nt, Homo sapiens
caucggccauaacaacaga

SEQ ID NO: 44765 - RNA, 19 nt, Homo sapiens
caccuuacuuucccauugu

SEQ ID NO: 44766 - RNA, 19 nt, Homo sapiens
ucugugacccuaguuauuu

SEQ ID NO: 44767 - RNA, 19 nt, Homo sapiens
cugugaaacugggaugaua

SEQ ID NO: 44768 - RNA, 19 nt, Homo sapiens
ugcaugcccuuccuuucua

SEQ ID NO: 44769 - RNA, 19 nt, Homo sapiens
gcagugauucaguaaguag

SEQ ID NO: 44770 - RNA, 19 nt, Homo sapiens
uaauaaugccuaccuugug

SEQ ID NO: 44771 - RNA, 19 nt, Homo sapiens
ucgauguccuccucuguga

SEQ ID NO: 44772 - RNA, 19 nt, Homo sapiens
gaugugggucccucucuug

SEQ ID NO: 44773 - RNA, 19 nt, Homo sapiens
gaaguaggaauguggaaaa

SEQ ID NO: 44774 - RNA, 19 nt, Homo sapiens
caagucauucucaccuaaa

SEQ ID NO: 44775 - RNA, 19 nt, Homo sapiens
auaaauauccugcucacau

SEQ ID NO: 44776 - RNA, 19 nt, Homo sapiens
gaagcgggcagcugagaag

SEQ ID NO: 44777 - RNA, 19 nt, Homo sapiens
ucucuuauaauuccaggua

SEQ ID NO: 44778 - RNA, 19 nt, Homo sapiens
acauuuagccccucucuua

SEQ ID NO: 44779 - RNA, 19 nt, Homo sapiens
cuaaacccucugugaaauu

SEQ ID NO: 44780 - RNA, 19 nt, Homo sapiens
gggaggcaggauccaauaa

SEQ ID NO: 44781 - RNA, 19 nt, Homo sapiens
gaggaggaccagucaucaa

SEQ ID NO: 44782 - RNA, 19 nt, Homo sapiens
gacugaagcaggcaaagga

SEQ ID NO: 44783 - RNA, 19 nt, Homo sapiens
caccuaaacccucugugaa

SEQ ID NO: 44784 - RNA, 19 nt, Homo sapiens
gaaauccuccaaucaaaau

SEQ ID NO: 44785 - RNA, 19 nt, Homo sapiens
caacccugugauacuauua

SEQ ID NO: 44786 - RNA, 19 nt, Homo sapiens
ugugaggguugcuucaaug

SEQ ID NO: 44787 - RNA, 19 nt, Homo sapiens
caaaacagcaucggccaua

SEQ ID NO: 44788 - RNA, 19 nt, Homo sapiens
aaccaggacaagcuacuua

SEQ ID NO: 44789 - RNA, 19 nt, Homo sapiens
ucacugggacuuuguaaac

SEQ ID NO: 44790 - RNA, 19 nt, Homo sapiens
ucuccuuguuguucuuuaa

SEQ ID NO: 44791 - RNA, 19 nt, Homo sapiens
aggaugagauugggagaga

SEQ ID NO: 44792 - RNA, 19 nt, Homo sapiens
uugcuucaaugauuaggaa

SEQ ID NO: 44793 - RNA, 19 nt, Homo sapiens
aggcaggauccaauaauuu

SEQ ID NO: 44794 - RNA, 19 nt, Homo sapiens
ucuauauccuugacaccuu

SEQ ID NO: 44795 - RNA, 19 nt, Homo sapiens
auacuguguucccucauau

SEQ ID NO: 44796 - RNA, 19 nt, Homo sapiens
ccacuuguucauucuguga

SEQ ID NO: 44797 - RNA, 19 nt, Homo sapiens
ugauaauaaugccuaccuu

SEQ ID NO: 44798 - RNA, 19 nt, Homo sapiens
gagaagcgggcagcugaga

SEQ ID NO: 44799 - RNA, 19 nt, Homo sapiens
uuuguagccucucuuuguu

SEQ ID NO: 44800 - RNA, 19 nt, Homo sapiens
cuaauuccacuuguucauu

SEQ ID NO: 44801 - RNA, 19 nt, Homo sapiens
uuguagcagugauucagua

SEQ ID NO: 44802 - RNA, 19 nt, Homo sapiens
gugaaaccaggacaagcua

SEQ ID NO: 44803 - RNA, 19 nt, Homo sapiens
cauaaucccugucuucuuu

SEQ ID NO: 44804 - RNA, 19 nt, Homo sapiens
gaaacugggaugauaauaa

SEQ ID NO: 44805 - RNA, 19 nt, Homo sapiens
gaggagaugacuacauuua

SEQ ID NO: 44806 - RNA, 19 nt, Homo sapiens
gauacuguguucccucaua

SEQ ID NO: 44807 - RNA, 19 nt, Homo sapiens
gcucauugcuuucuaagau

SEQ ID NO: 44808 - RNA, 19 nt, Homo sapiens
gaggguugcuucaaugauu

SEQ ID NO: 44809 - RNA, 19 nt, Homo sapiens
gaggcaggauccaauaauu

SEQ ID NO: 44810 - RNA, 19 nt, Homo sapiens
ucaaagaaauccuccaauc

SEQ ID NO: 44811 - RNA, 19 nt, Homo sapiens
aagaggagaugacuacauu

SEQ ID NO: 44812 - RNA, 19 nt, Homo sapiens
uaaacccucugugaaauuu

SEQ ID NO: 44813 - RNA, 19 nt, Homo sapiens
agauggagguggagcaaua

SEQ ID NO: 44814 - RNA, 19 nt, Homo sapiens
ccagguagauaacugcauu

SEQ ID NO: 44815 - RNA, 19 nt, Homo sapiens
guaaguagcaacccuguga

SEQ ID NO: 44816 - RNA, 19 nt, Homo sapiens
gcugaucuuugucuuuauu

SEQ ID NO: 44817 - RNA, 19 nt, Homo sapiens
ccaagucauucucaccuaa

SEQ ID NO: 44818 - RNA, 19 nt, Homo sapiens
uagcaacccugugauacua

SEQ ID NO: 44819 - RNA, 19 nt, Homo sapiens
caaagaaauccuccaauca

SEQ ID NO: 44820 - RNA, 19 nt, Homo sapiens
guagauaacugcauuuugu

SEQ ID NO: 44821 - RNA, 19 nt, Homo sapiens
aauaaugccuaccuuguga

SEQ ID NO: 44822 - RNA, 19 nt, Homo sapiens
aagaaauccuccaaucaaa

SEQ ID NO: 44823 - RNA, 19 nt, Homo sapiens
uaaauauccugcucacauc

SEQ ID NO: 44824 - RNA, 19 nt, Homo sapiens
aaagaaauccuccaaucaa

SEQ ID NO: 44825 - RNA, 19 nt, Homo sapiens
gaugcucauugcuuucuaa

SEQ ID NO: 44826 - RNA, 19 nt, Homo sapiens
gaggaccagucaucaauag

SEQ ID NO: 44827 - RNA, 19 nt, Homo sapiens
ggaggaccagucaucaaua

SEQ ID NO: 44828 - RNA, 19 nt, Homo sapiens
uugcugaucuuugucuuua

SEQ ID NO: 44829 - RNA, 19 nt, Homo sapiens
gcaacccugugauacuauu

SEQ ID NO: 44830 - RNA, 19 nt, Homo sapiens
ccugugacacuuauaaaua

SEQ ID NO: 44831 - RNA, 19 nt, Homo sapiens
ggagaugacuacauuuagc

SEQ ID NO: 44832 - RNA, 19 nt, Homo sapiens
cuauauccuugacaccuua

SEQ ID NO: 44833 - RNA, 19 nt, Homo sapiens
cccaaagacuuaucagaug

SEQ ID NO: 44834 - RNA, 19 nt, Homo sapiens
uaauuccacuuguucauuc

SEQ ID NO: 44835 - RNA, 19 nt, Homo sapiens
uagcagugauucaguaagu

SEQ ID NO: 44836 - RNA, 19 nt, Homo sapiens
uguaaagucuagcacaguu

SEQ ID NO: 44837 - RNA, 19 nt, Homo sapiens
aaaaucaccucccaccaua

SEQ ID NO: 44838 - RNA, 19 nt, Homo sapiens
guccaucacuggcucucua

SEQ ID NO: 44839 - RNA, 19 nt, Homo sapiens
ggaccagucaucaauagga

SEQ ID NO: 44840 - RNA, 19 nt, Homo sapiens
gguacugccugagcaagaa

SEQ ID NO: 44841 - RNA, 19 nt, Homo sapiens
gcacaguuccuugcauguu

SEQ ID NO: 44842 - RNA, 19 nt, Homo sapiens
ucaauaggaggaugagauu

SEQ ID NO: 44843 - RNA, 19 nt, Homo sapiens
ccaguucccucccucaaag

SEQ ID NO: 44844 - RNA, 19 nt, Homo sapiens
acaccuuacuuucccauug

SEQ ID NO: 44845 - RNA, 19 nt, Homo sapiens
caaaggaggaggcacagau

SEQ ID NO: 44846 - RNA, 19 nt, Homo sapiens
cacaguuccuugcauguug

SEQ ID NO: 44847 - RNA, 19 nt, Homo sapiens
gauguccuccucugugaaa

SEQ ID NO: 44848 - RNA, 19 nt, Homo sapiens
ggaaguaggaauguggaaa

SEQ ID NO: 44849 - RNA, 19 nt, Homo sapiens
ccuaaacccucugugaaau

SEQ ID NO: 44850 - RNA, 19 nt, Homo sapiens
gcagagcucccagcagaga

SEQ ID NO: 44851 - RNA, 19 nt, Homo sapiens
aggacaagcuacuuaacuu

SEQ ID NO: 44852 - RNA, 19 nt, Homo sapiens
gaaucuccuuguuguucuu

SEQ ID NO: 44853 - RNA, 19 nt, Homo sapiens
gagaggaggaccagucauc

SEQ ID NO: 44854 - RNA, 19 nt, Homo sapiens
ggaggcaggauccaauaau

SEQ ID NO: 44855 - RNA, 19 nt, Homo sapiens
aggguugcuucaaugauua

SEQ ID NO: 44856 - RNA, 19 nt, Homo sapiens
caucugaaucuccuuguug

SEQ ID NO: 44857 - RNA, 19 nt, Homo sapiens
gcaugcccuuccuuucuau

SEQ ID NO: 44858 - RNA, 19 nt, Homo sapiens
uaucagaugcucauugcuu

SEQ ID NO: 44859 - RNA, 19 nt, Homo sapiens
caucacuggcucucuaauu

SEQ ID NO: 44860 - RNA, 19 nt, Homo sapiens
caccuuacuuucccauugu

SEQ ID NO: 44861 - RNA, 19 nt, Homo sapiens
ucugugacccuaguuauuu

SEQ ID NO: 44862 - RNA, 19 nt, Homo sapiens
cugugaaacugggaugaua

SEQ ID NO: 44863 - RNA, 19 nt, Homo sapiens
ugcaugcccuuccuuucua

SEQ ID NO: 44864 - RNA, 19 nt, Homo sapiens
gcagugauucaguaaguag

SEQ ID NO: 44865 - RNA, 19 nt, Homo sapiens
uaauaaugccuaccuugug

SEQ ID NO: 44866 - RNA, 19 nt, Homo sapiens
ucgauguccuccucuguga

SEQ ID NO: 44867 - RNA, 19 nt, Homo sapiens
gaugugggucccucucuug

SEQ ID NO: 44868 - RNA, 19 nt, Homo sapiens
gaaguaggaauguggaaaa

SEQ ID NO: 44869 - RNA, 19 nt, Homo sapiens
caagucauucucaccuaaa

SEQ ID NO: 44870 - RNA, 19 nt, Homo sapiens
auaaauauccugcucacau

SEQ ID NO: 44871 - RNA, 19 nt, Homo sapiens
gaggaggaccagucaucaa

SEQ ID NO: 44872 - RNA, 19 nt, Homo sapiens
ucucuuauaauuccaggua

SEQ ID NO: 44873 - RNA, 19 nt, Homo sapiens
acauuuagccccucucuua

SEQ ID NO: 44874 - RNA, 19 nt, Homo sapiens
cuaaacccucugugaaauu

SEQ ID NO: 44875 - RNA, 19 nt, Homo sapiens
gggaggcaggauccaauaa

SEQ ID NO: 44876 - RNA, 19 nt, Homo sapiens
gacugaagcaggcaaagga

SEQ ID NO: 44877 - RNA, 19 nt, Homo sapiens
caccuaaacccucugugaa

SEQ ID NO: 44878 - RNA, 19 nt, Homo sapiens
gaaauccuccaaucaaaau

SEQ ID NO: 44879 - RNA, 19 nt, Homo sapiens
caacccugugauacuauua

SEQ ID NO: 44880 - RNA, 19 nt, Homo sapiens
ugugaggguugcuucaaug

SEQ ID NO: 44881 - RNA, 19 nt, Homo sapiens
aaccaggacaagcuacuua

SEQ ID NO: 44882 - RNA, 19 nt, Homo sapiens
ucacugggacuuuguaaac

SEQ ID NO: 44883 - RNA, 19 nt, Homo sapiens
ucuccuuguuguucuuuaa

SEQ ID NO: 44884 - RNA, 19 nt, Homo sapiens
aggaugagauugggagaga

SEQ ID NO: 44885 - RNA, 19 nt, Homo sapiens
uugcuucaaugauuaggaa

SEQ ID NO: 44886 - RNA, 19 nt, Homo sapiens
aggcaggauccaauaauuu

SEQ ID NO: 44887 - RNA, 19 nt, Homo sapiens
ucuauauccuugacaccuu

SEQ ID NO: 44888 - RNA, 19 nt, Homo sapiens
auacuguguucccucauau

SEQ ID NO: 44889 - RNA, 19 nt, Homo sapiens
ccacuuguucauucuguga

SEQ ID NO: 44890 - RNA, 19 nt, Homo sapiens
ugauaauaaugccuaccuu

SEQ ID NO: 44891 - RNA, 19 nt, Homo sapiens
uuuguagccucucuuuguu

SEQ ID NO: 44892 - RNA, 19 nt, Homo sapiens
gaugagauugggagagaca

SEQ ID NO: 44893 - RNA, 19 nt, Homo sapiens
cuaauuccacuuguucauu

SEQ ID NO: 44894 - RNA, 19 nt, Homo sapiens
uuguagcagugauucagua

SEQ ID NO: 44895 - RNA, 19 nt, Homo sapiens
gugaaaccaggacaagcua

SEQ ID NO: 44896 - RNA, 19 nt, Homo sapiens
cgaugugggucccucucuu

SEQ ID NO: 44897 - RNA, 19 nt, Homo sapiens
gagagcgagagcacgaauu

SEQ ID NO: 44898 - RNA, 19 nt, Homo sapiens
caccauaaucccugucuuc

SEQ ID NO: 44899 - RNA, 19 nt, Homo sapiens
aucagaugcucauugcuuu

SEQ ID NO: 44900 - RNA, 19 nt, Homo sapiens
ucuuauaauuccagguaga

SEQ ID NO: 44901 - RNA, 19 nt, Homo sapiens
gacccuaguuauuuucuga

SEQ ID NO: 44902 - RNA, 19 nt, Homo sapiens
ugaaacugggaugauaaua

SEQ ID NO: 44903 - RNA, 19 nt, Homo sapiens
gaagaugucuguuauccuu

SEQ ID NO: 44904 - RNA, 19 nt, Homo sapiens
ggaagaggcacuccuuuaa

SEQ ID NO: 44905 - RNA, 19 nt, Homo sapiens
ccaauaaacugacguucuu

SEQ ID NO: 44906 - RNA, 19 nt, Homo sapiens
gaacuuaccgagagauaaa

SEQ ID NO: 44907 - RNA, 19 nt, Homo sapiens
ugaaggaaaucaacacaaa

SEQ ID NO: 44908 - RNA, 19 nt, Homo sapiens
gaacauaguagaugcuuau

SEQ ID NO: 44909 - RNA, 19 nt, Homo sapiens
agaaaggaauucaguguuu

SEQ ID NO: 44910 - RNA, 19 nt, Homo sapiens
uagaagaugugaagaaaug

SEQ ID NO: 44911 - RNA, 19 nt, Homo sapiens
gaugaucuuugcucuguuu

SEQ ID NO: 44912 - RNA, 19 nt, Homo sapiens
gaaugagaaugagauguuu

SEQ ID NO: 44913 - RNA, 19 nt, Homo sapiens
ggguugaguuccagaauaa

SEQ ID NO: 44914 - RNA, 19 nt, Homo sapiens
ccaagucucuuaauaucuu

SEQ ID NO: 44915 - RNA, 19 nt, Homo sapiens
gugaagaaauggaucgaaa

SEQ ID NO: 44916 - RNA, 19 nt, Homo sapiens
gaaugaaguuagaagaugu

SEQ ID NO: 44917 - RNA, 19 nt, Homo sapiens
ggaaauuugugaaugaagu

SEQ ID NO: 44918 - RNA, 19 nt, Homo sapiens
caacggaaauuugugaaug

SEQ ID NO: 44919 - RNA, 19 nt, Homo sapiens
ggaggaugcugagauuauu

SEQ ID NO: 44920 - RNA, 19 nt, Homo sapiens
gggaagaggcacuccuuua

SEQ ID NO: 44921 - RNA, 19 nt, Homo sapiens
gaaauggcuucuggaguga

SEQ ID NO: 44922 - RNA, 19 nt, Homo sapiens
ggacaugauugacuuagag

SEQ ID NO: 44923 - RNA, 19 nt, Homo sapiens
guuagaagaugugaagaaa

SEQ ID NO: 44924 - RNA, 19 nt, Homo sapiens
ccagcuccguauacuauua

SEQ ID NO: 44925 - RNA, 19 nt, Homo sapiens
gaagggaaguuugaagagu

SEQ ID NO: 44926 - RNA, 19 nt, Homo sapiens
aaagcuaacauuccgauua

SEQ ID NO: 44927 - RNA, 19 nt, Homo sapiens
agaaauggaucgaaagcuu

SEQ ID NO: 44928 - RNA, 19 nt, Homo sapiens
ugaacaggaugcagacaaa

SEQ ID NO: 44929 - RNA, 19 nt, Homo sapiens
gaaguuagaagaugugaag

SEQ ID NO: 44930 - RNA, 19 nt, Homo sapiens
ugacuuaaauccagaugug

SEQ ID NO: 44931 - RNA, 19 nt, Homo sapiens
ggccgauguuuacuuauaa

SEQ ID NO: 44932 - RNA, 19 nt, Homo sapiens
cggccgauguuuacuuaua

SEQ ID NO: 44933 - RNA, 19 nt, Homo sapiens
guucaguggucgauacauu

SEQ ID NO: 44934 - RNA, 19 nt, Homo sapiens
ccaacaaguuuaccuaugg

SEQ ID NO: 44935 - RNA, 19 nt, Homo sapiens
acucagaaaugcuugauug

SEQ ID NO: 44936 - RNA, 19 nt, Homo sapiens
caacacugccuccuacuug

SEQ ID NO: 44937 - RNA, 19 nt, Homo sapiens
ggacagaaaggaauucagu

SEQ ID NO: 44938 - RNA, 19 nt, Homo sapiens
gcuauuugguuauccuuau

SEQ ID NO: 44939 - RNA, 19 nt, Homo sapiens
gguacucacuagacuggua

SEQ ID NO: 44940 - RNA, 19 nt, Homo sapiens
ccaaggcgaucagcugaaa

SEQ ID NO: 44941 - RNA, 19 nt, Homo sapiens
ggagagaaauccagguacu

SEQ ID NO: 44942 - RNA, 19 nt, Homo sapiens
gaagagugagucccuguga

SEQ ID NO: 44943 - RNA, 19 nt, Homo sapiens
acacuggccucaucuacaa

SEQ ID NO: 44944 - RNA, 19 nt, Homo sapiens
aagaggcacuccuuuaaga

SEQ ID NO: 44945 - RNA, 19 nt, Homo sapiens
aagcuaacauuccgauuau

SEQ ID NO: 44946 - RNA, 19 nt, Homo sapiens
ugaaugaaguuagaagaug

SEQ ID NO: 44947 - RNA, 19 nt, Homo sapiens
ccaggaagaugauauuugc

SEQ ID NO: 44948 - RNA, 19 nt, Homo sapiens
caccagccuugcccucuua

SEQ ID NO: 44949 - RNA, 19 nt, Homo sapiens
gauggcggauccagacuug

SEQ ID NO: 44950 - RNA, 19 nt, Homo sapiens
uuugggaacucucaacuuu

SEQ ID NO: 44951 - RNA, 19 nt, Homo sapiens
agacuucggucauggcauu

SEQ ID NO: 44952 - RNA, 19 nt, Homo sapiens
caaaugguucugaaucaaa

SEQ ID NO: 44953 - RNA, 19 nt, Homo sapiens
gauugaugaucuccaaaug

SEQ ID NO: 44954 - RNA, 19 nt, Homo sapiens
caagccuucugauccauuu

SEQ ID NO: 44955 - RNA, 19 nt, Homo sapiens
ggaguaauacagauucuuc

SEQ ID NO: 44956 - RNA, 19 nt, Homo sapiens
ucacccaucuagacuuuga

SEQ ID NO: 44957 - RNA, 19 nt, Homo sapiens
agaggaggaugcugagauu

SEQ ID NO: 44958 - RNA, 19 nt, Homo sapiens
gcacuacuguguguaccuu

SEQ ID NO: 44959 - RNA, 19 nt, Homo sapiens
cuucguggcuggugucauu

SEQ ID NO: 44960 - RNA, 19 nt, Homo sapiens
gaacugaaggaaaucaaca

SEQ ID NO: 44961 - RNA, 19 nt, Homo sapiens
gugaugaucuuugcucugu

SEQ ID NO: 44962 - RNA, 19 nt, Homo sapiens
gcaccagccuugcccucuu

SEQ ID NO: 44963 - RNA, 19 nt, Homo sapiens
agaugaagaugucuguuau

SEQ ID NO: 44964 - RNA, 19 nt, Homo sapiens
caaguuuaccuauggcuuu

SEQ ID NO: 44965 - RNA, 19 nt, Homo sapiens
ccaaaugguucugaaucaa

SEQ ID NO: 44966 - RNA, 19 nt, Homo sapiens
gaagaggcacuccuuuaag

SEQ ID NO: 44967 - RNA, 19 nt, Homo sapiens
gaaauccagguacucacua

SEQ ID NO: 44968 - RNA, 19 nt, Homo sapiens
gucagaggcugcuuauugu

SEQ ID NO: 44969 - RNA, 19 nt, Homo sapiens
guucaaccauaucuauuuc

SEQ ID NO: 44970 - RNA, 19 nt, Homo sapiens
aagaugaagaugucuguua

SEQ ID NO: 44971 - RNA, 19 nt, Homo sapiens
aguagaugcuuauggaauu

SEQ ID NO: 44972 - RNA, 19 nt, Homo sapiens
gaaaaugaacugaaggaaa

SEQ ID NO: 44973 - RNA, 19 nt, Homo sapiens
gguaacaugucccacucuu

SEQ ID NO: 44974 - RNA, 19 nt, Homo sapiens
gcagacgaguuugacuuug

SEQ ID NO: 44975 - RNA, 19 nt, Homo sapiens
gaaagcauuugggaacucu

SEQ ID NO: 44976 - RNA, 19 nt, Homo sapiens
uacggccgauguuuacuua

SEQ ID NO: 44977 - RNA, 19 nt, Homo sapiens
ucuauuugcugugauguuu

SEQ ID NO: 44978 - RNA, 19 nt, Homo sapiens
cguauacuauuaucacguu

SEQ ID NO: 44979 - RNA, 19 nt, Homo sapiens
cuucaugaccucuuuguuu

SEQ ID NO: 44980 - RNA, 19 nt, Homo sapiens
cuuauggaauuggaacuua

SEQ ID NO: 44981 - RNA, 19 nt, Homo sapiens
guagaugcuuauggaauug

SEQ ID NO: 44982 - RNA, 19 nt, Homo sapiens
gugaauaccaggauugaug

SEQ ID NO: 44983 - RNA, 19 nt, Homo sapiens
agucagaggcugcuuauug

SEQ ID NO: 44984 - RNA, 19 nt, Homo sapiens
caacuaggccaucaugagu

SEQ ID NO: 44985 - RNA, 19 nt, Homo sapiens
gagcuuggcgggagguuug

SEQ ID NO: 44986 - RNA, 19 nt, Homo sapiens
cugaauaucuacuuuggau

SEQ ID NO: 44987 - RNA, 19 nt, Homo sapiens
ccauaucuauuucaagaag

SEQ ID NO: 44988 - RNA, 19 nt, Homo sapiens
uaucauccauaugcuguuu

SEQ ID NO: 44989 - RNA, 19 nt, Homo sapiens
gaagaaugagaaugagaug

SEQ ID NO: 44990 - RNA, 19 nt, Homo sapiens
ggaccgguuucaaguucuu

SEQ ID NO: 44991 - RNA, 19 nt, Homo sapiens
ucauaaacauguuccucuu

SEQ ID NO: 44992 - RNA, 19 nt, Homo sapiens
acaaguggacggccuauga

SEQ ID NO: 44993 - RNA, 19 nt, Homo sapiens
aguggucgauacauuauuu

SEQ ID NO: 44994 - RNA, 19 nt, Homo sapiens
ggaacuuaccgagagauaa

SEQ ID NO: 44995 - RNA, 19 nt, Homo sapiens
gaacugaccgaauuaaaau

SEQ ID NO: 44996 - RNA, 19 nt, Homo sapiens
uagaaagaauucccugagu

SEQ ID NO: 44997 - RNA, 19 nt, Homo sapiens
gggaagggaaguuugaaga

SEQ ID NO: 44998 - RNA, 19 nt, Homo sapiens
uggguugaguuccagaaua

SEQ ID NO: 44999 - RNA, 19 nt, Homo sapiens
cuuggaugcugcuguuuaa

SEQ ID NO: 45000 - RNA, 19 nt, Homo sapiens
gguucaguuucgugacuua

SEQ ID NO: 45001 - RNA, 19 nt, Homo sapiens
ggagugaauaccaggauug

SEQ ID NO: 45002 - RNA, 19 nt, Homo sapiens
guuccgagccucacucuau

SEQ ID NO: 45003 - RNA, 19 nt, Homo sapiens
gauccaggcuuucaacgua

SEQ ID NO: 45004 - RNA, 19 nt, Homo sapiens
gcagcucucuaccuacuua

SEQ ID NO: 45005 - RNA, 19 nt, Homo sapiens
ccaacaagguguacauauu

SEQ ID NO: 45006 - RNA, 19 nt, Homo sapiens
ccacuuaccugcaggagaa

SEQ ID NO: 45007 - RNA, 19 nt, Homo sapiens
gcacuggacugaagagcuu

SEQ ID NO: 45008 - RNA, 19 nt, Homo sapiens
gcaguacacggguuuauuu

SEQ ID NO: 45009 - RNA, 19 nt, Homo sapiens
guuguuuccuuccuaauaa

SEQ ID NO: 45010 - RNA, 19 nt, Homo sapiens
uaagggacaugaauucuag

SEQ ID NO: 45011 - RNA, 19 nt, Homo sapiens
gaacgacucuuugguacca

SEQ ID NO: 45012 - RNA, 19 nt, Homo sapiens
gcaaaugcucccuccuuaa

SEQ ID NO: 45013 - RNA, 19 nt, Homo sapiens
caacaagguguacauauuc

SEQ ID NO: 45014 - RNA, 19 nt, Homo sapiens
gaccauggaucgcuuugau

SEQ ID NO: 45015 - RNA, 19 nt, Homo sapiens
guacacggguuuauuucug

SEQ ID NO: 45016 - RNA, 19 nt, Homo sapiens
ucuccuuucuccuuauuua

SEQ ID NO: 45017 - RNA, 19 nt, Homo sapiens
guaagggacaugaauucua

SEQ ID NO: 45018 - RNA, 19 nt, Homo sapiens
guacauauucugcguagau

SEQ ID NO: 45019 - RNA, 19 nt, Homo sapiens
ccaggaaugugcugcuguu

SEQ ID NO: 45020 - RNA, 19 nt, Homo sapiens
ccacaucaccagcgacuug

SEQ ID NO: 45021 - RNA, 19 nt, Homo sapiens
guaccacagugacauucaa

SEQ ID NO: 45022 - RNA, 19 nt, Homo sapiens
uaugaacgacucuuuggua

SEQ ID NO: 45023 - RNA, 19 nt, Homo sapiens
caaaugcucccuccuuaag

SEQ ID NO: 45024 - RNA, 19 nt, Homo sapiens
gcagcgcacuggacugaag

SEQ ID NO: 45025 - RNA, 19 nt, Homo sapiens
gguuguuuccuuccuaaua

SEQ ID NO: 45026 - RNA, 19 nt, Homo sapiens
gagcuucccucuuccuacu

SEQ ID NO: 45027 - RNA, 19 nt, Homo sapiens
acagugacauucaaguuca

SEQ ID NO: 45028 - RNA, 19 nt, Homo sapiens
ggucuccuuucuccuuauu

SEQ ID NO: 45029 - RNA, 19 nt, Homo sapiens
ucacagggcccagcaucua

SEQ ID NO: 45030 - RNA, 19 nt, Homo sapiens
ccacagugacauucaaguu

SEQ ID NO: 45031 - RNA, 19 nt, Homo sapiens
ccauggaucgcuuugauga

SEQ ID NO: 45032 - RNA, 19 nt, Homo sapiens
caggguggcccgugaugua

SEQ ID NO: 45033 - RNA, 19 nt, Homo sapiens
ggauagugcuuuuguguag

SEQ ID NO: 45034 - RNA, 19 nt, Homo sapiens
gaugaugcuucaggacuuc

SEQ ID NO: 45035 - RNA, 19 nt, Homo sapiens
aggacaagcugagcauuga

SEQ ID NO: 45036 - RNA, 19 nt, Homo sapiens
guccgaagaugucccauac

SEQ ID NO: 45037 - RNA, 19 nt, Homo sapiens
uugaggauuucacagcaua

SEQ ID NO: 45038 - RNA, 19 nt, Homo sapiens
ggcucucacugaccuauga

SEQ ID NO: 45039 - RNA, 19 nt, Homo sapiens
cuucuggaaugacuccuuu

SEQ ID NO: 45040 - RNA, 19 nt, Homo sapiens
gauccauccuccugugagu

SEQ ID NO: 45041 - RNA, 19 nt, Homo sapiens
gcauauggcgguguguuug

SEQ ID NO: 45042 - RNA, 19 nt, Homo sapiens
cugcuuggcugucguuauc

SEQ ID NO: 45043 - RNA, 19 nt, Homo sapiens
gaccuaugaacgacucuuu

SEQ ID NO: 45044 - RNA, 19 nt, Homo sapiens
uuaacugucuguccugcuu

SEQ ID NO: 45045 - RNA, 19 nt, Homo sapiens
ccuauggccugcacaugau

SEQ ID NO: 45046 - RNA, 19 nt, Homo sapiens
gagcauugaggauuucaca

SEQ ID NO: 45047 - RNA, 19 nt, Homo sapiens
caggacaagcugagcauug

SEQ ID NO: 45048 - RNA, 19 nt, Homo sapiens
acuugcagcucucuaccua

SEQ ID NO: 45049 - RNA, 19 nt, Homo sapiens
gcguaagggacaugaauuc

SEQ ID NO: 45050 - RNA, 19 nt, Homo sapiens
ccgcugaggagcuuucuug

SEQ ID NO: 45051 - RNA, 19 nt, Homo sapiens
cgacugugccagcuucuuc

SEQ ID NO: 45052 - RNA, 19 nt, Homo sapiens
agaugaugcuucaggacuu

SEQ ID NO: 45053 - RNA, 19 nt, Homo sapiens
gcugagcauugaggauuuc

SEQ ID NO: 45054 - RNA, 19 nt, Homo sapiens
ccgaagaugucccauacac

SEQ ID NO: 45055 - RNA, 19 nt, Homo sapiens
acacucaaguccgaagaug

SEQ ID NO: 45056 - RNA, 19 nt, Homo sapiens
gcucccuccuuaagguuau

SEQ ID NO: 45057 - RNA, 19 nt, Homo sapiens
ccuggcagaugaugcuuca

SEQ ID NO: 45058 - RNA, 19 nt, Homo sapiens
guuugggaguguggaagua

SEQ ID NO: 45059 - RNA, 19 nt, Homo sapiens
caagcaggacagcgccuuu

SEQ ID NO: 45060 - RNA, 19 nt, Homo sapiens
uccauccuccugugaguua

SEQ ID NO: 45061 - RNA, 19 nt, Homo sapiens
gcacacucaaguccgaaga

SEQ ID NO: 45062 - RNA, 19 nt, Homo sapiens
cgagugaccgggacuugug

SEQ ID NO: 45063 - RNA, 19 nt, Homo sapiens
ggugcuugguuguuuccuu

SEQ ID NO: 45064 - RNA, 19 nt, Homo sapiens
ccaucuugcucccucuuca

SEQ ID NO: 45065 - RNA, 19 nt, Homo sapiens
caagaccauggaucgcuuu

SEQ ID NO: 45066 - RNA, 19 nt, Homo sapiens
gcucuucaucuucaccuau

SEQ ID NO: 45067 - RNA, 19 nt, Homo sapiens
guucaugcucuucaucuuc

SEQ ID NO: 45068 - RNA, 19 nt, Homo sapiens
ccugugaguuacaaugaca

SEQ ID NO: 45069 - RNA, 19 nt, Homo sapiens
ggucgccagcugcuacaaa

SEQ ID NO: 45070 - RNA, 19 nt, Homo sapiens
uuauuucuguggccugaga

SEQ ID NO: 45071 - RNA, 19 nt, Homo sapiens
aagcugagcauugaggauu

SEQ ID NO: 45072 - RNA, 19 nt, Homo sapiens
ccuuucuccuuauuuauuc

SEQ ID NO: 45073 - RNA, 19 nt, Homo sapiens
agggucuccuuucuccuua

SEQ ID NO: 45074 - RNA, 19 nt, Homo sapiens
gguaugcagucagcacucu

SEQ ID NO: 45075 - RNA, 19 nt, Homo sapiens
cugcucaccucccuguuca

SEQ ID NO: 45076 - RNA, 19 nt, Homo sapiens
ggacagcgccuuuucuaac

SEQ ID NO: 45077 - RNA, 19 nt, Homo sapiens
ggcguaagggacaugaauu

SEQ ID NO: 45078 - RNA, 19 nt, Homo sapiens
gcucaccucccuguucaug

SEQ ID NO: 45079 - RNA, 19 nt, Homo sapiens
uacacggguuuauuucugu

SEQ ID NO: 45080 - RNA, 19 nt, Homo sapiens
gaauucuagggucuccuuu

SEQ ID NO: 45081 - RNA, 19 nt, Homo sapiens
ccauggagcgccucgaagu

SEQ ID NO: 45082 - RNA, 19 nt, Homo sapiens
cacagugacauucaaguuc

SEQ ID NO: 45083 - RNA, 19 nt, Homo sapiens
ucaccucccuguucaugcu

SEQ ID NO: 45084 - RNA, 19 nt, Homo sapiens
gaggauuucacagcauaug

SEQ ID NO: 45085 - RNA, 19 nt, Homo sapiens
uacauauucugcguagaug

SEQ ID NO: 45086 - RNA, 19 nt, Homo sapiens
ggcccagcaucuacuccuu

SEQ ID NO: 45087 - RNA, 19 nt, Homo sapiens
gaagaggacucauaaguaa

SEQ ID NO: 45088 - RNA, 19 nt, Homo sapiens
gaacagccauaaccaaaua

SEQ ID NO: 45089 - RNA, 19 nt, Homo sapiens
ggagauggcucauaaggua

SEQ ID NO: 45090 - RNA, 19 nt, Homo sapiens
gaugauaccucaaggaauu

SEQ ID NO: 45091 - RNA, 19 nt, Homo sapiens
ggagagugcugccaguuua

SEQ ID NO: 45092 - RNA, 19 nt, Homo sapiens
aaacacagcuagaguagua

SEQ ID NO: 45093 - RNA, 19 nt, Homo sapiens
ggaaugaucuucuggaugu

SEQ ID NO: 45094 - RNA, 19 nt, Homo sapiens
gauaaacgcucccuaaaca

SEQ ID NO: 45095 - RNA, 19 nt, Homo sapiens
gguauuagcuguaaaguca

SEQ ID NO: 45096 - RNA, 19 nt, Homo sapiens
gcacagauguagccauuga

SEQ ID NO: 45097 - RNA, 19 nt, Homo sapiens
gcagugagguuuacaacaa

SEQ ID NO: 45098 - RNA, 19 nt, Homo sapiens
ggaaagaauucaucuaagu

SEQ ID NO: 45099 - RNA, 19 nt, Homo sapiens
gcaaaggaguccaucauau

SEQ ID NO: 45100 - RNA, 19 nt, Homo sapiens
ggaugugccuucaacuuua

SEQ ID NO: 45101 - RNA, 19 nt, Homo sapiens
gaaaucagcguucauguug

SEQ ID NO: 45102 - RNA, 19 nt, Homo sapiens
gagauaauuucagcucuua

SEQ ID NO: 45103 - RNA, 19 nt, Homo sapiens
gagaauaggucugccauug

SEQ ID NO: 45104 - RNA, 19 nt, Homo sapiens
gcacauugcugaagaccaa

SEQ ID NO: 45105 - RNA, 19 nt, Homo sapiens
acaacaagcccuacaauua

SEQ ID NO: 45106 - RNA, 19 nt, Homo sapiens
caaaggaguccaucauaua

SEQ ID NO: 45107 - RNA, 19 nt, Homo sapiens
ucaagaagcuacuauuguu

SEQ ID NO: 45108 - RNA, 19 nt, Homo sapiens
caaguuggacucuaaguua

SEQ ID NO: 45109 - RNA, 19 nt, Homo sapiens
ugaaggacauucuauggua

SEQ ID NO: 45110 - RNA, 19 nt, Homo sapiens
cuacuaaccucuccagaaa

SEQ ID NO: 45111 - RNA, 19 nt, Homo sapiens
cuaaagaacacaccaguua

SEQ ID NO: 45112 - RNA, 19 nt, Homo sapiens
caaauuugaugccuuguga

SEQ ID NO: 45113 - RNA, 19 nt, Homo sapiens
auaaagcacugaagcauaa

SEQ ID NO: 45114 - RNA, 19 nt, Homo sapiens
guauaacacuuugcuagua

SEQ ID NO: 45115 - RNA, 19 nt, Homo sapiens
gaaaccaacuuacgagagu

SEQ ID NO: 45116 - RNA, 19 nt, Homo sapiens
gauaagacuggaaccauua

SEQ ID NO: 45117 - RNA, 19 nt, Homo sapiens
gaauaggucugccauugug

SEQ ID NO: 45118 - RNA, 19 nt, Homo sapiens
gcuccaauaugucuucuuu

SEQ ID NO: 45119 - RNA, 19 nt, Homo sapiens
gaaagacagucaagaggau

SEQ ID NO: 45120 - RNA, 19 nt, Homo sapiens
gggaguggaugauuagaaa

SEQ ID NO: 45121 - RNA, 19 nt, Homo sapiens
gcaaugggacuguugagua

SEQ ID NO: 45122 - RNA, 19 nt, Homo sapiens
gggauggacuucuuccuuu

SEQ ID NO: 45123 - RNA, 19 nt, Homo sapiens
ugaugacacugcauuauaa

SEQ ID NO: 45124 - RNA, 19 nt, Homo sapiens
gaugggaucugcagcaaug

SEQ ID NO: 45125 - RNA, 19 nt, Homo sapiens
ucacuuagaucauaaacga

SEQ ID NO: 45126 - RNA, 19 nt, Homo sapiens
agaaagaggugauuaugga

SEQ ID NO: 45127 - RNA, 19 nt, Homo sapiens
gcuguaaagucaccaauau

SEQ ID NO: 45128 - RNA, 19 nt, Homo sapiens
ggagauaucauuaaaguag

SEQ ID NO: 45129 - RNA, 19 nt, Homo sapiens
ggucugccauugugaagua

SEQ ID NO: 45130 - RNA, 19 nt, Homo sapiens
caagauggauuucauaugc

SEQ ID NO: 45131 - RNA, 19 nt, Homo sapiens
ucaaagcacuguguauaaa

SEQ ID NO: 45132 - RNA, 19 nt, Homo sapiens
ugaagcagcugaugugguu

SEQ ID NO: 45133 - RNA, 19 nt, Homo sapiens
gaacacagccaguuauucu

SEQ ID NO: 45134 - RNA, 19 nt, Homo sapiens
acugacaacuguucuaaua

SEQ ID NO: 45135 - RNA, 19 nt, Homo sapiens
cagaacgggucacugcuua

SEQ ID NO: 45136 - RNA, 19 nt, Homo sapiens
ucaccuauguggcaccuua

SEQ ID NO: 45137 - RNA, 19 nt, Homo sapiens
caagauguaugguguguca

SEQ ID NO: 45138 - RNA, 19 nt, Homo sapiens
gaaacgauaauacgauuug

SEQ ID NO: 45139 - RNA, 19 nt, Homo sapiens
caacguggagauaucauua

SEQ ID NO: 45140 - RNA, 19 nt, Homo sapiens
gaucucaaaugcucuuaau

SEQ ID NO: 45141 - RNA, 19 nt, Homo sapiens
gugccaggcugugguauua

SEQ ID NO: 45142 - RNA, 19 nt, Homo sapiens
ggaauagcagcuuguagua

SEQ ID NO: 45143 - RNA, 19 nt, Homo sapiens
cauuggagauggcucauaa

SEQ ID NO: 45144 - RNA, 19 nt, Homo sapiens
acacaacccuuucucaaau

SEQ ID NO: 45145 - RNA, 19 nt, Homo sapiens
gcauuugccuacucuuuga

SEQ ID NO: 45146 - RNA, 19 nt, Homo sapiens
ccauacaauugaaagcuua

SEQ ID NO: 45147 - RNA, 19 nt, Homo sapiens
caacaagcccuacaauuag

SEQ ID NO: 45148 - RNA, 19 nt, Homo sapiens
cauaaaguccucauuggua

SEQ ID NO: 45149 - RNA, 19 nt, Homo sapiens
gccgauggcuggaacauau

SEQ ID NO: 45150 - RNA, 19 nt, Homo sapiens
caaugggacuguugaguau

SEQ ID NO: 45151 - RNA, 19 nt, Homo sapiens
ugaagaggacucauaagua

SEQ ID NO: 45152 - RNA, 19 nt, Homo sapiens
uaaacucacuacugucuga

SEQ ID NO: 45153 - RNA, 19 nt, Homo sapiens
cagaauaucacaccauaaa

SEQ ID NO: 45154 - RNA, 19 nt, Homo sapiens
cagaaacgauaauacgauu

SEQ ID NO: 45155 - RNA, 19 nt, Homo sapiens
ggaagaggcacaaacauca

SEQ ID NO: 45156 - RNA, 19 nt, Homo sapiens
cagcauaguaguuucuuua

SEQ ID NO: 45157 - RNA, 19 nt, Homo sapiens
gcgcauaucuuuucuguau

SEQ ID NO: 45158 - RNA, 19 nt, Homo sapiens
gauaaggaaugaucuucug

SEQ ID NO: 45159 - RNA, 19 nt, Homo sapiens
uaaagguagugguauuuga

SEQ ID NO: 45160 - RNA, 19 nt, Homo sapiens
aauaaucccuucuauagug

SEQ ID NO: 45161 - RNA, 19 nt, Homo sapiens
cuaauacacuggucagaga

SEQ ID NO: 45162 - RNA, 19 nt, Homo sapiens
gcguuuaucuguuggcaaa

SEQ ID NO: 45163 - RNA, 19 nt, Homo sapiens
ggaccggauuguuaauuau

SEQ ID NO: 45164 - RNA, 19 nt, Homo sapiens
ggugggagauggaaucaau

SEQ ID NO: 45165 - RNA, 19 nt, Homo sapiens
ucacaagguugcuaaagug

SEQ ID NO: 45166 - RNA, 19 nt, Homo sapiens
ggaauauagaggacaauaa

SEQ ID NO: 45167 - RNA, 19 nt, Homo sapiens
gaugguggguacaggagua

SEQ ID NO: 45168 - RNA, 19 nt, Homo sapiens
gaaagaauucaucuaagug

SEQ ID NO: 45169 - RNA, 19 nt, Homo sapiens
gacaauaaucccuucuaua

SEQ ID NO: 45170 - RNA, 19 nt, Homo sapiens
ugaaggugcuauuaaucua

SEQ ID NO: 45171 - RNA, 19 nt, Homo sapiens
gcacauaggauuuguacuc

SEQ ID NO: 45172 - RNA, 19 nt, Homo sapiens
gguguuugcugaaguucua

SEQ ID NO: 45173 - RNA, 19 nt, Homo sapiens
aaguaaagguucuaacuga

SEQ ID NO: 45174 - RNA, 19 nt, Homo sapiens
uugcaacucuucaccauaa

SEQ ID NO: 45175 - RNA, 19 nt, Homo sapiens
caagugaaguugagaguac

SEQ ID NO: 45176 - RNA, 19 nt, Homo sapiens
uaucugcacuccaauaugu

SEQ ID NO: 45177 - RNA, 19 nt, Homo sapiens
ucagaagggucacagcaaa

SEQ ID NO: 45178 - RNA, 19 nt, Homo sapiens
uagacaagauguuuccaaa

SEQ ID NO: 45179 - RNA, 19 nt, Homo sapiens
ggucuuguauucauauugu

SEQ ID NO: 45180 - RNA, 19 nt, Homo sapiens
caugcugucuuucagauuu

SEQ ID NO: 45181 - RNA, 19 nt, Homo sapiens
gugagugccugguagcuaa

SEQ ID NO: 45182 - RNA, 19 nt, Homo sapiens
agaugugccuuauuuauug

SEQ ID NO: 45183 - RNA, 19 nt, Homo sapiens
ucuauaaacucacuacugu

SEQ ID NO: 45184 - RNA, 19 nt, Homo sapiens
aacaggagcuggacacuga

SEQ ID NO: 45185 - RNA, 19 nt, Homo sapiens
gaacagaaacgauaauacg

SEQ ID NO: 45186 - RNA, 19 nt, Homo sapiens
gagccaaagugaacccuau

SEQ ID NO: 45187 - RNA, 19 nt, Homo sapiens
cuaccaaccugaucaauuu

SEQ ID NO: 45188 - RNA, 19 nt, Homo sapiens
uaaaugacaucacagcaaa

SEQ ID NO: 45189 - RNA, 19 nt, Homo sapiens
caaaguggcugcuucuguu

SEQ ID NO: 45190 - RNA, 19 nt, Homo sapiens
agaauaagcuggagcaagu

SEQ ID NO: 45191 - RNA, 19 nt, Homo sapiens
aaacuuggagcaacaauaa

SEQ ID NO: 45192 - RNA, 19 nt, Homo sapiens
aauggucgauuaagcaaua

SEQ ID NO: 45193 - RNA, 19 nt, Homo sapiens
caggugcgaugcuucagua

SEQ ID NO: 45194 - RNA, 19 nt, Homo sapiens
uaugugaagcguuccauua

SEQ ID NO: 45195 - RNA, 19 nt, Homo sapiens
gagguaccuugcacaguga

SEQ ID NO: 45196 - RNA, 19 nt, Homo sapiens
gugaagcguuccauuaaag

SEQ ID NO: 45197 - RNA, 19 nt, Homo sapiens
cucaagagcuuccuaaguc

SEQ ID NO: 45198 - RNA, 19 nt, Homo sapiens
aaacuguccucaagagcuu

SEQ ID NO: 45199 - RNA, 19 nt, Homo sapiens
gccacacucucugaauuaa

SEQ ID NO: 45200 - RNA, 19 nt, Homo sapiens
gaaauuggaggcuaagacu

SEQ ID NO: 45201 - RNA, 19 nt, Homo sapiens
aagccacacucucugaauu

SEQ ID NO: 45202 - RNA, 19 nt, Homo sapiens
ucaauuugcuugcugaaaa

SEQ ID NO: 45203 - RNA, 19 nt, Homo sapiens
ugugaagcguuccauuaaa

SEQ ID NO: 45204 - RNA, 19 nt, Homo sapiens
uaaacuuggagcaacaaua

SEQ ID NO: 45205 - RNA, 19 nt, Homo sapiens
ucaagagcuuccuaaguca

SEQ ID NO: 45206 - RNA, 19 nt, Homo sapiens
gcuaugccacagcucuuua

SEQ ID NO: 45207 - RNA, 19 nt, Homo sapiens
agacugauccgucaaucuu

SEQ ID NO: 45208 - RNA, 19 nt, Homo sapiens
uauugaaauuggaggcuaa

SEQ ID NO: 45209 - RNA, 19 nt, Homo sapiens
gaauaagcuggagcaagua

SEQ ID NO: 45210 - RNA, 19 nt, Homo sapiens
ugccacagcucuuuauucu

SEQ ID NO: 45211 - RNA, 19 nt, Homo sapiens
gaagccacacucucugaau

SEQ ID NO: 45212 - RNA, 19 nt, Homo sapiens
gaccucugcaucuccuuua

SEQ ID NO: 45213 - RNA, 19 nt, Homo sapiens
agaccaagauucagaagcu

SEQ ID NO: 45214 - RNA, 19 nt, Homo sapiens
gaaaauggucgauuaagca

SEQ ID NO: 45215 - RNA, 19 nt, Homo sapiens
cuaaaugacaucacagcaa

SEQ ID NO: 45216 - RNA, 19 nt, Homo sapiens
ccaaaguggcugcuucugu

SEQ ID NO: 45217 - RNA, 19 nt, Homo sapiens
gagauugucuaaaaguguu

SEQ ID NO: 45218 - RNA, 19 nt, Homo sapiens
gcgcauuggcgagaaauau

SEQ ID NO: 45219 - RNA, 19 nt, Homo sapiens
gaagcguuccauuaaagug

SEQ ID NO: 45220 - RNA, 19 nt, Homo sapiens
agaagaagccacacucucu

SEQ ID NO: 45221 - RNA, 19 nt, Homo sapiens
aggagucguuucugccuuu

SEQ ID NO: 45222 - RNA, 19 nt, Homo sapiens
gcauuggcgagaaauaugu

SEQ ID NO: 45223 - RNA, 19 nt, Homo sapiens
cugcaucuccuuuagaaga

SEQ ID NO: 45224 - RNA, 19 nt, Homo sapiens
aagccuaaaugacaucaca

SEQ ID NO: 45225 - RNA, 19 nt, Homo sapiens
uaagcuggagcaaguagaa

SEQ ID NO: 45226 - RNA, 19 nt, Homo sapiens
gcagggcuaugcgggagau

SEQ ID NO: 45227 - RNA, 19 nt, Homo sapiens
cacacucucugaauuaaaa

SEQ ID NO: 45228 - RNA, 19 nt, Homo sapiens
gugaaaagccuaaaugaca

SEQ ID NO: 45229 - RNA, 19 nt, Homo sapiens
ucaagaccaagauucagaa

SEQ ID NO: 45230 - RNA, 19 nt, Homo sapiens
agccacacucucugaauua

SEQ ID NO: 45231 - RNA, 19 nt, Homo sapiens
gucaagaccaagauucaga

SEQ ID NO: 45232 - RNA, 19 nt, Homo sapiens
uaagucaaggccaaguauu

SEQ ID NO: 45233 - RNA, 19 nt, Homo sapiens
aaaaggaguuguugagagu

SEQ ID NO: 45234 - RNA, 19 nt, Homo sapiens
uaagacugauccgucaauc

SEQ ID NO: 45235 - RNA, 19 nt, Homo sapiens
aauuggaggcuaagacuga

SEQ ID NO: 45236 - RNA, 19 nt, Homo sapiens
aaggccaaguauugaaauu

SEQ ID NO: 45237 - RNA, 19 nt, Homo sapiens
caagagcuuccuaagucaa

SEQ ID NO: 45238 - RNA, 19 nt, Homo sapiens
ccacacucucugaauuaaa

SEQ ID NO: 45239 - RNA, 19 nt, Homo sapiens
guugagaguagcacaaauc

SEQ ID NO: 45240 - RNA, 19 nt, Homo sapiens
gggcuaugcgggagauugu

SEQ ID NO: 45241 - RNA, 19 nt, Homo sapiens
ggcgagaaauauguugaca

SEQ ID NO: 45242 - RNA, 19 nt, Homo sapiens
cuaagucaaggccaaguau

SEQ ID NO: 45243 - RNA, 19 nt, Homo sapiens
ccuaagucaaggccaagua

SEQ ID NO: 45244 - RNA, 19 nt, Homo sapiens
ccucaagagcuuccuaagu

SEQ ID NO: 45245 - RNA, 19 nt, Homo sapiens
ugcaucuccuuuagaagaa

SEQ ID NO: 45246 - RNA, 19 nt, Homo sapiens
uuucuaccaugaugagugu

SEQ ID NO: 45247 - RNA, 19 nt, Homo sapiens
aaaguggcugcuucuguuu

SEQ ID NO: 45248 - RNA, 19 nt, Homo sapiens
caaggccaaguauugaaau

SEQ ID NO: 45249 - RNA, 19 nt, Homo sapiens
aagucaaggccaaguauug

SEQ ID NO: 45250 - RNA, 19 nt, Homo sapiens
gugcgaugcuucaguaccu

SEQ ID NO: 45251 - RNA, 19 nt, Homo sapiens
gaucaauuugcuugcugaa

SEQ ID NO: 45252 - RNA, 19 nt, Homo sapiens
gaguagcacaaauccugaa

SEQ ID NO: 45253 - RNA, 19 nt, Homo sapiens
aaggaguuguugagaguag

SEQ ID NO: 45254 - RNA, 19 nt, Homo sapiens
ucuuaaacuuggagcaaca

SEQ ID NO: 45255 - RNA, 19 nt, Homo sapiens
cagaccauuugccaagcuu

SEQ ID NO: 45256 - RNA, 19 nt, Homo sapiens
aagaagccacacucucuga

SEQ ID NO: 45257 - RNA, 19 nt, Homo sapiens
cucugcaucuccuuuagaa

SEQ ID NO: 45258 - RNA, 19 nt, Homo sapiens
ugaaaagccuaaaugacau

SEQ ID NO: 45259 - RNA, 19 nt, Homo sapiens
gcaaagcccuuguuaaguu

SEQ ID NO: 45260 - RNA, 19 nt, Homo sapiens
gaacagagaccuugggaua

SEQ ID NO: 45261 - RNA, 19 nt, Homo sapiens
gaacaaaacugcccaagua

SEQ ID NO: 45262 - RNA, 19 nt, Homo sapiens
gaauaaaguuccugucauu

SEQ ID NO: 45263 - RNA, 19 nt, Homo sapiens
ggacaaauggcaucacuua

SEQ ID NO: 45264 - RNA, 19 nt, Homo sapiens
gauaaagacugugauguuu

SEQ ID NO: 45265 - RNA, 19 nt, Homo sapiens
guaauuguguccucucuuu

SEQ ID NO: 45266 - RNA, 19 nt, Homo sapiens
ggaauugggugcaaaguca

SEQ ID NO: 45267 - RNA, 19 nt, Homo sapiens
gcaauaccauggcugauga

SEQ ID NO: 45268 - RNA, 19 nt, Homo sapiens
ggacaggauuuccaauuug

SEQ ID NO: 45269 - RNA, 19 nt, Homo sapiens
ggagauggcgcacaagaua

SEQ ID NO: 45270 - RNA, 19 nt, Homo sapiens
gaucacaggucuuccaguu

SEQ ID NO: 45271 - RNA, 19 nt, Homo sapiens
ugacuaggcugaucauuau

SEQ ID NO: 45272 - RNA, 19 nt, Homo sapiens
aaaggaaucugcagaaaga

SEQ ID NO: 45273 - RNA, 19 nt, Homo sapiens
ucugaaagcuguucuacua

SEQ ID NO: 45274 - RNA, 19 nt, Homo sapiens
gagaauagauggaaugcau

SEQ ID NO: 45275 - RNA, 19 nt, Homo sapiens
ggugaucuauucauuguuu

SEQ ID NO: 45276 - RNA, 19 nt, Homo sapiens
uaaagacugugauguuuga

SEQ ID NO: 45277 - RNA, 19 nt, Homo sapiens
ggaagaggcucagauguca

SEQ ID NO: 45278 - RNA, 19 nt, Homo sapiens
acucagagcugcuauagaa

SEQ ID NO: 45279 - RNA, 19 nt, Homo sapiens
ccaagaggcugaggacuuu

SEQ ID NO: 45280 - RNA, 19 nt, Homo sapiens
guacauagucuguuccuuu

SEQ ID NO: 45281 - RNA, 19 nt, Homo sapiens
uccaggagcuccagaauaa

SEQ ID NO: 45282 - RNA, 19 nt, Homo sapiens
gaaaggcagagaucaagua

SEQ ID NO: 45283 - RNA, 19 nt, Homo sapiens
gaagacagccagagcuauu

SEQ ID NO: 45284 - RNA, 19 nt, Homo sapiens
aggcagagaucaaguauga

SEQ ID NO: 45285 - RNA, 19 nt, Homo sapiens
ugacaagacuggcaccauu

SEQ ID NO: 45286 - RNA, 19 nt, Homo sapiens
gaaauaaagcaguggaaga

SEQ ID NO: 45287 - RNA, 19 nt, Homo sapiens
cauaaacguuguguucaua

SEQ ID NO: 45288 - RNA, 19 nt, Homo sapiens
gaagggagcaucuauuuac

SEQ ID NO: 45289 - RNA, 19 nt, Homo sapiens
cgagauagcucaguucauc

SEQ ID NO: 45290 - RNA, 19 nt, Homo sapiens
gacaggauuuccaauuuga

SEQ ID NO: 45291 - RNA, 19 nt, Homo sapiens
caaauacuguaaagaggaa

SEQ ID NO: 45292 - RNA, 19 nt, Homo sapiens
caaagcccuuguuaaguuu

SEQ ID NO: 45293 - RNA, 19 nt, Homo sapiens
cugcaacaguucuuuauaa

SEQ ID NO: 45294 - RNA, 19 nt, Homo sapiens
caaaguggcucccuuaagc

SEQ ID NO: 45295 - RNA, 19 nt, Homo sapiens
gaagaagaguuuugcuuuu

SEQ ID NO: 45296 - RNA, 19 nt, Homo sapiens
uagauggaaugcauuguaa

SEQ ID NO: 45297 - RNA, 19 nt, Homo sapiens
caccuuggaugguuaguuu

SEQ ID NO: 45298 - RNA, 19 nt, Homo sapiens
aaaugguacugcccaaaua

SEQ ID NO: 45299 - RNA, 19 nt, Homo sapiens
ggaagaaagucgccauggu

SEQ ID NO: 45300 - RNA, 19 nt, Homo sapiens
caacaguucuuuauaaucc

SEQ ID NO: 45301 - RNA, 19 nt, Homo sapiens
guucauauauggacaugga

SEQ ID NO: 45302 - RNA, 19 nt, Homo sapiens
uaggaugacugcugugaaa

SEQ ID NO: 45303 - RNA, 19 nt, Homo sapiens
gaggacaauuuaaucauca

SEQ ID NO: 45304 - RNA, 19 nt, Homo sapiens
caagcgcgcuguugauugu

SEQ ID NO: 45305 - RNA, 19 nt, Homo sapiens
ugaaguugguugugauuga

SEQ ID NO: 45306 - RNA, 19 nt, Homo sapiens
gaaaugguacugcccaaau

SEQ ID NO: 45307 - RNA, 19 nt, Homo sapiens
guaauugcgaggucuauaa

SEQ ID NO: 45308 - RNA, 19 nt, Homo sapiens
gacaagacuggcaccauua

SEQ ID NO: 45309 - RNA, 19 nt, Homo sapiens
aagaggccgucaucacuua

SEQ ID NO: 45310 - RNA, 19 nt, Homo sapiens
cagcucaagugcuauaaga

SEQ ID NO: 45311 - RNA, 19 nt, Homo sapiens
uagaagacaugggauuuga

SEQ ID NO: 45312 - RNA, 19 nt, Homo sapiens
ugacauagccaauggacaa

SEQ ID NO: 45313 - RNA, 19 nt, Homo sapiens
gcguggcagucaccaaaua

SEQ ID NO: 45314 - RNA, 19 nt, Homo sapiens
gcagaaagaagcugguguu

SEQ ID NO: 45315 - RNA, 19 nt, Homo sapiens
ggacagaucacaggucuuc

SEQ ID NO: 45316 - RNA, 19 nt, Homo sapiens
gaauagauggaaugcauug

SEQ ID NO: 45317 - RNA, 19 nt, Homo sapiens
gauauugagcgguuacaaa

SEQ ID NO: 45318 - RNA, 19 nt, Homo sapiens
gcauucaccuuuccaagag

SEQ ID NO: 45319 - RNA, 19 nt, Homo sapiens
gaccuucucugugcugauu

SEQ ID NO: 45320 - RNA, 19 nt, Homo sapiens
cagcaaagcccuuguuaag

SEQ ID NO: 45321 - RNA, 19 nt, Homo sapiens
gaaaggaaucugcagaaag

SEQ ID NO: 45322 - RNA, 19 nt, Homo sapiens
ggaauuccauggugcaaac

SEQ ID NO: 45323 - RNA, 19 nt, Homo sapiens
ggaaugcauuguaagucuu

SEQ ID NO: 45324 - RNA, 19 nt, Homo sapiens
gaccauaaacguuguguuc

SEQ ID NO: 45325 - RNA, 19 nt, Homo sapiens
cgaagggagcaucuauuua

SEQ ID NO: 45326 - RNA, 19 nt, Homo sapiens
gaggagcccugugacauuc

SEQ ID NO: 45327 - RNA, 19 nt, Homo sapiens
gaagaacucagagcugcua

SEQ ID NO: 45328 - RNA, 19 nt, Homo sapiens
uaaaguaugacccuucuug

SEQ ID NO: 45329 - RNA, 19 nt, Homo sapiens
caggugaucuauucauugu

SEQ ID NO: 45330 - RNA, 19 nt, Homo sapiens
cuacuaacccucuuggaaa

SEQ ID NO: 45331 - RNA, 19 nt, Homo sapiens
ugacaauguuggcuaugaa

SEQ ID NO: 45332 - RNA, 19 nt, Homo sapiens
ucagggaccauguaaauga

SEQ ID NO: 45333 - RNA, 19 nt, Homo sapiens
gaggacaggauuuccaauu

SEQ ID NO: 45334 - RNA, 19 nt, Homo sapiens
gcugaucauuaucuaaaga

SEQ ID NO: 45335 - RNA, 19 nt, Homo sapiens
ccagggagcuugccacacu

SEQ ID NO: 45336 - RNA, 19 nt, Homo sapiens
gcagggaugaggagcagua

SEQ ID NO: 45337 - RNA, 19 nt, Homo sapiens
ugacagaccacgagaugaa

SEQ ID NO: 45338 - RNA, 19 nt, Homo sapiens
agaaaggaaucugcagaaa

SEQ ID NO: 45339 - RNA, 19 nt, Homo sapiens
gaacucagagcugcuauag

SEQ ID NO: 45340 - RNA, 19 nt, Homo sapiens
caacucagaaugcacuuga

SEQ ID NO: 45341 - RNA, 19 nt, Homo sapiens
ucacaggucuuccaguucu

SEQ ID NO: 45342 - RNA, 19 nt, Homo sapiens
aggacaggauuuccaauuu

SEQ ID NO: 45343 - RNA, 19 nt, Homo sapiens
cagcaugggcuuugucuug

SEQ ID NO: 45344 - RNA, 19 nt, Homo sapiens
gacuuccgcucccuggaua

SEQ ID NO: 45345 - RNA, 19 nt, Homo sapiens
ccaggucagugugcacaua

SEQ ID NO: 45346 - RNA, 19 nt, Homo sapiens
acaaauggcaucacuuaug

SEQ ID NO: 45347 - RNA, 19 nt, Homo sapiens
uaaaguuucucuuccugau

SEQ ID NO: 45348 - RNA, 19 nt, Homo sapiens
caacugagaauagauggaa

SEQ ID NO: 45349 - RNA, 19 nt, Homo sapiens
ggucaaaguguaaggaguu

SEQ ID NO: 45350 - RNA, 19 nt, Homo sapiens
ccgaagggagcaucuauuu

SEQ ID NO: 45351 - RNA, 19 nt, Homo sapiens
ggagaagccaugccaguca

SEQ ID NO: 45352 - RNA, 19 nt, Homo sapiens
aaacugcccaaguaaagua

SEQ ID NO: 45353 - RNA, 19 nt, Homo sapiens
gcuauuacuguccacauuu

SEQ ID NO: 45354 - RNA, 19 nt, Homo sapiens
gagauggcgcacaagauaa

SEQ ID NO: 45355 - RNA, 19 nt, Homo sapiens
gaacugcagaccucacugu

SEQ ID NO: 45356 - RNA, 19 nt, Homo sapiens
gugccaggcuguggaauug

SEQ ID NO: 45357 - RNA, 19 nt, Homo sapiens
gaaccagcaaugaagaaga

SEQ ID NO: 45358 - RNA, 19 nt, Homo sapiens
aaauaaagcaguggaagaa

SEQ ID NO: 45359 - RNA, 19 nt, Homo sapiens
gaacaacacugcugguuug

SEQ ID NO: 45360 - RNA, 19 nt, Homo sapiens
gaaauaagguagacucaau

SEQ ID NO: 45361 - RNA, 19 nt, Homo sapiens
gcccaaauaucaagaaaua

SEQ ID NO: 45362 - RNA, 19 nt, Homo sapiens
gaagucaucuguucauuau

SEQ ID NO: 45363 - RNA, 19 nt, Homo sapiens
caacauaaauccaagaaga

SEQ ID NO: 45364 - RNA, 19 nt, Homo sapiens
cagauaagcuucuagaauu

SEQ ID NO: 45365 - RNA, 19 nt, Homo sapiens
gacaugaucuugccaguaa

SEQ ID NO: 45366 - RNA, 19 nt, Homo sapiens
gagaaaggauuguagacua

SEQ ID NO: 45367 - RNA, 19 nt, Homo sapiens
gaagcaacauuuagugaaa

SEQ ID NO: 45368 - RNA, 19 nt, Homo sapiens
gaagauggauuuauaaagg

SEQ ID NO: 45369 - RNA, 19 nt, Homo sapiens
uaacagaguucccaagauu

SEQ ID NO: 45370 - RNA, 19 nt, Homo sapiens
ggucagcugucuacuguua

SEQ ID NO: 45371 - RNA, 19 nt, Homo sapiens
ggacugccguuaucuauug

SEQ ID NO: 45372 - RNA, 19 nt, Homo sapiens
gcagaagcuuauagaaaua

SEQ ID NO: 45373 - RNA, 19 nt, Homo sapiens
ggaagaaacagcuaacuuu

SEQ ID NO: 45374 - RNA, 19 nt, Homo sapiens
gaugauggcuguuuaaagu

SEQ ID NO: 45375 - RNA, 19 nt, Homo sapiens
ggaaaguucuacaucauga

SEQ ID NO: 45376 - RNA, 19 nt, Homo sapiens
ggagaaaccuuugaaguuc

SEQ ID NO: 45377 - RNA, 19 nt, Homo sapiens
gaaaccuucuguagugaua

SEQ ID NO: 45378 - RNA, 19 nt, Homo sapiens
ggaaaucaguucauauauc

SEQ ID NO: 45379 - RNA, 19 nt, Homo sapiens
gcaacucgccuaacagaua

SEQ ID NO: 45380 - RNA, 19 nt, Homo sapiens
ggaaauaauagccaaagua

SEQ ID NO: 45381 - RNA, 19 nt, Homo sapiens
caaguacuaugacaaauug

SEQ ID NO: 45382 - RNA, 19 nt, Homo sapiens
gaacagauccuugaacaug

SEQ ID NO: 45383 - RNA, 19 nt, Homo sapiens
gaaauuguaugcugcuaug

SEQ ID NO: 45384 - RNA, 19 nt, Homo sapiens
uuacugagcucuaguguug

SEQ ID NO: 45385 - RNA, 19 nt, Homo sapiens
caacuugucuguacucuuc

SEQ ID NO: 45386 - RNA, 19 nt, Homo sapiens
acugauggcugauuauuua

SEQ ID NO: 45387 - RNA, 19 nt, Homo sapiens
gcagaauucuuguaacaga

SEQ ID NO: 45388 - RNA, 19 nt, Homo sapiens
gcagagcucccaugaagua

SEQ ID NO: 45389 - RNA, 19 nt, Homo sapiens
acauuaagcuguaggauuu

SEQ ID NO: 45390 - RNA, 19 nt, Homo sapiens
cuuaagagcuguagaaguu

SEQ ID NO: 45391 - RNA, 19 nt, Homo sapiens
ucaauuagaugaacacaug

SEQ ID NO: 45392 - RNA, 19 nt, Homo sapiens
uaaacaagguuaucacaga

SEQ ID NO: 45393 - RNA, 19 nt, Homo sapiens
caaagaugauucugacauu

SEQ ID NO: 45394 - RNA, 19 nt, Homo sapiens
ucacagagcauacaaacua

SEQ ID NO: 45395 - RNA, 19 nt, Homo sapiens
ccacgaauguuaacucuau

SEQ ID NO: 45396 - RNA, 19 nt, Homo sapiens
uggcagaucucuacaauau

SEQ ID NO: 45397 - RNA, 19 nt, Homo sapiens
cagaccagaucauucauua

SEQ ID NO: 45398 - RNA, 19 nt, Homo sapiens
ggagugcacugaaacagaa

SEQ ID NO: 45399 - RNA, 19 nt, Homo sapiens
gcaacucccuccugucauu

SEQ ID NO: 45400 - RNA, 19 nt, Homo sapiens
gagacaagauuuccaagga

SEQ ID NO: 45401 - RNA, 19 nt, Homo sapiens
gcaaguaaacaguucauuu

SEQ ID NO: 45402 - RNA, 19 nt, Homo sapiens
guagagagauggagaccaa

SEQ ID NO: 45403 - RNA, 19 nt, Homo sapiens
caacucgccuaacagauaa

SEQ ID NO: 45404 - RNA, 19 nt, Homo sapiens
gcagaucucuacaauaugg

SEQ ID NO: 45405 - RNA, 19 nt, Homo sapiens
gaaagccacuucucaacau

SEQ ID NO: 45406 - RNA, 19 nt, Homo sapiens
guaugaaucugcuuuacaa

SEQ ID NO: 45407 - RNA, 19 nt, Homo sapiens
ggacaugugcauuaccuua

SEQ ID NO: 45408 - RNA, 19 nt, Homo sapiens
caacacugcugguuugaga

SEQ ID NO: 45409 - RNA, 19 nt, Homo sapiens
caaaguauuucuagccuau

SEQ ID NO: 45410 - RNA, 19 nt, Homo sapiens
ugacagggcuauucagcua

SEQ ID NO: 45411 - RNA, 19 nt, Homo sapiens
gaaauuauggcaguucuaa

SEQ ID NO: 45412 - RNA, 19 nt, Homo sapiens
gaaacaguagaaccuauua

SEQ ID NO: 45413 - RNA, 19 nt, Homo sapiens
ccgcuaaucuucuaacauu

SEQ ID NO: 45414 - RNA, 19 nt, Homo sapiens
aggaauugcuguugucuua

SEQ ID NO: 45415 - RNA, 19 nt, Homo sapiens
agaaacagcuaacuuugaa

SEQ ID NO: 45416 - RNA, 19 nt, Homo sapiens
ucaggaacaucuuggauuu

SEQ ID NO: 45417 - RNA, 19 nt, Homo sapiens
uaaagaaacugcagcuauc

SEQ ID NO: 45418 - RNA, 19 nt, Homo sapiens
caaaggcaguuguauugaa

SEQ ID NO: 45419 - RNA, 19 nt, Homo sapiens
acaagaagcuacugaugaa

SEQ ID NO: 45420 - RNA, 19 nt, Homo sapiens
cgaagagcaugugaaguua

SEQ ID NO: 45421 - RNA, 19 nt, Homo sapiens
ggagguuuaugcagaaauu

SEQ ID NO: 45422 - RNA, 19 nt, Homo sapiens
gagcuuaccuugcguaugc

SEQ ID NO: 45423 - RNA, 19 nt, Homo sapiens
gaacuggccuucgauucaa

SEQ ID NO: 45424 - RNA, 19 nt, Homo sapiens
guacagaagccaagacaaa

SEQ ID NO: 45425 - RNA, 19 nt, Homo sapiens
gaucauauccuggaagauu

SEQ ID NO: 45426 - RNA, 19 nt, Homo sapiens
cgucucagcucgucucuaa

SEQ ID NO: 45427 - RNA, 19 nt, Homo sapiens
gguuguaucuguucaauuc

SEQ ID NO: 45428 - RNA, 19 nt, Homo sapiens
gaagaaacagcuaacuuug

SEQ ID NO: 45429 - RNA, 19 nt, Homo sapiens
agagagaaauggcuuuaaa

SEQ ID NO: 45430 - RNA, 19 nt, Homo sapiens
gaaauaaugagcugaagga

SEQ ID NO: 45431 - RNA, 19 nt, Homo sapiens
gaauuugcuucuauacuug

SEQ ID NO: 45432 - RNA, 19 nt, Homo sapiens
caaggacugucaacauaaa

SEQ ID NO: 45433 - RNA, 19 nt, Homo sapiens
gaaaguauggaaaucauug

SEQ ID NO: 45434 - RNA, 19 nt, Homo sapiens
caagcaauguggaugauga

SEQ ID NO: 45435 - RNA, 19 nt, Homo sapiens
ccacuuauguuuguaaaug

SEQ ID NO: 45436 - RNA, 19 nt, Homo sapiens
ccaaagcgccacugaauga

SEQ ID NO: 45437 - RNA, 19 nt, Homo sapiens
uaaugucaaugguugguua

SEQ ID NO: 45438 - RNA, 19 nt, Homo sapiens
gaaagcaaugcaauuauga

SEQ ID NO: 45439 - RNA, 19 nt, Homo sapiens
uaagguagacucaauggua

SEQ ID NO: 45440 - RNA, 19 nt, Homo sapiens
gggaugcugugcaagauuu

SEQ ID NO: 45441 - RNA, 19 nt, Homo sapiens
gacaagauuuccaaggauu

SEQ ID NO: 45442 - RNA, 19 nt, Homo sapiens
uaacuuggaugucauugga

SEQ ID NO: 45443 - RNA, 19 nt, Homo sapiens
guaugaaucugugguugua

SEQ ID NO: 45444 - RNA, 19 nt, Homo sapiens
agaaaggauuguagacuaa

SEQ ID NO: 45445 - RNA, 19 nt, Homo sapiens
guagaagaagcaacauuua

SEQ ID NO: 45446 - RNA, 19 nt, Homo sapiens
caaacuauuuagcuccaua

SEQ ID NO: 45447 - RNA, 19 nt, Homo sapiens
guacaaaugaggaaugauu

SEQ ID NO: 45448 - RNA, 19 nt, Homo sapiens
ugaaagcaaugcaauuaug

SEQ ID NO: 45449 - RNA, 19 nt, Homo sapiens
uuacaaagguucgacauga

SEQ ID NO: 45450 - RNA, 19 nt, Homo sapiens
ggaguugcuuucuauuuau

SEQ ID NO: 45451 - RNA, 19 nt, Homo sapiens
aggaguugcuuucuauuua

SEQ ID NO: 45452 - RNA, 19 nt, Homo sapiens
gaaguaauccgggcuaguu

SEQ ID NO: 45453 - RNA, 19 nt, Homo sapiens
gaagagccauuaucaaagc

SEQ ID NO: 45454 - RNA, 19 nt, Homo sapiens
guaaucaagacucgaaaua

SEQ ID NO: 45455 - RNA, 19 nt, Homo sapiens
gggagaaaccuuugaaguu

SEQ ID NO: 45456 - RNA, 19 nt, Homo sapiens
guacaaaggcauaugaaug

SEQ ID NO: 45457 - RNA, 19 nt, Homo sapiens
cgaguggacagaugaauua

SEQ ID NO: 45458 - RNA, 19 nt, Homo sapiens
gaucagcauaccauaaaua

SEQ ID NO: 45459 - RNA, 19 nt, Homo sapiens
gcuaagagcucuauaauuu

SEQ ID NO: 45460 - RNA, 19 nt, Homo sapiens
gaagugggcugaagaauuu

SEQ ID NO: 45461 - RNA, 19 nt, Homo sapiens
gcaaagaacuucaucuaaa

SEQ ID NO: 45462 - RNA, 19 nt, Homo sapiens
ggaacuagcucuucagaaa

SEQ ID NO: 45463 - RNA, 19 nt, Homo sapiens
ccaaagagaugauuaagaa

SEQ ID NO: 45464 - RNA, 19 nt, Homo sapiens
gaggaaaccuucaauugua

SEQ ID NO: 45465 - RNA, 19 nt, Homo sapiens
ggaaguaacucugauauga

SEQ ID NO: 45466 - RNA, 19 nt, Homo sapiens
gauaguagcucaaguggaa

SEQ ID NO: 45467 - RNA, 19 nt, Homo sapiens
gcagagaaauuccuaaaga

SEQ ID NO: 45468 - RNA, 19 nt, Homo sapiens
ggaaagaguucaaggaaga

SEQ ID NO: 45469 - RNA, 19 nt, Homo sapiens
ugaaacagcuuaagaauuc

SEQ ID NO: 45470 - RNA, 19 nt, Homo sapiens
gaagaaaggugagcaguga

SEQ ID NO: 45471 - RNA, 19 nt, Homo sapiens
gaagaugcgucuaaugaaa

SEQ ID NO: 45472 - RNA, 19 nt, Homo sapiens
gagaagcaaucuacaauga

SEQ ID NO: 45473 - RNA, 19 nt, Homo sapiens
aaacugggcuccugcuuua

SEQ ID NO: 45474 - RNA, 19 nt, Homo sapiens
gaacauacauccagauuuu

SEQ ID NO: 45475 - RNA, 19 nt, Homo sapiens
gaacaccacuucaaaauaa

SEQ ID NO: 45476 - RNA, 19 nt, Homo sapiens
gacaacaggucaaucauuu

SEQ ID NO: 45477 - RNA, 19 nt, Homo sapiens
gaugaaaccuccaugaguu

SEQ ID NO: 45478 - RNA, 19 nt, Homo sapiens
gaagcaagcugacauuaca

SEQ ID NO: 45479 - RNA, 19 nt, Homo sapiens
acacacagcugaguucuua

SEQ ID NO: 45480 - RNA, 19 nt, Homo sapiens
gcaagaagauggugguguu

SEQ ID NO: 45481 - RNA, 19 nt, Homo sapiens
gaugaagccuuaucuaaau

SEQ ID NO: 45482 - RNA, 19 nt, Homo sapiens
ccacagauuuccucucuaa

SEQ ID NO: 45483 - RNA, 19 nt, Homo sapiens
ggaaaguucugaagauaau

SEQ ID NO: 45484 - RNA, 19 nt, Homo sapiens
ggagaagucuugcaguuau

SEQ ID NO: 45485 - RNA, 19 nt, Homo sapiens
gccaggagcuugauguuaa

SEQ ID NO: 45486 - RNA, 19 nt, Homo sapiens
gaggaaaguucugaagaua

SEQ ID NO: 45487 - RNA, 19 nt, Homo sapiens
gaaagaagaugguuguaac

SEQ ID NO: 45488 - RNA, 19 nt, Homo sapiens
caaagagcauaaagucaua

SEQ ID NO: 45489 - RNA, 19 nt, Homo sapiens
gcagugggauguggacuua

SEQ ID NO: 45490 - RNA, 19 nt, Homo sapiens
gaccaugcguuucaacaua

SEQ ID NO: 45491 - RNA, 19 nt, Homo sapiens
gauguuagcuggauguguu

SEQ ID NO: 45492 - RNA, 19 nt, Homo sapiens
gguuguaacucuucugaua

SEQ ID NO: 45493 - RNA, 19 nt, Homo sapiens
gaagcaaucuacaaugaug

SEQ ID NO: 45494 - RNA, 19 nt, Homo sapiens
cagaguauauucagaguuu

SEQ ID NO: 45495 - RNA, 19 nt, Homo sapiens
gaacaaggucugcaaagaa

SEQ ID NO: 45496 - RNA, 19 nt, Homo sapiens
gaauuuagaagcagaagua

SEQ ID NO: 45497 - RNA, 19 nt, Homo sapiens
gaggagguauuaaaucaaa

SEQ ID NO: 45498 - RNA, 19 nt, Homo sapiens
gaaagcaaguugaauacau

SEQ ID NO: 45499 - RNA, 19 nt, Homo sapiens
gcacaucucuuaacugcau

SEQ ID NO: 45500 - RNA, 19 nt, Homo sapiens
ggauauaauuucagcugua

SEQ ID NO: 45501 - RNA, 19 nt, Homo sapiens
caacagaggagguauuaaa

SEQ ID NO: 45502 - RNA, 19 nt, Homo sapiens
agacuuaaauuccgaguuu

SEQ ID NO: 45503 - RNA, 19 nt, Homo sapiens
gcacuaggauugugauaca

SEQ ID NO: 45504 - RNA, 19 nt, Homo sapiens
gaaaacaaguccuuccaua

SEQ ID NO: 45505 - RNA, 19 nt, Homo sapiens
uaacaggugugggcaauaa

SEQ ID NO: 45506 - RNA, 19 nt, Homo sapiens
agucauagaugcuaaguuu

SEQ ID NO: 45507 - RNA, 19 nt, Homo sapiens
gauggaugcuguaaacaaa

SEQ ID NO: 45508 - RNA, 19 nt, Homo sapiens
caaaguauguagaaucaga

SEQ ID NO: 45509 - RNA, 19 nt, Homo sapiens
agaagaaccucaauaugaa

SEQ ID NO: 45510 - RNA, 19 nt, Homo sapiens
gcagguguguauuuacuuu

SEQ ID NO: 45511 - RNA, 19 nt, Homo sapiens
gcaguuaucuuagcauugu

SEQ ID NO: 45512 - RNA, 19 nt, Homo sapiens
gaagaagaguugacugaag

SEQ ID NO: 45513 - RNA, 19 nt, Homo sapiens
guacuucucuuugaaauuc

SEQ ID NO: 45514 - RNA, 19 nt, Homo sapiens
gaugaaggccauauucuaa

SEQ ID NO: 45515 - RNA, 19 nt, Homo sapiens
gagaucgacuuccuaagaa

SEQ ID NO: 45516 - RNA, 19 nt, Homo sapiens
gaaaagcauucaaguauga

SEQ ID NO: 45517 - RNA, 19 nt, Homo sapiens
cuacuuagaucacuuaaca

SEQ ID NO: 45518 - RNA, 19 nt, Homo sapiens
gcuugagguuucugaauua

SEQ ID NO: 45519 - RNA, 19 nt, Homo sapiens
guauuaagguucaagaaga

SEQ ID NO: 45520 - RNA, 19 nt, Homo sapiens
ggaaagaugauaaaggaaa

SEQ ID NO: 45521 - RNA, 19 nt, Homo sapiens
gaaaucaguucugcuacaa

SEQ ID NO: 45522 - RNA, 19 nt, Homo sapiens
gguggaaacuugauuuguu

SEQ ID NO: 45523 - RNA, 19 nt, Homo sapiens
agaagaaucugaagaaaca

SEQ ID NO: 45524 - RNA, 19 nt, Homo sapiens
uaaacagccuuaaguauag

SEQ ID NO: 45525 - RNA, 19 nt, Homo sapiens
guacaggcguuagcauuaa

SEQ ID NO: 45526 - RNA, 19 nt, Homo sapiens
gcaaguaacuaagcaguca

SEQ ID NO: 45527 - RNA, 19 nt, Homo sapiens
aaagaaaucuccagguuca

SEQ ID NO: 45528 - RNA, 19 nt, Homo sapiens
ugagagaggugauagaaau

SEQ ID NO: 45529 - RNA, 19 nt, Homo sapiens
gaaaacagguagauaguga

SEQ ID NO: 45530 - RNA, 19 nt, Homo sapiens
caccauggaugaaacuaua

SEQ ID NO: 45531 - RNA, 19 nt, Homo sapiens
gaauauguguuagcuguga

SEQ ID NO: 45532 - RNA, 19 nt, Homo sapiens
gaguaucauuguaugguua

SEQ ID NO: 45533 - RNA, 19 nt, Homo sapiens
caaaguggcucaucaucau

SEQ ID NO: 45534 - RNA, 19 nt, Homo sapiens
caucugauacugagaaaua

SEQ ID NO: 45535 - RNA, 19 nt, Homo sapiens
guggagaguucaucuguaa

SEQ ID NO: 45536 - RNA, 19 nt, Homo sapiens
gaaacuugauuuguuguga

SEQ ID NO: 45537 - RNA, 19 nt, Homo sapiens
ucaaagugcuguuuaguag

SEQ ID NO: 45538 - RNA, 19 nt, Homo sapiens
ggauugugauacagaauuu

SEQ ID NO: 45539 - RNA, 19 nt, Homo sapiens
caaagaagaagaagaguug

SEQ ID NO: 45540 - RNA, 19 nt, Homo sapiens
gugaagagucggaaacuua

SEQ ID NO: 45541 - RNA, 19 nt, Homo sapiens
gaagcuaaacuuucaagaa

SEQ ID NO: 45542 - RNA, 19 nt, Homo sapiens
gaugucacuucuuccuuua

SEQ ID NO: 45543 - RNA, 19 nt, Homo sapiens
acaaagaaaucuccagguu

SEQ ID NO: 45544 - RNA, 19 nt, Homo sapiens
cagcggagcuauaaacaga

SEQ ID NO: 45545 - RNA, 19 nt, Homo sapiens
aagagaaacucccuaagaa

SEQ ID NO: 45546 - RNA, 19 nt, Homo sapiens
gaagagaagcaaucuacaa

SEQ ID NO: 45547 - RNA, 19 nt, Homo sapiens
ugaaugagcuuacugaacu

SEQ ID NO: 45548 - RNA, 19 nt, Homo sapiens
ggagaagacagaagauaaa

SEQ ID NO: 45549 - RNA, 19 nt, Homo sapiens
cggagaaucuggagaagaa

SEQ ID NO: 45550 - RNA, 19 nt, Homo sapiens
gaauagaauugccaagaag

SEQ ID NO: 45551 - RNA, 19 nt, Homo sapiens
gcagaaggcacaguugaua

SEQ ID NO: 45552 - RNA, 19 nt, Homo sapiens
cagaggagguauuaaauca

SEQ ID NO: 45553 - RNA, 19 nt, Homo sapiens
aagaagaaccucaauauga

SEQ ID NO: 45554 - RNA, 19 nt, Homo sapiens
caaagaagacuaguucaaa

SEQ ID NO: 45555 - RNA, 19 nt, Homo sapiens
ugaguuguuuggaugauua

SEQ ID NO: 45556 - RNA, 19 nt, Homo sapiens
gagccagacuuauuagaug

SEQ ID NO: 45557 - RNA, 19 nt, Homo sapiens
gaagacagaagauaaagau

SEQ ID NO: 45558 - RNA, 19 nt, Homo sapiens
ucaaggaggaggauuauuu

SEQ ID NO: 45559 - RNA, 19 nt, Homo sapiens
gcuaagagcucuauaauuu

SEQ ID NO: 45560 - RNA, 19 nt, Homo sapiens
gaagugggcugaagaauuu

SEQ ID NO: 45561 - RNA, 19 nt, Homo sapiens
gcaaagaacuucaucuaaa

SEQ ID NO: 45562 - RNA, 19 nt, Homo sapiens
ggaacuagcucuucagaaa

SEQ ID NO: 45563 - RNA, 19 nt, Homo sapiens
ccaaagagaugauuaagaa

SEQ ID NO: 45564 - RNA, 19 nt, Homo sapiens
gaggaaaccuucaauugua

SEQ ID NO: 45565 - RNA, 19 nt, Homo sapiens
ggaaguaacucugauauga

SEQ ID NO: 45566 - RNA, 19 nt, Homo sapiens
gauaguagcucaaguggaa

SEQ ID NO: 45567 - RNA, 19 nt, Homo sapiens
gcagagaaauuccuaaaga

SEQ ID NO: 45568 - RNA, 19 nt, Homo sapiens
ggaaagaguucaaggaaga

SEQ ID NO: 45569 - RNA, 19 nt, Homo sapiens
ugaaacagcuuaagaauuc

SEQ ID NO: 45570 - RNA, 19 nt, Homo sapiens
gaagaaaggugagcaguga

SEQ ID NO: 45571 - RNA, 19 nt, Homo sapiens
gaagaugcgucuaaugaaa

SEQ ID NO: 45572 - RNA, 19 nt, Homo sapiens
gagaagcaaucuacaauga

SEQ ID NO: 45573 - RNA, 19 nt, Homo sapiens
aaacugggcuccugcuuua

SEQ ID NO: 45574 - RNA, 19 nt, Homo sapiens
gaacauacauccagauuuu

SEQ ID NO: 45575 - RNA, 19 nt, Homo sapiens
gaacaccacuucaaaauaa

SEQ ID NO: 45576 - RNA, 19 nt, Homo sapiens
gacaacaggucaaucauuu

SEQ ID NO: 45577 - RNA, 19 nt, Homo sapiens
gaugaaaccuccaugaguu

SEQ ID NO: 45578 - RNA, 19 nt, Homo sapiens
gaagcaagcugacauuaca

SEQ ID NO: 45579 - RNA, 19 nt, Homo sapiens
acacacagcugaguucuua

SEQ ID NO: 45580 - RNA, 19 nt, Homo sapiens
gcaagaagauggugguguu

SEQ ID NO: 45581 - RNA, 19 nt, Homo sapiens
gaugaagccuuaucuaaau

SEQ ID NO: 45582 - RNA, 19 nt, Homo sapiens
ccacagauuuccucucuaa

SEQ ID NO: 45583 - RNA, 19 nt, Homo sapiens
ggaaaguucugaagauaau

SEQ ID NO: 45584 - RNA, 19 nt, Homo sapiens
ggagaagucuugcaguuau

SEQ ID NO: 45585 - RNA, 19 nt, Homo sapiens
gccaggagcuugauguuaa

SEQ ID NO: 45586 - RNA, 19 nt, Homo sapiens
gaggaaaguucugaagaua

SEQ ID NO: 45587 - RNA, 19 nt, Homo sapiens
gaaagaagaugguuguaac

SEQ ID NO: 45588 - RNA, 19 nt, Homo sapiens
caaagagcauaaagucaua

SEQ ID NO: 45589 - RNA, 19 nt, Homo sapiens
gcagugggauguggacuua

SEQ ID NO: 45590 - RNA, 19 nt, Homo sapiens
gaccaugcguuucaacaua

SEQ ID NO: 45591 - RNA, 19 nt, Homo sapiens
gauguuagcuggauguguu

SEQ ID NO: 45592 - RNA, 19 nt, Homo sapiens
gguuguaacucuucugaua

SEQ ID NO: 45593 - RNA, 19 nt, Homo sapiens
gaagcaaucuacaaugaug

SEQ ID NO: 45594 - RNA, 19 nt, Homo sapiens
cagaguauauucagaguuu

SEQ ID NO: 45595 - RNA, 19 nt, Homo sapiens
gaacaaggucugcaaagaa

SEQ ID NO: 45596 - RNA, 19 nt, Homo sapiens
gaggagguauuaaaucaaa

SEQ ID NO: 45597 - RNA, 19 nt, Homo sapiens
gaaagcaaguugaauacau

SEQ ID NO: 45598 - RNA, 19 nt, Homo sapiens
gcacaucucuuaacugcau

SEQ ID NO: 45599 - RNA, 19 nt, Homo sapiens
ggauauaauuucagcugua

SEQ ID NO: 45600 - RNA, 19 nt, Homo sapiens
caacagaggagguauuaaa

SEQ ID NO: 45601 - RNA, 19 nt, Homo sapiens
agacuuaaauuccgaguuu

SEQ ID NO: 45602 - RNA, 19 nt, Homo sapiens
gcacuaggauugugauaca

SEQ ID NO: 45603 - RNA, 19 nt, Homo sapiens
gaaaacaaguccuuccaua

SEQ ID NO: 45604 - RNA, 19 nt, Homo sapiens
uaacaggugugggcaauaa

SEQ ID NO: 45605 - RNA, 19 nt, Homo sapiens
agucauagaugcuaaguuu

SEQ ID NO: 45606 - RNA, 19 nt, Homo sapiens
gauggaugcuguaaacaaa

SEQ ID NO: 45607 - RNA, 19 nt, Homo sapiens
caaaguauguagaaucaga

SEQ ID NO: 45608 - RNA, 19 nt, Homo sapiens
agaagaaccucaauaugaa

SEQ ID NO: 45609 - RNA, 19 nt, Homo sapiens
gcagguguguauuuacuuu

SEQ ID NO: 45610 - RNA, 19 nt, Homo sapiens
gcaguuaucuuagcauugu

SEQ ID NO: 45611 - RNA, 19 nt, Homo sapiens
gaagaagaguugacugaag

SEQ ID NO: 45612 - RNA, 19 nt, Homo sapiens
guacuucucuuugaaauuc

SEQ ID NO: 45613 - RNA, 19 nt, Homo sapiens
gaugaaggccauauucuaa

SEQ ID NO: 45614 - RNA, 19 nt, Homo sapiens
gagaucgacuuccuaagaa

SEQ ID NO: 45615 - RNA, 19 nt, Homo sapiens
gaaaagcauucaaguauga

SEQ ID NO: 45616 - RNA, 19 nt, Homo sapiens
cuacuuagaucacuuaaca

SEQ ID NO: 45617 - RNA, 19 nt, Homo sapiens
gcuugagguuucugaauua

SEQ ID NO: 45618 - RNA, 19 nt, Homo sapiens
guauuaagguucaagaaga

SEQ ID NO: 45619 - RNA, 19 nt, Homo sapiens
ggaaagaugauaaaggaaa

SEQ ID NO: 45620 - RNA, 19 nt, Homo sapiens
gaaaucaguucugcuacaa

SEQ ID NO: 45621 - RNA, 19 nt, Homo sapiens
gguggaaacuugauuuguu

SEQ ID NO: 45622 - RNA, 19 nt, Homo sapiens
agaagaaucugaagaaaca

SEQ ID NO: 45623 - RNA, 19 nt, Homo sapiens
uaaacagccuuaaguauag

SEQ ID NO: 45624 - RNA, 19 nt, Homo sapiens
guacaggcguuagcauuaa

SEQ ID NO: 45625 - RNA, 19 nt, Homo sapiens
gcaaguaacuaagcaguca

SEQ ID NO: 45626 - RNA, 19 nt, Homo sapiens
aaagaaaucuccagguuca

SEQ ID NO: 45627 - RNA, 19 nt, Homo sapiens
ugagagaggugauagaaau

SEQ ID NO: 45628 - RNA, 19 nt, Homo sapiens
gaaaacagguagauaguga

SEQ ID NO: 45629 - RNA, 19 nt, Homo sapiens
caccauggaugaaacuaua

SEQ ID NO: 45630 - RNA, 19 nt, Homo sapiens
gaauauguguuagcuguga

SEQ ID NO: 45631 - RNA, 19 nt, Homo sapiens
gaguaucauuguaugguua

SEQ ID NO: 45632 - RNA, 19 nt, Homo sapiens
caaaguggcucaucaucau

SEQ ID NO: 45633 - RNA, 19 nt, Homo sapiens
caucugauacugagaaaua

SEQ ID NO: 45634 - RNA, 19 nt, Homo sapiens
guggagaguucaucuguaa

SEQ ID NO: 45635 - RNA, 19 nt, Homo sapiens
gaaacuugauuuguuguga

SEQ ID NO: 45636 - RNA, 19 nt, Homo sapiens
ucaaagugcuguuuaguag

SEQ ID NO: 45637 - RNA, 19 nt, Homo sapiens
ggauugugauacagaauuu

SEQ ID NO: 45638 - RNA, 19 nt, Homo sapiens
caaagaagaagaagaguug

SEQ ID NO: 45639 - RNA, 19 nt, Homo sapiens
gugaagagucggaaacuua

SEQ ID NO: 45640 - RNA, 19 nt, Homo sapiens
gaagcuaaacuuucaagaa

SEQ ID NO: 45641 - RNA, 19 nt, Homo sapiens
gaugucacuucuuccuuua

SEQ ID NO: 45642 - RNA, 19 nt, Homo sapiens
acaaagaaaucuccagguu

SEQ ID NO: 45643 - RNA, 19 nt, Homo sapiens
cagcggagcuauaaacaga

SEQ ID NO: 45644 - RNA, 19 nt, Homo sapiens
aagagaaacucccuaagaa

SEQ ID NO: 45645 - RNA, 19 nt, Homo sapiens
gaagagaagcaaucuacaa

SEQ ID NO: 45646 - RNA, 19 nt, Homo sapiens
ugaaugagcuuacugaacu

SEQ ID NO: 45647 - RNA, 19 nt, Homo sapiens
ggagaagacagaagauaaa

SEQ ID NO: 45648 - RNA, 19 nt, Homo sapiens
cggagaaucuggagaagaa

SEQ ID NO: 45649 - RNA, 19 nt, Homo sapiens
gaauagaauugccaagaag

SEQ ID NO: 45650 - RNA, 19 nt, Homo sapiens
gcagaaggcacaguugaua

SEQ ID NO: 45651 - RNA, 19 nt, Homo sapiens
cagaggagguauuaaauca

SEQ ID NO: 45652 - RNA, 19 nt, Homo sapiens
aagaagaaccucaauauga

SEQ ID NO: 45653 - RNA, 19 nt, Homo sapiens
caaagaagacuaguucaaa

SEQ ID NO: 45654 - RNA, 19 nt, Homo sapiens
ugaguuguuuggaugauua

SEQ ID NO: 45655 - RNA, 19 nt, Homo sapiens
gagccagacuuauuagaug

SEQ ID NO: 45656 - RNA, 19 nt, Homo sapiens
gaagacagaagauaaagau

SEQ ID NO: 45657 - RNA, 19 nt, Homo sapiens
ucaaggaggaggauuauuu

SEQ ID NO: 45658 - RNA, 19 nt, Homo sapiens
gaggaacaaagaacaaaua

SEQ ID NO: 45659 - RNA, 19 nt, Homo sapiens
gcuaagagcucuauaauuu

SEQ ID NO: 45660 - RNA, 19 nt, Homo sapiens
gaagugggcugaagaauuu

SEQ ID NO: 45661 - RNA, 19 nt, Homo sapiens
gcaaagaacuucaucuaaa

SEQ ID NO: 45662 - RNA, 19 nt, Homo sapiens
ggaacuagcucuucagaaa

SEQ ID NO: 45663 - RNA, 19 nt, Homo sapiens
ccaaagagaugauuaagaa

SEQ ID NO: 45664 - RNA, 19 nt, Homo sapiens
gaggaaaccuucaauugua

SEQ ID NO: 45665 - RNA, 19 nt, Homo sapiens
ggaaguaacucugauauga

SEQ ID NO: 45666 - RNA, 19 nt, Homo sapiens
gauaguagcucaaguggaa

SEQ ID NO: 45667 - RNA, 19 nt, Homo sapiens
gcagagaaauuccuaaaga

SEQ ID NO: 45668 - RNA, 19 nt, Homo sapiens
ggaaagaguucaaggaaga

SEQ ID NO: 45669 - RNA, 19 nt, Homo sapiens
ugaaacagcuuaagaauuc

SEQ ID NO: 45670 - RNA, 19 nt, Homo sapiens
gaagaaaggugagcaguga

SEQ ID NO: 45671 - RNA, 19 nt, Homo sapiens
gaagaugcgucuaaugaaa

SEQ ID NO: 45672 - RNA, 19 nt, Homo sapiens
gagaagcaaucuacaauga

SEQ ID NO: 45673 - RNA, 19 nt, Homo sapiens
aaacugggcuccugcuuua

SEQ ID NO: 45674 - RNA, 19 nt, Homo sapiens
gaacauacauccagauuuu

SEQ ID NO: 45675 - RNA, 19 nt, Homo sapiens
gaacaccacuucaaaauaa

SEQ ID NO: 45676 - RNA, 19 nt, Homo sapiens
gacaacaggucaaucauuu

SEQ ID NO: 45677 - RNA, 19 nt, Homo sapiens
gcacauagaagauacuuaa

SEQ ID NO: 45678 - RNA, 19 nt, Homo sapiens
gaugaaaccuccaugaguu

SEQ ID NO: 45679 - RNA, 19 nt, Homo sapiens
gaagcaagcugacauuaca

SEQ ID NO: 45680 - RNA, 19 nt, Homo sapiens
acacacagcugaguucuua

SEQ ID NO: 45681 - RNA, 19 nt, Homo sapiens
gcaagaagauggugguguu

SEQ ID NO: 45682 - RNA, 19 nt, Homo sapiens
gaugaagccuuaucuaaau

SEQ ID NO: 45683 - RNA, 19 nt, Homo sapiens
ccacagauuuccucucuaa

SEQ ID NO: 45684 - RNA, 19 nt, Homo sapiens
ggaaaguucugaagauaau

SEQ ID NO: 45685 - RNA, 19 nt, Homo sapiens
ggagaagucuugcaguuau

SEQ ID NO: 45686 - RNA, 19 nt, Homo sapiens
gccaggagcuugauguuaa

SEQ ID NO: 45687 - RNA, 19 nt, Homo sapiens
gaggaaaguucugaagaua

SEQ ID NO: 45688 - RNA, 19 nt, Homo sapiens
gaaagaagaugguuguaac

SEQ ID NO: 45689 - RNA, 19 nt, Homo sapiens
caaagagcauaaagucaua

SEQ ID NO: 45690 - RNA, 19 nt, Homo sapiens
gcagugggauguggacuua

SEQ ID NO: 45691 - RNA, 19 nt, Homo sapiens
gaccaugcguuucaacaua

SEQ ID NO: 45692 - RNA, 19 nt, Homo sapiens
gauguuagcuggauguguu

SEQ ID NO: 45693 - RNA, 19 nt, Homo sapiens
gguuguaacucuucugaua

SEQ ID NO: 45694 - RNA, 19 nt, Homo sapiens
gaagcaaucuacaaugaug

SEQ ID NO: 45695 - RNA, 19 nt, Homo sapiens
cagaguauauucagaguuu

SEQ ID NO: 45696 - RNA, 19 nt, Homo sapiens
gaacaaggucugcaaagaa

SEQ ID NO: 45697 - RNA, 19 nt, Homo sapiens
gaauuuagaagcagaagua

SEQ ID NO: 45698 - RNA, 19 nt, Homo sapiens
gaggagguauuaaaucaaa

SEQ ID NO: 45699 - RNA, 19 nt, Homo sapiens
ccaaagaauuaccuaguuu

SEQ ID NO: 45700 - RNA, 19 nt, Homo sapiens
gaaagcaaguugaauacau

SEQ ID NO: 45701 - RNA, 19 nt, Homo sapiens
gcacaucucuuaacugcau

SEQ ID NO: 45702 - RNA, 19 nt, Homo sapiens
ggauauaauuucagcugua

SEQ ID NO: 45703 - RNA, 19 nt, Homo sapiens
caacagaggagguauuaaa

SEQ ID NO: 45704 - RNA, 19 nt, Homo sapiens
agacuuaaauuccgaguuu

SEQ ID NO: 45705 - RNA, 19 nt, Homo sapiens
gcacuaggauugugauaca

SEQ ID NO: 45706 - RNA, 19 nt, Homo sapiens
gaaaacaaguccuuccaua

SEQ ID NO: 45707 - RNA, 19 nt, Homo sapiens
uaacaggugugggcaauaa

SEQ ID NO: 45708 - RNA, 19 nt, Homo sapiens
agucauagaugcuaaguuu

SEQ ID NO: 45709 - RNA, 19 nt, Homo sapiens
gauggaugcuguaaacaaa

SEQ ID NO: 45710 - RNA, 19 nt, Homo sapiens
caaaguauguagaaucaga

SEQ ID NO: 45711 - RNA, 19 nt, Homo sapiens
agaagaaccucaauaugaa

SEQ ID NO: 45712 - RNA, 19 nt, Homo sapiens
gcagguguguauuuacuuu

SEQ ID NO: 45713 - RNA, 19 nt, Homo sapiens
gcaguuaucuuagcauugu

SEQ ID NO: 45714 - RNA, 19 nt, Homo sapiens
gaagaagaguugacugaag

SEQ ID NO: 45715 - RNA, 19 nt, Homo sapiens
guacuucucuuugaaauuc

SEQ ID NO: 45716 - RNA, 19 nt, Homo sapiens
gaugaaggccauauucuaa

SEQ ID NO: 45717 - RNA, 19 nt, Homo sapiens
gagaucgacuuccuaagaa

SEQ ID NO: 45718 - RNA, 19 nt, Homo sapiens
gaaaagcauucaaguauga

SEQ ID NO: 45719 - RNA, 19 nt, Homo sapiens
cuacuuagaucacuuaaca

SEQ ID NO: 45720 - RNA, 19 nt, Homo sapiens
gcuugagguuucugaauua

SEQ ID NO: 45721 - RNA, 19 nt, Homo sapiens
guauuaagguucaagaaga

SEQ ID NO: 45722 - RNA, 19 nt, Homo sapiens
ggaaagaugauaaaggaaa

SEQ ID NO: 45723 - RNA, 19 nt, Homo sapiens
gaaaucaguucugcuacaa

SEQ ID NO: 45724 - RNA, 19 nt, Homo sapiens
gguggaaacuugauuuguu

SEQ ID NO: 45725 - RNA, 19 nt, Homo sapiens
agaagaaucugaagaaaca

SEQ ID NO: 45726 - RNA, 19 nt, Homo sapiens
uaaacagccuuaaguauag

SEQ ID NO: 45727 - RNA, 19 nt, Homo sapiens
guacaggcguuagcauuaa

SEQ ID NO: 45728 - RNA, 19 nt, Homo sapiens
gcaaguaacuaagcaguca

SEQ ID NO: 45729 - RNA, 19 nt, Homo sapiens
aaagaaaucuccagguuca

SEQ ID NO: 45730 - RNA, 19 nt, Homo sapiens
ugagagaggugauagaaau

SEQ ID NO: 45731 - RNA, 19 nt, Homo sapiens
gaaaacagguagauaguga

SEQ ID NO: 45732 - RNA, 19 nt, Homo sapiens
caccauggaugaaacuaua

SEQ ID NO: 45733 - RNA, 19 nt, Homo sapiens
gaauauguguuagcuguga

SEQ ID NO: 45734 - RNA, 19 nt, Homo sapiens
gaguaucauuguaugguua

SEQ ID NO: 45735 - RNA, 19 nt, Homo sapiens
caaaguggcucaucaucau

SEQ ID NO: 45736 - RNA, 19 nt, Homo sapiens
caucugauacugagaaaua

SEQ ID NO: 45737 - RNA, 19 nt, Homo sapiens
guggagaguucaucuguaa

SEQ ID NO: 45738 - RNA, 19 nt, Homo sapiens
gaaacuugauuuguuguga

SEQ ID NO: 45739 - RNA, 19 nt, Homo sapiens
ucaaagugcuguuuaguag

SEQ ID NO: 45740 - RNA, 19 nt, Homo sapiens
ggauugugauacagaauuu

SEQ ID NO: 45741 - RNA, 19 nt, Homo sapiens
caaagaagaagaagaguug

SEQ ID NO: 45742 - RNA, 19 nt, Homo sapiens
gugaagagucggaaacuua

SEQ ID NO: 45743 - RNA, 19 nt, Homo sapiens
gaagcuaaacuuucaagaa

SEQ ID NO: 45744 - RNA, 19 nt, Homo sapiens
gaugucacuucuuccuuua

SEQ ID NO: 45745 - RNA, 19 nt, Homo sapiens
acaaagaaaucuccagguu

SEQ ID NO: 45746 - RNA, 19 nt, Homo sapiens
cagcggagcuauaaacaga

SEQ ID NO: 45747 - RNA, 19 nt, Homo sapiens
aagagaaacucccuaagaa

SEQ ID NO: 45748 - RNA, 19 nt, Homo sapiens
gaagagaagcaaucuacaa

SEQ ID NO: 45749 - RNA, 19 nt, Homo sapiens
ugaaugagcuuacugaacu

SEQ ID NO: 45750 - RNA, 19 nt, Homo sapiens
ggagaagacagaagauaaa

SEQ ID NO: 45751 - RNA, 19 nt, Homo sapiens
cggagaaucuggagaagaa

SEQ ID NO: 45752 - RNA, 19 nt, Homo sapiens
gaauagaauugccaagaag

SEQ ID NO: 45753 - RNA, 19 nt, Homo sapiens
gcagaaggcacaguugaua

SEQ ID NO: 45754 - RNA, 19 nt, Homo sapiens
cagaggagguauuaaauca

SEQ ID NO: 45755 - RNA, 19 nt, Homo sapiens
aagaagaaccucaauauga

SEQ ID NO: 45756 - RNA, 19 nt, Homo sapiens
caaagaagacuaguucaaa

SEQ ID NO: 45757 - RNA, 19 nt, Homo sapiens
ugaguuguuuggaugauua

SEQ ID NO: 45758 - RNA, 19 nt, Homo sapiens
gagccagacuuauuagaug

SEQ ID NO: 45759 - RNA, 19 nt, Homo sapiens
ggacagagcgggaguguga

SEQ ID NO: 45760 - RNA, 19 nt, Homo sapiens
gaagaagacagauuucauu

SEQ ID NO: 45761 - RNA, 19 nt, Homo sapiens
cagcaucucugccgaauau

SEQ ID NO: 45762 - RNA, 19 nt, Homo sapiens
ccacauagcccuguaauau

SEQ ID NO: 45763 - RNA, 19 nt, Homo sapiens
guaccgagauuccguguug

SEQ ID NO: 45764 - RNA, 19 nt, Homo sapiens
gaagguacaauuccaguuu

SEQ ID NO: 45765 - RNA, 19 nt, Homo sapiens
ucagcuacauggagauuua

SEQ ID NO: 45766 - RNA, 19 nt, Homo sapiens
acagucaacucggaaauua

SEQ ID NO: 45767 - RNA, 19 nt, Homo sapiens
gaagaguuccggcagcuuu

SEQ ID NO: 45768 - RNA, 19 nt, Homo sapiens
caacagagacagacaagga

SEQ ID NO: 45769 - RNA, 19 nt, Homo sapiens
gaaagacaguagccaagca

SEQ ID NO: 45770 - RNA, 19 nt, Homo sapiens
ccaaguccuucauugagua

SEQ ID NO: 45771 - RNA, 19 nt, Homo sapiens
gcccagcacuuucaucaga

SEQ ID NO: 45772 - RNA, 19 nt, Homo sapiens
ggaaacagagaagaucaua

SEQ ID NO: 45773 - RNA, 19 nt, Homo sapiens
gcuaaaaucuccuuugaug

SEQ ID NO: 45774 - RNA, 19 nt, Homo sapiens
ccaaugcccugguggguau

SEQ ID NO: 45775 - RNA, 19 nt, Homo sapiens
acauggagauuuacuguga

SEQ ID NO: 45776 - RNA, 19 nt, Homo sapiens
gguccaagcucuccagaag

SEQ ID NO: 45777 - RNA, 19 nt, Homo sapiens
acauagcccuguaauauuc

SEQ ID NO: 45778 - RNA, 19 nt, Homo sapiens
aagcauagacagacuuaua

SEQ ID NO: 45779 - RNA, 19 nt, Homo sapiens
cuacgucaauggcaagaaa

SEQ ID NO: 45780 - RNA, 19 nt, Homo sapiens
ggaagcaccaccaccauug

SEQ ID NO: 45781 - RNA, 19 nt, Homo sapiens
gcagacaccuacgucaaug

SEQ ID NO: 45782 - RNA, 19 nt, Homo sapiens
acaugacacucuccgcuua

SEQ ID NO: 45783 - RNA, 19 nt, Homo sapiens
caucuugucucucaacauc

SEQ ID NO: 45784 - RNA, 19 nt, Homo sapiens
cagaaggccuccuccuaga

SEQ ID NO: 45785 - RNA, 19 nt, Homo sapiens
gcugucaccuccuacaaug

SEQ ID NO: 45786 - RNA, 19 nt, Homo sapiens
gccauuagcagguuucuug

SEQ ID NO: 45787 - RNA, 19 nt, Homo sapiens
ccgaugaagucaacaacaa

SEQ ID NO: 45788 - RNA, 19 nt, Homo sapiens
ucaagacacccaacacauu

SEQ ID NO: 45789 - RNA, 19 nt, Homo sapiens
cgagucagcccgaucguuu

SEQ ID NO: 45790 - RNA, 19 nt, Homo sapiens
caucugcggugucccuuug

SEQ ID NO: 45791 - RNA, 19 nt, Homo sapiens
ccaagugcaucauucagau

SEQ ID NO: 45792 - RNA, 19 nt, Homo sapiens
gcaccaccaccauuguuaa

SEQ ID NO: 45793 - RNA, 19 nt, Homo sapiens
ucacugacaugaccaaugc

SEQ ID NO: 45794 - RNA, 19 nt, Homo sapiens
gcgaagcuguggugaccuu

SEQ ID NO: 45795 - RNA, 19 nt, Homo sapiens
agacuuuccucucuuuguu

SEQ ID NO: 45796 - RNA, 19 nt, Homo sapiens
gcucuuugcugcugcaucu

SEQ ID NO: 45797 - RNA, 19 nt, Homo sapiens
gaaacagucaacucggaaa

SEQ ID NO: 45798 - RNA, 19 nt, Homo sapiens
caagacacccaacacauuc

SEQ ID NO: 45799 - RNA, 19 nt, Homo sapiens
cccaacaucuugucucuca

SEQ ID NO: 45800 - RNA, 19 nt, Homo sapiens
ccacagagccccugaagaa

SEQ ID NO: 45801 - RNA, 19 nt, Homo sapiens
gaacgaggacccgcugaug

SEQ ID NO: 45802 - RNA, 19 nt, Homo sapiens
gaaggaaacagagaagauc

SEQ ID NO: 45803 - RNA, 19 nt, Homo sapiens
ggagaagacuaggcacuac

SEQ ID NO: 45804 - RNA, 19 nt, Homo sapiens
cgaauaugccgacaucuuc

SEQ ID NO: 45805 - RNA, 19 nt, Homo sapiens
gcaacgccaucuuccucaa

SEQ ID NO: 45806 - RNA, 19 nt, Homo sapiens
cugagugccugcucuacua

SEQ ID NO: 45807 - RNA, 19 nt, Homo sapiens
ggcaaguccuacaccauga

SEQ ID NO: 45808 - RNA, 19 nt, Homo sapiens
gggccaagggcacagguua

SEQ ID NO: 45809 - RNA, 19 nt, Homo sapiens
ccacuucccucgggucaug

SEQ ID NO: 45810 - RNA, 19 nt, Homo sapiens
gcaggacauuguucugagu

SEQ ID NO: 45811 - RNA, 19 nt, Homo sapiens
cgaggaggccauugaaaga

SEQ ID NO: 45812 - RNA, 19 nt, Homo sapiens
gggccaacaucaacaaguc

SEQ ID NO: 45813 - RNA, 19 nt, Homo sapiens
guggcuggcuuggugguua

SEQ ID NO: 45814 - RNA, 19 nt, Homo sapiens
ccgcuuauaucgagaugga

SEQ ID NO: 45815 - RNA, 19 nt, Homo sapiens
ucaggaaaccgcaucauca

SEQ ID NO: 45816 - RNA, 19 nt, Homo sapiens
gcagcgaggaggccauuga

SEQ ID NO: 45817 - RNA, 19 nt, Homo sapiens
cugcaaugcugucaucaau

SEQ ID NO: 45818 - RNA, 19 nt, Homo sapiens
gauacaacgugugcaucuu

SEQ ID NO: 45819 - RNA, 19 nt, Homo sapiens
cagggaagaucggaauuca

SEQ ID NO: 45820 - RNA, 19 nt, Homo sapiens
cuagacagcucugagaaag

SEQ ID NO: 45821 - RNA, 19 nt, Homo sapiens
ggcgagaaauggagugagu

SEQ ID NO: 45822 - RNA, 19 nt, Homo sapiens
ccuguaauauucagaugga

SEQ ID NO: 45823 - RNA, 19 nt, Homo sapiens
ccacgaaggccacagagau

SEQ ID NO: 45824 - RNA, 19 nt, Homo sapiens
ugaccaaguccuucauuga

SEQ ID NO: 45825 - RNA, 19 nt, Homo sapiens
gggaaaaccugggcgguaa

SEQ ID NO: 45826 - RNA, 19 nt, Homo sapiens
cacauagcccuguaauauu

SEQ ID NO: 45827 - RNA, 19 nt, Homo sapiens
uuagugacauugaaacagu

SEQ ID NO: 45828 - RNA, 19 nt, Homo sapiens
guuaguuagugacauugaa

SEQ ID NO: 45829 - RNA, 19 nt, Homo sapiens
gcgacaaggacaugcauga

SEQ ID NO: 45830 - RNA, 19 nt, Homo sapiens
gugaccaaguccuucauug

SEQ ID NO: 45831 - RNA, 19 nt, Homo sapiens
gaaggccuccuccuagaca

SEQ ID NO: 45832 - RNA, 19 nt, Homo sapiens
cugcagacaucaacuacga

SEQ ID NO: 45833 - RNA, 19 nt, Homo sapiens
gcauagacagacuuauaau

SEQ ID NO: 45834 - RNA, 19 nt, Homo sapiens
agaaugugcucugguggaa

SEQ ID NO: 45835 - RNA, 19 nt, Homo sapiens
uccaagcucuccagaagga

SEQ ID NO: 45836 - RNA, 19 nt, Homo sapiens
acaacucucuccugcugaa

SEQ ID NO: 45837 - RNA, 19 nt, Homo sapiens
caacucggaaauuaacuau

SEQ ID NO: 45838 - RNA, 19 nt, Homo sapiens
caugagacaggcagccaua

SEQ ID NO: 45839 - RNA, 19 nt, Homo sapiens
ccaccaagcucagcacacu

SEQ ID NO: 45840 - RNA, 19 nt, Homo sapiens
caccugaggacaucaacua

SEQ ID NO: 45841 - RNA, 19 nt, Homo sapiens
gcgaggaggccauugaaag

SEQ ID NO: 45842 - RNA, 19 nt, Homo sapiens
ccacgagcgcaucuuguuu

SEQ ID NO: 45843 - RNA, 19 nt, Homo sapiens
ggagggagaacgcacaucu

SEQ ID NO: 45844 - RNA, 19 nt, Homo sapiens
uacguuaguuagugacauu

SEQ ID NO: 45845 - RNA, 19 nt, Homo sapiens
ggucuucuauucccgugau

SEQ ID NO: 45846 - RNA, 19 nt, Homo sapiens
gaccucuucucucggauca

SEQ ID NO: 45847 - RNA, 19 nt, Homo sapiens
ggauuacggugacacuacu

SEQ ID NO: 45848 - RNA, 19 nt, Homo sapiens
gcccgaucguuuccaagaa

SEQ ID NO: 45849 - RNA, 19 nt, Homo sapiens
aggaggagcccgaggauga

SEQ ID NO: 45850 - RNA, 19 nt, Homo sapiens
gaagcagggcaucgacaug

SEQ ID NO: 45851 - RNA, 19 nt, Homo sapiens
gaagcaccaccaccauugu

SEQ ID NO: 45852 - RNA, 19 nt, Homo sapiens
ggaggagcacugcgucuuc

SEQ ID NO: 45853 - RNA, 19 nt, Homo sapiens
uccgcgagcugaaggauga

SEQ ID NO: 45854 - RNA, 19 nt, Homo sapiens
ggacccaacaagaacaaga

SEQ ID NO: 45855 - RNA, 19 nt, Homo sapiens
ccacggagaaggugagcaa

SEQ ID NO: 45856 - RNA, 19 nt, Homo sapiens
ccagaggccuagggagguu

SEQ ID NO: 45857 - RNA, 19 nt, Homo sapiens
uuucuaaugccuccacaua

SEQ ID NO: 45858 - RNA, 19 nt, Homo sapiens
gaccaaguccuucauugag

SEQ ID NO: 45859 - RNA, 19 nt, Homo sapiens
aaacagagcuuauggcaaa

SEQ ID NO: 45860 - RNA, 19 nt, Homo sapiens
gaacagcuacauauacaua

SEQ ID NO: 45861 - RNA, 19 nt, Homo sapiens
gaaaguacggaccauaaua

SEQ ID NO: 45862 - RNA, 19 nt, Homo sapiens
gaagagcagauuauucaua

SEQ ID NO: 45863 - RNA, 19 nt, Homo sapiens
gcacauggaaccuuaauga

SEQ ID NO: 45864 - RNA, 19 nt, Homo sapiens
cauaugaggcuuucuguua

SEQ ID NO: 45865 - RNA, 19 nt, Homo sapiens
gagcagugauuaacgauau

SEQ ID NO: 45866 - RNA, 19 nt, Homo sapiens
ggaggucgauuuaguaaca

SEQ ID NO: 45867 - RNA, 19 nt, Homo sapiens
gaaacagaaucaaaguuag

SEQ ID NO: 45868 - RNA, 19 nt, Homo sapiens
gaaacaaaauuggcgauua

SEQ ID NO: 45869 - RNA, 19 nt, Homo sapiens
gaaugucccuggccaagga

SEQ ID NO: 45870 - RNA, 19 nt, Homo sapiens
guaauaagcgucuggaaug

SEQ ID NO: 45871 - RNA, 19 nt, Homo sapiens
ccaaggagcucauauucuc

SEQ ID NO: 45872 - RNA, 19 nt, Homo sapiens
guacggaccauaauaauca

SEQ ID NO: 45873 - RNA, 19 nt, Homo sapiens
cuacugugcugcauuaaga

SEQ ID NO: 45874 - RNA, 19 nt, Homo sapiens
ggauggaggucgauuuagu

SEQ ID NO: 45875 - RNA, 19 nt, Homo sapiens
gaaccuuaaugaccaaagu

SEQ ID NO: 45876 - RNA, 19 nt, Homo sapiens
gaggagaaccgaggaauug

SEQ ID NO: 45877 - RNA, 19 nt, Homo sapiens
ugucuacugugcugcauua

SEQ ID NO: 45878 - RNA, 19 nt, Homo sapiens
caaagugaagagcagauua

SEQ ID NO: 45879 - RNA, 19 nt, Homo sapiens
uaagagcagugauuaacga

SEQ ID NO: 45880 - RNA, 19 nt, Homo sapiens
gcucagaccauuccaacaa

SEQ ID NO: 45881 - RNA, 19 nt, Homo sapiens
gauggaggucgauuuagua

SEQ ID NO: 45882 - RNA, 19 nt, Homo sapiens
agaagaagcuuguuaugcu

SEQ ID NO: 45883 - RNA, 19 nt, Homo sapiens
gugcugaccuuaaggaaag

SEQ ID NO: 45884 - RNA, 19 nt, Homo sapiens
aaaguacggaccauaauaa

SEQ ID NO: 45885 - RNA, 19 nt, Homo sapiens
gaauuguggugcuuggaau

SEQ ID NO: 45886 - RNA, 19 nt, Homo sapiens
ggaccuggcgagagaguuu

SEQ ID NO: 45887 - RNA, 19 nt, Homo sapiens
ccagugaaguugguccuuu

SEQ ID NO: 45888 - RNA, 19 nt, Homo sapiens
auaugaggcuuucuguuaa

SEQ ID NO: 45889 - RNA, 19 nt, Homo sapiens
ccauagaagaagcuuguua

SEQ ID NO: 45890 - RNA, 19 nt, Homo sapiens
ggaggagaaccgaggaauu

SEQ ID NO: 45891 - RNA, 19 nt, Homo sapiens
gcuuugaaaucugauaaga

SEQ ID NO: 45892 - RNA, 19 nt, Homo sapiens
ggaauuguggugcuuggaa

SEQ ID NO: 45893 - RNA, 19 nt, Homo sapiens
ggcuacagcucugagauga

SEQ ID NO: 45894 - RNA, 19 nt, Homo sapiens
ggaaagagccaaaaugagu

SEQ ID NO: 45895 - RNA, 19 nt, Homo sapiens
gcauacgaacagcuacaua

SEQ ID NO: 45896 - RNA, 19 nt, Homo sapiens
cauagaagaagcuuguuau

SEQ ID NO: 45897 - RNA, 19 nt, Homo sapiens
caaaaugaguuccagugaa

SEQ ID NO: 45898 - RNA, 19 nt, Homo sapiens
aagaaaguacggaccauaa

SEQ ID NO: 45899 - RNA, 19 nt, Homo sapiens
uaagaaaguacggaccaua

SEQ ID NO: 45900 - RNA, 19 nt, Homo sapiens
aagagcagauuauucauac

SEQ ID NO: 45901 - RNA, 19 nt, Homo sapiens
acgaacagcuacauauaca

SEQ ID NO: 45902 - RNA, 19 nt, Homo sapiens
auacgaacagcuacauaua

SEQ ID NO: 45903 - RNA, 19 nt, Homo sapiens
cuacagcucugagaugaag

SEQ ID NO: 45904 - RNA, 19 nt, Homo sapiens
gugauuaacgauauugcua

SEQ ID NO: 45905 - RNA, 19 nt, Homo sapiens
caaaauaagagcagugauu

SEQ ID NO: 45906 - RNA, 19 nt, Homo sapiens
cauacgaacagcuacauau

SEQ ID NO: 45907 - RNA, 19 nt, Homo sapiens
gauuauucauacgguguaa

SEQ ID NO: 45908 - RNA, 19 nt, Homo sapiens
uaaagcuaguaguguauag

SEQ ID NO: 45909 - RNA, 19 nt, Homo sapiens
caauagauggacucgcuuu

SEQ ID NO: 45910 - RNA, 19 nt, Homo sapiens
gagugaaaacuaccuaaua

SEQ ID NO: 45911 - RNA, 19 nt, Homo sapiens
uggaugcuuugaaaucuga

SEQ ID NO: 45912 - RNA, 19 nt, Homo sapiens
aaagugaagagcagauuau

SEQ ID NO: 45913 - RNA, 19 nt, Homo sapiens
ggccaaggagcucauauuc

SEQ ID NO: 45914 - RNA, 19 nt, Homo sapiens
cucagcacauggaaccuua

SEQ ID NO: 45915 - RNA, 19 nt, Homo sapiens
uaugaggcuuucuguuaau

SEQ ID NO: 45916 - RNA, 19 nt, Homo sapiens
ccauaauaaucaggaguga

SEQ ID NO: 45917 - RNA, 19 nt, Homo sapiens
cuaguaguguauagucaga

SEQ ID NO: 45918 - RNA, 19 nt, Homo sapiens
caaugagaguggcaaaauu

SEQ ID NO: 45919 - RNA, 19 nt, Homo sapiens
ggagaaccgaggaauugug

SEQ ID NO: 45920 - RNA, 19 nt, Homo sapiens
gaggcuuucuguuaauuuu

SEQ ID NO: 45921 - RNA, 19 nt, Homo sapiens
ggacccauccguguacuuc

SEQ ID NO: 45922 - RNA, 19 nt, Homo sapiens
uaauaagcgucuggaaugg

SEQ ID NO: 45923 - RNA, 19 nt, Homo sapiens
ccuuggaccuggcgagaga

SEQ ID NO: 45924 - RNA, 19 nt, Homo sapiens
uagauggacucgcuuuagg

SEQ ID NO: 45925 - RNA, 19 nt, Homo sapiens
cuauaugccucagcacaug

SEQ ID NO: 45926 - RNA, 19 nt, Homo sapiens
cagaaacagaaucaaaguu

SEQ ID NO: 45927 - RNA, 19 nt, Homo sapiens
aguaguguauagucagaaa

SEQ ID NO: 45928 - RNA, 19 nt, Homo sapiens
gagaauaaaaggaacagaa

SEQ ID NO: 45929 - RNA, 19 nt, Homo sapiens
aguccucgauggcaaagaa

SEQ ID NO: 45930 - RNA, 19 nt, Homo sapiens
gcuuuagccugugauauac

SEQ ID NO: 45931 - RNA, 19 nt, Homo sapiens
gcagugauuaacgauauug

SEQ ID NO: 45932 - RNA, 19 nt, Homo sapiens
uaaugcauacgaacagcua

SEQ ID NO: 45933 - RNA, 19 nt, Homo sapiens
gcauaugaggcuuucuguu

SEQ ID NO: 45934 - RNA, 19 nt, Homo sapiens
agucagaaacagaaucaaa

SEQ ID NO: 45935 - RNA, 19 nt, Homo sapiens
uucuuaagaugccaaugua

SEQ ID NO: 45936 - RNA, 19 nt, Homo sapiens
agggauggaggucgauuua

SEQ ID NO: 45937 - RNA, 19 nt, Homo sapiens
gaagcuuguuaugcucaga

SEQ ID NO: 45938 - RNA, 19 nt, Homo sapiens
gggcuacagcucugagaug

SEQ ID NO: 45939 - RNA, 19 nt, Homo sapiens
gaaagagccaaaaugaguu

SEQ ID NO: 45940 - RNA, 19 nt, Homo sapiens
ggugcugaccuuaaggaaa

SEQ ID NO: 45941 - RNA, 19 nt, Homo sapiens
ccaaagugaagagcagauu

SEQ ID NO: 45942 - RNA, 19 nt, Homo sapiens
aggguuagccauagaagaa

SEQ ID NO: 45943 - RNA, 19 nt, Homo sapiens
cgauauugcuaaucuucca

SEQ ID NO: 45944 - RNA, 19 nt, Homo sapiens
ucagaaacagaaucaaagu

SEQ ID NO: 45945 - RNA, 19 nt, Homo sapiens
gugcuggugcugaccuuaa

SEQ ID NO: 45946 - RNA, 19 nt, Homo sapiens
ucuuucggauccacuauau

SEQ ID NO: 45947 - RNA, 19 nt, Homo sapiens
cucagaccauuccaacaaa

SEQ ID NO: 45948 - RNA, 19 nt, Homo sapiens
gcgauugccacgcgccauu

SEQ ID NO: 45949 - RNA, 19 nt, Homo sapiens
aaaugggccugguugaaac

SEQ ID NO: 45950 - RNA, 19 nt, Homo sapiens
aaaaugaguuccagugaag

SEQ ID NO: 45951 - RNA, 19 nt, Homo sapiens
uugauuguaugucuacugu

SEQ ID NO: 45952 - RNA, 19 nt, Homo sapiens
uguaauaagcgucuggaau

SEQ ID NO: 45953 - RNA, 19 nt, Homo sapiens
cuaagugauuaaugcauac

SEQ ID NO: 45954 - RNA, 19 nt, Homo sapiens
uccguguacuucauucaaa

SEQ ID NO: 45955 - RNA, 19 nt, Homo sapiens
aaugagaguggcaaaauua

SEQ ID NO: 45956 - RNA, 19 nt, Homo sapiens
gauauacgaguagcagcuu

SEQ ID NO: 45957 - RNA, 19 nt, Homo sapiens
aauagauggacucgcuuua

SEQ ID NO: 45958 - RNA, 19 nt, Homo sapiens
uguauagucagaaacagaa

SEQ ID NO: 45959 - RNA, 19 nt, Homo sapiens
gaacugcuguggucacuuu

SEQ ID NO: 45960 - RNA, 19 nt, Homo sapiens
agaaggagauucacagaga

SEQ ID NO: 45961 - RNA, 19 nt, Homo sapiens
gccaacagcccuaacauuu

SEQ ID NO: 45962 - RNA, 19 nt, Homo sapiens
ggaggauacugaggccuua

SEQ ID NO: 45963 - RNA, 19 nt, Homo sapiens
ggaagcgaaugaggaguuu

SEQ ID NO: 45964 - RNA, 19 nt, Homo sapiens
gcaagcaagcacuauauga

SEQ ID NO: 45965 - RNA, 19 nt, Homo sapiens
gcacaugaagcgacaaaga

SEQ ID NO: 45966 - RNA, 19 nt, Homo sapiens
caacagcccuaacauuugc

SEQ ID NO: 45967 - RNA, 19 nt, Homo sapiens
caacauagucaauuugcuu

SEQ ID NO: 45968 - RNA, 19 nt, Homo sapiens
caagcaagcacuauaugaa

SEQ ID NO: 45969 - RNA, 19 nt, Homo sapiens
ccacuccucugcugcuauu

SEQ ID NO: 45970 - RNA, 19 nt, Homo sapiens
ccaaccaugugacaccuuu

SEQ ID NO: 45971 - RNA, 19 nt, Homo sapiens
gaugugguacaaccucuua

SEQ ID NO: 45972 - RNA, 19 nt, Homo sapiens
agcaagcacuauaugaaua

SEQ ID NO: 45973 - RNA, 19 nt, Homo sapiens
uguguagacuugacuauca

SEQ ID NO: 45974 - RNA, 19 nt, Homo sapiens
ugacaaagcagagcacaug

SEQ ID NO: 45975 - RNA, 19 nt, Homo sapiens
gaggcugacugagcucaaa

SEQ ID NO: 45976 - RNA, 19 nt, Homo sapiens
ccaacagcccuaacauuug

SEQ ID NO: 45977 - RNA, 19 nt, Homo sapiens
gaccaugugugcggugcua

SEQ ID NO: 45978 - RNA, 19 nt, Homo sapiens
gcgcaagcaagcacuauau

SEQ ID NO: 45979 - RNA, 19 nt, Homo sapiens
agacuugacuaucacuaau

SEQ ID NO: 45980 - RNA, 19 nt, Homo sapiens
gacuaucacuaaucugcuu

SEQ ID NO: 45981 - RNA, 19 nt, Homo sapiens
agagagaccuggccaagac

SEQ ID NO: 45982 - RNA, 19 nt, Homo sapiens
caagaaggagauucacaga

SEQ ID NO: 45983 - RNA, 19 nt, Homo sapiens
uaacauuugccaagucuuc

SEQ ID NO: 45984 - RNA, 19 nt, Homo sapiens
uauccaagaugugguacaa

SEQ ID NO: 45985 - RNA, 19 nt, Homo sapiens
cucaagagauucugugcuu

SEQ ID NO: 45986 - RNA, 19 nt, Homo sapiens
gaccacaacauagucaauu

SEQ ID NO: 45987 - RNA, 19 nt, Homo sapiens
gggaagcgaaugaggaguu

SEQ ID NO: 45988 - RNA, 19 nt, Homo sapiens
ccacaacauagucaauuug

SEQ ID NO: 45989 - RNA, 19 nt, Homo sapiens
gagcacaugaagcgacaaa

SEQ ID NO: 45990 - RNA, 19 nt, Homo sapiens
gacuggcuguguagacuug

SEQ ID NO: 45991 - RNA, 19 nt, Homo sapiens
ccucuuacccugcaaguuc

SEQ ID NO: 45992 - RNA, 19 nt, Homo sapiens
gcaagcacuauaugaauac

SEQ ID NO: 45993 - RNA, 19 nt, Homo sapiens
caaagcagagcacaugaag

SEQ ID NO: 45994 - RNA, 19 nt, Homo sapiens
cuacccaacaugucaguuu

SEQ ID NO: 45995 - RNA, 19 nt, Homo sapiens
ucaggguccucauuuccaa

SEQ ID NO: 45996 - RNA, 19 nt, Homo sapiens
accacaacauagucaauuu

SEQ ID NO: 45997 - RNA, 19 nt, Homo sapiens
ugacaccuuucgaccacaa

SEQ ID NO: 45998 - RNA, 19 nt, Homo sapiens
cagcguccuucgcagauuc

SEQ ID NO: 45999 - RNA, 19 nt, Homo sapiens
uagacuugacuaucacuaa

SEQ ID NO: 46000 - RNA, 19 nt, Homo sapiens
gacaaagcagagcacauga

SEQ ID NO: 46001 - RNA, 19 nt, Homo sapiens
gcccuaacauuugccaagu

SEQ ID NO: 46002 - RNA, 19 nt, Homo sapiens
agucagcccagucuucuuu

SEQ ID NO: 46003 - RNA, 19 nt, Homo sapiens
gcugguggccaaggaauug

SEQ ID NO: 46004 - RNA, 19 nt, Homo sapiens
gauccucuacccaacaugu

SEQ ID NO: 46005 - RNA, 19 nt, Homo sapiens
ccuaacauuugccaagucu

SEQ ID NO: 46006 - RNA, 19 nt, Homo sapiens
gaggaagaggccaccaaug

SEQ ID NO: 46007 - RNA, 19 nt, Homo sapiens
cuauaugaauacgcaagaa

SEQ ID NO: 46008 - RNA, 19 nt, Homo sapiens
aagcaagcacuauaugaau

SEQ ID NO: 46009 - RNA, 19 nt, Homo sapiens
acaaagcagagcacaugaa

SEQ ID NO: 46010 - RNA, 19 nt, Homo sapiens
gcucacuccagcugacaaa

SEQ ID NO: 46011 - RNA, 19 nt, Homo sapiens
ucagagagucaaggaaguu

SEQ ID NO: 46012 - RNA, 19 nt, Homo sapiens
gggaguugguggagucacu

SEQ ID NO: 46013 - RNA, 19 nt, Homo sapiens
cuggaugggugggugguaa

SEQ ID NO: 46014 - RNA, 19 nt, Homo sapiens
gagcucaaaggaacaggau

SEQ ID NO: 46015 - RNA, 19 nt, Homo sapiens
gaauacgcaagaaggagau

SEQ ID NO: 46016 - RNA, 19 nt, Homo sapiens
ggagcgcaagcaagcacua

SEQ ID NO: 46017 - RNA, 19 nt, Homo sapiens
aggaagaggccaccaaugg

SEQ ID NO: 46018 - RNA, 19 nt, Homo sapiens
gcuccugaagcagcaguua

SEQ ID NO: 46019 - RNA, 19 nt, Homo sapiens
ccacagccucugccuccaa

SEQ ID NO: 46020 - RNA, 19 nt, Homo sapiens
cagagagucaaggaaguuu

SEQ ID NO: 46021 - RNA, 19 nt, Homo sapiens
guagacuugacuaucacua

SEQ ID NO: 46022 - RNA, 19 nt, Homo sapiens
caugugccauuggguguca

SEQ ID NO: 46023 - RNA, 19 nt, Homo sapiens
ugaggaagaggccaccaau

SEQ ID NO: 46024 - RNA, 19 nt, Homo sapiens
gggaacaccugcggacaua

SEQ ID NO: 46025 - RNA, 19 nt, Homo sapiens
gaacaccugcggacauaaa

SEQ ID NO: 46026 - RNA, 19 nt, Homo sapiens
caauaaaccuccgccaaug

SEQ ID NO: 46027 - RNA, 19 nt, Homo sapiens
ccagagcgcugcagucaca

SEQ ID NO: 46028 - RNA, 19 nt, Homo sapiens
gaacaagccccucucauuc

SEQ ID NO: 46029 - RNA, 19 nt, Homo sapiens
ugucaugucuugcacuuuc

SEQ ID NO: 46030 - RNA, 19 nt, Homo sapiens
gcgcugcagucacaguaga

SEQ ID NO: 46031 - RNA, 19 nt, Homo sapiens
acaauaaaccuccgccaau

SEQ ID NO: 46032 - RNA, 19 nt, Homo sapiens
ggugucaugucuugcacuu

SEQ ID NO: 46033 - RNA, 19 nt, Homo sapiens
gagcgcugcagucacagua

SEQ ID NO: 46034 - RNA, 19 nt, Homo sapiens
agaggcaauugcugucauu

SEQ ID NO: 46035 - RNA, 19 nt, Homo sapiens
acucugggcuugugcuguu

SEQ ID NO: 46036 - RNA, 19 nt, Homo sapiens
cuacgccauuucuggguaa

SEQ ID NO: 46037 - RNA, 19 nt, Homo sapiens
cuuggucccuuaucuuguu

SEQ ID NO: 46038 - RNA, 19 nt, Homo sapiens
cgccauuucuggguaauca

SEQ ID NO: 46039 - RNA, 19 nt, Homo sapiens
cugcagcacggacaauaaa

SEQ ID NO: 46040 - RNA, 19 nt, Homo sapiens
cagacaggcccacgugugu

SEQ ID NO: 46041 - RNA, 19 nt, Homo sapiens
ucaccacucugggcuugug

SEQ ID NO: 46042 - RNA, 19 nt, Homo sapiens
gcagaggcagcagcacaga

SEQ ID NO: 46043 - RNA, 19 nt, Homo sapiens
acaccugcggacauaaaua

SEQ ID NO: 46044 - RNA, 19 nt, Homo sapiens
ggaacaccugcggacauaa

SEQ ID NO: 46045 - RNA, 19 nt, Homo sapiens
gcugccaggaggagaacua

SEQ ID NO: 46046 - RNA, 19 nt, Homo sapiens
caccugcggacauaaauag

SEQ ID NO: 46047 - RNA, 19 nt, Homo sapiens
aaucagaaagcucagagau

SEQ ID NO: 46048 - RNA, 19 nt, Homo sapiens
agaacaagccccucucauu

SEQ ID NO: 46049 - RNA, 19 nt, Homo sapiens
gaagucaaaugcaugguua

SEQ ID NO: 46050 - RNA, 19 nt, Homo sapiens
ucaaagacguuacuaggaa

SEQ ID NO: 46051 - RNA, 19 nt, Homo sapiens
caacacagcuuucaguuuu

SEQ ID NO: 46052 - RNA, 19 nt, Homo sapiens
gagcucaucaucagucuua

SEQ ID NO: 46053 - RNA, 19 nt, Homo sapiens
gaacaaagagagcucauca

SEQ ID NO: 46054 - RNA, 19 nt, Homo sapiens
gaaacguucugaccaacaa

SEQ ID NO: 46055 - RNA, 19 nt, Homo sapiens
uaaccacccuagcuuuaua

SEQ ID NO: 46056 - RNA, 19 nt, Homo sapiens
caacuugauucuugugauu

SEQ ID NO: 46057 - RNA, 19 nt, Homo sapiens
gaaacaugcuguacuaaaa

SEQ ID NO: 46058 - RNA, 19 nt, Homo sapiens
ggaaaccuuuuaccuauua

SEQ ID NO: 46059 - RNA, 19 nt, Homo sapiens
ugagauugccucuuucuua

SEQ ID NO: 46060 - RNA, 19 nt, Homo sapiens
gcaaacauaggguaauaaa

SEQ ID NO: 46061 - RNA, 19 nt, Homo sapiens
ugaacggacuggauaguaa

SEQ ID NO: 46062 - RNA, 19 nt, Homo sapiens
gugcuaugcuggacauuaa

SEQ ID NO: 46063 - RNA, 19 nt, Homo sapiens
ggaaacaugcuguacuaaa

SEQ ID NO: 46064 - RNA, 19 nt, Homo sapiens
gagcaagggugcagagcaa

SEQ ID NO: 46065 - RNA, 19 nt, Homo sapiens
gaaacaagcaccgcauaaa

SEQ ID NO: 46066 - RNA, 19 nt, Homo sapiens
aaacagagcugagggagau

SEQ ID NO: 46067 - RNA, 19 nt, Homo sapiens
ucaaucaccuugcauuuca

SEQ ID NO: 46068 - RNA, 19 nt, Homo sapiens
ggaaacaagcaccgcauaa

SEQ ID NO: 46069 - RNA, 19 nt, Homo sapiens
ucaaaugcaugguuaagga

SEQ ID NO: 46070 - RNA, 19 nt, Homo sapiens
gaagcaggacuccagauuu

SEQ ID NO: 46071 - RNA, 19 nt, Homo sapiens
aaacugagaugcugaaggu

SEQ ID NO: 46072 - RNA, 19 nt, Homo sapiens
uugaauagcugcuguaauc

SEQ ID NO: 46073 - RNA, 19 nt, Homo sapiens
gagggaagcuuguggaaac

SEQ ID NO: 46074 - RNA, 19 nt, Homo sapiens
caaauucauuccuguuuca

SEQ ID NO: 46075 - RNA, 19 nt, Homo sapiens
gagacuguguuucuaguug

SEQ ID NO: 46076 - RNA, 19 nt, Homo sapiens
uuacuggguuccuugaaua

SEQ ID NO: 46077 - RNA, 19 nt, Homo sapiens
aaagagagcucaucaucag

SEQ ID NO: 46078 - RNA, 19 nt, Homo sapiens
gaagaugacuuuugugauc

SEQ ID NO: 46079 - RNA, 19 nt, Homo sapiens
gagauugccucuuucuuac

SEQ ID NO: 46080 - RNA, 19 nt, Homo sapiens
ggacauuguaaacguauuu

SEQ ID NO: 46081 - RNA, 19 nt, Homo sapiens
uaaggaggcuagcgaggaa

SEQ ID NO: 46082 - RNA, 19 nt, Homo sapiens
cauaaccacccuagcuuua

SEQ ID NO: 46083 - RNA, 19 nt, Homo sapiens
gaauugagcuagaaaucac

SEQ ID NO: 46084 - RNA, 19 nt, Homo sapiens
uaaauagcaugcaucaaag

SEQ ID NO: 46085 - RNA, 19 nt, Homo sapiens
gaacggacuggauaguaaa

SEQ ID NO: 46086 - RNA, 19 nt, Homo sapiens
ucaugcaacuugauucuug

SEQ ID NO: 46087 - RNA, 19 nt, Homo sapiens
caacaaacaguacggguau

SEQ ID NO: 46088 - RNA, 19 nt, Homo sapiens
ggaagcaggacuccagauu

SEQ ID NO: 46089 - RNA, 19 nt, Homo sapiens
guucaaagcuucccaugcu

SEQ ID NO: 46090 - RNA, 19 nt, Homo sapiens
ucgcaaacauaggguaaua

SEQ ID NO: 46091 - RNA, 19 nt, Homo sapiens
gaacauugucuuacuugau

SEQ ID NO: 46092 - RNA, 19 nt, Homo sapiens
gcacggugaagaugacuuu

SEQ ID NO: 46093 - RNA, 19 nt, Homo sapiens
gguaauaaauagcaugcau

SEQ ID NO: 46094 - RNA, 19 nt, Homo sapiens
uggaaggacucgccuaaau

SEQ ID NO: 46095 - RNA, 19 nt, Homo sapiens
ccgcauaaauacuugaguu

SEQ ID NO: 46096 - RNA, 19 nt, Homo sapiens
aacaagcaccgcauaaaua

SEQ ID NO: 46097 - RNA, 19 nt, Homo sapiens
guccuuucauuuccauuua

SEQ ID NO: 46098 - RNA, 19 nt, Homo sapiens
ucuuugagauugccucuuu

SEQ ID NO: 46099 - RNA, 19 nt, Homo sapiens
aagcaggacuccagauuuc

SEQ ID NO: 46100 - RNA, 19 nt, Homo sapiens
uuugguuccucacauauua

SEQ ID NO: 46101 - RNA, 19 nt, Homo sapiens
agagaaaacuucagagaaa

SEQ ID NO: 46102 - RNA, 19 nt, Homo sapiens
aguaagacuugauugguuu

SEQ ID NO: 46103 - RNA, 19 nt, Homo sapiens
gaaggacucgccuaaaucu

SEQ ID NO: 46104 - RNA, 19 nt, Homo sapiens
ggaaggacucgccuaaauc

SEQ ID NO: 46105 - RNA, 19 nt, Homo sapiens
cuagguaggugguuguuuc

SEQ ID NO: 46106 - RNA, 19 nt, Homo sapiens
ugagaacugcaaugaauaa

SEQ ID NO: 46107 - RNA, 19 nt, Homo sapiens
guaugagacuguguuucua

SEQ ID NO: 46108 - RNA, 19 nt, Homo sapiens
caccaucacugcauuacug

SEQ ID NO: 46109 - RNA, 19 nt, Homo sapiens
aaacaagcaccgcauaaau

SEQ ID NO: 46110 - RNA, 19 nt, Homo sapiens
ggaccacugcggccaaauu

SEQ ID NO: 46111 - RNA, 19 nt, Homo sapiens
acugagaacugcaaugaau

SEQ ID NO: 46112 - RNA, 19 nt, Homo sapiens
caacgugacaaccuuggua

SEQ ID NO: 46113 - RNA, 19 nt, Homo sapiens
acaaggguauccugugcua

SEQ ID NO: 46114 - RNA, 19 nt, Homo sapiens
caaagagagcucaucauca

SEQ ID NO: 46115 - RNA, 19 nt, Homo sapiens
cacccuagcuuuauauuuu

SEQ ID NO: 46116 - RNA, 19 nt, Homo sapiens
cuagaaaucacaagaacaa

SEQ ID NO: 46117 - RNA, 19 nt, Homo sapiens
gcaacuugauucuugugau

SEQ ID NO: 46118 - RNA, 19 nt, Homo sapiens
ucaaauucauuccuguuuc

SEQ ID NO: 46119 - RNA, 19 nt, Homo sapiens
ugagggagaucgcauuucu

SEQ ID NO: 46120 - RNA, 19 nt, Homo sapiens
gagcuagaaaucacaagaa

SEQ ID NO: 46121 - RNA, 19 nt, Homo sapiens
ugaucgaggugaacaaugu

SEQ ID NO: 46122 - RNA, 19 nt, Homo sapiens
gaccacugcggccaaauuu

SEQ ID NO: 46123 - RNA, 19 nt, Homo sapiens
ggauaguaaaguggaauua

SEQ ID NO: 46124 - RNA, 19 nt, Homo sapiens
gcacagacccaggauuauc

SEQ ID NO: 46125 - RNA, 19 nt, Homo sapiens
gaaggugagaggaaauguu

SEQ ID NO: 46126 - RNA, 19 nt, Homo sapiens
caacuugagccuugcauuc

SEQ ID NO: 46127 - RNA, 19 nt, Homo sapiens
aaucgaagcccaacaaaca

SEQ ID NO: 46128 - RNA, 19 nt, Homo sapiens
cuucaagacuguguucaaa

SEQ ID NO: 46129 - RNA, 19 nt, Homo sapiens
gcagguguucggcauguuu

SEQ ID NO: 46130 - RNA, 19 nt, Homo sapiens
uuccaucccugaaccauuu

SEQ ID NO: 46131 - RNA, 19 nt, Homo sapiens
gaaaaggauugcuuaaggu

SEQ ID NO: 46132 - RNA, 19 nt, Homo sapiens
agucagauuuguauaagga

SEQ ID NO: 46133 - RNA, 19 nt, Homo sapiens
ccaaguccaucaaauucau

SEQ ID NO: 46134 - RNA, 19 nt, Homo sapiens
guacggguauguggaagga

SEQ ID NO: 46135 - RNA, 19 nt, Homo sapiens
gccaaaacaugaaggaaaa

SEQ ID NO: 46136 - RNA, 19 nt, Homo sapiens
gggccucuuuccucucuuu

SEQ ID NO: 46137 - RNA, 19 nt, Homo sapiens
acgcacagacccaggauua

SEQ ID NO: 46138 - RNA, 19 nt, Homo sapiens
uacuugaucuucccgauga

SEQ ID NO: 46139 - RNA, 19 nt, Homo sapiens
uuaagguacucuggacuuu

SEQ ID NO: 46140 - RNA, 19 nt, Homo sapiens
guauaaggaaagccaaauu

SEQ ID NO: 46141 - RNA, 19 nt, Homo sapiens
caacacaacacagcuuuca

SEQ ID NO: 46142 - RNA, 19 nt, Homo sapiens
cgaggcauaucuucaccaa

SEQ ID NO: 46143 - RNA, 19 nt, Homo sapiens
acagaacauugucuuacuu

SEQ ID NO: 46144 - RNA, 19 nt, Homo sapiens
cacuauuucugaacaaaga

SEQ ID NO: 46145 - RNA, 19 nt, Homo sapiens
cgaccucgccgaaguugaa

SEQ ID NO: 46146 - RNA, 19 nt, Homo sapiens
gacuuucucuuggacauug

SEQ ID NO: 46147 - RNA, 19 nt, Homo sapiens
uaaacaguguccaggagau

SEQ ID NO: 46148 - RNA, 19 nt, Homo sapiens
guaagacuugauugguuua

SEQ ID NO: 46149 - RNA, 19 nt, Homo sapiens
caucaaaccucuccacuug

SEQ ID NO: 46150 - RNA, 19 nt, Homo sapiens
gaggaggacucuauuugga

SEQ ID NO: 46151 - RNA, 19 nt, Homo sapiens
gcccucaccuuccaccuua

SEQ ID NO: 46152 - RNA, 19 nt, Homo sapiens
cuaccugucuccauucuaa

SEQ ID NO: 46153 - RNA, 19 nt, Homo sapiens
ccaguccucugaacgauuu

SEQ ID NO: 46154 - RNA, 19 nt, Homo sapiens
gguaaggguuggaguuaga

SEQ ID NO: 46155 - RNA, 19 nt, Homo sapiens
gaacgauuuccgccuauuu

SEQ ID NO: 46156 - RNA, 19 nt, Homo sapiens
gccaagauccgaacaguga

SEQ ID NO: 46157 - RNA, 19 nt, Homo sapiens
ggaccacccuggcuaucuu

SEQ ID NO: 46158 - RNA, 19 nt, Homo sapiens
gaugaagauuccaccaaug

SEQ ID NO: 46159 - RNA, 19 nt, Homo sapiens
gcccaggccugaagaguca

SEQ ID NO: 46160 - RNA, 19 nt, Homo sapiens
gaacagugaagaugaccuu

SEQ ID NO: 46161 - RNA, 19 nt, Homo sapiens
aaaccuugcucauggauuc

SEQ ID NO: 46162 - RNA, 19 nt, Homo sapiens
ucucaacgcuucuccuuuc

SEQ ID NO: 46163 - RNA, 19 nt, Homo sapiens
gcucuuggcuuccagaaaa

SEQ ID NO: 46164 - RNA, 19 nt, Homo sapiens
uaaccugacuggcacaucu

SEQ ID NO: 46165 - RNA, 19 nt, Homo sapiens
ugaugaagauuccaccaau

SEQ ID NO: 46166 - RNA, 19 nt, Homo sapiens
cagugaagaugaccuuugu

SEQ ID NO: 46167 - RNA, 19 nt, Homo sapiens
gcacaucucagccuaacca

SEQ ID NO: 46168 - RNA, 19 nt, Homo sapiens
gcagucagggagaaucaaa

SEQ ID NO: 46169 - RNA, 19 nt, Homo sapiens
uagaggaggcccugucuga

SEQ ID NO: 46170 - RNA, 19 nt, Homo sapiens
cagccucccucaagucuuc

SEQ ID NO: 46171 - RNA, 19 nt, Homo sapiens
caacgcuucuccuuucucu

SEQ ID NO: 46172 - RNA, 19 nt, Homo sapiens
gugaggaggacucuauuug

SEQ ID NO: 46173 - RNA, 19 nt, Homo sapiens
gagaauuugaggcggauug

SEQ ID NO: 46174 - RNA, 19 nt, Homo sapiens
ccagaaaaguuuggagaaa

SEQ ID NO: 46175 - RNA, 19 nt, Homo sapiens
gaggaggcccugucugaag

SEQ ID NO: 46176 - RNA, 19 nt, Homo sapiens
uugcugggcucccuucuuc

SEQ ID NO: 46177 - RNA, 19 nt, Homo sapiens
guuuggagaaagagaauuu

SEQ ID NO: 46178 - RNA, 19 nt, Homo sapiens
gaggguaaggguuggaguu

SEQ ID NO: 46179 - RNA, 19 nt, Homo sapiens
cacccuggcuaucuucguu

SEQ ID NO: 46180 - RNA, 19 nt, Homo sapiens
ggaucuacaugggcuucaa

SEQ ID NO: 46181 - RNA, 19 nt, Homo sapiens
gggccaagauccgaacagu

SEQ ID NO: 46182 - RNA, 19 nt, Homo sapiens
gugcagggccgucaaguac

SEQ ID NO: 46183 - RNA, 19 nt, Homo sapiens
ccucauaagcucccaaucu

SEQ ID NO: 46184 - RNA, 19 nt, Homo sapiens
gacaggcccucaccuucca

SEQ ID NO: 46185 - RNA, 19 nt, Homo sapiens
gauuuguuguuguuguugu

SEQ ID NO: 46186 - RNA, 19 nt, Homo sapiens
gauccgaacagugaagaug

SEQ ID NO: 46187 - RNA, 19 nt, Homo sapiens
ggacaagaaugccccugau

SEQ ID NO: 46188 - RNA, 19 nt, Homo sapiens
gauccacacccucccuuca

SEQ ID NO: 46189 - RNA, 19 nt, Homo sapiens
gaaugccccugaugaagau

SEQ ID NO: 46190 - RNA, 19 nt, Homo sapiens
gcagggccgucaaguaccu

SEQ ID NO: 46191 - RNA, 19 nt, Homo sapiens
augaggagcuggccaaggu

SEQ ID NO: 46192 - RNA, 19 nt, Homo sapiens
agaaaaguuuggagaaaga

SEQ ID NO: 46193 - RNA, 19 nt, Homo sapiens
ugaacgauuuccgccuauu

SEQ ID NO: 46194 - RNA, 19 nt, Homo sapiens
gucgaucccagucacauuu

SEQ ID NO: 46195 - RNA, 19 nt, Homo sapiens
uggauuuguuguuguuguu

SEQ ID NO: 46196 - RNA, 19 nt, Homo sapiens
cuggcuaccugucuccauu

SEQ ID NO: 46197 - RNA, 19 nt, Homo sapiens
ccgcugagaccaucaucuu

SEQ ID NO: 46198 - RNA, 19 nt, Homo sapiens
cuucuucaguguccagaug

SEQ ID NO: 46199 - RNA, 19 nt, Homo sapiens
ggagaggggagaagugaaa

SEQ ID NO: 46200 - RNA, 19 nt, Homo sapiens
ggucgaucccagucacauu

SEQ ID NO: 46201 - RNA, 19 nt, Homo sapiens
cucauaagcucccaaucuc

SEQ ID NO: 46202 - RNA, 19 nt, Homo sapiens
cugagaccaucaucuuuua

SEQ ID NO: 46203 - RNA, 19 nt, Homo sapiens
ggguaaggguuggaguuag

SEQ ID NO: 46204 - RNA, 19 nt, Homo sapiens
gcugagaccaucaucuuuu

SEQ ID NO: 46205 - RNA, 19 nt, Homo sapiens
gggcucccuucuucagugu

SEQ ID NO: 46206 - RNA, 19 nt, Homo sapiens
ccucaggcacuggaaauga

SEQ ID NO: 46207 - RNA, 19 nt, Homo sapiens
uucaccaucucuaugcuuu

SEQ ID NO: 46208 - RNA, 19 nt, Homo sapiens
cagcaucaacaccaucuca

SEQ ID NO: 46209 - RNA, 19 nt, Homo sapiens
gguccugccauauucauag

SEQ ID NO: 46210 - RNA, 19 nt, Homo sapiens
ggacuuggagcuggcagau

SEQ ID NO: 46211 - RNA, 19 nt, Homo sapiens
caagaaugccccugaugaa

SEQ ID NO: 46212 - RNA, 19 nt, Homo sapiens
gcauguuugccuccaccua

SEQ ID NO: 46213 - RNA, 19 nt, Homo sapiens
ccaucaaaccucuccacuu

SEQ ID NO: 46214 - RNA, 19 nt, Homo sapiens
aaaguuuggagaaagagaa

SEQ ID NO: 46215 - RNA, 19 nt, Homo sapiens
ugaggaggacucuauuugg

SEQ ID NO: 46216 - RNA, 19 nt, Homo sapiens
cacauggugucccagaucu

SEQ ID NO: 46217 - RNA, 19 nt, Homo sapiens
cgugaggaggacucuauuu

SEQ ID NO: 46218 - RNA, 19 nt, Homo sapiens
acagugaagaugaccuuug

SEQ ID NO: 46219 - RNA, 19 nt, Homo sapiens
gaccaucccucucaaucuu

SEQ ID NO: 46220 - RNA, 19 nt, Homo sapiens
ggaugacgcuagugauugu

SEQ ID NO: 46221 - RNA, 19 nt, Homo sapiens
gcaccuaugucaccuggau

SEQ ID NO: 46222 - RNA, 19 nt, Homo sapiens
cucauucucucccuaauaa

SEQ ID NO: 46223 - RNA, 19 nt, Homo sapiens
ggauugcccugaugguguu

SEQ ID NO: 46224 - RNA, 19 nt, Homo sapiens
gaggaugacgcuagugauu

SEQ ID NO: 46225 - RNA, 19 nt, Homo sapiens
gcgcugcucuccauagucu

SEQ ID NO: 46226 - RNA, 19 nt, Homo sapiens
gcagcagcguguccucaga

SEQ ID NO: 46227 - RNA, 19 nt, Homo sapiens
gcagauggugggcauguau

SEQ ID NO: 46228 - RNA, 19 nt, Homo sapiens
ugagggagcccacguguca

SEQ ID NO: 46229 - RNA, 19 nt, Homo sapiens
cagagacccugggccauug

SEQ ID NO: 46230 - RNA, 19 nt, Homo sapiens
gauccuggguucugugcau

SEQ ID NO: 46231 - RNA, 19 nt, Homo sapiens
ccauacacgucuucauugg

SEQ ID NO: 46232 - RNA, 19 nt, Homo sapiens
ugauuguggucgucuaugu

SEQ ID NO: 46233 - RNA, 19 nt, Homo sapiens
ggccguggcucuguuccaa

SEQ ID NO: 46234 - RNA, 19 nt, Homo sapiens
cgucuucauuggccacuug

SEQ ID NO: 46235 - RNA, 19 nt, Homo sapiens
ccucauucucucccuaaua

SEQ ID NO: 46236 - RNA, 19 nt, Homo sapiens
gccaagacugugaggauga

SEQ ID NO: 46237 - RNA, 19 nt, Homo sapiens
gcugcucuccauagucuuu

SEQ ID NO: 46238 - RNA, 19 nt, Homo sapiens
gaggagcuguugggugucu

SEQ ID NO: 46239 - RNA, 19 nt, Homo sapiens
gugaggaugacgcuaguga

SEQ ID NO: 46240 - RNA, 19 nt, Homo sapiens
ucaccuggauugcccugau

SEQ ID NO: 46241 - RNA, 19 nt, Homo sapiens
gcuguggcccugagcaaug

SEQ ID NO: 46242 - RNA, 19 nt, Homo sapiens
ggccgucgcaccuauguca

SEQ ID NO: 46243 - RNA, 19 nt, Homo sapiens
cuggaucuaugcaucuuuc

SEQ ID NO: 46244 - RNA, 19 nt, Homo sapiens
ugacugcugggccugcuuu

SEQ ID NO: 46245 - RNA, 19 nt, Homo sapiens
acccauacacgucuucauu

SEQ ID NO: 46246 - RNA, 19 nt, Homo sapiens
ugucuccgccuuucuaauc

SEQ ID NO: 46247 - RNA, 19 nt, Homo sapiens
caccuggauugcccugaug

SEQ ID NO: 46248 - RNA, 19 nt, Homo sapiens
guaugccuccuccuacaug

SEQ ID NO: 46249 - RNA, 19 nt, Homo sapiens
gggcacccauacacgucuu

SEQ ID NO: 46250 - RNA, 19 nt, Homo sapiens
ccuuugugcuacucauguu

SEQ ID NO: 46251 - RNA, 19 nt, Homo sapiens
ugucugaccaucccucuca

SEQ ID NO: 46252 - RNA, 19 nt, Homo sapiens
gcuguggccaagacuguga

SEQ ID NO: 46253 - RNA, 19 nt, Homo sapiens
ggaaagaggugaacuggua

SEQ ID NO: 46254 - RNA, 19 nt, Homo sapiens
ggucagagcuggaggauuu

SEQ ID NO: 46255 - RNA, 19 nt, Homo sapiens
ccacaggucuagacuauua

SEQ ID NO: 46256 - RNA, 19 nt, Homo sapiens
gaaagaaggagacccguua

SEQ ID NO: 46257 - RNA, 19 nt, Homo sapiens
guaaggcucuagaucauaa

SEQ ID NO: 46258 - RNA, 19 nt, Homo sapiens
gugaagagcugaaggagaa

SEQ ID NO: 46259 - RNA, 19 nt, Homo sapiens
ccaagauucuagaugauua

SEQ ID NO: 46260 - RNA, 19 nt, Homo sapiens
ccaagaagaucuacaaugg

SEQ ID NO: 46261 - RNA, 19 nt, Homo sapiens
ggaacugcaugcugaauga

SEQ ID NO: 46262 - RNA, 19 nt, Homo sapiens
ccacugcacucaaccuuaa

SEQ ID NO: 46263 - RNA, 19 nt, Homo sapiens
gcuccaagauucuagauga

SEQ ID NO: 46264 - RNA, 19 nt, Homo sapiens
gaucagaugcuccaagauu

SEQ ID NO: 46265 - RNA, 19 nt, Homo sapiens
cuaaagcucugacauuaug

SEQ ID NO: 46266 - RNA, 19 nt, Homo sapiens
gagaaaggguugcccaagu

SEQ ID NO: 46267 - RNA, 19 nt, Homo sapiens
gaaauuccaaagucucuaa

SEQ ID NO: 46268 - RNA, 19 nt, Homo sapiens
ugauaaagccucaagguuu

SEQ ID NO: 46269 - RNA, 19 nt, Homo sapiens
ccaaguagcugggauuaca

SEQ ID NO: 46270 - RNA, 19 nt, Homo sapiens
gcaguagcaucaccuugaa

SEQ ID NO: 46271 - RNA, 19 nt, Homo sapiens
ccucuccucucuugaguua

SEQ ID NO: 46272 - RNA, 19 nt, Homo sapiens
cuaacggucuguucuguuu

SEQ ID NO: 46273 - RNA, 19 nt, Homo sapiens
guucuaagaugugauauuc

SEQ ID NO: 46274 - RNA, 19 nt, Homo sapiens
gauaaagccucaagguuuu

SEQ ID NO: 46275 - RNA, 19 nt, Homo sapiens
ugaacaggaugacuggaua

SEQ ID NO: 46276 - RNA, 19 nt, Homo sapiens
uuacagagcugcgggaaga

SEQ ID NO: 46277 - RNA, 19 nt, Homo sapiens
gcucaucggugucuguuuc

SEQ ID NO: 46278 - RNA, 19 nt, Homo sapiens
gucgaaagcucuagaaucu

SEQ ID NO: 46279 - RNA, 19 nt, Homo sapiens
ggagacccguuauggagaa

SEQ ID NO: 46280 - RNA, 19 nt, Homo sapiens
caucuuggcucucuuccuu

SEQ ID NO: 46281 - RNA, 19 nt, Homo sapiens
gagucuagauucaaagguu

SEQ ID NO: 46282 - RNA, 19 nt, Homo sapiens
gaccugaaauuccaaaguc

SEQ ID NO: 46283 - RNA, 19 nt, Homo sapiens
auucaaagguucuagguuu

SEQ ID NO: 46284 - RNA, 19 nt, Homo sapiens
cuuaagaccuacuguucua

SEQ ID NO: 46285 - RNA, 19 nt, Homo sapiens
ggaugaggguggagguuau

SEQ ID NO: 46286 - RNA, 19 nt, Homo sapiens
gacgaaauccucuauguca

SEQ ID NO: 46287 - RNA, 19 nt, Homo sapiens
guucuaacccuauacugua

SEQ ID NO: 46288 - RNA, 19 nt, Homo sapiens
ccaagagucuaaagaugga

SEQ ID NO: 46289 - RNA, 19 nt, Homo sapiens
cuaugagucuagauguuua

SEQ ID NO: 46290 - RNA, 19 nt, Homo sapiens
cuaccgaguucaagugauu

SEQ ID NO: 46291 - RNA, 19 nt, Homo sapiens
gaaauccucuaugucaaca

SEQ ID NO: 46292 - RNA, 19 nt, Homo sapiens
acagcgagauuuaugacua

SEQ ID NO: 46293 - RNA, 19 nt, Homo sapiens
gagaacagcgagauuuaug

SEQ ID NO: 46294 - RNA, 19 nt, Homo sapiens
ggagaaguguuugaaccaa

SEQ ID NO: 46295 - RNA, 19 nt, Homo sapiens
gaaggagacccguuaugga

SEQ ID NO: 46296 - RNA, 19 nt, Homo sapiens
gaugugauauucuaagacu

SEQ ID NO: 46297 - RNA, 19 nt, Homo sapiens
cauuagggaugccuccuuu

SEQ ID NO: 46298 - RNA, 19 nt, Homo sapiens
guccacaggucuagacuau

SEQ ID NO: 46299 - RNA, 19 nt, Homo sapiens
uagaucagaugcuccaaga

SEQ ID NO: 46300 - RNA, 19 nt, Homo sapiens
ccaaagugcugagauuaca

SEQ ID NO: 46301 - RNA, 19 nt, Homo sapiens
caccacacccggcuaauuu

SEQ ID NO: 46302 - RNA, 19 nt, Homo sapiens
uccaaagucucuaauucua

SEQ ID NO: 46303 - RNA, 19 nt, Homo sapiens
acuauuaggugcaauuuca

SEQ ID NO: 46304 - RNA, 19 nt, Homo sapiens
guucuaaggaccugaaauu

SEQ ID NO: 46305 - RNA, 19 nt, Homo sapiens
ggugucagcuccagguuca

SEQ ID NO: 46306 - RNA, 19 nt, Homo sapiens
guucuaagacucaaauguu

SEQ ID NO: 46307 - RNA, 19 nt, Homo sapiens
uauaguuucugaggcuuua

SEQ ID NO: 46308 - RNA, 19 nt, Homo sapiens
cuaaagauggaguuucuaa

SEQ ID NO: 46309 - RNA, 19 nt, Homo sapiens
uucuaaagcucugacauua

SEQ ID NO: 46310 - RNA, 19 nt, Homo sapiens
gguaccggcuggcguauca

SEQ ID NO: 46311 - RNA, 19 nt, Homo sapiens
agacucaaauguucuaagu

SEQ ID NO: 46312 - RNA, 19 nt, Homo sapiens
ucuaggcacuguaguucua

SEQ ID NO: 46313 - RNA, 19 nt, Homo sapiens
gagucuagauguuuauucu

SEQ ID NO: 46314 - RNA, 19 nt, Homo sapiens
agacaggguuucaccaugu

SEQ ID NO: 46315 - RNA, 19 nt, Homo sapiens
guucuagguuucaaagaug

SEQ ID NO: 46316 - RNA, 19 nt, Homo sapiens
cuaaggaccugaaauucca

SEQ ID NO: 46317 - RNA, 19 nt, Homo sapiens
gaagcccucccagguguua

SEQ ID NO: 46318 - RNA, 19 nt, Homo sapiens
caacccagccagacccuaa

SEQ ID NO: 46319 - RNA, 19 nt, Homo sapiens
ccacugaagcuaccuugaa

SEQ ID NO: 46320 - RNA, 19 nt, Homo sapiens
uggacgaucucccaccuuu

SEQ ID NO: 46321 - RNA, 19 nt, Homo sapiens
uuucugaggcuuuaugaua

SEQ ID NO: 46322 - RNA, 19 nt, Homo sapiens
cuauuaaagugcuaagguu

SEQ ID NO: 46323 - RNA, 19 nt, Homo sapiens
gguucuagguuucaaagau

SEQ ID NO: 46324 - RNA, 19 nt, Homo sapiens
gcaguagcaucaccaucug

SEQ ID NO: 46325 - RNA, 19 nt, Homo sapiens
cagcgagauuuaugacuau

SEQ ID NO: 46326 - RNA, 19 nt, Homo sapiens
guggucaucuuaccuuuca

SEQ ID NO: 46327 - RNA, 19 nt, Homo sapiens
gggcucaggucacauaaaa

SEQ ID NO: 46328 - RNA, 19 nt, Homo sapiens
agacaccaaaguucuaaua

SEQ ID NO: 46329 - RNA, 19 nt, Homo sapiens
gcacgcaggcugaagaaag

SEQ ID NO: 46330 - RNA, 19 nt, Homo sapiens
guucuaaagcucugacauu

SEQ ID NO: 46331 - RNA, 19 nt, Homo sapiens
ggguggagguuauccugaa

SEQ ID NO: 46332 - RNA, 19 nt, Homo sapiens
gauccuaagcaucuaaguu

SEQ ID NO: 46333 - RNA, 19 nt, Homo sapiens
ccaagauuccggauccuaa

SEQ ID NO: 46334 - RNA, 19 nt, Homo sapiens
gcuguaaggcucuagauca

SEQ ID NO: 46335 - RNA, 19 nt, Homo sapiens
gaggaauguuuaccagaca

SEQ ID NO: 46336 - RNA, 19 nt, Homo sapiens
ggcauggaguaucugagua

SEQ ID NO: 46337 - RNA, 19 nt, Homo sapiens
ugaagacgaugaagauugc

SEQ ID NO: 46338 - RNA, 19 nt, Homo sapiens
gcacagccaccaucacagu

SEQ ID NO: 46339 - RNA, 19 nt, Homo sapiens
gcacuguaguucuaagacu

SEQ ID NO: 46340 - RNA, 19 nt, Homo sapiens
gacaccaaaguucuaauaa

SEQ ID NO: 46341 - RNA, 19 nt, Homo sapiens
gcaucuaaguuauaagacu

SEQ ID NO: 46342 - RNA, 19 nt, Homo sapiens
ccuaagcaucuaaguuaua

SEQ ID NO: 46343 - RNA, 19 nt, Homo sapiens
guuaucuucucaaguucua

SEQ ID NO: 46344 - RNA, 19 nt, Homo sapiens
uuucaaagaugcugugagu

SEQ ID NO: 46345 - RNA, 19 nt, Homo sapiens
ccucccagguguuaacauu

SEQ ID NO: 46346 - RNA, 19 nt, Homo sapiens
ggagaacagcgagauuuau

SEQ ID NO: 46347 - RNA, 19 nt, Homo sapiens
gccaaucccucaccuucug

SEQ ID NO: 46348 - RNA, 19 nt, Homo sapiens
guccaagaauccacauuuc

SEQ ID NO: 46349 - RNA, 19 nt, Homo sapiens
cuucucaaguucuaagauu

SEQ ID NO: 46350 - RNA, 19 nt, Homo sapiens
guucuaaggccuaggauuc

SEQ ID NO: 46351 - RNA, 19 nt, Homo sapiens
uuaaagugcuaagguucua

SEQ ID NO: 46352 - RNA, 19 nt, Homo sapiens
gugaagcggucugcaugaa

SEQ ID NO: 46353 - RNA, 19 nt, Homo sapiens
ggaaagaggugaacuggua

SEQ ID NO: 46354 - RNA, 19 nt, Homo sapiens
ggucagagcuggaggauuu

SEQ ID NO: 46355 - RNA, 19 nt, Homo sapiens
ccacaggucuagacuauua

SEQ ID NO: 46356 - RNA, 19 nt, Homo sapiens
gaaagaaggagacccguua

SEQ ID NO: 46357 - RNA, 19 nt, Homo sapiens
guaaggcucuagaucauaa

SEQ ID NO: 46358 - RNA, 19 nt, Homo sapiens
gugaagagcugaaggagaa

SEQ ID NO: 46359 - RNA, 19 nt, Homo sapiens
ccaagauucuagaugauua

SEQ ID NO: 46360 - RNA, 19 nt, Homo sapiens
ccaagaagaucuacaaugg

SEQ ID NO: 46361 - RNA, 19 nt, Homo sapiens
ggaacugcaugcugaauga

SEQ ID NO: 46362 - RNA, 19 nt, Homo sapiens
ccacugcacucaaccuuaa

SEQ ID NO: 46363 - RNA, 19 nt, Homo sapiens
gcuccaagauucuagauga

SEQ ID NO: 46364 - RNA, 19 nt, Homo sapiens
gaucagaugcuccaagauu

SEQ ID NO: 46365 - RNA, 19 nt, Homo sapiens
cuaaagcucugacauuaug

SEQ ID NO: 46366 - RNA, 19 nt, Homo sapiens
gagaaaggguugcccaagu

SEQ ID NO: 46367 - RNA, 19 nt, Homo sapiens
gaaauuccaaagucucuaa

SEQ ID NO: 46368 - RNA, 19 nt, Homo sapiens
ugauaaagccucaagguuu

SEQ ID NO: 46369 - RNA, 19 nt, Homo sapiens
ccaaguagcugggauuaca

SEQ ID NO: 46370 - RNA, 19 nt, Homo sapiens
gcaguagcaucaccuugaa

SEQ ID NO: 46371 - RNA, 19 nt, Homo sapiens
ccucuccucucuugaguua

SEQ ID NO: 46372 - RNA, 19 nt, Homo sapiens
cuaacggucuguucuguuu

SEQ ID NO: 46373 - RNA, 19 nt, Homo sapiens
guucuaagaugugauauuc

SEQ ID NO: 46374 - RNA, 19 nt, Homo sapiens
gauaaagccucaagguuuu

SEQ ID NO: 46375 - RNA, 19 nt, Homo sapiens
ugaacaggaugacuggaua

SEQ ID NO: 46376 - RNA, 19 nt, Homo sapiens
uuacagagcugcgggaaga

SEQ ID NO: 46377 - RNA, 19 nt, Homo sapiens
gcucaucggugucuguuuc

SEQ ID NO: 46378 - RNA, 19 nt, Homo sapiens
gucgaaagcucuagaaucu

SEQ ID NO: 46379 - RNA, 19 nt, Homo sapiens
ggagacccguuauggagaa

SEQ ID NO: 46380 - RNA, 19 nt, Homo sapiens
caucuuggcucucuuccuu

SEQ ID NO: 46381 - RNA, 19 nt, Homo sapiens
gagucuagauucaaagguu

SEQ ID NO: 46382 - RNA, 19 nt, Homo sapiens
gaccugaaauuccaaaguc

SEQ ID NO: 46383 - RNA, 19 nt, Homo sapiens
auucaaagguucuagguuu

SEQ ID NO: 46384 - RNA, 19 nt, Homo sapiens
cuuaagaccuacuguucua

SEQ ID NO: 46385 - RNA, 19 nt, Homo sapiens
ggaugaggguggagguuau

SEQ ID NO: 46386 - RNA, 19 nt, Homo sapiens
gacgaaauccucuauguca

SEQ ID NO: 46387 - RNA, 19 nt, Homo sapiens
guucuaacccuauacugua

SEQ ID NO: 46388 - RNA, 19 nt, Homo sapiens
ccaagagucuaaagaugga

SEQ ID NO: 46389 - RNA, 19 nt, Homo sapiens
cuaugagucuagauguuua

SEQ ID NO: 46390 - RNA, 19 nt, Homo sapiens
cuaccgaguucaagugauu

SEQ ID NO: 46391 - RNA, 19 nt, Homo sapiens
gaaauccucuaugucaaca

SEQ ID NO: 46392 - RNA, 19 nt, Homo sapiens
acagcgagauuuaugacua

SEQ ID NO: 46393 - RNA, 19 nt, Homo sapiens
gagaacagcgagauuuaug

SEQ ID NO: 46394 - RNA, 19 nt, Homo sapiens
ggagaaguguuugaaccaa

SEQ ID NO: 46395 - RNA, 19 nt, Homo sapiens
gaaggagacccguuaugga

SEQ ID NO: 46396 - RNA, 19 nt, Homo sapiens
gaugugauauucuaagacu

SEQ ID NO: 46397 - RNA, 19 nt, Homo sapiens
cauuagggaugccuccuuu

SEQ ID NO: 46398 - RNA, 19 nt, Homo sapiens
guccacaggucuagacuau

SEQ ID NO: 46399 - RNA, 19 nt, Homo sapiens
uagaucagaugcuccaaga

SEQ ID NO: 46400 - RNA, 19 nt, Homo sapiens
ccaaagugcugagauuaca

SEQ ID NO: 46401 - RNA, 19 nt, Homo sapiens
caccacacccggcuaauuu

SEQ ID NO: 46402 - RNA, 19 nt, Homo sapiens
uccaaagucucuaauucua

SEQ ID NO: 46403 - RNA, 19 nt, Homo sapiens
acuauuaggugcaauuuca

SEQ ID NO: 46404 - RNA, 19 nt, Homo sapiens
guucuaaggaccugaaauu

SEQ ID NO: 46405 - RNA, 19 nt, Homo sapiens
ggugucagcuccagguuca

SEQ ID NO: 46406 - RNA, 19 nt, Homo sapiens
guucuaagacucaaauguu

SEQ ID NO: 46407 - RNA, 19 nt, Homo sapiens
uauaguuucugaggcuuua

SEQ ID NO: 46408 - RNA, 19 nt, Homo sapiens
cuaaagauggaguuucuaa

SEQ ID NO: 46409 - RNA, 19 nt, Homo sapiens
uucuaaagcucugacauua

SEQ ID NO: 46410 - RNA, 19 nt, Homo sapiens
gguaccggcuggcguauca

SEQ ID NO: 46411 - RNA, 19 nt, Homo sapiens
agacucaaauguucuaagu

SEQ ID NO: 46412 - RNA, 19 nt, Homo sapiens
ucuaggcacuguaguucua

SEQ ID NO: 46413 - RNA, 19 nt, Homo sapiens
gagucuagauguuuauucu

SEQ ID NO: 46414 - RNA, 19 nt, Homo sapiens
agacaggguuucaccaugu

SEQ ID NO: 46415 - RNA, 19 nt, Homo sapiens
guucuagguuucaaagaug

SEQ ID NO: 46416 - RNA, 19 nt, Homo sapiens
cuaaggaccugaaauucca

SEQ ID NO: 46417 - RNA, 19 nt, Homo sapiens
gaagcccucccagguguua

SEQ ID NO: 46418 - RNA, 19 nt, Homo sapiens
caacccagccagacccuaa

SEQ ID NO: 46419 - RNA, 19 nt, Homo sapiens
ccacugaagcuaccuugaa

SEQ ID NO: 46420 - RNA, 19 nt, Homo sapiens
uggacgaucucccaccuuu

SEQ ID NO: 46421 - RNA, 19 nt, Homo sapiens
uuucugaggcuuuaugaua

SEQ ID NO: 46422 - RNA, 19 nt, Homo sapiens
cuauuaaagugcuaagguu

SEQ ID NO: 46423 - RNA, 19 nt, Homo sapiens
gguucuagguuucaaagau

SEQ ID NO: 46424 - RNA, 19 nt, Homo sapiens
gcaguagcaucaccaucug

SEQ ID NO: 46425 - RNA, 19 nt, Homo sapiens
cagcgagauuuaugacuau

SEQ ID NO: 46426 - RNA, 19 nt, Homo sapiens
guggucaucuuaccuuuca

SEQ ID NO: 46427 - RNA, 19 nt, Homo sapiens
gggcucaggucacauaaaa

SEQ ID NO: 46428 - RNA, 19 nt, Homo sapiens
agacaccaaaguucuaaua

SEQ ID NO: 46429 - RNA, 19 nt, Homo sapiens
gcacgcaggcugaagaaag

SEQ ID NO: 46430 - RNA, 19 nt, Homo sapiens
guucuaaagcucugacauu

SEQ ID NO: 46431 - RNA, 19 nt, Homo sapiens
ggguggagguuauccugaa

SEQ ID NO: 46432 - RNA, 19 nt, Homo sapiens
gauccuaagcaucuaaguu

SEQ ID NO: 46433 - RNA, 19 nt, Homo sapiens
ccaagauuccggauccuaa

SEQ ID NO: 46434 - RNA, 19 nt, Homo sapiens
gcuguaaggcucuagauca

SEQ ID NO: 46435 - RNA, 19 nt, Homo sapiens
gaggaauguuuaccagaca

SEQ ID NO: 46436 - RNA, 19 nt, Homo sapiens
ggcauggaguaucugagua

SEQ ID NO: 46437 - RNA, 19 nt, Homo sapiens
ugaagacgaugaagauugc

SEQ ID NO: 46438 - RNA, 19 nt, Homo sapiens
gcacagccaccaucacagu

SEQ ID NO: 46439 - RNA, 19 nt, Homo sapiens
gcacuguaguucuaagacu

SEQ ID NO: 46440 - RNA, 19 nt, Homo sapiens
gacaccaaaguucuaauaa

SEQ ID NO: 46441 - RNA, 19 nt, Homo sapiens
gcaucuaaguuauaagacu

SEQ ID NO: 46442 - RNA, 19 nt, Homo sapiens
ccuaagcaucuaaguuaua

SEQ ID NO: 46443 - RNA, 19 nt, Homo sapiens
guuaucuucucaaguucua

SEQ ID NO: 46444 - RNA, 19 nt, Homo sapiens
uuucaaagaugcugugagu

SEQ ID NO: 46445 - RNA, 19 nt, Homo sapiens
ccucccagguguuaacauu

SEQ ID NO: 46446 - RNA, 19 nt, Homo sapiens
ggagaacagcgagauuuau

SEQ ID NO: 46447 - RNA, 19 nt, Homo sapiens
gccaaucccucaccuucug

SEQ ID NO: 46448 - RNA, 19 nt, Homo sapiens
guccaagaauccacauuuc

SEQ ID NO: 46449 - RNA, 19 nt, Homo sapiens
cuucucaaguucuaagauu

SEQ ID NO: 46450 - RNA, 19 nt, Homo sapiens
guucuaaggccuaggauuc

SEQ ID NO: 46451 - RNA, 19 nt, Homo sapiens
uuaaagugcuaagguucua

SEQ ID NO: 46452 - RNA, 19 nt, Homo sapiens
gugaagcggucugcaugaa

SEQ ID NO: 46453 - RNA, 19 nt, Homo sapiens
ggaaauaccugaaauacag

SEQ ID NO: 46454 - RNA, 19 nt, Homo sapiens
ugaaagacauuguggagua

SEQ ID NO: 46455 - RNA, 19 nt, Homo sapiens
ggaaaggacuacauugaau

SEQ ID NO: 46456 - RNA, 19 nt, Homo sapiens
uaacgggucucacguauug

SEQ ID NO: 46457 - RNA, 19 nt, Homo sapiens
guugugagaucgagaauaa

SEQ ID NO: 46458 - RNA, 19 nt, Homo sapiens
gaaaggacuacauugaauu

SEQ ID NO: 46459 - RNA, 19 nt, Homo sapiens
ggagacagguggaaggaau

SEQ ID NO: 46460 - RNA, 19 nt, Homo sapiens
gaaagacauuguggaguau

SEQ ID NO: 46461 - RNA, 19 nt, Homo sapiens
ucaaugaccuccaguucuu

SEQ ID NO: 46462 - RNA, 19 nt, Homo sapiens
ggagcauucuggaaauauu

SEQ ID NO: 46463 - RNA, 19 nt, Homo sapiens
gagauguucuucacaaugg

SEQ ID NO: 46464 - RNA, 19 nt, Homo sapiens
gagcauucuggaaauauua

SEQ ID NO: 46465 - RNA, 19 nt, Homo sapiens
guuacucucugaccuauau

SEQ ID NO: 46466 - RNA, 19 nt, Homo sapiens
gggaggacaucuuuaugga

SEQ ID NO: 46467 - RNA, 19 nt, Homo sapiens
gcccuuggcucacucaaug

SEQ ID NO: 46468 - RNA, 19 nt, Homo sapiens
gcggagcauucuggaaaua

SEQ ID NO: 46469 - RNA, 19 nt, Homo sapiens
gauggucguuacucucuga

SEQ ID NO: 46470 - RNA, 19 nt, Homo sapiens
aagacauuguggaguauua

SEQ ID NO: 46471 - RNA, 19 nt, Homo sapiens
acacugggcuguccaagca

SEQ ID NO: 46472 - RNA, 19 nt, Homo sapiens
ugaagugccuggccuacga

SEQ ID NO: 46473 - RNA, 19 nt, Homo sapiens
ggagauguucuucacaaug

SEQ ID NO: 46474 - RNA, 19 nt, Homo sapiens
cgacccagcagcccagaua

SEQ ID NO: 46475 - RNA, 19 nt, Homo sapiens
cagcggagcauucuggaaa

SEQ ID NO: 46476 - RNA, 19 nt, Homo sapiens
uggaaggaauggaggauug

SEQ ID NO: 46477 - RNA, 19 nt, Homo sapiens
ggcaagauccucccucugu

SEQ ID NO: 46478 - RNA, 19 nt, Homo sapiens
cugcgacucugcggaaaua

SEQ ID NO: 46479 - RNA, 19 nt, Homo sapiens
caauggaaauggcacuuac

SEQ ID NO: 46480 - RNA, 19 nt, Homo sapiens
ccagggaggacaucuuuau

SEQ ID NO: 46481 - RNA, 19 nt, Homo sapiens
ccaagauggucguuacucu

SEQ ID NO: 46482 - RNA, 19 nt, Homo sapiens
gggagauguucuucacaau

SEQ ID NO: 46483 - RNA, 19 nt, Homo sapiens
ggccagggaggacaucuuu

SEQ ID NO: 46484 - RNA, 19 nt, Homo sapiens
gaccuccaguucuuuagau

SEQ ID NO: 46485 - RNA, 19 nt, Homo sapiens
gaagcaggacagccaacuu

SEQ ID NO: 46486 - RNA, 19 nt, Homo sapiens
gauggaaaggacuacauug

SEQ ID NO: 46487 - RNA, 19 nt, Homo sapiens
cgacuucuacccagggaaa

SEQ ID NO: 46488 - RNA, 19 nt, Homo sapiens
uggaaaggacuacauugaa

SEQ ID NO: 46489 - RNA, 19 nt, Homo sapiens
caggacagccaacuucaga

SEQ ID NO: 46490 - RNA, 19 nt, Homo sapiens
gagaaaagaagaaacugaa

SEQ ID NO: 46491 - RNA, 19 nt, Homo sapiens
cagggaagguuugguugug

SEQ ID NO: 46492 - RNA, 19 nt, Homo sapiens
gcagggaagguuugguugu

SEQ ID NO: 46493 - RNA, 19 nt, Homo sapiens
ucucugaccuauaucuaca

SEQ ID NO: 46494 - RNA, 19 nt, Homo sapiens
gaagugggaggcagaacca

SEQ ID NO: 46495 - RNA, 19 nt, Homo sapiens
acaauggaaauggcacuua

SEQ ID NO: 46496 - RNA, 19 nt, Homo sapiens
guaacgggucucacguauu

SEQ ID NO: 46497 - RNA, 19 nt, Homo sapiens
uuauggagacccugaaaga

SEQ ID NO: 46498 - RNA, 19 nt, Homo sapiens
gaauggaggauuggaagca

SEQ ID NO: 46499 - RNA, 19 nt, Homo sapiens
gcggaaauaccugaaauac

SEQ ID NO: 46500 - RNA, 19 nt, Homo sapiens
aaaggacuacauugaauuc

SEQ ID NO: 46501 - RNA, 19 nt, Homo sapiens
cagaagcagcggagcauuc

SEQ ID NO: 46502 - RNA, 19 nt, Homo sapiens
aguaacgggucucacguau

SEQ ID NO: 46503 - RNA, 19 nt, Homo sapiens
gaaaagaagaaacugaagu

SEQ ID NO: 46504 - RNA, 19 nt, Homo sapiens
ggaggcagaaccagucuac

SEQ ID NO: 46505 - RNA, 19 nt, Homo sapiens
cagcagcccagauaaccaa

SEQ ID NO: 46506 - RNA, 19 nt, Homo sapiens
ugagaucgagaauaacaga

SEQ ID NO: 46507 - RNA, 19 nt, Homo sapiens
aaugaccuccaguucuuua

SEQ ID NO: 46508 - RNA, 19 nt, Homo sapiens
uguccaagcauguugaaga

SEQ ID NO: 46509 - RNA, 19 nt, Homo sapiens
ggggagauguucuucacaa

SEQ ID NO: 46510 - RNA, 19 nt, Homo sapiens
ggagaaaagaagaaacuga

SEQ ID NO: 46511 - RNA, 19 nt, Homo sapiens
cugcggaaauaccugaaau

SEQ ID NO: 46512 - RNA, 19 nt, Homo sapiens
ugauggaaaggacuacauu

SEQ ID NO: 46513 - RNA, 19 nt, Homo sapiens
caguaacgggucucacgua

SEQ ID NO: 46514 - RNA, 19 nt, Homo sapiens
gcagaagugggaggcagaa

SEQ ID NO: 46515 - RNA, 19 nt, Homo sapiens
uggagacccugaaagacau

SEQ ID NO: 46516 - RNA, 19 nt, Homo sapiens
gugccuggccuacgacuuc

SEQ ID NO: 46517 - RNA, 19 nt, Homo sapiens
ccagauaaccaagcagaag

SEQ ID NO: 46518 - RNA, 19 nt, Homo sapiens
cagcccagauaaccaagca

SEQ ID NO: 46519 - RNA, 19 nt, Homo sapiens
ggaagguuugguugugaga

SEQ ID NO: 46520 - RNA, 19 nt, Homo sapiens
gaaggaauggaggauugga

SEQ ID NO: 46521 - RNA, 19 nt, Homo sapiens
cggaaauaccugaaauaca

SEQ ID NO: 46522 - RNA, 19 nt, Homo sapiens
guccaagcauguugaagac

SEQ ID NO: 46523 - RNA, 19 nt, Homo sapiens
gauguucuucacaauggaa

SEQ ID NO: 46524 - RNA, 19 nt, Homo sapiens
cagauaaccaagcagaagu

SEQ ID NO: 46525 - RNA, 19 nt, Homo sapiens
gacccagcagcccagauaa

SEQ ID NO: 46526 - RNA, 19 nt, Homo sapiens
ccaugggacucuggagaca

SEQ ID NO: 46527 - RNA, 19 nt, Homo sapiens
gagacagguggaaggaaug

SEQ ID NO: 46528 - RNA, 19 nt, Homo sapiens
cuccaguucuuuagauaca

SEQ ID NO: 46529 - RNA, 19 nt, Homo sapiens
ggagacccugaaagacauu

SEQ ID NO: 46530 - RNA, 19 nt, Homo sapiens
aagcaggacagccaacuuc

SEQ ID NO: 46531 - RNA, 19 nt, Homo sapiens
caaugaccuccaguucuuu

SEQ ID NO: 46532 - RNA, 19 nt, Homo sapiens
gagaucgagaauaacagaa

SEQ ID NO: 46533 - RNA, 19 nt, Homo sapiens
gccagggaggacaucuuua

SEQ ID NO: 46534 - RNA, 19 nt, Homo sapiens
gaaccugaacgaccugaug

SEQ ID NO: 46535 - RNA, 19 nt, Homo sapiens
gcggccagcugcuuccaaa

SEQ ID NO: 46536 - RNA, 19 nt, Homo sapiens
ggcccuggcuguaauaaag

SEQ ID NO: 46537 - RNA, 19 nt, Homo sapiens
gaucgaugguguucucaac

SEQ ID NO: 46538 - RNA, 19 nt, Homo sapiens
ccgaggcccugacuucuuc

SEQ ID NO: 46539 - RNA, 19 nt, Homo sapiens
guaauaaagaagccgaucu

SEQ ID NO: 46540 - RNA, 19 nt, Homo sapiens
caugcccgcuucgugauga

SEQ ID NO: 46541 - RNA, 19 nt, Homo sapiens
gggcgucucucccguuuuc

SEQ ID NO: 46542 - RNA, 19 nt, Homo sapiens
gaaucaaggcaggcacuuc

SEQ ID NO: 46543 - RNA, 19 nt, Homo sapiens
uaauaaagaagccgaucuc

SEQ ID NO: 46544 - RNA, 19 nt, Homo sapiens
uaggagggcuggcaacuua

SEQ ID NO: 46545 - RNA, 19 nt, Homo sapiens
gcagguugcuccacaggua

SEQ ID NO: 46546 - RNA, 19 nt, Homo sapiens
ggacaugaucuucuuuaua

SEQ ID NO: 46547 - RNA, 19 nt, Homo sapiens
acucaaagcuuguuaagau

SEQ ID NO: 46548 - RNA, 19 nt, Homo sapiens
cuccaaagauucagguuua

SEQ ID NO: 46549 - RNA, 19 nt, Homo sapiens
ggucagauuugaacucuuc

SEQ ID NO: 46550 - RNA, 19 nt, Homo sapiens
gaguaugccugccguguga

SEQ ID NO: 46551 - RNA, 19 nt, Homo sapiens
ggacuggucuuucuaucuc

SEQ ID NO: 46552 - RNA, 19 nt, Homo sapiens
gagaauggaaagucaaauu

SEQ ID NO: 46553 - RNA, 19 nt, Homo sapiens
uaagugggaucgagacaug

SEQ ID NO: 46554 - RNA, 19 nt, Homo sapiens
ucacagcccaagauaguua

SEQ ID NO: 46555 - RNA, 19 nt, Homo sapiens
gcuuauacacuuacacuuu

SEQ ID NO: 46556 - RNA, 19 nt, Homo sapiens
agaauucucuuauccaaca

SEQ ID NO: 46557 - RNA, 19 nt, Homo sapiens
guuaagcgugcauaaguua

SEQ ID NO: 46558 - RNA, 19 nt, Homo sapiens
gcauuuggauuggaugaau

SEQ ID NO: 46559 - RNA, 19 nt, Homo sapiens
cauccgacauugaaguuga

SEQ ID NO: 46560 - RNA, 19 nt, Homo sapiens
gaauggagagagaauugaa

SEQ ID NO: 46561 - RNA, 19 nt, Homo sapiens
caauuuacauacucugcuu

SEQ ID NO: 46562 - RNA, 19 nt, Homo sapiens
gcaaggacuggucuuucua

SEQ ID NO: 46563 - RNA, 19 nt, Homo sapiens
gauaaaguaaggcaugguu

SEQ ID NO: 46564 - RNA, 19 nt, Homo sapiens
gcgcuacucucucuuucug

SEQ ID NO: 46565 - RNA, 19 nt, Homo sapiens
gaagaauggagagagaauu

SEQ ID NO: 46566 - RNA, 19 nt, Homo sapiens
cauacucugcuuagaauuu

SEQ ID NO: 46567 - RNA, 19 nt, Homo sapiens
uacauacucugcuuagaau

SEQ ID NO: 46568 - RNA, 19 nt, Homo sapiens
uuacauacucugcuuagaa

SEQ ID NO: 46569 - RNA, 19 nt, Homo sapiens
ccagcguacuccaaagauu

SEQ ID NO: 46570 - RNA, 19 nt, Homo sapiens
ugacaggauuauuggaaau

SEQ ID NO: 46571 - RNA, 19 nt, Homo sapiens
gauaguuaagcgugcauaa

SEQ ID NO: 46572 - RNA, 19 nt, Homo sapiens
cucaaagcuuguuaagaua

SEQ ID NO: 46573 - RNA, 19 nt, Homo sapiens
ugauguaucugagcagguu

SEQ ID NO: 46574 - RNA, 19 nt, Homo sapiens
caggauuauuggaaauuug

SEQ ID NO: 46575 - RNA, 19 nt, Homo sapiens
caaagcuuguuaagauagu

SEQ ID NO: 46576 - RNA, 19 nt, Homo sapiens
uauccaacaucaacaucuu

SEQ ID NO: 46577 - RNA, 19 nt, Homo sapiens
ugagugcugucuccauguu

SEQ ID NO: 46578 - RNA, 19 nt, Homo sapiens
caucauggagguuugaaga

SEQ ID NO: 46579 - RNA, 19 nt, Homo sapiens
ucauggagguuugaagaug

SEQ ID NO: 46580 - RNA, 19 nt, Homo sapiens
cuuucuaucucuuguacua

SEQ ID NO: 46581 - RNA, 19 nt, Homo sapiens
gcaugguugugguuaaucu

SEQ ID NO: 46582 - RNA, 19 nt, Homo sapiens
gcagcaucauggagguuug

SEQ ID NO: 46583 - RNA, 19 nt, Homo sapiens
uaaaguaaggcaugguugu

SEQ ID NO: 46584 - RNA, 19 nt, Homo sapiens
gcacucaaagcuuguuaag

SEQ ID NO: 46585 - RNA, 19 nt, Homo sapiens
caaggacuggucuuucuau

SEQ ID NO: 46586 - RNA, 19 nt, Homo sapiens
gcagagaauggaaagucaa

SEQ ID NO: 46587 - RNA, 19 nt, Homo sapiens
cauuuggauuggaugaauu

SEQ ID NO: 46588 - RNA, 19 nt, Homo sapiens
gugugaaccaugugacuuu

SEQ ID NO: 46589 - RNA, 19 nt, Homo sapiens
cagagaauggaaagucaaa

SEQ ID NO: 46590 - RNA, 19 nt, Homo sapiens
aagaauggagagagaauug

SEQ ID NO: 46591 - RNA, 19 nt, Homo sapiens
gacaggauuauuggaaauu

SEQ ID NO: 46592 - RNA, 19 nt, Homo sapiens
auacucugcuuagaauuug

SEQ ID NO: 46593 - RNA, 19 nt, Homo sapiens
ucaaucucuugcacucaaa

SEQ ID NO: 46594 - RNA, 19 nt, Homo sapiens
cagguuuacucacgucauc

SEQ ID NO: 46595 - RNA, 19 nt, Homo sapiens
ggagggcuggcaacuuaga

SEQ ID NO: 46596 - RNA, 19 nt, Homo sapiens
aaauucugcuugcuugcuu

SEQ ID NO: 46597 - RNA, 19 nt, Homo sapiens
uaaggcaugguugugguua

SEQ ID NO: 46598 - RNA, 19 nt, Homo sapiens
uugacaggauuauuggaaa

SEQ ID NO: 46599 - RNA, 19 nt, Homo sapiens
uggacaugaucuucuuuau

SEQ ID NO: 46600 - RNA, 19 nt, Homo sapiens
ugucacagcccaagauagu

SEQ ID NO: 46601 - RNA, 19 nt, Homo sapiens
acugaagaauggagagaga

SEQ ID NO: 46602 - RNA, 19 nt, Homo sapiens
gguugugguuaaucugguu

SEQ ID NO: 46603 - RNA, 19 nt, Homo sapiens
cagcguacuccaaagauuc

SEQ ID NO: 46604 - RNA, 19 nt, Homo sapiens
ugaaccaugugacuuuguc

SEQ ID NO: 46605 - RNA, 19 nt, Homo sapiens
aguuaagcgugcauaaguu

SEQ ID NO: 46606 - RNA, 19 nt, Homo sapiens
ucaaagcuuguuaagauag

SEQ ID NO: 46607 - RNA, 19 nt, Homo sapiens
caaagauucagguuuacuc

SEQ ID NO: 46608 - RNA, 19 nt, Homo sapiens
uaguuaagcgugcauaagu

SEQ ID NO: 46609 - RNA, 19 nt, Homo sapiens
cacaaaauguaggguuaua

SEQ ID NO: 46610 - RNA, 19 nt, Homo sapiens
agacauguaagcagcauca

SEQ ID NO: 46611 - RNA, 19 nt, Homo sapiens
uuucauccauccgacauug

SEQ ID NO: 46612 - RNA, 19 nt, Homo sapiens
guaaggcaugguugugguu

SEQ ID NO: 46613 - RNA, 19 nt, Homo sapiens
cagcagagaauggaaaguc

SEQ ID NO: 46614 - RNA, 19 nt, Homo sapiens
aguggagcauucagacuug

SEQ ID NO: 46615 - RNA, 19 nt, Homo sapiens
ugaagaauggagagagaau

SEQ ID NO: 46616 - RNA, 19 nt, Homo sapiens
aaggcaugguugugguuaa

SEQ ID NO: 46617 - RNA, 19 nt, Homo sapiens
uucaaucucuugcacucaa

SEQ ID NO: 46618 - RNA, 19 nt, Homo sapiens
agcaaggacuggucuuucu

SEQ ID NO: 46619 - RNA, 19 nt, Homo sapiens
ucagcaaggacuggucuuu

SEQ ID NO: 46620 - RNA, 19 nt, Homo sapiens
aaagauucagguuuacuca

SEQ ID NO: 46621 - RNA, 19 nt, Homo sapiens
ugugaaccaugugacuuug

SEQ ID NO: 46622 - RNA, 19 nt, Homo sapiens
ggucuuucuaucucuugua

SEQ ID NO: 46623 - RNA, 19 nt, Homo sapiens
cagcaaggacuggucuuuc

SEQ ID NO: 46624 - RNA, 19 nt, Homo sapiens
ggaaggagauccagagauu

SEQ ID NO: 46625 - RNA, 19 nt, Homo sapiens
guaaauuccucucuuugua

SEQ ID NO: 46626 - RNA, 19 nt, Homo sapiens
gacuaucuauggcuauuua

SEQ ID NO: 46627 - RNA, 19 nt, Homo sapiens
aaagagaugugaugaauag

SEQ ID NO: 46628 - RNA, 19 nt, Homo sapiens
ugaggaggcugccaacuuu

SEQ ID NO: 46629 - RNA, 19 nt, Homo sapiens
gaaaagagaugugaugaau

SEQ ID NO: 46630 - RNA, 19 nt, Homo sapiens
caauuaauauccaccaaug

SEQ ID NO: 46631 - RNA, 19 nt, Homo sapiens
gcuguaaauuccucucuuu

SEQ ID NO: 46632 - RNA, 19 nt, Homo sapiens
ccagucaacucuaagaaga

SEQ ID NO: 46633 - RNA, 19 nt, Homo sapiens
ugagugcacuuguugauga

SEQ ID NO: 46634 - RNA, 19 nt, Homo sapiens
acacgcagcugcacaggaa

SEQ ID NO: 46635 - RNA, 19 nt, Homo sapiens
gaagagacaugggaagaac

SEQ ID NO: 46636 - RNA, 19 nt, Homo sapiens
gaaucaugcuucuucacuu

SEQ ID NO: 46637 - RNA, 19 nt, Homo sapiens
ccacgguacuuauuaaugg

SEQ ID NO: 46638 - RNA, 19 nt, Homo sapiens
gacccacgauuugagguua

SEQ ID NO: 46639 - RNA, 19 nt, Homo sapiens
gguagucucuguaugucaa

SEQ ID NO: 46640 - RNA, 19 nt, Homo sapiens
ggacauggugaauaaauca

SEQ ID NO: 46641 - RNA, 19 nt, Homo sapiens
aaccagaaguaacagauuu

SEQ ID NO: 46642 - RNA, 19 nt, Homo sapiens
acuggacccugcuaucuua

SEQ ID NO: 46643 - RNA, 19 nt, Homo sapiens
cugaagauauuccugaaga

SEQ ID NO: 46644 - RNA, 19 nt, Homo sapiens
gaacaacuggacccugcua

SEQ ID NO: 46645 - RNA, 19 nt, Homo sapiens
uaggacagcugaagagaca

SEQ ID NO: 46646 - RNA, 19 nt, Homo sapiens
gcaaagcacacgcugaaca

SEQ ID NO: 46647 - RNA, 19 nt, Homo sapiens
cagccacgguacuuauuaa

SEQ ID NO: 46648 - RNA, 19 nt, Homo sapiens
gagaaggugauaagacuau

SEQ ID NO: 46649 - RNA, 19 nt, Homo sapiens
gacuuagaguuaauaguga

SEQ ID NO: 46650 - RNA, 19 nt, Homo sapiens
ugacuuagaguuaauagug

SEQ ID NO: 46651 - RNA, 19 nt, Homo sapiens
gaaaagcuauuaacaagac

SEQ ID NO: 46652 - RNA, 19 nt, Homo sapiens
cagguucucuugcuagguu

SEQ ID NO: 46653 - RNA, 19 nt, Homo sapiens
gaaccuacgcugaaauuuu

SEQ ID NO: 46654 - RNA, 19 nt, Homo sapiens
ggucucuucuggucucuga

SEQ ID NO: 46655 - RNA, 19 nt, Homo sapiens
cuaagaagacuagauauuc

SEQ ID NO: 46656 - RNA, 19 nt, Homo sapiens
ccucaacgacccacgauuu

SEQ ID NO: 46657 - RNA, 19 nt, Homo sapiens
agaaguaacagauuuggaa

SEQ ID NO: 46658 - RNA, 19 nt, Homo sapiens
ugggugggcugcuugaauu

SEQ ID NO: 46659 - RNA, 19 nt, Homo sapiens
gaaggagauccagagauuu

SEQ ID NO: 46660 - RNA, 19 nt, Homo sapiens
caaagcacacgcugaacaa

SEQ ID NO: 46661 - RNA, 19 nt, Homo sapiens
aaucaugcuucuucacuug

SEQ ID NO: 46662 - RNA, 19 nt, Homo sapiens
ccuuucagauggugaguuu

SEQ ID NO: 46663 - RNA, 19 nt, Homo sapiens
ccugauauuucacuuauac

SEQ ID NO: 46664 - RNA, 19 nt, Homo sapiens
ugaagauauuccugaagaa

SEQ ID NO: 46665 - RNA, 19 nt, Homo sapiens
aaacuggacauggugaaua

SEQ ID NO: 46666 - RNA, 19 nt, Homo sapiens
aaauagaaccuacgcugaa

SEQ ID NO: 46667 - RNA, 19 nt, Homo sapiens
gaaguaacagauuuggaau

SEQ ID NO: 46668 - RNA, 19 nt, Homo sapiens
caucccaggugccacacua

SEQ ID NO: 46669 - RNA, 19 nt, Homo sapiens
aauagaaccuacgcugaaa

SEQ ID NO: 46670 - RNA, 19 nt, Homo sapiens
gcaccucauuccagaugug

SEQ ID NO: 46671 - RNA, 19 nt, Homo sapiens
gagcccagcuguaaauucc

SEQ ID NO: 46672 - RNA, 19 nt, Homo sapiens
ggccuuggcuuaccauaac

SEQ ID NO: 46673 - RNA, 19 nt, Homo sapiens
ggaccugaaucaugcuucu

SEQ ID NO: 46674 - RNA, 19 nt, Homo sapiens
aacuggacauggugaauaa

SEQ ID NO: 46675 - RNA, 19 nt, Homo sapiens
gcauaacaagcuaaccaaa

SEQ ID NO: 46676 - RNA, 19 nt, Homo sapiens
uaagaagacuagauauucc

SEQ ID NO: 46677 - RNA, 19 nt, Homo sapiens
ggagaaggugauaagacua

SEQ ID NO: 46678 - RNA, 19 nt, Homo sapiens
ucagaccagccgacacuua

SEQ ID NO: 46679 - RNA, 19 nt, Homo sapiens
ccauucugcacaauuaaua

SEQ ID NO: 46680 - RNA, 19 nt, Homo sapiens
caacuuuccuuuuggcauu

SEQ ID NO: 46681 - RNA, 19 nt, Homo sapiens
auaacaagcuaaccaaacu

SEQ ID NO: 46682 - RNA, 19 nt, Homo sapiens
ggacagcugaagagacaug

SEQ ID NO: 46683 - RNA, 19 nt, Homo sapiens
gguauaucauggucagauc

SEQ ID NO: 46684 - RNA, 19 nt, Homo sapiens
ccgcaaaccagaaguaaca

SEQ ID NO: 46685 - RNA, 19 nt, Homo sapiens
ucgaggagcucucuuucuc

SEQ ID NO: 46686 - RNA, 19 nt, Homo sapiens
uagaaccuacgcugaaauu

SEQ ID NO: 46687 - RNA, 19 nt, Homo sapiens
gaccuucucucaauuuuca

SEQ ID NO: 46688 - RNA, 19 nt, Homo sapiens
gguaauugauuuguuuggu

SEQ ID NO: 46689 - RNA, 19 nt, Homo sapiens
auaagacuaucaacagcaa

SEQ ID NO: 46690 - RNA, 19 nt, Homo sapiens
gaguacagauuggacuauc

SEQ ID NO: 46691 - RNA, 19 nt, Homo sapiens
gcaaaccagaaguaacaga

SEQ ID NO: 46692 - RNA, 19 nt, Homo sapiens
cuauagggccaaugaauuc

SEQ ID NO: 46693 - RNA, 19 nt, Homo sapiens
gcauuccacagguauauca

SEQ ID NO: 46694 - RNA, 19 nt, Homo sapiens
ucacagccacgguacuuau

SEQ ID NO: 46695 - RNA, 19 nt, Homo sapiens
caacuggacccugcuaucu

SEQ ID NO: 46696 - RNA, 19 nt, Homo sapiens
ccucuucauuguaggagaa

SEQ ID NO: 46697 - RNA, 19 nt, Homo sapiens
ggacuaucuauggcuauuu

SEQ ID NO: 46698 - RNA, 19 nt, Homo sapiens
uauacugcauaacaagcua

SEQ ID NO: 46699 - RNA, 19 nt, Homo sapiens
gccagucaauauuuguuuc

SEQ ID NO: 46700 - RNA, 19 nt, Homo sapiens
ucugaaaccugaaaagcua

SEQ ID NO: 46701 - RNA, 19 nt, Homo sapiens
acagccacgguacuuauua

SEQ ID NO: 46702 - RNA, 19 nt, Homo sapiens
ugucaaggaguacagauug

SEQ ID NO: 46703 - RNA, 19 nt, Homo sapiens
caaaccagaaguaacagau

SEQ ID NO: 46704 - RNA, 19 nt, Homo sapiens
cacaggaacaugcuuggaa

SEQ ID NO: 46705 - RNA, 19 nt, Homo sapiens
ggccagucaauauuuguuu

SEQ ID NO: 46706 - RNA, 19 nt, Homo sapiens
gggaccaacuuuccuuuug

SEQ ID NO: 46707 - RNA, 19 nt, Homo sapiens
gaccagucaacucuaagaa

SEQ ID NO: 46708 - RNA, 19 nt, Homo sapiens
aaaccagaaguaacagauu

SEQ ID NO: 46709 - RNA, 19 nt, Homo sapiens
ugaagagacaugggaagaa

SEQ ID NO: 46710 - RNA, 19 nt, Homo sapiens
aggagaaggugauaagacu

SEQ ID NO: 46711 - RNA, 19 nt, Homo sapiens
ugauuuguuuggugguuug

SEQ ID NO: 46712 - RNA, 19 nt, Homo sapiens
uaaauuccucucuuuguac

SEQ ID NO: 46713 - RNA, 19 nt, Homo sapiens
aaggagauccagagauuuc

SEQ ID NO: 46714 - RNA, 19 nt, Homo sapiens
gcacaggaacaugcuugga

SEQ ID NO: 46715 - RNA, 19 nt, Homo sapiens
caacgacccacgauuugag

SEQ ID NO: 46716 - RNA, 19 nt, Homo sapiens
ggaguacagauuggacuau

SEQ ID NO: 46717 - RNA, 19 nt, Homo sapiens
ggagcccagcuguaaauuc

SEQ ID NO: 46718 - RNA, 19 nt, Homo sapiens
uugaugagccagugcauau

SEQ ID NO: 46719 - RNA, 19 nt, Homo sapiens
acuauagggccaaugaauu

SEQ ID NO: 46720 - RNA, 19 nt, Homo sapiens
aaccuacgcugaaauuuug

SEQ ID NO: 46721 - RNA, 19 nt, Homo sapiens
gacaugggaagaacaacug

SEQ ID NO: 46722 - RNA, 19 nt, Homo sapiens
cacaauuaauauccaccaa

SEQ ID NO: 46723 - RNA, 19 nt, Homo sapiens
cagccgacacuuagggaaa

SEQ ID NO: 46724 - RNA, 19 nt, Homo sapiens
gaaagaauguugcuuacuu

SEQ ID NO: 46725 - RNA, 19 nt, Homo sapiens
gaacagaucucacagaaac

SEQ ID NO: 46726 - RNA, 19 nt, Homo sapiens
gaacuggccuucucaaugu

SEQ ID NO: 46727 - RNA, 19 nt, Homo sapiens
gaacauuacucuuccagaa

SEQ ID NO: 46728 - RNA, 19 nt, Homo sapiens
gaacaagucugaagcaagu

SEQ ID NO: 46729 - RNA, 19 nt, Homo sapiens
gcagaugacugauaaaugu

SEQ ID NO: 46730 - RNA, 19 nt, Homo sapiens
gaacaagaaugugagguaa

SEQ ID NO: 46731 - RNA, 19 nt, Homo sapiens
gaagacaaaugacaggauu

SEQ ID NO: 46732 - RNA, 19 nt, Homo sapiens
gaaguggccugcagaaguu

SEQ ID NO: 46733 - RNA, 19 nt, Homo sapiens
gcauuaaggguuucuauua

SEQ ID NO: 46734 - RNA, 19 nt, Homo sapiens
cuccagagcuuaaauauaa

SEQ ID NO: 46735 - RNA, 19 nt, Homo sapiens
gaaauaggaugaaacucaa

SEQ ID NO: 46736 - RNA, 19 nt, Homo sapiens
cagaagaggugacaguuaa

SEQ ID NO: 46737 - RNA, 19 nt, Homo sapiens
ccagaaaguuuguaaagaa

SEQ ID NO: 46738 - RNA, 19 nt, Homo sapiens
aaacagaccuuaaacuuuc

SEQ ID NO: 46739 - RNA, 19 nt, Homo sapiens
gaaaguaaauuagcaaugg

SEQ ID NO: 46740 - RNA, 19 nt, Homo sapiens
ggaaagagaucacauuuug

SEQ ID NO: 46741 - RNA, 19 nt, Homo sapiens
cagaacagcuggauuguau

SEQ ID NO: 46742 - RNA, 19 nt, Homo sapiens
aaagauggcauacugauua

SEQ ID NO: 46743 - RNA, 19 nt, Homo sapiens
caaauuuggugugguauaa

SEQ ID NO: 46744 - RNA, 19 nt, Homo sapiens
gcaagugguuggccuaaga

SEQ ID NO: 46745 - RNA, 19 nt, Homo sapiens
gcauagcauuacacauuua

SEQ ID NO: 46746 - RNA, 19 nt, Homo sapiens
gaaccuaacuggacuuugc

SEQ ID NO: 46747 - RNA, 19 nt, Homo sapiens
guaaagagaauguggauga

SEQ ID NO: 46748 - RNA, 19 nt, Homo sapiens
gaacuggcguuaccaucaa

SEQ ID NO: 46749 - RNA, 19 nt, Homo sapiens
uaaugcagauggacagaua

SEQ ID NO: 46750 - RNA, 19 nt, Homo sapiens
ggccaaguguaauuucuua

SEQ ID NO: 46751 - RNA, 19 nt, Homo sapiens
gaaagagacacuucuauag

SEQ ID NO: 46752 - RNA, 19 nt, Homo sapiens
gaaauaggacucagaauac

SEQ ID NO: 46753 - RNA, 19 nt, Homo sapiens
ggacacuccuugccaaaug

SEQ ID NO: 46754 - RNA, 19 nt, Homo sapiens
uaacuacacuaccucauau

SEQ ID NO: 46755 - RNA, 19 nt, Homo sapiens
uuaaauagccagcauguaa

SEQ ID NO: 46756 - RNA, 19 nt, Homo sapiens
gaacuucccgacaacauuu

SEQ ID NO: 46757 - RNA, 19 nt, Homo sapiens
gggaggauauugcuaguau

SEQ ID NO: 46758 - RNA, 19 nt, Homo sapiens
gaagaaauaggacucagaa

SEQ ID NO: 46759 - RNA, 19 nt, Homo sapiens
caucauggacuuccuauuu

SEQ ID NO: 46760 - RNA, 19 nt, Homo sapiens
aaacaaauguggauacagu

SEQ ID NO: 46761 - RNA, 19 nt, Homo sapiens
gaucauugcucacuauuuu

SEQ ID NO: 46762 - RNA, 19 nt, Homo sapiens
gugcaaaugucaaauaauc

SEQ ID NO: 46763 - RNA, 19 nt, Homo sapiens
agaaauaggacucagaaua

SEQ ID NO: 46764 - RNA, 19 nt, Homo sapiens
ccacugaacuucccgacaa

SEQ ID NO: 46765 - RNA, 19 nt, Homo sapiens
gauauucgaagaagaagua

SEQ ID NO: 46766 - RNA, 19 nt, Homo sapiens
gcacuugguuuaaauuucu

SEQ ID NO: 46767 - RNA, 19 nt, Homo sapiens
guacagaggaguaguuuau

SEQ ID NO: 46768 - RNA, 19 nt, Homo sapiens
ggucuuaccugaaucuuag

SEQ ID NO: 46769 - RNA, 19 nt, Homo sapiens
caugauuucuccuugauuu

SEQ ID NO: 46770 - RNA, 19 nt, Homo sapiens
cagaacagaucucacagaa

SEQ ID NO: 46771 - RNA, 19 nt, Homo sapiens
ugaaagagacacuucuaua

SEQ ID NO: 46772 - RNA, 19 nt, Homo sapiens
ugcuauagcuuacugcuua

SEQ ID NO: 46773 - RNA, 19 nt, Homo sapiens
gaaggaaagagaucacauu

SEQ ID NO: 46774 - RNA, 19 nt, Homo sapiens
guaacuacacuaccucaua

SEQ ID NO: 46775 - RNA, 19 nt, Homo sapiens
ccauauagguauuucuuug

SEQ ID NO: 46776 - RNA, 19 nt, Homo sapiens
gcaccuaucgcauaacauu

SEQ ID NO: 46777 - RNA, 19 nt, Homo sapiens
uaauaacucuuccugcuau

SEQ ID NO: 46778 - RNA, 19 nt, Homo sapiens
aaucagaagugacuccuuu

SEQ ID NO: 46779 - RNA, 19 nt, Homo sapiens
gaccuuaaacuuucacuuu

SEQ ID NO: 46780 - RNA, 19 nt, Homo sapiens
gauggcauacugauuauaa

SEQ ID NO: 46781 - RNA, 19 nt, Homo sapiens
gcuuacugcuuaacuaauu

SEQ ID NO: 46782 - RNA, 19 nt, Homo sapiens
cagcaacucugcagguuug

SEQ ID NO: 46783 - RNA, 19 nt, Homo sapiens
ccucagcucugguugauga

SEQ ID NO: 46784 - RNA, 19 nt, Homo sapiens
gugcaaauguguggaguuu

SEQ ID NO: 46785 - RNA, 19 nt, Homo sapiens
ggugacaguuaaaggauuu

SEQ ID NO: 46786 - RNA, 19 nt, Homo sapiens
uagaaagucuggcuacaug

SEQ ID NO: 46787 - RNA, 19 nt, Homo sapiens
uugagaagcugcaaaguga

SEQ ID NO: 46788 - RNA, 19 nt, Homo sapiens
gcacaagcuuacuccagaa

SEQ ID NO: 46789 - RNA, 19 nt, Homo sapiens
aaagauggcucagaacaga

SEQ ID NO: 46790 - RNA, 19 nt, Homo sapiens
cagcaagaaugcccaagaa

SEQ ID NO: 46791 - RNA, 19 nt, Homo sapiens
gauggagagcugaacauua

SEQ ID NO: 46792 - RNA, 19 nt, Homo sapiens
guacucagcugcagauugc

SEQ ID NO: 46793 - RNA, 19 nt, Homo sapiens
uacagaaucuugaaucaga

SEQ ID NO: 46794 - RNA, 19 nt, Homo sapiens
gaucuucucagcaauuaaa

SEQ ID NO: 46795 - RNA, 19 nt, Homo sapiens
ggaugaaacucaaucuuuu

SEQ ID NO: 46796 - RNA, 19 nt, Homo sapiens
gagaaaacuugacuguaua

SEQ ID NO: 46797 - RNA, 19 nt, Homo sapiens
ggaggauauugcuaguaua

SEQ ID NO: 46798 - RNA, 19 nt, Homo sapiens
ggaccagucuucaugucuu

SEQ ID NO: 46799 - RNA, 19 nt, Homo sapiens
cauaucagacagcaauuua

SEQ ID NO: 46800 - RNA, 19 nt, Homo sapiens
gaaaguuuguaaagaagca

SEQ ID NO: 46801 - RNA, 19 nt, Homo sapiens
gaaggcuguucaagcaauu

SEQ ID NO: 46802 - RNA, 19 nt, Homo sapiens
guacagacguccaagaaaa

SEQ ID NO: 46803 - RNA, 19 nt, Homo sapiens
ucuagaaacugaugaagug

SEQ ID NO: 46804 - RNA, 19 nt, Homo sapiens
ggaauccugcuuucaguuu

SEQ ID NO: 46805 - RNA, 19 nt, Homo sapiens
acaaaugacaggauuauga

SEQ ID NO: 46806 - RNA, 19 nt, Homo sapiens
gggcuugucuagcuaaugu

SEQ ID NO: 46807 - RNA, 19 nt, Homo sapiens
ggaguaguuuauaguguug

SEQ ID NO: 46808 - RNA, 19 nt, Homo sapiens
gagcaccuaucgcauaaca

SEQ ID NO: 46809 - RNA, 19 nt, Homo sapiens
agagggaucuagaaacuga

SEQ ID NO: 46810 - RNA, 19 nt, Homo sapiens
gaugaagugugcaaaugug

SEQ ID NO: 46811 - RNA, 19 nt, Homo sapiens
gagcugaacauuacucuuc

SEQ ID NO: 46812 - RNA, 19 nt, Homo sapiens
guaguugucuccagagcuu

SEQ ID NO: 46813 - RNA, 19 nt, Homo sapiens
gaacccaguuuuaauggua

SEQ ID NO: 46814 - RNA, 19 nt, Homo sapiens
ugaaauaggaugaaacuca

SEQ ID NO: 46815 - RNA, 19 nt, Homo sapiens
uggaaacgaugauuauguu

SEQ ID NO: 46816 - RNA, 19 nt, Homo sapiens
gcagguuugugaaauagga

SEQ ID NO: 46817 - RNA, 19 nt, Homo sapiens
gaaagucuggcuacaugaa

SEQ ID NO: 46818 - RNA, 19 nt, Homo sapiens
ccaauauggugacuugaau

SEQ ID NO: 46819 - RNA, 19 nt, Homo sapiens
gaaaacagaccuuaaacuu

SEQ ID NO: 46820 - RNA, 19 nt, Homo sapiens
gauagugcaucccauacug

SEQ ID NO: 46821 - RNA, 19 nt, Homo sapiens
gcaguuacuuccacucaag

SEQ ID NO: 46822 - RNA, 19 nt, Homo sapiens
ggccauaagugggaaaguu

SEQ ID NO: 46823 - RNA, 19 nt, Homo sapiens
ccaauggaacccuugauuu

SEQ ID NO: 46824 - RNA, 19 nt, Homo sapiens
gaggaugagugacgaguuu

SEQ ID NO: 46825 - RNA, 19 nt, Homo sapiens
gggcagccaucuugaauau

SEQ ID NO: 46826 - RNA, 19 nt, Homo sapiens
gauccgugcugucuccuuu

SEQ ID NO: 46827 - RNA, 19 nt, Homo sapiens
guacuucccucaggccuau

SEQ ID NO: 46828 - RNA, 19 nt, Homo sapiens
gcugugccuugacuacgua

SEQ ID NO: 46829 - RNA, 19 nt, Homo sapiens
gggccgugcucacuaccaa

SEQ ID NO: 46830 - RNA, 19 nt, Homo sapiens
caucggaaguuuuggguuu

SEQ ID NO: 46831 - RNA, 19 nt, Homo sapiens
uuuguggacuccuuuaaga

SEQ ID NO: 46832 - RNA, 19 nt, Homo sapiens
gcucacuaccaaauguuaa

SEQ ID NO: 46833 - RNA, 19 nt, Homo sapiens
gaauaugggcggaaguacu

SEQ ID NO: 46834 - RNA, 19 nt, Homo sapiens
ggaggaugagugacgaguu

SEQ ID NO: 46835 - RNA, 19 nt, Homo sapiens
aauaugggcggaaguacuu

SEQ ID NO: 46836 - RNA, 19 nt, Homo sapiens
ggagggcugacccagauuc

SEQ ID NO: 46837 - RNA, 19 nt, Homo sapiens
agggagggcugacccagau

SEQ ID NO: 46838 - RNA, 19 nt, Homo sapiens
cgugcucacuaccaaaugu

SEQ ID NO: 46839 - RNA, 19 nt, Homo sapiens
guaacaucuuguccucaca

SEQ ID NO: 46840 - RNA, 19 nt, Homo sapiens
uugacuacguaacaucuug

SEQ ID NO: 46841 - RNA, 19 nt, Homo sapiens
cuaagucgcgagccagguu

SEQ ID NO: 46842 - RNA, 19 nt, Homo sapiens
ucacagcccagagcauguu

SEQ ID NO: 46843 - RNA, 19 nt, Homo sapiens
cagcuggacgcgagucuuc

SEQ ID NO: 46844 - RNA, 19 nt, Homo sapiens
ggaugagugacgaguuugu

SEQ ID NO: 46845 - RNA, 19 nt, Homo sapiens
gggcacagcaacgcagaug

SEQ ID NO: 46846 - RNA, 19 nt, Homo sapiens
gaggaugagugacgaguuu

SEQ ID NO: 46847 - RNA, 19 nt, Homo sapiens
gggcagccaucuugaauau

SEQ ID NO: 46848 - RNA, 19 nt, Homo sapiens
gauccgugcugucuccuuu

SEQ ID NO: 46849 - RNA, 19 nt, Homo sapiens
guacuucccucaggccuau

SEQ ID NO: 46850 - RNA, 19 nt, Homo sapiens
gggccgugcucacuaccaa

SEQ ID NO: 46851 - RNA, 19 nt, Homo sapiens
caucggaaguuuuggguuu

SEQ ID NO: 46852 - RNA, 19 nt, Homo sapiens
uuuguggacuccuuuaaga

SEQ ID NO: 46853 - RNA, 19 nt, Homo sapiens
gcucacuaccaaauguuaa

SEQ ID NO: 46854 - RNA, 19 nt, Homo sapiens
gaauaugggcggaaguacu

SEQ ID NO: 46855 - RNA, 19 nt, Homo sapiens
ggaggaugagugacgaguu

SEQ ID NO: 46856 - RNA, 19 nt, Homo sapiens
aauaugggcggaaguacuu

SEQ ID NO: 46857 - RNA, 19 nt, Homo sapiens
ggagggcugacccagauuc

SEQ ID NO: 46858 - RNA, 19 nt, Homo sapiens
agggagggcugacccagau

SEQ ID NO: 46859 - RNA, 19 nt, Homo sapiens
ggucaggugccucgagauc

SEQ ID NO: 46860 - RNA, 19 nt, Homo sapiens
cgugcucacuaccaaaugu

SEQ ID NO: 46861 - RNA, 19 nt, Homo sapiens
cuaagucgcgagccagguu

SEQ ID NO: 46862 - RNA, 19 nt, Homo sapiens
cagcuggacgcgagucuuc

SEQ ID NO: 46863 - RNA, 19 nt, Homo sapiens
ggaugagugacgaguuugu

SEQ ID NO: 46864 - RNA, 19 nt, Homo sapiens
gggcacagcaacgcagaug

SEQ ID NO: 46865 - RNA, 19 nt, Homo sapiens
gaauuuaccugauuucuuc

SEQ ID NO: 46866 - RNA, 19 nt, Homo sapiens
gaagcucucugcaaacuug

SEQ ID NO: 46867 - RNA, 19 nt, Homo sapiens
gaucggaauuuaccugauu

SEQ ID NO: 46868 - RNA, 19 nt, Homo sapiens
gaaaaucucugaaggaaau

SEQ ID NO: 46869 - RNA, 19 nt, Homo sapiens
gaguaaagcuccuauucug

SEQ ID NO: 46870 - RNA, 19 nt, Homo sapiens
caaagacaguagauugaaa

SEQ ID NO: 46871 - RNA, 19 nt, Homo sapiens
ggaagagguugaacuaaag

SEQ ID NO: 46872 - RNA, 19 nt, Homo sapiens
auaaagagcuuacuggaau

SEQ ID NO: 46873 - RNA, 19 nt, Homo sapiens
gaagcgaccuggagugaag

SEQ ID NO: 46874 - RNA, 19 nt, Homo sapiens
cgagugagguguagcagaa

SEQ ID NO: 46875 - RNA, 19 nt, Homo sapiens
caauagagcaguuuaugaa

SEQ ID NO: 46876 - RNA, 19 nt, Homo sapiens
uggaagaguugaauaaaga

SEQ ID NO: 46877 - RNA, 19 nt, Homo sapiens
ucacacugguucucaauga

SEQ ID NO: 46878 - RNA, 19 nt, Homo sapiens
guaaagcuccuauucuguu

SEQ ID NO: 46879 - RNA, 19 nt, Homo sapiens
uaaagcuccuauucuguuu

SEQ ID NO: 46880 - RNA, 19 nt, Homo sapiens
aggaagagguugaacuaaa

SEQ ID NO: 46881 - RNA, 19 nt, Homo sapiens
ggagaagucuguggagaag

SEQ ID NO: 46882 - RNA, 19 nt, Homo sapiens
aaagaacaguccacaggaa

SEQ ID NO: 46883 - RNA, 19 nt, Homo sapiens
gggcagcagugaaccaguu

SEQ ID NO: 46884 - RNA, 19 nt, Homo sapiens
ggaauuuaccugauuucuu

SEQ ID NO: 46885 - RNA, 19 nt, Homo sapiens
gcugcagucuacaaacuuu

SEQ ID NO: 46886 - RNA, 19 nt, Homo sapiens
acacugauccugccagaaa

SEQ ID NO: 46887 - RNA, 19 nt, Homo sapiens
aagcacgaccuucauguua

SEQ ID NO: 46888 - RNA, 19 nt, Homo sapiens
gacaguagauugaaaagga

SEQ ID NO: 46889 - RNA, 19 nt, Homo sapiens
ugaaacauuuggagaaguc

SEQ ID NO: 46890 - RNA, 19 nt, Homo sapiens
gaagagguugaacuaaaga

SEQ ID NO: 46891 - RNA, 19 nt, Homo sapiens
guugucagcacuuggaaua

SEQ ID NO: 46892 - RNA, 19 nt, Homo sapiens
gcugggcggucaacaagug

SEQ ID NO: 46893 - RNA, 19 nt, Homo sapiens
gugcugcccugaagaaugg

SEQ ID NO: 46894 - RNA, 19 nt, Homo sapiens
uagagcaguuuaugaagau

SEQ ID NO: 46895 - RNA, 19 nt, Homo sapiens
caaacuugauaggagagua

SEQ ID NO: 46896 - RNA, 19 nt, Homo sapiens
gaaauggaaacaccguugu

SEQ ID NO: 46897 - RNA, 19 nt, Homo sapiens
gaaaaggaaaggcuuggua

SEQ ID NO: 46898 - RNA, 19 nt, Homo sapiens
auagagcaguuuaugaaga

SEQ ID NO: 46899 - RNA, 19 nt, Homo sapiens
agaagucuguggagaagau

SEQ ID NO: 46900 - RNA, 19 nt, Homo sapiens
gggaaaaucucugaaggaa

SEQ ID NO: 46901 - RNA, 19 nt, Homo sapiens
gugaaccaguuguccaaga

SEQ ID NO: 46902 - RNA, 19 nt, Homo sapiens
acaggaagagguugaacua

SEQ ID NO: 46903 - RNA, 19 nt, Homo sapiens
acaauagagcaguuuauga

SEQ ID NO: 46904 - RNA, 19 nt, Homo sapiens
aaacuugauaggagaguaa

SEQ ID NO: 46905 - RNA, 19 nt, Homo sapiens
uaaagagcuuacuggaauc

SEQ ID NO: 46906 - RNA, 19 nt, Homo sapiens
gagaguaaaagccacaaua

SEQ ID NO: 46907 - RNA, 19 nt, Homo sapiens
cagaaacucauauuuaagg

SEQ ID NO: 46908 - RNA, 19 nt, Homo sapiens
gcuggaagaguugaauaaa

SEQ ID NO: 46909 - RNA, 19 nt, Homo sapiens
caccagcucugccgucucu

SEQ ID NO: 46910 - RNA, 19 nt, Homo sapiens
uuucaaagacaguagauug

SEQ ID NO: 46911 - RNA, 19 nt, Homo sapiens
cugaccagcuggaagaguu

SEQ ID NO: 46912 - RNA, 19 nt, Homo sapiens
guugaaacauuuggagaag

SEQ ID NO: 46913 - RNA, 19 nt, Homo sapiens
gaggagauugacacacuga

SEQ ID NO: 46914 - RNA, 19 nt, Homo sapiens
gcucucugcaaacuugaua

SEQ ID NO: 46915 - RNA, 19 nt, Homo sapiens
gaacaucugccaggagacu

SEQ ID NO: 46916 - RNA, 19 nt, Homo sapiens
aaaggaaaggcuugguaaa

SEQ ID NO: 46917 - RNA, 19 nt, Homo sapiens
ggagauugacacacugauc

SEQ ID NO: 46918 - RNA, 19 nt, Homo sapiens
ccacaauagagcaguuuau

SEQ ID NO: 46919 - RNA, 19 nt, Homo sapiens
aauaaagagcuuacuggaa

SEQ ID NO: 46920 - RNA, 19 nt, Homo sapiens
uggaggagauugacacacu

SEQ ID NO: 46921 - RNA, 19 nt, Homo sapiens
gaacaguccacaggaagag

SEQ ID NO: 46922 - RNA, 19 nt, Homo sapiens
gugacacaguggagcagaa

SEQ ID NO: 46923 - RNA, 19 nt, Homo sapiens
gagguugaacuaaagaagu

SEQ ID NO: 46924 - RNA, 19 nt, Homo sapiens
ugucagcacuuggaauaca

SEQ ID NO: 46925 - RNA, 19 nt, Homo sapiens
cacacugguucucaaugaa

SEQ ID NO: 46926 - RNA, 19 nt, Homo sapiens
ggaucggaauuuaccugau

SEQ ID NO: 46927 - RNA, 19 nt, Homo sapiens
cuggaagaguugaauaaag

SEQ ID NO: 46928 - RNA, 19 nt, Homo sapiens
cagcuggaagaguugaaua

SEQ ID NO: 46929 - RNA, 19 nt, Homo sapiens
acacugguucucaaugaaa

SEQ ID NO: 46930 - RNA, 19 nt, Homo sapiens
uggcccagguuguugaaga

SEQ ID NO: 46931 - RNA, 19 nt, Homo sapiens
gaagucuguggagaagaua

SEQ ID NO: 46932 - RNA, 19 nt, Homo sapiens
gcugugcugcccugaagaa

SEQ ID NO: 46933 - RNA, 19 nt, Homo sapiens
cacaauagagcaguuuaug

SEQ ID NO: 46934 - RNA, 19 nt, Homo sapiens
agaguugaauaaagagcuu

SEQ ID NO: 46935 - RNA, 19 nt, Homo sapiens
ggaagcgaccuggagugaa

SEQ ID NO: 46936 - RNA, 19 nt, Homo sapiens
gaggugaccagggaggaaa

SEQ ID NO: 46937 - RNA, 19 nt, Homo sapiens
gagcggcugcagucuacaa

SEQ ID NO: 46938 - RNA, 19 nt, Homo sapiens
gccacaauagagcaguuua

SEQ ID NO: 46939 - RNA, 19 nt, Homo sapiens
gcacgaccuucauguuacc

SEQ ID NO: 46940 - RNA, 19 nt, Homo sapiens
gucagcacuuggaauacaa

SEQ ID NO: 46941 - RNA, 19 nt, Homo sapiens
ugaguaaagcuccuauucu

SEQ ID NO: 46942 - RNA, 19 nt, Homo sapiens
gucucuggaucggaauuua

SEQ ID NO: 46943 - RNA, 19 nt, Homo sapiens
aagaggcgacccagaguga

SEQ ID NO: 46944 - RNA, 19 nt, Homo sapiens
gcccaaggauuugcaagcu

SEQ ID NO: 46945 - RNA, 19 nt, Homo sapiens
ggaggugaccagggaggaa

SEQ ID NO: 46946 - RNA, 19 nt, Homo sapiens
uggagaagucuguggagaa

SEQ ID NO: 46947 - RNA, 19 nt, Homo sapiens
cggcugcagucuacaaacu

SEQ ID NO: 46948 - RNA, 19 nt, Homo sapiens
ugaaccaguuguccaagac

SEQ ID NO: 46949 - RNA, 19 nt, Homo sapiens
gacccagggcgaagagaug

SEQ ID NO: 46950 - RNA, 19 nt, Homo sapiens
caggaagagguugaacuaa

SEQ ID NO: 46951 - RNA, 19 nt, Homo sapiens
ggaagaguugaauaaagag

SEQ ID NO: 46952 - RNA, 19 nt, Homo sapiens
ggucauguuaauugggaaa

SEQ ID NO: 46953 - RNA, 19 nt, Homo sapiens
cagcagggcagcagugaac

SEQ ID NO: 46954 - RNA, 19 nt, Homo sapiens
guacccagauguaucauua

SEQ ID NO: 46955 - RNA, 19 nt, Homo sapiens
gaaauguuaucaacgguuu

SEQ ID NO: 46956 - RNA, 19 nt, Homo sapiens
ccugaaagauguaaguuua

SEQ ID NO: 46957 - RNA, 19 nt, Homo sapiens
guaaauucccugaguguua

SEQ ID NO: 46958 - RNA, 19 nt, Homo sapiens
caaaugcugugaagagaaa

SEQ ID NO: 46959 - RNA, 19 nt, Homo sapiens
ugaccaagcuccugaaaga

SEQ ID NO: 46960 - RNA, 19 nt, Homo sapiens
caaccaauguauuuacuga

SEQ ID NO: 46961 - RNA, 19 nt, Homo sapiens
ggagggaaauguuaucaac

SEQ ID NO: 46962 - RNA, 19 nt, Homo sapiens
uaaauucccugaguguuau

SEQ ID NO: 46963 - RNA, 19 nt, Homo sapiens
ggauuucagucacaucuuc

SEQ ID NO: 46964 - RNA, 19 nt, Homo sapiens
agucacaucuuccugcuuu

SEQ ID NO: 46965 - RNA, 19 nt, Homo sapiens
gaaauguacccagauguau

SEQ ID NO: 46966 - RNA, 19 nt, Homo sapiens
gugcaguauuucugacaua

SEQ ID NO: 46967 - RNA, 19 nt, Homo sapiens
ggagauggaguuucacugu

SEQ ID NO: 46968 - RNA, 19 nt, Homo sapiens
guagaaugauguaaauagg

SEQ ID NO: 46969 - RNA, 19 nt, Homo sapiens
gcaguauuucugacauaua

SEQ ID NO: 46970 - RNA, 19 nt, Homo sapiens
agaaauguacccagaugua

SEQ ID NO: 46971 - RNA, 19 nt, Homo sapiens
gaucauugccagagauugu

SEQ ID NO: 46972 - RNA, 19 nt, Homo sapiens
agagaaauguacccagaug

SEQ ID NO: 46973 - RNA, 19 nt, Homo sapiens
ggauggugguggcaacaga

SEQ ID NO: 46974 - RNA, 19 nt, Homo sapiens
ccaagcuccugaaagaugu

SEQ ID NO: 46975 - RNA, 19 nt, Homo sapiens
aggaggagauggaguuuca

SEQ ID NO: 46976 - RNA, 19 nt, Homo sapiens
gcucugugcuucaucuucu

SEQ ID NO: 46977 - RNA, 19 nt, Homo sapiens
gaguguuauucuacuugua

SEQ ID NO: 46978 - RNA, 19 nt, Homo sapiens
gcauagacuuuuaaacuuc

SEQ ID NO: 46979 - RNA, 19 nt, Homo sapiens
gauguaucauuauccuugu

SEQ ID NO: 46980 - RNA, 19 nt, Homo sapiens
guuaucaacgguuucauug

SEQ ID NO: 46981 - RNA, 19 nt, Homo sapiens
gagggaucauugccagaga

SEQ ID NO: 46982 - RNA, 19 nt, Homo sapiens
aaaccacuguagaaugaug

SEQ ID NO: 46983 - RNA, 19 nt, Homo sapiens
gaguggggcuggagcagua

SEQ ID NO: 46984 - RNA, 19 nt, Homo sapiens
agauggaguuucacugugu

SEQ ID NO: 46985 - RNA, 19 nt, Homo sapiens
uaucaaaugcugugaagag

SEQ ID NO: 46986 - RNA, 19 nt, Homo sapiens
caaucaguauucaacaucu

SEQ ID NO: 46987 - RNA, 19 nt, Homo sapiens
uaaguuuacuacgcauaga

SEQ ID NO: 46988 - RNA, 19 nt, Homo sapiens
cuuccaaagugccgagauu

SEQ ID NO: 46989 - RNA, 19 nt, Homo sapiens
gcuuagaggaccaggagaa

SEQ ID NO: 46990 - RNA, 19 nt, Homo sapiens
ccaaagugccgagauuaca

SEQ ID NO: 46991 - RNA, 19 nt, Homo sapiens
ccagauguaucauuauccu

SEQ ID NO: 46992 - RNA, 19 nt, Homo sapiens
gagaaauguacccagaugu

SEQ ID NO: 46993 - RNA, 19 nt, Homo sapiens
uuacagcgaugugcauuuu

SEQ ID NO: 46994 - RNA, 19 nt, Homo sapiens
cagccaggauggucucgau

SEQ ID NO: 46995 - RNA, 19 nt, Homo sapiens
gucaaucaguauucaacau

SEQ ID NO: 46996 - RNA, 19 nt, Homo sapiens
ugaguguuauucuacuugu

SEQ ID NO: 46997 - RNA, 19 nt, Homo sapiens
caccguggcucgucucacu

SEQ ID NO: 46998 - RNA, 19 nt, Homo sapiens
ucaaaugcugugaagagaa

SEQ ID NO: 46999 - RNA, 19 nt, Homo sapiens
ggagguuggagccugaaga

SEQ ID NO: 47000 - RNA, 19 nt, Homo sapiens
aauaggaggagauggaguu

SEQ ID NO: 47001 - RNA, 19 nt, Homo sapiens
ggagacggcagcucaacag

SEQ ID NO: 47002 - RNA, 19 nt, Homo sapiens
aauuuagggucuccgguau

SEQ ID NO: 47003 - RNA, 19 nt, Homo sapiens
ucaaucaguauucaacauc

SEQ ID NO: 47004 - RNA, 19 nt, Homo sapiens
gggaucauugccagagauu

SEQ ID NO: 47005 - RNA, 19 nt, Homo sapiens
gcacuuuggagccacuauc

SEQ ID NO: 47006 - RNA, 19 nt, Homo sapiens
gauuacagcgaugugcauu

SEQ ID NO: 47007 - RNA, 19 nt, Homo sapiens
gggagggaaauguuaucaa

SEQ ID NO: 47008 - RNA, 19 nt, Homo sapiens
ccugaguguuauucuacuu

SEQ ID NO: 47009 - RNA, 19 nt, Homo sapiens
acccagauguaucauuauc

SEQ ID NO: 47010 - RNA, 19 nt, Homo sapiens
ggugguggcaacagagaug

SEQ ID NO: 47011 - RNA, 19 nt, Homo sapiens
acuaucaaaugcugugaag

SEQ ID NO: 47012 - RNA, 19 nt, Homo sapiens
caaagugccgagauuacag

SEQ ID NO: 47013 - RNA, 19 nt, Homo sapiens
ugcaguauuucugacauau

SEQ ID NO: 47014 - RNA, 19 nt, Homo sapiens
ugauguaaauagggacugu

SEQ ID NO: 47015 - RNA, 19 nt, Homo sapiens
gcugugaagagaaauguac

SEQ ID NO: 47016 - RNA, 19 nt, Homo sapiens
gaacuggacuuugagaaga

SEQ ID NO: 47017 - RNA, 19 nt, Homo sapiens
gauggaaacuggaaugagu

SEQ ID NO: 47018 - RNA, 19 nt, Homo sapiens
ucaacaagcucguguccaa

SEQ ID NO: 47019 - RNA, 19 nt, Homo sapiens
gaacacgaccguccugaau

SEQ ID NO: 47020 - RNA, 19 nt, Homo sapiens
gcgcuacacucucuacaug

SEQ ID NO: 47021 - RNA, 19 nt, Homo sapiens
ccacgugggugaagaagga

SEQ ID NO: 47022 - RNA, 19 nt, Homo sapiens
cgaccguccugaauucuaa

SEQ ID NO: 47023 - RNA, 19 nt, Homo sapiens
ccaaggaggagcccaagua

SEQ ID NO: 47024 - RNA, 19 nt, Homo sapiens
ggagguacauucgcucaga

SEQ ID NO: 47025 - RNA, 19 nt, Homo sapiens
gcuacacucucuacaugaa

SEQ ID NO: 47026 - RNA, 19 nt, Homo sapiens
gcaccaagaacgagaaugu

SEQ ID NO: 47027 - RNA, 19 nt, Homo sapiens
caacuuuggugcugugauc

SEQ ID NO: 47028 - RNA, 19 nt, Homo sapiens
augcagaacuggacuuuga

SEQ ID NO: 47029 - RNA, 19 nt, Homo sapiens
gaugucugcuugagagaug

SEQ ID NO: 47030 - RNA, 19 nt, Homo sapiens
gaucgaguuugcccacaug

SEQ ID NO: 47031 - RNA, 19 nt, Homo sapiens
caaaccaaguucugcaaca

SEQ ID NO: 47032 - RNA, 19 nt, Homo sapiens
acacgaccguccugaauuc

SEQ ID NO: 47033 - RNA, 19 nt, Homo sapiens
gacaucagcuuccccauga

SEQ ID NO: 47034 - RNA, 19 nt, Homo sapiens
ugaggaacaugacagagau

SEQ ID NO: 47035 - RNA, 19 nt, Homo sapiens
ugaaaugccgugugguuga

SEQ ID NO: 47036 - RNA, 19 nt, Homo sapiens
gcacacccuuggagaucga

SEQ ID NO: 47037 - RNA, 19 nt, Homo sapiens
cccaugagaucugugauga

SEQ ID NO: 47038 - RNA, 19 nt, Homo sapiens
cagcagacgcccaacaaga

SEQ ID NO: 47039 - RNA, 19 nt, Homo sapiens
gagaaugucgccaccuugu

SEQ ID NO: 47040 - RNA, 19 nt, Homo sapiens
ccaaugcccucauccucau

SEQ ID NO: 47041 - RNA, 19 nt, Homo sapiens
cgaguuugcccacauguau

SEQ ID NO: 47042 - RNA, 19 nt, Homo sapiens
ccaccaaccagaccuguau

SEQ ID NO: 47043 - RNA, 19 nt, Homo sapiens
ggaacacgaccguccugaa

SEQ ID NO: 47044 - RNA, 19 nt, Homo sapiens
cauaccaggugacagacaa

SEQ ID NO: 47045 - RNA, 19 nt, Homo sapiens
gaaaugccgugugguugac

SEQ ID NO: 47046 - RNA, 19 nt, Homo sapiens
ccaggacgcugugaaaugc

SEQ ID NO: 47047 - RNA, 19 nt, Homo sapiens
gaguuugcccacauguaua

SEQ ID NO: 47048 - RNA, 19 nt, Homo sapiens
gacagaggccgaugaagca

SEQ ID NO: 47049 - RNA, 19 nt, Homo sapiens
ggaaaguucuucggcuacu

SEQ ID NO: 47050 - RNA, 19 nt, Homo sapiens
gaaugucgccaccuugucu

SEQ ID NO: 47051 - RNA, 19 nt, Homo sapiens
gaagcggcaccaagacaug

SEQ ID NO: 47052 - RNA, 19 nt, Homo sapiens
caaguacagcauccacauu

SEQ ID NO: 47053 - RNA, 19 nt, Homo sapiens
cauccgcuguguuuccauu

SEQ ID NO: 47054 - RNA, 19 nt, Homo sapiens
gcagaacuggacuuugaga

SEQ ID NO: 47055 - RNA, 19 nt, Homo sapiens
ccacgcuggugcagggaaa

SEQ ID NO: 47056 - RNA, 19 nt, Homo sapiens
gcuccgcccucuuccagau

SEQ ID NO: 47057 - RNA, 19 nt, Homo sapiens
gguacagcaccaugaacua

SEQ ID NO: 47058 - RNA, 19 nt, Homo sapiens
ggacgggaccagcuacagu

SEQ ID NO: 47059 - RNA, 19 nt, Homo sapiens
gcauccacauugaccagau

SEQ ID NO: 47060 - RNA, 19 nt, Homo sapiens
ucauugggauccugguguu

SEQ ID NO: 47061 - RNA, 19 nt, Homo sapiens
ggccauuucugugggauuc

SEQ ID NO: 47062 - RNA, 19 nt, Homo sapiens
ccaccuacauccgcugugu

SEQ ID NO: 47063 - RNA, 19 nt, Homo sapiens
cagcagcgcacgcgugaau

SEQ ID NO: 47064 - RNA, 19 nt, Homo sapiens
cagcggagaaggacaagga

SEQ ID NO: 47065 - RNA, 19 nt, Homo sapiens
gaagucgcgguaugcagaa

SEQ ID NO: 47066 - RNA, 19 nt, Homo sapiens
uccaucaucuccuccaaug

SEQ ID NO: 47067 - RNA, 19 nt, Homo sapiens
accaaguucugcaacauug

SEQ ID NO: 47068 - RNA, 19 nt, Homo sapiens
aaaccaaguucugcaacau

SEQ ID NO: 47069 - RNA, 19 nt, Homo sapiens
caacaagcucguguccaaa

SEQ ID NO: 47070 - RNA, 19 nt, Homo sapiens
gcacugguuguggccauuu

SEQ ID NO: 47071 - RNA, 19 nt, Homo sapiens
cagcggagccacugacauc

SEQ ID NO: 47072 - RNA, 19 nt, Homo sapiens
gaacaugacagagauuuuc

SEQ ID NO: 47073 - RNA, 19 nt, Homo sapiens
ggaagcggcaccaagacau

SEQ ID NO: 47074 - RNA, 19 nt, Homo sapiens
gaacuuuguccagauccuu

SEQ ID NO: 47075 - RNA, 19 nt, Homo sapiens
acagaacuuuguccagauc

SEQ ID NO: 47076 - RNA, 19 nt, Homo sapiens
ggacguacagaacuuuguc

SEQ ID NO: 47077 - RNA, 19 nt, Homo sapiens
gcugacagaggccgaugaa

SEQ ID NO: 47078 - RNA, 19 nt, Homo sapiens
acaagcucguguccaaaga

SEQ ID NO: 47079 - RNA, 19 nt, Homo sapiens
cugagaagcaaaccaaguu

SEQ ID NO: 47080 - RNA, 19 nt, Homo sapiens
gucgccaccuugucuguga

SEQ ID NO: 47081 - RNA, 19 nt, Homo sapiens
gaucugugaugaggacaac

SEQ ID NO: 47082 - RNA, 19 nt, Homo sapiens
guacagcaccaugaacuac

SEQ ID NO: 47083 - RNA, 19 nt, Homo sapiens
guucugucauccucaucaa

SEQ ID NO: 47084 - RNA, 19 nt, Homo sapiens
gugaccggcucuccaccuu

SEQ ID NO: 47085 - RNA, 19 nt, Homo sapiens
uacagaacuuuguccagau

SEQ ID NO: 47086 - RNA, 19 nt, Homo sapiens
uccauugacuacagaaaca

SEQ ID NO: 47087 - RNA, 19 nt, Homo sapiens
ugagggcccugagaagcaa

SEQ ID NO: 47088 - RNA, 19 nt, Homo sapiens
guaugcagaacuggacuuu

SEQ ID NO: 47089 - RNA, 19 nt, Homo sapiens
acgagaaugucgccaccuu

SEQ ID NO: 47090 - RNA, 19 nt, Homo sapiens
aguacagcauccacauuga

SEQ ID NO: 47091 - RNA, 19 nt, Homo sapiens
aaguacagcauccacauug

SEQ ID NO: 47092 - RNA, 19 nt, Homo sapiens
ucacggacaagaagcugaa

SEQ ID NO: 47093 - RNA, 19 nt, Homo sapiens
gcccugagaagcaaaccaa

SEQ ID NO: 47094 - RNA, 19 nt, Homo sapiens
ucaugcuggucaucaucua

SEQ ID NO: 47095 - RNA, 19 nt, Homo sapiens
gcuguggcguguccucucu

SEQ ID NO: 47096 - RNA, 19 nt, Homo sapiens
gaggaacaugacagagauu

SEQ ID NO: 47097 - RNA, 19 nt, Homo sapiens
caacgccacaggacucauc

SEQ ID NO: 47098 - RNA, 19 nt, Homo sapiens
gcgcacacccuuggagauc

SEQ ID NO: 47099 - RNA, 19 nt, Homo sapiens
gugcugugaucuggaagga

SEQ ID NO: 47100 - RNA, 19 nt, Homo sapiens
gugaugaggacaacuuugg

SEQ ID NO: 47101 - RNA, 19 nt, Homo sapiens
ccaaguacagcauccacau

SEQ ID NO: 47102 - RNA, 19 nt, Homo sapiens
caaggaggagcccaaguac

SEQ ID NO: 47103 - RNA, 19 nt, Homo sapiens
ugugaaaugccgugugguu

SEQ ID NO: 47104 - RNA, 19 nt, Homo sapiens
gcacuguauccuccguaga

SEQ ID NO: 47105 - RNA, 19 nt, Homo sapiens
aaaggguacagcaccauga

SEQ ID NO: 47106 - RNA, 19 nt, Homo sapiens
ggacuuuguggacgucauc

SEQ ID NO: 47107 - RNA, 19 nt, Homo sapiens
gaucuccgugacugugaaa

SEQ ID NO: 47108 - RNA, 19 nt, Homo sapiens
ucccugcgguccacagaug

SEQ ID NO: 47109 - RNA, 19 nt, Homo sapiens
cugaggaacaugacagaga

SEQ ID NO: 47110 - RNA, 19 nt, Homo sapiens
ggacuuugagaagaucaug

SEQ ID NO: 47111 - RNA, 19 nt, Homo sapiens
gauccucuucgcugucuuc

SEQ ID NO: 47112 - RNA, 19 nt, Homo sapiens
ugaagcauccguguuugug

SEQ ID NO: 47113 - RNA, 19 nt, Homo sapiens
ggaauaaacuucacucugu

SEQ ID NO: 47114 - RNA, 19 nt, Homo sapiens
cgaaagaaauuacgguauu

SEQ ID NO: 47115 - RNA, 19 nt, Homo sapiens
caacaacucuagccaauuc

SEQ ID NO: 47116 - RNA, 19 nt, Homo sapiens
gcaaugaucuguucacaac

SEQ ID NO: 47117 - RNA, 19 nt, Homo sapiens
guccugagcugcagacuaa

SEQ ID NO: 47118 - RNA, 19 nt, Homo sapiens
gagcaagaguuauggagaa

SEQ ID NO: 47119 - RNA, 19 nt, Homo sapiens
gaaauccacagcagugaua

SEQ ID NO: 47120 - RNA, 19 nt, Homo sapiens
gaaagaaauuacgguauuc

SEQ ID NO: 47121 - RNA, 19 nt, Homo sapiens
gagaagcgguggagugugu

SEQ ID NO: 47122 - RNA, 19 nt, Homo sapiens
gagcagcaaugaucuguuc

SEQ ID NO: 47123 - RNA, 19 nt, Homo sapiens
ggauggagagcaagaguua

SEQ ID NO: 47124 - RNA, 19 nt, Homo sapiens
gaacuuuguugggaauaaa

SEQ ID NO: 47125 - RNA, 19 nt, Homo sapiens
gaagaggaaccgaaaguga

SEQ ID NO: 47126 - RNA, 19 nt, Homo sapiens
ccagggcccuuccuuguuu

SEQ ID NO: 47127 - RNA, 19 nt, Homo sapiens
agacuaagcucugcaguau

SEQ ID NO: 47128 - RNA, 19 nt, Homo sapiens
ggaacuuuguugggaauaa

SEQ ID NO: 47129 - RNA, 19 nt, Homo sapiens
ggaucuggcuugucaaaca

SEQ ID NO: 47130 - RNA, 19 nt, Homo sapiens
ccacagcagugauacaugu

SEQ ID NO: 47131 - RNA, 19 nt, Homo sapiens
gcgcagggcuuugucauca

SEQ ID NO: 47132 - RNA, 19 nt, Homo sapiens
gaugaguccuccuacuuug

SEQ ID NO: 47133 - RNA, 19 nt, Homo sapiens
ggccaacccuguuuacaug

SEQ ID NO: 47134 - RNA, 19 nt, Homo sapiens
cagaaucccuauggaauga

SEQ ID NO: 47135 - RNA, 19 nt, Homo sapiens
gaaggccagugguuagaau

SEQ ID NO: 47136 - RNA, 19 nt, Homo sapiens
gaucggugcuguacucuac

SEQ ID NO: 47137 - RNA, 19 nt, Homo sapiens
gcucuucucuguggacauu

SEQ ID NO: 47138 - RNA, 19 nt, Homo sapiens
caaccgagaugagauaugg

SEQ ID NO: 47139 - RNA, 19 nt, Homo sapiens
gaaacggcauucagaacuc

SEQ ID NO: 47140 - RNA, 19 nt, Homo sapiens
ggccgugucuguuggcuuu

SEQ ID NO: 47141 - RNA, 19 nt, Homo sapiens
caagaguuauggagaauac

SEQ ID NO: 47142 - RNA, 19 nt, Homo sapiens
ggacugcccacugcauaua

SEQ ID NO: 47143 - RNA, 19 nt, Homo sapiens
auucagaccuggacuuuga

SEQ ID NO: 47144 - RNA, 19 nt, Homo sapiens
gggcauggcucagguugug

SEQ ID NO: 47145 - RNA, 19 nt, Homo sapiens
ggagcaccuucaaaucuau

SEQ ID NO: 47146 - RNA, 19 nt, Homo sapiens
gccgagagguccaggaugu

SEQ ID NO: 47147 - RNA, 19 nt, Homo sapiens
ggaaucaucgucuucaaca

SEQ ID NO: 47148 - RNA, 19 nt, Homo sapiens
ucacaaccgagaugagaua

SEQ ID NO: 47149 - RNA, 19 nt, Homo sapiens
uggagcaccuucaaaucua

SEQ ID NO: 47150 - RNA, 19 nt, Homo sapiens
gcagauccugucagacuuu

SEQ ID NO: 47151 - RNA, 19 nt, Homo sapiens
gaaucaucgucuucaacaa

SEQ ID NO: 47152 - RNA, 19 nt, Homo sapiens
caacagcgcagccggaagu

SEQ ID NO: 47153 - RNA, 19 nt, Homo sapiens
gcccuagccuuccgcuuug

SEQ ID NO: 47154 - RNA, 19 nt, Homo sapiens
ucucagcuguguccaguga

SEQ ID NO: 47155 - RNA, 19 nt, Homo sapiens
gguggaaggccagugguua

SEQ ID NO: 47156 - RNA, 19 nt, Homo sapiens
gcaagaguuauggagaaua

SEQ ID NO: 47157 - RNA, 19 nt, Homo sapiens
ggaaacggcauucagaacu

SEQ ID NO: 47158 - RNA, 19 nt, Homo sapiens
gaacaugcucaucggaauc

SEQ ID NO: 47159 - RNA, 19 nt, Homo sapiens
gugaagccuuguagugaga

SEQ ID NO: 47160 - RNA, 19 nt, Homo sapiens
gaggugaagccuuguagug

SEQ ID NO: 47161 - RNA, 19 nt, Homo sapiens
acuaagcucugcaguaugg

SEQ ID NO: 47162 - RNA, 19 nt, Homo sapiens
ugaacaugcucaucggaau

SEQ ID NO: 47163 - RNA, 19 nt, Homo sapiens
ggacuacuccagagcagau

SEQ ID NO: 47164 - RNA, 19 nt, Homo sapiens
ucacugcugugcacugcuu

SEQ ID NO: 47165 - RNA, 19 nt, Homo sapiens
ucugaacgcuccaucaucu

SEQ ID NO: 47166 - RNA, 19 nt, Homo sapiens
gagcucuccuacaucauca

SEQ ID NO: 47167 - RNA, 19 nt, Homo sapiens
ugaugaguccuccuacuuu

SEQ ID NO: 47168 - RNA, 19 nt, Homo sapiens
gucgaggucuugcucauca

SEQ ID NO: 47169 - RNA, 19 nt, Homo sapiens
cagcaccuguccaccuuug

SEQ ID NO: 47170 - RNA, 19 nt, Homo sapiens
gccagcaccuguccaccuu

SEQ ID NO: 47171 - RNA, 19 nt, Homo sapiens
aacaacaacucuagccaau

SEQ ID NO: 47172 - RNA, 19 nt, Homo sapiens
gauccugucagacuuugaa

SEQ ID NO: 47173 - RNA, 19 nt, Homo sapiens
cgccaucuaugccgccuuu

SEQ ID NO: 47174 - RNA, 19 nt, Homo sapiens
gcccucggcugaugaugug

SEQ ID NO: 47175 - RNA, 19 nt, Homo sapiens
gcacuucgacaagaacuuc

SEQ ID NO: 47176 - RNA, 19 nt, Homo sapiens
gagcuggagcaccuucaaa

SEQ ID NO: 47177 - RNA, 19 nt, Homo sapiens
gcgaaagaaauuacgguau

SEQ ID NO: 47178 - RNA, 19 nt, Homo sapiens
ccagaaucccuauggaaug

SEQ ID NO: 47179 - RNA, 19 nt, Homo sapiens
ggcaagggacauaggauga

SEQ ID NO: 47180 - RNA, 19 nt, Homo sapiens
ggguggagguggugaggau

SEQ ID NO: 47181 - RNA, 19 nt, Homo sapiens
gaucuggcuugucaaacag

SEQ ID NO: 47182 - RNA, 19 nt, Homo sapiens
ggauguggaucuggcuugu

SEQ ID NO: 47183 - RNA, 19 nt, Homo sapiens
ggugggcgaugcucucaag

SEQ ID NO: 47184 - RNA, 19 nt, Homo sapiens
ggaagaggaaccgaaagug

SEQ ID NO: 47185 - RNA, 19 nt, Homo sapiens
guauucagaccuggacuuu

SEQ ID NO: 47186 - RNA, 19 nt, Homo sapiens
ucacccugcucgccaucua

SEQ ID NO: 47187 - RNA, 19 nt, Homo sapiens
gaguaccgcuaccuguauc

SEQ ID NO: 47188 - RNA, 19 nt, Homo sapiens
ggaaggccagugguuagaa

SEQ ID NO: 47189 - RNA, 19 nt, Homo sapiens
gcccacacccuguccaaug

SEQ ID NO: 47190 - RNA, 19 nt, Homo sapiens
accacgagcucaaccagaa

SEQ ID NO: 47191 - RNA, 19 nt, Homo sapiens
agaaauuacgguauucaga

SEQ ID NO: 47192 - RNA, 19 nt, Homo sapiens
ggaaauccacagcagugau

SEQ ID NO: 47193 - RNA, 19 nt, Homo sapiens
ggaacgccauggccucacu

SEQ ID NO: 47194 - RNA, 19 nt, Homo sapiens
ucacugacaccuuuaagag

SEQ ID NO: 47195 - RNA, 19 nt, Homo sapiens
cggcgcaccuacuauagug

SEQ ID NO: 47196 - RNA, 19 nt, Homo sapiens
ccacuaccuggucaacuuu

SEQ ID NO: 47197 - RNA, 19 nt, Homo sapiens
caacccuguuuacaugugu

SEQ ID NO: 47198 - RNA, 19 nt, Homo sapiens
gcagggcuuugucaucacu

SEQ ID NO: 47199 - RNA, 19 nt, Homo sapiens
ucucaguaaagcaagauua

SEQ ID NO: 47200 - RNA, 19 nt, Homo sapiens
gggaccugcucuucucugu

SEQ ID NO: 47201 - RNA, 19 nt, Homo sapiens
aagaggaaccgaaagugaa

SEQ ID NO: 47202 - RNA, 19 nt, Homo sapiens
cagcaaugaucuguucaca

SEQ ID NO: 47203 - RNA, 19 nt, Homo sapiens
caacuccgcgcagggcuuu

SEQ ID NO: 47204 - RNA, 19 nt, Homo sapiens
gcaagggcgugugcaccau

SEQ ID NO: 47205 - RNA, 19 nt, Homo sapiens
guccaccuuugcuguacua

SEQ ID NO: 47206 - RNA, 19 nt, Homo sapiens
ucuccuacaucaucaaugg

SEQ ID NO: 47207 - RNA, 19 nt, Homo sapiens
cggagcgugugcaccgaua

SEQ ID NO: 47208 - RNA, 19 nt, Homo sapiens
gggagaagcgguggagugu

SEQ ID NO: 47209 - RNA, 19 nt, Homo sapiens
uguccagccuuccaugaga

SEQ ID NO: 47210 - RNA, 19 nt, Homo sapiens
gaggaggugaagccuugua

SEQ ID NO: 47211 - RNA, 19 nt, Homo sapiens
ccaacccuguuuacaugug

SEQ ID NO: 47212 - RNA, 19 nt, Homo sapiens
ccucuuugcugucuucaac

SEQ ID NO: 47213 - RNA, 19 nt, Homo sapiens
gcaagaaacucagaagaua

SEQ ID NO: 47214 - RNA, 19 nt, Homo sapiens
ggacacggcuuauaagaaa

SEQ ID NO: 47215 - RNA, 19 nt, Homo sapiens
gaaagugacuauauuguga

SEQ ID NO: 47216 - RNA, 19 nt, Homo sapiens
gaacuuguguaucaccuua

SEQ ID NO: 47217 - RNA, 19 nt, Homo sapiens
gauaaacgcuccauauugu

SEQ ID NO: 47218 - RNA, 19 nt, Homo sapiens
ggacuaagguagagacaaa

SEQ ID NO: 47219 - RNA, 19 nt, Homo sapiens
gaaacuggaucaacgauau

SEQ ID NO: 47220 - RNA, 19 nt, Homo sapiens
ggacagauuucgggauaua

SEQ ID NO: 47221 - RNA, 19 nt, Homo sapiens
gcggagaacuguguacuua

SEQ ID NO: 47222 - RNA, 19 nt, Homo sapiens
gaugggagaucauacaauu

SEQ ID NO: 47223 - RNA, 19 nt, Homo sapiens
gacaucaacuuuccaauga

SEQ ID NO: 47224 - RNA, 19 nt, Homo sapiens
ggaacuauuucaagaacua

SEQ ID NO: 47225 - RNA, 19 nt, Homo sapiens
gagauggaauccuagauaa

SEQ ID NO: 47226 - RNA, 19 nt, Homo sapiens
gaauggauuuguaagguaa

SEQ ID NO: 47227 - RNA, 19 nt, Homo sapiens
ggaauggauuuguaaggua

SEQ ID NO: 47228 - RNA, 19 nt, Homo sapiens
gauggaaagugacuauauu

SEQ ID NO: 47229 - RNA, 19 nt, Homo sapiens
caagaugcauaucaaauga

SEQ ID NO: 47230 - RNA, 19 nt, Homo sapiens
caucauaagccuuguaaua

SEQ ID NO: 47231 - RNA, 19 nt, Homo sapiens
gaaauguaguggcuaguau

SEQ ID NO: 47232 - RNA, 19 nt, Homo sapiens
gaucaguucuucauaagga

SEQ ID NO: 47233 - RNA, 19 nt, Homo sapiens
gcuaagcuauucaacauug

SEQ ID NO: 47234 - RNA, 19 nt, Homo sapiens
gcaagagggugacuuucaa

SEQ ID NO: 47235 - RNA, 19 nt, Homo sapiens
ggagaacuguguacuuaug

SEQ ID NO: 47236 - RNA, 19 nt, Homo sapiens
ggaacacuuucuaggauuu

SEQ ID NO: 47237 - RNA, 19 nt, Homo sapiens
ucagcaaccuagagaaaua

SEQ ID NO: 47238 - RNA, 19 nt, Homo sapiens
caacuaauuucccaggauu

SEQ ID NO: 47239 - RNA, 19 nt, Homo sapiens
ucaaugaguucuuuagaga

SEQ ID NO: 47240 - RNA, 19 nt, Homo sapiens
gaagauaggguaguaauuc

SEQ ID NO: 47241 - RNA, 19 nt, Homo sapiens
gaagaugcacaacagauuu

SEQ ID NO: 47242 - RNA, 19 nt, Homo sapiens
gaagaggcauauggaacua

SEQ ID NO: 47243 - RNA, 19 nt, Homo sapiens
gcucaaaugugccaagugu

SEQ ID NO: 47244 - RNA, 19 nt, Homo sapiens
ggacagacucagacacaua

SEQ ID NO: 47245 - RNA, 19 nt, Homo sapiens
ucuaucaucucauccaaua

SEQ ID NO: 47246 - RNA, 19 nt, Homo sapiens
caaaguaaacccugaauuc

SEQ ID NO: 47247 - RNA, 19 nt, Homo sapiens
gaaaggcuauugcacuaca

SEQ ID NO: 47248 - RNA, 19 nt, Homo sapiens
gcaguggucuuucuugcuu

SEQ ID NO: 47249 - RNA, 19 nt, Homo sapiens
cauaagccuuguaauauug

SEQ ID NO: 47250 - RNA, 19 nt, Homo sapiens
ggagaagugucugaauuug

SEQ ID NO: 47251 - RNA, 19 nt, Homo sapiens
guaaccugcugauuuauau

SEQ ID NO: 47252 - RNA, 19 nt, Homo sapiens
agauagaacuagcucauuu

SEQ ID NO: 47253 - RNA, 19 nt, Homo sapiens
gaaucaaggguuugcaaua

SEQ ID NO: 47254 - RNA, 19 nt, Homo sapiens
ccucugaguuggaugauaa

SEQ ID NO: 47255 - RNA, 19 nt, Homo sapiens
guaauggaccaguucaaua

SEQ ID NO: 47256 - RNA, 19 nt, Homo sapiens
aaagaaugauggaaaguga

SEQ ID NO: 47257 - RNA, 19 nt, Homo sapiens
caagaaagaaugauggaaa

SEQ ID NO: 47258 - RNA, 19 nt, Homo sapiens
gggcuaagcuauucaacau

SEQ ID NO: 47259 - RNA, 19 nt, Homo sapiens
cuuaaugacuggaaaugua

SEQ ID NO: 47260 - RNA, 19 nt, Homo sapiens
uaacagggcagcaauguga

SEQ ID NO: 47261 - RNA, 19 nt, Homo sapiens
aaucaaggguuugcaauaa

SEQ ID NO: 47262 - RNA, 19 nt, Homo sapiens
gcaggacuaucaagaagug

SEQ ID NO: 47263 - RNA, 19 nt, Homo sapiens
ccaccuaucuccugguuau

SEQ ID NO: 47264 - RNA, 19 nt, Homo sapiens
gcaagaugcauaucaaaug

SEQ ID NO: 47265 - RNA, 19 nt, Homo sapiens
aaauaugcccugaggauua

SEQ ID NO: 47266 - RNA, 19 nt, Homo sapiens
aaccagaacuuguguauca

SEQ ID NO: 47267 - RNA, 19 nt, Homo sapiens
ucaguaggcuucaccagaa

SEQ ID NO: 47268 - RNA, 19 nt, Homo sapiens
caauaacacugcccucugu

SEQ ID NO: 47269 - RNA, 19 nt, Homo sapiens
aggaacauaugcagaauuu

SEQ ID NO: 47270 - RNA, 19 nt, Homo sapiens
ggaugaaggcuguucguaa

SEQ ID NO: 47271 - RNA, 19 nt, Homo sapiens
acccaagucugcaaucuua

SEQ ID NO: 47272 - RNA, 19 nt, Homo sapiens
gaggacuacucuaugcuuu

SEQ ID NO: 47273 - RNA, 19 nt, Homo sapiens
ugagagauccauaauacua

SEQ ID NO: 47274 - RNA, 19 nt, Homo sapiens
gaaucccuauuguguauug

SEQ ID NO: 47275 - RNA, 19 nt, Homo sapiens
ggaagaugcacaacagauu

SEQ ID NO: 47276 - RNA, 19 nt, Homo sapiens
gcaccugcccucagcauuu

SEQ ID NO: 47277 - RNA, 19 nt, Homo sapiens
guucguaaccugcugauuu

SEQ ID NO: 47278 - RNA, 19 nt, Homo sapiens
guaaauaaccagccuucaa

SEQ ID NO: 47279 - RNA, 19 nt, Homo sapiens
gagaaauaaucauggaauc

SEQ ID NO: 47280 - RNA, 19 nt, Homo sapiens
ucaaauaguuagcaaccuu

SEQ ID NO: 47281 - RNA, 19 nt, Homo sapiens
gcacugacacuuaagacuu

SEQ ID NO: 47282 - RNA, 19 nt, Homo sapiens
gggagaagugucugaauuu

SEQ ID NO: 47283 - RNA, 19 nt, Homo sapiens
ucaacgauaucaaugaguu

SEQ ID NO: 47284 - RNA, 19 nt, Homo sapiens
gcaaggcuuuguuauaguc

SEQ ID NO: 47285 - RNA, 19 nt, Homo sapiens
ggaaauguaguggcuagua

SEQ ID NO: 47286 - RNA, 19 nt, Homo sapiens
gcacauguucgguuacuug

SEQ ID NO: 47287 - RNA, 19 nt, Homo sapiens
ggacagugugacuaucuua

SEQ ID NO: 47288 - RNA, 19 nt, Homo sapiens
gaucaacgauaucaaugag

SEQ ID NO: 47289 - RNA, 19 nt, Homo sapiens
gaacauaugcagaauuugc

SEQ ID NO: 47290 - RNA, 19 nt, Homo sapiens
gcuauugcacuacaaagua

SEQ ID NO: 47291 - RNA, 19 nt, Homo sapiens
gaugaaggcuguucguaac

SEQ ID NO: 47292 - RNA, 19 nt, Homo sapiens
gcaaucauauauggcugua

SEQ ID NO: 47293 - RNA, 19 nt, Homo sapiens
gcacaaccaccacugcauu

SEQ ID NO: 47294 - RNA, 19 nt, Homo sapiens
gaaauaugcccugaggauu

SEQ ID NO: 47295 - RNA, 19 nt, Homo sapiens
gcgaagaagugagaagaug

SEQ ID NO: 47296 - RNA, 19 nt, Homo sapiens
gaucguauucuguaaguga

SEQ ID NO: 47297 - RNA, 19 nt, Homo sapiens
ccaugaagcacaauguaua

SEQ ID NO: 47298 - RNA, 19 nt, Homo sapiens
auucagaccuugacuuuga

SEQ ID NO: 47299 - RNA, 19 nt, Homo sapiens
ggaaagugacuauauugug

SEQ ID NO: 47300 - RNA, 19 nt, Homo sapiens
cauaguccauccucaagaa

SEQ ID NO: 47301 - RNA, 19 nt, Homo sapiens
acacagagccggucagaug

SEQ ID NO: 47302 - RNA, 19 nt, Homo sapiens
aauaaggccugaacccaaa

SEQ ID NO: 47303 - RNA, 19 nt, Homo sapiens
gaaugggacucagcagaga

SEQ ID NO: 47304 - RNA, 19 nt, Homo sapiens
ugaaggaccugaaacacau

SEQ ID NO: 47305 - RNA, 19 nt, Homo sapiens
uaugguaacuucucacuag

SEQ ID NO: 47306 - RNA, 19 nt, Homo sapiens
gagaaggucaugcauacaa

SEQ ID NO: 47307 - RNA, 19 nt, Homo sapiens
uaaauaaccagccuucaau

SEQ ID NO: 47308 - RNA, 19 nt, Homo sapiens
gaaguucuguaaauaacca

SEQ ID NO: 47309 - RNA, 19 nt, Homo sapiens
gagcuuagcaauccauguu

SEQ ID NO: 47310 - RNA, 19 nt, Homo sapiens
gagagauccauaauacuaa

SEQ ID NO: 47311 - RNA, 19 nt, Homo sapiens
ucacuccggugucaucaaa

SEQ ID NO: 47312 - RNA, 19 nt, Homo sapiens
uaacagacaucaacuuucc

SEQ ID NO: 47313 - RNA, 19 nt, Homo sapiens
gacagugccuucucuauug

SEQ ID NO: 47314 - RNA, 19 nt, Homo sapiens
gaaauaaacugugcaaucc

SEQ ID NO: 47315 - RNA, 19 nt, Homo sapiens
ggaaauaaacugugcaauc

SEQ ID NO: 47316 - RNA, 19 nt, Homo sapiens
ggacuugguuuguuauauc

SEQ ID NO: 47317 - RNA, 19 nt, Homo sapiens
ggauucagcuauucuggaa

SEQ ID NO: 47318 - RNA, 19 nt, Homo sapiens
cuacagggcuuaggacuug

SEQ ID NO: 47319 - RNA, 19 nt, Homo sapiens
cuuaggacuugguuuguua

SEQ ID NO: 47320 - RNA, 19 nt, Homo sapiens
caagaguacagaagcuuua

SEQ ID NO: 47321 - RNA, 19 nt, Homo sapiens
gaagaucagcacccuaaga

SEQ ID NO: 47322 - RNA, 19 nt, Homo sapiens
agaaaguguuuaacgguuu

SEQ ID NO: 47323 - RNA, 19 nt, Homo sapiens
uacagaagcuuuagcaagu

SEQ ID NO: 47324 - RNA, 19 nt, Homo sapiens
gugaauacuugaacucugu

SEQ ID NO: 47325 - RNA, 19 nt, Homo sapiens
ugucugaacucacguguca

SEQ ID NO: 47326 - RNA, 19 nt, Homo sapiens
gaucagcacccuaagagau

SEQ ID NO: 47327 - RNA, 19 nt, Homo sapiens
cagagaaugccuaugagua

SEQ ID NO: 47328 - RNA, 19 nt, Homo sapiens
ugacagugccuucucuauu

SEQ ID NO: 47329 - RNA, 19 nt, Homo sapiens
cagcuauucuggaagauca

SEQ ID NO: 47330 - RNA, 19 nt, Homo sapiens
gaaaguguuuaacgguuuu

SEQ ID NO: 47331 - RNA, 19 nt, Homo sapiens
uaugaguacuucaccaaga

SEQ ID NO: 47332 - RNA, 19 nt, Homo sapiens
gcagguagcccaggacaca

SEQ ID NO: 47333 - RNA, 19 nt, Homo sapiens
gcuuaggacuugguuuguu

SEQ ID NO: 47334 - RNA, 19 nt, Homo sapiens
gggcuuaggacuugguuug

SEQ ID NO: 47335 - RNA, 19 nt, Homo sapiens
caaccgacgcuaugacuca

SEQ ID NO: 47336 - RNA, 19 nt, Homo sapiens
gggccaagguccugcucaa

SEQ ID NO: 47337 - RNA, 19 nt, Homo sapiens
uggaagaucagcacccuaa

SEQ ID NO: 47338 - RNA, 19 nt, Homo sapiens
gaaugccuaugaguacuuc

SEQ ID NO: 47339 - RNA, 19 nt, Homo sapiens
cgacaucaaccgacgcuau

SEQ ID NO: 47340 - RNA, 19 nt, Homo sapiens
gacuugguuuguuauauca

SEQ ID NO: 47341 - RNA, 19 nt, Homo sapiens
gaacugugaauacuugaac

SEQ ID NO: 47342 - RNA, 19 nt, Homo sapiens
ggagaaggacuaucaacac

SEQ ID NO: 47343 - RNA, 19 nt, Homo sapiens
gggagaaggacuaucaaca

SEQ ID NO: 47344 - RNA, 19 nt, Homo sapiens
gcucccaacccauucacua

SEQ ID NO: 47345 - RNA, 19 nt, Homo sapiens
gacggcagcucgccaucau

SEQ ID NO: 47346 - RNA, 19 nt, Homo sapiens
ccaagguccugcucaacuc

SEQ ID NO: 47347 - RNA, 19 nt, Homo sapiens
cagaagcuuuagcaagugu

SEQ ID NO: 47348 - RNA, 19 nt, Homo sapiens
gcagagaaugccuaugagu

SEQ ID NO: 47349 - RNA, 19 nt, Homo sapiens
ucugaguguuuggaaauaa

SEQ ID NO: 47350 - RNA, 19 nt, Homo sapiens
cugaguguuuggaaauaaa

SEQ ID NO: 47351 - RNA, 19 nt, Homo sapiens
gaaaaggaguagggaguuc

SEQ ID NO: 47352 - RNA, 19 nt, Homo sapiens
ccaagguccucucaguucu

SEQ ID NO: 47353 - RNA, 19 nt, Homo sapiens
ucaagaguacagaagcuuu

SEQ ID NO: 47354 - RNA, 19 nt, Homo sapiens
gagaaugccuaugaguacu

SEQ ID NO: 47355 - RNA, 19 nt, Homo sapiens
gacaucaaccgacgcuaug

SEQ ID NO: 47356 - RNA, 19 nt, Homo sapiens
acccagagauggucaccuu

SEQ ID NO: 47357 - RNA, 19 nt, Homo sapiens
cuuccucucuccuuauaga

SEQ ID NO: 47358 - RNA, 19 nt, Homo sapiens
ggggaacugugaauacuug

SEQ ID NO: 47359 - RNA, 19 nt, Homo sapiens
cuaagugggagaaggacua

SEQ ID NO: 47360 - RNA, 19 nt, Homo sapiens
gguggcagcccugaacuug

SEQ ID NO: 47361 - RNA, 19 nt, Homo sapiens
uggccugacuggcuuccua

SEQ ID NO: 47362 - RNA, 19 nt, Homo sapiens
ggaacugugaauacuugaa

SEQ ID NO: 47363 - RNA, 19 nt, Homo sapiens
auucagcuauucuggaaga

SEQ ID NO: 47364 - RNA, 19 nt, Homo sapiens
gccaccagccuguuugaga

SEQ ID NO: 47365 - RNA, 19 nt, Homo sapiens
ggacuaucaacaccacuag

SEQ ID NO: 47366 - RNA, 19 nt, Homo sapiens
guuggacucucagggauuc

SEQ ID NO: 47367 - RNA, 19 nt, Homo sapiens
gagagcccauucccaccau

SEQ ID NO: 47368 - RNA, 19 nt, Homo sapiens
ggaguagggaguucaucug

SEQ ID NO: 47369 - RNA, 19 nt, Homo sapiens
cccuuccucucuccuuaua

SEQ ID NO: 47370 - RNA, 19 nt, Homo sapiens
guuuaacgguuuuagcuuu

SEQ ID NO: 47371 - RNA, 19 nt, Homo sapiens
gaguacagaagcuuuagca

SEQ ID NO: 47372 - RNA, 19 nt, Homo sapiens
gggauuggugggucuaugu

SEQ ID NO: 47373 - RNA, 19 nt, Homo sapiens
ccuauccucugaguguuug

SEQ ID NO: 47374 - RNA, 19 nt, Homo sapiens
uaucaacaccacuaggaau

SEQ ID NO: 47375 - RNA, 19 nt, Homo sapiens
ccaggagcaggaccuacua

SEQ ID NO: 47376 - RNA, 19 nt, Homo sapiens
ggauuggugggucuauguu

SEQ ID NO: 47377 - RNA, 19 nt, Homo sapiens
gucuuugccuucucuguuc

SEQ ID NO: 47378 - RNA, 19 nt, Homo sapiens
gauugccaccagccuguuu

SEQ ID NO: 47379 - RNA, 19 nt, Homo sapiens
agagaaugccuaugaguac

SEQ ID NO: 47380 - RNA, 19 nt, Homo sapiens
guaaaggcuacauccagau

SEQ ID NO: 47381 - RNA, 19 nt, Homo sapiens
acagaagcuuuagcaagug

SEQ ID NO: 47382 - RNA, 19 nt, Homo sapiens
cccaagguccucucaguuc

SEQ ID NO: 47383 - RNA, 19 nt, Homo sapiens
gaguacuucaccaagauug

SEQ ID NO: 47384 - RNA, 19 nt, Homo sapiens
gaucuacaggggacaagua

SEQ ID NO: 47385 - RNA, 19 nt, Homo sapiens
guucuugauucagccaaau

SEQ ID NO: 47386 - RNA, 19 nt, Homo sapiens
cucccuuccucucuccuua

SEQ ID NO: 47387 - RNA, 19 nt, Homo sapiens
gcccauucccaccauucua

SEQ ID NO: 47388 - RNA, 19 nt, Homo sapiens
ccucugaguguuuggaaau

SEQ ID NO: 47389 - RNA, 19 nt, Homo sapiens
ggugacagugccuucucua

SEQ ID NO: 47390 - RNA, 19 nt, Homo sapiens
gcucuggcacaguguaauc

SEQ ID NO: 47391 - RNA, 19 nt, Homo sapiens
gcaggaacaggaggcugaa

SEQ ID NO: 47392 - RNA, 19 nt, Homo sapiens
caaguaaaggcuacaucca

SEQ ID NO: 47393 - RNA, 19 nt, Homo sapiens
gcuaccgucuggcccuaca

SEQ ID NO: 47394 - RNA, 19 nt, Homo sapiens
ccaagaagguggccguaaa

SEQ ID NO: 47395 - RNA, 19 nt, Homo sapiens
gaacagaggcacccuaugg

SEQ ID NO: 47396 - RNA, 19 nt, Homo sapiens
caacuagaguauuaacugu

SEQ ID NO: 47397 - RNA, 19 nt, Homo sapiens
gaucccaccugucuuguca

SEQ ID NO: 47398 - RNA, 19 nt, Homo sapiens
gaagcucuauucgcuguau

SEQ ID NO: 47399 - RNA, 19 nt, Homo sapiens
guuaagacgugucgcacuu

SEQ ID NO: 47400 - RNA, 19 nt, Homo sapiens
ucaugacaauguuggaauu

SEQ ID NO: 47401 - RNA, 19 nt, Homo sapiens
ccacaucuuccuucucuga

SEQ ID NO: 47402 - RNA, 19 nt, Homo sapiens
uuugaaacgugaaggauug

SEQ ID NO: 47403 - RNA, 19 nt, Homo sapiens
ccacacuaguucaugguau

SEQ ID NO: 47404 - RNA, 19 nt, Homo sapiens
cugcagcccuccuacuauu

SEQ ID NO: 47405 - RNA, 19 nt, Homo sapiens
ccagaaccgucgcuacaag

SEQ ID NO: 47406 - RNA, 19 nt, Homo sapiens
ccugggcucuauuuauuau

SEQ ID NO: 47407 - RNA, 19 nt, Homo sapiens
aaagauuugugaaguuugg

SEQ ID NO: 47408 - RNA, 19 nt, Homo sapiens
gagaccacauagccugaau

SEQ ID NO: 47409 - RNA, 19 nt, Homo sapiens
uauccaugcuaccaaucua

SEQ ID NO: 47410 - RNA, 19 nt, Homo sapiens
gcgacgaccagagacaaua

SEQ ID NO: 47411 - RNA, 19 nt, Homo sapiens
gaaguuuggaagcucuauu

SEQ ID NO: 47412 - RNA, 19 nt, Homo sapiens
caugacaauguuggaauua

SEQ ID NO: 47413 - RNA, 19 nt, Homo sapiens
ucaacuagaguauuaacug

SEQ ID NO: 47414 - RNA, 19 nt, Homo sapiens
aggcgauccucaacaagaa

SEQ ID NO: 47415 - RNA, 19 nt, Homo sapiens
caagaagguggccguaaag

SEQ ID NO: 47416 - RNA, 19 nt, Homo sapiens
gcuggccgcuuccaaagac

SEQ ID NO: 47417 - RNA, 19 nt, Homo sapiens
ccaccugucuugucaaccu

SEQ ID NO: 47418 - RNA, 19 nt, Homo sapiens
caggcgauccucaacaaga

SEQ ID NO: 47419 - RNA, 19 nt, Homo sapiens
ggccagggguugauuugaa

SEQ ID NO: 47420 - RNA, 19 nt, Homo sapiens
uccaggcgauccucaacaa

SEQ ID NO: 47421 - RNA, 19 nt, Homo sapiens
ugggcucuauuuauuauca

SEQ ID NO: 47422 - RNA, 19 nt, Homo sapiens
ccaacaccuugacguccuu

SEQ ID NO: 47423 - RNA, 19 nt, Homo sapiens
aaccgucgcuacaagacaa

SEQ ID NO: 47424 - RNA, 19 nt, Homo sapiens
ugagcuggccgcuuccaaa

SEQ ID NO: 47425 - RNA, 19 nt, Homo sapiens
gaaccgucgcuacaagaca

SEQ ID NO: 47426 - RNA, 19 nt, Homo sapiens
uaagacgugucgcacuuuu

SEQ ID NO: 47427 - RNA, 19 nt, Homo sapiens
gagcuggccgcuuccaaag

SEQ ID NO: 47428 - RNA, 19 nt, Homo sapiens
cacacuaguucaugguauc

SEQ ID NO: 47429 - RNA, 19 nt, Homo sapiens
cuccacaucuuccuucucu

SEQ ID NO: 47430 - RNA, 19 nt, Homo sapiens
cuaccaaucuauguguauc

SEQ ID NO: 47431 - RNA, 19 nt, Homo sapiens
gcuaccaaucuauguguau

SEQ ID NO: 47432 - RNA, 19 nt, Homo sapiens
gauguccgccagcgucuca

SEQ ID NO: 47433 - RNA, 19 nt, Homo sapiens
ccccugggcucuauuuauu

SEQ ID NO: 47434 - RNA, 19 nt, Homo sapiens
acuauuacccguacuacug

SEQ ID NO: 47435 - RNA, 19 nt, Homo sapiens
cacugcagcccuccuacua

SEQ ID NO: 47436 - RNA, 19 nt, Homo sapiens
cagaaccgucgcuacaaga

SEQ ID NO: 47437 - RNA, 19 nt, Homo sapiens
accaaucuauguguaucua

SEQ ID NO: 47438 - RNA, 19 nt, Homo sapiens
ggagaccacauagccugaa

SEQ ID NO: 47439 - RNA, 19 nt, Homo sapiens
gcagcccuccuacuauuac

SEQ ID NO: 47440 - RNA, 19 nt, Homo sapiens
ggcccucagugucuaccuu

SEQ ID NO: 47441 - RNA, 19 nt, Homo sapiens
gccagggguugauuugaaa

SEQ ID NO: 47442 - RNA, 19 nt, Homo sapiens
gagcacaucuucuguagua

SEQ ID NO: 47443 - RNA, 19 nt, Homo sapiens
guaguaagcuucgaaauuu

SEQ ID NO: 47444 - RNA, 19 nt, Homo sapiens
caaaguaccuugaagugua

SEQ ID NO: 47445 - RNA, 19 nt, Homo sapiens
gaaauagacuuacuagcaa

SEQ ID NO: 47446 - RNA, 19 nt, Homo sapiens
acaaugagcugucagauuu

SEQ ID NO: 47447 - RNA, 19 nt, Homo sapiens
cgacauaccuucuguugaa

SEQ ID NO: 47448 - RNA, 19 nt, Homo sapiens
gcaagacucauaugaauuu

SEQ ID NO: 47449 - RNA, 19 nt, Homo sapiens
ucagauauguugugaguaa

SEQ ID NO: 47450 - RNA, 19 nt, Homo sapiens
gaagauaaauagacaacug

SEQ ID NO: 47451 - RNA, 19 nt, Homo sapiens
gaaauuugcuacaugacaa

SEQ ID NO: 47452 - RNA, 19 nt, Homo sapiens
gaagcaggcucaacagaga

SEQ ID NO: 47453 - RNA, 19 nt, Homo sapiens
gaagugauccaaauguuaa

SEQ ID NO: 47454 - RNA, 19 nt, Homo sapiens
gcagugggcugucuucaga

SEQ ID NO: 47455 - RNA, 19 nt, Homo sapiens
gaguaaagcuucagugcaa

SEQ ID NO: 47456 - RNA, 19 nt, Homo sapiens
gaaguaagaaagucagaua

SEQ ID NO: 47457 - RNA, 19 nt, Homo sapiens
guacuaacauucugagaga

SEQ ID NO: 47458 - RNA, 19 nt, Homo sapiens
acaaauagguagagucauu

SEQ ID NO: 47459 - RNA, 19 nt, Homo sapiens
guaagugacugcauuggaa

SEQ ID NO: 47460 - RNA, 19 nt, Homo sapiens
gagagagccuguguguuua

SEQ ID NO: 47461 - RNA, 19 nt, Homo sapiens
ggauggaccucuuguacuu

SEQ ID NO: 47462 - RNA, 19 nt, Homo sapiens
gaagguaguggaauuauug

SEQ ID NO: 47463 - RNA, 19 nt, Homo sapiens
ggaagugauccaaauguua

SEQ ID NO: 47464 - RNA, 19 nt, Homo sapiens
ugaagucucuuuaccauug

SEQ ID NO: 47465 - RNA, 19 nt, Homo sapiens
ugagagagccuguguguuu

SEQ ID NO: 47466 - RNA, 19 nt, Homo sapiens
uaacauguccgaugaauuc

SEQ ID NO: 47467 - RNA, 19 nt, Homo sapiens
gagcaggaaugaaguagug

SEQ ID NO: 47468 - RNA, 19 nt, Homo sapiens
guaagaaagucagauaugu

SEQ ID NO: 47469 - RNA, 19 nt, Homo sapiens
cagcaagacucauaugaau

SEQ ID NO: 47470 - RNA, 19 nt, Homo sapiens
ccagaaaugcuguuaauau

SEQ ID NO: 47471 - RNA, 19 nt, Homo sapiens
gguagagucauucauauuu

SEQ ID NO: 47472 - RNA, 19 nt, Homo sapiens
gagcuugcaguaauucuua

SEQ ID NO: 47473 - RNA, 19 nt, Homo sapiens
guagagucauucauauuug

SEQ ID NO: 47474 - RNA, 19 nt, Homo sapiens
ucagugagcuugcaguaau

SEQ ID NO: 47475 - RNA, 19 nt, Homo sapiens
aaacguggccaucacaaua

SEQ ID NO: 47476 - RNA, 19 nt, Homo sapiens
aaagaggaaucuaagcaaa

SEQ ID NO: 47477 - RNA, 19 nt, Homo sapiens
gcacacaguauaucaucua

SEQ ID NO: 47478 - RNA, 19 nt, Homo sapiens
gcacguggauauagucaag

SEQ ID NO: 47479 - RNA, 19 nt, Homo sapiens
uacaccaccuucuacauua

SEQ ID NO: 47480 - RNA, 19 nt, Homo sapiens
guacaccaccuucuacauu

SEQ ID NO: 47481 - RNA, 19 nt, Homo sapiens
uaaaguuggugguacauca

SEQ ID NO: 47482 - RNA, 19 nt, Homo sapiens
gcgggacgaugccggauaa

SEQ ID NO: 47483 - RNA, 19 nt, Homo sapiens
cuugacagcugaauauuau

SEQ ID NO: 47484 - RNA, 19 nt, Homo sapiens
uacaguaacucauguuguu

SEQ ID NO: 47485 - RNA, 19 nt, Homo sapiens
ggauauagucaagcuguua

SEQ ID NO: 47486 - RNA, 19 nt, Homo sapiens
gagagacuuugcuccauau

SEQ ID NO: 47487 - RNA, 19 nt, Homo sapiens
ugaaauagacuuacuagca

SEQ ID NO: 47488 - RNA, 19 nt, Homo sapiens
gauaaauggugaaauagac

SEQ ID NO: 47489 - RNA, 19 nt, Homo sapiens
gcaggaaacaagaagaauu

SEQ ID NO: 47490 - RNA, 19 nt, Homo sapiens
ggccagauccucaguagaa

SEQ ID NO: 47491 - RNA, 19 nt, Homo sapiens
gaaaguaugaaaucgcuau

SEQ ID NO: 47492 - RNA, 19 nt, Homo sapiens
gauggaugcuacuucuauu

SEQ ID NO: 47493 - RNA, 19 nt, Homo sapiens
caaaaugacucaccacuuc

SEQ ID NO: 47494 - RNA, 19 nt, Homo sapiens
acaguaacauguccgauga

SEQ ID NO: 47495 - RNA, 19 nt, Homo sapiens
gcaaacccagccugcaaua

SEQ ID NO: 47496 - RNA, 19 nt, Homo sapiens
gaagauaaaccuaggaaaa

SEQ ID NO: 47497 - RNA, 19 nt, Homo sapiens
gaauuugcacgguuuguga

SEQ ID NO: 47498 - RNA, 19 nt, Homo sapiens
aauggaugcuggauucuaa

SEQ ID NO: 47499 - RNA, 19 nt, Homo sapiens
gcugucagauuugaaagaa

SEQ ID NO: 47500 - RNA, 19 nt, Homo sapiens
caguaauucuuaaggcuaa

SEQ ID NO: 47501 - RNA, 19 nt, Homo sapiens
ccauauugcuucuauuaag

SEQ ID NO: 47502 - RNA, 19 nt, Homo sapiens
ugaagguaguggaauuauu

SEQ ID NO: 47503 - RNA, 19 nt, Homo sapiens
agaaaucuuugccauuaga

SEQ ID NO: 47504 - RNA, 19 nt, Homo sapiens
aaacccagccugcaauaaa

SEQ ID NO: 47505 - RNA, 19 nt, Homo sapiens
gaaagucagauauguugug

SEQ ID NO: 47506 - RNA, 19 nt, Homo sapiens
ugucagauuugaaagaaga

SEQ ID NO: 47507 - RNA, 19 nt, Homo sapiens
accauuggcugagcaaaua

SEQ ID NO: 47508 - RNA, 19 nt, Homo sapiens
cagcaugauucaacuuugu

SEQ ID NO: 47509 - RNA, 19 nt, Homo sapiens
caacuggacagcaugauuc

SEQ ID NO: 47510 - RNA, 19 nt, Homo sapiens
uauaccagaugaacauuuc

SEQ ID NO: 47511 - RNA, 19 nt, Homo sapiens
aaaguaccuugaaguguau

SEQ ID NO: 47512 - RNA, 19 nt, Homo sapiens
ggugaugcaguucaaagua

SEQ ID NO: 47513 - RNA, 19 nt, Homo sapiens
gaguuugacaguacaguaa

SEQ ID NO: 47514 - RNA, 19 nt, Homo sapiens
gcacaucuucuguaguaau

SEQ ID NO: 47515 - RNA, 19 nt, Homo sapiens
cacaucuucuguaguaauu

SEQ ID NO: 47516 - RNA, 19 nt, Homo sapiens
guaaaagcaugucuacgaa

SEQ ID NO: 47517 - RNA, 19 nt, Homo sapiens
gaacaccaccggguaucaa

SEQ ID NO: 47518 - RNA, 19 nt, Homo sapiens
ccaccuucaugcaaacgua

SEQ ID NO: 47519 - RNA, 19 nt, Homo sapiens
caaagaggaaucuaagcaa

SEQ ID NO: 47520 - RNA, 19 nt, Homo sapiens
aaagucagauauguuguga

SEQ ID NO: 47521 - RNA, 19 nt, Homo sapiens
ucaaacaccauccaaagga

SEQ ID NO: 47522 - RNA, 19 nt, Homo sapiens
ggaugcuacuucuauuugu

SEQ ID NO: 47523 - RNA, 19 nt, Homo sapiens
gaaugggcacguggauaua

SEQ ID NO: 47524 - RNA, 19 nt, Homo sapiens
gaaguagugacuccugaga

SEQ ID NO: 47525 - RNA, 19 nt, Homo sapiens
uagguagagucauucauau

SEQ ID NO: 47526 - RNA, 19 nt, Homo sapiens
ccuucgagcugguuuauag

SEQ ID NO: 47527 - RNA, 19 nt, Homo sapiens
gaugcuacuucuauuugug

SEQ ID NO: 47528 - RNA, 19 nt, Homo sapiens
gaugcuggauucuaaaauu

SEQ ID NO: 47529 - RNA, 19 nt, Homo sapiens
gcuguuacuuuccuaugga

SEQ ID NO: 47530 - RNA, 19 nt, Homo sapiens
caauauggcugugaaaaga

SEQ ID NO: 47531 - RNA, 19 nt, Homo sapiens
acaccaccuucuacauuaa

SEQ ID NO: 47532 - RNA, 19 nt, Homo sapiens
uaagagcaggaaugaagua

SEQ ID NO: 47533 - RNA, 19 nt, Homo sapiens
guaguaauuguguaaguga

SEQ ID NO: 47534 - RNA, 19 nt, Homo sapiens
ggaaacaagaagaauucaa

SEQ ID NO: 47535 - RNA, 19 nt, Homo sapiens
uguaguaagcuucgaaauu

SEQ ID NO: 47536 - RNA, 19 nt, Homo sapiens
auagguagagucauucaua

SEQ ID NO: 47537 - RNA, 19 nt, Homo sapiens
ugagagcccagucauugua

SEQ ID NO: 47538 - RNA, 19 nt, Homo sapiens
gagcugguuuauagacugu

SEQ ID NO: 47539 - RNA, 19 nt, Homo sapiens
gacagcaugauucaacuuu

SEQ ID NO: 47540 - RNA, 19 nt, Homo sapiens
augaagcuguugcccaaua

SEQ ID NO: 47541 - RNA, 19 nt, Homo sapiens
ucuagucccucagcaauga

SEQ ID NO: 47542 - RNA, 19 nt, Homo sapiens
gacccuagcucuuuccuuu

SEQ ID NO: 47543 - RNA, 19 nt, Homo sapiens
gaccuugacuugauuagug

SEQ ID NO: 47544 - RNA, 19 nt, Homo sapiens
aguggcagcugacauguuu

SEQ ID NO: 47545 - RNA, 19 nt, Homo sapiens
gaauugcucaaguucauug

SEQ ID NO: 47546 - RNA, 19 nt, Homo sapiens
acauggagcugcagaggau

SEQ ID NO: 47547 - RNA, 19 nt, Homo sapiens
caggaugcguccaccaaga

SEQ ID NO: 47548 - RNA, 19 nt, Homo sapiens
cagcugacauguuuucuga

SEQ ID NO: 47549 - RNA, 19 nt, Homo sapiens
gagcugcagaggaugauug

SEQ ID NO: 47550 - RNA, 19 nt, Homo sapiens
ccucugacccuagcucuuu

SEQ ID NO: 47551 - RNA, 19 nt, Homo sapiens
cagauguggucuauaaugc

SEQ ID NO: 47552 - RNA, 19 nt, Homo sapiens
uggaauugcucaaguucau

SEQ ID NO: 47553 - RNA, 19 nt, Homo sapiens
ucagauguggucuauaaug

SEQ ID NO: 47554 - RNA, 19 nt, Homo sapiens
caucaugggcuggacauug

SEQ ID NO: 47555 - RNA, 19 nt, Homo sapiens
ucaaggcccugugcaccaa

SEQ ID NO: 47556 - RNA, 19 nt, Homo sapiens
uuacgugucugaucaaucc

SEQ ID NO: 47557 - RNA, 19 nt, Homo sapiens
ggaauugcucaaguucauu

SEQ ID NO: 47558 - RNA, 19 nt, Homo sapiens
acugugaccuugacuugau

SEQ ID NO: 47559 - RNA, 19 nt, Homo sapiens
ccucuggaauugcucaagu

SEQ ID NO: 47560 - RNA, 19 nt, Homo sapiens
caaggugccggaacugauc

SEQ ID NO: 47561 - RNA, 19 nt, Homo sapiens
uguggucuauaaugcguuu

SEQ ID NO: 47562 - RNA, 19 nt, Homo sapiens
ccagggugguugggugaga

SEQ ID NO: 47563 - RNA, 19 nt, Homo sapiens
ggaucgagcagggcgaaug

SEQ ID NO: 47564 - RNA, 19 nt, Homo sapiens
uuccuuacgugucugauca

SEQ ID NO: 47565 - RNA, 19 nt, Homo sapiens
gaucgagcagggcgaaugg

SEQ ID NO: 47566 - RNA, 19 nt, Homo sapiens
ugccggaacugaucagaac

SEQ ID NO: 47567 - RNA, 19 nt, Homo sapiens
ccaaggugccggaacugau

SEQ ID NO: 47568 - RNA, 19 nt, Homo sapiens
ccgaguggcagcugacaug

SEQ ID NO: 47569 - RNA, 19 nt, Homo sapiens
gaguggcagcugacauguu

SEQ ID NO: 47570 - RNA, 19 nt, Homo sapiens
aguggcagcugacauguuu

SEQ ID NO: 47571 - RNA, 19 nt, Homo sapiens
acauggagcugcagaggau

SEQ ID NO: 47572 - RNA, 19 nt, Homo sapiens
caggaugcguccaccaaga

SEQ ID NO: 47573 - RNA, 19 nt, Homo sapiens
ggccuccucuccuacuuug

SEQ ID NO: 47574 - RNA, 19 nt, Homo sapiens
cagcugacauguuuucuga

SEQ ID NO: 47575 - RNA, 19 nt, Homo sapiens
gagcugcagaggaugauug

SEQ ID NO: 47576 - RNA, 19 nt, Homo sapiens
gcagaccgugaccaucuuu

SEQ ID NO: 47577 - RNA, 19 nt, Homo sapiens
caucaugggcuggacauug

SEQ ID NO: 47578 - RNA, 19 nt, Homo sapiens
ucaaggcccugugcaccaa

SEQ ID NO: 47579 - RNA, 19 nt, Homo sapiens
ucacucaccaucuggaaga

SEQ ID NO: 47580 - RNA, 19 nt, Homo sapiens
ggcagaccgugaccaucuu

SEQ ID NO: 47581 - RNA, 19 nt, Homo sapiens
cagcugccuuggacugugu

SEQ ID NO: 47582 - RNA, 19 nt, Homo sapiens
caaggugccggaacugauc

SEQ ID NO: 47583 - RNA, 19 nt, Homo sapiens
gaccgugaccaucuuugug

SEQ ID NO: 47584 - RNA, 19 nt, Homo sapiens
gaucgagcagggcgaaugg

SEQ ID NO: 47585 - RNA, 19 nt, Homo sapiens
ugccggaacugaucagaac

SEQ ID NO: 47586 - RNA, 19 nt, Homo sapiens
ccaaggugccggaacugau

SEQ ID NO: 47587 - RNA, 19 nt, Homo sapiens
ggaucgagcagggcgaaug

SEQ ID NO: 47588 - RNA, 19 nt, Homo sapiens
ccgaguggcagcugacaug

SEQ ID NO: 47589 - RNA, 19 nt, Homo sapiens
gaguggcagcugacauguu

SEQ ID NO: 47590 - RNA, 19 nt, Homo sapiens
caggaugcguccaccaaga

SEQ ID NO: 47591 - RNA, 19 nt, Homo sapiens
gaucgagcagggcgaaugg

SEQ ID NO: 47592 - RNA, 19 nt, Homo sapiens
ggaucgagcagggcgaaug

SEQ ID NO: 47593 - RNA, 19 nt, Homo sapiens
aguggcagcugacauguuu

SEQ ID NO: 47594 - RNA, 19 nt, Homo sapiens
ggccuccucuccuacuuug

SEQ ID NO: 47595 - RNA, 19 nt, Homo sapiens
cagcugacauguuuucuga

SEQ ID NO: 47596 - RNA, 19 nt, Homo sapiens
gcagaccgugaccaucuuu

SEQ ID NO: 47597 - RNA, 19 nt, Homo sapiens
caucaugggcuggacauug

SEQ ID NO: 47598 - RNA, 19 nt, Homo sapiens
ucaaggcccugugcaccaa

SEQ ID NO: 47599 - RNA, 19 nt, Homo sapiens
ggcagaccgugaccaucuu

SEQ ID NO: 47600 - RNA, 19 nt, Homo sapiens
cagcugccuuggacugugu

SEQ ID NO: 47601 - RNA, 19 nt, Homo sapiens
caaggugccggaacugauc

SEQ ID NO: 47602 - RNA, 19 nt, Homo sapiens
gaccgugaccaucuuugug

SEQ ID NO: 47603 - RNA, 19 nt, Homo sapiens
ugccggaacugaucagaac

SEQ ID NO: 47604 - RNA, 19 nt, Homo sapiens
ccaaggugccggaacugau

SEQ ID NO: 47605 - RNA, 19 nt, Homo sapiens
ccgaguggcagcugacaug

SEQ ID NO: 47606 - RNA, 19 nt, Homo sapiens
gaguggcagcugacauguu

SEQ ID NO: 47607 - RNA, 19 nt, Homo sapiens
gcucaaggcuggcgugaaa

SEQ ID NO: 47608 - RNA, 19 nt, Homo sapiens
ccaaggagcugggauuaca

SEQ ID NO: 47609 - RNA, 19 nt, Homo sapiens
aguggcagcugacauguuu

SEQ ID NO: 47610 - RNA, 19 nt, Homo sapiens
acauggagcugcagaggau

SEQ ID NO: 47611 - RNA, 19 nt, Homo sapiens
caggaugcguccaccaaga

SEQ ID NO: 47612 - RNA, 19 nt, Homo sapiens
ggccuccucuccuacuuug

SEQ ID NO: 47613 - RNA, 19 nt, Homo sapiens
cagcugacauguuuucuga

SEQ ID NO: 47614 - RNA, 19 nt, Homo sapiens
gagcugcagaggaugauug

SEQ ID NO: 47615 - RNA, 19 nt, Homo sapiens
gcagaccgugaccaucuuu

SEQ ID NO: 47616 - RNA, 19 nt, Homo sapiens
caucaugggcuggacauug

SEQ ID NO: 47617 - RNA, 19 nt, Homo sapiens
ggcgugaaauggcgugauc

SEQ ID NO: 47618 - RNA, 19 nt, Homo sapiens
ggcagaccgugaccaucuu

SEQ ID NO: 47619 - RNA, 19 nt, Homo sapiens
cagcugccuuggacugugu

SEQ ID NO: 47620 - RNA, 19 nt, Homo sapiens
caaggugccggaacugauc

SEQ ID NO: 47621 - RNA, 19 nt, Homo sapiens
ucaaggcuggcgugaaaug

SEQ ID NO: 47622 - RNA, 19 nt, Homo sapiens
gaccgugaccaucuuugug

SEQ ID NO: 47623 - RNA, 19 nt, Homo sapiens
ggaucgagcagggcgaaug

SEQ ID NO: 47624 - RNA, 19 nt, Homo sapiens
gaucgagcagggcgaaugg

SEQ ID NO: 47625 - RNA, 19 nt, Homo sapiens
ugccggaacugaucagaac

SEQ ID NO: 47626 - RNA, 19 nt, Homo sapiens
ccaaggugccggaacugau

SEQ ID NO: 47627 - RNA, 19 nt, Homo sapiens
ccgaguggcagcugacaug

SEQ ID NO: 47628 - RNA, 19 nt, Homo sapiens
gaguggcagcugacauguu

SEQ ID NO: 47629 - RNA, 19 nt, Homo sapiens
aguggcagcugacauguuu

SEQ ID NO: 47630 - RNA, 19 nt, Homo sapiens
acauggagcugcagaggau

SEQ ID NO: 47631 - RNA, 19 nt, Homo sapiens
caggaugcguccaccaaga

SEQ ID NO: 47632 - RNA, 19 nt, Homo sapiens
cagcugacauguuuucuga

SEQ ID NO: 47633 - RNA, 19 nt, Homo sapiens
gagcugcagaggaugauug

SEQ ID NO: 47634 - RNA, 19 nt, Homo sapiens
caucaugggcuggacauug

SEQ ID NO: 47635 - RNA, 19 nt, Homo sapiens
ucaaggcccugugcaccaa

SEQ ID NO: 47636 - RNA, 19 nt, Homo sapiens
ucacucaccaucuggaaga

SEQ ID NO: 47637 - RNA, 19 nt, Homo sapiens
ggaccgugaccaucuuugu

SEQ ID NO: 47638 - RNA, 19 nt, Homo sapiens
cagcugccuuggacugugu

SEQ ID NO: 47639 - RNA, 19 nt, Homo sapiens
caaggugccggaacugauc

SEQ ID NO: 47640 - RNA, 19 nt, Homo sapiens
gaccgugaccaucuuugug

SEQ ID NO: 47641 - RNA, 19 nt, Homo sapiens
guuggaccgugaccaucuu

SEQ ID NO: 47642 - RNA, 19 nt, Homo sapiens
gaucgagcagggcgaaugg

SEQ ID NO: 47643 - RNA, 19 nt, Homo sapiens
ggaucgagcagggcgaaug

SEQ ID NO: 47644 - RNA, 19 nt, Homo sapiens
ugccggaacugaucagaac

SEQ ID NO: 47645 - RNA, 19 nt, Homo sapiens
ccaaggugccggaacugau

SEQ ID NO: 47646 - RNA, 19 nt, Homo sapiens
ccgaguggcagcugacaug

SEQ ID NO: 47647 - RNA, 19 nt, Homo sapiens
gaguggcagcugacauguu

SEQ ID NO: 47648 - RNA, 19 nt, Homo sapiens
ggaaacaucuauauucuga

SEQ ID NO: 47649 - RNA, 19 nt, Homo sapiens
gaccugagcugcugugaaa

SEQ ID NO: 47650 - RNA, 19 nt, Homo sapiens
ccaggaaacuucucugaaa

SEQ ID NO: 47651 - RNA, 19 nt, Homo sapiens
uaaauuaccuuccuuguac

SEQ ID NO: 47652 - RNA, 19 nt, Homo sapiens
guccagaacugcccauaua

SEQ ID NO: 47653 - RNA, 19 nt, Homo sapiens
gacaguaaguguucauaaa

SEQ ID NO: 47654 - RNA, 19 nt, Homo sapiens
gaaccuggcugacgaggau

SEQ ID NO: 47655 - RNA, 19 nt, Homo sapiens
gcaaugaggccaauucgaa

SEQ ID NO: 47656 - RNA, 19 nt, Homo sapiens
gaauuggugucuuucuaaa

SEQ ID NO: 47657 - RNA, 19 nt, Homo sapiens
caaauccucuggaacaaga

SEQ ID NO: 47658 - RNA, 19 nt, Homo sapiens
ggacaacacccucaucaug

SEQ ID NO: 47659 - RNA, 19 nt, Homo sapiens
acacauacccacuuacuaa

SEQ ID NO: 47660 - RNA, 19 nt, Homo sapiens
gagagaaauugugaacauu

SEQ ID NO: 47661 - RNA, 19 nt, Homo sapiens
gcaauggaaacaucuauau

SEQ ID NO: 47662 - RNA, 19 nt, Homo sapiens
ggacaguaaguguucauaa

SEQ ID NO: 47663 - RNA, 19 nt, Homo sapiens
gccuagcgcuggcagauuu

SEQ ID NO: 47664 - RNA, 19 nt, Homo sapiens
cacuagagcuccuaaagau

SEQ ID NO: 47665 - RNA, 19 nt, Homo sapiens
uauaguagcagguuaguga

SEQ ID NO: 47666 - RNA, 19 nt, Homo sapiens
ggaaacuucucugaaaucu

SEQ ID NO: 47667 - RNA, 19 nt, Homo sapiens
acaaggcccugcucaaugu

SEQ ID NO: 47668 - RNA, 19 nt, Homo sapiens
aaggagaauuggugucuuu

SEQ ID NO: 47669 - RNA, 19 nt, Homo sapiens
gaaagccccugcacaauca

SEQ ID NO: 47670 - RNA, 19 nt, Homo sapiens
ggagagguccgcauuuauc

SEQ ID NO: 47671 - RNA, 19 nt, Homo sapiens
auaugacucuugcuugaua

SEQ ID NO: 47672 - RNA, 19 nt, Homo sapiens
agagagaaauugugaacau

SEQ ID NO: 47673 - RNA, 19 nt, Homo sapiens
gaaggcagagugugacaga

SEQ ID NO: 47674 - RNA, 19 nt, Homo sapiens
ggaggcauuuguaaaccaa

SEQ ID NO: 47675 - RNA, 19 nt, Homo sapiens
ccaguucauucagcuauuu

SEQ ID NO: 47676 - RNA, 19 nt, Homo sapiens
aaagcaacaugaagcaaga

SEQ ID NO: 47677 - RNA, 19 nt, Homo sapiens
uuauaugacucuugcuuga

SEQ ID NO: 47678 - RNA, 19 nt, Homo sapiens
caacaugaagcaagaaaca

SEQ ID NO: 47679 - RNA, 19 nt, Homo sapiens
caggaaacuucucugaaau

SEQ ID NO: 47680 - RNA, 19 nt, Homo sapiens
ggacuuauccggguacaca

SEQ ID NO: 47681 - RNA, 19 nt, Homo sapiens
ccaguuugauguugaguuc

SEQ ID NO: 47682 - RNA, 19 nt, Homo sapiens
caccugauguaaguuuaua

SEQ ID NO: 47683 - RNA, 19 nt, Homo sapiens
ggaugaaaugggagacaua

SEQ ID NO: 47684 - RNA, 19 nt, Homo sapiens
gagcaaacccagggaauag

SEQ ID NO: 47685 - RNA, 19 nt, Homo sapiens
gcagccauccugaccauga

SEQ ID NO: 47686 - RNA, 19 nt, Homo sapiens
agagguuucuggccaguuu

SEQ ID NO: 47687 - RNA, 19 nt, Homo sapiens
gcccuugugucuaugugua

SEQ ID NO: 47688 - RNA, 19 nt, Homo sapiens
cauacccacuuacuaaugu

SEQ ID NO: 47689 - RNA, 19 nt, Homo sapiens
ccacuaagaaauacaugaa

SEQ ID NO: 47690 - RNA, 19 nt, Homo sapiens
gagauugagccuccuguug

SEQ ID NO: 47691 - RNA, 19 nt, Homo sapiens
cccgaggccuucaccauuu

SEQ ID NO: 47692 - RNA, 19 nt, Homo sapiens
guaccuaccacuaagaaau

SEQ ID NO: 47693 - RNA, 19 nt, Homo sapiens
ccuuuaagcucacacuuca

SEQ ID NO: 47694 - RNA, 19 nt, Homo sapiens
gaagcguacagcaguguuu

SEQ ID NO: 47695 - RNA, 19 nt, Homo sapiens
gacaaggcccugcucaaug

SEQ ID NO: 47696 - RNA, 19 nt, Homo sapiens
ucuuagacauuaccuguug

SEQ ID NO: 47697 - RNA, 19 nt, Homo sapiens
ccacuagagcuccuaaaga

SEQ ID NO: 47698 - RNA, 19 nt, Homo sapiens
ccacgucccucaugcacau

SEQ ID NO: 47699 - RNA, 19 nt, Homo sapiens
ucucugaaaucuuagacuu

SEQ ID NO: 47700 - RNA, 19 nt, Homo sapiens
guaacaagggcaucucaga

SEQ ID NO: 47701 - RNA, 19 nt, Homo sapiens
ugacgaggaugcugugucu

SEQ ID NO: 47702 - RNA, 19 nt, Homo sapiens
uaccuaccacuaagaaaua

SEQ ID NO: 47703 - RNA, 19 nt, Homo sapiens
ucucagacaucaucaaggu

SEQ ID NO: 47704 - RNA, 19 nt, Homo sapiens
auggagagguccgcauuua

SEQ ID NO: 47705 - RNA, 19 nt, Homo sapiens
ucucucccauucucuagua

SEQ ID NO: 47706 - RNA, 19 nt, Homo sapiens
gaaaacagucucucccauu

SEQ ID NO: 47707 - RNA, 19 nt, Homo sapiens
ggaauacaagcugguggua

SEQ ID NO: 47708 - RNA, 19 nt, Homo sapiens
gaaauugugaacauuaagg

SEQ ID NO: 47709 - RNA, 19 nt, Homo sapiens
ggccuacgaugccacacaa

SEQ ID NO: 47710 - RNA, 19 nt, Homo sapiens
ugaccaccuugaagaagaa

SEQ ID NO: 47711 - RNA, 19 nt, Homo sapiens
gugucuauguguauaagaa

SEQ ID NO: 47712 - RNA, 19 nt, Homo sapiens
uuaaggacaaggagaauug

SEQ ID NO: 47713 - RNA, 19 nt, Homo sapiens
gaugaaaugggagacauau

SEQ ID NO: 47714 - RNA, 19 nt, Homo sapiens
cuagagcuccuaaagauca

SEQ ID NO: 47715 - RNA, 19 nt, Homo sapiens
auacugggcucagaucaga

SEQ ID NO: 47716 - RNA, 19 nt, Homo sapiens
ggccuauaguagcagguua

SEQ ID NO: 47717 - RNA, 19 nt, Homo sapiens
ccagaacugcccauauaga

SEQ ID NO: 47718 - RNA, 19 nt, Homo sapiens
ucugaaaucuuagacuuag

SEQ ID NO: 47719 - RNA, 19 nt, Homo sapiens
ugacaaggcccugcucaau

SEQ ID NO: 47720 - RNA, 19 nt, Homo sapiens
cagaggagccuuuguccau

SEQ ID NO: 47721 - RNA, 19 nt, Homo sapiens
caagaguuggacuauaauu

SEQ ID NO: 47722 - RNA, 19 nt, Homo sapiens
gcagucacuuccaguucau

SEQ ID NO: 47723 - RNA, 19 nt, Homo sapiens
ugagcaaacccagggaaua

SEQ ID NO: 47724 - RNA, 19 nt, Homo sapiens
acaacgaggcgcucuauuc

SEQ ID NO: 47725 - RNA, 19 nt, Homo sapiens
guacaacgaggcgcucuau

SEQ ID NO: 47726 - RNA, 19 nt, Homo sapiens
ggagaggaaggcagagugu

SEQ ID NO: 47727 - RNA, 19 nt, Homo sapiens
ggaugcucaugcccagaaa

SEQ ID NO: 47728 - RNA, 19 nt, Homo sapiens
gagcccaaaucagucaugu

SEQ ID NO: 47729 - RNA, 19 nt, Homo sapiens
gcucaugcccagaaagcaa

SEQ ID NO: 47730 - RNA, 19 nt, Homo sapiens
gcucuccucucuccuuguc

SEQ ID NO: 47731 - RNA, 19 nt, Homo sapiens
aguagcagguuagugagua

SEQ ID NO: 47732 - RNA, 19 nt, Homo sapiens
gggcaucucagacaucauc

SEQ ID NO: 47733 - RNA, 19 nt, Homo sapiens
ccaauugccuccaaauccu

SEQ ID NO: 47734 - RNA, 19 nt, Homo sapiens
gcaccugauguaaguuuau

SEQ ID NO: 47735 - RNA, 19 nt, Homo sapiens
cgugagaauuagcaggaaa

SEQ ID NO: 47736 - RNA, 19 nt, Homo sapiens
aggcagaaguccagaacug

SEQ ID NO: 47737 - RNA, 19 nt, Homo sapiens
gcucgucuccccucucuua

SEQ ID NO: 47738 - RNA, 19 nt, Homo sapiens
cagcaccugauguaaguuu

SEQ ID NO: 47739 - RNA, 19 nt, Homo sapiens
cccagcaccugauguaagu

SEQ ID NO: 47740 - RNA, 19 nt, Homo sapiens
ccagggcaguggucacauc

SEQ ID NO: 47741 - RNA, 19 nt, Homo sapiens
cagaacugcccauauagau

SEQ ID NO: 47742 - RNA, 19 nt, Homo sapiens
cagccauccugaccaugaa

SEQ ID NO: 47743 - RNA, 19 nt, Homo sapiens
caaggagaauuggugucuu

SEQ ID NO: 47744 - RNA, 19 nt, Homo sapiens
ugaaaugggagacauaugc

SEQ ID NO: 47745 - RNA, 19 nt, Homo sapiens
gggaugcucaugcccagaa

SEQ ID NO: 47746 - RNA, 19 nt, Homo sapiens
ucucagacccuacuucaag

SEQ ID NO: 47747 - RNA, 19 nt, Homo sapiens
agaggaaggcagaguguga

SEQ ID NO: 47748 - RNA, 19 nt, Homo sapiens
ggagagaucacuauaaaua

SEQ ID NO: 47749 - RNA, 19 nt, Homo sapiens
ggaauaggaugaaugcuuu

SEQ ID NO: 47750 - RNA, 19 nt, Homo sapiens
caagacagcucccucgauu

SEQ ID NO: 47751 - RNA, 19 nt, Homo sapiens
gcaauugaguuuguacuuu

SEQ ID NO: 47752 - RNA, 19 nt, Homo sapiens
ugaaggaagugaucucuuu

SEQ ID NO: 47753 - RNA, 19 nt, Homo sapiens
guaguacuguugcugaaua

SEQ ID NO: 47754 - RNA, 19 nt, Homo sapiens
gaagagucguuauauggaa

SEQ ID NO: 47755 - RNA, 19 nt, Homo sapiens
gagccaaucaguuauguua

SEQ ID NO: 47756 - RNA, 19 nt, Homo sapiens
guggagagaucacuauaaa

SEQ ID NO: 47757 - RNA, 19 nt, Homo sapiens
ccagugagccaaucaguua

SEQ ID NO: 47758 - RNA, 19 nt, Homo sapiens
gaaaggugcuaguuaaggu

SEQ ID NO: 47759 - RNA, 19 nt, Homo sapiens
gcaauaacaucaacacacu

SEQ ID NO: 47760 - RNA, 19 nt, Homo sapiens
gagacuugcuaaauggaua

SEQ ID NO: 47761 - RNA, 19 nt, Homo sapiens
uaguuaagguggaugaaua

SEQ ID NO: 47762 - RNA, 19 nt, Homo sapiens
ccaaacugcucauacagaa

SEQ ID NO: 47763 - RNA, 19 nt, Homo sapiens
gaugaaugcuuuugaagua

SEQ ID NO: 47764 - RNA, 19 nt, Homo sapiens
acaaagaacuacaugugaa

SEQ ID NO: 47765 - RNA, 19 nt, Homo sapiens
aaauacaggucaugaaguu

SEQ ID NO: 47766 - RNA, 19 nt, Homo sapiens
gcacccaguuucauguauu

SEQ ID NO: 47767 - RNA, 19 nt, Homo sapiens
gagacaauguuaauuccuu

SEQ ID NO: 47768 - RNA, 19 nt, Homo sapiens
ggaacucuaugaccuuaau

SEQ ID NO: 47769 - RNA, 19 nt, Homo sapiens
guacuguugcugaauaaua

SEQ ID NO: 47770 - RNA, 19 nt, Homo sapiens
uggcaaagauuuucuguua

SEQ ID NO: 47771 - RNA, 19 nt, Homo sapiens
uacgaaaggugcuaguuaa

SEQ ID NO: 47772 - RNA, 19 nt, Homo sapiens
agacuaaucuuuuggcuua

SEQ ID NO: 47773 - RNA, 19 nt, Homo sapiens
gcugaucauucuaauuuga

SEQ ID NO: 47774 - RNA, 19 nt, Homo sapiens
gcacagaggguuguuguau

SEQ ID NO: 47775 - RNA, 19 nt, Homo sapiens
aauagagacuugcuaaaug

SEQ ID NO: 47776 - RNA, 19 nt, Homo sapiens
gaaaugacagaaacagaga

SEQ ID NO: 47777 - RNA, 19 nt, Homo sapiens
gaagauagacuugcuuucu

SEQ ID NO: 47778 - RNA, 19 nt, Homo sapiens
ugaaggcauucguggguua

SEQ ID NO: 47779 - RNA, 19 nt, Homo sapiens
cauacagaauuacgcauuu

SEQ ID NO: 47780 - RNA, 19 nt, Homo sapiens
ccggauggauggccacaua

SEQ ID NO: 47781 - RNA, 19 nt, Homo sapiens
gaagguugaugcucgaagu

SEQ ID NO: 47782 - RNA, 19 nt, Homo sapiens
gcaauucgaagcaauaaca

SEQ ID NO: 47783 - RNA, 19 nt, Homo sapiens
agaacuacaugugaagaua

SEQ ID NO: 47784 - RNA, 19 nt, Homo sapiens
gacaaagaacuacauguga

SEQ ID NO: 47785 - RNA, 19 nt, Homo sapiens
uggagugaaugaacugaua

SEQ ID NO: 47786 - RNA, 19 nt, Homo sapiens
ggugaguuguacaaauuaa

SEQ ID NO: 47787 - RNA, 19 nt, Homo sapiens
gacccaaacugcucauaca

SEQ ID NO: 47788 - RNA, 19 nt, Homo sapiens
ucccgauacuggagaauua

SEQ ID NO: 47789 - RNA, 19 nt, Homo sapiens
uaaggaagaugagauugug

SEQ ID NO: 47790 - RNA, 19 nt, Homo sapiens
cauguaggcucgucaguag

SEQ ID NO: 47791 - RNA, 19 nt, Homo sapiens
uggcugaucauucuaauuu

SEQ ID NO: 47792 - RNA, 19 nt, Homo sapiens
gaauuacgcauuuccacuu

SEQ ID NO: 47793 - RNA, 19 nt, Homo sapiens
gauagucaccucucuuugu

SEQ ID NO: 47794 - RNA, 19 nt, Homo sapiens
uuacgaaaggugcuaguua

SEQ ID NO: 47795 - RNA, 19 nt, Homo sapiens
ggacacagacuaaucuuuu

SEQ ID NO: 47796 - RNA, 19 nt, Homo sapiens
acaaugaagagucguuaua

SEQ ID NO: 47797 - RNA, 19 nt, Homo sapiens
cuaauuugauccgaaguuu

SEQ ID NO: 47798 - RNA, 19 nt, Homo sapiens
guuaugcccuuuccaaugg

SEQ ID NO: 47799 - RNA, 19 nt, Homo sapiens
ggaaucugauguuucucuu

SEQ ID NO: 47800 - RNA, 19 nt, Homo sapiens
gcggccaccugcauauaaa

SEQ ID NO: 47801 - RNA, 19 nt, Homo sapiens
aaacugcucauacagaauu

SEQ ID NO: 47802 - RNA, 19 nt, Homo sapiens
gaugcaauucgaagcaaua

SEQ ID NO: 47803 - RNA, 19 nt, Homo sapiens
ccucugggcugagcaugua

SEQ ID NO: 47804 - RNA, 19 nt, Homo sapiens
ggcauaaucccagccaaua

SEQ ID NO: 47805 - RNA, 19 nt, Homo sapiens
ggauggccacauacaguua

SEQ ID NO: 47806 - RNA, 19 nt, Homo sapiens
gcugaauaauacuagguuu

SEQ ID NO: 47807 - RNA, 19 nt, Homo sapiens
ugaaguuccuggcaaagau

SEQ ID NO: 47808 - RNA, 19 nt, Homo sapiens
ccucaaagcaguaaaucaa

SEQ ID NO: 47809 - RNA, 19 nt, Homo sapiens
gcauguaggcucgucagua

SEQ ID NO: 47810 - RNA, 19 nt, Homo sapiens
cauccgagcaguauugauu

SEQ ID NO: 47811 - RNA, 19 nt, Homo sapiens
ggagugaaugaacugauaa

SEQ ID NO: 47812 - RNA, 19 nt, Homo sapiens
gcacaguuggaguuuauga

SEQ ID NO: 47813 - RNA, 19 nt, Homo sapiens
gaacuacaugugaagauag

SEQ ID NO: 47814 - RNA, 19 nt, Homo sapiens
ugaggaugcucgucugaug

SEQ ID NO: 47815 - RNA, 19 nt, Homo sapiens
ugauuuggcuggugauauc

SEQ ID NO: 47816 - RNA, 19 nt, Homo sapiens
cagaagacacucacauuca

SEQ ID NO: 47817 - RNA, 19 nt, Homo sapiens
aaauaaccuuggugaguug

SEQ ID NO: 47818 - RNA, 19 nt, Homo sapiens
ucaugaaguuccuggcaaa

SEQ ID NO: 47819 - RNA, 19 nt, Homo sapiens
ggaaaccucaaagcaguaa

SEQ ID NO: 47820 - RNA, 19 nt, Homo sapiens
gaagacacucacauucaga

SEQ ID NO: 47821 - RNA, 19 nt, Homo sapiens
gggcuucagaguccaauuu

SEQ ID NO: 47822 - RNA, 19 nt, Homo sapiens
gaaguuccuggcaaagauu

SEQ ID NO: 47823 - RNA, 19 nt, Homo sapiens
uggcacaguuggaguuuau

SEQ ID NO: 47824 - RNA, 19 nt, Homo sapiens
uuggugaguuguacaaauu

SEQ ID NO: 47825 - RNA, 19 nt, Homo sapiens
aaaauucgcuguaacaauc

SEQ ID NO: 47826 - RNA, 19 nt, Homo sapiens
gaacucuaugaccuuaaua

SEQ ID NO: 47827 - RNA, 19 nt, Homo sapiens
ggauuuuccugucuauuuu

SEQ ID NO: 47828 - RNA, 19 nt, Homo sapiens
gauaucauccagucaaugg

SEQ ID NO: 47829 - RNA, 19 nt, Homo sapiens
guacaucccagcauucaca

SEQ ID NO: 47830 - RNA, 19 nt, Homo sapiens
ugacuuugauggugaugga

SEQ ID NO: 47831 - RNA, 19 nt, Homo sapiens
caaugaagagucguuauau

SEQ ID NO: 47832 - RNA, 19 nt, Homo sapiens
cagcuuggauguggugcua

SEQ ID NO: 47833 - RNA, 19 nt, Homo sapiens
cacccaguuucauguauuu

SEQ ID NO: 47834 - RNA, 19 nt, Homo sapiens
gggaggucaucuuuaagga

SEQ ID NO: 47835 - RNA, 19 nt, Homo sapiens
cuacaauaauucggauuug

SEQ ID NO: 47836 - RNA, 19 nt, Homo sapiens
acccugagcuuggcuauga

SEQ ID NO: 47837 - RNA, 19 nt, Homo sapiens
ccuggaaucugauguuucu

SEQ ID NO: 47838 - RNA, 19 nt, Homo sapiens
agacaaagaacuacaugug

SEQ ID NO: 47839 - RNA, 19 nt, Homo sapiens
gaaaauaaccuuggugagu

SEQ ID NO: 47840 - RNA, 19 nt, Homo sapiens
ccaaagaaccaggugauca

SEQ ID NO: 47841 - RNA, 19 nt, Homo sapiens
aaugaagagucguuauaug

SEQ ID NO: 47842 - RNA, 19 nt, Homo sapiens
aaacaaugaagagucguua

SEQ ID NO: 47843 - RNA, 19 nt, Homo sapiens
ugauggugauggaaagaaa

SEQ ID NO: 47844 - RNA, 19 nt, Homo sapiens
agcaguaaaucaagcaauu

SEQ ID NO: 47845 - RNA, 19 nt, Homo sapiens
acagaggguuguuguaugg

SEQ ID NO: 47846 - RNA, 19 nt, Homo sapiens
ccagaagacacucacauuc

SEQ ID NO: 47847 - RNA, 19 nt, Homo sapiens
caucauccgagcaguauug

SEQ ID NO: 47848 - RNA, 19 nt, Homo sapiens
gcaaugcacugacuuauga

SEQ ID NO: 47849 - RNA, 19 nt, Homo sapiens
gcgaggaugugcuggauua

SEQ ID NO: 47850 - RNA, 19 nt, Homo sapiens
gacaauagcucucuggaau

SEQ ID NO: 47851 - RNA, 19 nt, Homo sapiens
ggagauggcucagaaguug

SEQ ID NO: 47852 - RNA, 19 nt, Homo sapiens
gcaaggcuguuaucaaaga

SEQ ID NO: 47853 - RNA, 19 nt, Homo sapiens
gaacaagucccucccugua

SEQ ID NO: 47854 - RNA, 19 nt, Homo sapiens
gaaacgagccaacuacuug

SEQ ID NO: 47855 - RNA, 19 nt, Homo sapiens
caauagcucucuggaauuu

SEQ ID NO: 47856 - RNA, 19 nt, Homo sapiens
ggauaaguguaacccuuua

SEQ ID NO: 47857 - RNA, 19 nt, Homo sapiens
ugacaaagccuugguuuaa

SEQ ID NO: 47858 - RNA, 19 nt, Homo sapiens
caagagagccuacgcagaa

SEQ ID NO: 47859 - RNA, 19 nt, Homo sapiens
cagcuaaacucaaccagaa

SEQ ID NO: 47860 - RNA, 19 nt, Homo sapiens
gauaaccacugaccagaug

SEQ ID NO: 47861 - RNA, 19 nt, Homo sapiens
ggccagaucuuuauuucuu

SEQ ID NO: 47862 - RNA, 19 nt, Homo sapiens
acauaaagcugccauugaa

SEQ ID NO: 47863 - RNA, 19 nt, Homo sapiens
ggaaucaaguccaacugaa

SEQ ID NO: 47864 - RNA, 19 nt, Homo sapiens
ccuaggaguuugcuacaua

SEQ ID NO: 47865 - RNA, 19 nt, Homo sapiens
gcagguggccagaucuuua

SEQ ID NO: 47866 - RNA, 19 nt, Homo sapiens
caaagggaauccagaacaa

SEQ ID NO: 47867 - RNA, 19 nt, Homo sapiens
cagaauacaguguguguua

SEQ ID NO: 47868 - RNA, 19 nt, Homo sapiens
acaaugcccugaaucuuaa

SEQ ID NO: 47869 - RNA, 19 nt, Homo sapiens
ggcacgaucugacuuauau

SEQ ID NO: 47870 - RNA, 19 nt, Homo sapiens
cugcaaggcuguuaucaaa

SEQ ID NO: 47871 - RNA, 19 nt, Homo sapiens
aagcagaacugguugauuc

SEQ ID NO: 47872 - RNA, 19 nt, Homo sapiens
gcuccagaguuuccuauuu

SEQ ID NO: 47873 - RNA, 19 nt, Homo sapiens
gaugcugucugcuuucaaa

SEQ ID NO: 47874 - RNA, 19 nt, Homo sapiens
ggaccaaaccaguuaaaga

SEQ ID NO: 47875 - RNA, 19 nt, Homo sapiens
gaaaauacagagcuucuua

SEQ ID NO: 47876 - RNA, 19 nt, Homo sapiens
cacaaugcccugaaucuua

SEQ ID NO: 47877 - RNA, 19 nt, Homo sapiens
gaacucaauuuccuguauc

SEQ ID NO: 47878 - RNA, 19 nt, Homo sapiens
ccauugaagucuacaagaa

SEQ ID NO: 47879 - RNA, 19 nt, Homo sapiens
gaaggcauuugaacaucuu

SEQ ID NO: 47880 - RNA, 19 nt, Homo sapiens
ggacaaggccauugaaguc

SEQ ID NO: 47881 - RNA, 19 nt, Homo sapiens
acauauaccugaagcaguu

SEQ ID NO: 47882 - RNA, 19 nt, Homo sapiens
gaucagccauaaccuagga

SEQ ID NO: 47883 - RNA, 19 nt, Homo sapiens
ggccaagccugcugaguau

SEQ ID NO: 47884 - RNA, 19 nt, Homo sapiens
auacagagcuucuuacaac

SEQ ID NO: 47885 - RNA, 19 nt, Homo sapiens
agaaggaaauauccaagaa

SEQ ID NO: 47886 - RNA, 19 nt, Homo sapiens
ucaaagaacagcuucaaga

SEQ ID NO: 47887 - RNA, 19 nt, Homo sapiens
ggagaucagccauaaccua

SEQ ID NO: 47888 - RNA, 19 nt, Homo sapiens
gaaucaaguccaacugaaa

SEQ ID NO: 47889 - RNA, 19 nt, Homo sapiens
agaacgcccuggcccaaua

SEQ ID NO: 47890 - RNA, 19 nt, Homo sapiens
caaaagcccuggaaguuga

SEQ ID NO: 47891 - RNA, 19 nt, Homo sapiens
gaccaaaccaguuaaagau

SEQ ID NO: 47892 - RNA, 19 nt, Homo sapiens
cagagcuucuuacaacuuu

SEQ ID NO: 47893 - RNA, 19 nt, Homo sapiens
cgaucugacuuauauaaug

SEQ ID NO: 47894 - RNA, 19 nt, Homo sapiens
caagaccaguugcacaaug

SEQ ID NO: 47895 - RNA, 19 nt, Homo sapiens
ccagaaagauugggagauc

SEQ ID NO: 47896 - RNA, 19 nt, Homo sapiens
acaagucccucccuguauu

SEQ ID NO: 47897 - RNA, 19 nt, Homo sapiens
uaggaaaggugacaugaca

SEQ ID NO: 47898 - RNA, 19 nt, Homo sapiens
gugaauaugcuaucuaugu

SEQ ID NO: 47899 - RNA, 19 nt, Homo sapiens
ucaagagacucagggauug

SEQ ID NO: 47900 - RNA, 19 nt, Homo sapiens
cauuauauccggaaagauu

SEQ ID NO: 47901 - RNA, 19 nt, Homo sapiens
guugugagguuuauuaguc

SEQ ID NO: 47902 - RNA, 19 nt, Homo sapiens
guagcucugugaugacaaa

SEQ ID NO: 47903 - RNA, 19 nt, Homo sapiens
ggaauuugacucugagaug

SEQ ID NO: 47904 - RNA, 19 nt, Homo sapiens
caagaaagcaguggaguuc

SEQ ID NO: 47905 - RNA, 19 nt, Homo sapiens
cugaguagcucugugauga

SEQ ID NO: 47906 - RNA, 19 nt, Homo sapiens
gaucugacuuauauaaugc

SEQ ID NO: 47907 - RNA, 19 nt, Homo sapiens
gaaagucagccuacucaag

SEQ ID NO: 47908 - RNA, 19 nt, Homo sapiens
gaccagaugcuaucaauac

SEQ ID NO: 47909 - RNA, 19 nt, Homo sapiens
ggacaauagcucucuggaa

SEQ ID NO: 47910 - RNA, 19 nt, Homo sapiens
gcauuuaccagaaggcauu

SEQ ID NO: 47911 - RNA, 19 nt, Homo sapiens
aagcugccauugaaguaua

SEQ ID NO: 47912 - RNA, 19 nt, Homo sapiens
uaaagcugccauugaagua

SEQ ID NO: 47913 - RNA, 19 nt, Homo sapiens
gaaggaaauauccaagaau

SEQ ID NO: 47914 - RNA, 19 nt, Homo sapiens
gaagauagucagugauaac

SEQ ID NO: 47915 - RNA, 19 nt, Homo sapiens
aguuaaagaucccaaauca

SEQ ID NO: 47916 - RNA, 19 nt, Homo sapiens
aaacucaaccagaaagauu

SEQ ID NO: 47917 - RNA, 19 nt, Homo sapiens
ccagacaugugcaguucuu

SEQ ID NO: 47918 - RNA, 19 nt, Homo sapiens
uauugaagauagucaguga

SEQ ID NO: 47919 - RNA, 19 nt, Homo sapiens
caucagaacaaauaagaga

SEQ ID NO: 47920 - RNA, 19 nt, Homo sapiens
acuuacagcucggcauuua

SEQ ID NO: 47921 - RNA, 19 nt, Homo sapiens
ugaagauagucagugauaa

SEQ ID NO: 47922 - RNA, 19 nt, Homo sapiens
cagguugugagguuuauua

SEQ ID NO: 47923 - RNA, 19 nt, Homo sapiens
cugacugacuccuuccuua

SEQ ID NO: 47924 - RNA, 19 nt, Homo sapiens
gaagaaagucagccuacuc

SEQ ID NO: 47925 - RNA, 19 nt, Homo sapiens
gcacaaugcccugaaucuu

SEQ ID NO: 47926 - RNA, 19 nt, Homo sapiens
gugugaauaugcuaucuau

SEQ ID NO: 47927 - RNA, 19 nt, Homo sapiens
uaaaauggcugaggagaga

SEQ ID NO: 47928 - RNA, 19 nt, Homo sapiens
agaacucaauuuccuguau

SEQ ID NO: 47929 - RNA, 19 nt, Homo sapiens
ccucugggcucuaaucaag

SEQ ID NO: 47930 - RNA, 19 nt, Homo sapiens
ugaagcagcuaaacucaac

SEQ ID NO: 47931 - RNA, 19 nt, Homo sapiens
ucaagcagguggccagauc

SEQ ID NO: 47932 - RNA, 19 nt, Homo sapiens
aaggaaauauccaagaauc

SEQ ID NO: 47933 - RNA, 19 nt, Homo sapiens
guccaagcauugauauuuc

SEQ ID NO: 47934 - RNA, 19 nt, Homo sapiens
gaugacaaagccuugguuu

SEQ ID NO: 47935 - RNA, 19 nt, Homo sapiens
cuugaggccuuauguaugu

SEQ ID NO: 47936 - RNA, 19 nt, Homo sapiens
caaagcaccagaccacuuc

SEQ ID NO: 47937 - RNA, 19 nt, Homo sapiens
uaaguguaacccuuuagua

SEQ ID NO: 47938 - RNA, 19 nt, Homo sapiens
gauuggaagauucuguaua

SEQ ID NO: 47939 - RNA, 19 nt, Homo sapiens
gccagaucuuuauuucuuu

SEQ ID NO: 47940 - RNA, 19 nt, Homo sapiens
ccaagaaucccuagaacuc

SEQ ID NO: 47941 - RNA, 19 nt, Homo sapiens
ccaaggcaaacacaaauau

SEQ ID NO: 47942 - RNA, 19 nt, Homo sapiens
acaugaugcugucugcuuu

SEQ ID NO: 47943 - RNA, 19 nt, Homo sapiens
ggaaaggugacaugacaca

SEQ ID NO: 47944 - RNA, 19 nt, Homo sapiens
acaaggccauugaagucua

SEQ ID NO: 47945 - RNA, 19 nt, Homo sapiens
cuuaugacccuaccaacua

SEQ ID NO: 47946 - RNA, 19 nt, Homo sapiens
gacgagaacucaauuuccu

SEQ ID NO: 47947 - RNA, 19 nt, Homo sapiens
cuagaacucuuccagacau

SEQ ID NO: 47948 - RNA, 19 nt, Homo sapiens
gaaauuggaucaagaaugg

SEQ ID NO: 47949 - RNA, 19 nt, Homo sapiens
ggaauuauuugaaggauug

SEQ ID NO: 47950 - RNA, 19 nt, Homo sapiens
ggagaaaccucauaucaag

SEQ ID NO: 47951 - RNA, 19 nt, Homo sapiens
guacaaaggcgagacaaua

SEQ ID NO: 47952 - RNA, 19 nt, Homo sapiens
gaaggcauuucgaggagua

SEQ ID NO: 47953 - RNA, 19 nt, Homo sapiens
gagagcgacuggacaauug

SEQ ID NO: 47954 - RNA, 19 nt, Homo sapiens
aaaugaagauggagaagaa

SEQ ID NO: 47955 - RNA, 19 nt, Homo sapiens
caauacacauuccaacuau

SEQ ID NO: 47956 - RNA, 19 nt, Homo sapiens
ggagugguccucagaguuu

SEQ ID NO: 47957 - RNA, 19 nt, Homo sapiens
gaagagagcgacuggacaa

SEQ ID NO: 47958 - RNA, 19 nt, Homo sapiens
gaacagagugagagagaug

SEQ ID NO: 47959 - RNA, 19 nt, Homo sapiens
gcaguggaauuauuugaag

SEQ ID NO: 47960 - RNA, 19 nt, Homo sapiens
agagauaccucaccaugga

SEQ ID NO: 47961 - RNA, 19 nt, Homo sapiens
gcuaaagaccuaauaguca

SEQ ID NO: 47962 - RNA, 19 nt, Homo sapiens
aauuacggcucaucucuuu

SEQ ID NO: 47963 - RNA, 19 nt, Homo sapiens
gaauuuaaggugucagaga

SEQ ID NO: 47964 - RNA, 19 nt, Homo sapiens
gggagaaaccucauaucaa

SEQ ID NO: 47965 - RNA, 19 nt, Homo sapiens
gugaagacguagauaaugg

SEQ ID NO: 47966 - RNA, 19 nt, Homo sapiens
caacucugccgguauuuga

SEQ ID NO: 47967 - RNA, 19 nt, Homo sapiens
gauaaaugaagauggagaa

SEQ ID NO: 47968 - RNA, 19 nt, Homo sapiens
gaagugggaacuaugaauc

SEQ ID NO: 47969 - RNA, 19 nt, Homo sapiens
gcaagaugggagggaauua

SEQ ID NO: 47970 - RNA, 19 nt, Homo sapiens
ggaacugagccuucucuug

SEQ ID NO: 47971 - RNA, 19 nt, Homo sapiens
caacaucugcuagucugua

SEQ ID NO: 47972 - RNA, 19 nt, Homo sapiens
gcucaucagcuuugcacua

SEQ ID NO: 47973 - RNA, 19 nt, Homo sapiens
acaauacacauuccaacua

SEQ ID NO: 47974 - RNA, 19 nt, Homo sapiens
caccauggaugacuugaca

SEQ ID NO: 47975 - RNA, 19 nt, Homo sapiens
gggccaaucccaaguaugu

SEQ ID NO: 47976 - RNA, 19 nt, Homo sapiens
uaacggaucggcagagugu

SEQ ID NO: 47977 - RNA, 19 nt, Homo sapiens
uaucaagccucuucagaac

SEQ ID NO: 47978 - RNA, 19 nt, Homo sapiens
ucaagaagccuaccaaagc

SEQ ID NO: 47979 - RNA, 19 nt, Homo sapiens
ggaauuacggcucaucucu

SEQ ID NO: 47980 - RNA, 19 nt, Homo sapiens
gggaacagagugagagaga

SEQ ID NO: 47981 - RNA, 19 nt, Homo sapiens
gccaaucccaaguauguaa

SEQ ID NO: 47982 - RNA, 19 nt, Homo sapiens
guauauucguccugcauuc

SEQ ID NO: 47983 - RNA, 19 nt, Homo sapiens
ccaaaccucaacauggaua

SEQ ID NO: 47984 - RNA, 19 nt, Homo sapiens
gcauuucgaggaguagaua

SEQ ID NO: 47985 - RNA, 19 nt, Homo sapiens
agagugagagagauguuua

SEQ ID NO: 47986 - RNA, 19 nt, Homo sapiens
gaauuacggcucaucucuu

SEQ ID NO: 47987 - RNA, 19 nt, Homo sapiens
gaugggagaaaccucauau

SEQ ID NO: 47988 - RNA, 19 nt, Homo sapiens
acuaugcaguggaauuauu

SEQ ID NO: 47989 - RNA, 19 nt, Homo sapiens
agccaaaccucaacaugga

SEQ ID NO: 47990 - RNA, 19 nt, Homo sapiens
ggaacagagugagagagau

SEQ ID NO: 47991 - RNA, 19 nt, Homo sapiens
cuggauaaaugaagaugga

SEQ ID NO: 47992 - RNA, 19 nt, Homo sapiens
gcaaauuaacugauaucca

SEQ ID NO: 47993 - RNA, 19 nt, Homo sapiens
uaaaugaagauggagaaga

SEQ ID NO: 47994 - RNA, 19 nt, Homo sapiens
ucaaguggaaccuuuaauc

SEQ ID NO: 47995 - RNA, 19 nt, Homo sapiens
cuaauagucacaccagcua

SEQ ID NO: 47996 - RNA, 19 nt, Homo sapiens
ugaaauuggaucaagaaug

SEQ ID NO: 47997 - RNA, 19 nt, Homo sapiens
ucaacagcuugugaaauug

SEQ ID NO: 47998 - RNA, 19 nt, Homo sapiens
caucagcuuugcacuaugc

SEQ ID NO: 47999 - RNA, 19 nt, Homo sapiens
caucugcuagucuguauau

SEQ ID NO: 48000 - RNA, 19 nt, Homo sapiens
ggucccauauucaacaucu

SEQ ID NO: 48001 - RNA, 19 nt, Homo sapiens
cgacuggacaauugugcua

SEQ ID NO: 48002 - RNA, 19 nt, Homo sapiens
gagcaaauuaacugauauc

SEQ ID NO: 48003 - RNA, 19 nt, Homo sapiens
ccgcaucuugagcaaauua

SEQ ID NO: 48004 - RNA, 19 nt, Homo sapiens
ggcaacuccuccacuagau

SEQ ID NO: 48005 - RNA, 19 nt, Homo sapiens
cacccuggcucaucagcuu

SEQ ID NO: 48006 - RNA, 19 nt, Homo sapiens
gagacaauacacauuccaa

SEQ ID NO: 48007 - RNA, 19 nt, Homo sapiens
uugcccaguuucugauaua

SEQ ID NO: 48008 - RNA, 19 nt, Homo sapiens
gaagaagaacuggcaacuc

SEQ ID NO: 48009 - RNA, 19 nt, Homo sapiens
ugcccaaugugaagacgua

SEQ ID NO: 48010 - RNA, 19 nt, Homo sapiens
cacaccagcuaccauuuua

SEQ ID NO: 48011 - RNA, 19 nt, Homo sapiens
ggaugggagaaaccucaua

SEQ ID NO: 48012 - RNA, 19 nt, Homo sapiens
ugaagauggagaagaagaa

SEQ ID NO: 48013 - RNA, 19 nt, Homo sapiens
gcaacucugccgguauuug

SEQ ID NO: 48014 - RNA, 19 nt, Homo sapiens
uaaggcuaaagaccuaaua

SEQ ID NO: 48015 - RNA, 19 nt, Homo sapiens
cauaucaagccucuucaga

SEQ ID NO: 48016 - RNA, 19 nt, Homo sapiens
uguguuguuugcccaguuu

SEQ ID NO: 48017 - RNA, 19 nt, Homo sapiens
gcaacuccuccacuagaug

SEQ ID NO: 48018 - RNA, 19 nt, Homo sapiens
gcagagaccaucagaucac

SEQ ID NO: 48019 - RNA, 19 nt, Homo sapiens
ugggagaaaccucauauca

SEQ ID NO: 48020 - RNA, 19 nt, Homo sapiens
aaugugaagacguagauaa

SEQ ID NO: 48021 - RNA, 19 nt, Homo sapiens
acuggcaacuccuccacua

SEQ ID NO: 48022 - RNA, 19 nt, Homo sapiens
uggcagagaccaucagauc

SEQ ID NO: 48023 - RNA, 19 nt, Homo sapiens
ccucauaucaagccucuuc

SEQ ID NO: 48024 - RNA, 19 nt, Homo sapiens
ggcuaaagaccuaauaguc

SEQ ID NO: 48025 - RNA, 19 nt, Homo sapiens
cguccugcauucauuggaa

SEQ ID NO: 48026 - RNA, 19 nt, Homo sapiens
caacagcuugugaaauugg

SEQ ID NO: 48027 - RNA, 19 nt, Homo sapiens
uucgaggaguagauaauaa

SEQ ID NO: 48028 - RNA, 19 nt, Homo sapiens
cucaucagcuuugcacuau

SEQ ID NO: 48029 - RNA, 19 nt, Homo sapiens
gcacaucaguggggugaau

SEQ ID NO: 48030 - RNA, 19 nt, Homo sapiens
guauguaagagccuggaaa

SEQ ID NO: 48031 - RNA, 19 nt, Homo sapiens
ucgaggaguagauaauaaa

SEQ ID NO: 48032 - RNA, 19 nt, Homo sapiens
ggcagaguguaccggagaa

SEQ ID NO: 48033 - RNA, 19 nt, Homo sapiens
cuaugcaguggaauuauuu

SEQ ID NO: 48034 - RNA, 19 nt, Homo sapiens
gacaauacacauuccaacu

SEQ ID NO: 48035 - RNA, 19 nt, Homo sapiens
gagauguuuagcucuggua

SEQ ID NO: 48036 - RNA, 19 nt, Homo sapiens
gugacaaggcggugcauuc

SEQ ID NO: 48037 - RNA, 19 nt, Homo sapiens
gugggaacuaugaaucuuu

SEQ ID NO: 48038 - RNA, 19 nt, Homo sapiens
uguaagagccuggaaaggu

SEQ ID NO: 48039 - RNA, 19 nt, Homo sapiens
agagagcgacuggacaauu

SEQ ID NO: 48040 - RNA, 19 nt, Homo sapiens
ggcgagacaauacacauuc

SEQ ID NO: 48041 - RNA, 19 nt, Homo sapiens
gagugguccucagaguuug

SEQ ID NO: 48042 - RNA, 19 nt, Homo sapiens
gcccugcucuuuguacucu

SEQ ID NO: 48043 - RNA, 19 nt, Homo sapiens
uugaaggauugaaggcauu

SEQ ID NO: 48044 - RNA, 19 nt, Homo sapiens
ccaaugugaagacguagau

SEQ ID NO: 48045 - RNA, 19 nt, Homo sapiens
ucaagccucuucagaaccu

SEQ ID NO: 48046 - RNA, 19 nt, Homo sapiens
guggagugguccucagagu

SEQ ID NO: 48047 - RNA, 19 nt, Homo sapiens
gaagauggagaagaagaac

SEQ ID NO: 48048 - RNA, 19 nt, Homo sapiens
gaagugcaauacgaaauaa

SEQ ID NO: 48049 - RNA, 19 nt, Homo sapiens
caaguuaggugggaauuau

SEQ ID NO: 48050 - RNA, 19 nt, Homo sapiens
agaaggagcugaaggagau

SEQ ID NO: 48051 - RNA, 19 nt, Homo sapiens
cacgaaagcuucucucugu

SEQ ID NO: 48052 - RNA, 19 nt, Homo sapiens
gggcagaucugggcacgaa

SEQ ID NO: 48053 - RNA, 19 nt, Homo sapiens
gacaggaaccuccauauuc

SEQ ID NO: 48054 - RNA, 19 nt, Homo sapiens
gcacucgccucccuaccaa

SEQ ID NO: 48055 - RNA, 19 nt, Homo sapiens
cacagaagccucauaagaa

SEQ ID NO: 48056 - RNA, 19 nt, Homo sapiens
ugacacagaagccucauaa

SEQ ID NO: 48057 - RNA, 19 nt, Homo sapiens
ugacucaccugaagugcaa

SEQ ID NO: 48058 - RNA, 19 nt, Homo sapiens
ugaagugcaauacgaaaua

SEQ ID NO: 48059 - RNA, 19 nt, Homo sapiens
acacagaagccucauaaga

SEQ ID NO: 48060 - RNA, 19 nt, Homo sapiens
ccaugaacaucuuugucua

SEQ ID NO: 48061 - RNA, 19 nt, Homo sapiens
gaauccagcccuuccagaa

SEQ ID NO: 48062 - RNA, 19 nt, Homo sapiens
acagaagccucauaagaag

SEQ ID NO: 48063 - RNA, 19 nt, Homo sapiens
gauaugccuccuccaguuu

SEQ ID NO: 48064 - RNA, 19 nt, Homo sapiens
agauaugccuccuccaguu

SEQ ID NO: 48065 - RNA, 19 nt, Homo sapiens
gaucugggcacgaaagcuu

SEQ ID NO: 48066 - RNA, 19 nt, Homo sapiens
caccugaagugcaauacga

SEQ ID NO: 48067 - RNA, 19 nt, Homo sapiens
agacaggaaccuccauauu

SEQ ID NO: 48068 - RNA, 19 nt, Homo sapiens
gaaccaugaacaucuuugu

SEQ ID NO: 48069 - RNA, 19 nt, Homo sapiens
gccugugccugccgaguuu

SEQ ID NO: 48070 - RNA, 19 nt, Homo sapiens
aaagacaggaaccuccaua

SEQ ID NO: 48071 - RNA, 19 nt, Homo sapiens
gcaccgaauccuguacaaa

SEQ ID NO: 48072 - RNA, 19 nt, Homo sapiens
gagcgcacgaucaccauga

SEQ ID NO: 48073 - RNA, 19 nt, Homo sapiens
gacagagucuacuggacau

SEQ ID NO: 48074 - RNA, 19 nt, Homo sapiens
ggagauccaguacggaauc

SEQ ID NO: 48075 - RNA, 19 nt, Homo sapiens
gauccaguacggaaucaga

SEQ ID NO: 48076 - RNA, 19 nt, Homo sapiens
gagauccaguacggaauca

SEQ ID NO: 48077 - RNA, 19 nt, Homo sapiens
ucaucgaaguggacaagga

SEQ ID NO: 48078 - RNA, 19 nt, Homo sapiens
cgaauccuguacaaagaca

SEQ ID NO: 48079 - RNA, 19 nt, Homo sapiens
gacauuuaccgaccacaug

SEQ ID NO: 48080 - RNA, 19 nt, Homo sapiens
cuacuggacccacgaagau

SEQ ID NO: 48081 - RNA, 19 nt, Homo sapiens
caaugacucaccugaagug

SEQ ID NO: 48082 - RNA, 19 nt, Homo sapiens
gaccugcagcuggaaauga

SEQ ID NO: 48083 - RNA, 19 nt, Homo sapiens
gcacgaucaccaugaagca

SEQ ID NO: 48084 - RNA, 19 nt, Homo sapiens
gcagaucugggcacgaaag

SEQ ID NO: 48085 - RNA, 19 nt, Homo sapiens
caccgaauccuguacaaag

SEQ ID NO: 48086 - RNA, 19 nt, Homo sapiens
cgaucaccaugaagcaguu

SEQ ID NO: 48087 - RNA, 19 nt, Homo sapiens
ccaccgacccguagcaucu

SEQ ID NO: 48088 - RNA, 19 nt, Homo sapiens
gcaacaggaggcacucaag

SEQ ID NO: 48089 - RNA, 19 nt, Homo sapiens
ggaaccaugaacaucuuug

SEQ ID NO: 48090 - RNA, 19 nt, Homo sapiens
ugggaaccaugaacaucuu

SEQ ID NO: 48091 - RNA, 19 nt, Homo sapiens
cagguccucuggcuguaug

SEQ ID NO: 48092 - RNA, 19 nt, Homo sapiens
acaaguuaggugggaauua

SEQ ID NO: 48093 - RNA, 19 nt, Homo sapiens
guucagguccgcccauuac

SEQ ID NO: 48094 - RNA, 19 nt, Homo sapiens
gguucagguccgcccauua

SEQ ID NO: 48095 - RNA, 19 nt, Homo sapiens
guguuugggaagacauuua

SEQ ID NO: 48096 - RNA, 19 nt, Homo sapiens
accaaugacucaccugaag

SEQ ID NO: 48097 - RNA, 19 nt, Homo sapiens
accgaauccuguacaaaga

SEQ ID NO: 48098 - RNA, 19 nt, Homo sapiens
gaaggcguucaaaggcaaa

SEQ ID NO: 48099 - RNA, 19 nt, Homo sapiens
gaggugggaaccaugaaca

SEQ ID NO: 48100 - RNA, 19 nt, Homo sapiens
uuaugggcccaccguguua

SEQ ID NO: 48101 - RNA, 19 nt, Homo sapiens
gcgcuccuguucgucauuc

SEQ ID NO: 48102 - RNA, 19 nt, Homo sapiens
ucgacaagcuggaguugcu

SEQ ID NO: 48103 - RNA, 19 nt, Homo sapiens
ggguucagguccgcccauu

SEQ ID NO: 48104 - RNA, 19 nt, Homo sapiens
gggaaccaugaacaucuuu

SEQ ID NO: 48105 - RNA, 19 nt, Homo sapiens
aaaugggccugagcugauc

SEQ ID NO: 48106 - RNA, 19 nt, Homo sapiens
gaacagaacguugaacuua

SEQ ID NO: 48107 - RNA, 19 nt, Homo sapiens
gaacauggguuuauuugau

SEQ ID NO: 48108 - RNA, 19 nt, Homo sapiens
gaacuuagcuaaauugacu

SEQ ID NO: 48109 - RNA, 19 nt, Homo sapiens
gaaaugacaggaaauauug

SEQ ID NO: 48110 - RNA, 19 nt, Homo sapiens
gaaacuacgugcucaacaa

SEQ ID NO: 48111 - RNA, 19 nt, Homo sapiens
gguaacaucucuuuaugaa

SEQ ID NO: 48112 - RNA, 19 nt, Homo sapiens
gaaugagacugaaauaauc

SEQ ID NO: 48113 - RNA, 19 nt, Homo sapiens
ggaaaugacaggaaauauu

SEQ ID NO: 48114 - RNA, 19 nt, Homo sapiens
ugacaugccagacauauua

SEQ ID NO: 48115 - RNA, 19 nt, Homo sapiens
ccaaauggcuagaacaugu

SEQ ID NO: 48116 - RNA, 19 nt, Homo sapiens
caacaagaauaaugacgaa

SEQ ID NO: 48117 - RNA, 19 nt, Homo sapiens
gaacaccgauccuccaaac

SEQ ID NO: 48118 - RNA, 19 nt, Homo sapiens
ugaaagaguuauuguagug

SEQ ID NO: 48119 - RNA, 19 nt, Homo sapiens
gcacagccaccucuuggua

SEQ ID NO: 48120 - RNA, 19 nt, Homo sapiens
guaacagccuuucuuggaa

SEQ ID NO: 48121 - RNA, 19 nt, Homo sapiens
acaauggccugguucaauu

SEQ ID NO: 48122 - RNA, 19 nt, Homo sapiens
gaagucacauacugaagau

SEQ ID NO: 48123 - RNA, 19 nt, Homo sapiens
gaacguugaacuuagcuaa

SEQ ID NO: 48124 - RNA, 19 nt, Homo sapiens
cagcaaagauaacaauagu

SEQ ID NO: 48125 - RNA, 19 nt, Homo sapiens
gacaggaaauauugaugaa

SEQ ID NO: 48126 - RNA, 19 nt, Homo sapiens
aaaugccacuguauugaua

SEQ ID NO: 48127 - RNA, 19 nt, Homo sapiens
caaguggucugauauuugg

SEQ ID NO: 48128 - RNA, 19 nt, Homo sapiens
gaaacacuguacaccauag

SEQ ID NO: 48129 - RNA, 19 nt, Homo sapiens
ggaaagaagagauaauuac

SEQ ID NO: 48130 - RNA, 19 nt, Homo sapiens
gcauggcuaugaaauugaa

SEQ ID NO: 48131 - RNA, 19 nt, Homo sapiens
gaauacagagucaacaaga

SEQ ID NO: 48132 - RNA, 19 nt, Homo sapiens
ggaagucacauacugaaga

SEQ ID NO: 48133 - RNA, 19 nt, Homo sapiens
gagaaucggaaaucaauau

SEQ ID NO: 48134 - RNA, 19 nt, Homo sapiens
gugaaacggugggcaaauu

SEQ ID NO: 48135 - RNA, 19 nt, Homo sapiens
gcgguaacaucucuuuaug

SEQ ID NO: 48136 - RNA, 19 nt, Homo sapiens
gcaggagcagcuucaguua

SEQ ID NO: 48137 - RNA, 19 nt, Homo sapiens
gaguagauccauagugaaa

SEQ ID NO: 48138 - RNA, 19 nt, Homo sapiens
gaauuugucuuugguuuac

SEQ ID NO: 48139 - RNA, 19 nt, Homo sapiens
gagaaugagacugaaauaa

SEQ ID NO: 48140 - RNA, 19 nt, Homo sapiens
gguaacagccuuucuugga

SEQ ID NO: 48141 - RNA, 19 nt, Homo sapiens
gaaugucagugcaguccaa

SEQ ID NO: 48142 - RNA, 19 nt, Homo sapiens
ggacuccuuugucaguaaa

SEQ ID NO: 48143 - RNA, 19 nt, Homo sapiens
ggaacaucaucuuuacaug

SEQ ID NO: 48144 - RNA, 19 nt, Homo sapiens
caucauaauugcaacaaag

SEQ ID NO: 48145 - RNA, 19 nt, Homo sapiens
uagcaaagucacaaucaua

SEQ ID NO: 48146 - RNA, 19 nt, Homo sapiens
ccucacaucuuuaacuuag

SEQ ID NO: 48147 - RNA, 19 nt, Homo sapiens
ccagaaggauaauauugau

SEQ ID NO: 48148 - RNA, 19 nt, Homo sapiens
uugaguagauccauaguga

SEQ ID NO: 48149 - RNA, 19 nt, Homo sapiens
cgauuacacuagcaagaaa

SEQ ID NO: 48150 - RNA, 19 nt, Homo sapiens
uaucuaaccuugaauacag

SEQ ID NO: 48151 - RNA, 19 nt, Homo sapiens
agacugaaauaaucaagug

SEQ ID NO: 48152 - RNA, 19 nt, Homo sapiens
uaacagccuuucuuggaau

SEQ ID NO: 48153 - RNA, 19 nt, Homo sapiens
gcucaacaaugucgauucu

SEQ ID NO: 48154 - RNA, 19 nt, Homo sapiens
aagcuggccugucuucaaa

SEQ ID NO: 48155 - RNA, 19 nt, Homo sapiens
cauauuacuugaacuugga

SEQ ID NO: 48156 - RNA, 19 nt, Homo sapiens
gcagagaaucggaaaucaa

SEQ ID NO: 48157 - RNA, 19 nt, Homo sapiens
caagaauaaugacgaaacu

SEQ ID NO: 48158 - RNA, 19 nt, Homo sapiens
ggccuugggugauguuguu

SEQ ID NO: 48159 - RNA, 19 nt, Homo sapiens
gggacuccuuugucaguaa

SEQ ID NO: 48160 - RNA, 19 nt, Homo sapiens
gcauuuccccgaaguauua

SEQ ID NO: 48161 - RNA, 19 nt, Homo sapiens
ggcuagaacauguuuaauu

SEQ ID NO: 48162 - RNA, 19 nt, Homo sapiens
gccagaaggauaauauuga

SEQ ID NO: 48163 - RNA, 19 nt, Homo sapiens
uugugugggucucuaauua

SEQ ID NO: 48164 - RNA, 19 nt, Homo sapiens
aaacuuccguggccagaau

SEQ ID NO: 48165 - RNA, 19 nt, Homo sapiens
gcuccuggcuucagcaaag

SEQ ID NO: 48166 - RNA, 19 nt, Homo sapiens
cuagagagaaugagacuga

SEQ ID NO: 48167 - RNA, 19 nt, Homo sapiens
gcuaggaacagaacguuga

SEQ ID NO: 48168 - RNA, 19 nt, Homo sapiens
ggaagccauucauuguuca

SEQ ID NO: 48169 - RNA, 19 nt, Homo sapiens
gauuuacccuuuauagaac

SEQ ID NO: 48170 - RNA, 19 nt, Homo sapiens
ugacaggaaauauugauga

SEQ ID NO: 48171 - RNA, 19 nt, Homo sapiens
aaauaaagauccccaagaa

SEQ ID NO: 48172 - RNA, 19 nt, Homo sapiens
gcucuucaguggguucaaa

SEQ ID NO: 48173 - RNA, 19 nt, Homo sapiens
ccaaguggucugauauuug

SEQ ID NO: 48174 - RNA, 19 nt, Homo sapiens
ccagacauauuacuugaac

SEQ ID NO: 48175 - RNA, 19 nt, Homo sapiens
gagagaaugagacugaaau

SEQ ID NO: 48176 - RNA, 19 nt, Homo sapiens
gcccuaggauucuuagcuu

SEQ ID NO: 48177 - RNA, 19 nt, Homo sapiens
gugggucucuaauuaauag

SEQ ID NO: 48178 - RNA, 19 nt, Homo sapiens
ggaacagaacguugaacuu

SEQ ID NO: 48179 - RNA, 19 nt, Homo sapiens
ggaacauggguuuauuuga

SEQ ID NO: 48180 - RNA, 19 nt, Homo sapiens
aaacuggaacaucaucuuu

SEQ ID NO: 48181 - RNA, 19 nt, Homo sapiens
cacagucucugaccaagug

SEQ ID NO: 48182 - RNA, 19 nt, Homo sapiens
gaaaucaauaugcauagca

SEQ ID NO: 48183 - RNA, 19 nt, Homo sapiens
gcaaagucacaaucauaug

SEQ ID NO: 48184 - RNA, 19 nt, Homo sapiens
caauaugcauagcaaaguc

SEQ ID NO: 48185 - RNA, 19 nt, Homo sapiens
gggaacauggguuuauuug

SEQ ID NO: 48186 - RNA, 19 nt, Homo sapiens
ugaaacggugggcaaauuu

SEQ ID NO: 48187 - RNA, 19 nt, Homo sapiens
ucacugacaugccagacau

SEQ ID NO: 48188 - RNA, 19 nt, Homo sapiens
gaccguggauggugauuuu

SEQ ID NO: 48189 - RNA, 19 nt, Homo sapiens
cagagaaucggaaaucaau

SEQ ID NO: 48190 - RNA, 19 nt, Homo sapiens
acaaucauaugcaucagau

SEQ ID NO: 48191 - RNA, 19 nt, Homo sapiens
uggaagccauucauuguuc

SEQ ID NO: 48192 - RNA, 19 nt, Homo sapiens
cagggaacauggguuuauu

SEQ ID NO: 48193 - RNA, 19 nt, Homo sapiens
ggucugauauuuggaaugc

SEQ ID NO: 48194 - RNA, 19 nt, Homo sapiens
ugucagugcaguccaauuu

SEQ ID NO: 48195 - RNA, 19 nt, Homo sapiens
ugagugaguuuggaaagga

SEQ ID NO: 48196 - RNA, 19 nt, Homo sapiens
uaucagugcucugcuuuua

SEQ ID NO: 48197 - RNA, 19 nt, Homo sapiens
cccgaaguauuacaugauu

SEQ ID NO: 48198 - RNA, 19 nt, Homo sapiens
guugaaagaguuauuguag

SEQ ID NO: 48199 - RNA, 19 nt, Homo sapiens
aauacagagucaacaagaa

SEQ ID NO: 48200 - RNA, 19 nt, Homo sapiens
gaugcauggcuaugaaauu

SEQ ID NO: 48201 - RNA, 19 nt, Homo sapiens
cuggguagaugaucagaga

SEQ ID NO: 48202 - RNA, 19 nt, Homo sapiens
uuagcuaaauugacugguu

SEQ ID NO: 48203 - RNA, 19 nt, Homo sapiens
ugaaacacuguacaccaua

SEQ ID NO: 48204 - RNA, 19 nt, Homo sapiens
gagucaacaagaauaauga

SEQ ID NO: 48205 - RNA, 19 nt, Homo sapiens
gagugaguuuggaaaggaa

SEQ ID NO: 48206 - RNA, 19 nt, Homo sapiens
cagcagaggucacgaauaa

SEQ ID NO: 48207 - RNA, 19 nt, Homo sapiens
caacuucgcugccacacuu

SEQ ID NO: 48208 - RNA, 19 nt, Homo sapiens
gaacgccacuucgucacua

SEQ ID NO: 48209 - RNA, 19 nt, Homo sapiens
ccagucagcucccucuaaa

SEQ ID NO: 48210 - RNA, 19 nt, Homo sapiens
ggaugguaaugauguguuu

SEQ ID NO: 48211 - RNA, 19 nt, Homo sapiens
gguauggcaucaugucaau

SEQ ID NO: 48212 - RNA, 19 nt, Homo sapiens
gaaccagcccuuucucauc

SEQ ID NO: 48213 - RNA, 19 nt, Homo sapiens
ccagaugccuguccacuac

SEQ ID NO: 48214 - RNA, 19 nt, Homo sapiens
gcagagaaccagcccuuuc

SEQ ID NO: 48215 - RNA, 19 nt, Homo sapiens
ggaggcaggugugcugaug

SEQ ID NO: 48216 - RNA, 19 nt, Homo sapiens
gaggucaauuacugggaua

SEQ ID NO: 48217 - RNA, 19 nt, Homo sapiens
agaaggugcugaagcucua

SEQ ID NO: 48218 - RNA, 19 nt, Homo sapiens
uggaugaggucaauuacug

SEQ ID NO: 48219 - RNA, 19 nt, Homo sapiens
gcaagcagcaggagucucu

SEQ ID NO: 48220 - RNA, 19 nt, Homo sapiens
gcagaggucacgaauaaac

SEQ ID NO: 48221 - RNA, 19 nt, Homo sapiens
ggccggaucuccuucuaca

SEQ ID NO: 48222 - RNA, 19 nt, Homo sapiens
ccaaccugcucuucucaga

SEQ ID NO: 48223 - RNA, 19 nt, Homo sapiens
ccacuacggcugcaaggaa

SEQ ID NO: 48224 - RNA, 19 nt, Homo sapiens
ugacacugcuuaacaccau

SEQ ID NO: 48225 - RNA, 19 nt, Homo sapiens
aggcaggugugcugaugua

SEQ ID NO: 48226 - RNA, 19 nt, Homo sapiens
gcaugacacugcuuaacac

SEQ ID NO: 48227 - RNA, 19 nt, Homo sapiens
gcucuucucagacguguau

SEQ ID NO: 48228 - RNA, 19 nt, Homo sapiens
gggaugaggagcaggagaa

SEQ ID NO: 48229 - RNA, 19 nt, Homo sapiens
ccagugcuauggcaacauc

SEQ ID NO: 48230 - RNA, 19 nt, Homo sapiens
cgaaggagaaggugcugaa

SEQ ID NO: 48231 - RNA, 19 nt, Homo sapiens
gcccaccucugagcaguau

SEQ ID NO: 48232 - RNA, 19 nt, Homo sapiens
ccaacagggucgucaucug

SEQ ID NO: 48233 - RNA, 19 nt, Homo sapiens
gcaaggaacgccacuucgu

SEQ ID NO: 48234 - RNA, 19 nt, Homo sapiens
cggaucuccuucuacauga

SEQ ID NO: 48235 - RNA, 19 nt, Homo sapiens
gugcugaagcucuacaaga

SEQ ID NO: 48236 - RNA, 19 nt, Homo sapiens
ccgcguggaugguaaugau

SEQ ID NO: 48237 - RNA, 19 nt, Homo sapiens
ucggcggaguuuauagaua

SEQ ID NO: 48238 - RNA, 19 nt, Homo sapiens
gcuauggcaacaucaguga

SEQ ID NO: 48239 - RNA, 19 nt, Homo sapiens
ccuucuacaugaccaacua

SEQ ID NO: 48240 - RNA, 19 nt, Homo sapiens
cgguggaugaggucaauua

SEQ ID NO: 48241 - RNA, 19 nt, Homo sapiens
ccaggcagcagcagcaguu

SEQ ID NO: 48242 - RNA, 19 nt, Homo sapiens
caggugugcugauguaucg

SEQ ID NO: 48243 - RNA, 19 nt, Homo sapiens
gcacauucaggacuagaag

SEQ ID NO: 48244 - RNA, 19 nt, Homo sapiens
gcuccucccguguuacauu

SEQ ID NO: 48245 - RNA, 19 nt, Homo sapiens
ggaagcagucccgcaggaa

SEQ ID NO: 48246 - RNA, 19 nt, Homo sapiens
ucaauuacugggauaaaca

SEQ ID NO: 48247 - RNA, 19 nt, Homo sapiens
gccagaugccuguccacua

SEQ ID NO: 48248 - RNA, 19 nt, Homo sapiens
gaccgcauccucuaugagu

SEQ ID NO: 48249 - RNA, 19 nt, Homo sapiens
cggcaaggccagaucauca

SEQ ID NO: 48250 - RNA, 19 nt, Homo sapiens
ccacuggaucacuucgaua

SEQ ID NO: 48251 - RNA, 19 nt, Homo sapiens
agacguguaucaggagaug

SEQ ID NO: 48252 - RNA, 19 nt, Homo sapiens
caacgucaucucuggaauc

SEQ ID NO: 48253 - RNA, 19 nt, Homo sapiens
gcugggugaugggcacauu

SEQ ID NO: 48254 - RNA, 19 nt, Homo sapiens
cacuggaucacuucgauaa

SEQ ID NO: 48255 - RNA, 19 nt, Homo sapiens
ggucaauuacugggauaaa

SEQ ID NO: 48256 - RNA, 19 nt, Homo sapiens
cagcaccagugacgacagu

SEQ ID NO: 48257 - RNA, 19 nt, Homo sapiens
ggucacgaauaaacugcau

SEQ ID NO: 48258 - RNA, 19 nt, Homo sapiens
gcaccagugacgacaguuc

SEQ ID NO: 48259 - RNA, 19 nt, Homo sapiens
gcaggugugcugauguauc

SEQ ID NO: 48260 - RNA, 19 nt, Homo sapiens
ccggaucuccuucuacaug

SEQ ID NO: 48261 - RNA, 19 nt, Homo sapiens
gggccucggcggaguuuau

SEQ ID NO: 48262 - RNA, 19 nt, Homo sapiens
gcugauguaucgggacuac

SEQ ID NO: 48263 - RNA, 19 nt, Homo sapiens
ccagcagaggucacgaaua

SEQ ID NO: 48264 - RNA, 19 nt, Homo sapiens
ggucgucaucuguuacuuc

SEQ ID NO: 48265 - RNA, 19 nt, Homo sapiens
ggcaaggccagaucaucaa

SEQ ID NO: 48266 - RNA, 19 nt, Homo sapiens
ccaacgucaucucuggaau

SEQ ID NO: 48267 - RNA, 19 nt, Homo sapiens
uauacaacgccacaaagga

SEQ ID NO: 48268 - RNA, 19 nt, Homo sapiens
guauacaacgccacaaagg

SEQ ID NO: 48269 - RNA, 19 nt, Homo sapiens
ccauggaccgcauccucua

SEQ ID NO: 48270 - RNA, 19 nt, Homo sapiens
ggccucggcggaguuuaua

SEQ ID NO: 48271 - RNA, 19 nt, Homo sapiens
aaugauguguuugccguau

SEQ ID NO: 48272 - RNA, 19 nt, Homo sapiens
ggguauggcaucaugucaa

SEQ ID NO: 48273 - RNA, 19 nt, Homo sapiens
aggagaaggugcugaagcu

SEQ ID NO: 48274 - RNA, 19 nt, Homo sapiens
uggaccgcauccucuauga

SEQ ID NO: 48275 - RNA, 19 nt, Homo sapiens
ugauguguuugccguauac

SEQ ID NO: 48276 - RNA, 19 nt, Homo sapiens
ucuccacgcccaccucuga

SEQ ID NO: 48277 - RNA, 19 nt, Homo sapiens
gcccagugcuauggcaaca

SEQ ID NO: 48278 - RNA, 19 nt, Homo sapiens
gucaauuacugggauaaac

SEQ ID NO: 48279 - RNA, 19 nt, Homo sapiens
gaaaucagcucuacaguuc

SEQ ID NO: 48280 - RNA, 19 nt, Homo sapiens
ggaagauuaugacuagaua

SEQ ID NO: 48281 - RNA, 19 nt, Homo sapiens
gaaauucaguuugcagauu

SEQ ID NO: 48282 - RNA, 19 nt, Homo sapiens
uaaugaagcugccaaguau

SEQ ID NO: 48283 - RNA, 19 nt, Homo sapiens
uaacacacauguauugaug

SEQ ID NO: 48284 - RNA, 19 nt, Homo sapiens
ggaagaagucccuauagaa

SEQ ID NO: 48285 - RNA, 19 nt, Homo sapiens
gaaccuagaggcuccuaua

SEQ ID NO: 48286 - RNA, 19 nt, Homo sapiens
ccuagaggcuccuauauca

SEQ ID NO: 48287 - RNA, 19 nt, Homo sapiens
ggaaaucagcucuacaguu

SEQ ID NO: 48288 - RNA, 19 nt, Homo sapiens
gcacucagguucaugugau

SEQ ID NO: 48289 - RNA, 19 nt, Homo sapiens
gcuccuauaucaagaguau

SEQ ID NO: 48290 - RNA, 19 nt, Homo sapiens
ggaggaauguuucuugaac

SEQ ID NO: 48291 - RNA, 19 nt, Homo sapiens
gauauuggcugaaaaguuc

SEQ ID NO: 48292 - RNA, 19 nt, Homo sapiens
gaagaagucccuauagaac

SEQ ID NO: 48293 - RNA, 19 nt, Homo sapiens
cggaagaagucccuauaga

SEQ ID NO: 48294 - RNA, 19 nt, Homo sapiens
ccacaugguaaucuuauaa

SEQ ID NO: 48295 - RNA, 19 nt, Homo sapiens
gauuaugacuagauaugga

SEQ ID NO: 48296 - RNA, 19 nt, Homo sapiens
ucacgaggcucccuugaca

SEQ ID NO: 48297 - RNA, 19 nt, Homo sapiens
gcaguaauauuuggugaag

SEQ ID NO: 48298 - RNA, 19 nt, Homo sapiens
gaucugaggacuauaauac

SEQ ID NO: 48299 - RNA, 19 nt, Homo sapiens
uauaauaccuugggaugug

SEQ ID NO: 48300 - RNA, 19 nt, Homo sapiens
aaauggaaguguuaugaug

SEQ ID NO: 48301 - RNA, 19 nt, Homo sapiens
ccagacaaauggaaguguu

SEQ ID NO: 48302 - RNA, 19 nt, Homo sapiens
uuaaugaagcugccaagua

SEQ ID NO: 48303 - RNA, 19 nt, Homo sapiens
ggaagggagugauguuacu

SEQ ID NO: 48304 - RNA, 19 nt, Homo sapiens
uaucaagaguaugugguua

SEQ ID NO: 48305 - RNA, 19 nt, Homo sapiens
caggaggaauguuucuuga

SEQ ID NO: 48306 - RNA, 19 nt, Homo sapiens
gugaagauguugccuuugg

SEQ ID NO: 48307 - RNA, 19 nt, Homo sapiens
ugucaugcauagaggauaa

SEQ ID NO: 48308 - RNA, 19 nt, Homo sapiens
ggcggcagguggcucauuu

SEQ ID NO: 48309 - RNA, 19 nt, Homo sapiens
gaaaagcggaagauuauga

SEQ ID NO: 48310 - RNA, 19 nt, Homo sapiens
gcauuugaucagauuguua

SEQ ID NO: 48311 - RNA, 19 nt, Homo sapiens
ucauugaucugaggacuau

SEQ ID NO: 48312 - RNA, 19 nt, Homo sapiens
gucuuuagaugcacuguug

SEQ ID NO: 48313 - RNA, 19 nt, Homo sapiens
gaucagauuguuaaugaag

SEQ ID NO: 48314 - RNA, 19 nt, Homo sapiens
ggaauuguuggauuuggaa

SEQ ID NO: 48315 - RNA, 19 nt, Homo sapiens
uggugaagauguugccuuu

SEQ ID NO: 48316 - RNA, 19 nt, Homo sapiens
uuauauuuccuccgacuua

SEQ ID NO: 48317 - RNA, 19 nt, Homo sapiens
acaaauggaaguguuauga

SEQ ID NO: 48318 - RNA, 19 nt, Homo sapiens
cuacugccauugcggaaau

SEQ ID NO: 48319 - RNA, 19 nt, Homo sapiens
gguggagucuuuagaugca

SEQ ID NO: 48320 - RNA, 19 nt, Homo sapiens
cagacaaauggaaguguua

SEQ ID NO: 48321 - RNA, 19 nt, Homo sapiens
ucaagaguaugugguuaug

SEQ ID NO: 48322 - RNA, 19 nt, Homo sapiens
gaaucaaggugguuauacc

SEQ ID NO: 48323 - RNA, 19 nt, Homo sapiens
acacacauguauugaugau

SEQ ID NO: 48324 - RNA, 19 nt, Homo sapiens
gcugaaaaguucuacauuc

SEQ ID NO: 48325 - RNA, 19 nt, Homo sapiens
guuaugaugcccuucgaaa

SEQ ID NO: 48326 - RNA, 19 nt, Homo sapiens
caggaagggagugauguua

SEQ ID NO: 48327 - RNA, 19 nt, Homo sapiens
ggaaauucaguuugcagau

SEQ ID NO: 48328 - RNA, 19 nt, Homo sapiens
caaauggaaguguuaugau

SEQ ID NO: 48329 - RNA, 19 nt, Homo sapiens
uggagugucuugugaaguc

SEQ ID NO: 48330 - RNA, 19 nt, Homo sapiens
ccaggaaucaaggugguua

SEQ ID NO: 48331 - RNA, 19 nt, Homo sapiens
cacuggagcuacugccauu

SEQ ID NO: 48332 - RNA, 19 nt, Homo sapiens
ggauaacucauuggccaaa

SEQ ID NO: 48333 - RNA, 19 nt, Homo sapiens
gucccaggccgaagucaua

SEQ ID NO: 48334 - RNA, 19 nt, Homo sapiens
uauagaaccauacaacauc

SEQ ID NO: 48335 - RNA, 19 nt, Homo sapiens
cuacaucccagacaaaugg

SEQ ID NO: 48336 - RNA, 19 nt, Homo sapiens
gacacaccauuuccucaca

SEQ ID NO: 48337 - RNA, 19 nt, Homo sapiens
gcagguggcucauuuuacu

SEQ ID NO: 48338 - RNA, 19 nt, Homo sapiens
ucaggaggaauguuucuug

SEQ ID NO: 48339 - RNA, 19 nt, Homo sapiens
caucggaaaucagcucuac

SEQ ID NO: 48340 - RNA, 19 nt, Homo sapiens
agaagucccuauagaacca

SEQ ID NO: 48341 - RNA, 19 nt, Homo sapiens
guaacacacauguauugau

SEQ ID NO: 48342 - RNA, 19 nt, Homo sapiens
uagaaaagcggaagauuau

SEQ ID NO: 48343 - RNA, 19 nt, Homo sapiens
aaacagggcgacugcuaau

SEQ ID NO: 48344 - RNA, 19 nt, Homo sapiens
ugccuuugguggagucuuu

SEQ ID NO: 48345 - RNA, 19 nt, Homo sapiens
ugccuuggauaacucauug

SEQ ID NO: 48346 - RNA, 19 nt, Homo sapiens
ggaaucaaggugguuauac

SEQ ID NO: 48347 - RNA, 19 nt, Homo sapiens
guacgggcaaacucagaaa

SEQ ID NO: 48348 - RNA, 19 nt, Homo sapiens
gguuaugacacaccauuuc

SEQ ID NO: 48349 - RNA, 19 nt, Homo sapiens
caaggaauuguuggauuug

SEQ ID NO: 48350 - RNA, 19 nt, Homo sapiens
ggaauguuucuugaaccua

SEQ ID NO: 48351 - RNA, 19 nt, Homo sapiens
acagggcgacugcuaauca

SEQ ID NO: 48352 - RNA, 19 nt, Homo sapiens
ggagugucuugugaaguca

SEQ ID NO: 48353 - RNA, 19 nt, Homo sapiens
agcggaagauuaugacuag

SEQ ID NO: 48354 - RNA, 19 nt, Homo sapiens
auagaaaagcggaagauua

SEQ ID NO: 48355 - RNA, 19 nt, Homo sapiens
cacaccauuuccucacauu

SEQ ID NO: 48356 - RNA, 19 nt, Homo sapiens
gauaacucauuggccaaag

SEQ ID NO: 48357 - RNA, 19 nt, Homo sapiens
acuguuggcuugcgagaca

SEQ ID NO: 48358 - RNA, 19 nt, Homo sapiens
ccauacaacaucccacugu

SEQ ID NO: 48359 - RNA, 19 nt, Homo sapiens
gcggaagaagucccuauag

SEQ ID NO: 48360 - RNA, 19 nt, Homo sapiens
auaacucauuggccaaaga

SEQ ID NO: 48361 - RNA, 19 nt, Homo sapiens
aagcggaagauuaugacua

SEQ ID NO: 48362 - RNA, 19 nt, Homo sapiens
cauucuacaucccagacaa

SEQ ID NO: 48363 - RNA, 19 nt, Homo sapiens
aagaguaugugguuaugac

SEQ ID NO: 48364 - RNA, 19 nt, Homo sapiens
caguucaggaggaauguuu

SEQ ID NO: 48365 - RNA, 19 nt, Homo sapiens
caaaacagggcgacugcua

SEQ ID NO: 48366 - RNA, 19 nt, Homo sapiens
guaagucugugaucaaaac

SEQ ID NO: 48367 - RNA, 19 nt, Homo sapiens
cuauagaaccauacaacau

SEQ ID NO: 48368 - RNA, 19 nt, Homo sapiens
gcccauugcccaggaauca

SEQ ID NO: 48369 - RNA, 19 nt, Homo sapiens
cugcauagccugagaaucc

SEQ ID NO: 48370 - RNA, 19 nt, Homo sapiens
uagaggcuccuauaucaag

SEQ ID NO: 48371 - RNA, 19 nt, Homo sapiens
cuacaguucaggaggaaug

SEQ ID NO: 48372 - RNA, 19 nt, Homo sapiens
uccacaugguaaucuuaua

SEQ ID NO: 48373 - RNA, 19 nt, Homo sapiens
uaacucauuggccaaagau

SEQ ID NO: 48374 - RNA, 19 nt, Homo sapiens
gacaaauggaaguguuaug

SEQ ID NO: 48375 - RNA, 19 nt, Homo sapiens
ugaagauguugccuuuggu

SEQ ID NO: 48376 - RNA, 19 nt, Homo sapiens
uuguaagucugugaucaaa

SEQ ID NO: 48377 - RNA, 19 nt, Homo sapiens
cuugugaagucauugaucu

SEQ ID NO: 48378 - RNA, 19 nt, Homo sapiens
gggcagcagcggaagaagu

SEQ ID NO: 48379 - RNA, 19 nt, Homo sapiens
gaauaggcauuaacacaaa

SEQ ID NO: 48380 - RNA, 19 nt, Homo sapiens
acacaaaccuucugccuuu

SEQ ID NO: 48381 - RNA, 19 nt, Homo sapiens
uggaauagcuucuggaauu

SEQ ID NO: 48382 - RNA, 19 nt, Homo sapiens
gaauauccauguacuuguu

SEQ ID NO: 48383 - RNA, 19 nt, Homo sapiens
guacuuugcuugcucauau

SEQ ID NO: 48384 - RNA, 19 nt, Homo sapiens
gaacacggcucacgcuuac

SEQ ID NO: 48385 - RNA, 19 nt, Homo sapiens
gaagggagguggcaagagu

SEQ ID NO: 48386 - RNA, 19 nt, Homo sapiens
ggaauagcuucuggaauuu

SEQ ID NO: 48387 - RNA, 19 nt, Homo sapiens
caacugguguuugaaagua

SEQ ID NO: 48388 - RNA, 19 nt, Homo sapiens
ugaacaagcucaaguggaa

SEQ ID NO: 48389 - RNA, 19 nt, Homo sapiens
gaagucaccucuugguuac

SEQ ID NO: 48390 - RNA, 19 nt, Homo sapiens
gcauguagucacuuuauaa

SEQ ID NO: 48391 - RNA, 19 nt, Homo sapiens
guacuaguguucuguuugu

SEQ ID NO: 48392 - RNA, 19 nt, Homo sapiens
ugaagucaccucuugguua

SEQ ID NO: 48393 - RNA, 19 nt, Homo sapiens
gcacaaguccuggauguug

SEQ ID NO: 48394 - RNA, 19 nt, Homo sapiens
ccagagugaucaaguguga

SEQ ID NO: 48395 - RNA, 19 nt, Homo sapiens
ucaaaugugugcagaagga

SEQ ID NO: 48396 - RNA, 19 nt, Homo sapiens
cacaauaccucaugcuuca

SEQ ID NO: 48397 - RNA, 19 nt, Homo sapiens
guagugaccuguuuaugag

SEQ ID NO: 48398 - RNA, 19 nt, Homo sapiens
ccgaggagcugcugcaaau

SEQ ID NO: 48399 - RNA, 19 nt, Homo sapiens
ggguauguuuaaucuguua

SEQ ID NO: 48400 - RNA, 19 nt, Homo sapiens
guguaucucuuucacauug

SEQ ID NO: 48401 - RNA, 19 nt, Homo sapiens
ccacggcguuguaccugua

SEQ ID NO: 48402 - RNA, 19 nt, Homo sapiens
uaacaagugugucuuacgu

SEQ ID NO: 48403 - RNA, 19 nt, Homo sapiens
caucuuggcuauguaauuc

SEQ ID NO: 48404 - RNA, 19 nt, Homo sapiens
gagaagcugugcaucuaca

SEQ ID NO: 48405 - RNA, 19 nt, Homo sapiens
ccgagaagcugugcaucua

SEQ ID NO: 48406 - RNA, 19 nt, Homo sapiens
guagauguguaaccucuuc

SEQ ID NO: 48407 - RNA, 19 nt, Homo sapiens
gggcacaaguccuggaugu

SEQ ID NO: 48408 - RNA, 19 nt, Homo sapiens
ccuuugauguuacagauuu

SEQ ID NO: 48409 - RNA, 19 nt, Homo sapiens
gcauguucguggccucuaa

SEQ ID NO: 48410 - RNA, 19 nt, Homo sapiens
aaagguugcuguuucacaa

SEQ ID NO: 48411 - RNA, 19 nt, Homo sapiens
gcuauuggaggaucaguuu

SEQ ID NO: 48412 - RNA, 19 nt, Homo sapiens
guuauuauauuccguaggu

SEQ ID NO: 48413 - RNA, 19 nt, Homo sapiens
ggaggaggguugugcuaca

SEQ ID NO: 48414 - RNA, 19 nt, Homo sapiens
ccaacaacuuccuguccua

SEQ ID NO: 48415 - RNA, 19 nt, Homo sapiens
ggugccaacugguguuuga

SEQ ID NO: 48416 - RNA, 19 nt, Homo sapiens
uccaauagguguaggaaau

SEQ ID NO: 48417 - RNA, 19 nt, Homo sapiens
cuaggcaucucuguacuuu

SEQ ID NO: 48418 - RNA, 19 nt, Homo sapiens
guaagaauaggcauuaaca

SEQ ID NO: 48419 - RNA, 19 nt, Homo sapiens
uuaaagagacuccaaaucu

SEQ ID NO: 48420 - RNA, 19 nt, Homo sapiens
gggcguagcaucauaguag

SEQ ID NO: 48421 - RNA, 19 nt, Homo sapiens
gauuacugcucuauuccaa

SEQ ID NO: 48422 - RNA, 19 nt, Homo sapiens
gggaauauccauguacuug

SEQ ID NO: 48423 - RNA, 19 nt, Homo sapiens
aagacgaaauagugacaua

SEQ ID NO: 48424 - RNA, 19 nt, Homo sapiens
ucacauuguuugcugcuau

SEQ ID NO: 48425 - RNA, 19 nt, Homo sapiens
acacaaagacauugauuca

SEQ ID NO: 48426 - RNA, 19 nt, Homo sapiens
gcguguagcuauggaaguu

SEQ ID NO: 48427 - RNA, 19 nt, Homo sapiens
uuacagcuguguuauucuu

SEQ ID NO: 48428 - RNA, 19 nt, Homo sapiens
guacuuguuucucuguugu

SEQ ID NO: 48429 - RNA, 19 nt, Homo sapiens
gcaaacacgcgcagaccuu

SEQ ID NO: 48430 - RNA, 19 nt, Homo sapiens
ugucauauacugccaugua

SEQ ID NO: 48431 - RNA, 19 nt, Homo sapiens
caggcacgguuuggaaaua

SEQ ID NO: 48432 - RNA, 19 nt, Homo sapiens
cgguuccgaugaauucuua

SEQ ID NO: 48433 - RNA, 19 nt, Homo sapiens
caaaccauccagugacaaa

SEQ ID NO: 48434 - RNA, 19 nt, Homo sapiens
ccaacaaaccauccaguga

SEQ ID NO: 48435 - RNA, 19 nt, Homo sapiens
gaagaggguuuuagguaga

SEQ ID NO: 48436 - RNA, 19 nt, Homo sapiens
gauuagguuccauccuuua

SEQ ID NO: 48437 - RNA, 19 nt, Homo sapiens
gaggagaacaaacagauca

SEQ ID NO: 48438 - RNA, 19 nt, Homo sapiens
uguggaggcugacguguga

SEQ ID NO: 48439 - RNA, 19 nt, Homo sapiens
acacacagauacacacaca

SEQ ID NO: 48440 - RNA, 19 nt, Homo sapiens
uggcugaagucaccucuug

SEQ ID NO: 48441 - RNA, 19 nt, Homo sapiens
acaacuuccuguccuacua

SEQ ID NO: 48442 - RNA, 19 nt, Homo sapiens
ggaauuuguucaaguuuug

SEQ ID NO: 48443 - RNA, 19 nt, Homo sapiens
auacugccauguacuaguu

SEQ ID NO: 48444 - RNA, 19 nt, Homo sapiens
aggccaguaugauuuauaa

SEQ ID NO: 48445 - RNA, 19 nt, Homo sapiens
gaugauaaguuccuuuccu

SEQ ID NO: 48446 - RNA, 19 nt, Homo sapiens
ccaauagguguaggaaaua

SEQ ID NO: 48447 - RNA, 19 nt, Homo sapiens
guuguaagaauaggcauua

SEQ ID NO: 48448 - RNA, 19 nt, Homo sapiens
cauauacugccauguacua

SEQ ID NO: 48449 - RNA, 19 nt, Homo sapiens
gaaguugaaguuuaggaau

SEQ ID NO: 48450 - RNA, 19 nt, Homo sapiens
ggaaugguuugggaauauc

SEQ ID NO: 48451 - RNA, 19 nt, Homo sapiens
cuacuugguuuguguucuu

SEQ ID NO: 48452 - RNA, 19 nt, Homo sapiens
uguagugaccuguuuauga

SEQ ID NO: 48453 - RNA, 19 nt, Homo sapiens
cuacgauacgcuacuauaa

SEQ ID NO: 48454 - RNA, 19 nt, Homo sapiens
ugugauuacugcucuauuc

SEQ ID NO: 48455 - RNA, 19 nt, Homo sapiens
ucacauugccaggaugaua

SEQ ID NO: 48456 - RNA, 19 nt, Homo sapiens
uguaaccucuucaccuuau

SEQ ID NO: 48457 - RNA, 19 nt, Homo sapiens
gaccuucguugcccucugu

SEQ ID NO: 48458 - RNA, 19 nt, Homo sapiens
cuaguguucuguuuguuau

SEQ ID NO: 48459 - RNA, 19 nt, Homo sapiens
ccaagcacuuucaguccaa

SEQ ID NO: 48460 - RNA, 19 nt, Homo sapiens
aggcaugggugcaaggaaa

SEQ ID NO: 48461 - RNA, 19 nt, Homo sapiens
uggaaugguuugggaauau

SEQ ID NO: 48462 - RNA, 19 nt, Homo sapiens
acccacagcuacuugguuu

SEQ ID NO: 48463 - RNA, 19 nt, Homo sapiens
guucguggccucuaagaug

SEQ ID NO: 48464 - RNA, 19 nt, Homo sapiens
uguguaaccucuucaccuu

SEQ ID NO: 48465 - RNA, 19 nt, Homo sapiens
ucuggaauuuguucaaguu

SEQ ID NO: 48466 - RNA, 19 nt, Homo sapiens
gaauagcuucuggaauuug

SEQ ID NO: 48467 - RNA, 19 nt, Homo sapiens
ccacacaaagacauugauu

SEQ ID NO: 48468 - RNA, 19 nt, Homo sapiens
uugcagaggauguucauaa

SEQ ID NO: 48469 - RNA, 19 nt, Homo sapiens
ggagggcaguuuucuaaug

SEQ ID NO: 48470 - RNA, 19 nt, Homo sapiens
caauagguguaggaaauag

SEQ ID NO: 48471 - RNA, 19 nt, Homo sapiens
aagagaagacgaaauagug

SEQ ID NO: 48472 - RNA, 19 nt, Homo sapiens
agaacacggcucacgcuua

SEQ ID NO: 48473 - RNA, 19 nt, Homo sapiens
ggaauauccauguacuugu

SEQ ID NO: 48474 - RNA, 19 nt, Homo sapiens
gacgaaauagugacauaau

SEQ ID NO: 48475 - RNA, 19 nt, Homo sapiens
agaauaggcauuaacacaa

SEQ ID NO: 48476 - RNA, 19 nt, Homo sapiens
uacagaugauagaggauuu

SEQ ID NO: 48477 - RNA, 19 nt, Homo sapiens
ggaggguugugcuacagau

SEQ ID NO: 48478 - RNA, 19 nt, Homo sapiens
aaacagaucauccgcaaac

SEQ ID NO: 48479 - RNA, 19 nt, Homo sapiens
ccagauagcucauuucauu

SEQ ID NO: 48480 - RNA, 19 nt, Homo sapiens
gaauaacucuguggcauua

SEQ ID NO: 48481 - RNA, 19 nt, Homo sapiens
ggacaucuguuucuaaaug

SEQ ID NO: 48482 - RNA, 19 nt, Homo sapiens
gaacagaauugcaaauagu

SEQ ID NO: 48483 - RNA, 19 nt, Homo sapiens
uaaaguaagucuccaguug

SEQ ID NO: 48484 - RNA, 19 nt, Homo sapiens
caaggaagcaccucaauuu

SEQ ID NO: 48485 - RNA, 19 nt, Homo sapiens
ggaauaaagucacagaauc

SEQ ID NO: 48486 - RNA, 19 nt, Homo sapiens
gaagugaggugucauggau

SEQ ID NO: 48487 - RNA, 19 nt, Homo sapiens
caucuuaacugcucuuuau

SEQ ID NO: 48488 - RNA, 19 nt, Homo sapiens
gcaaacauccuaucaacaa

SEQ ID NO: 48489 - RNA, 19 nt, Homo sapiens
uaacugcucuuuaugaaug

SEQ ID NO: 48490 - RNA, 19 nt, Homo sapiens
gagcaugaaugguacugua

SEQ ID NO: 48491 - RNA, 19 nt, Homo sapiens
ugaagacucugcucaguuu

SEQ ID NO: 48492 - RNA, 19 nt, Homo sapiens
gaacuaaggguaugaagga

SEQ ID NO: 48493 - RNA, 19 nt, Homo sapiens
gaaauacaagccauucuaa

SEQ ID NO: 48494 - RNA, 19 nt, Homo sapiens
gaauuccacugucaagaaa

SEQ ID NO: 48495 - RNA, 19 nt, Homo sapiens
gcauaugacucacaugaug

SEQ ID NO: 48496 - RNA, 19 nt, Homo sapiens
gaaauccgaccacuaauug

SEQ ID NO: 48497 - RNA, 19 nt, Homo sapiens
guaaauccaugcaccuaaa

SEQ ID NO: 48498 - RNA, 19 nt, Homo sapiens
ggaagcaccucaauuuagu

SEQ ID NO: 48499 - RNA, 19 nt, Homo sapiens
gaagagggauucacaucug

SEQ ID NO: 48500 - RNA, 19 nt, Homo sapiens
gaaucagccuugaaacauu

SEQ ID NO: 48501 - RNA, 19 nt, Homo sapiens
ggagucaguugaaauucua

SEQ ID NO: 48502 - RNA, 19 nt, Homo sapiens
gcagugcaaugguauaaau

SEQ ID NO: 48503 - RNA, 19 nt, Homo sapiens
gaaauuagggagucaguug

SEQ ID NO: 48504 - RNA, 19 nt, Homo sapiens
gcacaaauacuccgcaaga

SEQ ID NO: 48505 - RNA, 19 nt, Homo sapiens
ggacaaccaugaccuugga

SEQ ID NO: 48506 - RNA, 19 nt, Homo sapiens
gggagaagguguucauuca

SEQ ID NO: 48507 - RNA, 19 nt, Homo sapiens
uacaaguccuuuagucuua

SEQ ID NO: 48508 - RNA, 19 nt, Homo sapiens
cgaagaaccuugugugaca

SEQ ID NO: 48509 - RNA, 19 nt, Homo sapiens
gauguggccuuccauuuau

SEQ ID NO: 48510 - RNA, 19 nt, Homo sapiens
caacacaugucuagcuuuc

SEQ ID NO: 48511 - RNA, 19 nt, Homo sapiens
gagcaaaggugaucguuuu

SEQ ID NO: 48512 - RNA, 19 nt, Homo sapiens
uaaaguacagugugagaua

SEQ ID NO: 48513 - RNA, 19 nt, Homo sapiens
cugcaacacuguacacaua

SEQ ID NO: 48514 - RNA, 19 nt, Homo sapiens
aaacugaauuggagaguga

SEQ ID NO: 48515 - RNA, 19 nt, Homo sapiens
ucacuuaccucucuguguu

SEQ ID NO: 48516 - RNA, 19 nt, Homo sapiens
ugaagaacguggacgcuuu

SEQ ID NO: 48517 - RNA, 19 nt, Homo sapiens
ggaugucacuggccacuga

SEQ ID NO: 48518 - RNA, 19 nt, Homo sapiens
ggaaauccgaccacuaauu

SEQ ID NO: 48519 - RNA, 19 nt, Homo sapiens
aaagucacauugccauuaa

SEQ ID NO: 48520 - RNA, 19 nt, Homo sapiens
ggauaugucuaauggguau

SEQ ID NO: 48521 - RNA, 19 nt, Homo sapiens
gcacuuuguuuguguuguu

SEQ ID NO: 48522 - RNA, 19 nt, Homo sapiens
gaauaaagucacagaauca

SEQ ID NO: 48523 - RNA, 19 nt, Homo sapiens
guacucuguucaauguuua

SEQ ID NO: 48524 - RNA, 19 nt, Homo sapiens
uagauucgcuuuccauguu

SEQ ID NO: 48525 - RNA, 19 nt, Homo sapiens
caucaaaacuccugucuuu

SEQ ID NO: 48526 - RNA, 19 nt, Homo sapiens
ucagugauguuccaugaaa

SEQ ID NO: 48527 - RNA, 19 nt, Homo sapiens
uaauaugcauugucaguga

SEQ ID NO: 48528 - RNA, 19 nt, Homo sapiens
gcaacacuguacacauaaa

SEQ ID NO: 48529 - RNA, 19 nt, Homo sapiens
ggacaaucaugaaauaugc

SEQ ID NO: 48530 - RNA, 19 nt, Homo sapiens
caaacaagacgccaacauu

SEQ ID NO: 48531 - RNA, 19 nt, Homo sapiens
gucccucgcugcacaaaua

SEQ ID NO: 48532 - RNA, 19 nt, Homo sapiens
gaaaugcaguggugcuuac

SEQ ID NO: 48533 - RNA, 19 nt, Homo sapiens
gcugcaggcuguuuaagaa

SEQ ID NO: 48534 - RNA, 19 nt, Homo sapiens
gggagauagugaugaagua

SEQ ID NO: 48535 - RNA, 19 nt, Homo sapiens
cagagaaccaucccuauuu

SEQ ID NO: 48536 - RNA, 19 nt, Homo sapiens
gcaaaugaccagcagauuc

SEQ ID NO: 48537 - RNA, 19 nt, Homo sapiens
gcucagaauuccacuguca

SEQ ID NO: 48538 - RNA, 19 nt, Homo sapiens
gcaccucaauuuaguucaa

SEQ ID NO: 48539 - RNA, 19 nt, Homo sapiens
ccacugaggagcuuuguuu

SEQ ID NO: 48540 - RNA, 19 nt, Homo sapiens
uaagacauguaucacugua

SEQ ID NO: 48541 - RNA, 19 nt, Homo sapiens
gcccuuaaaucauaggaaa

SEQ ID NO: 48542 - RNA, 19 nt, Homo sapiens
cacuaaagcaguagaaaua

SEQ ID NO: 48543 - RNA, 19 nt, Homo sapiens
ggcuuaagauuuggaauaa

SEQ ID NO: 48544 - RNA, 19 nt, Homo sapiens
ggaaaccugugguaugaag

SEQ ID NO: 48545 - RNA, 19 nt, Homo sapiens
gaggugucauggauuaauu

SEQ ID NO: 48546 - RNA, 19 nt, Homo sapiens
ggagaacaggguacgauaa

SEQ ID NO: 48547 - RNA, 19 nt, Homo sapiens
aaauaagacuguaguguag

SEQ ID NO: 48548 - RNA, 19 nt, Homo sapiens
caaaugaccagcagauuca

SEQ ID NO: 48549 - RNA, 19 nt, Homo sapiens
ggaauguacucuguucaau

SEQ ID NO: 48550 - RNA, 19 nt, Homo sapiens
ggucagaguuaaauagagu

SEQ ID NO: 48551 - RNA, 19 nt, Homo sapiens
ucaaagugaugaauaugga

SEQ ID NO: 48552 - RNA, 19 nt, Homo sapiens
uuuaagagguggcugauau

SEQ ID NO: 48553 - RNA, 19 nt, Homo sapiens
gaaaggcucgcucaaucaa

SEQ ID NO: 48554 - RNA, 19 nt, Homo sapiens
gauaauacaaguccuuuag

SEQ ID NO: 48555 - RNA, 19 nt, Homo sapiens
aaacgggauucacagagua

SEQ ID NO: 48556 - RNA, 19 nt, Homo sapiens
ggagucaguuugcaguaug

SEQ ID NO: 48557 - RNA, 19 nt, Homo sapiens
ggaauaacucuguggcauu

SEQ ID NO: 48558 - RNA, 19 nt, Homo sapiens
gauguucugugccuguaaa

SEQ ID NO: 48559 - RNA, 19 nt, Homo sapiens
cgaaauacaagccauucua

SEQ ID NO: 48560 - RNA, 19 nt, Homo sapiens
gcaagagaggccagaauga

SEQ ID NO: 48561 - RNA, 19 nt, Homo sapiens
caagguagaauuugcaaga

SEQ ID NO: 48562 - RNA, 19 nt, Homo sapiens
ggagagugauaauacaagu

SEQ ID NO: 48563 - RNA, 19 nt, Homo sapiens
guagggacaucuguuucua

SEQ ID NO: 48564 - RNA, 19 nt, Homo sapiens
ggaaaggcucgaaauacaa

SEQ ID NO: 48565 - RNA, 19 nt, Homo sapiens
uauggugguuugaccuuua

SEQ ID NO: 48566 - RNA, 19 nt, Homo sapiens
gcaguguggucuccgaaug

SEQ ID NO: 48567 - RNA, 19 nt, Homo sapiens
ggaaaggcucgcucaauca

SEQ ID NO: 48568 - RNA, 19 nt, Homo sapiens
caaacgggauucacagagu

SEQ ID NO: 48569 - RNA, 19 nt, Homo sapiens
cuuaagcccugauugugua

SEQ ID NO: 48570 - RNA, 19 nt, Homo sapiens
gagaagguguucauucacu

SEQ ID NO: 48571 - RNA, 19 nt, Homo sapiens
uaagcaaugugaaacugaa

SEQ ID NO: 48572 - RNA, 19 nt, Homo sapiens
agauguggccuuccauuua

SEQ ID NO: 48573 - RNA, 19 nt, Homo sapiens
aaauccagauggcaaauga

SEQ ID NO: 48574 - RNA, 19 nt, Homo sapiens
guuauggccuauacacuau

SEQ ID NO: 48575 - RNA, 19 nt, Homo sapiens
agugaggugucauggauua

SEQ ID NO: 48576 - RNA, 19 nt, Homo sapiens
uuccuugucugucuaguua

SEQ ID NO: 48577 - RNA, 19 nt, Homo sapiens
ccauuaaacuuuccuuguc

SEQ ID NO: 48578 - RNA, 19 nt, Homo sapiens
cuuggacaaucaugaaaua

SEQ ID NO: 48579 - RNA, 19 nt, Homo sapiens
gcaaagcacauccaauaaa

SEQ ID NO: 48580 - RNA, 19 nt, Homo sapiens
gauuauaacuccucuucuu

SEQ ID NO: 48581 - RNA, 19 nt, Homo sapiens
gggagauagugaugaagua

SEQ ID NO: 48582 - RNA, 19 nt, Homo sapiens
caaagcacauccaauaaaa

SEQ ID NO: 48583 - RNA, 19 nt, Homo sapiens
uaacuccucuucuuucucu

SEQ ID NO: 48584 - RNA, 19 nt, Homo sapiens
augcaaagcacauccaaua

SEQ ID NO: 48585 - RNA, 19 nt, Homo sapiens
gaaguacauccauuauaag

SEQ ID NO: 48586 - RNA, 19 nt, Homo sapiens
guacgacaaccgggagaua

SEQ ID NO: 48587 - RNA, 19 nt, Homo sapiens
ggaggauuguggccuucuu

SEQ ID NO: 48588 - RNA, 19 nt, Homo sapiens
ggauuguggccuucuuuga

SEQ ID NO: 48589 - RNA, 19 nt, Homo sapiens
gaggauuguggccuucuuu

SEQ ID NO: 48590 - RNA, 19 nt, Homo sapiens
ccaauaaaauagcuggauu

SEQ ID NO: 48591 - RNA, 19 nt, Homo sapiens
cgaaauaaaaucagaguug

SEQ ID NO: 48592 - RNA, 19 nt, Homo sapiens
uauaacuccucuucuuucu

SEQ ID NO: 48593 - RNA, 19 nt, Homo sapiens
gaaugcaaagcacauccaa

SEQ ID NO: 48594 - RNA, 19 nt, Homo sapiens
agauagugaugaaguacau

SEQ ID NO: 48595 - RNA, 19 nt, Homo sapiens
uaacggaggcuggguaggu

SEQ ID NO: 48596 - RNA, 19 nt, Homo sapiens
cccuguggaugacugagua

SEQ ID NO: 48597 - RNA, 19 nt, Homo sapiens
gauuguggccuucuuugag

SEQ ID NO: 48598 - RNA, 19 nt, Homo sapiens
ugcaaagcacauccaauaa

SEQ ID NO: 48599 - RNA, 19 nt, Homo sapiens
gacaaccgggagauaguga

SEQ ID NO: 48600 - RNA, 19 nt, Homo sapiens
cgagugggaugcgggagau

SEQ ID NO: 48601 - RNA, 19 nt, Homo sapiens
gagauagugaugaaguaca

SEQ ID NO: 48602 - RNA, 19 nt, Homo sapiens
ccaagaaugcaaagcacau

SEQ ID NO: 48603 - RNA, 19 nt, Homo sapiens
ggagauagugaugaaguac

SEQ ID NO: 48604 - RNA, 19 nt, Homo sapiens
caaccgggagauagugaug

SEQ ID NO: 48605 - RNA, 19 nt, Homo sapiens
uuauaacuccucuucuuuc

SEQ ID NO: 48606 - RNA, 19 nt, Homo sapiens
ggaaggauauuauaaagug

SEQ ID NO: 48607 - RNA, 19 nt, Homo sapiens
gaaaggacacuccauauug

SEQ ID NO: 48608 - RNA, 19 nt, Homo sapiens
ggaaagaucugugaaaugc

SEQ ID NO: 48609 - RNA, 19 nt, Homo sapiens
gggaagaauuguaaccaua

SEQ ID NO: 48610 - RNA, 19 nt, Homo sapiens
guaaagaaguuugaaccua

SEQ ID NO: 48611 - RNA, 19 nt, Homo sapiens
caacacauacuucuacuuu

SEQ ID NO: 48612 - RNA, 19 nt, Homo sapiens
gcaauacuguugaccagaa

SEQ ID NO: 48613 - RNA, 19 nt, Homo sapiens
ggaggaaggauauuauaaa

SEQ ID NO: 48614 - RNA, 19 nt, Homo sapiens
gaaagugacuagggaggaa

SEQ ID NO: 48615 - RNA, 19 nt, Homo sapiens
gaggaaggauauuauaaag

SEQ ID NO: 48616 - RNA, 19 nt, Homo sapiens
aaagaucugugaaaugcua

SEQ ID NO: 48617 - RNA, 19 nt, Homo sapiens
uaacacaggagaauggaua

SEQ ID NO: 48618 - RNA, 19 nt, Homo sapiens
gaagguauucucaucaaga

SEQ ID NO: 48619 - RNA, 19 nt, Homo sapiens
caucaugugucauaacuca

SEQ ID NO: 48620 - RNA, 19 nt, Homo sapiens
ccagaaaggacacuccaua

SEQ ID NO: 48621 - RNA, 19 nt, Homo sapiens
gcagugcguccuacagaua

SEQ ID NO: 48622 - RNA, 19 nt, Homo sapiens
caacuuugaugauguaacu

SEQ ID NO: 48623 - RNA, 19 nt, Homo sapiens
ggaagaauuguaaccauau

SEQ ID NO: 48624 - RNA, 19 nt, Homo sapiens
aaaggacacuccauauugu

SEQ ID NO: 48625 - RNA, 19 nt, Homo sapiens
ugacugauauggaaacgau

SEQ ID NO: 48626 - RNA, 19 nt, Homo sapiens
ccuauaaggagauuucaua

SEQ ID NO: 48627 - RNA, 19 nt, Homo sapiens
gaaauuuuguccccaugua

SEQ ID NO: 48628 - RNA, 19 nt, Homo sapiens
caggaaagaucugugaaau

SEQ ID NO: 48629 - RNA, 19 nt, Homo sapiens
ggaaacgauugccaacaca

SEQ ID NO: 48630 - RNA, 19 nt, Homo sapiens
gaauaacacaggagaaugg

SEQ ID NO: 48631 - RNA, 19 nt, Homo sapiens
gggaggaaggauauuauaa

SEQ ID NO: 48632 - RNA, 19 nt, Homo sapiens
gaacacuauucaaccaagu

SEQ ID NO: 48633 - RNA, 19 nt, Homo sapiens
uaucucuccugaagcaaua

SEQ ID NO: 48634 - RNA, 19 nt, Homo sapiens
guaaccauauuugcauuug

SEQ ID NO: 48635 - RNA, 19 nt, Homo sapiens
gaagacggcaucauuaacu

SEQ ID NO: 48636 - RNA, 19 nt, Homo sapiens
aaaagaaucugaagucaug

SEQ ID NO: 48637 - RNA, 19 nt, Homo sapiens
gaaguuacaggaaagaucu

SEQ ID NO: 48638 - RNA, 19 nt, Homo sapiens
ugugaaaccggccuaauuu

SEQ ID NO: 48639 - RNA, 19 nt, Homo sapiens
auaaagugaugcaaacaga

SEQ ID NO: 48640 - RNA, 19 nt, Homo sapiens
agaaaggacacuccauauu

SEQ ID NO: 48641 - RNA, 19 nt, Homo sapiens
caauacuguugaccagaaa

SEQ ID NO: 48642 - RNA, 19 nt, Homo sapiens
ccagaacacuauucaacca

SEQ ID NO: 48643 - RNA, 19 nt, Homo sapiens
gacacuccauauugugaaa

SEQ ID NO: 48644 - RNA, 19 nt, Homo sapiens
ggagaauggauaaggcaaa

SEQ ID NO: 48645 - RNA, 19 nt, Homo sapiens
ggauguggauaccuauaag

SEQ ID NO: 48646 - RNA, 19 nt, Homo sapiens
gacugugaauuuggauaua

SEQ ID NO: 48647 - RNA, 19 nt, Homo sapiens
aaacgauugccaacacaua

SEQ ID NO: 48648 - RNA, 19 nt, Homo sapiens
gaaguuugaaccuaaaucu

SEQ ID NO: 48649 - RNA, 19 nt, Homo sapiens
uaacuugaccuuccagagu

SEQ ID NO: 48650 - RNA, 19 nt, Homo sapiens
ugacuagggaggaaggaua

SEQ ID NO: 48651 - RNA, 19 nt, Homo sapiens
aaagugaugcaaacagaaa

SEQ ID NO: 48652 - RNA, 19 nt, Homo sapiens
cagaaaggacacuccauau

SEQ ID NO: 48653 - RNA, 19 nt, Homo sapiens
uguaucaucaugugucaua

SEQ ID NO: 48654 - RNA, 19 nt, Homo sapiens
ggaaaagaaucugaaguca

SEQ ID NO: 48655 - RNA, 19 nt, Homo sapiens
cacauugccucaacagcuu

SEQ ID NO: 48656 - RNA, 19 nt, Homo sapiens
aaaucuggcuggaugacuu

SEQ ID NO: 48657 - RNA, 19 nt, Homo sapiens
ggauaccuauaaggagauu

SEQ ID NO: 48658 - RNA, 19 nt, Homo sapiens
aaacuucuacgacagcaaa

SEQ ID NO: 48659 - RNA, 19 nt, Homo sapiens
cguagacacugccagaaca

SEQ ID NO: 48660 - RNA, 19 nt, Homo sapiens
ggacacuccauauugugaa

SEQ ID NO: 48661 - RNA, 19 nt, Homo sapiens
cuagggaggaaggauauua

SEQ ID NO: 48662 - RNA, 19 nt, Homo sapiens
gagaauggauaaggcaaaa

SEQ ID NO: 48663 - RNA, 19 nt, Homo sapiens
ccaccagccuccauguauc

SEQ ID NO: 48664 - RNA, 19 nt, Homo sapiens
gaagucaugcuuggacaau

SEQ ID NO: 48665 - RNA, 19 nt, Homo sapiens
ccagaguuauggaaauuuu

SEQ ID NO: 48666 - RNA, 19 nt, Homo sapiens
gauguaacuugaccuucca

SEQ ID NO: 48667 - RNA, 19 nt, Homo sapiens
cagccuccauguaucauca

SEQ ID NO: 48668 - RNA, 19 nt, Homo sapiens
uuugaagacggcaucauua

SEQ ID NO: 48669 - RNA, 19 nt, Homo sapiens
guuugaagacggcaucauu

SEQ ID NO: 48670 - RNA, 19 nt, Homo sapiens
gaugauguaacuugaccuu

SEQ ID NO: 48671 - RNA, 19 nt, Homo sapiens
uaaagugaugcaaacagaa

SEQ ID NO: 48672 - RNA, 19 nt, Homo sapiens
gcauuugaagguauucuca

SEQ ID NO: 48673 - RNA, 19 nt, Homo sapiens
caggcuggcucaggacuau

SEQ ID NO: 48674 - RNA, 19 nt, Homo sapiens
cggauguggauaccuauaa

SEQ ID NO: 48675 - RNA, 19 nt, Homo sapiens
uugaagacggcaucauuaa

SEQ ID NO: 48676 - RNA, 19 nt, Homo sapiens
agucaugcuuggacaaugu

SEQ ID NO: 48677 - RNA, 19 nt, Homo sapiens
ccagagugcuacaaaaugu

SEQ ID NO: 48678 - RNA, 19 nt, Homo sapiens
gaaacgauugccaacacau

SEQ ID NO: 48679 - RNA, 19 nt, Homo sapiens
guaucaucaugugucauaa

SEQ ID NO: 48680 - RNA, 19 nt, Homo sapiens
aaugcuaucucuccugaag

SEQ ID NO: 48681 - RNA, 19 nt, Homo sapiens
ucugugaaaugcuaucucu

SEQ ID NO: 48682 - RNA, 19 nt, Homo sapiens
ucuagaaguuacaggaaag

SEQ ID NO: 48683 - RNA, 19 nt, Homo sapiens
gacacugccagaacacuau

SEQ ID NO: 48684 - RNA, 19 nt, Homo sapiens
cuuggacaauguuaauguu

SEQ ID NO: 48685 - RNA, 19 nt, Homo sapiens
ccaggcagaagaugacaga

SEQ ID NO: 48686 - RNA, 19 nt, Homo sapiens
gacuagggaggaaggauau

SEQ ID NO: 48687 - RNA, 19 nt, Homo sapiens
gagcauucucagcacauug

SEQ ID NO: 48688 - RNA, 19 nt, Homo sapiens
uuaauguuguguccguaga

SEQ ID NO: 48689 - RNA, 19 nt, Homo sapiens
gcuuggacaauguuaaugu

SEQ ID NO: 48690 - RNA, 19 nt, Homo sapiens
acuugaccuuccagaguua

SEQ ID NO: 48691 - RNA, 19 nt, Homo sapiens
cauauuugcauuugaaggu

SEQ ID NO: 48692 - RNA, 19 nt, Homo sapiens
uggaaacgauugccaacac

SEQ ID NO: 48693 - RNA, 19 nt, Homo sapiens
agacugugaauuuggauau

SEQ ID NO: 48694 - RNA, 19 nt, Homo sapiens
ugaagguauucucaucaag

SEQ ID NO: 48695 - RNA, 19 nt, Homo sapiens
agacacugccagaacacua

SEQ ID NO: 48696 - RNA, 19 nt, Homo sapiens
gaaaagaaucugaagucau

SEQ ID NO: 48697 - RNA, 19 nt, Homo sapiens
cuucuacgacagcaaauug

SEQ ID NO: 48698 - RNA, 19 nt, Homo sapiens
ugaauaacacaggagaaug

SEQ ID NO: 48699 - RNA, 19 nt, Homo sapiens
gaauuguaaccauauuugc

SEQ ID NO: 48700 - RNA, 19 nt, Homo sapiens
gauaccacaaccuggauca

SEQ ID NO: 48701 - RNA, 19 nt, Homo sapiens
ucaaccaagugauggaaaa

SEQ ID NO: 48702 - RNA, 19 nt, Homo sapiens
cuggaugacuuuucuagaa

SEQ ID NO: 48703 - RNA, 19 nt, Homo sapiens
uagggaggaaggauauuau

SEQ ID NO: 48704 - RNA, 19 nt, Homo sapiens
uucuagaaguuacaggaaa

SEQ ID NO: 48705 - RNA, 19 nt, Homo sapiens
gggaaaauggcuuuguaaa

SEQ ID NO: 48706 - RNA, 19 nt, Homo sapiens
ccagggagcuugaaaguuu

SEQ ID NO: 48707 - RNA, 19 nt, Homo sapiens
aaagugcaguucaguaaua

SEQ ID NO: 48708 - RNA, 19 nt, Homo sapiens
gagaaucacuaaccagaga

SEQ ID NO: 48709 - RNA, 19 nt, Homo sapiens
gagacuagauugccuuugu

SEQ ID NO: 48710 - RNA, 19 nt, Homo sapiens
ggaaaugaccagacacuga

SEQ ID NO: 48711 - RNA, 19 nt, Homo sapiens
ggauacagcuggagucagu

SEQ ID NO: 48712 - RNA, 19 nt, Homo sapiens
gagcccaucccuauuauaa

SEQ ID NO: 48713 - RNA, 19 nt, Homo sapiens
ggagggcccuaccugauug

SEQ ID NO: 48714 - RNA, 19 nt, Homo sapiens
gaaagggagcuaucaggaa

SEQ ID NO: 48715 - RNA, 19 nt, Homo sapiens
caacugggcccaagacaga

SEQ ID NO: 48716 - RNA, 19 nt, Homo sapiens
gaauuuaucacacuucugu

SEQ ID NO: 48717 - RNA, 19 nt, Homo sapiens
gcucucugcuguacauauu

SEQ ID NO: 48718 - RNA, 19 nt, Homo sapiens
ccuacaagcuuucccagaa

SEQ ID NO: 48719 - RNA, 19 nt, Homo sapiens
aaaggaggcuggcagguau

SEQ ID NO: 48720 - RNA, 19 nt, Homo sapiens
ggaggcaggcgacgaguuu

SEQ ID NO: 48721 - RNA, 19 nt, Homo sapiens
ccagaaaggagacuagauu

SEQ ID NO: 48722 - RNA, 19 nt, Homo sapiens
caaaggaggcuggcaggua

SEQ ID NO: 48723 - RNA, 19 nt, Homo sapiens
guugagcccaucccuauua

SEQ ID NO: 48724 - RNA, 19 nt, Homo sapiens
guccaaauguccuccagaa

SEQ ID NO: 48725 - RNA, 19 nt, Homo sapiens
aagcgugucuguauuuaug

SEQ ID NO: 48726 - RNA, 19 nt, Homo sapiens
ggagucaguuuagugaugu

SEQ ID NO: 48727 - RNA, 19 nt, Homo sapiens
guuaagcgugucuguauuu

SEQ ID NO: 48728 - RNA, 19 nt, Homo sapiens
gaaagugcaguucaguaau

SEQ ID NO: 48729 - RNA, 19 nt, Homo sapiens
guacauauuugagacuagu

SEQ ID NO: 48730 - RNA, 19 nt, Homo sapiens
ggguagggcugacuagaag

SEQ ID NO: 48731 - RNA, 19 nt, Homo sapiens
ggccucagcugccucacuu

SEQ ID NO: 48732 - RNA, 19 nt, Homo sapiens
gcuuugaacaggauacuuu

SEQ ID NO: 48733 - RNA, 19 nt, Homo sapiens
gacagcauaucagagcuuu

SEQ ID NO: 48734 - RNA, 19 nt, Homo sapiens
uuagugauguggaagagaa

SEQ ID NO: 48735 - RNA, 19 nt, Homo sapiens
uuaagcgugucuguauuua

SEQ ID NO: 48736 - RNA, 19 nt, Homo sapiens
gugcaacccuuaccccuua

SEQ ID NO: 48737 - RNA, 19 nt, Homo sapiens
ggaacucuaugggaacaau

SEQ ID NO: 48738 - RNA, 19 nt, Homo sapiens
gagauuggacggccugaug

SEQ ID NO: 48739 - RNA, 19 nt, Homo sapiens
ugaaauagucugugugaag

SEQ ID NO: 48740 - RNA, 19 nt, Homo sapiens
ggacugaaucggagaugga

SEQ ID NO: 48741 - RNA, 19 nt, Homo sapiens
ucagcugccucacuuccua

SEQ ID NO: 48742 - RNA, 19 nt, Homo sapiens
cagcauaucagagcuuuga

SEQ ID NO: 48743 - RNA, 19 nt, Homo sapiens
uaucuuggcuuuggaucuu

SEQ ID NO: 48744 - RNA, 19 nt, Homo sapiens
gcccaucccuauuauaaaa

SEQ ID NO: 48745 - RNA, 19 nt, Homo sapiens
agacuagauugccuuuguu

SEQ ID NO: 48746 - RNA, 19 nt, Homo sapiens
ccucagaauugaucauuuu

SEQ ID NO: 48747 - RNA, 19 nt, Homo sapiens
guuuguggccucagaauug

SEQ ID NO: 48748 - RNA, 19 nt, Homo sapiens
agaaucuuaucuuggcuuu

SEQ ID NO: 48749 - RNA, 19 nt, Homo sapiens
aaucuuaucuuggcuuugg

SEQ ID NO: 48750 - RNA, 19 nt, Homo sapiens
cagaaaggagacuagauug

SEQ ID NO: 48751 - RNA, 19 nt, Homo sapiens
ucaguuuagugauguggaa

SEQ ID NO: 48752 - RNA, 19 nt, Homo sapiens
gcuggagucaguuuaguga

SEQ ID NO: 48753 - RNA, 19 nt, Homo sapiens
ggagcuggugguugacuuu

SEQ ID NO: 48754 - RNA, 19 nt, Homo sapiens
ggacagcauaucagagcuu

SEQ ID NO: 48755 - RNA, 19 nt, Homo sapiens
gccucagaauugaucauuu

SEQ ID NO: 48756 - RNA, 19 nt, Homo sapiens
gacuagauugccuuuguuu

SEQ ID NO: 48757 - RNA, 19 nt, Homo sapiens
uggagucaguuuagugaug

SEQ ID NO: 48758 - RNA, 19 nt, Homo sapiens
agaagagaaucacuaacca

SEQ ID NO: 48759 - RNA, 19 nt, Homo sapiens
guuccagcucuuugaaaua

SEQ ID NO: 48760 - RNA, 19 nt, Homo sapiens
ucucugcuguacauauuug

SEQ ID NO: 48761 - RNA, 19 nt, Homo sapiens
gcaggaagggcaggaagga

SEQ ID NO: 48762 - RNA, 19 nt, Homo sapiens
acacugaccauccacucua

SEQ ID NO: 48763 - RNA, 19 nt, Homo sapiens
cugcugggcucacucuuca

SEQ ID NO: 48764 - RNA, 19 nt, Homo sapiens
ucagagcuuugaacaggau

SEQ ID NO: 48765 - RNA, 19 nt, Homo sapiens
gagcagguguuuuggacaa

SEQ ID NO: 48766 - RNA, 19 nt, Homo sapiens
uuccugagcuucgcaauuc

SEQ ID NO: 48767 - RNA, 19 nt, Homo sapiens
ucaggcugcuugggauaaa

SEQ ID NO: 48768 - RNA, 19 nt, Homo sapiens
aagugcaguucaguaauaa

SEQ ID NO: 48769 - RNA, 19 nt, Homo sapiens
gaggcuggcagguauggaa

SEQ ID NO: 48770 - RNA, 19 nt, Homo sapiens
gaaggugaaagugcaguuc

SEQ ID NO: 48771 - RNA, 19 nt, Homo sapiens
ggguggcccuugcaguuca

SEQ ID NO: 48772 - RNA, 19 nt, Homo sapiens
ccagggacagcauaucaga

SEQ ID NO: 48773 - RNA, 19 nt, Homo sapiens
accgggagcuggugguuga

SEQ ID NO: 48774 - RNA, 19 nt, Homo sapiens
ggaagcaccccaugccaaa

SEQ ID NO: 48775 - RNA, 19 nt, Homo sapiens
cacaaaaucuguccaaagg

SEQ ID NO: 48776 - RNA, 19 nt, Homo sapiens
acucuucagucggaaauga

SEQ ID NO: 48777 - RNA, 19 nt, Homo sapiens
ugucuguauuuauguguga

SEQ ID NO: 48778 - RNA, 19 nt, Homo sapiens
ggaccaacugggcccaaga

SEQ ID NO: 48779 - RNA, 19 nt, Homo sapiens
agucggaaaugaccagaca

SEQ ID NO: 48780 - RNA, 19 nt, Homo sapiens
gggagcuggugguugacuu

SEQ ID NO: 48781 - RNA, 19 nt, Homo sapiens
uguuaagcgugucuguauu

SEQ ID NO: 48782 - RNA, 19 nt, Homo sapiens
ccaggagaaccacuacaug

SEQ ID NO: 48783 - RNA, 19 nt, Homo sapiens
gagccgaaagggccaggaa

SEQ ID NO: 48784 - RNA, 19 nt, Homo sapiens
cauaucagagcuuugaaca

SEQ ID NO: 48785 - RNA, 19 nt, Homo sapiens
ccagcucuuugaaauaguc

SEQ ID NO: 48786 - RNA, 19 nt, Homo sapiens
uguuccagcucuuugaaau

SEQ ID NO: 48787 - RNA, 19 nt, Homo sapiens
gagcuggugcccggagauu

SEQ ID NO: 48788 - RNA, 19 nt, Homo sapiens
ucccuuggccucagaauuc

SEQ ID NO: 48789 - RNA, 19 nt, Homo sapiens
uuccagcucuuugaaauag

SEQ ID NO: 48790 - RNA, 19 nt, Homo sapiens
gaacucuaugggaacaaug

SEQ ID NO: 48791 - RNA, 19 nt, Homo sapiens
cauggcagcaguaaagcaa

SEQ ID NO: 48792 - RNA, 19 nt, Homo sapiens
ggccacagcagcaguuugg

SEQ ID NO: 48793 - RNA, 19 nt, Homo sapiens
uggaagagaacaggacuga

SEQ ID NO: 48794 - RNA, 19 nt, Homo sapiens
ccuucagaaucuuaucuug

SEQ ID NO: 48795 - RNA, 19 nt, Homo sapiens
cagaaccucuuccccagaa

SEQ ID NO: 48796 - RNA, 19 nt, Homo sapiens
cagagacgagacucaguga

SEQ ID NO: 48797 - RNA, 19 nt, Homo sapiens
uagauugccuuuguuuuga

SEQ ID NO: 48798 - RNA, 19 nt, Homo sapiens
ccacagcagcaguuuggau

SEQ ID NO: 48799 - RNA, 19 nt, Homo sapiens
ugguugacuuucucuccua

SEQ ID NO: 48800 - RNA, 19 nt, Homo sapiens
gcgugucuguauuuaugug

SEQ ID NO: 48801 - RNA, 19 nt, Homo sapiens
gccauugccaccaggagaa

SEQ ID NO: 48802 - RNA, 19 nt, Homo sapiens
guggaacucuaugggaaca

SEQ ID NO: 48803 - RNA, 19 nt, Homo sapiens
gcuggugguugacuuucuc

SEQ ID NO: 48804 - RNA, 19 nt, Homo sapiens
cagcuggagucaguuuagu

SEQ ID NO: 48805 - RNA, 19 nt, Homo sapiens
uuugaaauagucuguguga

SEQ ID NO: 48806 - RNA, 19 nt, Homo sapiens
ccagggagcuugaaaguuu

SEQ ID NO: 48807 - RNA, 19 nt, Homo sapiens
cagcuuggauggccacuua

SEQ ID NO: 48808 - RNA, 19 nt, Homo sapiens
aaagugcaguucaguaaua

SEQ ID NO: 48809 - RNA, 19 nt, Homo sapiens
gagaaucacuaaccagaga

SEQ ID NO: 48810 - RNA, 19 nt, Homo sapiens
gagacuagauugccuuugu

SEQ ID NO: 48811 - RNA, 19 nt, Homo sapiens
ggaaaugaccagacacuga

SEQ ID NO: 48812 - RNA, 19 nt, Homo sapiens
ggauacagcuggagucagu

SEQ ID NO: 48813 - RNA, 19 nt, Homo sapiens
gagcccaucccuauuauaa

SEQ ID NO: 48814 - RNA, 19 nt, Homo sapiens
acaaggagaugcagguauu

SEQ ID NO: 48815 - RNA, 19 nt, Homo sapiens
ggagggcccuaccugauug

SEQ ID NO: 48816 - RNA, 19 nt, Homo sapiens
gaaagggagcuaucaggaa

SEQ ID NO: 48817 - RNA, 19 nt, Homo sapiens
caacugggcccaagacaga

SEQ ID NO: 48818 - RNA, 19 nt, Homo sapiens
gaauuuaucacacuucugu

SEQ ID NO: 48819 - RNA, 19 nt, Homo sapiens
gcucucugcuguacauauu

SEQ ID NO: 48820 - RNA, 19 nt, Homo sapiens
ccuacaagcuuucccagaa

SEQ ID NO: 48821 - RNA, 19 nt, Homo sapiens
aaaggaggcuggcagguau

SEQ ID NO: 48822 - RNA, 19 nt, Homo sapiens
ggaggcaggcgacgaguuu

SEQ ID NO: 48823 - RNA, 19 nt, Homo sapiens
ccagaaaggagacuagauu

SEQ ID NO: 48824 - RNA, 19 nt, Homo sapiens
gguagugaaugaacucuuc

SEQ ID NO: 48825 - RNA, 19 nt, Homo sapiens
caaaggaggcuggcaggua

SEQ ID NO: 48826 - RNA, 19 nt, Homo sapiens
guugagcccaucccuauua

SEQ ID NO: 48827 - RNA, 19 nt, Homo sapiens
ucagagcuuugaacaggua

SEQ ID NO: 48828 - RNA, 19 nt, Homo sapiens
guccaaauguccuccagaa

SEQ ID NO: 48829 - RNA, 19 nt, Homo sapiens
gauggccacuuaccugaau

SEQ ID NO: 48830 - RNA, 19 nt, Homo sapiens
aagcgugucuguauuuaug

SEQ ID NO: 48831 - RNA, 19 nt, Homo sapiens
ggagucaguuuagugaugu

SEQ ID NO: 48832 - RNA, 19 nt, Homo sapiens
guuaagcgugucuguauuu

SEQ ID NO: 48833 - RNA, 19 nt, Homo sapiens
gaaagugcaguucaguaau

SEQ ID NO: 48834 - RNA, 19 nt, Homo sapiens
guacauauuugagacuagu

SEQ ID NO: 48835 - RNA, 19 nt, Homo sapiens
ggguagggcugacuagaag

SEQ ID NO: 48836 - RNA, 19 nt, Homo sapiens
ggccucagcugccucacuu

SEQ ID NO: 48837 - RNA, 19 nt, Homo sapiens
uugaacagguagugaauga

SEQ ID NO: 48838 - RNA, 19 nt, Homo sapiens
gacagcauaucagagcuuu

SEQ ID NO: 48839 - RNA, 19 nt, Homo sapiens
uuagugauguggaagagaa

SEQ ID NO: 48840 - RNA, 19 nt, Homo sapiens
uuaagcgugucuguauuua

SEQ ID NO: 48841 - RNA, 19 nt, Homo sapiens
gugcaacccuuaccccuua

SEQ ID NO: 48842 - RNA, 19 nt, Homo sapiens
ggaacucuaugggaacaau

SEQ ID NO: 48843 - RNA, 19 nt, Homo sapiens
gaacagguagugaaugaac

SEQ ID NO: 48844 - RNA, 19 nt, Homo sapiens
gagauuggacggccugaug

SEQ ID NO: 48845 - RNA, 19 nt, Homo sapiens
ugaaauagucugugugaag

SEQ ID NO: 48846 - RNA, 19 nt, Homo sapiens
ggacugaaucggagaugga

SEQ ID NO: 48847 - RNA, 19 nt, Homo sapiens
ucagcugccucacuuccua

SEQ ID NO: 48848 - RNA, 19 nt, Homo sapiens
cagcauaucagagcuuuga

SEQ ID NO: 48849 - RNA, 19 nt, Homo sapiens
uaucuuggcuuuggaucuu

SEQ ID NO: 48850 - RNA, 19 nt, Homo sapiens
gcccaucccuauuauaaaa

SEQ ID NO: 48851 - RNA, 19 nt, Homo sapiens
agacuagauugccuuuguu

SEQ ID NO: 48852 - RNA, 19 nt, Homo sapiens
ccucagaauugaucauuuu

SEQ ID NO: 48853 - RNA, 19 nt, Homo sapiens
guuuguggccucagaauug

SEQ ID NO: 48854 - RNA, 19 nt, Homo sapiens
agaaucuuaucuuggcuuu

SEQ ID NO: 48855 - RNA, 19 nt, Homo sapiens
aaucuuaucuuggcuuugg

SEQ ID NO: 48856 - RNA, 19 nt, Homo sapiens
cagaaaggagacuagauug

SEQ ID NO: 48857 - RNA, 19 nt, Homo sapiens
ucaguuuagugauguggaa

SEQ ID NO: 48858 - RNA, 19 nt, Homo sapiens
gcuggagucaguuuaguga

SEQ ID NO: 48859 - RNA, 19 nt, Homo sapiens
ggagcuggugguugacuuu

SEQ ID NO: 48860 - RNA, 19 nt, Homo sapiens
uuaccugaaugaccaccua

SEQ ID NO: 48861 - RNA, 19 nt, Homo sapiens
ggacagcauaucagagcuu

SEQ ID NO: 48862 - RNA, 19 nt, Homo sapiens
gccucagaauugaucauuu

SEQ ID NO: 48863 - RNA, 19 nt, Homo sapiens
gacuagauugccuuuguuu

SEQ ID NO: 48864 - RNA, 19 nt, Homo sapiens
uggagucaguuuagugaug

SEQ ID NO: 48865 - RNA, 19 nt, Homo sapiens
agaagagaaucacuaacca

SEQ ID NO: 48866 - RNA, 19 nt, Homo sapiens
guuccagcucuuugaaaua

SEQ ID NO: 48867 - RNA, 19 nt, Homo sapiens
ucucugcuguacauauuug

SEQ ID NO: 48868 - RNA, 19 nt, Homo sapiens
gcaggaagggcaggaagga

SEQ ID NO: 48869 - RNA, 19 nt, Homo sapiens
acacugaccauccacucua

SEQ ID NO: 48870 - RNA, 19 nt, Homo sapiens
cugcugggcucacucuuca

SEQ ID NO: 48871 - RNA, 19 nt, Homo sapiens
gagcagguguuuuggacaa

SEQ ID NO: 48872 - RNA, 19 nt, Homo sapiens
uuccugagcuucgcaauuc

SEQ ID NO: 48873 - RNA, 19 nt, Homo sapiens
ucaggcugcuugggauaaa

SEQ ID NO: 48874 - RNA, 19 nt, Homo sapiens
aagugcaguucaguaauaa

SEQ ID NO: 48875 - RNA, 19 nt, Homo sapiens
gaggcuggcagguauggaa

SEQ ID NO: 48876 - RNA, 19 nt, Homo sapiens
uggaaagcguagacaagga

SEQ ID NO: 48877 - RNA, 19 nt, Homo sapiens
gaaggugaaagugcaguuc

SEQ ID NO: 48878 - RNA, 19 nt, Homo sapiens
ggguggcccuugcaguuca

SEQ ID NO: 48879 - RNA, 19 nt, Homo sapiens
ccagggacagcauaucaga

SEQ ID NO: 48880 - RNA, 19 nt, Homo sapiens
accgggagcuggugguuga

SEQ ID NO: 48881 - RNA, 19 nt, Homo sapiens
ggaagcaccccaugccaaa

SEQ ID NO: 48882 - RNA, 19 nt, Homo sapiens
cacaaaaucuguccaaagg

SEQ ID NO: 48883 - RNA, 19 nt, Homo sapiens
acucuucagucggaaauga

SEQ ID NO: 48884 - RNA, 19 nt, Homo sapiens
gacaaggagaugcagguau

SEQ ID NO: 48885 - RNA, 19 nt, Homo sapiens
ugucuguauuuauguguga

SEQ ID NO: 48886 - RNA, 19 nt, Homo sapiens
ggaccaacugggcccaaga

SEQ ID NO: 48887 - RNA, 19 nt, Homo sapiens
agucggaaaugaccagaca

SEQ ID NO: 48888 - RNA, 19 nt, Homo sapiens
gggagcuggugguugacuu

SEQ ID NO: 48889 - RNA, 19 nt, Homo sapiens
uguuaagcgugucuguauu

SEQ ID NO: 48890 - RNA, 19 nt, Homo sapiens
ccaggagaaccacuacaug

SEQ ID NO: 48891 - RNA, 19 nt, Homo sapiens
gagccgaaagggccaggaa

SEQ ID NO: 48892 - RNA, 19 nt, Homo sapiens
cauaucagagcuuugaaca

SEQ ID NO: 48893 - RNA, 19 nt, Homo sapiens
ccagcucuuugaaauaguc

SEQ ID NO: 48894 - RNA, 19 nt, Homo sapiens
uguuccagcucuuugaaau

SEQ ID NO: 48895 - RNA, 19 nt, Homo sapiens
gagcuggugcccggagauu

SEQ ID NO: 48896 - RNA, 19 nt, Homo sapiens
ucccuuggccucagaauuc

SEQ ID NO: 48897 - RNA, 19 nt, Homo sapiens
ggauggccacuuaccugaa

SEQ ID NO: 48898 - RNA, 19 nt, Homo sapiens
gcuuugaacagguagugaa

SEQ ID NO: 48899 - RNA, 19 nt, Homo sapiens
uuccagcucuuugaaauag

SEQ ID NO: 48900 - RNA, 19 nt, Homo sapiens
gaacucuaugggaacaaug

SEQ ID NO: 48901 - RNA, 19 nt, Homo sapiens
cauggcagcaguaaagcaa

SEQ ID NO: 48902 - RNA, 19 nt, Homo sapiens
ggccacagcagcaguuugg

SEQ ID NO: 48903 - RNA, 19 nt, Homo sapiens
uggaagagaacaggacuga

SEQ ID NO: 48904 - RNA, 19 nt, Homo sapiens
ccuucagaaucuuaucuug

SEQ ID NO: 48905 - RNA, 19 nt, Homo sapiens
cagagacgagacucaguga

SEQ ID NO: 48906 - RNA, 19 nt, Homo sapiens
gaacagauuugguuaguuu

SEQ ID NO: 48907 - RNA, 19 nt, Homo sapiens
gcauauggguucuagagua

SEQ ID NO: 48908 - RNA, 19 nt, Homo sapiens
uagaacagcuucagauuau

SEQ ID NO: 48909 - RNA, 19 nt, Homo sapiens
gagaaaggguaguguguga

SEQ ID NO: 48910 - RNA, 19 nt, Homo sapiens
cauaagugcugaucuagaa

SEQ ID NO: 48911 - RNA, 19 nt, Homo sapiens
gggcauaagugcugaucua

SEQ ID NO: 48912 - RNA, 19 nt, Homo sapiens
guagcugucuuacauauug

SEQ ID NO: 48913 - RNA, 19 nt, Homo sapiens
gcacaucccuuuggaaugg

SEQ ID NO: 48914 - RNA, 19 nt, Homo sapiens
ggacacauaucccuguuag

SEQ ID NO: 48915 - RNA, 19 nt, Homo sapiens
gaaaugcccuuggaagaag

SEQ ID NO: 48916 - RNA, 19 nt, Homo sapiens
gcaacucgguccugcgauu

SEQ ID NO: 48917 - RNA, 19 nt, Homo sapiens
uaaauaaagcccagaaguu

SEQ ID NO: 48918 - RNA, 19 nt, Homo sapiens
ugaguaugguucccaauuu

SEQ ID NO: 48919 - RNA, 19 nt, Homo sapiens
uaagauugcugcucuccaa

SEQ ID NO: 48920 - RNA, 19 nt, Homo sapiens
guuauaagcugaggcagaa

SEQ ID NO: 48921 - RNA, 19 nt, Homo sapiens
aagcagcuguauuccauua

SEQ ID NO: 48922 - RNA, 19 nt, Homo sapiens
uggcagacuuuguagguua

SEQ ID NO: 48923 - RNA, 19 nt, Homo sapiens
aaauaaagcccagaaguuu

SEQ ID NO: 48924 - RNA, 19 nt, Homo sapiens
gaccaucggcuccaaauug

SEQ ID NO: 48925 - RNA, 19 nt, Homo sapiens
ccuagaauguggcaacgua

SEQ ID NO: 48926 - RNA, 19 nt, Homo sapiens
gcucuccaaugcuaacuuu

SEQ ID NO: 48927 - RNA, 19 nt, Homo sapiens
gagaaaacauucccucuug

SEQ ID NO: 48928 - RNA, 19 nt, Homo sapiens
gagaaaugcccuuggaaga

SEQ ID NO: 48929 - RNA, 19 nt, Homo sapiens
gaacagaacagagaaaugc

SEQ ID NO: 48930 - RNA, 19 nt, Homo sapiens
caaauuggccucagguguu

SEQ ID NO: 48931 - RNA, 19 nt, Homo sapiens
ggaagguggacuuacauaa

SEQ ID NO: 48932 - RNA, 19 nt, Homo sapiens
cuagaacagcuucagauua

SEQ ID NO: 48933 - RNA, 19 nt, Homo sapiens
gcagcuguauuccauuaga

SEQ ID NO: 48934 - RNA, 19 nt, Homo sapiens
ccagugcugugucuuaaga

SEQ ID NO: 48935 - RNA, 19 nt, Homo sapiens
ccuagaagcauuuaugauu

SEQ ID NO: 48936 - RNA, 19 nt, Homo sapiens
cacaggagauguagucguu

SEQ ID NO: 48937 - RNA, 19 nt, Homo sapiens
caagaaggcugaguauggu

SEQ ID NO: 48938 - RNA, 19 nt, Homo sapiens
ugagcaggcugggcaauuu

SEQ ID NO: 48939 - RNA, 19 nt, Homo sapiens
ccucaaggcuuagagagaa

SEQ ID NO: 48940 - RNA, 19 nt, Homo sapiens
ggagggaucacgccuauag

SEQ ID NO: 48941 - RNA, 19 nt, Homo sapiens
gcacacaaacacuauuuua

SEQ ID NO: 48942 - RNA, 19 nt, Homo sapiens
gauguuaacuuuggaacuc

SEQ ID NO: 48943 - RNA, 19 nt, Homo sapiens
cagaacagcuccccuugua

SEQ ID NO: 48944 - RNA, 19 nt, Homo sapiens
ugaggaagguggacuuaca

SEQ ID NO: 48945 - RNA, 19 nt, Homo sapiens
ggaacaggaugggcagaga

SEQ ID NO: 48946 - RNA, 19 nt, Homo sapiens
ccaagaaggcugaguaugg

SEQ ID NO: 48947 - RNA, 19 nt, Homo sapiens
acauaucccuguuagcauu

SEQ ID NO: 48948 - RNA, 19 nt, Homo sapiens
gcagagcccugaaguuucc

SEQ ID NO: 48949 - RNA, 19 nt, Homo sapiens
gaaauuauucacuccagau

SEQ ID NO: 48950 - RNA, 19 nt, Homo sapiens
gggcuuugguucggcuuua

SEQ ID NO: 48951 - RNA, 19 nt, Homo sapiens
gagaugaccauuucagauc

SEQ ID NO: 48952 - RNA, 19 nt, Homo sapiens
ucacccaggucuccgauga

SEQ ID NO: 48953 - RNA, 19 nt, Homo sapiens
gaacagcuucagauuaugg

SEQ ID NO: 48954 - RNA, 19 nt, Homo sapiens
ggacuggccuaugcugugu

SEQ ID NO: 48955 - RNA, 19 nt, Homo sapiens
gcaaggcuuuggagagaag

SEQ ID NO: 48956 - RNA, 19 nt, Homo sapiens
gaacaggaugggcagagaa

SEQ ID NO: 48957 - RNA, 19 nt, Homo sapiens
ccaccagugcugugucuua

SEQ ID NO: 48958 - RNA, 19 nt, Homo sapiens
cuggauggguggaggcuua

SEQ ID NO: 48959 - RNA, 19 nt, Homo sapiens
agggagagguggcuguuaa

SEQ ID NO: 48960 - RNA, 19 nt, Homo sapiens
gagcugaguaggccaggua

SEQ ID NO: 48961 - RNA, 19 nt, Homo sapiens
caaggaaggagcggaagua

SEQ ID NO: 48962 - RNA, 19 nt, Homo sapiens
gagcccaaagggacaaaua

SEQ ID NO: 48963 - RNA, 19 nt, Homo sapiens
uaagugcugaucuagaaua

SEQ ID NO: 48964 - RNA, 19 nt, Homo sapiens
acagagaaaugcccuugga

SEQ ID NO: 48965 - RNA, 19 nt, Homo sapiens
uggcagagcccugaaguuu

SEQ ID NO: 48966 - RNA, 19 nt, Homo sapiens
ccuaaaguguuuccaaucu

SEQ ID NO: 48967 - RNA, 19 nt, Homo sapiens
caggagagcaggaacagaa

SEQ ID NO: 48968 - RNA, 19 nt, Homo sapiens
gggcacacaaacacuauuu

SEQ ID NO: 48969 - RNA, 19 nt, Homo sapiens
uaaaguguuuccaaucucu

SEQ ID NO: 48970 - RNA, 19 nt, Homo sapiens
aauggugccuaaaguguuu

SEQ ID NO: 48971 - RNA, 19 nt, Homo sapiens
caccagugcugugucuuaa

SEQ ID NO: 48972 - RNA, 19 nt, Homo sapiens
cagaacagauuugguuagu

SEQ ID NO: 48973 - RNA, 19 nt, Homo sapiens
ggaacucgcaguccucuag

SEQ ID NO: 48974 - RNA, 19 nt, Homo sapiens
gaccuagaagcauuuauga

SEQ ID NO: 48975 - RNA, 19 nt, Homo sapiens
ugacucuucuuggagauuu

SEQ ID NO: 48976 - RNA, 19 nt, Homo sapiens
gccuugagaugaccauuuc

SEQ ID NO: 48977 - RNA, 19 nt, Homo sapiens
uacccaaacugaaacucua

SEQ ID NO: 48978 - RNA, 19 nt, Homo sapiens
uggcaaggcuuuggagaga

SEQ ID NO: 48979 - RNA, 19 nt, Homo sapiens
caacucgguccugcgauua

SEQ ID NO: 48980 - RNA, 19 nt, Homo sapiens
caaauuggagucugugcuu

SEQ ID NO: 48981 - RNA, 19 nt, Homo sapiens
gucugaggauguuaacuuu

SEQ ID NO: 48982 - RNA, 19 nt, Homo sapiens
ggaguucacagcucuauac

SEQ ID NO: 48983 - RNA, 19 nt, Homo sapiens
uuuccaaggugcuaagauu

SEQ ID NO: 48984 - RNA, 19 nt, Homo sapiens
gcauggguguuacuugucu

SEQ ID NO: 48985 - RNA, 19 nt, Homo sapiens
ccuuuggaauggaagcuua

SEQ ID NO: 48986 - RNA, 19 nt, Homo sapiens
auaagcagcuguauuccau

SEQ ID NO: 48987 - RNA, 19 nt, Homo sapiens
ggaacagaacagagaaaug

SEQ ID NO: 48988 - RNA, 19 nt, Homo sapiens
gaccaugguugacucuucu

SEQ ID NO: 48989 - RNA, 19 nt, Homo sapiens
cggcagaacagauuugguu

SEQ ID NO: 48990 - RNA, 19 nt, Homo sapiens
gaguaugguucccaauuuu

SEQ ID NO: 48991 - RNA, 19 nt, Homo sapiens
uaccuaccaugaccuagaa

SEQ ID NO: 48992 - RNA, 19 nt, Homo sapiens
cauauggguucuagaguac

SEQ ID NO: 48993 - RNA, 19 nt, Homo sapiens
gugcugaucuagaauacag

SEQ ID NO: 48994 - RNA, 19 nt, Homo sapiens
gcauaagugcugaucuaga

SEQ ID NO: 48995 - RNA, 19 nt, Homo sapiens
ggaauguuuuggcaaguuu

SEQ ID NO: 48996 - RNA, 19 nt, Homo sapiens
agaaaugcccuuggaagaa

SEQ ID NO: 48997 - RNA, 19 nt, Homo sapiens
cagauuugguuaguuuaga

SEQ ID NO: 48998 - RNA, 19 nt, Homo sapiens
uaaagggcuuggucuggau

SEQ ID NO: 48999 - RNA, 19 nt, Homo sapiens
gggcucugcugcuucuuuc

SEQ ID NO: 49000 - RNA, 19 nt, Homo sapiens
ucacagcccugaggaaggu

SEQ ID NO: 49001 - RNA, 19 nt, Homo sapiens
ggcagaacagauuugguua

SEQ ID NO: 49002 - RNA, 19 nt, Homo sapiens
ugagagagggcugcacuuu

SEQ ID NO: 49003 - RNA, 19 nt, Homo sapiens
aaauuggccucagguguug

SEQ ID NO: 49004 - RNA, 19 nt, Homo sapiens
guaccuaccaugaccuaga

SEQ ID NO: 49005 - RNA, 19 nt, Homo sapiens
gcaggaacagaacagagaa

SEQ ID NO: 49006 - RNA, 19 nt, Homo sapiens
gcacaugcaccuacccaua

SEQ ID NO: 49007 - RNA, 19 nt, Homo sapiens
gcacggaucacgauguaaa

SEQ ID NO: 49008 - RNA, 19 nt, Homo sapiens
gggcacggaucacgaugua

SEQ ID NO: 49009 - RNA, 19 nt, Homo sapiens
ggaucacgauguaaauuau

SEQ ID NO: 49010 - RNA, 19 nt, Homo sapiens
gaacaccgagugccaagaa

SEQ ID NO: 49011 - RNA, 19 nt, Homo sapiens
gagccuuacugccuuugua

SEQ ID NO: 49012 - RNA, 19 nt, Homo sapiens
ccacccacaucuuccauuu

SEQ ID NO: 49013 - RNA, 19 nt, Homo sapiens
gccgggagcucgacaucua

SEQ ID NO: 49014 - RNA, 19 nt, Homo sapiens
agacacgccucuccauauu

SEQ ID NO: 49015 - RNA, 19 nt, Homo sapiens
ggaccaggauuugcacaga

SEQ ID NO: 49016 - RNA, 19 nt, Homo sapiens
ggucaacccuucuggaaac

SEQ ID NO: 49017 - RNA, 19 nt, Homo sapiens
gaccaggauuugcacagaa

SEQ ID NO: 49018 - RNA, 19 nt, Homo sapiens
cggaucacgauguaaauua

SEQ ID NO: 49019 - RNA, 19 nt, Homo sapiens
ccauggcuccucccaauuu

SEQ ID NO: 49020 - RNA, 19 nt, Homo sapiens
ggccggaggcgcuuuacua

SEQ ID NO: 49021 - RNA, 19 nt, Homo sapiens
gcagaucuuggacucauga

SEQ ID NO: 49022 - RNA, 19 nt, Homo sapiens
cgacaucuacaacaaccua

SEQ ID NO: 49023 - RNA, 19 nt, Homo sapiens
ggaaugccacccacaucuu

SEQ ID NO: 49024 - RNA, 19 nt, Homo sapiens
gggcagaucuuggacucau

SEQ ID NO: 49025 - RNA, 19 nt, Homo sapiens
gaaugccacccacaucuuc

SEQ ID NO: 49026 - RNA, 19 nt, Homo sapiens
caacccuucuggaaacugu

SEQ ID NO: 49027 - RNA, 19 nt, Homo sapiens
caucuuccauuuccauguc

SEQ ID NO: 49028 - RNA, 19 nt, Homo sapiens
gaaaacaacagccuuagca

SEQ ID NO: 49029 - RNA, 19 nt, Homo sapiens
caacgugaacgcgcaaaug

SEQ ID NO: 49030 - RNA, 19 nt, Homo sapiens
ucgacgcaguggacauuaa

SEQ ID NO: 49031 - RNA, 19 nt, Homo sapiens
cccaauuucuuccuuccuu

SEQ ID NO: 49032 - RNA, 19 nt, Homo sapiens
gacagcagccucaagaacu

SEQ ID NO: 49033 - RNA, 19 nt, Homo sapiens
gguuggauuucuuuuguaa

SEQ ID NO: 49034 - RNA, 19 nt, Homo sapiens
uccacucucuaccagauaa

SEQ ID NO: 49035 - RNA, 19 nt, Homo sapiens
uggaaacugugaagaucug

SEQ ID NO: 49036 - RNA, 19 nt, Homo sapiens
ccgugcagcucuugcuaga

SEQ ID NO: 49037 - RNA, 19 nt, Homo sapiens
caucgacgcaguggacauu

SEQ ID NO: 49038 - RNA, 19 nt, Homo sapiens
ccuccacucucuaccagau

SEQ ID NO: 49039 - RNA, 19 nt, Homo sapiens
ucuggaaacugugaagauc

SEQ ID NO: 49040 - RNA, 19 nt, Homo sapiens
acagcagccucaagaacug

SEQ ID NO: 49041 - RNA, 19 nt, Homo sapiens
gagcucgacaucuacaaca

SEQ ID NO: 49042 - RNA, 19 nt, Homo sapiens
caacgacacgccgcucaug

SEQ ID NO: 49043 - RNA, 19 nt, Homo sapiens
acacgccucuccauauugc

SEQ ID NO: 49044 - RNA, 19 nt, Homo sapiens
gacacgccucuccauauug

SEQ ID NO: 49045 - RNA, 19 nt, Homo sapiens
cauggcuccucccaauuuc

SEQ ID NO: 49046 - RNA, 19 nt, Homo sapiens
ccacaucuuccauuuccau

SEQ ID NO: 49047 - RNA, 19 nt, Homo sapiens
uugcuguggugcaggguaa

SEQ ID NO: 49048 - RNA, 19 nt, Homo sapiens
ccggagccuuacugccuuu

SEQ ID NO: 49049 - RNA, 19 nt, Homo sapiens
gaauugagcucuguugauu

SEQ ID NO: 49050 - RNA, 19 nt, Homo sapiens
gagagaagcccuacaaaug

SEQ ID NO: 49051 - RNA, 19 nt, Homo sapiens
gaagaggcacgaagugaua

SEQ ID NO: 49052 - RNA, 19 nt, Homo sapiens
gaucugagaaucuuuauug

SEQ ID NO: 49053 - RNA, 19 nt, Homo sapiens
uggcagaguuguaaauaua

SEQ ID NO: 49054 - RNA, 19 nt, Homo sapiens
gcaguggccuguucuauag

SEQ ID NO: 49055 - RNA, 19 nt, Homo sapiens
aaccaaaggugaaggaaua

SEQ ID NO: 49056 - RNA, 19 nt, Homo sapiens
gagagaaaccuuaccauug

SEQ ID NO: 49057 - RNA, 19 nt, Homo sapiens
agacaagacuucaguaugu

SEQ ID NO: 49058 - RNA, 19 nt, Homo sapiens
aaagagcacuuaagagaau

SEQ ID NO: 49059 - RNA, 19 nt, Homo sapiens
gaaagagcacuuaagagaa

SEQ ID NO: 49060 - RNA, 19 nt, Homo sapiens
agagaaaccuuaccauugu

SEQ ID NO: 49061 - RNA, 19 nt, Homo sapiens
gagaacaaccugccacuga

SEQ ID NO: 49062 - RNA, 19 nt, Homo sapiens
ggagagaaaccuuaccauu

SEQ ID NO: 49063 - RNA, 19 nt, Homo sapiens
guacacaucucggcucaau

SEQ ID NO: 49064 - RNA, 19 nt, Homo sapiens
ugagcucuguugauucuua

SEQ ID NO: 49065 - RNA, 19 nt, Homo sapiens
agaaagagcacuuaagaga

SEQ ID NO: 49066 - RNA, 19 nt, Homo sapiens
ccacaccgccagccucuua

SEQ ID NO: 49067 - RNA, 19 nt, Homo sapiens
ugacaaacccuacaagugu

SEQ ID NO: 49068 - RNA, 19 nt, Homo sapiens
cugagaaucuuuauugaga

SEQ ID NO: 49069 - RNA, 19 nt, Homo sapiens
ggagagaagcccuacaaau

SEQ ID NO: 49070 - RNA, 19 nt, Homo sapiens
gcugaagcauggaguguug

SEQ ID NO: 49071 - RNA, 19 nt, Homo sapiens
acacaucucggcucaauuu

SEQ ID NO: 49072 - RNA, 19 nt, Homo sapiens
caucaagccuccucgugaa

SEQ ID NO: 49073 - RNA, 19 nt, Homo sapiens
gagaaacccuaucguugca

SEQ ID NO: 49074 - RNA, 19 nt, Homo sapiens
ugacaaggccagcaaagaa

SEQ ID NO: 49075 - RNA, 19 nt, Homo sapiens
caagugaagguuuacaauu

SEQ ID NO: 49076 - RNA, 19 nt, Homo sapiens
ugagaaagagcacuuaaga

SEQ ID NO: 49077 - RNA, 19 nt, Homo sapiens
ggugaaccaugucagcaaa

SEQ ID NO: 49078 - RNA, 19 nt, Homo sapiens
gcgucaugcuuguguuaua

SEQ ID NO: 49079 - RNA, 19 nt, Homo sapiens
caaaggugaaggaauauau

SEQ ID NO: 49080 - RNA, 19 nt, Homo sapiens
gacaagacuucaguauguu

SEQ ID NO: 49081 - RNA, 19 nt, Homo sapiens
ucaacagccucaaccagaa

SEQ ID NO: 49082 - RNA, 19 nt, Homo sapiens
uuacagaccaguugaaaug

SEQ ID NO: 49083 - RNA, 19 nt, Homo sapiens
uaaacucucuuugggaaug

SEQ ID NO: 49084 - RNA, 19 nt, Homo sapiens
gucgagacaucuugacuga

SEQ ID NO: 49085 - RNA, 19 nt, Homo sapiens
cgucaugcuuguguuauaa

SEQ ID NO: 49086 - RNA, 19 nt, Homo sapiens
ucacggaaguuuucaauga

SEQ ID NO: 49087 - RNA, 19 nt, Homo sapiens
aggaauauauggcagaguu

SEQ ID NO: 49088 - RNA, 19 nt, Homo sapiens
cagcaaagaagaagagaga

SEQ ID NO: 49089 - RNA, 19 nt, Homo sapiens
gauguucuucucaaccuua

SEQ ID NO: 49090 - RNA, 19 nt, Homo sapiens
cauggaguguugaugcuuu

SEQ ID NO: 49091 - RNA, 19 nt, Homo sapiens
gaagaaauacaaguucauc

SEQ ID NO: 49092 - RNA, 19 nt, Homo sapiens
gcaacuggaagaaauacaa

SEQ ID NO: 49093 - RNA, 19 nt, Homo sapiens
ccagugauguucuucucaa

SEQ ID NO: 49094 - RNA, 19 nt, Homo sapiens
uagaaguggugaugcaaga

SEQ ID NO: 49095 - RNA, 19 nt, Homo sapiens
cauauugcuucuucuccua

SEQ ID NO: 49096 - RNA, 19 nt, Homo sapiens
ugacagcuguauccaguuc

SEQ ID NO: 49097 - RNA, 19 nt, Homo sapiens
gcaagugaagguuuacaau

SEQ ID NO: 49098 - RNA, 19 nt, Homo sapiens
gaaccggaaccuccaaauc

SEQ ID NO: 49099 - RNA, 19 nt, Homo sapiens
ccacugccauaaaacauua

SEQ ID NO: 49100 - RNA, 19 nt, Homo sapiens
gagaaaccuuaccauugug

SEQ ID NO: 49101 - RNA, 19 nt, Homo sapiens
acacggaucugagaaucuu

SEQ ID NO: 49102 - RNA, 19 nt, Homo sapiens
gaagcaaggcauuggugaa

SEQ ID NO: 49103 - RNA, 19 nt, Homo sapiens
aaaggauacuguaacacuu

SEQ ID NO: 49104 - RNA, 19 nt, Homo sapiens
acacaggagagaaaccuua

SEQ ID NO: 49105 - RNA, 19 nt, Homo sapiens
ggugagaaacccuaucguu

SEQ ID NO: 49106 - RNA, 19 nt, Homo sapiens
gagcgugcaccaucccuuu

SEQ ID NO: 49107 - RNA, 19 nt, Homo sapiens
caaggaaacaaucccagaa

SEQ ID NO: 49108 - RNA, 19 nt, Homo sapiens
gugaagaguuccucaacag

SEQ ID NO: 49109 - RNA, 19 nt, Homo sapiens
gcagauggagcauguugug

SEQ ID NO: 49110 - RNA, 19 nt, Homo sapiens
gagaauugagcucuguuga

SEQ ID NO: 49111 - RNA, 19 nt, Homo sapiens
guuaaaggcucgauuuugu

SEQ ID NO: 49112 - RNA, 19 nt, Homo sapiens
uguguaaggugaaccaugu

SEQ ID NO: 49113 - RNA, 19 nt, Homo sapiens
caaaggauacuguaacacu

SEQ ID NO: 49114 - RNA, 19 nt, Homo sapiens
gagacgcucugcuuaugag

SEQ ID NO: 49115 - RNA, 19 nt, Homo sapiens
gaagcccuaucccugugaa

SEQ ID NO: 49116 - RNA, 19 nt, Homo sapiens
cuauguaccugcagaugga

SEQ ID NO: 49117 - RNA, 19 nt, Homo sapiens
gcaaggcauuggugaagac

SEQ ID NO: 49118 - RNA, 19 nt, Homo sapiens
ggguuuggcugugucuaaa

SEQ ID NO: 49119 - RNA, 19 nt, Homo sapiens
gcagacacagggacuugaa

SEQ ID NO: 49120 - RNA, 19 nt, Homo sapiens
aggauacuguaacacuuua

SEQ ID NO: 49121 - RNA, 19 nt, Homo sapiens
ggaaacaaucccagaagag

SEQ ID NO: 49122 - RNA, 19 nt, Homo sapiens
ucuauagcaucuuuacaga

SEQ ID NO: 49123 - RNA, 19 nt, Homo sapiens
uaaaaugccucaguguauu

SEQ ID NO: 49124 - RNA, 19 nt, Homo sapiens
gguaaaguccgaagcucaa

SEQ ID NO: 49125 - RNA, 19 nt, Homo sapiens
uggaagaaauacaaguuca

SEQ ID NO: 49126 - RNA, 19 nt, Homo sapiens
aggcauuggugaagacaaa

SEQ ID NO: 49127 - RNA, 19 nt, Homo sapiens
cuucuucuccuauguguaa

SEQ ID NO: 49128 - RNA, 19 nt, Homo sapiens
caaccagaaugccaaacca

SEQ ID NO: 49129 - RNA, 19 nt, Homo sapiens
aaaugcaaccuuaguguga

SEQ ID NO: 49130 - RNA, 19 nt, Homo sapiens
ccuguucuauagcaucuuu

SEQ ID NO: 49131 - RNA, 19 nt, Homo sapiens
guauauacccguacaacgu

SEQ ID NO: 49132 - RNA, 19 nt, Homo sapiens
gcaaaaugaggaauguaua

SEQ ID NO: 49133 - RNA, 19 nt, Homo sapiens
guucugacuugacuuuagu

SEQ ID NO: 49134 - RNA, 19 nt, Homo sapiens
gucgugaggugguggagaa

SEQ ID NO: 49135 - RNA, 19 nt, Homo sapiens
gaagcucaaauuccgagaa

SEQ ID NO: 49136 - RNA, 19 nt, Homo sapiens
ccgagacgcucugcuuaug

SEQ ID NO: 49137 - RNA, 19 nt, Homo sapiens
aggaaacaaucccagaaga

SEQ ID NO: 49138 - RNA, 19 nt, Homo sapiens
uucaguauguugucaaaga

SEQ ID NO: 49139 - RNA, 19 nt, Homo sapiens
cccaaaggauacuguaaca

SEQ ID NO: 49140 - RNA, 19 nt, Homo sapiens
gaaucuacccaaaggauac

SEQ ID NO: 49141 - RNA, 19 nt, Homo sapiens
gcagacccacagugacaaa

SEQ ID NO: 49142 - RNA, 19 nt, Homo sapiens
ccacucaccacucuacaug

SEQ ID NO: 49143 - RNA, 19 nt, Homo sapiens
gugaggugguggagaacaa

SEQ ID NO: 49144 - RNA, 19 nt, Homo sapiens
gauguugucauuguuguga

SEQ ID NO: 49145 - RNA, 19 nt, Homo sapiens
gcaucuguauaaguaagaa

SEQ ID NO: 49146 - RNA, 19 nt, Homo sapiens
aaagacaagacuucaguau

SEQ ID NO: 49147 - RNA, 19 nt, Homo sapiens
caugauguagugccucuuu

SEQ ID NO: 49148 - RNA, 19 nt, Homo sapiens
cugcggagccagauuugua

SEQ ID NO: 49149 - RNA, 19 nt, Homo sapiens
gagagaagcccuacaaaug

SEQ ID NO: 49150 - RNA, 19 nt, Homo sapiens
gaagaggcacgaagugaua

SEQ ID NO: 49151 - RNA, 19 nt, Homo sapiens
gaucugagaaucuuuauug

SEQ ID NO: 49152 - RNA, 19 nt, Homo sapiens
uggcagaguuguaaauaua

SEQ ID NO: 49153 - RNA, 19 nt, Homo sapiens
gcaguggccuguucuauag

SEQ ID NO: 49154 - RNA, 19 nt, Homo sapiens
aaccaaaggugaaggaaua

SEQ ID NO: 49155 - RNA, 19 nt, Homo sapiens
gagagaaaccuuaccauug

SEQ ID NO: 49156 - RNA, 19 nt, Homo sapiens
agacaagacuucaguaugu

SEQ ID NO: 49157 - RNA, 19 nt, Homo sapiens
aaagagcacuuaagagaau

SEQ ID NO: 49158 - RNA, 19 nt, Homo sapiens
gaaagagcacuuaagagaa

SEQ ID NO: 49159 - RNA, 19 nt, Homo sapiens
agagaaaccuuaccauugu

SEQ ID NO: 49160 - RNA, 19 nt, Homo sapiens
gagaacaaccugccacuga

SEQ ID NO: 49161 - RNA, 19 nt, Homo sapiens
ggagagaaaccuuaccauu

SEQ ID NO: 49162 - RNA, 19 nt, Homo sapiens
guacacaucucggcucaau

SEQ ID NO: 49163 - RNA, 19 nt, Homo sapiens
agaaagagcacuuaagaga

SEQ ID NO: 49164 - RNA, 19 nt, Homo sapiens
ccacaccgccagccucuua

SEQ ID NO: 49165 - RNA, 19 nt, Homo sapiens
ugacaaacccuacaagugu

SEQ ID NO: 49166 - RNA, 19 nt, Homo sapiens
ucaaggaaaccucucauuu

SEQ ID NO: 49167 - RNA, 19 nt, Homo sapiens
cugagaaucuuuauugaga

SEQ ID NO: 49168 - RNA, 19 nt, Homo sapiens
ggagagaagcccuacaaau

SEQ ID NO: 49169 - RNA, 19 nt, Homo sapiens
gcugaagcauggaguguug

SEQ ID NO: 49170 - RNA, 19 nt, Homo sapiens
acacaucucggcucaauuu

SEQ ID NO: 49171 - RNA, 19 nt, Homo sapiens
caucaagccuccucgugaa

SEQ ID NO: 49172 - RNA, 19 nt, Homo sapiens
ggaaaccucucauuuuaga

SEQ ID NO: 49173 - RNA, 19 nt, Homo sapiens
aaggaaaccucucauuuua

SEQ ID NO: 49174 - RNA, 19 nt, Homo sapiens
gagaaacccuaucguugca

SEQ ID NO: 49175 - RNA, 19 nt, Homo sapiens
ugacaaggccagcaaagaa

SEQ ID NO: 49176 - RNA, 19 nt, Homo sapiens
caagugaagguuuacaauu

SEQ ID NO: 49177 - RNA, 19 nt, Homo sapiens
ugagaaagagcacuuaaga

SEQ ID NO: 49178 - RNA, 19 nt, Homo sapiens
ggugaaccaugucagcaaa

SEQ ID NO: 49179 - RNA, 19 nt, Homo sapiens
gcgucaugcuuguguuaua

SEQ ID NO: 49180 - RNA, 19 nt, Homo sapiens
uuagagugcucauuugguu

SEQ ID NO: 49181 - RNA, 19 nt, Homo sapiens
gauagguucuuuugucuuu

SEQ ID NO: 49182 - RNA, 19 nt, Homo sapiens
caaaggugaaggaauauau

SEQ ID NO: 49183 - RNA, 19 nt, Homo sapiens
gacaagacuucaguauguu

SEQ ID NO: 49184 - RNA, 19 nt, Homo sapiens
ucaacagccucaaccagaa

SEQ ID NO: 49185 - RNA, 19 nt, Homo sapiens
uuacagaccaguugaaaug

SEQ ID NO: 49186 - RNA, 19 nt, Homo sapiens
uaaacucucuuugggaaug

SEQ ID NO: 49187 - RNA, 19 nt, Homo sapiens
gucgagacaucuugacuga

SEQ ID NO: 49188 - RNA, 19 nt, Homo sapiens
cgucaugcuuguguuauaa

SEQ ID NO: 49189 - RNA, 19 nt, Homo sapiens
ucacggaaguuuucaauga

SEQ ID NO: 49190 - RNA, 19 nt, Homo sapiens
aggaauauauggcagaguu

SEQ ID NO: 49191 - RNA, 19 nt, Homo sapiens
gagaaaauccuugaaguuu

SEQ ID NO: 49192 - RNA, 19 nt, Homo sapiens
cagcaaagaagaagagaga

SEQ ID NO: 49193 - RNA, 19 nt, Homo sapiens
gauguucuucucaaccuua

SEQ ID NO: 49194 - RNA, 19 nt, Homo sapiens
ggagauagguucuuuuguc

SEQ ID NO: 49195 - RNA, 19 nt, Homo sapiens
cauggaguguugaugcuuu

SEQ ID NO: 49196 - RNA, 19 nt, Homo sapiens
gaaggaagagaggaaaguu

SEQ ID NO: 49197 - RNA, 19 nt, Homo sapiens
gaagaaauacaaguucauc

SEQ ID NO: 49198 - RNA, 19 nt, Homo sapiens
gcaacuggaagaaauacaa

SEQ ID NO: 49199 - RNA, 19 nt, Homo sapiens
ccagugauguucuucucaa

SEQ ID NO: 49200 - RNA, 19 nt, Homo sapiens
guuagucuaucucucuuug

SEQ ID NO: 49201 - RNA, 19 nt, Homo sapiens
cauauugcuucuucuccua

SEQ ID NO: 49202 - RNA, 19 nt, Homo sapiens
ugacagcuguauccaguuc

SEQ ID NO: 49203 - RNA, 19 nt, Homo sapiens
gagaaaugucagaguguuu

SEQ ID NO: 49204 - RNA, 19 nt, Homo sapiens
gcacuugggaccacagaga

SEQ ID NO: 49205 - RNA, 19 nt, Homo sapiens
gcaagugaagguuuacaau

SEQ ID NO: 49206 - RNA, 19 nt, Homo sapiens
ccacugccauaaaacauua

SEQ ID NO: 49207 - RNA, 19 nt, Homo sapiens
gagaaaccuuaccauugug

SEQ ID NO: 49208 - RNA, 19 nt, Homo sapiens
caaggaaaccucucauuuu

SEQ ID NO: 49209 - RNA, 19 nt, Homo sapiens
acacggaucugagaaucuu

SEQ ID NO: 49210 - RNA, 19 nt, Homo sapiens
gaagcaaggcauuggugaa

SEQ ID NO: 49211 - RNA, 19 nt, Homo sapiens
gaaaauccuugaaguuugg

SEQ ID NO: 49212 - RNA, 19 nt, Homo sapiens
aaaggauacuguaacacuu

SEQ ID NO: 49213 - RNA, 19 nt, Homo sapiens
acacaggagagaaaccuua

SEQ ID NO: 49214 - RNA, 19 nt, Homo sapiens
ggugagaaacccuaucguu

SEQ ID NO: 49215 - RNA, 19 nt, Homo sapiens
gagcgugcaccaucccuuu

SEQ ID NO: 49216 - RNA, 19 nt, Homo sapiens
caaggaaacaaucccagaa

SEQ ID NO: 49217 - RNA, 19 nt, Homo sapiens
gugaagaguuccucaacag

SEQ ID NO: 49218 - RNA, 19 nt, Homo sapiens
gcagauggagcauguugug

SEQ ID NO: 49219 - RNA, 19 nt, Homo sapiens
guuaaaggcucgauuuugu

SEQ ID NO: 49220 - RNA, 19 nt, Homo sapiens
uguguaaggugaaccaugu

SEQ ID NO: 49221 - RNA, 19 nt, Homo sapiens
caaaggauacuguaacacu

SEQ ID NO: 49222 - RNA, 19 nt, Homo sapiens
gaagcccuaucccugugaa

SEQ ID NO: 49223 - RNA, 19 nt, Homo sapiens
cuauguaccugcagaugga

SEQ ID NO: 49224 - RNA, 19 nt, Homo sapiens
gcaaggcauuggugaagac

SEQ ID NO: 49225 - RNA, 19 nt, Homo sapiens
ccaugugucuucagcuuuc

SEQ ID NO: 49226 - RNA, 19 nt, Homo sapiens
ggguuuggcugugucuaaa

SEQ ID NO: 49227 - RNA, 19 nt, Homo sapiens
gcagacacagggacuugaa

SEQ ID NO: 49228 - RNA, 19 nt, Homo sapiens
aggauacuguaacacuuua

SEQ ID NO: 49229 - RNA, 19 nt, Homo sapiens
ggaaacaaucccagaagag

SEQ ID NO: 49230 - RNA, 19 nt, Homo sapiens
ucuauagcaucuuuacaga

SEQ ID NO: 49231 - RNA, 19 nt, Homo sapiens
cagaguguuugguuacaga

SEQ ID NO: 49232 - RNA, 19 nt, Homo sapiens
uaaaaugccucaguguauu

SEQ ID NO: 49233 - RNA, 19 nt, Homo sapiens
uggaagaaauacaaguuca

SEQ ID NO: 49234 - RNA, 19 nt, Homo sapiens
aggcauuggugaagacaaa

SEQ ID NO: 49235 - RNA, 19 nt, Homo sapiens
cuucuucuccuauguguaa

SEQ ID NO: 49236 - RNA, 19 nt, Homo sapiens
caaccagaaugccaaacca

SEQ ID NO: 49237 - RNA, 19 nt, Homo sapiens
aaaugcaaccuuaguguga

SEQ ID NO: 49238 - RNA, 19 nt, Homo sapiens
ccuguucuauagcaucuuu

SEQ ID NO: 49239 - RNA, 19 nt, Homo sapiens
guauauacccguacaacgu

SEQ ID NO: 49240 - RNA, 19 nt, Homo sapiens
gcaaaaugaggaauguaua

SEQ ID NO: 49241 - RNA, 19 nt, Homo sapiens
guucugacuugacuuuagu

SEQ ID NO: 49242 - RNA, 19 nt, Homo sapiens
gucgugaggugguggagaa

SEQ ID NO: 49243 - RNA, 19 nt, Homo sapiens
agagaaaugucagaguguu

SEQ ID NO: 49244 - RNA, 19 nt, Homo sapiens
aggaaacaaucccagaaga

SEQ ID NO: 49245 - RNA, 19 nt, Homo sapiens
gguuacagacucaaggaaa

SEQ ID NO: 49246 - RNA, 19 nt, Homo sapiens
uucaguauguugucaaaga

SEQ ID NO: 49247 - RNA, 19 nt, Homo sapiens
aggaggagauagguucuuu

SEQ ID NO: 49248 - RNA, 19 nt, Homo sapiens
cccaaaggauacuguaaca

SEQ ID NO: 49249 - RNA, 19 nt, Homo sapiens
gaacagaacuacuaacguu

SEQ ID NO: 49250 - RNA, 19 nt, Homo sapiens
gaagguacaucagcaauua

SEQ ID NO: 49251 - RNA, 19 nt, Homo sapiens
caagacagcugaaggagaa

SEQ ID NO: 49252 - RNA, 19 nt, Homo sapiens
caaaaugucuccugaaaua

SEQ ID NO: 49253 - RNA, 19 nt, Homo sapiens
gaagaacucugcugugaag

SEQ ID NO: 49254 - RNA, 19 nt, Homo sapiens
ggaagugucugcuggauuc

SEQ ID NO: 49255 - RNA, 19 nt, Homo sapiens
ccucagaccuuaaaccuuu

SEQ ID NO: 49256 - RNA, 19 nt, Homo sapiens
cuacuaacguuucaaguuu

SEQ ID NO: 49257 - RNA, 19 nt, Homo sapiens
uaagggauccugucuauuu

SEQ ID NO: 49258 - RNA, 19 nt, Homo sapiens
gaacagcucagagaaagua

SEQ ID NO: 49259 - RNA, 19 nt, Homo sapiens
ggaggaagagucccuguua

SEQ ID NO: 49260 - RNA, 19 nt, Homo sapiens
gcaauuaauucuagagcaa

SEQ ID NO: 49261 - RNA, 19 nt, Homo sapiens
gcaaaacacucaaaccuuu

SEQ ID NO: 49262 - RNA, 19 nt, Homo sapiens
ggacgucgcuuggauuuca

SEQ ID NO: 49263 - RNA, 19 nt, Homo sapiens
ggugagagaugaauuugga

SEQ ID NO: 49264 - RNA, 19 nt, Homo sapiens
gcaaaugggagaagaaaug

SEQ ID NO: 49265 - RNA, 19 nt, Homo sapiens
gugcaaagcccuuggaauu

SEQ ID NO: 49266 - RNA, 19 nt, Homo sapiens
guacuaaggucgagagucu

SEQ ID NO: 49267 - RNA, 19 nt, Homo sapiens
ggaaggcuguggaccgauu

SEQ ID NO: 49268 - RNA, 19 nt, Homo sapiens
gcaaagugcccucuugguu

SEQ ID NO: 49269 - RNA, 19 nt, Homo sapiens
gauaugguuuguacaaugu

SEQ ID NO: 49270 - RNA, 19 nt, Homo sapiens
ucaaauaccucaugcaaaa

SEQ ID NO: 49271 - RNA, 19 nt, Homo sapiens
caaagugcccucuugguuu

SEQ ID NO: 49272 - RNA, 19 nt, Homo sapiens
ggccaaagaugauaucaag

SEQ ID NO: 49273 - RNA, 19 nt, Homo sapiens
gcuaauuggugcauauuca

SEQ ID NO: 49274 - RNA, 19 nt, Homo sapiens
cguccuagcucgcauuuga

SEQ ID NO: 49275 - RNA, 19 nt, Homo sapiens
acacacacauccacagaaa

SEQ ID NO: 49276 - RNA, 19 nt, Homo sapiens
gaacuccucagaccuuaaa

SEQ ID NO: 49277 - RNA, 19 nt, Homo sapiens
gcaaagcccuuggaauuuu

SEQ ID NO: 49278 - RNA, 19 nt, Homo sapiens
ggacaugcaugacgauaac

SEQ ID NO: 49279 - RNA, 19 nt, Homo sapiens
caucagcaauuaauucuag

SEQ ID NO: 49280 - RNA, 19 nt, Homo sapiens
ccaaggcugucacuaguau

SEQ ID NO: 49281 - RNA, 19 nt, Homo sapiens
gcccaagguugaugacaaa

SEQ ID NO: 49282 - RNA, 19 nt, Homo sapiens
gcgcagaaccuaccugaug

SEQ ID NO: 49283 - RNA, 19 nt, Homo sapiens
gaauccacgugcuuuccua

SEQ ID NO: 49284 - RNA, 19 nt, Homo sapiens
ccgaagagauguagacgau

SEQ ID NO: 49285 - RNA, 19 nt, Homo sapiens
ugacggagcccaagguuga

SEQ ID NO: 49286 - RNA, 19 nt, Homo sapiens
aaagugcccucuugguuug

SEQ ID NO: 49287 - RNA, 19 nt, Homo sapiens
ggugaccucuggcauguau

SEQ ID NO: 49288 - RNA, 19 nt, Homo sapiens
guacaucagcaauuaauuc

SEQ ID NO: 49289 - RNA, 19 nt, Homo sapiens
gaaguuagcaaugccgaaa

SEQ ID NO: 49290 - RNA, 19 nt, Homo sapiens
caacaaaacuccgaagaga

SEQ ID NO: 49291 - RNA, 19 nt, Homo sapiens
guagauaugguuuguacaa

SEQ ID NO: 49292 - RNA, 19 nt, Homo sapiens
ucacuaguauuucucugaa

SEQ ID NO: 49293 - RNA, 19 nt, Homo sapiens
caaacaaggcgucgaggaa

SEQ ID NO: 49294 - RNA, 19 nt, Homo sapiens
gaugaacagcucagagaaa

SEQ ID NO: 49295 - RNA, 19 nt, Homo sapiens
ggaagguacaucagcaauu

SEQ ID NO: 49296 - RNA, 19 nt, Homo sapiens
ggugacacaucccuacgaa

SEQ ID NO: 49297 - RNA, 19 nt, Homo sapiens
aggaauggcuuaaggugaa

SEQ ID NO: 49298 - RNA, 19 nt, Homo sapiens
cugaagaacucugcuguga

SEQ ID NO: 49299 - RNA, 19 nt, Homo sapiens
cugguuugcucuuaauuaa

SEQ ID NO: 49300 - RNA, 19 nt, Homo sapiens
aggauuagcuggugcugaa

SEQ ID NO: 49301 - RNA, 19 nt, Homo sapiens
gaagagucccuguuacgau

SEQ ID NO: 49302 - RNA, 19 nt, Homo sapiens
gcgcgaugcccaacucuuu

SEQ ID NO: 49303 - RNA, 19 nt, Homo sapiens
gcagcgaaacuccaucuug

SEQ ID NO: 49304 - RNA, 19 nt, Homo sapiens
ggaauggcuuaaggugaaa

SEQ ID NO: 49305 - RNA, 19 nt, Homo sapiens
gaagccaggauuccauuug

SEQ ID NO: 49306 - RNA, 19 nt, Homo sapiens
agauguagacgaugcuuua

SEQ ID NO: 49307 - RNA, 19 nt, Homo sapiens
ucaagagacccgcaagaaa

SEQ ID NO: 49308 - RNA, 19 nt, Homo sapiens
cgaacugccuaaucguuug

SEQ ID NO: 49309 - RNA, 19 nt, Homo sapiens
gaacuacuaacguuucaag

SEQ ID NO: 49310 - RNA, 19 nt, Homo sapiens
cacagaaucuaagaccuuu

SEQ ID NO: 49311 - RNA, 19 nt, Homo sapiens
uagcaaugccgaaagguuu

SEQ ID NO: 49312 - RNA, 19 nt, Homo sapiens
uuuaagggauccugucuau

SEQ ID NO: 49313 - RNA, 19 nt, Homo sapiens
caagagacccgcaagaaac

SEQ ID NO: 49314 - RNA, 19 nt, Homo sapiens
gagggugaggcucuuauuu

SEQ ID NO: 49315 - RNA, 19 nt, Homo sapiens
ugaacuuucucucauagga

SEQ ID NO: 49316 - RNA, 19 nt, Homo sapiens
ucgaggaauuggaaagauu

SEQ ID NO: 49317 - RNA, 19 nt, Homo sapiens
gcugaacuuucucucauag

SEQ ID NO: 49318 - RNA, 19 nt, Homo sapiens
acacaucccuacgaaucua

SEQ ID NO: 49319 - RNA, 19 nt, Homo sapiens
ccuaaucguuugguucuga

SEQ ID NO: 49320 - RNA, 19 nt, Homo sapiens
cauaggacgucgcuuggau

SEQ ID NO: 49321 - RNA, 19 nt, Homo sapiens
gaaggagugccacccucua

SEQ ID NO: 49322 - RNA, 19 nt, Homo sapiens
agauaugguuuguacaaug

SEQ ID NO: 49323 - RNA, 19 nt, Homo sapiens
caguagauaugguuuguac

SEQ ID NO: 49324 - RNA, 19 nt, Homo sapiens
ccacagaaucuaagaccuu

SEQ ID NO: 49325 - RNA, 19 nt, Homo sapiens
gagagaugaauuuggauau

SEQ ID NO: 49326 - RNA, 19 nt, Homo sapiens
ggucauggguuuuguuguu

SEQ ID NO: 49327 - RNA, 19 nt, Homo sapiens
gugcugaacuuucucucau

SEQ ID NO: 49328 - RNA, 19 nt, Homo sapiens
uguagacgaugcuuuaaag

SEQ ID NO: 49329 - RNA, 19 nt, Homo sapiens
cuggaggccucucaacaaa

SEQ ID NO: 49330 - RNA, 19 nt, Homo sapiens
ugacacaucccuacgaauc

SEQ ID NO: 49331 - RNA, 19 nt, Homo sapiens
ccaaagaugauaucaagag

SEQ ID NO: 49332 - RNA, 19 nt, Homo sapiens
ugagagaugaauuuggaua

SEQ ID NO: 49333 - RNA, 19 nt, Homo sapiens
gaggaagagucccuguuac

SEQ ID NO: 49334 - RNA, 19 nt, Homo sapiens
gaaaggagagacgcaaucu

SEQ ID NO: 49335 - RNA, 19 nt, Homo sapiens
cgaggaauuggaaagauuu

SEQ ID NO: 49336 - RNA, 19 nt, Homo sapiens
ggaagagucccuguuacga

SEQ ID NO: 49337 - RNA, 19 nt, Homo sapiens
ccacuucucuauguaacga

SEQ ID NO: 49338 - RNA, 19 nt, Homo sapiens
cagauuccguagaguuaga

SEQ ID NO: 49339 - RNA, 19 nt, Homo sapiens
uaaagccuccgauaacugu

SEQ ID NO: 49340 - RNA, 19 nt, Homo sapiens
ugagaaaacucuuuaguac

SEQ ID NO: 49341 - RNA, 19 nt, Homo sapiens
ugaaggagaaugaaacaca

SEQ ID NO: 49342 - RNA, 19 nt, Homo sapiens
ggugcgaacagaacuacua

SEQ ID NO: 49343 - RNA, 19 nt, Homo sapiens
gaagucaggaauggcuuaa

SEQ ID NO: 49344 - RNA, 19 nt, Homo sapiens
gaagcugcggcuacacauu

SEQ ID NO: 49345 - RNA, 19 nt, Homo sapiens
ggauauuuauuuccuucuc

SEQ ID NO: 49346 - RNA, 19 nt, Homo sapiens
cccuuugaguuguguguua

SEQ ID NO: 49347 - RNA, 19 nt, Homo sapiens
gaggccugguuugcucuua

SEQ ID NO: 49348 - RNA, 19 nt, Homo sapiens
aacaaggcgucgaggaauu

SEQ ID NO: 49349 - RNA, 19 nt, Homo sapiens
gauaaacucugaaauggaa

SEQ ID NO: 49350 - RNA, 19 nt, Homo sapiens
caacacagcuccuccaguu

SEQ ID NO: 49351 - RNA, 19 nt, Homo sapiens
ggaaauaaaucuagcaaag

SEQ ID NO: 49352 - RNA, 19 nt, Homo sapiens
cuacugagauggccaauaa

SEQ ID NO: 49353 - RNA, 19 nt, Homo sapiens
gccagacgcugcaauauuu

SEQ ID NO: 49354 - RNA, 19 nt, Homo sapiens
caacugcaguguauagaaa

SEQ ID NO: 49355 - RNA, 19 nt, Homo sapiens
gaacauuucuaacaacaag

SEQ ID NO: 49356 - RNA, 19 nt, Homo sapiens
caacucaacucccaacaau

SEQ ID NO: 49357 - RNA, 19 nt, Homo sapiens
cguaagacguucuguguaa

SEQ ID NO: 49358 - RNA, 19 nt, Homo sapiens
ggaaugacccagccacuuu

SEQ ID NO: 49359 - RNA, 19 nt, Homo sapiens
ggacaucccucuugguaca

SEQ ID NO: 49360 - RNA, 19 nt, Homo sapiens
gaugauaccucagaagaug

SEQ ID NO: 49361 - RNA, 19 nt, Homo sapiens
agacaagggucaucuuuga

SEQ ID NO: 49362 - RNA, 19 nt, Homo sapiens
gaauaucccuggaagucuu

SEQ ID NO: 49363 - RNA, 19 nt, Homo sapiens
gagcagaguauuaaugaaa

SEQ ID NO: 49364 - RNA, 19 nt, Homo sapiens
gaagaaauagcaaauugga

SEQ ID NO: 49365 - RNA, 19 nt, Homo sapiens
ugucuugucucccaauaua

SEQ ID NO: 49366 - RNA, 19 nt, Homo sapiens
gcagauagcguggcugaaa

SEQ ID NO: 49367 - RNA, 19 nt, Homo sapiens
ggauccaacucucagauga

SEQ ID NO: 49368 - RNA, 19 nt, Homo sapiens
gcauggagaugaacaggau

SEQ ID NO: 49369 - RNA, 19 nt, Homo sapiens
cagcaugccuucgguguuu

SEQ ID NO: 49370 - RNA, 19 nt, Homo sapiens
cugaggagaugcugaaauu

SEQ ID NO: 49371 - RNA, 19 nt, Homo sapiens
ucagaagacuccagccaaa

SEQ ID NO: 49372 - RNA, 19 nt, Homo sapiens
cgaugacucugacauuaaa

SEQ ID NO: 49373 - RNA, 19 nt, Homo sapiens
ggauuuaccugaaaacaaa

SEQ ID NO: 49374 - RNA, 19 nt, Homo sapiens
cagaugcccucuccaaaug

SEQ ID NO: 49375 - RNA, 19 nt, Homo sapiens
uaauucugcugaccacaua

SEQ ID NO: 49376 - RNA, 19 nt, Homo sapiens
ugagggaguuccaggagua

SEQ ID NO: 49377 - RNA, 19 nt, Homo sapiens
gaacagaugcuaaaagcua

SEQ ID NO: 49378 - RNA, 19 nt, Homo sapiens
gaauccaucuucagaccuu

SEQ ID NO: 49379 - RNA, 19 nt, Homo sapiens
acacagaauccucgaauuu

SEQ ID NO: 49380 - RNA, 19 nt, Homo sapiens
ugaauaauaugccaggaau

SEQ ID NO: 49381 - RNA, 19 nt, Homo sapiens
cagaacccacucucuauua

SEQ ID NO: 49382 - RNA, 19 nt, Homo sapiens
ggaggaagccggaacaagu

SEQ ID NO: 49383 - RNA, 19 nt, Homo sapiens
caauagcucuucagcagau

SEQ ID NO: 49384 - RNA, 19 nt, Homo sapiens
gcagccaacuccacccauu

SEQ ID NO: 49385 - RNA, 19 nt, Homo sapiens
ccaacccacuggcacauuu

SEQ ID NO: 49386 - RNA, 19 nt, Homo sapiens
gaaagcuacuuggcaugaa

SEQ ID NO: 49387 - RNA, 19 nt, Homo sapiens
gagaugaacaggaugauuc

SEQ ID NO: 49388 - RNA, 19 nt, Homo sapiens
ggagucaguuggccagaug

SEQ ID NO: 49389 - RNA, 19 nt, Homo sapiens
gaaaugguuccaccuucua

SEQ ID NO: 49390 - RNA, 19 nt, Homo sapiens
gcaaauuggacauauugaa

SEQ ID NO: 49391 - RNA, 19 nt, Homo sapiens
gcagaauccugggguauua

SEQ ID NO: 49392 - RNA, 19 nt, Homo sapiens
uguguaaccuccauuaaau

SEQ ID NO: 49393 - RNA, 19 nt, Homo sapiens
ucagaccuuuggacuauuu

SEQ ID NO: 49394 - RNA, 19 nt, Homo sapiens
caaacugauuccuucugua

SEQ ID NO: 49395 - RNA, 19 nt, Homo sapiens
gcugggaaauguagaguca

SEQ ID NO: 49396 - RNA, 19 nt, Homo sapiens
cgaaaccucucccacaaca

SEQ ID NO: 49397 - RNA, 19 nt, Homo sapiens
ccaaagugguguacguguu

SEQ ID NO: 49398 - RNA, 19 nt, Homo sapiens
caaagugguguacguguuu

SEQ ID NO: 49399 - RNA, 19 nt, Homo sapiens
cuaaguugcuuugauguug

SEQ ID NO: 49400 - RNA, 19 nt, Homo sapiens
cggaagcccuuggauauau

SEQ ID NO: 49401 - RNA, 19 nt, Homo sapiens
ggccagggauugcgggaaa

SEQ ID NO: 49402 - RNA, 19 nt, Homo sapiens
caugauaaacucugaaaug

SEQ ID NO: 49403 - RNA, 19 nt, Homo sapiens
ccagagcuguggugucaga

SEQ ID NO: 49404 - RNA, 19 nt, Homo sapiens
ccucagagcagaguauuaa

SEQ ID NO: 49405 - RNA, 19 nt, Homo sapiens
augcugggcuguuuacuuu

SEQ ID NO: 49406 - RNA, 19 nt, Homo sapiens
caggaaugcugggcuguuu

SEQ ID NO: 49407 - RNA, 19 nt, Homo sapiens
gaucuaucccgcauuauuc

SEQ ID NO: 49408 - RNA, 19 nt, Homo sapiens
uuugaucuaucccgcauua

SEQ ID NO: 49409 - RNA, 19 nt, Homo sapiens
uaucugcccuucggaauga

SEQ ID NO: 49410 - RNA, 19 nt, Homo sapiens
uugaaacuaucgucucuuu

SEQ ID NO: 49411 - RNA, 19 nt, Homo sapiens
aacgaugacucugacauua

SEQ ID NO: 49412 - RNA, 19 nt, Homo sapiens
ucgagaauguauggauuua

SEQ ID NO: 49413 - RNA, 19 nt, Homo sapiens
caacuugccaucaaugaau

SEQ ID NO: 49414 - RNA, 19 nt, Homo sapiens
gaaauggaagggccgaaug

SEQ ID NO: 49415 - RNA, 19 nt, Homo sapiens
cacauaaagucccaggauu

SEQ ID NO: 49416 - RNA, 19 nt, Homo sapiens
cagagcagaguauuaauga

SEQ ID NO: 49417 - RNA, 19 nt, Homo sapiens
cuucagaccuuuggacuau

SEQ ID NO: 49418 - RNA, 19 nt, Homo sapiens
gcauuaacccucugaaguc

SEQ ID NO: 49419 - RNA, 19 nt, Homo sapiens
ccuaaacauucccaucuga

SEQ ID NO: 49420 - RNA, 19 nt, Homo sapiens
ucaggaaacacacagagua

SEQ ID NO: 49421 - RNA, 19 nt, Homo sapiens
caagggucaucuuugagaa

SEQ ID NO: 49422 - RNA, 19 nt, Homo sapiens
cagccugccucugugaaua

SEQ ID NO: 49423 - RNA, 19 nt, Homo sapiens
gcacagcgccucugaacac

SEQ ID NO: 49424 - RNA, 19 nt, Homo sapiens
aaacagaucagaccaagca

SEQ ID NO: 49425 - RNA, 19 nt, Homo sapiens
uaaccuccauuaaauuugg

SEQ ID NO: 49426 - RNA, 19 nt, Homo sapiens
ggaguuccaggaguacuua

SEQ ID NO: 49427 - RNA, 19 nt, Homo sapiens
acagaauccucgaauuuca

SEQ ID NO: 49428 - RNA, 19 nt, Homo sapiens
gaucagaccaagcagacaa

SEQ ID NO: 49429 - RNA, 19 nt, Homo sapiens
uaucgucucuuuccacauc

SEQ ID NO: 49430 - RNA, 19 nt, Homo sapiens
uuaaguguuuccuuccuuu

SEQ ID NO: 49431 - RNA, 19 nt, Homo sapiens
gcaccguucucuguauguu

SEQ ID NO: 49432 - RNA, 19 nt, Homo sapiens
uagcugugcuuugagaauu

SEQ ID NO: 49433 - RNA, 19 nt, Homo sapiens
cggaauaccugaguuugau

SEQ ID NO: 49434 - RNA, 19 nt, Homo sapiens
guaucaacaugccacauuc

SEQ ID NO: 49435 - RNA, 19 nt, Homo sapiens
gguaucaacaugccacauu

SEQ ID NO: 49436 - RNA, 19 nt, Homo sapiens
gagccugucccguuuguga

SEQ ID NO: 49437 - RNA, 19 nt, Homo sapiens
gaauugccaucggucaugu

SEQ ID NO: 49438 - RNA, 19 nt, Homo sapiens
ucucgaauguccaaguuug

SEQ ID NO: 49439 - RNA, 19 nt, Homo sapiens
aacccacucucuauuauga

SEQ ID NO: 49440 - RNA, 19 nt, Homo sapiens
ggaagcccuuggauauauc

SEQ ID NO: 49441 - RNA, 19 nt, Homo sapiens
gcggaagcccuuggauaua

SEQ ID NO: 49442 - RNA, 19 nt, Homo sapiens
gaggagaugcugaaauuac

SEQ ID NO: 49443 - RNA, 19 nt, Homo sapiens
gaaucccgauggcuuaucu

SEQ ID NO: 49444 - RNA, 19 nt, Homo sapiens
cagaguagcccuaagucaa

SEQ ID NO: 49445 - RNA, 19 nt, Homo sapiens
aaucaaugcauuccaguaa

SEQ ID NO: 49446 - RNA, 19 nt, Homo sapiens
caugagaccaccagccuuu

SEQ ID NO: 49447 - RNA, 19 nt, Homo sapiens
gaacccacucucuauuaug

SEQ ID NO: 49448 - RNA, 19 nt, Homo sapiens
ggcggaagcccuuggauau

SEQ ID NO: 49449 - RNA, 19 nt, Homo sapiens
ggacugagcuuaauaauuu

SEQ ID NO: 49450 - RNA, 19 nt, Homo sapiens
gauaaacucugaaccauua

SEQ ID NO: 49451 - RNA, 19 nt, Homo sapiens
caacuucgauguucuucua

SEQ ID NO: 49452 - RNA, 19 nt, Homo sapiens
cagaauagaugauguguca

SEQ ID NO: 49453 - RNA, 19 nt, Homo sapiens
gguagaaacuuccuugguu

SEQ ID NO: 49454 - RNA, 19 nt, Homo sapiens
gagcaggacuggugaugaa

SEQ ID NO: 49455 - RNA, 19 nt, Homo sapiens
uaaggaagauaaacucuga

SEQ ID NO: 49456 - RNA, 19 nt, Homo sapiens
ucagaucucuuuaggauga

SEQ ID NO: 49457 - RNA, 19 nt, Homo sapiens
ggagauagagaaaucaauu

SEQ ID NO: 49458 - RNA, 19 nt, Homo sapiens
gaaaggaacgaaugcgauu

SEQ ID NO: 49459 - RNA, 19 nt, Homo sapiens
gcuagguaauuaaccauuu

SEQ ID NO: 49460 - RNA, 19 nt, Homo sapiens
gaagauaaacucugaacca

SEQ ID NO: 49461 - RNA, 19 nt, Homo sapiens
gaauagaugaugugucaga

SEQ ID NO: 49462 - RNA, 19 nt, Homo sapiens
ccacgaagcaggcgaaguu

SEQ ID NO: 49463 - RNA, 19 nt, Homo sapiens
ggaaacucuuuauguuaga

SEQ ID NO: 49464 - RNA, 19 nt, Homo sapiens
guggaaacucuuuauguua

SEQ ID NO: 49465 - RNA, 19 nt, Homo sapiens
ggaggaaggcgcaaccauu

SEQ ID NO: 49466 - RNA, 19 nt, Homo sapiens
ugucagaucucuuuaggau

SEQ ID NO: 49467 - RNA, 19 nt, Homo sapiens
cuacggagauagagaaauc

SEQ ID NO: 49468 - RNA, 19 nt, Homo sapiens
gcgauucucuggaccuguu

SEQ ID NO: 49469 - RNA, 19 nt, Homo sapiens
uugcauaccuugucaacuu

SEQ ID NO: 49470 - RNA, 19 nt, Homo sapiens
uguggaaacucuuuauguu

SEQ ID NO: 49471 - RNA, 19 nt, Homo sapiens
ggacuggugaugaaauuau

SEQ ID NO: 49472 - RNA, 19 nt, Homo sapiens
caugucagcguuauuguaa

SEQ ID NO: 49473 - RNA, 19 nt, Homo sapiens
gaaguucauuguucucaac

SEQ ID NO: 49474 - RNA, 19 nt, Homo sapiens
gcucuggaauucuuguaga

SEQ ID NO: 49475 - RNA, 19 nt, Homo sapiens
uagcugcucuugcugcauu

SEQ ID NO: 49476 - RNA, 19 nt, Homo sapiens
uggaaacucuuuauguuag

SEQ ID NO: 49477 - RNA, 19 nt, Homo sapiens
gaagaaugcaccugugaag

SEQ ID NO: 49478 - RNA, 19 nt, Homo sapiens
gaggaaggcgcaaccauuc

SEQ ID NO: 49479 - RNA, 19 nt, Homo sapiens
caggacuggugaugaaauu

SEQ ID NO: 49480 - RNA, 19 nt, Homo sapiens
aaccgaaggucgacucuga

SEQ ID NO: 49481 - RNA, 19 nt, Homo sapiens
cuucgauguucuucuaaua

SEQ ID NO: 49482 - RNA, 19 nt, Homo sapiens
ugugaagacugcaucaaga

SEQ ID NO: 49483 - RNA, 19 nt, Homo sapiens
ggaagaaugcaccugugaa

SEQ ID NO: 49484 - RNA, 19 nt, Homo sapiens
gauauuacuuguccuucca

SEQ ID NO: 49485 - RNA, 19 nt, Homo sapiens
gacuggugaugaaauuauu

SEQ ID NO: 49486 - RNA, 19 nt, Homo sapiens
gggcauggcuaacauugac

SEQ ID NO: 49487 - RNA, 19 nt, Homo sapiens
uggaauucuuguagagaua

SEQ ID NO: 49488 - RNA, 19 nt, Homo sapiens
uuccuugguuucaugauua

SEQ ID NO: 49489 - RNA, 19 nt, Homo sapiens
uaacuguggaaacucuuua

SEQ ID NO: 49490 - RNA, 19 nt, Homo sapiens
ggaaggcgcaaccauucuu

SEQ ID NO: 49491 - RNA, 19 nt, Homo sapiens
gggacugagcuuaauaauu

SEQ ID NO: 49492 - RNA, 19 nt, Homo sapiens
acgaaugacuauugcaaga

SEQ ID NO: 49493 - RNA, 19 nt, Homo sapiens
ugucagcguuauuguaaug

SEQ ID NO: 49494 - RNA, 19 nt, Homo sapiens
ucuaauacuccuccucuaa

SEQ ID NO: 49495 - RNA, 19 nt, Homo sapiens
acucaaacuuagaaacuug

SEQ ID NO: 49496 - RNA, 19 nt, Homo sapiens
uaauacuccuccucuaaca

SEQ ID NO: 49497 - RNA, 19 nt, Homo sapiens
gaaacuugaauuagaugug

SEQ ID NO: 49498 - RNA, 19 nt, Homo sapiens
gaaugcaccugugaagacu

SEQ ID NO: 49499 - RNA, 19 nt, Homo sapiens
gggcagugcucccaaaaug

SEQ ID NO: 49500 - RNA, 19 nt, Homo sapiens
gaugaugugucagaucucu

SEQ ID NO: 49501 - RNA, 19 nt, Homo sapiens
caggcgaaguucauuguuc

SEQ ID NO: 49502 - RNA, 19 nt, Homo sapiens
gacucaaacuuagaaacuu

SEQ ID NO: 49503 - RNA, 19 nt, Homo sapiens
uucuguagcucccuuguuu

SEQ ID NO: 49504 - RNA, 19 nt, Homo sapiens
gaaggcgcaaccauucuug

SEQ ID NO: 49505 - RNA, 19 nt, Homo sapiens
cgaaguucauuguucucaa

SEQ ID NO: 49506 - RNA, 19 nt, Homo sapiens
cguaagaacccacgaagca

SEQ ID NO: 49507 - RNA, 19 nt, Homo sapiens
cauuugcucuggaauucuu

SEQ ID NO: 49508 - RNA, 19 nt, Homo sapiens
gcuuaaugguagaaacuuc

SEQ ID NO: 49509 - RNA, 19 nt, Homo sapiens
gaagcaggcgaaguucauu

SEQ ID NO: 49510 - RNA, 19 nt, Homo sapiens
cuagguaauuaaccauuuc

SEQ ID NO: 49511 - RNA, 19 nt, Homo sapiens
aaacgaaugacuauugcaa

SEQ ID NO: 49512 - RNA, 19 nt, Homo sapiens
gaaaacgaaugacuauugc

SEQ ID NO: 49513 - RNA, 19 nt, Homo sapiens
gacaguuuguugcaugcuu

SEQ ID NO: 49514 - RNA, 19 nt, Homo sapiens
cgaaaacgaaugacuauug

SEQ ID NO: 49515 - RNA, 19 nt, Homo sapiens
ggugaugaaauuauucuuc

SEQ ID NO: 49516 - RNA, 19 nt, Homo sapiens
uagaugugguauucaaauc

SEQ ID NO: 49517 - RNA, 19 nt, Homo sapiens
ggaauucuuguagagauau

SEQ ID NO: 49518 - RNA, 19 nt, Homo sapiens
ugaugugucagaucucuuu

SEQ ID NO: 49519 - RNA, 19 nt, Homo sapiens
gcaggacuggugaugaaau

SEQ ID NO: 49520 - RNA, 19 nt, Homo sapiens
aagauaaacucugaaccau

SEQ ID NO: 49521 - RNA, 19 nt, Homo sapiens
cgacucugaccauugcuuu

SEQ ID NO: 49522 - RNA, 19 nt, Homo sapiens
augcaagugugaccaauuc

SEQ ID NO: 49523 - RNA, 19 nt, Homo sapiens
ucuuuaggaugacuguauu

SEQ ID NO: 49524 - RNA, 19 nt, Homo sapiens
ccagcugcuuugagugcua

SEQ ID NO: 49525 - RNA, 19 nt, Homo sapiens
gcuuuccacucccagcuau

SEQ ID NO: 49526 - RNA, 19 nt, Homo sapiens
ccaggcuguucuuucugua

SEQ ID NO: 49527 - RNA, 19 nt, Homo sapiens
guaaugcaagugugaccaa

SEQ ID NO: 49528 - RNA, 19 nt, Homo sapiens
gagcuuaaugguagaaacu

SEQ ID NO: 49529 - RNA, 19 nt, Homo sapiens
aucaauuucugcuagguaa

SEQ ID NO: 49530 - RNA, 19 nt, Homo sapiens
ggagcuuaaugguagaaac

SEQ ID NO: 49531 - RNA, 19 nt, Homo sapiens
gaugugucagaucucuuua

SEQ ID NO: 49532 - RNA, 19 nt, Homo sapiens
ucagugaaaggaacgaaug

SEQ ID NO: 49533 - RNA, 19 nt, Homo sapiens
caagugugaccaauucagu

SEQ ID NO: 49534 - RNA, 19 nt, Homo sapiens
cuuccuugguuucaugauu

SEQ ID NO: 49535 - RNA, 19 nt, Homo sapiens
gaugugguauucaaauccu

SEQ ID NO: 49536 - RNA, 19 nt, Homo sapiens
gguuacuguugggagcuua

SEQ ID NO: 49537 - RNA, 19 nt, Homo sapiens
gagccugccagcugcuuug

SEQ ID NO: 49538 - RNA, 19 nt, Homo sapiens
cgaagcaggcgaaguucau

SEQ ID NO: 49539 - RNA, 19 nt, Homo sapiens
gcagugcucccaaaaugaa

SEQ ID NO: 49540 - RNA, 19 nt, Homo sapiens
gcaggcgaaguucauuguu

SEQ ID NO: 49541 - RNA, 19 nt, Homo sapiens
ggcuaacauugaccuggaa

SEQ ID NO: 49542 - RNA, 19 nt, Homo sapiens
cagcguuauuguaaugcaa

SEQ ID NO: 49543 - RNA, 19 nt, Homo sapiens
gugcuacggagauagagaa

SEQ ID NO: 49544 - RNA, 19 nt, Homo sapiens
uuugagugcuacggagaua

SEQ ID NO: 49545 - RNA, 19 nt, Homo sapiens
ccugccagcugcuuugagu

SEQ ID NO: 49546 - RNA, 19 nt, Homo sapiens
ccacgaaaacgaaugacua

SEQ ID NO: 49547 - RNA, 19 nt, Homo sapiens
aguacacgguggaagaaug

SEQ ID NO: 49548 - RNA, 19 nt, Homo sapiens
cuuccaggcuguucuuucu

SEQ ID NO: 49549 - RNA, 19 nt, Homo sapiens
gaggagaucuuccacauga

SEQ ID NO: 49550 - RNA, 19 nt, Homo sapiens
gacuacaucuuccuuauug

SEQ ID NO: 49551 - RNA, 19 nt, Homo sapiens
gggaggagaucgucaacuu

SEQ ID NO: 49552 - RNA, 19 nt, Homo sapiens
ccgagaagaucaagaagaa

SEQ ID NO: 49553 - RNA, 19 nt, Homo sapiens
gaagauccacgacuacuau

SEQ ID NO: 49554 - RNA, 19 nt, Homo sapiens
gccagaagauccacgacua

SEQ ID NO: 49555 - RNA, 19 nt, Homo sapiens
acaagcagguggagcagua

SEQ ID NO: 49556 - RNA, 19 nt, Homo sapiens
ccaucgcgcucacgcaaua

SEQ ID NO: 49557 - RNA, 19 nt, Homo sapiens
uccaggagaucgucaagua

SEQ ID NO: 49558 - RNA, 19 nt, Homo sapiens
ugaccaagcucaaguucga

SEQ ID NO: 49559 - RNA, 19 nt, Homo sapiens
guagguagccguaguugga

SEQ ID NO: 49560 - RNA, 19 nt, Homo sapiens
ggacuacaucuuccuuauu

SEQ ID NO: 49561 - RNA, 19 nt, Homo sapiens
gggaggagaucuuccacau

SEQ ID NO: 49562 - RNA, 19 nt, Homo sapiens
ucauggaccugguguugaa

SEQ ID NO: 49563 - RNA, 19 nt, Homo sapiens
gaccaaagccaugccauug

SEQ ID NO: 49564 - RNA, 19 nt, Homo sapiens
guacauguccuuccacaag

SEQ ID NO: 49565 - RNA, 19 nt, Homo sapiens
gccaguaccaggagaagua

SEQ ID NO: 49566 - RNA, 19 nt, Homo sapiens
gagaagaucaagaagaagu

SEQ ID NO: 49567 - RNA, 19 nt, Homo sapiens
gaggagaucgucaacuuca

SEQ ID NO: 49568 - RNA, 19 nt, Homo sapiens
gaacuuccgcaccggcauu

SEQ ID NO: 49569 - RNA, 19 nt, Homo sapiens
ucacuaagggcaacaagga

SEQ ID NO: 49570 - RNA, 19 nt, Homo sapiens
gcaccggcauugugaucga

SEQ ID NO: 49571 - RNA, 19 nt, Homo sapiens
caaguacgaccgcgagaug

SEQ ID NO: 49572 - RNA, 19 nt, Homo sapiens
gaagaucaagaagaaguau

SEQ ID NO: 49573 - RNA, 19 nt, Homo sapiens
gggcaucaccuucuucaag

SEQ ID NO: 49574 - RNA, 19 nt, Homo sapiens
gaccucaacucgggcguau

SEQ ID NO: 49575 - RNA, 19 nt, Homo sapiens
ggacaacacggagaucauc

SEQ ID NO: 49576 - RNA, 19 nt, Homo sapiens
acgaggugcuggaggagua

SEQ ID NO: 49577 - RNA, 19 nt, Homo sapiens
ggacaccuucuuccucaug

SEQ ID NO: 49578 - RNA, 19 nt, Homo sapiens
ucacggccaugcugaccaa

SEQ ID NO: 49579 - RNA, 19 nt, Homo sapiens
ugggaaaccucaucaucau

SEQ ID NO: 49580 - RNA, 19 nt, Homo sapiens
gaaggcaccaucgggaaga

SEQ ID NO: 49581 - RNA, 19 nt, Homo sapiens
gugggaaaccucaucauca

SEQ ID NO: 49582 - RNA, 19 nt, Homo sapiens
gaggaucguuuucuaagug

SEQ ID NO: 49583 - RNA, 19 nt, Homo sapiens
gcaacaaggagaugaagcu

SEQ ID NO: 49584 - RNA, 19 nt, Homo sapiens
uggacuacaucuuccuuau

SEQ ID NO: 49585 - RNA, 19 nt, Homo sapiens
agacguagguagccguagu

SEQ ID NO: 49586 - RNA, 19 nt, Homo sapiens
gcaagaagaauuccauccu

SEQ ID NO: 49587 - RNA, 19 nt, Homo sapiens
ggaagcugguggccuccau

SEQ ID NO: 49588 - RNA, 19 nt, Homo sapiens
ggaggagaucgucaacuuc

SEQ ID NO: 49589 - RNA, 19 nt, Homo sapiens
ggaggagaucuuccacaug

SEQ ID NO: 49590 - RNA, 19 nt, Homo sapiens
cgcaauaaacgacagcauu

SEQ ID NO: 49591 - RNA, 19 nt, Homo sapiens
cgaggaggaucguuuucua

SEQ ID NO: 49592 - RNA, 19 nt, Homo sapiens
ccucaacucgggcguauuc

SEQ ID NO: 49593 - RNA, 19 nt, Homo sapiens
gaccgcaucggcaagaaga

SEQ ID NO: 49594 - RNA, 19 nt, Homo sapiens
ucaccaugcugcuguucau

SEQ ID NO: 49595 - RNA, 19 nt, Homo sapiens
gcauugacuccgaggucua

SEQ ID NO: 49596 - RNA, 19 nt, Homo sapiens
agaagaucaagaagaagua

SEQ ID NO: 49597 - RNA, 19 nt, Homo sapiens
cagcugacuuccgccagaa

SEQ ID NO: 49598 - RNA, 19 nt, Homo sapiens
ccagcgcggugaugaggau

SEQ ID NO: 49599 - RNA, 19 nt, Homo sapiens
agaagauccacgacuacua

SEQ ID NO: 49600 - RNA, 19 nt, Homo sapiens
ggugggaaaccucaucauc

SEQ ID NO: 49601 - RNA, 19 nt, Homo sapiens
gugaugaggaucugcaauc

SEQ ID NO: 49602 - RNA, 19 nt, Homo sapiens
gaggacaacacggagauca

SEQ ID NO: 49603 - RNA, 19 nt, Homo sapiens
gcgccucucguccaacuug

SEQ ID NO: 49604 - RNA, 19 nt, Homo sapiens
guggucagcgugcucacua

SEQ ID NO: 49605 - RNA, 19 nt, Homo sapiens
ggagaucgucaacuucaac

SEQ ID NO: 49606 - RNA, 19 nt, Homo sapiens
gcagguggagcaguacaug

SEQ ID NO: 49607 - RNA, 19 nt, Homo sapiens
gaggaucugcaaucucauc

SEQ ID NO: 49608 - RNA, 19 nt, Homo sapiens
agaccaaagccaugccauu

SEQ ID NO: 49609 - RNA, 19 nt, Homo sapiens
caacucgggcguauucaac

SEQ ID NO: 49610 - RNA, 19 nt, Homo sapiens
gauccacgacuacuaugag

SEQ ID NO: 49611 - RNA, 19 nt, Homo sapiens
cuacaucuuccuuauugug

SEQ ID NO: 49612 - RNA, 19 nt, Homo sapiens
guggacuacaucuuccuua

SEQ ID NO: 49613 - RNA, 19 nt, Homo sapiens
ugaugaggaucugcaaucu

SEQ ID NO: 49614 - RNA, 19 nt, Homo sapiens
ccucauggaccugguguug

SEQ ID NO: 49615 - RNA, 19 nt, Homo sapiens
ggcccaaggugucguucuc

SEQ ID NO: 49616 - RNA, 19 nt, Homo sapiens
gcaucggcaagaagaauuc

SEQ ID NO: 49617 - RNA, 19 nt, Homo sapiens
gagcguggacaacuucaac

SEQ ID NO: 49618 - RNA, 19 nt, Homo sapiens
ccagccgggugacuacauc

SEQ ID NO: 49619 - RNA, 19 nt, Homo sapiens
ggaggaucguuuucuaagu

SEQ ID NO: 49620 - RNA, 19 nt, Homo sapiens
gaggaggaucguuuucuaa

SEQ ID NO: 49621 - RNA, 19 nt, Homo sapiens
cguccgaggaggaucguuu

SEQ ID NO: 49622 - RNA, 19 nt, Homo sapiens
gcugagcguggacaacuuc

SEQ ID NO: 49623 - RNA, 19 nt, Homo sapiens
ucugcaaucucaucagcau

SEQ ID NO: 49624 - RNA, 19 nt, Homo sapiens
ucuuccacaugaccuauga

SEQ ID NO: 49625 - RNA, 19 nt, Homo sapiens
ggaaggccaugacagauga

SEQ ID NO: 49626 - RNA, 19 nt, Homo sapiens
caacugaggacccaauauu

SEQ ID NO: 49627 - RNA, 19 nt, Homo sapiens
guuccaagcuugcaucaug

SEQ ID NO: 49628 - RNA, 19 nt, Homo sapiens
ugcaacagcuagaauuaaa

SEQ ID NO: 49629 - RNA, 19 nt, Homo sapiens
uaacggauacuucgucuuc

SEQ ID NO: 49630 - RNA, 19 nt, Homo sapiens
ggcacugucuuccuuauag

SEQ ID NO: 49631 - RNA, 19 nt, Homo sapiens
caccauuccuucauucuuc

SEQ ID NO: 49632 - RNA, 19 nt, Homo sapiens
caucuacaaucccaucauc

SEQ ID NO: 49633 - RNA, 19 nt, Homo sapiens
ucaacuacauucuggucaa

SEQ ID NO: 49634 - RNA, 19 nt, Homo sapiens
ucuacugcuucaugaauaa

SEQ ID NO: 49635 - RNA, 19 nt, Homo sapiens
gaugguaggauccuucugu

SEQ ID NO: 49636 - RNA, 19 nt, Homo sapiens
gcgcuacauugucaucugu

SEQ ID NO: 49637 - RNA, 19 nt, Homo sapiens
cgucuucggucgccauguu

SEQ ID NO: 49638 - RNA, 19 nt, Homo sapiens
guaggauccuucugugucu

SEQ ID NO: 49639 - RNA, 19 nt, Homo sapiens
caugggcacugucuuccuu

SEQ ID NO: 49640 - RNA, 19 nt, Homo sapiens
gggaaggccaugacagaug

SEQ ID NO: 49641 - RNA, 19 nt, Homo sapiens
caucaucuacugcuucaug

SEQ ID NO: 49642 - RNA, 19 nt, Homo sapiens
ggaagaguuuuaucuguuc

SEQ ID NO: 49643 - RNA, 19 nt, Homo sapiens
gggcacugucuuccuuaua

SEQ ID NO: 49644 - RNA, 19 nt, Homo sapiens
gcaacagcuagaauuaaau

SEQ ID NO: 49645 - RNA, 19 nt, Homo sapiens
aagcuugcaucaugaagau

SEQ ID NO: 49646 - RNA, 19 nt, Homo sapiens
cauggugguugugauggua

SEQ ID NO: 49647 - RNA, 19 nt, Homo sapiens
cuuauaggguucccacuca

SEQ ID NO: 49648 - RNA, 19 nt, Homo sapiens
aauauuggccuguuugcaa

SEQ ID NO: 49649 - RNA, 19 nt, Homo sapiens
gaggaagaguuuuaucugu

SEQ ID NO: 49650 - RNA, 19 nt, Homo sapiens
gggccucaguaccacauug

SEQ ID NO: 49651 - RNA, 19 nt, Homo sapiens
gcacugucuuccuuauagg

SEQ ID NO: 49652 - RNA, 19 nt, Homo sapiens
ucuacaaucccaucaucua

SEQ ID NO: 49653 - RNA, 19 nt, Homo sapiens
uuugagcgcuacauuguca

SEQ ID NO: 49654 - RNA, 19 nt, Homo sapiens
cuggcuaccuggaccauug

SEQ ID NO: 49655 - RNA, 19 nt, Homo sapiens
gggaugggccucaguacca

SEQ ID NO: 49656 - RNA, 19 nt, Homo sapiens
caagcuugcaucaugaaga

SEQ ID NO: 49657 - RNA, 19 nt, Homo sapiens
gcauggugguugugauggu

SEQ ID NO: 49658 - RNA, 19 nt, Homo sapiens
gugggaaggccaugacaga

SEQ ID NO: 49659 - RNA, 19 nt, Homo sapiens
caucuacugcuucaugaau

SEQ ID NO: 49660 - RNA, 19 nt, Homo sapiens
acaaucccaucaucuacug

SEQ ID NO: 49661 - RNA, 19 nt, Homo sapiens
cugagggccugcaguguuc

SEQ ID NO: 49662 - RNA, 19 nt, Homo sapiens
ugucucgucuacccaaguu

SEQ ID NO: 49663 - RNA, 19 nt, Homo sapiens
cagaugaauccgacacaug

SEQ ID NO: 49664 - RNA, 19 nt, Homo sapiens
cagcaggagucagcuacga

SEQ ID NO: 49665 - RNA, 19 nt, Homo sapiens
uaaccaugggcuggacuua

SEQ ID NO: 49666 - RNA, 19 nt, Homo sapiens
caacuacauucuggucaac

SEQ ID NO: 49667 - RNA, 19 nt, Homo sapiens
gaauaagcaguuccaagcu

SEQ ID NO: 49668 - RNA, 19 nt, Homo sapiens
guacaccgugggcaccaaa

SEQ ID NO: 49669 - RNA, 19 nt, Homo sapiens
ggucaacaaccguaaccau

SEQ ID NO: 49670 - RNA, 19 nt, Homo sapiens
gugccucucucccucaucu

SEQ ID NO: 49671 - RNA, 19 nt, Homo sapiens
gauggucacuggccuuccu

SEQ ID NO: 49672 - RNA, 19 nt, Homo sapiens
uuugcaacagcuagaauua

SEQ ID NO: 49673 - RNA, 19 nt, Homo sapiens
ccuguggcccugacuggua

SEQ ID NO: 49674 - RNA, 19 nt, Homo sapiens
gugcuugcaucuacaaucc

SEQ ID NO: 49675 - RNA, 19 nt, Homo sapiens
ugucaccauuccuucauuc

SEQ ID NO: 49676 - RNA, 19 nt, Homo sapiens
caucuucugcuucauugug

SEQ ID NO: 49677 - RNA, 19 nt, Homo sapiens
acaccgugggcaccaaaua

SEQ ID NO: 49678 - RNA, 19 nt, Homo sapiens
ccugagggccugcaguguu

SEQ ID NO: 49679 - RNA, 19 nt, Homo sapiens
guaagcccuucggcaacuu

SEQ ID NO: 49680 - RNA, 19 nt, Homo sapiens
gcaggucugguuacaggau

SEQ ID NO: 49681 - RNA, 19 nt, Homo sapiens
acaugcagcucccagaaaa

SEQ ID NO: 49682 - RNA, 19 nt, Homo sapiens
acacaugcagcucccagaa

SEQ ID NO: 49683 - RNA, 19 nt, Homo sapiens
cacaugcagcucccagaaa

SEQ ID NO: 49684 - RNA, 19 nt, Homo sapiens
cccaucaucuacugcuuca

SEQ ID NO: 49685 - RNA, 19 nt, Homo sapiens
cgugguuccucuucaucuu

SEQ ID NO: 49686 - RNA, 19 nt, Homo sapiens
uauacgugguuccucuuca

SEQ ID NO: 49687 - RNA, 19 nt, Homo sapiens
uuccaagcuugcaucauga

SEQ ID NO: 49688 - RNA, 19 nt, Homo sapiens
caacaaagaugccaaggau

SEQ ID NO: 49689 - RNA, 19 nt, Homo sapiens
gaacgaggaauuugagaua

SEQ ID NO: 49690 - RNA, 19 nt, Homo sapiens
gcaccaagcucaagaagca

SEQ ID NO: 49691 - RNA, 19 nt, Homo sapiens
gcagacagauggccuggaa

SEQ ID NO: 49692 - RNA, 19 nt, Homo sapiens
cagaagaaguguuucagaa

SEQ ID NO: 49693 - RNA, 19 nt, Homo sapiens
gaaaagggcuuggagauga

SEQ ID NO: 49694 - RNA, 19 nt, Homo sapiens
cgagugagcuggacuugga

SEQ ID NO: 49695 - RNA, 19 nt, Homo sapiens
ggaaaccucuggcuaaucg

SEQ ID NO: 49696 - RNA, 19 nt, Homo sapiens
caggagcgcuuccgcauga

SEQ ID NO: 49697 - RNA, 19 nt, Homo sapiens
ugaaugggaucgaaguaaa

SEQ ID NO: 49698 - RNA, 19 nt, Homo sapiens
ggacacagcugagccaaac

SEQ ID NO: 49699 - RNA, 19 nt, Homo sapiens
uaaggaagaugaugagucu

SEQ ID NO: 49700 - RNA, 19 nt, Homo sapiens
cggagaggcugaagaagaa

SEQ ID NO: 49701 - RNA, 19 nt, Homo sapiens
ccacucagccacuggauuu

SEQ ID NO: 49702 - RNA, 19 nt, Homo sapiens
gcacgcugguccuccauga

SEQ ID NO: 49703 - RNA, 19 nt, Homo sapiens
aauaaacgcugcugcuuca

SEQ ID NO: 49704 - RNA, 19 nt, Homo sapiens
agaaggaggcagucaauaa

SEQ ID NO: 49705 - RNA, 19 nt, Homo sapiens
guaaagcucucggucaagu

SEQ ID NO: 49706 - RNA, 19 nt, Homo sapiens
gcaaaacgcagcaguauga

SEQ ID NO: 49707 - RNA, 19 nt, Homo sapiens
gagaccaucuucuucaaag

SEQ ID NO: 49708 - RNA, 19 nt, Homo sapiens
gcauuccgcugaccaucaa

SEQ ID NO: 49709 - RNA, 19 nt, Homo sapiens
uggaaacucugcucuacaa

SEQ ID NO: 49710 - RNA, 19 nt, Homo sapiens
cuacggaguugccauggaa

SEQ ID NO: 49711 - RNA, 19 nt, Homo sapiens
gaaggaggcagucaauaag

SEQ ID NO: 49712 - RNA, 19 nt, Homo sapiens
caagaacucucuggaaacu

SEQ ID NO: 49713 - RNA, 19 nt, Homo sapiens
gcacugcugcugcccauga

SEQ ID NO: 49714 - RNA, 19 nt, Homo sapiens
gacugcagcuccaaugaga

SEQ ID NO: 49715 - RNA, 19 nt, Homo sapiens
gaccaacucgugugugaaa

SEQ ID NO: 49716 - RNA, 19 nt, Homo sapiens
gagagaagagggcgaacaa

SEQ ID NO: 49717 - RNA, 19 nt, Homo sapiens
aaagauuucuacuggauca

SEQ ID NO: 49718 - RNA, 19 nt, Homo sapiens
gcagaagaaguguuucaga

SEQ ID NO: 49719 - RNA, 19 nt, Homo sapiens
augaggagcuggacgcuuu

SEQ ID NO: 49720 - RNA, 19 nt, Homo sapiens
accaagaacucucuggaaa

SEQ ID NO: 49721 - RNA, 19 nt, Homo sapiens
caaagugccugagcucuac

SEQ ID NO: 49722 - RNA, 19 nt, Homo sapiens
caagccaguucaucucaga

SEQ ID NO: 49723 - RNA, 19 nt, Homo sapiens
gauuuaagcagaguucaaa

SEQ ID NO: 49724 - RNA, 19 nt, Homo sapiens
ucaauaaggaagaugauga

SEQ ID NO: 49725 - RNA, 19 nt, Homo sapiens
cacaaggaguucuaugaug

SEQ ID NO: 49726 - RNA, 19 nt, Homo sapiens
ucgcagaacucgcaacagu

SEQ ID NO: 49727 - RNA, 19 nt, Homo sapiens
ccucuucacugacgaguuc

SEQ ID NO: 49728 - RNA, 19 nt, Homo sapiens
caggcacgcugaagcugua

SEQ ID NO: 49729 - RNA, 19 nt, Homo sapiens
agacguugcuggccaagga

SEQ ID NO: 49730 - RNA, 19 nt, Homo sapiens
agagugacauccagagaga

SEQ ID NO: 49731 - RNA, 19 nt, Homo sapiens
caagagacagcgacccaaa

SEQ ID NO: 49732 - RNA, 19 nt, Homo sapiens
gagaaggaggcagucaaua

SEQ ID NO: 49733 - RNA, 19 nt, Homo sapiens
gguccaaggugcccuacau

SEQ ID NO: 49734 - RNA, 19 nt, Homo sapiens
cagcugagccaaacuggaa

SEQ ID NO: 49735 - RNA, 19 nt, Homo sapiens
gaucuccucugacuaugag

SEQ ID NO: 49736 - RNA, 19 nt, Homo sapiens
caaacuggaacgaggaauu

SEQ ID NO: 49737 - RNA, 19 nt, Homo sapiens
gcaacaaagaugccaagga

SEQ ID NO: 49738 - RNA, 19 nt, Homo sapiens
ucaggccaaugcucaguuu

SEQ ID NO: 49739 - RNA, 19 nt, Homo sapiens
gaagugcugucaggccaau

SEQ ID NO: 49740 - RNA, 19 nt, Homo sapiens
aaguaaagcucucggucaa

SEQ ID NO: 49741 - RNA, 19 nt, Homo sapiens
ugaggauacugugcuauga

SEQ ID NO: 49742 - RNA, 19 nt, Homo sapiens
aaacuggaacgaggaauuu

SEQ ID NO: 49743 - RNA, 19 nt, Homo sapiens
gagcuggacgcuuugaaga

SEQ ID NO: 49744 - RNA, 19 nt, Homo sapiens
ucaaagugccugagcucua

SEQ ID NO: 49745 - RNA, 19 nt, Homo sapiens
gaucgagaccaucuucuuc

SEQ ID NO: 49746 - RNA, 19 nt, Homo sapiens
gagcaggagaagcgccuua

SEQ ID NO: 49747 - RNA, 19 nt, Homo sapiens
gugugaaacuccagacugu

SEQ ID NO: 49748 - RNA, 19 nt, Homo sapiens
gaaggucaacgacaaagag

SEQ ID NO: 49749 - RNA, 19 nt, Homo sapiens
ugaucuaccugcagacguu

SEQ ID NO: 49750 - RNA, 19 nt, Homo sapiens
ugagcgagauggacgugaa

SEQ ID NO: 49751 - RNA, 19 nt, Homo sapiens
cuacggagaggcugaagaa

SEQ ID NO: 49752 - RNA, 19 nt, Homo sapiens
gcuggacgcuuugaagauc

SEQ ID NO: 49753 - RNA, 19 nt, Homo sapiens
gaccaagaacucucuggaa

SEQ ID NO: 49754 - RNA, 19 nt, Homo sapiens
ucuacgagauccacaagga

SEQ ID NO: 49755 - RNA, 19 nt, Homo sapiens
ucuauggguuucugaaugu

SEQ ID NO: 49756 - RNA, 19 nt, Homo sapiens
cgacgucaauaacaaggau

SEQ ID NO: 49757 - RNA, 19 nt, Homo sapiens
gggagcagcagaagaagug

SEQ ID NO: 49758 - RNA, 19 nt, Homo sapiens
ccaaggauccaacgaccaa

SEQ ID NO: 49759 - RNA, 19 nt, Homo sapiens
guucuccaccgaagucuaa

SEQ ID NO: 49760 - RNA, 19 nt, Homo sapiens
caaccucgccacggucuuu

SEQ ID NO: 49761 - RNA, 19 nt, Homo sapiens
aggauacugugcuaugaaa

SEQ ID NO: 49762 - RNA, 19 nt, Homo sapiens
gaggauacugugcuaugaa

SEQ ID NO: 49763 - RNA, 19 nt, Homo sapiens
ucucccagaucaagaguga

SEQ ID NO: 49764 - RNA, 19 nt, Homo sapiens
ccacaaggaguucuaugau

SEQ ID NO: 49765 - RNA, 19 nt, Homo sapiens
ugccugagcucuacgagau

SEQ ID NO: 49766 - RNA, 19 nt, Homo sapiens
ccuggaaaccucuggcuaa

SEQ ID NO: 49767 - RNA, 19 nt, Homo sapiens
ugaaaaggguggcagagaa

SEQ ID NO: 49768 - RNA, 19 nt, Homo sapiens
gaccaucaauaaggaagau

SEQ ID NO: 49769 - RNA, 19 nt, Homo sapiens
gaagcagagcggaggcaaa

SEQ ID NO: 49770 - RNA, 19 nt, Homo sapiens
cggauucccucacuguugu

SEQ ID NO: 49771 - RNA, 19 nt, Homo sapiens
acaaggaugugucggugau

SEQ ID NO: 49772 - RNA, 19 nt, Homo sapiens
ggacauccaggcacugaag

SEQ ID NO: 49773 - RNA, 19 nt, Homo sapiens
ggaacgaggaauuugagau

SEQ ID NO: 49774 - RNA, 19 nt, Homo sapiens
agaacucucuggaaacucu

SEQ ID NO: 49775 - RNA, 19 nt, Homo sapiens
gccagaagcaacaaagaug

SEQ ID NO: 49776 - RNA, 19 nt, Homo sapiens
gggccuucguggacaacua

SEQ ID NO: 49777 - RNA, 19 nt, Homo sapiens
ggaggcagucaauaagaug

SEQ ID NO: 49778 - RNA, 19 nt, Homo sapiens
gaccaucuucuucaaagug

SEQ ID NO: 49779 - RNA, 19 nt, Homo sapiens
uggaggaggugggcaucua

SEQ ID NO: 49780 - RNA, 19 nt, Homo sapiens
gagcacggacagacucaug

SEQ ID NO: 49781 - RNA, 19 nt, Homo sapiens
uggauuccuuuggguauuu

SEQ ID NO: 49782 - RNA, 19 nt, Homo sapiens
ggauuuaagcagaguucaa

SEQ ID NO: 49783 - RNA, 19 nt, Homo sapiens
cugaccaacucguguguga

SEQ ID NO: 49784 - RNA, 19 nt, Homo sapiens
ccugaucuccucugacuau

SEQ ID NO: 49785 - RNA, 19 nt, Homo sapiens
ucacugcugcugcuuaugu

SEQ ID NO: 49786 - RNA, 19 nt, Homo sapiens
cuacgaggacgccgaguug

SEQ ID NO: 49787 - RNA, 19 nt, Homo sapiens
caagagugacauccagaga

SEQ ID NO: 49788 - RNA, 19 nt, Homo sapiens
caacaaagaugccaaggau

SEQ ID NO: 49789 - RNA, 19 nt, Homo sapiens
gcaccaagcucaagaagca

SEQ ID NO: 49790 - RNA, 19 nt, Homo sapiens
gcagacagauggccuggaa

SEQ ID NO: 49791 - RNA, 19 nt, Homo sapiens
cagaagaaguguuucagaa

SEQ ID NO: 49792 - RNA, 19 nt, Homo sapiens
gaaaagggcuuggagauga

SEQ ID NO: 49793 - RNA, 19 nt, Homo sapiens
cgagugagcuggacuugga

SEQ ID NO: 49794 - RNA, 19 nt, Homo sapiens
ggaaaccucuggcuaaucg

SEQ ID NO: 49795 - RNA, 19 nt, Homo sapiens
caggagcgcuuccgcauga

SEQ ID NO: 49796 - RNA, 19 nt, Homo sapiens
ugaaugggaucgaaguaaa

SEQ ID NO: 49797 - RNA, 19 nt, Homo sapiens
ggacacagcugagccaaac

SEQ ID NO: 49798 - RNA, 19 nt, Homo sapiens
uaaggaagaugaugagucu

SEQ ID NO: 49799 - RNA, 19 nt, Homo sapiens
cggagaggcugaagaagaa

SEQ ID NO: 49800 - RNA, 19 nt, Homo sapiens
ccacucagccacuggauuu

SEQ ID NO: 49801 - RNA, 19 nt, Homo sapiens
gcacgcugguccuccauga

SEQ ID NO: 49802 - RNA, 19 nt, Homo sapiens
aauaaacgcugcugcuuca

SEQ ID NO: 49803 - RNA, 19 nt, Homo sapiens
agaaggaggcagucaauaa

SEQ ID NO: 49804 - RNA, 19 nt, Homo sapiens
guaaagcucucggucaagu

SEQ ID NO: 49805 - RNA, 19 nt, Homo sapiens
gcaaaacgcagcaguauga

SEQ ID NO: 49806 - RNA, 19 nt, Homo sapiens
gagaccaucuucuucaaag

SEQ ID NO: 49807 - RNA, 19 nt, Homo sapiens
gcauuccgcugaccaucaa

SEQ ID NO: 49808 - RNA, 19 nt, Homo sapiens
uggaaacucugcucuacaa

SEQ ID NO: 49809 - RNA, 19 nt, Homo sapiens
cuacggaguugccauggaa

SEQ ID NO: 49810 - RNA, 19 nt, Homo sapiens
gaaggaggcagucaauaag

SEQ ID NO: 49811 - RNA, 19 nt, Homo sapiens
caagaacucucuggaaacu

SEQ ID NO: 49812 - RNA, 19 nt, Homo sapiens
gcacugcugcugcccauga

SEQ ID NO: 49813 - RNA, 19 nt, Homo sapiens
gacugcagcuccaaugaga

SEQ ID NO: 49814 - RNA, 19 nt, Homo sapiens
gaccaacucgugugugaaa

SEQ ID NO: 49815 - RNA, 19 nt, Homo sapiens
gagagaagagggcgaacaa

SEQ ID NO: 49816 - RNA, 19 nt, Homo sapiens
aaagauuucuacuggauca

SEQ ID NO: 49817 - RNA, 19 nt, Homo sapiens
gcagaagaaguguuucaga

SEQ ID NO: 49818 - RNA, 19 nt, Homo sapiens
augaggagcuggacgcuuu

SEQ ID NO: 49819 - RNA, 19 nt, Homo sapiens
accaagaacucucuggaaa

SEQ ID NO: 49820 - RNA, 19 nt, Homo sapiens
caaagugccugagcucuac

SEQ ID NO: 49821 - RNA, 19 nt, Homo sapiens
gauuuaagcagaguucaaa

SEQ ID NO: 49822 - RNA, 19 nt, Homo sapiens
ucaauaaggaagaugauga

SEQ ID NO: 49823 - RNA, 19 nt, Homo sapiens
ucgcagaacucgcaacagu

SEQ ID NO: 49824 - RNA, 19 nt, Homo sapiens
ccucuucacugacgaguuc

SEQ ID NO: 49825 - RNA, 19 nt, Homo sapiens
caggcacgcugaagcugua

SEQ ID NO: 49826 - RNA, 19 nt, Homo sapiens
agacguugcuggccaagga

SEQ ID NO: 49827 - RNA, 19 nt, Homo sapiens
agagugacauccagagaga

SEQ ID NO: 49828 - RNA, 19 nt, Homo sapiens
gcccugaaguccacuaaag

SEQ ID NO: 49829 - RNA, 19 nt, Homo sapiens
caagagacagcgacccaaa

SEQ ID NO: 49830 - RNA, 19 nt, Homo sapiens
gagaaggaggcagucaaua

SEQ ID NO: 49831 - RNA, 19 nt, Homo sapiens
gguccaaggugcccuacau

SEQ ID NO: 49832 - RNA, 19 nt, Homo sapiens
cagcugagccaaacuggaa

SEQ ID NO: 49833 - RNA, 19 nt, Homo sapiens
gaucuccucugacuaugag

SEQ ID NO: 49834 - RNA, 19 nt, Homo sapiens
gcaacaaagaugccaagga

SEQ ID NO: 49835 - RNA, 19 nt, Homo sapiens
ucaggccaaugcucaguuu

SEQ ID NO: 49836 - RNA, 19 nt, Homo sapiens
gaagugcugucaggccaau

SEQ ID NO: 49837 - RNA, 19 nt, Homo sapiens
aaguaaagcucucggucaa

SEQ ID NO: 49838 - RNA, 19 nt, Homo sapiens
gagcuggacgcuuugaaga

SEQ ID NO: 49839 - RNA, 19 nt, Homo sapiens
ucaaagugccugagcucua

SEQ ID NO: 49840 - RNA, 19 nt, Homo sapiens
gaucgagaccaucuucuuc

SEQ ID NO: 49841 - RNA, 19 nt, Homo sapiens
gagcaggagaagcgccuua

SEQ ID NO: 49842 - RNA, 19 nt, Homo sapiens
gugugaaacuccagacugu

SEQ ID NO: 49843 - RNA, 19 nt, Homo sapiens
ugaucuaccugcagacguu

SEQ ID NO: 49844 - RNA, 19 nt, Homo sapiens
gaaggucaacgacaaagag

SEQ ID NO: 49845 - RNA, 19 nt, Homo sapiens
ugagcgagauggacgugaa

SEQ ID NO: 49846 - RNA, 19 nt, Homo sapiens
cuacggagaggcugaagaa

SEQ ID NO: 49847 - RNA, 19 nt, Homo sapiens
gcuggacgcuuugaagauc

SEQ ID NO: 49848 - RNA, 19 nt, Homo sapiens
gaccaagaacucucuggaa

SEQ ID NO: 49849 - RNA, 19 nt, Homo sapiens
ucuacgagauccacaagga

SEQ ID NO: 49850 - RNA, 19 nt, Homo sapiens
ucuauggguuucugaaugu

SEQ ID NO: 49851 - RNA, 19 nt, Homo sapiens
cgacgucaauaacaaggau

SEQ ID NO: 49852 - RNA, 19 nt, Homo sapiens
gggagcagcagaagaagug

SEQ ID NO: 49853 - RNA, 19 nt, Homo sapiens
ccaaggauccaacgaccaa

SEQ ID NO: 49854 - RNA, 19 nt, Homo sapiens
uaaacgcugcugcuucaaa

SEQ ID NO: 49855 - RNA, 19 nt, Homo sapiens
caagcuggccucagacugu

SEQ ID NO: 49856 - RNA, 19 nt, Homo sapiens
guucuccaccgaagucuaa

SEQ ID NO: 49857 - RNA, 19 nt, Homo sapiens
caaccucgccacggucuuu

SEQ ID NO: 49858 - RNA, 19 nt, Homo sapiens
ucucccagaucaagaguga

SEQ ID NO: 49859 - RNA, 19 nt, Homo sapiens
ugccugagcucuacgagau

SEQ ID NO: 49860 - RNA, 19 nt, Homo sapiens
ccuggaaaccucuggcuaa

SEQ ID NO: 49861 - RNA, 19 nt, Homo sapiens
ugaaaaggguggcagagaa

SEQ ID NO: 49862 - RNA, 19 nt, Homo sapiens
gaccaucaauaaggaagau

SEQ ID NO: 49863 - RNA, 19 nt, Homo sapiens
gaagcagagcggaggcaaa

SEQ ID NO: 49864 - RNA, 19 nt, Homo sapiens
cggauucccucacuguugu

SEQ ID NO: 49865 - RNA, 19 nt, Homo sapiens
acaaggaugugucggugau

SEQ ID NO: 49866 - RNA, 19 nt, Homo sapiens
ggacauccaggcacugaag

SEQ ID NO: 49867 - RNA, 19 nt, Homo sapiens
agaacucucuggaaacucu

SEQ ID NO: 49868 - RNA, 19 nt, Homo sapiens
gccagaagcaacaaagaug

SEQ ID NO: 49869 - RNA, 19 nt, Homo sapiens
gggccuucguggacaacua

SEQ ID NO: 49870 - RNA, 19 nt, Homo sapiens
ggaggcagucaauaagaug

SEQ ID NO: 49871 - RNA, 19 nt, Homo sapiens
gaccaucuucuucaaagug

SEQ ID NO: 49872 - RNA, 19 nt, Homo sapiens
uggaggaggugggcaucua

SEQ ID NO: 49873 - RNA, 19 nt, Homo sapiens
uggauuccuuuggguauuu

SEQ ID NO: 49874 - RNA, 19 nt, Homo sapiens
ggauuuaagcagaguucaa

SEQ ID NO: 49875 - RNA, 19 nt, Homo sapiens
cugaccaacucguguguga

SEQ ID NO: 49876 - RNA, 19 nt, Homo sapiens
ccugaucuccucugacuau

SEQ ID NO: 49877 - RNA, 19 nt, Homo sapiens
ucacugcugcugcuuaugu

SEQ ID NO: 49878 - RNA, 19 nt, Homo sapiens
caagagugacauccagaga

SEQ ID NO: 49879 - RNA, 19 nt, Homo sapiens
cuacgaggacgccgaguug

SEQ ID NO: 49880 - RNA, 19 nt, Homo sapiens
cggcacgucuuccuguuca

SEQ ID NO: 49881 - RNA, 19 nt, Homo sapiens
cagcaucaaugaggagauc

SEQ ID NO: 49882 - RNA, 19 nt, Homo sapiens
ucacuguuguaucuugaau

SEQ ID NO: 49883 - RNA, 19 nt, Homo sapiens
aagggaacgugaccggauu

SEQ ID NO: 49884 - RNA, 19 nt, Homo sapiens
ucuacuggaucacuuguca

SEQ ID NO: 49885 - RNA, 19 nt, Homo sapiens
gaaugggaucgaaguaaag

SEQ ID NO: 49886 - RNA, 19 nt, Homo sapiens
gaaugucaucguccacuca

SEQ ID NO: 49887 - RNA, 19 nt, Homo sapiens
gauuucuacuggaucacuu

SEQ ID NO: 49888 - RNA, 19 nt, Homo sapiens
gaaggacaaucccuacuuu

SEQ ID NO: 49889 - RNA, 19 nt, Homo sapiens
gaacauguccuucgagcua

SEQ ID NO: 49890 - RNA, 19 nt, Homo sapiens
ggagguugcuuacuuguug

SEQ ID NO: 49891 - RNA, 19 nt, Homo sapiens
gcuaauccaugaaagguuu

SEQ ID NO: 49892 - RNA, 19 nt, Homo sapiens
gaguggaccugaaggagua

SEQ ID NO: 49893 - RNA, 19 nt, Homo sapiens
ccacuaaguuugaauuugu

SEQ ID NO: 49894 - RNA, 19 nt, Homo sapiens
ggaaauggauucggguaga

SEQ ID NO: 49895 - RNA, 19 nt, Homo sapiens
gaaauggauucggguagaa

SEQ ID NO: 49896 - RNA, 19 nt, Homo sapiens
ucagagacguccaggaauu

SEQ ID NO: 49897 - RNA, 19 nt, Homo sapiens
gcuggacccugcccugaua

SEQ ID NO: 49898 - RNA, 19 nt, Homo sapiens
cauauuugcuaaacaggua

SEQ ID NO: 49899 - RNA, 19 nt, Homo sapiens
gcucagcucuccuccucua

SEQ ID NO: 49900 - RNA, 19 nt, Homo sapiens
ggaaagagcaguuuuauca

SEQ ID NO: 49901 - RNA, 19 nt, Homo sapiens
auaaacaucugccacacua

SEQ ID NO: 49902 - RNA, 19 nt, Homo sapiens
ggaguugggagguugcuua

SEQ ID NO: 49903 - RNA, 19 nt, Homo sapiens
gcuacuucaugcuguauaa

SEQ ID NO: 49904 - RNA, 19 nt, Homo sapiens
agacguggcuaccugcuuu

SEQ ID NO: 49905 - RNA, 19 nt, Homo sapiens
cggcggaucuuauugucua

SEQ ID NO: 49906 - RNA, 19 nt, Homo sapiens
cuucguaccuucagcauga

SEQ ID NO: 49907 - RNA, 19 nt, Homo sapiens
guccaggaauucaucgaua

SEQ ID NO: 49908 - RNA, 19 nt, Homo sapiens
guugggagguugcuuacuu

SEQ ID NO: 49909 - RNA, 19 nt, Homo sapiens
ccuguaagguuugguguuu

SEQ ID NO: 49910 - RNA, 19 nt, Homo sapiens
gaugccacuuucagacuuu

SEQ ID NO: 49911 - RNA, 19 nt, Homo sapiens
gcaggcaccuuccuuagcu

SEQ ID NO: 49912 - RNA, 19 nt, Homo sapiens
gaacuuugcagaacauguc

SEQ ID NO: 49913 - RNA, 19 nt, Homo sapiens
gcauuuccacuaaguuuga

SEQ ID NO: 49914 - RNA, 19 nt, Homo sapiens
gcaugagaguggccgcauu

SEQ ID NO: 49915 - RNA, 19 nt, Homo sapiens
aaacaucugccacacuaaa

SEQ ID NO: 49916 - RNA, 19 nt, Homo sapiens
guacucagcaccucagugu

SEQ ID NO: 49917 - RNA, 19 nt, Homo sapiens
ggucacggcggaucuuauu

SEQ ID NO: 49918 - RNA, 19 nt, Homo sapiens
uuccuuagcugagaacuuu

SEQ ID NO: 49919 - RNA, 19 nt, Homo sapiens
gcaccuuccuuagcugaga

SEQ ID NO: 49920 - RNA, 19 nt, Homo sapiens
ggagaacccaguaaaguac

SEQ ID NO: 49921 - RNA, 19 nt, Homo sapiens
gacgauccguggagaaagu

SEQ ID NO: 49922 - RNA, 19 nt, Homo sapiens
ggaagaccgugauguacac

SEQ ID NO: 49923 - RNA, 19 nt, Homo sapiens
gagagaugcagaugauaga

SEQ ID NO: 49924 - RNA, 19 nt, Homo sapiens
gcugagaacuuugcagaac

SEQ ID NO: 49925 - RNA, 19 nt, Homo sapiens
uggagaacccaguaaagua

SEQ ID NO: 49926 - RNA, 19 nt, Homo sapiens
agaacgaagucgagagaug

SEQ ID NO: 49927 - RNA, 19 nt, Homo sapiens
uccaggaauucaucgauaa

SEQ ID NO: 49928 - RNA, 19 nt, Homo sapiens
guagaacgaagucgagaga

SEQ ID NO: 49929 - RNA, 19 nt, Homo sapiens
ugaauucugugguucuaca

SEQ ID NO: 49930 - RNA, 19 nt, Homo sapiens
gucgagagaugcagaugau

SEQ ID NO: 49931 - RNA, 19 nt, Homo sapiens
guggcuaccugcuuuaugg

SEQ ID NO: 49932 - RNA, 19 nt, Homo sapiens
caugagaguggccgcauuu

SEQ ID NO: 49933 - RNA, 19 nt, Homo sapiens
ggauguggaugcugcuuuu

SEQ ID NO: 49934 - RNA, 19 nt, Homo sapiens
cagaggcauuccuuacaga

SEQ ID NO: 49935 - RNA, 19 nt, Homo sapiens
ggcgaccacugaauucugu

SEQ ID NO: 49936 - RNA, 19 nt, Homo sapiens
guguuucccuuucaagaug

SEQ ID NO: 49937 - RNA, 19 nt, Homo sapiens
gagguugcuuacuuguuga

SEQ ID NO: 49938 - RNA, 19 nt, Homo sapiens
ugucagagacguccaggaa

SEQ ID NO: 49939 - RNA, 19 nt, Homo sapiens
gggaagaccgugauguaca

SEQ ID NO: 49940 - RNA, 19 nt, Homo sapiens
gccauuacaugaucacacu

SEQ ID NO: 49941 - RNA, 19 nt, Homo sapiens
gcaccucagugucgagacu

SEQ ID NO: 49942 - RNA, 19 nt, Homo sapiens
uugcguauuugcauauuug

SEQ ID NO: 49943 - RNA, 19 nt, Homo sapiens
ugagaacuuugcagaacau

SEQ ID NO: 49944 - RNA, 19 nt, Homo sapiens
gaacuggagcacagcaucu

SEQ ID NO: 49945 - RNA, 19 nt, Homo sapiens
aagggaagaccgugaugua

SEQ ID NO: 49946 - RNA, 19 nt, Homo sapiens
cauauuuguugcguauuug

SEQ ID NO: 49947 - RNA, 19 nt, Homo sapiens
gacagaggcauuccuuaca

SEQ ID NO: 49948 - RNA, 19 nt, Homo sapiens
cgagagaugcagaugauag

SEQ ID NO: 49949 - RNA, 19 nt, Homo sapiens
gagaguggccgcauuucca

SEQ ID NO: 49950 - RNA, 19 nt, Homo sapiens
agcuaugccugguugcuua

SEQ ID NO: 49951 - RNA, 19 nt, Homo sapiens
gaagggaagaccgugaugu

SEQ ID NO: 49952 - RNA, 19 nt, Homo sapiens
agaugcagaugauagacuu

SEQ ID NO: 49953 - RNA, 19 nt, Homo sapiens
ugaaggacaaucccuacuu

SEQ ID NO: 49954 - RNA, 19 nt, Homo sapiens
ccgcauuuccacuaaguuu

SEQ ID NO: 49955 - RNA, 19 nt, Homo sapiens
ucaagaugccacuuucaga

SEQ ID NO: 49956 - RNA, 19 nt, Homo sapiens
gagcuaauccaugaaaggu

SEQ ID NO: 49957 - RNA, 19 nt, Homo sapiens
acuccagccucucugauga

SEQ ID NO: 49958 - RNA, 19 nt, Homo sapiens
gcacugaccgaaagguuuu

SEQ ID NO: 49959 - RNA, 19 nt, Homo sapiens
ccggaaggguguccaacug

SEQ ID NO: 49960 - RNA, 19 nt, Homo sapiens
cguauuugcauauuugcua

SEQ ID NO: 49961 - RNA, 19 nt, Homo sapiens
guugcguauuugcauauuu

SEQ ID NO: 49962 - RNA, 19 nt, Homo sapiens
ugacagaggcauuccuuac

SEQ ID NO: 49963 - RNA, 19 nt, Homo sapiens
gcccgcaucguguucauga

SEQ ID NO: 49964 - RNA, 19 nt, Homo sapiens
agacuuggcuguggagaac

SEQ ID NO: 49965 - RNA, 19 nt, Homo sapiens
ggcacugaccgaaagguuu

SEQ ID NO: 49966 - RNA, 19 nt, Homo sapiens
ggaagggaagaccgugaug

SEQ ID NO: 49967 - RNA, 19 nt, Homo sapiens
cuuauugucuacgauguga

SEQ ID NO: 49968 - RNA, 19 nt, Homo sapiens
gguuugguguuucccuuuc

SEQ ID NO: 49969 - RNA, 19 nt, Homo sapiens
cagguaguguuaggagcua

SEQ ID NO: 49970 - RNA, 19 nt, Homo sapiens
uccucuagcucaauaaaca

SEQ ID NO: 49971 - RNA, 19 nt, Homo sapiens
gagacuuggcuguggagaa

SEQ ID NO: 49972 - RNA, 19 nt, Homo sapiens
gggaaucugucaccuucac

SEQ ID NO: 49973 - RNA, 19 nt, Homo sapiens
ggccgcauuuccacuaagu

SEQ ID NO: 49974 - RNA, 19 nt, Homo sapiens
guggagaacccaguaaagu

SEQ ID NO: 49975 - RNA, 19 nt, Homo sapiens
acagaggcauuccuuacag

SEQ ID NO: 49976 - RNA, 19 nt, Homo sapiens
guacacugacagaggcauu

SEQ ID NO: 49977 - RNA, 19 nt, Homo sapiens
ucacggcggaucuuauugu

SEQ ID NO: 49978 - RNA, 19 nt, Homo sapiens
aguagcagaugggcagauu

SEQ ID NO: 49979 - RNA, 19 nt, Homo sapiens
gagcuaugccugguugcuu

SEQ ID NO: 49980 - RNA, 19 nt, Homo sapiens
cuccuccucuagcucaaua

SEQ ID NO: 49981 - RNA, 19 nt, Homo sapiens
gcagcugacccagauguuc

SEQ ID NO: 49982 - RNA, 19 nt, Homo sapiens
ggagcuaauccaugaaagg

SEQ ID NO: 49983 - RNA, 19 nt, Homo sapiens
gugacgauccguggagaaa

SEQ ID NO: 49984 - RNA, 19 nt, Homo sapiens
uaggagcuaauccaugaaa

SEQ ID NO: 49985 - RNA, 19 nt, Homo sapiens
gguguuucccuuucaagau

SEQ ID NO: 49986 - RNA, 19 nt, Homo sapiens
gcaauucacaaugcugagu

SEQ ID NO: 49987 - RNA, 19 nt, Homo sapiens
cugagaacuuugcagaaca

SEQ ID NO: 49988 - RNA, 19 nt, Homo sapiens
ggaaugacuucuuugcaua

SEQ ID NO: 49989 - RNA, 19 nt, Homo sapiens
ggagauaauuucauacaga

SEQ ID NO: 49990 - RNA, 19 nt, Homo sapiens
ccaagcaucugcauucaaa

SEQ ID NO: 49991 - RNA, 19 nt, Homo sapiens
gcgaagagguggagaaagu

SEQ ID NO: 49992 - RNA, 19 nt, Homo sapiens
gaagacccauaacugguuu

SEQ ID NO: 49993 - RNA, 19 nt, Homo sapiens
gaacugggccauucuaaca

SEQ ID NO: 49994 - RNA, 19 nt, Homo sapiens
gcaagaaguacuuugauga

SEQ ID NO: 49995 - RNA, 19 nt, Homo sapiens
gggcaaacauggugaaucu

SEQ ID NO: 49996 - RNA, 19 nt, Homo sapiens
gcaaacauggugaaucuau

SEQ ID NO: 49997 - RNA, 19 nt, Homo sapiens
gggaaugacuucuuugcau

SEQ ID NO: 49998 - RNA, 19 nt, Homo sapiens
uagagggaaugacuucuuu

SEQ ID NO: 49999 - RNA, 19 nt, Homo sapiens
ggagggaggaacccauaua

SEQ ID NO: 50000 - RNA, 19 nt, Homo sapiens
ugacuucuuugcauaguga

SEQ ID NO: 50001 - RNA, 19 nt, Homo sapiens
ggaagacccauaacugguu

SEQ ID NO: 50002 - RNA, 19 nt, Homo sapiens
ggaggaacccauauaguca

SEQ ID NO: 50003 - RNA, 19 nt, Homo sapiens
caagaaguacuuugaugaa

SEQ ID NO: 50004 - RNA, 19 nt, Homo sapiens
ggcaagaaguacuuugaug

SEQ ID NO: 50005 - RNA, 19 nt, Homo sapiens
ccuaaacagugaccgauug

SEQ ID NO: 50006 - RNA, 19 nt, Homo sapiens
ggauuuggguucucauugg

SEQ ID NO: 50007 - RNA, 19 nt, Homo sapiens
gggaggaacugggccauuc

SEQ ID NO: 50008 - RNA, 19 nt, Homo sapiens
ggagcaagacgcccacuau

SEQ ID NO: 50009 - RNA, 19 nt, Homo sapiens
cuccggagauaauuucaua

SEQ ID NO: 50010 - RNA, 19 nt, Homo sapiens
uggcagaagugaaccuuug

SEQ ID NO: 50011 - RNA, 19 nt, Homo sapiens
gagcaagacgcccacuauu

SEQ ID NO: 50012 - RNA, 19 nt, Homo sapiens
gaacccauauagucaacuc

SEQ ID NO: 50013 - RNA, 19 nt, Homo sapiens
agaaagugguggagauugu

SEQ ID NO: 50014 - RNA, 19 nt, Homo sapiens
ugacuugggccuucacaaa

SEQ ID NO: 50015 - RNA, 19 nt, Homo sapiens
ggagaaagugguggagauu

SEQ ID NO: 50016 - RNA, 19 nt, Homo sapiens
gggaggaacccauauaguc

SEQ ID NO: 50017 - RNA, 19 nt, Homo sapiens
ugucacggcucccaggaaa

SEQ ID NO: 50018 - RNA, 19 nt, Homo sapiens
caaacauggugaaucuauc

SEQ ID NO: 50019 - RNA, 19 nt, Homo sapiens
uuacagcccugagagcauu

SEQ ID NO: 50020 - RNA, 19 nt, Homo sapiens
ucgccaagauggagaccua

SEQ ID NO: 50021 - RNA, 19 nt, Homo sapiens
aaacagugaccgauugaga

SEQ ID NO: 50022 - RNA, 19 nt, Homo sapiens
ugucaucgaugcugucaca

SEQ ID NO: 50023 - RNA, 19 nt, Homo sapiens
gaaccguccagcucaaugu

SEQ ID NO: 50024 - RNA, 19 nt, Homo sapiens
acaagcagguggcagaagu

SEQ ID NO: 50025 - RNA, 19 nt, Homo sapiens
uaacacccguugcuaccau

SEQ ID NO: 50026 - RNA, 19 nt, Homo sapiens
ccaggaagacccauaacug

SEQ ID NO: 50027 - RNA, 19 nt, Homo sapiens
ugaaggacccugagaaagg

SEQ ID NO: 50028 - RNA, 19 nt, Homo sapiens
gaaugacuucuuugcauag

SEQ ID NO: 50029 - RNA, 19 nt, Homo sapiens
ccuaagugccugugauaga

SEQ ID NO: 50030 - RNA, 19 nt, Homo sapiens
gagaaagugguggagauug

SEQ ID NO: 50031 - RNA, 19 nt, Homo sapiens
ggagccgguuggcagcaaa

SEQ ID NO: 50032 - RNA, 19 nt, Homo sapiens
gaggaacugggccauucua

SEQ ID NO: 50033 - RNA, 19 nt, Homo sapiens
gaggaacccauauagucaa

SEQ ID NO: 50034 - RNA, 19 nt, Homo sapiens
gagggaggaacccauauag

SEQ ID NO: 50035 - RNA, 19 nt, Homo sapiens
gaucuacauccgcugaaga

SEQ ID NO: 50036 - RNA, 19 nt, Homo sapiens
gcaaggacuacggcaagaa

SEQ ID NO: 50037 - RNA, 19 nt, Homo sapiens
cguacugcaucaccaaguu

SEQ ID NO: 50038 - RNA, 19 nt, Homo sapiens
gcuugguucuacuuccuuu

SEQ ID NO: 50039 - RNA, 19 nt, Homo sapiens
cuaagugccugugauagag

SEQ ID NO: 50040 - RNA, 19 nt, Homo sapiens
gcagguggcagaagugaac

SEQ ID NO: 50041 - RNA, 19 nt, Homo sapiens
ccugaaggacccugagaaa

SEQ ID NO: 50042 - RNA, 19 nt, Homo sapiens
gaaggacaaaggccaugau

SEQ ID NO: 50043 - RNA, 19 nt, Homo sapiens
ggccaagcaucugcauuca

SEQ ID NO: 50044 - RNA, 19 nt, Homo sapiens
uggagaaagugguggagau

SEQ ID NO: 50045 - RNA, 19 nt, Homo sapiens
cggacugccugcgcuauga

SEQ ID NO: 50046 - RNA, 19 nt, Homo sapiens
gcagcgaagagguggagaa

SEQ ID NO: 50047 - RNA, 19 nt, Homo sapiens
uggacagccuaaacaguga

SEQ ID NO: 50048 - RNA, 19 nt, Homo sapiens
uuugcuggcugcuugauga

SEQ ID NO: 50049 - RNA, 19 nt, Homo sapiens
uaacuagagggaaugacuu

SEQ ID NO: 50050 - RNA, 19 nt, Homo sapiens
gcagaucaugacccacuug

SEQ ID NO: 50051 - RNA, 19 nt, Homo sapiens
cagcgaagagguggagaaa

SEQ ID NO: 50052 - RNA, 19 nt, Homo sapiens
uacauccgcugaagagucu

SEQ ID NO: 50053 - RNA, 19 nt, Homo sapiens
cccauauagucaacucuug

SEQ ID NO: 50054 - RNA, 19 nt, Homo sapiens
uagagaaaauggagcaaga

SEQ ID NO: 50055 - RNA, 19 nt, Homo sapiens
cuaaacagugaccgauuga

SEQ ID NO: 50056 - RNA, 19 nt, Homo sapiens
gcugcuugaugaaggacaa

SEQ ID NO: 50057 - RNA, 19 nt, Homo sapiens
cgauuggccgucggacuua

SEQ ID NO: 50058 - RNA, 19 nt, Homo sapiens
aaacauggugaaucuaucu

SEQ ID NO: 50059 - RNA, 19 nt, Homo sapiens
ggaggggcuuccagaaaga

SEQ ID NO: 50060 - RNA, 19 nt, Homo sapiens
ggcugugacucuggauuug

SEQ ID NO: 50061 - RNA, 19 nt, Homo sapiens
agcaagacgcccacuauug

SEQ ID NO: 50062 - RNA, 19 nt, Homo sapiens
ggaacugggccauucuaac

SEQ ID NO: 50063 - RNA, 19 nt, Homo sapiens
ggacuacggcaagaaguac

SEQ ID NO: 50064 - RNA, 19 nt, Homo sapiens
caaggacuacggcaagaag

SEQ ID NO: 50065 - RNA, 19 nt, Homo sapiens
gaaagugguggagauuguc

SEQ ID NO: 50066 - RNA, 19 nt, Homo sapiens
cuaaaucucagggcaaaca

SEQ ID NO: 50067 - RNA, 19 nt, Homo sapiens
ucuccgacaugaucuacau

SEQ ID NO: 50068 - RNA, 19 nt, Homo sapiens
cagugcggaugacgaaauc

SEQ ID NO: 50069 - RNA, 19 nt, Homo sapiens
guacugcaucaccaaguuc

SEQ ID NO: 50070 - RNA, 19 nt, Homo sapiens
gauuggccgucggacuuau

SEQ ID NO: 50071 - RNA, 19 nt, Homo sapiens
cuagagggaaugacuucuu

SEQ ID NO: 50072 - RNA, 19 nt, Homo sapiens
aacacuaacuagagggaau

SEQ ID NO: 50073 - RNA, 19 nt, Homo sapiens
uggccaagcaucugcauuc

SEQ ID NO: 50074 - RNA, 19 nt, Homo sapiens
gcaauuggccaacuucuuu

SEQ ID NO: 50075 - RNA, 19 nt, Homo sapiens
gaacguggcagaaaucuac

SEQ ID NO: 50076 - RNA, 19 nt, Homo sapiens
aaacagcauugaaccaaga

SEQ ID NO: 50077 - RNA, 19 nt, Homo sapiens
acagagugcugccaacauu

SEQ ID NO: 50078 - RNA, 19 nt, Homo sapiens
caaggauuguggaguuaaa

SEQ ID NO: 50079 - RNA, 19 nt, Homo sapiens
ccucugaucugguguuugu

SEQ ID NO: 50080 - RNA, 19 nt, Homo sapiens
ccaauaucuucaucccaua

SEQ ID NO: 50081 - RNA, 19 nt, Homo sapiens
caacauuuaucaucuccau

SEQ ID NO: 50082 - RNA, 19 nt, Homo sapiens
ucugggaacuuuauaaaca

SEQ ID NO: 50083 - RNA, 19 nt, Homo sapiens
caugaggccuggcacuuug

SEQ ID NO: 50084 - RNA, 19 nt, Homo sapiens
caacugaacguggcagaaa

SEQ ID NO: 50085 - RNA, 19 nt, Homo sapiens
caucaaggccaauuuguuc

SEQ ID NO: 50086 - RNA, 19 nt, Homo sapiens
ggucugggaacuuuauaaa

SEQ ID NO: 50087 - RNA, 19 nt, Homo sapiens
acuaacagcucccugaauc

SEQ ID NO: 50088 - RNA, 19 nt, Homo sapiens
caacuuuucuggcggaauu

SEQ ID NO: 50089 - RNA, 19 nt, Homo sapiens
agagugcugccaacauuua

SEQ ID NO: 50090 - RNA, 19 nt, Homo sapiens
gaaaacuccuccaaaagca

SEQ ID NO: 50091 - RNA, 19 nt, Homo sapiens
gcaaggauuguggaguuaa

SEQ ID NO: 50092 - RNA, 19 nt, Homo sapiens
ccucgaccuuccaggcuua

SEQ ID NO: 50093 - RNA, 19 nt, Homo sapiens
uaaaagucuugcuccaaua

SEQ ID NO: 50094 - RNA, 19 nt, Homo sapiens
ggauuguggaguuaaauau

SEQ ID NO: 50095 - RNA, 19 nt, Homo sapiens
uugcaaggauuguggaguu

SEQ ID NO: 50096 - RNA, 19 nt, Homo sapiens
ggucaucaaggccaauuug

SEQ ID NO: 50097 - RNA, 19 nt, Homo sapiens
cuuccaggcuuaaacgauu

SEQ ID NO: 50098 - RNA, 19 nt, Homo sapiens
caacuucuuugccuucacu

SEQ ID NO: 50099 - RNA, 19 nt, Homo sapiens
ggaacuuuauaaacaaugc

SEQ ID NO: 50100 - RNA, 19 nt, Homo sapiens
agccagcucuucccucaaa

SEQ ID NO: 50101 - RNA, 19 nt, Homo sapiens
gcagcucucacuaucagaa

SEQ ID NO: 50102 - RNA, 19 nt, Homo sapiens
gcgaucgucuucuucaacu

SEQ ID NO: 50103 - RNA, 19 nt, Homo sapiens
caaggucugggaacuuuau

SEQ ID NO: 50104 - RNA, 19 nt, Homo sapiens
ccaguaauuuaugucuuug

SEQ ID NO: 50105 - RNA, 19 nt, Homo sapiens
gcuacggccugugacaaug

SEQ ID NO: 50106 - RNA, 19 nt, Homo sapiens
accaaggucugggaacuuu

SEQ ID NO: 50107 - RNA, 19 nt, Homo sapiens
gaccugggccugcaauugg

SEQ ID NO: 50108 - RNA, 19 nt, Homo sapiens
ugcaaggauuguggaguua

SEQ ID NO: 50109 - RNA, 19 nt, Homo sapiens
ccaauuuguucaucagcau

SEQ ID NO: 50110 - RNA, 19 nt, Homo sapiens
uuuaucaucuccaucuguu

SEQ ID NO: 50111 - RNA, 19 nt, Homo sapiens
gaggaggucagcaggacaa

SEQ ID NO: 50112 - RNA, 19 nt, Homo sapiens
ccaugaggccuggcacuuu

SEQ ID NO: 50113 - RNA, 19 nt, Homo sapiens
cccugaauccaguaauuua

SEQ ID NO: 50114 - RNA, 19 nt, Homo sapiens
cauccaagccgucccagau

SEQ ID NO: 50115 - RNA, 19 nt, Homo sapiens
caccucagccucucgaguu

SEQ ID NO: 50116 - RNA, 19 nt, Homo sapiens
cuaaaagucuugcuccaau

SEQ ID NO: 50117 - RNA, 19 nt, Homo sapiens
aaaagcagcucucacuauc

SEQ ID NO: 50118 - RNA, 19 nt, Homo sapiens
caaaagcagcucucacuau

SEQ ID NO: 50119 - RNA, 19 nt, Homo sapiens
cugggaacuuuauaaacaa

SEQ ID NO: 50120 - RNA, 19 nt, Homo sapiens
gaggucagcaggacaaggu

SEQ ID NO: 50121 - RNA, 19 nt, Homo sapiens
uggcugcgaucgucuucuu

SEQ ID NO: 50122 - RNA, 19 nt, Homo sapiens
aaacaaugcaccccuaaaa

SEQ ID NO: 50123 - RNA, 19 nt, Homo sapiens
aagcagcucucacuaucag

SEQ ID NO: 50124 - RNA, 19 nt, Homo sapiens
caaggccaauuuguucauc

SEQ ID NO: 50125 - RNA, 19 nt, Homo sapiens
uaucaucuccaucuguuuc

SEQ ID NO: 50126 - RNA, 19 nt, Homo sapiens
uauucuggguuuccuccua

SEQ ID NO: 50127 - RNA, 19 nt, Homo sapiens
ucacuaacagcucccugaa

SEQ ID NO: 50128 - RNA, 19 nt, Homo sapiens
gaucgucuucuucaacuac

SEQ ID NO: 50129 - RNA, 19 nt, Homo sapiens
ucaucaaggccaauuuguu

SEQ ID NO: 50130 - RNA, 19 nt, Homo sapiens
gcaacugaacguggcagaa

SEQ ID NO: 50131 - RNA, 19 nt, Homo sapiens
ggaauuaaaacagcauuga

SEQ ID NO: 50132 - RNA, 19 nt, Homo sapiens
ccaaggucugggaacuuua

SEQ ID NO: 50133 - RNA, 19 nt, Homo sapiens
caaccuggcagccucugau

SEQ ID NO: 50134 - RNA, 19 nt, Homo sapiens
cagagugcugccaacauuu

SEQ ID NO: 50135 - RNA, 19 nt, Homo sapiens
cucccugaauccaguaauu

SEQ ID NO: 50136 - RNA, 19 nt, Homo sapiens
caauuggccaacuucuuug

SEQ ID NO: 50137 - RNA, 19 nt, Homo sapiens
ugaccugggccugcaauug

SEQ ID NO: 50138 - RNA, 19 nt, Homo sapiens
gugcugccaacauuuauca

SEQ ID NO: 50139 - RNA, 19 nt, Homo sapiens
gggaccugcugcacagagu

SEQ ID NO: 50140 - RNA, 19 nt, Homo sapiens
uaacagcucccugaaucca

SEQ ID NO: 50141 - RNA, 19 nt, Homo sapiens
cugccaacauuuaucaucu

SEQ ID NO: 50142 - RNA, 19 nt, Homo sapiens
ccugaauccaguaauuuau

SEQ ID NO: 50143 - RNA, 19 nt, Homo sapiens
gagaaaacuccuccaaaag

SEQ ID NO: 50144 - RNA, 19 nt, Homo sapiens
cgaucgucuucuucaacua

SEQ ID NO: 50145 - RNA, 19 nt, Homo sapiens
aggauuguggaguuaaaua

SEQ ID NO: 50146 - RNA, 19 nt, Homo sapiens
gcacuuugcaaggauugug

SEQ ID NO: 50147 - RNA, 19 nt, Homo sapiens
gaacaucuguccugugaaa

SEQ ID NO: 50148 - RNA, 19 nt, Homo sapiens
ucaaugagcuguuauguug

SEQ ID NO: 50149 - RNA, 19 nt, Homo sapiens
acacugaggucuagaaaua

SEQ ID NO: 50150 - RNA, 19 nt, Homo sapiens
gcuagaaccuggagaauga

SEQ ID NO: 50151 - RNA, 19 nt, Homo sapiens
guaaguaucuggaggaaga

SEQ ID NO: 50152 - RNA, 19 nt, Homo sapiens
gcuagaagcuggaggacua

SEQ ID NO: 50153 - RNA, 19 nt, Homo sapiens
gcuagaaccuggagaacua

SEQ ID NO: 50154 - RNA, 19 nt, Homo sapiens
gcuagaaccuguagagcua

SEQ ID NO: 50155 - RNA, 19 nt, Homo sapiens
gcuagaaucuggagagcua

SEQ ID NO: 50156 - RNA, 19 nt, Homo sapiens
gcuagaaucuggagagcua

SEQ ID NO: 50157 - RNA, 19 nt, Homo sapiens
uugcauagcucuagcauuu

SEQ ID NO: 50158 - RNA, 19 nt, Homo sapiens
gaacuuugaaggacaauuu

SEQ ID NO: 50159 - RNA, 19 nt, Homo sapiens
gaacugccauccagcuuug

SEQ ID NO: 50160 - RNA, 19 nt, Homo sapiens
gcuagaaccuggcaagcua

SEQ ID NO: 50161 - RNA, 19 nt, Homo sapiens
gcuagaaccuggagagcua

SEQ ID NO: 50162 - RNA, 19 nt, Homo sapiens
gaaaacaggugaaagaaga

SEQ ID NO: 50163 - RNA, 19 nt, Homo sapiens
ggcaagcgcuuccgaaaga

SEQ ID NO: 50164 - RNA, 19 nt, Homo sapiens
gcaaagagcccauaaaucc

SEQ ID NO: 50165 - RNA, 19 nt, Homo sapiens
ucaguucccucuucuguaa

SEQ ID NO: 50166 - RNA, 19 nt, Homo sapiens
gcauuacuguucuuauuug

SEQ ID NO: 50167 - RNA, 19 nt, Homo sapiens
gcuagaacauggagagcua

SEQ ID NO: 50168 - RNA, 19 nt, Homo sapiens
gcuggaaucuggagagcua

SEQ ID NO: 50169 - RNA, 19 nt, Homo sapiens
gcuggaaucuggagagcua

SEQ ID NO: 50170 - RNA, 19 nt, Homo sapiens
gcuggaaucuggagagcua

SEQ ID NO: 50171 - RNA, 19 nt, Homo sapiens
ggaggucugugccaaagaa

SEQ ID NO: 50172 - RNA, 19 nt, Homo sapiens
cagcauuacuguucuuauu

SEQ ID NO: 50173 - RNA, 19 nt, Homo sapiens
ccaaagaagaauccaauaa

SEQ ID NO: 50174 - RNA, 19 nt, Homo sapiens
aagaacaucuguccuguga

SEQ ID NO: 50175 - RNA, 19 nt, Homo sapiens
uagaugcccugauaaagaa

SEQ ID NO: 50176 - RNA, 19 nt, Homo sapiens
guagaugcccugauaaaga

SEQ ID NO: 50177 - RNA, 19 nt, Homo sapiens
gggcagcacucauucacuu

SEQ ID NO: 50178 - RNA, 19 nt, Homo sapiens
gcauagcucuagcauuugu

SEQ ID NO: 50179 - RNA, 19 nt, Homo sapiens
gcuagaaccuggagggaau

SEQ ID NO: 50180 - RNA, 19 nt, Homo sapiens
gaguugaugucuccgguaa

SEQ ID NO: 50181 - RNA, 19 nt, Homo sapiens
acaacgagaugcagaaguu

SEQ ID NO: 50182 - RNA, 19 nt, Homo sapiens
gaaggacaauuucuugcau

SEQ ID NO: 50183 - RNA, 19 nt, Homo sapiens
gagcuucccucccgugugu

SEQ ID NO: 50184 - RNA, 19 nt, Homo sapiens
ucaguggucuccaagcuuu

SEQ ID NO: 50185 - RNA, 19 nt, Homo sapiens
ggaagcauuucacauccaa

SEQ ID NO: 50186 - RNA, 19 nt, Homo sapiens
gcacgaccuugggaaauga

SEQ ID NO: 50187 - RNA, 19 nt, Homo sapiens
guaugaagauguacauucu

SEQ ID NO: 50188 - RNA, 19 nt, Homo sapiens
ggaagguggcccaguauga

SEQ ID NO: 50189 - RNA, 19 nt, Homo sapiens
agacguaacugggauaugu

SEQ ID NO: 50190 - RNA, 19 nt, Homo sapiens
ucacacagaucgccuccuu

SEQ ID NO: 50191 - RNA, 19 nt, Homo sapiens
gaagaaaacaggugaaaga

SEQ ID NO: 50192 - RNA, 19 nt, Homo sapiens
gcccauaaauccugaccaa

SEQ ID NO: 50193 - RNA, 19 nt, Homo sapiens
guagaucaguggucuccaa

SEQ ID NO: 50194 - RNA, 19 nt, Homo sapiens
gaaccaagaagggcuagaa

SEQ ID NO: 50195 - RNA, 19 nt, Homo sapiens
gcacucauucacuugauaa

SEQ ID NO: 50196 - RNA, 19 nt, Homo sapiens
gcacugccaccaccagaaa

SEQ ID NO: 50197 - RNA, 19 nt, Homo sapiens
caaagaagaauccaauaag

SEQ ID NO: 50198 - RNA, 19 nt, Homo sapiens
gaauuuguguaaggauuga

SEQ ID NO: 50199 - RNA, 19 nt, Homo sapiens
ggucagaacccauucagau

SEQ ID NO: 50200 - RNA, 19 nt, Homo sapiens
caacuucgacuggcucuuu

SEQ ID NO: 50201 - RNA, 19 nt, Homo sapiens
aaugagcuguuauguugua

SEQ ID NO: 50202 - RNA, 19 nt, Homo sapiens
ccaauccaacucugaauuu

SEQ ID NO: 50203 - RNA, 19 nt, Homo sapiens
uggaagauaucaauguuuc

SEQ ID NO: 50204 - RNA, 19 nt, Homo sapiens
gaaccuggagaaugagaaa

SEQ ID NO: 50205 - RNA, 19 nt, Homo sapiens
cagaggaagauauuucuaa

SEQ ID NO: 50206 - RNA, 19 nt, Homo sapiens
ggccaugucuucaaagucu

SEQ ID NO: 50207 - RNA, 19 nt, Homo sapiens
uaaaggcaguaacagguau

SEQ ID NO: 50208 - RNA, 19 nt, Homo sapiens
gcagggagcauggcuguga

SEQ ID NO: 50209 - RNA, 19 nt, Homo sapiens
gagcauaauaaauggauga

SEQ ID NO: 50210 - RNA, 19 nt, Homo sapiens
ugguguagaugcccugaua

SEQ ID NO: 50211 - RNA, 19 nt, Homo sapiens
guacaugugaggcaucauu

SEQ ID NO: 50212 - RNA, 19 nt, Homo sapiens
caagagggaagaaagagaa

SEQ ID NO: 50213 - RNA, 19 nt, Homo sapiens
aggacaauuucuugcauua

SEQ ID NO: 50214 - RNA, 19 nt, Homo sapiens
gcuaaaaccugagcuagaa

SEQ ID NO: 50215 - RNA, 19 nt, Homo sapiens
gcaguaacagguauaaagu

SEQ ID NO: 50216 - RNA, 19 nt, Homo sapiens
caaaaucacaacagcauua

SEQ ID NO: 50217 - RNA, 19 nt, Homo sapiens
gaucagcaccuuccuggau

SEQ ID NO: 50218 - RNA, 19 nt, Homo sapiens
ccacacauggugaaugaaa

SEQ ID NO: 50219 - RNA, 19 nt, Homo sapiens
ggacaauuucuugcauuaa

SEQ ID NO: 50220 - RNA, 19 nt, Homo sapiens
guaaaacaccggagacuaa

SEQ ID NO: 50221 - RNA, 19 nt, Homo sapiens
gugaauuuguguaaggauu

SEQ ID NO: 50222 - RNA, 19 nt, Homo sapiens
gaacucaaagacucaagug

SEQ ID NO: 50223 - RNA, 19 nt, Homo sapiens
gaaggaacucaaagacuca

SEQ ID NO: 50224 - RNA, 19 nt, Homo sapiens
gaucaguggucuccaagcu

SEQ ID NO: 50225 - RNA, 19 nt, Homo sapiens
gagcuguuauguuguaaac

SEQ ID NO: 50226 - RNA, 19 nt, Homo sapiens
ccauaaauccugaccaauc

SEQ ID NO: 50227 - RNA, 19 nt, Homo sapiens
gaaccuggagggcuagaau

SEQ ID NO: 50228 - RNA, 19 nt, Homo sapiens
gaaccuggagggcuagaau

SEQ ID NO: 50229 - RNA, 19 nt, Homo sapiens
ccuggaagauaucaauguu

SEQ ID NO: 50230 - RNA, 19 nt, Homo sapiens
ggaacaacgagaugcagaa

SEQ ID NO: 50231 - RNA, 19 nt, Homo sapiens
guaaacaggaagcauuuca

SEQ ID NO: 50232 - RNA, 19 nt, Homo sapiens
gaagauaucaauguuucug

SEQ ID NO: 50233 - RNA, 19 nt, Homo sapiens
ugccacacauggugaauga

SEQ ID NO: 50234 - RNA, 19 nt, Homo sapiens
gaaaaggaauggcaauggu

SEQ ID NO: 50235 - RNA, 19 nt, Homo sapiens
gcagaggaagauauuucua

SEQ ID NO: 50236 - RNA, 19 nt, Homo sapiens
gaagucguugugaggguua

SEQ ID NO: 50237 - RNA, 19 nt, Homo sapiens
gaccaagguuccagcucaa

SEQ ID NO: 50238 - RNA, 19 nt, Homo sapiens
gcaagagggaagaaagaga

SEQ ID NO: 50239 - RNA, 19 nt, Homo sapiens
aaagaagaauccaauaagc

SEQ ID NO: 50240 - RNA, 19 nt, Homo sapiens
cuauucagcuagaacuuug

SEQ ID NO: 50241 - RNA, 19 nt, Homo sapiens
gggcugcugugaauuugug

SEQ ID NO: 50242 - RNA, 19 nt, Homo sapiens
ucaccaacaugcuccugaa

SEQ ID NO: 50243 - RNA, 19 nt, Homo sapiens
cgucaccgcuugugucauc

SEQ ID NO: 50244 - RNA, 19 nt, Homo sapiens
aaauuuacauggcaaagag

SEQ ID NO: 50245 - RNA, 19 nt, Homo sapiens
gaacauggagagcuagaac

SEQ ID NO: 50246 - RNA, 19 nt, Homo sapiens
cacaguaggugcucauugg

SEQ ID NO: 50247 - RNA, 19 nt, Homo sapiens
uagaagagcuguuggauga

SEQ ID NO: 50248 - RNA, 19 nt, Homo sapiens
guauguacauugaccauua

SEQ ID NO: 50249 - RNA, 19 nt, Homo sapiens
guaaguaucuucguucuug

SEQ ID NO: 50250 - RNA, 19 nt, Homo sapiens
gaagauaguggauuuaugu

SEQ ID NO: 50251 - RNA, 19 nt, Homo sapiens
gauaguggauuuauguugu

SEQ ID NO: 50252 - RNA, 19 nt, Homo sapiens
gcauuacauuccuugauaa

SEQ ID NO: 50253 - RNA, 19 nt, Homo sapiens
gaacugcauguauaaauga

SEQ ID NO: 50254 - RNA, 19 nt, Homo sapiens
gccaagaacugaaaacaua

SEQ ID NO: 50255 - RNA, 19 nt, Homo sapiens
ggaagauaguggauuuaug

SEQ ID NO: 50256 - RNA, 19 nt, Homo sapiens
gaagggaaacagucauuug

SEQ ID NO: 50257 - RNA, 19 nt, Homo sapiens
guacagugguucuacaauc

SEQ ID NO: 50258 - RNA, 19 nt, Homo sapiens
gagcgugugugacaguauu

SEQ ID NO: 50259 - RNA, 19 nt, Homo sapiens
gacaguaaguaucuucguu

SEQ ID NO: 50260 - RNA, 19 nt, Homo sapiens
aaacuguccucuuucagaa

SEQ ID NO: 50261 - RNA, 19 nt, Homo sapiens
ugcauuacauuccuugaua

SEQ ID NO: 50262 - RNA, 19 nt, Homo sapiens
caggguaaauuauucaguu

SEQ ID NO: 50263 - RNA, 19 nt, Homo sapiens
ucugauagcguuggaauua

SEQ ID NO: 50264 - RNA, 19 nt, Homo sapiens
gauaauaaacuguccucuu

SEQ ID NO: 50265 - RNA, 19 nt, Homo sapiens
ugauagcguuggaauuaaa

SEQ ID NO: 50266 - RNA, 19 nt, Homo sapiens
ugaacugcauguauaaaug

SEQ ID NO: 50267 - RNA, 19 nt, Homo sapiens
caauaaggacgcagacuug

SEQ ID NO: 50268 - RNA, 19 nt, Homo sapiens
gagcugagcgugugugaca

SEQ ID NO: 50269 - RNA, 19 nt, Homo sapiens
aauaaacuguccucuuuca

SEQ ID NO: 50270 - RNA, 19 nt, Homo sapiens
caucauuggcugacacuuu

SEQ ID NO: 50271 - RNA, 19 nt, Homo sapiens
gcaugcugcuuuaauugug

SEQ ID NO: 50272 - RNA, 19 nt, Homo sapiens
uaaacuguccucuuucaga

SEQ ID NO: 50273 - RNA, 19 nt, Homo sapiens
aaggccaacugaagcaaua

SEQ ID NO: 50274 - RNA, 19 nt, Homo sapiens
ccuagaugcugcaaacaug

SEQ ID NO: 50275 - RNA, 19 nt, Homo sapiens
guagucaagugccuuugga

SEQ ID NO: 50276 - RNA, 19 nt, Homo sapiens
ucauaaggauagacacuuc

SEQ ID NO: 50277 - RNA, 19 nt, Homo sapiens
gcaaacauccgaggacaag

SEQ ID NO: 50278 - RNA, 19 nt, Homo sapiens
gaugaggaccagaaaguuc

SEQ ID NO: 50279 - RNA, 19 nt, Homo sapiens
ucgaacacgugauagaaga

SEQ ID NO: 50280 - RNA, 19 nt, Homo sapiens
guggauuuauguuguauag

SEQ ID NO: 50281 - RNA, 19 nt, Homo sapiens
gaacuacccagucguacgu

SEQ ID NO: 50282 - RNA, 19 nt, Homo sapiens
gucauuugcgcacaacuua

SEQ ID NO: 50283 - RNA, 19 nt, Homo sapiens
gaaaguucggcccaaugaa

SEQ ID NO: 50284 - RNA, 19 nt, Homo sapiens
uugauaauguugugguuug

SEQ ID NO: 50285 - RNA, 19 nt, Homo sapiens
ccagaaaguucggcccaau

SEQ ID NO: 50286 - RNA, 19 nt, Homo sapiens
gggaagauaguggauuuau

SEQ ID NO: 50287 - RNA, 19 nt, Homo sapiens
gcccaaggcagguucaaga

SEQ ID NO: 50288 - RNA, 19 nt, Homo sapiens
uaucuucguucuuguuagu

SEQ ID NO: 50289 - RNA, 19 nt, Homo sapiens
aaaggucccuguaucaaaa

SEQ ID NO: 50290 - RNA, 19 nt, Homo sapiens
agaaaguucggcccaauga

SEQ ID NO: 50291 - RNA, 19 nt, Homo sapiens
auaaauugcaugcugcuuu

SEQ ID NO: 50292 - RNA, 19 nt, Homo sapiens
auaauguugugguuuguug

SEQ ID NO: 50293 - RNA, 19 nt, Homo sapiens
caugaaagaagcaaacauc

SEQ ID NO: 50294 - RNA, 19 nt, Homo sapiens
ccagggugaugcucaguag

SEQ ID NO: 50295 - RNA, 19 nt, Homo sapiens
ugagaagagugaugaccau

SEQ ID NO: 50296 - RNA, 19 nt, Homo sapiens
ggaugaggaccagaaaguu

SEQ ID NO: 50297 - RNA, 19 nt, Homo sapiens
cagaagggaaacagucauu

SEQ ID NO: 50298 - RNA, 19 nt, Homo sapiens
caugcugcuuuaauuguga

SEQ ID NO: 50299 - RNA, 19 nt, Homo sapiens
gugguucuacaaucuauuu

SEQ ID NO: 50300 - RNA, 19 nt, Homo sapiens
uuaccuagaugcugcaaac

SEQ ID NO: 50301 - RNA, 19 nt, Homo sapiens
gaugcucaguagucaagug

SEQ ID NO: 50302 - RNA, 19 nt, Homo sapiens
cugauagcguuggaauuaa

SEQ ID NO: 50303 - RNA, 19 nt, Homo sapiens
cauuugcgcacaacuuaaa

SEQ ID NO: 50304 - RNA, 19 nt, Homo sapiens
ggcuggcgauucauaagga

SEQ ID NO: 50305 - RNA, 19 nt, Homo sapiens
gauagaagagcuguuggau

SEQ ID NO: 50306 - RNA, 19 nt, Homo sapiens
gaaaaggucccuguaucaa

SEQ ID NO: 50307 - RNA, 19 nt, Homo sapiens
ucuuucugcuggaggaaua

SEQ ID NO: 50308 - RNA, 19 nt, Homo sapiens
uaaggacgcagacuuguac

SEQ ID NO: 50309 - RNA, 19 nt, Homo sapiens
acaauaaggacgcagacuu

SEQ ID NO: 50310 - RNA, 19 nt, Homo sapiens
uacagugguucuacaaucu

SEQ ID NO: 50311 - RNA, 19 nt, Homo sapiens
gccgaacuacccagucgua

SEQ ID NO: 50312 - RNA, 19 nt, Homo sapiens
uaaguaucuucguucuugu

SEQ ID NO: 50313 - RNA, 19 nt, Homo sapiens
gauaauguugugguuuguu

SEQ ID NO: 50314 - RNA, 19 nt, Homo sapiens
agugcaaucccauggguua

SEQ ID NO: 50315 - RNA, 19 nt, Homo sapiens
cagugguucuacaaucuau

SEQ ID NO: 50316 - RNA, 19 nt, Homo sapiens
agacugcaguggacauguc

SEQ ID NO: 50317 - RNA, 19 nt, Homo sapiens
auaaggacgcagacuugua

SEQ ID NO: 50318 - RNA, 19 nt, Homo sapiens
acacacacacacacaacaa

SEQ ID NO: 50319 - RNA, 19 nt, Homo sapiens
auugcaugcugcuuuaauu

SEQ ID NO: 50320 - RNA, 19 nt, Homo sapiens
auacuuugguugcaugaag

SEQ ID NO: 50321 - RNA, 19 nt, Homo sapiens
gggugaugcucaguaguca

SEQ ID NO: 50322 - RNA, 19 nt, Homo sapiens
aaaacaaugucaaggugaa

SEQ ID NO: 50323 - RNA, 19 nt, Homo sapiens
cugcauguauaaaugaagu

SEQ ID NO: 50324 - RNA, 19 nt, Homo sapiens
ucaguagucaagugccuuu

SEQ ID NO: 50325 - RNA, 19 nt, Homo sapiens
caguaaguaucuucguucu

SEQ ID NO: 50326 - RNA, 19 nt, Homo sapiens
uaauaaacuguccucuuuc

SEQ ID NO: 50327 - RNA, 19 nt, Homo sapiens
caggugagaagagugauga

SEQ ID NO: 50328 - RNA, 19 nt, Homo sapiens
aaaguucggcccaaugaag

SEQ ID NO: 50329 - RNA, 19 nt, Homo sapiens
acaguacagugguucuaca

SEQ ID NO: 50330 - RNA, 19 nt, Homo sapiens
gacggucacaguccuugaa

SEQ ID NO: 50331 - RNA, 19 nt, Homo sapiens
cagaaaguucggcccaaug

SEQ ID NO: 50332 - RNA, 19 nt, Homo sapiens
cgugauagaagagcuguug

SEQ ID NO: 50333 - RNA, 19 nt, Homo sapiens
uaaggauagacacuucuug

SEQ ID NO: 50334 - RNA, 19 nt, Homo sapiens
aaacauccgaggacaaggu

SEQ ID NO: 50335 - RNA, 19 nt, Homo sapiens
guacauugaccauuaaaag

SEQ ID NO: 50336 - RNA, 19 nt, Homo sapiens
aaacaaugucaaggugaaa

SEQ ID NO: 50337 - RNA, 19 nt, Homo sapiens
aguaucuucguucuuguua

SEQ ID NO: 50338 - RNA, 19 nt, Homo sapiens
agaagggaaacagucauuu

SEQ ID NO: 50339 - RNA, 19 nt, Homo sapiens
aucauuggcugacacuuuc

SEQ ID NO: 50340 - RNA, 19 nt, Homo sapiens
gcaaucccauggguuacac

SEQ ID NO: 50341 - RNA, 19 nt, Homo sapiens
ugugugacaguauuaguga

SEQ ID NO: 50342 - RNA, 19 nt, Homo sapiens
guacacguccagggugaug

SEQ ID NO: 50343 - RNA, 19 nt, Homo sapiens
uagaagagcuguuggauga

SEQ ID NO: 50344 - RNA, 19 nt, Homo sapiens
guauguacauugaccauua

SEQ ID NO: 50345 - RNA, 19 nt, Homo sapiens
guaaguaucuucguucuug

SEQ ID NO: 50346 - RNA, 19 nt, Homo sapiens
gcaaaggguuauuagauuc

SEQ ID NO: 50347 - RNA, 19 nt, Homo sapiens
gaagauaguggauuuaugu

SEQ ID NO: 50348 - RNA, 19 nt, Homo sapiens
gauaguggauuuauguugu

SEQ ID NO: 50349 - RNA, 19 nt, Homo sapiens
gcauuacauuccuugauaa

SEQ ID NO: 50350 - RNA, 19 nt, Homo sapiens
gaacugcauguauaaauga

SEQ ID NO: 50351 - RNA, 19 nt, Homo sapiens
ccaaggugguugagaguuu

SEQ ID NO: 50352 - RNA, 19 nt, Homo sapiens
gccaagaacugaaaacaua

SEQ ID NO: 50353 - RNA, 19 nt, Homo sapiens
ggaagauaguggauuuaug

SEQ ID NO: 50354 - RNA, 19 nt, Homo sapiens
caaggugguugagaguuua

SEQ ID NO: 50355 - RNA, 19 nt, Homo sapiens
gaagggaaacagucauuug

SEQ ID NO: 50356 - RNA, 19 nt, Homo sapiens
guacagugguucuacaauc

SEQ ID NO: 50357 - RNA, 19 nt, Homo sapiens
gagcgugugugacaguauu

SEQ ID NO: 50358 - RNA, 19 nt, Homo sapiens
gacaguaaguaucuucguu

SEQ ID NO: 50359 - RNA, 19 nt, Homo sapiens
aaacuguccucuuucagaa

SEQ ID NO: 50360 - RNA, 19 nt, Homo sapiens
ugcauuacauuccuugaua

SEQ ID NO: 50361 - RNA, 19 nt, Homo sapiens
caggguaaauuauucaguu

SEQ ID NO: 50362 - RNA, 19 nt, Homo sapiens
ucugauagcguuggaauua

SEQ ID NO: 50363 - RNA, 19 nt, Homo sapiens
gagcaaagccgaacuucuc

SEQ ID NO: 50364 - RNA, 19 nt, Homo sapiens
gauaauaaacuguccucuu

SEQ ID NO: 50365 - RNA, 19 nt, Homo sapiens
ugauagcguuggaauuaaa

SEQ ID NO: 50366 - RNA, 19 nt, Homo sapiens
ugaacugcauguauaaaug

SEQ ID NO: 50367 - RNA, 19 nt, Homo sapiens
caugaugacuucaaacaag

SEQ ID NO: 50368 - RNA, 19 nt, Homo sapiens
ugcaaaggguuauuagauu

SEQ ID NO: 50369 - RNA, 19 nt, Homo sapiens
caauaaggacgcagacuug

SEQ ID NO: 50370 - RNA, 19 nt, Homo sapiens
gagcugagcgugugugaca

SEQ ID NO: 50371 - RNA, 19 nt, Homo sapiens
cuucaaacaagacacauua

SEQ ID NO: 50372 - RNA, 19 nt, Homo sapiens
aauaaacuguccucuuuca

SEQ ID NO: 50373 - RNA, 19 nt, Homo sapiens
caucauuggcugacacuuu

SEQ ID NO: 50374 - RNA, 19 nt, Homo sapiens
ggacagcaaaggcacaaug

SEQ ID NO: 50375 - RNA, 19 nt, Homo sapiens
gcaugcugcuuuaauugug

SEQ ID NO: 50376 - RNA, 19 nt, Homo sapiens
ucauuagaaucacguaaga

SEQ ID NO: 50377 - RNA, 19 nt, Homo sapiens
uaaacuguccucuuucaga

SEQ ID NO: 50378 - RNA, 19 nt, Homo sapiens
aaggccaacugaagcaaua

SEQ ID NO: 50379 - RNA, 19 nt, Homo sapiens
ccuagaugcugcaaacaug

SEQ ID NO: 50380 - RNA, 19 nt, Homo sapiens
guagucaagugccuuugga

SEQ ID NO: 50381 - RNA, 19 nt, Homo sapiens
aguuuaagcuugcggauau

SEQ ID NO: 50382 - RNA, 19 nt, Homo sapiens
caagacacauuaccuucca

SEQ ID NO: 50383 - RNA, 19 nt, Homo sapiens
cguaagaacucaaaaggaa

SEQ ID NO: 50384 - RNA, 19 nt, Homo sapiens
ucauaaggauagacacuuc

SEQ ID NO: 50385 - RNA, 19 nt, Homo sapiens
gcaaacauccgaggacaag

SEQ ID NO: 50386 - RNA, 19 nt, Homo sapiens
cagcaaaggcacaauguuc

SEQ ID NO: 50387 - RNA, 19 nt, Homo sapiens
aaacaagacacauuaccuu

SEQ ID NO: 50388 - RNA, 19 nt, Homo sapiens
aagccgaacuucucacaug

SEQ ID NO: 50389 - RNA, 19 nt, Homo sapiens
ugagggcguuugcguaaau

SEQ ID NO: 50390 - RNA, 19 nt, Homo sapiens
gaugaggaccagaaaguuc

SEQ ID NO: 50391 - RNA, 19 nt, Homo sapiens
ucgaacacgugauagaaga

SEQ ID NO: 50392 - RNA, 19 nt, Homo sapiens
guggauuuauguuguauag

SEQ ID NO: 50393 - RNA, 19 nt, Homo sapiens
gaacuacccagucguacgu

SEQ ID NO: 50394 - RNA, 19 nt, Homo sapiens
gcguuugcguaaaucuaua

SEQ ID NO: 50395 - RNA, 19 nt, Homo sapiens
gaacuucucacaugaugac

SEQ ID NO: 50396 - RNA, 19 nt, Homo sapiens
gucauuugcgcacaacuua

SEQ ID NO: 50397 - RNA, 19 nt, Homo sapiens
gaaaguucggcccaaugaa

SEQ ID NO: 50398 - RNA, 19 nt, Homo sapiens
uugauaauguugugguuug

SEQ ID NO: 50399 - RNA, 19 nt, Homo sapiens
uugcguaaaucuauagguu

SEQ ID NO: 50400 - RNA, 19 nt, Homo sapiens
gcguaaaucuauagguuuu

SEQ ID NO: 50401 - RNA, 19 nt, Homo sapiens
ccagaaaguucggcccaau

SEQ ID NO: 50402 - RNA, 19 nt, Homo sapiens
gggaagauaguggauuuau

SEQ ID NO: 50403 - RNA, 19 nt, Homo sapiens
gcccaaggcagguucaaga

SEQ ID NO: 50404 - RNA, 19 nt, Homo sapiens
gagacgagauuuuaagaca

SEQ ID NO: 50405 - RNA, 19 nt, Homo sapiens
uaucuucguucuuguuagu

SEQ ID NO: 50406 - RNA, 19 nt, Homo sapiens
aaaggucccuguaucaaaa

SEQ ID NO: 50407 - RNA, 19 nt, Homo sapiens
agaaaguucggcccaauga

SEQ ID NO: 50408 - RNA, 19 nt, Homo sapiens
auaaauugcaugcugcuuu

SEQ ID NO: 50409 - RNA, 19 nt, Homo sapiens
auaauguugugguuuguug

SEQ ID NO: 50410 - RNA, 19 nt, Homo sapiens
ccagggugaugcucaguag

SEQ ID NO: 50411 - RNA, 19 nt, Homo sapiens
caugaaagaagcaaacauc

SEQ ID NO: 50412 - RNA, 19 nt, Homo sapiens
ggaugaggaccagaaaguu

SEQ ID NO: 50413 - RNA, 19 nt, Homo sapiens
ugagaagagugaugaccau

SEQ ID NO: 50414 - RNA, 19 nt, Homo sapiens
ccgaacuucucacaugaug

SEQ ID NO: 50415 - RNA, 19 nt, Homo sapiens
cagaagggaaacagucauu

SEQ ID NO: 50416 - RNA, 19 nt, Homo sapiens
gaguuuaagcuugcggaua

SEQ ID NO: 50417 - RNA, 19 nt, Homo sapiens
caaaggguuauuagauuca

SEQ ID NO: 50418 - RNA, 19 nt, Homo sapiens
caugcugcuuuaauuguga

SEQ ID NO: 50419 - RNA, 19 nt, Homo sapiens
gugguucuacaaucuauuu

SEQ ID NO: 50420 - RNA, 19 nt, Homo sapiens
uuaccuagaugcugcaaac

SEQ ID NO: 50421 - RNA, 19 nt, Homo sapiens
gaugcucaguagucaagug

SEQ ID NO: 50422 - RNA, 19 nt, Homo sapiens
cugauagcguuggaauuaa

SEQ ID NO: 50423 - RNA, 19 nt, Homo sapiens
cauuugcgcacaacuuaaa

SEQ ID NO: 50424 - RNA, 19 nt, Homo sapiens
caucgaugccaguugcuuu

SEQ ID NO: 50425 - RNA, 19 nt, Homo sapiens
ggcuggcgauucauaagga

SEQ ID NO: 50426 - RNA, 19 nt, Homo sapiens
gauagaagagcuguuggau

SEQ ID NO: 50427 - RNA, 19 nt, Homo sapiens
gaaaaggucccuguaucaa

SEQ ID NO: 50428 - RNA, 19 nt, Homo sapiens
ucuuucugcuggaggaaua

SEQ ID NO: 50429 - RNA, 19 nt, Homo sapiens
uaaggacgcagacuuguac

SEQ ID NO: 50430 - RNA, 19 nt, Homo sapiens
gaugccaguugcuuugucu

SEQ ID NO: 50431 - RNA, 19 nt, Homo sapiens
acaauaaggacgcagacuu

SEQ ID NO: 50432 - RNA, 19 nt, Homo sapiens
cuucucacaugaugacuuc

SEQ ID NO: 50433 - RNA, 19 nt, Homo sapiens
uacagugguucuacaaucu

SEQ ID NO: 50434 - RNA, 19 nt, Homo sapiens
gccgaacuacccagucgua

SEQ ID NO: 50435 - RNA, 19 nt, Homo sapiens
gcaaaggcacaauguucca

SEQ ID NO: 50436 - RNA, 19 nt, Homo sapiens
uaaguaucuucguucuugu

SEQ ID NO: 50437 - RNA, 19 nt, Homo sapiens
gauaauguugugguuuguu

SEQ ID NO: 50438 - RNA, 19 nt, Homo sapiens
agugcaaucccauggguua

SEQ ID NO: 50439 - RNA, 19 nt, Homo sapiens
gacagcaaaggcacaaugu

SEQ ID NO: 50440 - RNA, 19 nt, Homo sapiens
caaagccgaacuucucaca

SEQ ID NO: 50441 - RNA, 19 nt, Homo sapiens
cagugguucuacaaucuau

SEQ ID NO: 50442 - RNA, 19 nt, Homo sapiens
agacugcaguggacauguc

SEQ ID NO: 50443 - RNA, 19 nt, Homo sapiens
uagaagagcuguuggauga

SEQ ID NO: 50444 - RNA, 19 nt, Homo sapiens
guauguacauugaccauua

SEQ ID NO: 50445 - RNA, 19 nt, Homo sapiens
guaaguaucuucguucuug

SEQ ID NO: 50446 - RNA, 19 nt, Homo sapiens
gaagauaguggauuuaugu

SEQ ID NO: 50447 - RNA, 19 nt, Homo sapiens
gauaguggauuuauguugu

SEQ ID NO: 50448 - RNA, 19 nt, Homo sapiens
gcauuacauuccuugauaa

SEQ ID NO: 50449 - RNA, 19 nt, Homo sapiens
gaacugcauguauaaauga

SEQ ID NO: 50450 - RNA, 19 nt, Homo sapiens
gccaagaacugaaaacaua

SEQ ID NO: 50451 - RNA, 19 nt, Homo sapiens
ggaagauaguggauuuaug

SEQ ID NO: 50452 - RNA, 19 nt, Homo sapiens
gaagggaaacagucauuug

SEQ ID NO: 50453 - RNA, 19 nt, Homo sapiens
guacagugguucuacaauc

SEQ ID NO: 50454 - RNA, 19 nt, Homo sapiens
gagcgugugugacaguauu

SEQ ID NO: 50455 - RNA, 19 nt, Homo sapiens
gacaguaaguaucuucguu

SEQ ID NO: 50456 - RNA, 19 nt, Homo sapiens
aaacuguccucuuucagaa

SEQ ID NO: 50457 - RNA, 19 nt, Homo sapiens
ugcauuacauuccuugaua

SEQ ID NO: 50458 - RNA, 19 nt, Homo sapiens
caggguaaauuauucaguu

SEQ ID NO: 50459 - RNA, 19 nt, Homo sapiens
ucugauagcguuggaauua

SEQ ID NO: 50460 - RNA, 19 nt, Homo sapiens
gauaauaaacuguccucuu

SEQ ID NO: 50461 - RNA, 19 nt, Homo sapiens
gaaaugcaaguguuuaucu

SEQ ID NO: 50462 - RNA, 19 nt, Homo sapiens
ugauagcguuggaauuaaa

SEQ ID NO: 50463 - RNA, 19 nt, Homo sapiens
ugaacugcauguauaaaug

SEQ ID NO: 50464 - RNA, 19 nt, Homo sapiens
caauaaggacgcagacuug

SEQ ID NO: 50465 - RNA, 19 nt, Homo sapiens
ucauugagcucgcugaagu

SEQ ID NO: 50466 - RNA, 19 nt, Homo sapiens
gagcugagcgugugugaca

SEQ ID NO: 50467 - RNA, 19 nt, Homo sapiens
aauaaacuguccucuuuca

SEQ ID NO: 50468 - RNA, 19 nt, Homo sapiens
ggagagagagucagauuuu

SEQ ID NO: 50469 - RNA, 19 nt, Homo sapiens
gagcggagcguuuggaaag

SEQ ID NO: 50470 - RNA, 19 nt, Homo sapiens
caucauuggcugacacuuu

SEQ ID NO: 50471 - RNA, 19 nt, Homo sapiens
gcaugcugcuuuaauugug

SEQ ID NO: 50472 - RNA, 19 nt, Homo sapiens
uaaacuguccucuuucaga

SEQ ID NO: 50473 - RNA, 19 nt, Homo sapiens
aaggccaacugaagcaaua

SEQ ID NO: 50474 - RNA, 19 nt, Homo sapiens
ccuagaugcugcaaacaug

SEQ ID NO: 50475 - RNA, 19 nt, Homo sapiens
guagucaagugccuuugga

SEQ ID NO: 50476 - RNA, 19 nt, Homo sapiens
gagguucggcucacacuga

SEQ ID NO: 50477 - RNA, 19 nt, Homo sapiens
gguauacuggguuaacuuu

SEQ ID NO: 50478 - RNA, 19 nt, Homo sapiens
gguguaggcuggaauagac

SEQ ID NO: 50479 - RNA, 19 nt, Homo sapiens
ucauaaggauagacacuuc

SEQ ID NO: 50480 - RNA, 19 nt, Homo sapiens
gcaaacauccgaggacaag

SEQ ID NO: 50481 - RNA, 19 nt, Homo sapiens
gaucggggcuggagagaga

SEQ ID NO: 50482 - RNA, 19 nt, Homo sapiens
gaugaggaccagaaaguuc

SEQ ID NO: 50483 - RNA, 19 nt, Homo sapiens
ucgaacacgugauagaaga

SEQ ID NO: 50484 - RNA, 19 nt, Homo sapiens
gguguaagccgcaaagaag

SEQ ID NO: 50485 - RNA, 19 nt, Homo sapiens
ggguugguauacuggguua

SEQ ID NO: 50486 - RNA, 19 nt, Homo sapiens
guggauuuauguuguauag

SEQ ID NO: 50487 - RNA, 19 nt, Homo sapiens
gaacuacccagucguacgu

SEQ ID NO: 50488 - RNA, 19 nt, Homo sapiens
gucauuugcgcacaacuua

SEQ ID NO: 50489 - RNA, 19 nt, Homo sapiens
gaaaguucggcccaaugaa

SEQ ID NO: 50490 - RNA, 19 nt, Homo sapiens
uugauaauguugugguuug

SEQ ID NO: 50491 - RNA, 19 nt, Homo sapiens
ccagaaaguucggcccaau

SEQ ID NO: 50492 - RNA, 19 nt, Homo sapiens
gggaaaugcaaguguuuau

SEQ ID NO: 50493 - RNA, 19 nt, Homo sapiens
ggaaagcgagccccaguuu

SEQ ID NO: 50494 - RNA, 19 nt, Homo sapiens
gggaagauaguggauuuau

SEQ ID NO: 50495 - RNA, 19 nt, Homo sapiens
gcccaaggcagguucaaga

SEQ ID NO: 50496 - RNA, 19 nt, Homo sapiens
uaucuucguucuuguuagu

SEQ ID NO: 50497 - RNA, 19 nt, Homo sapiens
aaaggucccuguaucaaaa

SEQ ID NO: 50498 - RNA, 19 nt, Homo sapiens
agaaaguucggcccaauga

SEQ ID NO: 50499 - RNA, 19 nt, Homo sapiens
auaaauugcaugcugcuuu

SEQ ID NO: 50500 - RNA, 19 nt, Homo sapiens
auaauguugugguuuguug

SEQ ID NO: 50501 - RNA, 19 nt, Homo sapiens
ccagggugaugcucaguag

SEQ ID NO: 50502 - RNA, 19 nt, Homo sapiens
caugaaagaagcaaacauc

SEQ ID NO: 50503 - RNA, 19 nt, Homo sapiens
guguuuaucuccaggaucu

SEQ ID NO: 50504 - RNA, 19 nt, Homo sapiens
ggaugaggaccagaaaguu

SEQ ID NO: 50505 - RNA, 19 nt, Homo sapiens
ugagaagagugaugaccau

SEQ ID NO: 50506 - RNA, 19 nt, Homo sapiens
ggaaaugcaaguguuuauc

SEQ ID NO: 50507 - RNA, 19 nt, Homo sapiens
cagaagggaaacagucauu

SEQ ID NO: 50508 - RNA, 19 nt, Homo sapiens
uauacuggguuaacuuugg

SEQ ID NO: 50509 - RNA, 19 nt, Homo sapiens
caugcugcuuuaauuguga

SEQ ID NO: 50510 - RNA, 19 nt, Homo sapiens
gugguucuacaaucuauuu

SEQ ID NO: 50511 - RNA, 19 nt, Homo sapiens
uuaccuagaugcugcaaac

SEQ ID NO: 50512 - RNA, 19 nt, Homo sapiens
gaugcucaguagucaagug

SEQ ID NO: 50513 - RNA, 19 nt, Homo sapiens
cugauagcguuggaauuaa

SEQ ID NO: 50514 - RNA, 19 nt, Homo sapiens
cauuugcgcacaacuuaaa

SEQ ID NO: 50515 - RNA, 19 nt, Homo sapiens
uggguuaacuuugggaaau

SEQ ID NO: 50516 - RNA, 19 nt, Homo sapiens
ggcuggcgauucauaagga

SEQ ID NO: 50517 - RNA, 19 nt, Homo sapiens
gauagaagagcuguuggau

SEQ ID NO: 50518 - RNA, 19 nt, Homo sapiens
gaaaaggucccuguaucaa

SEQ ID NO: 50519 - RNA, 19 nt, Homo sapiens
ggguuaacuuugggaaaug

SEQ ID NO: 50520 - RNA, 19 nt, Homo sapiens
ucuuucugcuggaggaaua

SEQ ID NO: 50521 - RNA, 19 nt, Homo sapiens
uaaggacgcagacuuguac

SEQ ID NO: 50522 - RNA, 19 nt, Homo sapiens
ggcaagcuccggguuggua

SEQ ID NO: 50523 - RNA, 19 nt, Homo sapiens
gcuccggguugguauacug

SEQ ID NO: 50524 - RNA, 19 nt, Homo sapiens
acaauaaggacgcagacuu

SEQ ID NO: 50525 - RNA, 19 nt, Homo sapiens
ggagcggagcguuuggaaa

SEQ ID NO: 50526 - RNA, 19 nt, Homo sapiens
uacagugguucuacaaucu

SEQ ID NO: 50527 - RNA, 19 nt, Homo sapiens
gccgaacuacccagucgua

SEQ ID NO: 50528 - RNA, 19 nt, Homo sapiens
uaaguaucuucguucuugu

SEQ ID NO: 50529 - RNA, 19 nt, Homo sapiens
gauaauguugugguuuguu

SEQ ID NO: 50530 - RNA, 19 nt, Homo sapiens
agugcaaucccauggguua

SEQ ID NO: 50531 - RNA, 19 nt, Homo sapiens
gagagagagucagauuuug

SEQ ID NO: 50532 - RNA, 19 nt, Homo sapiens
cagugguucuacaaucuau

SEQ ID NO: 50533 - RNA, 19 nt, Homo sapiens
caagcuccggguugguaua

SEQ ID NO: 50534 - RNA, 19 nt, Homo sapiens
agacugcaguggacauguc

SEQ ID NO: 50535 - RNA, 19 nt, Homo sapiens
auaaggacgcagacuugua

SEQ ID NO: 50536 - RNA, 19 nt, Homo sapiens
acacacacacacacaacaa

SEQ ID NO: 50537 - RNA, 19 nt, Homo sapiens
auugcaugcugcuuuaauu

SEQ ID NO: 50538 - RNA, 19 nt, Homo sapiens
gggugaugcucaguaguca

SEQ ID NO: 50539 - RNA, 19 nt, Homo sapiens
auacuuugguugcaugaag

SEQ ID NO: 50540 - RNA, 19 nt, Homo sapiens
aaaacaaugucaaggugaa

SEQ ID NO: 50541 - RNA, 19 nt, Homo sapiens
gcaagcuccggguugguau

SEQ ID NO: 50542 - RNA, 19 nt, Homo sapiens
cugcauguauaaaugaagu

SEQ ID NO: 50543 - RNA, 19 nt, Homo sapiens
uagaagagcuguuggauga

SEQ ID NO: 50544 - RNA, 19 nt, Homo sapiens
guauguacauugaccauua

SEQ ID NO: 50545 - RNA, 19 nt, Homo sapiens
guaaguaucuucguucuug

SEQ ID NO: 50546 - RNA, 19 nt, Homo sapiens
gcagcugccuugaugguua

SEQ ID NO: 50547 - RNA, 19 nt, Homo sapiens
gaagauaguggauuuaugu

SEQ ID NO: 50548 - RNA, 19 nt, Homo sapiens
gauaguggauuuauguugu

SEQ ID NO: 50549 - RNA, 19 nt, Homo sapiens
gcaauuuccacuaucaaua

SEQ ID NO: 50550 - RNA, 19 nt, Homo sapiens
gcauuacauuccuugauaa

SEQ ID NO: 50551 - RNA, 19 nt, Homo sapiens
gaacugcauguauaaauga

SEQ ID NO: 50552 - RNA, 19 nt, Homo sapiens
gccaagaacugaaaacaua

SEQ ID NO: 50553 - RNA, 19 nt, Homo sapiens
ggaagauaguggauuuaug

SEQ ID NO: 50554 - RNA, 19 nt, Homo sapiens
gaagggaaacagucauuug

SEQ ID NO: 50555 - RNA, 19 nt, Homo sapiens
guacagugguucuacaauc

SEQ ID NO: 50556 - RNA, 19 nt, Homo sapiens
gagcgugugugacaguauu

SEQ ID NO: 50557 - RNA, 19 nt, Homo sapiens
guacauaccgggcaccaaa

SEQ ID NO: 50558 - RNA, 19 nt, Homo sapiens
gacaguaaguaucuucguu

SEQ ID NO: 50559 - RNA, 19 nt, Homo sapiens
aaacuguccucuuucagaa

SEQ ID NO: 50560 - RNA, 19 nt, Homo sapiens
ugcauuacauuccuugaua

SEQ ID NO: 50561 - RNA, 19 nt, Homo sapiens
caggguaaauuauucaguu

SEQ ID NO: 50562 - RNA, 19 nt, Homo sapiens
ucugauagcguuggaauua

SEQ ID NO: 50563 - RNA, 19 nt, Homo sapiens
gauaauaaacuguccucuu

SEQ ID NO: 50564 - RNA, 19 nt, Homo sapiens
ugauagcguuggaauuaaa

SEQ ID NO: 50565 - RNA, 19 nt, Homo sapiens
ugaacugcauguauaaaug

SEQ ID NO: 50566 - RNA, 19 nt, Homo sapiens
gaacagaaggaguacauac

SEQ ID NO: 50567 - RNA, 19 nt, Homo sapiens
caauaaggacgcagacuug

SEQ ID NO: 50568 - RNA, 19 nt, Homo sapiens
gagcugagcgugugugaca

SEQ ID NO: 50569 - RNA, 19 nt, Homo sapiens
cggagcagcugccuugaug

SEQ ID NO: 50570 - RNA, 19 nt, Homo sapiens
gccaugcaauuuccacuau

SEQ ID NO: 50571 - RNA, 19 nt, Homo sapiens
aauaaacuguccucuuuca

SEQ ID NO: 50572 - RNA, 19 nt, Homo sapiens
caucauuggcugacacuuu

SEQ ID NO: 50573 - RNA, 19 nt, Homo sapiens
gcaugcugcuuuaauugug

SEQ ID NO: 50574 - RNA, 19 nt, Homo sapiens
uaaacuguccucuuucaga

SEQ ID NO: 50575 - RNA, 19 nt, Homo sapiens
aaggccaacugaagcaaua

SEQ ID NO: 50576 - RNA, 19 nt, Homo sapiens
ccuagaugcugcaaacaug

SEQ ID NO: 50577 - RNA, 19 nt, Homo sapiens
guagucaagugccuuugga

SEQ ID NO: 50578 - RNA, 19 nt, Homo sapiens
gagaucaaauggagcuucu

SEQ ID NO: 50579 - RNA, 19 nt, Homo sapiens
ucauaaggauagacacuuc

SEQ ID NO: 50580 - RNA, 19 nt, Homo sapiens
gcaaacauccgaggacaag

SEQ ID NO: 50581 - RNA, 19 nt, Homo sapiens
gaugaggaccagaaaguuc

SEQ ID NO: 50582 - RNA, 19 nt, Homo sapiens
ucgaacacgugauagaaga

SEQ ID NO: 50583 - RNA, 19 nt, Homo sapiens
ugacaaguagugacugaaa

SEQ ID NO: 50584 - RNA, 19 nt, Homo sapiens
guggauuuauguuguauag

SEQ ID NO: 50585 - RNA, 19 nt, Homo sapiens
gaacuacccagucguacgu

SEQ ID NO: 50586 - RNA, 19 nt, Homo sapiens
gucauuugcgcacaacuua

SEQ ID NO: 50587 - RNA, 19 nt, Homo sapiens
caugcaauuuccacuauca

SEQ ID NO: 50588 - RNA, 19 nt, Homo sapiens
gaaaguucggcccaaugaa

SEQ ID NO: 50589 - RNA, 19 nt, Homo sapiens
uugauaauguugugguuug

SEQ ID NO: 50590 - RNA, 19 nt, Homo sapiens
cugcagaacagaaggagua

SEQ ID NO: 50591 - RNA, 19 nt, Homo sapiens
ccagaaaguucggcccaau

SEQ ID NO: 50592 - RNA, 19 nt, Homo sapiens
gggaagauaguggauuuau

SEQ ID NO: 50593 - RNA, 19 nt, Homo sapiens
gcccaaggcagguucaaga

SEQ ID NO: 50594 - RNA, 19 nt, Homo sapiens
uaucuucguucuuguuagu

SEQ ID NO: 50595 - RNA, 19 nt, Homo sapiens
aaaggucccuguaucaaaa

SEQ ID NO: 50596 - RNA, 19 nt, Homo sapiens
agaaaguucggcccaauga

SEQ ID NO: 50597 - RNA, 19 nt, Homo sapiens
auaaauugcaugcugcuuu

SEQ ID NO: 50598 - RNA, 19 nt, Homo sapiens
auaauguugugguuuguug

SEQ ID NO: 50599 - RNA, 19 nt, Homo sapiens
ccagggugaugcucaguag

SEQ ID NO: 50600 - RNA, 19 nt, Homo sapiens
caugaaagaagcaaacauc

SEQ ID NO: 50601 - RNA, 19 nt, Homo sapiens
ggaugaggaccagaaaguu

SEQ ID NO: 50602 - RNA, 19 nt, Homo sapiens
ccggcgaacuagcaugaaa

SEQ ID NO: 50603 - RNA, 19 nt, Homo sapiens
ugagaagagugaugaccau

SEQ ID NO: 50604 - RNA, 19 nt, Homo sapiens
uaauagagugugggaguuu

SEQ ID NO: 50605 - RNA, 19 nt, Homo sapiens
cagaagggaaacagucauu

SEQ ID NO: 50606 - RNA, 19 nt, Homo sapiens
caugcugcuuuaauuguga

SEQ ID NO: 50607 - RNA, 19 nt, Homo sapiens
gugguucuacaaucuauuu

SEQ ID NO: 50608 - RNA, 19 nt, Homo sapiens
uuaccuagaugcugcaaac

SEQ ID NO: 50609 - RNA, 19 nt, Homo sapiens
gaugcucaguagucaagug

SEQ ID NO: 50610 - RNA, 19 nt, Homo sapiens
cugauagcguuggaauuaa

SEQ ID NO: 50611 - RNA, 19 nt, Homo sapiens
cauuugcgcacaacuuaaa

SEQ ID NO: 50612 - RNA, 19 nt, Homo sapiens
ggcuggcgauucauaagga

SEQ ID NO: 50613 - RNA, 19 nt, Homo sapiens
gauagaagagcuguuggau

SEQ ID NO: 50614 - RNA, 19 nt, Homo sapiens
gaaaaggucccuguaucaa

SEQ ID NO: 50615 - RNA, 19 nt, Homo sapiens
ucuuucugcuggaggaaua

SEQ ID NO: 50616 - RNA, 19 nt, Homo sapiens
uaaggacgcagacuuguac

SEQ ID NO: 50617 - RNA, 19 nt, Homo sapiens
cgaacuagcaugaaaucuc

SEQ ID NO: 50618 - RNA, 19 nt, Homo sapiens
cugccuugaugguuacuuu

SEQ ID NO: 50619 - RNA, 19 nt, Homo sapiens
acaauaaggacgcagacuu

SEQ ID NO: 50620 - RNA, 19 nt, Homo sapiens
gacaaguagugacugaaaa

SEQ ID NO: 50621 - RNA, 19 nt, Homo sapiens
uacagugguucuacaaucu

SEQ ID NO: 50622 - RNA, 19 nt, Homo sapiens
gccgaacuacccagucgua

SEQ ID NO: 50623 - RNA, 19 nt, Homo sapiens
gagcagcugccuugauggu

SEQ ID NO: 50624 - RNA, 19 nt, Homo sapiens
uaaguaucuucguucuugu

SEQ ID NO: 50625 - RNA, 19 nt, Homo sapiens
gauaauguugugguuuguu

SEQ ID NO: 50626 - RNA, 19 nt, Homo sapiens
cagaacagaaggaguacau

SEQ ID NO: 50627 - RNA, 19 nt, Homo sapiens
agugcaaucccauggguua

SEQ ID NO: 50628 - RNA, 19 nt, Homo sapiens
cagugguucuacaaucuau

SEQ ID NO: 50629 - RNA, 19 nt, Homo sapiens
agacugcaguggacauguc

SEQ ID NO: 50630 - RNA, 19 nt, Homo sapiens
auaaggacgcagacuugua

SEQ ID NO: 50631 - RNA, 19 nt, Homo sapiens
acacacacacacacaacaa

SEQ ID NO: 50632 - RNA, 19 nt, Homo sapiens
auugcaugcugcuuuaauu

SEQ ID NO: 50633 - RNA, 19 nt, Homo sapiens
gggugaugcucaguaguca

SEQ ID NO: 50634 - RNA, 19 nt, Homo sapiens
auacuuugguugcaugaag

SEQ ID NO: 50635 - RNA, 19 nt, Homo sapiens
aaaacaaugucaaggugaa

SEQ ID NO: 50636 - RNA, 19 nt, Homo sapiens
uuugacaaguagugacuga

SEQ ID NO: 50637 - RNA, 19 nt, Homo sapiens
auaauagagugugggaguu

SEQ ID NO: 50638 - RNA, 19 nt, Homo sapiens
cugcauguauaaaugaagu

SEQ ID NO: 50639 - RNA, 19 nt, Homo sapiens
ucaguagucaagugccuuu

SEQ ID NO: 50640 - RNA, 19 nt, Homo sapiens
caguaaguaucuucguucu

SEQ ID NO: 50641 - RNA, 19 nt, Homo sapiens
uaauaaacuguccucuuuc

SEQ ID NO: 50642 - RNA, 19 nt, Homo sapiens
acaguacagugguucuaca

SEQ ID NO: 50643 - RNA, 19 nt, Homo sapiens
uagaagagcuguuggauga

SEQ ID NO: 50644 - RNA, 19 nt, Homo sapiens
guauguacauugaccauua

SEQ ID NO: 50645 - RNA, 19 nt, Homo sapiens
guaaguaucuucguucuug

SEQ ID NO: 50646 - RNA, 19 nt, Homo sapiens
gaagauaguggauuuaugu

SEQ ID NO: 50647 - RNA, 19 nt, Homo sapiens
ccagggaaguuaagaguuu

SEQ ID NO: 50648 - RNA, 19 nt, Homo sapiens
gauaguggauuuauguugu

SEQ ID NO: 50649 - RNA, 19 nt, Homo sapiens
gcauuacauuccuugauaa

SEQ ID NO: 50650 - RNA, 19 nt, Homo sapiens
gaacugcauguauaaauga

SEQ ID NO: 50651 - RNA, 19 nt, Homo sapiens
gccaagaacugaaaacaua

SEQ ID NO: 50652 - RNA, 19 nt, Homo sapiens
ggaagauaguggauuuaug

SEQ ID NO: 50653 - RNA, 19 nt, Homo sapiens
gaagggaaacagucauuug

SEQ ID NO: 50654 - RNA, 19 nt, Homo sapiens
guacagugguucuacaauc

SEQ ID NO: 50655 - RNA, 19 nt, Homo sapiens
gagcgugugugacaguauu

SEQ ID NO: 50656 - RNA, 19 nt, Homo sapiens
gacaguaaguaucuucguu

SEQ ID NO: 50657 - RNA, 19 nt, Homo sapiens
aaacuguccucuuucagaa

SEQ ID NO: 50658 - RNA, 19 nt, Homo sapiens
ugcauuacauuccuugaua

SEQ ID NO: 50659 - RNA, 19 nt, Homo sapiens
caggguaaauuauucaguu

SEQ ID NO: 50660 - RNA, 19 nt, Homo sapiens
ucugauagcguuggaauua

SEQ ID NO: 50661 - RNA, 19 nt, Homo sapiens
gauaauaaacuguccucuu

SEQ ID NO: 50662 - RNA, 19 nt, Homo sapiens
ugauagcguuggaauuaaa

SEQ ID NO: 50663 - RNA, 19 nt, Homo sapiens
ugaacugcauguauaaaug

SEQ ID NO: 50664 - RNA, 19 nt, Homo sapiens
caauaaggacgcagacuug

SEQ ID NO: 50665 - RNA, 19 nt, Homo sapiens
gagcugagcgugugugaca

SEQ ID NO: 50666 - RNA, 19 nt, Homo sapiens
aauaaacuguccucuuuca

SEQ ID NO: 50667 - RNA, 19 nt, Homo sapiens
caucauuggcugacacuuu

SEQ ID NO: 50668 - RNA, 19 nt, Homo sapiens
gcaugcugcuuuaauugug

SEQ ID NO: 50669 - RNA, 19 nt, Homo sapiens
uaaacuguccucuuucaga

SEQ ID NO: 50670 - RNA, 19 nt, Homo sapiens
aaggccaacugaagcaaua

SEQ ID NO: 50671 - RNA, 19 nt, Homo sapiens
ccuagaugcugcaaacaug

SEQ ID NO: 50672 - RNA, 19 nt, Homo sapiens
guagucaagugccuuugga

SEQ ID NO: 50673 - RNA, 19 nt, Homo sapiens
ucauaaggauagacacuuc

SEQ ID NO: 50674 - RNA, 19 nt, Homo sapiens
gcaaacauccgaggacaag

SEQ ID NO: 50675 - RNA, 19 nt, Homo sapiens
gaugaggaccagaaaguuc

SEQ ID NO: 50676 - RNA, 19 nt, Homo sapiens
ucgaacacgugauagaaga

SEQ ID NO: 50677 - RNA, 19 nt, Homo sapiens
guggauuuauguuguauag

SEQ ID NO: 50678 - RNA, 19 nt, Homo sapiens
gaacuacccagucguacgu

SEQ ID NO: 50679 - RNA, 19 nt, Homo sapiens
gucauuugcgcacaacuua

SEQ ID NO: 50680 - RNA, 19 nt, Homo sapiens
gaaaguucggcccaaugaa

SEQ ID NO: 50681 - RNA, 19 nt, Homo sapiens
uugauaauguugugguuug

SEQ ID NO: 50682 - RNA, 19 nt, Homo sapiens
ccagaaaguucggcccaau

SEQ ID NO: 50683 - RNA, 19 nt, Homo sapiens
aaacuugggaggcggaauu

SEQ ID NO: 50684 - RNA, 19 nt, Homo sapiens
gggaagauaguggauuuau

SEQ ID NO: 50685 - RNA, 19 nt, Homo sapiens
gcccaaggcagguucaaga

SEQ ID NO: 50686 - RNA, 19 nt, Homo sapiens
uaucuucguucuuguuagu

SEQ ID NO: 50687 - RNA, 19 nt, Homo sapiens
caaguccgaagccaaugua

SEQ ID NO: 50688 - RNA, 19 nt, Homo sapiens
aaaggucccuguaucaaaa

SEQ ID NO: 50689 - RNA, 19 nt, Homo sapiens
agaaaguucggcccaauga

SEQ ID NO: 50690 - RNA, 19 nt, Homo sapiens
auaaauugcaugcugcuuu

SEQ ID NO: 50691 - RNA, 19 nt, Homo sapiens
auaauguugugguuuguug

SEQ ID NO: 50692 - RNA, 19 nt, Homo sapiens
ccagggugaugcucaguag

SEQ ID NO: 50693 - RNA, 19 nt, Homo sapiens
caugaaagaagcaaacauc

SEQ ID NO: 50694 - RNA, 19 nt, Homo sapiens
gcagagccgggaagaggaa

SEQ ID NO: 50695 - RNA, 19 nt, Homo sapiens
ggaugaggaccagaaaguu

SEQ ID NO: 50696 - RNA, 19 nt, Homo sapiens
ugagaagagugaugaccau

SEQ ID NO: 50697 - RNA, 19 nt, Homo sapiens
cagaagggaaacagucauu

SEQ ID NO: 50698 - RNA, 19 nt, Homo sapiens
caugcugcuuuaauuguga

SEQ ID NO: 50699 - RNA, 19 nt, Homo sapiens
gugguucuacaaucuauuu

SEQ ID NO: 50700 - RNA, 19 nt, Homo sapiens
uuaccuagaugcugcaaac

SEQ ID NO: 50701 - RNA, 19 nt, Homo sapiens
gaugcucaguagucaagug

SEQ ID NO: 50702 - RNA, 19 nt, Homo sapiens
cugauagcguuggaauuaa

SEQ ID NO: 50703 - RNA, 19 nt, Homo sapiens
cauuugcgcacaacuuaaa

SEQ ID NO: 50704 - RNA, 19 nt, Homo sapiens
ggcuggcgauucauaagga

SEQ ID NO: 50705 - RNA, 19 nt, Homo sapiens
gauagaagagcuguuggau

SEQ ID NO: 50706 - RNA, 19 nt, Homo sapiens
gaaaaggucccuguaucaa

SEQ ID NO: 50707 - RNA, 19 nt, Homo sapiens
ucuuucugcuggaggaaua

SEQ ID NO: 50708 - RNA, 19 nt, Homo sapiens
uaaggacgcagacuuguac

SEQ ID NO: 50709 - RNA, 19 nt, Homo sapiens
uuacaaguccgaagccaau

SEQ ID NO: 50710 - RNA, 19 nt, Homo sapiens
acaauaaggacgcagacuu

SEQ ID NO: 50711 - RNA, 19 nt, Homo sapiens
uacagugguucuacaaucu

SEQ ID NO: 50712 - RNA, 19 nt, Homo sapiens
gccgaacuacccagucgua

SEQ ID NO: 50713 - RNA, 19 nt, Homo sapiens
ccacaucucuacccauccu

SEQ ID NO: 50714 - RNA, 19 nt, Homo sapiens
uaaguaucuucguucuugu

SEQ ID NO: 50715 - RNA, 19 nt, Homo sapiens
gauaauguugugguuuguu

SEQ ID NO: 50716 - RNA, 19 nt, Homo sapiens
agugcaaucccauggguua

SEQ ID NO: 50717 - RNA, 19 nt, Homo sapiens
ggccgaacccacaucucua

SEQ ID NO: 50718 - RNA, 19 nt, Homo sapiens
cagugguucuacaaucuau

SEQ ID NO: 50719 - RNA, 19 nt, Homo sapiens
agacugcaguggacauguc

SEQ ID NO: 50720 - RNA, 19 nt, Homo sapiens
auaaggacgcagacuugua

SEQ ID NO: 50721 - RNA, 19 nt, Homo sapiens
acacacacacacacaacaa

SEQ ID NO: 50722 - RNA, 19 nt, Homo sapiens
auacuuugguugcaugaag

SEQ ID NO: 50723 - RNA, 19 nt, Homo sapiens
auugcaugcugcuuuaauu

SEQ ID NO: 50724 - RNA, 19 nt, Homo sapiens
caauguagcuuggaaaacu

SEQ ID NO: 50725 - RNA, 19 nt, Homo sapiens
gggugaugcucaguaguca

SEQ ID NO: 50726 - RNA, 19 nt, Homo sapiens
aaaacaaugucaaggugaa

SEQ ID NO: 50727 - RNA, 19 nt, Homo sapiens
cugcauguauaaaugaagu

SEQ ID NO: 50728 - RNA, 19 nt, Homo sapiens
ucaguagucaagugccuuu

SEQ ID NO: 50729 - RNA, 19 nt, Homo sapiens
caguaaguaucuucguucu

SEQ ID NO: 50730 - RNA, 19 nt, Homo sapiens
uaauaaacuguccucuuuc

SEQ ID NO: 50731 - RNA, 19 nt, Homo sapiens
acaguacagugguucuaca

SEQ ID NO: 50732 - RNA, 19 nt, Homo sapiens
gacggucacaguccuugaa

SEQ ID NO: 50733 - RNA, 19 nt, Homo sapiens
caggugagaagagugauga

SEQ ID NO: 50734 - RNA, 19 nt, Homo sapiens
aaaguucggcccaaugaag

SEQ ID NO: 50735 - RNA, 19 nt, Homo sapiens
gggagugguugggauguac

SEQ ID NO: 50736 - RNA, 19 nt, Homo sapiens
cagaaaguucggcccaaug

SEQ ID NO: 50737 - RNA, 19 nt, Homo sapiens
uaaggauagacacuucuug

SEQ ID NO: 50738 - RNA, 19 nt, Homo sapiens
cgugauagaagagcuguug

SEQ ID NO: 50739 - RNA, 19 nt, Homo sapiens
ggauucuugacucggguua

SEQ ID NO: 50740 - RNA, 19 nt, Homo sapiens
guacauugaccauuaaaag

SEQ ID NO: 50741 - RNA, 19 nt, Homo sapiens
aaacauccgaggacaaggu

SEQ ID NO: 50742 - RNA, 19 nt, Homo sapiens
aaacaaugucaaggugaaa

SEQ ID NO: 50743 - RNA, 19 nt, Homo sapiens
uagaagagcuguuggauga

SEQ ID NO: 50744 - RNA, 19 nt, Homo sapiens
guauguacauugaccauua

SEQ ID NO: 50745 - RNA, 19 nt, Homo sapiens
uuacaaagcugcuaaagug

SEQ ID NO: 50746 - RNA, 19 nt, Homo sapiens
guaaguaucuucguucuug

SEQ ID NO: 50747 - RNA, 19 nt, Homo sapiens
gcaugucucugguuuauau

SEQ ID NO: 50748 - RNA, 19 nt, Homo sapiens
gaacuugaagccacaauuu

SEQ ID NO: 50749 - RNA, 19 nt, Homo sapiens
gaagauaguggauuuaugu

SEQ ID NO: 50750 - RNA, 19 nt, Homo sapiens
gauaguggauuuauguugu

SEQ ID NO: 50751 - RNA, 19 nt, Homo sapiens
agaaagcccuaaccaguuu

SEQ ID NO: 50752 - RNA, 19 nt, Homo sapiens
caaaggaccauguugcuaa

SEQ ID NO: 50753 - RNA, 19 nt, Homo sapiens
gcauuacauuccuugauaa

SEQ ID NO: 50754 - RNA, 19 nt, Homo sapiens
gaacugcauguauaaauga

SEQ ID NO: 50755 - RNA, 19 nt, Homo sapiens
gccaagaacugaaaacaua

SEQ ID NO: 50756 - RNA, 19 nt, Homo sapiens
gcagaauggccuggaauua

SEQ ID NO: 50757 - RNA, 19 nt, Homo sapiens
ggaagaaggagaacuugaa

SEQ ID NO: 50758 - RNA, 19 nt, Homo sapiens
ggaagauaguggauuuaug

SEQ ID NO: 50759 - RNA, 19 nt, Homo sapiens
caucuaaucucagguuuau

SEQ ID NO: 50760 - RNA, 19 nt, Homo sapiens
gaagggaaacagucauuug

SEQ ID NO: 50761 - RNA, 19 nt, Homo sapiens
guacagugguucuacaauc

SEQ ID NO: 50762 - RNA, 19 nt, Homo sapiens
gagcgugugugacaguauu

SEQ ID NO: 50763 - RNA, 19 nt, Homo sapiens
gacaguaaguaucuucguu

SEQ ID NO: 50764 - RNA, 19 nt, Homo sapiens
aaacuguccucuuucagaa

SEQ ID NO: 50765 - RNA, 19 nt, Homo sapiens
ugcauuacauuccuugaua

SEQ ID NO: 50766 - RNA, 19 nt, Homo sapiens
caggguaaauuauucaguu

SEQ ID NO: 50767 - RNA, 19 nt, Homo sapiens
ucugauagcguuggaauua

SEQ ID NO: 50768 - RNA, 19 nt, Homo sapiens
ggaccauguugcuaacuug

SEQ ID NO: 50769 - RNA, 19 nt, Homo sapiens
gauaauaaacuguccucuu

SEQ ID NO: 50770 - RNA, 19 nt, Homo sapiens
ugauagcguuggaauuaaa

SEQ ID NO: 50771 - RNA, 19 nt, Homo sapiens
ugaacugcauguauaaaug

SEQ ID NO: 50772 - RNA, 19 nt, Homo sapiens
gacaucacauagcuagaaa

SEQ ID NO: 50773 - RNA, 19 nt, Homo sapiens
caauaaggacgcagacuug

SEQ ID NO: 50774 - RNA, 19 nt, Homo sapiens
gcacacuacugacacugau

SEQ ID NO: 50775 - RNA, 19 nt, Homo sapiens
gagcugagcgugugugaca

SEQ ID NO: 50776 - RNA, 19 nt, Homo sapiens
uaauuacacuugcaguugu

SEQ ID NO: 50777 - RNA, 19 nt, Homo sapiens
ccauguugcuaacuugaaa

SEQ ID NO: 50778 - RNA, 19 nt, Homo sapiens
aauaaacuguccucuuuca

SEQ ID NO: 50779 - RNA, 19 nt, Homo sapiens
caucauuggcugacacuuu

SEQ ID NO: 50780 - RNA, 19 nt, Homo sapiens
agaauggccuggaauuaca

SEQ ID NO: 50781 - RNA, 19 nt, Homo sapiens
gcaugcugcuuuaauugug

SEQ ID NO: 50782 - RNA, 19 nt, Homo sapiens
uaaacuguccucuuucaga

SEQ ID NO: 50783 - RNA, 19 nt, Homo sapiens
aaggccaacugaagcaaua

SEQ ID NO: 50784 - RNA, 19 nt, Homo sapiens
ccuagaugcugcaaacaug

SEQ ID NO: 50785 - RNA, 19 nt, Homo sapiens
guagucaagugccuuugga

SEQ ID NO: 50786 - RNA, 19 nt, Homo sapiens
ucauaaggauagacacuuc

SEQ ID NO: 50787 - RNA, 19 nt, Homo sapiens
gcaaacauccgaggacaag

SEQ ID NO: 50788 - RNA, 19 nt, Homo sapiens
gaagaaggagaacuugaag

SEQ ID NO: 50789 - RNA, 19 nt, Homo sapiens
ugucacacauuccugcaaa

SEQ ID NO: 50790 - RNA, 19 nt, Homo sapiens
gaugaggaccagaaaguuc

SEQ ID NO: 50791 - RNA, 19 nt, Homo sapiens
ucgaacacgugauagaaga

SEQ ID NO: 50792 - RNA, 19 nt, Homo sapiens
guggauuuauguuguauag

SEQ ID NO: 50793 - RNA, 19 nt, Homo sapiens
gaacuacccagucguacgu

SEQ ID NO: 50794 - RNA, 19 nt, Homo sapiens
gucauuugcgcacaacuua

SEQ ID NO: 50795 - RNA, 19 nt, Homo sapiens
gaaaguucggcccaaugaa

SEQ ID NO: 50796 - RNA, 19 nt, Homo sapiens
aaacuuacaaagcugcuaa

SEQ ID NO: 50797 - RNA, 19 nt, Homo sapiens
uugauaauguugugguuug

SEQ ID NO: 50798 - RNA, 19 nt, Homo sapiens
ccagaaaguucggcccaau

SEQ ID NO: 50799 - RNA, 19 nt, Homo sapiens
uugcaguuguugcuuagua

SEQ ID NO: 50800 - RNA, 19 nt, Homo sapiens
cacuugcaguuguugcuua

SEQ ID NO: 50801 - RNA, 19 nt, Homo sapiens
gggaagauaguggauuuau

SEQ ID NO: 50802 - RNA, 19 nt, Homo sapiens
gcccaaggcagguucaaga

SEQ ID NO: 50803 - RNA, 19 nt, Homo sapiens
uaucuucguucuuguuagu

SEQ ID NO: 50804 - RNA, 19 nt, Homo sapiens
aaaggucccuguaucaaaa

SEQ ID NO: 50805 - RNA, 19 nt, Homo sapiens
agaaaguucggcccaauga

SEQ ID NO: 50806 - RNA, 19 nt, Homo sapiens
cugcaugucucugguuuau

SEQ ID NO: 50807 - RNA, 19 nt, Homo sapiens
auaaauugcaugcugcuuu

SEQ ID NO: 50808 - RNA, 19 nt, Homo sapiens
auaauguugugguuuguug

SEQ ID NO: 50809 - RNA, 19 nt, Homo sapiens
ccagggugaugcucaguag

SEQ ID NO: 50810 - RNA, 19 nt, Homo sapiens
caugaaagaagcaaacauc

SEQ ID NO: 50811 - RNA, 19 nt, Homo sapiens
ccaguuuucugucuuguuu

SEQ ID NO: 50812 - RNA, 19 nt, Homo sapiens
aagaaagcccuaaccaguu

SEQ ID NO: 50813 - RNA, 19 nt, Homo sapiens
acauacagcacacuacuga

SEQ ID NO: 50814 - RNA, 19 nt, Homo sapiens
ggaugaggaccagaaaguu

SEQ ID NO: 50815 - RNA, 19 nt, Homo sapiens
ugagaagagugaugaccau

SEQ ID NO: 50816 - RNA, 19 nt, Homo sapiens
uggugcagcuggaguuuau

SEQ ID NO: 50817 - RNA, 19 nt, Homo sapiens
gggaagaaggagaacuuga

SEQ ID NO: 50818 - RNA, 19 nt, Homo sapiens
gcuaaagugggaagaagga

SEQ ID NO: 50819 - RNA, 19 nt, Homo sapiens
cagaagggaaacagucauu

SEQ ID NO: 50820 - RNA, 19 nt, Homo sapiens
gcuagaaaggcccaucaga

SEQ ID NO: 50821 - RNA, 19 nt, Homo sapiens
acacuacugacacugauuu

SEQ ID NO: 50822 - RNA, 19 nt, Homo sapiens
agacaucacauagcuagaa

SEQ ID NO: 50823 - RNA, 19 nt, Homo sapiens
caugcugcuuuaauuguga

SEQ ID NO: 50824 - RNA, 19 nt, Homo sapiens
gugguucuacaaucuauuu

SEQ ID NO: 50825 - RNA, 19 nt, Homo sapiens
uuaccuagaugcugcaaac

SEQ ID NO: 50826 - RNA, 19 nt, Homo sapiens
gaugcucaguagucaagug

SEQ ID NO: 50827 - RNA, 19 nt, Homo sapiens
caacugcuguuuuauugug

SEQ ID NO: 50828 - RNA, 19 nt, Homo sapiens
ccaucuaaucucagguuua

SEQ ID NO: 50829 - RNA, 19 nt, Homo sapiens
cugauagcguuggaauuaa

SEQ ID NO: 50830 - RNA, 19 nt, Homo sapiens
cauuugcgcacaacuuaaa

SEQ ID NO: 50831 - RNA, 19 nt, Homo sapiens
ggcuggcgauucauaagga

SEQ ID NO: 50832 - RNA, 19 nt, Homo sapiens
gauagaagagcuguuggau

SEQ ID NO: 50833 - RNA, 19 nt, Homo sapiens
cuacugacacugauuugug

SEQ ID NO: 50834 - RNA, 19 nt, Homo sapiens
uuaauuacacuugcaguug

SEQ ID NO: 50835 - RNA, 19 nt, Homo sapiens
gaaaaggucccuguaucaa

SEQ ID NO: 50836 - RNA, 19 nt, Homo sapiens
ucuuucugcuggaggaaua

SEQ ID NO: 50837 - RNA, 19 nt, Homo sapiens
uaaggacgcagacuuguac

SEQ ID NO: 50838 - RNA, 19 nt, Homo sapiens
ggaaacacugcaugucucu

SEQ ID NO: 50839 - RNA, 19 nt, Homo sapiens
gccaucuaaucucagguuu

SEQ ID NO: 50840 - RNA, 19 nt, Homo sapiens
acaauaaggacgcagacuu

SEQ ID NO: 50841 - RNA, 19 nt, Homo sapiens
cagaauggccuggaauuac

SEQ ID NO: 50842 - RNA, 19 nt, Homo sapiens
uacagugguucuacaaucu

SEQ ID NO: 50843 - RNA, 19 nt, Homo sapiens
caagagaagucguuucauu

SEQ ID NO: 50844 - RNA, 19 nt, Homo sapiens
ggaaggaggucuacaucaa

SEQ ID NO: 50845 - RNA, 19 nt, Homo sapiens
ugaucaagcucaagaauaa

SEQ ID NO: 50846 - RNA, 19 nt, Homo sapiens
agaauaagcugaaauaugg

SEQ ID NO: 50847 - RNA, 19 nt, Homo sapiens
cgaagcagcucaaugaaau

SEQ ID NO: 50848 - RNA, 19 nt, Homo sapiens
gaugaaagccagucucuga

SEQ ID NO: 50849 - RNA, 19 nt, Homo sapiens
gggaacaacucgagcuuug

SEQ ID NO: 50850 - RNA, 19 nt, Homo sapiens
ggagauagaaguaguccua

SEQ ID NO: 50851 - RNA, 19 nt, Homo sapiens
acacguaccugcagaucua

SEQ ID NO: 50852 - RNA, 19 nt, Homo sapiens
uugagaagguggcaaguua

SEQ ID NO: 50853 - RNA, 19 nt, Homo sapiens
ucacgaagcagcucaauga

SEQ ID NO: 50854 - RNA, 19 nt, Homo sapiens
ccucaugacugauggauug

SEQ ID NO: 50855 - RNA, 19 nt, Homo sapiens
ggauuuggguuuucuauaa

SEQ ID NO: 50856 - RNA, 19 nt, Homo sapiens
gccaagauauggucuagug

SEQ ID NO: 50857 - RNA, 19 nt, Homo sapiens
gaaagacaaugagcaacau

SEQ ID NO: 50858 - RNA, 19 nt, Homo sapiens
gaaaggcagcugugagaga

SEQ ID NO: 50859 - RNA, 19 nt, Homo sapiens
gccaagaucucagucauuc

SEQ ID NO: 50860 - RNA, 19 nt, Homo sapiens
gaacaucuaccuggugcua

SEQ ID NO: 50861 - RNA, 19 nt, Homo sapiens
ggagcacccugaagacuca

SEQ ID NO: 50862 - RNA, 19 nt, Homo sapiens
gagaagucguuucauucaa

SEQ ID NO: 50863 - RNA, 19 nt, Homo sapiens
gggcuguggugucugagua

SEQ ID NO: 50864 - RNA, 19 nt, Homo sapiens
gcagcucaaugaaaucaau

SEQ ID NO: 50865 - RNA, 19 nt, Homo sapiens
ggccgaagcuuuccugucu

SEQ ID NO: 50866 - RNA, 19 nt, Homo sapiens
caagaaagacaaugagcaa

SEQ ID NO: 50867 - RNA, 19 nt, Homo sapiens
ggcgugggauugaauuaaa

SEQ ID NO: 50868 - RNA, 19 nt, Homo sapiens
ggauaucaaagcucuguuu

SEQ ID NO: 50869 - RNA, 19 nt, Homo sapiens
gcaauccacuguccaagac

SEQ ID NO: 50870 - RNA, 19 nt, Homo sapiens
acaggaaggguaccgauua

SEQ ID NO: 50871 - RNA, 19 nt, Homo sapiens
ggacccaauuacugucauu

SEQ ID NO: 50872 - RNA, 19 nt, Homo sapiens
gcccgagacuuucacauca

SEQ ID NO: 50873 - RNA, 19 nt, Homo sapiens
gcucaagaauaagcugaaa

SEQ ID NO: 50874 - RNA, 19 nt, Homo sapiens
ggaccuggagauagaagua

SEQ ID NO: 50875 - RNA, 19 nt, Homo sapiens
gaagauguuuucuaccaaa

SEQ ID NO: 50876 - RNA, 19 nt, Homo sapiens
gaagcagacagcaguaaug

SEQ ID NO: 50877 - RNA, 19 nt, Homo sapiens
gaacaacagaagcggaaga

SEQ ID NO: 50878 - RNA, 19 nt, Homo sapiens
ugaaauauggccagacuau

SEQ ID NO: 50879 - RNA, 19 nt, Homo sapiens
aggauuaucuggaugucua

SEQ ID NO: 50880 - RNA, 19 nt, Homo sapiens
aaucgcaccugccaaguga

SEQ ID NO: 50881 - RNA, 19 nt, Homo sapiens
gaagucguuucauucaagu

SEQ ID NO: 50882 - RNA, 19 nt, Homo sapiens
gaagcgggaccuggagaua

SEQ ID NO: 50883 - RNA, 19 nt, Homo sapiens
caagugaacaucaaugcuu

SEQ ID NO: 50884 - RNA, 19 nt, Homo sapiens
caacuucacaggagccaaa

SEQ ID NO: 50885 - RNA, 19 nt, Homo sapiens
gagccaagcagacaagcaa

SEQ ID NO: 50886 - RNA, 19 nt, Homo sapiens
gaacaacucgagcuuugag

SEQ ID NO: 50887 - RNA, 19 nt, Homo sapiens
gcugaaauauggccagacu

SEQ ID NO: 50888 - RNA, 19 nt, Homo sapiens
cuacaacauuaaugggaaa

SEQ ID NO: 50889 - RNA, 19 nt, Homo sapiens
ugacagcagcacauuguuu

SEQ ID NO: 50890 - RNA, 19 nt, Homo sapiens
caaagucaaggauauggaa

SEQ ID NO: 50891 - RNA, 19 nt, Homo sapiens
gaaccaagugaacaucaau

SEQ ID NO: 50892 - RNA, 19 nt, Homo sapiens
aaauauggccagacuauca

SEQ ID NO: 50893 - RNA, 19 nt, Homo sapiens
gccaagacuccuucaugua

SEQ ID NO: 50894 - RNA, 19 nt, Homo sapiens
ccugaagacucaagaccaa

SEQ ID NO: 50895 - RNA, 19 nt, Homo sapiens
gaaggaggucuacaucaag

SEQ ID NO: 50896 - RNA, 19 nt, Homo sapiens
cagacuaucaggcccauuu

SEQ ID NO: 50897 - RNA, 19 nt, Homo sapiens
uagaaguaguccuauuuca

SEQ ID NO: 50898 - RNA, 19 nt, Homo sapiens
gcaguguacagcaugauga

SEQ ID NO: 50899 - RNA, 19 nt, Homo sapiens
gugaugagaucucuuucca

SEQ ID NO: 50900 - RNA, 19 nt, Homo sapiens
ugagugaugagaucucuuu

SEQ ID NO: 50901 - RNA, 19 nt, Homo sapiens
caaugugagugaugagauc

SEQ ID NO: 50902 - RNA, 19 nt, Homo sapiens
aagugaacaucaaugcuuu

SEQ ID NO: 50903 - RNA, 19 nt, Homo sapiens
augaugagcuggccagaug

SEQ ID NO: 50904 - RNA, 19 nt, Homo sapiens
gagaagguggcaaguuaug

SEQ ID NO: 50905 - RNA, 19 nt, Homo sapiens
caaggaacacucaaucaag

SEQ ID NO: 50906 - RNA, 19 nt, Homo sapiens
gaccauagaaggagucgau

SEQ ID NO: 50907 - RNA, 19 nt, Homo sapiens
agaagucguuucauucaag

SEQ ID NO: 50908 - RNA, 19 nt, Homo sapiens
caaagucaaggacaucuca

SEQ ID NO: 50909 - RNA, 19 nt, Homo sapiens
aguaguggaugucugcaaa

SEQ ID NO: 50910 - RNA, 19 nt, Homo sapiens
aaggaggucuacaucaaga

SEQ ID NO: 50911 - RNA, 19 nt, Homo sapiens
gacaaggaacacucaauca

SEQ ID NO: 50912 - RNA, 19 nt, Homo sapiens
ugaaccaagugaacaucaa

SEQ ID NO: 50913 - RNA, 19 nt, Homo sapiens
ccaagacuccuucauguac

SEQ ID NO: 50914 - RNA, 19 nt, Homo sapiens
aagaugaggauuuggguuu

SEQ ID NO: 50915 - RNA, 19 nt, Homo sapiens
ucacaucaaccucuuucaa

SEQ ID NO: 50916 - RNA, 19 nt, Homo sapiens
gcuauacauuggcaaggau

SEQ ID NO: 50917 - RNA, 19 nt, Homo sapiens
ccugaugcccuuuaucuug

SEQ ID NO: 50918 - RNA, 19 nt, Homo sapiens
ugccaagacuccuucaugu

SEQ ID NO: 50919 - RNA, 19 nt, Homo sapiens
cacaagagaagucguuuca

SEQ ID NO: 50920 - RNA, 19 nt, Homo sapiens
ggaacaacucgagcuuuga

SEQ ID NO: 50921 - RNA, 19 nt, Homo sapiens
gacagcagcacauuguuuc

SEQ ID NO: 50922 - RNA, 19 nt, Homo sapiens
uguggugucugaguacuuu

SEQ ID NO: 50923 - RNA, 19 nt, Homo sapiens
ggucaaagugucugaagca

SEQ ID NO: 50924 - RNA, 19 nt, Homo sapiens
gaagguggcaaguuauggu

SEQ ID NO: 50925 - RNA, 19 nt, Homo sapiens
ccacugcuaugacgguuac

SEQ ID NO: 50926 - RNA, 19 nt, Homo sapiens
gugcagagcaauccacugu

SEQ ID NO: 50927 - RNA, 19 nt, Homo sapiens
acaaggaacacucaaucaa

SEQ ID NO: 50928 - RNA, 19 nt, Homo sapiens
ucuaccaaaugaucgauga

SEQ ID NO: 50929 - RNA, 19 nt, Homo sapiens
gauguuuucuaccaaauga

SEQ ID NO: 50930 - RNA, 19 nt, Homo sapiens
gaagaccacaaguugaagu

SEQ ID NO: 50931 - RNA, 19 nt, Homo sapiens
ggugugaagccaagauaug

SEQ ID NO: 50932 - RNA, 19 nt, Homo sapiens
gaaacuccaagaugaggau

SEQ ID NO: 50933 - RNA, 19 nt, Homo sapiens
aagaaaggcagcugugaga

SEQ ID NO: 50934 - RNA, 19 nt, Homo sapiens
ugacaaggaacacucaauc

SEQ ID NO: 50935 - RNA, 19 nt, Homo sapiens
gacagagaccauagaagga

SEQ ID NO: 50936 - RNA, 19 nt, Homo sapiens
gggcgugggauugaauuaa

SEQ ID NO: 50937 - RNA, 19 nt, Homo sapiens
cauucaaguugguguaauc

SEQ ID NO: 50938 - RNA, 19 nt, Homo sapiens
ggaggucuacaucaagaau

SEQ ID NO: 50939 - RNA, 19 nt, Homo sapiens
uuaugaagaccacaaguug

SEQ ID NO: 50940 - RNA, 19 nt, Homo sapiens
gaagccaagauauggucua

SEQ ID NO: 50941 - RNA, 19 nt, Homo sapiens
acaucaaccucuuucaagu

SEQ ID NO: 50942 - RNA, 19 nt, Homo sapiens
gaaauauggccagacuauc

SEQ ID NO: 50943 - RNA, 19 nt, Homo sapiens
gaaagugaaucuaaguuug

SEQ ID NO: 50944 - RNA, 19 nt, Homo sapiens
ggaaggcccugaagagaaa

SEQ ID NO: 50945 - RNA, 19 nt, Homo sapiens
gaaagaagauggacaacca

SEQ ID NO: 50946 - RNA, 19 nt, Homo sapiens
gaugaagccuugcugcaua

SEQ ID NO: 50947 - RNA, 19 nt, Homo sapiens
ccacugagcucuacaccaa

SEQ ID NO: 50948 - RNA, 19 nt, Homo sapiens
gaagauggacaaccaauug

SEQ ID NO: 50949 - RNA, 19 nt, Homo sapiens
ggaagacucugugcuuuau

SEQ ID NO: 50950 - RNA, 19 nt, Homo sapiens
caacggagcucuggaagau

SEQ ID NO: 50951 - RNA, 19 nt, Homo sapiens
ggaaagugaaucuaaguuu

SEQ ID NO: 50952 - RNA, 19 nt, Homo sapiens
ucuggaagaugcaccauua

SEQ ID NO: 50953 - RNA, 19 nt, Homo sapiens
acgaugagauucagcuuua

SEQ ID NO: 50954 - RNA, 19 nt, Homo sapiens
ggguaaugcuuugauauuu

SEQ ID NO: 50955 - RNA, 19 nt, Homo sapiens
gaagaaaucaggagagaag

SEQ ID NO: 50956 - RNA, 19 nt, Homo sapiens
gcaaaggacaggcacaaga

SEQ ID NO: 50957 - RNA, 19 nt, Homo sapiens
ggagaaagaagauggacaa

SEQ ID NO: 50958 - RNA, 19 nt, Homo sapiens
gacaacaacucuggaacaa

SEQ ID NO: 50959 - RNA, 19 nt, Homo sapiens
gaugagauucagcuuuaua

SEQ ID NO: 50960 - RNA, 19 nt, Homo sapiens
gaccauaguugacccaucu

SEQ ID NO: 50961 - RNA, 19 nt, Homo sapiens
gcugaccucugccuucauu

SEQ ID NO: 50962 - RNA, 19 nt, Homo sapiens
ggauggagcugaggugcuu

SEQ ID NO: 50963 - RNA, 19 nt, Homo sapiens
cagcaaacccugaagaaug

SEQ ID NO: 50964 - RNA, 19 nt, Homo sapiens
ggaacaagcuauuaaaagu

SEQ ID NO: 50965 - RNA, 19 nt, Homo sapiens
cggagagcauucagacaua

SEQ ID NO: 50966 - RNA, 19 nt, Homo sapiens
acaggaaggucaaggagaa

SEQ ID NO: 50967 - RNA, 19 nt, Homo sapiens
ggagagcauucagacauau

SEQ ID NO: 50968 - RNA, 19 nt, Homo sapiens
gcggaagacucugugcuuu

SEQ ID NO: 50969 - RNA, 19 nt, Homo sapiens
gaaguucagaccuauauca

SEQ ID NO: 50970 - RNA, 19 nt, Homo sapiens
caaaggacaggcacaagaa

SEQ ID NO: 50971 - RNA, 19 nt, Homo sapiens
gaaaugcuugaacggcuua

SEQ ID NO: 50972 - RNA, 19 nt, Homo sapiens
aaagugcccaugaguguua

SEQ ID NO: 50973 - RNA, 19 nt, Homo sapiens
gaaugucaacuccugcuaa

SEQ ID NO: 50974 - RNA, 19 nt, Homo sapiens
gaggguuccuguuuggauu

SEQ ID NO: 50975 - RNA, 19 nt, Homo sapiens
uaacaaggaagcugaugaa

SEQ ID NO: 50976 - RNA, 19 nt, Homo sapiens
gaaagacaaagucagacaa

SEQ ID NO: 50977 - RNA, 19 nt, Homo sapiens
agcaaacccugaagaauga

SEQ ID NO: 50978 - RNA, 19 nt, Homo sapiens
caaagucagacaagaagaa

SEQ ID NO: 50979 - RNA, 19 nt, Homo sapiens
ccagauggagggcagauaa

SEQ ID NO: 50980 - RNA, 19 nt, Homo sapiens
gcagaggaaccaucuauac

SEQ ID NO: 50981 - RNA, 19 nt, Homo sapiens
agauucagcuuuauaacga

SEQ ID NO: 50982 - RNA, 19 nt, Homo sapiens
ggaaagacaaagucagaca

SEQ ID NO: 50983 - RNA, 19 nt, Homo sapiens
gguggaaucuaucgagaag

SEQ ID NO: 50984 - RNA, 19 nt, Homo sapiens
cccaauuucugcaagauga

SEQ ID NO: 50985 - RNA, 19 nt, Homo sapiens
agacaaagucagacaagaa

SEQ ID NO: 50986 - RNA, 19 nt, Homo sapiens
gaccaugauuggaaagaca

SEQ ID NO: 50987 - RNA, 19 nt, Homo sapiens
cggaagacucugugcuuua

SEQ ID NO: 50988 - RNA, 19 nt, Homo sapiens
aagaagaaaucaggagaga

SEQ ID NO: 50989 - RNA, 19 nt, Homo sapiens
ugaagaaaccgcugugauc

SEQ ID NO: 50990 - RNA, 19 nt, Homo sapiens
ggaccgguaucaucguauc

SEQ ID NO: 50991 - RNA, 19 nt, Homo sapiens
aagacucugugcuuuauga

SEQ ID NO: 50992 - RNA, 19 nt, Homo sapiens
uggaagugguggaaucuau

SEQ ID NO: 50993 - RNA, 19 nt, Homo sapiens
uugaacggcuuaacaagga

SEQ ID NO: 50994 - RNA, 19 nt, Homo sapiens
aaugucaacuccugcuaaa

SEQ ID NO: 50995 - RNA, 19 nt, Homo sapiens
ggaagacacaaagcuggua

SEQ ID NO: 50996 - RNA, 19 nt, Homo sapiens
gaaaguaaagaaguaaguc

SEQ ID NO: 50997 - RNA, 19 nt, Homo sapiens
ggugguacuuaaagaggaa

SEQ ID NO: 50998 - RNA, 19 nt, Homo sapiens
ggaagaugcaccauuaaaa

SEQ ID NO: 50999 - RNA, 19 nt, Homo sapiens
gagcuggaccgguaucauc

SEQ ID NO: 51000 - RNA, 19 nt, Homo sapiens
gaucguggagaccaugauu

SEQ ID NO: 51001 - RNA, 19 nt, Homo sapiens
aagaggaaagugaaucuaa

SEQ ID NO: 51002 - RNA, 19 nt, Homo sapiens
gcuggaagcccaauuucug

SEQ ID NO: 51003 - RNA, 19 nt, Homo sapiens
uggauuagaccauaguuga

SEQ ID NO: 51004 - RNA, 19 nt, Homo sapiens
gggugaggguuccuguuug

SEQ ID NO: 51005 - RNA, 19 nt, Homo sapiens
ucacaggggaugccaauua

SEQ ID NO: 51006 - RNA, 19 nt, Homo sapiens
ggugaggguuccuguuugg

SEQ ID NO: 51007 - RNA, 19 nt, Homo sapiens
gugaggagcgggacgaaga

SEQ ID NO: 51008 - RNA, 19 nt, Homo sapiens
ggauauaacagcagcaaaa

SEQ ID NO: 51009 - RNA, 19 nt, Homo sapiens
cagagcggguccuggagaa

SEQ ID NO: 51010 - RNA, 19 nt, Homo sapiens
gaagcaaguaugaaaauga

SEQ ID NO: 51011 - RNA, 19 nt, Homo sapiens
guggagaccaugauuggaa

SEQ ID NO: 51012 - RNA, 19 nt, Homo sapiens
caauugaccagcagccuau

SEQ ID NO: 51013 - RNA, 19 nt, Homo sapiens
gaggaaagugaaucuaagu

SEQ ID NO: 51014 - RNA, 19 nt, Homo sapiens
gacaaagucagacaagaag

SEQ ID NO: 51015 - RNA, 19 nt, Homo sapiens
uggagaccaugauuggaaa

SEQ ID NO: 51016 - RNA, 19 nt, Homo sapiens
caucguaucaucgagauug

SEQ ID NO: 51017 - RNA, 19 nt, Homo sapiens
gugcagaggaaccaucuau

SEQ ID NO: 51018 - RNA, 19 nt, Homo sapiens
ggucaaggagaaagugaga

SEQ ID NO: 51019 - RNA, 19 nt, Homo sapiens
agaggaaagugaaucuaag

SEQ ID NO: 51020 - RNA, 19 nt, Homo sapiens
gacgaugagauucagcuuu

SEQ ID NO: 51021 - RNA, 19 nt, Homo sapiens
ccuccagcauccauuguga

SEQ ID NO: 51022 - RNA, 19 nt, Homo sapiens
gaaaaugagugcgaauguc

SEQ ID NO: 51023 - RNA, 19 nt, Homo sapiens
gaaucuaaguuugaaucag

SEQ ID NO: 51024 - RNA, 19 nt, Homo sapiens
gaagaugcaccauuaaaag

SEQ ID NO: 51025 - RNA, 19 nt, Homo sapiens
uggaagaugcaccauuaaa

SEQ ID NO: 51026 - RNA, 19 nt, Homo sapiens
ggacaggcacaagaagaau

SEQ ID NO: 51027 - RNA, 19 nt, Homo sapiens
ucagcuggaagcccaauuu

SEQ ID NO: 51028 - RNA, 19 nt, Homo sapiens
uaaagaggaaagugaaucu

SEQ ID NO: 51029 - RNA, 19 nt, Homo sapiens
ccaugaguguuaugacgau

SEQ ID NO: 51030 - RNA, 19 nt, Homo sapiens
ggaagugguggaaucuauc

SEQ ID NO: 51031 - RNA, 19 nt, Homo sapiens
cuauagacaaggagauuga

SEQ ID NO: 51032 - RNA, 19 nt, Homo sapiens
gaaggucaaggagaaagug

SEQ ID NO: 51033 - RNA, 19 nt, Homo sapiens
uugggaaacuauacaggaa

SEQ ID NO: 51034 - RNA, 19 nt, Homo sapiens
augaagccuugcugcauaa

SEQ ID NO: 51035 - RNA, 19 nt, Homo sapiens
ucagacauaugaagaaacc

SEQ ID NO: 51036 - RNA, 19 nt, Homo sapiens
uggaaggcccugaagagaa

SEQ ID NO: 51037 - RNA, 19 nt, Homo sapiens
gaccagcagccuauagaca

SEQ ID NO: 51038 - RNA, 19 nt, Homo sapiens
gcaggagaaagaagaugga

SEQ ID NO: 51039 - RNA, 19 nt, Homo sapiens
ucuccuccaucacagcuaa

SEQ ID NO: 51040 - RNA, 19 nt, Homo sapiens
gauucuaugucuccuccau

SEQ ID NO: 51041 - RNA, 19 nt, Homo sapiens
uacaggugguacuuaaaga

SEQ ID NO: 51042 - RNA, 19 nt, Homo sapiens
gagauucagcuuuauaacg

SEQ ID NO: 51043 - RNA, 19 nt, Homo sapiens
cgaguuggcugaccacauc

SEQ ID NO: 51044 - RNA, 19 nt, Homo sapiens
gcacccuucuuuccucuuc

SEQ ID NO: 51045 - RNA, 19 nt, Homo sapiens
gcagcgagguagugaagag

SEQ ID NO: 51046 - RNA, 19 nt, Homo sapiens
ggcgcuaccuguaucaaug

SEQ ID NO: 51047 - RNA, 19 nt, Homo sapiens
ggaggugugugagcucaau

SEQ ID NO: 51048 - RNA, 19 nt, Homo sapiens
ucacacuccucgcccuauu

SEQ ID NO: 51049 - RNA, 19 nt, Homo sapiens
gugcagccuuuguguccaa

SEQ ID NO: 51050 - RNA, 19 nt, Homo sapiens
ccaccgagacaccaugaga

SEQ ID NO: 51051 - RNA, 19 nt, Homo sapiens
ccaggagggagguguguga

SEQ ID NO: 51052 - RNA, 19 nt, Homo sapiens
gggcagcgagguagugaag

SEQ ID NO: 51053 - RNA, 19 nt, Homo sapiens
ucuccaggcacccuucuuu

SEQ ID NO: 51054 - RNA, 19 nt, Homo sapiens
gagggcagcgagguaguga

SEQ ID NO: 51055 - RNA, 19 nt, Homo sapiens
ggagaacaguggcuuugaa

SEQ ID NO: 51056 - RNA, 19 nt, Homo sapiens
ugaaugaacuccaccuaga

SEQ ID NO: 51057 - RNA, 19 nt, Homo sapiens
guccaaggcuccaguccua

SEQ ID NO: 51058 - RNA, 19 nt, Homo sapiens
ugaagucugugcccaaaga

SEQ ID NO: 51059 - RNA, 19 nt, Homo sapiens
ccaacaacaucaccaaagu

SEQ ID NO: 51060 - RNA, 19 nt, Homo sapiens
agacacacauguucuguuc

SEQ ID NO: 51061 - RNA, 19 nt, Homo sapiens
gcaucagccucuucaacaa

SEQ ID NO: 51062 - RNA, 19 nt, Homo sapiens
ggacacaccggacagauag

SEQ ID NO: 51063 - RNA, 19 nt, Homo sapiens
ccaccuagaccacaacaaa

SEQ ID NO: 51064 - RNA, 19 nt, Homo sapiens
guggcugucuuuccauuaa

SEQ ID NO: 51065 - RNA, 19 nt, Homo sapiens
gaccaguccucccuucugu

SEQ ID NO: 51066 - RNA, 19 nt, Homo sapiens
gccaggaggcgguccauaa

SEQ ID NO: 51067 - RNA, 19 nt, Homo sapiens
uaucugcacuccaacaaca

SEQ ID NO: 51068 - RNA, 19 nt, Homo sapiens
gaacacagccagacauccu

SEQ ID NO: 51069 - RNA, 19 nt, Homo sapiens
ccgcaaggaugacuucaag

SEQ ID NO: 51070 - RNA, 19 nt, Homo sapiens
agaccuuucucgcuucuga

SEQ ID NO: 51071 - RNA, 19 nt, Homo sapiens
gaacaguggcuuugaaccu

SEQ ID NO: 51072 - RNA, 19 nt, Homo sapiens
ggaacccacuggagaacag

SEQ ID NO: 51073 - RNA, 19 nt, Homo sapiens
aggaggcgguccauaagaa

SEQ ID NO: 51074 - RNA, 19 nt, Homo sapiens
ucccuucuguucucucuuu

SEQ ID NO: 51075 - RNA, 19 nt, Homo sapiens
caacaacaucaccaaagug

SEQ ID NO: 51076 - RNA, 19 nt, Homo sapiens
gaugaacgaugaggaagcu

SEQ ID NO: 51077 - RNA, 19 nt, Homo sapiens
ggagugaguagcugcuuuc

SEQ ID NO: 51078 - RNA, 19 nt, Homo sapiens
aaagagaucuccccugaca

SEQ ID NO: 51079 - RNA, 19 nt, Homo sapiens
uggcuucgccugucccuuu

SEQ ID NO: 51080 - RNA, 19 nt, Homo sapiens
ggacuucacccuggacgau

SEQ ID NO: 51081 - RNA, 19 nt, Homo sapiens
ggcaucagccucuucaaca

SEQ ID NO: 51082 - RNA, 19 nt, Homo sapiens
ucaugcauuuccagccuuu

SEQ ID NO: 51083 - RNA, 19 nt, Homo sapiens
ucccugagacccugaauga

SEQ ID NO: 51084 - RNA, 19 nt, Homo sapiens
cggacacaccggacagaua

SEQ ID NO: 51085 - RNA, 19 nt, Homo sapiens
gagcugggacugcuuucug

SEQ ID NO: 51086 - RNA, 19 nt, Homo sapiens
caugaugaacgaugaggaa

SEQ ID NO: 51087 - RNA, 19 nt, Homo sapiens
ugaggucgguggcugucuu

SEQ ID NO: 51088 - RNA, 19 nt, Homo sapiens
ugcagaagcucuacaucuc

SEQ ID NO: 51089 - RNA, 19 nt, Homo sapiens
gcgggaacccacuggagaa

SEQ ID NO: 51090 - RNA, 19 nt, Homo sapiens
ucuccgagcuccgcaagga

SEQ ID NO: 51091 - RNA, 19 nt, Homo sapiens
ucugaagucugugcccaaa

SEQ ID NO: 51092 - RNA, 19 nt, Homo sapiens
gguggcugucuuuccauua

SEQ ID NO: 51093 - RNA, 19 nt, Homo sapiens
gggacugcuuucugucugu

SEQ ID NO: 51094 - RNA, 19 nt, Homo sapiens
ggcagagccaggaagcuaa

SEQ ID NO: 51095 - RNA, 19 nt, Homo sapiens
uuaaagaaacaccgugcaa

SEQ ID NO: 51096 - RNA, 19 nt, Homo sapiens
ggaggcgguccauaagaau

SEQ ID NO: 51097 - RNA, 19 nt, Homo sapiens
gaaugaacuccaccuagac

SEQ ID NO: 51098 - RNA, 19 nt, Homo sapiens
gccugaagcucaacuaccu

SEQ ID NO: 51099 - RNA, 19 nt, Homo sapiens
ucgauggccugaagcucaa

SEQ ID NO: 51100 - RNA, 19 nt, Homo sapiens
guggcuaggucuccccuua

SEQ ID NO: 51101 - RNA, 19 nt, Homo sapiens
ccaaagugggugucaacga

SEQ ID NO: 51102 - RNA, 19 nt, Homo sapiens
gagaacaguggcuuugaac

SEQ ID NO: 51103 - RNA, 19 nt, Homo sapiens
ccaguccucccuucuguuc

SEQ ID NO: 51104 - RNA, 19 nt, Homo sapiens
ggacccggacucugucaca

SEQ ID NO: 51105 - RNA, 19 nt, Homo sapiens
caacuaccugcgcaucuca

SEQ ID NO: 51106 - RNA, 19 nt, Homo sapiens
gaggucgguggcugucuuu

SEQ ID NO: 51107 - RNA, 19 nt, Homo sapiens
cccaaagaccucccugaga

SEQ ID NO: 51108 - RNA, 19 nt, Homo sapiens
ugacuggcauccccaaaga

SEQ ID NO: 51109 - RNA, 19 nt, Homo sapiens
uggcugucuuuccauuaaa

SEQ ID NO: 51110 - RNA, 19 nt, Homo sapiens
ugagcuugguggccuguuc

SEQ ID NO: 51111 - RNA, 19 nt, Homo sapiens
gaggcgguccauaagaaug

SEQ ID NO: 51112 - RNA, 19 nt, Homo sapiens
aggagugaguagcugcuuu

SEQ ID NO: 51113 - RNA, 19 nt, Homo sapiens
ucaacuaccugcgcaucuc

SEQ ID NO: 51114 - RNA, 19 nt, Homo sapiens
ccagguccauccgccaugu

SEQ ID NO: 51115 - RNA, 19 nt, Homo sapiens
acacacauguucuguuccu

SEQ ID NO: 51116 - RNA, 19 nt, Homo sapiens
ccaggaggcgguccauaag

SEQ ID NO: 51117 - RNA, 19 nt, Homo sapiens
gcagagccaggaagcuaag

SEQ ID NO: 51118 - RNA, 19 nt, Homo sapiens
gggaacacagccagacauc

SEQ ID NO: 51119 - RNA, 19 nt, Homo sapiens
aaacugcccaggagugagu

SEQ ID NO: 51120 - RNA, 19 nt, Homo sapiens
ugcuggaccugcagaacaa

SEQ ID NO: 51121 - RNA, 19 nt, Homo sapiens
acaaacugcccaggaguga

SEQ ID NO: 51122 - RNA, 19 nt, Homo sapiens
ugaacaacaagaucuccaa

SEQ ID NO: 51123 - RNA, 19 nt, Homo sapiens
caggaggcgguccauaaga

SEQ ID NO: 51124 - RNA, 19 nt, Homo sapiens
caacggcaucagccucuuc

SEQ ID NO: 51125 - RNA, 19 nt, Homo sapiens
ccugagacccugaaugaac

SEQ ID NO: 51126 - RNA, 19 nt, Homo sapiens
ggaggaggauuauaacuua

SEQ ID NO: 51127 - RNA, 19 nt, Homo sapiens
gcacaguacuccuggcuua

SEQ ID NO: 51128 - RNA, 19 nt, Homo sapiens
gaucaugucugaauuaugu

SEQ ID NO: 51129 - RNA, 19 nt, Homo sapiens
ggaaccagcuucugauaaa

SEQ ID NO: 51130 - RNA, 19 nt, Homo sapiens
agucagaucuugugaauga

SEQ ID NO: 51131 - RNA, 19 nt, Homo sapiens
gaaagaaaccaccgaaauc

SEQ ID NO: 51132 - RNA, 19 nt, Homo sapiens
uaacagccucugaaauuua

SEQ ID NO: 51133 - RNA, 19 nt, Homo sapiens
gcaaacagcggucgagaga

SEQ ID NO: 51134 - RNA, 19 nt, Homo sapiens
gaaaguacauugggagucu

SEQ ID NO: 51135 - RNA, 19 nt, Homo sapiens
gaaaguaaacggcaguaau

SEQ ID NO: 51136 - RNA, 19 nt, Homo sapiens
cugcagugcugauguauuu

SEQ ID NO: 51137 - RNA, 19 nt, Homo sapiens
gcugugcuguguuauuuaa

SEQ ID NO: 51138 - RNA, 19 nt, Homo sapiens
ccuaacagccacagaaaua

SEQ ID NO: 51139 - RNA, 19 nt, Homo sapiens
caacaccacccucagcaua

SEQ ID NO: 51140 - RNA, 19 nt, Homo sapiens
gcucacagccucacuucua

SEQ ID NO: 51141 - RNA, 19 nt, Homo sapiens
uggcuaagaucaugucuga

SEQ ID NO: 51142 - RNA, 19 nt, Homo sapiens
ugagcuaaguccaguagua

SEQ ID NO: 51143 - RNA, 19 nt, Homo sapiens
ggaaacagcgagagagaga

SEQ ID NO: 51144 - RNA, 19 nt, Homo sapiens
gcaagccugucuucagaga

SEQ ID NO: 51145 - RNA, 19 nt, Homo sapiens
gaaagagggaccagaacuu

SEQ ID NO: 51146 - RNA, 19 nt, Homo sapiens
ucaggagccucucaagauu

SEQ ID NO: 51147 - RNA, 19 nt, Homo sapiens
ccagucaccuugaauguca

SEQ ID NO: 51148 - RNA, 19 nt, Homo sapiens
caacaggacccucacucua

SEQ ID NO: 51149 - RNA, 19 nt, Homo sapiens
gauggcaaccgucaaauug

SEQ ID NO: 51150 - RNA, 19 nt, Homo sapiens
gcugugaggaggaggauua

SEQ ID NO: 51151 - RNA, 19 nt, Homo sapiens
ggagggaaccagcuucuga

SEQ ID NO: 51152 - RNA, 19 nt, Homo sapiens
caguagcccuggcauguuu

SEQ ID NO: 51153 - RNA, 19 nt, Homo sapiens
gaucauagucacugagcua

SEQ ID NO: 51154 - RNA, 19 nt, Homo sapiens
aaagucagaucuugugaau

SEQ ID NO: 51155 - RNA, 19 nt, Homo sapiens
aaacagcggucgagagaca

SEQ ID NO: 51156 - RNA, 19 nt, Homo sapiens
gcuaagaucaugucugaau

SEQ ID NO: 51157 - RNA, 19 nt, Homo sapiens
gugaggaggaggauuauaa

SEQ ID NO: 51158 - RNA, 19 nt, Homo sapiens
ucagaccaaucaucaacua

SEQ ID NO: 51159 - RNA, 19 nt, Homo sapiens
gaacuagcaaagagaagaa

SEQ ID NO: 51160 - RNA, 19 nt, Homo sapiens
gcaguaaugcuucuccuau

SEQ ID NO: 51161 - RNA, 19 nt, Homo sapiens
uuaacagccucugaaauuu

SEQ ID NO: 51162 - RNA, 19 nt, Homo sapiens
gucaauagaugaaaguaca

SEQ ID NO: 51163 - RNA, 19 nt, Homo sapiens
caagaugaaugaaguuacu

SEQ ID NO: 51164 - RNA, 19 nt, Homo sapiens
cuaacaagaugaaugaagu

SEQ ID NO: 51165 - RNA, 19 nt, Homo sapiens
gaacguaaacuauaaugcu

SEQ ID NO: 51166 - RNA, 19 nt, Homo sapiens
gcauaaacccugucaagag

SEQ ID NO: 51167 - RNA, 19 nt, Homo sapiens
gucagaggcuccaaauaga

SEQ ID NO: 51168 - RNA, 19 nt, Homo sapiens
aguaaugcuucuccuauuu

SEQ ID NO: 51169 - RNA, 19 nt, Homo sapiens
ggagauaaggacucuguga

SEQ ID NO: 51170 - RNA, 19 nt, Homo sapiens
gaaauacagaacccaguga

SEQ ID NO: 51171 - RNA, 19 nt, Homo sapiens
uggcaaccgucaaauugua

SEQ ID NO: 51172 - RNA, 19 nt, Homo sapiens
uuuaacagccucugaaauu

SEQ ID NO: 51173 - RNA, 19 nt, Homo sapiens
ugaaagaaaccaccgaaau

SEQ ID NO: 51174 - RNA, 19 nt, Homo sapiens
gcccuucagcgauuauuua

SEQ ID NO: 51175 - RNA, 19 nt, Homo sapiens
gugcuuagcuagaauacca

SEQ ID NO: 51176 - RNA, 19 nt, Homo sapiens
gccauagccuugagguuau

SEQ ID NO: 51177 - RNA, 19 nt, Homo sapiens
ucagagagcugcccuucag

SEQ ID NO: 51178 - RNA, 19 nt, Homo sapiens
caguaaugcuucuccuauu

SEQ ID NO: 51179 - RNA, 19 nt, Homo sapiens
aaaguaaacggcaguaaug

SEQ ID NO: 51180 - RNA, 19 nt, Homo sapiens
gagauaaggacucugugaa

SEQ ID NO: 51181 - RNA, 19 nt, Homo sapiens
cuaagaucaugucugaauu

SEQ ID NO: 51182 - RNA, 19 nt, Homo sapiens
caacuaccauucuauucca

SEQ ID NO: 51183 - RNA, 19 nt, Homo sapiens
gagcuagauuuaacucagu

SEQ ID NO: 51184 - RNA, 19 nt, Homo sapiens
uggcaagccugucuucaga

SEQ ID NO: 51185 - RNA, 19 nt, Homo sapiens
ccaaugacccaccuaacaa

SEQ ID NO: 51186 - RNA, 19 nt, Homo sapiens
ggaggaugcugggacguau

SEQ ID NO: 51187 - RNA, 19 nt, Homo sapiens
ggaccacagucaagacgau

SEQ ID NO: 51188 - RNA, 19 nt, Homo sapiens
caaccuaccugugguggau

SEQ ID NO: 51189 - RNA, 19 nt, Homo sapiens
uguaggauaugcaauagga

SEQ ID NO: 51190 - RNA, 19 nt, Homo sapiens
gaggaagacaggcaaaugu

SEQ ID NO: 51191 - RNA, 19 nt, Homo sapiens
gcuaggaacuugggaaagg

SEQ ID NO: 51192 - RNA, 19 nt, Homo sapiens
gcugauguauuucaagucu

SEQ ID NO: 51193 - RNA, 19 nt, Homo sapiens
gggaaccagcuucugauaa

SEQ ID NO: 51194 - RNA, 19 nt, Homo sapiens
gcuagaauaccaccuaauc

SEQ ID NO: 51195 - RNA, 19 nt, Homo sapiens
ggauggcaaccgucaaauu

SEQ ID NO: 51196 - RNA, 19 nt, Homo sapiens
guaaacggcaguaaugcuu

SEQ ID NO: 51197 - RNA, 19 nt, Homo sapiens
uccaugcugugcuguguua

SEQ ID NO: 51198 - RNA, 19 nt, Homo sapiens
ccaaccuucuugucauuga

SEQ ID NO: 51199 - RNA, 19 nt, Homo sapiens
uaacccaccugcacaguac

SEQ ID NO: 51200 - RNA, 19 nt, Homo sapiens
gcaauaggaacucaacaag

SEQ ID NO: 51201 - RNA, 19 nt, Homo sapiens
gugcauacuuucccucauc

SEQ ID NO: 51202 - RNA, 19 nt, Homo sapiens
uugcuuaccugaucucaug

SEQ ID NO: 51203 - RNA, 19 nt, Homo sapiens
ucugagacauuccaccauu

SEQ ID NO: 51204 - RNA, 19 nt, Homo sapiens
gaacuugggaaaggaauca

SEQ ID NO: 51205 - RNA, 19 nt, Homo sapiens
guuauguccuuuuccauua

SEQ ID NO: 51206 - RNA, 19 nt, Homo sapiens
ugccauagccuugagguua

SEQ ID NO: 51207 - RNA, 19 nt, Homo sapiens
cuacucuuccuuccuaaua

SEQ ID NO: 51208 - RNA, 19 nt, Homo sapiens
ggcccugguugcucugaua

SEQ ID NO: 51209 - RNA, 19 nt, Homo sapiens
caucaacuaccauucuauu

SEQ ID NO: 51210 - RNA, 19 nt, Homo sapiens
uagcuagaauaccaccuaa

SEQ ID NO: 51211 - RNA, 19 nt, Homo sapiens
cuaauucggauuugccaua

SEQ ID NO: 51212 - RNA, 19 nt, Homo sapiens
cuauaaugcucuaccacaa

SEQ ID NO: 51213 - RNA, 19 nt, Homo sapiens
cuauauugcuuaccugauc

SEQ ID NO: 51214 - RNA, 19 nt, Homo sapiens
ggaggaagacaggcaaaug

SEQ ID NO: 51215 - RNA, 19 nt, Homo sapiens
ugucagaggcuccaaauag

SEQ ID NO: 51216 - RNA, 19 nt, Homo sapiens
ccgauugccuuaggugaaa

SEQ ID NO: 51217 - RNA, 19 nt, Homo sapiens
aaacaacuuucuccuacuc

SEQ ID NO: 51218 - RNA, 19 nt, Homo sapiens
gaacuuugaagcccagcaa

SEQ ID NO: 51219 - RNA, 19 nt, Homo sapiens
gauaugcaauaggaacuca

SEQ ID NO: 51220 - RNA, 19 nt, Homo sapiens
cguaaacuauaaugcucua

SEQ ID NO: 51221 - RNA, 19 nt, Homo sapiens
cauagucacugagcuaagu

SEQ ID NO: 51222 - RNA, 19 nt, Homo sapiens
cacggacugugcauacuuu

SEQ ID NO: 51223 - RNA, 19 nt, Homo sapiens
caaggcaauuccugaugga

SEQ ID NO: 51224 - RNA, 19 nt, Homo sapiens
ucagagaacccacuagaag

SEQ ID NO: 51225 - RNA, 19 nt, Homo sapiens
aaacagcgagagagagaaa

SEQ ID NO: 51226 - RNA, 19 nt, Homo sapiens
uaugagaccugaucaauaa

SEQ ID NO: 51227 - RNA, 19 nt, Homo sapiens
gaagauaucugggcaggaa

SEQ ID NO: 51228 - RNA, 19 nt, Homo sapiens
gaggagagauggauauuuc

SEQ ID NO: 51229 - RNA, 19 nt, Homo sapiens
ugaaggagaugcuuuggua

SEQ ID NO: 51230 - RNA, 19 nt, Homo sapiens
gaacguggacuucuugauu

SEQ ID NO: 51231 - RNA, 19 nt, Homo sapiens
gcaacuaugucuuagagaa

SEQ ID NO: 51232 - RNA, 19 nt, Homo sapiens
gagugaaacugaagucaaa

SEQ ID NO: 51233 - RNA, 19 nt, Homo sapiens
caaaacacaucacaucuua

SEQ ID NO: 51234 - RNA, 19 nt, Homo sapiens
gcagagugagcuuguauua

SEQ ID NO: 51235 - RNA, 19 nt, Homo sapiens
gagaccugaucaauaaaua

SEQ ID NO: 51236 - RNA, 19 nt, Homo sapiens
caaagaggaugagacauga

SEQ ID NO: 51237 - RNA, 19 nt, Homo sapiens
gcaaagaggaugagacaug

SEQ ID NO: 51238 - RNA, 19 nt, Homo sapiens
gauuggagauggaggguuu

SEQ ID NO: 51239 - RNA, 19 nt, Homo sapiens
gcaggagcauccaucauug

SEQ ID NO: 51240 - RNA, 19 nt, Homo sapiens
gaagauacaagacuauuag

SEQ ID NO: 51241 - RNA, 19 nt, Homo sapiens
gaaaggggcuuccaaguuc

SEQ ID NO: 51242 - RNA, 19 nt, Homo sapiens
caaaguaaaucuugaacag

SEQ ID NO: 51243 - RNA, 19 nt, Homo sapiens
gagcuuguauuaguuggua

SEQ ID NO: 51244 - RNA, 19 nt, Homo sapiens
acaaguggcugaugaagga

SEQ ID NO: 51245 - RNA, 19 nt, Homo sapiens
gcucaagccugaagauaca

SEQ ID NO: 51246 - RNA, 19 nt, Homo sapiens
ggugugaacugccacuuug

SEQ ID NO: 51247 - RNA, 19 nt, Homo sapiens
agagugagcuuguauuagu

SEQ ID NO: 51248 - RNA, 19 nt, Homo sapiens
ggucacaguuccuacaaau

SEQ ID NO: 51249 - RNA, 19 nt, Homo sapiens
cagugaagcucaugaagga

SEQ ID NO: 51250 - RNA, 19 nt, Homo sapiens
gaacaugacccuuaguaac

SEQ ID NO: 51251 - RNA, 19 nt, Homo sapiens
uguauuaguugguagcuuu

SEQ ID NO: 51252 - RNA, 19 nt, Homo sapiens
ggguuuggauccacaguuu

SEQ ID NO: 51253 - RNA, 19 nt, Homo sapiens
guaggucagucauaugaga

SEQ ID NO: 51254 - RNA, 19 nt, Homo sapiens
auacaacccuucaauguca

SEQ ID NO: 51255 - RNA, 19 nt, Homo sapiens
ucagacaccuucauaccuu

SEQ ID NO: 51256 - RNA, 19 nt, Homo sapiens
cgacaucgcccgacaagug

SEQ ID NO: 51257 - RNA, 19 nt, Homo sapiens
ucaugcagcuuucuaaaca

SEQ ID NO: 51258 - RNA, 19 nt, Homo sapiens
gcuauuaccugaacaaaau

SEQ ID NO: 51259 - RNA, 19 nt, Homo sapiens
acugaaagcucaccugaug

SEQ ID NO: 51260 - RNA, 19 nt, Homo sapiens
gcagcuuucuaaacauuau

SEQ ID NO: 51261 - RNA, 19 nt, Homo sapiens
aaacaugacuacccucagu

SEQ ID NO: 51262 - RNA, 19 nt, Homo sapiens
agaaagaagccacaacuga

SEQ ID NO: 51263 - RNA, 19 nt, Homo sapiens
guugaaaccuugauagcau

SEQ ID NO: 51264 - RNA, 19 nt, Homo sapiens
uuuaaaugcuggagagauu

SEQ ID NO: 51265 - RNA, 19 nt, Homo sapiens
ucaucgaucucccagaauu

SEQ ID NO: 51266 - RNA, 19 nt, Homo sapiens
caagaagggcauccuagaa

SEQ ID NO: 51267 - RNA, 19 nt, Homo sapiens
gggcaacuaugucuuagag

SEQ ID NO: 51268 - RNA, 19 nt, Homo sapiens
gauacaagacuauuagaag

SEQ ID NO: 51269 - RNA, 19 nt, Homo sapiens
gcagcaaccaugugcauug

SEQ ID NO: 51270 - RNA, 19 nt, Homo sapiens
auaaguaggucagucauau

SEQ ID NO: 51271 - RNA, 19 nt, Homo sapiens
ugaauuguuugagcuguuu

SEQ ID NO: 51272 - RNA, 19 nt, Homo sapiens
ugacuacccucaguguauu

SEQ ID NO: 51273 - RNA, 19 nt, Homo sapiens
uuuccuagauugagaacua

SEQ ID NO: 51274 - RNA, 19 nt, Homo sapiens
gauggaggguuugucuuug

SEQ ID NO: 51275 - RNA, 19 nt, Homo sapiens
gaagcugugugggcaguug

SEQ ID NO: 51276 - RNA, 19 nt, Homo sapiens
cagacaccuucauaccuua

SEQ ID NO: 51277 - RNA, 19 nt, Homo sapiens
gaaggaauacugggagaau

SEQ ID NO: 51278 - RNA, 19 nt, Homo sapiens
gaagugguuuggacaugca

SEQ ID NO: 51279 - RNA, 19 nt, Homo sapiens
gagugagcuuguauuaguu

SEQ ID NO: 51280 - RNA, 19 nt, Homo sapiens
guuaaugccacuugaagaa

SEQ ID NO: 51281 - RNA, 19 nt, Homo sapiens
gagcagagugagcuuguau

SEQ ID NO: 51282 - RNA, 19 nt, Homo sapiens
caucuuacugucgaaauua

SEQ ID NO: 51283 - RNA, 19 nt, Homo sapiens
uaaaagacauagaccaaug

SEQ ID NO: 51284 - RNA, 19 nt, Homo sapiens
agaccauccuguuuaaguu

SEQ ID NO: 51285 - RNA, 19 nt, Homo sapiens
ggacagauaaagcgcuaug

SEQ ID NO: 51286 - RNA, 19 nt, Homo sapiens
gcagugcuuucaugaaugc

SEQ ID NO: 51287 - RNA, 19 nt, Homo sapiens
ccauacaacccuucaaugu

SEQ ID NO: 51288 - RNA, 19 nt, Homo sapiens
ggaggagagauggauauuu

SEQ ID NO: 51289 - RNA, 19 nt, Homo sapiens
gauaaagcgcuauggaaag

SEQ ID NO: 51290 - RNA, 19 nt, Homo sapiens
agauaaagcgcuauggaaa

SEQ ID NO: 51291 - RNA, 19 nt, Homo sapiens
gaaugccauccuacacaua

SEQ ID NO: 51292 - RNA, 19 nt, Homo sapiens
gcagaaagaagccacaacu

SEQ ID NO: 51293 - RNA, 19 nt, Homo sapiens
caagggccaggaaggaaua

SEQ ID NO: 51294 - RNA, 19 nt, Homo sapiens
ggaggcugcccaacugaaa

SEQ ID NO: 51295 - RNA, 19 nt, Homo sapiens
aguuagaggucuuuaugaa

SEQ ID NO: 51296 - RNA, 19 nt, Homo sapiens
gaccauccuguuuaaguuu

SEQ ID NO: 51297 - RNA, 19 nt, Homo sapiens
gagaccauccuguuuaagu

SEQ ID NO: 51298 - RNA, 19 nt, Homo sapiens
gccugaagauacaagacua

SEQ ID NO: 51299 - RNA, 19 nt, Homo sapiens
gcaguucgccagcuucauc

SEQ ID NO: 51300 - RNA, 19 nt, Homo sapiens
cagauaaagcgcuauggaa

SEQ ID NO: 51301 - RNA, 19 nt, Homo sapiens
gggcauccuagaacguuua

SEQ ID NO: 51302 - RNA, 19 nt, Homo sapiens
gggaagugguuuggacaug

SEQ ID NO: 51303 - RNA, 19 nt, Homo sapiens
ugagucagacaccuucaua

SEQ ID NO: 51304 - RNA, 19 nt, Homo sapiens
acucuagccugguuuccua

SEQ ID NO: 51305 - RNA, 19 nt, Homo sapiens
cacaguagccucgauagaa

SEQ ID NO: 51306 - RNA, 19 nt, Homo sapiens
gcaggaggagugagucaga

SEQ ID NO: 51307 - RNA, 19 nt, Homo sapiens
ccauaaggcugagcagagu

SEQ ID NO: 51308 - RNA, 19 nt, Homo sapiens
cauccuacacauauuauug

SEQ ID NO: 51309 - RNA, 19 nt, Homo sapiens
ucacaguuccuacaaauac

SEQ ID NO: 51310 - RNA, 19 nt, Homo sapiens
ccaagaagggcauccuaga

SEQ ID NO: 51311 - RNA, 19 nt, Homo sapiens
cuucauaccuuagcugcaa

SEQ ID NO: 51312 - RNA, 19 nt, Homo sapiens
aaagaagagcaaugagaaa

SEQ ID NO: 51313 - RNA, 19 nt, Homo sapiens
uagccugguuuccuagauu

SEQ ID NO: 51314 - RNA, 19 nt, Homo sapiens
gaagacaagcuggagaaca

SEQ ID NO: 51315 - RNA, 19 nt, Homo sapiens
uuucaugaaugccauccua

SEQ ID NO: 51316 - RNA, 19 nt, Homo sapiens
ggagauggaggguuugucu

SEQ ID NO: 51317 - RNA, 19 nt, Homo sapiens
gcaagggccaggaaggaau

SEQ ID NO: 51318 - RNA, 19 nt, Homo sapiens
caacaagcagggauucauc

SEQ ID NO: 51319 - RNA, 19 nt, Homo sapiens
gcccuuggcuuaccacacu

SEQ ID NO: 51320 - RNA, 19 nt, Homo sapiens
cauccuagaacguuuaaau

SEQ ID NO: 51321 - RNA, 19 nt, Homo sapiens
ggucaugcagcuuucuaaa

SEQ ID NO: 51322 - RNA, 19 nt, Homo sapiens
gcuacaagacacuuaagga

SEQ ID NO: 51323 - RNA, 19 nt, Homo sapiens
acacaucacaucuuacugu

SEQ ID NO: 51324 - RNA, 19 nt, Homo sapiens
ugaacaugacccuuaguaa

SEQ ID NO: 51325 - RNA, 19 nt, Homo sapiens
gaaguugguaggcuagcaa

SEQ ID NO: 51326 - RNA, 19 nt, Homo sapiens
gaaaugaacugaaggcuuu

SEQ ID NO: 51327 - RNA, 19 nt, Homo sapiens
gcaaagagccaaugaauau

SEQ ID NO: 51328 - RNA, 19 nt, Homo sapiens
gaagagauccucaagcuaa

SEQ ID NO: 51329 - RNA, 19 nt, Homo sapiens
ugacgaagcuuagaaauga

SEQ ID NO: 51330 - RNA, 19 nt, Homo sapiens
gcaacugucucgucaaaga

SEQ ID NO: 51331 - RNA, 19 nt, Homo sapiens
gaauacggaugaaggauga

SEQ ID NO: 51332 - RNA, 19 nt, Homo sapiens
gaaacugaauggagacuau

SEQ ID NO: 51333 - RNA, 19 nt, Homo sapiens
gcacagagcccagcaaaga

SEQ ID NO: 51334 - RNA, 19 nt, Homo sapiens
ggacuauacugaauuggaa

SEQ ID NO: 51335 - RNA, 19 nt, Homo sapiens
gaaggaggcuuacuaucug

SEQ ID NO: 51336 - RNA, 19 nt, Homo sapiens
ggauuaauguccaucguuu

SEQ ID NO: 51337 - RNA, 19 nt, Homo sapiens
gaugaaauccgagaauaua

SEQ ID NO: 51338 - RNA, 19 nt, Homo sapiens
agaagacucugaacacuuu

SEQ ID NO: 51339 - RNA, 19 nt, Homo sapiens
gaagguugcugaagaugga

SEQ ID NO: 51340 - RNA, 19 nt, Homo sapiens
ggacaucaaugguuuagag

SEQ ID NO: 51341 - RNA, 19 nt, Homo sapiens
ggagugaaccaaacaauga

SEQ ID NO: 51342 - RNA, 19 nt, Homo sapiens
gaaccaaguccaacuaaga

SEQ ID NO: 51343 - RNA, 19 nt, Homo sapiens
uaacugaggugauugaucu

SEQ ID NO: 51344 - RNA, 19 nt, Homo sapiens
uagcuaaucucaagaacaa

SEQ ID NO: 51345 - RNA, 19 nt, Homo sapiens
gaucugaaagcugaaauua

SEQ ID NO: 51346 - RNA, 19 nt, Homo sapiens
gcaacaagaugugaugaau

SEQ ID NO: 51347 - RNA, 19 nt, Homo sapiens
gagcagaucgccacauuga

SEQ ID NO: 51348 - RNA, 19 nt, Homo sapiens
ccacagugcucacaacuag

SEQ ID NO: 51349 - RNA, 19 nt, Homo sapiens
cacaaucucuccuguuauu

SEQ ID NO: 51350 - RNA, 19 nt, Homo sapiens
aagaagcccucgagacuuu

SEQ ID NO: 51351 - RNA, 19 nt, Homo sapiens
gacauucagugaggaguua

SEQ ID NO: 51352 - RNA, 19 nt, Homo sapiens
gaaaaucacaguacccuua

SEQ ID NO: 51353 - RNA, 19 nt, Homo sapiens
cccacaaucucuccuguua

SEQ ID NO: 51354 - RNA, 19 nt, Homo sapiens
ucaaacagcaguaugauga

SEQ ID NO: 51355 - RNA, 19 nt, Homo sapiens
caacaagaugugaugaaua

SEQ ID NO: 51356 - RNA, 19 nt, Homo sapiens
gaaaccaugacgaagcuua

SEQ ID NO: 51357 - RNA, 19 nt, Homo sapiens
gggagcagaucgccacauu

SEQ ID NO: 51358 - RNA, 19 nt, Homo sapiens
gaccucaucugaaccaguu

SEQ ID NO: 51359 - RNA, 19 nt, Homo sapiens
guagauggacucaaauuug

SEQ ID NO: 51360 - RNA, 19 nt, Homo sapiens
acacuuaccuccugcauag

SEQ ID NO: 51361 - RNA, 19 nt, Homo sapiens
ggaggaggcccaugacuau

SEQ ID NO: 51362 - RNA, 19 nt, Homo sapiens
gaagaagacucugaacacu

SEQ ID NO: 51363 - RNA, 19 nt, Homo sapiens
aaacaaggaccucaucuga

SEQ ID NO: 51364 - RNA, 19 nt, Homo sapiens
caagugacauccgcaaaga

SEQ ID NO: 51365 - RNA, 19 nt, Homo sapiens
ucugaaagcugaaauuaag

SEQ ID NO: 51366 - RNA, 19 nt, Homo sapiens
aaacuacacugaugagaag

SEQ ID NO: 51367 - RNA, 19 nt, Homo sapiens
caccaugugugucuaugua

SEQ ID NO: 51368 - RNA, 19 nt, Homo sapiens
guuuagagauccuugaaug

SEQ ID NO: 51369 - RNA, 19 nt, Homo sapiens
ggaagaagcccucgagacu

SEQ ID NO: 51370 - RNA, 19 nt, Homo sapiens
gaucggcagcccuaaagua

SEQ ID NO: 51371 - RNA, 19 nt, Homo sapiens
ucaaauggcuacaguucau

SEQ ID NO: 51372 - RNA, 19 nt, Homo sapiens
gaucccaccuccacagaau

SEQ ID NO: 51373 - RNA, 19 nt, Homo sapiens
aaacuaguguccacguuga

SEQ ID NO: 51374 - RNA, 19 nt, Homo sapiens
cuacagagaauacggauga

SEQ ID NO: 51375 - RNA, 19 nt, Homo sapiens
cuuccuaccuacagaauuu

SEQ ID NO: 51376 - RNA, 19 nt, Homo sapiens
ccaugggccucuugugaaa

SEQ ID NO: 51377 - RNA, 19 nt, Homo sapiens
ccacagacacccaacauuc

SEQ ID NO: 51378 - RNA, 19 nt, Homo sapiens
gauccaggcugccgaguac

SEQ ID NO: 51379 - RNA, 19 nt, Homo sapiens
gaacccugucucugacuua

SEQ ID NO: 51380 - RNA, 19 nt, Homo sapiens
cuacaaccuuaaugccaua

SEQ ID NO: 51381 - RNA, 19 nt, Homo sapiens
ggagaguggugagaagaug

SEQ ID NO: 51382 - RNA, 19 nt, Homo sapiens
ugcagacgguggaccauua

SEQ ID NO: 51383 - RNA, 19 nt, Homo sapiens
caucaaugguuuagagauc

SEQ ID NO: 51384 - RNA, 19 nt, Homo sapiens
uagagaggcuaaccaagga

SEQ ID NO: 51385 - RNA, 19 nt, Homo sapiens
gggcuguggucacuaaugu

SEQ ID NO: 51386 - RNA, 19 nt, Homo sapiens
cgaaggaggcuuacuaucu

SEQ ID NO: 51387 - RNA, 19 nt, Homo sapiens
cagcaucgaaggaggcuua

SEQ ID NO: 51388 - RNA, 19 nt, Homo sapiens
ggacuuagaguuugaccau

SEQ ID NO: 51389 - RNA, 19 nt, Homo sapiens
guuagcagcugcagaggau

SEQ ID NO: 51390 - RNA, 19 nt, Homo sapiens
gcuuagaaaugaacugaag

SEQ ID NO: 51391 - RNA, 19 nt, Homo sapiens
gagaaggaguugcaaaaga

SEQ ID NO: 51392 - RNA, 19 nt, Homo sapiens
aaauccagauguaugauga

SEQ ID NO: 51393 - RNA, 19 nt, Homo sapiens
acgagaaaguugagaagaa

SEQ ID NO: 51394 - RNA, 19 nt, Homo sapiens
gcuggaggacuuagaguuu

SEQ ID NO: 51395 - RNA, 19 nt, Homo sapiens
caagaugugaugaauaugu

SEQ ID NO: 51396 - RNA, 19 nt, Homo sapiens
gggaggaggcccaugacua

SEQ ID NO: 51397 - RNA, 19 nt, Homo sapiens
ggaagagauccucaagcua

SEQ ID NO: 51398 - RNA, 19 nt, Homo sapiens
caaccuuaaugccauaauc

SEQ ID NO: 51399 - RNA, 19 nt, Homo sapiens
acaaggaccucaucugaac

SEQ ID NO: 51400 - RNA, 19 nt, Homo sapiens
acagggucaugcuggauua

SEQ ID NO: 51401 - RNA, 19 nt, Homo sapiens
gaagaagcccucgagacuu

SEQ ID NO: 51402 - RNA, 19 nt, Homo sapiens
gguugaauacgaaggcuua

SEQ ID NO: 51403 - RNA, 19 nt, Homo sapiens
caucgaaggaggcuuacua

SEQ ID NO: 51404 - RNA, 19 nt, Homo sapiens
uggcuacaguucauuuaaa

SEQ ID NO: 51405 - RNA, 19 nt, Homo sapiens
gagaagaagacucugaaca

SEQ ID NO: 51406 - RNA, 19 nt, Homo sapiens
gaaacaaggaccucaucug

SEQ ID NO: 51407 - RNA, 19 nt, Homo sapiens
ucacagagcacgucaaugc

SEQ ID NO: 51408 - RNA, 19 nt, Homo sapiens
cucaguagauggacucaaa

SEQ ID NO: 51409 - RNA, 19 nt, Homo sapiens
gaaauccgagaauauaagu

SEQ ID NO: 51410 - RNA, 19 nt, Homo sapiens
auaaacuucugccaucaaa

SEQ ID NO: 51411 - RNA, 19 nt, Homo sapiens
gcaaaggcaaacuuggaaa

SEQ ID NO: 51412 - RNA, 19 nt, Homo sapiens
aaucacaguacccuuaaua

SEQ ID NO: 51413 - RNA, 19 nt, Homo sapiens
ugaggugauugaucugaaa

SEQ ID NO: 51414 - RNA, 19 nt, Homo sapiens
gaaggagaacaaugagaug

SEQ ID NO: 51415 - RNA, 19 nt, Homo sapiens
ggcuacaguucauuuaaau

SEQ ID NO: 51416 - RNA, 19 nt, Homo sapiens
aaacuucugccaucaaaug

SEQ ID NO: 51417 - RNA, 19 nt, Homo sapiens
gaugagaagaagacucuga

SEQ ID NO: 51418 - RNA, 19 nt, Homo sapiens
ugacugaaaccaugacgaa

SEQ ID NO: 51419 - RNA, 19 nt, Homo sapiens
ucaagcaucugcagaaagc

SEQ ID NO: 51420 - RNA, 19 nt, Homo sapiens
gaugaucccagaggacuuu

SEQ ID NO: 51421 - RNA, 19 nt, Homo sapiens
gggucaugcuggauuacua

SEQ ID NO: 51422 - RNA, 19 nt, Homo sapiens
caaggagaguggugagaag

SEQ ID NO: 51423 - RNA, 19 nt, Homo sapiens
gagaaggccaaguaugaga

SEQ ID NO: 51424 - RNA, 19 nt, Homo sapiens
cuaucggacucccaccuua

SEQ ID NO: 51425 - RNA, 19 nt, Homo sapiens
gccauccgauugaaagaga

SEQ ID NO: 51426 - RNA, 19 nt, Homo sapiens
caaagaaucuacuggaaua

SEQ ID NO: 51427 - RNA, 19 nt, Homo sapiens
ggagaaaugucugaaguaa

SEQ ID NO: 51428 - RNA, 19 nt, Homo sapiens
ggacuucgauucuuuggaa

SEQ ID NO: 51429 - RNA, 19 nt, Homo sapiens
agaaaugucugaaguaaga

SEQ ID NO: 51430 - RNA, 19 nt, Homo sapiens
gaaguuucauggacgguuu

SEQ ID NO: 51431 - RNA, 19 nt, Homo sapiens
gaacacugcugagguuuua

SEQ ID NO: 51432 - RNA, 19 nt, Homo sapiens
gaggagaaaugucugaagu

SEQ ID NO: 51433 - RNA, 19 nt, Homo sapiens
ggagggcagugacgcauug

SEQ ID NO: 51434 - RNA, 19 nt, Homo sapiens
gcaaagaaucuacuggaau

SEQ ID NO: 51435 - RNA, 19 nt, Homo sapiens
ggcaaagaaucuacuggaa

SEQ ID NO: 51436 - RNA, 19 nt, Homo sapiens
ucaccacacuuaaggagaa

SEQ ID NO: 51437 - RNA, 19 nt, Homo sapiens
uggaggacuucgauucuuu

SEQ ID NO: 51438 - RNA, 19 nt, Homo sapiens
aagaggaccuggacccuau

SEQ ID NO: 51439 - RNA, 19 nt, Homo sapiens
auaaugagguucuggagau

SEQ ID NO: 51440 - RNA, 19 nt, Homo sapiens
uggcaugacugacucugaa

SEQ ID NO: 51441 - RNA, 19 nt, Homo sapiens
cugcaauugucaccgguua

SEQ ID NO: 51442 - RNA, 19 nt, Homo sapiens
acacuuaaggagaacauaa

SEQ ID NO: 51443 - RNA, 19 nt, Homo sapiens
gacgguuucaccacacuua

SEQ ID NO: 51444 - RNA, 19 nt, Homo sapiens
gccugcugcuguuaucuuu

SEQ ID NO: 51445 - RNA, 19 nt, Homo sapiens
cuggaacacugcugagguu

SEQ ID NO: 51446 - RNA, 19 nt, Homo sapiens
ggaggacuucgauucuuug

SEQ ID NO: 51447 - RNA, 19 nt, Homo sapiens
aauguugguuuccagcaaa

SEQ ID NO: 51448 - RNA, 19 nt, Homo sapiens
caggagugcucaauaaaau

SEQ ID NO: 51449 - RNA, 19 nt, Homo sapiens
gggucuggcuuucaucuac

SEQ ID NO: 51450 - RNA, 19 nt, Homo sapiens
aggagaacauaaugagguu

SEQ ID NO: 51451 - RNA, 19 nt, Homo sapiens
aaauguugguuuccagcaa

SEQ ID NO: 51452 - RNA, 19 nt, Homo sapiens
gcaggagugcucaauaaaa

SEQ ID NO: 51453 - RNA, 19 nt, Homo sapiens
uccuauggcucugcaauug

SEQ ID NO: 51454 - RNA, 19 nt, Homo sapiens
cgaccagacugaggacauc

SEQ ID NO: 51455 - RNA, 19 nt, Homo sapiens
gagaaaugucugaaguaag

SEQ ID NO: 51456 - RNA, 19 nt, Homo sapiens
gcaccugcugcucaaguga

SEQ ID NO: 51457 - RNA, 19 nt, Homo sapiens
gcaugacugacucugaaga

SEQ ID NO: 51458 - RNA, 19 nt, Homo sapiens
cuauggcucugcaauuguc

SEQ ID NO: 51459 - RNA, 19 nt, Homo sapiens
gcaauugucaccgguuaac

SEQ ID NO: 51460 - RNA, 19 nt, Homo sapiens
aggagaaaugucugaagua

SEQ ID NO: 51461 - RNA, 19 nt, Homo sapiens
uaaugagguucuggagauc

SEQ ID NO: 51462 - RNA, 19 nt, Homo sapiens
uuaaggagaacauaaugag

SEQ ID NO: 51463 - RNA, 19 nt, Homo sapiens
ggagguucuuggcaugacu

SEQ ID NO: 51464 - RNA, 19 nt, Homo sapiens
cuuaaggagaacauaauga

SEQ ID NO: 51465 - RNA, 19 nt, Homo sapiens
ggacagaggcugaguuuga

SEQ ID NO: 51466 - RNA, 19 nt, Homo sapiens
guacauacauugugaacga

SEQ ID NO: 51467 - RNA, 19 nt, Homo sapiens
agaagaaacuggccugaaa

SEQ ID NO: 51468 - RNA, 19 nt, Homo sapiens
caauggauccuuaagauuu

SEQ ID NO: 51469 - RNA, 19 nt, Homo sapiens
ggaccucgaugacuuuaga

SEQ ID NO: 51470 - RNA, 19 nt, Homo sapiens
gaagaaaucgagaaguuug

SEQ ID NO: 51471 - RNA, 19 nt, Homo sapiens
gaaacuggccugaaagugu

SEQ ID NO: 51472 - RNA, 19 nt, Homo sapiens
caaagaaugucccaaagag

SEQ ID NO: 51473 - RNA, 19 nt, Homo sapiens
gagaacggccuuucaaaug

SEQ ID NO: 51474 - RNA, 19 nt, Homo sapiens
ggccagcucuccaaucuga

SEQ ID NO: 51475 - RNA, 19 nt, Homo sapiens
cacagugccuucuccuuua

SEQ ID NO: 51476 - RNA, 19 nt, Homo sapiens
gaucugacccgaaucaaug

SEQ ID NO: 51477 - RNA, 19 nt, Homo sapiens
caacaacuuuggccucuuc

SEQ ID NO: 51478 - RNA, 19 nt, Homo sapiens
ggaaucugcuuuucaagua

SEQ ID NO: 51479 - RNA, 19 nt, Homo sapiens
gaacucugcccaaagaaug

SEQ ID NO: 51480 - RNA, 19 nt, Homo sapiens
agaaacaguugaaccaaug

SEQ ID NO: 51481 - RNA, 19 nt, Homo sapiens
guaaaggucaaacaagaaa

SEQ ID NO: 51482 - RNA, 19 nt, Homo sapiens
ggagaacggccuuucaaau

SEQ ID NO: 51483 - RNA, 19 nt, Homo sapiens
ccacagugccuucuccuuu

SEQ ID NO: 51484 - RNA, 19 nt, Homo sapiens
gacagaggcugaguuugaa

SEQ ID NO: 51485 - RNA, 19 nt, Homo sapiens
gaagaucugacccgaauca

SEQ ID NO: 51486 - RNA, 19 nt, Homo sapiens
gagagaaaccauaccaaug

SEQ ID NO: 51487 - RNA, 19 nt, Homo sapiens
gaacggccuuucaaauguc

SEQ ID NO: 51488 - RNA, 19 nt, Homo sapiens
gcaacuggaugcgcuaugu

SEQ ID NO: 51489 - RNA, 19 nt, Homo sapiens
ggagagaaaccauaccaau

SEQ ID NO: 51490 - RNA, 19 nt, Homo sapiens
ugaauggcaucaacaacuu

SEQ ID NO: 51491 - RNA, 19 nt, Homo sapiens
gaguacagcgugaaagaaa

SEQ ID NO: 51492 - RNA, 19 nt, Homo sapiens
aaugaacucugcccaaaga

SEQ ID NO: 51493 - RNA, 19 nt, Homo sapiens
ccggagagcugacaaugau

SEQ ID NO: 51494 - RNA, 19 nt, Homo sapiens
ccacuucauugacggcuuu

SEQ ID NO: 51495 - RNA, 19 nt, Homo sapiens
gcaacaagggcuuuacuca

SEQ ID NO: 51496 - RNA, 19 nt, Homo sapiens
uaagaacgccaacaggaaa

SEQ ID NO: 51497 - RNA, 19 nt, Homo sapiens
ccgaaucaaugaagaaauc

SEQ ID NO: 51498 - RNA, 19 nt, Homo sapiens
gaacuacauccaucucugu

SEQ ID NO: 51499 - RNA, 19 nt, Homo sapiens
gagaguacagcgugaaaga

SEQ ID NO: 51500 - RNA, 19 nt, Homo sapiens
ggagagcugacaaugauga

SEQ ID NO: 51501 - RNA, 19 nt, Homo sapiens
gccagacgguuaacacaga

SEQ ID NO: 51502 - RNA, 19 nt, Homo sapiens
uggaagaucugacccgaau

SEQ ID NO: 51503 - RNA, 19 nt, Homo sapiens
agaacggccuuucaaaugu

SEQ ID NO: 51504 - RNA, 19 nt, Homo sapiens
gagcuucaccacuucauug

SEQ ID NO: 51505 - RNA, 19 nt, Homo sapiens
ggucaaacaagaaacaguu

SEQ ID NO: 51506 - RNA, 19 nt, Homo sapiens
ccaaagaaugucccaaaga

SEQ ID NO: 51507 - RNA, 19 nt, Homo sapiens
gaacuucuugugugguauu

SEQ ID NO: 51508 - RNA, 19 nt, Homo sapiens
ccaaugacacaguuccuaa

SEQ ID NO: 51509 - RNA, 19 nt, Homo sapiens
acaaagugcugccgugaca

SEQ ID NO: 51510 - RNA, 19 nt, Homo sapiens
augaagaaaucgagaaguu

SEQ ID NO: 51511 - RNA, 19 nt, Homo sapiens
ggugugcccugccaaguuc

SEQ ID NO: 51512 - RNA, 19 nt, Homo sapiens
gagaaaccauaccaaugca

SEQ ID NO: 51513 - RNA, 19 nt, Homo sapiens
ccucuaccguucuaacauu

SEQ ID NO: 51514 - RNA, 19 nt, Homo sapiens
ggagugaugaguaaagaau

SEQ ID NO: 51515 - RNA, 19 nt, Homo sapiens
ggacuccuacgcuuacuug

SEQ ID NO: 51516 - RNA, 19 nt, Homo sapiens
cuacaccaaugacacaguu

SEQ ID NO: 51517 - RNA, 19 nt, Homo sapiens
caaggaaucugcuuuucaa

SEQ ID NO: 51518 - RNA, 19 nt, Homo sapiens
ccuacggcaugaauuguaa

SEQ ID NO: 51519 - RNA, 19 nt, Homo sapiens
caaacaagaaacaguugaa

SEQ ID NO: 51520 - RNA, 19 nt, Homo sapiens
caccaacagugaagagguu

SEQ ID NO: 51521 - RNA, 19 nt, Homo sapiens
cuguaaaggucaaacaaga

SEQ ID NO: 51522 - RNA, 19 nt, Homo sapiens
gaagaaacuggccugaaag

SEQ ID NO: 51523 - RNA, 19 nt, Homo sapiens
ucgaggacguggaggauga

SEQ ID NO: 51524 - RNA, 19 nt, Homo sapiens
gagaaaagccacaugaaug

SEQ ID NO: 51525 - RNA, 19 nt, Homo sapiens
gcccaaagaaugucccaaa

SEQ ID NO: 51526 - RNA, 19 nt, Homo sapiens
uaaagcaaccgagcacuga

SEQ ID NO: 51527 - RNA, 19 nt, Homo sapiens
caaacacagagcagucuaa

SEQ ID NO: 51528 - RNA, 19 nt, Homo sapiens
uuauuggagugaugaguaa

SEQ ID NO: 51529 - RNA, 19 nt, Homo sapiens
uugaaccaauggauccuua

SEQ ID NO: 51530 - RNA, 19 nt, Homo sapiens
gaauggcaucaacaacuuu

SEQ ID NO: 51531 - RNA, 19 nt, Homo sapiens
aaacaugaccggcuacaag

SEQ ID NO: 51532 - RNA, 19 nt, Homo sapiens
ugaugaaucucacacaaac

SEQ ID NO: 51533 - RNA, 19 nt, Homo sapiens
guuauuggagugaugagua

SEQ ID NO: 51534 - RNA, 19 nt, Homo sapiens
gcggaggcauccuuaccaa

SEQ ID NO: 51535 - RNA, 19 nt, Homo sapiens
ccaauggauccuuaagauu

SEQ ID NO: 51536 - RNA, 19 nt, Homo sapiens
aagaaacaguugaaccaau

SEQ ID NO: 51537 - RNA, 19 nt, Homo sapiens
gugcagccuuuaugaguca

SEQ ID NO: 51538 - RNA, 19 nt, Homo sapiens
cgagaaguuugacaucagu

SEQ ID NO: 51539 - RNA, 19 nt, Homo sapiens
ccgggaagccagacgguua

SEQ ID NO: 51540 - RNA, 19 nt, Homo sapiens
ucaaaugucagacuugcaa

SEQ ID NO: 51541 - RNA, 19 nt, Homo sapiens
caaguacgaaugcaacguu

SEQ ID NO: 51542 - RNA, 19 nt, Homo sapiens
gagagacccacguacauca

SEQ ID NO: 51543 - RNA, 19 nt, Homo sapiens
acagagcagucuaaagcaa

SEQ ID NO: 51544 - RNA, 19 nt, Homo sapiens
gaggggagcuucaccacuu

SEQ ID NO: 51545 - RNA, 19 nt, Homo sapiens
ugaagaaaucgagaaguuu

SEQ ID NO: 51546 - RNA, 19 nt, Homo sapiens
gcaugaauggcaucaacaa

SEQ ID NO: 51547 - RNA, 19 nt, Homo sapiens
aggcugaguuugaagagaa

SEQ ID NO: 51548 - RNA, 19 nt, Homo sapiens
gagagaguacagcgugaaa

SEQ ID NO: 51549 - RNA, 19 nt, Homo sapiens
gagcugacaaugaugaauc

SEQ ID NO: 51550 - RNA, 19 nt, Homo sapiens
cggcuuuaaugaagagaaa

SEQ ID NO: 51551 - RNA, 19 nt, Homo sapiens
gagugaugaguaaagaaua

SEQ ID NO: 51552 - RNA, 19 nt, Homo sapiens
gaagagguuauuggaguga

SEQ ID NO: 51553 - RNA, 19 nt, Homo sapiens
aaaaggaccucgaugacuu

SEQ ID NO: 51554 - RNA, 19 nt, Homo sapiens
gaacgccaacaggaaauau

SEQ ID NO: 51555 - RNA, 19 nt, Homo sapiens
gaaaucuacaccaaugaca

SEQ ID NO: 51556 - RNA, 19 nt, Homo sapiens
caacagugaagagguuauu

SEQ ID NO: 51557 - RNA, 19 nt, Homo sapiens
cagcaugaauggcaucaac

SEQ ID NO: 51558 - RNA, 19 nt, Homo sapiens
caaaggaaaggaccucuac

SEQ ID NO: 51559 - RNA, 19 nt, Homo sapiens
cuaagaacgccaacaggaa

SEQ ID NO: 51560 - RNA, 19 nt, Homo sapiens
acacagagcagucuaaagc

SEQ ID NO: 51561 - RNA, 19 nt, Homo sapiens
aaugaugaaucucacacaa

SEQ ID NO: 51562 - RNA, 19 nt, Homo sapiens
aggaacuucuuguguggua

SEQ ID NO: 51563 - RNA, 19 nt, Homo sapiens
uaccaaagggcacacguuu

SEQ ID NO: 51564 - RNA, 19 nt, Homo sapiens
gaguaaagaauacauacca

SEQ ID NO: 51565 - RNA, 19 nt, Homo sapiens
gaggaugccugcuggauuu

SEQ ID NO: 51566 - RNA, 19 nt, Homo sapiens
gaagagcuauggugaaaca

SEQ ID NO: 51567 - RNA, 19 nt, Homo sapiens
aaacaccacugaagcauug

SEQ ID NO: 51568 - RNA, 19 nt, Homo sapiens
gaagggauggcauacauug

SEQ ID NO: 51569 - RNA, 19 nt, Homo sapiens
acaugaagguggccauuaa

SEQ ID NO: 51570 - RNA, 19 nt, Homo sapiens
gagcugaucaagcacuaua

SEQ ID NO: 51571 - RNA, 19 nt, Homo sapiens
gcagacguguggucguuug

SEQ ID NO: 51572 - RNA, 19 nt, Homo sapiens
aagcgacugucaucaagua

SEQ ID NO: 51573 - RNA, 19 nt, Homo sapiens
ccaaggagcccaucuacau

SEQ ID NO: 51574 - RNA, 19 nt, Homo sapiens
gaaacaccacugaagcauu

SEQ ID NO: 51575 - RNA, 19 nt, Homo sapiens
guaagcgacugucaucaag

SEQ ID NO: 51576 - RNA, 19 nt, Homo sapiens
gagcccaucuacauuguca

SEQ ID NO: 51577 - RNA, 19 nt, Homo sapiens
cugaagagcuauggugaaa

SEQ ID NO: 51578 - RNA, 19 nt, Homo sapiens
ccaacauccuggugucuga

SEQ ID NO: 51579 - RNA, 19 nt, Homo sapiens
gggacuggcuuuugcuuua

SEQ ID NO: 51580 - RNA, 19 nt, Homo sapiens
ggaaccaugucuccagaag

SEQ ID NO: 51581 - RNA, 19 nt, Homo sapiens
cuggauggguuacuacaaa

SEQ ID NO: 51582 - RNA, 19 nt, Homo sapiens
gcuccuuucuuaucagaga

SEQ ID NO: 51583 - RNA, 19 nt, Homo sapiens
gucgggaucugaagagcua

SEQ ID NO: 51584 - RNA, 19 nt, Homo sapiens
gguaagcgacugucaucaa

SEQ ID NO: 51585 - RNA, 19 nt, Homo sapiens
caaggagcccaucuacauu

SEQ ID NO: 51586 - RNA, 19 nt, Homo sapiens
ggucagcgcccaagacaag

SEQ ID NO: 51587 - RNA, 19 nt, Homo sapiens
gaaagccacaagccaugaa

SEQ ID NO: 51588 - RNA, 19 nt, Homo sapiens
gaaacucgggucuggacaa

SEQ ID NO: 51589 - RNA, 19 nt, Homo sapiens
uggcuuggcucgaaucauc

SEQ ID NO: 51590 - RNA, 19 nt, Homo sapiens
gggagcugaucaagcacua

SEQ ID NO: 51591 - RNA, 19 nt, Homo sapiens
ugauugagaugagaagaau

SEQ ID NO: 51592 - RNA, 19 nt, Homo sapiens
ugacuacaccgcuaugaau

SEQ ID NO: 51593 - RNA, 19 nt, Homo sapiens
gugaauacacggcccaaga

SEQ ID NO: 51594 - RNA, 19 nt, Homo sapiens
ccauuaagacgcugaagga

SEQ ID NO: 51595 - RNA, 19 nt, Homo sapiens
acucgggucuggacaauuc

SEQ ID NO: 51596 - RNA, 19 nt, Homo sapiens
gaugaagggagcagauugu

SEQ ID NO: 51597 - RNA, 19 nt, Homo sapiens
ucagagagagugaaaccaa

SEQ ID NO: 51598 - RNA, 19 nt, Homo sapiens
gcuuuaggaugguguugga

SEQ ID NO: 51599 - RNA, 19 nt, Homo sapiens
acauugagcgcaugaauuc

SEQ ID NO: 51600 - RNA, 19 nt, Homo sapiens
augaacaccuggaugaaga

SEQ ID NO: 51601 - RNA, 19 nt, Homo sapiens
caugaaaacugauugagau

SEQ ID NO: 51602 - RNA, 19 nt, Homo sapiens
ccgaugaacaccuggauga

SEQ ID NO: 51603 - RNA, 19 nt, Homo sapiens
gaaauggaaaggugguucu

SEQ ID NO: 51604 - RNA, 19 nt, Homo sapiens
gaaggacaagggccaaugg

SEQ ID NO: 51605 - RNA, 19 nt, Homo sapiens
cgacugucaucaaguaagg

SEQ ID NO: 51606 - RNA, 19 nt, Homo sapiens
aagcagacguguggucguu

SEQ ID NO: 51607 - RNA, 19 nt, Homo sapiens
uggauuuccugaagacaga

SEQ ID NO: 51608 - RNA, 19 nt, Homo sapiens
ggauggggcugguaaguag

SEQ ID NO: 51609 - RNA, 19 nt, Homo sapiens
guuggaaguugcucguugu

SEQ ID NO: 51610 - RNA, 19 nt, Homo sapiens
gaaaacugauugagaugag

SEQ ID NO: 51611 - RNA, 19 nt, Homo sapiens
ucucugugccgcuucauuu

SEQ ID NO: 51612 - RNA, 19 nt, Homo sapiens
cugaagggauggcauacau

SEQ ID NO: 51613 - RNA, 19 nt, Homo sapiens
ggagagccuggaaauggaa

SEQ ID NO: 51614 - RNA, 19 nt, Homo sapiens
uggagagccuggaaaugga

SEQ ID NO: 51615 - RNA, 19 nt, Homo sapiens
gaaaagccgaucaaagaga

SEQ ID NO: 51616 - RNA, 19 nt, Homo sapiens
ucccaaggcugauugacau

SEQ ID NO: 51617 - RNA, 19 nt, Homo sapiens
aaacucgggucuggacaau

SEQ ID NO: 51618 - RNA, 19 nt, Homo sapiens
gaucacagggucggaagga

SEQ ID NO: 51619 - RNA, 19 nt, Homo sapiens
uggaugaagacaagcauuu

SEQ ID NO: 51620 - RNA, 19 nt, Homo sapiens
acaccuggaugaagacaag

SEQ ID NO: 51621 - RNA, 19 nt, Homo sapiens
ggugaggccaacaugauga

SEQ ID NO: 51622 - RNA, 19 nt, Homo sapiens
caacaugaagguggccauu

SEQ ID NO: 51623 - RNA, 19 nt, Homo sapiens
cuacaccgcuaugaaugau

SEQ ID NO: 51624 - RNA, 19 nt, Homo sapiens
ggaugaagacaagcauuuc

SEQ ID NO: 51625 - RNA, 19 nt, Homo sapiens
ggugucgccugugcccuuu

SEQ ID NO: 51626 - RNA, 19 nt, Homo sapiens
ugacaugucggcgcagauu

SEQ ID NO: 51627 - RNA, 19 nt, Homo sapiens
ucaccaaggagcccaucua

SEQ ID NO: 51628 - RNA, 19 nt, Homo sapiens
guggagagccuggaaaugg

SEQ ID NO: 51629 - RNA, 19 nt, Homo sapiens
gaucaaagagaaggacaag

SEQ ID NO: 51630 - RNA, 19 nt, Homo sapiens
cugugccgcuucauuugua

SEQ ID NO: 51631 - RNA, 19 nt, Homo sapiens
cgaaucaucgacagugaau

SEQ ID NO: 51632 - RNA, 19 nt, Homo sapiens
caaggcugauugacauguc

SEQ ID NO: 51633 - RNA, 19 nt, Homo sapiens
gaugaacaccuggaugaag

SEQ ID NO: 51634 - RNA, 19 nt, Homo sapiens
gcgaagucuggauggguua

SEQ ID NO: 51635 - RNA, 19 nt, Homo sapiens
ugaucaagcacuauaagau

SEQ ID NO: 51636 - RNA, 19 nt, Homo sapiens
gagugaaaccaacaaaggu

SEQ ID NO: 51637 - RNA, 19 nt, Homo sapiens
gaguggagagccuggaaau

SEQ ID NO: 51638 - RNA, 19 nt, Homo sapiens
ugguggcucuguaugacua

SEQ ID NO: 51639 - RNA, 19 nt, Homo sapiens
ggucuucaccaucaaagca

SEQ ID NO: 51640 - RNA, 19 nt, Homo sapiens
gaaggagggaaccaugucu

SEQ ID NO: 51641 - RNA, 19 nt, Homo sapiens
aaaagccgaucaaagagaa

SEQ ID NO: 51642 - RNA, 19 nt, Homo sapiens
gcacggucauccggaguac

SEQ ID NO: 51643 - RNA, 19 nt, Homo sapiens
acugaagcauugccaagga

SEQ ID NO: 51644 - RNA, 19 nt, Homo sapiens
guaagggugucgggaucug

SEQ ID NO: 51645 - RNA, 19 nt, Homo sapiens
gagagugaaaccaacaaag

SEQ ID NO: 51646 - RNA, 19 nt, Homo sapiens
gagagagugaaaccaacaa

SEQ ID NO: 51647 - RNA, 19 nt, Homo sapiens
gccggcuccuuucuuauca

SEQ ID NO: 51648 - RNA, 19 nt, Homo sapiens
gaaggucagcgcccaagac

SEQ ID NO: 51649 - RNA, 19 nt, Homo sapiens
cacaagccaugaaaacuga

SEQ ID NO: 51650 - RNA, 19 nt, Homo sapiens
gacuacaccgcuaugaaug

SEQ ID NO: 51651 - RNA, 19 nt, Homo sapiens
aaacugauugagaugagaa

SEQ ID NO: 51652 - RNA, 19 nt, Homo sapiens
gugaaacaccacugaagca

SEQ ID NO: 51653 - RNA, 19 nt, Homo sapiens
gcuaugugcccagcaacuu

SEQ ID NO: 51654 - RNA, 19 nt, Homo sapiens
aggaaaagccgaucaaaga

SEQ ID NO: 51655 - RNA, 19 nt, Homo sapiens
aaucaucgacagugaauac

SEQ ID NO: 51656 - RNA, 19 nt, Homo sapiens
gcauacauugagcgcauga

SEQ ID NO: 51657 - RNA, 19 nt, Homo sapiens
ucuacauugucaccgagua

SEQ ID NO: 51658 - RNA, 19 nt, Homo sapiens
aaggagcccaucuacauug

SEQ ID NO: 51659 - RNA, 19 nt, Homo sapiens
uacauugagcgcaugaauu

SEQ ID NO: 51660 - RNA, 19 nt, Homo sapiens
ugaagggauggcauacauu

SEQ ID NO: 51661 - RNA, 19 nt, Homo sapiens
gcagcuucuugcuccaauc

SEQ ID NO: 51662 - RNA, 19 nt, Homo sapiens
cuaugugcccagcaacuuu

SEQ ID NO: 51663 - RNA, 19 nt, Homo sapiens
cagaugaagggagcagauu

SEQ ID NO: 51664 - RNA, 19 nt, Homo sapiens
agaggaugccugcuggauu

SEQ ID NO: 51665 - RNA, 19 nt, Homo sapiens
gagcacaucuguaaauuaa

SEQ ID NO: 51666 - RNA, 19 nt, Homo sapiens
ggaagugauuucaguauua

SEQ ID NO: 51667 - RNA, 19 nt, Homo sapiens
ggaagaagcugaauuacau

SEQ ID NO: 51668 - RNA, 19 nt, Homo sapiens
gaaaagaucugugcaagua

SEQ ID NO: 51669 - RNA, 19 nt, Homo sapiens
gcaaguaacagacucauuu

SEQ ID NO: 51670 - RNA, 19 nt, Homo sapiens
gagaaacucacuucaauaa

SEQ ID NO: 51671 - RNA, 19 nt, Homo sapiens
caggauggcugucagguua

SEQ ID NO: 51672 - RNA, 19 nt, Homo sapiens
gggaagacauaaugcauaa

SEQ ID NO: 51673 - RNA, 19 nt, Homo sapiens
gaagaagaauuuggaagaa

SEQ ID NO: 51674 - RNA, 19 nt, Homo sapiens
caccauggcugacacguua

SEQ ID NO: 51675 - RNA, 19 nt, Homo sapiens
caaaggaaaugaugaagau

SEQ ID NO: 51676 - RNA, 19 nt, Homo sapiens
ggaauucuaugaaggaguu

SEQ ID NO: 51677 - RNA, 19 nt, Homo sapiens
gaaagcaccacccauauga

SEQ ID NO: 51678 - RNA, 19 nt, Homo sapiens
cuaaaucuguggaggguua

SEQ ID NO: 51679 - RNA, 19 nt, Homo sapiens
ugacauagaugacuuugau

SEQ ID NO: 51680 - RNA, 19 nt, Homo sapiens
gaacgucacucagccagaa

SEQ ID NO: 51681 - RNA, 19 nt, Homo sapiens
gaaauaaagcccaaacugu

SEQ ID NO: 51682 - RNA, 19 nt, Homo sapiens
gaaagugacucucugaaaa

SEQ ID NO: 51683 - RNA, 19 nt, Homo sapiens
gagaugaagugcagcagaa

SEQ ID NO: 51684 - RNA, 19 nt, Homo sapiens
gaccaucugugacuauaaa

SEQ ID NO: 51685 - RNA, 19 nt, Homo sapiens
ucacaaggaaugagaaaua

SEQ ID NO: 51686 - RNA, 19 nt, Homo sapiens
ccagauguuucuugugaua

SEQ ID NO: 51687 - RNA, 19 nt, Homo sapiens
gaucaaugcugcacugcuu

SEQ ID NO: 51688 - RNA, 19 nt, Homo sapiens
gaauaaacauacugcuuca

SEQ ID NO: 51689 - RNA, 19 nt, Homo sapiens
gcacugcugugaaagauca

SEQ ID NO: 51690 - RNA, 19 nt, Homo sapiens
gaaaugaaaggaagaggaa

SEQ ID NO: 51691 - RNA, 19 nt, Homo sapiens
ggauacugcucucaagaaa

SEQ ID NO: 51692 - RNA, 19 nt, Homo sapiens
ugagaaaguuccauguauu

SEQ ID NO: 51693 - RNA, 19 nt, Homo sapiens
ggaaagugacucucugaaa

SEQ ID NO: 51694 - RNA, 19 nt, Homo sapiens
cagcagaaguggauuaauc

SEQ ID NO: 51695 - RNA, 19 nt, Homo sapiens
gaaggucggccaauuaaau

SEQ ID NO: 51696 - RNA, 19 nt, Homo sapiens
gcacagcuuuauacaacaa

SEQ ID NO: 51697 - RNA, 19 nt, Homo sapiens
gccagaacacuuaauaaua

SEQ ID NO: 51698 - RNA, 19 nt, Homo sapiens
ggacaucgccagcugaaga

SEQ ID NO: 51699 - RNA, 19 nt, Homo sapiens
aaauaaagcccaaacugua

SEQ ID NO: 51700 - RNA, 19 nt, Homo sapiens
ucuggaagauuuacuauga

SEQ ID NO: 51701 - RNA, 19 nt, Homo sapiens
gaagcuugcagaaucuuua

SEQ ID NO: 51702 - RNA, 19 nt, Homo sapiens
caaggaaggucggccaauu

SEQ ID NO: 51703 - RNA, 19 nt, Homo sapiens
gcacugcucagaaaucaaa

SEQ ID NO: 51704 - RNA, 19 nt, Homo sapiens
auacugcucucaagaaauu

SEQ ID NO: 51705 - RNA, 19 nt, Homo sapiens
ccaccgaagccuauaaaua

SEQ ID NO: 51706 - RNA, 19 nt, Homo sapiens
ggucaaggacuucuuuaaa

SEQ ID NO: 51707 - RNA, 19 nt, Homo sapiens
ucagaaagcaccacccaua

SEQ ID NO: 51708 - RNA, 19 nt, Homo sapiens
cagaaguccuuuguaagua

SEQ ID NO: 51709 - RNA, 19 nt, Homo sapiens
ggagcacaucuguaaauua

SEQ ID NO: 51710 - RNA, 19 nt, Homo sapiens
gaaucucaauguacauaga

SEQ ID NO: 51711 - RNA, 19 nt, Homo sapiens
gaaauccuccagcaucauu

SEQ ID NO: 51712 - RNA, 19 nt, Homo sapiens
ggcgaucgcuuaugugaug

SEQ ID NO: 51713 - RNA, 19 nt, Homo sapiens
ugagaucacuuaucguaga

SEQ ID NO: 51714 - RNA, 19 nt, Homo sapiens
gagaaaguuccauguauug

SEQ ID NO: 51715 - RNA, 19 nt, Homo sapiens
aagagaaacucacuucaau

SEQ ID NO: 51716 - RNA, 19 nt, Homo sapiens
gaaaccaucauacaagaga

SEQ ID NO: 51717 - RNA, 19 nt, Homo sapiens
ugacucagcugaagauucu

SEQ ID NO: 51718 - RNA, 19 nt, Homo sapiens
gaaaguuccauguauugaa

SEQ ID NO: 51719 - RNA, 19 nt, Homo sapiens
aaaugaagaugcucaggaa

SEQ ID NO: 51720 - RNA, 19 nt, Homo sapiens
gggaugauauggaugacuu

SEQ ID NO: 51721 - RNA, 19 nt, Homo sapiens
guacauagacccucuuucu

SEQ ID NO: 51722 - RNA, 19 nt, Homo sapiens
ggaaauaaagcccaaacug

SEQ ID NO: 51723 - RNA, 19 nt, Homo sapiens
uaucguagaucaaguccaa

SEQ ID NO: 51724 - RNA, 19 nt, Homo sapiens
gagcguuuccaaagucuua

SEQ ID NO: 51725 - RNA, 19 nt, Homo sapiens
guaacagacucauuucuac

SEQ ID NO: 51726 - RNA, 19 nt, Homo sapiens
uagaugacuuugaugauga

SEQ ID NO: 51727 - RNA, 19 nt, Homo sapiens
ggaugacucagaaugguua

SEQ ID NO: 51728 - RNA, 19 nt, Homo sapiens
gaagugauuucaguauuac

SEQ ID NO: 51729 - RNA, 19 nt, Homo sapiens
uggcagagcuggaagagau

SEQ ID NO: 51730 - RNA, 19 nt, Homo sapiens
gugguaagaguuuguguua

SEQ ID NO: 51731 - RNA, 19 nt, Homo sapiens
acagaaggaugacucagaa

SEQ ID NO: 51732 - RNA, 19 nt, Homo sapiens
ucaccagauucuuuaagua

SEQ ID NO: 51733 - RNA, 19 nt, Homo sapiens
gauuuuggaugaagacuua

SEQ ID NO: 51734 - RNA, 19 nt, Homo sapiens
ggaaaaggaucugcuuauu

SEQ ID NO: 51735 - RNA, 19 nt, Homo sapiens
gguuaucugugcuacaauu

SEQ ID NO: 51736 - RNA, 19 nt, Homo sapiens
ggaugaagacuuauauauc

SEQ ID NO: 51737 - RNA, 19 nt, Homo sapiens
caagagaaacucacuucaa

SEQ ID NO: 51738 - RNA, 19 nt, Homo sapiens
ccucagguguuuagcauga

SEQ ID NO: 51739 - RNA, 19 nt, Homo sapiens
guaagaaacacccagaugu

SEQ ID NO: 51740 - RNA, 19 nt, Homo sapiens
gaacauaagaaggaaacuu

SEQ ID NO: 51741 - RNA, 19 nt, Homo sapiens
gaaagcgagcaaauagauu

SEQ ID NO: 51742 - RNA, 19 nt, Homo sapiens
cucagaagcuacaaauauu

SEQ ID NO: 51743 - RNA, 19 nt, Homo sapiens
ggagauacaggccugauuc

SEQ ID NO: 51744 - RNA, 19 nt, Homo sapiens
gcaacuagaacgucacuca

SEQ ID NO: 51745 - RNA, 19 nt, Homo sapiens
cauagacccucuuucuugu

SEQ ID NO: 51746 - RNA, 19 nt, Homo sapiens
caagucagcacaaaauuua

SEQ ID NO: 51747 - RNA, 19 nt, Homo sapiens
gaugaugacugggaagaca

SEQ ID NO: 51748 - RNA, 19 nt, Homo sapiens
aaacccaaccuuccuauga

SEQ ID NO: 51749 - RNA, 19 nt, Homo sapiens
gcgaaaagaagaagaauuu

SEQ ID NO: 51750 - RNA, 19 nt, Homo sapiens
cacaccaacuguaaagaaa

SEQ ID NO: 51751 - RNA, 19 nt, Homo sapiens
uagacccucuuucuuguuu

SEQ ID NO: 51752 - RNA, 19 nt, Homo sapiens
aaaaggaucugcuuauuca

SEQ ID NO: 51753 - RNA, 19 nt, Homo sapiens
ggacgugcgauuugugauu

SEQ ID NO: 51754 - RNA, 19 nt, Homo sapiens
guguuuagcaugagcuuua

SEQ ID NO: 51755 - RNA, 19 nt, Homo sapiens
caggaaauguucucacaag

SEQ ID NO: 51756 - RNA, 19 nt, Homo sapiens
uuucacaccuucccucaaa

SEQ ID NO: 51757 - RNA, 19 nt, Homo sapiens
cggaagugauuucaguauu

SEQ ID NO: 51758 - RNA, 19 nt, Homo sapiens
cacaaggaaugagaaauau

SEQ ID NO: 51759 - RNA, 19 nt, Homo sapiens
caugguacauuacugugaa

SEQ ID NO: 51760 - RNA, 19 nt, Homo sapiens
cagguuaucugugcuacaa

SEQ ID NO: 51761 - RNA, 19 nt, Homo sapiens
gaaguggauuaaucaggau

SEQ ID NO: 51762 - RNA, 19 nt, Homo sapiens
aagcugacuuccuuggaua

SEQ ID NO: 51763 - RNA, 19 nt, Homo sapiens
uaauuuagcagccagcaaa

SEQ ID NO: 51764 - RNA, 19 nt, Homo sapiens
caaccuuccuaugauauug

SEQ ID NO: 51765 - RNA, 19 nt, Homo sapiens
gaagguagcugcucugaua

SEQ ID NO: 51766 - RNA, 19 nt, Homo sapiens
ccaggaaccucuucagaaa

SEQ ID NO: 51767 - RNA, 19 nt, Homo sapiens
ccagaaggaugaaugauau

SEQ ID NO: 51768 - RNA, 19 nt, Homo sapiens
gaugagagaauucuguaua

SEQ ID NO: 51769 - RNA, 19 nt, Homo sapiens
ggaagcaugucccugaaga

SEQ ID NO: 51770 - RNA, 19 nt, Homo sapiens
uagccaaucuuaccuguuu

SEQ ID NO: 51771 - RNA, 19 nt, Homo sapiens
guggaauacuuaagcaaua

SEQ ID NO: 51772 - RNA, 19 nt, Homo sapiens
ucaagccacucuucaauau

SEQ ID NO: 51773 - RNA, 19 nt, Homo sapiens
gacgagcgauugaggugua

SEQ ID NO: 51774 - RNA, 19 nt, Homo sapiens
gaucaggucauacuaucua

SEQ ID NO: 51775 - RNA, 19 nt, Homo sapiens
gaagaucaggucauacuau

SEQ ID NO: 51776 - RNA, 19 nt, Homo sapiens
ggacugaagccaaaguuau

SEQ ID NO: 51777 - RNA, 19 nt, Homo sapiens
gagggaggguggccuaaga

SEQ ID NO: 51778 - RNA, 19 nt, Homo sapiens
gaauuugaguuuagccaau

SEQ ID NO: 51779 - RNA, 19 nt, Homo sapiens
ggacagauccagggacuga

SEQ ID NO: 51780 - RNA, 19 nt, Homo sapiens
gaccuucacugcugucuca

SEQ ID NO: 51781 - RNA, 19 nt, Homo sapiens
ggaaaacacuucaauagca

SEQ ID NO: 51782 - RNA, 19 nt, Homo sapiens
gagcuuuggcugagugaua

SEQ ID NO: 51783 - RNA, 19 nt, Homo sapiens
ugaagaccauggccacaaa

SEQ ID NO: 51784 - RNA, 19 nt, Homo sapiens
gaggguggccuaagaguug

SEQ ID NO: 51785 - RNA, 19 nt, Homo sapiens
gggaauaucgagacaaaga

SEQ ID NO: 51786 - RNA, 19 nt, Homo sapiens
guugaacgcuguuauuucu

SEQ ID NO: 51787 - RNA, 19 nt, Homo sapiens
ucagugacaugaaucucua

SEQ ID NO: 51788 - RNA, 19 nt, Homo sapiens
acaacaaacuuuacacagu

SEQ ID NO: 51789 - RNA, 19 nt, Homo sapiens
uuacacaguggaauacuua

SEQ ID NO: 51790 - RNA, 19 nt, Homo sapiens
gaugguggccaaugggaua

SEQ ID NO: 51791 - RNA, 19 nt, Homo sapiens
gcaugcugcuggacaguau

SEQ ID NO: 51792 - RNA, 19 nt, Homo sapiens
ugagguguauggagagaaa

SEQ ID NO: 51793 - RNA, 19 nt, Homo sapiens
cuacucuccucaucucuaa

SEQ ID NO: 51794 - RNA, 19 nt, Homo sapiens
ugaagaacaugaauaaagc

SEQ ID NO: 51795 - RNA, 19 nt, Homo sapiens
gaaaacacuucaauagcaa

SEQ ID NO: 51796 - RNA, 19 nt, Homo sapiens
aagaaaugcuucccugaau

SEQ ID NO: 51797 - RNA, 19 nt, Homo sapiens
aaugggauaugcuuguuaa

SEQ ID NO: 51798 - RNA, 19 nt, Homo sapiens
gcuuuaugcugaaacagaa

SEQ ID NO: 51799 - RNA, 19 nt, Homo sapiens
aauaugguguuaucccuaa

SEQ ID NO: 51800 - RNA, 19 nt, Homo sapiens
ggacacagcccagagaaag

SEQ ID NO: 51801 - RNA, 19 nt, Homo sapiens
caacagaggcaaccagaag

SEQ ID NO: 51802 - RNA, 19 nt, Homo sapiens
gguguuaucccuaagaaau

SEQ ID NO: 51803 - RNA, 19 nt, Homo sapiens
gaugagugguucucugagu

SEQ ID NO: 51804 - RNA, 19 nt, Homo sapiens
gaccaugaguuaguguuug

SEQ ID NO: 51805 - RNA, 19 nt, Homo sapiens
gaacaugucaagccacucu

SEQ ID NO: 51806 - RNA, 19 nt, Homo sapiens
cauaacacccuuggaguuu

SEQ ID NO: 51807 - RNA, 19 nt, Homo sapiens
gaaaugcuucccugaaucu

SEQ ID NO: 51808 - RNA, 19 nt, Homo sapiens
uaagaaaugcuucccugaa

SEQ ID NO: 51809 - RNA, 19 nt, Homo sapiens
gaccauggccacaaagguu

SEQ ID NO: 51810 - RNA, 19 nt, Homo sapiens
ggaagaucaggucauacua

SEQ ID NO: 51811 - RNA, 19 nt, Homo sapiens
agagaaggaugaucaggau

SEQ ID NO: 51812 - RNA, 19 nt, Homo sapiens
uaacacccuuggaguuuua

SEQ ID NO: 51813 - RNA, 19 nt, Homo sapiens
uaugaacccugcaaaugau

SEQ ID NO: 51814 - RNA, 19 nt, Homo sapiens
ugaacgcuguuauuucuuc

SEQ ID NO: 51815 - RNA, 19 nt, Homo sapiens
caaccagaaggaugaauga

SEQ ID NO: 51816 - RNA, 19 nt, Homo sapiens
gcaagccaaucaccaacca

SEQ ID NO: 51817 - RNA, 19 nt, Homo sapiens
gagagaauucuguauacga

SEQ ID NO: 51818 - RNA, 19 nt, Homo sapiens
ccaaugggauaugcuuguu

SEQ ID NO: 51819 - RNA, 19 nt, Homo sapiens
guuaugaggcuuccauuca

SEQ ID NO: 51820 - RNA, 19 nt, Homo sapiens
gcuccuuguuccuagagua

SEQ ID NO: 51821 - RNA, 19 nt, Homo sapiens
gaccuaaugcuccuuguuc

SEQ ID NO: 51822 - RNA, 19 nt, Homo sapiens
ccaaggacccuggaagcua

SEQ ID NO: 51823 - RNA, 19 nt, Homo sapiens
gcaaccagaaggaugaaug

SEQ ID NO: 51824 - RNA, 19 nt, Homo sapiens
uuaugaacccugcaaauga

SEQ ID NO: 51825 - RNA, 19 nt, Homo sapiens
cucaggaucucuuagcauu

SEQ ID NO: 51826 - RNA, 19 nt, Homo sapiens
ggauggugcuuucacaaaa

SEQ ID NO: 51827 - RNA, 19 nt, Homo sapiens
uggagaggcugugugguuu

SEQ ID NO: 51828 - RNA, 19 nt, Homo sapiens
guacaacaaacuuuacaca

SEQ ID NO: 51829 - RNA, 19 nt, Homo sapiens
gucaagccacucuucaaua

SEQ ID NO: 51830 - RNA, 19 nt, Homo sapiens
guaauccaccagagacauu

SEQ ID NO: 51831 - RNA, 19 nt, Homo sapiens
gaggcaaccagaaggauga

SEQ ID NO: 51832 - RNA, 19 nt, Homo sapiens
gggacugaagccaaaguua

SEQ ID NO: 51833 - RNA, 19 nt, Homo sapiens
gaagaggugcuagcugugu

SEQ ID NO: 51834 - RNA, 19 nt, Homo sapiens
ggagaguggagaauucaug

SEQ ID NO: 51835 - RNA, 19 nt, Homo sapiens
ccuugaagaacaugaauaa

SEQ ID NO: 51836 - RNA, 19 nt, Homo sapiens
ugggauaugcuuguuaaua

SEQ ID NO: 51837 - RNA, 19 nt, Homo sapiens
ucucuaugaccaugaguua

SEQ ID NO: 51838 - RNA, 19 nt, Homo sapiens
ugacaugaaucucuaugac

SEQ ID NO: 51839 - RNA, 19 nt, Homo sapiens
guucguacuugcccagaau

SEQ ID NO: 51840 - RNA, 19 nt, Homo sapiens
cugggaauaucgagacaaa

SEQ ID NO: 51841 - RNA, 19 nt, Homo sapiens
caagaugagagaauucugu

SEQ ID NO: 51842 - RNA, 19 nt, Homo sapiens
caaugggauaugcuuguua

SEQ ID NO: 51843 - RNA, 19 nt, Homo sapiens
cagaauacuguuaaaggaa

SEQ ID NO: 51844 - RNA, 19 nt, Homo sapiens
ggugcuagcuguguuagag

SEQ ID NO: 51845 - RNA, 19 nt, Homo sapiens
ccauaacacccuuggaguu

SEQ ID NO: 51846 - RNA, 19 nt, Homo sapiens
cgaguggugugcaucuguu

SEQ ID NO: 51847 - RNA, 19 nt, Homo sapiens
agaaaugcuucccugaauc

SEQ ID NO: 51848 - RNA, 19 nt, Homo sapiens
gagaaaggagccugaggau

SEQ ID NO: 51849 - RNA, 19 nt, Homo sapiens
uaacagcucaggaucucuu

SEQ ID NO: 51850 - RNA, 19 nt, Homo sapiens
cauggaaccugacguagcu

SEQ ID NO: 51851 - RNA, 19 nt, Homo sapiens
gaaggaugaucaggauggu

SEQ ID NO: 51852 - RNA, 19 nt, Homo sapiens
gaaucucuaugaccaugag

SEQ ID NO: 51853 - RNA, 19 nt, Homo sapiens
cacaggacgucaugaugga

SEQ ID NO: 51854 - RNA, 19 nt, Homo sapiens
gacgagaggacgagcgauu

SEQ ID NO: 51855 - RNA, 19 nt, Homo sapiens
gacugaagccaaaguuaug

SEQ ID NO: 51856 - RNA, 19 nt, Homo sapiens
gggccucagugacaugaau

SEQ ID NO: 51857 - RNA, 19 nt, Homo sapiens
gcccauugacuuccugaaa

SEQ ID NO: 51858 - RNA, 19 nt, Homo sapiens
gaaaauuggccccauaaca

SEQ ID NO: 51859 - RNA, 19 nt, Homo sapiens
ggaggguggccuaagaguu

SEQ ID NO: 51860 - RNA, 19 nt, Homo sapiens
acagucagauuuccagucu

SEQ ID NO: 51861 - RNA, 19 nt, Homo sapiens
aagcggagaggcugacuuu

SEQ ID NO: 51862 - RNA, 19 nt, Homo sapiens
gaucuuuucuugucugaau

SEQ ID NO: 51863 - RNA, 19 nt, Homo sapiens
gcuguuauuucuucuugag

SEQ ID NO: 51864 - RNA, 19 nt, Homo sapiens
aaaguuugguucugugucu

SEQ ID NO: 51865 - RNA, 19 nt, Homo sapiens
ggagaaagguggacuggaa

SEQ ID NO: 51866 - RNA, 19 nt, Homo sapiens
ggagggagauggaucaauc

SEQ ID NO: 51867 - RNA, 19 nt, Homo sapiens
gcaagaggcuggauuuuga

SEQ ID NO: 51868 - RNA, 19 nt, Homo sapiens
ggagauggaucaaucaaac

SEQ ID NO: 51869 - RNA, 19 nt, Homo sapiens
gaaacaacuucuacuucug

SEQ ID NO: 51870 - RNA, 19 nt, Homo sapiens
ggacagauuggacaacuau

SEQ ID NO: 51871 - RNA, 19 nt, Homo sapiens
gccaugaacuacccgcuaa

SEQ ID NO: 51872 - RNA, 19 nt, Homo sapiens
ucacgcaccucccauccua

SEQ ID NO: 51873 - RNA, 19 nt, Homo sapiens
gcagggaaguguaagaaac

SEQ ID NO: 51874 - RNA, 19 nt, Homo sapiens
gaacacacuccaucagcuu

SEQ ID NO: 51875 - RNA, 19 nt, Homo sapiens
caagagaaccaagcagaaa

SEQ ID NO: 51876 - RNA, 19 nt, Homo sapiens
ggaugucacucagauggaa

SEQ ID NO: 51877 - RNA, 19 nt, Homo sapiens
ccaccucucucaccacguu

SEQ ID NO: 51878 - RNA, 19 nt, Homo sapiens
caacgaggaagcccuaaga

SEQ ID NO: 51879 - RNA, 19 nt, Homo sapiens
ugacgaagcugggcuguac

SEQ ID NO: 51880 - RNA, 19 nt, Homo sapiens
ggaaauggaccucgagaac

SEQ ID NO: 51881 - RNA, 19 nt, Homo sapiens
gaggcuggauuuugaauuu

SEQ ID NO: 51882 - RNA, 19 nt, Homo sapiens
gcaccucccauccuaauca

SEQ ID NO: 51883 - RNA, 19 nt, Homo sapiens
gaggcaagaggcuggauuu

SEQ ID NO: 51884 - RNA, 19 nt, Homo sapiens
uaaaacaggucaauacagu

SEQ ID NO: 51885 - RNA, 19 nt, Homo sapiens
cagaaacgcaugccugguu

SEQ ID NO: 51886 - RNA, 19 nt, Homo sapiens
ccacggagaccuuccuguu

SEQ ID NO: 51887 - RNA, 19 nt, Homo sapiens
ugaaggccguggacaauac

SEQ ID NO: 51888 - RNA, 19 nt, Homo sapiens
acagauuggacaacuauaa

SEQ ID NO: 51889 - RNA, 19 nt, Homo sapiens
gggagccucucaacauaag

SEQ ID NO: 51890 - RNA, 19 nt, Homo sapiens
ccgagaagcaagaaagaaa

SEQ ID NO: 51891 - RNA, 19 nt, Homo sapiens
uaagaguguccuaggagua

SEQ ID NO: 51892 - RNA, 19 nt, Homo sapiens
gcggaaagcagcucaaagg

SEQ ID NO: 51893 - RNA, 19 nt, Homo sapiens
gcucaaaggcacagugaag

SEQ ID NO: 51894 - RNA, 19 nt, Homo sapiens
gcaggagcagucucucuga

SEQ ID NO: 51895 - RNA, 19 nt, Homo sapiens
ccaagagaaccaagcagaa

SEQ ID NO: 51896 - RNA, 19 nt, Homo sapiens
ugauugcccugcacaaagu

SEQ ID NO: 51897 - RNA, 19 nt, Homo sapiens
gguuaaggcugaggaaagg

SEQ ID NO: 51898 - RNA, 19 nt, Homo sapiens
ccaaggccaucacaacaac

SEQ ID NO: 51899 - RNA, 19 nt, Homo sapiens
ggaaggaggcuggcuuguc

SEQ ID NO: 51900 - RNA, 19 nt, Homo sapiens
caaggagggagauggauca

SEQ ID NO: 51901 - RNA, 19 nt, Homo sapiens
ugucgcggcuccugacgaa

SEQ ID NO: 51902 - RNA, 19 nt, Homo sapiens
gcgugaaguuccgcaguga

SEQ ID NO: 51903 - RNA, 19 nt, Homo sapiens
gggagauggaucaaucaaa

SEQ ID NO: 51904 - RNA, 19 nt, Homo sapiens
gaguguggccuucggacaa

SEQ ID NO: 51905 - RNA, 19 nt, Homo sapiens
ggcuaagaguguccuagga

SEQ ID NO: 51906 - RNA, 19 nt, Homo sapiens
gccaaggccaucacaacaa

SEQ ID NO: 51907 - RNA, 19 nt, Homo sapiens
gcaguuccacggagaccuu

SEQ ID NO: 51908 - RNA, 19 nt, Homo sapiens
ccucauggccuccuucaag

SEQ ID NO: 51909 - RNA, 19 nt, Homo sapiens
gacucuaggugcccuugga

SEQ ID NO: 51910 - RNA, 19 nt, Homo sapiens
gcugaaggccguggacaau

SEQ ID NO: 51911 - RNA, 19 nt, Homo sapiens
gcugcuccgugcuuguuug

SEQ ID NO: 51912 - RNA, 19 nt, Homo sapiens
cgcuaacgcuggaaaugga

SEQ ID NO: 51913 - RNA, 19 nt, Homo sapiens
aaacaggucaauacaguac

SEQ ID NO: 51914 - RNA, 19 nt, Homo sapiens
gggagguugugggcauuga

SEQ ID NO: 51915 - RNA, 19 nt, Homo sapiens
gcccaccugucaaacaaag

SEQ ID NO: 51916 - RNA, 19 nt, Homo sapiens
aaauggaccucgagaaccu

SEQ ID NO: 51917 - RNA, 19 nt, Homo sapiens
ccucacucccuucccauaa

SEQ ID NO: 51918 - RNA, 19 nt, Homo sapiens
ggggaugaguggagguuaa

SEQ ID NO: 51919 - RNA, 19 nt, Homo sapiens
ugacaagcaucuucuuccu

SEQ ID NO: 51920 - RNA, 19 nt, Homo sapiens
gcuauagacccgaggaaac

SEQ ID NO: 51921 - RNA, 19 nt, Homo sapiens
gaagcgugaaggccgagaa

SEQ ID NO: 51922 - RNA, 19 nt, Homo sapiens
cugcccaccugucaaacaa

SEQ ID NO: 51923 - RNA, 19 nt, Homo sapiens
gagcagucucucugaguca

SEQ ID NO: 51924 - RNA, 19 nt, Homo sapiens
uggacagauuggacaacua

SEQ ID NO: 51925 - RNA, 19 nt, Homo sapiens
gucuucaucuugcccuuug

SEQ ID NO: 51926 - RNA, 19 nt, Homo sapiens
gauuggacaacuauaacga

SEQ ID NO: 51927 - RNA, 19 nt, Homo sapiens
auccaaugcucaagaaaca

SEQ ID NO: 51928 - RNA, 19 nt, Homo sapiens
cagcucaaaggcacaguga

SEQ ID NO: 51929 - RNA, 19 nt, Homo sapiens
ggugacaagcaucuucuuc

SEQ ID NO: 51930 - RNA, 19 nt, Homo sapiens
ggcagggaaguguaagaaa

SEQ ID NO: 51931 - RNA, 19 nt, Homo sapiens
gagguugugggcauugaug

SEQ ID NO: 51932 - RNA, 19 nt, Homo sapiens
gaaggccgagaagcaagaa

SEQ ID NO: 51933 - RNA, 19 nt, Homo sapiens
gagguuaaggcugaggaaa

SEQ ID NO: 51934 - RNA, 19 nt, Homo sapiens
cuccuugccuugccagaga

SEQ ID NO: 51935 - RNA, 19 nt, Homo sapiens
cagggaaguguaagaaaca

SEQ ID NO: 51936 - RNA, 19 nt, Homo sapiens
gagggagauggaucaauca

SEQ ID NO: 51937 - RNA, 19 nt, Homo sapiens
cggggagccucucaacaua

SEQ ID NO: 51938 - RNA, 19 nt, Homo sapiens
ggagguuaaggcugaggaa

SEQ ID NO: 51939 - RNA, 19 nt, Homo sapiens
gaaacgcaugccugguuca

SEQ ID NO: 51940 - RNA, 19 nt, Homo sapiens
gggcucaccguggcuaaga

SEQ ID NO: 51941 - RNA, 19 nt, Homo sapiens
cccgauuccucuaccaugu

SEQ ID NO: 51942 - RNA, 19 nt, Homo sapiens
gugauugcccugcacaaag

SEQ ID NO: 51943 - RNA, 19 nt, Homo sapiens
aaaaggcaccuauaaaaca

SEQ ID NO: 51944 - RNA, 19 nt, Homo sapiens
ccaagcagccaagcuccuu

SEQ ID NO: 51945 - RNA, 19 nt, Homo sapiens
ggccgagaagcaagaaaga

SEQ ID NO: 51946 - RNA, 19 nt, Homo sapiens
aaucauccaaugcucaaga

SEQ ID NO: 51947 - RNA, 19 nt, Homo sapiens
cuaaucauccaaugcucaa

SEQ ID NO: 51948 - RNA, 19 nt, Homo sapiens
ccuaccacaucgucaucuu

SEQ ID NO: 51949 - RNA, 19 nt, Homo sapiens
ggagaaagguggacuggaa

SEQ ID NO: 51950 - RNA, 19 nt, Homo sapiens
ggagggagauggaucaauc

SEQ ID NO: 51951 - RNA, 19 nt, Homo sapiens
gcaagaggcuggauuuuga

SEQ ID NO: 51952 - RNA, 19 nt, Homo sapiens
ggagauggaucaaucaaac

SEQ ID NO: 51953 - RNA, 19 nt, Homo sapiens
gaaacaacuucuacuucug

SEQ ID NO: 51954 - RNA, 19 nt, Homo sapiens
ggacagauuggacaacuau

SEQ ID NO: 51955 - RNA, 19 nt, Homo sapiens
ucacgcaccucccauccua

SEQ ID NO: 51956 - RNA, 19 nt, Homo sapiens
gcagggaaguguaagaaac

SEQ ID NO: 51957 - RNA, 19 nt, Homo sapiens
gaacacacuccaucagcuu

SEQ ID NO: 51958 - RNA, 19 nt, Homo sapiens
caagagaaccaagcagaaa

SEQ ID NO: 51959 - RNA, 19 nt, Homo sapiens
ggaugucacucagauggaa

SEQ ID NO: 51960 - RNA, 19 nt, Homo sapiens
ccaccucucucaccacguu

SEQ ID NO: 51961 - RNA, 19 nt, Homo sapiens
ggaaugcggucccuuugac

SEQ ID NO: 51962 - RNA, 19 nt, Homo sapiens
caacgaggaagcccuaaga

SEQ ID NO: 51963 - RNA, 19 nt, Homo sapiens
ugacgaagcugggcuguac

SEQ ID NO: 51964 - RNA, 19 nt, Homo sapiens
gaggcuggauuuugaauuu

SEQ ID NO: 51965 - RNA, 19 nt, Homo sapiens
gcaccucccauccuaauca

SEQ ID NO: 51966 - RNA, 19 nt, Homo sapiens
gaggcaagaggcuggauuu

SEQ ID NO: 51967 - RNA, 19 nt, Homo sapiens
uaaaacaggucaauacagu

SEQ ID NO: 51968 - RNA, 19 nt, Homo sapiens
cagaaacgcaugccugguu

SEQ ID NO: 51969 - RNA, 19 nt, Homo sapiens
ccacggagaccuuccuguu

SEQ ID NO: 51970 - RNA, 19 nt, Homo sapiens
ugaaggccguggacaauac

SEQ ID NO: 51971 - RNA, 19 nt, Homo sapiens
gaaagacagguccuuaggu

SEQ ID NO: 51972 - RNA, 19 nt, Homo sapiens
ggaaagacagguccuuagg

SEQ ID NO: 51973 - RNA, 19 nt, Homo sapiens
acagauuggacaacuauaa

SEQ ID NO: 51974 - RNA, 19 nt, Homo sapiens
ccgagaagcaagaaagaaa

SEQ ID NO: 51975 - RNA, 19 nt, Homo sapiens
uaagaguguccuaggagua

SEQ ID NO: 51976 - RNA, 19 nt, Homo sapiens
gcggaaagcagcucaaagg

SEQ ID NO: 51977 - RNA, 19 nt, Homo sapiens
gcucaaaggcacagugaag

SEQ ID NO: 51978 - RNA, 19 nt, Homo sapiens
gcaggagcagucucucuga

SEQ ID NO: 51979 - RNA, 19 nt, Homo sapiens
ccaagagaaccaagcagaa

SEQ ID NO: 51980 - RNA, 19 nt, Homo sapiens
ugauugcccugcacaaagu

SEQ ID NO: 51981 - RNA, 19 nt, Homo sapiens
gguuaaggcugaggaaagg

SEQ ID NO: 51982 - RNA, 19 nt, Homo sapiens
ccaaggccaucacaacaac

SEQ ID NO: 51983 - RNA, 19 nt, Homo sapiens
ggucagugggcccuaugua

SEQ ID NO: 51984 - RNA, 19 nt, Homo sapiens
ggaaggaggcuggcuuguc

SEQ ID NO: 51985 - RNA, 19 nt, Homo sapiens
caagagagcuaggguuccu

SEQ ID NO: 51986 - RNA, 19 nt, Homo sapiens
caaggagggagauggauca

SEQ ID NO: 51987 - RNA, 19 nt, Homo sapiens
ugucgcggcuccugacgaa

SEQ ID NO: 51988 - RNA, 19 nt, Homo sapiens
gcgugaaguuccgcaguga

SEQ ID NO: 51989 - RNA, 19 nt, Homo sapiens
gggagauggaucaaucaaa

SEQ ID NO: 51990 - RNA, 19 nt, Homo sapiens
gaguguggccuucggacaa

SEQ ID NO: 51991 - RNA, 19 nt, Homo sapiens
ggcuaagaguguccuagga

SEQ ID NO: 51992 - RNA, 19 nt, Homo sapiens
gccaaggccaucacaacaa

SEQ ID NO: 51993 - RNA, 19 nt, Homo sapiens
gcaguuccacggagaccuu

SEQ ID NO: 51994 - RNA, 19 nt, Homo sapiens
ccucauggccuccuucaag

SEQ ID NO: 51995 - RNA, 19 nt, Homo sapiens
gacucuaggugcccuugga

SEQ ID NO: 51996 - RNA, 19 nt, Homo sapiens
ggaaaagacaaagugauuu

SEQ ID NO: 51997 - RNA, 19 nt, Homo sapiens
gcugaaggccguggacaau

SEQ ID NO: 51998 - RNA, 19 nt, Homo sapiens
gcugcuccgugcuuguuug

SEQ ID NO: 51999 - RNA, 19 nt, Homo sapiens
aaacaggucaauacaguac

SEQ ID NO: 52000 - RNA, 19 nt, Homo sapiens
gggagguugugggcauuga

SEQ ID NO: 52001 - RNA, 19 nt, Homo sapiens
gcccaccugucaaacaaag

SEQ ID NO: 52002 - RNA, 19 nt, Homo sapiens
ccucacucccuucccauaa

SEQ ID NO: 52003 - RNA, 19 nt, Homo sapiens
ggggaugaguggagguuaa

SEQ ID NO: 52004 - RNA, 19 nt, Homo sapiens
ugacaagcaucuucuuccu

SEQ ID NO: 52005 - RNA, 19 nt, Homo sapiens
gcuauagacccgaggaaac

SEQ ID NO: 52006 - RNA, 19 nt, Homo sapiens
gaagcgugaaggccgagaa

SEQ ID NO: 52007 - RNA, 19 nt, Homo sapiens
cugcccaccugucaaacaa

SEQ ID NO: 52008 - RNA, 19 nt, Homo sapiens
gagcagucucucugaguca

SEQ ID NO: 52009 - RNA, 19 nt, Homo sapiens
uggacagauuggacaacua

SEQ ID NO: 52010 - RNA, 19 nt, Homo sapiens
gauuggacaacuauaacga

SEQ ID NO: 52011 - RNA, 19 nt, Homo sapiens
gucuucaucuugcccuuug

SEQ ID NO: 52012 - RNA, 19 nt, Homo sapiens
auccaaugcucaagaaaca

SEQ ID NO: 52013 - RNA, 19 nt, Homo sapiens
cagcucaaaggcacaguga

SEQ ID NO: 52014 - RNA, 19 nt, Homo sapiens
ggugacaagcaucuucuuc

SEQ ID NO: 52015 - RNA, 19 nt, Homo sapiens
ggcagggaaguguaagaaa

SEQ ID NO: 52016 - RNA, 19 nt, Homo sapiens
gagguugugggcauugaug

SEQ ID NO: 52017 - RNA, 19 nt, Homo sapiens
gaaggccgagaagcaagaa

SEQ ID NO: 52018 - RNA, 19 nt, Homo sapiens
gagguuaaggcugaggaaa

SEQ ID NO: 52019 - RNA, 19 nt, Homo sapiens
cuccuugccuugccagaga

SEQ ID NO: 52020 - RNA, 19 nt, Homo sapiens
cagggaaguguaagaaaca

SEQ ID NO: 52021 - RNA, 19 nt, Homo sapiens
gagggagauggaucaauca

SEQ ID NO: 52022 - RNA, 19 nt, Homo sapiens
ggagguuaaggcugaggaa

SEQ ID NO: 52023 - RNA, 19 nt, Homo sapiens
gaaacgcaugccugguuca

SEQ ID NO: 52024 - RNA, 19 nt, Homo sapiens
gaaugcggucccuuugaca

SEQ ID NO: 52025 - RNA, 19 nt, Homo sapiens
gggcucaccguggcuaaga

SEQ ID NO: 52026 - RNA, 19 nt, Homo sapiens
cccgauuccucuaccaugu

SEQ ID NO: 52027 - RNA, 19 nt, Homo sapiens
gugauugcccugcacaaag

SEQ ID NO: 52028 - RNA, 19 nt, Homo sapiens
aaaaggcaccuauaaaaca

SEQ ID NO: 52029 - RNA, 19 nt, Homo sapiens
uuugaaacuugacauuugg

SEQ ID NO: 52030 - RNA, 19 nt, Homo sapiens
ccaagcagccaagcuccuu

SEQ ID NO: 52031 - RNA, 19 nt, Homo sapiens
ggccgagaagcaagaaaga

SEQ ID NO: 52032 - RNA, 19 nt, Homo sapiens
aaucauccaaugcucaaga

SEQ ID NO: 52033 - RNA, 19 nt, Homo sapiens
cuaaucauccaaugcucaa

SEQ ID NO: 52034 - RNA, 19 nt, Homo sapiens
ccuaccacaucgucaucuu

SEQ ID NO: 52035 - RNA, 19 nt, Homo sapiens
cagaagaaauccagaaaua

SEQ ID NO: 52036 - RNA, 19 nt, Homo sapiens
ggaaagaccugcugaaagg

SEQ ID NO: 52037 - RNA, 19 nt, Homo sapiens
gaaaggaagaucaguauau

SEQ ID NO: 52038 - RNA, 19 nt, Homo sapiens
caagauggcaccagcauuu

SEQ ID NO: 52039 - RNA, 19 nt, Homo sapiens
gaagagaccaagaugaaug

SEQ ID NO: 52040 - RNA, 19 nt, Homo sapiens
ccagaaauauugcuguuca

SEQ ID NO: 52041 - RNA, 19 nt, Homo sapiens
gaagaagagaccaagauga

SEQ ID NO: 52042 - RNA, 19 nt, Homo sapiens
gaagaaaaguccacuguca

SEQ ID NO: 52043 - RNA, 19 nt, Homo sapiens
ggagcuggcugagcagaaa

SEQ ID NO: 52044 - RNA, 19 nt, Homo sapiens
aaauauugcuguucaagga

SEQ ID NO: 52045 - RNA, 19 nt, Homo sapiens
gaaagggucgcuccucuuc

SEQ ID NO: 52046 - RNA, 19 nt, Homo sapiens
aaaggaagaucaguauaug

SEQ ID NO: 52047 - RNA, 19 nt, Homo sapiens
gccuauaucugcagugaga

SEQ ID NO: 52048 - RNA, 19 nt, Homo sapiens
cgaaacagauauuuaagcu

SEQ ID NO: 52049 - RNA, 19 nt, Homo sapiens
gagaaugugccaaauguag

SEQ ID NO: 52050 - RNA, 19 nt, Homo sapiens
gcacgaggagcauguugaa

SEQ ID NO: 52051 - RNA, 19 nt, Homo sapiens
gcagauuucuuuggaggau

SEQ ID NO: 52052 - RNA, 19 nt, Homo sapiens
ggaagaucaguauaugaaa

SEQ ID NO: 52053 - RNA, 19 nt, Homo sapiens
gcgaaaggaagaucaguau

SEQ ID NO: 52054 - RNA, 19 nt, Homo sapiens
ggagcauguugaacucuug

SEQ ID NO: 52055 - RNA, 19 nt, Homo sapiens
uggagaaugugccaaaugu

SEQ ID NO: 52056 - RNA, 19 nt, Homo sapiens
aagaagagaccaagaugaa

SEQ ID NO: 52057 - RNA, 19 nt, Homo sapiens
gcauuugguucuucucaag

SEQ ID NO: 52058 - RNA, 19 nt, Homo sapiens
ccaaauguaggagugaaua

SEQ ID NO: 52059 - RNA, 19 nt, Homo sapiens
caucugacccguuggaaga

SEQ ID NO: 52060 - RNA, 19 nt, Homo sapiens
gcagaagaaauccagaaau

SEQ ID NO: 52061 - RNA, 19 nt, Homo sapiens
ggagaaugugccaaaugua

SEQ ID NO: 52062 - RNA, 19 nt, Homo sapiens
ggaacuggcugcugaaaag

SEQ ID NO: 52063 - RNA, 19 nt, Homo sapiens
caaauguaggagugaauaa

SEQ ID NO: 52064 - RNA, 19 nt, Homo sapiens
cgaaaggaagaucaguaua

SEQ ID NO: 52065 - RNA, 19 nt, Homo sapiens
gcacguccuuguggaauac

SEQ ID NO: 52066 - RNA, 19 nt, Homo sapiens
gaguccagcagauuucuuu

SEQ ID NO: 52067 - RNA, 19 nt, Homo sapiens
ggagcuuucucuugugucu

SEQ ID NO: 52068 - RNA, 19 nt, Homo sapiens
gggaaagaccugcugaaag

SEQ ID NO: 52069 - RNA, 19 nt, Homo sapiens
gaguugaccauuaucucua

SEQ ID NO: 52070 - RNA, 19 nt, Homo sapiens
cgaagaagagaccaagaug

SEQ ID NO: 52071 - RNA, 19 nt, Homo sapiens
ggagugaauaagaacauau

SEQ ID NO: 52072 - RNA, 19 nt, Homo sapiens
gaaugugccaaauguagga

SEQ ID NO: 52073 - RNA, 19 nt, Homo sapiens
ugauguagcacuuccaaga

SEQ ID NO: 52074 - RNA, 19 nt, Homo sapiens
gaaggaacuggcugcugaa

SEQ ID NO: 52075 - RNA, 19 nt, Homo sapiens
uggcuggucucccucuuug

SEQ ID NO: 52076 - RNA, 19 nt, Homo sapiens
cagaaauauugcuguucaa

SEQ ID NO: 52077 - RNA, 19 nt, Homo sapiens
aggaagaucaguauaugaa

SEQ ID NO: 52078 - RNA, 19 nt, Homo sapiens
aagaggaggaggugaugua

SEQ ID NO: 52079 - RNA, 19 nt, Homo sapiens
ugucauggauugaagaaaa

SEQ ID NO: 52080 - RNA, 19 nt, Homo sapiens
ccacugucauggauugaag

SEQ ID NO: 52081 - RNA, 19 nt, Homo sapiens
uggcugagcagaaaggaaa

SEQ ID NO: 52082 - RNA, 19 nt, Homo sapiens
gauguagcacuuccaagau

SEQ ID NO: 52083 - RNA, 19 nt, Homo sapiens
aggaggaggugauguagca

SEQ ID NO: 52084 - RNA, 19 nt, Homo sapiens
uggaagagcgaaaggaaga

SEQ ID NO: 52085 - RNA, 19 nt, Homo sapiens
agguggaggucgccuauau

SEQ ID NO: 52086 - RNA, 19 nt, Homo sapiens
guuggaagaagaccgguuu

SEQ ID NO: 52087 - RNA, 19 nt, Homo sapiens
gcagaaaggaaaagucuug

SEQ ID NO: 52088 - RNA, 19 nt, Homo sapiens
cgaggagcauguugaacuc

SEQ ID NO: 52089 - RNA, 19 nt, Homo sapiens
ucaggcaguuccuuaaugc

SEQ ID NO: 52090 - RNA, 19 nt, Homo sapiens
uacaucaggcaguuccuua

SEQ ID NO: 52091 - RNA, 19 nt, Homo sapiens
gaagagcgaaaggaagauc

SEQ ID NO: 52092 - RNA, 19 nt, Homo sapiens
ggucgcuccucuucacauc

SEQ ID NO: 52093 - RNA, 19 nt, Homo sapiens
augcagagcccgagaggaa

SEQ ID NO: 52094 - RNA, 19 nt, Homo sapiens
gcuguucaaggaaguaaga

SEQ ID NO: 52095 - RNA, 19 nt, Homo sapiens
aggagugaauaagaacaua

SEQ ID NO: 52096 - RNA, 19 nt, Homo sapiens
aagcuuccauuucaagucu

SEQ ID NO: 52097 - RNA, 19 nt, Homo sapiens
gauggaggaauucgcuuuc

SEQ ID NO: 52098 - RNA, 19 nt, Homo sapiens
gagcauguugaacucuuga

SEQ ID NO: 52099 - RNA, 19 nt, Homo sapiens
gcagagcccgagaggaagu

SEQ ID NO: 52100 - RNA, 19 nt, Homo sapiens
ucgccuauaucugcaguga

SEQ ID NO: 52101 - RNA, 19 nt, Homo sapiens
guaagaggaggaggugaug

SEQ ID NO: 52102 - RNA, 19 nt, Homo sapiens
caucaggcaguuccuuaau

SEQ ID NO: 52103 - RNA, 19 nt, Homo sapiens
gcauguugaacucuugaug

SEQ ID NO: 52104 - RNA, 19 nt, Homo sapiens
caagaguugaccauuaucu

SEQ ID NO: 52105 - RNA, 19 nt, Homo sapiens
ccgaagaagagaccaagau

SEQ ID NO: 52106 - RNA, 19 nt, Homo sapiens
ucuugugucugccacuuug

SEQ ID NO: 52107 - RNA, 19 nt, Homo sapiens
gcuccagccaugaggacua

SEQ ID NO: 52108 - RNA, 19 nt, Homo sapiens
gaugagggacuugcggaau

SEQ ID NO: 52109 - RNA, 19 nt, Homo sapiens
ugaccauuaucucuauucu

SEQ ID NO: 52110 - RNA, 19 nt, Homo sapiens
aauguaggagugaauaaga

SEQ ID NO: 52111 - RNA, 19 nt, Homo sapiens
gguuuggcuucccugcauu

SEQ ID NO: 52112 - RNA, 19 nt, Homo sapiens
ugauggaggaauucgcuuu

SEQ ID NO: 52113 - RNA, 19 nt, Homo sapiens
guugaccauuaucucuauu

SEQ ID NO: 52114 - RNA, 19 nt, Homo sapiens
agcacguccuuguggaaua

SEQ ID NO: 52115 - RNA, 19 nt, Homo sapiens
ccaagauggcaccagcauu

SEQ ID NO: 52116 - RNA, 19 nt, Homo sapiens
gagaagaaaaguccacugu

SEQ ID NO: 52117 - RNA, 19 nt, Homo sapiens
ugaaagggucgcuccucuu

SEQ ID NO: 52118 - RNA, 19 nt, Homo sapiens
gaccauuaucucuauucuu

SEQ ID NO: 52119 - RNA, 19 nt, Homo sapiens
ggugauguagcacuuccaa

SEQ ID NO: 52120 - RNA, 19 nt, Homo sapiens
auguaggagugaauaagaa

SEQ ID NO: 52121 - RNA, 19 nt, Homo sapiens
agcggcaucucucgacuga

SEQ ID NO: 52122 - RNA, 19 nt, Homo sapiens
ucacaucugacccguugga

SEQ ID NO: 52123 - RNA, 19 nt, Homo sapiens
gcaagcagguuacgaagug

SEQ ID NO: 52124 - RNA, 19 nt, Homo sapiens
gccaagagcuucaaauuac

SEQ ID NO: 52125 - RNA, 19 nt, Homo sapiens
gagccaagagcuucaaauu

SEQ ID NO: 52126 - RNA, 19 nt, Homo sapiens
ccucaagggucaucuccaa

SEQ ID NO: 52127 - RNA, 19 nt, Homo sapiens
gacaugaggagcaaaggaa

SEQ ID NO: 52128 - RNA, 19 nt, Homo sapiens
aacaugaccugggccauuu

SEQ ID NO: 52129 - RNA, 19 nt, Homo sapiens
caagggucaucuccaaaca

SEQ ID NO: 52130 - RNA, 19 nt, Homo sapiens
ugaaguacguggcugugau

SEQ ID NO: 52131 - RNA, 19 nt, Homo sapiens
guacgauggccgucaagaa

SEQ ID NO: 52132 - RNA, 19 nt, Homo sapiens
gaaguacguggcugugaug

SEQ ID NO: 52133 - RNA, 19 nt, Homo sapiens
agccaagagcuucaaauua

SEQ ID NO: 52134 - RNA, 19 nt, Homo sapiens
ggacaugaggagcaaagga

SEQ ID NO: 52135 - RNA, 19 nt, Homo sapiens
ccuccaggcugccaucaga

SEQ ID NO: 52136 - RNA, 19 nt, Homo sapiens
aaacaugaccugggccauu

SEQ ID NO: 52137 - RNA, 19 nt, Homo sapiens
gagcuucaaauuacucuag

SEQ ID NO: 52138 - RNA, 19 nt, Homo sapiens
ggugcaagcagguuacgaa

SEQ ID NO: 52139 - RNA, 19 nt, Homo sapiens
ccaagagcuucaaauuacu

SEQ ID NO: 52140 - RNA, 19 nt, Homo sapiens
cauaggagaccagccacua

SEQ ID NO: 52141 - RNA, 19 nt, Homo sapiens
cgauggccgucaagaagau

SEQ ID NO: 52142 - RNA, 19 nt, Homo sapiens
caagcagguuacgaaguga

SEQ ID NO: 52143 - RNA, 19 nt, Homo sapiens
ggagaccagccacuaacug

SEQ ID NO: 52144 - RNA, 19 nt, Homo sapiens
agggucaucuccaaacaug

SEQ ID NO: 52145 - RNA, 19 nt, Homo sapiens
gaaugccacccucccagau

SEQ ID NO: 52146 - RNA, 19 nt, Homo sapiens
ugaccugggccauuucaug

SEQ ID NO: 52147 - RNA, 19 nt, Homo sapiens
ugcaggcugugacugauga

SEQ ID NO: 52148 - RNA, 19 nt, Homo sapiens
aauaaauguugagccaaga

SEQ ID NO: 52149 - RNA, 19 nt, Homo sapiens
gacugcaggcugugacuga

SEQ ID NO: 52150 - RNA, 19 nt, Homo sapiens
acaaggugcugcgggaauc

SEQ ID NO: 52151 - RNA, 19 nt, Homo sapiens
cagccgauguggacaagac

SEQ ID NO: 52152 - RNA, 19 nt, Homo sapiens
caucugggaggguggcauu

SEQ ID NO: 52153 - RNA, 19 nt, Homo sapiens
cucagucccacgacaguua

SEQ ID NO: 52154 - RNA, 19 nt, Homo sapiens
auaggagaccagccacuaa

SEQ ID NO: 52155 - RNA, 19 nt, Homo sapiens
gaaagaagcuguggaaaua

SEQ ID NO: 52156 - RNA, 19 nt, Homo sapiens
ggaaauagcuaaugagaaa

SEQ ID NO: 52157 - RNA, 19 nt, Homo sapiens
ccagaggucucauauguua

SEQ ID NO: 52158 - RNA, 19 nt, Homo sapiens
cagaacagcucauuucaaa

SEQ ID NO: 52159 - RNA, 19 nt, Homo sapiens
gaagacagcacccauuuaa

SEQ ID NO: 52160 - RNA, 19 nt, Homo sapiens
gaauaugcaugucaaagaa

SEQ ID NO: 52161 - RNA, 19 nt, Homo sapiens
gaaauaaccgggacaaaga

SEQ ID NO: 52162 - RNA, 19 nt, Homo sapiens
gaaaggaaguucagucagu

SEQ ID NO: 52163 - RNA, 19 nt, Homo sapiens
gcaggaacauuuguacaua

SEQ ID NO: 52164 - RNA, 19 nt, Homo sapiens
agacacagcucaaaccuaa

SEQ ID NO: 52165 - RNA, 19 nt, Homo sapiens
gaagagcaauccaucauca

SEQ ID NO: 52166 - RNA, 19 nt, Homo sapiens
gaccaaaucuauaguugaa

SEQ ID NO: 52167 - RNA, 19 nt, Homo sapiens
ggaauagccuugguacaaa

SEQ ID NO: 52168 - RNA, 19 nt, Homo sapiens
ggacauuauugccauauug

SEQ ID NO: 52169 - RNA, 19 nt, Homo sapiens
cagcuuaccuucugaaaga

SEQ ID NO: 52170 - RNA, 19 nt, Homo sapiens
ggaauaaaguaguccauag

SEQ ID NO: 52171 - RNA, 19 nt, Homo sapiens
ucaaagaaaugcacacaug

SEQ ID NO: 52172 - RNA, 19 nt, Homo sapiens
gacagcagcuucuuaacuu

SEQ ID NO: 52173 - RNA, 19 nt, Homo sapiens
gaauuuacuugguaggaaa

SEQ ID NO: 52174 - RNA, 19 nt, Homo sapiens
gaaaccaucuccuaaaauu

SEQ ID NO: 52175 - RNA, 19 nt, Homo sapiens
ucaguuccuucuucaauua

SEQ ID NO: 52176 - RNA, 19 nt, Homo sapiens
ugaaagauguggcuaagga

SEQ ID NO: 52177 - RNA, 19 nt, Homo sapiens
ggaaugaaaccaucuccua

SEQ ID NO: 52178 - RNA, 19 nt, Homo sapiens
gaaugaaaccaucuccuaa

SEQ ID NO: 52179 - RNA, 19 nt, Homo sapiens
uuacccagcuguuuaauau

SEQ ID NO: 52180 - RNA, 19 nt, Homo sapiens
gcacuuaaauaauggucuu

SEQ ID NO: 52181 - RNA, 19 nt, Homo sapiens
caccagaggucucauaugu

SEQ ID NO: 52182 - RNA, 19 nt, Homo sapiens
caagauggcaaaccaagua

SEQ ID NO: 52183 - RNA, 19 nt, Homo sapiens
gaacaagugaugaccuaaa

SEQ ID NO: 52184 - RNA, 19 nt, Homo sapiens
caagucaccuccaguaaca

SEQ ID NO: 52185 - RNA, 19 nt, Homo sapiens
gaaauauauuccacacugu

SEQ ID NO: 52186 - RNA, 19 nt, Homo sapiens
ggauuggguuggccucuaa

SEQ ID NO: 52187 - RNA, 19 nt, Homo sapiens
gagaccaaaucuauaguug

SEQ ID NO: 52188 - RNA, 19 nt, Homo sapiens
gaucacuggugcaucauga

SEQ ID NO: 52189 - RNA, 19 nt, Homo sapiens
caggaaagguguuggauca

SEQ ID NO: 52190 - RNA, 19 nt, Homo sapiens
uguuaaaggucuuggauaa

SEQ ID NO: 52191 - RNA, 19 nt, Homo sapiens
guggagggcuguaaugcua

SEQ ID NO: 52192 - RNA, 19 nt, Homo sapiens
ggacauugauuuuguauuc

SEQ ID NO: 52193 - RNA, 19 nt, Homo sapiens
cagaacaagugaugaccua

SEQ ID NO: 52194 - RNA, 19 nt, Homo sapiens
gaauaaaguaguccauaga

SEQ ID NO: 52195 - RNA, 19 nt, Homo sapiens
caaccagccuucccaaaca

SEQ ID NO: 52196 - RNA, 19 nt, Homo sapiens
ggagagaccaaaucuauag

SEQ ID NO: 52197 - RNA, 19 nt, Homo sapiens
gauuauuucuguggucuaa

SEQ ID NO: 52198 - RNA, 19 nt, Homo sapiens
gaaauccagaccugaguuu

SEQ ID NO: 52199 - RNA, 19 nt, Homo sapiens
guaacaagauggcaaacca

SEQ ID NO: 52200 - RNA, 19 nt, Homo sapiens
ccaauguaguguuugauau

SEQ ID NO: 52201 - RNA, 19 nt, Homo sapiens
gagaguagcagccauucuu

SEQ ID NO: 52202 - RNA, 19 nt, Homo sapiens
gagcaggccacacacaauu

SEQ ID NO: 52203 - RNA, 19 nt, Homo sapiens
cagcucagaugaagacaug

SEQ ID NO: 52204 - RNA, 19 nt, Homo sapiens
ggacacuucaggauuauau

SEQ ID NO: 52205 - RNA, 19 nt, Homo sapiens
acuggacacuucaggauua

SEQ ID NO: 52206 - RNA, 19 nt, Homo sapiens
aaccaaguaugcucagaua

SEQ ID NO: 52207 - RNA, 19 nt, Homo sapiens
ccaguccaauguaguguuu

SEQ ID NO: 52208 - RNA, 19 nt, Homo sapiens
gaacagcucauuucaaacg

SEQ ID NO: 52209 - RNA, 19 nt, Homo sapiens
ugacaaaggcacccucaaa

SEQ ID NO: 52210 - RNA, 19 nt, Homo sapiens
gguacaaggacauugauuu

SEQ ID NO: 52211 - RNA, 19 nt, Homo sapiens
uaaggaagccuaucaggau

SEQ ID NO: 52212 - RNA, 19 nt, Homo sapiens
gagcauacaccagcauuga

SEQ ID NO: 52213 - RNA, 19 nt, Homo sapiens
gaauagccuugguacaaag

SEQ ID NO: 52214 - RNA, 19 nt, Homo sapiens
caacauugucacuaaguuu

SEQ ID NO: 52215 - RNA, 19 nt, Homo sapiens
gcuguacucugaacuguag

SEQ ID NO: 52216 - RNA, 19 nt, Homo sapiens
gaccggcucuucagugugu

SEQ ID NO: 52217 - RNA, 19 nt, Homo sapiens
cguauaagauuaggaugaa

SEQ ID NO: 52218 - RNA, 19 nt, Homo sapiens
ccagauuuguuuacauguu

SEQ ID NO: 52219 - RNA, 19 nt, Homo sapiens
cgaaugggcagucugguuu

SEQ ID NO: 52220 - RNA, 19 nt, Homo sapiens
aaugaggcuugcaguguua

SEQ ID NO: 52221 - RNA, 19 nt, Homo sapiens
gaaugggcagucugguuua

SEQ ID NO: 52222 - RNA, 19 nt, Homo sapiens
caucgugaaucaguaauug

SEQ ID NO: 52223 - RNA, 19 nt, Homo sapiens
guaggacauuauugccaua

SEQ ID NO: 52224 - RNA, 19 nt, Homo sapiens
caaaggaacaagucgaaug

SEQ ID NO: 52225 - RNA, 19 nt, Homo sapiens
uaaauucgugguugaugua

SEQ ID NO: 52226 - RNA, 19 nt, Homo sapiens
caggaacauuuguacauau

SEQ ID NO: 52227 - RNA, 19 nt, Homo sapiens
aaaugaggcuugcaguguu

SEQ ID NO: 52228 - RNA, 19 nt, Homo sapiens
caaaagacauacaguaaca

SEQ ID NO: 52229 - RNA, 19 nt, Homo sapiens
acaagaauaugcaugucaa

SEQ ID NO: 52230 - RNA, 19 nt, Homo sapiens
ggagcagcauguacaguca

SEQ ID NO: 52231 - RNA, 19 nt, Homo sapiens
gggcuguaaugcuaccuuu

SEQ ID NO: 52232 - RNA, 19 nt, Homo sapiens
caagccagguggagauugu

SEQ ID NO: 52233 - RNA, 19 nt, Homo sapiens
ugaugguuguuguguauuu

SEQ ID NO: 52234 - RNA, 19 nt, Homo sapiens
cauauucugccguagauaa

SEQ ID NO: 52235 - RNA, 19 nt, Homo sapiens
guacauauucugccguaga

SEQ ID NO: 52236 - RNA, 19 nt, Homo sapiens
ggucaccuguggaaugaau

SEQ ID NO: 52237 - RNA, 19 nt, Homo sapiens
caagugaugaccuaaaugu

SEQ ID NO: 52238 - RNA, 19 nt, Homo sapiens
gaccaucccuguguuugga

SEQ ID NO: 52239 - RNA, 19 nt, Homo sapiens
aagaagaaauccaggaagu

SEQ ID NO: 52240 - RNA, 19 nt, Homo sapiens
ugacuuucaugcugccuuu

SEQ ID NO: 52241 - RNA, 19 nt, Homo sapiens
ugugacaucugcaagaaga

SEQ ID NO: 52242 - RNA, 19 nt, Homo sapiens
gacacaaccucagcucaga

SEQ ID NO: 52243 - RNA, 19 nt, Homo sapiens
cuacaaugccguccacuug

SEQ ID NO: 52244 - RNA, 19 nt, Homo sapiens
ccacaccauuucagguuga

SEQ ID NO: 52245 - RNA, 19 nt, Homo sapiens
ggaaagguguuggaucacu

SEQ ID NO: 52246 - RNA, 19 nt, Homo sapiens
uuaguuacccagcuguuua

SEQ ID NO: 52247 - RNA, 19 nt, Homo sapiens
gaagcaagaugagguucuc

SEQ ID NO: 52248 - RNA, 19 nt, Homo sapiens
aagaugagguucuccagau

SEQ ID NO: 52249 - RNA, 19 nt, Homo sapiens
gagaggaauagccuuggua

SEQ ID NO: 52250 - RNA, 19 nt, Homo sapiens
ccacagcaaauguagauau

SEQ ID NO: 52251 - RNA, 19 nt, Homo sapiens
gaacucauggcaauucaag

SEQ ID NO: 52252 - RNA, 19 nt, Homo sapiens
guagguacaaggacauuga

SEQ ID NO: 52253 - RNA, 19 nt, Homo sapiens
ccacacuguuacauacauu

SEQ ID NO: 52254 - RNA, 19 nt, Homo sapiens
ugaauuuacuugguaggaa

SEQ ID NO: 52255 - RNA, 19 nt, Homo sapiens
gagcaagcauguugaauuu

SEQ ID NO: 52256 - RNA, 19 nt, Homo sapiens
gcaagcauguugaauuuaa

SEQ ID NO: 52257 - RNA, 19 nt, Homo sapiens
gcacaucuuucuauacuuu

SEQ ID NO: 52258 - RNA, 19 nt, Homo sapiens
ggacauaccuaauacuuuc

SEQ ID NO: 52259 - RNA, 19 nt, Homo sapiens
gaauaugccuucucugcua

SEQ ID NO: 52260 - RNA, 19 nt, Homo sapiens
gaggagagguugcagauga

SEQ ID NO: 52261 - RNA, 19 nt, Homo sapiens
ucuaaagucuguuccauua

SEQ ID NO: 52262 - RNA, 19 nt, Homo sapiens
gaagaucagucaccagaga

SEQ ID NO: 52263 - RNA, 19 nt, Homo sapiens
guaaaugggucaucagcaa

SEQ ID NO: 52264 - RNA, 19 nt, Homo sapiens
gaauaacgauuucuugcau

SEQ ID NO: 52265 - RNA, 19 nt, Homo sapiens
guucaucacccaucaguua

SEQ ID NO: 52266 - RNA, 19 nt, Homo sapiens
caagaucacugagcuaaau

SEQ ID NO: 52267 - RNA, 19 nt, Homo sapiens
ggaaagaauaugcauagaa

SEQ ID NO: 52268 - RNA, 19 nt, Homo sapiens
gaaauucaaccaacggaaa

SEQ ID NO: 52269 - RNA, 19 nt, Homo sapiens
uaaagucuguuccauuaga

SEQ ID NO: 52270 - RNA, 19 nt, Homo sapiens
ggaaagaugggaaaugguu

SEQ ID NO: 52271 - RNA, 19 nt, Homo sapiens
gaacagauuggaucggaaa

SEQ ID NO: 52272 - RNA, 19 nt, Homo sapiens
ccagagagauggacugaca

SEQ ID NO: 52273 - RNA, 19 nt, Homo sapiens
gcagauacccauaaccuau

SEQ ID NO: 52274 - RNA, 19 nt, Homo sapiens
ucaacuaacgccuacauua

SEQ ID NO: 52275 - RNA, 19 nt, Homo sapiens
cauuacagcuuucuagaug

SEQ ID NO: 52276 - RNA, 19 nt, Homo sapiens
gagauggacugacaaaugc

SEQ ID NO: 52277 - RNA, 19 nt, Homo sapiens
cagcaacuaugaaauaauc

SEQ ID NO: 52278 - RNA, 19 nt, Homo sapiens
gagaaggaaugguccacuu

SEQ ID NO: 52279 - RNA, 19 nt, Homo sapiens
ccagauugaugucauguau

SEQ ID NO: 52280 - RNA, 19 nt, Homo sapiens
ggaggguacuucauugaug

SEQ ID NO: 52281 - RNA, 19 nt, Homo sapiens
ggccauaguuuguuaaucu

SEQ ID NO: 52282 - RNA, 19 nt, Homo sapiens
guagugacauuaaauuugg

SEQ ID NO: 52283 - RNA, 19 nt, Homo sapiens
ggauauugccuacauuuau

SEQ ID NO: 52284 - RNA, 19 nt, Homo sapiens
aggaggaggugaaugauaa

SEQ ID NO: 52285 - RNA, 19 nt, Homo sapiens
cagauuggaucggaaagua

SEQ ID NO: 52286 - RNA, 19 nt, Homo sapiens
gaacaacgagaaucaagau

SEQ ID NO: 52287 - RNA, 19 nt, Homo sapiens
gacaaaugcuggagaacug

SEQ ID NO: 52288 - RNA, 19 nt, Homo sapiens
ccuaauacuuuccagauug

SEQ ID NO: 52289 - RNA, 19 nt, Homo sapiens
ccacaaccauaauagaaug

SEQ ID NO: 52290 - RNA, 19 nt, Homo sapiens
guaagaaucagauggcauu

SEQ ID NO: 52291 - RNA, 19 nt, Homo sapiens
ccagaccacuacugaauau

SEQ ID NO: 52292 - RNA, 19 nt, Homo sapiens
cagcaaguauuguccuauu

SEQ ID NO: 52293 - RNA, 19 nt, Homo sapiens
gauuuauacuucucuguug

SEQ ID NO: 52294 - RNA, 19 nt, Homo sapiens
agaaucagauggcauuaug

SEQ ID NO: 52295 - RNA, 19 nt, Homo sapiens
caaaaccgaucaaagaaaa

SEQ ID NO: 52296 - RNA, 19 nt, Homo sapiens
gcaaguauuguccuauuug

SEQ ID NO: 52297 - RNA, 19 nt, Homo sapiens
caauagaccucgaaaauca

SEQ ID NO: 52298 - RNA, 19 nt, Homo sapiens
cuggagaacuggaaaguga

SEQ ID NO: 52299 - RNA, 19 nt, Homo sapiens
ggcagcaacuaugaaauaa

SEQ ID NO: 52300 - RNA, 19 nt, Homo sapiens
gaagucacaagauacauau

SEQ ID NO: 52301 - RNA, 19 nt, Homo sapiens
caucacccaucaguuauuu

SEQ ID NO: 52302 - RNA, 19 nt, Homo sapiens
aaagauggacuacauguga

SEQ ID NO: 52303 - RNA, 19 nt, Homo sapiens
gcagaaaugcaucgaacaa

SEQ ID NO: 52304 - RNA, 19 nt, Homo sapiens
uauggaaaccgucuuaauu

SEQ ID NO: 52305 - RNA, 19 nt, Homo sapiens
gcaauuggcacaucuuucu

SEQ ID NO: 52306 - RNA, 19 nt, Homo sapiens
gcaguggacauaagcauug

SEQ ID NO: 52307 - RNA, 19 nt, Homo sapiens
cuauggacguuaauugaaa

SEQ ID NO: 52308 - RNA, 19 nt, Homo sapiens
ccacuuccauugaaauaca

SEQ ID NO: 52309 - RNA, 19 nt, Homo sapiens
gaggguguuuauucuauau

SEQ ID NO: 52310 - RNA, 19 nt, Homo sapiens
gaaagaugggaaaugguuu

SEQ ID NO: 52311 - RNA, 19 nt, Homo sapiens
cuaauacuuuccagauuga

SEQ ID NO: 52312 - RNA, 19 nt, Homo sapiens
gugaggguguuuauucuau

SEQ ID NO: 52313 - RNA, 19 nt, Homo sapiens
gaaauaaucguaguaugag

SEQ ID NO: 52314 - RNA, 19 nt, Homo sapiens
gacauaacaggaaacagua

SEQ ID NO: 52315 - RNA, 19 nt, Homo sapiens
ccucacauuuccaguacua

SEQ ID NO: 52316 - RNA, 19 nt, Homo sapiens
cuaaggaggaggugaauga

SEQ ID NO: 52317 - RNA, 19 nt, Homo sapiens
gguucgaccuuugcagaua

SEQ ID NO: 52318 - RNA, 19 nt, Homo sapiens
uacauuacauucuccuuga

SEQ ID NO: 52319 - RNA, 19 nt, Homo sapiens
gcuaauacaugugacuauc

SEQ ID NO: 52320 - RNA, 19 nt, Homo sapiens
caauggcucuaaugaagau

SEQ ID NO: 52321 - RNA, 19 nt, Homo sapiens
caaguauuguccuauuugu

SEQ ID NO: 52322 - RNA, 19 nt, Homo sapiens
ugaagucacaagauacaua

SEQ ID NO: 52323 - RNA, 19 nt, Homo sapiens
ugaggguguuuauucuaua

SEQ ID NO: 52324 - RNA, 19 nt, Homo sapiens
gaaaugcaucgaacaacga

SEQ ID NO: 52325 - RNA, 19 nt, Homo sapiens
ggucgaacuuggugugugu

SEQ ID NO: 52326 - RNA, 19 nt, Homo sapiens
uuuaauaggugguauagca

SEQ ID NO: 52327 - RNA, 19 nt, Homo sapiens
cguccaauuugcuuucuuu

SEQ ID NO: 52328 - RNA, 19 nt, Homo sapiens
gaccagaccacuacugaau

SEQ ID NO: 52329 - RNA, 19 nt, Homo sapiens
caacuaacgccuacauuac

SEQ ID NO: 52330 - RNA, 19 nt, Homo sapiens
gguauucccuccaccucuu

SEQ ID NO: 52331 - RNA, 19 nt, Homo sapiens
uaauggauauugccuacau

SEQ ID NO: 52332 - RNA, 19 nt, Homo sapiens
gaacgacuuuuaacuuuca

SEQ ID NO: 52333 - RNA, 19 nt, Homo sapiens
gauaaaacucuccaagaua

SEQ ID NO: 52334 - RNA, 19 nt, Homo sapiens
ggguguuuauucuauauga

SEQ ID NO: 52335 - RNA, 19 nt, Homo sapiens
aaauagagcaagcauguug

SEQ ID NO: 52336 - RNA, 19 nt, Homo sapiens
aggaaacaguauuguauga

SEQ ID NO: 52337 - RNA, 19 nt, Homo sapiens
ugacauaacaggaaacagu

SEQ ID NO: 52338 - RNA, 19 nt, Homo sapiens
ucaaccaacggaaagaaua

SEQ ID NO: 52339 - RNA, 19 nt, Homo sapiens
ggaggugaaugauaaaaga

SEQ ID NO: 52340 - RNA, 19 nt, Homo sapiens
aaauauggaaaccgucuua

SEQ ID NO: 52341 - RNA, 19 nt, Homo sapiens
ggacguuaauugaaaagaa

SEQ ID NO: 52342 - RNA, 19 nt, Homo sapiens
guugauaccugagacuguu

SEQ ID NO: 52343 - RNA, 19 nt, Homo sapiens
uuaaauagagcaagcaugu

SEQ ID NO: 52344 - RNA, 19 nt, Homo sapiens
uaggaaagaugggaaaugg

SEQ ID NO: 52345 - RNA, 19 nt, Homo sapiens
ccauugaaauacagaguuc

SEQ ID NO: 52346 - RNA, 19 nt, Homo sapiens
guaugaggaggaaccuuua

SEQ ID NO: 52347 - RNA, 19 nt, Homo sapiens
gcuuauccauugaauucuu

SEQ ID NO: 52348 - RNA, 19 nt, Homo sapiens
aggcagcaacuaugaaaua

SEQ ID NO: 52349 - RNA, 19 nt, Homo sapiens
ccaacugguucgaccuuug

SEQ ID NO: 52350 - RNA, 19 nt, Homo sapiens
gauuggaucggaaaguaaa

SEQ ID NO: 52351 - RNA, 19 nt, Homo sapiens
gaccacuacugaauauaag

SEQ ID NO: 52352 - RNA, 19 nt, Homo sapiens
agaccacuacugaauauaa

SEQ ID NO: 52353 - RNA, 19 nt, Homo sapiens
ucacaagaccagaccacua

SEQ ID NO: 52354 - RNA, 19 nt, Homo sapiens
caaccaacggaaagaauau

SEQ ID NO: 52355 - RNA, 19 nt, Homo sapiens
gcaaugaugugugcaagua

SEQ ID NO: 52356 - RNA, 19 nt, Homo sapiens
ggacagcuauauuguguuc

SEQ ID NO: 52357 - RNA, 19 nt, Homo sapiens
gaggacagcuauauugugu

SEQ ID NO: 52358 - RNA, 19 nt, Homo sapiens
gggagaagaucauccugaa

SEQ ID NO: 52359 - RNA, 19 nt, Homo sapiens
ccaacuacccagacgauua

SEQ ID NO: 52360 - RNA, 19 nt, Homo sapiens
caucaaagcugcaguucca

SEQ ID NO: 52361 - RNA, 19 nt, Homo sapiens
gagcagcggugccucaaca

SEQ ID NO: 52362 - RNA, 19 nt, Homo sapiens
ggagagacccugcaagaca

SEQ ID NO: 52363 - RNA, 19 nt, Homo sapiens
gcucguaaguccuccauca

SEQ ID NO: 52364 - RNA, 19 nt, Homo sapiens
gcaucucccugcaguuuga

SEQ ID NO: 52365 - RNA, 19 nt, Homo sapiens
ucaggaaccucaccuugga

SEQ ID NO: 52366 - RNA, 19 nt, Homo sapiens
gggcuuugccgucaacuuu

SEQ ID NO: 52367 - RNA, 19 nt, Homo sapiens
gcuaugagaagccugauga

SEQ ID NO: 52368 - RNA, 19 nt, Homo sapiens
aaaggacuauggccacauu

SEQ ID NO: 52369 - RNA, 19 nt, Homo sapiens
gcuauauuguguucaccua

SEQ ID NO: 52370 - RNA, 19 nt, Homo sapiens
gcacugacgaggacagcua

SEQ ID NO: 52371 - RNA, 19 nt, Homo sapiens
ugugggagauggagaggua

SEQ ID NO: 52372 - RNA, 19 nt, Homo sapiens
ggacauugcccuggacgaa

SEQ ID NO: 52373 - RNA, 19 nt, Homo sapiens
gcauuacgcucggaacaca

SEQ ID NO: 52374 - RNA, 19 nt, Homo sapiens
ggcaagaacugugacaagu

SEQ ID NO: 52375 - RNA, 19 nt, Homo sapiens
gacgaggacagcuauauug

SEQ ID NO: 52376 - RNA, 19 nt, Homo sapiens
caguuugacuucuuugaga

SEQ ID NO: 52377 - RNA, 19 nt, Homo sapiens
gagaagaucauccugaacu

SEQ ID NO: 52378 - RNA, 19 nt, Homo sapiens
gacauuuccuguugugaag

SEQ ID NO: 52379 - RNA, 19 nt, Homo sapiens
ucugugacauuuccuguug

SEQ ID NO: 52380 - RNA, 19 nt, Homo sapiens
caagcugcauggcaaguuc

SEQ ID NO: 52381 - RNA, 19 nt, Homo sapiens
ggacuauggccacauucaa

SEQ ID NO: 52382 - RNA, 19 nt, Homo sapiens
cauuuccuguugugaagua

SEQ ID NO: 52383 - RNA, 19 nt, Homo sapiens
ugacggguccauuaacaaa

SEQ ID NO: 52384 - RNA, 19 nt, Homo sapiens
agacagagggcaaugaugu

SEQ ID NO: 52385 - RNA, 19 nt, Homo sapiens
uggcuacucugcucacaug

SEQ ID NO: 52386 - RNA, 19 nt, Homo sapiens
cagaacuggugcucucuuc

SEQ ID NO: 52387 - RNA, 19 nt, Homo sapiens
cauggcaaguucugugguu

SEQ ID NO: 52388 - RNA, 19 nt, Homo sapiens
ucacauuccaguccuuuga

SEQ ID NO: 52389 - RNA, 19 nt, Homo sapiens
ugacauuuccuguugugaa

SEQ ID NO: 52390 - RNA, 19 nt, Homo sapiens
ggucaucaccucccaguac

SEQ ID NO: 52391 - RNA, 19 nt, Homo sapiens
ccacgugggccucacauuc

SEQ ID NO: 52392 - RNA, 19 nt, Homo sapiens
guggagagacccugcaaga

SEQ ID NO: 52393 - RNA, 19 nt, Homo sapiens
cccgcaagcuuuacaagug

SEQ ID NO: 52394 - RNA, 19 nt, Homo sapiens
ugacgaggacagcuauauu

SEQ ID NO: 52395 - RNA, 19 nt, Homo sapiens
gaacuggugcucucuucuc

SEQ ID NO: 52396 - RNA, 19 nt, Homo sapiens
caacuacccagacgauuac

SEQ ID NO: 52397 - RNA, 19 nt, Homo sapiens
gagauggcuucuggaggaa

SEQ ID NO: 52398 - RNA, 19 nt, Homo sapiens
agaagaucauccugaacuu

SEQ ID NO: 52399 - RNA, 19 nt, Homo sapiens
cagcugugccuacgacuau

SEQ ID NO: 52400 - RNA, 19 nt, Homo sapiens
cguaaguccuccaucaaag

SEQ ID NO: 52401 - RNA, 19 nt, Homo sapiens
acauugcccuggacgaaga

SEQ ID NO: 52402 - RNA, 19 nt, Homo sapiens
ucaacacccugggcagcua

SEQ ID NO: 52403 - RNA, 19 nt, Homo sapiens
caaacucccugagccuauc

SEQ ID NO: 52404 - RNA, 19 nt, Homo sapiens
uauauuguguucaccuauc

SEQ ID NO: 52405 - RNA, 19 nt, Homo sapiens
cuucaaggcccacuucuuc

SEQ ID NO: 52406 - RNA, 19 nt, Homo sapiens
caacaugcgcguggaguuc

SEQ ID NO: 52407 - RNA, 19 nt, Homo sapiens
caaauuccgagugcagaaa

SEQ ID NO: 52408 - RNA, 19 nt, Homo sapiens
agccagggcaggaguauaa

SEQ ID NO: 52409 - RNA, 19 nt, Homo sapiens
ccgcaucucccugcaguuu

SEQ ID NO: 52410 - RNA, 19 nt, Homo sapiens
gacuauggccacauucaau

SEQ ID NO: 52411 - RNA, 19 nt, Homo sapiens
gggcuucuuugcagucuac

SEQ ID NO: 52412 - RNA, 19 nt, Homo sapiens
cagcagcaauuggguugga

SEQ ID NO: 52413 - RNA, 19 nt, Homo sapiens
agacagcacaggcaacuuc

SEQ ID NO: 52414 - RNA, 19 nt, Homo sapiens
ggcucaaguucgucucuga

SEQ ID NO: 52415 - RNA, 19 nt, Homo sapiens
gcgcuacuguggcuaugag

SEQ ID NO: 52416 - RNA, 19 nt, Homo sapiens
ggucauccccuuugucauu

SEQ ID NO: 52417 - RNA, 19 nt, Homo sapiens
ugacuucgacagcaucaug

SEQ ID NO: 52418 - RNA, 19 nt, Homo sapiens
ucugacggguccauuaaca

SEQ ID NO: 52419 - RNA, 19 nt, Homo sapiens
gcagcaauuggguuggaaa

SEQ ID NO: 52420 - RNA, 19 nt, Homo sapiens
ccuaucgucuccacugaca

SEQ ID NO: 52421 - RNA, 19 nt, Homo sapiens
ccaaacucccugagccuau

SEQ ID NO: 52422 - RNA, 19 nt, Homo sapiens
gcaguuugacuucuuugag

SEQ ID NO: 52423 - RNA, 19 nt, Homo sapiens
ccugcaguuugacuucuuu

SEQ ID NO: 52424 - RNA, 19 nt, Homo sapiens
gcggauuccucaccaagcu

SEQ ID NO: 52425 - RNA, 19 nt, Homo sapiens
ucucugacggguccauuaa

SEQ ID NO: 52426 - RNA, 19 nt, Homo sapiens
gucaucaccucccaguaca

SEQ ID NO: 52427 - RNA, 19 nt, Homo sapiens
gcaucuuccuggauaccau

SEQ ID NO: 52428 - RNA, 19 nt, Homo sapiens
ugugacaaguucggcauug

SEQ ID NO: 52429 - RNA, 19 nt, Homo sapiens
ucguaaguccuccaucaaa

SEQ ID NO: 52430 - RNA, 19 nt, Homo sapiens
ucaaauuccgagugcagaa

SEQ ID NO: 52431 - RNA, 19 nt, Homo sapiens
caaggcccacuucuucuca

SEQ ID NO: 52432 - RNA, 19 nt, Homo sapiens
ucaccucccaguacaacaa

SEQ ID NO: 52433 - RNA, 19 nt, Homo sapiens
cgaggacagcuauauugug

SEQ ID NO: 52434 - RNA, 19 nt, Homo sapiens
gagaagcccgaggucauca

SEQ ID NO: 52435 - RNA, 19 nt, Homo sapiens
uccaguccuuugagauuga

SEQ ID NO: 52436 - RNA, 19 nt, Homo sapiens
ccuaugacuucgacagcau

SEQ ID NO: 52437 - RNA, 19 nt, Homo sapiens
ccgccacguuuccaucguu

SEQ ID NO: 52438 - RNA, 19 nt, Homo sapiens
ccaccuccacucugccauu

SEQ ID NO: 52439 - RNA, 19 nt, Homo sapiens
gaguucaaguccgacaaca

SEQ ID NO: 52440 - RNA, 19 nt, Homo sapiens
gaggugcgcaguggacuca

SEQ ID NO: 52441 - RNA, 19 nt, Homo sapiens
gacagagggcaaugaugug

SEQ ID NO: 52442 - RNA, 19 nt, Homo sapiens
gagacagagggcaaugaug

SEQ ID NO: 52443 - RNA, 19 nt, Homo sapiens
gggugaaaccucccauugg

SEQ ID NO: 52444 - RNA, 19 nt, Homo sapiens
ugagacagagggcaaugau

SEQ ID NO: 52445 - RNA, 19 nt, Homo sapiens
caagacagcacaggcaacu

SEQ ID NO: 52446 - RNA, 19 nt, Homo sapiens
gcaaugaugugugcaagua

SEQ ID NO: 52447 - RNA, 19 nt, Homo sapiens
gaaagagccugaagaccuu

SEQ ID NO: 52448 - RNA, 19 nt, Homo sapiens
ggacagcuauauuguguuc

SEQ ID NO: 52449 - RNA, 19 nt, Homo sapiens
gaggacagcuauauugugu

SEQ ID NO: 52450 - RNA, 19 nt, Homo sapiens
gggagaagaucauccugaa

SEQ ID NO: 52451 - RNA, 19 nt, Homo sapiens
gaccgacacucacaucuau

SEQ ID NO: 52452 - RNA, 19 nt, Homo sapiens
ccaacuacccagacgauua

SEQ ID NO: 52453 - RNA, 19 nt, Homo sapiens
caucaaagcugcaguucca

SEQ ID NO: 52454 - RNA, 19 nt, Homo sapiens
gagcagcggugccucaaca

SEQ ID NO: 52455 - RNA, 19 nt, Homo sapiens
ggagagacccugcaagaca

SEQ ID NO: 52456 - RNA, 19 nt, Homo sapiens
gcucguaaguccuccauca

SEQ ID NO: 52457 - RNA, 19 nt, Homo sapiens
gcaucucccugcaguuuga

SEQ ID NO: 52458 - RNA, 19 nt, Homo sapiens
ccaagaaggagaagaaaga

SEQ ID NO: 52459 - RNA, 19 nt, Homo sapiens
gaagaaagagccugaagac

SEQ ID NO: 52460 - RNA, 19 nt, Homo sapiens
ucaggaaccucaccuugga

SEQ ID NO: 52461 - RNA, 19 nt, Homo sapiens
ggaccgacacucacaucua

SEQ ID NO: 52462 - RNA, 19 nt, Homo sapiens
gggcuuugccgucaacuuu

SEQ ID NO: 52463 - RNA, 19 nt, Homo sapiens
gcuaugagaagccugauga

SEQ ID NO: 52464 - RNA, 19 nt, Homo sapiens
aaaggacuauggccacauu

SEQ ID NO: 52465 - RNA, 19 nt, Homo sapiens
gcuauauuguguucaccua

SEQ ID NO: 52466 - RNA, 19 nt, Homo sapiens
gcacugacgaggacagcua

SEQ ID NO: 52467 - RNA, 19 nt, Homo sapiens
ugugggagauggagaggua

SEQ ID NO: 52468 - RNA, 19 nt, Homo sapiens
ggacauugcccuggacgaa

SEQ ID NO: 52469 - RNA, 19 nt, Homo sapiens
gcauuacgcucggaacaca

SEQ ID NO: 52470 - RNA, 19 nt, Homo sapiens
ggcaagaacugugacaagu

SEQ ID NO: 52471 - RNA, 19 nt, Homo sapiens
gacgaggacagcuauauug

SEQ ID NO: 52472 - RNA, 19 nt, Homo sapiens
caguuugacuucuuugaga

SEQ ID NO: 52473 - RNA, 19 nt, Homo sapiens
gagaagaucauccugaacu

SEQ ID NO: 52474 - RNA, 19 nt, Homo sapiens
gacauuuccuguugugaag

SEQ ID NO: 52475 - RNA, 19 nt, Homo sapiens
ucugugacauuuccuguug

SEQ ID NO: 52476 - RNA, 19 nt, Homo sapiens
caagcugcauggcaaguuc

SEQ ID NO: 52477 - RNA, 19 nt, Homo sapiens
ggacuauggccacauucaa

SEQ ID NO: 52478 - RNA, 19 nt, Homo sapiens
cauuuccuguugugaagua

SEQ ID NO: 52479 - RNA, 19 nt, Homo sapiens
ugacggguccauuaacaaa

SEQ ID NO: 52480 - RNA, 19 nt, Homo sapiens
agacagagggcaaugaugu

SEQ ID NO: 52481 - RNA, 19 nt, Homo sapiens
uggcuacucugcucacaug

SEQ ID NO: 52482 - RNA, 19 nt, Homo sapiens
cagaacuggugcucucuuc

SEQ ID NO: 52483 - RNA, 19 nt, Homo sapiens
uaucaggccuggaguuacu

SEQ ID NO: 52484 - RNA, 19 nt, Homo sapiens
cauggcaaguucugugguu

SEQ ID NO: 52485 - RNA, 19 nt, Homo sapiens
ucacauuccaguccuuuga

SEQ ID NO: 52486 - RNA, 19 nt, Homo sapiens
ugacauuuccuguugugaa

SEQ ID NO: 52487 - RNA, 19 nt, Homo sapiens
ggucaucaccucccaguac

SEQ ID NO: 52488 - RNA, 19 nt, Homo sapiens
ccacgugggccucacauuc

SEQ ID NO: 52489 - RNA, 19 nt, Homo sapiens
guggagagacccugcaaga

SEQ ID NO: 52490 - RNA, 19 nt, Homo sapiens
cccgcaagcuuuacaagug

SEQ ID NO: 52491 - RNA, 19 nt, Homo sapiens
ugacgaggacagcuauauu

SEQ ID NO: 52492 - RNA, 19 nt, Homo sapiens
gaacuggugcucucuucuc

SEQ ID NO: 52493 - RNA, 19 nt, Homo sapiens
caacuacccagacgauuac

SEQ ID NO: 52494 - RNA, 19 nt, Homo sapiens
gagauggcuucuggaggaa

SEQ ID NO: 52495 - RNA, 19 nt, Homo sapiens
agaagaucauccugaacuu

SEQ ID NO: 52496 - RNA, 19 nt, Homo sapiens
ccacuucuucucagucuug

SEQ ID NO: 52497 - RNA, 19 nt, Homo sapiens
cguaaguccuccaucaaag

SEQ ID NO: 52498 - RNA, 19 nt, Homo sapiens
cagcugugccuacgacuau

SEQ ID NO: 52499 - RNA, 19 nt, Homo sapiens
ucaacacccugggcagcua

SEQ ID NO: 52500 - RNA, 19 nt, Homo sapiens
caaacucccugagccuauc

SEQ ID NO: 52501 - RNA, 19 nt, Homo sapiens
uauauuguguucaccuauc

SEQ ID NO: 52502 - RNA, 19 nt, Homo sapiens
acauugcccuggacgaaga

SEQ ID NO: 52503 - RNA, 19 nt, Homo sapiens
ggagcuauuuggacuuuug

SEQ ID NO: 52504 - RNA, 19 nt, Homo sapiens
cuucaaggcccacuucuuc

SEQ ID NO: 52505 - RNA, 19 nt, Homo sapiens
caacaugcgcguggaguuc

SEQ ID NO: 52506 - RNA, 19 nt, Homo sapiens
caaauuccgagugcagaaa

SEQ ID NO: 52507 - RNA, 19 nt, Homo sapiens
gagaagaaagagccugaag

SEQ ID NO: 52508 - RNA, 19 nt, Homo sapiens
agccagggcaggaguauaa

SEQ ID NO: 52509 - RNA, 19 nt, Homo sapiens
gcauuugggcacuguagga

SEQ ID NO: 52510 - RNA, 19 nt, Homo sapiens
ucuaucaggccuggaguua

SEQ ID NO: 52511 - RNA, 19 nt, Homo sapiens
ccgcaucucccugcaguuu

SEQ ID NO: 52512 - RNA, 19 nt, Homo sapiens
gacuauggccacauucaau

SEQ ID NO: 52513 - RNA, 19 nt, Homo sapiens
gggcuucuuugcagucuac

SEQ ID NO: 52514 - RNA, 19 nt, Homo sapiens
cagcagcaauuggguugga

SEQ ID NO: 52515 - RNA, 19 nt, Homo sapiens
agacagcacaggcaacuuc

SEQ ID NO: 52516 - RNA, 19 nt, Homo sapiens
gacccuaagccaagaagga

SEQ ID NO: 52517 - RNA, 19 nt, Homo sapiens
ggcucaaguucgucucuga

SEQ ID NO: 52518 - RNA, 19 nt, Homo sapiens
gcgcuacuguggcuaugag

SEQ ID NO: 52519 - RNA, 19 nt, Homo sapiens
agaagaaagagccugaaga

SEQ ID NO: 52520 - RNA, 19 nt, Homo sapiens
ggucauccccuuugucauu

SEQ ID NO: 52521 - RNA, 19 nt, Homo sapiens
ugacuucgacagcaucaug

SEQ ID NO: 52522 - RNA, 19 nt, Homo sapiens
ucugacggguccauuaaca

SEQ ID NO: 52523 - RNA, 19 nt, Homo sapiens
gcagcaauuggguuggaaa

SEQ ID NO: 52524 - RNA, 19 nt, Homo sapiens
ccuaucgucuccacugaca

SEQ ID NO: 52525 - RNA, 19 nt, Homo sapiens
ccaaacucccugagccuau

SEQ ID NO: 52526 - RNA, 19 nt, Homo sapiens
gcaguuugacuucuuugag

SEQ ID NO: 52527 - RNA, 19 nt, Homo sapiens
ccugcaguuugacuucuuu

SEQ ID NO: 52528 - RNA, 19 nt, Homo sapiens
gcggauuccucaccaagcu

SEQ ID NO: 52529 - RNA, 19 nt, Homo sapiens
ucucugacggguccauuaa

SEQ ID NO: 52530 - RNA, 19 nt, Homo sapiens
gcccacuucuucucagucu

SEQ ID NO: 52531 - RNA, 19 nt, Homo sapiens
gucaucaccucccaguaca

SEQ ID NO: 52532 - RNA, 19 nt, Homo sapiens
gcaucuuccuggauaccau

SEQ ID NO: 52533 - RNA, 19 nt, Homo sapiens
aagccaagaaggagaagaa

SEQ ID NO: 52534 - RNA, 19 nt, Homo sapiens
ugugacaaguucggcauug

SEQ ID NO: 52535 - RNA, 19 nt, Homo sapiens
ucguaaguccuccaucaaa

SEQ ID NO: 52536 - RNA, 19 nt, Homo sapiens
ucaaauuccgagugcagaa

SEQ ID NO: 52537 - RNA, 19 nt, Homo sapiens
ggagaagaaagagccugaa

SEQ ID NO: 52538 - RNA, 19 nt, Homo sapiens
caaggcccacuucuucuca

SEQ ID NO: 52539 - RNA, 19 nt, Homo sapiens
ggggagcuauuuggacuuu

SEQ ID NO: 52540 - RNA, 19 nt, Homo sapiens
ucaccucccaguacaacaa

SEQ ID NO: 52541 - RNA, 19 nt, Homo sapiens
gagaagcccgaggucauca

SEQ ID NO: 52542 - RNA, 19 nt, Homo sapiens
uccaguccuuugagauuga

SEQ ID NO: 52543 - RNA, 19 nt, Homo sapiens
cgaggacagcuauauugug

SEQ ID NO: 52544 - RNA, 19 nt, Homo sapiens
ccuaugacuucgacagcau

SEQ ID NO: 52545 - RNA, 19 nt, Homo sapiens
ccgccacguuuccaucguu

SEQ ID NO: 52546 - RNA, 19 nt, Homo sapiens
gagcagagcuuccacaaga

SEQ ID NO: 52547 - RNA, 19 nt, Homo sapiens
gaacuggacuccggcauaa

SEQ ID NO: 52548 - RNA, 19 nt, Homo sapiens
gcaaugaugugugcaagua

SEQ ID NO: 52549 - RNA, 19 nt, Homo sapiens
caacuggccugacaaguau

SEQ ID NO: 52550 - RNA, 19 nt, Homo sapiens
ggacagcuauauuguguuc

SEQ ID NO: 52551 - RNA, 19 nt, Homo sapiens
caauaaaccgaaaguguua

SEQ ID NO: 52552 - RNA, 19 nt, Homo sapiens
gaggacagcuauauugugu

SEQ ID NO: 52553 - RNA, 19 nt, Homo sapiens
gacgagugcuccaaggaua

SEQ ID NO: 52554 - RNA, 19 nt, Homo sapiens
gggagaagaucauccugaa

SEQ ID NO: 52555 - RNA, 19 nt, Homo sapiens
ccaacuacccagacgauua

SEQ ID NO: 52556 - RNA, 19 nt, Homo sapiens
caucaaagcugcaguucca

SEQ ID NO: 52557 - RNA, 19 nt, Homo sapiens
ccaacuggccugacaagua

SEQ ID NO: 52558 - RNA, 19 nt, Homo sapiens
gagcagcggugccucaaca

SEQ ID NO: 52559 - RNA, 19 nt, Homo sapiens
gggcagacgugaagaccaa

SEQ ID NO: 52560 - RNA, 19 nt, Homo sapiens
ggagagacccugcaagaca

SEQ ID NO: 52561 - RNA, 19 nt, Homo sapiens
gcucguaaguccuccauca

SEQ ID NO: 52562 - RNA, 19 nt, Homo sapiens
gcaaagaagccggcuguga

SEQ ID NO: 52563 - RNA, 19 nt, Homo sapiens
gcaucucccugcaguuuga

SEQ ID NO: 52564 - RNA, 19 nt, Homo sapiens
ccaauaaaccgaaaguguu

SEQ ID NO: 52565 - RNA, 19 nt, Homo sapiens
ggaacuggacuccggcaua

SEQ ID NO: 52566 - RNA, 19 nt, Homo sapiens
gagauucuguccuggugaa

SEQ ID NO: 52567 - RNA, 19 nt, Homo sapiens
agucaucauuccucucuua

SEQ ID NO: 52568 - RNA, 19 nt, Homo sapiens
caacaagcacgacugcaaa

SEQ ID NO: 52569 - RNA, 19 nt, Homo sapiens
gggcuuugccgucaacuuu

SEQ ID NO: 52570 - RNA, 19 nt, Homo sapiens
gcuaugagaagccugauga

SEQ ID NO: 52571 - RNA, 19 nt, Homo sapiens
aaaggacuauggccacauu

SEQ ID NO: 52572 - RNA, 19 nt, Homo sapiens
gcuauauuguguucaccua

SEQ ID NO: 52573 - RNA, 19 nt, Homo sapiens
gcacugacgaggacagcua

SEQ ID NO: 52574 - RNA, 19 nt, Homo sapiens
cacaagacauuucgaaguc

SEQ ID NO: 52575 - RNA, 19 nt, Homo sapiens
ugugggagauggagaggua

SEQ ID NO: 52576 - RNA, 19 nt, Homo sapiens
ucaacacguucggcaguua

SEQ ID NO: 52577 - RNA, 19 nt, Homo sapiens
ggacauugcccuggacgaa

SEQ ID NO: 52578 - RNA, 19 nt, Homo sapiens
gcauuacgcucggaacaca

SEQ ID NO: 52579 - RNA, 19 nt, Homo sapiens
ggcaagaacugugacaagu

SEQ ID NO: 52580 - RNA, 19 nt, Homo sapiens
gacgaggacagcuauauug

SEQ ID NO: 52581 - RNA, 19 nt, Homo sapiens
caguuugacuucuuugaga

SEQ ID NO: 52582 - RNA, 19 nt, Homo sapiens
gagaagaucauccugaacu

SEQ ID NO: 52583 - RNA, 19 nt, Homo sapiens
gaagucaucauuccucucu

SEQ ID NO: 52584 - RNA, 19 nt, Homo sapiens
gggcaccgcagccaauaaa

SEQ ID NO: 52585 - RNA, 19 nt, Homo sapiens
caagcacgacugcaaagaa

SEQ ID NO: 52586 - RNA, 19 nt, Homo sapiens
caagcugcauggcaaguuc

SEQ ID NO: 52587 - RNA, 19 nt, Homo sapiens
gccaauaaaccgaaagugu

SEQ ID NO: 52588 - RNA, 19 nt, Homo sapiens
caagacagggcuucucuca

SEQ ID NO: 52589 - RNA, 19 nt, Homo sapiens
ccaauggccuggugagacu

SEQ ID NO: 52590 - RNA, 19 nt, Homo sapiens
ggacuauggccacauucaa

SEQ ID NO: 52591 - RNA, 19 nt, Homo sapiens
acaaguaucccagcaagaa

SEQ ID NO: 52592 - RNA, 19 nt, Homo sapiens
ugacggguccauuaacaaa

SEQ ID NO: 52593 - RNA, 19 nt, Homo sapiens
ccacaagacauuucgaagu

SEQ ID NO: 52594 - RNA, 19 nt, Homo sapiens
agacagagggcaaugaugu

SEQ ID NO: 52595 - RNA, 19 nt, Homo sapiens
ggagaccgacugcggcuau

SEQ ID NO: 52596 - RNA, 19 nt, Homo sapiens
uggcuacucugcucacaug

SEQ ID NO: 52597 - RNA, 19 nt, Homo sapiens
gcauguuccugcgcuucua

SEQ ID NO: 52598 - RNA, 19 nt, Homo sapiens
cauggcaaguucugugguu

SEQ ID NO: 52599 - RNA, 19 nt, Homo sapiens
ucacauuccaguccuuuga

SEQ ID NO: 52600 - RNA, 19 nt, Homo sapiens
caagacauuucgaagucau

SEQ ID NO: 52601 - RNA, 19 nt, Homo sapiens
ggucaucaccucccaguac

SEQ ID NO: 52602 - RNA, 19 nt, Homo sapiens
ccacgugggccucacauuc

SEQ ID NO: 52603 - RNA, 19 nt, Homo sapiens
guggagagacccugcaaga

SEQ ID NO: 52604 - RNA, 19 nt, Homo sapiens
cccgcaagcuuuacaagug

SEQ ID NO: 52605 - RNA, 19 nt, Homo sapiens
ugacgaggacagcuauauu

SEQ ID NO: 52606 - RNA, 19 nt, Homo sapiens
ggacgagugcuccaaggau

SEQ ID NO: 52607 - RNA, 19 nt, Homo sapiens
caacuacccagacgauuac

SEQ ID NO: 52608 - RNA, 19 nt, Homo sapiens
gagauggcuucuggaggaa

SEQ ID NO: 52609 - RNA, 19 nt, Homo sapiens
agaagaucauccugaacuu

SEQ ID NO: 52610 - RNA, 19 nt, Homo sapiens
cguaaguccuccaucaaag

SEQ ID NO: 52611 - RNA, 19 nt, Homo sapiens
cagcugugccuacgacuau

SEQ ID NO: 52612 - RNA, 19 nt, Homo sapiens
gagcuuccacaagacauuu

SEQ ID NO: 52613 - RNA, 19 nt, Homo sapiens
ucaacacccugggcagcua

SEQ ID NO: 52614 - RNA, 19 nt, Homo sapiens
acauugcccuggacgaaga

SEQ ID NO: 52615 - RNA, 19 nt, Homo sapiens
caaacucccugagccuauc

SEQ ID NO: 52616 - RNA, 19 nt, Homo sapiens
uauauuguguucaccuauc

SEQ ID NO: 52617 - RNA, 19 nt, Homo sapiens
cuucaaggcccacuucuuc

SEQ ID NO: 52618 - RNA, 19 nt, Homo sapiens
caacaugcgcguggaguuc

SEQ ID NO: 52619 - RNA, 19 nt, Homo sapiens
gcagagcuuccacaagaca

SEQ ID NO: 52620 - RNA, 19 nt, Homo sapiens
auaacucgguccagcgaaa

SEQ ID NO: 52621 - RNA, 19 nt, Homo sapiens
aagcacgacugcaaagaag

SEQ ID NO: 52622 - RNA, 19 nt, Homo sapiens
agccagggcaggaguauaa

SEQ ID NO: 52623 - RNA, 19 nt, Homo sapiens
gcuccagccucgauuuggu

SEQ ID NO: 52624 - RNA, 19 nt, Homo sapiens
gcaguuaugagugccaaug

SEQ ID NO: 52625 - RNA, 19 nt, Homo sapiens
ccgcaucucccugcaguuu

SEQ ID NO: 52626 - RNA, 19 nt, Homo sapiens
gacuauggccacauucaau

SEQ ID NO: 52627 - RNA, 19 nt, Homo sapiens
gggcuucuuugcagucuac

SEQ ID NO: 52628 - RNA, 19 nt, Homo sapiens
cagcagcaauuggguugga

SEQ ID NO: 52629 - RNA, 19 nt, Homo sapiens
agacagcacaggcaacuuc

SEQ ID NO: 52630 - RNA, 19 nt, Homo sapiens
gauacaccagcaccaaguu

SEQ ID NO: 52631 - RNA, 19 nt, Homo sapiens
cgacugcggcuaugacuac

SEQ ID NO: 52632 - RNA, 19 nt, Homo sapiens
ggacugugagugggucauu

SEQ ID NO: 52633 - RNA, 19 nt, Homo sapiens
caacacguucggcaguuau

SEQ ID NO: 52634 - RNA, 19 nt, Homo sapiens
ggcucaaguucgucucuga

SEQ ID NO: 52635 - RNA, 19 nt, Homo sapiens
gcgcuacuguggcuaugag

SEQ ID NO: 52636 - RNA, 19 nt, Homo sapiens
gggcauuauuuucauugua

SEQ ID NO: 52637 - RNA, 19 nt, Homo sapiens
acaacaagcacgacugcaa

SEQ ID NO: 52638 - RNA, 19 nt, Homo sapiens
gcccacuucuucucagaca

SEQ ID NO: 52639 - RNA, 19 nt, Homo sapiens
ggucauccccuuugucauu

SEQ ID NO: 52640 - RNA, 19 nt, Homo sapiens
ugacuucgacagcaucaug

SEQ ID NO: 52641 - RNA, 19 nt, Homo sapiens
ugaaguuccacucggauga

SEQ ID NO: 52642 - RNA, 19 nt, Homo sapiens
ucugacggguccauuaaca

SEQ ID NO: 52643 - RNA, 19 nt, Homo sapiens
gcagcaauuggguuggaaa

SEQ ID NO: 52644 - RNA, 19 nt, Homo sapiens
ccuaucgucuccacugaca

SEQ ID NO: 52645 - RNA, 19 nt, Homo sapiens
ccaaacucccugagccuau

SEQ ID NO: 52646 - RNA, 19 nt, Homo sapiens
gcaaugaugugugcaagua

SEQ ID NO: 52647 - RNA, 19 nt, Homo sapiens
gaagaaagagccuugaaga

SEQ ID NO: 52648 - RNA, 19 nt, Homo sapiens
ggacagcuauauuguguuc

SEQ ID NO: 52649 - RNA, 19 nt, Homo sapiens
gaggacagcuauauugugu

SEQ ID NO: 52650 - RNA, 19 nt, Homo sapiens
gggagaagaucauccugaa

SEQ ID NO: 52651 - RNA, 19 nt, Homo sapiens
ccaacuacccagacgauua

SEQ ID NO: 52652 - RNA, 19 nt, Homo sapiens
caucaaagcugcaguucca

SEQ ID NO: 52653 - RNA, 19 nt, Homo sapiens
gagcagcggugccucaaca

SEQ ID NO: 52654 - RNA, 19 nt, Homo sapiens
ggagagacccugcaagaca

SEQ ID NO: 52655 - RNA, 19 nt, Homo sapiens
gcucguaaguccuccauca

SEQ ID NO: 52656 - RNA, 19 nt, Homo sapiens
gcaucucccugcaguuuga

SEQ ID NO: 52657 - RNA, 19 nt, Homo sapiens
ccaagaaggagaagaaaga

SEQ ID NO: 52658 - RNA, 19 nt, Homo sapiens
gggcuuugccgucaacuuu

SEQ ID NO: 52659 - RNA, 19 nt, Homo sapiens
gcuaugagaagccugauga

SEQ ID NO: 52660 - RNA, 19 nt, Homo sapiens
aaaggacuauggccacauu

SEQ ID NO: 52661 - RNA, 19 nt, Homo sapiens
gcuauauuguguucaccua

SEQ ID NO: 52662 - RNA, 19 nt, Homo sapiens
gcacugacgaggacagcua

SEQ ID NO: 52663 - RNA, 19 nt, Homo sapiens
ugugggagauggagaggua

SEQ ID NO: 52664 - RNA, 19 nt, Homo sapiens
ggacauugcccuggacgaa

SEQ ID NO: 52665 - RNA, 19 nt, Homo sapiens
gcauuacgcucggaacaca

SEQ ID NO: 52666 - RNA, 19 nt, Homo sapiens
ggcaagaacugugacaagu

SEQ ID NO: 52667 - RNA, 19 nt, Homo sapiens
gacgaggacagcuauauug

SEQ ID NO: 52668 - RNA, 19 nt, Homo sapiens
caguuugacuucuuugaga

SEQ ID NO: 52669 - RNA, 19 nt, Homo sapiens
gagaagaucauccugaacu

SEQ ID NO: 52670 - RNA, 19 nt, Homo sapiens
gagaagaaagagccuugaa

SEQ ID NO: 52671 - RNA, 19 nt, Homo sapiens
caagcugcauggcaaguuc

SEQ ID NO: 52672 - RNA, 19 nt, Homo sapiens
ggacuauggccacauucaa

SEQ ID NO: 52673 - RNA, 19 nt, Homo sapiens
ugacggguccauuaacaaa

SEQ ID NO: 52674 - RNA, 19 nt, Homo sapiens
agacagagggcaaugaugu

SEQ ID NO: 52675 - RNA, 19 nt, Homo sapiens
uggcuacucugcucacaug

SEQ ID NO: 52676 - RNA, 19 nt, Homo sapiens
aaagagccuugaagaccuu

SEQ ID NO: 52677 - RNA, 19 nt, Homo sapiens
cauggcaaguucugugguu

SEQ ID NO: 52678 - RNA, 19 nt, Homo sapiens
ucacauuccaguccuuuga

SEQ ID NO: 52679 - RNA, 19 nt, Homo sapiens
ggucaucaccucccaguac

SEQ ID NO: 52680 - RNA, 19 nt, Homo sapiens
ccacgugggccucacauuc

SEQ ID NO: 52681 - RNA, 19 nt, Homo sapiens
guggagagacccugcaaga

SEQ ID NO: 52682 - RNA, 19 nt, Homo sapiens
cccgcaagcuuuacaagug

SEQ ID NO: 52683 - RNA, 19 nt, Homo sapiens
ugacgaggacagcuauauu

SEQ ID NO: 52684 - RNA, 19 nt, Homo sapiens
caacuacccagacgauuac

SEQ ID NO: 52685 - RNA, 19 nt, Homo sapiens
gagauggcuucuggaggaa

SEQ ID NO: 52686 - RNA, 19 nt, Homo sapiens
agaagaucauccugaacuu

SEQ ID NO: 52687 - RNA, 19 nt, Homo sapiens
cagcugugccuacgacuau

SEQ ID NO: 52688 - RNA, 19 nt, Homo sapiens
cguaaguccuccaucaaag

SEQ ID NO: 52689 - RNA, 19 nt, Homo sapiens
acauugcccuggacgaaga

SEQ ID NO: 52690 - RNA, 19 nt, Homo sapiens
ucaacacccugggcagcua

SEQ ID NO: 52691 - RNA, 19 nt, Homo sapiens
caaacucccugagccuauc

SEQ ID NO: 52692 - RNA, 19 nt, Homo sapiens
uauauuguguucaccuauc

SEQ ID NO: 52693 - RNA, 19 nt, Homo sapiens
ggagcuauuuggacuuuug

SEQ ID NO: 52694 - RNA, 19 nt, Homo sapiens
cuucaaggcccacuucuuc

SEQ ID NO: 52695 - RNA, 19 nt, Homo sapiens
caacaugcgcguggaguuc

SEQ ID NO: 52696 - RNA, 19 nt, Homo sapiens
caaauuccgagugcagaaa

SEQ ID NO: 52697 - RNA, 19 nt, Homo sapiens
agccagggcaggaguauaa

SEQ ID NO: 52698 - RNA, 19 nt, Homo sapiens
ccgcaucucccugcaguuu

SEQ ID NO: 52699 - RNA, 19 nt, Homo sapiens
gacuauggccacauucaau

SEQ ID NO: 52700 - RNA, 19 nt, Homo sapiens
gggcuucuuugcagucuac

SEQ ID NO: 52701 - RNA, 19 nt, Homo sapiens
cagcagcaauuggguugga

SEQ ID NO: 52702 - RNA, 19 nt, Homo sapiens
agacagcacaggcaacuuc

SEQ ID NO: 52703 - RNA, 19 nt, Homo sapiens
gcauuuggaccuguaggaa

SEQ ID NO: 52704 - RNA, 19 nt, Homo sapiens
ggagaagaaagagccuuga

SEQ ID NO: 52705 - RNA, 19 nt, Homo sapiens
gacccuaagccaagaagga

SEQ ID NO: 52706 - RNA, 19 nt, Homo sapiens
ggcucaaguucgucucuga

SEQ ID NO: 52707 - RNA, 19 nt, Homo sapiens
gcgcuacuguggcuaugag

SEQ ID NO: 52708 - RNA, 19 nt, Homo sapiens
ggucauccccuuugucauu

SEQ ID NO: 52709 - RNA, 19 nt, Homo sapiens
ugacuucgacagcaucaug

SEQ ID NO: 52710 - RNA, 19 nt, Homo sapiens
ucugacggguccauuaaca

SEQ ID NO: 52711 - RNA, 19 nt, Homo sapiens
gcagcaauuggguuggaaa

SEQ ID NO: 52712 - RNA, 19 nt, Homo sapiens
ccuaucgucuccacugaca

SEQ ID NO: 52713 - RNA, 19 nt, Homo sapiens
ccaaacucccugagccuau

SEQ ID NO: 52714 - RNA, 19 nt, Homo sapiens
gcaguuugacuucuuugag

SEQ ID NO: 52715 - RNA, 19 nt, Homo sapiens
ccugcaguuugacuucuuu

SEQ ID NO: 52716 - RNA, 19 nt, Homo sapiens
gcggauuccucaccaagcu

SEQ ID NO: 52717 - RNA, 19 nt, Homo sapiens
ucucugacggguccauuaa

SEQ ID NO: 52718 - RNA, 19 nt, Homo sapiens
gucaucaccucccaguaca

SEQ ID NO: 52719 - RNA, 19 nt, Homo sapiens
gcaucuuccuggauaccau

SEQ ID NO: 52720 - RNA, 19 nt, Homo sapiens
cauuuggaccuguaggaaa

SEQ ID NO: 52721 - RNA, 19 nt, Homo sapiens
aagccaagaaggagaagaa

SEQ ID NO: 52722 - RNA, 19 nt, Homo sapiens
ugugacaaguucggcauug

SEQ ID NO: 52723 - RNA, 19 nt, Homo sapiens
ucaaauuccgagugcagaa

SEQ ID NO: 52724 - RNA, 19 nt, Homo sapiens
caaggcccacuucuucuca

SEQ ID NO: 52725 - RNA, 19 nt, Homo sapiens
ucguaaguccuccaucaaa

SEQ ID NO: 52726 - RNA, 19 nt, Homo sapiens
cgaggacagcuauauugug

SEQ ID NO: 52727 - RNA, 19 nt, Homo sapiens
ggggagcuauuuggacuuu

SEQ ID NO: 52728 - RNA, 19 nt, Homo sapiens
ucaccucccaguacaacaa

SEQ ID NO: 52729 - RNA, 19 nt, Homo sapiens
gagaagcccgaggucauca

SEQ ID NO: 52730 - RNA, 19 nt, Homo sapiens
uccaguccuuugagauuga

SEQ ID NO: 52731 - RNA, 19 nt, Homo sapiens
ccuaugacuucgacagcau

SEQ ID NO: 52732 - RNA, 19 nt, Homo sapiens
ccgccacguuuccaucguu

SEQ ID NO: 52733 - RNA, 19 nt, Homo sapiens
gaguucaaguccgacaaca

SEQ ID NO: 52734 - RNA, 19 nt, Homo sapiens
gaggugcgcaguggacuca

SEQ ID NO: 52735 - RNA, 19 nt, Homo sapiens
gacagagggcaaugaugug

SEQ ID NO: 52736 - RNA, 19 nt, Homo sapiens
gagacagagggcaaugaug

SEQ ID NO: 52737 - RNA, 19 nt, Homo sapiens
gggugaaaccucccauugg

SEQ ID NO: 52738 - RNA, 19 nt, Homo sapiens
ugagacagagggcaaugau

SEQ ID NO: 52739 - RNA, 19 nt, Homo sapiens
caagacagcacaggcaacu

SEQ ID NO: 52740 - RNA, 19 nt, Homo sapiens
gcaaugaugugugcaagua

SEQ ID NO: 52741 - RNA, 19 nt, Homo sapiens
gaaauggccacacuuauga

SEQ ID NO: 52742 - RNA, 19 nt, Homo sapiens
ggacagcuauauuguguuc

SEQ ID NO: 52743 - RNA, 19 nt, Homo sapiens
gaggacagcuauauugugu

SEQ ID NO: 52744 - RNA, 19 nt, Homo sapiens
gggagaagaucauccugaa

SEQ ID NO: 52745 - RNA, 19 nt, Homo sapiens
gaccuuggccuguucauuu

SEQ ID NO: 52746 - RNA, 19 nt, Homo sapiens
ccaacuacccagacgauua

SEQ ID NO: 52747 - RNA, 19 nt, Homo sapiens
caucaaagcugcaguucca

SEQ ID NO: 52748 - RNA, 19 nt, Homo sapiens
gagcagcggugccucaaca

SEQ ID NO: 52749 - RNA, 19 nt, Homo sapiens
ggagagacccugcaagaca

SEQ ID NO: 52750 - RNA, 19 nt, Homo sapiens
gcucguaaguccuccauca

SEQ ID NO: 52751 - RNA, 19 nt, Homo sapiens
gcaucucccugcaguuuga

SEQ ID NO: 52752 - RNA, 19 nt, Homo sapiens
gggcuuugccgucaacuuu

SEQ ID NO: 52753 - RNA, 19 nt, Homo sapiens
gcuaugagaagccugauga

SEQ ID NO: 52754 - RNA, 19 nt, Homo sapiens
aaaggacuauggccacauu

SEQ ID NO: 52755 - RNA, 19 nt, Homo sapiens
gcuauauuguguucaccua

SEQ ID NO: 52756 - RNA, 19 nt, Homo sapiens
gcacugacgaggacagcua

SEQ ID NO: 52757 - RNA, 19 nt, Homo sapiens
ugugggagauggagaggua

SEQ ID NO: 52758 - RNA, 19 nt, Homo sapiens
ggacauugcccuggacgaa

SEQ ID NO: 52759 - RNA, 19 nt, Homo sapiens
gcauuacgcucggaacaca

SEQ ID NO: 52760 - RNA, 19 nt, Homo sapiens
ggcaagaacugugacaagu

SEQ ID NO: 52761 - RNA, 19 nt, Homo sapiens
gacgaggacagcuauauug

SEQ ID NO: 52762 - RNA, 19 nt, Homo sapiens
caguuugacuucuuugaga

SEQ ID NO: 52763 - RNA, 19 nt, Homo sapiens
gagaagaucauccugaacu

SEQ ID NO: 52764 - RNA, 19 nt, Homo sapiens
auagaaauggccacacuua

SEQ ID NO: 52765 - RNA, 19 nt, Homo sapiens
ggaggaccuuggccuguuc

SEQ ID NO: 52766 - RNA, 19 nt, Homo sapiens
agaaauggccacacuuaug

SEQ ID NO: 52767 - RNA, 19 nt, Homo sapiens
caagcugcauggcaaguuc

SEQ ID NO: 52768 - RNA, 19 nt, Homo sapiens
caucucagcccacaucuca

SEQ ID NO: 52769 - RNA, 19 nt, Homo sapiens
ggacuauggccacauucaa

SEQ ID NO: 52770 - RNA, 19 nt, Homo sapiens
ugacggguccauuaacaaa

SEQ ID NO: 52771 - RNA, 19 nt, Homo sapiens
agacagagggcaaugaugu

SEQ ID NO: 52772 - RNA, 19 nt, Homo sapiens
gcagagaagauagaaaugg

SEQ ID NO: 52773 - RNA, 19 nt, Homo sapiens
uggcuacucugcucacaug

SEQ ID NO: 52774 - RNA, 19 nt, Homo sapiens
cauggcaaguucugugguu

SEQ ID NO: 52775 - RNA, 19 nt, Homo sapiens
ucacauuccaguccuuuga

SEQ ID NO: 52776 - RNA, 19 nt, Homo sapiens
ggucaucaccucccaguac

SEQ ID NO: 52777 - RNA, 19 nt, Homo sapiens
ccacgugggccucacauuc

SEQ ID NO: 52778 - RNA, 19 nt, Homo sapiens
guggagagacccugcaaga

SEQ ID NO: 52779 - RNA, 19 nt, Homo sapiens
cccgcaagcuuuacaagug

SEQ ID NO: 52780 - RNA, 19 nt, Homo sapiens
ugacgaggacagcuauauu

SEQ ID NO: 52781 - RNA, 19 nt, Homo sapiens
caacuacccagacgauuac

SEQ ID NO: 52782 - RNA, 19 nt, Homo sapiens
gagauggcuucuggaggaa

SEQ ID NO: 52783 - RNA, 19 nt, Homo sapiens
agaagaucauccugaacuu

SEQ ID NO: 52784 - RNA, 19 nt, Homo sapiens
cagcugugccuacgacuau

SEQ ID NO: 52785 - RNA, 19 nt, Homo sapiens
cguaaguccuccaucaaag

SEQ ID NO: 52786 - RNA, 19 nt, Homo sapiens
acauugcccuggacgaaga

SEQ ID NO: 52787 - RNA, 19 nt, Homo sapiens
ucaacacccugggcagcua

SEQ ID NO: 52788 - RNA, 19 nt, Homo sapiens
caaacucccugagccuauc

SEQ ID NO: 52789 - RNA, 19 nt, Homo sapiens
uauauuguguucaccuauc

SEQ ID NO: 52790 - RNA, 19 nt, Homo sapiens
cuucaaggcccacuucuuc

SEQ ID NO: 52791 - RNA, 19 nt, Homo sapiens
caacaugcgcguggaguuc

SEQ ID NO: 52792 - RNA, 19 nt, Homo sapiens
caaauuccgagugcagaaa

SEQ ID NO: 52793 - RNA, 19 nt, Homo sapiens
agccagggcaggaguauaa

SEQ ID NO: 52794 - RNA, 19 nt, Homo sapiens
ccgcaucucccugcaguuu

SEQ ID NO: 52795 - RNA, 19 nt, Homo sapiens
gauagaaauggccacacuu

SEQ ID NO: 52796 - RNA, 19 nt, Homo sapiens
gacuauggccacauucaau

SEQ ID NO: 52797 - RNA, 19 nt, Homo sapiens
gggcuucuuugcagucuac

SEQ ID NO: 52798 - RNA, 19 nt, Homo sapiens
cagcagcaauuggguugga

SEQ ID NO: 52799 - RNA, 19 nt, Homo sapiens
agacagcacaggcaacuuc

SEQ ID NO: 52800 - RNA, 19 nt, Homo sapiens
ccacacuuaugaccccuua

SEQ ID NO: 52801 - RNA, 19 nt, Homo sapiens
ggcucaaguucgucucuga

SEQ ID NO: 52802 - RNA, 19 nt, Homo sapiens
gcgcuacuguggcuaugag

SEQ ID NO: 52803 - RNA, 19 nt, Homo sapiens
ggucauccccuuugucauu

SEQ ID NO: 52804 - RNA, 19 nt, Homo sapiens
ugacuucgacagcaucaug

SEQ ID NO: 52805 - RNA, 19 nt, Homo sapiens
ggaccuuggccuguucauu

SEQ ID NO: 52806 - RNA, 19 nt, Homo sapiens
ucugacggguccauuaaca

SEQ ID NO: 52807 - RNA, 19 nt, Homo sapiens
gcagcaauuggguuggaaa

SEQ ID NO: 52808 - RNA, 19 nt, Homo sapiens
ccuaucgucuccacugaca

SEQ ID NO: 52809 - RNA, 19 nt, Homo sapiens
ccaaacucccugagccuau

SEQ ID NO: 52810 - RNA, 19 nt, Homo sapiens
gcaguuugacuucuuugag

SEQ ID NO: 52811 - RNA, 19 nt, Homo sapiens
ccugcaguuugacuucuuu

SEQ ID NO: 52812 - RNA, 19 nt, Homo sapiens
gcggauuccucaccaagcu

SEQ ID NO: 52813 - RNA, 19 nt, Homo sapiens
uagaaauggccacacuuau

SEQ ID NO: 52814 - RNA, 19 nt, Homo sapiens
agauagaaauggccacacu

SEQ ID NO: 52815 - RNA, 19 nt, Homo sapiens
guguuaugaucuacagguu

SEQ ID NO: 52816 - RNA, 19 nt, Homo sapiens
ucucugacggguccauuaa

SEQ ID NO: 52817 - RNA, 19 nt, Homo sapiens
gucaucaccucccaguaca

SEQ ID NO: 52818 - RNA, 19 nt, Homo sapiens
ccuguucauuugcagagaa

SEQ ID NO: 52819 - RNA, 19 nt, Homo sapiens
uggaggaccuuggccuguu

SEQ ID NO: 52820 - RNA, 19 nt, Homo sapiens
uaauggcuccagcucacua

SEQ ID NO: 52821 - RNA, 19 nt, Homo sapiens
gacagcacuccgaggcuaa

SEQ ID NO: 52822 - RNA, 19 nt, Homo sapiens
gcaucuuccuggauaccau

SEQ ID NO: 52823 - RNA, 19 nt, Homo sapiens
caucuucuccuuacugcau

SEQ ID NO: 52824 - RNA, 19 nt, Homo sapiens
uugcagagaagauagaaau

SEQ ID NO: 52825 - RNA, 19 nt, Homo sapiens
ugugacaaguucggcauug

SEQ ID NO: 52826 - RNA, 19 nt, Homo sapiens
ucaaauuccgagugcagaa

SEQ ID NO: 52827 - RNA, 19 nt, Homo sapiens
caaggcccacuucuucuca

SEQ ID NO: 52828 - RNA, 19 nt, Homo sapiens
ucguaaguccuccaucaaa

SEQ ID NO: 52829 - RNA, 19 nt, Homo sapiens
ucaccucccaguacaacaa

SEQ ID NO: 52830 - RNA, 19 nt, Homo sapiens
cgaggacagcuauauugug

SEQ ID NO: 52831 - RNA, 19 nt, Homo sapiens
gagaagcccgaggucauca

SEQ ID NO: 52832 - RNA, 19 nt, Homo sapiens
uccaguccuuugagauuga

SEQ ID NO: 52833 - RNA, 19 nt, Homo sapiens
ccuaugacuucgacagcau

SEQ ID NO: 52834 - RNA, 19 nt, Homo sapiens
ccgccacguuuccaucguu

SEQ ID NO: 52835 - RNA, 19 nt, Homo sapiens
gaguucaaguccgacaaca

SEQ ID NO: 52836 - RNA, 19 nt, Homo sapiens
gaggugcgcaguggacuca

SEQ ID NO: 52837 - RNA, 19 nt, Homo sapiens
gacagagggcaaugaugug

SEQ ID NO: 52838 - RNA, 19 nt, Homo sapiens
gagacagagggcaaugaug

SEQ ID NO: 52839 - RNA, 19 nt, Homo sapiens
gggugaaaccucccauugg

SEQ ID NO: 52840 - RNA, 19 nt, Homo sapiens
gcaaugaugugugcaagua

SEQ ID NO: 52841 - RNA, 19 nt, Homo sapiens
ccagauagcugcauuacuc

SEQ ID NO: 52842 - RNA, 19 nt, Homo sapiens
ggacagcuauauuguguuc

SEQ ID NO: 52843 - RNA, 19 nt, Homo sapiens
gaggacagcuauauugugu

SEQ ID NO: 52844 - RNA, 19 nt, Homo sapiens
gggagaagaucauccugaa

SEQ ID NO: 52845 - RNA, 19 nt, Homo sapiens
ccaacuacccagacgauua

SEQ ID NO: 52846 - RNA, 19 nt, Homo sapiens
caucaaagcugcaguucca

SEQ ID NO: 52847 - RNA, 19 nt, Homo sapiens
gagcagcggugccucaaca

SEQ ID NO: 52848 - RNA, 19 nt, Homo sapiens
ggagagacccugcaagaca

SEQ ID NO: 52849 - RNA, 19 nt, Homo sapiens
gcucguaaguccuccauca

SEQ ID NO: 52850 - RNA, 19 nt, Homo sapiens
gcaucucccugcaguuuga

SEQ ID NO: 52851 - RNA, 19 nt, Homo sapiens
ccucagggcaggaguauaa

SEQ ID NO: 52852 - RNA, 19 nt, Homo sapiens
gggcuuugccgucaacuuu

SEQ ID NO: 52853 - RNA, 19 nt, Homo sapiens
gcuaugagaagccugauga

SEQ ID NO: 52854 - RNA, 19 nt, Homo sapiens
aaaggacuauggccacauu

SEQ ID NO: 52855 - RNA, 19 nt, Homo sapiens
gcuauauuguguucaccua

SEQ ID NO: 52856 - RNA, 19 nt, Homo sapiens
gcacugacgaggacagcua

SEQ ID NO: 52857 - RNA, 19 nt, Homo sapiens
ugugggagauggagaggua

SEQ ID NO: 52858 - RNA, 19 nt, Homo sapiens
ggacauugcccuggacgaa

SEQ ID NO: 52859 - RNA, 19 nt, Homo sapiens
gcauuacgcucggaacaca

SEQ ID NO: 52860 - RNA, 19 nt, Homo sapiens
ggcaagaacugugacaagu

SEQ ID NO: 52861 - RNA, 19 nt, Homo sapiens
gacgaggacagcuauauug

SEQ ID NO: 52862 - RNA, 19 nt, Homo sapiens
caguuugacuucuuugaga

SEQ ID NO: 52863 - RNA, 19 nt, Homo sapiens
gagaagaucauccugaacu

SEQ ID NO: 52864 - RNA, 19 nt, Homo sapiens
caagcugcauggcaaguuc

SEQ ID NO: 52865 - RNA, 19 nt, Homo sapiens
ggacuauggccacauucaa

SEQ ID NO: 52866 - RNA, 19 nt, Homo sapiens
caucauuagucccagauag

SEQ ID NO: 52867 - RNA, 19 nt, Homo sapiens
ugacggguccauuaacaaa

SEQ ID NO: 52868 - RNA, 19 nt, Homo sapiens
agacagagggcaaugaugu

SEQ ID NO: 52869 - RNA, 19 nt, Homo sapiens
uggcuacucugcucacaug

SEQ ID NO: 52870 - RNA, 19 nt, Homo sapiens
cauggcaaguucugugguu

SEQ ID NO: 52871 - RNA, 19 nt, Homo sapiens
ucacauuccaguccuuuga

SEQ ID NO: 52872 - RNA, 19 nt, Homo sapiens
ggucaucaccucccaguac

SEQ ID NO: 52873 - RNA, 19 nt, Homo sapiens
ccacgugggccucacauuc

SEQ ID NO: 52874 - RNA, 19 nt, Homo sapiens
guggagagacccugcaaga

SEQ ID NO: 52875 - RNA, 19 nt, Homo sapiens
cccgcaagcuuuacaagug

SEQ ID NO: 52876 - RNA, 19 nt, Homo sapiens
ugacgaggacagcuauauu

SEQ ID NO: 52877 - RNA, 19 nt, Homo sapiens
caacuacccagacgauuac

SEQ ID NO: 52878 - RNA, 19 nt, Homo sapiens
gagauggcuucuggaggaa

SEQ ID NO: 52879 - RNA, 19 nt, Homo sapiens
agaagaucauccugaacuu

SEQ ID NO: 52880 - RNA, 19 nt, Homo sapiens
cagcugugccuacgacuau

SEQ ID NO: 52881 - RNA, 19 nt, Homo sapiens
cguaaguccuccaucaaag

SEQ ID NO: 52882 - RNA, 19 nt, Homo sapiens
ucaacacccugggcagcua

SEQ ID NO: 52883 - RNA, 19 nt, Homo sapiens
acauugcccuggacgaaga

SEQ ID NO: 52884 - RNA, 19 nt, Homo sapiens
caaacucccugagccuauc

SEQ ID NO: 52885 - RNA, 19 nt, Homo sapiens
uauauuguguucaccuauc

SEQ ID NO: 52886 - RNA, 19 nt, Homo sapiens
cuucaaggcccacuucuuc

SEQ ID NO: 52887 - RNA, 19 nt, Homo sapiens
caacaugcgcguggaguuc

SEQ ID NO: 52888 - RNA, 19 nt, Homo sapiens
caaauuccgagugcagaaa

SEQ ID NO: 52889 - RNA, 19 nt, Homo sapiens
ccgcaucucccugcaguuu

SEQ ID NO: 52890 - RNA, 19 nt, Homo sapiens
gacuauggccacauucaau

SEQ ID NO: 52891 - RNA, 19 nt, Homo sapiens
gggcuucuuugcagucuac

SEQ ID NO: 52892 - RNA, 19 nt, Homo sapiens
cagcagcaauuggguugga

SEQ ID NO: 52893 - RNA, 19 nt, Homo sapiens
agacagcacaggcaacuuc

SEQ ID NO: 52894 - RNA, 19 nt, Homo sapiens
ggcucaaguucgucucuga

SEQ ID NO: 52895 - RNA, 19 nt, Homo sapiens
gcgcuacuguggcuaugag

SEQ ID NO: 52896 - RNA, 19 nt, Homo sapiens
uagcugcauuacucacuug

SEQ ID NO: 52897 - RNA, 19 nt, Homo sapiens
gugcuuccuucccauguuc

SEQ ID NO: 52898 - RNA, 19 nt, Homo sapiens
ggugcuuccuucccauguu

SEQ ID NO: 52899 - RNA, 19 nt, Homo sapiens
ucucagcuguggcucuaga

SEQ ID NO: 52900 - RNA, 19 nt, Homo sapiens
ugacuucgacagcaucaug

SEQ ID NO: 52901 - RNA, 19 nt, Homo sapiens
ggucauccccuuugucauu

SEQ ID NO: 52902 - RNA, 19 nt, Homo sapiens
ucugacggguccauuaaca

SEQ ID NO: 52903 - RNA, 19 nt, Homo sapiens
gcagcaauuggguuggaaa

SEQ ID NO: 52904 - RNA, 19 nt, Homo sapiens
ccuaucgucuccacugaca

SEQ ID NO: 52905 - RNA, 19 nt, Homo sapiens
ccaaacucccugagccuau

SEQ ID NO: 52906 - RNA, 19 nt, Homo sapiens
caacacuggccagggauga

SEQ ID NO: 52907 - RNA, 19 nt, Homo sapiens
gcaguuugacuucuuugag

SEQ ID NO: 52908 - RNA, 19 nt, Homo sapiens
ccugcaguuugacuucuuu

SEQ ID NO: 52909 - RNA, 19 nt, Homo sapiens
gcggauuccucaccaagcu

SEQ ID NO: 52910 - RNA, 19 nt, Homo sapiens
ucucugacggguccauuaa

SEQ ID NO: 52911 - RNA, 19 nt, Homo sapiens
cuucucagcuguggcucua

SEQ ID NO: 52912 - RNA, 19 nt, Homo sapiens
gucaucaccucccaguaca

SEQ ID NO: 52913 - RNA, 19 nt, Homo sapiens
gggaugacaaccugguaug

SEQ ID NO: 52914 - RNA, 19 nt, Homo sapiens
gcaucuuccuggauaccau

SEQ ID NO: 52915 - RNA, 19 nt, Homo sapiens
gcaucauuagucccagaua

SEQ ID NO: 52916 - RNA, 19 nt, Homo sapiens
cuagaaauggugcuuccuu

SEQ ID NO: 52917 - RNA, 19 nt, Homo sapiens
ugugacaaguucggcauug

SEQ ID NO: 52918 - RNA, 19 nt, Homo sapiens
ucaaauuccgagugcagaa

SEQ ID NO: 52919 - RNA, 19 nt, Homo sapiens
caaggcccacuucuucuca

SEQ ID NO: 52920 - RNA, 19 nt, Homo sapiens
ucguaaguccuccaucaaa

SEQ ID NO: 52921 - RNA, 19 nt, Homo sapiens
agcuguggcucuagaaaug

SEQ ID NO: 52922 - RNA, 19 nt, Homo sapiens
ucaccucccaguacaacaa

SEQ ID NO: 52923 - RNA, 19 nt, Homo sapiens
gagaagcccgaggucauca

SEQ ID NO: 52924 - RNA, 19 nt, Homo sapiens
uccaguccuuugagauuga

SEQ ID NO: 52925 - RNA, 19 nt, Homo sapiens
ccuaugacuucgacagcau

SEQ ID NO: 52926 - RNA, 19 nt, Homo sapiens
gccaggcguucuccacucu

SEQ ID NO: 52927 - RNA, 19 nt, Homo sapiens
ccgccacguuuccaucguu

SEQ ID NO: 52928 - RNA, 19 nt, Homo sapiens
cgaggacagcuauauugug

SEQ ID NO: 52929 - RNA, 19 nt, Homo sapiens
gaguucaaguccgacaaca

SEQ ID NO: 52930 - RNA, 19 nt, Homo sapiens
gaggugcgcaguggacuca

SEQ ID NO: 52931 - RNA, 19 nt, Homo sapiens
gacagagggcaaugaugug

SEQ ID NO: 52932 - RNA, 19 nt, Homo sapiens
gagacagagggcaaugaug

SEQ ID NO: 52933 - RNA, 19 nt, Homo sapiens
gggugaaaccucccauugg

SEQ ID NO: 52934 - RNA, 19 nt, Homo sapiens
caggcguucuccacucuuc

SEQ ID NO: 52935 - RNA, 19 nt, Homo sapiens
ugagacagagggcaaugau

SEQ ID NO: 52936 - RNA, 19 nt, Homo sapiens
caagacagcacaggcaacu

SEQ ID NO: 52937 - RNA, 19 nt, Homo sapiens
cagcuguggcucuagaaau

SEQ ID NO: 52938 - RNA, 19 nt, Homo sapiens
gaacacagcuggucacaga

SEQ ID NO: 52939 - RNA, 19 nt, Homo sapiens
caagagacauguuaggaua

SEQ ID NO: 52940 - RNA, 19 nt, Homo sapiens
gaacuugcagggagaauaa

SEQ ID NO: 52941 - RNA, 19 nt, Homo sapiens
ggacugcggucuccuaaag

SEQ ID NO: 52942 - RNA, 19 nt, Homo sapiens
caucugaacuccacuaauc

SEQ ID NO: 52943 - RNA, 19 nt, Homo sapiens
gcaagcaggugggaaaguu

SEQ ID NO: 52944 - RNA, 19 nt, Homo sapiens
cgacagaacucagugcuau

SEQ ID NO: 52945 - RNA, 19 nt, Homo sapiens
gaugcaagaugcuuuagga

SEQ ID NO: 52946 - RNA, 19 nt, Homo sapiens
ggccauugcuaguaacuuu

SEQ ID NO: 52947 - RNA, 19 nt, Homo sapiens
gcaagaugcuuuaggaaac

SEQ ID NO: 52948 - RNA, 19 nt, Homo sapiens
ggucaacucuguuaacucu

SEQ ID NO: 52949 - RNA, 19 nt, Homo sapiens
ucaacucuguuaacucuaa

SEQ ID NO: 52950 - RNA, 19 nt, Homo sapiens
cagcagagcuucagguuuu

SEQ ID NO: 52951 - RNA, 19 nt, Homo sapiens
gaaggaggaggcaaagaaa

SEQ ID NO: 52952 - RNA, 19 nt, Homo sapiens
caacagccaacucgaaauu

SEQ ID NO: 52953 - RNA, 19 nt, Homo sapiens
gauaaggccauugcuagua

SEQ ID NO: 52954 - RNA, 19 nt, Homo sapiens
cggagauucuucuuuaauu

SEQ ID NO: 52955 - RNA, 19 nt, Homo sapiens
guaagagacacccuuugua

SEQ ID NO: 52956 - RNA, 19 nt, Homo sapiens
acccggagauucuucuuua

SEQ ID NO: 52957 - RNA, 19 nt, Homo sapiens
ucuguuaacucuaagauuc

SEQ ID NO: 52958 - RNA, 19 nt, Homo sapiens
auaaggccauugcuaguaa

SEQ ID NO: 52959 - RNA, 19 nt, Homo sapiens
gaacagaugcaagaugcuu

SEQ ID NO: 52960 - RNA, 19 nt, Homo sapiens
ccacuaaucaugccauugu

SEQ ID NO: 52961 - RNA, 19 nt, Homo sapiens
aaacagcggaaacgccuua

SEQ ID NO: 52962 - RNA, 19 nt, Homo sapiens
ggucacagauaaggccauu

SEQ ID NO: 52963 - RNA, 19 nt, Homo sapiens
ccagguuggugaaucagaa

SEQ ID NO: 52964 - RNA, 19 nt, Homo sapiens
caagaugcuuuaggaaaca

SEQ ID NO: 52965 - RNA, 19 nt, Homo sapiens
gaacuaucaggacaugguu

SEQ ID NO: 52966 - RNA, 19 nt, Homo sapiens
aaagaacuaucaggacaug

SEQ ID NO: 52967 - RNA, 19 nt, Homo sapiens
gaagaacuaccagaaacga

SEQ ID NO: 52968 - RNA, 19 nt, Homo sapiens
uguggacgcucuuucaaug

SEQ ID NO: 52969 - RNA, 19 nt, Homo sapiens
uuccaucaccgaauuaaua

SEQ ID NO: 52970 - RNA, 19 nt, Homo sapiens
uaagagacacccuuuguac

SEQ ID NO: 52971 - RNA, 19 nt, Homo sapiens
acacagcuggucacagaua

SEQ ID NO: 52972 - RNA, 19 nt, Homo sapiens
agaaggaggaggcaaagaa

SEQ ID NO: 52973 - RNA, 19 nt, Homo sapiens
gggacccgcugucuucuag

SEQ ID NO: 52974 - RNA, 19 nt, Homo sapiens
ucucgaugcuguaccuuga

SEQ ID NO: 52975 - RNA, 19 nt, Homo sapiens
cgccuuaaguccagcugua

SEQ ID NO: 52976 - RNA, 19 nt, Homo sapiens
gggagaaggaggaggcaaa

SEQ ID NO: 52977 - RNA, 19 nt, Homo sapiens
gaucaucugaacuccacua

SEQ ID NO: 52978 - RNA, 19 nt, Homo sapiens
acagaugcaagaugcuuua

SEQ ID NO: 52979 - RNA, 19 nt, Homo sapiens
cacagcuggucacagauaa

SEQ ID NO: 52980 - RNA, 19 nt, Homo sapiens
caguuuccaucaccgaauu

SEQ ID NO: 52981 - RNA, 19 nt, Homo sapiens
aaacaaggugucuccaaga

SEQ ID NO: 52982 - RNA, 19 nt, Homo sapiens
uggaagaacuaccagaaac

SEQ ID NO: 52983 - RNA, 19 nt, Homo sapiens
gaaaacaacccggagauuc

SEQ ID NO: 52984 - RNA, 19 nt, Homo sapiens
gcuguaagagacacccuuu

SEQ ID NO: 52985 - RNA, 19 nt, Homo sapiens
acagauaaggccauugcua

SEQ ID NO: 52986 - RNA, 19 nt, Homo sapiens
gcuguaccuugacgagaau

SEQ ID NO: 52987 - RNA, 19 nt, Homo sapiens
aagcaggucuuugcaccaa

SEQ ID NO: 52988 - RNA, 19 nt, Homo sapiens
ccaagagacauguuaggau

SEQ ID NO: 52989 - RNA, 19 nt, Homo sapiens
caagcaggugggaaaguuu

SEQ ID NO: 52990 - RNA, 19 nt, Homo sapiens
cagcggaaacgccuuaagu

SEQ ID NO: 52991 - RNA, 19 nt, Homo sapiens
gcaacagccaacucgaaau

SEQ ID NO: 52992 - RNA, 19 nt, Homo sapiens
gaugcuuuaggaaacaaua

SEQ ID NO: 52993 - RNA, 19 nt, Homo sapiens
cagcauguucggccugaaa

SEQ ID NO: 52994 - RNA, 19 nt, Homo sapiens
gcuaguacagcaaaauuaa

SEQ ID NO: 52995 - RNA, 19 nt, Homo sapiens
uguaagagacacccuuugu

SEQ ID NO: 52996 - RNA, 19 nt, Homo sapiens
cgagaacagaugcaagaug

SEQ ID NO: 52997 - RNA, 19 nt, Homo sapiens
ccucaucccagcccucuga

SEQ ID NO: 52998 - RNA, 19 nt, Homo sapiens
ugcaagaugcuuuaggaaa

SEQ ID NO: 52999 - RNA, 19 nt, Homo sapiens
cccggagauucuucuuuaa

SEQ ID NO: 53000 - RNA, 19 nt, Homo sapiens
gcgcagcuuccaccaugaa

SEQ ID NO: 53001 - RNA, 19 nt, Homo sapiens
uggacgcucuuucaaugga

SEQ ID NO: 53002 - RNA, 19 nt, Homo sapiens
ggacacgccaaccauggau

SEQ ID NO: 53003 - RNA, 19 nt, Homo sapiens
caauagcaguuuccaucac

SEQ ID NO: 53004 - RNA, 19 nt, Homo sapiens
ugacgagaaugaaaagguu

SEQ ID NO: 53005 - RNA, 19 nt, Homo sapiens
ugcuguaccuugacgagaa

SEQ ID NO: 53006 - RNA, 19 nt, Homo sapiens
ugaacuugcagggagaaua

SEQ ID NO: 53007 - RNA, 19 nt, Homo sapiens
gaaacgagugggaaaacaa

SEQ ID NO: 53008 - RNA, 19 nt, Homo sapiens
ggaagaacuaccagaaacg

SEQ ID NO: 53009 - RNA, 19 nt, Homo sapiens
cuaaucaugccauuguuca

SEQ ID NO: 53010 - RNA, 19 nt, Homo sapiens
uaaguccagcuguaagaga

SEQ ID NO: 53011 - RNA, 19 nt, Homo sapiens
agagacauguuaggauaag

SEQ ID NO: 53012 - RNA, 19 nt, Homo sapiens
ccacuuggaggagaaacaa

SEQ ID NO: 53013 - RNA, 19 nt, Homo sapiens
gcaguuuccaucaccgaau

SEQ ID NO: 53014 - RNA, 19 nt, Homo sapiens
aaacaacccggagauucuu

SEQ ID NO: 53015 - RNA, 19 nt, Homo sapiens
ggagaaggaggaggcaaag

SEQ ID NO: 53016 - RNA, 19 nt, Homo sapiens
ccauguggacgcucuuuca

SEQ ID NO: 53017 - RNA, 19 nt, Homo sapiens
uaaagaacuaucaggacau

SEQ ID NO: 53018 - RNA, 19 nt, Homo sapiens
ucacagauaaggccauugc

SEQ ID NO: 53019 - RNA, 19 nt, Homo sapiens
gagaaggaggaggcaaaga

SEQ ID NO: 53020 - RNA, 19 nt, Homo sapiens
uuaggaaacaauagcaguu

SEQ ID NO: 53021 - RNA, 19 nt, Homo sapiens
ggaaaacaacccggagauu

SEQ ID NO: 53022 - RNA, 19 nt, Homo sapiens
gguugugggugucgcuagu

SEQ ID NO: 53023 - RNA, 19 nt, Homo sapiens
caacucuguuaacucuaag

SEQ ID NO: 53024 - RNA, 19 nt, Homo sapiens
aacaaggugucuccaagag

SEQ ID NO: 53025 - RNA, 19 nt, Homo sapiens
agaaacaaggugucuccaa

SEQ ID NO: 53026 - RNA, 19 nt, Homo sapiens
ugcaacagccaacucgaaa

SEQ ID NO: 53027 - RNA, 19 nt, Homo sapiens
ccugagcgaguucgaguug

SEQ ID NO: 53028 - RNA, 19 nt, Homo sapiens
acaauagcaguuuccauca

SEQ ID NO: 53029 - RNA, 19 nt, Homo sapiens
ccggagauucuucuuuaau

SEQ ID NO: 53030 - RNA, 19 nt, Homo sapiens
ccacggagaaugcccuuuu

SEQ ID NO: 53031 - RNA, 19 nt, Homo sapiens
aagagacauguuaggauaa

SEQ ID NO: 53032 - RNA, 19 nt, Homo sapiens
ggaaacacauucagauuga

SEQ ID NO: 53033 - RNA, 19 nt, Homo sapiens
gauauuggcuggagugaau

SEQ ID NO: 53034 - RNA, 19 nt, Homo sapiens
cagauaaccuggcaaagaa

SEQ ID NO: 53035 - RNA, 19 nt, Homo sapiens
gagcugcccuuuccauuga

SEQ ID NO: 53036 - RNA, 19 nt, Homo sapiens
gaauguagugcuuaaagua

SEQ ID NO: 53037 - RNA, 19 nt, Homo sapiens
gaaaagauguccucacuca

SEQ ID NO: 53038 - RNA, 19 nt, Homo sapiens
gaaaaggacuguauaucuu

SEQ ID NO: 53039 - RNA, 19 nt, Homo sapiens
gccagacgcuccaauuuga

SEQ ID NO: 53040 - RNA, 19 nt, Homo sapiens
caaggucucugaacacaug

SEQ ID NO: 53041 - RNA, 19 nt, Homo sapiens
gcagauaaccuggcaaaga

SEQ ID NO: 53042 - RNA, 19 nt, Homo sapiens
ggagaaagcaguggauuga

SEQ ID NO: 53043 - RNA, 19 nt, Homo sapiens
caacacgguucgcagcuuu

SEQ ID NO: 53044 - RNA, 19 nt, Homo sapiens
gggaagagcccaccuguca

SEQ ID NO: 53045 - RNA, 19 nt, Homo sapiens
agauaucacucaauucuug

SEQ ID NO: 53046 - RNA, 19 nt, Homo sapiens
ugacaucgcuaaccaaguc

SEQ ID NO: 53047 - RNA, 19 nt, Homo sapiens
uaaaguauacccuaacaug

SEQ ID NO: 53048 - RNA, 19 nt, Homo sapiens
gagagaaagccuuacaaga

SEQ ID NO: 53049 - RNA, 19 nt, Homo sapiens
caaaugggauagccacauc

SEQ ID NO: 53050 - RNA, 19 nt, Homo sapiens
gauuuaacauuacguccaa

SEQ ID NO: 53051 - RNA, 19 nt, Homo sapiens
gguagacuuugcagauauu

SEQ ID NO: 53052 - RNA, 19 nt, Homo sapiens
cuguauaucuucaaucuga

SEQ ID NO: 53053 - RNA, 19 nt, Homo sapiens
ggauugaaccucggaauug

SEQ ID NO: 53054 - RNA, 19 nt, Homo sapiens
gaggaaacacauucagauu

SEQ ID NO: 53055 - RNA, 19 nt, Homo sapiens
caaagaaaaugaagaguuc

SEQ ID NO: 53056 - RNA, 19 nt, Homo sapiens
gcauggacccucaaauuca

SEQ ID NO: 53057 - RNA, 19 nt, Homo sapiens
ggaauugcgccaggagaua

SEQ ID NO: 53058 - RNA, 19 nt, Homo sapiens
caucagagcugcccuuucc

SEQ ID NO: 53059 - RNA, 19 nt, Homo sapiens
ccucauaggauuuaacauu

SEQ ID NO: 53060 - RNA, 19 nt, Homo sapiens
gaaagaaaaggacuguaua

SEQ ID NO: 53061 - RNA, 19 nt, Homo sapiens
gggaggagagaaagccuua

SEQ ID NO: 53062 - RNA, 19 nt, Homo sapiens
aaaccaaagucaacuccuu

SEQ ID NO: 53063 - RNA, 19 nt, Homo sapiens
caagguagacuuugcagau

SEQ ID NO: 53064 - RNA, 19 nt, Homo sapiens
gucuugcgcuugcagauaa

SEQ ID NO: 53065 - RNA, 19 nt, Homo sapiens
gacaaggucucugaacaca

SEQ ID NO: 53066 - RNA, 19 nt, Homo sapiens
uguccuggcugucuaaaga

SEQ ID NO: 53067 - RNA, 19 nt, Homo sapiens
cagaaagugugguaucaag

SEQ ID NO: 53068 - RNA, 19 nt, Homo sapiens
aagauguccucacucagua

SEQ ID NO: 53069 - RNA, 19 nt, Homo sapiens
gacuguauaucuucaaucu

SEQ ID NO: 53070 - RNA, 19 nt, Homo sapiens
aagguagacuuugcagaua

SEQ ID NO: 53071 - RNA, 19 nt, Homo sapiens
ggccaucugucaguggaua

SEQ ID NO: 53072 - RNA, 19 nt, Homo sapiens
ggagagaaagccuuacaag

SEQ ID NO: 53073 - RNA, 19 nt, Homo sapiens
gccagaaagugugguauca

SEQ ID NO: 53074 - RNA, 19 nt, Homo sapiens
gaaacacauucagauugau

SEQ ID NO: 53075 - RNA, 19 nt, Homo sapiens
acacuguauuucuguauug

SEQ ID NO: 53076 - RNA, 19 nt, Homo sapiens
ggagagcuaggaaacauca

SEQ ID NO: 53077 - RNA, 19 nt, Homo sapiens
gcaacacgguucgcagcuu

SEQ ID NO: 53078 - RNA, 19 nt, Homo sapiens
uaacaugacaguagagucu

SEQ ID NO: 53079 - RNA, 19 nt, Homo sapiens
uccagagccuuauaucuug

SEQ ID NO: 53080 - RNA, 19 nt, Homo sapiens
gcucagaggaaacacauuc

SEQ ID NO: 53081 - RNA, 19 nt, Homo sapiens
aaaguauacccuaacauga

SEQ ID NO: 53082 - RNA, 19 nt, Homo sapiens
agagaaagccuuacaagac

SEQ ID NO: 53083 - RNA, 19 nt, Homo sapiens
ggacgccagcugccaaaga

SEQ ID NO: 53084 - RNA, 19 nt, Homo sapiens
cagcagaaacucuugaaag

SEQ ID NO: 53085 - RNA, 19 nt, Homo sapiens
guccuuugaugccuauuau

SEQ ID NO: 53086 - RNA, 19 nt, Homo sapiens
caaguccuuugaugccuau

SEQ ID NO: 53087 - RNA, 19 nt, Homo sapiens
agaaagcaguggauugaac

SEQ ID NO: 53088 - RNA, 19 nt, Homo sapiens
caguggauauggccaaauc

SEQ ID NO: 53089 - RNA, 19 nt, Homo sapiens
cugcauggacccucaaauu

SEQ ID NO: 53090 - RNA, 19 nt, Homo sapiens
agaauguagugcuuaaagu

SEQ ID NO: 53091 - RNA, 19 nt, Homo sapiens
aaagauguccucacucagu

SEQ ID NO: 53092 - RNA, 19 nt, Homo sapiens
caucaaaucaugcuaccau

SEQ ID NO: 53093 - RNA, 19 nt, Homo sapiens
gaaagugugguaucaagcu

SEQ ID NO: 53094 - RNA, 19 nt, Homo sapiens
gcagcagaaacucuugaaa

SEQ ID NO: 53095 - RNA, 19 nt, Homo sapiens
cagcagaaaccaaagucaa

SEQ ID NO: 53096 - RNA, 19 nt, Homo sapiens
aaauucagcagaaaccaaa

SEQ ID NO: 53097 - RNA, 19 nt, Homo sapiens
caaauucagcagaaaccaa

SEQ ID NO: 53098 - RNA, 19 nt, Homo sapiens
gacgccagcugccaaagag

SEQ ID NO: 53099 - RNA, 19 nt, Homo sapiens
aaaggacuguauaucuuca

SEQ ID NO: 53100 - RNA, 19 nt, Homo sapiens
cacacuguauuucuguauu

SEQ ID NO: 53101 - RNA, 19 nt, Homo sapiens
gauugaaccucggaauugc

SEQ ID NO: 53102 - RNA, 19 nt, Homo sapiens
gaggagagaaagccuuaca

SEQ ID NO: 53103 - RNA, 19 nt, Homo sapiens
cuuaaaguauacccuaaca

SEQ ID NO: 53104 - RNA, 19 nt, Homo sapiens
caugcuaccauccagagua

SEQ ID NO: 53105 - RNA, 19 nt, Homo sapiens
uuacagggacaccggaauu

SEQ ID NO: 53106 - RNA, 19 nt, Homo sapiens
gaccuacagcucuuucuca

SEQ ID NO: 53107 - RNA, 19 nt, Homo sapiens
uggagugaauggauuaucu

SEQ ID NO: 53108 - RNA, 19 nt, Homo sapiens
uggcuggagugaauggauu

SEQ ID NO: 53109 - RNA, 19 nt, Homo sapiens
gagaaagcaguggauugaa

SEQ ID NO: 53110 - RNA, 19 nt, Homo sapiens
aaucugacaucgcuaacca

SEQ ID NO: 53111 - RNA, 19 nt, Homo sapiens
ccauugagcggaggaagaa

SEQ ID NO: 53112 - RNA, 19 nt, Homo sapiens
ggauauggccaaaucucau

SEQ ID NO: 53113 - RNA, 19 nt, Homo sapiens
cagaggaaacacauucaga

SEQ ID NO: 53114 - RNA, 19 nt, Homo sapiens
cagcugguuuggaguucaa

SEQ ID NO: 53115 - RNA, 19 nt, Homo sapiens
cauccagaguauagugaga

SEQ ID NO: 53116 - RNA, 19 nt, Homo sapiens
ccuuugaugccuauuauug

SEQ ID NO: 53117 - RNA, 19 nt, Homo sapiens
gauauggccaaaucucauc

SEQ ID NO: 53118 - RNA, 19 nt, Homo sapiens
gccacacuguauuucugua

SEQ ID NO: 53119 - RNA, 19 nt, Homo sapiens
aaagugugguaucaagcuu

SEQ ID NO: 53120 - RNA, 19 nt, Homo sapiens
aggaaacacauucagauug

SEQ ID NO: 53121 - RNA, 19 nt, Homo sapiens
gauguccucacucaguauu

SEQ ID NO: 53122 - RNA, 19 nt, Homo sapiens
gcuaccauccagaguauag

SEQ ID NO: 53123 - RNA, 19 nt, Homo sapiens
aaccaagucugaaaacauu

SEQ ID NO: 53124 - RNA, 19 nt, Homo sapiens
cagaaaagauguccucacu

SEQ ID NO: 53125 - RNA, 19 nt, Homo sapiens
uuccagagccuuauaucuu

SEQ ID NO: 53126 - RNA, 19 nt, Homo sapiens
gaggaaggccaaagaaaau

SEQ ID NO: 53127 - RNA, 19 nt, Homo sapiens
gucuaaagauaucacucaa

SEQ ID NO: 53128 - RNA, 19 nt, Homo sapiens
caaaucaugcuaccaucca

SEQ ID NO: 53129 - RNA, 19 nt, Homo sapiens
acaugacaguagagucuug

SEQ ID NO: 53130 - RNA, 19 nt, Homo sapiens
agguagacuuugcagauau

SEQ ID NO: 53131 - RNA, 19 nt, Homo sapiens
gaauugcgccaggagauac

SEQ ID NO: 53132 - RNA, 19 nt, Homo sapiens
caagaaucauggacuguua

SEQ ID NO: 53133 - RNA, 19 nt, Homo sapiens
gcaaguuuguucaagauug

SEQ ID NO: 53134 - RNA, 19 nt, Homo sapiens
gagccaugcuaguuugaua

SEQ ID NO: 53135 - RNA, 19 nt, Homo sapiens
gggagaagcagccaaacua

SEQ ID NO: 53136 - RNA, 19 nt, Homo sapiens
gaaagaggaggaaggaaga

SEQ ID NO: 53137 - RNA, 19 nt, Homo sapiens
ggaagaagaauaagaacug

SEQ ID NO: 53138 - RNA, 19 nt, Homo sapiens
gcacuggucuugaguaucc

SEQ ID NO: 53139 - RNA, 19 nt, Homo sapiens
ccuuauagcuggacuuuua

SEQ ID NO: 53140 - RNA, 19 nt, Homo sapiens
aagauuggcugucaagaau

SEQ ID NO: 53141 - RNA, 19 nt, Homo sapiens
uagcaagagugccgucauu

SEQ ID NO: 53142 - RNA, 19 nt, Homo sapiens
ccaggaagaagaauaagaa

SEQ ID NO: 53143 - RNA, 19 nt, Homo sapiens
ccacagcacuggucuugag

SEQ ID NO: 53144 - RNA, 19 nt, Homo sapiens
cgacacuucugcagauguu

SEQ ID NO: 53145 - RNA, 19 nt, Homo sapiens
caagauuggcugucaagaa

SEQ ID NO: 53146 - RNA, 19 nt, Homo sapiens
ccagcaaguuuguucaaga

SEQ ID NO: 53147 - RNA, 19 nt, Homo sapiens
ggaggaggaaggaaagaaa

SEQ ID NO: 53148 - RNA, 19 nt, Homo sapiens
uacacagacugcuuccuua

SEQ ID NO: 53149 - RNA, 19 nt, Homo sapiens
gaugugggcuggaaugacu

SEQ ID NO: 53150 - RNA, 19 nt, Homo sapiens
gggcuggaaugacuggauu

SEQ ID NO: 53151 - RNA, 19 nt, Homo sapiens
gacuuuacgugcaaauguu

SEQ ID NO: 53152 - RNA, 19 nt, Homo sapiens
gaggauagacagauauaca

SEQ ID NO: 53153 - RNA, 19 nt, Homo sapiens
acagacugcuuccuuauag

SEQ ID NO: 53154 - RNA, 19 nt, Homo sapiens
ggagaagcagccaaacuau

SEQ ID NO: 53155 - RNA, 19 nt, Homo sapiens
aagaacaucuggagaacau

SEQ ID NO: 53156 - RNA, 19 nt, Homo sapiens
cagcaaguuuguucaagau

SEQ ID NO: 53157 - RNA, 19 nt, Homo sapiens
cauggacuguuauuauaug

SEQ ID NO: 53158 - RNA, 19 nt, Homo sapiens
gaggaaggaaagaaagaaa

SEQ ID NO: 53159 - RNA, 19 nt, Homo sapiens
gaaucauggacuguuauua

SEQ ID NO: 53160 - RNA, 19 nt, Homo sapiens
gggccaggaagaagaauaa

SEQ ID NO: 53161 - RNA, 19 nt, Homo sapiens
cagcacuggucuugaguau

SEQ ID NO: 53162 - RNA, 19 nt, Homo sapiens
caaccaaccaugccauugu

SEQ ID NO: 53163 - RNA, 19 nt, Homo sapiens
gagaagcagccaaacuaug

SEQ ID NO: 53164 - RNA, 19 nt, Homo sapiens
gcgcgagccaugcuaguuu

SEQ ID NO: 53165 - RNA, 19 nt, Homo sapiens
accuugaccuuauuuauga

SEQ ID NO: 53166 - RNA, 19 nt, Homo sapiens
ggaggaaggaaagaaagaa

SEQ ID NO: 53167 - RNA, 19 nt, Homo sapiens
gcugauggucguuuuauua

SEQ ID NO: 53168 - RNA, 19 nt, Homo sapiens
ggaaggaagaugcgagaag

SEQ ID NO: 53169 - RNA, 19 nt, Homo sapiens
caaguuuguucaagauugg

SEQ ID NO: 53170 - RNA, 19 nt, Homo sapiens
guagugccaucccgagcaa

SEQ ID NO: 53171 - RNA, 19 nt, Homo sapiens
gauauacacaccacacaca

SEQ ID NO: 53172 - RNA, 19 nt, Homo sapiens
ccuugaggauagacagaua

SEQ ID NO: 53173 - RNA, 19 nt, Homo sapiens
gagaucaggcaguccuuga

SEQ ID NO: 53174 - RNA, 19 nt, Homo sapiens
acauucaccuugaccuuau

SEQ ID NO: 53175 - RNA, 19 nt, Homo sapiens
ggauucccguccaagcuau

SEQ ID NO: 53176 - RNA, 19 nt, Homo sapiens
guaccuggaugaguaugau

SEQ ID NO: 53177 - RNA, 19 nt, Homo sapiens
gggccagcaugucaggauu

SEQ ID NO: 53178 - RNA, 19 nt, Homo sapiens
cacagacugcuuccuuaua

SEQ ID NO: 53179 - RNA, 19 nt, Homo sapiens
cuacacagacugcuuccuu

SEQ ID NO: 53180 - RNA, 19 nt, Homo sapiens
ggccagcaugucaggauua

SEQ ID NO: 53181 - RNA, 19 nt, Homo sapiens
ugcuguaccuggaugagua

SEQ ID NO: 53182 - RNA, 19 nt, Homo sapiens
cgaagaacaucuggagaac

SEQ ID NO: 53183 - RNA, 19 nt, Homo sapiens
gcccuaagcaucacucaca

SEQ ID NO: 53184 - RNA, 19 nt, Homo sapiens
ggaagaggaggaggaagga

SEQ ID NO: 53185 - RNA, 19 nt, Homo sapiens
gcagcuucccugagccuuu

SEQ ID NO: 53186 - RNA, 19 nt, Homo sapiens
gagccuuuccagcaaguuu

SEQ ID NO: 53187 - RNA, 19 nt, Homo sapiens
caccuugaccuuauuuaug

SEQ ID NO: 53188 - RNA, 19 nt, Homo sapiens
augauaaggugguacugaa

SEQ ID NO: 53189 - RNA, 19 nt, Homo sapiens
caggauuagccgaucguua

SEQ ID NO: 53190 - RNA, 19 nt, Homo sapiens
ugacacggugggaaacuuu

SEQ ID NO: 53191 - RNA, 19 nt, Homo sapiens
cccuaaacauucaccuuga

SEQ ID NO: 53192 - RNA, 19 nt, Homo sapiens
ggauagacagauauacaca

SEQ ID NO: 53193 - RNA, 19 nt, Homo sapiens
ccuguugugugcccacuga

SEQ ID NO: 53194 - RNA, 19 nt, Homo sapiens
gaagaacaucuggagaaca

SEQ ID NO: 53195 - RNA, 19 nt, Homo sapiens
ugaguaugauaagguggua

SEQ ID NO: 53196 - RNA, 19 nt, Homo sapiens
agaagcagccaaacuaugg

SEQ ID NO: 53197 - RNA, 19 nt, Homo sapiens
gaucuuuaccggcuucagu

SEQ ID NO: 53198 - RNA, 19 nt, Homo sapiens
guucaagauuggcugucaa

SEQ ID NO: 53199 - RNA, 19 nt, Homo sapiens
agaaagcgagggagggaaa

SEQ ID NO: 53200 - RNA, 19 nt, Homo sapiens
ugacuuuacgugcaaaugu

SEQ ID NO: 53201 - RNA, 19 nt, Homo sapiens
acgaagaacaucuggagaa

SEQ ID NO: 53202 - RNA, 19 nt, Homo sapiens
ggaaggaaagaaagaaagc

SEQ ID NO: 53203 - RNA, 19 nt, Homo sapiens
cagcuucccugagccuuuc

SEQ ID NO: 53204 - RNA, 19 nt, Homo sapiens
ccuggucaauucugucaau

SEQ ID NO: 53205 - RNA, 19 nt, Homo sapiens
cugaguaucuagcuugucu

SEQ ID NO: 53206 - RNA, 19 nt, Homo sapiens
ucaccuugaccuuauuuau

SEQ ID NO: 53207 - RNA, 19 nt, Homo sapiens
ggucaccuuuggccaugau

SEQ ID NO: 53208 - RNA, 19 nt, Homo sapiens
gcuuuucguuuccucuuua

SEQ ID NO: 53209 - RNA, 19 nt, Homo sapiens
gaggagcuuccaccacgaa

SEQ ID NO: 53210 - RNA, 19 nt, Homo sapiens
aaacauucaccuugaccuu

SEQ ID NO: 53211 - RNA, 19 nt, Homo sapiens
gaaugcugauggucguuuu

SEQ ID NO: 53212 - RNA, 19 nt, Homo sapiens
ucaagaaucauggacuguu

SEQ ID NO: 53213 - RNA, 19 nt, Homo sapiens
acacacacguucccaucca

SEQ ID NO: 53214 - RNA, 19 nt, Homo sapiens
cacacacacacaccacaua

SEQ ID NO: 53215 - RNA, 19 nt, Homo sapiens
ggacuucgaggcgacacuu

SEQ ID NO: 53216 - RNA, 19 nt, Homo sapiens
gaagaggaggaggaaggaa

SEQ ID NO: 53217 - RNA, 19 nt, Homo sapiens
aacauucaccuugaccuua

SEQ ID NO: 53218 - RNA, 19 nt, Homo sapiens
gauaaggugguacugaaaa

SEQ ID NO: 53219 - RNA, 19 nt, Homo sapiens
ugauaaggugguacugaaa

SEQ ID NO: 53220 - RNA, 19 nt, Homo sapiens
gccaggaagaagaauaaga

SEQ ID NO: 53221 - RNA, 19 nt, Homo sapiens
caccagggccagcauguca

SEQ ID NO: 53222 - RNA, 19 nt, Homo sapiens
aagaggaggaggaaggaaa

SEQ ID NO: 53223 - RNA, 19 nt, Homo sapiens
uuuaugacuuuacgugcaa

SEQ ID NO: 53224 - RNA, 19 nt, Homo sapiens
acacagacugcuuccuuau

SEQ ID NO: 53225 - RNA, 19 nt, Homo sapiens
aaccaaccaugccauugug

SEQ ID NO: 53226 - RNA, 19 nt, Homo sapiens
gcaccucaucacacgacua

SEQ ID NO: 53227 - RNA, 19 nt, Homo sapiens
gaggaggaaggaaagaaag

SEQ ID NO: 53228 - RNA, 19 nt, Homo sapiens
gugacacggugggaaacuu

SEQ ID NO: 53229 - RNA, 19 nt, Homo sapiens
aggcgacacuucugcagau

SEQ ID NO: 53230 - RNA, 19 nt, Homo sapiens
guaaccgaaugcugauggu

SEQ ID NO: 53231 - RNA, 19 nt, Homo sapiens
ccacucacccacacacuac

SEQ ID NO: 53232 - RNA, 19 nt, Homo sapiens
caagaaucauggacuguua

SEQ ID NO: 53233 - RNA, 19 nt, Homo sapiens
gcaaguuuguucaagauug

SEQ ID NO: 53234 - RNA, 19 nt, Homo sapiens
gagccaugcuaguuugaua

SEQ ID NO: 53235 - RNA, 19 nt, Homo sapiens
gggagaagcagccaaacua

SEQ ID NO: 53236 - RNA, 19 nt, Homo sapiens
gaaagaggaggaaggaaga

SEQ ID NO: 53237 - RNA, 19 nt, Homo sapiens
ggaagaagaauaagaacug

SEQ ID NO: 53238 - RNA, 19 nt, Homo sapiens
gcacuggucuugaguaucc

SEQ ID NO: 53239 - RNA, 19 nt, Homo sapiens
ccuuauagcuggacuuuua

SEQ ID NO: 53240 - RNA, 19 nt, Homo sapiens
aagauuggcugucaagaau

SEQ ID NO: 53241 - RNA, 19 nt, Homo sapiens
uagcaagagugccgucauu

SEQ ID NO: 53242 - RNA, 19 nt, Homo sapiens
ccaggaagaagaauaagaa

SEQ ID NO: 53243 - RNA, 19 nt, Homo sapiens
ccacagcacuggucuugag

SEQ ID NO: 53244 - RNA, 19 nt, Homo sapiens
cgacacuucugcagauguu

SEQ ID NO: 53245 - RNA, 19 nt, Homo sapiens
caagauuggcugucaagaa

SEQ ID NO: 53246 - RNA, 19 nt, Homo sapiens
ccagcaaguuuguucaaga

SEQ ID NO: 53247 - RNA, 19 nt, Homo sapiens
ggaggaggaaggaaagaaa

SEQ ID NO: 53248 - RNA, 19 nt, Homo sapiens
uacacagacugcuuccuua

SEQ ID NO: 53249 - RNA, 19 nt, Homo sapiens
gaugugggcuggaaugacu

SEQ ID NO: 53250 - RNA, 19 nt, Homo sapiens
gggcuggaaugacuggauu

SEQ ID NO: 53251 - RNA, 19 nt, Homo sapiens
gacuuuacgugcaaauguu

SEQ ID NO: 53252 - RNA, 19 nt, Homo sapiens
gaggauagacagauauaca

SEQ ID NO: 53253 - RNA, 19 nt, Homo sapiens
acagacugcuuccuuauag

SEQ ID NO: 53254 - RNA, 19 nt, Homo sapiens
ggagaagcagccaaacuau

SEQ ID NO: 53255 - RNA, 19 nt, Homo sapiens
aagaacaucuggagaacau

SEQ ID NO: 53256 - RNA, 19 nt, Homo sapiens
cagcaaguuuguucaagau

SEQ ID NO: 53257 - RNA, 19 nt, Homo sapiens
cauggacuguuauuauaug

SEQ ID NO: 53258 - RNA, 19 nt, Homo sapiens
gaggaaggaaagaaagaaa

SEQ ID NO: 53259 - RNA, 19 nt, Homo sapiens
gaaucauggacuguuauua

SEQ ID NO: 53260 - RNA, 19 nt, Homo sapiens
gggccaggaagaagaauaa

SEQ ID NO: 53261 - RNA, 19 nt, Homo sapiens
cagcacuggucuugaguau

SEQ ID NO: 53262 - RNA, 19 nt, Homo sapiens
caaccaaccaugccauugu

SEQ ID NO: 53263 - RNA, 19 nt, Homo sapiens
gagaagcagccaaacuaug

SEQ ID NO: 53264 - RNA, 19 nt, Homo sapiens
gcgcgagccaugcuaguuu

SEQ ID NO: 53265 - RNA, 19 nt, Homo sapiens
accuugaccuuauuuauga

SEQ ID NO: 53266 - RNA, 19 nt, Homo sapiens
guagugccaucccgagcaa

SEQ ID NO: 53267 - RNA, 19 nt, Homo sapiens
ggaggaaggaaagaaagaa

SEQ ID NO: 53268 - RNA, 19 nt, Homo sapiens
gcugauggucguuuuauua

SEQ ID NO: 53269 - RNA, 19 nt, Homo sapiens
ggaaggaagaugcgagaag

SEQ ID NO: 53270 - RNA, 19 nt, Homo sapiens
caaguuuguucaagauugg

SEQ ID NO: 53271 - RNA, 19 nt, Homo sapiens
gauauacacaccacacaca

SEQ ID NO: 53272 - RNA, 19 nt, Homo sapiens
ccuugaggauagacagaua

SEQ ID NO: 53273 - RNA, 19 nt, Homo sapiens
gagaucaggcaguccuuga

SEQ ID NO: 53274 - RNA, 19 nt, Homo sapiens
acauucaccuugaccuuau

SEQ ID NO: 53275 - RNA, 19 nt, Homo sapiens
guaccuggaugaguaugau

SEQ ID NO: 53276 - RNA, 19 nt, Homo sapiens
gggccagcaugucaggauu

SEQ ID NO: 53277 - RNA, 19 nt, Homo sapiens
cacagacugcuuccuuaua

SEQ ID NO: 53278 - RNA, 19 nt, Homo sapiens
cuacacagacugcuuccuu

SEQ ID NO: 53279 - RNA, 19 nt, Homo sapiens
ggccagcaugucaggauua

SEQ ID NO: 53280 - RNA, 19 nt, Homo sapiens
uaggagccauuccguagug

SEQ ID NO: 53281 - RNA, 19 nt, Homo sapiens
ugcuguaccuggaugagua

SEQ ID NO: 53282 - RNA, 19 nt, Homo sapiens
cgaagaacaucuggagaac

SEQ ID NO: 53283 - RNA, 19 nt, Homo sapiens
ggaagaggaggaggaagga

SEQ ID NO: 53284 - RNA, 19 nt, Homo sapiens
gcccuaagcaucacucaca

SEQ ID NO: 53285 - RNA, 19 nt, Homo sapiens
gcagcuucccugagccuuu

SEQ ID NO: 53286 - RNA, 19 nt, Homo sapiens
gagccuuuccagcaaguuu

SEQ ID NO: 53287 - RNA, 19 nt, Homo sapiens
caccuugaccuuauuuaug

SEQ ID NO: 53288 - RNA, 19 nt, Homo sapiens
augauaaggugguacugaa

SEQ ID NO: 53289 - RNA, 19 nt, Homo sapiens
caggauuagccgaucguua

SEQ ID NO: 53290 - RNA, 19 nt, Homo sapiens
ugacacggugggaaacuuu

SEQ ID NO: 53291 - RNA, 19 nt, Homo sapiens
cccuaaacauucaccuuga

SEQ ID NO: 53292 - RNA, 19 nt, Homo sapiens
ggauagacagauauacaca

SEQ ID NO: 53293 - RNA, 19 nt, Homo sapiens
ccuguugugugcccacuga

SEQ ID NO: 53294 - RNA, 19 nt, Homo sapiens
gaagaacaucuggagaaca

SEQ ID NO: 53295 - RNA, 19 nt, Homo sapiens
agaaagcgagggagggaaa

SEQ ID NO: 53296 - RNA, 19 nt, Homo sapiens
ugaguaugauaagguggua

SEQ ID NO: 53297 - RNA, 19 nt, Homo sapiens
guucaagauuggcugucaa

SEQ ID NO: 53298 - RNA, 19 nt, Homo sapiens
agaagcagccaaacuaugg

SEQ ID NO: 53299 - RNA, 19 nt, Homo sapiens
gaucuuuaccggcuucagu

SEQ ID NO: 53300 - RNA, 19 nt, Homo sapiens
ugacuuuacgugcaaaugu

SEQ ID NO: 53301 - RNA, 19 nt, Homo sapiens
ggaaggaaagaaagaaagc

SEQ ID NO: 53302 - RNA, 19 nt, Homo sapiens
acgaagaacaucuggagaa

SEQ ID NO: 53303 - RNA, 19 nt, Homo sapiens
cagcuucccugagccuuuc

SEQ ID NO: 53304 - RNA, 19 nt, Homo sapiens
ccuggucaauucugucaau

SEQ ID NO: 53305 - RNA, 19 nt, Homo sapiens
ucaccuugaccuuauuuau

SEQ ID NO: 53306 - RNA, 19 nt, Homo sapiens
ggucaccuuuggccaugau

SEQ ID NO: 53307 - RNA, 19 nt, Homo sapiens
gcuuuucguuuccucuuua

SEQ ID NO: 53308 - RNA, 19 nt, Homo sapiens
gaggagcuuccaccacgaa

SEQ ID NO: 53309 - RNA, 19 nt, Homo sapiens
aaacauucaccuugaccuu

SEQ ID NO: 53310 - RNA, 19 nt, Homo sapiens
ucaagaaucauggacuguu

SEQ ID NO: 53311 - RNA, 19 nt, Homo sapiens
gaaugcugauggucguuuu

SEQ ID NO: 53312 - RNA, 19 nt, Homo sapiens
acacacacguucccaucca

SEQ ID NO: 53313 - RNA, 19 nt, Homo sapiens
cacacacacacaccacaua

SEQ ID NO: 53314 - RNA, 19 nt, Homo sapiens
ggacuucgaggcgacacuu

SEQ ID NO: 53315 - RNA, 19 nt, Homo sapiens
gaagaggaggaggaaggaa

SEQ ID NO: 53316 - RNA, 19 nt, Homo sapiens
aacauucaccuugaccuua

SEQ ID NO: 53317 - RNA, 19 nt, Homo sapiens
gauaaggugguacugaaaa

SEQ ID NO: 53318 - RNA, 19 nt, Homo sapiens
ugauaaggugguacugaaa

SEQ ID NO: 53319 - RNA, 19 nt, Homo sapiens
gccaggaagaagaauaaga

SEQ ID NO: 53320 - RNA, 19 nt, Homo sapiens
caccagggccagcauguca

SEQ ID NO: 53321 - RNA, 19 nt, Homo sapiens
aagaggaggaggaaggaaa

SEQ ID NO: 53322 - RNA, 19 nt, Homo sapiens
uuuaugacuuuacgugcaa

SEQ ID NO: 53323 - RNA, 19 nt, Homo sapiens
acacagacugcuuccuuau

SEQ ID NO: 53324 - RNA, 19 nt, Homo sapiens
gaggaggaaggaaagaaag

SEQ ID NO: 53325 - RNA, 19 nt, Homo sapiens
aaccaaccaugccauugug

SEQ ID NO: 53326 - RNA, 19 nt, Homo sapiens
gcaccucaucacacgacua

SEQ ID NO: 53327 - RNA, 19 nt, Homo sapiens
guaaccgaaugcugauggu

SEQ ID NO: 53328 - RNA, 19 nt, Homo sapiens
gugacacggugggaaacuu

SEQ ID NO: 53329 - RNA, 19 nt, Homo sapiens
aggcgacacuucugcagau

SEQ ID NO: 53330 - RNA, 19 nt, Homo sapiens
ccacucacccacacacuac

SEQ ID NO: 53331 - RNA, 19 nt, Homo sapiens
uaugauaaggugguacuga

SEQ ID NO: 53332 - RNA, 19 nt, Homo sapiens
caagaaucauggacuguua

SEQ ID NO: 53333 - RNA, 19 nt, Homo sapiens
ggagugugguggugguuua

SEQ ID NO: 53334 - RNA, 19 nt, Homo sapiens
gcaaguuuguucaagauug

SEQ ID NO: 53335 - RNA, 19 nt, Homo sapiens
cgaaagcuguucaccguuu

SEQ ID NO: 53336 - RNA, 19 nt, Homo sapiens
gagccaugcuaguuugaua

SEQ ID NO: 53337 - RNA, 19 nt, Homo sapiens
gggagaagcagccaaacua

SEQ ID NO: 53338 - RNA, 19 nt, Homo sapiens
ggaagaagaauaagaacug

SEQ ID NO: 53339 - RNA, 19 nt, Homo sapiens
gcacuggucuugaguaucc

SEQ ID NO: 53340 - RNA, 19 nt, Homo sapiens
ccuuauagcuggacuuuua

SEQ ID NO: 53341 - RNA, 19 nt, Homo sapiens
aagauuggcugucaagaau

SEQ ID NO: 53342 - RNA, 19 nt, Homo sapiens
uagcaagagugccgucauu

SEQ ID NO: 53343 - RNA, 19 nt, Homo sapiens
ccaggaagaagaauaagaa

SEQ ID NO: 53344 - RNA, 19 nt, Homo sapiens
ccacagcacuggucuugag

SEQ ID NO: 53345 - RNA, 19 nt, Homo sapiens
cgacacuucugcagauguu

SEQ ID NO: 53346 - RNA, 19 nt, Homo sapiens
caagauuggcugucaagaa

SEQ ID NO: 53347 - RNA, 19 nt, Homo sapiens
ccagcaaguuuguucaaga

SEQ ID NO: 53348 - RNA, 19 nt, Homo sapiens
uacacagacugcuuccuua

SEQ ID NO: 53349 - RNA, 19 nt, Homo sapiens
gaugugggcuggaaugacu

SEQ ID NO: 53350 - RNA, 19 nt, Homo sapiens
gggcuggaaugacuggauu

SEQ ID NO: 53351 - RNA, 19 nt, Homo sapiens
gacuuuacgugcaaauguu

SEQ ID NO: 53352 - RNA, 19 nt, Homo sapiens
gaggauagacagauauaca

SEQ ID NO: 53353 - RNA, 19 nt, Homo sapiens
acagacugcuuccuuauag

SEQ ID NO: 53354 - RNA, 19 nt, Homo sapiens
ggagaagcagccaaacuau

SEQ ID NO: 53355 - RNA, 19 nt, Homo sapiens
aagaacaucuggagaacau

SEQ ID NO: 53356 - RNA, 19 nt, Homo sapiens
cagcaaguuuguucaagau

SEQ ID NO: 53357 - RNA, 19 nt, Homo sapiens
cauggacuguuauuauaug

SEQ ID NO: 53358 - RNA, 19 nt, Homo sapiens
gaaucauggacuguuauua

SEQ ID NO: 53359 - RNA, 19 nt, Homo sapiens
gggccaggaagaagaauaa

SEQ ID NO: 53360 - RNA, 19 nt, Homo sapiens
cagcacuggucuugaguau

SEQ ID NO: 53361 - RNA, 19 nt, Homo sapiens
caaccaaccaugccauugu

SEQ ID NO: 53362 - RNA, 19 nt, Homo sapiens
gagaagcagccaaacuaug

SEQ ID NO: 53363 - RNA, 19 nt, Homo sapiens
gcgcgagccaugcuaguuu

SEQ ID NO: 53364 - RNA, 19 nt, Homo sapiens
accuugaccuuauuuauga

SEQ ID NO: 53365 - RNA, 19 nt, Homo sapiens
guagugccaucccgagcaa

SEQ ID NO: 53366 - RNA, 19 nt, Homo sapiens
gcugauggucguuuuauua

SEQ ID NO: 53367 - RNA, 19 nt, Homo sapiens
caaguuuguucaagauugg

SEQ ID NO: 53368 - RNA, 19 nt, Homo sapiens
gauauacacaccacacaca

SEQ ID NO: 53369 - RNA, 19 nt, Homo sapiens
ccuugaggauagacagaua

SEQ ID NO: 53370 - RNA, 19 nt, Homo sapiens
gagaucaggcaguccuuga

SEQ ID NO: 53371 - RNA, 19 nt, Homo sapiens
acauucaccuugaccuuau

SEQ ID NO: 53372 - RNA, 19 nt, Homo sapiens
guaccuggaugaguaugau

SEQ ID NO: 53373 - RNA, 19 nt, Homo sapiens
gggccagcaugucaggauu

SEQ ID NO: 53374 - RNA, 19 nt, Homo sapiens
cacagacugcuuccuuaua

SEQ ID NO: 53375 - RNA, 19 nt, Homo sapiens
cuacacagacugcuuccuu

SEQ ID NO: 53376 - RNA, 19 nt, Homo sapiens
ggccagcaugucaggauua

SEQ ID NO: 53377 - RNA, 19 nt, Homo sapiens
gaaagcuguucaccguuuu

SEQ ID NO: 53378 - RNA, 19 nt, Homo sapiens
ugcuguaccuggaugagua

SEQ ID NO: 53379 - RNA, 19 nt, Homo sapiens
cgaagaacaucuggagaac

SEQ ID NO: 53380 - RNA, 19 nt, Homo sapiens
gcagcuucccugagccuuu

SEQ ID NO: 53381 - RNA, 19 nt, Homo sapiens
gcccuaagcaucacucaca

SEQ ID NO: 53382 - RNA, 19 nt, Homo sapiens
gagccuuuccagcaaguuu

SEQ ID NO: 53383 - RNA, 19 nt, Homo sapiens
caccuugaccuuauuuaug

SEQ ID NO: 53384 - RNA, 19 nt, Homo sapiens
augauaaggugguacugaa

SEQ ID NO: 53385 - RNA, 19 nt, Homo sapiens
caggauuagccgaucguua

SEQ ID NO: 53386 - RNA, 19 nt, Homo sapiens
ugacacggugggaaacuuu

SEQ ID NO: 53387 - RNA, 19 nt, Homo sapiens
cccuaaacauucaccuuga

SEQ ID NO: 53388 - RNA, 19 nt, Homo sapiens
ggauagacagauauacaca

SEQ ID NO: 53389 - RNA, 19 nt, Homo sapiens
ccuguugugugcccacuga

SEQ ID NO: 53390 - RNA, 19 nt, Homo sapiens
gaagaacaucuggagaaca

SEQ ID NO: 53391 - RNA, 19 nt, Homo sapiens
ugaguaugauaagguggua

SEQ ID NO: 53392 - RNA, 19 nt, Homo sapiens
guucaagauuggcugucaa

SEQ ID NO: 53393 - RNA, 19 nt, Homo sapiens
agaagcagccaaacuaugg

SEQ ID NO: 53394 - RNA, 19 nt, Homo sapiens
gaucuuuaccggcuucagu

SEQ ID NO: 53395 - RNA, 19 nt, Homo sapiens
ugacuuuacgugcaaaugu

SEQ ID NO: 53396 - RNA, 19 nt, Homo sapiens
cagcuucccugagccuuuc

SEQ ID NO: 53397 - RNA, 19 nt, Homo sapiens
acgaagaacaucuggagaa

SEQ ID NO: 53398 - RNA, 19 nt, Homo sapiens
ccuggucaauucugucaau

SEQ ID NO: 53399 - RNA, 19 nt, Homo sapiens
ucaccuugaccuuauuuau

SEQ ID NO: 53400 - RNA, 19 nt, Homo sapiens
ggucaccuuuggccaugau

SEQ ID NO: 53401 - RNA, 19 nt, Homo sapiens
gcuuuucguuuccucuuua

SEQ ID NO: 53402 - RNA, 19 nt, Homo sapiens
gaggagcuuccaccacgaa

SEQ ID NO: 53403 - RNA, 19 nt, Homo sapiens
aaacauucaccuugaccuu

SEQ ID NO: 53404 - RNA, 19 nt, Homo sapiens
ucaagaaucauggacuguu

SEQ ID NO: 53405 - RNA, 19 nt, Homo sapiens
gaaugcugauggucguuuu

SEQ ID NO: 53406 - RNA, 19 nt, Homo sapiens
acacacacguucccaucca

SEQ ID NO: 53407 - RNA, 19 nt, Homo sapiens
cacacacacacaccacaua

SEQ ID NO: 53408 - RNA, 19 nt, Homo sapiens
ggacuucgaggcgacacuu

SEQ ID NO: 53409 - RNA, 19 nt, Homo sapiens
aacauucaccuugaccuua

SEQ ID NO: 53410 - RNA, 19 nt, Homo sapiens
gauaaggugguacugaaaa

SEQ ID NO: 53411 - RNA, 19 nt, Homo sapiens
ugauaaggugguacugaaa

SEQ ID NO: 53412 - RNA, 19 nt, Homo sapiens
gccaggaagaagaauaaga

SEQ ID NO: 53413 - RNA, 19 nt, Homo sapiens
caccagggccagcauguca

SEQ ID NO: 53414 - RNA, 19 nt, Homo sapiens
uuuaugacuuuacgugcaa

SEQ ID NO: 53415 - RNA, 19 nt, Homo sapiens
acacagacugcuuccuuau

SEQ ID NO: 53416 - RNA, 19 nt, Homo sapiens
aaccaaccaugccauugug

SEQ ID NO: 53417 - RNA, 19 nt, Homo sapiens
gcaccucaucacacgacua

SEQ ID NO: 53418 - RNA, 19 nt, Homo sapiens
guaaccgaaugcugauggu

SEQ ID NO: 53419 - RNA, 19 nt, Homo sapiens
gugacacggugggaaacuu

SEQ ID NO: 53420 - RNA, 19 nt, Homo sapiens
aggcgacacuucugcagau

SEQ ID NO: 53421 - RNA, 19 nt, Homo sapiens
cgcgagccaugcuaguuug

SEQ ID NO: 53422 - RNA, 19 nt, Homo sapiens
ccacucacccacacacuac

SEQ ID NO: 53423 - RNA, 19 nt, Homo sapiens
uaugauaaggugguacuga

SEQ ID NO: 53424 - RNA, 19 nt, Homo sapiens
ucaagggagugggaauugg

SEQ ID NO: 53425 - RNA, 19 nt, Homo sapiens
gccagcaugucaggauuag

SEQ ID NO: 53426 - RNA, 19 nt, Homo sapiens
cgaaugcugauggucguuu

SEQ ID NO: 53427 - RNA, 19 nt, Homo sapiens
gugggaaacuuuugaugug

SEQ ID NO: 53428 - RNA, 19 nt, Homo sapiens
gcagcaucccugagaacga

SEQ ID NO: 53429 - RNA, 19 nt, Homo sapiens
gacuacaugcgggaucuuu

SEQ ID NO: 53430 - RNA, 19 nt, Homo sapiens
cauucaccuugaccuuauu

SEQ ID NO: 53431 - RNA, 19 nt, Homo sapiens
aucaggagaugguaguaga

SEQ ID NO: 53432 - RNA, 19 nt, Homo sapiens
gaagagggcugguauauuu

SEQ ID NO: 53433 - RNA, 19 nt, Homo sapiens
ggaaacacauuuacuugaa

SEQ ID NO: 53434 - RNA, 19 nt, Homo sapiens
uaacaacuguggauaauug

SEQ ID NO: 53435 - RNA, 19 nt, Homo sapiens
ggacagauauauauuccaa

SEQ ID NO: 53436 - RNA, 19 nt, Homo sapiens
caggaaggauuucaaguaa

SEQ ID NO: 53437 - RNA, 19 nt, Homo sapiens
uaggucaucugaucaaaua

SEQ ID NO: 53438 - RNA, 19 nt, Homo sapiens
gagguggaauuaacaguaa

SEQ ID NO: 53439 - RNA, 19 nt, Homo sapiens
caaauuaaaugccaucucu

SEQ ID NO: 53440 - RNA, 19 nt, Homo sapiens
gcgaaggcauuacaaagaa

SEQ ID NO: 53441 - RNA, 19 nt, Homo sapiens
ggacuuacaggaaggauuu

SEQ ID NO: 53442 - RNA, 19 nt, Homo sapiens
ucaaguaaauucagggaaa

SEQ ID NO: 53443 - RNA, 19 nt, Homo sapiens
gauaccaacuuucugaaug

SEQ ID NO: 53444 - RNA, 19 nt, Homo sapiens
caugagcuuugucaacuua

SEQ ID NO: 53445 - RNA, 19 nt, Homo sapiens
aaagggaaauucucucuau

SEQ ID NO: 53446 - RNA, 19 nt, Homo sapiens
aguacaaccuagaguauua

SEQ ID NO: 53447 - RNA, 19 nt, Homo sapiens
ccacuuaacgcccauauga

SEQ ID NO: 53448 - RNA, 19 nt, Homo sapiens
gcagaucuguucuuguuag

SEQ ID NO: 53449 - RNA, 19 nt, Homo sapiens
gaaagacgggaaauacaaa

SEQ ID NO: 53450 - RNA, 19 nt, Homo sapiens
gauguuuccugaccacgua

SEQ ID NO: 53451 - RNA, 19 nt, Homo sapiens
guaagaagcacgaacucua

SEQ ID NO: 53452 - RNA, 19 nt, Homo sapiens
ucacagacccagaccauuu

SEQ ID NO: 53453 - RNA, 19 nt, Homo sapiens
cagcauagaucugugauuc

SEQ ID NO: 53454 - RNA, 19 nt, Homo sapiens
gagauuauaacacaaguga

SEQ ID NO: 53455 - RNA, 19 nt, Homo sapiens
acaaugccaugaccaauga

SEQ ID NO: 53456 - RNA, 19 nt, Homo sapiens
gaaacuguaccuccuagaa

SEQ ID NO: 53457 - RNA, 19 nt, Homo sapiens
aaaugucacugucaugaaa

SEQ ID NO: 53458 - RNA, 19 nt, Homo sapiens
gagaagaacucaaaagcaa

SEQ ID NO: 53459 - RNA, 19 nt, Homo sapiens
aagcauacuuucagacaaa

SEQ ID NO: 53460 - RNA, 19 nt, Homo sapiens
gaucuguucuuguuagaca

SEQ ID NO: 53461 - RNA, 19 nt, Homo sapiens
ggagguggaauuaacagua

SEQ ID NO: 53462 - RNA, 19 nt, Homo sapiens
gggaaauucucucuaucuu

SEQ ID NO: 53463 - RNA, 19 nt, Homo sapiens
ggaaauacaaagggaaauu

SEQ ID NO: 53464 - RNA, 19 nt, Homo sapiens
gauuauagcaccagaagga

SEQ ID NO: 53465 - RNA, 19 nt, Homo sapiens
gcagcugaauuccggauau

SEQ ID NO: 53466 - RNA, 19 nt, Homo sapiens
ggaugcagaucuguucuug

SEQ ID NO: 53467 - RNA, 19 nt, Homo sapiens
gaauuaacaguaagaagga

SEQ ID NO: 53468 - RNA, 19 nt, Homo sapiens
ccagaauaauuugggcuua

SEQ ID NO: 53469 - RNA, 19 nt, Homo sapiens
gaaaugucacugucaugaa

SEQ ID NO: 53470 - RNA, 19 nt, Homo sapiens
gaaaaucggugaggauguu

SEQ ID NO: 53471 - RNA, 19 nt, Homo sapiens
uggcaggacuggauuauag

SEQ ID NO: 53472 - RNA, 19 nt, Homo sapiens
ggcccaagcuuuagaugug

SEQ ID NO: 53473 - RNA, 19 nt, Homo sapiens
gagcaacaaccgauuugaa

SEQ ID NO: 53474 - RNA, 19 nt, Homo sapiens
gaaauaacuacucuugaca

SEQ ID NO: 53475 - RNA, 19 nt, Homo sapiens
cagcugaauuccggauaua

SEQ ID NO: 53476 - RNA, 19 nt, Homo sapiens
ggaaauucucucuaucuug

SEQ ID NO: 53477 - RNA, 19 nt, Homo sapiens
gaaauacaaagggaaauuc

SEQ ID NO: 53478 - RNA, 19 nt, Homo sapiens
aaaugcaucugacuguauu

SEQ ID NO: 53479 - RNA, 19 nt, Homo sapiens
ggacgcaguaucaacguaa

SEQ ID NO: 53480 - RNA, 19 nt, Homo sapiens
uuaaggguauuguggguuu

SEQ ID NO: 53481 - RNA, 19 nt, Homo sapiens
gaagauuacuuugggaacu

SEQ ID NO: 53482 - RNA, 19 nt, Homo sapiens
gggaaacacauuuacuuga

SEQ ID NO: 53483 - RNA, 19 nt, Homo sapiens
agaaggauacgcugcauuu

SEQ ID NO: 53484 - RNA, 19 nt, Homo sapiens
uggguuggcuugucuuuga

SEQ ID NO: 53485 - RNA, 19 nt, Homo sapiens
ggagaaagggauugaaugg

SEQ ID NO: 53486 - RNA, 19 nt, Homo sapiens
cgaaagacgggaaauacaa

SEQ ID NO: 53487 - RNA, 19 nt, Homo sapiens
gaaggcauuacaaagaauu

SEQ ID NO: 53488 - RNA, 19 nt, Homo sapiens
gcuggguucuaguggguua

SEQ ID NO: 53489 - RNA, 19 nt, Homo sapiens
acaggaaggauuucaagua

SEQ ID NO: 53490 - RNA, 19 nt, Homo sapiens
augcagaucuguucuuguu

SEQ ID NO: 53491 - RNA, 19 nt, Homo sapiens
cauguucacuccaguuuua

SEQ ID NO: 53492 - RNA, 19 nt, Homo sapiens
caaaagcaagugaagauua

SEQ ID NO: 53493 - RNA, 19 nt, Homo sapiens
uaagaagcacgaacucuau

SEQ ID NO: 53494 - RNA, 19 nt, Homo sapiens
gacagggaccucagucaaa

SEQ ID NO: 53495 - RNA, 19 nt, Homo sapiens
gggcauccuuggcagaaga

SEQ ID NO: 53496 - RNA, 19 nt, Homo sapiens
ccacgaaagacgggaaaua

SEQ ID NO: 53497 - RNA, 19 nt, Homo sapiens
gggauugaauggacuuaca

SEQ ID NO: 53498 - RNA, 19 nt, Homo sapiens
agaaauaacuacucuugac

SEQ ID NO: 53499 - RNA, 19 nt, Homo sapiens
gaagaucaacuuuugcuaa

SEQ ID NO: 53500 - RNA, 19 nt, Homo sapiens
gcauagaucugugauucag

SEQ ID NO: 53501 - RNA, 19 nt, Homo sapiens
auaccaacuuucugaauga

SEQ ID NO: 53502 - RNA, 19 nt, Homo sapiens
ccaagcugccggacagaua

SEQ ID NO: 53503 - RNA, 19 nt, Homo sapiens
gaaugcauaggucaucuga

SEQ ID NO: 53504 - RNA, 19 nt, Homo sapiens
gaucaacuuuugcuaauuc

SEQ ID NO: 53505 - RNA, 19 nt, Homo sapiens
uaaaugccaucucuguucu

SEQ ID NO: 53506 - RNA, 19 nt, Homo sapiens
cgugagagcagccaacaaa

SEQ ID NO: 53507 - RNA, 19 nt, Homo sapiens
ucucuguucuguacuuuga

SEQ ID NO: 53508 - RNA, 19 nt, Homo sapiens
gaauguucuuuuccacuua

SEQ ID NO: 53509 - RNA, 19 nt, Homo sapiens
gagagcagccaacaaacga

SEQ ID NO: 53510 - RNA, 19 nt, Homo sapiens
caugauaccaacuuucuga

SEQ ID NO: 53511 - RNA, 19 nt, Homo sapiens
gauguugugcucagaaaug

SEQ ID NO: 53512 - RNA, 19 nt, Homo sapiens
gagcagccaacaaacgaaa

SEQ ID NO: 53513 - RNA, 19 nt, Homo sapiens
cuagccagccuccaugaua

SEQ ID NO: 53514 - RNA, 19 nt, Homo sapiens
gcaauaaauccagcucuca

SEQ ID NO: 53515 - RNA, 19 nt, Homo sapiens
ucagaaaugucacugucau

SEQ ID NO: 53516 - RNA, 19 nt, Homo sapiens
caaccacgcuauaguucag

SEQ ID NO: 53517 - RNA, 19 nt, Homo sapiens
caucaaggaauacacaaau

SEQ ID NO: 53518 - RNA, 19 nt, Homo sapiens
caacuguggauaauuggaa

SEQ ID NO: 53519 - RNA, 19 nt, Homo sapiens
gcauaggucaucugaucaa

SEQ ID NO: 53520 - RNA, 19 nt, Homo sapiens
uggcuugucuuugauauca

SEQ ID NO: 53521 - RNA, 19 nt, Homo sapiens
aaauagggaugcagaucug

SEQ ID NO: 53522 - RNA, 19 nt, Homo sapiens
cgaaggcauuacaaagaau

SEQ ID NO: 53523 - RNA, 19 nt, Homo sapiens
caaagggaaauucucucua

SEQ ID NO: 53524 - RNA, 19 nt, Homo sapiens
aagauuacuuugggaacua

SEQ ID NO: 53525 - RNA, 19 nt, Homo sapiens
gcuccaaccaaauuaaaug

SEQ ID NO: 53526 - RNA, 19 nt, Homo sapiens
uccagaauguccaguguug

SEQ ID NO: 53527 - RNA, 19 nt, Homo sapiens
gauguggguuggcuugucu

SEQ ID NO: 53528 - RNA, 19 nt, Homo sapiens
ggauggcaggacuggauua

SEQ ID NO: 53529 - RNA, 19 nt, Homo sapiens
ggucaucugaucaaauaau

SEQ ID NO: 53530 - RNA, 19 nt, Homo sapiens
augcauaggucaucugauc

SEQ ID NO: 53531 - RNA, 19 nt, Homo sapiens
gacgcaguaucaacguaaa

SEQ ID NO: 53532 - RNA, 19 nt, Homo sapiens
ggaguuaaauguauucuug

SEQ ID NO: 53533 - RNA, 19 nt, Homo sapiens
ggaaggcaauuucauacua

SEQ ID NO: 53534 - RNA, 19 nt, Homo sapiens
gaagaaggcuggcuggaau

SEQ ID NO: 53535 - RNA, 19 nt, Homo sapiens
gaaggcaauuucauacuaa

SEQ ID NO: 53536 - RNA, 19 nt, Homo sapiens
caacagcagugaauugaaa

SEQ ID NO: 53537 - RNA, 19 nt, Homo sapiens
cagcauuuaucaagucuua

SEQ ID NO: 53538 - RNA, 19 nt, Homo sapiens
gaugagacuuugaaacuau

SEQ ID NO: 53539 - RNA, 19 nt, Homo sapiens
gggaugagcaugcuguuua

SEQ ID NO: 53540 - RNA, 19 nt, Homo sapiens
ggacgaccaugagagauaa

SEQ ID NO: 53541 - RNA, 19 nt, Homo sapiens
cuacaacuguuugcacuua

SEQ ID NO: 53542 - RNA, 19 nt, Homo sapiens
gcagaaacauaaccgugaa

SEQ ID NO: 53543 - RNA, 19 nt, Homo sapiens
caugguggcuuucuucaaa

SEQ ID NO: 53544 - RNA, 19 nt, Homo sapiens
uaaaugacgugaguaguug

SEQ ID NO: 53545 - RNA, 19 nt, Homo sapiens
gcaggaagcaugagcugua

SEQ ID NO: 53546 - RNA, 19 nt, Homo sapiens
guaaaugacgugaguaguu

SEQ ID NO: 53547 - RNA, 19 nt, Homo sapiens
ggugacggcugcagaauuc

SEQ ID NO: 53548 - RNA, 19 nt, Homo sapiens
acaaagaguucaaguucaa

SEQ ID NO: 53549 - RNA, 19 nt, Homo sapiens
auaauuugcucacuuggua

SEQ ID NO: 53550 - RNA, 19 nt, Homo sapiens
ccacaaagaguucaaguuc

SEQ ID NO: 53551 - RNA, 19 nt, Homo sapiens
ggaugagcaugcuguuuau

SEQ ID NO: 53552 - RNA, 19 nt, Homo sapiens
aggaucagcugguucagua

SEQ ID NO: 53553 - RNA, 19 nt, Homo sapiens
gcuaaaggaucagcugguu

SEQ ID NO: 53554 - RNA, 19 nt, Homo sapiens
caucucgguucuuuacuuu

SEQ ID NO: 53555 - RNA, 19 nt, Homo sapiens
ucaugccagugccuuauua

SEQ ID NO: 53556 - RNA, 19 nt, Homo sapiens
gauuacaucugccuuaaaa

SEQ ID NO: 53557 - RNA, 19 nt, Homo sapiens
uggcaggacuggaucauug

SEQ ID NO: 53558 - RNA, 19 nt, Homo sapiens
gagacggcccuuacgauaa

SEQ ID NO: 53559 - RNA, 19 nt, Homo sapiens
ggacagcgccuuccucaac

SEQ ID NO: 53560 - RNA, 19 nt, Homo sapiens
caauuacugugauggagaa

SEQ ID NO: 53561 - RNA, 19 nt, Homo sapiens
caugagagauaaggacuga

SEQ ID NO: 53562 - RNA, 19 nt, Homo sapiens
gagggugcccagcuuauaa

SEQ ID NO: 53563 - RNA, 19 nt, Homo sapiens
guagcaagcugaguuugga

SEQ ID NO: 53564 - RNA, 19 nt, Homo sapiens
gcaauuucauacuaaacug

SEQ ID NO: 53565 - RNA, 19 nt, Homo sapiens
gugcccagcuuauaagaau

SEQ ID NO: 53566 - RNA, 19 nt, Homo sapiens
gguaacugcagaaacauaa

SEQ ID NO: 53567 - RNA, 19 nt, Homo sapiens
uuggaugucuguagcauaa

SEQ ID NO: 53568 - RNA, 19 nt, Homo sapiens
cgaugagacuuugaaacua

SEQ ID NO: 53569 - RNA, 19 nt, Homo sapiens
agucauugcuguuguaugu

SEQ ID NO: 53570 - RNA, 19 nt, Homo sapiens
gaccuugguucaccuuaug

SEQ ID NO: 53571 - RNA, 19 nt, Homo sapiens
acaccucaauccuccauuu

SEQ ID NO: 53572 - RNA, 19 nt, Homo sapiens
uccauuugcuguacucuuu

SEQ ID NO: 53573 - RNA, 19 nt, Homo sapiens
guucaguacugucuaucaa

SEQ ID NO: 53574 - RNA, 19 nt, Homo sapiens
gcucaccucuucuuuacca

SEQ ID NO: 53575 - RNA, 19 nt, Homo sapiens
ggaaaauaaucucaaagga

SEQ ID NO: 53576 - RNA, 19 nt, Homo sapiens
gggcuaugcugccaauuac

SEQ ID NO: 53577 - RNA, 19 nt, Homo sapiens
gaaugcuccuucccacuca

SEQ ID NO: 53578 - RNA, 19 nt, Homo sapiens
ggaagcaugagcuguaugu

SEQ ID NO: 53579 - RNA, 19 nt, Homo sapiens
ugagcaugcuguuuaugaa

SEQ ID NO: 53580 - RNA, 19 nt, Homo sapiens
ucuaguaccuuuucaguaa

SEQ ID NO: 53581 - RNA, 19 nt, Homo sapiens
uaaaggaucagcugguuca

SEQ ID NO: 53582 - RNA, 19 nt, Homo sapiens
ggaugccacuaacucgaaa

SEQ ID NO: 53583 - RNA, 19 nt, Homo sapiens
ccacucaacgcacacauga

SEQ ID NO: 53584 - RNA, 19 nt, Homo sapiens
cuacaaggacuguguuaug

SEQ ID NO: 53585 - RNA, 19 nt, Homo sapiens
aaaguagacugauuacacu

SEQ ID NO: 53586 - RNA, 19 nt, Homo sapiens
gcccuugucucagucauug

SEQ ID NO: 53587 - RNA, 19 nt, Homo sapiens
ccaggaagauuuuaaagga

SEQ ID NO: 53588 - RNA, 19 nt, Homo sapiens
gaacagaaaucggggaagu

SEQ ID NO: 53589 - RNA, 19 nt, Homo sapiens
gccuuggauuccuagauua

SEQ ID NO: 53590 - RNA, 19 nt, Homo sapiens
ucucgguucuuuacuuuga

SEQ ID NO: 53591 - RNA, 19 nt, Homo sapiens
caagggcuaugcugccaau

SEQ ID NO: 53592 - RNA, 19 nt, Homo sapiens
gugcucaccucuucuuuac

SEQ ID NO: 53593 - RNA, 19 nt, Homo sapiens
ucucaaaggaguuaaaugu

SEQ ID NO: 53594 - RNA, 19 nt, Homo sapiens
agagacggcccuuacgaua

SEQ ID NO: 53595 - RNA, 19 nt, Homo sapiens
aaggcuggcuggaauuuga

SEQ ID NO: 53596 - RNA, 19 nt, Homo sapiens
cacaaagaguucaaguuca

SEQ ID NO: 53597 - RNA, 19 nt, Homo sapiens
ggguguuuguuaguaaaua

SEQ ID NO: 53598 - RNA, 19 nt, Homo sapiens
ggacgaugagacuuugaaa

SEQ ID NO: 53599 - RNA, 19 nt, Homo sapiens
uaaaugccaucucgguucu

SEQ ID NO: 53600 - RNA, 19 nt, Homo sapiens
gaaccaacgaagaaaauaa

SEQ ID NO: 53601 - RNA, 19 nt, Homo sapiens
caaccaaccacgcgauugu

SEQ ID NO: 53602 - RNA, 19 nt, Homo sapiens
uaucagcauuuaucaaguc

SEQ ID NO: 53603 - RNA, 19 nt, Homo sapiens
ugccuuggauuccuagauu

SEQ ID NO: 53604 - RNA, 19 nt, Homo sapiens
ccaucucgguucuuuacuu

SEQ ID NO: 53605 - RNA, 19 nt, Homo sapiens
gcagagacggcccuuacga

SEQ ID NO: 53606 - RNA, 19 nt, Homo sapiens
uguuugcacuuacagcuuu

SEQ ID NO: 53607 - RNA, 19 nt, Homo sapiens
aaacauaccauuucuacac

SEQ ID NO: 53608 - RNA, 19 nt, Homo sapiens
ucauugcuguuguauguuc

SEQ ID NO: 53609 - RNA, 19 nt, Homo sapiens
ucaguacugucuaucaaag

SEQ ID NO: 53610 - RNA, 19 nt, Homo sapiens
ggugggacgaugagacuuu

SEQ ID NO: 53611 - RNA, 19 nt, Homo sapiens
aaacacggaagcacaguug

SEQ ID NO: 53612 - RNA, 19 nt, Homo sapiens
uuacaacagcagugaauug

SEQ ID NO: 53613 - RNA, 19 nt, Homo sapiens
gauuacaacagcagugaau

SEQ ID NO: 53614 - RNA, 19 nt, Homo sapiens
gcauuuaucaagucuuaca

SEQ ID NO: 53615 - RNA, 19 nt, Homo sapiens
gcagaauuccgcaucuaca

SEQ ID NO: 53616 - RNA, 19 nt, Homo sapiens
gcagugcucaccucuucuu

SEQ ID NO: 53617 - RNA, 19 nt, Homo sapiens
aggcagugcucaccucuuc

SEQ ID NO: 53618 - RNA, 19 nt, Homo sapiens
gguguuuguuaguaaauag

SEQ ID NO: 53619 - RNA, 19 nt, Homo sapiens
caggaagcaugagcuguau

SEQ ID NO: 53620 - RNA, 19 nt, Homo sapiens
cggacgaccaugagagaua

SEQ ID NO: 53621 - RNA, 19 nt, Homo sapiens
gcuuauaagaaugguguua

SEQ ID NO: 53622 - RNA, 19 nt, Homo sapiens
uugugaaccugguggagua

SEQ ID NO: 53623 - RNA, 19 nt, Homo sapiens
acaggaauaugguuguaag

SEQ ID NO: 53624 - RNA, 19 nt, Homo sapiens
uacaaggacuguguuaugg

SEQ ID NO: 53625 - RNA, 19 nt, Homo sapiens
ggaugucuguagcauaagg

SEQ ID NO: 53626 - RNA, 19 nt, Homo sapiens
aagcaugagcuguauguga

SEQ ID NO: 53627 - RNA, 19 nt, Homo sapiens
aguaugggccucagaagaa

SEQ ID NO: 53628 - RNA, 19 nt, Homo sapiens
aaaugagggugcccagcuu

SEQ ID NO: 53629 - RNA, 19 nt, Homo sapiens
gaguaguuguuggucugua

SEQ ID NO: 53630 - RNA, 19 nt, Homo sapiens
uugcucacuugguaaauga

SEQ ID NO: 53631 - RNA, 19 nt, Homo sapiens
acacugaggugaggcuaca

SEQ ID NO: 53632 - RNA, 19 nt, Homo sapiens
gaagaaauacagaaacaug

SEQ ID NO: 53633 - RNA, 19 nt, Homo sapiens
ccucugaacuccuacauga

SEQ ID NO: 53634 - RNA, 19 nt, Homo sapiens
guaagaagcacgagcugua

SEQ ID NO: 53635 - RNA, 19 nt, Homo sapiens
ggacucguuuccagaggua

SEQ ID NO: 53636 - RNA, 19 nt, Homo sapiens
ggaaacaugagcagcauau

SEQ ID NO: 53637 - RNA, 19 nt, Homo sapiens
gaacaagcagcccuucaug

SEQ ID NO: 53638 - RNA, 19 nt, Homo sapiens
gagugugccuucccucuga

SEQ ID NO: 53639 - RNA, 19 nt, Homo sapiens
gcaaacagcgcagccagaa

SEQ ID NO: 53640 - RNA, 19 nt, Homo sapiens
gggaacgcuucgacaauga

SEQ ID NO: 53641 - RNA, 19 nt, Homo sapiens
gaaguuccuguaauaaaug

SEQ ID NO: 53642 - RNA, 19 nt, Homo sapiens
gaggugcacucgagcuuca

SEQ ID NO: 53643 - RNA, 19 nt, Homo sapiens
caugguggcuuucuucaag

SEQ ID NO: 53644 - RNA, 19 nt, Homo sapiens
uaaaggugugagaguauua

SEQ ID NO: 53645 - RNA, 19 nt, Homo sapiens
gcuccaacgucauccugaa

SEQ ID NO: 53646 - RNA, 19 nt, Homo sapiens
gcuccaagacgcccaagaa

SEQ ID NO: 53647 - RNA, 19 nt, Homo sapiens
gaguuccgguuugaucuuu

SEQ ID NO: 53648 - RNA, 19 nt, Homo sapiens
gaacaagauccuacaagcu

SEQ ID NO: 53649 - RNA, 19 nt, Homo sapiens
caucgagaguuccgguuug

SEQ ID NO: 53650 - RNA, 19 nt, Homo sapiens
cugaagaaauacagaaaca

SEQ ID NO: 53651 - RNA, 19 nt, Homo sapiens
aaugagacguuccggauca

SEQ ID NO: 53652 - RNA, 19 nt, Homo sapiens
ggugugagaguauuaggaa

SEQ ID NO: 53653 - RNA, 19 nt, Homo sapiens
ccaacgucauccugaagaa

SEQ ID NO: 53654 - RNA, 19 nt, Homo sapiens
cguggaacaugacaaggaa

SEQ ID NO: 53655 - RNA, 19 nt, Homo sapiens
cuacaaggccgucuucagu

SEQ ID NO: 53656 - RNA, 19 nt, Homo sapiens
gagaguauuaggaaacaug

SEQ ID NO: 53657 - RNA, 19 nt, Homo sapiens
uuaaaggugugagaguauu

SEQ ID NO: 53658 - RNA, 19 nt, Homo sapiens
ggaaccagcagaccaacug

SEQ ID NO: 53659 - RNA, 19 nt, Homo sapiens
caacucggcacccauguuc

SEQ ID NO: 53660 - RNA, 19 nt, Homo sapiens
cuuuaaaggugugagagua

SEQ ID NO: 53661 - RNA, 19 nt, Homo sapiens
gaacaugacaaggaauucu

SEQ ID NO: 53662 - RNA, 19 nt, Homo sapiens
uacaagcugugcaggcaaa

SEQ ID NO: 53663 - RNA, 19 nt, Homo sapiens
cgggaacgcuucgacaaug

SEQ ID NO: 53664 - RNA, 19 nt, Homo sapiens
ccaagacgcccaagaacca

SEQ ID NO: 53665 - RNA, 19 nt, Homo sapiens
ggcaaaaccuagcaggaaa

SEQ ID NO: 53666 - RNA, 19 nt, Homo sapiens
gugagaguauuaggaaaca

SEQ ID NO: 53667 - RNA, 19 nt, Homo sapiens
caacgucauccugaagaaa

SEQ ID NO: 53668 - RNA, 19 nt, Homo sapiens
uacaaggccgucuucagua

SEQ ID NO: 53669 - RNA, 19 nt, Homo sapiens
gaacgcuucgacaaugaga

SEQ ID NO: 53670 - RNA, 19 nt, Homo sapiens
cuaccaccaucgagaguuc

SEQ ID NO: 53671 - RNA, 19 nt, Homo sapiens
caacuuuaaaggugugaga

SEQ ID NO: 53672 - RNA, 19 nt, Homo sapiens
gaaaauugacccggaaguu

SEQ ID NO: 53673 - RNA, 19 nt, Homo sapiens
cagcauccaaugaacaaga

SEQ ID NO: 53674 - RNA, 19 nt, Homo sapiens
gcauauggcuuuugaucag

SEQ ID NO: 53675 - RNA, 19 nt, Homo sapiens
aaacaugagcagcauaugg

SEQ ID NO: 53676 - RNA, 19 nt, Homo sapiens
acaaggccgucuucaguac

SEQ ID NO: 53677 - RNA, 19 nt, Homo sapiens
uaagaagcacgagcuguau

SEQ ID NO: 53678 - RNA, 19 nt, Homo sapiens
gaucuacaaggacuacauc

SEQ ID NO: 53679 - RNA, 19 nt, Homo sapiens
ccaggaaccagcagaccaa

SEQ ID NO: 53680 - RNA, 19 nt, Homo sapiens
cagggaaucggaucucuuc

SEQ ID NO: 53681 - RNA, 19 nt, Homo sapiens
gccaugcacggacucguuu

SEQ ID NO: 53682 - RNA, 19 nt, Homo sapiens
ccaacugccuuuugugaga

SEQ ID NO: 53683 - RNA, 19 nt, Homo sapiens
ccugcaagauagccauuuc

SEQ ID NO: 53684 - RNA, 19 nt, Homo sapiens
ugcagacgcugguccacuu

SEQ ID NO: 53685 - RNA, 19 nt, Homo sapiens
ggagaugcagcgcgagauc

SEQ ID NO: 53686 - RNA, 19 nt, Homo sapiens
gcugguguuugacaucaca

SEQ ID NO: 53687 - RNA, 19 nt, Homo sapiens
agggcuggcugguguuuga

SEQ ID NO: 53688 - RNA, 19 nt, Homo sapiens
gcagggaaucggaucucuu

SEQ ID NO: 53689 - RNA, 19 nt, Homo sapiens
gaaacaugagcagcauaug

SEQ ID NO: 53690 - RNA, 19 nt, Homo sapiens
cgagaauucagacccuuug

SEQ ID NO: 53691 - RNA, 19 nt, Homo sapiens
ggagggcuggcugguguuu

SEQ ID NO: 53692 - RNA, 19 nt, Homo sapiens
cgagaguuccgguuugauc

SEQ ID NO: 53693 - RNA, 19 nt, Homo sapiens
ggcagcauccaaugaacaa

SEQ ID NO: 53694 - RNA, 19 nt, Homo sapiens
ucaaccucguggaacauga

SEQ ID NO: 53695 - RNA, 19 nt, Homo sapiens
acgucauccugaagaaaua

SEQ ID NO: 53696 - RNA, 19 nt, Homo sapiens
gcagccgaauuccggaucu

SEQ ID NO: 53697 - RNA, 19 nt, Homo sapiens
ccaucuccguccucuacuu

SEQ ID NO: 53698 - RNA, 19 nt, Homo sapiens
acaagcagcccuucauggu

SEQ ID NO: 53699 - RNA, 19 nt, Homo sapiens
ggaacaugacaaggaauuc

SEQ ID NO: 53700 - RNA, 19 nt, Homo sapiens
ccaucgagaguuccgguuu

SEQ ID NO: 53701 - RNA, 19 nt, Homo sapiens
uggccagccugcaagauag

SEQ ID NO: 53702 - RNA, 19 nt, Homo sapiens
gucauuggcugggaagucu

SEQ ID NO: 53703 - RNA, 19 nt, Homo sapiens
ccacuagcuccuccgagaa

SEQ ID NO: 53704 - RNA, 19 nt, Homo sapiens
uggaacaugacaaggaauu

SEQ ID NO: 53705 - RNA, 19 nt, Homo sapiens
cagccgaauuccggaucua

SEQ ID NO: 53706 - RNA, 19 nt, Homo sapiens
gcaaaaccuagcaggaaaa

SEQ ID NO: 53707 - RNA, 19 nt, Homo sapiens
ggucaugagcuucgucaac

SEQ ID NO: 53708 - RNA, 19 nt, Homo sapiens
uaggaaacaugagcagcau

SEQ ID NO: 53709 - RNA, 19 nt, Homo sapiens
gugugagaguauuaggaaa

SEQ ID NO: 53710 - RNA, 19 nt, Homo sapiens
cuggccagccugcaagaua

SEQ ID NO: 53711 - RNA, 19 nt, Homo sapiens
gagaguuccgguuugaucu

SEQ ID NO: 53712 - RNA, 19 nt, Homo sapiens
agccagaaccgcuccaaga

SEQ ID NO: 53713 - RNA, 19 nt, Homo sapiens
gagcagagaucacaacauu

SEQ ID NO: 53714 - RNA, 19 nt, Homo sapiens
gaagagaccugccuuguag

SEQ ID NO: 53715 - RNA, 19 nt, Homo sapiens
gaagagacccucccaugua

SEQ ID NO: 53716 - RNA, 19 nt, Homo sapiens
caacagauaugauguaaag

SEQ ID NO: 53717 - RNA, 19 nt, Homo sapiens
uaauuuaccugcuggaaua

SEQ ID NO: 53718 - RNA, 19 nt, Homo sapiens
caaagaaucugucuaccaa

SEQ ID NO: 53719 - RNA, 19 nt, Homo sapiens
caaacaaccuucagccaaa

SEQ ID NO: 53720 - RNA, 19 nt, Homo sapiens
ugagauagauguggaauga

SEQ ID NO: 53721 - RNA, 19 nt, Homo sapiens
ggaguuggaguguuuauuu

SEQ ID NO: 53722 - RNA, 19 nt, Homo sapiens
ggaaacugcuguucuccuu

SEQ ID NO: 53723 - RNA, 19 nt, Homo sapiens
ccacuggacuccugcauga

SEQ ID NO: 53724 - RNA, 19 nt, Homo sapiens
aagcagaguuggcacauaa

SEQ ID NO: 53725 - RNA, 19 nt, Homo sapiens
gcucagcucuguggaguuu

SEQ ID NO: 53726 - RNA, 19 nt, Homo sapiens
guagguggcuuccuuaucu

SEQ ID NO: 53727 - RNA, 19 nt, Homo sapiens
gaagcagaguuggcacaua

SEQ ID NO: 53728 - RNA, 19 nt, Homo sapiens
uugcuaagccuguaauuua

SEQ ID NO: 53729 - RNA, 19 nt, Homo sapiens
ggagugacaaguaguaauu

SEQ ID NO: 53730 - RNA, 19 nt, Homo sapiens
gcauuuaucuucccuuguc

SEQ ID NO: 53731 - RNA, 19 nt, Homo sapiens
gagcaaaacuguugucuca

SEQ ID NO: 53732 - RNA, 19 nt, Homo sapiens
cagauaugauguaaaguga

SEQ ID NO: 53733 - RNA, 19 nt, Homo sapiens
ccucugugcucuacuauga

SEQ ID NO: 53734 - RNA, 19 nt, Homo sapiens
gcccaaaccgugucauuaa

SEQ ID NO: 53735 - RNA, 19 nt, Homo sapiens
ggucacagcugcggaguuc

SEQ ID NO: 53736 - RNA, 19 nt, Homo sapiens
gcaguguucuacccaaaug

SEQ ID NO: 53737 - RNA, 19 nt, Homo sapiens
gccagaagcagccucauaa

SEQ ID NO: 53738 - RNA, 19 nt, Homo sapiens
gccaacagauaugauguaa

SEQ ID NO: 53739 - RNA, 19 nt, Homo sapiens
gcagacaucaguaaucaau

SEQ ID NO: 53740 - RNA, 19 nt, Homo sapiens
gauaaccccugaaguauug

SEQ ID NO: 53741 - RNA, 19 nt, Homo sapiens
ccacguacaugacccuuuc

SEQ ID NO: 53742 - RNA, 19 nt, Homo sapiens
gaguuggaguguuuauuug

SEQ ID NO: 53743 - RNA, 19 nt, Homo sapiens
gagugaacagcaugauuua

SEQ ID NO: 53744 - RNA, 19 nt, Homo sapiens
ggaagagacccucccaugu

SEQ ID NO: 53745 - RNA, 19 nt, Homo sapiens
caacaugggcagccuguga

SEQ ID NO: 53746 - RNA, 19 nt, Homo sapiens
gauguggaaugaccugaga

SEQ ID NO: 53747 - RNA, 19 nt, Homo sapiens
cagcagcccuguccugugu

SEQ ID NO: 53748 - RNA, 19 nt, Homo sapiens
ugagugaacagcaugauuu

SEQ ID NO: 53749 - RNA, 19 nt, Homo sapiens
ccugaaguauuguauauuc

SEQ ID NO: 53750 - RNA, 19 nt, Homo sapiens
ccaccucugugcucuacua

SEQ ID NO: 53751 - RNA, 19 nt, Homo sapiens
ggaggaggcagccgaagaa

SEQ ID NO: 53752 - RNA, 19 nt, Homo sapiens
ugaagagaccugccuugua

SEQ ID NO: 53753 - RNA, 19 nt, Homo sapiens
gaauggcagacaucaguaa

SEQ ID NO: 53754 - RNA, 19 nt, Homo sapiens
gcucuggccuggaggugaa

SEQ ID NO: 53755 - RNA, 19 nt, Homo sapiens
gucaugagcuucguuaaca

SEQ ID NO: 53756 - RNA, 19 nt, Homo sapiens
guaagagcauggacauuuu

SEQ ID NO: 53757 - RNA, 19 nt, Homo sapiens
cagguggucucaaucauca

SEQ ID NO: 53758 - RNA, 19 nt, Homo sapiens
gcagagaucacaacauugc

SEQ ID NO: 53759 - RNA, 19 nt, Homo sapiens
ugaguuggguggagagguu

SEQ ID NO: 53760 - RNA, 19 nt, Homo sapiens
uguaagagcauggacauuu

SEQ ID NO: 53761 - RNA, 19 nt, Homo sapiens
cccaaaccgugucauuaaa

SEQ ID NO: 53762 - RNA, 19 nt, Homo sapiens
ccaauugacccaucuaucu

SEQ ID NO: 53763 - RNA, 19 nt, Homo sapiens
agacaucaguaaucaaucu

SEQ ID NO: 53764 - RNA, 19 nt, Homo sapiens
gcuuugaccugacccagau

SEQ ID NO: 53765 - RNA, 19 nt, Homo sapiens
uggcagacaucaguaauca

SEQ ID NO: 53766 - RNA, 19 nt, Homo sapiens
guagacauguggagucaac

SEQ ID NO: 53767 - RNA, 19 nt, Homo sapiens
guuggagaauucccuauca

SEQ ID NO: 53768 - RNA, 19 nt, Homo sapiens
ucuggaaguuggagaauuc

SEQ ID NO: 53769 - RNA, 19 nt, Homo sapiens
gaucacaacauugcacuuc

SEQ ID NO: 53770 - RNA, 19 nt, Homo sapiens
gagugacaaguaguaauua

SEQ ID NO: 53771 - RNA, 19 nt, Homo sapiens
gguggugcaugccuauaau

SEQ ID NO: 53772 - RNA, 19 nt, Homo sapiens
uaccaacuccucauaguga

SEQ ID NO: 53773 - RNA, 19 nt, Homo sapiens
acugggaguuggaguguuu

SEQ ID NO: 53774 - RNA, 19 nt, Homo sapiens
gcauggacauuuuacuuug

SEQ ID NO: 53775 - RNA, 19 nt, Homo sapiens
ucccuugucuuccugcuuu

SEQ ID NO: 53776 - RNA, 19 nt, Homo sapiens
gaagcaggaaacccucaaa

SEQ ID NO: 53777 - RNA, 19 nt, Homo sapiens
uguccuggcugguucuuug

SEQ ID NO: 53778 - RNA, 19 nt, Homo sapiens
ccucugcuguucucggaaa

SEQ ID NO: 53779 - RNA, 19 nt, Homo sapiens
gaagucaggaguucaagac

SEQ ID NO: 53780 - RNA, 19 nt, Homo sapiens
gcauuugccucugccaucu

SEQ ID NO: 53781 - RNA, 19 nt, Homo sapiens
cagcccagguggucucaau

SEQ ID NO: 53782 - RNA, 19 nt, Homo sapiens
ccaaagaaucugucuacca

SEQ ID NO: 53783 - RNA, 19 nt, Homo sapiens
gagcagccacugggaguug

SEQ ID NO: 53784 - RNA, 19 nt, Homo sapiens
acagauaugauguaaagug

SEQ ID NO: 53785 - RNA, 19 nt, Homo sapiens
gcacagccacugccaacag

SEQ ID NO: 53786 - RNA, 19 nt, Homo sapiens
uaugacagcagcaacaaug

SEQ ID NO: 53787 - RNA, 19 nt, Homo sapiens
ggccaaggcaggcagauca

SEQ ID NO: 53788 - RNA, 19 nt, Homo sapiens
caucuaggaaagacaugua

SEQ ID NO: 53789 - RNA, 19 nt, Homo sapiens
ugucugagguccuauccau

SEQ ID NO: 53790 - RNA, 19 nt, Homo sapiens
gcgcaagcaccgcaacaug

SEQ ID NO: 53791 - RNA, 19 nt, Homo sapiens
cuacucggccuauuacugu

SEQ ID NO: 53792 - RNA, 19 nt, Homo sapiens
gaaaccccaucuguacuaa

SEQ ID NO: 53793 - RNA, 19 nt, Homo sapiens
uuugauuucugacuugcua

SEQ ID NO: 53794 - RNA, 19 nt, Homo sapiens
guuggaguguuuauuugau

SEQ ID NO: 53795 - RNA, 19 nt, Homo sapiens
cacagccacugccaacaga

SEQ ID NO: 53796 - RNA, 19 nt, Homo sapiens
gaaagacauguaagagcau

SEQ ID NO: 53797 - RNA, 19 nt, Homo sapiens
cuaggaaagacauguaaga

SEQ ID NO: 53798 - RNA, 19 nt, Homo sapiens
gauccacuggucacaggua

SEQ ID NO: 53799 - RNA, 19 nt, Homo sapiens
gcaagcaccgcaacauggu

SEQ ID NO: 53800 - RNA, 19 nt, Homo sapiens
aagagacccucccauguac

SEQ ID NO: 53801 - RNA, 19 nt, Homo sapiens
guaguaauuaggcugaguu

SEQ ID NO: 53802 - RNA, 19 nt, Homo sapiens
cagccacugccaacagaua

SEQ ID NO: 53803 - RNA, 19 nt, Homo sapiens
aguaaucaaucuggaaugu

SEQ ID NO: 53804 - RNA, 19 nt, Homo sapiens
gcauccaccugcucaacag

SEQ ID NO: 53805 - RNA, 19 nt, Homo sapiens
ggaggcugaggcagaauug

SEQ ID NO: 53806 - RNA, 19 nt, Homo sapiens
agaguuggcacauaacaug

SEQ ID NO: 53807 - RNA, 19 nt, Homo sapiens
gcagaguuggcacauaaca

SEQ ID NO: 53808 - RNA, 19 nt, Homo sapiens
uuucagggagugacaagua

SEQ ID NO: 53809 - RNA, 19 nt, Homo sapiens
gccucuauguggagacuga

SEQ ID NO: 53810 - RNA, 19 nt, Homo sapiens
aaacaaccuucagccaaag

SEQ ID NO: 53811 - RNA, 19 nt, Homo sapiens
ccuuguagguggcuuccuu

SEQ ID NO: 53812 - RNA, 19 nt, Homo sapiens
uugugugacuguccuguuu

SEQ ID NO: 53813 - RNA, 19 nt, Homo sapiens
cagcagagauggagaaaua

SEQ ID NO: 53814 - RNA, 19 nt, Homo sapiens
gaauaaggauguuaacuug

SEQ ID NO: 53815 - RNA, 19 nt, Homo sapiens
gaagugaauuccugcauuu

SEQ ID NO: 53816 - RNA, 19 nt, Homo sapiens
ugacucagcuauacauuua

SEQ ID NO: 53817 - RNA, 19 nt, Homo sapiens
gaaccaugcuuacaaagaa

SEQ ID NO: 53818 - RNA, 19 nt, Homo sapiens
gaacagugaugaaugucua

SEQ ID NO: 53819 - RNA, 19 nt, Homo sapiens
ggaacaggaugaagcauuu

SEQ ID NO: 53820 - RNA, 19 nt, Homo sapiens
ggacucagcucuauuugau

SEQ ID NO: 53821 - RNA, 19 nt, Homo sapiens
gcacugggaugaaaucaga

SEQ ID NO: 53822 - RNA, 19 nt, Homo sapiens
gaacaaugacucagcuaua

SEQ ID NO: 53823 - RNA, 19 nt, Homo sapiens
guagcaagaccaauuauua

SEQ ID NO: 53824 - RNA, 19 nt, Homo sapiens
gaaagcacuucuuauugaa

SEQ ID NO: 53825 - RNA, 19 nt, Homo sapiens
ccagagcccugcuuaaauu

SEQ ID NO: 53826 - RNA, 19 nt, Homo sapiens
gaaguagcaagaccaauua

SEQ ID NO: 53827 - RNA, 19 nt, Homo sapiens
ggagauggcucgucguugu

SEQ ID NO: 53828 - RNA, 19 nt, Homo sapiens
ggacauugcuuugccauca

SEQ ID NO: 53829 - RNA, 19 nt, Homo sapiens
caggaaacauuacaauuga

SEQ ID NO: 53830 - RNA, 19 nt, Homo sapiens
ggaauaaggauguuaacuu

SEQ ID NO: 53831 - RNA, 19 nt, Homo sapiens
agaaauagacuuugccuuu

SEQ ID NO: 53832 - RNA, 19 nt, Homo sapiens
gauacaagcugggaacuuc

SEQ ID NO: 53833 - RNA, 19 nt, Homo sapiens
gagaaacucuagacugcaa

SEQ ID NO: 53834 - RNA, 19 nt, Homo sapiens
cuacauggcucccgaagug

SEQ ID NO: 53835 - RNA, 19 nt, Homo sapiens
acucagcucuauuugauua

SEQ ID NO: 53836 - RNA, 19 nt, Homo sapiens
gauguuaacuugguucuca

SEQ ID NO: 53837 - RNA, 19 nt, Homo sapiens
gaaaauggaucucucuaug

SEQ ID NO: 53838 - RNA, 19 nt, Homo sapiens
gagcuucuauugccaugaa

SEQ ID NO: 53839 - RNA, 19 nt, Homo sapiens
caucauggcugacaucuac

SEQ ID NO: 53840 - RNA, 19 nt, Homo sapiens
gugaaagccuuaagaagau

SEQ ID NO: 53841 - RNA, 19 nt, Homo sapiens
ggucuggacuaccuuuauu

SEQ ID NO: 53842 - RNA, 19 nt, Homo sapiens
gaaagcauccucuccaaag

SEQ ID NO: 53843 - RNA, 19 nt, Homo sapiens
gaaauagacuuugccuuuu

SEQ ID NO: 53844 - RNA, 19 nt, Homo sapiens
aaacagaaaucuaccaaac

SEQ ID NO: 53845 - RNA, 19 nt, Homo sapiens
ggagaaaccacauuagcuu

SEQ ID NO: 53846 - RNA, 19 nt, Homo sapiens
cauacaagccauuuacuuu

SEQ ID NO: 53847 - RNA, 19 nt, Homo sapiens
ccaaacagauucagauggu

SEQ ID NO: 53848 - RNA, 19 nt, Homo sapiens
gcaauguaagugccuauaa

SEQ ID NO: 53849 - RNA, 19 nt, Homo sapiens
gagggaucguggaagaaua

SEQ ID NO: 53850 - RNA, 19 nt, Homo sapiens
caggguguaugaaauauga

SEQ ID NO: 53851 - RNA, 19 nt, Homo sapiens
ucacaggcugcuaauauua

SEQ ID NO: 53852 - RNA, 19 nt, Homo sapiens
gaauuagaguggaauaagg

SEQ ID NO: 53853 - RNA, 19 nt, Homo sapiens
gggccuugcuguuaaauuc

SEQ ID NO: 53854 - RNA, 19 nt, Homo sapiens
ugaagaagccagcugguuu

SEQ ID NO: 53855 - RNA, 19 nt, Homo sapiens
aaacggugcuuucugugaa

SEQ ID NO: 53856 - RNA, 19 nt, Homo sapiens
ucacagcauugagaauuaa

SEQ ID NO: 53857 - RNA, 19 nt, Homo sapiens
gaccugggccuugcuguua

SEQ ID NO: 53858 - RNA, 19 nt, Homo sapiens
ucacaaaguucugguagug

SEQ ID NO: 53859 - RNA, 19 nt, Homo sapiens
gaacaggaugaagcauuua

SEQ ID NO: 53860 - RNA, 19 nt, Homo sapiens
ugaagugaauuccugcauu

SEQ ID NO: 53861 - RNA, 19 nt, Homo sapiens
ggacgaaagccugaacaaa

SEQ ID NO: 53862 - RNA, 19 nt, Homo sapiens
ugacacaaaugaaguugau

SEQ ID NO: 53863 - RNA, 19 nt, Homo sapiens
gcauugagaauuaagaaga

SEQ ID NO: 53864 - RNA, 19 nt, Homo sapiens
gaagaugaccagggagaaa

SEQ ID NO: 53865 - RNA, 19 nt, Homo sapiens
gcuauacauuuacaucaga

SEQ ID NO: 53866 - RNA, 19 nt, Homo sapiens
uaaaacagccuauagauga

SEQ ID NO: 53867 - RNA, 19 nt, Homo sapiens
ucaguucguuuguauucua

SEQ ID NO: 53868 - RNA, 19 nt, Homo sapiens
gacauucaguucguuugua

SEQ ID NO: 53869 - RNA, 19 nt, Homo sapiens
acagaaaucuaccaaacug

SEQ ID NO: 53870 - RNA, 19 nt, Homo sapiens
ccagggagaaaccacauua

SEQ ID NO: 53871 - RNA, 19 nt, Homo sapiens
caagaccaauuauuaaagg

SEQ ID NO: 53872 - RNA, 19 nt, Homo sapiens
ugaaguagcaagaccaauu

SEQ ID NO: 53873 - RNA, 19 nt, Homo sapiens
ggaaagcauccucuccaaa

SEQ ID NO: 53874 - RNA, 19 nt, Homo sapiens
guucacaggcugcuaauau

SEQ ID NO: 53875 - RNA, 19 nt, Homo sapiens
gaagaagccagcugguuuc

SEQ ID NO: 53876 - RNA, 19 nt, Homo sapiens
gugcaaagauucuccaaaa

SEQ ID NO: 53877 - RNA, 19 nt, Homo sapiens
ccagaugaugcuauuaaua

SEQ ID NO: 53878 - RNA, 19 nt, Homo sapiens
caucauuucucguguucaa

SEQ ID NO: 53879 - RNA, 19 nt, Homo sapiens
gaaagcagugggaguugaa

SEQ ID NO: 53880 - RNA, 19 nt, Homo sapiens
ggauuccucugcugccauu

SEQ ID NO: 53881 - RNA, 19 nt, Homo sapiens
uuuaugaacugcaucaaga

SEQ ID NO: 53882 - RNA, 19 nt, Homo sapiens
ucaguacucuuauuaggau

SEQ ID NO: 53883 - RNA, 19 nt, Homo sapiens
cuaccaaacugugcuaaug

SEQ ID NO: 53884 - RNA, 19 nt, Homo sapiens
gaaacagaaaucuaccaaa

SEQ ID NO: 53885 - RNA, 19 nt, Homo sapiens
gauggaagcauaggucaaa

SEQ ID NO: 53886 - RNA, 19 nt, Homo sapiens
ugaaagccuuaagaagaua

SEQ ID NO: 53887 - RNA, 19 nt, Homo sapiens
gguugaaucccaagaugua

SEQ ID NO: 53888 - RNA, 19 nt, Homo sapiens
caggagggaucguggaaga

SEQ ID NO: 53889 - RNA, 19 nt, Homo sapiens
aagcagacgucguuacaau

SEQ ID NO: 53890 - RNA, 19 nt, Homo sapiens
acaggaaacauuacaauug

SEQ ID NO: 53891 - RNA, 19 nt, Homo sapiens
ugugaaagccuuaagaaga

SEQ ID NO: 53892 - RNA, 19 nt, Homo sapiens
gaugugcccuugaauacca

SEQ ID NO: 53893 - RNA, 19 nt, Homo sapiens
gaaucuggauaguaugcuu

SEQ ID NO: 53894 - RNA, 19 nt, Homo sapiens
gccuauagaugaugaugug

SEQ ID NO: 53895 - RNA, 19 nt, Homo sapiens
uggcauggguggaauuaga

SEQ ID NO: 53896 - RNA, 19 nt, Homo sapiens
guggaacagugaugaaugu

SEQ ID NO: 53897 - RNA, 19 nt, Homo sapiens
uaagaaagcagugggaguu

SEQ ID NO: 53898 - RNA, 19 nt, Homo sapiens
uggacuaccuuuauugguu

SEQ ID NO: 53899 - RNA, 19 nt, Homo sapiens
gcaagaccaauuauuaaag

SEQ ID NO: 53900 - RNA, 19 nt, Homo sapiens
gcagagauggagaaauaga

SEQ ID NO: 53901 - RNA, 19 nt, Homo sapiens
uaaaugagcgcagcagaga

SEQ ID NO: 53902 - RNA, 19 nt, Homo sapiens
gauuacugauuaccaugaa

SEQ ID NO: 53903 - RNA, 19 nt, Homo sapiens
gaaguacaguuuuaucuag

SEQ ID NO: 53904 - RNA, 19 nt, Homo sapiens
uucaugagauggaagcaua

SEQ ID NO: 53905 - RNA, 19 nt, Homo sapiens
caacagugacacaaaugaa

SEQ ID NO: 53906 - RNA, 19 nt, Homo sapiens
ucagcgaacuauugccaaa

SEQ ID NO: 53907 - RNA, 19 nt, Homo sapiens
ucagggcacuguccagaug

SEQ ID NO: 53908 - RNA, 19 nt, Homo sapiens
gaaagccuuaagaagauaa

SEQ ID NO: 53909 - RNA, 19 nt, Homo sapiens
aaaccuuucaguacucuua

SEQ ID NO: 53910 - RNA, 19 nt, Homo sapiens
caauguaagugccuauaac

SEQ ID NO: 53911 - RNA, 19 nt, Homo sapiens
gugaauuccugcauuugau

SEQ ID NO: 53912 - RNA, 19 nt, Homo sapiens
aaaguuggagcuucuauug

SEQ ID NO: 53913 - RNA, 19 nt, Homo sapiens
ccacagggcuuuacuuaua

SEQ ID NO: 53914 - RNA, 19 nt, Homo sapiens
gaaaucacuuccagucuua

SEQ ID NO: 53915 - RNA, 19 nt, Homo sapiens
gaaaggaacgaauguaaua

SEQ ID NO: 53916 - RNA, 19 nt, Homo sapiens
ccaaaggucuugcguugua

SEQ ID NO: 53917 - RNA, 19 nt, Homo sapiens
caaauaagcauccacagua

SEQ ID NO: 53918 - RNA, 19 nt, Homo sapiens
gacgagagcuugaacagaa

SEQ ID NO: 53919 - RNA, 19 nt, Homo sapiens
gggccuggcuguuaaauuu

SEQ ID NO: 53920 - RNA, 19 nt, Homo sapiens
gaaagaggauggugagagu

SEQ ID NO: 53921 - RNA, 19 nt, Homo sapiens
gaacgaauguaauaaagac

SEQ ID NO: 53922 - RNA, 19 nt, Homo sapiens
aaaggaagaucauuucaug

SEQ ID NO: 53923 - RNA, 19 nt, Homo sapiens
guucagaccucaccuuuca

SEQ ID NO: 53924 - RNA, 19 nt, Homo sapiens
cuaaaucaaugcugaaguu

SEQ ID NO: 53925 - RNA, 19 nt, Homo sapiens
gcacagacggauauuguuu

SEQ ID NO: 53926 - RNA, 19 nt, Homo sapiens
guaagcaucucugcagaaa

SEQ ID NO: 53927 - RNA, 19 nt, Homo sapiens
caucaaagaagaucaauug

SEQ ID NO: 53928 - RNA, 19 nt, Homo sapiens
gagauugugugcaucaaga

SEQ ID NO: 53929 - RNA, 19 nt, Homo sapiens
aagcaaacuuccuugauaa

SEQ ID NO: 53930 - RNA, 19 nt, Homo sapiens
gagguauaguggaagaaua

SEQ ID NO: 53931 - RNA, 19 nt, Homo sapiens
ucagagagacagaaauaua

SEQ ID NO: 53932 - RNA, 19 nt, Homo sapiens
ugauaaagguucagacuuc

SEQ ID NO: 53933 - RNA, 19 nt, Homo sapiens
ggauauuguuucacgauga

SEQ ID NO: 53934 - RNA, 19 nt, Homo sapiens
aaauggaacuugcuguauu

SEQ ID NO: 53935 - RNA, 19 nt, Homo sapiens
gaaaaugguucccuuuaug

SEQ ID NO: 53936 - RNA, 19 nt, Homo sapiens
aaagguagcugugaaagug

SEQ ID NO: 53937 - RNA, 19 nt, Homo sapiens
gcacagaaaggaacgaaug

SEQ ID NO: 53938 - RNA, 19 nt, Homo sapiens
uuucaugccuuguugauaa

SEQ ID NO: 53939 - RNA, 19 nt, Homo sapiens
gaaguugacauaccaccua

SEQ ID NO: 53940 - RNA, 19 nt, Homo sapiens
gucaguggcuuaugucauu

SEQ ID NO: 53941 - RNA, 19 nt, Homo sapiens
guucagagagacagaaaua

SEQ ID NO: 53942 - RNA, 19 nt, Homo sapiens
uagaacaggaugaaacuua

SEQ ID NO: 53943 - RNA, 19 nt, Homo sapiens
gaaaacacuugccaaaaug

SEQ ID NO: 53944 - RNA, 19 nt, Homo sapiens
uggcugacauguauaguuu

SEQ ID NO: 53945 - RNA, 19 nt, Homo sapiens
acacagaaaucuuuaguac

SEQ ID NO: 53946 - RNA, 19 nt, Homo sapiens
acagaaaucuuuaguacuc

SEQ ID NO: 53947 - RNA, 19 nt, Homo sapiens
gacuauagcuaagcagauu

SEQ ID NO: 53948 - RNA, 19 nt, Homo sapiens
gagaaucccugagagacuu

SEQ ID NO: 53949 - RNA, 19 nt, Homo sapiens
ggagcgaccugggcaaaga

SEQ ID NO: 53950 - RNA, 19 nt, Homo sapiens
aagaauaccagcuuccuua

SEQ ID NO: 53951 - RNA, 19 nt, Homo sapiens
uuacaagccugccauaagu

SEQ ID NO: 53952 - RNA, 19 nt, Homo sapiens
ugacagcccugcggguuaa

SEQ ID NO: 53953 - RNA, 19 nt, Homo sapiens
gggcuuuacuuauaucugu

SEQ ID NO: 53954 - RNA, 19 nt, Homo sapiens
cagaaaggaacgaauguaa

SEQ ID NO: 53955 - RNA, 19 nt, Homo sapiens
aauaccagcuuccuuauca

SEQ ID NO: 53956 - RNA, 19 nt, Homo sapiens
agaaaucacuuccagucuu

SEQ ID NO: 53957 - RNA, 19 nt, Homo sapiens
gcucuugguccuuaucaua

SEQ ID NO: 53958 - RNA, 19 nt, Homo sapiens
gagcaaaagacaucaaaua

SEQ ID NO: 53959 - RNA, 19 nt, Homo sapiens
gaccugggccuggcuguua

SEQ ID NO: 53960 - RNA, 19 nt, Homo sapiens
ucucagagcucaggaagug

SEQ ID NO: 53961 - RNA, 19 nt, Homo sapiens
gacuucugcugauucauaa

SEQ ID NO: 53962 - RNA, 19 nt, Homo sapiens
ccuagacgcuaaaucaaug

SEQ ID NO: 53963 - RNA, 19 nt, Homo sapiens
ccaaaggacuauagcuaag

SEQ ID NO: 53964 - RNA, 19 nt, Homo sapiens
ggaacgaauguaauaaaga

SEQ ID NO: 53965 - RNA, 19 nt, Homo sapiens
aaacuuccuugauaacaug

SEQ ID NO: 53966 - RNA, 19 nt, Homo sapiens
caaacuuccuugauaacau

SEQ ID NO: 53967 - RNA, 19 nt, Homo sapiens
augguucccuuuaugauua

SEQ ID NO: 53968 - RNA, 19 nt, Homo sapiens
gaaaggaaaggaagaucau

SEQ ID NO: 53969 - RNA, 19 nt, Homo sapiens
ggacccaguuguaccuaau

SEQ ID NO: 53970 - RNA, 19 nt, Homo sapiens
gaaaccagaccucgauaca

SEQ ID NO: 53971 - RNA, 19 nt, Homo sapiens
caccacagggcuuuacuua

SEQ ID NO: 53972 - RNA, 19 nt, Homo sapiens
ggacuagaaggcucagauu

SEQ ID NO: 53973 - RNA, 19 nt, Homo sapiens
gauauuguuucacgaugau

SEQ ID NO: 53974 - RNA, 19 nt, Homo sapiens
gagcagugaugagugucua

SEQ ID NO: 53975 - RNA, 19 nt, Homo sapiens
ccaccacccuagacgcuaa

SEQ ID NO: 53976 - RNA, 19 nt, Homo sapiens
cagguacucuucuguuugu

SEQ ID NO: 53977 - RNA, 19 nt, Homo sapiens
caaaugaaguugacauacc

SEQ ID NO: 53978 - RNA, 19 nt, Homo sapiens
cagagagacagaaauauau

SEQ ID NO: 53979 - RNA, 19 nt, Homo sapiens
ggaugaaacuuacauuccu

SEQ ID NO: 53980 - RNA, 19 nt, Homo sapiens
caagaaaccagaccucgau

SEQ ID NO: 53981 - RNA, 19 nt, Homo sapiens
cgaauguaauaaagaccua

SEQ ID NO: 53982 - RNA, 19 nt, Homo sapiens
agacuucugcugauucaua

SEQ ID NO: 53983 - RNA, 19 nt, Homo sapiens
cuauaugccuccagaagug

SEQ ID NO: 53984 - RNA, 19 nt, Homo sapiens
caaaggucuugcguuguaa

SEQ ID NO: 53985 - RNA, 19 nt, Homo sapiens
cggagaaaccguuggguaa

SEQ ID NO: 53986 - RNA, 19 nt, Homo sapiens
aauggaacuugcuguauug

SEQ ID NO: 53987 - RNA, 19 nt, Homo sapiens
gaucauuucaugccuuguu

SEQ ID NO: 53988 - RNA, 19 nt, Homo sapiens
caaaagacaucaaauaagc

SEQ ID NO: 53989 - RNA, 19 nt, Homo sapiens
ccaccaccauuguccagaa

SEQ ID NO: 53990 - RNA, 19 nt, Homo sapiens
gcgaagugcaggaaaauua

SEQ ID NO: 53991 - RNA, 19 nt, Homo sapiens
gauaggagaggaaaaguaa

SEQ ID NO: 53992 - RNA, 19 nt, Homo sapiens
agaaaacacuugccaaaau

SEQ ID NO: 53993 - RNA, 19 nt, Homo sapiens
ugagggagauugugugcau

SEQ ID NO: 53994 - RNA, 19 nt, Homo sapiens
ccaccuaacacucgaguug

SEQ ID NO: 53995 - RNA, 19 nt, Homo sapiens
gcaauugcccaucgagauc

SEQ ID NO: 53996 - RNA, 19 nt, Homo sapiens
gcugauucauaaccauuug

SEQ ID NO: 53997 - RNA, 19 nt, Homo sapiens
gaugaggcaugaaaacauu

SEQ ID NO: 53998 - RNA, 19 nt, Homo sapiens
ggucuugcguuguaaaugc

SEQ ID NO: 53999 - RNA, 19 nt, Homo sapiens
gagaaaccguuggguaacu

SEQ ID NO: 54000 - RNA, 19 nt, Homo sapiens
acauuaaacucugauagga

SEQ ID NO: 54001 - RNA, 19 nt, Homo sapiens
ggacauuaaacucugauag

SEQ ID NO: 54002 - RNA, 19 nt, Homo sapiens
gauaaagguucagacuucu

SEQ ID NO: 54003 - RNA, 19 nt, Homo sapiens
cacagggcuuuacuuauau

SEQ ID NO: 54004 - RNA, 19 nt, Homo sapiens
ugacaagagaggaaacaaa

SEQ ID NO: 54005 - RNA, 19 nt, Homo sapiens
ucuuagaugugaaaggaaa

SEQ ID NO: 54006 - RNA, 19 nt, Homo sapiens
gaaaacucaugacagaaug

SEQ ID NO: 54007 - RNA, 19 nt, Homo sapiens
ggagguugcuaggagaugu

SEQ ID NO: 54008 - RNA, 19 nt, Homo sapiens
ccaggacauuaaacucuga

SEQ ID NO: 54009 - RNA, 19 nt, Homo sapiens
aaucacagacuaucaugaa

SEQ ID NO: 54010 - RNA, 19 nt, Homo sapiens
cuaagcagauucagauggu

SEQ ID NO: 54011 - RNA, 19 nt, Homo sapiens
gauacagcauuggguuaga

SEQ ID NO: 54012 - RNA, 19 nt, Homo sapiens
uacacugccuccauugaaa

SEQ ID NO: 54013 - RNA, 19 nt, Homo sapiens
gauggaaccuguguuauua

SEQ ID NO: 54014 - RNA, 19 nt, Homo sapiens
ggaaugaacugucugugaa

SEQ ID NO: 54015 - RNA, 19 nt, Homo sapiens
ggaaagcucugaugagaau

SEQ ID NO: 54016 - RNA, 19 nt, Homo sapiens
gaacgcaaccugucacaua

SEQ ID NO: 54017 - RNA, 19 nt, Homo sapiens
gaagguggccgaacuaauu

SEQ ID NO: 54018 - RNA, 19 nt, Homo sapiens
gaaccuguguuauuaguga

SEQ ID NO: 54019 - RNA, 19 nt, Homo sapiens
caacauugcccgcuuuaua

SEQ ID NO: 54020 - RNA, 19 nt, Homo sapiens
gaaagaaacaaaucuguga

SEQ ID NO: 54021 - RNA, 19 nt, Homo sapiens
caagagaccuacuaguuug

SEQ ID NO: 54022 - RNA, 19 nt, Homo sapiens
gauaagaaccucaaggaaa

SEQ ID NO: 54023 - RNA, 19 nt, Homo sapiens
gcagaaauguccuagugaa

SEQ ID NO: 54024 - RNA, 19 nt, Homo sapiens
gcaacaagcuggccaugau

SEQ ID NO: 54025 - RNA, 19 nt, Homo sapiens
ugaagaauauuuccucuga

SEQ ID NO: 54026 - RNA, 19 nt, Homo sapiens
gaaaggauggcugaacuua

SEQ ID NO: 54027 - RNA, 19 nt, Homo sapiens
gauggaacaugacaacauu

SEQ ID NO: 54028 - RNA, 19 nt, Homo sapiens
uaaccgagaugagacaaua

SEQ ID NO: 54029 - RNA, 19 nt, Homo sapiens
ggagagaaaugaagggaau

SEQ ID NO: 54030 - RNA, 19 nt, Homo sapiens
caagaaauguugcagaauc

SEQ ID NO: 54031 - RNA, 19 nt, Homo sapiens
ggaagauaaugcagccaua

SEQ ID NO: 54032 - RNA, 19 nt, Homo sapiens
gguagaaaccacaguguua

SEQ ID NO: 54033 - RNA, 19 nt, Homo sapiens
cuacaaccauggugucuaa

SEQ ID NO: 54034 - RNA, 19 nt, Homo sapiens
gcacagauuuauguaaugu

SEQ ID NO: 54035 - RNA, 19 nt, Homo sapiens
ccaacaagcuagacccaaa

SEQ ID NO: 54036 - RNA, 19 nt, Homo sapiens
guacuggcaugacuacuau

SEQ ID NO: 54037 - RNA, 19 nt, Homo sapiens
ugaaacaaguagacaugua

SEQ ID NO: 54038 - RNA, 19 nt, Homo sapiens
agaaggagcugugaacuug

SEQ ID NO: 54039 - RNA, 19 nt, Homo sapiens
gcaugagccuuuacugaga

SEQ ID NO: 54040 - RNA, 19 nt, Homo sapiens
gcagcaagcacaaaucaaa

SEQ ID NO: 54041 - RNA, 19 nt, Homo sapiens
cauggugucuaaagauaua

SEQ ID NO: 54042 - RNA, 19 nt, Homo sapiens
gaggacacccggcugaaua

SEQ ID NO: 54043 - RNA, 19 nt, Homo sapiens
ccaagagaccuacuaguuu

SEQ ID NO: 54044 - RNA, 19 nt, Homo sapiens
gaagaagacuuggaaacca

SEQ ID NO: 54045 - RNA, 19 nt, Homo sapiens
gcuuacagcugacagaaga

SEQ ID NO: 54046 - RNA, 19 nt, Homo sapiens
cagcacaccuuugacuaua

SEQ ID NO: 54047 - RNA, 19 nt, Homo sapiens
ugaaucagcuuugaaacaa

SEQ ID NO: 54048 - RNA, 19 nt, Homo sapiens
cagcagaaauguccuagug

SEQ ID NO: 54049 - RNA, 19 nt, Homo sapiens
cagcaggacuucacacaga

SEQ ID NO: 54050 - RNA, 19 nt, Homo sapiens
gaaacuacgagggaaauaa

SEQ ID NO: 54051 - RNA, 19 nt, Homo sapiens
gaaacaaguagacauguau

SEQ ID NO: 54052 - RNA, 19 nt, Homo sapiens
gagagucacugcagaugga

SEQ ID NO: 54053 - RNA, 19 nt, Homo sapiens
gauaguugccuuaugcuuu

SEQ ID NO: 54054 - RNA, 19 nt, Homo sapiens
gaaaauagccuggcaguga

SEQ ID NO: 54055 - RNA, 19 nt, Homo sapiens
uaaacaaggucuucacagu

SEQ ID NO: 54056 - RNA, 19 nt, Homo sapiens
aguagaaucucucaugaaa

SEQ ID NO: 54057 - RNA, 19 nt, Homo sapiens
caaccauggugucuaaaga

SEQ ID NO: 54058 - RNA, 19 nt, Homo sapiens
cugaaucgcuggacuguga

SEQ ID NO: 54059 - RNA, 19 nt, Homo sapiens
gcagaaccuucccaagaga

SEQ ID NO: 54060 - RNA, 19 nt, Homo sapiens
acacccggcugaauauuaa

SEQ ID NO: 54061 - RNA, 19 nt, Homo sapiens
gggaauccguaccagagua

SEQ ID NO: 54062 - RNA, 19 nt, Homo sapiens
gaagauaaugcagccauaa

SEQ ID NO: 54063 - RNA, 19 nt, Homo sapiens
acgaggagaucauuauaaa

SEQ ID NO: 54064 - RNA, 19 nt, Homo sapiens
gcagcuagguccucucauc

SEQ ID NO: 54065 - RNA, 19 nt, Homo sapiens
gagcaugagccuuuacuga

SEQ ID NO: 54066 - RNA, 19 nt, Homo sapiens
ggaguacuaucccaaugga

SEQ ID NO: 54067 - RNA, 19 nt, Homo sapiens
aaacaaggucuucacagua

SEQ ID NO: 54068 - RNA, 19 nt, Homo sapiens
ggcaucagucucuguauua

SEQ ID NO: 54069 - RNA, 19 nt, Homo sapiens
acugugaagucaacaauaa

SEQ ID NO: 54070 - RNA, 19 nt, Homo sapiens
ggaguugccaagaugaaua

SEQ ID NO: 54071 - RNA, 19 nt, Homo sapiens
ccaugaggcugacuggaaa

SEQ ID NO: 54072 - RNA, 19 nt, Homo sapiens
uggcuuaucuucacacaga

SEQ ID NO: 54073 - RNA, 19 nt, Homo sapiens
cuaauucucuggaucuuuc

SEQ ID NO: 54074 - RNA, 19 nt, Homo sapiens
gcacagaggccuaauucuc

SEQ ID NO: 54075 - RNA, 19 nt, Homo sapiens
gcaaauggccaagcauguu

SEQ ID NO: 54076 - RNA, 19 nt, Homo sapiens
gacagcaucgugaagaaua

SEQ ID NO: 54077 - RNA, 19 nt, Homo sapiens
aaggauggcugaacuuaug

SEQ ID NO: 54078 - RNA, 19 nt, Homo sapiens
gguaagcucuugccgucuu

SEQ ID NO: 54079 - RNA, 19 nt, Homo sapiens
ugacaacauugcccgcuuu

SEQ ID NO: 54080 - RNA, 19 nt, Homo sapiens
ugaagaauguguaguaacu

SEQ ID NO: 54081 - RNA, 19 nt, Homo sapiens
gaucaagaaacgugugaaa

SEQ ID NO: 54082 - RNA, 19 nt, Homo sapiens
gagcacagaggccuaauuc

SEQ ID NO: 54083 - RNA, 19 nt, Homo sapiens
cgaacuaauuccaauaaca

SEQ ID NO: 54084 - RNA, 19 nt, Homo sapiens
cagcagaaccuucccaaga

SEQ ID NO: 54085 - RNA, 19 nt, Homo sapiens
ggagauauuuaugagaugu

SEQ ID NO: 54086 - RNA, 19 nt, Homo sapiens
gaggcugacuggaaauaga

SEQ ID NO: 54087 - RNA, 19 nt, Homo sapiens
gaagagcacagaggccuaa

SEQ ID NO: 54088 - RNA, 19 nt, Homo sapiens
caaauggccaagcauguuu

SEQ ID NO: 54089 - RNA, 19 nt, Homo sapiens
aaggaaagcucugaugaga

SEQ ID NO: 54090 - RNA, 19 nt, Homo sapiens
gaugaaacaaaucugcaua

SEQ ID NO: 54091 - RNA, 19 nt, Homo sapiens
cauguaugcucuuggacua

SEQ ID NO: 54092 - RNA, 19 nt, Homo sapiens
ccuauggagugaaauuauu

SEQ ID NO: 54093 - RNA, 19 nt, Homo sapiens
guagaaaccacaguguuaa

SEQ ID NO: 54094 - RNA, 19 nt, Homo sapiens
cgcaaccugucacauaaua

SEQ ID NO: 54095 - RNA, 19 nt, Homo sapiens
gacacccggcugaauauua

SEQ ID NO: 54096 - RNA, 19 nt, Homo sapiens
cuucuuggcucccugcuuu

SEQ ID NO: 54097 - RNA, 19 nt, Homo sapiens
caaacaaccaacauaguga

SEQ ID NO: 54098 - RNA, 19 nt, Homo sapiens
ggccaagcauguuugauuc

SEQ ID NO: 54099 - RNA, 19 nt, Homo sapiens
aacaaggucuucacaguau

SEQ ID NO: 54100 - RNA, 19 nt, Homo sapiens
gacaggagaccguaaacaa

SEQ ID NO: 54101 - RNA, 19 nt, Homo sapiens
caucagccauuuguccuuu

SEQ ID NO: 54102 - RNA, 19 nt, Homo sapiens
cccaagaaauguugcagaa

SEQ ID NO: 54103 - RNA, 19 nt, Homo sapiens
acacauagggcccaagaaa

SEQ ID NO: 54104 - RNA, 19 nt, Homo sapiens
cuacuucccauauuucuuu

SEQ ID NO: 54105 - RNA, 19 nt, Homo sapiens
gcaauuucccaucgagauu

SEQ ID NO: 54106 - RNA, 19 nt, Homo sapiens
cuagaggacuggcuuaucu

SEQ ID NO: 54107 - RNA, 19 nt, Homo sapiens
guauuuaagucuccacaca

SEQ ID NO: 54108 - RNA, 19 nt, Homo sapiens
cgaacccucucuugaucua

SEQ ID NO: 54109 - RNA, 19 nt, Homo sapiens
gaauggaacauaccguuuc

SEQ ID NO: 54110 - RNA, 19 nt, Homo sapiens
ucaagccuauggagugaaa

SEQ ID NO: 54111 - RNA, 19 nt, Homo sapiens
uggcagcaguauacagaua

SEQ ID NO: 54112 - RNA, 19 nt, Homo sapiens
agacaugccuuccguuugg

SEQ ID NO: 54113 - RNA, 19 nt, Homo sapiens
gauggaaccuguguuauua

SEQ ID NO: 54114 - RNA, 19 nt, Homo sapiens
ggaaugaacugucugugaa

SEQ ID NO: 54115 - RNA, 19 nt, Homo sapiens
gaaccuguguuauuaguga

SEQ ID NO: 54116 - RNA, 19 nt, Homo sapiens
caacauugcccgcuuuaua

SEQ ID NO: 54117 - RNA, 19 nt, Homo sapiens
gaaagaaacaaaucuguga

SEQ ID NO: 54118 - RNA, 19 nt, Homo sapiens
gcagaaauguccuagugaa

SEQ ID NO: 54119 - RNA, 19 nt, Homo sapiens
gaacguaggugagucaaca

SEQ ID NO: 54120 - RNA, 19 nt, Homo sapiens
gaaaggauggcugaacuua

SEQ ID NO: 54121 - RNA, 19 nt, Homo sapiens
gauggaacaugacaacauu

SEQ ID NO: 54122 - RNA, 19 nt, Homo sapiens
uaaccgagaugagacaaua

SEQ ID NO: 54123 - RNA, 19 nt, Homo sapiens
ggaagauaaugcagccaua

SEQ ID NO: 54124 - RNA, 19 nt, Homo sapiens
cuacaaccauggugucuaa

SEQ ID NO: 54125 - RNA, 19 nt, Homo sapiens
gcacagauuuauguaaugu

SEQ ID NO: 54126 - RNA, 19 nt, Homo sapiens
ugaaacaaguagacaugua

SEQ ID NO: 54127 - RNA, 19 nt, Homo sapiens
agaaggagcugugaacuug

SEQ ID NO: 54128 - RNA, 19 nt, Homo sapiens
cauggugucuaaagauaua

SEQ ID NO: 54129 - RNA, 19 nt, Homo sapiens
ugaaucagcuuugaaacaa

SEQ ID NO: 54130 - RNA, 19 nt, Homo sapiens
cagcagaaauguccuagug

SEQ ID NO: 54131 - RNA, 19 nt, Homo sapiens
gaaacaaguagacauguau

SEQ ID NO: 54132 - RNA, 19 nt, Homo sapiens
gagagucacugcagaugga

SEQ ID NO: 54133 - RNA, 19 nt, Homo sapiens
gauaguugccuuaugcuuu

SEQ ID NO: 54134 - RNA, 19 nt, Homo sapiens
gaaaauagccuggcaguga

SEQ ID NO: 54135 - RNA, 19 nt, Homo sapiens
uaaacaaggucuucacagu

SEQ ID NO: 54136 - RNA, 19 nt, Homo sapiens
aguagaaucucucaugaaa

SEQ ID NO: 54137 - RNA, 19 nt, Homo sapiens
caaccauggugucuaaaga

SEQ ID NO: 54138 - RNA, 19 nt, Homo sapiens
cugaaucgcuggacuguga

SEQ ID NO: 54139 - RNA, 19 nt, Homo sapiens
gggaauccguaccagagua

SEQ ID NO: 54140 - RNA, 19 nt, Homo sapiens
gaagauaaugcagccauaa

SEQ ID NO: 54141 - RNA, 19 nt, Homo sapiens
acgaggagaucauuauaaa

SEQ ID NO: 54142 - RNA, 19 nt, Homo sapiens
ggaguacuaucccaaugga

SEQ ID NO: 54143 - RNA, 19 nt, Homo sapiens
aaacaaggucuucacagua

SEQ ID NO: 54144 - RNA, 19 nt, Homo sapiens
ggcaucagucucuguauua

SEQ ID NO: 54145 - RNA, 19 nt, Homo sapiens
acugugaagucaacaauaa

SEQ ID NO: 54146 - RNA, 19 nt, Homo sapiens
ccaugaggcugacuggaaa

SEQ ID NO: 54147 - RNA, 19 nt, Homo sapiens
uggcuuaucuucacacaga

SEQ ID NO: 54148 - RNA, 19 nt, Homo sapiens
aaggauggcugaacuuaug

SEQ ID NO: 54149 - RNA, 19 nt, Homo sapiens
gguaagcucuugccgucuu

SEQ ID NO: 54150 - RNA, 19 nt, Homo sapiens
ugacaacauugcccgcuuu

SEQ ID NO: 54151 - RNA, 19 nt, Homo sapiens
ugaagaauguguaguaacu

SEQ ID NO: 54152 - RNA, 19 nt, Homo sapiens
gaucaagaaacgugugaaa

SEQ ID NO: 54153 - RNA, 19 nt, Homo sapiens
ggagauauuuaugagaugu

SEQ ID NO: 54154 - RNA, 19 nt, Homo sapiens
gaggcugacuggaaauaga

SEQ ID NO: 54155 - RNA, 19 nt, Homo sapiens
cauguaugcucuuggacua

SEQ ID NO: 54156 - RNA, 19 nt, Homo sapiens
ccuauggagugaaauuauu

SEQ ID NO: 54157 - RNA, 19 nt, Homo sapiens
aacaaggucuucacaguau

SEQ ID NO: 54158 - RNA, 19 nt, Homo sapiens
gacaggagaccguaaacaa

SEQ ID NO: 54159 - RNA, 19 nt, Homo sapiens
gcaauuucccaucgagauu

SEQ ID NO: 54160 - RNA, 19 nt, Homo sapiens
cuagaggacuggcuuaucu

SEQ ID NO: 54161 - RNA, 19 nt, Homo sapiens
guauuuaagucuccacaca

SEQ ID NO: 54162 - RNA, 19 nt, Homo sapiens
cgaacccucucuugaucua

SEQ ID NO: 54163 - RNA, 19 nt, Homo sapiens
gaauggaacauaccguuuc

SEQ ID NO: 54164 - RNA, 19 nt, Homo sapiens
ucaagccuauggagugaaa

SEQ ID NO: 54165 - RNA, 19 nt, Homo sapiens
gaaugaacugucugugaaa

SEQ ID NO: 54166 - RNA, 19 nt, Homo sapiens
gcucuuggacuaaucuauu

SEQ ID NO: 54167 - RNA, 19 nt, Homo sapiens
agacauguaugcucuugga

SEQ ID NO: 54168 - RNA, 19 nt, Homo sapiens
gcuauggccuuugggagaa

SEQ ID NO: 54169 - RNA, 19 nt, Homo sapiens
gcagauggacgcauggaau

SEQ ID NO: 54170 - RNA, 19 nt, Homo sapiens
uggcugaacuuaugaugau

SEQ ID NO: 54171 - RNA, 19 nt, Homo sapiens
uaagcgagguuggcacuau

SEQ ID NO: 54172 - RNA, 19 nt, Homo sapiens
ccacgaggagaucauuaua

SEQ ID NO: 54173 - RNA, 19 nt, Homo sapiens
cagauggacgcauggaaua

SEQ ID NO: 54174 - RNA, 19 nt, Homo sapiens
uugcaaaccgucagaauuu

SEQ ID NO: 54175 - RNA, 19 nt, Homo sapiens
gaaggaggcacugcuacaa

SEQ ID NO: 54176 - RNA, 19 nt, Homo sapiens
cagaguaccagauggcuuu

SEQ ID NO: 54177 - RNA, 19 nt, Homo sapiens
guagacauguaugcucuug

SEQ ID NO: 54178 - RNA, 19 nt, Homo sapiens
gaacuugagggacugugaa

SEQ ID NO: 54179 - RNA, 19 nt, Homo sapiens
aaugucaacuuuacugaga

SEQ ID NO: 54180 - RNA, 19 nt, Homo sapiens
ugaacugucugugaaaugu

SEQ ID NO: 54181 - RNA, 19 nt, Homo sapiens
aaaacucccuauucucuua

SEQ ID NO: 54182 - RNA, 19 nt, Homo sapiens
caguccaccucauucauuu

SEQ ID NO: 54183 - RNA, 19 nt, Homo sapiens
ugauggaaccuguguuauu

SEQ ID NO: 54184 - RNA, 19 nt, Homo sapiens
aaugauggaaccuguguua

SEQ ID NO: 54185 - RNA, 19 nt, Homo sapiens
ggacuggcuuaucuucaca

SEQ ID NO: 54186 - RNA, 19 nt, Homo sapiens
aauauuugcuugugaugga

SEQ ID NO: 54187 - RNA, 19 nt, Homo sapiens
cagagugccuuugauggaa

SEQ ID NO: 54188 - RNA, 19 nt, Homo sapiens
cuaugaagaauguguagua

SEQ ID NO: 54189 - RNA, 19 nt, Homo sapiens
aacacaagauggcaaauca

SEQ ID NO: 54190 - RNA, 19 nt, Homo sapiens
aauccaaugucuacugcua

SEQ ID NO: 54191 - RNA, 19 nt, Homo sapiens
ucaaggagacaaucgaaga

SEQ ID NO: 54192 - RNA, 19 nt, Homo sapiens
auauuaugcucgaaaggua

SEQ ID NO: 54193 - RNA, 19 nt, Homo sapiens
caacaauaauggcaguaac

SEQ ID NO: 54194 - RNA, 19 nt, Homo sapiens
caaaucaggaucaggugaa

SEQ ID NO: 54195 - RNA, 19 nt, Homo sapiens
guaggugagucaacacaag

SEQ ID NO: 54196 - RNA, 19 nt, Homo sapiens
ggaaaggauggcugaacuu

SEQ ID NO: 54197 - RNA, 19 nt, Homo sapiens
gacaauauuaugcucgaaa

SEQ ID NO: 54198 - RNA, 19 nt, Homo sapiens
gcccaacagucaauccaau

SEQ ID NO: 54199 - RNA, 19 nt, Homo sapiens
gaaaccaucccacuuuuga

SEQ ID NO: 54200 - RNA, 19 nt, Homo sapiens
ggacaauauuaugcucgaa

SEQ ID NO: 54201 - RNA, 19 nt, Homo sapiens
auaguugccuuaugcuuug

SEQ ID NO: 54202 - RNA, 19 nt, Homo sapiens
uggcaucagucucuguauu

SEQ ID NO: 54203 - RNA, 19 nt, Homo sapiens
uaccguuucugcuguugua

SEQ ID NO: 54204 - RNA, 19 nt, Homo sapiens
gucuaaagauauaggaaug

SEQ ID NO: 54205 - RNA, 19 nt, Homo sapiens
ggagacaaucgaagacugu

SEQ ID NO: 54206 - RNA, 19 nt, Homo sapiens
ugggagauauuuaugagau

SEQ ID NO: 54207 - RNA, 19 nt, Homo sapiens
ggacugugaaucagcuuug

SEQ ID NO: 54208 - RNA, 19 nt, Homo sapiens
gacaacauugcccgcuuua

SEQ ID NO: 54209 - RNA, 19 nt, Homo sapiens
aaucauugcuuuggcauca

SEQ ID NO: 54210 - RNA, 19 nt, Homo sapiens
ccacucaguccaccucauu

SEQ ID NO: 54211 - RNA, 19 nt, Homo sapiens
cagggcaguucauuccaaa

SEQ ID NO: 54212 - RNA, 19 nt, Homo sapiens
caagauggcaaaucaggau

SEQ ID NO: 54213 - RNA, 19 nt, Homo sapiens
aaacaaaccuuuccuacua

SEQ ID NO: 54214 - RNA, 19 nt, Homo sapiens
gaaggagcauuuaugguua

SEQ ID NO: 54215 - RNA, 19 nt, Homo sapiens
gagaagagauuaccuuguu

SEQ ID NO: 54216 - RNA, 19 nt, Homo sapiens
gaacaaaguuuccagucaa

SEQ ID NO: 54217 - RNA, 19 nt, Homo sapiens
gaacaaggcaggaaacaaa

SEQ ID NO: 54218 - RNA, 19 nt, Homo sapiens
gaagauaccucgggcaguu

SEQ ID NO: 54219 - RNA, 19 nt, Homo sapiens
guaaggcugugaaugauaa

SEQ ID NO: 54220 - RNA, 19 nt, Homo sapiens
gaaauuaggagugcugaua

SEQ ID NO: 54221 - RNA, 19 nt, Homo sapiens
gaagagagccgaagucagu

SEQ ID NO: 54222 - RNA, 19 nt, Homo sapiens
gagcauuuaugguuagaaa

SEQ ID NO: 54223 - RNA, 19 nt, Homo sapiens
gcuuagagcuugagaguca

SEQ ID NO: 54224 - RNA, 19 nt, Homo sapiens
cuccagagguguuucauua

SEQ ID NO: 54225 - RNA, 19 nt, Homo sapiens
gaacaguuacucagacaaa

SEQ ID NO: 54226 - RNA, 19 nt, Homo sapiens
guaccagucuagcgcaaua

SEQ ID NO: 54227 - RNA, 19 nt, Homo sapiens
guaccacucuagcccaaua

SEQ ID NO: 54228 - RNA, 19 nt, Homo sapiens
gcagacgccuguagagaga

SEQ ID NO: 54229 - RNA, 19 nt, Homo sapiens
aaggaacugucaaacauua

SEQ ID NO: 54230 - RNA, 19 nt, Homo sapiens
gacaagcauugaagaagaa

SEQ ID NO: 54231 - RNA, 19 nt, Homo sapiens
uaaauucuauggagugugu

SEQ ID NO: 54232 - RNA, 19 nt, Homo sapiens
gaagagaaacacagaguuc

SEQ ID NO: 54233 - RNA, 19 nt, Homo sapiens
ggaagcagcccuaugacuu

SEQ ID NO: 54234 - RNA, 19 nt, Homo sapiens
caacaaaggccaacaaggu

SEQ ID NO: 54235 - RNA, 19 nt, Homo sapiens
caacuccugucuuccauug

SEQ ID NO: 54236 - RNA, 19 nt, Homo sapiens
ggacuuggcugcucguaac

SEQ ID NO: 54237 - RNA, 19 nt, Homo sapiens
ggacccacauguauacuuc

SEQ ID NO: 54238 - RNA, 19 nt, Homo sapiens
ggagagucaccaauucaua

SEQ ID NO: 54239 - RNA, 19 nt, Homo sapiens
ccauauacauagugacuga

SEQ ID NO: 54240 - RNA, 19 nt, Homo sapiens
acaguguccuuauuuagua

SEQ ID NO: 54241 - RNA, 19 nt, Homo sapiens
gaagagauuaccuuguuga

SEQ ID NO: 54242 - RNA, 19 nt, Homo sapiens
aagaugggcuucucuaugu

SEQ ID NO: 54243 - RNA, 19 nt, Homo sapiens
gagacuguguucaugugua

SEQ ID NO: 54244 - RNA, 19 nt, Homo sapiens
gaaaguagcaaggcauaau

SEQ ID NO: 54245 - RNA, 19 nt, Homo sapiens
agacaagcauugaagaaga

SEQ ID NO: 54246 - RNA, 19 nt, Homo sapiens
ugaauuaccugaggaguca

SEQ ID NO: 54247 - RNA, 19 nt, Homo sapiens
ggaauucccugagucaagu

SEQ ID NO: 54248 - RNA, 19 nt, Homo sapiens
gaagcagcccuaugacuug

SEQ ID NO: 54249 - RNA, 19 nt, Homo sapiens
caaaugcugagaacaaauu

SEQ ID NO: 54250 - RNA, 19 nt, Homo sapiens
ucaaagauuucaugggaau

SEQ ID NO: 54251 - RNA, 19 nt, Homo sapiens
gaagauguugcaagcagua

SEQ ID NO: 54252 - RNA, 19 nt, Homo sapiens
ggaaugacaagguauguuc

SEQ ID NO: 54253 - RNA, 19 nt, Homo sapiens
gcaguaugauguugcuguu

SEQ ID NO: 54254 - RNA, 19 nt, Homo sapiens
cagauugucuauaaagaug

SEQ ID NO: 54255 - RNA, 19 nt, Homo sapiens
agacugagcagaacugaaa

SEQ ID NO: 54256 - RNA, 19 nt, Homo sapiens
guucauguguaaagacuga

SEQ ID NO: 54257 - RNA, 19 nt, Homo sapiens
gaaaugugcuacgaugucu

SEQ ID NO: 54258 - RNA, 19 nt, Homo sapiens
ggaugauuaugacugguuu

SEQ ID NO: 54259 - RNA, 19 nt, Homo sapiens
aggaaaaccuggaugauua

SEQ ID NO: 54260 - RNA, 19 nt, Homo sapiens
ugacaacgaaucaaagaaa

SEQ ID NO: 54261 - RNA, 19 nt, Homo sapiens
cacaccaccucaaagauuu

SEQ ID NO: 54262 - RNA, 19 nt, Homo sapiens
cagcagcagugaagauguu

SEQ ID NO: 54263 - RNA, 19 nt, Homo sapiens
cagccaccaucuucaagua

SEQ ID NO: 54264 - RNA, 19 nt, Homo sapiens
gaaaugaacaaggcaggaa

SEQ ID NO: 54265 - RNA, 19 nt, Homo sapiens
guagcaaggcauaauguaa

SEQ ID NO: 54266 - RNA, 19 nt, Homo sapiens
ggagugcugauaagaauga

SEQ ID NO: 54267 - RNA, 19 nt, Homo sapiens
ccaagcugguuaaauucua

SEQ ID NO: 54268 - RNA, 19 nt, Homo sapiens
agacuguguucauguguaa

SEQ ID NO: 54269 - RNA, 19 nt, Homo sapiens
aguaugauguugcuguuaa

SEQ ID NO: 54270 - RNA, 19 nt, Homo sapiens
agaaggagcauuuaugguu

SEQ ID NO: 54271 - RNA, 19 nt, Homo sapiens
ugacagcaacucaaagaaa

SEQ ID NO: 54272 - RNA, 19 nt, Homo sapiens
gugcugauaagaaugaaua

SEQ ID NO: 54273 - RNA, 19 nt, Homo sapiens
uuaguaaggcugugaauga

SEQ ID NO: 54274 - RNA, 19 nt, Homo sapiens
gagagacaguacccauuuc

SEQ ID NO: 54275 - RNA, 19 nt, Homo sapiens
aaucagauguguggagaaa

SEQ ID NO: 54276 - RNA, 19 nt, Homo sapiens
uaggagugcugauaagaau

SEQ ID NO: 54277 - RNA, 19 nt, Homo sapiens
gguguuucauuacuucaaa

SEQ ID NO: 54278 - RNA, 19 nt, Homo sapiens
guaucugacuuuggaauga

SEQ ID NO: 54279 - RNA, 19 nt, Homo sapiens
gaaauggaaucugggaacu

SEQ ID NO: 54280 - RNA, 19 nt, Homo sapiens
ggcaguuccuguucucaaa

SEQ ID NO: 54281 - RNA, 19 nt, Homo sapiens
guuaaggacccacauguau

SEQ ID NO: 54282 - RNA, 19 nt, Homo sapiens
caagcugguuaaauucuau

SEQ ID NO: 54283 - RNA, 19 nt, Homo sapiens
caaauuauaccuggcagaa

SEQ ID NO: 54284 - RNA, 19 nt, Homo sapiens
aucacaaucugaacaguua

SEQ ID NO: 54285 - RNA, 19 nt, Homo sapiens
ucacaccaccucaaagauu

SEQ ID NO: 54286 - RNA, 19 nt, Homo sapiens
ucagauguguggagaaagu

SEQ ID NO: 54287 - RNA, 19 nt, Homo sapiens
uacaaaugcugagaacaaa

SEQ ID NO: 54288 - RNA, 19 nt, Homo sapiens
gaucacaaucugaacaguu

SEQ ID NO: 54289 - RNA, 19 nt, Homo sapiens
gcagcccuaugacuuguau

SEQ ID NO: 54290 - RNA, 19 nt, Homo sapiens
ggaauaccccauauacaua

SEQ ID NO: 54291 - RNA, 19 nt, Homo sapiens
uuaaggacccacauguaua

SEQ ID NO: 54292 - RNA, 19 nt, Homo sapiens
cgaagucagugguugaaag

SEQ ID NO: 54293 - RNA, 19 nt, Homo sapiens
agaaaaggauccauugaaa

SEQ ID NO: 54294 - RNA, 19 nt, Homo sapiens
gugcuacgaugucugugaa

SEQ ID NO: 54295 - RNA, 19 nt, Homo sapiens
ugauguugcuguuaagaug

SEQ ID NO: 54296 - RNA, 19 nt, Homo sapiens
gacagcaacucaaagaaaa

SEQ ID NO: 54297 - RNA, 19 nt, Homo sapiens
ggaguguguucaaaggaau

SEQ ID NO: 54298 - RNA, 19 nt, Homo sapiens
gaaaaggggcagcagaaaa

SEQ ID NO: 54299 - RNA, 19 nt, Homo sapiens
aauggaaucugggaacuga

SEQ ID NO: 54300 - RNA, 19 nt, Homo sapiens
uauagagacuguguucaug

SEQ ID NO: 54301 - RNA, 19 nt, Homo sapiens
caauauagagacuguguuc

SEQ ID NO: 54302 - RNA, 19 nt, Homo sapiens
aucccaagcugguuaaauu

SEQ ID NO: 54303 - RNA, 19 nt, Homo sapiens
gcgagucuaaggaugauaa

SEQ ID NO: 54304 - RNA, 19 nt, Homo sapiens
agagagacaguacccauuu

SEQ ID NO: 54305 - RNA, 19 nt, Homo sapiens
ggaaaguagcaaggcauaa

SEQ ID NO: 54306 - RNA, 19 nt, Homo sapiens
gaaaagaaggagcauuuau

SEQ ID NO: 54307 - RNA, 19 nt, Homo sapiens
gcaauaugacagcaacuca

SEQ ID NO: 54308 - RNA, 19 nt, Homo sapiens
gagcagacgccuguagaga

SEQ ID NO: 54309 - RNA, 19 nt, Homo sapiens
uuaugcugcuccugauaua

SEQ ID NO: 54310 - RNA, 19 nt, Homo sapiens
auacaaaugcugagaacaa

SEQ ID NO: 54311 - RNA, 19 nt, Homo sapiens
aaaaggaacugucaaacau

SEQ ID NO: 54312 - RNA, 19 nt, Homo sapiens
ugaaucacaccaccucaaa

SEQ ID NO: 54313 - RNA, 19 nt, Homo sapiens
ggacauaccugcugugaaa

SEQ ID NO: 54314 - RNA, 19 nt, Homo sapiens
gaacgacacucgaaauaug

SEQ ID NO: 54315 - RNA, 19 nt, Homo sapiens
gagcaaggauugagucuga

SEQ ID NO: 54316 - RNA, 19 nt, Homo sapiens
gaugaaggcuccucccaaa

SEQ ID NO: 54317 - RNA, 19 nt, Homo sapiens
ggacuuggcccugcuauuu

SEQ ID NO: 54318 - RNA, 19 nt, Homo sapiens
aaacagaucuugcguaugc

SEQ ID NO: 54319 - RNA, 19 nt, Homo sapiens
cagcugaaaugaugaagaa

SEQ ID NO: 54320 - RNA, 19 nt, Homo sapiens
gaggauucaugggcuauua

SEQ ID NO: 54321 - RNA, 19 nt, Homo sapiens
ggagagagagcaaggauug

SEQ ID NO: 54322 - RNA, 19 nt, Homo sapiens
ggacagagaccgacaacga

SEQ ID NO: 54323 - RNA, 19 nt, Homo sapiens
cgaagaaacuaaacagauc

SEQ ID NO: 54324 - RNA, 19 nt, Homo sapiens
cuaaacagaucuugcguau

SEQ ID NO: 54325 - RNA, 19 nt, Homo sapiens
gaagagagagacagacgaa

SEQ ID NO: 54326 - RNA, 19 nt, Homo sapiens
ggacauggagguggacaua

SEQ ID NO: 54327 - RNA, 19 nt, Homo sapiens
aaagggaacugggauaaga

SEQ ID NO: 54328 - RNA, 19 nt, Homo sapiens
agaaguaacugucaagaag

SEQ ID NO: 54329 - RNA, 19 nt, Homo sapiens
gacaugggaccuucucaua

SEQ ID NO: 54330 - RNA, 19 nt, Homo sapiens
gggcccagcugaaaugaug

SEQ ID NO: 54331 - RNA, 19 nt, Homo sapiens
ggucccagcuugccaguuc

SEQ ID NO: 54332 - RNA, 19 nt, Homo sapiens
ugacgaaccagauguuaaa

SEQ ID NO: 54333 - RNA, 19 nt, Homo sapiens
gagcagggcccagcugaaa

SEQ ID NO: 54334 - RNA, 19 nt, Homo sapiens
gaagaggaacugcuguuuc

SEQ ID NO: 54335 - RNA, 19 nt, Homo sapiens
gaaagaccgagaagccaaa

SEQ ID NO: 54336 - RNA, 19 nt, Homo sapiens
ggaagaggaacugcuguuu

SEQ ID NO: 54337 - RNA, 19 nt, Homo sapiens
gagagagacagacgaagaa

SEQ ID NO: 54338 - RNA, 19 nt, Homo sapiens
caugggaccuucucauauc

SEQ ID NO: 54339 - RNA, 19 nt, Homo sapiens
caucaagccuaucaagaca

SEQ ID NO: 54340 - RNA, 19 nt, Homo sapiens
ggaacgacacucgaaauau

SEQ ID NO: 54341 - RNA, 19 nt, Homo sapiens
cagaagugauccagucuca

SEQ ID NO: 54342 - RNA, 19 nt, Homo sapiens
ggaggaagaggccaagaug

SEQ ID NO: 54343 - RNA, 19 nt, Homo sapiens
gaacuagcaggcacucaau

SEQ ID NO: 54344 - RNA, 19 nt, Homo sapiens
ggauucaugggcuauuaua

SEQ ID NO: 54345 - RNA, 19 nt, Homo sapiens
gacuuggcccugcuauuua

SEQ ID NO: 54346 - RNA, 19 nt, Homo sapiens
gaaagaggagccacgagau

SEQ ID NO: 54347 - RNA, 19 nt, Homo sapiens
gaaggcuccucccaaagca

SEQ ID NO: 54348 - RNA, 19 nt, Homo sapiens
caaggaagagcccaaggaa

SEQ ID NO: 54349 - RNA, 19 nt, Homo sapiens
ggacagguggugcucauca

SEQ ID NO: 54350 - RNA, 19 nt, Homo sapiens
aagaggaacugcuguuucu

SEQ ID NO: 54351 - RNA, 19 nt, Homo sapiens
gucggaagaucaaggaaga

SEQ ID NO: 54352 - RNA, 19 nt, Homo sapiens
gaagaaguaacugucaaga

SEQ ID NO: 54353 - RNA, 19 nt, Homo sapiens
aauaaacguucauguccuu

SEQ ID NO: 54354 - RNA, 19 nt, Homo sapiens
ggaaaacuaccuaaccuuu

SEQ ID NO: 54355 - RNA, 19 nt, Homo sapiens
gaucacaaacaccgguaaa

SEQ ID NO: 54356 - RNA, 19 nt, Homo sapiens
ucaagccuaucaagacaga

SEQ ID NO: 54357 - RNA, 19 nt, Homo sapiens
agacagacgaagaaacuaa

SEQ ID NO: 54358 - RNA, 19 nt, Homo sapiens
gcagggcccagcugaaaug

SEQ ID NO: 54359 - RNA, 19 nt, Homo sapiens
ggaagagcccaaggaagaa

SEQ ID NO: 54360 - RNA, 19 nt, Homo sapiens
ggacaucaagccuaucaag

SEQ ID NO: 54361 - RNA, 19 nt, Homo sapiens
aggaagagcccaaggaaga

SEQ ID NO: 54362 - RNA, 19 nt, Homo sapiens
ucucauaucaucaacauca

SEQ ID NO: 54363 - RNA, 19 nt, Homo sapiens
gggauaagacaguggaugu

SEQ ID NO: 54364 - RNA, 19 nt, Homo sapiens
caacaugucggaaggaaac

SEQ ID NO: 54365 - RNA, 19 nt, Homo sapiens
gaggaagaggccaagauga

SEQ ID NO: 54366 - RNA, 19 nt, Homo sapiens
ggaagaaaaugacgaacca

SEQ ID NO: 54367 - RNA, 19 nt, Homo sapiens
gaagaaacuaaacagaucu

SEQ ID NO: 54368 - RNA, 19 nt, Homo sapiens
gacagguggugcucaucaa

SEQ ID NO: 54369 - RNA, 19 nt, Homo sapiens
gacagacgaagaaacuaaa

SEQ ID NO: 54370 - RNA, 19 nt, Homo sapiens
gauaagacaguggaugugu

SEQ ID NO: 54371 - RNA, 19 nt, Homo sapiens
agaccgagaagccaaauug

SEQ ID NO: 54372 - RNA, 19 nt, Homo sapiens
gaggaacgacacucgaaau

SEQ ID NO: 54373 - RNA, 19 nt, Homo sapiens
uauacuauccgacacaaau

SEQ ID NO: 54374 - RNA, 19 nt, Homo sapiens
gcaaggauugagucugaga

SEQ ID NO: 54375 - RNA, 19 nt, Homo sapiens
gacaucaagccuaucaaga

SEQ ID NO: 54376 - RNA, 19 nt, Homo sapiens
ggaagaaguaacugucaag

SEQ ID NO: 54377 - RNA, 19 nt, Homo sapiens
cuuaaucucuuccacugau

SEQ ID NO: 54378 - RNA, 19 nt, Homo sapiens
ggaagaggccaagaugaag

SEQ ID NO: 54379 - RNA, 19 nt, Homo sapiens
ggcaacaugucggaaggaa

SEQ ID NO: 54380 - RNA, 19 nt, Homo sapiens
gaaaaugacgaaccagaug

SEQ ID NO: 54381 - RNA, 19 nt, Homo sapiens
agagagagacagacgaaga

SEQ ID NO: 54382 - RNA, 19 nt, Homo sapiens
gcugccugcuccagacauu

SEQ ID NO: 54383 - RNA, 19 nt, Homo sapiens
gcaggagaaagaccgagaa

SEQ ID NO: 54384 - RNA, 19 nt, Homo sapiens
ucaucaagcaggagaaaga

SEQ ID NO: 54385 - RNA, 19 nt, Homo sapiens
aggaagaggccaagaugaa

SEQ ID NO: 54386 - RNA, 19 nt, Homo sapiens
gccacgagaugaggaggaa

SEQ ID NO: 54387 - RNA, 19 nt, Homo sapiens
gaccuucucauaucaucaa

SEQ ID NO: 54388 - RNA, 19 nt, Homo sapiens
cccaggacaucaagccuau

SEQ ID NO: 54389 - RNA, 19 nt, Homo sapiens
gaaccagauguuaaaccuu

SEQ ID NO: 54390 - RNA, 19 nt, Homo sapiens
cgaaccagauguuaaaccu

SEQ ID NO: 54391 - RNA, 19 nt, Homo sapiens
aggaacgacacucgaaaua

SEQ ID NO: 54392 - RNA, 19 nt, Homo sapiens
gaaggagaagcgugaaagg

SEQ ID NO: 54393 - RNA, 19 nt, Homo sapiens
gcaacaugucggaaggaaa

SEQ ID NO: 54394 - RNA, 19 nt, Homo sapiens
aaguaacugucaagaagga

SEQ ID NO: 54395 - RNA, 19 nt, Homo sapiens
gacgaagaaacuaaacaga

SEQ ID NO: 54396 - RNA, 19 nt, Homo sapiens
uaucaucagucggaagauc

SEQ ID NO: 54397 - RNA, 19 nt, Homo sapiens
ucaaggaagagcccaagga

SEQ ID NO: 54398 - RNA, 19 nt, Homo sapiens
cagucucacuccaucuuug

SEQ ID NO: 54399 - RNA, 19 nt, Homo sapiens
aaagaggagccacgagaug

SEQ ID NO: 54400 - RNA, 19 nt, Homo sapiens
ccaaggaagaggacaugga

SEQ ID NO: 54401 - RNA, 19 nt, Homo sapiens
cuagcaggcacucaauaaa

SEQ ID NO: 54402 - RNA, 19 nt, Homo sapiens
acuagcaggcacucaauaa

SEQ ID NO: 54403 - RNA, 19 nt, Homo sapiens
ccacugaugcauccuccaa

SEQ ID NO: 54404 - RNA, 19 nt, Homo sapiens
ccaaggaagaaguaacugu

SEQ ID NO: 54405 - RNA, 19 nt, Homo sapiens
gcucaucaagcaggagaaa

SEQ ID NO: 54406 - RNA, 19 nt, Homo sapiens
gguucuguguccuuggaaa

SEQ ID NO: 54407 - RNA, 19 nt, Homo sapiens
aagaaguaacugucaagaa

SEQ ID NO: 54408 - RNA, 19 nt, Homo sapiens
uaccugcugugaaagugaa

SEQ ID NO: 54409 - RNA, 19 nt, Homo sapiens
aggaagaaguaacugucaa

SEQ ID NO: 54410 - RNA, 19 nt, Homo sapiens
gaagagcccaaggaagaag

SEQ ID NO: 54411 - RNA, 19 nt, Homo sapiens
gagagagagcaaggauuga

SEQ ID NO: 54412 - RNA, 19 nt, Homo sapiens
acaaacaccgguaaaauga

SEQ ID NO: 54413 - RNA, 19 nt, Homo sapiens
ggagaucucuuaaggcaaa

SEQ ID NO: 54414 - RNA, 19 nt, Homo sapiens
ccaagagauugucaaauuu

SEQ ID NO: 54415 - RNA, 19 nt, Homo sapiens
gagaagagguaggaagaaa

SEQ ID NO: 54416 - RNA, 19 nt, Homo sapiens
gccggaagcuuaucacaaa

SEQ ID NO: 54417 - RNA, 19 nt, Homo sapiens
ggacaagcuucucaucuuc

SEQ ID NO: 54418 - RNA, 19 nt, Homo sapiens
ggaggaaggucuggcauug

SEQ ID NO: 54419 - RNA, 19 nt, Homo sapiens
gcaguuggcuaaagagcaa

SEQ ID NO: 54420 - RNA, 19 nt, Homo sapiens
gaagaaaggugaugaaaac

SEQ ID NO: 54421 - RNA, 19 nt, Homo sapiens
accaagagauugucaaauu

SEQ ID NO: 54422 - RNA, 19 nt, Homo sapiens
gggaggagaucucuuaagg

SEQ ID NO: 54423 - RNA, 19 nt, Homo sapiens
agacaaagaaucagagaaa

SEQ ID NO: 54424 - RNA, 19 nt, Homo sapiens
cuaaagagcaagacaaaga

SEQ ID NO: 54425 - RNA, 19 nt, Homo sapiens
gaagagagaagagguagga

SEQ ID NO: 54426 - RNA, 19 nt, Homo sapiens
ucagggaggagaucucuua

SEQ ID NO: 54427 - RNA, 19 nt, Homo sapiens
ggauauccgugauuguuca

SEQ ID NO: 54428 - RNA, 19 nt, Homo sapiens
gcgcuacgccuguuucuug

SEQ ID NO: 54429 - RNA, 19 nt, Homo sapiens
acaguugcgucacagaaua

SEQ ID NO: 54430 - RNA, 19 nt, Homo sapiens
gagagaagagguaggaaga

SEQ ID NO: 54431 - RNA, 19 nt, Homo sapiens
ggaaguggagaaucacaaa

SEQ ID NO: 54432 - RNA, 19 nt, Homo sapiens
caagagauugucaaauuug

SEQ ID NO: 54433 - RNA, 19 nt, Homo sapiens
caaagaaucagagaaacaa

SEQ ID NO: 54434 - RNA, 19 nt, Homo sapiens
ggaagcuuaucacaaaaua

SEQ ID NO: 54435 - RNA, 19 nt, Homo sapiens
aagcuaaucucaccugcaa

SEQ ID NO: 54436 - RNA, 19 nt, Homo sapiens
cggacaagcuucucaucuu

SEQ ID NO: 54437 - RNA, 19 nt, Homo sapiens
aaucgacaaucuagagaaa

SEQ ID NO: 54438 - RNA, 19 nt, Homo sapiens
gcuacgguccucuauauug

SEQ ID NO: 54439 - RNA, 19 nt, Homo sapiens
gguccucuauauugugaaa

SEQ ID NO: 54440 - RNA, 19 nt, Homo sapiens
uaaccaagagauugucaaa

SEQ ID NO: 54441 - RNA, 19 nt, Homo sapiens
uaaagagcaagacaaagaa

SEQ ID NO: 54442 - RNA, 19 nt, Homo sapiens
cuacgguccucuauauugu

SEQ ID NO: 54443 - RNA, 19 nt, Homo sapiens
gaagagguaggaagaaagg

SEQ ID NO: 54444 - RNA, 19 nt, Homo sapiens
gcccuuaaaugccagaucu

SEQ ID NO: 54445 - RNA, 19 nt, Homo sapiens
uugcuacgguccucuauau

SEQ ID NO: 54446 - RNA, 19 nt, Homo sapiens
gcccagacauccaguacca

SEQ ID NO: 54447 - RNA, 19 nt, Homo sapiens
gcucuuacugaacugaaua

SEQ ID NO: 54448 - RNA, 19 nt, Homo sapiens
cuacgccuguuucuugcua

SEQ ID NO: 54449 - RNA, 19 nt, Homo sapiens
gaggugaaggcgcuuauuc

SEQ ID NO: 54450 - RNA, 19 nt, Homo sapiens
gccaugcagucucuaguca

SEQ ID NO: 54451 - RNA, 19 nt, Homo sapiens
ccuuucagcuccuguuuca

SEQ ID NO: 54452 - RNA, 19 nt, Homo sapiens
gcaaucgacaaucuagaga

SEQ ID NO: 54453 - RNA, 19 nt, Homo sapiens
uggagcaguuggcuaaaga

SEQ ID NO: 54454 - RNA, 19 nt, Homo sapiens
ggaagaaaggugaugaaaa

SEQ ID NO: 54455 - RNA, 19 nt, Homo sapiens
caggauauccgugauuguu

SEQ ID NO: 54456 - RNA, 19 nt, Homo sapiens
ggcuaaagagcaagacaaa

SEQ ID NO: 54457 - RNA, 19 nt, Homo sapiens
gacaaagaaucagagaaac

SEQ ID NO: 54458 - RNA, 19 nt, Homo sapiens
caagacaaagaaucagaga

SEQ ID NO: 54459 - RNA, 19 nt, Homo sapiens
aaucucaccugcaaaauug

SEQ ID NO: 54460 - RNA, 19 nt, Homo sapiens
cuagucacuucuucacgaa

SEQ ID NO: 54461 - RNA, 19 nt, Homo sapiens
gaaggcgcuuauucaggau

SEQ ID NO: 54462 - RNA, 19 nt, Homo sapiens
guaggaagaaaggugauga

SEQ ID NO: 54463 - RNA, 19 nt, Homo sapiens
gggaggaaggucuggcauu

SEQ ID NO: 54464 - RNA, 19 nt, Homo sapiens
acaaagaaucagagaaaca

SEQ ID NO: 54465 - RNA, 19 nt, Homo sapiens
aagcggcucuuuccauuuu

SEQ ID NO: 54466 - RNA, 19 nt, Homo sapiens
gcucccaucgugcccuuaa

SEQ ID NO: 54467 - RNA, 19 nt, Homo sapiens
ccacacaccccuccguuuu

SEQ ID NO: 54468 - RNA, 19 nt, Homo sapiens
ucccaaaggugccaguucu

SEQ ID NO: 54469 - RNA, 19 nt, Homo sapiens
gaagaauuuaaguccaugu

SEQ ID NO: 54470 - RNA, 19 nt, Homo sapiens
agagcaagacaaagaauca

SEQ ID NO: 54471 - RNA, 19 nt, Homo sapiens
ggccggaagcuuaucacaa

SEQ ID NO: 54472 - RNA, 19 nt, Homo sapiens
caaucuagagaaagcagaa

SEQ ID NO: 54473 - RNA, 19 nt, Homo sapiens
caaucgacaaucuagagaa

SEQ ID NO: 54474 - RNA, 19 nt, Homo sapiens
gcuaaucucaccugcaaaa

SEQ ID NO: 54475 - RNA, 19 nt, Homo sapiens
ggaggugaaggcgcuuauu

SEQ ID NO: 54476 - RNA, 19 nt, Homo sapiens
ccugagcucuaggcugcua

SEQ ID NO: 54477 - RNA, 19 nt, Homo sapiens
ugauuguucaggacccuua

SEQ ID NO: 54478 - RNA, 19 nt, Homo sapiens
agaaucagagaaacaacuu

SEQ ID NO: 54479 - RNA, 19 nt, Homo sapiens
ugcagucucuagucacuuc

SEQ ID NO: 54480 - RNA, 19 nt, Homo sapiens
cuuccaccauugugcacua

SEQ ID NO: 54481 - RNA, 19 nt, Homo sapiens
ucucuuaaggcaaaggaaa

SEQ ID NO: 54482 - RNA, 19 nt, Homo sapiens
ucagcaaucaggccucaug

SEQ ID NO: 54483 - RNA, 19 nt, Homo sapiens
guccacguccggaucugua

SEQ ID NO: 54484 - RNA, 19 nt, Homo sapiens
caugcagucucuagucacu

SEQ ID NO: 54485 - RNA, 19 nt, Homo sapiens
ccaagagauugucaaauuu

SEQ ID NO: 54486 - RNA, 19 nt, Homo sapiens
gccggaagcuuaucacaaa

SEQ ID NO: 54487 - RNA, 19 nt, Homo sapiens
ggacaagcuucucaucuuc

SEQ ID NO: 54488 - RNA, 19 nt, Homo sapiens
gcaguuggcuaaagagcaa

SEQ ID NO: 54489 - RNA, 19 nt, Homo sapiens
accaagagauugucaaauu

SEQ ID NO: 54490 - RNA, 19 nt, Homo sapiens
agacaaagaaucagagaaa

SEQ ID NO: 54491 - RNA, 19 nt, Homo sapiens
cuaaagagcaagacaaaga

SEQ ID NO: 54492 - RNA, 19 nt, Homo sapiens
ggauauccgugauuguuca

SEQ ID NO: 54493 - RNA, 19 nt, Homo sapiens
gcgcuacgccuguuucuug

SEQ ID NO: 54494 - RNA, 19 nt, Homo sapiens
acaguugcgucacagaaua

SEQ ID NO: 54495 - RNA, 19 nt, Homo sapiens
ggaaguggagaaucacaaa

SEQ ID NO: 54496 - RNA, 19 nt, Homo sapiens
caagagauugucaaauuug

SEQ ID NO: 54497 - RNA, 19 nt, Homo sapiens
caaagaaucagagaaacaa

SEQ ID NO: 54498 - RNA, 19 nt, Homo sapiens
ggaagcuuaucacaaaaua

SEQ ID NO: 54499 - RNA, 19 nt, Homo sapiens
cggacaagcuucucaucuu

SEQ ID NO: 54500 - RNA, 19 nt, Homo sapiens
gcuacgguccucuauauug

SEQ ID NO: 54501 - RNA, 19 nt, Homo sapiens
gguccucuauauugugaaa

SEQ ID NO: 54502 - RNA, 19 nt, Homo sapiens
uaaccaagagauugucaaa

SEQ ID NO: 54503 - RNA, 19 nt, Homo sapiens
uaaagagcaagacaaagaa

SEQ ID NO: 54504 - RNA, 19 nt, Homo sapiens
cuacgguccucuauauugu

SEQ ID NO: 54505 - RNA, 19 nt, Homo sapiens
uugcuacgguccucuauau

SEQ ID NO: 54506 - RNA, 19 nt, Homo sapiens
gcccagacauccaguacca

SEQ ID NO: 54507 - RNA, 19 nt, Homo sapiens
gcucuuacugaacugaaua

SEQ ID NO: 54508 - RNA, 19 nt, Homo sapiens
cuacgccuguuucuugcua

SEQ ID NO: 54509 - RNA, 19 nt, Homo sapiens
gccaugcagucucuaguca

SEQ ID NO: 54510 - RNA, 19 nt, Homo sapiens
gaggugaaggcgcuuauuc

SEQ ID NO: 54511 - RNA, 19 nt, Homo sapiens
ccuuucagcuccuguuuca

SEQ ID NO: 54512 - RNA, 19 nt, Homo sapiens
uggagcaguuggcuaaaga

SEQ ID NO: 54513 - RNA, 19 nt, Homo sapiens
caggauauccgugauuguu

SEQ ID NO: 54514 - RNA, 19 nt, Homo sapiens
ggcuaaagagcaagacaaa

SEQ ID NO: 54515 - RNA, 19 nt, Homo sapiens
gacaaagaaucagagaaac

SEQ ID NO: 54516 - RNA, 19 nt, Homo sapiens
caagacaaagaaucagaga

SEQ ID NO: 54517 - RNA, 19 nt, Homo sapiens
gaaggcgcuuauucaggau

SEQ ID NO: 54518 - RNA, 19 nt, Homo sapiens
cuagucacuucuucacgaa

SEQ ID NO: 54519 - RNA, 19 nt, Homo sapiens
acaaagaaucagagaaaca

SEQ ID NO: 54520 - RNA, 19 nt, Homo sapiens
aagcggcucuuuccauuuu

SEQ ID NO: 54521 - RNA, 19 nt, Homo sapiens
ccacacaccccuccguuuu

SEQ ID NO: 54522 - RNA, 19 nt, Homo sapiens
ucccaaaggugccaguucu

SEQ ID NO: 54523 - RNA, 19 nt, Homo sapiens
gaagaauuuaaguccaugu

SEQ ID NO: 54524 - RNA, 19 nt, Homo sapiens
agagcaagacaaagaauca

SEQ ID NO: 54525 - RNA, 19 nt, Homo sapiens
ggccggaagcuuaucacaa

SEQ ID NO: 54526 - RNA, 19 nt, Homo sapiens
ggaggugaaggcgcuuauu

SEQ ID NO: 54527 - RNA, 19 nt, Homo sapiens
ugauuguucaggacccuua

SEQ ID NO: 54528 - RNA, 19 nt, Homo sapiens
ccugagcucuaggcugcua

SEQ ID NO: 54529 - RNA, 19 nt, Homo sapiens
agaaucagagaaacaacuu

SEQ ID NO: 54530 - RNA, 19 nt, Homo sapiens
ugcagucucuagucacuuc

SEQ ID NO: 54531 - RNA, 19 nt, Homo sapiens
guccacguccggaucugua

SEQ ID NO: 54532 - RNA, 19 nt, Homo sapiens
caugcagucucuagucacu

SEQ ID NO: 54533 - RNA, 19 nt, Homo sapiens
ggagaucucuuaaggcaaa

SEQ ID NO: 54534 - RNA, 19 nt, Homo sapiens
ccaagagauugucaaauuu

SEQ ID NO: 54535 - RNA, 19 nt, Homo sapiens
gagaagagguaggaagaaa

SEQ ID NO: 54536 - RNA, 19 nt, Homo sapiens
gccggaagcuuaucacaaa

SEQ ID NO: 54537 - RNA, 19 nt, Homo sapiens
ggacaagcuucucaucuuc

SEQ ID NO: 54538 - RNA, 19 nt, Homo sapiens
ggaggaaggucuggcauug

SEQ ID NO: 54539 - RNA, 19 nt, Homo sapiens
gcaguuggcuaaagagcaa

SEQ ID NO: 54540 - RNA, 19 nt, Homo sapiens
gaagaaaggugaugaaaac

SEQ ID NO: 54541 - RNA, 19 nt, Homo sapiens
accaagagauugucaaauu

SEQ ID NO: 54542 - RNA, 19 nt, Homo sapiens
gaauacagccaguucucua

SEQ ID NO: 54543 - RNA, 19 nt, Homo sapiens
gggaggagaucucuuaagg

SEQ ID NO: 54544 - RNA, 19 nt, Homo sapiens
ucagugaccuggagcaguu

SEQ ID NO: 54545 - RNA, 19 nt, Homo sapiens
agacaaagaaucagagaaa

SEQ ID NO: 54546 - RNA, 19 nt, Homo sapiens
cuaaagagcaagacaaaga

SEQ ID NO: 54547 - RNA, 19 nt, Homo sapiens
gaagagagaagagguagga

SEQ ID NO: 54548 - RNA, 19 nt, Homo sapiens
gacuucaacucuccaacua

SEQ ID NO: 54549 - RNA, 19 nt, Homo sapiens
ucagggaggagaucucuua

SEQ ID NO: 54550 - RNA, 19 nt, Homo sapiens
ggauauccgugauuguuca

SEQ ID NO: 54551 - RNA, 19 nt, Homo sapiens
gcgcuacgccuguuucuug

SEQ ID NO: 54552 - RNA, 19 nt, Homo sapiens
acaguugcgucacagaaua

SEQ ID NO: 54553 - RNA, 19 nt, Homo sapiens
gagagaagagguaggaaga

SEQ ID NO: 54554 - RNA, 19 nt, Homo sapiens
ggaaguggagaaucacaaa

SEQ ID NO: 54555 - RNA, 19 nt, Homo sapiens
gcauuuauuuggacugcuu

SEQ ID NO: 54556 - RNA, 19 nt, Homo sapiens
caagagauugucaaauuug

SEQ ID NO: 54557 - RNA, 19 nt, Homo sapiens
caaagaaucagagaaacaa

SEQ ID NO: 54558 - RNA, 19 nt, Homo sapiens
caacuacaccuguuaccuu

SEQ ID NO: 54559 - RNA, 19 nt, Homo sapiens
caacucagcaugacuucaa

SEQ ID NO: 54560 - RNA, 19 nt, Homo sapiens
ggaagcuuaucacaaaaua

SEQ ID NO: 54561 - RNA, 19 nt, Homo sapiens
aagcuaaucucaccugcaa

SEQ ID NO: 54562 - RNA, 19 nt, Homo sapiens
cggacaagcuucucaucuu

SEQ ID NO: 54563 - RNA, 19 nt, Homo sapiens
aaucgacaaucuagagaaa

SEQ ID NO: 54564 - RNA, 19 nt, Homo sapiens
gcuacgguccucuauauug

SEQ ID NO: 54565 - RNA, 19 nt, Homo sapiens
gguccucuauauugugaaa

SEQ ID NO: 54566 - RNA, 19 nt, Homo sapiens
uaacuuauucccugacaga

SEQ ID NO: 54567 - RNA, 19 nt, Homo sapiens
uaaagagcaagacaaagaa

SEQ ID NO: 54568 - RNA, 19 nt, Homo sapiens
uaaccaagagauugucaaa

SEQ ID NO: 54569 - RNA, 19 nt, Homo sapiens
cuacgguccucuauauugu

SEQ ID NO: 54570 - RNA, 19 nt, Homo sapiens
gaagagguaggaagaaagg

SEQ ID NO: 54571 - RNA, 19 nt, Homo sapiens
gcccuuaaaugccagaucu

SEQ ID NO: 54572 - RNA, 19 nt, Homo sapiens
uugcuacgguccucuauau

SEQ ID NO: 54573 - RNA, 19 nt, Homo sapiens
gcccagacauccaguacca

SEQ ID NO: 54574 - RNA, 19 nt, Homo sapiens
gcucuuacugaacugaaua

SEQ ID NO: 54575 - RNA, 19 nt, Homo sapiens
cuacgccuguuucuugcua

SEQ ID NO: 54576 - RNA, 19 nt, Homo sapiens
gccaugcagucucuaguca

SEQ ID NO: 54577 - RNA, 19 nt, Homo sapiens
gaggugaaggcgcuuauuc

SEQ ID NO: 54578 - RNA, 19 nt, Homo sapiens
ccuuucagcuccuguuuca

SEQ ID NO: 54579 - RNA, 19 nt, Homo sapiens
gcaaucgacaaucuagaga

SEQ ID NO: 54580 - RNA, 19 nt, Homo sapiens
uggagcaguuggcuaaaga

SEQ ID NO: 54581 - RNA, 19 nt, Homo sapiens
ggaagaaaggugaugaaaa

SEQ ID NO: 54582 - RNA, 19 nt, Homo sapiens
caggauauccgugauuguu

SEQ ID NO: 54583 - RNA, 19 nt, Homo sapiens
ggcuaaagagcaagacaaa

SEQ ID NO: 54584 - RNA, 19 nt, Homo sapiens
gacaaagaaucagagaaac

SEQ ID NO: 54585 - RNA, 19 nt, Homo sapiens
caagacaaagaaucagaga

SEQ ID NO: 54586 - RNA, 19 nt, Homo sapiens
cuucaacucuccaacuaca

SEQ ID NO: 54587 - RNA, 19 nt, Homo sapiens
cuuauucccugacagacuu

SEQ ID NO: 54588 - RNA, 19 nt, Homo sapiens
gcuaacuuauucccugaca

SEQ ID NO: 54589 - RNA, 19 nt, Homo sapiens
aaucucaccugcaaaauug

SEQ ID NO: 54590 - RNA, 19 nt, Homo sapiens
cuagucacuucuucacgaa

SEQ ID NO: 54591 - RNA, 19 nt, Homo sapiens
gaaggcgcuuauucaggau

SEQ ID NO: 54592 - RNA, 19 nt, Homo sapiens
guaggaagaaaggugauga

SEQ ID NO: 54593 - RNA, 19 nt, Homo sapiens
gggaggaaggucuggcauu

SEQ ID NO: 54594 - RNA, 19 nt, Homo sapiens
acaaagaaucagagaaaca

SEQ ID NO: 54595 - RNA, 19 nt, Homo sapiens
aagcggcucuuuccauuuu

SEQ ID NO: 54596 - RNA, 19 nt, Homo sapiens
gcucccaucgugcccuuaa

SEQ ID NO: 54597 - RNA, 19 nt, Homo sapiens
uacagccaguucucuauca

SEQ ID NO: 54598 - RNA, 19 nt, Homo sapiens
ccacacaccccuccguuuu

SEQ ID NO: 54599 - RNA, 19 nt, Homo sapiens
ucccaaaggugccaguucu

SEQ ID NO: 54600 - RNA, 19 nt, Homo sapiens
gaagaauuuaaguccaugu

SEQ ID NO: 54601 - RNA, 19 nt, Homo sapiens
agagcaagacaaagaauca

SEQ ID NO: 54602 - RNA, 19 nt, Homo sapiens
ggccggaagcuuaucacaa

SEQ ID NO: 54603 - RNA, 19 nt, Homo sapiens
caaucuagagaaagcagaa

SEQ ID NO: 54604 - RNA, 19 nt, Homo sapiens
caaucgacaaucuagagaa

SEQ ID NO: 54605 - RNA, 19 nt, Homo sapiens
gcuaaucucaccugcaaaa

SEQ ID NO: 54606 - RNA, 19 nt, Homo sapiens
ggaggugaaggcgcuuauu

SEQ ID NO: 54607 - RNA, 19 nt, Homo sapiens
ugauuguucaggacccuua

SEQ ID NO: 54608 - RNA, 19 nt, Homo sapiens
ccugagcucuaggcugcua

SEQ ID NO: 54609 - RNA, 19 nt, Homo sapiens
agaaucagagaaacaacuu

SEQ ID NO: 54610 - RNA, 19 nt, Homo sapiens
ugcagucucuagucacuuc

SEQ ID NO: 54611 - RNA, 19 nt, Homo sapiens
acagccaguucucuaucaa

SEQ ID NO: 54612 - RNA, 19 nt, Homo sapiens
cuuccaccauugugcacua

SEQ ID NO: 54613 - RNA, 19 nt, Homo sapiens
ucucuuaaggcaaaggaaa

SEQ ID NO: 54614 - RNA, 19 nt, Homo sapiens
ucagcaaucaggccucaug

SEQ ID NO: 54615 - RNA, 19 nt, Homo sapiens
ucuccaacuacaccuguua

SEQ ID NO: 54616 - RNA, 19 nt, Homo sapiens
gaaaacuccuggucauucc

SEQ ID NO: 54617 - RNA, 19 nt, Homo sapiens
guccacguccggaucugua

SEQ ID NO: 54618 - RNA, 19 nt, Homo sapiens
caugcagucucuagucacu

SEQ ID NO: 54619 - RNA, 19 nt, Homo sapiens
ccaagagauugucaaauuu

SEQ ID NO: 54620 - RNA, 19 nt, Homo sapiens
gagaagagguaggaagaaa

SEQ ID NO: 54621 - RNA, 19 nt, Homo sapiens
gccggaagcuuaucacaaa

SEQ ID NO: 54622 - RNA, 19 nt, Homo sapiens
ggacaagcuucucaucuuc

SEQ ID NO: 54623 - RNA, 19 nt, Homo sapiens
ggaggaaggucuggcauug

SEQ ID NO: 54624 - RNA, 19 nt, Homo sapiens
gcaguuggcuaaagagcaa

SEQ ID NO: 54625 - RNA, 19 nt, Homo sapiens
gaagaaaggugaugaaaac

SEQ ID NO: 54626 - RNA, 19 nt, Homo sapiens
accaagagauugucaaauu

SEQ ID NO: 54627 - RNA, 19 nt, Homo sapiens
gaauacagccaguucucua

SEQ ID NO: 54628 - RNA, 19 nt, Homo sapiens
ucagugaccuggagcaguu

SEQ ID NO: 54629 - RNA, 19 nt, Homo sapiens
agacaaagaaucagagaaa

SEQ ID NO: 54630 - RNA, 19 nt, Homo sapiens
cuaaagagcaagacaaaga

SEQ ID NO: 54631 - RNA, 19 nt, Homo sapiens
gaagagagaagagguagga

SEQ ID NO: 54632 - RNA, 19 nt, Homo sapiens
gacuucaacucuccaacua

SEQ ID NO: 54633 - RNA, 19 nt, Homo sapiens
ggauauccgugauuguuca

SEQ ID NO: 54634 - RNA, 19 nt, Homo sapiens
gcgcuacgccuguuucuug

SEQ ID NO: 54635 - RNA, 19 nt, Homo sapiens
acaguugcgucacagaaua

SEQ ID NO: 54636 - RNA, 19 nt, Homo sapiens
gagagaagagguaggaaga

SEQ ID NO: 54637 - RNA, 19 nt, Homo sapiens
ggaaguggagaaucacaaa

SEQ ID NO: 54638 - RNA, 19 nt, Homo sapiens
gcauuuauuuggacugcuu

SEQ ID NO: 54639 - RNA, 19 nt, Homo sapiens
caagagauugucaaauuug

SEQ ID NO: 54640 - RNA, 19 nt, Homo sapiens
caaagaaucagagaaacaa

SEQ ID NO: 54641 - RNA, 19 nt, Homo sapiens
caacuacaccuguuaccuu

SEQ ID NO: 54642 - RNA, 19 nt, Homo sapiens
caacucagcaugacuucaa

SEQ ID NO: 54643 - RNA, 19 nt, Homo sapiens
ggaagcuuaucacaaaaua

SEQ ID NO: 54644 - RNA, 19 nt, Homo sapiens
cggacaagcuucucaucuu

SEQ ID NO: 54645 - RNA, 19 nt, Homo sapiens
gcuacgguccucuauauug

SEQ ID NO: 54646 - RNA, 19 nt, Homo sapiens
gguccucuauauugugaaa

SEQ ID NO: 54647 - RNA, 19 nt, Homo sapiens
uaacuuauucccugacaga

SEQ ID NO: 54648 - RNA, 19 nt, Homo sapiens
uaaccaagagauugucaaa

SEQ ID NO: 54649 - RNA, 19 nt, Homo sapiens
uaaagagcaagacaaagaa

SEQ ID NO: 54650 - RNA, 19 nt, Homo sapiens
cuacgguccucuauauugu

SEQ ID NO: 54651 - RNA, 19 nt, Homo sapiens
gaagagguaggaagaaagg

SEQ ID NO: 54652 - RNA, 19 nt, Homo sapiens
gcccuuaaaugccagaucu

SEQ ID NO: 54653 - RNA, 19 nt, Homo sapiens
uugcuacgguccucuauau

SEQ ID NO: 54654 - RNA, 19 nt, Homo sapiens
gcccagacauccaguacca

SEQ ID NO: 54655 - RNA, 19 nt, Homo sapiens
gcucuuacugaacugaaua

SEQ ID NO: 54656 - RNA, 19 nt, Homo sapiens
cuacgccuguuucuugcua

SEQ ID NO: 54657 - RNA, 19 nt, Homo sapiens
gccaugcagucucuaguca

SEQ ID NO: 54658 - RNA, 19 nt, Homo sapiens
gaggugaaggcgcuuauuc

SEQ ID NO: 54659 - RNA, 19 nt, Homo sapiens
ccuuucagcuccuguuuca

SEQ ID NO: 54660 - RNA, 19 nt, Homo sapiens
uggagcaguuggcuaaaga

SEQ ID NO: 54661 - RNA, 19 nt, Homo sapiens
ggaagaaaggugaugaaaa

SEQ ID NO: 54662 - RNA, 19 nt, Homo sapiens
caggauauccgugauuguu

SEQ ID NO: 54663 - RNA, 19 nt, Homo sapiens
ggcuaaagagcaagacaaa

SEQ ID NO: 54664 - RNA, 19 nt, Homo sapiens
gacaaagaaucagagaaac

SEQ ID NO: 54665 - RNA, 19 nt, Homo sapiens
caagacaaagaaucagaga

SEQ ID NO: 54666 - RNA, 19 nt, Homo sapiens
cuucaacucuccaacuaca

SEQ ID NO: 54667 - RNA, 19 nt, Homo sapiens
cuuauucccugacagacuu

SEQ ID NO: 54668 - RNA, 19 nt, Homo sapiens
gcuaacuuauucccugaca

SEQ ID NO: 54669 - RNA, 19 nt, Homo sapiens
gaaggcgcuuauucaggau

SEQ ID NO: 54670 - RNA, 19 nt, Homo sapiens
cuagucacuucuucacgaa

SEQ ID NO: 54671 - RNA, 19 nt, Homo sapiens
guaggaagaaaggugauga

SEQ ID NO: 54672 - RNA, 19 nt, Homo sapiens
gggaggaaggucuggcauu

SEQ ID NO: 54673 - RNA, 19 nt, Homo sapiens
acaaagaaucagagaaaca

SEQ ID NO: 54674 - RNA, 19 nt, Homo sapiens
aagcggcucuuuccauuuu

SEQ ID NO: 54675 - RNA, 19 nt, Homo sapiens
gcucccaucgugcccuuaa

SEQ ID NO: 54676 - RNA, 19 nt, Homo sapiens
uacagccaguucucuauca

SEQ ID NO: 54677 - RNA, 19 nt, Homo sapiens
ccacacaccccuccguuuu

SEQ ID NO: 54678 - RNA, 19 nt, Homo sapiens
ucccaaaggugccaguucu

SEQ ID NO: 54679 - RNA, 19 nt, Homo sapiens
gaagaauuuaaguccaugu

SEQ ID NO: 54680 - RNA, 19 nt, Homo sapiens
agagcaagacaaagaauca

SEQ ID NO: 54681 - RNA, 19 nt, Homo sapiens
ggccggaagcuuaucacaa

SEQ ID NO: 54682 - RNA, 19 nt, Homo sapiens
ggaggugaaggcgcuuauu

SEQ ID NO: 54683 - RNA, 19 nt, Homo sapiens
ccugagcucuaggcugcua

SEQ ID NO: 54684 - RNA, 19 nt, Homo sapiens
ugauuguucaggacccuua

SEQ ID NO: 54685 - RNA, 19 nt, Homo sapiens
agaaucagagaaacaacuu

SEQ ID NO: 54686 - RNA, 19 nt, Homo sapiens
ugcagucucuagucacuuc

SEQ ID NO: 54687 - RNA, 19 nt, Homo sapiens
cuuccaccauugugcacua

SEQ ID NO: 54688 - RNA, 19 nt, Homo sapiens
acagccaguucucuaucaa

SEQ ID NO: 54689 - RNA, 19 nt, Homo sapiens
ucuccaacuacaccuguua

SEQ ID NO: 54690 - RNA, 19 nt, Homo sapiens
gaaaacuccuggucauucc

SEQ ID NO: 54691 - RNA, 19 nt, Homo sapiens
guccacguccggaucugua

SEQ ID NO: 54692 - RNA, 19 nt, Homo sapiens
caugcagucucuagucacu

SEQ ID NO: 54693 - RNA, 19 nt, Homo sapiens
gaagaaauaugcagguaua

SEQ ID NO: 54694 - RNA, 19 nt, Homo sapiens
gcaaauugauagaagguua

SEQ ID NO: 54695 - RNA, 19 nt, Homo sapiens
cagagaaugugaugaguua

SEQ ID NO: 54696 - RNA, 19 nt, Homo sapiens
aaacaagacugaagaaugu

SEQ ID NO: 54697 - RNA, 19 nt, Homo sapiens
guacauccuucuugguuua

SEQ ID NO: 54698 - RNA, 19 nt, Homo sapiens
uuucuaagcugccauauaa

SEQ ID NO: 54699 - RNA, 19 nt, Homo sapiens
ggaaauaaagugagaaaga

SEQ ID NO: 54700 - RNA, 19 nt, Homo sapiens
ggaauuacggguuuguaua

SEQ ID NO: 54701 - RNA, 19 nt, Homo sapiens
gacauuggcucccuggauu

SEQ ID NO: 54702 - RNA, 19 nt, Homo sapiens
gagaaccacacuuuauaua

SEQ ID NO: 54703 - RNA, 19 nt, Homo sapiens
guaaacugauugucaugaa

SEQ ID NO: 54704 - RNA, 19 nt, Homo sapiens
cuucuucggugaaauauuu

SEQ ID NO: 54705 - RNA, 19 nt, Homo sapiens
gauagaagguuacggaaaa

SEQ ID NO: 54706 - RNA, 19 nt, Homo sapiens
gaaggcaauugaacccuau

SEQ ID NO: 54707 - RNA, 19 nt, Homo sapiens
gaauuacggguuuguauau

SEQ ID NO: 54708 - RNA, 19 nt, Homo sapiens
acccaaagaucauguauau

SEQ ID NO: 54709 - RNA, 19 nt, Homo sapiens
caaacaagacugaagaaug

SEQ ID NO: 54710 - RNA, 19 nt, Homo sapiens
gaucaagaacuuaauggaa

SEQ ID NO: 54711 - RNA, 19 nt, Homo sapiens
uagagaaccacacuuuaua

SEQ ID NO: 54712 - RNA, 19 nt, Homo sapiens
aaagaagaauggcaagaug

SEQ ID NO: 54713 - RNA, 19 nt, Homo sapiens
gauggaagguguggaacuu

SEQ ID NO: 54714 - RNA, 19 nt, Homo sapiens
guacugguuugcaaauuuc

SEQ ID NO: 54715 - RNA, 19 nt, Homo sapiens
ugaagaaugugcugaugga

SEQ ID NO: 54716 - RNA, 19 nt, Homo sapiens
ggaauacguuggcauacca

SEQ ID NO: 54717 - RNA, 19 nt, Homo sapiens
gcuguuacaagaccauuua

SEQ ID NO: 54718 - RNA, 19 nt, Homo sapiens
caggaaauguuaucagcaa

SEQ ID NO: 54719 - RNA, 19 nt, Homo sapiens
cuaguuagauugugguguu

SEQ ID NO: 54720 - RNA, 19 nt, Homo sapiens
gcagaaaacuacaugauag

SEQ ID NO: 54721 - RNA, 19 nt, Homo sapiens
ucuuagaacuagaggauuu

SEQ ID NO: 54722 - RNA, 19 nt, Homo sapiens
guauauaagaccacgauuu

SEQ ID NO: 54723 - RNA, 19 nt, Homo sapiens
aaauagagaaccacacuuu

SEQ ID NO: 54724 - RNA, 19 nt, Homo sapiens
ccacaggguugauaugaag

SEQ ID NO: 54725 - RNA, 19 nt, Homo sapiens
ugacuuagauggcuuagac

SEQ ID NO: 54726 - RNA, 19 nt, Homo sapiens
ggcaacagaugguaaacug

SEQ ID NO: 54727 - RNA, 19 nt, Homo sapiens
auagauaccugauggacaa

SEQ ID NO: 54728 - RNA, 19 nt, Homo sapiens
gaaaggcucaauuacugaa

SEQ ID NO: 54729 - RNA, 19 nt, Homo sapiens
ggaaaggcucaauuacuga

SEQ ID NO: 54730 - RNA, 19 nt, Homo sapiens
guguggaacuuaaagaaga

SEQ ID NO: 54731 - RNA, 19 nt, Homo sapiens
gcauaaauggcaaaggaaa

SEQ ID NO: 54732 - RNA, 19 nt, Homo sapiens
guauaugagugcugaguag

SEQ ID NO: 54733 - RNA, 19 nt, Homo sapiens
caagcgcauugcacacuuu

SEQ ID NO: 54734 - RNA, 19 nt, Homo sapiens
gaaaguagucagccuaacu

SEQ ID NO: 54735 - RNA, 19 nt, Homo sapiens
gaugguaaacugauuguca

SEQ ID NO: 54736 - RNA, 19 nt, Homo sapiens
uggaagguguggaacuuaa

SEQ ID NO: 54737 - RNA, 19 nt, Homo sapiens
uguacugguuugcaaauuu

SEQ ID NO: 54738 - RNA, 19 nt, Homo sapiens
aggaaaggcucaauuacug

SEQ ID NO: 54739 - RNA, 19 nt, Homo sapiens
gcagagaaugugaugaguu

SEQ ID NO: 54740 - RNA, 19 nt, Homo sapiens
ugaguaguauugcagagaa

SEQ ID NO: 54741 - RNA, 19 nt, Homo sapiens
guucacugcuguacugguu

SEQ ID NO: 54742 - RNA, 19 nt, Homo sapiens
uggcguauguucaggauug

SEQ ID NO: 54743 - RNA, 19 nt, Homo sapiens
ccaaaauacuuccauauca

SEQ ID NO: 54744 - RNA, 19 nt, Homo sapiens
ggaagaaauaugcagguau

SEQ ID NO: 54745 - RNA, 19 nt, Homo sapiens
caucuucuucggugaaaua

SEQ ID NO: 54746 - RNA, 19 nt, Homo sapiens
ggaaauguuaucagcaaau

SEQ ID NO: 54747 - RNA, 19 nt, Homo sapiens
aagcagauauacuagcuau

SEQ ID NO: 54748 - RNA, 19 nt, Homo sapiens
cacuagaaguuaauggaaa

SEQ ID NO: 54749 - RNA, 19 nt, Homo sapiens
uccgauaccuuuaccagaa

SEQ ID NO: 54750 - RNA, 19 nt, Homo sapiens
ugaacccgguaguuuguuu

SEQ ID NO: 54751 - RNA, 19 nt, Homo sapiens
ugaguuuguucacuuaaug

SEQ ID NO: 54752 - RNA, 19 nt, Homo sapiens
caacagaugguaaacugau

SEQ ID NO: 54753 - RNA, 19 nt, Homo sapiens
cuggguaacuuaggaaauu

SEQ ID NO: 54754 - RNA, 19 nt, Homo sapiens
gcaauugaacccuauaaaa

SEQ ID NO: 54755 - RNA, 19 nt, Homo sapiens
gacacaccgucagagaaua

SEQ ID NO: 54756 - RNA, 19 nt, Homo sapiens
ugauggcucuguauuguca

SEQ ID NO: 54757 - RNA, 19 nt, Homo sapiens
guuuguaguugacauugaa

SEQ ID NO: 54758 - RNA, 19 nt, Homo sapiens
cauggaauacguuggcaua

SEQ ID NO: 54759 - RNA, 19 nt, Homo sapiens
cgucagagaauaguaauga

SEQ ID NO: 54760 - RNA, 19 nt, Homo sapiens
cagaugauuuggaugaaag

SEQ ID NO: 54761 - RNA, 19 nt, Homo sapiens
uaugagugcugaguaguau

SEQ ID NO: 54762 - RNA, 19 nt, Homo sapiens
ugucaugaauacccaaaga

SEQ ID NO: 54763 - RNA, 19 nt, Homo sapiens
uggaagaaauaugcaggua

SEQ ID NO: 54764 - RNA, 19 nt, Homo sapiens
ucagaugauuuggaugaaa

SEQ ID NO: 54765 - RNA, 19 nt, Homo sapiens
accagaagaugauaguauu

SEQ ID NO: 54766 - RNA, 19 nt, Homo sapiens
guuagauugugguguuuau

SEQ ID NO: 54767 - RNA, 19 nt, Homo sapiens
ggaagguguggaacuuaaa

SEQ ID NO: 54768 - RNA, 19 nt, Homo sapiens
ggacauuggcucccuggau

SEQ ID NO: 54769 - RNA, 19 nt, Homo sapiens
gaccacaggguugauauga

SEQ ID NO: 54770 - RNA, 19 nt, Homo sapiens
aaggcucaauuacugaaua

SEQ ID NO: 54771 - RNA, 19 nt, Homo sapiens
gaagaugauaguauugaag

SEQ ID NO: 54772 - RNA, 19 nt, Homo sapiens
gaacuagaggauuuaagca

SEQ ID NO: 54773 - RNA, 19 nt, Homo sapiens
aauagagaaccacacuuua

SEQ ID NO: 54774 - RNA, 19 nt, Homo sapiens
acaguaaguuuggcaucua

SEQ ID NO: 54775 - RNA, 19 nt, Homo sapiens
aaaacaagaugaaccgaaa

SEQ ID NO: 54776 - RNA, 19 nt, Homo sapiens
gaccauuuauuagcucgaa

SEQ ID NO: 54777 - RNA, 19 nt, Homo sapiens
ugggauggcucaggaaaug

SEQ ID NO: 54778 - RNA, 19 nt, Homo sapiens
gaggauggaagguguggaa

SEQ ID NO: 54779 - RNA, 19 nt, Homo sapiens
agucuuagcaucaucauau

SEQ ID NO: 54780 - RNA, 19 nt, Homo sapiens
uguuugaccuaguuagauu

SEQ ID NO: 54781 - RNA, 19 nt, Homo sapiens
uaaagaagaauggcaagau

SEQ ID NO: 54782 - RNA, 19 nt, Homo sapiens
gagaaugugaugaguuauc

SEQ ID NO: 54783 - RNA, 19 nt, Homo sapiens
uuaagcagggucggaauua

SEQ ID NO: 54784 - RNA, 19 nt, Homo sapiens
uggguaacuuaggaaauua

SEQ ID NO: 54785 - RNA, 19 nt, Homo sapiens
ucaauguguaccugucuua

SEQ ID NO: 54786 - RNA, 19 nt, Homo sapiens
augcauaaauggcaaagga

SEQ ID NO: 54787 - RNA, 19 nt, Homo sapiens
ucacugcuguacugguuug

SEQ ID NO: 54788 - RNA, 19 nt, Homo sapiens
cagaagaugauaguauuga

SEQ ID NO: 54789 - RNA, 19 nt, Homo sapiens
uguauauacugggacauuu

SEQ ID NO: 54790 - RNA, 19 nt, Homo sapiens
uaaggcaacagaugguaaa

SEQ ID NO: 54791 - RNA, 19 nt, Homo sapiens
aagcugccauauaagaauu

SEQ ID NO: 54792 - RNA, 19 nt, Homo sapiens
gcauuuauuggcccauauu

SEQ ID NO: 54793 - RNA, 19 nt, Homo sapiens
ggaauuaagucuccgauua

SEQ ID NO: 54794 - RNA, 19 nt, Homo sapiens
gaacugcacuucagcaaua

SEQ ID NO: 54795 - RNA, 19 nt, Homo sapiens
caacauagcucacugaaga

SEQ ID NO: 54796 - RNA, 19 nt, Homo sapiens
gcaaaucugugucuacuuu

SEQ ID NO: 54797 - RNA, 19 nt, Homo sapiens
caacagggcuucugaaaca

SEQ ID NO: 54798 - RNA, 19 nt, Homo sapiens
ggaaagaaguugaaagcau

SEQ ID NO: 54799 - RNA, 19 nt, Homo sapiens
cuucugagcuugcaacaua

SEQ ID NO: 54800 - RNA, 19 nt, Homo sapiens
caugauguguguuguauuu

SEQ ID NO: 54801 - RNA, 19 nt, Homo sapiens
ggaagaugauauugaaaga

SEQ ID NO: 54802 - RNA, 19 nt, Homo sapiens
ggaugcagguugucuacua

SEQ ID NO: 54803 - RNA, 19 nt, Homo sapiens
ccacgucacuuguguuuau

SEQ ID NO: 54804 - RNA, 19 nt, Homo sapiens
cagccucgguuucuauuua

SEQ ID NO: 54805 - RNA, 19 nt, Homo sapiens
caacagaaaccaagauaga

SEQ ID NO: 54806 - RNA, 19 nt, Homo sapiens
ugaggaagaugauauugaa

SEQ ID NO: 54807 - RNA, 19 nt, Homo sapiens
guuaguggauuacuucuga

SEQ ID NO: 54808 - RNA, 19 nt, Homo sapiens
cagcugaaguacuuuauau

SEQ ID NO: 54809 - RNA, 19 nt, Homo sapiens
gaauuaagucuccgauuau

SEQ ID NO: 54810 - RNA, 19 nt, Homo sapiens
acuaaacucuucuugcuuu

SEQ ID NO: 54811 - RNA, 19 nt, Homo sapiens
gaugcagguugucuacuaa

SEQ ID NO: 54812 - RNA, 19 nt, Homo sapiens
gaauuuaauccucuccuuu

SEQ ID NO: 54813 - RNA, 19 nt, Homo sapiens
gaaagaaggaaagaaguug

SEQ ID NO: 54814 - RNA, 19 nt, Homo sapiens
agauagagcuacaaacuca

SEQ ID NO: 54815 - RNA, 19 nt, Homo sapiens
ugauuaaugucuacuguga

SEQ ID NO: 54816 - RNA, 19 nt, Homo sapiens
augaagaacuggagucuga

SEQ ID NO: 54817 - RNA, 19 nt, Homo sapiens
ggccuuauauaucacacua

SEQ ID NO: 54818 - RNA, 19 nt, Homo sapiens
cagguugucuacuaaagaa

SEQ ID NO: 54819 - RNA, 19 nt, Homo sapiens
uuaaauggaugcagguugu

SEQ ID NO: 54820 - RNA, 19 nt, Homo sapiens
acacgagcgucaugaagaa

SEQ ID NO: 54821 - RNA, 19 nt, Homo sapiens
gaaguugaaagcaucuuga

SEQ ID NO: 54822 - RNA, 19 nt, Homo sapiens
caagauagagcuacaaacu

SEQ ID NO: 54823 - RNA, 19 nt, Homo sapiens
gauaugggauuggucaagu

SEQ ID NO: 54824 - RNA, 19 nt, Homo sapiens
aaacucagauuggauaugg

SEQ ID NO: 54825 - RNA, 19 nt, Homo sapiens
cacccuggaugaucaguuu

SEQ ID NO: 54826 - RNA, 19 nt, Homo sapiens
ccauagcauuggagagaaa

SEQ ID NO: 54827 - RNA, 19 nt, Homo sapiens
ucgcagacaccacaagaua

SEQ ID NO: 54828 - RNA, 19 nt, Homo sapiens
gaacacgagcgucaugaag

SEQ ID NO: 54829 - RNA, 19 nt, Homo sapiens
ugaaagaaggaaagaaguu

SEQ ID NO: 54830 - RNA, 19 nt, Homo sapiens
acagauacccauagcauug

SEQ ID NO: 54831 - RNA, 19 nt, Homo sapiens
acacuaaacucuucuugcu

SEQ ID NO: 54832 - RNA, 19 nt, Homo sapiens
augcugcguuccuaauuua

SEQ ID NO: 54833 - RNA, 19 nt, Homo sapiens
guaaaugcugcguuccuaa

SEQ ID NO: 54834 - RNA, 19 nt, Homo sapiens
uuaauccucuccuuugugu

SEQ ID NO: 54835 - RNA, 19 nt, Homo sapiens
gcagguugucuacuaaaga

SEQ ID NO: 54836 - RNA, 19 nt, Homo sapiens
ccuaugggaucaauaagca

SEQ ID NO: 54837 - RNA, 19 nt, Homo sapiens
acaccuaugggaucaauaa

SEQ ID NO: 54838 - RNA, 19 nt, Homo sapiens
caaaucugugucuacuuua

SEQ ID NO: 54839 - RNA, 19 nt, Homo sapiens
acucugcauuggugaauuu

SEQ ID NO: 54840 - RNA, 19 nt, Homo sapiens
aaaccaagauagagcuaca

SEQ ID NO: 54841 - RNA, 19 nt, Homo sapiens
cagauuggauaugggauug

SEQ ID NO: 54842 - RNA, 19 nt, Homo sapiens
caacuuuugugugcuuuua

SEQ ID NO: 54843 - RNA, 19 nt, Homo sapiens
aaugcugcguuccuaauuu

SEQ ID NO: 54844 - RNA, 19 nt, Homo sapiens
uguaaaugcugcguuccua

SEQ ID NO: 54845 - RNA, 19 nt, Homo sapiens
caucucugcugcucucuca

SEQ ID NO: 54846 - RNA, 19 nt, Homo sapiens
ggaacacgagcgucaugaa

SEQ ID NO: 54847 - RNA, 19 nt, Homo sapiens
ugaauuuaauccucuccuu

SEQ ID NO: 54848 - RNA, 19 nt, Homo sapiens
gaaggaaagaaguugaaag

SEQ ID NO: 54849 - RNA, 19 nt, Homo sapiens
aaacagauacccauagcau

SEQ ID NO: 54850 - RNA, 19 nt, Homo sapiens
ucaauaagcaugucagacu

SEQ ID NO: 54851 - RNA, 19 nt, Homo sapiens
gcccgcagcugaagcacau

SEQ ID NO: 54852 - RNA, 19 nt, Homo sapiens
ggguagaacugcacuucag

SEQ ID NO: 54853 - RNA, 19 nt, Homo sapiens
gucaugauguguguuguau

SEQ ID NO: 54854 - RNA, 19 nt, Homo sapiens
gaucaauaagcaugucaga

SEQ ID NO: 54855 - RNA, 19 nt, Homo sapiens
guggauuacuucugagcuu

SEQ ID NO: 54856 - RNA, 19 nt, Homo sapiens
cugcauuggugaauuuaau

SEQ ID NO: 54857 - RNA, 19 nt, Homo sapiens
cgucacuuguguuuauuug

SEQ ID NO: 54858 - RNA, 19 nt, Homo sapiens
uuaagucuccgauuauuag

SEQ ID NO: 54859 - RNA, 19 nt, Homo sapiens
ugaaacagauacccauagc

SEQ ID NO: 54860 - RNA, 19 nt, Homo sapiens
guucguuaguggauuacuu

SEQ ID NO: 54861 - RNA, 19 nt, Homo sapiens
gaugauauugaaagaagga

SEQ ID NO: 54862 - RNA, 19 nt, Homo sapiens
cuaagcaaaucugugucua

SEQ ID NO: 54863 - RNA, 19 nt, Homo sapiens
ggccacgucacuuguguuu

SEQ ID NO: 54864 - RNA, 19 nt, Homo sapiens
ucacugaagagcuguuaga

SEQ ID NO: 54865 - RNA, 19 nt, Homo sapiens
uaaaugcugcguuccuaau

SEQ ID NO: 54866 - RNA, 19 nt, Homo sapiens
uugguucguuaguggauua

SEQ ID NO: 54867 - RNA, 19 nt, Homo sapiens
aaagaaggaaagaaguuga

SEQ ID NO: 54868 - RNA, 19 nt, Homo sapiens
gauauugaaagaaggaaag

SEQ ID NO: 54869 - RNA, 19 nt, Homo sapiens
guacacuaaacucuucuug

SEQ ID NO: 54870 - RNA, 19 nt, Homo sapiens
ucacacuauuguagaaagu

SEQ ID NO: 54871 - RNA, 19 nt, Homo sapiens
auuguggccuuauauauca

SEQ ID NO: 54872 - RNA, 19 nt, Homo sapiens
uauauuggaaggcgucuga

SEQ ID NO: 54873 - RNA, 19 nt, Homo sapiens
gaggaagaugauauugaaa

SEQ ID NO: 54874 - RNA, 19 nt, Homo sapiens
uauaauggagacauggaaa

SEQ ID NO: 54875 - RNA, 19 nt, Homo sapiens
guugucuacuaaagaaaga

SEQ ID NO: 54876 - RNA, 19 nt, Homo sapiens
ucagcugaaguacuuuaua

SEQ ID NO: 54877 - RNA, 19 nt, Homo sapiens
guuccagccucgguuucua

SEQ ID NO: 54878 - RNA, 19 nt, Homo sapiens
gaggaacacgagcgucaug

SEQ ID NO: 54879 - RNA, 19 nt, Homo sapiens
aagcaaaucugugucuacu

SEQ ID NO: 54880 - RNA, 19 nt, Homo sapiens
gccucgguuucuauuuaua

SEQ ID NO: 54881 - RNA, 19 nt, Homo sapiens
cauaaucaacagaaaccaa

SEQ ID NO: 54882 - RNA, 19 nt, Homo sapiens
gcucgcagacaccacaaga

SEQ ID NO: 54883 - RNA, 19 nt, Homo sapiens
gaaacagauacccauagca

SEQ ID NO: 54884 - RNA, 19 nt, Homo sapiens
uaucugcaaccuuaauuca

SEQ ID NO: 54885 - RNA, 19 nt, Homo sapiens
ccucgguuucuauuuauaa

SEQ ID NO: 54886 - RNA, 19 nt, Homo sapiens
aauuuaauccucuccuuug

SEQ ID NO: 54887 - RNA, 19 nt, Homo sapiens
ggacgcacagcaugagucu

SEQ ID NO: 54888 - RNA, 19 nt, Homo sapiens
cgguuucuauuuauaaugg

SEQ ID NO: 54889 - RNA, 19 nt, Homo sapiens
guucguacacuaaacucuu

SEQ ID NO: 54890 - RNA, 19 nt, Homo sapiens
gauuggauaugggauuggu

SEQ ID NO: 54891 - RNA, 19 nt, Homo sapiens
uuacaccuaugggaucaau

SEQ ID NO: 54892 - RNA, 19 nt, Homo sapiens
ucagauuggauaugggauu

SEQ ID NO: 54893 - RNA, 19 nt, Homo sapiens
gcaaugcuauuaucucuaa

SEQ ID NO: 54894 - RNA, 19 nt, Homo sapiens
caacauaacuaccaucucu

SEQ ID NO: 54895 - RNA, 19 nt, Homo sapiens
gaacuugagaccauuguaa

SEQ ID NO: 54896 - RNA, 19 nt, Homo sapiens
ggacucggcuuguuguguu

SEQ ID NO: 54897 - RNA, 19 nt, Homo sapiens
gagaucagguuagcaaaug

SEQ ID NO: 54898 - RNA, 19 nt, Homo sapiens
gacuagaccuguaucauuc

SEQ ID NO: 54899 - RNA, 19 nt, Homo sapiens
gaagcuuuauugucuaguu

SEQ ID NO: 54900 - RNA, 19 nt, Homo sapiens
caacaugaaucaggacaga

SEQ ID NO: 54901 - RNA, 19 nt, Homo sapiens
agaaggaagucgaggcuuu

SEQ ID NO: 54902 - RNA, 19 nt, Homo sapiens
agaagaaguuguagaagga

SEQ ID NO: 54903 - RNA, 19 nt, Homo sapiens
gggcuaggcaucuauauug

SEQ ID NO: 54904 - RNA, 19 nt, Homo sapiens
caaacucuguugaggcauu

SEQ ID NO: 54905 - RNA, 19 nt, Homo sapiens
gaagugguguauugucaca

SEQ ID NO: 54906 - RNA, 19 nt, Homo sapiens
gaagaugggcagaucaugu

SEQ ID NO: 54907 - RNA, 19 nt, Homo sapiens
cacaguagcuuauuugaac

SEQ ID NO: 54908 - RNA, 19 nt, Homo sapiens
gcaaguuucccuaaguuug

SEQ ID NO: 54909 - RNA, 19 nt, Homo sapiens
caacaacaacugcgaggaa

SEQ ID NO: 54910 - RNA, 19 nt, Homo sapiens
ccugugaagugguguauug

SEQ ID NO: 54911 - RNA, 19 nt, Homo sapiens
gcagcaauggcaaugauaa

SEQ ID NO: 54912 - RNA, 19 nt, Homo sapiens
ccaguaacccucaaauuca

SEQ ID NO: 54913 - RNA, 19 nt, Homo sapiens
agaagaagaaguuguagaa

SEQ ID NO: 54914 - RNA, 19 nt, Homo sapiens
caaguuucccuaaguuuga

SEQ ID NO: 54915 - RNA, 19 nt, Homo sapiens
uaacuaccaucucucucuu

SEQ ID NO: 54916 - RNA, 19 nt, Homo sapiens
gcaaaugccaccagcagau

SEQ ID NO: 54917 - RNA, 19 nt, Homo sapiens
gugaagugguguauuguca

SEQ ID NO: 54918 - RNA, 19 nt, Homo sapiens
caaaggcaaguuucccuaa

SEQ ID NO: 54919 - RNA, 19 nt, Homo sapiens
ccaccagacuagaccugua

SEQ ID NO: 54920 - RNA, 19 nt, Homo sapiens
gaacagcagcaauggcaau

SEQ ID NO: 54921 - RNA, 19 nt, Homo sapiens
agacuagaccuguaucauu

SEQ ID NO: 54922 - RNA, 19 nt, Homo sapiens
cagguuagcaaaugaugua

SEQ ID NO: 54923 - RNA, 19 nt, Homo sapiens
caguaacccucaaauucaa

SEQ ID NO: 54924 - RNA, 19 nt, Homo sapiens
cuaggcaucuauauuggaa

SEQ ID NO: 54925 - RNA, 19 nt, Homo sapiens
gaaggaagucgaggcuuug

SEQ ID NO: 54926 - RNA, 19 nt, Homo sapiens
ccaagacaaaggcaaguuu

SEQ ID NO: 54927 - RNA, 19 nt, Homo sapiens
caccagcagauuauaauuu

SEQ ID NO: 54928 - RNA, 19 nt, Homo sapiens
ccauagcucucagucagaa

SEQ ID NO: 54929 - RNA, 19 nt, Homo sapiens
gcaauggcaaugauaaugg

SEQ ID NO: 54930 - RNA, 19 nt, Homo sapiens
cagcagcaauggcaaugau

SEQ ID NO: 54931 - RNA, 19 nt, Homo sapiens
ugacagcccuucgccacaa

SEQ ID NO: 54932 - RNA, 19 nt, Homo sapiens
cagaguuuacuguuguuua

SEQ ID NO: 54933 - RNA, 19 nt, Homo sapiens
agaauuuccuaacagaguu

SEQ ID NO: 54934 - RNA, 19 nt, Homo sapiens
agucgaggcuuugaagaaa

SEQ ID NO: 54935 - RNA, 19 nt, Homo sapiens
acaagaagaugggcagauc

SEQ ID NO: 54936 - RNA, 19 nt, Homo sapiens
uaccaucucucucuuaaaa

SEQ ID NO: 54937 - RNA, 19 nt, Homo sapiens
ggaagucgaggcuuugaag

SEQ ID NO: 54938 - RNA, 19 nt, Homo sapiens
gaaucaggacagaguaguu

SEQ ID NO: 54939 - RNA, 19 nt, Homo sapiens
acuaccaucucucucuuaa

SEQ ID NO: 54940 - RNA, 19 nt, Homo sapiens
agaguuuacuguuguuuag

SEQ ID NO: 54941 - RNA, 19 nt, Homo sapiens
guaacccucaaauucaaua

SEQ ID NO: 54942 - RNA, 19 nt, Homo sapiens
ccaaggaguuccacuucag

SEQ ID NO: 54943 - RNA, 19 nt, Homo sapiens
gcaaugauaauggcaaugg

SEQ ID NO: 54944 - RNA, 19 nt, Homo sapiens
gucagaagaagaaguugua

SEQ ID NO: 54945 - RNA, 19 nt, Homo sapiens
caaaugccaccagcagauu

SEQ ID NO: 54946 - RNA, 19 nt, Homo sapiens
gaauuuccuaacagaguuu

SEQ ID NO: 54947 - RNA, 19 nt, Homo sapiens
gcacaacaacaacaacaac

SEQ ID NO: 54948 - RNA, 19 nt, Homo sapiens
guaagcaugacccaaccua

SEQ ID NO: 54949 - RNA, 19 nt, Homo sapiens
aaaauauccugggcaauaa

SEQ ID NO: 54950 - RNA, 19 nt, Homo sapiens
cggcaaugcuauuaucucu

SEQ ID NO: 54951 - RNA, 19 nt, Homo sapiens
ucacaguagcuuauuugaa

SEQ ID NO: 54952 - RNA, 19 nt, Homo sapiens
gaagucgaggcuuugaaga

SEQ ID NO: 54953 - RNA, 19 nt, Homo sapiens
gcagggaccauagcucuca

SEQ ID NO: 54954 - RNA, 19 nt, Homo sapiens
aaacucuguugaggcauuu

SEQ ID NO: 54955 - RNA, 19 nt, Homo sapiens
gaacacguaccauccucau

SEQ ID NO: 54956 - RNA, 19 nt, Homo sapiens
uauuugaacuugagaccau

SEQ ID NO: 54957 - RNA, 19 nt, Homo sapiens
aaaguggagccaugaagaa

SEQ ID NO: 54958 - RNA, 19 nt, Homo sapiens
cuaaacguucugugucuuu

SEQ ID NO: 54959 - RNA, 19 nt, Homo sapiens
gaagaagaaguuguagaag

SEQ ID NO: 54960 - RNA, 19 nt, Homo sapiens
ucagucagaagaagaaguu

SEQ ID NO: 54961 - RNA, 19 nt, Homo sapiens
ggagacauggagaagauuc

SEQ ID NO: 54962 - RNA, 19 nt, Homo sapiens
aggcaaguuucccuaaguu

SEQ ID NO: 54963 - RNA, 19 nt, Homo sapiens
caagacaaaggcaaguuuc

SEQ ID NO: 54964 - RNA, 19 nt, Homo sapiens
cauguuugauguggaaaug

SEQ ID NO: 54965 - RNA, 19 nt, Homo sapiens
ggaugcacaacaugaauca

SEQ ID NO: 54966 - RNA, 19 nt, Homo sapiens
aaaugccaccagcagauua

SEQ ID NO: 54967 - RNA, 19 nt, Homo sapiens
aacaacaacugcgaggaaa

SEQ ID NO: 54968 - RNA, 19 nt, Homo sapiens
uccaguaacccucaaauuc

SEQ ID NO: 54969 - RNA, 19 nt, Homo sapiens
uagcuuauuugaacuugag

SEQ ID NO: 54970 - RNA, 19 nt, Homo sapiens
gcuuuauugucuaguuguu

SEQ ID NO: 54971 - RNA, 19 nt, Homo sapiens
guagcuuauuugaacuuga

SEQ ID NO: 54972 - RNA, 19 nt, Homo sapiens
aaaugcgugugaccuguga

SEQ ID NO: 54973 - RNA, 19 nt, Homo sapiens
ggaaaagccccuggaaaug

SEQ ID NO: 54974 - RNA, 19 nt, Homo sapiens
aaaggcaaguuucccuaag

SEQ ID NO: 54975 - RNA, 19 nt, Homo sapiens
guggagccaugaagaaagg

SEQ ID NO: 54976 - RNA, 19 nt, Homo sapiens
caaggaguuccacuucaga

SEQ ID NO: 54977 - RNA, 19 nt, Homo sapiens
aagcuuuauugucuaguug

SEQ ID NO: 54978 - RNA, 19 nt, Homo sapiens
aagaagcuuuauugucuag

SEQ ID NO: 54979 - RNA, 19 nt, Homo sapiens
cgagaucagguuagcaaau

SEQ ID NO: 54980 - RNA, 19 nt, Homo sapiens
acauauccaauuccaguaa

SEQ ID NO: 54981 - RNA, 19 nt, Homo sapiens
ccacuucagacacccuaaa

SEQ ID NO: 54982 - RNA, 19 nt, Homo sapiens
ggcaaguuucccuaaguuu

SEQ ID NO: 54983 - RNA, 19 nt, Homo sapiens
cuguaucauucaugguaua

SEQ ID NO: 54984 - RNA, 19 nt, Homo sapiens
ccaccagcagauuauaauu

SEQ ID NO: 54985 - RNA, 19 nt, Homo sapiens
gugguguauugucacagua

SEQ ID NO: 54986 - RNA, 19 nt, Homo sapiens
ucucuuccuuucucauguu

SEQ ID NO: 54987 - RNA, 19 nt, Homo sapiens
aagaugggcagaucauguu

SEQ ID NO: 54988 - RNA, 19 nt, Homo sapiens
caagaagaugggcagauca

SEQ ID NO: 54989 - RNA, 19 nt, Homo sapiens
aaaggcaaggcacaacaaa

SEQ ID NO: 54990 - RNA, 19 nt, Homo sapiens
ucccuaaguuugaguugau

SEQ ID NO: 54991 - RNA, 19 nt, Homo sapiens
ugucggcaaugcuauuauc

SEQ ID NO: 54992 - RNA, 19 nt, Homo sapiens
uagaauuuccuaacagagu

SEQ ID NO: 54993 - RNA, 19 nt, Homo sapiens
gagaaggaauguugcauga

SEQ ID NO: 54994 - RNA, 19 nt, Homo sapiens
gaaggaauguugcaugagu

SEQ ID NO: 54995 - RNA, 19 nt, Homo sapiens
guaauaaacuucuccaaac

SEQ ID NO: 54996 - RNA, 19 nt, Homo sapiens
gcgaugagcuggagaugau

SEQ ID NO: 54997 - RNA, 19 nt, Homo sapiens
gaacaccucucaccugaac

SEQ ID NO: 54998 - RNA, 19 nt, Homo sapiens
gcaagguggugucccugua

SEQ ID NO: 54999 - RNA, 19 nt, Homo sapiens
gcauggcacucaggagaua

SEQ ID NO: 55000 - RNA, 19 nt, Homo sapiens
gcacaugugaggcaucuuu

SEQ ID NO: 55001 - RNA, 19 nt, Homo sapiens
gguaauaaacuucuccaaa

SEQ ID NO: 55002 - RNA, 19 nt, Homo sapiens
ggacucaucgugacauuga

SEQ ID NO: 55003 - RNA, 19 nt, Homo sapiens
aaacagagcguaagguuca

SEQ ID NO: 55004 - RNA, 19 nt, Homo sapiens
guaaacagagcguaagguu

SEQ ID NO: 55005 - RNA, 19 nt, Homo sapiens
acacacagccuucccuuga

SEQ ID NO: 55006 - RNA, 19 nt, Homo sapiens
uauuagggcuccguaagaa

SEQ ID NO: 55007 - RNA, 19 nt, Homo sapiens
guaugacacccacuuguga

SEQ ID NO: 55008 - RNA, 19 nt, Homo sapiens
gcacaucucccugcagucu

SEQ ID NO: 55009 - RNA, 19 nt, Homo sapiens
uaauaaacuucuccaaacg

SEQ ID NO: 55010 - RNA, 19 nt, Homo sapiens
ggagauacaggcuggacau

SEQ ID NO: 55011 - RNA, 19 nt, Homo sapiens
gaucauggacgccuuugac

SEQ ID NO: 55012 - RNA, 19 nt, Homo sapiens
acaccuaacccauggaugu

SEQ ID NO: 55013 - RNA, 19 nt, Homo sapiens
cuacauuucuaggcacaug

SEQ ID NO: 55014 - RNA, 19 nt, Homo sapiens
ucacaugcugguugcuuaa

SEQ ID NO: 55015 - RNA, 19 nt, Homo sapiens
acaucucccugcagucuga

SEQ ID NO: 55016 - RNA, 19 nt, Homo sapiens
ggaucccaguccauuguca

SEQ ID NO: 55017 - RNA, 19 nt, Homo sapiens
uucacaugcugguugcuua

SEQ ID NO: 55018 - RNA, 19 nt, Homo sapiens
caagguggugucccuguau

SEQ ID NO: 55019 - RNA, 19 nt, Homo sapiens
auaaacuucuccaaacgau

SEQ ID NO: 55020 - RNA, 19 nt, Homo sapiens
ggguaggggugguaauaaa

SEQ ID NO: 55021 - RNA, 19 nt, Homo sapiens
gcacaccuaacccauggau

SEQ ID NO: 55022 - RNA, 19 nt, Homo sapiens
gaagagcuguggggacuca

SEQ ID NO: 55023 - RNA, 19 nt, Homo sapiens
cauccucaaacaaccauuu

SEQ ID NO: 55024 - RNA, 19 nt, Homo sapiens
cuugacgccuacauuucua

SEQ ID NO: 55025 - RNA, 19 nt, Homo sapiens
cuauuagggcuccguaaga

SEQ ID NO: 55026 - RNA, 19 nt, Homo sapiens
gaguaugacacccacuugu

SEQ ID NO: 55027 - RNA, 19 nt, Homo sapiens
cgagaucauggacgccuuu

SEQ ID NO: 55028 - RNA, 19 nt, Homo sapiens
ggaacaccucucaccugaa

SEQ ID NO: 55029 - RNA, 19 nt, Homo sapiens
caccugcucucaccugaac

SEQ ID NO: 55030 - RNA, 19 nt, Homo sapiens
caccugcucucaccugaac

SEQ ID NO: 55031 - RNA, 19 nt, Homo sapiens
cugauguccucaagugugu

SEQ ID NO: 55032 - RNA, 19 nt, Homo sapiens
ggucccaucccaggaagaa

SEQ ID NO: 55033 - RNA, 19 nt, Homo sapiens
gcggcgagcagauccugaa

SEQ ID NO: 55034 - RNA, 19 nt, Homo sapiens
gaggguaggggugguaaua

SEQ ID NO: 55035 - RNA, 19 nt, Homo sapiens
cggccgagaaggaauguug

SEQ ID NO: 55036 - RNA, 19 nt, Homo sapiens
gccaggaagucagggucaa

SEQ ID NO: 55037 - RNA, 19 nt, Homo sapiens
gaacaucguuucaggaaua

SEQ ID NO: 55038 - RNA, 19 nt, Homo sapiens
gaaaggaucucuguacuaa

SEQ ID NO: 55039 - RNA, 19 nt, Homo sapiens
gcaaaucacugaaguacua

SEQ ID NO: 55040 - RNA, 19 nt, Homo sapiens
ugagagagcugacauauga

SEQ ID NO: 55041 - RNA, 19 nt, Homo sapiens
gaagagaaccuccugaauu

SEQ ID NO: 55042 - RNA, 19 nt, Homo sapiens
gaaaguguguucagaauca

SEQ ID NO: 55043 - RNA, 19 nt, Homo sapiens
gaacuuauuugguugaaug

SEQ ID NO: 55044 - RNA, 19 nt, Homo sapiens
aaagacagcuucaacagua

SEQ ID NO: 55045 - RNA, 19 nt, Homo sapiens
ggaaagagaugauuugcau

SEQ ID NO: 55046 - RNA, 19 nt, Homo sapiens
gaaggaagccgcugaaaga

SEQ ID NO: 55047 - RNA, 19 nt, Homo sapiens
gauaagggcugaaagugaa

SEQ ID NO: 55048 - RNA, 19 nt, Homo sapiens
caacagugcuugagaauag

SEQ ID NO: 55049 - RNA, 19 nt, Homo sapiens
gaaaggguauucucaacaa

SEQ ID NO: 55050 - RNA, 19 nt, Homo sapiens
gagaaacaguugaaagaaa

SEQ ID NO: 55051 - RNA, 19 nt, Homo sapiens
ccaaagaagcuacugauua

SEQ ID NO: 55052 - RNA, 19 nt, Homo sapiens
gagguuagaccaaucauua

SEQ ID NO: 55053 - RNA, 19 nt, Homo sapiens
gcagguagaugaacuaaca

SEQ ID NO: 55054 - RNA, 19 nt, Homo sapiens
gcagagaaauguagaagau

SEQ ID NO: 55055 - RNA, 19 nt, Homo sapiens
gaagaaagagagacaauga

SEQ ID NO: 55056 - RNA, 19 nt, Homo sapiens
caaaugaacacuugcauaa

SEQ ID NO: 55057 - RNA, 19 nt, Homo sapiens
gaaacaaacuauccagcaa

SEQ ID NO: 55058 - RNA, 19 nt, Homo sapiens
gaaggacuaugaauuacaa

SEQ ID NO: 55059 - RNA, 19 nt, Homo sapiens
ggacacagguuagaaaugu

SEQ ID NO: 55060 - RNA, 19 nt, Homo sapiens
aagagaaccuccugaauuu

SEQ ID NO: 55061 - RNA, 19 nt, Homo sapiens
ggaagccgcugaaagagaa

SEQ ID NO: 55062 - RNA, 19 nt, Homo sapiens
cagcagaucucauuauuca

SEQ ID NO: 55063 - RNA, 19 nt, Homo sapiens
caaagaagcuacugauuac

SEQ ID NO: 55064 - RNA, 19 nt, Homo sapiens
agacaaagcucaugauauc

SEQ ID NO: 55065 - RNA, 19 nt, Homo sapiens
gcaugaacaucaauuaguu

SEQ ID NO: 55066 - RNA, 19 nt, Homo sapiens
gaucagaauugaccgugua

SEQ ID NO: 55067 - RNA, 19 nt, Homo sapiens
gaaggcagcugugggauau

SEQ ID NO: 55068 - RNA, 19 nt, Homo sapiens
gagcugacauaugaacuua

SEQ ID NO: 55069 - RNA, 19 nt, Homo sapiens
gaacaugaaccaagucuau

SEQ ID NO: 55070 - RNA, 19 nt, Homo sapiens
caagaggaaucaguuuaua

SEQ ID NO: 55071 - RNA, 19 nt, Homo sapiens
gaaagaaguuagaaaucug

SEQ ID NO: 55072 - RNA, 19 nt, Homo sapiens
caaaugacagcaccucuua

SEQ ID NO: 55073 - RNA, 19 nt, Homo sapiens
uuacagaacuugcugauuc

SEQ ID NO: 55074 - RNA, 19 nt, Homo sapiens
ggaaaaggcucguuugcua

SEQ ID NO: 55075 - RNA, 19 nt, Homo sapiens
gaaagcagaagaacucaaa

SEQ ID NO: 55076 - RNA, 19 nt, Homo sapiens
gcauuaggcuugacuuugu

SEQ ID NO: 55077 - RNA, 19 nt, Homo sapiens
uaaauuugcuggugauuca

SEQ ID NO: 55078 - RNA, 19 nt, Homo sapiens
caaagacgaugaauguguu

SEQ ID NO: 55079 - RNA, 19 nt, Homo sapiens
gaagcaccauggaaucaaa

SEQ ID NO: 55080 - RNA, 19 nt, Homo sapiens
agagaaaccugauugagaa

SEQ ID NO: 55081 - RNA, 19 nt, Homo sapiens
gaucaugcauguucaguca

SEQ ID NO: 55082 - RNA, 19 nt, Homo sapiens
caagauaacgcaugugaaa

SEQ ID NO: 55083 - RNA, 19 nt, Homo sapiens
gaacagauacccaaagaag

SEQ ID NO: 55084 - RNA, 19 nt, Homo sapiens
ggaagcaaaucauuaccaa

SEQ ID NO: 55085 - RNA, 19 nt, Homo sapiens
ccaaguagguauuauagau

SEQ ID NO: 55086 - RNA, 19 nt, Homo sapiens
caagacgaauuacacuuaa

SEQ ID NO: 55087 - RNA, 19 nt, Homo sapiens
gcagaaaguucagcuacaa

SEQ ID NO: 55088 - RNA, 19 nt, Homo sapiens
gcaagaagcuagugaucuc

SEQ ID NO: 55089 - RNA, 19 nt, Homo sapiens
aggaaucacucaaaguuua

SEQ ID NO: 55090 - RNA, 19 nt, Homo sapiens
gaacagacaaagcucauga

SEQ ID NO: 55091 - RNA, 19 nt, Homo sapiens
agaaauugcuggguauaua

SEQ ID NO: 55092 - RNA, 19 nt, Homo sapiens
gcagaggaguuucggaaga

SEQ ID NO: 55093 - RNA, 19 nt, Homo sapiens
gcagaauaaugaaaccaaa

SEQ ID NO: 55094 - RNA, 19 nt, Homo sapiens
uaaaucaguucaggagaua

SEQ ID NO: 55095 - RNA, 19 nt, Homo sapiens
gaauuugaaucuagucuca

SEQ ID NO: 55096 - RNA, 19 nt, Homo sapiens
gaaauuauggccuuaagga

SEQ ID NO: 55097 - RNA, 19 nt, Homo sapiens
gguauauacuugaauguga

SEQ ID NO: 55098 - RNA, 19 nt, Homo sapiens
caacacugaucaacucuug

SEQ ID NO: 55099 - RNA, 19 nt, Homo sapiens
ucuagugccucaugaauaa

SEQ ID NO: 55100 - RNA, 19 nt, Homo sapiens
gaaggccucaucacacuua

SEQ ID NO: 55101 - RNA, 19 nt, Homo sapiens
gaacuaacagcugccaaua

SEQ ID NO: 55102 - RNA, 19 nt, Homo sapiens
aaacuaaacugugugaaga

SEQ ID NO: 55103 - RNA, 19 nt, Homo sapiens
caauguggcuucaauaaag

SEQ ID NO: 55104 - RNA, 19 nt, Homo sapiens
uaaacugacuuaugcagaa

SEQ ID NO: 55105 - RNA, 19 nt, Homo sapiens
ccaggcagaucaauuggua

SEQ ID NO: 55106 - RNA, 19 nt, Homo sapiens
cugaucaacucuugcauua

SEQ ID NO: 55107 - RNA, 19 nt, Homo sapiens
agucagggaugaugaauuu

SEQ ID NO: 55108 - RNA, 19 nt, Homo sapiens
caaagacuguaccuucaaa

SEQ ID NO: 55109 - RNA, 19 nt, Homo sapiens
gaaacuacaaagagaagua

SEQ ID NO: 55110 - RNA, 19 nt, Homo sapiens
gaaagaaagaacaucguuu

SEQ ID NO: 55111 - RNA, 19 nt, Homo sapiens
gcagggaacuugaaaccau

SEQ ID NO: 55112 - RNA, 19 nt, Homo sapiens
aaagcgcaauuaucaguua

SEQ ID NO: 55113 - RNA, 19 nt, Homo sapiens
uaacgggucuccagcaaga

SEQ ID NO: 55114 - RNA, 19 nt, Homo sapiens
uaaaagagcugccguggaa

SEQ ID NO: 55115 - RNA, 19 nt, Homo sapiens
caagaaagauuugcacagu

SEQ ID NO: 55116 - RNA, 19 nt, Homo sapiens
auacagaagucacaacauu

SEQ ID NO: 55117 - RNA, 19 nt, Homo sapiens
gaacaagcaguaugauaug

SEQ ID NO: 55118 - RNA, 19 nt, Homo sapiens
gaacuugaaaccauuguga

SEQ ID NO: 55119 - RNA, 19 nt, Homo sapiens
gcagaacaguacucagcua

SEQ ID NO: 55120 - RNA, 19 nt, Homo sapiens
ugaagaagaagcaguuaua

SEQ ID NO: 55121 - RNA, 19 nt, Homo sapiens
uagcaaaccuaaugggaaa

SEQ ID NO: 55122 - RNA, 19 nt, Homo sapiens
agaagcuacugauuacuua

SEQ ID NO: 55123 - RNA, 19 nt, Homo sapiens
gugauucuguguuuaguaa

SEQ ID NO: 55124 - RNA, 19 nt, Homo sapiens
gaccuucuuugcauauuaa

SEQ ID NO: 55125 - RNA, 19 nt, Homo sapiens
ggaaaggaucucuguacua

SEQ ID NO: 55126 - RNA, 19 nt, Homo sapiens
uaacgcaugugaaauggaa

SEQ ID NO: 55127 - RNA, 19 nt, Homo sapiens
ucaaagagcaugaacauca

SEQ ID NO: 55128 - RNA, 19 nt, Homo sapiens
gucagaaacuugaggauga

SEQ ID NO: 55129 - RNA, 19 nt, Homo sapiens
cagcacaaaugaacacuug

SEQ ID NO: 55130 - RNA, 19 nt, Homo sapiens
uaagugaguuggaaagaau

SEQ ID NO: 55131 - RNA, 19 nt, Homo sapiens
gaauugagcaacaguauca

SEQ ID NO: 55132 - RNA, 19 nt, Homo sapiens
caacugaagccaaggaauu

SEQ ID NO: 55133 - RNA, 19 nt, Homo sapiens
gaauuggguugaugagaug

SEQ ID NO: 55134 - RNA, 19 nt, Homo sapiens
gaguagagccaaauucauu

SEQ ID NO: 55135 - RNA, 19 nt, Homo sapiens
ggaauccgauguuuggaau

SEQ ID NO: 55136 - RNA, 19 nt, Homo sapiens
gcgacagugugaauuagua

SEQ ID NO: 55137 - RNA, 19 nt, Homo sapiens
ggaaucaacuucugaauuu

SEQ ID NO: 55138 - RNA, 19 nt, Homo sapiens
gaacaucguuucaggaaua

SEQ ID NO: 55139 - RNA, 19 nt, Homo sapiens
gcagaaagcuaugaaauaa

SEQ ID NO: 55140 - RNA, 19 nt, Homo sapiens
gcaaaucacugaaguacua

SEQ ID NO: 55141 - RNA, 19 nt, Homo sapiens
gaacaugacucagaaguuu

SEQ ID NO: 55142 - RNA, 19 nt, Homo sapiens
gcaaagcgauuucaaguug

SEQ ID NO: 55143 - RNA, 19 nt, Homo sapiens
ggaagacacuaagaaauua

SEQ ID NO: 55144 - RNA, 19 nt, Homo sapiens
ggaagacucucaauaagaa

SEQ ID NO: 55145 - RNA, 19 nt, Homo sapiens
gaacaaaacugcaacaaaa

SEQ ID NO: 55146 - RNA, 19 nt, Homo sapiens
aaagagagcugaacuaaau

SEQ ID NO: 55147 - RNA, 19 nt, Homo sapiens
gaaaucaccugccagcaaa

SEQ ID NO: 55148 - RNA, 19 nt, Homo sapiens
gaacacaguuugcugauuc

SEQ ID NO: 55149 - RNA, 19 nt, Homo sapiens
uuaaagaucugguggauaa

SEQ ID NO: 55150 - RNA, 19 nt, Homo sapiens
gaaaguguguucagaauca

SEQ ID NO: 55151 - RNA, 19 nt, Homo sapiens
gaacagacccuaaauguag

SEQ ID NO: 55152 - RNA, 19 nt, Homo sapiens
gcacaaagccuuagaagau

SEQ ID NO: 55153 - RNA, 19 nt, Homo sapiens
ggacaugacugacauaagu

SEQ ID NO: 55154 - RNA, 19 nt, Homo sapiens
gaacuuauuugguugaaug

SEQ ID NO: 55155 - RNA, 19 nt, Homo sapiens
caagaaaucucgagugaug

SEQ ID NO: 55156 - RNA, 19 nt, Homo sapiens
uaacauuucugcacuguaa

SEQ ID NO: 55157 - RNA, 19 nt, Homo sapiens
ggaaacauaugaagaacuu

SEQ ID NO: 55158 - RNA, 19 nt, Homo sapiens
ggaaagagaugauuugcau

SEQ ID NO: 55159 - RNA, 19 nt, Homo sapiens
gaaacuacacuuacugaua

SEQ ID NO: 55160 - RNA, 19 nt, Homo sapiens
ggaaauggaccaacacuuu

SEQ ID NO: 55161 - RNA, 19 nt, Homo sapiens
acacuaaacucuccaaauu

SEQ ID NO: 55162 - RNA, 19 nt, Homo sapiens
gcaauguucuuggaaauaa

SEQ ID NO: 55163 - RNA, 19 nt, Homo sapiens
ccaaagaagcuacugauua

SEQ ID NO: 55164 - RNA, 19 nt, Homo sapiens
ggcaagaacucaaucaauu

SEQ ID NO: 55165 - RNA, 19 nt, Homo sapiens
gcagauuggugauaauaaa

SEQ ID NO: 55166 - RNA, 19 nt, Homo sapiens
gaagaauccuccaauaauc

SEQ ID NO: 55167 - RNA, 19 nt, Homo sapiens
gcaagaacucaaucaauua

SEQ ID NO: 55168 - RNA, 19 nt, Homo sapiens
ucaaagagauagugcaauu

SEQ ID NO: 55169 - RNA, 19 nt, Homo sapiens
ccaaagcuguucaggauaa

SEQ ID NO: 55170 - RNA, 19 nt, Homo sapiens
gaacugaagcagaauguaa

SEQ ID NO: 55171 - RNA, 19 nt, Homo sapiens
gaaggaacagccacaaaua

SEQ ID NO: 55172 - RNA, 19 nt, Homo sapiens
uaaaucagguggagcagua

SEQ ID NO: 55173 - RNA, 19 nt, Homo sapiens
gaaggacuaugaauuacaa

SEQ ID NO: 55174 - RNA, 19 nt, Homo sapiens
ggacacagguuagaaaugu

SEQ ID NO: 55175 - RNA, 19 nt, Homo sapiens
ggaggaagcccuguuauuu

SEQ ID NO: 55176 - RNA, 19 nt, Homo sapiens
gcaaugacaaugccaauaa

SEQ ID NO: 55177 - RNA, 19 nt, Homo sapiens
gcaacuagaaggcaucuua

SEQ ID NO: 55178 - RNA, 19 nt, Homo sapiens
ggaagaaacugaaaaggua

SEQ ID NO: 55179 - RNA, 19 nt, Homo sapiens
cagcagaucucauuauuca

SEQ ID NO: 55180 - RNA, 19 nt, Homo sapiens
caaagaagcuacugauuac

SEQ ID NO: 55181 - RNA, 19 nt, Homo sapiens
agacaaagcucaugauauc

SEQ ID NO: 55182 - RNA, 19 nt, Homo sapiens
gcagguugcuguagagaaa

SEQ ID NO: 55183 - RNA, 19 nt, Homo sapiens
gaacagaacgggacccauu

SEQ ID NO: 55184 - RNA, 19 nt, Homo sapiens
gaggaaauaucaaccaaga

SEQ ID NO: 55185 - RNA, 19 nt, Homo sapiens
ggaggacaguggcuugaua

SEQ ID NO: 55186 - RNA, 19 nt, Homo sapiens
ggagaucgaugcagccauu

SEQ ID NO: 55187 - RNA, 19 nt, Homo sapiens
acaaauaccugaccauguu

SEQ ID NO: 55188 - RNA, 19 nt, Homo sapiens
gaagcagaauguaaacaaa

SEQ ID NO: 55189 - RNA, 19 nt, Homo sapiens
uagcggaacugaacacuaa

SEQ ID NO: 55190 - RNA, 19 nt, Homo sapiens
gaacagaaacuuaaugaag

SEQ ID NO: 55191 - RNA, 19 nt, Homo sapiens
gaacaugaaccaagucuau

SEQ ID NO: 55192 - RNA, 19 nt, Homo sapiens
gcaaugggcugaaacuaca

SEQ ID NO: 55193 - RNA, 19 nt, Homo sapiens
gcagauaaagugaagauuu

SEQ ID NO: 55194 - RNA, 19 nt, Homo sapiens
cagcaaaugucuagagauu

SEQ ID NO: 55195 - RNA, 19 nt, Homo sapiens
caacagcaaucaaggaaga

SEQ ID NO: 55196 - RNA, 19 nt, Homo sapiens
ugaugaaucugaucgauaa

SEQ ID NO: 55197 - RNA, 19 nt, Homo sapiens
ggaagucugugcugccuuu

SEQ ID NO: 55198 - RNA, 19 nt, Homo sapiens
ucaagaaguuuccaaagaa

SEQ ID NO: 55199 - RNA, 19 nt, Homo sapiens
gaaagugcauuaugaaacu

SEQ ID NO: 55200 - RNA, 19 nt, Homo sapiens
gaagauaaggcuuugauug

SEQ ID NO: 55201 - RNA, 19 nt, Homo sapiens
caagaggaaucaguuuaua

SEQ ID NO: 55202 - RNA, 19 nt, Homo sapiens
gacaguggcuugauaacaa

SEQ ID NO: 55203 - RNA, 19 nt, Homo sapiens
gaacacaagccucauauag

SEQ ID NO: 55204 - RNA, 19 nt, Homo sapiens
ggaagaauccuccaauaau

SEQ ID NO: 55205 - RNA, 19 nt, Homo sapiens
caaaugacagcaccucuua

SEQ ID NO: 55206 - RNA, 19 nt, Homo sapiens
gagggaauuugcuaacuuu

SEQ ID NO: 55207 - RNA, 19 nt, Homo sapiens
gcaugggauucucuaaaua

SEQ ID NO: 55208 - RNA, 19 nt, Homo sapiens
cagcagagcccgcagauaa

SEQ ID NO: 55209 - RNA, 19 nt, Homo sapiens
ccaauaaucuaacccaguu

SEQ ID NO: 55210 - RNA, 19 nt, Homo sapiens
gaacaugaaggaacugaaa

SEQ ID NO: 55211 - RNA, 19 nt, Homo sapiens
gagaagaggaugaaguuaa

SEQ ID NO: 55212 - RNA, 19 nt, Homo sapiens
gcagguagcuaaguguaaa

SEQ ID NO: 55213 - RNA, 19 nt, Homo sapiens
gaaagaaggaggaaacuca

SEQ ID NO: 55214 - RNA, 19 nt, Homo sapiens
caaaggagcagcuagauau

SEQ ID NO: 55215 - RNA, 19 nt, Homo sapiens
uaaagucucugcagaagga

SEQ ID NO: 55216 - RNA, 19 nt, Homo sapiens
acacuuaucugaaccuauu

SEQ ID NO: 55217 - RNA, 19 nt, Homo sapiens
ugacaucaaugguuuaaug

SEQ ID NO: 55218 - RNA, 19 nt, Homo sapiens
uaaauuugcuggugauuca

SEQ ID NO: 55219 - RNA, 19 nt, Homo sapiens
caaagacgaugaauguguu

SEQ ID NO: 55220 - RNA, 19 nt, Homo sapiens
agacaaauauugaccaaga

SEQ ID NO: 55221 - RNA, 19 nt, Homo sapiens
gaccauaagggaagaaaua

SEQ ID NO: 55222 - RNA, 19 nt, Homo sapiens
cagcaggccuuauguaaug

SEQ ID NO: 55223 - RNA, 19 nt, Homo sapiens
ugagugacuuggauaauaa

SEQ ID NO: 55224 - RNA, 19 nt, Homo sapiens
gcaauugagugacagaugu

SEQ ID NO: 55225 - RNA, 19 nt, Homo sapiens
caagcaaccuucagaacaa

SEQ ID NO: 55226 - RNA, 19 nt, Homo sapiens
ggaaaguccuggaauugau

SEQ ID NO: 55227 - RNA, 19 nt, Homo sapiens
ugacagaugugacuggauu

SEQ ID NO: 55228 - RNA, 19 nt, Homo sapiens
aggaaucacucaaaguuua

SEQ ID NO: 55229 - RNA, 19 nt, Homo sapiens
gaacagacaaagcucauga

SEQ ID NO: 55230 - RNA, 19 nt, Homo sapiens
agaaauugcuggguauaua

SEQ ID NO: 55231 - RNA, 19 nt, Homo sapiens
cuaaagccauugaaauuga

SEQ ID NO: 55232 - RNA, 19 nt, Homo sapiens
uauugcaggugguaaauua

SEQ ID NO: 55233 - RNA, 19 nt, Homo sapiens
gaacagccacaaauacuga

SEQ ID NO: 55234 - RNA, 19 nt, Homo sapiens
ucaggucucucuacucuaa

SEQ ID NO: 55235 - RNA, 19 nt, Homo sapiens
uaaaucaguucaggagaua

SEQ ID NO: 55236 - RNA, 19 nt, Homo sapiens
gaauuugaaucuagucuca

SEQ ID NO: 55237 - RNA, 19 nt, Homo sapiens
gaacaucguuucaggaaua

SEQ ID NO: 55238 - RNA, 19 nt, Homo sapiens
gaaagggaaugcacaaaua

SEQ ID NO: 55239 - RNA, 19 nt, Homo sapiens
gcaaaucacugaaguacua

SEQ ID NO: 55240 - RNA, 19 nt, Homo sapiens
gcaaugaucuuuguaguaa

SEQ ID NO: 55241 - RNA, 19 nt, Homo sapiens
gagcuucacugcaucauua

SEQ ID NO: 55242 - RNA, 19 nt, Homo sapiens
gcaaguauuucacaugaua

SEQ ID NO: 55243 - RNA, 19 nt, Homo sapiens
ggaauuagguugcuugaga

SEQ ID NO: 55244 - RNA, 19 nt, Homo sapiens
gaaaguguguucagaauca

SEQ ID NO: 55245 - RNA, 19 nt, Homo sapiens
gaaagagcuugaucuguuu

SEQ ID NO: 55246 - RNA, 19 nt, Homo sapiens
gaacuuauuugguugaaug

SEQ ID NO: 55247 - RNA, 19 nt, Homo sapiens
gaaagaaggucauaugaac

SEQ ID NO: 55248 - RNA, 19 nt, Homo sapiens
caacugagauugcuggaaa

SEQ ID NO: 55249 - RNA, 19 nt, Homo sapiens
ggaaagagaugauuugcau

SEQ ID NO: 55250 - RNA, 19 nt, Homo sapiens
gcaaauggauuaggaaaug

SEQ ID NO: 55251 - RNA, 19 nt, Homo sapiens
ggaagaaacauaagcauuu

SEQ ID NO: 55252 - RNA, 19 nt, Homo sapiens
ccaaagaagcuacugauua

SEQ ID NO: 55253 - RNA, 19 nt, Homo sapiens
gaaaugauaacuccaguaa

SEQ ID NO: 55254 - RNA, 19 nt, Homo sapiens
aaagagaaguccacuagua

SEQ ID NO: 55255 - RNA, 19 nt, Homo sapiens
ccaaagagauuagugauga

SEQ ID NO: 55256 - RNA, 19 nt, Homo sapiens
ugaagaagcugucagagaa

SEQ ID NO: 55257 - RNA, 19 nt, Homo sapiens
agaaagagcuugaucuguu

SEQ ID NO: 55258 - RNA, 19 nt, Homo sapiens
gaaggacuaugaauuacaa

SEQ ID NO: 55259 - RNA, 19 nt, Homo sapiens
ggacacagguuagaaaugu

SEQ ID NO: 55260 - RNA, 19 nt, Homo sapiens
gaacuaaagccagaaagua

SEQ ID NO: 55261 - RNA, 19 nt, Homo sapiens
aaacgucacugcugaauga

SEQ ID NO: 55262 - RNA, 19 nt, Homo sapiens
cagcagaucucauuauuca

SEQ ID NO: 55263 - RNA, 19 nt, Homo sapiens
caaagaagcuacugauuac

SEQ ID NO: 55264 - RNA, 19 nt, Homo sapiens
agacaaagcucaugauauc

SEQ ID NO: 55265 - RNA, 19 nt, Homo sapiens
caaaugaacgugcaaauga

SEQ ID NO: 55266 - RNA, 19 nt, Homo sapiens
gaggaaauaucaaccaaga

SEQ ID NO: 55267 - RNA, 19 nt, Homo sapiens
aaagcaaccuuccagaaua

SEQ ID NO: 55268 - RNA, 19 nt, Homo sapiens
gcacaguuguagcucuuua

SEQ ID NO: 55269 - RNA, 19 nt, Homo sapiens
gaacaugaaccaagucuau

SEQ ID NO: 55270 - RNA, 19 nt, Homo sapiens
ucaaggaucuguguaauga

SEQ ID NO: 55271 - RNA, 19 nt, Homo sapiens
ggagguagaauaacauuaa

SEQ ID NO: 55272 - RNA, 19 nt, Homo sapiens
gaagcgaucucauuaaagg

SEQ ID NO: 55273 - RNA, 19 nt, Homo sapiens
ggaaagccauuugucauug

SEQ ID NO: 55274 - RNA, 19 nt, Homo sapiens
guugguagcuuaaguguga

SEQ ID NO: 55275 - RNA, 19 nt, Homo sapiens
uaagaggccucauugacua

SEQ ID NO: 55276 - RNA, 19 nt, Homo sapiens
caagaggaaucaguuuaua

SEQ ID NO: 55277 - RNA, 19 nt, Homo sapiens
caucacaguugguaaauga

SEQ ID NO: 55278 - RNA, 19 nt, Homo sapiens
ugaauugucucagguauuu

SEQ ID NO: 55279 - RNA, 19 nt, Homo sapiens
gaagaugagucugaaauag

SEQ ID NO: 55280 - RNA, 19 nt, Homo sapiens
gaaagugugcuauagauga

SEQ ID NO: 55281 - RNA, 19 nt, Homo sapiens
caaaugacagcaccucuua

SEQ ID NO: 55282 - RNA, 19 nt, Homo sapiens
gaaagccauuugucauuga

SEQ ID NO: 55283 - RNA, 19 nt, Homo sapiens
acaaguaaguugaccuaua

SEQ ID NO: 55284 - RNA, 19 nt, Homo sapiens
gagaugauccuuucuguau

SEQ ID NO: 55285 - RNA, 19 nt, Homo sapiens
guacugagccugauuuaau

SEQ ID NO: 55286 - RNA, 19 nt, Homo sapiens
caagaaggagguagaauaa

SEQ ID NO: 55287 - RNA, 19 nt, Homo sapiens
gaagcuggauaaagugauu

SEQ ID NO: 55288 - RNA, 19 nt, Homo sapiens
uaaauuugcuggugauuca

SEQ ID NO: 55289 - RNA, 19 nt, Homo sapiens
caaagacgaugaauguguu

SEQ ID NO: 55290 - RNA, 19 nt, Homo sapiens
aaagaggcauuacgucuaa

SEQ ID NO: 55291 - RNA, 19 nt, Homo sapiens
gagcuucuccuuaauauau

SEQ ID NO: 55292 - RNA, 19 nt, Homo sapiens
gaugauccuuucuguauug

SEQ ID NO: 55293 - RNA, 19 nt, Homo sapiens
gacauuacuucagacauua

SEQ ID NO: 55294 - RNA, 19 nt, Homo sapiens
ugacauuacuucagacauu

SEQ ID NO: 55295 - RNA, 19 nt, Homo sapiens
uaaagacacugaaucugaa

SEQ ID NO: 55296 - RNA, 19 nt, Homo sapiens
ugaaugaucagcagaauaa

SEQ ID NO: 55297 - RNA, 19 nt, Homo sapiens
caaaugaauuggccuacaa

SEQ ID NO: 55298 - RNA, 19 nt, Homo sapiens
guacuugggugaaggagaa

SEQ ID NO: 55299 - RNA, 19 nt, Homo sapiens
ugaauuagguacugaucua

SEQ ID NO: 55300 - RNA, 19 nt, Homo sapiens
gaagaaggaggagguauaa

SEQ ID NO: 55301 - RNA, 19 nt, Homo sapiens
ggaagaugagucugaaaua

SEQ ID NO: 55302 - RNA, 19 nt, Homo sapiens
gcaguauccucacauauca

SEQ ID NO: 55303 - RNA, 19 nt, Homo sapiens
aggaaucacucaaaguuua

SEQ ID NO: 55304 - RNA, 19 nt, Homo sapiens
gaacagacaaagcucauga

SEQ ID NO: 55305 - RNA, 19 nt, Homo sapiens
agaaauugcuggguauaua

SEQ ID NO: 55306 - RNA, 19 nt, Homo sapiens
gaacaaguaaguugaccua

SEQ ID NO: 55307 - RNA, 19 nt, Homo sapiens
ggauguaaaggauaucuua

SEQ ID NO: 55308 - RNA, 19 nt, Homo sapiens
gaagaaaggaagaguaugu

SEQ ID NO: 55309 - RNA, 19 nt, Homo sapiens
gcagaugccugaagacaag

SEQ ID NO: 55310 - RNA, 19 nt, Homo sapiens
aagcucaucugguguauuu

SEQ ID NO: 55311 - RNA, 19 nt, Homo sapiens
ggaaggcugucaugcagaa

SEQ ID NO: 55312 - RNA, 19 nt, Homo sapiens
uaaaucaguucaggagaua

SEQ ID NO: 55313 - RNA, 19 nt, Homo sapiens
gaauuugaaucuagucuca

SEQ ID NO: 55314 - RNA, 19 nt, Homo sapiens
gaaauuauggccuuaagga

SEQ ID NO: 55315 - RNA, 19 nt, Homo sapiens
gguauauacuugaauguga

SEQ ID NO: 55316 - RNA, 19 nt, Homo sapiens
caacacugaucaacucuug

SEQ ID NO: 55317 - RNA, 19 nt, Homo sapiens
caaguaaguugaccuauac

SEQ ID NO: 55318 - RNA, 19 nt, Homo sapiens
ggaaacuacuauucuccua

SEQ ID NO: 55319 - RNA, 19 nt, Homo sapiens
gcaaagaaggaaacuacua

SEQ ID NO: 55320 - RNA, 19 nt, Homo sapiens
acacaaagguuaaguugau

SEQ ID NO: 55321 - RNA, 19 nt, Homo sapiens
caaugauucuucuggauaa

SEQ ID NO: 55322 - RNA, 19 nt, Homo sapiens
gcaguacagugugauuuaa

SEQ ID NO: 55323 - RNA, 19 nt, Homo sapiens
aagaaugacuguugaagaa

SEQ ID NO: 55324 - RNA, 19 nt, Homo sapiens
aaacuaaacugugugaaga

SEQ ID NO: 55325 - RNA, 19 nt, Homo sapiens
caauguggcuucaauaaag

SEQ ID NO: 55326 - RNA, 19 nt, Homo sapiens
uaaacugacuuaugcagaa

SEQ ID NO: 55327 - RNA, 19 nt, Homo sapiens
ccaggcagaucaauuggua

SEQ ID NO: 55328 - RNA, 19 nt, Homo sapiens
cugaucaacucuugcauua

SEQ ID NO: 55329 - RNA, 19 nt, Homo sapiens
gaaggaaacuacuauucuc

SEQ ID NO: 55330 - RNA, 19 nt, Homo sapiens
aaaguugacucaucucuug

SEQ ID NO: 55331 - RNA, 19 nt, Homo sapiens
guauguaacuggacaggaa

SEQ ID NO: 55332 - RNA, 19 nt, Homo sapiens
aaagagagcuucacugcau

SEQ ID NO: 55333 - RNA, 19 nt, Homo sapiens
caacaacacagcaucaauu

SEQ ID NO: 55334 - RNA, 19 nt, Homo sapiens
gaaagaaagaacaucguuu

SEQ ID NO: 55335 - RNA, 19 nt, Homo sapiens
cacauugucuucaggauuu

SEQ ID NO: 55336 - RNA, 19 nt, Homo sapiens
guugucaggucaaagaaua

SEQ ID NO: 55337 - RNA, 19 nt, Homo sapiens
guagugaacucguacaaug

SEQ ID NO: 55338 - RNA, 19 nt, Homo sapiens
cuacugggcucgucucuuu

SEQ ID NO: 55339 - RNA, 19 nt, Homo sapiens
aaagcuguguucagaguua

SEQ ID NO: 55340 - RNA, 19 nt, Homo sapiens
guucagaguuaggagaaua

SEQ ID NO: 55341 - RNA, 19 nt, Homo sapiens
agaaagggacggaccaaua

SEQ ID NO: 55342 - RNA, 19 nt, Homo sapiens
aagaagggcuggcaaaaua

SEQ ID NO: 55343 - RNA, 19 nt, Homo sapiens
gaaagggacggaccaauac

SEQ ID NO: 55344 - RNA, 19 nt, Homo sapiens
gaagauuugcguuagaguu

SEQ ID NO: 55345 - RNA, 19 nt, Homo sapiens
gaaguauuguggccuugga

SEQ ID NO: 55346 - RNA, 19 nt, Homo sapiens
agagagaacuagagcacuu

SEQ ID NO: 55347 - RNA, 19 nt, Homo sapiens
uacuguagcuuguuguuug

SEQ ID NO: 55348 - RNA, 19 nt, Homo sapiens
ccauagaccugguuguacu

SEQ ID NO: 55349 - RNA, 19 nt, Homo sapiens
ucaccucccugaccucugu

SEQ ID NO: 55350 - RNA, 19 nt, Homo sapiens
ucgcgaaguucccguucua

SEQ ID NO: 55351 - RNA, 19 nt, Homo sapiens
ccuugucguucccgaauaa

SEQ ID NO: 55352 - RNA, 19 nt, Homo sapiens
ggaccaaauuuucuagaga

SEQ ID NO: 55353 - RNA, 19 nt, Homo sapiens
ugaaagaucgguggaacuu

SEQ ID NO: 55354 - RNA, 19 nt, Homo sapiens
ggaccaauacguguguuug

SEQ ID NO: 55355 - RNA, 19 nt, Homo sapiens
gagagaacuagagcacuuu

SEQ ID NO: 55356 - RNA, 19 nt, Homo sapiens
guuaggagaauauauccaa

SEQ ID NO: 55357 - RNA, 19 nt, Homo sapiens
aagauuugcguuagaguuu

SEQ ID NO: 55358 - RNA, 19 nt, Homo sapiens
ccgaauaaauuuuguguuc

SEQ ID NO: 55359 - RNA, 19 nt, Homo sapiens
caacgagugcuucaucaag

SEQ ID NO: 55360 - RNA, 19 nt, Homo sapiens
guacuguagcuuguuguuu

SEQ ID NO: 55361 - RNA, 19 nt, Homo sapiens
guuguacuguagcuuguug

SEQ ID NO: 55362 - RNA, 19 nt, Homo sapiens
gcuccugucgcuccucuuu

SEQ ID NO: 55363 - RNA, 19 nt, Homo sapiens
gggaaggagaaaugugaaa

SEQ ID NO: 55364 - RNA, 19 nt, Homo sapiens
uuucaaaccuccugcuucu

SEQ ID NO: 55365 - RNA, 19 nt, Homo sapiens
gcagaccucuuggccuucu

SEQ ID NO: 55366 - RNA, 19 nt, Homo sapiens
ccuuggaguuugcuaaauc

SEQ ID NO: 55367 - RNA, 19 nt, Homo sapiens
caugaugcauugcucuuac

SEQ ID NO: 55368 - RNA, 19 nt, Homo sapiens
gcagucuccagaaguuuga

SEQ ID NO: 55369 - RNA, 19 nt, Homo sapiens
gaacccucuugaagcuguu

SEQ ID NO: 55370 - RNA, 19 nt, Homo sapiens
ccaugaugcauugcucuua

SEQ ID NO: 55371 - RNA, 19 nt, Homo sapiens
gagcucgccaugaugcauu

SEQ ID NO: 55372 - RNA, 19 nt, Homo sapiens
agaccugguuguacuguag

SEQ ID NO: 55373 - RNA, 19 nt, Homo sapiens
ugucguucccgaauaaauu

SEQ ID NO: 55374 - RNA, 19 nt, Homo sapiens
gcuuuaguauuccucaucu

SEQ ID NO: 55375 - RNA, 19 nt, Homo sapiens
uguccggcaucuaccagua

SEQ ID NO: 55376 - RNA, 19 nt, Homo sapiens
caaauucaccgcggaaagg

SEQ ID NO: 55377 - RNA, 19 nt, Homo sapiens
guuugagacuuggccguaa

SEQ ID NO: 55378 - RNA, 19 nt, Homo sapiens
cagcgucuccugcccaaau

SEQ ID NO: 55379 - RNA, 19 nt, Homo sapiens
aauaagaagggcuggcaaa

SEQ ID NO: 55380 - RNA, 19 nt, Homo sapiens
ucuacgagaagaauaagaa

SEQ ID NO: 55381 - RNA, 19 nt, Homo sapiens
gccuugucguucccgaaua

SEQ ID NO: 55382 - RNA, 19 nt, Homo sapiens
cgaaguucccguucuacga

SEQ ID NO: 55383 - RNA, 19 nt, Homo sapiens
gagcacuuuuguuguguuu

SEQ ID NO: 55384 - RNA, 19 nt, Homo sapiens
agaguuaggagaauauauc

SEQ ID NO: 55385 - RNA, 19 nt, Homo sapiens
uggcuaauguuuuguuuga

SEQ ID NO: 55386 - RNA, 19 nt, Homo sapiens
cagucuggcuuccucaaca

SEQ ID NO: 55387 - RNA, 19 nt, Homo sapiens
guacaucaucgcgaaguuc

SEQ ID NO: 55388 - RNA, 19 nt, Homo sapiens
gaacuagagcacuuuuguu

SEQ ID NO: 55389 - RNA, 19 nt, Homo sapiens
ggccuuggaguuugcuaaa

SEQ ID NO: 55390 - RNA, 19 nt, Homo sapiens
ggaaggagaaaugugaaac

SEQ ID NO: 55391 - RNA, 19 nt, Homo sapiens
uaaaagaugguuucgucua

SEQ ID NO: 55392 - RNA, 19 nt, Homo sapiens
uauuguggccuuggaguuu

SEQ ID NO: 55393 - RNA, 19 nt, Homo sapiens
gucguucccgaauaaauuu

SEQ ID NO: 55394 - RNA, 19 nt, Homo sapiens
uagaccugguuguacugua

SEQ ID NO: 55395 - RNA, 19 nt, Homo sapiens
gagaaagggacggaccaau

SEQ ID NO: 55396 - RNA, 19 nt, Homo sapiens
cuagagcacuuuuguugug

SEQ ID NO: 55397 - RNA, 19 nt, Homo sapiens
gcaucuaccaguacaucau

SEQ ID NO: 55398 - RNA, 19 nt, Homo sapiens
gccacaaccucagccucaa

SEQ ID NO: 55399 - RNA, 19 nt, Homo sapiens
ucagaguuaggagaauaua

SEQ ID NO: 55400 - RNA, 19 nt, Homo sapiens
cuggaagauuugcguuaga

SEQ ID NO: 55401 - RNA, 19 nt, Homo sapiens
ucuggaagauuugcguuag

SEQ ID NO: 55402 - RNA, 19 nt, Homo sapiens
ugaccucugugaccuugca

SEQ ID NO: 55403 - RNA, 19 nt, Homo sapiens
gaaggagaaaugugaaacc

SEQ ID NO: 55404 - RNA, 19 nt, Homo sapiens
guauuguggccuuggaguu

SEQ ID NO: 55405 - RNA, 19 nt, Homo sapiens
ccaaauucaccgcggaaag

SEQ ID NO: 55406 - RNA, 19 nt, Homo sapiens
cauccgcagucuccagaag

SEQ ID NO: 55407 - RNA, 19 nt, Homo sapiens
gaagacaucaucaacauua

SEQ ID NO: 55408 - RNA, 19 nt, Homo sapiens
guaacuagguaacuuauug

SEQ ID NO: 55409 - RNA, 19 nt, Homo sapiens
gaaagcuccuggcgucuaa

SEQ ID NO: 55410 - RNA, 19 nt, Homo sapiens
gagaugaaguuaaagguau

SEQ ID NO: 55411 - RNA, 19 nt, Homo sapiens
gaaaguagaagaucaagga

SEQ ID NO: 55412 - RNA, 19 nt, Homo sapiens
ggaauaaggagaaccguuu

SEQ ID NO: 55413 - RNA, 19 nt, Homo sapiens
uuagagacauccuucauuu

SEQ ID NO: 55414 - RNA, 19 nt, Homo sapiens
ggaggaagcucggaacugu

SEQ ID NO: 55415 - RNA, 19 nt, Homo sapiens
ggucauaaguuucugagau

SEQ ID NO: 55416 - RNA, 19 nt, Homo sapiens
gaacuuuggguaccuguaa

SEQ ID NO: 55417 - RNA, 19 nt, Homo sapiens
gaccggagguauaaaguau

SEQ ID NO: 55418 - RNA, 19 nt, Homo sapiens
ugacagaaaugacaacaag

SEQ ID NO: 55419 - RNA, 19 nt, Homo sapiens
gcacuauucuaaucaguag

SEQ ID NO: 55420 - RNA, 19 nt, Homo sapiens
gaugggagagcaacaagua

SEQ ID NO: 55421 - RNA, 19 nt, Homo sapiens
gcagauggcuuugaaucau

SEQ ID NO: 55422 - RNA, 19 nt, Homo sapiens
gauaucugcucauggaaau

SEQ ID NO: 55423 - RNA, 19 nt, Homo sapiens
uaaaugagcgucacuaugg

SEQ ID NO: 55424 - RNA, 19 nt, Homo sapiens
gggagcagauggcuuugaa

SEQ ID NO: 55425 - RNA, 19 nt, Homo sapiens
gagcuaggcuguggaguag

SEQ ID NO: 55426 - RNA, 19 nt, Homo sapiens
aaggauugcucccgaagua

SEQ ID NO: 55427 - RNA, 19 nt, Homo sapiens
ggagagggugcuuggaaua

SEQ ID NO: 55428 - RNA, 19 nt, Homo sapiens
gaaguucagccaucaguau

SEQ ID NO: 55429 - RNA, 19 nt, Homo sapiens
uugcuguccuugaauauua

SEQ ID NO: 55430 - RNA, 19 nt, Homo sapiens
gaguagaguuuguauaggu

SEQ ID NO: 55431 - RNA, 19 nt, Homo sapiens
ccaagcagccauuaagaaa

SEQ ID NO: 55432 - RNA, 19 nt, Homo sapiens
gugaggcucuggagaagaa

SEQ ID NO: 55433 - RNA, 19 nt, Homo sapiens
gagaaagucacagauauau

SEQ ID NO: 55434 - RNA, 19 nt, Homo sapiens
caaaagaaguggcauagga

SEQ ID NO: 55435 - RNA, 19 nt, Homo sapiens
ugagaaagucacagauaua

SEQ ID NO: 55436 - RNA, 19 nt, Homo sapiens
gacaggcacuauucuaauc

SEQ ID NO: 55437 - RNA, 19 nt, Homo sapiens
uaggaugccucagugcuua

SEQ ID NO: 55438 - RNA, 19 nt, Homo sapiens
caagugaggcucuggagaa

SEQ ID NO: 55439 - RNA, 19 nt, Homo sapiens
gaaucauggugaagaacaa

SEQ ID NO: 55440 - RNA, 19 nt, Homo sapiens
gaagcaacucaaagcguua

SEQ ID NO: 55441 - RNA, 19 nt, Homo sapiens
gaucuuguauucacaucug

SEQ ID NO: 55442 - RNA, 19 nt, Homo sapiens
ugaguuugaucuuguauuc

SEQ ID NO: 55443 - RNA, 19 nt, Homo sapiens
gagagacuccuucccuauu

SEQ ID NO: 55444 - RNA, 19 nt, Homo sapiens
guauucacaucuguccuua

SEQ ID NO: 55445 - RNA, 19 nt, Homo sapiens
caacauuacucuuccuacu

SEQ ID NO: 55446 - RNA, 19 nt, Homo sapiens
gggauaacaguaagggaua

SEQ ID NO: 55447 - RNA, 19 nt, Homo sapiens
ggagaagaagcuacaaugu

SEQ ID NO: 55448 - RNA, 19 nt, Homo sapiens
caacaaccaccaccacaau

SEQ ID NO: 55449 - RNA, 19 nt, Homo sapiens
gugcugaacucucucucuu

SEQ ID NO: 55450 - RNA, 19 nt, Homo sapiens
ucugauaucugcucaugga

SEQ ID NO: 55451 - RNA, 19 nt, Homo sapiens
guagcuggguggaucagaa

SEQ ID NO: 55452 - RNA, 19 nt, Homo sapiens
agagacauccuucauuuga

SEQ ID NO: 55453 - RNA, 19 nt, Homo sapiens
guugagaaagucacagaua

SEQ ID NO: 55454 - RNA, 19 nt, Homo sapiens
gucauaaguuucugagaug

SEQ ID NO: 55455 - RNA, 19 nt, Homo sapiens
ggaaagcuccuggcgucua

SEQ ID NO: 55456 - RNA, 19 nt, Homo sapiens
ucacaucuguccuuaaucg

SEQ ID NO: 55457 - RNA, 19 nt, Homo sapiens
gagagggugcuuggaauaa

SEQ ID NO: 55458 - RNA, 19 nt, Homo sapiens
ccaucaguauguccaagua

SEQ ID NO: 55459 - RNA, 19 nt, Homo sapiens
gcaaaaccauucugauauc

SEQ ID NO: 55460 - RNA, 19 nt, Homo sapiens
gcuccuggcgucuaaauga

SEQ ID NO: 55461 - RNA, 19 nt, Homo sapiens
gaauauuagcccauuugaa

SEQ ID NO: 55462 - RNA, 19 nt, Homo sapiens
ggauaacaguaagggauau

SEQ ID NO: 55463 - RNA, 19 nt, Homo sapiens
gcucauggaaauagcagua

SEQ ID NO: 55464 - RNA, 19 nt, Homo sapiens
gauugcucccgaaguauua

SEQ ID NO: 55465 - RNA, 19 nt, Homo sapiens
ccaccacaaugacagaaau

SEQ ID NO: 55466 - RNA, 19 nt, Homo sapiens
gccagaggcccauuaguug

SEQ ID NO: 55467 - RNA, 19 nt, Homo sapiens
agagacuccuucccuauug

SEQ ID NO: 55468 - RNA, 19 nt, Homo sapiens
gagcagauggcuuugaauc

SEQ ID NO: 55469 - RNA, 19 nt, Homo sapiens
caaguagagaugaaguuaa

SEQ ID NO: 55470 - RNA, 19 nt, Homo sapiens
acaaguagagaugaaguua

SEQ ID NO: 55471 - RNA, 19 nt, Homo sapiens
ggauugcucccgaaguauu

SEQ ID NO: 55472 - RNA, 19 nt, Homo sapiens
caagaauaagcagcaaaua

SEQ ID NO: 55473 - RNA, 19 nt, Homo sapiens
ggaaguucagccaucagua

SEQ ID NO: 55474 - RNA, 19 nt, Homo sapiens
caguaagggauauuagaua

SEQ ID NO: 55475 - RNA, 19 nt, Homo sapiens
gcagugaugaguccuagga

SEQ ID NO: 55476 - RNA, 19 nt, Homo sapiens
gcugaacucucucucuuuu

SEQ ID NO: 55477 - RNA, 19 nt, Homo sapiens
aagcagccauuaagaaagu

SEQ ID NO: 55478 - RNA, 19 nt, Homo sapiens
ggguaccuguaauuaguuu

SEQ ID NO: 55479 - RNA, 19 nt, Homo sapiens
uugagaaagucacagauau

SEQ ID NO: 55480 - RNA, 19 nt, Homo sapiens
gauccaagcagccauuaag

SEQ ID NO: 55481 - RNA, 19 nt, Homo sapiens
gguauaaaguaugcgaugu

SEQ ID NO: 55482 - RNA, 19 nt, Homo sapiens
gaaaacgccugggaaguuc

SEQ ID NO: 55483 - RNA, 19 nt, Homo sapiens
acagggagcagauggcuuu

SEQ ID NO: 55484 - RNA, 19 nt, Homo sapiens
gaaacucaacagcgaagga

SEQ ID NO: 55485 - RNA, 19 nt, Homo sapiens
gaauaagcagcaaauaaac

SEQ ID NO: 55486 - RNA, 19 nt, Homo sapiens
agacauccuucauuugaca

SEQ ID NO: 55487 - RNA, 19 nt, Homo sapiens
cccuuuaacuugucuucua

SEQ ID NO: 55488 - RNA, 19 nt, Homo sapiens
caacugccacggucggaaa

SEQ ID NO: 55489 - RNA, 19 nt, Homo sapiens
cagauggcuuugaaucaug

SEQ ID NO: 55490 - RNA, 19 nt, Homo sapiens
uuaguagaauuccucuuug

SEQ ID NO: 55491 - RNA, 19 nt, Homo sapiens
cuaaucaguaguucacuuu

SEQ ID NO: 55492 - RNA, 19 nt, Homo sapiens
gagcaacaaguagagauga

SEQ ID NO: 55493 - RNA, 19 nt, Homo sapiens
uuguauagguaacuaggua

SEQ ID NO: 55494 - RNA, 19 nt, Homo sapiens
ggaaugggugccuguggaa

SEQ ID NO: 55495 - RNA, 19 nt, Homo sapiens
gaagagcuaggccaggaau

SEQ ID NO: 55496 - RNA, 19 nt, Homo sapiens
cuuaaucgguccauucaca

SEQ ID NO: 55497 - RNA, 19 nt, Homo sapiens
gcccauuaguugagaaagu

SEQ ID NO: 55498 - RNA, 19 nt, Homo sapiens
gaaggucauaaguuucuga

SEQ ID NO: 55499 - RNA, 19 nt, Homo sapiens
cauccuuacuaccaagaaa

SEQ ID NO: 55500 - RNA, 19 nt, Homo sapiens
ccacaagaauaagcagcaa

SEQ ID NO: 55501 - RNA, 19 nt, Homo sapiens
uagguaacuagguaacuua

SEQ ID NO: 55502 - RNA, 19 nt, Homo sapiens
gcuaggcuguggaguagag

SEQ ID NO: 55503 - RNA, 19 nt, Homo sapiens
ggucggaaagcuuaaagga

SEQ ID NO: 55504 - RNA, 19 nt, Homo sapiens
auucacaucuguccuuaau

SEQ ID NO: 55505 - RNA, 19 nt, Homo sapiens
aacuauggcuguugagguu

SEQ ID NO: 55506 - RNA, 19 nt, Homo sapiens
aggaggcgcuggcucuuug

SEQ ID NO: 55507 - RNA, 19 nt, Homo sapiens
ucaagaaccucaauaagaa

SEQ ID NO: 55508 - RNA, 19 nt, Homo sapiens
ugaaggcgcugaaguuuaa

SEQ ID NO: 55509 - RNA, 19 nt, Homo sapiens
gcuauaaucucagcacuuu

SEQ ID NO: 55510 - RNA, 19 nt, Homo sapiens
gcagugagcuguaauugca

SEQ ID NO: 55511 - RNA, 19 nt, Homo sapiens
gaagacagcaugauauaug

SEQ ID NO: 55512 - RNA, 19 nt, Homo sapiens
gcucacagcuauaaucuca

SEQ ID NO: 55513 - RNA, 19 nt, Homo sapiens
gcagaugaauucaacaagu

SEQ ID NO: 55514 - RNA, 19 nt, Homo sapiens
gcaaacacaaccugcauuu

SEQ ID NO: 55515 - RNA, 19 nt, Homo sapiens
gggcauaaccgcacucauu

SEQ ID NO: 55516 - RNA, 19 nt, Homo sapiens
aagaccagcuugugcaaua

SEQ ID NO: 55517 - RNA, 19 nt, Homo sapiens
cagaugaauucaacaaguu

SEQ ID NO: 55518 - RNA, 19 nt, Homo sapiens
uugcugaucucguaccuua

SEQ ID NO: 55519 - RNA, 19 nt, Homo sapiens
gaaacucuccgccuuugaa

SEQ ID NO: 55520 - RNA, 19 nt, Homo sapiens
ugacgaagacagcaugaua

SEQ ID NO: 55521 - RNA, 19 nt, Homo sapiens
gaaguggagagacugauuu

SEQ ID NO: 55522 - RNA, 19 nt, Homo sapiens
gguaaccucugccaaagug

SEQ ID NO: 55523 - RNA, 19 nt, Homo sapiens
gcucacggcugcauuugau

SEQ ID NO: 55524 - RNA, 19 nt, Homo sapiens
gaacaagaaagccucuaga

SEQ ID NO: 55525 - RNA, 19 nt, Homo sapiens
ggagugagagaacaagaaa

SEQ ID NO: 55526 - RNA, 19 nt, Homo sapiens
caaaagaugcuguugauuu

SEQ ID NO: 55527 - RNA, 19 nt, Homo sapiens
gaguaccgcuaaggcuuua

SEQ ID NO: 55528 - RNA, 19 nt, Homo sapiens
gaugaaggcgcugaaguuu

SEQ ID NO: 55529 - RNA, 19 nt, Homo sapiens
gcuacuuccugggauguua

SEQ ID NO: 55530 - RNA, 19 nt, Homo sapiens
gcauaagacaguuuaaaca

SEQ ID NO: 55531 - RNA, 19 nt, Homo sapiens
caugccgacuucauucaua

SEQ ID NO: 55532 - RNA, 19 nt, Homo sapiens
ggaaguggagagacugauu

SEQ ID NO: 55533 - RNA, 19 nt, Homo sapiens
gauggcauaagacaguuua

SEQ ID NO: 55534 - RNA, 19 nt, Homo sapiens
guggguggauggcauaaga

SEQ ID NO: 55535 - RNA, 19 nt, Homo sapiens
ucaacaaguuagcagaaga

SEQ ID NO: 55536 - RNA, 19 nt, Homo sapiens
cuauggguaugacuacuuu

SEQ ID NO: 55537 - RNA, 19 nt, Homo sapiens
aagacagcaugauauauga

SEQ ID NO: 55538 - RNA, 19 nt, Homo sapiens
uaacaugaugccuuugaaa

SEQ ID NO: 55539 - RNA, 19 nt, Homo sapiens
caaauggagugagagaaca

SEQ ID NO: 55540 - RNA, 19 nt, Homo sapiens
gaaucacguugggaacuga

SEQ ID NO: 55541 - RNA, 19 nt, Homo sapiens
ggucccaggugcucaggaa

SEQ ID NO: 55542 - RNA, 19 nt, Homo sapiens
gcacgguggcucacagcua

SEQ ID NO: 55543 - RNA, 19 nt, Homo sapiens
aaaagaugcuguugauuug

SEQ ID NO: 55544 - RNA, 19 nt, Homo sapiens
caaccugggcaacagagua

SEQ ID NO: 55545 - RNA, 19 nt, Homo sapiens
cgaaguggcacacaucugu

SEQ ID NO: 55546 - RNA, 19 nt, Homo sapiens
gaccagcuugugcaauaua

SEQ ID NO: 55547 - RNA, 19 nt, Homo sapiens
gaccucagcucaagaaccu

SEQ ID NO: 55548 - RNA, 19 nt, Homo sapiens
ggcauaaccgcacucauug

SEQ ID NO: 55549 - RNA, 19 nt, Homo sapiens
uccgagauguuuccaaaug

SEQ ID NO: 55550 - RNA, 19 nt, Homo sapiens
gacgaagacagcaugauau

SEQ ID NO: 55551 - RNA, 19 nt, Homo sapiens
cucaagaaccucaauaaga

SEQ ID NO: 55552 - RNA, 19 nt, Homo sapiens
cacgguggcucacagcuau

SEQ ID NO: 55553 - RNA, 19 nt, Homo sapiens
gcccaggaaucugcuuuau

SEQ ID NO: 55554 - RNA, 19 nt, Homo sapiens
acgaagacagcaugauaua

SEQ ID NO: 55555 - RNA, 19 nt, Homo sapiens
ugaaagggaugcaaaagau

SEQ ID NO: 55556 - RNA, 19 nt, Homo sapiens
guguggagaugcccaggaa

SEQ ID NO: 55557 - RNA, 19 nt, Homo sapiens
caacagaguaagaccuugu

SEQ ID NO: 55558 - RNA, 19 nt, Homo sapiens
ccuaaccaaaugagaauaa

SEQ ID NO: 55559 - RNA, 19 nt, Homo sapiens
aaacacaaccugcauuugc

SEQ ID NO: 55560 - RNA, 19 nt, Homo sapiens
ugaugaaggcgcugaaguu

SEQ ID NO: 55561 - RNA, 19 nt, Homo sapiens
ccucgaggcuauggacauu

SEQ ID NO: 55562 - RNA, 19 nt, Homo sapiens
gcguucagcugcauuacca

SEQ ID NO: 55563 - RNA, 19 nt, Homo sapiens
gaggugggaggaucacuug

SEQ ID NO: 55564 - RNA, 19 nt, Homo sapiens
ccaaaguggcugugaaugg

SEQ ID NO: 55565 - RNA, 19 nt, Homo sapiens
guuaacaugaugccuuuga

SEQ ID NO: 55566 - RNA, 19 nt, Homo sapiens
guugcugccuguuaacaug

SEQ ID NO: 55567 - RNA, 19 nt, Homo sapiens
gcugaucucguaccuuaau

SEQ ID NO: 55568 - RNA, 19 nt, Homo sapiens
uuaacaugaugccuuugaa

SEQ ID NO: 55569 - RNA, 19 nt, Homo sapiens
gcccuaagucuucucuuug

SEQ ID NO: 55570 - RNA, 19 nt, Homo sapiens
cgauuucccagcagacuuu

SEQ ID NO: 55571 - RNA, 19 nt, Homo sapiens
gcucaagaaccucaauaag

SEQ ID NO: 55572 - RNA, 19 nt, Homo sapiens
gagcuguaauugcaucacu

SEQ ID NO: 55573 - RNA, 19 nt, Homo sapiens
aggcugaggugggagaauu

SEQ ID NO: 55574 - RNA, 19 nt, Homo sapiens
aaugcacacuccagucuug

SEQ ID NO: 55575 - RNA, 19 nt, Homo sapiens
guuaggaaguggagagacu

SEQ ID NO: 55576 - RNA, 19 nt, Homo sapiens
caugaugccuuugaaacuc

SEQ ID NO: 55577 - RNA, 19 nt, Homo sapiens
cuguuaacaugaugccuuu

SEQ ID NO: 55578 - RNA, 19 nt, Homo sapiens
uauccuaaccaaaugagaa

SEQ ID NO: 55579 - RNA, 19 nt, Homo sapiens
ucccuucaaucuuauccua

SEQ ID NO: 55580 - RNA, 19 nt, Homo sapiens
agcccuaagucuucucuuu

SEQ ID NO: 55581 - RNA, 19 nt, Homo sapiens
aagaugcuguugauuugau

SEQ ID NO: 55582 - RNA, 19 nt, Homo sapiens
ucaaucuuauccuaaccaa

SEQ ID NO: 55583 - RNA, 19 nt, Homo sapiens
ucucuuugcuugcugaucu

SEQ ID NO: 55584 - RNA, 19 nt, Homo sapiens
ugaguaccgcuaaggcuuu

SEQ ID NO: 55585 - RNA, 19 nt, Homo sapiens
ccaaauggagugagagaac

SEQ ID NO: 55586 - RNA, 19 nt, Homo sapiens
gagacuccggcucuacaaa

SEQ ID NO: 55587 - RNA, 19 nt, Homo sapiens
gaucucguaccuuaaugug

SEQ ID NO: 55588 - RNA, 19 nt, Homo sapiens
ucuccgccuuugaaacuuu

SEQ ID NO: 55589 - RNA, 19 nt, Homo sapiens
ucguguugcugccuguuaa

SEQ ID NO: 55590 - RNA, 19 nt, Homo sapiens
cauuucagcaccucgguaa

SEQ ID NO: 55591 - RNA, 19 nt, Homo sapiens
gaaugcacacuccagucuu

SEQ ID NO: 55592 - RNA, 19 nt, Homo sapiens
ggcauaagacaguuuaaac

SEQ ID NO: 55593 - RNA, 19 nt, Homo sapiens
gaagcccucuauggguaug

SEQ ID NO: 55594 - RNA, 19 nt, Homo sapiens
cgaagacagcaugauauau

SEQ ID NO: 55595 - RNA, 19 nt, Homo sapiens
cagcucaagaaccucaaua

SEQ ID NO: 55596 - RNA, 19 nt, Homo sapiens
ccaaaugagaauaaugaca

SEQ ID NO: 55597 - RNA, 19 nt, Homo sapiens
aaaguggguggauggcaua

SEQ ID NO: 55598 - RNA, 19 nt, Homo sapiens
acaagaaagccucuagaag

SEQ ID NO: 55599 - RNA, 19 nt, Homo sapiens
aacaagaaagccucuagaa

SEQ ID NO: 55600 - RNA, 19 nt, Homo sapiens
gaauggcguucagcugcau

SEQ ID NO: 55601 - RNA, 19 nt, Homo sapiens
ggcaacagaguaagaccuu

SEQ ID NO: 55602 - RNA, 19 nt, Homo sapiens
uauaaucucagcacuuugg

SEQ ID NO: 55603 - RNA, 19 nt, Homo sapiens
gcugaaguuuaagaagguu

SEQ ID NO: 55604 - RNA, 19 nt, Homo sapiens
gaucacuugagcccaauuc

SEQ ID NO: 55605 - RNA, 19 nt, Homo sapiens
uugaaacucuccgccuuug

SEQ ID NO: 55606 - RNA, 19 nt, Homo sapiens
gaaaggcucacggcugcau

SEQ ID NO: 55607 - RNA, 19 nt, Homo sapiens
gaacugaagcacucaaaua

SEQ ID NO: 55608 - RNA, 19 nt, Homo sapiens
gaggaaacauuauucauug

SEQ ID NO: 55609 - RNA, 19 nt, Homo sapiens
gagaugacaugauuccaaa

SEQ ID NO: 55610 - RNA, 19 nt, Homo sapiens
cgacucagauucagaaaug

SEQ ID NO: 55611 - RNA, 19 nt, Homo sapiens
ucagacagcuuuaagauca

SEQ ID NO: 55612 - RNA, 19 nt, Homo sapiens
ccuccaagcugcaaccuua

SEQ ID NO: 55613 - RNA, 19 nt, Homo sapiens
gaaagugaccaauucugua

SEQ ID NO: 55614 - RNA, 19 nt, Homo sapiens
gcgagaaagugaccaauuc

SEQ ID NO: 55615 - RNA, 19 nt, Homo sapiens
ggaucaagauuccugacua

SEQ ID NO: 55616 - RNA, 19 nt, Homo sapiens
ggcuaaggcugcagagaua

SEQ ID NO: 55617 - RNA, 19 nt, Homo sapiens
ccaaaggaguccaaauuuc

SEQ ID NO: 55618 - RNA, 19 nt, Homo sapiens
cugaagcacucaaauauug

SEQ ID NO: 55619 - RNA, 19 nt, Homo sapiens
caagauuccugacuacuca

SEQ ID NO: 55620 - RNA, 19 nt, Homo sapiens
ggaauccucuccagaucuu

SEQ ID NO: 55621 - RNA, 19 nt, Homo sapiens
gaagaugacccuuagagau

SEQ ID NO: 55622 - RNA, 19 nt, Homo sapiens
ggaaucguguuucaauugu

SEQ ID NO: 55623 - RNA, 19 nt, Homo sapiens
agaaggagcugaagaggau

SEQ ID NO: 55624 - RNA, 19 nt, Homo sapiens
uaaacacgaggaaacauua

SEQ ID NO: 55625 - RNA, 19 nt, Homo sapiens
ccuuagagaugacaugauu

SEQ ID NO: 55626 - RNA, 19 nt, Homo sapiens
gaaucguguuucaauugua

SEQ ID NO: 55627 - RNA, 19 nt, Homo sapiens
caagaaguuucccaacaug

SEQ ID NO: 55628 - RNA, 19 nt, Homo sapiens
ccaagaaguuucccaacau

SEQ ID NO: 55629 - RNA, 19 nt, Homo sapiens
cgaggaaacauuauucauu

SEQ ID NO: 55630 - RNA, 19 nt, Homo sapiens
gcauggacauccgugaauu

SEQ ID NO: 55631 - RNA, 19 nt, Homo sapiens
ccaccggccuuaccuucua

SEQ ID NO: 55632 - RNA, 19 nt, Homo sapiens
gacguugucuauaaaugaa

SEQ ID NO: 55633 - RNA, 19 nt, Homo sapiens
gccaagaaguuucccaaca

SEQ ID NO: 55634 - RNA, 19 nt, Homo sapiens
gaucaagauuccugacuac

SEQ ID NO: 55635 - RNA, 19 nt, Homo sapiens
uggcagcucuggaggauga

SEQ ID NO: 55636 - RNA, 19 nt, Homo sapiens
ggccuuaaguucuccauca

SEQ ID NO: 55637 - RNA, 19 nt, Homo sapiens
uagaaggcauguccauuuc

SEQ ID NO: 55638 - RNA, 19 nt, Homo sapiens
gcuguucggugcagacguu

SEQ ID NO: 55639 - RNA, 19 nt, Homo sapiens
ugcaggauaucaugaacua

SEQ ID NO: 55640 - RNA, 19 nt, Homo sapiens
gacccuggauguacagaug

SEQ ID NO: 55641 - RNA, 19 nt, Homo sapiens
gcagccacaucaacagugu

SEQ ID NO: 55642 - RNA, 19 nt, Homo sapiens
caggaaucguguuucaauu

SEQ ID NO: 55643 - RNA, 19 nt, Homo sapiens
gaucugaagcugggcagua

SEQ ID NO: 55644 - RNA, 19 nt, Homo sapiens
ggaaacauuauucauugga

SEQ ID NO: 55645 - RNA, 19 nt, Homo sapiens
uaacgagaaacuacagaaa

SEQ ID NO: 55646 - RNA, 19 nt, Homo sapiens
gcccaggguuaacgagaaa

SEQ ID NO: 55647 - RNA, 19 nt, Homo sapiens
uugaauugcugcaggauau

SEQ ID NO: 55648 - RNA, 19 nt, Homo sapiens
gagcugaagaggaucaaga

SEQ ID NO: 55649 - RNA, 19 nt, Homo sapiens
auuaugagcuucuuucaag

SEQ ID NO: 55650 - RNA, 19 nt, Homo sapiens
ccaauucuguauccuccaa

SEQ ID NO: 55651 - RNA, 19 nt, Homo sapiens
gauccaacucuuccacaaa

SEQ ID NO: 55652 - RNA, 19 nt, Homo sapiens
auagaaggcauguccauuu

SEQ ID NO: 55653 - RNA, 19 nt, Homo sapiens
cgagaugggugucccugau

SEQ ID NO: 55654 - RNA, 19 nt, Homo sapiens
ugacuacucagacagcuuu

SEQ ID NO: 55655 - RNA, 19 nt, Homo sapiens
gcacaucucaaagagcaaa

SEQ ID NO: 55656 - RNA, 19 nt, Homo sapiens
ccaggaaucguguuucaau

SEQ ID NO: 55657 - RNA, 19 nt, Homo sapiens
gaagauacagauccauguc

SEQ ID NO: 55658 - RNA, 19 nt, Homo sapiens
gaucuaaacacgaggaaac

SEQ ID NO: 55659 - RNA, 19 nt, Homo sapiens
ggaaauggaaggcacaaaa

SEQ ID NO: 55660 - RNA, 19 nt, Homo sapiens
caacgccaauaucaagauc

SEQ ID NO: 55661 - RNA, 19 nt, Homo sapiens
gauaucaugaacuacauug

SEQ ID NO: 55662 - RNA, 19 nt, Homo sapiens
caaaggaguccaaauuucg

SEQ ID NO: 55663 - RNA, 19 nt, Homo sapiens
ccacaauccaccucccuuu

SEQ ID NO: 55664 - RNA, 19 nt, Homo sapiens
uaagcauggugcccaaugu

SEQ ID NO: 55665 - RNA, 19 nt, Homo sapiens
aagaugacccuuagagaug

SEQ ID NO: 55666 - RNA, 19 nt, Homo sapiens
ccaagcugcaaccuuauuu

SEQ ID NO: 55667 - RNA, 19 nt, Homo sapiens
aaagugaccaauucuguau

SEQ ID NO: 55668 - RNA, 19 nt, Homo sapiens
gggcuaaggcugcagagau

SEQ ID NO: 55669 - RNA, 19 nt, Homo sapiens
cuaaacacgaggaaacauu

SEQ ID NO: 55670 - RNA, 19 nt, Homo sapiens
caaacuucuucgacucaga

SEQ ID NO: 55671 - RNA, 19 nt, Homo sapiens
guccaaauuucgacugaca

SEQ ID NO: 55672 - RNA, 19 nt, Homo sapiens
uccaaaggaguccaaauuu

SEQ ID NO: 55673 - RNA, 19 nt, Homo sapiens
ucagacuacuucuucaaca

SEQ ID NO: 55674 - RNA, 19 nt, Homo sapiens
caaugugggccuuaaguuc

SEQ ID NO: 55675 - RNA, 19 nt, Homo sapiens
ugaagaggaucaagauucc

SEQ ID NO: 55676 - RNA, 19 nt, Homo sapiens
cagcaacgccaauaucaag

SEQ ID NO: 55677 - RNA, 19 nt, Homo sapiens
gauuaugagcuucuuucaa

SEQ ID NO: 55678 - RNA, 19 nt, Homo sapiens
caacaugaagauacagauc

SEQ ID NO: 55679 - RNA, 19 nt, Homo sapiens
gaaguuucccaacaugaag

SEQ ID NO: 55680 - RNA, 19 nt, Homo sapiens
gaguccagcucuacaacgu

SEQ ID NO: 55681 - RNA, 19 nt, Homo sapiens
ggaacugaagcacucaaau

SEQ ID NO: 55682 - RNA, 19 nt, Homo sapiens
agaugacccuuagagauga

SEQ ID NO: 55683 - RNA, 19 nt, Homo sapiens
ccauuugugcuucaugaaa

SEQ ID NO: 55684 - RNA, 19 nt, Homo sapiens
gaauuccagcuucccaguu

SEQ ID NO: 55685 - RNA, 19 nt, Homo sapiens
gcgcuucgaaacaagauga

SEQ ID NO: 55686 - RNA, 19 nt, Homo sapiens
gcaacgccaauaucaagau

SEQ ID NO: 55687 - RNA, 19 nt, Homo sapiens
ccaaugugggccuuaaguu

SEQ ID NO: 55688 - RNA, 19 nt, Homo sapiens
gggauuaugagcuucuuuc

SEQ ID NO: 55689 - RNA, 19 nt, Homo sapiens
cuucccaguucccagauaa

SEQ ID NO: 55690 - RNA, 19 nt, Homo sapiens
ugagguggccaagaaguuu

SEQ ID NO: 55691 - RNA, 19 nt, Homo sapiens
ugaagaugacccuuagaga

SEQ ID NO: 55692 - RNA, 19 nt, Homo sapiens
agucugcgcuucgaaacaa

SEQ ID NO: 55693 - RNA, 19 nt, Homo sapiens
uaaggcugcagagauauuu

SEQ ID NO: 55694 - RNA, 19 nt, Homo sapiens
aaaagugcaugguguguau

SEQ ID NO: 55695 - RNA, 19 nt, Homo sapiens
gaaaagugcauggugugua

SEQ ID NO: 55696 - RNA, 19 nt, Homo sapiens
ggauaucaugaacuacauu

SEQ ID NO: 55697 - RNA, 19 nt, Homo sapiens
caggauaucaugaacuaca

SEQ ID NO: 55698 - RNA, 19 nt, Homo sapiens
gcuucccucuuccugauug

SEQ ID NO: 55699 - RNA, 19 nt, Homo sapiens
gcuucccaguucccagaua

SEQ ID NO: 55700 - RNA, 19 nt, Homo sapiens
acgagaaacuacagaaagg

SEQ ID NO: 55701 - RNA, 19 nt, Homo sapiens
agaaguuucccaacaugaa

SEQ ID NO: 55702 - RNA, 19 nt, Homo sapiens
ugauccaacucuuccacaa

SEQ ID NO: 55703 - RNA, 19 nt, Homo sapiens
cugaagaggaucaagauuc

SEQ ID NO: 55704 - RNA, 19 nt, Homo sapiens
gagaugggugucccugaug

SEQ ID NO: 55705 - RNA, 19 nt, Homo sapiens
ccucucagacuacuucuuc

SEQ ID NO: 55706 - RNA, 19 nt, Homo sapiens
uggcuggaaucaacuaugg

SEQ ID NO: 55707 - RNA, 19 nt, Homo sapiens
gaagugggcuccaguauua

SEQ ID NO: 55708 - RNA, 19 nt, Homo sapiens
caaaguagcugauguauug

SEQ ID NO: 55709 - RNA, 19 nt, Homo sapiens
gcaagaugcugauucauua

SEQ ID NO: 55710 - RNA, 19 nt, Homo sapiens
ggaaauggcugaacuagaa

SEQ ID NO: 55711 - RNA, 19 nt, Homo sapiens
gcaagaauaugaagaagua

SEQ ID NO: 55712 - RNA, 19 nt, Homo sapiens
gaagagaacuuaucuagug

SEQ ID NO: 55713 - RNA, 19 nt, Homo sapiens
gaacaaagcacaucagaaa

SEQ ID NO: 55714 - RNA, 19 nt, Homo sapiens
ccauacagcuucauaaaua

SEQ ID NO: 55715 - RNA, 19 nt, Homo sapiens
gaagccagcucaagcaaua

SEQ ID NO: 55716 - RNA, 19 nt, Homo sapiens
gcagauaguucuaccagua

SEQ ID NO: 55717 - RNA, 19 nt, Homo sapiens
caacgaaacuggacucauu

SEQ ID NO: 55718 - RNA, 19 nt, Homo sapiens
gaacuuaucuagugaggau

SEQ ID NO: 55719 - RNA, 19 nt, Homo sapiens
gaacacagaggagaauuua

SEQ ID NO: 55720 - RNA, 19 nt, Homo sapiens
ccagugaacuuaaagaauu

SEQ ID NO: 55721 - RNA, 19 nt, Homo sapiens
aagcauggauucaaacuua

SEQ ID NO: 55722 - RNA, 19 nt, Homo sapiens
gagcugaaguuaacaaaug

SEQ ID NO: 55723 - RNA, 19 nt, Homo sapiens
gaaauagguuccagugaug

SEQ ID NO: 55724 - RNA, 19 nt, Homo sapiens
gaacggacacugaaauauu

SEQ ID NO: 55725 - RNA, 19 nt, Homo sapiens
cagaagugaugaacuguua

SEQ ID NO: 55726 - RNA, 19 nt, Homo sapiens
ccaaagaucucauguuaag

SEQ ID NO: 55727 - RNA, 19 nt, Homo sapiens
caaaugaacagacaaguaa

SEQ ID NO: 55728 - RNA, 19 nt, Homo sapiens
agaaugagcuuacaaagug

SEQ ID NO: 55729 - RNA, 19 nt, Homo sapiens
gaacagcaguuuauuacuc

SEQ ID NO: 55730 - RNA, 19 nt, Homo sapiens
gaaauuagaguccucagaa

SEQ ID NO: 55731 - RNA, 19 nt, Homo sapiens
caagaaaguacgagauuua

SEQ ID NO: 55732 - RNA, 19 nt, Homo sapiens
gaaagcagauuuggcaguu

SEQ ID NO: 55733 - RNA, 19 nt, Homo sapiens
gaaccugucuccacaaagu

SEQ ID NO: 55734 - RNA, 19 nt, Homo sapiens
ggaaagaaugagucuaaua

SEQ ID NO: 55735 - RNA, 19 nt, Homo sapiens
ugaaucaaaugccaaagua

SEQ ID NO: 55736 - RNA, 19 nt, Homo sapiens
gaaguaaggaaacauguaa

SEQ ID NO: 55737 - RNA, 19 nt, Homo sapiens
caaauaaacuugguagcaa

SEQ ID NO: 55738 - RNA, 19 nt, Homo sapiens
cagcuacccuuccaucaua

SEQ ID NO: 55739 - RNA, 19 nt, Homo sapiens
ugaaagaucuguagagagu

SEQ ID NO: 55740 - RNA, 19 nt, Homo sapiens
caauauggaacucgaauua

SEQ ID NO: 55741 - RNA, 19 nt, Homo sapiens
ccaaaucaguagagaguaa

SEQ ID NO: 55742 - RNA, 19 nt, Homo sapiens
gaaauuagccggucauggu

SEQ ID NO: 55743 - RNA, 19 nt, Homo sapiens
ccacaucacuuuaacuaau

SEQ ID NO: 55744 - RNA, 19 nt, Homo sapiens
ggucaagugaugaauauua

SEQ ID NO: 55745 - RNA, 19 nt, Homo sapiens
ggaacgggcuuggaagaaa

SEQ ID NO: 55746 - RNA, 19 nt, Homo sapiens
guuagaugauggugaaaua

SEQ ID NO: 55747 - RNA, 19 nt, Homo sapiens
caaaggaggcucuagguuu

SEQ ID NO: 55748 - RNA, 19 nt, Homo sapiens
uaauaucacugcaggcuuu

SEQ ID NO: 55749 - RNA, 19 nt, Homo sapiens
gaagauguuccuuggauaa

SEQ ID NO: 55750 - RNA, 19 nt, Homo sapiens
gggauaccaugcaacauaa

SEQ ID NO: 55751 - RNA, 19 nt, Homo sapiens
aaagagaaaugggaaauga

SEQ ID NO: 55752 - RNA, 19 nt, Homo sapiens
gcaaggagccaacauaaca

SEQ ID NO: 55753 - RNA, 19 nt, Homo sapiens
gaacagaaagaaauggauu

SEQ ID NO: 55754 - RNA, 19 nt, Homo sapiens
caauauaccuucucagucu

SEQ ID NO: 55755 - RNA, 19 nt, Homo sapiens
ucaaauaccagugaacuua

SEQ ID NO: 55756 - RNA, 19 nt, Homo sapiens
aacgaaagcugaaccuaua

SEQ ID NO: 55757 - RNA, 19 nt, Homo sapiens
gaaaguuaaugagugguuu

SEQ ID NO: 55758 - RNA, 19 nt, Homo sapiens
gaagauaccguuaauaagg

SEQ ID NO: 55759 - RNA, 19 nt, Homo sapiens
gaaaaggacuucuggcuau

SEQ ID NO: 55760 - RNA, 19 nt, Homo sapiens
gauaaugccaaauguagua

SEQ ID NO: 55761 - RNA, 19 nt, Homo sapiens
gcagaauggucaagugaug

SEQ ID NO: 55762 - RNA, 19 nt, Homo sapiens
gcagugagccaagaucaua

SEQ ID NO: 55763 - RNA, 19 nt, Homo sapiens
gggcaguucucaaauguug

SEQ ID NO: 55764 - RNA, 19 nt, Homo sapiens
gcaguaaccagguaauauu

SEQ ID NO: 55765 - RNA, 19 nt, Homo sapiens
guaagcauccugaaauaaa

SEQ ID NO: 55766 - RNA, 19 nt, Homo sapiens
gcauagaaauggaagaaag

SEQ ID NO: 55767 - RNA, 19 nt, Homo sapiens
guagagaguagcaguauuu

SEQ ID NO: 55768 - RNA, 19 nt, Homo sapiens
gaaaauaacucuccugaac

SEQ ID NO: 55769 - RNA, 19 nt, Homo sapiens
gaaaauggguaguuagcua

SEQ ID NO: 55770 - RNA, 19 nt, Homo sapiens
ggaauugguuucagaugau

SEQ ID NO: 55771 - RNA, 19 nt, Homo sapiens
aaagacuccugaaaugaua

SEQ ID NO: 55772 - RNA, 19 nt, Homo sapiens
aaaggcugcuugugaauuu

SEQ ID NO: 55773 - RNA, 19 nt, Homo sapiens
uauaagaccucuggcauga

SEQ ID NO: 55774 - RNA, 19 nt, Homo sapiens
gaaggagcuuucaucauuc

SEQ ID NO: 55775 - RNA, 19 nt, Homo sapiens
cuagaaaucuguugcuaug

SEQ ID NO: 55776 - RNA, 19 nt, Homo sapiens
gaggagauguggucaaugg

SEQ ID NO: 55777 - RNA, 19 nt, Homo sapiens
gaaacuacccaucucaaga

SEQ ID NO: 55778 - RNA, 19 nt, Homo sapiens
ugaaauagguuccagugau

SEQ ID NO: 55779 - RNA, 19 nt, Homo sapiens
guacagacaguuaauauca

SEQ ID NO: 55780 - RNA, 19 nt, Homo sapiens
ucaggaaaguaucucguua

SEQ ID NO: 55781 - RNA, 19 nt, Homo sapiens
gaaccuauaagcagcagua

SEQ ID NO: 55782 - RNA, 19 nt, Homo sapiens
gcucagggcuauccucuca

SEQ ID NO: 55783 - RNA, 19 nt, Homo sapiens
ugaaugcuaugcuuagauu

SEQ ID NO: 55784 - RNA, 19 nt, Homo sapiens
caucaucaacccaguaaua

SEQ ID NO: 55785 - RNA, 19 nt, Homo sapiens
gaaaccauacagcuucaua

SEQ ID NO: 55786 - RNA, 19 nt, Homo sapiens
caacauaaccugauaaagc

SEQ ID NO: 55787 - RNA, 19 nt, Homo sapiens
aaacaagcgucucugaaga

SEQ ID NO: 55788 - RNA, 19 nt, Homo sapiens
gaaguaguucagacuguua

SEQ ID NO: 55789 - RNA, 19 nt, Homo sapiens
ggacucauuacuccaaaua

SEQ ID NO: 55790 - RNA, 19 nt, Homo sapiens
ccaauagaaucacucgaaa

SEQ ID NO: 55791 - RNA, 19 nt, Homo sapiens
ucaugaggcuuuaauaugu

SEQ ID NO: 55792 - RNA, 19 nt, Homo sapiens
gaacaucaucaacccagua

SEQ ID NO: 55793 - RNA, 19 nt, Homo sapiens
gaagagcuauugaaaauca

SEQ ID NO: 55794 - RNA, 19 nt, Homo sapiens
gaagagacuacucauguug

SEQ ID NO: 55795 - RNA, 19 nt, Homo sapiens
gaaacaagcgucucugaag

SEQ ID NO: 55796 - RNA, 19 nt, Homo sapiens
ggaaacaagcauagaaaug

SEQ ID NO: 55797 - RNA, 19 nt, Homo sapiens
aaucuaagcccaccuaauu

SEQ ID NO: 55798 - RNA, 19 nt, Homo sapiens
cuaaauagcagcauucaga

SEQ ID NO: 55799 - RNA, 19 nt, Homo sapiens
gcagagggauaccaugcaa

SEQ ID NO: 55800 - RNA, 19 nt, Homo sapiens
auacagauuucucuccaua

SEQ ID NO: 55801 - RNA, 19 nt, Homo sapiens
gaaugagucuaauaucaag

SEQ ID NO: 55802 - RNA, 19 nt, Homo sapiens
gcagaaaccuacaacucau

SEQ ID NO: 55803 - RNA, 19 nt, Homo sapiens
ugaacuagaagcuguguua

SEQ ID NO: 55804 - RNA, 19 nt, Homo sapiens
gcagugaauuggaagacuu

SEQ ID NO: 55805 - RNA, 19 nt, Homo sapiens
gaaacaagcauagaaaugg

SEQ ID NO: 55806 - RNA, 19 nt, Homo sapiens
ggaaguaaggaaacaugua

SEQ ID NO: 55807 - RNA, 19 nt, Homo sapiens
gaagugggcuccaguauua

SEQ ID NO: 55808 - RNA, 19 nt, Homo sapiens
caaaguagcugauguauug

SEQ ID NO: 55809 - RNA, 19 nt, Homo sapiens
gcaagaugcugauucauua

SEQ ID NO: 55810 - RNA, 19 nt, Homo sapiens
ggaaauggcugaacuagaa

SEQ ID NO: 55811 - RNA, 19 nt, Homo sapiens
gcaagaauaugaagaagua

SEQ ID NO: 55812 - RNA, 19 nt, Homo sapiens
gaagagaacuuaucuagug

SEQ ID NO: 55813 - RNA, 19 nt, Homo sapiens
gaacaaagcacaucagaaa

SEQ ID NO: 55814 - RNA, 19 nt, Homo sapiens
ccauacagcuucauaaaua

SEQ ID NO: 55815 - RNA, 19 nt, Homo sapiens
gaagccagcucaagcaaua

SEQ ID NO: 55816 - RNA, 19 nt, Homo sapiens
gcagauaguucuaccagua

SEQ ID NO: 55817 - RNA, 19 nt, Homo sapiens
caacgaaacuggacucauu

SEQ ID NO: 55818 - RNA, 19 nt, Homo sapiens
gaacuuaucuagugaggau

SEQ ID NO: 55819 - RNA, 19 nt, Homo sapiens
gaaacuccgucucuacuaa

SEQ ID NO: 55820 - RNA, 19 nt, Homo sapiens
gaacacagaggagaauuua

SEQ ID NO: 55821 - RNA, 19 nt, Homo sapiens
ccagugaacuuaaagaauu

SEQ ID NO: 55822 - RNA, 19 nt, Homo sapiens
aagcauggauucaaacuua

SEQ ID NO: 55823 - RNA, 19 nt, Homo sapiens
gagcugaaguuaacaaaug

SEQ ID NO: 55824 - RNA, 19 nt, Homo sapiens
gaaauagguuccagugaug

SEQ ID NO: 55825 - RNA, 19 nt, Homo sapiens
gaacggacacugaaauauu

SEQ ID NO: 55826 - RNA, 19 nt, Homo sapiens
cagaagugaugaacuguua

SEQ ID NO: 55827 - RNA, 19 nt, Homo sapiens
ccaaagaucucauguuaag

SEQ ID NO: 55828 - RNA, 19 nt, Homo sapiens
caaaugaacagacaaguaa

SEQ ID NO: 55829 - RNA, 19 nt, Homo sapiens
agaaugagcuuacaaagug

SEQ ID NO: 55830 - RNA, 19 nt, Homo sapiens
gaacagcaguuuauuacuc

SEQ ID NO: 55831 - RNA, 19 nt, Homo sapiens
gaaauuagaguccucagaa

SEQ ID NO: 55832 - RNA, 19 nt, Homo sapiens
caagaaaguacgagauuua

SEQ ID NO: 55833 - RNA, 19 nt, Homo sapiens
gaaagcagauuuggcaguu

SEQ ID NO: 55834 - RNA, 19 nt, Homo sapiens
gaaccugucuccacaaagu

SEQ ID NO: 55835 - RNA, 19 nt, Homo sapiens
gauaggaacuggaauaugc

SEQ ID NO: 55836 - RNA, 19 nt, Homo sapiens
ggaaagaaugagucuaaua

SEQ ID NO: 55837 - RNA, 19 nt, Homo sapiens
ugaaucaaaugccaaagua

SEQ ID NO: 55838 - RNA, 19 nt, Homo sapiens
gaaguaaggaaacauguaa

SEQ ID NO: 55839 - RNA, 19 nt, Homo sapiens
caaauaaacuugguagcaa

SEQ ID NO: 55840 - RNA, 19 nt, Homo sapiens
cagcuacccuuccaucaua

SEQ ID NO: 55841 - RNA, 19 nt, Homo sapiens
ugaaagaucuguagagagu

SEQ ID NO: 55842 - RNA, 19 nt, Homo sapiens
caauauggaacucgaauua

SEQ ID NO: 55843 - RNA, 19 nt, Homo sapiens
ccaaaucaguagagaguaa

SEQ ID NO: 55844 - RNA, 19 nt, Homo sapiens
gaaauuagccggucauggu

SEQ ID NO: 55845 - RNA, 19 nt, Homo sapiens
ccacaucacuuuaacuaau

SEQ ID NO: 55846 - RNA, 19 nt, Homo sapiens
ggucaagugaugaauauua

SEQ ID NO: 55847 - RNA, 19 nt, Homo sapiens
ggaacgggcuuggaagaaa

SEQ ID NO: 55848 - RNA, 19 nt, Homo sapiens
guuagaugauggugaaaua

SEQ ID NO: 55849 - RNA, 19 nt, Homo sapiens
caaaggaggcucuagguuu

SEQ ID NO: 55850 - RNA, 19 nt, Homo sapiens
uaauaucacugcaggcuuu

SEQ ID NO: 55851 - RNA, 19 nt, Homo sapiens
gaagauguuccuuggauaa

SEQ ID NO: 55852 - RNA, 19 nt, Homo sapiens
gggauaccaugcaacauaa

SEQ ID NO: 55853 - RNA, 19 nt, Homo sapiens
aaagagaaaugggaaauga

SEQ ID NO: 55854 - RNA, 19 nt, Homo sapiens
gcaaggagccaacauaaca

SEQ ID NO: 55855 - RNA, 19 nt, Homo sapiens
caauauaccuucucagucu

SEQ ID NO: 55856 - RNA, 19 nt, Homo sapiens
ucaaauaccagugaacuua

SEQ ID NO: 55857 - RNA, 19 nt, Homo sapiens
aacgaaagcugaaccuaua

SEQ ID NO: 55858 - RNA, 19 nt, Homo sapiens
gaaaguuaaugagugguuu

SEQ ID NO: 55859 - RNA, 19 nt, Homo sapiens
gaagauaccguuaauaagg

SEQ ID NO: 55860 - RNA, 19 nt, Homo sapiens
gaacagaaagaaauggauu

SEQ ID NO: 55861 - RNA, 19 nt, Homo sapiens
gaaaaggacuucuggcuau

SEQ ID NO: 55862 - RNA, 19 nt, Homo sapiens
gauaaugccaaauguagua

SEQ ID NO: 55863 - RNA, 19 nt, Homo sapiens
gcagaauggucaagugaug

SEQ ID NO: 55864 - RNA, 19 nt, Homo sapiens
gcagugagccaagaucaua

SEQ ID NO: 55865 - RNA, 19 nt, Homo sapiens
gggcaguucucaaauguug

SEQ ID NO: 55866 - RNA, 19 nt, Homo sapiens
gcaguaaccagguaauauu

SEQ ID NO: 55867 - RNA, 19 nt, Homo sapiens
guaagcauccugaaauaaa

SEQ ID NO: 55868 - RNA, 19 nt, Homo sapiens
gcauagaaauggaagaaag

SEQ ID NO: 55869 - RNA, 19 nt, Homo sapiens
guagagaguagcaguauuu

SEQ ID NO: 55870 - RNA, 19 nt, Homo sapiens
gaaaauaacucuccugaac

SEQ ID NO: 55871 - RNA, 19 nt, Homo sapiens
gaaaauggguaguuagcua

SEQ ID NO: 55872 - RNA, 19 nt, Homo sapiens
ggaauugguuucagaugau

SEQ ID NO: 55873 - RNA, 19 nt, Homo sapiens
aaagacuccugaaaugaua

SEQ ID NO: 55874 - RNA, 19 nt, Homo sapiens
aaaggcugcuugugaauuu

SEQ ID NO: 55875 - RNA, 19 nt, Homo sapiens
uauaagaccucuggcauga

SEQ ID NO: 55876 - RNA, 19 nt, Homo sapiens
gaaggagcuuucaucauuc

SEQ ID NO: 55877 - RNA, 19 nt, Homo sapiens
cuagaaaucuguugcuaug

SEQ ID NO: 55878 - RNA, 19 nt, Homo sapiens
gaggagauguggucaaugg

SEQ ID NO: 55879 - RNA, 19 nt, Homo sapiens
gaaacuacccaucucaaga

SEQ ID NO: 55880 - RNA, 19 nt, Homo sapiens
ugaaauagguuccagugau

SEQ ID NO: 55881 - RNA, 19 nt, Homo sapiens
guacagacaguuaauauca

SEQ ID NO: 55882 - RNA, 19 nt, Homo sapiens
ucaggaaaguaucucguua

SEQ ID NO: 55883 - RNA, 19 nt, Homo sapiens
gaaccuauaagcagcagua

SEQ ID NO: 55884 - RNA, 19 nt, Homo sapiens
gcucagggcuauccucuca

SEQ ID NO: 55885 - RNA, 19 nt, Homo sapiens
ugaaugcuaugcuuagauu

SEQ ID NO: 55886 - RNA, 19 nt, Homo sapiens
caucaucaacccaguaaua

SEQ ID NO: 55887 - RNA, 19 nt, Homo sapiens
gaaaccauacagcuucaua

SEQ ID NO: 55888 - RNA, 19 nt, Homo sapiens
caacauaaccugauaaagc

SEQ ID NO: 55889 - RNA, 19 nt, Homo sapiens
aaacaagcgucucugaaga

SEQ ID NO: 55890 - RNA, 19 nt, Homo sapiens
gaaguaguucagacuguua

SEQ ID NO: 55891 - RNA, 19 nt, Homo sapiens
ggacucauuacuccaaaua

SEQ ID NO: 55892 - RNA, 19 nt, Homo sapiens
ccaauagaaucacucgaaa

SEQ ID NO: 55893 - RNA, 19 nt, Homo sapiens
ucaugaggcuuuaauaugu

SEQ ID NO: 55894 - RNA, 19 nt, Homo sapiens
gaacaucaucaacccagua

SEQ ID NO: 55895 - RNA, 19 nt, Homo sapiens
gaagagcuauugaaaauca

SEQ ID NO: 55896 - RNA, 19 nt, Homo sapiens
gaagagacuacucauguug

SEQ ID NO: 55897 - RNA, 19 nt, Homo sapiens
gaaacaagcgucucugaag

SEQ ID NO: 55898 - RNA, 19 nt, Homo sapiens
ggaaacaagcauagaaaug

SEQ ID NO: 55899 - RNA, 19 nt, Homo sapiens
aaucuaagcccaccuaauu

SEQ ID NO: 55900 - RNA, 19 nt, Homo sapiens
cuaaauagcagcauucaga

SEQ ID NO: 55901 - RNA, 19 nt, Homo sapiens
gcagagggauaccaugcaa

SEQ ID NO: 55902 - RNA, 19 nt, Homo sapiens
auacagauuucucuccaua

SEQ ID NO: 55903 - RNA, 19 nt, Homo sapiens
gaaugagucuaauaucaag

SEQ ID NO: 55904 - RNA, 19 nt, Homo sapiens
gcagaaaccuacaacucau

SEQ ID NO: 55905 - RNA, 19 nt, Homo sapiens
gagccgagaucgcgccauu

SEQ ID NO: 55906 - RNA, 19 nt, Homo sapiens
ugaacuagaagcuguguua

SEQ ID NO: 55907 - RNA, 19 nt, Homo sapiens
gaagugggcuccaguauua

SEQ ID NO: 55908 - RNA, 19 nt, Homo sapiens
caaaguagcugauguauug

SEQ ID NO: 55909 - RNA, 19 nt, Homo sapiens
gcaagaugcugauucauua

SEQ ID NO: 55910 - RNA, 19 nt, Homo sapiens
ggaaauggcugaacuagaa

SEQ ID NO: 55911 - RNA, 19 nt, Homo sapiens
gcaagaauaugaagaagua

SEQ ID NO: 55912 - RNA, 19 nt, Homo sapiens
gaagagaacuuaucuagug

SEQ ID NO: 55913 - RNA, 19 nt, Homo sapiens
gaacaaagcacaucagaaa

SEQ ID NO: 55914 - RNA, 19 nt, Homo sapiens
ccauacagcuucauaaaua

SEQ ID NO: 55915 - RNA, 19 nt, Homo sapiens
gaagccagcucaagcaaua

SEQ ID NO: 55916 - RNA, 19 nt, Homo sapiens
gcagauaguucuaccagua

SEQ ID NO: 55917 - RNA, 19 nt, Homo sapiens
caacgaaacuggacucauu

SEQ ID NO: 55918 - RNA, 19 nt, Homo sapiens
gaacuuaucuagugaggau

SEQ ID NO: 55919 - RNA, 19 nt, Homo sapiens
gaacacagaggagaauuua

SEQ ID NO: 55920 - RNA, 19 nt, Homo sapiens
ccagugaacuuaaagaauu

SEQ ID NO: 55921 - RNA, 19 nt, Homo sapiens
aagcauggauucaaacuua

SEQ ID NO: 55922 - RNA, 19 nt, Homo sapiens
gagcugaaguuaacaaaug

SEQ ID NO: 55923 - RNA, 19 nt, Homo sapiens
gaaauagguuccagugaug

SEQ ID NO: 55924 - RNA, 19 nt, Homo sapiens
gaacggacacugaaauauu

SEQ ID NO: 55925 - RNA, 19 nt, Homo sapiens
cagaagugaugaacuguua

SEQ ID NO: 55926 - RNA, 19 nt, Homo sapiens
ccaaagaucucauguuaag

SEQ ID NO: 55927 - RNA, 19 nt, Homo sapiens
caaaugaacagacaaguaa

SEQ ID NO: 55928 - RNA, 19 nt, Homo sapiens
agaaugagcuuacaaagug

SEQ ID NO: 55929 - RNA, 19 nt, Homo sapiens
gaacagcaguuuauuacuc

SEQ ID NO: 55930 - RNA, 19 nt, Homo sapiens
gaaauuagaguccucagaa

SEQ ID NO: 55931 - RNA, 19 nt, Homo sapiens
caagaaaguacgagauuua

SEQ ID NO: 55932 - RNA, 19 nt, Homo sapiens
gaaagcagauuuggcaguu

SEQ ID NO: 55933 - RNA, 19 nt, Homo sapiens
gaaccugucuccacaaagu

SEQ ID NO: 55934 - RNA, 19 nt, Homo sapiens
ggaaagaaugagucuaaua

SEQ ID NO: 55935 - RNA, 19 nt, Homo sapiens
ugaaucaaaugccaaagua

SEQ ID NO: 55936 - RNA, 19 nt, Homo sapiens
gaaguaaggaaacauguaa

SEQ ID NO: 55937 - RNA, 19 nt, Homo sapiens
caaauaaacuugguagcaa

SEQ ID NO: 55938 - RNA, 19 nt, Homo sapiens
cagcuacccuuccaucaua

SEQ ID NO: 55939 - RNA, 19 nt, Homo sapiens
ugaaagaucuguagagagu

SEQ ID NO: 55940 - RNA, 19 nt, Homo sapiens
caauauggaacucgaauua

SEQ ID NO: 55941 - RNA, 19 nt, Homo sapiens
ccaaaucaguagagaguaa

SEQ ID NO: 55942 - RNA, 19 nt, Homo sapiens
gaaauuagccggucauggu

SEQ ID NO: 55943 - RNA, 19 nt, Homo sapiens
ccacaucacuuuaacuaau

SEQ ID NO: 55944 - RNA, 19 nt, Homo sapiens
ggucaagugaugaauauua

SEQ ID NO: 55945 - RNA, 19 nt, Homo sapiens
ggaacgggcuuggaagaaa

SEQ ID NO: 55946 - RNA, 19 nt, Homo sapiens
guuagaugauggugaaaua

SEQ ID NO: 55947 - RNA, 19 nt, Homo sapiens
caaaggaggcucuagguuu

SEQ ID NO: 55948 - RNA, 19 nt, Homo sapiens
uaauaucacugcaggcuuu

SEQ ID NO: 55949 - RNA, 19 nt, Homo sapiens
gaagauguuccuuggauaa

SEQ ID NO: 55950 - RNA, 19 nt, Homo sapiens
gggauaccaugcaacauaa

SEQ ID NO: 55951 - RNA, 19 nt, Homo sapiens
aaagagaaaugggaaauga

SEQ ID NO: 55952 - RNA, 19 nt, Homo sapiens
gcaaggagccaacauaaca

SEQ ID NO: 55953 - RNA, 19 nt, Homo sapiens
caauauaccuucucagucu

SEQ ID NO: 55954 - RNA, 19 nt, Homo sapiens
gaacagaaagaaauggauu

SEQ ID NO: 55955 - RNA, 19 nt, Homo sapiens
ucaaauaccagugaacuua

SEQ ID NO: 55956 - RNA, 19 nt, Homo sapiens
aacgaaagcugaaccuaua

SEQ ID NO: 55957 - RNA, 19 nt, Homo sapiens
gaaaguuaaugagugguuu

SEQ ID NO: 55958 - RNA, 19 nt, Homo sapiens
gaagauaccguuaauaagg

SEQ ID NO: 55959 - RNA, 19 nt, Homo sapiens
gaaaaggacuucuggcuau

SEQ ID NO: 55960 - RNA, 19 nt, Homo sapiens
gauaaugccaaauguagua

SEQ ID NO: 55961 - RNA, 19 nt, Homo sapiens
gcagaauggucaagugaug

SEQ ID NO: 55962 - RNA, 19 nt, Homo sapiens
gcagugagccaagaucaua

SEQ ID NO: 55963 - RNA, 19 nt, Homo sapiens
gggcaguucucaaauguug

SEQ ID NO: 55964 - RNA, 19 nt, Homo sapiens
gcaguaaccagguaauauu

SEQ ID NO: 55965 - RNA, 19 nt, Homo sapiens
guaagcauccugaaauaaa

SEQ ID NO: 55966 - RNA, 19 nt, Homo sapiens
gcauagaaauggaagaaag

SEQ ID NO: 55967 - RNA, 19 nt, Homo sapiens
guagagaguagcaguauuu

SEQ ID NO: 55968 - RNA, 19 nt, Homo sapiens
gaaaauaacucuccugaac

SEQ ID NO: 55969 - RNA, 19 nt, Homo sapiens
gaaaauggguaguuagcua

SEQ ID NO: 55970 - RNA, 19 nt, Homo sapiens
ggaauugguuucagaugau

SEQ ID NO: 55971 - RNA, 19 nt, Homo sapiens
aaagacuccugaaaugaua

SEQ ID NO: 55972 - RNA, 19 nt, Homo sapiens
aaaggcugcuugugaauuu

SEQ ID NO: 55973 - RNA, 19 nt, Homo sapiens
uauaagaccucuggcauga

SEQ ID NO: 55974 - RNA, 19 nt, Homo sapiens
gaaggagcuuucaucauuc

SEQ ID NO: 55975 - RNA, 19 nt, Homo sapiens
cuagaaaucuguugcuaug

SEQ ID NO: 55976 - RNA, 19 nt, Homo sapiens
gaggagauguggucaaugg

SEQ ID NO: 55977 - RNA, 19 nt, Homo sapiens
gaaacuacccaucucaaga

SEQ ID NO: 55978 - RNA, 19 nt, Homo sapiens
ugaaauagguuccagugau

SEQ ID NO: 55979 - RNA, 19 nt, Homo sapiens
guacagacaguuaauauca

SEQ ID NO: 55980 - RNA, 19 nt, Homo sapiens
ucaggaaaguaucucguua

SEQ ID NO: 55981 - RNA, 19 nt, Homo sapiens
gaaccuauaagcagcagua

SEQ ID NO: 55982 - RNA, 19 nt, Homo sapiens
gcucagggcuauccucuca

SEQ ID NO: 55983 - RNA, 19 nt, Homo sapiens
ugaaugcuaugcuuagauu

SEQ ID NO: 55984 - RNA, 19 nt, Homo sapiens
caucaucaacccaguaaua

SEQ ID NO: 55985 - RNA, 19 nt, Homo sapiens
gaaaccauacagcuucaua

SEQ ID NO: 55986 - RNA, 19 nt, Homo sapiens
caacauaaccugauaaagc

SEQ ID NO: 55987 - RNA, 19 nt, Homo sapiens
aaacaagcgucucugaaga

SEQ ID NO: 55988 - RNA, 19 nt, Homo sapiens
gaaguaguucagacuguua

SEQ ID NO: 55989 - RNA, 19 nt, Homo sapiens
ggacucauuacuccaaaua

SEQ ID NO: 55990 - RNA, 19 nt, Homo sapiens
ccaauagaaucacucgaaa

SEQ ID NO: 55991 - RNA, 19 nt, Homo sapiens
ucaugaggcuuuaauaugu

SEQ ID NO: 55992 - RNA, 19 nt, Homo sapiens
gaacaucaucaacccagua

SEQ ID NO: 55993 - RNA, 19 nt, Homo sapiens
gaagagcuauugaaaauca

SEQ ID NO: 55994 - RNA, 19 nt, Homo sapiens
gaagagacuacucauguug

SEQ ID NO: 55995 - RNA, 19 nt, Homo sapiens
gaaacaagcgucucugaag

SEQ ID NO: 55996 - RNA, 19 nt, Homo sapiens
ggaaacaagcauagaaaug

SEQ ID NO: 55997 - RNA, 19 nt, Homo sapiens
aaucuaagcccaccuaauu

SEQ ID NO: 55998 - RNA, 19 nt, Homo sapiens
cuaaauagcagcauucaga

SEQ ID NO: 55999 - RNA, 19 nt, Homo sapiens
gcagagggauaccaugcaa

SEQ ID NO: 56000 - RNA, 19 nt, Homo sapiens
auacagauuucucuccaua

SEQ ID NO: 56001 - RNA, 19 nt, Homo sapiens
gaaugagucuaauaucaag

SEQ ID NO: 56002 - RNA, 19 nt, Homo sapiens
gcagaaaccuacaacucau

SEQ ID NO: 56003 - RNA, 19 nt, Homo sapiens
ugaacuagaagcuguguua

SEQ ID NO: 56004 - RNA, 19 nt, Homo sapiens
gcagugaauuggaagacuu

SEQ ID NO: 56005 - RNA, 19 nt, Homo sapiens
gaaacaagcauagaaaugg

SEQ ID NO: 56006 - RNA, 19 nt, Homo sapiens
ggaaguaaggaaacaugua

SEQ ID NO: 56007 - RNA, 19 nt, Homo sapiens
gaagugggcuccaguauua

SEQ ID NO: 56008 - RNA, 19 nt, Homo sapiens
caaaguagcugauguauug

SEQ ID NO: 56009 - RNA, 19 nt, Homo sapiens
gcaagaugcugauucauua

SEQ ID NO: 56010 - RNA, 19 nt, Homo sapiens
ggaaauggcugaacuagaa

SEQ ID NO: 56011 - RNA, 19 nt, Homo sapiens
gcaagaauaugaagaagua

SEQ ID NO: 56012 - RNA, 19 nt, Homo sapiens
gaagagaacuuaucuagug

SEQ ID NO: 56013 - RNA, 19 nt, Homo sapiens
gaacaaagcacaucagaaa

SEQ ID NO: 56014 - RNA, 19 nt, Homo sapiens
ccauacagcuucauaaaua

SEQ ID NO: 56015 - RNA, 19 nt, Homo sapiens
gaagccagcucaagcaaua

SEQ ID NO: 56016 - RNA, 19 nt, Homo sapiens
gcagauaguucuaccagua

SEQ ID NO: 56017 - RNA, 19 nt, Homo sapiens
caacgaaacuggacucauu

SEQ ID NO: 56018 - RNA, 19 nt, Homo sapiens
gaacuuaucuagugaggau

SEQ ID NO: 56019 - RNA, 19 nt, Homo sapiens
gaacacagaggagaauuua

SEQ ID NO: 56020 - RNA, 19 nt, Homo sapiens
ccagugaacuuaaagaauu

SEQ ID NO: 56021 - RNA, 19 nt, Homo sapiens
aagcauggauucaaacuua

SEQ ID NO: 56022 - RNA, 19 nt, Homo sapiens
gagcugaaguuaacaaaug

SEQ ID NO: 56023 - RNA, 19 nt, Homo sapiens
gaaauagguuccagugaug

SEQ ID NO: 56024 - RNA, 19 nt, Homo sapiens
gaacggacacugaaauauu

SEQ ID NO: 56025 - RNA, 19 nt, Homo sapiens
cagaagugaugaacuguua

SEQ ID NO: 56026 - RNA, 19 nt, Homo sapiens
ccaaagaucucauguuaag

SEQ ID NO: 56027 - RNA, 19 nt, Homo sapiens
caaaugaacagacaaguaa

SEQ ID NO: 56028 - RNA, 19 nt, Homo sapiens
agaaugagcuuacaaagug

SEQ ID NO: 56029 - RNA, 19 nt, Homo sapiens
gaacagcaguuuauuacuc

SEQ ID NO: 56030 - RNA, 19 nt, Homo sapiens
gaaauuagaguccucagaa

SEQ ID NO: 56031 - RNA, 19 nt, Homo sapiens
gaaagcagauuuggcaguu

SEQ ID NO: 56032 - RNA, 19 nt, Homo sapiens
ggaaagaaugagucuaaua

SEQ ID NO: 56033 - RNA, 19 nt, Homo sapiens
ugaaucaaaugccaaagua

SEQ ID NO: 56034 - RNA, 19 nt, Homo sapiens
gaaguaaggaaacauguaa

SEQ ID NO: 56035 - RNA, 19 nt, Homo sapiens
caaauaaacuugguagcaa

SEQ ID NO: 56036 - RNA, 19 nt, Homo sapiens
cagcuacccuuccaucaua

SEQ ID NO: 56037 - RNA, 19 nt, Homo sapiens
ugaaagaucuguagagagu

SEQ ID NO: 56038 - RNA, 19 nt, Homo sapiens
caauauggaacucgaauua

SEQ ID NO: 56039 - RNA, 19 nt, Homo sapiens
ccaaaucaguagagaguaa

SEQ ID NO: 56040 - RNA, 19 nt, Homo sapiens
gaaauuagccggucauggu

SEQ ID NO: 56041 - RNA, 19 nt, Homo sapiens
ccacaucacuuuaacuaau

SEQ ID NO: 56042 - RNA, 19 nt, Homo sapiens
ggucaagugaugaauauua

SEQ ID NO: 56043 - RNA, 19 nt, Homo sapiens
ggaacgggcuuggaagaaa

SEQ ID NO: 56044 - RNA, 19 nt, Homo sapiens
guuagaugauggugaaaua

SEQ ID NO: 56045 - RNA, 19 nt, Homo sapiens
caaaggaggcucuagguuu

SEQ ID NO: 56046 - RNA, 19 nt, Homo sapiens
uaauaucacugcaggcuuu

SEQ ID NO: 56047 - RNA, 19 nt, Homo sapiens
gaagauguuccuuggauaa

SEQ ID NO: 56048 - RNA, 19 nt, Homo sapiens
gggauaccaugcaacauaa

SEQ ID NO: 56049 - RNA, 19 nt, Homo sapiens
aaagagaaaugggaaauga

SEQ ID NO: 56050 - RNA, 19 nt, Homo sapiens
gcaaggagccaacauaaca

SEQ ID NO: 56051 - RNA, 19 nt, Homo sapiens
caauauaccuucucagucu

SEQ ID NO: 56052 - RNA, 19 nt, Homo sapiens
ucaaauaccagugaacuua

SEQ ID NO: 56053 - RNA, 19 nt, Homo sapiens
aacgaaagcugaaccuaua

SEQ ID NO: 56054 - RNA, 19 nt, Homo sapiens
gaaaguuaaugagugguuu

SEQ ID NO: 56055 - RNA, 19 nt, Homo sapiens
gaaaaggacuucuggcuau

SEQ ID NO: 56056 - RNA, 19 nt, Homo sapiens
gauaaugccaaauguagua

SEQ ID NO: 56057 - RNA, 19 nt, Homo sapiens
gcagaauggucaagugaug

SEQ ID NO: 56058 - RNA, 19 nt, Homo sapiens
gcagugagccaagaucaua

SEQ ID NO: 56059 - RNA, 19 nt, Homo sapiens
gggcaguucucaaauguug

SEQ ID NO: 56060 - RNA, 19 nt, Homo sapiens
gcaguaaccagguaauauu

SEQ ID NO: 56061 - RNA, 19 nt, Homo sapiens
guaagcauccugaaauaaa

SEQ ID NO: 56062 - RNA, 19 nt, Homo sapiens
gcauagaaauggaagaaag

SEQ ID NO: 56063 - RNA, 19 nt, Homo sapiens
guagagaguagcaguauuu

SEQ ID NO: 56064 - RNA, 19 nt, Homo sapiens
gaaaauggguaguuagcua

SEQ ID NO: 56065 - RNA, 19 nt, Homo sapiens
ggaauugguuucagaugau

SEQ ID NO: 56066 - RNA, 19 nt, Homo sapiens
aaagacuccugaaaugaua

SEQ ID NO: 56067 - RNA, 19 nt, Homo sapiens
uauaagaccucuggcauga

SEQ ID NO: 56068 - RNA, 19 nt, Homo sapiens
gaaggagcuuucaucauuc

SEQ ID NO: 56069 - RNA, 19 nt, Homo sapiens
cuagaaaucuguugcuaug

SEQ ID NO: 56070 - RNA, 19 nt, Homo sapiens
gaggagauguggucaaugg

SEQ ID NO: 56071 - RNA, 19 nt, Homo sapiens
gaaacuacccaucucaaga

SEQ ID NO: 56072 - RNA, 19 nt, Homo sapiens
ugaaauagguuccagugau

SEQ ID NO: 56073 - RNA, 19 nt, Homo sapiens
guacagacaguuaauauca

SEQ ID NO: 56074 - RNA, 19 nt, Homo sapiens
ucaggaaaguaucucguua

SEQ ID NO: 56075 - RNA, 19 nt, Homo sapiens
gaaccuauaagcagcagua

SEQ ID NO: 56076 - RNA, 19 nt, Homo sapiens
gcucagggcuauccucuca

SEQ ID NO: 56077 - RNA, 19 nt, Homo sapiens
ugaaugcuaugcuuagauu

SEQ ID NO: 56078 - RNA, 19 nt, Homo sapiens
caucaucaacccaguaaua

SEQ ID NO: 56079 - RNA, 19 nt, Homo sapiens
gaaaccauacagcuucaua

SEQ ID NO: 56080 - RNA, 19 nt, Homo sapiens
caacauaaccugauaaagc

SEQ ID NO: 56081 - RNA, 19 nt, Homo sapiens
aaacaagcgucucugaaga

SEQ ID NO: 56082 - RNA, 19 nt, Homo sapiens
gaaguaguucagacuguua

SEQ ID NO: 56083 - RNA, 19 nt, Homo sapiens
ggacucauuacuccaaaua

SEQ ID NO: 56084 - RNA, 19 nt, Homo sapiens
ccaauagaaucacucgaaa

SEQ ID NO: 56085 - RNA, 19 nt, Homo sapiens
ucaugaggcuuuaauaugu

SEQ ID NO: 56086 - RNA, 19 nt, Homo sapiens
gaacaucaucaacccagua

SEQ ID NO: 56087 - RNA, 19 nt, Homo sapiens
gaagagacuacucauguug

SEQ ID NO: 56088 - RNA, 19 nt, Homo sapiens
gaaacaagcgucucugaag

SEQ ID NO: 56089 - RNA, 19 nt, Homo sapiens
ggaaacaagcauagaaaug

SEQ ID NO: 56090 - RNA, 19 nt, Homo sapiens
aaucuaagcccaccuaauu

SEQ ID NO: 56091 - RNA, 19 nt, Homo sapiens
cuaaauagcagcauucaga

SEQ ID NO: 56092 - RNA, 19 nt, Homo sapiens
gcagagggauaccaugcaa

SEQ ID NO: 56093 - RNA, 19 nt, Homo sapiens
auacagauuucucuccaua

SEQ ID NO: 56094 - RNA, 19 nt, Homo sapiens
gaaugagucuaauaucaag

SEQ ID NO: 56095 - RNA, 19 nt, Homo sapiens
gcagaaaccuacaacucau

SEQ ID NO: 56096 - RNA, 19 nt, Homo sapiens
ugaacuagaagcuguguua

SEQ ID NO: 56097 - RNA, 19 nt, Homo sapiens
gcagugaauuggaagacuu

SEQ ID NO: 56098 - RNA, 19 nt, Homo sapiens
gaaacaagcauagaaaugg

SEQ ID NO: 56099 - RNA, 19 nt, Homo sapiens
ggaaguaaggaaacaugua

SEQ ID NO: 56100 - RNA, 19 nt, Homo sapiens
gagaaucccaggacagaaa

SEQ ID NO: 56101 - RNA, 19 nt, Homo sapiens
gaaaacaccacaucacuuu

SEQ ID NO: 56102 - RNA, 19 nt, Homo sapiens
ggugguacaugcacaguug

SEQ ID NO: 56103 - RNA, 19 nt, Homo sapiens
cugaugaccuguuagauga

SEQ ID NO: 56104 - RNA, 19 nt, Homo sapiens
ugagaacagcaguuuauua

SEQ ID NO: 56105 - RNA, 19 nt, Homo sapiens
gaacucgaauuaaauaucc

SEQ ID NO: 56106 - RNA, 19 nt, Homo sapiens
guagaugaauauucugguu

SEQ ID NO: 56107 - RNA, 19 nt, Homo sapiens
gcaagaugcugauucauua

SEQ ID NO: 56108 - RNA, 19 nt, Homo sapiens
ggaaauggcugaacuagaa

SEQ ID NO: 56109 - RNA, 19 nt, Homo sapiens
gaacaaagcacaucagaaa

SEQ ID NO: 56110 - RNA, 19 nt, Homo sapiens
ccauacagcuucauaaaua

SEQ ID NO: 56111 - RNA, 19 nt, Homo sapiens
gcagauaguucuaccagua

SEQ ID NO: 56112 - RNA, 19 nt, Homo sapiens
gaacggacacugaaauauu

SEQ ID NO: 56113 - RNA, 19 nt, Homo sapiens
agaaugagcuuacaaagug

SEQ ID NO: 56114 - RNA, 19 nt, Homo sapiens
caagaaaguacgagauuua

SEQ ID NO: 56115 - RNA, 19 nt, Homo sapiens
gaaccugucuccacaaagu

SEQ ID NO: 56116 - RNA, 19 nt, Homo sapiens
caaauaaacuugguagcaa

SEQ ID NO: 56117 - RNA, 19 nt, Homo sapiens
cagcuacccuuccaucaua

SEQ ID NO: 56118 - RNA, 19 nt, Homo sapiens
gaaauuagccggucauggu

SEQ ID NO: 56119 - RNA, 19 nt, Homo sapiens
ccacaucacuuuaacuaau

SEQ ID NO: 56120 - RNA, 19 nt, Homo sapiens
gggauaccaugcaacauaa

SEQ ID NO: 56121 - RNA, 19 nt, Homo sapiens
gaacagaaagaaauggauu

SEQ ID NO: 56122 - RNA, 19 nt, Homo sapiens
gaaaaggacuucuggcuau

SEQ ID NO: 56123 - RNA, 19 nt, Homo sapiens
gcagugagccaagaucaua

SEQ ID NO: 56124 - RNA, 19 nt, Homo sapiens
gggcaguucucaaauguug

SEQ ID NO: 56125 - RNA, 19 nt, Homo sapiens
gaaaauaacucuccugaac

SEQ ID NO: 56126 - RNA, 19 nt, Homo sapiens
gaaaauggguaguuagcua

SEQ ID NO: 56127 - RNA, 19 nt, Homo sapiens
uauaagaccucuggcauga

SEQ ID NO: 56128 - RNA, 19 nt, Homo sapiens
gaaggagcuuucaucauuc

SEQ ID NO: 56129 - RNA, 19 nt, Homo sapiens
cuagaaaucuguugcuaug

SEQ ID NO: 56130 - RNA, 19 nt, Homo sapiens
gaggagauguggucaaugg

SEQ ID NO: 56131 - RNA, 19 nt, Homo sapiens
gaaacuacccaucucaaga

SEQ ID NO: 56132 - RNA, 19 nt, Homo sapiens
gcucagggcuauccucuca

SEQ ID NO: 56133 - RNA, 19 nt, Homo sapiens
gaaaccauacagcuucaua

SEQ ID NO: 56134 - RNA, 19 nt, Homo sapiens
caacauaaccugauaaagc

SEQ ID NO: 56135 - RNA, 19 nt, Homo sapiens
aaacaagcgucucugaaga

SEQ ID NO: 56136 - RNA, 19 nt, Homo sapiens
gaagagcuauugaaaauca

SEQ ID NO: 56137 - RNA, 19 nt, Homo sapiens
gaagagacuacucauguug

SEQ ID NO: 56138 - RNA, 19 nt, Homo sapiens
gaaacaagcgucucugaag

SEQ ID NO: 56139 - RNA, 19 nt, Homo sapiens
gcagagggauaccaugcaa

SEQ ID NO: 56140 - RNA, 19 nt, Homo sapiens
ugaacuagaagcuguguua

SEQ ID NO: 56141 - RNA, 19 nt, Homo sapiens
gaaaguacgagauuuaguc

SEQ ID NO: 56142 - RNA, 19 nt, Homo sapiens
gagaaucccaggacagaaa

SEQ ID NO: 56143 - RNA, 19 nt, Homo sapiens
gaaaacaccacaucacuuu

SEQ ID NO: 56144 - RNA, 19 nt, Homo sapiens
ggugguacaugcacaguug

SEQ ID NO: 56145 - RNA, 19 nt, Homo sapiens
cuacuguccuggcuacuaa

SEQ ID NO: 56146 - RNA, 19 nt, Homo sapiens
gcccacagaucaacuggaa

SEQ ID NO: 56147 - RNA, 19 nt, Homo sapiens
caacagaaagggucaacaa

SEQ ID NO: 56148 - RNA, 19 nt, Homo sapiens
ugacacagguuuggaguau

SEQ ID NO: 56149 - RNA, 19 nt, Homo sapiens
ugacagaucccaccaggaa

SEQ ID NO: 56150 - RNA, 19 nt, Homo sapiens
uaagaccucuggcaugaau

SEQ ID NO: 56151 - RNA, 19 nt, Homo sapiens
gcagggagaagccagaauu

SEQ ID NO: 56152 - RNA, 19 nt, Homo sapiens
gaagacugcucagggcuau

SEQ ID NO: 56153 - RNA, 19 nt, Homo sapiens
gagauuuagucaacuuguu

SEQ ID NO: 56154 - RNA, 19 nt, Homo sapiens
ggaggaaaauggguaguua

SEQ ID NO: 56155 - RNA, 19 nt, Homo sapiens
ucauuaagguuguugaugu

SEQ ID NO: 56156 - RNA, 19 nt, Homo sapiens
aagaggagcucauuaaggu

SEQ ID NO: 56157 - RNA, 19 nt, Homo sapiens
ugagaacucugaggacaaa

SEQ ID NO: 56158 - RNA, 19 nt, Homo sapiens
gacccagucuauuaaagaa

SEQ ID NO: 56159 - RNA, 19 nt, Homo sapiens
ugaagagacuacucauguu

SEQ ID NO: 56160 - RNA, 19 nt, Homo sapiens
ggacaaagcagcggauaca

SEQ ID NO: 56161 - RNA, 19 nt, Homo sapiens
uaacucuccugaacaucua

SEQ ID NO: 56162 - RNA, 19 nt, Homo sapiens
gcaaauaaacuugguagca

SEQ ID NO: 56163 - RNA, 19 nt, Homo sapiens
gaauaguccuugggcaguu

SEQ ID NO: 56164 - RNA, 19 nt, Homo sapiens
aacggacacugaaauauuu

SEQ ID NO: 56165 - RNA, 19 nt, Homo sapiens
aaacaccacaucacuuuaa

SEQ ID NO: 56166 - RNA, 19 nt, Homo sapiens
gaauagaaacuacccaucu

SEQ ID NO: 56167 - RNA, 19 nt, Homo sapiens
uaaagaaccaggaguggaa

SEQ ID NO: 56168 - RNA, 19 nt, Homo sapiens
acuagaagcuguguuagaa

SEQ ID NO: 56169 - RNA, 19 nt, Homo sapiens
gcuguuaacacugcaaaua

SEQ ID NO: 56170 - RNA, 19 nt, Homo sapiens
gaauagcugguuucccuaa

SEQ ID NO: 56171 - RNA, 19 nt, Homo sapiens
gaaccgguuuccaaagaca

SEQ ID NO: 56172 - RNA, 19 nt, Homo sapiens
gcagguauuagaaaugaaa

SEQ ID NO: 56173 - RNA, 19 nt, Homo sapiens
ucaagagaauagcugguuu

SEQ ID NO: 56174 - RNA, 19 nt, Homo sapiens
gaaauucugaggcagguau

SEQ ID NO: 56175 - RNA, 19 nt, Homo sapiens
gaucgauuaugugacuuaa

SEQ ID NO: 56176 - RNA, 19 nt, Homo sapiens
gagcuccucucacucuuca

SEQ ID NO: 56177 - RNA, 19 nt, Homo sapiens
ccaagaaugagcuuacaaa

SEQ ID NO: 56178 - RNA, 19 nt, Homo sapiens
gcuggacaccuaccugaua

SEQ ID NO: 56179 - RNA, 19 nt, Homo sapiens
caucauaagugacucuucu

SEQ ID NO: 56180 - RNA, 19 nt, Homo sapiens
caugcaacauaaccugaua

SEQ ID NO: 56181 - RNA, 19 nt, Homo sapiens
caaaguaugggcuacagaa

SEQ ID NO: 56182 - RNA, 19 nt, Homo sapiens
acaagaaaguacgagauuu

SEQ ID NO: 56183 - RNA, 19 nt, Homo sapiens
uuguagcucugguauauaa

SEQ ID NO: 56184 - RNA, 19 nt, Homo sapiens
aagaaccgguuuccaaaga

SEQ ID NO: 56185 - RNA, 19 nt, Homo sapiens
cagaucaacuggaauggau

SEQ ID NO: 56186 - RNA, 19 nt, Homo sapiens
aaauaacucuccugaacau

SEQ ID NO: 56187 - RNA, 19 nt, Homo sapiens
guaaauguugugcuguuaa

SEQ ID NO: 56188 - RNA, 19 nt, Homo sapiens
cacaguguccuuuauguaa

SEQ ID NO: 56189 - RNA, 19 nt, Homo sapiens
ucaagaaccgguuuccaaa

SEQ ID NO: 56190 - RNA, 19 nt, Homo sapiens
gaaaugaaaaggaaacuug

SEQ ID NO: 56191 - RNA, 19 nt, Homo sapiens
ccacagaucaacuggaaug

SEQ ID NO: 56192 - RNA, 19 nt, Homo sapiens
caacaugcccacagaucaa

SEQ ID NO: 56193 - RNA, 19 nt, Homo sapiens
ucaccaacaugcccacaga

SEQ ID NO: 56194 - RNA, 19 nt, Homo sapiens
cagaggagauguggucaau

SEQ ID NO: 56195 - RNA, 19 nt, Homo sapiens
gcaggaaauggcugaacua

SEQ ID NO: 56196 - RNA, 19 nt, Homo sapiens
uguaaauguugugcuguua

SEQ ID NO: 56197 - RNA, 19 nt, Homo sapiens
gaaaccccaucucuacuaa

SEQ ID NO: 56198 - RNA, 19 nt, Homo sapiens
ucgauuaugugacuuaaag

SEQ ID NO: 56199 - RNA, 19 nt, Homo sapiens
ggaucgauuaugugacuua

SEQ ID NO: 56200 - RNA, 19 nt, Homo sapiens
ggagagugcuugggaucga

SEQ ID NO: 56201 - RNA, 19 nt, Homo sapiens
ucacaaaggcagagaguca

SEQ ID NO: 56202 - RNA, 19 nt, Homo sapiens
gcccuauucuuucuauuca

SEQ ID NO: 56203 - RNA, 19 nt, Homo sapiens
uguccuggcuacuaaauau

SEQ ID NO: 56204 - RNA, 19 nt, Homo sapiens
caauugggcagauguguga

SEQ ID NO: 56205 - RNA, 19 nt, Homo sapiens
gugaacggacacugaaaua

SEQ ID NO: 56206 - RNA, 19 nt, Homo sapiens
ggagaagccagaauugaca

SEQ ID NO: 56207 - RNA, 19 nt, Homo sapiens
gaagugggcuccaguauua

SEQ ID NO: 56208 - RNA, 19 nt, Homo sapiens
caaaguagcugauguauug

SEQ ID NO: 56209 - RNA, 19 nt, Homo sapiens
gcaagaugcugauucauua

SEQ ID NO: 56210 - RNA, 19 nt, Homo sapiens
ggaaauggcugaacuagaa

SEQ ID NO: 56211 - RNA, 19 nt, Homo sapiens
gcaagaauaugaagaagua

SEQ ID NO: 56212 - RNA, 19 nt, Homo sapiens
gaagagaacuuaucuagug

SEQ ID NO: 56213 - RNA, 19 nt, Homo sapiens
gaacaaagcacaucagaaa

SEQ ID NO: 56214 - RNA, 19 nt, Homo sapiens
ccauacagcuucauaaaua

SEQ ID NO: 56215 - RNA, 19 nt, Homo sapiens
gaagccagcucaagcaaua

SEQ ID NO: 56216 - RNA, 19 nt, Homo sapiens
caacgaaacuggacucauu

SEQ ID NO: 56217 - RNA, 19 nt, Homo sapiens
gaacuuaucuagugaggau

SEQ ID NO: 56218 - RNA, 19 nt, Homo sapiens
gaacacagaggagaauuua

SEQ ID NO: 56219 - RNA, 19 nt, Homo sapiens
ccagugaacuuaaagaauu

SEQ ID NO: 56220 - RNA, 19 nt, Homo sapiens
aagcauggauucaaacuua

SEQ ID NO: 56221 - RNA, 19 nt, Homo sapiens
gagcugaaguuaacaaaug

SEQ ID NO: 56222 - RNA, 19 nt, Homo sapiens
gaaauagguuccagugaug

SEQ ID NO: 56223 - RNA, 19 nt, Homo sapiens
gaacggacacugaaauauu

SEQ ID NO: 56224 - RNA, 19 nt, Homo sapiens
cagaagugaugaacuguua

SEQ ID NO: 56225 - RNA, 19 nt, Homo sapiens
ccaaagaucucauguuaag

SEQ ID NO: 56226 - RNA, 19 nt, Homo sapiens
caaaugaacagacaaguaa

SEQ ID NO: 56227 - RNA, 19 nt, Homo sapiens
agaaugagcuuacaaagug

SEQ ID NO: 56228 - RNA, 19 nt, Homo sapiens
gaacagcaguuuauuacuc

SEQ ID NO: 56229 - RNA, 19 nt, Homo sapiens
gaaauuagaguccucagaa

SEQ ID NO: 56230 - RNA, 19 nt, Homo sapiens
caagaaaguacgagauuua

SEQ ID NO: 56231 - RNA, 19 nt, Homo sapiens
gaaagcagauuuggcaguu

SEQ ID NO: 56232 - RNA, 19 nt, Homo sapiens
gaaccugucuccacaaagu

SEQ ID NO: 56233 - RNA, 19 nt, Homo sapiens
ggaaagaaugagucuaaua

SEQ ID NO: 56234 - RNA, 19 nt, Homo sapiens
ugaaucaaaugccaaagua

SEQ ID NO: 56235 - RNA, 19 nt, Homo sapiens
gaaguaaggaaacauguaa

SEQ ID NO: 56236 - RNA, 19 nt, Homo sapiens
caaauaaacuugguagcaa

SEQ ID NO: 56237 - RNA, 19 nt, Homo sapiens
cagcuacccuuccaucaua

SEQ ID NO: 56238 - RNA, 19 nt, Homo sapiens
ugaaagaucuguagagagu

SEQ ID NO: 56239 - RNA, 19 nt, Homo sapiens
caauauggaacucgaauua

SEQ ID NO: 56240 - RNA, 19 nt, Homo sapiens
ccaaaucaguagagaguaa

SEQ ID NO: 56241 - RNA, 19 nt, Homo sapiens
gaaauuagccggucauggu

SEQ ID NO: 56242 - RNA, 19 nt, Homo sapiens
ggucaagugaugaauauua

SEQ ID NO: 56243 - RNA, 19 nt, Homo sapiens
ggaacgggcuuggaagaaa

SEQ ID NO: 56244 - RNA, 19 nt, Homo sapiens
guuagaugauggugaaaua

SEQ ID NO: 56245 - RNA, 19 nt, Homo sapiens
caaaggaggcucuagguuu

SEQ ID NO: 56246 - RNA, 19 nt, Homo sapiens
uaauaucacugcaggcuuu

SEQ ID NO: 56247 - RNA, 19 nt, Homo sapiens
gaagauguuccuuggauaa

SEQ ID NO: 56248 - RNA, 19 nt, Homo sapiens
gggauaccaugcaacauaa

SEQ ID NO: 56249 - RNA, 19 nt, Homo sapiens
aaagagaaaugggaaauga

SEQ ID NO: 56250 - RNA, 19 nt, Homo sapiens
gcaaggagccaacauaaca

SEQ ID NO: 56251 - RNA, 19 nt, Homo sapiens
caauauaccuucucagucu

SEQ ID NO: 56252 - RNA, 19 nt, Homo sapiens
ucaaauaccagugaacuua

SEQ ID NO: 56253 - RNA, 19 nt, Homo sapiens
aacgaaagcugaaccuaua

SEQ ID NO: 56254 - RNA, 19 nt, Homo sapiens
gaacagaaagaaauggauu

SEQ ID NO: 56255 - RNA, 19 nt, Homo sapiens
gaaaguuaaugagugguuu

SEQ ID NO: 56256 - RNA, 19 nt, Homo sapiens
gaagauaccguuaauaagg

SEQ ID NO: 56257 - RNA, 19 nt, Homo sapiens
gaaaaggacuucuggcuau

SEQ ID NO: 56258 - RNA, 19 nt, Homo sapiens
gauaaugccaaauguagua

SEQ ID NO: 56259 - RNA, 19 nt, Homo sapiens
gcagaauggucaagugaug

SEQ ID NO: 56260 - RNA, 19 nt, Homo sapiens
gcagugagccaagaucaua

SEQ ID NO: 56261 - RNA, 19 nt, Homo sapiens
gggcaguucucaaauguug

SEQ ID NO: 56262 - RNA, 19 nt, Homo sapiens
gcaguaaccagguaauauu

SEQ ID NO: 56263 - RNA, 19 nt, Homo sapiens
guaagcauccugaaauaaa

SEQ ID NO: 56264 - RNA, 19 nt, Homo sapiens
gcauagaaauggaagaaag

SEQ ID NO: 56265 - RNA, 19 nt, Homo sapiens
guagagaguagcaguauuu

SEQ ID NO: 56266 - RNA, 19 nt, Homo sapiens
gaaaauaacucuccugaac

SEQ ID NO: 56267 - RNA, 19 nt, Homo sapiens
gaaaauggguaguuagcua

SEQ ID NO: 56268 - RNA, 19 nt, Homo sapiens
ggaauugguuucagaugau

SEQ ID NO: 56269 - RNA, 19 nt, Homo sapiens
aaagacuccugaaaugaua

SEQ ID NO: 56270 - RNA, 19 nt, Homo sapiens
aaaggcugcuugugaauuu

SEQ ID NO: 56271 - RNA, 19 nt, Homo sapiens
uauaagaccucuggcauga

SEQ ID NO: 56272 - RNA, 19 nt, Homo sapiens
gaaggagcuuucaucauuc

SEQ ID NO: 56273 - RNA, 19 nt, Homo sapiens
cuagaaaucuguugcuaug

SEQ ID NO: 56274 - RNA, 19 nt, Homo sapiens
gaggagauguggucaaugg

SEQ ID NO: 56275 - RNA, 19 nt, Homo sapiens
ugaaauagguuccagugau

SEQ ID NO: 56276 - RNA, 19 nt, Homo sapiens
guacagacaguuaauauca

SEQ ID NO: 56277 - RNA, 19 nt, Homo sapiens
ucaggaaaguaucucguua

SEQ ID NO: 56278 - RNA, 19 nt, Homo sapiens
gaaccuauaagcagcagua

SEQ ID NO: 56279 - RNA, 19 nt, Homo sapiens
gcucagggcuauccucuca

SEQ ID NO: 56280 - RNA, 19 nt, Homo sapiens
ugaaugcuaugcuuagauu

SEQ ID NO: 56281 - RNA, 19 nt, Homo sapiens
caucaucaacccaguaaua

SEQ ID NO: 56282 - RNA, 19 nt, Homo sapiens
gaaaccauacagcuucaua

SEQ ID NO: 56283 - RNA, 19 nt, Homo sapiens
caacauaaccugauaaagc

SEQ ID NO: 56284 - RNA, 19 nt, Homo sapiens
aaacaagcgucucugaaga

SEQ ID NO: 56285 - RNA, 19 nt, Homo sapiens
gaaguaguucagacuguua

SEQ ID NO: 56286 - RNA, 19 nt, Homo sapiens
ggacucauuacuccaaaua

SEQ ID NO: 56287 - RNA, 19 nt, Homo sapiens
ccaauagaaucacucgaaa

SEQ ID NO: 56288 - RNA, 19 nt, Homo sapiens
ucaugaggcuuuaauaugu

SEQ ID NO: 56289 - RNA, 19 nt, Homo sapiens
gaacaucaucaacccagua

SEQ ID NO: 56290 - RNA, 19 nt, Homo sapiens
gaagagcuauugaaaauca

SEQ ID NO: 56291 - RNA, 19 nt, Homo sapiens
gaaacaagcgucucugaag

SEQ ID NO: 56292 - RNA, 19 nt, Homo sapiens
ggaaacaagcauagaaaug

SEQ ID NO: 56293 - RNA, 19 nt, Homo sapiens
aaucuaagcccaccuaauu

SEQ ID NO: 56294 - RNA, 19 nt, Homo sapiens
cuaaauagcagcauucaga

SEQ ID NO: 56295 - RNA, 19 nt, Homo sapiens
gcagagggauaccaugcaa

SEQ ID NO: 56296 - RNA, 19 nt, Homo sapiens
auacagauuucucuccaua

SEQ ID NO: 56297 - RNA, 19 nt, Homo sapiens
gaaugagucuaauaucaag

SEQ ID NO: 56298 - RNA, 19 nt, Homo sapiens
gcagaaaccuacaacucau

SEQ ID NO: 56299 - RNA, 19 nt, Homo sapiens
ugaacuagaagcuguguua

SEQ ID NO: 56300 - RNA, 19 nt, Homo sapiens
gcagugaauuggaagacuu

SEQ ID NO: 56301 - RNA, 19 nt, Homo sapiens
gaaacaagcauagaaaugg

SEQ ID NO: 56302 - RNA, 19 nt, Homo sapiens
ggaaguaaggaaacaugua

SEQ ID NO: 56303 - RNA, 19 nt, Homo sapiens
gaaaguacgagauuuaguc

SEQ ID NO: 56304 - RNA, 19 nt, Homo sapiens
gagaaucccaggacagaaa

SEQ ID NO: 56305 - RNA, 19 nt, Homo sapiens
cugaugaccuguuagauga

SEQ ID NO: 56306 - RNA, 19 nt, Homo sapiens
gaacucgaauuaaauaucc

SEQ ID NO: 56307 - RNA, 19 nt, Homo sapiens
gaagugggcuccaguauua

SEQ ID NO: 56308 - RNA, 19 nt, Homo sapiens
caaaguagcugauguauug

SEQ ID NO: 56309 - RNA, 19 nt, Homo sapiens
gcaagaugcugauucauua

SEQ ID NO: 56310 - RNA, 19 nt, Homo sapiens
ggaaauggcugaacuagaa

SEQ ID NO: 56311 - RNA, 19 nt, Homo sapiens
gcaagaauaugaagaagua

SEQ ID NO: 56312 - RNA, 19 nt, Homo sapiens
gaagagaacuuaucuagug

SEQ ID NO: 56313 - RNA, 19 nt, Homo sapiens
gaacaaagcacaucagaaa

SEQ ID NO: 56314 - RNA, 19 nt, Homo sapiens
ccauacagcuucauaaaua

SEQ ID NO: 56315 - RNA, 19 nt, Homo sapiens
gaagccagcucaagcaaua

SEQ ID NO: 56316 - RNA, 19 nt, Homo sapiens
caacgaaacuggacucauu

SEQ ID NO: 56317 - RNA, 19 nt, Homo sapiens
gaacuuaucuagugaggau

SEQ ID NO: 56318 - RNA, 19 nt, Homo sapiens
gaacacagaggagaauuua

SEQ ID NO: 56319 - RNA, 19 nt, Homo sapiens
ccagugaacuuaaagaauu

SEQ ID NO: 56320 - RNA, 19 nt, Homo sapiens
aagcauggauucaaacuua

SEQ ID NO: 56321 - RNA, 19 nt, Homo sapiens
gagcugaaguuaacaaaug

SEQ ID NO: 56322 - RNA, 19 nt, Homo sapiens
gaaauagguuccagugaug

SEQ ID NO: 56323 - RNA, 19 nt, Homo sapiens
cagaagugaugaacuguua

SEQ ID NO: 56324 - RNA, 19 nt, Homo sapiens
ccaaagaucucauguuaag

SEQ ID NO: 56325 - RNA, 19 nt, Homo sapiens
caaaugaacagacaaguaa

SEQ ID NO: 56326 - RNA, 19 nt, Homo sapiens
agaaugagcuuacaaagug

SEQ ID NO: 56327 - RNA, 19 nt, Homo sapiens
gaacagcaguuuauuacuc

SEQ ID NO: 56328 - RNA, 19 nt, Homo sapiens
gaaauuagaguccucagaa

SEQ ID NO: 56329 - RNA, 19 nt, Homo sapiens
caagaaaguacgagauuua

SEQ ID NO: 56330 - RNA, 19 nt, Homo sapiens
gaaagcagauuuggcaguu

SEQ ID NO: 56331 - RNA, 19 nt, Homo sapiens
gaaccugucuccacaaagu

SEQ ID NO: 56332 - RNA, 19 nt, Homo sapiens
ggaaagaaugagucuaaua

SEQ ID NO: 56333 - RNA, 19 nt, Homo sapiens
ugaaucaaaugccaaagua

SEQ ID NO: 56334 - RNA, 19 nt, Homo sapiens
gaaguaaggaaacauguaa

SEQ ID NO: 56335 - RNA, 19 nt, Homo sapiens
caaauaaacuugguagcaa

SEQ ID NO: 56336 - RNA, 19 nt, Homo sapiens
cagcuacccuuccaucaua

SEQ ID NO: 56337 - RNA, 19 nt, Homo sapiens
ugaaagaucuguagagagu

SEQ ID NO: 56338 - RNA, 19 nt, Homo sapiens
caauauggaacucgaauua

SEQ ID NO: 56339 - RNA, 19 nt, Homo sapiens
ccaaaucaguagagaguaa

SEQ ID NO: 56340 - RNA, 19 nt, Homo sapiens
gaaauuagccggucauggu

SEQ ID NO: 56341 - RNA, 19 nt, Homo sapiens
ggucaagugaugaauauua

SEQ ID NO: 56342 - RNA, 19 nt, Homo sapiens
ggaacgggcuuggaagaaa

SEQ ID NO: 56343 - RNA, 19 nt, Homo sapiens
guuagaugauggugaaaua

SEQ ID NO: 56344 - RNA, 19 nt, Homo sapiens
caaaggaggcucuagguuu

SEQ ID NO: 56345 - RNA, 19 nt, Homo sapiens
uaauaucacugcaggcuuu

SEQ ID NO: 56346 - RNA, 19 nt, Homo sapiens
gaagauguuccuuggauaa

SEQ ID NO: 56347 - RNA, 19 nt, Homo sapiens
gggauaccaugcaacauaa

SEQ ID NO: 56348 - RNA, 19 nt, Homo sapiens
aaagagaaaugggaaauga

SEQ ID NO: 56349 - RNA, 19 nt, Homo sapiens
gcaaggagccaacauaaca

SEQ ID NO: 56350 - RNA, 19 nt, Homo sapiens
gaacagaaagaaauggauu

SEQ ID NO: 56351 - RNA, 19 nt, Homo sapiens
caauauaccuucucagucu

SEQ ID NO: 56352 - RNA, 19 nt, Homo sapiens
ucaaauaccagugaacuua

SEQ ID NO: 56353 - RNA, 19 nt, Homo sapiens
aacgaaagcugaaccuaua

SEQ ID NO: 56354 - RNA, 19 nt, Homo sapiens
gaaaguuaaugagugguuu

SEQ ID NO: 56355 - RNA, 19 nt, Homo sapiens
gaagauaccguuaauaagg

SEQ ID NO: 56356 - RNA, 19 nt, Homo sapiens
gaaaaggacuucuggcuau

SEQ ID NO: 56357 - RNA, 19 nt, Homo sapiens
gauaaugccaaauguagua

SEQ ID NO: 56358 - RNA, 19 nt, Homo sapiens
gcagaauggucaagugaug

SEQ ID NO: 56359 - RNA, 19 nt, Homo sapiens
gcagugagccaagaucaua

SEQ ID NO: 56360 - RNA, 19 nt, Homo sapiens
gggcaguucucaaauguug

SEQ ID NO: 56361 - RNA, 19 nt, Homo sapiens
gcaguaaccagguaauauu

SEQ ID NO: 56362 - RNA, 19 nt, Homo sapiens
guaagcauccugaaauaaa

SEQ ID NO: 56363 - RNA, 19 nt, Homo sapiens
gcauagaaauggaagaaag

SEQ ID NO: 56364 - RNA, 19 nt, Homo sapiens
guagagaguagcaguauuu

SEQ ID NO: 56365 - RNA, 19 nt, Homo sapiens
gaaaauaacucuccugaac

SEQ ID NO: 56366 - RNA, 19 nt, Homo sapiens
ggaauugguuucagaugau

SEQ ID NO: 56367 - RNA, 19 nt, Homo sapiens
aaagacuccugaaaugaua

SEQ ID NO: 56368 - RNA, 19 nt, Homo sapiens
aaaggcugcuugugaauuu

SEQ ID NO: 56369 - RNA, 19 nt, Homo sapiens
uauaagaccucuggcauga

SEQ ID NO: 56370 - RNA, 19 nt, Homo sapiens
gaaggagcuuucaucauuc

SEQ ID NO: 56371 - RNA, 19 nt, Homo sapiens
cuagaaaucuguugcuaug

SEQ ID NO: 56372 - RNA, 19 nt, Homo sapiens
gaggagauguggucaaugg

SEQ ID NO: 56373 - RNA, 19 nt, Homo sapiens
ugaaauagguuccagugau

SEQ ID NO: 56374 - RNA, 19 nt, Homo sapiens
guacagacaguuaauauca

SEQ ID NO: 56375 - RNA, 19 nt, Homo sapiens
ucaggaaaguaucucguua

SEQ ID NO: 56376 - RNA, 19 nt, Homo sapiens
gaaccuauaagcagcagua

SEQ ID NO: 56377 - RNA, 19 nt, Homo sapiens
gcucagggcuauccucuca

SEQ ID NO: 56378 - RNA, 19 nt, Homo sapiens
ugaaugcuaugcuuagauu

SEQ ID NO: 56379 - RNA, 19 nt, Homo sapiens
caucaucaacccaguaaua

SEQ ID NO: 56380 - RNA, 19 nt, Homo sapiens
gaaaccauacagcuucaua

SEQ ID NO: 56381 - RNA, 19 nt, Homo sapiens
caacauaaccugauaaagc

SEQ ID NO: 56382 - RNA, 19 nt, Homo sapiens
aaacaagcgucucugaaga

SEQ ID NO: 56383 - RNA, 19 nt, Homo sapiens
gaaguaguucagacuguua

SEQ ID NO: 56384 - RNA, 19 nt, Homo sapiens
ggacucauuacuccaaaua

SEQ ID NO: 56385 - RNA, 19 nt, Homo sapiens
ccaauagaaucacucgaaa

SEQ ID NO: 56386 - RNA, 19 nt, Homo sapiens
ucaugaggcuuuaauaugu

SEQ ID NO: 56387 - RNA, 19 nt, Homo sapiens
gaacaucaucaacccagua

SEQ ID NO: 56388 - RNA, 19 nt, Homo sapiens
gaagagcuauugaaaauca

SEQ ID NO: 56389 - RNA, 19 nt, Homo sapiens
gaaacaagcgucucugaag

SEQ ID NO: 56390 - RNA, 19 nt, Homo sapiens
ggaaacaagcauagaaaug

SEQ ID NO: 56391 - RNA, 19 nt, Homo sapiens
aaucuaagcccaccuaauu

SEQ ID NO: 56392 - RNA, 19 nt, Homo sapiens
cuaaauagcagcauucaga

SEQ ID NO: 56393 - RNA, 19 nt, Homo sapiens
gcagagggauaccaugcaa

SEQ ID NO: 56394 - RNA, 19 nt, Homo sapiens
auacagauuucucuccaua

SEQ ID NO: 56395 - RNA, 19 nt, Homo sapiens
gaaugagucuaauaucaag

SEQ ID NO: 56396 - RNA, 19 nt, Homo sapiens
gcagaaaccuacaacucau

SEQ ID NO: 56397 - RNA, 19 nt, Homo sapiens
ugaacuagaagcuguguua

SEQ ID NO: 56398 - RNA, 19 nt, Homo sapiens
gcagugaauuggaagacuu

SEQ ID NO: 56399 - RNA, 19 nt, Homo sapiens
gaaacaagcauagaaaugg

SEQ ID NO: 56400 - RNA, 19 nt, Homo sapiens
ggaaguaaggaaacaugua

SEQ ID NO: 56401 - RNA, 19 nt, Homo sapiens
gaaaguacgagauuuaguc

SEQ ID NO: 56402 - RNA, 19 nt, Homo sapiens
gagaaucccaggacagaaa

SEQ ID NO: 56403 - RNA, 19 nt, Homo sapiens
cugaugaccuguuagauga

SEQ ID NO: 56404 - RNA, 19 nt, Homo sapiens
gaacucgaauuaaauaucc

SEQ ID NO: 56405 - RNA, 19 nt, Homo sapiens
guagaugaauauucugguu

SEQ ID NO: 56406 - RNA, 19 nt, Homo sapiens
ugagaacagcaguuuauua

SEQ ID NO: 56407 - RNA, 19 nt, Homo sapiens
gaagugggcuccaguauua

SEQ ID NO: 56408 - RNA, 19 nt, Homo sapiens
caaaguagcugauguauug

SEQ ID NO: 56409 - RNA, 19 nt, Homo sapiens
gcaagaugcugauucauua

SEQ ID NO: 56410 - RNA, 19 nt, Homo sapiens
ggaaauggcugaacuagaa

SEQ ID NO: 56411 - RNA, 19 nt, Homo sapiens
gcaagaauaugaagaagua

SEQ ID NO: 56412 - RNA, 19 nt, Homo sapiens
gaagagaacuuaucuagug

SEQ ID NO: 56413 - RNA, 19 nt, Homo sapiens
gaacaaagcacaucagaaa

SEQ ID NO: 56414 - RNA, 19 nt, Homo sapiens
ccauacagcuucauaaaua

SEQ ID NO: 56415 - RNA, 19 nt, Homo sapiens
gaagccagcucaagcaaua

SEQ ID NO: 56416 - RNA, 19 nt, Homo sapiens
gcagauaguucuaccagua

SEQ ID NO: 56417 - RNA, 19 nt, Homo sapiens
caacgaaacuggacucauu

SEQ ID NO: 56418 - RNA, 19 nt, Homo sapiens
gaacuuaucuagugaggau

SEQ ID NO: 56419 - RNA, 19 nt, Homo sapiens
gaacacagaggagaauuua

SEQ ID NO: 56420 - RNA, 19 nt, Homo sapiens
ccagugaacuuaaagaauu

SEQ ID NO: 56421 - RNA, 19 nt, Homo sapiens
aagcauggauucaaacuua

SEQ ID NO: 56422 - RNA, 19 nt, Homo sapiens
gagcugaaguuaacaaaug

SEQ ID NO: 56423 - RNA, 19 nt, Homo sapiens
gaaauagguuccagugaug

SEQ ID NO: 56424 - RNA, 19 nt, Homo sapiens
gaacggacacugaaauauu

SEQ ID NO: 56425 - RNA, 19 nt, Homo sapiens
cagaagugaugaacuguua

SEQ ID NO: 56426 - RNA, 19 nt, Homo sapiens
ccaaagaucucauguuaag

SEQ ID NO: 56427 - RNA, 19 nt, Homo sapiens
caaaugaacagacaaguaa

SEQ ID NO: 56428 - RNA, 19 nt, Homo sapiens
agaaugagcuuacaaagug

SEQ ID NO: 56429 - RNA, 19 nt, Homo sapiens
gaacagcaguuuauuacuc

SEQ ID NO: 56430 - RNA, 19 nt, Homo sapiens
gaaauuagaguccucagaa

SEQ ID NO: 56431 - RNA, 19 nt, Homo sapiens
caagaaaguacgagauuua

SEQ ID NO: 56432 - RNA, 19 nt, Homo sapiens
guggaaagaugcugaguuu

SEQ ID NO: 56433 - RNA, 19 nt, Homo sapiens
gaaagcagauuuggcaguu

SEQ ID NO: 56434 - RNA, 19 nt, Homo sapiens
gaaccugucuccacaaagu

SEQ ID NO: 56435 - RNA, 19 nt, Homo sapiens
ggaaagaaugagucuaaua

SEQ ID NO: 56436 - RNA, 19 nt, Homo sapiens
ugaaucaaaugccaaagua

SEQ ID NO: 56437 - RNA, 19 nt, Homo sapiens
gaaguaaggaaacauguaa

SEQ ID NO: 56438 - RNA, 19 nt, Homo sapiens
caaauaaacuugguagcaa

SEQ ID NO: 56439 - RNA, 19 nt, Homo sapiens
cagcuacccuuccaucaua

SEQ ID NO: 56440 - RNA, 19 nt, Homo sapiens
ugaaagaucuguagagagu

SEQ ID NO: 56441 - RNA, 19 nt, Homo sapiens
caauauggaacucgaauua

SEQ ID NO: 56442 - RNA, 19 nt, Homo sapiens
ccaaaucaguagagaguaa

SEQ ID NO: 56443 - RNA, 19 nt, Homo sapiens
gaaauuagccggucauggu

SEQ ID NO: 56444 - RNA, 19 nt, Homo sapiens
ggucaagugaugaauauua

SEQ ID NO: 56445 - RNA, 19 nt, Homo sapiens
ggaacgggcuuggaagaaa

SEQ ID NO: 56446 - RNA, 19 nt, Homo sapiens
guuagaugauggugaaaua

SEQ ID NO: 56447 - RNA, 19 nt, Homo sapiens
caaaggaggcucuagguuu

SEQ ID NO: 56448 - RNA, 19 nt, Homo sapiens
uaauaucacugcaggcuuu

SEQ ID NO: 56449 - RNA, 19 nt, Homo sapiens
gaagauguuccuuggauaa

SEQ ID NO: 56450 - RNA, 19 nt, Homo sapiens
gggauaccaugcaacauaa

SEQ ID NO: 56451 - RNA, 19 nt, Homo sapiens
aaagagaaaugggaaauga

SEQ ID NO: 56452 - RNA, 19 nt, Homo sapiens
gcaaggagccaacauaaca

SEQ ID NO: 56453 - RNA, 19 nt, Homo sapiens
gaaagaugcugaguuugug

SEQ ID NO: 56454 - RNA, 19 nt, Homo sapiens
ggaaagaugcugaguuugu

SEQ ID NO: 56455 - RNA, 19 nt, Homo sapiens
caauauaccuucucagucu

SEQ ID NO: 56456 - RNA, 19 nt, Homo sapiens
ucaaauaccagugaacuua

SEQ ID NO: 56457 - RNA, 19 nt, Homo sapiens
aacgaaagcugaaccuaua

SEQ ID NO: 56458 - RNA, 19 nt, Homo sapiens
gaacagaaagaaauggauu

SEQ ID NO: 56459 - RNA, 19 nt, Homo sapiens
gaaaguuaaugagugguuu

SEQ ID NO: 56460 - RNA, 19 nt, Homo sapiens
gaagauaccguuaauaagg

SEQ ID NO: 56461 - RNA, 19 nt, Homo sapiens
gaaaaggacuucuggcuau

SEQ ID NO: 56462 - RNA, 19 nt, Homo sapiens
gauaaugccaaauguagua

SEQ ID NO: 56463 - RNA, 19 nt, Homo sapiens
gcagaauggucaagugaug

SEQ ID NO: 56464 - RNA, 19 nt, Homo sapiens
gcagugagccaagaucaua

SEQ ID NO: 56465 - RNA, 19 nt, Homo sapiens
gggcaguucucaaauguug

SEQ ID NO: 56466 - RNA, 19 nt, Homo sapiens
gcaguaaccagguaauauu

SEQ ID NO: 56467 - RNA, 19 nt, Homo sapiens
guaagcauccugaaauaaa

SEQ ID NO: 56468 - RNA, 19 nt, Homo sapiens
gcauagaaauggaagaaag

SEQ ID NO: 56469 - RNA, 19 nt, Homo sapiens
guagagaguagcaguauuu

SEQ ID NO: 56470 - RNA, 19 nt, Homo sapiens
gaaaauaacucuccugaac

SEQ ID NO: 56471 - RNA, 19 nt, Homo sapiens
gaaaauggguaguuagcua

SEQ ID NO: 56472 - RNA, 19 nt, Homo sapiens
ggaauugguuucagaugau

SEQ ID NO: 56473 - RNA, 19 nt, Homo sapiens
aaagacuccugaaaugaua

SEQ ID NO: 56474 - RNA, 19 nt, Homo sapiens
aaaggcugcuugugaauuu

SEQ ID NO: 56475 - RNA, 19 nt, Homo sapiens
uauaagaccucuggcauga

SEQ ID NO: 56476 - RNA, 19 nt, Homo sapiens
gaaggagcuuucaucauuc

SEQ ID NO: 56477 - RNA, 19 nt, Homo sapiens
cuagaaaucuguugcuaug

SEQ ID NO: 56478 - RNA, 19 nt, Homo sapiens
gaggagauguggucaaugg

SEQ ID NO: 56479 - RNA, 19 nt, Homo sapiens
ugaaauagguuccagugau

SEQ ID NO: 56480 - RNA, 19 nt, Homo sapiens
guacagacaguuaauauca

SEQ ID NO: 56481 - RNA, 19 nt, Homo sapiens
ucaggaaaguaucucguua

SEQ ID NO: 56482 - RNA, 19 nt, Homo sapiens
gaaccuauaagcagcagua

SEQ ID NO: 56483 - RNA, 19 nt, Homo sapiens
gcucagggcuauccucuca

SEQ ID NO: 56484 - RNA, 19 nt, Homo sapiens
ugaaugcuaugcuuagauu

SEQ ID NO: 56485 - RNA, 19 nt, Homo sapiens
caucaucaacccaguaaua

SEQ ID NO: 56486 - RNA, 19 nt, Homo sapiens
gaaaccauacagcuucaua

SEQ ID NO: 56487 - RNA, 19 nt, Homo sapiens
caacauaaccugauaaagc

SEQ ID NO: 56488 - RNA, 19 nt, Homo sapiens
aaacaagcgucucugaaga

SEQ ID NO: 56489 - RNA, 19 nt, Homo sapiens
gaaguaguucagacuguua

SEQ ID NO: 56490 - RNA, 19 nt, Homo sapiens
ggacucauuacuccaaaua

SEQ ID NO: 56491 - RNA, 19 nt, Homo sapiens
ccaauagaaucacucgaaa

SEQ ID NO: 56492 - RNA, 19 nt, Homo sapiens
ucaugaggcuuuaauaugu

SEQ ID NO: 56493 - RNA, 19 nt, Homo sapiens
gaacaucaucaacccagua

SEQ ID NO: 56494 - RNA, 19 nt, Homo sapiens
gaagagcuauugaaaauca

SEQ ID NO: 56495 - RNA, 19 nt, Homo sapiens
gaaacaagcgucucugaag

SEQ ID NO: 56496 - RNA, 19 nt, Homo sapiens
ggaaacaagcauagaaaug

SEQ ID NO: 56497 - RNA, 19 nt, Homo sapiens
aaucuaagcccaccuaauu

SEQ ID NO: 56498 - RNA, 19 nt, Homo sapiens
cuaaauagcagcauucaga

SEQ ID NO: 56499 - RNA, 19 nt, Homo sapiens
gcagagggauaccaugcaa

SEQ ID NO: 56500 - RNA, 19 nt, Homo sapiens
auacagauuucucuccaua

SEQ ID NO: 56501 - RNA, 19 nt, Homo sapiens
gaaugagucuaauaucaag

SEQ ID NO: 56502 - RNA, 19 nt, Homo sapiens
gcagaaaccuacaacucau

SEQ ID NO: 56503 - RNA, 19 nt, Homo sapiens
ugaacuagaagcuguguua

SEQ ID NO: 56504 - RNA, 19 nt, Homo sapiens
gcagugaauuggaagacuu

SEQ ID NO: 56505 - RNA, 19 nt, Homo sapiens
gaaacaagcauagaaaugg

SEQ ID NO: 56506 - RNA, 19 nt, Homo sapiens
ggaaguaaggaaacaugua

SEQ ID NO: 56507 - RNA, 19 nt, Homo sapiens
gaagugggcuccaguauua

SEQ ID NO: 56508 - RNA, 19 nt, Homo sapiens
caaaguagcugauguauug

SEQ ID NO: 56509 - RNA, 19 nt, Homo sapiens
gcaagaugcugauucauua

SEQ ID NO: 56510 - RNA, 19 nt, Homo sapiens
ggaaauggcugaacuagaa

SEQ ID NO: 56511 - RNA, 19 nt, Homo sapiens
gcaagaauaugaagaagua

SEQ ID NO: 56512 - RNA, 19 nt, Homo sapiens
gaagagaacuuaucuagug

SEQ ID NO: 56513 - RNA, 19 nt, Homo sapiens
gaacaaagcacaucagaaa

SEQ ID NO: 56514 - RNA, 19 nt, Homo sapiens
ccauacagcuucauaaaua

SEQ ID NO: 56515 - RNA, 19 nt, Homo sapiens
gaagccagcucaagcaaua

SEQ ID NO: 56516 - RNA, 19 nt, Homo sapiens
gcagauaguucuaccagua

SEQ ID NO: 56517 - RNA, 19 nt, Homo sapiens
caacgaaacuggacucauu

SEQ ID NO: 56518 - RNA, 19 nt, Homo sapiens
gaacuuaucuagugaggau

SEQ ID NO: 56519 - RNA, 19 nt, Homo sapiens
gaacacagaggagaauuua

SEQ ID NO: 56520 - RNA, 19 nt, Homo sapiens
ccagugaacuuaaagaauu

SEQ ID NO: 56521 - RNA, 19 nt, Homo sapiens
aagcauggauucaaacuua

SEQ ID NO: 56522 - RNA, 19 nt, Homo sapiens
gagcugaaguuaacaaaug

SEQ ID NO: 56523 - RNA, 19 nt, Homo sapiens
gaaauagguuccagugaug

SEQ ID NO: 56524 - RNA, 19 nt, Homo sapiens
gaacggacacugaaauauu

SEQ ID NO: 56525 - RNA, 19 nt, Homo sapiens
cagaagugaugaacuguua

SEQ ID NO: 56526 - RNA, 19 nt, Homo sapiens
ccaaagaucucauguuaag

SEQ ID NO: 56527 - RNA, 19 nt, Homo sapiens
caaaugaacagacaaguaa

SEQ ID NO: 56528 - RNA, 19 nt, Homo sapiens
agaaugagcuuacaaagug

SEQ ID NO: 56529 - RNA, 19 nt, Homo sapiens
gaacagcaguuuauuacuc

SEQ ID NO: 56530 - RNA, 19 nt, Homo sapiens
gaaauuagaguccucagaa

SEQ ID NO: 56531 - RNA, 19 nt, Homo sapiens
caagaaaguacgagauuua

SEQ ID NO: 56532 - RNA, 19 nt, Homo sapiens
gaaagcagauuuggcaguu

SEQ ID NO: 56533 - RNA, 19 nt, Homo sapiens
gaaccugucuccacaaagu

SEQ ID NO: 56534 - RNA, 19 nt, Homo sapiens
ggaaagaaugagucuaaua

SEQ ID NO: 56535 - RNA, 19 nt, Homo sapiens
ugaaucaaaugccaaagua

SEQ ID NO: 56536 - RNA, 19 nt, Homo sapiens
gaaguaaggaaacauguaa

SEQ ID NO: 56537 - RNA, 19 nt, Homo sapiens
caaauaaacuugguagcaa

SEQ ID NO: 56538 - RNA, 19 nt, Homo sapiens
cagcuacccuuccaucaua

SEQ ID NO: 56539 - RNA, 19 nt, Homo sapiens
ugaaagaucuguagagagu

SEQ ID NO: 56540 - RNA, 19 nt, Homo sapiens
caauauggaacucgaauua

SEQ ID NO: 56541 - RNA, 19 nt, Homo sapiens
ccaaaucaguagagaguaa

SEQ ID NO: 56542 - RNA, 19 nt, Homo sapiens
gaaauuagccggucauggu

SEQ ID NO: 56543 - RNA, 19 nt, Homo sapiens
ccacaucacuuuaacuaau

SEQ ID NO: 56544 - RNA, 19 nt, Homo sapiens
ggucaagugaugaauauua

SEQ ID NO: 56545 - RNA, 19 nt, Homo sapiens
ggaacgggcuuggaagaaa

SEQ ID NO: 56546 - RNA, 19 nt, Homo sapiens
guuagaugauggugaaaua

SEQ ID NO: 56547 - RNA, 19 nt, Homo sapiens
caaaggaggcucuagguuu

SEQ ID NO: 56548 - RNA, 19 nt, Homo sapiens
uaauaucacugcaggcuuu

SEQ ID NO: 56549 - RNA, 19 nt, Homo sapiens
gaagauguuccuuggauaa

SEQ ID NO: 56550 - RNA, 19 nt, Homo sapiens
gggauaccaugcaacauaa

SEQ ID NO: 56551 - RNA, 19 nt, Homo sapiens
aaagagaaaugggaaauga

SEQ ID NO: 56552 - RNA, 19 nt, Homo sapiens
gcaaggagccaacauaaca

SEQ ID NO: 56553 - RNA, 19 nt, Homo sapiens
gaacagaaagaaauggauu

SEQ ID NO: 56554 - RNA, 19 nt, Homo sapiens
caauauaccuucucagucu

SEQ ID NO: 56555 - RNA, 19 nt, Homo sapiens
ucaaauaccagugaacuua

SEQ ID NO: 56556 - RNA, 19 nt, Homo sapiens
aacgaaagcugaaccuaua

SEQ ID NO: 56557 - RNA, 19 nt, Homo sapiens
gaaaguuaaugagugguuu

SEQ ID NO: 56558 - RNA, 19 nt, Homo sapiens
gaaaaggacuucuggcuau

SEQ ID NO: 56559 - RNA, 19 nt, Homo sapiens
gauaaugccaaauguagua

SEQ ID NO: 56560 - RNA, 19 nt, Homo sapiens
gcagaauggucaagugaug

SEQ ID NO: 56561 - RNA, 19 nt, Homo sapiens
gcagugagccaagaucaua

SEQ ID NO: 56562 - RNA, 19 nt, Homo sapiens
gggcaguucucaaauguug

SEQ ID NO: 56563 - RNA, 19 nt, Homo sapiens
gcaguaaccagguaauauu

SEQ ID NO: 56564 - RNA, 19 nt, Homo sapiens
guaagcauccugaaauaaa

SEQ ID NO: 56565 - RNA, 19 nt, Homo sapiens
gcauagaaauggaagaaag

SEQ ID NO: 56566 - RNA, 19 nt, Homo sapiens
guagagaguagcaguauuu

SEQ ID NO: 56567 - RNA, 19 nt, Homo sapiens
gaaaauaacucuccugaac

SEQ ID NO: 56568 - RNA, 19 nt, Homo sapiens
gaaaauggguaguuagcua

SEQ ID NO: 56569 - RNA, 19 nt, Homo sapiens
ggaauugguuucagaugau

SEQ ID NO: 56570 - RNA, 19 nt, Homo sapiens
aaagacuccugaaaugaua

SEQ ID NO: 56571 - RNA, 19 nt, Homo sapiens
ugaauuggcugcuugugaa

SEQ ID NO: 56572 - RNA, 19 nt, Homo sapiens
uauaagaccucuggcauga

SEQ ID NO: 56573 - RNA, 19 nt, Homo sapiens
gaaggagcuuucaucauuc

SEQ ID NO: 56574 - RNA, 19 nt, Homo sapiens
cuagaaaucuguugcuaug

SEQ ID NO: 56575 - RNA, 19 nt, Homo sapiens
gaggagauguggucaaugg

SEQ ID NO: 56576 - RNA, 19 nt, Homo sapiens
gaaacuacccaucucaaga

SEQ ID NO: 56577 - RNA, 19 nt, Homo sapiens
ugaaauagguuccagugau

SEQ ID NO: 56578 - RNA, 19 nt, Homo sapiens
guacagacaguuaauauca

SEQ ID NO: 56579 - RNA, 19 nt, Homo sapiens
ucaggaaaguaucucguua

SEQ ID NO: 56580 - RNA, 19 nt, Homo sapiens
gaaccuauaagcagcagua

SEQ ID NO: 56581 - RNA, 19 nt, Homo sapiens
gcucagggcuauccucuca

SEQ ID NO: 56582 - RNA, 19 nt, Homo sapiens
ugaaugcuaugcuuagauu

SEQ ID NO: 56583 - RNA, 19 nt, Homo sapiens
caucaucaacccaguaaua

SEQ ID NO: 56584 - RNA, 19 nt, Homo sapiens
gaaaccauacagcuucaua

SEQ ID NO: 56585 - RNA, 19 nt, Homo sapiens
caacauaaccugauaaagc

SEQ ID NO: 56586 - RNA, 19 nt, Homo sapiens
aaacaagcgucucugaaga

SEQ ID NO: 56587 - RNA, 19 nt, Homo sapiens
gaaguaguucagacuguua

SEQ ID NO: 56588 - RNA, 19 nt, Homo sapiens
ggacucauuacuccaaaua

SEQ ID NO: 56589 - RNA, 19 nt, Homo sapiens
ccaauagaaucacucgaaa

SEQ ID NO: 56590 - RNA, 19 nt, Homo sapiens
ucaugaggcuuuaauaugu

SEQ ID NO: 56591 - RNA, 19 nt, Homo sapiens
gaacaucaucaacccagua

SEQ ID NO: 56592 - RNA, 19 nt, Homo sapiens
gaagagcuauugaaaauca

SEQ ID NO: 56593 - RNA, 19 nt, Homo sapiens
gaagagacuacucauguug

SEQ ID NO: 56594 - RNA, 19 nt, Homo sapiens
gaaacaagcgucucugaag

SEQ ID NO: 56595 - RNA, 19 nt, Homo sapiens
ggaaacaagcauagaaaug

SEQ ID NO: 56596 - RNA, 19 nt, Homo sapiens
aaucuaagcccaccuaauu

SEQ ID NO: 56597 - RNA, 19 nt, Homo sapiens
cuaaauagcagcauucaga

SEQ ID NO: 56598 - RNA, 19 nt, Homo sapiens
gcagagggauaccaugcaa

SEQ ID NO: 56599 - RNA, 19 nt, Homo sapiens
auacagauuucucuccaua

SEQ ID NO: 56600 - RNA, 19 nt, Homo sapiens
gaaugagucuaauaucaag

SEQ ID NO: 56601 - RNA, 19 nt, Homo sapiens
gcagaaaccuacaacucau

SEQ ID NO: 56602 - RNA, 19 nt, Homo sapiens
ugaacuagaagcuguguua

SEQ ID NO: 56603 - RNA, 19 nt, Homo sapiens
gcagugaauuggaagacuu

SEQ ID NO: 56604 - RNA, 19 nt, Homo sapiens
gaaacaagcauagaaaugg

SEQ ID NO: 56605 - RNA, 19 nt, Homo sapiens
ggaaguaaggaaacaugua

SEQ ID NO: 56606 - RNA, 19 nt, Homo sapiens
gaaaguacgagauuuaguc

SEQ ID NO: 56607 - RNA, 19 nt, Homo sapiens
gcaagaugcugauucauua

SEQ ID NO: 56608 - RNA, 19 nt, Homo sapiens
ggaaauggcugaacuagaa

SEQ ID NO: 56609 - RNA, 19 nt, Homo sapiens
gaacaaagcacaucagaaa

SEQ ID NO: 56610 - RNA, 19 nt, Homo sapiens
ccauacagcuucauaaaua

SEQ ID NO: 56611 - RNA, 19 nt, Homo sapiens
gcagauaguucuaccagua

SEQ ID NO: 56612 - RNA, 19 nt, Homo sapiens
gaacggacacugaaauauu

SEQ ID NO: 56613 - RNA, 19 nt, Homo sapiens
agaaugagcuuacaaagug

SEQ ID NO: 56614 - RNA, 19 nt, Homo sapiens
caagaaaguacgagauuua

SEQ ID NO: 56615 - RNA, 19 nt, Homo sapiens
gaaccugucuccacaaagu

SEQ ID NO: 56616 - RNA, 19 nt, Homo sapiens
caaauaaacuugguagcaa

SEQ ID NO: 56617 - RNA, 19 nt, Homo sapiens
cagcuacccuuccaucaua

SEQ ID NO: 56618 - RNA, 19 nt, Homo sapiens
gaaauuagccggucauggu

SEQ ID NO: 56619 - RNA, 19 nt, Homo sapiens
ccacaucacuuuaacuaau

SEQ ID NO: 56620 - RNA, 19 nt, Homo sapiens
gggauaccaugcaacauaa

SEQ ID NO: 56621 - RNA, 19 nt, Homo sapiens
gaagauaccguuaauaagg

SEQ ID NO: 56622 - RNA, 19 nt, Homo sapiens
gaacagaaagaaauggauu

SEQ ID NO: 56623 - RNA, 19 nt, Homo sapiens
gaaaaggacuucuggcuau

SEQ ID NO: 56624 - RNA, 19 nt, Homo sapiens
gcagugagccaagaucaua

SEQ ID NO: 56625 - RNA, 19 nt, Homo sapiens
gggcaguucucaaauguug

SEQ ID NO: 56626 - RNA, 19 nt, Homo sapiens
ccacaggacccaagaauga

SEQ ID NO: 56627 - RNA, 19 nt, Homo sapiens
gaaaauaacucuccugaac

SEQ ID NO: 56628 - RNA, 19 nt, Homo sapiens
gaaaauggguaguuagcua

SEQ ID NO: 56629 - RNA, 19 nt, Homo sapiens
uauaagaccucuggcauga

SEQ ID NO: 56630 - RNA, 19 nt, Homo sapiens
gaaggagcuuucaucauuc

SEQ ID NO: 56631 - RNA, 19 nt, Homo sapiens
cuagaaaucuguugcuaug

SEQ ID NO: 56632 - RNA, 19 nt, Homo sapiens
gaggagauguggucaaugg

SEQ ID NO: 56633 - RNA, 19 nt, Homo sapiens
gaaacuacccaucucaaga

SEQ ID NO: 56634 - RNA, 19 nt, Homo sapiens
gcucagggcuauccucuca

SEQ ID NO: 56635 - RNA, 19 nt, Homo sapiens
gaaaccauacagcuucaua

SEQ ID NO: 56636 - RNA, 19 nt, Homo sapiens
caacauaaccugauaaagc

SEQ ID NO: 56637 - RNA, 19 nt, Homo sapiens
aaacaagcgucucugaaga

SEQ ID NO: 56638 - RNA, 19 nt, Homo sapiens
gaagagcuauugaaaauca

SEQ ID NO: 56639 - RNA, 19 nt, Homo sapiens
gaagagacuacucauguug

SEQ ID NO: 56640 - RNA, 19 nt, Homo sapiens
gaaacaagcgucucugaag

SEQ ID NO: 56641 - RNA, 19 nt, Homo sapiens
gcagagggauaccaugcaa

SEQ ID NO: 56642 - RNA, 19 nt, Homo sapiens
ugaacuagaagcuguguua

SEQ ID NO: 56643 - RNA, 19 nt, Homo sapiens
gaaaguacgagauuuaguc

SEQ ID NO: 56644 - RNA, 19 nt, Homo sapiens
gagaaucccaggacagaaa

SEQ ID NO: 56645 - RNA, 19 nt, Homo sapiens
gaaaacaccacaucacuuu

SEQ ID NO: 56646 - RNA, 19 nt, Homo sapiens
ggugguacaugcacaguug

SEQ ID NO: 56647 - RNA, 19 nt, Homo sapiens
cuacuguccuggcuacuaa

SEQ ID NO: 56648 - RNA, 19 nt, Homo sapiens
gcccacagaucaacuggaa

SEQ ID NO: 56649 - RNA, 19 nt, Homo sapiens
caacagaaagggucaacaa

SEQ ID NO: 56650 - RNA, 19 nt, Homo sapiens
ugugggagaucaagaauug

SEQ ID NO: 56651 - RNA, 19 nt, Homo sapiens
ugacacagguuuggaguau

SEQ ID NO: 56652 - RNA, 19 nt, Homo sapiens
ugacagaucccaccaggaa

SEQ ID NO: 56653 - RNA, 19 nt, Homo sapiens
uaagaccucuggcaugaau

SEQ ID NO: 56654 - RNA, 19 nt, Homo sapiens
gcagggagaagccagaauu

SEQ ID NO: 56655 - RNA, 19 nt, Homo sapiens
gaagacugcucagggcuau

SEQ ID NO: 56656 - RNA, 19 nt, Homo sapiens
gagauuuagucaacuuguu

SEQ ID NO: 56657 - RNA, 19 nt, Homo sapiens
ggaggaaaauggguaguua

SEQ ID NO: 56658 - RNA, 19 nt, Homo sapiens
ucauuaagguuguugaugu

SEQ ID NO: 56659 - RNA, 19 nt, Homo sapiens
aagaggagcucauuaaggu

SEQ ID NO: 56660 - RNA, 19 nt, Homo sapiens
ugagaacucugaggacaaa

SEQ ID NO: 56661 - RNA, 19 nt, Homo sapiens
gacccagucuauuaaagaa

SEQ ID NO: 56662 - RNA, 19 nt, Homo sapiens
ugaagagacuacucauguu

SEQ ID NO: 56663 - RNA, 19 nt, Homo sapiens
cugaagauaccguuaauaa

SEQ ID NO: 56664 - RNA, 19 nt, Homo sapiens
ggacaaagcagcggauaca

SEQ ID NO: 56665 - RNA, 19 nt, Homo sapiens
uaacucuccugaacaucua

SEQ ID NO: 56666 - RNA, 19 nt, Homo sapiens
gcaaauaaacuugguagca

SEQ ID NO: 56667 - RNA, 19 nt, Homo sapiens
gaauaguccuugggcaguu

SEQ ID NO: 56668 - RNA, 19 nt, Homo sapiens
aacggacacugaaauauuu

SEQ ID NO: 56669 - RNA, 19 nt, Homo sapiens
aaacaccacaucacuuuaa

SEQ ID NO: 56670 - RNA, 19 nt, Homo sapiens
gaauagaaacuacccaucu

SEQ ID NO: 56671 - RNA, 19 nt, Homo sapiens
uaaagaaccaggaguggaa

SEQ ID NO: 56672 - RNA, 19 nt, Homo sapiens
acuagaagcuguguuagaa

SEQ ID NO: 56673 - RNA, 19 nt, Homo sapiens
gcuguuaacacugcaaaua

SEQ ID NO: 56674 - RNA, 19 nt, Homo sapiens
gaauagcugguuucccuaa

SEQ ID NO: 56675 - RNA, 19 nt, Homo sapiens
gaaccgguuuccaaagaca

SEQ ID NO: 56676 - RNA, 19 nt, Homo sapiens
gcagguauuagaaaugaaa

SEQ ID NO: 56677 - RNA, 19 nt, Homo sapiens
ucaagagaauagcugguuu

SEQ ID NO: 56678 - RNA, 19 nt, Homo sapiens
gaaauucugaggcagguau

SEQ ID NO: 56679 - RNA, 19 nt, Homo sapiens
gaucgauuaugugacuuaa

SEQ ID NO: 56680 - RNA, 19 nt, Homo sapiens
gagcuccucucacucuuca

SEQ ID NO: 56681 - RNA, 19 nt, Homo sapiens
ccaagaaugagcuuacaaa

SEQ ID NO: 56682 - RNA, 19 nt, Homo sapiens
gcuggacaccuaccugaua

SEQ ID NO: 56683 - RNA, 19 nt, Homo sapiens
caucauaagugacucuucu

SEQ ID NO: 56684 - RNA, 19 nt, Homo sapiens
caugcaacauaaccugaua

SEQ ID NO: 56685 - RNA, 19 nt, Homo sapiens
caaaguaugggcuacagaa

SEQ ID NO: 56686 - RNA, 19 nt, Homo sapiens
acaagaaaguacgagauuu

SEQ ID NO: 56687 - RNA, 19 nt, Homo sapiens
uuguagcucugguauauaa

SEQ ID NO: 56688 - RNA, 19 nt, Homo sapiens
aagaaccgguuuccaaaga

SEQ ID NO: 56689 - RNA, 19 nt, Homo sapiens
cagaucaacuggaauggau

SEQ ID NO: 56690 - RNA, 19 nt, Homo sapiens
aaauaacucuccugaacau

SEQ ID NO: 56691 - RNA, 19 nt, Homo sapiens
guaaauguugugcuguuaa

SEQ ID NO: 56692 - RNA, 19 nt, Homo sapiens
cacaguguccuuuauguaa

SEQ ID NO: 56693 - RNA, 19 nt, Homo sapiens
ucaagaaccgguuuccaaa

SEQ ID NO: 56694 - RNA, 19 nt, Homo sapiens
gaaaugaaaaggaaacuug

SEQ ID NO: 56695 - RNA, 19 nt, Homo sapiens
ccacagaucaacuggaaug

SEQ ID NO: 56696 - RNA, 19 nt, Homo sapiens
caacaugcccacagaucaa

SEQ ID NO: 56697 - RNA, 19 nt, Homo sapiens
ucaccaacaugcccacaga

SEQ ID NO: 56698 - RNA, 19 nt, Homo sapiens
cagaggagauguggucaau

SEQ ID NO: 56699 - RNA, 19 nt, Homo sapiens
gcaggaaauggcugaacua

SEQ ID NO: 56700 - RNA, 19 nt, Homo sapiens
uguaaauguugugcuguua

SEQ ID NO: 56701 - RNA, 19 nt, Homo sapiens
gaaaccccaucucuacuaa

SEQ ID NO: 56702 - RNA, 19 nt, Homo sapiens
ucgauuaugugacuuaaag

SEQ ID NO: 56703 - RNA, 19 nt, Homo sapiens
ggaucgauuaugugacuua

SEQ ID NO: 56704 - RNA, 19 nt, Homo sapiens
ggagagugcuugggaucga

SEQ ID NO: 56705 - RNA, 19 nt, Homo sapiens
ucacaaaggcagagaguca

SEQ ID NO: 56706 - RNA, 19 nt, Homo sapiens
gcccuauucuuucuauuca

SEQ ID NO: 56707 - RNA, 19 nt, Homo sapiens
gcaagaugcugauucauua

SEQ ID NO: 56708 - RNA, 19 nt, Homo sapiens
ggaaauggcugaacuagaa

SEQ ID NO: 56709 - RNA, 19 nt, Homo sapiens
gaacaaagcacaucagaaa

SEQ ID NO: 56710 - RNA, 19 nt, Homo sapiens
ccauacagcuucauaaaua

SEQ ID NO: 56711 - RNA, 19 nt, Homo sapiens
gcagauaguucuaccagua

SEQ ID NO: 56712 - RNA, 19 nt, Homo sapiens
gaacggacacugaaauauu

SEQ ID NO: 56713 - RNA, 19 nt, Homo sapiens
agaaugagcuuacaaagug

SEQ ID NO: 56714 - RNA, 19 nt, Homo sapiens
caagaaaguacgagauuua

SEQ ID NO: 56715 - RNA, 19 nt, Homo sapiens
gaaccugucuccacaaagu

SEQ ID NO: 56716 - RNA, 19 nt, Homo sapiens
caaauaaacuugguagcaa

SEQ ID NO: 56717 - RNA, 19 nt, Homo sapiens
cagcuacccuuccaucaua

SEQ ID NO: 56718 - RNA, 19 nt, Homo sapiens
gaaauuagccggucauggu

SEQ ID NO: 56719 - RNA, 19 nt, Homo sapiens
ccacaucacuuuaacuaau

SEQ ID NO: 56720 - RNA, 19 nt, Homo sapiens
gggauaccaugcaacauaa

SEQ ID NO: 56721 - RNA, 19 nt, Homo sapiens
gaacaucgucaacccagua

SEQ ID NO: 56722 - RNA, 19 nt, Homo sapiens
gaagauaccguuaauaagg

SEQ ID NO: 56723 - RNA, 19 nt, Homo sapiens
gaacagaaagaaauggauu

SEQ ID NO: 56724 - RNA, 19 nt, Homo sapiens
gaaaaggacuucuggcuau

SEQ ID NO: 56725 - RNA, 19 nt, Homo sapiens
gcagugagccaagaucaua

SEQ ID NO: 56726 - RNA, 19 nt, Homo sapiens
gggcaguucucaaauguug

SEQ ID NO: 56727 - RNA, 19 nt, Homo sapiens
gaaaauaacucuccugaac

SEQ ID NO: 56728 - RNA, 19 nt, Homo sapiens
gaaaauggguaguuagcua

SEQ ID NO: 56729 - RNA, 19 nt, Homo sapiens
aaaggcugcuugugaauuu

SEQ ID NO: 56730 - RNA, 19 nt, Homo sapiens
uauaagaccucuggcauga

SEQ ID NO: 56731 - RNA, 19 nt, Homo sapiens
gaaggagcuuucaucauuc

SEQ ID NO: 56732 - RNA, 19 nt, Homo sapiens
cuagaaaucuguugcuaug

SEQ ID NO: 56733 - RNA, 19 nt, Homo sapiens
gaggagauguggucaaugg

SEQ ID NO: 56734 - RNA, 19 nt, Homo sapiens
gaaacuacccaucucaaga

SEQ ID NO: 56735 - RNA, 19 nt, Homo sapiens
gcucagggcuauccucuca

SEQ ID NO: 56736 - RNA, 19 nt, Homo sapiens
gaaaccauacagcuucaua

SEQ ID NO: 56737 - RNA, 19 nt, Homo sapiens
caacauaaccugauaaagc

SEQ ID NO: 56738 - RNA, 19 nt, Homo sapiens
aaacaagcgucucugaaga

SEQ ID NO: 56739 - RNA, 19 nt, Homo sapiens
gaagagcuauugaaaauca

SEQ ID NO: 56740 - RNA, 19 nt, Homo sapiens
gaagagacuacucauguug

SEQ ID NO: 56741 - RNA, 19 nt, Homo sapiens
gaaacaagcgucucugaag

SEQ ID NO: 56742 - RNA, 19 nt, Homo sapiens
gcagagggauaccaugcaa

SEQ ID NO: 56743 - RNA, 19 nt, Homo sapiens
ugaacuagaagcuguguua

SEQ ID NO: 56744 - RNA, 19 nt, Homo sapiens
gaaaguacgagauuuaguc

SEQ ID NO: 56745 - RNA, 19 nt, Homo sapiens
gagaaucccaggacagaaa

SEQ ID NO: 56746 - RNA, 19 nt, Homo sapiens
gaaaacaccacaucacuuu

SEQ ID NO: 56747 - RNA, 19 nt, Homo sapiens
ggugguacaugcacaguug

SEQ ID NO: 56748 - RNA, 19 nt, Homo sapiens
cuacuguccuggcuacuaa

SEQ ID NO: 56749 - RNA, 19 nt, Homo sapiens
gcccacagaucaacuggaa

SEQ ID NO: 56750 - RNA, 19 nt, Homo sapiens
caacagaaagggucaacaa

SEQ ID NO: 56751 - RNA, 19 nt, Homo sapiens
ugugggagaucaagaauug

SEQ ID NO: 56752 - RNA, 19 nt, Homo sapiens
ugacacagguuuggaguau

SEQ ID NO: 56753 - RNA, 19 nt, Homo sapiens
ugacagaucccaccaggaa

SEQ ID NO: 56754 - RNA, 19 nt, Homo sapiens
uaagaccucuggcaugaau

SEQ ID NO: 56755 - RNA, 19 nt, Homo sapiens
gcagggagaagccagaauu

SEQ ID NO: 56756 - RNA, 19 nt, Homo sapiens
gaagacugcucagggcuau

SEQ ID NO: 56757 - RNA, 19 nt, Homo sapiens
gagauuuagucaacuuguu

SEQ ID NO: 56758 - RNA, 19 nt, Homo sapiens
ggaggaaaauggguaguua

SEQ ID NO: 56759 - RNA, 19 nt, Homo sapiens
ucauuaagguuguugaugu

SEQ ID NO: 56760 - RNA, 19 nt, Homo sapiens
aagaggagcucauuaaggu

SEQ ID NO: 56761 - RNA, 19 nt, Homo sapiens
ugagaacucugaggacaaa

SEQ ID NO: 56762 - RNA, 19 nt, Homo sapiens
gacccagucuauuaaagaa

SEQ ID NO: 56763 - RNA, 19 nt, Homo sapiens
ugaagagacuacucauguu

SEQ ID NO: 56764 - RNA, 19 nt, Homo sapiens
cugaagauaccguuaauaa

SEQ ID NO: 56765 - RNA, 19 nt, Homo sapiens
ggacaaagcagcggauaca

SEQ ID NO: 56766 - RNA, 19 nt, Homo sapiens
uaacucuccugaacaucua

SEQ ID NO: 56767 - RNA, 19 nt, Homo sapiens
gcaaauaaacuugguagca

SEQ ID NO: 56768 - RNA, 19 nt, Homo sapiens
gaauaguccuugggcaguu

SEQ ID NO: 56769 - RNA, 19 nt, Homo sapiens
aacggacacugaaauauuu

SEQ ID NO: 56770 - RNA, 19 nt, Homo sapiens
aaacaccacaucacuuuaa

SEQ ID NO: 56771 - RNA, 19 nt, Homo sapiens
gaauagaaacuacccaucu

SEQ ID NO: 56772 - RNA, 19 nt, Homo sapiens
uaaagaaccaggaguggaa

SEQ ID NO: 56773 - RNA, 19 nt, Homo sapiens
acuagaagcuguguuagaa

SEQ ID NO: 56774 - RNA, 19 nt, Homo sapiens
gcuguuaacacugcaaaua

SEQ ID NO: 56775 - RNA, 19 nt, Homo sapiens
gaauagcugguuucccuaa

SEQ ID NO: 56776 - RNA, 19 nt, Homo sapiens
caucgucaacccaguaaua

SEQ ID NO: 56777 - RNA, 19 nt, Homo sapiens
gaaccgguuuccaaagaca

SEQ ID NO: 56778 - RNA, 19 nt, Homo sapiens
gcagguauuagaaaugaaa

SEQ ID NO: 56779 - RNA, 19 nt, Homo sapiens
ucaagagaauagcugguuu

SEQ ID NO: 56780 - RNA, 19 nt, Homo sapiens
gaaauucugaggcagguau

SEQ ID NO: 56781 - RNA, 19 nt, Homo sapiens
gaucgauuaugugacuuaa

SEQ ID NO: 56782 - RNA, 19 nt, Homo sapiens
gagcuccucucacucuuca

SEQ ID NO: 56783 - RNA, 19 nt, Homo sapiens
ccaagaaugagcuuacaaa

SEQ ID NO: 56784 - RNA, 19 nt, Homo sapiens
gcuggacaccuaccugaua

SEQ ID NO: 56785 - RNA, 19 nt, Homo sapiens
caugcaacauaaccugaua

SEQ ID NO: 56786 - RNA, 19 nt, Homo sapiens
caaaguaugggcuacagaa

SEQ ID NO: 56787 - RNA, 19 nt, Homo sapiens
acaagaaaguacgagauuu

SEQ ID NO: 56788 - RNA, 19 nt, Homo sapiens
uuguagcucugguauauaa

SEQ ID NO: 56789 - RNA, 19 nt, Homo sapiens
aagaaccgguuuccaaaga

SEQ ID NO: 56790 - RNA, 19 nt, Homo sapiens
cagaucaacuggaauggau

SEQ ID NO: 56791 - RNA, 19 nt, Homo sapiens
ugagacggauguaacaaau

SEQ ID NO: 56792 - RNA, 19 nt, Homo sapiens
aaauaacucuccugaacau

SEQ ID NO: 56793 - RNA, 19 nt, Homo sapiens
guaaauguugugcuguuaa

SEQ ID NO: 56794 - RNA, 19 nt, Homo sapiens
cacaguguccuuuauguaa

SEQ ID NO: 56795 - RNA, 19 nt, Homo sapiens
ucaagaaccgguuuccaaa

SEQ ID NO: 56796 - RNA, 19 nt, Homo sapiens
gaaaugaaaaggaaacuug

SEQ ID NO: 56797 - RNA, 19 nt, Homo sapiens
ccacagaucaacuggaaug

SEQ ID NO: 56798 - RNA, 19 nt, Homo sapiens
caacaugcccacagaucaa

SEQ ID NO: 56799 - RNA, 19 nt, Homo sapiens
ucaccaacaugcccacaga

SEQ ID NO: 56800 - RNA, 19 nt, Homo sapiens
cagaggagauguggucaau

SEQ ID NO: 56801 - RNA, 19 nt, Homo sapiens
gcaggaaauggcugaacua

SEQ ID NO: 56802 - RNA, 19 nt, Homo sapiens
gcugagaggcauccagaaa

SEQ ID NO: 56803 - RNA, 19 nt, Homo sapiens
uguaaauguugugcuguua

SEQ ID NO: 56804 - RNA, 19 nt, Homo sapiens
gaaaccccaucucuacuaa

SEQ ID NO: 56805 - RNA, 19 nt, Homo sapiens
ucgauuaugugacuuaaag

SEQ ID NO: 56806 - RNA, 19 nt, Homo sapiens
ggaucgauuaugugacuua

SEQ ID NO: 56807 - RNA, 19 nt, Homo sapiens
gcaagaugcugauucauua

SEQ ID NO: 56808 - RNA, 19 nt, Homo sapiens
ggaaauggcugaacuagaa

SEQ ID NO: 56809 - RNA, 19 nt, Homo sapiens
gaacaaagcacaucagaaa

SEQ ID NO: 56810 - RNA, 19 nt, Homo sapiens
ccauacagcuucauaaaua

SEQ ID NO: 56811 - RNA, 19 nt, Homo sapiens
gcagauaguucuaccagua

SEQ ID NO: 56812 - RNA, 19 nt, Homo sapiens
gaacggacacugaaauauu

SEQ ID NO: 56813 - RNA, 19 nt, Homo sapiens
agaaugagcuuacaaagug

SEQ ID NO: 56814 - RNA, 19 nt, Homo sapiens
caagaaaguacgagauuua

SEQ ID NO: 56815 - RNA, 19 nt, Homo sapiens
gaaccugucuccacaaagu

SEQ ID NO: 56816 - RNA, 19 nt, Homo sapiens
caaauaaacuugguagcaa

SEQ ID NO: 56817 - RNA, 19 nt, Homo sapiens
cagcuacccuuccaucaua

SEQ ID NO: 56818 - RNA, 19 nt, Homo sapiens
gaaauuagccggucauggu

SEQ ID NO: 56819 - RNA, 19 nt, Homo sapiens
ccacaucacuuuaacuaau

SEQ ID NO: 56820 - RNA, 19 nt, Homo sapiens
gggauaccaugcaacauaa

SEQ ID NO: 56821 - RNA, 19 nt, Homo sapiens
gaacagaaagaaauggauu

SEQ ID NO: 56822 - RNA, 19 nt, Homo sapiens
gaaaaggacuucuggcuau

SEQ ID NO: 56823 - RNA, 19 nt, Homo sapiens
gcagugagccaagaucaua

SEQ ID NO: 56824 - RNA, 19 nt, Homo sapiens
gggcaguucucaaauguug

SEQ ID NO: 56825 - RNA, 19 nt, Homo sapiens
gaaaauaacucuccugaac

SEQ ID NO: 56826 - RNA, 19 nt, Homo sapiens
gaaaauggguaguuagcua

SEQ ID NO: 56827 - RNA, 19 nt, Homo sapiens
ugaauuggcugcuugugaa

SEQ ID NO: 56828 - RNA, 19 nt, Homo sapiens
uauaagaccucuggcauga

SEQ ID NO: 56829 - RNA, 19 nt, Homo sapiens
gaaggagcuuucaucauuc

SEQ ID NO: 56830 - RNA, 19 nt, Homo sapiens
cuagaaaucuguugcuaug

SEQ ID NO: 56831 - RNA, 19 nt, Homo sapiens
gaggagauguggucaaugg

SEQ ID NO: 56832 - RNA, 19 nt, Homo sapiens
gaaacuacccaucucaaga

SEQ ID NO: 56833 - RNA, 19 nt, Homo sapiens
gcucagggcuauccucuca

SEQ ID NO: 56834 - RNA, 19 nt, Homo sapiens
caucaucaacccaguaaua

SEQ ID NO: 56835 - RNA, 19 nt, Homo sapiens
gaaaccauacagcuucaua

SEQ ID NO: 56836 - RNA, 19 nt, Homo sapiens
caacauaaccugauaaagc

SEQ ID NO: 56837 - RNA, 19 nt, Homo sapiens
aaacaagcgucucugaaga

SEQ ID NO: 56838 - RNA, 19 nt, Homo sapiens
gaacaucaucaacccagua

SEQ ID NO: 56839 - RNA, 19 nt, Homo sapiens
gaagagcuauugaaaauca

SEQ ID NO: 56840 - RNA, 19 nt, Homo sapiens
gaagagacuacucauguug

SEQ ID NO: 56841 - RNA, 19 nt, Homo sapiens
gaaacaagcgucucugaag

SEQ ID NO: 56842 - RNA, 19 nt, Homo sapiens
gcagagggauaccaugcaa

SEQ ID NO: 56843 - RNA, 19 nt, Homo sapiens
ugaacuagaagcuguguua

SEQ ID NO: 56844 - RNA, 19 nt, Homo sapiens
gaaaguacgagauuuaguc

SEQ ID NO: 56845 - RNA, 19 nt, Homo sapiens
gagaaucccaggacagaaa

SEQ ID NO: 56846 - RNA, 19 nt, Homo sapiens
gaaaacaccacaucacuuu

SEQ ID NO: 56847 - RNA, 19 nt, Homo sapiens
ggugguacaugcacaguug

SEQ ID NO: 56848 - RNA, 19 nt, Homo sapiens
cuacuguccuggcuacuaa

SEQ ID NO: 56849 - RNA, 19 nt, Homo sapiens
gcccacagaucaacuggaa

SEQ ID NO: 56850 - RNA, 19 nt, Homo sapiens
caacagaaagggucaacaa

SEQ ID NO: 56851 - RNA, 19 nt, Homo sapiens
ugacacagguuuggaguau

SEQ ID NO: 56852 - RNA, 19 nt, Homo sapiens
ugacagaucccaccaggaa

SEQ ID NO: 56853 - RNA, 19 nt, Homo sapiens
uaagaccucuggcaugaau

SEQ ID NO: 56854 - RNA, 19 nt, Homo sapiens
gcagggagaagccagaauu

SEQ ID NO: 56855 - RNA, 19 nt, Homo sapiens
gaagacugcucagggcuau

SEQ ID NO: 56856 - RNA, 19 nt, Homo sapiens
gagauuuagucaacuuguu

SEQ ID NO: 56857 - RNA, 19 nt, Homo sapiens
ggaggaaaauggguaguua

SEQ ID NO: 56858 - RNA, 19 nt, Homo sapiens
ucauuaagguuguugaugu

SEQ ID NO: 56859 - RNA, 19 nt, Homo sapiens
aagaggagcucauuaaggu

SEQ ID NO: 56860 - RNA, 19 nt, Homo sapiens
ugagaacucugaggacaaa

SEQ ID NO: 56861 - RNA, 19 nt, Homo sapiens
gacccagucuauuaaagaa

SEQ ID NO: 56862 - RNA, 19 nt, Homo sapiens
ugaagagacuacucauguu

SEQ ID NO: 56863 - RNA, 19 nt, Homo sapiens
ggacaaagcagcggauaca

SEQ ID NO: 56864 - RNA, 19 nt, Homo sapiens
uaacucuccugaacaucua

SEQ ID NO: 56865 - RNA, 19 nt, Homo sapiens
gcaaauaaacuugguagca

SEQ ID NO: 56866 - RNA, 19 nt, Homo sapiens
gaauaguccuugggcaguu

SEQ ID NO: 56867 - RNA, 19 nt, Homo sapiens
aacggacacugaaauauuu

SEQ ID NO: 56868 - RNA, 19 nt, Homo sapiens
aaacaccacaucacuuuaa

SEQ ID NO: 56869 - RNA, 19 nt, Homo sapiens
gaauagaaacuacccaucu

SEQ ID NO: 56870 - RNA, 19 nt, Homo sapiens
uaaagaaccaggaguggaa

SEQ ID NO: 56871 - RNA, 19 nt, Homo sapiens
acuagaagcuguguuagaa

SEQ ID NO: 56872 - RNA, 19 nt, Homo sapiens
gcuguuaacacugcaaaua

SEQ ID NO: 56873 - RNA, 19 nt, Homo sapiens
gaauagcugguuucccuaa

SEQ ID NO: 56874 - RNA, 19 nt, Homo sapiens
gaaccgguuuccaaagaca

SEQ ID NO: 56875 - RNA, 19 nt, Homo sapiens
gcagguauuagaaaugaaa

SEQ ID NO: 56876 - RNA, 19 nt, Homo sapiens
ucaagagaauagcugguuu

SEQ ID NO: 56877 - RNA, 19 nt, Homo sapiens
gaaauucugaggcagguau

SEQ ID NO: 56878 - RNA, 19 nt, Homo sapiens
gaucgauuaugugacuuaa

SEQ ID NO: 56879 - RNA, 19 nt, Homo sapiens
gagcuccucucacucuuca

SEQ ID NO: 56880 - RNA, 19 nt, Homo sapiens
ccaagaaugagcuuacaaa

SEQ ID NO: 56881 - RNA, 19 nt, Homo sapiens
gcuggacaccuaccugaua

SEQ ID NO: 56882 - RNA, 19 nt, Homo sapiens
caucauaagugacucuucu

SEQ ID NO: 56883 - RNA, 19 nt, Homo sapiens
caugcaacauaaccugaua

SEQ ID NO: 56884 - RNA, 19 nt, Homo sapiens
caaaguaugggcuacagaa

SEQ ID NO: 56885 - RNA, 19 nt, Homo sapiens
acaagaaaguacgagauuu

SEQ ID NO: 56886 - RNA, 19 nt, Homo sapiens
uuguagcucugguauauaa

SEQ ID NO: 56887 - RNA, 19 nt, Homo sapiens
aagaaccgguuuccaaaga

SEQ ID NO: 56888 - RNA, 19 nt, Homo sapiens
cagaucaacuggaauggau

SEQ ID NO: 56889 - RNA, 19 nt, Homo sapiens
ugagacggauguaacaaau

SEQ ID NO: 56890 - RNA, 19 nt, Homo sapiens
aaauaacucuccugaacau

SEQ ID NO: 56891 - RNA, 19 nt, Homo sapiens
caucaacccaguaauaaug

SEQ ID NO: 56892 - RNA, 19 nt, Homo sapiens
guaaauguugugcuguuaa

SEQ ID NO: 56893 - RNA, 19 nt, Homo sapiens
cacaguguccuuuauguaa

SEQ ID NO: 56894 - RNA, 19 nt, Homo sapiens
ucaagaaccgguuuccaaa

SEQ ID NO: 56895 - RNA, 19 nt, Homo sapiens
gaaaugaaaaggaaacuug

SEQ ID NO: 56896 - RNA, 19 nt, Homo sapiens
ccacagaucaacuggaaug

SEQ ID NO: 56897 - RNA, 19 nt, Homo sapiens
caacaugcccacagaucaa

SEQ ID NO: 56898 - RNA, 19 nt, Homo sapiens
ucaccaacaugcccacaga

SEQ ID NO: 56899 - RNA, 19 nt, Homo sapiens
cagaggagauguggucaau

SEQ ID NO: 56900 - RNA, 19 nt, Homo sapiens
gcaggaaauggcugaacua

SEQ ID NO: 56901 - RNA, 19 nt, Homo sapiens
gcugagaggcauccagaaa

SEQ ID NO: 56902 - RNA, 19 nt, Homo sapiens
uguaaauguugugcuguua

SEQ ID NO: 56903 - RNA, 19 nt, Homo sapiens
gaaaccccaucucuacuaa

SEQ ID NO: 56904 - RNA, 19 nt, Homo sapiens
ucgauuaugugacuuaaag

SEQ ID NO: 56905 - RNA, 19 nt, Homo sapiens
ggaucgauuaugugacuua

SEQ ID NO: 56906 - RNA, 19 nt, Homo sapiens
ggagagugcuugggaucga

SEQ ID NO: 56907 - RNA, 19 nt, Homo sapiens
gaagugggcuccaguauua

SEQ ID NO: 56908 - RNA, 19 nt, Homo sapiens
caaaguagcugauguauug

SEQ ID NO: 56909 - RNA, 19 nt, Homo sapiens
gcaagaugcugauucauua

SEQ ID NO: 56910 - RNA, 19 nt, Homo sapiens
ggaaauggcugaacuagaa

SEQ ID NO: 56911 - RNA, 19 nt, Homo sapiens
gcaagaauaugaagaagua

SEQ ID NO: 56912 - RNA, 19 nt, Homo sapiens
gaagagaacuuaucuagug

SEQ ID NO: 56913 - RNA, 19 nt, Homo sapiens
gaacaaagcacaucagaaa

SEQ ID NO: 56914 - RNA, 19 nt, Homo sapiens
ccauacagcuucauaaaua

SEQ ID NO: 56915 - RNA, 19 nt, Homo sapiens
gaagccagcucaagcaaua

SEQ ID NO: 56916 - RNA, 19 nt, Homo sapiens
gcagauaguucuaccagua

SEQ ID NO: 56917 - RNA, 19 nt, Homo sapiens
caacgaaacuggacucauu

SEQ ID NO: 56918 - RNA, 19 nt, Homo sapiens
gaacuuaucuagugaggau

SEQ ID NO: 56919 - RNA, 19 nt, Homo sapiens
gaacacagaggagaauuua

SEQ ID NO: 56920 - RNA, 19 nt, Homo sapiens
ccagugaacuuaaagaauu

SEQ ID NO: 56921 - RNA, 19 nt, Homo sapiens
aagcauggauucaaacuua

SEQ ID NO: 56922 - RNA, 19 nt, Homo sapiens
gagcugaaguuaacaaaug

SEQ ID NO: 56923 - RNA, 19 nt, Homo sapiens
gaaauagguuccagugaug

SEQ ID NO: 56924 - RNA, 19 nt, Homo sapiens
gaacggacacugaaauauu

SEQ ID NO: 56925 - RNA, 19 nt, Homo sapiens
cagaagugaugaacuguua

SEQ ID NO: 56926 - RNA, 19 nt, Homo sapiens
ccaaagaucucauguuaag

SEQ ID NO: 56927 - RNA, 19 nt, Homo sapiens
caaaugaacagacaaguaa

SEQ ID NO: 56928 - RNA, 19 nt, Homo sapiens
gaacagcaguuuauuacuc

SEQ ID NO: 56929 - RNA, 19 nt, Homo sapiens
gaaauuagaguccucagaa

SEQ ID NO: 56930 - RNA, 19 nt, Homo sapiens
caagaaaguacgagauuua

SEQ ID NO: 56931 - RNA, 19 nt, Homo sapiens
gaaagcagauuuggcaguu

SEQ ID NO: 56932 - RNA, 19 nt, Homo sapiens
gaaccugucuccacaaagu

SEQ ID NO: 56933 - RNA, 19 nt, Homo sapiens
ggaaagaaugagucuaaua

SEQ ID NO: 56934 - RNA, 19 nt, Homo sapiens
ugaaucaaaugccaaagua

SEQ ID NO: 56935 - RNA, 19 nt, Homo sapiens
gaaguaaggaaacauguaa

SEQ ID NO: 56936 - RNA, 19 nt, Homo sapiens
caaauaaacuugguagcaa

SEQ ID NO: 56937 - RNA, 19 nt, Homo sapiens
cagcuacccuuccaucaua

SEQ ID NO: 56938 - RNA, 19 nt, Homo sapiens
ugaaagaucuguagagagu

SEQ ID NO: 56939 - RNA, 19 nt, Homo sapiens
caauauggaacucgaauua

SEQ ID NO: 56940 - RNA, 19 nt, Homo sapiens
ccaaaucaguagagaguaa

SEQ ID NO: 56941 - RNA, 19 nt, Homo sapiens
gaaauuagccggucauggu

SEQ ID NO: 56942 - RNA, 19 nt, Homo sapiens
ccacaucacuuuaacuaau

SEQ ID NO: 56943 - RNA, 19 nt, Homo sapiens
ggucaagugaugaauauua

SEQ ID NO: 56944 - RNA, 19 nt, Homo sapiens
ggaacgggcuuggaagaaa

SEQ ID NO: 56945 - RNA, 19 nt, Homo sapiens
guuagaugauggugaaaua

SEQ ID NO: 56946 - RNA, 19 nt, Homo sapiens
caaaggaggcucuagguuu

SEQ ID NO: 56947 - RNA, 19 nt, Homo sapiens
uaauaucacugcaggcuuu

SEQ ID NO: 56948 - RNA, 19 nt, Homo sapiens
gaagauguuccuuggauaa

SEQ ID NO: 56949 - RNA, 19 nt, Homo sapiens
ccaaguagcugggacuauu

SEQ ID NO: 56950 - RNA, 19 nt, Homo sapiens
gggauaccaugcaacauaa

SEQ ID NO: 56951 - RNA, 19 nt, Homo sapiens
aaagagaaaugggaaauga

SEQ ID NO: 56952 - RNA, 19 nt, Homo sapiens
gcaaggagccaacauaaca

SEQ ID NO: 56953 - RNA, 19 nt, Homo sapiens
aagaugagcuuacaaagug

SEQ ID NO: 56954 - RNA, 19 nt, Homo sapiens
gaacagaaagaaauggauu

SEQ ID NO: 56955 - RNA, 19 nt, Homo sapiens
caauauaccuucucagucu

SEQ ID NO: 56956 - RNA, 19 nt, Homo sapiens
ucaaauaccagugaacuua

SEQ ID NO: 56957 - RNA, 19 nt, Homo sapiens
aacgaaagcugaaccuaua

SEQ ID NO: 56958 - RNA, 19 nt, Homo sapiens
gaaaguuaaugagugguuu

SEQ ID NO: 56959 - RNA, 19 nt, Homo sapiens
gaagauaccguuaauaagg

SEQ ID NO: 56960 - RNA, 19 nt, Homo sapiens
gaaaaggacuucuggcuau

SEQ ID NO: 56961 - RNA, 19 nt, Homo sapiens
gauaaugccaaauguagua

SEQ ID NO: 56962 - RNA, 19 nt, Homo sapiens
gcagaauggucaagugaug

SEQ ID NO: 56963 - RNA, 19 nt, Homo sapiens
gcagugagccaagaucaua

SEQ ID NO: 56964 - RNA, 19 nt, Homo sapiens
gggcaguucucaaauguug

SEQ ID NO: 56965 - RNA, 19 nt, Homo sapiens
gcaguaaccagguaauauu

SEQ ID NO: 56966 - RNA, 19 nt, Homo sapiens
guaagcauccugaaauaaa

SEQ ID NO: 56967 - RNA, 19 nt, Homo sapiens
gcauagaaauggaagaaag

SEQ ID NO: 56968 - RNA, 19 nt, Homo sapiens
guagagaguagcaguauuu

SEQ ID NO: 56969 - RNA, 19 nt, Homo sapiens
gaaaauaacucuccugaac

SEQ ID NO: 56970 - RNA, 19 nt, Homo sapiens
gaaaauggguaguuagcua

SEQ ID NO: 56971 - RNA, 19 nt, Homo sapiens
ggaauugguuucagaugau

SEQ ID NO: 56972 - RNA, 19 nt, Homo sapiens
aaagacuccugaaaugaua

SEQ ID NO: 56973 - RNA, 19 nt, Homo sapiens
aaaggcugcuugugaauuu

SEQ ID NO: 56974 - RNA, 19 nt, Homo sapiens
uauaagaccucuggcauga

SEQ ID NO: 56975 - RNA, 19 nt, Homo sapiens
gaaggagcuuucaucauuc

SEQ ID NO: 56976 - RNA, 19 nt, Homo sapiens
cuagaaaucuguugcuaug

SEQ ID NO: 56977 - RNA, 19 nt, Homo sapiens
gaggagauguggucaaugg

SEQ ID NO: 56978 - RNA, 19 nt, Homo sapiens
gaaacuacccaucucaaga

SEQ ID NO: 56979 - RNA, 19 nt, Homo sapiens
ugaaauagguuccagugau

SEQ ID NO: 56980 - RNA, 19 nt, Homo sapiens
guacagacaguuaauauca

SEQ ID NO: 56981 - RNA, 19 nt, Homo sapiens
ucaggaaaguaucucguua

SEQ ID NO: 56982 - RNA, 19 nt, Homo sapiens
gaaccuauaagcagcagua

SEQ ID NO: 56983 - RNA, 19 nt, Homo sapiens
gcucagggcuauccucuca

SEQ ID NO: 56984 - RNA, 19 nt, Homo sapiens
ugaaugcuaugcuuagauu

SEQ ID NO: 56985 - RNA, 19 nt, Homo sapiens
caucaucaacccaguaaua

SEQ ID NO: 56986 - RNA, 19 nt, Homo sapiens
gaaaccauacagcuucaua

SEQ ID NO: 56987 - RNA, 19 nt, Homo sapiens
caacauaaccugauaaagc

SEQ ID NO: 56988 - RNA, 19 nt, Homo sapiens
aaacaagcgucucugaaga

SEQ ID NO: 56989 - RNA, 19 nt, Homo sapiens
gaaguaguucagacuguua

SEQ ID NO: 56990 - RNA, 19 nt, Homo sapiens
ggacucauuacuccaaaua

SEQ ID NO: 56991 - RNA, 19 nt, Homo sapiens
ccaauagaaucacucgaaa

SEQ ID NO: 56992 - RNA, 19 nt, Homo sapiens
ucaugaggcuuuaauaugu

SEQ ID NO: 56993 - RNA, 19 nt, Homo sapiens
gaacaucaucaacccagua

SEQ ID NO: 56994 - RNA, 19 nt, Homo sapiens
gaagagcuauugaaaauca

SEQ ID NO: 56995 - RNA, 19 nt, Homo sapiens
gaagagacuacucauguug

SEQ ID NO: 56996 - RNA, 19 nt, Homo sapiens
gaaacaagcgucucugaag

SEQ ID NO: 56997 - RNA, 19 nt, Homo sapiens
ggaaacaagcauagaaaug

SEQ ID NO: 56998 - RNA, 19 nt, Homo sapiens
aaucuaagcccaccuaauu

SEQ ID NO: 56999 - RNA, 19 nt, Homo sapiens
cuaaauagcagcauucaga

SEQ ID NO: 57000 - RNA, 19 nt, Homo sapiens
gcagagggauaccaugcaa

SEQ ID NO: 57001 - RNA, 19 nt, Homo sapiens
auacagauuucucuccaua

SEQ ID NO: 57002 - RNA, 19 nt, Homo sapiens
gaaugagucuaauaucaag

SEQ ID NO: 57003 - RNA, 19 nt, Homo sapiens
gcagaaaccuacaacucau

SEQ ID NO: 57004 - RNA, 19 nt, Homo sapiens
ugaacuagaagcuguguua

SEQ ID NO: 57005 - RNA, 19 nt, Homo sapiens
gcagugaauuggaagacuu

SEQ ID NO: 57006 - RNA, 19 nt, Homo sapiens
gaaacaagcauagaaaugg

SEQ ID NO: 57007 - RNA, 19 nt, Homo sapiens
gaacaacaguuauuggaau

SEQ ID NO: 57008 - RNA, 19 nt, Homo sapiens
acagagaccucaagaguaa

SEQ ID NO: 57009 - RNA, 19 nt, Homo sapiens
acaaagagaacaacaguua

SEQ ID NO: 57010 - RNA, 19 nt, Homo sapiens
caauagaaccugucaauau

SEQ ID NO: 57011 - RNA, 19 nt, Homo sapiens
gauuagagaccaaggauuu

SEQ ID NO: 57012 - RNA, 19 nt, Homo sapiens
ccacugauguguguuaauu

SEQ ID NO: 57013 - RNA, 19 nt, Homo sapiens
ggauuguucuguaugaauu

SEQ ID NO: 57014 - RNA, 19 nt, Homo sapiens
gaagacaggaaucgaauga

SEQ ID NO: 57015 - RNA, 19 nt, Homo sapiens
gaggagguguggaauauca

SEQ ID NO: 57016 - RNA, 19 nt, Homo sapiens
caaauucucgccucuauug

SEQ ID NO: 57017 - RNA, 19 nt, Homo sapiens
agacaggaaucgaaugaaa

SEQ ID NO: 57018 - RNA, 19 nt, Homo sapiens
guacagaaguuccacugau

SEQ ID NO: 57019 - RNA, 19 nt, Homo sapiens
caacagggaccagauaauu

SEQ ID NO: 57020 - RNA, 19 nt, Homo sapiens
gugaaagccuuacagaaau

SEQ ID NO: 57021 - RNA, 19 nt, Homo sapiens
gaaucgggcugguuuccaa

SEQ ID NO: 57022 - RNA, 19 nt, Homo sapiens
caacaacagggaccagaua

SEQ ID NO: 57023 - RNA, 19 nt, Homo sapiens
uuaccuggcucacuaacua

SEQ ID NO: 57024 - RNA, 19 nt, Homo sapiens
caacuugauuugcuguuug

SEQ ID NO: 57025 - RNA, 19 nt, Homo sapiens
ugucaaacaugugguuaua

SEQ ID NO: 57026 - RNA, 19 nt, Homo sapiens
ccagagugcugugcuguuu

SEQ ID NO: 57027 - RNA, 19 nt, Homo sapiens
cgugaaagccuuacagaaa

SEQ ID NO: 57028 - RNA, 19 nt, Homo sapiens
ggagagaagaaaccaauug

SEQ ID NO: 57029 - RNA, 19 nt, Homo sapiens
caagcuagaugcacuccaa

SEQ ID NO: 57030 - RNA, 19 nt, Homo sapiens
caucagaacccuccuugaa

SEQ ID NO: 57031 - RNA, 19 nt, Homo sapiens
gagaugaucaaacuuauag

SEQ ID NO: 57032 - RNA, 19 nt, Homo sapiens
gaagaucaucgaaaucaau

SEQ ID NO: 57033 - RNA, 19 nt, Homo sapiens
gauauuuccuggcuuacug

SEQ ID NO: 57034 - RNA, 19 nt, Homo sapiens
caugaagaccucacaguaa

SEQ ID NO: 57035 - RNA, 19 nt, Homo sapiens
gaccucaagaguaauaaua

SEQ ID NO: 57036 - RNA, 19 nt, Homo sapiens
gcaguuacaagccuucaaa

SEQ ID NO: 57037 - RNA, 19 nt, Homo sapiens
gcauaauccaccaucaaua

SEQ ID NO: 57038 - RNA, 19 nt, Homo sapiens
caaaagccaugaagagauu

SEQ ID NO: 57039 - RNA, 19 nt, Homo sapiens
gaaaguggcauggugaugu

SEQ ID NO: 57040 - RNA, 19 nt, Homo sapiens
ucagaacccuccuugaauc

SEQ ID NO: 57041 - RNA, 19 nt, Homo sapiens
ucaguaagguacggaguaa

SEQ ID NO: 57042 - RNA, 19 nt, Homo sapiens
caccagaagucaucagaau

SEQ ID NO: 57043 - RNA, 19 nt, Homo sapiens
ggagaauguuccacuuaca

SEQ ID NO: 57044 - RNA, 19 nt, Homo sapiens
cauaauccaccaucaauau

SEQ ID NO: 57045 - RNA, 19 nt, Homo sapiens
gagaacaacaguuauugga

SEQ ID NO: 57046 - RNA, 19 nt, Homo sapiens
ccacagagaccucaagagu

SEQ ID NO: 57047 - RNA, 19 nt, Homo sapiens
gagaccaaauuugagauga

SEQ ID NO: 57048 - RNA, 19 nt, Homo sapiens
aaacacgacaugugaauau

SEQ ID NO: 57049 - RNA, 19 nt, Homo sapiens
ggaagaggcguccuuagca

SEQ ID NO: 57050 - RNA, 19 nt, Homo sapiens
acugauauuuccuggcuua

SEQ ID NO: 57051 - RNA, 19 nt, Homo sapiens
cuaaagaaagcacugauga

SEQ ID NO: 57052 - RNA, 19 nt, Homo sapiens
caacaaagagaacaacagu

SEQ ID NO: 57053 - RNA, 19 nt, Homo sapiens
guauaugcauuugggauug

SEQ ID NO: 57054 - RNA, 19 nt, Homo sapiens
acaguugucuggauccauu

SEQ ID NO: 57055 - RNA, 19 nt, Homo sapiens
augaagaccucacaguaaa

SEQ ID NO: 57056 - RNA, 19 nt, Homo sapiens
cggaggagguguggaauau

SEQ ID NO: 57057 - RNA, 19 nt, Homo sapiens
gugcuaccuucaucucuuu

SEQ ID NO: 57058 - RNA, 19 nt, Homo sapiens
ggaggccuaugaagaauac

SEQ ID NO: 57059 - RNA, 19 nt, Homo sapiens
acaguuaccuuauucaaac

SEQ ID NO: 57060 - RNA, 19 nt, Homo sapiens
ggacucgagugaugauugg

SEQ ID NO: 57061 - RNA, 19 nt, Homo sapiens
agacgggacucgagugaug

SEQ ID NO: 57062 - RNA, 19 nt, Homo sapiens
ccaacuugauuugcuguuu

SEQ ID NO: 57063 - RNA, 19 nt, Homo sapiens
agaaagcacugaugaugag

SEQ ID NO: 57064 - RNA, 19 nt, Homo sapiens
gacaguuaccuuauucaaa

SEQ ID NO: 57065 - RNA, 19 nt, Homo sapiens
ggacaguuaccuuauucaa

SEQ ID NO: 57066 - RNA, 19 nt, Homo sapiens
cauuugggauuguucugua

SEQ ID NO: 57067 - RNA, 19 nt, Homo sapiens
gagcauaauccaccaucaa

SEQ ID NO: 57068 - RNA, 19 nt, Homo sapiens
ucauugagaccaaauuuga

SEQ ID NO: 57069 - RNA, 19 nt, Homo sapiens
gugaaaauguugaauguga

SEQ ID NO: 57070 - RNA, 19 nt, Homo sapiens
gagaauguuccacuuacaa

SEQ ID NO: 57071 - RNA, 19 nt, Homo sapiens
gggcauggauuacuuacac

SEQ ID NO: 57072 - RNA, 19 nt, Homo sapiens
ccugcaagguguggaguua

SEQ ID NO: 57073 - RNA, 19 nt, Homo sapiens
ucaugaagaccucacagua

SEQ ID NO: 57074 - RNA, 19 nt, Homo sapiens
gaccaaauuugagaugauc

SEQ ID NO: 57075 - RNA, 19 nt, Homo sapiens
ggacaaagaauuggaucug

SEQ ID NO: 57076 - RNA, 19 nt, Homo sapiens
aaagaaagcacugaugaug

SEQ ID NO: 57077 - RNA, 19 nt, Homo sapiens
ucaucagaaugcaagauaa

SEQ ID NO: 57078 - RNA, 19 nt, Homo sapiens
acaaaugagugagagaguu

SEQ ID NO: 57079 - RNA, 19 nt, Homo sapiens
caucagaaugcaagauaaa

SEQ ID NO: 57080 - RNA, 19 nt, Homo sapiens
ugaaagccuuacagaaauc

SEQ ID NO: 57081 - RNA, 19 nt, Homo sapiens
uagaugcacuccaacaaag

SEQ ID NO: 57082 - RNA, 19 nt, Homo sapiens
agucagauguauaugcauu

SEQ ID NO: 57083 - RNA, 19 nt, Homo sapiens
acagugaaaucucgaugga

SEQ ID NO: 57084 - RNA, 19 nt, Homo sapiens
gaacagucuacaagggaaa

SEQ ID NO: 57085 - RNA, 19 nt, Homo sapiens
cucauuaccuggcucacua

SEQ ID NO: 57086 - RNA, 19 nt, Homo sapiens
uacagaaguuccacugaug

SEQ ID NO: 57087 - RNA, 19 nt, Homo sapiens
ucaggagaguagcaacaaa

SEQ ID NO: 57088 - RNA, 19 nt, Homo sapiens
ggauaccugucuccagauc

SEQ ID NO: 57089 - RNA, 19 nt, Homo sapiens
ucagucagauguauaugca

SEQ ID NO: 57090 - RNA, 19 nt, Homo sapiens
gguguggaauaucaaacaa

SEQ ID NO: 57091 - RNA, 19 nt, Homo sapiens
caaaugagugagagaguuc

SEQ ID NO: 57092 - RNA, 19 nt, Homo sapiens
gaaacaaaugagugagaga

SEQ ID NO: 57093 - RNA, 19 nt, Homo sapiens
ggagcauaauccaccauca

SEQ ID NO: 57094 - RNA, 19 nt, Homo sapiens
ucagauguauaugcauuug

SEQ ID NO: 57095 - RNA, 19 nt, Homo sapiens
ccaaggauuucguggugau

SEQ ID NO: 57096 - RNA, 19 nt, Homo sapiens
caaagagaacaacaguuau

SEQ ID NO: 57097 - RNA, 19 nt, Homo sapiens
gaacaguugucuggaucca

SEQ ID NO: 57098 - RNA, 19 nt, Homo sapiens
cacagagaccucaagagua

SEQ ID NO: 57099 - RNA, 19 nt, Homo sapiens
ugaagaucaucgaaaucaa

SEQ ID NO: 57100 - RNA, 19 nt, Homo sapiens
cccaaauucucgccucuau

SEQ ID NO: 57101 - RNA, 19 nt, Homo sapiens
cugcacagggcauggauua

SEQ ID NO: 57102 - RNA, 19 nt, Homo sapiens
gaauauccuacucuucaug

SEQ ID NO: 57103 - RNA, 19 nt, Homo sapiens
ucaccgcagugcaucagaa

SEQ ID NO: 57104 - RNA, 19 nt, Homo sapiens
cacaauagaaccugucaau

SEQ ID NO: 57105 - RNA, 19 nt, Homo sapiens
guugacacaggaacauaua

SEQ ID NO: 57106 - RNA, 19 nt, Homo sapiens
gcaucaauggauaccguua

SEQ ID NO: 57107 - RNA, 19 nt, Homo sapiens
ggaaagagauacagaauuu

SEQ ID NO: 57108 - RNA, 19 nt, Homo sapiens
gaaacggacuugcuauuua

SEQ ID NO: 57109 - RNA, 19 nt, Homo sapiens
ggacauggcucugaugaua

SEQ ID NO: 57110 - RNA, 19 nt, Homo sapiens
uaaauuaucuggccaguuu

SEQ ID NO: 57111 - RNA, 19 nt, Homo sapiens
guaaagaaaugcagaauuc

SEQ ID NO: 57112 - RNA, 19 nt, Homo sapiens
gaagacaucaucuggauua

SEQ ID NO: 57113 - RNA, 19 nt, Homo sapiens
gguaucagaugcuucauua

SEQ ID NO: 57114 - RNA, 19 nt, Homo sapiens
gaaagaaagugucccaguu

SEQ ID NO: 57115 - RNA, 19 nt, Homo sapiens
gaagaaugcagguuuaaua

SEQ ID NO: 57116 - RNA, 19 nt, Homo sapiens
ggaagucaguuugaauuua

SEQ ID NO: 57117 - RNA, 19 nt, Homo sapiens
gaaacaagcuucugauguc

SEQ ID NO: 57118 - RNA, 19 nt, Homo sapiens
gaagaacaauauccuacua

SEQ ID NO: 57119 - RNA, 19 nt, Homo sapiens
gaaagucaaugccaaaugu

SEQ ID NO: 57120 - RNA, 19 nt, Homo sapiens
cagcuuaccuugaggguua

SEQ ID NO: 57121 - RNA, 19 nt, Homo sapiens
caaagaaccuacucuguug

SEQ ID NO: 57122 - RNA, 19 nt, Homo sapiens
ggaggaauaucguagguaa

SEQ ID NO: 57123 - RNA, 19 nt, Homo sapiens
caaaggcgacaauaaauua

SEQ ID NO: 57124 - RNA, 19 nt, Homo sapiens
gccaaagagucauuuaaua

SEQ ID NO: 57125 - RNA, 19 nt, Homo sapiens
gaaguuugcuggccuguug

SEQ ID NO: 57126 - RNA, 19 nt, Homo sapiens
gaaccaacuuuguccuuaa

SEQ ID NO: 57127 - RNA, 19 nt, Homo sapiens
uaaggaacgucaagagaua

SEQ ID NO: 57128 - RNA, 19 nt, Homo sapiens
cuucauaacucucuagaua

SEQ ID NO: 57129 - RNA, 19 nt, Homo sapiens
ggaauaaucuugcuuuagg

SEQ ID NO: 57130 - RNA, 19 nt, Homo sapiens
gcucaaagguaacaauuau

SEQ ID NO: 57131 - RNA, 19 nt, Homo sapiens
caacaaagcagauuuagga

SEQ ID NO: 57132 - RNA, 19 nt, Homo sapiens
cgaagaacuugcauugaua

SEQ ID NO: 57133 - RNA, 19 nt, Homo sapiens
auaaacagcuguauacgua

SEQ ID NO: 57134 - RNA, 19 nt, Homo sapiens
caaaugggcaggacucuua

SEQ ID NO: 57135 - RNA, 19 nt, Homo sapiens
caaaggaaaccaucuuaua

SEQ ID NO: 57136 - RNA, 19 nt, Homo sapiens
cccagaaucucuuauguua

SEQ ID NO: 57137 - RNA, 19 nt, Homo sapiens
cagaggauauucuucauaa

SEQ ID NO: 57138 - RNA, 19 nt, Homo sapiens
gcaaaugcauacccacaaa

SEQ ID NO: 57139 - RNA, 19 nt, Homo sapiens
gaaaucaacuagugaccuu

SEQ ID NO: 57140 - RNA, 19 nt, Homo sapiens
ggaaacuucugcagaggua

SEQ ID NO: 57141 - RNA, 19 nt, Homo sapiens
gaagguacaguugaaauua

SEQ ID NO: 57142 - RNA, 19 nt, Homo sapiens
ggacaucuccuugaauaua

SEQ ID NO: 57143 - RNA, 19 nt, Homo sapiens
guacacugcucaaaucauu

SEQ ID NO: 57144 - RNA, 19 nt, Homo sapiens
gggcaaagacccuaaagua

SEQ ID NO: 57145 - RNA, 19 nt, Homo sapiens
cuacaucucugaucaaaga

SEQ ID NO: 57146 - RNA, 19 nt, Homo sapiens
guaaauaccuuggcauuag

SEQ ID NO: 57147 - RNA, 19 nt, Homo sapiens
cagacaagcucaaagguaa

SEQ ID NO: 57148 - RNA, 19 nt, Homo sapiens
guacuuauguugcacaaug

SEQ ID NO: 57149 - RNA, 19 nt, Homo sapiens
gaucgaagauuguuuaugc

SEQ ID NO: 57150 - RNA, 19 nt, Homo sapiens
gaaacagacuugacuugug

SEQ ID NO: 57151 - RNA, 19 nt, Homo sapiens
ccaaggauguucugucaaa

SEQ ID NO: 57152 - RNA, 19 nt, Homo sapiens
gaggaaauguucuagaaau

SEQ ID NO: 57153 - RNA, 19 nt, Homo sapiens
gcaaagaccacauuggaaa

SEQ ID NO: 57154 - RNA, 19 nt, Homo sapiens
ucagaugacuccauuuaaa

SEQ ID NO: 57155 - RNA, 19 nt, Homo sapiens
ucaaagagcauacccuaua

SEQ ID NO: 57156 - RNA, 19 nt, Homo sapiens
gaagaagaaccuuuagauu

SEQ ID NO: 57157 - RNA, 19 nt, Homo sapiens
gaagauuguuuaugcauca

SEQ ID NO: 57158 - RNA, 19 nt, Homo sapiens
caagaaagguacaauucaa

SEQ ID NO: 57159 - RNA, 19 nt, Homo sapiens
gaaguggaaccaaaugaua

SEQ ID NO: 57160 - RNA, 19 nt, Homo sapiens
ccuagaagaugaaguauau

SEQ ID NO: 57161 - RNA, 19 nt, Homo sapiens
gaaaguuuauggacuggaa

SEQ ID NO: 57162 - RNA, 19 nt, Homo sapiens
gaaaguuccuuacacaaag

SEQ ID NO: 57163 - RNA, 19 nt, Homo sapiens
gcagaauucucucaauaau

SEQ ID NO: 57164 - RNA, 19 nt, Homo sapiens
ggaaacagacauaguuaaa

SEQ ID NO: 57165 - RNA, 19 nt, Homo sapiens
gagggaaacacucagauua

SEQ ID NO: 57166 - RNA, 19 nt, Homo sapiens
ggagguagcuucagaacag

SEQ ID NO: 57167 - RNA, 19 nt, Homo sapiens
caacccaagugucaauuaa

SEQ ID NO: 57168 - RNA, 19 nt, Homo sapiens
ggacaauucugaggaaaug

SEQ ID NO: 57169 - RNA, 19 nt, Homo sapiens
gagaagacaucaucuggau

SEQ ID NO: 57170 - RNA, 19 nt, Homo sapiens
gagcaagccucagucaauu

SEQ ID NO: 57171 - RNA, 19 nt, Homo sapiens
caagauguaugugcuuuaa

SEQ ID NO: 57172 - RNA, 19 nt, Homo sapiens
aaucaggccuucuuacuuu

SEQ ID NO: 57173 - RNA, 19 nt, Homo sapiens
guaaagaccuugaauuagc

SEQ ID NO: 57174 - RNA, 19 nt, Homo sapiens
gacucuaggucaagauuua

SEQ ID NO: 57175 - RNA, 19 nt, Homo sapiens
gaaagagauugaugaccaa

SEQ ID NO: 57176 - RNA, 19 nt, Homo sapiens
gggaaacacucagauuaaa

SEQ ID NO: 57177 - RNA, 19 nt, Homo sapiens
gcaaaggcgacaauaaauu

SEQ ID NO: 57178 - RNA, 19 nt, Homo sapiens
ggacacaauuacaacuaaa

SEQ ID NO: 57179 - RNA, 19 nt, Homo sapiens
aggcaaauguugaaugaua

SEQ ID NO: 57180 - RNA, 19 nt, Homo sapiens
gcaaagacccuaaaguaca

SEQ ID NO: 57181 - RNA, 19 nt, Homo sapiens
gaagucaguuugaauuuac

SEQ ID NO: 57182 - RNA, 19 nt, Homo sapiens
cagaacagcuucaaauaag

SEQ ID NO: 57183 - RNA, 19 nt, Homo sapiens
ccaaguagcuaaugaaagg

SEQ ID NO: 57184 - RNA, 19 nt, Homo sapiens
gcucaaaucauuccuggua

SEQ ID NO: 57185 - RNA, 19 nt, Homo sapiens
gauaugauacggaaauuga

SEQ ID NO: 57186 - RNA, 19 nt, Homo sapiens
gaaagugucccaguuggua

SEQ ID NO: 57187 - RNA, 19 nt, Homo sapiens
gaaacacucagauuaaaga

SEQ ID NO: 57188 - RNA, 19 nt, Homo sapiens
caagaacucuaccaugguu

SEQ ID NO: 57189 - RNA, 19 nt, Homo sapiens
ggaaaagaaucaagaugua

SEQ ID NO: 57190 - RNA, 19 nt, Homo sapiens
ggaaauacauacuguuugc

SEQ ID NO: 57191 - RNA, 19 nt, Homo sapiens
ugacauacuuugcaaugaa

SEQ ID NO: 57192 - RNA, 19 nt, Homo sapiens
ccucuuagcugucuuaaag

SEQ ID NO: 57193 - RNA, 19 nt, Homo sapiens
ucacagaguugaacagugu

SEQ ID NO: 57194 - RNA, 19 nt, Homo sapiens
ugaagaauguugaagauca

SEQ ID NO: 57195 - RNA, 19 nt, Homo sapiens
cagcacaacauaugucuua

SEQ ID NO: 57196 - RNA, 19 nt, Homo sapiens
gcagaagaguacauuugaa

SEQ ID NO: 57197 - RNA, 19 nt, Homo sapiens
gaaaaugccagcacucuua

SEQ ID NO: 57198 - RNA, 19 nt, Homo sapiens
cucaggaucuugauuauaa

SEQ ID NO: 57199 - RNA, 19 nt, Homo sapiens
caaauguccuagaagauga

SEQ ID NO: 57200 - RNA, 19 nt, Homo sapiens
gaagaacuugcauugauaa

SEQ ID NO: 57201 - RNA, 19 nt, Homo sapiens
ugaaagagcuaacauacag

SEQ ID NO: 57202 - RNA, 19 nt, Homo sapiens
cuagaagccuuauucacua

SEQ ID NO: 57203 - RNA, 19 nt, Homo sapiens
gaacaucugacuuuggaaa

SEQ ID NO: 57204 - RNA, 19 nt, Homo sapiens
agacacaggugauaaacaa

SEQ ID NO: 57205 - RNA, 19 nt, Homo sapiens
gagaagagccuuggauuuc

SEQ ID NO: 57206 - RNA, 19 nt, Homo sapiens
gccauuaaauuguccauau

SEQ ID NO: 57207 - RNA, 19 nt, Homo sapiens
gcgaguaguucacauaaua

SEQ ID NO: 57208 - RNA, 19 nt, Homo sapiens
gaauauagcuguuucuucu

SEQ ID NO: 57209 - RNA, 19 nt, Homo sapiens
gaaaggcacucaacagaau

SEQ ID NO: 57210 - RNA, 19 nt, Homo sapiens
gaaauguucccuaaguuua

SEQ ID NO: 57211 - RNA, 19 nt, Homo sapiens
gcaguuaagucugaauaua

SEQ ID NO: 57212 - RNA, 19 nt, Homo sapiens
gaccacaccuucacaugua

SEQ ID NO: 57213 - RNA, 19 nt, Homo sapiens
caaaucaacuucaguaucu

SEQ ID NO: 57214 - RNA, 19 nt, Homo sapiens
guaaugaaauccucagaug

SEQ ID NO: 57215 - RNA, 19 nt, Homo sapiens
gagaugacauuguucuuau

SEQ ID NO: 57216 - RNA, 19 nt, Homo sapiens
gaaagaacauccgcaguca

SEQ ID NO: 57217 - RNA, 19 nt, Homo sapiens
gaacaggcgucacacagau

SEQ ID NO: 57218 - RNA, 19 nt, Homo sapiens
gaacuucacucacagaaaa

SEQ ID NO: 57219 - RNA, 19 nt, Homo sapiens
caagaaugcuucaggaugu

SEQ ID NO: 57220 - RNA, 19 nt, Homo sapiens
gaaaauggauaaccaagaa

SEQ ID NO: 57221 - RNA, 19 nt, Homo sapiens
caagauaaauccaaacucu

SEQ ID NO: 57222 - RNA, 19 nt, Homo sapiens
gauaggauauugugugcaa

SEQ ID NO: 57223 - RNA, 19 nt, Homo sapiens
cuaaagagcauguaaagaa

SEQ ID NO: 57224 - RNA, 19 nt, Homo sapiens
caaaugaggcuaaaggaaa

SEQ ID NO: 57225 - RNA, 19 nt, Homo sapiens
guagagagaacacuaauga

SEQ ID NO: 57226 - RNA, 19 nt, Homo sapiens
ggagaugacauuguucuua

SEQ ID NO: 57227 - RNA, 19 nt, Homo sapiens
caacuucaguaucuacaaa

SEQ ID NO: 57228 - RNA, 19 nt, Homo sapiens
caaaugauucuccuucuaa

SEQ ID NO: 57229 - RNA, 19 nt, Homo sapiens
ucaaagcaguuaagaaugu

SEQ ID NO: 57230 - RNA, 19 nt, Homo sapiens
ucucaaagaccgugauuua

SEQ ID NO: 57231 - RNA, 19 nt, Homo sapiens
aaucagaaauguucccuaa

SEQ ID NO: 57232 - RNA, 19 nt, Homo sapiens
gggaauggauugacuguag

SEQ ID NO: 57233 - RNA, 19 nt, Homo sapiens
aagaagcgcuuggagaaua

SEQ ID NO: 57234 - RNA, 19 nt, Homo sapiens
gauaugacccuucaaagug

SEQ ID NO: 57235 - RNA, 19 nt, Homo sapiens
gagaagagcagaaagaaca

SEQ ID NO: 57236 - RNA, 19 nt, Homo sapiens
cuaaaccuaugaacuauga

SEQ ID NO: 57237 - RNA, 19 nt, Homo sapiens
gaagauaaugcuaaaccua

SEQ ID NO: 57238 - RNA, 19 nt, Homo sapiens
cgacaaacagcuauuauug

SEQ ID NO: 57239 - RNA, 19 nt, Homo sapiens
caucagaagcucaagauaa

SEQ ID NO: 57240 - RNA, 19 nt, Homo sapiens
gaugagcucuucaaccaau

SEQ ID NO: 57241 - RNA, 19 nt, Homo sapiens
gacacaaccucugccaaua

SEQ ID NO: 57242 - RNA, 19 nt, Homo sapiens
gaaagcaucaacacuaaga

SEQ ID NO: 57243 - RNA, 19 nt, Homo sapiens
aagaaaugcuugcaaagaa

SEQ ID NO: 57244 - RNA, 19 nt, Homo sapiens
gaaagcagauacaacaacu

SEQ ID NO: 57245 - RNA, 19 nt, Homo sapiens
ccaaaugauucuccuucua

SEQ ID NO: 57246 - RNA, 19 nt, Homo sapiens
caacaacuccugcaacuuc

SEQ ID NO: 57247 - RNA, 19 nt, Homo sapiens
gaacucauacggaagcauu

SEQ ID NO: 57248 - RNA, 19 nt, Homo sapiens
ucaaauggcauaacuguga

SEQ ID NO: 57249 - RNA, 19 nt, Homo sapiens
gaaaguagcagcagugacu

SEQ ID NO: 57250 - RNA, 19 nt, Homo sapiens
cagaugagcucuucaacca

SEQ ID NO: 57251 - RNA, 19 nt, Homo sapiens
gaaaccaucagguguaaug

SEQ ID NO: 57252 - RNA, 19 nt, Homo sapiens
ucacacagauaggauauug

SEQ ID NO: 57253 - RNA, 19 nt, Homo sapiens
ucagaaauguucccuaagu

SEQ ID NO: 57254 - RNA, 19 nt, Homo sapiens
gaacucuucugaugauucu

SEQ ID NO: 57255 - RNA, 19 nt, Homo sapiens
aaacagauaucacagaaac

SEQ ID NO: 57256 - RNA, 19 nt, Homo sapiens
gcuuucagauaacaagaua

SEQ ID NO: 57257 - RNA, 19 nt, Homo sapiens
ccaaguaccuuuccguaag

SEQ ID NO: 57258 - RNA, 19 nt, Homo sapiens
uagagaagcuguuuaugca

SEQ ID NO: 57259 - RNA, 19 nt, Homo sapiens
ugacaaaucaacuucagua

SEQ ID NO: 57260 - RNA, 19 nt, Homo sapiens
ggaauggauugacuguaga

SEQ ID NO: 57261 - RNA, 19 nt, Homo sapiens
guuagaaucugaaugucaa

SEQ ID NO: 57262 - RNA, 19 nt, Homo sapiens
acacaacgauguuagaauc

SEQ ID NO: 57263 - RNA, 19 nt, Homo sapiens
gacuuaagcucuucagaca

SEQ ID NO: 57264 - RNA, 19 nt, Homo sapiens
agauagagauagacuuuga

SEQ ID NO: 57265 - RNA, 19 nt, Homo sapiens
agaaaugcuugcaaagaaa

SEQ ID NO: 57266 - RNA, 19 nt, Homo sapiens
gaggaaagcagauacaaca

SEQ ID NO: 57267 - RNA, 19 nt, Homo sapiens
guacagaaggauauaaaga

SEQ ID NO: 57268 - RNA, 19 nt, Homo sapiens
agaguaugccuuuauguua

SEQ ID NO: 57269 - RNA, 19 nt, Homo sapiens
gagaguaugccuuuauguu

SEQ ID NO: 57270 - RNA, 19 nt, Homo sapiens
gauugaaccuguugagagu

SEQ ID NO: 57271 - RNA, 19 nt, Homo sapiens
gaacaauuaaggcacugua

SEQ ID NO: 57272 - RNA, 19 nt, Homo sapiens
uguggagacuguuaaagua

SEQ ID NO: 57273 - RNA, 19 nt, Homo sapiens
gaaaauaugccaaagaaug

SEQ ID NO: 57274 - RNA, 19 nt, Homo sapiens
gauguuagaaucugaaugu

SEQ ID NO: 57275 - RNA, 19 nt, Homo sapiens
caacgauguuagaaucuga

SEQ ID NO: 57276 - RNA, 19 nt, Homo sapiens
caucaacacuaagagaauu

SEQ ID NO: 57277 - RNA, 19 nt, Homo sapiens
gcaaaugaggcuaaaggaa

SEQ ID NO: 57278 - RNA, 19 nt, Homo sapiens
gaggucaaguuaagaguca

SEQ ID NO: 57279 - RNA, 19 nt, Homo sapiens
cugaaagcaucaacacuaa

SEQ ID NO: 57280 - RNA, 19 nt, Homo sapiens
gaagaugaagauaaugcua

SEQ ID NO: 57281 - RNA, 19 nt, Homo sapiens
ggaaacaacaguucauugg

SEQ ID NO: 57282 - RNA, 19 nt, Homo sapiens
cagaaauguucccuaaguu

SEQ ID NO: 57283 - RNA, 19 nt, Homo sapiens
gcaauuccaauccugauga

SEQ ID NO: 57284 - RNA, 19 nt, Homo sapiens
gugaaaccaucagguguaa

SEQ ID NO: 57285 - RNA, 19 nt, Homo sapiens
ugagauagagauagacuuu

SEQ ID NO: 57286 - RNA, 19 nt, Homo sapiens
caagagaaaucagccaaag

SEQ ID NO: 57287 - RNA, 19 nt, Homo sapiens
cugaacagcucucaaaugg

SEQ ID NO: 57288 - RNA, 19 nt, Homo sapiens
cagauucucagcaacaaua

SEQ ID NO: 57289 - RNA, 19 nt, Homo sapiens
uaacaagccuggagaugac

SEQ ID NO: 57290 - RNA, 19 nt, Homo sapiens
gaaaagcagccauagaaaa

SEQ ID NO: 57291 - RNA, 19 nt, Homo sapiens
caaaacagauaucacagaa

SEQ ID NO: 57292 - RNA, 19 nt, Homo sapiens
gaguaugccuuuauguuac

SEQ ID NO: 57293 - RNA, 19 nt, Homo sapiens
uaaggaugcauacucauuu

SEQ ID NO: 57294 - RNA, 19 nt, Homo sapiens
cgauggaucuuggaacuau

SEQ ID NO: 57295 - RNA, 19 nt, Homo sapiens
caaagugacauuaugacaa

SEQ ID NO: 57296 - RNA, 19 nt, Homo sapiens
agagauagacuuugaaaca

SEQ ID NO: 57297 - RNA, 19 nt, Homo sapiens
gaguuaagcgucuugcaaa

SEQ ID NO: 57298 - RNA, 19 nt, Homo sapiens
ggcacaagcucuagagaag

SEQ ID NO: 57299 - RNA, 19 nt, Homo sapiens
aucagaagcucaagauaaa

SEQ ID NO: 57300 - RNA, 19 nt, Homo sapiens
caucagguguaaugaaauc

SEQ ID NO: 57301 - RNA, 19 nt, Homo sapiens
caccaccaauuagcauuua

SEQ ID NO: 57302 - RNA, 19 nt, Homo sapiens
cuaagaaagagaccauuaa

SEQ ID NO: 57303 - RNA, 19 nt, Homo sapiens
caacaguucauuggucuaa

SEQ ID NO: 57304 - RNA, 19 nt, Homo sapiens
agagaaaucagccaaagaa

SEQ ID NO: 57305 - RNA, 19 nt, Homo sapiens
caaguacaauccuccagau

SEQ ID NO: 57306 - RNA, 19 nt, Homo sapiens
ugcggcagauguuagauua

SEQ ID NO: 57307 - RNA, 19 nt, Homo sapiens
ggacgaagauuuugacuua

SEQ ID NO: 57308 - RNA, 19 nt, Homo sapiens
guaacaagaugcucaacua

SEQ ID NO: 57309 - RNA, 19 nt, Homo sapiens
ggacugagaauguauguaa

SEQ ID NO: 57310 - RNA, 19 nt, Homo sapiens
agaaguagcuuuaaugguu

SEQ ID NO: 57311 - RNA, 19 nt, Homo sapiens
gaaguagcuuuaaugguuu

SEQ ID NO: 57312 - RNA, 19 nt, Homo sapiens
uaccguaggucuauccuua

SEQ ID NO: 57313 - RNA, 19 nt, Homo sapiens
acagacaagucccauauuu

SEQ ID NO: 57314 - RNA, 19 nt, Homo sapiens
gaugacaaauccauagaau

SEQ ID NO: 57315 - RNA, 19 nt, Homo sapiens
gcaacuuagugccuuguaa

SEQ ID NO: 57316 - RNA, 19 nt, Homo sapiens
uaacgacuauuugcaguuu

SEQ ID NO: 57317 - RNA, 19 nt, Homo sapiens
gauuugagguucuggauuc

SEQ ID NO: 57318 - RNA, 19 nt, Homo sapiens
ucacugcacaucaauauaa

SEQ ID NO: 57319 - RNA, 19 nt, Homo sapiens
acacacacauuaagaugaa

SEQ ID NO: 57320 - RNA, 19 nt, Homo sapiens
caacuaggacugagaaugu

SEQ ID NO: 57321 - RNA, 19 nt, Homo sapiens
acaagaugcucaacuauag

SEQ ID NO: 57322 - RNA, 19 nt, Homo sapiens
gaacuggcacacacacauu

SEQ ID NO: 57323 - RNA, 19 nt, Homo sapiens
uaacagacaagucccauau

SEQ ID NO: 57324 - RNA, 19 nt, Homo sapiens
cauaaggacaagucaauuu

SEQ ID NO: 57325 - RNA, 19 nt, Homo sapiens
cagcagacuuuccaucuca

SEQ ID NO: 57326 - RNA, 19 nt, Homo sapiens
gcacacacacauuaagaug

SEQ ID NO: 57327 - RNA, 19 nt, Homo sapiens
ggugagcaguuaaugguau

SEQ ID NO: 57328 - RNA, 19 nt, Homo sapiens
ucacuaccgucgcuuucua

SEQ ID NO: 57329 - RNA, 19 nt, Homo sapiens
caaauugaguuucuuucuc

SEQ ID NO: 57330 - RNA, 19 nt, Homo sapiens
gggacuuugugauuuaauu

SEQ ID NO: 57331 - RNA, 19 nt, Homo sapiens
uaccgucgcuuucuauuuc

SEQ ID NO: 57332 - RNA, 19 nt, Homo sapiens
gcuccaaguuccaccagaa

SEQ ID NO: 57333 - RNA, 19 nt, Homo sapiens
guaaaacgauuuccuguag

SEQ ID NO: 57334 - RNA, 19 nt, Homo sapiens
ccacuuaccaugcauaaca

SEQ ID NO: 57335 - RNA, 19 nt, Homo sapiens
caagucaauuugucaguag

SEQ ID NO: 57336 - RNA, 19 nt, Homo sapiens
gugcccaucucaagacauu

SEQ ID NO: 57337 - RNA, 19 nt, Homo sapiens
agagaaacccuuugacuuc

SEQ ID NO: 57338 - RNA, 19 nt, Homo sapiens
acgauuuccuguagaagua

SEQ ID NO: 57339 - RNA, 19 nt, Homo sapiens
agugggacuuugugauuua

SEQ ID NO: 57340 - RNA, 19 nt, Homo sapiens
cuuagugccuuguaaucua

SEQ ID NO: 57341 - RNA, 19 nt, Homo sapiens
acauuccacucacagauuu

SEQ ID NO: 57342 - RNA, 19 nt, Homo sapiens
gcaaauugaguuucuuucu

SEQ ID NO: 57343 - RNA, 19 nt, Homo sapiens
guguuggacugcaaauuga

SEQ ID NO: 57344 - RNA, 19 nt, Homo sapiens
gugacuacauuaccucuuc

SEQ ID NO: 57345 - RNA, 19 nt, Homo sapiens
gacugagaauguauguaaa

SEQ ID NO: 57346 - RNA, 19 nt, Homo sapiens
caacuuagugccuuguaau

SEQ ID NO: 57347 - RNA, 19 nt, Homo sapiens
ggagcuggcaagccucuuu

SEQ ID NO: 57348 - RNA, 19 nt, Homo sapiens
aacaagaugcucaacuaua

SEQ ID NO: 57349 - RNA, 19 nt, Homo sapiens
gacauuccacucacagauu

SEQ ID NO: 57350 - RNA, 19 nt, Homo sapiens
uaacaagaugcucaacuau

SEQ ID NO: 57351 - RNA, 19 nt, Homo sapiens
cuauuucucuuucuuugug

SEQ ID NO: 57352 - RNA, 19 nt, Homo sapiens
aaucuaacuuugucacugu

SEQ ID NO: 57353 - RNA, 19 nt, Homo sapiens
gcuugucacugcacaucaa

SEQ ID NO: 57354 - RNA, 19 nt, Homo sapiens
gcacucacgccaugcuuuc

SEQ ID NO: 57355 - RNA, 19 nt, Homo sapiens
acgacuauuugcaguuuaa

SEQ ID NO: 57356 - RNA, 19 nt, Homo sapiens
uggcaccucuccaccugua

SEQ ID NO: 57357 - RNA, 19 nt, Homo sapiens
ggaaaacggugccuguaag

SEQ ID NO: 57358 - RNA, 19 nt, Homo sapiens
gugagcaguuaaugguauu

SEQ ID NO: 57359 - RNA, 19 nt, Homo sapiens
caccuucccucauuucagu

SEQ ID NO: 57360 - RNA, 19 nt, Homo sapiens
cguauuuauugccaaacua

SEQ ID NO: 57361 - RNA, 19 nt, Homo sapiens
guagaaguagcuuuaaugg

SEQ ID NO: 57362 - RNA, 19 nt, Homo sapiens
ccaccuaacauaaggacaa

SEQ ID NO: 57363 - RNA, 19 nt, Homo sapiens
ucaagacauuccacucaca

SEQ ID NO: 57364 - RNA, 19 nt, Homo sapiens
ugccaaaucacaagagaaa

SEQ ID NO: 57365 - RNA, 19 nt, Homo sapiens
cacaggcccuacauuaaca

SEQ ID NO: 57366 - RNA, 19 nt, Homo sapiens
ccacaggcccuacauuaac

SEQ ID NO: 57367 - RNA, 19 nt, Homo sapiens
aagagaaacccuuugacuu

SEQ ID NO: 57368 - RNA, 19 nt, Homo sapiens
ucacaacuaggacugagaa

SEQ ID NO: 57369 - RNA, 19 nt, Homo sapiens
gcaggaaggaaggcugaaa

SEQ ID NO: 57370 - RNA, 19 nt, Homo sapiens
uaacauaaggacaagucaa

SEQ ID NO: 57371 - RNA, 19 nt, Homo sapiens
ccacgugcccaucucaaga

SEQ ID NO: 57372 - RNA, 19 nt, Homo sapiens
cacugcacaucaauauaaa

SEQ ID NO: 57373 - RNA, 19 nt, Homo sapiens
gcgcgaacgcacaggauga

SEQ ID NO: 57374 - RNA, 19 nt, Homo sapiens
gcucuagaauaccguaggu

SEQ ID NO: 57375 - RNA, 19 nt, Homo sapiens
uuacagaagcaacuuagug

SEQ ID NO: 57376 - RNA, 19 nt, Homo sapiens
agccuuaagugccaaauca

SEQ ID NO: 57377 - RNA, 19 nt, Homo sapiens
ggcccuacauuaacaaggu

SEQ ID NO: 57378 - RNA, 19 nt, Homo sapiens
ggacuaggagagacuugau

SEQ ID NO: 57379 - RNA, 19 nt, Homo sapiens
ucagucucccgcacacuua

SEQ ID NO: 57380 - RNA, 19 nt, Homo sapiens
ucaagacgccugcccaucu

SEQ ID NO: 57381 - RNA, 19 nt, Homo sapiens
aaacggugccuguaaguac

SEQ ID NO: 57382 - RNA, 19 nt, Homo sapiens
gugggacuuugugauuuaa

SEQ ID NO: 57383 - RNA, 19 nt, Homo sapiens
ccacaucccauacccucuu

SEQ ID NO: 57384 - RNA, 19 nt, Homo sapiens
guaacgacuauuugcaguu

SEQ ID NO: 57385 - RNA, 19 nt, Homo sapiens
uguguuggacugcaaauug

SEQ ID NO: 57386 - RNA, 19 nt, Homo sapiens
caacugcaccuucccucau

SEQ ID NO: 57387 - RNA, 19 nt, Homo sapiens
auaaggacaagucaauuug

SEQ ID NO: 57388 - RNA, 19 nt, Homo sapiens
cccacaggcccuacauuaa

SEQ ID NO: 57389 - RNA, 19 nt, Homo sapiens
cgaguccccucacauguuu

SEQ ID NO: 57390 - RNA, 19 nt, Homo sapiens
gccaccaucuucgacuuga

SEQ ID NO: 57391 - RNA, 19 nt, Homo sapiens
uguagaaguagcuuuaaug

SEQ ID NO: 57392 - RNA, 19 nt, Homo sapiens
aaaacgauuuccuguagaa

SEQ ID NO: 57393 - RNA, 19 nt, Homo sapiens
ggagagacuugauuuuggu

SEQ ID NO: 57394 - RNA, 19 nt, Homo sapiens
gaaccccuguugacuaauc

SEQ ID NO: 57395 - RNA, 19 nt, Homo sapiens
ugacuacauuaccucuuca

SEQ ID NO: 57396 - RNA, 19 nt, Homo sapiens
uuuaggccuuucacaacua

SEQ ID NO: 57397 - RNA, 19 nt, Homo sapiens
caauaucuguguaaaacga

SEQ ID NO: 57398 - RNA, 19 nt, Homo sapiens
uaccaugcauaacagacaa

SEQ ID NO: 57399 - RNA, 19 nt, Homo sapiens
gcccuacauuaacaagguu

SEQ ID NO: 57400 - RNA, 19 nt, Homo sapiens
gagcuggcaagccucuuug

SEQ ID NO: 57401 - RNA, 19 nt, Homo sapiens
cuaccgucgcuuucuauuu

SEQ ID NO: 57402 - RNA, 19 nt, Homo sapiens
aacuaggacugagaaugua

SEQ ID NO: 57403 - RNA, 19 nt, Homo sapiens
gacugcaaauugaguuucu

SEQ ID NO: 57404 - RNA, 19 nt, Homo sapiens
acuaggagagacuugauuu

SEQ ID NO: 57405 - RNA, 19 nt, Homo sapiens
guugccugcuggacagaaa

SEQ ID NO: 57406 - RNA, 19 nt, Homo sapiens
ugaguuucuuucucuuuag

SEQ ID NO: 57407 - RNA, 19 nt, Homo sapiens
gaauaugccuugauaguua

SEQ ID NO: 57408 - RNA, 19 nt, Homo sapiens
gcacagcccugcucaacaa

SEQ ID NO: 57409 - RNA, 19 nt, Homo sapiens
ggaaggcgguucagagaug

SEQ ID NO: 57410 - RNA, 19 nt, Homo sapiens
gaacagcauuaguuaaguc

SEQ ID NO: 57411 - RNA, 19 nt, Homo sapiens
ucagaccgguguaaacaaa

SEQ ID NO: 57412 - RNA, 19 nt, Homo sapiens
ccaccuugcuaaaccuaua

SEQ ID NO: 57413 - RNA, 19 nt, Homo sapiens
caaagguccauacugguua

SEQ ID NO: 57414 - RNA, 19 nt, Homo sapiens
caacaaggagaacaaauuc

SEQ ID NO: 57415 - RNA, 19 nt, Homo sapiens
cuuaguggauguucaguuu

SEQ ID NO: 57416 - RNA, 19 nt, Homo sapiens
ucaacaaggagaacaaauu

SEQ ID NO: 57417 - RNA, 19 nt, Homo sapiens
acaacaugcuggacaagaa

SEQ ID NO: 57418 - RNA, 19 nt, Homo sapiens
gcuccucgcuucucuccuu

SEQ ID NO: 57419 - RNA, 19 nt, Homo sapiens
gaagaaguuccuaauugug

SEQ ID NO: 57420 - RNA, 19 nt, Homo sapiens
gguccauacugguuacuug

SEQ ID NO: 57421 - RNA, 19 nt, Homo sapiens
ccaaagguccauacugguu

SEQ ID NO: 57422 - RNA, 19 nt, Homo sapiens
gagcucagcagccucauca

SEQ ID NO: 57423 - RNA, 19 nt, Homo sapiens
ugaacaacaugcuggacaa

SEQ ID NO: 57424 - RNA, 19 nt, Homo sapiens
caaccaccauuccaucucu

SEQ ID NO: 57425 - RNA, 19 nt, Homo sapiens
gcaguugugauacgaauag

SEQ ID NO: 57426 - RNA, 19 nt, Homo sapiens
gaaggcgguucagagaugu

SEQ ID NO: 57427 - RNA, 19 nt, Homo sapiens
cauccagacccacaacuuu

SEQ ID NO: 57428 - RNA, 19 nt, Homo sapiens
gggaacccuucucuuggaa

SEQ ID NO: 57429 - RNA, 19 nt, Homo sapiens
cauacugguuacuugguuu

SEQ ID NO: 57430 - RNA, 19 nt, Homo sapiens
uuaguuaaguccagaugug

SEQ ID NO: 57431 - RNA, 19 nt, Homo sapiens
cauuccaucucuucacuug

SEQ ID NO: 57432 - RNA, 19 nt, Homo sapiens
gggcaguugugauacgaau

SEQ ID NO: 57433 - RNA, 19 nt, Homo sapiens
ugcuaaaccuauaagcuuu

SEQ ID NO: 57434 - RNA, 19 nt, Homo sapiens
ucgguuuccucuugucuuu

SEQ ID NO: 57435 - RNA, 19 nt, Homo sapiens
ccauacugguuacuugguu

SEQ ID NO: 57436 - RNA, 19 nt, Homo sapiens
cuucuacgaugucgacuuc

SEQ ID NO: 57437 - RNA, 19 nt, Homo sapiens
ggaccgcgacagcuaccua

SEQ ID NO: 57438 - RNA, 19 nt, Homo sapiens
ugacucgccauccgaagua

SEQ ID NO: 57439 - RNA, 19 nt, Homo sapiens
cacuuaaacuuuguuagga

SEQ ID NO: 57440 - RNA, 19 nt, Homo sapiens
gaagggaaggcgguucaga

SEQ ID NO: 57441 - RNA, 19 nt, Homo sapiens
uaguggauguucaguuuag

SEQ ID NO: 57442 - RNA, 19 nt, Homo sapiens
agaauaugccuugauaguu

SEQ ID NO: 57443 - RNA, 19 nt, Homo sapiens
ugggaacccuucucuugga

SEQ ID NO: 57444 - RNA, 19 nt, Homo sapiens
agaaaucccuggccaaccu

SEQ ID NO: 57445 - RNA, 19 nt, Homo sapiens
gcagcuaccaaccaccauu

SEQ ID NO: 57446 - RNA, 19 nt, Homo sapiens
uggccaaccucaaccugaa

SEQ ID NO: 57447 - RNA, 19 nt, Homo sapiens
cugguuacuugguuucauu

SEQ ID NO: 57448 - RNA, 19 nt, Homo sapiens
gcacuuggacucgaacucu

SEQ ID NO: 57449 - RNA, 19 nt, Homo sapiens
ccgaugaguuugggacuuc

SEQ ID NO: 57450 - RNA, 19 nt, Homo sapiens
aagaauaugccuugauagu

SEQ ID NO: 57451 - RNA, 19 nt, Homo sapiens
ugaacagcauuaguuaagu

SEQ ID NO: 57452 - RNA, 19 nt, Homo sapiens
gcucaacaaggagaacaaa

SEQ ID NO: 57453 - RNA, 19 nt, Homo sapiens
aaacaugucgaccacacuu

SEQ ID NO: 57454 - RNA, 19 nt, Homo sapiens
ccacugcgggauccagaaa

SEQ ID NO: 57455 - RNA, 19 nt, Homo sapiens
ugugggaacccuucucuug

SEQ ID NO: 57456 - RNA, 19 nt, Homo sapiens
cagcccugcucaacaagga

SEQ ID NO: 57457 - RNA, 19 nt, Homo sapiens
ccaauauauucugccaaga

SEQ ID NO: 57458 - RNA, 19 nt, Homo sapiens
gaacaacaugcuggacaag

SEQ ID NO: 57459 - RNA, 19 nt, Homo sapiens
aagaaguuccuaauugugu

SEQ ID NO: 57460 - RNA, 19 nt, Homo sapiens
ucuacgaugucgacuucuu

SEQ ID NO: 57461 - RNA, 19 nt, Homo sapiens
caacaugcuggacaagaag

SEQ ID NO: 57462 - RNA, 19 nt, Homo sapiens
acacuuaaacuuuguuagg

SEQ ID NO: 57463 - RNA, 19 nt, Homo sapiens
gaccgcgacagcuaccuaa

SEQ ID NO: 57464 - RNA, 19 nt, Homo sapiens
gagcggcacgugcaaguac

SEQ ID NO: 57465 - RNA, 19 nt, Homo sapiens
ccucagcccauagguguuu

SEQ ID NO: 57466 - RNA, 19 nt, Homo sapiens
gaguuugggacuucaggaa

SEQ ID NO: 57467 - RNA, 19 nt, Homo sapiens
gugauacgaauagaacaaa

SEQ ID NO: 57468 - RNA, 19 nt, Homo sapiens
uugcuaaaccuauaagcuu

SEQ ID NO: 57469 - RNA, 19 nt, Homo sapiens
gagagcggcacgugcaagu

SEQ ID NO: 57470 - RNA, 19 nt, Homo sapiens
aauaugccuugauaguuag

SEQ ID NO: 57471 - RNA, 19 nt, Homo sapiens
acuugaacagcauuaguua

SEQ ID NO: 57472 - RNA, 19 nt, Homo sapiens
cacuugaacagcauuaguu

SEQ ID NO: 57473 - RNA, 19 nt, Homo sapiens
gcagcugcucgcccaaguu

SEQ ID NO: 57474 - RNA, 19 nt, Homo sapiens
caacuccacgcgcuacaag

SEQ ID NO: 57475 - RNA, 19 nt, Homo sapiens
cuacgaugucgacuucuug

SEQ ID NO: 57476 - RNA, 19 nt, Homo sapiens
gcaaguacggcgaaaagug

SEQ ID NO: 57477 - RNA, 19 nt, Homo sapiens
cagcugcucgcccaaguuc

SEQ ID NO: 57478 - RNA, 19 nt, Homo sapiens
uuaguggauguucaguuua

SEQ ID NO: 57479 - RNA, 19 nt, Homo sapiens
aguuagcccucagcccaua

SEQ ID NO: 57480 - RNA, 19 nt, Homo sapiens
caccacagccucagcuucu

SEQ ID NO: 57481 - RNA, 19 nt, Homo sapiens
ggacaacucuccaggaaua

SEQ ID NO: 57482 - RNA, 19 nt, Homo sapiens
gaacauaccuacugaggaa

SEQ ID NO: 57483 - RNA, 19 nt, Homo sapiens
gaacugagaagaagaaaua

SEQ ID NO: 57484 - RNA, 19 nt, Homo sapiens
gcaaacaguuccaaauauu

SEQ ID NO: 57485 - RNA, 19 nt, Homo sapiens
gaaaugcuauucucaucaa

SEQ ID NO: 57486 - RNA, 19 nt, Homo sapiens
gaggacagauucuagcuuu

SEQ ID NO: 57487 - RNA, 19 nt, Homo sapiens
gaucgugucuaugauauuu

SEQ ID NO: 57488 - RNA, 19 nt, Homo sapiens
guuguaaggugcucucuuu

SEQ ID NO: 57489 - RNA, 19 nt, Homo sapiens
gaaagagaauugccagaac

SEQ ID NO: 57490 - RNA, 19 nt, Homo sapiens
caagcucugugguuucuaa

SEQ ID NO: 57491 - RNA, 19 nt, Homo sapiens
ccucuuauccugucucuaa

SEQ ID NO: 57492 - RNA, 19 nt, Homo sapiens
ggaugcaacucacuaccuu

SEQ ID NO: 57493 - RNA, 19 nt, Homo sapiens
ccaaauccaugcaaacagu

SEQ ID NO: 57494 - RNA, 19 nt, Homo sapiens
cagaagaaauggcucaaag

SEQ ID NO: 57495 - RNA, 19 nt, Homo sapiens
guaaggugcucucuuucau

SEQ ID NO: 57496 - RNA, 19 nt, Homo sapiens
aaucacaaaugacacagaa

SEQ ID NO: 57497 - RNA, 19 nt, Homo sapiens
caaaucaccuccuguaccu

SEQ ID NO: 57498 - RNA, 19 nt, Homo sapiens
ccagaacgguauugguguu

SEQ ID NO: 57499 - RNA, 19 nt, Homo sapiens
guucuguucuguucuccua

SEQ ID NO: 57500 - RNA, 19 nt, Homo sapiens
ugcaaacaguuccaaauau

SEQ ID NO: 57501 - RNA, 19 nt, Homo sapiens
ggaaaugcuauucucauca

SEQ ID NO: 57502 - RNA, 19 nt, Homo sapiens
ucaucaagcucugugguuu

SEQ ID NO: 57503 - RNA, 19 nt, Homo sapiens
gcauuugaacugagaagaa

SEQ ID NO: 57504 - RNA, 19 nt, Homo sapiens
gcugacaccucucuuacca

SEQ ID NO: 57505 - RNA, 19 nt, Homo sapiens
ugucuacuauuccuugauu

SEQ ID NO: 57506 - RNA, 19 nt, Homo sapiens
cgaaagagaauugccagaa

SEQ ID NO: 57507 - RNA, 19 nt, Homo sapiens
ugaaucauguaccucuuau

SEQ ID NO: 57508 - RNA, 19 nt, Homo sapiens
gcucugugguuucuaacga

SEQ ID NO: 57509 - RNA, 19 nt, Homo sapiens
aagcucaguuguucuguug

SEQ ID NO: 57510 - RNA, 19 nt, Homo sapiens
ggauggcuguucggaagaa

SEQ ID NO: 57511 - RNA, 19 nt, Homo sapiens
cagccucacucaccuaauc

SEQ ID NO: 57512 - RNA, 19 nt, Homo sapiens
gaacgguauugguguuggu

SEQ ID NO: 57513 - RNA, 19 nt, Homo sapiens
gauucuagcuuuucaagga

SEQ ID NO: 57514 - RNA, 19 nt, Homo sapiens
gcacugggagcauacagau

SEQ ID NO: 57515 - RNA, 19 nt, Homo sapiens
caaaagcacccugaacaua

SEQ ID NO: 57516 - RNA, 19 nt, Homo sapiens
gcaggcagaggacagauuc

SEQ ID NO: 57517 - RNA, 19 nt, Homo sapiens
aaauuagugugaccucguu

SEQ ID NO: 57518 - RNA, 19 nt, Homo sapiens
ccugaagacuuguguaaaa

SEQ ID NO: 57519 - RNA, 19 nt, Homo sapiens
ggaagaauugguuguaagg

SEQ ID NO: 57520 - RNA, 19 nt, Homo sapiens
gaccaaauccaugcaaaca

SEQ ID NO: 57521 - RNA, 19 nt, Homo sapiens
ucacaaaugacacagaauc

SEQ ID NO: 57522 - RNA, 19 nt, Homo sapiens
ucggaagaauugguuguaa

SEQ ID NO: 57523 - RNA, 19 nt, Homo sapiens
augcaaacaguuccaaaua

SEQ ID NO: 57524 - RNA, 19 nt, Homo sapiens
aauaccaucucguuacuag

SEQ ID NO: 57525 - RNA, 19 nt, Homo sapiens
ccaucuauauuacuuaugc

SEQ ID NO: 57526 - RNA, 19 nt, Homo sapiens
uacauucucugcugugcuu

SEQ ID NO: 57527 - RNA, 19 nt, Homo sapiens
ccaaugccauccugaagac

SEQ ID NO: 57528 - RNA, 19 nt, Homo sapiens
uggaaaugcuauucucauc

SEQ ID NO: 57529 - RNA, 19 nt, Homo sapiens
gcuaggacccuuuacaaaa

SEQ ID NO: 57530 - RNA, 19 nt, Homo sapiens
guuacuagacguaggcauu

SEQ ID NO: 57531 - RNA, 19 nt, Homo sapiens
caacucuccaggaauagaa

SEQ ID NO: 57532 - RNA, 19 nt, Homo sapiens
gaagcaggcagaggacaga

SEQ ID NO: 57533 - RNA, 19 nt, Homo sapiens
gcucaguuguucuguugca

SEQ ID NO: 57534 - RNA, 19 nt, Homo sapiens
guaccucuaccauucauuc

SEQ ID NO: 57535 - RNA, 19 nt, Homo sapiens
gcgucuggaucgugucuau

SEQ ID NO: 57536 - RNA, 19 nt, Homo sapiens
guaucuggaugucuuggau

SEQ ID NO: 57537 - RNA, 19 nt, Homo sapiens
ucacucaccuaaucagacu

SEQ ID NO: 57538 - RNA, 19 nt, Homo sapiens
gugacaaucaacugcauuu

SEQ ID NO: 57539 - RNA, 19 nt, Homo sapiens
gagcgacagcccuccaaug

SEQ ID NO: 57540 - RNA, 19 nt, Homo sapiens
gugucaguguucacauuaa

SEQ ID NO: 57541 - RNA, 19 nt, Homo sapiens
cggaagaauugguuguaag

SEQ ID NO: 57542 - RNA, 19 nt, Homo sapiens
caccuaaucagacuuuaau

SEQ ID NO: 57543 - RNA, 19 nt, Homo sapiens
ucaccuaaucagacuuuaa

SEQ ID NO: 57544 - RNA, 19 nt, Homo sapiens
aaagcucaguuguucuguu

SEQ ID NO: 57545 - RNA, 19 nt, Homo sapiens
cugcugugcuucuuagugu

SEQ ID NO: 57546 - RNA, 19 nt, Homo sapiens
cuuaugcugugaucauuuc

SEQ ID NO: 57547 - RNA, 19 nt, Homo sapiens
guugcugacaccucucuua

SEQ ID NO: 57548 - RNA, 19 nt, Homo sapiens
cauuugaacugagaagaag

SEQ ID NO: 57549 - RNA, 19 nt, Homo sapiens
ucacuucucaaaccuaugu

SEQ ID NO: 57550 - RNA, 19 nt, Homo sapiens
acaaagccaugcccguaag

SEQ ID NO: 57551 - RNA, 19 nt, Homo sapiens
uacuauuccuugauugcua

SEQ ID NO: 57552 - RNA, 19 nt, Homo sapiens
ucagugggcauccuuggaa

SEQ ID NO: 57553 - RNA, 19 nt, Homo sapiens
ucugugguuucuaacgaua

SEQ ID NO: 57554 - RNA, 19 nt, Homo sapiens
cuaauaccaucucguuacu

SEQ ID NO: 57555 - RNA, 19 nt, Homo sapiens
uggaucgugucuaugauau

SEQ ID NO: 57556 - RNA, 19 nt, Homo sapiens
aagaccaaauccaugcaaa

SEQ ID NO: 57557 - RNA, 19 nt, Homo sapiens
gcuauucucaucaaagucu

SEQ ID NO: 57558 - RNA, 19 nt, Homo sapiens
gcaguugugaagccacuug

SEQ ID NO: 57559 - RNA, 19 nt, Homo sapiens
ggggacaacucuccaggaa

SEQ ID NO: 57560 - RNA, 19 nt, Homo sapiens
cgauaacacaaauaaagga

SEQ ID NO: 57561 - RNA, 19 nt, Homo sapiens
gguguugguggcucuguuu

SEQ ID NO: 57562 - RNA, 19 nt, Homo sapiens
gaaucccgaaagagaauug

SEQ ID NO: 57563 - RNA, 19 nt, Homo sapiens
ugacagauacaaggcaguu

SEQ ID NO: 57564 - RNA, 19 nt, Homo sapiens
gcauugugugccaucuaua

SEQ ID NO: 57565 - RNA, 19 nt, Homo sapiens
aggaauagaagcauugugu

SEQ ID NO: 57566 - RNA, 19 nt, Homo sapiens
ugccaaaucaccuccugua

SEQ ID NO: 57567 - RNA, 19 nt, Homo sapiens
gaauugccagaacgguauu

SEQ ID NO: 57568 - RNA, 19 nt, Homo sapiens
agaauugccagaacgguau

SEQ ID NO: 57569 - RNA, 19 nt, Homo sapiens
cuacauuauuccacucucu

SEQ ID NO: 57570 - RNA, 19 nt, Homo sapiens
ucuaugauauuugcucuac

SEQ ID NO: 57571 - RNA, 19 nt, Homo sapiens
cagugggcauccuuggaaa

SEQ ID NO: 57572 - RNA, 19 nt, Homo sapiens
uuaucucugucuacuauuc

SEQ ID NO: 57573 - RNA, 19 nt, Homo sapiens
gacacagaaucaucaagcu

SEQ ID NO: 57574 - RNA, 19 nt, Homo sapiens
ucucuauuaucucugucua

SEQ ID NO: 57575 - RNA, 19 nt, Homo sapiens
cuucuuaguguucuacauu

SEQ ID NO: 57576 - RNA, 19 nt, Homo sapiens
uugaaucauguaccucuua

SEQ ID NO: 57577 - RNA, 19 nt, Homo sapiens
ucauccggcucacuucugu

SEQ ID NO: 57578 - RNA, 19 nt, Homo sapiens
ccuaauaccaucucguuac

SEQ ID NO: 57579 - RNA, 19 nt, Homo sapiens
uccuguaccucuaccauuc

SEQ ID NO: 57580 - RNA, 19 nt, Homo sapiens
ugauugcuaggacccuuua

SEQ ID NO: 57581 - RNA, 19 nt, Homo sapiens
ggucagagcuacacauuga

SEQ ID NO: 57582 - RNA, 19 nt, Homo sapiens
ggacgacucugaccucuug

SEQ ID NO: 57583 - RNA, 19 nt, Homo sapiens
ggacaaggcccucaugaac

SEQ ID NO: 57584 - RNA, 19 nt, Homo sapiens
uccaaguucucaccucuua

SEQ ID NO: 57585 - RNA, 19 nt, Homo sapiens
caaguucucaccucuuaaa

SEQ ID NO: 57586 - RNA, 19 nt, Homo sapiens
ccacccaccgccacaauaa

SEQ ID NO: 57587 - RNA, 19 nt, Homo sapiens
caucauacacuuccuucuu

SEQ ID NO: 57588 - RNA, 19 nt, Homo sapiens
ucccagugcuugcaagauu

SEQ ID NO: 57589 - RNA, 19 nt, Homo sapiens
gcgggcagcaccagaauga

SEQ ID NO: 57590 - RNA, 19 nt, Homo sapiens
gcagguucuucgugaguuc

SEQ ID NO: 57591 - RNA, 19 nt, Homo sapiens
gacugggccugguacaaga

SEQ ID NO: 57592 - RNA, 19 nt, Homo sapiens
uugagaaccugaacaugga

SEQ ID NO: 57593 - RNA, 19 nt, Homo sapiens
aucauacacuuccuucuuu

SEQ ID NO: 57594 - RNA, 19 nt, Homo sapiens
gaagucgucagaacacauc

SEQ ID NO: 57595 - RNA, 19 nt, Homo sapiens
guaggaccggcgaggaaua

SEQ ID NO: 57596 - RNA, 19 nt, Homo sapiens
ucaccaucaucuucaucua

SEQ ID NO: 57597 - RNA, 19 nt, Homo sapiens
gccagguccuugcccuuug

SEQ ID NO: 57598 - RNA, 19 nt, Homo sapiens
cgucagaacacaucaacga

SEQ ID NO: 57599 - RNA, 19 nt, Homo sapiens
gagugaaggccgugaaguc

SEQ ID NO: 57600 - RNA, 19 nt, Homo sapiens
ugaaugacagcgccacaga

SEQ ID NO: 57601 - RNA, 19 nt, Homo sapiens
ccagguccuugcccuuugu

SEQ ID NO: 57602 - RNA, 19 nt, Homo sapiens
gcaagauuccaaguucuca

SEQ ID NO: 57603 - RNA, 19 nt, Homo sapiens
gggcagcaccagaaugaca

SEQ ID NO: 57604 - RNA, 19 nt, Homo sapiens
cccguagauucccaucaua

SEQ ID NO: 57605 - RNA, 19 nt, Homo sapiens
gagcagguucuucgugagu

SEQ ID NO: 57606 - RNA, 19 nt, Homo sapiens
gaccggcgaggaauaggaa

SEQ ID NO: 57607 - RNA, 19 nt, Homo sapiens
ucacugacugggccuggua

SEQ ID NO: 57608 - RNA, 19 nt, Homo sapiens
gcugucugguugcgccauu

SEQ ID NO: 57609 - RNA, 19 nt, Homo sapiens
gcgaggaauaggaaucaug

SEQ ID NO: 57610 - RNA, 19 nt, Homo sapiens
ggaccggcgaggaauagga

SEQ ID NO: 57611 - RNA, 19 nt, Homo sapiens
ucacugacucugaggacaa

SEQ ID NO: 57612 - RNA, 19 nt, Homo sapiens
ucaccugcuccuugaauga

SEQ ID NO: 57613 - RNA, 19 nt, Homo sapiens
ucagagcuacacauugaga

SEQ ID NO: 57614 - RNA, 19 nt, Homo sapiens
agaguacuccugcgucuuc

SEQ ID NO: 57615 - RNA, 19 nt, Homo sapiens
gcagcaccagaaugacaaa

SEQ ID NO: 57616 - RNA, 19 nt, Homo sapiens
acaagaucacugacucuga

SEQ ID NO: 57617 - RNA, 19 nt, Homo sapiens
cuccucaccugcuccuuga

SEQ ID NO: 57618 - RNA, 19 nt, Homo sapiens
guccuugcccuuuguggaa

SEQ ID NO: 57619 - RNA, 19 nt, Homo sapiens
gcgguuggagguuguagga

SEQ ID NO: 57620 - RNA, 19 nt, Homo sapiens
gccgugaagucgucagaac

SEQ ID NO: 57621 - RNA, 19 nt, Homo sapiens
gaaaacccaccccguagau

SEQ ID NO: 57622 - RNA, 19 nt, Homo sapiens
guacaagaucacugacucu

SEQ ID NO: 57623 - RNA, 19 nt, Homo sapiens
cggccaugcuggucugcaa

SEQ ID NO: 57624 - RNA, 19 nt, Homo sapiens
ggccacagaggacucacuu

SEQ ID NO: 57625 - RNA, 19 nt, Homo sapiens
ccugguacaagaucacuga

SEQ ID NO: 57626 - RNA, 19 nt, Homo sapiens
ugacugggccugguacaag

SEQ ID NO: 57627 - RNA, 19 nt, Homo sapiens
ucagacugcuuguauauua

SEQ ID NO: 57628 - RNA, 19 nt, Homo sapiens
ggaaaacgauguccugaaa

SEQ ID NO: 57629 - RNA, 19 nt, Homo sapiens
gaaguuaguucuauuuagc

SEQ ID NO: 57630 - RNA, 19 nt, Homo sapiens
gagcuggugucgacagaaa

SEQ ID NO: 57631 - RNA, 19 nt, Homo sapiens
gggcauccauccaguauuc

SEQ ID NO: 57632 - RNA, 19 nt, Homo sapiens
aggcauauguucaggauuu

SEQ ID NO: 57633 - RNA, 19 nt, Homo sapiens
gaaucgagaucuggguuau

SEQ ID NO: 57634 - RNA, 19 nt, Homo sapiens
guuaacagcuuugcagaca

SEQ ID NO: 57635 - RNA, 19 nt, Homo sapiens
ccugagcgauguucuguau

SEQ ID NO: 57636 - RNA, 19 nt, Homo sapiens
gaaacuguguugcucuaac

SEQ ID NO: 57637 - RNA, 19 nt, Homo sapiens
ucagaagacugugaaaaua

SEQ ID NO: 57638 - RNA, 19 nt, Homo sapiens
gcagacaacacccgucguu

SEQ ID NO: 57639 - RNA, 19 nt, Homo sapiens
gcagucaucauucguguuc

SEQ ID NO: 57640 - RNA, 19 nt, Homo sapiens
ccaaaugauucuguuaucu

SEQ ID NO: 57641 - RNA, 19 nt, Homo sapiens
gacaacacccgucguuuua

SEQ ID NO: 57642 - RNA, 19 nt, Homo sapiens
gcaugaaaguccuggaaaa

SEQ ID NO: 57643 - RNA, 19 nt, Homo sapiens
caucauucguguucugugu

SEQ ID NO: 57644 - RNA, 19 nt, Homo sapiens
uaacagcuuugcagacaac

SEQ ID NO: 57645 - RNA, 19 nt, Homo sapiens
aauagccaccuccuuguua

SEQ ID NO: 57646 - RNA, 19 nt, Homo sapiens
guauuucaaugaggcauau

SEQ ID NO: 57647 - RNA, 19 nt, Homo sapiens
cauccugacugugccuuaa

SEQ ID NO: 57648 - RNA, 19 nt, Homo sapiens
gaucuggguuaugcaugaa

SEQ ID NO: 57649 - RNA, 19 nt, Homo sapiens
uuccaaaccuccagaagga

SEQ ID NO: 57650 - RNA, 19 nt, Homo sapiens
gagccuaucccaucaaagg

SEQ ID NO: 57651 - RNA, 19 nt, Homo sapiens
uggaaacuguguugcucua

SEQ ID NO: 57652 - RNA, 19 nt, Homo sapiens
cagacugcuuguauauuau

SEQ ID NO: 57653 - RNA, 19 nt, Homo sapiens
gcagcagccgcuacucaaa

SEQ ID NO: 57654 - RNA, 19 nt, Homo sapiens
ccuaucccaucaaagguuu

SEQ ID NO: 57655 - RNA, 19 nt, Homo sapiens
ugagcgauguucuguaugg

SEQ ID NO: 57656 - RNA, 19 nt, Homo sapiens
gagauaagucccuguucug

SEQ ID NO: 57657 - RNA, 19 nt, Homo sapiens
ucaaugaggcauauguuca

SEQ ID NO: 57658 - RNA, 19 nt, Homo sapiens
ccaaaccuccagaaggaaa

SEQ ID NO: 57659 - RNA, 19 nt, Homo sapiens
aaaugacucuggacucgau

SEQ ID NO: 57660 - RNA, 19 nt, Homo sapiens
agagauaagucccuguucu

SEQ ID NO: 57661 - RNA, 19 nt, Homo sapiens
cgaaucgagaucuggguua

SEQ ID NO: 57662 - RNA, 19 nt, Homo sapiens
caucugggaagccuuuaaa

SEQ ID NO: 57663 - RNA, 19 nt, Homo sapiens
cagcacccauccugacugu

SEQ ID NO: 57664 - RNA, 19 nt, Homo sapiens
agaucuggguuaugcauga

SEQ ID NO: 57665 - RNA, 19 nt, Homo sapiens
uggcaggguugcagauuuc

SEQ ID NO: 57666 - RNA, 19 nt, Homo sapiens
auagccaccuccuuguuaa

SEQ ID NO: 57667 - RNA, 19 nt, Homo sapiens
ugaggcauauguucaggau

SEQ ID NO: 57668 - RNA, 19 nt, Homo sapiens
ggacuggagggaccaaagu

SEQ ID NO: 57669 - RNA, 19 nt, Homo sapiens
ggaaacuguguugcucuaa

SEQ ID NO: 57670 - RNA, 19 nt, Homo sapiens
aaaacgauguccugaaaau

SEQ ID NO: 57671 - RNA, 19 nt, Homo sapiens
acaggagccuaucccauca

SEQ ID NO: 57672 - RNA, 19 nt, Homo sapiens
ccgagcagcggaacaagaa

SEQ ID NO: 57673 - RNA, 19 nt, Homo sapiens
ggaaccgccuugguagaag

SEQ ID NO: 57674 - RNA, 19 nt, Homo sapiens
guaacuggaaacuguguug

SEQ ID NO: 57675 - RNA, 19 nt, Homo sapiens
caacacccgucguuuuaug

SEQ ID NO: 57676 - RNA, 19 nt, Homo sapiens
ccagagauaagucccuguu

SEQ ID NO: 57677 - RNA, 19 nt, Homo sapiens
gguauuucaaugaggcaua

SEQ ID NO: 57678 - RNA, 19 nt, Homo sapiens
ucauucguguucuguguau

SEQ ID NO: 57679 - RNA, 19 nt, Homo sapiens
aaguggcgcuggacaagga

SEQ ID NO: 57680 - RNA, 19 nt, Homo sapiens
acucaacuguaacuggaaa

SEQ ID NO: 57681 - RNA, 19 nt, Homo sapiens
cugggaagccuuuaaagug

SEQ ID NO: 57682 - RNA, 19 nt, Homo sapiens
caaagcauugggagucaga

SEQ ID NO: 57683 - RNA, 19 nt, Homo sapiens
cacaaagcauugggaguca

SEQ ID NO: 57684 - RNA, 19 nt, Homo sapiens
ucagaaacaagaaguuagu

SEQ ID NO: 57685 - RNA, 19 nt, Homo sapiens
aacuguaacuggaaacugu

SEQ ID NO: 57686 - RNA, 19 nt, Homo sapiens
ccagugaagcucuuacagu

SEQ ID NO: 57687 - RNA, 19 nt, Homo sapiens
cguguucuguguauaccaa

SEQ ID NO: 57688 - RNA, 19 nt, Homo sapiens
aaaagaggcugaaggacau

SEQ ID NO: 57689 - RNA, 19 nt, Homo sapiens
cagcaugaaaguccuggaa

SEQ ID NO: 57690 - RNA, 19 nt, Homo sapiens
gggaaggcagcaugaaagu

SEQ ID NO: 57691 - RNA, 19 nt, Homo sapiens
cagaagacugugaaaauaa

SEQ ID NO: 57692 - RNA, 19 nt, Homo sapiens
gugcugcccucagacuaug

SEQ ID NO: 57693 - RNA, 19 nt, Homo sapiens
ccaagucuuuauacagaac

SEQ ID NO: 57694 - RNA, 19 nt, Homo sapiens
aaagggcauccauccagua

SEQ ID NO: 57695 - RNA, 19 nt, Homo sapiens
cuacaucagaagacuguga

SEQ ID NO: 57696 - RNA, 19 nt, Homo sapiens
uucccggacucaacuguaa

SEQ ID NO: 57697 - RNA, 19 nt, Homo sapiens
uuacacgaaucgagaucug

SEQ ID NO: 57698 - RNA, 19 nt, Homo sapiens
uaccaauccugcccuacau

SEQ ID NO: 57699 - RNA, 19 nt, Homo sapiens
caggguugcagauuucuug

SEQ ID NO: 57700 - RNA, 19 nt, Homo sapiens
gaaaacgauguccugaaaa

SEQ ID NO: 57701 - RNA, 19 nt, Homo sapiens
ucuguuaucuaaagaagcu

SEQ ID NO: 57702 - RNA, 19 nt, Homo sapiens
aaauagccaccuccuuguu

SEQ ID NO: 57703 - RNA, 19 nt, Homo sapiens
cagcuucugcuucuacugu

SEQ ID NO: 57704 - RNA, 19 nt, Homo sapiens
cagccgcuacucaaagaaa

SEQ ID NO: 57705 - RNA, 19 nt, Homo sapiens
aaugauuaccgaccaguga

SEQ ID NO: 57706 - RNA, 19 nt, Homo sapiens
cggaaccgccuugguagaa

SEQ ID NO: 57707 - RNA, 19 nt, Homo sapiens
gcccucagacuaugaccuu

SEQ ID NO: 57708 - RNA, 19 nt, Homo sapiens
gcuucugcuucuacuguug

SEQ ID NO: 57709 - RNA, 19 nt, Homo sapiens
ccaauccugcccuacauca

SEQ ID NO: 57710 - RNA, 19 nt, Homo sapiens
uaaaguggcgcuggacaag

SEQ ID NO: 57711 - RNA, 19 nt, Homo sapiens
agaaacaagaaguuaguuc

SEQ ID NO: 57712 - RNA, 19 nt, Homo sapiens
cccaagucuuuauacagaa

SEQ ID NO: 57713 - RNA, 19 nt, Homo sapiens
ggcagcagccgcuacucaa

SEQ ID NO: 57714 - RNA, 19 nt, Homo sapiens
aggagccuaucccaucaaa

SEQ ID NO: 57715 - RNA, 19 nt, Homo sapiens
accaaaugauucuguuauc

SEQ ID NO: 57716 - RNA, 19 nt, Homo sapiens
ccccaagucuuuauacaga

SEQ ID NO: 57717 - RNA, 19 nt, Homo sapiens
acucuggacucgauuacca

SEQ ID NO: 57718 - RNA, 19 nt, Homo sapiens
ggagagaucacuacauuaa

SEQ ID NO: 57719 - RNA, 19 nt, Homo sapiens
gaacauucccuugaucuca

SEQ ID NO: 57720 - RNA, 19 nt, Homo sapiens
gcagagugcccauggaaga

SEQ ID NO: 57721 - RNA, 19 nt, Homo sapiens
agggagagaucacuacauu

SEQ ID NO: 57722 - RNA, 19 nt, Homo sapiens
ccuaauggcuucccuggau

SEQ ID NO: 57723 - RNA, 19 nt, Homo sapiens
gaaucgcggacaagaagua

SEQ ID NO: 57724 - RNA, 19 nt, Homo sapiens
gagaaucgcggacaagaag

SEQ ID NO: 57725 - RNA, 19 nt, Homo sapiens
gagagaucacuacauuaaa

SEQ ID NO: 57726 - RNA, 19 nt, Homo sapiens
aauaaacacuuccuuugag

SEQ ID NO: 57727 - RNA, 19 nt, Homo sapiens
gaagcuggcacaucuugga

SEQ ID NO: 57728 - RNA, 19 nt, Homo sapiens
agagaucacuacauuaaac

SEQ ID NO: 57729 - RNA, 19 nt, Homo sapiens
gggagagaucacuacauua

SEQ ID NO: 57730 - RNA, 19 nt, Homo sapiens
gagaaggcccaaggacaaa

SEQ ID NO: 57731 - RNA, 19 nt, Homo sapiens
gagcgacugagaagagaaa

SEQ ID NO: 57732 - RNA, 19 nt, Homo sapiens
gaauucauggcaucuacuu

SEQ ID NO: 57733 - RNA, 19 nt, Homo sapiens
cauggcaucuacuucguau

SEQ ID NO: 57734 - RNA, 19 nt, Homo sapiens
ucacccaucuccugcaaca

SEQ ID NO: 57735 - RNA, 19 nt, Homo sapiens
gugauggagugucgcaaug

SEQ ID NO: 57736 - RNA, 19 nt, Homo sapiens
gaagggcuuucaggaugug

SEQ ID NO: 57737 - RNA, 19 nt, Homo sapiens
gcuugaacauucccuugau

SEQ ID NO: 57738 - RNA, 19 nt, Homo sapiens
uggcaucuacuucguauga

SEQ ID NO: 57739 - RNA, 19 nt, Homo sapiens
cuacuucguaugacuauug

SEQ ID NO: 57740 - RNA, 19 nt, Homo sapiens
gauggagugucgcaauguc

SEQ ID NO: 57741 - RNA, 19 nt, Homo sapiens
gagccucccuccggacaau

SEQ ID NO: 57742 - RNA, 19 nt, Homo sapiens
agagaaggcccaaggacaa

SEQ ID NO: 57743 - RNA, 19 nt, Homo sapiens
gcagagguggagcgacuga

SEQ ID NO: 57744 - RNA, 19 nt, Homo sapiens
ccagaagggcuuucaggau

SEQ ID NO: 57745 - RNA, 19 nt, Homo sapiens
agaagggcuuucaggaugu

SEQ ID NO: 57746 - RNA, 19 nt, Homo sapiens
gaauucuggugcuccugau

SEQ ID NO: 57747 - RNA, 19 nt, Homo sapiens
cauuaaaccauaagcuuca

SEQ ID NO: 57748 - RNA, 19 nt, Homo sapiens
caugugcugccuguuguua

SEQ ID NO: 57749 - RNA, 19 nt, Homo sapiens
gagguggagcgacugagaa

SEQ ID NO: 57750 - RNA, 19 nt, Homo sapiens
acacugugauggcccuaau

SEQ ID NO: 57751 - RNA, 19 nt, Homo sapiens
gcuuuucgcuugaacauuc

SEQ ID NO: 57752 - RNA, 19 nt, Homo sapiens
gcaucuacuucguaugacu

SEQ ID NO: 57753 - RNA, 19 nt, Homo sapiens
caucuacuucguaugacua

SEQ ID NO: 57754 - RNA, 19 nt, Homo sapiens
gaaaguggaggagcuugag

SEQ ID NO: 57755 - RNA, 19 nt, Homo sapiens
ugagaaucgcggacaagaa

SEQ ID NO: 57756 - RNA, 19 nt, Homo sapiens
gagaaaaccaggucuuaag

SEQ ID NO: 57757 - RNA, 19 nt, Homo sapiens
ugugcugccuguuguuaug

SEQ ID NO: 57758 - RNA, 19 nt, Homo sapiens
ucgcggacaagaaguacua

SEQ ID NO: 57759 - RNA, 19 nt, Homo sapiens
gcgugagaaucgcggacaa

SEQ ID NO: 57760 - RNA, 19 nt, Homo sapiens
ggucuuaagcgugagaauc

SEQ ID NO: 57761 - RNA, 19 nt, Homo sapiens
gaucacuacauuaaaccau

SEQ ID NO: 57762 - RNA, 19 nt, Homo sapiens
agaaaguggaggagcuuga

SEQ ID NO: 57763 - RNA, 19 nt, Homo sapiens
gugagaaucgcggacaaga

SEQ ID NO: 57764 - RNA, 19 nt, Homo sapiens
gggauaagcgcuguaagcu

SEQ ID NO: 57765 - RNA, 19 nt, Homo sapiens
ugucacccaucuccugcaa

SEQ ID NO: 57766 - RNA, 19 nt, Homo sapiens
gaaaggagguuaggucuua

SEQ ID NO: 57767 - RNA, 19 nt, Homo sapiens
caaagugccuugcucauuu

SEQ ID NO: 57768 - RNA, 19 nt, Homo sapiens
gaagaaagaagaagaaaug

SEQ ID NO: 57769 - RNA, 19 nt, Homo sapiens
gaaagaagaagaaauggaa

SEQ ID NO: 57770 - RNA, 19 nt, Homo sapiens
ugagagaguugacuuguuu

SEQ ID NO: 57771 - RNA, 19 nt, Homo sapiens
gaagggaaauuucaauaac

SEQ ID NO: 57772 - RNA, 19 nt, Homo sapiens
gaaagaagaaagaagaaga

SEQ ID NO: 57773 - RNA, 19 nt, Homo sapiens
gagguuaggucuuaggaau

SEQ ID NO: 57774 - RNA, 19 nt, Homo sapiens
gaaacucuggguaaagaua

SEQ ID NO: 57775 - RNA, 19 nt, Homo sapiens
ccagaaguccugaaacuaa

SEQ ID NO: 57776 - RNA, 19 nt, Homo sapiens
gaagaaggagggagacuug

SEQ ID NO: 57777 - RNA, 19 nt, Homo sapiens
gaaguaguuucguuuccuu

SEQ ID NO: 57778 - RNA, 19 nt, Homo sapiens
caacagaagggaaauuuca

SEQ ID NO: 57779 - RNA, 19 nt, Homo sapiens
cagaaugugucucaggaaa

SEQ ID NO: 57780 - RNA, 19 nt, Homo sapiens
uaacuccuaucaaugaaga

SEQ ID NO: 57781 - RNA, 19 nt, Homo sapiens
gguuaggucuuaggaauug

SEQ ID NO: 57782 - RNA, 19 nt, Homo sapiens
ggaaaggccacuucucuag

SEQ ID NO: 57783 - RNA, 19 nt, Homo sapiens
gaugggaauuccaccagaa

SEQ ID NO: 57784 - RNA, 19 nt, Homo sapiens
uaucaagcauuuaccaugu

SEQ ID NO: 57785 - RNA, 19 nt, Homo sapiens
gaagagacaaauauugcuu

SEQ ID NO: 57786 - RNA, 19 nt, Homo sapiens
cagaagggaaauuucaaua

SEQ ID NO: 57787 - RNA, 19 nt, Homo sapiens
ucaccaggauuacuaguca

SEQ ID NO: 57788 - RNA, 19 nt, Homo sapiens
gugccuugcucauuugaaa

SEQ ID NO: 57789 - RNA, 19 nt, Homo sapiens
ggagacagaggacagauuc

SEQ ID NO: 57790 - RNA, 19 nt, Homo sapiens
aaaagcaacugguuaggua

SEQ ID NO: 57791 - RNA, 19 nt, Homo sapiens
gauagcaguuaugguaguu

SEQ ID NO: 57792 - RNA, 19 nt, Homo sapiens
ccaagcaauacaagcauua

SEQ ID NO: 57793 - RNA, 19 nt, Homo sapiens
aagaagaaauggaaacucu

SEQ ID NO: 57794 - RNA, 19 nt, Homo sapiens
cagaaguccugaaacuaau

SEQ ID NO: 57795 - RNA, 19 nt, Homo sapiens
cauuuaccaugugcuaaua

SEQ ID NO: 57796 - RNA, 19 nt, Homo sapiens
uggaaacucuggguaaaga

SEQ ID NO: 57797 - RNA, 19 nt, Homo sapiens
gugagagaguugacuuguu

SEQ ID NO: 57798 - RNA, 19 nt, Homo sapiens
caauaaccuuucacuuaag

SEQ ID NO: 57799 - RNA, 19 nt, Homo sapiens
aaagugccuugcucauuug

SEQ ID NO: 57800 - RNA, 19 nt, Homo sapiens
ggauuacuagucaaacaaa

SEQ ID NO: 57801 - RNA, 19 nt, Homo sapiens
uuugauagcaguuauggua

SEQ ID NO: 57802 - RNA, 19 nt, Homo sapiens
gaggaaaacugugcagcua

SEQ ID NO: 57803 - RNA, 19 nt, Homo sapiens
uccaugagauagcuauuau

SEQ ID NO: 57804 - RNA, 19 nt, Homo sapiens
gcauuuaccaugugcuaau

SEQ ID NO: 57805 - RNA, 19 nt, Homo sapiens
caccagaaguccugaaacu

SEQ ID NO: 57806 - RNA, 19 nt, Homo sapiens
gaaaauggacagaaugugu

SEQ ID NO: 57807 - RNA, 19 nt, Homo sapiens
ucuggugauuuguuugaua

SEQ ID NO: 57808 - RNA, 19 nt, Homo sapiens
caggauuacuagucaaaca

SEQ ID NO: 57809 - RNA, 19 nt, Homo sapiens
gcagcuaccaccacacaau

SEQ ID NO: 57810 - RNA, 19 nt, Homo sapiens
aguauugucaccaggauua

SEQ ID NO: 57811 - RNA, 19 nt, Homo sapiens
caacaacagaagggaaauu

SEQ ID NO: 57812 - RNA, 19 nt, Homo sapiens
aauggaaacucuggguaaa

SEQ ID NO: 57813 - RNA, 19 nt, Homo sapiens
aaauggaaacucuggguaa

SEQ ID NO: 57814 - RNA, 19 nt, Homo sapiens
gguaaagauauaacuccua

SEQ ID NO: 57815 - RNA, 19 nt, Homo sapiens
ggaaacgucguaaaagaaa

SEQ ID NO: 57816 - RNA, 19 nt, Homo sapiens
aagcauuacugcaucaaag

SEQ ID NO: 57817 - RNA, 19 nt, Homo sapiens
accaugugcuaauaaguuu

SEQ ID NO: 57818 - RNA, 19 nt, Homo sapiens
gcggaaaggccacuucucu

SEQ ID NO: 57819 - RNA, 19 nt, Homo sapiens
agauucuggugauuuguuu

SEQ ID NO: 57820 - RNA, 19 nt, Homo sapiens
aaaggccacuucucuaggu

SEQ ID NO: 57821 - RNA, 19 nt, Homo sapiens
uaccaugugcuaauaaguu

SEQ ID NO: 57822 - RNA, 19 nt, Homo sapiens
uaaguauugucaccaggau

SEQ ID NO: 57823 - RNA, 19 nt, Homo sapiens
gguguuucccugccuugua

SEQ ID NO: 57824 - RNA, 19 nt, Homo sapiens
aaacagcuaguagacauga

SEQ ID NO: 57825 - RNA, 19 nt, Homo sapiens
gaagauauugaagagacaa

SEQ ID NO: 57826 - RNA, 19 nt, Homo sapiens
gcaacugguuagguagcaa

SEQ ID NO: 57827 - RNA, 19 nt, Homo sapiens
cggaaaggccacuucucua

SEQ ID NO: 57828 - RNA, 19 nt, Homo sapiens
accuuucacuuaaguauug

SEQ ID NO: 57829 - RNA, 19 nt, Homo sapiens
ccugggaaguaguuucguu

SEQ ID NO: 57830 - RNA, 19 nt, Homo sapiens
uuagguagcaacaacagaa

SEQ ID NO: 57831 - RNA, 19 nt, Homo sapiens
ugaagauauugaagagaca

SEQ ID NO: 57832 - RNA, 19 nt, Homo sapiens
guguuucccugccuuguag

SEQ ID NO: 57833 - RNA, 19 nt, Homo sapiens
gaagaagaaauggaaacuc

SEQ ID NO: 57834 - RNA, 19 nt, Homo sapiens
guaguuucguuuccuucug

SEQ ID NO: 57835 - RNA, 19 nt, Homo sapiens
gagcaaggugugagagagu

SEQ ID NO: 57836 - RNA, 19 nt, Homo sapiens
cccaagcaauacaagcauu

SEQ ID NO: 57837 - RNA, 19 nt, Homo sapiens
ugauagcaguuaugguagu

SEQ ID NO: 57838 - RNA, 19 nt, Homo sapiens
ugaugaaggcuacauugga

SEQ ID NO: 57839 - RNA, 19 nt, Homo sapiens
caagcauuacugcaucaaa

SEQ ID NO: 57840 - RNA, 19 nt, Homo sapiens
ccaaguccugcgccucuuu

SEQ ID NO: 57841 - RNA, 19 nt, Homo sapiens
ccaugagauagcuauuaua

SEQ ID NO: 57842 - RNA, 19 nt, Homo sapiens
caugugcuaauaaguuuga

SEQ ID NO: 57843 - RNA, 19 nt, Homo sapiens
aacaacagaagggaaauuu

SEQ ID NO: 57844 - RNA, 19 nt, Homo sapiens
agaaagaagaagaaaugga

SEQ ID NO: 57845 - RNA, 19 nt, Homo sapiens
ugacuuguuuuaccuaaga

SEQ ID NO: 57846 - RNA, 19 nt, Homo sapiens
gcaaggugugagagaguug

SEQ ID NO: 57847 - RNA, 19 nt, Homo sapiens
aaagcuaccauuuaucaag

SEQ ID NO: 57848 - RNA, 19 nt, Homo sapiens
ggagguuaggucuuaggaa

SEQ ID NO: 57849 - RNA, 19 nt, Homo sapiens
ccuucugccuccgggauua

SEQ ID NO: 57850 - RNA, 19 nt, Homo sapiens
ggugauuuguuugauagca

SEQ ID NO: 57851 - RNA, 19 nt, Homo sapiens
uuucagcaauccaugagau

SEQ ID NO: 57852 - RNA, 19 nt, Homo sapiens
cgaagaaggagggagacuu

SEQ ID NO: 57853 - RNA, 19 nt, Homo sapiens
aaacucuggguaaagauau

SEQ ID NO: 57854 - RNA, 19 nt, Homo sapiens
cuggugauuuguuugauag

SEQ ID NO: 57855 - RNA, 19 nt, Homo sapiens
uacaagcauuacugcauca

SEQ ID NO: 57856 - RNA, 19 nt, Homo sapiens
gaaguccugaaacuaaugg

SEQ ID NO: 57857 - RNA, 19 nt, Homo sapiens
gcaauccaugagauagcua

SEQ ID NO: 57858 - RNA, 19 nt, Homo sapiens
gggaauuccaccagaaguc

SEQ ID NO: 57859 - RNA, 19 nt, Homo sapiens
cagcuaguagacaugaauu

SEQ ID NO: 57860 - RNA, 19 nt, Homo sapiens
ucggaaacgucguaaaaga

SEQ ID NO: 57861 - RNA, 19 nt, Homo sapiens
caaguccugcgccucuuug

SEQ ID NO: 57862 - RNA, 19 nt, Homo sapiens
gcuaguagacaugaauuuu

SEQ ID NO: 57863 - RNA, 19 nt, Homo sapiens
gguggcaagcugcaaagug

SEQ ID NO: 57864 - RNA, 19 nt, Homo sapiens
cuuaaaaggcuaugaaguu

SEQ ID NO: 57865 - RNA, 19 nt, Homo sapiens
ggaaacucuggguaaagau

SEQ ID NO: 57866 - RNA, 19 nt, Homo sapiens
gaacauccauuuauccauu

SEQ ID NO: 57867 - RNA, 19 nt, Homo sapiens
uaacaaaucucucaguaug

SEQ ID NO: 57868 - RNA, 19 nt, Homo sapiens
gaaguaagcuugcucuuuu

SEQ ID NO: 57869 - RNA, 19 nt, Homo sapiens
ggauucaacuuuacaagaa

SEQ ID NO: 57870 - RNA, 19 nt, Homo sapiens
ucacgaggcugaauauuau

SEQ ID NO: 57871 - RNA, 19 nt, Homo sapiens
ccaauggccucugcuguua

SEQ ID NO: 57872 - RNA, 19 nt, Homo sapiens
gaugauguaugacaauuuc

SEQ ID NO: 57873 - RNA, 19 nt, Homo sapiens
gaaacggacccaucccaua

SEQ ID NO: 57874 - RNA, 19 nt, Homo sapiens
acucugagaugauguauga

SEQ ID NO: 57875 - RNA, 19 nt, Homo sapiens
gauaccaguucaacacaaa

SEQ ID NO: 57876 - RNA, 19 nt, Homo sapiens
gaagauggcauucauggau

SEQ ID NO: 57877 - RNA, 19 nt, Homo sapiens
gagaugauguaugacaauu

SEQ ID NO: 57878 - RNA, 19 nt, Homo sapiens
ucuaacaaaucucucagua

SEQ ID NO: 57879 - RNA, 19 nt, Homo sapiens
ggaccaucuuucugccuua

SEQ ID NO: 57880 - RNA, 19 nt, Homo sapiens
gggagaaugaccacuauuu

SEQ ID NO: 57881 - RNA, 19 nt, Homo sapiens
caacuucaguacuuccuau

SEQ ID NO: 57882 - RNA, 19 nt, Homo sapiens
aaacacaaccucuacuuug

SEQ ID NO: 57883 - RNA, 19 nt, Homo sapiens
ugacaucuaugaacagcaa

SEQ ID NO: 57884 - RNA, 19 nt, Homo sapiens
gaaggaugcucaggaaguc

SEQ ID NO: 57885 - RNA, 19 nt, Homo sapiens
ccaaaaggauguacagauu

SEQ ID NO: 57886 - RNA, 19 nt, Homo sapiens
caauugagauucagaaagc

SEQ ID NO: 57887 - RNA, 19 nt, Homo sapiens
gaugggagauaccaguuca

SEQ ID NO: 57888 - RNA, 19 nt, Homo sapiens
acaagaacauccauuuauc

SEQ ID NO: 57889 - RNA, 19 nt, Homo sapiens
ccagaaccuugacaucuau

SEQ ID NO: 57890 - RNA, 19 nt, Homo sapiens
cgauuggucucaagcuaaa

SEQ ID NO: 57891 - RNA, 19 nt, Homo sapiens
uaugggcgcuuguaugaga

SEQ ID NO: 57892 - RNA, 19 nt, Homo sapiens
ggagaaugaccacuauuuc

SEQ ID NO: 57893 - RNA, 19 nt, Homo sapiens
uaaacacaaccucuacuuu

SEQ ID NO: 57894 - RNA, 19 nt, Homo sapiens
cacaugcuuugauauauug

SEQ ID NO: 57895 - RNA, 19 nt, Homo sapiens
caaaugucguguucagcaa

SEQ ID NO: 57896 - RNA, 19 nt, Homo sapiens
guacauggcacuuacuaca

SEQ ID NO: 57897 - RNA, 19 nt, Homo sapiens
ucagaaagcuuuugcuguu

SEQ ID NO: 57898 - RNA, 19 nt, Homo sapiens
aacacaaccucuacuuuga

SEQ ID NO: 57899 - RNA, 19 nt, Homo sapiens
gaccaucuuucugccuuaa

SEQ ID NO: 57900 - RNA, 19 nt, Homo sapiens
aaagucaccuuauaauugc

SEQ ID NO: 57901 - RNA, 19 nt, Homo sapiens
ucaacguucuggcagcuaa

SEQ ID NO: 57902 - RNA, 19 nt, Homo sapiens
guaaacacaaccucuacuu

SEQ ID NO: 57903 - RNA, 19 nt, Homo sapiens
ccucaccgcuucaaugaca

SEQ ID NO: 57904 - RNA, 19 nt, Homo sapiens
agaagucccugaccagcuu

SEQ ID NO: 57905 - RNA, 19 nt, Homo sapiens
gauuauaguguuuccagaa

SEQ ID NO: 57906 - RNA, 19 nt, Homo sapiens
caagccacaucuuccucua

SEQ ID NO: 57907 - RNA, 19 nt, Homo sapiens
ccucaaucaucgagacauu

SEQ ID NO: 57908 - RNA, 19 nt, Homo sapiens
cuuccuauaucuuuccuuu

SEQ ID NO: 57909 - RNA, 19 nt, Homo sapiens
ccucugcuguuauuuacuu

SEQ ID NO: 57910 - RNA, 19 nt, Homo sapiens
gaugacaggaaguggcaua

SEQ ID NO: 57911 - RNA, 19 nt, Homo sapiens
ggugaagcauguuguguac

SEQ ID NO: 57912 - RNA, 19 nt, Homo sapiens
gaaccuugacaucuaugaa

SEQ ID NO: 57913 - RNA, 19 nt, Homo sapiens
gaaccagaaccuugacauc

SEQ ID NO: 57914 - RNA, 19 nt, Homo sapiens
uuauguggcugccguguau

SEQ ID NO: 57915 - RNA, 19 nt, Homo sapiens
gcgauuggucucaagcuaa

SEQ ID NO: 57916 - RNA, 19 nt, Homo sapiens
ggcaggagcccacuucugu

SEQ ID NO: 57917 - RNA, 19 nt, Homo sapiens
gaaccagcucccacucuug

SEQ ID NO: 57918 - RNA, 19 nt, Homo sapiens
ugaaccagcucccacucuu

SEQ ID NO: 57919 - RNA, 19 nt, Homo sapiens
accagaaccuugacaucua

SEQ ID NO: 57920 - RNA, 19 nt, Homo sapiens
gagcguggcugaccaucac

SEQ ID NO: 57921 - RNA, 19 nt, Homo sapiens
cuucacaugcuuugauaua

SEQ ID NO: 57922 - RNA, 19 nt, Homo sapiens
cauucgauguuccucuuaa

SEQ ID NO: 57923 - RNA, 19 nt, Homo sapiens
uggcagcaauugagauuca

SEQ ID NO: 57924 - RNA, 19 nt, Homo sapiens
cgauguuccucuuaaagug

SEQ ID NO: 57925 - RNA, 19 nt, Homo sapiens
ggagauaccaguucaacac

SEQ ID NO: 57926 - RNA, 19 nt, Homo sapiens
ccacaucuuccucuaacaa

SEQ ID NO: 57927 - RNA, 19 nt, Homo sapiens
ccucagugucuuccucuua

SEQ ID NO: 57928 - RNA, 19 nt, Homo sapiens
gcuguuauuuacuuuacga

SEQ ID NO: 57929 - RNA, 19 nt, Homo sapiens
gcaauugagauucagaaag

SEQ ID NO: 57930 - RNA, 19 nt, Homo sapiens
agaaguaagcuugcucuuu

SEQ ID NO: 57931 - RNA, 19 nt, Homo sapiens
aagauggcauucauggauu

SEQ ID NO: 57932 - RNA, 19 nt, Homo sapiens
caaaaggauguacagauua

SEQ ID NO: 57933 - RNA, 19 nt, Homo sapiens
cucagugucuuccucuuaa

SEQ ID NO: 57934 - RNA, 19 nt, Homo sapiens
ucuaugggcgcuuguauga

SEQ ID NO: 57935 - RNA, 19 nt, Homo sapiens
aaugucguguucagcaaua

SEQ ID NO: 57936 - RNA, 19 nt, Homo sapiens
gguauuuucuguucacauu

SEQ ID NO: 57937 - RNA, 19 nt, Homo sapiens
gcugggagaaugaccacua

SEQ ID NO: 57938 - RNA, 19 nt, Homo sapiens
uccuauaucuuuccuuugu

SEQ ID NO: 57939 - RNA, 19 nt, Homo sapiens
aaacggacccaucccauag

SEQ ID NO: 57940 - RNA, 19 nt, Homo sapiens
gagaaugcaacaggugaaa

SEQ ID NO: 57941 - RNA, 19 nt, Homo sapiens
gcaauaauggaacccuugu

SEQ ID NO: 57942 - RNA, 19 nt, Homo sapiens
gagccucaccgcuucaaug

SEQ ID NO: 57943 - RNA, 19 nt, Homo sapiens
gcagauucccucagugucu

SEQ ID NO: 57944 - RNA, 19 nt, Homo sapiens
acauuucacucugagauga

SEQ ID NO: 57945 - RNA, 19 nt, Homo sapiens
gugaugaggccaccaagug

SEQ ID NO: 57946 - RNA, 19 nt, Homo sapiens
ggacucuggccaucauguu

SEQ ID NO: 57947 - RNA, 19 nt, Homo sapiens
acacaguacauggcacuua

SEQ ID NO: 57948 - RNA, 19 nt, Homo sapiens
gguuuggcaucuucacaug

SEQ ID NO: 57949 - RNA, 19 nt, Homo sapiens
aauaauggaacccuuguug

SEQ ID NO: 57950 - RNA, 19 nt, Homo sapiens
uauaguguuuccagaagau

SEQ ID NO: 57951 - RNA, 19 nt, Homo sapiens
gauuuguggucugcauuau

SEQ ID NO: 57952 - RNA, 19 nt, Homo sapiens
aauggccucugcuguuauu

SEQ ID NO: 57953 - RNA, 19 nt, Homo sapiens
gacaggaaguggcauacac

SEQ ID NO: 57954 - RNA, 19 nt, Homo sapiens
acuacaaggugaagcaugu

SEQ ID NO: 57955 - RNA, 19 nt, Homo sapiens
gcauucgauguuccucuua

SEQ ID NO: 57956 - RNA, 19 nt, Homo sapiens
ugaugggcuucacacagua

SEQ ID NO: 57957 - RNA, 19 nt, Homo sapiens
ggacccaucccauaguaag

SEQ ID NO: 57958 - RNA, 19 nt, Homo sapiens
ucagugucuuccucuuaaa

SEQ ID NO: 57959 - RNA, 19 nt, Homo sapiens
ggaaaaguguguggucugu

SEQ ID NO: 57960 - RNA, 19 nt, Homo sapiens
cuucaguacuuccuauauc

SEQ ID NO: 57961 - RNA, 19 nt, Homo sapiens
acauggcacuuacuacauc

SEQ ID NO: 57962 - RNA, 19 nt, Homo sapiens
ggaaguccacugugaugag

SEQ ID NO: 57963 - RNA, 19 nt, Homo sapiens
cucaggaaguccacuguga

SEQ ID NO: 57964 - RNA, 19 nt, Homo sapiens
caggcgauccguacuguga

SEQ ID NO: 57965 - RNA, 19 nt, Homo sapiens
ccuuggagcucaugaacca

SEQ ID NO: 57966 - RNA, 19 nt, Homo sapiens
gcacuuagauggauauaaa

SEQ ID NO: 57967 - RNA, 19 nt, Homo sapiens
ggacaucuguucuuccaua

SEQ ID NO: 57968 - RNA, 19 nt, Homo sapiens
ggaaccagcauucuaauua

SEQ ID NO: 57969 - RNA, 19 nt, Homo sapiens
guaaguaguugucauauuc

SEQ ID NO: 57970 - RNA, 19 nt, Homo sapiens
acaaagauguguccaguuu

SEQ ID NO: 57971 - RNA, 19 nt, Homo sapiens
ucacugagcucauggaaug

SEQ ID NO: 57972 - RNA, 19 nt, Homo sapiens
ggaaagaugugucccaaag

SEQ ID NO: 57973 - RNA, 19 nt, Homo sapiens
ucaauagccucaccacuaa

SEQ ID NO: 57974 - RNA, 19 nt, Homo sapiens
aaagggagcugaaauagga

SEQ ID NO: 57975 - RNA, 19 nt, Homo sapiens
gaccauggauuuaacuuau

SEQ ID NO: 57976 - RNA, 19 nt, Homo sapiens
caacguaguguuauuagua

SEQ ID NO: 57977 - RNA, 19 nt, Homo sapiens
cguauaaacucaagccuuu

SEQ ID NO: 57978 - RNA, 19 nt, Homo sapiens
gaaccagcauucuaauuag

SEQ ID NO: 57979 - RNA, 19 nt, Homo sapiens
aaacuuaacuguggccuuu

SEQ ID NO: 57980 - RNA, 19 nt, Homo sapiens
gaaaucacaucacuguauc

SEQ ID NO: 57981 - RNA, 19 nt, Homo sapiens
gagcgcaacugacuaggaa

SEQ ID NO: 57982 - RNA, 19 nt, Homo sapiens
agaaagcccuucaccauug

SEQ ID NO: 57983 - RNA, 19 nt, Homo sapiens
guaaugagaucuggaaaca

SEQ ID NO: 57984 - RNA, 19 nt, Homo sapiens
uagcacagcugucuuuaug

SEQ ID NO: 57985 - RNA, 19 nt, Homo sapiens
ggaagucacugcucuuugg

SEQ ID NO: 57986 - RNA, 19 nt, Homo sapiens
gaaaguaaacagaguugaa

SEQ ID NO: 57987 - RNA, 19 nt, Homo sapiens
gaaguucucuuuugccaua

SEQ ID NO: 57988 - RNA, 19 nt, Homo sapiens
cuacagcucuucgcguuua

SEQ ID NO: 57989 - RNA, 19 nt, Homo sapiens
ggaaugaugcccuggcuuu

SEQ ID NO: 57990 - RNA, 19 nt, Homo sapiens
gaaguaacgcuuucugaug

SEQ ID NO: 57991 - RNA, 19 nt, Homo sapiens
uaucuccucucuuugguua

SEQ ID NO: 57992 - RNA, 19 nt, Homo sapiens
caaagucagugaaagacaa

SEQ ID NO: 57993 - RNA, 19 nt, Homo sapiens
gaaaagaaccaacagaauu

SEQ ID NO: 57994 - RNA, 19 nt, Homo sapiens
gcacagcugucuuuaugca

SEQ ID NO: 57995 - RNA, 19 nt, Homo sapiens
gugcaagaguuauguagaa

SEQ ID NO: 57996 - RNA, 19 nt, Homo sapiens
aaaccacucucuugaauca

SEQ ID NO: 57997 - RNA, 19 nt, Homo sapiens
gcacucuaguuuauacuug

SEQ ID NO: 57998 - RNA, 19 nt, Homo sapiens
ccauuuaccugaaaacuua

SEQ ID NO: 57999 - RNA, 19 nt, Homo sapiens
gcaccucucuugcaguuuc

SEQ ID NO: 58000 - RNA, 19 nt, Homo sapiens
ggaaugguucugcuuauga

SEQ ID NO: 58001 - RNA, 19 nt, Homo sapiens
caacauggaauacuacgaa

SEQ ID NO: 58002 - RNA, 19 nt, Homo sapiens
gaaaucaugcgcagagaug

SEQ ID NO: 58003 - RNA, 19 nt, Homo sapiens
gaacauaagcugcacuuuu

SEQ ID NO: 58004 - RNA, 19 nt, Homo sapiens
caagauaugguucaaauag

SEQ ID NO: 58005 - RNA, 19 nt, Homo sapiens
caagaguuauguagaagga

SEQ ID NO: 58006 - RNA, 19 nt, Homo sapiens
ggauauaaaugcagcaacu

SEQ ID NO: 58007 - RNA, 19 nt, Homo sapiens
gauucacacugcauuuauu

SEQ ID NO: 58008 - RNA, 19 nt, Homo sapiens
gaucuggaaacaccuauuu

SEQ ID NO: 58009 - RNA, 19 nt, Homo sapiens
aaguaacgcuuucugauga

SEQ ID NO: 58010 - RNA, 19 nt, Homo sapiens
ggaauacuacgaaugaaau

SEQ ID NO: 58011 - RNA, 19 nt, Homo sapiens
gaaagcccuucaccauugu

SEQ ID NO: 58012 - RNA, 19 nt, Homo sapiens
gaaagaaagcaaagcaaag

SEQ ID NO: 58013 - RNA, 19 nt, Homo sapiens
gagaaaacaugucaggaaa

SEQ ID NO: 58014 - RNA, 19 nt, Homo sapiens
ggaacgcccuugugauugg

SEQ ID NO: 58015 - RNA, 19 nt, Homo sapiens
gaaugguucugcuuaugau

SEQ ID NO: 58016 - RNA, 19 nt, Homo sapiens
aaagauguguccaguuuca

SEQ ID NO: 58017 - RNA, 19 nt, Homo sapiens
guaucuaggugucuauaau

SEQ ID NO: 58018 - RNA, 19 nt, Homo sapiens
gagaaggaggguaguguuu

SEQ ID NO: 58019 - RNA, 19 nt, Homo sapiens
gcagaggaugaauaaguua

SEQ ID NO: 58020 - RNA, 19 nt, Homo sapiens
aacauaagcugcacuuuua

SEQ ID NO: 58021 - RNA, 19 nt, Homo sapiens
guuaagauaucuccucucu

SEQ ID NO: 58022 - RNA, 19 nt, Homo sapiens
cgaaagaaagcaaagcaaa

SEQ ID NO: 58023 - RNA, 19 nt, Homo sapiens
cacaacagaugcugaagga

SEQ ID NO: 58024 - RNA, 19 nt, Homo sapiens
gaggauagaagcagauguu

SEQ ID NO: 58025 - RNA, 19 nt, Homo sapiens
ucucaaagcccauuacaga

SEQ ID NO: 58026 - RNA, 19 nt, Homo sapiens
gaaugaugcccuggcuuua

SEQ ID NO: 58027 - RNA, 19 nt, Homo sapiens
gcucugaaauguguaaaca

SEQ ID NO: 58028 - RNA, 19 nt, Homo sapiens
ucacaucacuguaucuuuu

SEQ ID NO: 58029 - RNA, 19 nt, Homo sapiens
cgaaugaaaucacaucacu

SEQ ID NO: 58030 - RNA, 19 nt, Homo sapiens
ccauggauuuaacuuauga

SEQ ID NO: 58031 - RNA, 19 nt, Homo sapiens
gaaagaaacgaaagaaagc

SEQ ID NO: 58032 - RNA, 19 nt, Homo sapiens
gagaacugcuuuuaacauu

SEQ ID NO: 58033 - RNA, 19 nt, Homo sapiens
gagcuauggugcacucuag

SEQ ID NO: 58034 - RNA, 19 nt, Homo sapiens
ugaaaucacaucacuguau

SEQ ID NO: 58035 - RNA, 19 nt, Homo sapiens
cgagugugcuucaguuugu

SEQ ID NO: 58036 - RNA, 19 nt, Homo sapiens
gugaugggauucugcgaaa

SEQ ID NO: 58037 - RNA, 19 nt, Homo sapiens
gcccuggcuuuaagguuua

SEQ ID NO: 58038 - RNA, 19 nt, Homo sapiens
aaauaggacuacuagaguu

SEQ ID NO: 58039 - RNA, 19 nt, Homo sapiens
caggcaacauggaauacua

SEQ ID NO: 58040 - RNA, 19 nt, Homo sapiens
gagcugaaauaggaacaga

SEQ ID NO: 58041 - RNA, 19 nt, Homo sapiens
ggccaagacuggguagauu

SEQ ID NO: 58042 - RNA, 19 nt, Homo sapiens
aaacggaacagucggauug

SEQ ID NO: 58043 - RNA, 19 nt, Homo sapiens
gaacgagcgcaacugacua

SEQ ID NO: 58044 - RNA, 19 nt, Homo sapiens
caaauaggacuacuagagu

SEQ ID NO: 58045 - RNA, 19 nt, Homo sapiens
uaaaugcagcaacuuguuu

SEQ ID NO: 58046 - RNA, 19 nt, Homo sapiens
caaagcaaagucagugaaa

SEQ ID NO: 58047 - RNA, 19 nt, Homo sapiens
ggaaagggagcugaaauag

SEQ ID NO: 58048 - RNA, 19 nt, Homo sapiens
gcauaacaguaaugagauc

SEQ ID NO: 58049 - RNA, 19 nt, Homo sapiens
gugcauaacaguaaugaga

SEQ ID NO: 58050 - RNA, 19 nt, Homo sapiens
gaugugagggcagaauaua

SEQ ID NO: 58051 - RNA, 19 nt, Homo sapiens
uaaugcagaggaugaauaa

SEQ ID NO: 58052 - RNA, 19 nt, Homo sapiens
gagggaaggcaaaugcuuu

SEQ ID NO: 58053 - RNA, 19 nt, Homo sapiens
gaaucugggucgaguccuu

SEQ ID NO: 58054 - RNA, 19 nt, Homo sapiens
gaugggauucugcgaaauu

SEQ ID NO: 58055 - RNA, 19 nt, Homo sapiens
cauggaauacuacgaauga

SEQ ID NO: 58056 - RNA, 19 nt, Homo sapiens
gcugaaauaggaacagaaa

SEQ ID NO: 58057 - RNA, 19 nt, Homo sapiens
gaaugugugcauaacagua

SEQ ID NO: 58058 - RNA, 19 nt, Homo sapiens
ugacgagugugcuucaguu

SEQ ID NO: 58059 - RNA, 19 nt, Homo sapiens
ggagaaaguaaacagaguu

SEQ ID NO: 58060 - RNA, 19 nt, Homo sapiens
caaaugcaggauaguaauu

SEQ ID NO: 58061 - RNA, 19 nt, Homo sapiens
gcaaagcaaagucagugaa

SEQ ID NO: 58062 - RNA, 19 nt, Homo sapiens
gacccauacucguuucuga

SEQ ID NO: 58063 - RNA, 19 nt, Homo sapiens
ggagaaugcaggcaacaug

SEQ ID NO: 58064 - RNA, 19 nt, Homo sapiens
gagaugugagggcagaaua

SEQ ID NO: 58065 - RNA, 19 nt, Homo sapiens
gugggaaagucuauggaaa

SEQ ID NO: 58066 - RNA, 19 nt, Homo sapiens
gcaaacagcuguauaguug

SEQ ID NO: 58067 - RNA, 19 nt, Homo sapiens
caaaucagcuuuauagguu

SEQ ID NO: 58068 - RNA, 19 nt, Homo sapiens
gaagaagaauggauuguau

SEQ ID NO: 58069 - RNA, 19 nt, Homo sapiens
guaaauagaugacaaacga

SEQ ID NO: 58070 - RNA, 19 nt, Homo sapiens
gaacuggccucuacaaauc

SEQ ID NO: 58071 - RNA, 19 nt, Homo sapiens
gaugugaaauggagaagua

SEQ ID NO: 58072 - RNA, 19 nt, Homo sapiens
ccaaagggcagaauaaaua

SEQ ID NO: 58073 - RNA, 19 nt, Homo sapiens
uaagguaccucucaacauu

SEQ ID NO: 58074 - RNA, 19 nt, Homo sapiens
gauguucgcucgugcagua

SEQ ID NO: 58075 - RNA, 19 nt, Homo sapiens
uaccaagucuucucauuua

SEQ ID NO: 58076 - RNA, 19 nt, Homo sapiens
cagagaugcuccagaauuu

SEQ ID NO: 58077 - RNA, 19 nt, Homo sapiens
gaucucaucucaucucaug

SEQ ID NO: 58078 - RNA, 19 nt, Homo sapiens
gaaacacaccuacaugaaa

SEQ ID NO: 58079 - RNA, 19 nt, Homo sapiens
uaacacacaucaagacaga

SEQ ID NO: 58080 - RNA, 19 nt, Homo sapiens
aaacagcuguauaguugua

SEQ ID NO: 58081 - RNA, 19 nt, Homo sapiens
cugaagagcuuaaagauag

SEQ ID NO: 58082 - RNA, 19 nt, Homo sapiens
gcagagaugcuccagaauu

SEQ ID NO: 58083 - RNA, 19 nt, Homo sapiens
caaauuucaugcacugauu

SEQ ID NO: 58084 - RNA, 19 nt, Homo sapiens
guauauggcuuuacucaag

SEQ ID NO: 58085 - RNA, 19 nt, Homo sapiens
gaacaaauguguggguuuu

SEQ ID NO: 58086 - RNA, 19 nt, Homo sapiens
caaaaggggucuuaauuga

SEQ ID NO: 58087 - RNA, 19 nt, Homo sapiens
ggaaacacaccuacaugaa

SEQ ID NO: 58088 - RNA, 19 nt, Homo sapiens
gcaauggacacucuuaaug

SEQ ID NO: 58089 - RNA, 19 nt, Homo sapiens
acaauaagcuaaacgcaau

SEQ ID NO: 58090 - RNA, 19 nt, Homo sapiens
gcacaaaaguuuauaccaa

SEQ ID NO: 58091 - RNA, 19 nt, Homo sapiens
gagaugcuccagaauuuaa

SEQ ID NO: 58092 - RNA, 19 nt, Homo sapiens
acaaauagccauugaacaa

SEQ ID NO: 58093 - RNA, 19 nt, Homo sapiens
uuaagaaucuggaaugcuu

SEQ ID NO: 58094 - RNA, 19 nt, Homo sapiens
guagguaauuccuuagaga

SEQ ID NO: 58095 - RNA, 19 nt, Homo sapiens
caaccugucagauacaaua

SEQ ID NO: 58096 - RNA, 19 nt, Homo sapiens
guaagaggcuucaaaaugu

SEQ ID NO: 58097 - RNA, 19 nt, Homo sapiens
uuacagugcaguuuaguua

SEQ ID NO: 58098 - RNA, 19 nt, Homo sapiens
gugcaguacuguugguuaa

SEQ ID NO: 58099 - RNA, 19 nt, Homo sapiens
ugaauacacuuacaguuag

SEQ ID NO: 58100 - RNA, 19 nt, Homo sapiens
gcagaaaucgguugcuguu

SEQ ID NO: 58101 - RNA, 19 nt, Homo sapiens
caguauaccuggcaauuca

SEQ ID NO: 58102 - RNA, 19 nt, Homo sapiens
aagaauggauuguauguca

SEQ ID NO: 58103 - RNA, 19 nt, Homo sapiens
ccaccacccugccaguuaa

SEQ ID NO: 58104 - RNA, 19 nt, Homo sapiens
gcaguacuguugguuaaau

SEQ ID NO: 58105 - RNA, 19 nt, Homo sapiens
caaagggcagaauaaauaa

SEQ ID NO: 58106 - RNA, 19 nt, Homo sapiens
uaaccaaagggcagaauaa

SEQ ID NO: 58107 - RNA, 19 nt, Homo sapiens
gcaaaucagcuuuauaggu

SEQ ID NO: 58108 - RNA, 19 nt, Homo sapiens
cuccagaggugaacaauau

SEQ ID NO: 58109 - RNA, 19 nt, Homo sapiens
uggaagagcggaagaguuu

SEQ ID NO: 58110 - RNA, 19 nt, Homo sapiens
agacugcagugaaacaauu

SEQ ID NO: 58111 - RNA, 19 nt, Homo sapiens
gaaauggagaaguaucuga

SEQ ID NO: 58112 - RNA, 19 nt, Homo sapiens
gagagaaugagauguuuau

SEQ ID NO: 58113 - RNA, 19 nt, Homo sapiens
gggagugugugcagcguuu

SEQ ID NO: 58114 - RNA, 19 nt, Homo sapiens
gaugacaaacgauguaaau

SEQ ID NO: 58115 - RNA, 19 nt, Homo sapiens
caaaugacagaccuaacua

SEQ ID NO: 58116 - RNA, 19 nt, Homo sapiens
cuucuaaacuggcaauuca

SEQ ID NO: 58117 - RNA, 19 nt, Homo sapiens
gaauacaccggaucuagau

SEQ ID NO: 58118 - RNA, 19 nt, Homo sapiens
guucaaccucuuacaauaa

SEQ ID NO: 58119 - RNA, 19 nt, Homo sapiens
gaagaggcaccagaacuga

SEQ ID NO: 58120 - RNA, 19 nt, Homo sapiens
gugucugccuuuaaauaua

SEQ ID NO: 58121 - RNA, 19 nt, Homo sapiens
gcaggcaccagaagaagaa

SEQ ID NO: 58122 - RNA, 19 nt, Homo sapiens
gcagcaauggacacucuua

SEQ ID NO: 58123 - RNA, 19 nt, Homo sapiens
ggagcaaacagcuguauag

SEQ ID NO: 58124 - RNA, 19 nt, Homo sapiens
guauuguggucauuuccua

SEQ ID NO: 58125 - RNA, 19 nt, Homo sapiens
aaacugaagagcuuaaaga

SEQ ID NO: 58126 - RNA, 19 nt, Homo sapiens
caaauagccauugaacaaa

SEQ ID NO: 58127 - RNA, 19 nt, Homo sapiens
gcuguauaguuguagaauu

SEQ ID NO: 58128 - RNA, 19 nt, Homo sapiens
gaaaucgguugcuguuuug

SEQ ID NO: 58129 - RNA, 19 nt, Homo sapiens
acacuuacaguuaggauuu

SEQ ID NO: 58130 - RNA, 19 nt, Homo sapiens
caacaggccacuuacuuuc

SEQ ID NO: 58131 - RNA, 19 nt, Homo sapiens
agacagugccucagucgua

SEQ ID NO: 58132 - RNA, 19 nt, Homo sapiens
cauccaaccugucagauac

SEQ ID NO: 58133 - RNA, 19 nt, Homo sapiens
uacaauugcuucuaaacug

SEQ ID NO: 58134 - RNA, 19 nt, Homo sapiens
cugcuacaauugcuucuaa

SEQ ID NO: 58135 - RNA, 19 nt, Homo sapiens
gauaugcccaguucuacaa

SEQ ID NO: 58136 - RNA, 19 nt, Homo sapiens
cacugacacugaaggguua

SEQ ID NO: 58137 - RNA, 19 nt, Homo sapiens
aaacacaccuacaugaaaa

SEQ ID NO: 58138 - RNA, 19 nt, Homo sapiens
ggaggacguuggcguuuac

SEQ ID NO: 58139 - RNA, 19 nt, Homo sapiens
gagggaaggaauaaucauu

SEQ ID NO: 58140 - RNA, 19 nt, Homo sapiens
uggauuguaugucaagauu

SEQ ID NO: 58141 - RNA, 19 nt, Homo sapiens
caauggacacucuuaaugu

SEQ ID NO: 58142 - RNA, 19 nt, Homo sapiens
cggaggacguuggcguuua

SEQ ID NO: 58143 - RNA, 19 nt, Homo sapiens
ugacagaccuaacuauucc

SEQ ID NO: 58144 - RNA, 19 nt, Homo sapiens
acacacaccucugcuguuc

SEQ ID NO: 58145 - RNA, 19 nt, Homo sapiens
aguucaaccucuuacaaua

SEQ ID NO: 58146 - RNA, 19 nt, Homo sapiens
uaggauuugugguaaggua

SEQ ID NO: 58147 - RNA, 19 nt, Homo sapiens
uauaccaagucuucucauu

SEQ ID NO: 58148 - RNA, 19 nt, Homo sapiens
aauggacacucuuaauguu

SEQ ID NO: 58149 - RNA, 19 nt, Homo sapiens
gagaacuggccucuacaaa

SEQ ID NO: 58150 - RNA, 19 nt, Homo sapiens
gcaaauaauggagcaaaca

SEQ ID NO: 58151 - RNA, 19 nt, Homo sapiens
acagugagacacaguaauu

SEQ ID NO: 58152 - RNA, 19 nt, Homo sapiens
acaguuaggauuuguggua

SEQ ID NO: 58153 - RNA, 19 nt, Homo sapiens
ccaagucuucucauuuaaa

SEQ ID NO: 58154 - RNA, 19 nt, Homo sapiens
ccaguuaacucacaaaaca

SEQ ID NO: 58155 - RNA, 19 nt, Homo sapiens
ccagaggugaacaauauuu

SEQ ID NO: 58156 - RNA, 19 nt, Homo sapiens
ccugagaacuggccucuac

SEQ ID NO: 58157 - RNA, 19 nt, Homo sapiens
agaaaucgguugcuguuuu

SEQ ID NO: 58158 - RNA, 19 nt, Homo sapiens
gguaauuccuuagagauac

SEQ ID NO: 58159 - RNA, 19 nt, Homo sapiens
gaaaacagggaauacauug

SEQ ID NO: 58160 - RNA, 19 nt, Homo sapiens
ccugucagauacaauagaa

SEQ ID NO: 58161 - RNA, 19 nt, Homo sapiens
ccagagaccgugcguaaca

SEQ ID NO: 58162 - RNA, 19 nt, Homo sapiens
cagacaagaugugaaaugg

SEQ ID NO: 58163 - RNA, 19 nt, Homo sapiens
guaauuccuuagagauaca

SEQ ID NO: 58164 - RNA, 19 nt, Homo sapiens
aaaggggucuuaauugaaa

SEQ ID NO: 58165 - RNA, 19 nt, Homo sapiens
ccaaaacguugaauugaug

SEQ ID NO: 58166 - RNA, 19 nt, Homo sapiens
caaagcagcugacagaaau

SEQ ID NO: 58167 - RNA, 19 nt, Homo sapiens
gcgaacacuuucaccauua

SEQ ID NO: 58168 - RNA, 19 nt, Homo sapiens
gauaaaaccugaagaaguu

SEQ ID NO: 58169 - RNA, 19 nt, Homo sapiens
gaagaagccugggaaucaa

SEQ ID NO: 58170 - RNA, 19 nt, Homo sapiens
gaagaggugaauauguuua

SEQ ID NO: 58171 - RNA, 19 nt, Homo sapiens
gaaagaagaaggugguuca

SEQ ID NO: 58172 - RNA, 19 nt, Homo sapiens
gaacagccacagcagauga

SEQ ID NO: 58173 - RNA, 19 nt, Homo sapiens
ggaugaugaugaugaaguu

SEQ ID NO: 58174 - RNA, 19 nt, Homo sapiens
agaagaaggugguucauag

SEQ ID NO: 58175 - RNA, 19 nt, Homo sapiens
caaacaaucuguggaugga

SEQ ID NO: 58176 - RNA, 19 nt, Homo sapiens
gaggcaaacugaauugagu

SEQ ID NO: 58177 - RNA, 19 nt, Homo sapiens
cgaagaagccugggaauca

SEQ ID NO: 58178 - RNA, 19 nt, Homo sapiens
gaaugaggcaaacugaauu

SEQ ID NO: 58179 - RNA, 19 nt, Homo sapiens
uugaagaggugaauauguu

SEQ ID NO: 58180 - RNA, 19 nt, Homo sapiens
gaagaaggugguucauaga

SEQ ID NO: 58181 - RNA, 19 nt, Homo sapiens
gagaggaugaugaugauga

SEQ ID NO: 58182 - RNA, 19 nt, Homo sapiens
agacaaagcagcugacaga

SEQ ID NO: 58183 - RNA, 19 nt, Homo sapiens
gaaagaaacaaucaugaac

SEQ ID NO: 58184 - RNA, 19 nt, Homo sapiens
gaugaggcuuccaagaaug

SEQ ID NO: 58185 - RNA, 19 nt, Homo sapiens
ggccgaagcucugcccaaa

SEQ ID NO: 58186 - RNA, 19 nt, Homo sapiens
guaaacaauaucucuggua

SEQ ID NO: 58187 - RNA, 19 nt, Homo sapiens
ugaugaggcuuccaagaau

SEQ ID NO: 58188 - RNA, 19 nt, Homo sapiens
cagaucuuguggagaauuu

SEQ ID NO: 58189 - RNA, 19 nt, Homo sapiens
ccgaagcucugcccaaaca

SEQ ID NO: 58190 - RNA, 19 nt, Homo sapiens
uaacaacccuaaaguucag

SEQ ID NO: 58191 - RNA, 19 nt, Homo sapiens
gaagauaaaaccugaagaa

SEQ ID NO: 58192 - RNA, 19 nt, Homo sapiens
cuucaguucuccuuaaaga

SEQ ID NO: 58193 - RNA, 19 nt, Homo sapiens
caagaaugaggcaaacuga

SEQ ID NO: 58194 - RNA, 19 nt, Homo sapiens
acugggagcugcuauuuua

SEQ ID NO: 58195 - RNA, 19 nt, Homo sapiens
acaaagcagcugacagaaa

SEQ ID NO: 58196 - RNA, 19 nt, Homo sapiens
gcagcugacagaaaugcua

SEQ ID NO: 58197 - RNA, 19 nt, Homo sapiens
ugaugaaguuccagaucuu

SEQ ID NO: 58198 - RNA, 19 nt, Homo sapiens
gcgcauuggugggaaagga

SEQ ID NO: 58199 - RNA, 19 nt, Homo sapiens
agaggaugaugaugaugaa

SEQ ID NO: 58200 - RNA, 19 nt, Homo sapiens
aacaaucuguggauggaaa

SEQ ID NO: 58201 - RNA, 19 nt, Homo sapiens
gaagcucugcccaaacaau

SEQ ID NO: 58202 - RNA, 19 nt, Homo sapiens
caagaugaaagaaacaauc

SEQ ID NO: 58203 - RNA, 19 nt, Homo sapiens
agaaugaggcaaacugaau

SEQ ID NO: 58204 - RNA, 19 nt, Homo sapiens
gaggugaauauguuuacaa

SEQ ID NO: 58205 - RNA, 19 nt, Homo sapiens
gaaguuagggguaaacaau

SEQ ID NO: 58206 - RNA, 19 nt, Homo sapiens
aagaaacaaucaugaacca

SEQ ID NO: 58207 - RNA, 19 nt, Homo sapiens
cuuauucgcuccgacaaga

SEQ ID NO: 58208 - RNA, 19 nt, Homo sapiens
ugaagaggugaauauguuu

SEQ ID NO: 58209 - RNA, 19 nt, Homo sapiens
gcuuauacacaauucauuc

SEQ ID NO: 58210 - RNA, 19 nt, Homo sapiens
ccgacaagaugaaagaaac

SEQ ID NO: 58211 - RNA, 19 nt, Homo sapiens
aagaagaaggugguucaua

SEQ ID NO: 58212 - RNA, 19 nt, Homo sapiens
cugcagcucuuuucaguuu

SEQ ID NO: 58213 - RNA, 19 nt, Homo sapiens
gcuccgacaagaugaaaga

SEQ ID NO: 58214 - RNA, 19 nt, Homo sapiens
uggagaggaugaugaugau

SEQ ID NO: 58215 - RNA, 19 nt, Homo sapiens
ccaagaaugaggcaaacug

SEQ ID NO: 58216 - RNA, 19 nt, Homo sapiens
uuaacaacccuaaaguuca

SEQ ID NO: 58217 - RNA, 19 nt, Homo sapiens
uugaugaggcuuccaagaa

SEQ ID NO: 58218 - RNA, 19 nt, Homo sapiens
gaugaugaaguuccagauc

SEQ ID NO: 58219 - RNA, 19 nt, Homo sapiens
gaugaaguuccagaucuug

SEQ ID NO: 58220 - RNA, 19 nt, Homo sapiens
cgaacacuuucaccauuac

SEQ ID NO: 58221 - RNA, 19 nt, Homo sapiens
agcgaacacuuucaccauu

SEQ ID NO: 58222 - RNA, 19 nt, Homo sapiens
uuaaagaaguuagggguaa

SEQ ID NO: 58223 - RNA, 19 nt, Homo sapiens
uuacugggagcugcuauuu

SEQ ID NO: 58224 - RNA, 19 nt, Homo sapiens
uagaacagccacagcagau

SEQ ID NO: 58225 - RNA, 19 nt, Homo sapiens
aagaaggugguucauagaa

SEQ ID NO: 58226 - RNA, 19 nt, Homo sapiens
gggagcugcuauuuuauau

SEQ ID NO: 58227 - RNA, 19 nt, Homo sapiens
cuggagaggaugaugauga

SEQ ID NO: 58228 - RNA, 19 nt, Homo sapiens
gacaagaugaaagaaacaa

SEQ ID NO: 58229 - RNA, 19 nt, Homo sapiens
cuacuggagaggaugauga

SEQ ID NO: 58230 - RNA, 19 nt, Homo sapiens
acaaaccaaggaacaguga

SEQ ID NO: 58231 - RNA, 19 nt, Homo sapiens
caaacugcaggcacaagug

SEQ ID NO: 58232 - RNA, 19 nt, Homo sapiens
gaacacuuucaccauuaca

SEQ ID NO: 58233 - RNA, 19 nt, Homo sapiens
gcccaaacaaucuguggau

SEQ ID NO: 58234 - RNA, 19 nt, Homo sapiens
cgacaagaugaaagaaaca

SEQ ID NO: 58235 - RNA, 19 nt, Homo sapiens
agccacagcagaugacaaa

SEQ ID NO: 58236 - RNA, 19 nt, Homo sapiens
uaaagaaguuagggguaaa

SEQ ID NO: 58237 - RNA, 19 nt, Homo sapiens
ccaaacugcaggcacaagu

SEQ ID NO: 58238 - RNA, 19 nt, Homo sapiens
cagcgaacacuuucaccau

SEQ ID NO: 58239 - RNA, 19 nt, Homo sapiens
caaagcagcugacagaaau

SEQ ID NO: 58240 - RNA, 19 nt, Homo sapiens
gcaaacacuuucaccauga

SEQ ID NO: 58241 - RNA, 19 nt, Homo sapiens
gaaacaaucaugaaccaaa

SEQ ID NO: 58242 - RNA, 19 nt, Homo sapiens
gaagaggugaauauguuua

SEQ ID NO: 58243 - RNA, 19 nt, Homo sapiens
uaaacaauaucccugguau

SEQ ID NO: 58244 - RNA, 19 nt, Homo sapiens
uugaagaggugaauauguu

SEQ ID NO: 58245 - RNA, 19 nt, Homo sapiens
gaaagaaacaaucaugaac

SEQ ID NO: 58246 - RNA, 19 nt, Homo sapiens
agacaaagcagcugacaga

SEQ ID NO: 58247 - RNA, 19 nt, Homo sapiens
gaauauguuuacacaccaa

SEQ ID NO: 58248 - RNA, 19 nt, Homo sapiens
cagcaucgaucauaaacca

SEQ ID NO: 58249 - RNA, 19 nt, Homo sapiens
guaaacaauaucccuggua

SEQ ID NO: 58250 - RNA, 19 nt, Homo sapiens
gcacacuggucggaaagga

SEQ ID NO: 58251 - RNA, 19 nt, Homo sapiens
gaaauuagggguaaacaau

SEQ ID NO: 58252 - RNA, 19 nt, Homo sapiens
cuacucagcaucgaucaua

SEQ ID NO: 58253 - RNA, 19 nt, Homo sapiens
uuucaguucuccuuaaaga

SEQ ID NO: 58254 - RNA, 19 nt, Homo sapiens
acaaagcagcugacagaaa

SEQ ID NO: 58255 - RNA, 19 nt, Homo sapiens
gcagcugacagaaaugcua

SEQ ID NO: 58256 - RNA, 19 nt, Homo sapiens
gacaggccaugcugagaca

SEQ ID NO: 58257 - RNA, 19 nt, Homo sapiens
aagaaacaaucaugaacca

SEQ ID NO: 58258 - RNA, 19 nt, Homo sapiens
ugaagaggugaauauguuu

SEQ ID NO: 58259 - RNA, 19 nt, Homo sapiens
aggaacugcucacaggaaa

SEQ ID NO: 58260 - RNA, 19 nt, Homo sapiens
cagcaaacacuuucaccau

SEQ ID NO: 58261 - RNA, 19 nt, Homo sapiens
acacgacagcagaggauaa

SEQ ID NO: 58262 - RNA, 19 nt, Homo sapiens
caccaaacggcaagcagaa

SEQ ID NO: 58263 - RNA, 19 nt, Homo sapiens
caaacacuuucaccaugac

SEQ ID NO: 58264 - RNA, 19 nt, Homo sapiens
auaaaccagugcugcagau

SEQ ID NO: 58265 - RNA, 19 nt, Homo sapiens
ccaaacggcaagcagaagu

SEQ ID NO: 58266 - RNA, 19 nt, Homo sapiens
acaccaaggaacagugauu

SEQ ID NO: 58267 - RNA, 19 nt, Homo sapiens
caaacggcaagcagaagug

SEQ ID NO: 58268 - RNA, 19 nt, Homo sapiens
acacaccaaggaacaguga

SEQ ID NO: 58269 - RNA, 19 nt, Homo sapiens
uacucagcaucgaucauaa

SEQ ID NO: 58270 - RNA, 19 nt, Homo sapiens
cacgacagcagaggauaaa

SEQ ID NO: 58271 - RNA, 19 nt, Homo sapiens
gaacugguguaaauuugua

SEQ ID NO: 58272 - RNA, 19 nt, Homo sapiens
ggacaguaccuuucaauga

SEQ ID NO: 58273 - RNA, 19 nt, Homo sapiens
gaaguguccuacagaauug

SEQ ID NO: 58274 - RNA, 19 nt, Homo sapiens
gugaagaucuggcacaaga

SEQ ID NO: 58275 - RNA, 19 nt, Homo sapiens
gaaaguggaggucugguuu

SEQ ID NO: 58276 - RNA, 19 nt, Homo sapiens
guggaggucugguuuguaa

SEQ ID NO: 58277 - RNA, 19 nt, Homo sapiens
gacaguaccuuucaaugau

SEQ ID NO: 58278 - RNA, 19 nt, Homo sapiens
guuuguaacuuuccuugua

SEQ ID NO: 58279 - RNA, 19 nt, Homo sapiens
gcaaaguuguacagauuuc

SEQ ID NO: 58280 - RNA, 19 nt, Homo sapiens
uggcaaaguuguacagauu

SEQ ID NO: 58281 - RNA, 19 nt, Homo sapiens
ccacaaaccaccaucuauu

SEQ ID NO: 58282 - RNA, 19 nt, Homo sapiens
uaaaauggauccucugauu

SEQ ID NO: 58283 - RNA, 19 nt, Homo sapiens
gaacuuuguuagucaucuu

SEQ ID NO: 58284 - RNA, 19 nt, Homo sapiens
guauauugauuguggcaaa

SEQ ID NO: 58285 - RNA, 19 nt, Homo sapiens
gaaaugcagcuauugagau

SEQ ID NO: 58286 - RNA, 19 nt, Homo sapiens
gaaucuuucucugcaguaa

SEQ ID NO: 58287 - RNA, 19 nt, Homo sapiens
gcacaagauagaaugguaa

SEQ ID NO: 58288 - RNA, 19 nt, Homo sapiens
ggcacaagauagaauggua

SEQ ID NO: 58289 - RNA, 19 nt, Homo sapiens
ggaaaugcagcuauugaga

SEQ ID NO: 58290 - RNA, 19 nt, Homo sapiens
ccagcucucuguacauuug

SEQ ID NO: 58291 - RNA, 19 nt, Homo sapiens
ugucucaacugugguguua

SEQ ID NO: 58292 - RNA, 19 nt, Homo sapiens
gauauagucuguggaugga

SEQ ID NO: 58293 - RNA, 19 nt, Homo sapiens
gcagaacauuauaaacauc

SEQ ID NO: 58294 - RNA, 19 nt, Homo sapiens
gaauuuaaaccaugucaca

SEQ ID NO: 58295 - RNA, 19 nt, Homo sapiens
ugaaguguccuacagaauu

SEQ ID NO: 58296 - RNA, 19 nt, Homo sapiens
cuauugagaucuucgaaug

SEQ ID NO: 58297 - RNA, 19 nt, Homo sapiens
guauucgcaucaaccauaa

SEQ ID NO: 58298 - RNA, 19 nt, Homo sapiens
ggcagaacauuauaaacau

SEQ ID NO: 58299 - RNA, 19 nt, Homo sapiens
cacaaaccaccaucuauuu

SEQ ID NO: 58300 - RNA, 19 nt, Homo sapiens
caguaccuuucaaugauua

SEQ ID NO: 58301 - RNA, 19 nt, Homo sapiens
guaacuuuccuuguacuua

SEQ ID NO: 58302 - RNA, 19 nt, Homo sapiens
agacugaguaaacuucuua

SEQ ID NO: 58303 - RNA, 19 nt, Homo sapiens
gcacagcggauuggacuga

SEQ ID NO: 58304 - RNA, 19 nt, Homo sapiens
guacauaaagacaaacuag

SEQ ID NO: 58305 - RNA, 19 nt, Homo sapiens
ucccagacauaccuaaauu

SEQ ID NO: 58306 - RNA, 19 nt, Homo sapiens
cgccaucgcucgucucuuc

SEQ ID NO: 58307 - RNA, 19 nt, Homo sapiens
cuacagaauuggagaggau

SEQ ID NO: 58308 - RNA, 19 nt, Homo sapiens
gacaaacuaguaagcauga

SEQ ID NO: 58309 - RNA, 19 nt, Homo sapiens
uaugaaguguccuacagaa

SEQ ID NO: 58310 - RNA, 19 nt, Homo sapiens
gggauggauuauggaauuu

SEQ ID NO: 58311 - RNA, 19 nt, Homo sapiens
ggauggauuauggaauuua

SEQ ID NO: 58312 - RNA, 19 nt, Homo sapiens
ucucggagcuggaaaugca

SEQ ID NO: 58313 - RNA, 19 nt, Homo sapiens
aaaugcagcuauugagauc

SEQ ID NO: 58314 - RNA, 19 nt, Homo sapiens
ccaucugugugcuguauga

SEQ ID NO: 58315 - RNA, 19 nt, Homo sapiens
acaguaccuuucaaugauu

SEQ ID NO: 58316 - RNA, 19 nt, Homo sapiens
ggggauggauuauggaauu

SEQ ID NO: 58317 - RNA, 19 nt, Homo sapiens
gcagaacgagcccuuccaa

SEQ ID NO: 58318 - RNA, 19 nt, Homo sapiens
ggucugguuuguaacuuuc

SEQ ID NO: 58319 - RNA, 19 nt, Homo sapiens
uaaggaggaacuucucuug

SEQ ID NO: 58320 - RNA, 19 nt, Homo sapiens
uguauucgcaucaaccaua

SEQ ID NO: 58321 - RNA, 19 nt, Homo sapiens
ggaucggguuaccguugua

SEQ ID NO: 58322 - RNA, 19 nt, Homo sapiens
ugccauaguuuggacagua

SEQ ID NO: 58323 - RNA, 19 nt, Homo sapiens
uaagauauagucuguggau

SEQ ID NO: 58324 - RNA, 19 nt, Homo sapiens
gcaggagguagcacucaaa

SEQ ID NO: 58325 - RNA, 19 nt, Homo sapiens
uggcagaacauuauaaaca

SEQ ID NO: 58326 - RNA, 19 nt, Homo sapiens
ccuagcacuuaaauaugua

SEQ ID NO: 58327 - RNA, 19 nt, Homo sapiens
aaacaugguaguacuggaa

SEQ ID NO: 58328 - RNA, 19 nt, Homo sapiens
gcuggcagaacauuauaaa

SEQ ID NO: 58329 - RNA, 19 nt, Homo sapiens
gaaagaaagacaaaaguag

SEQ ID NO: 58330 - RNA, 19 nt, Homo sapiens
ccagccagcucucuguaca

SEQ ID NO: 58331 - RNA, 19 nt, Homo sapiens
gggaucggguuaccguugu

SEQ ID NO: 58332 - RNA, 19 nt, Homo sapiens
acaauaugaugacuguauc

SEQ ID NO: 58333 - RNA, 19 nt, Homo sapiens
ucaggcuucucccaaguga

SEQ ID NO: 58334 - RNA, 19 nt, Homo sapiens
ggcaaaguuguacagauuu

SEQ ID NO: 58335 - RNA, 19 nt, Homo sapiens
ggaauuugcacuauuacac

SEQ ID NO: 58336 - RNA, 19 nt, Homo sapiens
ggagguagcacucaaaaca

SEQ ID NO: 58337 - RNA, 19 nt, Homo sapiens
ccaaguuucuccgcaccaa

SEQ ID NO: 58338 - RNA, 19 nt, Homo sapiens
gcaccagccagcucucugu

SEQ ID NO: 58339 - RNA, 19 nt, Homo sapiens
gaauuugcacuauuacacu

SEQ ID NO: 58340 - RNA, 19 nt, Homo sapiens
acuacaauaugaugacugu

SEQ ID NO: 58341 - RNA, 19 nt, Homo sapiens
ccuaugaaguguccuacag

SEQ ID NO: 58342 - RNA, 19 nt, Homo sapiens
cauggcaacaggcuuuaaa

SEQ ID NO: 58343 - RNA, 19 nt, Homo sapiens
gggaaguccuagggugguu

SEQ ID NO: 58344 - RNA, 19 nt, Homo sapiens
guaaggaggaacuucucuu

SEQ ID NO: 58345 - RNA, 19 nt, Homo sapiens
gguaguacuggaaauuuua

SEQ ID NO: 58346 - RNA, 19 nt, Homo sapiens
gaggucugguuuguaacuu

SEQ ID NO: 58347 - RNA, 19 nt, Homo sapiens
accuagcacuuaaauaugu

SEQ ID NO: 58348 - RNA, 19 nt, Homo sapiens
ccagacauaccuaaauuuu

SEQ ID NO: 58349 - RNA, 19 nt, Homo sapiens
guccuagggugguuucagu

SEQ ID NO: 58350 - RNA, 19 nt, Homo sapiens
gaguccaaguaaaugauca

SEQ ID NO: 58351 - RNA, 19 nt, Homo sapiens
gacuguaucagguuaagau

SEQ ID NO: 58352 - RNA, 19 nt, Homo sapiens
guucaggcuucucccaagu

SEQ ID NO: 58353 - RNA, 19 nt, Homo sapiens
aaauggauccucugauugg

SEQ ID NO: 58354 - RNA, 19 nt, Homo sapiens
guggcaaaguuguacagau

SEQ ID NO: 58355 - RNA, 19 nt, Homo sapiens
cuagggugguuucaguuuc

SEQ ID NO: 58356 - RNA, 19 nt, Homo sapiens
agccagcucucuguacauu

SEQ ID NO: 58357 - RNA, 19 nt, Homo sapiens
aagacaaacuaguaagcau

SEQ ID NO: 58358 - RNA, 19 nt, Homo sapiens
gcacuauuacacuugaaag

SEQ ID NO: 58359 - RNA, 19 nt, Homo sapiens
ccugugaguccaaguaaau

SEQ ID NO: 58360 - RNA, 19 nt, Homo sapiens
ugacagugccauaguuugg

SEQ ID NO: 58361 - RNA, 19 nt, Homo sapiens
cacaagauagaaugguaaa

SEQ ID NO: 58362 - RNA, 19 nt, Homo sapiens
caugcaagggaucggguua

SEQ ID NO: 58363 - RNA, 19 nt, Homo sapiens
gccugugaguccaaguaaa

SEQ ID NO: 58364 - RNA, 19 nt, Homo sapiens
uauugauuguggcaaaguu

SEQ ID NO: 58365 - RNA, 19 nt, Homo sapiens
augaacugguguaaauuug

SEQ ID NO: 58366 - RNA, 19 nt, Homo sapiens
aguagcaagugaccagaau

SEQ ID NO: 58367 - RNA, 19 nt, Homo sapiens
caugguaguacuggaaauu

SEQ ID NO: 58368 - RNA, 19 nt, Homo sapiens
aggggaauuugcacuauua

SEQ ID NO: 58369 - RNA, 19 nt, Homo sapiens
ccuagggugguuucaguuu

SEQ ID NO: 58370 - RNA, 19 nt, Homo sapiens
gaaguccuagggugguuuc

SEQ ID NO: 58371 - RNA, 19 nt, Homo sapiens
gaacaggaauggaagcuua

SEQ ID NO: 58372 - RNA, 19 nt, Homo sapiens
gaagaucacuuguguugaa

SEQ ID NO: 58373 - RNA, 19 nt, Homo sapiens
gcagaagacuccauagaaa

SEQ ID NO: 58374 - RNA, 19 nt, Homo sapiens
gcuaugggcugccaaauuu

SEQ ID NO: 58375 - RNA, 19 nt, Homo sapiens
ucaaggaguuguuaaagua

SEQ ID NO: 58376 - RNA, 19 nt, Homo sapiens
gaaauggugucauaaagau

SEQ ID NO: 58377 - RNA, 19 nt, Homo sapiens
gaagcuaccugcauuaagu

SEQ ID NO: 58378 - RNA, 19 nt, Homo sapiens
gaaagcaacuuaccauggu

SEQ ID NO: 58379 - RNA, 19 nt, Homo sapiens
gauaguggcuucugagcaa

SEQ ID NO: 58380 - RNA, 19 nt, Homo sapiens
gguaaacgaucaaggaguu

SEQ ID NO: 58381 - RNA, 19 nt, Homo sapiens
gaaggagguuucauuguca

SEQ ID NO: 58382 - RNA, 19 nt, Homo sapiens
gagaagaucacuuguguug

SEQ ID NO: 58383 - RNA, 19 nt, Homo sapiens
ggaugcaccucuucuuuga

SEQ ID NO: 58384 - RNA, 19 nt, Homo sapiens
gcggaagggugaugaauau

SEQ ID NO: 58385 - RNA, 19 nt, Homo sapiens
guacaacagugaucugguu

SEQ ID NO: 58386 - RNA, 19 nt, Homo sapiens
uaagaaggguucaauagau

SEQ ID NO: 58387 - RNA, 19 nt, Homo sapiens
uggaauaccuggagucaaa

SEQ ID NO: 58388 - RNA, 19 nt, Homo sapiens
gaagcgaucccaacagaaa

SEQ ID NO: 58389 - RNA, 19 nt, Homo sapiens
guaaauagccgcacaaagg

SEQ ID NO: 58390 - RNA, 19 nt, Homo sapiens
ggagcaaauuucaaucauu

SEQ ID NO: 58391 - RNA, 19 nt, Homo sapiens
caauagauguugagaagau

SEQ ID NO: 58392 - RNA, 19 nt, Homo sapiens
ggugauacgucauuauguu

SEQ ID NO: 58393 - RNA, 19 nt, Homo sapiens
ggaagggugaugaauauuu

SEQ ID NO: 58394 - RNA, 19 nt, Homo sapiens
gcacaaacucuccuacuau

SEQ ID NO: 58395 - RNA, 19 nt, Homo sapiens
gaagaugccauaugagaga

SEQ ID NO: 58396 - RNA, 19 nt, Homo sapiens
ugaugaaucuuucccauga

SEQ ID NO: 58397 - RNA, 19 nt, Homo sapiens
gcaccagucuccacaagug

SEQ ID NO: 58398 - RNA, 19 nt, Homo sapiens
caggugaacuccagaaaga

SEQ ID NO: 58399 - RNA, 19 nt, Homo sapiens
ucucuggacuguaagaaua

SEQ ID NO: 58400 - RNA, 19 nt, Homo sapiens
ucccugagcucauuaacua

SEQ ID NO: 58401 - RNA, 19 nt, Homo sapiens
uccaacagcucuuugagua

SEQ ID NO: 58402 - RNA, 19 nt, Homo sapiens
ucaguaggcuccaaauuuc

SEQ ID NO: 58403 - RNA, 19 nt, Homo sapiens
gcucaaauauccagugucu

SEQ ID NO: 58404 - RNA, 19 nt, Homo sapiens
ggauacggaucaugggaaa

SEQ ID NO: 58405 - RNA, 19 nt, Homo sapiens
gguauguccuggaugauga

SEQ ID NO: 58406 - RNA, 19 nt, Homo sapiens
ggugaagaguccagugaaa

SEQ ID NO: 58407 - RNA, 19 nt, Homo sapiens
gaauuuggcaagaaugaaa

SEQ ID NO: 58408 - RNA, 19 nt, Homo sapiens
cagaugagcgucccacuuu

SEQ ID NO: 58409 - RNA, 19 nt, Homo sapiens
gaagggugaugaauauuuu

SEQ ID NO: 58410 - RNA, 19 nt, Homo sapiens
aaacaucaccucuaaacuu

SEQ ID NO: 58411 - RNA, 19 nt, Homo sapiens
guaagaaggguucaauaga

SEQ ID NO: 58412 - RNA, 19 nt, Homo sapiens
ggagggaggauguaaauag

SEQ ID NO: 58413 - RNA, 19 nt, Homo sapiens
ccagugaaauggagcaaau

SEQ ID NO: 58414 - RNA, 19 nt, Homo sapiens
gaauuaagacagacugaau

SEQ ID NO: 58415 - RNA, 19 nt, Homo sapiens
ugagacugcugaacacauu

SEQ ID NO: 58416 - RNA, 19 nt, Homo sapiens
ggaccgaauuuggcaagaa

SEQ ID NO: 58417 - RNA, 19 nt, Homo sapiens
caugggaaauugauccaaa

SEQ ID NO: 58418 - RNA, 19 nt, Homo sapiens
gaaagacagauuccgagaa

SEQ ID NO: 58419 - RNA, 19 nt, Homo sapiens
auccugagcucgccaauaa

SEQ ID NO: 58420 - RNA, 19 nt, Homo sapiens
caucaucacugaguacaug

SEQ ID NO: 58421 - RNA, 19 nt, Homo sapiens
ucaaauauccagugucuca

SEQ ID NO: 58422 - RNA, 19 nt, Homo sapiens
ggaaaucccaagcuuagga

SEQ ID NO: 58423 - RNA, 19 nt, Homo sapiens
gaggaaaucccaagcuuag

SEQ ID NO: 58424 - RNA, 19 nt, Homo sapiens
cuacuucucuucuccacaa

SEQ ID NO: 58425 - RNA, 19 nt, Homo sapiens
gggaagaugccauaugaga

SEQ ID NO: 58426 - RNA, 19 nt, Homo sapiens
caccggaaguccugaugua

SEQ ID NO: 58427 - RNA, 19 nt, Homo sapiens
gugcaaggaugucugugaa

SEQ ID NO: 58428 - RNA, 19 nt, Homo sapiens
ugaagaagccaaagucaug

SEQ ID NO: 58429 - RNA, 19 nt, Homo sapiens
aaagacagauuccgagaag

SEQ ID NO: 58430 - RNA, 19 nt, Homo sapiens
caaagaaggcuccaugucu

SEQ ID NO: 58431 - RNA, 19 nt, Homo sapiens
gaaggcuacauuccuagua

SEQ ID NO: 58432 - RNA, 19 nt, Homo sapiens
gaaacagugguuccugaaa

SEQ ID NO: 58433 - RNA, 19 nt, Homo sapiens
gaccgaauuuggcaagaau

SEQ ID NO: 58434 - RNA, 19 nt, Homo sapiens
uaggagcccuggagccuuu

SEQ ID NO: 58435 - RNA, 19 nt, Homo sapiens
caacucugcaggacucaua

SEQ ID NO: 58436 - RNA, 19 nt, Homo sapiens
gcaaagcuggcaaauauac

SEQ ID NO: 58437 - RNA, 19 nt, Homo sapiens
agaaggagguuucauuguc

SEQ ID NO: 58438 - RNA, 19 nt, Homo sapiens
cacaaacucuccuacuaug

SEQ ID NO: 58439 - RNA, 19 nt, Homo sapiens
agacugaauuugcgaugaa

SEQ ID NO: 58440 - RNA, 19 nt, Homo sapiens
aguauuaccuggcugagaa

SEQ ID NO: 58441 - RNA, 19 nt, Homo sapiens
guggagagcacgagauaaa

SEQ ID NO: 58442 - RNA, 19 nt, Homo sapiens
gaaugcaaaugaucuacag

SEQ ID NO: 58443 - RNA, 19 nt, Homo sapiens
cagaggaaaucccaagcuu

SEQ ID NO: 58444 - RNA, 19 nt, Homo sapiens
gaagaagccaaagucauga

SEQ ID NO: 58445 - RNA, 19 nt, Homo sapiens
gagaagaggcaguaagaag

SEQ ID NO: 58446 - RNA, 19 nt, Homo sapiens
gggagaagaggcaguaaga

SEQ ID NO: 58447 - RNA, 19 nt, Homo sapiens
gaugccauaugagagauuu

SEQ ID NO: 58448 - RNA, 19 nt, Homo sapiens
cggaaguccugauguauag

SEQ ID NO: 58449 - RNA, 19 nt, Homo sapiens
caccucagagccaguauua

SEQ ID NO: 58450 - RNA, 19 nt, Homo sapiens
gucauuauguuguguguuc

SEQ ID NO: 58451 - RNA, 19 nt, Homo sapiens
ugagcaauauucuagaugu

SEQ ID NO: 58452 - RNA, 19 nt, Homo sapiens
caaugcaucugggaagcua

SEQ ID NO: 58453 - RNA, 19 nt, Homo sapiens
aagaaggguucaauagaug

SEQ ID NO: 58454 - RNA, 19 nt, Homo sapiens
ugaaauggugucauaaaga

SEQ ID NO: 58455 - RNA, 19 nt, Homo sapiens
aaagaaggagguuucauug

SEQ ID NO: 58456 - RNA, 19 nt, Homo sapiens
gccaaugaaugcaaaugau

SEQ ID NO: 58457 - RNA, 19 nt, Homo sapiens
gcaauauucuagaugucau

SEQ ID NO: 58458 - RNA, 19 nt, Homo sapiens
ggaaauggagaggccagua

SEQ ID NO: 58459 - RNA, 19 nt, Homo sapiens
gagguuucauugucagaga

SEQ ID NO: 58460 - RNA, 19 nt, Homo sapiens
aaggcuacauuccuaguaa

SEQ ID NO: 58461 - RNA, 19 nt, Homo sapiens
ugcacaaacucuccuacua

SEQ ID NO: 58462 - RNA, 19 nt, Homo sapiens
aagaaaacaucaccucuaa

SEQ ID NO: 58463 - RNA, 19 nt, Homo sapiens
augagaagcuggugcaguu

SEQ ID NO: 58464 - RNA, 19 nt, Homo sapiens
caucaccucuaaacuucaa

SEQ ID NO: 58465 - RNA, 19 nt, Homo sapiens
caccaucccugagcucauu

SEQ ID NO: 58466 - RNA, 19 nt, Homo sapiens
ugaagcagaagacuccaua

SEQ ID NO: 58467 - RNA, 19 nt, Homo sapiens
ccagaaagaagaagcuaug

SEQ ID NO: 58468 - RNA, 19 nt, Homo sapiens
agaaauguaugagugguau

SEQ ID NO: 58469 - RNA, 19 nt, Homo sapiens
uuguggcccuuuaugauua

SEQ ID NO: 58470 - RNA, 19 nt, Homo sapiens
agaaauaucacccuugcuu

SEQ ID NO: 58471 - RNA, 19 nt, Homo sapiens
gaacuuggagggaauauua

SEQ ID NO: 58472 - RNA, 19 nt, Homo sapiens
ggagagaaguuuccaucua

SEQ ID NO: 58473 - RNA, 19 nt, Homo sapiens
ccaauagacuccaggcuua

SEQ ID NO: 58474 - RNA, 19 nt, Homo sapiens
uaucucagcucaucuguuu

SEQ ID NO: 58475 - RNA, 19 nt, Homo sapiens
ggagaagaaaguagaaaua

SEQ ID NO: 58476 - RNA, 19 nt, Homo sapiens
gcacuuuccuuuacacaug

SEQ ID NO: 58477 - RNA, 19 nt, Homo sapiens
gggagaaugugaugaagaa

SEQ ID NO: 58478 - RNA, 19 nt, Homo sapiens
cagccuauaucgcaaauuu

SEQ ID NO: 58479 - RNA, 19 nt, Homo sapiens
gcacagcuguucuuuguac

SEQ ID NO: 58480 - RNA, 19 nt, Homo sapiens
uggaagaacucaaauggaa

SEQ ID NO: 58481 - RNA, 19 nt, Homo sapiens
caacaugaaugauggaucu

SEQ ID NO: 58482 - RNA, 19 nt, Homo sapiens
guucugggcuguagaguug

SEQ ID NO: 58483 - RNA, 19 nt, Homo sapiens
cagacacucuccauucuaa

SEQ ID NO: 58484 - RNA, 19 nt, Homo sapiens
ugauggaucugauaucuau

SEQ ID NO: 58485 - RNA, 19 nt, Homo sapiens
gagagaaguuuccaucuac

SEQ ID NO: 58486 - RNA, 19 nt, Homo sapiens
ucaaagacauuccuagaag

SEQ ID NO: 58487 - RNA, 19 nt, Homo sapiens
gagggaauauuaugaugga

SEQ ID NO: 58488 - RNA, 19 nt, Homo sapiens
cagagacacuucuacgaaa

SEQ ID NO: 58489 - RNA, 19 nt, Homo sapiens
uagcaucucucuauuucaa

SEQ ID NO: 58490 - RNA, 19 nt, Homo sapiens
gagggacucacaucaguua

SEQ ID NO: 58491 - RNA, 19 nt, Homo sapiens
gagcagagaggaacugaga

SEQ ID NO: 58492 - RNA, 19 nt, Homo sapiens
gcugaaaucccauaaagga

SEQ ID NO: 58493 - RNA, 19 nt, Homo sapiens
ggaaacuacuuggagcaaa

SEQ ID NO: 58494 - RNA, 19 nt, Homo sapiens
uuacacacaccuucaguua

SEQ ID NO: 58495 - RNA, 19 nt, Homo sapiens
aaacucaaaggacagauua

SEQ ID NO: 58496 - RNA, 19 nt, Homo sapiens
ccuaaucccuuaagacuag

SEQ ID NO: 58497 - RNA, 19 nt, Homo sapiens
caucgucuuuaccuaauaa

SEQ ID NO: 58498 - RNA, 19 nt, Homo sapiens
gaaacuacuuggagcaaac

SEQ ID NO: 58499 - RNA, 19 nt, Homo sapiens
gaugaagggucaggcagaa

SEQ ID NO: 58500 - RNA, 19 nt, Homo sapiens
ucaaacugcuucuaguguu

SEQ ID NO: 58501 - RNA, 19 nt, Homo sapiens
ggacucacaucaguuaucu

SEQ ID NO: 58502 - RNA, 19 nt, Homo sapiens
ucaagagaauggagaaauc

SEQ ID NO: 58503 - RNA, 19 nt, Homo sapiens
gcucaucgucuuuaccuaa

SEQ ID NO: 58504 - RNA, 19 nt, Homo sapiens
gaggauccguggcgucaga

SEQ ID NO: 58505 - RNA, 19 nt, Homo sapiens
ggagggaagugaggugaau

SEQ ID NO: 58506 - RNA, 19 nt, Homo sapiens
uuccaaaucuguuucugua

SEQ ID NO: 58507 - RNA, 19 nt, Homo sapiens
ccuguuggguggcaauuaa

SEQ ID NO: 58508 - RNA, 19 nt, Homo sapiens
ggaagauucacgucagaaa

SEQ ID NO: 58509 - RNA, 19 nt, Homo sapiens
gagagaggaggaaugaauu

SEQ ID NO: 58510 - RNA, 19 nt, Homo sapiens
gcaccucagugggauggua

SEQ ID NO: 58511 - RNA, 19 nt, Homo sapiens
caaagacauuccuagaagu

SEQ ID NO: 58512 - RNA, 19 nt, Homo sapiens
ugaaauaucuugguaucca

SEQ ID NO: 58513 - RNA, 19 nt, Homo sapiens
uuacauugcugcugcuaga

SEQ ID NO: 58514 - RNA, 19 nt, Homo sapiens
gaagaaaguagaaauaucc

SEQ ID NO: 58515 - RNA, 19 nt, Homo sapiens
ggauggaagcuacgaagaa

SEQ ID NO: 58516 - RNA, 19 nt, Homo sapiens
gcaggaagccgagcagaug

SEQ ID NO: 58517 - RNA, 19 nt, Homo sapiens
ccucagcccucaucucaau

SEQ ID NO: 58518 - RNA, 19 nt, Homo sapiens
ggauaaggguauguggaaa

SEQ ID NO: 58519 - RNA, 19 nt, Homo sapiens
gauuagggaucgagauugg

SEQ ID NO: 58520 - RNA, 19 nt, Homo sapiens
gacuagaaccuauaggaaa

SEQ ID NO: 58521 - RNA, 19 nt, Homo sapiens
cuaaggagaucccauuguc

SEQ ID NO: 58522 - RNA, 19 nt, Homo sapiens
ggaagaacucaaauggaaa

SEQ ID NO: 58523 - RNA, 19 nt, Homo sapiens
gauugcaccuguguauuug

SEQ ID NO: 58524 - RNA, 19 nt, Homo sapiens
gcagagaggaacugagaug

SEQ ID NO: 58525 - RNA, 19 nt, Homo sapiens
gcuguagaguuguauggaa

SEQ ID NO: 58526 - RNA, 19 nt, Homo sapiens
gaaauauccauaccagcuu

SEQ ID NO: 58527 - RNA, 19 nt, Homo sapiens
guaugcaaguucaagagaa

SEQ ID NO: 58528 - RNA, 19 nt, Homo sapiens
gauggaagcuacgaagaag

SEQ ID NO: 58529 - RNA, 19 nt, Homo sapiens
ccgagcagaugcccgagua

SEQ ID NO: 58530 - RNA, 19 nt, Homo sapiens
ugauugcaccuguguauuu

SEQ ID NO: 58531 - RNA, 19 nt, Homo sapiens
caaacugcuucuaguguuc

SEQ ID NO: 58532 - RNA, 19 nt, Homo sapiens
uugcacagcuguucuuugu

SEQ ID NO: 58533 - RNA, 19 nt, Homo sapiens
acaccuggcucauccauag

SEQ ID NO: 58534 - RNA, 19 nt, Homo sapiens
guugaaauaucuugguauc

SEQ ID NO: 58535 - RNA, 19 nt, Homo sapiens
gaaguuuccaucuacauca

SEQ ID NO: 58536 - RNA, 19 nt, Homo sapiens
gaaaucccauaaaggaacu

SEQ ID NO: 58537 - RNA, 19 nt, Homo sapiens
gcagacacucuccauucua

SEQ ID NO: 58538 - RNA, 19 nt, Homo sapiens
guagggagaaugugaugaa

SEQ ID NO: 58539 - RNA, 19 nt, Homo sapiens
ggauucagcucccuuugac

SEQ ID NO: 58540 - RNA, 19 nt, Homo sapiens
aagagagacuccuggaaga

SEQ ID NO: 58541 - RNA, 19 nt, Homo sapiens
ccagagagaggaggaauga

SEQ ID NO: 58542 - RNA, 19 nt, Homo sapiens
gagacuauacaacgaaaga

SEQ ID NO: 58543 - RNA, 19 nt, Homo sapiens
ucacaucaguaugcaaguu

SEQ ID NO: 58544 - RNA, 19 nt, Homo sapiens
caggauagauguugcucau

SEQ ID NO: 58545 - RNA, 19 nt, Homo sapiens
cuacccagcuuuccuacau

SEQ ID NO: 58546 - RNA, 19 nt, Homo sapiens
ucagagacacuucuacgaa

SEQ ID NO: 58547 - RNA, 19 nt, Homo sapiens
ccucugcgcccuccuguuu

SEQ ID NO: 58548 - RNA, 19 nt, Homo sapiens
gaauaucucagcucaucug

SEQ ID NO: 58549 - RNA, 19 nt, Homo sapiens
gcaucucucuauuucaaag

SEQ ID NO: 58550 - RNA, 19 nt, Homo sapiens
uaauuaauccugugaaggu

SEQ ID NO: 58551 - RNA, 19 nt, Homo sapiens
ggcuucaccugcuagcuuu

SEQ ID NO: 58552 - RNA, 19 nt, Homo sapiens
ggacugauugcaccugugu

SEQ ID NO: 58553 - RNA, 19 nt, Homo sapiens
gaauccaggcacaugauga

SEQ ID NO: 58554 - RNA, 19 nt, Homo sapiens
ccuauggucuagcgguaaa

SEQ ID NO: 58555 - RNA, 19 nt, Homo sapiens
gacaggagaagaaaguaga

SEQ ID NO: 58556 - RNA, 19 nt, Homo sapiens
ccugagcacuuuccuuuac

SEQ ID NO: 58557 - RNA, 19 nt, Homo sapiens
acacacaccuucaguuagc

SEQ ID NO: 58558 - RNA, 19 nt, Homo sapiens
caaacucaaaggacagauu

SEQ ID NO: 58559 - RNA, 19 nt, Homo sapiens
gcaccuuccaaaucuguuu

SEQ ID NO: 58560 - RNA, 19 nt, Homo sapiens
guuggguggcaauuaauua

SEQ ID NO: 58561 - RNA, 19 nt, Homo sapiens
cugaccaucugcccaauug

SEQ ID NO: 58562 - RNA, 19 nt, Homo sapiens
gaagaacucaaauggaaaa

SEQ ID NO: 58563 - RNA, 19 nt, Homo sapiens
ggacaggagaagaaaguag

SEQ ID NO: 58564 - RNA, 19 nt, Homo sapiens
gaacuuccaagggagagaa

SEQ ID NO: 58565 - RNA, 19 nt, Homo sapiens
uuacacauguggcuugucu

SEQ ID NO: 58566 - RNA, 19 nt, Homo sapiens
ggugggagauggcaguuuu

SEQ ID NO: 58567 - RNA, 19 nt, Homo sapiens
aagaagcccuggugcaucu

SEQ ID NO: 58568 - RNA, 19 nt, Homo sapiens
aaaggaacuuggagggaau

SEQ ID NO: 58569 - RNA, 19 nt, Homo sapiens
cagauuagggaucgagauu

SEQ ID NO: 58570 - RNA, 19 nt, Homo sapiens
gagaaugugaugaagaaag

SEQ ID NO: 58571 - RNA, 19 nt, Homo sapiens
gaucaucucuucuuuguca

SEQ ID NO: 58572 - RNA, 19 nt, Homo sapiens
gaauggcaguguauuagua

SEQ ID NO: 58573 - RNA, 19 nt, Homo sapiens
cuacagcuauggaacauua

SEQ ID NO: 58574 - RNA, 19 nt, Homo sapiens
gaagacagacauuauauga

SEQ ID NO: 58575 - RNA, 19 nt, Homo sapiens
ggaacuaccagaucgauua

SEQ ID NO: 58576 - RNA, 19 nt, Homo sapiens
caacaacacuauacuaaca

SEQ ID NO: 58577 - RNA, 19 nt, Homo sapiens
guucuaagcuggucuaugu

SEQ ID NO: 58578 - RNA, 19 nt, Homo sapiens
gaagagugaucacgauuuc

SEQ ID NO: 58579 - RNA, 19 nt, Homo sapiens
gagaaugcuuuacaugauu

SEQ ID NO: 58580 - RNA, 19 nt, Homo sapiens
gauaaagagucaaauaugg

SEQ ID NO: 58581 - RNA, 19 nt, Homo sapiens
gaaauaacauggccugcau

SEQ ID NO: 58582 - RNA, 19 nt, Homo sapiens
gcuccaaacuucauuguug

SEQ ID NO: 58583 - RNA, 19 nt, Homo sapiens
guacugcucuuagaaugua

SEQ ID NO: 58584 - RNA, 19 nt, Homo sapiens
ggaagugccucaugcugaa

SEQ ID NO: 58585 - RNA, 19 nt, Homo sapiens
ggagaaagcaugagcaaug

SEQ ID NO: 58586 - RNA, 19 nt, Homo sapiens
ggaacuauauucacagcaa

SEQ ID NO: 58587 - RNA, 19 nt, Homo sapiens
uaagaguacucaugaauuc

SEQ ID NO: 58588 - RNA, 19 nt, Homo sapiens
ggaacaggaugaugaagau

SEQ ID NO: 58589 - RNA, 19 nt, Homo sapiens
ggagugauaucuucagcuu

SEQ ID NO: 58590 - RNA, 19 nt, Homo sapiens
gaacuauauucacagcaaa

SEQ ID NO: 58591 - RNA, 19 nt, Homo sapiens
guucuauucugcccacuua

SEQ ID NO: 58592 - RNA, 19 nt, Homo sapiens
gaauaagaguacucaugaa

SEQ ID NO: 58593 - RNA, 19 nt, Homo sapiens
gaauggcaauguaaacuuc

SEQ ID NO: 58594 - RNA, 19 nt, Homo sapiens
gaacagcuauuaaaacaga

SEQ ID NO: 58595 - RNA, 19 nt, Homo sapiens
caacaacaauacagguuau

SEQ ID NO: 58596 - RNA, 19 nt, Homo sapiens
gcaacaacaauacagguua

SEQ ID NO: 58597 - RNA, 19 nt, Homo sapiens
gaagauggaaacaaagaaa

SEQ ID NO: 58598 - RNA, 19 nt, Homo sapiens
caggaaagguccgagguua

SEQ ID NO: 58599 - RNA, 19 nt, Homo sapiens
gcaagugcaugacugugaa

SEQ ID NO: 58600 - RNA, 19 nt, Homo sapiens
acagugaccuccaucaauu

SEQ ID NO: 58601 - RNA, 19 nt, Homo sapiens
ggauauagacaguccuuaa

SEQ ID NO: 58602 - RNA, 19 nt, Homo sapiens
ucacacaacuccaaacaca

SEQ ID NO: 58603 - RNA, 19 nt, Homo sapiens
gacccaagauucaucaguu

SEQ ID NO: 58604 - RNA, 19 nt, Homo sapiens
ugaaucugcucacuuuaaa

SEQ ID NO: 58605 - RNA, 19 nt, Homo sapiens
gucaucaucuuccaucuuu

SEQ ID NO: 58606 - RNA, 19 nt, Homo sapiens
ccagacaauuucauacuug

SEQ ID NO: 58607 - RNA, 19 nt, Homo sapiens
gugaguuccuauccaaaua

SEQ ID NO: 58608 - RNA, 19 nt, Homo sapiens
caagauucaucaguuauug

SEQ ID NO: 58609 - RNA, 19 nt, Homo sapiens
gauauagacaguccuuaaa

SEQ ID NO: 58610 - RNA, 19 nt, Homo sapiens
ugaauaagaguacucauga

SEQ ID NO: 58611 - RNA, 19 nt, Homo sapiens
gaugcuggaugugugaaua

SEQ ID NO: 58612 - RNA, 19 nt, Homo sapiens
auaugaaucugcucacuuu

SEQ ID NO: 58613 - RNA, 19 nt, Homo sapiens
ccagaauggcaguguauua

SEQ ID NO: 58614 - RNA, 19 nt, Homo sapiens
caaagaagggugugaaaca

SEQ ID NO: 58615 - RNA, 19 nt, Homo sapiens
gaagagaauuuuccugaga

SEQ ID NO: 58616 - RNA, 19 nt, Homo sapiens
gaauguaagcguucacgaa

SEQ ID NO: 58617 - RNA, 19 nt, Homo sapiens
uaacauggccugcauuucu

SEQ ID NO: 58618 - RNA, 19 nt, Homo sapiens
gugcaugacugugaaauca

SEQ ID NO: 58619 - RNA, 19 nt, Homo sapiens
ugagaaugcuuuacaugau

SEQ ID NO: 58620 - RNA, 19 nt, Homo sapiens
ccagagaguuccugcaaca

SEQ ID NO: 58621 - RNA, 19 nt, Homo sapiens
ggaugaugaagaugauuua

SEQ ID NO: 58622 - RNA, 19 nt, Homo sapiens
guaauaggcuaauuguacu

SEQ ID NO: 58623 - RNA, 19 nt, Homo sapiens
gguauucgcugcaacaaaa

SEQ ID NO: 58624 - RNA, 19 nt, Homo sapiens
gcaaagaugcuggaugugu

SEQ ID NO: 58625 - RNA, 19 nt, Homo sapiens
gaaucaggguucagagcuu

SEQ ID NO: 58626 - RNA, 19 nt, Homo sapiens
ggauauguggaaugaauuu

SEQ ID NO: 58627 - RNA, 19 nt, Homo sapiens
gcaacaaaccauggaacua

SEQ ID NO: 58628 - RNA, 19 nt, Homo sapiens
gcacauguuuaugaaguuc

SEQ ID NO: 58629 - RNA, 19 nt, Homo sapiens
ccagugaguuccuauccaa

SEQ ID NO: 58630 - RNA, 19 nt, Homo sapiens
ucagcagacuuccuucaaa

SEQ ID NO: 58631 - RNA, 19 nt, Homo sapiens
ggaaagguccgagguuaau

SEQ ID NO: 58632 - RNA, 19 nt, Homo sapiens
gagaaagcaugagcaaugg

SEQ ID NO: 58633 - RNA, 19 nt, Homo sapiens
gaauugagagcccagaaau

SEQ ID NO: 58634 - RNA, 19 nt, Homo sapiens
gagaguuccugcaacaaca

SEQ ID NO: 58635 - RNA, 19 nt, Homo sapiens
gaagaaauaccacaaugac

SEQ ID NO: 58636 - RNA, 19 nt, Homo sapiens
caaugacccucuuggugaa

SEQ ID NO: 58637 - RNA, 19 nt, Homo sapiens
gggaacccaugggaugaua

SEQ ID NO: 58638 - RNA, 19 nt, Homo sapiens
gcuccuacacuuccugaua

SEQ ID NO: 58639 - RNA, 19 nt, Homo sapiens
gcacacaaaagaagcauua

SEQ ID NO: 58640 - RNA, 19 nt, Homo sapiens
gaacugagagcgccauguc

SEQ ID NO: 58641 - RNA, 19 nt, Homo sapiens
guacaacagugaccuccau

SEQ ID NO: 58642 - RNA, 19 nt, Homo sapiens
ggcaaaagcugaagaaagu

SEQ ID NO: 58643 - RNA, 19 nt, Homo sapiens
cagcacauguuuaugaagu

SEQ ID NO: 58644 - RNA, 19 nt, Homo sapiens
gaaagacuaaagccaucua

SEQ ID NO: 58645 - RNA, 19 nt, Homo sapiens
aagaagaaauaccacaaug

SEQ ID NO: 58646 - RNA, 19 nt, Homo sapiens
gaagauccaccagaugcua

SEQ ID NO: 58647 - RNA, 19 nt, Homo sapiens
ggucagaguauagauauga

SEQ ID NO: 58648 - RNA, 19 nt, Homo sapiens
ggacccaguugauggaaag

SEQ ID NO: 58649 - RNA, 19 nt, Homo sapiens
gcagaauggaugcagauga

SEQ ID NO: 58650 - RNA, 19 nt, Homo sapiens
guacaaccaugggauugga

SEQ ID NO: 58651 - RNA, 19 nt, Homo sapiens
uaauuguacugcucuuaga

SEQ ID NO: 58652 - RNA, 19 nt, Homo sapiens
caacuugcgucuacaccau

SEQ ID NO: 58653 - RNA, 19 nt, Homo sapiens
guuccuauccaaauacuuu

SEQ ID NO: 58654 - RNA, 19 nt, Homo sapiens
cagaauggaugcagaugag

SEQ ID NO: 58655 - RNA, 19 nt, Homo sapiens
ugaaugggaaagauacaua

SEQ ID NO: 58656 - RNA, 19 nt, Homo sapiens
gaauggaugcagaugaguu

SEQ ID NO: 58657 - RNA, 19 nt, Homo sapiens
uugagcagguuguuaugua

SEQ ID NO: 58658 - RNA, 19 nt, Homo sapiens
caacaaaccauggaacuac

SEQ ID NO: 58659 - RNA, 19 nt, Homo sapiens
aaucauucauggagacauu

SEQ ID NO: 58660 - RNA, 19 nt, Homo sapiens
cagcuauggaacauuauua

SEQ ID NO: 58661 - RNA, 19 nt, Homo sapiens
ccaucaagcccaagacuga

SEQ ID NO: 58662 - RNA, 19 nt, Homo sapiens
acccaagauucaucaguua

SEQ ID NO: 58663 - RNA, 19 nt, Homo sapiens
aaagaagcauuagguuuca

SEQ ID NO: 58664 - RNA, 19 nt, Homo sapiens
cgaagagugaucacgauuu

SEQ ID NO: 58665 - RNA, 19 nt, Homo sapiens
agagcuuucuggagugaua

SEQ ID NO: 58666 - RNA, 19 nt, Homo sapiens
gacauuaaaccagacaauu

SEQ ID NO: 58667 - RNA, 19 nt, Homo sapiens
caacagugaccuccaucaa

SEQ ID NO: 58668 - RNA, 19 nt, Homo sapiens
gaucaaagaagggugugaa

SEQ ID NO: 58669 - RNA, 19 nt, Homo sapiens
gcaaggagaagcuuauucg

SEQ ID NO: 58670 - RNA, 19 nt, Homo sapiens
cguaauaggcuaauuguac

SEQ ID NO: 58671 - RNA, 19 nt, Homo sapiens
ggaagaagaucuagaugua

SEQ ID NO: 58672 - RNA, 19 nt, Homo sapiens
caagauggcuguauuguuu

SEQ ID NO: 58673 - RNA, 19 nt, Homo sapiens
gaaagcagaugcgauauuu

SEQ ID NO: 58674 - RNA, 19 nt, Homo sapiens
gagaauaccuaauauguga

SEQ ID NO: 58675 - RNA, 19 nt, Homo sapiens
caauacagcuucacugaua

SEQ ID NO: 58676 - RNA, 19 nt, Homo sapiens
aagaaacucugcagaauua

SEQ ID NO: 58677 - RNA, 19 nt, Homo sapiens
ggaacaaccucauucuaaa

SEQ ID NO: 58678 - RNA, 19 nt, Homo sapiens
gcaaugagccuuuggauau

SEQ ID NO: 58679 - RNA, 19 nt, Homo sapiens
gaaucugccuguaacaaua

SEQ ID NO: 58680 - RNA, 19 nt, Homo sapiens
gaagauuuaugcaggagua

SEQ ID NO: 58681 - RNA, 19 nt, Homo sapiens
gagcagaaaugcagaaaca

SEQ ID NO: 58682 - RNA, 19 nt, Homo sapiens
gaagaugugucuccagaug

SEQ ID NO: 58683 - RNA, 19 nt, Homo sapiens
gaaaugacccucuggaugu

SEQ ID NO: 58684 - RNA, 19 nt, Homo sapiens
gugaauauauuacccauga

SEQ ID NO: 58685 - RNA, 19 nt, Homo sapiens
gauggugaauuguggaaua

SEQ ID NO: 58686 - RNA, 19 nt, Homo sapiens
agaaagagcuguagaagca

SEQ ID NO: 58687 - RNA, 19 nt, Homo sapiens
gaaacgggcauuugaauau

SEQ ID NO: 58688 - RNA, 19 nt, Homo sapiens
gaaacuguaugugcuguaa

SEQ ID NO: 58689 - RNA, 19 nt, Homo sapiens
gcaagcaccuccuccauca

SEQ ID NO: 58690 - RNA, 19 nt, Homo sapiens
aagagaagaugauguauug

SEQ ID NO: 58691 - RNA, 19 nt, Homo sapiens
agaagacacuugugacuuu

SEQ ID NO: 58692 - RNA, 19 nt, Homo sapiens
gcagacagcuacugaaguc

SEQ ID NO: 58693 - RNA, 19 nt, Homo sapiens
gaaagcaucaccucaaaug

SEQ ID NO: 58694 - RNA, 19 nt, Homo sapiens
caagaacaaucaagcuuug

SEQ ID NO: 58695 - RNA, 19 nt, Homo sapiens
gagaagaugauguauugua

SEQ ID NO: 58696 - RNA, 19 nt, Homo sapiens
gagcagaacuauccucaag

SEQ ID NO: 58697 - RNA, 19 nt, Homo sapiens
gcuaaaagauggugaauug

SEQ ID NO: 58698 - RNA, 19 nt, Homo sapiens
ggagacaacuaaacugcaa

SEQ ID NO: 58699 - RNA, 19 nt, Homo sapiens
gcacaagaaucugccugua

SEQ ID NO: 58700 - RNA, 19 nt, Homo sapiens
acagaaggcugaaccacua

SEQ ID NO: 58701 - RNA, 19 nt, Homo sapiens
aaacuucacuugcggagaa

SEQ ID NO: 58702 - RNA, 19 nt, Homo sapiens
gaaacagauugaagagaug

SEQ ID NO: 58703 - RNA, 19 nt, Homo sapiens
cagaaagccuggaaaggaa

SEQ ID NO: 58704 - RNA, 19 nt, Homo sapiens
gaaggagaguaauauguca

SEQ ID NO: 58705 - RNA, 19 nt, Homo sapiens
ggagaugaaugggaacuga

SEQ ID NO: 58706 - RNA, 19 nt, Homo sapiens
gaaugacucuauccaguuc

SEQ ID NO: 58707 - RNA, 19 nt, Homo sapiens
gcaaucaagucucacagau

SEQ ID NO: 58708 - RNA, 19 nt, Homo sapiens
cagaaagcaucaccucaaa

SEQ ID NO: 58709 - RNA, 19 nt, Homo sapiens
cuacaaaggagacaacuaa

SEQ ID NO: 58710 - RNA, 19 nt, Homo sapiens
gaaauucgggcugaaguuu

SEQ ID NO: 58711 - RNA, 19 nt, Homo sapiens
ccaagaaacucugcagaau

SEQ ID NO: 58712 - RNA, 19 nt, Homo sapiens
ggaagagacugcacaacag

SEQ ID NO: 58713 - RNA, 19 nt, Homo sapiens
ucaaauuccugagaaacua

SEQ ID NO: 58714 - RNA, 19 nt, Homo sapiens
gaagagacgaugccuacaa

SEQ ID NO: 58715 - RNA, 19 nt, Homo sapiens
agaaagagaagaugaugua

SEQ ID NO: 58716 - RNA, 19 nt, Homo sapiens
gcagaacuauccucaaggu

SEQ ID NO: 58717 - RNA, 19 nt, Homo sapiens
guggaacacugaaacugua

SEQ ID NO: 58718 - RNA, 19 nt, Homo sapiens
uagcagauuuagcacauuu

SEQ ID NO: 58719 - RNA, 19 nt, Homo sapiens
ccaacacagugaauauauu

SEQ ID NO: 58720 - RNA, 19 nt, Homo sapiens
gaagaagaucuagauguaa

SEQ ID NO: 58721 - RNA, 19 nt, Homo sapiens
gaacaggugaucagcaaga

SEQ ID NO: 58722 - RNA, 19 nt, Homo sapiens
uugaagagauggagaagaa

SEQ ID NO: 58723 - RNA, 19 nt, Homo sapiens
gcacaacagccaguuauga

SEQ ID NO: 58724 - RNA, 19 nt, Homo sapiens
gaaagaagaagaggaggaa

SEQ ID NO: 58725 - RNA, 19 nt, Homo sapiens
gacaaaagauccuggcuaa

SEQ ID NO: 58726 - RNA, 19 nt, Homo sapiens
gaagacacuugugacuuug

SEQ ID NO: 58727 - RNA, 19 nt, Homo sapiens
gagcgaggaugccauuauc

SEQ ID NO: 58728 - RNA, 19 nt, Homo sapiens
agaaacagauugaagagau

SEQ ID NO: 58729 - RNA, 19 nt, Homo sapiens
ggaaagcagaugcgauauu

SEQ ID NO: 58730 - RNA, 19 nt, Homo sapiens
ggacagagcagaacuaucc

SEQ ID NO: 58731 - RNA, 19 nt, Homo sapiens
guagggaaguuaacuaguc

SEQ ID NO: 58732 - RNA, 19 nt, Homo sapiens
caagaaacucugcagaauu

SEQ ID NO: 58733 - RNA, 19 nt, Homo sapiens
gcaaagggaagccgagcua

SEQ ID NO: 58734 - RNA, 19 nt, Homo sapiens
gaauaugaagcuagagaaa

SEQ ID NO: 58735 - RNA, 19 nt, Homo sapiens
gcagaagaauaugaagcua

SEQ ID NO: 58736 - RNA, 19 nt, Homo sapiens
ggaaugacucuauccaguu

SEQ ID NO: 58737 - RNA, 19 nt, Homo sapiens
gcagaaaugcagaaacaga

SEQ ID NO: 58738 - RNA, 19 nt, Homo sapiens
gagaagaaagagaagauga

SEQ ID NO: 58739 - RNA, 19 nt, Homo sapiens
agaagaauaugaagcuaga

SEQ ID NO: 58740 - RNA, 19 nt, Homo sapiens
gaggauuacugcauuaaac

SEQ ID NO: 58741 - RNA, 19 nt, Homo sapiens
ucaagaagcugagcccaau

SEQ ID NO: 58742 - RNA, 19 nt, Homo sapiens
cacacuagcugaacuaaag

SEQ ID NO: 58743 - RNA, 19 nt, Homo sapiens
uaggaaagcagaugcgaua

SEQ ID NO: 58744 - RNA, 19 nt, Homo sapiens
ucagagcaaugguuguauu

SEQ ID NO: 58745 - RNA, 19 nt, Homo sapiens
gagggcagguugcggaaga

SEQ ID NO: 58746 - RNA, 19 nt, Homo sapiens
gaaaugcagaaacagauug

SEQ ID NO: 58747 - RNA, 19 nt, Homo sapiens
gcagaaacgggcauuugaa

SEQ ID NO: 58748 - RNA, 19 nt, Homo sapiens
agaguaauaugucaacguu

SEQ ID NO: 58749 - RNA, 19 nt, Homo sapiens
gaagaaagagaagaugaug

SEQ ID NO: 58750 - RNA, 19 nt, Homo sapiens
ccgcugugcuucccaguuu

SEQ ID NO: 58751 - RNA, 19 nt, Homo sapiens
gaacagaggacuccaaaau

SEQ ID NO: 58752 - RNA, 19 nt, Homo sapiens
cuaaacagacucauuacaa

SEQ ID NO: 58753 - RNA, 19 nt, Homo sapiens
gcacuaccauugcuguucu

SEQ ID NO: 58754 - RNA, 19 nt, Homo sapiens
gcuaggcaaucaagucuca

SEQ ID NO: 58755 - RNA, 19 nt, Homo sapiens
ucagugagcuaggcaauca

SEQ ID NO: 58756 - RNA, 19 nt, Homo sapiens
ggugaauuguggaauaaau

SEQ ID NO: 58757 - RNA, 19 nt, Homo sapiens
acacaaagcagaaauaguc

SEQ ID NO: 58758 - RNA, 19 nt, Homo sapiens
gcagaguuguguauagaag

SEQ ID NO: 58759 - RNA, 19 nt, Homo sapiens
caguguaccuuucuccauu

SEQ ID NO: 58760 - RNA, 19 nt, Homo sapiens
aagagacgaugccuacaaa

SEQ ID NO: 58761 - RNA, 19 nt, Homo sapiens
ggaagggauucaacagaag

SEQ ID NO: 58762 - RNA, 19 nt, Homo sapiens
cuuuggauauguacaguua

SEQ ID NO: 58763 - RNA, 19 nt, Homo sapiens
ggaaggagaguaauauguc

SEQ ID NO: 58764 - RNA, 19 nt, Homo sapiens
gagaaacuagaacuuacua

SEQ ID NO: 58765 - RNA, 19 nt, Homo sapiens
ucaaaugucuucaaauucc

SEQ ID NO: 58766 - RNA, 19 nt, Homo sapiens
gaacaaccucauucuaaag

SEQ ID NO: 58767 - RNA, 19 nt, Homo sapiens
uaccauugcuguucuacuu

SEQ ID NO: 58768 - RNA, 19 nt, Homo sapiens
ugaagucccuaccagaguu

SEQ ID NO: 58769 - RNA, 19 nt, Homo sapiens
gaagcugagcccaauuauu

SEQ ID NO: 58770 - RNA, 19 nt, Homo sapiens
uagcugaacuaaagagcaa

SEQ ID NO: 58771 - RNA, 19 nt, Homo sapiens
gagaugacguugcugaaua

SEQ ID NO: 58772 - RNA, 19 nt, Homo sapiens
ggagaaggcugccacaaug

SEQ ID NO: 58773 - RNA, 19 nt, Homo sapiens
ccauagagauguucaugaa

SEQ ID NO: 58774 - RNA, 19 nt, Homo sapiens
ugacguugcugaauacaaa

SEQ ID NO: 58775 - RNA, 19 nt, Homo sapiens
caacuuccaucucuacaug

SEQ ID NO: 58776 - RNA, 19 nt, Homo sapiens
cuacauggcucucaagaag

SEQ ID NO: 58777 - RNA, 19 nt, Homo sapiens
uggagaagcugacugagaa

SEQ ID NO: 58778 - RNA, 19 nt, Homo sapiens
agacagagguugagacagu

SEQ ID NO: 58779 - RNA, 19 nt, Homo sapiens
ccacagcuaucgcccgaaa

SEQ ID NO: 58780 - RNA, 19 nt, Homo sapiens
gaagaugacacugagcuuu

SEQ ID NO: 58781 - RNA, 19 nt, Homo sapiens
gaaaauugcugagauggaa

SEQ ID NO: 58782 - RNA, 19 nt, Homo sapiens
gagaagcggaggaagagua

SEQ ID NO: 58783 - RNA, 19 nt, Homo sapiens
ggacugcagcugccaugua

SEQ ID NO: 58784 - RNA, 19 nt, Homo sapiens
aggcaaagacagauauuua

SEQ ID NO: 58785 - RNA, 19 nt, Homo sapiens
ggauaaaggcaaagacaga

SEQ ID NO: 58786 - RNA, 19 nt, Homo sapiens
cgacucaacuuccaucucu

SEQ ID NO: 58787 - RNA, 19 nt, Homo sapiens
gagcuuuaauggcugaaga

SEQ ID NO: 58788 - RNA, 19 nt, Homo sapiens
ucaggucacuguggauaaa

SEQ ID NO: 58789 - RNA, 19 nt, Homo sapiens
aagaugacacugagcuuua

SEQ ID NO: 58790 - RNA, 19 nt, Homo sapiens
ggcaaagacagauauuuau

SEQ ID NO: 58791 - RNA, 19 nt, Homo sapiens
agaaguaugcacugccuua

SEQ ID NO: 58792 - RNA, 19 nt, Homo sapiens
gggagguauuaucuaagua

SEQ ID NO: 58793 - RNA, 19 nt, Homo sapiens
gagaaggcugccacaauga

SEQ ID NO: 58794 - RNA, 19 nt, Homo sapiens
gcaaauccucuacgucaca

SEQ ID NO: 58795 - RNA, 19 nt, Homo sapiens
ccuuaucccuguuuaguuc

SEQ ID NO: 58796 - RNA, 19 nt, Homo sapiens
ugacugaagaugacacuga

SEQ ID NO: 58797 - RNA, 19 nt, Homo sapiens
gcagacagagguugagaca

SEQ ID NO: 58798 - RNA, 19 nt, Homo sapiens
uaaaggcaaagacagauau

SEQ ID NO: 58799 - RNA, 19 nt, Homo sapiens
caacuugagauaccauaug

SEQ ID NO: 58800 - RNA, 19 nt, Homo sapiens
ugagagccaacuugagaua

SEQ ID NO: 58801 - RNA, 19 nt, Homo sapiens
agaugacacugagcuuuaa

SEQ ID NO: 58802 - RNA, 19 nt, Homo sapiens
guucaaagggauccugauu

SEQ ID NO: 58803 - RNA, 19 nt, Homo sapiens
gauccuucccggcaacuuu

SEQ ID NO: 58804 - RNA, 19 nt, Homo sapiens
ugacugagaagcagacaga

SEQ ID NO: 58805 - RNA, 19 nt, Homo sapiens
ucaaagggauccugauucc

SEQ ID NO: 58806 - RNA, 19 nt, Homo sapiens
uccgggagguauuaucuaa

SEQ ID NO: 58807 - RNA, 19 nt, Homo sapiens
gacugcugcuggauaagaa

SEQ ID NO: 58808 - RNA, 19 nt, Homo sapiens
cccaaggcauuuaagauca

SEQ ID NO: 58809 - RNA, 19 nt, Homo sapiens
ucagggcagugacagauca

SEQ ID NO: 58810 - RNA, 19 nt, Homo sapiens
gaauacagcggugccaaca

SEQ ID NO: 58811 - RNA, 19 nt, Homo sapiens
gaauacaaacgacucaacu

SEQ ID NO: 58812 - RNA, 19 nt, Homo sapiens
gacugcagcugccauguac

SEQ ID NO: 58813 - RNA, 19 nt, Homo sapiens
cgggagguauuaucuaagu

SEQ ID NO: 58814 - RNA, 19 nt, Homo sapiens
ggaugagcgugccauagag

SEQ ID NO: 58815 - RNA, 19 nt, Homo sapiens
accagugccuccugacuuu

SEQ ID NO: 58816 - RNA, 19 nt, Homo sapiens
gcccaaggcauuuaagauc

SEQ ID NO: 58817 - RNA, 19 nt, Homo sapiens
guucugagagccaacuuga

SEQ ID NO: 58818 - RNA, 19 nt, Homo sapiens
gcggcuggguccaagaaug

SEQ ID NO: 58819 - RNA, 19 nt, Homo sapiens
guaccaggccaccaggauu

SEQ ID NO: 58820 - RNA, 19 nt, Homo sapiens
ccaaggcauuuaagaucau

SEQ ID NO: 58821 - RNA, 19 nt, Homo sapiens
uggcugacaucaucaugga

SEQ ID NO: 58822 - RNA, 19 nt, Homo sapiens
gaucagggcagugacagau

SEQ ID NO: 58823 - RNA, 19 nt, Homo sapiens
ggacagagaagcgugaacu

SEQ ID NO: 58824 - RNA, 19 nt, Homo sapiens
gauaaaggcaaagacagau

SEQ ID NO: 58825 - RNA, 19 nt, Homo sapiens
ucugagagccaacuugaga

SEQ ID NO: 58826 - RNA, 19 nt, Homo sapiens
acaaacgacucaacuucca

SEQ ID NO: 58827 - RNA, 19 nt, Homo sapiens
gggagcaaauccucuacgu

SEQ ID NO: 58828 - RNA, 19 nt, Homo sapiens
cacccuggcugacaucauc

SEQ ID NO: 58829 - RNA, 19 nt, Homo sapiens
gagauaccauaugcuagca

SEQ ID NO: 58830 - RNA, 19 nt, Homo sapiens
caggagaagcggaggaaga

SEQ ID NO: 58831 - RNA, 19 nt, Homo sapiens
ggagguauuaucuaaguac

SEQ ID NO: 58832 - RNA, 19 nt, Homo sapiens
aagaaugccucaggaugga

SEQ ID NO: 58833 - RNA, 19 nt, Homo sapiens
gaugagcgugccauagaga

SEQ ID NO: 58834 - RNA, 19 nt, Homo sapiens
aaauugcugagauggaaua

SEQ ID NO: 58835 - RNA, 19 nt, Homo sapiens
ugcgacugcugcuggauaa

SEQ ID NO: 58836 - RNA, 19 nt, Homo sapiens
guagcaucaucaccaagug

SEQ ID NO: 58837 - RNA, 19 nt, Homo sapiens
uaccaggccaccaggauuu

SEQ ID NO: 58838 - RNA, 19 nt, Homo sapiens
ucauggagaagcugacuga

SEQ ID NO: 58839 - RNA, 19 nt, Homo sapiens
gguucccucuuccauucua

SEQ ID NO: 58840 - RNA, 19 nt, Homo sapiens
gaaggcugccacaaugaca

SEQ ID NO: 58841 - RNA, 19 nt, Homo sapiens
auaaaggcaaagacagaua

SEQ ID NO: 58842 - RNA, 19 nt, Homo sapiens
cuugagauaccauaugcua

SEQ ID NO: 58843 - RNA, 19 nt, Homo sapiens
gcuggaugcccuagucuuc

SEQ ID NO: 58844 - RNA, 19 nt, Homo sapiens
ggugcuggaugcccuaguc

SEQ ID NO: 58845 - RNA, 19 nt, Homo sapiens
auacaaacgacucaacuuc

SEQ ID NO: 58846 - RNA, 19 nt, Homo sapiens
cugguucccucuuccauuc

SEQ ID NO: 58847 - RNA, 19 nt, Homo sapiens
cgaaaucaggcgugagcuu

SEQ ID NO: 58848 - RNA, 19 nt, Homo sapiens
cgacugcugcuggauaaga

SEQ ID NO: 58849 - RNA, 19 nt, Homo sapiens
gcugaaaauugcugagaug

SEQ ID NO: 58850 - RNA, 19 nt, Homo sapiens
gcagcaagcacggcagcaa

SEQ ID NO: 58851 - RNA, 19 nt, Homo sapiens
cagcuguccuggccaaagg

SEQ ID NO: 58852 - RNA, 19 nt, Homo sapiens
gccauagagauguucauga

SEQ ID NO: 58853 - RNA, 19 nt, Homo sapiens
gcugcuggauaagaaguau

SEQ ID NO: 58854 - RNA, 19 nt, Homo sapiens
gguagcaucaucaccaagu

SEQ ID NO: 58855 - RNA, 19 nt, Homo sapiens
cuaaguaccgcaguggaaa

SEQ ID NO: 58856 - RNA, 19 nt, Homo sapiens
uugcugagauggaauacag

SEQ ID NO: 58857 - RNA, 19 nt, Homo sapiens
aggaugagcgugccauaga

SEQ ID NO: 58858 - RNA, 19 nt, Homo sapiens
ccuggagccugguucaaag

SEQ ID NO: 58859 - RNA, 19 nt, Homo sapiens
gagcgugccauagagaugu

SEQ ID NO: 58860 - RNA, 19 nt, Homo sapiens
ggcuuggugugaguacuuu

SEQ ID NO: 58861 - RNA, 19 nt, Homo sapiens
uggagaaggcugccacaau

SEQ ID NO: 58862 - RNA, 19 nt, Homo sapiens
gacucaacuuccaucucua

SEQ ID NO: 58863 - RNA, 19 nt, Homo sapiens
agaugacguugcugaauac

SEQ ID NO: 58864 - RNA, 19 nt, Homo sapiens
agaagcagacagagguuga

SEQ ID NO: 58865 - RNA, 19 nt, Homo sapiens
gacaggagaagcggaggaa

SEQ ID NO: 58866 - RNA, 19 nt, Homo sapiens
gagccaacuugagauacca

SEQ ID NO: 58867 - RNA, 19 nt, Homo sapiens
ccagugcggccaugcugaa

SEQ ID NO: 58868 - RNA, 19 nt, Homo sapiens
gggcuuggugugaguacuu

SEQ ID NO: 58869 - RNA, 19 nt, Homo sapiens
gcugguucccucuuccauu

SEQ ID NO: 58870 - RNA, 19 nt, Homo sapiens
cgagaugacguugcugaau

SEQ ID NO: 58871 - RNA, 19 nt, Homo sapiens
cagcagagcuucagagguu

SEQ ID NO: 58872 - RNA, 19 nt, Homo sapiens
gcuccuaccuggucuggaa

SEQ ID NO: 58873 - RNA, 19 nt, Homo sapiens
cgaccacacucaacuacug

SEQ ID NO: 58874 - RNA, 19 nt, Homo sapiens
acacucaacuacugcguau

SEQ ID NO: 58875 - RNA, 19 nt, Homo sapiens
ccacugggccugcuagucu

SEQ ID NO: 58876 - RNA, 19 nt, Homo sapiens
cugggaggcuucacagaga

SEQ ID NO: 58877 - RNA, 19 nt, Homo sapiens
ugugcuuucugcaugcuua

SEQ ID NO: 58878 - RNA, 19 nt, Homo sapiens
gcaguguccugugcuuucu

SEQ ID NO: 58879 - RNA, 19 nt, Homo sapiens
cuuggaacauggaauuuua

SEQ ID NO: 58880 - RNA, 19 nt, Homo sapiens
ggccgucacgcuuucauga

SEQ ID NO: 58881 - RNA, 19 nt, Homo sapiens
cuuagagcauguucuugga

SEQ ID NO: 58882 - RNA, 19 nt, Homo sapiens
caggugccaucacgcuugu

SEQ ID NO: 58883 - RNA, 19 nt, Homo sapiens
ugggaggcuucacagagaa

SEQ ID NO: 58884 - RNA, 19 nt, Homo sapiens
cagcagagcuucagagguu

SEQ ID NO: 58885 - RNA, 19 nt, Homo sapiens
gcuccuaccuggucuggaa

SEQ ID NO: 58886 - RNA, 19 nt, Homo sapiens
cgaccacacucaacuacug

SEQ ID NO: 58887 - RNA, 19 nt, Homo sapiens
acacucaacuacugcguau

SEQ ID NO: 58888 - RNA, 19 nt, Homo sapiens
ccacugggccugcuagucu

SEQ ID NO: 58889 - RNA, 19 nt, Homo sapiens
cugggaggcuucacagaga

SEQ ID NO: 58890 - RNA, 19 nt, Homo sapiens
ugugcuuucugcaugcuua

SEQ ID NO: 58891 - RNA, 19 nt, Homo sapiens
gcaguguccugugcuuucu

SEQ ID NO: 58892 - RNA, 19 nt, Homo sapiens
cuuggaacauggaauuuua

SEQ ID NO: 58893 - RNA, 19 nt, Homo sapiens
ggccgucacgcuuucauga

SEQ ID NO: 58894 - RNA, 19 nt, Homo sapiens
cuuagagcauguucuugga

SEQ ID NO: 58895 - RNA, 19 nt, Homo sapiens
caggugccaucacgcuugu

SEQ ID NO: 58896 - RNA, 19 nt, Homo sapiens
ugggaggcuucacagagaa

SEQ ID NO: 58897 - RNA, 19 nt, Homo sapiens
ucaccagacucuauaaaua

SEQ ID NO: 58898 - RNA, 19 nt, Homo sapiens
caagggaccugcuucuauu

SEQ ID NO: 58899 - RNA, 19 nt, Homo sapiens
caacaacaguuaucuccaa

SEQ ID NO: 58900 - RNA, 19 nt, Homo sapiens
gauagagccuccucaaauc

SEQ ID NO: 58901 - RNA, 19 nt, Homo sapiens
ggauagagccuccucaaau

SEQ ID NO: 58902 - RNA, 19 nt, Homo sapiens
caaguucccugucuucaug

SEQ ID NO: 58903 - RNA, 19 nt, Homo sapiens
ggacccagaucuucagguu

SEQ ID NO: 58904 - RNA, 19 nt, Homo sapiens
aaacaaaccuggagagcau

SEQ ID NO: 58905 - RNA, 19 nt, Homo sapiens
gcucucagcccuucuguuu

SEQ ID NO: 58906 - RNA, 19 nt, Homo sapiens
gcaagggaccugcuucuau

SEQ ID NO: 58907 - RNA, 19 nt, Homo sapiens
ugaagaagguggagaccaa

SEQ ID NO: 58908 - RNA, 19 nt, Homo sapiens
gcacccugcuggucuuuga

SEQ ID NO: 58909 - RNA, 19 nt, Homo sapiens
gggaugcuuugguagauuu

SEQ ID NO: 58910 - RNA, 19 nt, Homo sapiens
gaauggaacccuuucacuu

SEQ ID NO: 58911 - RNA, 19 nt, Homo sapiens
ccaagaugcuauucguuga

SEQ ID NO: 58912 - RNA, 19 nt, Homo sapiens
ccagagaguuugcaagaca

SEQ ID NO: 58913 - RNA, 19 nt, Homo sapiens
caccagacucuauaaauaa

SEQ ID NO: 58914 - RNA, 19 nt, Homo sapiens
caacagugacgccaacuug

SEQ ID NO: 58915 - RNA, 19 nt, Homo sapiens
gaaggucgcaacaacaguu

SEQ ID NO: 58916 - RNA, 19 nt, Homo sapiens
ggaacccuuucacuucaaa

SEQ ID NO: 58917 - RNA, 19 nt, Homo sapiens
ccugaaacaucgucuugaa

SEQ ID NO: 58918 - RNA, 19 nt, Homo sapiens
ccaaggacuucaccugugu

SEQ ID NO: 58919 - RNA, 19 nt, Homo sapiens
ccacacaacccaccacaga

SEQ ID NO: 58920 - RNA, 19 nt, Homo sapiens
uaacagcuaauaccacuga

SEQ ID NO: 58921 - RNA, 19 nt, Homo sapiens
ccaagaacaccaacaacaa

SEQ ID NO: 58922 - RNA, 19 nt, Homo sapiens
cuacccagcucccaacaga

SEQ ID NO: 58923 - RNA, 19 nt, Homo sapiens
gccaggauaugcucucaau

SEQ ID NO: 58924 - RNA, 19 nt, Homo sapiens
aaagugcccaugaugaaua

SEQ ID NO: 58925 - RNA, 19 nt, Homo sapiens
gcagcuuucucuaguucaa

SEQ ID NO: 58926 - RNA, 19 nt, Homo sapiens
gcacaaguucccugucuuc

SEQ ID NO: 58927 - RNA, 19 nt, Homo sapiens
cagcuaauaccacugauga

SEQ ID NO: 58928 - RNA, 19 nt, Homo sapiens
ccaaguggaagacaacauu

SEQ ID NO: 58929 - RNA, 19 nt, Homo sapiens
caggauaugcucucaauca

SEQ ID NO: 58930 - RNA, 19 nt, Homo sapiens
caacauuugaucccaagaa

SEQ ID NO: 58931 - RNA, 19 nt, Homo sapiens
caaguucaccagacucuau

SEQ ID NO: 58932 - RNA, 19 nt, Homo sapiens
gaacaccaacaacaagauc

SEQ ID NO: 58933 - RNA, 19 nt, Homo sapiens
caacccacccaaccaacua

SEQ ID NO: 58934 - RNA, 19 nt, Homo sapiens
caacucaacaaccaauuca

SEQ ID NO: 58935 - RNA, 19 nt, Homo sapiens
ugaugaauagcaagaagua

SEQ ID NO: 58936 - RNA, 19 nt, Homo sapiens
gaagguggagaccaacaug

SEQ ID NO: 58937 - RNA, 19 nt, Homo sapiens
cagcacaaguucccugucu

SEQ ID NO: 58938 - RNA, 19 nt, Homo sapiens
caagaacaccaacaacaag

SEQ ID NO: 58939 - RNA, 19 nt, Homo sapiens
gggauagagccuccucaaa

SEQ ID NO: 58940 - RNA, 19 nt, Homo sapiens
uggagaaacuggagauguc

SEQ ID NO: 58941 - RNA, 19 nt, Homo sapiens
caaguggaagacaacauuu

SEQ ID NO: 58942 - RNA, 19 nt, Homo sapiens
acccagaucuucagguuuc

SEQ ID NO: 58943 - RNA, 19 nt, Homo sapiens
gaagggaaggucgcaacaa

SEQ ID NO: 58944 - RNA, 19 nt, Homo sapiens
gacagucugcccuccgaua

SEQ ID NO: 58945 - RNA, 19 nt, Homo sapiens
gcagcagcccuuccucuuc

SEQ ID NO: 58946 - RNA, 19 nt, Homo sapiens
ggauaugcucucaaucaug

SEQ ID NO: 58947 - RNA, 19 nt, Homo sapiens
aacauuugaucccaagaaa

SEQ ID NO: 58948 - RNA, 19 nt, Homo sapiens
gccaagaacaccaacaaca

SEQ ID NO: 58949 - RNA, 19 nt, Homo sapiens
caauucagccaccaaaaua

SEQ ID NO: 58950 - RNA, 19 nt, Homo sapiens
gggaccagcagcacaaguu

SEQ ID NO: 58951 - RNA, 19 nt, Homo sapiens
ugacagaggacccagaucu

SEQ ID NO: 58952 - RNA, 19 nt, Homo sapiens
caagaugcuauucguugaa

SEQ ID NO: 58953 - RNA, 19 nt, Homo sapiens
cugcagcucucccacaauc

SEQ ID NO: 58954 - RNA, 19 nt, Homo sapiens
caagaaaaccagaauggaa

SEQ ID NO: 58955 - RNA, 19 nt, Homo sapiens
caugaugaauagcaagaag

SEQ ID NO: 58956 - RNA, 19 nt, Homo sapiens
ucucagcaaugaagaaggu

SEQ ID NO: 58957 - RNA, 19 nt, Homo sapiens
acaaccaacucaacaacca

SEQ ID NO: 58958 - RNA, 19 nt, Homo sapiens
ccagcccacucuccuaaca

SEQ ID NO: 58959 - RNA, 19 nt, Homo sapiens
ccagaguccuaagcaacaa

SEQ ID NO: 58960 - RNA, 19 nt, Homo sapiens
gacagaggacccagaucuu

SEQ ID NO: 58961 - RNA, 19 nt, Homo sapiens
gugacgaccagccaggaua

SEQ ID NO: 58962 - RNA, 19 nt, Homo sapiens
gaaccugaaacaucgucuu

SEQ ID NO: 58963 - RNA, 19 nt, Homo sapiens
uaaaagugcccaugaugaa

SEQ ID NO: 58964 - RNA, 19 nt, Homo sapiens
aauggaacccuuucacuuc

SEQ ID NO: 58965 - RNA, 19 nt, Homo sapiens
gggcugggcagaacaccaa

SEQ ID NO: 58966 - RNA, 19 nt, Homo sapiens
cccaggauccagagaguuu

SEQ ID NO: 58967 - RNA, 19 nt, Homo sapiens
ccaccaaaauaacagcuaa

SEQ ID NO: 58968 - RNA, 19 nt, Homo sapiens
caacuuggagcucaucaac

SEQ ID NO: 58969 - RNA, 19 nt, Homo sapiens
ucaccucagucucucagau

SEQ ID NO: 58970 - RNA, 19 nt, Homo sapiens
cagcaucgccagccuccuu

SEQ ID NO: 58971 - RNA, 19 nt, Homo sapiens
uaccacgccuucucagcaa

SEQ ID NO: 58972 - RNA, 19 nt, Homo sapiens
gcccugccaugcucuccaa

SEQ ID NO: 58973 - RNA, 19 nt, Homo sapiens
ucuauuagcccuucuccau

SEQ ID NO: 58974 - RNA, 19 nt, Homo sapiens
ggaccagcagcacaaguuc

SEQ ID NO: 58975 - RNA, 19 nt, Homo sapiens
cagaggacccagaucuuca

SEQ ID NO: 58976 - RNA, 19 nt, Homo sapiens
gcucuaccacgccuucuca

SEQ ID NO: 58977 - RNA, 19 nt, Homo sapiens
ccaacucaacaaccaauuc

SEQ ID NO: 58978 - RNA, 19 nt, Homo sapiens
gcuaauaccacugaugaac

SEQ ID NO: 58979 - RNA, 19 nt, Homo sapiens
guuuccagcuugccgacaa

SEQ ID NO: 58980 - RNA, 19 nt, Homo sapiens
gcagcucucccacaaucug

SEQ ID NO: 58981 - RNA, 19 nt, Homo sapiens
guucaccagacucuauaaa

SEQ ID NO: 58982 - RNA, 19 nt, Homo sapiens
aagggaaggucgcaacaac

SEQ ID NO: 58983 - RNA, 19 nt, Homo sapiens
ggcaagggaccugcuucua

SEQ ID NO: 58984 - RNA, 19 nt, Homo sapiens
gggcagaacaccaaaacaa

SEQ ID NO: 58985 - RNA, 19 nt, Homo sapiens
guuacucucugcucugacu

SEQ ID NO: 58986 - RNA, 19 nt, Homo sapiens
gaugaacccaccacacaac

SEQ ID NO: 58987 - RNA, 19 nt, Homo sapiens
aaucauggagaaauuggaa

SEQ ID NO: 58988 - RNA, 19 nt, Homo sapiens
caaccaacucaacaaccaa

SEQ ID NO: 58989 - RNA, 19 nt, Homo sapiens
uugcagcuuucucuaguuc

SEQ ID NO: 58990 - RNA, 19 nt, Homo sapiens
aagggaccugcuucuauua

SEQ ID NO: 58991 - RNA, 19 nt, Homo sapiens
uaaccugugugggcugaca

SEQ ID NO: 58992 - RNA, 19 nt, Homo sapiens
ugacgaccagccaggauau

SEQ ID NO: 58993 - RNA, 19 nt, Homo sapiens
ccauuucauugaccaaacu

SEQ ID NO: 58994 - RNA, 19 nt, Homo sapiens
agggacaccuuugugaaug

SEQ ID NO: 58995 - RNA, 19 nt, Homo sapiens
ggagaccaacauggccuuu

SEQ ID NO: 58996 - RNA, 19 nt, Homo sapiens
gggaaggucgcaacaacag

SEQ ID NO: 58997 - RNA, 19 nt, Homo sapiens
ccagagaaguuaagaaaua

SEQ ID NO: 58998 - RNA, 19 nt, Homo sapiens
gaaauugcaucccuuauug

SEQ ID NO: 58999 - RNA, 19 nt, Homo sapiens
guagagaucugccaaguug

SEQ ID NO: 59000 - RNA, 19 nt, Homo sapiens
gagcacauccuuuaauuaa

SEQ ID NO: 59001 - RNA, 19 nt, Homo sapiens
caacacgggcuuauaauuu

SEQ ID NO: 59002 - RNA, 19 nt, Homo sapiens
ugacagaggaugugaguua

SEQ ID NO: 59003 - RNA, 19 nt, Homo sapiens
gaagagaacccuaccugaa

SEQ ID NO: 59004 - RNA, 19 nt, Homo sapiens
gaaaugggcacauaaucaa

SEQ ID NO: 59005 - RNA, 19 nt, Homo sapiens
gcaauguccuucagucuuc

SEQ ID NO: 59006 - RNA, 19 nt, Homo sapiens
gaguuaagauugcuuggaa

SEQ ID NO: 59007 - RNA, 19 nt, Homo sapiens
aaagaugccuugccuguug

SEQ ID NO: 59008 - RNA, 19 nt, Homo sapiens
ggaaguaagggaaauaaga

SEQ ID NO: 59009 - RNA, 19 nt, Homo sapiens
aauagaagcuggagugaug

SEQ ID NO: 59010 - RNA, 19 nt, Homo sapiens
guucagaaaugggcacaua

SEQ ID NO: 59011 - RNA, 19 nt, Homo sapiens
gaagacaucauuuaagauc

SEQ ID NO: 59012 - RNA, 19 nt, Homo sapiens
gaaccaaagcuuucaggaa

SEQ ID NO: 59013 - RNA, 19 nt, Homo sapiens
ugaauaugcugacagaaga

SEQ ID NO: 59014 - RNA, 19 nt, Homo sapiens
gaccagagaaguuaagaaa

SEQ ID NO: 59015 - RNA, 19 nt, Homo sapiens
gaggccagaugaauagaaa

SEQ ID NO: 59016 - RNA, 19 nt, Homo sapiens
gcaagcauuuguuaagauc

SEQ ID NO: 59017 - RNA, 19 nt, Homo sapiens
cugaagacaucauuuaaga

SEQ ID NO: 59018 - RNA, 19 nt, Homo sapiens
guacagccauccauugcuu

SEQ ID NO: 59019 - RNA, 19 nt, Homo sapiens
gaacuacucagauucacuu

SEQ ID NO: 59020 - RNA, 19 nt, Homo sapiens
ucaaaugcuugcuugcuuu

SEQ ID NO: 59021 - RNA, 19 nt, Homo sapiens
ucacagccauugccaguau

SEQ ID NO: 59022 - RNA, 19 nt, Homo sapiens
gacuaguccugaaugauuu

SEQ ID NO: 59023 - RNA, 19 nt, Homo sapiens
gaauucaccugugcccaaa

SEQ ID NO: 59024 - RNA, 19 nt, Homo sapiens
cauuuaagaucccgaauuc

SEQ ID NO: 59025 - RNA, 19 nt, Homo sapiens
gcuuauaauuugccauuug

SEQ ID NO: 59026 - RNA, 19 nt, Homo sapiens
aaacaucuguggcugcuau

SEQ ID NO: 59027 - RNA, 19 nt, Homo sapiens
aaaggaaaguagacaaguu

SEQ ID NO: 59028 - RNA, 19 nt, Homo sapiens
gcaacacgggcuuauaauu

SEQ ID NO: 59029 - RNA, 19 nt, Homo sapiens
caaguuugauggagagaga

SEQ ID NO: 59030 - RNA, 19 nt, Homo sapiens
gcacuuuacacacauuauu

SEQ ID NO: 59031 - RNA, 19 nt, Homo sapiens
agucagaacuacucagauu

SEQ ID NO: 59032 - RNA, 19 nt, Homo sapiens
gaauagaucggaguagaga

SEQ ID NO: 59033 - RNA, 19 nt, Homo sapiens
ggaugugaguuaucgucua

SEQ ID NO: 59034 - RNA, 19 nt, Homo sapiens
gcaaaauccucucucuauu

SEQ ID NO: 59035 - RNA, 19 nt, Homo sapiens
gccauugccaguauuguua

SEQ ID NO: 59036 - RNA, 19 nt, Homo sapiens
agagacagaucccugaaga

SEQ ID NO: 59037 - RNA, 19 nt, Homo sapiens
gaaaguagacaaguuugau

SEQ ID NO: 59038 - RNA, 19 nt, Homo sapiens
ggaaaguagacaaguuuga

SEQ ID NO: 59039 - RNA, 19 nt, Homo sapiens
gcacagcaauguccuucag

SEQ ID NO: 59040 - RNA, 19 nt, Homo sapiens
gaucugccaaguugccuua

SEQ ID NO: 59041 - RNA, 19 nt, Homo sapiens
ccugaggacuggagaauca

SEQ ID NO: 59042 - RNA, 19 nt, Homo sapiens
aagcuggagugaugaaauu

SEQ ID NO: 59043 - RNA, 19 nt, Homo sapiens
cgacagggccauagugaga

SEQ ID NO: 59044 - RNA, 19 nt, Homo sapiens
ccucagcacuuuacacaca

SEQ ID NO: 59045 - RNA, 19 nt, Homo sapiens
uagcaagcauuuguuaaga

SEQ ID NO: 59046 - RNA, 19 nt, Homo sapiens
ggagagagaggcagagaca

SEQ ID NO: 59047 - RNA, 19 nt, Homo sapiens
gaaauagaagcuggaguga

SEQ ID NO: 59048 - RNA, 19 nt, Homo sapiens
uaaucaaacuagaccaaug

SEQ ID NO: 59049 - RNA, 19 nt, Homo sapiens
cagagcagguaacgccuuu

SEQ ID NO: 59050 - RNA, 19 nt, Homo sapiens
uaagggaaauaagacugua

SEQ ID NO: 59051 - RNA, 19 nt, Homo sapiens
ccuguaaucccaacacuuu

SEQ ID NO: 59052 - RNA, 19 nt, Homo sapiens
ccagacuaguccugaauga

SEQ ID NO: 59053 - RNA, 19 nt, Homo sapiens
ggccaaaucaucaugcaaa

SEQ ID NO: 59054 - RNA, 19 nt, Homo sapiens
ccacagugauugguucaga

SEQ ID NO: 59055 - RNA, 19 nt, Homo sapiens
agacuaguccugaaugauu

SEQ ID NO: 59056 - RNA, 19 nt, Homo sapiens
acagaucccugaagacauc

SEQ ID NO: 59057 - RNA, 19 nt, Homo sapiens
gaggcacugugacaucuug

SEQ ID NO: 59058 - RNA, 19 nt, Homo sapiens
gaaagaugccuugccuguu

SEQ ID NO: 59059 - RNA, 19 nt, Homo sapiens
gaguagagaucugccaagu

SEQ ID NO: 59060 - RNA, 19 nt, Homo sapiens
gaugugaguuaucgucuac

SEQ ID NO: 59061 - RNA, 19 nt, Homo sapiens
agaucuagcugccugaaug

SEQ ID NO: 59062 - RNA, 19 nt, Homo sapiens
gacagaggaugugaguuau

SEQ ID NO: 59063 - RNA, 19 nt, Homo sapiens
agaaauugcaucccuuauu

SEQ ID NO: 59064 - RNA, 19 nt, Homo sapiens
aagagaacccuaccugaaa

SEQ ID NO: 59065 - RNA, 19 nt, Homo sapiens
aacacgggcuuauaauuug

SEQ ID NO: 59066 - RNA, 19 nt, Homo sapiens
ccagugaguugagaucaug

SEQ ID NO: 59067 - RNA, 19 nt, Homo sapiens
ccaaaucaucaugcaaaua

SEQ ID NO: 59068 - RNA, 19 nt, Homo sapiens
gagagggagauauucauga

SEQ ID NO: 59069 - RNA, 19 nt, Homo sapiens
caacagggagagggagaua

SEQ ID NO: 59070 - RNA, 19 nt, Homo sapiens
caauuuagcaagcauuugu

SEQ ID NO: 59071 - RNA, 19 nt, Homo sapiens
agaguucacuuucccuaga

SEQ ID NO: 59072 - RNA, 19 nt, Homo sapiens
ggagagggagauauucaug

SEQ ID NO: 59073 - RNA, 19 nt, Homo sapiens
gaaguaagggaaauaagac

SEQ ID NO: 59074 - RNA, 19 nt, Homo sapiens
ugagcacauccuuuaauua

SEQ ID NO: 59075 - RNA, 19 nt, Homo sapiens
ccuuugagcacauccuuua

SEQ ID NO: 59076 - RNA, 19 nt, Homo sapiens
gaagcuggagugaugaaau

SEQ ID NO: 59077 - RNA, 19 nt, Homo sapiens
agaaaugggcacauaauca

SEQ ID NO: 59078 - RNA, 19 nt, Homo sapiens
gggaauuccuuucaguuuu

SEQ ID NO: 59079 - RNA, 19 nt, Homo sapiens
cuacucagauucacuugca

SEQ ID NO: 59080 - RNA, 19 nt, Homo sapiens
uaaugaaacaggaaaggaa

SEQ ID NO: 59081 - RNA, 19 nt, Homo sapiens
cagaagaaccaaagcuuuc

SEQ ID NO: 59082 - RNA, 19 nt, Homo sapiens
uggaauagaucggaguaga

SEQ ID NO: 59083 - RNA, 19 nt, Homo sapiens
gaagcagagauuccaguga

SEQ ID NO: 59084 - RNA, 19 nt, Homo sapiens
uugagcacauccuuuaauu

SEQ ID NO: 59085 - RNA, 19 nt, Homo sapiens
ggccagaugaauagaaauu

SEQ ID NO: 59086 - RNA, 19 nt, Homo sapiens
gggcuuauaauuugccauu

SEQ ID NO: 59087 - RNA, 19 nt, Homo sapiens
gccaaaucaucaugcaaau

SEQ ID NO: 59088 - RNA, 19 nt, Homo sapiens
caagucagaacuacucaga

SEQ ID NO: 59089 - RNA, 19 nt, Homo sapiens
cuagcugccugaauguauu

SEQ ID NO: 59090 - RNA, 19 nt, Homo sapiens
gcacauaaucaaacuagac

SEQ ID NO: 59091 - RNA, 19 nt, Homo sapiens
ccagcacuaugucaauaug

SEQ ID NO: 59092 - RNA, 19 nt, Homo sapiens
gcagagauuccagugaguu

SEQ ID NO: 59093 - RNA, 19 nt, Homo sapiens
agacacuccucagcacuuu

SEQ ID NO: 59094 - RNA, 19 nt, Homo sapiens
gcccaaagccagacuaguc

SEQ ID NO: 59095 - RNA, 19 nt, Homo sapiens
gccaaucagaguucacuuu

SEQ ID NO: 59096 - RNA, 19 nt, Homo sapiens
ggacugggcuuggggaaga

SEQ ID NO: 59097 - RNA, 19 nt, Homo sapiens
ccauaucgcuggccucuau

SEQ ID NO: 59098 - RNA, 19 nt, Homo sapiens
ggaauaaacaucugugucu

SEQ ID NO: 59099 - RNA, 19 nt, Homo sapiens
gaaccugggcccucuggaa

SEQ ID NO: 59100 - RNA, 19 nt, Homo sapiens
cgugacacaugcucuaaga

SEQ ID NO: 59101 - RNA, 19 nt, Homo sapiens
ggaagaaccguaccagaac

SEQ ID NO: 59102 - RNA, 19 nt, Homo sapiens
gcaacguggucaucuucga

SEQ ID NO: 59103 - RNA, 19 nt, Homo sapiens
gcacuguacccggcuacua

SEQ ID NO: 59104 - RNA, 19 nt, Homo sapiens
ggucaucaccaaccaggaa

SEQ ID NO: 59105 - RNA, 19 nt, Homo sapiens
gcucuaagaagcucguuuc

SEQ ID NO: 59106 - RNA, 19 nt, Homo sapiens
aggaagaaccguaccagaa

SEQ ID NO: 59107 - RNA, 19 nt, Homo sapiens
ccaccucucuggcuuccau

SEQ ID NO: 59108 - RNA, 19 nt, Homo sapiens
cguggcaucccgggaauua

SEQ ID NO: 59109 - RNA, 19 nt, Homo sapiens
gauggcuggugcucugugu

SEQ ID NO: 59110 - RNA, 19 nt, Homo sapiens
ugacacaugcucuaagaag

SEQ ID NO: 59111 - RNA, 19 nt, Homo sapiens
uggcaucccgggaauuaaa

SEQ ID NO: 59112 - RNA, 19 nt, Homo sapiens
gcaccagacgggaagaaag

SEQ ID NO: 59113 - RNA, 19 nt, Homo sapiens
gggcaacguggucaucuuc

SEQ ID NO: 59114 - RNA, 19 nt, Homo sapiens
ucccugggcuucugugaca

SEQ ID NO: 59115 - RNA, 19 nt, Homo sapiens
cgauucgucugcacuguac

SEQ ID NO: 59116 - RNA, 19 nt, Homo sapiens
gaaaggggaggcaggaaga

SEQ ID NO: 59117 - RNA, 19 nt, Homo sapiens
guacccggcuacuacuacu

SEQ ID NO: 59118 - RNA, 19 nt, Homo sapiens
ucgacacggucaucaccaa

SEQ ID NO: 59119 - RNA, 19 nt, Homo sapiens
gcccaggaaacaucaagga

SEQ ID NO: 59120 - RNA, 19 nt, Homo sapiens
ccgauucgucugcacugua

SEQ ID NO: 59121 - RNA, 19 nt, Homo sapiens
ucugugugcuggccauauc

SEQ ID NO: 59122 - RNA, 19 nt, Homo sapiens
gaacaguggucuaauucaa

SEQ ID NO: 59123 - RNA, 19 nt, Homo sapiens
gaagugccaugcucagaaa

SEQ ID NO: 59124 - RNA, 19 nt, Homo sapiens
ggaggcgucugacacagua

SEQ ID NO: 59125 - RNA, 19 nt, Homo sapiens
ggugaaugcugcugaguga

SEQ ID NO: 59126 - RNA, 19 nt, Homo sapiens
gaagggagacccagggauu

SEQ ID NO: 59127 - RNA, 19 nt, Homo sapiens
gugguaaccucucacauug

SEQ ID NO: 59128 - RNA, 19 nt, Homo sapiens
gaaugaaccaugaaugaau

SEQ ID NO: 59129 - RNA, 19 nt, Homo sapiens
gcucagaaauguugguuac

SEQ ID NO: 59130 - RNA, 19 nt, Homo sapiens
ucaccaacaugaacaacaa

SEQ ID NO: 59131 - RNA, 19 nt, Homo sapiens
ccaacaugaacaacaauua

SEQ ID NO: 59132 - RNA, 19 nt, Homo sapiens
ggugguaaccucucacauu

SEQ ID NO: 59133 - RNA, 19 nt, Homo sapiens
aaggaacaguggucuaauu

SEQ ID NO: 59134 - RNA, 19 nt, Homo sapiens
ccaaggaacaguggucuaa

SEQ ID NO: 59135 - RNA, 19 nt, Homo sapiens
gguaaccucucacauuguc

SEQ ID NO: 59136 - RNA, 19 nt, Homo sapiens
gagggaaccugugcgugaa

SEQ ID NO: 59137 - RNA, 19 nt, Homo sapiens
cuacaaggccacccagaaa

SEQ ID NO: 59138 - RNA, 19 nt, Homo sapiens
gacacaguaugaugaugaa

SEQ ID NO: 59139 - RNA, 19 nt, Homo sapiens
gcugcugagugaaugagua

SEQ ID NO: 59140 - RNA, 19 nt, Homo sapiens
cugagugaaugaguaaaua

SEQ ID NO: 59141 - RNA, 19 nt, Homo sapiens
gaaugcugcugagugaaug

SEQ ID NO: 59142 - RNA, 19 nt, Homo sapiens
ugacacaguaugaugauga

SEQ ID NO: 59143 - RNA, 19 nt, Homo sapiens
aaugaaccaugaaugaaug

SEQ ID NO: 59144 - RNA, 19 nt, Homo sapiens
uuccugcucuuuccagaua

SEQ ID NO: 59145 - RNA, 19 nt, Homo sapiens
augaaugaaugaaccauga

SEQ ID NO: 59146 - RNA, 19 nt, Homo sapiens
caguagggcuuggugaaug

SEQ ID NO: 59147 - RNA, 19 nt, Homo sapiens
gaaugaaugaaccaugaau

SEQ ID NO: 59148 - RNA, 19 nt, Homo sapiens
cgacaagaacucacuacug

SEQ ID NO: 59149 - RNA, 19 nt, Homo sapiens
acaguaugaugaugaagau

SEQ ID NO: 59150 - RNA, 19 nt, Homo sapiens
ugaaugaaccaugaaugaa

SEQ ID NO: 59151 - RNA, 19 nt, Homo sapiens
ggaacaguggucuaauuca

SEQ ID NO: 59152 - RNA, 19 nt, Homo sapiens
gcaaggugcccggucucua

SEQ ID NO: 59153 - RNA, 19 nt, Homo sapiens
cgccuucucugccacaaga

SEQ ID NO: 59154 - RNA, 19 nt, Homo sapiens
gccaugcucagaaauguug

SEQ ID NO: 59155 - RNA, 19 nt, Homo sapiens
uugguuacaugaaugaaug

SEQ ID NO: 59156 - RNA, 19 nt, Homo sapiens
gcugagugaaugaguaaau

SEQ ID NO: 59157 - RNA, 19 nt, Homo sapiens
gugccaugcucagaaaugu

SEQ ID NO: 59158 - RNA, 19 nt, Homo sapiens
ugaaugcugcugagugaau

SEQ ID NO: 59159 - RNA, 19 nt, Homo sapiens
caaggugcccggucucuac

SEQ ID NO: 59160 - RNA, 19 nt, Homo sapiens
cacgugaucaccaacauga

SEQ ID NO: 59161 - RNA, 19 nt, Homo sapiens
ccacaagaaccaucaacgu

SEQ ID NO: 59162 - RNA, 19 nt, Homo sapiens
uggagaccauggugaguuc

SEQ ID NO: 59163 - RNA, 19 nt, Homo sapiens
agaagugccaugcucagaa

SEQ ID NO: 59164 - RNA, 19 nt, Homo sapiens
cagcaucccaguacugauc

SEQ ID NO: 59165 - RNA, 19 nt, Homo sapiens
augaaugaaccaugaauga

SEQ ID NO: 59166 - RNA, 19 nt, Homo sapiens
cuccugggccuaaucgaua

SEQ ID NO: 59167 - RNA, 19 nt, Homo sapiens
cacaguaugaugaugaaga

SEQ ID NO: 59168 - RNA, 19 nt, Homo sapiens
guggcaaguucaccugcaa

SEQ ID NO: 59169 - RNA, 19 nt, Homo sapiens
ggcagcaucccaguacuga

SEQ ID NO: 59170 - RNA, 19 nt, Homo sapiens
acaguggucuaauucaacu

SEQ ID NO: 59171 - RNA, 19 nt, Homo sapiens
ugaaugaaugaaccaugaa

SEQ ID NO: 59172 - RNA, 19 nt, Homo sapiens
uaaccucucacauugucuu

SEQ ID NO: 59173 - RNA, 19 nt, Homo sapiens
gugaaucgggagacuacaa

SEQ ID NO: 59174 - RNA, 19 nt, Homo sapiens
cauggugaguucggagaga

SEQ ID NO: 59175 - RNA, 19 nt, Homo sapiens
ccacaggaggcgucugaca

SEQ ID NO: 59176 - RNA, 19 nt, Homo sapiens
gaagggagaacccggcuua

SEQ ID NO: 59177 - RNA, 19 nt, Homo sapiens
gcagauacaagcagaaauu

SEQ ID NO: 59178 - RNA, 19 nt, Homo sapiens
ccucugaacuucuuuagga

SEQ ID NO: 59179 - RNA, 19 nt, Homo sapiens
ccaacagccugaucagauu

SEQ ID NO: 59180 - RNA, 19 nt, Homo sapiens
gaaauuccagucaguguuc

SEQ ID NO: 59181 - RNA, 19 nt, Homo sapiens
gaucugaggacaucucugu

SEQ ID NO: 59182 - RNA, 19 nt, Homo sapiens
guggggagauauauaaaua

SEQ ID NO: 59183 - RNA, 19 nt, Homo sapiens
gcggugugcugcugagguu

SEQ ID NO: 59184 - RNA, 19 nt, Homo sapiens
aagcagaucugaggacauc

SEQ ID NO: 59185 - RNA, 19 nt, Homo sapiens
caaguucaccugcaaaguc

SEQ ID NO: 59186 - RNA, 19 nt, Homo sapiens
cacgagcacuggcaaguuc

SEQ ID NO: 59187 - RNA, 19 nt, Homo sapiens
ucaaaguggucaccuucug

SEQ ID NO: 59188 - RNA, 19 nt, Homo sapiens
gcacccaacagccugauca

SEQ ID NO: 59189 - RNA, 19 nt, Homo sapiens
gauacaagcagaaauucca

SEQ ID NO: 59190 - RNA, 19 nt, Homo sapiens
ucaacgcgguccucaccaa

SEQ ID NO: 59191 - RNA, 19 nt, Homo sapiens
gggcagauacaagcagaaa

SEQ ID NO: 59192 - RNA, 19 nt, Homo sapiens
gcauggacccaccuuacug

SEQ ID NO: 59193 - RNA, 19 nt, Homo sapiens
caaaguggucaccuucugu

SEQ ID NO: 59194 - RNA, 19 nt, Homo sapiens
ccaacccgcagggagauua

SEQ ID NO: 59195 - RNA, 19 nt, Homo sapiens
agucacugcuugugugguu

SEQ ID NO: 59196 - RNA, 19 nt, Homo sapiens
cugggacacuuaaccaaug

SEQ ID NO: 59197 - RNA, 19 nt, Homo sapiens
caaugacuacuacgacaug

SEQ ID NO: 59198 - RNA, 19 nt, Homo sapiens
gaagggguggggagauaua

SEQ ID NO: 59199 - RNA, 19 nt, Homo sapiens
caacagccugaucagauuc

SEQ ID NO: 59200 - RNA, 19 nt, Homo sapiens
caggugaggagggcagaua

SEQ ID NO: 59201 - RNA, 19 nt, Homo sapiens
guucucuccuuccucugaa

SEQ ID NO: 59202 - RNA, 19 nt, Homo sapiens
gcgucaaaguggucaccuu

SEQ ID NO: 59203 - RNA, 19 nt, Homo sapiens
cccaacagccugaucagau

SEQ ID NO: 59204 - RNA, 19 nt, Homo sapiens
cagaaauuccagucagugu

SEQ ID NO: 59205 - RNA, 19 nt, Homo sapiens
ccaaugccuucugguacug

SEQ ID NO: 59206 - RNA, 19 nt, Homo sapiens
aaaccaaucaggucaacuc

SEQ ID NO: 59207 - RNA, 19 nt, Homo sapiens
gguucucuccuuccucuga

SEQ ID NO: 59208 - RNA, 19 nt, Homo sapiens
gcaaguucaccugcaaagu

SEQ ID NO: 59209 - RNA, 19 nt, Homo sapiens
agaaauuccagucaguguu

SEQ ID NO: 59210 - RNA, 19 nt, Homo sapiens
caagcagaaauuccaguca

SEQ ID NO: 59211 - RNA, 19 nt, Homo sapiens
gcagaaagaccguguguga

SEQ ID NO: 59212 - RNA, 19 nt, Homo sapiens
gaucucugcugauaagaaa

SEQ ID NO: 59213 - RNA, 19 nt, Homo sapiens
gaacagaggcagcgcauca

SEQ ID NO: 59214 - RNA, 19 nt, Homo sapiens
gcacagggcauuuggaaga

SEQ ID NO: 59215 - RNA, 19 nt, Homo sapiens
ggaagaacauuggcgaguu

SEQ ID NO: 59216 - RNA, 19 nt, Homo sapiens
caagaucucugcugauaag

SEQ ID NO: 59217 - RNA, 19 nt, Homo sapiens
gucaagaucucugcugaua

SEQ ID NO: 59218 - RNA, 19 nt, Homo sapiens
gaaagaauaggauggaugu

SEQ ID NO: 59219 - RNA, 19 nt, Homo sapiens
gaaagaccgugugugaaau

SEQ ID NO: 59220 - RNA, 19 nt, Homo sapiens
ggaaccaggugcugcauuc

SEQ ID NO: 59221 - RNA, 19 nt, Homo sapiens
ggaaagaaggaauuuaugu

SEQ ID NO: 59222 - RNA, 19 nt, Homo sapiens
ggacugagcccagaauuca

SEQ ID NO: 59223 - RNA, 19 nt, Homo sapiens
ggauggauguguucucuca

SEQ ID NO: 59224 - RNA, 19 nt, Homo sapiens
ccaccgagaucaucaagug

SEQ ID NO: 59225 - RNA, 19 nt, Homo sapiens
gaacagaagggagagaaga

SEQ ID NO: 59226 - RNA, 19 nt, Homo sapiens
acacgggccuugagaaaug

SEQ ID NO: 59227 - RNA, 19 nt, Homo sapiens
caacacgggccuugagaaa

SEQ ID NO: 59228 - RNA, 19 nt, Homo sapiens
acaccaaagugcucaacua

SEQ ID NO: 59229 - RNA, 19 nt, Homo sapiens
uaagggacccgaacacuga

SEQ ID NO: 59230 - RNA, 19 nt, Homo sapiens
agaaagaccgugugugaaa

SEQ ID NO: 59231 - RNA, 19 nt, Homo sapiens
ccaaagugcucaacuacgu

SEQ ID NO: 59232 - RNA, 19 nt, Homo sapiens
aggagaagauugcucauga

SEQ ID NO: 59233 - RNA, 19 nt, Homo sapiens
ucaaguuccuggagccuuu

SEQ ID NO: 59234 - RNA, 19 nt, Homo sapiens
gaaagaaggaauuuauguc

SEQ ID NO: 59235 - RNA, 19 nt, Homo sapiens
ccaagacccuagacgaguu

SEQ ID NO: 59236 - RNA, 19 nt, Homo sapiens
gcccagaauucacuagguu

SEQ ID NO: 59237 - RNA, 19 nt, Homo sapiens
gcaaggcuaccagcucaua

SEQ ID NO: 59238 - RNA, 19 nt, Homo sapiens
ggaccaucauguucuacaa

SEQ ID NO: 59239 - RNA, 19 nt, Homo sapiens
ugagaaauguggcucuugu

SEQ ID NO: 59240 - RNA, 19 nt, Homo sapiens
agaauaggauggauguguu

SEQ ID NO: 59241 - RNA, 19 nt, Homo sapiens
caaugggagugaacaccua

SEQ ID NO: 59242 - RNA, 19 nt, Homo sapiens
ucccaucccucagaaguua

SEQ ID NO: 59243 - RNA, 19 nt, Homo sapiens
gaccugcgcugcaacuaca

SEQ ID NO: 59244 - RNA, 19 nt, Homo sapiens
gaaacaaccacugugauca

SEQ ID NO: 59245 - RNA, 19 nt, Homo sapiens
ggacacccaucucuaaagc

SEQ ID NO: 59246 - RNA, 19 nt, Homo sapiens
ugacaacgauaccuucuac

SEQ ID NO: 59247 - RNA, 19 nt, Homo sapiens
ugauguacuuuaccugaaa

SEQ ID NO: 59248 - RNA, 19 nt, Homo sapiens
gcuggacacccaucucuaa

SEQ ID NO: 59249 - RNA, 19 nt, Homo sapiens
ucaugaagcuaggaaauca

SEQ ID NO: 59250 - RNA, 19 nt, Homo sapiens
gcacagcacagggcauuug

SEQ ID NO: 59251 - RNA, 19 nt, Homo sapiens
gccaugagccauauuacaa

SEQ ID NO: 59252 - RNA, 19 nt, Homo sapiens
gaggauugcagaggauaua

SEQ ID NO: 59253 - RNA, 19 nt, Homo sapiens
acacagacuucuccaacga

SEQ ID NO: 59254 - RNA, 19 nt, Homo sapiens
ccaguuccgugacuacuuc

SEQ ID NO: 59255 - RNA, 19 nt, Homo sapiens
acaagaugcugcugaccuu

SEQ ID NO: 59256 - RNA, 19 nt, Homo sapiens
gagaaauguggcucuugua

SEQ ID NO: 59257 - RNA, 19 nt, Homo sapiens
caugagccauauuacaaga

SEQ ID NO: 59258 - RNA, 19 nt, Homo sapiens
ccagagagcaguguggaaa

SEQ ID NO: 59259 - RNA, 19 nt, Homo sapiens
caacgccucuuuggaugug

SEQ ID NO: 59260 - RNA, 19 nt, Homo sapiens
cuaccaagcuguggaccuu

SEQ ID NO: 59261 - RNA, 19 nt, Homo sapiens
uggacuggaucaagaaaga

SEQ ID NO: 59262 - RNA, 19 nt, Homo sapiens
cccgaaaccugccuaaugg

SEQ ID NO: 59263 - RNA, 19 nt, Homo sapiens
cccaacaacuuugaaacaa

SEQ ID NO: 59264 - RNA, 19 nt, Homo sapiens
ucaacuacguggacuggau

SEQ ID NO: 59265 - RNA, 19 nt, Homo sapiens
gaacacgaagcgcaaagca

SEQ ID NO: 59266 - RNA, 19 nt, Homo sapiens
gggaaagaaggaauuuaug

SEQ ID NO: 59267 - RNA, 19 nt, Homo sapiens
gcuauggcuucuacaccaa

SEQ ID NO: 59268 - RNA, 19 nt, Homo sapiens
ggagaagauugcucaugac

SEQ ID NO: 59269 - RNA, 19 nt, Homo sapiens
cuaauggugacuuccguua

SEQ ID NO: 59270 - RNA, 19 nt, Homo sapiens
agaauucacuagguucgaa

SEQ ID NO: 59271 - RNA, 19 nt, Homo sapiens
ugagccauauuacaagaug

SEQ ID NO: 59272 - RNA, 19 nt, Homo sapiens
guuggaggcuacuucuguu

SEQ ID NO: 59273 - RNA, 19 nt, Homo sapiens
cgggaaagaaggaauuuau

SEQ ID NO: 59274 - RNA, 19 nt, Homo sapiens
gaauaggauggauguguuc

SEQ ID NO: 59275 - RNA, 19 nt, Homo sapiens
ccaacaacuuugaaacaac

SEQ ID NO: 59276 - RNA, 19 nt, Homo sapiens
aaggcugcuucuaugauua

SEQ ID NO: 59277 - RNA, 19 nt, Homo sapiens
gaccaguuguugauaacca

SEQ ID NO: 59278 - RNA, 19 nt, Homo sapiens
ugaaacaaccacugugauc

SEQ ID NO: 59279 - RNA, 19 nt, Homo sapiens
ggucauggaggagaagauu

SEQ ID NO: 59280 - RNA, 19 nt, Homo sapiens
acaaggcccguauccagua

SEQ ID NO: 59281 - RNA, 19 nt, Homo sapiens
ggacuaccgucaggaugag

SEQ ID NO: 59282 - RNA, 19 nt, Homo sapiens
ccucggugcuugccagugu

SEQ ID NO: 59283 - RNA, 19 nt, Homo sapiens
cagcacagggcauuuggaa

SEQ ID NO: 59284 - RNA, 19 nt, Homo sapiens
cuacugccaugagccauau

SEQ ID NO: 59285 - RNA, 19 nt, Homo sapiens
cgugacuacuucauugcua

SEQ ID NO: 59286 - RNA, 19 nt, Homo sapiens
cuagacgaguucaccauca

SEQ ID NO: 59287 - RNA, 19 nt, Homo sapiens
uacguggacuggaucaaga

SEQ ID NO: 59288 - RNA, 19 nt, Homo sapiens
ggaugaguccuacaauuuu

SEQ ID NO: 59289 - RNA, 19 nt, Homo sapiens
gcucaugaagcuaggaaau

SEQ ID NO: 59290 - RNA, 19 nt, Homo sapiens
ggaggcaucaggcuacauc

SEQ ID NO: 59291 - RNA, 19 nt, Homo sapiens
aaagaccgugugugaaauu

SEQ ID NO: 59292 - RNA, 19 nt, Homo sapiens
gaugaguccuacaauuuug

SEQ ID NO: 59293 - RNA, 19 nt, Homo sapiens
aagcaacgccucuuuggau

SEQ ID NO: 59294 - RNA, 19 nt, Homo sapiens
gcaguaagggacccgaaca

SEQ ID NO: 59295 - RNA, 19 nt, Homo sapiens
ggagagcccaggauucaac

SEQ ID NO: 59296 - RNA, 19 nt, Homo sapiens
gaccgugugugaaauucuc

SEQ ID NO: 59297 - RNA, 19 nt, Homo sapiens
guugauaaccacuaagagu

SEQ ID NO: 59298 - RNA, 19 nt, Homo sapiens
aaauguggcucuuguaccu

SEQ ID NO: 59299 - RNA, 19 nt, Homo sapiens
gggaaagaauaggauggau

SEQ ID NO: 59300 - RNA, 19 nt, Homo sapiens
aauggugacuuccguuaca

SEQ ID NO: 59301 - RNA, 19 nt, Homo sapiens
cuguggaccuugaugaaug

SEQ ID NO: 59302 - RNA, 19 nt, Homo sapiens
guacuuuaccugaaacaac

SEQ ID NO: 59303 - RNA, 19 nt, Homo sapiens
ucaagaucucugcugauaa

SEQ ID NO: 59304 - RNA, 19 nt, Homo sapiens
gaggagaagauugcucaug

SEQ ID NO: 59305 - RNA, 19 nt, Homo sapiens
cacagggcauuuggaagaa

SEQ ID NO: 59306 - RNA, 19 nt, Homo sapiens
ccagaugcaagaucaagga

SEQ ID NO: 59307 - RNA, 19 nt, Homo sapiens
gcuggaagcugcgcuacac

SEQ ID NO: 59308 - RNA, 19 nt, Homo sapiens
auggauguguucucucaaa

SEQ ID NO: 59309 - RNA, 19 nt, Homo sapiens
ccaucugccucccugacaa

SEQ ID NO: 59310 - RNA, 19 nt, Homo sapiens
gcaacgccucuuuggaugu

SEQ ID NO: 59311 - RNA, 19 nt, Homo sapiens
gaagagagaucgugcuguu

SEQ ID NO: 59312 - RNA, 19 nt, Homo sapiens
gaacuauguugacuggaua

SEQ ID NO: 59313 - RNA, 19 nt, Homo sapiens
ccacagggauaccuuaauu

SEQ ID NO: 59314 - RNA, 19 nt, Homo sapiens
ccaauuaucccaaaccaua

SEQ ID NO: 59315 - RNA, 19 nt, Homo sapiens
agagaaaucuugggacaua

SEQ ID NO: 59316 - RNA, 19 nt, Homo sapiens
caucaugacugaaagaaga

SEQ ID NO: 59317 - RNA, 19 nt, Homo sapiens
gauaucaucuuccaaacug

SEQ ID NO: 59318 - RNA, 19 nt, Homo sapiens
gauggaagcugcuggaagu

SEQ ID NO: 59319 - RNA, 19 nt, Homo sapiens
ccacagacauaaaugaaug

SEQ ID NO: 59320 - RNA, 19 nt, Homo sapiens
ccagagauguggugcauug

SEQ ID NO: 59321 - RNA, 19 nt, Homo sapiens
ggacaaaucgccagagaug

SEQ ID NO: 59322 - RNA, 19 nt, Homo sapiens
ggaagacacucccaauucu

SEQ ID NO: 59323 - RNA, 19 nt, Homo sapiens
agggauaccuuaauucuuu

SEQ ID NO: 59324 - RNA, 19 nt, Homo sapiens
gagcauguguuuauucauc

SEQ ID NO: 59325 - RNA, 19 nt, Homo sapiens
gcaauuugguccuuacugu

SEQ ID NO: 59326 - RNA, 19 nt, Homo sapiens
gaaauguguuccagucugu

SEQ ID NO: 59327 - RNA, 19 nt, Homo sapiens
ggacauagaaguuccugaa

SEQ ID NO: 59328 - RNA, 19 nt, Homo sapiens
uauguugacuggauaauga

SEQ ID NO: 59329 - RNA, 19 nt, Homo sapiens
ggacagaggagcaguaaca

SEQ ID NO: 59330 - RNA, 19 nt, Homo sapiens
gaguaccuauuguagauaa

SEQ ID NO: 59331 - RNA, 19 nt, Homo sapiens
gaauugugcuggucauaca

SEQ ID NO: 59332 - RNA, 19 nt, Homo sapiens
gagguagaguuugaucaua

SEQ ID NO: 59333 - RNA, 19 nt, Homo sapiens
ggagagaagggcauggaua

SEQ ID NO: 59334 - RNA, 19 nt, Homo sapiens
guaaugcucuugauaucau

SEQ ID NO: 59335 - RNA, 19 nt, Homo sapiens
gacacgagcgaaugauuua

SEQ ID NO: 59336 - RNA, 19 nt, Homo sapiens
gggcauggauagcuguaaa

SEQ ID NO: 59337 - RNA, 19 nt, Homo sapiens
gcugaaagacccagugaaa

SEQ ID NO: 59338 - RNA, 19 nt, Homo sapiens
ggagaaaggguuccaagug

SEQ ID NO: 59339 - RNA, 19 nt, Homo sapiens
ggacuaauccagauacauc

SEQ ID NO: 59340 - RNA, 19 nt, Homo sapiens
ccagagaacccuuugaaga

SEQ ID NO: 59341 - RNA, 19 nt, Homo sapiens
gaguaucacugugcuggua

SEQ ID NO: 59342 - RNA, 19 nt, Homo sapiens
gaacugugcguaugacuca

SEQ ID NO: 59343 - RNA, 19 nt, Homo sapiens
acauugagcugucagagaa

SEQ ID NO: 59344 - RNA, 19 nt, Homo sapiens
gguaugggauucaccucua

SEQ ID NO: 59345 - RNA, 19 nt, Homo sapiens
cagagaacccuuugaagaa

SEQ ID NO: 59346 - RNA, 19 nt, Homo sapiens
ccagagagcacuuuguuug

SEQ ID NO: 59347 - RNA, 19 nt, Homo sapiens
gcuggaaacuucgcuauca

SEQ ID NO: 59348 - RNA, 19 nt, Homo sapiens
gaguaaugcucuugauauc

SEQ ID NO: 59349 - RNA, 19 nt, Homo sapiens
ucacccaucuggacauuga

SEQ ID NO: 59350 - RNA, 19 nt, Homo sapiens
gcacuccuuucuugcacua

SEQ ID NO: 59351 - RNA, 19 nt, Homo sapiens
ccaaugacaagaccaaauu

SEQ ID NO: 59352 - RNA, 19 nt, Homo sapiens
gcugacggcugcucauguu

SEQ ID NO: 59353 - RNA, 19 nt, Homo sapiens
ggagccauauuacuacaug

SEQ ID NO: 59354 - RNA, 19 nt, Homo sapiens
gugaggagccauauuacua

SEQ ID NO: 59355 - RNA, 19 nt, Homo sapiens
aauggaaaguggaguaauu

SEQ ID NO: 59356 - RNA, 19 nt, Homo sapiens
ccagugagguagagaaauc

SEQ ID NO: 59357 - RNA, 19 nt, Homo sapiens
gagcgaaugauuuaaauag

SEQ ID NO: 59358 - RNA, 19 nt, Homo sapiens
guaaagaacuauguugacu

SEQ ID NO: 59359 - RNA, 19 nt, Homo sapiens
gagagcacuuuguuugguu

SEQ ID NO: 59360 - RNA, 19 nt, Homo sapiens
gaauauuuccuccaugaug

SEQ ID NO: 59361 - RNA, 19 nt, Homo sapiens
uguauucacugcacugauu

SEQ ID NO: 59362 - RNA, 19 nt, Homo sapiens
acacacggguaaagaacua

SEQ ID NO: 59363 - RNA, 19 nt, Homo sapiens
agagaacccuuugaagaaa

SEQ ID NO: 59364 - RNA, 19 nt, Homo sapiens
gcacagauuuuguagaugu

SEQ ID NO: 59365 - RNA, 19 nt, Homo sapiens
gcacuauuccacagggaua

SEQ ID NO: 59366 - RNA, 19 nt, Homo sapiens
ccagaaggacgaaccaauu

SEQ ID NO: 59367 - RNA, 19 nt, Homo sapiens
gcgggaaacugccuugaca

SEQ ID NO: 59368 - RNA, 19 nt, Homo sapiens
ccucaaggcggcaagguua

SEQ ID NO: 59369 - RNA, 19 nt, Homo sapiens
gauccgaugcagauauuaa

SEQ ID NO: 59370 - RNA, 19 nt, Homo sapiens
gaacucaaggugugaauac

SEQ ID NO: 59371 - RNA, 19 nt, Homo sapiens
uaacuauccucaggcauau

SEQ ID NO: 59372 - RNA, 19 nt, Homo sapiens
cuaacuauccucaggcaua

SEQ ID NO: 59373 - RNA, 19 nt, Homo sapiens
gguagaguuugaucauaga

SEQ ID NO: 59374 - RNA, 19 nt, Homo sapiens
ggagaaacccacagcagau

SEQ ID NO: 59375 - RNA, 19 nt, Homo sapiens
cagaaggacgaaccaauuu

SEQ ID NO: 59376 - RNA, 19 nt, Homo sapiens
ggugcaacaucuuucuauu

SEQ ID NO: 59377 - RNA, 19 nt, Homo sapiens
uaccuucuguuccuuauga

SEQ ID NO: 59378 - RNA, 19 nt, Homo sapiens
gagagaagauuuugaugug

SEQ ID NO: 59379 - RNA, 19 nt, Homo sapiens
gaagaauugcggaguuaau

SEQ ID NO: 59380 - RNA, 19 nt, Homo sapiens
caugaagaauugcggaguu

SEQ ID NO: 59381 - RNA, 19 nt, Homo sapiens
aauauuuccuccaugauga

SEQ ID NO: 59382 - RNA, 19 nt, Homo sapiens
ccaagucccauacaacaaa

SEQ ID NO: 59383 - RNA, 19 nt, Homo sapiens
ucagagaacugugcguaug

SEQ ID NO: 59384 - RNA, 19 nt, Homo sapiens
cggaguaccuauuguagau

SEQ ID NO: 59385 - RNA, 19 nt, Homo sapiens
ggaaacagggagccaacaa

SEQ ID NO: 59386 - RNA, 19 nt, Homo sapiens
ccaaugcccugcccuaagg

SEQ ID NO: 59387 - RNA, 19 nt, Homo sapiens
cacugucuauguacaauaa

SEQ ID NO: 59388 - RNA, 19 nt, Homo sapiens
gagagaagggcauggauag

SEQ ID NO: 59389 - RNA, 19 nt, Homo sapiens
ggacgaaccaauuuugaua

SEQ ID NO: 59390 - RNA, 19 nt, Homo sapiens
acagggagccaacaaugua

SEQ ID NO: 59391 - RNA, 19 nt, Homo sapiens
gaaacagggagccaacaau

SEQ ID NO: 59392 - RNA, 19 nt, Homo sapiens
gcaauggaaaguggaguaa

SEQ ID NO: 59393 - RNA, 19 nt, Homo sapiens
agagggaacugacccacuu

SEQ ID NO: 59394 - RNA, 19 nt, Homo sapiens
augaugacaugaagaauug

SEQ ID NO: 59395 - RNA, 19 nt, Homo sapiens
gcugguggagcgcucauua

SEQ ID NO: 59396 - RNA, 19 nt, Homo sapiens
uggcaagucuucuuugaca

SEQ ID NO: 59397 - RNA, 19 nt, Homo sapiens
gcacuuuguuugguucugu

SEQ ID NO: 59398 - RNA, 19 nt, Homo sapiens
ugagaaugguaaaguugaa

SEQ ID NO: 59399 - RNA, 19 nt, Homo sapiens
ggaguaauuccaaacugaa

SEQ ID NO: 59400 - RNA, 19 nt, Homo sapiens
ugcaggagaucggcaauuu

SEQ ID NO: 59401 - RNA, 19 nt, Homo sapiens
gaaaucuugggacauagaa

SEQ ID NO: 59402 - RNA, 19 nt, Homo sapiens
cuugugaggagccauauua

SEQ ID NO: 59403 - RNA, 19 nt, Homo sapiens
aguauccacugucuaugua

SEQ ID NO: 59404 - RNA, 19 nt, Homo sapiens
cuuccaaacugaucuaaca

SEQ ID NO: 59405 - RNA, 19 nt, Homo sapiens
agaaguuccugaaggguau

SEQ ID NO: 59406 - RNA, 19 nt, Homo sapiens
ggguaaagaacuauguuga

SEQ ID NO: 59407 - RNA, 19 nt, Homo sapiens
aaacagggagccaacaaug

SEQ ID NO: 59408 - RNA, 19 nt, Homo sapiens
uuagagauguggugcagau

SEQ ID NO: 59409 - RNA, 19 nt, Homo sapiens
cagaggagcaguaacaauc

SEQ ID NO: 59410 - RNA, 19 nt, Homo sapiens
gggauaccuuaauucuuug

SEQ ID NO: 59411 - RNA, 19 nt, Homo sapiens
gcaaagaauuccuuauuga

SEQ ID NO: 59412 - RNA, 19 nt, Homo sapiens
ggagcaaacugaacauuaa

SEQ ID NO: 59413 - RNA, 19 nt, Homo sapiens
uaacaccuaugcagccuua

SEQ ID NO: 59414 - RNA, 19 nt, Homo sapiens
gaacugggacuaacaccua

SEQ ID NO: 59415 - RNA, 19 nt, Homo sapiens
gacaggaucuucagcuuug

SEQ ID NO: 59416 - RNA, 19 nt, Homo sapiens
gagguugucucccaagaaa

SEQ ID NO: 59417 - RNA, 19 nt, Homo sapiens
agaaugaacugcugaacaa

SEQ ID NO: 59418 - RNA, 19 nt, Homo sapiens
ggcaaagaauuccuuauug

SEQ ID NO: 59419 - RNA, 19 nt, Homo sapiens
gaagaggaaugacuaucug

SEQ ID NO: 59420 - RNA, 19 nt, Homo sapiens
caagacagcuguugaccau

SEQ ID NO: 59421 - RNA, 19 nt, Homo sapiens
ccacgagacuuucacauca

SEQ ID NO: 59422 - RNA, 19 nt, Homo sapiens
aaacagcugugugugauaa

SEQ ID NO: 59423 - RNA, 19 nt, Homo sapiens
gaggauggcuucauauugc

SEQ ID NO: 59424 - RNA, 19 nt, Homo sapiens
ugacauagcucugcugaag

SEQ ID NO: 59425 - RNA, 19 nt, Homo sapiens
gggcaaagaauuccuuauu

SEQ ID NO: 59426 - RNA, 19 nt, Homo sapiens
gggagcaaacugaacauua

SEQ ID NO: 59427 - RNA, 19 nt, Homo sapiens
caccaggucuuugaacaua

SEQ ID NO: 59428 - RNA, 19 nt, Homo sapiens
ccaaaguccucaugucugu

SEQ ID NO: 59429 - RNA, 19 nt, Homo sapiens
guagggaccaugagaauga

SEQ ID NO: 59430 - RNA, 19 nt, Homo sapiens
ggacaggaucuucagcuuu

SEQ ID NO: 59431 - RNA, 19 nt, Homo sapiens
gagaaacagcuguguguga

SEQ ID NO: 59432 - RNA, 19 nt, Homo sapiens
agacagcuguugaccauau

SEQ ID NO: 59433 - RNA, 19 nt, Homo sapiens
gagcggagauucagguuuu

SEQ ID NO: 59434 - RNA, 19 nt, Homo sapiens
gagagauccugaacaucaa

SEQ ID NO: 59435 - RNA, 19 nt, Homo sapiens
ucagggagguggugacaga

SEQ ID NO: 59436 - RNA, 19 nt, Homo sapiens
ugacuugacucaugcuugu

SEQ ID NO: 59437 - RNA, 19 nt, Homo sapiens
gacaagcugugccgagguu

SEQ ID NO: 59438 - RNA, 19 nt, Homo sapiens
gaaacagcugugugugaua

SEQ ID NO: 59439 - RNA, 19 nt, Homo sapiens
ggauaugacugaggugauc

SEQ ID NO: 59440 - RNA, 19 nt, Homo sapiens
gugugaggauggcuucaua

SEQ ID NO: 59441 - RNA, 19 nt, Homo sapiens
ugaaugagcuaggguccaa

SEQ ID NO: 59442 - RNA, 19 nt, Homo sapiens
agagagauccugaacauca

SEQ ID NO: 59443 - RNA, 19 nt, Homo sapiens
ccuggcaugucacuauuaa

SEQ ID NO: 59444 - RNA, 19 nt, Homo sapiens
gaacugcugaacaaacaga

SEQ ID NO: 59445 - RNA, 19 nt, Homo sapiens
gagaaugaacugcugaaca

SEQ ID NO: 59446 - RNA, 19 nt, Homo sapiens
caugugggauggagaaaca

SEQ ID NO: 59447 - RNA, 19 nt, Homo sapiens
gauguggacuggagagaac

SEQ ID NO: 59448 - RNA, 19 nt, Homo sapiens
ugacagaccaguuccuaug

SEQ ID NO: 59449 - RNA, 19 nt, Homo sapiens
gaaugacuaucuggacauc

SEQ ID NO: 59450 - RNA, 19 nt, Homo sapiens
ggaaaaugccaacuauaaa

SEQ ID NO: 59451 - RNA, 19 nt, Homo sapiens
ccaccaaucccacccagaa

SEQ ID NO: 59452 - RNA, 19 nt, Homo sapiens
agaaacagcugugugugau

SEQ ID NO: 59453 - RNA, 19 nt, Homo sapiens
gcacacaagcugggaaauc

SEQ ID NO: 59454 - RNA, 19 nt, Homo sapiens
aacgacaacucccgggaua

SEQ ID NO: 59455 - RNA, 19 nt, Homo sapiens
gcacuuccuucucccacau

SEQ ID NO: 59456 - RNA, 19 nt, Homo sapiens
ccaggucuuugaacauaug

SEQ ID NO: 59457 - RNA, 19 nt, Homo sapiens
gaaauccucagggcuccua

SEQ ID NO: 59458 - RNA, 19 nt, Homo sapiens
ucuccuagcugaguaaauc

SEQ ID NO: 59459 - RNA, 19 nt, Homo sapiens
ggaguucuauggugaugac

SEQ ID NO: 59460 - RNA, 19 nt, Homo sapiens
ggacuggagagaacugaau

SEQ ID NO: 59461 - RNA, 19 nt, Homo sapiens
ggaguggaguggacaagcu

SEQ ID NO: 59462 - RNA, 19 nt, Homo sapiens
caaagaauuccuuauugag

SEQ ID NO: 59463 - RNA, 19 nt, Homo sapiens
aacagugucuaucucauga

SEQ ID NO: 59464 - RNA, 19 nt, Homo sapiens
ccucaugucuguccugaac

SEQ ID NO: 59465 - RNA, 19 nt, Homo sapiens
ccucagaacgugaauaucu

SEQ ID NO: 59466 - RNA, 19 nt, Homo sapiens
ggaaagccugggccguaaa

SEQ ID NO: 59467 - RNA, 19 nt, Homo sapiens
ggacaggcuuccgcuuugg

SEQ ID NO: 59468 - RNA, 19 nt, Homo sapiens
gaguaaauccgggucucua

SEQ ID NO: 59469 - RNA, 19 nt, Homo sapiens
gcaccuguagggaccauga

SEQ ID NO: 59470 - RNA, 19 nt, Homo sapiens
ccucaaggcagcaccugua

SEQ ID NO: 59471 - RNA, 19 nt, Homo sapiens
ccuuggcucugcugacaaa

SEQ ID NO: 59472 - RNA, 19 nt, Homo sapiens
ugaggauggcuucauauug

SEQ ID NO: 59473 - RNA, 19 nt, Homo sapiens
ccaacuauaaagaucauga

SEQ ID NO: 59474 - RNA, 19 nt, Homo sapiens
gaaaaugccaacuauaaag

SEQ ID NO: 59475 - RNA, 19 nt, Homo sapiens
cgacaacucccgggauaug

SEQ ID NO: 59476 - RNA, 19 nt, Homo sapiens
gccgccaacccuacucuua

SEQ ID NO: 59477 - RNA, 19 nt, Homo sapiens
gaaugaacugcugaacaaa

SEQ ID NO: 59478 - RNA, 19 nt, Homo sapiens
gcccagaaaguaaagaugu

SEQ ID NO: 59479 - RNA, 19 nt, Homo sapiens
augacuaucuggacaucua

SEQ ID NO: 59480 - RNA, 19 nt, Homo sapiens
gaaauccgacaugccauca

SEQ ID NO: 59481 - RNA, 19 nt, Homo sapiens
aaacagugucuaucucaug

SEQ ID NO: 59482 - RNA, 19 nt, Homo sapiens
caucacggcugugcaagag

SEQ ID NO: 59483 - RNA, 19 nt, Homo sapiens
cacgagacuuucacaucaa

SEQ ID NO: 59484 - RNA, 19 nt, Homo sapiens
gugaggauggcuucauauu

SEQ ID NO: 59485 - RNA, 19 nt, Homo sapiens
gcccucagaacgugaauau

SEQ ID NO: 59486 - RNA, 19 nt, Homo sapiens
cgccaacccuacucuuaug

SEQ ID NO: 59487 - RNA, 19 nt, Homo sapiens
cccaggguuugaugucuuu

SEQ ID NO: 59488 - RNA, 19 nt, Homo sapiens
gagagaacugaaugagcua

SEQ ID NO: 59489 - RNA, 19 nt, Homo sapiens
gacaugccaucauccuucu

SEQ ID NO: 59490 - RNA, 19 nt, Homo sapiens
uaaacagugucuaucucau

SEQ ID NO: 59491 - RNA, 19 nt, Homo sapiens
gugaucagcagccuggaaa

SEQ ID NO: 59492 - RNA, 19 nt, Homo sapiens
aggaaagccugggccguaa

SEQ ID NO: 59493 - RNA, 19 nt, Homo sapiens
agaguguuccugcucauuu

SEQ ID NO: 59494 - RNA, 19 nt, Homo sapiens
gcaccaggucuuugaacau

SEQ ID NO: 59495 - RNA, 19 nt, Homo sapiens
cagugucuaucucaugaug

SEQ ID NO: 59496 - RNA, 19 nt, Homo sapiens
gaaaauggaacugggacua

SEQ ID NO: 59497 - RNA, 19 nt, Homo sapiens
cugguugacuugacucaug

SEQ ID NO: 59498 - RNA, 19 nt, Homo sapiens
uaaauccgggucucuagga

SEQ ID NO: 59499 - RNA, 19 nt, Homo sapiens
caucuucuaccucugaaug

SEQ ID NO: 59500 - RNA, 19 nt, Homo sapiens
ggugacagaccaguuccua

SEQ ID NO: 59501 - RNA, 19 nt, Homo sapiens
ggaaugacuaucuggacau

SEQ ID NO: 59502 - RNA, 19 nt, Homo sapiens
gagcuucgagugugaggau

SEQ ID NO: 59503 - RNA, 19 nt, Homo sapiens
ccucaucuccgaccaaugg

SEQ ID NO: 59504 - RNA, 19 nt, Homo sapiens
ggguggcucucccaagaca

SEQ ID NO: 59505 - RNA, 19 nt, Homo sapiens
caugaugaacaaccaaaug

SEQ ID NO: 59506 - RNA, 19 nt, Homo sapiens
uggaaaaugccaacuauaa

SEQ ID NO: 59507 - RNA, 19 nt, Homo sapiens
acccuacucuuaugacuuc

SEQ ID NO: 59508 - RNA, 19 nt, Homo sapiens
gcgcacacaagcugggaaa

SEQ ID NO: 59509 - RNA, 19 nt, Homo sapiens
ugaaugggagcaaacugaa

SEQ ID NO: 59510 - RNA, 19 nt, Homo sapiens
gcacgauggaggccaaucu

SEQ ID NO: 59511 - RNA, 19 nt, Homo sapiens
gagaauugcuucauacaaa

SEQ ID NO: 59512 - RNA, 19 nt, Homo sapiens
cuacgaagcucaugaauau

SEQ ID NO: 59513 - RNA, 19 nt, Homo sapiens
caacucaccuguaauaaau

SEQ ID NO: 59514 - RNA, 19 nt, Homo sapiens
gagccguucucuacaauua

SEQ ID NO: 59515 - RNA, 19 nt, Homo sapiens
gacaaagccuucuccgaua

SEQ ID NO: 59516 - RNA, 19 nt, Homo sapiens
gaucaacucaccuguaaua

SEQ ID NO: 59517 - RNA, 19 nt, Homo sapiens
gcaggaggcuaaagauauu

SEQ ID NO: 59518 - RNA, 19 nt, Homo sapiens
gaacaucguuucccgaagu

SEQ ID NO: 59519 - RNA, 19 nt, Homo sapiens
ccaaugguguugacagaua

SEQ ID NO: 59520 - RNA, 19 nt, Homo sapiens
ggaacacccucaucaucua

SEQ ID NO: 59521 - RNA, 19 nt, Homo sapiens
agaaaugauugguggauua

SEQ ID NO: 59522 - RNA, 19 nt, Homo sapiens
gaagagaaccagaaacaau

SEQ ID NO: 59523 - RNA, 19 nt, Homo sapiens
gaagaaacacuaccucaug

SEQ ID NO: 59524 - RNA, 19 nt, Homo sapiens
ccaaugacuuugacgagua

SEQ ID NO: 59525 - RNA, 19 nt, Homo sapiens
gaacugaaccuugaugugu

SEQ ID NO: 59526 - RNA, 19 nt, Homo sapiens
gaaacgagcagguggaaau

SEQ ID NO: 59527 - RNA, 19 nt, Homo sapiens
gcagaugacccugaagaua

SEQ ID NO: 59528 - RNA, 19 nt, Homo sapiens
gaggaugacugucuagcuu

SEQ ID NO: 59529 - RNA, 19 nt, Homo sapiens
gaacugccuuugucaucuu

SEQ ID NO: 59530 - RNA, 19 nt, Homo sapiens
ugaggagaauugcuucaua

SEQ ID NO: 59531 - RNA, 19 nt, Homo sapiens
aagaucaacucaccuguaa

SEQ ID NO: 59532 - RNA, 19 nt, Homo sapiens
ggagggaacugccuuuguc

SEQ ID NO: 59533 - RNA, 19 nt, Homo sapiens
guaagcagcucuacaacgu

SEQ ID NO: 59534 - RNA, 19 nt, Homo sapiens
ccaaggagcugcgcaagug

SEQ ID NO: 59535 - RNA, 19 nt, Homo sapiens
gaaggaaucagaaugaaca

SEQ ID NO: 59536 - RNA, 19 nt, Homo sapiens
gauccgagccuacuaugaa

SEQ ID NO: 59537 - RNA, 19 nt, Homo sapiens
cagaagcccuugagcauca

SEQ ID NO: 59538 - RNA, 19 nt, Homo sapiens
gaaccagcuuggcgucuug

SEQ ID NO: 59539 - RNA, 19 nt, Homo sapiens
ggacgaaugccaagacgaa

SEQ ID NO: 59540 - RNA, 19 nt, Homo sapiens
ugaagcagcuggccaaugg

SEQ ID NO: 59541 - RNA, 19 nt, Homo sapiens
ggacaucauugcagaagag

SEQ ID NO: 59542 - RNA, 19 nt, Homo sapiens
ccacugaguuugaggugaa

SEQ ID NO: 59543 - RNA, 19 nt, Homo sapiens
gaacguugaggacuugaaa

SEQ ID NO: 59544 - RNA, 19 nt, Homo sapiens
guaauaaauucgaccucaa

SEQ ID NO: 59545 - RNA, 19 nt, Homo sapiens
gugaaggagugcagaaaga

SEQ ID NO: 59546 - RNA, 19 nt, Homo sapiens
ggacaaagucggcaaguac

SEQ ID NO: 59547 - RNA, 19 nt, Homo sapiens
acaccuaccugaucaugaa

SEQ ID NO: 59548 - RNA, 19 nt, Homo sapiens
ggacccaagugguggagaa

SEQ ID NO: 59549 - RNA, 19 nt, Homo sapiens
gaggagaauugcuucauac

SEQ ID NO: 59550 - RNA, 19 nt, Homo sapiens
caacccagcucugccuuug

SEQ ID NO: 59551 - RNA, 19 nt, Homo sapiens
gaccagaauucuccugcaa

SEQ ID NO: 59552 - RNA, 19 nt, Homo sapiens
cgaagugaguucccagaga

SEQ ID NO: 59553 - RNA, 19 nt, Homo sapiens
gaagauccgagccuacuau

SEQ ID NO: 59554 - RNA, 19 nt, Homo sapiens
gauaggaacacccucauca

SEQ ID NO: 59555 - RNA, 19 nt, Homo sapiens
ggaacaacaacgagaaaga

SEQ ID NO: 59556 - RNA, 19 nt, Homo sapiens
ggucaucgcugugcauuac

SEQ ID NO: 59557 - RNA, 19 nt, Homo sapiens
caacagggaguucaaguca

SEQ ID NO: 59558 - RNA, 19 nt, Homo sapiens
gaucagaagagaccaagga

SEQ ID NO: 59559 - RNA, 19 nt, Homo sapiens
gugggcaacuccaacaauu

SEQ ID NO: 59560 - RNA, 19 nt, Homo sapiens
agacacagaugaccugaag

SEQ ID NO: 59561 - RNA, 19 nt, Homo sapiens
caagaacacuaugauccuu

SEQ ID NO: 59562 - RNA, 19 nt, Homo sapiens
ggccucuucuuaacaaauu

SEQ ID NO: 59563 - RNA, 19 nt, Homo sapiens
caccaauacuuuaauguag

SEQ ID NO: 59564 - RNA, 19 nt, Homo sapiens
gaaguucggccuagagaag

SEQ ID NO: 59565 - RNA, 19 nt, Homo sapiens
cgaagcucaugaauauauu

SEQ ID NO: 59566 - RNA, 19 nt, Homo sapiens
ggauuacgccggugucuuc

SEQ ID NO: 59567 - RNA, 19 nt, Homo sapiens
cagauccacuucaccaaga

SEQ ID NO: 59568 - RNA, 19 nt, Homo sapiens
ggucuucuccacugaguuu

SEQ ID NO: 59569 - RNA, 19 nt, Homo sapiens
ucaaugaacagagauacua

SEQ ID NO: 59570 - RNA, 19 nt, Homo sapiens
caacaacgagaaagacaug

SEQ ID NO: 59571 - RNA, 19 nt, Homo sapiens
ccaagacacccaaguacuu

SEQ ID NO: 59572 - RNA, 19 nt, Homo sapiens
ggagaauugcuucauacaa

SEQ ID NO: 59573 - RNA, 19 nt, Homo sapiens
acagggaguucaagucaga

SEQ ID NO: 59574 - RNA, 19 nt, Homo sapiens
ggaugacugucuagcuuuc

SEQ ID NO: 59575 - RNA, 19 nt, Homo sapiens
ggccaaugguguugacaga

SEQ ID NO: 59576 - RNA, 19 nt, Homo sapiens
ucaacucaccuguaauaaa

SEQ ID NO: 59577 - RNA, 19 nt, Homo sapiens
ucaccaagacacccaagua

SEQ ID NO: 59578 - RNA, 19 nt, Homo sapiens
ggaacugccuuugucaucu

SEQ ID NO: 59579 - RNA, 19 nt, Homo sapiens
aagaaacacuaccucaugu

SEQ ID NO: 59580 - RNA, 19 nt, Homo sapiens
guucaccaauacuuuaaug

SEQ ID NO: 59581 - RNA, 19 nt, Homo sapiens
ggacaaggucucacacucu

SEQ ID NO: 59582 - RNA, 19 nt, Homo sapiens
cagaugacccugaagauag

SEQ ID NO: 59583 - RNA, 19 nt, Homo sapiens
gggagacccucaacgucaa

SEQ ID NO: 59584 - RNA, 19 nt, Homo sapiens
ggacggucauggucaacau

SEQ ID NO: 59585 - RNA, 19 nt, Homo sapiens
ccaacuacaugaaccuaca

SEQ ID NO: 59586 - RNA, 19 nt, Homo sapiens
ggacagcagcgcacguuca

SEQ ID NO: 59587 - RNA, 19 nt, Homo sapiens
uuucaaaguucaccaauac

SEQ ID NO: 59588 - RNA, 19 nt, Homo sapiens
ggaugccacuaugucuaua

SEQ ID NO: 59589 - RNA, 19 nt, Homo sapiens
gcagaagagaacaucguuu

SEQ ID NO: 59590 - RNA, 19 nt, Homo sapiens
gcguguucgugcugaauaa

SEQ ID NO: 59591 - RNA, 19 nt, Homo sapiens
aaagaucaacucaccugua

SEQ ID NO: 59592 - RNA, 19 nt, Homo sapiens
gcagcuggccuucagacaa

SEQ ID NO: 59593 - RNA, 19 nt, Homo sapiens
aaacugacgcagaguaaga

SEQ ID NO: 59594 - RNA, 19 nt, Homo sapiens
agguucagcuguccaauga

SEQ ID NO: 59595 - RNA, 19 nt, Homo sapiens
ggacauauccaugaugacu

SEQ ID NO: 59596 - RNA, 19 nt, Homo sapiens
ucacaguaaugcaggacuu

SEQ ID NO: 59597 - RNA, 19 nt, Homo sapiens
cagaagagaacaucguuuc

SEQ ID NO: 59598 - RNA, 19 nt, Homo sapiens
gcucugccgugaugaacug

SEQ ID NO: 59599 - RNA, 19 nt, Homo sapiens
agaacacuaugauccuuga

SEQ ID NO: 59600 - RNA, 19 nt, Homo sapiens
gaacaacaacgagaaagac

SEQ ID NO: 59601 - RNA, 19 nt, Homo sapiens
cggcuacccuacucuguug

SEQ ID NO: 59602 - RNA, 19 nt, Homo sapiens
ggcagcagaugacccugaa

SEQ ID NO: 59603 - RNA, 19 nt, Homo sapiens
aguuugaggugaaggagua

SEQ ID NO: 59604 - RNA, 19 nt, Homo sapiens
ggaagauccgagccuacua

SEQ ID NO: 59605 - RNA, 19 nt, Homo sapiens
cagcagcgcacguucauca

SEQ ID NO: 59606 - RNA, 19 nt, Homo sapiens
agacagacaagaccaucua

SEQ ID NO: 59607 - RNA, 19 nt, Homo sapiens
aacaagcucugccgugaug

SEQ ID NO: 59608 - RNA, 19 nt, Homo sapiens
gaacaagcucugccgugau

SEQ ID NO: 59609 - RNA, 19 nt, Homo sapiens
acaaagccuucuccgauag

SEQ ID NO: 59610 - RNA, 19 nt, Homo sapiens
gugacaauguaccaugcua

SEQ ID NO: 59611 - RNA, 19 nt, Homo sapiens
gaaaacaggucucuugaaa

SEQ ID NO: 59612 - RNA, 19 nt, Homo sapiens
aagagaagcuacuuuguuu

SEQ ID NO: 59613 - RNA, 19 nt, Homo sapiens
ccuagaaacuuguuagaaa

SEQ ID NO: 59614 - RNA, 19 nt, Homo sapiens
uaauagauguggcuacaaa

SEQ ID NO: 59615 - RNA, 19 nt, Homo sapiens
ggaguccugucauugcuua

SEQ ID NO: 59616 - RNA, 19 nt, Homo sapiens
ucaaagaccuucugcagau

SEQ ID NO: 59617 - RNA, 19 nt, Homo sapiens
gccagugucuuccugcuua

SEQ ID NO: 59618 - RNA, 19 nt, Homo sapiens
auaagaggaugaagugaua

SEQ ID NO: 59619 - RNA, 19 nt, Homo sapiens
caacugaccuacucucaca

SEQ ID NO: 59620 - RNA, 19 nt, Homo sapiens
gucgauauuuccaucauua

SEQ ID NO: 59621 - RNA, 19 nt, Homo sapiens
gccaauaguugcuuuaauc

SEQ ID NO: 59622 - RNA, 19 nt, Homo sapiens
ccacaagguuuccaggauu

SEQ ID NO: 59623 - RNA, 19 nt, Homo sapiens
gcucuuaggcaaucacaua

SEQ ID NO: 59624 - RNA, 19 nt, Homo sapiens
cacaagguuuccaggauua

SEQ ID NO: 59625 - RNA, 19 nt, Homo sapiens
caaacuaagcuaugugaaa

SEQ ID NO: 59626 - RNA, 19 nt, Homo sapiens
gguuagauccuuccucuuu

SEQ ID NO: 59627 - RNA, 19 nt, Homo sapiens
gcuuuaaucccuuccuuua

SEQ ID NO: 59628 - RNA, 19 nt, Homo sapiens
cuuccaaccucaaacauuu

SEQ ID NO: 59629 - RNA, 19 nt, Homo sapiens
ggacagugaacacaauuug

SEQ ID NO: 59630 - RNA, 19 nt, Homo sapiens
uaagagaagcuacuuuguu

SEQ ID NO: 59631 - RNA, 19 nt, Homo sapiens
gcucuagcaucugccaaua

SEQ ID NO: 59632 - RNA, 19 nt, Homo sapiens
gaaauaagagaagcuacuu

SEQ ID NO: 59633 - RNA, 19 nt, Homo sapiens
ccaguggguuuccuauuga

SEQ ID NO: 59634 - RNA, 19 nt, Homo sapiens
gaaagaaauaguacaacug

SEQ ID NO: 59635 - RNA, 19 nt, Homo sapiens
ggugguggcugucuuucuu

SEQ ID NO: 59636 - RNA, 19 nt, Homo sapiens
ggauaacucugaugcuuuu

SEQ ID NO: 59637 - RNA, 19 nt, Homo sapiens
gauccuuccucuuuccaaa

SEQ ID NO: 59638 - RNA, 19 nt, Homo sapiens
ucagaaucaucgcaaugua

SEQ ID NO: 59639 - RNA, 19 nt, Homo sapiens
ggaaagauuuuaggaagaa

SEQ ID NO: 59640 - RNA, 19 nt, Homo sapiens
gggauggccugcucuaucu

SEQ ID NO: 59641 - RNA, 19 nt, Homo sapiens
ggaucgcugucuuguggua

SEQ ID NO: 59642 - RNA, 19 nt, Homo sapiens
gauguggucucaccuaaaa

SEQ ID NO: 59643 - RNA, 19 nt, Homo sapiens
caaagaccuucugcagauu

SEQ ID NO: 59644 - RNA, 19 nt, Homo sapiens
cauaauagauguggcuaca

SEQ ID NO: 59645 - RNA, 19 nt, Homo sapiens
guuuagcaauggcgucuuu

SEQ ID NO: 59646 - RNA, 19 nt, Homo sapiens
guacacagacuauugacau

SEQ ID NO: 59647 - RNA, 19 nt, Homo sapiens
uuuaaucccuuccuuuaug

SEQ ID NO: 59648 - RNA, 19 nt, Homo sapiens
gagaaaugaaugauagguu

SEQ ID NO: 59649 - RNA, 19 nt, Homo sapiens
agauguggcuacaaauuug

SEQ ID NO: 59650 - RNA, 19 nt, Homo sapiens
agacaaccauaauagaugu

SEQ ID NO: 59651 - RNA, 19 nt, Homo sapiens
gcauuccuguguucgugua

SEQ ID NO: 59652 - RNA, 19 nt, Homo sapiens
cuauuucuaucccaaacua

SEQ ID NO: 59653 - RNA, 19 nt, Homo sapiens
caauucaacugaccuacuc

SEQ ID NO: 59654 - RNA, 19 nt, Homo sapiens
ccucaaacauuucaaagac

SEQ ID NO: 59655 - RNA, 19 nt, Homo sapiens
uagauguggcuacaaauuu

SEQ ID NO: 59656 - RNA, 19 nt, Homo sapiens
guaucugggugguggcuuu

SEQ ID NO: 59657 - RNA, 19 nt, Homo sapiens
cuacagacaaccauaauag

SEQ ID NO: 59658 - RNA, 19 nt, Homo sapiens
gggaaaucuucacuacaga

SEQ ID NO: 59659 - RNA, 19 nt, Homo sapiens
gaugugcauuccuguguuc

SEQ ID NO: 59660 - RNA, 19 nt, Homo sapiens
caaccucaaacauuucaaa

SEQ ID NO: 59661 - RNA, 19 nt, Homo sapiens
gaaaugaaugauagguuag

SEQ ID NO: 59662 - RNA, 19 nt, Homo sapiens
cgggaaaucuucacuacag

SEQ ID NO: 59663 - RNA, 19 nt, Homo sapiens
aauaagagaagcuacuuug

SEQ ID NO: 59664 - RNA, 19 nt, Homo sapiens
caagggcacuuaacaaacc

SEQ ID NO: 59665 - RNA, 19 nt, Homo sapiens
gaaacuuguuagaaaugca

SEQ ID NO: 59666 - RNA, 19 nt, Homo sapiens
ucacuacagacaaccauaa

SEQ ID NO: 59667 - RNA, 19 nt, Homo sapiens
aaugauagguuagauccuu

SEQ ID NO: 59668 - RNA, 19 nt, Homo sapiens
cuggagaaaugaaugauag

SEQ ID NO: 59669 - RNA, 19 nt, Homo sapiens
gugagcagcggacuucaaa

SEQ ID NO: 59670 - RNA, 19 nt, Homo sapiens
agaaauaguacaacugugu

SEQ ID NO: 59671 - RNA, 19 nt, Homo sapiens
gaaagcaaggcaguccauu

SEQ ID NO: 59672 - RNA, 19 nt, Homo sapiens
uagcaucugccaauaguug

SEQ ID NO: 59673 - RNA, 19 nt, Homo sapiens
gaaaucuucacuacagaca

SEQ ID NO: 59674 - RNA, 19 nt, Homo sapiens
gacaucagcaucaccuaga

SEQ ID NO: 59675 - RNA, 19 nt, Homo sapiens
ccaaacaaaugaucauccu

SEQ ID NO: 59676 - RNA, 19 nt, Homo sapiens
guuagauccuuccucuuuc

SEQ ID NO: 59677 - RNA, 19 nt, Homo sapiens
caauccagcgguucucaaa

SEQ ID NO: 59678 - RNA, 19 nt, Homo sapiens
guacaacugugugaaaaug

SEQ ID NO: 59679 - RNA, 19 nt, Homo sapiens
gcaagggcacuuaacaaac

SEQ ID NO: 59680 - RNA, 19 nt, Homo sapiens
uguuacagcuucauugucu

SEQ ID NO: 59681 - RNA, 19 nt, Homo sapiens
aagguuuccaggauuauua

SEQ ID NO: 59682 - RNA, 19 nt, Homo sapiens
aaacaggucucuugaaaac

SEQ ID NO: 59683 - RNA, 19 nt, Homo sapiens
cagacaaccauaauagaug

SEQ ID NO: 59684 - RNA, 19 nt, Homo sapiens
ucauuguccucaacauguu

SEQ ID NO: 59685 - RNA, 19 nt, Homo sapiens
cagcaagggcacuuaacaa

SEQ ID NO: 59686 - RNA, 19 nt, Homo sapiens
cagcaucaccuagaaacuu

SEQ ID NO: 59687 - RNA, 19 nt, Homo sapiens
ucuagcaucugccaauagu

SEQ ID NO: 59688 - RNA, 19 nt, Homo sapiens
gcugcccucuguuaucaug

SEQ ID NO: 59689 - RNA, 19 nt, Homo sapiens
aacccucguuucugauuaa

SEQ ID NO: 59690 - RNA, 19 nt, Homo sapiens
ccacugucccucaaacaau

SEQ ID NO: 59691 - RNA, 19 nt, Homo sapiens
ucacagaugacgaucaagu

SEQ ID NO: 59692 - RNA, 19 nt, Homo sapiens
ccaauucacagaugacgau

SEQ ID NO: 59693 - RNA, 19 nt, Homo sapiens
cugauguggucucaccuaa

SEQ ID NO: 59694 - RNA, 19 nt, Homo sapiens
ucagccgccuggagaaaug

SEQ ID NO: 59695 - RNA, 19 nt, Homo sapiens
ggugguggcuuuugugaug

SEQ ID NO: 59696 - RNA, 19 nt, Homo sapiens
caaacgguacacagacuau

SEQ ID NO: 59697 - RNA, 19 nt, Homo sapiens
gccuucagcuacugucuca

SEQ ID NO: 59698 - RNA, 19 nt, Homo sapiens
aagcaaggcaguccauuca

SEQ ID NO: 59699 - RNA, 19 nt, Homo sapiens
cgccaagucucagagcaaa

SEQ ID NO: 59700 - RNA, 19 nt, Homo sapiens
ccucguuucugauuaaugc

SEQ ID NO: 59701 - RNA, 19 nt, Homo sapiens
uauaagaggaugaagugau

SEQ ID NO: 59702 - RNA, 19 nt, Homo sapiens
cuuaggcaaucacauagug

SEQ ID NO: 59703 - RNA, 19 nt, Homo sapiens
auucacagaugacgaucaa

SEQ ID NO: 59704 - RNA, 19 nt, Homo sapiens
cuggauaacucugaugcuu

SEQ ID NO: 59705 - RNA, 19 nt, Homo sapiens
gguuuccuauugaagauca

SEQ ID NO: 59706 - RNA, 19 nt, Homo sapiens
ucucacagccauggaauga

SEQ ID NO: 59707 - RNA, 19 nt, Homo sapiens
acagacaaccauaauagau

SEQ ID NO: 59708 - RNA, 19 nt, Homo sapiens
gcugagaccaauucaacug

SEQ ID NO: 59709 - RNA, 19 nt, Homo sapiens
cacugucccucaaacaaug

SEQ ID NO: 59710 - RNA, 19 nt, Homo sapiens
gggaaagauuuuaggaaga

SEQ ID NO: 59711 - RNA, 19 nt, Homo sapiens
gagaggagcuggucuauga

SEQ ID NO: 59712 - RNA, 19 nt, Homo sapiens
ggaaauaccuggcaacucu

SEQ ID NO: 59713 - RNA, 19 nt, Homo sapiens
gaguacggcuuccagguua

SEQ ID NO: 59714 - RNA, 19 nt, Homo sapiens
gaggauggcuacaggauga

SEQ ID NO: 59715 - RNA, 19 nt, Homo sapiens
gaucuaaccucucuuggau

SEQ ID NO: 59716 - RNA, 19 nt, Homo sapiens
caagucagcauuccaauaa

SEQ ID NO: 59717 - RNA, 19 nt, Homo sapiens
gcacugcuguguccgcuuu

SEQ ID NO: 59718 - RNA, 19 nt, Homo sapiens
cgacaaacauccaggguau

SEQ ID NO: 59719 - RNA, 19 nt, Homo sapiens
gcgcaacccuguacgacua

SEQ ID NO: 59720 - RNA, 19 nt, Homo sapiens
agaaacccaucucguaaua

SEQ ID NO: 59721 - RNA, 19 nt, Homo sapiens
gcagcaagaucaaugugaa

SEQ ID NO: 59722 - RNA, 19 nt, Homo sapiens
ggaccgcuuucaaauauug

SEQ ID NO: 59723 - RNA, 19 nt, Homo sapiens
ggaugaaguuugccugcua

SEQ ID NO: 59724 - RNA, 19 nt, Homo sapiens
gaaggcggaugguuccuau

SEQ ID NO: 59725 - RNA, 19 nt, Homo sapiens
guggaccgcuuucaaauau

SEQ ID NO: 59726 - RNA, 19 nt, Homo sapiens
ccaagguucugcagauuga

SEQ ID NO: 59727 - RNA, 19 nt, Homo sapiens
gggcagaucguguucauga

SEQ ID NO: 59728 - RNA, 19 nt, Homo sapiens
gagcucacauccugguauu

SEQ ID NO: 59729 - RNA, 19 nt, Homo sapiens
gcuuugggcuccuagauga

SEQ ID NO: 59730 - RNA, 19 nt, Homo sapiens
gggaaagaauauuugauca

SEQ ID NO: 59731 - RNA, 19 nt, Homo sapiens
caaacgaggacuaugagua

SEQ ID NO: 59732 - RNA, 19 nt, Homo sapiens
gaagaucucagcccgauuc

SEQ ID NO: 59733 - RNA, 19 nt, Homo sapiens
aguuugaggugaagaaaua

SEQ ID NO: 59734 - RNA, 19 nt, Homo sapiens
gaucucagcccgauucuca

SEQ ID NO: 59735 - RNA, 19 nt, Homo sapiens
ggaggaaacagcaaaggaa

SEQ ID NO: 59736 - RNA, 19 nt, Homo sapiens
gcagcaaagugucaguguu

SEQ ID NO: 59737 - RNA, 19 nt, Homo sapiens
ggaaacaguggaccgcuuu

SEQ ID NO: 59738 - RNA, 19 nt, Homo sapiens
agacggaccagcccauuua

SEQ ID NO: 59739 - RNA, 19 nt, Homo sapiens
gaagagcuguggccuccau

SEQ ID NO: 59740 - RNA, 19 nt, Homo sapiens
aaacccaucucguaauaau

SEQ ID NO: 59741 - RNA, 19 nt, Homo sapiens
gagaugcgguguccaaggu

SEQ ID NO: 59742 - RNA, 19 nt, Homo sapiens
aggaggaccugauugauga

SEQ ID NO: 59743 - RNA, 19 nt, Homo sapiens
ggagaccaguggaccuuau

SEQ ID NO: 59744 - RNA, 19 nt, Homo sapiens
caacucugaucccaauaug

SEQ ID NO: 59745 - RNA, 19 nt, Homo sapiens
caacagcagcacccaguuu

SEQ ID NO: 59746 - RNA, 19 nt, Homo sapiens
ggccuguccucuauaacua

SEQ ID NO: 59747 - RNA, 19 nt, Homo sapiens
ggcaaggucuuugaagcua

SEQ ID NO: 59748 - RNA, 19 nt, Homo sapiens
gccaggaccuacagauaga

SEQ ID NO: 59749 - RNA, 19 nt, Homo sapiens
gaaauugggucaguaugcu

SEQ ID NO: 59750 - RNA, 19 nt, Homo sapiens
caacaugggcaaggucuuu

SEQ ID NO: 59751 - RNA, 19 nt, Homo sapiens
ggaagaaggagguguacau

SEQ ID NO: 59752 - RNA, 19 nt, Homo sapiens
gaaguuugccugcuacuac

SEQ ID NO: 59753 - RNA, 19 nt, Homo sapiens
gaggaggaccugauugaug

SEQ ID NO: 59754 - RNA, 19 nt, Homo sapiens
gcaaggucuuugaagcuau

SEQ ID NO: 59755 - RNA, 19 nt, Homo sapiens
ucaaaggccacgucgagua

SEQ ID NO: 59756 - RNA, 19 nt, Homo sapiens
uguugaagguccugaguuu

SEQ ID NO: 59757 - RNA, 19 nt, Homo sapiens
ggaguacggcuuccagguu

SEQ ID NO: 59758 - RNA, 19 nt, Homo sapiens
gcaaaggaacccugaaggu

SEQ ID NO: 59759 - RNA, 19 nt, Homo sapiens
acaacaaccucauggcaau

SEQ ID NO: 59760 - RNA, 19 nt, Homo sapiens
gagcuggucuaugaacuca

SEQ ID NO: 59761 - RNA, 19 nt, Homo sapiens
gaccuuauccagaaagaga

SEQ ID NO: 59762 - RNA, 19 nt, Homo sapiens
ccgugaagcuccacuuaga

SEQ ID NO: 59763 - RNA, 19 nt, Homo sapiens
gcacccuccuucuacuuug

SEQ ID NO: 59764 - RNA, 19 nt, Homo sapiens
ccaagucagcauuccaaua

SEQ ID NO: 59765 - RNA, 19 nt, Homo sapiens
gaggacagguagugaaagg

SEQ ID NO: 59766 - RNA, 19 nt, Homo sapiens
uggcauuccugucaaaguu

SEQ ID NO: 59767 - RNA, 19 nt, Homo sapiens
gaagaaggagguguacaug

SEQ ID NO: 59768 - RNA, 19 nt, Homo sapiens
ucacagucaugguggagaa

SEQ ID NO: 59769 - RNA, 19 nt, Homo sapiens
caggugcccuugaaagaug

SEQ ID NO: 59770 - RNA, 19 nt, Homo sapiens
gcaacucugaucccaauau

SEQ ID NO: 59771 - RNA, 19 nt, Homo sapiens
gggacacucugaaccugaa

SEQ ID NO: 59772 - RNA, 19 nt, Homo sapiens
agucagcauuccaauaauu

SEQ ID NO: 59773 - RNA, 19 nt, Homo sapiens
cagcaaagugucaguguug

SEQ ID NO: 59774 - RNA, 19 nt, Homo sapiens
ggacgucacccuccugagu

SEQ ID NO: 59775 - RNA, 19 nt, Homo sapiens
ugacacgucugcccaugau

SEQ ID NO: 59776 - RNA, 19 nt, Homo sapiens
gggugcagcuccaggaugu

SEQ ID NO: 59777 - RNA, 19 nt, Homo sapiens
gaaacccaucucguaauaa

SEQ ID NO: 59778 - RNA, 19 nt, Homo sapiens
caaggucuuugaagcuaug

SEQ ID NO: 59779 - RNA, 19 nt, Homo sapiens
gcagaucguguucaugaau

SEQ ID NO: 59780 - RNA, 19 nt, Homo sapiens
gucagcauuccaauaauua

SEQ ID NO: 59781 - RNA, 19 nt, Homo sapiens
cuaaucagaugcgcaacuu

SEQ ID NO: 59782 - RNA, 19 nt, Homo sapiens
agaccaagaucacccaagu

SEQ ID NO: 59783 - RNA, 19 nt, Homo sapiens
ggaccugauugaugaggau

SEQ ID NO: 59784 - RNA, 19 nt, Homo sapiens
ggagaagacaacccggaaa

SEQ ID NO: 59785 - RNA, 19 nt, Homo sapiens
gugaagcuccacuuagaaa

SEQ ID NO: 59786 - RNA, 19 nt, Homo sapiens
ggacagguagugaaaggau

SEQ ID NO: 59787 - RNA, 19 nt, Homo sapiens
agacggaucuaaccucucu

SEQ ID NO: 59788 - RNA, 19 nt, Homo sapiens
gaccagggcauauuaaagg

SEQ ID NO: 59789 - RNA, 19 nt, Homo sapiens
ggaagcaaacgaggacuau

SEQ ID NO: 59790 - RNA, 19 nt, Homo sapiens
ucucaaaggcaaacucauu

SEQ ID NO: 59791 - RNA, 19 nt, Homo sapiens
gagggcagaucguguucau

SEQ ID NO: 59792 - RNA, 19 nt, Homo sapiens
aagcaaacgaggacuauga

SEQ ID NO: 59793 - RNA, 19 nt, Homo sapiens
gugcagagccauugaagca

SEQ ID NO: 59794 - RNA, 19 nt, Homo sapiens
uggcaacucugaucccaau

SEQ ID NO: 59795 - RNA, 19 nt, Homo sapiens
ggccggaccuuggaaauac

SEQ ID NO: 59796 - RNA, 19 nt, Homo sapiens
gcugcggccuguccucuau

SEQ ID NO: 59797 - RNA, 19 nt, Homo sapiens
gcaagaagagcagggacaa

SEQ ID NO: 59798 - RNA, 19 nt, Homo sapiens
gagagucugcgcaagaaga

SEQ ID NO: 59799 - RNA, 19 nt, Homo sapiens
aaaaggcgauuaaugagaa

SEQ ID NO: 59800 - RNA, 19 nt, Homo sapiens
gaagcugaauaugggcauu

SEQ ID NO: 59801 - RNA, 19 nt, Homo sapiens
gaugaaaugcaguuagaca

SEQ ID NO: 59802 - RNA, 19 nt, Homo sapiens
gugcccagcucaacgacuu

SEQ ID NO: 59803 - RNA, 19 nt, Homo sapiens
ggaucuaaccucucuugga

SEQ ID NO: 59804 - RNA, 19 nt, Homo sapiens
gaccaucgcccuucaucau

SEQ ID NO: 59805 - RNA, 19 nt, Homo sapiens
gagcaaaccaugaucuacu

SEQ ID NO: 59806 - RNA, 19 nt, Homo sapiens
gcugagagucugcgcaaga

SEQ ID NO: 59807 - RNA, 19 nt, Homo sapiens
gcauuccugucaaaguuuc

SEQ ID NO: 59808 - RNA, 19 nt, Homo sapiens
uugaugaaaugcaguuaga

SEQ ID NO: 59809 - RNA, 19 nt, Homo sapiens
gugcugaccuggagaagcu

SEQ ID NO: 59810 - RNA, 19 nt, Homo sapiens
ggaggaggagcugcaguuu

SEQ ID NO: 59811 - RNA, 19 nt, Homo sapiens
gagaggagcuggucuauga

SEQ ID NO: 59812 - RNA, 19 nt, Homo sapiens
ggaaauaccuggcaacucu

SEQ ID NO: 59813 - RNA, 19 nt, Homo sapiens
ggaccucucuccagugaua

SEQ ID NO: 59814 - RNA, 19 nt, Homo sapiens
gaguacggcuuccagguua

SEQ ID NO: 59815 - RNA, 19 nt, Homo sapiens
gaggauggcuacaggauga

SEQ ID NO: 59816 - RNA, 19 nt, Homo sapiens
gaucuaaccucucuuggau

SEQ ID NO: 59817 - RNA, 19 nt, Homo sapiens
caagucagcauuccaauaa

SEQ ID NO: 59818 - RNA, 19 nt, Homo sapiens
gcacugcuguguccgcuuu

SEQ ID NO: 59819 - RNA, 19 nt, Homo sapiens
cgacaaacauccaggguau

SEQ ID NO: 59820 - RNA, 19 nt, Homo sapiens
gcgcaacccuguacgacua

SEQ ID NO: 59821 - RNA, 19 nt, Homo sapiens
agaaacccaucucguaaua

SEQ ID NO: 59822 - RNA, 19 nt, Homo sapiens
gcagcaagaucaaugugaa

SEQ ID NO: 59823 - RNA, 19 nt, Homo sapiens
ggaccgcuuucaaauauug

SEQ ID NO: 59824 - RNA, 19 nt, Homo sapiens
ggaugaaguuugccugcua

SEQ ID NO: 59825 - RNA, 19 nt, Homo sapiens
gaaggcggaugguuccuau

SEQ ID NO: 59826 - RNA, 19 nt, Homo sapiens
guggaccgcuuucaaauau

SEQ ID NO: 59827 - RNA, 19 nt, Homo sapiens
ccaagguucugcagauuga

SEQ ID NO: 59828 - RNA, 19 nt, Homo sapiens
gggcagaucguguucauga

SEQ ID NO: 59829 - RNA, 19 nt, Homo sapiens
gagcucacauccugguauu

SEQ ID NO: 59830 - RNA, 19 nt, Homo sapiens
gcuuugggcuccuagauga

SEQ ID NO: 59831 - RNA, 19 nt, Homo sapiens
gggaaagaauauuugauca

SEQ ID NO: 59832 - RNA, 19 nt, Homo sapiens
gaagaucucagcccgauuc

SEQ ID NO: 59833 - RNA, 19 nt, Homo sapiens
aguuugaggugaagaaaua

SEQ ID NO: 59834 - RNA, 19 nt, Homo sapiens
gaucucagcccgauucuca

SEQ ID NO: 59835 - RNA, 19 nt, Homo sapiens
ggaggaaacagcaaaggaa

SEQ ID NO: 59836 - RNA, 19 nt, Homo sapiens
gcagcaaagugucaguguu

SEQ ID NO: 59837 - RNA, 19 nt, Homo sapiens
guaggaggaucgccugaga

SEQ ID NO: 59838 - RNA, 19 nt, Homo sapiens
ggaaacaguggaccgcuuu

SEQ ID NO: 59839 - RNA, 19 nt, Homo sapiens
agacggaccagcccauuua

SEQ ID NO: 59840 - RNA, 19 nt, Homo sapiens
gaagagcuguggccuccau

SEQ ID NO: 59841 - RNA, 19 nt, Homo sapiens
aaacccaucucguaauaau

SEQ ID NO: 59842 - RNA, 19 nt, Homo sapiens
gagaugcgguguccaaggu

SEQ ID NO: 59843 - RNA, 19 nt, Homo sapiens
aggaggaccugauugauga

SEQ ID NO: 59844 - RNA, 19 nt, Homo sapiens
ggagaccaguggaccuuau

SEQ ID NO: 59845 - RNA, 19 nt, Homo sapiens
caacucugaucccaauaug

SEQ ID NO: 59846 - RNA, 19 nt, Homo sapiens
caacagcagcacccaguuu

SEQ ID NO: 59847 - RNA, 19 nt, Homo sapiens
ggccuguccucuauaacua

SEQ ID NO: 59848 - RNA, 19 nt, Homo sapiens
ggcaaggucuuugaagcua

SEQ ID NO: 59849 - RNA, 19 nt, Homo sapiens
gccaggaccuacagauaga

SEQ ID NO: 59850 - RNA, 19 nt, Homo sapiens
gaaauugggucaguaugcu

SEQ ID NO: 59851 - RNA, 19 nt, Homo sapiens
caacaugggcaaggucuuu

SEQ ID NO: 59852 - RNA, 19 nt, Homo sapiens
ggaagaaggagguguacau

SEQ ID NO: 59853 - RNA, 19 nt, Homo sapiens
gaaguuugccugcuacuac

SEQ ID NO: 59854 - RNA, 19 nt, Homo sapiens
gaggaggaccugauugaug

SEQ ID NO: 59855 - RNA, 19 nt, Homo sapiens
gcaaggucuuugaagcuau

SEQ ID NO: 59856 - RNA, 19 nt, Homo sapiens
caggaccucucuccaguga

SEQ ID NO: 59857 - RNA, 19 nt, Homo sapiens
ucaaaggccacgucgagua

SEQ ID NO: 59858 - RNA, 19 nt, Homo sapiens
uguugaagguccugaguuu

SEQ ID NO: 59859 - RNA, 19 nt, Homo sapiens
ggaguacggcuuccagguu

SEQ ID NO: 59860 - RNA, 19 nt, Homo sapiens
gcaaaggaacccugaaggu

SEQ ID NO: 59861 - RNA, 19 nt, Homo sapiens
acaacaaccucauggcaau

SEQ ID NO: 59862 - RNA, 19 nt, Homo sapiens
gagcuggucuaugaacuca

SEQ ID NO: 59863 - RNA, 19 nt, Homo sapiens
gaccuuauccagaaagaga

SEQ ID NO: 59864 - RNA, 19 nt, Homo sapiens
ccgugaagcuccacuuaga

SEQ ID NO: 59865 - RNA, 19 nt, Homo sapiens
gaggacagguagugaaagg

SEQ ID NO: 59866 - RNA, 19 nt, Homo sapiens
gcacccuccuucuacuuug

SEQ ID NO: 59867 - RNA, 19 nt, Homo sapiens
ccaagucagcauuccaaua

SEQ ID NO: 59868 - RNA, 19 nt, Homo sapiens
uggcauuccugucaaaguu

SEQ ID NO: 59869 - RNA, 19 nt, Homo sapiens
gaagaaggagguguacaug

SEQ ID NO: 59870 - RNA, 19 nt, Homo sapiens
gaggaucgccugagaaacu

SEQ ID NO: 59871 - RNA, 19 nt, Homo sapiens
cugcagccaucauugagua

SEQ ID NO: 59872 - RNA, 19 nt, Homo sapiens
ucacagucaugguggagaa

SEQ ID NO: 59873 - RNA, 19 nt, Homo sapiens
caggugcccuugaaagaug

SEQ ID NO: 59874 - RNA, 19 nt, Homo sapiens
gcaacucugaucccaauau

SEQ ID NO: 59875 - RNA, 19 nt, Homo sapiens
gggacacucugaaccugaa

SEQ ID NO: 59876 - RNA, 19 nt, Homo sapiens
agucagcauuccaauaauu

SEQ ID NO: 59877 - RNA, 19 nt, Homo sapiens
cagcaaagugucaguguug

SEQ ID NO: 59878 - RNA, 19 nt, Homo sapiens
ggacgucacccuccugagu

SEQ ID NO: 59879 - RNA, 19 nt, Homo sapiens
ugacacgucugcccaugau

SEQ ID NO: 59880 - RNA, 19 nt, Homo sapiens
gggugcagcuccaggaugu

SEQ ID NO: 59881 - RNA, 19 nt, Homo sapiens
caaggucuuugaagcuaug

SEQ ID NO: 59882 - RNA, 19 nt, Homo sapiens
gcagaucguguucaugaau

SEQ ID NO: 59883 - RNA, 19 nt, Homo sapiens
gaaacccaucucguaauaa

SEQ ID NO: 59884 - RNA, 19 nt, Homo sapiens
gucagcauuccaauaauua

SEQ ID NO: 59885 - RNA, 19 nt, Homo sapiens
agacggaucuaaccucucu

SEQ ID NO: 59886 - RNA, 19 nt, Homo sapiens
cuaaucagaugcgcaacuu

SEQ ID NO: 59887 - RNA, 19 nt, Homo sapiens
agaccaagaucacccaagu

SEQ ID NO: 59888 - RNA, 19 nt, Homo sapiens
ggaccugauugaugaggau

SEQ ID NO: 59889 - RNA, 19 nt, Homo sapiens
ggagaagacaacccggaaa

SEQ ID NO: 59890 - RNA, 19 nt, Homo sapiens
gugaagcuccacuuagaaa

SEQ ID NO: 59891 - RNA, 19 nt, Homo sapiens
ggacagguagugaaaggau

SEQ ID NO: 59892 - RNA, 19 nt, Homo sapiens
gaccagggcauauuaaagg

SEQ ID NO: 59893 - RNA, 19 nt, Homo sapiens
ggaagcaaacgaggacuau

SEQ ID NO: 59894 - RNA, 19 nt, Homo sapiens
gagggcagaucguguucau

SEQ ID NO: 59895 - RNA, 19 nt, Homo sapiens
aagcaaacgaggacuauga

SEQ ID NO: 59896 - RNA, 19 nt, Homo sapiens
gugcagagccauugaagca

SEQ ID NO: 59897 - RNA, 19 nt, Homo sapiens
uggcaacucugaucccaau

SEQ ID NO: 59898 - RNA, 19 nt, Homo sapiens
ggccggaccuuggaaauac

SEQ ID NO: 59899 - RNA, 19 nt, Homo sapiens
gcugcggccuguccucuau

SEQ ID NO: 59900 - RNA, 19 nt, Homo sapiens
gcaagaagagcagggacaa

SEQ ID NO: 59901 - RNA, 19 nt, Homo sapiens
gagagucugcgcaagaaga

SEQ ID NO: 59902 - RNA, 19 nt, Homo sapiens
aaaaggcgauuaaugagaa

SEQ ID NO: 59903 - RNA, 19 nt, Homo sapiens
gaagcugaauaugggcauu

SEQ ID NO: 59904 - RNA, 19 nt, Homo sapiens
gaugaaaugcaguuagaca

SEQ ID NO: 59905 - RNA, 19 nt, Homo sapiens
gugcccagcucaacgacuu

SEQ ID NO: 59906 - RNA, 19 nt, Homo sapiens
gaccaucgcccuucaucau

SEQ ID NO: 59907 - RNA, 19 nt, Homo sapiens
gagcaaaccaugaucuacu

SEQ ID NO: 59908 - RNA, 19 nt, Homo sapiens
ggaucuaaccucucuugga

SEQ ID NO: 59909 - RNA, 19 nt, Homo sapiens
gcugagagucugcgcaaga

SEQ ID NO: 59910 - RNA, 19 nt, Homo sapiens
gcauuccugucaaaguuuc

SEQ ID NO: 59911 - RNA, 19 nt, Homo sapiens
gaaagucucugauccaauu

SEQ ID NO: 59912 - RNA, 19 nt, Homo sapiens
ccaauucucuuccaaauga

SEQ ID NO: 59913 - RNA, 19 nt, Homo sapiens
gauauuacguugacugaga

SEQ ID NO: 59914 - RNA, 19 nt, Homo sapiens
gcuuugagauugugaaauu

SEQ ID NO: 59915 - RNA, 19 nt, Homo sapiens
gaaccaaagcuaaauaaug

SEQ ID NO: 59916 - RNA, 19 nt, Homo sapiens
gaauucagcuguucagaag

SEQ ID NO: 59917 - RNA, 19 nt, Homo sapiens
gaacuacucugaaauacac

SEQ ID NO: 59918 - RNA, 19 nt, Homo sapiens
ggaguuggcuggagucauc

SEQ ID NO: 59919 - RNA, 19 nt, Homo sapiens
uuaauuggcucaaccacua

SEQ ID NO: 59920 - RNA, 19 nt, Homo sapiens
ccaaggaugugaggcguua

SEQ ID NO: 59921 - RNA, 19 nt, Homo sapiens
gcaauuaccagucaacuuc

SEQ ID NO: 59922 - RNA, 19 nt, Homo sapiens
caaauagaauucagcuguu

SEQ ID NO: 59923 - RNA, 19 nt, Homo sapiens
gcaguguaauucauuguga

SEQ ID NO: 59924 - RNA, 19 nt, Homo sapiens
uagcaaaucuacugucaau

SEQ ID NO: 59925 - RNA, 19 nt, Homo sapiens
guggagacauuugcaauuu

SEQ ID NO: 59926 - RNA, 19 nt, Homo sapiens
gcaagacaauccacuuugg

SEQ ID NO: 59927 - RNA, 19 nt, Homo sapiens
ggauaaggaucaguauguu

SEQ ID NO: 59928 - RNA, 19 nt, Homo sapiens
gauuuggacccaucuauaa

SEQ ID NO: 59929 - RNA, 19 nt, Homo sapiens
gugaaauugucaaguguaa

SEQ ID NO: 59930 - RNA, 19 nt, Homo sapiens
uauaacaccuucuguaucu

SEQ ID NO: 59931 - RNA, 19 nt, Homo sapiens
gaugugaggcguuauguug

SEQ ID NO: 59932 - RNA, 19 nt, Homo sapiens
gauagcaaauggaauccuu

SEQ ID NO: 59933 - RNA, 19 nt, Homo sapiens
gcacagcggugaagaaaau

SEQ ID NO: 59934 - RNA, 19 nt, Homo sapiens
gccaaucacuguguuuauu

SEQ ID NO: 59935 - RNA, 19 nt, Homo sapiens
ggacccaucuauaauuaca

SEQ ID NO: 59936 - RNA, 19 nt, Homo sapiens
gggaaauggucucuggauu

SEQ ID NO: 59937 - RNA, 19 nt, Homo sapiens
gaaccaggacuacauagau

SEQ ID NO: 59938 - RNA, 19 nt, Homo sapiens
gaagguugucuguggauaa

SEQ ID NO: 59939 - RNA, 19 nt, Homo sapiens
gcuaaauaauggugaaauc

SEQ ID NO: 59940 - RNA, 19 nt, Homo sapiens
aaccaaagcuaaauaaugg

SEQ ID NO: 59941 - RNA, 19 nt, Homo sapiens
caacuucaggguauuauga

SEQ ID NO: 59942 - RNA, 19 nt, Homo sapiens
ccagucaacuucaggguau

SEQ ID NO: 59943 - RNA, 19 nt, Homo sapiens
ggaagguugucuguggaua

SEQ ID NO: 59944 - RNA, 19 nt, Homo sapiens
ggauuuggacccaucuaua

SEQ ID NO: 59945 - RNA, 19 nt, Homo sapiens
ggaaauugaacaacuggaa

SEQ ID NO: 59946 - RNA, 19 nt, Homo sapiens
gaaaccagaauuagugaau

SEQ ID NO: 59947 - RNA, 19 nt, Homo sapiens
gaacaacuggaacuacaga

SEQ ID NO: 59948 - RNA, 19 nt, Homo sapiens
uaagcugucucuggaaauu

SEQ ID NO: 59949 - RNA, 19 nt, Homo sapiens
uauaagcugucucuggaaa

SEQ ID NO: 59950 - RNA, 19 nt, Homo sapiens
aaauggcccuggagguaua

SEQ ID NO: 59951 - RNA, 19 nt, Homo sapiens
ccaggagaguuacguaaug

SEQ ID NO: 59952 - RNA, 19 nt, Homo sapiens
cgaaggcugugaacaagug

SEQ ID NO: 59953 - RNA, 19 nt, Homo sapiens
ccaaugugauucuggcuau

SEQ ID NO: 59954 - RNA, 19 nt, Homo sapiens
gcagcaguguaauucauug

SEQ ID NO: 59955 - RNA, 19 nt, Homo sapiens
acacacaaagcacaaauuu

SEQ ID NO: 59956 - RNA, 19 nt, Homo sapiens
gaaaauggcccuggaggua

SEQ ID NO: 59957 - RNA, 19 nt, Homo sapiens
aaguagagauuaagacaga

SEQ ID NO: 59958 - RNA, 19 nt, Homo sapiens
gaggaaccaggacuacaua

SEQ ID NO: 59959 - RNA, 19 nt, Homo sapiens
cagaugagccuacgacugu

SEQ ID NO: 59960 - RNA, 19 nt, Homo sapiens
ggccaugccuccauuucuu

SEQ ID NO: 59961 - RNA, 19 nt, Homo sapiens
gcaaguagagauuaagaca

SEQ ID NO: 59962 - RNA, 19 nt, Homo sapiens
cuugaucgcugcucuguug

SEQ ID NO: 59963 - RNA, 19 nt, Homo sapiens
uuggacccaucuauaauua

SEQ ID NO: 59964 - RNA, 19 nt, Homo sapiens
uguggagaaugaaacaaua

SEQ ID NO: 59965 - RNA, 19 nt, Homo sapiens
acagaucaguuuagcaaau

SEQ ID NO: 59966 - RNA, 19 nt, Homo sapiens
ccaaucacuguguuuauuu

SEQ ID NO: 59967 - RNA, 19 nt, Homo sapiens
gcgcaagacaauccacuuu

SEQ ID NO: 59968 - RNA, 19 nt, Homo sapiens
cuacgacugugauuuguca

SEQ ID NO: 59969 - RNA, 19 nt, Homo sapiens
gaggauguguauguuguug

SEQ ID NO: 59970 - RNA, 19 nt, Homo sapiens
gcuacaaacccacuacaga

SEQ ID NO: 59971 - RNA, 19 nt, Homo sapiens
ccacccacuuuaucauuug

SEQ ID NO: 59972 - RNA, 19 nt, Homo sapiens
ucccagauaucaucauaga

SEQ ID NO: 59973 - RNA, 19 nt, Homo sapiens
ccagauaucaucauagagu

SEQ ID NO: 59974 - RNA, 19 nt, Homo sapiens
caaggcaguuuucuucuuu

SEQ ID NO: 59975 - RNA, 19 nt, Homo sapiens
gauaaggaucaguauguug

SEQ ID NO: 59976 - RNA, 19 nt, Homo sapiens
ccaugggcauuauaaacaa

SEQ ID NO: 59977 - RNA, 19 nt, Homo sapiens
caaucacuguguuuauuuc

SEQ ID NO: 59978 - RNA, 19 nt, Homo sapiens
aaugugaaauugucaagug

SEQ ID NO: 59979 - RNA, 19 nt, Homo sapiens
guugugaaguccaagauag

SEQ ID NO: 59980 - RNA, 19 nt, Homo sapiens
gaucacaaauagaauucag

SEQ ID NO: 59981 - RNA, 19 nt, Homo sapiens
gcaauucaauacagaucag

SEQ ID NO: 59982 - RNA, 19 nt, Homo sapiens
cgacugugauuugucagaa

SEQ ID NO: 59983 - RNA, 19 nt, Homo sapiens
caaaagaggauguguaugu

SEQ ID NO: 59984 - RNA, 19 nt, Homo sapiens
ggaggaaccaggacuacau

SEQ ID NO: 59985 - RNA, 19 nt, Homo sapiens
ggaaccaggacuacauaga

SEQ ID NO: 59986 - RNA, 19 nt, Homo sapiens
gcugauagcaaauggaauc

SEQ ID NO: 59987 - RNA, 19 nt, Homo sapiens
gaaauugucaaguguaagc

SEQ ID NO: 59988 - RNA, 19 nt, Homo sapiens
guggagcaauuaccaguca

SEQ ID NO: 59989 - RNA, 19 nt, Homo sapiens
ggagguauauaagcugucu

SEQ ID NO: 59990 - RNA, 19 nt, Homo sapiens
gcauacggcuuuucuguca

SEQ ID NO: 59991 - RNA, 19 nt, Homo sapiens
ccagacaucaggaauggaa

SEQ ID NO: 59992 - RNA, 19 nt, Homo sapiens
cagacacccaggagaguua

SEQ ID NO: 59993 - RNA, 19 nt, Homo sapiens
ggaacuacucugaaauaca

SEQ ID NO: 59994 - RNA, 19 nt, Homo sapiens
gauccaauucucuuccaaa

SEQ ID NO: 59995 - RNA, 19 nt, Homo sapiens
guuuagugcuuugagauug

SEQ ID NO: 59996 - RNA, 19 nt, Homo sapiens
aagaggauguguauguugu

SEQ ID NO: 59997 - RNA, 19 nt, Homo sapiens
gcaguuuucuucuuugaga

SEQ ID NO: 59998 - RNA, 19 nt, Homo sapiens
gauggcgaauggguguaua

SEQ ID NO: 59999 - RNA, 19 nt, Homo sapiens
cuacaaacccacuacagau

SEQ ID NO: 60000 - RNA, 19 nt, Homo sapiens
guagagauuaagacagauu

SEQ ID NO: 60001 - RNA, 19 nt, Homo sapiens
cagaucaguuuagcaaauc

SEQ ID NO: 60002 - RNA, 19 nt, Homo sapiens
cagaggugcccaaguguga

SEQ ID NO: 60003 - RNA, 19 nt, Homo sapiens
ggagacauuugcaauuuuc

SEQ ID NO: 60004 - RNA, 19 nt, Homo sapiens
gacugugauuugucagaaa

SEQ ID NO: 60005 - RNA, 19 nt, Homo sapiens
cuugugagcccaauaguug

SEQ ID NO: 60006 - RNA, 19 nt, Homo sapiens
aaauagaauucagcuguuc

SEQ ID NO: 60007 - RNA, 19 nt, Homo sapiens
cuggaacuacucugaaaua

SEQ ID NO: 60008 - RNA, 19 nt, Homo sapiens
caacacacaaagcacaaau

SEQ ID NO: 60009 - RNA, 19 nt, Homo sapiens
caauuuggcagugauauuc

SEQ ID NO: 60010 - RNA, 19 nt, Homo sapiens
auacagaucaguuuagcaa

SEQ ID NO: 60011 - RNA, 19 nt, Homo sapiens
ggaaauaacuucaccuuag

SEQ ID NO: 60012 - RNA, 19 nt, Homo sapiens
gaagaaagcugaguugaag

SEQ ID NO: 60013 - RNA, 19 nt, Homo sapiens
gagaggaggugguuagguu

SEQ ID NO: 60014 - RNA, 19 nt, Homo sapiens
gauccaccauuaguuauua

SEQ ID NO: 60015 - RNA, 19 nt, Homo sapiens
gagcagauguaauagaaau

SEQ ID NO: 60016 - RNA, 19 nt, Homo sapiens
cagcugagcagauguaaua

SEQ ID NO: 60017 - RNA, 19 nt, Homo sapiens
gaagacagguacuacuuag

SEQ ID NO: 60018 - RNA, 19 nt, Homo sapiens
caauuaaccucuucucuag

SEQ ID NO: 60019 - RNA, 19 nt, Homo sapiens
gaaauaacuucaccuuagg

SEQ ID NO: 60020 - RNA, 19 nt, Homo sapiens
gaaaguggcaugacaaugg

SEQ ID NO: 60021 - RNA, 19 nt, Homo sapiens
ggacuuugaucaccagaug

SEQ ID NO: 60022 - RNA, 19 nt, Homo sapiens
ggacuuacguuuguaucaa

SEQ ID NO: 60023 - RNA, 19 nt, Homo sapiens
gcgaagccauggagaacuu

SEQ ID NO: 60024 - RNA, 19 nt, Homo sapiens
ccaggaagcucccaaacca

SEQ ID NO: 60025 - RNA, 19 nt, Homo sapiens
ucaauuaaccucuucucua

SEQ ID NO: 60026 - RNA, 19 nt, Homo sapiens
guucugauuuccugucgua

SEQ ID NO: 60027 - RNA, 19 nt, Homo sapiens
gcaccucccuuucccaucu

SEQ ID NO: 60028 - RNA, 19 nt, Homo sapiens
ugucugagcugggugaauu

SEQ ID NO: 60029 - RNA, 19 nt, Homo sapiens
gagcagcaaugcguugaug

SEQ ID NO: 60030 - RNA, 19 nt, Homo sapiens
ugaagacagguacuacuua

SEQ ID NO: 60031 - RNA, 19 nt, Homo sapiens
gggauaacaccacuacuga

SEQ ID NO: 60032 - RNA, 19 nt, Homo sapiens
gaauccaguucauggcuau

SEQ ID NO: 60033 - RNA, 19 nt, Homo sapiens
uaggauccaccauuaguua

SEQ ID NO: 60034 - RNA, 19 nt, Homo sapiens
cugagcagauguaauagaa

SEQ ID NO: 60035 - RNA, 19 nt, Homo sapiens
gaauguaagugacaaaauc

SEQ ID NO: 60036 - RNA, 19 nt, Homo sapiens
gugguuagguuggucuuaa

SEQ ID NO: 60037 - RNA, 19 nt, Homo sapiens
aaaggaaaguggcaugaca

SEQ ID NO: 60038 - RNA, 19 nt, Homo sapiens
uuacagccguucugauuuc

SEQ ID NO: 60039 - RNA, 19 nt, Homo sapiens
aagcugaguugaaggcaaa

SEQ ID NO: 60040 - RNA, 19 nt, Homo sapiens
ggagguggaaggacagauu

SEQ ID NO: 60041 - RNA, 19 nt, Homo sapiens
ugaagaaagcugaguugaa

SEQ ID NO: 60042 - RNA, 19 nt, Homo sapiens
cagggaggguaaaucaauu

SEQ ID NO: 60043 - RNA, 19 nt, Homo sapiens
gauaacaccacuacugagu

SEQ ID NO: 60044 - RNA, 19 nt, Homo sapiens
gauuuccugucguaagauu

SEQ ID NO: 60045 - RNA, 19 nt, Homo sapiens
aauauucucuggagcugaa

SEQ ID NO: 60046 - RNA, 19 nt, Homo sapiens
ggagaacuuuaugcaacaa

SEQ ID NO: 60047 - RNA, 19 nt, Homo sapiens
gaagccauggagaacuuua

SEQ ID NO: 60048 - RNA, 19 nt, Homo sapiens
ucacguuuaugugcaauga

SEQ ID NO: 60049 - RNA, 19 nt, Homo sapiens
gaggguaaaucaauuaacc

SEQ ID NO: 60050 - RNA, 19 nt, Homo sapiens
gcuggugaauggagaguuc

SEQ ID NO: 60051 - RNA, 19 nt, Homo sapiens
cuuaagcaguguuagaaga

SEQ ID NO: 60052 - RNA, 19 nt, Homo sapiens
aaaguggcaugacaaugga

SEQ ID NO: 60053 - RNA, 19 nt, Homo sapiens
caccauuaguuauuacugu

SEQ ID NO: 60054 - RNA, 19 nt, Homo sapiens
ggauccaccauuaguuauu

SEQ ID NO: 60055 - RNA, 19 nt, Homo sapiens
gaauggagaguucaguucu

SEQ ID NO: 60056 - RNA, 19 nt, Homo sapiens
ggucuuaagcaguguuaga

SEQ ID NO: 60057 - RNA, 19 nt, Homo sapiens
caauggaggagcuaaaaua

SEQ ID NO: 60058 - RNA, 19 nt, Homo sapiens
cugauuuccugucguaaga

SEQ ID NO: 60059 - RNA, 19 nt, Homo sapiens
ccagggaggguaaaucaau

SEQ ID NO: 60060 - RNA, 19 nt, Homo sapiens
uuaccaucccuuuguauuu

SEQ ID NO: 60061 - RNA, 19 nt, Homo sapiens
uauaccagcuuccuuacag

SEQ ID NO: 60062 - RNA, 19 nt, Homo sapiens
gugaagacagguacuacuu

SEQ ID NO: 60063 - RNA, 19 nt, Homo sapiens
ccuuacagccguucugauu

SEQ ID NO: 60064 - RNA, 19 nt, Homo sapiens
gggaggguaaaucaauuaa

SEQ ID NO: 60065 - RNA, 19 nt, Homo sapiens
gacaaaaucacguuuaugu

SEQ ID NO: 60066 - RNA, 19 nt, Homo sapiens
uggugugcgugcugucuua

SEQ ID NO: 60067 - RNA, 19 nt, Homo sapiens
uggaggagcuaaaauauuc

SEQ ID NO: 60068 - RNA, 19 nt, Homo sapiens
ggaaaguggcaugacaaug

SEQ ID NO: 60069 - RNA, 19 nt, Homo sapiens
accuuaggauccaccauua

SEQ ID NO: 60070 - RNA, 19 nt, Homo sapiens
gcugaagaaagcugaguug

SEQ ID NO: 60071 - RNA, 19 nt, Homo sapiens
uuucaaaccaggugucuga

SEQ ID NO: 60072 - RNA, 19 nt, Homo sapiens
gcaaugaccacuacauccu

SEQ ID NO: 60073 - RNA, 19 nt, Homo sapiens
uggagaacuuuaugcaaca

SEQ ID NO: 60074 - RNA, 19 nt, Homo sapiens
gauccaggaagcucccaaa

SEQ ID NO: 60075 - RNA, 19 nt, Homo sapiens
gcaaaaguagggacuguga

SEQ ID NO: 60076 - RNA, 19 nt, Homo sapiens
cacuacagcugagcagaug

SEQ ID NO: 60077 - RNA, 19 nt, Homo sapiens
ugacaauggaggagcuaaa

SEQ ID NO: 60078 - RNA, 19 nt, Homo sapiens
cuuccagucugcaaguuga

SEQ ID NO: 60079 - RNA, 19 nt, Homo sapiens
cccuauaccagcuuccuua

SEQ ID NO: 60080 - RNA, 19 nt, Homo sapiens
aggaaauaacuucaccuua

SEQ ID NO: 60081 - RNA, 19 nt, Homo sapiens
ccucuaaggagugggauaa

SEQ ID NO: 60082 - RNA, 19 nt, Homo sapiens
gacuuacguuuguaucaag

SEQ ID NO: 60083 - RNA, 19 nt, Homo sapiens
gcugagcagauguaauaga

SEQ ID NO: 60084 - RNA, 19 nt, Homo sapiens
uuaaaccuggcaacucuuu

SEQ ID NO: 60085 - RNA, 19 nt, Homo sapiens
aaucggagccagugucuag

SEQ ID NO: 60086 - RNA, 19 nt, Homo sapiens
caccuuaggauccaccauu

SEQ ID NO: 60087 - RNA, 19 nt, Homo sapiens
ccaguggacaauagcauau

SEQ ID NO: 60088 - RNA, 19 nt, Homo sapiens
caaaccagagugugagaag

SEQ ID NO: 60089 - RNA, 19 nt, Homo sapiens
caccugggcaccucccuuu

SEQ ID NO: 60090 - RNA, 19 nt, Homo sapiens
aaaucacguuuaugugcaa

SEQ ID NO: 60091 - RNA, 19 nt, Homo sapiens
ucuaaggagugggauaaca

SEQ ID NO: 60092 - RNA, 19 nt, Homo sapiens
uaccaucccuuuguauuuu

SEQ ID NO: 60093 - RNA, 19 nt, Homo sapiens
gcaaucggagccagugucu

SEQ ID NO: 60094 - RNA, 19 nt, Homo sapiens
uaugugcaaugaccacuac

SEQ ID NO: 60095 - RNA, 19 nt, Homo sapiens
uaagcaguguuagaagauc

SEQ ID NO: 60096 - RNA, 19 nt, Homo sapiens
agggaggguaaaucaauua

SEQ ID NO: 60097 - RNA, 19 nt, Homo sapiens
cuagagaggaggugguuag

SEQ ID NO: 60098 - RNA, 19 nt, Homo sapiens
aauggagaguucaguucuu

SEQ ID NO: 60099 - RNA, 19 nt, Homo sapiens
gggacuuacguuuguauca

SEQ ID NO: 60100 - RNA, 19 nt, Homo sapiens
gagguggaaggacagauuc

SEQ ID NO: 60101 - RNA, 19 nt, Homo sapiens
guggcgaguuucugcuuca

SEQ ID NO: 60102 - RNA, 19 nt, Homo sapiens
aaaccuggcaacucuuuua

SEQ ID NO: 60103 - RNA, 19 nt, Homo sapiens
gaaggcaaaauuguuguaa

SEQ ID NO: 60104 - RNA, 19 nt, Homo sapiens
gaagcucccaaaccagagu

SEQ ID NO: 60105 - RNA, 19 nt, Homo sapiens
gugcaaugaccacuacauc

SEQ ID NO: 60106 - RNA, 19 nt, Homo sapiens
ggccugugaauguaaguga

SEQ ID NO: 60107 - RNA, 19 nt, Homo sapiens
ggagaaggccuaugccaaa

SEQ ID NO: 60108 - RNA, 19 nt, Homo sapiens
ccacugacuugcuguguga

SEQ ID NO: 60109 - RNA, 19 nt, Homo sapiens
ucaagaagccagaagauga

SEQ ID NO: 60110 - RNA, 19 nt, Homo sapiens
cuaagggacucuauccauu

SEQ ID NO: 60111 - RNA, 19 nt, Homo sapiens
ucacggacaucaucaagug

SEQ ID NO: 60112 - RNA, 19 nt, Homo sapiens
caacaggggcuaacucuua

SEQ ID NO: 60113 - RNA, 19 nt, Homo sapiens
ucagagaaguuggacauga

SEQ ID NO: 60114 - RNA, 19 nt, Homo sapiens
ggaguuuccuugcugagau

SEQ ID NO: 60115 - RNA, 19 nt, Homo sapiens
acgacucacucuacuauaa

SEQ ID NO: 60116 - RNA, 19 nt, Homo sapiens
gcugaaggaugaauuucug

SEQ ID NO: 60117 - RNA, 19 nt, Homo sapiens
gaaggccuaugccaaacug

SEQ ID NO: 60118 - RNA, 19 nt, Homo sapiens
ucacugaugugcccuccaa

SEQ ID NO: 60119 - RNA, 19 nt, Homo sapiens
caagaagccagaagaugaa

SEQ ID NO: 60120 - RNA, 19 nt, Homo sapiens
gaacggcugcccacaguca

SEQ ID NO: 60121 - RNA, 19 nt, Homo sapiens
gacggugaguucuggauga

SEQ ID NO: 60122 - RNA, 19 nt, Homo sapiens
cagagaaguuggacaugau

SEQ ID NO: 60123 - RNA, 19 nt, Homo sapiens
gugagaaccuggccauugg

SEQ ID NO: 60124 - RNA, 19 nt, Homo sapiens
cuacuggccuucuucaagu

SEQ ID NO: 60125 - RNA, 19 nt, Homo sapiens
acaaccagcucaucuacug

SEQ ID NO: 60126 - RNA, 19 nt, Homo sapiens
ccacugggccugagucuag

SEQ ID NO: 60127 - RNA, 19 nt, Homo sapiens
gcaggacgacggugaguuc

SEQ ID NO: 60128 - RNA, 19 nt, Homo sapiens
gaguuuccuugcugagauu

SEQ ID NO: 60129 - RNA, 19 nt, Homo sapiens
ggugagaaccuggccauug

SEQ ID NO: 60130 - RNA, 19 nt, Homo sapiens
gaacccacaguacaucuuc

SEQ ID NO: 60131 - RNA, 19 nt, Homo sapiens
ggacuucacgggugguguu

SEQ ID NO: 60132 - RNA, 19 nt, Homo sapiens
uaagggacucuauccauug

SEQ ID NO: 60133 - RNA, 19 nt, Homo sapiens
caacugucaccacugcuaa

SEQ ID NO: 60134 - RNA, 19 nt, Homo sapiens
ucuacaagguggaggagaa

SEQ ID NO: 60135 - RNA, 19 nt, Homo sapiens
ucugacaccugcccaccua

SEQ ID NO: 60136 - RNA, 19 nt, Homo sapiens
ggcuaacucuuaugugauc

SEQ ID NO: 60137 - RNA, 19 nt, Homo sapiens
cacaguacaucuucgaagu

SEQ ID NO: 60138 - RNA, 19 nt, Homo sapiens
ccuaugaggaccagaacua

SEQ ID NO: 60139 - RNA, 19 nt, Homo sapiens
gugggcaacugcugguuug

SEQ ID NO: 60140 - RNA, 19 nt, Homo sapiens
ugacgacucacucuacuau

SEQ ID NO: 60141 - RNA, 19 nt, Homo sapiens
gcuuugacaucuacaaggu

SEQ ID NO: 60142 - RNA, 19 nt, Homo sapiens
ucaacaaccagcucaucua

SEQ ID NO: 60143 - RNA, 19 nt, Homo sapiens
gacuugcugugugaccuua

SEQ ID NO: 60144 - RNA, 19 nt, Homo sapiens
cagcagcaccucccucaug

SEQ ID NO: 60145 - RNA, 19 nt, Homo sapiens
gcaccuccacaccagagua

SEQ ID NO: 60146 - RNA, 19 nt, Homo sapiens
guacuucacggacaucauc

SEQ ID NO: 60147 - RNA, 19 nt, Homo sapiens
aagggacucuauccauuga

SEQ ID NO: 60148 - RNA, 19 nt, Homo sapiens
caccugagcauccacaaga

SEQ ID NO: 60149 - RNA, 19 nt, Homo sapiens
gagaaggccuaugccaaac

SEQ ID NO: 60150 - RNA, 19 nt, Homo sapiens
ccauuggcuuugacaucua

SEQ ID NO: 60151 - RNA, 19 nt, Homo sapiens
gaagccagaagaugaaguc

SEQ ID NO: 60152 - RNA, 19 nt, Homo sapiens
caguacaucuucgaaguca

SEQ ID NO: 60153 - RNA, 19 nt, Homo sapiens
gguaaagggccacgcauac

SEQ ID NO: 60154 - RNA, 19 nt, Homo sapiens
caacaaccagcucaucuac

SEQ ID NO: 60155 - RNA, 19 nt, Homo sapiens
gcuaagggacucuauccau

SEQ ID NO: 60156 - RNA, 19 nt, Homo sapiens
acaccagaguacaauguga

SEQ ID NO: 60157 - RNA, 19 nt, Homo sapiens
ggggcuaacucuuauguga

SEQ ID NO: 60158 - RNA, 19 nt, Homo sapiens
gcagaaagugagcaagagu

SEQ ID NO: 60159 - RNA, 19 nt, Homo sapiens
gaggaguggcagaaaguga

SEQ ID NO: 60160 - RNA, 19 nt, Homo sapiens
cagacgcacugguggacuu

SEQ ID NO: 60161 - RNA, 19 nt, Homo sapiens
ccgaggagcgccaagaaga

SEQ ID NO: 60162 - RNA, 19 nt, Homo sapiens
caagugugagggagacaaa

SEQ ID NO: 60163 - RNA, 19 nt, Homo sapiens
guacaucuucgaagucaag

SEQ ID NO: 60164 - RNA, 19 nt, Homo sapiens
gaggagcgccaagaagaug

SEQ ID NO: 60165 - RNA, 19 nt, Homo sapiens
ccacugacgacucacucua

SEQ ID NO: 60166 - RNA, 19 nt, Homo sapiens
agaaagugagcaagaguga

SEQ ID NO: 60167 - RNA, 19 nt, Homo sapiens
ucacugaugugcgcaaggu

SEQ ID NO: 60168 - RNA, 19 nt, Homo sapiens
gggcagcagccaccauguu

SEQ ID NO: 60169 - RNA, 19 nt, Homo sapiens
gagccagcccaucacugua

SEQ ID NO: 60170 - RNA, 19 nt, Homo sapiens
ccagcuccaucuacaucaa

SEQ ID NO: 60171 - RNA, 19 nt, Homo sapiens
agagugagcgggagaagau

SEQ ID NO: 60172 - RNA, 19 nt, Homo sapiens
caugaggacccgcgacaga

SEQ ID NO: 60173 - RNA, 19 nt, Homo sapiens
gggagucgcuguggcaaaa

SEQ ID NO: 60174 - RNA, 19 nt, Homo sapiens
cauacgccgucacugaugu

SEQ ID NO: 60175 - RNA, 19 nt, Homo sapiens
caucagugccuccaucaag

SEQ ID NO: 60176 - RNA, 19 nt, Homo sapiens
ccacaccagaguacaaugu

SEQ ID NO: 60177 - RNA, 19 nt, Homo sapiens
gggagcugcgccuggauaa

SEQ ID NO: 60178 - RNA, 19 nt, Homo sapiens
ggacgugugccgguacuuc

SEQ ID NO: 60179 - RNA, 19 nt, Homo sapiens
gcauacgccgucacugaug

SEQ ID NO: 60180 - RNA, 19 nt, Homo sapiens
acgaugagacuaagaggaa

SEQ ID NO: 60181 - RNA, 19 nt, Homo sapiens
ccaaacuggcaggcuguua

SEQ ID NO: 60182 - RNA, 19 nt, Homo sapiens
accgagugcugaaggauga

SEQ ID NO: 60183 - RNA, 19 nt, Homo sapiens
ccaccauguucucgugugu

SEQ ID NO: 60184 - RNA, 19 nt, Homo sapiens
ucuuugagcgcauguuaaa

SEQ ID NO: 60185 - RNA, 19 nt, Homo sapiens
ggugcgcccuaguggagaa

SEQ ID NO: 60186 - RNA, 19 nt, Homo sapiens
ggugggcaacugcugguuu

SEQ ID NO: 60187 - RNA, 19 nt, Homo sapiens
caucuuccacuuccacuuc

SEQ ID NO: 60188 - RNA, 19 nt, Homo sapiens
ucacgggugguguuucuga

SEQ ID NO: 60189 - RNA, 19 nt, Homo sapiens
ucaacugucaccacugcua

SEQ ID NO: 60190 - RNA, 19 nt, Homo sapiens
gagcugcuggccucaagga

SEQ ID NO: 60191 - RNA, 19 nt, Homo sapiens
ggcagaaagugagcaagag

SEQ ID NO: 60192 - RNA, 19 nt, Homo sapiens
acgcauacgccgucacuga

SEQ ID NO: 60193 - RNA, 19 nt, Homo sapiens
caaacuggcaggcuguuac

SEQ ID NO: 60194 - RNA, 19 nt, Homo sapiens
ggcagcagccaccauguuc

SEQ ID NO: 60195 - RNA, 19 nt, Homo sapiens
cuccgagucuucacugaug

SEQ ID NO: 60196 - RNA, 19 nt, Homo sapiens
ggaggagaaccgccaguac

SEQ ID NO: 60197 - RNA, 19 nt, Homo sapiens
gcaagagugagcgggagaa

SEQ ID NO: 60198 - RNA, 19 nt, Homo sapiens
ugugugaccuuaggaaguc

SEQ ID NO: 60199 - RNA, 19 nt, Homo sapiens
ggaaccaccgagugcugaa

SEQ ID NO: 60200 - RNA, 19 nt, Homo sapiens
ugagccagcccaucacugu

SEQ ID NO: 60201 - RNA, 19 nt, Homo sapiens
caccagaguacaaugugaa

SEQ ID NO: 60202 - RNA, 19 nt, Homo sapiens
uaacucuuaugugaucauc

SEQ ID NO: 60203 - RNA, 19 nt, Homo sapiens
gacgacucacucuacuaua

SEQ ID NO: 60204 - RNA, 19 nt, Homo sapiens
gaagucaagaagccagaag

SEQ ID NO: 60205 - RNA, 19 nt, Homo sapiens
gcggcugcaucaaccacaa

SEQ ID NO: 60206 - RNA, 19 nt, Homo sapiens
ucaagugccgcgugaucaa

SEQ ID NO: 60207 - RNA, 19 nt, Homo sapiens
gagaacagcuuauaucuua

SEQ ID NO: 60208 - RNA, 19 nt, Homo sapiens
gaagggauguugagcauua

SEQ ID NO: 60209 - RNA, 19 nt, Homo sapiens
ggaagacaguacuuaauua

SEQ ID NO: 60210 - RNA, 19 nt, Homo sapiens
ucaaagaacugucauacua

SEQ ID NO: 60211 - RNA, 19 nt, Homo sapiens
gagaaagacucugagauua

SEQ ID NO: 60212 - RNA, 19 nt, Homo sapiens
cgacacagcucuaauuaaa

SEQ ID NO: 60213 - RNA, 19 nt, Homo sapiens
ggacuuaccuuccucacua

SEQ ID NO: 60214 - RNA, 19 nt, Homo sapiens
ggauuucucuucauucaua

SEQ ID NO: 60215 - RNA, 19 nt, Homo sapiens
gagagaagcuuugguuaaa

SEQ ID NO: 60216 - RNA, 19 nt, Homo sapiens
gaaaggaacuguuuacaac

SEQ ID NO: 60217 - RNA, 19 nt, Homo sapiens
gcagaugacucccaagaaa

SEQ ID NO: 60218 - RNA, 19 nt, Homo sapiens
uaaagaagcccuccagaua

SEQ ID NO: 60219 - RNA, 19 nt, Homo sapiens
gaagaaauguuguuacgau

SEQ ID NO: 60220 - RNA, 19 nt, Homo sapiens
gcuaauaucucucauaaag

SEQ ID NO: 60221 - RNA, 19 nt, Homo sapiens
gaaauaacauggccuugga

SEQ ID NO: 60222 - RNA, 19 nt, Homo sapiens
caaacugugucucuuaaua

SEQ ID NO: 60223 - RNA, 19 nt, Homo sapiens
gcaaacauaugucauuuca

SEQ ID NO: 60224 - RNA, 19 nt, Homo sapiens
agaaauaccuggcaucaaa

SEQ ID NO: 60225 - RNA, 19 nt, Homo sapiens
gagaacagauccaauugaa

SEQ ID NO: 60226 - RNA, 19 nt, Homo sapiens
gcaaagguguucaaagaug

SEQ ID NO: 60227 - RNA, 19 nt, Homo sapiens
ggagaacaucugaauauua

SEQ ID NO: 60228 - RNA, 19 nt, Homo sapiens
gaaaugcugacuacucuua

SEQ ID NO: 60229 - RNA, 19 nt, Homo sapiens
gaaguuguaucaaagcauu

SEQ ID NO: 60230 - RNA, 19 nt, Homo sapiens
gaagaacgcugcaaaagaa

SEQ ID NO: 60231 - RNA, 19 nt, Homo sapiens
acaggaaacugaucauuaa

SEQ ID NO: 60232 - RNA, 19 nt, Homo sapiens
gaucuugucugcaguucua

SEQ ID NO: 60233 - RNA, 19 nt, Homo sapiens
gaaacugucuuaaccuuca

SEQ ID NO: 60234 - RNA, 19 nt, Homo sapiens
gggaugcaguucuguguua

SEQ ID NO: 60235 - RNA, 19 nt, Homo sapiens
caagaugcaucaaagcuuu

SEQ ID NO: 60236 - RNA, 19 nt, Homo sapiens
gagcaaacauaugucauuu

SEQ ID NO: 60237 - RNA, 19 nt, Homo sapiens
gcacaaaguccuccaaaug

SEQ ID NO: 60238 - RNA, 19 nt, Homo sapiens
gauucagucugguuaaaua

SEQ ID NO: 60239 - RNA, 19 nt, Homo sapiens
ggaaagcuauucugguguu

SEQ ID NO: 60240 - RNA, 19 nt, Homo sapiens
gaaauuggccuucacaaca

SEQ ID NO: 60241 - RNA, 19 nt, Homo sapiens
gaacagauccaauugaaag

SEQ ID NO: 60242 - RNA, 19 nt, Homo sapiens
gugcuaauaucucucauaa

SEQ ID NO: 60243 - RNA, 19 nt, Homo sapiens
ccaaaacucugcaaucuua

SEQ ID NO: 60244 - RNA, 19 nt, Homo sapiens
ucaaauggcuaucagaaga

SEQ ID NO: 60245 - RNA, 19 nt, Homo sapiens
gaacaccuccucaaaccua

SEQ ID NO: 60246 - RNA, 19 nt, Homo sapiens
uagcuggucuuauuuguaa

SEQ ID NO: 60247 - RNA, 19 nt, Homo sapiens
gaagagagaagcuuugguu

SEQ ID NO: 60248 - RNA, 19 nt, Homo sapiens
gauggagccugcguuaaua

SEQ ID NO: 60249 - RNA, 19 nt, Homo sapiens
gauaaacaguguaccaugu

SEQ ID NO: 60250 - RNA, 19 nt, Homo sapiens
agucugaacuugaaagaua

SEQ ID NO: 60251 - RNA, 19 nt, Homo sapiens
gaaaggaguucccauacag

SEQ ID NO: 60252 - RNA, 19 nt, Homo sapiens
gcacuugguuaacagcuuu

SEQ ID NO: 60253 - RNA, 19 nt, Homo sapiens
cggaaacucugauuacaaa

SEQ ID NO: 60254 - RNA, 19 nt, Homo sapiens
uaauggaucuuucaaggaa

SEQ ID NO: 60255 - RNA, 19 nt, Homo sapiens
ugacggugcuggaguuuaa

SEQ ID NO: 60256 - RNA, 19 nt, Homo sapiens
gcacaaacaauugauguaa

SEQ ID NO: 60257 - RNA, 19 nt, Homo sapiens
gaugagcguugucccagua

SEQ ID NO: 60258 - RNA, 19 nt, Homo sapiens
gaaagaacaguccauugaa

SEQ ID NO: 60259 - RNA, 19 nt, Homo sapiens
gcaaaugcaggaagaauug

SEQ ID NO: 60260 - RNA, 19 nt, Homo sapiens
aaucaaagauggacauguu

SEQ ID NO: 60261 - RNA, 19 nt, Homo sapiens
gagccugcguuaauaauga

SEQ ID NO: 60262 - RNA, 19 nt, Homo sapiens
gaugaaccuuguaaagaaa

SEQ ID NO: 60263 - RNA, 19 nt, Homo sapiens
ugaugaaccuuguaaagaa

SEQ ID NO: 60264 - RNA, 19 nt, Homo sapiens
gagaaacugucuuaaccuu

SEQ ID NO: 60265 - RNA, 19 nt, Homo sapiens
aaagaacaguccauugaaa

SEQ ID NO: 60266 - RNA, 19 nt, Homo sapiens
cgaaagaacaguccauuga

SEQ ID NO: 60267 - RNA, 19 nt, Homo sapiens
gaaauguuguuacgaugga

SEQ ID NO: 60268 - RNA, 19 nt, Homo sapiens
caacuggaaccgcauauuu

SEQ ID NO: 60269 - RNA, 19 nt, Homo sapiens
auucauagcuggucuuauu

SEQ ID NO: 60270 - RNA, 19 nt, Homo sapiens
guuaacagcuuuugcuuua

SEQ ID NO: 60271 - RNA, 19 nt, Homo sapiens
ucacugaggcugacguuua

SEQ ID NO: 60272 - RNA, 19 nt, Homo sapiens
gacaauggauuucucuuca

SEQ ID NO: 60273 - RNA, 19 nt, Homo sapiens
gaucagaaguugacauggu

SEQ ID NO: 60274 - RNA, 19 nt, Homo sapiens
aaacauggccuuugcuuga

SEQ ID NO: 60275 - RNA, 19 nt, Homo sapiens
uagaggugcuucucaauga

SEQ ID NO: 60276 - RNA, 19 nt, Homo sapiens
gaaagcuauucugguguua

SEQ ID NO: 60277 - RNA, 19 nt, Homo sapiens
gaugcaacaaucucuauua

SEQ ID NO: 60278 - RNA, 19 nt, Homo sapiens
gcauacaguuugcacuuau

SEQ ID NO: 60279 - RNA, 19 nt, Homo sapiens
gaagaaucaucaucuggau

SEQ ID NO: 60280 - RNA, 19 nt, Homo sapiens
gaggagaacagauccaauu

SEQ ID NO: 60281 - RNA, 19 nt, Homo sapiens
caaucgagccagaauauaa

SEQ ID NO: 60282 - RNA, 19 nt, Homo sapiens
gagauugcauaugcuuaua

SEQ ID NO: 60283 - RNA, 19 nt, Homo sapiens
gaauaccacagaccagaua

SEQ ID NO: 60284 - RNA, 19 nt, Homo sapiens
gaauauucacuccugguua

SEQ ID NO: 60285 - RNA, 19 nt, Homo sapiens
aggcaaagguguucaaaga

SEQ ID NO: 60286 - RNA, 19 nt, Homo sapiens
ugaaacagcagucaaagaa

SEQ ID NO: 60287 - RNA, 19 nt, Homo sapiens
aagaagcccuccagauaaa

SEQ ID NO: 60288 - RNA, 19 nt, Homo sapiens
ugagaaagacucugagauu

SEQ ID NO: 60289 - RNA, 19 nt, Homo sapiens
ugaggaaguuugcagcuuu

SEQ ID NO: 60290 - RNA, 19 nt, Homo sapiens
ggaacuguuuacaacuaua

SEQ ID NO: 60291 - RNA, 19 nt, Homo sapiens
uggauacacugaagcauuu

SEQ ID NO: 60292 - RNA, 19 nt, Homo sapiens
gccaaacugugucucuuaa

SEQ ID NO: 60293 - RNA, 19 nt, Homo sapiens
gaaugccaauaaccuauga

SEQ ID NO: 60294 - RNA, 19 nt, Homo sapiens
aaagaagcccuccagauaa

SEQ ID NO: 60295 - RNA, 19 nt, Homo sapiens
aauauucacuccugguuaa

SEQ ID NO: 60296 - RNA, 19 nt, Homo sapiens
gaagauagaagaaauagcu

SEQ ID NO: 60297 - RNA, 19 nt, Homo sapiens
gggagaacaucugaauauu

SEQ ID NO: 60298 - RNA, 19 nt, Homo sapiens
gaaaugaugcaaacagcaa

SEQ ID NO: 60299 - RNA, 19 nt, Homo sapiens
gaaagaaaauaccaaggaa

SEQ ID NO: 60300 - RNA, 19 nt, Homo sapiens
gggaagcuguugcugagaa

SEQ ID NO: 60301 - RNA, 19 nt, Homo sapiens
ccaauaaccuaugacaaug

SEQ ID NO: 60302 - RNA, 19 nt, Homo sapiens
ccggauauuugaacucuuu

SEQ ID NO: 60303 - RNA, 19 nt, Homo sapiens
ggagcaaacauaugucauu

SEQ ID NO: 60304 - RNA, 19 nt, Homo sapiens
gaaggcaucaauauccuaa

SEQ ID NO: 60305 - RNA, 19 nt, Homo sapiens
gagcugcacggauuaguuu

SEQ ID NO: 60306 - RNA, 19 nt, Homo sapiens
gagaacagacagcagaauu

SEQ ID NO: 60307 - RNA, 19 nt, Homo sapiens
gaacagggaacucagaaua

SEQ ID NO: 60308 - RNA, 19 nt, Homo sapiens
uaucuaagcucuuguaagu

SEQ ID NO: 60309 - RNA, 19 nt, Homo sapiens
ggaauccacucuccauuuc

SEQ ID NO: 60310 - RNA, 19 nt, Homo sapiens
ggaguuaucuaagcucuug

SEQ ID NO: 60311 - RNA, 19 nt, Homo sapiens
gaaagauucucgcuuaaaa

SEQ ID NO: 60312 - RNA, 19 nt, Homo sapiens
ucuaagcucuuguaaguga

SEQ ID NO: 60313 - RNA, 19 nt, Homo sapiens
uaaccaggauauugacauu

SEQ ID NO: 60314 - RNA, 19 nt, Homo sapiens
ggugaacacuuccuucuag

SEQ ID NO: 60315 - RNA, 19 nt, Homo sapiens
gcacuaugaugacaaggau

SEQ ID NO: 60316 - RNA, 19 nt, Homo sapiens
gaacucagaauacagacaa

SEQ ID NO: 60317 - RNA, 19 nt, Homo sapiens
ggacuacagccacgacaaa

SEQ ID NO: 60318 - RNA, 19 nt, Homo sapiens
gaggaguacuuuccaccaa

SEQ ID NO: 60319 - RNA, 19 nt, Homo sapiens
gaauacagacaaguagaaa

SEQ ID NO: 60320 - RNA, 19 nt, Homo sapiens
ggaacguguugacugaaga

SEQ ID NO: 60321 - RNA, 19 nt, Homo sapiens
gugggaugguguuaccuua

SEQ ID NO: 60322 - RNA, 19 nt, Homo sapiens
gcuuucugcugguguuuaa

SEQ ID NO: 60323 - RNA, 19 nt, Homo sapiens
caucaccacuggcccuuug

SEQ ID NO: 60324 - RNA, 19 nt, Homo sapiens
gguagugggugccuguaau

SEQ ID NO: 60325 - RNA, 19 nt, Homo sapiens
acagacaaguagaaagauu

SEQ ID NO: 60326 - RNA, 19 nt, Homo sapiens
gccauucucccucuuguuu

SEQ ID NO: 60327 - RNA, 19 nt, Homo sapiens
gaagauacaggacauucuc

SEQ ID NO: 60328 - RNA, 19 nt, Homo sapiens
caaacucaacacaauugua

SEQ ID NO: 60329 - RNA, 19 nt, Homo sapiens
cagcgggacucuucucauc

SEQ ID NO: 60330 - RNA, 19 nt, Homo sapiens
ccacucuccauuucuauaa

SEQ ID NO: 60331 - RNA, 19 nt, Homo sapiens
aauccacucuccauuucua

SEQ ID NO: 60332 - RNA, 19 nt, Homo sapiens
auauguaacuggaaucuca

SEQ ID NO: 60333 - RNA, 19 nt, Homo sapiens
acagagggaucuuguguac

SEQ ID NO: 60334 - RNA, 19 nt, Homo sapiens
cuaacuaacucuccuccau

SEQ ID NO: 60335 - RNA, 19 nt, Homo sapiens
uacaucaacugcugcauca

SEQ ID NO: 60336 - RNA, 19 nt, Homo sapiens
ugacauugauacagugaag

SEQ ID NO: 60337 - RNA, 19 nt, Homo sapiens
gagggaggcucugucucaa

SEQ ID NO: 60338 - RNA, 19 nt, Homo sapiens
caggagaccagaacaugaa

SEQ ID NO: 60339 - RNA, 19 nt, Homo sapiens
ucucauccuuccucauuug

SEQ ID NO: 60340 - RNA, 19 nt, Homo sapiens
cuacucacgcucacgauuu

SEQ ID NO: 60341 - RNA, 19 nt, Homo sapiens
accaggauauugacauuga

SEQ ID NO: 60342 - RNA, 19 nt, Homo sapiens
gggaggcucugucucaaaa

SEQ ID NO: 60343 - RNA, 19 nt, Homo sapiens
cgagggaggcucugucuca

SEQ ID NO: 60344 - RNA, 19 nt, Homo sapiens
agaaguccauggaguuauc

SEQ ID NO: 60345 - RNA, 19 nt, Homo sapiens
acagaaguccauggaguua

SEQ ID NO: 60346 - RNA, 19 nt, Homo sapiens
auacagacaaguagaaaga

SEQ ID NO: 60347 - RNA, 19 nt, Homo sapiens
ccagacuugucccuccuuu

SEQ ID NO: 60348 - RNA, 19 nt, Homo sapiens
gaucauugcaaacucaaca

SEQ ID NO: 60349 - RNA, 19 nt, Homo sapiens
caggauauugacauugaua

SEQ ID NO: 60350 - RNA, 19 nt, Homo sapiens
ucucauaaccaggauauug

SEQ ID NO: 60351 - RNA, 19 nt, Homo sapiens
acagggaacucagaauaca

SEQ ID NO: 60352 - RNA, 19 nt, Homo sapiens
caacaccccuguggauaaa

SEQ ID NO: 60353 - RNA, 19 nt, Homo sapiens
ccaggagaccagaacauga

SEQ ID NO: 60354 - RNA, 19 nt, Homo sapiens
ucacgcucacgauuuguua

SEQ ID NO: 60355 - RNA, 19 nt, Homo sapiens
gauuaugggcacuaugaug

SEQ ID NO: 60356 - RNA, 19 nt, Homo sapiens
ccuguaaucccagaacuuu

SEQ ID NO: 60357 - RNA, 19 nt, Homo sapiens
cuaacucuccuccauguug

SEQ ID NO: 60358 - RNA, 19 nt, Homo sapiens
gugguggccaguuucuuua

SEQ ID NO: 60359 - RNA, 19 nt, Homo sapiens
aggcugaggugggagaauu

SEQ ID NO: 60360 - RNA, 19 nt, Homo sapiens
gaagacccaggcaguguag

SEQ ID NO: 60361 - RNA, 19 nt, Homo sapiens
ccaccuuccugcugcugaa

SEQ ID NO: 60362 - RNA, 19 nt, Homo sapiens
uaacuggaaucucaaaagu

SEQ ID NO: 60363 - RNA, 19 nt, Homo sapiens
caaacagaaacccguguau

SEQ ID NO: 60364 - RNA, 19 nt, Homo sapiens
cauccuuccucauuugcaa

SEQ ID NO: 60365 - RNA, 19 nt, Homo sapiens
ucauccugcucaacaugua

SEQ ID NO: 60366 - RNA, 19 nt, Homo sapiens
gcaaacucaacacaauugu

SEQ ID NO: 60367 - RNA, 19 nt, Homo sapiens
ucgcaccacugcacucuag

SEQ ID NO: 60368 - RNA, 19 nt, Homo sapiens
agaauacagacaaguagaa

SEQ ID NO: 60369 - RNA, 19 nt, Homo sapiens
uuagggagagcaagucauu

SEQ ID NO: 60370 - RNA, 19 nt, Homo sapiens
aggaauccacucuccauuu

SEQ ID NO: 60371 - RNA, 19 nt, Homo sapiens
ccacacaccaucuuuccau

SEQ ID NO: 60372 - RNA, 19 nt, Homo sapiens
aggaguacuuuccaccaaa

SEQ ID NO: 60373 - RNA, 19 nt, Homo sapiens
ggauauugacauugauaca

SEQ ID NO: 60374 - RNA, 19 nt, Homo sapiens
gcaguuuuguuuguacuuu

SEQ ID NO: 60375 - RNA, 19 nt, Homo sapiens
gaauugcucgaaccuugga

SEQ ID NO: 60376 - RNA, 19 nt, Homo sapiens
gaaaccccgucuguacuaa

SEQ ID NO: 60377 - RNA, 19 nt, Homo sapiens
acaaacagaaacccgugua

SEQ ID NO: 60378 - RNA, 19 nt, Homo sapiens
acugaagaguccgugguua

SEQ ID NO: 60379 - RNA, 19 nt, Homo sapiens
gccaguuucuuuaucuucu

SEQ ID NO: 60380 - RNA, 19 nt, Homo sapiens
auacaggacauucucauca

SEQ ID NO: 60381 - RNA, 19 nt, Homo sapiens
caauguagucucauaacca

SEQ ID NO: 60382 - RNA, 19 nt, Homo sapiens
cuucucauccuuccucauu

SEQ ID NO: 60383 - RNA, 19 nt, Homo sapiens
uccggaacguguugacuga

SEQ ID NO: 60384 - RNA, 19 nt, Homo sapiens
ccuuccugcugcugaauaa

SEQ ID NO: 60385 - RNA, 19 nt, Homo sapiens
ggauaaugauguccuuccu

SEQ ID NO: 60386 - RNA, 19 nt, Homo sapiens
gauacaggacauucucauc

SEQ ID NO: 60387 - RNA, 19 nt, Homo sapiens
cagaauacagacaaguaga

SEQ ID NO: 60388 - RNA, 19 nt, Homo sapiens
cugauuaugggcacuauga

SEQ ID NO: 60389 - RNA, 19 nt, Homo sapiens
agaagacccaggcagugua

SEQ ID NO: 60390 - RNA, 19 nt, Homo sapiens
gguggccaguuucuuuauc

SEQ ID NO: 60391 - RNA, 19 nt, Homo sapiens
uacucacgcucacgauuug

SEQ ID NO: 60392 - RNA, 19 nt, Homo sapiens
ccaucugguuccucaacuu

SEQ ID NO: 60393 - RNA, 19 nt, Homo sapiens
caucuuugcagucgucuuc

SEQ ID NO: 60394 - RNA, 19 nt, Homo sapiens
gccaagcggaccaucaaug

SEQ ID NO: 60395 - RNA, 19 nt, Homo sapiens
gggaugguguuaccuuagc

SEQ ID NO: 60396 - RNA, 19 nt, Homo sapiens
gcucacgauuuguuacacu

SEQ ID NO: 60397 - RNA, 19 nt, Homo sapiens
aaacagaaacccguguauc

SEQ ID NO: 60398 - RNA, 19 nt, Homo sapiens
caucugguuccucaacuug

SEQ ID NO: 60399 - RNA, 19 nt, Homo sapiens
uaaccuguuuugagcuuaa

SEQ ID NO: 60400 - RNA, 19 nt, Homo sapiens
aaauuaacugggcauggua

SEQ ID NO: 60401 - RNA, 19 nt, Homo sapiens
gcucuuguaagugaguuaa

SEQ ID NO: 60402 - RNA, 19 nt, Homo sapiens
cagacaaguagaaagauuc

SEQ ID NO: 60403 - RNA, 19 nt, Homo sapiens
uuugcaaggugaacacuuc

SEQ ID NO: 60404 - RNA, 19 nt, Homo sapiens
aacuaacucuccuccaugu

SEQ ID NO: 60405 - RNA, 19 nt, Homo sapiens
cagugaagauacaggacau

SEQ ID NO: 60406 - RNA, 19 nt, Homo sapiens
cucauaaccaggauauuga

SEQ ID NO: 60407 - RNA, 19 nt, Homo sapiens
gaaacagucuccagauuau

SEQ ID NO: 60408 - RNA, 19 nt, Homo sapiens
ggacaagacuuucauccaa

SEQ ID NO: 60409 - RNA, 19 nt, Homo sapiens
gagaagauguugaaauuuc

SEQ ID NO: 60410 - RNA, 19 nt, Homo sapiens
ggaaagcuuugcaagagua

SEQ ID NO: 60411 - RNA, 19 nt, Homo sapiens
gaauguaacuggcaaagau

SEQ ID NO: 60412 - RNA, 19 nt, Homo sapiens
ggacaaccauguaucaaug

SEQ ID NO: 60413 - RNA, 19 nt, Homo sapiens
caacaaggcucauucucaa

SEQ ID NO: 60414 - RNA, 19 nt, Homo sapiens
gaaagaauccuguggcuau

SEQ ID NO: 60415 - RNA, 19 nt, Homo sapiens
gaaaccaacucuacugugu

SEQ ID NO: 60416 - RNA, 19 nt, Homo sapiens
gaagaucucuguguguuug

SEQ ID NO: 60417 - RNA, 19 nt, Homo sapiens
ccaacaagcugucagagaa

SEQ ID NO: 60418 - RNA, 19 nt, Homo sapiens
gcaccuuucugaugucuuu

SEQ ID NO: 60419 - RNA, 19 nt, Homo sapiens
gagcagacacagacaaaua

SEQ ID NO: 60420 - RNA, 19 nt, Homo sapiens
gggcaugucuuauucaguu

SEQ ID NO: 60421 - RNA, 19 nt, Homo sapiens
gaccuucucuaucaguuua

SEQ ID NO: 60422 - RNA, 19 nt, Homo sapiens
gcucaaaguuacugacaaa

SEQ ID NO: 60423 - RNA, 19 nt, Homo sapiens
ggauuuaacuucucuugga

SEQ ID NO: 60424 - RNA, 19 nt, Homo sapiens
uaacauauauacccucuuc

SEQ ID NO: 60425 - RNA, 19 nt, Homo sapiens
gaacucggcagauaauaaa

SEQ ID NO: 60426 - RNA, 19 nt, Homo sapiens
uggagaagauguugaaauu

SEQ ID NO: 60427 - RNA, 19 nt, Homo sapiens
gaggcugacugcaagaaua

SEQ ID NO: 60428 - RNA, 19 nt, Homo sapiens
aaacagauuucuacaagga

SEQ ID NO: 60429 - RNA, 19 nt, Homo sapiens
ggaagaagccaaacacugu

SEQ ID NO: 60430 - RNA, 19 nt, Homo sapiens
ggacaccacccauuucaaa

SEQ ID NO: 60431 - RNA, 19 nt, Homo sapiens
gcaggagacuagagaaugu

SEQ ID NO: 60432 - RNA, 19 nt, Homo sapiens
ccacagcagucucguaaau

SEQ ID NO: 60433 - RNA, 19 nt, Homo sapiens
gaaauuucaugccuuacug

SEQ ID NO: 60434 - RNA, 19 nt, Homo sapiens
ugaaugcucugaucaacaa

SEQ ID NO: 60435 - RNA, 19 nt, Homo sapiens
gauaaguacuaccaggaaa

SEQ ID NO: 60436 - RNA, 19 nt, Homo sapiens
uguaugaccuucucuauca

SEQ ID NO: 60437 - RNA, 19 nt, Homo sapiens
gguacaaacugcagaagau

SEQ ID NO: 60438 - RNA, 19 nt, Homo sapiens
gaaaguguuuggccuagca

SEQ ID NO: 60439 - RNA, 19 nt, Homo sapiens
agaaacagucuccagauua

SEQ ID NO: 60440 - RNA, 19 nt, Homo sapiens
ugaaagcacuuaaccaucu

SEQ ID NO: 60441 - RNA, 19 nt, Homo sapiens
cccaauaauuugcagcuua

SEQ ID NO: 60442 - RNA, 19 nt, Homo sapiens
gaaccaacuccuacaaaug

SEQ ID NO: 60443 - RNA, 19 nt, Homo sapiens
acacagacuccaacgauua

SEQ ID NO: 60444 - RNA, 19 nt, Homo sapiens
ccugagaacucggcagaua

SEQ ID NO: 60445 - RNA, 19 nt, Homo sapiens
ggaucugaaugcauuugua

SEQ ID NO: 60446 - RNA, 19 nt, Homo sapiens
gcucuggucuggaggagaa

SEQ ID NO: 60447 - RNA, 19 nt, Homo sapiens
aaacagaaaucuccagaac

SEQ ID NO: 60448 - RNA, 19 nt, Homo sapiens
caaugaugaugaagaaaug

SEQ ID NO: 60449 - RNA, 19 nt, Homo sapiens
ccauaauucugccuucaaa

SEQ ID NO: 60450 - RNA, 19 nt, Homo sapiens
gaggaagacugcacauuuu

SEQ ID NO: 60451 - RNA, 19 nt, Homo sapiens
gaacuaaagaacucagguu

SEQ ID NO: 60452 - RNA, 19 nt, Homo sapiens
gaagcuuuguuuggauuaa

SEQ ID NO: 60453 - RNA, 19 nt, Homo sapiens
gagaaguccuugauaacuc

SEQ ID NO: 60454 - RNA, 19 nt, Homo sapiens
ccagaaaguuagaaugcaa

SEQ ID NO: 60455 - RNA, 19 nt, Homo sapiens
guauacaggaugucaagua

SEQ ID NO: 60456 - RNA, 19 nt, Homo sapiens
gaagaaccaacuccuacaa

SEQ ID NO: 60457 - RNA, 19 nt, Homo sapiens
gaaauacugcauccuggaa

SEQ ID NO: 60458 - RNA, 19 nt, Homo sapiens
gcaaacaggaagauggaaa

SEQ ID NO: 60459 - RNA, 19 nt, Homo sapiens
gaagugggaacuauaagau

SEQ ID NO: 60460 - RNA, 19 nt, Homo sapiens
gcagugaggaacuaaagaa

SEQ ID NO: 60461 - RNA, 19 nt, Homo sapiens
uaacuucucuuggacacaa

SEQ ID NO: 60462 - RNA, 19 nt, Homo sapiens
gauuuaccaucccgaagaa

SEQ ID NO: 60463 - RNA, 19 nt, Homo sapiens
ccaauaauuugcagcuuag

SEQ ID NO: 60464 - RNA, 19 nt, Homo sapiens
ggacagaaacaaucaggau

SEQ ID NO: 60465 - RNA, 19 nt, Homo sapiens
uagaauuggugaauccauu

SEQ ID NO: 60466 - RNA, 19 nt, Homo sapiens
gaucugcaccuuucugaug

SEQ ID NO: 60467 - RNA, 19 nt, Homo sapiens
ugcagaagaugacuugaaa

SEQ ID NO: 60468 - RNA, 19 nt, Homo sapiens
gagaauucuugcacaaaca

SEQ ID NO: 60469 - RNA, 19 nt, Homo sapiens
ccaaaugugucugccuauu

SEQ ID NO: 60470 - RNA, 19 nt, Homo sapiens
gacacagacuccaacgauu

SEQ ID NO: 60471 - RNA, 19 nt, Homo sapiens
caggaaagcuuugcaagag

SEQ ID NO: 60472 - RNA, 19 nt, Homo sapiens
cuacaaggauuuaacuucu

SEQ ID NO: 60473 - RNA, 19 nt, Homo sapiens
cuacaaaugagaauucuug

SEQ ID NO: 60474 - RNA, 19 nt, Homo sapiens
agaggaagacugcacauuu

SEQ ID NO: 60475 - RNA, 19 nt, Homo sapiens
aaccaugcauuccaucuaa

SEQ ID NO: 60476 - RNA, 19 nt, Homo sapiens
gacaguggccgcugcauug

SEQ ID NO: 60477 - RNA, 19 nt, Homo sapiens
gcaagcaggagacuagaga

SEQ ID NO: 60478 - RNA, 19 nt, Homo sapiens
caaaugugucugccuauug

SEQ ID NO: 60479 - RNA, 19 nt, Homo sapiens
ggagaagauguugaaauuu

SEQ ID NO: 60480 - RNA, 19 nt, Homo sapiens
guaccugugaugcuacuua

SEQ ID NO: 60481 - RNA, 19 nt, Homo sapiens
gaaagcacuuaaccaucug

SEQ ID NO: 60482 - RNA, 19 nt, Homo sapiens
caacgaaagcuaaagaucu

SEQ ID NO: 60483 - RNA, 19 nt, Homo sapiens
gaagaugacuugaaaacag

SEQ ID NO: 60484 - RNA, 19 nt, Homo sapiens
gaaaaugacuguggagaca

SEQ ID NO: 60485 - RNA, 19 nt, Homo sapiens
acacagacaaauaguagua

SEQ ID NO: 60486 - RNA, 19 nt, Homo sapiens
gcccuuauguagccuguga

SEQ ID NO: 60487 - RNA, 19 nt, Homo sapiens
cacaaacucugcuuaaagg

SEQ ID NO: 60488 - RNA, 19 nt, Homo sapiens
ggaacaaccucaggaaagc

SEQ ID NO: 60489 - RNA, 19 nt, Homo sapiens
ccagcacaaugaacagauu

SEQ ID NO: 60490 - RNA, 19 nt, Homo sapiens
gaucugaaugcauuuguau

SEQ ID NO: 60491 - RNA, 19 nt, Homo sapiens
ccugugaugcuacuuauaa

SEQ ID NO: 60492 - RNA, 19 nt, Homo sapiens
agaauaaauuucgcuguga

SEQ ID NO: 60493 - RNA, 19 nt, Homo sapiens
agaaccaacuccuacaaau

SEQ ID NO: 60494 - RNA, 19 nt, Homo sapiens
gagaaaacauugaacaucu

SEQ ID NO: 60495 - RNA, 19 nt, Homo sapiens
uauauacccucuucauucu

SEQ ID NO: 60496 - RNA, 19 nt, Homo sapiens
cagagauuguauagaauug

SEQ ID NO: 60497 - RNA, 19 nt, Homo sapiens
caacaagcugucagagaaa

SEQ ID NO: 60498 - RNA, 19 nt, Homo sapiens
gcagcaagcaggagacuag

SEQ ID NO: 60499 - RNA, 19 nt, Homo sapiens
ccacaaacucugcuuaaag

SEQ ID NO: 60500 - RNA, 19 nt, Homo sapiens
acagcagucucguaaauuc

SEQ ID NO: 60501 - RNA, 19 nt, Homo sapiens
aaacauugaacaucuguga

SEQ ID NO: 60502 - RNA, 19 nt, Homo sapiens
gacgggaccuggagacaag

SEQ ID NO: 60503 - RNA, 19 nt, Homo sapiens
gagcagagaaauccauauc

SEQ ID NO: 60504 - RNA, 19 nt, Homo sapiens
aaacaaaaguggaacauag

SEQ ID NO: 60505 - RNA, 19 nt, Homo sapiens
uagaauacaacucugcuuu

SEQ ID NO: 60506 - RNA, 19 nt, Homo sapiens
gcuaggcccagcacaauga

SEQ ID NO: 60507 - RNA, 19 nt, Homo sapiens
gaagaaggguuuagcauuu

SEQ ID NO: 60508 - RNA, 19 nt, Homo sapiens
ggaaaugcauugucagaaa

SEQ ID NO: 60509 - RNA, 19 nt, Homo sapiens
gaaggauacucucuuauug

SEQ ID NO: 60510 - RNA, 19 nt, Homo sapiens
gaagauuaaucgaccagua

SEQ ID NO: 60511 - RNA, 19 nt, Homo sapiens
ggaaauguccuguccuaua

SEQ ID NO: 60512 - RNA, 19 nt, Homo sapiens
gaacacacaucaucuaguc

SEQ ID NO: 60513 - RNA, 19 nt, Homo sapiens
ugagagggcuuaaaugaaa

SEQ ID NO: 60514 - RNA, 19 nt, Homo sapiens
gggagaaacugcagaauuc

SEQ ID NO: 60515 - RNA, 19 nt, Homo sapiens
gaaaugagagggcuuaaau

SEQ ID NO: 60516 - RNA, 19 nt, Homo sapiens
guacacagguagauuaguu

SEQ ID NO: 60517 - RNA, 19 nt, Homo sapiens
gaacgugaucuccugauua

SEQ ID NO: 60518 - RNA, 19 nt, Homo sapiens
gaaauguccuguccuauac

SEQ ID NO: 60519 - RNA, 19 nt, Homo sapiens
uauaugagcugguaaagga

SEQ ID NO: 60520 - RNA, 19 nt, Homo sapiens
ggaguacacagguagauua

SEQ ID NO: 60521 - RNA, 19 nt, Homo sapiens
caaauacaauucagucuuc

SEQ ID NO: 60522 - RNA, 19 nt, Homo sapiens
gauacucucuuauuggaaa

SEQ ID NO: 60523 - RNA, 19 nt, Homo sapiens
guaguaaucucacacuuca

SEQ ID NO: 60524 - RNA, 19 nt, Homo sapiens
ccacauugcuuuccuuugu

SEQ ID NO: 60525 - RNA, 19 nt, Homo sapiens
gaagaaugcccgcugugua

SEQ ID NO: 60526 - RNA, 19 nt, Homo sapiens
aagaguaucuggaugaauu

SEQ ID NO: 60527 - RNA, 19 nt, Homo sapiens
gguagaaauuacacccuua

SEQ ID NO: 60528 - RNA, 19 nt, Homo sapiens
uaggagaguuccaaaguuu

SEQ ID NO: 60529 - RNA, 19 nt, Homo sapiens
ggaagaaggguuuagcauu

SEQ ID NO: 60530 - RNA, 19 nt, Homo sapiens
ugacuaaucuuccucaagu

SEQ ID NO: 60531 - RNA, 19 nt, Homo sapiens
acaauucagucuucucuuu

SEQ ID NO: 60532 - RNA, 19 nt, Homo sapiens
ccaaaucugaaucgaauua

SEQ ID NO: 60533 - RNA, 19 nt, Homo sapiens
aaugaaggauacucucuua

SEQ ID NO: 60534 - RNA, 19 nt, Homo sapiens
gacagagucucacuuuguu

SEQ ID NO: 60535 - RNA, 19 nt, Homo sapiens
gaaaacaucugcacaacug

SEQ ID NO: 60536 - RNA, 19 nt, Homo sapiens
acauagaacuuacuggaaa

SEQ ID NO: 60537 - RNA, 19 nt, Homo sapiens
agaugaagguccaauguuu

SEQ ID NO: 60538 - RNA, 19 nt, Homo sapiens
ggauguaugugcucaagau

SEQ ID NO: 60539 - RNA, 19 nt, Homo sapiens
ccaaugaaauccauaaagg

SEQ ID NO: 60540 - RNA, 19 nt, Homo sapiens
uggcucaguucauuaauaa

SEQ ID NO: 60541 - RNA, 19 nt, Homo sapiens
gaaguggcucaguucauua

SEQ ID NO: 60542 - RNA, 19 nt, Homo sapiens
ggaacagagucaucaauac

SEQ ID NO: 60543 - RNA, 19 nt, Homo sapiens
gauuuacgguggcuuguug

SEQ ID NO: 60544 - RNA, 19 nt, Homo sapiens
gaacuuacuggaaaugguu

SEQ ID NO: 60545 - RNA, 19 nt, Homo sapiens
uaaaccuccuccuaacaua

SEQ ID NO: 60546 - RNA, 19 nt, Homo sapiens
ggacaauccugcuggaaac

SEQ ID NO: 60547 - RNA, 19 nt, Homo sapiens
ggaaaugguuacaaugaac

SEQ ID NO: 60548 - RNA, 19 nt, Homo sapiens
ggagaaaugagagggcuua

SEQ ID NO: 60549 - RNA, 19 nt, Homo sapiens
guucugacccugguaaaua

SEQ ID NO: 60550 - RNA, 19 nt, Homo sapiens
gaaaugcauugucagaaaa

SEQ ID NO: 60551 - RNA, 19 nt, Homo sapiens
gaaccacauugcuuuccuu

SEQ ID NO: 60552 - RNA, 19 nt, Homo sapiens
guggaaauguccuguccua

SEQ ID NO: 60553 - RNA, 19 nt, Homo sapiens
ggauacagucccagaguuu

SEQ ID NO: 60554 - RNA, 19 nt, Homo sapiens
gaaaauugccuguguucua

SEQ ID NO: 60555 - RNA, 19 nt, Homo sapiens
gaacccagaacaauguauu

SEQ ID NO: 60556 - RNA, 19 nt, Homo sapiens
aaacauacgucgacagaac

SEQ ID NO: 60557 - RNA, 19 nt, Homo sapiens
gugagaaggugacuguuuc

SEQ ID NO: 60558 - RNA, 19 nt, Homo sapiens
ggccagauguggagaagau

SEQ ID NO: 60559 - RNA, 19 nt, Homo sapiens
ugaaggauacucucuuauu

SEQ ID NO: 60560 - RNA, 19 nt, Homo sapiens
cuugaaagauggauuuguu

SEQ ID NO: 60561 - RNA, 19 nt, Homo sapiens
uaaucuuccucaagucaua

SEQ ID NO: 60562 - RNA, 19 nt, Homo sapiens
gcaaggagcagacgauguc

SEQ ID NO: 60563 - RNA, 19 nt, Homo sapiens
gaaacccaguggccagaug

SEQ ID NO: 60564 - RNA, 19 nt, Homo sapiens
ggaggagaauacagaguuc

SEQ ID NO: 60565 - RNA, 19 nt, Homo sapiens
guggcucaguucauuaaua

SEQ ID NO: 60566 - RNA, 19 nt, Homo sapiens
ugacugugcauuugagaua

SEQ ID NO: 60567 - RNA, 19 nt, Homo sapiens
aaauguaaauccucagguu

SEQ ID NO: 60568 - RNA, 19 nt, Homo sapiens
ugaagacagugcugaugaa

SEQ ID NO: 60569 - RNA, 19 nt, Homo sapiens
gaggauugcacuagagaaa

SEQ ID NO: 60570 - RNA, 19 nt, Homo sapiens
gcacacaaugcgaagauga

SEQ ID NO: 60571 - RNA, 19 nt, Homo sapiens
ugcaauggcuguaccaaga

SEQ ID NO: 60572 - RNA, 19 nt, Homo sapiens
ccaagcagcugggauuaca

SEQ ID NO: 60573 - RNA, 19 nt, Homo sapiens
ccagccaucuguauaaaca

SEQ ID NO: 60574 - RNA, 19 nt, Homo sapiens
gcauuuguguggaagugaa

SEQ ID NO: 60575 - RNA, 19 nt, Homo sapiens
gaaagauggauuuguucaa

SEQ ID NO: 60576 - RNA, 19 nt, Homo sapiens
gcugacaccuuuauaugag

SEQ ID NO: 60577 - RNA, 19 nt, Homo sapiens
gcaguuauacuucacauac

SEQ ID NO: 60578 - RNA, 19 nt, Homo sapiens
cgacagaacacacaucauc

SEQ ID NO: 60579 - RNA, 19 nt, Homo sapiens
guacuuggucuuauguaaa

SEQ ID NO: 60580 - RNA, 19 nt, Homo sapiens
aggauuagaacacucauua

SEQ ID NO: 60581 - RNA, 19 nt, Homo sapiens
acagguagauuaguuugaa

SEQ ID NO: 60582 - RNA, 19 nt, Homo sapiens
uaaagaggacuugaacaaa

SEQ ID NO: 60583 - RNA, 19 nt, Homo sapiens
ccagaacacacucuacaaa

SEQ ID NO: 60584 - RNA, 19 nt, Homo sapiens
gcugcguguucuugaaaua

SEQ ID NO: 60585 - RNA, 19 nt, Homo sapiens
ggaccuuccuuggauguau

SEQ ID NO: 60586 - RNA, 19 nt, Homo sapiens
uaaguggaguccugagaug

SEQ ID NO: 60587 - RNA, 19 nt, Homo sapiens
ggugagaaggugacuguuu

SEQ ID NO: 60588 - RNA, 19 nt, Homo sapiens
aaacauaggacuggaaguu

SEQ ID NO: 60589 - RNA, 19 nt, Homo sapiens
aaagaggacuugaacaaaa

SEQ ID NO: 60590 - RNA, 19 nt, Homo sapiens
cuucauaucuggccuuagu

SEQ ID NO: 60591 - RNA, 19 nt, Homo sapiens
cuucagaugacaaggauua

SEQ ID NO: 60592 - RNA, 19 nt, Homo sapiens
acauaggacuggaaguuug

SEQ ID NO: 60593 - RNA, 19 nt, Homo sapiens
cgacagaaagcacacaaug

SEQ ID NO: 60594 - RNA, 19 nt, Homo sapiens
ggauuagaacacucauuaa

SEQ ID NO: 60595 - RNA, 19 nt, Homo sapiens
gcuggaauacuuacucuug

SEQ ID NO: 60596 - RNA, 19 nt, Homo sapiens
ucucacacuucauccuaua

SEQ ID NO: 60597 - RNA, 19 nt, Homo sapiens
ucccaaaucugaaucgaau

SEQ ID NO: 60598 - RNA, 19 nt, Homo sapiens
ugaaauccauaaaggaaag

SEQ ID NO: 60599 - RNA, 19 nt, Homo sapiens
gaacacucauuaagaugcu

SEQ ID NO: 60600 - RNA, 19 nt, Homo sapiens
aaugagagggcuuaaauga

SEQ ID NO: 60601 - RNA, 19 nt, Homo sapiens
aaagauggauuuguucaag

SEQ ID NO: 60602 - RNA, 19 nt, Homo sapiens
gcggucaguugcuguguau

SEQ ID NO: 60603 - RNA, 19 nt, Homo sapiens
uggaaaugguuacaaugaa

SEQ ID NO: 60604 - RNA, 19 nt, Homo sapiens
gagagggcuuaaaugaaau

SEQ ID NO: 60605 - RNA, 19 nt, Homo sapiens
gagaacaaauacaauucag

SEQ ID NO: 60606 - RNA, 19 nt, Homo sapiens
ugacuaggauaacagaaag

SEQ ID NO: 60607 - RNA, 19 nt, Homo sapiens
ggagggagcuucgauauga

SEQ ID NO: 60608 - RNA, 19 nt, Homo sapiens
caaaugaccuucuuuccaa

SEQ ID NO: 60609 - RNA, 19 nt, Homo sapiens
gcagagauaucacgacaug

SEQ ID NO: 60610 - RNA, 19 nt, Homo sapiens
ccaauuuccugaauagaua

SEQ ID NO: 60611 - RNA, 19 nt, Homo sapiens
gcagacaccugaaacaauc

SEQ ID NO: 60612 - RNA, 19 nt, Homo sapiens
ggacaggauuuccagugua

SEQ ID NO: 60613 - RNA, 19 nt, Homo sapiens
ggaggucauuaaaguauaa

SEQ ID NO: 60614 - RNA, 19 nt, Homo sapiens
gaggaaggaugacauuaug

SEQ ID NO: 60615 - RNA, 19 nt, Homo sapiens
gaauauauccuggugauug

SEQ ID NO: 60616 - RNA, 19 nt, Homo sapiens
gacaggauuuccaguguaa

SEQ ID NO: 60617 - RNA, 19 nt, Homo sapiens
gaacuuacaggauguuaga

SEQ ID NO: 60618 - RNA, 19 nt, Homo sapiens
gauguugacuguuaacuag

SEQ ID NO: 60619 - RNA, 19 nt, Homo sapiens
acagccaacuauucuauua

SEQ ID NO: 60620 - RNA, 19 nt, Homo sapiens
gaccaggacugccuugaug

SEQ ID NO: 60621 - RNA, 19 nt, Homo sapiens
uagaagcucuguccuacuu

SEQ ID NO: 60622 - RNA, 19 nt, Homo sapiens
gagaagagagugugacaau

SEQ ID NO: 60623 - RNA, 19 nt, Homo sapiens
caagccagcugcuccaguu

SEQ ID NO: 60624 - RNA, 19 nt, Homo sapiens
cagaacaggagcaccauua

SEQ ID NO: 60625 - RNA, 19 nt, Homo sapiens
cuauggagaugaugagaaa

SEQ ID NO: 60626 - RNA, 19 nt, Homo sapiens
gggaggucauuaaaguaua

SEQ ID NO: 60627 - RNA, 19 nt, Homo sapiens
gcugagauguuugcuguug

SEQ ID NO: 60628 - RNA, 19 nt, Homo sapiens
ccaggaagaugcucagagu

SEQ ID NO: 60629 - RNA, 19 nt, Homo sapiens
ggacgacugugaagauguc

SEQ ID NO: 60630 - RNA, 19 nt, Homo sapiens
uaagagaagaugcaaauca

SEQ ID NO: 60631 - RNA, 19 nt, Homo sapiens
gagcaggcauccaggaaag

SEQ ID NO: 60632 - RNA, 19 nt, Homo sapiens
aaauguugguggagguuua

SEQ ID NO: 60633 - RNA, 19 nt, Homo sapiens
gcaaaugaccuucuuucca

SEQ ID NO: 60634 - RNA, 19 nt, Homo sapiens
gaagaugucagggccauug

SEQ ID NO: 60635 - RNA, 19 nt, Homo sapiens
gaugggagcuggaguugcu

SEQ ID NO: 60636 - RNA, 19 nt, Homo sapiens
ccagaucaguacaauuaug

SEQ ID NO: 60637 - RNA, 19 nt, Homo sapiens
uauugggcguugauuguua

SEQ ID NO: 60638 - RNA, 19 nt, Homo sapiens
gagaugaugagaaauacuu

SEQ ID NO: 60639 - RNA, 19 nt, Homo sapiens
gauaugacuccaccuguga

SEQ ID NO: 60640 - RNA, 19 nt, Homo sapiens
uuccagaucaguacaauua

SEQ ID NO: 60641 - RNA, 19 nt, Homo sapiens
gaacaggagcaccauuaca

SEQ ID NO: 60642 - RNA, 19 nt, Homo sapiens
gagauaucacgacauguuu

SEQ ID NO: 60643 - RNA, 19 nt, Homo sapiens
ucggaaacccuacaacuuu

SEQ ID NO: 60644 - RNA, 19 nt, Homo sapiens
gaaggugaaccagagagua

SEQ ID NO: 60645 - RNA, 19 nt, Homo sapiens
gggccuugcuucaacaaug

SEQ ID NO: 60646 - RNA, 19 nt, Homo sapiens
accaguaucugauggaauu

SEQ ID NO: 60647 - RNA, 19 nt, Homo sapiens
ggaccaguaucugauggaa

SEQ ID NO: 60648 - RNA, 19 nt, Homo sapiens
aauauauccuggugauuga

SEQ ID NO: 60649 - RNA, 19 nt, Homo sapiens
gugaacgucucuacuaugg

SEQ ID NO: 60650 - RNA, 19 nt, Homo sapiens
ggucagaguggacagauug

SEQ ID NO: 60651 - RNA, 19 nt, Homo sapiens
ggauguugacuguuaacua

SEQ ID NO: 60652 - RNA, 19 nt, Homo sapiens
uggaaucuccucagaguuu

SEQ ID NO: 60653 - RNA, 19 nt, Homo sapiens
guacgaugccaguuauuau

SEQ ID NO: 60654 - RNA, 19 nt, Homo sapiens
gcagaugggagcuggaguu

SEQ ID NO: 60655 - RNA, 19 nt, Homo sapiens
uggguggcauuuaugaaua

SEQ ID NO: 60656 - RNA, 19 nt, Homo sapiens
aacuggauguugacuguua

SEQ ID NO: 60657 - RNA, 19 nt, Homo sapiens
cagccaguaugaaccaauu

SEQ ID NO: 60658 - RNA, 19 nt, Homo sapiens
gaggacgacugugaagaug

SEQ ID NO: 60659 - RNA, 19 nt, Homo sapiens
ugagauguuugcuguuguu

SEQ ID NO: 60660 - RNA, 19 nt, Homo sapiens
gaagcucuguccuacuuac

SEQ ID NO: 60661 - RNA, 19 nt, Homo sapiens
gaccagaugcuguggaugu

SEQ ID NO: 60662 - RNA, 19 nt, Homo sapiens
gaaacgccaccuugugugu

SEQ ID NO: 60663 - RNA, 19 nt, Homo sapiens
gcuucuggcugagauguuu

SEQ ID NO: 60664 - RNA, 19 nt, Homo sapiens
gaagagagugugacaaucc

SEQ ID NO: 60665 - RNA, 19 nt, Homo sapiens
gcaaacacagacagaagga

SEQ ID NO: 60666 - RNA, 19 nt, Homo sapiens
gaugaggaaggaugacauu

SEQ ID NO: 60667 - RNA, 19 nt, Homo sapiens
aaacaaucaacgcccaaua

SEQ ID NO: 60668 - RNA, 19 nt, Homo sapiens
gcacugacuauuggauaaa

SEQ ID NO: 60669 - RNA, 19 nt, Homo sapiens
gggagaacuuacaggaugu

SEQ ID NO: 60670 - RNA, 19 nt, Homo sapiens
agagauaucacgacauguu

SEQ ID NO: 60671 - RNA, 19 nt, Homo sapiens
ggguggcauuuaugaauau

SEQ ID NO: 60672 - RNA, 19 nt, Homo sapiens
caaaguaggaugaaaauuc

SEQ ID NO: 60673 - RNA, 19 nt, Homo sapiens
gagcaaacacagacagaag

SEQ ID NO: 60674 - RNA, 19 nt, Homo sapiens
ugaggaaggaugacauuau

SEQ ID NO: 60675 - RNA, 19 nt, Homo sapiens
uaaugcaaaugaccuucuu

SEQ ID NO: 60676 - RNA, 19 nt, Homo sapiens
acaaucaacgcccaauaaa

SEQ ID NO: 60677 - RNA, 19 nt, Homo sapiens
uaucaggagaccauuguaa

SEQ ID NO: 60678 - RNA, 19 nt, Homo sapiens
ucagggccauugacgaaga

SEQ ID NO: 60679 - RNA, 19 nt, Homo sapiens
aacaaucaacgcccaauaa

SEQ ID NO: 60680 - RNA, 19 nt, Homo sapiens
ggaaaggagaagagagugu

SEQ ID NO: 60681 - RNA, 19 nt, Homo sapiens
aaaauggaaucccuuggua

SEQ ID NO: 60682 - RNA, 19 nt, Homo sapiens
gaaggaaugcugcagucau

SEQ ID NO: 60683 - RNA, 19 nt, Homo sapiens
gugagacgguauacaaugg

SEQ ID NO: 60684 - RNA, 19 nt, Homo sapiens
gaagaugcucagagugugu

SEQ ID NO: 60685 - RNA, 19 nt, Homo sapiens
gccagcugcuccaguucua

SEQ ID NO: 60686 - RNA, 19 nt, Homo sapiens
ccuugggcauucaauauga

SEQ ID NO: 60687 - RNA, 19 nt, Homo sapiens
gguggcauuuaugaauaua

SEQ ID NO: 60688 - RNA, 19 nt, Homo sapiens
ggugacaucugggaucaag

SEQ ID NO: 60689 - RNA, 19 nt, Homo sapiens
gauguuugcuguuguuuuc

SEQ ID NO: 60690 - RNA, 19 nt, Homo sapiens
acaggagcaccauuacaua

SEQ ID NO: 60691 - RNA, 19 nt, Homo sapiens
auacuggaaucuccucaga

SEQ ID NO: 60692 - RNA, 19 nt, Homo sapiens
caucugcaguggugacauc

SEQ ID NO: 60693 - RNA, 19 nt, Homo sapiens
aaacugaaagggccaggaa

SEQ ID NO: 60694 - RNA, 19 nt, Homo sapiens
gagaacuuacaggauguua

SEQ ID NO: 60695 - RNA, 19 nt, Homo sapiens
cuacagccaacuauucuau

SEQ ID NO: 60696 - RNA, 19 nt, Homo sapiens
augcaaaucagcacacuuu

SEQ ID NO: 60697 - RNA, 19 nt, Homo sapiens
aagagaagaugcaaaucag

SEQ ID NO: 60698 - RNA, 19 nt, Homo sapiens
agaaggagccaaagcagau

SEQ ID NO: 60699 - RNA, 19 nt, Homo sapiens
aaaugaccuucuuuccaaa

SEQ ID NO: 60700 - RNA, 19 nt, Homo sapiens
ccugugaacgucucuacua

SEQ ID NO: 60701 - RNA, 19 nt, Homo sapiens
uguacgaugccaguuauua

SEQ ID NO: 60702 - RNA, 19 nt, Homo sapiens
aaggugaaccagagaguaa

SEQ ID NO: 60703 - RNA, 19 nt, Homo sapiens
guucacucauagaaacauu

SEQ ID NO: 60704 - RNA, 19 nt, Homo sapiens
acuauuggauaaagacuuc

SEQ ID NO: 60705 - RNA, 19 nt, Homo sapiens
gcuguggaagacauuauuu

SEQ ID NO: 60706 - RNA, 19 nt, Homo sapiens
uuacuccaauuuccugaau

SEQ ID NO: 60707 - RNA, 19 nt, Homo sapiens
gaagcaaacuguagaagga

SEQ ID NO: 60708 - RNA, 19 nt, Homo sapiens
caacuucucugacaaggaa

SEQ ID NO: 60709 - RNA, 19 nt, Homo sapiens
guacagguaugccuacuug

SEQ ID NO: 60710 - RNA, 19 nt, Homo sapiens
gcagugggcuacauacaau

SEQ ID NO: 60711 - RNA, 19 nt, Homo sapiens
aaacgauucucucauacua

SEQ ID NO: 60712 - RNA, 19 nt, Homo sapiens
guaaaccgcagacuucuuu

SEQ ID NO: 60713 - RNA, 19 nt, Homo sapiens
gaagucaagugcgauguga

SEQ ID NO: 60714 - RNA, 19 nt, Homo sapiens
gaauacacccucguuauga

SEQ ID NO: 60715 - RNA, 19 nt, Homo sapiens
gaacuuggcaucaguaguc

SEQ ID NO: 60716 - RNA, 19 nt, Homo sapiens
guaggcaaaugcagaggua

SEQ ID NO: 60717 - RNA, 19 nt, Homo sapiens
gaagccucaugcuccauua

SEQ ID NO: 60718 - RNA, 19 nt, Homo sapiens
caaaggcaguguaacaauc

SEQ ID NO: 60719 - RNA, 19 nt, Homo sapiens
gcaagucugguuucaguuu

SEQ ID NO: 60720 - RNA, 19 nt, Homo sapiens
aacaagagcuuugcuaaga

SEQ ID NO: 60721 - RNA, 19 nt, Homo sapiens
ggcaaacacuauauuagga

SEQ ID NO: 60722 - RNA, 19 nt, Homo sapiens
ucaaagugaucgaggcaaa

SEQ ID NO: 60723 - RNA, 19 nt, Homo sapiens
gcagacagaugcggagugu

SEQ ID NO: 60724 - RNA, 19 nt, Homo sapiens
caaaugcagucaacaagag

SEQ ID NO: 60725 - RNA, 19 nt, Homo sapiens
gcucagcccuacaccaguu

SEQ ID NO: 60726 - RNA, 19 nt, Homo sapiens
gaucgaggcaaacacuaua

SEQ ID NO: 60727 - RNA, 19 nt, Homo sapiens
accaaacgauucucucaua

SEQ ID NO: 60728 - RNA, 19 nt, Homo sapiens
gaaccaaacgauucucuca

SEQ ID NO: 60729 - RNA, 19 nt, Homo sapiens
cgaggcaaacacuauauua

SEQ ID NO: 60730 - RNA, 19 nt, Homo sapiens
gcaagcaagucugguuuca

SEQ ID NO: 60731 - RNA, 19 nt, Homo sapiens
caagacaaaggcaguguaa

SEQ ID NO: 60732 - RNA, 19 nt, Homo sapiens
ggagcuauuucuucucugu

SEQ ID NO: 60733 - RNA, 19 nt, Homo sapiens
caacccagccaucaucaaa

SEQ ID NO: 60734 - RNA, 19 nt, Homo sapiens
ccagugggauaaauuuguu

SEQ ID NO: 60735 - RNA, 19 nt, Homo sapiens
caacagaccaugcggaagu

SEQ ID NO: 60736 - RNA, 19 nt, Homo sapiens
gaggagauuauacucuuaa

SEQ ID NO: 60737 - RNA, 19 nt, Homo sapiens
aggcaaauacgaauucaua

SEQ ID NO: 60738 - RNA, 19 nt, Homo sapiens
gacugcaucuguccuguug

SEQ ID NO: 60739 - RNA, 19 nt, Homo sapiens
ccagccaucaucaaaguua

SEQ ID NO: 60740 - RNA, 19 nt, Homo sapiens
gagacgcugugcaguacaa

SEQ ID NO: 60741 - RNA, 19 nt, Homo sapiens
agcaugaaauggaccaaua

SEQ ID NO: 60742 - RNA, 19 nt, Homo sapiens
gcaaacuguagaaggauuu

SEQ ID NO: 60743 - RNA, 19 nt, Homo sapiens
ugaaguagcacauuacaag

SEQ ID NO: 60744 - RNA, 19 nt, Homo sapiens
uggagucccuguccugaaa

SEQ ID NO: 60745 - RNA, 19 nt, Homo sapiens
auugugagcugucuaguug

SEQ ID NO: 60746 - RNA, 19 nt, Homo sapiens
ggucaaaugcagucaacaa

SEQ ID NO: 60747 - RNA, 19 nt, Homo sapiens
ucaacaagagcuuugcuaa

SEQ ID NO: 60748 - RNA, 19 nt, Homo sapiens
ggagagaggagauuauacu

SEQ ID NO: 60749 - RNA, 19 nt, Homo sapiens
acgauucucucauacuaaa

SEQ ID NO: 60750 - RNA, 19 nt, Homo sapiens
aagcaagucugguuucagu

SEQ ID NO: 60751 - RNA, 19 nt, Homo sapiens
ccuacaauguggaaagcua

SEQ ID NO: 60752 - RNA, 19 nt, Homo sapiens
ccacagauuuugccuauuc

SEQ ID NO: 60753 - RNA, 19 nt, Homo sapiens
gaaacaagagggacaccau

SEQ ID NO: 60754 - RNA, 19 nt, Homo sapiens
gggugugucuguaggcaaa

SEQ ID NO: 60755 - RNA, 19 nt, Homo sapiens
gaacgcaaugucacagaga

SEQ ID NO: 60756 - RNA, 19 nt, Homo sapiens
ugaauacacccucguuaug

SEQ ID NO: 60757 - RNA, 19 nt, Homo sapiens
gcagacuucuuugcaaugg

SEQ ID NO: 60758 - RNA, 19 nt, Homo sapiens
agacaaaggcaguguaaca

SEQ ID NO: 60759 - RNA, 19 nt, Homo sapiens
guacaacccagccaucauc

SEQ ID NO: 60760 - RNA, 19 nt, Homo sapiens
gacaaaggcaguguaacaa

SEQ ID NO: 60761 - RNA, 19 nt, Homo sapiens
gggagacgcugugcaguac

SEQ ID NO: 60762 - RNA, 19 nt, Homo sapiens
aauacacccucguuaugaa

SEQ ID NO: 60763 - RNA, 19 nt, Homo sapiens
ccagucagaugaagcaaac

SEQ ID NO: 60764 - RNA, 19 nt, Homo sapiens
guggagaccagucagauga

SEQ ID NO: 60765 - RNA, 19 nt, Homo sapiens
caugcaagcuguuuaaaau

SEQ ID NO: 60766 - RNA, 19 nt, Homo sapiens
gguggagccucuguaugaa

SEQ ID NO: 60767 - RNA, 19 nt, Homo sapiens
caacaagagcuuugcuaag

SEQ ID NO: 60768 - RNA, 19 nt, Homo sapiens
caaagaggccauggagaga

SEQ ID NO: 60769 - RNA, 19 nt, Homo sapiens
ccuggaauauuugaacuug

SEQ ID NO: 60770 - RNA, 19 nt, Homo sapiens
agacguaagacaagacaaa

SEQ ID NO: 60771 - RNA, 19 nt, Homo sapiens
ggucaaauuggucuucaug

SEQ ID NO: 60772 - RNA, 19 nt, Homo sapiens
uaaaauugguggugccauu

SEQ ID NO: 60773 - RNA, 19 nt, Homo sapiens
ccaaacgauucucucauac

SEQ ID NO: 60774 - RNA, 19 nt, Homo sapiens
gaggcaaacacuauauuag

SEQ ID NO: 60775 - RNA, 19 nt, Homo sapiens
gaaagcuacacgccacaga

SEQ ID NO: 60776 - RNA, 19 nt, Homo sapiens
gaugggaaguggaauugcu

SEQ ID NO: 60777 - RNA, 19 nt, Homo sapiens
ucaaaugcagucaacaaga

SEQ ID NO: 60778 - RNA, 19 nt, Homo sapiens
cagccaucaucaaaguuaa

SEQ ID NO: 60779 - RNA, 19 nt, Homo sapiens
ccaaggcaaauacgaauuc

SEQ ID NO: 60780 - RNA, 19 nt, Homo sapiens
ccgcagacuucuuugcaau

SEQ ID NO: 60781 - RNA, 19 nt, Homo sapiens
uggcaucuccugucacauu

SEQ ID NO: 60782 - RNA, 19 nt, Homo sapiens
gcuccuagcagaugauaca

SEQ ID NO: 60783 - RNA, 19 nt, Homo sapiens
gaagacguaagacaagaca

SEQ ID NO: 60784 - RNA, 19 nt, Homo sapiens
ccacauuccuuugggucaa

SEQ ID NO: 60785 - RNA, 19 nt, Homo sapiens
caaggcaaauacgaauuca

SEQ ID NO: 60786 - RNA, 19 nt, Homo sapiens
gcagucaacaagagcuuug

SEQ ID NO: 60787 - RNA, 19 nt, Homo sapiens
gaugaagcaaacuguagaa

SEQ ID NO: 60788 - RNA, 19 nt, Homo sapiens
ggcaucuccugucacauug

SEQ ID NO: 60789 - RNA, 19 nt, Homo sapiens
gcacagugaggcagaacau

SEQ ID NO: 60790 - RNA, 19 nt, Homo sapiens
ccacagacccaaggcaaau

SEQ ID NO: 60791 - RNA, 19 nt, Homo sapiens
caaacuguagaaggauuua

SEQ ID NO: 60792 - RNA, 19 nt, Homo sapiens
gaagaaaagguacagguau

SEQ ID NO: 60793 - RNA, 19 nt, Homo sapiens
ucaaauuggucuucaugcu

SEQ ID NO: 60794 - RNA, 19 nt, Homo sapiens
uaagguggagccucuguau

SEQ ID NO: 60795 - RNA, 19 nt, Homo sapiens
uaugaauacacccucguua

SEQ ID NO: 60796 - RNA, 19 nt, Homo sapiens
uaggagaaccaaacgauuc

SEQ ID NO: 60797 - RNA, 19 nt, Homo sapiens
ggagaccagucagaugaag

SEQ ID NO: 60798 - RNA, 19 nt, Homo sapiens
ggaagucaagugcgaugug

SEQ ID NO: 60799 - RNA, 19 nt, Homo sapiens
acagugaggcagaacauga

SEQ ID NO: 60800 - RNA, 19 nt, Homo sapiens
gauugugagcugucuaguu

SEQ ID NO: 60801 - RNA, 19 nt, Homo sapiens
guggagcuauuucuucucu

SEQ ID NO: 60802 - RNA, 19 nt, Homo sapiens
gaggugaaaggccacauuc

SEQ ID NO: 60803 - RNA, 19 nt, Homo sapiens
ccucuuggaccacauguga

SEQ ID NO: 60804 - RNA, 19 nt, Homo sapiens
ugaugcccauugauuguga

SEQ ID NO: 60805 - RNA, 19 nt, Homo sapiens
gagaucucuuccgugauuu

SEQ ID NO: 60806 - RNA, 19 nt, Homo sapiens
gacccaaggcaaauacgaa

SEQ ID NO: 60807 - RNA, 19 nt, Homo sapiens
gacaguggguggaguggua

SEQ ID NO: 60808 - RNA, 19 nt, Homo sapiens
gagugguaccuacuuauua

SEQ ID NO: 60809 - RNA, 19 nt, Homo sapiens
guggagugguaccuacuua

SEQ ID NO: 60810 - RNA, 19 nt, Homo sapiens
ggagugguaccuacuuauu

SEQ ID NO: 60811 - RNA, 19 nt, Homo sapiens
agugguaccuacuuauuaa

SEQ ID NO: 60812 - RNA, 19 nt, Homo sapiens
gaguuucgcuguccuguac

SEQ ID NO: 60813 - RNA, 19 nt, Homo sapiens
gguaccuacuuauuaaaug

SEQ ID NO: 60814 - RNA, 19 nt, Homo sapiens
gaaaccagccucagaucag

SEQ ID NO: 60815 - RNA, 19 nt, Homo sapiens
gagaccgacuaccagaguu

SEQ ID NO: 60816 - RNA, 19 nt, Homo sapiens
ggaccagaucuucuacuuc

SEQ ID NO: 60817 - RNA, 19 nt, Homo sapiens
gucaguaccuuccgaaagc

SEQ ID NO: 60818 - RNA, 19 nt, Homo sapiens
ugacugaggaccagaucuu

SEQ ID NO: 60819 - RNA, 19 nt, Homo sapiens
ggacugcgacccucuugac

SEQ ID NO: 60820 - RNA, 19 nt, Homo sapiens
ugaaaccagccucagauca

SEQ ID NO: 60821 - RNA, 19 nt, Homo sapiens
ccagcucuauggagacaca

SEQ ID NO: 60822 - RNA, 19 nt, Homo sapiens
aggaccagaucuucuacuu

SEQ ID NO: 60823 - RNA, 19 nt, Homo sapiens
gcaggugcgccagcucuau

SEQ ID NO: 60824 - RNA, 19 nt, Homo sapiens
cugaggaccagaucuucua

SEQ ID NO: 60825 - RNA, 19 nt, Homo sapiens
cugcgacccucuugacucu

SEQ ID NO: 60826 - RNA, 19 nt, Homo sapiens
caaaguggauccaguguua

SEQ ID NO: 60827 - RNA, 19 nt, Homo sapiens
ggaacuaccuggacuuaaa

SEQ ID NO: 60828 - RNA, 19 nt, Homo sapiens
ggcaaacaguccauaauua

SEQ ID NO: 60829 - RNA, 19 nt, Homo sapiens
ggaauaugccuuucuuaua

SEQ ID NO: 60830 - RNA, 19 nt, Homo sapiens
caacuuacuuccugcauuu

SEQ ID NO: 60831 - RNA, 19 nt, Homo sapiens
uuacauaacuuccguauca

SEQ ID NO: 60832 - RNA, 19 nt, Homo sapiens
gcaaauaaaucuggugaau

SEQ ID NO: 60833 - RNA, 19 nt, Homo sapiens
gaaauaacauucucugacu

SEQ ID NO: 60834 - RNA, 19 nt, Homo sapiens
aagagaaacugggaaauua

SEQ ID NO: 60835 - RNA, 19 nt, Homo sapiens
caaagaaacuauagugaca

SEQ ID NO: 60836 - RNA, 19 nt, Homo sapiens
guacagccuugaaucuaua

SEQ ID NO: 60837 - RNA, 19 nt, Homo sapiens
caacaaagcauuuacagau

SEQ ID NO: 60838 - RNA, 19 nt, Homo sapiens
gcgaauagcugaugguucu

SEQ ID NO: 60839 - RNA, 19 nt, Homo sapiens
ggaccauaauucacuuuaa

SEQ ID NO: 60840 - RNA, 19 nt, Homo sapiens
ccaaagcguuucuggauug

SEQ ID NO: 60841 - RNA, 19 nt, Homo sapiens
gaagcaauacacccaaaua

SEQ ID NO: 60842 - RNA, 19 nt, Homo sapiens
cauagcagcucauaucaug

SEQ ID NO: 60843 - RNA, 19 nt, Homo sapiens
gcaguaguauugauagguu

SEQ ID NO: 60844 - RNA, 19 nt, Homo sapiens
gcaauacacccaaauacaa

SEQ ID NO: 60845 - RNA, 19 nt, Homo sapiens
uagaaacacugccaacuug

SEQ ID NO: 60846 - RNA, 19 nt, Homo sapiens
caguggagcugcaaauaaa

SEQ ID NO: 60847 - RNA, 19 nt, Homo sapiens
gugaugagaguauuuguua

SEQ ID NO: 60848 - RNA, 19 nt, Homo sapiens
ggaaauggacccucaggaa

SEQ ID NO: 60849 - RNA, 19 nt, Homo sapiens
gcgaggaaaugcccaaaga

SEQ ID NO: 60850 - RNA, 19 nt, Homo sapiens
gaaagaccguuuacaaagc

SEQ ID NO: 60851 - RNA, 19 nt, Homo sapiens
ucacguaguucuugguaaa

SEQ ID NO: 60852 - RNA, 19 nt, Homo sapiens
ggacuugaguuaacugaag

SEQ ID NO: 60853 - RNA, 19 nt, Homo sapiens
ggaaauagauacauauacc

SEQ ID NO: 60854 - RNA, 19 nt, Homo sapiens
gcaaacaguccauaauuag

SEQ ID NO: 60855 - RNA, 19 nt, Homo sapiens
gaaggagagccucaaacua

SEQ ID NO: 60856 - RNA, 19 nt, Homo sapiens
gaggagaugggauagcuua

SEQ ID NO: 60857 - RNA, 19 nt, Homo sapiens
cagagagaauacuuacaua

SEQ ID NO: 60858 - RNA, 19 nt, Homo sapiens
cagaagaauuucagagaga

SEQ ID NO: 60859 - RNA, 19 nt, Homo sapiens
gaaauuagagcaacaucau

SEQ ID NO: 60860 - RNA, 19 nt, Homo sapiens
gaggaaaugcccaaagaaa

SEQ ID NO: 60861 - RNA, 19 nt, Homo sapiens
agacagagauauuucaaca

SEQ ID NO: 60862 - RNA, 19 nt, Homo sapiens
acaaucagcuuuggaaguu

SEQ ID NO: 60863 - RNA, 19 nt, Homo sapiens
gaaauggacccucaggaau

SEQ ID NO: 60864 - RNA, 19 nt, Homo sapiens
gcauuuguuuguugaaaga

SEQ ID NO: 60865 - RNA, 19 nt, Homo sapiens
cacacaaacugcuagaauu

SEQ ID NO: 60866 - RNA, 19 nt, Homo sapiens
gcucauaucaugguuguuu

SEQ ID NO: 60867 - RNA, 19 nt, Homo sapiens
gagaugggauagcuuaaag

SEQ ID NO: 60868 - RNA, 19 nt, Homo sapiens
guuacacgcuguuuagcua

SEQ ID NO: 60869 - RNA, 19 nt, Homo sapiens
caagagaaacugggaaauu

SEQ ID NO: 60870 - RNA, 19 nt, Homo sapiens
ugaguuggauuagauguuu

SEQ ID NO: 60871 - RNA, 19 nt, Homo sapiens
ccaaagguguacuuagaga

SEQ ID NO: 60872 - RNA, 19 nt, Homo sapiens
gauccaagcuuaauuuuca

SEQ ID NO: 60873 - RNA, 19 nt, Homo sapiens
cuacagaccguauuuauca

SEQ ID NO: 60874 - RNA, 19 nt, Homo sapiens
agggaagaaucacuaaaua

SEQ ID NO: 60875 - RNA, 19 nt, Homo sapiens
ccacaguuauucaaacaau

SEQ ID NO: 60876 - RNA, 19 nt, Homo sapiens
gcauuuacaacucagauuu

SEQ ID NO: 60877 - RNA, 19 nt, Homo sapiens
gacacugguuuaaaugaaa

SEQ ID NO: 60878 - RNA, 19 nt, Homo sapiens
cuaccuggacuuaaauuua

SEQ ID NO: 60879 - RNA, 19 nt, Homo sapiens
auaaauuucugucccguaa

SEQ ID NO: 60880 - RNA, 19 nt, Homo sapiens
guaauccuguggaaauaga

SEQ ID NO: 60881 - RNA, 19 nt, Homo sapiens
gguguuaccuaggccauaa

SEQ ID NO: 60882 - RNA, 19 nt, Homo sapiens
caugaaauguguucuccaa

SEQ ID NO: 60883 - RNA, 19 nt, Homo sapiens
ucuguagacucaaaucuuu

SEQ ID NO: 60884 - RNA, 19 nt, Homo sapiens
ggacuuagaauacuugucu

SEQ ID NO: 60885 - RNA, 19 nt, Homo sapiens
acacccaaauacaaucuua

SEQ ID NO: 60886 - RNA, 19 nt, Homo sapiens
caagcuguccuguguagua

SEQ ID NO: 60887 - RNA, 19 nt, Homo sapiens
gaauuugguauccugauuu

SEQ ID NO: 60888 - RNA, 19 nt, Homo sapiens
gaauuuggagcugcuauaa

SEQ ID NO: 60889 - RNA, 19 nt, Homo sapiens
agacaucuuuccauuguug

SEQ ID NO: 60890 - RNA, 19 nt, Homo sapiens
aaauggacccucaggaaua

SEQ ID NO: 60891 - RNA, 19 nt, Homo sapiens
acaauuacuucaucuggaa

SEQ ID NO: 60892 - RNA, 19 nt, Homo sapiens
ugacauagcagcucauauc

SEQ ID NO: 60893 - RNA, 19 nt, Homo sapiens
gaaaugcccaaagaaacua

SEQ ID NO: 60894 - RNA, 19 nt, Homo sapiens
ggguaauccuguggaaaua

SEQ ID NO: 60895 - RNA, 19 nt, Homo sapiens
gauccaguguuaauuguag

SEQ ID NO: 60896 - RNA, 19 nt, Homo sapiens
caaagcauuuacagauaga

SEQ ID NO: 60897 - RNA, 19 nt, Homo sapiens
ggaagaaucacuaaauacu

SEQ ID NO: 60898 - RNA, 19 nt, Homo sapiens
gaaaacaucugaaguucuc

SEQ ID NO: 60899 - RNA, 19 nt, Homo sapiens
acacaaacugcuagaauuu

SEQ ID NO: 60900 - RNA, 19 nt, Homo sapiens
guaaguacuucgaaaauug

SEQ ID NO: 60901 - RNA, 19 nt, Homo sapiens
gaaauguguucuccaaagc

SEQ ID NO: 60902 - RNA, 19 nt, Homo sapiens
ugaaauguguucuccaaag

SEQ ID NO: 60903 - RNA, 19 nt, Homo sapiens
gcugaugguucucauguuc

SEQ ID NO: 60904 - RNA, 19 nt, Homo sapiens
guaauacuguuugggcauu

SEQ ID NO: 60905 - RNA, 19 nt, Homo sapiens
gcaagguccugcagcaucu

SEQ ID NO: 60906 - RNA, 19 nt, Homo sapiens
cauauucuguagacucaaa

SEQ ID NO: 60907 - RNA, 19 nt, Homo sapiens
cauaugauguguacucagu

SEQ ID NO: 60908 - RNA, 19 nt, Homo sapiens
gaucaggacuuagaauacu

SEQ ID NO: 60909 - RNA, 19 nt, Homo sapiens
ggaagggaagaaucacuaa

SEQ ID NO: 60910 - RNA, 19 nt, Homo sapiens
ggaaaugcccaaagaaacu

SEQ ID NO: 60911 - RNA, 19 nt, Homo sapiens
aaagcuguauccugaauau

SEQ ID NO: 60912 - RNA, 19 nt, Homo sapiens
gaacuaccuggacuuaaau

SEQ ID NO: 60913 - RNA, 19 nt, Homo sapiens
uuauaucccucacguaguu

SEQ ID NO: 60914 - RNA, 19 nt, Homo sapiens
aauccaagcuguccugugu

SEQ ID NO: 60915 - RNA, 19 nt, Homo sapiens
uugcgucgaucaaauaauu

SEQ ID NO: 60916 - RNA, 19 nt, Homo sapiens
cacugaaacugagguauuu

SEQ ID NO: 60917 - RNA, 19 nt, Homo sapiens
ugacagguacuucauauuc

SEQ ID NO: 60918 - RNA, 19 nt, Homo sapiens
aaggagagccucaaacuau

SEQ ID NO: 60919 - RNA, 19 nt, Homo sapiens
gauauucaagacagagaua

SEQ ID NO: 60920 - RNA, 19 nt, Homo sapiens
uuaaagcgaugccauuagu

SEQ ID NO: 60921 - RNA, 19 nt, Homo sapiens
gugagcaucuccuccuuau

SEQ ID NO: 60922 - RNA, 19 nt, Homo sapiens
gaagggaagaaucacuaaa

SEQ ID NO: 60923 - RNA, 19 nt, Homo sapiens
ucucaaaaguccacaguua

SEQ ID NO: 60924 - RNA, 19 nt, Homo sapiens
uaaauuguggguugaacua

SEQ ID NO: 60925 - RNA, 19 nt, Homo sapiens
uccaagaacucaccaagau

SEQ ID NO: 60926 - RNA, 19 nt, Homo sapiens
gaaacagccuccucaauuu

SEQ ID NO: 60927 - RNA, 19 nt, Homo sapiens
gaaacacucugacauacua

SEQ ID NO: 60928 - RNA, 19 nt, Homo sapiens
gaacguggcuucuuugauc

SEQ ID NO: 60929 - RNA, 19 nt, Homo sapiens
ggaaacagccuccucaauu

SEQ ID NO: 60930 - RNA, 19 nt, Homo sapiens
ggaaagguguugaacuaaa

SEQ ID NO: 60931 - RNA, 19 nt, Homo sapiens
aaucuuagcugccaaguaa

SEQ ID NO: 60932 - RNA, 19 nt, Homo sapiens
gcggaaagguguugaacua

SEQ ID NO: 60933 - RNA, 19 nt, Homo sapiens
ggaauugccugugaaauca

SEQ ID NO: 60934 - RNA, 19 nt, Homo sapiens
caacugggccucuuccaua

SEQ ID NO: 60935 - RNA, 19 nt, Homo sapiens
gggaagauuuguaaugaga

SEQ ID NO: 60936 - RNA, 19 nt, Homo sapiens
gauguuguuucacucauaa

SEQ ID NO: 60937 - RNA, 19 nt, Homo sapiens
ggaggacucuaugaacuaa

SEQ ID NO: 60938 - RNA, 19 nt, Homo sapiens
caagagaagacaucaaauu

SEQ ID NO: 60939 - RNA, 19 nt, Homo sapiens
ggguagagcuguaaacauc

SEQ ID NO: 60940 - RNA, 19 nt, Homo sapiens
gaaccgaacauuacgaaga

SEQ ID NO: 60941 - RNA, 19 nt, Homo sapiens
guacagugauucuaaugga

SEQ ID NO: 60942 - RNA, 19 nt, Homo sapiens
gacaaugaguucuacaaug

SEQ ID NO: 60943 - RNA, 19 nt, Homo sapiens
caaauaaagcugaacaaug

SEQ ID NO: 60944 - RNA, 19 nt, Homo sapiens
cacauagacugcagaauga

SEQ ID NO: 60945 - RNA, 19 nt, Homo sapiens
ggagguacagugauucuaa

SEQ ID NO: 60946 - RNA, 19 nt, Homo sapiens
ggaaagagccauugaagac

SEQ ID NO: 60947 - RNA, 19 nt, Homo sapiens
agacaaauguuucguucaa

SEQ ID NO: 60948 - RNA, 19 nt, Homo sapiens
ccaaguaaauagcaacaug

SEQ ID NO: 60949 - RNA, 19 nt, Homo sapiens
aaagagccauugaagacua

SEQ ID NO: 60950 - RNA, 19 nt, Homo sapiens
gaggaugacugcggaaaug

SEQ ID NO: 60951 - RNA, 19 nt, Homo sapiens
gaaagguguugaacuaaaa

SEQ ID NO: 60952 - RNA, 19 nt, Homo sapiens
gaggaaccgugauugaugu

SEQ ID NO: 60953 - RNA, 19 nt, Homo sapiens
aaugagaagucaacaguga

SEQ ID NO: 60954 - RNA, 19 nt, Homo sapiens
ugaggucuuuggacaauuu

SEQ ID NO: 60955 - RNA, 19 nt, Homo sapiens
acaaugaguucuacaaugg

SEQ ID NO: 60956 - RNA, 19 nt, Homo sapiens
uaaugcagcuauaucucua

SEQ ID NO: 60957 - RNA, 19 nt, Homo sapiens
aaauggagguacagugauu

SEQ ID NO: 60958 - RNA, 19 nt, Homo sapiens
acaggcagaugcauaaaga

SEQ ID NO: 60959 - RNA, 19 nt, Homo sapiens
acacauagacugcagaaug

SEQ ID NO: 60960 - RNA, 19 nt, Homo sapiens
ggauguaucucuggcuuuc

SEQ ID NO: 60961 - RNA, 19 nt, Homo sapiens
gaaaggagaaauucaucug

SEQ ID NO: 60962 - RNA, 19 nt, Homo sapiens
gagacagagugguagaaga

SEQ ID NO: 60963 - RNA, 19 nt, Homo sapiens
acaaauguuucguucaaga

SEQ ID NO: 60964 - RNA, 19 nt, Homo sapiens
ucuaauggauggaaagugu

SEQ ID NO: 60965 - RNA, 19 nt, Homo sapiens
cacaguacacgaccaguua

SEQ ID NO: 60966 - RNA, 19 nt, Homo sapiens
gaacauuacgaagaacaaa

SEQ ID NO: 60967 - RNA, 19 nt, Homo sapiens
cauaaaugaugcuccuguu

SEQ ID NO: 60968 - RNA, 19 nt, Homo sapiens
gcauuugaacugaaagaaa

SEQ ID NO: 60969 - RNA, 19 nt, Homo sapiens
cauagaugauguuguuuca

SEQ ID NO: 60970 - RNA, 19 nt, Homo sapiens
gggagaggguagagcugua

SEQ ID NO: 60971 - RNA, 19 nt, Homo sapiens
gcuaugggaucaacauuuu

SEQ ID NO: 60972 - RNA, 19 nt, Homo sapiens
gggaauugccugugaaauc

SEQ ID NO: 60973 - RNA, 19 nt, Homo sapiens
gagguacagugauucuaau

SEQ ID NO: 60974 - RNA, 19 nt, Homo sapiens
aaugagaaaucgcgauguu

SEQ ID NO: 60975 - RNA, 19 nt, Homo sapiens
cagaugaggaugauuguga

SEQ ID NO: 60976 - RNA, 19 nt, Homo sapiens
uguuggagcugaauuuaau

SEQ ID NO: 60977 - RNA, 19 nt, Homo sapiens
aggacucuaugaacuaaua

SEQ ID NO: 60978 - RNA, 19 nt, Homo sapiens
gcacaguacacgaccaguu

SEQ ID NO: 60979 - RNA, 19 nt, Homo sapiens
gcacaccuuuugacaauga

SEQ ID NO: 60980 - RNA, 19 nt, Homo sapiens
aaaugccaaucucuucuaa

SEQ ID NO: 60981 - RNA, 19 nt, Homo sapiens
agaagucaacagugaaaua

SEQ ID NO: 60982 - RNA, 19 nt, Homo sapiens
gggagaauauuuugccuuu

SEQ ID NO: 60983 - RNA, 19 nt, Homo sapiens
aaccgaacauuacgaagaa

SEQ ID NO: 60984 - RNA, 19 nt, Homo sapiens
ugauguuguuucacucaua

SEQ ID NO: 60985 - RNA, 19 nt, Homo sapiens
agagaugccuuggguauca

SEQ ID NO: 60986 - RNA, 19 nt, Homo sapiens
gguguaauggugacaauga

SEQ ID NO: 60987 - RNA, 19 nt, Homo sapiens
gcacaccuaaagaaacaaa

SEQ ID NO: 60988 - RNA, 19 nt, Homo sapiens
cugggaagauuuguaauga

SEQ ID NO: 60989 - RNA, 19 nt, Homo sapiens
gcagcuauaucucuaaaau

SEQ ID NO: 60990 - RNA, 19 nt, Homo sapiens
gcaugugaaaggagaaauu

SEQ ID NO: 60991 - RNA, 19 nt, Homo sapiens
gaagucaacagugaaauac

SEQ ID NO: 60992 - RNA, 19 nt, Homo sapiens
aaagagaugccuuggguau

SEQ ID NO: 60993 - RNA, 19 nt, Homo sapiens
uggcuucuuugaucuauga

SEQ ID NO: 60994 - RNA, 19 nt, Homo sapiens
cuuggaacguggcuucuuu

SEQ ID NO: 60995 - RNA, 19 nt, Homo sapiens
guucuacaauggacucugu

SEQ ID NO: 60996 - RNA, 19 nt, Homo sapiens
cuauggaacucacuacagu

SEQ ID NO: 60997 - RNA, 19 nt, Homo sapiens
aaaguaucauccaagagaa

SEQ ID NO: 60998 - RNA, 19 nt, Homo sapiens
gaggaugauugugaaagug

SEQ ID NO: 60999 - RNA, 19 nt, Homo sapiens
ugauugaugugacugacuu

SEQ ID NO: 61000 - RNA, 19 nt, Homo sapiens
ggagaggguagagcuguaa

SEQ ID NO: 61001 - RNA, 19 nt, Homo sapiens
caaauguuucguucaagaa

SEQ ID NO: 61002 - RNA, 19 nt, Homo sapiens
aaauuuacacccacugaaa

SEQ ID NO: 61003 - RNA, 19 nt, Homo sapiens
ugaggaugauugugaaagu

SEQ ID NO: 61004 - RNA, 19 nt, Homo sapiens
caaugacugcggagacuuu

SEQ ID NO: 61005 - RNA, 19 nt, Homo sapiens
cgaggaaccgugauugaug

SEQ ID NO: 61006 - RNA, 19 nt, Homo sapiens
uagaugauguuguuucacu

SEQ ID NO: 61007 - RNA, 19 nt, Homo sapiens
ugccggagcuuugcaguug

SEQ ID NO: 61008 - RNA, 19 nt, Homo sapiens
gugaggaugcugaggauga

SEQ ID NO: 61009 - RNA, 19 nt, Homo sapiens
gaagaagaaaacacuagua

SEQ ID NO: 61010 - RNA, 19 nt, Homo sapiens
ugagggaauugccugugaa

SEQ ID NO: 61011 - RNA, 19 nt, Homo sapiens
ggauggaaaguguuugugu

SEQ ID NO: 61012 - RNA, 19 nt, Homo sapiens
ugagaaaucgcgauguugu

SEQ ID NO: 61013 - RNA, 19 nt, Homo sapiens
ugacugcggaaaugacuuu

SEQ ID NO: 61014 - RNA, 19 nt, Homo sapiens
cgccagaacugcuuuaucc

SEQ ID NO: 61015 - RNA, 19 nt, Homo sapiens
ugagaagucaacagugaaa

SEQ ID NO: 61016 - RNA, 19 nt, Homo sapiens
caaaauggagguacaguga

SEQ ID NO: 61017 - RNA, 19 nt, Homo sapiens
aaacaaaacuuggaaagag

SEQ ID NO: 61018 - RNA, 19 nt, Homo sapiens
uaaaugaugcuccuguucu

SEQ ID NO: 61019 - RNA, 19 nt, Homo sapiens
aaauguuucugcaugugaa

SEQ ID NO: 61020 - RNA, 19 nt, Homo sapiens
gcagagacagagugguaga

SEQ ID NO: 61021 - RNA, 19 nt, Homo sapiens
aaacacuaguaccuucaga

SEQ ID NO: 61022 - RNA, 19 nt, Homo sapiens
gagggaauugccugugaaa

SEQ ID NO: 61023 - RNA, 19 nt, Homo sapiens
uaauggauggaaaguguuu

SEQ ID NO: 61024 - RNA, 19 nt, Homo sapiens
gaugcuccuguucucauua

SEQ ID NO: 61025 - RNA, 19 nt, Homo sapiens
uaggaggacucuaugaacu

SEQ ID NO: 61026 - RNA, 19 nt, Homo sapiens
gcuauucucugaacguauu

SEQ ID NO: 61027 - RNA, 19 nt, Homo sapiens
gaagauggaggaugagaug

SEQ ID NO: 61028 - RNA, 19 nt, Homo sapiens
ccaaagagguguccuucuc

SEQ ID NO: 61029 - RNA, 19 nt, Homo sapiens
ggaagaugaagaacgauuu

SEQ ID NO: 61030 - RNA, 19 nt, Homo sapiens
ggaccggccuaauaaacau

SEQ ID NO: 61031 - RNA, 19 nt, Homo sapiens
ugucaggaccggccuaaua

SEQ ID NO: 61032 - RNA, 19 nt, Homo sapiens
caggaucaguucccaguga

SEQ ID NO: 61033 - RNA, 19 nt, Homo sapiens
uaugagaacuacaacaagu

SEQ ID NO: 61034 - RNA, 19 nt, Homo sapiens
acaccaaccucuugagcaa

SEQ ID NO: 61035 - RNA, 19 nt, Homo sapiens
gaagcugcaguuccucuuu

SEQ ID NO: 61036 - RNA, 19 nt, Homo sapiens
gaagaugaagaacgauuuc

SEQ ID NO: 61037 - RNA, 19 nt, Homo sapiens
ucacagaugcugcgcaaga

SEQ ID NO: 61038 - RNA, 19 nt, Homo sapiens
uagacaagcugcguagaga

SEQ ID NO: 61039 - RNA, 19 nt, Homo sapiens
accaaccucuugagcaaua

SEQ ID NO: 61040 - RNA, 19 nt, Homo sapiens
gucaggaccggccuaauaa

SEQ ID NO: 61041 - RNA, 19 nt, Homo sapiens
ccgaguugcuggccaaugu

SEQ ID NO: 61042 - RNA, 19 nt, Homo sapiens
acgggaugcugaagcuuua

SEQ ID NO: 61043 - RNA, 19 nt, Homo sapiens
guucagcccuguggaguuc

SEQ ID NO: 61044 - RNA, 19 nt, Homo sapiens
gagguguccuucuccaaca

SEQ ID NO: 61045 - RNA, 19 nt, Homo sapiens
gauggacaccaaccucuug

SEQ ID NO: 61046 - RNA, 19 nt, Homo sapiens
ggacccgacugaucugaac

SEQ ID NO: 61047 - RNA, 19 nt, Homo sapiens
uccggaagauggaggauga

SEQ ID NO: 61048 - RNA, 19 nt, Homo sapiens
ccaccaacauggcagugau

SEQ ID NO: 61049 - RNA, 19 nt, Homo sapiens
ugaccggcaucaucaagau

SEQ ID NO: 61050 - RNA, 19 nt, Homo sapiens
aagcuauucucugaacgua

SEQ ID NO: 61051 - RNA, 19 nt, Homo sapiens
gcagggugguggugacaac

SEQ ID NO: 61052 - RNA, 19 nt, Homo sapiens
ggaaguuuaccuagacaag

SEQ ID NO: 61053 - RNA, 19 nt, Homo sapiens
agaaggagcugagaaaccu

SEQ ID NO: 61054 - RNA, 19 nt, Homo sapiens
aagcugcaguuccucuuug

SEQ ID NO: 61055 - RNA, 19 nt, Homo sapiens
agacgcugcuggagugugu

SEQ ID NO: 61056 - RNA, 19 nt, Homo sapiens
gcagugaucaccgacuuca

SEQ ID NO: 61057 - RNA, 19 nt, Homo sapiens
cuacaacaaguucaucuca

SEQ ID NO: 61058 - RNA, 19 nt, Homo sapiens
ucuaugagaacuacaacaa

SEQ ID NO: 61059 - RNA, 19 nt, Homo sapiens
agaggacuuucuccgugua

SEQ ID NO: 61060 - RNA, 19 nt, Homo sapiens
cauccucacucucacugau

SEQ ID NO: 61061 - RNA, 19 nt, Homo sapiens
ggaagauggaggaugagau

SEQ ID NO: 61062 - RNA, 19 nt, Homo sapiens
cccaguugauggacaguga

SEQ ID NO: 61063 - RNA, 19 nt, Homo sapiens
gugcugaccggcaucauca

SEQ ID NO: 61064 - RNA, 19 nt, Homo sapiens
gaagcuauucucugaacgu

SEQ ID NO: 61065 - RNA, 19 nt, Homo sapiens
uggagaaggagcugagaaa

SEQ ID NO: 61066 - RNA, 19 nt, Homo sapiens
cgaagaacucgugcacuug

SEQ ID NO: 61067 - RNA, 19 nt, Homo sapiens
ucucugaacguauugaugu

SEQ ID NO: 61068 - RNA, 19 nt, Homo sapiens
gcgacuggcucagcacucu

SEQ ID NO: 61069 - RNA, 19 nt, Homo sapiens
accaacaccugcccucguu

SEQ ID NO: 61070 - RNA, 19 nt, Homo sapiens
gacaagcugcguagagagu

SEQ ID NO: 61071 - RNA, 19 nt, Homo sapiens
gccacuuucugcagcucua

SEQ ID NO: 61072 - RNA, 19 nt, Homo sapiens
uggcagugaucaccgacuu

SEQ ID NO: 61073 - RNA, 19 nt, Homo sapiens
aagaacgauuuccggaaga

SEQ ID NO: 61074 - RNA, 19 nt, Homo sapiens
uccggaagaugaagaacga

SEQ ID NO: 61075 - RNA, 19 nt, Homo sapiens
ugagcaauauccagaagcu

SEQ ID NO: 61076 - RNA, 19 nt, Homo sapiens
gggugguggugacaacuca

SEQ ID NO: 61077 - RNA, 19 nt, Homo sapiens
gaacgauuuccggaagaug

SEQ ID NO: 61078 - RNA, 19 nt, Homo sapiens
ggaugcugaagcuuuacua

SEQ ID NO: 61079 - RNA, 19 nt, Homo sapiens
cugaacguauugauguguu

SEQ ID NO: 61080 - RNA, 19 nt, Homo sapiens
ggccuggucauaucacaga

SEQ ID NO: 61081 - RNA, 19 nt, Homo sapiens
acagacaccauccggaaga

SEQ ID NO: 61082 - RNA, 19 nt, Homo sapiens
cacgggaugcugaagcuuu

SEQ ID NO: 61083 - RNA, 19 nt, Homo sapiens
gggcugcaguuggaacgau

SEQ ID NO: 61084 - RNA, 19 nt, Homo sapiens
ggacauggugcggcagauc

SEQ ID NO: 61085 - RNA, 19 nt, Homo sapiens
gagcaauauccagaagcua

SEQ ID NO: 61086 - RNA, 19 nt, Homo sapiens
agacggccaccaucuccua

SEQ ID NO: 61087 - RNA, 19 nt, Homo sapiens
ggacgacugccaggucauc

SEQ ID NO: 61088 - RNA, 19 nt, Homo sapiens
gggcuucguccacucuaug

SEQ ID NO: 61089 - RNA, 19 nt, Homo sapiens
gagaaggagcugagaaacc

SEQ ID NO: 61090 - RNA, 19 nt, Homo sapiens
cggaagaugaagaacgauu

SEQ ID NO: 61091 - RNA, 19 nt, Homo sapiens
gccacgagcgcaucaccaa

SEQ ID NO: 61092 - RNA, 19 nt, Homo sapiens
cauguguggccuccucaaa

SEQ ID NO: 61093 - RNA, 19 nt, Homo sapiens
ucaggaccggccuaauaaa

SEQ ID NO: 61094 - RNA, 19 nt, Homo sapiens
gcaaggagcccgacacuga

SEQ ID NO: 61095 - RNA, 19 nt, Homo sapiens
ggaauaugcugaccuuuca

SEQ ID NO: 61096 - RNA, 19 nt, Homo sapiens
agaaagacguggaagauuu

SEQ ID NO: 61097 - RNA, 19 nt, Homo sapiens
caaccugccuuacuuugua

SEQ ID NO: 61098 - RNA, 19 nt, Homo sapiens
gaagcucacuguugcaaau

SEQ ID NO: 61099 - RNA, 19 nt, Homo sapiens
gggcacaucuuccuaaucu

SEQ ID NO: 61100 - RNA, 19 nt, Homo sapiens
gcaggaauaugcugaccuu

SEQ ID NO: 61101 - RNA, 19 nt, Homo sapiens
ucacuagccuucauauaug

SEQ ID NO: 61102 - RNA, 19 nt, Homo sapiens
caccacagccugcuaauuu

SEQ ID NO: 61103 - RNA, 19 nt, Homo sapiens
gaaaacaacucuauguaca

SEQ ID NO: 61104 - RNA, 19 nt, Homo sapiens
gaagugauccgcccaccuu

SEQ ID NO: 61105 - RNA, 19 nt, Homo sapiens
gaucuucuguucaaaguac

SEQ ID NO: 61106 - RNA, 19 nt, Homo sapiens
aaacaacucuauguacaug

SEQ ID NO: 61107 - RNA, 19 nt, Homo sapiens
gggcaugggucuuggagau

SEQ ID NO: 61108 - RNA, 19 nt, Homo sapiens
gcagaaagacguggaagau

SEQ ID NO: 61109 - RNA, 19 nt, Homo sapiens
ggaacucacagccagcaua

SEQ ID NO: 61110 - RNA, 19 nt, Homo sapiens
gagaucuucuguucaaagu

SEQ ID NO: 61111 - RNA, 19 nt, Homo sapiens
gcacaucuuccuaaucugu

SEQ ID NO: 61112 - RNA, 19 nt, Homo sapiens
uggagucuguggaugaaua

SEQ ID NO: 61113 - RNA, 19 nt, Homo sapiens
acacugauuugaucgauuc

SEQ ID NO: 61114 - RNA, 19 nt, Homo sapiens
ggagugcaguggcaugauc

SEQ ID NO: 61115 - RNA, 19 nt, Homo sapiens
ggauagugcuggcuuccau

SEQ ID NO: 61116 - RNA, 19 nt, Homo sapiens
uaaugugggagaccaaaua

SEQ ID NO: 61117 - RNA, 19 nt, Homo sapiens
ggucaggccuugcuugcau

SEQ ID NO: 61118 - RNA, 19 nt, Homo sapiens
acagaaggcuggcguagca

SEQ ID NO: 61119 - RNA, 19 nt, Homo sapiens
ggaugaauaucaguuugug

SEQ ID NO: 61120 - RNA, 19 nt, Homo sapiens
gcuaagacagcuuucaguu

SEQ ID NO: 61121 - RNA, 19 nt, Homo sapiens
gaacucacagccagcauag

SEQ ID NO: 61122 - RNA, 19 nt, Homo sapiens
gcccgacacugauuugauc

SEQ ID NO: 61123 - RNA, 19 nt, Homo sapiens
gcacguucuuggucacugu

SEQ ID NO: 61124 - RNA, 19 nt, Homo sapiens
ccucugggaucaagggauu

SEQ ID NO: 61125 - RNA, 19 nt, Homo sapiens
cccaaagcaugaacauuau

SEQ ID NO: 61126 - RNA, 19 nt, Homo sapiens
cacccaaccugccuuacuu

SEQ ID NO: 61127 - RNA, 19 nt, Homo sapiens
gauuugaucgauucuguga

SEQ ID NO: 61128 - RNA, 19 nt, Homo sapiens
gguccaccuuggccuguuu

SEQ ID NO: 61129 - RNA, 19 nt, Homo sapiens
uuggagaucuucuguucaa

SEQ ID NO: 61130 - RNA, 19 nt, Homo sapiens
cagagccacugggcacuuu

SEQ ID NO: 61131 - RNA, 19 nt, Homo sapiens
gagaaaacaacucuaugua

SEQ ID NO: 61132 - RNA, 19 nt, Homo sapiens
gaaagacguggaagauuuu

SEQ ID NO: 61133 - RNA, 19 nt, Homo sapiens
ccagggcccuccagauuac

SEQ ID NO: 61134 - RNA, 19 nt, Homo sapiens
gcucacuagccuucauaua

SEQ ID NO: 61135 - RNA, 19 nt, Homo sapiens
cagcaugcccuguggauca

SEQ ID NO: 61136 - RNA, 19 nt, Homo sapiens
gacacugauuugaucgauu

SEQ ID NO: 61137 - RNA, 19 nt, Homo sapiens
cuucugaccugcaaucaag

SEQ ID NO: 61138 - RNA, 19 nt, Homo sapiens
ccacugggcacuuuguuuc

SEQ ID NO: 61139 - RNA, 19 nt, Homo sapiens
guggaugaauaucaguuug

SEQ ID NO: 61140 - RNA, 19 nt, Homo sapiens
gcucucggaugcacaacau

SEQ ID NO: 61141 - RNA, 19 nt, Homo sapiens
acaucuuccuaaucuguua

SEQ ID NO: 61142 - RNA, 19 nt, Homo sapiens
cuuggucacuguuccauug

SEQ ID NO: 61143 - RNA, 19 nt, Homo sapiens
acacaaaccccaccaauug

SEQ ID NO: 61144 - RNA, 19 nt, Homo sapiens
gagauuccauuccauuuuc

SEQ ID NO: 61145 - RNA, 19 nt, Homo sapiens
ggagaucuucuguucaaag

SEQ ID NO: 61146 - RNA, 19 nt, Homo sapiens
ccccaaagcaugaacauua

SEQ ID NO: 61147 - RNA, 19 nt, Homo sapiens
cccagggcccuccagauua

SEQ ID NO: 61148 - RNA, 19 nt, Homo sapiens
ucuuggagaucuucuguuc

SEQ ID NO: 61149 - RNA, 19 nt, Homo sapiens
gcaugggucuuggagaucu

SEQ ID NO: 61150 - RNA, 19 nt, Homo sapiens
gcaaccggcagaugacugu

SEQ ID NO: 61151 - RNA, 19 nt, Homo sapiens
cucacuagccuucauauau

SEQ ID NO: 61152 - RNA, 19 nt, Homo sapiens
ugauggagaacacagauga

SEQ ID NO: 61153 - RNA, 19 nt, Homo sapiens
ggagaaaacaacucuaugu

SEQ ID NO: 61154 - RNA, 19 nt, Homo sapiens
acagguacccuacggauca

SEQ ID NO: 61155 - RNA, 19 nt, Homo sapiens
cagaaagacguggaagauu

SEQ ID NO: 61156 - RNA, 19 nt, Homo sapiens
uacagaaacuagggcuaaa

SEQ ID NO: 61157 - RNA, 19 nt, Homo sapiens
cauggcaaccggcagauga

SEQ ID NO: 61158 - RNA, 19 nt, Homo sapiens
gcucuaggccagaucuugu

SEQ ID NO: 61159 - RNA, 19 nt, Homo sapiens
gucaggccuugcuugcaua

SEQ ID NO: 61160 - RNA, 19 nt, Homo sapiens
auacagaaacuagggcuaa

SEQ ID NO: 61161 - RNA, 19 nt, Homo sapiens
cgacacugauuugaucgau

SEQ ID NO: 61162 - RNA, 19 nt, Homo sapiens
ggagauuccauuccauuuu

SEQ ID NO: 61163 - RNA, 19 nt, Homo sapiens
ccagguuuguggagucugu

SEQ ID NO: 61164 - RNA, 19 nt, Homo sapiens
gguaggaggcacguucuug

SEQ ID NO: 61165 - RNA, 19 nt, Homo sapiens
uugaguagcugggauuaca

SEQ ID NO: 61166 - RNA, 19 nt, Homo sapiens
cuaagacagcuuucaguuc

SEQ ID NO: 61167 - RNA, 19 nt, Homo sapiens
uggcguagcagguaaagau

SEQ ID NO: 61168 - RNA, 19 nt, Homo sapiens
ggcaugaucuuggcucacu

SEQ ID NO: 61169 - RNA, 19 nt, Homo sapiens
ugacugugauccggaaagu

SEQ ID NO: 61170 - RNA, 19 nt, Homo sapiens
uuugaucgauucugugaca

SEQ ID NO: 61171 - RNA, 19 nt, Homo sapiens
cugauuugaucgauucugu

SEQ ID NO: 61172 - RNA, 19 nt, Homo sapiens
guuuguggagcgccuguua

SEQ ID NO: 61173 - RNA, 19 nt, Homo sapiens
cugcuucucuguguguaaa

SEQ ID NO: 61174 - RNA, 19 nt, Homo sapiens
gacaguugcgcgcacagaa

SEQ ID NO: 61175 - RNA, 19 nt, Homo sapiens
gggaucaccaggcuaaugg

SEQ ID NO: 61176 - RNA, 19 nt, Homo sapiens
ggagucuguggaugaauau

SEQ ID NO: 61177 - RNA, 19 nt, Homo sapiens
cagcucacuagccuucaua

SEQ ID NO: 61178 - RNA, 19 nt, Homo sapiens
caaggagcccgacacugau

SEQ ID NO: 61179 - RNA, 19 nt, Homo sapiens
aagcaugaacauuauccua

SEQ ID NO: 61180 - RNA, 19 nt, Homo sapiens
ccuccuaucuuggccuguu

SEQ ID NO: 61181 - RNA, 19 nt, Homo sapiens
auagggaucaccaggcuaa

SEQ ID NO: 61182 - RNA, 19 nt, Homo sapiens
ccuuauacuuggagucaca

SEQ ID NO: 61183 - RNA, 19 nt, Homo sapiens
caaagcguugggauuauag

SEQ ID NO: 61184 - RNA, 19 nt, Homo sapiens
ggagcccgacacugauuug

SEQ ID NO: 61185 - RNA, 19 nt, Homo sapiens
uuccuaaucuguuaauggu

SEQ ID NO: 61186 - RNA, 19 nt, Homo sapiens
gccacugggcacuuuguuu

SEQ ID NO: 61187 - RNA, 19 nt, Homo sapiens
caaaccccaccaauuguua

SEQ ID NO: 61188 - RNA, 19 nt, Homo sapiens
ggguuugcaggcaggaaua

SEQ ID NO: 61189 - RNA, 19 nt, Homo sapiens
ggucuuggagaucuucugu

SEQ ID NO: 61190 - RNA, 19 nt, Homo sapiens
gcagagccacugggcacuu

SEQ ID NO: 61191 - RNA, 19 nt, Homo sapiens
ccaccacagccugcuaauu

SEQ ID NO: 61192 - RNA, 19 nt, Homo sapiens
uaucuuggccuguucuuuu

SEQ ID NO: 61193 - RNA, 19 nt, Homo sapiens
guaaagauggcagcuacca

SEQ ID NO: 61194 - RNA, 19 nt, Homo sapiens
ccaagcccaugcuguggua

SEQ ID NO: 61195 - RNA, 19 nt, Homo sapiens
uggaggagcuggauaaugc

SEQ ID NO: 61196 - RNA, 19 nt, Homo sapiens
uuacccuggucauuaauaa

SEQ ID NO: 61197 - RNA, 19 nt, Homo sapiens
gaaacaggccguggcuaga

SEQ ID NO: 61198 - RNA, 19 nt, Homo sapiens
gcuuccagcugcccaaugu

SEQ ID NO: 61199 - RNA, 19 nt, Homo sapiens
gcugcucucugacuucugu

SEQ ID NO: 61200 - RNA, 19 nt, Homo sapiens
cgcauacucucgcccugua

SEQ ID NO: 61201 - RNA, 19 nt, Homo sapiens
gcauggcaccugcgcagaa

SEQ ID NO: 61202 - RNA, 19 nt, Homo sapiens
cauggcaccugcgcagaaa

SEQ ID NO: 61203 - RNA, 19 nt, Homo sapiens
ggccguggcuagagaagag

SEQ ID NO: 61204 - RNA, 19 nt, Homo sapiens
acgacgcgcugcucucuga

SEQ ID NO: 61205 - RNA, 19 nt, Homo sapiens
guagaucgcggugccaguu

SEQ ID NO: 61206 - RNA, 19 nt, Homo sapiens
ccacacugcucggcguuuc

SEQ ID NO: 61207 - RNA, 19 nt, Homo sapiens
caccugcccucgcuguaau

SEQ ID NO: 61208 - RNA, 19 nt, Homo sapiens
gcgcugcucucugacuucu

SEQ ID NO: 61209 - RNA, 19 nt, Homo sapiens
guuacccuggucauuaaua

SEQ ID NO: 61210 - RNA, 19 nt, Homo sapiens
gcuguaaugcgcccuacug

SEQ ID NO: 61211 - RNA, 19 nt, Homo sapiens
cgagcggguucuuggagau

SEQ ID NO: 61212 - RNA, 19 nt, Homo sapiens
gcacaacuguuuaagagua

SEQ ID NO: 61213 - RNA, 19 nt, Homo sapiens
ggaaggaacugacacauuc

SEQ ID NO: 61214 - RNA, 19 nt, Homo sapiens
gcaaagggaugcuguauag

SEQ ID NO: 61215 - RNA, 19 nt, Homo sapiens
gaccaacccuccaauuaua

SEQ ID NO: 61216 - RNA, 19 nt, Homo sapiens
aaagaaagcugcauugaga

SEQ ID NO: 61217 - RNA, 19 nt, Homo sapiens
gaacacaaaugaugcuaga

SEQ ID NO: 61218 - RNA, 19 nt, Homo sapiens
caaaggagcuucaaagagu

SEQ ID NO: 61219 - RNA, 19 nt, Homo sapiens
gaaguuuaaugacugguua

SEQ ID NO: 61220 - RNA, 19 nt, Homo sapiens
uaggaaaccugccauauga

SEQ ID NO: 61221 - RNA, 19 nt, Homo sapiens
caaaggccaugccauugua

SEQ ID NO: 61222 - RNA, 19 nt, Homo sapiens
agaggaacauugugaauuu

SEQ ID NO: 61223 - RNA, 19 nt, Homo sapiens
gaaauggaaucugucaaga

SEQ ID NO: 61224 - RNA, 19 nt, Homo sapiens
gaacugacauuugauaagg

SEQ ID NO: 61225 - RNA, 19 nt, Homo sapiens
cagauguggucccaauuua

SEQ ID NO: 61226 - RNA, 19 nt, Homo sapiens
ggaacauugugaauuugua

SEQ ID NO: 61227 - RNA, 19 nt, Homo sapiens
gauguggucccaauuuaua

SEQ ID NO: 61228 - RNA, 19 nt, Homo sapiens
ccauaacgguggaugagua

SEQ ID NO: 61229 - RNA, 19 nt, Homo sapiens
uuaaauggaugcaauggaa

SEQ ID NO: 61230 - RNA, 19 nt, Homo sapiens
gagcuugaguuaaaucuag

SEQ ID NO: 61231 - RNA, 19 nt, Homo sapiens
ggacagccaagcuuucuuu

SEQ ID NO: 61232 - RNA, 19 nt, Homo sapiens
uaaaugcccuauuggaaug

SEQ ID NO: 61233 - RNA, 19 nt, Homo sapiens
gcagauguggucccaauuu

SEQ ID NO: 61234 - RNA, 19 nt, Homo sapiens
gaaaucagaggaacauugu

SEQ ID NO: 61235 - RNA, 19 nt, Homo sapiens
gaacagaugguauccagau

SEQ ID NO: 61236 - RNA, 19 nt, Homo sapiens
gaacugacacauucucuca

SEQ ID NO: 61237 - RNA, 19 nt, Homo sapiens
gagggaaggucuauaaacu

SEQ ID NO: 61238 - RNA, 19 nt, Homo sapiens
gaaaccugccauaugaaua

SEQ ID NO: 61239 - RNA, 19 nt, Homo sapiens
caagagcagguauuucaua

SEQ ID NO: 61240 - RNA, 19 nt, Homo sapiens
gccaugccauuguaaauug

SEQ ID NO: 61241 - RNA, 19 nt, Homo sapiens
gagguugugcuucuuauuu

SEQ ID NO: 61242 - RNA, 19 nt, Homo sapiens
ggacauccuucuccacaca

SEQ ID NO: 61243 - RNA, 19 nt, Homo sapiens
gcacagcgguauugaugag

SEQ ID NO: 61244 - RNA, 19 nt, Homo sapiens
cuagugagauuccuauugu

SEQ ID NO: 61245 - RNA, 19 nt, Homo sapiens
gagacuggguuccaaagga

SEQ ID NO: 61246 - RNA, 19 nt, Homo sapiens
gugaauugcucaugccuau

SEQ ID NO: 61247 - RNA, 19 nt, Homo sapiens
acaggcauguauagacuua

SEQ ID NO: 61248 - RNA, 19 nt, Homo sapiens
ucucagagcucaaggucuu

SEQ ID NO: 61249 - RNA, 19 nt, Homo sapiens
ucuguaaaguugugaauug

SEQ ID NO: 61250 - RNA, 19 nt, Homo sapiens
cagccaagcuuucuuuuaa

SEQ ID NO: 61251 - RNA, 19 nt, Homo sapiens
caacacagauuugcacaac

SEQ ID NO: 61252 - RNA, 19 nt, Homo sapiens
cagaggacuuugacaaugu

SEQ ID NO: 61253 - RNA, 19 nt, Homo sapiens
ccagaggacuuugacaaug

SEQ ID NO: 61254 - RNA, 19 nt, Homo sapiens
agacuuaaauggaugcaau

SEQ ID NO: 61255 - RNA, 19 nt, Homo sapiens
caacagaaguaggcaugga

SEQ ID NO: 61256 - RNA, 19 nt, Homo sapiens
cuguugagcuuuauucuau

SEQ ID NO: 61257 - RNA, 19 nt, Homo sapiens
caucagaagucggaaggaa

SEQ ID NO: 61258 - RNA, 19 nt, Homo sapiens
uuacaaacccugugaguuc

SEQ ID NO: 61259 - RNA, 19 nt, Homo sapiens
gcaauggaagcuaacuaaa

SEQ ID NO: 61260 - RNA, 19 nt, Homo sapiens
cguuaggaguuuaauauug

SEQ ID NO: 61261 - RNA, 19 nt, Homo sapiens
gaauugcucaugccuauag

SEQ ID NO: 61262 - RNA, 19 nt, Homo sapiens
gaggaacauugugaauuug

SEQ ID NO: 61263 - RNA, 19 nt, Homo sapiens
cgaccaacccuccaauuau

SEQ ID NO: 61264 - RNA, 19 nt, Homo sapiens
ggcccaagcuccauguguu

SEQ ID NO: 61265 - RNA, 19 nt, Homo sapiens
ggaaaccugccauaugaau

SEQ ID NO: 61266 - RNA, 19 nt, Homo sapiens
uuuaaugacugguuaggaa

SEQ ID NO: 61267 - RNA, 19 nt, Homo sapiens
caaggcaaaguuaccauaa

SEQ ID NO: 61268 - RNA, 19 nt, Homo sapiens
ugacuacguuaggaguuua

SEQ ID NO: 61269 - RNA, 19 nt, Homo sapiens
acacagauuugcacaacug

SEQ ID NO: 61270 - RNA, 19 nt, Homo sapiens
ccgaccaacccuccaauua

SEQ ID NO: 61271 - RNA, 19 nt, Homo sapiens
uguaaaugcuguugagcuu

SEQ ID NO: 61272 - RNA, 19 nt, Homo sapiens
aaagcugcauugagaagaa

SEQ ID NO: 61273 - RNA, 19 nt, Homo sapiens
caaacccugugaguucuuu

SEQ ID NO: 61274 - RNA, 19 nt, Homo sapiens
ugaguuaaaucuagguaca

SEQ ID NO: 61275 - RNA, 19 nt, Homo sapiens
gcagacuccuuuucaauau

SEQ ID NO: 61276 - RNA, 19 nt, Homo sapiens
cagauuugcacaacuguuu

SEQ ID NO: 61277 - RNA, 19 nt, Homo sapiens
ggaaucaugaacugacauu

SEQ ID NO: 61278 - RNA, 19 nt, Homo sapiens
gcuaauagucauuucuguu

SEQ ID NO: 61279 - RNA, 19 nt, Homo sapiens
ugagauuccuauugugguu

SEQ ID NO: 61280 - RNA, 19 nt, Homo sapiens
caugaacugacauuugaua

SEQ ID NO: 61281 - RNA, 19 nt, Homo sapiens
cacaugggauuccuucuca

SEQ ID NO: 61282 - RNA, 19 nt, Homo sapiens
gucaagagcagguauuuca

SEQ ID NO: 61283 - RNA, 19 nt, Homo sapiens
gaugcaaucuucgcuagca

SEQ ID NO: 61284 - RNA, 19 nt, Homo sapiens
uggaugcaauggaagcuaa

SEQ ID NO: 61285 - RNA, 19 nt, Homo sapiens
ugaaaucagaggaacauug

SEQ ID NO: 61286 - RNA, 19 nt, Homo sapiens
gaagcuaacuaaaauaagg

SEQ ID NO: 61287 - RNA, 19 nt, Homo sapiens
gcauguauagacuuaaaug

SEQ ID NO: 61288 - RNA, 19 nt, Homo sapiens
cuaaaugcccuauuggaau

SEQ ID NO: 61289 - RNA, 19 nt, Homo sapiens
aucaugaacugacauuuga

SEQ ID NO: 61290 - RNA, 19 nt, Homo sapiens
gcuuaguuguccuuucuau

SEQ ID NO: 61291 - RNA, 19 nt, Homo sapiens
ggaguuuaauauugucaag

SEQ ID NO: 61292 - RNA, 19 nt, Homo sapiens
ugaagguuauggcaucaug

SEQ ID NO: 61293 - RNA, 19 nt, Homo sapiens
gaaauuuaggaaagcaguu

SEQ ID NO: 61294 - RNA, 19 nt, Homo sapiens
caugccugcuuccaucuuu

SEQ ID NO: 61295 - RNA, 19 nt, Homo sapiens
ugguuuaacuagugagauu

SEQ ID NO: 61296 - RNA, 19 nt, Homo sapiens
aaggaugguuuaacuagug

SEQ ID NO: 61297 - RNA, 19 nt, Homo sapiens
gaaagcugcauugagaaga

SEQ ID NO: 61298 - RNA, 19 nt, Homo sapiens
ucucaaaggccaugccauu

SEQ ID NO: 61299 - RNA, 19 nt, Homo sapiens
acagcgguauugaugagua

SEQ ID NO: 61300 - RNA, 19 nt, Homo sapiens
gacauuugauaaggaauuc

SEQ ID NO: 61301 - RNA, 19 nt, Homo sapiens
aggcauguauagacuuaaa

SEQ ID NO: 61302 - RNA, 19 nt, Homo sapiens
ucaaggcaaaguuaccaua

SEQ ID NO: 61303 - RNA, 19 nt, Homo sapiens
gauuugcacaacuguuuaa

SEQ ID NO: 61304 - RNA, 19 nt, Homo sapiens
guauccagaugccuuaugg

SEQ ID NO: 61305 - RNA, 19 nt, Homo sapiens
gguuauacaaggucucauu

SEQ ID NO: 61306 - RNA, 19 nt, Homo sapiens
uaaagaaagcugcauugag

SEQ ID NO: 61307 - RNA, 19 nt, Homo sapiens
ccaaaggacagccaagcuu

SEQ ID NO: 61308 - RNA, 19 nt, Homo sapiens
cagaggaacauugugaauu

SEQ ID NO: 61309 - RNA, 19 nt, Homo sapiens
ggcauugacauacucauga

SEQ ID NO: 61310 - RNA, 19 nt, Homo sapiens
cauggcagaccuuguuaaa

SEQ ID NO: 61311 - RNA, 19 nt, Homo sapiens
aaucaugaacugacauuug

SEQ ID NO: 61312 - RNA, 19 nt, Homo sapiens
ggacaagggcuucaacuuu

SEQ ID NO: 61313 - RNA, 19 nt, Homo sapiens
ucacaggccugaaccagua

SEQ ID NO: 61314 - RNA, 19 nt, Homo sapiens
aaacugacuuugugccuua

SEQ ID NO: 61315 - RNA, 19 nt, Homo sapiens
ggaguguaguauucauuua

SEQ ID NO: 61316 - RNA, 19 nt, Homo sapiens
gaaagacaccggagacaug

SEQ ID NO: 61317 - RNA, 19 nt, Homo sapiens
ggucaucccucccuucuuc

SEQ ID NO: 61318 - RNA, 19 nt, Homo sapiens
gagaggaccugcccaccuu

SEQ ID NO: 61319 - RNA, 19 nt, Homo sapiens
gaacaaggagcgcaucuuc

SEQ ID NO: 61320 - RNA, 19 nt, Homo sapiens
guccuuaacuggaaaguga

SEQ ID NO: 61321 - RNA, 19 nt, Homo sapiens
gaacuucaccuaccacauc

SEQ ID NO: 61322 - RNA, 19 nt, Homo sapiens
ggaccaaaguugccuuaag

SEQ ID NO: 61323 - RNA, 19 nt, Homo sapiens
ccaggaauauccaggaaga

SEQ ID NO: 61324 - RNA, 19 nt, Homo sapiens
gcaugcggcuggugcacua

SEQ ID NO: 61325 - RNA, 19 nt, Homo sapiens
gacaagggcuucaacuuuu

SEQ ID NO: 61326 - RNA, 19 nt, Homo sapiens
gaucagugaccacaucauu

SEQ ID NO: 61327 - RNA, 19 nt, Homo sapiens
guuuaccucuuuccagaua

SEQ ID NO: 61328 - RNA, 19 nt, Homo sapiens
gcacagagggaaccugaga

SEQ ID NO: 61329 - RNA, 19 nt, Homo sapiens
gcacagaaccagaacuaca

SEQ ID NO: 61330 - RNA, 19 nt, Homo sapiens
gaccaccgcuaacaacaug

SEQ ID NO: 61331 - RNA, 19 nt, Homo sapiens
gcccugaaccaguccauua

SEQ ID NO: 61332 - RNA, 19 nt, Homo sapiens
ugaauggaaugaucaaaca

SEQ ID NO: 61333 - RNA, 19 nt, Homo sapiens
ucucaccgguggccaauaa

SEQ ID NO: 61334 - RNA, 19 nt, Homo sapiens
ccacaucccugucaguagu

SEQ ID NO: 61335 - RNA, 19 nt, Homo sapiens
ggacaccaccgagcaauug

SEQ ID NO: 61336 - RNA, 19 nt, Homo sapiens
gcuaacaacaugcguaaga

SEQ ID NO: 61337 - RNA, 19 nt, Homo sapiens
caaaggaggaaccauguga

SEQ ID NO: 61338 - RNA, 19 nt, Homo sapiens
gaccaaaguugccuuaagc

SEQ ID NO: 61339 - RNA, 19 nt, Homo sapiens
guuagcagcuggcucuguu

SEQ ID NO: 61340 - RNA, 19 nt, Homo sapiens
gaaaugggaaagggaauug

SEQ ID NO: 61341 - RNA, 19 nt, Homo sapiens
ggaaggauggagcuagaaa

SEQ ID NO: 61342 - RNA, 19 nt, Homo sapiens
guacgaugcuaacuacaag

SEQ ID NO: 61343 - RNA, 19 nt, Homo sapiens
guggaggccuuuccuugaa

SEQ ID NO: 61344 - RNA, 19 nt, Homo sapiens
caauaaccauccuguccuu

SEQ ID NO: 61345 - RNA, 19 nt, Homo sapiens
gaaggaguguaguauucau

SEQ ID NO: 61346 - RNA, 19 nt, Homo sapiens
gaucucagagcgcaucauu

SEQ ID NO: 61347 - RNA, 19 nt, Homo sapiens
uggaaggaguguaguauuc

SEQ ID NO: 61348 - RNA, 19 nt, Homo sapiens
uggagaaacugacuuugug

SEQ ID NO: 61349 - RNA, 19 nt, Homo sapiens
gacauggucuuugccaaug

SEQ ID NO: 61350 - RNA, 19 nt, Homo sapiens
ccgcugaacugcaacaaca

SEQ ID NO: 61351 - RNA, 19 nt, Homo sapiens
gagcagaggagcaggaauc

SEQ ID NO: 61352 - RNA, 19 nt, Homo sapiens
gaaccaguccauuaacauc

SEQ ID NO: 61353 - RNA, 19 nt, Homo sapiens
gaauauccaggaagaggaa

SEQ ID NO: 61354 - RNA, 19 nt, Homo sapiens
gcaaauccuccugcccaua

SEQ ID NO: 61355 - RNA, 19 nt, Homo sapiens
gguaugcugccaccucuuu

SEQ ID NO: 61356 - RNA, 19 nt, Homo sapiens
ugaauucaccuaccacuuc

SEQ ID NO: 61357 - RNA, 19 nt, Homo sapiens
ggaaaaccauagagaacuu

SEQ ID NO: 61358 - RNA, 19 nt, Homo sapiens
cuaacaacaugcguaagaa

SEQ ID NO: 61359 - RNA, 19 nt, Homo sapiens
ucccugagcuugguauuug

SEQ ID NO: 61360 - RNA, 19 nt, Homo sapiens
gcaauggugugagugucuu

SEQ ID NO: 61361 - RNA, 19 nt, Homo sapiens
gagcgacagcgauguguug

SEQ ID NO: 61362 - RNA, 19 nt, Homo sapiens
gcagcgggaucuguacaug

SEQ ID NO: 61363 - RNA, 19 nt, Homo sapiens
gggaggccuuucuauagug

SEQ ID NO: 61364 - RNA, 19 nt, Homo sapiens
ugccauggguccagaaaug

SEQ ID NO: 61365 - RNA, 19 nt, Homo sapiens
ggaaggaguguaguauuca

SEQ ID NO: 61366 - RNA, 19 nt, Homo sapiens
acaaggagcugcccaugcu

SEQ ID NO: 61367 - RNA, 19 nt, Homo sapiens
cccauaccgugcacccuua

SEQ ID NO: 61368 - RNA, 19 nt, Homo sapiens
caagguggccagcaaguca

SEQ ID NO: 61369 - RNA, 19 nt, Homo sapiens
gcccagaugcugaauggaa

SEQ ID NO: 61370 - RNA, 19 nt, Homo sapiens
gaauccucccuaugccuua

SEQ ID NO: 61371 - RNA, 19 nt, Homo sapiens
uaagugccaccuucaaguu

SEQ ID NO: 61372 - RNA, 19 nt, Homo sapiens
gaugcugaauggaaugauc

SEQ ID NO: 61373 - RNA, 19 nt, Homo sapiens
aaauguucguuucuucuga

SEQ ID NO: 61374 - RNA, 19 nt, Homo sapiens
aaugggaggccuuucuaua

SEQ ID NO: 61375 - RNA, 19 nt, Homo sapiens
gccagacucggacuucuaa

SEQ ID NO: 61376 - RNA, 19 nt, Homo sapiens
ucucagagcgcaucauugu

SEQ ID NO: 61377 - RNA, 19 nt, Homo sapiens
ggaauagcagggauagcuu

SEQ ID NO: 61378 - RNA, 19 nt, Homo sapiens
gaaugggaggccuuucuau

SEQ ID NO: 61379 - RNA, 19 nt, Homo sapiens
gguuagggaagaaguugua

SEQ ID NO: 61380 - RNA, 19 nt, Homo sapiens
gagccuugaaccaggaaua

SEQ ID NO: 61381 - RNA, 19 nt, Homo sapiens
caagucaucguccgugguu

SEQ ID NO: 61382 - RNA, 19 nt, Homo sapiens
ugugcaagcugacagacaa

SEQ ID NO: 61383 - RNA, 19 nt, Homo sapiens
ucaaguggcagccucauca

SEQ ID NO: 61384 - RNA, 19 nt, Homo sapiens
gagcuugguauuugucaug

SEQ ID NO: 61385 - RNA, 19 nt, Homo sapiens
gccuuaagccugugguaaa

SEQ ID NO: 61386 - RNA, 19 nt, Homo sapiens
gcucauggaaggaguguag

SEQ ID NO: 61387 - RNA, 19 nt, Homo sapiens
gaacugcaacaacaacaac

SEQ ID NO: 61388 - RNA, 19 nt, Homo sapiens
acucggacuucuaagcuuu

SEQ ID NO: 61389 - RNA, 19 nt, Homo sapiens
gucaugggcucgcuuaugc

SEQ ID NO: 61390 - RNA, 19 nt, Homo sapiens
gggcagaugcaaauagcuu

SEQ ID NO: 61391 - RNA, 19 nt, Homo sapiens
ggaagccuguggcccugau

SEQ ID NO: 61392 - RNA, 19 nt, Homo sapiens
ggaccaguuuaccucuuuc

SEQ ID NO: 61393 - RNA, 19 nt, Homo sapiens
gggcaaagccaagaacagu

SEQ ID NO: 61394 - RNA, 19 nt, Homo sapiens
gaccucugcuucccugaca

SEQ ID NO: 61395 - RNA, 19 nt, Homo sapiens
ugaaugggaggccuuucua

SEQ ID NO: 61396 - RNA, 19 nt, Homo sapiens
gaacagucccagccuuggu

SEQ ID NO: 61397 - RNA, 19 nt, Homo sapiens
caaauccuccugcccauac

SEQ ID NO: 61398 - RNA, 19 nt, Homo sapiens
gcugagccuuccuuaugau

SEQ ID NO: 61399 - RNA, 19 nt, Homo sapiens
gccaggacaggaccaguuu

SEQ ID NO: 61400 - RNA, 19 nt, Homo sapiens
ccugagagccagagacuuc

SEQ ID NO: 61401 - RNA, 19 nt, Homo sapiens
gccugacucugcagaugaa

SEQ ID NO: 61402 - RNA, 19 nt, Homo sapiens
gcauacagcccucuuugcu

SEQ ID NO: 61403 - RNA, 19 nt, Homo sapiens
ggucuuugccaaugggaaa

SEQ ID NO: 61404 - RNA, 19 nt, Homo sapiens
acucugaggugggcaguga

SEQ ID NO: 61405 - RNA, 19 nt, Homo sapiens
gguuggagaaacugacuuu

SEQ ID NO: 61406 - RNA, 19 nt, Homo sapiens
ggacaggaccaguuuaccu

SEQ ID NO: 61407 - RNA, 19 nt, Homo sapiens
ccaacuaccaguccaucaa

SEQ ID NO: 61408 - RNA, 19 nt, Homo sapiens
gcagcuggcucuguuucca

SEQ ID NO: 61409 - RNA, 19 nt, Homo sapiens
ugggaggccuuucuauagu

SEQ ID NO: 61410 - RNA, 19 nt, Homo sapiens
aggaccaguuuaccucuuu

SEQ ID NO: 61411 - RNA, 19 nt, Homo sapiens
ggacagugacagccucagu

SEQ ID NO: 61412 - RNA, 19 nt, Homo sapiens
caaguacacucgugauauc

SEQ ID NO: 61413 - RNA, 19 nt, Homo sapiens
guacacucgugauaucuau

SEQ ID NO: 61414 - RNA, 19 nt, Homo sapiens
auaaagagcuccucaucuc

SEQ ID NO: 61415 - RNA, 19 nt, Homo sapiens
gaaaccugcuuuuguaaau

SEQ ID NO: 61416 - RNA, 19 nt, Homo sapiens
ccgccugguucuucguuua

SEQ ID NO: 61417 - RNA, 19 nt, Homo sapiens
caccugcugcucauaauaa

SEQ ID NO: 61418 - RNA, 19 nt, Homo sapiens
ccaaguacacucgugauau

SEQ ID NO: 61419 - RNA, 19 nt, Homo sapiens
ggucaccucuaccaaguac

SEQ ID NO: 61420 - RNA, 19 nt, Homo sapiens
gcucuggguuggcaucuac

SEQ ID NO: 61421 - RNA, 19 nt, Homo sapiens
cucgugauaucuauaaaga

SEQ ID NO: 61422 - RNA, 19 nt, Homo sapiens
agauauaccagcccaguga

SEQ ID NO: 61423 - RNA, 19 nt, Homo sapiens
acacucgugauaucuauaa

SEQ ID NO: 61424 - RNA, 19 nt, Homo sapiens
ccaccugcugcucauaaua

SEQ ID NO: 61425 - RNA, 19 nt, Homo sapiens
acugaaaccugcuuuugua

SEQ ID NO: 61426 - RNA, 19 nt, Homo sapiens
ucgaggccaugagcagaua

SEQ ID NO: 61427 - RNA, 19 nt, Homo sapiens
gaggccaugagcagauaua

SEQ ID NO: 61428 - RNA, 19 nt, Homo sapiens
gccaugagcagauauacca

SEQ ID NO: 61429 - RNA, 19 nt, Homo sapiens
caucugaccguggugcuuu

SEQ ID NO: 61430 - RNA, 19 nt, Homo sapiens
gauauaccagcccagugaa

SEQ ID NO: 61431 - RNA, 19 nt, Homo sapiens
gcucauaauaaaugcagau

SEQ ID NO: 61432 - RNA, 19 nt, Homo sapiens
acaaccagauggcuucacu

SEQ ID NO: 61433 - RNA, 19 nt, Homo sapiens
cuauaaagagcuccucauc

SEQ ID NO: 61434 - RNA, 19 nt, Homo sapiens
cugcugcucauaauaaaug

SEQ ID NO: 61435 - RNA, 19 nt, Homo sapiens
aaccagauggcuucacuga

SEQ ID NO: 61436 - RNA, 19 nt, Homo sapiens
uauaaagagcuccucaucu

SEQ ID NO: 61437 - RNA, 19 nt, Homo sapiens
gagcuccucaucuccuuag

SEQ ID NO: 61438 - RNA, 19 nt, Homo sapiens
gcagacagcuccuggaugu

SEQ ID NO: 61439 - RNA, 19 nt, Homo sapiens
gcagugcuguacauguuua

SEQ ID NO: 61440 - RNA, 19 nt, Homo sapiens
gaaaucgccuaccucuuug

SEQ ID NO: 61441 - RNA, 19 nt, Homo sapiens
acaaagaggucugcuacua

SEQ ID NO: 61442 - RNA, 19 nt, Homo sapiens
agaaaucgccuaccucuuu

SEQ ID NO: 61443 - RNA, 19 nt, Homo sapiens
ggaagcaguuagggagaua

SEQ ID NO: 61444 - RNA, 19 nt, Homo sapiens
gacaagauccggacuucua

SEQ ID NO: 61445 - RNA, 19 nt, Homo sapiens
acaaggugcuggagaacua

SEQ ID NO: 61446 - RNA, 19 nt, Homo sapiens
ccaaguaccucgaccucaa

SEQ ID NO: 61447 - RNA, 19 nt, Homo sapiens
ggcaaacaaugacaucuug

SEQ ID NO: 61448 - RNA, 19 nt, Homo sapiens
ucagaugccuacucagaaa

SEQ ID NO: 61449 - RNA, 19 nt, Homo sapiens
ucaacaaggugcuggagaa

SEQ ID NO: 61450 - RNA, 19 nt, Homo sapiens
gacagacucucagaugaaa

SEQ ID NO: 61451 - RNA, 19 nt, Homo sapiens
gaagaccgcucugcucucu

SEQ ID NO: 61452 - RNA, 19 nt, Homo sapiens
agaaaguggugaucaguau

SEQ ID NO: 61453 - RNA, 19 nt, Homo sapiens
ccaaucauguguucaguag

SEQ ID NO: 61454 - RNA, 19 nt, Homo sapiens
ggccaccucuucuacauug

SEQ ID NO: 61455 - RNA, 19 nt, Homo sapiens
caacaaggccuucaaugag

SEQ ID NO: 61456 - RNA, 19 nt, Homo sapiens
uguauaaacuggauguaga

SEQ ID NO: 61457 - RNA, 19 nt, Homo sapiens
ggaggagcccacauacuuu

SEQ ID NO: 61458 - RNA, 19 nt, Homo sapiens
uaaacuggauguagaagca

SEQ ID NO: 61459 - RNA, 19 nt, Homo sapiens
caagacagacucucagaug

SEQ ID NO: 61460 - RNA, 19 nt, Homo sapiens
caacugcuguggcuguaau

SEQ ID NO: 61461 - RNA, 19 nt, Homo sapiens
ggaugccggugaccagaaa

SEQ ID NO: 61462 - RNA, 19 nt, Homo sapiens
ccagucagaugccuacuca

SEQ ID NO: 61463 - RNA, 19 nt, Homo sapiens
ggagcugccugaggaggua

SEQ ID NO: 61464 - RNA, 19 nt, Homo sapiens
ccacauacuuugccaucug

SEQ ID NO: 61465 - RNA, 19 nt, Homo sapiens
cgacacauguauucucauc

SEQ ID NO: 61466 - RNA, 19 nt, Homo sapiens
acaacaaggccuucaauga

SEQ ID NO: 61467 - RNA, 19 nt, Homo sapiens
guucgugacugcugugguu

SEQ ID NO: 61468 - RNA, 19 nt, Homo sapiens
cugaguacaucaagaagaa

SEQ ID NO: 61469 - RNA, 19 nt, Homo sapiens
aaagaggucugcuacuaca

SEQ ID NO: 61470 - RNA, 19 nt, Homo sapiens
gaaugucacccucggaaug

SEQ ID NO: 61471 - RNA, 19 nt, Homo sapiens
cgaccucacugccaagaau

SEQ ID NO: 61472 - RNA, 19 nt, Homo sapiens
ccaaggaugcccugacuga

SEQ ID NO: 61473 - RNA, 19 nt, Homo sapiens
ggaauucgccgaguucauc

SEQ ID NO: 61474 - RNA, 19 nt, Homo sapiens
ggagcaagucccagucuga

SEQ ID NO: 61475 - RNA, 19 nt, Homo sapiens
ccaaacuaauauugcugua

SEQ ID NO: 61476 - RNA, 19 nt, Homo sapiens
gauccaaacuaauauugcu

SEQ ID NO: 61477 - RNA, 19 nt, Homo sapiens
aagacagacucucagauga

SEQ ID NO: 61478 - RNA, 19 nt, Homo sapiens
gccaugaugcggucuauga

SEQ ID NO: 61479 - RNA, 19 nt, Homo sapiens
guccucaggugcuggaauu

SEQ ID NO: 61480 - RNA, 19 nt, Homo sapiens
gacaacugcuguggcugua

SEQ ID NO: 61481 - RNA, 19 nt, Homo sapiens
guaugaaagauccaaacua

SEQ ID NO: 61482 - RNA, 19 nt, Homo sapiens
gggcuuggcucaggaugug

SEQ ID NO: 61483 - RNA, 19 nt, Homo sapiens
acacauguauucucaucug

SEQ ID NO: 61484 - RNA, 19 nt, Homo sapiens
cugcagugcuguacauguu

SEQ ID NO: 61485 - RNA, 19 nt, Homo sapiens
gcaagucccagucugagau

SEQ ID NO: 61486 - RNA, 19 nt, Homo sapiens
gaggagcccacauacuuug

SEQ ID NO: 61487 - RNA, 19 nt, Homo sapiens
gugaggaugcgauggagua

SEQ ID NO: 61488 - RNA, 19 nt, Homo sapiens
caaacacuacggccugauu

SEQ ID NO: 61489 - RNA, 19 nt, Homo sapiens
gaagaaaguggugaucagu

SEQ ID NO: 61490 - RNA, 19 nt, Homo sapiens
caagaauucacaagagaug

SEQ ID NO: 61491 - RNA, 19 nt, Homo sapiens
guagucauccucagugugu

SEQ ID NO: 61492 - RNA, 19 nt, Homo sapiens
guauaaacuggauguagaa

SEQ ID NO: 61493 - RNA, 19 nt, Homo sapiens
cuuccuggcuuaccuucua

SEQ ID NO: 61494 - RNA, 19 nt, Homo sapiens
aggaugcgauggaguauuc

SEQ ID NO: 61495 - RNA, 19 nt, Homo sapiens
gagaugcuccgcuacaaag

SEQ ID NO: 61496 - RNA, 19 nt, Homo sapiens
ccaagaggaggcagcguaa

SEQ ID NO: 61497 - RNA, 19 nt, Homo sapiens
ccucaagaauucacaagag

SEQ ID NO: 61498 - RNA, 19 nt, Homo sapiens
cuacccaccucgcccuuga

SEQ ID NO: 61499 - RNA, 19 nt, Homo sapiens
cagcugaguacaucaagaa

SEQ ID NO: 61500 - RNA, 19 nt, Homo sapiens
caagagaugcuccgcuaca

SEQ ID NO: 61501 - RNA, 19 nt, Homo sapiens
gacuugaugucuggccuuu

SEQ ID NO: 61502 - RNA, 19 nt, Homo sapiens
caagcaccguggccaguca

SEQ ID NO: 61503 - RNA, 19 nt, Homo sapiens
agacagacucucagaugaa

SEQ ID NO: 61504 - RNA, 19 nt, Homo sapiens
guacauguuuacagaagcu

SEQ ID NO: 61505 - RNA, 19 nt, Homo sapiens
ccaaugacgaggaggaaga

SEQ ID NO: 61506 - RNA, 19 nt, Homo sapiens
gaagcaccaagcccaaaug

SEQ ID NO: 61507 - RNA, 19 nt, Homo sapiens
gcucgguccugcucguguu

SEQ ID NO: 61508 - RNA, 19 nt, Homo sapiens
gcuacuacaugcucuuugc

SEQ ID NO: 61509 - RNA, 19 nt, Homo sapiens
guaccucgaccucaagaau

SEQ ID NO: 61510 - RNA, 19 nt, Homo sapiens
caaaaucaguggcucuuag

SEQ ID NO: 61511 - RNA, 19 nt, Homo sapiens
caaagaggucugcuacuac

SEQ ID NO: 61512 - RNA, 19 nt, Homo sapiens
cuugaugucuggccuuuua

SEQ ID NO: 61513 - RNA, 19 nt, Homo sapiens
agaccucccucucaugauc

SEQ ID NO: 61514 - RNA, 19 nt, Homo sapiens
gggaagcaguuagggagau

SEQ ID NO: 61515 - RNA, 19 nt, Homo sapiens
ucuucggccuggucuauaa

SEQ ID NO: 61516 - RNA, 19 nt, Homo sapiens
ccagugcugcggccaauga

SEQ ID NO: 61517 - RNA, 19 nt, Homo sapiens
gaaacuggagcaggagaug

SEQ ID NO: 61518 - RNA, 19 nt, Homo sapiens
gcugaggcauacagagcuu

SEQ ID NO: 61519 - RNA, 19 nt, Homo sapiens
uccaagaccucuacugcau

SEQ ID NO: 61520 - RNA, 19 nt, Homo sapiens
gagcuggcgcugcacaaug

SEQ ID NO: 61521 - RNA, 19 nt, Homo sapiens
gagcugcugcugcugucua

SEQ ID NO: 61522 - RNA, 19 nt, Homo sapiens
cgacaacaaggccuucaau

SEQ ID NO: 61523 - RNA, 19 nt, Homo sapiens
cucaagaauucacaagaga

SEQ ID NO: 61524 - RNA, 19 nt, Homo sapiens
caagcugccucccaucacu

SEQ ID NO: 61525 - RNA, 19 nt, Homo sapiens
gacaacaaggccuucaaug

SEQ ID NO: 61526 - RNA, 19 nt, Homo sapiens
aggaggagcccacauacuu

SEQ ID NO: 61527 - RNA, 19 nt, Homo sapiens
agaagaaaguggugaucag

SEQ ID NO: 61528 - RNA, 19 nt, Homo sapiens
gguggaccaugacaagaag

SEQ ID NO: 61529 - RNA, 19 nt, Homo sapiens
caucuuggccuuccugucu

SEQ ID NO: 61530 - RNA, 19 nt, Homo sapiens
gaaaguggugaucaguauc

SEQ ID NO: 61531 - RNA, 19 nt, Homo sapiens
aagaaaguggugaucagua

SEQ ID NO: 61532 - RNA, 19 nt, Homo sapiens
gagucaccaucgaggaaga

SEQ ID NO: 61533 - RNA, 19 nt, Homo sapiens
ucgucuggcucacucagua

SEQ ID NO: 61534 - RNA, 19 nt, Homo sapiens
ugaccagaaacaccaagua

SEQ ID NO: 61535 - RNA, 19 nt, Homo sapiens
gcuggucugugggcaguga

SEQ ID NO: 61536 - RNA, 19 nt, Homo sapiens
ccaaauggcggaucaucgu

SEQ ID NO: 61537 - RNA, 19 nt, Homo sapiens
gaccagaaacaccaaguac

SEQ ID NO: 61538 - RNA, 19 nt, Homo sapiens
aagccauucuuuaccauua

SEQ ID NO: 61539 - RNA, 19 nt, Homo sapiens
cccaucaccucucugcuua

SEQ ID NO: 61540 - RNA, 19 nt, Homo sapiens
ggacaacgcaguguucaau

SEQ ID NO: 61541 - RNA, 19 nt, Homo sapiens
ccagacaucuuuccagaac

SEQ ID NO: 61542 - RNA, 19 nt, Homo sapiens
gccaaugguuugccugcau

SEQ ID NO: 61543 - RNA, 19 nt, Homo sapiens
caucuuuccagaacacaaa

SEQ ID NO: 61544 - RNA, 19 nt, Homo sapiens
ggcuuaaacugccaauggu

SEQ ID NO: 61545 - RNA, 19 nt, Homo sapiens
uccagcagcuccagacauc

SEQ ID NO: 61546 - RNA, 19 nt, Homo sapiens
ugguuugccugcauguaaa

SEQ ID NO: 61547 - RNA, 19 nt, Homo sapiens
cagcagcuccagacaucuu

SEQ ID NO: 61548 - RNA, 19 nt, Homo sapiens
agccauucuuuaccauuaa

SEQ ID NO: 61549 - RNA, 19 nt, Homo sapiens
acgcaguguucaauccauu

SEQ ID NO: 61550 - RNA, 19 nt, Homo sapiens
agacaucuuuccagaacac

SEQ ID NO: 61551 - RNA, 19 nt, Homo sapiens
gcuuaaacugccaaugguu

SEQ ID NO: 61552 - RNA, 19 nt, Homo sapiens
ucacagagcucaaugauga

SEQ ID NO: 61553 - RNA, 19 nt, Homo sapiens
gagccuggccuguaacuua

SEQ ID NO: 61554 - RNA, 19 nt, Homo sapiens
agaaggagccacucauuua

SEQ ID NO: 61555 - RNA, 19 nt, Homo sapiens
gaggaccgcuucaugcuau

SEQ ID NO: 61556 - RNA, 19 nt, Homo sapiens
gagaugaagucgacugauc

SEQ ID NO: 61557 - RNA, 19 nt, Homo sapiens
gaaggagccacucauuuau

SEQ ID NO: 61558 - RNA, 19 nt, Homo sapiens
gaagacaucaucacagauc

SEQ ID NO: 61559 - RNA, 19 nt, Homo sapiens
gcauggugcucaaggaguu

SEQ ID NO: 61560 - RNA, 19 nt, Homo sapiens
uggaggagcuggaggagaa

SEQ ID NO: 61561 - RNA, 19 nt, Homo sapiens
gcagaaggagccacucauu

SEQ ID NO: 61562 - RNA, 19 nt, Homo sapiens
caucaaguccucugacaaa

SEQ ID NO: 61563 - RNA, 19 nt, Homo sapiens
gaacuggguggcacugaaa

SEQ ID NO: 61564 - RNA, 19 nt, Homo sapiens
gcaaggcgacacucauuga

SEQ ID NO: 61565 - RNA, 19 nt, Homo sapiens
gaaugccacucuugaacug

SEQ ID NO: 61566 - RNA, 19 nt, Homo sapiens
gagcuagacaugagugauu

SEQ ID NO: 61567 - RNA, 19 nt, Homo sapiens
gaaggucauugcugagaag

SEQ ID NO: 61568 - RNA, 19 nt, Homo sapiens
gcagcgaggccuagaguug

SEQ ID NO: 61569 - RNA, 19 nt, Homo sapiens
cauuaaggccuacaagaaa

SEQ ID NO: 61570 - RNA, 19 nt, Homo sapiens
gaauugggcccaggaguga

SEQ ID NO: 61571 - RNA, 19 nt, Homo sapiens
cagaaggagccacucauuu

SEQ ID NO: 61572 - RNA, 19 nt, Homo sapiens
ggaagacgcgacucagaau

SEQ ID NO: 61573 - RNA, 19 nt, Homo sapiens
agaagcccauccagacuaa

SEQ ID NO: 61574 - RNA, 19 nt, Homo sapiens
gaagacgcgacucagaauu

SEQ ID NO: 61575 - RNA, 19 nt, Homo sapiens
ucacagaucugcggaacca

SEQ ID NO: 61576 - RNA, 19 nt, Homo sapiens
uugaagacaucaucacaga

SEQ ID NO: 61577 - RNA, 19 nt, Homo sapiens
gagaaguacccgcaacuca

SEQ ID NO: 61578 - RNA, 19 nt, Homo sapiens
ggucauugcugagaaguac

SEQ ID NO: 61579 - RNA, 19 nt, Homo sapiens
ccaaauagccauacuuagc

SEQ ID NO: 61580 - RNA, 19 nt, Homo sapiens
ccuccgaccucucgcugua

SEQ ID NO: 61581 - RNA, 19 nt, Homo sapiens
ucauuaaggccuacaagaa

SEQ ID NO: 61582 - RNA, 19 nt, Homo sapiens
gaaguacccgcaacucaca

SEQ ID NO: 61583 - RNA, 19 nt, Homo sapiens
gagccuggaugcgcuguug

SEQ ID NO: 61584 - RNA, 19 nt, Homo sapiens
caaguccucugacaaacuc

SEQ ID NO: 61585 - RNA, 19 nt, Homo sapiens
ggaggaccgcuucaugcua

SEQ ID NO: 61586 - RNA, 19 nt, Homo sapiens
ggccuagaguugacacaga

SEQ ID NO: 61587 - RNA, 19 nt, Homo sapiens
ugaaggucauugcugagaa

SEQ ID NO: 61588 - RNA, 19 nt, Homo sapiens
cagcaaggcgacacucauu

SEQ ID NO: 61589 - RNA, 19 nt, Homo sapiens
gaccucagcgcucucaaga

SEQ ID NO: 61590 - RNA, 19 nt, Homo sapiens
ugaacuggguggcacugaa

SEQ ID NO: 61591 - RNA, 19 nt, Homo sapiens
cuccaaauagccauacuua

SEQ ID NO: 61592 - RNA, 19 nt, Homo sapiens
uggaugcgcuguuggagau

SEQ ID NO: 61593 - RNA, 19 nt, Homo sapiens
gcucaugccgcaacugaau

SEQ ID NO: 61594 - RNA, 19 nt, Homo sapiens
cucuuuagccgcuucauua

SEQ ID NO: 61595 - RNA, 19 nt, Homo sapiens
gagauuguccuggccuuug

SEQ ID NO: 61596 - RNA, 19 nt, Homo sapiens
gcgcaucugccaagccauu

SEQ ID NO: 61597 - RNA, 19 nt, Homo sapiens
cagacuaaguuccgaaugc

SEQ ID NO: 61598 - RNA, 19 nt, Homo sapiens
caauggaggagcugucaga

SEQ ID NO: 61599 - RNA, 19 nt, Homo sapiens
gaugcgcuguuggagauga

SEQ ID NO: 61600 - RNA, 19 nt, Homo sapiens
ccuggccuguaacuuauaa

SEQ ID NO: 61601 - RNA, 19 nt, Homo sapiens
caccggcacugucuucaca

SEQ ID NO: 61602 - RNA, 19 nt, Homo sapiens
gaucaccggcacugucuuc

SEQ ID NO: 61603 - RNA, 19 nt, Homo sapiens
ccaacucgcccaccaugga

SEQ ID NO: 61604 - RNA, 19 nt, Homo sapiens
uugagucugugguggagua

SEQ ID NO: 61605 - RNA, 19 nt, Homo sapiens
ccacagcgaccugcacuuc

SEQ ID NO: 61606 - RNA, 19 nt, Homo sapiens
ggccacagauggaccucau

SEQ ID NO: 61607 - RNA, 19 nt, Homo sapiens
ggagauuguccuggccuuu

SEQ ID NO: 61608 - RNA, 19 nt, Homo sapiens
uaugagagcgaccgugaug

SEQ ID NO: 61609 - RNA, 19 nt, Homo sapiens
ugacaaacuccgccagauc

SEQ ID NO: 61610 - RNA, 19 nt, Homo sapiens
cagccucaauguccaucaa

SEQ ID NO: 61611 - RNA, 19 nt, Homo sapiens
ggagguggaacaguggaaa

SEQ ID NO: 61612 - RNA, 19 nt, Homo sapiens
aagaagcccauccagacua

SEQ ID NO: 61613 - RNA, 19 nt, Homo sapiens
ugacacagagagaguuugu

SEQ ID NO: 61614 - RNA, 19 nt, Homo sapiens
cagcgaggccuagaguuga

SEQ ID NO: 61615 - RNA, 19 nt, Homo sapiens
ugaaacggaggcagcagaa

SEQ ID NO: 61616 - RNA, 19 nt, Homo sapiens
ucaggaggccuuugagucu

SEQ ID NO: 61617 - RNA, 19 nt, Homo sapiens
gaguaaggcagcccagaag

SEQ ID NO: 61618 - RNA, 19 nt, Homo sapiens
aagacgcgacucagaauug

SEQ ID NO: 61619 - RNA, 19 nt, Homo sapiens
ggcaacuacaugaacagua

SEQ ID NO: 61620 - RNA, 19 nt, Homo sapiens
gagcgcaugaccacacuca

SEQ ID NO: 61621 - RNA, 19 nt, Homo sapiens
gcuggugcauccuccucuu

SEQ ID NO: 61622 - RNA, 19 nt, Homo sapiens
guggaguacuucggagaga

SEQ ID NO: 61623 - RNA, 19 nt, Homo sapiens
caagaagcccauccagacu

SEQ ID NO: 61624 - RNA, 19 nt, Homo sapiens
uuuagccgcuucauuaagg

SEQ ID NO: 61625 - RNA, 19 nt, Homo sapiens
agaguaaggcagcccagaa

SEQ ID NO: 61626 - RNA, 19 nt, Homo sapiens
ggaccucagcgcucucaag

SEQ ID NO: 61627 - RNA, 19 nt, Homo sapiens
agccuggccuguaacuuau

SEQ ID NO: 61628 - RNA, 19 nt, Homo sapiens
aggaagacgcgacucagaa

SEQ ID NO: 61629 - RNA, 19 nt, Homo sapiens
ugcaggagcuagacaugag

SEQ ID NO: 61630 - RNA, 19 nt, Homo sapiens
agucugugguggaguacuu

SEQ ID NO: 61631 - RNA, 19 nt, Homo sapiens
guugacacagagagaguuu

SEQ ID NO: 61632 - RNA, 19 nt, Homo sapiens
uaggaagacgcgacucaga

SEQ ID NO: 61633 - RNA, 19 nt, Homo sapiens
cuacauccgcgcagacaca

SEQ ID NO: 61634 - RNA, 19 nt, Homo sapiens
cagcagaaggagccacuca

SEQ ID NO: 61635 - RNA, 19 nt, Homo sapiens
agcuagacaugagugauuu

SEQ ID NO: 61636 - RNA, 19 nt, Homo sapiens
gugaaggucauugcugaga

SEQ ID NO: 61637 - RNA, 19 nt, Homo sapiens
ucaccuuccugggcaacuu

SEQ ID NO: 61638 - RNA, 19 nt, Homo sapiens
caugagugauuuugaggaa

SEQ ID NO: 61639 - RNA, 19 nt, Homo sapiens
gcaucugccaagccauuga

SEQ ID NO: 61640 - RNA, 19 nt, Homo sapiens
gaacugccuuuguuaaaua

SEQ ID NO: 61641 - RNA, 19 nt, Homo sapiens
ggagacaaaugacagauua

SEQ ID NO: 61642 - RNA, 19 nt, Homo sapiens
gcaaauggaugcauacaga

SEQ ID NO: 61643 - RNA, 19 nt, Homo sapiens
uaacagaaauggcauagaa

SEQ ID NO: 61644 - RNA, 19 nt, Homo sapiens
guagauaggucacugguuu

SEQ ID NO: 61645 - RNA, 19 nt, Homo sapiens
uaacaaacauucgugcuua

SEQ ID NO: 61646 - RNA, 19 nt, Homo sapiens
gaaccaauauuucagcauu

SEQ ID NO: 61647 - RNA, 19 nt, Homo sapiens
gauaagauagggaagauua

SEQ ID NO: 61648 - RNA, 19 nt, Homo sapiens
gcagagcacuucaaauaug

SEQ ID NO: 61649 - RNA, 19 nt, Homo sapiens
gaauugaggcuuaaacuuu

SEQ ID NO: 61650 - RNA, 19 nt, Homo sapiens
cgaggaaagucacaaauuu

SEQ ID NO: 61651 - RNA, 19 nt, Homo sapiens
cagcauuucugacuuguua

SEQ ID NO: 61652 - RNA, 19 nt, Homo sapiens
gcacaguguuguucaguuu

SEQ ID NO: 61653 - RNA, 19 nt, Homo sapiens
gcacauauccuacccaaug

SEQ ID NO: 61654 - RNA, 19 nt, Homo sapiens
caacuaaggugccucaugu

SEQ ID NO: 61655 - RNA, 19 nt, Homo sapiens
ggagaacuguugagcauga

SEQ ID NO: 61656 - RNA, 19 nt, Homo sapiens
gaaagaauaccucaggaaa

SEQ ID NO: 61657 - RNA, 19 nt, Homo sapiens
aaagaaagauguugcucua

SEQ ID NO: 61658 - RNA, 19 nt, Homo sapiens
gcauacagauuaaagucua

SEQ ID NO: 61659 - RNA, 19 nt, Homo sapiens
gaaauuacguuuuggauug

SEQ ID NO: 61660 - RNA, 19 nt, Homo sapiens
gaacaaacaagcaacaguu

SEQ ID NO: 61661 - RNA, 19 nt, Homo sapiens
gguuagagcuauagagauu

SEQ ID NO: 61662 - RNA, 19 nt, Homo sapiens
gguauaaaguggagaaguu

SEQ ID NO: 61663 - RNA, 19 nt, Homo sapiens
caaauacacuuacaagaag

SEQ ID NO: 61664 - RNA, 19 nt, Homo sapiens
gaggaaagucacaaauuua

SEQ ID NO: 61665 - RNA, 19 nt, Homo sapiens
gcauuuccauucacuaauu

SEQ ID NO: 61666 - RNA, 19 nt, Homo sapiens
gcacauguccacaguauug

SEQ ID NO: 61667 - RNA, 19 nt, Homo sapiens
gaacuaguccaacucuuaa

SEQ ID NO: 61668 - RNA, 19 nt, Homo sapiens
ccacagagguauuugaugu

SEQ ID NO: 61669 - RNA, 19 nt, Homo sapiens
ucagauaccuuuaaucauc

SEQ ID NO: 61670 - RNA, 19 nt, Homo sapiens
caucauugcuuccuuucua

SEQ ID NO: 61671 - RNA, 19 nt, Homo sapiens
ggagaggguuagagcuaua

SEQ ID NO: 61672 - RNA, 19 nt, Homo sapiens
gaaagauguugcucuaagu

SEQ ID NO: 61673 - RNA, 19 nt, Homo sapiens
aaacauucgugcuuacuuu

SEQ ID NO: 61674 - RNA, 19 nt, Homo sapiens
gaauaaagaaggaagcauu

SEQ ID NO: 61675 - RNA, 19 nt, Homo sapiens
gcaucuaucuccugcugua

SEQ ID NO: 61676 - RNA, 19 nt, Homo sapiens
uuaggaagcugcugucuga

SEQ ID NO: 61677 - RNA, 19 nt, Homo sapiens
cuagagaacugccuuuguu

SEQ ID NO: 61678 - RNA, 19 nt, Homo sapiens
caaccuguguggaaguaua

SEQ ID NO: 61679 - RNA, 19 nt, Homo sapiens
ggacguagccuaacauuuu

SEQ ID NO: 61680 - RNA, 19 nt, Homo sapiens
aagaugagcuggaaugaug

SEQ ID NO: 61681 - RNA, 19 nt, Homo sapiens
gugaagagccaccuccuua

SEQ ID NO: 61682 - RNA, 19 nt, Homo sapiens
ccacaucauugcuuccuuu

SEQ ID NO: 61683 - RNA, 19 nt, Homo sapiens
aauaagccauuguggguua

SEQ ID NO: 61684 - RNA, 19 nt, Homo sapiens
gauacuugguuucuguuaa

SEQ ID NO: 61685 - RNA, 19 nt, Homo sapiens
gagcagagacuugugaauu

SEQ ID NO: 61686 - RNA, 19 nt, Homo sapiens
agaaagaagugugaacaaa

SEQ ID NO: 61687 - RNA, 19 nt, Homo sapiens
guaaggugcuguauauaag

SEQ ID NO: 61688 - RNA, 19 nt, Homo sapiens
gagaaaggcucaaaaggaa

SEQ ID NO: 61689 - RNA, 19 nt, Homo sapiens
gcagagagcacaauaguac

SEQ ID NO: 61690 - RNA, 19 nt, Homo sapiens
ggaccaguguuaguuauau

SEQ ID NO: 61691 - RNA, 19 nt, Homo sapiens
gaaccauauuugacaguga

SEQ ID NO: 61692 - RNA, 19 nt, Homo sapiens
gagcaaugguguaguucuu

SEQ ID NO: 61693 - RNA, 19 nt, Homo sapiens
caauuucccuucagcagaa

SEQ ID NO: 61694 - RNA, 19 nt, Homo sapiens
ucaacauaauucccaguua

SEQ ID NO: 61695 - RNA, 19 nt, Homo sapiens
aaacugaaauugacucuac

SEQ ID NO: 61696 - RNA, 19 nt, Homo sapiens
caacaguucccuucucuga

SEQ ID NO: 61697 - RNA, 19 nt, Homo sapiens
gagaacugccuuuguuaaa

SEQ ID NO: 61698 - RNA, 19 nt, Homo sapiens
ccacaguauuggcgagaua

SEQ ID NO: 61699 - RNA, 19 nt, Homo sapiens
ggaaguauauacaguugag

SEQ ID NO: 61700 - RNA, 19 nt, Homo sapiens
gcuaaccacucuccucuuc

SEQ ID NO: 61701 - RNA, 19 nt, Homo sapiens
gcauagcauucuuaaagga

SEQ ID NO: 61702 - RNA, 19 nt, Homo sapiens
ccauucaugucccaucaua

SEQ ID NO: 61703 - RNA, 19 nt, Homo sapiens
aaagaagugugaacaaaca

SEQ ID NO: 61704 - RNA, 19 nt, Homo sapiens
aaagauacuugguuucugu

SEQ ID NO: 61705 - RNA, 19 nt, Homo sapiens
cacaagaaaucccaagaga

SEQ ID NO: 61706 - RNA, 19 nt, Homo sapiens
gaacacaugcauuuaugga

SEQ ID NO: 61707 - RNA, 19 nt, Homo sapiens
ugaaguaacaguagagauu

SEQ ID NO: 61708 - RNA, 19 nt, Homo sapiens
gcccagauccuaaaugcua

SEQ ID NO: 61709 - RNA, 19 nt, Homo sapiens
cuucuuaccucuguagaua

SEQ ID NO: 61710 - RNA, 19 nt, Homo sapiens
agauuaaguuccagcauuu

SEQ ID NO: 61711 - RNA, 19 nt, Homo sapiens
ggaaagaauaccucaggaa

SEQ ID NO: 61712 - RNA, 19 nt, Homo sapiens
ccaaugaaguaacaguaga

SEQ ID NO: 61713 - RNA, 19 nt, Homo sapiens
cgaacuggaugcauuagga

SEQ ID NO: 61714 - RNA, 19 nt, Homo sapiens
caagagagcagaagcgaau

SEQ ID NO: 61715 - RNA, 19 nt, Homo sapiens
ccacagaacuaguccaacu

SEQ ID NO: 61716 - RNA, 19 nt, Homo sapiens
gcagugcaauuucuucagu

SEQ ID NO: 61717 - RNA, 19 nt, Homo sapiens
ugaaucccaucuauaagaa

SEQ ID NO: 61718 - RNA, 19 nt, Homo sapiens
caucuugaaucccaucuau

SEQ ID NO: 61719 - RNA, 19 nt, Homo sapiens
gcaaugguguaguucuuag

SEQ ID NO: 61720 - RNA, 19 nt, Homo sapiens
caggacgaauugaggcuua

SEQ ID NO: 61721 - RNA, 19 nt, Homo sapiens
ugccaucaguuagaaauua

SEQ ID NO: 61722 - RNA, 19 nt, Homo sapiens
gugaguauaugaauguguu

SEQ ID NO: 61723 - RNA, 19 nt, Homo sapiens
agaacuaguccaacucuua

SEQ ID NO: 61724 - RNA, 19 nt, Homo sapiens
uagcauagcauucuuaaag

SEQ ID NO: 61725 - RNA, 19 nt, Homo sapiens
gaagauaagauagggaaga

SEQ ID NO: 61726 - RNA, 19 nt, Homo sapiens
ggaguucgcccaaaucauc

SEQ ID NO: 61727 - RNA, 19 nt, Homo sapiens
aaggagacuuugcagauaa

SEQ ID NO: 61728 - RNA, 19 nt, Homo sapiens
gcccaucugacccauauua

SEQ ID NO: 61729 - RNA, 19 nt, Homo sapiens
ugaaggaccucucauccau

SEQ ID NO: 61730 - RNA, 19 nt, Homo sapiens
gaaguaacaguagagauug

SEQ ID NO: 61731 - RNA, 19 nt, Homo sapiens
gacagugccuggagaaugg

SEQ ID NO: 61732 - RNA, 19 nt, Homo sapiens
ugaaaggacaauugaauga

SEQ ID NO: 61733 - RNA, 19 nt, Homo sapiens
ugggaaagauacuugguuu

SEQ ID NO: 61734 - RNA, 19 nt, Homo sapiens
gcgaggacuucuugaacuu

SEQ ID NO: 61735 - RNA, 19 nt, Homo sapiens
aaagagauuucaugaagca

SEQ ID NO: 61736 - RNA, 19 nt, Homo sapiens
cuuaguaacugugaguaua

SEQ ID NO: 61737 - RNA, 19 nt, Homo sapiens
gcacaauaguacccaucaa

SEQ ID NO: 61738 - RNA, 19 nt, Homo sapiens
uuaaugugcuuguugguau

SEQ ID NO: 61739 - RNA, 19 nt, Homo sapiens
gaggcucacuguugucaga

SEQ ID NO: 61740 - RNA, 19 nt, Homo sapiens
gagcagagaugaagacaag

SEQ ID NO: 61741 - RNA, 19 nt, Homo sapiens
cuuggaagcuugaauuaua

SEQ ID NO: 61742 - RNA, 19 nt, Homo sapiens
gacaagacaugaugaaauc

SEQ ID NO: 61743 - RNA, 19 nt, Homo sapiens
cuaaggaaguuuggaaaua

SEQ ID NO: 61744 - RNA, 19 nt, Homo sapiens
uugcagagauuccuaagua

SEQ ID NO: 61745 - RNA, 19 nt, Homo sapiens
gcugaaauuuccacaaaga

SEQ ID NO: 61746 - RNA, 19 nt, Homo sapiens
gaaaagugcugccuaagga

SEQ ID NO: 61747 - RNA, 19 nt, Homo sapiens
gggaauagcuaaaccuuuu

SEQ ID NO: 61748 - RNA, 19 nt, Homo sapiens
guaaaguauugcagagauu

SEQ ID NO: 61749 - RNA, 19 nt, Homo sapiens
guccuaaccucaauuguau

SEQ ID NO: 61750 - RNA, 19 nt, Homo sapiens
gaacggagagcagagauga

SEQ ID NO: 61751 - RNA, 19 nt, Homo sapiens
guucaucucuguuucuaga

SEQ ID NO: 61752 - RNA, 19 nt, Homo sapiens
aauauggccuguuuaaaga

SEQ ID NO: 61753 - RNA, 19 nt, Homo sapiens
cagauugccuugaauuuua

SEQ ID NO: 61754 - RNA, 19 nt, Homo sapiens
gaacugaccagcccucauc

SEQ ID NO: 61755 - RNA, 19 nt, Homo sapiens
gcagagauuccuaaguauu

SEQ ID NO: 61756 - RNA, 19 nt, Homo sapiens
gcagacuggugaccuucua

SEQ ID NO: 61757 - RNA, 19 nt, Homo sapiens
gaagaaaacccguaugcua

SEQ ID NO: 61758 - RNA, 19 nt, Homo sapiens
gaacgucuccugucuuugg

SEQ ID NO: 61759 - RNA, 19 nt, Homo sapiens
uaaggaaguuuggaaauag

SEQ ID NO: 61760 - RNA, 19 nt, Homo sapiens
ccagaaaaccuucauauaa

SEQ ID NO: 61761 - RNA, 19 nt, Homo sapiens
gaagacaagacaugaugaa

SEQ ID NO: 61762 - RNA, 19 nt, Homo sapiens
ucaaggaugcguuccauuu

SEQ ID NO: 61763 - RNA, 19 nt, Homo sapiens
gcagguguguccagaguca

SEQ ID NO: 61764 - RNA, 19 nt, Homo sapiens
ucagugaacucuguaugaa

SEQ ID NO: 61765 - RNA, 19 nt, Homo sapiens
cagagauuccuaaguauuu

SEQ ID NO: 61766 - RNA, 19 nt, Homo sapiens
uaacauuccuaggcugaaa

SEQ ID NO: 61767 - RNA, 19 nt, Homo sapiens
guacacagucugauaagga

SEQ ID NO: 61768 - RNA, 19 nt, Homo sapiens
cuaaagcgcuccagcacau

SEQ ID NO: 61769 - RNA, 19 nt, Homo sapiens
aaagacacuugguaauaga

SEQ ID NO: 61770 - RNA, 19 nt, Homo sapiens
ccagaacacuucaagaacu

SEQ ID NO: 61771 - RNA, 19 nt, Homo sapiens
gaccuucuauucccuguuc

SEQ ID NO: 61772 - RNA, 19 nt, Homo sapiens
ucugagcacuuccuucuga

SEQ ID NO: 61773 - RNA, 19 nt, Homo sapiens
gugcgcaucuugagucuuc

SEQ ID NO: 61774 - RNA, 19 nt, Homo sapiens
aaacccguaugcuagauuu

SEQ ID NO: 61775 - RNA, 19 nt, Homo sapiens
cggcuucccuuuguaaauu

SEQ ID NO: 61776 - RNA, 19 nt, Homo sapiens
ugauuucccugaccucuug

SEQ ID NO: 61777 - RNA, 19 nt, Homo sapiens
ggacaggagugaggagaag

SEQ ID NO: 61778 - RNA, 19 nt, Homo sapiens
aggcugaaauuuccacaaa

SEQ ID NO: 61779 - RNA, 19 nt, Homo sapiens
ccuaaccucaauuguauua

SEQ ID NO: 61780 - RNA, 19 nt, Homo sapiens
ccaguacacagucugauaa

SEQ ID NO: 61781 - RNA, 19 nt, Homo sapiens
caaggaaaccauaaagcuu

SEQ ID NO: 61782 - RNA, 19 nt, Homo sapiens
uagaaacccacgucuguaa

SEQ ID NO: 61783 - RNA, 19 nt, Homo sapiens
gcaguagugugcgugcaaa

SEQ ID NO: 61784 - RNA, 19 nt, Homo sapiens
ugaagaacgucuccugucu

SEQ ID NO: 61785 - RNA, 19 nt, Homo sapiens
gaucaaggaugcguuccau

SEQ ID NO: 61786 - RNA, 19 nt, Homo sapiens
aaauauggccuguuuaaag

SEQ ID NO: 61787 - RNA, 19 nt, Homo sapiens
gagaugaagacaagacaug

SEQ ID NO: 61788 - RNA, 19 nt, Homo sapiens
caggauacguggcuuuagu

SEQ ID NO: 61789 - RNA, 19 nt, Homo sapiens
cuucacaccuguugacuca

SEQ ID NO: 61790 - RNA, 19 nt, Homo sapiens
uucaagaacucgucaaaca

SEQ ID NO: 61791 - RNA, 19 nt, Homo sapiens
cguccuaaccucaauugua

SEQ ID NO: 61792 - RNA, 19 nt, Homo sapiens
guagaaacccacgucugua

SEQ ID NO: 61793 - RNA, 19 nt, Homo sapiens
agugaacucuguaugaaug

SEQ ID NO: 61794 - RNA, 19 nt, Homo sapiens
guuucucucuguccacuaa

SEQ ID NO: 61795 - RNA, 19 nt, Homo sapiens
ggagcugcuuguucucaga

SEQ ID NO: 61796 - RNA, 19 nt, Homo sapiens
ggauacguggcuuuaguaa

SEQ ID NO: 61797 - RNA, 19 nt, Homo sapiens
ccaccggcuucccuuugua

SEQ ID NO: 61798 - RNA, 19 nt, Homo sapiens
gcuuggagugccuuaauuu

SEQ ID NO: 61799 - RNA, 19 nt, Homo sapiens
ggauuuuccucccugcuua

SEQ ID NO: 61800 - RNA, 19 nt, Homo sapiens
gugaagagugccugaagaa

SEQ ID NO: 61801 - RNA, 19 nt, Homo sapiens
agggcucgguugugaaaua

SEQ ID NO: 61802 - RNA, 19 nt, Homo sapiens
cagcagcaccuaagaucaa

SEQ ID NO: 61803 - RNA, 19 nt, Homo sapiens
uaaauagcauuggggaaua

SEQ ID NO: 61804 - RNA, 19 nt, Homo sapiens
ucacaccuguugacucaca

SEQ ID NO: 61805 - RNA, 19 nt, Homo sapiens
agacaagacaugaugaaau

SEQ ID NO: 61806 - RNA, 19 nt, Homo sapiens
gaccagcccucaucauucc

SEQ ID NO: 61807 - RNA, 19 nt, Homo sapiens
uaaccucaaggaaaccaua

SEQ ID NO: 61808 - RNA, 19 nt, Homo sapiens
acaaagaauagaaccugua

SEQ ID NO: 61809 - RNA, 19 nt, Homo sapiens
ucacugauccagaacacuu

SEQ ID NO: 61810 - RNA, 19 nt, Homo sapiens
uuauaaaugugguguuugg

SEQ ID NO: 61811 - RNA, 19 nt, Homo sapiens
guaacgcuccacugacuga

SEQ ID NO: 61812 - RNA, 19 nt, Homo sapiens
ccacguuucuguaaaauca

SEQ ID NO: 61813 - RNA, 19 nt, Homo sapiens
ccugaccucuugggcauuu

SEQ ID NO: 61814 - RNA, 19 nt, Homo sapiens
ugucuuuggugcaacacua

SEQ ID NO: 61815 - RNA, 19 nt, Homo sapiens
cagaacacuucaagaacuc

SEQ ID NO: 61816 - RNA, 19 nt, Homo sapiens
uuuguugggugaacuuuga

SEQ ID NO: 61817 - RNA, 19 nt, Homo sapiens
caaagaauagaaccuguac

SEQ ID NO: 61818 - RNA, 19 nt, Homo sapiens
ggucugagcacuuccuucu

SEQ ID NO: 61819 - RNA, 19 nt, Homo sapiens
aguaaaguauugcagagau

SEQ ID NO: 61820 - RNA, 19 nt, Homo sapiens
ugugaagagugccugaaga

SEQ ID NO: 61821 - RNA, 19 nt, Homo sapiens
cauaaaagacacuugguaa

SEQ ID NO: 61822 - RNA, 19 nt, Homo sapiens
gaaacccacgucuguaagg

SEQ ID NO: 61823 - RNA, 19 nt, Homo sapiens
uguagaaacccacgucugu

SEQ ID NO: 61824 - RNA, 19 nt, Homo sapiens
aaaagacacuugguaauag

SEQ ID NO: 61825 - RNA, 19 nt, Homo sapiens
gccaccggcuucccuuugu

SEQ ID NO: 61826 - RNA, 19 nt, Homo sapiens
ggcauuuguauuuguagua

SEQ ID NO: 61827 - RNA, 19 nt, Homo sapiens
gcggggaagucacugaaaa

SEQ ID NO: 61828 - RNA, 19 nt, Homo sapiens
acacagggaagucgguuug

SEQ ID NO: 61829 - RNA, 19 nt, Homo sapiens
ggagaccacguggccauug

SEQ ID NO: 61830 - RNA, 19 nt, Homo sapiens
gaugaagacaagacaugau

SEQ ID NO: 61831 - RNA, 19 nt, Homo sapiens
guauugcagagauuccuaa

SEQ ID NO: 61832 - RNA, 19 nt, Homo sapiens
gggcauuuguauuuguagu

SEQ ID NO: 61833 - RNA, 19 nt, Homo sapiens
aaaguucacaggcagauca

SEQ ID NO: 61834 - RNA, 19 nt, Homo sapiens
aagcagguguguccagagu

SEQ ID NO: 61835 - RNA, 19 nt, Homo sapiens
ugaccagcccucaucauuc

SEQ ID NO: 61836 - RNA, 19 nt, Homo sapiens
ucaaggaaaccauaaagcu

SEQ ID NO: 61837 - RNA, 19 nt, Homo sapiens
aaacuguaaccucaaggaa

SEQ ID NO: 61838 - RNA, 19 nt, Homo sapiens
ggaagccggacaggaguga

SEQ ID NO: 61839 - RNA, 19 nt, Homo sapiens
gacacuugguaauagacuu

SEQ ID NO: 61840 - RNA, 19 nt, Homo sapiens
ucacagauaucuccauuug

SEQ ID NO: 61841 - RNA, 19 nt, Homo sapiens
gcugugagguuguggauga

SEQ ID NO: 61842 - RNA, 19 nt, Homo sapiens
gaugcaagcucuccagaag

SEQ ID NO: 61843 - RNA, 19 nt, Homo sapiens
gcgcuuuguuggaauggua

SEQ ID NO: 61844 - RNA, 19 nt, Homo sapiens
cauagaggguggacaguuc

SEQ ID NO: 61845 - RNA, 19 nt, Homo sapiens
caagggagacuucgagaau

SEQ ID NO: 61846 - RNA, 19 nt, Homo sapiens
gcucuuaaagggaggauuu

SEQ ID NO: 61847 - RNA, 19 nt, Homo sapiens
gcagccgccucacagauau

SEQ ID NO: 61848 - RNA, 19 nt, Homo sapiens
aagcuaugcugcacacuga

SEQ ID NO: 61849 - RNA, 19 nt, Homo sapiens
ccucacagauaucuccauu

SEQ ID NO: 61850 - RNA, 19 nt, Homo sapiens
ggaugaacguggccugaag

SEQ ID NO: 61851 - RNA, 19 nt, Homo sapiens
gaaggggugugaucucuga

SEQ ID NO: 61852 - RNA, 19 nt, Homo sapiens
aggcuguccucccuaauaa

SEQ ID NO: 61853 - RNA, 19 nt, Homo sapiens
uacagaagcuggacaacca

SEQ ID NO: 61854 - RNA, 19 nt, Homo sapiens
ucgcaagucuuaugaggau

SEQ ID NO: 61855 - RNA, 19 nt, Homo sapiens
ccaguuuccuucccucuca

SEQ ID NO: 61856 - RNA, 19 nt, Homo sapiens
gccacaaucugggcaguga

SEQ ID NO: 61857 - RNA, 19 nt, Homo sapiens
ggcagccgccucacagaua

SEQ ID NO: 61858 - RNA, 19 nt, Homo sapiens
acaggaagcagcuagacua

SEQ ID NO: 61859 - RNA, 19 nt, Homo sapiens
gagaaugcuggcacccaua

SEQ ID NO: 61860 - RNA, 19 nt, Homo sapiens
gcaagggagacuucgagaa

SEQ ID NO: 61861 - RNA, 19 nt, Homo sapiens
ggucuucacggauggcuuu

SEQ ID NO: 61862 - RNA, 19 nt, Homo sapiens
caggcuguccucccuaaua

SEQ ID NO: 61863 - RNA, 19 nt, Homo sapiens
ggagugggugcccucagua

SEQ ID NO: 61864 - RNA, 19 nt, Homo sapiens
acaaaagccuccccgguuu

SEQ ID NO: 61865 - RNA, 19 nt, Homo sapiens
agucaccacucgggacaua

SEQ ID NO: 61866 - RNA, 19 nt, Homo sapiens
cgugcaagcucuccagaag

SEQ ID NO: 61867 - RNA, 19 nt, Homo sapiens
cagcugguguguaggaaag

SEQ ID NO: 61868 - RNA, 19 nt, Homo sapiens
gugacagucuuccugaaag

SEQ ID NO: 61869 - RNA, 19 nt, Homo sapiens
gagugggugcccucaguaa

SEQ ID NO: 61870 - RNA, 19 nt, Homo sapiens
ggaugcaagcucuccagaa

SEQ ID NO: 61871 - RNA, 19 nt, Homo sapiens
gaagcauucacgugagaug

SEQ ID NO: 61872 - RNA, 19 nt, Homo sapiens
uggcugagcucuucuaccu

SEQ ID NO: 61873 - RNA, 19 nt, Homo sapiens
ggagagaguuuuguuuucu

SEQ ID NO: 61874 - RNA, 19 nt, Homo sapiens
cgguggagaugccugucua

SEQ ID NO: 61875 - RNA, 19 nt, Homo sapiens
gcaggugcgccuuccuuuc

SEQ ID NO: 61876 - RNA, 19 nt, Homo sapiens
acggauggcuuugccgauu

SEQ ID NO: 61877 - RNA, 19 nt, Homo sapiens
gggcaggaguggguguuag

SEQ ID NO: 61878 - RNA, 19 nt, Homo sapiens
gcaugguugugacagucuu

SEQ ID NO: 61879 - RNA, 19 nt, Homo sapiens
caugagauauucccauccu

SEQ ID NO: 61880 - RNA, 19 nt, Homo sapiens
gggaguccuuggagcaucu

SEQ ID NO: 61881 - RNA, 19 nt, Homo sapiens
gagcugucccgugcacuga

SEQ ID NO: 61882 - RNA, 19 nt, Homo sapiens
gaagcugacgcggaagaug

SEQ ID NO: 61883 - RNA, 19 nt, Homo sapiens
aggaagcauucacgugaga

SEQ ID NO: 61884 - RNA, 19 nt, Homo sapiens
uuaugaggaugccacaauc

SEQ ID NO: 61885 - RNA, 19 nt, Homo sapiens
gggagagaguuuuguuuuc

SEQ ID NO: 61886 - RNA, 19 nt, Homo sapiens
gaucuggaggugacguuuc

SEQ ID NO: 61887 - RNA, 19 nt, Homo sapiens
caggaguggguguuaggua

SEQ ID NO: 61888 - RNA, 19 nt, Homo sapiens
gagagaguuuuguuuucuu

SEQ ID NO: 61889 - RNA, 19 nt, Homo sapiens
cggauggcuuugccgauuc

SEQ ID NO: 61890 - RNA, 19 nt, Homo sapiens
ugcaggcuguccucccuaa

SEQ ID NO: 61891 - RNA, 19 nt, Homo sapiens
gggaagcccagggugaaga

SEQ ID NO: 61892 - RNA, 19 nt, Homo sapiens
gugagguuguggaugaaca

SEQ ID NO: 61893 - RNA, 19 nt, Homo sapiens
uccuuucucucuccuguga

SEQ ID NO: 61894 - RNA, 19 nt, Homo sapiens
ggcaggugcgccuuccuuu

SEQ ID NO: 61895 - RNA, 19 nt, Homo sapiens
aagggagacuucgagaaug

SEQ ID NO: 61896 - RNA, 19 nt, Homo sapiens
ugugacagucuuccugaaa

SEQ ID NO: 61897 - RNA, 19 nt, Homo sapiens
uggagugggugcccucagu

SEQ ID NO: 61898 - RNA, 19 nt, Homo sapiens
ccuuccagcugguguguag

SEQ ID NO: 61899 - RNA, 19 nt, Homo sapiens
ucaccacucgggacauaga

SEQ ID NO: 61900 - RNA, 19 nt, Homo sapiens
caggugcgccuuccuuucu

SEQ ID NO: 61901 - RNA, 19 nt, Homo sapiens
guccuuggauagauuucug

SEQ ID NO: 61902 - RNA, 19 nt, Homo sapiens
gaccugagaucacuucuua

SEQ ID NO: 61903 - RNA, 19 nt, Homo sapiens
gaaagcggcuguuuaggaa

SEQ ID NO: 61904 - RNA, 19 nt, Homo sapiens
uggaguagauuguacauua

SEQ ID NO: 61905 - RNA, 19 nt, Homo sapiens
ggaguagauuguacauuaa

SEQ ID NO: 61906 - RNA, 19 nt, Homo sapiens
gcacucugaucuacaaauu

SEQ ID NO: 61907 - RNA, 19 nt, Homo sapiens
ggugagaggugauagcuau

SEQ ID NO: 61908 - RNA, 19 nt, Homo sapiens
cacauuggcuuucuucaug

SEQ ID NO: 61909 - RNA, 19 nt, Homo sapiens
gccagaaugugaauguauu

SEQ ID NO: 61910 - RNA, 19 nt, Homo sapiens
gcugguggauaaugauuga

SEQ ID NO: 61911 - RNA, 19 nt, Homo sapiens
acucugaucuacaaauuug

SEQ ID NO: 61912 - RNA, 19 nt, Homo sapiens
gaacaggugcucgaguuug

SEQ ID NO: 61913 - RNA, 19 nt, Homo sapiens
gagaggugauagcuaugaa

SEQ ID NO: 61914 - RNA, 19 nt, Homo sapiens
cagcugugguguauccuaa

SEQ ID NO: 61915 - RNA, 19 nt, Homo sapiens
gaaugugaauguauugacu

SEQ ID NO: 61916 - RNA, 19 nt, Homo sapiens
caaauggaguagauuguac

SEQ ID NO: 61917 - RNA, 19 nt, Homo sapiens
aagaacaggugcucgaguu

SEQ ID NO: 61918 - RNA, 19 nt, Homo sapiens
gaaccaugccuuucacaca

SEQ ID NO: 61919 - RNA, 19 nt, Homo sapiens
ugucgcagguauauuguuu

SEQ ID NO: 61920 - RNA, 19 nt, Homo sapiens
ccaaauggaguagauugua

SEQ ID NO: 61921 - RNA, 19 nt, Homo sapiens
ugaagaagcugggauacag

SEQ ID NO: 61922 - RNA, 19 nt, Homo sapiens
ugaaagcggcuguuuagga

SEQ ID NO: 61923 - RNA, 19 nt, Homo sapiens
uuuacaggcugguggauaa

SEQ ID NO: 61924 - RNA, 19 nt, Homo sapiens
uguauugacuggagugaga

SEQ ID NO: 61925 - RNA, 19 nt, Homo sapiens
uggaagaaccgaagagcua

SEQ ID NO: 61926 - RNA, 19 nt, Homo sapiens
uggcaggcuuccuagauaa

SEQ ID NO: 61927 - RNA, 19 nt, Homo sapiens
gaucuacaaauuuggaaga

SEQ ID NO: 61928 - RNA, 19 nt, Homo sapiens
gugcauauguuacccaaaa

SEQ ID NO: 61929 - RNA, 19 nt, Homo sapiens
uaaaugcuguauccaaugc

SEQ ID NO: 61930 - RNA, 19 nt, Homo sapiens
caggcuuccuagauaauuu

SEQ ID NO: 61931 - RNA, 19 nt, Homo sapiens
gguuucauguugauguuug

SEQ ID NO: 61932 - RNA, 19 nt, Homo sapiens
uuucauugguuucauguug

SEQ ID NO: 61933 - RNA, 19 nt, Homo sapiens
uaugaaagcggcuguuuag

SEQ ID NO: 61934 - RNA, 19 nt, Homo sapiens
ugaugcagcugugguguau

SEQ ID NO: 61935 - RNA, 19 nt, Homo sapiens
gaagucggcgugggcguuu

SEQ ID NO: 61936 - RNA, 19 nt, Homo sapiens
ggaagaaccgaagagcuau

SEQ ID NO: 61937 - RNA, 19 nt, Homo sapiens
cuaugaaagcggcuguuua

SEQ ID NO: 61938 - RNA, 19 nt, Homo sapiens
uuagcacucugaucuacaa

SEQ ID NO: 61939 - RNA, 19 nt, Homo sapiens
acaggcugguggauaauga

SEQ ID NO: 61940 - RNA, 19 nt, Homo sapiens
ugacuggagugagagaaga

SEQ ID NO: 61941 - RNA, 19 nt, Homo sapiens
gcuaugaaagcggcuguuu

SEQ ID NO: 61942 - RNA, 19 nt, Homo sapiens
gaagaaccgaagagcuaug

SEQ ID NO: 61943 - RNA, 19 nt, Homo sapiens
gauguuugggucacuuauu

SEQ ID NO: 61944 - RNA, 19 nt, Homo sapiens
aagcggcuguuuaggaaga

SEQ ID NO: 61945 - RNA, 19 nt, Homo sapiens
gcaggcuuccuagauaauu

SEQ ID NO: 61946 - RNA, 19 nt, Homo sapiens
auggcaggcuuccuagaua

SEQ ID NO: 61947 - RNA, 19 nt, Homo sapiens
ggccagaaugugaauguau

SEQ ID NO: 61948 - RNA, 19 nt, Homo sapiens
caucuguugucgcagguau

SEQ ID NO: 61949 - RNA, 19 nt, Homo sapiens
acauuggcuuucuucauga

SEQ ID NO: 61950 - RNA, 19 nt, Homo sapiens
ggcgugggcguuugaagaa

SEQ ID NO: 61951 - RNA, 19 nt, Homo sapiens
gaggugauagcuaugaaag

SEQ ID NO: 61952 - RNA, 19 nt, Homo sapiens
guuugaagaagcugggaua

SEQ ID NO: 61953 - RNA, 19 nt, Homo sapiens
aaccaugccuuucacacau

SEQ ID NO: 61954 - RNA, 19 nt, Homo sapiens
ccacauuggcuuucuucau

SEQ ID NO: 61955 - RNA, 19 nt, Homo sapiens
gcagcugugguguauccua

SEQ ID NO: 61956 - RNA, 19 nt, Homo sapiens
gcauauguuacccaaaaua

SEQ ID NO: 61957 - RNA, 19 nt, Homo sapiens
ucacuuauugcuuccaugu

SEQ ID NO: 61958 - RNA, 19 nt, Homo sapiens
ccagaaugugaauguauug

SEQ ID NO: 61959 - RNA, 19 nt, Homo sapiens
gaguuuggcuuuucauugg

SEQ ID NO: 61960 - RNA, 19 nt, Homo sapiens
acaguugaaccaugccuuu

SEQ ID NO: 61961 - RNA, 19 nt, Homo sapiens
ggaccugagaucacuucuu

SEQ ID NO: 61962 - RNA, 19 nt, Homo sapiens
ggucacuuauugcuuccau

SEQ ID NO: 61963 - RNA, 19 nt, Homo sapiens
uggcuuucuucaugauaaa

SEQ ID NO: 61964 - RNA, 19 nt, Homo sapiens
auguuugggucacuuauug

SEQ ID NO: 61965 - RNA, 19 nt, Homo sapiens
ugagaggugauagcuauga

SEQ ID NO: 61966 - RNA, 19 nt, Homo sapiens
uuggcuuucuucaugauaa

SEQ ID NO: 61967 - RNA, 19 nt, Homo sapiens
ccugagaucacuucuuaag

SEQ ID NO: 61968 - RNA, 19 nt, Homo sapiens
cccaaaauacugauguuua

SEQ ID NO: 61969 - RNA, 19 nt, Homo sapiens
ggagugagagaagaaaugc

SEQ ID NO: 61970 - RNA, 19 nt, Homo sapiens
ggugcucgaguuuggcuuu

SEQ ID NO: 61971 - RNA, 19 nt, Homo sapiens
uguugucgcagguauauug

SEQ ID NO: 61972 - RNA, 19 nt, Homo sapiens
gguguauccuaagccagaa

SEQ ID NO: 61973 - RNA, 19 nt, Homo sapiens
gagcuauggaccugagauc

SEQ ID NO: 61974 - RNA, 19 nt, Homo sapiens
ucauugguuucauguugau

SEQ ID NO: 61975 - RNA, 19 nt, Homo sapiens
uucauugguuucauguuga

SEQ ID NO: 61976 - RNA, 19 nt, Homo sapiens
uggccagaaugugaaugua

SEQ ID NO: 61977 - RNA, 19 nt, Homo sapiens
cggcgugggcguuugaaga

SEQ ID NO: 61978 - RNA, 19 nt, Homo sapiens
ggaaaugacuaaaucuuca

SEQ ID NO: 61979 - RNA, 19 nt, Homo sapiens
ccaaguggguccuguguuu

SEQ ID NO: 61980 - RNA, 19 nt, Homo sapiens
gacuaaaucuucauucuuc

SEQ ID NO: 61981 - RNA, 19 nt, Homo sapiens
ggaacacacugcucuguag

SEQ ID NO: 61982 - RNA, 19 nt, Homo sapiens
ggaagcugcugcucuugaa

SEQ ID NO: 61983 - RNA, 19 nt, Homo sapiens
gcacacagacagucccuuu

SEQ ID NO: 61984 - RNA, 19 nt, Homo sapiens
cgagcgaggugaagaaguu

SEQ ID NO: 61985 - RNA, 19 nt, Homo sapiens
guucugugcucauuuacuu

SEQ ID NO: 61986 - RNA, 19 nt, Homo sapiens
uggagggucugcaggcuua

SEQ ID NO: 61987 - RNA, 19 nt, Homo sapiens
gccaagcccugcuggagaa

SEQ ID NO: 61988 - RNA, 19 nt, Homo sapiens
cgaaggguauggugucaug

SEQ ID NO: 61989 - RNA, 19 nt, Homo sapiens
ggagaacuaugagaaugug

SEQ ID NO: 61990 - RNA, 19 nt, Homo sapiens
ucaucgagguggacgagua

SEQ ID NO: 61991 - RNA, 19 nt, Homo sapiens
gcagaaaugggcaaguuca

SEQ ID NO: 61992 - RNA, 19 nt, Homo sapiens
gaacacacugcucuguaga

SEQ ID NO: 61993 - RNA, 19 nt, Homo sapiens
gggaaaugacuaaaucuuc

SEQ ID NO: 61994 - RNA, 19 nt, Homo sapiens
cagcacagccggcucauca

SEQ ID NO: 61995 - RNA, 19 nt, Homo sapiens
acacugcucuguagaaugc

SEQ ID NO: 61996 - RNA, 19 nt, Homo sapiens
gagguucuguuccuuggau

SEQ ID NO: 61997 - RNA, 19 nt, Homo sapiens
gggaacacacugcucugua

SEQ ID NO: 61998 - RNA, 19 nt, Homo sapiens
gcguguaccucguuaaagg

SEQ ID NO: 61999 - RNA, 19 nt, Homo sapiens
ggacgaccaccuaugugaa

SEQ ID NO: 62000 - RNA, 19 nt, Homo sapiens
gcacgcaccccucuuaauu

SEQ ID NO: 62001 - RNA, 19 nt, Homo sapiens
ggaugcggcuucccuugca

SEQ ID NO: 62002 - RNA, 19 nt, Homo sapiens
ccacauccacgaaggguau

SEQ ID NO: 62003 - RNA, 19 nt, Homo sapiens
accacgagcugaccuuuga

SEQ ID NO: 62004 - RNA, 19 nt, Homo sapiens
gcaaguucagggucagauu

SEQ ID NO: 62005 - RNA, 19 nt, Homo sapiens
guagugagguucuguuccu

SEQ ID NO: 62006 - RNA, 19 nt, Homo sapiens
ggacaucucaggaauucag

SEQ ID NO: 62007 - RNA, 19 nt, Homo sapiens
gaauggguuuuggaaguua

SEQ ID NO: 62008 - RNA, 19 nt, Homo sapiens
gggguucugugcucauuua

SEQ ID NO: 62009 - RNA, 19 nt, Homo sapiens
gggacgaccaccuauguga

SEQ ID NO: 62010 - RNA, 19 nt, Homo sapiens
ccaacugcaucuaccuuca

SEQ ID NO: 62011 - RNA, 19 nt, Homo sapiens
guucauggccgaccucauc

SEQ ID NO: 62012 - RNA, 19 nt, Homo sapiens
gggaagcugcugcucuuga

SEQ ID NO: 62013 - RNA, 19 nt, Homo sapiens
gcacgcaccgacacacaug

SEQ ID NO: 62014 - RNA, 19 nt, Homo sapiens
gcacagccggcucaucauc

SEQ ID NO: 62015 - RNA, 19 nt, Homo sapiens
aggcagaaaugggcaaguu

SEQ ID NO: 62016 - RNA, 19 nt, Homo sapiens
ccucuuaauugaaccaagu

SEQ ID NO: 62017 - RNA, 19 nt, Homo sapiens
gugagagcguucccaguca

SEQ ID NO: 62018 - RNA, 19 nt, Homo sapiens
gcguagacauccugauaac

SEQ ID NO: 62019 - RNA, 19 nt, Homo sapiens
ccggagaacuaugagaaug

SEQ ID NO: 62020 - RNA, 19 nt, Homo sapiens
acacacugcucuguagaau

SEQ ID NO: 62021 - RNA, 19 nt, Homo sapiens
ggccuuggaacgacucuuu

SEQ ID NO: 62022 - RNA, 19 nt, Homo sapiens
cagaugggacgaccaccua

SEQ ID NO: 62023 - RNA, 19 nt, Homo sapiens
ugaagccggagaacuauga

SEQ ID NO: 62024 - RNA, 19 nt, Homo sapiens
uuagggacaucucaggaau

SEQ ID NO: 62025 - RNA, 19 nt, Homo sapiens
ggucagggccuuggaacga

SEQ ID NO: 62026 - RNA, 19 nt, Homo sapiens
ggcguagacauccugauaa

SEQ ID NO: 62027 - RNA, 19 nt, Homo sapiens
aggcguagacauccugaua

SEQ ID NO: 62028 - RNA, 19 nt, Homo sapiens
uucgugagcugcacacaga

SEQ ID NO: 62029 - RNA, 19 nt, Homo sapiens
uuugggaaaugacuaaauc

SEQ ID NO: 62030 - RNA, 19 nt, Homo sapiens
caaguucagggucagauuc

SEQ ID NO: 62031 - RNA, 19 nt, Homo sapiens
caccuuggacagcuucuuu

SEQ ID NO: 62032 - RNA, 19 nt, Homo sapiens
agaaugcgguagccuggau

SEQ ID NO: 62033 - RNA, 19 nt, Homo sapiens
gaacuaccagcccgugaac

SEQ ID NO: 62034 - RNA, 19 nt, Homo sapiens
gacgaccaccuaugugaau

SEQ ID NO: 62035 - RNA, 19 nt, Homo sapiens
gccuucaccuucuacaaca

SEQ ID NO: 62036 - RNA, 19 nt, Homo sapiens
agggacaucucaggaauuc

SEQ ID NO: 62037 - RNA, 19 nt, Homo sapiens
gcaggucagggccuuggaa

SEQ ID NO: 62038 - RNA, 19 nt, Homo sapiens
uggccgaccucaucaagca

SEQ ID NO: 62039 - RNA, 19 nt, Homo sapiens
gcaggacuuuuacuacuuc

SEQ ID NO: 62040 - RNA, 19 nt, Homo sapiens
guuaaaggaccuacuaagc

SEQ ID NO: 62041 - RNA, 19 nt, Homo sapiens
caaccacgagcugaccuuu

SEQ ID NO: 62042 - RNA, 19 nt, Homo sapiens
uugggaagcugcugcucuu

SEQ ID NO: 62043 - RNA, 19 nt, Homo sapiens
uuaaaggaccuacuaagcu

SEQ ID NO: 62044 - RNA, 19 nt, Homo sapiens
cguaugcacugugaacuac

SEQ ID NO: 62045 - RNA, 19 nt, Homo sapiens
ggacggaccccauccagau

SEQ ID NO: 62046 - RNA, 19 nt, Homo sapiens
aagcccugcuggagaaaug

SEQ ID NO: 62047 - RNA, 19 nt, Homo sapiens
ucacucggagccuggauga

SEQ ID NO: 62048 - RNA, 19 nt, Homo sapiens
acacaaaaucucccucuaa

SEQ ID NO: 62049 - RNA, 19 nt, Homo sapiens
uggacgcccuccugguuug

SEQ ID NO: 62050 - RNA, 19 nt, Homo sapiens
gccuuggaacgacucuuua

SEQ ID NO: 62051 - RNA, 19 nt, Homo sapiens
ugaacuaccagcccgugaa

SEQ ID NO: 62052 - RNA, 19 nt, Homo sapiens
gaccaacugcaucuaccuu

SEQ ID NO: 62053 - RNA, 19 nt, Homo sapiens
gcugaagccggagaacuau

SEQ ID NO: 62054 - RNA, 19 nt, Homo sapiens
gguccuguguuucucuuuu

SEQ ID NO: 62055 - RNA, 19 nt, Homo sapiens
ugagagcguucccagucau

SEQ ID NO: 62056 - RNA, 19 nt, Homo sapiens
caaaaucucccucuaacca

SEQ ID NO: 62057 - RNA, 19 nt, Homo sapiens
gaugggacgaccaccuaug

SEQ ID NO: 62058 - RNA, 19 nt, Homo sapiens
cauggcagcccugguucua

SEQ ID NO: 62059 - RNA, 19 nt, Homo sapiens
ucaucaagcaggacuuuua

SEQ ID NO: 62060 - RNA, 19 nt, Homo sapiens
gcaggcagucaggcagaaa

SEQ ID NO: 62061 - RNA, 19 nt, Homo sapiens
ggcaggcagucaggcagaa

SEQ ID NO: 62062 - RNA, 19 nt, Homo sapiens
ugaacaaugaccugagugu

SEQ ID NO: 62063 - RNA, 19 nt, Homo sapiens
acacagacagucccuuucu

SEQ ID NO: 62064 - RNA, 19 nt, Homo sapiens
gaagcugcugcucuugaau

SEQ ID NO: 62065 - RNA, 19 nt, Homo sapiens
ccacccaggccuucaccuu

SEQ ID NO: 62066 - RNA, 19 nt, Homo sapiens
cuugaacaaugaccugagu

SEQ ID NO: 62067 - RNA, 19 nt, Homo sapiens
gcaaccacgagcugaccuu

SEQ ID NO: 62068 - RNA, 19 nt, Homo sapiens
guacggcgacgugcugauc

SEQ ID NO: 62069 - RNA, 19 nt, Homo sapiens
uaacuuggaucaucuguaa

SEQ ID NO: 62070 - RNA, 19 nt, Homo sapiens
ggacaacgauaaccgauca

SEQ ID NO: 62071 - RNA, 19 nt, Homo sapiens
cagagcagcuggcacaauu

SEQ ID NO: 62072 - RNA, 19 nt, Homo sapiens
ucacguagcucacuggaau

SEQ ID NO: 62073 - RNA, 19 nt, Homo sapiens
gcugaugguuuggcaguua

SEQ ID NO: 62074 - RNA, 19 nt, Homo sapiens
gcuacaggcucuuucaguu

SEQ ID NO: 62075 - RNA, 19 nt, Homo sapiens
uuaguaagcuagcaaauag

SEQ ID NO: 62076 - RNA, 19 nt, Homo sapiens
cagcaugccuucaaaucaa

SEQ ID NO: 62077 - RNA, 19 nt, Homo sapiens
ugacucauccuccucuuua

SEQ ID NO: 62078 - RNA, 19 nt, Homo sapiens
caaauauucugccgagcuu

SEQ ID NO: 62079 - RNA, 19 nt, Homo sapiens
gggcauucuuuccauguaa

SEQ ID NO: 62080 - RNA, 19 nt, Homo sapiens
gaacagugagagcuucauu

SEQ ID NO: 62081 - RNA, 19 nt, Homo sapiens
caaaugagcaugguucaga

SEQ ID NO: 62082 - RNA, 19 nt, Homo sapiens
gaacacagcccugcuucug

SEQ ID NO: 62083 - RNA, 19 nt, Homo sapiens
ccucaaaggcugaugguuu

SEQ ID NO: 62084 - RNA, 19 nt, Homo sapiens
aaacaugacaccucucuga

SEQ ID NO: 62085 - RNA, 19 nt, Homo sapiens
ccagugaaaccaaacauga

SEQ ID NO: 62086 - RNA, 19 nt, Homo sapiens
caagacagcaugccuucaa

SEQ ID NO: 62087 - RNA, 19 nt, Homo sapiens
guaaggagagcaucagugu

SEQ ID NO: 62088 - RNA, 19 nt, Homo sapiens
acccaaagcugcagaaagu

SEQ ID NO: 62089 - RNA, 19 nt, Homo sapiens
cagcccugcuucugacaua

SEQ ID NO: 62090 - RNA, 19 nt, Homo sapiens
uacaguggauggagucaaa

SEQ ID NO: 62091 - RNA, 19 nt, Homo sapiens
gaguguaacuuggaucauc

SEQ ID NO: 62092 - RNA, 19 nt, Homo sapiens
acaccucucugaaaccuau

SEQ ID NO: 62093 - RNA, 19 nt, Homo sapiens
gcaaauaguaaucuguaag

SEQ ID NO: 62094 - RNA, 19 nt, Homo sapiens
uggauggagucaaauauuc

SEQ ID NO: 62095 - RNA, 19 nt, Homo sapiens
ucacuggaauucugcaaag

SEQ ID NO: 62096 - RNA, 19 nt, Homo sapiens
cuacaggcucuuucaguuu

SEQ ID NO: 62097 - RNA, 19 nt, Homo sapiens
aaaugagcaugguucagaa

SEQ ID NO: 62098 - RNA, 19 nt, Homo sapiens
ggcauucuuuccauguaaa

SEQ ID NO: 62099 - RNA, 19 nt, Homo sapiens
caacccagccacagccaaa

SEQ ID NO: 62100 - RNA, 19 nt, Homo sapiens
caugacaccucucugaaac

SEQ ID NO: 62101 - RNA, 19 nt, Homo sapiens
caacuaagugauuuguaug

SEQ ID NO: 62102 - RNA, 19 nt, Homo sapiens
guagcucacuggaauucug

SEQ ID NO: 62103 - RNA, 19 nt, Homo sapiens
ccacagagguagugaaaag

SEQ ID NO: 62104 - RNA, 19 nt, Homo sapiens
guggcagccuucucucauu

SEQ ID NO: 62105 - RNA, 19 nt, Homo sapiens
agugagagcuucauuuuga

SEQ ID NO: 62106 - RNA, 19 nt, Homo sapiens
gcagccuucuaucaaaugu

SEQ ID NO: 62107 - RNA, 19 nt, Homo sapiens
caagaacacagcccugcuu

SEQ ID NO: 62108 - RNA, 19 nt, Homo sapiens
uacaggcucuuucaguuuc

SEQ ID NO: 62109 - RNA, 19 nt, Homo sapiens
gcuagcaaauaguaaucug

SEQ ID NO: 62110 - RNA, 19 nt, Homo sapiens
gccuucaaaucaaucugua

SEQ ID NO: 62111 - RNA, 19 nt, Homo sapiens
gagaguguaacuuggauca

SEQ ID NO: 62112 - RNA, 19 nt, Homo sapiens
guggauggagucaaauauu

SEQ ID NO: 62113 - RNA, 19 nt, Homo sapiens
uaaaaccagugaaaccaaa

SEQ ID NO: 62114 - RNA, 19 nt, Homo sapiens
ccaauccccuguugauauu

SEQ ID NO: 62115 - RNA, 19 nt, Homo sapiens
aaggagagcaucaguguca

SEQ ID NO: 62116 - RNA, 19 nt, Homo sapiens
ccacagccaaagaaauuau

SEQ ID NO: 62117 - RNA, 19 nt, Homo sapiens
cuaagugauuuguaugucu

SEQ ID NO: 62118 - RNA, 19 nt, Homo sapiens
aagacagcaugccuucaaa

SEQ ID NO: 62119 - RNA, 19 nt, Homo sapiens
cuucugacauaauccaguu

SEQ ID NO: 62120 - RNA, 19 nt, Homo sapiens
ccgcagccuucuaucaaau

SEQ ID NO: 62121 - RNA, 19 nt, Homo sapiens
cuauuagugucuccuacaa

SEQ ID NO: 62122 - RNA, 19 nt, Homo sapiens
caauggaaauaaccaaucc

SEQ ID NO: 62123 - RNA, 19 nt, Homo sapiens
gagcaagcuguaucccauu

SEQ ID NO: 62124 - RNA, 19 nt, Homo sapiens
guaagcuagcaaauaguaa

SEQ ID NO: 62125 - RNA, 19 nt, Homo sapiens
aguaagcuagcaaauagua

SEQ ID NO: 62126 - RNA, 19 nt, Homo sapiens
cugaagggcagaacaguga

SEQ ID NO: 62127 - RNA, 19 nt, Homo sapiens
gccaaagaaauuaucaaug

SEQ ID NO: 62128 - RNA, 19 nt, Homo sapiens
aaaugguccugaacaaugg

SEQ ID NO: 62129 - RNA, 19 nt, Homo sapiens
gacagcaugccuucaaauc

SEQ ID NO: 62130 - RNA, 19 nt, Homo sapiens
gaagggcagaacagugaga

SEQ ID NO: 62131 - RNA, 19 nt, Homo sapiens
caauuccgcagccuucuau

SEQ ID NO: 62132 - RNA, 19 nt, Homo sapiens
gaugcccuccaagcaauua

SEQ ID NO: 62133 - RNA, 19 nt, Homo sapiens
ggaauucugcaaaguacuc

SEQ ID NO: 62134 - RNA, 19 nt, Homo sapiens
caaguuuaguuugaggaau

SEQ ID NO: 62135 - RNA, 19 nt, Homo sapiens
guaacuuggaucaucugua

SEQ ID NO: 62136 - RNA, 19 nt, Homo sapiens
agccacagccaaagaaauu

SEQ ID NO: 62137 - RNA, 19 nt, Homo sapiens
caaauaguaaucuguaagc

SEQ ID NO: 62138 - RNA, 19 nt, Homo sapiens
gaaacuuguccuuccucaa

SEQ ID NO: 62139 - RNA, 19 nt, Homo sapiens
agccuucuaucaaauguug

SEQ ID NO: 62140 - RNA, 19 nt, Homo sapiens
uuuaugagaguguaacuug

SEQ ID NO: 62141 - RNA, 19 nt, Homo sapiens
ggaccuacccuggcucucu

SEQ ID NO: 62142 - RNA, 19 nt, Homo sapiens
ucucugaaaccuauuagug

SEQ ID NO: 62143 - RNA, 19 nt, Homo sapiens
ccaauggaaauaaccaauc

SEQ ID NO: 62144 - RNA, 19 nt, Homo sapiens
uggcagccuucucucauuc

SEQ ID NO: 62145 - RNA, 19 nt, Homo sapiens
aaagaaaacucaguagaag

SEQ ID NO: 62146 - RNA, 19 nt, Homo sapiens
gcaucagugucagcucaga

SEQ ID NO: 62147 - RNA, 19 nt, Homo sapiens
gacucauccuccucuuuau

SEQ ID NO: 62148 - RNA, 19 nt, Homo sapiens
cuacucuccuuccuucauc

SEQ ID NO: 62149 - RNA, 19 nt, Homo sapiens
ggauggagucaaauauucu

SEQ ID NO: 62150 - RNA, 19 nt, Homo sapiens
caguggauggagucaaaua

SEQ ID NO: 62151 - RNA, 19 nt, Homo sapiens
ugacagcuacaggcucuuu

SEQ ID NO: 62152 - RNA, 19 nt, Homo sapiens
acaugacaccucucugaaa

SEQ ID NO: 62153 - RNA, 19 nt, Homo sapiens
ccaaagcugcagaaaguac

SEQ ID NO: 62154 - RNA, 19 nt, Homo sapiens
ggugguccuuucucugaca

SEQ ID NO: 62155 - RNA, 19 nt, Homo sapiens
gccacagccaaagaaauua

SEQ ID NO: 62156 - RNA, 19 nt, Homo sapiens
gagccccauucacaaauuu

SEQ ID NO: 62157 - RNA, 19 nt, Homo sapiens
caaacgagccccauucaca

SEQ ID NO: 62158 - RNA, 19 nt, Homo sapiens
caauggagcaagcuguauc

SEQ ID NO: 62159 - RNA, 19 nt, Homo sapiens
ccaaacaugacaccucucu

SEQ ID NO: 62160 - RNA, 19 nt, Homo sapiens
guucuuacugcuuaauuca

SEQ ID NO: 62161 - RNA, 19 nt, Homo sapiens
caaauguugaaggugauaa

SEQ ID NO: 62162 - RNA, 19 nt, Homo sapiens
acagcaugccuucaaauca

SEQ ID NO: 62163 - RNA, 19 nt, Homo sapiens
uaugagaguguaacuugga

SEQ ID NO: 62164 - RNA, 19 nt, Homo sapiens
acuggaauucugcaaagua

SEQ ID NO: 62165 - RNA, 19 nt, Homo sapiens
uccgcagccuucuaucaaa

SEQ ID NO: 62166 - RNA, 19 nt, Homo sapiens
uugaugcccuccaagcaau

SEQ ID NO: 62167 - RNA, 19 nt, Homo sapiens
cugcagaaaguacuugaug

SEQ ID NO: 62168 - RNA, 19 nt, Homo sapiens
gaaaacucaguagaagaua

SEQ ID NO: 62169 - RNA, 19 nt, Homo sapiens
gaaauaugcugcagaacuu

SEQ ID NO: 62170 - RNA, 19 nt, Homo sapiens
aaucaaagcuuccuucaaa

SEQ ID NO: 62171 - RNA, 19 nt, Homo sapiens
ggacaagguucagagcaua

SEQ ID NO: 62172 - RNA, 19 nt, Homo sapiens
gcgagcagguguugaaauu

SEQ ID NO: 62173 - RNA, 19 nt, Homo sapiens
gcaaauccauagcacaaga

SEQ ID NO: 62174 - RNA, 19 nt, Homo sapiens
cuucaucucuuacuugaua

SEQ ID NO: 62175 - RNA, 19 nt, Homo sapiens
aaagaaauaugcugcagaa

SEQ ID NO: 62176 - RNA, 19 nt, Homo sapiens
ggauggcacuuacagauug

SEQ ID NO: 62177 - RNA, 19 nt, Homo sapiens
cauagucuguauccaaaua

SEQ ID NO: 62178 - RNA, 19 nt, Homo sapiens
caagauaaauugagcuagu

SEQ ID NO: 62179 - RNA, 19 nt, Homo sapiens
gaagaacaggcaaaucaaa

SEQ ID NO: 62180 - RNA, 19 nt, Homo sapiens
caacaauggucaugcuuuc

SEQ ID NO: 62181 - RNA, 19 nt, Homo sapiens
cagaguauauuuccauuca

SEQ ID NO: 62182 - RNA, 19 nt, Homo sapiens
caaagcuuccuucaaauaa

SEQ ID NO: 62183 - RNA, 19 nt, Homo sapiens
gaguauauuuccauucaga

SEQ ID NO: 62184 - RNA, 19 nt, Homo sapiens
gaucuaccuuggugauuug

SEQ ID NO: 62185 - RNA, 19 nt, Homo sapiens
ucaaagcuuccuucaaaua

SEQ ID NO: 62186 - RNA, 19 nt, Homo sapiens
gaaauuccguaaacuuaac

SEQ ID NO: 62187 - RNA, 19 nt, Homo sapiens
ggacuggccguucuaggua

SEQ ID NO: 62188 - RNA, 19 nt, Homo sapiens
ucagaaaguuguugaugug

SEQ ID NO: 62189 - RNA, 19 nt, Homo sapiens
gcugguuggugcuuuguuu

SEQ ID NO: 62190 - RNA, 19 nt, Homo sapiens
gggcaagagugcugacuuc

SEQ ID NO: 62191 - RNA, 19 nt, Homo sapiens
guagaaugguugagugcaa

SEQ ID NO: 62192 - RNA, 19 nt, Homo sapiens
cuagacccuucaucucuua

SEQ ID NO: 62193 - RNA, 19 nt, Homo sapiens
gaaaguagaaugguugagu

SEQ ID NO: 62194 - RNA, 19 nt, Homo sapiens
gaccaauugucaugcuuga

SEQ ID NO: 62195 - RNA, 19 nt, Homo sapiens
gaccugagcacuggcauaa

SEQ ID NO: 62196 - RNA, 19 nt, Homo sapiens
gcagcgagcagguguugaa

SEQ ID NO: 62197 - RNA, 19 nt, Homo sapiens
gcacuuacagauugauuca

SEQ ID NO: 62198 - RNA, 19 nt, Homo sapiens
guucaugauuucaagaugu

SEQ ID NO: 62199 - RNA, 19 nt, Homo sapiens
acucacaauuguugacuaa

SEQ ID NO: 62200 - RNA, 19 nt, Homo sapiens
acagauugauucaguuuca

SEQ ID NO: 62201 - RNA, 19 nt, Homo sapiens
ugacuucacuaacuucgau

SEQ ID NO: 62202 - RNA, 19 nt, Homo sapiens
uaaugaaucuucggguguu

SEQ ID NO: 62203 - RNA, 19 nt, Homo sapiens
gugcugacuucacuaacuu

SEQ ID NO: 62204 - RNA, 19 nt, Homo sapiens
ugugaagacuagaccaauu

SEQ ID NO: 62205 - RNA, 19 nt, Homo sapiens
cuucggguguuucccuuua

SEQ ID NO: 62206 - RNA, 19 nt, Homo sapiens
gcacuggcauaaggacuuc

SEQ ID NO: 62207 - RNA, 19 nt, Homo sapiens
cagagcauacuguggauaa

SEQ ID NO: 62208 - RNA, 19 nt, Homo sapiens
gauggcacuuacagauuga

SEQ ID NO: 62209 - RNA, 19 nt, Homo sapiens
cccauagucuguauccaaa

SEQ ID NO: 62210 - RNA, 19 nt, Homo sapiens
gagcagguguugaaauucc

SEQ ID NO: 62211 - RNA, 19 nt, Homo sapiens
gcgcgaccaugucccauca

SEQ ID NO: 62212 - RNA, 19 nt, Homo sapiens
cauaaggacuuccccauug

SEQ ID NO: 62213 - RNA, 19 nt, Homo sapiens
agaucuaccuuggugauuu

SEQ ID NO: 62214 - RNA, 19 nt, Homo sapiens
cauagcacaagauaaauug

SEQ ID NO: 62215 - RNA, 19 nt, Homo sapiens
ccauagcacaagauaaauu

SEQ ID NO: 62216 - RNA, 19 nt, Homo sapiens
uagaaugguugagugcaaa

SEQ ID NO: 62217 - RNA, 19 nt, Homo sapiens
aagcuuccuucaaauaaga

SEQ ID NO: 62218 - RNA, 19 nt, Homo sapiens
gaaugugugaccuggauug

SEQ ID NO: 62219 - RNA, 19 nt, Homo sapiens
gugaagacuagaccaauug

SEQ ID NO: 62220 - RNA, 19 nt, Homo sapiens
cugcagaacuucacuuggu

SEQ ID NO: 62221 - RNA, 19 nt, Homo sapiens
cacagaauauaggauaaga

SEQ ID NO: 62222 - RNA, 19 nt, Homo sapiens
ugauucaguuucacuuuca

SEQ ID NO: 62223 - RNA, 19 nt, Homo sapiens
ugaugacucucaggacaaa

SEQ ID NO: 62224 - RNA, 19 nt, Homo sapiens
ggaccugagcacuggcaua

SEQ ID NO: 62225 - RNA, 19 nt, Homo sapiens
guugacaucgacacucaua

SEQ ID NO: 62226 - RNA, 19 nt, Homo sapiens
gguguuucccuuuagcuaa

SEQ ID NO: 62227 - RNA, 19 nt, Homo sapiens
cugaagaacaggcaaauca

SEQ ID NO: 62228 - RNA, 19 nt, Homo sapiens
uccguaaacuuaacuucaa

SEQ ID NO: 62229 - RNA, 19 nt, Homo sapiens
gaagguuggcagcgcuaaa

SEQ ID NO: 62230 - RNA, 19 nt, Homo sapiens
caaaucagguaaaauaguc

SEQ ID NO: 62231 - RNA, 19 nt, Homo sapiens
gacccugguugcuuugugu

SEQ ID NO: 62232 - RNA, 19 nt, Homo sapiens
ggacccugguugcuuugug

SEQ ID NO: 62233 - RNA, 19 nt, Homo sapiens
ucaacaauggucaugcuuu

SEQ ID NO: 62234 - RNA, 19 nt, Homo sapiens
caaaucaaagcuuccuuca

SEQ ID NO: 62235 - RNA, 19 nt, Homo sapiens
ugaccuggauugugcucaa

SEQ ID NO: 62236 - RNA, 19 nt, Homo sapiens
ucacuggaacaccaaauau

SEQ ID NO: 62237 - RNA, 19 nt, Homo sapiens
ucucuuacuugauagacuu

SEQ ID NO: 62238 - RNA, 19 nt, Homo sapiens
acacucauacagccaagua

SEQ ID NO: 62239 - RNA, 19 nt, Homo sapiens
auaggaaaguagaaugguu

SEQ ID NO: 62240 - RNA, 19 nt, Homo sapiens
agaauaaaguaccuugacu

SEQ ID NO: 62241 - RNA, 19 nt, Homo sapiens
gaacaggcaaaucaaagcu

SEQ ID NO: 62242 - RNA, 19 nt, Homo sapiens
ccugagcacuggcauaagg

SEQ ID NO: 62243 - RNA, 19 nt, Homo sapiens
ccauucagacaauauauca

SEQ ID NO: 62244 - RNA, 19 nt, Homo sapiens
guugaaauuccguaaacuu

SEQ ID NO: 62245 - RNA, 19 nt, Homo sapiens
gguuggugcuuuguuuaug

SEQ ID NO: 62246 - RNA, 19 nt, Homo sapiens
ugacaucgacacucauaca

SEQ ID NO: 62247 - RNA, 19 nt, Homo sapiens
gacccuucaucucuuacuu

SEQ ID NO: 62248 - RNA, 19 nt, Homo sapiens
ucuagacccuucaucucuu

SEQ ID NO: 62249 - RNA, 19 nt, Homo sapiens
guugcuuugugucuaguuu

SEQ ID NO: 62250 - RNA, 19 nt, Homo sapiens
ugaagaacaggcaaaucaa

SEQ ID NO: 62251 - RNA, 19 nt, Homo sapiens
uuuggacccugguugcuuu

SEQ ID NO: 62252 - RNA, 19 nt, Homo sapiens
aaagcuuccuucaaauaag

SEQ ID NO: 62253 - RNA, 19 nt, Homo sapiens
gucaugauucuauguaaug

SEQ ID NO: 62254 - RNA, 19 nt, Homo sapiens
cacaagauaaauugagcua

SEQ ID NO: 62255 - RNA, 19 nt, Homo sapiens
auccauagcacaagauaaa

SEQ ID NO: 62256 - RNA, 19 nt, Homo sapiens
gucuguauccaaauaauga

SEQ ID NO: 62257 - RNA, 19 nt, Homo sapiens
ccacugaagaacaggcaaa

SEQ ID NO: 62258 - RNA, 19 nt, Homo sapiens
gaacugaugguggacaacu

SEQ ID NO: 62259 - RNA, 19 nt, Homo sapiens
guguugaaauuccguaaac

SEQ ID NO: 62260 - RNA, 19 nt, Homo sapiens
uggaaugugugaccuggau

SEQ ID NO: 62261 - RNA, 19 nt, Homo sapiens
agaaauaugcugcagaacu

SEQ ID NO: 62262 - RNA, 19 nt, Homo sapiens
aggcaaaucagguaaaaua

SEQ ID NO: 62263 - RNA, 19 nt, Homo sapiens
aagacuagaccaauuguca

SEQ ID NO: 62264 - RNA, 19 nt, Homo sapiens
uaaggcaaaucagguaaaa

SEQ ID NO: 62265 - RNA, 19 nt, Homo sapiens
gacuagaccaauugucaug

SEQ ID NO: 62266 - RNA, 19 nt, Homo sapiens
gacuggccguucuagguau

SEQ ID NO: 62267 - RNA, 19 nt, Homo sapiens
guuaaggcaaaucagguaa

SEQ ID NO: 62268 - RNA, 19 nt, Homo sapiens
uucagaaaguuguugaugu

SEQ ID NO: 62269 - RNA, 19 nt, Homo sapiens
gaaauaaacucgcacaagu

SEQ ID NO: 62270 - RNA, 19 nt, Homo sapiens
aaacagagauggaagagua

SEQ ID NO: 62271 - RNA, 19 nt, Homo sapiens
ggugagagcuuccuucaaa

SEQ ID NO: 62272 - RNA, 19 nt, Homo sapiens
gcaaagggagucaaacuua

SEQ ID NO: 62273 - RNA, 19 nt, Homo sapiens
gaaggagggccauuuauuu

SEQ ID NO: 62274 - RNA, 19 nt, Homo sapiens
gcaagaagucagucauuua

SEQ ID NO: 62275 - RNA, 19 nt, Homo sapiens
gaaaggaaaccuaccauug

SEQ ID NO: 62276 - RNA, 19 nt, Homo sapiens
gggaagaccugccgaguug

SEQ ID NO: 62277 - RNA, 19 nt, Homo sapiens
ccaagaccauccugaauaa

SEQ ID NO: 62278 - RNA, 19 nt, Homo sapiens
gcauagauuucacauuuga

SEQ ID NO: 62279 - RNA, 19 nt, Homo sapiens
cuacuaagauuacuugguu

SEQ ID NO: 62280 - RNA, 19 nt, Homo sapiens
gaagauaggacaugagaau

SEQ ID NO: 62281 - RNA, 19 nt, Homo sapiens
gcacaaguguccagagauc

SEQ ID NO: 62282 - RNA, 19 nt, Homo sapiens
cacccucgcugaccuaaua

SEQ ID NO: 62283 - RNA, 19 nt, Homo sapiens
agaagucagucauuuauug

SEQ ID NO: 62284 - RNA, 19 nt, Homo sapiens
gcaaacaaacgaguucuuu

SEQ ID NO: 62285 - RNA, 19 nt, Homo sapiens
gcaagaauugagcuaauaa

SEQ ID NO: 62286 - RNA, 19 nt, Homo sapiens
ccguugagcugcauacuaa

SEQ ID NO: 62287 - RNA, 19 nt, Homo sapiens
ucgacaagaucuaauauga

SEQ ID NO: 62288 - RNA, 19 nt, Homo sapiens
gguaaaguuucaaagaaga

SEQ ID NO: 62289 - RNA, 19 nt, Homo sapiens
gccaagaccauccugaaua

SEQ ID NO: 62290 - RNA, 19 nt, Homo sapiens
cagaaccaauaaagacaua

SEQ ID NO: 62291 - RNA, 19 nt, Homo sapiens
cgaguuguauuugaugaua

SEQ ID NO: 62292 - RNA, 19 nt, Homo sapiens
cuaaagacaucaggcauga

SEQ ID NO: 62293 - RNA, 19 nt, Homo sapiens
gaaugaaugaucacuagaa

SEQ ID NO: 62294 - RNA, 19 nt, Homo sapiens
gaagucagucauuuauuga

SEQ ID NO: 62295 - RNA, 19 nt, Homo sapiens
caagaagucagucauuuau

SEQ ID NO: 62296 - RNA, 19 nt, Homo sapiens
gauggaagaguaaagauau

SEQ ID NO: 62297 - RNA, 19 nt, Homo sapiens
caaagggagucaaacuuag

SEQ ID NO: 62298 - RNA, 19 nt, Homo sapiens
gaagaccugccgaguugua

SEQ ID NO: 62299 - RNA, 19 nt, Homo sapiens
uggacaagauuaagacaaa

SEQ ID NO: 62300 - RNA, 19 nt, Homo sapiens
cagcggagcuucauuuggu

SEQ ID NO: 62301 - RNA, 19 nt, Homo sapiens
uaguagagguguaugaaga

SEQ ID NO: 62302 - RNA, 19 nt, Homo sapiens
cauggucugugucuuauga

SEQ ID NO: 62303 - RNA, 19 nt, Homo sapiens
ggaaaggaaaccuaccauu

SEQ ID NO: 62304 - RNA, 19 nt, Homo sapiens
ucacacaacuucauguuuu

SEQ ID NO: 62305 - RNA, 19 nt, Homo sapiens
guuggaauuuauccuagua

SEQ ID NO: 62306 - RNA, 19 nt, Homo sapiens
acaauacaaucaggaguuu

SEQ ID NO: 62307 - RNA, 19 nt, Homo sapiens
ugaaggagggccauuuauu

SEQ ID NO: 62308 - RNA, 19 nt, Homo sapiens
cagcaagaauugagcuaau

SEQ ID NO: 62309 - RNA, 19 nt, Homo sapiens
cuccacagccuaucaauaa

SEQ ID NO: 62310 - RNA, 19 nt, Homo sapiens
gaauggcgaguuccagauu

SEQ ID NO: 62311 - RNA, 19 nt, Homo sapiens
cuucauaaauguaguugga

SEQ ID NO: 62312 - RNA, 19 nt, Homo sapiens
gcaaugaaugugagagaug

SEQ ID NO: 62313 - RNA, 19 nt, Homo sapiens
cuccaagucuauuucauuu

SEQ ID NO: 62314 - RNA, 19 nt, Homo sapiens
gagagcuuccuucaaauga

SEQ ID NO: 62315 - RNA, 19 nt, Homo sapiens
ucaccaagaucuaaguuac

SEQ ID NO: 62316 - RNA, 19 nt, Homo sapiens
guaguuggaauuuauccua

SEQ ID NO: 62317 - RNA, 19 nt, Homo sapiens
cuaccgacuucgccaguuu

SEQ ID NO: 62318 - RNA, 19 nt, Homo sapiens
cgacaagaucuaauaugaa

SEQ ID NO: 62319 - RNA, 19 nt, Homo sapiens
caaugaaugugagagaugu

SEQ ID NO: 62320 - RNA, 19 nt, Homo sapiens
gagaagaagaggagaugga

SEQ ID NO: 62321 - RNA, 19 nt, Homo sapiens
ccaauaaagacauaaaugg

SEQ ID NO: 62322 - RNA, 19 nt, Homo sapiens
uaugaguuguccaucuuaa

SEQ ID NO: 62323 - RNA, 19 nt, Homo sapiens
uggaaugaaugaucacuag

SEQ ID NO: 62324 - RNA, 19 nt, Homo sapiens
agcaagaauugagcuaaua

SEQ ID NO: 62325 - RNA, 19 nt, Homo sapiens
gagcaaugaaugugagaga

SEQ ID NO: 62326 - RNA, 19 nt, Homo sapiens
ggacaagauuaagacaaag

SEQ ID NO: 62327 - RNA, 19 nt, Homo sapiens
acuggaacccgaaguauaa

SEQ ID NO: 62328 - RNA, 19 nt, Homo sapiens
gaccugccgaguuguauuu

SEQ ID NO: 62329 - RNA, 19 nt, Homo sapiens
uaaaauggcuagcuauugg

SEQ ID NO: 62330 - RNA, 19 nt, Homo sapiens
gcucuuacuccaagucuau

SEQ ID NO: 62331 - RNA, 19 nt, Homo sapiens
aaggaaaccuaccauugga

SEQ ID NO: 62332 - RNA, 19 nt, Homo sapiens
aaaugaggcugcuggaucu

SEQ ID NO: 62333 - RNA, 19 nt, Homo sapiens
ccugaaggagggccauuua

SEQ ID NO: 62334 - RNA, 19 nt, Homo sapiens
ucacauuugaucucuguaa

SEQ ID NO: 62335 - RNA, 19 nt, Homo sapiens
ggaccuaccagggcucauu

SEQ ID NO: 62336 - RNA, 19 nt, Homo sapiens
ucaaagaagaagaaacaga

SEQ ID NO: 62337 - RNA, 19 nt, Homo sapiens
gcauuggacaagauuaaga

SEQ ID NO: 62338 - RNA, 19 nt, Homo sapiens
guacugaucaccagaacca

SEQ ID NO: 62339 - RNA, 19 nt, Homo sapiens
acaaaagagugaaugauga

SEQ ID NO: 62340 - RNA, 19 nt, Homo sapiens
agcaagaagucagucauuu

SEQ ID NO: 62341 - RNA, 19 nt, Homo sapiens
aaaggaaaccuaccauugg

SEQ ID NO: 62342 - RNA, 19 nt, Homo sapiens
ggcaugaacuuuucccaaa

SEQ ID NO: 62343 - RNA, 19 nt, Homo sapiens
cuaauaaggccaugcaagu

SEQ ID NO: 62344 - RNA, 19 nt, Homo sapiens
gagagaagaagaggagaug

SEQ ID NO: 62345 - RNA, 19 nt, Homo sapiens
ugaagucaaagcaguugua

SEQ ID NO: 62346 - RNA, 19 nt, Homo sapiens
aaugaucacuagaacacaa

SEQ ID NO: 62347 - RNA, 19 nt, Homo sapiens
cuauagacagcaagaauug

SEQ ID NO: 62348 - RNA, 19 nt, Homo sapiens
ucgcacaaguguccagaga

SEQ ID NO: 62349 - RNA, 19 nt, Homo sapiens
caaacaaacgaguucuuuc

SEQ ID NO: 62350 - RNA, 19 nt, Homo sapiens
gaugggaucgcugugauug

SEQ ID NO: 62351 - RNA, 19 nt, Homo sapiens
cgacuucgccaguuucauc

SEQ ID NO: 62352 - RNA, 19 nt, Homo sapiens
gaugauacuuaugauaggu

SEQ ID NO: 62353 - RNA, 19 nt, Homo sapiens
cagcaagaagucagucauu

SEQ ID NO: 62354 - RNA, 19 nt, Homo sapiens
gccauggucugugucuuau

SEQ ID NO: 62355 - RNA, 19 nt, Homo sapiens
ggaaugaaugaucacuaga

SEQ ID NO: 62356 - RNA, 19 nt, Homo sapiens
gcaggcaaacaaacgaguu

SEQ ID NO: 62357 - RNA, 19 nt, Homo sapiens
cgaaauaaacucgcacaag

SEQ ID NO: 62358 - RNA, 19 nt, Homo sapiens
ucaccagaaccaauaaaga

SEQ ID NO: 62359 - RNA, 19 nt, Homo sapiens
gaucaccagaaccaauaaa

SEQ ID NO: 62360 - RNA, 19 nt, Homo sapiens
acuggaggcuggaaugaau

SEQ ID NO: 62361 - RNA, 19 nt, Homo sapiens
gacuauagacagcaagaau

SEQ ID NO: 62362 - RNA, 19 nt, Homo sapiens
agauggaagaguaaagaua

SEQ ID NO: 62363 - RNA, 19 nt, Homo sapiens
cacaauacaaucaggaguu

SEQ ID NO: 62364 - RNA, 19 nt, Homo sapiens
guagagguguaugaagauc

SEQ ID NO: 62365 - RNA, 19 nt, Homo sapiens
gugagagcuuccuucaaau

SEQ ID NO: 62366 - RNA, 19 nt, Homo sapiens
uuaaagaagcccugaagca

SEQ ID NO: 62367 - RNA, 19 nt, Homo sapiens
gccgaguuguauuugauga

SEQ ID NO: 62368 - RNA, 19 nt, Homo sapiens
caucaggcaugacccuucu

SEQ ID NO: 62369 - RNA, 19 nt, Homo sapiens
gaacagacagugagcauga

SEQ ID NO: 62370 - RNA, 19 nt, Homo sapiens
gagaacagauccuggcauu

SEQ ID NO: 62371 - RNA, 19 nt, Homo sapiens
gcacauaguacaugagaaa

SEQ ID NO: 62372 - RNA, 19 nt, Homo sapiens
gcacgcagccucucuguug

SEQ ID NO: 62373 - RNA, 19 nt, Homo sapiens
gaacaaggccagcauuucu

SEQ ID NO: 62374 - RNA, 19 nt, Homo sapiens
gguccgacuugccauauaa

SEQ ID NO: 62375 - RNA, 19 nt, Homo sapiens
gaacagauccuggcauucu

SEQ ID NO: 62376 - RNA, 19 nt, Homo sapiens
ccauucagcuucacagaga

SEQ ID NO: 62377 - RNA, 19 nt, Homo sapiens
gagaacaaggccagcauuu

SEQ ID NO: 62378 - RNA, 19 nt, Homo sapiens
uggaggcacugucuaauau

SEQ ID NO: 62379 - RNA, 19 nt, Homo sapiens
ggacuuuaggcaugauuaa

SEQ ID NO: 62380 - RNA, 19 nt, Homo sapiens
guggaggcacugucuaaua

SEQ ID NO: 62381 - RNA, 19 nt, Homo sapiens
ccauggagaugcacauagu

SEQ ID NO: 62382 - RNA, 19 nt, Homo sapiens
ugccucagcucuccaaguu

SEQ ID NO: 62383 - RNA, 19 nt, Homo sapiens
gggcagcgcacggugauaa

SEQ ID NO: 62384 - RNA, 19 nt, Homo sapiens
gaaacugaggcacuacuuc

SEQ ID NO: 62385 - RNA, 19 nt, Homo sapiens
cucagaagcuguacuacga

SEQ ID NO: 62386 - RNA, 19 nt, Homo sapiens
ggagaacaaggccagcauu

SEQ ID NO: 62387 - RNA, 19 nt, Homo sapiens
gacaaggaacagacaguga

SEQ ID NO: 62388 - RNA, 19 nt, Homo sapiens
cauaguacaugagaaagag

SEQ ID NO: 62389 - RNA, 19 nt, Homo sapiens
ggugggacuuuaggcauga

SEQ ID NO: 62390 - RNA, 19 nt, Homo sapiens
caucgaggaaugugaaaga

SEQ ID NO: 62391 - RNA, 19 nt, Homo sapiens
aggagaaacugaggcacua

SEQ ID NO: 62392 - RNA, 19 nt, Homo sapiens
acaccgaccugcgaugaga

SEQ ID NO: 62393 - RNA, 19 nt, Homo sapiens
ggagaugcacauaguacau

SEQ ID NO: 62394 - RNA, 19 nt, Homo sapiens
gagaugcacauaguacaug

SEQ ID NO: 62395 - RNA, 19 nt, Homo sapiens
gcacuuugccauggagaug

SEQ ID NO: 62396 - RNA, 19 nt, Homo sapiens
gaagcuguacuacgacaag

SEQ ID NO: 62397 - RNA, 19 nt, Homo sapiens
ggacccugaagacgaaauu

SEQ ID NO: 62398 - RNA, 19 nt, Homo sapiens
gggagcacuuugccaugga

SEQ ID NO: 62399 - RNA, 19 nt, Homo sapiens
gggacuuuaggcaugauua

SEQ ID NO: 62400 - RNA, 19 nt, Homo sapiens
gggagcccauucagcuuca

SEQ ID NO: 62401 - RNA, 19 nt, Homo sapiens
ccacaccgaccugcgauga

SEQ ID NO: 62402 - RNA, 19 nt, Homo sapiens
agaugcacauaguacauga

SEQ ID NO: 62403 - RNA, 19 nt, Homo sapiens
cuucuucucuggcuacgau

SEQ ID NO: 62404 - RNA, 19 nt, Homo sapiens
gcuguacuacgacaaggaa

SEQ ID NO: 62405 - RNA, 19 nt, Homo sapiens
cauaccaggccaaacaguu

SEQ ID NO: 62406 - RNA, 19 nt, Homo sapiens
ucucucagaagcuguacua

SEQ ID NO: 62407 - RNA, 19 nt, Homo sapiens
gaggcacugucuaauaucc

SEQ ID NO: 62408 - RNA, 19 nt, Homo sapiens
ugaugauguugcuggagaa

SEQ ID NO: 62409 - RNA, 19 nt, Homo sapiens
caaggcaaagguggacaaa

SEQ ID NO: 62410 - RNA, 19 nt, Homo sapiens
cagugagcaugaaggacaa

SEQ ID NO: 62411 - RNA, 19 nt, Homo sapiens
agacagugagcaugaagga

SEQ ID NO: 62412 - RNA, 19 nt, Homo sapiens
aaacugggacgcuucuucu

SEQ ID NO: 62413 - RNA, 19 nt, Homo sapiens
cauggagaugcacauagua

SEQ ID NO: 62414 - RNA, 19 nt, Homo sapiens
aagccgaguccuccaacua

SEQ ID NO: 62415 - RNA, 19 nt, Homo sapiens
ucaacaucgucaccaccaa

SEQ ID NO: 62416 - RNA, 19 nt, Homo sapiens
acacuggugcuacgagguu

SEQ ID NO: 62417 - RNA, 19 nt, Homo sapiens
aaggucgucuggacugugu

SEQ ID NO: 62418 - RNA, 19 nt, Homo sapiens
aaaccugagaugagcacua

SEQ ID NO: 62419 - RNA, 19 nt, Homo sapiens
acauaguacaugagaaaga

SEQ ID NO: 62420 - RNA, 19 nt, Homo sapiens
ugguccgacuugccauaua

SEQ ID NO: 62421 - RNA, 19 nt, Homo sapiens
auaccaggccaaacaguug

SEQ ID NO: 62422 - RNA, 19 nt, Homo sapiens
guacaugacuucugaaauu

SEQ ID NO: 62423 - RNA, 19 nt, Homo sapiens
gaacaacuaucgcccacuu

SEQ ID NO: 62424 - RNA, 19 nt, Homo sapiens
gaacaucacccucuucaga

SEQ ID NO: 62425 - RNA, 19 nt, Homo sapiens
uagcagaacugacuuugaa

SEQ ID NO: 62426 - RNA, 19 nt, Homo sapiens
gacauuagguccacaugaa

SEQ ID NO: 62427 - RNA, 19 nt, Homo sapiens
gauuguacaugacuucuga

SEQ ID NO: 62428 - RNA, 19 nt, Homo sapiens
caagccagcucucugcauu

SEQ ID NO: 62429 - RNA, 19 nt, Homo sapiens
gagaaugguuuggcuguga

SEQ ID NO: 62430 - RNA, 19 nt, Homo sapiens
ggaauucugugaaauacca

SEQ ID NO: 62431 - RNA, 19 nt, Homo sapiens
gcauuuaguucacuggaau

SEQ ID NO: 62432 - RNA, 19 nt, Homo sapiens
gaaaaccacuacagacuga

SEQ ID NO: 62433 - RNA, 19 nt, Homo sapiens
gaaggagcccguugaagug

SEQ ID NO: 62434 - RNA, 19 nt, Homo sapiens
ggagggacagcgucuauga

SEQ ID NO: 62435 - RNA, 19 nt, Homo sapiens
ggacaucuugccggaaaua

SEQ ID NO: 62436 - RNA, 19 nt, Homo sapiens
gaacacuggcuaccucuuc

SEQ ID NO: 62437 - RNA, 19 nt, Homo sapiens
gaaggaaggaagcguuguu

SEQ ID NO: 62438 - RNA, 19 nt, Homo sapiens
guggacaucuugccggaaa

SEQ ID NO: 62439 - RNA, 19 nt, Homo sapiens
gaauagcagaacugacuuu

SEQ ID NO: 62440 - RNA, 19 nt, Homo sapiens
gcacaagguccuagagaca

SEQ ID NO: 62441 - RNA, 19 nt, Homo sapiens
agaagaugauggugaacaa

SEQ ID NO: 62442 - RNA, 19 nt, Homo sapiens
gggaacagacccaagaugu

SEQ ID NO: 62443 - RNA, 19 nt, Homo sapiens
gggaggaacacuuggaaga

SEQ ID NO: 62444 - RNA, 19 nt, Homo sapiens
acccggcagucuccuauua

SEQ ID NO: 62445 - RNA, 19 nt, Homo sapiens
gcauggcaaaccagcaaua

SEQ ID NO: 62446 - RNA, 19 nt, Homo sapiens
cauuagguccacaugaaua

SEQ ID NO: 62447 - RNA, 19 nt, Homo sapiens
acaagguccuagagacauu

SEQ ID NO: 62448 - RNA, 19 nt, Homo sapiens
aggagaagaugauggugaa

SEQ ID NO: 62449 - RNA, 19 nt, Homo sapiens
agaaggagcccguugaagu

SEQ ID NO: 62450 - RNA, 19 nt, Homo sapiens
gaagcguuguuucccaagu

SEQ ID NO: 62451 - RNA, 19 nt, Homo sapiens
ccacaugaauagcagaacu

SEQ ID NO: 62452 - RNA, 19 nt, Homo sapiens
agaugauggugaacaacua

SEQ ID NO: 62453 - RNA, 19 nt, Homo sapiens
acuacagacugaagcaauu

SEQ ID NO: 62454 - RNA, 19 nt, Homo sapiens
gcagucuccuauuaacauc

SEQ ID NO: 62455 - RNA, 19 nt, Homo sapiens
agaacugacuuugaaggaa

SEQ ID NO: 62456 - RNA, 19 nt, Homo sapiens
aaaccagcaauaacacuuu

SEQ ID NO: 62457 - RNA, 19 nt, Homo sapiens
caaaccagcaauaacacuu

SEQ ID NO: 62458 - RNA, 19 nt, Homo sapiens
gggaacaucacccucuuca

SEQ ID NO: 62459 - RNA, 19 nt, Homo sapiens
gaugauggugaacaacuau

SEQ ID NO: 62460 - RNA, 19 nt, Homo sapiens
gugaagaggagaagaugau

SEQ ID NO: 62461 - RNA, 19 nt, Homo sapiens
gaaugguuuggcugugaua

SEQ ID NO: 62462 - RNA, 19 nt, Homo sapiens
uuaguucacuggaauucug

SEQ ID NO: 62463 - RNA, 19 nt, Homo sapiens
uggaagaccucagcuuucu

SEQ ID NO: 62464 - RNA, 19 nt, Homo sapiens
uggcaaaccagcaauaaca

SEQ ID NO: 62465 - RNA, 19 nt, Homo sapiens
caagguccuagagacauua

SEQ ID NO: 62466 - RNA, 19 nt, Homo sapiens
gagaagaugauggugaaca

SEQ ID NO: 62467 - RNA, 19 nt, Homo sapiens
ccagaaggagcccguugaa

SEQ ID NO: 62468 - RNA, 19 nt, Homo sapiens
acuggaauucugugaaaua

SEQ ID NO: 62469 - RNA, 19 nt, Homo sapiens
accgaggcaucaggaauua

SEQ ID NO: 62470 - RNA, 19 nt, Homo sapiens
caccgaggcaucaggaauu

SEQ ID NO: 62471 - RNA, 19 nt, Homo sapiens
gcacccggcagucuccuau

SEQ ID NO: 62472 - RNA, 19 nt, Homo sapiens
aagcguuguuucccaaguu

SEQ ID NO: 62473 - RNA, 19 nt, Homo sapiens
cauccugccuguacaucug

SEQ ID NO: 62474 - RNA, 19 nt, Homo sapiens
ccucagcuuucuccuucuu

SEQ ID NO: 62475 - RNA, 19 nt, Homo sapiens
gggcacaagguccuagaga

SEQ ID NO: 62476 - RNA, 19 nt, Homo sapiens
cuacagacugaagcaauuu

SEQ ID NO: 62477 - RNA, 19 nt, Homo sapiens
cauggcaaaccagcaauaa

SEQ ID NO: 62478 - RNA, 19 nt, Homo sapiens
cacucagggucuccuauga

SEQ ID NO: 62479 - RNA, 19 nt, Homo sapiens
ccagggcgaugguguucuc

SEQ ID NO: 62480 - RNA, 19 nt, Homo sapiens
aaccagcaauaacacuuug

SEQ ID NO: 62481 - RNA, 19 nt, Homo sapiens
ggcagucuccuauuaacau

SEQ ID NO: 62482 - RNA, 19 nt, Homo sapiens
cagaacugacuuugaagga

SEQ ID NO: 62483 - RNA, 19 nt, Homo sapiens
caacuaucgcccacuucaa

SEQ ID NO: 62484 - RNA, 19 nt, Homo sapiens
gaagcugucgugggagaga

SEQ ID NO: 62485 - RNA, 19 nt, Homo sapiens
cuuggaagaccucagcuuu

SEQ ID NO: 62486 - RNA, 19 nt, Homo sapiens
ccacucagggucuccuaug

SEQ ID NO: 62487 - RNA, 19 nt, Homo sapiens
ggugaagaggagaagauga

SEQ ID NO: 62488 - RNA, 19 nt, Homo sapiens
gcaaaccagcaauaacacu

SEQ ID NO: 62489 - RNA, 19 nt, Homo sapiens
agacauuagguccacauga

SEQ ID NO: 62490 - RNA, 19 nt, Homo sapiens
gugcauggcaaaccagcaa

SEQ ID NO: 62491 - RNA, 19 nt, Homo sapiens
ccagcucucugcauuucgu

SEQ ID NO: 62492 - RNA, 19 nt, Homo sapiens
gagcugcauuuaguucacu

SEQ ID NO: 62493 - RNA, 19 nt, Homo sapiens
uuucugcacuuggugaaga

SEQ ID NO: 62494 - RNA, 19 nt, Homo sapiens
agaaugguuuggcugugau

SEQ ID NO: 62495 - RNA, 19 nt, Homo sapiens
ggaggaacacuuggaagac

SEQ ID NO: 62496 - RNA, 19 nt, Homo sapiens
cgaggcaucaggaauuagu

SEQ ID NO: 62497 - RNA, 19 nt, Homo sapiens
ccaccgaggcaucaggaau

SEQ ID NO: 62498 - RNA, 19 nt, Homo sapiens
ggaaauucuugacuacuua

SEQ ID NO: 62499 - RNA, 19 nt, Homo sapiens
gaccuuuccuuuagcauua

SEQ ID NO: 62500 - RNA, 19 nt, Homo sapiens
ugaccugucugaauuauaa

SEQ ID NO: 62501 - RNA, 19 nt, Homo sapiens
ggaaauggaacccuaacua

SEQ ID NO: 62502 - RNA, 19 nt, Homo sapiens
uaacuauucucccaucaaa

SEQ ID NO: 62503 - RNA, 19 nt, Homo sapiens
ggaaauugauuggaauaga

SEQ ID NO: 62504 - RNA, 19 nt, Homo sapiens
ggacgaaggugcgguacaa

SEQ ID NO: 62505 - RNA, 19 nt, Homo sapiens
gaaauggaacccuaacuau

SEQ ID NO: 62506 - RNA, 19 nt, Homo sapiens
ucguugaggugaagaauua

SEQ ID NO: 62507 - RNA, 19 nt, Homo sapiens
ccaggaaccuccagcacua

SEQ ID NO: 62508 - RNA, 19 nt, Homo sapiens
gacaguggcugacggcauu

SEQ ID NO: 62509 - RNA, 19 nt, Homo sapiens
ugacggcauuguauacaua

SEQ ID NO: 62510 - RNA, 19 nt, Homo sapiens
gaucgagauucacauuguu

SEQ ID NO: 62511 - RNA, 19 nt, Homo sapiens
gaacugaggaaagcuaaga

SEQ ID NO: 62512 - RNA, 19 nt, Homo sapiens
gguuugugcuggcagauuu

SEQ ID NO: 62513 - RNA, 19 nt, Homo sapiens
gaauccaacuucccgaauc

SEQ ID NO: 62514 - RNA, 19 nt, Homo sapiens
gcaacaagaccauccacaa

SEQ ID NO: 62515 - RNA, 19 nt, Homo sapiens
caucaccaguggaaauuga

SEQ ID NO: 62516 - RNA, 19 nt, Homo sapiens
ugagauggcuucaguucau

SEQ ID NO: 62517 - RNA, 19 nt, Homo sapiens
cacccuaccuugucuaaga

SEQ ID NO: 62518 - RNA, 19 nt, Homo sapiens
gaagcuggagaauuccuua

SEQ ID NO: 62519 - RNA, 19 nt, Homo sapiens
gugaagaauuacccugaaa

SEQ ID NO: 62520 - RNA, 19 nt, Homo sapiens
ggaauagaaacuuaaagga

SEQ ID NO: 62521 - RNA, 19 nt, Homo sapiens
gcuguugggauucugauua

SEQ ID NO: 62522 - RNA, 19 nt, Homo sapiens
gcucugaauuccaguuuua

SEQ ID NO: 62523 - RNA, 19 nt, Homo sapiens
cuaagaggaagauucaaua

SEQ ID NO: 62524 - RNA, 19 nt, Homo sapiens
ggacacagguuuggaagcu

SEQ ID NO: 62525 - RNA, 19 nt, Homo sapiens
uuuggaagcuggagaauuc

SEQ ID NO: 62526 - RNA, 19 nt, Homo sapiens
ggugaagaauuacccugaa

SEQ ID NO: 62527 - RNA, 19 nt, Homo sapiens
ggucaacaauggccacaca

SEQ ID NO: 62528 - RNA, 19 nt, Homo sapiens
ugacuggccuugacguuca

SEQ ID NO: 62529 - RNA, 19 nt, Homo sapiens
gacaugugaucgagauuca

SEQ ID NO: 62530 - RNA, 19 nt, Homo sapiens
cagagacagucgccuauca

SEQ ID NO: 62531 - RNA, 19 nt, Homo sapiens
caacuucauuucucaucug

SEQ ID NO: 62532 - RNA, 19 nt, Homo sapiens
caaguacccaggacaaaga

SEQ ID NO: 62533 - RNA, 19 nt, Homo sapiens
cagccugaccuuuccuuua

SEQ ID NO: 62534 - RNA, 19 nt, Homo sapiens
caguggaaauugauuggaa

SEQ ID NO: 62535 - RNA, 19 nt, Homo sapiens
ugagacgggaucugaguua

SEQ ID NO: 62536 - RNA, 19 nt, Homo sapiens
uaagaaaccaugugugucu

SEQ ID NO: 62537 - RNA, 19 nt, Homo sapiens
gcuaagaggaagauucaau

SEQ ID NO: 62538 - RNA, 19 nt, Homo sapiens
ggagaauuccuuacuggau

SEQ ID NO: 62539 - RNA, 19 nt, Homo sapiens
aaauggaacccuaacuauu

SEQ ID NO: 62540 - RNA, 19 nt, Homo sapiens
gcauugaacugaggaaagc

SEQ ID NO: 62541 - RNA, 19 nt, Homo sapiens
aagaagagcauugaacuga

SEQ ID NO: 62542 - RNA, 19 nt, Homo sapiens
uugaggaaauucuugacua

SEQ ID NO: 62543 - RNA, 19 nt, Homo sapiens
gcaacuucauuucucaucu

SEQ ID NO: 62544 - RNA, 19 nt, Homo sapiens
cguaugauauagcccaaga

SEQ ID NO: 62545 - RNA, 19 nt, Homo sapiens
ugacuggaccuacucagaa

SEQ ID NO: 62546 - RNA, 19 nt, Homo sapiens
ugaucgagauucacauugu

SEQ ID NO: 62547 - RNA, 19 nt, Homo sapiens
ucagacaugugaucgagau

SEQ ID NO: 62548 - RNA, 19 nt, Homo sapiens
uaaaccagccugaccuuuc

SEQ ID NO: 62549 - RNA, 19 nt, Homo sapiens
gacgggaucagacauguga

SEQ ID NO: 62550 - RNA, 19 nt, Homo sapiens
cccaucaaaucauauaugu

SEQ ID NO: 62551 - RNA, 19 nt, Homo sapiens
aggaaauucuugacuacuu

SEQ ID NO: 62552 - RNA, 19 nt, Homo sapiens
aauggaacccuaacuauuc

SEQ ID NO: 62553 - RNA, 19 nt, Homo sapiens
gagauggcuucaguucaug

SEQ ID NO: 62554 - RNA, 19 nt, Homo sapiens
ugaggaaauucuugacuac

SEQ ID NO: 62555 - RNA, 19 nt, Homo sapiens
gcuggagaauuccuuacug

SEQ ID NO: 62556 - RNA, 19 nt, Homo sapiens
gagaacguccacugguuug

SEQ ID NO: 62557 - RNA, 19 nt, Homo sapiens
agauucacauuguucacua

SEQ ID NO: 62558 - RNA, 19 nt, Homo sapiens
cuguugggauucugauuaa

SEQ ID NO: 62559 - RNA, 19 nt, Homo sapiens
acaagaccauccacaacga

SEQ ID NO: 62560 - RNA, 19 nt, Homo sapiens
caacaagaccauccacaac

SEQ ID NO: 62561 - RNA, 19 nt, Homo sapiens
ugagaacguccacugguuu

SEQ ID NO: 62562 - RNA, 19 nt, Homo sapiens
auacauagcccagcagaug

SEQ ID NO: 62563 - RNA, 19 nt, Homo sapiens
ggaaagcuaagaggaagau

SEQ ID NO: 62564 - RNA, 19 nt, Homo sapiens
ugaggaaagcuaagaggaa

SEQ ID NO: 62565 - RNA, 19 nt, Homo sapiens
gaacguccacugguuugug

SEQ ID NO: 62566 - RNA, 19 nt, Homo sapiens
gacaucaccaguggaaauu

SEQ ID NO: 62567 - RNA, 19 nt, Homo sapiens
gaaucaggaauacacucua

SEQ ID NO: 62568 - RNA, 19 nt, Homo sapiens
uacaagacguaugauauag

SEQ ID NO: 62569 - RNA, 19 nt, Homo sapiens
aaucaggaauacacucuag

SEQ ID NO: 62570 - RNA, 19 nt, Homo sapiens
cugagaacguccacugguu

SEQ ID NO: 62571 - RNA, 19 nt, Homo sapiens
gaucugaguuagacaucac

SEQ ID NO: 62572 - RNA, 19 nt, Homo sapiens
gagacgggaucugaguuag

SEQ ID NO: 62573 - RNA, 19 nt, Homo sapiens
cugggcagcuguugggauu

SEQ ID NO: 62574 - RNA, 19 nt, Homo sapiens
ucuaagaaaccaugugugu

SEQ ID NO: 62575 - RNA, 19 nt, Homo sapiens
agccugaccuuuccuuuag

SEQ ID NO: 62576 - RNA, 19 nt, Homo sapiens
gaaacuuaaaggaaaugga

SEQ ID NO: 62577 - RNA, 19 nt, Homo sapiens
guggaaauugauuggaaua

SEQ ID NO: 62578 - RNA, 19 nt, Homo sapiens
agacaucaccaguggaaau

SEQ ID NO: 62579 - RNA, 19 nt, Homo sapiens
aauccaacuucccgaauca

SEQ ID NO: 62580 - RNA, 19 nt, Homo sapiens
cccagcagaugcacuuuca

SEQ ID NO: 62581 - RNA, 19 nt, Homo sapiens
aaaggaaauggaacccuaa

SEQ ID NO: 62582 - RNA, 19 nt, Homo sapiens
ggaucugaguuagacauca

SEQ ID NO: 62583 - RNA, 19 nt, Homo sapiens
gacuggaccuacucagaag

SEQ ID NO: 62584 - RNA, 19 nt, Homo sapiens
cuacauaagauugaggaaa

SEQ ID NO: 62585 - RNA, 19 nt, Homo sapiens
agaccauccacaacgauua

SEQ ID NO: 62586 - RNA, 19 nt, Homo sapiens
acagcaacuucauuucuca

SEQ ID NO: 62587 - RNA, 19 nt, Homo sapiens
auucucccaucaaaucaua

SEQ ID NO: 62588 - RNA, 19 nt, Homo sapiens
gacgggaucugaguuagac

SEQ ID NO: 62589 - RNA, 19 nt, Homo sapiens
acagucgccuaucaaccua

SEQ ID NO: 62590 - RNA, 19 nt, Homo sapiens
cuacuuaagaagagcauug

SEQ ID NO: 62591 - RNA, 19 nt, Homo sapiens
ccuuuagcauuagauguaa

SEQ ID NO: 62592 - RNA, 19 nt, Homo sapiens
auguugaccugucugaauu

SEQ ID NO: 62593 - RNA, 19 nt, Homo sapiens
aagcuaagaggaagauuca

SEQ ID NO: 62594 - RNA, 19 nt, Homo sapiens
agaauuccuuacuggauca

SEQ ID NO: 62595 - RNA, 19 nt, Homo sapiens
ccaggacacagguuuggaa

SEQ ID NO: 62596 - RNA, 19 nt, Homo sapiens
gaaccuccagcacuacuac

SEQ ID NO: 62597 - RNA, 19 nt, Homo sapiens
ggaaccuccagcacuacua

SEQ ID NO: 62598 - RNA, 19 nt, Homo sapiens
guccaucccuguugaauua

SEQ ID NO: 62599 - RNA, 19 nt, Homo sapiens
cagagagacucaagcaaua

SEQ ID NO: 62600 - RNA, 19 nt, Homo sapiens
ccagggagaucgccaauca

SEQ ID NO: 62601 - RNA, 19 nt, Homo sapiens
gagacucaagcaauaauua

SEQ ID NO: 62602 - RNA, 19 nt, Homo sapiens
cacuggagcuuuccuauga

SEQ ID NO: 62603 - RNA, 19 nt, Homo sapiens
gccaaucacccaucaauau

SEQ ID NO: 62604 - RNA, 19 nt, Homo sapiens
ggaaggagcaggagcuaag

SEQ ID NO: 62605 - RNA, 19 nt, Homo sapiens
gagagugucaccuggauug

SEQ ID NO: 62606 - RNA, 19 nt, Homo sapiens
gaucgccaaucacccauca

SEQ ID NO: 62607 - RNA, 19 nt, Homo sapiens
caucccuguugaauuaaua

SEQ ID NO: 62608 - RNA, 19 nt, Homo sapiens
ccagagagacucaagcaau

SEQ ID NO: 62609 - RNA, 19 nt, Homo sapiens
cagaugcgcucuacauggu

SEQ ID NO: 62610 - RNA, 19 nt, Homo sapiens
cagcaugaaucgucugaca

SEQ ID NO: 62611 - RNA, 19 nt, Homo sapiens
gcacccuggcuauagcuua

SEQ ID NO: 62612 - RNA, 19 nt, Homo sapiens
cagguagacuucaaugaca

SEQ ID NO: 62613 - RNA, 19 nt, Homo sapiens
ggauccacauggugaacaa

SEQ ID NO: 62614 - RNA, 19 nt, Homo sapiens
gcacaagcuguaucccauu

SEQ ID NO: 62615 - RNA, 19 nt, Homo sapiens
caccaaagccaccuacaug

SEQ ID NO: 62616 - RNA, 19 nt, Homo sapiens
cucaagggcuuccauguca

SEQ ID NO: 62617 - RNA, 19 nt, Homo sapiens
cacaagcuguaucccauug

SEQ ID NO: 62618 - RNA, 19 nt, Homo sapiens
ucacuggaaugccaagaag

SEQ ID NO: 62619 - RNA, 19 nt, Homo sapiens
caaagccaccuacaugaca

SEQ ID NO: 62620 - RNA, 19 nt, Homo sapiens
ugacagaugcgcucuacau

SEQ ID NO: 62621 - RNA, 19 nt, Homo sapiens
uggccacucuguccaggua

SEQ ID NO: 62622 - RNA, 19 nt, Homo sapiens
gagagacucaagcaauaau

SEQ ID NO: 62623 - RNA, 19 nt, Homo sapiens
cagcugacacuaccagaga

SEQ ID NO: 62624 - RNA, 19 nt, Homo sapiens
gaagcacgauguggguucu

SEQ ID NO: 62625 - RNA, 19 nt, Homo sapiens
gaggugacguggccuucuc

SEQ ID NO: 62626 - RNA, 19 nt, Homo sapiens
ccaaucacccaucaauauc

SEQ ID NO: 62627 - RNA, 19 nt, Homo sapiens
gcaucugguucacuggaau

SEQ ID NO: 62628 - RNA, 19 nt, Homo sapiens
cacccuggcuauagcuuau

SEQ ID NO: 62629 - RNA, 19 nt, Homo sapiens
caaucacccaucaauauca

SEQ ID NO: 62630 - RNA, 19 nt, Homo sapiens
ggaaccuccucuggucuuc

SEQ ID NO: 62631 - RNA, 19 nt, Homo sapiens
ccacuagggcaccaucuuc

SEQ ID NO: 62632 - RNA, 19 nt, Homo sapiens
ucaagcaguuucacuucca

SEQ ID NO: 62633 - RNA, 19 nt, Homo sapiens
gacagaugcgcucuacaug

SEQ ID NO: 62634 - RNA, 19 nt, Homo sapiens
caccaacaauggccacucu

SEQ ID NO: 62635 - RNA, 19 nt, Homo sapiens
ucacugccaggccauuaaa

SEQ ID NO: 62636 - RNA, 19 nt, Homo sapiens
acuggaaugccaagaagua

SEQ ID NO: 62637 - RNA, 19 nt, Homo sapiens
agagagacucaagcaauaa

SEQ ID NO: 62638 - RNA, 19 nt, Homo sapiens
ggaugggacccuugagucu

SEQ ID NO: 62639 - RNA, 19 nt, Homo sapiens
ccacauggugaacaacuuc

SEQ ID NO: 62640 - RNA, 19 nt, Homo sapiens
ccacuggagcuuuccuaug

SEQ ID NO: 62641 - RNA, 19 nt, Homo sapiens
ggaaugccaagaaguacag

SEQ ID NO: 62642 - RNA, 19 nt, Homo sapiens
gacucaagcaauaauuaga

SEQ ID NO: 62643 - RNA, 19 nt, Homo sapiens
ccagguagacuucaaugac

SEQ ID NO: 62644 - RNA, 19 nt, Homo sapiens
gggaaccuccucuggucuu

SEQ ID NO: 62645 - RNA, 19 nt, Homo sapiens
ccuaccgccucaagcaguu

SEQ ID NO: 62646 - RNA, 19 nt, Homo sapiens
ccaacaauggccacucugu

SEQ ID NO: 62647 - RNA, 19 nt, Homo sapiens
cgccaaucacccaucaaua

SEQ ID NO: 62648 - RNA, 19 nt, Homo sapiens
gcaccaaagcccaguucag

SEQ ID NO: 62649 - RNA, 19 nt, Homo sapiens
aaucacccaucaauaucau

SEQ ID NO: 62650 - RNA, 19 nt, Homo sapiens
cgcauuggcacaagcugua

SEQ ID NO: 62651 - RNA, 19 nt, Homo sapiens
gaaguuccggagccugcuu

SEQ ID NO: 62652 - RNA, 19 nt, Homo sapiens
gccacucuguccagguaga

SEQ ID NO: 62653 - RNA, 19 nt, Homo sapiens
gggcaagaagcacgaugug

SEQ ID NO: 62654 - RNA, 19 nt, Homo sapiens
ugcaaccacuggagcuuuc

SEQ ID NO: 62655 - RNA, 19 nt, Homo sapiens
ccaaagacccugggaaccu

SEQ ID NO: 62656 - RNA, 19 nt, Homo sapiens
gaacaagucugucuucaug

SEQ ID NO: 62657 - RNA, 19 nt, Homo sapiens
ccaaagaaacccuauauua

SEQ ID NO: 62658 - RNA, 19 nt, Homo sapiens
ggacauaccauucagguua

SEQ ID NO: 62659 - RNA, 19 nt, Homo sapiens
gcacaaagcaaacaauaaa

SEQ ID NO: 62660 - RNA, 19 nt, Homo sapiens
cuacauaguugaaggauuu

SEQ ID NO: 62661 - RNA, 19 nt, Homo sapiens
ggaagacaaugguccuaua

SEQ ID NO: 62662 - RNA, 19 nt, Homo sapiens
gaacuaguguaauucuuga

SEQ ID NO: 62663 - RNA, 19 nt, Homo sapiens
ccacuacuuugguauguua

SEQ ID NO: 62664 - RNA, 19 nt, Homo sapiens
ggauuuaacugaauguaug

SEQ ID NO: 62665 - RNA, 19 nt, Homo sapiens
gagaaagguguaagaaaua

SEQ ID NO: 62666 - RNA, 19 nt, Homo sapiens
gcaaagugaaugauuagua

SEQ ID NO: 62667 - RNA, 19 nt, Homo sapiens
ugagaaagguguaagaaau

SEQ ID NO: 62668 - RNA, 19 nt, Homo sapiens
gcacacgguuaauuucaaa

SEQ ID NO: 62669 - RNA, 19 nt, Homo sapiens
gagcugcaccuucaguuua

SEQ ID NO: 62670 - RNA, 19 nt, Homo sapiens
gaagacaaugguccuauaa

SEQ ID NO: 62671 - RNA, 19 nt, Homo sapiens
ucgaagcugugguuuaaua

SEQ ID NO: 62672 - RNA, 19 nt, Homo sapiens
ggaaggcugugaugggauu

SEQ ID NO: 62673 - RNA, 19 nt, Homo sapiens
ccgauacccuuuaacuaua

SEQ ID NO: 62674 - RNA, 19 nt, Homo sapiens
caagagaggcuagguauga

SEQ ID NO: 62675 - RNA, 19 nt, Homo sapiens
ggaagaggaugaggaggaa

SEQ ID NO: 62676 - RNA, 19 nt, Homo sapiens
ugacugaaauccuccaaga

SEQ ID NO: 62677 - RNA, 19 nt, Homo sapiens
gcaacauaauacucacuuu

SEQ ID NO: 62678 - RNA, 19 nt, Homo sapiens
guuaguaguucuucauuuc

SEQ ID NO: 62679 - RNA, 19 nt, Homo sapiens
agacaaugguccuauaaug

SEQ ID NO: 62680 - RNA, 19 nt, Homo sapiens
gcuuuaauccuaacacuuu

SEQ ID NO: 62681 - RNA, 19 nt, Homo sapiens
gcacccauaccacaauuaa

SEQ ID NO: 62682 - RNA, 19 nt, Homo sapiens
gcacggaaucgccaucauu

SEQ ID NO: 62683 - RNA, 19 nt, Homo sapiens
guugaaggauuuaacugaa

SEQ ID NO: 62684 - RNA, 19 nt, Homo sapiens
ccucaaagccugcguuguu

SEQ ID NO: 62685 - RNA, 19 nt, Homo sapiens
gcauuucaguagccaaaga

SEQ ID NO: 62686 - RNA, 19 nt, Homo sapiens
caucauugcucuguuuguu

SEQ ID NO: 62687 - RNA, 19 nt, Homo sapiens
gacauaccauucagguuau

SEQ ID NO: 62688 - RNA, 19 nt, Homo sapiens
gcuuuacuuuccauacaua

SEQ ID NO: 62689 - RNA, 19 nt, Homo sapiens
agaaauggcuguauauucc

SEQ ID NO: 62690 - RNA, 19 nt, Homo sapiens
guucugagcacacgguuaa

SEQ ID NO: 62691 - RNA, 19 nt, Homo sapiens
gggaauaccagucuccuau

SEQ ID NO: 62692 - RNA, 19 nt, Homo sapiens
uagaguaccuggcacaaag

SEQ ID NO: 62693 - RNA, 19 nt, Homo sapiens
ccaggaauagcuuuacuuu

SEQ ID NO: 62694 - RNA, 19 nt, Homo sapiens
acugaaauccuccaagaua

SEQ ID NO: 62695 - RNA, 19 nt, Homo sapiens
ggucugguguuuccugaug

SEQ ID NO: 62696 - RNA, 19 nt, Homo sapiens
gaugugacagaaugagaua

SEQ ID NO: 62697 - RNA, 19 nt, Homo sapiens
uagcagauguaagcguaua

SEQ ID NO: 62698 - RNA, 19 nt, Homo sapiens
gguguaagaaauaggauaa

SEQ ID NO: 62699 - RNA, 19 nt, Homo sapiens
auucgaagcugugguuuaa

SEQ ID NO: 62700 - RNA, 19 nt, Homo sapiens
ugaaggauuuaacugaaug

SEQ ID NO: 62701 - RNA, 19 nt, Homo sapiens
gaaauccuccaagauauuc

SEQ ID NO: 62702 - RNA, 19 nt, Homo sapiens
gauaggaaaggaacauguu

SEQ ID NO: 62703 - RNA, 19 nt, Homo sapiens
auacuuaguugccguuaga

SEQ ID NO: 62704 - RNA, 19 nt, Homo sapiens
acccauaccacaauuaaua

SEQ ID NO: 62705 - RNA, 19 nt, Homo sapiens
ggcuguauauuccaaagaa

SEQ ID NO: 62706 - RNA, 19 nt, Homo sapiens
ugaaggcugugacugaaau

SEQ ID NO: 62707 - RNA, 19 nt, Homo sapiens
guuuauugcuuauguguag

SEQ ID NO: 62708 - RNA, 19 nt, Homo sapiens
cugcuaggauucauaguug

SEQ ID NO: 62709 - RNA, 19 nt, Homo sapiens
ccuccaagauauucaguau

SEQ ID NO: 62710 - RNA, 19 nt, Homo sapiens
cuuuaaagaugaccaacaa

SEQ ID NO: 62711 - RNA, 19 nt, Homo sapiens
cauuagagcugcauuucag

SEQ ID NO: 62712 - RNA, 19 nt, Homo sapiens
cgauacccuuuaacuauau

SEQ ID NO: 62713 - RNA, 19 nt, Homo sapiens
guagaaggaaugaaacuag

SEQ ID NO: 62714 - RNA, 19 nt, Homo sapiens
cuauaaugcccuuggauaa

SEQ ID NO: 62715 - RNA, 19 nt, Homo sapiens
guaccuggcacaaagcaaa

SEQ ID NO: 62716 - RNA, 19 nt, Homo sapiens
uacacuugcugaaaugaaa

SEQ ID NO: 62717 - RNA, 19 nt, Homo sapiens
ccuauaaugcccuuggaua

SEQ ID NO: 62718 - RNA, 19 nt, Homo sapiens
auaccuugcuuuaauccua

SEQ ID NO: 62719 - RNA, 19 nt, Homo sapiens
ugaaauccuccaagauauu

SEQ ID NO: 62720 - RNA, 19 nt, Homo sapiens
cugaaauccuccaagauau

SEQ ID NO: 62721 - RNA, 19 nt, Homo sapiens
gagcacacgguuaauuuca

SEQ ID NO: 62722 - RNA, 19 nt, Homo sapiens
gaauagcuuuacuuuccau

SEQ ID NO: 62723 - RNA, 19 nt, Homo sapiens
auaaugcccuuggauaaga

SEQ ID NO: 62724 - RNA, 19 nt, Homo sapiens
acaauaccuugcuuuaauc

SEQ ID NO: 62725 - RNA, 19 nt, Homo sapiens
cguuagaugugacagaaug

SEQ ID NO: 62726 - RNA, 19 nt, Homo sapiens
gccguuagaugugacagaa

SEQ ID NO: 62727 - RNA, 19 nt, Homo sapiens
ggaauuugagaaaggugua

SEQ ID NO: 62728 - RNA, 19 nt, Homo sapiens
ccaaagaggacaggaacaa

SEQ ID NO: 62729 - RNA, 19 nt, Homo sapiens
gggauuacuggguguauga

SEQ ID NO: 62730 - RNA, 19 nt, Homo sapiens
ggcacaaagcaaacaauaa

SEQ ID NO: 62731 - RNA, 19 nt, Homo sapiens
cugaauguauggaucaaau

SEQ ID NO: 62732 - RNA, 19 nt, Homo sapiens
cagcacccauaccacaauu

SEQ ID NO: 62733 - RNA, 19 nt, Homo sapiens
gcuguauauuccaaagaaa

SEQ ID NO: 62734 - RNA, 19 nt, Homo sapiens
uagaaauggcuguauauuc

SEQ ID NO: 62735 - RNA, 19 nt, Homo sapiens
ccuguacacuugcugaaau

SEQ ID NO: 62736 - RNA, 19 nt, Homo sapiens
ggaccugagcuucaucgaa

SEQ ID NO: 62737 - RNA, 19 nt, Homo sapiens
aggcugaggacacauguua

SEQ ID NO: 62738 - RNA, 19 nt, Homo sapiens
gcuugaaggcugugacuga

SEQ ID NO: 62739 - RNA, 19 nt, Homo sapiens
ucauugcucuguuuguuca

SEQ ID NO: 62740 - RNA, 19 nt, Homo sapiens
cgccaucauugcucuguuu

SEQ ID NO: 62741 - RNA, 19 nt, Homo sapiens
gugacagaaugagauaauu

SEQ ID NO: 62742 - RNA, 19 nt, Homo sapiens
ugauuccacuacuuuggua

SEQ ID NO: 62743 - RNA, 19 nt, Homo sapiens
agaaagguguaagaaauag

SEQ ID NO: 62744 - RNA, 19 nt, Homo sapiens
uaacugaauguauggauca

SEQ ID NO: 62745 - RNA, 19 nt, Homo sapiens
cauuaaugcagcaacauaa

SEQ ID NO: 62746 - RNA, 19 nt, Homo sapiens
uagaaggaaugaaacuagu

SEQ ID NO: 62747 - RNA, 19 nt, Homo sapiens
ggaacauguuggcuugaag

SEQ ID NO: 62748 - RNA, 19 nt, Homo sapiens
uagcuuuacuuuccauaca

SEQ ID NO: 62749 - RNA, 19 nt, Homo sapiens
gcaccauguaccaggaaua

SEQ ID NO: 62750 - RNA, 19 nt, Homo sapiens
gcacucacacugcgguuca

SEQ ID NO: 62751 - RNA, 19 nt, Homo sapiens
cacauacuguuuauugcuu

SEQ ID NO: 62752 - RNA, 19 nt, Homo sapiens
caucccaccuugcagugaa

SEQ ID NO: 62753 - RNA, 19 nt, Homo sapiens
cuauuaaccuaaacucaag

SEQ ID NO: 62754 - RNA, 19 nt, Homo sapiens
aagcugugguuuaauagga

SEQ ID NO: 62755 - RNA, 19 nt, Homo sapiens
uugcuuauguguagaagga

SEQ ID NO: 62756 - RNA, 19 nt, Homo sapiens
ggaucuaccugaaguuaag

SEQ ID NO: 62757 - RNA, 19 nt, Homo sapiens
gaggaucuaccugaaguua

SEQ ID NO: 62758 - RNA, 19 nt, Homo sapiens
ggaagaaaucgcugaggaa

SEQ ID NO: 62759 - RNA, 19 nt, Homo sapiens
uaccugaaguuaagccuaa

SEQ ID NO: 62760 - RNA, 19 nt, Homo sapiens
gaggcuggaucuuggagaa

SEQ ID NO: 62761 - RNA, 19 nt, Homo sapiens
ggugucaucuggacugugu

SEQ ID NO: 62762 - RNA, 19 nt, Homo sapiens
gaggaucuaccuacuguug

SEQ ID NO: 62763 - RNA, 19 nt, Homo sapiens
cgacgcagccuuugaaugg

SEQ ID NO: 62764 - RNA, 19 nt, Homo sapiens
aggaggaucugcccaguga

SEQ ID NO: 62765 - RNA, 19 nt, Homo sapiens
gagcgacgcagccuuugaa

SEQ ID NO: 62766 - RNA, 19 nt, Homo sapiens
gcgcaacaauggccacagu

SEQ ID NO: 62767 - RNA, 19 nt, Homo sapiens
gaaguuaagccuaaaucag

SEQ ID NO: 62768 - RNA, 19 nt, Homo sapiens
gccgcuacuuccaauauga

SEQ ID NO: 62769 - RNA, 19 nt, Homo sapiens
ugaaugggcgagugauuga

SEQ ID NO: 62770 - RNA, 19 nt, Homo sapiens
gcaacaauggccacagugu

SEQ ID NO: 62771 - RNA, 19 nt, Homo sapiens
agaggaggaucuaccugaa

SEQ ID NO: 62772 - RNA, 19 nt, Homo sapiens
uguccuguccugcucauua

SEQ ID NO: 62773 - RNA, 19 nt, Homo sapiens
gaucuuggagaaugugaga

SEQ ID NO: 62774 - RNA, 19 nt, Homo sapiens
ggaucuaccuacuguugag

SEQ ID NO: 62775 - RNA, 19 nt, Homo sapiens
gagccaguccagcugaauu

SEQ ID NO: 62776 - RNA, 19 nt, Homo sapiens
aaguuaagccuaaaucaga

SEQ ID NO: 62777 - RNA, 19 nt, Homo sapiens
guccuguccugcucauuau

SEQ ID NO: 62778 - RNA, 19 nt, Homo sapiens
guugcugucucgcuuggaa

SEQ ID NO: 62779 - RNA, 19 nt, Homo sapiens
gcaccgccuuugccagagu

SEQ ID NO: 62780 - RNA, 19 nt, Homo sapiens
gcacagaaggggaaccaaa

SEQ ID NO: 62781 - RNA, 19 nt, Homo sapiens
cagugaugcugagugcuaa

SEQ ID NO: 62782 - RNA, 19 nt, Homo sapiens
acagugaugcugagugcua

SEQ ID NO: 62783 - RNA, 19 nt, Homo sapiens
ucaucuggacuguguuuaa

SEQ ID NO: 62784 - RNA, 19 nt, Homo sapiens
ggcuggaucuuggagaaug

SEQ ID NO: 62785 - RNA, 19 nt, Homo sapiens
uccuggagauccucaagaa

SEQ ID NO: 62786 - RNA, 19 nt, Homo sapiens
ugagaaggcagcacagaag

SEQ ID NO: 62787 - RNA, 19 nt, Homo sapiens
gaugagaaggcagcacaga

SEQ ID NO: 62788 - RNA, 19 nt, Homo sapiens
caucuggacuguguuuaac

SEQ ID NO: 62789 - RNA, 19 nt, Homo sapiens
gcuggaucuuggagaaugu

SEQ ID NO: 62790 - RNA, 19 nt, Homo sapiens
guguuuaaccagacaguga

SEQ ID NO: 62791 - RNA, 19 nt, Homo sapiens
ugacuucagccgcuacuuc

SEQ ID NO: 62792 - RNA, 19 nt, Homo sapiens
cagagucauuggcgcuaug

SEQ ID NO: 62793 - RNA, 19 nt, Homo sapiens
gaggaucugcccagugaag

SEQ ID NO: 62794 - RNA, 19 nt, Homo sapiens
cagccgcuacuuccaauau

SEQ ID NO: 62795 - RNA, 19 nt, Homo sapiens
aguuaagccuaaaucagaa

SEQ ID NO: 62796 - RNA, 19 nt, Homo sapiens
aggaggaucuaccugaagu

SEQ ID NO: 62797 - RNA, 19 nt, Homo sapiens
caagaaccccagaauaaug

SEQ ID NO: 62798 - RNA, 19 nt, Homo sapiens
ccuuuuaacugccaagaaa

SEQ ID NO: 62799 - RNA, 19 nt, Homo sapiens
gaagaaaacagugccuaug

SEQ ID NO: 62800 - RNA, 19 nt, Homo sapiens
ccagagucauuggcgcuau

SEQ ID NO: 62801 - RNA, 19 nt, Homo sapiens
ugaaguuaagccuaaauca

SEQ ID NO: 62802 - RNA, 19 nt, Homo sapiens
ucauuaugccacuuccuuu

SEQ ID NO: 62803 - RNA, 19 nt, Homo sapiens
cagcgucgcguuccuugug

SEQ ID NO: 62804 - RNA, 19 nt, Homo sapiens
cugcacuccugcccucuga

SEQ ID NO: 62805 - RNA, 19 nt, Homo sapiens
uaugaggggucucugacua

SEQ ID NO: 62806 - RNA, 19 nt, Homo sapiens
ggaagaaaacagugccuau

SEQ ID NO: 62807 - RNA, 19 nt, Homo sapiens
ugucacugcugcuucugau

SEQ ID NO: 62808 - RNA, 19 nt, Homo sapiens
cucaagaaccccagaauaa

SEQ ID NO: 62809 - RNA, 19 nt, Homo sapiens
ggaggaucuaccugaaguu

SEQ ID NO: 62810 - RNA, 19 nt, Homo sapiens
gaggaggaucuaccugaag

SEQ ID NO: 62811 - RNA, 19 nt, Homo sapiens
caagaaugaugccuacuuu

SEQ ID NO: 62812 - RNA, 19 nt, Homo sapiens
cagaauacuuccuguuuaa

SEQ ID NO: 62813 - RNA, 19 nt, Homo sapiens
gaagaagaguggguuugaa

SEQ ID NO: 62814 - RNA, 19 nt, Homo sapiens
ggacagaggagcugagaga

SEQ ID NO: 62815 - RNA, 19 nt, Homo sapiens
gaacugcggcugcuguuug

SEQ ID NO: 62816 - RNA, 19 nt, Homo sapiens
guaggaagaucaggagcua

SEQ ID NO: 62817 - RNA, 19 nt, Homo sapiens
ggagaggagguguggguua

SEQ ID NO: 62818 - RNA, 19 nt, Homo sapiens
ucaccuggauccucauuga

SEQ ID NO: 62819 - RNA, 19 nt, Homo sapiens
gaaaagagcagaggaaaga

SEQ ID NO: 62820 - RNA, 19 nt, Homo sapiens
gaaagaggaaagacacaga

SEQ ID NO: 62821 - RNA, 19 nt, Homo sapiens
gaggaaagacacagagaga

SEQ ID NO: 62822 - RNA, 19 nt, Homo sapiens
aggauaaucuccagggaaa

SEQ ID NO: 62823 - RNA, 19 nt, Homo sapiens
gagaggagguguggguuag

SEQ ID NO: 62824 - RNA, 19 nt, Homo sapiens
aauaucaccucccuucaga

SEQ ID NO: 62825 - RNA, 19 nt, Homo sapiens
gaaugaugccuacuuucuu

SEQ ID NO: 62826 - RNA, 19 nt, Homo sapiens
uaaagggacagaauacuuc

SEQ ID NO: 62827 - RNA, 19 nt, Homo sapiens
gagcuccuguucccugaau

SEQ ID NO: 62828 - RNA, 19 nt, Homo sapiens
ugggagagcuuaaugaaaa

SEQ ID NO: 62829 - RNA, 19 nt, Homo sapiens
ugguggagcuacaaggaua

SEQ ID NO: 62830 - RNA, 19 nt, Homo sapiens
gcugagaggaguaggaaga

SEQ ID NO: 62831 - RNA, 19 nt, Homo sapiens
gagaggaguaggaagauca

SEQ ID NO: 62832 - RNA, 19 nt, Homo sapiens
gaacucuacgggaauuuca

SEQ ID NO: 62833 - RNA, 19 nt, Homo sapiens
gaggagguguggguuagga

SEQ ID NO: 62834 - RNA, 19 nt, Homo sapiens
gccagaauccuccaucuca

SEQ ID NO: 62835 - RNA, 19 nt, Homo sapiens
aaugaugccuacuuucuuc

SEQ ID NO: 62836 - RNA, 19 nt, Homo sapiens
ucacucgcaucuccuacaa

SEQ ID NO: 62837 - RNA, 19 nt, Homo sapiens
caggaacucuacgggaauu

SEQ ID NO: 62838 - RNA, 19 nt, Homo sapiens
gcucggaacaucagaucaa

SEQ ID NO: 62839 - RNA, 19 nt, Homo sapiens
gcuauuaaagggacagaau

SEQ ID NO: 62840 - RNA, 19 nt, Homo sapiens
ggaguuaccccuaaaacaa

SEQ ID NO: 62841 - RNA, 19 nt, Homo sapiens
acucgcaucuccuacaaga

SEQ ID NO: 62842 - RNA, 19 nt, Homo sapiens
gagaagaagaguggguuug

SEQ ID NO: 62843 - RNA, 19 nt, Homo sapiens
gagcagaggaaagaggaaa

SEQ ID NO: 62844 - RNA, 19 nt, Homo sapiens
gagccagaauccuccaucu

SEQ ID NO: 62845 - RNA, 19 nt, Homo sapiens
gcagaggaaagaggaaaga

SEQ ID NO: 62846 - RNA, 19 nt, Homo sapiens
uuaaagggacagaauacuu

SEQ ID NO: 62847 - RNA, 19 nt, Homo sapiens
ucaccucccuucagaugca

SEQ ID NO: 62848 - RNA, 19 nt, Homo sapiens
ggagcuacaaggauaaucu

SEQ ID NO: 62849 - RNA, 19 nt, Homo sapiens
ccaacuaccgccugcaugu

SEQ ID NO: 62850 - RNA, 19 nt, Homo sapiens
agaagaagaguggguuuga

SEQ ID NO: 62851 - RNA, 19 nt, Homo sapiens
acaagaaugaugccuacuu

SEQ ID NO: 62852 - RNA, 19 nt, Homo sapiens
ucgcaucuccuacaagaau

SEQ ID NO: 62853 - RNA, 19 nt, Homo sapiens
ggagaggaaagcuggaagu

SEQ ID NO: 62854 - RNA, 19 nt, Homo sapiens
uaucaccucccuucagaug

SEQ ID NO: 62855 - RNA, 19 nt, Homo sapiens
cucagucccuggcugcuuu

SEQ ID NO: 62856 - RNA, 19 nt, Homo sapiens
cagaauccuccaucucaga

SEQ ID NO: 62857 - RNA, 19 nt, Homo sapiens
gagacgggagagagaagaa

SEQ ID NO: 62858 - RNA, 19 nt, Homo sapiens
caguaccucuaacccauuc

SEQ ID NO: 62859 - RNA, 19 nt, Homo sapiens
cagccucuuugucaacguu

SEQ ID NO: 62860 - RNA, 19 nt, Homo sapiens
ggaacucuacgggaauuuc

SEQ ID NO: 62861 - RNA, 19 nt, Homo sapiens
gcagcucauucacuucaac

SEQ ID NO: 62862 - RNA, 19 nt, Homo sapiens
gauaaucuccagggaaacu

SEQ ID NO: 62863 - RNA, 19 nt, Homo sapiens
gaggacugguggagcuaca

SEQ ID NO: 62864 - RNA, 19 nt, Homo sapiens
gaggagaggaaagcuggaa

SEQ ID NO: 62865 - RNA, 19 nt, Homo sapiens
gaugccuacuuucuucaag

SEQ ID NO: 62866 - RNA, 19 nt, Homo sapiens
cagagagacgggagagaga

SEQ ID NO: 62867 - RNA, 19 nt, Homo sapiens
gugcagcucauucacuuca

SEQ ID NO: 62868 - RNA, 19 nt, Homo sapiens
ccuggcugcuuuggcauuu

SEQ ID NO: 62869 - RNA, 19 nt, Homo sapiens
gcaucuccuacaagaauga

SEQ ID NO: 62870 - RNA, 19 nt, Homo sapiens
gacgggagagagaagaaga

SEQ ID NO: 62871 - RNA, 19 nt, Homo sapiens
gccauucucagccucuuug

SEQ ID NO: 62872 - RNA, 19 nt, Homo sapiens
ugagacuccugagccagaa

SEQ ID NO: 62873 - RNA, 19 nt, Homo sapiens
caauaucaccucccuucag

SEQ ID NO: 62874 - RNA, 19 nt, Homo sapiens
ccgagacugucaccuggau

SEQ ID NO: 62875 - RNA, 19 nt, Homo sapiens
gguggagcuacaaggauaa

SEQ ID NO: 62876 - RNA, 19 nt, Homo sapiens
uccagagccucagcgguaa

SEQ ID NO: 62877 - RNA, 19 nt, Homo sapiens
ccaguaccucuaacccauu

SEQ ID NO: 62878 - RNA, 19 nt, Homo sapiens
aggugcagcucauucacuu

SEQ ID NO: 62879 - RNA, 19 nt, Homo sapiens
aggaagaucaggagcuaga

SEQ ID NO: 62880 - RNA, 19 nt, Homo sapiens
gagaggaaagcuggaaguc

SEQ ID NO: 62881 - RNA, 19 nt, Homo sapiens
gagaauagcugguccaaga

SEQ ID NO: 62882 - RNA, 19 nt, Homo sapiens
gcacagaccuuagggaaug

SEQ ID NO: 62883 - RNA, 19 nt, Homo sapiens
ggaaauaggcagaaacaaa

SEQ ID NO: 62884 - RNA, 19 nt, Homo sapiens
caagagauauacauuguga

SEQ ID NO: 62885 - RNA, 19 nt, Homo sapiens
gaugucaaaucgugguuua

SEQ ID NO: 62886 - RNA, 19 nt, Homo sapiens
gagaaaugaucaacaacuu

SEQ ID NO: 62887 - RNA, 19 nt, Homo sapiens
gaaauguccucuugaagca

SEQ ID NO: 62888 - RNA, 19 nt, Homo sapiens
gggcuggcaucauguauuu

SEQ ID NO: 62889 - RNA, 19 nt, Homo sapiens
ccagagaaaugaucaacaa

SEQ ID NO: 62890 - RNA, 19 nt, Homo sapiens
ccauagaccugcacaguga

SEQ ID NO: 62891 - RNA, 19 nt, Homo sapiens
gagaugggcuccuucaauc

SEQ ID NO: 62892 - RNA, 19 nt, Homo sapiens
gagaagacauggaugaucu

SEQ ID NO: 62893 - RNA, 19 nt, Homo sapiens
ccaccaagauggagacuga

SEQ ID NO: 62894 - RNA, 19 nt, Homo sapiens
ggagaggaccgcugaauau

SEQ ID NO: 62895 - RNA, 19 nt, Homo sapiens
caggaaggaucaaguugua

SEQ ID NO: 62896 - RNA, 19 nt, Homo sapiens
cuacuaagauacuccauau

SEQ ID NO: 62897 - RNA, 19 nt, Homo sapiens
uaaugaggcuguuccuuga

SEQ ID NO: 62898 - RNA, 19 nt, Homo sapiens
gggcaucucccucugauuu

SEQ ID NO: 62899 - RNA, 19 nt, Homo sapiens
caugaaauguccucuugaa

SEQ ID NO: 62900 - RNA, 19 nt, Homo sapiens
gacccaaucugccuuugaa

SEQ ID NO: 62901 - RNA, 19 nt, Homo sapiens
caaaaugacuguagaacuu

SEQ ID NO: 62902 - RNA, 19 nt, Homo sapiens
gaggaccgcugaauauuac

SEQ ID NO: 62903 - RNA, 19 nt, Homo sapiens
cauuauaacucagaccuuu

SEQ ID NO: 62904 - RNA, 19 nt, Homo sapiens
ggacaggaaggaucaaguu

SEQ ID NO: 62905 - RNA, 19 nt, Homo sapiens
gaaauaggcagaaacaaaa

SEQ ID NO: 62906 - RNA, 19 nt, Homo sapiens
ggaucaaguuguagagaga

SEQ ID NO: 62907 - RNA, 19 nt, Homo sapiens
aaugugcacucucugcuua

SEQ ID NO: 62908 - RNA, 19 nt, Homo sapiens
gaucuucagucaccuucaa

SEQ ID NO: 62909 - RNA, 19 nt, Homo sapiens
acagugacauccuccagua

SEQ ID NO: 62910 - RNA, 19 nt, Homo sapiens
gacaugaguuccgagauga

SEQ ID NO: 62911 - RNA, 19 nt, Homo sapiens
ggacaaagagaaugagaag

SEQ ID NO: 62912 - RNA, 19 nt, Homo sapiens
cuacuucucucucucugaa

SEQ ID NO: 62913 - RNA, 19 nt, Homo sapiens
gaaacaaaaugacuguaga

SEQ ID NO: 62914 - RNA, 19 nt, Homo sapiens
ucagucaccuucaacaugu

SEQ ID NO: 62915 - RNA, 19 nt, Homo sapiens
agacaugaguuccgagaug

SEQ ID NO: 62916 - RNA, 19 nt, Homo sapiens
ggaaggaucaaguuguaga

SEQ ID NO: 62917 - RNA, 19 nt, Homo sapiens
ggaauggcagguucaaguu

SEQ ID NO: 62918 - RNA, 19 nt, Homo sapiens
ggaaucagaauuggaauca

SEQ ID NO: 62919 - RNA, 19 nt, Homo sapiens
acaagggagucauuuacaa

SEQ ID NO: 62920 - RNA, 19 nt, Homo sapiens
agaggaccgcugaauauua

SEQ ID NO: 62921 - RNA, 19 nt, Homo sapiens
caaagagaaugagaagaca

SEQ ID NO: 62922 - RNA, 19 nt, Homo sapiens
ucuccaagcuuucagacaa

SEQ ID NO: 62923 - RNA, 19 nt, Homo sapiens
gcaguaagccaaggucaug

SEQ ID NO: 62924 - RNA, 19 nt, Homo sapiens
gauaacaagggagucauuu

SEQ ID NO: 62925 - RNA, 19 nt, Homo sapiens
uguccuggcuguucucauu

SEQ ID NO: 62926 - RNA, 19 nt, Homo sapiens
aggcgcaacuccuccauuu

SEQ ID NO: 62927 - RNA, 19 nt, Homo sapiens
caguggagcaguuauguuu

SEQ ID NO: 62928 - RNA, 19 nt, Homo sapiens
gagaggaccgcugaauauu

SEQ ID NO: 62929 - RNA, 19 nt, Homo sapiens
gaggaaauaggcagaaaca

SEQ ID NO: 62930 - RNA, 19 nt, Homo sapiens
gugacauccuccaguauga

SEQ ID NO: 62931 - RNA, 19 nt, Homo sapiens
ugugugagauugugaagug

SEQ ID NO: 62932 - RNA, 19 nt, Homo sapiens
ccgccgagcugcacauugu

SEQ ID NO: 62933 - RNA, 19 nt, Homo sapiens
gaagggagagagagcuaga

SEQ ID NO: 62934 - RNA, 19 nt, Homo sapiens
gauauauuagggacacuuu

SEQ ID NO: 62935 - RNA, 19 nt, Homo sapiens
acaagaaugugcacucucu

SEQ ID NO: 62936 - RNA, 19 nt, Homo sapiens
aauguccucuugaagcaua

SEQ ID NO: 62937 - RNA, 19 nt, Homo sapiens
ugagaacccuguggagaug

SEQ ID NO: 62938 - RNA, 19 nt, Homo sapiens
cgaaucacacagacaguuu

SEQ ID NO: 62939 - RNA, 19 nt, Homo sapiens
gaauggagacuuuuaucua

SEQ ID NO: 62940 - RNA, 19 nt, Homo sapiens
aaucagaauuggaaucaca

SEQ ID NO: 62941 - RNA, 19 nt, Homo sapiens
caaguguccuggaaagucu

SEQ ID NO: 62942 - RNA, 19 nt, Homo sapiens
gguguucucuguagcucaa

SEQ ID NO: 62943 - RNA, 19 nt, Homo sapiens
guacaaaggccaggaagca

SEQ ID NO: 62944 - RNA, 19 nt, Homo sapiens
gcuacuaagauacuccaua

SEQ ID NO: 62945 - RNA, 19 nt, Homo sapiens
gagaagggagagagagcua

SEQ ID NO: 62946 - RNA, 19 nt, Homo sapiens
guuccgagaugacccaauc

SEQ ID NO: 62947 - RNA, 19 nt, Homo sapiens
guggagcaguuauguuuua

SEQ ID NO: 62948 - RNA, 19 nt, Homo sapiens
ccaagcagcaggaauucaa

SEQ ID NO: 62949 - RNA, 19 nt, Homo sapiens
agaccaagcagcaggaauu

SEQ ID NO: 62950 - RNA, 19 nt, Homo sapiens
uaacaagggagucauuuac

SEQ ID NO: 62951 - RNA, 19 nt, Homo sapiens
cuaagauacuccauauucu

SEQ ID NO: 62952 - RNA, 19 nt, Homo sapiens
gggaauggcagguucaagu

SEQ ID NO: 62953 - RNA, 19 nt, Homo sapiens
acuaagauacuccauauuc

SEQ ID NO: 62954 - RNA, 19 nt, Homo sapiens
aaccuggaauggagacuuu

SEQ ID NO: 62955 - RNA, 19 nt, Homo sapiens
cggagaggaccgcugaaua

SEQ ID NO: 62956 - RNA, 19 nt, Homo sapiens
ggaaugcuacuaagauacu

SEQ ID NO: 62957 - RNA, 19 nt, Homo sapiens
auggaaugcuacuaagaua

SEQ ID NO: 62958 - RNA, 19 nt, Homo sapiens
gcaguuauguuuuauacuc

SEQ ID NO: 62959 - RNA, 19 nt, Homo sapiens
gagucucacuuuggaauca

SEQ ID NO: 62960 - RNA, 19 nt, Homo sapiens
gaaccugcccucggacaug

SEQ ID NO: 62961 - RNA, 19 nt, Homo sapiens
gaugagaggcugguauaca

SEQ ID NO: 62962 - RNA, 19 nt, Homo sapiens
ggaggcggagguugcagua

SEQ ID NO: 62963 - RNA, 19 nt, Homo sapiens
caaucugucugccaacaag

SEQ ID NO: 62964 - RNA, 19 nt, Homo sapiens
guccagaaguucgaugaga

SEQ ID NO: 62965 - RNA, 19 nt, Homo sapiens
gcacauuguccauuauaac

SEQ ID NO: 62966 - RNA, 19 nt, Homo sapiens
cauuguccauuauaacuca

SEQ ID NO: 62967 - RNA, 19 nt, Homo sapiens
gcuuucaaguguccuggaa

SEQ ID NO: 62968 - RNA, 19 nt, Homo sapiens
uggaugggaugcacucuca

SEQ ID NO: 62969 - RNA, 19 nt, Homo sapiens
auaacaagggagucauuua

SEQ ID NO: 62970 - RNA, 19 nt, Homo sapiens
ggcccuggcuggcauucuu

SEQ ID NO: 62971 - RNA, 19 nt, Homo sapiens
agcaugaaauguccucuug

SEQ ID NO: 62972 - RNA, 19 nt, Homo sapiens
ggcaaguaauaauggaaug

SEQ ID NO: 62973 - RNA, 19 nt, Homo sapiens
aaucgugguuuagaucaaa

SEQ ID NO: 62974 - RNA, 19 nt, Homo sapiens
gcuagagggacaaagagaa

SEQ ID NO: 62975 - RNA, 19 nt, Homo sapiens
gaaugugcacucucugcuu

SEQ ID NO: 62976 - RNA, 19 nt, Homo sapiens
gucccgggauucaacauug

SEQ ID NO: 62977 - RNA, 19 nt, Homo sapiens
ugagaugggcuccuucaau

SEQ ID NO: 62978 - RNA, 19 nt, Homo sapiens
aauccaaccuccugucagu

SEQ ID NO: 62979 - RNA, 19 nt, Homo sapiens
caaauccaaccuccuguca

SEQ ID NO: 62980 - RNA, 19 nt, Homo sapiens
gaauggcagguucaaguuc

SEQ ID NO: 62981 - RNA, 19 nt, Homo sapiens
gcaaauaccuccucuacga

SEQ ID NO: 62982 - RNA, 19 nt, Homo sapiens
ggacugaucuccucuacaa

SEQ ID NO: 62983 - RNA, 19 nt, Homo sapiens
gaagaugaguuccaaauca

SEQ ID NO: 62984 - RNA, 19 nt, Homo sapiens
ggcaagaaauguccucaua

SEQ ID NO: 62985 - RNA, 19 nt, Homo sapiens
ggaacaacgugcugcgaua

SEQ ID NO: 62986 - RNA, 19 nt, Homo sapiens
gcacagcccuggacaucaa

SEQ ID NO: 62987 - RNA, 19 nt, Homo sapiens
gagagggccugcauugauu

SEQ ID NO: 62988 - RNA, 19 nt, Homo sapiens
gaaccauacuucauuggaa

SEQ ID NO: 62989 - RNA, 19 nt, Homo sapiens
ugacugaguuugggaauaa

SEQ ID NO: 62990 - RNA, 19 nt, Homo sapiens
gaagaaguaugaauuccau

SEQ ID NO: 62991 - RNA, 19 nt, Homo sapiens
gaaagauugucgaggcaaa

SEQ ID NO: 62992 - RNA, 19 nt, Homo sapiens
ggaacgaggucauguacga

SEQ ID NO: 62993 - RNA, 19 nt, Homo sapiens
ggaugcagguguuugguaa

SEQ ID NO: 62994 - RNA, 19 nt, Homo sapiens
gaaacuugcccuacagaaa

SEQ ID NO: 62995 - RNA, 19 nt, Homo sapiens
ccacaaaggcuccuacuug

SEQ ID NO: 62996 - RNA, 19 nt, Homo sapiens
gcggucggauucauuauaa

SEQ ID NO: 62997 - RNA, 19 nt, Homo sapiens
gggcuucuguugcuuauga

SEQ ID NO: 62998 - RNA, 19 nt, Homo sapiens
gaacuacacccuccugaau

SEQ ID NO: 62999 - RNA, 19 nt, Homo sapiens
cacaaaggcuccuacuuga

SEQ ID NO: 63000 - RNA, 19 nt, Homo sapiens
ggaauaaccucaguaccau

SEQ ID NO: 63001 - RNA, 19 nt, Homo sapiens
cgaauggccucccuuugaa

SEQ ID NO: 63002 - RNA, 19 nt, Homo sapiens
acaagaugauggaggaaua

SEQ ID NO: 63003 - RNA, 19 nt, Homo sapiens
gaaaagacaucaacacgau

SEQ ID NO: 63004 - RNA, 19 nt, Homo sapiens
ccaccaacuucgauacuuu

SEQ ID NO: 63005 - RNA, 19 nt, Homo sapiens
ugaaagagcaacagaagaa

SEQ ID NO: 63006 - RNA, 19 nt, Homo sapiens
ggagaaccaccauaaagaa

SEQ ID NO: 63007 - RNA, 19 nt, Homo sapiens
gcagagaaccagaggagaa

SEQ ID NO: 63008 - RNA, 19 nt, Homo sapiens
caagaaauguccucauagg

SEQ ID NO: 63009 - RNA, 19 nt, Homo sapiens
ccaaaucacugagcacaau

SEQ ID NO: 63010 - RNA, 19 nt, Homo sapiens
ggacagugaugaagaugag

SEQ ID NO: 63011 - RNA, 19 nt, Homo sapiens
ccaaggagguggcagaagu

SEQ ID NO: 63012 - RNA, 19 nt, Homo sapiens
ggaauauucucgacuucau

SEQ ID NO: 63013 - RNA, 19 nt, Homo sapiens
guuacgagcccucagguua

SEQ ID NO: 63014 - RNA, 19 nt, Homo sapiens
ggaaugucauggacuuugu

SEQ ID NO: 63015 - RNA, 19 nt, Homo sapiens
caggagauguuccagaaga

SEQ ID NO: 63016 - RNA, 19 nt, Homo sapiens
gcacugacgaguccaaaga

SEQ ID NO: 63017 - RNA, 19 nt, Homo sapiens
aaagacaucaacacgauua

SEQ ID NO: 63018 - RNA, 19 nt, Homo sapiens
gcagaggcaucccuuugau

SEQ ID NO: 63019 - RNA, 19 nt, Homo sapiens
ggacagaccugagcaugac

SEQ ID NO: 63020 - RNA, 19 nt, Homo sapiens
ucacugagcacaauaacuu

SEQ ID NO: 63021 - RNA, 19 nt, Homo sapiens
gcagaucggccuccuccua

SEQ ID NO: 63022 - RNA, 19 nt, Homo sapiens
gagcgucuccgcagucgua

SEQ ID NO: 63023 - RNA, 19 nt, Homo sapiens
gaacaucuucgacuuugug

SEQ ID NO: 63024 - RNA, 19 nt, Homo sapiens
gaauauucucgacuucaua

SEQ ID NO: 63025 - RNA, 19 nt, Homo sapiens
gggaaaccgugugauaaga

SEQ ID NO: 63026 - RNA, 19 nt, Homo sapiens
ugaauuccauuacgacaau

SEQ ID NO: 63027 - RNA, 19 nt, Homo sapiens
gagaaccaccauaaagaaa

SEQ ID NO: 63028 - RNA, 19 nt, Homo sapiens
ggaccgcuaugcccaggaa

SEQ ID NO: 63029 - RNA, 19 nt, Homo sapiens
ccacagguccucaagcauu

SEQ ID NO: 63030 - RNA, 19 nt, Homo sapiens
gagcagaggcaucccuuug

SEQ ID NO: 63031 - RNA, 19 nt, Homo sapiens
ggaaaccgugugauaagaa

SEQ ID NO: 63032 - RNA, 19 nt, Homo sapiens
ggaauaacuucaucaaccu

SEQ ID NO: 63033 - RNA, 19 nt, Homo sapiens
gggaggcccuguauaacga

SEQ ID NO: 63034 - RNA, 19 nt, Homo sapiens
caucugggcugucauaaaa

SEQ ID NO: 63035 - RNA, 19 nt, Homo sapiens
aggaauggcuggaauguca

SEQ ID NO: 63036 - RNA, 19 nt, Homo sapiens
uuucgaggcuggaauuaaa

SEQ ID NO: 63037 - RNA, 19 nt, Homo sapiens
ggccacacguguccuauuc

SEQ ID NO: 63038 - RNA, 19 nt, Homo sapiens
agaacugccucacgguuaa

SEQ ID NO: 63039 - RNA, 19 nt, Homo sapiens
cagaggauauugacaacau

SEQ ID NO: 63040 - RNA, 19 nt, Homo sapiens
gaucuacgcagccaugaug

SEQ ID NO: 63041 - RNA, 19 nt, Homo sapiens
gaagacaacguggugagaa

SEQ ID NO: 63042 - RNA, 19 nt, Homo sapiens
cccaggagcucaccaagga

SEQ ID NO: 63043 - RNA, 19 nt, Homo sapiens
guacugggcaucucucaga

SEQ ID NO: 63044 - RNA, 19 nt, Homo sapiens
guccugaagucgaucauga

SEQ ID NO: 63045 - RNA, 19 nt, Homo sapiens
gcagcgaaccagaaacuug

SEQ ID NO: 63046 - RNA, 19 nt, Homo sapiens
gaucggccuccuccuauuu

SEQ ID NO: 63047 - RNA, 19 nt, Homo sapiens
gggaauaaccucaguacca

SEQ ID NO: 63048 - RNA, 19 nt, Homo sapiens
caagggaggagccgacaaa

SEQ ID NO: 63049 - RNA, 19 nt, Homo sapiens
ggacgaggacagugaugaa

SEQ ID NO: 63050 - RNA, 19 nt, Homo sapiens
cagaacugccucacgguua

SEQ ID NO: 63051 - RNA, 19 nt, Homo sapiens
gggaguggaagaaguauga

SEQ ID NO: 63052 - RNA, 19 nt, Homo sapiens
ggucaucugggcugucaua

SEQ ID NO: 63053 - RNA, 19 nt, Homo sapiens
ccgaauggccucccuuuga

SEQ ID NO: 63054 - RNA, 19 nt, Homo sapiens
gcuggaaugucauggacuu

SEQ ID NO: 63055 - RNA, 19 nt, Homo sapiens
gcacauggaguccggaaca

SEQ ID NO: 63056 - RNA, 19 nt, Homo sapiens
cuucaucuaugccaucauu

SEQ ID NO: 63057 - RNA, 19 nt, Homo sapiens
ugacgaguccaaagaguuu

SEQ ID NO: 63058 - RNA, 19 nt, Homo sapiens
gcgauacuuugacuacguu

SEQ ID NO: 63059 - RNA, 19 nt, Homo sapiens
ggccaucgcuguggacaau

SEQ ID NO: 63060 - RNA, 19 nt, Homo sapiens
gaucuccucuacaauagca

SEQ ID NO: 63061 - RNA, 19 nt, Homo sapiens
ugucuggaaucccaaguuu

SEQ ID NO: 63062 - RNA, 19 nt, Homo sapiens
ugacaacaccguccacuuc

SEQ ID NO: 63063 - RNA, 19 nt, Homo sapiens
gcucguuucugaugcugaa

SEQ ID NO: 63064 - RNA, 19 nt, Homo sapiens
gcaucagggugccuacuuc

SEQ ID NO: 63065 - RNA, 19 nt, Homo sapiens
gcaacaacaacaccaacaa

SEQ ID NO: 63066 - RNA, 19 nt, Homo sapiens
gccgggaggcccuguauaa

SEQ ID NO: 63067 - RNA, 19 nt, Homo sapiens
ggacuccucccaccaacuu

SEQ ID NO: 63068 - RNA, 19 nt, Homo sapiens
ggaacugguuguacuucau

SEQ ID NO: 63069 - RNA, 19 nt, Homo sapiens
gcaaucauaggguuagaau

SEQ ID NO: 63070 - RNA, 19 nt, Homo sapiens
acagaaccauacuucauug

SEQ ID NO: 63071 - RNA, 19 nt, Homo sapiens
cccaggagauguuccagaa

SEQ ID NO: 63072 - RNA, 19 nt, Homo sapiens
gcaagaaauguccucauag

SEQ ID NO: 63073 - RNA, 19 nt, Homo sapiens
gaaaccgugugauaagaac

SEQ ID NO: 63074 - RNA, 19 nt, Homo sapiens
ggaauacagccuggagaaa

SEQ ID NO: 63075 - RNA, 19 nt, Homo sapiens
gacaucaacacgauuaaau

SEQ ID NO: 63076 - RNA, 19 nt, Homo sapiens
cgugaccucuggaauauuc

SEQ ID NO: 63077 - RNA, 19 nt, Homo sapiens
gaagaaggaggaggaggaa

SEQ ID NO: 63078 - RNA, 19 nt, Homo sapiens
ccaguuuaauuucgaugaa

SEQ ID NO: 63079 - RNA, 19 nt, Homo sapiens
caagacagauuugcucaac

SEQ ID NO: 63080 - RNA, 19 nt, Homo sapiens
ccaaugggaccaaauguca

SEQ ID NO: 63081 - RNA, 19 nt, Homo sapiens
gcaaauaccuccucuacga

SEQ ID NO: 63082 - RNA, 19 nt, Homo sapiens
ggacugaucuccucuacaa

SEQ ID NO: 63083 - RNA, 19 nt, Homo sapiens
gaagaugaguuccaaauca

SEQ ID NO: 63084 - RNA, 19 nt, Homo sapiens
ggcaagaaauguccucaua

SEQ ID NO: 63085 - RNA, 19 nt, Homo sapiens
ggaacaacgugcugcgaua

SEQ ID NO: 63086 - RNA, 19 nt, Homo sapiens
gcacagcccuggacaucaa

SEQ ID NO: 63087 - RNA, 19 nt, Homo sapiens
gagagggccugcauugauu

SEQ ID NO: 63088 - RNA, 19 nt, Homo sapiens
gaaccauacuucauuggaa

SEQ ID NO: 63089 - RNA, 19 nt, Homo sapiens
ugacugaguuugggaauaa

SEQ ID NO: 63090 - RNA, 19 nt, Homo sapiens
gaagaaguaugaauuccau

SEQ ID NO: 63091 - RNA, 19 nt, Homo sapiens
gaaagauugucgaggcaaa

SEQ ID NO: 63092 - RNA, 19 nt, Homo sapiens
ggaacgaggucauguacga

SEQ ID NO: 63093 - RNA, 19 nt, Homo sapiens
ggaugcagguguuugguaa

SEQ ID NO: 63094 - RNA, 19 nt, Homo sapiens
gaaacuugcccuacagaaa

SEQ ID NO: 63095 - RNA, 19 nt, Homo sapiens
ccacaaaggcuccuacuug

SEQ ID NO: 63096 - RNA, 19 nt, Homo sapiens
gcggucggauucauuauaa

SEQ ID NO: 63097 - RNA, 19 nt, Homo sapiens
gggcuucuguugcuuauga

SEQ ID NO: 63098 - RNA, 19 nt, Homo sapiens
gaacuacacccuccugaau

SEQ ID NO: 63099 - RNA, 19 nt, Homo sapiens
cacaaaggcuccuacuuga

SEQ ID NO: 63100 - RNA, 19 nt, Homo sapiens
ggaauaaccucaguaccau

SEQ ID NO: 63101 - RNA, 19 nt, Homo sapiens
cgaauggccucccuuugaa

SEQ ID NO: 63102 - RNA, 19 nt, Homo sapiens
acaagaugauggaggaaua

SEQ ID NO: 63103 - RNA, 19 nt, Homo sapiens
gaaaagacaucaacacgau

SEQ ID NO: 63104 - RNA, 19 nt, Homo sapiens
ccaccaacuucgauacuuu

SEQ ID NO: 63105 - RNA, 19 nt, Homo sapiens
ugaaagagcaacagaagaa

SEQ ID NO: 63106 - RNA, 19 nt, Homo sapiens
ggagaaccaccauaaagaa

SEQ ID NO: 63107 - RNA, 19 nt, Homo sapiens
gcagagaaccagaggagaa

SEQ ID NO: 63108 - RNA, 19 nt, Homo sapiens
caagaaauguccucauagg

SEQ ID NO: 63109 - RNA, 19 nt, Homo sapiens
ccaaaucacugagcacaau

SEQ ID NO: 63110 - RNA, 19 nt, Homo sapiens
ggacagugaugaagaugag

SEQ ID NO: 63111 - RNA, 19 nt, Homo sapiens
ccaaggagguggcagaagu

SEQ ID NO: 63112 - RNA, 19 nt, Homo sapiens
ggaauauucucgacuucau

SEQ ID NO: 63113 - RNA, 19 nt, Homo sapiens
guuacgagcccucagguua

SEQ ID NO: 63114 - RNA, 19 nt, Homo sapiens
ggaaugucauggacuuugu

SEQ ID NO: 63115 - RNA, 19 nt, Homo sapiens
caggagauguuccagaaga

SEQ ID NO: 63116 - RNA, 19 nt, Homo sapiens
gcacugacgaguccaaaga

SEQ ID NO: 63117 - RNA, 19 nt, Homo sapiens
aaagacaucaacacgauua

SEQ ID NO: 63118 - RNA, 19 nt, Homo sapiens
gcagaggcaucccuuugau

SEQ ID NO: 63119 - RNA, 19 nt, Homo sapiens
ggacagaccugagcaugac

SEQ ID NO: 63120 - RNA, 19 nt, Homo sapiens
ucacugagcacaauaacuu

SEQ ID NO: 63121 - RNA, 19 nt, Homo sapiens
gcagaucggccuccuccua

SEQ ID NO: 63122 - RNA, 19 nt, Homo sapiens
gagcgucuccgcagucgua

SEQ ID NO: 63123 - RNA, 19 nt, Homo sapiens
gaacaucuucgacuuugug

SEQ ID NO: 63124 - RNA, 19 nt, Homo sapiens
gaauauucucgacuucaua

SEQ ID NO: 63125 - RNA, 19 nt, Homo sapiens
gggaaaccgugugauaaga

SEQ ID NO: 63126 - RNA, 19 nt, Homo sapiens
ugaauuccauuacgacaau

SEQ ID NO: 63127 - RNA, 19 nt, Homo sapiens
gagaaccaccauaaagaaa

SEQ ID NO: 63128 - RNA, 19 nt, Homo sapiens
ggaccgcuaugcccaggaa

SEQ ID NO: 63129 - RNA, 19 nt, Homo sapiens
ccacagguccucaagcauu

SEQ ID NO: 63130 - RNA, 19 nt, Homo sapiens
gagcagaggcaucccuuug

SEQ ID NO: 63131 - RNA, 19 nt, Homo sapiens
ggaaaccgugugauaagaa

SEQ ID NO: 63132 - RNA, 19 nt, Homo sapiens
ggaauaacuucaucaaccu

SEQ ID NO: 63133 - RNA, 19 nt, Homo sapiens
gggaggcccuguauaacga

SEQ ID NO: 63134 - RNA, 19 nt, Homo sapiens
caucugggcugucauaaaa

SEQ ID NO: 63135 - RNA, 19 nt, Homo sapiens
aggaauggcuggaauguca

SEQ ID NO: 63136 - RNA, 19 nt, Homo sapiens
uuucgaggcuggaauuaaa

SEQ ID NO: 63137 - RNA, 19 nt, Homo sapiens
ggccacacguguccuauuc

SEQ ID NO: 63138 - RNA, 19 nt, Homo sapiens
agaacugccucacgguuaa

SEQ ID NO: 63139 - RNA, 19 nt, Homo sapiens
cagaggauauugacaacau

SEQ ID NO: 63140 - RNA, 19 nt, Homo sapiens
gaucuacgcagccaugaug

SEQ ID NO: 63141 - RNA, 19 nt, Homo sapiens
gaagacaacguggugagaa

SEQ ID NO: 63142 - RNA, 19 nt, Homo sapiens
cccaggagcucaccaagga

SEQ ID NO: 63143 - RNA, 19 nt, Homo sapiens
guacugggcaucucucaga

SEQ ID NO: 63144 - RNA, 19 nt, Homo sapiens
guccugaagucgaucauga

SEQ ID NO: 63145 - RNA, 19 nt, Homo sapiens
gcagcgaaccagaaacuug

SEQ ID NO: 63146 - RNA, 19 nt, Homo sapiens
gaucggccuccuccuauuu

SEQ ID NO: 63147 - RNA, 19 nt, Homo sapiens
gggaauaaccucaguacca

SEQ ID NO: 63148 - RNA, 19 nt, Homo sapiens
caagggaggagccgacaaa

SEQ ID NO: 63149 - RNA, 19 nt, Homo sapiens
ggacgaggacagugaugaa

SEQ ID NO: 63150 - RNA, 19 nt, Homo sapiens
cagaacugccucacgguua

SEQ ID NO: 63151 - RNA, 19 nt, Homo sapiens
gggaguggaagaaguauga

SEQ ID NO: 63152 - RNA, 19 nt, Homo sapiens
ggucaucugggcugucaua

SEQ ID NO: 63153 - RNA, 19 nt, Homo sapiens
ccgaauggccucccuuuga

SEQ ID NO: 63154 - RNA, 19 nt, Homo sapiens
gcuggaaugucauggacuu

SEQ ID NO: 63155 - RNA, 19 nt, Homo sapiens
gcacauggaguccggaaca

SEQ ID NO: 63156 - RNA, 19 nt, Homo sapiens
cuucaucuaugccaucauu

SEQ ID NO: 63157 - RNA, 19 nt, Homo sapiens
ugacgaguccaaagaguuu

SEQ ID NO: 63158 - RNA, 19 nt, Homo sapiens
gcgauacuuugacuacguu

SEQ ID NO: 63159 - RNA, 19 nt, Homo sapiens
ggccaucgcuguggacaau

SEQ ID NO: 63160 - RNA, 19 nt, Homo sapiens
gaucuccucuacaauagca

SEQ ID NO: 63161 - RNA, 19 nt, Homo sapiens
ugucuggaaucccaaguuu

SEQ ID NO: 63162 - RNA, 19 nt, Homo sapiens
ugacaacaccguccacuuc

SEQ ID NO: 63163 - RNA, 19 nt, Homo sapiens
gcucguuucugaugcugaa

SEQ ID NO: 63164 - RNA, 19 nt, Homo sapiens
gcaucagggugccuacuuc

SEQ ID NO: 63165 - RNA, 19 nt, Homo sapiens
gcaacaacaacaccaacaa

SEQ ID NO: 63166 - RNA, 19 nt, Homo sapiens
gccgggaggcccuguauaa

SEQ ID NO: 63167 - RNA, 19 nt, Homo sapiens
ggacuccucccaccaacuu

SEQ ID NO: 63168 - RNA, 19 nt, Homo sapiens
ggaacugguuguacuucau

SEQ ID NO: 63169 - RNA, 19 nt, Homo sapiens
gcaaucauaggguuagaau

SEQ ID NO: 63170 - RNA, 19 nt, Homo sapiens
acagaaccauacuucauug

SEQ ID NO: 63171 - RNA, 19 nt, Homo sapiens
cccaggagauguuccagaa

SEQ ID NO: 63172 - RNA, 19 nt, Homo sapiens
gcaagaaauguccucauag

SEQ ID NO: 63173 - RNA, 19 nt, Homo sapiens
gaaaccgugugauaagaac

SEQ ID NO: 63174 - RNA, 19 nt, Homo sapiens
ggaauacagccuggagaaa

SEQ ID NO: 63175 - RNA, 19 nt, Homo sapiens
gacaucaacacgauuaaau

SEQ ID NO: 63176 - RNA, 19 nt, Homo sapiens
cgugaccucuggaauauuc

SEQ ID NO: 63177 - RNA, 19 nt, Homo sapiens
gaagaaggaggaggaggaa

SEQ ID NO: 63178 - RNA, 19 nt, Homo sapiens
ccaguuuaauuucgaugaa

SEQ ID NO: 63179 - RNA, 19 nt, Homo sapiens
caagacagauuugcucaac

SEQ ID NO: 63180 - RNA, 19 nt, Homo sapiens
ccaaugggaccaaauguca

SEQ ID NO: 63181 - RNA, 19 nt, Homo sapiens
ggacugacauccucuauaa

SEQ ID NO: 63182 - RNA, 19 nt, Homo sapiens
gaacaacgcucugaaauac

SEQ ID NO: 63183 - RNA, 19 nt, Homo sapiens
ggacaugacuguucacuuc

SEQ ID NO: 63184 - RNA, 19 nt, Homo sapiens
gaaaugcccugcucgaguu

SEQ ID NO: 63185 - RNA, 19 nt, Homo sapiens
ggaaagacaucaauaccau

SEQ ID NO: 63186 - RNA, 19 nt, Homo sapiens
ggaacaacgcucugaaaua

SEQ ID NO: 63187 - RNA, 19 nt, Homo sapiens
ugaaauaccuggauuacau

SEQ ID NO: 63188 - RNA, 19 nt, Homo sapiens
gaaggaggcugagauagug

SEQ ID NO: 63189 - RNA, 19 nt, Homo sapiens
gagcagaaaugaccugauc

SEQ ID NO: 63190 - RNA, 19 nt, Homo sapiens
uaacagagauugcggaaac

SEQ ID NO: 63191 - RNA, 19 nt, Homo sapiens
ucacagagaugucccugaa

SEQ ID NO: 63192 - RNA, 19 nt, Homo sapiens
ggacggcacuggagaucaa

SEQ ID NO: 63193 - RNA, 19 nt, Homo sapiens
uauaagacguggacauuug

SEQ ID NO: 63194 - RNA, 19 nt, Homo sapiens
ggagaaggaggcugagaua

SEQ ID NO: 63195 - RNA, 19 nt, Homo sapiens
caaagcagcaucaguguga

SEQ ID NO: 63196 - RNA, 19 nt, Homo sapiens
ggaagcggaugacgugaug

SEQ ID NO: 63197 - RNA, 19 nt, Homo sapiens
ccaaagaaguggcugaagu

SEQ ID NO: 63198 - RNA, 19 nt, Homo sapiens
ccaagagaguggcaucaaa

SEQ ID NO: 63199 - RNA, 19 nt, Homo sapiens
ggcagucguuccaguauaa

SEQ ID NO: 63200 - RNA, 19 nt, Homo sapiens
guucauauuugccgucauu

SEQ ID NO: 63201 - RNA, 19 nt, Homo sapiens
ggaacuggcucuacuucau

SEQ ID NO: 63202 - RNA, 19 nt, Homo sapiens
gaugauauuugacuucuac

SEQ ID NO: 63203 - RNA, 19 nt, Homo sapiens
cccaagagcugaccaagga

SEQ ID NO: 63204 - RNA, 19 nt, Homo sapiens
ccagaagacuuuggacuug

SEQ ID NO: 63205 - RNA, 19 nt, Homo sapiens
ugauaaagaugaucgacuu

SEQ ID NO: 63206 - RNA, 19 nt, Homo sapiens
agacagagagcucgucaua

SEQ ID NO: 63207 - RNA, 19 nt, Homo sapiens
gaaauaccuggauuacauu

SEQ ID NO: 63208 - RNA, 19 nt, Homo sapiens
cgaacacuauuguacauau

SEQ ID NO: 63209 - RNA, 19 nt, Homo sapiens
gagaagauguuccgguuuu

SEQ ID NO: 63210 - RNA, 19 nt, Homo sapiens
ucaccaacuuugacaauau

SEQ ID NO: 63211 - RNA, 19 nt, Homo sapiens
ccauaagccugaugagaug

SEQ ID NO: 63212 - RNA, 19 nt, Homo sapiens
gaacacuauuguacauauc

SEQ ID NO: 63213 - RNA, 19 nt, Homo sapiens
gaaacuacacucugcugaa

SEQ ID NO: 63214 - RNA, 19 nt, Homo sapiens
gucaguauuuggauuauga

SEQ ID NO: 63215 - RNA, 19 nt, Homo sapiens
ugaacucccugaagaaugu

SEQ ID NO: 63216 - RNA, 19 nt, Homo sapiens
gcucugaaauaccuggauu

SEQ ID NO: 63217 - RNA, 19 nt, Homo sapiens
ugucugggauuccaaguuu

SEQ ID NO: 63218 - RNA, 19 nt, Homo sapiens
gaaggagauuuccguugug

SEQ ID NO: 63219 - RNA, 19 nt, Homo sapiens
gcgggacucuuccauccua

SEQ ID NO: 63220 - RNA, 19 nt, Homo sapiens
acagagaugucccugaaga

SEQ ID NO: 63221 - RNA, 19 nt, Homo sapiens
aaucaucgcucugggcuuu

SEQ ID NO: 63222 - RNA, 19 nt, Homo sapiens
guggugaacucccugaaga

SEQ ID NO: 63223 - RNA, 19 nt, Homo sapiens
gcacagacucgcccaggaa

SEQ ID NO: 63224 - RNA, 19 nt, Homo sapiens
gaagaagcagccaaucaga

SEQ ID NO: 63225 - RNA, 19 nt, Homo sapiens
ggaggaaggagaagauguu

SEQ ID NO: 63226 - RNA, 19 nt, Homo sapiens
acagagagcucgucauacu

SEQ ID NO: 63227 - RNA, 19 nt, Homo sapiens
ggagggagaggaccgguuu

SEQ ID NO: 63228 - RNA, 19 nt, Homo sapiens
acaaugacauguuugagau

SEQ ID NO: 63229 - RNA, 19 nt, Homo sapiens
ggaaugucuuugacuuugu

SEQ ID NO: 63230 - RNA, 19 nt, Homo sapiens
caacaucuuuguggcuuug

SEQ ID NO: 63231 - RNA, 19 nt, Homo sapiens
gcacagaugaauccaagga

SEQ ID NO: 63232 - RNA, 19 nt, Homo sapiens
gagcagcaccucccugaug

SEQ ID NO: 63233 - RNA, 19 nt, Homo sapiens
gaauuggcucugacccuua

SEQ ID NO: 63234 - RNA, 19 nt, Homo sapiens
gaacauucuggacuucauu

SEQ ID NO: 63235 - RNA, 19 nt, Homo sapiens
ccuuugagauggugauaaa

SEQ ID NO: 63236 - RNA, 19 nt, Homo sapiens
ccaagaagagcagaaauga

SEQ ID NO: 63237 - RNA, 19 nt, Homo sapiens
gacauccucuauaauacaa

SEQ ID NO: 63238 - RNA, 19 nt, Homo sapiens
caguuacaaugacauguuu

SEQ ID NO: 63239 - RNA, 19 nt, Homo sapiens
guauuuggauuaugagaag

SEQ ID NO: 63240 - RNA, 19 nt, Homo sapiens
aaacuacacucugcugaau

SEQ ID NO: 63241 - RNA, 19 nt, Homo sapiens
cugaggaucuucaaaguca

SEQ ID NO: 63242 - RNA, 19 nt, Homo sapiens
gugcucaaguccaucauga

SEQ ID NO: 63243 - RNA, 19 nt, Homo sapiens
uuaugcagcucugaugaua

SEQ ID NO: 63244 - RNA, 19 nt, Homo sapiens
gaacgagagggcuugcauu

SEQ ID NO: 63245 - RNA, 19 nt, Homo sapiens
agaugucccugaagaugua

SEQ ID NO: 63246 - RNA, 19 nt, Homo sapiens
acugacauccucuauaaua

SEQ ID NO: 63247 - RNA, 19 nt, Homo sapiens
gggcagugguuccgugaau

SEQ ID NO: 63248 - RNA, 19 nt, Homo sapiens
ggaauauugcccuggauga

SEQ ID NO: 63249 - RNA, 19 nt, Homo sapiens
gcagguguuugggaauauu

SEQ ID NO: 63250 - RNA, 19 nt, Homo sapiens
caaccaacuucgacaccuu

SEQ ID NO: 63251 - RNA, 19 nt, Homo sapiens
ugaaaugccugaacaucgu

SEQ ID NO: 63252 - RNA, 19 nt, Homo sapiens
ugauagcccucaacacugu

SEQ ID NO: 63253 - RNA, 19 nt, Homo sapiens
gagauggugauaaagauga

SEQ ID NO: 63254 - RNA, 19 nt, Homo sapiens
ccauacagcuccauguucu

SEQ ID NO: 63255 - RNA, 19 nt, Homo sapiens
cagcucugaugauauuuga

SEQ ID NO: 63256 - RNA, 19 nt, Homo sapiens
cgagagggcuugcauugac

SEQ ID NO: 63257 - RNA, 19 nt, Homo sapiens
gaaugcagccuggagaaga

SEQ ID NO: 63258 - RNA, 19 nt, Homo sapiens
ggucuacuuuguggucuuu

SEQ ID NO: 63259 - RNA, 19 nt, Homo sapiens
ggaagaagcagccaaucag

SEQ ID NO: 63260 - RNA, 19 nt, Homo sapiens
ccucauguuugccaucauu

SEQ ID NO: 63261 - RNA, 19 nt, Homo sapiens
gcuccuuucugauguugaa

SEQ ID NO: 63262 - RNA, 19 nt, Homo sapiens
gcucuucauguucauauuu

SEQ ID NO: 63263 - RNA, 19 nt, Homo sapiens
ggaacauucuggacuucau

SEQ ID NO: 63264 - RNA, 19 nt, Homo sapiens
ucacuggugucuuuaccuu

SEQ ID NO: 63265 - RNA, 19 nt, Homo sapiens
gccagaggaugcagacaau

SEQ ID NO: 63266 - RNA, 19 nt, Homo sapiens
guguggccauggugcauua

SEQ ID NO: 63267 - RNA, 19 nt, Homo sapiens
ucauuggccuggaguucua

SEQ ID NO: 63268 - RNA, 19 nt, Homo sapiens
gcuggaacgucauggacuu

SEQ ID NO: 63269 - RNA, 19 nt, Homo sapiens
augcagcucugaugauauu

SEQ ID NO: 63270 - RNA, 19 nt, Homo sapiens
gaaugucuuugacuuuguc

SEQ ID NO: 63271 - RNA, 19 nt, Homo sapiens
ccaggcaguggaagaaaua

SEQ ID NO: 63272 - RNA, 19 nt, Homo sapiens
gaacuggcucuacuucauc

SEQ ID NO: 63273 - RNA, 19 nt, Homo sapiens
ggcagcgucuggacaguga

SEQ ID NO: 63274 - RNA, 19 nt, Homo sapiens
gagaguggcaucaaagagu

SEQ ID NO: 63275 - RNA, 19 nt, Homo sapiens
acaaggugaugucugaaug

SEQ ID NO: 63276 - RNA, 19 nt, Homo sapiens
caucuugauugucuacaug

SEQ ID NO: 63277 - RNA, 19 nt, Homo sapiens
ucaauaccaucaagucucu

SEQ ID NO: 63278 - RNA, 19 nt, Homo sapiens
uggaaugucuuugacuuug

SEQ ID NO: 63279 - RNA, 19 nt, Homo sapiens
agagaugccuggaaugucu

SEQ ID NO: 63280 - RNA, 19 nt, Homo sapiens
ucaaacggcugcccaagcu

SEQ ID NO: 63281 - RNA, 19 nt, Homo sapiens
ggaauucggugauguauga

SEQ ID NO: 63282 - RNA, 19 nt, Homo sapiens
gaagaagaguguuuacaaa

SEQ ID NO: 63283 - RNA, 19 nt, Homo sapiens
gaagaaaccguuauacuug

SEQ ID NO: 63284 - RNA, 19 nt, Homo sapiens
ccacggagguucaauagaa

SEQ ID NO: 63285 - RNA, 19 nt, Homo sapiens
gaaacuauauccuacugaa

SEQ ID NO: 63286 - RNA, 19 nt, Homo sapiens
gaaaccauuugcacauauu

SEQ ID NO: 63287 - RNA, 19 nt, Homo sapiens
gcaacuacaucacguacaa

SEQ ID NO: 63288 - RNA, 19 nt, Homo sapiens
gcuggaaccuacuagauuu

SEQ ID NO: 63289 - RNA, 19 nt, Homo sapiens
ucucugagcuucaccuuaa

SEQ ID NO: 63290 - RNA, 19 nt, Homo sapiens
ggaagaagaguguuuacaa

SEQ ID NO: 63291 - RNA, 19 nt, Homo sapiens
gaugagaccuaugaaguga

SEQ ID NO: 63292 - RNA, 19 nt, Homo sapiens
ccaccaagguuccaacuau

SEQ ID NO: 63293 - RNA, 19 nt, Homo sapiens
gaagaguguuuacaaaguc

SEQ ID NO: 63294 - RNA, 19 nt, Homo sapiens
gaucaucaaccucuuugua

SEQ ID NO: 63295 - RNA, 19 nt, Homo sapiens
gaaauugcucugaagauga

SEQ ID NO: 63296 - RNA, 19 nt, Homo sapiens
ggacggacgugcuguacug

SEQ ID NO: 63297 - RNA, 19 nt, Homo sapiens
ggccagagcugccuguuca

SEQ ID NO: 63298 - RNA, 19 nt, Homo sapiens
caggucaguuucaguauuu

SEQ ID NO: 63299 - RNA, 19 nt, Homo sapiens
ggaaccauauucuguuuua

SEQ ID NO: 63300 - RNA, 19 nt, Homo sapiens
gacagaaauuuaagggaaa

SEQ ID NO: 63301 - RNA, 19 nt, Homo sapiens
gcaaacgggugucuuucga

SEQ ID NO: 63302 - RNA, 19 nt, Homo sapiens
ggaaagcuguacaccuguu

SEQ ID NO: 63303 - RNA, 19 nt, Homo sapiens
ggaggaagaagaguguuua

SEQ ID NO: 63304 - RNA, 19 nt, Homo sapiens
gcagagaugcuccugaaga

SEQ ID NO: 63305 - RNA, 19 nt, Homo sapiens
ugaagaaaccguuauacuu

SEQ ID NO: 63306 - RNA, 19 nt, Homo sapiens
uagaaaccauuugcacaua

SEQ ID NO: 63307 - RNA, 19 nt, Homo sapiens
ggaacagcgucuucauuca

SEQ ID NO: 63308 - RNA, 19 nt, Homo sapiens
ccaccaagaucaacaugga

SEQ ID NO: 63309 - RNA, 19 nt, Homo sapiens
ggauguuagucuguauuua

SEQ ID NO: 63310 - RNA, 19 nt, Homo sapiens
agacaucgauccugagaau

SEQ ID NO: 63311 - RNA, 19 nt, Homo sapiens
gcucuucacuggccucuuc

SEQ ID NO: 63312 - RNA, 19 nt, Homo sapiens
ggagaagauugagcugaaa

SEQ ID NO: 63313 - RNA, 19 nt, Homo sapiens
ggacagucauguucaaugc

SEQ ID NO: 63314 - RNA, 19 nt, Homo sapiens
gcaaacgccuggucuccau

SEQ ID NO: 63315 - RNA, 19 nt, Homo sapiens
ccaaugcucucccucuaug

SEQ ID NO: 63316 - RNA, 19 nt, Homo sapiens
ccaagaaccagcaccagua

SEQ ID NO: 63317 - RNA, 19 nt, Homo sapiens
ugaaauugcucugaagaug

SEQ ID NO: 63318 - RNA, 19 nt, Homo sapiens
gagcuucaccuuaaggaaa

SEQ ID NO: 63319 - RNA, 19 nt, Homo sapiens
ggaauaucucuuucucaua

SEQ ID NO: 63320 - RNA, 19 nt, Homo sapiens
ccucgaaucuugcgcgaaa

SEQ ID NO: 63321 - RNA, 19 nt, Homo sapiens
gcugagcgcucuuuuguuu

SEQ ID NO: 63322 - RNA, 19 nt, Homo sapiens
ggguagcauuguugauaua

SEQ ID NO: 63323 - RNA, 19 nt, Homo sapiens
ggucaaugaugccguagga

SEQ ID NO: 63324 - RNA, 19 nt, Homo sapiens
gaaacacccugugguagca

SEQ ID NO: 63325 - RNA, 19 nt, Homo sapiens
caucaucgccuucuucaug

SEQ ID NO: 63326 - RNA, 19 nt, Homo sapiens
caggaaccauauucuguuu

SEQ ID NO: 63327 - RNA, 19 nt, Homo sapiens
gcuagaagaggaucucaaa

SEQ ID NO: 63328 - RNA, 19 nt, Homo sapiens
gggaaucaguaacucuuug

SEQ ID NO: 63329 - RNA, 19 nt, Homo sapiens
ccuaugaagugaagaugaa

SEQ ID NO: 63330 - RNA, 19 nt, Homo sapiens
gcaaccacgucagcuacua

SEQ ID NO: 63331 - RNA, 19 nt, Homo sapiens
acugugagcuggacaagaa

SEQ ID NO: 63332 - RNA, 19 nt, Homo sapiens
ccaaggaggagaagauuga

SEQ ID NO: 63333 - RNA, 19 nt, Homo sapiens
ggacuggaauucggugaug

SEQ ID NO: 63334 - RNA, 19 nt, Homo sapiens
gcagucaagucuaaugucu

SEQ ID NO: 63335 - RNA, 19 nt, Homo sapiens
gaagacaucgauccugaga

SEQ ID NO: 63336 - RNA, 19 nt, Homo sapiens
caccaacuuugacaacuuu

SEQ ID NO: 63337 - RNA, 19 nt, Homo sapiens
gaggaugcguuacaguuuc

SEQ ID NO: 63338 - RNA, 19 nt, Homo sapiens
guuaucauuuccuuaggua

SEQ ID NO: 63339 - RNA, 19 nt, Homo sapiens
gaacagcgucuucauucau

SEQ ID NO: 63340 - RNA, 19 nt, Homo sapiens
gaaccuagaacaagccaau

SEQ ID NO: 63341 - RNA, 19 nt, Homo sapiens
gaccacggcuuccucgaau

SEQ ID NO: 63342 - RNA, 19 nt, Homo sapiens
cggcagagaugcuccugaa

SEQ ID NO: 63343 - RNA, 19 nt, Homo sapiens
ccaacuggcucacagaagu

SEQ ID NO: 63344 - RNA, 19 nt, Homo sapiens
aaagguaacuggcaaugca

SEQ ID NO: 63345 - RNA, 19 nt, Homo sapiens
ggacggcccugaggaucaa

SEQ ID NO: 63346 - RNA, 19 nt, Homo sapiens
aagaaaccguuauacuuga

SEQ ID NO: 63347 - RNA, 19 nt, Homo sapiens
caauauauuccguguaaug

SEQ ID NO: 63348 - RNA, 19 nt, Homo sapiens
gguggaagcggucuugauu

SEQ ID NO: 63349 - RNA, 19 nt, Homo sapiens
gcaaagagcagggccuugu

SEQ ID NO: 63350 - RNA, 19 nt, Homo sapiens
gcacaagaccugcuacaac

SEQ ID NO: 63351 - RNA, 19 nt, Homo sapiens
ccaccuggaugaguuuaaa

SEQ ID NO: 63352 - RNA, 19 nt, Homo sapiens
gagaugcuccugaagaugu

SEQ ID NO: 63353 - RNA, 19 nt, Homo sapiens
cagagaugcuccugaagau

SEQ ID NO: 63354 - RNA, 19 nt, Homo sapiens
cuaauggguucguuucaga

SEQ ID NO: 63355 - RNA, 19 nt, Homo sapiens
gaagggaaccuagaacaag

SEQ ID NO: 63356 - RNA, 19 nt, Homo sapiens
agaagaguguuuacaaagu

SEQ ID NO: 63357 - RNA, 19 nt, Homo sapiens
ggucuugauuucagaagga

SEQ ID NO: 63358 - RNA, 19 nt, Homo sapiens
gaagcggucuugauuucag

SEQ ID NO: 63359 - RNA, 19 nt, Homo sapiens
aagugaagaugaaccauga

SEQ ID NO: 63360 - RNA, 19 nt, Homo sapiens
caaucaaugucgugaagau

SEQ ID NO: 63361 - RNA, 19 nt, Homo sapiens
ccauugaaauugcucugaa

SEQ ID NO: 63362 - RNA, 19 nt, Homo sapiens
ccagggauguuagucugua

SEQ ID NO: 63363 - RNA, 19 nt, Homo sapiens
ggaggagcacauucgauaa

SEQ ID NO: 63364 - RNA, 19 nt, Homo sapiens
cggaggagcacauucgaua

SEQ ID NO: 63365 - RNA, 19 nt, Homo sapiens
uggaagcggucuugauuuc

SEQ ID NO: 63366 - RNA, 19 nt, Homo sapiens
ggagguacauccccaagaa

SEQ ID NO: 63367 - RNA, 19 nt, Homo sapiens
ccuauggacuccucuuuca

SEQ ID NO: 63368 - RNA, 19 nt, Homo sapiens
gcgaccaucuccacaguca

SEQ ID NO: 63369 - RNA, 19 nt, Homo sapiens
ucaggucaguuucaguauu

SEQ ID NO: 63370 - RNA, 19 nt, Homo sapiens
ugaguuguguuggcauuaa

SEQ ID NO: 63371 - RNA, 19 nt, Homo sapiens
cauauguccugcccgugua

SEQ ID NO: 63372 - RNA, 19 nt, Homo sapiens
ucaccaaccugauccucuu

SEQ ID NO: 63373 - RNA, 19 nt, Homo sapiens
ggagcacauucgauaacuu

SEQ ID NO: 63374 - RNA, 19 nt, Homo sapiens
ggacuggcccuggaucuau

SEQ ID NO: 63375 - RNA, 19 nt, Homo sapiens
uauauucccuuuccagaag

SEQ ID NO: 63376 - RNA, 19 nt, Homo sapiens
gauaauguuucuguugaag

SEQ ID NO: 63377 - RNA, 19 nt, Homo sapiens
ucaguaacucuuugcauuu

SEQ ID NO: 63378 - RNA, 19 nt, Homo sapiens
ggaugagaccuaugaagug

SEQ ID NO: 63379 - RNA, 19 nt, Homo sapiens
ggucaccguuggcaaguuc

SEQ ID NO: 63380 - RNA, 19 nt, Homo sapiens
gagaucaaccggaacaaca

SEQ ID NO: 63381 - RNA, 19 nt, Homo sapiens
gaauaugccuuccugauua

SEQ ID NO: 63382 - RNA, 19 nt, Homo sapiens
gaacagcucccaacuauuu

SEQ ID NO: 63383 - RNA, 19 nt, Homo sapiens
gaaauucggugugucauaa

SEQ ID NO: 63384 - RNA, 19 nt, Homo sapiens
gaaaguacccugcgaagaa

SEQ ID NO: 63385 - RNA, 19 nt, Homo sapiens
gaacaugccucucaacagu

SEQ ID NO: 63386 - RNA, 19 nt, Homo sapiens
gauuauagcguauggauua

SEQ ID NO: 63387 - RNA, 19 nt, Homo sapiens
gaacggcucuuaagaucaa

SEQ ID NO: 63388 - RNA, 19 nt, Homo sapiens
ggacauugcuguggacuuu

SEQ ID NO: 63389 - RNA, 19 nt, Homo sapiens
cgaagagccugcauuagua

SEQ ID NO: 63390 - RNA, 19 nt, Homo sapiens
ggagcaagcuaaugaagaa

SEQ ID NO: 63391 - RNA, 19 nt, Homo sapiens
gaacacugcucagaaagaa

SEQ ID NO: 63392 - RNA, 19 nt, Homo sapiens
guccugaacuccauuauaa

SEQ ID NO: 63393 - RNA, 19 nt, Homo sapiens
ggaacacgauacuggguua

SEQ ID NO: 63394 - RNA, 19 nt, Homo sapiens
ugacacagauucaagauau

SEQ ID NO: 63395 - RNA, 19 nt, Homo sapiens
gauaacaaccagaucaaua

SEQ ID NO: 63396 - RNA, 19 nt, Homo sapiens
ccgaauagcuccaagcaaa

SEQ ID NO: 63397 - RNA, 19 nt, Homo sapiens
gaaaagugccucauaguua

SEQ ID NO: 63398 - RNA, 19 nt, Homo sapiens
gaucauccuuggcucauuu

SEQ ID NO: 63399 - RNA, 19 nt, Homo sapiens
ggacagacgugcucuacug

SEQ ID NO: 63400 - RNA, 19 nt, Homo sapiens
gaacaucuuugugggcuuu

SEQ ID NO: 63401 - RNA, 19 nt, Homo sapiens
ggaaaccauuugacauauu

SEQ ID NO: 63402 - RNA, 19 nt, Homo sapiens
gagcaggaguauuucagua

SEQ ID NO: 63403 - RNA, 19 nt, Homo sapiens
gaagagagcaauagaaucu

SEQ ID NO: 63404 - RNA, 19 nt, Homo sapiens
cggcaaaucuggaggcuuu

SEQ ID NO: 63405 - RNA, 19 nt, Homo sapiens
cagagaagguccaguguga

SEQ ID NO: 63406 - RNA, 19 nt, Homo sapiens
gaggaaggcaaacgaaaua

SEQ ID NO: 63407 - RNA, 19 nt, Homo sapiens
agaagaagaugauguguuc

SEQ ID NO: 63408 - RNA, 19 nt, Homo sapiens
gaacggaucuggcaaaaca

SEQ ID NO: 63409 - RNA, 19 nt, Homo sapiens
acaacaagguuacaauuga

SEQ ID NO: 63410 - RNA, 19 nt, Homo sapiens
caacuuaguggcauccuua

SEQ ID NO: 63411 - RNA, 19 nt, Homo sapiens
gaaggcaaacgaaauacua

SEQ ID NO: 63412 - RNA, 19 nt, Homo sapiens
caacaaaucauaacuugga

SEQ ID NO: 63413 - RNA, 19 nt, Homo sapiens
caaguaaagcccagaagua

SEQ ID NO: 63414 - RNA, 19 nt, Homo sapiens
gaaaagaacccgcuauuau

SEQ ID NO: 63415 - RNA, 19 nt, Homo sapiens
gcgaagaacaccacaauug

SEQ ID NO: 63416 - RNA, 19 nt, Homo sapiens
ugaaagucaucgcauuuaa

SEQ ID NO: 63417 - RNA, 19 nt, Homo sapiens
ggacaucgauccggagaau

SEQ ID NO: 63418 - RNA, 19 nt, Homo sapiens
ggacccaacugaaagugaa

SEQ ID NO: 63419 - RNA, 19 nt, Homo sapiens
gaaagaagaagcggaagaa

SEQ ID NO: 63420 - RNA, 19 nt, Homo sapiens
ggagcaccuuugacaauuu

SEQ ID NO: 63421 - RNA, 19 nt, Homo sapiens
cuaaagggcuacuuggauu

SEQ ID NO: 63422 - RNA, 19 nt, Homo sapiens
gauggaauuuacuggauuu

SEQ ID NO: 63423 - RNA, 19 nt, Homo sapiens
gauuauugcuacauccuaa

SEQ ID NO: 63424 - RNA, 19 nt, Homo sapiens
caaaugccaaucucaauaa

SEQ ID NO: 63425 - RNA, 19 nt, Homo sapiens
aaacagugauuucaacuuc

SEQ ID NO: 63426 - RNA, 19 nt, Homo sapiens
ggaaugcugugauguacga

SEQ ID NO: 63427 - RNA, 19 nt, Homo sapiens
cugaacaccuuaaccauuu

SEQ ID NO: 63428 - RNA, 19 nt, Homo sapiens
guuuagcuguucugaaaua

SEQ ID NO: 63429 - RNA, 19 nt, Homo sapiens
cauuguagcuuucuucaug

SEQ ID NO: 63430 - RNA, 19 nt, Homo sapiens
gaacaucggcccaaucuac

SEQ ID NO: 63431 - RNA, 19 nt, Homo sapiens
ggccaucgcuguagacaau

SEQ ID NO: 63432 - RNA, 19 nt, Homo sapiens
ggacuucccugagcaacuu

SEQ ID NO: 63433 - RNA, 19 nt, Homo sapiens
gacgaugacucgcccguuu

SEQ ID NO: 63434 - RNA, 19 nt, Homo sapiens
gcacgucccuugcggagau

SEQ ID NO: 63435 - RNA, 19 nt, Homo sapiens
caauuuggcugaugcugaa

SEQ ID NO: 63436 - RNA, 19 nt, Homo sapiens
guaggauuguuuaguguaa

SEQ ID NO: 63437 - RNA, 19 nt, Homo sapiens
gagauccuguugaagauga

SEQ ID NO: 63438 - RNA, 19 nt, Homo sapiens
gaaaagagagccuagaaaa

SEQ ID NO: 63439 - RNA, 19 nt, Homo sapiens
gcaccagacuuccucuuuc

SEQ ID NO: 63440 - RNA, 19 nt, Homo sapiens
gcacuaguugggaguaaua

SEQ ID NO: 63441 - RNA, 19 nt, Homo sapiens
gaacuucgggcugugauaa

SEQ ID NO: 63442 - RNA, 19 nt, Homo sapiens
gcaggaacuacuucaauuu

SEQ ID NO: 63443 - RNA, 19 nt, Homo sapiens
cgaaggaucucggaguuga

SEQ ID NO: 63444 - RNA, 19 nt, Homo sapiens
ggaucucucucccaaagaa

SEQ ID NO: 63445 - RNA, 19 nt, Homo sapiens
ggaaauucggugugucaua

SEQ ID NO: 63446 - RNA, 19 nt, Homo sapiens
ggacagucauguuuaaugc

SEQ ID NO: 63447 - RNA, 19 nt, Homo sapiens
ggccugcguugcuguauaa

SEQ ID NO: 63448 - RNA, 19 nt, Homo sapiens
caacaagguuacaauugau

SEQ ID NO: 63449 - RNA, 19 nt, Homo sapiens
ggaagaaggaggagaggaa

SEQ ID NO: 63450 - RNA, 19 nt, Homo sapiens
ggauggaauuuacuggauu

SEQ ID NO: 63451 - RNA, 19 nt, Homo sapiens
gagauccuccuucaacuuu

SEQ ID NO: 63452 - RNA, 19 nt, Homo sapiens
acacaguagucgcucaaua

SEQ ID NO: 63453 - RNA, 19 nt, Homo sapiens
ggccuuagcuauuuacauc

SEQ ID NO: 63454 - RNA, 19 nt, Homo sapiens
agagauacauggcuauuuc

SEQ ID NO: 63455 - RNA, 19 nt, Homo sapiens
gagaagguccagugugaaa

SEQ ID NO: 63456 - RNA, 19 nt, Homo sapiens
gagauuaguugccaugaac

SEQ ID NO: 63457 - RNA, 19 nt, Homo sapiens
aguagucgcucaauaaaug

SEQ ID NO: 63458 - RNA, 19 nt, Homo sapiens
gcagauguuugggaaaguu

SEQ ID NO: 63459 - RNA, 19 nt, Homo sapiens
gaagcggacccaacugaaa

SEQ ID NO: 63460 - RNA, 19 nt, Homo sapiens
ucacuacccuccugcaguu

SEQ ID NO: 63461 - RNA, 19 nt, Homo sapiens
gcaagaggcaccagacuuc

SEQ ID NO: 63462 - RNA, 19 nt, Homo sapiens
gagaagaggaugaagacaa

SEQ ID NO: 63463 - RNA, 19 nt, Homo sapiens
caccaacuuugauaacuuu

SEQ ID NO: 63464 - RNA, 19 nt, Homo sapiens
caacaaaugccaaucucaa

SEQ ID NO: 63465 - RNA, 19 nt, Homo sapiens
ccagaaauccggcgugcua

SEQ ID NO: 63466 - RNA, 19 nt, Homo sapiens
aaagaacccgcuauuauga

SEQ ID NO: 63467 - RNA, 19 nt, Homo sapiens
caagcaaacuguccugucu

SEQ ID NO: 63468 - RNA, 19 nt, Homo sapiens
gaacaacaaaccagaaguc

SEQ ID NO: 63469 - RNA, 19 nt, Homo sapiens
cuuaguggcauccuuauua

SEQ ID NO: 63470 - RNA, 19 nt, Homo sapiens
ggaccuggcggaugaaaug

SEQ ID NO: 63471 - RNA, 19 nt, Homo sapiens
gaaauccggcgugcuauau

SEQ ID NO: 63472 - RNA, 19 nt, Homo sapiens
gaagaaaaccagcaugaaa

SEQ ID NO: 63473 - RNA, 19 nt, Homo sapiens
gcaagcuaaugaagaacuu

SEQ ID NO: 63474 - RNA, 19 nt, Homo sapiens
gaucaucaaucuguuugug

SEQ ID NO: 63475 - RNA, 19 nt, Homo sapiens
aguccaagauguucaauga

SEQ ID NO: 63476 - RNA, 19 nt, Homo sapiens
gggaaguucuaucgcugua

SEQ ID NO: 63477 - RNA, 19 nt, Homo sapiens
ccagauugguugacacaga

SEQ ID NO: 63478 - RNA, 19 nt, Homo sapiens
gcagauacccaggcagaaa

SEQ ID NO: 63479 - RNA, 19 nt, Homo sapiens
ccaaaggccuucaauucca

SEQ ID NO: 63480 - RNA, 19 nt, Homo sapiens
ggaaugaucgucugcaucu

SEQ ID NO: 63481 - RNA, 19 nt, Homo sapiens
ggacagcucuggacauuaa

SEQ ID NO: 63482 - RNA, 19 nt, Homo sapiens
ggaaugaggugauguacaa

SEQ ID NO: 63483 - RNA, 19 nt, Homo sapiens
ccaagaagcucaucgauug

SEQ ID NO: 63484 - RNA, 19 nt, Homo sapiens
ggaggcagguuuaacuuua

SEQ ID NO: 63485 - RNA, 19 nt, Homo sapiens
gcagguauuuggaaacaua

SEQ ID NO: 63486 - RNA, 19 nt, Homo sapiens
gacagaaccuuauuucauu

SEQ ID NO: 63487 - RNA, 19 nt, Homo sapiens
ggaagaagaugacaaaugc

SEQ ID NO: 63488 - RNA, 19 nt, Homo sapiens
gcaacaaaguccugaggua

SEQ ID NO: 63489 - RNA, 19 nt, Homo sapiens
gaaauuauccugacagaca

SEQ ID NO: 63490 - RNA, 19 nt, Homo sapiens
gaugagcacuguguugaua

SEQ ID NO: 63491 - RNA, 19 nt, Homo sapiens
ggaauuggcuguacuucau

SEQ ID NO: 63492 - RNA, 19 nt, Homo sapiens
caagagaugucccuccaaa

SEQ ID NO: 63493 - RNA, 19 nt, Homo sapiens
guagugaccuccuugaaga

SEQ ID NO: 63494 - RNA, 19 nt, Homo sapiens
gaacaccaguggcuucaau

SEQ ID NO: 63495 - RNA, 19 nt, Homo sapiens
gcaggaacccacuucaaua

SEQ ID NO: 63496 - RNA, 19 nt, Homo sapiens
ucaacaaccugcuaaguga

SEQ ID NO: 63497 - RNA, 19 nt, Homo sapiens
ugaagucuaucaucaguuu

SEQ ID NO: 63498 - RNA, 19 nt, Homo sapiens
gaacaauucagguauucua

SEQ ID NO: 63499 - RNA, 19 nt, Homo sapiens
guucuacaguggcaaguua

SEQ ID NO: 63500 - RNA, 19 nt, Homo sapiens
gaagagagagcccaggauu

SEQ ID NO: 63501 - RNA, 19 nt, Homo sapiens
caauaccaaugaugccuua

SEQ ID NO: 63502 - RNA, 19 nt, Homo sapiens
acacugagauguaugaaau

SEQ ID NO: 63503 - RNA, 19 nt, Homo sapiens
gggauaagcguucaaauuc

SEQ ID NO: 63504 - RNA, 19 nt, Homo sapiens
gaagacagaaccuuauuuc

SEQ ID NO: 63505 - RNA, 19 nt, Homo sapiens
agagagagcccaggauuua

SEQ ID NO: 63506 - RNA, 19 nt, Homo sapiens
ccucuacuaugcagaauuu

SEQ ID NO: 63507 - RNA, 19 nt, Homo sapiens
gaauaucuuugacuucauc

SEQ ID NO: 63508 - RNA, 19 nt, Homo sapiens
gaacccacuucaauacuca

SEQ ID NO: 63509 - RNA, 19 nt, Homo sapiens
ccuccaaaguggcauauaa

SEQ ID NO: 63510 - RNA, 19 nt, Homo sapiens
cgagacaccuggaauaucu

SEQ ID NO: 63511 - RNA, 19 nt, Homo sapiens
acaaaguccugagguauuu

SEQ ID NO: 63512 - RNA, 19 nt, Homo sapiens
ggaauuugguggucuccuu

SEQ ID NO: 63513 - RNA, 19 nt, Homo sapiens
caauucagguauucuagaa

SEQ ID NO: 63514 - RNA, 19 nt, Homo sapiens
gggcacagguucccuaagu

SEQ ID NO: 63515 - RNA, 19 nt, Homo sapiens
gcccugaaguaccugaaua

SEQ ID NO: 63516 - RNA, 19 nt, Homo sapiens
ccacugugcuguacaauac

SEQ ID NO: 63517 - RNA, 19 nt, Homo sapiens
cuauguagaucacgagaaa

SEQ ID NO: 63518 - RNA, 19 nt, Homo sapiens
gaaguggucugggcaaucu

SEQ ID NO: 63519 - RNA, 19 nt, Homo sapiens
ggcaguaucacagaaauua

SEQ ID NO: 63520 - RNA, 19 nt, Homo sapiens
ggucaucgcuuuuggcuuu

SEQ ID NO: 63521 - RNA, 19 nt, Homo sapiens
gaacauccgccuuagaagu

SEQ ID NO: 63522 - RNA, 19 nt, Homo sapiens
ggaccacugugcuguacaa

SEQ ID NO: 63523 - RNA, 19 nt, Homo sapiens
ggaaggauggccucaaguu

SEQ ID NO: 63524 - RNA, 19 nt, Homo sapiens
ucacccaccuccucuacua

SEQ ID NO: 63525 - RNA, 19 nt, Homo sapiens
gcacagguucccuaaguga

SEQ ID NO: 63526 - RNA, 19 nt, Homo sapiens
gcaccgaucuggccuacgu

SEQ ID NO: 63527 - RNA, 19 nt, Homo sapiens
ggaugcagguauuuggaaa

SEQ ID NO: 63528 - RNA, 19 nt, Homo sapiens
ccuaugagcuggcccugaa

SEQ ID NO: 63529 - RNA, 19 nt, Homo sapiens
uguacaagcucuucauguu

SEQ ID NO: 63530 - RNA, 19 nt, Homo sapiens
ggaacauccuggacuuugu

SEQ ID NO: 63531 - RNA, 19 nt, Homo sapiens
gaucauggacuacuauaag

SEQ ID NO: 63532 - RNA, 19 nt, Homo sapiens
gccaugaucgccuugaaua

SEQ ID NO: 63533 - RNA, 19 nt, Homo sapiens
gcagcacucuguagaugug

SEQ ID NO: 63534 - RNA, 19 nt, Homo sapiens
ccuuugagaugguuauaaa

SEQ ID NO: 63535 - RNA, 19 nt, Homo sapiens
ggacuggaaugaggugaug

SEQ ID NO: 63536 - RNA, 19 nt, Homo sapiens
ggaaauaugccaagaagcu

SEQ ID NO: 63537 - RNA, 19 nt, Homo sapiens
cacuucaccuccacacuua

SEQ ID NO: 63538 - RNA, 19 nt, Homo sapiens
gccaguagcugaggacaug

SEQ ID NO: 63539 - RNA, 19 nt, Homo sapiens
ccgaagggcuuucaugaag

SEQ ID NO: 63540 - RNA, 19 nt, Homo sapiens
gagaagacagaaccuuauu

SEQ ID NO: 63541 - RNA, 19 nt, Homo sapiens
ggagaagacagaaccuuau

SEQ ID NO: 63542 - RNA, 19 nt, Homo sapiens
aagauaacauugucaggaa

SEQ ID NO: 63543 - RNA, 19 nt, Homo sapiens
gaagaugacaaaugcuaga

SEQ ID NO: 63544 - RNA, 19 nt, Homo sapiens
accaguggcuucaauauga

SEQ ID NO: 63545 - RNA, 19 nt, Homo sapiens
ggacuauggcuuuguacaa

SEQ ID NO: 63546 - RNA, 19 nt, Homo sapiens
ggacuccuucggcaaauuu

SEQ ID NO: 63547 - RNA, 19 nt, Homo sapiens
gagcgugcuucaugaacaa

SEQ ID NO: 63548 - RNA, 19 nt, Homo sapiens
cgcaauggcuggaauguca

SEQ ID NO: 63549 - RNA, 19 nt, Homo sapiens
gaaaugcugacucucaugu

SEQ ID NO: 63550 - RNA, 19 nt, Homo sapiens
ucaacauacucauugugua

SEQ ID NO: 63551 - RNA, 19 nt, Homo sapiens
caucgagcgugcuucauga

SEQ ID NO: 63552 - RNA, 19 nt, Homo sapiens
gcucuuaccuccgcaaugg

SEQ ID NO: 63553 - RNA, 19 nt, Homo sapiens
gaugcaugcucuucucuca

SEQ ID NO: 63554 - RNA, 19 nt, Homo sapiens
gcgaaagcaucuucucucu

SEQ ID NO: 63555 - RNA, 19 nt, Homo sapiens
gcauggagccuucaucucu

SEQ ID NO: 63556 - RNA, 19 nt, Homo sapiens
agaguaaggugaagaagca

SEQ ID NO: 63557 - RNA, 19 nt, Homo sapiens
cagaaauuauccugacaga

SEQ ID NO: 63558 - RNA, 19 nt, Homo sapiens
gcacggacaguuccaagga

SEQ ID NO: 63559 - RNA, 19 nt, Homo sapiens
caacaaaguccugagguau

SEQ ID NO: 63560 - RNA, 19 nt, Homo sapiens
agaagaagcagaagaagga

SEQ ID NO: 63561 - RNA, 19 nt, Homo sapiens
agaugucccugaagaugua

SEQ ID NO: 63562 - RNA, 19 nt, Homo sapiens
gaaccgaagggcuuucaug

SEQ ID NO: 63563 - RNA, 19 nt, Homo sapiens
caggaaauaugccaagaag

SEQ ID NO: 63564 - RNA, 19 nt, Homo sapiens
caaaaucuaugcagcaaug

SEQ ID NO: 63565 - RNA, 19 nt, Homo sapiens
ggcagcagcuagacucaga

SEQ ID NO: 63566 - RNA, 19 nt, Homo sapiens
gcauguggccgcauccauu

SEQ ID NO: 63567 - RNA, 19 nt, Homo sapiens
ugagaugguuauaaagaug

SEQ ID NO: 63568 - RNA, 19 nt, Homo sapiens
aggaggagguggagaagaa

SEQ ID NO: 63569 - RNA, 19 nt, Homo sapiens
gagaggcuguggugaccuu

SEQ ID NO: 63570 - RNA, 19 nt, Homo sapiens
ggaacccacuucaauacuc

SEQ ID NO: 63571 - RNA, 19 nt, Homo sapiens
gcuggaaugucauggacuu

SEQ ID NO: 63572 - RNA, 19 nt, Homo sapiens
cucaggagaucauugcuaa

SEQ ID NO: 63573 - RNA, 19 nt, Homo sapiens
uggaauaucuuugacuuca

SEQ ID NO: 63574 - RNA, 19 nt, Homo sapiens
agaagaagaagcagaagaa

SEQ ID NO: 63575 - RNA, 19 nt, Homo sapiens
gaaggaggcagagaucaga

SEQ ID NO: 63576 - RNA, 19 nt, Homo sapiens
caacuacacgcuacugaau

SEQ ID NO: 63577 - RNA, 19 nt, Homo sapiens
gguuaaaucccagguguuu

SEQ ID NO: 63578 - RNA, 19 nt, Homo sapiens
uaucaaaagugcaaaggua

SEQ ID NO: 63579 - RNA, 19 nt, Homo sapiens
gaaggauggccucaaguuc

SEQ ID NO: 63580 - RNA, 19 nt, Homo sapiens
uacaagcucuucauguuca

SEQ ID NO: 63581 - RNA, 19 nt, Homo sapiens
ggaaccagcucucucuaua

SEQ ID NO: 63582 - RNA, 19 nt, Homo sapiens
caacagugauuucaacuuu

SEQ ID NO: 63583 - RNA, 19 nt, Homo sapiens
gaggacagcucccgcauuu

SEQ ID NO: 63584 - RNA, 19 nt, Homo sapiens
ggacaucccugaagaucaa

SEQ ID NO: 63585 - RNA, 19 nt, Homo sapiens
gcacacagauaaaccgaaa

SEQ ID NO: 63586 - RNA, 19 nt, Homo sapiens
gaucauaaaucucuuugug

SEQ ID NO: 63587 - RNA, 19 nt, Homo sapiens
gcacauugcucuggacauu

SEQ ID NO: 63588 - RNA, 19 nt, Homo sapiens
ggacagacuuccagauuca

SEQ ID NO: 63589 - RNA, 19 nt, Homo sapiens
ugccguagcugguuuaaua

SEQ ID NO: 63590 - RNA, 19 nt, Homo sapiens
gaacguguuucuugccauu

SEQ ID NO: 63591 - RNA, 19 nt, Homo sapiens
ggaagcggaugaaacagaa

SEQ ID NO: 63592 - RNA, 19 nt, Homo sapiens
gaaaaggacuuggaaacua

SEQ ID NO: 63593 - RNA, 19 nt, Homo sapiens
aaagaaagaugucggaauc

SEQ ID NO: 63594 - RNA, 19 nt, Homo sapiens
ggaaacaucaugauuguca

SEQ ID NO: 63595 - RNA, 19 nt, Homo sapiens
ccaagaacccgcaucagua

SEQ ID NO: 63596 - RNA, 19 nt, Homo sapiens
gaagaaaccagcacagcaa

SEQ ID NO: 63597 - RNA, 19 nt, Homo sapiens
gugcaucuauuucaucauu

SEQ ID NO: 63598 - RNA, 19 nt, Homo sapiens
aacagaagcugcuagauga

SEQ ID NO: 63599 - RNA, 19 nt, Homo sapiens
ccgaagagcuggacaugga

SEQ ID NO: 63600 - RNA, 19 nt, Homo sapiens
ucacagagcucagagauac

SEQ ID NO: 63601 - RNA, 19 nt, Homo sapiens
caagguggcucuucaggau

SEQ ID NO: 63602 - RNA, 19 nt, Homo sapiens
ucacuggccucuucacuau

SEQ ID NO: 63603 - RNA, 19 nt, Homo sapiens
ucacugaagucaauaaugg

SEQ ID NO: 63604 - RNA, 19 nt, Homo sapiens
ccacacuucugcaauuuau

SEQ ID NO: 63605 - RNA, 19 nt, Homo sapiens
ccaagggacucaagcaugu

SEQ ID NO: 63606 - RNA, 19 nt, Homo sapiens
caucaugucuucaccaauc

SEQ ID NO: 63607 - RNA, 19 nt, Homo sapiens
ucaccacacuucugcaauu

SEQ ID NO: 63608 - RNA, 19 nt, Homo sapiens
gagauucuacuaaagauga

SEQ ID NO: 63609 - RNA, 19 nt, Homo sapiens
gggcaguugugaggauuua

SEQ ID NO: 63610 - RNA, 19 nt, Homo sapiens
ggucuucacuggccucuuc

SEQ ID NO: 63611 - RNA, 19 nt, Homo sapiens
gaagagcaaugagaaggau

SEQ ID NO: 63612 - RNA, 19 nt, Homo sapiens
ggaccgaugugcucuacug

SEQ ID NO: 63613 - RNA, 19 nt, Homo sapiens
gaacucugcugccuuugag

SEQ ID NO: 63614 - RNA, 19 nt, Homo sapiens
gaaagaaagaugucggaau

SEQ ID NO: 63615 - RNA, 19 nt, Homo sapiens
caucauuuaugccaucauu

SEQ ID NO: 63616 - RNA, 19 nt, Homo sapiens
ucacccagauccaggagua

SEQ ID NO: 63617 - RNA, 19 nt, Homo sapiens
ccaggaggcuucgauguga

SEQ ID NO: 63618 - RNA, 19 nt, Homo sapiens
gaaauucagggcccaauag

SEQ ID NO: 63619 - RNA, 19 nt, Homo sapiens
ggacuuggaaacuaacaaa

SEQ ID NO: 63620 - RNA, 19 nt, Homo sapiens
ggacaacuuugauuaucuc

SEQ ID NO: 63621 - RNA, 19 nt, Homo sapiens
ccaggaguaugccaacaaa

SEQ ID NO: 63622 - RNA, 19 nt, Homo sapiens
gaacacguuugacgcucuu

SEQ ID NO: 63623 - RNA, 19 nt, Homo sapiens
acugugagcuggacaagaa

SEQ ID NO: 63624 - RNA, 19 nt, Homo sapiens
acaaggccaucgaugcaua

SEQ ID NO: 63625 - RNA, 19 nt, Homo sapiens
ggagagagagaaagcgaaa

SEQ ID NO: 63626 - RNA, 19 nt, Homo sapiens
aaacagaagcugcuagaug

SEQ ID NO: 63627 - RNA, 19 nt, Homo sapiens
aagaggaucuggucugaau

SEQ ID NO: 63628 - RNA, 19 nt, Homo sapiens
ggaagaagaggaagaagag

SEQ ID NO: 63629 - RNA, 19 nt, Homo sapiens
ggaagaagaggaagaagag

SEQ ID NO: 63630 - RNA, 19 nt, Homo sapiens
ugaaauccaucgcauccuu

SEQ ID NO: 63631 - RNA, 19 nt, Homo sapiens
uggcaucccugcucaauuc

SEQ ID NO: 63632 - RNA, 19 nt, Homo sapiens
ucaagaggaucuggucuga

SEQ ID NO: 63633 - RNA, 19 nt, Homo sapiens
ggugugauccugagucuga

SEQ ID NO: 63634 - RNA, 19 nt, Homo sapiens
caggauggcacacagauaa

SEQ ID NO: 63635 - RNA, 19 nt, Homo sapiens
gaagcaccuuugacacguu

SEQ ID NO: 63636 - RNA, 19 nt, Homo sapiens
caaccgcuuugacugcuuu

SEQ ID NO: 63637 - RNA, 19 nt, Homo sapiens
cuacugggcugugcuguug

SEQ ID NO: 63638 - RNA, 19 nt, Homo sapiens
gggacagacuuccagauuc

SEQ ID NO: 63639 - RNA, 19 nt, Homo sapiens
gaucuggucugaauaugac

SEQ ID NO: 63640 - RNA, 19 nt, Homo sapiens
gcauuuccauuaccuucuu

SEQ ID NO: 63641 - RNA, 19 nt, Homo sapiens
caagaacccgcaucaguau

SEQ ID NO: 63642 - RNA, 19 nt, Homo sapiens
ggccugcacugcuauacaa

SEQ ID NO: 63643 - RNA, 19 nt, Homo sapiens
gcccuucaaucucgaaaga

SEQ ID NO: 63644 - RNA, 19 nt, Homo sapiens
gaagggauccgcacauugc

SEQ ID NO: 63645 - RNA, 19 nt, Homo sapiens
uggucaagcuucucaguaa

SEQ ID NO: 63646 - RNA, 19 nt, Homo sapiens
guagcugguuuaauauguu

SEQ ID NO: 63647 - RNA, 19 nt, Homo sapiens
gaauguuggugugcaucua

SEQ ID NO: 63648 - RNA, 19 nt, Homo sapiens
ccaggacuauuuccgcaaa

SEQ ID NO: 63649 - RNA, 19 nt, Homo sapiens
ugugaacucugcugccuuu

SEQ ID NO: 63650 - RNA, 19 nt, Homo sapiens
gugaagggauccgcacauu

SEQ ID NO: 63651 - RNA, 19 nt, Homo sapiens
uggccgagcugaccaauag

SEQ ID NO: 63652 - RNA, 19 nt, Homo sapiens
gcagguggaguacguauuc

SEQ ID NO: 63653 - RNA, 19 nt, Homo sapiens
cagauucacucuccuuugg

SEQ ID NO: 63654 - RNA, 19 nt, Homo sapiens
gacaagaaccagcgucaau

SEQ ID NO: 63655 - RNA, 19 nt, Homo sapiens
ggucaacagugauuucaac

SEQ ID NO: 63656 - RNA, 19 nt, Homo sapiens
ggaggaagaagaggaagaa

SEQ ID NO: 63657 - RNA, 19 nt, Homo sapiens
ggacuugggagacgagaug

SEQ ID NO: 63658 - RNA, 19 nt, Homo sapiens
gaggaucuggucugaauau

SEQ ID NO: 63659 - RNA, 19 nt, Homo sapiens
ucauggacaacuuugauua

SEQ ID NO: 63660 - RNA, 19 nt, Homo sapiens
cagauaaaccgaaacaaca

SEQ ID NO: 63661 - RNA, 19 nt, Homo sapiens
aagcauuacuucacugaug

SEQ ID NO: 63662 - RNA, 19 nt, Homo sapiens
gaucucaguguucuucauu

SEQ ID NO: 63663 - RNA, 19 nt, Homo sapiens
gggagaagagcaaugagaa

SEQ ID NO: 63664 - RNA, 19 nt, Homo sapiens
gcuggaaccuacucgacuu

SEQ ID NO: 63665 - RNA, 19 nt, Homo sapiens
aaaaggacuuggaaacuaa

SEQ ID NO: 63666 - RNA, 19 nt, Homo sapiens
gaacaugccccucaacuca

SEQ ID NO: 63667 - RNA, 19 nt, Homo sapiens
uuucgccucuuccgaguua

SEQ ID NO: 63668 - RNA, 19 nt, Homo sapiens
ccuucaagcccaagcauua

SEQ ID NO: 63669 - RNA, 19 nt, Homo sapiens
agacugcucccuucaacua

SEQ ID NO: 63670 - RNA, 19 nt, Homo sapiens
ugacaccgguuccaugaca

SEQ ID NO: 63671 - RNA, 19 nt, Homo sapiens
ucaccaacuuugacaacuu

SEQ ID NO: 63672 - RNA, 19 nt, Homo sapiens
gaaccagcucucucuauag

SEQ ID NO: 63673 - RNA, 19 nt, Homo sapiens
cuucaucuaugccgucauu

SEQ ID NO: 63674 - RNA, 19 nt, Homo sapiens
ggauauugccgucacugaa

SEQ ID NO: 63675 - RNA, 19 nt, Homo sapiens
ccuucaaucucgaaagaaa

SEQ ID NO: 63676 - RNA, 19 nt, Homo sapiens
gaacugcccuggguguacu

SEQ ID NO: 63677 - RNA, 19 nt, Homo sapiens
gugcucaauuccaucauga

SEQ ID NO: 63678 - RNA, 19 nt, Homo sapiens
gaaccuacucgacuucauc

SEQ ID NO: 63679 - RNA, 19 nt, Homo sapiens
caccacacuucugcaauuu

SEQ ID NO: 63680 - RNA, 19 nt, Homo sapiens
ucggaaacaucaugauugu

SEQ ID NO: 63681 - RNA, 19 nt, Homo sapiens
gaaaucagauccuuaaaca

SEQ ID NO: 63682 - RNA, 19 nt, Homo sapiens
ccaagaagcuggagcagaa

SEQ ID NO: 63683 - RNA, 19 nt, Homo sapiens
uggagaagcuggaguauuu

SEQ ID NO: 63684 - RNA, 19 nt, Homo sapiens
caacagagcuacugaaagg

SEQ ID NO: 63685 - RNA, 19 nt, Homo sapiens
ggagucaccugucuucuug

SEQ ID NO: 63686 - RNA, 19 nt, Homo sapiens
gcaccaacuuugcauacua

SEQ ID NO: 63687 - RNA, 19 nt, Homo sapiens
ccacugagaugcugaugaa

SEQ ID NO: 63688 - RNA, 19 nt, Homo sapiens
ggagaugccugccaaaugg

SEQ ID NO: 63689 - RNA, 19 nt, Homo sapiens
gcacggcacucaagaucaa

SEQ ID NO: 63690 - RNA, 19 nt, Homo sapiens
ccacugaggugcuacauuc

SEQ ID NO: 63691 - RNA, 19 nt, Homo sapiens
ggaagaaacagcccaagaa

SEQ ID NO: 63692 - RNA, 19 nt, Homo sapiens
ggucaucccuccaauagga

SEQ ID NO: 63693 - RNA, 19 nt, Homo sapiens
ggauggagcuucuaauguc

SEQ ID NO: 63694 - RNA, 19 nt, Homo sapiens
aagaagaucuggaagagaa

SEQ ID NO: 63695 - RNA, 19 nt, Homo sapiens
gcacaagaccugcuacuuc

SEQ ID NO: 63696 - RNA, 19 nt, Homo sapiens
gaagccaguuccugagauu

SEQ ID NO: 63697 - RNA, 19 nt, Homo sapiens
caaauaaaccggaacaaca

SEQ ID NO: 63698 - RNA, 19 nt, Homo sapiens
gagauuguccucaagauga

SEQ ID NO: 63699 - RNA, 19 nt, Homo sapiens
ucgaugaguuugaaucuaa

SEQ ID NO: 63700 - RNA, 19 nt, Homo sapiens
ggaccucaaugauguacaa

SEQ ID NO: 63701 - RNA, 19 nt, Homo sapiens
cagcaacuuugacaacuuu

SEQ ID NO: 63702 - RNA, 19 nt, Homo sapiens
gaguauuucuuccucauug

SEQ ID NO: 63703 - RNA, 19 nt, Homo sapiens
gaagagaaccagcaugaag

SEQ ID NO: 63704 - RNA, 19 nt, Homo sapiens
gaaaaucgaugaguuugaa

SEQ ID NO: 63705 - RNA, 19 nt, Homo sapiens
ucacuacccuccuacaguu

SEQ ID NO: 63706 - RNA, 19 nt, Homo sapiens
gaugaaggccugaggaaga

SEQ ID NO: 63707 - RNA, 19 nt, Homo sapiens
gcaacuagaugaggaccuu

SEQ ID NO: 63708 - RNA, 19 nt, Homo sapiens
caaaggagccggcuuggau

SEQ ID NO: 63709 - RNA, 19 nt, Homo sapiens
gaaggacauuguacagauc

SEQ ID NO: 63710 - RNA, 19 nt, Homo sapiens
ugagaaaucagauccuuaa

SEQ ID NO: 63711 - RNA, 19 nt, Homo sapiens
ggccaaggcugaggagaaa

SEQ ID NO: 63712 - RNA, 19 nt, Homo sapiens
gcaacuacauccugcucaa

SEQ ID NO: 63713 - RNA, 19 nt, Homo sapiens
cacaagaccugcuacuuca

SEQ ID NO: 63714 - RNA, 19 nt, Homo sapiens
gugcuggacuucaccauug

SEQ ID NO: 63715 - RNA, 19 nt, Homo sapiens
gcgccaauguguacaguau

SEQ ID NO: 63716 - RNA, 19 nt, Homo sapiens
gcagcaacuuugacaacuu

SEQ ID NO: 63717 - RNA, 19 nt, Homo sapiens
cagagagccuguaugaaau

SEQ ID NO: 63718 - RNA, 19 nt, Homo sapiens
gaucauggcaacagagcua

SEQ ID NO: 63719 - RNA, 19 nt, Homo sapiens
gaaccagcaugaagcucuu

SEQ ID NO: 63720 - RNA, 19 nt, Homo sapiens
caacaaccguguggagaug

SEQ ID NO: 63721 - RNA, 19 nt, Homo sapiens
acugugagcuggacaagaa

SEQ ID NO: 63722 - RNA, 19 nt, Homo sapiens
uaagauccguguccugugu

SEQ ID NO: 63723 - RNA, 19 nt, Homo sapiens
gcaguggaaccgcaucuuu

SEQ ID NO: 63724 - RNA, 19 nt, Homo sapiens
gcaagaggcaugauuggau

SEQ ID NO: 63725 - RNA, 19 nt, Homo sapiens
gaagaucgccuugguggau

SEQ ID NO: 63726 - RNA, 19 nt, Homo sapiens
ggacuucaccauugucuuc

SEQ ID NO: 63727 - RNA, 19 nt, Homo sapiens
gagcuggcaugaccaaugg

SEQ ID NO: 63728 - RNA, 19 nt, Homo sapiens
gaaguucuacgccacauuc

SEQ ID NO: 63729 - RNA, 19 nt, Homo sapiens
gcaauuacuucaacaugcu

SEQ ID NO: 63730 - RNA, 19 nt, Homo sapiens
ucagauccuuaaacacuuu

SEQ ID NO: 63731 - RNA, 19 nt, Homo sapiens
gaagacuggaccucaauga

SEQ ID NO: 63732 - RNA, 19 nt, Homo sapiens
gaagaaacagcccaagaag

SEQ ID NO: 63733 - RNA, 19 nt, Homo sapiens
caagacggaagguaacuuu

SEQ ID NO: 63734 - RNA, 19 nt, Homo sapiens
gaaccagcgccaaugugua

SEQ ID NO: 63735 - RNA, 19 nt, Homo sapiens
gaguuugaaucuaauguca

SEQ ID NO: 63736 - RNA, 19 nt, Homo sapiens
gacuggaccucaaugaugu

SEQ ID NO: 63737 - RNA, 19 nt, Homo sapiens
gccaguacuucaugucuau

SEQ ID NO: 63738 - RNA, 19 nt, Homo sapiens
aguccaaggucuucuauug

SEQ ID NO: 63739 - RNA, 19 nt, Homo sapiens
gaguggcccuggaucuauu

SEQ ID NO: 63740 - RNA, 19 nt, Homo sapiens
caucaucuaugccaucauc

SEQ ID NO: 63741 - RNA, 19 nt, Homo sapiens
agaaggacauuguacagau

SEQ ID NO: 63742 - RNA, 19 nt, Homo sapiens
agucaacgauggccaagaa

SEQ ID NO: 63743 - RNA, 19 nt, Homo sapiens
ggagguaugacuuugaaga

SEQ ID NO: 63744 - RNA, 19 nt, Homo sapiens
caacgccaaugucgccuau

SEQ ID NO: 63745 - RNA, 19 nt, Homo sapiens
agauagagauggaagagau

SEQ ID NO: 63746 - RNA, 19 nt, Homo sapiens
ugagggccaucaucaagaa

SEQ ID NO: 63747 - RNA, 19 nt, Homo sapiens
ucaagaagaucuggaagag

SEQ ID NO: 63748 - RNA, 19 nt, Homo sapiens
gggaaguucugcccacauc

SEQ ID NO: 63749 - RNA, 19 nt, Homo sapiens
gaaauugcaggcuugaaca

SEQ ID NO: 63750 - RNA, 19 nt, Homo sapiens
gauggagcuucuaauguca

SEQ ID NO: 63751 - RNA, 19 nt, Homo sapiens
ggucaggaaccaccucaaa

SEQ ID NO: 63752 - RNA, 19 nt, Homo sapiens
ccaaauggaaccagaggaa

SEQ ID NO: 63753 - RNA, 19 nt, Homo sapiens
gagauggagucaccugucu

SEQ ID NO: 63754 - RNA, 19 nt, Homo sapiens
gagcugagggccaucauca

SEQ ID NO: 63755 - RNA, 19 nt, Homo sapiens
guacggcgcagcaacuuug

SEQ ID NO: 63756 - RNA, 19 nt, Homo sapiens
gggagaagcagcaacuaga

SEQ ID NO: 63757 - RNA, 19 nt, Homo sapiens
gcauacuacuacuucauca

SEQ ID NO: 63758 - RNA, 19 nt, Homo sapiens
guguuugacuuccugauug

SEQ ID NO: 63759 - RNA, 19 nt, Homo sapiens
ggaaugugcuggacuucac

SEQ ID NO: 63760 - RNA, 19 nt, Homo sapiens
gcuggaaugugcuggacuu

SEQ ID NO: 63761 - RNA, 19 nt, Homo sapiens
gaugacaacaacucucuga

SEQ ID NO: 63762 - RNA, 19 nt, Homo sapiens
gaggcaggguggucaggaa

SEQ ID NO: 63763 - RNA, 19 nt, Homo sapiens
aaauaaaccggaacaacaa

SEQ ID NO: 63764 - RNA, 19 nt, Homo sapiens
ggaaaccccuggaaugugu

SEQ ID NO: 63765 - RNA, 19 nt, Homo sapiens
ggccuucacuaucaucuuc

SEQ ID NO: 63766 - RNA, 19 nt, Homo sapiens
aauguggccuucacuauca

SEQ ID NO: 63767 - RNA, 19 nt, Homo sapiens
gcuggucacuacccuccua

SEQ ID NO: 63768 - RNA, 19 nt, Homo sapiens
gagaaggccgugcccauuc

SEQ ID NO: 63769 - RNA, 19 nt, Homo sapiens
caagaccugcuacuucauu

SEQ ID NO: 63770 - RNA, 19 nt, Homo sapiens
ggaacagguuaacgucauc

SEQ ID NO: 63771 - RNA, 19 nt, Homo sapiens
cuacuggccugcagcuaug

SEQ ID NO: 63772 - RNA, 19 nt, Homo sapiens
gagagacugaguacaagaa

SEQ ID NO: 63773 - RNA, 19 nt, Homo sapiens
ccucaaugauguacaaugg

SEQ ID NO: 63774 - RNA, 19 nt, Homo sapiens
caucagcgucuuccaggua

SEQ ID NO: 63775 - RNA, 19 nt, Homo sapiens
gccaugacaucgugaaguc

SEQ ID NO: 63776 - RNA, 19 nt, Homo sapiens
gagagccuguaugaaauug

SEQ ID NO: 63777 - RNA, 19 nt, Homo sapiens
gccaugaugucccucuuca

SEQ ID NO: 63778 - RNA, 19 nt, Homo sapiens
gggcugauuccaugagaaa

SEQ ID NO: 63779 - RNA, 19 nt, Homo sapiens
gauguacaaugggaucaug

SEQ ID NO: 63780 - RNA, 19 nt, Homo sapiens
ggacgucgcugagcaaccu

SEQ ID NO: 63781 - RNA, 19 nt, Homo sapiens
gggauggacuccugucuua

SEQ ID NO: 63782 - RNA, 19 nt, Homo sapiens
gaacuucucuaagccuaua

SEQ ID NO: 63783 - RNA, 19 nt, Homo sapiens
ggaccuagcuugaggcaau

SEQ ID NO: 63784 - RNA, 19 nt, Homo sapiens
aaauauagcugaugcuguu

SEQ ID NO: 63785 - RNA, 19 nt, Homo sapiens
ggagauggaguuugaguuu

SEQ ID NO: 63786 - RNA, 19 nt, Homo sapiens
ugaagugacugugaagaua

SEQ ID NO: 63787 - RNA, 19 nt, Homo sapiens
cagaggcccugucaucuuu

SEQ ID NO: 63788 - RNA, 19 nt, Homo sapiens
gcugguagcugucaagauc

SEQ ID NO: 63789 - RNA, 19 nt, Homo sapiens
gaagugacugugaagauaa

SEQ ID NO: 63790 - RNA, 19 nt, Homo sapiens
ugaaagaggugaagaucau

SEQ ID NO: 63791 - RNA, 19 nt, Homo sapiens
gcagguggaucuacaacga

SEQ ID NO: 63792 - RNA, 19 nt, Homo sapiens
gcacuaggcagguaauaau

SEQ ID NO: 63793 - RNA, 19 nt, Homo sapiens
ggacaucucuaguguagcu

SEQ ID NO: 63794 - RNA, 19 nt, Homo sapiens
guaucuaccuuaugaagug

SEQ ID NO: 63795 - RNA, 19 nt, Homo sapiens
uaguguagcugccacauug

SEQ ID NO: 63796 - RNA, 19 nt, Homo sapiens
gaggugaucucaggcaaug

SEQ ID NO: 63797 - RNA, 19 nt, Homo sapiens
ggagcuaccggcugcguua

SEQ ID NO: 63798 - RNA, 19 nt, Homo sapiens
ucucuaagccuauacguuu

SEQ ID NO: 63799 - RNA, 19 nt, Homo sapiens
cgacagcccucaagaucug

SEQ ID NO: 63800 - RNA, 19 nt, Homo sapiens
gacagcccaucaccucuaa

SEQ ID NO: 63801 - RNA, 19 nt, Homo sapiens
aagaggagcugacgguuca

SEQ ID NO: 63802 - RNA, 19 nt, Homo sapiens
cuaggcagguaauaauaaa

SEQ ID NO: 63803 - RNA, 19 nt, Homo sapiens
gcagugccgcuuccucuuu

SEQ ID NO: 63804 - RNA, 19 nt, Homo sapiens
gggcagacaauguauuuau

SEQ ID NO: 63805 - RNA, 19 nt, Homo sapiens
cuaugcagguccacuguaa

SEQ ID NO: 63806 - RNA, 19 nt, Homo sapiens
gagauggaguuugaguuug

SEQ ID NO: 63807 - RNA, 19 nt, Homo sapiens
gcucaucauugcccucaug

SEQ ID NO: 63808 - RNA, 19 nt, Homo sapiens
acacuauccucaucaacaa

SEQ ID NO: 63809 - RNA, 19 nt, Homo sapiens
agauggaguuugaguuuga

SEQ ID NO: 63810 - RNA, 19 nt, Homo sapiens
ccaagaaugccaggaauga

SEQ ID NO: 63811 - RNA, 19 nt, Homo sapiens
cgaaaucuccuucaucucu

SEQ ID NO: 63812 - RNA, 19 nt, Homo sapiens
ggagaaauauaggauagac

SEQ ID NO: 63813 - RNA, 19 nt, Homo sapiens
gggacacccuuugcuggua

SEQ ID NO: 63814 - RNA, 19 nt, Homo sapiens
ucucauguguuaaauaugg

SEQ ID NO: 63815 - RNA, 19 nt, Homo sapiens
cccuaguucucauguguua

SEQ ID NO: 63816 - RNA, 19 nt, Homo sapiens
caauggcucugccuacagu

SEQ ID NO: 63817 - RNA, 19 nt, Homo sapiens
ucucugauguggugaacaa

SEQ ID NO: 63818 - RNA, 19 nt, Homo sapiens
cuuaggaaguauuaacuga

SEQ ID NO: 63819 - RNA, 19 nt, Homo sapiens
ggauucuguuuaaggguuu

SEQ ID NO: 63820 - RNA, 19 nt, Homo sapiens
gaguaaauauugggauugg

SEQ ID NO: 63821 - RNA, 19 nt, Homo sapiens
ggccagaugccaccaagaa

SEQ ID NO: 63822 - RNA, 19 nt, Homo sapiens
ccaaggaggaggaguacuu

SEQ ID NO: 63823 - RNA, 19 nt, Homo sapiens
gaccagaggcccugucauc

SEQ ID NO: 63824 - RNA, 19 nt, Homo sapiens
acacuaauauauggaccua

SEQ ID NO: 63825 - RNA, 19 nt, Homo sapiens
gguuggacaucucuagugu

SEQ ID NO: 63826 - RNA, 19 nt, Homo sapiens
cagcccaucaccucuaaua

SEQ ID NO: 63827 - RNA, 19 nt, Homo sapiens
cuggaugacuuuaggaaga

SEQ ID NO: 63828 - RNA, 19 nt, Homo sapiens
acugaucucugcccuaguu

SEQ ID NO: 63829 - RNA, 19 nt, Homo sapiens
caaugacuguuguuguugu

SEQ ID NO: 63830 - RNA, 19 nt, Homo sapiens
guagcugccacauugauuu

SEQ ID NO: 63831 - RNA, 19 nt, Homo sapiens
uaggaaguauuaacugauc

SEQ ID NO: 63832 - RNA, 19 nt, Homo sapiens
gcucaaggacccaaacauc

SEQ ID NO: 63833 - RNA, 19 nt, Homo sapiens
ggcagacaauguauuuauc

SEQ ID NO: 63834 - RNA, 19 nt, Homo sapiens
uauagcugaugcuguuaaa

SEQ ID NO: 63835 - RNA, 19 nt, Homo sapiens
uggaguaaauauugggauu

SEQ ID NO: 63836 - RNA, 19 nt, Homo sapiens
ggacaagaaggagaggaaa

SEQ ID NO: 63837 - RNA, 19 nt, Homo sapiens
acacucaacuuuguacauc

SEQ ID NO: 63838 - RNA, 19 nt, Homo sapiens
cgacagcccaucaccucua

SEQ ID NO: 63839 - RNA, 19 nt, Homo sapiens
caaggacccaaacaucauu

SEQ ID NO: 63840 - RNA, 19 nt, Homo sapiens
gaucucgacuccgcuucaa

SEQ ID NO: 63841 - RNA, 19 nt, Homo sapiens
gacacuauccucaucaaca

SEQ ID NO: 63842 - RNA, 19 nt, Homo sapiens
gcagacaauguauuuaucu

SEQ ID NO: 63843 - RNA, 19 nt, Homo sapiens
auacguuucuguggaguaa

SEQ ID NO: 63844 - RNA, 19 nt, Homo sapiens
cuuaugaagugacugugaa

SEQ ID NO: 63845 - RNA, 19 nt, Homo sapiens
cucaagaucugguuagucu

SEQ ID NO: 63846 - RNA, 19 nt, Homo sapiens
ugccgaggcugacauuguu

SEQ ID NO: 63847 - RNA, 19 nt, Homo sapiens
gggccuauaugagcugaug

SEQ ID NO: 63848 - RNA, 19 nt, Homo sapiens
aagaaugccaggaaugauu

SEQ ID NO: 63849 - RNA, 19 nt, Homo sapiens
ccagaugccaccaagaaug

SEQ ID NO: 63850 - RNA, 19 nt, Homo sapiens
gaucugguuagucuugauu

SEQ ID NO: 63851 - RNA, 19 nt, Homo sapiens
gggacacuauccucaucaa

SEQ ID NO: 63852 - RNA, 19 nt, Homo sapiens
gauggacuccugucuuaca

SEQ ID NO: 63853 - RNA, 19 nt, Homo sapiens
ggucgguguuucccaagga

SEQ ID NO: 63854 - RNA, 19 nt, Homo sapiens
gcagguaauaauaaagguu

SEQ ID NO: 63855 - RNA, 19 nt, Homo sapiens
ggaguaaauauugggauug

SEQ ID NO: 63856 - RNA, 19 nt, Homo sapiens
ccacuggacaacacugauu

SEQ ID NO: 63857 - RNA, 19 nt, Homo sapiens
cuaguucucauguguuaaa

SEQ ID NO: 63858 - RNA, 19 nt, Homo sapiens
ggagaacggcgaccucaac

SEQ ID NO: 63859 - RNA, 19 nt, Homo sapiens
agaaugccaggaaugauuu

SEQ ID NO: 63860 - RNA, 19 nt, Homo sapiens
ccaccaagaaugccaggaa

SEQ ID NO: 63861 - RNA, 19 nt, Homo sapiens
ucaacgacuccaccuauga

SEQ ID NO: 63862 - RNA, 19 nt, Homo sapiens
gaccuagcuugaggcaauu

SEQ ID NO: 63863 - RNA, 19 nt, Homo sapiens
ggaaggguggggagaaaua

SEQ ID NO: 63864 - RNA, 19 nt, Homo sapiens
caccaagaaugccaggaau

SEQ ID NO: 63865 - RNA, 19 nt, Homo sapiens
aaguggagaugcugacaug

SEQ ID NO: 63866 - RNA, 19 nt, Homo sapiens
ccagaggcccugucaucuu

SEQ ID NO: 63867 - RNA, 19 nt, Homo sapiens
cugauguggugaacaauuc

SEQ ID NO: 63868 - RNA, 19 nt, Homo sapiens
gguccacuguaacaacaug

SEQ ID NO: 63869 - RNA, 19 nt, Homo sapiens
gccaggcuaugacuaugug

SEQ ID NO: 63870 - RNA, 19 nt, Homo sapiens
ggaccaucccagacaguga

SEQ ID NO: 63871 - RNA, 19 nt, Homo sapiens
guggagaugcugacaugaa

SEQ ID NO: 63872 - RNA, 19 nt, Homo sapiens
ccuccuccaucaccugaaa

SEQ ID NO: 63873 - RNA, 19 nt, Homo sapiens
acgagcaggucaucgagaa

SEQ ID NO: 63874 - RNA, 19 nt, Homo sapiens
cagugccgcuuccucuuug

SEQ ID NO: 63875 - RNA, 19 nt, Homo sapiens
uuggacaucucuaguguag

SEQ ID NO: 63876 - RNA, 19 nt, Homo sapiens
gugaggaggacaagaagga

SEQ ID NO: 63877 - RNA, 19 nt, Homo sapiens
gaaagaggugaagaucaug

SEQ ID NO: 63878 - RNA, 19 nt, Homo sapiens
cagguccacuguaacaaca

SEQ ID NO: 63879 - RNA, 19 nt, Homo sapiens
aagugacugugaagauaaa

SEQ ID NO: 63880 - RNA, 19 nt, Homo sapiens
ccucaacgacuccaccuau

SEQ ID NO: 63881 - RNA, 19 nt, Homo sapiens
gggauggacuccugucuua

SEQ ID NO: 63882 - RNA, 19 nt, Homo sapiens
gaacuucucuaagccuaua

SEQ ID NO: 63883 - RNA, 19 nt, Homo sapiens
ggaccuagcuugaggcaau

SEQ ID NO: 63884 - RNA, 19 nt, Homo sapiens
aaauauagcugaugcuguu

SEQ ID NO: 63885 - RNA, 19 nt, Homo sapiens
ggagauggaguuugaguuu

SEQ ID NO: 63886 - RNA, 19 nt, Homo sapiens
ugaagugacugugaagaua

SEQ ID NO: 63887 - RNA, 19 nt, Homo sapiens
cagaggcccugucaucuuu

SEQ ID NO: 63888 - RNA, 19 nt, Homo sapiens
gcugguagcugucaagauc

SEQ ID NO: 63889 - RNA, 19 nt, Homo sapiens
gaagugacugugaagauaa

SEQ ID NO: 63890 - RNA, 19 nt, Homo sapiens
ugaaagaggugaagaucau

SEQ ID NO: 63891 - RNA, 19 nt, Homo sapiens
gcagguggaucuacaacga

SEQ ID NO: 63892 - RNA, 19 nt, Homo sapiens
gcacuaggcagguaauaau

SEQ ID NO: 63893 - RNA, 19 nt, Homo sapiens
ggacaucucuaguguagcu

SEQ ID NO: 63894 - RNA, 19 nt, Homo sapiens
guaucuaccuuaugaagug

SEQ ID NO: 63895 - RNA, 19 nt, Homo sapiens
uaguguagcugccacauug

SEQ ID NO: 63896 - RNA, 19 nt, Homo sapiens
gaggugaucucaggcaaug

SEQ ID NO: 63897 - RNA, 19 nt, Homo sapiens
ggagcuaccggcugcguua

SEQ ID NO: 63898 - RNA, 19 nt, Homo sapiens
ucucuaagccuauacguuu

SEQ ID NO: 63899 - RNA, 19 nt, Homo sapiens
cgacagcccucaagaucug

SEQ ID NO: 63900 - RNA, 19 nt, Homo sapiens
gacagcccaucaccucuaa

SEQ ID NO: 63901 - RNA, 19 nt, Homo sapiens
aagaggagcugacgguuca

SEQ ID NO: 63902 - RNA, 19 nt, Homo sapiens
cuaggcagguaauaauaaa

SEQ ID NO: 63903 - RNA, 19 nt, Homo sapiens
gcagugccgcuuccucuuu

SEQ ID NO: 63904 - RNA, 19 nt, Homo sapiens
gggcagacaauguauuuau

SEQ ID NO: 63905 - RNA, 19 nt, Homo sapiens
cuaugcagguccacuguaa

SEQ ID NO: 63906 - RNA, 19 nt, Homo sapiens
gagauggaguuugaguuug

SEQ ID NO: 63907 - RNA, 19 nt, Homo sapiens
gcucaucauugcccucaug

SEQ ID NO: 63908 - RNA, 19 nt, Homo sapiens
acacuauccucaucaacaa

SEQ ID NO: 63909 - RNA, 19 nt, Homo sapiens
agauggaguuugaguuuga

SEQ ID NO: 63910 - RNA, 19 nt, Homo sapiens
ccaagaaugccaggaauga

SEQ ID NO: 63911 - RNA, 19 nt, Homo sapiens
cgaaaucuccuucaucucu

SEQ ID NO: 63912 - RNA, 19 nt, Homo sapiens
ggagaaauauaggauagac

SEQ ID NO: 63913 - RNA, 19 nt, Homo sapiens
gggacacccuuugcuggua

SEQ ID NO: 63914 - RNA, 19 nt, Homo sapiens
ucucauguguuaaauaugg

SEQ ID NO: 63915 - RNA, 19 nt, Homo sapiens
cccuaguucucauguguua

SEQ ID NO: 63916 - RNA, 19 nt, Homo sapiens
ucucugauguggugaacaa

SEQ ID NO: 63917 - RNA, 19 nt, Homo sapiens
cuuaggaaguauuaacuga

SEQ ID NO: 63918 - RNA, 19 nt, Homo sapiens
ggauucuguuuaaggguuu

SEQ ID NO: 63919 - RNA, 19 nt, Homo sapiens
gaguaaauauugggauugg

SEQ ID NO: 63920 - RNA, 19 nt, Homo sapiens
ggccagaugccaccaagaa

SEQ ID NO: 63921 - RNA, 19 nt, Homo sapiens
ccaaggaggaggaguacuu

SEQ ID NO: 63922 - RNA, 19 nt, Homo sapiens
gaccagaggcccugucauc

SEQ ID NO: 63923 - RNA, 19 nt, Homo sapiens
acacuaauauauggaccua

SEQ ID NO: 63924 - RNA, 19 nt, Homo sapiens
gguuggacaucucuagugu

SEQ ID NO: 63925 - RNA, 19 nt, Homo sapiens
cagcccaucaccucuaaua

SEQ ID NO: 63926 - RNA, 19 nt, Homo sapiens
cuggaugacuuuaggaaga

SEQ ID NO: 63927 - RNA, 19 nt, Homo sapiens
acugaucucugcccuaguu

SEQ ID NO: 63928 - RNA, 19 nt, Homo sapiens
caaugacuguuguuguugu

SEQ ID NO: 63929 - RNA, 19 nt, Homo sapiens
guagcugccacauugauuu

SEQ ID NO: 63930 - RNA, 19 nt, Homo sapiens
uaggaaguauuaacugauc

SEQ ID NO: 63931 - RNA, 19 nt, Homo sapiens
gcucaaggacccaaacauc

SEQ ID NO: 63932 - RNA, 19 nt, Homo sapiens
ggcagacaauguauuuauc

SEQ ID NO: 63933 - RNA, 19 nt, Homo sapiens
uauagcugaugcuguuaaa

SEQ ID NO: 63934 - RNA, 19 nt, Homo sapiens
uggaguaaauauugggauu

SEQ ID NO: 63935 - RNA, 19 nt, Homo sapiens
ggacaagaaggagaggaaa

SEQ ID NO: 63936 - RNA, 19 nt, Homo sapiens
acacucaacuuuguacauc

SEQ ID NO: 63937 - RNA, 19 nt, Homo sapiens
cgacagcccaucaccucua

SEQ ID NO: 63938 - RNA, 19 nt, Homo sapiens
caaggacccaaacaucauu

SEQ ID NO: 63939 - RNA, 19 nt, Homo sapiens
gaucucgacuccgcuucaa

SEQ ID NO: 63940 - RNA, 19 nt, Homo sapiens
gacacuauccucaucaaca

SEQ ID NO: 63941 - RNA, 19 nt, Homo sapiens
gcagacaauguauuuaucu

SEQ ID NO: 63942 - RNA, 19 nt, Homo sapiens
auacguuucuguggaguaa

SEQ ID NO: 63943 - RNA, 19 nt, Homo sapiens
cuuaugaagugacugugaa

SEQ ID NO: 63944 - RNA, 19 nt, Homo sapiens
cucaagaucugguuagucu

SEQ ID NO: 63945 - RNA, 19 nt, Homo sapiens
ugccgaggcugacauuguu

SEQ ID NO: 63946 - RNA, 19 nt, Homo sapiens
gggccuauaugagcugaug

SEQ ID NO: 63947 - RNA, 19 nt, Homo sapiens
aagaaugccaggaaugauu

SEQ ID NO: 63948 - RNA, 19 nt, Homo sapiens
ccagaugccaccaagaaug

SEQ ID NO: 63949 - RNA, 19 nt, Homo sapiens
gaucugguuagucuugauu

SEQ ID NO: 63950 - RNA, 19 nt, Homo sapiens
gggacacuauccucaucaa

SEQ ID NO: 63951 - RNA, 19 nt, Homo sapiens
gauggacuccugucuuaca

SEQ ID NO: 63952 - RNA, 19 nt, Homo sapiens
ggucgguguuucccaagga

SEQ ID NO: 63953 - RNA, 19 nt, Homo sapiens
gcagguaauaauaaagguu

SEQ ID NO: 63954 - RNA, 19 nt, Homo sapiens
ggaguaaauauugggauug

SEQ ID NO: 63955 - RNA, 19 nt, Homo sapiens
ccacuggacaacacugauu

SEQ ID NO: 63956 - RNA, 19 nt, Homo sapiens
cuaguucucauguguuaaa

SEQ ID NO: 63957 - RNA, 19 nt, Homo sapiens
ggagaacggcgaccucaac

SEQ ID NO: 63958 - RNA, 19 nt, Homo sapiens
agaaugccaggaaugauuu

SEQ ID NO: 63959 - RNA, 19 nt, Homo sapiens
ccaccaagaaugccaggaa

SEQ ID NO: 63960 - RNA, 19 nt, Homo sapiens
ucaacgacuccaccuauga

SEQ ID NO: 63961 - RNA, 19 nt, Homo sapiens
gaccuagcuugaggcaauu

SEQ ID NO: 63962 - RNA, 19 nt, Homo sapiens
ggaaggguggggagaaaua

SEQ ID NO: 63963 - RNA, 19 nt, Homo sapiens
caccaagaaugccaggaau

SEQ ID NO: 63964 - RNA, 19 nt, Homo sapiens
aaguggagaugcugacaug

SEQ ID NO: 63965 - RNA, 19 nt, Homo sapiens
ccagaggcccugucaucuu

SEQ ID NO: 63966 - RNA, 19 nt, Homo sapiens
cugauguggugaacaauuc

SEQ ID NO: 63967 - RNA, 19 nt, Homo sapiens
gguccacuguaacaacaug

SEQ ID NO: 63968 - RNA, 19 nt, Homo sapiens
gccaggcuaugacuaugug

SEQ ID NO: 63969 - RNA, 19 nt, Homo sapiens
ggaccaucccagacaguga

SEQ ID NO: 63970 - RNA, 19 nt, Homo sapiens
guggagaugcugacaugaa

SEQ ID NO: 63971 - RNA, 19 nt, Homo sapiens
ccuccuccaucaccugaaa

SEQ ID NO: 63972 - RNA, 19 nt, Homo sapiens
acgagcaggucaucgagaa

SEQ ID NO: 63973 - RNA, 19 nt, Homo sapiens
cagugccgcuuccucuuug

SEQ ID NO: 63974 - RNA, 19 nt, Homo sapiens
uuggacaucucuaguguag

SEQ ID NO: 63975 - RNA, 19 nt, Homo sapiens
gugaggaggacaagaagga

SEQ ID NO: 63976 - RNA, 19 nt, Homo sapiens
gaaagaggugaagaucaug

SEQ ID NO: 63977 - RNA, 19 nt, Homo sapiens
cagguccacuguaacaaca

SEQ ID NO: 63978 - RNA, 19 nt, Homo sapiens
aagugacugugaagauaaa

SEQ ID NO: 63979 - RNA, 19 nt, Homo sapiens
ccucaacgacuccaccuau

SEQ ID NO: 63980 - RNA, 19 nt, Homo sapiens
ccuugugccugcuccugua

SEQ ID NO: 63981 - RNA, 19 nt, Homo sapiens
gggauggacuccugucuua

SEQ ID NO: 63982 - RNA, 19 nt, Homo sapiens
gaacuucucuaagccuaua

SEQ ID NO: 63983 - RNA, 19 nt, Homo sapiens
ggaccuagcuugaggcaau

SEQ ID NO: 63984 - RNA, 19 nt, Homo sapiens
aaauauagcugaugcuguu

SEQ ID NO: 63985 - RNA, 19 nt, Homo sapiens
ggagauggaguuugaguuu

SEQ ID NO: 63986 - RNA, 19 nt, Homo sapiens
ugaagugacugugaagaua

SEQ ID NO: 63987 - RNA, 19 nt, Homo sapiens
cagaggcccugucaucuuu

SEQ ID NO: 63988 - RNA, 19 nt, Homo sapiens
gcugguagcugucaagauc

SEQ ID NO: 63989 - RNA, 19 nt, Homo sapiens
gaagugacugugaagauaa

SEQ ID NO: 63990 - RNA, 19 nt, Homo sapiens
ugaaagaggugaagaucau

SEQ ID NO: 63991 - RNA, 19 nt, Homo sapiens
gcagguggaucuacaacga

SEQ ID NO: 63992 - RNA, 19 nt, Homo sapiens
gcacuaggcagguaauaau

SEQ ID NO: 63993 - RNA, 19 nt, Homo sapiens
ggacaucucuaguguagcu

SEQ ID NO: 63994 - RNA, 19 nt, Homo sapiens
guaucuaccuuaugaagug

SEQ ID NO: 63995 - RNA, 19 nt, Homo sapiens
uaguguagcugccacauug

SEQ ID NO: 63996 - RNA, 19 nt, Homo sapiens
gaggugaucucaggcaaug

SEQ ID NO: 63997 - RNA, 19 nt, Homo sapiens
ggagcuaccggcugcguua

SEQ ID NO: 63998 - RNA, 19 nt, Homo sapiens
ucucuaagccuauacguuu

SEQ ID NO: 63999 - RNA, 19 nt, Homo sapiens
cgacagcccucaagaucug

SEQ ID NO: 64000 - RNA, 19 nt, Homo sapiens
gacagcccaucaccucuaa

SEQ ID NO: 64001 - RNA, 19 nt, Homo sapiens
aagaggagcugacgguuca

SEQ ID NO: 64002 - RNA, 19 nt, Homo sapiens
cuaggcagguaauaauaaa

SEQ ID NO: 64003 - RNA, 19 nt, Homo sapiens
gcagugccgcuuccucuuu

SEQ ID NO: 64004 - RNA, 19 nt, Homo sapiens
gggcagacaauguauuuau

SEQ ID NO: 64005 - RNA, 19 nt, Homo sapiens
cuaugcagguccacuguaa

SEQ ID NO: 64006 - RNA, 19 nt, Homo sapiens
gagauggaguuugaguuug

SEQ ID NO: 64007 - RNA, 19 nt, Homo sapiens
gcucaucauugcccucaug

SEQ ID NO: 64008 - RNA, 19 nt, Homo sapiens
acacuauccucaucaacaa

SEQ ID NO: 64009 - RNA, 19 nt, Homo sapiens
agauggaguuugaguuuga

SEQ ID NO: 64010 - RNA, 19 nt, Homo sapiens
cgaaaucuccuucaucucu

SEQ ID NO: 64011 - RNA, 19 nt, Homo sapiens
ggagaaauauaggauagac

SEQ ID NO: 64012 - RNA, 19 nt, Homo sapiens
gggacacccuuugcuggua

SEQ ID NO: 64013 - RNA, 19 nt, Homo sapiens
ucucauguguuaaauaugg

SEQ ID NO: 64014 - RNA, 19 nt, Homo sapiens
cccuaguucucauguguua

SEQ ID NO: 64015 - RNA, 19 nt, Homo sapiens
ucucugauguggugaacaa

SEQ ID NO: 64016 - RNA, 19 nt, Homo sapiens
cuuaggaaguauuaacuga

SEQ ID NO: 64017 - RNA, 19 nt, Homo sapiens
ggauucuguuuaaggguuu

SEQ ID NO: 64018 - RNA, 19 nt, Homo sapiens
gaguaaauauugggauugg

SEQ ID NO: 64019 - RNA, 19 nt, Homo sapiens
ggccagaugccaccaagaa

SEQ ID NO: 64020 - RNA, 19 nt, Homo sapiens
ccaaggaggaggaguacuu

SEQ ID NO: 64021 - RNA, 19 nt, Homo sapiens
gaccagaggcccugucauc

SEQ ID NO: 64022 - RNA, 19 nt, Homo sapiens
acacuaauauauggaccua

SEQ ID NO: 64023 - RNA, 19 nt, Homo sapiens
gguuggacaucucuagugu

SEQ ID NO: 64024 - RNA, 19 nt, Homo sapiens
cagcccaucaccucuaaua

SEQ ID NO: 64025 - RNA, 19 nt, Homo sapiens
cuggaugacuuuaggaaga

SEQ ID NO: 64026 - RNA, 19 nt, Homo sapiens
acugaucucugcccuaguu

SEQ ID NO: 64027 - RNA, 19 nt, Homo sapiens
caaugacuguuguuguugu

SEQ ID NO: 64028 - RNA, 19 nt, Homo sapiens
guagcugccacauugauuu

SEQ ID NO: 64029 - RNA, 19 nt, Homo sapiens
uaggaaguauuaacugauc

SEQ ID NO: 64030 - RNA, 19 nt, Homo sapiens
gcucaaggacccaaacauc

SEQ ID NO: 64031 - RNA, 19 nt, Homo sapiens
ggcagacaauguauuuauc

SEQ ID NO: 64032 - RNA, 19 nt, Homo sapiens
uauagcugaugcuguuaaa

SEQ ID NO: 64033 - RNA, 19 nt, Homo sapiens
uggaguaaauauugggauu

SEQ ID NO: 64034 - RNA, 19 nt, Homo sapiens
ggacaagaaggagaggaaa

SEQ ID NO: 64035 - RNA, 19 nt, Homo sapiens
acacucaacuuuguacauc

SEQ ID NO: 64036 - RNA, 19 nt, Homo sapiens
cgacagcccaucaccucua

SEQ ID NO: 64037 - RNA, 19 nt, Homo sapiens
caaggacccaaacaucauu

SEQ ID NO: 64038 - RNA, 19 nt, Homo sapiens
gaucucgacuccgcuucaa

SEQ ID NO: 64039 - RNA, 19 nt, Homo sapiens
gacacuauccucaucaaca

SEQ ID NO: 64040 - RNA, 19 nt, Homo sapiens
gcagacaauguauuuaucu

SEQ ID NO: 64041 - RNA, 19 nt, Homo sapiens
auacguuucuguggaguaa

SEQ ID NO: 64042 - RNA, 19 nt, Homo sapiens
cucaagaucugguuagucu

SEQ ID NO: 64043 - RNA, 19 nt, Homo sapiens
ugccgaggcugacauuguu

SEQ ID NO: 64044 - RNA, 19 nt, Homo sapiens
cuuaugaagugacugugaa

SEQ ID NO: 64045 - RNA, 19 nt, Homo sapiens
gggccuauaugagcugaug

SEQ ID NO: 64046 - RNA, 19 nt, Homo sapiens
ccagaugccaccaagaaug

SEQ ID NO: 64047 - RNA, 19 nt, Homo sapiens
gaucugguuagucuugauu

SEQ ID NO: 64048 - RNA, 19 nt, Homo sapiens
gggacacuauccucaucaa

SEQ ID NO: 64049 - RNA, 19 nt, Homo sapiens
gauggacuccugucuuaca

SEQ ID NO: 64050 - RNA, 19 nt, Homo sapiens
ggucgguguuucccaagga

SEQ ID NO: 64051 - RNA, 19 nt, Homo sapiens
gcagguaauaauaaagguu

SEQ ID NO: 64052 - RNA, 19 nt, Homo sapiens
ggaguaaauauugggauug

SEQ ID NO: 64053 - RNA, 19 nt, Homo sapiens
ccacuggacaacacugauu

SEQ ID NO: 64054 - RNA, 19 nt, Homo sapiens
cuaguucucauguguuaaa

SEQ ID NO: 64055 - RNA, 19 nt, Homo sapiens
ggagaacggcgaccucaac

SEQ ID NO: 64056 - RNA, 19 nt, Homo sapiens
ucaacgacuccaccuauga

SEQ ID NO: 64057 - RNA, 19 nt, Homo sapiens
gaccuagcuugaggcaauu

SEQ ID NO: 64058 - RNA, 19 nt, Homo sapiens
ggaaggguggggagaaaua

SEQ ID NO: 64059 - RNA, 19 nt, Homo sapiens
aaguggagaugcugacaug

SEQ ID NO: 64060 - RNA, 19 nt, Homo sapiens
ccagaggcccugucaucuu

SEQ ID NO: 64061 - RNA, 19 nt, Homo sapiens
cugauguggugaacaauuc

SEQ ID NO: 64062 - RNA, 19 nt, Homo sapiens
gguccacuguaacaacaug

SEQ ID NO: 64063 - RNA, 19 nt, Homo sapiens
gccaggcuaugacuaugug

SEQ ID NO: 64064 - RNA, 19 nt, Homo sapiens
ggaccaucccagacaguga

SEQ ID NO: 64065 - RNA, 19 nt, Homo sapiens
guggagaugcugacaugaa

SEQ ID NO: 64066 - RNA, 19 nt, Homo sapiens
ccuccuccaucaccugaaa

SEQ ID NO: 64067 - RNA, 19 nt, Homo sapiens
acgagcaggucaucgagaa

SEQ ID NO: 64068 - RNA, 19 nt, Homo sapiens
cagugccgcuuccucuuug

SEQ ID NO: 64069 - RNA, 19 nt, Homo sapiens
uuggacaucucuaguguag

SEQ ID NO: 64070 - RNA, 19 nt, Homo sapiens
gugaggaggacaagaagga

SEQ ID NO: 64071 - RNA, 19 nt, Homo sapiens
gaaagaggugaagaucaug

SEQ ID NO: 64072 - RNA, 19 nt, Homo sapiens
cagguccacuguaacaaca

SEQ ID NO: 64073 - RNA, 19 nt, Homo sapiens
ccucaacgacuccaccuau

SEQ ID NO: 64074 - RNA, 19 nt, Homo sapiens
aagugacugugaagauaaa

SEQ ID NO: 64075 - RNA, 19 nt, Homo sapiens
ccuugugccugcuccugua

SEQ ID NO: 64076 - RNA, 19 nt, Homo sapiens
ggcagaggaugcacucaac

SEQ ID NO: 64077 - RNA, 19 nt, Homo sapiens
gagcagcgaccacccuuuu

SEQ ID NO: 64078 - RNA, 19 nt, Homo sapiens
gcauguggcagcccagauc

SEQ ID NO: 64079 - RNA, 19 nt, Homo sapiens
uggagaugcugacaugaag

SEQ ID NO: 64080 - RNA, 19 nt, Homo sapiens
cacuaggcagguaauaaua

SEQ ID NO: 64081 - RNA, 19 nt, Homo sapiens
aagcaaagcuguagaaaua

SEQ ID NO: 64082 - RNA, 19 nt, Homo sapiens
ccaaaggaauuacagauua

SEQ ID NO: 64083 - RNA, 19 nt, Homo sapiens
gcaaugaaguugucuacua

SEQ ID NO: 64084 - RNA, 19 nt, Homo sapiens
caacauaaccggccaauuu

SEQ ID NO: 64085 - RNA, 19 nt, Homo sapiens
gcaaagcuguagaaauaua

SEQ ID NO: 64086 - RNA, 19 nt, Homo sapiens
gcagacauauuacaaauug

SEQ ID NO: 64087 - RNA, 19 nt, Homo sapiens
gaacagcugcuuaauuaua

SEQ ID NO: 64088 - RNA, 19 nt, Homo sapiens
gaacucaacuggacaagug

SEQ ID NO: 64089 - RNA, 19 nt, Homo sapiens
uugaacagcugcuuaauua

SEQ ID NO: 64090 - RNA, 19 nt, Homo sapiens
gaacaucugucuccgaaau

SEQ ID NO: 64091 - RNA, 19 nt, Homo sapiens
aaccaaaucugcauaguua

SEQ ID NO: 64092 - RNA, 19 nt, Homo sapiens
gaacugggacuugucauua

SEQ ID NO: 64093 - RNA, 19 nt, Homo sapiens
ggacaucgcucagcauaug

SEQ ID NO: 64094 - RNA, 19 nt, Homo sapiens
ugagacaccugguuaauau

SEQ ID NO: 64095 - RNA, 19 nt, Homo sapiens
guaaauuccuggauagaga

SEQ ID NO: 64096 - RNA, 19 nt, Homo sapiens
gaacaccaacuuaauauuc

SEQ ID NO: 64097 - RNA, 19 nt, Homo sapiens
gaacaaacccaguauuucu

SEQ ID NO: 64098 - RNA, 19 nt, Homo sapiens
gaugcaggcuuuacaaaug

SEQ ID NO: 64099 - RNA, 19 nt, Homo sapiens
gcaaacugcaauaagauua

SEQ ID NO: 64100 - RNA, 19 nt, Homo sapiens
gauagagaauuucaccaaa

SEQ ID NO: 64101 - RNA, 19 nt, Homo sapiens
caaaugaacuuguccaaaa

SEQ ID NO: 64102 - RNA, 19 nt, Homo sapiens
gaugagagauauauugaca

SEQ ID NO: 64103 - RNA, 19 nt, Homo sapiens
gaacucugguuaaaucuca

SEQ ID NO: 64104 - RNA, 19 nt, Homo sapiens
ugaaagacgcggugaauaa

SEQ ID NO: 64105 - RNA, 19 nt, Homo sapiens
gaugguggguuucuucuga

SEQ ID NO: 64106 - RNA, 19 nt, Homo sapiens
gaggacagcuucuauaaaa

SEQ ID NO: 64107 - RNA, 19 nt, Homo sapiens
ccugaugucugcuuugaua

SEQ ID NO: 64108 - RNA, 19 nt, Homo sapiens
ccaaacaacccaucaugua

SEQ ID NO: 64109 - RNA, 19 nt, Homo sapiens
uagaaacccucucagauga

SEQ ID NO: 64110 - RNA, 19 nt, Homo sapiens
gaaucaauacucaggaaua

SEQ ID NO: 64111 - RNA, 19 nt, Homo sapiens
ggacaagugccuuagauga

SEQ ID NO: 64112 - RNA, 19 nt, Homo sapiens
cguaauggauugugugauu

SEQ ID NO: 64113 - RNA, 19 nt, Homo sapiens
ugaagaaucuggcuauaca

SEQ ID NO: 64114 - RNA, 19 nt, Homo sapiens
caaacaacccaucauguaa

SEQ ID NO: 64115 - RNA, 19 nt, Homo sapiens
gcacgcagcaguccauauu

SEQ ID NO: 64116 - RNA, 19 nt, Homo sapiens
aaaggagccuagauaauga

SEQ ID NO: 64117 - RNA, 19 nt, Homo sapiens
gaugugaguggaaguguua

SEQ ID NO: 64118 - RNA, 19 nt, Homo sapiens
gaaauugcagccagggaua

SEQ ID NO: 64119 - RNA, 19 nt, Homo sapiens
uaacguagggucagcuaua

SEQ ID NO: 64120 - RNA, 19 nt, Homo sapiens
gauggaggaugaugacuuc

SEQ ID NO: 64121 - RNA, 19 nt, Homo sapiens
caaucgauccuaaugguua

SEQ ID NO: 64122 - RNA, 19 nt, Homo sapiens
ccacuggccuagcucgaua

SEQ ID NO: 64123 - RNA, 19 nt, Homo sapiens
ugauguaaauuccuggaua

SEQ ID NO: 64124 - RNA, 19 nt, Homo sapiens
ccaagcaaauguaagaaau

SEQ ID NO: 64125 - RNA, 19 nt, Homo sapiens
gcaaugaccugaaaauauc

SEQ ID NO: 64126 - RNA, 19 nt, Homo sapiens
guaccuggaugcauuggaa

SEQ ID NO: 64127 - RNA, 19 nt, Homo sapiens
caaagaggcuggagaaaau

SEQ ID NO: 64128 - RNA, 19 nt, Homo sapiens
agagcaaacugcaauaaga

SEQ ID NO: 64129 - RNA, 19 nt, Homo sapiens
cuaaagacaugcuuauucu

SEQ ID NO: 64130 - RNA, 19 nt, Homo sapiens
caccauggguugauaauag

SEQ ID NO: 64131 - RNA, 19 nt, Homo sapiens
caagaugagagauauauug

SEQ ID NO: 64132 - RNA, 19 nt, Homo sapiens
gaguagaugugucuuugga

SEQ ID NO: 64133 - RNA, 19 nt, Homo sapiens
gggaguagaugugucuuug

SEQ ID NO: 64134 - RNA, 19 nt, Homo sapiens
ggacuugucauuacuggaa

SEQ ID NO: 64135 - RNA, 19 nt, Homo sapiens
ggauugacacuuaaacuga

SEQ ID NO: 64136 - RNA, 19 nt, Homo sapiens
cuacagcaguuucucuuga

SEQ ID NO: 64137 - RNA, 19 nt, Homo sapiens
gauguaaauuccuggauag

SEQ ID NO: 64138 - RNA, 19 nt, Homo sapiens
ucacugcucccuacuuuaa

SEQ ID NO: 64139 - RNA, 19 nt, Homo sapiens
uggauaagaugcaagaaga

SEQ ID NO: 64140 - RNA, 19 nt, Homo sapiens
caaacuagaagagacaaua

SEQ ID NO: 64141 - RNA, 19 nt, Homo sapiens
gcaauaagaaucaauacuc

SEQ ID NO: 64142 - RNA, 19 nt, Homo sapiens
gaacuccaaauaagauuga

SEQ ID NO: 64143 - RNA, 19 nt, Homo sapiens
gcacacaccggcuguuaug

SEQ ID NO: 64144 - RNA, 19 nt, Homo sapiens
uaacgacaguaaaucauuc

SEQ ID NO: 64145 - RNA, 19 nt, Homo sapiens
gaaagacgcggugaauaau

SEQ ID NO: 64146 - RNA, 19 nt, Homo sapiens
gaaacccucucagaugaug

SEQ ID NO: 64147 - RNA, 19 nt, Homo sapiens
uggccuagcucgauauuau

SEQ ID NO: 64148 - RNA, 19 nt, Homo sapiens
caguugagauggaggauga

SEQ ID NO: 64149 - RNA, 19 nt, Homo sapiens
ggagaaaauuggcaagaaa

SEQ ID NO: 64150 - RNA, 19 nt, Homo sapiens
cgaaauaagaugauugaug

SEQ ID NO: 64151 - RNA, 19 nt, Homo sapiens
caacuggacaagugccuua

SEQ ID NO: 64152 - RNA, 19 nt, Homo sapiens
gacgacaaauaucuuauca

SEQ ID NO: 64153 - RNA, 19 nt, Homo sapiens
ggaauccaguuucuacuac

SEQ ID NO: 64154 - RNA, 19 nt, Homo sapiens
cagcauaugugccaucagu

SEQ ID NO: 64155 - RNA, 19 nt, Homo sapiens
gaaucgggcauuaugguaa

SEQ ID NO: 64156 - RNA, 19 nt, Homo sapiens
uaccagaguuuaucccaaa

SEQ ID NO: 64157 - RNA, 19 nt, Homo sapiens
caacgaguuuauugauaga

SEQ ID NO: 64158 - RNA, 19 nt, Homo sapiens
agagagagcccaggagaua

SEQ ID NO: 64159 - RNA, 19 nt, Homo sapiens
gauaauaguagaacuccaa

SEQ ID NO: 64160 - RNA, 19 nt, Homo sapiens
aagaaacagugacguaaug

SEQ ID NO: 64161 - RNA, 19 nt, Homo sapiens
agacaaagcuaagcaaguc

SEQ ID NO: 64162 - RNA, 19 nt, Homo sapiens
gauugaccuuuaugaugua

SEQ ID NO: 64163 - RNA, 19 nt, Homo sapiens
acaaugucuuggaggauua

SEQ ID NO: 64164 - RNA, 19 nt, Homo sapiens
cagaaucuuucauggagaa

SEQ ID NO: 64165 - RNA, 19 nt, Homo sapiens
aaucauggguggauaagau

SEQ ID NO: 64166 - RNA, 19 nt, Homo sapiens
caguuucucuugaguuuga

SEQ ID NO: 64167 - RNA, 19 nt, Homo sapiens
ggauagagaauuucaccaa

SEQ ID NO: 64168 - RNA, 19 nt, Homo sapiens
ggagugaaagcacgauuug

SEQ ID NO: 64169 - RNA, 19 nt, Homo sapiens
gaaacaggacauacacaug

SEQ ID NO: 64170 - RNA, 19 nt, Homo sapiens
agagauauauugacaaagg

SEQ ID NO: 64171 - RNA, 19 nt, Homo sapiens
agauugaccuuuaugaugu

SEQ ID NO: 64172 - RNA, 19 nt, Homo sapiens
caaugaaguugucuacuac

SEQ ID NO: 64173 - RNA, 19 nt, Homo sapiens
gagaaaagcuuaugaacac

SEQ ID NO: 64174 - RNA, 19 nt, Homo sapiens
uuacugcaaugaccugaaa

SEQ ID NO: 64175 - RNA, 19 nt, Homo sapiens
uggcacagauuacaguuug

SEQ ID NO: 64176 - RNA, 19 nt, Homo sapiens
gacaagugccuuagaugaa

SEQ ID NO: 64177 - RNA, 19 nt, Homo sapiens
ccaaaucugcauaguuaaa

SEQ ID NO: 64178 - RNA, 19 nt, Homo sapiens
aauagagucuugcuugaug

SEQ ID NO: 64179 - RNA, 19 nt, Homo sapiens
guaacgcggauuugauuaa

SEQ ID NO: 64180 - RNA, 19 nt, Homo sapiens
gagauauauugacaaagga

SEQ ID NO: 64181 - RNA, 19 nt, Homo sapiens
gcaaacacaucaucauuga

SEQ ID NO: 64182 - RNA, 19 nt, Homo sapiens
gcagaaagcuuuauuugac

SEQ ID NO: 64183 - RNA, 19 nt, Homo sapiens
ggacaaauguuggcuacaa

SEQ ID NO: 64184 - RNA, 19 nt, Homo sapiens
gaaaggaggccacagauuc

SEQ ID NO: 64185 - RNA, 19 nt, Homo sapiens
gcucacaccugacauguau

SEQ ID NO: 64186 - RNA, 19 nt, Homo sapiens
ggaagaagacuaugaggaa

SEQ ID NO: 64187 - RNA, 19 nt, Homo sapiens
gcgagcaucuggcggagua

SEQ ID NO: 64188 - RNA, 19 nt, Homo sapiens
gcaaauacagcaagaggaa

SEQ ID NO: 64189 - RNA, 19 nt, Homo sapiens
gaaagucucaguccaaaca

SEQ ID NO: 64190 - RNA, 19 nt, Homo sapiens
gcuaagcgcucaguucuca

SEQ ID NO: 64191 - RNA, 19 nt, Homo sapiens
uuacagacaugaugcagaa

SEQ ID NO: 64192 - RNA, 19 nt, Homo sapiens
guauuugccucucgugauu

SEQ ID NO: 64193 - RNA, 19 nt, Homo sapiens
ggugaaagccauagcauga

SEQ ID NO: 64194 - RNA, 19 nt, Homo sapiens
acaccucaauguccaaaua

SEQ ID NO: 64195 - RNA, 19 nt, Homo sapiens
gaggaaagggcgauucaaa

SEQ ID NO: 64196 - RNA, 19 nt, Homo sapiens
ggagaaguauuuugccaua

SEQ ID NO: 64197 - RNA, 19 nt, Homo sapiens
gggcuuggcugcugcuguu

SEQ ID NO: 64198 - RNA, 19 nt, Homo sapiens
gcaaugggaagcucaaugu

SEQ ID NO: 64199 - RNA, 19 nt, Homo sapiens
ccagaacccugaggaguga

SEQ ID NO: 64200 - RNA, 19 nt, Homo sapiens
ggaaaggaggccacagauu

SEQ ID NO: 64201 - RNA, 19 nt, Homo sapiens
ggacgaggaagaagacuau

SEQ ID NO: 64202 - RNA, 19 nt, Homo sapiens
gaaggagggcugugagguu

SEQ ID NO: 64203 - RNA, 19 nt, Homo sapiens
gggagcacguccucggaua

SEQ ID NO: 64204 - RNA, 19 nt, Homo sapiens
aggaagagcugaccgacaa

SEQ ID NO: 64205 - RNA, 19 nt, Homo sapiens
ccugggagcugcugauaug

SEQ ID NO: 64206 - RNA, 19 nt, Homo sapiens
uggcugaggugcagaguga

SEQ ID NO: 64207 - RNA, 19 nt, Homo sapiens
ccacuggugcaaugucuua

SEQ ID NO: 64208 - RNA, 19 nt, Homo sapiens
ccaucugucugucuauauu

SEQ ID NO: 64209 - RNA, 19 nt, Homo sapiens
gacaaauguuggcuacaau

SEQ ID NO: 64210 - RNA, 19 nt, Homo sapiens
ccacuguccuguccuuugu

SEQ ID NO: 64211 - RNA, 19 nt, Homo sapiens
gcacuuccuuaacucuuuc

SEQ ID NO: 64212 - RNA, 19 nt, Homo sapiens
ccaaagacuuccugcacau

SEQ ID NO: 64213 - RNA, 19 nt, Homo sapiens
ggugcaaugucuuaaauac

SEQ ID NO: 64214 - RNA, 19 nt, Homo sapiens
cagcaaacacaucaucauu

SEQ ID NO: 64215 - RNA, 19 nt, Homo sapiens
gaggaaagucucaguccaa

SEQ ID NO: 64216 - RNA, 19 nt, Homo sapiens
gcuacgagguuacagacau

SEQ ID NO: 64217 - RNA, 19 nt, Homo sapiens
gcucaagggcuacgagguu

SEQ ID NO: 64218 - RNA, 19 nt, Homo sapiens
ggaggaccgggaagccuua

SEQ ID NO: 64219 - RNA, 19 nt, Homo sapiens
gaugcagaaagcuuuauuu

SEQ ID NO: 64220 - RNA, 19 nt, Homo sapiens
ugaaagccauagcaugaca

SEQ ID NO: 64221 - RNA, 19 nt, Homo sapiens
ugaaaucgagcgaaucuuc

SEQ ID NO: 64222 - RNA, 19 nt, Homo sapiens
gcaaugucuuaaauacaca

SEQ ID NO: 64223 - RNA, 19 nt, Homo sapiens
gugggugccugaagauguu

SEQ ID NO: 64224 - RNA, 19 nt, Homo sapiens
gggauacccaccuuucuga

SEQ ID NO: 64225 - RNA, 19 nt, Homo sapiens
caucauuguuuacaucaag

SEQ ID NO: 64226 - RNA, 19 nt, Homo sapiens
ggaaagggcgauucaaacg

SEQ ID NO: 64227 - RNA, 19 nt, Homo sapiens
guguggacauggagacuga

SEQ ID NO: 64228 - RNA, 19 nt, Homo sapiens
agagugaaaucgagcgaau

SEQ ID NO: 64229 - RNA, 19 nt, Homo sapiens
ccaaacagaagcagaaguc

SEQ ID NO: 64230 - RNA, 19 nt, Homo sapiens
gcaaaucaggcgauaacuc

SEQ ID NO: 64231 - RNA, 19 nt, Homo sapiens
aagcagagcgccaggcauu

SEQ ID NO: 64232 - RNA, 19 nt, Homo sapiens
gcucaaagcuugggguuuc

SEQ ID NO: 64233 - RNA, 19 nt, Homo sapiens
aacagaagcugcgccagaa

SEQ ID NO: 64234 - RNA, 19 nt, Homo sapiens
ggagaaauacaauaaugac

SEQ ID NO: 64235 - RNA, 19 nt, Homo sapiens
gcacaucaaggagaaauac

SEQ ID NO: 64236 - RNA, 19 nt, Homo sapiens
cagcuuccacuuacugauu

SEQ ID NO: 64237 - RNA, 19 nt, Homo sapiens
cucaagggcuacgagguua

SEQ ID NO: 64238 - RNA, 19 nt, Homo sapiens
ccucugauguauugcuaga

SEQ ID NO: 64239 - RNA, 19 nt, Homo sapiens
guugugcccugagucauug

SEQ ID NO: 64240 - RNA, 19 nt, Homo sapiens
gcagagcgccaggcauuag

SEQ ID NO: 64241 - RNA, 19 nt, Homo sapiens
caaauagcggccucggaaa

SEQ ID NO: 64242 - RNA, 19 nt, Homo sapiens
cagaaagcuuuauuugacu

SEQ ID NO: 64243 - RNA, 19 nt, Homo sapiens
cuacgagguuacagacaug

SEQ ID NO: 64244 - RNA, 19 nt, Homo sapiens
gcccucugauguauugcua

SEQ ID NO: 64245 - RNA, 19 nt, Homo sapiens
aaaccacuguccuguccuu

SEQ ID NO: 64246 - RNA, 19 nt, Homo sapiens
ggcgcugucucccuccuuu

SEQ ID NO: 64247 - RNA, 19 nt, Homo sapiens
aggaaagucucaguccaaa

SEQ ID NO: 64248 - RNA, 19 nt, Homo sapiens
uucaaaggcucaucaaguc

SEQ ID NO: 64249 - RNA, 19 nt, Homo sapiens
guacuucaaaggcucauca

SEQ ID NO: 64250 - RNA, 19 nt, Homo sapiens
caucaagucccgaggaaag

SEQ ID NO: 64251 - RNA, 19 nt, Homo sapiens
gcgcucaguucucaacaac

SEQ ID NO: 64252 - RNA, 19 nt, Homo sapiens
gggugcagcuuccacuuac

SEQ ID NO: 64253 - RNA, 19 nt, Homo sapiens
uaagugacgguccuaagug

SEQ ID NO: 64254 - RNA, 19 nt, Homo sapiens
caugaugcagaaagcuuua

SEQ ID NO: 64255 - RNA, 19 nt, Homo sapiens
cagacccacuggugcaaug

SEQ ID NO: 64256 - RNA, 19 nt, Homo sapiens
guacuuggaagccuauugg

SEQ ID NO: 64257 - RNA, 19 nt, Homo sapiens
caucaaggagaaauacaau

SEQ ID NO: 64258 - RNA, 19 nt, Homo sapiens
gauguugugcccugaguca

SEQ ID NO: 64259 - RNA, 19 nt, Homo sapiens
gaagcuggcaggcauacag

SEQ ID NO: 64260 - RNA, 19 nt, Homo sapiens
gcugugcggacaaauguug

SEQ ID NO: 64261 - RNA, 19 nt, Homo sapiens
gggaggacgaggaagaaga

SEQ ID NO: 64262 - RNA, 19 nt, Homo sapiens
uuaccugucucuccacaag

SEQ ID NO: 64263 - RNA, 19 nt, Homo sapiens
aagggugggugccugaaga

SEQ ID NO: 64264 - RNA, 19 nt, Homo sapiens
ucuuuguccucgccacaua

SEQ ID NO: 64265 - RNA, 19 nt, Homo sapiens
cagggcaaauacagcaaga

SEQ ID NO: 64266 - RNA, 19 nt, Homo sapiens
caacguccagggcccagaa

SEQ ID NO: 64267 - RNA, 19 nt, Homo sapiens
ugcacuuccuuaacucuuu

SEQ ID NO: 64268 - RNA, 19 nt, Homo sapiens
uuaccugccuguuguggau

SEQ ID NO: 64269 - RNA, 19 nt, Homo sapiens
uaccacauccaacagcuuu

SEQ ID NO: 64270 - RNA, 19 nt, Homo sapiens
gaaagcuuuauuugacuuc

SEQ ID NO: 64271 - RNA, 19 nt, Homo sapiens
cagcaaaucaggcgauaac

SEQ ID NO: 64272 - RNA, 19 nt, Homo sapiens
gcugugagguuggcuucau

SEQ ID NO: 64273 - RNA, 19 nt, Homo sapiens
agcuuccacuuacugauua

SEQ ID NO: 64274 - RNA, 19 nt, Homo sapiens
gagccgagugugccaacaa

SEQ ID NO: 64275 - RNA, 19 nt, Homo sapiens
cuucaaaggcucaucaagu

SEQ ID NO: 64276 - RNA, 19 nt, Homo sapiens
gcugaggugcagagugaaa

SEQ ID NO: 64277 - RNA, 19 nt, Homo sapiens
ugcagaaagcuuuauuuga

SEQ ID NO: 64278 - RNA, 19 nt, Homo sapiens
gacaugaugcagaaagcuu

SEQ ID NO: 64279 - RNA, 19 nt, Homo sapiens
caaauacagcaagaggaaa

SEQ ID NO: 64280 - RNA, 19 nt, Homo sapiens
cuggugcaaugucuuaaau

SEQ ID NO: 64281 - RNA, 19 nt, Homo sapiens
ggucuacacugcaaucaua

SEQ ID NO: 64282 - RNA, 19 nt, Homo sapiens
gcaagacacucagauguuu

SEQ ID NO: 64283 - RNA, 19 nt, Homo sapiens
uaugugaucugucuuguaa

SEQ ID NO: 64284 - RNA, 19 nt, Homo sapiens
acaaacaccuccuuauuau

SEQ ID NO: 64285 - RNA, 19 nt, Homo sapiens
ggaaauucaucauccaguu

SEQ ID NO: 64286 - RNA, 19 nt, Homo sapiens
gcaaacaaacaccuccuua

SEQ ID NO: 64287 - RNA, 19 nt, Homo sapiens
gccaaacgcucgguauuaa

SEQ ID NO: 64288 - RNA, 19 nt, Homo sapiens
gagaauggcuacuguaaaa

SEQ ID NO: 64289 - RNA, 19 nt, Homo sapiens
cagauucagucuugccuua

SEQ ID NO: 64290 - RNA, 19 nt, Homo sapiens
cuaagaagcagucacauaa

SEQ ID NO: 64291 - RNA, 19 nt, Homo sapiens
gguagcagcugauaaacug

SEQ ID NO: 64292 - RNA, 19 nt, Homo sapiens
caacacaaggucaagcuua

SEQ ID NO: 64293 - RNA, 19 nt, Homo sapiens
uagcauggauagaguauug

SEQ ID NO: 64294 - RNA, 19 nt, Homo sapiens
gcuacgaggucacagauau

SEQ ID NO: 64295 - RNA, 19 nt, Homo sapiens
cauagaugcuacuggcuua

SEQ ID NO: 64296 - RNA, 19 nt, Homo sapiens
ggcagaagcuaagugauuu

SEQ ID NO: 64297 - RNA, 19 nt, Homo sapiens
aaacaaacaccuccuuauu

SEQ ID NO: 64298 - RNA, 19 nt, Homo sapiens
gcaauagcauggauagagu

SEQ ID NO: 64299 - RNA, 19 nt, Homo sapiens
gaugugaucuuggaugaga

SEQ ID NO: 64300 - RNA, 19 nt, Homo sapiens
gaugguagcagcugauaaa

SEQ ID NO: 64301 - RNA, 19 nt, Homo sapiens
gacaaagcccguugcauuu

SEQ ID NO: 64302 - RNA, 19 nt, Homo sapiens
ugugaucugucuuguaaua

SEQ ID NO: 64303 - RNA, 19 nt, Homo sapiens
gaaauucaucauccaguuu

SEQ ID NO: 64304 - RNA, 19 nt, Homo sapiens
aacaaacaccuccuuauua

SEQ ID NO: 64305 - RNA, 19 nt, Homo sapiens
gaaauguaguugauguauc

SEQ ID NO: 64306 - RNA, 19 nt, Homo sapiens
gcuaagaagcagucacaua

SEQ ID NO: 64307 - RNA, 19 nt, Homo sapiens
cgagggaaaucucaagcua

SEQ ID NO: 64308 - RNA, 19 nt, Homo sapiens
agacaaagcccguugcauu

SEQ ID NO: 64309 - RNA, 19 nt, Homo sapiens
uggcuuagaugcagaagaa

SEQ ID NO: 64310 - RNA, 19 nt, Homo sapiens
agaagaaccuaguguggaa

SEQ ID NO: 64311 - RNA, 19 nt, Homo sapiens
gcaggcaucugauuugcau

SEQ ID NO: 64312 - RNA, 19 nt, Homo sapiens
acacugcaaucauauguga

SEQ ID NO: 64313 - RNA, 19 nt, Homo sapiens
uagcggaaguucagaguga

SEQ ID NO: 64314 - RNA, 19 nt, Homo sapiens
caguuugggugacauagua

SEQ ID NO: 64315 - RNA, 19 nt, Homo sapiens
guacggguguccuaugguu

SEQ ID NO: 64316 - RNA, 19 nt, Homo sapiens
ggaaaucucaagcuaaaca

SEQ ID NO: 64317 - RNA, 19 nt, Homo sapiens
caaaggggaucauaaaguu

SEQ ID NO: 64318 - RNA, 19 nt, Homo sapiens
gaauagcaauagcauggau

SEQ ID NO: 64319 - RNA, 19 nt, Homo sapiens
ccaaggaucgcuacuguga

SEQ ID NO: 64320 - RNA, 19 nt, Homo sapiens
ggaccacuguuucuugcuu

SEQ ID NO: 64321 - RNA, 19 nt, Homo sapiens
caucugauuugcauauuca

SEQ ID NO: 64322 - RNA, 19 nt, Homo sapiens
auagaaagauccaacacaa

SEQ ID NO: 64323 - RNA, 19 nt, Homo sapiens
gggcggauauccaucacaa

SEQ ID NO: 64324 - RNA, 19 nt, Homo sapiens
gccagaaucagcacagaua

SEQ ID NO: 64325 - RNA, 19 nt, Homo sapiens
aaggaucgcuacugugaaa

SEQ ID NO: 64326 - RNA, 19 nt, Homo sapiens
ucacagauaugaugcaaaa

SEQ ID NO: 64327 - RNA, 19 nt, Homo sapiens
gauuugcucaugccucuua

SEQ ID NO: 64328 - RNA, 19 nt, Homo sapiens
agggaaaucucaagcuaaa

SEQ ID NO: 64329 - RNA, 19 nt, Homo sapiens
caaacaccuccuuauuaua

SEQ ID NO: 64330 - RNA, 19 nt, Homo sapiens
gugagcaccuugccgacua

SEQ ID NO: 64331 - RNA, 19 nt, Homo sapiens
gcaguccuccgguugcaua

SEQ ID NO: 64332 - RNA, 19 nt, Homo sapiens
ucgagacucugccuacgua

SEQ ID NO: 64333 - RNA, 19 nt, Homo sapiens
caaacaaacaccuccuuau

SEQ ID NO: 64334 - RNA, 19 nt, Homo sapiens
cuccagagcuguucgaugu

SEQ ID NO: 64335 - RNA, 19 nt, Homo sapiens
ggaggcagaagcuaaguga

SEQ ID NO: 64336 - RNA, 19 nt, Homo sapiens
gaagaagaucucaaauuac

SEQ ID NO: 64337 - RNA, 19 nt, Homo sapiens
guaaaagcgucaccaagaa

SEQ ID NO: 64338 - RNA, 19 nt, Homo sapiens
ccaguaagcacgcaauaau

SEQ ID NO: 64339 - RNA, 19 nt, Homo sapiens
gaagggcggauauccauca

SEQ ID NO: 64340 - RNA, 19 nt, Homo sapiens
aaagaaggcugugaaaucg

SEQ ID NO: 64341 - RNA, 19 nt, Homo sapiens
uacauaaauuggccuggua

SEQ ID NO: 64342 - RNA, 19 nt, Homo sapiens
uggauagaguauugagaua

SEQ ID NO: 64343 - RNA, 19 nt, Homo sapiens
uauuauugcuguugcuuga

SEQ ID NO: 64344 - RNA, 19 nt, Homo sapiens
gcuguucgaugugaucuug

SEQ ID NO: 64345 - RNA, 19 nt, Homo sapiens
ccagagcuguucgauguga

SEQ ID NO: 64346 - RNA, 19 nt, Homo sapiens
gcuaagugauuugcucaug

SEQ ID NO: 64347 - RNA, 19 nt, Homo sapiens
ucaguuugaucacacuauu

SEQ ID NO: 64348 - RNA, 19 nt, Homo sapiens
gcaucugauuugcauauuc

SEQ ID NO: 64349 - RNA, 19 nt, Homo sapiens
gaaaugcaagacacucaga

SEQ ID NO: 64350 - RNA, 19 nt, Homo sapiens
cagcgcagccgucauaaau

SEQ ID NO: 64351 - RNA, 19 nt, Homo sapiens
gagggaaaucucaagcuaa

SEQ ID NO: 64352 - RNA, 19 nt, Homo sapiens
caguaagcacgcaauaaua

SEQ ID NO: 64353 - RNA, 19 nt, Homo sapiens
auaaacagcagcaggagua

SEQ ID NO: 64354 - RNA, 19 nt, Homo sapiens
uaacaaugacugguggaua

SEQ ID NO: 64355 - RNA, 19 nt, Homo sapiens
guaagugcuacauaaauug

SEQ ID NO: 64356 - RNA, 19 nt, Homo sapiens
uaagaagcagucacauaaa

SEQ ID NO: 64357 - RNA, 19 nt, Homo sapiens
guauuaaacaaucccagua

SEQ ID NO: 64358 - RNA, 19 nt, Homo sapiens
ggaggaaauucaucaucca

SEQ ID NO: 64359 - RNA, 19 nt, Homo sapiens
uaaaucaggaggaaauuca

SEQ ID NO: 64360 - RNA, 19 nt, Homo sapiens
aagaagaucucaaauuacg

SEQ ID NO: 64361 - RNA, 19 nt, Homo sapiens
aagcagcgcagccgucaua

SEQ ID NO: 64362 - RNA, 19 nt, Homo sapiens
ggauagggcgauugguaaa

SEQ ID NO: 64363 - RNA, 19 nt, Homo sapiens
ggucacagauaugaugcaa

SEQ ID NO: 64364 - RNA, 19 nt, Homo sapiens
aauaaaaucucgagggaaa

SEQ ID NO: 64365 - RNA, 19 nt, Homo sapiens
ugacaucucgcuugccaaa

SEQ ID NO: 64366 - RNA, 19 nt, Homo sapiens
guggauagggcgauuggua

SEQ ID NO: 64367 - RNA, 19 nt, Homo sapiens
aacaaugacugguggauag

SEQ ID NO: 64368 - RNA, 19 nt, Homo sapiens
uuaauacgcaggcaucuga

SEQ ID NO: 64369 - RNA, 19 nt, Homo sapiens
aagaaacucugacgaucug

SEQ ID NO: 64370 - RNA, 19 nt, Homo sapiens
caagaacauugcaguuggu

SEQ ID NO: 64371 - RNA, 19 nt, Homo sapiens
agagugaaaucgaaaggau

SEQ ID NO: 64372 - RNA, 19 nt, Homo sapiens
gagccaagcaagggaaauu

SEQ ID NO: 64373 - RNA, 19 nt, Homo sapiens
gaguacggguguccuaugg

SEQ ID NO: 64374 - RNA, 19 nt, Homo sapiens
uuggguagcugccacuuga

SEQ ID NO: 64375 - RNA, 19 nt, Homo sapiens
auggagaagugauaucaaa

SEQ ID NO: 64376 - RNA, 19 nt, Homo sapiens
uucccaagcugaagaagaa

SEQ ID NO: 64377 - RNA, 19 nt, Homo sapiens
cuagugggcccuucucuga

SEQ ID NO: 64378 - RNA, 19 nt, Homo sapiens
gcacacuccuccguaugau

SEQ ID NO: 64379 - RNA, 19 nt, Homo sapiens
aguagaaggugggaagaaa

SEQ ID NO: 64380 - RNA, 19 nt, Homo sapiens
ugaaaaggauggagaagug

SEQ ID NO: 64381 - RNA, 19 nt, Homo sapiens
gcacaaaccugaggcauuu

SEQ ID NO: 64382 - RNA, 19 nt, Homo sapiens
guacagauggcauaugaua

SEQ ID NO: 64383 - RNA, 19 nt, Homo sapiens
ucacagacaugaugcagaa

SEQ ID NO: 64384 - RNA, 19 nt, Homo sapiens
gacccucucugaaagguua

SEQ ID NO: 64385 - RNA, 19 nt, Homo sapiens
gcaagaggaccaucauuga

SEQ ID NO: 64386 - RNA, 19 nt, Homo sapiens
ggagucauuugaugugauu

SEQ ID NO: 64387 - RNA, 19 nt, Homo sapiens
aaagauuuccuccacauua

SEQ ID NO: 64388 - RNA, 19 nt, Homo sapiens
gaacagaaggccaggagau

SEQ ID NO: 64389 - RNA, 19 nt, Homo sapiens
aaagagaaguacagcaaug

SEQ ID NO: 64390 - RNA, 19 nt, Homo sapiens
gcccaaggauagcuacuga

SEQ ID NO: 64391 - RNA, 19 nt, Homo sapiens
ccaaaucccugcagcuagu

SEQ ID NO: 64392 - RNA, 19 nt, Homo sapiens
aagauuuccuccacauuaa

SEQ ID NO: 64393 - RNA, 19 nt, Homo sapiens
ugagaucgagcgcauauuu

SEQ ID NO: 64394 - RNA, 19 nt, Homo sapiens
ccguacagauggcauauga

SEQ ID NO: 64395 - RNA, 19 nt, Homo sapiens
ccaaagauuuccuccacau

SEQ ID NO: 64396 - RNA, 19 nt, Homo sapiens
gaucugugcucaacaaucc

SEQ ID NO: 64397 - RNA, 19 nt, Homo sapiens
gaaagguuaugaggucaca

SEQ ID NO: 64398 - RNA, 19 nt, Homo sapiens
ggugggacccucucugaaa

SEQ ID NO: 64399 - RNA, 19 nt, Homo sapiens
gcaccugaccguacagaug

SEQ ID NO: 64400 - RNA, 19 nt, Homo sapiens
guuaugaggucacagacau

SEQ ID NO: 64401 - RNA, 19 nt, Homo sapiens
ggaccaaugucagcuacug

SEQ ID NO: 64402 - RNA, 19 nt, Homo sapiens
ggaagucacagaugaagca

SEQ ID NO: 64403 - RNA, 19 nt, Homo sapiens
caaaguguccucaccaaag

SEQ ID NO: 64404 - RNA, 19 nt, Homo sapiens
ggcaagaggaccaucauug

SEQ ID NO: 64405 - RNA, 19 nt, Homo sapiens
cgaaagggccaagcacaaa

SEQ ID NO: 64406 - RNA, 19 nt, Homo sapiens
ccaccggagucauuugaug

SEQ ID NO: 64407 - RNA, 19 nt, Homo sapiens
gaggaggacuacgcagaug

SEQ ID NO: 64408 - RNA, 19 nt, Homo sapiens
ugaagcaccugaccguaca

SEQ ID NO: 64409 - RNA, 19 nt, Homo sapiens
uuaaagagaaguacagcaa

SEQ ID NO: 64410 - RNA, 19 nt, Homo sapiens
gagaucgagcgcauauuug

SEQ ID NO: 64411 - RNA, 19 nt, Homo sapiens
ggaggaggacuacgcagau

SEQ ID NO: 64412 - RNA, 19 nt, Homo sapiens
ggccaaaucccugcagcua

SEQ ID NO: 64413 - RNA, 19 nt, Homo sapiens
gugagcuccuggcugagua

SEQ ID NO: 64414 - RNA, 19 nt, Homo sapiens
caaagauuuccuccacauu

SEQ ID NO: 64415 - RNA, 19 nt, Homo sapiens
uugcggaagugcagaguga

SEQ ID NO: 64416 - RNA, 19 nt, Homo sapiens
cagaacacaaccacaguga

SEQ ID NO: 64417 - RNA, 19 nt, Homo sapiens
gcccaggacucagaacaca

SEQ ID NO: 64418 - RNA, 19 nt, Homo sapiens
gucaaaguguccucaccaa

SEQ ID NO: 64419 - RNA, 19 nt, Homo sapiens
gcucaaacaggaacagaag

SEQ ID NO: 64420 - RNA, 19 nt, Homo sapiens
cagcuacuguggcguacug

SEQ ID NO: 64421 - RNA, 19 nt, Homo sapiens
gaaagggccaagcacaaac

SEQ ID NO: 64422 - RNA, 19 nt, Homo sapiens
aaaguguccucaccaaagg

SEQ ID NO: 64423 - RNA, 19 nt, Homo sapiens
uugaugugauucuggauga

SEQ ID NO: 64424 - RNA, 19 nt, Homo sapiens
ucucuucgacuuccucaaa

SEQ ID NO: 64425 - RNA, 19 nt, Homo sapiens
acagauggcauaugauaag

SEQ ID NO: 64426 - RNA, 19 nt, Homo sapiens
ucaaaguguccucaccaaa

SEQ ID NO: 64427 - RNA, 19 nt, Homo sapiens
gacauuggcaaccgacguu

SEQ ID NO: 64428 - RNA, 19 nt, Homo sapiens
gcuugaugcccucugauga

SEQ ID NO: 64429 - RNA, 19 nt, Homo sapiens
gcggugaggaccaauguca

SEQ ID NO: 64430 - RNA, 19 nt, Homo sapiens
caagaggaccaucauugag

SEQ ID NO: 64431 - RNA, 19 nt, Homo sapiens
gugggacccucucugaaag

SEQ ID NO: 64432 - RNA, 19 nt, Homo sapiens
uaaagagaaguacagcaau

SEQ ID NO: 64433 - RNA, 19 nt, Homo sapiens
guacuccagcgucucauuc

SEQ ID NO: 64434 - RNA, 19 nt, Homo sapiens
agaucgagcgcauauuuga

SEQ ID NO: 64435 - RNA, 19 nt, Homo sapiens
acagcuugaugcccucuga

SEQ ID NO: 64436 - RNA, 19 nt, Homo sapiens
gcucagcagcagcucgaaa

SEQ ID NO: 64437 - RNA, 19 nt, Homo sapiens
gcuccagcauugcggaagu

SEQ ID NO: 64438 - RNA, 19 nt, Homo sapiens
gggcaagaggaccaucauu

SEQ ID NO: 64439 - RNA, 19 nt, Homo sapiens
cauaugauaagcugguuca

SEQ ID NO: 64440 - RNA, 19 nt, Homo sapiens
gaugugauucuggaugaga

SEQ ID NO: 64441 - RNA, 19 nt, Homo sapiens
aaagcaggcggaacauguu

SEQ ID NO: 64442 - RNA, 19 nt, Homo sapiens
ggaagugcagagugagauc

SEQ ID NO: 64443 - RNA, 19 nt, Homo sapiens
gagaaguacagcaaugacu

SEQ ID NO: 64444 - RNA, 19 nt, Homo sapiens
ugaggucacagacaugaug

SEQ ID NO: 64445 - RNA, 19 nt, Homo sapiens
gcccaccggagucauuuga

SEQ ID NO: 64446 - RNA, 19 nt, Homo sapiens
aaagcgaucugugcucaac

SEQ ID NO: 64447 - RNA, 19 nt, Homo sapiens
gggcucuggagucaacuuu

SEQ ID NO: 64448 - RNA, 19 nt, Homo sapiens
aagagaaguacagcaauga

SEQ ID NO: 64449 - RNA, 19 nt, Homo sapiens
ugaccguacagauggcaua

SEQ ID NO: 64450 - RNA, 19 nt, Homo sapiens
caaaucccugcagcuagua

SEQ ID NO: 64451 - RNA, 19 nt, Homo sapiens
ucugcccgcuccagcauug

SEQ ID NO: 64452 - RNA, 19 nt, Homo sapiens
ucgaaagggccaagcacaa

SEQ ID NO: 64453 - RNA, 19 nt, Homo sapiens
ccggagucauuugauguga

SEQ ID NO: 64454 - RNA, 19 nt, Homo sapiens
uacagauggcauaugauaa

SEQ ID NO: 64455 - RNA, 19 nt, Homo sapiens
gcacagcuaucuccuuuga

SEQ ID NO: 64456 - RNA, 19 nt, Homo sapiens
ccagaaauguuugauguua

SEQ ID NO: 64457 - RNA, 19 nt, Homo sapiens
gaaagagggcugugaaauu

SEQ ID NO: 64458 - RNA, 19 nt, Homo sapiens
uaacagacaugaugcagaa

SEQ ID NO: 64459 - RNA, 19 nt, Homo sapiens
ggauaaaccaaucaucuua

SEQ ID NO: 64460 - RNA, 19 nt, Homo sapiens
guccaaaccuguagcauuu

SEQ ID NO: 64461 - RNA, 19 nt, Homo sapiens
uaagaggucuguccuaaau

SEQ ID NO: 64462 - RNA, 19 nt, Homo sapiens
gaaaucaaguggaaauucu

SEQ ID NO: 64463 - RNA, 19 nt, Homo sapiens
gcuaagaggucuguccuaa

SEQ ID NO: 64464 - RNA, 19 nt, Homo sapiens
ggagggaaaucaaguggaa

SEQ ID NO: 64465 - RNA, 19 nt, Homo sapiens
aaagagggcugugaaauug

SEQ ID NO: 64466 - RNA, 19 nt, Homo sapiens
ccacggcacucucaccaua

SEQ ID NO: 64467 - RNA, 19 nt, Homo sapiens
gaugggaggauuucaauaa

SEQ ID NO: 64468 - RNA, 19 nt, Homo sapiens
ggccgucacugaaagguua

SEQ ID NO: 64469 - RNA, 19 nt, Homo sapiens
agaggaaagucacaaagua

SEQ ID NO: 64470 - RNA, 19 nt, Homo sapiens
gcacauuccuccuuacgau

SEQ ID NO: 64471 - RNA, 19 nt, Homo sapiens
uuacagcgguugauuaaau

SEQ ID NO: 64472 - RNA, 19 nt, Homo sapiens
uaggaaggcuggugaaaga

SEQ ID NO: 64473 - RNA, 19 nt, Homo sapiens
cuaaugaccucugaugaaa

SEQ ID NO: 64474 - RNA, 19 nt, Homo sapiens
gguggcagcugauaaacuu

SEQ ID NO: 64475 - RNA, 19 nt, Homo sapiens
ggaaguacaaagugaaauu

SEQ ID NO: 64476 - RNA, 19 nt, Homo sapiens
gaggaaagucacaaaguaa

SEQ ID NO: 64477 - RNA, 19 nt, Homo sapiens
gaacacccgguccagcuua

SEQ ID NO: 64478 - RNA, 19 nt, Homo sapiens
agaggucuguccuaaauaa

SEQ ID NO: 64479 - RNA, 19 nt, Homo sapiens
aagcacagcuaucuccuuu

SEQ ID NO: 64480 - RNA, 19 nt, Homo sapiens
gaagucuaaugaccucuga

SEQ ID NO: 64481 - RNA, 19 nt, Homo sapiens
gaaagggcucggaagagua

SEQ ID NO: 64482 - RNA, 19 nt, Homo sapiens
uauaaagacuuccuuagca

SEQ ID NO: 64483 - RNA, 19 nt, Homo sapiens
aagauuacccugacucaua

SEQ ID NO: 64484 - RNA, 19 nt, Homo sapiens
acugaaagguuacgaggua

SEQ ID NO: 64485 - RNA, 19 nt, Homo sapiens
caucuuaacuuggcuaaca

SEQ ID NO: 64486 - RNA, 19 nt, Homo sapiens
gacauaggcuuugagucua

SEQ ID NO: 64487 - RNA, 19 nt, Homo sapiens
cagcauagccgagaucauu

SEQ ID NO: 64488 - RNA, 19 nt, Homo sapiens
ggaaauucuucuucaaguc

SEQ ID NO: 64489 - RNA, 19 nt, Homo sapiens
gagucuagauggauauuag

SEQ ID NO: 64490 - RNA, 19 nt, Homo sapiens
cugauaaacuugcacaaug

SEQ ID NO: 64491 - RNA, 19 nt, Homo sapiens
cagcacaacuuauaaagac

SEQ ID NO: 64492 - RNA, 19 nt, Homo sapiens
gaacauacggauccagcaa

SEQ ID NO: 64493 - RNA, 19 nt, Homo sapiens
acucauaccaggacacuua

SEQ ID NO: 64494 - RNA, 19 nt, Homo sapiens
ggacgaggaugugccuguu

SEQ ID NO: 64495 - RNA, 19 nt, Homo sapiens
cgacauaggcuuugagucu

SEQ ID NO: 64496 - RNA, 19 nt, Homo sapiens
gaaguacaaagugaaauug

SEQ ID NO: 64497 - RNA, 19 nt, Homo sapiens
gcugacauuucucuugcua

SEQ ID NO: 64498 - RNA, 19 nt, Homo sapiens
gggaggauuucaauaacga

SEQ ID NO: 64499 - RNA, 19 nt, Homo sapiens
gaaaugguaucugggacau

SEQ ID NO: 64500 - RNA, 19 nt, Homo sapiens
ugaaagggcucggaagagu

SEQ ID NO: 64501 - RNA, 19 nt, Homo sapiens
ucacccagcacaacuuaua

SEQ ID NO: 64502 - RNA, 19 nt, Homo sapiens
uagcggaaguacaaaguga

SEQ ID NO: 64503 - RNA, 19 nt, Homo sapiens
gagagugacagcugacauu

SEQ ID NO: 64504 - RNA, 19 nt, Homo sapiens
ggaaaucaaguggaaauuc

SEQ ID NO: 64505 - RNA, 19 nt, Homo sapiens
guaaaagucucaucuccaa

SEQ ID NO: 64506 - RNA, 19 nt, Homo sapiens
cagcuuagcggaaguacaa

SEQ ID NO: 64507 - RNA, 19 nt, Homo sapiens
acagcuaucuccuuugaug

SEQ ID NO: 64508 - RNA, 19 nt, Homo sapiens
agccaugacucccgacaua

SEQ ID NO: 64509 - RNA, 19 nt, Homo sapiens
cacagcaauuucuggguua

SEQ ID NO: 64510 - RNA, 19 nt, Homo sapiens
ugacuccgaugucucuuug

SEQ ID NO: 64511 - RNA, 19 nt, Homo sapiens
gaaauucuucuucaagucu

SEQ ID NO: 64512 - RNA, 19 nt, Homo sapiens
gagaacagcaagcagcuau

SEQ ID NO: 64513 - RNA, 19 nt, Homo sapiens
ucauuacccucuuguggaa

SEQ ID NO: 64514 - RNA, 19 nt, Homo sapiens
gaaagucacaaaguaaaca

SEQ ID NO: 64515 - RNA, 19 nt, Homo sapiens
ugacauuucucuugcuaag

SEQ ID NO: 64516 - RNA, 19 nt, Homo sapiens
gaagaggaccgggaagcaa

SEQ ID NO: 64517 - RNA, 19 nt, Homo sapiens
acauaggcuuugagucuaa

SEQ ID NO: 64518 - RNA, 19 nt, Homo sapiens
gaagaagauuacccugacu

SEQ ID NO: 64519 - RNA, 19 nt, Homo sapiens
cgagaucauuacccucuug

SEQ ID NO: 64520 - RNA, 19 nt, Homo sapiens
uuacagagucagcgaauga

SEQ ID NO: 64521 - RNA, 19 nt, Homo sapiens
gcacaacuuauaaagacuu

SEQ ID NO: 64522 - RNA, 19 nt, Homo sapiens
cagcaagagagcaauaauu

SEQ ID NO: 64523 - RNA, 19 nt, Homo sapiens
guaggaaccgcuugucuuc

SEQ ID NO: 64524 - RNA, 19 nt, Homo sapiens
gaacucuccaauugaaaga

SEQ ID NO: 64525 - RNA, 19 nt, Homo sapiens
ccacucagauuggagaaca

SEQ ID NO: 64526 - RNA, 19 nt, Homo sapiens
agacaaaugugagcuacug

SEQ ID NO: 64527 - RNA, 19 nt, Homo sapiens
cuaaauaaucccagcaaga

SEQ ID NO: 64528 - RNA, 19 nt, Homo sapiens
ccgagcaacucccacauca

SEQ ID NO: 64529 - RNA, 19 nt, Homo sapiens
uaaauaaucccagcaagag

SEQ ID NO: 64530 - RNA, 19 nt, Homo sapiens
cgagguaacagacaugaug

SEQ ID NO: 64531 - RNA, 19 nt, Homo sapiens
gagcaacucccacaucaac

SEQ ID NO: 64532 - RNA, 19 nt, Homo sapiens
agucucaucuccaaagguu

SEQ ID NO: 64533 - RNA, 19 nt, Homo sapiens
ggauuucaauaacgagagu

SEQ ID NO: 64534 - RNA, 19 nt, Homo sapiens
ggcuuugagucuaaugaaa

SEQ ID NO: 64535 - RNA, 19 nt, Homo sapiens
gcuugaggaugcaugugaa

SEQ ID NO: 64536 - RNA, 19 nt, Homo sapiens
gugcuaggauaaaccaauc

SEQ ID NO: 64537 - RNA, 19 nt, Homo sapiens
gcaaaguccaaaccuguag

SEQ ID NO: 64538 - RNA, 19 nt, Homo sapiens
ggagagagaacagcaagca

SEQ ID NO: 64539 - RNA, 19 nt, Homo sapiens
ucuaaugaccucugaugaa

SEQ ID NO: 64540 - RNA, 19 nt, Homo sapiens
ccauaucccacagcaauuu

SEQ ID NO: 64541 - RNA, 19 nt, Homo sapiens
caacugguggcagcugaua

SEQ ID NO: 64542 - RNA, 19 nt, Homo sapiens
uggaaauucuucuucaagu

SEQ ID NO: 64543 - RNA, 19 nt, Homo sapiens
gauaggaaggcuggugaaa

SEQ ID NO: 64544 - RNA, 19 nt, Homo sapiens
aaugauugguggauaggaa

SEQ ID NO: 64545 - RNA, 19 nt, Homo sapiens
caccauaucccacagcaau

SEQ ID NO: 64546 - RNA, 19 nt, Homo sapiens
ugauaaacuugcacaaugc

SEQ ID NO: 64547 - RNA, 19 nt, Homo sapiens
ggugaaagagggcugugaa

SEQ ID NO: 64548 - RNA, 19 nt, Homo sapiens
ccuugagucuagauggaua

SEQ ID NO: 64549 - RNA, 19 nt, Homo sapiens
aaccaaucaucuuaacuug

SEQ ID NO: 64550 - RNA, 19 nt, Homo sapiens
agugacagcugacauuucu

SEQ ID NO: 64551 - RNA, 19 nt, Homo sapiens
gcuaucuccuuugaugcua

SEQ ID NO: 64552 - RNA, 19 nt, Homo sapiens
gcccuugagucuagaugga

SEQ ID NO: 64553 - RNA, 19 nt, Homo sapiens
agacaggguucagcggauu

SEQ ID NO: 64554 - RNA, 19 nt, Homo sapiens
gcggaaguacaaagugaaa

SEQ ID NO: 64555 - RNA, 19 nt, Homo sapiens
gcucggagaucuucgaauu

SEQ ID NO: 64556 - RNA, 19 nt, Homo sapiens
gacuguggcuugaaauaaa

SEQ ID NO: 64557 - RNA, 19 nt, Homo sapiens
guaaauagccagccugucu

SEQ ID NO: 64558 - RNA, 19 nt, Homo sapiens
ggaagaagagggacuaucu

SEQ ID NO: 64559 - RNA, 19 nt, Homo sapiens
gauaagcugccuccaguug

SEQ ID NO: 64560 - RNA, 19 nt, Homo sapiens
gagcaagacgugaguccua

SEQ ID NO: 64561 - RNA, 19 nt, Homo sapiens
gaaucugacuguggcuuga

SEQ ID NO: 64562 - RNA, 19 nt, Homo sapiens
uuaacuggguagaaucuga

SEQ ID NO: 64563 - RNA, 19 nt, Homo sapiens
ugacuguggcuugaaauaa

SEQ ID NO: 64564 - RNA, 19 nt, Homo sapiens
ucggagaucuucgaauuca

SEQ ID NO: 64565 - RNA, 19 nt, Homo sapiens
gaagaagagggacuaucug

SEQ ID NO: 64566 - RNA, 19 nt, Homo sapiens
guccuaaccuggccacagu

SEQ ID NO: 64567 - RNA, 19 nt, Homo sapiens
ggccaugacagccguggua

SEQ ID NO: 64568 - RNA, 19 nt, Homo sapiens
guuccuacuucaggcauuu

SEQ ID NO: 64569 - RNA, 19 nt, Homo sapiens
gugaagcgcaugauugaca

SEQ ID NO: 64570 - RNA, 19 nt, Homo sapiens
uaagcugccuccaguuguc

SEQ ID NO: 64571 - RNA, 19 nt, Homo sapiens
gaggaggcgggagcaauuu

SEQ ID NO: 64572 - RNA, 19 nt, Homo sapiens
cagaaggaguacagcaucu

SEQ ID NO: 64573 - RNA, 19 nt, Homo sapiens
uagccagccugucucuuuc

SEQ ID NO: 64574 - RNA, 19 nt, Homo sapiens
cuccaguuguccuuuauga

SEQ ID NO: 64575 - RNA, 19 nt, Homo sapiens
auagccagccugucucuuu

SEQ ID NO: 64576 - RNA, 19 nt, Homo sapiens
ugccuccaguuguccuuua

SEQ ID NO: 64577 - RNA, 19 nt, Homo sapiens
ccacuguaccagccucuga

SEQ ID NO: 64578 - RNA, 19 nt, Homo sapiens
agaggaggcgggagcaauu

SEQ ID NO: 64579 - RNA, 19 nt, Homo sapiens
gagaggaggcgggagcaau

SEQ ID NO: 64580 - RNA, 19 nt, Homo sapiens
cgaauucaccacucagaag

SEQ ID NO: 64581 - RNA, 19 nt, Homo sapiens
guaccagccucugauaagc

SEQ ID NO: 64582 - RNA, 19 nt, Homo sapiens
agcaagacgugaguccuaa

SEQ ID NO: 64583 - RNA, 19 nt, Homo sapiens
ggucuuggccuggaaccuu

SEQ ID NO: 64584 - RNA, 19 nt, Homo sapiens
cggugaagcgcaugauuga

SEQ ID NO: 64585 - RNA, 19 nt, Homo sapiens
ccaguuguccuuuaugaac

SEQ ID NO: 64586 - RNA, 19 nt, Homo sapiens
ccgucuggaucgaguacua

SEQ ID NO: 64587 - RNA, 19 nt, Homo sapiens
cauguucuaugccuuugca

SEQ ID NO: 64588 - RNA, 19 nt, Homo sapiens
caguuguccuuuaugaaca

SEQ ID NO: 64589 - RNA, 19 nt, Homo sapiens
cuugucaccugcccuagga

SEQ ID NO: 64590 - RNA, 19 nt, Homo sapiens
ggaggcgggagcaauuuua

SEQ ID NO: 64591 - RNA, 19 nt, Homo sapiens
ggagcccugggaagcauuu

SEQ ID NO: 64592 - RNA, 19 nt, Homo sapiens
gcagguggacagguguuug

SEQ ID NO: 64593 - RNA, 19 nt, Homo sapiens
ccacauggagcaccacaac

SEQ ID NO: 64594 - RNA, 19 nt, Homo sapiens
gcgugacccucuucugcau

SEQ ID NO: 64595 - RNA, 19 nt, Homo sapiens
guccauguucuaugccuuu

SEQ ID NO: 64596 - RNA, 19 nt, Homo sapiens
ccgcguccauguucuaugc

SEQ ID NO: 64597 - RNA, 19 nt, Homo sapiens
gguguuccguguaaauagc

SEQ ID NO: 64598 - RNA, 19 nt, Homo sapiens
uauuacuccugguccuuug

SEQ ID NO: 64599 - RNA, 19 nt, Homo sapiens
gagcucggagaucuucgaa

SEQ ID NO: 64600 - RNA, 19 nt, Homo sapiens
caccaugucccagaccaaa

SEQ ID NO: 64601 - RNA, 19 nt, Homo sapiens
ggaaauauccuaaugguuu

SEQ ID NO: 64602 - RNA, 19 nt, Homo sapiens
ggaagaaacuacaacagaa

SEQ ID NO: 64603 - RNA, 19 nt, Homo sapiens
gaaagcaaguacacuggua

SEQ ID NO: 64604 - RNA, 19 nt, Homo sapiens
gauguuaucuggcguauuc

SEQ ID NO: 64605 - RNA, 19 nt, Homo sapiens
gcugaaggcugcucaaguu

SEQ ID NO: 64606 - RNA, 19 nt, Homo sapiens
ggacugugcuuacccuuau

SEQ ID NO: 64607 - RNA, 19 nt, Homo sapiens
gccaugaaguuccuuaauu

SEQ ID NO: 64608 - RNA, 19 nt, Homo sapiens
cagaagaugugcucagcua

SEQ ID NO: 64609 - RNA, 19 nt, Homo sapiens
gaagaaacuacaacagaaa

SEQ ID NO: 64610 - RNA, 19 nt, Homo sapiens
ccaugaaguuccuuaauug

SEQ ID NO: 64611 - RNA, 19 nt, Homo sapiens
gaacggaucaagugcuuau

SEQ ID NO: 64612 - RNA, 19 nt, Homo sapiens
gagaacggaucaagugcuu

SEQ ID NO: 64613 - RNA, 19 nt, Homo sapiens
caacugggcuguggcaauc

SEQ ID NO: 64614 - RNA, 19 nt, Homo sapiens
gggaagaaacuacaacaga

SEQ ID NO: 64615 - RNA, 19 nt, Homo sapiens
gcuggaagcugucguugag

SEQ ID NO: 64616 - RNA, 19 nt, Homo sapiens
agacacagccaccgaguuu

SEQ ID NO: 64617 - RNA, 19 nt, Homo sapiens
gcagaacuaagcagucuug

SEQ ID NO: 64618 - RNA, 19 nt, Homo sapiens
ccuaaugguuucagagaug

SEQ ID NO: 64619 - RNA, 19 nt, Homo sapiens
gaaggaguaguaagcagaa

SEQ ID NO: 64620 - RNA, 19 nt, Homo sapiens
gcuuugaaguugccaugaa

SEQ ID NO: 64621 - RNA, 19 nt, Homo sapiens
guacaaaggguucaaugca

SEQ ID NO: 64622 - RNA, 19 nt, Homo sapiens
ggagucacauccuuguaca

SEQ ID NO: 64623 - RNA, 19 nt, Homo sapiens
gauccgaggcaucuacaaa

SEQ ID NO: 64624 - RNA, 19 nt, Homo sapiens
gaagaugugcucagcuauc

SEQ ID NO: 64625 - RNA, 19 nt, Homo sapiens
gaaacacccagaagaugug

SEQ ID NO: 64626 - RNA, 19 nt, Homo sapiens
ggaaauggaacaaguagcu

SEQ ID NO: 64627 - RNA, 19 nt, Homo sapiens
gaacugacagacggaguga

SEQ ID NO: 64628 - RNA, 19 nt, Homo sapiens
caacagaaacacccagaag

SEQ ID NO: 64629 - RNA, 19 nt, Homo sapiens
uggugagacuguugccuua

SEQ ID NO: 64630 - RNA, 19 nt, Homo sapiens
cauguacucugggaccuuu

SEQ ID NO: 64631 - RNA, 19 nt, Homo sapiens
gaagcuguaccaggaguuu

SEQ ID NO: 64632 - RNA, 19 nt, Homo sapiens
gugagacuguugccuuaau

SEQ ID NO: 64633 - RNA, 19 nt, Homo sapiens
uggaauguauuucaugaca

SEQ ID NO: 64634 - RNA, 19 nt, Homo sapiens
ccugggaaauauccuaaug

SEQ ID NO: 64635 - RNA, 19 nt, Homo sapiens
gacugcaccuccugggaaa

SEQ ID NO: 64636 - RNA, 19 nt, Homo sapiens
gggacugugcuuacccuua

SEQ ID NO: 64637 - RNA, 19 nt, Homo sapiens
gaucaagugcuuauuacag

SEQ ID NO: 64638 - RNA, 19 nt, Homo sapiens
ggacuuggugagacuguug

SEQ ID NO: 64639 - RNA, 19 nt, Homo sapiens
gcuaguggaauguauuuca

SEQ ID NO: 64640 - RNA, 19 nt, Homo sapiens
cauccugcaccguguauaa

SEQ ID NO: 64641 - RNA, 19 nt, Homo sapiens
ugagacuguugccuuaaug

SEQ ID NO: 64642 - RNA, 19 nt, Homo sapiens
gaaauggaacaaguagcuu

SEQ ID NO: 64643 - RNA, 19 nt, Homo sapiens
gaaggcugcucaaguucac

SEQ ID NO: 64644 - RNA, 19 nt, Homo sapiens
cagccaaugcggccuguuu

SEQ ID NO: 64645 - RNA, 19 nt, Homo sapiens
aguggaauguauuucauga

SEQ ID NO: 64646 - RNA, 19 nt, Homo sapiens
cagcuaguggaauguauuu

SEQ ID NO: 64647 - RNA, 19 nt, Homo sapiens
caagugcuuauuacagauu

SEQ ID NO: 64648 - RNA, 19 nt, Homo sapiens
acggaucaagugcuuauua

SEQ ID NO: 64649 - RNA, 19 nt, Homo sapiens
agaaacacccagaagaugu

SEQ ID NO: 64650 - RNA, 19 nt, Homo sapiens
acagaaacacccagaagau

SEQ ID NO: 64651 - RNA, 19 nt, Homo sapiens
gagacuguugccuuaauga

SEQ ID NO: 64652 - RNA, 19 nt, Homo sapiens
gcauggacuuggugagacu

SEQ ID NO: 64653 - RNA, 19 nt, Homo sapiens
cagaaacacccagaagaug

SEQ ID NO: 64654 - RNA, 19 nt, Homo sapiens
ggagaaggaguaguaagca

SEQ ID NO: 64655 - RNA, 19 nt, Homo sapiens
uugaggagaaggaguagua

SEQ ID NO: 64656 - RNA, 19 nt, Homo sapiens
guagcuuccagaccagaua

SEQ ID NO: 64657 - RNA, 19 nt, Homo sapiens
uguauaacuuaguguguca

SEQ ID NO: 64658 - RNA, 19 nt, Homo sapiens
ugggaaauauccuaauggu

SEQ ID NO: 64659 - RNA, 19 nt, Homo sapiens
uugcagggaucuucaacug

SEQ ID NO: 64660 - RNA, 19 nt, Homo sapiens
aucaagugcuuauuacaga

SEQ ID NO: 64661 - RNA, 19 nt, Homo sapiens
cggaucaagugcuuauuac

SEQ ID NO: 64662 - RNA, 19 nt, Homo sapiens
caccguguauaacuuagug

SEQ ID NO: 64663 - RNA, 19 nt, Homo sapiens
uggacaaccucccauguac

SEQ ID NO: 64664 - RNA, 19 nt, Homo sapiens
aagcagaacuaagcagucu

SEQ ID NO: 64665 - RNA, 19 nt, Homo sapiens
ucaagugcuuauuacagau

SEQ ID NO: 64666 - RNA, 19 nt, Homo sapiens
gggaauggcugccccuauc

SEQ ID NO: 64667 - RNA, 19 nt, Homo sapiens
cuaguggaauguauuucau

SEQ ID NO: 64668 - RNA, 19 nt, Homo sapiens
ugucccagcuaguggaaug

SEQ ID NO: 64669 - RNA, 19 nt, Homo sapiens
cgagaugucccagcuagug

SEQ ID NO: 64670 - RNA, 19 nt, Homo sapiens
cuacaaagggacugugcuu

SEQ ID NO: 64671 - RNA, 19 nt, Homo sapiens
ugacagacggagugacaga

SEQ ID NO: 64672 - RNA, 19 nt, Homo sapiens
caaugcggccuguuuccuu

SEQ ID NO: 64673 - RNA, 19 nt, Homo sapiens
gggaaauauccuaaugguu

SEQ ID NO: 64674 - RNA, 19 nt, Homo sapiens
uuccuuggcuuugaaguug

SEQ ID NO: 64675 - RNA, 19 nt, Homo sapiens
gugcaaagaagcuguacca

SEQ ID NO: 64676 - RNA, 19 nt, Homo sapiens
cuggacaaccucccaugua

SEQ ID NO: 64677 - RNA, 19 nt, Homo sapiens
gaguuugccuggacaaccu

SEQ ID NO: 64678 - RNA, 19 nt, Homo sapiens
cugcaccguguauaacuua

SEQ ID NO: 64679 - RNA, 19 nt, Homo sapiens
cuaaugguuucagagaugu

SEQ ID NO: 64680 - RNA, 19 nt, Homo sapiens
caaagggacugugcuuacc

SEQ ID NO: 64681 - RNA, 19 nt, Homo sapiens
uacaaagggacugugcuua

SEQ ID NO: 64682 - RNA, 19 nt, Homo sapiens
gugcauggacuuggugaga

SEQ ID NO: 64683 - RNA, 19 nt, Homo sapiens
agucacauccuuguacaaa

SEQ ID NO: 64684 - RNA, 19 nt, Homo sapiens
acaaagggacugugcuuac

SEQ ID NO: 64685 - RNA, 19 nt, Homo sapiens
gacaaccucccauguacuc

SEQ ID NO: 64686 - RNA, 19 nt, Homo sapiens
ggagugacagacggacuga

SEQ ID NO: 64687 - RNA, 19 nt, Homo sapiens
gggauguuaucuggcguau

SEQ ID NO: 64688 - RNA, 19 nt, Homo sapiens
ucugggaccuuugacuguu

SEQ ID NO: 64689 - RNA, 19 nt, Homo sapiens
cugggaccuuugacuguuu

SEQ ID NO: 64690 - RNA, 19 nt, Homo sapiens
cugcaccuccugggaaaua

SEQ ID NO: 64691 - RNA, 19 nt, Homo sapiens
gagggucagugagcucagu

SEQ ID NO: 64692 - RNA, 19 nt, Homo sapiens
ccagcuaguggaauguauu

SEQ ID NO: 64693 - RNA, 19 nt, Homo sapiens
ggaucaagugcuuauuaca

SEQ ID NO: 64694 - RNA, 19 nt, Homo sapiens
ugacauccugcaccgugua

SEQ ID NO: 64695 - RNA, 19 nt, Homo sapiens
aagcugucguugaggagaa

SEQ ID NO: 64696 - RNA, 19 nt, Homo sapiens
ccuguuuccuuggcuuuga

SEQ ID NO: 64697 - RNA, 19 nt, Homo sapiens
ggacaaccucccauguacu

SEQ ID NO: 64698 - RNA, 19 nt, Homo sapiens
agggaaagagggucaguga

SEQ ID NO: 64699 - RNA, 19 nt, Homo sapiens
gaugcuggaagcugucguu

SEQ ID NO: 64700 - RNA, 19 nt, Homo sapiens
cccaucagcccgcucaaga

SEQ ID NO: 64701 - RNA, 19 nt, Homo sapiens
ggaaggagauugaguacga

SEQ ID NO: 64702 - RNA, 19 nt, Homo sapiens
gagggucucuucuuaagua

SEQ ID NO: 64703 - RNA, 19 nt, Homo sapiens
guaugagggucucuucuua

SEQ ID NO: 64704 - RNA, 19 nt, Homo sapiens
gagcaugaguggacaauuc

SEQ ID NO: 64705 - RNA, 19 nt, Homo sapiens
gcaccaagcuggcccuuca

SEQ ID NO: 64706 - RNA, 19 nt, Homo sapiens
ccagaggucuccauuaaga

SEQ ID NO: 64707 - RNA, 19 nt, Homo sapiens
uaccagaggucuccauuaa

SEQ ID NO: 64708 - RNA, 19 nt, Homo sapiens
gcacacacacugcguauga

SEQ ID NO: 64709 - RNA, 19 nt, Homo sapiens
gaguaaaggugccucaguu

SEQ ID NO: 64710 - RNA, 19 nt, Homo sapiens
uggccaagcuggagaauuu

SEQ ID NO: 64711 - RNA, 19 nt, Homo sapiens
gaagagcguuggugaaguc

SEQ ID NO: 64712 - RNA, 19 nt, Homo sapiens
gcucugcccuggccaguaa

SEQ ID NO: 64713 - RNA, 19 nt, Homo sapiens
gaaggugcauguugacugu

SEQ ID NO: 64714 - RNA, 19 nt, Homo sapiens
ugagaaccguuucaaguuu

SEQ ID NO: 64715 - RNA, 19 nt, Homo sapiens
gagcauggcgucaagguaa

SEQ ID NO: 64716 - RNA, 19 nt, Homo sapiens
uaacccaggugauacguaa

SEQ ID NO: 64717 - RNA, 19 nt, Homo sapiens
gcaccaagcaggaggaauu

SEQ ID NO: 64718 - RNA, 19 nt, Homo sapiens
gaaguccucucggaaggua

SEQ ID NO: 64719 - RNA, 19 nt, Homo sapiens
gaaacagauugacacaguu

SEQ ID NO: 64720 - RNA, 19 nt, Homo sapiens
gaugggaccuuagcaaguu

SEQ ID NO: 64721 - RNA, 19 nt, Homo sapiens
gaucgacucuacuuugaug

SEQ ID NO: 64722 - RNA, 19 nt, Homo sapiens
gcucuagcguugaauuuga

SEQ ID NO: 64723 - RNA, 19 nt, Homo sapiens
ccaguaaggccacagguua

SEQ ID NO: 64724 - RNA, 19 nt, Homo sapiens
ccacguagcagcacuggua

SEQ ID NO: 64725 - RNA, 19 nt, Homo sapiens
gagcggugcugcuaugaau

SEQ ID NO: 64726 - RNA, 19 nt, Homo sapiens
ugaaacagauugacacagu

SEQ ID NO: 64727 - RNA, 19 nt, Homo sapiens
ggccaagacuuacaagaug

SEQ ID NO: 64728 - RNA, 19 nt, Homo sapiens
cagaugaaauggaugaguu

SEQ ID NO: 64729 - RNA, 19 nt, Homo sapiens
ggccagcccagacaaauua

SEQ ID NO: 64730 - RNA, 19 nt, Homo sapiens
caagcuggcccuucagaua

SEQ ID NO: 64731 - RNA, 19 nt, Homo sapiens
ucagaugucucaccuguuc

SEQ ID NO: 64732 - RNA, 19 nt, Homo sapiens
cgaaagaugggauauaaga

SEQ ID NO: 64733 - RNA, 19 nt, Homo sapiens
caaauuaccuauaccuaac

SEQ ID NO: 64734 - RNA, 19 nt, Homo sapiens
gcagcacacuuagauauuc

SEQ ID NO: 64735 - RNA, 19 nt, Homo sapiens
gaugaccagcugaaaguua

SEQ ID NO: 64736 - RNA, 19 nt, Homo sapiens
cuacaaggcacagaucuua

SEQ ID NO: 64737 - RNA, 19 nt, Homo sapiens
ccagacaaauuaccuauac

SEQ ID NO: 64738 - RNA, 19 nt, Homo sapiens
gauggaaggagauugagua

SEQ ID NO: 64739 - RNA, 19 nt, Homo sapiens
agacugggcuccucucuuc

SEQ ID NO: 64740 - RNA, 19 nt, Homo sapiens
gaaccaggugggacacaua

SEQ ID NO: 64741 - RNA, 19 nt, Homo sapiens
acuuugagcuggugauuaa

SEQ ID NO: 64742 - RNA, 19 nt, Homo sapiens
gaucaaagccauugugcau

SEQ ID NO: 64743 - RNA, 19 nt, Homo sapiens
guggacagcugcccaacaa

SEQ ID NO: 64744 - RNA, 19 nt, Homo sapiens
ccaaugaugguuccaauga

SEQ ID NO: 64745 - RNA, 19 nt, Homo sapiens
cagcugacuucuacacuga

SEQ ID NO: 64746 - RNA, 19 nt, Homo sapiens
cagcagccgucuccaaaga

SEQ ID NO: 64747 - RNA, 19 nt, Homo sapiens
gagcguuggugaagucaug

SEQ ID NO: 64748 - RNA, 19 nt, Homo sapiens
gcucuggcuuugccucuaa

SEQ ID NO: 64749 - RNA, 19 nt, Homo sapiens
caagugcaccaaacucuuu

SEQ ID NO: 64750 - RNA, 19 nt, Homo sapiens
ucgaacaccucauguccua

SEQ ID NO: 64751 - RNA, 19 nt, Homo sapiens
gcuagugcgugcagccuuu

SEQ ID NO: 64752 - RNA, 19 nt, Homo sapiens
ggucucuucuuaaguaaug

SEQ ID NO: 64753 - RNA, 19 nt, Homo sapiens
gugaucgacucuacuuuga

SEQ ID NO: 64754 - RNA, 19 nt, Homo sapiens
gcauugggcguucauuuga

SEQ ID NO: 64755 - RNA, 19 nt, Homo sapiens
gaacccagcguggauuauu

SEQ ID NO: 64756 - RNA, 19 nt, Homo sapiens
gccaagacuuacaagauga

SEQ ID NO: 64757 - RNA, 19 nt, Homo sapiens
uccgaaagaugggauauaa

SEQ ID NO: 64758 - RNA, 19 nt, Homo sapiens
ccuuaaaccuguacaguca

SEQ ID NO: 64759 - RNA, 19 nt, Homo sapiens
gagcaguauuacaucauug

SEQ ID NO: 64760 - RNA, 19 nt, Homo sapiens
cacaacagcuugccuuucu

SEQ ID NO: 64761 - RNA, 19 nt, Homo sapiens
agacuuacaagaugagaua

SEQ ID NO: 64762 - RNA, 19 nt, Homo sapiens
acuguggccucaaguauaa

SEQ ID NO: 64763 - RNA, 19 nt, Homo sapiens
ucacugaucccuccuacaa

SEQ ID NO: 64764 - RNA, 19 nt, Homo sapiens
gcuguggacuggcacuuug

SEQ ID NO: 64765 - RNA, 19 nt, Homo sapiens
cggcacagcugacuucuac

SEQ ID NO: 64766 - RNA, 19 nt, Homo sapiens
gugaggagcugggaacugu

SEQ ID NO: 64767 - RNA, 19 nt, Homo sapiens
gcugaaaguuauugaaugc

SEQ ID NO: 64768 - RNA, 19 nt, Homo sapiens
guuauccacuggcuuaugu

SEQ ID NO: 64769 - RNA, 19 nt, Homo sapiens
gaugguguguuacugacuu

SEQ ID NO: 64770 - RNA, 19 nt, Homo sapiens
caaugaugguuccaaugaa

SEQ ID NO: 64771 - RNA, 19 nt, Homo sapiens
ggacuguggccucaaguau

SEQ ID NO: 64772 - RNA, 19 nt, Homo sapiens
gaauggaacagaaccuuca

SEQ ID NO: 64773 - RNA, 19 nt, Homo sapiens
agaagaagaugguggugau

SEQ ID NO: 64774 - RNA, 19 nt, Homo sapiens
ugucucaccuguucaaugu

SEQ ID NO: 64775 - RNA, 19 nt, Homo sapiens
ccaaggaucagaugucuca

SEQ ID NO: 64776 - RNA, 19 nt, Homo sapiens
gaggggagguugccuauau

SEQ ID NO: 64777 - RNA, 19 nt, Homo sapiens
gugcucaccuauccucuga

SEQ ID NO: 64778 - RNA, 19 nt, Homo sapiens
cagguuauccacuggcuua

SEQ ID NO: 64779 - RNA, 19 nt, Homo sapiens
gggcagcacacuuagauau

SEQ ID NO: 64780 - RNA, 19 nt, Homo sapiens
gaagcacggacgcacagua

SEQ ID NO: 64781 - RNA, 19 nt, Homo sapiens
ggagauccugcuaauuaaa

SEQ ID NO: 64782 - RNA, 19 nt, Homo sapiens
gauaucaagugcaccaaac

SEQ ID NO: 64783 - RNA, 19 nt, Homo sapiens
ccaggaggcuaaggagauu

SEQ ID NO: 64784 - RNA, 19 nt, Homo sapiens
cgagucagcacaaagauug

SEQ ID NO: 64785 - RNA, 19 nt, Homo sapiens
caauuaaggcccugaagga

SEQ ID NO: 64786 - RNA, 19 nt, Homo sapiens
ggacuuccaccaccacgaa

SEQ ID NO: 64787 - RNA, 19 nt, Homo sapiens
cagcuugccuuucuucagu

SEQ ID NO: 64788 - RNA, 19 nt, Homo sapiens
guaccagaggucuccauua

SEQ ID NO: 64789 - RNA, 19 nt, Homo sapiens
gauggugggugaccugaag

SEQ ID NO: 64790 - RNA, 19 nt, Homo sapiens
gcugagcggugcugcuaug

SEQ ID NO: 64791 - RNA, 19 nt, Homo sapiens
ggacagcugcccaacaaca

SEQ ID NO: 64792 - RNA, 19 nt, Homo sapiens
ugagcaguauuacaucauu

SEQ ID NO: 64793 - RNA, 19 nt, Homo sapiens
ggcagcaaauucucuugaa

SEQ ID NO: 64794 - RNA, 19 nt, Homo sapiens
gcacaccaguggagaccau

SEQ ID NO: 64795 - RNA, 19 nt, Homo sapiens
uuagagagcggcugacuga

SEQ ID NO: 64796 - RNA, 19 nt, Homo sapiens
ggaauuccagugccuccua

SEQ ID NO: 64797 - RNA, 19 nt, Homo sapiens
gauggagcauuucgagaca

SEQ ID NO: 64798 - RNA, 19 nt, Homo sapiens
gcugagaaccguuucaagu

SEQ ID NO: 64799 - RNA, 19 nt, Homo sapiens
ccacacuggugaguccaua

SEQ ID NO: 64800 - RNA, 19 nt, Homo sapiens
ggccuuugcugccagaaug

SEQ ID NO: 64801 - RNA, 19 nt, Homo sapiens
gaaaggagcugcagaacuu

SEQ ID NO: 64802 - RNA, 19 nt, Homo sapiens
gaacggaucuugcucuuau

SEQ ID NO: 64803 - RNA, 19 nt, Homo sapiens
gaaguuaacagucucauua

SEQ ID NO: 64804 - RNA, 19 nt, Homo sapiens
gcacauuugucacugaaua

SEQ ID NO: 64805 - RNA, 19 nt, Homo sapiens
ggacggcaauggauacaua

SEQ ID NO: 64806 - RNA, 19 nt, Homo sapiens
agaguuggcucacguauua

SEQ ID NO: 64807 - RNA, 19 nt, Homo sapiens
gagauuggcuuugccuuua

SEQ ID NO: 64808 - RNA, 19 nt, Homo sapiens
gcaaauaguuucaaaugag

SEQ ID NO: 64809 - RNA, 19 nt, Homo sapiens
gcaaagagaugauggaaaa

SEQ ID NO: 64810 - RNA, 19 nt, Homo sapiens
agaagaaagucuaugcuua

SEQ ID NO: 64811 - RNA, 19 nt, Homo sapiens
uaacugagauggccagguu

SEQ ID NO: 64812 - RNA, 19 nt, Homo sapiens
caacaaacuuacugucaga

SEQ ID NO: 64813 - RNA, 19 nt, Homo sapiens
gaacaagauuucccuaaaa

SEQ ID NO: 64814 - RNA, 19 nt, Homo sapiens
guuaucaccugaaaugaaa

SEQ ID NO: 64815 - RNA, 19 nt, Homo sapiens
caucacagccucacaguuu

SEQ ID NO: 64816 - RNA, 19 nt, Homo sapiens
ggacacagacacacgcaua

SEQ ID NO: 64817 - RNA, 19 nt, Homo sapiens
cagagaauaugaccuaaau

SEQ ID NO: 64818 - RNA, 19 nt, Homo sapiens
ugaacaagauuucccuaaa

SEQ ID NO: 64819 - RNA, 19 nt, Homo sapiens
gaagaaagucuaugcuuag

SEQ ID NO: 64820 - RNA, 19 nt, Homo sapiens
aacaggaucuggauauuaa

SEQ ID NO: 64821 - RNA, 19 nt, Homo sapiens
cacaguggcuucauagaaa

SEQ ID NO: 64822 - RNA, 19 nt, Homo sapiens
gccauuagacugaauuuaa

SEQ ID NO: 64823 - RNA, 19 nt, Homo sapiens
ggaguuaucaccugaaaug

SEQ ID NO: 64824 - RNA, 19 nt, Homo sapiens
gcuagaauauccuauacug

SEQ ID NO: 64825 - RNA, 19 nt, Homo sapiens
ucacauauuuguagcuaga

SEQ ID NO: 64826 - RNA, 19 nt, Homo sapiens
ccauagaacugucccacaa

SEQ ID NO: 64827 - RNA, 19 nt, Homo sapiens
uaaaggaccugcuagaaaa

SEQ ID NO: 64828 - RNA, 19 nt, Homo sapiens
caaacuuacugucagagaa

SEQ ID NO: 64829 - RNA, 19 nt, Homo sapiens
gaauauccuauacugguua

SEQ ID NO: 64830 - RNA, 19 nt, Homo sapiens
agaagaacauaauggcuuu

SEQ ID NO: 64831 - RNA, 19 nt, Homo sapiens
cugaggagcuuaagaacuu

SEQ ID NO: 64832 - RNA, 19 nt, Homo sapiens
gaaagaaggcuggauugga

SEQ ID NO: 64833 - RNA, 19 nt, Homo sapiens
aaaaugaacuggaugcuuu

SEQ ID NO: 64834 - RNA, 19 nt, Homo sapiens
cuaagucaguuucacauau

SEQ ID NO: 64835 - RNA, 19 nt, Homo sapiens
cauagcauccugauuauug

SEQ ID NO: 64836 - RNA, 19 nt, Homo sapiens
auucauagcauccugauua

SEQ ID NO: 64837 - RNA, 19 nt, Homo sapiens
ugaaggaucugugcgagaa

SEQ ID NO: 64838 - RNA, 19 nt, Homo sapiens
ggagauuggcuuugccuuu

SEQ ID NO: 64839 - RNA, 19 nt, Homo sapiens
gaacaaacagaaacgagau

SEQ ID NO: 64840 - RNA, 19 nt, Homo sapiens
gcuauaauguuucccucaa

SEQ ID NO: 64841 - RNA, 19 nt, Homo sapiens
aaacaggaucuggauauua

SEQ ID NO: 64842 - RNA, 19 nt, Homo sapiens
uaaacaggaucuggauauu

SEQ ID NO: 64843 - RNA, 19 nt, Homo sapiens
gugguuaccuggaaggaaa

SEQ ID NO: 64844 - RNA, 19 nt, Homo sapiens
gagaucagcauucaaaaua

SEQ ID NO: 64845 - RNA, 19 nt, Homo sapiens
ccaccaggauuaaucucua

SEQ ID NO: 64846 - RNA, 19 nt, Homo sapiens
cuaaaggaccugcuagaaa

SEQ ID NO: 64847 - RNA, 19 nt, Homo sapiens
aaacugaggagcuuaagaa

SEQ ID NO: 64848 - RNA, 19 nt, Homo sapiens
gaacuggaugcuuuacuga

SEQ ID NO: 64849 - RNA, 19 nt, Homo sapiens
gggaaagaguucaauaagg

SEQ ID NO: 64850 - RNA, 19 nt, Homo sapiens
gaauaugaccuaaauccau

SEQ ID NO: 64851 - RNA, 19 nt, Homo sapiens
ggcaauggauacauagaug

SEQ ID NO: 64852 - RNA, 19 nt, Homo sapiens
ugagagauguguccaugug

SEQ ID NO: 64853 - RNA, 19 nt, Homo sapiens
guagcuagaauauccuaua

SEQ ID NO: 64854 - RNA, 19 nt, Homo sapiens
caacauacaagaagaacau

SEQ ID NO: 64855 - RNA, 19 nt, Homo sapiens
gaucugugcgagaagaaua

SEQ ID NO: 64856 - RNA, 19 nt, Homo sapiens
gcacugccauuagacugaa

SEQ ID NO: 64857 - RNA, 19 nt, Homo sapiens
gaaacagggagcuaugaga

SEQ ID NO: 64858 - RNA, 19 nt, Homo sapiens
gaccuaaugcugaaacuau

SEQ ID NO: 64859 - RNA, 19 nt, Homo sapiens
auacagaccuaaugcugaa

SEQ ID NO: 64860 - RNA, 19 nt, Homo sapiens
uggaagcacugccauuaga

SEQ ID NO: 64861 - RNA, 19 nt, Homo sapiens
gcaaauuauucuagucaac

SEQ ID NO: 64862 - RNA, 19 nt, Homo sapiens
aauaggaauuguagaguug

SEQ ID NO: 64863 - RNA, 19 nt, Homo sapiens
uuaacagucucauuacaga

SEQ ID NO: 64864 - RNA, 19 nt, Homo sapiens
cauagaaacugaggagcuu

SEQ ID NO: 64865 - RNA, 19 nt, Homo sapiens
uauaauguuucccucaaga

SEQ ID NO: 64866 - RNA, 19 nt, Homo sapiens
uugcauacuuccuggauuu

SEQ ID NO: 64867 - RNA, 19 nt, Homo sapiens
gagcaccagaugacacaua

SEQ ID NO: 64868 - RNA, 19 nt, Homo sapiens
gaauaaacaggaucuggau

SEQ ID NO: 64869 - RNA, 19 nt, Homo sapiens
gcaauggauacauagauga

SEQ ID NO: 64870 - RNA, 19 nt, Homo sapiens
cuagucaacugcuguuuua

SEQ ID NO: 64871 - RNA, 19 nt, Homo sapiens
gauguguggcucauucuuu

SEQ ID NO: 64872 - RNA, 19 nt, Homo sapiens
gauguugagugggagauug

SEQ ID NO: 64873 - RNA, 19 nt, Homo sapiens
cugcuuggauccauacaaa

SEQ ID NO: 64874 - RNA, 19 nt, Homo sapiens
gcuuguuucuauacuguuu

SEQ ID NO: 64875 - RNA, 19 nt, Homo sapiens
gaugggaagcuggaauuaa

SEQ ID NO: 64876 - RNA, 19 nt, Homo sapiens
caccaggauuaaucucuaa

SEQ ID NO: 64877 - RNA, 19 nt, Homo sapiens
gcagucaucccucaucaca

SEQ ID NO: 64878 - RNA, 19 nt, Homo sapiens
ggaagggagcaccagauga

SEQ ID NO: 64879 - RNA, 19 nt, Homo sapiens
ugaacuggaugcuuuacug

SEQ ID NO: 64880 - RNA, 19 nt, Homo sapiens
uguauucuguggauucuau

SEQ ID NO: 64881 - RNA, 19 nt, Homo sapiens
gaagggagcaccagaugac

SEQ ID NO: 64882 - RNA, 19 nt, Homo sapiens
caggauguguggcucauuc

SEQ ID NO: 64883 - RNA, 19 nt, Homo sapiens
ggaguaggcuguauuuucu

SEQ ID NO: 64884 - RNA, 19 nt, Homo sapiens
gauguguccaugugaaauu

SEQ ID NO: 64885 - RNA, 19 nt, Homo sapiens
gguaucugcugccucugaa

SEQ ID NO: 64886 - RNA, 19 nt, Homo sapiens
ucuagucucugauuugcaa

SEQ ID NO: 64887 - RNA, 19 nt, Homo sapiens
cgagaagaauaaacaggau

SEQ ID NO: 64888 - RNA, 19 nt, Homo sapiens
gugggaaagaguucaauaa

SEQ ID NO: 64889 - RNA, 19 nt, Homo sapiens
gaaacugaggagcuuaaga

SEQ ID NO: 64890 - RNA, 19 nt, Homo sapiens
agaauauccuauacugguu

SEQ ID NO: 64891 - RNA, 19 nt, Homo sapiens
caggaucuggauauuaaua

SEQ ID NO: 64892 - RNA, 19 nt, Homo sapiens
cggaagugguuaccuggaa

SEQ ID NO: 64893 - RNA, 19 nt, Homo sapiens
ccauuagacugaauuuaac

SEQ ID NO: 64894 - RNA, 19 nt, Homo sapiens
gagauguguccaugugaaa

SEQ ID NO: 64895 - RNA, 19 nt, Homo sapiens
agagauguguccaugugaa

SEQ ID NO: 64896 - RNA, 19 nt, Homo sapiens
gaaggcuggauuggaguua

SEQ ID NO: 64897 - RNA, 19 nt, Homo sapiens
cagcuuguuucuauacugu

SEQ ID NO: 64898 - RNA, 19 nt, Homo sapiens
gaucaggacggcaauggau

SEQ ID NO: 64899 - RNA, 19 nt, Homo sapiens
aagcuggaauuaacugaga

SEQ ID NO: 64900 - RNA, 19 nt, Homo sapiens
caacugcuguuuuauguca

SEQ ID NO: 64901 - RNA, 19 nt, Homo sapiens
gaaaggcucuggcaugaug

SEQ ID NO: 64902 - RNA, 19 nt, Homo sapiens
ccaaugagcucaagggauu

SEQ ID NO: 64903 - RNA, 19 nt, Homo sapiens
gcaaggaccuggagauugu

SEQ ID NO: 64904 - RNA, 19 nt, Homo sapiens
ggaauacacccaaaccaua

SEQ ID NO: 64905 - RNA, 19 nt, Homo sapiens
gaaagguccugcuguggaa

SEQ ID NO: 64906 - RNA, 19 nt, Homo sapiens
ugaaggaucuguacgagaa

SEQ ID NO: 64907 - RNA, 19 nt, Homo sapiens
ggaaauggguauauugaag

SEQ ID NO: 64908 - RNA, 19 nt, Homo sapiens
gaaagagcgucauguccuu

SEQ ID NO: 64909 - RNA, 19 nt, Homo sapiens
gauagaagcggcuacauug

SEQ ID NO: 64910 - RNA, 19 nt, Homo sapiens
gaacggggauggcaaauug

SEQ ID NO: 64911 - RNA, 19 nt, Homo sapiens
guaaagagcuagaaaacuu

SEQ ID NO: 64912 - RNA, 19 nt, Homo sapiens
gagaaaagaugaaggaguu

SEQ ID NO: 64913 - RNA, 19 nt, Homo sapiens
ggaaaucaauauucaacag

SEQ ID NO: 64914 - RNA, 19 nt, Homo sapiens
gcucuggcaugaugucaaa

SEQ ID NO: 64915 - RNA, 19 nt, Homo sapiens
gagcaggaaacgagagaua

SEQ ID NO: 64916 - RNA, 19 nt, Homo sapiens
ggauagaagcggcuacauu

SEQ ID NO: 64917 - RNA, 19 nt, Homo sapiens
ucucagaacuccugugugu

SEQ ID NO: 64918 - RNA, 19 nt, Homo sapiens
ggaaauauggaagcacuuu

SEQ ID NO: 64919 - RNA, 19 nt, Homo sapiens
gaagguaaagagcuagaaa

SEQ ID NO: 64920 - RNA, 19 nt, Homo sapiens
aagaagaguuuacagacaa

SEQ ID NO: 64921 - RNA, 19 nt, Homo sapiens
ccaaagaagaguuuacaga

SEQ ID NO: 64922 - RNA, 19 nt, Homo sapiens
cuaauucucuucgcuguga

SEQ ID NO: 64923 - RNA, 19 nt, Homo sapiens
aaagaagaguuuacagaca

SEQ ID NO: 64924 - RNA, 19 nt, Homo sapiens
uucaacagcucaccaacua

SEQ ID NO: 64925 - RNA, 19 nt, Homo sapiens
uggcagagcuggcgcagau

SEQ ID NO: 64926 - RNA, 19 nt, Homo sapiens
agacggaaauggguauauu

SEQ ID NO: 64927 - RNA, 19 nt, Homo sapiens
uuaacgcgaucuucacauu

SEQ ID NO: 64928 - RNA, 19 nt, Homo sapiens
agcccaagcuccaggaaua

SEQ ID NO: 64929 - RNA, 19 nt, Homo sapiens
gcaggaaacgagagauaga

SEQ ID NO: 64930 - RNA, 19 nt, Homo sapiens
gcaaauugggccucucaga

SEQ ID NO: 64931 - RNA, 19 nt, Homo sapiens
cuacggauguuugacuuga

SEQ ID NO: 64932 - RNA, 19 nt, Homo sapiens
gaaacgagagauagaggau

SEQ ID NO: 64933 - RNA, 19 nt, Homo sapiens
gaauacacccaaaccauac

SEQ ID NO: 64934 - RNA, 19 nt, Homo sapiens
gaaauauggaagcacuuug

SEQ ID NO: 64935 - RNA, 19 nt, Homo sapiens
aggaaaggcucuggcauga

SEQ ID NO: 64936 - RNA, 19 nt, Homo sapiens
uauugaagguaaagagcua

SEQ ID NO: 64937 - RNA, 19 nt, Homo sapiens
gaagaguuuacagacaaua

SEQ ID NO: 64938 - RNA, 19 nt, Homo sapiens
ucaagggauuccugucaga

SEQ ID NO: 64939 - RNA, 19 nt, Homo sapiens
agacaggaguggcuacauc

SEQ ID NO: 64940 - RNA, 19 nt, Homo sapiens
cucccucgcuguaugauuu

SEQ ID NO: 64941 - RNA, 19 nt, Homo sapiens
caacagcucaccaacuaca

SEQ ID NO: 64942 - RNA, 19 nt, Homo sapiens
ucuuuggguuucuuguuua

SEQ ID NO: 64943 - RNA, 19 nt, Homo sapiens
ugguguagcuguccucuca

SEQ ID NO: 64944 - RNA, 19 nt, Homo sapiens
aaauauggaagcacuuuga

SEQ ID NO: 64945 - RNA, 19 nt, Homo sapiens
uaacgcgaucuucacauuu

SEQ ID NO: 64946 - RNA, 19 nt, Homo sapiens
gaaaacuuccugcuuaaau

SEQ ID NO: 64947 - RNA, 19 nt, Homo sapiens
gcucaagggauuccuguca

SEQ ID NO: 64948 - RNA, 19 nt, Homo sapiens
caugagcucccucgcugua

SEQ ID NO: 64949 - RNA, 19 nt, Homo sapiens
caaaccauacuacggaugu

SEQ ID NO: 64950 - RNA, 19 nt, Homo sapiens
agugacaacuuuggagaaa

SEQ ID NO: 64951 - RNA, 19 nt, Homo sapiens
auggguauauugaagguaa

SEQ ID NO: 64952 - RNA, 19 nt, Homo sapiens
gacggaaauggguauauug

SEQ ID NO: 64953 - RNA, 19 nt, Homo sapiens
gaaggaucuguacgagaaa

SEQ ID NO: 64954 - RNA, 19 nt, Homo sapiens
aggaguucaugcagaagua

SEQ ID NO: 64955 - RNA, 19 nt, Homo sapiens
gaguuuaacgcgaucuuca

SEQ ID NO: 64956 - RNA, 19 nt, Homo sapiens
gcccuuuccuugccuucuu

SEQ ID NO: 64957 - RNA, 19 nt, Homo sapiens
gagcucccucgcuguauga

SEQ ID NO: 64958 - RNA, 19 nt, Homo sapiens
guguagcuguccucucaga

SEQ ID NO: 64959 - RNA, 19 nt, Homo sapiens
agaagaguuuacagacaau

SEQ ID NO: 64960 - RNA, 19 nt, Homo sapiens
ugagcucccucgcuguaug

SEQ ID NO: 64961 - RNA, 19 nt, Homo sapiens
gcagacggaaauggguaua

SEQ ID NO: 64962 - RNA, 19 nt, Homo sapiens
gagugacaacuuuggagaa

SEQ ID NO: 64963 - RNA, 19 nt, Homo sapiens
cucuuuggguuucuuguuu

SEQ ID NO: 64964 - RNA, 19 nt, Homo sapiens
guggaucacacacauggaa

SEQ ID NO: 64965 - RNA, 19 nt, Homo sapiens
cuacagaaagagcgucaug

SEQ ID NO: 64966 - RNA, 19 nt, Homo sapiens
uuacucggcgugcuccuuu

SEQ ID NO: 64967 - RNA, 19 nt, Homo sapiens
gcaugaugucaaagaguga

SEQ ID NO: 64968 - RNA, 19 nt, Homo sapiens
ugauuuaggcuucuauguc

SEQ ID NO: 64969 - RNA, 19 nt, Homo sapiens
ggaaaggcucuggcaugau

SEQ ID NO: 64970 - RNA, 19 nt, Homo sapiens
cggaaauggguauauugaa

SEQ ID NO: 64971 - RNA, 19 nt, Homo sapiens
aaauggguauauugaaggu

SEQ ID NO: 64972 - RNA, 19 nt, Homo sapiens
ccgcaaggaccuggagauu

SEQ ID NO: 64973 - RNA, 19 nt, Homo sapiens
gcucaccaacuacagaaag

SEQ ID NO: 64974 - RNA, 19 nt, Homo sapiens
ugacgagcaugagcuggau

SEQ ID NO: 64975 - RNA, 19 nt, Homo sapiens
caggaguggcuacaucgaa

SEQ ID NO: 64976 - RNA, 19 nt, Homo sapiens
acagaaagagcgucauguc

SEQ ID NO: 64977 - RNA, 19 nt, Homo sapiens
aaacucagaugggaaaauc

SEQ ID NO: 64978 - RNA, 19 nt, Homo sapiens
acggaaauggguauauuga

SEQ ID NO: 64979 - RNA, 19 nt, Homo sapiens
aaaccauacuacggauguu

SEQ ID NO: 64980 - RNA, 19 nt, Homo sapiens
uguaugauuuaggcuucua

SEQ ID NO: 64981 - RNA, 19 nt, Homo sapiens
ucucuucgcugugaugcau

SEQ ID NO: 64982 - RNA, 19 nt, Homo sapiens
cagcucaccaacuacagaa

SEQ ID NO: 64983 - RNA, 19 nt, Homo sapiens
gcuccagcgccgaguuuau

SEQ ID NO: 64984 - RNA, 19 nt, Homo sapiens
gaaaggcucuggcaugaug

SEQ ID NO: 64985 - RNA, 19 nt, Homo sapiens
ccaaugagcucaagggauu

SEQ ID NO: 64986 - RNA, 19 nt, Homo sapiens
gcaaggaccuggagauugu

SEQ ID NO: 64987 - RNA, 19 nt, Homo sapiens
ggaauacacccaaaccaua

SEQ ID NO: 64988 - RNA, 19 nt, Homo sapiens
gaaagguccugcuguggaa

SEQ ID NO: 64989 - RNA, 19 nt, Homo sapiens
ugaaggaucuguacgagaa

SEQ ID NO: 64990 - RNA, 19 nt, Homo sapiens
ggaaauggguauauugaag

SEQ ID NO: 64991 - RNA, 19 nt, Homo sapiens
gaaagagcgucauguccuu

SEQ ID NO: 64992 - RNA, 19 nt, Homo sapiens
gauagaagcggcuacauug

SEQ ID NO: 64993 - RNA, 19 nt, Homo sapiens
gaacggggauggcaaauug

SEQ ID NO: 64994 - RNA, 19 nt, Homo sapiens
guaaagagcuagaaaacuu

SEQ ID NO: 64995 - RNA, 19 nt, Homo sapiens
gagaaaagaugaaggaguu

SEQ ID NO: 64996 - RNA, 19 nt, Homo sapiens
ggaaaucaauauucaacag

SEQ ID NO: 64997 - RNA, 19 nt, Homo sapiens
gcucuggcaugaugucaaa

SEQ ID NO: 64998 - RNA, 19 nt, Homo sapiens
gagcaggaaacgagagaua

SEQ ID NO: 64999 - RNA, 19 nt, Homo sapiens
ggauagaagcggcuacauu

SEQ ID NO: 65000 - RNA, 19 nt, Homo sapiens
ucucagaacuccugugugu

SEQ ID NO: 65001 - RNA, 19 nt, Homo sapiens
ggaaauauggaagcacuuu

SEQ ID NO: 65002 - RNA, 19 nt, Homo sapiens
gaagguaaagagcuagaaa

SEQ ID NO: 65003 - RNA, 19 nt, Homo sapiens
aagaagaguuuacagacaa

SEQ ID NO: 65004 - RNA, 19 nt, Homo sapiens
ccaaagaagaguuuacaga

SEQ ID NO: 65005 - RNA, 19 nt, Homo sapiens
cuaauucucuucgcuguga

SEQ ID NO: 65006 - RNA, 19 nt, Homo sapiens
aaagaagaguuuacagaca

SEQ ID NO: 65007 - RNA, 19 nt, Homo sapiens
uucaacagcucaccaacua

SEQ ID NO: 65008 - RNA, 19 nt, Homo sapiens
uggcagagcuggcgcagau

SEQ ID NO: 65009 - RNA, 19 nt, Homo sapiens
agacggaaauggguauauu

SEQ ID NO: 65010 - RNA, 19 nt, Homo sapiens
uuaacgcgaucuucacauu

SEQ ID NO: 65011 - RNA, 19 nt, Homo sapiens
agcccaagcuccaggaaua

SEQ ID NO: 65012 - RNA, 19 nt, Homo sapiens
gcaggaaacgagagauaga

SEQ ID NO: 65013 - RNA, 19 nt, Homo sapiens
gcaaauugggccucucaga

SEQ ID NO: 65014 - RNA, 19 nt, Homo sapiens
cuacggauguuugacuuga

SEQ ID NO: 65015 - RNA, 19 nt, Homo sapiens
gaaacgagagauagaggau

SEQ ID NO: 65016 - RNA, 19 nt, Homo sapiens
gaauacacccaaaccauac

SEQ ID NO: 65017 - RNA, 19 nt, Homo sapiens
gaaauauggaagcacuuug

SEQ ID NO: 65018 - RNA, 19 nt, Homo sapiens
aggaaaggcucuggcauga

SEQ ID NO: 65019 - RNA, 19 nt, Homo sapiens
uauugaagguaaagagcua

SEQ ID NO: 65020 - RNA, 19 nt, Homo sapiens
gaagaguuuacagacaaua

SEQ ID NO: 65021 - RNA, 19 nt, Homo sapiens
ucaagggauuccugucaga

SEQ ID NO: 65022 - RNA, 19 nt, Homo sapiens
agacaggaguggcuacauc

SEQ ID NO: 65023 - RNA, 19 nt, Homo sapiens
cucccucgcuguaugauuu

SEQ ID NO: 65024 - RNA, 19 nt, Homo sapiens
caacagcucaccaacuaca

SEQ ID NO: 65025 - RNA, 19 nt, Homo sapiens
ucuuuggguuucuuguuua

SEQ ID NO: 65026 - RNA, 19 nt, Homo sapiens
ugguguagcuguccucuca

SEQ ID NO: 65027 - RNA, 19 nt, Homo sapiens
aaauauggaagcacuuuga

SEQ ID NO: 65028 - RNA, 19 nt, Homo sapiens
uaacgcgaucuucacauuu

SEQ ID NO: 65029 - RNA, 19 nt, Homo sapiens
gcucaagggauuccuguca

SEQ ID NO: 65030 - RNA, 19 nt, Homo sapiens
caugagcucccucgcugua

SEQ ID NO: 65031 - RNA, 19 nt, Homo sapiens
caaaccauacuacggaugu

SEQ ID NO: 65032 - RNA, 19 nt, Homo sapiens
agugacaacuuuggagaaa

SEQ ID NO: 65033 - RNA, 19 nt, Homo sapiens
auggguauauugaagguaa

SEQ ID NO: 65034 - RNA, 19 nt, Homo sapiens
gacggaaauggguauauug

SEQ ID NO: 65035 - RNA, 19 nt, Homo sapiens
gaaggaucuguacgagaaa

SEQ ID NO: 65036 - RNA, 19 nt, Homo sapiens
aggaguucaugcagaagua

SEQ ID NO: 65037 - RNA, 19 nt, Homo sapiens
gaguuuaacgcgaucuuca

SEQ ID NO: 65038 - RNA, 19 nt, Homo sapiens
gcccuuuccuugccuucuu

SEQ ID NO: 65039 - RNA, 19 nt, Homo sapiens
gagcucccucgcuguauga

SEQ ID NO: 65040 - RNA, 19 nt, Homo sapiens
guguagcuguccucucaga

SEQ ID NO: 65041 - RNA, 19 nt, Homo sapiens
agaagaguuuacagacaau

SEQ ID NO: 65042 - RNA, 19 nt, Homo sapiens
ugagcucccucgcuguaug

SEQ ID NO: 65043 - RNA, 19 nt, Homo sapiens
gcagacggaaauggguaua

SEQ ID NO: 65044 - RNA, 19 nt, Homo sapiens
gagugacaacuuuggagaa

SEQ ID NO: 65045 - RNA, 19 nt, Homo sapiens
cucuuuggguuucuuguuu

SEQ ID NO: 65046 - RNA, 19 nt, Homo sapiens
guggaucacacacauggaa

SEQ ID NO: 65047 - RNA, 19 nt, Homo sapiens
cuacagaaagagcgucaug

SEQ ID NO: 65048 - RNA, 19 nt, Homo sapiens
uuacucggcgugcuccuuu

SEQ ID NO: 65049 - RNA, 19 nt, Homo sapiens
ugauuuaggcuucuauguc

SEQ ID NO: 65050 - RNA, 19 nt, Homo sapiens
ggaaaggcucuggcaugau

SEQ ID NO: 65051 - RNA, 19 nt, Homo sapiens
gcaugaugucaaagaguga

SEQ ID NO: 65052 - RNA, 19 nt, Homo sapiens
cggaaauggguauauugaa

SEQ ID NO: 65053 - RNA, 19 nt, Homo sapiens
aaauggguauauugaaggu

SEQ ID NO: 65054 - RNA, 19 nt, Homo sapiens
ccgcaaggaccuggagauu

SEQ ID NO: 65055 - RNA, 19 nt, Homo sapiens
gcucaccaacuacagaaag

SEQ ID NO: 65056 - RNA, 19 nt, Homo sapiens
ugacgagcaugagcuggau

SEQ ID NO: 65057 - RNA, 19 nt, Homo sapiens
caggaguggcuacaucgaa

SEQ ID NO: 65058 - RNA, 19 nt, Homo sapiens
aaacucagaugggaaaauc

SEQ ID NO: 65059 - RNA, 19 nt, Homo sapiens
acagaaagagcgucauguc

SEQ ID NO: 65060 - RNA, 19 nt, Homo sapiens
acggaaauggguauauuga

SEQ ID NO: 65061 - RNA, 19 nt, Homo sapiens
aaaccauacuacggauguu

SEQ ID NO: 65062 - RNA, 19 nt, Homo sapiens
uguaugauuuaggcuucua

SEQ ID NO: 65063 - RNA, 19 nt, Homo sapiens
ucucuucgcugugaugcau

SEQ ID NO: 65064 - RNA, 19 nt, Homo sapiens
cagcucaccaacuacagaa

SEQ ID NO: 65065 - RNA, 19 nt, Homo sapiens
gcuccagcgccgaguuuau

SEQ ID NO: 65066 - RNA, 19 nt, Homo sapiens
gaaaggcucuggcaugaug

SEQ ID NO: 65067 - RNA, 19 nt, Homo sapiens
ccaaugagcucaagggauu

SEQ ID NO: 65068 - RNA, 19 nt, Homo sapiens
gcaaggaccuggagauugu

SEQ ID NO: 65069 - RNA, 19 nt, Homo sapiens
ggaauacacccaaaccaua

SEQ ID NO: 65070 - RNA, 19 nt, Homo sapiens
gaaagguccugcuguggaa

SEQ ID NO: 65071 - RNA, 19 nt, Homo sapiens
ugaaggaucuguacgagaa

SEQ ID NO: 65072 - RNA, 19 nt, Homo sapiens
ggaaauggguauauugaag

SEQ ID NO: 65073 - RNA, 19 nt, Homo sapiens
gaaagagcgucauguccuu

SEQ ID NO: 65074 - RNA, 19 nt, Homo sapiens
gauagaagcggcuacauug

SEQ ID NO: 65075 - RNA, 19 nt, Homo sapiens
gaacggggauggcaaauug

SEQ ID NO: 65076 - RNA, 19 nt, Homo sapiens
guaaagagcuagaaaacuu

SEQ ID NO: 65077 - RNA, 19 nt, Homo sapiens
gagaaaagaugaaggaguu

SEQ ID NO: 65078 - RNA, 19 nt, Homo sapiens
ggaaaucaauauucaacag

SEQ ID NO: 65079 - RNA, 19 nt, Homo sapiens
gcucuggcaugaugucaaa

SEQ ID NO: 65080 - RNA, 19 nt, Homo sapiens
gagcaggaaacgagagaua

SEQ ID NO: 65081 - RNA, 19 nt, Homo sapiens
ggauagaagcggcuacauu

SEQ ID NO: 65082 - RNA, 19 nt, Homo sapiens
ucucagaacuccugugugu

SEQ ID NO: 65083 - RNA, 19 nt, Homo sapiens
ggaaauauggaagcacuuu

SEQ ID NO: 65084 - RNA, 19 nt, Homo sapiens
gaagguaaagagcuagaaa

SEQ ID NO: 65085 - RNA, 19 nt, Homo sapiens
aagaagaguuuacagacaa

SEQ ID NO: 65086 - RNA, 19 nt, Homo sapiens
ccaaagaagaguuuacaga

SEQ ID NO: 65087 - RNA, 19 nt, Homo sapiens
cuaauucucuucgcuguga

SEQ ID NO: 65088 - RNA, 19 nt, Homo sapiens
ucagagaugucccggauag

SEQ ID NO: 65089 - RNA, 19 nt, Homo sapiens
aaagaagaguuuacagaca

SEQ ID NO: 65090 - RNA, 19 nt, Homo sapiens
uucaacagcucaccaacua

SEQ ID NO: 65091 - RNA, 19 nt, Homo sapiens
uggcagagcuggcgcagau

SEQ ID NO: 65092 - RNA, 19 nt, Homo sapiens
agacggaaauggguauauu

SEQ ID NO: 65093 - RNA, 19 nt, Homo sapiens
agcccaagcuccaggaaua

SEQ ID NO: 65094 - RNA, 19 nt, Homo sapiens
gcaggaaacgagagauaga

SEQ ID NO: 65095 - RNA, 19 nt, Homo sapiens
gcaaauugggccucucaga

SEQ ID NO: 65096 - RNA, 19 nt, Homo sapiens
cuacggauguuugacuuga

SEQ ID NO: 65097 - RNA, 19 nt, Homo sapiens
gaaacgagagauagaggau

SEQ ID NO: 65098 - RNA, 19 nt, Homo sapiens
gaauacacccaaaccauac

SEQ ID NO: 65099 - RNA, 19 nt, Homo sapiens
gaaauauggaagcacuuug

SEQ ID NO: 65100 - RNA, 19 nt, Homo sapiens
aggaaaggcucuggcauga

SEQ ID NO: 65101 - RNA, 19 nt, Homo sapiens
uauugaagguaaagagcua

SEQ ID NO: 65102 - RNA, 19 nt, Homo sapiens
gaagaguuuacagacaaua

SEQ ID NO: 65103 - RNA, 19 nt, Homo sapiens
ucaagggauuccugucaga

SEQ ID NO: 65104 - RNA, 19 nt, Homo sapiens
agacaggaguggcuacauc

SEQ ID NO: 65105 - RNA, 19 nt, Homo sapiens
cucccucgcuguaugauuu

SEQ ID NO: 65106 - RNA, 19 nt, Homo sapiens
caacagcucaccaacuaca

SEQ ID NO: 65107 - RNA, 19 nt, Homo sapiens
ucuuuggguuucuuguuua

SEQ ID NO: 65108 - RNA, 19 nt, Homo sapiens
ugguguagcuguccucuca

SEQ ID NO: 65109 - RNA, 19 nt, Homo sapiens
aaauauggaagcacuuuga

SEQ ID NO: 65110 - RNA, 19 nt, Homo sapiens
gcucaagggauuccuguca

SEQ ID NO: 65111 - RNA, 19 nt, Homo sapiens
caugagcucccucgcugua

SEQ ID NO: 65112 - RNA, 19 nt, Homo sapiens
caaaccauacuacggaugu

SEQ ID NO: 65113 - RNA, 19 nt, Homo sapiens
agugacaacuuuggagaaa

SEQ ID NO: 65114 - RNA, 19 nt, Homo sapiens
auggguauauugaagguaa

SEQ ID NO: 65115 - RNA, 19 nt, Homo sapiens
gacggaaauggguauauug

SEQ ID NO: 65116 - RNA, 19 nt, Homo sapiens
gaaggaucuguacgagaaa

SEQ ID NO: 65117 - RNA, 19 nt, Homo sapiens
aggaguucaugcagaagua

SEQ ID NO: 65118 - RNA, 19 nt, Homo sapiens
gcccuuuccuugccuucuu

SEQ ID NO: 65119 - RNA, 19 nt, Homo sapiens
gagcucccucgcuguauga

SEQ ID NO: 65120 - RNA, 19 nt, Homo sapiens
guguagcuguccucucaga

SEQ ID NO: 65121 - RNA, 19 nt, Homo sapiens
agaagaguuuacagacaau

SEQ ID NO: 65122 - RNA, 19 nt, Homo sapiens
ugagcucccucgcuguaug

SEQ ID NO: 65123 - RNA, 19 nt, Homo sapiens
gcagacggaaauggguaua

SEQ ID NO: 65124 - RNA, 19 nt, Homo sapiens
gagaugucccggauagaag

SEQ ID NO: 65125 - RNA, 19 nt, Homo sapiens
agagaugucccggauagaa

SEQ ID NO: 65126 - RNA, 19 nt, Homo sapiens
gagugacaacuuuggagaa

SEQ ID NO: 65127 - RNA, 19 nt, Homo sapiens
cucuuuggguuucuuguuu

SEQ ID NO: 65128 - RNA, 19 nt, Homo sapiens
guggaucacacacauggaa

SEQ ID NO: 65129 - RNA, 19 nt, Homo sapiens
cuacagaaagagcgucaug

SEQ ID NO: 65130 - RNA, 19 nt, Homo sapiens
uuacucggcgugcuccuuu

SEQ ID NO: 65131 - RNA, 19 nt, Homo sapiens
ugauuuaggcuucuauguc

SEQ ID NO: 65132 - RNA, 19 nt, Homo sapiens
ggaaaggcucuggcaugau

SEQ ID NO: 65133 - RNA, 19 nt, Homo sapiens
gcaugaugucaaagaguga

SEQ ID NO: 65134 - RNA, 19 nt, Homo sapiens
cggaaauggguauauugaa

SEQ ID NO: 65135 - RNA, 19 nt, Homo sapiens
aaauggguauauugaaggu

SEQ ID NO: 65136 - RNA, 19 nt, Homo sapiens
ccgcaaggaccuggagauu

SEQ ID NO: 65137 - RNA, 19 nt, Homo sapiens
gcucaccaacuacagaaag

SEQ ID NO: 65138 - RNA, 19 nt, Homo sapiens
ugacgagcaugagcuggau

SEQ ID NO: 65139 - RNA, 19 nt, Homo sapiens
caggaguggcuacaucgaa

SEQ ID NO: 65140 - RNA, 19 nt, Homo sapiens
aaacucagaugggaaaauc

SEQ ID NO: 65141 - RNA, 19 nt, Homo sapiens
acagaaagagcgucauguc

SEQ ID NO: 65142 - RNA, 19 nt, Homo sapiens
acggaaauggguauauuga

SEQ ID NO: 65143 - RNA, 19 nt, Homo sapiens
aaaccauacuacggauguu

SEQ ID NO: 65144 - RNA, 19 nt, Homo sapiens
uguaugauuuaggcuucua

SEQ ID NO: 65145 - RNA, 19 nt, Homo sapiens
ucucuucgcugugaugcau

SEQ ID NO: 65146 - RNA, 19 nt, Homo sapiens
cagcucaccaacuacagaa

SEQ ID NO: 65147 - RNA, 19 nt, Homo sapiens
gcuccagcgccgaguuuau

SEQ ID NO: 65148 - RNA, 19 nt, Homo sapiens
caaagucucugguuuaauu

SEQ ID NO: 65149 - RNA, 19 nt, Homo sapiens
gaauggagauggagaaguu

SEQ ID NO: 65150 - RNA, 19 nt, Homo sapiens
gaacugaagcuauugauuc

SEQ ID NO: 65151 - RNA, 19 nt, Homo sapiens
ggacaagaauggagaugga

SEQ ID NO: 65152 - RNA, 19 nt, Homo sapiens
gcugugagguucaguuauu

SEQ ID NO: 65153 - RNA, 19 nt, Homo sapiens
ggucuuauccuauguggaa

SEQ ID NO: 65154 - RNA, 19 nt, Homo sapiens
uucaagaacuggacaagaa

SEQ ID NO: 65155 - RNA, 19 nt, Homo sapiens
aggaugaacugaagcuauu

SEQ ID NO: 65156 - RNA, 19 nt, Homo sapiens
caaccagacaccagaauga

SEQ ID NO: 65157 - RNA, 19 nt, Homo sapiens
ccagacaccagaaugagua

SEQ ID NO: 65158 - RNA, 19 nt, Homo sapiens
uauaauaaccuggcuguga

SEQ ID NO: 65159 - RNA, 19 nt, Homo sapiens
cccaaagucucugguuuaa

SEQ ID NO: 65160 - RNA, 19 nt, Homo sapiens
gcuguggucuuauccuaug

SEQ ID NO: 65161 - RNA, 19 nt, Homo sapiens
ccugagcacuggaggaaga

SEQ ID NO: 65162 - RNA, 19 nt, Homo sapiens
gugcuguggucuuauccua

SEQ ID NO: 65163 - RNA, 19 nt, Homo sapiens
ucuucuagcuguuucacua

SEQ ID NO: 65164 - RNA, 19 nt, Homo sapiens
gagauggagaaguuaguuu

SEQ ID NO: 65165 - RNA, 19 nt, Homo sapiens
gucaaaggaugaacugaag

SEQ ID NO: 65166 - RNA, 19 nt, Homo sapiens
cgccugugcuguggucuua

SEQ ID NO: 65167 - RNA, 19 nt, Homo sapiens
gaagaauuccaaguauuag

SEQ ID NO: 65168 - RNA, 19 nt, Homo sapiens
aaacuccucuuugauucuu

SEQ ID NO: 65169 - RNA, 19 nt, Homo sapiens
guccaaacacccuagauga

SEQ ID NO: 65170 - RNA, 19 nt, Homo sapiens
gaggaacugaagaggauuu

SEQ ID NO: 65171 - RNA, 19 nt, Homo sapiens
acaccagaaugaguacuaa

SEQ ID NO: 65172 - RNA, 19 nt, Homo sapiens
ggagauggagaaguuaguu

SEQ ID NO: 65173 - RNA, 19 nt, Homo sapiens
gcaaccagacaccagaaug

SEQ ID NO: 65174 - RNA, 19 nt, Homo sapiens
cugaggaacugaagaggau

SEQ ID NO: 65175 - RNA, 19 nt, Homo sapiens
caagaauggagauggagaa

SEQ ID NO: 65176 - RNA, 19 nt, Homo sapiens
cagaccaguugucaaagga

SEQ ID NO: 65177 - RNA, 19 nt, Homo sapiens
gaugaacugaagcuauuga

SEQ ID NO: 65178 - RNA, 19 nt, Homo sapiens
ccaaacacccuagaugauc

SEQ ID NO: 65179 - RNA, 19 nt, Homo sapiens
gacaccagaaugaguacua

SEQ ID NO: 65180 - RNA, 19 nt, Homo sapiens
gguccaaacacccuagaug

SEQ ID NO: 65181 - RNA, 19 nt, Homo sapiens
ccagaccaguugucaaagg

SEQ ID NO: 65182 - RNA, 19 nt, Homo sapiens
cugugagguucaguuauua

SEQ ID NO: 65183 - RNA, 19 nt, Homo sapiens
caagaacuggacaagaaug

SEQ ID NO: 65184 - RNA, 19 nt, Homo sapiens
ugucaaaggaugaacugaa

SEQ ID NO: 65185 - RNA, 19 nt, Homo sapiens
ucuagcuguuucacuauug

SEQ ID NO: 65186 - RNA, 19 nt, Homo sapiens
gugagguucaguuauuauu

SEQ ID NO: 65187 - RNA, 19 nt, Homo sapiens
ugaacugaagcuauugauu

SEQ ID NO: 65188 - RNA, 19 nt, Homo sapiens
gucucugguuuaauucuuu

SEQ ID NO: 65189 - RNA, 19 nt, Homo sapiens
uggcugugagguucaguua

SEQ ID NO: 65190 - RNA, 19 nt, Homo sapiens
ucaagaacuggacaagaau

SEQ ID NO: 65191 - RNA, 19 nt, Homo sapiens
ucucugguuuaauucuuug

SEQ ID NO: 65192 - RNA, 19 nt, Homo sapiens
caaaggaugaacugaagcu

SEQ ID NO: 65193 - RNA, 19 nt, Homo sapiens
gauccagaccaguugucaa

SEQ ID NO: 65194 - RNA, 19 nt, Homo sapiens
caacuaaacuccucccuuu

SEQ ID NO: 65195 - RNA, 19 nt, Homo sapiens
gaccaucgcccucauguua

SEQ ID NO: 65196 - RNA, 19 nt, Homo sapiens
gcugaucauuugaggaaua

SEQ ID NO: 65197 - RNA, 19 nt, Homo sapiens
gaggaugucucaaacuuca

SEQ ID NO: 65198 - RNA, 19 nt, Homo sapiens
gcacauacacgcaggacuu

SEQ ID NO: 65199 - RNA, 19 nt, Homo sapiens
gcgguaaucugaguacuug

SEQ ID NO: 65200 - RNA, 19 nt, Homo sapiens
cagaggaugucucaaacuu

SEQ ID NO: 65201 - RNA, 19 nt, Homo sapiens
ucaacaaguuucacacguu

SEQ ID NO: 65202 - RNA, 19 nt, Homo sapiens
gaucuaagcggugcgguaa

SEQ ID NO: 65203 - RNA, 19 nt, Homo sapiens
ggaaagagagcaggacuca

SEQ ID NO: 65204 - RNA, 19 nt, Homo sapiens
gagcuccucuguccugcuu

SEQ ID NO: 65205 - RNA, 19 nt, Homo sapiens
uggagcaccuggaaagaaa

SEQ ID NO: 65206 - RNA, 19 nt, Homo sapiens
ggauauguccagcgacuug

SEQ ID NO: 65207 - RNA, 19 nt, Homo sapiens
gcaggacuaugugcagaug

SEQ ID NO: 65208 - RNA, 19 nt, Homo sapiens
aaagagagcaggacucaca

SEQ ID NO: 65209 - RNA, 19 nt, Homo sapiens
ucccuuuccuuccuaauuu

SEQ ID NO: 65210 - RNA, 19 nt, Homo sapiens
gaaaauaccagaaaaugag

SEQ ID NO: 65211 - RNA, 19 nt, Homo sapiens
ggaaaauaccagaaaauga

SEQ ID NO: 65212 - RNA, 19 nt, Homo sapiens
ggacucacagguuggaaga

SEQ ID NO: 65213 - RNA, 19 nt, Homo sapiens
ccuauaacuugaugcaugu

SEQ ID NO: 65214 - RNA, 19 nt, Homo sapiens
gugcugaucauuugaggaa

SEQ ID NO: 65215 - RNA, 19 nt, Homo sapiens
agaaucaccugggaaaaua

SEQ ID NO: 65216 - RNA, 19 nt, Homo sapiens
uggcagaggaugucucaaa

SEQ ID NO: 65217 - RNA, 19 nt, Homo sapiens
ugaugcaugugguuugguu

SEQ ID NO: 65218 - RNA, 19 nt, Homo sapiens
ccagcgacuuggagagaga

SEQ ID NO: 65219 - RNA, 19 nt, Homo sapiens
cugaucauuugaggaauaa

SEQ ID NO: 65220 - RNA, 19 nt, Homo sapiens
ggcagaggaugucucaaac

SEQ ID NO: 65221 - RNA, 19 nt, Homo sapiens
cauccuuccuauaacuuga

SEQ ID NO: 65222 - RNA, 19 nt, Homo sapiens
ucagaugggaggaaagaga

SEQ ID NO: 65223 - RNA, 19 nt, Homo sapiens
ucuugcauccuuccuauaa

SEQ ID NO: 65224 - RNA, 19 nt, Homo sapiens
gagagaccaucgcccucau

SEQ ID NO: 65225 - RNA, 19 nt, Homo sapiens
aagagaaucaccugggaaa

SEQ ID NO: 65226 - RNA, 19 nt, Homo sapiens
ggaugucucaaacuucaga

SEQ ID NO: 65227 - RNA, 19 nt, Homo sapiens
ucuaagcggugcgguaauc

SEQ ID NO: 65228 - RNA, 19 nt, Homo sapiens
ggagcaggagcaagagaga

SEQ ID NO: 65229 - RNA, 19 nt, Homo sapiens
acucacagguuggaagaga

SEQ ID NO: 65230 - RNA, 19 nt, Homo sapiens
ccucuguccugcuucugaa

SEQ ID NO: 65231 - RNA, 19 nt, Homo sapiens
aggacuaugugcagaugaa

SEQ ID NO: 65232 - RNA, 19 nt, Homo sapiens
gcggugcgguaaucugagu

SEQ ID NO: 65233 - RNA, 19 nt, Homo sapiens
uaacuugaugcaugugguu

SEQ ID NO: 65234 - RNA, 19 nt, Homo sapiens
cuucuugcauccuuccuau

SEQ ID NO: 65235 - RNA, 19 nt, Homo sapiens
gagaccaucgcccucaugu

SEQ ID NO: 65236 - RNA, 19 nt, Homo sapiens
ggaaagaaaagggauaugu

SEQ ID NO: 65237 - RNA, 19 nt, Homo sapiens
ccagaaugccaacuaaacu

SEQ ID NO: 65238 - RNA, 19 nt, Homo sapiens
uuccuaauuucccuucuug

SEQ ID NO: 65239 - RNA, 19 nt, Homo sapiens
gaaagaaaagggauauguc

SEQ ID NO: 65240 - RNA, 19 nt, Homo sapiens
acacgcaggacuucaacaa

SEQ ID NO: 65241 - RNA, 19 nt, Homo sapiens
gcauccuuccuauaacuug

SEQ ID NO: 65242 - RNA, 19 nt, Homo sapiens
cagcaucuugguccuguug

SEQ ID NO: 65243 - RNA, 19 nt, Homo sapiens
gagaaucaccugggaaaau

SEQ ID NO: 65244 - RNA, 19 nt, Homo sapiens
gcagaggaugucucaaacu

SEQ ID NO: 65245 - RNA, 19 nt, Homo sapiens
gcaucuugguccuguugca

SEQ ID NO: 65246 - RNA, 19 nt, Homo sapiens
gguuggagcaccuggaaag

SEQ ID NO: 65247 - RNA, 19 nt, Homo sapiens
cauacacgcaggacuucaa

SEQ ID NO: 65248 - RNA, 19 nt, Homo sapiens
gguaaucugaguacuugca

SEQ ID NO: 65249 - RNA, 19 nt, Homo sapiens
gggaaaauaccagaaaaug

SEQ ID NO: 65250 - RNA, 19 nt, Homo sapiens
ucacagguuggaagagaau

SEQ ID NO: 65251 - RNA, 19 nt, Homo sapiens
gcaggacucacagguugga

SEQ ID NO: 65252 - RNA, 19 nt, Homo sapiens
gaauauagauacccaauug

SEQ ID NO: 65253 - RNA, 19 nt, Homo sapiens
uaugagagcucuaguauuu

SEQ ID NO: 65254 - RNA, 19 nt, Homo sapiens
guaagaaacugccaaacua

SEQ ID NO: 65255 - RNA, 19 nt, Homo sapiens
ggaagaagguguguccuaa

SEQ ID NO: 65256 - RNA, 19 nt, Homo sapiens
ccaaugacauauccuuaua

SEQ ID NO: 65257 - RNA, 19 nt, Homo sapiens
uauaagagauucacucaga

SEQ ID NO: 65258 - RNA, 19 nt, Homo sapiens
ggugagagguguagguuga

SEQ ID NO: 65259 - RNA, 19 nt, Homo sapiens
gaagagagccugcaacacu

SEQ ID NO: 65260 - RNA, 19 nt, Homo sapiens
gcucuaguauuuccacaaa

SEQ ID NO: 65261 - RNA, 19 nt, Homo sapiens
ugaagggucuguuuaaauc

SEQ ID NO: 65262 - RNA, 19 nt, Homo sapiens
gaaaguguguauuuaacuc

SEQ ID NO: 65263 - RNA, 19 nt, Homo sapiens
caacugaucauauuugugu

SEQ ID NO: 65264 - RNA, 19 nt, Homo sapiens
gcuaguagauagaaauaca

SEQ ID NO: 65265 - RNA, 19 nt, Homo sapiens
cuacacauaucuuguuaga

SEQ ID NO: 65266 - RNA, 19 nt, Homo sapiens
ccagaacugugagagaaua

SEQ ID NO: 65267 - RNA, 19 nt, Homo sapiens
ugggagaauuagcauauua

SEQ ID NO: 65268 - RNA, 19 nt, Homo sapiens
aaauagguauguagcagua

SEQ ID NO: 65269 - RNA, 19 nt, Homo sapiens
gaacugugagagaauaauu

SEQ ID NO: 65270 - RNA, 19 nt, Homo sapiens
gacauauccuuauaagaga

SEQ ID NO: 65271 - RNA, 19 nt, Homo sapiens
gagcaucuauuuuaccaua

SEQ ID NO: 65272 - RNA, 19 nt, Homo sapiens
uggcuugcuugcuuuauua

SEQ ID NO: 65273 - RNA, 19 nt, Homo sapiens
ugacauauccuuauaagag

SEQ ID NO: 65274 - RNA, 19 nt, Homo sapiens
gcgcugcccugaaacucua

SEQ ID NO: 65275 - RNA, 19 nt, Homo sapiens
gcaagauuguuuucagaua

SEQ ID NO: 65276 - RNA, 19 nt, Homo sapiens
gaagacacauguggagaag

SEQ ID NO: 65277 - RNA, 19 nt, Homo sapiens
gaagaagguguguccuaaa

SEQ ID NO: 65278 - RNA, 19 nt, Homo sapiens
ugacagcccuaggaaacua

SEQ ID NO: 65279 - RNA, 19 nt, Homo sapiens
gagauucacucagaagaca

SEQ ID NO: 65280 - RNA, 19 nt, Homo sapiens
uagaaucaguguguuacua

SEQ ID NO: 65281 - RNA, 19 nt, Homo sapiens
gaagguguguccuaaaucc

SEQ ID NO: 65282 - RNA, 19 nt, Homo sapiens
guucauugcuaguagauag

SEQ ID NO: 65283 - RNA, 19 nt, Homo sapiens
cauacugccuugauuagug

SEQ ID NO: 65284 - RNA, 19 nt, Homo sapiens
gagugggauugcuggguua

SEQ ID NO: 65285 - RNA, 19 nt, Homo sapiens
ccaaggaagucugugucua

SEQ ID NO: 65286 - RNA, 19 nt, Homo sapiens
aagaagguguguccuaaau

SEQ ID NO: 65287 - RNA, 19 nt, Homo sapiens
gggagaauuagcauauuaa

SEQ ID NO: 65288 - RNA, 19 nt, Homo sapiens
cuugauuaguguaguguua

SEQ ID NO: 65289 - RNA, 19 nt, Homo sapiens
agaaacugccaaacuauuu

SEQ ID NO: 65290 - RNA, 19 nt, Homo sapiens
uuaagucguucaauucaug

SEQ ID NO: 65291 - RNA, 19 nt, Homo sapiens
cauaugagagcucuaguau

SEQ ID NO: 65292 - RNA, 19 nt, Homo sapiens
ugggauugcuggguuauuu

SEQ ID NO: 65293 - RNA, 19 nt, Homo sapiens
cuaaugacguugagcaucu

SEQ ID NO: 65294 - RNA, 19 nt, Homo sapiens
gcaggacuaugugcagaug

SEQ ID NO: 65295 - RNA, 19 nt, Homo sapiens
ugacguugagcaucuauuu

SEQ ID NO: 65296 - RNA, 19 nt, Homo sapiens
gaaucaguguguuacuauc

SEQ ID NO: 65297 - RNA, 19 nt, Homo sapiens
uaaugugggucuaccaaca

SEQ ID NO: 65298 - RNA, 19 nt, Homo sapiens
ugucauacugccuugauua

SEQ ID NO: 65299 - RNA, 19 nt, Homo sapiens
ccauauguuuaucaccuuu

SEQ ID NO: 65300 - RNA, 19 nt, Homo sapiens
uaagaaacugccaaacuau

SEQ ID NO: 65301 - RNA, 19 nt, Homo sapiens
ggacuuccagcuuccagaa

SEQ ID NO: 65302 - RNA, 19 nt, Homo sapiens
gagaaggugacaugacaga

SEQ ID NO: 65303 - RNA, 19 nt, Homo sapiens
uggagaaggugacaugaca

SEQ ID NO: 65304 - RNA, 19 nt, Homo sapiens
gaacucuuugccuaacuaa

SEQ ID NO: 65305 - RNA, 19 nt, Homo sapiens
gcugacaccuagaguuugg

SEQ ID NO: 65306 - RNA, 19 nt, Homo sapiens
agacacauguggagaaggu

SEQ ID NO: 65307 - RNA, 19 nt, Homo sapiens
guauauuucuggguucuca

SEQ ID NO: 65308 - RNA, 19 nt, Homo sapiens
agacuguuauuucaccauu

SEQ ID NO: 65309 - RNA, 19 nt, Homo sapiens
agaacucuuugccuaacua

SEQ ID NO: 65310 - RNA, 19 nt, Homo sapiens
cccaaugacuaaugacguu

SEQ ID NO: 65311 - RNA, 19 nt, Homo sapiens
agaacagucucuggaagaa

SEQ ID NO: 65312 - RNA, 19 nt, Homo sapiens
gauaaugugggucuaccaa

SEQ ID NO: 65313 - RNA, 19 nt, Homo sapiens
ucauaccugugaauauaga

SEQ ID NO: 65314 - RNA, 19 nt, Homo sapiens
aacagucucuggaagaaga

SEQ ID NO: 65315 - RNA, 19 nt, Homo sapiens
gauacccaauuguuucagu

SEQ ID NO: 65316 - RNA, 19 nt, Homo sapiens
gcaacuucgugcccaccaa

SEQ ID NO: 65317 - RNA, 19 nt, Homo sapiens
caaggaagucugugucuac

SEQ ID NO: 65318 - RNA, 19 nt, Homo sapiens
uaaauccaaugacauaucc

SEQ ID NO: 65319 - RNA, 19 nt, Homo sapiens
augaaugacuccaggaaga

SEQ ID NO: 65320 - RNA, 19 nt, Homo sapiens
ggucccaaggucacaauaa

SEQ ID NO: 65321 - RNA, 19 nt, Homo sapiens
ggaaaguguguauuuaacu

SEQ ID NO: 65322 - RNA, 19 nt, Homo sapiens
gugguaauuuguuaugaca

SEQ ID NO: 65323 - RNA, 19 nt, Homo sapiens
cagaagagagccugcaaca

SEQ ID NO: 65324 - RNA, 19 nt, Homo sapiens
ugagagguguagguugaaa

SEQ ID NO: 65325 - RNA, 19 nt, Homo sapiens
uauugaagggucuguuuaa

SEQ ID NO: 65326 - RNA, 19 nt, Homo sapiens
gacuguuauuucaccauuu

SEQ ID NO: 65327 - RNA, 19 nt, Homo sapiens
uaaugacguugagcaucua

SEQ ID NO: 65328 - RNA, 19 nt, Homo sapiens
caaacuauuuucugaagug

SEQ ID NO: 65329 - RNA, 19 nt, Homo sapiens
ccuaggaaacuaauacaau

SEQ ID NO: 65330 - RNA, 19 nt, Homo sapiens
cagcaggugugguguucau

SEQ ID NO: 65331 - RNA, 19 nt, Homo sapiens
gaaacugccaaacuauuuu

SEQ ID NO: 65332 - RNA, 19 nt, Homo sapiens
gcauggguuuccggaaguu

SEQ ID NO: 65333 - RNA, 19 nt, Homo sapiens
auaagagauucacucagaa

SEQ ID NO: 65334 - RNA, 19 nt, Homo sapiens
aauucugucucauugauug

SEQ ID NO: 65335 - RNA, 19 nt, Homo sapiens
ucauauuuguguggguaua

SEQ ID NO: 65336 - RNA, 19 nt, Homo sapiens
gaaacuuccuuccccugaa

SEQ ID NO: 65337 - RNA, 19 nt, Homo sapiens
uguuguggaugcaagauug

SEQ ID NO: 65338 - RNA, 19 nt, Homo sapiens
cuguuuaaaucuucugcua

SEQ ID NO: 65339 - RNA, 19 nt, Homo sapiens
agccugagcagaugaauga

SEQ ID NO: 65340 - RNA, 19 nt, Homo sapiens
gaaggccagugagcugaag

SEQ ID NO: 65341 - RNA, 19 nt, Homo sapiens
cugcugacaccuagaguuu

SEQ ID NO: 65342 - RNA, 19 nt, Homo sapiens
guguuaaagugaaucucaa

SEQ ID NO: 65343 - RNA, 19 nt, Homo sapiens
aagaaacugccaaacuauu

SEQ ID NO: 65344 - RNA, 19 nt, Homo sapiens
uggaaaguguguauuuaac

SEQ ID NO: 65345 - RNA, 19 nt, Homo sapiens
ggaggcacaagccaaggaa

SEQ ID NO: 65346 - RNA, 19 nt, Homo sapiens
agaagacacauguggagaa

SEQ ID NO: 65347 - RNA, 19 nt, Homo sapiens
ucacucagaagacacaugu

SEQ ID NO: 65348 - RNA, 19 nt, Homo sapiens
guguguuacuaucuacaaa

SEQ ID NO: 65349 - RNA, 19 nt, Homo sapiens
cggccacacucaguaaaga

SEQ ID NO: 65350 - RNA, 19 nt, Homo sapiens
uuauugaagggucuguuua

SEQ ID NO: 65351 - RNA, 19 nt, Homo sapiens
ccacauaugagagcucuag

SEQ ID NO: 65352 - RNA, 19 nt, Homo sapiens
gaaagaccaugcauuuaaa

SEQ ID NO: 65353 - RNA, 19 nt, Homo sapiens
gcaggaagauguaugcuuu

SEQ ID NO: 65354 - RNA, 19 nt, Homo sapiens
gcaaauuacuccaagguuu

SEQ ID NO: 65355 - RNA, 19 nt, Homo sapiens
gaauaaaccaguaucguua

SEQ ID NO: 65356 - RNA, 19 nt, Homo sapiens
ggaccuagcuguuguaaag

SEQ ID NO: 65357 - RNA, 19 nt, Homo sapiens
ggagaaagaccaugcauuu

SEQ ID NO: 65358 - RNA, 19 nt, Homo sapiens
gaagauguaugcuuugaau

SEQ ID NO: 65359 - RNA, 19 nt, Homo sapiens
gaauuggucuuaauguuga

SEQ ID NO: 65360 - RNA, 19 nt, Homo sapiens
uaaagcagauuaccucuug

SEQ ID NO: 65361 - RNA, 19 nt, Homo sapiens
gaacauaucauuugugaag

SEQ ID NO: 65362 - RNA, 19 nt, Homo sapiens
gcacauaguucugcccaaa

SEQ ID NO: 65363 - RNA, 19 nt, Homo sapiens
ggacugagaugcaaauguc

SEQ ID NO: 65364 - RNA, 19 nt, Homo sapiens
gagaucaucccuuugaaua

SEQ ID NO: 65365 - RNA, 19 nt, Homo sapiens
gaaccgaacauaucauuug

SEQ ID NO: 65366 - RNA, 19 nt, Homo sapiens
ucaaaccuauccaacaaua

SEQ ID NO: 65367 - RNA, 19 nt, Homo sapiens
caaauuacuccaagguuua

SEQ ID NO: 65368 - RNA, 19 nt, Homo sapiens
ggaagacaauacucccuuu

SEQ ID NO: 65369 - RNA, 19 nt, Homo sapiens
gaccaugcauuuaaaguau

SEQ ID NO: 65370 - RNA, 19 nt, Homo sapiens
ccggugagcugcaagauuu

SEQ ID NO: 65371 - RNA, 19 nt, Homo sapiens
gaacauguuucuuacuuac

SEQ ID NO: 65372 - RNA, 19 nt, Homo sapiens
gugcugagaucaucccuuu

SEQ ID NO: 65373 - RNA, 19 nt, Homo sapiens
ggucauucuuugucaauuu

SEQ ID NO: 65374 - RNA, 19 nt, Homo sapiens
gcuccaaauuuaaccauaa

SEQ ID NO: 65375 - RNA, 19 nt, Homo sapiens
ccacauaaguccauuaacu

SEQ ID NO: 65376 - RNA, 19 nt, Homo sapiens
gauauaugauuacgugaug

SEQ ID NO: 65377 - RNA, 19 nt, Homo sapiens
caaaugcuaugaccgaaug

SEQ ID NO: 65378 - RNA, 19 nt, Homo sapiens
caggagggcuaauuagaaa

SEQ ID NO: 65379 - RNA, 19 nt, Homo sapiens
agaaagaccaugcauuuaa

SEQ ID NO: 65380 - RNA, 19 nt, Homo sapiens
gagaaagaccaugcauuua

SEQ ID NO: 65381 - RNA, 19 nt, Homo sapiens
agacaauacucccuuuaaa

SEQ ID NO: 65382 - RNA, 19 nt, Homo sapiens
gaagacaauacucccuuua

SEQ ID NO: 65383 - RNA, 19 nt, Homo sapiens
caauagagcccaagccauu

SEQ ID NO: 65384 - RNA, 19 nt, Homo sapiens
gaaauugaccuaguucaga

SEQ ID NO: 65385 - RNA, 19 nt, Homo sapiens
gaucaucccuuugaauauc

SEQ ID NO: 65386 - RNA, 19 nt, Homo sapiens
ccaaugggcccaauucaaa

SEQ ID NO: 65387 - RNA, 19 nt, Homo sapiens
gcaacaguaaucagaguua

SEQ ID NO: 65388 - RNA, 19 nt, Homo sapiens
gauccaggagggcuaauua

SEQ ID NO: 65389 - RNA, 19 nt, Homo sapiens
ggaaugaaccagccaacaa

SEQ ID NO: 65390 - RNA, 19 nt, Homo sapiens
ccaccugguugaaguagua

SEQ ID NO: 65391 - RNA, 19 nt, Homo sapiens
caagcaaaguaucaaagaa

SEQ ID NO: 65392 - RNA, 19 nt, Homo sapiens
gugaauuuguccauuguaa

SEQ ID NO: 65393 - RNA, 19 nt, Homo sapiens
aaucaaaccuauccaacaa

SEQ ID NO: 65394 - RNA, 19 nt, Homo sapiens
ccgaacauaucauuuguga

SEQ ID NO: 65395 - RNA, 19 nt, Homo sapiens
gaugauggaugcacaguac

SEQ ID NO: 65396 - RNA, 19 nt, Homo sapiens
ucauaucucucuuuacuuc

SEQ ID NO: 65397 - RNA, 19 nt, Homo sapiens
guugaccgcuuguuucuug

SEQ ID NO: 65398 - RNA, 19 nt, Homo sapiens
cacaaagaaucuaucacua

SEQ ID NO: 65399 - RNA, 19 nt, Homo sapiens
gcaagcaaaguaucaaaga

SEQ ID NO: 65400 - RNA, 19 nt, Homo sapiens
gaaugcauauguucuguac

SEQ ID NO: 65401 - RNA, 19 nt, Homo sapiens
gaagguccauauugcaauc

SEQ ID NO: 65402 - RNA, 19 nt, Homo sapiens
gaccgcuuguuucuuguua

SEQ ID NO: 65403 - RNA, 19 nt, Homo sapiens
gcaguuacccgcauaccaa

SEQ ID NO: 65404 - RNA, 19 nt, Homo sapiens
ucagugaauuuguccauug

SEQ ID NO: 65405 - RNA, 19 nt, Homo sapiens
ggagagugcugagaucauc

SEQ ID NO: 65406 - RNA, 19 nt, Homo sapiens
gugaaaugcuuaugcuugu

SEQ ID NO: 65407 - RNA, 19 nt, Homo sapiens
acugagaggucacaaagaa

SEQ ID NO: 65408 - RNA, 19 nt, Homo sapiens
caaccacuauccaugcuau

SEQ ID NO: 65409 - RNA, 19 nt, Homo sapiens
gcugagaucaucccuuuga

SEQ ID NO: 65410 - RNA, 19 nt, Homo sapiens
gugaugcacucucugauuc

SEQ ID NO: 65411 - RNA, 19 nt, Homo sapiens
ucacaguaaugcaagcaaa

SEQ ID NO: 65412 - RNA, 19 nt, Homo sapiens
gcggugguauuaucucuug

SEQ ID NO: 65413 - RNA, 19 nt, Homo sapiens
acaauacucccuuuaaaga

SEQ ID NO: 65414 - RNA, 19 nt, Homo sapiens
gcacuguuucuucuucuaa

SEQ ID NO: 65415 - RNA, 19 nt, Homo sapiens
ggaucuaucuucauacacu

SEQ ID NO: 65416 - RNA, 19 nt, Homo sapiens
augcauauguucuguacua

SEQ ID NO: 65417 - RNA, 19 nt, Homo sapiens
acauaguucugcccaaauu

SEQ ID NO: 65418 - RNA, 19 nt, Homo sapiens
cagaagugauuuaguugug

SEQ ID NO: 65419 - RNA, 19 nt, Homo sapiens
ugaauaaaccaguaucguu

SEQ ID NO: 65420 - RNA, 19 nt, Homo sapiens
caugauggccugcaacuau

SEQ ID NO: 65421 - RNA, 19 nt, Homo sapiens
ccaaggagaagguccauau

SEQ ID NO: 65422 - RNA, 19 nt, Homo sapiens
gcuugaaugugaaggcaaa

SEQ ID NO: 65423 - RNA, 19 nt, Homo sapiens
agagucaucugcuugaaug

SEQ ID NO: 65424 - RNA, 19 nt, Homo sapiens
gagaagguccauauugcaa

SEQ ID NO: 65425 - RNA, 19 nt, Homo sapiens
gaauuugggauacuaaagu

SEQ ID NO: 65426 - RNA, 19 nt, Homo sapiens
gauacagggugcuccuugu

SEQ ID NO: 65427 - RNA, 19 nt, Homo sapiens
caauuuacaucugccauca

SEQ ID NO: 65428 - RNA, 19 nt, Homo sapiens
gaaacccauuugcuuuaca

SEQ ID NO: 65429 - RNA, 19 nt, Homo sapiens
ggaaacccauuugcuuuac

SEQ ID NO: 65430 - RNA, 19 nt, Homo sapiens
gaaccugguccaacuauac

SEQ ID NO: 65431 - RNA, 19 nt, Homo sapiens
ugacacaccggcuggagua

SEQ ID NO: 65432 - RNA, 19 nt, Homo sapiens
gaaaugcuuaugcuugugu

SEQ ID NO: 65433 - RNA, 19 nt, Homo sapiens
acaguguuauguaguauug

SEQ ID NO: 65434 - RNA, 19 nt, Homo sapiens
ccaaucacaguguuaugua

SEQ ID NO: 65435 - RNA, 19 nt, Homo sapiens
cuccaaaucuccagucuca

SEQ ID NO: 65436 - RNA, 19 nt, Homo sapiens
gagcccaagccauuucuuu

SEQ ID NO: 65437 - RNA, 19 nt, Homo sapiens
ccaggagggcuaauuagaa

SEQ ID NO: 65438 - RNA, 19 nt, Homo sapiens
gaucacugagccaucauuu

SEQ ID NO: 65439 - RNA, 19 nt, Homo sapiens
uuccagggcuucuuuguug

SEQ ID NO: 65440 - RNA, 19 nt, Homo sapiens
uguggucaauuucuucuuu

SEQ ID NO: 65441 - RNA, 19 nt, Homo sapiens
uggaaacccauuugcuuua

SEQ ID NO: 65442 - RNA, 19 nt, Homo sapiens
aauacucccuuuaaagaga

SEQ ID NO: 65443 - RNA, 19 nt, Homo sapiens
uaucauagagcaagaguca

SEQ ID NO: 65444 - RNA, 19 nt, Homo sapiens
guggaaacccauuugcuuu

SEQ ID NO: 65445 - RNA, 19 nt, Homo sapiens
gaaacugaagaaugcauau

SEQ ID NO: 65446 - RNA, 19 nt, Homo sapiens
ggaguauuguccuaucagu

SEQ ID NO: 65447 - RNA, 19 nt, Homo sapiens
uaagucuccuuuacugaau

SEQ ID NO: 65448 - RNA, 19 nt, Homo sapiens
ugauuuaguuguggaaaga

SEQ ID NO: 65449 - RNA, 19 nt, Homo sapiens
gaagauccaggagggcuaa

SEQ ID NO: 65450 - RNA, 19 nt, Homo sapiens
gcccuugggugcuaucuag

SEQ ID NO: 65451 - RNA, 19 nt, Homo sapiens
gacaauacucccuuuaaag

SEQ ID NO: 65452 - RNA, 19 nt, Homo sapiens
gaagauggcuugucagaug

SEQ ID NO: 65453 - RNA, 19 nt, Homo sapiens
gaagagagauuagaacugu

SEQ ID NO: 65454 - RNA, 19 nt, Homo sapiens
gaaguuaagucgcagaaug

SEQ ID NO: 65455 - RNA, 19 nt, Homo sapiens
ggacaaagaacccaaagaa

SEQ ID NO: 65456 - RNA, 19 nt, Homo sapiens
gggaagaaguuucagacua

SEQ ID NO: 65457 - RNA, 19 nt, Homo sapiens
gaagggauuuacagaaguu

SEQ ID NO: 65458 - RNA, 19 nt, Homo sapiens
ggaagaaguuucagacuac

SEQ ID NO: 65459 - RNA, 19 nt, Homo sapiens
caacagaagauccaaguuu

SEQ ID NO: 65460 - RNA, 19 nt, Homo sapiens
gaaaucacaccauggauga

SEQ ID NO: 65461 - RNA, 19 nt, Homo sapiens
ggaguucgacccaacaaua

SEQ ID NO: 65462 - RNA, 19 nt, Homo sapiens
cuagagauguucaugguaa

SEQ ID NO: 65463 - RNA, 19 nt, Homo sapiens
ggagaaagggaauguguuu

SEQ ID NO: 65464 - RNA, 19 nt, Homo sapiens
gaagagaagaggaggcuaa

SEQ ID NO: 65465 - RNA, 19 nt, Homo sapiens
caaagaacccaaagaagaa

SEQ ID NO: 65466 - RNA, 19 nt, Homo sapiens
aacagaagauccaaguuua

SEQ ID NO: 65467 - RNA, 19 nt, Homo sapiens
gaaagaagggauuuacaga

SEQ ID NO: 65468 - RNA, 19 nt, Homo sapiens
gaaaagcaguggugucaaa

SEQ ID NO: 65469 - RNA, 19 nt, Homo sapiens
gcaauaaugguugucuuua

SEQ ID NO: 65470 - RNA, 19 nt, Homo sapiens
ccaguaaacccauguauau

SEQ ID NO: 65471 - RNA, 19 nt, Homo sapiens
caagucaccugcucccaaa

SEQ ID NO: 65472 - RNA, 19 nt, Homo sapiens
gcagcaggcacaccaaaua

SEQ ID NO: 65473 - RNA, 19 nt, Homo sapiens
ucgagaagcucaaacagaa

SEQ ID NO: 65474 - RNA, 19 nt, Homo sapiens
gcugugaaauagagacuuu

SEQ ID NO: 65475 - RNA, 19 nt, Homo sapiens
ggaaacugcuggcuugaag

SEQ ID NO: 65476 - RNA, 19 nt, Homo sapiens
agaaaucaguccuuccuuu

SEQ ID NO: 65477 - RNA, 19 nt, Homo sapiens
gaaugacgaugaugaagag

SEQ ID NO: 65478 - RNA, 19 nt, Homo sapiens
agaauguacuguuaaggua

SEQ ID NO: 65479 - RNA, 19 nt, Homo sapiens
caagaaagaagacaaggaa

SEQ ID NO: 65480 - RNA, 19 nt, Homo sapiens
caagaaagauacgagauag

SEQ ID NO: 65481 - RNA, 19 nt, Homo sapiens
ccaagaaagauacgagaua

SEQ ID NO: 65482 - RNA, 19 nt, Homo sapiens
gcagaagaaugcaaaauga

SEQ ID NO: 65483 - RNA, 19 nt, Homo sapiens
gaaaagcaaucuguggaua

SEQ ID NO: 65484 - RNA, 19 nt, Homo sapiens
caagaaaccauucaagugu

SEQ ID NO: 65485 - RNA, 19 nt, Homo sapiens
gccagaagaugccagaaga

SEQ ID NO: 65486 - RNA, 19 nt, Homo sapiens
acaaagaacccaaagaaga

SEQ ID NO: 65487 - RNA, 19 nt, Homo sapiens
gagcgucgcagagaacuua

SEQ ID NO: 65488 - RNA, 19 nt, Homo sapiens
ugagacaguuccagaaaga

SEQ ID NO: 65489 - RNA, 19 nt, Homo sapiens
gcauacacauauacaaaca

SEQ ID NO: 65490 - RNA, 19 nt, Homo sapiens
auacagaagucauguuguu

SEQ ID NO: 65491 - RNA, 19 nt, Homo sapiens
ucccaaaccuucugacuug

SEQ ID NO: 65492 - RNA, 19 nt, Homo sapiens
guacgcaacaucaagagua

SEQ ID NO: 65493 - RNA, 19 nt, Homo sapiens
ggaaugacgaugaugaaga

SEQ ID NO: 65494 - RNA, 19 nt, Homo sapiens
gaacauuucaagaucauca

SEQ ID NO: 65495 - RNA, 19 nt, Homo sapiens
caaacacacuaaugguaga

SEQ ID NO: 65496 - RNA, 19 nt, Homo sapiens
gaaagucgccaagaaagau

SEQ ID NO: 65497 - RNA, 19 nt, Homo sapiens
guuagaaggaguugaaauu

SEQ ID NO: 65498 - RNA, 19 nt, Homo sapiens
gagauuagaacuguuagaa

SEQ ID NO: 65499 - RNA, 19 nt, Homo sapiens
aaacauggcagauagguau

SEQ ID NO: 65500 - RNA, 19 nt, Homo sapiens
gauagaagagcgagcagaa

SEQ ID NO: 65501 - RNA, 19 nt, Homo sapiens
gagaauucaugacccacaa

SEQ ID NO: 65502 - RNA, 19 nt, Homo sapiens
acagaaacauggcagauag

SEQ ID NO: 65503 - RNA, 19 nt, Homo sapiens
caucauaacucuguaucug

SEQ ID NO: 65504 - RNA, 19 nt, Homo sapiens
gaagaggaggcuaaaggaa

SEQ ID NO: 65505 - RNA, 19 nt, Homo sapiens
aagaagaaguuaagagcuu

SEQ ID NO: 65506 - RNA, 19 nt, Homo sapiens
gaacuuagaaggcaaaaga

SEQ ID NO: 65507 - RNA, 19 nt, Homo sapiens
uagccaauaucacagcuuu

SEQ ID NO: 65508 - RNA, 19 nt, Homo sapiens
cgagauagaggaaacagaa

SEQ ID NO: 65509 - RNA, 19 nt, Homo sapiens
gaaacauggcagauaggua

SEQ ID NO: 65510 - RNA, 19 nt, Homo sapiens
aaacccaugcugugaaaua

SEQ ID NO: 65511 - RNA, 19 nt, Homo sapiens
agaaacccaugcugugaaa

SEQ ID NO: 65512 - RNA, 19 nt, Homo sapiens
gaagguguacgcaacauca

SEQ ID NO: 65513 - RNA, 19 nt, Homo sapiens
uaaaugcauucuugaaguc

SEQ ID NO: 65514 - RNA, 19 nt, Homo sapiens
agagagauuagaacuguua

SEQ ID NO: 65515 - RNA, 19 nt, Homo sapiens
guaacuagccaauaucaca

SEQ ID NO: 65516 - RNA, 19 nt, Homo sapiens
uagaagagcgagcagaauu

SEQ ID NO: 65517 - RNA, 19 nt, Homo sapiens
gggcuaauucgcucuguuu

SEQ ID NO: 65518 - RNA, 19 nt, Homo sapiens
ccuaaagguucaucucuca

SEQ ID NO: 65519 - RNA, 19 nt, Homo sapiens
ggaggaagccgaucgaaaa

SEQ ID NO: 65520 - RNA, 19 nt, Homo sapiens
gaucgaaagaagggauuua

SEQ ID NO: 65521 - RNA, 19 nt, Homo sapiens
gaacccaaagaagaaguua

SEQ ID NO: 65522 - RNA, 19 nt, Homo sapiens
gagaaaaucagaucaaaga

SEQ ID NO: 65523 - RNA, 19 nt, Homo sapiens
gaguucgacccaacaauaa

SEQ ID NO: 65524 - RNA, 19 nt, Homo sapiens
gugcauacacauauacaaa

SEQ ID NO: 65525 - RNA, 19 nt, Homo sapiens
guggauuucuuuaguagug

SEQ ID NO: 65526 - RNA, 19 nt, Homo sapiens
cagaagauccaaguuuaaa

SEQ ID NO: 65527 - RNA, 19 nt, Homo sapiens
guccuuccuuuccgacuua

SEQ ID NO: 65528 - RNA, 19 nt, Homo sapiens
gaaagaacccaagcucaag

SEQ ID NO: 65529 - RNA, 19 nt, Homo sapiens
caaaccuucugacuugaga

SEQ ID NO: 65530 - RNA, 19 nt, Homo sapiens
gaagaaguuucagacuaca

SEQ ID NO: 65531 - RNA, 19 nt, Homo sapiens
gagaagaggaggcuaaagg

SEQ ID NO: 65532 - RNA, 19 nt, Homo sapiens
ccagaaggcucagacaucu

SEQ ID NO: 65533 - RNA, 19 nt, Homo sapiens
ccaaagcgagggagcauug

SEQ ID NO: 65534 - RNA, 19 nt, Homo sapiens
cagaaacagucaccaaguc

SEQ ID NO: 65535 - RNA, 19 nt, Homo sapiens
ucaaugaauggcuaacuaa

SEQ ID NO: 65536 - RNA, 19 nt, Homo sapiens
gacaagaaaccauucaagu

SEQ ID NO: 65537 - RNA, 19 nt, Homo sapiens
agaggaggcuaaaggaaga

SEQ ID NO: 65538 - RNA, 19 nt, Homo sapiens
aagaagggauuuacagaag

SEQ ID NO: 65539 - RNA, 19 nt, Homo sapiens
gauacgagauagaggaaac

SEQ ID NO: 65540 - RNA, 19 nt, Homo sapiens
cugaugaccuauaagaaga

SEQ ID NO: 65541 - RNA, 19 nt, Homo sapiens
aguaacccauuucagauuu

SEQ ID NO: 65542 - RNA, 19 nt, Homo sapiens
cagcaggcacaccaaauaa

SEQ ID NO: 65543 - RNA, 19 nt, Homo sapiens
ccagaggaaugacgaugau

SEQ ID NO: 65544 - RNA, 19 nt, Homo sapiens
ccacaaacuuaaacauacu

SEQ ID NO: 65545 - RNA, 19 nt, Homo sapiens
ccaagacaaccaccacaaa

SEQ ID NO: 65546 - RNA, 19 nt, Homo sapiens
gaugaccuauaagaagaaa

SEQ ID NO: 65547 - RNA, 19 nt, Homo sapiens
guaacccauuucagauuug

SEQ ID NO: 65548 - RNA, 19 nt, Homo sapiens
agaaagaacccaagcucaa

SEQ ID NO: 65549 - RNA, 19 nt, Homo sapiens
aagaaaccauucaaguguu

SEQ ID NO: 65550 - RNA, 19 nt, Homo sapiens
uggcugugcuccugcuuaa

SEQ ID NO: 65551 - RNA, 19 nt, Homo sapiens
gaaauacugcaauaauggu

SEQ ID NO: 65552 - RNA, 19 nt, Homo sapiens
gaacuaaagugcaagcuaa

SEQ ID NO: 65553 - RNA, 19 nt, Homo sapiens
gaagauggcuugucagaug

SEQ ID NO: 65554 - RNA, 19 nt, Homo sapiens
gaagagagauuagaacugu

SEQ ID NO: 65555 - RNA, 19 nt, Homo sapiens
gaaguuaagucgcagaaug

SEQ ID NO: 65556 - RNA, 19 nt, Homo sapiens
ggacaaagaacccaaagaa

SEQ ID NO: 65557 - RNA, 19 nt, Homo sapiens
gaagggaacuaaagugcaa

SEQ ID NO: 65558 - RNA, 19 nt, Homo sapiens
gggaagaaguuucagacua

SEQ ID NO: 65559 - RNA, 19 nt, Homo sapiens
aagaagagaucaaagauga

SEQ ID NO: 65560 - RNA, 19 nt, Homo sapiens
gaagggaaauggguaaaug

SEQ ID NO: 65561 - RNA, 19 nt, Homo sapiens
gaagggauuuacagaaguu

SEQ ID NO: 65562 - RNA, 19 nt, Homo sapiens
ggaagaaguuucagacuac

SEQ ID NO: 65563 - RNA, 19 nt, Homo sapiens
caacagaagauccaaguuu

SEQ ID NO: 65564 - RNA, 19 nt, Homo sapiens
gagaaaagcuccaagaaga

SEQ ID NO: 65565 - RNA, 19 nt, Homo sapiens
gaaaucacaccauggauga

SEQ ID NO: 65566 - RNA, 19 nt, Homo sapiens
ggaguucgacccaacaaua

SEQ ID NO: 65567 - RNA, 19 nt, Homo sapiens
cuagagauguucaugguaa

SEQ ID NO: 65568 - RNA, 19 nt, Homo sapiens
ggagaaagggaauguguuu

SEQ ID NO: 65569 - RNA, 19 nt, Homo sapiens
gaagagaagaggaggcuaa

SEQ ID NO: 65570 - RNA, 19 nt, Homo sapiens
caaagaacccaaagaagaa

SEQ ID NO: 65571 - RNA, 19 nt, Homo sapiens
gaagagagggaaaggauga

SEQ ID NO: 65572 - RNA, 19 nt, Homo sapiens
cagaagagccuaaacaaga

SEQ ID NO: 65573 - RNA, 19 nt, Homo sapiens
aacagaagauccaaguuua

SEQ ID NO: 65574 - RNA, 19 nt, Homo sapiens
gaaagaagggauuuacaga

SEQ ID NO: 65575 - RNA, 19 nt, Homo sapiens
gaaaagcaguggugucaaa

SEQ ID NO: 65576 - RNA, 19 nt, Homo sapiens
gcaauaaugguugucuuua

SEQ ID NO: 65577 - RNA, 19 nt, Homo sapiens
gaaagcacaagaagauaaa

SEQ ID NO: 65578 - RNA, 19 nt, Homo sapiens
ccaguaaacccauguauau

SEQ ID NO: 65579 - RNA, 19 nt, Homo sapiens
caagucaccugcucccaaa

SEQ ID NO: 65580 - RNA, 19 nt, Homo sapiens
gcagcaggcacaccaaaua

SEQ ID NO: 65581 - RNA, 19 nt, Homo sapiens
ucgagaagcucaaacagaa

SEQ ID NO: 65582 - RNA, 19 nt, Homo sapiens
gcugugaaauagagacuuu

SEQ ID NO: 65583 - RNA, 19 nt, Homo sapiens
ggaaacugcuggcuugaag

SEQ ID NO: 65584 - RNA, 19 nt, Homo sapiens
agaaaucaguccuuccuuu

SEQ ID NO: 65585 - RNA, 19 nt, Homo sapiens
gaagagaucaaagaugaaa

SEQ ID NO: 65586 - RNA, 19 nt, Homo sapiens
ggaaauggguaaaugaaaa

SEQ ID NO: 65587 - RNA, 19 nt, Homo sapiens
gauaaaggaggaagagaaa

SEQ ID NO: 65588 - RNA, 19 nt, Homo sapiens
gauaaaggaggaagagaaa

SEQ ID NO: 65589 - RNA, 19 nt, Homo sapiens
gagaagagaagggaacuaa

SEQ ID NO: 65590 - RNA, 19 nt, Homo sapiens
uagaagagcagaaacguaa

SEQ ID NO: 65591 - RNA, 19 nt, Homo sapiens
gaaugacgaugaugaagag

SEQ ID NO: 65592 - RNA, 19 nt, Homo sapiens
agaauguacuguuaaggua

SEQ ID NO: 65593 - RNA, 19 nt, Homo sapiens
agacaagccuaccuucaaa

SEQ ID NO: 65594 - RNA, 19 nt, Homo sapiens
gaggagaggcagaggauaa

SEQ ID NO: 65595 - RNA, 19 nt, Homo sapiens
gaggagaggcagaggauaa

SEQ ID NO: 65596 - RNA, 19 nt, Homo sapiens
gaggagaggcagaggauaa

SEQ ID NO: 65597 - RNA, 19 nt, Homo sapiens
caagaaagaagacaaggaa

SEQ ID NO: 65598 - RNA, 19 nt, Homo sapiens
caagaaagauacgagauag

SEQ ID NO: 65599 - RNA, 19 nt, Homo sapiens
gaagagaagggaacuaaag

SEQ ID NO: 65600 - RNA, 19 nt, Homo sapiens
gcagaucaguucagaagag

SEQ ID NO: 65601 - RNA, 19 nt, Homo sapiens
ccaagaaagauacgagaua

SEQ ID NO: 65602 - RNA, 19 nt, Homo sapiens
gcagaagaaugcaaaauga

SEQ ID NO: 65603 - RNA, 19 nt, Homo sapiens
gaaaagcaaucuguggaua

SEQ ID NO: 65604 - RNA, 19 nt, Homo sapiens
caagaaaccauucaagugu

SEQ ID NO: 65605 - RNA, 19 nt, Homo sapiens
gccagaagaugccagaaga

SEQ ID NO: 65606 - RNA, 19 nt, Homo sapiens
acaaagaacccaaagaaga

SEQ ID NO: 65607 - RNA, 19 nt, Homo sapiens
gagcgucgcagagaacuua

SEQ ID NO: 65608 - RNA, 19 nt, Homo sapiens
ugagacaguuccagaaaga

SEQ ID NO: 65609 - RNA, 19 nt, Homo sapiens
gaugaacgagcaagaauug

SEQ ID NO: 65610 - RNA, 19 nt, Homo sapiens
gcauacacauauacaaaca

SEQ ID NO: 65611 - RNA, 19 nt, Homo sapiens
auacagaagucauguuguu

SEQ ID NO: 65612 - RNA, 19 nt, Homo sapiens
aaagaaagcacaagaagau

SEQ ID NO: 65613 - RNA, 19 nt, Homo sapiens
ucccaaaccuucugacuug

SEQ ID NO: 65614 - RNA, 19 nt, Homo sapiens
guacgcaacaucaagagua

SEQ ID NO: 65615 - RNA, 19 nt, Homo sapiens
acaagcagcuagaagagaa

SEQ ID NO: 65616 - RNA, 19 nt, Homo sapiens
ggaaugacgaugaugaaga

SEQ ID NO: 65617 - RNA, 19 nt, Homo sapiens
gaacauuucaagaucauca

SEQ ID NO: 65618 - RNA, 19 nt, Homo sapiens
guaacaagcagcuagaaga

SEQ ID NO: 65619 - RNA, 19 nt, Homo sapiens
ggauaaaggaggaagagaa

SEQ ID NO: 65620 - RNA, 19 nt, Homo sapiens
ggauaaaggaggaagagaa

SEQ ID NO: 65621 - RNA, 19 nt, Homo sapiens
gaauuaaagccgagcaaga

SEQ ID NO: 65622 - RNA, 19 nt, Homo sapiens
ggaagcagaagaaagagaa

SEQ ID NO: 65623 - RNA, 19 nt, Homo sapiens
caaacacacuaaugguaga

SEQ ID NO: 65624 - RNA, 19 nt, Homo sapiens
ggaagagaaggcuaaggua

SEQ ID NO: 65625 - RNA, 19 nt, Homo sapiens
gaaagucgccaagaaagau

SEQ ID NO: 65626 - RNA, 19 nt, Homo sapiens
guuagaaggaguugaaauu

SEQ ID NO: 65627 - RNA, 19 nt, Homo sapiens
gagauuagaacuguuagaa

SEQ ID NO: 65628 - RNA, 19 nt, Homo sapiens
aaacauggcagauagguau

SEQ ID NO: 65629 - RNA, 19 nt, Homo sapiens
gauagaagagcgagcagaa

SEQ ID NO: 65630 - RNA, 19 nt, Homo sapiens
gagaauucaugacccacaa

SEQ ID NO: 65631 - RNA, 19 nt, Homo sapiens
ggaaacagugguaauguca

SEQ ID NO: 65632 - RNA, 19 nt, Homo sapiens
acagaaacauggcagauag

SEQ ID NO: 65633 - RNA, 19 nt, Homo sapiens
caucauaacucuguaucug

SEQ ID NO: 65634 - RNA, 19 nt, Homo sapiens
gaagaggaggcuaaaggaa

SEQ ID NO: 65635 - RNA, 19 nt, Homo sapiens
aagaagaaguuaagagcuu

SEQ ID NO: 65636 - RNA, 19 nt, Homo sapiens
aaagauagcagaugaacga

SEQ ID NO: 65637 - RNA, 19 nt, Homo sapiens
ggaagaggaagacaaggaa

SEQ ID NO: 65638 - RNA, 19 nt, Homo sapiens
gaacuuagaaggcaaaaga

SEQ ID NO: 65639 - RNA, 19 nt, Homo sapiens
uagccaauaucacagcuuu

SEQ ID NO: 65640 - RNA, 19 nt, Homo sapiens
cgagauagaggaaacagaa

SEQ ID NO: 65641 - RNA, 19 nt, Homo sapiens
gaaacauggcagauaggua

SEQ ID NO: 65642 - RNA, 19 nt, Homo sapiens
aaacccaugcugugaaaua

SEQ ID NO: 65643 - RNA, 19 nt, Homo sapiens
agaaacccaugcugugaaa

SEQ ID NO: 65644 - RNA, 19 nt, Homo sapiens
gaagguguacgcaacauca

SEQ ID NO: 65645 - RNA, 19 nt, Homo sapiens
ggaacuaaagugcaagcua

SEQ ID NO: 65646 - RNA, 19 nt, Homo sapiens
uaaaugcauucuugaaguc

SEQ ID NO: 65647 - RNA, 19 nt, Homo sapiens
gaugagggaggaagagaaa

SEQ ID NO: 65648 - RNA, 19 nt, Homo sapiens
agagagauuagaacuguua

SEQ ID NO: 65649 - RNA, 19 nt, Homo sapiens
guaacuagccaauaucaca

SEQ ID NO: 65650 - RNA, 19 nt, Homo sapiens
uagaagagcgagcagaauu

SEQ ID NO: 65651 - RNA, 19 nt, Homo sapiens
agagaaggcuaagguagaa

SEQ ID NO: 65652 - RNA, 19 nt, Homo sapiens
gaacuaaagugcaagcuaa

SEQ ID NO: 65653 - RNA, 19 nt, Homo sapiens
gaagauggcuugucagaug

SEQ ID NO: 65654 - RNA, 19 nt, Homo sapiens
gaaguuaagucgcagaaug

SEQ ID NO: 65655 - RNA, 19 nt, Homo sapiens
ggacaaagaacccaaagaa

SEQ ID NO: 65656 - RNA, 19 nt, Homo sapiens
gaagggaacuaaagugcaa

SEQ ID NO: 65657 - RNA, 19 nt, Homo sapiens
aagaagagaucaaagauga

SEQ ID NO: 65658 - RNA, 19 nt, Homo sapiens
gaagggauuuacagaaguu

SEQ ID NO: 65659 - RNA, 19 nt, Homo sapiens
caacagaagauccaaguuu

SEQ ID NO: 65660 - RNA, 19 nt, Homo sapiens
gagaaaagcuccaagaaga

SEQ ID NO: 65661 - RNA, 19 nt, Homo sapiens
ggaguucgacccaacaaua

SEQ ID NO: 65662 - RNA, 19 nt, Homo sapiens
cuagagauguucaugguaa

SEQ ID NO: 65663 - RNA, 19 nt, Homo sapiens
ggagaaagggaauguguuu

SEQ ID NO: 65664 - RNA, 19 nt, Homo sapiens
gaagagaagaggaggcuaa

SEQ ID NO: 65665 - RNA, 19 nt, Homo sapiens
caaagaacccaaagaagaa

SEQ ID NO: 65666 - RNA, 19 nt, Homo sapiens
aacagaagauccaaguuua

SEQ ID NO: 65667 - RNA, 19 nt, Homo sapiens
gaaagaagggauuuacaga

SEQ ID NO: 65668 - RNA, 19 nt, Homo sapiens
gaaaagcaguggugucaaa

SEQ ID NO: 65669 - RNA, 19 nt, Homo sapiens
ccaguaaacccauguauau

SEQ ID NO: 65670 - RNA, 19 nt, Homo sapiens
caagucaccugcucccaaa

SEQ ID NO: 65671 - RNA, 19 nt, Homo sapiens
gcagcaggcacaccaaaua

SEQ ID NO: 65672 - RNA, 19 nt, Homo sapiens
ucgagaagcucaaacagaa

SEQ ID NO: 65673 - RNA, 19 nt, Homo sapiens
gcugugaaauagagacuuu

SEQ ID NO: 65674 - RNA, 19 nt, Homo sapiens
ggaaacugcuggcuugaag

SEQ ID NO: 65675 - RNA, 19 nt, Homo sapiens
gaagagaucaaagaugaaa

SEQ ID NO: 65676 - RNA, 19 nt, Homo sapiens
gaaugacgaugaugaagag

SEQ ID NO: 65677 - RNA, 19 nt, Homo sapiens
gagaagagaagggaacuaa

SEQ ID NO: 65678 - RNA, 19 nt, Homo sapiens
agacaagccuaccuucaaa

SEQ ID NO: 65679 - RNA, 19 nt, Homo sapiens
caagaaagaagacaaggaa

SEQ ID NO: 65680 - RNA, 19 nt, Homo sapiens
caagaaagauacgagauag

SEQ ID NO: 65681 - RNA, 19 nt, Homo sapiens
gaagagaagggaacuaaag

SEQ ID NO: 65682 - RNA, 19 nt, Homo sapiens
ccaagaaagauacgagaua

SEQ ID NO: 65683 - RNA, 19 nt, Homo sapiens
gcagaagaaugcaaaauga

SEQ ID NO: 65684 - RNA, 19 nt, Homo sapiens
gaaaagcaaucuguggaua

SEQ ID NO: 65685 - RNA, 19 nt, Homo sapiens
caagaaaccauucaagugu

SEQ ID NO: 65686 - RNA, 19 nt, Homo sapiens
gccagaagaugccagaaga

SEQ ID NO: 65687 - RNA, 19 nt, Homo sapiens
acaaagaacccaaagaaga

SEQ ID NO: 65688 - RNA, 19 nt, Homo sapiens
ugagacaguuccagaaaga

SEQ ID NO: 65689 - RNA, 19 nt, Homo sapiens
auacagaagucauguuguu

SEQ ID NO: 65690 - RNA, 19 nt, Homo sapiens
ucccaaaccuucugacuug

SEQ ID NO: 65691 - RNA, 19 nt, Homo sapiens
guacgcaacaucaagagua

SEQ ID NO: 65692 - RNA, 19 nt, Homo sapiens
ggaaugacgaugaugaaga

SEQ ID NO: 65693 - RNA, 19 nt, Homo sapiens
aaucacagcuagagauguu

SEQ ID NO: 65694 - RNA, 19 nt, Homo sapiens
gaaagucgccaagaaagau

SEQ ID NO: 65695 - RNA, 19 nt, Homo sapiens
gauagaagagcgagcagaa

SEQ ID NO: 65696 - RNA, 19 nt, Homo sapiens
gagaauucaugacccacaa

SEQ ID NO: 65697 - RNA, 19 nt, Homo sapiens
caucauaacucuguaucug

SEQ ID NO: 65698 - RNA, 19 nt, Homo sapiens
gaagaggaggcuaaaggaa

SEQ ID NO: 65699 - RNA, 19 nt, Homo sapiens
aagaagaaguuaagagcuu

SEQ ID NO: 65700 - RNA, 19 nt, Homo sapiens
cgagauagaggaaacagaa

SEQ ID NO: 65701 - RNA, 19 nt, Homo sapiens
aaacccaugcugugaaaua

SEQ ID NO: 65702 - RNA, 19 nt, Homo sapiens
agaaacccaugcugugaaa

SEQ ID NO: 65703 - RNA, 19 nt, Homo sapiens
gaagguguacgcaacauca

SEQ ID NO: 65704 - RNA, 19 nt, Homo sapiens
ggaacuaaagugcaagcua

SEQ ID NO: 65705 - RNA, 19 nt, Homo sapiens
uagaagagcgagcagaauu

SEQ ID NO: 65706 - RNA, 19 nt, Homo sapiens
ccuaaagguucaucucuca

SEQ ID NO: 65707 - RNA, 19 nt, Homo sapiens
ggaggaagccgaucgaaaa

SEQ ID NO: 65708 - RNA, 19 nt, Homo sapiens
gaucgaaagaagggauuua

SEQ ID NO: 65709 - RNA, 19 nt, Homo sapiens
gaacccaaagaagaaguua

SEQ ID NO: 65710 - RNA, 19 nt, Homo sapiens
gaguucgacccaacaauaa

SEQ ID NO: 65711 - RNA, 19 nt, Homo sapiens
cagaagauccaaguuuaaa

SEQ ID NO: 65712 - RNA, 19 nt, Homo sapiens
cuaauucgcucuuuuguau

SEQ ID NO: 65713 - RNA, 19 nt, Homo sapiens
gaaagaacccaagcucaag

SEQ ID NO: 65714 - RNA, 19 nt, Homo sapiens
caaaccuucugacuugaga

SEQ ID NO: 65715 - RNA, 19 nt, Homo sapiens
gagaagaggaggcuaaagg

SEQ ID NO: 65716 - RNA, 19 nt, Homo sapiens
ccaaagcgagggagcauug

SEQ ID NO: 65717 - RNA, 19 nt, Homo sapiens
cagaaacagucaccaaguc

SEQ ID NO: 65718 - RNA, 19 nt, Homo sapiens
ucaaugaauggcuaacuaa

SEQ ID NO: 65719 - RNA, 19 nt, Homo sapiens
gacaagaaaccauucaagu

SEQ ID NO: 65720 - RNA, 19 nt, Homo sapiens
agaggaggcuaaaggaaga

SEQ ID NO: 65721 - RNA, 19 nt, Homo sapiens
aagaagggauuuacagaag

SEQ ID NO: 65722 - RNA, 19 nt, Homo sapiens
gauacgagauagaggaaac

SEQ ID NO: 65723 - RNA, 19 nt, Homo sapiens
aguaacccauuucagauuu

SEQ ID NO: 65724 - RNA, 19 nt, Homo sapiens
cagcaggcacaccaaauaa

SEQ ID NO: 65725 - RNA, 19 nt, Homo sapiens
ccagaggaaugacgaugau

SEQ ID NO: 65726 - RNA, 19 nt, Homo sapiens
ccaagacaaccaccacaaa

SEQ ID NO: 65727 - RNA, 19 nt, Homo sapiens
ccacaaacuuaaacauacu

SEQ ID NO: 65728 - RNA, 19 nt, Homo sapiens
guaacccauuucagauuug

SEQ ID NO: 65729 - RNA, 19 nt, Homo sapiens
agaaagaacccaagcucaa

SEQ ID NO: 65730 - RNA, 19 nt, Homo sapiens
aagaaaccauucaaguguu

SEQ ID NO: 65731 - RNA, 19 nt, Homo sapiens
gaaauacugcaauaauggu

SEQ ID NO: 65732 - RNA, 19 nt, Homo sapiens
guaggcaauuguaacacuu

SEQ ID NO: 65733 - RNA, 19 nt, Homo sapiens
gaggaaugacgaugaugaa

SEQ ID NO: 65734 - RNA, 19 nt, Homo sapiens
gcaguauaccagugcaauu

SEQ ID NO: 65735 - RNA, 19 nt, Homo sapiens
gcugagaaacgccagaaga

SEQ ID NO: 65736 - RNA, 19 nt, Homo sapiens
aaagaagggauuuacagaa

SEQ ID NO: 65737 - RNA, 19 nt, Homo sapiens
cagcaauagucuccaagau

SEQ ID NO: 65738 - RNA, 19 nt, Homo sapiens
acaagaaaccauucaagug

SEQ ID NO: 65739 - RNA, 19 nt, Homo sapiens
ucagagaggaggaagagaa

SEQ ID NO: 65740 - RNA, 19 nt, Homo sapiens
ccaagcagaagaaugcaaa

SEQ ID NO: 65741 - RNA, 19 nt, Homo sapiens
uaacccauuucagauuuga

SEQ ID NO: 65742 - RNA, 19 nt, Homo sapiens
cggaaugugugcaguaucu

SEQ ID NO: 65743 - RNA, 19 nt, Homo sapiens
aaagaaacccaugcuguga

SEQ ID NO: 65744 - RNA, 19 nt, Homo sapiens
ggcagaagcaggaggaaga

SEQ ID NO: 65745 - RNA, 19 nt, Homo sapiens
ggaggugaaugcccagaac

SEQ ID NO: 65746 - RNA, 19 nt, Homo sapiens
cgagggagcauuggagaaa

SEQ ID NO: 65747 - RNA, 19 nt, Homo sapiens
aaacagaaacagucaccaa

SEQ ID NO: 65748 - RNA, 19 nt, Homo sapiens
aaaugaaacuaccgagaag

SEQ ID NO: 65749 - RNA, 19 nt, Homo sapiens
ucaagaguaugugggagaa

SEQ ID NO: 65750 - RNA, 19 nt, Homo sapiens
aaauacagaagucauguug

SEQ ID NO: 65751 - RNA, 19 nt, Homo sapiens
caaugaauggcuaacuaaa

SEQ ID NO: 65752 - RNA, 19 nt, Homo sapiens
gaagauggcuugucagaug

SEQ ID NO: 65753 - RNA, 19 nt, Homo sapiens
gaaguuaagucgcagaaug

SEQ ID NO: 65754 - RNA, 19 nt, Homo sapiens
ggacaaagaacccaaagaa

SEQ ID NO: 65755 - RNA, 19 nt, Homo sapiens
gaagggauuuacagaaguu

SEQ ID NO: 65756 - RNA, 19 nt, Homo sapiens
caacagaagauccaaguuu

SEQ ID NO: 65757 - RNA, 19 nt, Homo sapiens
ggaguucgacccaacaaua

SEQ ID NO: 65758 - RNA, 19 nt, Homo sapiens
cuagagauguucaugguaa

SEQ ID NO: 65759 - RNA, 19 nt, Homo sapiens
ggagaaagggaauguguuu

SEQ ID NO: 65760 - RNA, 19 nt, Homo sapiens
gaagagaagaggaggcuaa

SEQ ID NO: 65761 - RNA, 19 nt, Homo sapiens
caaagaacccaaagaagaa

SEQ ID NO: 65762 - RNA, 19 nt, Homo sapiens
aacagaagauccaaguuua

SEQ ID NO: 65763 - RNA, 19 nt, Homo sapiens
gaaagaagggauuuacaga

SEQ ID NO: 65764 - RNA, 19 nt, Homo sapiens
gaaaagcaguggugucaaa

SEQ ID NO: 65765 - RNA, 19 nt, Homo sapiens
ccaguaaacccauguauau

SEQ ID NO: 65766 - RNA, 19 nt, Homo sapiens
caagucaccugcucccaaa

SEQ ID NO: 65767 - RNA, 19 nt, Homo sapiens
gcagcaggcacaccaaaua

SEQ ID NO: 65768 - RNA, 19 nt, Homo sapiens
ucgagaagcucaaacagaa

SEQ ID NO: 65769 - RNA, 19 nt, Homo sapiens
gcugugaaauagagacuuu

SEQ ID NO: 65770 - RNA, 19 nt, Homo sapiens
ggaaacugcuggcuugaag

SEQ ID NO: 65771 - RNA, 19 nt, Homo sapiens
gaaugacgaugaugaagag

SEQ ID NO: 65772 - RNA, 19 nt, Homo sapiens
caagaaagaagacaaggaa

SEQ ID NO: 65773 - RNA, 19 nt, Homo sapiens
caagaaagauacgagauag

SEQ ID NO: 65774 - RNA, 19 nt, Homo sapiens
ccaagaaagauacgagaua

SEQ ID NO: 65775 - RNA, 19 nt, Homo sapiens
gcagaagaaugcaaaauga

SEQ ID NO: 65776 - RNA, 19 nt, Homo sapiens
gaaaagcaaucuguggaua

SEQ ID NO: 65777 - RNA, 19 nt, Homo sapiens
caagaaaccauucaagugu

SEQ ID NO: 65778 - RNA, 19 nt, Homo sapiens
gccagaagaugccagaaga

SEQ ID NO: 65779 - RNA, 19 nt, Homo sapiens
acaaagaacccaaagaaga

SEQ ID NO: 65780 - RNA, 19 nt, Homo sapiens
ugagacaguuccagaaaga

SEQ ID NO: 65781 - RNA, 19 nt, Homo sapiens
auacagaagucauguuguu

SEQ ID NO: 65782 - RNA, 19 nt, Homo sapiens
ucccaaaccuucugacuug

SEQ ID NO: 65783 - RNA, 19 nt, Homo sapiens
guacgcaacaucaagagua

SEQ ID NO: 65784 - RNA, 19 nt, Homo sapiens
ggaaugacgaugaugaaga

SEQ ID NO: 65785 - RNA, 19 nt, Homo sapiens
aaucacagcuagagauguu

SEQ ID NO: 65786 - RNA, 19 nt, Homo sapiens
gaaagucgccaagaaagau

SEQ ID NO: 65787 - RNA, 19 nt, Homo sapiens
gauagaagagcgagcagaa

SEQ ID NO: 65788 - RNA, 19 nt, Homo sapiens
gagaauucaugacccacaa

SEQ ID NO: 65789 - RNA, 19 nt, Homo sapiens
caucauaacucuguaucug

SEQ ID NO: 65790 - RNA, 19 nt, Homo sapiens
gaagaggaggcuaaaggaa

SEQ ID NO: 65791 - RNA, 19 nt, Homo sapiens
aagaagaaguuaagagcuu

SEQ ID NO: 65792 - RNA, 19 nt, Homo sapiens
cgagauagaggaaacagaa

SEQ ID NO: 65793 - RNA, 19 nt, Homo sapiens
aaacccaugcugugaaaua

SEQ ID NO: 65794 - RNA, 19 nt, Homo sapiens
agaaacccaugcugugaaa

SEQ ID NO: 65795 - RNA, 19 nt, Homo sapiens
gaagguguacgcaacauca

SEQ ID NO: 65796 - RNA, 19 nt, Homo sapiens
uagaagagcgagcagaauu

SEQ ID NO: 65797 - RNA, 19 nt, Homo sapiens
ccuaaagguucaucucuca

SEQ ID NO: 65798 - RNA, 19 nt, Homo sapiens
ggaggaagccgaucgaaaa

SEQ ID NO: 65799 - RNA, 19 nt, Homo sapiens
gaucgaaagaagggauuua

SEQ ID NO: 65800 - RNA, 19 nt, Homo sapiens
gaacccaaagaagaaguua

SEQ ID NO: 65801 - RNA, 19 nt, Homo sapiens
gagaaaaucagaucaaaga

SEQ ID NO: 65802 - RNA, 19 nt, Homo sapiens
gaguucgacccaacaauaa

SEQ ID NO: 65803 - RNA, 19 nt, Homo sapiens
cagaagauccaaguuuaaa

SEQ ID NO: 65804 - RNA, 19 nt, Homo sapiens
cuaauucgcucuuuuguau

SEQ ID NO: 65805 - RNA, 19 nt, Homo sapiens
gaaagaacccaagcucaag

SEQ ID NO: 65806 - RNA, 19 nt, Homo sapiens
caaaccuucugacuugaga

SEQ ID NO: 65807 - RNA, 19 nt, Homo sapiens
gagaagaggaggcuaaagg

SEQ ID NO: 65808 - RNA, 19 nt, Homo sapiens
ccaaagcgagggagcauug

SEQ ID NO: 65809 - RNA, 19 nt, Homo sapiens
cagaaacagucaccaaguc

SEQ ID NO: 65810 - RNA, 19 nt, Homo sapiens
ucaaugaauggcuaacuaa

SEQ ID NO: 65811 - RNA, 19 nt, Homo sapiens
gacaagaaaccauucaagu

SEQ ID NO: 65812 - RNA, 19 nt, Homo sapiens
agaggaggcuaaaggaaga

SEQ ID NO: 65813 - RNA, 19 nt, Homo sapiens
aagaagggauuuacagaag

SEQ ID NO: 65814 - RNA, 19 nt, Homo sapiens
gauacgagauagaggaaac

SEQ ID NO: 65815 - RNA, 19 nt, Homo sapiens
aguaacccauuucagauuu

SEQ ID NO: 65816 - RNA, 19 nt, Homo sapiens
cagcaggcacaccaaauaa

SEQ ID NO: 65817 - RNA, 19 nt, Homo sapiens
ccagaggaaugacgaugau

SEQ ID NO: 65818 - RNA, 19 nt, Homo sapiens
ccaagacaaccaccacaaa

SEQ ID NO: 65819 - RNA, 19 nt, Homo sapiens
ccacaaacuuaaacauacu

SEQ ID NO: 65820 - RNA, 19 nt, Homo sapiens
guaacccauuucagauuug

SEQ ID NO: 65821 - RNA, 19 nt, Homo sapiens
agaaagaacccaagcucaa

SEQ ID NO: 65822 - RNA, 19 nt, Homo sapiens
aagaaaccauucaaguguu

SEQ ID NO: 65823 - RNA, 19 nt, Homo sapiens
gaaauacugcaauaauggu

SEQ ID NO: 65824 - RNA, 19 nt, Homo sapiens
guaggcaauuguaacacuu

SEQ ID NO: 65825 - RNA, 19 nt, Homo sapiens
gaggaaugacgaugaugaa

SEQ ID NO: 65826 - RNA, 19 nt, Homo sapiens
gcaguauaccagugcaauu

SEQ ID NO: 65827 - RNA, 19 nt, Homo sapiens
gcugagaaacgccagaaga

SEQ ID NO: 65828 - RNA, 19 nt, Homo sapiens
aaagaagggauuuacagaa

SEQ ID NO: 65829 - RNA, 19 nt, Homo sapiens
cagcaauagucuccaagau

SEQ ID NO: 65830 - RNA, 19 nt, Homo sapiens
acaagaaaccauucaagug

SEQ ID NO: 65831 - RNA, 19 nt, Homo sapiens
ucagagaggaggaagagaa

SEQ ID NO: 65832 - RNA, 19 nt, Homo sapiens
ccaagcagaagaaugcaaa

SEQ ID NO: 65833 - RNA, 19 nt, Homo sapiens
uaacccauuucagauuuga

SEQ ID NO: 65834 - RNA, 19 nt, Homo sapiens
ggaggugaaugcccagaac

SEQ ID NO: 65835 - RNA, 19 nt, Homo sapiens
cggaaugugugcaguaucu

SEQ ID NO: 65836 - RNA, 19 nt, Homo sapiens
ggcagaagcaggaggaaga

SEQ ID NO: 65837 - RNA, 19 nt, Homo sapiens
aaagaaacccaugcuguga

SEQ ID NO: 65838 - RNA, 19 nt, Homo sapiens
cgagggagcauuggagaaa

SEQ ID NO: 65839 - RNA, 19 nt, Homo sapiens
aaacagaaacagucaccaa

SEQ ID NO: 65840 - RNA, 19 nt, Homo sapiens
aaaugaaacuaccgagaag

SEQ ID NO: 65841 - RNA, 19 nt, Homo sapiens
ucaagaguaugugggagaa

SEQ ID NO: 65842 - RNA, 19 nt, Homo sapiens
aaauacagaagucauguug

SEQ ID NO: 65843 - RNA, 19 nt, Homo sapiens
caaugaauggcuaacuaaa

SEQ ID NO: 65844 - RNA, 19 nt, Homo sapiens
caaaucgacccaucaagca

SEQ ID NO: 65845 - RNA, 19 nt, Homo sapiens
aaagguucaucucucaaga

SEQ ID NO: 65846 - RNA, 19 nt, Homo sapiens
cagaagauggcuugucaga

SEQ ID NO: 65847 - RNA, 19 nt, Homo sapiens
uaaaggaagagauugaaag

SEQ ID NO: 65848 - RNA, 19 nt, Homo sapiens
gaaaaucagaucaaagaug

SEQ ID NO: 65849 - RNA, 19 nt, Homo sapiens
ugaaauacugcaauaaugg

SEQ ID NO: 65850 - RNA, 19 nt, Homo sapiens
acagaagauccaaguuuaa

SEQ ID NO: 65851 - RNA, 19 nt, Homo sapiens
gcagugauaccaaccacau

SEQ ID NO: 65852 - RNA, 19 nt, Homo sapiens
gaacuaaagugcaagcuaa

SEQ ID NO: 65853 - RNA, 19 nt, Homo sapiens
gaagauggcuugucagaug

SEQ ID NO: 65854 - RNA, 19 nt, Homo sapiens
gaagagagauuagaacugu

SEQ ID NO: 65855 - RNA, 19 nt, Homo sapiens
gaaguuaagucgcagaaug

SEQ ID NO: 65856 - RNA, 19 nt, Homo sapiens
ggacaaagaacccaaagaa

SEQ ID NO: 65857 - RNA, 19 nt, Homo sapiens
gaagggaacuaaagugcaa

SEQ ID NO: 65858 - RNA, 19 nt, Homo sapiens
gggaagaaguuucagacua

SEQ ID NO: 65859 - RNA, 19 nt, Homo sapiens
aagaagagaucaaagauga

SEQ ID NO: 65860 - RNA, 19 nt, Homo sapiens
gaagggauuuacagaaguu

SEQ ID NO: 65861 - RNA, 19 nt, Homo sapiens
ggaagaaguuucagacuac

SEQ ID NO: 65862 - RNA, 19 nt, Homo sapiens
caacagaagauccaaguuu

SEQ ID NO: 65863 - RNA, 19 nt, Homo sapiens
gagaaaagcuccaagaaga

SEQ ID NO: 65864 - RNA, 19 nt, Homo sapiens
gaaaucacaccauggauga

SEQ ID NO: 65865 - RNA, 19 nt, Homo sapiens
ggaguucgacccaacaaua

SEQ ID NO: 65866 - RNA, 19 nt, Homo sapiens
cuagagauguucaugguaa

SEQ ID NO: 65867 - RNA, 19 nt, Homo sapiens
ggagaaagggaauguguuu

SEQ ID NO: 65868 - RNA, 19 nt, Homo sapiens
gaagagaagaggaggcuaa

SEQ ID NO: 65869 - RNA, 19 nt, Homo sapiens
caaagaacccaaagaagaa

SEQ ID NO: 65870 - RNA, 19 nt, Homo sapiens
aacagaagauccaaguuua

SEQ ID NO: 65871 - RNA, 19 nt, Homo sapiens
gaaagaagggauuuacaga

SEQ ID NO: 65872 - RNA, 19 nt, Homo sapiens
gaaaagcaguggugucaaa

SEQ ID NO: 65873 - RNA, 19 nt, Homo sapiens
gcaauaaugguugucuuua

SEQ ID NO: 65874 - RNA, 19 nt, Homo sapiens
ccaguaaacccauguauau

SEQ ID NO: 65875 - RNA, 19 nt, Homo sapiens
caagucaccugcucccaaa

SEQ ID NO: 65876 - RNA, 19 nt, Homo sapiens
gcagcaggcacaccaaaua

SEQ ID NO: 65877 - RNA, 19 nt, Homo sapiens
ucgagaagcucaaacagaa

SEQ ID NO: 65878 - RNA, 19 nt, Homo sapiens
gcugugaaauagagacuuu

SEQ ID NO: 65879 - RNA, 19 nt, Homo sapiens
ggaaacugcuggcuugaag

SEQ ID NO: 65880 - RNA, 19 nt, Homo sapiens
agaaaucaguccuuccuuu

SEQ ID NO: 65881 - RNA, 19 nt, Homo sapiens
gaagagaucaaagaugaaa

SEQ ID NO: 65882 - RNA, 19 nt, Homo sapiens
gagaagagaagggaacuaa

SEQ ID NO: 65883 - RNA, 19 nt, Homo sapiens
gaaugacgaugaugaagag

SEQ ID NO: 65884 - RNA, 19 nt, Homo sapiens
agaauguacuguuaaggua

SEQ ID NO: 65885 - RNA, 19 nt, Homo sapiens
agacaagccuaccuucaaa

SEQ ID NO: 65886 - RNA, 19 nt, Homo sapiens
caagaaagaagacaaggaa

SEQ ID NO: 65887 - RNA, 19 nt, Homo sapiens
caagaaagauacgagauag

SEQ ID NO: 65888 - RNA, 19 nt, Homo sapiens
gaagagaagggaacuaaag

SEQ ID NO: 65889 - RNA, 19 nt, Homo sapiens
ccaagaaagauacgagaua

SEQ ID NO: 65890 - RNA, 19 nt, Homo sapiens
gcagaagaaugcaaaauga

SEQ ID NO: 65891 - RNA, 19 nt, Homo sapiens
gaaaagcaaucuguggaua

SEQ ID NO: 65892 - RNA, 19 nt, Homo sapiens
caagaaaccauucaagugu

SEQ ID NO: 65893 - RNA, 19 nt, Homo sapiens
gccagaagaugccagaaga

SEQ ID NO: 65894 - RNA, 19 nt, Homo sapiens
acaaagaacccaaagaaga

SEQ ID NO: 65895 - RNA, 19 nt, Homo sapiens
gagcgucgcagagaacuua

SEQ ID NO: 65896 - RNA, 19 nt, Homo sapiens
ugagacaguuccagaaaga

SEQ ID NO: 65897 - RNA, 19 nt, Homo sapiens
gcauacacauauacaaaca

SEQ ID NO: 65898 - RNA, 19 nt, Homo sapiens
auacagaagucauguuguu

SEQ ID NO: 65899 - RNA, 19 nt, Homo sapiens
ucccaaaccuucugacuug

SEQ ID NO: 65900 - RNA, 19 nt, Homo sapiens
guacgcaacaucaagagua

SEQ ID NO: 65901 - RNA, 19 nt, Homo sapiens
ggaaugacgaugaugaaga

SEQ ID NO: 65902 - RNA, 19 nt, Homo sapiens
gaacauuucaagaucauca

SEQ ID NO: 65903 - RNA, 19 nt, Homo sapiens
caaacacacuaaugguaga

SEQ ID NO: 65904 - RNA, 19 nt, Homo sapiens
gaaagucgccaagaaagau

SEQ ID NO: 65905 - RNA, 19 nt, Homo sapiens
guuagaaggaguugaaauu

SEQ ID NO: 65906 - RNA, 19 nt, Homo sapiens
gagauuagaacuguuagaa

SEQ ID NO: 65907 - RNA, 19 nt, Homo sapiens
aaacauggcagauagguau

SEQ ID NO: 65908 - RNA, 19 nt, Homo sapiens
gauagaagagcgagcagaa

SEQ ID NO: 65909 - RNA, 19 nt, Homo sapiens
gagaauucaugacccacaa

SEQ ID NO: 65910 - RNA, 19 nt, Homo sapiens
acagaaacauggcagauag

SEQ ID NO: 65911 - RNA, 19 nt, Homo sapiens
caucauaacucuguaucug

SEQ ID NO: 65912 - RNA, 19 nt, Homo sapiens
gaagaggaggcuaaaggaa

SEQ ID NO: 65913 - RNA, 19 nt, Homo sapiens
aagaagaaguuaagagcuu

SEQ ID NO: 65914 - RNA, 19 nt, Homo sapiens
gaacuuagaaggcaaaaga

SEQ ID NO: 65915 - RNA, 19 nt, Homo sapiens
uagccaauaucacagcuuu

SEQ ID NO: 65916 - RNA, 19 nt, Homo sapiens
cgagauagaggaaacagaa

SEQ ID NO: 65917 - RNA, 19 nt, Homo sapiens
gaaacauggcagauaggua

SEQ ID NO: 65918 - RNA, 19 nt, Homo sapiens
aaacccaugcugugaaaua

SEQ ID NO: 65919 - RNA, 19 nt, Homo sapiens
agaaacccaugcugugaaa

SEQ ID NO: 65920 - RNA, 19 nt, Homo sapiens
gaagguguacgcaacauca

SEQ ID NO: 65921 - RNA, 19 nt, Homo sapiens
ggaacuaaagugcaagcua

SEQ ID NO: 65922 - RNA, 19 nt, Homo sapiens
uaaaugcauucuugaaguc

SEQ ID NO: 65923 - RNA, 19 nt, Homo sapiens
agagagauuagaacuguua

SEQ ID NO: 65924 - RNA, 19 nt, Homo sapiens
guaacuagccaauaucaca

SEQ ID NO: 65925 - RNA, 19 nt, Homo sapiens
uagaagagcgagcagaauu

SEQ ID NO: 65926 - RNA, 19 nt, Homo sapiens
gggcuaauucgcucuguuu

SEQ ID NO: 65927 - RNA, 19 nt, Homo sapiens
ccuaaagguucaucucuca

SEQ ID NO: 65928 - RNA, 19 nt, Homo sapiens
ggaggaagccgaucgaaaa

SEQ ID NO: 65929 - RNA, 19 nt, Homo sapiens
gaucgaaagaagggauuua

SEQ ID NO: 65930 - RNA, 19 nt, Homo sapiens
gaacccaaagaagaaguua

SEQ ID NO: 65931 - RNA, 19 nt, Homo sapiens
gaguucgacccaacaauaa

SEQ ID NO: 65932 - RNA, 19 nt, Homo sapiens
ccagaaggcucagacaucu

SEQ ID NO: 65933 - RNA, 19 nt, Homo sapiens
gugcauacacauauacaaa

SEQ ID NO: 65934 - RNA, 19 nt, Homo sapiens
guggauuucuuuaguagug

SEQ ID NO: 65935 - RNA, 19 nt, Homo sapiens
cagaagauccaaguuuaaa

SEQ ID NO: 65936 - RNA, 19 nt, Homo sapiens
guccuuccuuuccgacuua

SEQ ID NO: 65937 - RNA, 19 nt, Homo sapiens
gaaagaacccaagcucaag

SEQ ID NO: 65938 - RNA, 19 nt, Homo sapiens
caaaccuucugacuugaga

SEQ ID NO: 65939 - RNA, 19 nt, Homo sapiens
gagaagaggaggcuaaagg

SEQ ID NO: 65940 - RNA, 19 nt, Homo sapiens
gaagaaguuucagacuaca

SEQ ID NO: 65941 - RNA, 19 nt, Homo sapiens
ccaaagcgagggagcauug

SEQ ID NO: 65942 - RNA, 19 nt, Homo sapiens
cagaaacagucaccaaguc

SEQ ID NO: 65943 - RNA, 19 nt, Homo sapiens
ucaaugaauggcuaacuaa

SEQ ID NO: 65944 - RNA, 19 nt, Homo sapiens
gacaagaaaccauucaagu

SEQ ID NO: 65945 - RNA, 19 nt, Homo sapiens
agaggaggcuaaaggaaga

SEQ ID NO: 65946 - RNA, 19 nt, Homo sapiens
aagaagggauuuacagaag

SEQ ID NO: 65947 - RNA, 19 nt, Homo sapiens
gauacgagauagaggaaac

SEQ ID NO: 65948 - RNA, 19 nt, Homo sapiens
cugaugaccuauaagaaga

SEQ ID NO: 65949 - RNA, 19 nt, Homo sapiens
aguaacccauuucagauuu

SEQ ID NO: 65950 - RNA, 19 nt, Homo sapiens
cagcaggcacaccaaauaa

SEQ ID NO: 65951 - RNA, 19 nt, Homo sapiens
ccagaggaaugacgaugau

SEQ ID NO: 65952 - RNA, 19 nt, Homo sapiens
gcaugcagcuugacgauug

SEQ ID NO: 65953 - RNA, 19 nt, Homo sapiens
gaagcugaauugcaggaua

SEQ ID NO: 65954 - RNA, 19 nt, Homo sapiens
gaucagagaagcagauauu

SEQ ID NO: 65955 - RNA, 19 nt, Homo sapiens
caaaggaacuuggaacugu

SEQ ID NO: 65956 - RNA, 19 nt, Homo sapiens
acuaacagaugaagaagua

SEQ ID NO: 65957 - RNA, 19 nt, Homo sapiens
ugucauagcugguuuacug

SEQ ID NO: 65958 - RNA, 19 nt, Homo sapiens
gaagaauucguacagauga

SEQ ID NO: 65959 - RNA, 19 nt, Homo sapiens
aagaacagauugcugaauu

SEQ ID NO: 65960 - RNA, 19 nt, Homo sapiens
ucaaauggguucuaguuca

SEQ ID NO: 65961 - RNA, 19 nt, Homo sapiens
agaaguagaugaaaugauc

SEQ ID NO: 65962 - RNA, 19 nt, Homo sapiens
caaauggguucuaguucaa

SEQ ID NO: 65963 - RNA, 19 nt, Homo sapiens
gcacaaccaucaacauugc

SEQ ID NO: 65964 - RNA, 19 nt, Homo sapiens
gaugaugacugcaaaauga

SEQ ID NO: 65965 - RNA, 19 nt, Homo sapiens
gcccguguauguugguuua

SEQ ID NO: 65966 - RNA, 19 nt, Homo sapiens
uagaugaaaugaucagaga

SEQ ID NO: 65967 - RNA, 19 nt, Homo sapiens
ugacuaugauggcuagaaa

SEQ ID NO: 65968 - RNA, 19 nt, Homo sapiens
gaacuuggaacugucauga

SEQ ID NO: 65969 - RNA, 19 nt, Homo sapiens
gcauuguucuagagugaaa

SEQ ID NO: 65970 - RNA, 19 nt, Homo sapiens
ugaaagauacagauaguga

SEQ ID NO: 65971 - RNA, 19 nt, Homo sapiens
caacuaugaagaauucgua

SEQ ID NO: 65972 - RNA, 19 nt, Homo sapiens
gaaagauacagauagugaa

SEQ ID NO: 65973 - RNA, 19 nt, Homo sapiens
cagucaggccuuuguauua

SEQ ID NO: 65974 - RNA, 19 nt, Homo sapiens
ggaugguccucuuguacuu

SEQ ID NO: 65975 - RNA, 19 nt, Homo sapiens
gaagaaguagaugaaauga

SEQ ID NO: 65976 - RNA, 19 nt, Homo sapiens
ugcaggauaugaucaauga

SEQ ID NO: 65977 - RNA, 19 nt, Homo sapiens
caacagaagcugaauugca

SEQ ID NO: 65978 - RNA, 19 nt, Homo sapiens
gaacagauugcugaauuca

SEQ ID NO: 65979 - RNA, 19 nt, Homo sapiens
ggucagaacccaacagaag

SEQ ID NO: 65980 - RNA, 19 nt, Homo sapiens
agucaggccuuuguauuaa

SEQ ID NO: 65981 - RNA, 19 nt, Homo sapiens
ugacaaggauggcaauggu

SEQ ID NO: 65982 - RNA, 19 nt, Homo sapiens
uuacguccauuccaaguug

SEQ ID NO: 65983 - RNA, 19 nt, Homo sapiens
gagcaucuuuggacucucu

SEQ ID NO: 65984 - RNA, 19 nt, Homo sapiens
ucacuguucacacaaauuu

SEQ ID NO: 65985 - RNA, 19 nt, Homo sapiens
agucaacuaugaagaauuc

SEQ ID NO: 65986 - RNA, 19 nt, Homo sapiens
caagucaacuaugaagaau

SEQ ID NO: 65987 - RNA, 19 nt, Homo sapiens
ggauggcaaugguuauauc

SEQ ID NO: 65988 - RNA, 19 nt, Homo sapiens
agauacagauagugaagaa

SEQ ID NO: 65989 - RNA, 19 nt, Homo sapiens
acagauugcugaauucaag

SEQ ID NO: 65990 - RNA, 19 nt, Homo sapiens
gcacagucaggccuuugua

SEQ ID NO: 65991 - RNA, 19 nt, Homo sapiens
guacagaugaugacugcaa

SEQ ID NO: 65992 - RNA, 19 nt, Homo sapiens
acaaggauggcaaugguua

SEQ ID NO: 65993 - RNA, 19 nt, Homo sapiens
cauagcugguuuacugaaa

SEQ ID NO: 65994 - RNA, 19 nt, Homo sapiens
ugaagaaguagaugaaaug

SEQ ID NO: 65995 - RNA, 19 nt, Homo sapiens
gaacccaacagaagcugaa

SEQ ID NO: 65996 - RNA, 19 nt, Homo sapiens
cagcacaaccaucaacauu

SEQ ID NO: 65997 - RNA, 19 nt, Homo sapiens
uuacuuaccucuugcaaaa

SEQ ID NO: 65998 - RNA, 19 nt, Homo sapiens
ggacaagucaacuaugaag

SEQ ID NO: 65999 - RNA, 19 nt, Homo sapiens
cugaucagcugaccgaaga

SEQ ID NO: 66000 - RNA, 19 nt, Homo sapiens
gguucuaguucaauuuguu

SEQ ID NO: 66001 - RNA, 19 nt, Homo sapiens
uguuugggcuggccaguuu

SEQ ID NO: 66002 - RNA, 19 nt, Homo sapiens
cacaaaaucugcauguauu

SEQ ID NO: 66003 - RNA, 19 nt, Homo sapiens
cagagaagcagauauugau

SEQ ID NO: 66004 - RNA, 19 nt, Homo sapiens
ucagagaagcagauauuga

SEQ ID NO: 66005 - RNA, 19 nt, Homo sapiens
aagcugaauugcaggauau

SEQ ID NO: 66006 - RNA, 19 nt, Homo sapiens
acggacaagucaacuauga

SEQ ID NO: 66007 - RNA, 19 nt, Homo sapiens
agaagcagauauugaugga

SEQ ID NO: 66008 - RNA, 19 nt, Homo sapiens
acauugcuguucaaagaaa

SEQ ID NO: 66009 - RNA, 19 nt, Homo sapiens
ugaaguggaugcugauggu

SEQ ID NO: 66010 - RNA, 19 nt, Homo sapiens
acaagucaacuaugaagaa

SEQ ID NO: 66011 - RNA, 19 nt, Homo sapiens
uaacagaugaagaaguaga

SEQ ID NO: 66012 - RNA, 19 nt, Homo sapiens
uaucagugcagcagaacua

SEQ ID NO: 66013 - RNA, 19 nt, Homo sapiens
gaagaccuacuuucaacuc

SEQ ID NO: 66014 - RNA, 19 nt, Homo sapiens
gaugaaaugaucagagaag

SEQ ID NO: 66015 - RNA, 19 nt, Homo sapiens
gaagaacagauugcugaau

SEQ ID NO: 66016 - RNA, 19 nt, Homo sapiens
gaccuacuuucaacuccuu

SEQ ID NO: 66017 - RNA, 19 nt, Homo sapiens
uaugaucaaugaaguggau

SEQ ID NO: 66018 - RNA, 19 nt, Homo sapiens
ugaagaauucguacagaug

SEQ ID NO: 66019 - RNA, 19 nt, Homo sapiens
agaaauccgugaggcauuc

SEQ ID NO: 66020 - RNA, 19 nt, Homo sapiens
gaauucguacagaugauga

SEQ ID NO: 66021 - RNA, 19 nt, Homo sapiens
gaugaagaaguagaugaaa

SEQ ID NO: 66022 - RNA, 19 nt, Homo sapiens
agaacagauugcugaauuc

SEQ ID NO: 66023 - RNA, 19 nt, Homo sapiens
ugaggucacugggucagaa

SEQ ID NO: 66024 - RNA, 19 nt, Homo sapiens
caguuuacguccauuccaa

SEQ ID NO: 66025 - RNA, 19 nt, Homo sapiens
gggagcaucuuuggacucu

SEQ ID NO: 66026 - RNA, 19 nt, Homo sapiens
guuuagcguugucugcauu

SEQ ID NO: 66027 - RNA, 19 nt, Homo sapiens
uaaauugucauagcugguu

SEQ ID NO: 66028 - RNA, 19 nt, Homo sapiens
gucaggccuuuguauuaaa

SEQ ID NO: 66029 - RNA, 19 nt, Homo sapiens
uaugaagaauucguacaga

SEQ ID NO: 66030 - RNA, 19 nt, Homo sapiens
uuauaucagugcagcagaa

SEQ ID NO: 66031 - RNA, 19 nt, Homo sapiens
cugcauuguucuagaguga

SEQ ID NO: 66032 - RNA, 19 nt, Homo sapiens
cuaaagaucaagcuacaca

SEQ ID NO: 66033 - RNA, 19 nt, Homo sapiens
uagcaaaacugaaugucaa

SEQ ID NO: 66034 - RNA, 19 nt, Homo sapiens
gaacugucaugaggucacu

SEQ ID NO: 66035 - RNA, 19 nt, Homo sapiens
gagacggacaagucaacua

SEQ ID NO: 66036 - RNA, 19 nt, Homo sapiens
caugacaaacuuaggagaa

SEQ ID NO: 66037 - RNA, 19 nt, Homo sapiens
uacagaugaugacugcaaa

SEQ ID NO: 66038 - RNA, 19 nt, Homo sapiens
gauggagacggacaaguca

SEQ ID NO: 66039 - RNA, 19 nt, Homo sapiens
gaaguagaugaaaugauca

SEQ ID NO: 66040 - RNA, 19 nt, Homo sapiens
ucacgucaugacaaacuua

SEQ ID NO: 66041 - RNA, 19 nt, Homo sapiens
uacagauagugaagaagaa

SEQ ID NO: 66042 - RNA, 19 nt, Homo sapiens
auacagauagugaagaaga

SEQ ID NO: 66043 - RNA, 19 nt, Homo sapiens
uuucaugcaugcagcuuga

SEQ ID NO: 66044 - RNA, 19 nt, Homo sapiens
aaaucugcauguauugguu

SEQ ID NO: 66045 - RNA, 19 nt, Homo sapiens
cagaugaagaaguagauga

SEQ ID NO: 66046 - RNA, 19 nt, Homo sapiens
gaaguggaugcugauggua

SEQ ID NO: 66047 - RNA, 19 nt, Homo sapiens
uggcaaugguuauaucagu

SEQ ID NO: 66048 - RNA, 19 nt, Homo sapiens
ccuucucccuauuugauaa

SEQ ID NO: 66049 - RNA, 19 nt, Homo sapiens
agacggacaagucaacuau

SEQ ID NO: 66050 - RNA, 19 nt, Homo sapiens
guuguaaaugcuagucuuu

SEQ ID NO: 66051 - RNA, 19 nt, Homo sapiens
gcugaccgaagaacagauu

SEQ ID NO: 66052 - RNA, 19 nt, Homo sapiens
ggacaugauuaaugaagua

SEQ ID NO: 66053 - RNA, 19 nt, Homo sapiens
ggagagaaguuaacagaug

SEQ ID NO: 66054 - RNA, 19 nt, Homo sapiens
gaaguuaacagaugaagaa

SEQ ID NO: 66055 - RNA, 19 nt, Homo sapiens
gugaagaccuuguacagaa

SEQ ID NO: 66056 - RNA, 19 nt, Homo sapiens
gagagaaguuaacagauga

SEQ ID NO: 66057 - RNA, 19 nt, Homo sapiens
ugaagaaguugaugaaaug

SEQ ID NO: 66058 - RNA, 19 nt, Homo sapiens
guuaacagaugaagaaguu

SEQ ID NO: 66059 - RNA, 19 nt, Homo sapiens
ugacaaagauggugaugga

SEQ ID NO: 66060 - RNA, 19 nt, Homo sapiens
ugacaaaccuuggagagaa

SEQ ID NO: 66061 - RNA, 19 nt, Homo sapiens
ugacaaugauggcaagaaa

SEQ ID NO: 66062 - RNA, 19 nt, Homo sapiens
gaacuucgccaugugauga

SEQ ID NO: 66063 - RNA, 19 nt, Homo sapiens
ggcaauggcuauauuagug

SEQ ID NO: 66064 - RNA, 19 nt, Homo sapiens
gcagauugcagaauucaaa

SEQ ID NO: 66065 - RNA, 19 nt, Homo sapiens
uacaggacaugauuaauga

SEQ ID NO: 66066 - RNA, 19 nt, Homo sapiens
gcaaagugaagaccuugua

SEQ ID NO: 66067 - RNA, 19 nt, Homo sapiens
ggauggcaauggcuauauu

SEQ ID NO: 66068 - RNA, 19 nt, Homo sapiens
ggacuucauuccuccaugu

SEQ ID NO: 66069 - RNA, 19 nt, Homo sapiens
gaaagacacagacagugaa

SEQ ID NO: 66070 - RNA, 19 nt, Homo sapiens
gaucagggaagcagauauu

SEQ ID NO: 66071 - RNA, 19 nt, Homo sapiens
ggaagcagauauugauggu

SEQ ID NO: 66072 - RNA, 19 nt, Homo sapiens
acaauugacuucccugaau

SEQ ID NO: 66073 - RNA, 19 nt, Homo sapiens
caaaauccauuccaaguug

SEQ ID NO: 66074 - RNA, 19 nt, Homo sapiens
ggacagucaacaauaugua

SEQ ID NO: 66075 - RNA, 19 nt, Homo sapiens
guugaaguguggaguugua

SEQ ID NO: 66076 - RNA, 19 nt, Homo sapiens
ugaaguagaugcugauggu

SEQ ID NO: 66077 - RNA, 19 nt, Homo sapiens
aagagcagauugcagaauu

SEQ ID NO: 66078 - RNA, 19 nt, Homo sapiens
gauggcaauggcuauauua

SEQ ID NO: 66079 - RNA, 19 nt, Homo sapiens
ugagggaacaucuggguua

SEQ ID NO: 66080 - RNA, 19 nt, Homo sapiens
caaguaaacuaugaagagu

SEQ ID NO: 66081 - RNA, 19 nt, Homo sapiens
ggaauugggaacuguaaug

SEQ ID NO: 66082 - RNA, 19 nt, Homo sapiens
caaaggaauugggaacugu

SEQ ID NO: 66083 - RNA, 19 nt, Homo sapiens
guacaaaugaugacagcaa

SEQ ID NO: 66084 - RNA, 19 nt, Homo sapiens
gaagaagaaauuagagaag

SEQ ID NO: 66085 - RNA, 19 nt, Homo sapiens
uauggacagucaacaauau

SEQ ID NO: 66086 - RNA, 19 nt, Homo sapiens
ugaaagacacagacaguga

SEQ ID NO: 66087 - RNA, 19 nt, Homo sapiens
ugacuucccugaauuucug

SEQ ID NO: 66088 - RNA, 19 nt, Homo sapiens
ugauggugauggucaagua

SEQ ID NO: 66089 - RNA, 19 nt, Homo sapiens
gcagaacuucgccauguga

SEQ ID NO: 66090 - RNA, 19 nt, Homo sapiens
gaauugggaacuguaauga

SEQ ID NO: 66091 - RNA, 19 nt, Homo sapiens
gaacuauaacaacaaagga

SEQ ID NO: 66092 - RNA, 19 nt, Homo sapiens
uaacagaugaagaaguuga

SEQ ID NO: 66093 - RNA, 19 nt, Homo sapiens
ugagaucucuugggcagaa

SEQ ID NO: 66094 - RNA, 19 nt, Homo sapiens
gaacuguaaugagaucucu

SEQ ID NO: 66095 - RNA, 19 nt, Homo sapiens
gcauguauaguaauuagga

SEQ ID NO: 66096 - RNA, 19 nt, Homo sapiens
cacagacagugaagaagaa

SEQ ID NO: 66097 - RNA, 19 nt, Homo sapiens
gggaacaucuggguuaugc

SEQ ID NO: 66098 - RNA, 19 nt, Homo sapiens
gagggaacaucuggguuau

SEQ ID NO: 66099 - RNA, 19 nt, Homo sapiens
caaagauggugauggaacu

SEQ ID NO: 66100 - RNA, 19 nt, Homo sapiens
gcauguuguuguugaagug

SEQ ID NO: 66101 - RNA, 19 nt, Homo sapiens
agauggaguuggucaaaug

SEQ ID NO: 66102 - RNA, 19 nt, Homo sapiens
uacaaaugaugacagcaaa

SEQ ID NO: 66103 - RNA, 19 nt, Homo sapiens
uuacaggacaugauuaaug

SEQ ID NO: 66104 - RNA, 19 nt, Homo sapiens
ugauggaacuauaacaaca

SEQ ID NO: 66105 - RNA, 19 nt, Homo sapiens
gaugguaauggcacaauug

SEQ ID NO: 66106 - RNA, 19 nt, Homo sapiens
gauggugauggaacuauaa

SEQ ID NO: 66107 - RNA, 19 nt, Homo sapiens
gaacugucagcauguuguu

SEQ ID NO: 66108 - RNA, 19 nt, Homo sapiens
aaagguuucucccuacugu

SEQ ID NO: 66109 - RNA, 19 nt, Homo sapiens
ugaagaccuuguacagaau

SEQ ID NO: 66110 - RNA, 19 nt, Homo sapiens
agaaguugaugaaaugauc

SEQ ID NO: 66111 - RNA, 19 nt, Homo sapiens
gaagaaguugaugaaauga

SEQ ID NO: 66112 - RNA, 19 nt, Homo sapiens
uauuagugcugcagaacuu

SEQ ID NO: 66113 - RNA, 19 nt, Homo sapiens
agacagugaagaagaaauu

SEQ ID NO: 66114 - RNA, 19 nt, Homo sapiens
agacacagacagugaagaa

SEQ ID NO: 66115 - RNA, 19 nt, Homo sapiens
gauugcagaauucaaagaa

SEQ ID NO: 66116 - RNA, 19 nt, Homo sapiens
gacaaaccuuggagagaag

SEQ ID NO: 66117 - RNA, 19 nt, Homo sapiens
agagaagcauuccgugugu

SEQ ID NO: 66118 - RNA, 19 nt, Homo sapiens
ggugauggaacuauaacaa

SEQ ID NO: 66119 - RNA, 19 nt, Homo sapiens
ggaacuauaacaacaaagg

SEQ ID NO: 66120 - RNA, 19 nt, Homo sapiens
ucaaguaaacuaugaagag

SEQ ID NO: 66121 - RNA, 19 nt, Homo sapiens
gagaagcauuccguguguu

SEQ ID NO: 66122 - RNA, 19 nt, Homo sapiens
gacagugaagaagaaauua

SEQ ID NO: 66123 - RNA, 19 nt, Homo sapiens
agauggugauggaacuaua

SEQ ID NO: 66124 - RNA, 19 nt, Homo sapiens
acacagacagugaagaaga

SEQ ID NO: 66125 - RNA, 19 nt, Homo sapiens
cuuaaaaguugcacuauug

SEQ ID NO: 66126 - RNA, 19 nt, Homo sapiens
gguaauggcacaauugacu

SEQ ID NO: 66127 - RNA, 19 nt, Homo sapiens
gaagagcagauugcagaau

SEQ ID NO: 66128 - RNA, 19 nt, Homo sapiens
gucagcauguuguuguuga

SEQ ID NO: 66129 - RNA, 19 nt, Homo sapiens
gaagaccuuguacagaaug

SEQ ID NO: 66130 - RNA, 19 nt, Homo sapiens
gaugaagaaguugaugaaa

SEQ ID NO: 66131 - RNA, 19 nt, Homo sapiens
cugcagaacuucgccaugu

SEQ ID NO: 66132 - RNA, 19 nt, Homo sapiens
ccacagaagcagaguuaca

SEQ ID NO: 66133 - RNA, 19 nt, Homo sapiens
gcauuccguguguuugaua

SEQ ID NO: 66134 - RNA, 19 nt, Homo sapiens
gaguuacaggacaugauua

SEQ ID NO: 66135 - RNA, 19 nt, Homo sapiens
uuacugucauuguccuaaa

SEQ ID NO: 66136 - RNA, 19 nt, Homo sapiens
gauggaacuauaacaacaa

SEQ ID NO: 66137 - RNA, 19 nt, Homo sapiens
agaagaaauuagagaagca

SEQ ID NO: 66138 - RNA, 19 nt, Homo sapiens
gaaguagaugcugauggua

SEQ ID NO: 66139 - RNA, 19 nt, Homo sapiens
ggaacugucagcauguugu

SEQ ID NO: 66140 - RNA, 19 nt, Homo sapiens
acaucuggguuaugccuuu

SEQ ID NO: 66141 - RNA, 19 nt, Homo sapiens
gauggaguuggucaaauga

SEQ ID NO: 66142 - RNA, 19 nt, Homo sapiens
ucccacagaagcagaguua

SEQ ID NO: 66143 - RNA, 19 nt, Homo sapiens
caaaugaugacagcaaagu

SEQ ID NO: 66144 - RNA, 19 nt, Homo sapiens
gauggugauggucaaguaa

SEQ ID NO: 66145 - RNA, 19 nt, Homo sapiens
auugggaacuguaaugaga

SEQ ID NO: 66146 - RNA, 19 nt, Homo sapiens
cuauggacagucaacaaua

SEQ ID NO: 66147 - RNA, 19 nt, Homo sapiens
ucuaagcccuucugcacau

SEQ ID NO: 66148 - RNA, 19 nt, Homo sapiens
guauaguaauuaggacuuc

SEQ ID NO: 66149 - RNA, 19 nt, Homo sapiens
gaugacagcaaagugaaga

SEQ ID NO: 66150 - RNA, 19 nt, Homo sapiens
acaaaggaauugggaacug

SEQ ID NO: 66151 - RNA, 19 nt, Homo sapiens
gaucaaguaacauguugca

SEQ ID NO: 66152 - RNA, 19 nt, Homo sapiens
gggagaagcugaccgauga

SEQ ID NO: 66153 - RNA, 19 nt, Homo sapiens
gaugaugacugcaaaguga

SEQ ID NO: 66154 - RNA, 19 nt, Homo sapiens
gagaaacgcaccugcaaua

SEQ ID NO: 66155 - RNA, 19 nt, Homo sapiens
gagauggccaggucaauua

SEQ ID NO: 66156 - RNA, 19 nt, Homo sapiens
ggucaauuaugaagaguuu

SEQ ID NO: 66157 - RNA, 19 nt, Homo sapiens
gaaacgcaccugcaauaaa

SEQ ID NO: 66158 - RNA, 19 nt, Homo sapiens
guaaauaccuggugcuaac

SEQ ID NO: 66159 - RNA, 19 nt, Homo sapiens
gcaauauuguguucaguuc

SEQ ID NO: 66160 - RNA, 19 nt, Homo sapiens
gauggucgcuuuguaaugu

SEQ ID NO: 66161 - RNA, 19 nt, Homo sapiens
ccucuuguuugucaucuua

SEQ ID NO: 66162 - RNA, 19 nt, Homo sapiens
gaacgggaccauugacuuc

SEQ ID NO: 66163 - RNA, 19 nt, Homo sapiens
guaaugugcugguucucuu

SEQ ID NO: 66164 - RNA, 19 nt, Homo sapiens
gucccaagcugcaugauug

SEQ ID NO: 66165 - RNA, 19 nt, Homo sapiens
caagagaggcauuccagaa

SEQ ID NO: 66166 - RNA, 19 nt, Homo sapiens
ugacugagaaucugauaaa

SEQ ID NO: 66167 - RNA, 19 nt, Homo sapiens
ggauggagauggcacuauc

SEQ ID NO: 66168 - RNA, 19 nt, Homo sapiens
cuauggcccuuaagacuuu

SEQ ID NO: 66169 - RNA, 19 nt, Homo sapiens
cagaagagcaugcccuuug

SEQ ID NO: 66170 - RNA, 19 nt, Homo sapiens
uagcaaacaccaauugauu

SEQ ID NO: 66171 - RNA, 19 nt, Homo sapiens
gaaagaugaaggacacaga

SEQ ID NO: 66172 - RNA, 19 nt, Homo sapiens
aaacgcaccugcaauaaaa

SEQ ID NO: 66173 - RNA, 19 nt, Homo sapiens
ggagauggccaggucaauu

SEQ ID NO: 66174 - RNA, 19 nt, Homo sapiens
ugcaggauaugaucaauga

SEQ ID NO: 66175 - RNA, 19 nt, Homo sapiens
gagaggcauuccagaagga

SEQ ID NO: 66176 - RNA, 19 nt, Homo sapiens
ccugaugcauucauaaguu

SEQ ID NO: 66177 - RNA, 19 nt, Homo sapiens
ggagguggaugagaugauc

SEQ ID NO: 66178 - RNA, 19 nt, Homo sapiens
ggacaaguaagucaaugug

SEQ ID NO: 66179 - RNA, 19 nt, Homo sapiens
guacagaugaugacugcaa

SEQ ID NO: 66180 - RNA, 19 nt, Homo sapiens
cugagaaucugauaaagca

SEQ ID NO: 66181 - RNA, 19 nt, Homo sapiens
ugaagaguuuguacagaug

SEQ ID NO: 66182 - RNA, 19 nt, Homo sapiens
guucugaaaccaucugauu

SEQ ID NO: 66183 - RNA, 19 nt, Homo sapiens
gaagaguuuguacagauga

SEQ ID NO: 66184 - RNA, 19 nt, Homo sapiens
gccaagagcugaggguaag

SEQ ID NO: 66185 - RNA, 19 nt, Homo sapiens
gcccuuaagacuuucauuu

SEQ ID NO: 66186 - RNA, 19 nt, Homo sapiens
gcaaccagcccugugauuc

SEQ ID NO: 66187 - RNA, 19 nt, Homo sapiens
cagggaggcugacaucgau

SEQ ID NO: 66188 - RNA, 19 nt, Homo sapiens
gcgugaggcuguggacauu

SEQ ID NO: 66189 - RNA, 19 nt, Homo sapiens
ggagcagauugcagaguuc

SEQ ID NO: 66190 - RNA, 19 nt, Homo sapiens
ccaggucaauuaugaagag

SEQ ID NO: 66191 - RNA, 19 nt, Homo sapiens
ggaacgggaccauugacuu

SEQ ID NO: 66192 - RNA, 19 nt, Homo sapiens
ccagggaacgggaccauug

SEQ ID NO: 66193 - RNA, 19 nt, Homo sapiens
gaaccaugcugggcuagcu

SEQ ID NO: 66194 - RNA, 19 nt, Homo sapiens
gcacuaucaccaccaagga

SEQ ID NO: 66195 - RNA, 19 nt, Homo sapiens
ugaaggacacagacaguga

SEQ ID NO: 66196 - RNA, 19 nt, Homo sapiens
uccaaggccugaugcauuc

SEQ ID NO: 66197 - RNA, 19 nt, Homo sapiens
caugauggccagaaagaug

SEQ ID NO: 66198 - RNA, 19 nt, Homo sapiens
ggaugcagaugaccuucca

SEQ ID NO: 66199 - RNA, 19 nt, Homo sapiens
ccauugacuucccggaguu

SEQ ID NO: 66200 - RNA, 19 nt, Homo sapiens
ggacagaaccccacugaag

SEQ ID NO: 66201 - RNA, 19 nt, Homo sapiens
uaugaagaguuuguacaga

SEQ ID NO: 66202 - RNA, 19 nt, Homo sapiens
cgagaggcguuccgugucu

SEQ ID NO: 66203 - RNA, 19 nt, Homo sapiens
aggagcagauugcagaguu

SEQ ID NO: 66204 - RNA, 19 nt, Homo sapiens
cucucgagcuguucuguaa

SEQ ID NO: 66205 - RNA, 19 nt, Homo sapiens
ggcgaugcccguucucuug

SEQ ID NO: 66206 - RNA, 19 nt, Homo sapiens
uacagaugaugacugcaaa

SEQ ID NO: 66207 - RNA, 19 nt, Homo sapiens
ugcccuugcuucugacuuu

SEQ ID NO: 66208 - RNA, 19 nt, Homo sapiens
gcagaagagcaugcccuuu

SEQ ID NO: 66209 - RNA, 19 nt, Homo sapiens
gcgaugcccguucucuuga

SEQ ID NO: 66210 - RNA, 19 nt, Homo sapiens
ggcaauauuguguucaguu

SEQ ID NO: 66211 - RNA, 19 nt, Homo sapiens
agaaacgcaccugcaauaa

SEQ ID NO: 66212 - RNA, 19 nt, Homo sapiens
caucugauuggcuuucuga

SEQ ID NO: 66213 - RNA, 19 nt, Homo sapiens
cugaugcauucauaaguug

SEQ ID NO: 66214 - RNA, 19 nt, Homo sapiens
augaagaguuuguacagau

SEQ ID NO: 66215 - RNA, 19 nt, Homo sapiens
ccgaugaggagguggauga

SEQ ID NO: 66216 - RNA, 19 nt, Homo sapiens
gaugaaggacacagacagu

SEQ ID NO: 66217 - RNA, 19 nt, Homo sapiens
gagcuguucuguaaauacc

SEQ ID NO: 66218 - RNA, 19 nt, Homo sapiens
gauuggcuuucugagguuu

SEQ ID NO: 66219 - RNA, 19 nt, Homo sapiens
gaccugcccagcuuugaga

SEQ ID NO: 66220 - RNA, 19 nt, Homo sapiens
gagcugcgucacguaauga

SEQ ID NO: 66221 - RNA, 19 nt, Homo sapiens
ggaauguuuugguuuuguu

SEQ ID NO: 66222 - RNA, 19 nt, Homo sapiens
ggauggucgcuuuguaaug

SEQ ID NO: 66223 - RNA, 19 nt, Homo sapiens
gaguuuguacagaugauga

SEQ ID NO: 66224 - RNA, 19 nt, Homo sapiens
agagcugcgucacguaaug

SEQ ID NO: 66225 - RNA, 19 nt, Homo sapiens
gcagauugcagaguucaag

SEQ ID NO: 66226 - RNA, 19 nt, Homo sapiens
gagaggcguuccgugucuu

SEQ ID NO: 66227 - RNA, 19 nt, Homo sapiens
uccgugcccuugcuucuga

SEQ ID NO: 66228 - RNA, 19 nt, Homo sapiens
gcuucuccguggugacuug

SEQ ID NO: 66229 - RNA, 19 nt, Homo sapiens
gggauggucgcuuuguaau

SEQ ID NO: 66230 - RNA, 19 nt, Homo sapiens
gguggggacugcucauuug

SEQ ID NO: 66231 - RNA, 19 nt, Homo sapiens
ucacugcccaggucgauca

SEQ ID NO: 66232 - RNA, 19 nt, Homo sapiens
ugauuggcuuucugagguu

SEQ ID NO: 66233 - RNA, 19 nt, Homo sapiens
gcugcaugauugcucuuuc

SEQ ID NO: 66234 - RNA, 19 nt, Homo sapiens
gugaggcuguggacauuuu

SEQ ID NO: 66235 - RNA, 19 nt, Homo sapiens
ccuuaagacuuucauuuug

SEQ ID NO: 66236 - RNA, 19 nt, Homo sapiens
ucgagcuguucuguaaaua

SEQ ID NO: 66237 - RNA, 19 nt, Homo sapiens
aaaccgggcaauauugugu

SEQ ID NO: 66238 - RNA, 19 nt, Homo sapiens
gagcugcaggauaugauca

SEQ ID NO: 66239 - RNA, 19 nt, Homo sapiens
caugcaaccagcccuguga

SEQ ID NO: 66240 - RNA, 19 nt, Homo sapiens
agaagagcaugcccuuugc

SEQ ID NO: 66241 - RNA, 19 nt, Homo sapiens
ugagguggaugcagaugac

SEQ ID NO: 66242 - RNA, 19 nt, Homo sapiens
gaugcccguucucuugauc

SEQ ID NO: 66243 - RNA, 19 nt, Homo sapiens
cggaguuccugaccaugau

SEQ ID NO: 66244 - RNA, 19 nt, Homo sapiens
augaggagguggaugagau

SEQ ID NO: 66245 - RNA, 19 nt, Homo sapiens
gauggagauggcacuauca

SEQ ID NO: 66246 - RNA, 19 nt, Homo sapiens
uaaugugcugguucucuuu

SEQ ID NO: 66247 - RNA, 19 nt, Homo sapiens
cucgagcuguucuguaaau

SEQ ID NO: 66248 - RNA, 19 nt, Homo sapiens
acuggcugcuguucugaaa

SEQ ID NO: 66249 - RNA, 19 nt, Homo sapiens
gaggaauuguggcguugac

SEQ ID NO: 66250 - RNA, 19 nt, Homo sapiens
cagggaacgggaccauuga

SEQ ID NO: 66251 - RNA, 19 nt, Homo sapiens
aaggccugaugcauucaua

SEQ ID NO: 66252 - RNA, 19 nt, Homo sapiens
gagacggacaggugaacua

SEQ ID NO: 66253 - RNA, 19 nt, Homo sapiens
aggagcaggucacagaauu

SEQ ID NO: 66254 - RNA, 19 nt, Homo sapiens
gcaggucacagaauucaag

SEQ ID NO: 66255 - RNA, 19 nt, Homo sapiens
gagcaggucacagaauuca

SEQ ID NO: 66256 - RNA, 19 nt, Homo sapiens
gagcugcgggacaugauga

SEQ ID NO: 66257 - RNA, 19 nt, Homo sapiens
ggacaacgaggaggagauc

SEQ ID NO: 66258 - RNA, 19 nt, Homo sapiens
ugaaggacacggacaacga

SEQ ID NO: 66259 - RNA, 19 nt, Homo sapiens
gagcugcgacacgucauga

SEQ ID NO: 66260 - RNA, 19 nt, Homo sapiens
acgaggagguggacgagau

SEQ ID NO: 66261 - RNA, 19 nt, Homo sapiens
ugcgggacaugaugaguga

SEQ ID NO: 66262 - RNA, 19 nt, Homo sapiens
ggagcaggucacagaauuc

SEQ ID NO: 66263 - RNA, 19 nt, Homo sapiens
gaggagcaggucacagaau

SEQ ID NO: 66264 - RNA, 19 nt, Homo sapiens
ggagguggacgagaugauc

SEQ ID NO: 66265 - RNA, 19 nt, Homo sapiens
gaggccuucucccuguuug

SEQ ID NO: 66266 - RNA, 19 nt, Homo sapiens
ggacaugaugagugagauc

SEQ ID NO: 66267 - RNA, 19 nt, Homo sapiens
acggacaggugaacuacga

SEQ ID NO: 66268 - RNA, 19 nt, Homo sapiens
cugaggagcaggucacaga

SEQ ID NO: 66269 - RNA, 19 nt, Homo sapiens
ggcaugauggccaggaaga

SEQ ID NO: 66270 - RNA, 19 nt, Homo sapiens
caugauggccaggaagaug

SEQ ID NO: 66271 - RNA, 19 nt, Homo sapiens
ggagaaagauaaagguuug

SEQ ID NO: 66272 - RNA, 19 nt, Homo sapiens
gugaagcuguuuccuaaua

SEQ ID NO: 66273 - RNA, 19 nt, Homo sapiens
ggacugggaugaagagaug

SEQ ID NO: 66274 - RNA, 19 nt, Homo sapiens
gcaagaacgugcugaucaa

SEQ ID NO: 66275 - RNA, 19 nt, Homo sapiens
gaacggggcucuucucauu

SEQ ID NO: 66276 - RNA, 19 nt, Homo sapiens
gcaaauucguucucaguuc

SEQ ID NO: 66277 - RNA, 19 nt, Homo sapiens
gauaaagguuugcagacaa

SEQ ID NO: 66278 - RNA, 19 nt, Homo sapiens
ggacaaagaugaggaugag

SEQ ID NO: 66279 - RNA, 19 nt, Homo sapiens
ccuaugaggugaagauuga

SEQ ID NO: 66280 - RNA, 19 nt, Homo sapiens
ggaggaagaugaggaggaa

SEQ ID NO: 66281 - RNA, 19 nt, Homo sapiens
ggaggaagaagacaagaaa

SEQ ID NO: 66282 - RNA, 19 nt, Homo sapiens
gcacggagacucagaauac

SEQ ID NO: 66283 - RNA, 19 nt, Homo sapiens
caagaagguucaugucauc

SEQ ID NO: 66284 - RNA, 19 nt, Homo sapiens
uaacaaaggcagcagagaa

SEQ ID NO: 66285 - RNA, 19 nt, Homo sapiens
ggcauacgcugaggaguuu

SEQ ID NO: 66286 - RNA, 19 nt, Homo sapiens
ccacaggccugagauuuca

SEQ ID NO: 66287 - RNA, 19 nt, Homo sapiens
uugcaaggaugaugaguuu

SEQ ID NO: 66288 - RNA, 19 nt, Homo sapiens
gauaaaggauccugaugcu

SEQ ID NO: 66289 - RNA, 19 nt, Homo sapiens
ccaaacacaagucagauuu

SEQ ID NO: 66290 - RNA, 19 nt, Homo sapiens
agaaacaaaugaaggacaa

SEQ ID NO: 66291 - RNA, 19 nt, Homo sapiens
ccaagaagguucaugucau

SEQ ID NO: 66292 - RNA, 19 nt, Homo sapiens
ggaggaugaugaggacaaa

SEQ ID NO: 66293 - RNA, 19 nt, Homo sapiens
guucucaucuuucuugauc

SEQ ID NO: 66294 - RNA, 19 nt, Homo sapiens
ccaaauaaugucucuguga

SEQ ID NO: 66295 - RNA, 19 nt, Homo sapiens
gcauaucccugacccugau

SEQ ID NO: 66296 - RNA, 19 nt, Homo sapiens
gggacaagcccgagcauau

SEQ ID NO: 66297 - RNA, 19 nt, Homo sapiens
gaagauaaaggauccugau

SEQ ID NO: 66298 - RNA, 19 nt, Homo sapiens
gauuucaucugcucuccuu

SEQ ID NO: 66299 - RNA, 19 nt, Homo sapiens
gcaccaagaagguucaugu

SEQ ID NO: 66300 - RNA, 19 nt, Homo sapiens
gaagcuguuuccuaauagu

SEQ ID NO: 66301 - RNA, 19 nt, Homo sapiens
gaucgaauccaaacacaag

SEQ ID NO: 66302 - RNA, 19 nt, Homo sapiens
gcaaggaugaugaguuuac

SEQ ID NO: 66303 - RNA, 19 nt, Homo sapiens
ggccagacaacaccuauga

SEQ ID NO: 66304 - RNA, 19 nt, Homo sapiens
agaacgugcugaucaacaa

SEQ ID NO: 66305 - RNA, 19 nt, Homo sapiens
ggacaagcccgagcauauc

SEQ ID NO: 66306 - RNA, 19 nt, Homo sapiens
gcaccaucuuugacaacuu

SEQ ID NO: 66307 - RNA, 19 nt, Homo sapiens
ggacaaggaggaagaugag

SEQ ID NO: 66308 - RNA, 19 nt, Homo sapiens
ggacaaggaggaugaugag

SEQ ID NO: 66309 - RNA, 19 nt, Homo sapiens
cagcagagaaacaaaugaa

SEQ ID NO: 66310 - RNA, 19 nt, Homo sapiens
ggcaagaacgugcugauca

SEQ ID NO: 66311 - RNA, 19 nt, Homo sapiens
caugucaucuucaacuaca

SEQ ID NO: 66312 - RNA, 19 nt, Homo sapiens
gcuguuuccuaauaguuug

SEQ ID NO: 66313 - RNA, 19 nt, Homo sapiens
augugaagcuguuuccuaa

SEQ ID NO: 66314 - RNA, 19 nt, Homo sapiens
gaggagaaagauaaagguu

SEQ ID NO: 66315 - RNA, 19 nt, Homo sapiens
gugacgaggagaaagauaa

SEQ ID NO: 66316 - RNA, 19 nt, Homo sapiens
ccagauuggcucacacuga

SEQ ID NO: 66317 - RNA, 19 nt, Homo sapiens
cuaugccuaugauaacuuu

SEQ ID NO: 66318 - RNA, 19 nt, Homo sapiens
acacaccuguacacacuga

SEQ ID NO: 66319 - RNA, 19 nt, Homo sapiens
caccaucuuugacaacuuc

SEQ ID NO: 66320 - RNA, 19 nt, Homo sapiens
gcagaucgacaacccagau

SEQ ID NO: 66321 - RNA, 19 nt, Homo sapiens
cgacaacccagauuacaag

SEQ ID NO: 66322 - RNA, 19 nt, Homo sapiens
aaaggauccugaugcuuca

SEQ ID NO: 66323 - RNA, 19 nt, Homo sapiens
cagagaaacaaaugaagga

SEQ ID NO: 66324 - RNA, 19 nt, Homo sapiens
uuugacaacuuccucauca

SEQ ID NO: 66325 - RNA, 19 nt, Homo sapiens
caaggaugaugaguuuaca

SEQ ID NO: 66326 - RNA, 19 nt, Homo sapiens
ugaagcuguuuccuaauag

SEQ ID NO: 66327 - RNA, 19 nt, Homo sapiens
agauaaagguuugcagaca

SEQ ID NO: 66328 - RNA, 19 nt, Homo sapiens
gaaacaaaugaaggacaaa

SEQ ID NO: 66329 - RNA, 19 nt, Homo sapiens
gcggcuaugugaagcuguu

SEQ ID NO: 66330 - RNA, 19 nt, Homo sapiens
gaagacaagaaacgcaaag

SEQ ID NO: 66331 - RNA, 19 nt, Homo sapiens
gacgaggagcagaggcuua

SEQ ID NO: 66332 - RNA, 19 nt, Homo sapiens
ccccuucucucaucucuua

SEQ ID NO: 66333 - RNA, 19 nt, Homo sapiens
gacucgagaacuuucauuu

SEQ ID NO: 66334 - RNA, 19 nt, Homo sapiens
cagaggacaaggaggauga

SEQ ID NO: 66335 - RNA, 19 nt, Homo sapiens
uuaaggaggaggaagaaga

SEQ ID NO: 66336 - RNA, 19 nt, Homo sapiens
caaaggcagcagagaaaca

SEQ ID NO: 66337 - RNA, 19 nt, Homo sapiens
aacaaaggcagcagagaaa

SEQ ID NO: 66338 - RNA, 19 nt, Homo sapiens
ugacgaggagaaagauaaa

SEQ ID NO: 66339 - RNA, 19 nt, Homo sapiens
acaaggacauccguugcaa

SEQ ID NO: 66340 - RNA, 19 nt, Homo sapiens
ucucaucuuucuugaucaa

SEQ ID NO: 66341 - RNA, 19 nt, Homo sapiens
gcagcagagaaacaaauga

SEQ ID NO: 66342 - RNA, 19 nt, Homo sapiens
ucaccaacgaugaggcaua

SEQ ID NO: 66343 - RNA, 19 nt, Homo sapiens
ggauccacccagaaauuga

SEQ ID NO: 66344 - RNA, 19 nt, Homo sapiens
uaugugaagcuguuuccua

SEQ ID NO: 66345 - RNA, 19 nt, Homo sapiens
ggugaaacaugagcagaac

SEQ ID NO: 66346 - RNA, 19 nt, Homo sapiens
ggaggaggaagaagacaag

SEQ ID NO: 66347 - RNA, 19 nt, Homo sapiens
caguaucuaugccuaugau

SEQ ID NO: 66348 - RNA, 19 nt, Homo sapiens
gaucgacaacccagauuac

SEQ ID NO: 66349 - RNA, 19 nt, Homo sapiens
aaacacaagucagauuuug

SEQ ID NO: 66350 - RNA, 19 nt, Homo sapiens
acaacuuccucaucaccaa

SEQ ID NO: 66351 - RNA, 19 nt, Homo sapiens
gaagaugaggaggaagaug

SEQ ID NO: 66352 - RNA, 19 nt, Homo sapiens
ucccugacccugaugcuaa

SEQ ID NO: 66353 - RNA, 19 nt, Homo sapiens
agacaugcacggagacuca

SEQ ID NO: 66354 - RNA, 19 nt, Homo sapiens
gccacaggccugagauuuc

SEQ ID NO: 66355 - RNA, 19 nt, Homo sapiens
gaugaugaggacaaagaug

SEQ ID NO: 66356 - RNA, 19 nt, Homo sapiens
auaaagguuugcagacaag

SEQ ID NO: 66357 - RNA, 19 nt, Homo sapiens
caagucuggcaccaucuuu

SEQ ID NO: 66358 - RNA, 19 nt, Homo sapiens
caccaacgaugaggcauac

SEQ ID NO: 66359 - RNA, 19 nt, Homo sapiens
ggcaaauucguucucaguu

SEQ ID NO: 66360 - RNA, 19 nt, Homo sapiens
gggcagugguguggagaag

SEQ ID NO: 66361 - RNA, 19 nt, Homo sapiens
gaagagauggacggagagu

SEQ ID NO: 66362 - RNA, 19 nt, Homo sapiens
ggucccagauuggcucaca

SEQ ID NO: 66363 - RNA, 19 nt, Homo sapiens
aagaugaggaggaagaugu

SEQ ID NO: 66364 - RNA, 19 nt, Homo sapiens
agacgcugguggugcaguu

SEQ ID NO: 66365 - RNA, 19 nt, Homo sapiens
aaaggcagcagagaaacaa

SEQ ID NO: 66366 - RNA, 19 nt, Homo sapiens
ugaaacaugagcagaacau

SEQ ID NO: 66367 - RNA, 19 nt, Homo sapiens
agaucgacaacccagauua

SEQ ID NO: 66368 - RNA, 19 nt, Homo sapiens
acacugagaauguaagaac

SEQ ID NO: 66369 - RNA, 19 nt, Homo sapiens
ggugacgaggagaaagaua

SEQ ID NO: 66370 - RNA, 19 nt, Homo sapiens
caucuuucuugaucaacau

SEQ ID NO: 66371 - RNA, 19 nt, Homo sapiens
gaagaccagugauaauuua

SEQ ID NO: 66372 - RNA, 19 nt, Homo sapiens
gaaccuagguauauccuuu

SEQ ID NO: 66373 - RNA, 19 nt, Homo sapiens
gaacaacucuaauuaguac

SEQ ID NO: 66374 - RNA, 19 nt, Homo sapiens
cgaaagaaauggucacuga

SEQ ID NO: 66375 - RNA, 19 nt, Homo sapiens
gauaguggauauacucuuu

SEQ ID NO: 66376 - RNA, 19 nt, Homo sapiens
uaagaaacccugagauuaa

SEQ ID NO: 66377 - RNA, 19 nt, Homo sapiens
gaggaaagaucuaauuauc

SEQ ID NO: 66378 - RNA, 19 nt, Homo sapiens
guaccuaucuguuucuaaa

SEQ ID NO: 66379 - RNA, 19 nt, Homo sapiens
caacuccacuuuacccaua

SEQ ID NO: 66380 - RNA, 19 nt, Homo sapiens
ggaaaggcuuggaaagauu

SEQ ID NO: 66381 - RNA, 19 nt, Homo sapiens
gcagagagcccaggccuua

SEQ ID NO: 66382 - RNA, 19 nt, Homo sapiens
ggugcugggugauuuauua

SEQ ID NO: 66383 - RNA, 19 nt, Homo sapiens
ggagaucguugacaaguau

SEQ ID NO: 66384 - RNA, 19 nt, Homo sapiens
ggaaagagcuaaagaaacc

SEQ ID NO: 66385 - RNA, 19 nt, Homo sapiens
aaagagagauguggaaaga

SEQ ID NO: 66386 - RNA, 19 nt, Homo sapiens
cauuagcucuuuacucuuu

SEQ ID NO: 66387 - RNA, 19 nt, Homo sapiens
agacaaacauuagcucuuu

SEQ ID NO: 66388 - RNA, 19 nt, Homo sapiens
ggaacaacucuaauuagua

SEQ ID NO: 66389 - RNA, 19 nt, Homo sapiens
gcccaggccuuauguuaaa

SEQ ID NO: 66390 - RNA, 19 nt, Homo sapiens
ggaaacaauggaagauaua

SEQ ID NO: 66391 - RNA, 19 nt, Homo sapiens
gaaaaucaaucaaguagug

SEQ ID NO: 66392 - RNA, 19 nt, Homo sapiens
gacaaacauuagcucuuua

SEQ ID NO: 66393 - RNA, 19 nt, Homo sapiens
caacaggguuucaguccuu

SEQ ID NO: 66394 - RNA, 19 nt, Homo sapiens
aaacaaggauggcaagcuu

SEQ ID NO: 66395 - RNA, 19 nt, Homo sapiens
gagagcaguuuguugaguu

SEQ ID NO: 66396 - RNA, 19 nt, Homo sapiens
uaagaaugcugaugguuuc

SEQ ID NO: 66397 - RNA, 19 nt, Homo sapiens
gagaugagcggagguuuaa

SEQ ID NO: 66398 - RNA, 19 nt, Homo sapiens
gaaugaucccuuugaaauu

SEQ ID NO: 66399 - RNA, 19 nt, Homo sapiens
gagcccaggccuuauguua

SEQ ID NO: 66400 - RNA, 19 nt, Homo sapiens
gagagaacacuuagucuug

SEQ ID NO: 66401 - RNA, 19 nt, Homo sapiens
ugaggaacaacucuaauua

SEQ ID NO: 66402 - RNA, 19 nt, Homo sapiens
ucauugaucuagaagagua

SEQ ID NO: 66403 - RNA, 19 nt, Homo sapiens
gaggugggcucccugguau

SEQ ID NO: 66404 - RNA, 19 nt, Homo sapiens
cauauuguguguucuguga

SEQ ID NO: 66405 - RNA, 19 nt, Homo sapiens
aaggaaacguuuaucauga

SEQ ID NO: 66406 - RNA, 19 nt, Homo sapiens
caucuugaaugaucccuuu

SEQ ID NO: 66407 - RNA, 19 nt, Homo sapiens
uuaagaaacccugagauua

SEQ ID NO: 66408 - RNA, 19 nt, Homo sapiens
gcucaaagacuggauuaaa

SEQ ID NO: 66409 - RNA, 19 nt, Homo sapiens
gcaguguucuuaucuugug

SEQ ID NO: 66410 - RNA, 19 nt, Homo sapiens
ucacaaugcaaaccacuua

SEQ ID NO: 66411 - RNA, 19 nt, Homo sapiens
agaaacagcuggaaaacua

SEQ ID NO: 66412 - RNA, 19 nt, Homo sapiens
gaacccucauuuccucaaa

SEQ ID NO: 66413 - RNA, 19 nt, Homo sapiens
cagaauggguaaagacaga

SEQ ID NO: 66414 - RNA, 19 nt, Homo sapiens
ugaaugaucccuuugaaau

SEQ ID NO: 66415 - RNA, 19 nt, Homo sapiens
caauauaggguaauggaaa

SEQ ID NO: 66416 - RNA, 19 nt, Homo sapiens
gaaaugcucaagacuuaau

SEQ ID NO: 66417 - RNA, 19 nt, Homo sapiens
aaagccagguauaauguaa

SEQ ID NO: 66418 - RNA, 19 nt, Homo sapiens
ggaaacguuuaucaugaau

SEQ ID NO: 66419 - RNA, 19 nt, Homo sapiens
caacugaaccugccauuac

SEQ ID NO: 66420 - RNA, 19 nt, Homo sapiens
caacauuucauagguagua

SEQ ID NO: 66421 - RNA, 19 nt, Homo sapiens
gaccugcgacaguuucuua

SEQ ID NO: 66422 - RNA, 19 nt, Homo sapiens
ggaguaugacuacaugaaa

SEQ ID NO: 66423 - RNA, 19 nt, Homo sapiens
cagguuaccaagauaaaua

SEQ ID NO: 66424 - RNA, 19 nt, Homo sapiens
acaaugaugcucagaguuu

SEQ ID NO: 66425 - RNA, 19 nt, Homo sapiens
aagaaacccugagauuaaa

SEQ ID NO: 66426 - RNA, 19 nt, Homo sapiens
gaaagaaauggucacugaa

SEQ ID NO: 66427 - RNA, 19 nt, Homo sapiens
uagugaaugugaucucuuu

SEQ ID NO: 66428 - RNA, 19 nt, Homo sapiens
guucugagcugcggaggaa

SEQ ID NO: 66429 - RNA, 19 nt, Homo sapiens
gcacaaaagcgcuggauuu

SEQ ID NO: 66430 - RNA, 19 nt, Homo sapiens
gaaggaccguguacaucau

SEQ ID NO: 66431 - RNA, 19 nt, Homo sapiens
gaaaggcuuggaaagauug

SEQ ID NO: 66432 - RNA, 19 nt, Homo sapiens
gacagcagcaagcauuaua

SEQ ID NO: 66433 - RNA, 19 nt, Homo sapiens
ugacaagguucacaaugau

SEQ ID NO: 66434 - RNA, 19 nt, Homo sapiens
ccucauaccucacaaugca

SEQ ID NO: 66435 - RNA, 19 nt, Homo sapiens
ggacaauaguuaaauuagc

SEQ ID NO: 66436 - RNA, 19 nt, Homo sapiens
gcaacugaaccugccauua

SEQ ID NO: 66437 - RNA, 19 nt, Homo sapiens
gaaauuguuugcgcuacug

SEQ ID NO: 66438 - RNA, 19 nt, Homo sapiens
ucaaucaaguagugaaugu

SEQ ID NO: 66439 - RNA, 19 nt, Homo sapiens
ucacacauguagacaaaca

SEQ ID NO: 66440 - RNA, 19 nt, Homo sapiens
gagcucaaagacuggauua

SEQ ID NO: 66441 - RNA, 19 nt, Homo sapiens
gaccauggcuuaccuuucc

SEQ ID NO: 66442 - RNA, 19 nt, Homo sapiens
ccuagaaccucccaguaga

SEQ ID NO: 66443 - RNA, 19 nt, Homo sapiens
aacauuagcucuuuacucu

SEQ ID NO: 66444 - RNA, 19 nt, Homo sapiens
gcagccaggccacagauuu

SEQ ID NO: 66445 - RNA, 19 nt, Homo sapiens
uaaaauagauggcgacaag

SEQ ID NO: 66446 - RNA, 19 nt, Homo sapiens
gaaccgugaugggaagaug

SEQ ID NO: 66447 - RNA, 19 nt, Homo sapiens
gcugaugguuucauugauc

SEQ ID NO: 66448 - RNA, 19 nt, Homo sapiens
guccaacauuucauaggua

SEQ ID NO: 66449 - RNA, 19 nt, Homo sapiens
guaagccugagaucaauaa

SEQ ID NO: 66450 - RNA, 19 nt, Homo sapiens
gaguaugacuacaugaaag

SEQ ID NO: 66451 - RNA, 19 nt, Homo sapiens
auaaacagaugaugguuag

SEQ ID NO: 66452 - RNA, 19 nt, Homo sapiens
ugcuagcucucuugaauuu

SEQ ID NO: 66453 - RNA, 19 nt, Homo sapiens
aaugcuagcucucuugaau

SEQ ID NO: 66454 - RNA, 19 nt, Homo sapiens
uuaagaagaccagugauaa

SEQ ID NO: 66455 - RNA, 19 nt, Homo sapiens
guggaaagagcuaaagaaa

SEQ ID NO: 66456 - RNA, 19 nt, Homo sapiens
agccugagaucaauaagaa

SEQ ID NO: 66457 - RNA, 19 nt, Homo sapiens
ucacaaugaugcucagagu

SEQ ID NO: 66458 - RNA, 19 nt, Homo sapiens
gcacagccuuugccuugag

SEQ ID NO: 66459 - RNA, 19 nt, Homo sapiens
gcaccuggucuaugaauca

SEQ ID NO: 66460 - RNA, 19 nt, Homo sapiens
ggacaaggaagagaccaaa

SEQ ID NO: 66461 - RNA, 19 nt, Homo sapiens
gagcggagguuuaaaaugg

SEQ ID NO: 66462 - RNA, 19 nt, Homo sapiens
cucaaagacuggauuaaau

SEQ ID NO: 66463 - RNA, 19 nt, Homo sapiens
aaagacagcagcaagcauu

SEQ ID NO: 66464 - RNA, 19 nt, Homo sapiens
aaaggaaacguuuaucaug

SEQ ID NO: 66465 - RNA, 19 nt, Homo sapiens
gaauuaaucuugguuucac

SEQ ID NO: 66466 - RNA, 19 nt, Homo sapiens
ggaauuaaucuugguuuca

SEQ ID NO: 66467 - RNA, 19 nt, Homo sapiens
ccacauauuacauucaguu

SEQ ID NO: 66468 - RNA, 19 nt, Homo sapiens
acucacacauguagacaaa

SEQ ID NO: 66469 - RNA, 19 nt, Homo sapiens
gaauacugaugagccagaa

SEQ ID NO: 66470 - RNA, 19 nt, Homo sapiens
gaucuagaagaguauauug

SEQ ID NO: 66471 - RNA, 19 nt, Homo sapiens
gcacauauuugaagugaau

SEQ ID NO: 66472 - RNA, 19 nt, Homo sapiens
uaacacaacguaacacuua

SEQ ID NO: 66473 - RNA, 19 nt, Homo sapiens
gaggagaacuguuugauag

SEQ ID NO: 66474 - RNA, 19 nt, Homo sapiens
gcaugugacugcuuuauga

SEQ ID NO: 66475 - RNA, 19 nt, Homo sapiens
gaugauaguuguacauaug

SEQ ID NO: 66476 - RNA, 19 nt, Homo sapiens
cuaaacagcuuccuucaga

SEQ ID NO: 66477 - RNA, 19 nt, Homo sapiens
gaugaaguaucucuaaaug

SEQ ID NO: 66478 - RNA, 19 nt, Homo sapiens
caugaaagcuauuccagaa

SEQ ID NO: 66479 - RNA, 19 nt, Homo sapiens
uaaaggccaugaagccaua

SEQ ID NO: 66480 - RNA, 19 nt, Homo sapiens
gaacaucaagugcucauga

SEQ ID NO: 66481 - RNA, 19 nt, Homo sapiens
agaaacggcugacuacauu

SEQ ID NO: 66482 - RNA, 19 nt, Homo sapiens
caucuuacuuuguggauuu

SEQ ID NO: 66483 - RNA, 19 nt, Homo sapiens
cauguggucuguaggaaua

SEQ ID NO: 66484 - RNA, 19 nt, Homo sapiens
acaaggagaugcuuauaga

SEQ ID NO: 66485 - RNA, 19 nt, Homo sapiens
gguaagaaauugaaguauc

SEQ ID NO: 66486 - RNA, 19 nt, Homo sapiens
aaaagaagcuccaagaauu

SEQ ID NO: 66487 - RNA, 19 nt, Homo sapiens
ggaggcaguugcuuaucua

SEQ ID NO: 66488 - RNA, 19 nt, Homo sapiens
uaaaagacauguucccaua

SEQ ID NO: 66489 - RNA, 19 nt, Homo sapiens
gcagaugccguuaaacaaa

SEQ ID NO: 66490 - RNA, 19 nt, Homo sapiens
gaagccauaugucccuaaa

SEQ ID NO: 66491 - RNA, 19 nt, Homo sapiens
guacugcgcaccugaaauu

SEQ ID NO: 66492 - RNA, 19 nt, Homo sapiens
ggaggagaacuguuugaua

SEQ ID NO: 66493 - RNA, 19 nt, Homo sapiens
gcuuauagaugauaguugu

SEQ ID NO: 66494 - RNA, 19 nt, Homo sapiens
caagaaagguguggaagca

SEQ ID NO: 66495 - RNA, 19 nt, Homo sapiens
ggagaacuguuugauagga

SEQ ID NO: 66496 - RNA, 19 nt, Homo sapiens
gaaccauucuaugaugaaa

SEQ ID NO: 66497 - RNA, 19 nt, Homo sapiens
ggaagcaugauauguacua

SEQ ID NO: 66498 - RNA, 19 nt, Homo sapiens
aguuaaaggugcagauaua

SEQ ID NO: 66499 - RNA, 19 nt, Homo sapiens
ccaaagaaacggcugacua

SEQ ID NO: 66500 - RNA, 19 nt, Homo sapiens
gggaugaaguaucucuaaa

SEQ ID NO: 66501 - RNA, 19 nt, Homo sapiens
gauuugaaccauucuauga

SEQ ID NO: 66502 - RNA, 19 nt, Homo sapiens
ggaauaaucaccuacaucu

SEQ ID NO: 66503 - RNA, 19 nt, Homo sapiens
ugaaagaggcgaucaguuc

SEQ ID NO: 66504 - RNA, 19 nt, Homo sapiens
cguaagaacugagauagga

SEQ ID NO: 66505 - RNA, 19 nt, Homo sapiens
caaugcaugugacugcuuu

SEQ ID NO: 66506 - RNA, 19 nt, Homo sapiens
gaacuacugcuuagcuaau

SEQ ID NO: 66507 - RNA, 19 nt, Homo sapiens
caugauauguacuauagug

SEQ ID NO: 66508 - RNA, 19 nt, Homo sapiens
ggcagcagcucccagagaa

SEQ ID NO: 66509 - RNA, 19 nt, Homo sapiens
ucaccuacaucuuacuuug

SEQ ID NO: 66510 - RNA, 19 nt, Homo sapiens
gaaagaggcgaucaguuca

SEQ ID NO: 66511 - RNA, 19 nt, Homo sapiens
ggugcaagccuuagagaaa

SEQ ID NO: 66512 - RNA, 19 nt, Homo sapiens
aggagaagcugaagacugu

SEQ ID NO: 66513 - RNA, 19 nt, Homo sapiens
gaaagcuauuccagaagga

SEQ ID NO: 66514 - RNA, 19 nt, Homo sapiens
gcgaagaugcucaaaguca

SEQ ID NO: 66515 - RNA, 19 nt, Homo sapiens
guaagaaauugaaguaucc

SEQ ID NO: 66516 - RNA, 19 nt, Homo sapiens
ugucuucuauggcauguaa

SEQ ID NO: 66517 - RNA, 19 nt, Homo sapiens
gacauguucccauaacuuu

SEQ ID NO: 66518 - RNA, 19 nt, Homo sapiens
ugaguuaaaucuugcaagu

SEQ ID NO: 66519 - RNA, 19 nt, Homo sapiens
guacuauagugauucuguu

SEQ ID NO: 66520 - RNA, 19 nt, Homo sapiens
ggacauguggucuguagga

SEQ ID NO: 66521 - RNA, 19 nt, Homo sapiens
gaagccuuaugcucucaaa

SEQ ID NO: 66522 - RNA, 19 nt, Homo sapiens
gaagugaauaguagcaaau

SEQ ID NO: 66523 - RNA, 19 nt, Homo sapiens
ugaagugaauaguagcaaa

SEQ ID NO: 66524 - RNA, 19 nt, Homo sapiens
caaccaguggcacauauuu

SEQ ID NO: 66525 - RNA, 19 nt, Homo sapiens
gaaagguguggaagcauga

SEQ ID NO: 66526 - RNA, 19 nt, Homo sapiens
caaagaaacggcugacuac

SEQ ID NO: 66527 - RNA, 19 nt, Homo sapiens
ggacuuggucagaaaauua

SEQ ID NO: 66528 - RNA, 19 nt, Homo sapiens
cagaugccguuaaacaaau

SEQ ID NO: 66529 - RNA, 19 nt, Homo sapiens
ggagaugcuuauagaugau

SEQ ID NO: 66530 - RNA, 19 nt, Homo sapiens
aggagaugcuuauagauga

SEQ ID NO: 66531 - RNA, 19 nt, Homo sapiens
gcaguugcuuaucuacaug

SEQ ID NO: 66532 - RNA, 19 nt, Homo sapiens
ccucucacauccaaacauu

SEQ ID NO: 66533 - RNA, 19 nt, Homo sapiens
gaagcaugauauguacuau

SEQ ID NO: 66534 - RNA, 19 nt, Homo sapiens
gaagcucugcuguggguuu

SEQ ID NO: 66535 - RNA, 19 nt, Homo sapiens
ggaugaaguaucucuaaau

SEQ ID NO: 66536 - RNA, 19 nt, Homo sapiens
gagauaggaguucuucuuc

SEQ ID NO: 66537 - RNA, 19 nt, Homo sapiens
guguacagaugcaaacaga

SEQ ID NO: 66538 - RNA, 19 nt, Homo sapiens
gcaaguuaacacaacguaa

SEQ ID NO: 66539 - RNA, 19 nt, Homo sapiens
agaaaucagucugguccua

SEQ ID NO: 66540 - RNA, 19 nt, Homo sapiens
uguaauggauaccuaauac

SEQ ID NO: 66541 - RNA, 19 nt, Homo sapiens
uggcugaccuggaacuaga

SEQ ID NO: 66542 - RNA, 19 nt, Homo sapiens
ggcaguugcuuaucuacau

SEQ ID NO: 66543 - RNA, 19 nt, Homo sapiens
gagaacuguuugauaggau

SEQ ID NO: 66544 - RNA, 19 nt, Homo sapiens
guacagaugcaaacagaag

SEQ ID NO: 66545 - RNA, 19 nt, Homo sapiens
gaugugauccugccagagu

SEQ ID NO: 66546 - RNA, 19 nt, Homo sapiens
gaaguuccacagcaagaug

SEQ ID NO: 66547 - RNA, 19 nt, Homo sapiens
agauauaaaugcugaagag

SEQ ID NO: 66548 - RNA, 19 nt, Homo sapiens
aggcugagcugaugaaggu

SEQ ID NO: 66549 - RNA, 19 nt, Homo sapiens
cugcgaagaugcucaaagu

SEQ ID NO: 66550 - RNA, 19 nt, Homo sapiens
ggugcuacauccauugugu

SEQ ID NO: 66551 - RNA, 19 nt, Homo sapiens
gcauguaauggauaccuaa

SEQ ID NO: 66552 - RNA, 19 nt, Homo sapiens
uguggaagcaugauaugua

SEQ ID NO: 66553 - RNA, 19 nt, Homo sapiens
ccagaguacuaaacagcuu

SEQ ID NO: 66554 - RNA, 19 nt, Homo sapiens
cagguaaagcagccaauuu

SEQ ID NO: 66555 - RNA, 19 nt, Homo sapiens
ucuuagagguugugccuau

SEQ ID NO: 66556 - RNA, 19 nt, Homo sapiens
aaagacauguucccauaac

SEQ ID NO: 66557 - RNA, 19 nt, Homo sapiens
uggcacauauuugaaguga

SEQ ID NO: 66558 - RNA, 19 nt, Homo sapiens
gcaaccaguggcacauauu

SEQ ID NO: 66559 - RNA, 19 nt, Homo sapiens
gcucucaaaguguuaaaga

SEQ ID NO: 66560 - RNA, 19 nt, Homo sapiens
gaaacggcugacuacauuu

SEQ ID NO: 66561 - RNA, 19 nt, Homo sapiens
gaauaaucaccuacaucuu

SEQ ID NO: 66562 - RNA, 19 nt, Homo sapiens
caucaagugcucaugaaga

SEQ ID NO: 66563 - RNA, 19 nt, Homo sapiens
ugagauaggaguucuucuu

SEQ ID NO: 66564 - RNA, 19 nt, Homo sapiens
ggcauguaauggauaccua

SEQ ID NO: 66565 - RNA, 19 nt, Homo sapiens
guuaaaggugcagauauaa

SEQ ID NO: 66566 - RNA, 19 nt, Homo sapiens
aaaguuaaaggugcagaua

SEQ ID NO: 66567 - RNA, 19 nt, Homo sapiens
gugaauaguagcaaauugu

SEQ ID NO: 66568 - RNA, 19 nt, Homo sapiens
agcaugauauguacuauag

SEQ ID NO: 66569 - RNA, 19 nt, Homo sapiens
gugcaagccuuagagaaag

SEQ ID NO: 66570 - RNA, 19 nt, Homo sapiens
acacauggauaccgcucaa

SEQ ID NO: 66571 - RNA, 19 nt, Homo sapiens
ccagagggcuucccaguaa

SEQ ID NO: 66572 - RNA, 19 nt, Homo sapiens
uaacuagacuucucagauu

SEQ ID NO: 66573 - RNA, 19 nt, Homo sapiens
gaacacugcucaaacuuuc

SEQ ID NO: 66574 - RNA, 19 nt, Homo sapiens
gagcagaacuggugaggau

SEQ ID NO: 66575 - RNA, 19 nt, Homo sapiens
ggacuuccaucgauucuau

SEQ ID NO: 66576 - RNA, 19 nt, Homo sapiens
gcaaagcacugggaauuuc

SEQ ID NO: 66577 - RNA, 19 nt, Homo sapiens
gaagagcgauggugugaag

SEQ ID NO: 66578 - RNA, 19 nt, Homo sapiens
ucaguucccucauugguua

SEQ ID NO: 66579 - RNA, 19 nt, Homo sapiens
gcaaacgucuggcuaugug

SEQ ID NO: 66580 - RNA, 19 nt, Homo sapiens
gcucaaacuuucugcuauu

SEQ ID NO: 66581 - RNA, 19 nt, Homo sapiens
ggacuccuguuuacuucua

SEQ ID NO: 66582 - RNA, 19 nt, Homo sapiens
gaaagcaacguuuagguau

SEQ ID NO: 66583 - RNA, 19 nt, Homo sapiens
gagagggaaucuaauuguu

SEQ ID NO: 66584 - RNA, 19 nt, Homo sapiens
ugacagagcagcugauuga

SEQ ID NO: 66585 - RNA, 19 nt, Homo sapiens
gaccagacuugcuguguga

SEQ ID NO: 66586 - RNA, 19 nt, Homo sapiens
aauaagaugcugaccauua

SEQ ID NO: 66587 - RNA, 19 nt, Homo sapiens
caaguuccuuucccucuuu

SEQ ID NO: 66588 - RNA, 19 nt, Homo sapiens
auaagaugcugaccauuaa

SEQ ID NO: 66589 - RNA, 19 nt, Homo sapiens
ggaguaugcugccaagauc

SEQ ID NO: 66590 - RNA, 19 nt, Homo sapiens
cgucaucccuggagaauuc

SEQ ID NO: 66591 - RNA, 19 nt, Homo sapiens
gaaguccaccuccaacauu

SEQ ID NO: 66592 - RNA, 19 nt, Homo sapiens
gaagaaaacacucaacaaa

SEQ ID NO: 66593 - RNA, 19 nt, Homo sapiens
gcggaaacaggaaauuaua

SEQ ID NO: 66594 - RNA, 19 nt, Homo sapiens
ggaaagagcagugauuugg

SEQ ID NO: 66595 - RNA, 19 nt, Homo sapiens
ucaauaagaugcugaccau

SEQ ID NO: 66596 - RNA, 19 nt, Homo sapiens
ccaagaucaucaacacaaa

SEQ ID NO: 66597 - RNA, 19 nt, Homo sapiens
gcaaguuccuuucccucuu

SEQ ID NO: 66598 - RNA, 19 nt, Homo sapiens
ggaauucucccaugucauc

SEQ ID NO: 66599 - RNA, 19 nt, Homo sapiens
gagcaaacgucuggcuaug

SEQ ID NO: 66600 - RNA, 19 nt, Homo sapiens
gauguuugauccgagauuu

SEQ ID NO: 66601 - RNA, 19 nt, Homo sapiens
gcagcugauugaagccaua

SEQ ID NO: 66602 - RNA, 19 nt, Homo sapiens
ggacaccacuaccugaucu

SEQ ID NO: 66603 - RNA, 19 nt, Homo sapiens
gagguuguauucucagugu

SEQ ID NO: 66604 - RNA, 19 nt, Homo sapiens
ccacuaggaucuacugucu

SEQ ID NO: 66605 - RNA, 19 nt, Homo sapiens
ggucuucucuaccgaacuu

SEQ ID NO: 66606 - RNA, 19 nt, Homo sapiens
gcugugaacuugaaugaac

SEQ ID NO: 66607 - RNA, 19 nt, Homo sapiens
aaaguguucuccuggguuu

SEQ ID NO: 66608 - RNA, 19 nt, Homo sapiens
gauuucaucucaccauauc

SEQ ID NO: 66609 - RNA, 19 nt, Homo sapiens
gaacuggugaggauguuug

SEQ ID NO: 66610 - RNA, 19 nt, Homo sapiens
ucgcguuaauggauauuua

SEQ ID NO: 66611 - RNA, 19 nt, Homo sapiens
caaaagaaagcaacguuua

SEQ ID NO: 66612 - RNA, 19 nt, Homo sapiens
gagcgauggugugaagaaa

SEQ ID NO: 66613 - RNA, 19 nt, Homo sapiens
gauuucgcguuaauggaua

SEQ ID NO: 66614 - RNA, 19 nt, Homo sapiens
ggaacuguuugaagauauc

SEQ ID NO: 66615 - RNA, 19 nt, Homo sapiens
agaaagcaacguuuaggua

SEQ ID NO: 66616 - RNA, 19 nt, Homo sapiens
gagggaaucuaauuguuuu

SEQ ID NO: 66617 - RNA, 19 nt, Homo sapiens
ucagagagggaaucuaauu

SEQ ID NO: 66618 - RNA, 19 nt, Homo sapiens
aaccuuggcuccagcauga

SEQ ID NO: 66619 - RNA, 19 nt, Homo sapiens
gaacuggcagggauaguca

SEQ ID NO: 66620 - RNA, 19 nt, Homo sapiens
ucuacugucugcacuguuu

SEQ ID NO: 66621 - RNA, 19 nt, Homo sapiens
cagcaaagcacugggaauu

SEQ ID NO: 66622 - RNA, 19 nt, Homo sapiens
gaguggagcugcugguucu

SEQ ID NO: 66623 - RNA, 19 nt, Homo sapiens
cagugaagcuggcagacuu

SEQ ID NO: 66624 - RNA, 19 nt, Homo sapiens
gggaacuguuugaagauau

SEQ ID NO: 66625 - RNA, 19 nt, Homo sapiens
cgugcugguuucuuuguua

SEQ ID NO: 66626 - RNA, 19 nt, Homo sapiens
uaauuuaccugcaggaacu

SEQ ID NO: 66627 - RNA, 19 nt, Homo sapiens
gcuaugugaagccuaauuu

SEQ ID NO: 66628 - RNA, 19 nt, Homo sapiens
gaacuucccaggauuucau

SEQ ID NO: 66629 - RNA, 19 nt, Homo sapiens
aacuagacuucucagauua

SEQ ID NO: 66630 - RNA, 19 nt, Homo sapiens
gcugguuucuuuguuacua

SEQ ID NO: 66631 - RNA, 19 nt, Homo sapiens
gaauuccagcuuugucgua

SEQ ID NO: 66632 - RNA, 19 nt, Homo sapiens
cauaagcaauggagauuuu

SEQ ID NO: 66633 - RNA, 19 nt, Homo sapiens
uuaauggaauccucagaga

SEQ ID NO: 66634 - RNA, 19 nt, Homo sapiens
ucagugcaauaaauagcua

SEQ ID NO: 66635 - RNA, 19 nt, Homo sapiens
gaagaaggggcguuuguuu

SEQ ID NO: 66636 - RNA, 19 nt, Homo sapiens
gaucuacugucugcacugu

SEQ ID NO: 66637 - RNA, 19 nt, Homo sapiens
ggagggaggcugucaggau

SEQ ID NO: 66638 - RNA, 19 nt, Homo sapiens
ucccagaccucuccucuuc

SEQ ID NO: 66639 - RNA, 19 nt, Homo sapiens
gcacaccaccauccugaau

SEQ ID NO: 66640 - RNA, 19 nt, Homo sapiens
ccuccugucucccuucaaa

SEQ ID NO: 66641 - RNA, 19 nt, Homo sapiens
gguguugguuggagcagaa

SEQ ID NO: 66642 - RNA, 19 nt, Homo sapiens
cuaccgaacuucccaggau

SEQ ID NO: 66643 - RNA, 19 nt, Homo sapiens
aaguccaccuccaacauua

SEQ ID NO: 66644 - RNA, 19 nt, Homo sapiens
ggaugaagacaccaaagug

SEQ ID NO: 66645 - RNA, 19 nt, Homo sapiens
cagaagugcugcggaagga

SEQ ID NO: 66646 - RNA, 19 nt, Homo sapiens
ggcaaguggucccuagguu

SEQ ID NO: 66647 - RNA, 19 nt, Homo sapiens
gcaggaacuggcagggaua

SEQ ID NO: 66648 - RNA, 19 nt, Homo sapiens
guccaucacuggccucugu

SEQ ID NO: 66649 - RNA, 19 nt, Homo sapiens
uagccaaauuucuguguau

SEQ ID NO: 66650 - RNA, 19 nt, Homo sapiens
gugcggaaacaggaaauua

SEQ ID NO: 66651 - RNA, 19 nt, Homo sapiens
caacaucguccgacuacau

SEQ ID NO: 66652 - RNA, 19 nt, Homo sapiens
gaaacugaagggagccauu

SEQ ID NO: 66653 - RNA, 19 nt, Homo sapiens
ugaaugaacacugcucaaa

SEQ ID NO: 66654 - RNA, 19 nt, Homo sapiens
gggaugaguuugccagacu

SEQ ID NO: 66655 - RNA, 19 nt, Homo sapiens
ggagcaaacgucuggcuau

SEQ ID NO: 66656 - RNA, 19 nt, Homo sapiens
gagcgugugucuucauugc

SEQ ID NO: 66657 - RNA, 19 nt, Homo sapiens
gccaagaucaucaacacaa

SEQ ID NO: 66658 - RNA, 19 nt, Homo sapiens
guaauaacuagacuucuca

SEQ ID NO: 66659 - RNA, 19 nt, Homo sapiens
gguaucacuucuacuugga

SEQ ID NO: 66660 - RNA, 19 nt, Homo sapiens
caaaaccaaucuacauguu

SEQ ID NO: 66661 - RNA, 19 nt, Homo sapiens
gaucguccacuuccacaga

SEQ ID NO: 66662 - RNA, 19 nt, Homo sapiens
gcaggcaugguuuggguuu

SEQ ID NO: 66663 - RNA, 19 nt, Homo sapiens
ugaacacugcucaaacuuu

SEQ ID NO: 66664 - RNA, 19 nt, Homo sapiens
cagccucaguucccucauu

SEQ ID NO: 66665 - RNA, 19 nt, Homo sapiens
uuuccaagcugguccauca

SEQ ID NO: 66666 - RNA, 19 nt, Homo sapiens
gcugucugcuggguucuuu

SEQ ID NO: 66667 - RNA, 19 nt, Homo sapiens
uggaauaccuuggcacauc

SEQ ID NO: 66668 - RNA, 19 nt, Homo sapiens
ggauuucgcguuaauggau

SEQ ID NO: 66669 - RNA, 19 nt, Homo sapiens
agagggaaucuaauuguuu

SEQ ID NO: 66670 - RNA, 19 nt, Homo sapiens
gaaugaacacugcucaaac

SEQ ID NO: 66671 - RNA, 19 nt, Homo sapiens
ccagagggcuucccaguaa

SEQ ID NO: 66672 - RNA, 19 nt, Homo sapiens
uaacuagacuucucagauu

SEQ ID NO: 66673 - RNA, 19 nt, Homo sapiens
gaacacugcucaaacuuuc

SEQ ID NO: 66674 - RNA, 19 nt, Homo sapiens
gagcagaacuggugaggau

SEQ ID NO: 66675 - RNA, 19 nt, Homo sapiens
ggacuuccaucgauucuau

SEQ ID NO: 66676 - RNA, 19 nt, Homo sapiens
gcaaagcacugggaauuuc

SEQ ID NO: 66677 - RNA, 19 nt, Homo sapiens
gaagagcgauggugugaag

SEQ ID NO: 66678 - RNA, 19 nt, Homo sapiens
ucaguucccucauugguua

SEQ ID NO: 66679 - RNA, 19 nt, Homo sapiens
gcaaacgucuggcuaugug

SEQ ID NO: 66680 - RNA, 19 nt, Homo sapiens
gcucaaacuuucugcuauu

SEQ ID NO: 66681 - RNA, 19 nt, Homo sapiens
ggacuccuguuuacuucua

SEQ ID NO: 66682 - RNA, 19 nt, Homo sapiens
gaaagcaacguuuagguau

SEQ ID NO: 66683 - RNA, 19 nt, Homo sapiens
gagagggaaucuaauuguu

SEQ ID NO: 66684 - RNA, 19 nt, Homo sapiens
ugacagagcagcugauuga

SEQ ID NO: 66685 - RNA, 19 nt, Homo sapiens
gaccagacuugcuguguga

SEQ ID NO: 66686 - RNA, 19 nt, Homo sapiens
aauaagaugcugaccauua

SEQ ID NO: 66687 - RNA, 19 nt, Homo sapiens
caaguuccuuucccucuuu

SEQ ID NO: 66688 - RNA, 19 nt, Homo sapiens
auaagaugcugaccauuaa

SEQ ID NO: 66689 - RNA, 19 nt, Homo sapiens
ggaguaugcugccaagauc

SEQ ID NO: 66690 - RNA, 19 nt, Homo sapiens
cgucaucccuggagaauuc

SEQ ID NO: 66691 - RNA, 19 nt, Homo sapiens
gaaguccaccuccaacauu

SEQ ID NO: 66692 - RNA, 19 nt, Homo sapiens
gaagaaaacacucaacaaa

SEQ ID NO: 66693 - RNA, 19 nt, Homo sapiens
gcggaaacaggaaauuaua

SEQ ID NO: 66694 - RNA, 19 nt, Homo sapiens
ggaaagagcagugauuugg

SEQ ID NO: 66695 - RNA, 19 nt, Homo sapiens
ucaauaagaugcugaccau

SEQ ID NO: 66696 - RNA, 19 nt, Homo sapiens
ccaagaucaucaacacaaa

SEQ ID NO: 66697 - RNA, 19 nt, Homo sapiens
gcaaguuccuuucccucuu

SEQ ID NO: 66698 - RNA, 19 nt, Homo sapiens
ggaauucucccaugucauc

SEQ ID NO: 66699 - RNA, 19 nt, Homo sapiens
gagcaaacgucuggcuaug

SEQ ID NO: 66700 - RNA, 19 nt, Homo sapiens
gauguuugauccgagauuu

SEQ ID NO: 66701 - RNA, 19 nt, Homo sapiens
gcagcugauugaagccaua

SEQ ID NO: 66702 - RNA, 19 nt, Homo sapiens
ggacaccacuaccugaucu

SEQ ID NO: 66703 - RNA, 19 nt, Homo sapiens
gagguuguauucucagugu

SEQ ID NO: 66704 - RNA, 19 nt, Homo sapiens
ccacuaggaucuacugucu

SEQ ID NO: 66705 - RNA, 19 nt, Homo sapiens
ggucuucucuaccgaacuu

SEQ ID NO: 66706 - RNA, 19 nt, Homo sapiens
gcugugaacuugaaugaac

SEQ ID NO: 66707 - RNA, 19 nt, Homo sapiens
aaaguguucuccuggguuu

SEQ ID NO: 66708 - RNA, 19 nt, Homo sapiens
gauuucaucucaccauauc

SEQ ID NO: 66709 - RNA, 19 nt, Homo sapiens
gaacuggugaggauguuug

SEQ ID NO: 66710 - RNA, 19 nt, Homo sapiens
ucgcguuaauggauauuua

SEQ ID NO: 66711 - RNA, 19 nt, Homo sapiens
caaaagaaagcaacguuua

SEQ ID NO: 66712 - RNA, 19 nt, Homo sapiens
gauuucgcguuaauggaua

SEQ ID NO: 66713 - RNA, 19 nt, Homo sapiens
ggaacuguuugaagauauc

SEQ ID NO: 66714 - RNA, 19 nt, Homo sapiens
agaaagcaacguuuaggua

SEQ ID NO: 66715 - RNA, 19 nt, Homo sapiens
gagggaaucuaauuguuuu

SEQ ID NO: 66716 - RNA, 19 nt, Homo sapiens
ucagagagggaaucuaauu

SEQ ID NO: 66717 - RNA, 19 nt, Homo sapiens
aaccuuggcuccagcauga

SEQ ID NO: 66718 - RNA, 19 nt, Homo sapiens
gaacuggcagggauaguca

SEQ ID NO: 66719 - RNA, 19 nt, Homo sapiens
ucuacugucugcacuguuu

SEQ ID NO: 66720 - RNA, 19 nt, Homo sapiens
cagcaaagcacugggaauu

SEQ ID NO: 66721 - RNA, 19 nt, Homo sapiens
gaguggagcugcugguucu

SEQ ID NO: 66722 - RNA, 19 nt, Homo sapiens
cagugaagcuggcagacuu

SEQ ID NO: 66723 - RNA, 19 nt, Homo sapiens
gggaacuguuugaagauau

SEQ ID NO: 66724 - RNA, 19 nt, Homo sapiens
cgugcugguuucuuuguua

SEQ ID NO: 66725 - RNA, 19 nt, Homo sapiens
uaauuuaccugcaggaacu

SEQ ID NO: 66726 - RNA, 19 nt, Homo sapiens
gcuaugugaagccuaauuu

SEQ ID NO: 66727 - RNA, 19 nt, Homo sapiens
gaacuucccaggauuucau

SEQ ID NO: 66728 - RNA, 19 nt, Homo sapiens
aacuagacuucucagauua

SEQ ID NO: 66729 - RNA, 19 nt, Homo sapiens
gcugguuucuuuguuacua

SEQ ID NO: 66730 - RNA, 19 nt, Homo sapiens
gaauuccagcuuugucgua

SEQ ID NO: 66731 - RNA, 19 nt, Homo sapiens
cauaagcaauggagauuuu

SEQ ID NO: 66732 - RNA, 19 nt, Homo sapiens
ucagugcaauaaauagcua

SEQ ID NO: 66733 - RNA, 19 nt, Homo sapiens
gaagaaggggcguuuguuu

SEQ ID NO: 66734 - RNA, 19 nt, Homo sapiens
gaucuacugucugcacugu

SEQ ID NO: 66735 - RNA, 19 nt, Homo sapiens
ggagggaggcugucaggau

SEQ ID NO: 66736 - RNA, 19 nt, Homo sapiens
ucccagaccucuccucuuc

SEQ ID NO: 66737 - RNA, 19 nt, Homo sapiens
gcacaccaccauccugaau

SEQ ID NO: 66738 - RNA, 19 nt, Homo sapiens
ccuccugucucccuucaaa

SEQ ID NO: 66739 - RNA, 19 nt, Homo sapiens
gguguugguuggagcagaa

SEQ ID NO: 66740 - RNA, 19 nt, Homo sapiens
cuaccgaacuucccaggau

SEQ ID NO: 66741 - RNA, 19 nt, Homo sapiens
aaguccaccuccaacauua

SEQ ID NO: 66742 - RNA, 19 nt, Homo sapiens
ggaugaagacaccaaagug

SEQ ID NO: 66743 - RNA, 19 nt, Homo sapiens
gcgauggugugaaggaauc

SEQ ID NO: 66744 - RNA, 19 nt, Homo sapiens
cagaagugcugcggaagga

SEQ ID NO: 66745 - RNA, 19 nt, Homo sapiens
caacaucguccgacuacau

SEQ ID NO: 66746 - RNA, 19 nt, Homo sapiens
ggcaaguggucccuagguu

SEQ ID NO: 66747 - RNA, 19 nt, Homo sapiens
gcaggaacuggcagggaua

SEQ ID NO: 66748 - RNA, 19 nt, Homo sapiens
guccaucacuggccucugu

SEQ ID NO: 66749 - RNA, 19 nt, Homo sapiens
uagccaaauuucuguguau

SEQ ID NO: 66750 - RNA, 19 nt, Homo sapiens
gugcggaaacaggaaauua

SEQ ID NO: 66751 - RNA, 19 nt, Homo sapiens
gagcgauggugugaaggaa

SEQ ID NO: 66752 - RNA, 19 nt, Homo sapiens
gaaacugaagggagccauu

SEQ ID NO: 66753 - RNA, 19 nt, Homo sapiens
ugaaugaacacugcucaaa

SEQ ID NO: 66754 - RNA, 19 nt, Homo sapiens
gggaugaguuugccagacu

SEQ ID NO: 66755 - RNA, 19 nt, Homo sapiens
ggagcaaacgucuggcuau

SEQ ID NO: 66756 - RNA, 19 nt, Homo sapiens
gagcgugugucuucauugc

SEQ ID NO: 66757 - RNA, 19 nt, Homo sapiens
gccaagaucaucaacacaa

SEQ ID NO: 66758 - RNA, 19 nt, Homo sapiens
guaauaacuagacuucuca

SEQ ID NO: 66759 - RNA, 19 nt, Homo sapiens
gguaucacuucuacuugga

SEQ ID NO: 66760 - RNA, 19 nt, Homo sapiens
caaaaccaaucuacauguu

SEQ ID NO: 66761 - RNA, 19 nt, Homo sapiens
gaucguccacuuccacaga

SEQ ID NO: 66762 - RNA, 19 nt, Homo sapiens
gcaggcaugguuuggguuu

SEQ ID NO: 66763 - RNA, 19 nt, Homo sapiens
ugaacacugcucaaacuuu

SEQ ID NO: 66764 - RNA, 19 nt, Homo sapiens
cagccucaguucccucauu

SEQ ID NO: 66765 - RNA, 19 nt, Homo sapiens
uuuccaagcugguccauca

SEQ ID NO: 66766 - RNA, 19 nt, Homo sapiens
gcugucugcuggguucuuu

SEQ ID NO: 66767 - RNA, 19 nt, Homo sapiens
uggaauaccuuggcacauc

SEQ ID NO: 66768 - RNA, 19 nt, Homo sapiens
ggauuucgcguuaauggau

SEQ ID NO: 66769 - RNA, 19 nt, Homo sapiens
agagggaaucuaauuguuu

SEQ ID NO: 66770 - RNA, 19 nt, Homo sapiens
gaaugaacacugcucaaac

SEQ ID NO: 66771 - RNA, 19 nt, Homo sapiens
gaccagaugugauuuguua

SEQ ID NO: 66772 - RNA, 19 nt, Homo sapiens
gaaagcagauggagucaag

SEQ ID NO: 66773 - RNA, 19 nt, Homo sapiens
ggacagaguugguguuugg

SEQ ID NO: 66774 - RNA, 19 nt, Homo sapiens
ggaagcaggagaucauuaa

SEQ ID NO: 66775 - RNA, 19 nt, Homo sapiens
ggaacaagccaagaguuua

SEQ ID NO: 66776 - RNA, 19 nt, Homo sapiens
caacaacggugacuuugag

SEQ ID NO: 66777 - RNA, 19 nt, Homo sapiens
aaaccaccgucauccauaa

SEQ ID NO: 66778 - RNA, 19 nt, Homo sapiens
ggauuaaggagucuucuga

SEQ ID NO: 66779 - RNA, 19 nt, Homo sapiens
uaaggagucuucugacagu

SEQ ID NO: 66780 - RNA, 19 nt, Homo sapiens
gaacaagccaagaguuuac

SEQ ID NO: 66781 - RNA, 19 nt, Homo sapiens
gaagagcugcgcccugguu

SEQ ID NO: 66782 - RNA, 19 nt, Homo sapiens
cagcaggcaugguuugguu

SEQ ID NO: 66783 - RNA, 19 nt, Homo sapiens
gcacgucauuggagaggau

SEQ ID NO: 66784 - RNA, 19 nt, Homo sapiens
caaaccaccgucauccaua

SEQ ID NO: 66785 - RNA, 19 nt, Homo sapiens
cagugaagcuggcagacuu

SEQ ID NO: 66786 - RNA, 19 nt, Homo sapiens
ccagaugugauuuguuaaa

SEQ ID NO: 66787 - RNA, 19 nt, Homo sapiens
ggacggagcgagcagaucu

SEQ ID NO: 66788 - RNA, 19 nt, Homo sapiens
caacaagaaagcagaugga

SEQ ID NO: 66789 - RNA, 19 nt, Homo sapiens
gcaagccuguggacaucug

SEQ ID NO: 66790 - RNA, 19 nt, Homo sapiens
ccaagaucaucaacaccaa

SEQ ID NO: 66791 - RNA, 19 nt, Homo sapiens
caaaggggcugcagugaag

SEQ ID NO: 66792 - RNA, 19 nt, Homo sapiens
ccagacgaauagcaccaaa

SEQ ID NO: 66793 - RNA, 19 nt, Homo sapiens
ugacgacgacaaccacaaa

SEQ ID NO: 66794 - RNA, 19 nt, Homo sapiens
aacaagaccagaugugauu

SEQ ID NO: 66795 - RNA, 19 nt, Homo sapiens
uggaacaagccaagaguuu

SEQ ID NO: 66796 - RNA, 19 nt, Homo sapiens
caagaccagaugugauuug

SEQ ID NO: 66797 - RNA, 19 nt, Homo sapiens
agaaccugcuggccaagaa

SEQ ID NO: 66798 - RNA, 19 nt, Homo sapiens
uaccagcucuacgaggaua

SEQ ID NO: 66799 - RNA, 19 nt, Homo sapiens
acccagggcugaccucguu

SEQ ID NO: 66800 - RNA, 19 nt, Homo sapiens
cggaagcaggagaucauua

SEQ ID NO: 66801 - RNA, 19 nt, Homo sapiens
cgucacuccugaagccaaa

SEQ ID NO: 66802 - RNA, 19 nt, Homo sapiens
gaucaucaacaccaagaag

SEQ ID NO: 66803 - RNA, 19 nt, Homo sapiens
ggacuuccacagauucuac

SEQ ID NO: 66804 - RNA, 19 nt, Homo sapiens
ucaaccagaugcugaccau

SEQ ID NO: 66805 - RNA, 19 nt, Homo sapiens
gcagacuucggccuagcua

SEQ ID NO: 66806 - RNA, 19 nt, Homo sapiens
cagccaagaucaucaacac

SEQ ID NO: 66807 - RNA, 19 nt, Homo sapiens
aaacaagaccagaugugau

SEQ ID NO: 66808 - RNA, 19 nt, Homo sapiens
acauccggcucacgcagua

SEQ ID NO: 66809 - RNA, 19 nt, Homo sapiens
agccagagaucaccagaag

SEQ ID NO: 66810 - RNA, 19 nt, Homo sapiens
ggacaccgucacuccugaa

SEQ ID NO: 66811 - RNA, 19 nt, Homo sapiens
ggacgaggaccagcacaag

SEQ ID NO: 66812 - RNA, 19 nt, Homo sapiens
ucucugacauccugaacuc

SEQ ID NO: 66813 - RNA, 19 nt, Homo sapiens
ucucugacauccugaacuc

SEQ ID NO: 66814 - RNA, 19 nt, Homo sapiens
gagccauccucaccaccau

SEQ ID NO: 66815 - RNA, 19 nt, Homo sapiens
gcaaaggggcugcagugaa

SEQ ID NO: 66816 - RNA, 19 nt, Homo sapiens
guucuccauugucaccaaa

SEQ ID NO: 66817 - RNA, 19 nt, Homo sapiens
ucugaagcauuccaacauc

SEQ ID NO: 66818 - RNA, 19 nt, Homo sapiens
ccagagaucaccagaagcu

SEQ ID NO: 66819 - RNA, 19 nt, Homo sapiens
aagcaggagaucauuaaga

SEQ ID NO: 66820 - RNA, 19 nt, Homo sapiens
gcaggcaugguuugguuuc

SEQ ID NO: 66821 - RNA, 19 nt, Homo sapiens
ggucuucgaucuggucacu

SEQ ID NO: 66822 - RNA, 19 nt, Homo sapiens
ggcagaacgugcacuucca

SEQ ID NO: 66823 - RNA, 19 nt, Homo sapiens
gcaccggccaugaguaugc

SEQ ID NO: 66824 - RNA, 19 nt, Homo sapiens
gaagcaggagaucauuaag

SEQ ID NO: 66825 - RNA, 19 nt, Homo sapiens
ccacacggaauuucucagu

SEQ ID NO: 66826 - RNA, 19 nt, Homo sapiens
ccgaggagggcuuccacua

SEQ ID NO: 66827 - RNA, 19 nt, Homo sapiens
caucgaggccgucaacaac

SEQ ID NO: 66828 - RNA, 19 nt, Homo sapiens
auaccaccauagaggauga

SEQ ID NO: 66829 - RNA, 19 nt, Homo sapiens
gugccaauaccaccauaga

SEQ ID NO: 66830 - RNA, 19 nt, Homo sapiens
ggacgggauuaaggagucu

SEQ ID NO: 66831 - RNA, 19 nt, Homo sapiens
gaguaugcagccaagauca

SEQ ID NO: 66832 - RNA, 19 nt, Homo sapiens
uggcaagccuguggacauc

SEQ ID NO: 66833 - RNA, 19 nt, Homo sapiens
gugccugugucugcagaaa

SEQ ID NO: 66834 - RNA, 19 nt, Homo sapiens
gccugccugucgcauguuu

SEQ ID NO: 66835 - RNA, 19 nt, Homo sapiens
uagaggaugaagacgcuaa

SEQ ID NO: 66836 - RNA, 19 nt, Homo sapiens
ucaaaccaccgucauccau

SEQ ID NO: 66837 - RNA, 19 nt, Homo sapiens
gacuguggagugucugaaa

SEQ ID NO: 66838 - RNA, 19 nt, Homo sapiens
gagaaccugcuggccaaga

SEQ ID NO: 66839 - RNA, 19 nt, Homo sapiens
aagaccagaugugauuugu

SEQ ID NO: 66840 - RNA, 19 nt, Homo sapiens
agcaggagaucauuaagac

SEQ ID NO: 66841 - RNA, 19 nt, Homo sapiens
auuaaggagucuucugaca

SEQ ID NO: 66842 - RNA, 19 nt, Homo sapiens
gaccagaugugauuuguua

SEQ ID NO: 66843 - RNA, 19 nt, Homo sapiens
gaaagcagauggagucaag

SEQ ID NO: 66844 - RNA, 19 nt, Homo sapiens
ggacagaguugguguuugg

SEQ ID NO: 66845 - RNA, 19 nt, Homo sapiens
ggaagcaggagaucauuaa

SEQ ID NO: 66846 - RNA, 19 nt, Homo sapiens
ggaacaagccaagaguuua

SEQ ID NO: 66847 - RNA, 19 nt, Homo sapiens
caacaacggugacuuugag

SEQ ID NO: 66848 - RNA, 19 nt, Homo sapiens
aaaccaccgucauccauaa

SEQ ID NO: 66849 - RNA, 19 nt, Homo sapiens
ggauuaaggagucuucuga

SEQ ID NO: 66850 - RNA, 19 nt, Homo sapiens
uaaggagucuucugacagu

SEQ ID NO: 66851 - RNA, 19 nt, Homo sapiens
gaacaagccaagaguuuac

SEQ ID NO: 66852 - RNA, 19 nt, Homo sapiens
gaagagcugcgcccugguu

SEQ ID NO: 66853 - RNA, 19 nt, Homo sapiens
cagcaggcaugguuugguu

SEQ ID NO: 66854 - RNA, 19 nt, Homo sapiens
gcacgucauuggagaggau

SEQ ID NO: 66855 - RNA, 19 nt, Homo sapiens
caaaccaccgucauccaua

SEQ ID NO: 66856 - RNA, 19 nt, Homo sapiens
cagugaagcuggcagacuu

SEQ ID NO: 66857 - RNA, 19 nt, Homo sapiens
ccagaugugauuuguuaaa

SEQ ID NO: 66858 - RNA, 19 nt, Homo sapiens
ggacggagcgagcagaucu

SEQ ID NO: 66859 - RNA, 19 nt, Homo sapiens
caacaagaaagcagaugga

SEQ ID NO: 66860 - RNA, 19 nt, Homo sapiens
gcaagccuguggacaucug

SEQ ID NO: 66861 - RNA, 19 nt, Homo sapiens
ccaagaucaucaacaccaa

SEQ ID NO: 66862 - RNA, 19 nt, Homo sapiens
caaaggggcugcagugaag

SEQ ID NO: 66863 - RNA, 19 nt, Homo sapiens
ccagacgaauagcaccaaa

SEQ ID NO: 66864 - RNA, 19 nt, Homo sapiens
ugacgacgacaaccacaaa

SEQ ID NO: 66865 - RNA, 19 nt, Homo sapiens
aacaagaccagaugugauu

SEQ ID NO: 66866 - RNA, 19 nt, Homo sapiens
uggaacaagccaagaguuu

SEQ ID NO: 66867 - RNA, 19 nt, Homo sapiens
caagaccagaugugauuug

SEQ ID NO: 66868 - RNA, 19 nt, Homo sapiens
agaaccugcuggccaagaa

SEQ ID NO: 66869 - RNA, 19 nt, Homo sapiens
uaccagcucuacgaggaua

SEQ ID NO: 66870 - RNA, 19 nt, Homo sapiens
acccagggcugaccucguu

SEQ ID NO: 66871 - RNA, 19 nt, Homo sapiens
cggaagcaggagaucauua

SEQ ID NO: 66872 - RNA, 19 nt, Homo sapiens
cgucacuccugaagccaaa

SEQ ID NO: 66873 - RNA, 19 nt, Homo sapiens
gaucaucaacaccaagaag

SEQ ID NO: 66874 - RNA, 19 nt, Homo sapiens
ggacuuccacagauucuac

SEQ ID NO: 66875 - RNA, 19 nt, Homo sapiens
ucaaccagaugcugaccau

SEQ ID NO: 66876 - RNA, 19 nt, Homo sapiens
gcagacuucggccuagcua

SEQ ID NO: 66877 - RNA, 19 nt, Homo sapiens
cagccaagaucaucaacac

SEQ ID NO: 66878 - RNA, 19 nt, Homo sapiens
aaacaagaccagaugugau

SEQ ID NO: 66879 - RNA, 19 nt, Homo sapiens
acauccggcucacgcagua

SEQ ID NO: 66880 - RNA, 19 nt, Homo sapiens
agccagagaucaccagaag

SEQ ID NO: 66881 - RNA, 19 nt, Homo sapiens
ggacaccgucacuccugaa

SEQ ID NO: 66882 - RNA, 19 nt, Homo sapiens
ggacgaggaccagcacaag

SEQ ID NO: 66883 - RNA, 19 nt, Homo sapiens
gagccauccucaccaccau

SEQ ID NO: 66884 - RNA, 19 nt, Homo sapiens
gcaaaggggcugcagugaa

SEQ ID NO: 66885 - RNA, 19 nt, Homo sapiens
guucuccauugucaccaaa

SEQ ID NO: 66886 - RNA, 19 nt, Homo sapiens
ucugaagcauuccaacauc

SEQ ID NO: 66887 - RNA, 19 nt, Homo sapiens
ccagagaucaccagaagcu

SEQ ID NO: 66888 - RNA, 19 nt, Homo sapiens
aagcaggagaucauuaaga

SEQ ID NO: 66889 - RNA, 19 nt, Homo sapiens
gcaggcaugguuugguuuc

SEQ ID NO: 66890 - RNA, 19 nt, Homo sapiens
ggucuucgaucuggucacu

SEQ ID NO: 66891 - RNA, 19 nt, Homo sapiens
ggcagaacgugcacuucca

SEQ ID NO: 66892 - RNA, 19 nt, Homo sapiens
gcaccggccaugaguaugc

SEQ ID NO: 66893 - RNA, 19 nt, Homo sapiens
gaagcaggagaucauuaag

SEQ ID NO: 66894 - RNA, 19 nt, Homo sapiens
ccacacggaauuucucagu

SEQ ID NO: 66895 - RNA, 19 nt, Homo sapiens
ccgaggagggcuuccacua

SEQ ID NO: 66896 - RNA, 19 nt, Homo sapiens
caucgaggccgucaacaac

SEQ ID NO: 66897 - RNA, 19 nt, Homo sapiens
auaccaccauagaggauga

SEQ ID NO: 66898 - RNA, 19 nt, Homo sapiens
gugccaauaccaccauaga

SEQ ID NO: 66899 - RNA, 19 nt, Homo sapiens
ggacgggauuaaggagucu

SEQ ID NO: 66900 - RNA, 19 nt, Homo sapiens
gaguaugcagccaagauca

SEQ ID NO: 66901 - RNA, 19 nt, Homo sapiens
uggcaagccuguggacauc

SEQ ID NO: 66902 - RNA, 19 nt, Homo sapiens
gugccugugucugcagaaa

SEQ ID NO: 66903 - RNA, 19 nt, Homo sapiens
gccugccugucgcauguuu

SEQ ID NO: 66904 - RNA, 19 nt, Homo sapiens
uagaggaugaagacgcuaa

SEQ ID NO: 66905 - RNA, 19 nt, Homo sapiens
ucaaaccaccgucauccau

SEQ ID NO: 66906 - RNA, 19 nt, Homo sapiens
gacuguggagugucugaaa

SEQ ID NO: 66907 - RNA, 19 nt, Homo sapiens
gagaaccugcuggccaaga

SEQ ID NO: 66908 - RNA, 19 nt, Homo sapiens
aagaccagaugugauuugu

SEQ ID NO: 66909 - RNA, 19 nt, Homo sapiens
agcaggagaucauuaagac

SEQ ID NO: 66910 - RNA, 19 nt, Homo sapiens
auuaaggagucuucugaca

SEQ ID NO: 66911 - RNA, 19 nt, Homo sapiens
gaccagaugugauuuguua

SEQ ID NO: 66912 - RNA, 19 nt, Homo sapiens
gaaagcagauggagucaag

SEQ ID NO: 66913 - RNA, 19 nt, Homo sapiens
ggacagaguugguguuugg

SEQ ID NO: 66914 - RNA, 19 nt, Homo sapiens
ggaagcaggagaucauuaa

SEQ ID NO: 66915 - RNA, 19 nt, Homo sapiens
caacaacggugacuuugag

SEQ ID NO: 66916 - RNA, 19 nt, Homo sapiens
aaaccaccgucauccauaa

SEQ ID NO: 66917 - RNA, 19 nt, Homo sapiens
ggauuaaggagucuucuga

SEQ ID NO: 66918 - RNA, 19 nt, Homo sapiens
uaaggagucuucugacagu

SEQ ID NO: 66919 - RNA, 19 nt, Homo sapiens
gaagagcugcgcccugguu

SEQ ID NO: 66920 - RNA, 19 nt, Homo sapiens
cagcaggcaugguuugguu

SEQ ID NO: 66921 - RNA, 19 nt, Homo sapiens
gcacgucauuggagaggau

SEQ ID NO: 66922 - RNA, 19 nt, Homo sapiens
caaaccaccgucauccaua

SEQ ID NO: 66923 - RNA, 19 nt, Homo sapiens
cagugaagcuggcagacuu

SEQ ID NO: 66924 - RNA, 19 nt, Homo sapiens
ccagaugugauuuguuaaa

SEQ ID NO: 66925 - RNA, 19 nt, Homo sapiens
ggacggagcgagcagaucu

SEQ ID NO: 66926 - RNA, 19 nt, Homo sapiens
caacaagaaagcagaugga

SEQ ID NO: 66927 - RNA, 19 nt, Homo sapiens
gcaagccuguggacaucug

SEQ ID NO: 66928 - RNA, 19 nt, Homo sapiens
ccaagaucaucaacaccaa

SEQ ID NO: 66929 - RNA, 19 nt, Homo sapiens
caaaggggcugcagugaag

SEQ ID NO: 66930 - RNA, 19 nt, Homo sapiens
ccagacgaauagcaccaaa

SEQ ID NO: 66931 - RNA, 19 nt, Homo sapiens
ugacgacgacaaccacaaa

SEQ ID NO: 66932 - RNA, 19 nt, Homo sapiens
aacaagaccagaugugauu

SEQ ID NO: 66933 - RNA, 19 nt, Homo sapiens
uaccagcucuacgaggaua

SEQ ID NO: 66934 - RNA, 19 nt, Homo sapiens
caagaccagaugugauuug

SEQ ID NO: 66935 - RNA, 19 nt, Homo sapiens
agaaccugcuggccaagaa

SEQ ID NO: 66936 - RNA, 19 nt, Homo sapiens
acccagggcugaccucguu

SEQ ID NO: 66937 - RNA, 19 nt, Homo sapiens
cggaagcaggagaucauua

SEQ ID NO: 66938 - RNA, 19 nt, Homo sapiens
ucucagcagccaagaguuu

SEQ ID NO: 66939 - RNA, 19 nt, Homo sapiens
cgucacuccugaagccaaa

SEQ ID NO: 66940 - RNA, 19 nt, Homo sapiens
gaucaucaacaccaagaag

SEQ ID NO: 66941 - RNA, 19 nt, Homo sapiens
ggacuuccacagauucuac

SEQ ID NO: 66942 - RNA, 19 nt, Homo sapiens
ucaaccagaugcugaccau

SEQ ID NO: 66943 - RNA, 19 nt, Homo sapiens
gcagacuucggccuagcua

SEQ ID NO: 66944 - RNA, 19 nt, Homo sapiens
cagccaagaucaucaacac

SEQ ID NO: 66945 - RNA, 19 nt, Homo sapiens
aaacaagaccagaugugau

SEQ ID NO: 66946 - RNA, 19 nt, Homo sapiens
acauccggcucacgcagua

SEQ ID NO: 66947 - RNA, 19 nt, Homo sapiens
agccagagaucaccagaag

SEQ ID NO: 66948 - RNA, 19 nt, Homo sapiens
ggacaccgucacuccugaa

SEQ ID NO: 66949 - RNA, 19 nt, Homo sapiens
ggacgaggaccagcacaag

SEQ ID NO: 66950 - RNA, 19 nt, Homo sapiens
gagccauccucaccaccau

SEQ ID NO: 66951 - RNA, 19 nt, Homo sapiens
gcaaaggggcugcagugaa

SEQ ID NO: 66952 - RNA, 19 nt, Homo sapiens
guucuccauugucaccaaa

SEQ ID NO: 66953 - RNA, 19 nt, Homo sapiens
ucugaagcauuccaacauc

SEQ ID NO: 66954 - RNA, 19 nt, Homo sapiens
ccagagaucaccagaagcu

SEQ ID NO: 66955 - RNA, 19 nt, Homo sapiens
aagcaggagaucauuaaga

SEQ ID NO: 66956 - RNA, 19 nt, Homo sapiens
gcaggcaugguuugguuuc

SEQ ID NO: 66957 - RNA, 19 nt, Homo sapiens
ggucuucgaucuggucacu

SEQ ID NO: 66958 - RNA, 19 nt, Homo sapiens
ggcagaacgugcacuucca

SEQ ID NO: 66959 - RNA, 19 nt, Homo sapiens
gaagcaggagaucauuaag

SEQ ID NO: 66960 - RNA, 19 nt, Homo sapiens
gcaccggccaugaguaugc

SEQ ID NO: 66961 - RNA, 19 nt, Homo sapiens
ccgaggagggcuuccacua

SEQ ID NO: 66962 - RNA, 19 nt, Homo sapiens
caucgaggccgucaacaac

SEQ ID NO: 66963 - RNA, 19 nt, Homo sapiens
auaccaccauagaggauga

SEQ ID NO: 66964 - RNA, 19 nt, Homo sapiens
gugccaauaccaccauaga

SEQ ID NO: 66965 - RNA, 19 nt, Homo sapiens
ggacgggauuaaggagucu

SEQ ID NO: 66966 - RNA, 19 nt, Homo sapiens
uggcaagccuguggacauc

SEQ ID NO: 66967 - RNA, 19 nt, Homo sapiens
gaguaugcagccaagauca

SEQ ID NO: 66968 - RNA, 19 nt, Homo sapiens
gugccugugucugcagaaa

SEQ ID NO: 66969 - RNA, 19 nt, Homo sapiens
gccugccugucgcauguuu

SEQ ID NO: 66970 - RNA, 19 nt, Homo sapiens
uagaggaugaagacgcuaa

SEQ ID NO: 66971 - RNA, 19 nt, Homo sapiens
ucaaaccaccgucauccau

SEQ ID NO: 66972 - RNA, 19 nt, Homo sapiens
gacuguggagugucugaaa

SEQ ID NO: 66973 - RNA, 19 nt, Homo sapiens
gagaaccugcuggccaaga

SEQ ID NO: 66974 - RNA, 19 nt, Homo sapiens
aagaccagaugugauuugu

SEQ ID NO: 66975 - RNA, 19 nt, Homo sapiens
agcaggagaucauuaagac

SEQ ID NO: 66976 - RNA, 19 nt, Homo sapiens
auuaaggagucuucugaca

SEQ ID NO: 66977 - RNA, 19 nt, Homo sapiens
gaccagaugugauuuguua

SEQ ID NO: 66978 - RNA, 19 nt, Homo sapiens
gaaagcagauggagucaag

SEQ ID NO: 66979 - RNA, 19 nt, Homo sapiens
ggacagaguugguguuugg

SEQ ID NO: 66980 - RNA, 19 nt, Homo sapiens
ggaagcaggagaucauuaa

SEQ ID NO: 66981 - RNA, 19 nt, Homo sapiens
caacaacggugacuuugag

SEQ ID NO: 66982 - RNA, 19 nt, Homo sapiens
aaaccaccgucauccauaa

SEQ ID NO: 66983 - RNA, 19 nt, Homo sapiens
ggauuaaggagucuucuga

SEQ ID NO: 66984 - RNA, 19 nt, Homo sapiens
uaaggagucuucugacagu

SEQ ID NO: 66985 - RNA, 19 nt, Homo sapiens
gaagagcugcgcccugguu

SEQ ID NO: 66986 - RNA, 19 nt, Homo sapiens
cagcaggcaugguuugguu

SEQ ID NO: 66987 - RNA, 19 nt, Homo sapiens
gcacgucauuggagaggau

SEQ ID NO: 66988 - RNA, 19 nt, Homo sapiens
caaaccaccgucauccaua

SEQ ID NO: 66989 - RNA, 19 nt, Homo sapiens
cagugaagcuggcagacuu

SEQ ID NO: 66990 - RNA, 19 nt, Homo sapiens
ccagaugugauuuguuaaa

SEQ ID NO: 66991 - RNA, 19 nt, Homo sapiens
ggacggagcgagcagaucu

SEQ ID NO: 66992 - RNA, 19 nt, Homo sapiens
caacaagaaagcagaugga

SEQ ID NO: 66993 - RNA, 19 nt, Homo sapiens
gcaagccuguggacaucug

SEQ ID NO: 66994 - RNA, 19 nt, Homo sapiens
ccaagaucaucaacaccaa

SEQ ID NO: 66995 - RNA, 19 nt, Homo sapiens
caaaggggcugcagugaag

SEQ ID NO: 66996 - RNA, 19 nt, Homo sapiens
ccagacgaauagcaccaaa

SEQ ID NO: 66997 - RNA, 19 nt, Homo sapiens
gaauuucucagccaagagu

SEQ ID NO: 66998 - RNA, 19 nt, Homo sapiens
ugacgacgacaaccacaaa

SEQ ID NO: 66999 - RNA, 19 nt, Homo sapiens
aacaagaccagaugugauu

SEQ ID NO: 67000 - RNA, 19 nt, Homo sapiens
uaccagcucuacgaggaua

SEQ ID NO: 67001 - RNA, 19 nt, Homo sapiens
caagaccagaugugauuug

SEQ ID NO: 67002 - RNA, 19 nt, Homo sapiens
agaaccugcuggccaagaa

SEQ ID NO: 67003 - RNA, 19 nt, Homo sapiens
acccagggcugaccucguu

SEQ ID NO: 67004 - RNA, 19 nt, Homo sapiens
cggaagcaggagaucauua

SEQ ID NO: 67005 - RNA, 19 nt, Homo sapiens
cgucacuccugaagccaaa

SEQ ID NO: 67006 - RNA, 19 nt, Homo sapiens
gaucaucaacaccaagaag

SEQ ID NO: 67007 - RNA, 19 nt, Homo sapiens
ggacuuccacagauucuac

SEQ ID NO: 67008 - RNA, 19 nt, Homo sapiens
cggaauuucucagccaaga

SEQ ID NO: 67009 - RNA, 19 nt, Homo sapiens
ucaaccagaugcugaccau

SEQ ID NO: 67010 - RNA, 19 nt, Homo sapiens
gcagacuucggccuagcua

SEQ ID NO: 67011 - RNA, 19 nt, Homo sapiens
cagccaagaucaucaacac

SEQ ID NO: 67012 - RNA, 19 nt, Homo sapiens
aaacaagaccagaugugau

SEQ ID NO: 67013 - RNA, 19 nt, Homo sapiens
acauccggcucacgcagua

SEQ ID NO: 67014 - RNA, 19 nt, Homo sapiens
agccagagaucaccagaag

SEQ ID NO: 67015 - RNA, 19 nt, Homo sapiens
ggacaccgucacuccugaa

SEQ ID NO: 67016 - RNA, 19 nt, Homo sapiens
ggacgaggaccagcacaag

SEQ ID NO: 67017 - RNA, 19 nt, Homo sapiens
gagccauccucaccaccau

SEQ ID NO: 67018 - RNA, 19 nt, Homo sapiens
gcaaaggggcugcagugaa

SEQ ID NO: 67019 - RNA, 19 nt, Homo sapiens
guucuccauugucaccaaa

SEQ ID NO: 67020 - RNA, 19 nt, Homo sapiens
ucugaagcauuccaacauc

SEQ ID NO: 67021 - RNA, 19 nt, Homo sapiens
ccagagaucaccagaagcu

SEQ ID NO: 67022 - RNA, 19 nt, Homo sapiens
aagcaggagaucauuaaga

SEQ ID NO: 67023 - RNA, 19 nt, Homo sapiens
gcaggcaugguuugguuuc

SEQ ID NO: 67024 - RNA, 19 nt, Homo sapiens
ggucuucgaucuggucacu

SEQ ID NO: 67025 - RNA, 19 nt, Homo sapiens
ggcagaacgugcacuucca

SEQ ID NO: 67026 - RNA, 19 nt, Homo sapiens
gaagcaggagaucauuaag

SEQ ID NO: 67027 - RNA, 19 nt, Homo sapiens
gcaccggccaugaguaugc

SEQ ID NO: 67028 - RNA, 19 nt, Homo sapiens
ccgaggagggcuuccacua

SEQ ID NO: 67029 - RNA, 19 nt, Homo sapiens
caucgaggccgucaacaac

SEQ ID NO: 67030 - RNA, 19 nt, Homo sapiens
auaccaccauagaggauga

SEQ ID NO: 67031 - RNA, 19 nt, Homo sapiens
gugccaauaccaccauaga

SEQ ID NO: 67032 - RNA, 19 nt, Homo sapiens
ggacgggauuaaggagucu

SEQ ID NO: 67033 - RNA, 19 nt, Homo sapiens
uggcaagccuguggacauc

SEQ ID NO: 67034 - RNA, 19 nt, Homo sapiens
gaguaugcagccaagauca

SEQ ID NO: 67035 - RNA, 19 nt, Homo sapiens
gugccugugucugcagaaa

SEQ ID NO: 67036 - RNA, 19 nt, Homo sapiens
gccugccugucgcauguuu

SEQ ID NO: 67037 - RNA, 19 nt, Homo sapiens
uagaggaugaagacgcuaa

SEQ ID NO: 67038 - RNA, 19 nt, Homo sapiens
ucaaaccaccgucauccau

SEQ ID NO: 67039 - RNA, 19 nt, Homo sapiens
gacuguggagugucugaaa

SEQ ID NO: 67040 - RNA, 19 nt, Homo sapiens
gagaaccugcuggccaaga

SEQ ID NO: 67041 - RNA, 19 nt, Homo sapiens
aagaccagaugugauuugu

SEQ ID NO: 67042 - RNA, 19 nt, Homo sapiens
agcaggagaucauuaagac

SEQ ID NO: 67043 - RNA, 19 nt, Homo sapiens
auuaaggagucuucugaca

SEQ ID NO: 67044 - RNA, 19 nt, Homo sapiens
uuucucagccaagaguuua

SEQ ID NO: 67045 - RNA, 19 nt, Homo sapiens
gaccagaugugauuuguua

SEQ ID NO: 67046 - RNA, 19 nt, Homo sapiens
gaaagcagauggagucaag

SEQ ID NO: 67047 - RNA, 19 nt, Homo sapiens
ggacagaguugguguuugg

SEQ ID NO: 67048 - RNA, 19 nt, Homo sapiens
ggaagcaggagaucauuaa

SEQ ID NO: 67049 - RNA, 19 nt, Homo sapiens
caacaacggugacuuugag

SEQ ID NO: 67050 - RNA, 19 nt, Homo sapiens
gaagagcugcgcccugguu

SEQ ID NO: 67051 - RNA, 19 nt, Homo sapiens
cagcaggcaugguuugguu

SEQ ID NO: 67052 - RNA, 19 nt, Homo sapiens
gcacgucauuggagaggau

SEQ ID NO: 67053 - RNA, 19 nt, Homo sapiens
cagugaagcuggcagacuu

SEQ ID NO: 67054 - RNA, 19 nt, Homo sapiens
ccagaugugauuuguuaaa

SEQ ID NO: 67055 - RNA, 19 nt, Homo sapiens
ggacggagcgagcagaucu

SEQ ID NO: 67056 - RNA, 19 nt, Homo sapiens
caacaagaaagcagaugga

SEQ ID NO: 67057 - RNA, 19 nt, Homo sapiens
gcaagccuguggacaucug

SEQ ID NO: 67058 - RNA, 19 nt, Homo sapiens
ccaagaucaucaacaccaa

SEQ ID NO: 67059 - RNA, 19 nt, Homo sapiens
caaaggggcugcagugaag

SEQ ID NO: 67060 - RNA, 19 nt, Homo sapiens
ccagacgaauagcaccaaa

SEQ ID NO: 67061 - RNA, 19 nt, Homo sapiens
ugacgacgacaaccacaaa

SEQ ID NO: 67062 - RNA, 19 nt, Homo sapiens
aacaagaccagaugugauu

SEQ ID NO: 67063 - RNA, 19 nt, Homo sapiens
caagaccagaugugauuug

SEQ ID NO: 67064 - RNA, 19 nt, Homo sapiens
agaaccugcuggccaagaa

SEQ ID NO: 67065 - RNA, 19 nt, Homo sapiens
uaccagcucuacgaggaua

SEQ ID NO: 67066 - RNA, 19 nt, Homo sapiens
acccagggcugaccucguu

SEQ ID NO: 67067 - RNA, 19 nt, Homo sapiens
cggaagcaggagaucauua

SEQ ID NO: 67068 - RNA, 19 nt, Homo sapiens
ucucagcagccaagaguuu

SEQ ID NO: 67069 - RNA, 19 nt, Homo sapiens
cgucacuccugaagccaaa

SEQ ID NO: 67070 - RNA, 19 nt, Homo sapiens
gaucaucaacaccaagaag

SEQ ID NO: 67071 - RNA, 19 nt, Homo sapiens
ggacuuccacagauucuac

SEQ ID NO: 67072 - RNA, 19 nt, Homo sapiens
ucaaccagaugcugaccau

SEQ ID NO: 67073 - RNA, 19 nt, Homo sapiens
gcagacuucggccuagcua

SEQ ID NO: 67074 - RNA, 19 nt, Homo sapiens
cagccaagaucaucaacac

SEQ ID NO: 67075 - RNA, 19 nt, Homo sapiens
aaacaagaccagaugugau

SEQ ID NO: 67076 - RNA, 19 nt, Homo sapiens
acauccggcucacgcagua

SEQ ID NO: 67077 - RNA, 19 nt, Homo sapiens
gcccuggagucuucugaca

SEQ ID NO: 67078 - RNA, 19 nt, Homo sapiens
agccagagaucaccagaag

SEQ ID NO: 67079 - RNA, 19 nt, Homo sapiens
ccuggagucuucugacagu

SEQ ID NO: 67080 - RNA, 19 nt, Homo sapiens
ggacaccgucacuccugaa

SEQ ID NO: 67081 - RNA, 19 nt, Homo sapiens
ggacgaggaccagcacaag

SEQ ID NO: 67082 - RNA, 19 nt, Homo sapiens
gagccauccucaccaccau

SEQ ID NO: 67083 - RNA, 19 nt, Homo sapiens
gcaaaggggcugcagugaa

SEQ ID NO: 67084 - RNA, 19 nt, Homo sapiens
guucuccauugucaccaaa

SEQ ID NO: 67085 - RNA, 19 nt, Homo sapiens
ucugaagcauuccaacauc

SEQ ID NO: 67086 - RNA, 19 nt, Homo sapiens
ccagagaucaccagaagcu

SEQ ID NO: 67087 - RNA, 19 nt, Homo sapiens
aagcaggagaucauuaaga

SEQ ID NO: 67088 - RNA, 19 nt, Homo sapiens
gcaggcaugguuugguuuc

SEQ ID NO: 67089 - RNA, 19 nt, Homo sapiens
ggucuucgaucuggucacu

SEQ ID NO: 67090 - RNA, 19 nt, Homo sapiens
ggcagaacgugcacuucca

SEQ ID NO: 67091 - RNA, 19 nt, Homo sapiens
gaagcaggagaucauuaag

SEQ ID NO: 67092 - RNA, 19 nt, Homo sapiens
gcaccggccaugaguaugc

SEQ ID NO: 67093 - RNA, 19 nt, Homo sapiens
ccgaggagggcuuccacua

SEQ ID NO: 67094 - RNA, 19 nt, Homo sapiens
caucgaggccgucaacaac

SEQ ID NO: 67095 - RNA, 19 nt, Homo sapiens
auaccaccauagaggauga

SEQ ID NO: 67096 - RNA, 19 nt, Homo sapiens
gugccaauaccaccauaga

SEQ ID NO: 67097 - RNA, 19 nt, Homo sapiens
uggcaagccuguggacauc

SEQ ID NO: 67098 - RNA, 19 nt, Homo sapiens
gaguaugcagccaagauca

SEQ ID NO: 67099 - RNA, 19 nt, Homo sapiens
gugccugugucugcagaaa

SEQ ID NO: 67100 - RNA, 19 nt, Homo sapiens
gccugccugucgcauguuu

SEQ ID NO: 67101 - RNA, 19 nt, Homo sapiens
uagaggaugaagacgcuaa

SEQ ID NO: 67102 - RNA, 19 nt, Homo sapiens
gacuguggagugucugaaa

SEQ ID NO: 67103 - RNA, 19 nt, Homo sapiens
gagaaccugcuggccaaga

SEQ ID NO: 67104 - RNA, 19 nt, Homo sapiens
aagaccagaugugauuugu

SEQ ID NO: 67105 - RNA, 19 nt, Homo sapiens
agcaggagaucauuaagac

SEQ ID NO: 67106 - RNA, 19 nt, Homo sapiens
gaccagaugugauuuguua

SEQ ID NO: 67107 - RNA, 19 nt, Homo sapiens
gaaagcagauggagucaag

SEQ ID NO: 67108 - RNA, 19 nt, Homo sapiens
ggacagaguugguguuugg

SEQ ID NO: 67109 - RNA, 19 nt, Homo sapiens
ggaagcaggagaucauuaa

SEQ ID NO: 67110 - RNA, 19 nt, Homo sapiens
ggaacaagccaagaguuua

SEQ ID NO: 67111 - RNA, 19 nt, Homo sapiens
caacaacggugacuuugag

SEQ ID NO: 67112 - RNA, 19 nt, Homo sapiens
aaaccaccgucauccauaa

SEQ ID NO: 67113 - RNA, 19 nt, Homo sapiens
ggauuaaggagucuucuga

SEQ ID NO: 67114 - RNA, 19 nt, Homo sapiens
uaaggagucuucugacagu

SEQ ID NO: 67115 - RNA, 19 nt, Homo sapiens
gaacaagccaagaguuuac

SEQ ID NO: 67116 - RNA, 19 nt, Homo sapiens
gaagagcugcgcccugguu

SEQ ID NO: 67117 - RNA, 19 nt, Homo sapiens
cagcaggcaugguuugguu

SEQ ID NO: 67118 - RNA, 19 nt, Homo sapiens
gcacgucauuggagaggau

SEQ ID NO: 67119 - RNA, 19 nt, Homo sapiens
caaaccaccgucauccaua

SEQ ID NO: 67120 - RNA, 19 nt, Homo sapiens
cagugaagcuggcagacuu

SEQ ID NO: 67121 - RNA, 19 nt, Homo sapiens
ccagaugugauuuguuaaa

SEQ ID NO: 67122 - RNA, 19 nt, Homo sapiens
ggacggagcgagcagaucu

SEQ ID NO: 67123 - RNA, 19 nt, Homo sapiens
caacaagaaagcagaugga

SEQ ID NO: 67124 - RNA, 19 nt, Homo sapiens
gcaagccuguggacaucug

SEQ ID NO: 67125 - RNA, 19 nt, Homo sapiens
ccaagaucaucaacaccaa

SEQ ID NO: 67126 - RNA, 19 nt, Homo sapiens
caaaggggcugcagugaag

SEQ ID NO: 67127 - RNA, 19 nt, Homo sapiens
ugacgacgacaaccacaaa

SEQ ID NO: 67128 - RNA, 19 nt, Homo sapiens
aacaagaccagaugugauu

SEQ ID NO: 67129 - RNA, 19 nt, Homo sapiens
uggaacaagccaagaguuu

SEQ ID NO: 67130 - RNA, 19 nt, Homo sapiens
caagaccagaugugauuug

SEQ ID NO: 67131 - RNA, 19 nt, Homo sapiens
agaaccugcuggccaagaa

SEQ ID NO: 67132 - RNA, 19 nt, Homo sapiens
uaccagcucuacgaggaua

SEQ ID NO: 67133 - RNA, 19 nt, Homo sapiens
cggaagcaggagaucauua

SEQ ID NO: 67134 - RNA, 19 nt, Homo sapiens
cgucacuccugaagccaaa

SEQ ID NO: 67135 - RNA, 19 nt, Homo sapiens
gaucaucaacaccaagaag

SEQ ID NO: 67136 - RNA, 19 nt, Homo sapiens
ggccuacgcauucuacuuc

SEQ ID NO: 67137 - RNA, 19 nt, Homo sapiens
ucaaccagaugcugaccau

SEQ ID NO: 67138 - RNA, 19 nt, Homo sapiens
gcagacuucggccuagcua

SEQ ID NO: 67139 - RNA, 19 nt, Homo sapiens
cagccaagaucaucaacac

SEQ ID NO: 67140 - RNA, 19 nt, Homo sapiens
aaacaagaccagaugugau

SEQ ID NO: 67141 - RNA, 19 nt, Homo sapiens
acauccggcucacgcagua

SEQ ID NO: 67142 - RNA, 19 nt, Homo sapiens
ggagucaaggagccucaaa

SEQ ID NO: 67143 - RNA, 19 nt, Homo sapiens
agccagagaucaccagaag

SEQ ID NO: 67144 - RNA, 19 nt, Homo sapiens
ggacaccgucacuccugaa

SEQ ID NO: 67145 - RNA, 19 nt, Homo sapiens
ggacgaggaccagcacaag

SEQ ID NO: 67146 - RNA, 19 nt, Homo sapiens
gagccauccucaccaccau

SEQ ID NO: 67147 - RNA, 19 nt, Homo sapiens
gcaaaggggcugcagugaa

SEQ ID NO: 67148 - RNA, 19 nt, Homo sapiens
guucuccauugucaccaaa

SEQ ID NO: 67149 - RNA, 19 nt, Homo sapiens
ucugaagcauuccaacauc

SEQ ID NO: 67150 - RNA, 19 nt, Homo sapiens
ccagagaucaccagaagcu

SEQ ID NO: 67151 - RNA, 19 nt, Homo sapiens
aagcaggagaucauuaaga

SEQ ID NO: 67152 - RNA, 19 nt, Homo sapiens
gcaggcaugguuugguuuc

SEQ ID NO: 67153 - RNA, 19 nt, Homo sapiens
ggucuucgaucuggucacu

SEQ ID NO: 67154 - RNA, 19 nt, Homo sapiens
ggcagaacgugcacuucca

SEQ ID NO: 67155 - RNA, 19 nt, Homo sapiens
gaagcaggagaucauuaag

SEQ ID NO: 67156 - RNA, 19 nt, Homo sapiens
ccacacggaauuucucagu

SEQ ID NO: 67157 - RNA, 19 nt, Homo sapiens
gcaccggccaugaguaugc

SEQ ID NO: 67158 - RNA, 19 nt, Homo sapiens
ccgaggagggcuuccacua

SEQ ID NO: 67159 - RNA, 19 nt, Homo sapiens
caucgaggccgucaacaac

SEQ ID NO: 67160 - RNA, 19 nt, Homo sapiens
auaccaccauagaggauga

SEQ ID NO: 67161 - RNA, 19 nt, Homo sapiens
gugccaauaccaccauaga

SEQ ID NO: 67162 - RNA, 19 nt, Homo sapiens
ggacgggauuaaggagucu

SEQ ID NO: 67163 - RNA, 19 nt, Homo sapiens
gaguaugcagccaagauca

SEQ ID NO: 67164 - RNA, 19 nt, Homo sapiens
uggcaagccuguggacauc

SEQ ID NO: 67165 - RNA, 19 nt, Homo sapiens
gugccugugucugcagaaa

SEQ ID NO: 67166 - RNA, 19 nt, Homo sapiens
gccugccugucgcauguuu

SEQ ID NO: 67167 - RNA, 19 nt, Homo sapiens
uagaggaugaagacgcuaa

SEQ ID NO: 67168 - RNA, 19 nt, Homo sapiens
ucaaaccaccgucauccau

SEQ ID NO: 67169 - RNA, 19 nt, Homo sapiens
gacuguggagugucugaaa

SEQ ID NO: 67170 - RNA, 19 nt, Homo sapiens
gagaaccugcuggccaaga

SEQ ID NO: 67171 - RNA, 19 nt, Homo sapiens
aagaccagaugugauuugu

SEQ ID NO: 67172 - RNA, 19 nt, Homo sapiens
agcaggagaucauuaagac

SEQ ID NO: 67173 - RNA, 19 nt, Homo sapiens
auuaaggagucuucugaca

SEQ ID NO: 67174 - RNA, 19 nt, Homo sapiens
gaccagaugugauuuguua

SEQ ID NO: 67175 - RNA, 19 nt, Homo sapiens
gaaagcagauggagucaag

SEQ ID NO: 67176 - RNA, 19 nt, Homo sapiens
ggacagaguugguguuugg

SEQ ID NO: 67177 - RNA, 19 nt, Homo sapiens
ggaagcaggagaucauuaa

SEQ ID NO: 67178 - RNA, 19 nt, Homo sapiens
caacaacggugacuuugag

SEQ ID NO: 67179 - RNA, 19 nt, Homo sapiens
caaggagucuucugacagu

SEQ ID NO: 67180 - RNA, 19 nt, Homo sapiens
gaagagcugcgcccugguu

SEQ ID NO: 67181 - RNA, 19 nt, Homo sapiens
cagcaggcaugguuugguu

SEQ ID NO: 67182 - RNA, 19 nt, Homo sapiens
gcacgucauuggagaggau

SEQ ID NO: 67183 - RNA, 19 nt, Homo sapiens
cagugaagcuggcagacuu

SEQ ID NO: 67184 - RNA, 19 nt, Homo sapiens
ccagaugugauuuguuaaa

SEQ ID NO: 67185 - RNA, 19 nt, Homo sapiens
ggacggagcgagcagaucu

SEQ ID NO: 67186 - RNA, 19 nt, Homo sapiens
caacaagaaagcagaugga

SEQ ID NO: 67187 - RNA, 19 nt, Homo sapiens
gcaagccuguggacaucug

SEQ ID NO: 67188 - RNA, 19 nt, Homo sapiens
ccaagaucaucaacaccaa

SEQ ID NO: 67189 - RNA, 19 nt, Homo sapiens
caaaggggcugcagugaag

SEQ ID NO: 67190 - RNA, 19 nt, Homo sapiens
ugacgacgacaaccacaaa

SEQ ID NO: 67191 - RNA, 19 nt, Homo sapiens
aacaagaccagaugugauu

SEQ ID NO: 67192 - RNA, 19 nt, Homo sapiens
caagaccagaugugauuug

SEQ ID NO: 67193 - RNA, 19 nt, Homo sapiens
agaaccugcuggccaagaa

SEQ ID NO: 67194 - RNA, 19 nt, Homo sapiens
uaccagcucuacgaggaua

SEQ ID NO: 67195 - RNA, 19 nt, Homo sapiens
acccagggcugaccucguu

SEQ ID NO: 67196 - RNA, 19 nt, Homo sapiens
cggaagcaggagaucauua

SEQ ID NO: 67197 - RNA, 19 nt, Homo sapiens
ucucagcagccaagaguuu

SEQ ID NO: 67198 - RNA, 19 nt, Homo sapiens
cgucacuccugaagccaaa

SEQ ID NO: 67199 - RNA, 19 nt, Homo sapiens
gaucaucaacaccaagaag

SEQ ID NO: 67200 - RNA, 19 nt, Homo sapiens
ggacuuccacagauucuac

SEQ ID NO: 67201 - RNA, 19 nt, Homo sapiens
gagucaaggagucuucuga

SEQ ID NO: 67202 - RNA, 19 nt, Homo sapiens
ucaaccagaugcugaccau

SEQ ID NO: 67203 - RNA, 19 nt, Homo sapiens
gcagacuucggccuagcua

SEQ ID NO: 67204 - RNA, 19 nt, Homo sapiens
cagccaagaucaucaacac

SEQ ID NO: 67205 - RNA, 19 nt, Homo sapiens
aaacaagaccagaugugau

SEQ ID NO: 67206 - RNA, 19 nt, Homo sapiens
acauccggcucacgcagua

SEQ ID NO: 67207 - RNA, 19 nt, Homo sapiens
agccagagaucaccagaag

SEQ ID NO: 67208 - RNA, 19 nt, Homo sapiens
ggacaccgucacuccugaa

SEQ ID NO: 67209 - RNA, 19 nt, Homo sapiens
ggacgaggaccagcacaag

SEQ ID NO: 67210 - RNA, 19 nt, Homo sapiens
gagccauccucaccaccau

SEQ ID NO: 67211 - RNA, 19 nt, Homo sapiens
gcaaaggggcugcagugaa

SEQ ID NO: 67212 - RNA, 19 nt, Homo sapiens
guucuccauugucaccaaa

SEQ ID NO: 67213 - RNA, 19 nt, Homo sapiens
ucugaagcauuccaacauc

SEQ ID NO: 67214 - RNA, 19 nt, Homo sapiens
ccagagaucaccagaagcu

SEQ ID NO: 67215 - RNA, 19 nt, Homo sapiens
aagcaggagaucauuaaga

SEQ ID NO: 67216 - RNA, 19 nt, Homo sapiens
gcaggcaugguuugguuuc

SEQ ID NO: 67217 - RNA, 19 nt, Homo sapiens
ggucuucgaucuggucacu

SEQ ID NO: 67218 - RNA, 19 nt, Homo sapiens
ggcagaacgugcacuucca

SEQ ID NO: 67219 - RNA, 19 nt, Homo sapiens
gaagcaggagaucauuaag

SEQ ID NO: 67220 - RNA, 19 nt, Homo sapiens
gcaccggccaugaguaugc

SEQ ID NO: 67221 - RNA, 19 nt, Homo sapiens
ccgaggagggcuuccacua

SEQ ID NO: 67222 - RNA, 19 nt, Homo sapiens
caucgaggccgucaacaac

SEQ ID NO: 67223 - RNA, 19 nt, Homo sapiens
gaguaugcagccaagauca

SEQ ID NO: 67224 - RNA, 19 nt, Homo sapiens
auaccaccauagaggauga

SEQ ID NO: 67225 - RNA, 19 nt, Homo sapiens
gugccaauaccaccauaga

SEQ ID NO: 67226 - RNA, 19 nt, Homo sapiens
uggcaagccuguggacauc

SEQ ID NO: 67227 - RNA, 19 nt, Homo sapiens
gugccugugucugcagaaa

SEQ ID NO: 67228 - RNA, 19 nt, Homo sapiens
gccugccugucgcauguuu

SEQ ID NO: 67229 - RNA, 19 nt, Homo sapiens
uagaggaugaagacgcuaa

SEQ ID NO: 67230 - RNA, 19 nt, Homo sapiens
gacuguggagugucugaaa

SEQ ID NO: 67231 - RNA, 19 nt, Homo sapiens
gagaaccugcuggccaaga

SEQ ID NO: 67232 - RNA, 19 nt, Homo sapiens
aagaccagaugugauuugu

SEQ ID NO: 67233 - RNA, 19 nt, Homo sapiens
agcaggagaucauuaagac

SEQ ID NO: 67234 - RNA, 19 nt, Homo sapiens
gaccagaugugauuuguua

SEQ ID NO: 67235 - RNA, 19 nt, Homo sapiens
ggacagaguugguguuugg

SEQ ID NO: 67236 - RNA, 19 nt, Homo sapiens
ggaagcaggagaucauuaa

SEQ ID NO: 67237 - RNA, 19 nt, Homo sapiens
caacaacggugacuuugag

SEQ ID NO: 67238 - RNA, 19 nt, Homo sapiens
gaagagcugcgcccugguu

SEQ ID NO: 67239 - RNA, 19 nt, Homo sapiens
cagcaggcaugguuugguu

SEQ ID NO: 67240 - RNA, 19 nt, Homo sapiens
gcacgucauuggagaggau

SEQ ID NO: 67241 - RNA, 19 nt, Homo sapiens
cagugaagcuggcagacuu

SEQ ID NO: 67242 - RNA, 19 nt, Homo sapiens
ccagaugugauuuguuaaa

SEQ ID NO: 67243 - RNA, 19 nt, Homo sapiens
ggacggagcgagcagaucu

SEQ ID NO: 67244 - RNA, 19 nt, Homo sapiens
gcaagccuguggacaucug

SEQ ID NO: 67245 - RNA, 19 nt, Homo sapiens
ccaagaucaucaacaccaa

SEQ ID NO: 67246 - RNA, 19 nt, Homo sapiens
caaaggggcugcagugaag

SEQ ID NO: 67247 - RNA, 19 nt, Homo sapiens
ugacgacgacaaccacaaa

SEQ ID NO: 67248 - RNA, 19 nt, Homo sapiens
aacaagaccagaugugauu

SEQ ID NO: 67249 - RNA, 19 nt, Homo sapiens
uaccagcucuacgaggaua

SEQ ID NO: 67250 - RNA, 19 nt, Homo sapiens
caagaccagaugugauuug

SEQ ID NO: 67251 - RNA, 19 nt, Homo sapiens
agaaccugcuggccaagaa

SEQ ID NO: 67252 - RNA, 19 nt, Homo sapiens
acccagggcugaccucguu

SEQ ID NO: 67253 - RNA, 19 nt, Homo sapiens
cggaagcaggagaucauua

SEQ ID NO: 67254 - RNA, 19 nt, Homo sapiens
cgucacuccugaagccaaa

SEQ ID NO: 67255 - RNA, 19 nt, Homo sapiens
gaucaucaacaccaagaag

SEQ ID NO: 67256 - RNA, 19 nt, Homo sapiens
ggacuuccacagauucuac

SEQ ID NO: 67257 - RNA, 19 nt, Homo sapiens
ucaaccagaugcugaccau

SEQ ID NO: 67258 - RNA, 19 nt, Homo sapiens
gcagacuucggccuagcua

SEQ ID NO: 67259 - RNA, 19 nt, Homo sapiens
cagccaagaucaucaacac

SEQ ID NO: 67260 - RNA, 19 nt, Homo sapiens
aaacaagaccagaugugau

SEQ ID NO: 67261 - RNA, 19 nt, Homo sapiens
acauccggcucacgcagua

SEQ ID NO: 67262 - RNA, 19 nt, Homo sapiens
agccagagaucaccagaag

SEQ ID NO: 67263 - RNA, 19 nt, Homo sapiens
ggacaccgucacuccugaa

SEQ ID NO: 67264 - RNA, 19 nt, Homo sapiens
ggacgaggaccagcacaag

SEQ ID NO: 67265 - RNA, 19 nt, Homo sapiens
gagccauccucaccaccau

SEQ ID NO: 67266 - RNA, 19 nt, Homo sapiens
gcaaaggggcugcagugaa

SEQ ID NO: 67267 - RNA, 19 nt, Homo sapiens
guucuccauugucaccaaa

SEQ ID NO: 67268 - RNA, 19 nt, Homo sapiens
ucugaagcauuccaacauc

SEQ ID NO: 67269 - RNA, 19 nt, Homo sapiens
ccagagaucaccagaagcu

SEQ ID NO: 67270 - RNA, 19 nt, Homo sapiens
aagcaggagaucauuaaga

SEQ ID NO: 67271 - RNA, 19 nt, Homo sapiens
gcaggcaugguuugguuuc

SEQ ID NO: 67272 - RNA, 19 nt, Homo sapiens
ggucuucgaucuggucacu

SEQ ID NO: 67273 - RNA, 19 nt, Homo sapiens
ggcagaacgugcacuucca

SEQ ID NO: 67274 - RNA, 19 nt, Homo sapiens
gaagcaggagaucauuaag

SEQ ID NO: 67275 - RNA, 19 nt, Homo sapiens
ccgaggagggcuuccacua

SEQ ID NO: 67276 - RNA, 19 nt, Homo sapiens
gcaccggccaugaguaugc

SEQ ID NO: 67277 - RNA, 19 nt, Homo sapiens
caucgaggccgucaacaac

SEQ ID NO: 67278 - RNA, 19 nt, Homo sapiens
uggcaagccuguggacauc

SEQ ID NO: 67279 - RNA, 19 nt, Homo sapiens
gaguaugcagccaagauca

SEQ ID NO: 67280 - RNA, 19 nt, Homo sapiens
gugccugugucugcagaaa

SEQ ID NO: 67281 - RNA, 19 nt, Homo sapiens
gccugccugucgcauguuu

SEQ ID NO: 67282 - RNA, 19 nt, Homo sapiens
gacuguggagugucugaaa

SEQ ID NO: 67283 - RNA, 19 nt, Homo sapiens
gagaaccugcuggccaaga

SEQ ID NO: 67284 - RNA, 19 nt, Homo sapiens
aagaccagaugugauuugu

SEQ ID NO: 67285 - RNA, 19 nt, Homo sapiens
agcaggagaucauuaagac

SEQ ID NO: 67286 - RNA, 19 nt, Homo sapiens
ccaaagaccucaucaauaa

SEQ ID NO: 67287 - RNA, 19 nt, Homo sapiens
gcuagaaucugccgucuuu

SEQ ID NO: 67288 - RNA, 19 nt, Homo sapiens
gaagaaaccagauggagua

SEQ ID NO: 67289 - RNA, 19 nt, Homo sapiens
gaucaaggcuggagcuuau

SEQ ID NO: 67290 - RNA, 19 nt, Homo sapiens
gaucgaagcuaucaacaau

SEQ ID NO: 67291 - RNA, 19 nt, Homo sapiens
guaaagauccuuauggaaa

SEQ ID NO: 67292 - RNA, 19 nt, Homo sapiens
gaggugaacuguuugaaga

SEQ ID NO: 67293 - RNA, 19 nt, Homo sapiens
gaaaccagauggaguaaag

SEQ ID NO: 67294 - RNA, 19 nt, Homo sapiens
gaagagggcuuucacuacu

SEQ ID NO: 67295 - RNA, 19 nt, Homo sapiens
aaaccaauccacacuauua

SEQ ID NO: 67296 - RNA, 19 nt, Homo sapiens
guaaaggagucaacugaga

SEQ ID NO: 67297 - RNA, 19 nt, Homo sapiens
caaagucacugaacaacug

SEQ ID NO: 67298 - RNA, 19 nt, Homo sapiens
gggagcagcugugaaauug

SEQ ID NO: 67299 - RNA, 19 nt, Homo sapiens
caaagacaaugcagucaga

SEQ ID NO: 67300 - RNA, 19 nt, Homo sapiens
gaaaguggcagaauguuca

SEQ ID NO: 67301 - RNA, 19 nt, Homo sapiens
gcacgaaagcaagagauua

SEQ ID NO: 67302 - RNA, 19 nt, Homo sapiens
gccaagaguuuguugaaga

SEQ ID NO: 67303 - RNA, 19 nt, Homo sapiens
gauggaaaguggcagaaug

SEQ ID NO: 67304 - RNA, 19 nt, Homo sapiens
gccaaagaccucaucaaua

SEQ ID NO: 67305 - RNA, 19 nt, Homo sapiens
caacuaugcuggcuacaag

SEQ ID NO: 67306 - RNA, 19 nt, Homo sapiens
gaaagccaguggauaugug

SEQ ID NO: 67307 - RNA, 19 nt, Homo sapiens
caagggagcagcugugaaa

SEQ ID NO: 67308 - RNA, 19 nt, Homo sapiens
ucaccuaaauggcauaguu

SEQ ID NO: 67309 - RNA, 19 nt, Homo sapiens
ucacauaugggucuucuaa

SEQ ID NO: 67310 - RNA, 19 nt, Homo sapiens
ccaagaguuuguugaagaa

SEQ ID NO: 67311 - RNA, 19 nt, Homo sapiens
guagacugcuugaagaaau

SEQ ID NO: 67312 - RNA, 19 nt, Homo sapiens
acaagaauaugcugccaaa

SEQ ID NO: 67313 - RNA, 19 nt, Homo sapiens
ccauggaucugucaacguu

SEQ ID NO: 67314 - RNA, 19 nt, Homo sapiens
guuaaucauugucaccuaa

SEQ ID NO: 67315 - RNA, 19 nt, Homo sapiens
gaagcacccuaauauugug

SEQ ID NO: 67316 - RNA, 19 nt, Homo sapiens
auacaacaauugaggauga

SEQ ID NO: 67317 - RNA, 19 nt, Homo sapiens
ggugccaucuugacaacua

SEQ ID NO: 67318 - RNA, 19 nt, Homo sapiens
ugaacuguuugaagacaua

SEQ ID NO: 67319 - RNA, 19 nt, Homo sapiens
uaaagauccuuauggaaag

SEQ ID NO: 67320 - RNA, 19 nt, Homo sapiens
ggaugaagaccaacacaga

SEQ ID NO: 67321 - RNA, 19 nt, Homo sapiens
acauaugggucuucuaaau

SEQ ID NO: 67322 - RNA, 19 nt, Homo sapiens
gaaagcaagagauuaucaa

SEQ ID NO: 67323 - RNA, 19 nt, Homo sapiens
ggaugaagaugugaaagca

SEQ ID NO: 67324 - RNA, 19 nt, Homo sapiens
gaguaaaggagucaacuga

SEQ ID NO: 67325 - RNA, 19 nt, Homo sapiens
gaacaacugaucgaagcua

SEQ ID NO: 67326 - RNA, 19 nt, Homo sapiens
gaaagagaagcuagaaucu

SEQ ID NO: 67327 - RNA, 19 nt, Homo sapiens
auauuaggcucacacagua

SEQ ID NO: 67328 - RNA, 19 nt, Homo sapiens
gcaagagauuaucaaaguc

SEQ ID NO: 67329 - RNA, 19 nt, Homo sapiens
caagagaauacuacaguga

SEQ ID NO: 67330 - RNA, 19 nt, Homo sapiens
cuacuugguguuugauuua

SEQ ID NO: 67331 - RNA, 19 nt, Homo sapiens
cagaagagggcuuucacua

SEQ ID NO: 67332 - RNA, 19 nt, Homo sapiens
acuaaagggugccaucuug

SEQ ID NO: 67333 - RNA, 19 nt, Homo sapiens
cauaugggucuucuaaauu

SEQ ID NO: 67334 - RNA, 19 nt, Homo sapiens
cagcaggcgugguuugguu

SEQ ID NO: 67335 - RNA, 19 nt, Homo sapiens
ggugagaagauguaugaaa

SEQ ID NO: 67336 - RNA, 19 nt, Homo sapiens
ggaaaguggcagaauguuc

SEQ ID NO: 67337 - RNA, 19 nt, Homo sapiens
agcaagagauuaucaaagu

SEQ ID NO: 67338 - RNA, 19 nt, Homo sapiens
gaucaucagaaacuagaaa

SEQ ID NO: 67339 - RNA, 19 nt, Homo sapiens
gugagaagauguaugaaaa

SEQ ID NO: 67340 - RNA, 19 nt, Homo sapiens
gcugaugccagucauugua

SEQ ID NO: 67341 - RNA, 19 nt, Homo sapiens
uacuggaggugaacuguuu

SEQ ID NO: 67342 - RNA, 19 nt, Homo sapiens
gaaaauuccuacuggacaa

SEQ ID NO: 67343 - RNA, 19 nt, Homo sapiens
ucuaaacccucauguacau

SEQ ID NO: 67344 - RNA, 19 nt, Homo sapiens
caagagauuaucaaaguca

SEQ ID NO: 67345 - RNA, 19 nt, Homo sapiens
gcgacuucaugauagcaua

SEQ ID NO: 67346 - RNA, 19 nt, Homo sapiens
aaacaucuaaggccugaaa

SEQ ID NO: 67347 - RNA, 19 nt, Homo sapiens
acugagaguucaaauacaa

SEQ ID NO: 67348 - RNA, 19 nt, Homo sapiens
gcaguggaaugccaaagac

SEQ ID NO: 67349 - RNA, 19 nt, Homo sapiens
ugaagcacccuaauauugu

SEQ ID NO: 67350 - RNA, 19 nt, Homo sapiens
guggugagaagauguauga

SEQ ID NO: 67351 - RNA, 19 nt, Homo sapiens
auaaaccaauccacacuau

SEQ ID NO: 67352 - RNA, 19 nt, Homo sapiens
uggcacaccuggauaucuu

SEQ ID NO: 67353 - RNA, 19 nt, Homo sapiens
cagauucuagaaaguguua

SEQ ID NO: 67354 - RNA, 19 nt, Homo sapiens
guauacagcagauucuaga

SEQ ID NO: 67355 - RNA, 19 nt, Homo sapiens
gaauaugcugccaaaauua

SEQ ID NO: 67356 - RNA, 19 nt, Homo sapiens
agaauaugcugccaaaauu

SEQ ID NO: 67357 - RNA, 19 nt, Homo sapiens
ccaauccacacuauuauuc

SEQ ID NO: 67358 - RNA, 19 nt, Homo sapiens
uagacugcuugaagaaauu

SEQ ID NO: 67359 - RNA, 19 nt, Homo sapiens
caaagaccucaucaauaaa

SEQ ID NO: 67360 - RNA, 19 nt, Homo sapiens
ggaaagccaguggauaugu

SEQ ID NO: 67361 - RNA, 19 nt, Homo sapiens
ccugaagccugagaauuug

SEQ ID NO: 67362 - RNA, 19 nt, Homo sapiens
agaaagagaagcuagaauc

SEQ ID NO: 67363 - RNA, 19 nt, Homo sapiens
caauugaggaugaagaugu

SEQ ID NO: 67364 - RNA, 19 nt, Homo sapiens
gcacugaagcacccaugga

SEQ ID NO: 67365 - RNA, 19 nt, Homo sapiens
ggugacuccugaagccaaa

SEQ ID NO: 67366 - RNA, 19 nt, Homo sapiens
ggcuggagcuuaugauuuu

SEQ ID NO: 67367 - RNA, 19 nt, Homo sapiens
ucgaagcuaucaacaaugg

SEQ ID NO: 67368 - RNA, 19 nt, Homo sapiens
caacaauugaggaugaaga

SEQ ID NO: 67369 - RNA, 19 nt, Homo sapiens
uugaagcacccuaauauug

SEQ ID NO: 67370 - RNA, 19 nt, Homo sapiens
caccgauucuacuuugaaa

SEQ ID NO: 67371 - RNA, 19 nt, Homo sapiens
acccaggccuuacugcuuu

SEQ ID NO: 67372 - RNA, 19 nt, Homo sapiens
cgaaagcaagagauuauca

SEQ ID NO: 67373 - RNA, 19 nt, Homo sapiens
cauguggugucauucucua

SEQ ID NO: 67374 - RNA, 19 nt, Homo sapiens
agacauaguggcaagagaa

SEQ ID NO: 67375 - RNA, 19 nt, Homo sapiens
cugaagcuuuggguaauuu

SEQ ID NO: 67376 - RNA, 19 nt, Homo sapiens
uaucaaagucacugaacaa

SEQ ID NO: 67377 - RNA, 19 nt, Homo sapiens
guggugucauucucuauau

SEQ ID NO: 67378 - RNA, 19 nt, Homo sapiens
gugggcauguggugucauu

SEQ ID NO: 67379 - RNA, 19 nt, Homo sapiens
ugaugccagucauuguaua

SEQ ID NO: 67380 - RNA, 19 nt, Homo sapiens
gaaacuagaaagagaagcu

SEQ ID NO: 67381 - RNA, 19 nt, Homo sapiens
caucaagccacccuguauu

SEQ ID NO: 67382 - RNA, 19 nt, Homo sapiens
cacgaaagcaagagauuau

SEQ ID NO: 67383 - RNA, 19 nt, Homo sapiens
agacaaugcagucagaaga

SEQ ID NO: 67384 - RNA, 19 nt, Homo sapiens
uauauuaggcucacacagu

SEQ ID NO: 67385 - RNA, 19 nt, Homo sapiens
ugaaagcacgaaagcaaga

SEQ ID NO: 67386 - RNA, 19 nt, Homo sapiens
ccaaagaccucaucaauaa

SEQ ID NO: 67387 - RNA, 19 nt, Homo sapiens
gcuagaaucugccgucuuu

SEQ ID NO: 67388 - RNA, 19 nt, Homo sapiens
gaagaaaccagauggagua

SEQ ID NO: 67389 - RNA, 19 nt, Homo sapiens
gaucaaggcuggagcuuau

SEQ ID NO: 67390 - RNA, 19 nt, Homo sapiens
gaucgaagcuaucaacaau

SEQ ID NO: 67391 - RNA, 19 nt, Homo sapiens
guaaagauccuuauggaaa

SEQ ID NO: 67392 - RNA, 19 nt, Homo sapiens
gaggugaacuguuugaaga

SEQ ID NO: 67393 - RNA, 19 nt, Homo sapiens
ggucagcuccuucuacuua

SEQ ID NO: 67394 - RNA, 19 nt, Homo sapiens
gaaaccagauggaguaaag

SEQ ID NO: 67395 - RNA, 19 nt, Homo sapiens
gaagagggcuuucacuacu

SEQ ID NO: 67396 - RNA, 19 nt, Homo sapiens
caacaguacccaucaagua

SEQ ID NO: 67397 - RNA, 19 nt, Homo sapiens
aaaccaauccacacuauua

SEQ ID NO: 67398 - RNA, 19 nt, Homo sapiens
guaaaggagucaacugaga

SEQ ID NO: 67399 - RNA, 19 nt, Homo sapiens
caaagucacugaacaacug

SEQ ID NO: 67400 - RNA, 19 nt, Homo sapiens
gggagcagcugugaaauug

SEQ ID NO: 67401 - RNA, 19 nt, Homo sapiens
caaagacaaugcagucaga

SEQ ID NO: 67402 - RNA, 19 nt, Homo sapiens
gaaaguggcagaauguuca

SEQ ID NO: 67403 - RNA, 19 nt, Homo sapiens
gcacgaaagcaagagauua

SEQ ID NO: 67404 - RNA, 19 nt, Homo sapiens
gccaagaguuuguugaaga

SEQ ID NO: 67405 - RNA, 19 nt, Homo sapiens
gauggaaaguggcagaaug

SEQ ID NO: 67406 - RNA, 19 nt, Homo sapiens
gccaaagaccucaucaaua

SEQ ID NO: 67407 - RNA, 19 nt, Homo sapiens
caacuaugcuggcuacaag

SEQ ID NO: 67408 - RNA, 19 nt, Homo sapiens
gaaagccaguggauaugug

SEQ ID NO: 67409 - RNA, 19 nt, Homo sapiens
caagggagcagcugugaaa

SEQ ID NO: 67410 - RNA, 19 nt, Homo sapiens
ucaccuaaauggcauaguu

SEQ ID NO: 67411 - RNA, 19 nt, Homo sapiens
ccaagaguuuguugaagaa

SEQ ID NO: 67412 - RNA, 19 nt, Homo sapiens
guagacugcuugaagaaau

SEQ ID NO: 67413 - RNA, 19 nt, Homo sapiens
acaagaauaugcugccaaa

SEQ ID NO: 67414 - RNA, 19 nt, Homo sapiens
ccauggaucugucaacguu

SEQ ID NO: 67415 - RNA, 19 nt, Homo sapiens
guuaaucauugucaccuaa

SEQ ID NO: 67416 - RNA, 19 nt, Homo sapiens
gaagcacccuaauauugug

SEQ ID NO: 67417 - RNA, 19 nt, Homo sapiens
auacaacaauugaggauga

SEQ ID NO: 67418 - RNA, 19 nt, Homo sapiens
ggugccaucuugacaacua

SEQ ID NO: 67419 - RNA, 19 nt, Homo sapiens
ugaacuguuugaagacaua

SEQ ID NO: 67420 - RNA, 19 nt, Homo sapiens
uaaagauccuuauggaaag

SEQ ID NO: 67421 - RNA, 19 nt, Homo sapiens
ggaugaagaccaacacaga

SEQ ID NO: 67422 - RNA, 19 nt, Homo sapiens
gaaagcaagagauuaucaa

SEQ ID NO: 67423 - RNA, 19 nt, Homo sapiens
ggaugaagaugugaaagca

SEQ ID NO: 67424 - RNA, 19 nt, Homo sapiens
gaguaaaggagucaacuga

SEQ ID NO: 67425 - RNA, 19 nt, Homo sapiens
uaaaugccuucacgggaaa

SEQ ID NO: 67426 - RNA, 19 nt, Homo sapiens
gaacaacugaucgaagcua

SEQ ID NO: 67427 - RNA, 19 nt, Homo sapiens
gaaagagaagcuagaaucu

SEQ ID NO: 67428 - RNA, 19 nt, Homo sapiens
auauuaggcucacacagua

SEQ ID NO: 67429 - RNA, 19 nt, Homo sapiens
gcaagagauuaucaaaguc

SEQ ID NO: 67430 - RNA, 19 nt, Homo sapiens
caagagaauacuacaguga

SEQ ID NO: 67431 - RNA, 19 nt, Homo sapiens
cuacuugguguuugauuua

SEQ ID NO: 67432 - RNA, 19 nt, Homo sapiens
cagaagagggcuuucacua

SEQ ID NO: 67433 - RNA, 19 nt, Homo sapiens
acuaaagggugccaucuug

SEQ ID NO: 67434 - RNA, 19 nt, Homo sapiens
cagcaggcgugguuugguu

SEQ ID NO: 67435 - RNA, 19 nt, Homo sapiens
ggugagaagauguaugaaa

SEQ ID NO: 67436 - RNA, 19 nt, Homo sapiens
gcuaguaguugguuacacu

SEQ ID NO: 67437 - RNA, 19 nt, Homo sapiens
ggaaaguggcagaauguuc

SEQ ID NO: 67438 - RNA, 19 nt, Homo sapiens
agcaagagauuaucaaagu

SEQ ID NO: 67439 - RNA, 19 nt, Homo sapiens
gaucaucagaaacuagaaa

SEQ ID NO: 67440 - RNA, 19 nt, Homo sapiens
gugagaagauguaugaaaa

SEQ ID NO: 67441 - RNA, 19 nt, Homo sapiens
guuaauagcaugguauaug

SEQ ID NO: 67442 - RNA, 19 nt, Homo sapiens
gcugaugccagucauugua

SEQ ID NO: 67443 - RNA, 19 nt, Homo sapiens
uacuggaggugaacuguuu

SEQ ID NO: 67444 - RNA, 19 nt, Homo sapiens
gaaaauuccuacuggacaa

SEQ ID NO: 67445 - RNA, 19 nt, Homo sapiens
guaguugguuacacugaug

SEQ ID NO: 67446 - RNA, 19 nt, Homo sapiens
ucuaaacccucauguacau

SEQ ID NO: 67447 - RNA, 19 nt, Homo sapiens
caagagauuaucaaaguca

SEQ ID NO: 67448 - RNA, 19 nt, Homo sapiens
gcgacuucaugauagcaua

SEQ ID NO: 67449 - RNA, 19 nt, Homo sapiens
acugagaguucaaauacaa

SEQ ID NO: 67450 - RNA, 19 nt, Homo sapiens
gcaguggaaugccaaagac

SEQ ID NO: 67451 - RNA, 19 nt, Homo sapiens
ugaagcacccuaauauugu

SEQ ID NO: 67452 - RNA, 19 nt, Homo sapiens
auaaaccaauccacacuau

SEQ ID NO: 67453 - RNA, 19 nt, Homo sapiens
uggcacaccuggauaucuu

SEQ ID NO: 67454 - RNA, 19 nt, Homo sapiens
cagauucuagaaaguguua

SEQ ID NO: 67455 - RNA, 19 nt, Homo sapiens
guauacagcagauucuaga

SEQ ID NO: 67456 - RNA, 19 nt, Homo sapiens
guggugagaagauguauga

SEQ ID NO: 67457 - RNA, 19 nt, Homo sapiens
gaauaugcugccaaaauua

SEQ ID NO: 67458 - RNA, 19 nt, Homo sapiens
agaauaugcugccaaaauu

SEQ ID NO: 67459 - RNA, 19 nt, Homo sapiens
guacccaucaaguaaauau

SEQ ID NO: 67460 - RNA, 19 nt, Homo sapiens
ccaauccacacuauuauuc

SEQ ID NO: 67461 - RNA, 19 nt, Homo sapiens
uagacugcuugaagaaauu

SEQ ID NO: 67462 - RNA, 19 nt, Homo sapiens
caaagaccucaucaauaaa

SEQ ID NO: 67463 - RNA, 19 nt, Homo sapiens
ggaaagccaguggauaugu

SEQ ID NO: 67464 - RNA, 19 nt, Homo sapiens
ccugaagccugagaauuug

SEQ ID NO: 67465 - RNA, 19 nt, Homo sapiens
agaaagagaagcuagaauc

SEQ ID NO: 67466 - RNA, 19 nt, Homo sapiens
caauugaggaugaagaugu

SEQ ID NO: 67467 - RNA, 19 nt, Homo sapiens
gcacugaagcacccaugga

SEQ ID NO: 67468 - RNA, 19 nt, Homo sapiens
ggugacuccugaagccaaa

SEQ ID NO: 67469 - RNA, 19 nt, Homo sapiens
ggcuggagcuuaugauuuu

SEQ ID NO: 67470 - RNA, 19 nt, Homo sapiens
gucagcuucuuuguuaaua

SEQ ID NO: 67471 - RNA, 19 nt, Homo sapiens
ucgaagcuaucaacaaugg

SEQ ID NO: 67472 - RNA, 19 nt, Homo sapiens
caacaauugaggaugaaga

SEQ ID NO: 67473 - RNA, 19 nt, Homo sapiens
uugaagcacccuaauauug

SEQ ID NO: 67474 - RNA, 19 nt, Homo sapiens
caccgauucuacuuugaaa

SEQ ID NO: 67475 - RNA, 19 nt, Homo sapiens
acccaggccuuacugcuuu

SEQ ID NO: 67476 - RNA, 19 nt, Homo sapiens
cgaaagcaagagauuauca

SEQ ID NO: 67477 - RNA, 19 nt, Homo sapiens
cauguggugucauucucua

SEQ ID NO: 67478 - RNA, 19 nt, Homo sapiens
agacauaguggcaagagaa

SEQ ID NO: 67479 - RNA, 19 nt, Homo sapiens
cagcuucuuuguuaauaca

SEQ ID NO: 67480 - RNA, 19 nt, Homo sapiens
cugaagcuuuggguaauuu

SEQ ID NO: 67481 - RNA, 19 nt, Homo sapiens
uaucaaagucacugaacaa

SEQ ID NO: 67482 - RNA, 19 nt, Homo sapiens
guggugucauucucuauau

SEQ ID NO: 67483 - RNA, 19 nt, Homo sapiens
gugggcauguggugucauu

SEQ ID NO: 67484 - RNA, 19 nt, Homo sapiens
ugaugccagucauuguaua

SEQ ID NO: 67485 - RNA, 19 nt, Homo sapiens
gaaacuagaaagagaagcu

SEQ ID NO: 67486 - RNA, 19 nt, Homo sapiens
ccaaagaccucaucaauaa

SEQ ID NO: 67487 - RNA, 19 nt, Homo sapiens
guaaaggacugauugauau

SEQ ID NO: 67488 - RNA, 19 nt, Homo sapiens
gcuagaaucugccgucuuu

SEQ ID NO: 67489 - RNA, 19 nt, Homo sapiens
gaagaaaccagauggagua

SEQ ID NO: 67490 - RNA, 19 nt, Homo sapiens
gaucaaggcuggagcuuau

SEQ ID NO: 67491 - RNA, 19 nt, Homo sapiens
ggagguauuugcauuguuu

SEQ ID NO: 67492 - RNA, 19 nt, Homo sapiens
gaucgaagcuaucaacaau

SEQ ID NO: 67493 - RNA, 19 nt, Homo sapiens
gcacuaagaugugaggaaa

SEQ ID NO: 67494 - RNA, 19 nt, Homo sapiens
guaaagauccuuauggaaa

SEQ ID NO: 67495 - RNA, 19 nt, Homo sapiens
guagauggguugaagcuuu

SEQ ID NO: 67496 - RNA, 19 nt, Homo sapiens
ucaaaucugugaucucuuu

SEQ ID NO: 67497 - RNA, 19 nt, Homo sapiens
gaggugaacuguuugaaga

SEQ ID NO: 67498 - RNA, 19 nt, Homo sapiens
gaaaccagauggaguaaag

SEQ ID NO: 67499 - RNA, 19 nt, Homo sapiens
guacaacucuucaucaagu

SEQ ID NO: 67500 - RNA, 19 nt, Homo sapiens
gguaaaggacugauugaua

SEQ ID NO: 67501 - RNA, 19 nt, Homo sapiens
gaagagggcuuucacuacu

SEQ ID NO: 67502 - RNA, 19 nt, Homo sapiens
caacaguacccaucaagua

SEQ ID NO: 67503 - RNA, 19 nt, Homo sapiens
aaaccaauccacacuauua

SEQ ID NO: 67504 - RNA, 19 nt, Homo sapiens
guaaaggagucaacugaga

SEQ ID NO: 67505 - RNA, 19 nt, Homo sapiens
gaauagaagugaaauuugc

SEQ ID NO: 67506 - RNA, 19 nt, Homo sapiens
caaagucacugaacaacug

SEQ ID NO: 67507 - RNA, 19 nt, Homo sapiens
ucacaucauuucugaguuu

SEQ ID NO: 67508 - RNA, 19 nt, Homo sapiens
guuagaauuucccaguuua

SEQ ID NO: 67509 - RNA, 19 nt, Homo sapiens
gaaaguagaagcaagaauc

SEQ ID NO: 67510 - RNA, 19 nt, Homo sapiens
gggagcagcugugaaauug

SEQ ID NO: 67511 - RNA, 19 nt, Homo sapiens
uagagaggcuuacaaaugu

SEQ ID NO: 67512 - RNA, 19 nt, Homo sapiens
caauuaaagugggaugaua

SEQ ID NO: 67513 - RNA, 19 nt, Homo sapiens
uuagaacucuuugcuguua

SEQ ID NO: 67514 - RNA, 19 nt, Homo sapiens
gaaugacaguuguaagaga

SEQ ID NO: 67515 - RNA, 19 nt, Homo sapiens
caaagacaaugcagucaga

SEQ ID NO: 67516 - RNA, 19 nt, Homo sapiens
gcaagaaucaguugguuug

SEQ ID NO: 67517 - RNA, 19 nt, Homo sapiens
gaaaguggcagaauguuca

SEQ ID NO: 67518 - RNA, 19 nt, Homo sapiens
gcacgaaagcaagagauua

SEQ ID NO: 67519 - RNA, 19 nt, Homo sapiens
gccaagaguuuguugaaga

SEQ ID NO: 67520 - RNA, 19 nt, Homo sapiens
ucaucaaguuucucuguua

SEQ ID NO: 67521 - RNA, 19 nt, Homo sapiens
gauggaaaguggcagaaug

SEQ ID NO: 67522 - RNA, 19 nt, Homo sapiens
gccaaagaccucaucaaua

SEQ ID NO: 67523 - RNA, 19 nt, Homo sapiens
ggaaucuccaucauuguua

SEQ ID NO: 67524 - RNA, 19 nt, Homo sapiens
caacuaugcuggcuacaag

SEQ ID NO: 67525 - RNA, 19 nt, Homo sapiens
gaaagccaguggauaugug

SEQ ID NO: 67526 - RNA, 19 nt, Homo sapiens
caagggagcagcugugaaa

SEQ ID NO: 67527 - RNA, 19 nt, Homo sapiens
uagcuucucucuugaauca

SEQ ID NO: 67528 - RNA, 19 nt, Homo sapiens
caucaaguuucucuguuaa

SEQ ID NO: 67529 - RNA, 19 nt, Homo sapiens
ucaccuaaauggcauaguu

SEQ ID NO: 67530 - RNA, 19 nt, Homo sapiens
ccaagaguuuguugaagaa

SEQ ID NO: 67531 - RNA, 19 nt, Homo sapiens
guagacugcuugaagaaau

SEQ ID NO: 67532 - RNA, 19 nt, Homo sapiens
acaagaauaugcugccaaa

SEQ ID NO: 67533 - RNA, 19 nt, Homo sapiens
gugaagguccuacauguaa

SEQ ID NO: 67534 - RNA, 19 nt, Homo sapiens
ccauggaucugucaacguu

SEQ ID NO: 67535 - RNA, 19 nt, Homo sapiens
uaacuuagcaugugguguu

SEQ ID NO: 67536 - RNA, 19 nt, Homo sapiens
gguugaagcuuuucugaua

SEQ ID NO: 67537 - RNA, 19 nt, Homo sapiens
auacacccaugcuaaauuu

SEQ ID NO: 67538 - RNA, 19 nt, Homo sapiens
guuaaucauugucaccuaa

SEQ ID NO: 67539 - RNA, 19 nt, Homo sapiens
gaagcacccuaauauugug

SEQ ID NO: 67540 - RNA, 19 nt, Homo sapiens
cauguuaaccugccaauga

SEQ ID NO: 67541 - RNA, 19 nt, Homo sapiens
auacaacaauugaggauga

SEQ ID NO: 67542 - RNA, 19 nt, Homo sapiens
gaaucuccaucauuguuau

SEQ ID NO: 67543 - RNA, 19 nt, Homo sapiens
ggugccaucuugacaacua

SEQ ID NO: 67544 - RNA, 19 nt, Homo sapiens
ugaacuguuugaagacaua

SEQ ID NO: 67545 - RNA, 19 nt, Homo sapiens
guuaauacacccaugcuaa

SEQ ID NO: 67546 - RNA, 19 nt, Homo sapiens
uaaagauccuuauggaaag

SEQ ID NO: 67547 - RNA, 19 nt, Homo sapiens
ggaaugaaagggucacuuc

SEQ ID NO: 67548 - RNA, 19 nt, Homo sapiens
gauguuccacacaaacuua

SEQ ID NO: 67549 - RNA, 19 nt, Homo sapiens
ggaugaagaccaacacaga

SEQ ID NO: 67550 - RNA, 19 nt, Homo sapiens
ggaggauaccaacuugaua

SEQ ID NO: 67551 - RNA, 19 nt, Homo sapiens
uaacuauguuggagguauu

SEQ ID NO: 67552 - RNA, 19 nt, Homo sapiens
agaaucaguugguuugcua

SEQ ID NO: 67553 - RNA, 19 nt, Homo sapiens
gaaagcaagagauuaucaa

SEQ ID NO: 67554 - RNA, 19 nt, Homo sapiens
ggaugaagaugugaaagca

SEQ ID NO: 67555 - RNA, 19 nt, Homo sapiens
gaguaaaggagucaacuga

SEQ ID NO: 67556 - RNA, 19 nt, Homo sapiens
aaacaacccuuccucuuuu

SEQ ID NO: 67557 - RNA, 19 nt, Homo sapiens
gaacaacugaucgaagcua

SEQ ID NO: 67558 - RNA, 19 nt, Homo sapiens
gaaagagaagcuagaaucu

SEQ ID NO: 67559 - RNA, 19 nt, Homo sapiens
ccaggaggauaccaacuug

SEQ ID NO: 67560 - RNA, 19 nt, Homo sapiens
caaacuguguaaacuggaa

SEQ ID NO: 67561 - RNA, 19 nt, Homo sapiens
auauuaggcucacacagua

SEQ ID NO: 67562 - RNA, 19 nt, Homo sapiens
gcaagagauuaucaaaguc

SEQ ID NO: 67563 - RNA, 19 nt, Homo sapiens
caagagaauacuacaguga

SEQ ID NO: 67564 - RNA, 19 nt, Homo sapiens
acuaagaugugaggaaauu

SEQ ID NO: 67565 - RNA, 19 nt, Homo sapiens
caucucaccucucuguguu

SEQ ID NO: 67566 - RNA, 19 nt, Homo sapiens
uuagagaggcuuacaaaug

SEQ ID NO: 67567 - RNA, 19 nt, Homo sapiens
gggaugauaugugggcaaa

SEQ ID NO: 67568 - RNA, 19 nt, Homo sapiens
cuacuugguguuugauuua

SEQ ID NO: 67569 - RNA, 19 nt, Homo sapiens
cagaagagggcuuucacua

SEQ ID NO: 67570 - RNA, 19 nt, Homo sapiens
gaguuagaauuucccaguu

SEQ ID NO: 67571 - RNA, 19 nt, Homo sapiens
ggucacuucugcaucauca

SEQ ID NO: 67572 - RNA, 19 nt, Homo sapiens
ucaaguuucucuguuaaug

SEQ ID NO: 67573 - RNA, 19 nt, Homo sapiens
acuaaagggugccaucuug

SEQ ID NO: 67574 - RNA, 19 nt, Homo sapiens
gcaaguuccuccugugacu

SEQ ID NO: 67575 - RNA, 19 nt, Homo sapiens
ggugagaagauguaugaaa

SEQ ID NO: 67576 - RNA, 19 nt, Homo sapiens
cagcaggcgugguuugguu

SEQ ID NO: 67577 - RNA, 19 nt, Homo sapiens
guaauucacaguccucaga

SEQ ID NO: 67578 - RNA, 19 nt, Homo sapiens
ggaaaguggcagaauguuc

SEQ ID NO: 67579 - RNA, 19 nt, Homo sapiens
agcaagagauuaucaaagu

SEQ ID NO: 67580 - RNA, 19 nt, Homo sapiens
gugagaagauguaugaaaa

SEQ ID NO: 67581 - RNA, 19 nt, Homo sapiens
gaucaucagaaacuagaaa

SEQ ID NO: 67582 - RNA, 19 nt, Homo sapiens
aaagggaaauguccuaggu

SEQ ID NO: 67583 - RNA, 19 nt, Homo sapiens
gcuaguagugugugagaaa

SEQ ID NO: 67584 - RNA, 19 nt, Homo sapiens
gaaaauuccuacuggacaa

SEQ ID NO: 67585 - RNA, 19 nt, Homo sapiens
gcugaugccagucauugua

SEQ ID NO: 67586 - RNA, 19 nt, Homo sapiens
ccaaagaccucaucaauaa

SEQ ID NO: 67587 - RNA, 19 nt, Homo sapiens
guaaaggacugauugauau

SEQ ID NO: 67588 - RNA, 19 nt, Homo sapiens
gcuagaaucugccgucuuu

SEQ ID NO: 67589 - RNA, 19 nt, Homo sapiens
gaagaaaccagauggagua

SEQ ID NO: 67590 - RNA, 19 nt, Homo sapiens
gaucaaggcuggagcuuau

SEQ ID NO: 67591 - RNA, 19 nt, Homo sapiens
ggagguauuugcauuguuu

SEQ ID NO: 67592 - RNA, 19 nt, Homo sapiens
gaucgaagcuaucaacaau

SEQ ID NO: 67593 - RNA, 19 nt, Homo sapiens
gcacuaagaugugaggaaa

SEQ ID NO: 67594 - RNA, 19 nt, Homo sapiens
guaaagauccuuauggaaa

SEQ ID NO: 67595 - RNA, 19 nt, Homo sapiens
guagauggguugaagcuuu

SEQ ID NO: 67596 - RNA, 19 nt, Homo sapiens
ucaaaucugugaucucuuu

SEQ ID NO: 67597 - RNA, 19 nt, Homo sapiens
gaggugaacuguuugaaga

SEQ ID NO: 67598 - RNA, 19 nt, Homo sapiens
gaaaccagauggaguaaag

SEQ ID NO: 67599 - RNA, 19 nt, Homo sapiens
guacaacucuucaucaagu

SEQ ID NO: 67600 - RNA, 19 nt, Homo sapiens
gguaaaggacugauugaua

SEQ ID NO: 67601 - RNA, 19 nt, Homo sapiens
gaagagggcuuucacuacu

SEQ ID NO: 67602 - RNA, 19 nt, Homo sapiens
aaaccaauccacacuauua

SEQ ID NO: 67603 - RNA, 19 nt, Homo sapiens
guaaaggagucaacugaga

SEQ ID NO: 67604 - RNA, 19 nt, Homo sapiens
gaauagaagugaaauuugc

SEQ ID NO: 67605 - RNA, 19 nt, Homo sapiens
caaagucacugaacaacug

SEQ ID NO: 67606 - RNA, 19 nt, Homo sapiens
ucacaucauuucugaguuu

SEQ ID NO: 67607 - RNA, 19 nt, Homo sapiens
guuagaauuucccaguuua

SEQ ID NO: 67608 - RNA, 19 nt, Homo sapiens
gaaaguagaagcaagaauc

SEQ ID NO: 67609 - RNA, 19 nt, Homo sapiens
gggagcagcugugaaauug

SEQ ID NO: 67610 - RNA, 19 nt, Homo sapiens
uagagaggcuuacaaaugu

SEQ ID NO: 67611 - RNA, 19 nt, Homo sapiens
caauuaaagugggaugaua

SEQ ID NO: 67612 - RNA, 19 nt, Homo sapiens
uuagaacucuuugcuguua

SEQ ID NO: 67613 - RNA, 19 nt, Homo sapiens
gaaugacaguuguaagaga

SEQ ID NO: 67614 - RNA, 19 nt, Homo sapiens
caaagacaaugcagucaga

SEQ ID NO: 67615 - RNA, 19 nt, Homo sapiens
gcaagaaucaguugguuug

SEQ ID NO: 67616 - RNA, 19 nt, Homo sapiens
gaaaguggcagaauguuca

SEQ ID NO: 67617 - RNA, 19 nt, Homo sapiens
caacaguacccaucaacua

SEQ ID NO: 67618 - RNA, 19 nt, Homo sapiens
gcacgaaagcaagagauua

SEQ ID NO: 67619 - RNA, 19 nt, Homo sapiens
gccaagaguuuguugaaga

SEQ ID NO: 67620 - RNA, 19 nt, Homo sapiens
ucaucaaguuucucuguua

SEQ ID NO: 67621 - RNA, 19 nt, Homo sapiens
gauggaaaguggcagaaug

SEQ ID NO: 67622 - RNA, 19 nt, Homo sapiens
gccaaagaccucaucaaua

SEQ ID NO: 67623 - RNA, 19 nt, Homo sapiens
ggaaucuccaucauuguua

SEQ ID NO: 67624 - RNA, 19 nt, Homo sapiens
caacuaugcuggcuacaag

SEQ ID NO: 67625 - RNA, 19 nt, Homo sapiens
gaaagccaguggauaugug

SEQ ID NO: 67626 - RNA, 19 nt, Homo sapiens
caagggagcagcugugaaa

SEQ ID NO: 67627 - RNA, 19 nt, Homo sapiens
uagcuucucucuugaauca

SEQ ID NO: 67628 - RNA, 19 nt, Homo sapiens
caucaaguuucucuguuaa

SEQ ID NO: 67629 - RNA, 19 nt, Homo sapiens
ucaccuaaauggcauaguu

SEQ ID NO: 67630 - RNA, 19 nt, Homo sapiens
ccaagaguuuguugaagaa

SEQ ID NO: 67631 - RNA, 19 nt, Homo sapiens
guagacugcuugaagaaau

SEQ ID NO: 67632 - RNA, 19 nt, Homo sapiens
acaagaauaugcugccaaa

SEQ ID NO: 67633 - RNA, 19 nt, Homo sapiens
gugaagguccuacauguaa

SEQ ID NO: 67634 - RNA, 19 nt, Homo sapiens
ccauggaucugucaacguu

SEQ ID NO: 67635 - RNA, 19 nt, Homo sapiens
uaacuuagcaugugguguu

SEQ ID NO: 67636 - RNA, 19 nt, Homo sapiens
gguugaagcuuuucugaua

SEQ ID NO: 67637 - RNA, 19 nt, Homo sapiens
guuaaucauugucaccuaa

SEQ ID NO: 67638 - RNA, 19 nt, Homo sapiens
gaagcacccuaauauugug

SEQ ID NO: 67639 - RNA, 19 nt, Homo sapiens
cauguuaaccugccaauga

SEQ ID NO: 67640 - RNA, 19 nt, Homo sapiens
auacaacaauugaggauga

SEQ ID NO: 67641 - RNA, 19 nt, Homo sapiens
gaaucuccaucauuguuau

SEQ ID NO: 67642 - RNA, 19 nt, Homo sapiens
ggugccaucuugacaacua

SEQ ID NO: 67643 - RNA, 19 nt, Homo sapiens
ugaacuguuugaagacaua

SEQ ID NO: 67644 - RNA, 19 nt, Homo sapiens
uaaagauccuuauggaaag

SEQ ID NO: 67645 - RNA, 19 nt, Homo sapiens
ggaaugaaagggucacuuc

SEQ ID NO: 67646 - RNA, 19 nt, Homo sapiens
gauguuccacacaaacuua

SEQ ID NO: 67647 - RNA, 19 nt, Homo sapiens
ggaugaagaccaacacaga

SEQ ID NO: 67648 - RNA, 19 nt, Homo sapiens
ggaggauaccaacuugaua

SEQ ID NO: 67649 - RNA, 19 nt, Homo sapiens
uaacuauguuggagguauu

SEQ ID NO: 67650 - RNA, 19 nt, Homo sapiens
agaaucaguugguuugcua

SEQ ID NO: 67651 - RNA, 19 nt, Homo sapiens
gaaagcaagagauuaucaa

SEQ ID NO: 67652 - RNA, 19 nt, Homo sapiens
ggaugaagaugugaaagca

SEQ ID NO: 67653 - RNA, 19 nt, Homo sapiens
gaguaaaggagucaacuga

SEQ ID NO: 67654 - RNA, 19 nt, Homo sapiens
aaacaacccuuccucuuuu

SEQ ID NO: 67655 - RNA, 19 nt, Homo sapiens
gaacaacugaucgaagcua

SEQ ID NO: 67656 - RNA, 19 nt, Homo sapiens
gaaagagaagcuagaaucu

SEQ ID NO: 67657 - RNA, 19 nt, Homo sapiens
ccaggaggauaccaacuug

SEQ ID NO: 67658 - RNA, 19 nt, Homo sapiens
caaacuguguaaacuggaa

SEQ ID NO: 67659 - RNA, 19 nt, Homo sapiens
guacccaucaacuaaauuu

SEQ ID NO: 67660 - RNA, 19 nt, Homo sapiens
auauuaggcucacacagua

SEQ ID NO: 67661 - RNA, 19 nt, Homo sapiens
gcaagagauuaucaaaguc

SEQ ID NO: 67662 - RNA, 19 nt, Homo sapiens
caagagaauacuacaguga

SEQ ID NO: 67663 - RNA, 19 nt, Homo sapiens
acuaagaugugaggaaauu

SEQ ID NO: 67664 - RNA, 19 nt, Homo sapiens
caucucaccucucuguguu

SEQ ID NO: 67665 - RNA, 19 nt, Homo sapiens
uuagagaggcuuacaaaug

SEQ ID NO: 67666 - RNA, 19 nt, Homo sapiens
gggaugauaugugggcaaa

SEQ ID NO: 67667 - RNA, 19 nt, Homo sapiens
cuacuugguguuugauuua

SEQ ID NO: 67668 - RNA, 19 nt, Homo sapiens
cagaagagggcuuucacua

SEQ ID NO: 67669 - RNA, 19 nt, Homo sapiens
gaguuagaauuucccaguu

SEQ ID NO: 67670 - RNA, 19 nt, Homo sapiens
ggucacuucugcaucauca

SEQ ID NO: 67671 - RNA, 19 nt, Homo sapiens
ucaaguuucucuguuaaug

SEQ ID NO: 67672 - RNA, 19 nt, Homo sapiens
acuaaagggugccaucuug

SEQ ID NO: 67673 - RNA, 19 nt, Homo sapiens
ggugagaagauguaugaaa

SEQ ID NO: 67674 - RNA, 19 nt, Homo sapiens
gcaaguuccuccugugacu

SEQ ID NO: 67675 - RNA, 19 nt, Homo sapiens
cagcaggcgugguuugguu

SEQ ID NO: 67676 - RNA, 19 nt, Homo sapiens
guaauucacaguccucaga

SEQ ID NO: 67677 - RNA, 19 nt, Homo sapiens
gugagaagauguaugaaaa

SEQ ID NO: 67678 - RNA, 19 nt, Homo sapiens
ggaaaguggcagaauguuc

SEQ ID NO: 67679 - RNA, 19 nt, Homo sapiens
agcaagagauuaucaaagu

SEQ ID NO: 67680 - RNA, 19 nt, Homo sapiens
gaucaucagaaacuagaaa

SEQ ID NO: 67681 - RNA, 19 nt, Homo sapiens
aaagggaaauguccuaggu

SEQ ID NO: 67682 - RNA, 19 nt, Homo sapiens
gaaaauuccuacuggacaa

SEQ ID NO: 67683 - RNA, 19 nt, Homo sapiens
gcuaguagugugugagaaa

SEQ ID NO: 67684 - RNA, 19 nt, Homo sapiens
gcugaugccagucauugua

SEQ ID NO: 67685 - RNA, 19 nt, Homo sapiens
uacuggaggugaacuguuu

SEQ ID NO: 67686 - RNA, 19 nt, Homo sapiens
aaacaacgcugcagauuua

SEQ ID NO: 67687 - RNA, 19 nt, Homo sapiens
gcacaaacaucuccacuuu

SEQ ID NO: 67688 - RNA, 19 nt, Homo sapiens
gaagagaucuauacccuaa

SEQ ID NO: 67689 - RNA, 19 nt, Homo sapiens
ggaaugaacuucuuuggaa

SEQ ID NO: 67690 - RNA, 19 nt, Homo sapiens
ggaaagaucccuauggaaa

SEQ ID NO: 67691 - RNA, 19 nt, Homo sapiens
gaagagguguccuuacaga

SEQ ID NO: 67692 - RNA, 19 nt, Homo sapiens
gaugagaaaccucguguua

SEQ ID NO: 67693 - RNA, 19 nt, Homo sapiens
gaggaaagaucccuaugga

SEQ ID NO: 67694 - RNA, 19 nt, Homo sapiens
aggcaaagcuacagguuua

SEQ ID NO: 67695 - RNA, 19 nt, Homo sapiens
gcagauagcaaagaagaua

SEQ ID NO: 67696 - RNA, 19 nt, Homo sapiens
caggagaucauuaagauua

SEQ ID NO: 67697 - RNA, 19 nt, Homo sapiens
gacaaauggucuuagaauu

SEQ ID NO: 67698 - RNA, 19 nt, Homo sapiens
caaauggucuuagaauuca

SEQ ID NO: 67699 - RNA, 19 nt, Homo sapiens
gagaauuggugcugcagaa

SEQ ID NO: 67700 - RNA, 19 nt, Homo sapiens
ggacguugcuguacugucu

SEQ ID NO: 67701 - RNA, 19 nt, Homo sapiens
gaacuucucagcugccaaa

SEQ ID NO: 67702 - RNA, 19 nt, Homo sapiens
ugagaaaccucguguuagu

SEQ ID NO: 67703 - RNA, 19 nt, Homo sapiens
gcuaaugucagcaucuaua

SEQ ID NO: 67704 - RNA, 19 nt, Homo sapiens
gaaaacaggagaucauuaa

SEQ ID NO: 67705 - RNA, 19 nt, Homo sapiens
gcucggauaugucgacuuc

SEQ ID NO: 67706 - RNA, 19 nt, Homo sapiens
caagaaggcaggaguaugu

SEQ ID NO: 67707 - RNA, 19 nt, Homo sapiens
aaugaaaccuugaacugaa

SEQ ID NO: 67708 - RNA, 19 nt, Homo sapiens
gguagacccuucauagcuu

SEQ ID NO: 67709 - RNA, 19 nt, Homo sapiens
cuaagcagauagcaaagaa

SEQ ID NO: 67710 - RNA, 19 nt, Homo sapiens
gcaugacaacauagaaaua

SEQ ID NO: 67711 - RNA, 19 nt, Homo sapiens
ccaugaagccgaugagaaa

SEQ ID NO: 67712 - RNA, 19 nt, Homo sapiens
ggagccagcugagaagaga

SEQ ID NO: 67713 - RNA, 19 nt, Homo sapiens
aagaagagguguccuuaca

SEQ ID NO: 67714 - RNA, 19 nt, Homo sapiens
gauaauggaggagcaauug

SEQ ID NO: 67715 - RNA, 19 nt, Homo sapiens
guacuacagugaagcagau

SEQ ID NO: 67716 - RNA, 19 nt, Homo sapiens
ggagcuguuugaagacauu

SEQ ID NO: 67717 - RNA, 19 nt, Homo sapiens
gggcuaaugucagcaucua

SEQ ID NO: 67718 - RNA, 19 nt, Homo sapiens
caugugggcccuaauauug

SEQ ID NO: 67719 - RNA, 19 nt, Homo sapiens
gagaacaucgugaccauca

SEQ ID NO: 67720 - RNA, 19 nt, Homo sapiens
uuacagaacagcugauuga

SEQ ID NO: 67721 - RNA, 19 nt, Homo sapiens
guacacaacgcuacagaug

SEQ ID NO: 67722 - RNA, 19 nt, Homo sapiens
gcagaugccagccacugua

SEQ ID NO: 67723 - RNA, 19 nt, Homo sapiens
gaacgugaggcucggauau

SEQ ID NO: 67724 - RNA, 19 nt, Homo sapiens
guagacccuucauagcuuu

SEQ ID NO: 67725 - RNA, 19 nt, Homo sapiens
gaacaucgugaccaucaga

SEQ ID NO: 67726 - RNA, 19 nt, Homo sapiens
ucacucauccauuucuaua

SEQ ID NO: 67727 - RNA, 19 nt, Homo sapiens
gauggcaaguggcucaaug

SEQ ID NO: 67728 - RNA, 19 nt, Homo sapiens
ccgucaagcuggcugauuu

SEQ ID NO: 67729 - RNA, 19 nt, Homo sapiens
ccacuucuuagcauucuua

SEQ ID NO: 67730 - RNA, 19 nt, Homo sapiens
ugagacccauagcuucaua

SEQ ID NO: 67731 - RNA, 19 nt, Homo sapiens
aaaggaauccauaccauga

SEQ ID NO: 67732 - RNA, 19 nt, Homo sapiens
caaugaaaccuugaacuga

SEQ ID NO: 67733 - RNA, 19 nt, Homo sapiens
gugcugaucuggaccaucu

SEQ ID NO: 67734 - RNA, 19 nt, Homo sapiens
gcaugugggcccuaauauu

SEQ ID NO: 67735 - RNA, 19 nt, Homo sapiens
gaaguguacccgccaugaa

SEQ ID NO: 67736 - RNA, 19 nt, Homo sapiens
acaaauggucuuagaauuc

SEQ ID NO: 67737 - RNA, 19 nt, Homo sapiens
cacgagagcugggagaaga

SEQ ID NO: 67738 - RNA, 19 nt, Homo sapiens
ggccuugguuucccucaaa

SEQ ID NO: 67739 - RNA, 19 nt, Homo sapiens
ugacugcucuggcaagaag

SEQ ID NO: 67740 - RNA, 19 nt, Homo sapiens
guagaagggaagagaauug

SEQ ID NO: 67741 - RNA, 19 nt, Homo sapiens
aacaggagaucauuaagau

SEQ ID NO: 67742 - RNA, 19 nt, Homo sapiens
aaacaggagaucauuaaga

SEQ ID NO: 67743 - RNA, 19 nt, Homo sapiens
gagagcagcaggcuugguu

SEQ ID NO: 67744 - RNA, 19 nt, Homo sapiens
gcaagggugcuuucucugu

SEQ ID NO: 67745 - RNA, 19 nt, Homo sapiens
gggagaagaggcaaagcua

SEQ ID NO: 67746 - RNA, 19 nt, Homo sapiens
ccagagaguacuacaguga

SEQ ID NO: 67747 - RNA, 19 nt, Homo sapiens
gaaggcaggaguauguaug

SEQ ID NO: 67748 - RNA, 19 nt, Homo sapiens
gagaagaggcaaagcuaca

SEQ ID NO: 67749 - RNA, 19 nt, Homo sapiens
gcuguacugucuuguuuag

SEQ ID NO: 67750 - RNA, 19 nt, Homo sapiens
gaacuugaucaaccagaug

SEQ ID NO: 67751 - RNA, 19 nt, Homo sapiens
gaacagcaagccuauccau

SEQ ID NO: 67752 - RNA, 19 nt, Homo sapiens
agaagaagagguguccuua

SEQ ID NO: 67753 - RNA, 19 nt, Homo sapiens
gaagaggugguggucguuu

SEQ ID NO: 67754 - RNA, 19 nt, Homo sapiens
guacugucuuguuuagugu

SEQ ID NO: 67755 - RNA, 19 nt, Homo sapiens
cggcaguccuguuuguuug

SEQ ID NO: 67756 - RNA, 19 nt, Homo sapiens
agaaucuccuguccaagaa

SEQ ID NO: 67757 - RNA, 19 nt, Homo sapiens
gaaagaucccuauggaaaa

SEQ ID NO: 67758 - RNA, 19 nt, Homo sapiens
cagcaggcuugguuugguu

SEQ ID NO: 67759 - RNA, 19 nt, Homo sapiens
ggagaguguuaaccacauc

SEQ ID NO: 67760 - RNA, 19 nt, Homo sapiens
gaggcaaagcuacagguuu

SEQ ID NO: 67761 - RNA, 19 nt, Homo sapiens
uagcaaagaagauaaugga

SEQ ID NO: 67762 - RNA, 19 nt, Homo sapiens
ucuauacccuaagcagaua

SEQ ID NO: 67763 - RNA, 19 nt, Homo sapiens
ccuguuuguuugagguuua

SEQ ID NO: 67764 - RNA, 19 nt, Homo sapiens
ccaaaagccuauugaacaa

SEQ ID NO: 67765 - RNA, 19 nt, Homo sapiens
acaagaaacggaaggcauu

SEQ ID NO: 67766 - RNA, 19 nt, Homo sapiens
ccgagcaccucaugcaugu

SEQ ID NO: 67767 - RNA, 19 nt, Homo sapiens
ucugaaacauccaaacauc

SEQ ID NO: 67768 - RNA, 19 nt, Homo sapiens
caacaccaccacagaagau

SEQ ID NO: 67769 - RNA, 19 nt, Homo sapiens
gcaacaccaccacagaaga

SEQ ID NO: 67770 - RNA, 19 nt, Homo sapiens
gaccauaaacccagcaaag

SEQ ID NO: 67771 - RNA, 19 nt, Homo sapiens
gcggggagcuguuugaaga

SEQ ID NO: 67772 - RNA, 19 nt, Homo sapiens
caagaaacggaaggcauuu

SEQ ID NO: 67773 - RNA, 19 nt, Homo sapiens
ucucugugcucaaggaguu

SEQ ID NO: 67774 - RNA, 19 nt, Homo sapiens
gcaccagccagucagaaga

SEQ ID NO: 67775 - RNA, 19 nt, Homo sapiens
gcgccuccaugacaguauu

SEQ ID NO: 67776 - RNA, 19 nt, Homo sapiens
aaccagaugcugaccauaa

SEQ ID NO: 67777 - RNA, 19 nt, Homo sapiens
ugcacucacucauccauuu

SEQ ID NO: 67778 - RNA, 19 nt, Homo sapiens
uguacugucuuguuuagug

SEQ ID NO: 67779 - RNA, 19 nt, Homo sapiens
uugcuguacugucuuguuu

SEQ ID NO: 67780 - RNA, 19 nt, Homo sapiens
ggagaucauuaagauuaca

SEQ ID NO: 67781 - RNA, 19 nt, Homo sapiens
aggagacuguggaguguuu

SEQ ID NO: 67782 - RNA, 19 nt, Homo sapiens
aaacggaaggcauuugaug

SEQ ID NO: 67783 - RNA, 19 nt, Homo sapiens
caaugcaugugggcccuaa

SEQ ID NO: 67784 - RNA, 19 nt, Homo sapiens
gcaagaaggcaggaguaug

SEQ ID NO: 67785 - RNA, 19 nt, Homo sapiens
gcggcaguccuguuuguuu

SEQ ID NO: 67786 - RNA, 19 nt, Homo sapiens
aaacaacgcugcagauuua

SEQ ID NO: 67787 - RNA, 19 nt, Homo sapiens
gcacaaacaucuccacuuu

SEQ ID NO: 67788 - RNA, 19 nt, Homo sapiens
gaagagaucuauacccuaa

SEQ ID NO: 67789 - RNA, 19 nt, Homo sapiens
ggaaugaacuucuuuggaa

SEQ ID NO: 67790 - RNA, 19 nt, Homo sapiens
ggaaagaucccuauggaaa

SEQ ID NO: 67791 - RNA, 19 nt, Homo sapiens
gaagagguguccuuacaga

SEQ ID NO: 67792 - RNA, 19 nt, Homo sapiens
gaugagaaaccucguguua

SEQ ID NO: 67793 - RNA, 19 nt, Homo sapiens
gaggaaagaucccuaugga

SEQ ID NO: 67794 - RNA, 19 nt, Homo sapiens
aggcaaagcuacagguuua

SEQ ID NO: 67795 - RNA, 19 nt, Homo sapiens
gcagauagcaaagaagaua

SEQ ID NO: 67796 - RNA, 19 nt, Homo sapiens
caggagaucauuaagauua

SEQ ID NO: 67797 - RNA, 19 nt, Homo sapiens
gacaaauggucuuagaauu

SEQ ID NO: 67798 - RNA, 19 nt, Homo sapiens
caaauggucuuagaauuca

SEQ ID NO: 67799 - RNA, 19 nt, Homo sapiens
gagaauuggugcugcagaa

SEQ ID NO: 67800 - RNA, 19 nt, Homo sapiens
ggauggcggugucaagaaa

SEQ ID NO: 67801 - RNA, 19 nt, Homo sapiens
ggacguugcuguacugucu

SEQ ID NO: 67802 - RNA, 19 nt, Homo sapiens
ugagaaaccucguguuagu

SEQ ID NO: 67803 - RNA, 19 nt, Homo sapiens
gcuaaugucagcaucuaua

SEQ ID NO: 67804 - RNA, 19 nt, Homo sapiens
gaaaacaggagaucauuaa

SEQ ID NO: 67805 - RNA, 19 nt, Homo sapiens
gcucggauaugucgacuuc

SEQ ID NO: 67806 - RNA, 19 nt, Homo sapiens
caagaaggcaggaguaugu

SEQ ID NO: 67807 - RNA, 19 nt, Homo sapiens
aaugaaaccuugaacugaa

SEQ ID NO: 67808 - RNA, 19 nt, Homo sapiens
gguagacccuucauagcuu

SEQ ID NO: 67809 - RNA, 19 nt, Homo sapiens
cuaagcagauagcaaagaa

SEQ ID NO: 67810 - RNA, 19 nt, Homo sapiens
gcaugacaacauagaaaua

SEQ ID NO: 67811 - RNA, 19 nt, Homo sapiens
ccaugaagccgaugagaaa

SEQ ID NO: 67812 - RNA, 19 nt, Homo sapiens
ggagccagcugagaagaga

SEQ ID NO: 67813 - RNA, 19 nt, Homo sapiens
aagaagagguguccuuaca

SEQ ID NO: 67814 - RNA, 19 nt, Homo sapiens
gauaauggaggagcaauug

SEQ ID NO: 67815 - RNA, 19 nt, Homo sapiens
guacuacagugaagcagau

SEQ ID NO: 67816 - RNA, 19 nt, Homo sapiens
ggagcuguuugaagacauu

SEQ ID NO: 67817 - RNA, 19 nt, Homo sapiens
gggcuaaugucagcaucua

SEQ ID NO: 67818 - RNA, 19 nt, Homo sapiens
caugugggcccuaauauug

SEQ ID NO: 67819 - RNA, 19 nt, Homo sapiens
gagaacaucgugaccauca

SEQ ID NO: 67820 - RNA, 19 nt, Homo sapiens
uuacagaacagcugauuga

SEQ ID NO: 67821 - RNA, 19 nt, Homo sapiens
guacacaacgcuacagaug

SEQ ID NO: 67822 - RNA, 19 nt, Homo sapiens
gcagaugccagccacugua

SEQ ID NO: 67823 - RNA, 19 nt, Homo sapiens
gaacgugaggcucggauau

SEQ ID NO: 67824 - RNA, 19 nt, Homo sapiens
guagacccuucauagcuuu

SEQ ID NO: 67825 - RNA, 19 nt, Homo sapiens
gaacaucgugaccaucaga

SEQ ID NO: 67826 - RNA, 19 nt, Homo sapiens
ucacucauccauuucuaua

SEQ ID NO: 67827 - RNA, 19 nt, Homo sapiens
gauggcaaguggcucaaug

SEQ ID NO: 67828 - RNA, 19 nt, Homo sapiens
ccgucaagcuggcugauuu

SEQ ID NO: 67829 - RNA, 19 nt, Homo sapiens
ccacuucuuagcauucuua

SEQ ID NO: 67830 - RNA, 19 nt, Homo sapiens
ugagacccauagcuucaua

SEQ ID NO: 67831 - RNA, 19 nt, Homo sapiens
aaaggaauccauaccauga

SEQ ID NO: 67832 - RNA, 19 nt, Homo sapiens
caaugaaaccuugaacuga

SEQ ID NO: 67833 - RNA, 19 nt, Homo sapiens
gugcugaucuggaccaucu

SEQ ID NO: 67834 - RNA, 19 nt, Homo sapiens
gcaugugggcccuaauauu

SEQ ID NO: 67835 - RNA, 19 nt, Homo sapiens
gaaguguacccgccaugaa

SEQ ID NO: 67836 - RNA, 19 nt, Homo sapiens
acaaauggucuuagaauuc

SEQ ID NO: 67837 - RNA, 19 nt, Homo sapiens
cacgagagcugggagaaga

SEQ ID NO: 67838 - RNA, 19 nt, Homo sapiens
ggccuugguuucccucaaa

SEQ ID NO: 67839 - RNA, 19 nt, Homo sapiens
ugacugcucuggcaagaag

SEQ ID NO: 67840 - RNA, 19 nt, Homo sapiens
guagaagggaagagaauug

SEQ ID NO: 67841 - RNA, 19 nt, Homo sapiens
aacaggagaucauuaagau

SEQ ID NO: 67842 - RNA, 19 nt, Homo sapiens
aaacaggagaucauuaaga

SEQ ID NO: 67843 - RNA, 19 nt, Homo sapiens
gagagcagcaggcuugguu

SEQ ID NO: 67844 - RNA, 19 nt, Homo sapiens
gcaagggugcuuucucugu

SEQ ID NO: 67845 - RNA, 19 nt, Homo sapiens
gggagaagaggcaaagcua

SEQ ID NO: 67846 - RNA, 19 nt, Homo sapiens
ccagagaguacuacaguga

SEQ ID NO: 67847 - RNA, 19 nt, Homo sapiens
gaaggcaggaguauguaug

SEQ ID NO: 67848 - RNA, 19 nt, Homo sapiens
gagaagaggcaaagcuaca

SEQ ID NO: 67849 - RNA, 19 nt, Homo sapiens
gcuguacugucuuguuuag

SEQ ID NO: 67850 - RNA, 19 nt, Homo sapiens
gaacuugaucaaccagaug

SEQ ID NO: 67851 - RNA, 19 nt, Homo sapiens
gaacagcaagccuauccau

SEQ ID NO: 67852 - RNA, 19 nt, Homo sapiens
agaagaagagguguccuua

SEQ ID NO: 67853 - RNA, 19 nt, Homo sapiens
gaagaggugguggucguuu

SEQ ID NO: 67854 - RNA, 19 nt, Homo sapiens
guacugucuuguuuagugu

SEQ ID NO: 67855 - RNA, 19 nt, Homo sapiens
cggcaguccuguuuguuug

SEQ ID NO: 67856 - RNA, 19 nt, Homo sapiens
agaaucuccuguccaagaa

SEQ ID NO: 67857 - RNA, 19 nt, Homo sapiens
gaaagaucccuauggaaaa

SEQ ID NO: 67858 - RNA, 19 nt, Homo sapiens
cagcaggcuugguuugguu

SEQ ID NO: 67859 - RNA, 19 nt, Homo sapiens
ggagaguguuaaccacauc

SEQ ID NO: 67860 - RNA, 19 nt, Homo sapiens
gaggcaaagcuacagguuu

SEQ ID NO: 67861 - RNA, 19 nt, Homo sapiens
uagcaaagaagauaaugga

SEQ ID NO: 67862 - RNA, 19 nt, Homo sapiens
ucuauacccuaagcagaua

SEQ ID NO: 67863 - RNA, 19 nt, Homo sapiens
ccuguuuguuugagguuua

SEQ ID NO: 67864 - RNA, 19 nt, Homo sapiens
ccaaaagccuauugaacaa

SEQ ID NO: 67865 - RNA, 19 nt, Homo sapiens
acaagaaacggaaggcauu

SEQ ID NO: 67866 - RNA, 19 nt, Homo sapiens
ccgagcaccucaugcaugu

SEQ ID NO: 67867 - RNA, 19 nt, Homo sapiens
ucugaaacauccaaacauc

SEQ ID NO: 67868 - RNA, 19 nt, Homo sapiens
caacaccaccacagaagau

SEQ ID NO: 67869 - RNA, 19 nt, Homo sapiens
gcaacaccaccacagaaga

SEQ ID NO: 67870 - RNA, 19 nt, Homo sapiens
gaccauaaacccagcaaag

SEQ ID NO: 67871 - RNA, 19 nt, Homo sapiens
gcggggagcuguuugaaga

SEQ ID NO: 67872 - RNA, 19 nt, Homo sapiens
caagaaacggaaggcauuu

SEQ ID NO: 67873 - RNA, 19 nt, Homo sapiens
ucucugugcucaaggaguu

SEQ ID NO: 67874 - RNA, 19 nt, Homo sapiens
gcaccagccagucagaaga

SEQ ID NO: 67875 - RNA, 19 nt, Homo sapiens
gcgccuccaugacaguauu

SEQ ID NO: 67876 - RNA, 19 nt, Homo sapiens
aaccagaugcugaccauaa

SEQ ID NO: 67877 - RNA, 19 nt, Homo sapiens
ugcacucacucauccauuu

SEQ ID NO: 67878 - RNA, 19 nt, Homo sapiens
uguacugucuuguuuagug

SEQ ID NO: 67879 - RNA, 19 nt, Homo sapiens
uugcuguacugucuuguuu

SEQ ID NO: 67880 - RNA, 19 nt, Homo sapiens
ggagaucauuaagauuaca

SEQ ID NO: 67881 - RNA, 19 nt, Homo sapiens
aggagacuguggaguguuu

SEQ ID NO: 67882 - RNA, 19 nt, Homo sapiens
aaacggaaggcauuugaug

SEQ ID NO: 67883 - RNA, 19 nt, Homo sapiens
caaugcaugugggcccuaa

SEQ ID NO: 67884 - RNA, 19 nt, Homo sapiens
gcaagaaggcaggaguaug

SEQ ID NO: 67885 - RNA, 19 nt, Homo sapiens
gcggcaguccuguuuguuu

SEQ ID NO: 67886 - RNA, 19 nt, Homo sapiens
aaacaacgcugcagauuua

SEQ ID NO: 67887 - RNA, 19 nt, Homo sapiens
gcacaaacaucuccacuuu

SEQ ID NO: 67888 - RNA, 19 nt, Homo sapiens
gaagagaucuauacccuaa

SEQ ID NO: 67889 - RNA, 19 nt, Homo sapiens
ggaaugaacuucuuuggaa

SEQ ID NO: 67890 - RNA, 19 nt, Homo sapiens
ggaaagaucccuauggaaa

SEQ ID NO: 67891 - RNA, 19 nt, Homo sapiens
gaagagguguccuuacaga

SEQ ID NO: 67892 - RNA, 19 nt, Homo sapiens
gaugagaaaccucguguua

SEQ ID NO: 67893 - RNA, 19 nt, Homo sapiens
gaggaaagaucccuaugga

SEQ ID NO: 67894 - RNA, 19 nt, Homo sapiens
aggcaaagcuacagguuua

SEQ ID NO: 67895 - RNA, 19 nt, Homo sapiens
gcagauagcaaagaagaua

SEQ ID NO: 67896 - RNA, 19 nt, Homo sapiens
caggagaucauuaagauua

SEQ ID NO: 67897 - RNA, 19 nt, Homo sapiens
gacaaauggucuuagaauu

SEQ ID NO: 67898 - RNA, 19 nt, Homo sapiens
caaauggucuuagaauuca

SEQ ID NO: 67899 - RNA, 19 nt, Homo sapiens
gagaauuggugcugcagaa

SEQ ID NO: 67900 - RNA, 19 nt, Homo sapiens
ggacguugcuguacugucu

SEQ ID NO: 67901 - RNA, 19 nt, Homo sapiens
gaacuucucagcugccaaa

SEQ ID NO: 67902 - RNA, 19 nt, Homo sapiens
ugagaaaccucguguuagu

SEQ ID NO: 67903 - RNA, 19 nt, Homo sapiens
gcuaaugucagcaucuaua

SEQ ID NO: 67904 - RNA, 19 nt, Homo sapiens
gaaaacaggagaucauuaa

SEQ ID NO: 67905 - RNA, 19 nt, Homo sapiens
gcucggauaugucgacuuc

SEQ ID NO: 67906 - RNA, 19 nt, Homo sapiens
caagaaggcaggaguaugu

SEQ ID NO: 67907 - RNA, 19 nt, Homo sapiens
aaugaaaccuugaacugaa

SEQ ID NO: 67908 - RNA, 19 nt, Homo sapiens
gguagacccuucauagcuu

SEQ ID NO: 67909 - RNA, 19 nt, Homo sapiens
cuaagcagauagcaaagaa

SEQ ID NO: 67910 - RNA, 19 nt, Homo sapiens
gcaugacaacauagaaaua

SEQ ID NO: 67911 - RNA, 19 nt, Homo sapiens
ccaugaagccgaugagaaa

SEQ ID NO: 67912 - RNA, 19 nt, Homo sapiens
ggagccagcugagaagaga

SEQ ID NO: 67913 - RNA, 19 nt, Homo sapiens
aagaagagguguccuuaca

SEQ ID NO: 67914 - RNA, 19 nt, Homo sapiens
gauaauggaggagcaauug

SEQ ID NO: 67915 - RNA, 19 nt, Homo sapiens
guacuacagugaagcagau

SEQ ID NO: 67916 - RNA, 19 nt, Homo sapiens
ggagcuguuugaagacauu

SEQ ID NO: 67917 - RNA, 19 nt, Homo sapiens
gggcuaaugucagcaucua

SEQ ID NO: 67918 - RNA, 19 nt, Homo sapiens
caugugggcccuaauauug

SEQ ID NO: 67919 - RNA, 19 nt, Homo sapiens
gagaacaucgugaccauca

SEQ ID NO: 67920 - RNA, 19 nt, Homo sapiens
uuacagaacagcugauuga

SEQ ID NO: 67921 - RNA, 19 nt, Homo sapiens
guacacaacgcuacagaug

SEQ ID NO: 67922 - RNA, 19 nt, Homo sapiens
gcagaugccagccacugua

SEQ ID NO: 67923 - RNA, 19 nt, Homo sapiens
gaacgugaggcucggauau

SEQ ID NO: 67924 - RNA, 19 nt, Homo sapiens
guagacccuucauagcuuu

SEQ ID NO: 67925 - RNA, 19 nt, Homo sapiens
gaacaucgugaccaucaga

SEQ ID NO: 67926 - RNA, 19 nt, Homo sapiens
ucacucauccauuucuaua

SEQ ID NO: 67927 - RNA, 19 nt, Homo sapiens
gauggcaaguggcucaaug

SEQ ID NO: 67928 - RNA, 19 nt, Homo sapiens
ccgucaagcuggcugauuu

SEQ ID NO: 67929 - RNA, 19 nt, Homo sapiens
ccacuucuuagcauucuua

SEQ ID NO: 67930 - RNA, 19 nt, Homo sapiens
ugagacccauagcuucaua

SEQ ID NO: 67931 - RNA, 19 nt, Homo sapiens
aaaggaauccauaccauga

SEQ ID NO: 67932 - RNA, 19 nt, Homo sapiens
caaugaaaccuugaacuga

SEQ ID NO: 67933 - RNA, 19 nt, Homo sapiens
gugcugaucuggaccaucu

SEQ ID NO: 67934 - RNA, 19 nt, Homo sapiens
gcaugugggcccuaauauu

SEQ ID NO: 67935 - RNA, 19 nt, Homo sapiens
gaaguguacccgccaugaa

SEQ ID NO: 67936 - RNA, 19 nt, Homo sapiens
acaaauggucuuagaauuc

SEQ ID NO: 67937 - RNA, 19 nt, Homo sapiens
cacgagagcugggagaaga

SEQ ID NO: 67938 - RNA, 19 nt, Homo sapiens
ggccuugguuucccucaaa

SEQ ID NO: 67939 - RNA, 19 nt, Homo sapiens
ugacugcucuggcaagaag

SEQ ID NO: 67940 - RNA, 19 nt, Homo sapiens
guagaagggaagagaauug

SEQ ID NO: 67941 - RNA, 19 nt, Homo sapiens
aacaggagaucauuaagau

SEQ ID NO: 67942 - RNA, 19 nt, Homo sapiens
aaacaggagaucauuaaga

SEQ ID NO: 67943 - RNA, 19 nt, Homo sapiens
gagagcagcaggcuugguu

SEQ ID NO: 67944 - RNA, 19 nt, Homo sapiens
gcaagggugcuuucucugu

SEQ ID NO: 67945 - RNA, 19 nt, Homo sapiens
gggagaagaggcaaagcua

SEQ ID NO: 67946 - RNA, 19 nt, Homo sapiens
ccagagaguacuacaguga

SEQ ID NO: 67947 - RNA, 19 nt, Homo sapiens
gaaggcaggaguauguaug

SEQ ID NO: 67948 - RNA, 19 nt, Homo sapiens
gagaagaggcaaagcuaca

SEQ ID NO: 67949 - RNA, 19 nt, Homo sapiens
gcuguacugucuuguuuag

SEQ ID NO: 67950 - RNA, 19 nt, Homo sapiens
gaacuugaucaaccagaug

SEQ ID NO: 67951 - RNA, 19 nt, Homo sapiens
gaacagcaagccuauccau

SEQ ID NO: 67952 - RNA, 19 nt, Homo sapiens
agaagaagagguguccuua

SEQ ID NO: 67953 - RNA, 19 nt, Homo sapiens
gaagaggugguggucguuu

SEQ ID NO: 67954 - RNA, 19 nt, Homo sapiens
guacugucuuguuuagugu

SEQ ID NO: 67955 - RNA, 19 nt, Homo sapiens
cggcaguccuguuuguuug

SEQ ID NO: 67956 - RNA, 19 nt, Homo sapiens
agaaucuccuguccaagaa

SEQ ID NO: 67957 - RNA, 19 nt, Homo sapiens
gaaagaucccuauggaaaa

SEQ ID NO: 67958 - RNA, 19 nt, Homo sapiens
cagcaggcuugguuugguu

SEQ ID NO: 67959 - RNA, 19 nt, Homo sapiens
ggagaguguuaaccacauc

SEQ ID NO: 67960 - RNA, 19 nt, Homo sapiens
gaggcaaagcuacagguuu

SEQ ID NO: 67961 - RNA, 19 nt, Homo sapiens
uagcaaagaagauaaugga

SEQ ID NO: 67962 - RNA, 19 nt, Homo sapiens
ucuauacccuaagcagaua

SEQ ID NO: 67963 - RNA, 19 nt, Homo sapiens
ccuguuuguuugagguuua

SEQ ID NO: 67964 - RNA, 19 nt, Homo sapiens
ccaaaagccuauugaacaa

SEQ ID NO: 67965 - RNA, 19 nt, Homo sapiens
acaagaaacggaaggcauu

SEQ ID NO: 67966 - RNA, 19 nt, Homo sapiens
ccgagcaccucaugcaugu

SEQ ID NO: 67967 - RNA, 19 nt, Homo sapiens
ucugaaacauccaaacauc

SEQ ID NO: 67968 - RNA, 19 nt, Homo sapiens
caacaccaccacagaagau

SEQ ID NO: 67969 - RNA, 19 nt, Homo sapiens
gcaacaccaccacagaaga

SEQ ID NO: 67970 - RNA, 19 nt, Homo sapiens
gaccauaaacccagcaaag

SEQ ID NO: 67971 - RNA, 19 nt, Homo sapiens
gcggggagcuguuugaaga

SEQ ID NO: 67972 - RNA, 19 nt, Homo sapiens
caagaaacggaaggcauuu

SEQ ID NO: 67973 - RNA, 19 nt, Homo sapiens
ucucugugcucaaggaguu

SEQ ID NO: 67974 - RNA, 19 nt, Homo sapiens
gcaccagccagucagaaga

SEQ ID NO: 67975 - RNA, 19 nt, Homo sapiens
gcgccuccaugacaguauu

SEQ ID NO: 67976 - RNA, 19 nt, Homo sapiens
aaccagaugcugaccauaa

SEQ ID NO: 67977 - RNA, 19 nt, Homo sapiens
ugcacucacucauccauuu

SEQ ID NO: 67978 - RNA, 19 nt, Homo sapiens
uguacugucuuguuuagug

SEQ ID NO: 67979 - RNA, 19 nt, Homo sapiens
uugcuguacugucuuguuu

SEQ ID NO: 67980 - RNA, 19 nt, Homo sapiens
ggagaucauuaagauuaca

SEQ ID NO: 67981 - RNA, 19 nt, Homo sapiens
aggagacuguggaguguuu

SEQ ID NO: 67982 - RNA, 19 nt, Homo sapiens
aaacggaaggcauuugaug

SEQ ID NO: 67983 - RNA, 19 nt, Homo sapiens
caaugcaugugggcccuaa

SEQ ID NO: 67984 - RNA, 19 nt, Homo sapiens
gcaagaaggcaggaguaug

SEQ ID NO: 67985 - RNA, 19 nt, Homo sapiens
gcggcaguccuguuuguuu

SEQ ID NO: 67986 - RNA, 19 nt, Homo sapiens
aaacaacgcugcagauuua

SEQ ID NO: 67987 - RNA, 19 nt, Homo sapiens
gcacaaacaucuccacuuu

SEQ ID NO: 67988 - RNA, 19 nt, Homo sapiens
gaagagaucuauacccuaa

SEQ ID NO: 67989 - RNA, 19 nt, Homo sapiens
ggaaugaacuucuuuggaa

SEQ ID NO: 67990 - RNA, 19 nt, Homo sapiens
ggaaagaucccuauggaaa

SEQ ID NO: 67991 - RNA, 19 nt, Homo sapiens
gaagagguguccuuacaga

SEQ ID NO: 67992 - RNA, 19 nt, Homo sapiens
gaugagaaaccucguguua

SEQ ID NO: 67993 - RNA, 19 nt, Homo sapiens
gaggaaagaucccuaugga

SEQ ID NO: 67994 - RNA, 19 nt, Homo sapiens
aggcaaagcuacagguuua

SEQ ID NO: 67995 - RNA, 19 nt, Homo sapiens
gcagauagcaaagaagaua

SEQ ID NO: 67996 - RNA, 19 nt, Homo sapiens
caggagaucauuaagauua

SEQ ID NO: 67997 - RNA, 19 nt, Homo sapiens
gacaaauggucuuagaauu

SEQ ID NO: 67998 - RNA, 19 nt, Homo sapiens
caaauggucuuagaauuca

SEQ ID NO: 67999 - RNA, 19 nt, Homo sapiens
gagaauuggugcugcagaa

SEQ ID NO: 68000 - RNA, 19 nt, Homo sapiens
ggacguugcuguacugucu

SEQ ID NO: 68001 - RNA, 19 nt, Homo sapiens
gaacuucucagcugccaaa

SEQ ID NO: 68002 - RNA, 19 nt, Homo sapiens
ugagaaaccucguguuagu

SEQ ID NO: 68003 - RNA, 19 nt, Homo sapiens
gcuaaugucagcaucuaua

SEQ ID NO: 68004 - RNA, 19 nt, Homo sapiens
gaaaacaggagaucauuaa

SEQ ID NO: 68005 - RNA, 19 nt, Homo sapiens
gcucggauaugucgacuuc

SEQ ID NO: 68006 - RNA, 19 nt, Homo sapiens
caagaaggcaggaguaugu

SEQ ID NO: 68007 - RNA, 19 nt, Homo sapiens
aaugaaaccuugaacugaa

SEQ ID NO: 68008 - RNA, 19 nt, Homo sapiens
gguagacccuucauagcuu

SEQ ID NO: 68009 - RNA, 19 nt, Homo sapiens
cuaagcagauagcaaagaa

SEQ ID NO: 68010 - RNA, 19 nt, Homo sapiens
gcaugacaacauagaaaua

SEQ ID NO: 68011 - RNA, 19 nt, Homo sapiens
ccaugaagccgaugagaaa

SEQ ID NO: 68012 - RNA, 19 nt, Homo sapiens
ggagccagcugagaagaga

SEQ ID NO: 68013 - RNA, 19 nt, Homo sapiens
aagaagagguguccuuaca

SEQ ID NO: 68014 - RNA, 19 nt, Homo sapiens
gauaauggaggagcaauug

SEQ ID NO: 68015 - RNA, 19 nt, Homo sapiens
guacuacagugaagcagau

SEQ ID NO: 68016 - RNA, 19 nt, Homo sapiens
ggagcuguuugaagacauu

SEQ ID NO: 68017 - RNA, 19 nt, Homo sapiens
gggcuaaugucagcaucua

SEQ ID NO: 68018 - RNA, 19 nt, Homo sapiens
caugugggcccuaauauug

SEQ ID NO: 68019 - RNA, 19 nt, Homo sapiens
gagaacaucgugaccauca

SEQ ID NO: 68020 - RNA, 19 nt, Homo sapiens
uuacagaacagcugauuga

SEQ ID NO: 68021 - RNA, 19 nt, Homo sapiens
guacacaacgcuacagaug

SEQ ID NO: 68022 - RNA, 19 nt, Homo sapiens
gcagaugccagccacugua

SEQ ID NO: 68023 - RNA, 19 nt, Homo sapiens
gaacgugaggcucggauau

SEQ ID NO: 68024 - RNA, 19 nt, Homo sapiens
guagacccuucauagcuuu

SEQ ID NO: 68025 - RNA, 19 nt, Homo sapiens
gaacaucgugaccaucaga

SEQ ID NO: 68026 - RNA, 19 nt, Homo sapiens
ucacucauccauuucuaua

SEQ ID NO: 68027 - RNA, 19 nt, Homo sapiens
gauggcaaguggcucaaug

SEQ ID NO: 68028 - RNA, 19 nt, Homo sapiens
ccgucaagcuggcugauuu

SEQ ID NO: 68029 - RNA, 19 nt, Homo sapiens
ccacuucuuagcauucuua

SEQ ID NO: 68030 - RNA, 19 nt, Homo sapiens
ugagacccauagcuucaua

SEQ ID NO: 68031 - RNA, 19 nt, Homo sapiens
aaaggaauccauaccauga

SEQ ID NO: 68032 - RNA, 19 nt, Homo sapiens
caaugaaaccuugaacuga

SEQ ID NO: 68033 - RNA, 19 nt, Homo sapiens
gugcugaucuggaccaucu

SEQ ID NO: 68034 - RNA, 19 nt, Homo sapiens
gcaugugggcccuaauauu

SEQ ID NO: 68035 - RNA, 19 nt, Homo sapiens
gaaguguacccgccaugaa

SEQ ID NO: 68036 - RNA, 19 nt, Homo sapiens
acaaauggucuuagaauuc

SEQ ID NO: 68037 - RNA, 19 nt, Homo sapiens
cacgagagcugggagaaga

SEQ ID NO: 68038 - RNA, 19 nt, Homo sapiens
ggccuugguuucccucaaa

SEQ ID NO: 68039 - RNA, 19 nt, Homo sapiens
ugacugcucuggcaagaag

SEQ ID NO: 68040 - RNA, 19 nt, Homo sapiens
guagaagggaagagaauug

SEQ ID NO: 68041 - RNA, 19 nt, Homo sapiens
aacaggagaucauuaagau

SEQ ID NO: 68042 - RNA, 19 nt, Homo sapiens
aaacaggagaucauuaaga

SEQ ID NO: 68043 - RNA, 19 nt, Homo sapiens
gagagcagcaggcuugguu

SEQ ID NO: 68044 - RNA, 19 nt, Homo sapiens
gcaagggugcuuucucugu

SEQ ID NO: 68045 - RNA, 19 nt, Homo sapiens
gggagaagaggcaaagcua

SEQ ID NO: 68046 - RNA, 19 nt, Homo sapiens
ccagagaguacuacaguga

SEQ ID NO: 68047 - RNA, 19 nt, Homo sapiens
gaaggcaggaguauguaug

SEQ ID NO: 68048 - RNA, 19 nt, Homo sapiens
gagaagaggcaaagcuaca

SEQ ID NO: 68049 - RNA, 19 nt, Homo sapiens
gcuguacugucuuguuuag

SEQ ID NO: 68050 - RNA, 19 nt, Homo sapiens
gaacuugaucaaccagaug

SEQ ID NO: 68051 - RNA, 19 nt, Homo sapiens
gaacagcaagccuauccau

SEQ ID NO: 68052 - RNA, 19 nt, Homo sapiens
agaagaagagguguccuua

SEQ ID NO: 68053 - RNA, 19 nt, Homo sapiens
gaagaggugguggucguuu

SEQ ID NO: 68054 - RNA, 19 nt, Homo sapiens
guacugucuuguuuagugu

SEQ ID NO: 68055 - RNA, 19 nt, Homo sapiens
cggcaguccuguuuguuug

SEQ ID NO: 68056 - RNA, 19 nt, Homo sapiens
agaaucuccuguccaagaa

SEQ ID NO: 68057 - RNA, 19 nt, Homo sapiens
gaaagaucccuauggaaaa

SEQ ID NO: 68058 - RNA, 19 nt, Homo sapiens
cagcaggcuugguuugguu

SEQ ID NO: 68059 - RNA, 19 nt, Homo sapiens
ggagaguguuaaccacauc

SEQ ID NO: 68060 - RNA, 19 nt, Homo sapiens
gaggcaaagcuacagguuu

SEQ ID NO: 68061 - RNA, 19 nt, Homo sapiens
uagcaaagaagauaaugga

SEQ ID NO: 68062 - RNA, 19 nt, Homo sapiens
ucuauacccuaagcagaua

SEQ ID NO: 68063 - RNA, 19 nt, Homo sapiens
ccuguuuguuugagguuua

SEQ ID NO: 68064 - RNA, 19 nt, Homo sapiens
ccaaaagccuauugaacaa

SEQ ID NO: 68065 - RNA, 19 nt, Homo sapiens
acaagaaacggaaggcauu

SEQ ID NO: 68066 - RNA, 19 nt, Homo sapiens
ccgagcaccucaugcaugu

SEQ ID NO: 68067 - RNA, 19 nt, Homo sapiens
ucugaaacauccaaacauc

SEQ ID NO: 68068 - RNA, 19 nt, Homo sapiens
caacaccaccacagaagau

SEQ ID NO: 68069 - RNA, 19 nt, Homo sapiens
gcaacaccaccacagaaga

SEQ ID NO: 68070 - RNA, 19 nt, Homo sapiens
gaccauaaacccagcaaag

SEQ ID NO: 68071 - RNA, 19 nt, Homo sapiens
gcggggagcuguuugaaga

SEQ ID NO: 68072 - RNA, 19 nt, Homo sapiens
caagaaacggaaggcauuu

SEQ ID NO: 68073 - RNA, 19 nt, Homo sapiens
ucucugugcucaaggaguu

SEQ ID NO: 68074 - RNA, 19 nt, Homo sapiens
gcaccagccagucagaaga

SEQ ID NO: 68075 - RNA, 19 nt, Homo sapiens
gcgccuccaugacaguauu

SEQ ID NO: 68076 - RNA, 19 nt, Homo sapiens
aaccagaugcugaccauaa

SEQ ID NO: 68077 - RNA, 19 nt, Homo sapiens
ugcacucacucauccauuu

SEQ ID NO: 68078 - RNA, 19 nt, Homo sapiens
uguacugucuuguuuagug

SEQ ID NO: 68079 - RNA, 19 nt, Homo sapiens
uugcuguacugucuuguuu

SEQ ID NO: 68080 - RNA, 19 nt, Homo sapiens
ggagaucauuaagauuaca

SEQ ID NO: 68081 - RNA, 19 nt, Homo sapiens
aggagacuguggaguguuu

SEQ ID NO: 68082 - RNA, 19 nt, Homo sapiens
aaacggaaggcauuugaug

SEQ ID NO: 68083 - RNA, 19 nt, Homo sapiens
caaugcaugugggcccuaa

SEQ ID NO: 68084 - RNA, 19 nt, Homo sapiens
gcaagaaggcaggaguaug

SEQ ID NO: 68085 - RNA, 19 nt, Homo sapiens
gcggcaguccuguuuguuu

SEQ ID NO: 68086 - RNA, 19 nt, Homo sapiens
aaacaacgcugcagauuua

SEQ ID NO: 68087 - RNA, 19 nt, Homo sapiens
gcacaaacaucuccacuuu

SEQ ID NO: 68088 - RNA, 19 nt, Homo sapiens
gaagagaucuauacccuaa

SEQ ID NO: 68089 - RNA, 19 nt, Homo sapiens
ggaaugaacuucuuuggaa

SEQ ID NO: 68090 - RNA, 19 nt, Homo sapiens
ggaaagaucccuauggaaa

SEQ ID NO: 68091 - RNA, 19 nt, Homo sapiens
gaagagguguccuuacaga

SEQ ID NO: 68092 - RNA, 19 nt, Homo sapiens
gaugagaaaccucguguua

SEQ ID NO: 68093 - RNA, 19 nt, Homo sapiens
gaggaaagaucccuaugga

SEQ ID NO: 68094 - RNA, 19 nt, Homo sapiens
aggcaaagcuacagguuua

SEQ ID NO: 68095 - RNA, 19 nt, Homo sapiens
gcagauagcaaagaagaua

SEQ ID NO: 68096 - RNA, 19 nt, Homo sapiens
caggagaucauuaagauua

SEQ ID NO: 68097 - RNA, 19 nt, Homo sapiens
gacaaauggucuuagaauu

SEQ ID NO: 68098 - RNA, 19 nt, Homo sapiens
caaauggucuuagaauuca

SEQ ID NO: 68099 - RNA, 19 nt, Homo sapiens
gagaauuggugcugcagaa

SEQ ID NO: 68100 - RNA, 19 nt, Homo sapiens
ggacguugcuguacugucu

SEQ ID NO: 68101 - RNA, 19 nt, Homo sapiens
gaacuucucagcugccaaa

SEQ ID NO: 68102 - RNA, 19 nt, Homo sapiens
ugagaaaccucguguuagu

SEQ ID NO: 68103 - RNA, 19 nt, Homo sapiens
gcuaaugucagcaucuaua

SEQ ID NO: 68104 - RNA, 19 nt, Homo sapiens
gaaaacaggagaucauuaa

SEQ ID NO: 68105 - RNA, 19 nt, Homo sapiens
gcucggauaugucgacuuc

SEQ ID NO: 68106 - RNA, 19 nt, Homo sapiens
caagaaggcaggaguaugu

SEQ ID NO: 68107 - RNA, 19 nt, Homo sapiens
aaugaaaccuugaacugaa

SEQ ID NO: 68108 - RNA, 19 nt, Homo sapiens
gguagacccuucauagcuu

SEQ ID NO: 68109 - RNA, 19 nt, Homo sapiens
cuaagcagauagcaaagaa

SEQ ID NO: 68110 - RNA, 19 nt, Homo sapiens
gcaugacaacauagaaaua

SEQ ID NO: 68111 - RNA, 19 nt, Homo sapiens
ccaugaagccgaugagaaa

SEQ ID NO: 68112 - RNA, 19 nt, Homo sapiens
ggagccagcugagaagaga

SEQ ID NO: 68113 - RNA, 19 nt, Homo sapiens
aagaagagguguccuuaca

SEQ ID NO: 68114 - RNA, 19 nt, Homo sapiens
gauaauggaggagcaauug

SEQ ID NO: 68115 - RNA, 19 nt, Homo sapiens
guacuacagugaagcagau

SEQ ID NO: 68116 - RNA, 19 nt, Homo sapiens
ggagcuguuugaagacauu

SEQ ID NO: 68117 - RNA, 19 nt, Homo sapiens
gggcuaaugucagcaucua

SEQ ID NO: 68118 - RNA, 19 nt, Homo sapiens
caugugggcccuaauauug

SEQ ID NO: 68119 - RNA, 19 nt, Homo sapiens
gagaacaucgugaccauca

SEQ ID NO: 68120 - RNA, 19 nt, Homo sapiens
uuacagaacagcugauuga

SEQ ID NO: 68121 - RNA, 19 nt, Homo sapiens
guacacaacgcuacagaug

SEQ ID NO: 68122 - RNA, 19 nt, Homo sapiens
gcagaugccagccacugua

SEQ ID NO: 68123 - RNA, 19 nt, Homo sapiens
gaacgugaggcucggauau

SEQ ID NO: 68124 - RNA, 19 nt, Homo sapiens
guagacccuucauagcuuu

SEQ ID NO: 68125 - RNA, 19 nt, Homo sapiens
gaacaucgugaccaucaga

SEQ ID NO: 68126 - RNA, 19 nt, Homo sapiens
ucacucauccauuucuaua

SEQ ID NO: 68127 - RNA, 19 nt, Homo sapiens
gauggcaaguggcucaaug

SEQ ID NO: 68128 - RNA, 19 nt, Homo sapiens
ccgucaagcuggcugauuu

SEQ ID NO: 68129 - RNA, 19 nt, Homo sapiens
ccacuucuuagcauucuua

SEQ ID NO: 68130 - RNA, 19 nt, Homo sapiens
ugagacccauagcuucaua

SEQ ID NO: 68131 - RNA, 19 nt, Homo sapiens
aaaggaauccauaccauga

SEQ ID NO: 68132 - RNA, 19 nt, Homo sapiens
caaugaaaccuugaacuga

SEQ ID NO: 68133 - RNA, 19 nt, Homo sapiens
gugcugaucuggaccaucu

SEQ ID NO: 68134 - RNA, 19 nt, Homo sapiens
gcaugugggcccuaauauu

SEQ ID NO: 68135 - RNA, 19 nt, Homo sapiens
gaaguguacccgccaugaa

SEQ ID NO: 68136 - RNA, 19 nt, Homo sapiens
acaaauggucuuagaauuc

SEQ ID NO: 68137 - RNA, 19 nt, Homo sapiens
cacgagagcugggagaaga

SEQ ID NO: 68138 - RNA, 19 nt, Homo sapiens
ggccuugguuucccucaaa

SEQ ID NO: 68139 - RNA, 19 nt, Homo sapiens
ugacugcucuggcaagaag

SEQ ID NO: 68140 - RNA, 19 nt, Homo sapiens
guagaagggaagagaauug

SEQ ID NO: 68141 - RNA, 19 nt, Homo sapiens
aacaggagaucauuaagau

SEQ ID NO: 68142 - RNA, 19 nt, Homo sapiens
aaacaggagaucauuaaga

SEQ ID NO: 68143 - RNA, 19 nt, Homo sapiens
gagagcagcaggcuugguu

SEQ ID NO: 68144 - RNA, 19 nt, Homo sapiens
gcaagggugcuuucucugu

SEQ ID NO: 68145 - RNA, 19 nt, Homo sapiens
gggagaagaggcaaagcua

SEQ ID NO: 68146 - RNA, 19 nt, Homo sapiens
ccagagaguacuacaguga

SEQ ID NO: 68147 - RNA, 19 nt, Homo sapiens
gaaggcaggaguauguaug

SEQ ID NO: 68148 - RNA, 19 nt, Homo sapiens
gagaagaggcaaagcuaca

SEQ ID NO: 68149 - RNA, 19 nt, Homo sapiens
gcuguacugucuuguuuag

SEQ ID NO: 68150 - RNA, 19 nt, Homo sapiens
gaacuugaucaaccagaug

SEQ ID NO: 68151 - RNA, 19 nt, Homo sapiens
gaacagcaagccuauccau

SEQ ID NO: 68152 - RNA, 19 nt, Homo sapiens
agaagaagagguguccuua

SEQ ID NO: 68153 - RNA, 19 nt, Homo sapiens
gaagaggugguggucguuu

SEQ ID NO: 68154 - RNA, 19 nt, Homo sapiens
guacugucuuguuuagugu

SEQ ID NO: 68155 - RNA, 19 nt, Homo sapiens
cggcaguccuguuuguuug

SEQ ID NO: 68156 - RNA, 19 nt, Homo sapiens
agaaucuccuguccaagaa

SEQ ID NO: 68157 - RNA, 19 nt, Homo sapiens
gaaagaucccuauggaaaa

SEQ ID NO: 68158 - RNA, 19 nt, Homo sapiens
cagcaggcuugguuugguu

SEQ ID NO: 68159 - RNA, 19 nt, Homo sapiens
ggagaguguuaaccacauc

SEQ ID NO: 68160 - RNA, 19 nt, Homo sapiens
gaggcaaagcuacagguuu

SEQ ID NO: 68161 - RNA, 19 nt, Homo sapiens
uagcaaagaagauaaugga

SEQ ID NO: 68162 - RNA, 19 nt, Homo sapiens
ucuauacccuaagcagaua

SEQ ID NO: 68163 - RNA, 19 nt, Homo sapiens
ccuguuuguuugagguuua

SEQ ID NO: 68164 - RNA, 19 nt, Homo sapiens
ccaaaagccuauugaacaa

SEQ ID NO: 68165 - RNA, 19 nt, Homo sapiens
acaagaaacggaaggcauu

SEQ ID NO: 68166 - RNA, 19 nt, Homo sapiens
ccgagcaccucaugcaugu

SEQ ID NO: 68167 - RNA, 19 nt, Homo sapiens
ucugaaacauccaaacauc

SEQ ID NO: 68168 - RNA, 19 nt, Homo sapiens
caacaccaccacagaagau

SEQ ID NO: 68169 - RNA, 19 nt, Homo sapiens
gcaacaccaccacagaaga

SEQ ID NO: 68170 - RNA, 19 nt, Homo sapiens
gaccauaaacccagcaaag

SEQ ID NO: 68171 - RNA, 19 nt, Homo sapiens
gcggggagcuguuugaaga

SEQ ID NO: 68172 - RNA, 19 nt, Homo sapiens
caagaaacggaaggcauuu

SEQ ID NO: 68173 - RNA, 19 nt, Homo sapiens
ucucugugcucaaggaguu

SEQ ID NO: 68174 - RNA, 19 nt, Homo sapiens
gcaccagccagucagaaga

SEQ ID NO: 68175 - RNA, 19 nt, Homo sapiens
gcgccuccaugacaguauu

SEQ ID NO: 68176 - RNA, 19 nt, Homo sapiens
aaccagaugcugaccauaa

SEQ ID NO: 68177 - RNA, 19 nt, Homo sapiens
ugcacucacucauccauuu

SEQ ID NO: 68178 - RNA, 19 nt, Homo sapiens
uguacugucuuguuuagug

SEQ ID NO: 68179 - RNA, 19 nt, Homo sapiens
uugcuguacugucuuguuu

SEQ ID NO: 68180 - RNA, 19 nt, Homo sapiens
ggagaucauuaagauuaca

SEQ ID NO: 68181 - RNA, 19 nt, Homo sapiens
aggagacuguggaguguuu

SEQ ID NO: 68182 - RNA, 19 nt, Homo sapiens
aaacggaaggcauuugaug

SEQ ID NO: 68183 - RNA, 19 nt, Homo sapiens
caaugcaugugggcccuaa

SEQ ID NO: 68184 - RNA, 19 nt, Homo sapiens
gcaagaaggcaggaguaug

SEQ ID NO: 68185 - RNA, 19 nt, Homo sapiens
gcggcaguccuguuuguuu

SEQ ID NO: 68186 - RNA, 19 nt, Homo sapiens
aaacaacgcugcagauuua

SEQ ID NO: 68187 - RNA, 19 nt, Homo sapiens
gcacaaacaucuccacuuu

SEQ ID NO: 68188 - RNA, 19 nt, Homo sapiens
gaagagaucuauacccuaa

SEQ ID NO: 68189 - RNA, 19 nt, Homo sapiens
ggaaugaacuucuuuggaa

SEQ ID NO: 68190 - RNA, 19 nt, Homo sapiens
ggaaagaucccuauggaaa

SEQ ID NO: 68191 - RNA, 19 nt, Homo sapiens
gaagagguguccuuacaga

SEQ ID NO: 68192 - RNA, 19 nt, Homo sapiens
gaugagaaaccucguguua

SEQ ID NO: 68193 - RNA, 19 nt, Homo sapiens
gaggaaagaucccuaugga

SEQ ID NO: 68194 - RNA, 19 nt, Homo sapiens
aggcaaagcuacagguuua

SEQ ID NO: 68195 - RNA, 19 nt, Homo sapiens
gcagauagcaaagaagaua

SEQ ID NO: 68196 - RNA, 19 nt, Homo sapiens
caggagaucauuaagauua

SEQ ID NO: 68197 - RNA, 19 nt, Homo sapiens
gacaaauggucuuagaauu

SEQ ID NO: 68198 - RNA, 19 nt, Homo sapiens
caaauggucuuagaauuca

SEQ ID NO: 68199 - RNA, 19 nt, Homo sapiens
gagaauuggugcugcagaa

SEQ ID NO: 68200 - RNA, 19 nt, Homo sapiens
ggacguugcuguacugucu

SEQ ID NO: 68201 - RNA, 19 nt, Homo sapiens
gaacuucucagcugccaaa

SEQ ID NO: 68202 - RNA, 19 nt, Homo sapiens
ugagaaaccucguguuagu

SEQ ID NO: 68203 - RNA, 19 nt, Homo sapiens
gcuaaugucagcaucuaua

SEQ ID NO: 68204 - RNA, 19 nt, Homo sapiens
gaaaacaggagaucauuaa

SEQ ID NO: 68205 - RNA, 19 nt, Homo sapiens
gcucggauaugucgacuuc

SEQ ID NO: 68206 - RNA, 19 nt, Homo sapiens
caagaaggcaggaguaugu

SEQ ID NO: 68207 - RNA, 19 nt, Homo sapiens
aaugaaaccuugaacugaa

SEQ ID NO: 68208 - RNA, 19 nt, Homo sapiens
gguagacccuucauagcuu

SEQ ID NO: 68209 - RNA, 19 nt, Homo sapiens
cuaagcagauagcaaagaa

SEQ ID NO: 68210 - RNA, 19 nt, Homo sapiens
gcaugacaacauagaaaua

SEQ ID NO: 68211 - RNA, 19 nt, Homo sapiens
ccaugaagccgaugagaaa

SEQ ID NO: 68212 - RNA, 19 nt, Homo sapiens
ggagccagcugagaagaga

SEQ ID NO: 68213 - RNA, 19 nt, Homo sapiens
aagaagagguguccuuaca

SEQ ID NO: 68214 - RNA, 19 nt, Homo sapiens
gauaauggaggagcaauug

SEQ ID NO: 68215 - RNA, 19 nt, Homo sapiens
guacuacagugaagcagau

SEQ ID NO: 68216 - RNA, 19 nt, Homo sapiens
ggagcuguuugaagacauu

SEQ ID NO: 68217 - RNA, 19 nt, Homo sapiens
gggcuaaugucagcaucua

SEQ ID NO: 68218 - RNA, 19 nt, Homo sapiens
caugugggcccuaauauug

SEQ ID NO: 68219 - RNA, 19 nt, Homo sapiens
gagaacaucgugaccauca

SEQ ID NO: 68220 - RNA, 19 nt, Homo sapiens
uuacagaacagcugauuga

SEQ ID NO: 68221 - RNA, 19 nt, Homo sapiens
guacacaacgcuacagaug

SEQ ID NO: 68222 - RNA, 19 nt, Homo sapiens
gcagaugccagccacugua

SEQ ID NO: 68223 - RNA, 19 nt, Homo sapiens
gaacgugaggcucggauau

SEQ ID NO: 68224 - RNA, 19 nt, Homo sapiens
guagacccuucauagcuuu

SEQ ID NO: 68225 - RNA, 19 nt, Homo sapiens
gaacaucgugaccaucaga

SEQ ID NO: 68226 - RNA, 19 nt, Homo sapiens
ucacucauccauuucuaua

SEQ ID NO: 68227 - RNA, 19 nt, Homo sapiens
gauggcaaguggcucaaug

SEQ ID NO: 68228 - RNA, 19 nt, Homo sapiens
ccgucaagcuggcugauuu

SEQ ID NO: 68229 - RNA, 19 nt, Homo sapiens
ccacuucuuagcauucuua

SEQ ID NO: 68230 - RNA, 19 nt, Homo sapiens
ugagacccauagcuucaua

SEQ ID NO: 68231 - RNA, 19 nt, Homo sapiens
aaaggaauccauaccauga

SEQ ID NO: 68232 - RNA, 19 nt, Homo sapiens
caaugaaaccuugaacuga

SEQ ID NO: 68233 - RNA, 19 nt, Homo sapiens
gugcugaucuggaccaucu

SEQ ID NO: 68234 - RNA, 19 nt, Homo sapiens
gcaugugggcccuaauauu

SEQ ID NO: 68235 - RNA, 19 nt, Homo sapiens
gaaguguacccgccaugaa

SEQ ID NO: 68236 - RNA, 19 nt, Homo sapiens
acaaauggucuuagaauuc

SEQ ID NO: 68237 - RNA, 19 nt, Homo sapiens
cacgagagcugggagaaga

SEQ ID NO: 68238 - RNA, 19 nt, Homo sapiens
ggccuugguuucccucaaa

SEQ ID NO: 68239 - RNA, 19 nt, Homo sapiens
ugacugcucuggcaagaag

SEQ ID NO: 68240 - RNA, 19 nt, Homo sapiens
guagaagggaagagaauug

SEQ ID NO: 68241 - RNA, 19 nt, Homo sapiens
aacaggagaucauuaagau

SEQ ID NO: 68242 - RNA, 19 nt, Homo sapiens
aaacaggagaucauuaaga

SEQ ID NO: 68243 - RNA, 19 nt, Homo sapiens
gagagcagcaggcuugguu

SEQ ID NO: 68244 - RNA, 19 nt, Homo sapiens
gcaagggugcuuucucugu

SEQ ID NO: 68245 - RNA, 19 nt, Homo sapiens
gggagaagaggcaaagcua

SEQ ID NO: 68246 - RNA, 19 nt, Homo sapiens
ccagagaguacuacaguga

SEQ ID NO: 68247 - RNA, 19 nt, Homo sapiens
gaaggcaggaguauguaug

SEQ ID NO: 68248 - RNA, 19 nt, Homo sapiens
gagaagaggcaaagcuaca

SEQ ID NO: 68249 - RNA, 19 nt, Homo sapiens
gcuguacugucuuguuuag

SEQ ID NO: 68250 - RNA, 19 nt, Homo sapiens
gaacuugaucaaccagaug

SEQ ID NO: 68251 - RNA, 19 nt, Homo sapiens
gaacagcaagccuauccau

SEQ ID NO: 68252 - RNA, 19 nt, Homo sapiens
agaagaagagguguccuua

SEQ ID NO: 68253 - RNA, 19 nt, Homo sapiens
gaagaggugguggucguuu

SEQ ID NO: 68254 - RNA, 19 nt, Homo sapiens
guacugucuuguuuagugu

SEQ ID NO: 68255 - RNA, 19 nt, Homo sapiens
cggcaguccuguuuguuug

SEQ ID NO: 68256 - RNA, 19 nt, Homo sapiens
agaaucuccuguccaagaa

SEQ ID NO: 68257 - RNA, 19 nt, Homo sapiens
gaaagaucccuauggaaaa

SEQ ID NO: 68258 - RNA, 19 nt, Homo sapiens
cagcaggcuugguuugguu

SEQ ID NO: 68259 - RNA, 19 nt, Homo sapiens
ggagaguguuaaccacauc

SEQ ID NO: 68260 - RNA, 19 nt, Homo sapiens
gaggcaaagcuacagguuu

SEQ ID NO: 68261 - RNA, 19 nt, Homo sapiens
uagcaaagaagauaaugga

SEQ ID NO: 68262 - RNA, 19 nt, Homo sapiens
ucuauacccuaagcagaua

SEQ ID NO: 68263 - RNA, 19 nt, Homo sapiens
ccuguuuguuugagguuua

SEQ ID NO: 68264 - RNA, 19 nt, Homo sapiens
ccaaaagccuauugaacaa

SEQ ID NO: 68265 - RNA, 19 nt, Homo sapiens
acaagaaacggaaggcauu

SEQ ID NO: 68266 - RNA, 19 nt, Homo sapiens
ccgagcaccucaugcaugu

SEQ ID NO: 68267 - RNA, 19 nt, Homo sapiens
ucugaaacauccaaacauc

SEQ ID NO: 68268 - RNA, 19 nt, Homo sapiens
caacaccaccacagaagau

SEQ ID NO: 68269 - RNA, 19 nt, Homo sapiens
gcaacaccaccacagaaga

SEQ ID NO: 68270 - RNA, 19 nt, Homo sapiens
gaccauaaacccagcaaag

SEQ ID NO: 68271 - RNA, 19 nt, Homo sapiens
gcggggagcuguuugaaga

SEQ ID NO: 68272 - RNA, 19 nt, Homo sapiens
caagaaacggaaggcauuu

SEQ ID NO: 68273 - RNA, 19 nt, Homo sapiens
ucucugugcucaaggaguu

SEQ ID NO: 68274 - RNA, 19 nt, Homo sapiens
gcaccagccagucagaaga

SEQ ID NO: 68275 - RNA, 19 nt, Homo sapiens
gcgccuccaugacaguauu

SEQ ID NO: 68276 - RNA, 19 nt, Homo sapiens
aaccagaugcugaccauaa

SEQ ID NO: 68277 - RNA, 19 nt, Homo sapiens
ugcacucacucauccauuu

SEQ ID NO: 68278 - RNA, 19 nt, Homo sapiens
uguacugucuuguuuagug

SEQ ID NO: 68279 - RNA, 19 nt, Homo sapiens
uugcuguacugucuuguuu

SEQ ID NO: 68280 - RNA, 19 nt, Homo sapiens
ggagaucauuaagauuaca

SEQ ID NO: 68281 - RNA, 19 nt, Homo sapiens
aggagacuguggaguguuu

SEQ ID NO: 68282 - RNA, 19 nt, Homo sapiens
aaacggaaggcauuugaug

SEQ ID NO: 68283 - RNA, 19 nt, Homo sapiens
caaugcaugugggcccuaa

SEQ ID NO: 68284 - RNA, 19 nt, Homo sapiens
gcaagaaggcaggaguaug

SEQ ID NO: 68285 - RNA, 19 nt, Homo sapiens
gcggcaguccuguuuguuu

SEQ ID NO: 68286 - RNA, 19 nt, Homo sapiens
ggaaacagcugauuaguga

SEQ ID NO: 68287 - RNA, 19 nt, Homo sapiens
ggagaaagcugcucaugaa

SEQ ID NO: 68288 - RNA, 19 nt, Homo sapiens
gaaagaaacugaauugucu

SEQ ID NO: 68289 - RNA, 19 nt, Homo sapiens
gcaccuggccuuauaaaua

SEQ ID NO: 68290 - RNA, 19 nt, Homo sapiens
gaaacugaauugucuaaug

SEQ ID NO: 68291 - RNA, 19 nt, Homo sapiens
gucaugaacugcuugauua

SEQ ID NO: 68292 - RNA, 19 nt, Homo sapiens
aaauuggacucguucauua

SEQ ID NO: 68293 - RNA, 19 nt, Homo sapiens
gcaaauugguuuacaccuu

SEQ ID NO: 68294 - RNA, 19 nt, Homo sapiens
gggcugaguuuguauuauu

SEQ ID NO: 68295 - RNA, 19 nt, Homo sapiens
gaagauaaagacaacagua

SEQ ID NO: 68296 - RNA, 19 nt, Homo sapiens
guacaugggauuauacaaa

SEQ ID NO: 68297 - RNA, 19 nt, Homo sapiens
gaagaagcaaugaagcuaa

SEQ ID NO: 68298 - RNA, 19 nt, Homo sapiens
ccaaguagcugggauuaca

SEQ ID NO: 68299 - RNA, 19 nt, Homo sapiens
gaaagcugcucaugaacuc

SEQ ID NO: 68300 - RNA, 19 nt, Homo sapiens
caccuggccuuauaaauau

SEQ ID NO: 68301 - RNA, 19 nt, Homo sapiens
ccaaauauggucuagauga

SEQ ID NO: 68302 - RNA, 19 nt, Homo sapiens
gauaaagacaacaguacua

SEQ ID NO: 68303 - RNA, 19 nt, Homo sapiens
caaagcagcaggacaguga

SEQ ID NO: 68304 - RNA, 19 nt, Homo sapiens
guccauauuugcuccauuu

SEQ ID NO: 68305 - RNA, 19 nt, Homo sapiens
ggauggaaauacaacagaa

SEQ ID NO: 68306 - RNA, 19 nt, Homo sapiens
gaagaagaaagucaaacaa

SEQ ID NO: 68307 - RNA, 19 nt, Homo sapiens
acuaacagcugcacuucua

SEQ ID NO: 68308 - RNA, 19 nt, Homo sapiens
cagcacaaguauuuaauca

SEQ ID NO: 68309 - RNA, 19 nt, Homo sapiens
gagacugcuucuuguguuu

SEQ ID NO: 68310 - RNA, 19 nt, Homo sapiens
ccucuaacuucucagauuu

SEQ ID NO: 68311 - RNA, 19 nt, Homo sapiens
uaaaagggcugaguuugua

SEQ ID NO: 68312 - RNA, 19 nt, Homo sapiens
gaauagaguaccaauguca

SEQ ID NO: 68313 - RNA, 19 nt, Homo sapiens
cuaaggaaacagcugauua

SEQ ID NO: 68314 - RNA, 19 nt, Homo sapiens
caaugaagcuaaggaaaca

SEQ ID NO: 68315 - RNA, 19 nt, Homo sapiens
ggaagaagaaagucaaaca

SEQ ID NO: 68316 - RNA, 19 nt, Homo sapiens
ggcugaguuuguauuauua

SEQ ID NO: 68317 - RNA, 19 nt, Homo sapiens
cauauuugcuccauuucuu

SEQ ID NO: 68318 - RNA, 19 nt, Homo sapiens
ucaagaggauggaaauaca

SEQ ID NO: 68319 - RNA, 19 nt, Homo sapiens
gagacaaauuggacucguu

SEQ ID NO: 68320 - RNA, 19 nt, Homo sapiens
gguuaauccuugugacauu

SEQ ID NO: 68321 - RNA, 19 nt, Homo sapiens
aaugggaugugaagaauug

SEQ ID NO: 68322 - RNA, 19 nt, Homo sapiens
gggaauuccugccgaagug

SEQ ID NO: 68323 - RNA, 19 nt, Homo sapiens
gcaguaccuuuccagauuc

SEQ ID NO: 68324 - RNA, 19 nt, Homo sapiens
uaaaggaggcaaauugguu

SEQ ID NO: 68325 - RNA, 19 nt, Homo sapiens
gguguuacauuuccuuaca

SEQ ID NO: 68326 - RNA, 19 nt, Homo sapiens
gaauuugacucuuuucgaa

SEQ ID NO: 68327 - RNA, 19 nt, Homo sapiens
ggaaauacaacagaagaau

SEQ ID NO: 68328 - RNA, 19 nt, Homo sapiens
caaauuggacucguucauu

SEQ ID NO: 68329 - RNA, 19 nt, Homo sapiens
caugugaaauuggaaggua

SEQ ID NO: 68330 - RNA, 19 nt, Homo sapiens
gaacugagaaggagaagcu

SEQ ID NO: 68331 - RNA, 19 nt, Homo sapiens
caaauauggucuagaugag

SEQ ID NO: 68332 - RNA, 19 nt, Homo sapiens
caugaagccuguagaacug

SEQ ID NO: 68333 - RNA, 19 nt, Homo sapiens
ccaaagugcugggauuaca

SEQ ID NO: 68334 - RNA, 19 nt, Homo sapiens
gcaacccaauagcauaaau

SEQ ID NO: 68335 - RNA, 19 nt, Homo sapiens
gccauggccuagagcagua

SEQ ID NO: 68336 - RNA, 19 nt, Homo sapiens
agacuaaaguguuaauguc

SEQ ID NO: 68337 - RNA, 19 nt, Homo sapiens
agacaggguuucuccaugu

SEQ ID NO: 68338 - RNA, 19 nt, Homo sapiens
gcaaugaagcuaaggaaac

SEQ ID NO: 68339 - RNA, 19 nt, Homo sapiens
uggucuagaugaguuauua

SEQ ID NO: 68340 - RNA, 19 nt, Homo sapiens
agaaggagaagcuuacaaa

SEQ ID NO: 68341 - RNA, 19 nt, Homo sapiens
gaucaauggauaccuauag

SEQ ID NO: 68342 - RNA, 19 nt, Homo sapiens
aaacagcugauuagugaaa

SEQ ID NO: 68343 - RNA, 19 nt, Homo sapiens
aagaauagaguaccaaugu

SEQ ID NO: 68344 - RNA, 19 nt, Homo sapiens
gaagaauagaguaccaaug

SEQ ID NO: 68345 - RNA, 19 nt, Homo sapiens
agcaguaccuuuccagauu

SEQ ID NO: 68346 - RNA, 19 nt, Homo sapiens
acagauaaauguggucuca

SEQ ID NO: 68347 - RNA, 19 nt, Homo sapiens
uaggagaacagauaaaugu

SEQ ID NO: 68348 - RNA, 19 nt, Homo sapiens
ggugggaugugcucuucuu

SEQ ID NO: 68349 - RNA, 19 nt, Homo sapiens
uaaggaaacagcugauuag

SEQ ID NO: 68350 - RNA, 19 nt, Homo sapiens
aauauggucuagaugaguu

SEQ ID NO: 68351 - RNA, 19 nt, Homo sapiens
ugaaagaaacugaauuguc

SEQ ID NO: 68352 - RNA, 19 nt, Homo sapiens
ggaggcaaauugguuuaca

SEQ ID NO: 68353 - RNA, 19 nt, Homo sapiens
gcucugaaguaccaugaag

SEQ ID NO: 68354 - RNA, 19 nt, Homo sapiens
cagcugcacuucuauuguc

SEQ ID NO: 68355 - RNA, 19 nt, Homo sapiens
cacugcaccuggccuuaua

SEQ ID NO: 68356 - RNA, 19 nt, Homo sapiens
ucauacaugugaaauugga

SEQ ID NO: 68357 - RNA, 19 nt, Homo sapiens
augaacugcuugauuauug

SEQ ID NO: 68358 - RNA, 19 nt, Homo sapiens
gaguagugcugggugauuc

SEQ ID NO: 68359 - RNA, 19 nt, Homo sapiens
gacaggguuucuccauguu

SEQ ID NO: 68360 - RNA, 19 nt, Homo sapiens
uaacagcugcacuucuauu

SEQ ID NO: 68361 - RNA, 19 nt, Homo sapiens
aaagacaacaguacuaaca

SEQ ID NO: 68362 - RNA, 19 nt, Homo sapiens
cgaagaagcaaugaagcua

SEQ ID NO: 68363 - RNA, 19 nt, Homo sapiens
cagcguuccuuccguuuca

SEQ ID NO: 68364 - RNA, 19 nt, Homo sapiens
ccaacugggagacaaauug

SEQ ID NO: 68365 - RNA, 19 nt, Homo sapiens
ugcaaauacuuguccauau

SEQ ID NO: 68366 - RNA, 19 nt, Homo sapiens
ccaccugagugcaguagug

SEQ ID NO: 68367 - RNA, 19 nt, Homo sapiens
gcagcaggacagugauaaa

SEQ ID NO: 68368 - RNA, 19 nt, Homo sapiens
ccaccacgcccagcuaauu

SEQ ID NO: 68369 - RNA, 19 nt, Homo sapiens
ccuagagacugcuucuugu

SEQ ID NO: 68370 - RNA, 19 nt, Homo sapiens
gagcaguaccuuuccagau

SEQ ID NO: 68371 - RNA, 19 nt, Homo sapiens
gucacuugguguuacauuu

SEQ ID NO: 68372 - RNA, 19 nt, Homo sapiens
aaaggaggcaaauugguuu

SEQ ID NO: 68373 - RNA, 19 nt, Homo sapiens
uugcguacaugggauuaua

SEQ ID NO: 68374 - RNA, 19 nt, Homo sapiens
agagacugcuucuuguguu

SEQ ID NO: 68375 - RNA, 19 nt, Homo sapiens
cuucucagauuuguaauuc

SEQ ID NO: 68376 - RNA, 19 nt, Homo sapiens
caauggauaccuauagcaa

SEQ ID NO: 68377 - RNA, 19 nt, Homo sapiens
gaagcaaugaagcuaagga

SEQ ID NO: 68378 - RNA, 19 nt, Homo sapiens
gaagaauugaggcaugcaa

SEQ ID NO: 68379 - RNA, 19 nt, Homo sapiens
caaaaugggaugugaagaa

SEQ ID NO: 68380 - RNA, 19 nt, Homo sapiens
guagaacugagaaggagaa

SEQ ID NO: 68381 - RNA, 19 nt, Homo sapiens
uauauugcagugucucuaa

SEQ ID NO: 68382 - RNA, 19 nt, Homo sapiens
gaacagaggggaccugaca

SEQ ID NO: 68383 - RNA, 19 nt, Homo sapiens
guuggguugucuucuuaaa

SEQ ID NO: 68384 - RNA, 19 nt, Homo sapiens
uguuaacucugcacauugu

SEQ ID NO: 68385 - RNA, 19 nt, Homo sapiens
cggagaaagcugcucauga

SEQ ID NO: 68386 - RNA, 19 nt, Homo sapiens
gaagauuggcaaagaguuu

SEQ ID NO: 68387 - RNA, 19 nt, Homo sapiens
aagagaagauuggcaaaga

SEQ ID NO: 68388 - RNA, 19 nt, Homo sapiens
ugauaaggauaacaagaga

SEQ ID NO: 68389 - RNA, 19 nt, Homo sapiens
gcucugagaaauaaacuau

SEQ ID NO: 68390 - RNA, 19 nt, Homo sapiens
uaaaagaauuguccagaga

SEQ ID NO: 68391 - RNA, 19 nt, Homo sapiens
aaagaauuguccagagaau

SEQ ID NO: 68392 - RNA, 19 nt, Homo sapiens
ucugggcucugagaaauaa

SEQ ID NO: 68393 - RNA, 19 nt, Homo sapiens
ccggaaaucuaaagagaag

SEQ ID NO: 68394 - RNA, 19 nt, Homo sapiens
ccaugaagacccaaaggaa

SEQ ID NO: 68395 - RNA, 19 nt, Homo sapiens
ggcaaagaguuuaaaagaa

SEQ ID NO: 68396 - RNA, 19 nt, Homo sapiens
agaauuguccagagaauca

SEQ ID NO: 68397 - RNA, 19 nt, Homo sapiens
gagaagauuggcaaagagu

SEQ ID NO: 68398 - RNA, 19 nt, Homo sapiens
ucaguugugauaaggauaa

SEQ ID NO: 68399 - RNA, 19 nt, Homo sapiens
ggacagugacccucaacca

SEQ ID NO: 68400 - RNA, 19 nt, Homo sapiens
caugaagacccaaaggaau

SEQ ID NO: 68401 - RNA, 19 nt, Homo sapiens
aaggauaacaagagauuug

SEQ ID NO: 68402 - RNA, 19 nt, Homo sapiens
uaaagagaagauuggcaaa

SEQ ID NO: 68403 - RNA, 19 nt, Homo sapiens
gugauaaggauaacaagag

SEQ ID NO: 68404 - RNA, 19 nt, Homo sapiens
aagauuggcaaagaguuua

SEQ ID NO: 68405 - RNA, 19 nt, Homo sapiens
agagaagauuggcaaagag

SEQ ID NO: 68406 - RNA, 19 nt, Homo sapiens
uuccggaaaucuaaagaga

SEQ ID NO: 68407 - RNA, 19 nt, Homo sapiens
ccuuugacaucaguuguga

SEQ ID NO: 68408 - RNA, 19 nt, Homo sapiens
ccugcugggugauuucuuc

SEQ ID NO: 68409 - RNA, 19 nt, Homo sapiens
cagcgguccucggaugcua

SEQ ID NO: 68410 - RNA, 19 nt, Homo sapiens
ccagaggauugugacuuca

SEQ ID NO: 68411 - RNA, 19 nt, Homo sapiens
gcagucaccagaggauugu

SEQ ID NO: 68412 - RNA, 19 nt, Homo sapiens
accagaggauugugacuuc

SEQ ID NO: 68413 - RNA, 19 nt, Homo sapiens
gccaugaagacccaaagga

SEQ ID NO: 68414 - RNA, 19 nt, Homo sapiens
ccucggaugcuaaccucua

SEQ ID NO: 68415 - RNA, 19 nt, Homo sapiens
gauaaggauaacaagagau

SEQ ID NO: 68416 - RNA, 19 nt, Homo sapiens
gggcuccuuugacaucagu

SEQ ID NO: 68417 - RNA, 19 nt, Homo sapiens
gaaggacgggcuggugaag

SEQ ID NO: 68418 - RNA, 19 nt, Homo sapiens
gaaacaaucuuaagagcuu

SEQ ID NO: 68419 - RNA, 19 nt, Homo sapiens
uaacguggcuuguagaauu

SEQ ID NO: 68420 - RNA, 19 nt, Homo sapiens
gaacagacuagaaguauuu

SEQ ID NO: 68421 - RNA, 19 nt, Homo sapiens
gaugaaggcuguaucuauu

SEQ ID NO: 68422 - RNA, 19 nt, Homo sapiens
gaagaauaguugaugauug

SEQ ID NO: 68423 - RNA, 19 nt, Homo sapiens
gcagguggcuuguuaagga

SEQ ID NO: 68424 - RNA, 19 nt, Homo sapiens
guggaaaucugcucaauga

SEQ ID NO: 68425 - RNA, 19 nt, Homo sapiens
gcagaugggugcuaucaga

SEQ ID NO: 68426 - RNA, 19 nt, Homo sapiens
gaacuuugccagucuuuaa

SEQ ID NO: 68427 - RNA, 19 nt, Homo sapiens
ggaagugguugcuguguau

SEQ ID NO: 68428 - RNA, 19 nt, Homo sapiens
ugacaugacuccuccugua

SEQ ID NO: 68429 - RNA, 19 nt, Homo sapiens
ccagugguauggaguauaa

SEQ ID NO: 68430 - RNA, 19 nt, Homo sapiens
gagcuuaaauugucagauc

SEQ ID NO: 68431 - RNA, 19 nt, Homo sapiens
gaaagacgauaccgaugau

SEQ ID NO: 68432 - RNA, 19 nt, Homo sapiens
ggagagggacugaauagaa

SEQ ID NO: 68433 - RNA, 19 nt, Homo sapiens
guaaauacuugcaguugug

SEQ ID NO: 68434 - RNA, 19 nt, Homo sapiens
gcugagcuuuaaaucauua

SEQ ID NO: 68435 - RNA, 19 nt, Homo sapiens
uauaagcccugcauaaugu

SEQ ID NO: 68436 - RNA, 19 nt, Homo sapiens
gaaaagugaugcugaagaa

SEQ ID NO: 68437 - RNA, 19 nt, Homo sapiens
gaacagaucaccaagaaac

SEQ ID NO: 68438 - RNA, 19 nt, Homo sapiens
gaaaucugcucaaugacau

SEQ ID NO: 68439 - RNA, 19 nt, Homo sapiens
uagcuucaguuguucuuua

SEQ ID NO: 68440 - RNA, 19 nt, Homo sapiens
gaaaguguguguguucugu

SEQ ID NO: 68441 - RNA, 19 nt, Homo sapiens
aagagaaacuugaagagaa

SEQ ID NO: 68442 - RNA, 19 nt, Homo sapiens
gcacgugagcuccggaaua

SEQ ID NO: 68443 - RNA, 19 nt, Homo sapiens
gaagagaaacuugaagaga

SEQ ID NO: 68444 - RNA, 19 nt, Homo sapiens
cgauaccgaugaugaaauu

SEQ ID NO: 68445 - RNA, 19 nt, Homo sapiens
gcacuugggcauuuauauu

SEQ ID NO: 68446 - RNA, 19 nt, Homo sapiens
gagagggacugaauagaag

SEQ ID NO: 68447 - RNA, 19 nt, Homo sapiens
uugaagaucuggaaccuuu

SEQ ID NO: 68448 - RNA, 19 nt, Homo sapiens
ggauugggaugaagacaug

SEQ ID NO: 68449 - RNA, 19 nt, Homo sapiens
cauuagagcuuaaauuguc

SEQ ID NO: 68450 - RNA, 19 nt, Homo sapiens
uggagcagguggcuuguua

SEQ ID NO: 68451 - RNA, 19 nt, Homo sapiens
aaaggacccuguuucugua

SEQ ID NO: 68452 - RNA, 19 nt, Homo sapiens
ggaggaaggagaagagaaa

SEQ ID NO: 68453 - RNA, 19 nt, Homo sapiens
gaaauugccaaauaugaug

SEQ ID NO: 68454 - RNA, 19 nt, Homo sapiens
gaagauauugggaaggaaa

SEQ ID NO: 68455 - RNA, 19 nt, Homo sapiens
agaauugacugcaguugaa

SEQ ID NO: 68456 - RNA, 19 nt, Homo sapiens
agagaaacuugaagagaaa

SEQ ID NO: 68457 - RNA, 19 nt, Homo sapiens
ggaagccuccuaugauuga

SEQ ID NO: 68458 - RNA, 19 nt, Homo sapiens
aaacacaucuuuacacacu

SEQ ID NO: 68459 - RNA, 19 nt, Homo sapiens
gaaaauaugucugcagguu

SEQ ID NO: 68460 - RNA, 19 nt, Homo sapiens
caauaaagcaguccuguuc

SEQ ID NO: 68461 - RNA, 19 nt, Homo sapiens
uaaaggacccuguuucugu

SEQ ID NO: 68462 - RNA, 19 nt, Homo sapiens
gggaagugguugcugugua

SEQ ID NO: 68463 - RNA, 19 nt, Homo sapiens
gggaagauauugggaagga

SEQ ID NO: 68464 - RNA, 19 nt, Homo sapiens
aagcaguccuguucaaauu

SEQ ID NO: 68465 - RNA, 19 nt, Homo sapiens
ugauugauauugaggauga

SEQ ID NO: 68466 - RNA, 19 nt, Homo sapiens
gcuuggaacugcuauuguu

SEQ ID NO: 68467 - RNA, 19 nt, Homo sapiens
gaaaacacaucuuuacaca

SEQ ID NO: 68468 - RNA, 19 nt, Homo sapiens
aaacggguaucuaugaaga

SEQ ID NO: 68469 - RNA, 19 nt, Homo sapiens
uagcagacuuucccaaaug

SEQ ID NO: 68470 - RNA, 19 nt, Homo sapiens
gagaagagaaacuugaaga

SEQ ID NO: 68471 - RNA, 19 nt, Homo sapiens
gcaaauggaagccuccuau

SEQ ID NO: 68472 - RNA, 19 nt, Homo sapiens
agacauggauggagaaugg

SEQ ID NO: 68473 - RNA, 19 nt, Homo sapiens
cugcuaagauuccagauga

SEQ ID NO: 68474 - RNA, 19 nt, Homo sapiens
uuacaaagcuccaguucca

SEQ ID NO: 68475 - RNA, 19 nt, Homo sapiens
gguccagcauccugauuaa

SEQ ID NO: 68476 - RNA, 19 nt, Homo sapiens
gaucauugcauuuccagaa

SEQ ID NO: 68477 - RNA, 19 nt, Homo sapiens
aagcaugaguuaucugauu

SEQ ID NO: 68478 - RNA, 19 nt, Homo sapiens
aaagugaucuuagguuugu

SEQ ID NO: 68479 - RNA, 19 nt, Homo sapiens
ugagucagcuccuggaugu

SEQ ID NO: 68480 - RNA, 19 nt, Homo sapiens
cagagaaaccugaggauug

SEQ ID NO: 68481 - RNA, 19 nt, Homo sapiens
ggaaaucugcucaaugaca

SEQ ID NO: 68482 - RNA, 19 nt, Homo sapiens
acacaucuuuacacacuaa

SEQ ID NO: 68483 - RNA, 19 nt, Homo sapiens
caccaagccucucauuguu

SEQ ID NO: 68484 - RNA, 19 nt, Homo sapiens
gauagaacuuugccagucu

SEQ ID NO: 68485 - RNA, 19 nt, Homo sapiens
gauauaaaggacccuguuu

SEQ ID NO: 68486 - RNA, 19 nt, Homo sapiens
gaaggaagaggaagaagag

SEQ ID NO: 68487 - RNA, 19 nt, Homo sapiens
ucagauguguuccuccauu

SEQ ID NO: 68488 - RNA, 19 nt, Homo sapiens
uuuagaggcuuucaaaugu

SEQ ID NO: 68489 - RNA, 19 nt, Homo sapiens
gaagcccaaauucauauaa

SEQ ID NO: 68490 - RNA, 19 nt, Homo sapiens
cauaaugguugugaaaugu

SEQ ID NO: 68491 - RNA, 19 nt, Homo sapiens
gaagagagugaaacaaucu

SEQ ID NO: 68492 - RNA, 19 nt, Homo sapiens
cgaagagagugaaacaauc

SEQ ID NO: 68493 - RNA, 19 nt, Homo sapiens
gauaaaggacuuguguuga

SEQ ID NO: 68494 - RNA, 19 nt, Homo sapiens
aaauaugucugcagguuuc

SEQ ID NO: 68495 - RNA, 19 nt, Homo sapiens
gugauuacguguauguuuc

SEQ ID NO: 68496 - RNA, 19 nt, Homo sapiens
acuagucuguguaacuuua

SEQ ID NO: 68497 - RNA, 19 nt, Homo sapiens
gaugaugaugugauugaua

SEQ ID NO: 68498 - RNA, 19 nt, Homo sapiens
cagauguguuccuccauuu

SEQ ID NO: 68499 - RNA, 19 nt, Homo sapiens
ggagaugaguugcaguuuu

SEQ ID NO: 68500 - RNA, 19 nt, Homo sapiens
uugaacagaucaccaagaa

SEQ ID NO: 68501 - RNA, 19 nt, Homo sapiens
ggaaggagaagagaaacuu

SEQ ID NO: 68502 - RNA, 19 nt, Homo sapiens
aagaauaguugaugauugg

SEQ ID NO: 68503 - RNA, 19 nt, Homo sapiens
augcagaucugaagaccua

SEQ ID NO: 68504 - RNA, 19 nt, Homo sapiens
uaaaggacuuguguugaug

SEQ ID NO: 68505 - RNA, 19 nt, Homo sapiens
gagagugaaacaaucuuaa

SEQ ID NO: 68506 - RNA, 19 nt, Homo sapiens
ccaagccucucauuguuca

SEQ ID NO: 68507 - RNA, 19 nt, Homo sapiens
auaaaggacuuguguugau

SEQ ID NO: 68508 - RNA, 19 nt, Homo sapiens
uuagaggcuuucaaaugua

SEQ ID NO: 68509 - RNA, 19 nt, Homo sapiens
uguaacaguugugucauaa

SEQ ID NO: 68510 - RNA, 19 nt, Homo sapiens
gcaauucauguaacaguug

SEQ ID NO: 68511 - RNA, 19 nt, Homo sapiens
ugaacagacuagaaguauu

SEQ ID NO: 68512 - RNA, 19 nt, Homo sapiens
ucagcaggcuccaguugaa

SEQ ID NO: 68513 - RNA, 19 nt, Homo sapiens
gaagaugguggcacuguca

SEQ ID NO: 68514 - RNA, 19 nt, Homo sapiens
gcagagaaaccugaggauu

SEQ ID NO: 68515 - RNA, 19 nt, Homo sapiens
cugguuaccuguuccauug

SEQ ID NO: 68516 - RNA, 19 nt, Homo sapiens
cuuuaaacaucuagcagua

SEQ ID NO: 68517 - RNA, 19 nt, Homo sapiens
uggguagucuauauucuaa

SEQ ID NO: 68518 - RNA, 19 nt, Homo sapiens
ggaggagccugcugagaug

SEQ ID NO: 68519 - RNA, 19 nt, Homo sapiens
gauaucugaugacugcuuu

SEQ ID NO: 68520 - RNA, 19 nt, Homo sapiens
cagaagagguuucccaucu

SEQ ID NO: 68521 - RNA, 19 nt, Homo sapiens
caaugagucugaccucuuc

SEQ ID NO: 68522 - RNA, 19 nt, Homo sapiens
gaacugcugauaucugaug

SEQ ID NO: 68523 - RNA, 19 nt, Homo sapiens
gaaccagggcgucuucuuc

SEQ ID NO: 68524 - RNA, 19 nt, Homo sapiens
gcaaugagucugaccucuu

SEQ ID NO: 68525 - RNA, 19 nt, Homo sapiens
cugcagauguucaauaaag

SEQ ID NO: 68526 - RNA, 19 nt, Homo sapiens
ggaaggugguguggaguca

SEQ ID NO: 68527 - RNA, 19 nt, Homo sapiens
gggaggagccugcugagau

SEQ ID NO: 68528 - RNA, 19 nt, Homo sapiens
ggagucagcauuucacaag

SEQ ID NO: 68529 - RNA, 19 nt, Homo sapiens
ccgcagcucuguauaaggu

SEQ ID NO: 68530 - RNA, 19 nt, Homo sapiens
gauccaggccugcaugugu

SEQ ID NO: 68531 - RNA, 19 nt, Homo sapiens
cccugcagauguucaauaa

SEQ ID NO: 68532 - RNA, 19 nt, Homo sapiens
gaaaagcgaaugagaagga

SEQ ID NO: 68533 - RNA, 19 nt, Homo sapiens
gaucugaagacagcaugua

SEQ ID NO: 68534 - RNA, 19 nt, Homo sapiens
gcacaauggcccagaagag

SEQ ID NO: 68535 - RNA, 19 nt, Homo sapiens
gcagauguucaauaaagga

SEQ ID NO: 68536 - RNA, 19 nt, Homo sapiens
uugaacugcugauaucuga

SEQ ID NO: 68537 - RNA, 19 nt, Homo sapiens
acacucagguggagauucu

SEQ ID NO: 68538 - RNA, 19 nt, Homo sapiens
gaacugggacagcuucaac

SEQ ID NO: 68539 - RNA, 19 nt, Homo sapiens
gagucagcauuucacaaga

SEQ ID NO: 68540 - RNA, 19 nt, Homo sapiens
gcaaggcccagguggagau

SEQ ID NO: 68541 - RNA, 19 nt, Homo sapiens
agguggagauugucacuga

SEQ ID NO: 68542 - RNA, 19 nt, Homo sapiens
cagcugccaucaagaaacu

SEQ ID NO: 68543 - RNA, 19 nt, Homo sapiens
gagucugaccucuucauga

SEQ ID NO: 68544 - RNA, 19 nt, Homo sapiens
ggccgcagcucuguauaag

SEQ ID NO: 68545 - RNA, 19 nt, Homo sapiens
gggcaacccugaggaagac

SEQ ID NO: 68546 - RNA, 19 nt, Homo sapiens
caucugcaccuguggauag

SEQ ID NO: 68547 - RNA, 19 nt, Homo sapiens
gaaccuacgaagcagagau

SEQ ID NO: 68548 - RNA, 19 nt, Homo sapiens
ggauaggccagcagucauc

SEQ ID NO: 68549 - RNA, 19 nt, Homo sapiens
gaacacucagguggagauu

SEQ ID NO: 68550 - RNA, 19 nt, Homo sapiens
ucacagcugacaaggcaaa

SEQ ID NO: 68551 - RNA, 19 nt, Homo sapiens
gcugcacaauggcccagaa

SEQ ID NO: 68552 - RNA, 19 nt, Homo sapiens
ugaugccacuggacagaug

SEQ ID NO: 68553 - RNA, 19 nt, Homo sapiens
agucugaccucuucaugag

SEQ ID NO: 68554 - RNA, 19 nt, Homo sapiens
agaagagguuucccaucug

SEQ ID NO: 68555 - RNA, 19 nt, Homo sapiens
ucaauaaaggagacaagug

SEQ ID NO: 68556 - RNA, 19 nt, Homo sapiens
gugagagucccaucuucaa

SEQ ID NO: 68557 - RNA, 19 nt, Homo sapiens
gcccuugaacugcugauau

SEQ ID NO: 68558 - RNA, 19 nt, Homo sapiens
gaagaccucacagcugaca

SEQ ID NO: 68559 - RNA, 19 nt, Homo sapiens
gguguggagucagcauuuc

SEQ ID NO: 68560 - RNA, 19 nt, Homo sapiens
gaaacucuaccaggugaag

SEQ ID NO: 68561 - RNA, 19 nt, Homo sapiens
caauggcccagaagagguu

SEQ ID NO: 68562 - RNA, 19 nt, Homo sapiens
cagcauguacacagccauu

SEQ ID NO: 68563 - RNA, 19 nt, Homo sapiens
ccaggccgcagcucuguau

SEQ ID NO: 68564 - RNA, 19 nt, Homo sapiens
ggagccugcugagaugauc

SEQ ID NO: 68565 - RNA, 19 nt, Homo sapiens
gcgaggugcagggcaauga

SEQ ID NO: 68566 - RNA, 19 nt, Homo sapiens
cccuugaacugcugauauc

SEQ ID NO: 68567 - RNA, 19 nt, Homo sapiens
ucaucucgcgcaugcagua

SEQ ID NO: 68568 - RNA, 19 nt, Homo sapiens
ccaagccugcucugaagga

SEQ ID NO: 68569 - RNA, 19 nt, Homo sapiens
guggauaggccagcaguca

SEQ ID NO: 68570 - RNA, 19 nt, Homo sapiens
ggaauuaccuguccaucuu

SEQ ID NO: 68571 - RNA, 19 nt, Homo sapiens
ccacggaacugcugucaaa

SEQ ID NO: 68572 - RNA, 19 nt, Homo sapiens
ggaacaacguggacccaua

SEQ ID NO: 68573 - RNA, 19 nt, Homo sapiens
gaaggcagcuuucgcuugu

SEQ ID NO: 68574 - RNA, 19 nt, Homo sapiens
ggccagagcuuccagaaug

SEQ ID NO: 68575 - RNA, 19 nt, Homo sapiens
gaaggccuaugccaaggua

SEQ ID NO: 68576 - RNA, 19 nt, Homo sapiens
ggacacagaucuggaugga

SEQ ID NO: 68577 - RNA, 19 nt, Homo sapiens
ggaaccgcauccggaauua

SEQ ID NO: 68578 - RNA, 19 nt, Homo sapiens
gaacaacguggacccauau

SEQ ID NO: 68579 - RNA, 19 nt, Homo sapiens
gaacaccacacucuacgaa

SEQ ID NO: 68580 - RNA, 19 nt, Homo sapiens
ggacuuguguacugguuau

SEQ ID NO: 68581 - RNA, 19 nt, Homo sapiens
ucaauaggaucaucagcaa

SEQ ID NO: 68582 - RNA, 19 nt, Homo sapiens
ggauggaguugugaccuuu

SEQ ID NO: 68583 - RNA, 19 nt, Homo sapiens
aagaggagauugacgagaa

SEQ ID NO: 68584 - RNA, 19 nt, Homo sapiens
ccagugaccucuaccagau

SEQ ID NO: 68585 - RNA, 19 nt, Homo sapiens
ggagcgcccugcuugagaa

SEQ ID NO: 68586 - RNA, 19 nt, Homo sapiens
caacguggacccauaugaa

SEQ ID NO: 68587 - RNA, 19 nt, Homo sapiens
ggccaugccuacucuguga

SEQ ID NO: 68588 - RNA, 19 nt, Homo sapiens
gaucaucagcaaacacaaa

SEQ ID NO: 68589 - RNA, 19 nt, Homo sapiens
gaagggccaugccuacucu

SEQ ID NO: 68590 - RNA, 19 nt, Homo sapiens
ggaggucccguguuccaua

SEQ ID NO: 68591 - RNA, 19 nt, Homo sapiens
ggccaucacuuucaagaag

SEQ ID NO: 68592 - RNA, 19 nt, Homo sapiens
ggccuugccugcagacuau

SEQ ID NO: 68593 - RNA, 19 nt, Homo sapiens
gguugcagcugaccauguu

SEQ ID NO: 68594 - RNA, 19 nt, Homo sapiens
gaaacuacccagccaccuu

SEQ ID NO: 68595 - RNA, 19 nt, Homo sapiens
acaaagaccugcggaccaa

SEQ ID NO: 68596 - RNA, 19 nt, Homo sapiens
gaacuucaaggcccucuuc

SEQ ID NO: 68597 - RNA, 19 nt, Homo sapiens
gggccaagcaggugaacua

SEQ ID NO: 68598 - RNA, 19 nt, Homo sapiens
caacaaggagggcgacuuc

SEQ ID NO: 68599 - RNA, 19 nt, Homo sapiens
ggucgacuuugacaauuuc

SEQ ID NO: 68600 - RNA, 19 nt, Homo sapiens
caagaccuauggcaucaag

SEQ ID NO: 68601 - RNA, 19 nt, Homo sapiens
gaggucccguguuccauau

SEQ ID NO: 68602 - RNA, 19 nt, Homo sapiens
uagagaccauguuccgauu

SEQ ID NO: 68603 - RNA, 19 nt, Homo sapiens
ggacuguggagcuggauga

SEQ ID NO: 68604 - RNA, 19 nt, Homo sapiens
ugaaggaguugcggacaau

SEQ ID NO: 68605 - RNA, 19 nt, Homo sapiens
gugaaggaguugcggacaa

SEQ ID NO: 68606 - RNA, 19 nt, Homo sapiens
gcaaauggaacaccacacu

SEQ ID NO: 68607 - RNA, 19 nt, Homo sapiens
gaggaaccccaaauaauaa

SEQ ID NO: 68608 - RNA, 19 nt, Homo sapiens
ccuauggcaucaaguggaa

SEQ ID NO: 68609 - RNA, 19 nt, Homo sapiens
gcggucgacuuugacaauu

SEQ ID NO: 68610 - RNA, 19 nt, Homo sapiens
ggacgggaagcuaguguuc

SEQ ID NO: 68611 - RNA, 19 nt, Homo sapiens
ggagcuacccgcacagaca

SEQ ID NO: 68612 - RNA, 19 nt, Homo sapiens
agaggaaccccaaauaaua

SEQ ID NO: 68613 - RNA, 19 nt, Homo sapiens
gagaccauguuccgauuuu

SEQ ID NO: 68614 - RNA, 19 nt, Homo sapiens
agacaucuccagcguucua

SEQ ID NO: 68615 - RNA, 19 nt, Homo sapiens
ugccaagccucgccuccua

SEQ ID NO: 68616 - RNA, 19 nt, Homo sapiens
gggacccucuuccgugaug

SEQ ID NO: 68617 - RNA, 19 nt, Homo sapiens
ggagauugacgagaacuuc

SEQ ID NO: 68618 - RNA, 19 nt, Homo sapiens
cggaugacccggacgacua

SEQ ID NO: 68619 - RNA, 19 nt, Homo sapiens
cugcugggcugcuccauag

SEQ ID NO: 68620 - RNA, 19 nt, Homo sapiens
guugugaccuuugacuugu

SEQ ID NO: 68621 - RNA, 19 nt, Homo sapiens
ggucccguguuccauauag

SEQ ID NO: 68622 - RNA, 19 nt, Homo sapiens
cggucgacuuugacaauuu

SEQ ID NO: 68623 - RNA, 19 nt, Homo sapiens
gggaggacauggagaucag

SEQ ID NO: 68624 - RNA, 19 nt, Homo sapiens
ccaauuccuccaagaccua

SEQ ID NO: 68625 - RNA, 19 nt, Homo sapiens
caugagugccuacgagaug

SEQ ID NO: 68626 - RNA, 19 nt, Homo sapiens
gccgcgacauggagacuau

SEQ ID NO: 68627 - RNA, 19 nt, Homo sapiens
ggucccaauuccuccaaga

SEQ ID NO: 68628 - RNA, 19 nt, Homo sapiens
ugugaccuuugacuuguuu

SEQ ID NO: 68629 - RNA, 19 nt, Homo sapiens
ggagaucugcaaccucaca

SEQ ID NO: 68630 - RNA, 19 nt, Homo sapiens
caucaaggacgggaagcua

SEQ ID NO: 68631 - RNA, 19 nt, Homo sapiens
ccugcagacuauaaacuau

SEQ ID NO: 68632 - RNA, 19 nt, Homo sapiens
cgacuuugacaauuucguu

SEQ ID NO: 68633 - RNA, 19 nt, Homo sapiens
gagauugacgagaacuuca

SEQ ID NO: 68634 - RNA, 19 nt, Homo sapiens
gagaugcggauggccauug

SEQ ID NO: 68635 - RNA, 19 nt, Homo sapiens
gccugcagacuauaaacua

SEQ ID NO: 68636 - RNA, 19 nt, Homo sapiens
agaugcggauggccauuga

SEQ ID NO: 68637 - RNA, 19 nt, Homo sapiens
gaauuaccuguccaucuuc

SEQ ID NO: 68638 - RNA, 19 nt, Homo sapiens
augagaaugccaucaagua

SEQ ID NO: 68639 - RNA, 19 nt, Homo sapiens
ccaugagaaugccaucaag

SEQ ID NO: 68640 - RNA, 19 nt, Homo sapiens
ucaacaagaagcuguacga

SEQ ID NO: 68641 - RNA, 19 nt, Homo sapiens
gaggccaucacuuucaaga

SEQ ID NO: 68642 - RNA, 19 nt, Homo sapiens
cagagggcuuugaggacuu

SEQ ID NO: 68643 - RNA, 19 nt, Homo sapiens
gccaugagaaugccaucaa

SEQ ID NO: 68644 - RNA, 19 nt, Homo sapiens
ggaagcgucccacggaacu

SEQ ID NO: 68645 - RNA, 19 nt, Homo sapiens
gccagagcuuccagaaugg

SEQ ID NO: 68646 - RNA, 19 nt, Homo sapiens
gaaguuugaccuggacaag

SEQ ID NO: 68647 - RNA, 19 nt, Homo sapiens
ggaaguuugaccuggacaa

SEQ ID NO: 68648 - RNA, 19 nt, Homo sapiens
uccaagaccuauggcauca

SEQ ID NO: 68649 - RNA, 19 nt, Homo sapiens
gaugucauuccgagacuuc

SEQ ID NO: 68650 - RNA, 19 nt, Homo sapiens
uaaaaggccccacaucugu

SEQ ID NO: 68651 - RNA, 19 nt, Homo sapiens
uggauggaguugugaccuu

SEQ ID NO: 68652 - RNA, 19 nt, Homo sapiens
uuccagcuguggcaauuug

SEQ ID NO: 68653 - RNA, 19 nt, Homo sapiens
uggaaccgcauccggaauu

SEQ ID NO: 68654 - RNA, 19 nt, Homo sapiens
acauggagaucagcgugaa

SEQ ID NO: 68655 - RNA, 19 nt, Homo sapiens
gaccagauccaggccaauc

SEQ ID NO: 68656 - RNA, 19 nt, Homo sapiens
uggaggccaucacuuucaa

SEQ ID NO: 68657 - RNA, 19 nt, Homo sapiens
gcuccgggcagaacugugu

SEQ ID NO: 68658 - RNA, 19 nt, Homo sapiens
gaucaucacgccgguguac

SEQ ID NO: 68659 - RNA, 19 nt, Homo sapiens
gcagcauggugaaccucau

SEQ ID NO: 68660 - RNA, 19 nt, Homo sapiens
caauaggaucaucagcaaa

SEQ ID NO: 68661 - RNA, 19 nt, Homo sapiens
gcuucgugcucgcccuuau

SEQ ID NO: 68662 - RNA, 19 nt, Homo sapiens
ggaacaccacacucuacga

SEQ ID NO: 68663 - RNA, 19 nt, Homo sapiens
ggaugucauuccgagacuu

SEQ ID NO: 68664 - RNA, 19 nt, Homo sapiens
gggacuuguguacugguua

SEQ ID NO: 68665 - RNA, 19 nt, Homo sapiens
accacuagcucgacacagu

SEQ ID NO: 68666 - RNA, 19 nt, Homo sapiens
cagcugaccauguuugcau

SEQ ID NO: 68667 - RNA, 19 nt, Homo sapiens
gagcuacccgcacagacau

SEQ ID NO: 68668 - RNA, 19 nt, Homo sapiens
gacuuugacaauuucguuu

SEQ ID NO: 68669 - RNA, 19 nt, Homo sapiens
gacaagucgggcagcauga

SEQ ID NO: 68670 - RNA, 19 nt, Homo sapiens
ggacuaagcuuccauagaa

SEQ ID NO: 68671 - RNA, 19 nt, Homo sapiens
aaacaacaguccaagauua

SEQ ID NO: 68672 - RNA, 19 nt, Homo sapiens
aaagacaccuugccuauaa

SEQ ID NO: 68673 - RNA, 19 nt, Homo sapiens
uaacuaaucugccugaaga

SEQ ID NO: 68674 - RNA, 19 nt, Homo sapiens
caauagagcucgaccuuau

SEQ ID NO: 68675 - RNA, 19 nt, Homo sapiens
gaaacgcuauucaagauau

SEQ ID NO: 68676 - RNA, 19 nt, Homo sapiens
aaagaaagcugacuaccaa

SEQ ID NO: 68677 - RNA, 19 nt, Homo sapiens
gcaugaagauggagaauuc

SEQ ID NO: 68678 - RNA, 19 nt, Homo sapiens
cgagaauacuggaacaaua

SEQ ID NO: 68679 - RNA, 19 nt, Homo sapiens
ccgaggagguugaaaguaa

SEQ ID NO: 68680 - RNA, 19 nt, Homo sapiens
ggaacuacccgaacacauu

SEQ ID NO: 68681 - RNA, 19 nt, Homo sapiens
gccaagauaucaagucaga

SEQ ID NO: 68682 - RNA, 19 nt, Homo sapiens
gcagaaguuucacacauca

SEQ ID NO: 68683 - RNA, 19 nt, Homo sapiens
ggacagggcgguggaauga

SEQ ID NO: 68684 - RNA, 19 nt, Homo sapiens
ggagaucucugccuuugag

SEQ ID NO: 68685 - RNA, 19 nt, Homo sapiens
gcaaagcgccaagauauca

SEQ ID NO: 68686 - RNA, 19 nt, Homo sapiens
ggagaauucuggaugucuu

SEQ ID NO: 68687 - RNA, 19 nt, Homo sapiens
uaacggaagccuacagaaa

SEQ ID NO: 68688 - RNA, 19 nt, Homo sapiens
gaagaagcagguuucaaga

SEQ ID NO: 68689 - RNA, 19 nt, Homo sapiens
uagcaaagcgccaagauau

SEQ ID NO: 68690 - RNA, 19 nt, Homo sapiens
gcagggagguauuuaacag

SEQ ID NO: 68691 - RNA, 19 nt, Homo sapiens
ugagauagcagaaguuuca

SEQ ID NO: 68692 - RNA, 19 nt, Homo sapiens
ggaaacgcuauucaagaua

SEQ ID NO: 68693 - RNA, 19 nt, Homo sapiens
agaagcagguuucaagaug

SEQ ID NO: 68694 - RNA, 19 nt, Homo sapiens
ccuuauacaucuggucuua

SEQ ID NO: 68695 - RNA, 19 nt, Homo sapiens
gcggagaucucugccuuug

SEQ ID NO: 68696 - RNA, 19 nt, Homo sapiens
cuaccaagcugucgaugau

SEQ ID NO: 68697 - RNA, 19 nt, Homo sapiens
caacauccaccucagcaaa

SEQ ID NO: 68698 - RNA, 19 nt, Homo sapiens
ccgaacacauucuggauga

SEQ ID NO: 68699 - RNA, 19 nt, Homo sapiens
gcaaaugagucgcuuaacc

SEQ ID NO: 68700 - RNA, 19 nt, Homo sapiens
caagauaucaagucagaug

SEQ ID NO: 68701 - RNA, 19 nt, Homo sapiens
gaacuacccgaacacauuc

SEQ ID NO: 68702 - RNA, 19 nt, Homo sapiens
gauggagaauucuggaugu

SEQ ID NO: 68703 - RNA, 19 nt, Homo sapiens
gaucaacggaugcuaugaa

SEQ ID NO: 68704 - RNA, 19 nt, Homo sapiens
caccuugccuauaauuaaa

SEQ ID NO: 68705 - RNA, 19 nt, Homo sapiens
gcuagcaacauuauagaaa

SEQ ID NO: 68706 - RNA, 19 nt, Homo sapiens
ugggaaacaugguauauca

SEQ ID NO: 68707 - RNA, 19 nt, Homo sapiens
gagaauacuggaacaauag

SEQ ID NO: 68708 - RNA, 19 nt, Homo sapiens
gcagcuggaucccgagaau

SEQ ID NO: 68709 - RNA, 19 nt, Homo sapiens
gcggaaggcauuagaagaa

SEQ ID NO: 68710 - RNA, 19 nt, Homo sapiens
ugaaggaguucuacauucu

SEQ ID NO: 68711 - RNA, 19 nt, Homo sapiens
uacaagaaguggaaacuca

SEQ ID NO: 68712 - RNA, 19 nt, Homo sapiens
cagggaauauuuaaagcaa

SEQ ID NO: 68713 - RNA, 19 nt, Homo sapiens
ccauagaaauacacuuugu

SEQ ID NO: 68714 - RNA, 19 nt, Homo sapiens
uggaaacgcuauucaagau

SEQ ID NO: 68715 - RNA, 19 nt, Homo sapiens
gcgccaagauaucaaguca

SEQ ID NO: 68716 - RNA, 19 nt, Homo sapiens
uaguaaaucguucuccuua

SEQ ID NO: 68717 - RNA, 19 nt, Homo sapiens
ugccuuaucuucuuccaaa

SEQ ID NO: 68718 - RNA, 19 nt, Homo sapiens
gguauaucaugaaguaauc

SEQ ID NO: 68719 - RNA, 19 nt, Homo sapiens
caaacaacaguccaagauu

SEQ ID NO: 68720 - RNA, 19 nt, Homo sapiens
gaaaucgaggccaaucuug

SEQ ID NO: 68721 - RNA, 19 nt, Homo sapiens
gaagaugggcgaggacaug

SEQ ID NO: 68722 - RNA, 19 nt, Homo sapiens
gaaaagacaccuugccuau

SEQ ID NO: 68723 - RNA, 19 nt, Homo sapiens
ccaggcauccaauuuguaa

SEQ ID NO: 68724 - RNA, 19 nt, Homo sapiens
gaaguggaaacucaccaaa

SEQ ID NO: 68725 - RNA, 19 nt, Homo sapiens
ccaaacaacaguccaagau

SEQ ID NO: 68726 - RNA, 19 nt, Homo sapiens
aaaugcagcuguugauucu

SEQ ID NO: 68727 - RNA, 19 nt, Homo sapiens
uagcagaaguuucacacau

SEQ ID NO: 68728 - RNA, 19 nt, Homo sapiens
uaccaugaauuccuaugaa

SEQ ID NO: 68729 - RNA, 19 nt, Homo sapiens
auagaaaggacacaaguuu

SEQ ID NO: 68730 - RNA, 19 nt, Homo sapiens
gacuaagcuuccauagaaa

SEQ ID NO: 68731 - RNA, 19 nt, Homo sapiens
gaaaaucagccaaggacua

SEQ ID NO: 68732 - RNA, 19 nt, Homo sapiens
gcucagacaccuucaucaa

SEQ ID NO: 68733 - RNA, 19 nt, Homo sapiens
caagaucaacggaugcuau

SEQ ID NO: 68734 - RNA, 19 nt, Homo sapiens
acaccuugccuauaauuaa

SEQ ID NO: 68735 - RNA, 19 nt, Homo sapiens
gaacuucaccaccacuagu

SEQ ID NO: 68736 - RNA, 19 nt, Homo sapiens
uacauucucuggacgaaga

SEQ ID NO: 68737 - RNA, 19 nt, Homo sapiens
gcugaaggaguucuacauu

SEQ ID NO: 68738 - RNA, 19 nt, Homo sapiens
cagcgaggaugacauugau

SEQ ID NO: 68739 - RNA, 19 nt, Homo sapiens
aaagggauccugcgcuuga

SEQ ID NO: 68740 - RNA, 19 nt, Homo sapiens
gcgaggaugacauugauga

SEQ ID NO: 68741 - RNA, 19 nt, Homo sapiens
ccacugagggcuucgaaga

SEQ ID NO: 68742 - RNA, 19 nt, Homo sapiens
gagaaggcauacgccaaga

SEQ ID NO: 68743 - RNA, 19 nt, Homo sapiens
guuuaugagcacacaauua

SEQ ID NO: 68744 - RNA, 19 nt, Homo sapiens
gaaggcauacgccaagauc

SEQ ID NO: 68745 - RNA, 19 nt, Homo sapiens
aaaccaggcauccaauuug

SEQ ID NO: 68746 - RNA, 19 nt, Homo sapiens
gggaauauuuaaagcaacu

SEQ ID NO: 68747 - RNA, 19 nt, Homo sapiens
caaggacuaagcuuccaua

SEQ ID NO: 68748 - RNA, 19 nt, Homo sapiens
gaccagcucaucaucgauu

SEQ ID NO: 68749 - RNA, 19 nt, Homo sapiens
ugcccaagcuggaacacua

SEQ ID NO: 68750 - RNA, 19 nt, Homo sapiens
caccuugaaugaagaaauc

SEQ ID NO: 68751 - RNA, 19 nt, Homo sapiens
caugaauuccuaugaaaug

SEQ ID NO: 68752 - RNA, 19 nt, Homo sapiens
ggaugacauugaugaugga

SEQ ID NO: 68753 - RNA, 19 nt, Homo sapiens
gagcacacaauuauagcuu

SEQ ID NO: 68754 - RNA, 19 nt, Homo sapiens
gaggggacaucacuuagaa

SEQ ID NO: 68755 - RNA, 19 nt, Homo sapiens
cauccaauuuguaaaccaa

SEQ ID NO: 68756 - RNA, 19 nt, Homo sapiens
uaucuggaccucaaaauua

SEQ ID NO: 68757 - RNA, 19 nt, Homo sapiens
agucaucguugcucgguuu

SEQ ID NO: 68758 - RNA, 19 nt, Homo sapiens
ggucugguaccaugaauuc

SEQ ID NO: 68759 - RNA, 19 nt, Homo sapiens
caucggcuuuggcaucuau

SEQ ID NO: 68760 - RNA, 19 nt, Homo sapiens
gcgaggacaugcacaccau

SEQ ID NO: 68761 - RNA, 19 nt, Homo sapiens
gagaauucuggaugucuuu

SEQ ID NO: 68762 - RNA, 19 nt, Homo sapiens
ggaagccuacagaaacuga

SEQ ID NO: 68763 - RNA, 19 nt, Homo sapiens
uuauacaucuggucuuaca

SEQ ID NO: 68764 - RNA, 19 nt, Homo sapiens
gacccuauucggccuuaua

SEQ ID NO: 68765 - RNA, 19 nt, Homo sapiens
agauuaccauuucccauga

SEQ ID NO: 68766 - RNA, 19 nt, Homo sapiens
aguccaagauuaccauuuc

SEQ ID NO: 68767 - RNA, 19 nt, Homo sapiens
caagaugcccugucaacuc

SEQ ID NO: 68768 - RNA, 19 nt, Homo sapiens
guaccaugaauuccuauga

SEQ ID NO: 68769 - RNA, 19 nt, Homo sapiens
agacagguuuuguagaaua

SEQ ID NO: 68770 - RNA, 19 nt, Homo sapiens
gaauagggcugguuacuuu

SEQ ID NO: 68771 - RNA, 19 nt, Homo sapiens
gaagguagcuguaucuuau

SEQ ID NO: 68772 - RNA, 19 nt, Homo sapiens
gaagagaccuccggaaauu

SEQ ID NO: 68773 - RNA, 19 nt, Homo sapiens
caacauugcuucagaaauc

SEQ ID NO: 68774 - RNA, 19 nt, Homo sapiens
gaagaaagccaucgagaga

SEQ ID NO: 68775 - RNA, 19 nt, Homo sapiens
gcacgaacaugaccuaugg

SEQ ID NO: 68776 - RNA, 19 nt, Homo sapiens
guacaacaaucaacugguu

SEQ ID NO: 68777 - RNA, 19 nt, Homo sapiens
caacaauuccggaacauuu

SEQ ID NO: 68778 - RNA, 19 nt, Homo sapiens
gcacggaugguaaggaaua

SEQ ID NO: 68779 - RNA, 19 nt, Homo sapiens
gaacaucgacuuugacagu

SEQ ID NO: 68780 - RNA, 19 nt, Homo sapiens
cacaagaaaugucuagaaa

SEQ ID NO: 68781 - RNA, 19 nt, Homo sapiens
ggagugcucugcuggagaa

SEQ ID NO: 68782 - RNA, 19 nt, Homo sapiens
cagaugagcucaagaaggu

SEQ ID NO: 68783 - RNA, 19 nt, Homo sapiens
gaacuuauggcuucagaau

SEQ ID NO: 68784 - RNA, 19 nt, Homo sapiens
cugaugggcuuucaacuuu

SEQ ID NO: 68785 - RNA, 19 nt, Homo sapiens
gaugauggcacgaacauga

SEQ ID NO: 68786 - RNA, 19 nt, Homo sapiens
ccaaagccaugcaggauca

SEQ ID NO: 68787 - RNA, 19 nt, Homo sapiens
ggacaaucauuccgguuca

SEQ ID NO: 68788 - RNA, 19 nt, Homo sapiens
guaaagcaaugagguagga

SEQ ID NO: 68789 - RNA, 19 nt, Homo sapiens
caaagccauuuaccucaaa

SEQ ID NO: 68790 - RNA, 19 nt, Homo sapiens
gccagucucuucaccauug

SEQ ID NO: 68791 - RNA, 19 nt, Homo sapiens
guucaaaggugagaaagug

SEQ ID NO: 68792 - RNA, 19 nt, Homo sapiens
gaucagggaugcuccuagu

SEQ ID NO: 68793 - RNA, 19 nt, Homo sapiens
acaaggaccugaagacaca

SEQ ID NO: 68794 - RNA, 19 nt, Homo sapiens
ucacaaaguuggagaucug

SEQ ID NO: 68795 - RNA, 19 nt, Homo sapiens
uguacaagaucaugaagaa

SEQ ID NO: 68796 - RNA, 19 nt, Homo sapiens
ggaagagaccuccggaaau

SEQ ID NO: 68797 - RNA, 19 nt, Homo sapiens
ccaaagccauuuaccucaa

SEQ ID NO: 68798 - RNA, 19 nt, Homo sapiens
gcucugaucaggaaaguga

SEQ ID NO: 68799 - RNA, 19 nt, Homo sapiens
uaaggaauauggauaacuc

SEQ ID NO: 68800 - RNA, 19 nt, Homo sapiens
uaaacuaacucaguggaau

SEQ ID NO: 68801 - RNA, 19 nt, Homo sapiens
gagcaaacagcaacaagga

SEQ ID NO: 68802 - RNA, 19 nt, Homo sapiens
ccaggcaccucaucaguca

SEQ ID NO: 68803 - RNA, 19 nt, Homo sapiens
ucgagcaacuucacaagaa

SEQ ID NO: 68804 - RNA, 19 nt, Homo sapiens
ucucucagaugacagaauu

SEQ ID NO: 68805 - RNA, 19 nt, Homo sapiens
ccgaugcucugcagucuga

SEQ ID NO: 68806 - RNA, 19 nt, Homo sapiens
gauuucaucuaccauuuca

SEQ ID NO: 68807 - RNA, 19 nt, Homo sapiens
gagaacuuauggcuucaga

SEQ ID NO: 68808 - RNA, 19 nt, Homo sapiens
cuacgaagcucugaaaggu

SEQ ID NO: 68809 - RNA, 19 nt, Homo sapiens
cuucagaccuggacagugu

SEQ ID NO: 68810 - RNA, 19 nt, Homo sapiens
gauggagaguucuggaugu

SEQ ID NO: 68811 - RNA, 19 nt, Homo sapiens
cuaaauaaaggcaugugua

SEQ ID NO: 68812 - RNA, 19 nt, Homo sapiens
aaacuaacucaguggaaua

SEQ ID NO: 68813 - RNA, 19 nt, Homo sapiens
gcaaugagguaggaagaac

SEQ ID NO: 68814 - RNA, 19 nt, Homo sapiens
ucacucaggauuucaguuu

SEQ ID NO: 68815 - RNA, 19 nt, Homo sapiens
ggcugcagcucaccaugua

SEQ ID NO: 68816 - RNA, 19 nt, Homo sapiens
ugacaaggauggagauggu

SEQ ID NO: 68817 - RNA, 19 nt, Homo sapiens
ucaacaaccagcucuauga

SEQ ID NO: 68818 - RNA, 19 nt, Homo sapiens
ggaggacgaugacccugau

SEQ ID NO: 68819 - RNA, 19 nt, Homo sapiens
cuagugacauguacaagau

SEQ ID NO: 68820 - RNA, 19 nt, Homo sapiens
caagaaaugucuagaaaag

SEQ ID NO: 68821 - RNA, 19 nt, Homo sapiens
cgagcaacuucacaagaaa

SEQ ID NO: 68822 - RNA, 19 nt, Homo sapiens
acaugaacaucgacuuuga

SEQ ID NO: 68823 - RNA, 19 nt, Homo sapiens
uggcagcucugaucaggaa

SEQ ID NO: 68824 - RNA, 19 nt, Homo sapiens
ugaagguagcuguaucuua

SEQ ID NO: 68825 - RNA, 19 nt, Homo sapiens
gcacucagcaccuccuugu

SEQ ID NO: 68826 - RNA, 19 nt, Homo sapiens
aaaccaagcccaucaucuu

SEQ ID NO: 68827 - RNA, 19 nt, Homo sapiens
ucuacgagguucccaaaga

SEQ ID NO: 68828 - RNA, 19 nt, Homo sapiens
gcaacuucccagauacuuu

SEQ ID NO: 68829 - RNA, 19 nt, Homo sapiens
uggaaggacuggagcuuug

SEQ ID NO: 68830 - RNA, 19 nt, Homo sapiens
aaacccaaguggcaucuau

SEQ ID NO: 68831 - RNA, 19 nt, Homo sapiens
gcaguugcuuccuuuccuu

SEQ ID NO: 68832 - RNA, 19 nt, Homo sapiens
ggaauagggcugguuacuu

SEQ ID NO: 68833 - RNA, 19 nt, Homo sapiens
ugccuagccugacccuuua

SEQ ID NO: 68834 - RNA, 19 nt, Homo sapiens
gcagauagcaggagaugac

SEQ ID NO: 68835 - RNA, 19 nt, Homo sapiens
cagcaacaauuccggaaca

SEQ ID NO: 68836 - RNA, 19 nt, Homo sapiens
aaacaagcccugauaagca

SEQ ID NO: 68837 - RNA, 19 nt, Homo sapiens
ugccgcaacuucccagaua

SEQ ID NO: 68838 - RNA, 19 nt, Homo sapiens
acuuauggcuucagaauca

SEQ ID NO: 68839 - RNA, 19 nt, Homo sapiens
gcaggaucacucaggauuu

SEQ ID NO: 68840 - RNA, 19 nt, Homo sapiens
gauuaaggccuggcagaaa

SEQ ID NO: 68841 - RNA, 19 nt, Homo sapiens
uaacacagucgugaacaaa

SEQ ID NO: 68842 - RNA, 19 nt, Homo sapiens
ggucacgccuacucuguca

SEQ ID NO: 68843 - RNA, 19 nt, Homo sapiens
ucacaagaaaugucuagaa

SEQ ID NO: 68844 - RNA, 19 nt, Homo sapiens
acaaacacaugaacaucga

SEQ ID NO: 68845 - RNA, 19 nt, Homo sapiens
gugaggaacagcaacaauu

SEQ ID NO: 68846 - RNA, 19 nt, Homo sapiens
cagaaucacagcucgguuu

SEQ ID NO: 68847 - RNA, 19 nt, Homo sapiens
aagcugaucuaaauaaagg

SEQ ID NO: 68848 - RNA, 19 nt, Homo sapiens
cuucagaaauccuuuagca

SEQ ID NO: 68849 - RNA, 19 nt, Homo sapiens
gagggcauguucagagcuu

SEQ ID NO: 68850 - RNA, 19 nt, Homo sapiens
caccaccucuggaacaaga

SEQ ID NO: 68851 - RNA, 19 nt, Homo sapiens
ggaaagugaggaacagcaa

SEQ ID NO: 68852 - RNA, 19 nt, Homo sapiens
caacuucccagauacuuuc

SEQ ID NO: 68853 - RNA, 19 nt, Homo sapiens
caggaucacucaggauuuc

SEQ ID NO: 68854 - RNA, 19 nt, Homo sapiens
gaugacagaauuacuccaa

SEQ ID NO: 68855 - RNA, 19 nt, Homo sapiens
gauagcaggagaugacaug

SEQ ID NO: 68856 - RNA, 19 nt, Homo sapiens
caucuaccauuucacaaag

SEQ ID NO: 68857 - RNA, 19 nt, Homo sapiens
uggagaaggcuuaugcuaa

SEQ ID NO: 68858 - RNA, 19 nt, Homo sapiens
ggguggacgugguuauaga

SEQ ID NO: 68859 - RNA, 19 nt, Homo sapiens
gaucuuccacuuccaguuc

SEQ ID NO: 68860 - RNA, 19 nt, Homo sapiens
acacaugaacaucgacuuu

SEQ ID NO: 68861 - RNA, 19 nt, Homo sapiens
ugauugcgcucauggauac

SEQ ID NO: 68862 - RNA, 19 nt, Homo sapiens
ugaucaaaguuucaucgaa

SEQ ID NO: 68863 - RNA, 19 nt, Homo sapiens
ugaaagagaagacauucga

SEQ ID NO: 68864 - RNA, 19 nt, Homo sapiens
guacgcagacaaacacaug

SEQ ID NO: 68865 - RNA, 19 nt, Homo sapiens
acacagucgugaacaaaca

SEQ ID NO: 68866 - RNA, 19 nt, Homo sapiens
gaugaggucccguucaaag

SEQ ID NO: 68867 - RNA, 19 nt, Homo sapiens
uggaugaggucccguucaa

SEQ ID NO: 68868 - RNA, 19 nt, Homo sapiens
acaaccagcucuaugacau

SEQ ID NO: 68869 - RNA, 19 nt, Homo sapiens
gugcagaugagcucaagaa

SEQ ID NO: 68870 - RNA, 19 nt, Homo sapiens
gaauagggcugguuacuuu

SEQ ID NO: 68871 - RNA, 19 nt, Homo sapiens
gaagguagcuguaucuuau

SEQ ID NO: 68872 - RNA, 19 nt, Homo sapiens
gaagagaccuccggaaauu

SEQ ID NO: 68873 - RNA, 19 nt, Homo sapiens
caacauugcuucagaaauc

SEQ ID NO: 68874 - RNA, 19 nt, Homo sapiens
gaagaaagccaucgagaga

SEQ ID NO: 68875 - RNA, 19 nt, Homo sapiens
gcacgaacaugaccuaugg

SEQ ID NO: 68876 - RNA, 19 nt, Homo sapiens
guacaacaaucaacugguu

SEQ ID NO: 68877 - RNA, 19 nt, Homo sapiens
caacaauuccggaacauuu

SEQ ID NO: 68878 - RNA, 19 nt, Homo sapiens
gcacggaugguaaggaaua

SEQ ID NO: 68879 - RNA, 19 nt, Homo sapiens
gaacaucgacuuugacagu

SEQ ID NO: 68880 - RNA, 19 nt, Homo sapiens
cacaagaaaugucuagaaa

SEQ ID NO: 68881 - RNA, 19 nt, Homo sapiens
ggagugcucugcuggagaa

SEQ ID NO: 68882 - RNA, 19 nt, Homo sapiens
cagaugagcucaagaaggu

SEQ ID NO: 68883 - RNA, 19 nt, Homo sapiens
gaacuuauggcuucagaau

SEQ ID NO: 68884 - RNA, 19 nt, Homo sapiens
cugaugggcuuucaacuuu

SEQ ID NO: 68885 - RNA, 19 nt, Homo sapiens
gaugauggcacgaacauga

SEQ ID NO: 68886 - RNA, 19 nt, Homo sapiens
ccaaagccaugcaggauca

SEQ ID NO: 68887 - RNA, 19 nt, Homo sapiens
ggacaaucauuccgguuca

SEQ ID NO: 68888 - RNA, 19 nt, Homo sapiens
guaaagcaaugagguagga

SEQ ID NO: 68889 - RNA, 19 nt, Homo sapiens
caaagccauuuaccucaaa

SEQ ID NO: 68890 - RNA, 19 nt, Homo sapiens
gccagucucuucaccauug

SEQ ID NO: 68891 - RNA, 19 nt, Homo sapiens
guucaaaggugagaaagug

SEQ ID NO: 68892 - RNA, 19 nt, Homo sapiens
gaucagggaugcuccuagu

SEQ ID NO: 68893 - RNA, 19 nt, Homo sapiens
acaaggaccugaagacaca

SEQ ID NO: 68894 - RNA, 19 nt, Homo sapiens
ucacaaaguuggagaucug

SEQ ID NO: 68895 - RNA, 19 nt, Homo sapiens
uguacaagaucaugaagaa

SEQ ID NO: 68896 - RNA, 19 nt, Homo sapiens
ggaagagaccuccggaaau

SEQ ID NO: 68897 - RNA, 19 nt, Homo sapiens
ccaaagccauuuaccucaa

SEQ ID NO: 68898 - RNA, 19 nt, Homo sapiens
gcucugaucaggaaaguga

SEQ ID NO: 68899 - RNA, 19 nt, Homo sapiens
uaaggaauauggauaacuc

SEQ ID NO: 68900 - RNA, 19 nt, Homo sapiens
uaaacuaacucaguggaau

SEQ ID NO: 68901 - RNA, 19 nt, Homo sapiens
gagcaaacagcaacaagga

SEQ ID NO: 68902 - RNA, 19 nt, Homo sapiens
ccaggcaccucaucaguca

SEQ ID NO: 68903 - RNA, 19 nt, Homo sapiens
ucgagcaacuucacaagaa

SEQ ID NO: 68904 - RNA, 19 nt, Homo sapiens
ucucucagaugacagaauu

SEQ ID NO: 68905 - RNA, 19 nt, Homo sapiens
ccgaugcucugcagucuga

SEQ ID NO: 68906 - RNA, 19 nt, Homo sapiens
gauuucaucuaccauuuca

SEQ ID NO: 68907 - RNA, 19 nt, Homo sapiens
gagaacuuauggcuucaga

SEQ ID NO: 68908 - RNA, 19 nt, Homo sapiens
cuacgaagcucugaaaggu

SEQ ID NO: 68909 - RNA, 19 nt, Homo sapiens
cuucagaccuggacagugu

SEQ ID NO: 68910 - RNA, 19 nt, Homo sapiens
gauggagaguucuggaugu

SEQ ID NO: 68911 - RNA, 19 nt, Homo sapiens
cuaaauaaaggcaugugua

SEQ ID NO: 68912 - RNA, 19 nt, Homo sapiens
aaacuaacucaguggaaua

SEQ ID NO: 68913 - RNA, 19 nt, Homo sapiens
gcaaugagguaggaagaac

SEQ ID NO: 68914 - RNA, 19 nt, Homo sapiens
ucacucaggauuucaguuu

SEQ ID NO: 68915 - RNA, 19 nt, Homo sapiens
ggcugcagcucaccaugua

SEQ ID NO: 68916 - RNA, 19 nt, Homo sapiens
ugacaaggauggagauggu

SEQ ID NO: 68917 - RNA, 19 nt, Homo sapiens
ucaacaaccagcucuauga

SEQ ID NO: 68918 - RNA, 19 nt, Homo sapiens
ggaggacgaugacccugau

SEQ ID NO: 68919 - RNA, 19 nt, Homo sapiens
cuagugacauguacaagau

SEQ ID NO: 68920 - RNA, 19 nt, Homo sapiens
caagaaaugucuagaaaag

SEQ ID NO: 68921 - RNA, 19 nt, Homo sapiens
cgagcaacuucacaagaaa

SEQ ID NO: 68922 - RNA, 19 nt, Homo sapiens
acaugaacaucgacuuuga

SEQ ID NO: 68923 - RNA, 19 nt, Homo sapiens
uggcagcucugaucaggaa

SEQ ID NO: 68924 - RNA, 19 nt, Homo sapiens
ugaagguagcuguaucuua

SEQ ID NO: 68925 - RNA, 19 nt, Homo sapiens
gcacucagcaccuccuugu

SEQ ID NO: 68926 - RNA, 19 nt, Homo sapiens
ucuacgagguucccaaaga

SEQ ID NO: 68927 - RNA, 19 nt, Homo sapiens
gcaacuucccagauacuuu

SEQ ID NO: 68928 - RNA, 19 nt, Homo sapiens
uggaaggacuggagcuuug

SEQ ID NO: 68929 - RNA, 19 nt, Homo sapiens
aaacccaaguggcaucuau

SEQ ID NO: 68930 - RNA, 19 nt, Homo sapiens
gcaguugcuuccuuuccuu

SEQ ID NO: 68931 - RNA, 19 nt, Homo sapiens
ggaauagggcugguuacuu

SEQ ID NO: 68932 - RNA, 19 nt, Homo sapiens
ugccuagccugacccuuua

SEQ ID NO: 68933 - RNA, 19 nt, Homo sapiens
gcagauagcaggagaugac

SEQ ID NO: 68934 - RNA, 19 nt, Homo sapiens
cagcaacaauuccggaaca

SEQ ID NO: 68935 - RNA, 19 nt, Homo sapiens
aaacaagcccugauaagca

SEQ ID NO: 68936 - RNA, 19 nt, Homo sapiens
ugccgcaacuucccagaua

SEQ ID NO: 68937 - RNA, 19 nt, Homo sapiens
acuuauggcuucagaauca

SEQ ID NO: 68938 - RNA, 19 nt, Homo sapiens
gcaggaucacucaggauuu

SEQ ID NO: 68939 - RNA, 19 nt, Homo sapiens
gauuaaggccuggcagaaa

SEQ ID NO: 68940 - RNA, 19 nt, Homo sapiens
uaacacagucgugaacaaa

SEQ ID NO: 68941 - RNA, 19 nt, Homo sapiens
ggucacgccuacucuguca

SEQ ID NO: 68942 - RNA, 19 nt, Homo sapiens
ucacaagaaaugucuagaa

SEQ ID NO: 68943 - RNA, 19 nt, Homo sapiens
acaaacacaugaacaucga

SEQ ID NO: 68944 - RNA, 19 nt, Homo sapiens
gugaggaacagcaacaauu

SEQ ID NO: 68945 - RNA, 19 nt, Homo sapiens
cagaaucacagcucgguuu

SEQ ID NO: 68946 - RNA, 19 nt, Homo sapiens
aagcugaucuaaauaaagg

SEQ ID NO: 68947 - RNA, 19 nt, Homo sapiens
cuucagaaauccuuuagca

SEQ ID NO: 68948 - RNA, 19 nt, Homo sapiens
gagggcauguucagagcuu

SEQ ID NO: 68949 - RNA, 19 nt, Homo sapiens
caccaccucuggaacaaga

SEQ ID NO: 68950 - RNA, 19 nt, Homo sapiens
ggaaagugaggaacagcaa

SEQ ID NO: 68951 - RNA, 19 nt, Homo sapiens
caacuucccagauacuuuc

SEQ ID NO: 68952 - RNA, 19 nt, Homo sapiens
caggaucacucaggauuuc

SEQ ID NO: 68953 - RNA, 19 nt, Homo sapiens
gauagcaggagaugacaug

SEQ ID NO: 68954 - RNA, 19 nt, Homo sapiens
gaugacagaauuacuccaa

SEQ ID NO: 68955 - RNA, 19 nt, Homo sapiens
caucuaccauuucacaaag

SEQ ID NO: 68956 - RNA, 19 nt, Homo sapiens
uggagaaggcuuaugcuaa

SEQ ID NO: 68957 - RNA, 19 nt, Homo sapiens
ggguggacgugguuauaga

SEQ ID NO: 68958 - RNA, 19 nt, Homo sapiens
gaucuuccacuuccaguuc

SEQ ID NO: 68959 - RNA, 19 nt, Homo sapiens
acacaugaacaucgacuuu

SEQ ID NO: 68960 - RNA, 19 nt, Homo sapiens
ugauugcgcucauggauac

SEQ ID NO: 68961 - RNA, 19 nt, Homo sapiens
ugaucaaaguuucaucgaa

SEQ ID NO: 68962 - RNA, 19 nt, Homo sapiens
ugaaagagaagacauucga

SEQ ID NO: 68963 - RNA, 19 nt, Homo sapiens
guacgcagacaaacacaug

SEQ ID NO: 68964 - RNA, 19 nt, Homo sapiens
acacagucgugaacaaaca

SEQ ID NO: 68965 - RNA, 19 nt, Homo sapiens
gaugaggucccguucaaag

SEQ ID NO: 68966 - RNA, 19 nt, Homo sapiens
uggaugaggucccguucaa

SEQ ID NO: 68967 - RNA, 19 nt, Homo sapiens
acaaccagcucuaugacau

SEQ ID NO: 68968 - RNA, 19 nt, Homo sapiens
gugcagaugagcucaagaa

SEQ ID NO: 68969 - RNA, 19 nt, Homo sapiens
aacaagcccugauaagcaa

SEQ ID NO: 68970 - RNA, 19 nt, Homo sapiens
gaauagggcugguuacuuu

SEQ ID NO: 68971 - RNA, 19 nt, Homo sapiens
gaagguagcuguaucuuau

SEQ ID NO: 68972 - RNA, 19 nt, Homo sapiens
gaagagaccuccggaaauu

SEQ ID NO: 68973 - RNA, 19 nt, Homo sapiens
caacauugcuucagaaauc

SEQ ID NO: 68974 - RNA, 19 nt, Homo sapiens
gaagaaagccaucgagaga

SEQ ID NO: 68975 - RNA, 19 nt, Homo sapiens
guacaacaaucaacugguu

SEQ ID NO: 68976 - RNA, 19 nt, Homo sapiens
caacaauuccggaacauuu

SEQ ID NO: 68977 - RNA, 19 nt, Homo sapiens
gaacaucgacuuugacagu

SEQ ID NO: 68978 - RNA, 19 nt, Homo sapiens
cacaagaaaugucuagaaa

SEQ ID NO: 68979 - RNA, 19 nt, Homo sapiens
ggagugcucugcuggagaa

SEQ ID NO: 68980 - RNA, 19 nt, Homo sapiens
cagaugagcucaagaaggu

SEQ ID NO: 68981 - RNA, 19 nt, Homo sapiens
gaacuuauggcuucagaau

SEQ ID NO: 68982 - RNA, 19 nt, Homo sapiens
cugaugggcuuucaacuuu

SEQ ID NO: 68983 - RNA, 19 nt, Homo sapiens
ccaaagccaugcaggauca

SEQ ID NO: 68984 - RNA, 19 nt, Homo sapiens
guaaagcaaugagguagga

SEQ ID NO: 68985 - RNA, 19 nt, Homo sapiens
caaagccauuuaccucaaa

SEQ ID NO: 68986 - RNA, 19 nt, Homo sapiens
gccagucucuucaccauug

SEQ ID NO: 68987 - RNA, 19 nt, Homo sapiens
guucaaaggugagaaagug

SEQ ID NO: 68988 - RNA, 19 nt, Homo sapiens
gaucagggaugcuccuagu

SEQ ID NO: 68989 - RNA, 19 nt, Homo sapiens
acaaggaccugaagacaca

SEQ ID NO: 68990 - RNA, 19 nt, Homo sapiens
ucacaaaguuggagaucug

SEQ ID NO: 68991 - RNA, 19 nt, Homo sapiens
uguacaagaucaugaagaa

SEQ ID NO: 68992 - RNA, 19 nt, Homo sapiens
ggaagagaccuccggaaau

SEQ ID NO: 68993 - RNA, 19 nt, Homo sapiens
ccaaagccauuuaccucaa

SEQ ID NO: 68994 - RNA, 19 nt, Homo sapiens
gcucugaucaggaaaguga

SEQ ID NO: 68995 - RNA, 19 nt, Homo sapiens
uaaacuaacucaguggaau

SEQ ID NO: 68996 - RNA, 19 nt, Homo sapiens
ccaggcaccucaucaguca

SEQ ID NO: 68997 - RNA, 19 nt, Homo sapiens
ucgagcaacuucacaagaa

SEQ ID NO: 68998 - RNA, 19 nt, Homo sapiens
ucucucagaugacagaauu

SEQ ID NO: 68999 - RNA, 19 nt, Homo sapiens
ccgaugcucugcagucuga

SEQ ID NO: 69000 - RNA, 19 nt, Homo sapiens
gagaacuuauggcuucaga

SEQ ID NO: 69001 - RNA, 19 nt, Homo sapiens
gauuucaucuaccauuuca

SEQ ID NO: 69002 - RNA, 19 nt, Homo sapiens
cuacgaagcucugaaaggu

SEQ ID NO: 69003 - RNA, 19 nt, Homo sapiens
cuucagaccuggacagugu

SEQ ID NO: 69004 - RNA, 19 nt, Homo sapiens
gauggagaguucuggaugu

SEQ ID NO: 69005 - RNA, 19 nt, Homo sapiens
cuaaauaaaggcaugugua

SEQ ID NO: 69006 - RNA, 19 nt, Homo sapiens
aaacuaacucaguggaaua

SEQ ID NO: 69007 - RNA, 19 nt, Homo sapiens
gcaaugagguaggaagaac

SEQ ID NO: 69008 - RNA, 19 nt, Homo sapiens
ucacucaggauuucaguuu

SEQ ID NO: 69009 - RNA, 19 nt, Homo sapiens
ggcugcagcucaccaugua

SEQ ID NO: 69010 - RNA, 19 nt, Homo sapiens
ugacaaggauggagauggu

SEQ ID NO: 69011 - RNA, 19 nt, Homo sapiens
ucaacaaccagcucuauga

SEQ ID NO: 69012 - RNA, 19 nt, Homo sapiens
ggaggacgaugacccugau

SEQ ID NO: 69013 - RNA, 19 nt, Homo sapiens
cuagugacauguacaagau

SEQ ID NO: 69014 - RNA, 19 nt, Homo sapiens
caagaaaugucuagaaaag

SEQ ID NO: 69015 - RNA, 19 nt, Homo sapiens
cgagcaacuucacaagaaa

SEQ ID NO: 69016 - RNA, 19 nt, Homo sapiens
acaugaacaucgacuuuga

SEQ ID NO: 69017 - RNA, 19 nt, Homo sapiens
uggcagcucugaucaggaa

SEQ ID NO: 69018 - RNA, 19 nt, Homo sapiens
ugaagguagcuguaucuua

SEQ ID NO: 69019 - RNA, 19 nt, Homo sapiens
gcacucagcaccuccuugu

SEQ ID NO: 69020 - RNA, 19 nt, Homo sapiens
ucuacgagguucccaaaga

SEQ ID NO: 69021 - RNA, 19 nt, Homo sapiens
gcaacuucccagauacuuu

SEQ ID NO: 69022 - RNA, 19 nt, Homo sapiens
uggaaggacuggagcuuug

SEQ ID NO: 69023 - RNA, 19 nt, Homo sapiens
aaacccaaguggcaucuau

SEQ ID NO: 69024 - RNA, 19 nt, Homo sapiens
gcaguugcuuccuuuccuu

SEQ ID NO: 69025 - RNA, 19 nt, Homo sapiens
ggaauagggcugguuacuu

SEQ ID NO: 69026 - RNA, 19 nt, Homo sapiens
ugccuagccugacccuuua

SEQ ID NO: 69027 - RNA, 19 nt, Homo sapiens
gcagauagcaggagaugac

SEQ ID NO: 69028 - RNA, 19 nt, Homo sapiens
cagcaacaauuccggaaca

SEQ ID NO: 69029 - RNA, 19 nt, Homo sapiens
ugccgcaacuucccagaua

SEQ ID NO: 69030 - RNA, 19 nt, Homo sapiens
acuuauggcuucagaauca

SEQ ID NO: 69031 - RNA, 19 nt, Homo sapiens
gcaggaucacucaggauuu

SEQ ID NO: 69032 - RNA, 19 nt, Homo sapiens
gauuaaggccuggcagaaa

SEQ ID NO: 69033 - RNA, 19 nt, Homo sapiens
uaacacagucgugaacaaa

SEQ ID NO: 69034 - RNA, 19 nt, Homo sapiens
ggucacgccuacucuguca

SEQ ID NO: 69035 - RNA, 19 nt, Homo sapiens
ucacaagaaaugucuagaa

SEQ ID NO: 69036 - RNA, 19 nt, Homo sapiens
cagaaucacagcucgguuu

SEQ ID NO: 69037 - RNA, 19 nt, Homo sapiens
acaaacacaugaacaucga

SEQ ID NO: 69038 - RNA, 19 nt, Homo sapiens
gugaggaacagcaacaauu

SEQ ID NO: 69039 - RNA, 19 nt, Homo sapiens
aagcugaucuaaauaaagg

SEQ ID NO: 69040 - RNA, 19 nt, Homo sapiens
gagggcauguucagagcuu

SEQ ID NO: 69041 - RNA, 19 nt, Homo sapiens
caccaccucuggaacaaga

SEQ ID NO: 69042 - RNA, 19 nt, Homo sapiens
ggaaagugaggaacagcaa

SEQ ID NO: 69043 - RNA, 19 nt, Homo sapiens
caacuucccagauacuuuc

SEQ ID NO: 69044 - RNA, 19 nt, Homo sapiens
cuucagaaauccuuuagca

SEQ ID NO: 69045 - RNA, 19 nt, Homo sapiens
caggaucacucaggauuuc

SEQ ID NO: 69046 - RNA, 19 nt, Homo sapiens
gauagcaggagaugacaug

SEQ ID NO: 69047 - RNA, 19 nt, Homo sapiens
caucuaccauuucacaaag

SEQ ID NO: 69048 - RNA, 19 nt, Homo sapiens
uggagaaggcuuaugcuaa

SEQ ID NO: 69049 - RNA, 19 nt, Homo sapiens
ggguggacgugguuauaga

SEQ ID NO: 69050 - RNA, 19 nt, Homo sapiens
gaucuuccacuuccaguuc

SEQ ID NO: 69051 - RNA, 19 nt, Homo sapiens
gaugacagaauuacuccaa

SEQ ID NO: 69052 - RNA, 19 nt, Homo sapiens
acacaugaacaucgacuuu

SEQ ID NO: 69053 - RNA, 19 nt, Homo sapiens
ugauugcgcucauggauac

SEQ ID NO: 69054 - RNA, 19 nt, Homo sapiens
ugaucaaaguuucaucgaa

SEQ ID NO: 69055 - RNA, 19 nt, Homo sapiens
ugaaagagaagacauucga

SEQ ID NO: 69056 - RNA, 19 nt, Homo sapiens
guacgcagacaaacacaug

SEQ ID NO: 69057 - RNA, 19 nt, Homo sapiens
acacagucgugaacaaaca

SEQ ID NO: 69058 - RNA, 19 nt, Homo sapiens
gaugaggucccguucaaag

SEQ ID NO: 69059 - RNA, 19 nt, Homo sapiens
uggaugaggucccguucaa

SEQ ID NO: 69060 - RNA, 19 nt, Homo sapiens
acaaccagcucuaugacau

SEQ ID NO: 69061 - RNA, 19 nt, Homo sapiens
gugcagaugagcucaagaa

SEQ ID NO: 69062 - RNA, 19 nt, Homo sapiens
gaagacauucgagcaacuu

SEQ ID NO: 69063 - RNA, 19 nt, Homo sapiens
uagccugacccuuuaguaa

SEQ ID NO: 69064 - RNA, 19 nt, Homo sapiens
guucagagcuuuucaugca

SEQ ID NO: 69065 - RNA, 19 nt, Homo sapiens
gcaacaauuccggaacauu

SEQ ID NO: 69066 - RNA, 19 nt, Homo sapiens
gaggauuucaucuaccauu

SEQ ID NO: 69067 - RNA, 19 nt, Homo sapiens
gcuccaugguuccuacgaa

SEQ ID NO: 69068 - RNA, 19 nt, Homo sapiens
gcagacaaacacaugaaca

SEQ ID NO: 69069 - RNA, 19 nt, Homo sapiens
ucagggaugcuccuaguga

SEQ ID NO: 69070 - RNA, 19 nt, Homo sapiens
gaauagggcugguuacuuu

SEQ ID NO: 69071 - RNA, 19 nt, Homo sapiens
caacaauuccggaacauuu

SEQ ID NO: 69072 - RNA, 19 nt, Homo sapiens
gaacaucgacuuugacagu

SEQ ID NO: 69073 - RNA, 19 nt, Homo sapiens
cagaugagcucaagaaggu

SEQ ID NO: 69074 - RNA, 19 nt, Homo sapiens
ccaaagccaugcaggauca

SEQ ID NO: 69075 - RNA, 19 nt, Homo sapiens
guaaagcaaugagguagga

SEQ ID NO: 69076 - RNA, 19 nt, Homo sapiens
caaagccauuuaccucaaa

SEQ ID NO: 69077 - RNA, 19 nt, Homo sapiens
acaaggaccugaagacaca

SEQ ID NO: 69078 - RNA, 19 nt, Homo sapiens
ccaaagccauuuaccucaa

SEQ ID NO: 69079 - RNA, 19 nt, Homo sapiens
gcucugaucaggaaaguga

SEQ ID NO: 69080 - RNA, 19 nt, Homo sapiens
uaaacuaacucaguggaau

SEQ ID NO: 69081 - RNA, 19 nt, Homo sapiens
gagcaaacagcaacaagga

SEQ ID NO: 69082 - RNA, 19 nt, Homo sapiens
ccaggcaccucaucaguca

SEQ ID NO: 69083 - RNA, 19 nt, Homo sapiens
gagcagcuguucugaugca

SEQ ID NO: 69084 - RNA, 19 nt, Homo sapiens
cuaaauaaaggcaugugua

SEQ ID NO: 69085 - RNA, 19 nt, Homo sapiens
aaacuaacucaguggaaua

SEQ ID NO: 69086 - RNA, 19 nt, Homo sapiens
gcaaugagguaggaagaac

SEQ ID NO: 69087 - RNA, 19 nt, Homo sapiens
ucacucaggauuucaguuu

SEQ ID NO: 69088 - RNA, 19 nt, Homo sapiens
ggcugcagcucaccaugua

SEQ ID NO: 69089 - RNA, 19 nt, Homo sapiens
ugacaaggauggagauggu

SEQ ID NO: 69090 - RNA, 19 nt, Homo sapiens
ucaacaaccagcucuauga

SEQ ID NO: 69091 - RNA, 19 nt, Homo sapiens
acaugaacaucgacuuuga

SEQ ID NO: 69092 - RNA, 19 nt, Homo sapiens
uggcagcucugaucaggaa

SEQ ID NO: 69093 - RNA, 19 nt, Homo sapiens
gcacucagcaccuccuugu

SEQ ID NO: 69094 - RNA, 19 nt, Homo sapiens
aaaccaagcccaucaucuu

SEQ ID NO: 69095 - RNA, 19 nt, Homo sapiens
ggaauagggcugguuacuu

SEQ ID NO: 69096 - RNA, 19 nt, Homo sapiens
ugccuagccugacccuuua

SEQ ID NO: 69097 - RNA, 19 nt, Homo sapiens
gcagauagcaggagaugac

SEQ ID NO: 69098 - RNA, 19 nt, Homo sapiens
cagcaacaauuccggaaca

SEQ ID NO: 69099 - RNA, 19 nt, Homo sapiens
aaacaagcccugauaagca

SEQ ID NO: 69100 - RNA, 19 nt, Homo sapiens
gcaggaucacucaggauuu

SEQ ID NO: 69101 - RNA, 19 nt, Homo sapiens
gauuaaggccuggcagaaa

SEQ ID NO: 69102 - RNA, 19 nt, Homo sapiens
uaacacagucgugaacaaa

SEQ ID NO: 69103 - RNA, 19 nt, Homo sapiens
acaaacacaugaacaucga

SEQ ID NO: 69104 - RNA, 19 nt, Homo sapiens
gugaggaacagcaacaauu

SEQ ID NO: 69105 - RNA, 19 nt, Homo sapiens
aagcugaucuaaauaaagg

SEQ ID NO: 69106 - RNA, 19 nt, Homo sapiens
gagggcauguucagagcuu

SEQ ID NO: 69107 - RNA, 19 nt, Homo sapiens
caccaccucuggaacaaga

SEQ ID NO: 69108 - RNA, 19 nt, Homo sapiens
ggaaagugaggaacagcaa

SEQ ID NO: 69109 - RNA, 19 nt, Homo sapiens
aggagcagcuguucugaug

SEQ ID NO: 69110 - RNA, 19 nt, Homo sapiens
caggaucacucaggauuuc

SEQ ID NO: 69111 - RNA, 19 nt, Homo sapiens
gauagcaggagaugacaug

SEQ ID NO: 69112 - RNA, 19 nt, Homo sapiens
acacaugaacaucgacuuu

SEQ ID NO: 69113 - RNA, 19 nt, Homo sapiens
ugauugcgcucauggauac

SEQ ID NO: 69114 - RNA, 19 nt, Homo sapiens
guacgcagacaaacacaug

SEQ ID NO: 69115 - RNA, 19 nt, Homo sapiens
acacagucgugaacaaaca

SEQ ID NO: 69116 - RNA, 19 nt, Homo sapiens
acaaccagcucuaugacau

SEQ ID NO: 69117 - RNA, 19 nt, Homo sapiens
gugcagaugagcucaagaa

SEQ ID NO: 69118 - RNA, 19 nt, Homo sapiens
aacaagcccugauaagcaa

SEQ ID NO: 69119 - RNA, 19 nt, Homo sapiens
gcaaaacaagcccugauaa

SEQ ID NO: 69120 - RNA, 19 nt, Homo sapiens
uagccugacccuuuaguaa

SEQ ID NO: 69121 - RNA, 19 nt, Homo sapiens
guucagagcuuuucaugca

SEQ ID NO: 69122 - RNA, 19 nt, Homo sapiens
gcaacaauuccggaacauu

SEQ ID NO: 69123 - RNA, 19 nt, Homo sapiens
gcagacaaacacaugaaca

SEQ ID NO: 69124 - RNA, 19 nt, Homo sapiens
aauaaaggcauguguaugg

SEQ ID NO: 69125 - RNA, 19 nt, Homo sapiens
ucauaaguuuggcugcauu

SEQ ID NO: 69126 - RNA, 19 nt, Homo sapiens
ucaaaggacccagcagcua

SEQ ID NO: 69127 - RNA, 19 nt, Homo sapiens
gaugcgaaaugcagucaac

SEQ ID NO: 69128 - RNA, 19 nt, Homo sapiens
ucaguuucacccucuauuu

SEQ ID NO: 69129 - RNA, 19 nt, Homo sapiens
ucaucaagcucaacguucu

SEQ ID NO: 69130 - RNA, 19 nt, Homo sapiens
acaucgacuuugacaguuu

SEQ ID NO: 69131 - RNA, 19 nt, Homo sapiens
gcuacgagaugcgaaaugc

SEQ ID NO: 69132 - RNA, 19 nt, Homo sapiens
gaagacacacggguucaca

SEQ ID NO: 69133 - RNA, 19 nt, Homo sapiens
guaaacuaacucaguggaa

SEQ ID NO: 69134 - RNA, 19 nt, Homo sapiens
uuaacacagucgugaacaa

SEQ ID NO: 69135 - RNA, 19 nt, Homo sapiens
ucaugcuccuccuccauuu

SEQ ID NO: 69136 - RNA, 19 nt, Homo sapiens
caucgacuuugacaguuuc

SEQ ID NO: 69137 - RNA, 19 nt, Homo sapiens
ugaggaacagcaacaauuc

SEQ ID NO: 69138 - RNA, 19 nt, Homo sapiens
caucuucguuucggacaga

SEQ ID NO: 69139 - RNA, 19 nt, Homo sapiens
cuccgggucuucucugaaa

SEQ ID NO: 69140 - RNA, 19 nt, Homo sapiens
uuaguaaagcaaugaggua

SEQ ID NO: 69141 - RNA, 19 nt, Homo sapiens
uucaucugcugcuucguua

SEQ ID NO: 69142 - RNA, 19 nt, Homo sapiens
gauuccaccucaacaacca

SEQ ID NO: 69143 - RNA, 19 nt, Homo sapiens
acucaggauuucaguuuca

SEQ ID NO: 69144 - RNA, 19 nt, Homo sapiens
gagcaaaaccuacaucaac

SEQ ID NO: 69145 - RNA, 19 nt, Homo sapiens
ucaaacacuaugacacaga

SEQ ID NO: 69146 - RNA, 19 nt, Homo sapiens
uaucaucaagcucaacguu

SEQ ID NO: 69147 - RNA, 19 nt, Homo sapiens
aaacacaaggaccugaaga

SEQ ID NO: 69148 - RNA, 19 nt, Homo sapiens
ggagucagaggagggcaaa

SEQ ID NO: 69149 - RNA, 19 nt, Homo sapiens
cauaaguuuggcugcauuu

SEQ ID NO: 69150 - RNA, 19 nt, Homo sapiens
guccugccguagcaugauu

SEQ ID NO: 69151 - RNA, 19 nt, Homo sapiens
acacacacagucacacaga

SEQ ID NO: 69152 - RNA, 19 nt, Homo sapiens
ccacacacacagucacaca

SEQ ID NO: 69153 - RNA, 19 nt, Homo sapiens
cagacaaacacaugaacau

SEQ ID NO: 69154 - RNA, 19 nt, Homo sapiens
gcuuacagccacacacaca

SEQ ID NO: 69155 - RNA, 19 nt, Homo sapiens
gaggagcagcuguucugau

SEQ ID NO: 69156 - RNA, 19 nt, Homo sapiens
gagugcuccugcuuaccuu

SEQ ID NO: 69157 - RNA, 19 nt, Homo sapiens
caguuucacccucuauuuc

SEQ ID NO: 69158 - RNA, 19 nt, Homo sapiens
gcaggauuccaccucaaca

SEQ ID NO: 69159 - RNA, 19 nt, Homo sapiens
uaggcugucugcagaagca

SEQ ID NO: 69160 - RNA, 19 nt, Homo sapiens
gucaugcuccuccuccauu

SEQ ID NO: 69161 - RNA, 19 nt, Homo sapiens
cuauuuccaaagccauuua

SEQ ID NO: 69162 - RNA, 19 nt, Homo sapiens
caacaaccagcucuaugac

SEQ ID NO: 69163 - RNA, 19 nt, Homo sapiens
gaccaguccggcaccauca

SEQ ID NO: 69164 - RNA, 19 nt, Homo sapiens
gacaaggauggagauggua

SEQ ID NO: 69165 - RNA, 19 nt, Homo sapiens
cgacuuugacaguuucauc

SEQ ID NO: 69166 - RNA, 19 nt, Homo sapiens
aaccagcucuaugacauca

SEQ ID NO: 69167 - RNA, 19 nt, Homo sapiens
agucaacgacgcaggauuc

SEQ ID NO: 69168 - RNA, 19 nt, Homo sapiens
uuucaaacacuaugacaca

SEQ ID NO: 69169 - RNA, 19 nt, Homo sapiens
acaaacacaaggaccugaa

SEQ ID NO: 69170 - RNA, 19 nt, Homo sapiens
gaauagggcugguuacuuu

SEQ ID NO: 69171 - RNA, 19 nt, Homo sapiens
ccaagugccuucugaauga

SEQ ID NO: 69172 - RNA, 19 nt, Homo sapiens
caacaauuccggaacauuu

SEQ ID NO: 69173 - RNA, 19 nt, Homo sapiens
gaacaucgacuuugacagu

SEQ ID NO: 69174 - RNA, 19 nt, Homo sapiens
cagaugagcucaagaaggu

SEQ ID NO: 69175 - RNA, 19 nt, Homo sapiens
ccaaagccaugcaggauca

SEQ ID NO: 69176 - RNA, 19 nt, Homo sapiens
guaaagcaaugagguagga

SEQ ID NO: 69177 - RNA, 19 nt, Homo sapiens
caaagccauuuaccucaaa

SEQ ID NO: 69178 - RNA, 19 nt, Homo sapiens
acaaggaccugaagacaca

SEQ ID NO: 69179 - RNA, 19 nt, Homo sapiens
ggucaucggugugcaguau

SEQ ID NO: 69180 - RNA, 19 nt, Homo sapiens
ccaaagccauuuaccucaa

SEQ ID NO: 69181 - RNA, 19 nt, Homo sapiens
gcucugaucaggaaaguga

SEQ ID NO: 69182 - RNA, 19 nt, Homo sapiens
uaaacuaacucaguggaau

SEQ ID NO: 69183 - RNA, 19 nt, Homo sapiens
ccaggcaccucaucaguca

SEQ ID NO: 69184 - RNA, 19 nt, Homo sapiens
cuaaauaaaggcaugugua

SEQ ID NO: 69185 - RNA, 19 nt, Homo sapiens
aaacuaacucaguggaaua

SEQ ID NO: 69186 - RNA, 19 nt, Homo sapiens
gcaaugagguaggaagaac

SEQ ID NO: 69187 - RNA, 19 nt, Homo sapiens
ucacucaggauuucaguuu

SEQ ID NO: 69188 - RNA, 19 nt, Homo sapiens
ggcugcagcucaccaugua

SEQ ID NO: 69189 - RNA, 19 nt, Homo sapiens
ugacaaggauggagauggu

SEQ ID NO: 69190 - RNA, 19 nt, Homo sapiens
ucaacaaccagcucuauga

SEQ ID NO: 69191 - RNA, 19 nt, Homo sapiens
acaugaacaucgacuuuga

SEQ ID NO: 69192 - RNA, 19 nt, Homo sapiens
uggcagcucugaucaggaa

SEQ ID NO: 69193 - RNA, 19 nt, Homo sapiens
gcacucagcaccuccuugu

SEQ ID NO: 69194 - RNA, 19 nt, Homo sapiens
ggaauagggcugguuacuu

SEQ ID NO: 69195 - RNA, 19 nt, Homo sapiens
ugccuagccugacccuuua

SEQ ID NO: 69196 - RNA, 19 nt, Homo sapiens
gcagauagcaggagaugac

SEQ ID NO: 69197 - RNA, 19 nt, Homo sapiens
cagcaacaauuccggaaca

SEQ ID NO: 69198 - RNA, 19 nt, Homo sapiens
gaucuguucuggucaucug

SEQ ID NO: 69199 - RNA, 19 nt, Homo sapiens
gcaggaucacucaggauuu

SEQ ID NO: 69200 - RNA, 19 nt, Homo sapiens
gauuaaggccuggcagaaa

SEQ ID NO: 69201 - RNA, 19 nt, Homo sapiens
uaacacagucgugaacaaa

SEQ ID NO: 69202 - RNA, 19 nt, Homo sapiens
acaaacacaugaacaucga

SEQ ID NO: 69203 - RNA, 19 nt, Homo sapiens
gugaggaacagcaacaauu

SEQ ID NO: 69204 - RNA, 19 nt, Homo sapiens
aagcugaucuaaauaaagg

SEQ ID NO: 69205 - RNA, 19 nt, Homo sapiens
gagggcauguucagagcuu

SEQ ID NO: 69206 - RNA, 19 nt, Homo sapiens
caccaccucuggaacaaga

SEQ ID NO: 69207 - RNA, 19 nt, Homo sapiens
ggaaagugaggaacagcaa

SEQ ID NO: 69208 - RNA, 19 nt, Homo sapiens
caggaucacucaggauuuc

SEQ ID NO: 69209 - RNA, 19 nt, Homo sapiens
gauagcaggagaugacaug

SEQ ID NO: 69210 - RNA, 19 nt, Homo sapiens
acacaugaacaucgacuuu

SEQ ID NO: 69211 - RNA, 19 nt, Homo sapiens
ugauugcgcucauggauac

SEQ ID NO: 69212 - RNA, 19 nt, Homo sapiens
guacgcagacaaacacaug

SEQ ID NO: 69213 - RNA, 19 nt, Homo sapiens
acacagucgugaacaaaca

SEQ ID NO: 69214 - RNA, 19 nt, Homo sapiens
acaaccagcucuaugacau

SEQ ID NO: 69215 - RNA, 19 nt, Homo sapiens
gugcagaugagcucaagaa

SEQ ID NO: 69216 - RNA, 19 nt, Homo sapiens
uagccugacccuuuaguaa

SEQ ID NO: 69217 - RNA, 19 nt, Homo sapiens
guucagagcuuuucaugca

SEQ ID NO: 69218 - RNA, 19 nt, Homo sapiens
gcaacaauuccggaacauu

SEQ ID NO: 69219 - RNA, 19 nt, Homo sapiens
gcgauugguuuuaguggua

SEQ ID NO: 69220 - RNA, 19 nt, Homo sapiens
gcagacaaacacaugaaca

SEQ ID NO: 69221 - RNA, 19 nt, Homo sapiens
aauaaaggcauguguaugg

SEQ ID NO: 69222 - RNA, 19 nt, Homo sapiens
ucauaaguuuggcugcauu

SEQ ID NO: 69223 - RNA, 19 nt, Homo sapiens
ucaaaggacccagcagcua

SEQ ID NO: 69224 - RNA, 19 nt, Homo sapiens
gaugcgaaaugcagucaac

SEQ ID NO: 69225 - RNA, 19 nt, Homo sapiens
ucaguuucacccucuauuu

SEQ ID NO: 69226 - RNA, 19 nt, Homo sapiens
ucaucaagcucaacguucu

SEQ ID NO: 69227 - RNA, 19 nt, Homo sapiens
acaucgacuuugacaguuu

SEQ ID NO: 69228 - RNA, 19 nt, Homo sapiens
gcuacgagaugcgaaaugc

SEQ ID NO: 69229 - RNA, 19 nt, Homo sapiens
gaagacacacggguucaca

SEQ ID NO: 69230 - RNA, 19 nt, Homo sapiens
guaaacuaacucaguggaa

SEQ ID NO: 69231 - RNA, 19 nt, Homo sapiens
ucaucggugugcaguauug

SEQ ID NO: 69232 - RNA, 19 nt, Homo sapiens
uuaacacagucgugaacaa

SEQ ID NO: 69233 - RNA, 19 nt, Homo sapiens
ucaugcuccuccuccauuu

SEQ ID NO: 69234 - RNA, 19 nt, Homo sapiens
caucgacuuugacaguuuc

SEQ ID NO: 69235 - RNA, 19 nt, Homo sapiens
ugaggaacagcaacaauuc

SEQ ID NO: 69236 - RNA, 19 nt, Homo sapiens
uuaguaaagcaaugaggua

SEQ ID NO: 69237 - RNA, 19 nt, Homo sapiens
uucaucugcugcuucguua

SEQ ID NO: 69238 - RNA, 19 nt, Homo sapiens
gauuccaccucaacaacca

SEQ ID NO: 69239 - RNA, 19 nt, Homo sapiens
acucaggauuucaguuuca

SEQ ID NO: 69240 - RNA, 19 nt, Homo sapiens
ugaaugaccacaggcgauu

SEQ ID NO: 69241 - RNA, 19 nt, Homo sapiens
ucaaacacuaugacacaga

SEQ ID NO: 69242 - RNA, 19 nt, Homo sapiens
uaucaucaagcucaacguu

SEQ ID NO: 69243 - RNA, 19 nt, Homo sapiens
aaacacaaggaccugaaga

SEQ ID NO: 69244 - RNA, 19 nt, Homo sapiens
cauaaguuuggcugcauuu

SEQ ID NO: 69245 - RNA, 19 nt, Homo sapiens
guccugccguagcaugauu

SEQ ID NO: 69246 - RNA, 19 nt, Homo sapiens
cagacaaacacaugaacau

SEQ ID NO: 69247 - RNA, 19 nt, Homo sapiens
gaaugaccacaggcgauug

SEQ ID NO: 69248 - RNA, 19 nt, Homo sapiens
gagugcuccugcuuaccuu

SEQ ID NO: 69249 - RNA, 19 nt, Homo sapiens
caguuucacccucuauuuc

SEQ ID NO: 69250 - RNA, 19 nt, Homo sapiens
gcaggauuccaccucaaca

SEQ ID NO: 69251 - RNA, 19 nt, Homo sapiens
uaggcugucugcagaagca

SEQ ID NO: 69252 - RNA, 19 nt, Homo sapiens
gucaugcuccuccuccauu

SEQ ID NO: 69253 - RNA, 19 nt, Homo sapiens
cuauuuccaaagccauuua

SEQ ID NO: 69254 - RNA, 19 nt, Homo sapiens
caacaaccagcucuaugac

SEQ ID NO: 69255 - RNA, 19 nt, Homo sapiens
gaccaguccggcaccauca

SEQ ID NO: 69256 - RNA, 19 nt, Homo sapiens
gacaaggauggagauggua

SEQ ID NO: 69257 - RNA, 19 nt, Homo sapiens
cgacuuugacaguuucauc

SEQ ID NO: 69258 - RNA, 19 nt, Homo sapiens
ucaggaaagugaggaacag

SEQ ID NO: 69259 - RNA, 19 nt, Homo sapiens
aaccagcucuaugacauca

SEQ ID NO: 69260 - RNA, 19 nt, Homo sapiens
agucaacgacgcaggauuc

SEQ ID NO: 69261 - RNA, 19 nt, Homo sapiens
uuucaaacacuaugacaca

SEQ ID NO: 69262 - RNA, 19 nt, Homo sapiens
acaaacacaaggaccugaa

SEQ ID NO: 69263 - RNA, 19 nt, Homo sapiens
gaauagggcugguuacuuu

SEQ ID NO: 69264 - RNA, 19 nt, Homo sapiens
ccaagugccuucugaauga

SEQ ID NO: 69265 - RNA, 19 nt, Homo sapiens
caacaauuccggaacauuu

SEQ ID NO: 69266 - RNA, 19 nt, Homo sapiens
gaacaucgacuuugacagu

SEQ ID NO: 69267 - RNA, 19 nt, Homo sapiens
cagaugagcucaagaaggu

SEQ ID NO: 69268 - RNA, 19 nt, Homo sapiens
ccaaagccaugcaggauca

SEQ ID NO: 69269 - RNA, 19 nt, Homo sapiens
guaaagcaaugagguagga

SEQ ID NO: 69270 - RNA, 19 nt, Homo sapiens
caaagccauuuaccucaaa

SEQ ID NO: 69271 - RNA, 19 nt, Homo sapiens
acaaggaccugaagacaca

SEQ ID NO: 69272 - RNA, 19 nt, Homo sapiens
ggucaucggugugcaguau

SEQ ID NO: 69273 - RNA, 19 nt, Homo sapiens
ccaaagccauuuaccucaa

SEQ ID NO: 69274 - RNA, 19 nt, Homo sapiens
gcucugaucaggaaaguga

SEQ ID NO: 69275 - RNA, 19 nt, Homo sapiens
uaaacuaacucaguggaau

SEQ ID NO: 69276 - RNA, 19 nt, Homo sapiens
ccaggcaccucaucaguca

SEQ ID NO: 69277 - RNA, 19 nt, Homo sapiens
cuaaauaaaggcaugugua

SEQ ID NO: 69278 - RNA, 19 nt, Homo sapiens
aaacuaacucaguggaaua

SEQ ID NO: 69279 - RNA, 19 nt, Homo sapiens
gcaaugagguaggaagaac

SEQ ID NO: 69280 - RNA, 19 nt, Homo sapiens
ucacucaggauuucaguuu

SEQ ID NO: 69281 - RNA, 19 nt, Homo sapiens
ggcugcagcucaccaugua

SEQ ID NO: 69282 - RNA, 19 nt, Homo sapiens
ugacaaggauggagauggu

SEQ ID NO: 69283 - RNA, 19 nt, Homo sapiens
ucaacaaccagcucuauga

SEQ ID NO: 69284 - RNA, 19 nt, Homo sapiens
acaugaacaucgacuuuga

SEQ ID NO: 69285 - RNA, 19 nt, Homo sapiens
uggcagcucugaucaggaa

SEQ ID NO: 69286 - RNA, 19 nt, Homo sapiens
gcacucagcaccuccuugu

SEQ ID NO: 69287 - RNA, 19 nt, Homo sapiens
ggaauagggcugguuacuu

SEQ ID NO: 69288 - RNA, 19 nt, Homo sapiens
ugccuagccugacccuuua

SEQ ID NO: 69289 - RNA, 19 nt, Homo sapiens
gcagauagcaggagaugac

SEQ ID NO: 69290 - RNA, 19 nt, Homo sapiens
cagcaacaauuccggaaca

SEQ ID NO: 69291 - RNA, 19 nt, Homo sapiens
ggagcuggcacgucacaaa

SEQ ID NO: 69292 - RNA, 19 nt, Homo sapiens
gaucuguucuggucaucug

SEQ ID NO: 69293 - RNA, 19 nt, Homo sapiens
gcaggaucacucaggauuu

SEQ ID NO: 69294 - RNA, 19 nt, Homo sapiens
gauuaaggccuggcagaaa

SEQ ID NO: 69295 - RNA, 19 nt, Homo sapiens
uaacacagucgugaacaaa

SEQ ID NO: 69296 - RNA, 19 nt, Homo sapiens
acaaacacaugaacaucga

SEQ ID NO: 69297 - RNA, 19 nt, Homo sapiens
gugaggaacagcaacaauu

SEQ ID NO: 69298 - RNA, 19 nt, Homo sapiens
aagcugaucuaaauaaagg

SEQ ID NO: 69299 - RNA, 19 nt, Homo sapiens
gagggcauguucagagcuu

SEQ ID NO: 69300 - RNA, 19 nt, Homo sapiens
caccaccucuggaacaaga

SEQ ID NO: 69301 - RNA, 19 nt, Homo sapiens
ggaaagugaggaacagcaa

SEQ ID NO: 69302 - RNA, 19 nt, Homo sapiens
caggaucacucaggauuuc

SEQ ID NO: 69303 - RNA, 19 nt, Homo sapiens
gauagcaggagaugacaug

SEQ ID NO: 69304 - RNA, 19 nt, Homo sapiens
acacaugaacaucgacuuu

SEQ ID NO: 69305 - RNA, 19 nt, Homo sapiens
ugauugcgcucauggauac

SEQ ID NO: 69306 - RNA, 19 nt, Homo sapiens
guacgcagacaaacacaug

SEQ ID NO: 69307 - RNA, 19 nt, Homo sapiens
acacagucgugaacaaaca

SEQ ID NO: 69308 - RNA, 19 nt, Homo sapiens
acaaccagcucuaugacau

SEQ ID NO: 69309 - RNA, 19 nt, Homo sapiens
gugcagaugagcucaagaa

SEQ ID NO: 69310 - RNA, 19 nt, Homo sapiens
uagccugacccuuuaguaa

SEQ ID NO: 69311 - RNA, 19 nt, Homo sapiens
guucagagcuuuucaugca

SEQ ID NO: 69312 - RNA, 19 nt, Homo sapiens
gcaacaauuccggaacauu

SEQ ID NO: 69313 - RNA, 19 nt, Homo sapiens
gcgauugguuuuaguggua

SEQ ID NO: 69314 - RNA, 19 nt, Homo sapiens
gcagacaaacacaugaaca

SEQ ID NO: 69315 - RNA, 19 nt, Homo sapiens
aauaaaggcauguguaugg

SEQ ID NO: 69316 - RNA, 19 nt, Homo sapiens
ucauaaguuuggcugcauu

SEQ ID NO: 69317 - RNA, 19 nt, Homo sapiens
ucaaaggacccagcagcua

SEQ ID NO: 69318 - RNA, 19 nt, Homo sapiens
gaugcgaaaugcagucaac

SEQ ID NO: 69319 - RNA, 19 nt, Homo sapiens
ucaguuucacccucuauuu

SEQ ID NO: 69320 - RNA, 19 nt, Homo sapiens
ucaucaagcucaacguucu

SEQ ID NO: 69321 - RNA, 19 nt, Homo sapiens
acaucgacuuugacaguuu

SEQ ID NO: 69322 - RNA, 19 nt, Homo sapiens
gcuacgagaugcgaaaugc

SEQ ID NO: 69323 - RNA, 19 nt, Homo sapiens
gaagacacacggguucaca

SEQ ID NO: 69324 - RNA, 19 nt, Homo sapiens
guaaacuaacucaguggaa

SEQ ID NO: 69325 - RNA, 19 nt, Homo sapiens
ucaucggugugcaguauug

SEQ ID NO: 69326 - RNA, 19 nt, Homo sapiens
uuaacacagucgugaacaa

SEQ ID NO: 69327 - RNA, 19 nt, Homo sapiens
ucaugcuccuccuccauuu

SEQ ID NO: 69328 - RNA, 19 nt, Homo sapiens
caucgacuuugacaguuuc

SEQ ID NO: 69329 - RNA, 19 nt, Homo sapiens
ugaggaacagcaacaauuc

SEQ ID NO: 69330 - RNA, 19 nt, Homo sapiens
uuaguaaagcaaugaggua

SEQ ID NO: 69331 - RNA, 19 nt, Homo sapiens
uucaucugcugcuucguua

SEQ ID NO: 69332 - RNA, 19 nt, Homo sapiens
gauuccaccucaacaacca

SEQ ID NO: 69333 - RNA, 19 nt, Homo sapiens
acucaggauuucaguuuca

SEQ ID NO: 69334 - RNA, 19 nt, Homo sapiens
ugaaugaccacaggcgauu

SEQ ID NO: 69335 - RNA, 19 nt, Homo sapiens
ucaaacacuaugacacaga

SEQ ID NO: 69336 - RNA, 19 nt, Homo sapiens
uaucaucaagcucaacguu

SEQ ID NO: 69337 - RNA, 19 nt, Homo sapiens
aaacacaaggaccugaaga

SEQ ID NO: 69338 - RNA, 19 nt, Homo sapiens
cauaaguuuggcugcauuu

SEQ ID NO: 69339 - RNA, 19 nt, Homo sapiens
guccugccguagcaugauu

SEQ ID NO: 69340 - RNA, 19 nt, Homo sapiens
cagacaaacacaugaacau

SEQ ID NO: 69341 - RNA, 19 nt, Homo sapiens
gaaugaccacaggcgauug

SEQ ID NO: 69342 - RNA, 19 nt, Homo sapiens
gagugcuccugcuuaccuu

SEQ ID NO: 69343 - RNA, 19 nt, Homo sapiens
caguuucacccucuauuuc

SEQ ID NO: 69344 - RNA, 19 nt, Homo sapiens
gcaggauuccaccucaaca

SEQ ID NO: 69345 - RNA, 19 nt, Homo sapiens
uaggcugucugcagaagca

SEQ ID NO: 69346 - RNA, 19 nt, Homo sapiens
gucaugcuccuccuccauu

SEQ ID NO: 69347 - RNA, 19 nt, Homo sapiens
cuauuuccaaagccauuua

SEQ ID NO: 69348 - RNA, 19 nt, Homo sapiens
caacaaccagcucuaugac

SEQ ID NO: 69349 - RNA, 19 nt, Homo sapiens
gaccaguccggcaccauca

SEQ ID NO: 69350 - RNA, 19 nt, Homo sapiens
gacaaggauggagauggua

SEQ ID NO: 69351 - RNA, 19 nt, Homo sapiens
ucaggaaagugaggaacag

SEQ ID NO: 69352 - RNA, 19 nt, Homo sapiens
cgacuuugacaguuucauc

SEQ ID NO: 69353 - RNA, 19 nt, Homo sapiens
aaccagcucuaugacauca

SEQ ID NO: 69354 - RNA, 19 nt, Homo sapiens
agucaacgacgcaggauuc

SEQ ID NO: 69355 - RNA, 19 nt, Homo sapiens
uuucaaacacuaugacaca

SEQ ID NO: 69356 - RNA, 19 nt, Homo sapiens
acaaacacaaggaccugaa

SEQ ID NO: 69357 - RNA, 19 nt, Homo sapiens
gagcaucucuauaacauga

SEQ ID NO: 69358 - RNA, 19 nt, Homo sapiens
ugaaugagcaucucuauaa

SEQ ID NO: 69359 - RNA, 19 nt, Homo sapiens
ccacagaacucaugaacau

SEQ ID NO: 69360 - RNA, 19 nt, Homo sapiens
gcagccauguuccugguua

SEQ ID NO: 69361 - RNA, 19 nt, Homo sapiens
gcacacacccacuccguaa

SEQ ID NO: 69362 - RNA, 19 nt, Homo sapiens
acacauuacuccaacauug

SEQ ID NO: 69363 - RNA, 19 nt, Homo sapiens
gaacauggauuuugacaac

SEQ ID NO: 69364 - RNA, 19 nt, Homo sapiens
gaaagugggaacauggauu

SEQ ID NO: 69365 - RNA, 19 nt, Homo sapiens
ggcugcagcugacuaugua

SEQ ID NO: 69366 - RNA, 19 nt, Homo sapiens
ccagugccuuugucuauau

SEQ ID NO: 69367 - RNA, 19 nt, Homo sapiens
gauccugucugcagucaca

SEQ ID NO: 69368 - RNA, 19 nt, Homo sapiens
cccaguugcugaucucuaa

SEQ ID NO: 69369 - RNA, 19 nt, Homo sapiens
ggacaaauccaggugaaca

SEQ ID NO: 69370 - RNA, 19 nt, Homo sapiens
gaaugagcaucucuauaac

SEQ ID NO: 69371 - RNA, 19 nt, Homo sapiens
guucgacacugaccgauca

SEQ ID NO: 69372 - RNA, 19 nt, Homo sapiens
caacauccagggcccaauu

SEQ ID NO: 69373 - RNA, 19 nt, Homo sapiens
ugucugcagucacaucuuu

SEQ ID NO: 69374 - RNA, 19 nt, Homo sapiens
gaacauucucaauaagguu

SEQ ID NO: 69375 - RNA, 19 nt, Homo sapiens
gaacucaugaacauucuca

SEQ ID NO: 69376 - RNA, 19 nt, Homo sapiens
cauguuccgugccuucaaa

SEQ ID NO: 69377 - RNA, 19 nt, Homo sapiens
ucagggaccauuugcagua

SEQ ID NO: 69378 - RNA, 19 nt, Homo sapiens
acccugaucugaagacuga

SEQ ID NO: 69379 - RNA, 19 nt, Homo sapiens
cugguuaacucguucuuga

SEQ ID NO: 69380 - RNA, 19 nt, Homo sapiens
aaagugggaacauggauuu

SEQ ID NO: 69381 - RNA, 19 nt, Homo sapiens
uuacccagcuucucaacau

SEQ ID NO: 69382 - RNA, 19 nt, Homo sapiens
aaagauggcacuggacaaa

SEQ ID NO: 69383 - RNA, 19 nt, Homo sapiens
cgacgcuacucagaugaaa

SEQ ID NO: 69384 - RNA, 19 nt, Homo sapiens
gugaggagguccggcaguu

SEQ ID NO: 69385 - RNA, 19 nt, Homo sapiens
ggaaccgacucccagaacu

SEQ ID NO: 69386 - RNA, 19 nt, Homo sapiens
gaucauccgacgcuacuca

SEQ ID NO: 69387 - RNA, 19 nt, Homo sapiens
ugaacauucucaauaaggu

SEQ ID NO: 69388 - RNA, 19 nt, Homo sapiens
cucaugaacauucucaaua

SEQ ID NO: 69389 - RNA, 19 nt, Homo sapiens
ggaggucagcgccacagaa

SEQ ID NO: 69390 - RNA, 19 nt, Homo sapiens
gcaguuccggagacucuuu

SEQ ID NO: 69391 - RNA, 19 nt, Homo sapiens
cccagugccuuugucuaua

SEQ ID NO: 69392 - RNA, 19 nt, Homo sapiens
agauggcacuggacaaauc

SEQ ID NO: 69393 - RNA, 19 nt, Homo sapiens
ggccauauacaaacaguuc

SEQ ID NO: 69394 - RNA, 19 nt, Homo sapiens
caugaacauucucaauaag

SEQ ID NO: 69395 - RNA, 19 nt, Homo sapiens
gcacacauuacuccaacau

SEQ ID NO: 69396 - RNA, 19 nt, Homo sapiens
gcaucucuauaacaugauc

SEQ ID NO: 69397 - RNA, 19 nt, Homo sapiens
gaucugaagacugaugguu

SEQ ID NO: 69398 - RNA, 19 nt, Homo sapiens
acagaacucaugaacauuc

SEQ ID NO: 69399 - RNA, 19 nt, Homo sapiens
gcucuaggacacucuaaca

SEQ ID NO: 69400 - RNA, 19 nt, Homo sapiens
cagccauguuccugguuaa

SEQ ID NO: 69401 - RNA, 19 nt, Homo sapiens
gaaccgacucccagaacuc

SEQ ID NO: 69402 - RNA, 19 nt, Homo sapiens
gggaccauuugcaguagug

SEQ ID NO: 69403 - RNA, 19 nt, Homo sapiens
ggcaggccauauacaaaca

SEQ ID NO: 69404 - RNA, 19 nt, Homo sapiens
cacauuacuccaacauuga

SEQ ID NO: 69405 - RNA, 19 nt, Homo sapiens
ggucagcgccacagaacuc

SEQ ID NO: 69406 - RNA, 19 nt, Homo sapiens
gugagucgcagccauguuc

SEQ ID NO: 69407 - RNA, 19 nt, Homo sapiens
ucaccgccuugcuauagga

SEQ ID NO: 69408 - RNA, 19 nt, Homo sapiens
gacuauguauuccugaacu

SEQ ID NO: 69409 - RNA, 19 nt, Homo sapiens
aaauaaacaugccccaguu

SEQ ID NO: 69410 - RNA, 19 nt, Homo sapiens
caaagauggcacuggacaa

SEQ ID NO: 69411 - RNA, 19 nt, Homo sapiens
ugaacucccaggugccuuu

SEQ ID NO: 69412 - RNA, 19 nt, Homo sapiens
acacgacacccugaucuga

SEQ ID NO: 69413 - RNA, 19 nt, Homo sapiens
aagccuagcacuugugaug

SEQ ID NO: 69414 - RNA, 19 nt, Homo sapiens
ggagucaucagcgccauca

SEQ ID NO: 69415 - RNA, 19 nt, Homo sapiens
gcugggcuuugaggaauuc

SEQ ID NO: 69416 - RNA, 19 nt, Homo sapiens
gugggaacauggauuuuga

SEQ ID NO: 69417 - RNA, 19 nt, Homo sapiens
agaugaaagugggaacaug

SEQ ID NO: 69418 - RNA, 19 nt, Homo sapiens
gcagcaugguggccgugau

SEQ ID NO: 69419 - RNA, 19 nt, Homo sapiens
ucugaagacugaugguuuu

SEQ ID NO: 69420 - RNA, 19 nt, Homo sapiens
gcacuugugaugccuccau

SEQ ID NO: 69421 - RNA, 19 nt, Homo sapiens
guucucucaguacuuguua

SEQ ID NO: 69422 - RNA, 19 nt, Homo sapiens
gaacggccaugcgcauccu

SEQ ID NO: 69423 - RNA, 19 nt, Homo sapiens
cugcugacccacaagcuuu

SEQ ID NO: 69424 - RNA, 19 nt, Homo sapiens
augagcaucucuauaacau

SEQ ID NO: 69425 - RNA, 19 nt, Homo sapiens
cauccuaggcggagucauc

SEQ ID NO: 69426 - RNA, 19 nt, Homo sapiens
ccauguuccugguuaacuc

SEQ ID NO: 69427 - RNA, 19 nt, Homo sapiens
ccaggaggaaauaaacaug

SEQ ID NO: 69428 - RNA, 19 nt, Homo sapiens
uuuguucucucaguacuug

SEQ ID NO: 69429 - RNA, 19 nt, Homo sapiens
gacaaauccaggugaacau

SEQ ID NO: 69430 - RNA, 19 nt, Homo sapiens
cugaaugagcaucucuaua

SEQ ID NO: 69431 - RNA, 19 nt, Homo sapiens
gaacucccaggugccuuug

SEQ ID NO: 69432 - RNA, 19 nt, Homo sapiens
gaccgaucagggaccauuu

SEQ ID NO: 69433 - RNA, 19 nt, Homo sapiens
cagugccuuugucuauauu

SEQ ID NO: 69434 - RNA, 19 nt, Homo sapiens
gaggucagcgccacagaac

SEQ ID NO: 69435 - RNA, 19 nt, Homo sapiens
ccucaccgccuugcuauag

SEQ ID NO: 69436 - RNA, 19 nt, Homo sapiens
gguuaacucguucuugaag

SEQ ID NO: 69437 - RNA, 19 nt, Homo sapiens
ggacugaaguggugauuga

SEQ ID NO: 69438 - RNA, 19 nt, Homo sapiens
gaagaaguaugccaaugaa

SEQ ID NO: 69439 - RNA, 19 nt, Homo sapiens
gaggaaagauaaguaagua

SEQ ID NO: 69440 - RNA, 19 nt, Homo sapiens
guacuucccuccaucuuaa

SEQ ID NO: 69441 - RNA, 19 nt, Homo sapiens
gagaauucauccagacaua

SEQ ID NO: 69442 - RNA, 19 nt, Homo sapiens
ggagugaaauuucugaaga

SEQ ID NO: 69443 - RNA, 19 nt, Homo sapiens
cacaucagcuucaagguua

SEQ ID NO: 69444 - RNA, 19 nt, Homo sapiens
gaauacaguucaugccauu

SEQ ID NO: 69445 - RNA, 19 nt, Homo sapiens
ccacugacauuccuauuau

SEQ ID NO: 69446 - RNA, 19 nt, Homo sapiens
cauccuagcuccugacuga

SEQ ID NO: 69447 - RNA, 19 nt, Homo sapiens
gggaagaccugacaauuac

SEQ ID NO: 69448 - RNA, 19 nt, Homo sapiens
agaaggaccugcgcacuua

SEQ ID NO: 69449 - RNA, 19 nt, Homo sapiens
ggccauaccuauaccauga

SEQ ID NO: 69450 - RNA, 19 nt, Homo sapiens
ucacugagcucuaaaucug

SEQ ID NO: 69451 - RNA, 19 nt, Homo sapiens
cuacagaugucuuugaugu

SEQ ID NO: 69452 - RNA, 19 nt, Homo sapiens
gcaagaggaaagauaagua

SEQ ID NO: 69453 - RNA, 19 nt, Homo sapiens
ggucuagccugacauccua

SEQ ID NO: 69454 - RNA, 19 nt, Homo sapiens
gaaauguacuucccuccau

SEQ ID NO: 69455 - RNA, 19 nt, Homo sapiens
gaagauacacugagcuugu

SEQ ID NO: 69456 - RNA, 19 nt, Homo sapiens
acagaugucuuugauguuu

SEQ ID NO: 69457 - RNA, 19 nt, Homo sapiens
ggacuuccaccuauauuga

SEQ ID NO: 69458 - RNA, 19 nt, Homo sapiens
caaagcugcuaggcuguua

SEQ ID NO: 69459 - RNA, 19 nt, Homo sapiens
gaucuggucuucucuuucu

SEQ ID NO: 69460 - RNA, 19 nt, Homo sapiens
uaacggagaucuggucuuc

SEQ ID NO: 69461 - RNA, 19 nt, Homo sapiens
gauucaagcaggacaauaa

SEQ ID NO: 69462 - RNA, 19 nt, Homo sapiens
gcacaguguuucugagcaa

SEQ ID NO: 69463 - RNA, 19 nt, Homo sapiens
gaggagaaguacaagcuau

SEQ ID NO: 69464 - RNA, 19 nt, Homo sapiens
guagcuacauaaccuauau

SEQ ID NO: 69465 - RNA, 19 nt, Homo sapiens
ggugauugaugacuuguug

SEQ ID NO: 69466 - RNA, 19 nt, Homo sapiens
caagaggaaagauaaguaa

SEQ ID NO: 69467 - RNA, 19 nt, Homo sapiens
ucaggaggcugcuauaaca

SEQ ID NO: 69468 - RNA, 19 nt, Homo sapiens
ggaaugcucugcuggaaaa

SEQ ID NO: 69469 - RNA, 19 nt, Homo sapiens
ccacuuccaugaaugaguu

SEQ ID NO: 69470 - RNA, 19 nt, Homo sapiens
gagaagaaguaugccaaug

SEQ ID NO: 69471 - RNA, 19 nt, Homo sapiens
ggagaugaaccgcaaauuc

SEQ ID NO: 69472 - RNA, 19 nt, Homo sapiens
gaauucauccagacauauu

SEQ ID NO: 69473 - RNA, 19 nt, Homo sapiens
gcuccugacugaacacuau

SEQ ID NO: 69474 - RNA, 19 nt, Homo sapiens
caucuuaaccuaucaacuu

SEQ ID NO: 69475 - RNA, 19 nt, Homo sapiens
ugggaagaccugacaauua

SEQ ID NO: 69476 - RNA, 19 nt, Homo sapiens
ggacuucacgggcacauug

SEQ ID NO: 69477 - RNA, 19 nt, Homo sapiens
ggaacugacucuggacaug

SEQ ID NO: 69478 - RNA, 19 nt, Homo sapiens
guacuuagccuaccuagac

SEQ ID NO: 69479 - RNA, 19 nt, Homo sapiens
gcacauuggcugaaacugu

SEQ ID NO: 69480 - RNA, 19 nt, Homo sapiens
caacgcuucugcaaugaug

SEQ ID NO: 69481 - RNA, 19 nt, Homo sapiens
gcugggacuuccaccuaua

SEQ ID NO: 69482 - RNA, 19 nt, Homo sapiens
ucacuacacugccuuacau

SEQ ID NO: 69483 - RNA, 19 nt, Homo sapiens
cugaggaccuggagaagaa

SEQ ID NO: 69484 - RNA, 19 nt, Homo sapiens
gaagaagggcaacuaugug

SEQ ID NO: 69485 - RNA, 19 nt, Homo sapiens
gcacaaggucauuauguca

SEQ ID NO: 69486 - RNA, 19 nt, Homo sapiens
gaagaguggcagcaacuga

SEQ ID NO: 69487 - RNA, 19 nt, Homo sapiens
cacauuggcugaaacuguu

SEQ ID NO: 69488 - RNA, 19 nt, Homo sapiens
caaagacaauucccaacca

SEQ ID NO: 69489 - RNA, 19 nt, Homo sapiens
gaagcaggaaugcaucaaa

SEQ ID NO: 69490 - RNA, 19 nt, Homo sapiens
uuucaacgcuucugcaaug

SEQ ID NO: 69491 - RNA, 19 nt, Homo sapiens
gagcuggaguucaaugagu

SEQ ID NO: 69492 - RNA, 19 nt, Homo sapiens
ggugccaggucuuaguuaa

SEQ ID NO: 69493 - RNA, 19 nt, Homo sapiens
guauaugguucgccugaga

SEQ ID NO: 69494 - RNA, 19 nt, Homo sapiens
gcugggauauuucacuuuc

SEQ ID NO: 69495 - RNA, 19 nt, Homo sapiens
agacaauucccaaccauaa

SEQ ID NO: 69496 - RNA, 19 nt, Homo sapiens
cuagacaucauacacauuu

SEQ ID NO: 69497 - RNA, 19 nt, Homo sapiens
gcuggacuguggaugauga

SEQ ID NO: 69498 - RNA, 19 nt, Homo sapiens
uaaguaccauacacaccua

SEQ ID NO: 69499 - RNA, 19 nt, Homo sapiens
ggucugaucugcuguucca

SEQ ID NO: 69500 - RNA, 19 nt, Homo sapiens
gaccagcaagcauucauuu

SEQ ID NO: 69501 - RNA, 19 nt, Homo sapiens
ggauauuucacuuucguuu

SEQ ID NO: 69502 - RNA, 19 nt, Homo sapiens
ucucuagagucagucauua

SEQ ID NO: 69503 - RNA, 19 nt, Homo sapiens
auacacauuugccaagaaa

SEQ ID NO: 69504 - RNA, 19 nt, Homo sapiens
uaagaagggugguccaacu

SEQ ID NO: 69505 - RNA, 19 nt, Homo sapiens
ugaagaagggcaacuaugu

SEQ ID NO: 69506 - RNA, 19 nt, Homo sapiens
ccuauaccaugacugauau

SEQ ID NO: 69507 - RNA, 19 nt, Homo sapiens
ccaaaucacaauaaaguuc

SEQ ID NO: 69508 - RNA, 19 nt, Homo sapiens
gaaggaggagggcugauca

SEQ ID NO: 69509 - RNA, 19 nt, Homo sapiens
ggcugaaacuguugacaug

SEQ ID NO: 69510 - RNA, 19 nt, Homo sapiens
gggcacaagccaaugguuu

SEQ ID NO: 69511 - RNA, 19 nt, Homo sapiens
gaaauaccaggaacugaag

SEQ ID NO: 69512 - RNA, 19 nt, Homo sapiens
cgacaguccuaucuagaca

SEQ ID NO: 69513 - RNA, 19 nt, Homo sapiens
ccacaucagcuucaagguu

SEQ ID NO: 69514 - RNA, 19 nt, Homo sapiens
gaaacuguaaacccauauu

SEQ ID NO: 69515 - RNA, 19 nt, Homo sapiens
agaagaaguaugccaauga

SEQ ID NO: 69516 - RNA, 19 nt, Homo sapiens
uuacucagaucacuguuca

SEQ ID NO: 69517 - RNA, 19 nt, Homo sapiens
gaagggcaacuaugugcuu

SEQ ID NO: 69518 - RNA, 19 nt, Homo sapiens
gugcugagaagguguauau

SEQ ID NO: 69519 - RNA, 19 nt, Homo sapiens
cuggaaaggugguguggaa

SEQ ID NO: 69520 - RNA, 19 nt, Homo sapiens
cuacacugccuuacauaaa

SEQ ID NO: 69521 - RNA, 19 nt, Homo sapiens
acacacaccuacacucaca

SEQ ID NO: 69522 - RNA, 19 nt, Homo sapiens
gcucguggcuacccgaaag

SEQ ID NO: 69523 - RNA, 19 nt, Homo sapiens
agaaauaccaggaacugaa

SEQ ID NO: 69524 - RNA, 19 nt, Homo sapiens
gaucugcuguuccauugag

SEQ ID NO: 69525 - RNA, 19 nt, Homo sapiens
guucaggagucucauugga

SEQ ID NO: 69526 - RNA, 19 nt, Homo sapiens
gaaguaugccaaugaaacu

SEQ ID NO: 69527 - RNA, 19 nt, Homo sapiens
cugaaugucugccgcaaug

SEQ ID NO: 69528 - RNA, 19 nt, Homo sapiens
cugaaguggugauugauga

SEQ ID NO: 69529 - RNA, 19 nt, Homo sapiens
cagaaggaccacugacauu

SEQ ID NO: 69530 - RNA, 19 nt, Homo sapiens
guaugccaaugaaacugua

SEQ ID NO: 69531 - RNA, 19 nt, Homo sapiens
ucaaggcccaguauaaaug

SEQ ID NO: 69532 - RNA, 19 nt, Homo sapiens
ccuaauaucauuuguacug

SEQ ID NO: 69533 - RNA, 19 nt, Homo sapiens
ccacacacaccuacacuca

SEQ ID NO: 69534 - RNA, 19 nt, Homo sapiens
gccgugaucugaagucucu

SEQ ID NO: 69535 - RNA, 19 nt, Homo sapiens
gaaacauaguuguaguacu

SEQ ID NO: 69536 - RNA, 19 nt, Homo sapiens
cauacacauuugccaagaa

SEQ ID NO: 69537 - RNA, 19 nt, Homo sapiens
gcacaacacagcuaacaca

SEQ ID NO: 69538 - RNA, 19 nt, Homo sapiens
ugucaucgcagcugcauuu

SEQ ID NO: 69539 - RNA, 19 nt, Homo sapiens
ccuggacgcugaugaguuc

SEQ ID NO: 69540 - RNA, 19 nt, Homo sapiens
gugagugccuccaugaaca

SEQ ID NO: 69541 - RNA, 19 nt, Homo sapiens
ccaaucagaagauggcaaa

SEQ ID NO: 69542 - RNA, 19 nt, Homo sapiens
gagggugugugcaggaagu

SEQ ID NO: 69543 - RNA, 19 nt, Homo sapiens
ccagaggcaccuuccacua

SEQ ID NO: 69544 - RNA, 19 nt, Homo sapiens
ggaauuccaggacuacuac

SEQ ID NO: 69545 - RNA, 19 nt, Homo sapiens
uggcggaauuccaggacua

SEQ ID NO: 69546 - RNA, 19 nt, Homo sapiens
gauggcaaauggggaauaa

SEQ ID NO: 69547 - RNA, 19 nt, Homo sapiens
ggcagggucuggccaaacu

SEQ ID NO: 69548 - RNA, 19 nt, Homo sapiens
gagaaacuccgggcacagu

SEQ ID NO: 69549 - RNA, 19 nt, Homo sapiens
ggaguucguggccaugaug

SEQ ID NO: 69550 - RNA, 19 nt, Homo sapiens
cagaggcaccuuccacuag

SEQ ID NO: 69551 - RNA, 19 nt, Homo sapiens
cauccuaaccucagaaacu

SEQ ID NO: 69552 - RNA, 19 nt, Homo sapiens
cggaauuccaggacuacua

SEQ ID NO: 69553 - RNA, 19 nt, Homo sapiens
cagagggugugugcaggaa

SEQ ID NO: 69554 - RNA, 19 nt, Homo sapiens
ggaagugggaccgcaaugg

SEQ ID NO: 69555 - RNA, 19 nt, Homo sapiens
cgcuggaucuggaggaguu

SEQ ID NO: 69556 - RNA, 19 nt, Homo sapiens
ccaggcacaacacagcuaa

SEQ ID NO: 69557 - RNA, 19 nt, Homo sapiens
aucagaagauggcaaaugg

SEQ ID NO: 69558 - RNA, 19 nt, Homo sapiens
gaaggacgggcaggucaca

SEQ ID NO: 69559 - RNA, 19 nt, Homo sapiens
ccagagcccagaccaagca

SEQ ID NO: 69560 - RNA, 19 nt, Homo sapiens
aaucagaagauggcaaaug

SEQ ID NO: 69561 - RNA, 19 nt, Homo sapiens
gaggaguucguggccauga

SEQ ID NO: 69562 - RNA, 19 nt, Homo sapiens
gcaccuuccacuagcaaca

SEQ ID NO: 69563 - RNA, 19 nt, Homo sapiens
gaggcaccuuccacuagca

SEQ ID NO: 69564 - RNA, 19 nt, Homo sapiens
ugaacacggaugaggaguu

SEQ ID NO: 69565 - RNA, 19 nt, Homo sapiens
gcacaacacagcuaacaca

SEQ ID NO: 69566 - RNA, 19 nt, Homo sapiens
ugucaucgcagcugcauuu

SEQ ID NO: 69567 - RNA, 19 nt, Homo sapiens
ccuggacgcugaugaguuc

SEQ ID NO: 69568 - RNA, 19 nt, Homo sapiens
gugagugccuccaugaaca

SEQ ID NO: 69569 - RNA, 19 nt, Homo sapiens
ccaaucagaagauggcaaa

SEQ ID NO: 69570 - RNA, 19 nt, Homo sapiens
gagggugugugcaggaagu

SEQ ID NO: 69571 - RNA, 19 nt, Homo sapiens
ccagaggcaccuuccacua

SEQ ID NO: 69572 - RNA, 19 nt, Homo sapiens
ggaauuccaggacuacuac

SEQ ID NO: 69573 - RNA, 19 nt, Homo sapiens
uggcggaauuccaggacua

SEQ ID NO: 69574 - RNA, 19 nt, Homo sapiens
gauggcaaauggggaauaa

SEQ ID NO: 69575 - RNA, 19 nt, Homo sapiens
ggcagggucuggccaaacu

SEQ ID NO: 69576 - RNA, 19 nt, Homo sapiens
gagaaacuccgggcacagu

SEQ ID NO: 69577 - RNA, 19 nt, Homo sapiens
ggaguucguggccaugaug

SEQ ID NO: 69578 - RNA, 19 nt, Homo sapiens
cagaggcaccuuccacuag

SEQ ID NO: 69579 - RNA, 19 nt, Homo sapiens
cauccuaaccucagaaacu

SEQ ID NO: 69580 - RNA, 19 nt, Homo sapiens
cggaauuccaggacuacua

SEQ ID NO: 69581 - RNA, 19 nt, Homo sapiens
cagagggugugugcaggaa

SEQ ID NO: 69582 - RNA, 19 nt, Homo sapiens
ggaagugggaccgcaaugg

SEQ ID NO: 69583 - RNA, 19 nt, Homo sapiens
cgcuggaucuggaggaguu

SEQ ID NO: 69584 - RNA, 19 nt, Homo sapiens
ccaggcacaacacagcuaa

SEQ ID NO: 69585 - RNA, 19 nt, Homo sapiens
aucagaagauggcaaaugg

SEQ ID NO: 69586 - RNA, 19 nt, Homo sapiens
ccagagcccagaccaagca

SEQ ID NO: 69587 - RNA, 19 nt, Homo sapiens
aaucagaagauggcaaaug

SEQ ID NO: 69588 - RNA, 19 nt, Homo sapiens
gaggaguucguggccauga

SEQ ID NO: 69589 - RNA, 19 nt, Homo sapiens
gcaccuuccacuagcaaca

SEQ ID NO: 69590 - RNA, 19 nt, Homo sapiens
gaggcaccuuccacuagca

SEQ ID NO: 69591 - RNA, 19 nt, Homo sapiens
ugaacacggaugaggaguu

SEQ ID NO: 69592 - RNA, 19 nt, Homo sapiens
gaaccaaagugaaaggaua

SEQ ID NO: 69593 - RNA, 19 nt, Homo sapiens
gccaagaacucaaguguaa

SEQ ID NO: 69594 - RNA, 19 nt, Homo sapiens
gcaaagaaaugcagaaugc

SEQ ID NO: 69595 - RNA, 19 nt, Homo sapiens
gaagauagaaggauaugaa

SEQ ID NO: 69596 - RNA, 19 nt, Homo sapiens
ggaacaagauacucagcua

SEQ ID NO: 69597 - RNA, 19 nt, Homo sapiens
ggaauacuguugaaccuau

SEQ ID NO: 69598 - RNA, 19 nt, Homo sapiens
uaucgcaucucauaacuaa

SEQ ID NO: 69599 - RNA, 19 nt, Homo sapiens
agauucagguucacuauua

SEQ ID NO: 69600 - RNA, 19 nt, Homo sapiens
auagguaucuugugcuuua

SEQ ID NO: 69601 - RNA, 19 nt, Homo sapiens
gaucaggucuuaauuacag

SEQ ID NO: 69602 - RNA, 19 nt, Homo sapiens
ggcaguaucuuucuauugu

SEQ ID NO: 69603 - RNA, 19 nt, Homo sapiens
gaauacuguugaaccuaua

SEQ ID NO: 69604 - RNA, 19 nt, Homo sapiens
gguaucuugugcuuuaaua

SEQ ID NO: 69605 - RNA, 19 nt, Homo sapiens
uguaucagguagucuaaua

SEQ ID NO: 69606 - RNA, 19 nt, Homo sapiens
gcaguaucuuucuauugua

SEQ ID NO: 69607 - RNA, 19 nt, Homo sapiens
gguuaauucugccacauuu

SEQ ID NO: 69608 - RNA, 19 nt, Homo sapiens
guaggauucuucaguaugu

SEQ ID NO: 69609 - RNA, 19 nt, Homo sapiens
cacacuaucuucuguauca

SEQ ID NO: 69610 - RNA, 19 nt, Homo sapiens
agagugaucuauccuaaug

SEQ ID NO: 69611 - RNA, 19 nt, Homo sapiens
gcuacaagauuggcaaaga

SEQ ID NO: 69612 - RNA, 19 nt, Homo sapiens
cuacaagauuggcaaagaa

SEQ ID NO: 69613 - RNA, 19 nt, Homo sapiens
ucauaaagauguacaggau

SEQ ID NO: 69614 - RNA, 19 nt, Homo sapiens
gaugggcaacagacuauua

SEQ ID NO: 69615 - RNA, 19 nt, Homo sapiens
gauagaaggauaugaagau

SEQ ID NO: 69616 - RNA, 19 nt, Homo sapiens
gacguucggcuacuacuua

SEQ ID NO: 69617 - RNA, 19 nt, Homo sapiens
gcagguauguguguaaucu

SEQ ID NO: 69618 - RNA, 19 nt, Homo sapiens
uggcaggauuguacuauaa

SEQ ID NO: 69619 - RNA, 19 nt, Homo sapiens
auacucagcuacaagauug

SEQ ID NO: 69620 - RNA, 19 nt, Homo sapiens
guacaggauucacuaacug

SEQ ID NO: 69621 - RNA, 19 nt, Homo sapiens
uuuaagagccuaugugaaa

SEQ ID NO: 69622 - RNA, 19 nt, Homo sapiens
agagagugaucuauccuaa

SEQ ID NO: 69623 - RNA, 19 nt, Homo sapiens
uuucuagccucauggaaua

SEQ ID NO: 69624 - RNA, 19 nt, Homo sapiens
aauguaggauucuucagua

SEQ ID NO: 69625 - RNA, 19 nt, Homo sapiens
ggaauaauagguaucuugu

SEQ ID NO: 69626 - RNA, 19 nt, Homo sapiens
uucaagaacugcugacgua

SEQ ID NO: 69627 - RNA, 19 nt, Homo sapiens
ugaaagaccauuauuccaa

SEQ ID NO: 69628 - RNA, 19 nt, Homo sapiens
ggauuguacuauaagcaaa

SEQ ID NO: 69629 - RNA, 19 nt, Homo sapiens
guucggcuacuacuuaaua

SEQ ID NO: 69630 - RNA, 19 nt, Homo sapiens
gaguggaaguucaccauca

SEQ ID NO: 69631 - RNA, 19 nt, Homo sapiens
auacacaggugacauagau

SEQ ID NO: 69632 - RNA, 19 nt, Homo sapiens
ccaaagacuugaaccacau

SEQ ID NO: 69633 - RNA, 19 nt, Homo sapiens
uguguucucugccuuguaa

SEQ ID NO: 69634 - RNA, 19 nt, Homo sapiens
ggaagacacauucauccuu

SEQ ID NO: 69635 - RNA, 19 nt, Homo sapiens
agaauacacaggugacaua

SEQ ID NO: 69636 - RNA, 19 nt, Homo sapiens
uaauagguaucuugugcuu

SEQ ID NO: 69637 - RNA, 19 nt, Homo sapiens
aaaugcagauguugaagga

SEQ ID NO: 69638 - RNA, 19 nt, Homo sapiens
gaacauguuugcuuuuauc

SEQ ID NO: 69639 - RNA, 19 nt, Homo sapiens
ccacauucccugcacauga

SEQ ID NO: 69640 - RNA, 19 nt, Homo sapiens
gauucaacguguggucaua

SEQ ID NO: 69641 - RNA, 19 nt, Homo sapiens
auaaagauguacaggauuc

SEQ ID NO: 69642 - RNA, 19 nt, Homo sapiens
gggcaacagacuauuauug

SEQ ID NO: 69643 - RNA, 19 nt, Homo sapiens
caagguauuauggucauua

SEQ ID NO: 69644 - RNA, 19 nt, Homo sapiens
aagaaaugcagaaugcuua

SEQ ID NO: 69645 - RNA, 19 nt, Homo sapiens
guaauauagucaagcaagu

SEQ ID NO: 69646 - RNA, 19 nt, Homo sapiens
cacauucccugcacaugaa

SEQ ID NO: 69647 - RNA, 19 nt, Homo sapiens
cuauagcguugucuugauu

SEQ ID NO: 69648 - RNA, 19 nt, Homo sapiens
ggaaagacaaggauucaac

SEQ ID NO: 69649 - RNA, 19 nt, Homo sapiens
uuaugaagauggcaauguu

SEQ ID NO: 69650 - RNA, 19 nt, Homo sapiens
ggauguaaacuucuuucaa

SEQ ID NO: 69651 - RNA, 19 nt, Homo sapiens
cacuaacuguuucgaauga

SEQ ID NO: 69652 - RNA, 19 nt, Homo sapiens
ucaguugguuagucauaaa

SEQ ID NO: 69653 - RNA, 19 nt, Homo sapiens
gaagcccugcuacugauuu

SEQ ID NO: 69654 - RNA, 19 nt, Homo sapiens
ggcuacuacuuaauaauga

SEQ ID NO: 69655 - RNA, 19 nt, Homo sapiens
gaguaucagacagcaauua

SEQ ID NO: 69656 - RNA, 19 nt, Homo sapiens
gguauuauggucauuacuu

SEQ ID NO: 69657 - RNA, 19 nt, Homo sapiens
aguauaacauggaucaguu

SEQ ID NO: 69658 - RNA, 19 nt, Homo sapiens
uuucaaaguuaaccgguuu

SEQ ID NO: 69659 - RNA, 19 nt, Homo sapiens
caagauuggcaaagaaaug

SEQ ID NO: 69660 - RNA, 19 nt, Homo sapiens
gauacucagcuacaagauu

SEQ ID NO: 69661 - RNA, 19 nt, Homo sapiens
gauucagguucacuauuau

SEQ ID NO: 69662 - RNA, 19 nt, Homo sapiens
guugaaggaauaauaggua

SEQ ID NO: 69663 - RNA, 19 nt, Homo sapiens
caugaagcccugcuacuga

SEQ ID NO: 69664 - RNA, 19 nt, Homo sapiens
gcuuaaaggcugaauguag

SEQ ID NO: 69665 - RNA, 19 nt, Homo sapiens
ucaguaauauagucaagca

SEQ ID NO: 69666 - RNA, 19 nt, Homo sapiens
caaauuacucuuccucagu

SEQ ID NO: 69667 - RNA, 19 nt, Homo sapiens
gaaggaauaauagguaucu

SEQ ID NO: 69668 - RNA, 19 nt, Homo sapiens
guaguuauacaucugcauu

SEQ ID NO: 69669 - RNA, 19 nt, Homo sapiens
uacagucucuagcuaaaug

SEQ ID NO: 69670 - RNA, 19 nt, Homo sapiens
gaaaugcagaaugcuuaaa

SEQ ID NO: 69671 - RNA, 19 nt, Homo sapiens
gcaccaaaaucgacuggaa

SEQ ID NO: 69672 - RNA, 19 nt, Homo sapiens
caaugacguucggcuacua

SEQ ID NO: 69673 - RNA, 19 nt, Homo sapiens
gauaugacaacugguaaug

SEQ ID NO: 69674 - RNA, 19 nt, Homo sapiens
uaugauaugacaacuggua

SEQ ID NO: 69675 - RNA, 19 nt, Homo sapiens
cuaaagaggcuaugcuaca

SEQ ID NO: 69676 - RNA, 19 nt, Homo sapiens
gacaagguauuauggucau

SEQ ID NO: 69677 - RNA, 19 nt, Homo sapiens
gaaccuauagcguugucuu

SEQ ID NO: 69678 - RNA, 19 nt, Homo sapiens
caaacaaugucagauacca

SEQ ID NO: 69679 - RNA, 19 nt, Homo sapiens
caaguguaacugugauaaa

SEQ ID NO: 69680 - RNA, 19 nt, Homo sapiens
gagagagugaucuauccua

SEQ ID NO: 69681 - RNA, 19 nt, Homo sapiens
gguuagucauaaagaugua

SEQ ID NO: 69682 - RNA, 19 nt, Homo sapiens
gaagauggcaauguucagu

SEQ ID NO: 69683 - RNA, 19 nt, Homo sapiens
ucuguacuguuuaugcuaa

SEQ ID NO: 69684 - RNA, 19 nt, Homo sapiens
ccauugagcuguguaugca

SEQ ID NO: 69685 - RNA, 19 nt, Homo sapiens
uaugacaacugguaauggu

SEQ ID NO: 69686 - RNA, 19 nt, Homo sapiens
guauguguguaaucucaga

SEQ ID NO: 69687 - RNA, 19 nt, Homo sapiens
cuuaguaccauuguaguua

SEQ ID NO: 69688 - RNA, 19 nt, Homo sapiens
uaaagaggcuaugcuacag

SEQ ID NO: 69689 - RNA, 19 nt, Homo sapiens
gcuaaauucaucacucaug

SEQ ID NO: 69690 - RNA, 19 nt, Homo sapiens
gauguugaaggaauaauag

SEQ ID NO: 69691 - RNA, 19 nt, Homo sapiens
cacaugcauuugcccagua

SEQ ID NO: 69692 - RNA, 19 nt, Homo sapiens
gcacuaagauugauuggaa

SEQ ID NO: 69693 - RNA, 19 nt, Homo sapiens
gcaaagagaugcagaaugc

SEQ ID NO: 69694 - RNA, 19 nt, Homo sapiens
ggaacaagauccuuagcua

SEQ ID NO: 69695 - RNA, 19 nt, Homo sapiens
gaauggaaguuuacaauca

SEQ ID NO: 69696 - RNA, 19 nt, Homo sapiens
gauguucgguuacugcuua

SEQ ID NO: 69697 - RNA, 19 nt, Homo sapiens
ggaggcaacugauccaaga

SEQ ID NO: 69698 - RNA, 19 nt, Homo sapiens
ggacagcaaaccauuauug

SEQ ID NO: 69699 - RNA, 19 nt, Homo sapiens
gcaguugaaucauggagaa

SEQ ID NO: 69700 - RNA, 19 nt, Homo sapiens
gaagagaaggugcguauag

SEQ ID NO: 69701 - RNA, 19 nt, Homo sapiens
gguuacugcuuaauaauga

SEQ ID NO: 69702 - RNA, 19 nt, Homo sapiens
gcaguugucugaugaagag

SEQ ID NO: 69703 - RNA, 19 nt, Homo sapiens
cgucgacaguugccaguua

SEQ ID NO: 69704 - RNA, 19 nt, Homo sapiens
gcaaacagcaaaagaauuu

SEQ ID NO: 69705 - RNA, 19 nt, Homo sapiens
gcuacaagauuggcaaaga

SEQ ID NO: 69706 - RNA, 19 nt, Homo sapiens
gaggagcaguugucugaug

SEQ ID NO: 69707 - RNA, 19 nt, Homo sapiens
gcagaaugcauaagaugaa

SEQ ID NO: 69708 - RNA, 19 nt, Homo sapiens
uauacaagauucccuaaca

SEQ ID NO: 69709 - RNA, 19 nt, Homo sapiens
gcuagugagucauaaagau

SEQ ID NO: 69710 - RNA, 19 nt, Homo sapiens
uuucaaugauguucgguua

SEQ ID NO: 69711 - RNA, 19 nt, Homo sapiens
gauuggaacaagauccuua

SEQ ID NO: 69712 - RNA, 19 nt, Homo sapiens
ucugagagcuuacguaaaa

SEQ ID NO: 69713 - RNA, 19 nt, Homo sapiens
aguagaaacugcucugaga

SEQ ID NO: 69714 - RNA, 19 nt, Homo sapiens
ggaaggagcagcccaugca

SEQ ID NO: 69715 - RNA, 19 nt, Homo sapiens
auggagaacuucaguagaa

SEQ ID NO: 69716 - RNA, 19 nt, Homo sapiens
uccaagacccugugaagua

SEQ ID NO: 69717 - RNA, 19 nt, Homo sapiens
uaaggaaggaggcaacuga

SEQ ID NO: 69718 - RNA, 19 nt, Homo sapiens
cuugggaaauggaaaguuu

SEQ ID NO: 69719 - RNA, 19 nt, Homo sapiens
gcauagaaagccaucaguu

SEQ ID NO: 69720 - RNA, 19 nt, Homo sapiens
ccaagacccugugaaguag

SEQ ID NO: 69721 - RNA, 19 nt, Homo sapiens
uuaugaagaucagguauug

SEQ ID NO: 69722 - RNA, 19 nt, Homo sapiens
ccaguuacacgcacuaaga

SEQ ID NO: 69723 - RNA, 19 nt, Homo sapiens
uaagaugaacauugcauga

SEQ ID NO: 69724 - RNA, 19 nt, Homo sapiens
caagauucccuaacagugu

SEQ ID NO: 69725 - RNA, 19 nt, Homo sapiens
cuagugagucauaaagaua

SEQ ID NO: 69726 - RNA, 19 nt, Homo sapiens
gccaucaguuccaagcaaa

SEQ ID NO: 69727 - RNA, 19 nt, Homo sapiens
guucagcuagugagucaua

SEQ ID NO: 69728 - RNA, 19 nt, Homo sapiens
gauauacaagauucccuaa

SEQ ID NO: 69729 - RNA, 19 nt, Homo sapiens
cagaauggaaguuuacaau

SEQ ID NO: 69730 - RNA, 19 nt, Homo sapiens
cauagaaagccaucaguuc

SEQ ID NO: 69731 - RNA, 19 nt, Homo sapiens
aacagaacauggcgacuug

SEQ ID NO: 69732 - RNA, 19 nt, Homo sapiens
uaacagaacauggcgacuu

SEQ ID NO: 69733 - RNA, 19 nt, Homo sapiens
guucgguuacugcuuaaua

SEQ ID NO: 69734 - RNA, 19 nt, Homo sapiens
uaagauugauuggaacaag

SEQ ID NO: 69735 - RNA, 19 nt, Homo sapiens
uguagaagcugcagaaaau

SEQ ID NO: 69736 - RNA, 19 nt, Homo sapiens
gcagcaaaauucaucauuc

SEQ ID NO: 69737 - RNA, 19 nt, Homo sapiens
caagauccuuagcuacaag

SEQ ID NO: 69738 - RNA, 19 nt, Homo sapiens
gauuguagaagcugcagaa

SEQ ID NO: 69739 - RNA, 19 nt, Homo sapiens
uggaggagcaguugucuga

SEQ ID NO: 69740 - RNA, 19 nt, Homo sapiens
gauccaagacccugugaag

SEQ ID NO: 69741 - RNA, 19 nt, Homo sapiens
cuacaagauuggcaaagag

SEQ ID NO: 69742 - RNA, 19 nt, Homo sapiens
auccuuagcuacaagauug

SEQ ID NO: 69743 - RNA, 19 nt, Homo sapiens
gaggucagaauggaaguuu

SEQ ID NO: 69744 - RNA, 19 nt, Homo sapiens
cgaauggagucugcacugu

SEQ ID NO: 69745 - RNA, 19 nt, Homo sapiens
aggagcagcccaugcauuu

SEQ ID NO: 69746 - RNA, 19 nt, Homo sapiens
caagauuggcaaagagaug

SEQ ID NO: 69747 - RNA, 19 nt, Homo sapiens
gucggacacuacuuucaaa

SEQ ID NO: 69748 - RNA, 19 nt, Homo sapiens
cccuaacagugucuaauga

SEQ ID NO: 69749 - RNA, 19 nt, Homo sapiens
guugaaucauggagaacuu

SEQ ID NO: 69750 - RNA, 19 nt, Homo sapiens
acaagauccuuagcuacaa

SEQ ID NO: 69751 - RNA, 19 nt, Homo sapiens
aagauugauuggaacaaga

SEQ ID NO: 69752 - RNA, 19 nt, Homo sapiens
guuacacgcacuaagauug

SEQ ID NO: 69753 - RNA, 19 nt, Homo sapiens
gguaauguucagcuaguga

SEQ ID NO: 69754 - RNA, 19 nt, Homo sapiens
agaaagccaucaguuccaa

SEQ ID NO: 69755 - RNA, 19 nt, Homo sapiens
gagcaguugucugaugaag

SEQ ID NO: 69756 - RNA, 19 nt, Homo sapiens
uaacagugucuaaugaagu

SEQ ID NO: 69757 - RNA, 19 nt, Homo sapiens
aauggagucugcacugugu

SEQ ID NO: 69758 - RNA, 19 nt, Homo sapiens
aggagcaguugucugauga

SEQ ID NO: 69759 - RNA, 19 nt, Homo sapiens
gauccuuagcuacaagauu

SEQ ID NO: 69760 - RNA, 19 nt, Homo sapiens
ugagaauuaucagacaaug

SEQ ID NO: 69761 - RNA, 19 nt, Homo sapiens
cagcaaaauucaucauuca

SEQ ID NO: 69762 - RNA, 19 nt, Homo sapiens
cauuauugcaugcauagaa

SEQ ID NO: 69763 - RNA, 19 nt, Homo sapiens
guuaugaagaucagguauu

SEQ ID NO: 69764 - RNA, 19 nt, Homo sapiens
gaaugcauaagaugaacau

SEQ ID NO: 69765 - RNA, 19 nt, Homo sapiens
gagaauuaucagacaaugu

SEQ ID NO: 69766 - RNA, 19 nt, Homo sapiens
cuaacagugucuaaugaag

SEQ ID NO: 69767 - RNA, 19 nt, Homo sapiens
ucaaugauguucgguuacu

SEQ ID NO: 69768 - RNA, 19 nt, Homo sapiens
uggagaacuucaguagaaa

SEQ ID NO: 69769 - RNA, 19 nt, Homo sapiens
uggagaauuuaaugagguu

SEQ ID NO: 69770 - RNA, 19 nt, Homo sapiens
uucgguuacugcuuaauaa

SEQ ID NO: 69771 - RNA, 19 nt, Homo sapiens
uuacacgcacuaagauuga

SEQ ID NO: 69772 - RNA, 19 nt, Homo sapiens
aacagugucuaaugaagug

SEQ ID NO: 69773 - RNA, 19 nt, Homo sapiens
aaccauuauugcaugcaua

SEQ ID NO: 69774 - RNA, 19 nt, Homo sapiens
aaaagaacauuacccgaau

SEQ ID NO: 69775 - RNA, 19 nt, Homo sapiens
aaaaugcaguugaaucaug

SEQ ID NO: 69776 - RNA, 19 nt, Homo sapiens
ugcauaagaugaacauugc

SEQ ID NO: 69777 - RNA, 19 nt, Homo sapiens
agccuuacgucgacaguug

SEQ ID NO: 69778 - RNA, 19 nt, Homo sapiens
gcaaaauucaucauucaug

SEQ ID NO: 69779 - RNA, 19 nt, Homo sapiens
gagcagcccaugcauuugc

SEQ ID NO: 69780 - RNA, 19 nt, Homo sapiens
gagcuuacguaaaagaaca

SEQ ID NO: 69781 - RNA, 19 nt, Homo sapiens
cauggcgacuugggaaaug

SEQ ID NO: 69782 - RNA, 19 nt, Homo sapiens
gaaggaggcaacugaucca

SEQ ID NO: 69783 - RNA, 19 nt, Homo sapiens
guuggcaucuugaaaauuc

SEQ ID NO: 69784 - RNA, 19 nt, Homo sapiens
ggucagaauggaaguuuac

SEQ ID NO: 69785 - RNA, 19 nt, Homo sapiens
cagugagaauuaucagaca

SEQ ID NO: 69786 - RNA, 19 nt, Homo sapiens
ccuaacagugucuaaugaa

SEQ ID NO: 69787 - RNA, 19 nt, Homo sapiens
aacaagauccuuagcuaca

SEQ ID NO: 69788 - RNA, 19 nt, Homo sapiens
gcguauagcagcaaaauuc

SEQ ID NO: 69789 - RNA, 19 nt, Homo sapiens
ggcaaagagaugcagaaug

SEQ ID NO: 69790 - RNA, 19 nt, Homo sapiens
gauccaaagaacagaaucu

SEQ ID NO: 69791 - RNA, 19 nt, Homo sapiens
ugccaucagugagaauuau

SEQ ID NO: 69792 - RNA, 19 nt, Homo sapiens
uagaagaggucaaggauaa

SEQ ID NO: 69793 - RNA, 19 nt, Homo sapiens
ugaagaaacugaagaagaa

SEQ ID NO: 69794 - RNA, 19 nt, Homo sapiens
caacagaaccaaagacuaa

SEQ ID NO: 69795 - RNA, 19 nt, Homo sapiens
uaacgaugcucacaauaaa

SEQ ID NO: 69796 - RNA, 19 nt, Homo sapiens
gaaagccacuccugccaaa

SEQ ID NO: 69797 - RNA, 19 nt, Homo sapiens
caaagaaaccugcagauga

SEQ ID NO: 69798 - RNA, 19 nt, Homo sapiens
ggaagcagauccagaagau

SEQ ID NO: 69799 - RNA, 19 nt, Homo sapiens
aaagaaagguggagaagga

SEQ ID NO: 69800 - RNA, 19 nt, Homo sapiens
aaacagaaccugagaagaa

SEQ ID NO: 69801 - RNA, 19 nt, Homo sapiens
gaccacaucuuccuaacaa

SEQ ID NO: 69802 - RNA, 19 nt, Homo sapiens
gaagccaccuacaaagaaa

SEQ ID NO: 69803 - RNA, 19 nt, Homo sapiens
aaacaauuccuccugauua

SEQ ID NO: 69804 - RNA, 19 nt, Homo sapiens
guaaagagaaaccaucuaa

SEQ ID NO: 69805 - RNA, 19 nt, Homo sapiens
ggagaaggccaaagaagaa

SEQ ID NO: 69806 - RNA, 19 nt, Homo sapiens
gagaagaagucacagucaa

SEQ ID NO: 69807 - RNA, 19 nt, Homo sapiens
gaaaaccugugauggauaa

SEQ ID NO: 69808 - RNA, 19 nt, Homo sapiens
guaacgaugcucacaauaa

SEQ ID NO: 69809 - RNA, 19 nt, Homo sapiens
caaaaugcuucaucucuua

SEQ ID NO: 69810 - RNA, 19 nt, Homo sapiens
gaacagcagccaucagaga

SEQ ID NO: 69811 - RNA, 19 nt, Homo sapiens
gcugguggauggugacuuu

SEQ ID NO: 69812 - RNA, 19 nt, Homo sapiens
acaaaccaauggaagauaa

SEQ ID NO: 69813 - RNA, 19 nt, Homo sapiens
gaacagcuuccacccauga

SEQ ID NO: 69814 - RNA, 19 nt, Homo sapiens
gaaacaaucccaucugagu

SEQ ID NO: 69815 - RNA, 19 nt, Homo sapiens
gaaacaauuccuccugauu

SEQ ID NO: 69816 - RNA, 19 nt, Homo sapiens
ggagaaggauacaaugagu

SEQ ID NO: 69817 - RNA, 19 nt, Homo sapiens
agaaagagaugacacuauc

SEQ ID NO: 69818 - RNA, 19 nt, Homo sapiens
uaaacucucugacagucua

SEQ ID NO: 69819 - RNA, 19 nt, Homo sapiens
acagaaaccucacagaaca

SEQ ID NO: 69820 - RNA, 19 nt, Homo sapiens
cagcaagucuuccaguaug

SEQ ID NO: 69821 - RNA, 19 nt, Homo sapiens
gaacaaaccaauggaagau

SEQ ID NO: 69822 - RNA, 19 nt, Homo sapiens
agaggaaucuacagaaguu

SEQ ID NO: 69823 - RNA, 19 nt, Homo sapiens
gagagaguguugcugguau

SEQ ID NO: 69824 - RNA, 19 nt, Homo sapiens
gaaaucaacagaaccaaag

SEQ ID NO: 69825 - RNA, 19 nt, Homo sapiens
ggacaggacaaaccaguga

SEQ ID NO: 69826 - RNA, 19 nt, Homo sapiens
gagacaagcuuggagaaag

SEQ ID NO: 69827 - RNA, 19 nt, Homo sapiens
ggucaaggauaaagaugga

SEQ ID NO: 69828 - RNA, 19 nt, Homo sapiens
ucucugaacauccuaaaua

SEQ ID NO: 69829 - RNA, 19 nt, Homo sapiens
caaguuaagguaucuggua

SEQ ID NO: 69830 - RNA, 19 nt, Homo sapiens
ccaccuacauagaggaauu

SEQ ID NO: 69831 - RNA, 19 nt, Homo sapiens
ggcaaaagcuaaagaagaa

SEQ ID NO: 69832 - RNA, 19 nt, Homo sapiens
gauaaaccaucgggaaagu

SEQ ID NO: 69833 - RNA, 19 nt, Homo sapiens
gccaaaagaugacuaaaga

SEQ ID NO: 69834 - RNA, 19 nt, Homo sapiens
ccaaagcaccuaagaaugg

SEQ ID NO: 69835 - RNA, 19 nt, Homo sapiens
ugucggaccuccaugugua

SEQ ID NO: 69836 - RNA, 19 nt, Homo sapiens
ugaccggucugaauguaaa

SEQ ID NO: 69837 - RNA, 19 nt, Homo sapiens
agacaagcuuggagaaaga

SEQ ID NO: 69838 - RNA, 19 nt, Homo sapiens
caaagaagaagaccgugaa

SEQ ID NO: 69839 - RNA, 19 nt, Homo sapiens
gcaaagacaacagaggaaa

SEQ ID NO: 69840 - RNA, 19 nt, Homo sapiens
aaagaaaccugcagaugac

SEQ ID NO: 69841 - RNA, 19 nt, Homo sapiens
ccaaugaguuccaccuaca

SEQ ID NO: 69842 - RNA, 19 nt, Homo sapiens
caauuguucugggugauuu

SEQ ID NO: 69843 - RNA, 19 nt, Homo sapiens
ucugguaucugcauguaaa

SEQ ID NO: 69844 - RNA, 19 nt, Homo sapiens
gagaaagagaugacacuau

SEQ ID NO: 69845 - RNA, 19 nt, Homo sapiens
gaugaugccuuggauaaac

SEQ ID NO: 69846 - RNA, 19 nt, Homo sapiens
ggaccuccauguguaguau

SEQ ID NO: 69847 - RNA, 19 nt, Homo sapiens
gaaguaacgaugcucacaa

SEQ ID NO: 69848 - RNA, 19 nt, Homo sapiens
cugaacauccuaaauauug

SEQ ID NO: 69849 - RNA, 19 nt, Homo sapiens
ugacaaagaccucgaugau

SEQ ID NO: 69850 - RNA, 19 nt, Homo sapiens
gugaaaagcuuggugaaaa

SEQ ID NO: 69851 - RNA, 19 nt, Homo sapiens
aaaggaagcagauccagaa

SEQ ID NO: 69852 - RNA, 19 nt, Homo sapiens
caagccgggugacaagaaa

SEQ ID NO: 69853 - RNA, 19 nt, Homo sapiens
ggugauuucuagaaugguu

SEQ ID NO: 69854 - RNA, 19 nt, Homo sapiens
caaagcaccuaagaaugga

SEQ ID NO: 69855 - RNA, 19 nt, Homo sapiens
cuacagaaaccucacagaa

SEQ ID NO: 69856 - RNA, 19 nt, Homo sapiens
uggauaaagucaaggagaa

SEQ ID NO: 69857 - RNA, 19 nt, Homo sapiens
gaccuccgcucaauuaagg

SEQ ID NO: 69858 - RNA, 19 nt, Homo sapiens
ggagagaguguugcuggua

SEQ ID NO: 69859 - RNA, 19 nt, Homo sapiens
ucagagaaaucaacagaac

SEQ ID NO: 69860 - RNA, 19 nt, Homo sapiens
gauggugacuuuugaagaa

SEQ ID NO: 69861 - RNA, 19 nt, Homo sapiens
gaacacagcaaaggauaag

SEQ ID NO: 69862 - RNA, 19 nt, Homo sapiens
ucaaggagaaggccaaaga

SEQ ID NO: 69863 - RNA, 19 nt, Homo sapiens
gccagaugaugcuguagaa

SEQ ID NO: 69864 - RNA, 19 nt, Homo sapiens
aaagaggaaucuacagaag

SEQ ID NO: 69865 - RNA, 19 nt, Homo sapiens
ggaauuggguaaaagagaa

SEQ ID NO: 69866 - RNA, 19 nt, Homo sapiens
ggagguaaagcgaaggauu

SEQ ID NO: 69867 - RNA, 19 nt, Homo sapiens
ggagaaagagaugacacua

SEQ ID NO: 69868 - RNA, 19 nt, Homo sapiens
aaacaaucccaucugagua

SEQ ID NO: 69869 - RNA, 19 nt, Homo sapiens
cauccuaaauauugguuug

SEQ ID NO: 69870 - RNA, 19 nt, Homo sapiens
gcgaaggauucagcaaaga

SEQ ID NO: 69871 - RNA, 19 nt, Homo sapiens
caaaggauaagugcaagaa

SEQ ID NO: 69872 - RNA, 19 nt, Homo sapiens
gaagaaacugaagaagaaa

SEQ ID NO: 69873 - RNA, 19 nt, Homo sapiens
gagguaaagcgaaggauuc

SEQ ID NO: 69874 - RNA, 19 nt, Homo sapiens
uaucccaccugaauacaga

SEQ ID NO: 69875 - RNA, 19 nt, Homo sapiens
gaugagaacaaaccaaugg

SEQ ID NO: 69876 - RNA, 19 nt, Homo sapiens
ugacccagaugagaacaaa

SEQ ID NO: 69877 - RNA, 19 nt, Homo sapiens
gaacagccucggccaccaa

SEQ ID NO: 69878 - RNA, 19 nt, Homo sapiens
ugcuuuggaugacuuaaua

SEQ ID NO: 69879 - RNA, 19 nt, Homo sapiens
gcaagccgggugacaagaa

SEQ ID NO: 69880 - RNA, 19 nt, Homo sapiens
auacagacaucuccuggau

SEQ ID NO: 69881 - RNA, 19 nt, Homo sapiens
gaaguguggugaggaugau

SEQ ID NO: 69882 - RNA, 19 nt, Homo sapiens
ggaagucgaugaggcaaaa

SEQ ID NO: 69883 - RNA, 19 nt, Homo sapiens
cagcaaaggauaagugcaa

SEQ ID NO: 69884 - RNA, 19 nt, Homo sapiens
ccaauggaagauaaaguaa

SEQ ID NO: 69885 - RNA, 19 nt, Homo sapiens
gaaguuucagauccaauga

SEQ ID NO: 69886 - RNA, 19 nt, Homo sapiens
caucagagaaaucaacaga

SEQ ID NO: 69887 - RNA, 19 nt, Homo sapiens
uaucugguaucugcaugua

SEQ ID NO: 69888 - RNA, 19 nt, Homo sapiens
cagaacacagcaaaggaua

SEQ ID NO: 69889 - RNA, 19 nt, Homo sapiens
ugaagccaccuacaaagaa

SEQ ID NO: 69890 - RNA, 19 nt, Homo sapiens
ggaagauaaaguaaaggaa

SEQ ID NO: 69891 - RNA, 19 nt, Homo sapiens
aacaauuccuccugauuau

SEQ ID NO: 69892 - RNA, 19 nt, Homo sapiens
gcacugauaucaucgauua

SEQ ID NO: 69893 - RNA, 19 nt, Homo sapiens
uagaagaggucaaggauaa

SEQ ID NO: 69894 - RNA, 19 nt, Homo sapiens
ugaagaaacugaagaagaa

SEQ ID NO: 69895 - RNA, 19 nt, Homo sapiens
caacagaaccaaagacuaa

SEQ ID NO: 69896 - RNA, 19 nt, Homo sapiens
uaacgaugcucacaauaaa

SEQ ID NO: 69897 - RNA, 19 nt, Homo sapiens
gaaagccacuccugccaaa

SEQ ID NO: 69898 - RNA, 19 nt, Homo sapiens
caaagaaaccugcagauga

SEQ ID NO: 69899 - RNA, 19 nt, Homo sapiens
ggaagcagauccagaagau

SEQ ID NO: 69900 - RNA, 19 nt, Homo sapiens
aaagaaagguggagaagga

SEQ ID NO: 69901 - RNA, 19 nt, Homo sapiens
aaacagaaccugagaagaa

SEQ ID NO: 69902 - RNA, 19 nt, Homo sapiens
gaagccaccuacaaagaaa

SEQ ID NO: 69903 - RNA, 19 nt, Homo sapiens
aaacaauuccuccugauua

SEQ ID NO: 69904 - RNA, 19 nt, Homo sapiens
guaaagagaaaccaucuaa

SEQ ID NO: 69905 - RNA, 19 nt, Homo sapiens
ggaguaagcuacaggaucu

SEQ ID NO: 69906 - RNA, 19 nt, Homo sapiens
gaaauaucuucgagacuug

SEQ ID NO: 69907 - RNA, 19 nt, Homo sapiens
uagcaaauuucgagcauaa

SEQ ID NO: 69908 - RNA, 19 nt, Homo sapiens
uaacacugcuuauaaaugg

SEQ ID NO: 69909 - RNA, 19 nt, Homo sapiens
ggagaaggccaaagaagaa

SEQ ID NO: 69910 - RNA, 19 nt, Homo sapiens
gagaagaagucacagucaa

SEQ ID NO: 69911 - RNA, 19 nt, Homo sapiens
caguauagguguuugcuuu

SEQ ID NO: 69912 - RNA, 19 nt, Homo sapiens
ggagagaaagcuuuauauu

SEQ ID NO: 69913 - RNA, 19 nt, Homo sapiens
gaaaaccugugauggauaa

SEQ ID NO: 69914 - RNA, 19 nt, Homo sapiens
guaacgaugcucacaauaa

SEQ ID NO: 69915 - RNA, 19 nt, Homo sapiens
caaaaugcuucaucucuua

SEQ ID NO: 69916 - RNA, 19 nt, Homo sapiens
gaacagcagccaucagaga

SEQ ID NO: 69917 - RNA, 19 nt, Homo sapiens
agacuuggguguuuguuaa

SEQ ID NO: 69918 - RNA, 19 nt, Homo sapiens
gggcacauaucuccucuug

SEQ ID NO: 69919 - RNA, 19 nt, Homo sapiens
gaacauugcacugauauca

SEQ ID NO: 69920 - RNA, 19 nt, Homo sapiens
gcugguggauggugacuuu

SEQ ID NO: 69921 - RNA, 19 nt, Homo sapiens
acaaaccaauggaagauaa

SEQ ID NO: 69922 - RNA, 19 nt, Homo sapiens
gaacagcuuccacccauga

SEQ ID NO: 69923 - RNA, 19 nt, Homo sapiens
gaaacaaucccaucugagu

SEQ ID NO: 69924 - RNA, 19 nt, Homo sapiens
gagcagcaacugugucuuu

SEQ ID NO: 69925 - RNA, 19 nt, Homo sapiens
gauaaguccuuguguagca

SEQ ID NO: 69926 - RNA, 19 nt, Homo sapiens
gaaacaauuccuccugauu

SEQ ID NO: 69927 - RNA, 19 nt, Homo sapiens
ggagaaggauacaaugagu

SEQ ID NO: 69928 - RNA, 19 nt, Homo sapiens
agaaagagaugacacuauc

SEQ ID NO: 69929 - RNA, 19 nt, Homo sapiens
cuugaacucuguugguuua

SEQ ID NO: 69930 - RNA, 19 nt, Homo sapiens
uuagauaaguccuugugua

SEQ ID NO: 69931 - RNA, 19 nt, Homo sapiens
uaaacucucugacagucua

SEQ ID NO: 69932 - RNA, 19 nt, Homo sapiens
agaaauaucuucgagacuu

SEQ ID NO: 69933 - RNA, 19 nt, Homo sapiens
caaauacucucugaaaguc

SEQ ID NO: 69934 - RNA, 19 nt, Homo sapiens
acagaaaccucacagaaca

SEQ ID NO: 69935 - RNA, 19 nt, Homo sapiens
gaacaaaccaauggaagau

SEQ ID NO: 69936 - RNA, 19 nt, Homo sapiens
gaaugcagaccuccugaaa

SEQ ID NO: 69937 - RNA, 19 nt, Homo sapiens
agaggaaucuacagaaguu

SEQ ID NO: 69938 - RNA, 19 nt, Homo sapiens
gagagaguguugcugguau

SEQ ID NO: 69939 - RNA, 19 nt, Homo sapiens
gaaaucaacagaaccaaag

SEQ ID NO: 69940 - RNA, 19 nt, Homo sapiens
cagcaagucuuccaguaug

SEQ ID NO: 69941 - RNA, 19 nt, Homo sapiens
ccacagcaauguaagaagu

SEQ ID NO: 69942 - RNA, 19 nt, Homo sapiens
cagcaacugugucuuuaga

SEQ ID NO: 69943 - RNA, 19 nt, Homo sapiens
guacucaucugacuugaac

SEQ ID NO: 69944 - RNA, 19 nt, Homo sapiens
ggacaggacaaaccaguga

SEQ ID NO: 69945 - RNA, 19 nt, Homo sapiens
gagacaagcuuggagaaag

SEQ ID NO: 69946 - RNA, 19 nt, Homo sapiens
ggucaaggauaaagaugga

SEQ ID NO: 69947 - RNA, 19 nt, Homo sapiens
ucucugaacauccuaaaua

SEQ ID NO: 69948 - RNA, 19 nt, Homo sapiens
caaguuaagguaucuggua

SEQ ID NO: 69949 - RNA, 19 nt, Homo sapiens
ccaccuacauagaggaauu

SEQ ID NO: 69950 - RNA, 19 nt, Homo sapiens
gcaaauuucgagcauaaga

SEQ ID NO: 69951 - RNA, 19 nt, Homo sapiens
ggcaaaagcuaaagaagaa

SEQ ID NO: 69952 - RNA, 19 nt, Homo sapiens
gauaaaccaucgggaaagu

SEQ ID NO: 69953 - RNA, 19 nt, Homo sapiens
uaucuaauccucccauuug

SEQ ID NO: 69954 - RNA, 19 nt, Homo sapiens
gaacucuguugguuuacug

SEQ ID NO: 69955 - RNA, 19 nt, Homo sapiens
gccaaaagaugacuaaaga

SEQ ID NO: 69956 - RNA, 19 nt, Homo sapiens
ccaaagcaccuaagaaugg

SEQ ID NO: 69957 - RNA, 19 nt, Homo sapiens
ugucggaccuccaugugua

SEQ ID NO: 69958 - RNA, 19 nt, Homo sapiens
ugaccggucugaauguaaa

SEQ ID NO: 69959 - RNA, 19 nt, Homo sapiens
gaccaaaacugaaaaucaa

SEQ ID NO: 69960 - RNA, 19 nt, Homo sapiens
agacaagcuuggagaaaga

SEQ ID NO: 69961 - RNA, 19 nt, Homo sapiens
caaagaagaagaccgugaa

SEQ ID NO: 69962 - RNA, 19 nt, Homo sapiens
gcaaagacaacagaggaaa

SEQ ID NO: 69963 - RNA, 19 nt, Homo sapiens
aaagaaaccugcagaugac

SEQ ID NO: 69964 - RNA, 19 nt, Homo sapiens
ccaaugaguuccaccuaca

SEQ ID NO: 69965 - RNA, 19 nt, Homo sapiens
uuagagcuauugccacauu

SEQ ID NO: 69966 - RNA, 19 nt, Homo sapiens
caauuguucugggugauuu

SEQ ID NO: 69967 - RNA, 19 nt, Homo sapiens
ucugguaucugcauguaaa

SEQ ID NO: 69968 - RNA, 19 nt, Homo sapiens
gagaaagagaugacacuau

SEQ ID NO: 69969 - RNA, 19 nt, Homo sapiens
gaugaugccuuggauaaac

SEQ ID NO: 69970 - RNA, 19 nt, Homo sapiens
ggaccuccauguguaguau

SEQ ID NO: 69971 - RNA, 19 nt, Homo sapiens
gaaguaacgaugcucacaa

SEQ ID NO: 69972 - RNA, 19 nt, Homo sapiens
gcaaggauacggcuucagu

SEQ ID NO: 69973 - RNA, 19 nt, Homo sapiens
ccugaacauugcacugaua

SEQ ID NO: 69974 - RNA, 19 nt, Homo sapiens
cugaacauccuaaauauug

SEQ ID NO: 69975 - RNA, 19 nt, Homo sapiens
ugacaaagaccucgaugau

SEQ ID NO: 69976 - RNA, 19 nt, Homo sapiens
gugaaaagcuuggugaaaa

SEQ ID NO: 69977 - RNA, 19 nt, Homo sapiens
aaaggaagcagauccagaa

SEQ ID NO: 69978 - RNA, 19 nt, Homo sapiens
caagccgggugacaagaaa

SEQ ID NO: 69979 - RNA, 19 nt, Homo sapiens
gagacuuggguguuuguua

SEQ ID NO: 69980 - RNA, 19 nt, Homo sapiens
ccaaauacucucugaaagu

SEQ ID NO: 69981 - RNA, 19 nt, Homo sapiens
uaaauggcaccacaucuug

SEQ ID NO: 69982 - RNA, 19 nt, Homo sapiens
ccucuugggcugcuaauaa

SEQ ID NO: 69983 - RNA, 19 nt, Homo sapiens
ggugauuucuagaaugguu

SEQ ID NO: 69984 - RNA, 19 nt, Homo sapiens
caaagcaccuaagaaugga

SEQ ID NO: 69985 - RNA, 19 nt, Homo sapiens
cuacagaaaccucacagaa

SEQ ID NO: 69986 - RNA, 19 nt, Homo sapiens
uggauaaagucaaggagaa

SEQ ID NO: 69987 - RNA, 19 nt, Homo sapiens
gaccuccgcucaauuaagg

SEQ ID NO: 69988 - RNA, 19 nt, Homo sapiens
ggagagaguguugcuggua

SEQ ID NO: 69989 - RNA, 19 nt, Homo sapiens
ucagagaaaucaacagaac

SEQ ID NO: 69990 - RNA, 19 nt, Homo sapiens
ggcaauauuguaucuguuu

SEQ ID NO: 69991 - RNA, 19 nt, Homo sapiens
uugcaaauauccacuuaga

SEQ ID NO: 69992 - RNA, 19 nt, Homo sapiens
uagaagaggucaaggauaa

SEQ ID NO: 69993 - RNA, 19 nt, Homo sapiens
ggacugcccuggccuaaga

SEQ ID NO: 69994 - RNA, 19 nt, Homo sapiens
gaaagccacuccugccaaa

SEQ ID NO: 69995 - RNA, 19 nt, Homo sapiens
caaagaaaccugcagauga

SEQ ID NO: 69996 - RNA, 19 nt, Homo sapiens
ggaagcagauccagaagau

SEQ ID NO: 69997 - RNA, 19 nt, Homo sapiens
gaagccaccuacaaagaaa

SEQ ID NO: 69998 - RNA, 19 nt, Homo sapiens
aaacaauuccuccugauua

SEQ ID NO: 69999 - RNA, 19 nt, Homo sapiens
guaaagagaaaccaucuaa

SEQ ID NO: 70000 - RNA, 19 nt, Homo sapiens
uagcaaauuucgagcauaa

SEQ ID NO: 70001 - RNA, 19 nt, Homo sapiens
ggagaaggccaaagaagaa

SEQ ID NO: 70002 - RNA, 19 nt, Homo sapiens
ggagagaaagcuuuauauu

SEQ ID NO: 70003 - RNA, 19 nt, Homo sapiens
gaaaaccugugauggauaa

SEQ ID NO: 70004 - RNA, 19 nt, Homo sapiens
caaaaugcuucaucucuua

SEQ ID NO: 70005 - RNA, 19 nt, Homo sapiens
gcugguggauggugacuuu

SEQ ID NO: 70006 - RNA, 19 nt, Homo sapiens
acaaaccaauggaagauaa

SEQ ID NO: 70007 - RNA, 19 nt, Homo sapiens
gaacagcuuccacccauga

SEQ ID NO: 70008 - RNA, 19 nt, Homo sapiens
gaaacaaucccaucugagu

SEQ ID NO: 70009 - RNA, 19 nt, Homo sapiens
gauaaguccuuguguagca

SEQ ID NO: 70010 - RNA, 19 nt, Homo sapiens
gaaacaauuccuccugauu

SEQ ID NO: 70011 - RNA, 19 nt, Homo sapiens
agaaagagaugacacuauc

SEQ ID NO: 70012 - RNA, 19 nt, Homo sapiens
uuagauaaguccuugugua

SEQ ID NO: 70013 - RNA, 19 nt, Homo sapiens
uaaacucucugacagucua

SEQ ID NO: 70014 - RNA, 19 nt, Homo sapiens
acagaaaccucacagaaca

SEQ ID NO: 70015 - RNA, 19 nt, Homo sapiens
gaacaaaccaauggaagau

SEQ ID NO: 70016 - RNA, 19 nt, Homo sapiens
ggacaggacaaaccaguga

SEQ ID NO: 70017 - RNA, 19 nt, Homo sapiens
gagacaagcuuggagaaag

SEQ ID NO: 70018 - RNA, 19 nt, Homo sapiens
ggucaaggauaaagaugga

SEQ ID NO: 70019 - RNA, 19 nt, Homo sapiens
ucucugaacauccuaaaua

SEQ ID NO: 70020 - RNA, 19 nt, Homo sapiens
caaguuaagguaucuggua

SEQ ID NO: 70021 - RNA, 19 nt, Homo sapiens
gcaaauuucgagcauaaga

SEQ ID NO: 70022 - RNA, 19 nt, Homo sapiens
gccaaaagaugacuaaaga

SEQ ID NO: 70023 - RNA, 19 nt, Homo sapiens
ccaaagcaccuaagaaugg

SEQ ID NO: 70024 - RNA, 19 nt, Homo sapiens
ugucggaccuccaugugua

SEQ ID NO: 70025 - RNA, 19 nt, Homo sapiens
ugaccggucugaauguaaa

SEQ ID NO: 70026 - RNA, 19 nt, Homo sapiens
agacaagcuuggagaaaga

SEQ ID NO: 70027 - RNA, 19 nt, Homo sapiens
caaagaagaagaccgugaa

SEQ ID NO: 70028 - RNA, 19 nt, Homo sapiens
gcaaagacaacagaggaaa

SEQ ID NO: 70029 - RNA, 19 nt, Homo sapiens
aaagaaaccugcagaugac

SEQ ID NO: 70030 - RNA, 19 nt, Homo sapiens
caauuguucugggugauuu

SEQ ID NO: 70031 - RNA, 19 nt, Homo sapiens
ucugguaucugcauguaaa

SEQ ID NO: 70032 - RNA, 19 nt, Homo sapiens
gagaaagagaugacacuau

SEQ ID NO: 70033 - RNA, 19 nt, Homo sapiens
gaugaugccuuggauaaac

SEQ ID NO: 70034 - RNA, 19 nt, Homo sapiens
ggaccuccauguguaguau

SEQ ID NO: 70035 - RNA, 19 nt, Homo sapiens
gagaagcaguucguaucuu

SEQ ID NO: 70036 - RNA, 19 nt, Homo sapiens
cugaacauccuaaauauug

SEQ ID NO: 70037 - RNA, 19 nt, Homo sapiens
ugacaaagaccucgaugau

SEQ ID NO: 70038 - RNA, 19 nt, Homo sapiens
gugaaaagcuuggugaaaa

SEQ ID NO: 70039 - RNA, 19 nt, Homo sapiens
aaaggaagcagauccagaa

SEQ ID NO: 70040 - RNA, 19 nt, Homo sapiens
ggugauuucuagaaugguu

SEQ ID NO: 70041 - RNA, 19 nt, Homo sapiens
caaagcaccuaagaaugga

SEQ ID NO: 70042 - RNA, 19 nt, Homo sapiens
cuacagaaaccucacagaa

SEQ ID NO: 70043 - RNA, 19 nt, Homo sapiens
gaccuccgcucaauuaagg

SEQ ID NO: 70044 - RNA, 19 nt, Homo sapiens
cgugauaccucgagugaca

SEQ ID NO: 70045 - RNA, 19 nt, Homo sapiens
uggauaaagucaaggagaa

SEQ ID NO: 70046 - RNA, 19 nt, Homo sapiens
guccuuguguagcaaauuu

SEQ ID NO: 70047 - RNA, 19 nt, Homo sapiens
gauggugacuuuugaagaa

SEQ ID NO: 70048 - RNA, 19 nt, Homo sapiens
gaacacagcaaaggauaag

SEQ ID NO: 70049 - RNA, 19 nt, Homo sapiens
ucaaggagaaggccaaaga

SEQ ID NO: 70050 - RNA, 19 nt, Homo sapiens
gccagaugaugcuguagaa

SEQ ID NO: 70051 - RNA, 19 nt, Homo sapiens
guagcaaauuucgagcaua

SEQ ID NO: 70052 - RNA, 19 nt, Homo sapiens
ggagguaaagcgaaggauu

SEQ ID NO: 70053 - RNA, 19 nt, Homo sapiens
ggagaaagagaugacacua

SEQ ID NO: 70054 - RNA, 19 nt, Homo sapiens
aaacaaucccaucugagua

SEQ ID NO: 70055 - RNA, 19 nt, Homo sapiens
cauccuaaauauugguuug

SEQ ID NO: 70056 - RNA, 19 nt, Homo sapiens
gcgaaggauucagcaaaga

SEQ ID NO: 70057 - RNA, 19 nt, Homo sapiens
caaaggauaagugcaagaa

SEQ ID NO: 70058 - RNA, 19 nt, Homo sapiens
caagagaagcaguucguau

SEQ ID NO: 70059 - RNA, 19 nt, Homo sapiens
gaacacacugagacuugaa

SEQ ID NO: 70060 - RNA, 19 nt, Homo sapiens
gagguaaagcgaaggauuc

SEQ ID NO: 70061 - RNA, 19 nt, Homo sapiens
uaucccaccugaauacaga

SEQ ID NO: 70062 - RNA, 19 nt, Homo sapiens
gaugagaacaaaccaaugg

SEQ ID NO: 70063 - RNA, 19 nt, Homo sapiens
ugacccagaugagaacaaa

SEQ ID NO: 70064 - RNA, 19 nt, Homo sapiens
auacagacaucuccuggau

SEQ ID NO: 70065 - RNA, 19 nt, Homo sapiens
gaaguguggugaggaugau

SEQ ID NO: 70066 - RNA, 19 nt, Homo sapiens
cagaacacacugagacuug

SEQ ID NO: 70067 - RNA, 19 nt, Homo sapiens
cagcaaaggauaagugcaa

SEQ ID NO: 70068 - RNA, 19 nt, Homo sapiens
ccaauggaagauaaaguaa

SEQ ID NO: 70069 - RNA, 19 nt, Homo sapiens
gcaagagaagcaguucgua

SEQ ID NO: 70070 - RNA, 19 nt, Homo sapiens
uaucugguaucugcaugua

SEQ ID NO: 70071 - RNA, 19 nt, Homo sapiens
cagaacacagcaaaggaua

SEQ ID NO: 70072 - RNA, 19 nt, Homo sapiens
ugaagccaccuacaaagaa

SEQ ID NO: 70073 - RNA, 19 nt, Homo sapiens
ggaagauaaaguaaaggaa

SEQ ID NO: 70074 - RNA, 19 nt, Homo sapiens
aacaauuccuccugauuau

SEQ ID NO: 70075 - RNA, 19 nt, Homo sapiens
caauuaaggaagucgauga

SEQ ID NO: 70076 - RNA, 19 nt, Homo sapiens
ggauaaagauggaaaacca

SEQ ID NO: 70077 - RNA, 19 nt, Homo sapiens
caaauuucgagcauaagaa

SEQ ID NO: 70078 - RNA, 19 nt, Homo sapiens
ugaggacuucugcaucuua

SEQ ID NO: 70079 - RNA, 19 nt, Homo sapiens
gggagagaaagcuuuauau

SEQ ID NO: 70080 - RNA, 19 nt, Homo sapiens
ugccaucucugaagugguu

SEQ ID NO: 70081 - RNA, 19 nt, Homo sapiens
gaaaccaucuaagccaacu

SEQ ID NO: 70082 - RNA, 19 nt, Homo sapiens
gacacuaucccaccugaau

SEQ ID NO: 70083 - RNA, 19 nt, Homo sapiens
ucgaugaugccuuggauaa

SEQ ID NO: 70084 - RNA, 19 nt, Homo sapiens
uaagaugggccaguuucua

SEQ ID NO: 70085 - RNA, 19 nt, Homo sapiens
gugaagccaccuacaaaga

SEQ ID NO: 70086 - RNA, 19 nt, Homo sapiens
gaaggauucagcaaagaca

SEQ ID NO: 70087 - RNA, 19 nt, Homo sapiens
ucaaagaaaccugcagaug

SEQ ID NO: 70088 - RNA, 19 nt, Homo sapiens
gacaaagaccucgaugaug

SEQ ID NO: 70089 - RNA, 19 nt, Homo sapiens
gaagaggucaaggauaaag

SEQ ID NO: 70090 - RNA, 19 nt, Homo sapiens
gauuagaagaggucaagga

SEQ ID NO: 70091 - RNA, 19 nt, Homo sapiens
caauuccuccugauuauag

SEQ ID NO: 70092 - RNA, 19 nt, Homo sapiens
uagaagaggucaaggauaa

SEQ ID NO: 70093 - RNA, 19 nt, Homo sapiens
ugaagaaacugaagaagaa

SEQ ID NO: 70094 - RNA, 19 nt, Homo sapiens
caacagaaccaaagacuaa

SEQ ID NO: 70095 - RNA, 19 nt, Homo sapiens
uaacgaugcucacaauaaa

SEQ ID NO: 70096 - RNA, 19 nt, Homo sapiens
gaaagccacuccugccaaa

SEQ ID NO: 70097 - RNA, 19 nt, Homo sapiens
caaagaaaccugcagauga

SEQ ID NO: 70098 - RNA, 19 nt, Homo sapiens
ggaagcagauccagaagau

SEQ ID NO: 70099 - RNA, 19 nt, Homo sapiens
aaagaaagguggagaagga

SEQ ID NO: 70100 - RNA, 19 nt, Homo sapiens
gaagccaccuacaaagaaa

SEQ ID NO: 70101 - RNA, 19 nt, Homo sapiens
aaacaauuccuccugauua

SEQ ID NO: 70102 - RNA, 19 nt, Homo sapiens
guaaagagaaaccaucuaa

SEQ ID NO: 70103 - RNA, 19 nt, Homo sapiens
ggagaaggccaaagaagaa

SEQ ID NO: 70104 - RNA, 19 nt, Homo sapiens
gaaaaccugugauggauaa

SEQ ID NO: 70105 - RNA, 19 nt, Homo sapiens
guaacgaugcucacaauaa

SEQ ID NO: 70106 - RNA, 19 nt, Homo sapiens
caaaaugcuucaucucuua

SEQ ID NO: 70107 - RNA, 19 nt, Homo sapiens
gaacagcagccaucagaga

SEQ ID NO: 70108 - RNA, 19 nt, Homo sapiens
gcugguggauggugacuuu

SEQ ID NO: 70109 - RNA, 19 nt, Homo sapiens
acaaaccaauggaagauaa

SEQ ID NO: 70110 - RNA, 19 nt, Homo sapiens
gaacagcuuccacccauga

SEQ ID NO: 70111 - RNA, 19 nt, Homo sapiens
gaaacaaucccaucugagu

SEQ ID NO: 70112 - RNA, 19 nt, Homo sapiens
gaaacaauuccuccugauu

SEQ ID NO: 70113 - RNA, 19 nt, Homo sapiens
ggagaaggauacaaugagu

SEQ ID NO: 70114 - RNA, 19 nt, Homo sapiens
agaaagagaugacacuauc

SEQ ID NO: 70115 - RNA, 19 nt, Homo sapiens
uaaacucucugacagucua

SEQ ID NO: 70116 - RNA, 19 nt, Homo sapiens
acagaaaccucacagaaca

SEQ ID NO: 70117 - RNA, 19 nt, Homo sapiens
gaacaaaccaauggaagau

SEQ ID NO: 70118 - RNA, 19 nt, Homo sapiens
agaggaaucuacagaaguu

SEQ ID NO: 70119 - RNA, 19 nt, Homo sapiens
gagagaguguugcugguau

SEQ ID NO: 70120 - RNA, 19 nt, Homo sapiens
gaaaucaacagaaccaaag

SEQ ID NO: 70121 - RNA, 19 nt, Homo sapiens
ggacaggacaaaccaguga

SEQ ID NO: 70122 - RNA, 19 nt, Homo sapiens
gagacaagcuuggagaaag

SEQ ID NO: 70123 - RNA, 19 nt, Homo sapiens
ggucaaggauaaagaugga

SEQ ID NO: 70124 - RNA, 19 nt, Homo sapiens
ugucuucuauuccacuuua

SEQ ID NO: 70125 - RNA, 19 nt, Homo sapiens
ucucugaacauccuaaaua

SEQ ID NO: 70126 - RNA, 19 nt, Homo sapiens
caaguuaagguaucuggua

SEQ ID NO: 70127 - RNA, 19 nt, Homo sapiens
ccaccuacauagaggaauu

SEQ ID NO: 70128 - RNA, 19 nt, Homo sapiens
ggcaaaagcuaaagaagaa

SEQ ID NO: 70129 - RNA, 19 nt, Homo sapiens
gauaaaccaucgggaaagu

SEQ ID NO: 70130 - RNA, 19 nt, Homo sapiens
gccaaaagaugacuaaaga

SEQ ID NO: 70131 - RNA, 19 nt, Homo sapiens
ccaaagcaccuaagaaugg

SEQ ID NO: 70132 - RNA, 19 nt, Homo sapiens
ugucggaccuccaugugua

SEQ ID NO: 70133 - RNA, 19 nt, Homo sapiens
ugaccggucugaauguaaa

SEQ ID NO: 70134 - RNA, 19 nt, Homo sapiens
gcagcuaaguggaaguugu

SEQ ID NO: 70135 - RNA, 19 nt, Homo sapiens
agacaagcuuggagaaaga

SEQ ID NO: 70136 - RNA, 19 nt, Homo sapiens
caaagaagaagaccgugaa

SEQ ID NO: 70137 - RNA, 19 nt, Homo sapiens
acuauuggcuaaacccaua

SEQ ID NO: 70138 - RNA, 19 nt, Homo sapiens
gcaaagacaacagaggaaa

SEQ ID NO: 70139 - RNA, 19 nt, Homo sapiens
aaagaaaccugcagaugac

SEQ ID NO: 70140 - RNA, 19 nt, Homo sapiens
ccaaugaguuccaccuaca

SEQ ID NO: 70141 - RNA, 19 nt, Homo sapiens
caauuguucugggugauuu

SEQ ID NO: 70142 - RNA, 19 nt, Homo sapiens
ucugguaucugcauguaaa

SEQ ID NO: 70143 - RNA, 19 nt, Homo sapiens
gagaaagagaugacacuau

SEQ ID NO: 70144 - RNA, 19 nt, Homo sapiens
gaugaugccuuggauaaac

SEQ ID NO: 70145 - RNA, 19 nt, Homo sapiens
ggaccuccauguguaguau

SEQ ID NO: 70146 - RNA, 19 nt, Homo sapiens
gaaguaacgaugcucacaa

SEQ ID NO: 70147 - RNA, 19 nt, Homo sapiens
cugaacauccuaaauauug

SEQ ID NO: 70148 - RNA, 19 nt, Homo sapiens
ugacaaagaccucgaugau

SEQ ID NO: 70149 - RNA, 19 nt, Homo sapiens
gugaaaagcuuggugaaaa

SEQ ID NO: 70150 - RNA, 19 nt, Homo sapiens
aaaggaagcagauccagaa

SEQ ID NO: 70151 - RNA, 19 nt, Homo sapiens
caagccgggugacaagaaa

SEQ ID NO: 70152 - RNA, 19 nt, Homo sapiens
ggugauuucuagaaugguu

SEQ ID NO: 70153 - RNA, 19 nt, Homo sapiens
caaagcaccuaagaaugga

SEQ ID NO: 70154 - RNA, 19 nt, Homo sapiens
cuacagaaaccucacagaa

SEQ ID NO: 70155 - RNA, 19 nt, Homo sapiens
uggauaaagucaaggagaa

SEQ ID NO: 70156 - RNA, 19 nt, Homo sapiens
gaccuccgcucaauuaagg

SEQ ID NO: 70157 - RNA, 19 nt, Homo sapiens
ggagagaguguugcuggua

SEQ ID NO: 70158 - RNA, 19 nt, Homo sapiens
ucagagaaaucaacagaac

SEQ ID NO: 70159 - RNA, 19 nt, Homo sapiens
gauggugacuuuugaagaa

SEQ ID NO: 70160 - RNA, 19 nt, Homo sapiens
gaacacagcaaaggauaag

SEQ ID NO: 70161 - RNA, 19 nt, Homo sapiens
ucaaggagaaggccaaaga

SEQ ID NO: 70162 - RNA, 19 nt, Homo sapiens
gccagaugaugcuguagaa

SEQ ID NO: 70163 - RNA, 19 nt, Homo sapiens
aaagaggaaucuacagaag

SEQ ID NO: 70164 - RNA, 19 nt, Homo sapiens
ggaauuggguaaaagagaa

SEQ ID NO: 70165 - RNA, 19 nt, Homo sapiens
ggagguaaagcgaaggauu

SEQ ID NO: 70166 - RNA, 19 nt, Homo sapiens
ggagaaagagaugacacua

SEQ ID NO: 70167 - RNA, 19 nt, Homo sapiens
aaacaaucccaucugagua

SEQ ID NO: 70168 - RNA, 19 nt, Homo sapiens
cauccuaaauauugguuug

SEQ ID NO: 70169 - RNA, 19 nt, Homo sapiens
gcgaaggauucagcaaaga

SEQ ID NO: 70170 - RNA, 19 nt, Homo sapiens
caaaggauaagugcaagaa

SEQ ID NO: 70171 - RNA, 19 nt, Homo sapiens
gaagaaacugaagaagaaa

SEQ ID NO: 70172 - RNA, 19 nt, Homo sapiens
gagguaaagcgaaggauuc

SEQ ID NO: 70173 - RNA, 19 nt, Homo sapiens
uaucccaccugaauacaga

SEQ ID NO: 70174 - RNA, 19 nt, Homo sapiens
gaugagaacaaaccaaugg

SEQ ID NO: 70175 - RNA, 19 nt, Homo sapiens
ugacccagaugagaacaaa

SEQ ID NO: 70176 - RNA, 19 nt, Homo sapiens
ugcuuuggaugacuuaaua

SEQ ID NO: 70177 - RNA, 19 nt, Homo sapiens
gcaagccgggugacaagaa

SEQ ID NO: 70178 - RNA, 19 nt, Homo sapiens
auacagacaucuccuggau

SEQ ID NO: 70179 - RNA, 19 nt, Homo sapiens
gaaguguggugaggaugau

SEQ ID NO: 70180 - RNA, 19 nt, Homo sapiens
ggaagucgaugaggcaaaa

SEQ ID NO: 70181 - RNA, 19 nt, Homo sapiens
cagcaaaggauaagugcaa

SEQ ID NO: 70182 - RNA, 19 nt, Homo sapiens
ccaauggaagauaaaguaa

SEQ ID NO: 70183 - RNA, 19 nt, Homo sapiens
gaaguuucagauccaauga

SEQ ID NO: 70184 - RNA, 19 nt, Homo sapiens
caucagagaaaucaacaga

SEQ ID NO: 70185 - RNA, 19 nt, Homo sapiens
uaucugguaucugcaugua

SEQ ID NO: 70186 - RNA, 19 nt, Homo sapiens
cagaacacagcaaaggaua

SEQ ID NO: 70187 - RNA, 19 nt, Homo sapiens
ugaagccaccuacaaagaa

SEQ ID NO: 70188 - RNA, 19 nt, Homo sapiens
ggaagauaaaguaaaggaa

SEQ ID NO: 70189 - RNA, 19 nt, Homo sapiens
aacaauuccuccugauuau

SEQ ID NO: 70190 - RNA, 19 nt, Homo sapiens
caucagauacaggaaguaa

SEQ ID NO: 70191 - RNA, 19 nt, Homo sapiens
ggauaaagauggaaaacca

SEQ ID NO: 70192 - RNA, 19 nt, Homo sapiens
cauaacagcugcaucauug

SEQ ID NO: 70193 - RNA, 19 nt, Homo sapiens
ggagauggaucaaagaaga

SEQ ID NO: 70194 - RNA, 19 nt, Homo sapiens
gaaguacgcugaacgagau

SEQ ID NO: 70195 - RNA, 19 nt, Homo sapiens
ggagugauccucauaaaga

SEQ ID NO: 70196 - RNA, 19 nt, Homo sapiens
caaaggauaucgucaaugg

SEQ ID NO: 70197 - RNA, 19 nt, Homo sapiens
aagaagcucugaagaauga

SEQ ID NO: 70198 - RNA, 19 nt, Homo sapiens
gagacaagguggugggaaa

SEQ ID NO: 70199 - RNA, 19 nt, Homo sapiens
aaagaaggcuggagaugga

SEQ ID NO: 70200 - RNA, 19 nt, Homo sapiens
ccagacagauggagaagga

SEQ ID NO: 70201 - RNA, 19 nt, Homo sapiens
acaagaagcucugaagaau

SEQ ID NO: 70202 - RNA, 19 nt, Homo sapiens
gaucuccugucuucuguug

SEQ ID NO: 70203 - RNA, 19 nt, Homo sapiens
gagugauccucauaaagaa

SEQ ID NO: 70204 - RNA, 19 nt, Homo sapiens
ucacauaacagcugcauca

SEQ ID NO: 70205 - RNA, 19 nt, Homo sapiens
ugaacgagaucuacuuugg

SEQ ID NO: 70206 - RNA, 19 nt, Homo sapiens
gccgugcacucguuagauu

SEQ ID NO: 70207 - RNA, 19 nt, Homo sapiens
gguggaggcuuugaagaga

SEQ ID NO: 70208 - RNA, 19 nt, Homo sapiens
ucaaugggcugaggucugu

SEQ ID NO: 70209 - RNA, 19 nt, Homo sapiens
gaacgagaucuacuuugga

SEQ ID NO: 70210 - RNA, 19 nt, Homo sapiens
uagaggacauggaaaauaa

SEQ ID NO: 70211 - RNA, 19 nt, Homo sapiens
acaaugccuuugaccagua

SEQ ID NO: 70212 - RNA, 19 nt, Homo sapiens
gcaccgcccauuacaaguu

SEQ ID NO: 70213 - RNA, 19 nt, Homo sapiens
aaacaaaggauaucgucaa

SEQ ID NO: 70214 - RNA, 19 nt, Homo sapiens
caccauggaguaacaagua

SEQ ID NO: 70215 - RNA, 19 nt, Homo sapiens
ggacugugccuuggaccua

SEQ ID NO: 70216 - RNA, 19 nt, Homo sapiens
gaagguggcgucucaucug

SEQ ID NO: 70217 - RNA, 19 nt, Homo sapiens
ccauagagaccgugugguu

SEQ ID NO: 70218 - RNA, 19 nt, Homo sapiens
aacgagaucuacuuuggaa

SEQ ID NO: 70219 - RNA, 19 nt, Homo sapiens
gcugaacgagaucuacuuu

SEQ ID NO: 70220 - RNA, 19 nt, Homo sapiens
caagaagcucugaagaaug

SEQ ID NO: 70221 - RNA, 19 nt, Homo sapiens
aaacaagaagcucugaaga

SEQ ID NO: 70222 - RNA, 19 nt, Homo sapiens
ggaagccaacaaugccuuu

SEQ ID NO: 70223 - RNA, 19 nt, Homo sapiens
gaagagaaagcagcaaugc

SEQ ID NO: 70224 - RNA, 19 nt, Homo sapiens
ucguuagauuccuuucuua

SEQ ID NO: 70225 - RNA, 19 nt, Homo sapiens
gcagacaaaucaaaacaag

SEQ ID NO: 70226 - RNA, 19 nt, Homo sapiens
ggagguggaagccaacaau

SEQ ID NO: 70227 - RNA, 19 nt, Homo sapiens
aacaagaagcucugaagaa

SEQ ID NO: 70228 - RNA, 19 nt, Homo sapiens
aacaaaggauaucgucaau

SEQ ID NO: 70229 - RNA, 19 nt, Homo sapiens
gacugugccuuggaccuaa

SEQ ID NO: 70230 - RNA, 19 nt, Homo sapiens
gcacucguuagauuccuuu

SEQ ID NO: 70231 - RNA, 19 nt, Homo sapiens
guggaggcuuugaagagaa

SEQ ID NO: 70232 - RNA, 19 nt, Homo sapiens
gagaaggaugaaacuguga

SEQ ID NO: 70233 - RNA, 19 nt, Homo sapiens
cuggagugauccucauaaa

SEQ ID NO: 70234 - RNA, 19 nt, Homo sapiens
caaugccuuugaccaguau

SEQ ID NO: 70235 - RNA, 19 nt, Homo sapiens
cccgacaggucacauaaca

SEQ ID NO: 70236 - RNA, 19 nt, Homo sapiens
uggaggcuuugaagagaaa

SEQ ID NO: 70237 - RNA, 19 nt, Homo sapiens
ugguagaagugcaggagaa

SEQ ID NO: 70238 - RNA, 19 nt, Homo sapiens
aucaaaggcugcugggauu

SEQ ID NO: 70239 - RNA, 19 nt, Homo sapiens
cauagagaccgugugguuu

SEQ ID NO: 70240 - RNA, 19 nt, Homo sapiens
guuagauuccuuucuuaga

SEQ ID NO: 70241 - RNA, 19 nt, Homo sapiens
ggcuggagauggaucaaag

SEQ ID NO: 70242 - RNA, 19 nt, Homo sapiens
gcuggagugauccucauaa

SEQ ID NO: 70243 - RNA, 19 nt, Homo sapiens
caccgcccauuacaaguug

SEQ ID NO: 70244 - RNA, 19 nt, Homo sapiens
aggauuaccuuuuguguga

SEQ ID NO: 70245 - RNA, 19 nt, Homo sapiens
cauggaguaacaaguauga

SEQ ID NO: 70246 - RNA, 19 nt, Homo sapiens
gcaaugcuaaaccucuguu

SEQ ID NO: 70247 - RNA, 19 nt, Homo sapiens
gaaaauugccagagacaag

SEQ ID NO: 70248 - RNA, 19 nt, Homo sapiens
uagaagugcaggagaaauc

SEQ ID NO: 70249 - RNA, 19 nt, Homo sapiens
gguagaagugcaggagaaa

SEQ ID NO: 70250 - RNA, 19 nt, Homo sapiens
uggcuuugcuggagugauc

SEQ ID NO: 70251 - RNA, 19 nt, Homo sapiens
ggacauggaaaauaaaauc

SEQ ID NO: 70252 - RNA, 19 nt, Homo sapiens
guagaggacauggaaaaua

SEQ ID NO: 70253 - RNA, 19 nt, Homo sapiens
gacagauggagaaggauga

SEQ ID NO: 70254 - RNA, 19 nt, Homo sapiens
gguggcgucucaucugucu

SEQ ID NO: 70255 - RNA, 19 nt, Homo sapiens
cucagucucuccacauuuc

SEQ ID NO: 70256 - RNA, 19 nt, Homo sapiens
aggaugaaacugugaguga

SEQ ID NO: 70257 - RNA, 19 nt, Homo sapiens
acauaacagcugcaucauu

SEQ ID NO: 70258 - RNA, 19 nt, Homo sapiens
cucguuagauuccuuucuu

SEQ ID NO: 70259 - RNA, 19 nt, Homo sapiens
gaaggcuggagauggauca

SEQ ID NO: 70260 - RNA, 19 nt, Homo sapiens
ugacugcuccccacacaua

SEQ ID NO: 70261 - RNA, 19 nt, Homo sapiens
gagauggaucaaagaagau

SEQ ID NO: 70262 - RNA, 19 nt, Homo sapiens
acaagguggugggaaagga

SEQ ID NO: 70263 - RNA, 19 nt, Homo sapiens
ugaagagaaagcagcaaug

SEQ ID NO: 70264 - RNA, 19 nt, Homo sapiens
uccuauaggucaccaugga

SEQ ID NO: 70265 - RNA, 19 nt, Homo sapiens
gaccagccacugaaaauug

SEQ ID NO: 70266 - RNA, 19 nt, Homo sapiens
gaaggaugaaacugugagu

SEQ ID NO: 70267 - RNA, 19 nt, Homo sapiens
gagguggaagccaacaaug

SEQ ID NO: 70268 - RNA, 19 nt, Homo sapiens
guacgcugaacgagaucua

SEQ ID NO: 70269 - RNA, 19 nt, Homo sapiens
uggagaaggaugaaacugu

SEQ ID NO: 70270 - RNA, 19 nt, Homo sapiens
uauaggucaccauggagua

SEQ ID NO: 70271 - RNA, 19 nt, Homo sapiens
gauggggacuccuauaggu

SEQ ID NO: 70272 - RNA, 19 nt, Homo sapiens
cuccacauuuccauagaga

SEQ ID NO: 70273 - RNA, 19 nt, Homo sapiens
cgagaucuacuuuggaaaa

SEQ ID NO: 70274 - RNA, 19 nt, Homo sapiens
gaagccaacaaugccuuug

SEQ ID NO: 70275 - RNA, 19 nt, Homo sapiens
ccugguagaggacauggaa

SEQ ID NO: 70276 - RNA, 19 nt, Homo sapiens
cauaaagaaggcuggagau

SEQ ID NO: 70277 - RNA, 19 nt, Homo sapiens
gaagaguguugaaggauua

SEQ ID NO: 70278 - RNA, 19 nt, Homo sapiens
gcaaagagcucagcaaagg

SEQ ID NO: 70279 - RNA, 19 nt, Homo sapiens
ggacaacgguuacggcuau

SEQ ID NO: 70280 - RNA, 19 nt, Homo sapiens
aagcagaacugaauaagaa

SEQ ID NO: 70281 - RNA, 19 nt, Homo sapiens
cgacaaauacuccaaguuu

SEQ ID NO: 70282 - RNA, 19 nt, Homo sapiens
gaagacagcaauucacaaa

SEQ ID NO: 70283 - RNA, 19 nt, Homo sapiens
caaugggucugucuacuuu

SEQ ID NO: 70284 - RNA, 19 nt, Homo sapiens
gcaugaacauuacggauau

SEQ ID NO: 70285 - RNA, 19 nt, Homo sapiens
agacagaaacaccuuauua

SEQ ID NO: 70286 - RNA, 19 nt, Homo sapiens
cauuaaagaugccuugaaa

SEQ ID NO: 70287 - RNA, 19 nt, Homo sapiens
agucagcgcuucaauauga

SEQ ID NO: 70288 - RNA, 19 nt, Homo sapiens
ucagaaagcccuucaagaa

SEQ ID NO: 70289 - RNA, 19 nt, Homo sapiens
gguccuaaauuaagaguug

SEQ ID NO: 70290 - RNA, 19 nt, Homo sapiens
gacagaaacaccuuauuaa

SEQ ID NO: 70291 - RNA, 19 nt, Homo sapiens
gcaaagggcaagccaagaa

SEQ ID NO: 70292 - RNA, 19 nt, Homo sapiens
gaagaagcagaacugaaua

SEQ ID NO: 70293 - RNA, 19 nt, Homo sapiens
ggagucagcgcuucaauau

SEQ ID NO: 70294 - RNA, 19 nt, Homo sapiens
ccaaggauuugcucucuga

SEQ ID NO: 70295 - RNA, 19 nt, Homo sapiens
uaagaguuguguucaugua

SEQ ID NO: 70296 - RNA, 19 nt, Homo sapiens
ggaagaagccaaggauuug

SEQ ID NO: 70297 - RNA, 19 nt, Homo sapiens
gagaagcucuacaaggaau

SEQ ID NO: 70298 - RNA, 19 nt, Homo sapiens
ccacagagccacuugagaa

SEQ ID NO: 70299 - RNA, 19 nt, Homo sapiens
gaccacggaucccgauaaa

SEQ ID NO: 70300 - RNA, 19 nt, Homo sapiens
ggaaggacacccuggacua

SEQ ID NO: 70301 - RNA, 19 nt, Homo sapiens
gcaaagcuggccaagauga

SEQ ID NO: 70302 - RNA, 19 nt, Homo sapiens
ggaggaaacaggaacaaga

SEQ ID NO: 70303 - RNA, 19 nt, Homo sapiens
gggcuucgauggacauuca

SEQ ID NO: 70304 - RNA, 19 nt, Homo sapiens
ggauauugaugacaagauc

SEQ ID NO: 70305 - RNA, 19 nt, Homo sapiens
gaacauuacggauauugau

SEQ ID NO: 70306 - RNA, 19 nt, Homo sapiens
aggagaagcucuacaagga

SEQ ID NO: 70307 - RNA, 19 nt, Homo sapiens
gaaggagugcggaagauug

SEQ ID NO: 70308 - RNA, 19 nt, Homo sapiens
cauggaagcucugaauguu

SEQ ID NO: 70309 - RNA, 19 nt, Homo sapiens
caugcagacuccaccuuua

SEQ ID NO: 70310 - RNA, 19 nt, Homo sapiens
gaagcagaacugaauaaga

SEQ ID NO: 70311 - RNA, 19 nt, Homo sapiens
gaggaaacaggaacaagaa

SEQ ID NO: 70312 - RNA, 19 nt, Homo sapiens
gcagaccgccugagugaga

SEQ ID NO: 70313 - RNA, 19 nt, Homo sapiens
ucuccaagcugcccaaguu

SEQ ID NO: 70314 - RNA, 19 nt, Homo sapiens
ccagugagauguucuuguc

SEQ ID NO: 70315 - RNA, 19 nt, Homo sapiens
ugagaagaguguugaagga

SEQ ID NO: 70316 - RNA, 19 nt, Homo sapiens
caacgacuuugccuuaugg

SEQ ID NO: 70317 - RNA, 19 nt, Homo sapiens
gggcaaagagcucagcaaa

SEQ ID NO: 70318 - RNA, 19 nt, Homo sapiens
gugaguaugugccagaaau

SEQ ID NO: 70319 - RNA, 19 nt, Homo sapiens
uuacggauauugaugacaa

SEQ ID NO: 70320 - RNA, 19 nt, Homo sapiens
ggaaagccgugaggaagag

SEQ ID NO: 70321 - RNA, 19 nt, Homo sapiens
gaagaagaagcagaacuga

SEQ ID NO: 70322 - RNA, 19 nt, Homo sapiens
gccagaaauugugaacuuu

SEQ ID NO: 70323 - RNA, 19 nt, Homo sapiens
agaagaguguugaaggauu

SEQ ID NO: 70324 - RNA, 19 nt, Homo sapiens
gagaaggagugcggaagau

SEQ ID NO: 70325 - RNA, 19 nt, Homo sapiens
acacuuggcugugauguca

SEQ ID NO: 70326 - RNA, 19 nt, Homo sapiens
ugaaacugguagacagaaa

SEQ ID NO: 70327 - RNA, 19 nt, Homo sapiens
agaagaagcagaacugaau

SEQ ID NO: 70328 - RNA, 19 nt, Homo sapiens
gaaguucuugaaugaguuu

SEQ ID NO: 70329 - RNA, 19 nt, Homo sapiens
gcacucagcacggcaguug

SEQ ID NO: 70330 - RNA, 19 nt, Homo sapiens
cagaaauugugaacuuugu

SEQ ID NO: 70331 - RNA, 19 nt, Homo sapiens
gcagauggcccagaaugga

SEQ ID NO: 70332 - RNA, 19 nt, Homo sapiens
ccaacgacuuugccuuaug

SEQ ID NO: 70333 - RNA, 19 nt, Homo sapiens
gcgagaagcacuccuaugg

SEQ ID NO: 70334 - RNA, 19 nt, Homo sapiens
gggucugucuacuuugaua

SEQ ID NO: 70335 - RNA, 19 nt, Homo sapiens
gaacuuuguccagaagauu

SEQ ID NO: 70336 - RNA, 19 nt, Homo sapiens
uggaagaagccaaggauuu

SEQ ID NO: 70337 - RNA, 19 nt, Homo sapiens
gaaacaggaacaagaagca

SEQ ID NO: 70338 - RNA, 19 nt, Homo sapiens
gggagaagaagaagcagaa

SEQ ID NO: 70339 - RNA, 19 nt, Homo sapiens
gcucugagacauugauaau

SEQ ID NO: 70340 - RNA, 19 nt, Homo sapiens
ggagaagcucuacaaggaa

SEQ ID NO: 70341 - RNA, 19 nt, Homo sapiens
gaggagaagaggaagaaga

SEQ ID NO: 70342 - RNA, 19 nt, Homo sapiens
ugccagaaauugugaacuu

SEQ ID NO: 70343 - RNA, 19 nt, Homo sapiens
ccuaucauguuuacaguca

SEQ ID NO: 70344 - RNA, 19 nt, Homo sapiens
ucccagcgcuccuaucaug

SEQ ID NO: 70345 - RNA, 19 nt, Homo sapiens
gagaagaggaagaagaaag

SEQ ID NO: 70346 - RNA, 19 nt, Homo sapiens
acaauuccaucuucuccaa

SEQ ID NO: 70347 - RNA, 19 nt, Homo sapiens
cagugcagcuugccacaga

SEQ ID NO: 70348 - RNA, 19 nt, Homo sapiens
ggaacaagaagcagcaaag

SEQ ID NO: 70349 - RNA, 19 nt, Homo sapiens
gaagaggagaagaggaaga

SEQ ID NO: 70350 - RNA, 19 nt, Homo sapiens
uggagaacaucgcccugua

SEQ ID NO: 70351 - RNA, 19 nt, Homo sapiens
acaaagcccucugugacaa

SEQ ID NO: 70352 - RNA, 19 nt, Homo sapiens
gaucagaaagcccuucaag

SEQ ID NO: 70353 - RNA, 19 nt, Homo sapiens
acaacagccucaccaggaa

SEQ ID NO: 70354 - RNA, 19 nt, Homo sapiens
uuuaaaccauuguggacua

SEQ ID NO: 70355 - RNA, 19 nt, Homo sapiens
gcagaugcucgaacggauu

SEQ ID NO: 70356 - RNA, 19 nt, Homo sapiens
ucggaggccuacuuugaaa

SEQ ID NO: 70357 - RNA, 19 nt, Homo sapiens
ggacuuccacagagacaug

SEQ ID NO: 70358 - RNA, 19 nt, Homo sapiens
cagcgcuccuaucauguuu

SEQ ID NO: 70359 - RNA, 19 nt, Homo sapiens
ucacccauaugcugaagau

SEQ ID NO: 70360 - RNA, 19 nt, Homo sapiens
guagguucgugucgucguu

SEQ ID NO: 70361 - RNA, 19 nt, Homo sapiens
agaagaggaagaagaaaga

SEQ ID NO: 70362 - RNA, 19 nt, Homo sapiens
cuucagguguuaucagaau

SEQ ID NO: 70363 - RNA, 19 nt, Homo sapiens
agacagcaauucacaaagc

SEQ ID NO: 70364 - RNA, 19 nt, Homo sapiens
acaagaagacagcaauuca

SEQ ID NO: 70365 - RNA, 19 nt, Homo sapiens
ucccaacgacuuugccuua

SEQ ID NO: 70366 - RNA, 19 nt, Homo sapiens
gguagacagaaacaccuua

SEQ ID NO: 70367 - RNA, 19 nt, Homo sapiens
gcaccgucauggaagagau

SEQ ID NO: 70368 - RNA, 19 nt, Homo sapiens
gacaagaagacagcaauuc

SEQ ID NO: 70369 - RNA, 19 nt, Homo sapiens
gaacuuuuaugacaagaag

SEQ ID NO: 70370 - RNA, 19 nt, Homo sapiens
ccaaugggucugucuacuu

SEQ ID NO: 70371 - RNA, 19 nt, Homo sapiens
ccagaaauugugaacuuug

SEQ ID NO: 70372 - RNA, 19 nt, Homo sapiens
gaaguguucauaccucaag

SEQ ID NO: 70373 - RNA, 19 nt, Homo sapiens
cuacaucucuuuugauauc

SEQ ID NO: 70374 - RNA, 19 nt, Homo sapiens
gugagauguucuugucaga

SEQ ID NO: 70375 - RNA, 19 nt, Homo sapiens
gcgguugcaucagauucua

SEQ ID NO: 70376 - RNA, 19 nt, Homo sapiens
gaguaugugccagaaauug

SEQ ID NO: 70377 - RNA, 19 nt, Homo sapiens
gaagaguguugaaggauua

SEQ ID NO: 70378 - RNA, 19 nt, Homo sapiens
gcaaagagcucagcaaagg

SEQ ID NO: 70379 - RNA, 19 nt, Homo sapiens
ggacaacgguuacggcuau

SEQ ID NO: 70380 - RNA, 19 nt, Homo sapiens
aagcagaacugaauaagaa

SEQ ID NO: 70381 - RNA, 19 nt, Homo sapiens
cgacaaauacuccaaguuu

SEQ ID NO: 70382 - RNA, 19 nt, Homo sapiens
gaagacagcaauucacaaa

SEQ ID NO: 70383 - RNA, 19 nt, Homo sapiens
caaugggucugucuacuuu

SEQ ID NO: 70384 - RNA, 19 nt, Homo sapiens
gcaugaacauuacggauau

SEQ ID NO: 70385 - RNA, 19 nt, Homo sapiens
agacagaaacaccuuauua

SEQ ID NO: 70386 - RNA, 19 nt, Homo sapiens
cauuaaagaugccuugaaa

SEQ ID NO: 70387 - RNA, 19 nt, Homo sapiens
agucagcgcuucaauauga

SEQ ID NO: 70388 - RNA, 19 nt, Homo sapiens
ucagaaagcccuucaagaa

SEQ ID NO: 70389 - RNA, 19 nt, Homo sapiens
gguccuaaauuaagaguug

SEQ ID NO: 70390 - RNA, 19 nt, Homo sapiens
gacagaaacaccuuauuaa

SEQ ID NO: 70391 - RNA, 19 nt, Homo sapiens
gcaaagggcaagccaagaa

SEQ ID NO: 70392 - RNA, 19 nt, Homo sapiens
gaagaagcagaacugaaua

SEQ ID NO: 70393 - RNA, 19 nt, Homo sapiens
ggagucagcgcuucaauau

SEQ ID NO: 70394 - RNA, 19 nt, Homo sapiens
ccaaggauuugcucucuga

SEQ ID NO: 70395 - RNA, 19 nt, Homo sapiens
uaagaguuguguucaugua

SEQ ID NO: 70396 - RNA, 19 nt, Homo sapiens
ggaagaagccaaggauuug

SEQ ID NO: 70397 - RNA, 19 nt, Homo sapiens
gagaagcucuacaaggaau

SEQ ID NO: 70398 - RNA, 19 nt, Homo sapiens
ccacagagccacuugagaa

SEQ ID NO: 70399 - RNA, 19 nt, Homo sapiens
gaccacggaucccgauaaa

SEQ ID NO: 70400 - RNA, 19 nt, Homo sapiens
ggaaggacacccuggacua

SEQ ID NO: 70401 - RNA, 19 nt, Homo sapiens
gcaaagcuggccaagauga

SEQ ID NO: 70402 - RNA, 19 nt, Homo sapiens
ggaggaaacaggaacaaga

SEQ ID NO: 70403 - RNA, 19 nt, Homo sapiens
gggcuucgauggacauuca

SEQ ID NO: 70404 - RNA, 19 nt, Homo sapiens
ggauauugaugacaagauc

SEQ ID NO: 70405 - RNA, 19 nt, Homo sapiens
gaacauuacggauauugau

SEQ ID NO: 70406 - RNA, 19 nt, Homo sapiens
aggagaagcucuacaagga

SEQ ID NO: 70407 - RNA, 19 nt, Homo sapiens
gaaggagugcggaagauug

SEQ ID NO: 70408 - RNA, 19 nt, Homo sapiens
cauggaagcucugaauguu

SEQ ID NO: 70409 - RNA, 19 nt, Homo sapiens
caugcagacuccaccuuua

SEQ ID NO: 70410 - RNA, 19 nt, Homo sapiens
gaagcagaacugaauaaga

SEQ ID NO: 70411 - RNA, 19 nt, Homo sapiens
gaggaaacaggaacaagaa

SEQ ID NO: 70412 - RNA, 19 nt, Homo sapiens
gcagaccgccugagugaga

SEQ ID NO: 70413 - RNA, 19 nt, Homo sapiens
ucuccaagcugcccaaguu

SEQ ID NO: 70414 - RNA, 19 nt, Homo sapiens
ccagugagauguucuuguc

SEQ ID NO: 70415 - RNA, 19 nt, Homo sapiens
ugagaagaguguugaagga

SEQ ID NO: 70416 - RNA, 19 nt, Homo sapiens
caacgacuuugccuuaugg

SEQ ID NO: 70417 - RNA, 19 nt, Homo sapiens
gggcaaagagcucagcaaa

SEQ ID NO: 70418 - RNA, 19 nt, Homo sapiens
gugaguaugugccagaaau

SEQ ID NO: 70419 - RNA, 19 nt, Homo sapiens
uuacggauauugaugacaa

SEQ ID NO: 70420 - RNA, 19 nt, Homo sapiens
ggaaagccgugaggaagag

SEQ ID NO: 70421 - RNA, 19 nt, Homo sapiens
gaagaagaagcagaacuga

SEQ ID NO: 70422 - RNA, 19 nt, Homo sapiens
gccagaaauugugaacuuu

SEQ ID NO: 70423 - RNA, 19 nt, Homo sapiens
agaagaguguugaaggauu

SEQ ID NO: 70424 - RNA, 19 nt, Homo sapiens
gagaaggagugcggaagau

SEQ ID NO: 70425 - RNA, 19 nt, Homo sapiens
acacuuggcugugauguca

SEQ ID NO: 70426 - RNA, 19 nt, Homo sapiens
ugaaacugguagacagaaa

SEQ ID NO: 70427 - RNA, 19 nt, Homo sapiens
agaagaagcagaacugaau

SEQ ID NO: 70428 - RNA, 19 nt, Homo sapiens
gaaguucuugaaugaguuu

SEQ ID NO: 70429 - RNA, 19 nt, Homo sapiens
gcacucagcacggcaguug

SEQ ID NO: 70430 - RNA, 19 nt, Homo sapiens
cagaaauugugaacuuugu

SEQ ID NO: 70431 - RNA, 19 nt, Homo sapiens
gcagauggcccagaaugga

SEQ ID NO: 70432 - RNA, 19 nt, Homo sapiens
ccaacgacuuugccuuaug

SEQ ID NO: 70433 - RNA, 19 nt, Homo sapiens
gcgagaagcacuccuaugg

SEQ ID NO: 70434 - RNA, 19 nt, Homo sapiens
gggucugucuacuuugaua

SEQ ID NO: 70435 - RNA, 19 nt, Homo sapiens
gaacuuuguccagaagauu

SEQ ID NO: 70436 - RNA, 19 nt, Homo sapiens
uggaagaagccaaggauuu

SEQ ID NO: 70437 - RNA, 19 nt, Homo sapiens
gaaacaggaacaagaagca

SEQ ID NO: 70438 - RNA, 19 nt, Homo sapiens
gggagaagaagaagcagaa

SEQ ID NO: 70439 - RNA, 19 nt, Homo sapiens
gcucugagacauugauaau

SEQ ID NO: 70440 - RNA, 19 nt, Homo sapiens
ggagaagcucuacaaggaa

SEQ ID NO: 70441 - RNA, 19 nt, Homo sapiens
gaggagaagaggaagaaga

SEQ ID NO: 70442 - RNA, 19 nt, Homo sapiens
ugccagaaauugugaacuu

SEQ ID NO: 70443 - RNA, 19 nt, Homo sapiens
ccuaucauguuuacaguca

SEQ ID NO: 70444 - RNA, 19 nt, Homo sapiens
ucccagcgcuccuaucaug

SEQ ID NO: 70445 - RNA, 19 nt, Homo sapiens
gagaagaggaagaagaaag

SEQ ID NO: 70446 - RNA, 19 nt, Homo sapiens
acaauuccaucuucuccaa

SEQ ID NO: 70447 - RNA, 19 nt, Homo sapiens
cagugcagcuugccacaga

SEQ ID NO: 70448 - RNA, 19 nt, Homo sapiens
ggaacaagaagcagcaaag

SEQ ID NO: 70449 - RNA, 19 nt, Homo sapiens
gaagaggagaagaggaaga

SEQ ID NO: 70450 - RNA, 19 nt, Homo sapiens
uggagaacaucgcccugua

SEQ ID NO: 70451 - RNA, 19 nt, Homo sapiens
acaaagcccucugugacaa

SEQ ID NO: 70452 - RNA, 19 nt, Homo sapiens
gaucagaaagcccuucaag

SEQ ID NO: 70453 - RNA, 19 nt, Homo sapiens
acaacagccucaccaggaa

SEQ ID NO: 70454 - RNA, 19 nt, Homo sapiens
uuuaaaccauuguggacua

SEQ ID NO: 70455 - RNA, 19 nt, Homo sapiens
gcagaugcucgaacggauu

SEQ ID NO: 70456 - RNA, 19 nt, Homo sapiens
ucggaggccuacuuugaaa

SEQ ID NO: 70457 - RNA, 19 nt, Homo sapiens
ggacuuccacagagacaug

SEQ ID NO: 70458 - RNA, 19 nt, Homo sapiens
cagcgcuccuaucauguuu

SEQ ID NO: 70459 - RNA, 19 nt, Homo sapiens
ucacccauaugcugaagau

SEQ ID NO: 70460 - RNA, 19 nt, Homo sapiens
guagguucgugucgucguu

SEQ ID NO: 70461 - RNA, 19 nt, Homo sapiens
agaagaggaagaagaaaga

SEQ ID NO: 70462 - RNA, 19 nt, Homo sapiens
cuucagguguuaucagaau

SEQ ID NO: 70463 - RNA, 19 nt, Homo sapiens
agacagcaauucacaaagc

SEQ ID NO: 70464 - RNA, 19 nt, Homo sapiens
acaagaagacagcaauuca

SEQ ID NO: 70465 - RNA, 19 nt, Homo sapiens
ucccaacgacuuugccuua

SEQ ID NO: 70466 - RNA, 19 nt, Homo sapiens
gguagacagaaacaccuua

SEQ ID NO: 70467 - RNA, 19 nt, Homo sapiens
gcaccgucauggaagagau

SEQ ID NO: 70468 - RNA, 19 nt, Homo sapiens
gacaagaagacagcaauuc

SEQ ID NO: 70469 - RNA, 19 nt, Homo sapiens
gaacuuuuaugacaagaag

SEQ ID NO: 70470 - RNA, 19 nt, Homo sapiens
ccaaugggucugucuacuu

SEQ ID NO: 70471 - RNA, 19 nt, Homo sapiens
ccagaaauugugaacuuug

SEQ ID NO: 70472 - RNA, 19 nt, Homo sapiens
gaaguguucauaccucaag

SEQ ID NO: 70473 - RNA, 19 nt, Homo sapiens
cuacaucucuuuugauauc

SEQ ID NO: 70474 - RNA, 19 nt, Homo sapiens
gugagauguucuugucaga

SEQ ID NO: 70475 - RNA, 19 nt, Homo sapiens
gcgguugcaucagauucua

SEQ ID NO: 70476 - RNA, 19 nt, Homo sapiens
gaguaugugccagaaauug

SEQ ID NO: 70477 - RNA, 19 nt, Homo sapiens
gcacaggcaugccaaauuu

SEQ ID NO: 70478 - RNA, 19 nt, Homo sapiens
caaaggauauggaaacaaa

SEQ ID NO: 70479 - RNA, 19 nt, Homo sapiens
agaagaagcucaaaggaua

SEQ ID NO: 70480 - RNA, 19 nt, Homo sapiens
cuacagagcuggaggcauu

SEQ ID NO: 70481 - RNA, 19 nt, Homo sapiens
gaagagaucguucuguaaa

SEQ ID NO: 70482 - RNA, 19 nt, Homo sapiens
uaaggaaacuguaugaaug

SEQ ID NO: 70483 - RNA, 19 nt, Homo sapiens
gugaagagaucguucugua

SEQ ID NO: 70484 - RNA, 19 nt, Homo sapiens
cagaagaguuugaggauga

SEQ ID NO: 70485 - RNA, 19 nt, Homo sapiens
gagaagagaaagcuguuua

SEQ ID NO: 70486 - RNA, 19 nt, Homo sapiens
gaagagauggagaaaguaa

SEQ ID NO: 70487 - RNA, 19 nt, Homo sapiens
ggaauuaugucugcugaau

SEQ ID NO: 70488 - RNA, 19 nt, Homo sapiens
gaagacucauugaacauau

SEQ ID NO: 70489 - RNA, 19 nt, Homo sapiens
ggaaaccuaucuuuaccaa

SEQ ID NO: 70490 - RNA, 19 nt, Homo sapiens
ggaugaugcuauuaagaaa

SEQ ID NO: 70491 - RNA, 19 nt, Homo sapiens
gcaagucccagauauacua

SEQ ID NO: 70492 - RNA, 19 nt, Homo sapiens
gaagaaacacucugagcaa

SEQ ID NO: 70493 - RNA, 19 nt, Homo sapiens
gauaagacccgagcuuuga

SEQ ID NO: 70494 - RNA, 19 nt, Homo sapiens
ggaagacucauugaacaua

SEQ ID NO: 70495 - RNA, 19 nt, Homo sapiens
caagggugcugaacaagga

SEQ ID NO: 70496 - RNA, 19 nt, Homo sapiens
uaagaaagcccacauagag

SEQ ID NO: 70497 - RNA, 19 nt, Homo sapiens
guuuaaagauucaguagga

SEQ ID NO: 70498 - RNA, 19 nt, Homo sapiens
agacaagggugcugaacaa

SEQ ID NO: 70499 - RNA, 19 nt, Homo sapiens
gaaacacucugagcaaguc

SEQ ID NO: 70500 - RNA, 19 nt, Homo sapiens
gaacuggagcugagguuga

SEQ ID NO: 70501 - RNA, 19 nt, Homo sapiens
cggcagagauuuauccaau

SEQ ID NO: 70502 - RNA, 19 nt, Homo sapiens
ggcagagauuuauccaaua

SEQ ID NO: 70503 - RNA, 19 nt, Homo sapiens
gaauuaugucugcugaaua

SEQ ID NO: 70504 - RNA, 19 nt, Homo sapiens
acaacucaaugcaaucuuu

SEQ ID NO: 70505 - RNA, 19 nt, Homo sapiens
gaagggaaugucaagcuuu

SEQ ID NO: 70506 - RNA, 19 nt, Homo sapiens
caacucaaugcaaucuuua

SEQ ID NO: 70507 - RNA, 19 nt, Homo sapiens
gcacacgucuugcucucau

SEQ ID NO: 70508 - RNA, 19 nt, Homo sapiens
gggugaagguacaauaaau

SEQ ID NO: 70509 - RNA, 19 nt, Homo sapiens
aaaccuaucuuuaccaacu

SEQ ID NO: 70510 - RNA, 19 nt, Homo sapiens
ccagauauacuacaacuca

SEQ ID NO: 70511 - RNA, 19 nt, Homo sapiens
uaaauggcuuacuggauga

SEQ ID NO: 70512 - RNA, 19 nt, Homo sapiens
aggaagagauggagaaagu

SEQ ID NO: 70513 - RNA, 19 nt, Homo sapiens
guacagcguagaugugaaa

SEQ ID NO: 70514 - RNA, 19 nt, Homo sapiens
gaagaagcucaaaggauau

SEQ ID NO: 70515 - RNA, 19 nt, Homo sapiens
ggauaagacccgagcuuug

SEQ ID NO: 70516 - RNA, 19 nt, Homo sapiens
uacaauaaauggcuuacug

SEQ ID NO: 70517 - RNA, 19 nt, Homo sapiens
gaaggcauuugugggaaga

SEQ ID NO: 70518 - RNA, 19 nt, Homo sapiens
gcacguuccugguguucau

SEQ ID NO: 70519 - RNA, 19 nt, Homo sapiens
ugacaaugcugcuacaaaa

SEQ ID NO: 70520 - RNA, 19 nt, Homo sapiens
gaaaagccauggccgacaa

SEQ ID NO: 70521 - RNA, 19 nt, Homo sapiens
gaagagaaagcuguuuauc

SEQ ID NO: 70522 - RNA, 19 nt, Homo sapiens
gagcugagguugacaucac

SEQ ID NO: 70523 - RNA, 19 nt, Homo sapiens
gacaguauuccuagaagaa

SEQ ID NO: 70524 - RNA, 19 nt, Homo sapiens
caaauuugcaucacauaca

SEQ ID NO: 70525 - RNA, 19 nt, Homo sapiens
ggcaggaagugaagagauc

SEQ ID NO: 70526 - RNA, 19 nt, Homo sapiens
guggugugguuuaaagauu

SEQ ID NO: 70527 - RNA, 19 nt, Homo sapiens
gagcaagucccagauauac

SEQ ID NO: 70528 - RNA, 19 nt, Homo sapiens
ugacaguauuccuagaaga

SEQ ID NO: 70529 - RNA, 19 nt, Homo sapiens
ugaagagaucguucuguaa

SEQ ID NO: 70530 - RNA, 19 nt, Homo sapiens
gcagaugcccaccacugaa

SEQ ID NO: 70531 - RNA, 19 nt, Homo sapiens
gguguggugugguuuaaag

SEQ ID NO: 70532 - RNA, 19 nt, Homo sapiens
gauauacuacaacucaaug

SEQ ID NO: 70533 - RNA, 19 nt, Homo sapiens
ugagcaagucccagauaua

SEQ ID NO: 70534 - RNA, 19 nt, Homo sapiens
uggcuuacuggaugaauua

SEQ ID NO: 70535 - RNA, 19 nt, Homo sapiens
ggaagagauggagaaagua

SEQ ID NO: 70536 - RNA, 19 nt, Homo sapiens
caccagauaauguuucuug

SEQ ID NO: 70537 - RNA, 19 nt, Homo sapiens
ggacaaaccgaaggugauc

SEQ ID NO: 70538 - RNA, 19 nt, Homo sapiens
agaagggaaugucaagcuu

SEQ ID NO: 70539 - RNA, 19 nt, Homo sapiens
agagugacuuugacaagau

SEQ ID NO: 70540 - RNA, 19 nt, Homo sapiens
gcucuuccacaccagauaa

SEQ ID NO: 70541 - RNA, 19 nt, Homo sapiens
agaaagcccacauagagaa

SEQ ID NO: 70542 - RNA, 19 nt, Homo sapiens
gaggaugaugcuauuaaga

SEQ ID NO: 70543 - RNA, 19 nt, Homo sapiens
guuugaggaugaugcuauu

SEQ ID NO: 70544 - RNA, 19 nt, Homo sapiens
cuucggacaugacuacaga

SEQ ID NO: 70545 - RNA, 19 nt, Homo sapiens
gcucaaaggauauggaaac

SEQ ID NO: 70546 - RNA, 19 nt, Homo sapiens
aagggaaugucaagcuuug

SEQ ID NO: 70547 - RNA, 19 nt, Homo sapiens
gaagugaagagaucguucu

SEQ ID NO: 70548 - RNA, 19 nt, Homo sapiens
gagugacuuugacaagaug

SEQ ID NO: 70549 - RNA, 19 nt, Homo sapiens
aagagugacuuugacaaga

SEQ ID NO: 70550 - RNA, 19 nt, Homo sapiens
uaaagauucaguaggaguu

SEQ ID NO: 70551 - RNA, 19 nt, Homo sapiens
ggugaagguacaauaaaug

SEQ ID NO: 70552 - RNA, 19 nt, Homo sapiens
cuggaugaauuauuacaga

SEQ ID NO: 70553 - RNA, 19 nt, Homo sapiens
ccugugauguggaggaaau

SEQ ID NO: 70554 - RNA, 19 nt, Homo sapiens
gcccaaguuugaaggacaa

SEQ ID NO: 70555 - RNA, 19 nt, Homo sapiens
caaugaagaauuugacagu

SEQ ID NO: 70556 - RNA, 19 nt, Homo sapiens
ggagaagagaaagcuguuu

SEQ ID NO: 70557 - RNA, 19 nt, Homo sapiens
uuaagaaagcccacauaga

SEQ ID NO: 70558 - RNA, 19 nt, Homo sapiens
ccucuucccaggacauuaa

SEQ ID NO: 70559 - RNA, 19 nt, Homo sapiens
ucauugaacauaugcaaga

SEQ ID NO: 70560 - RNA, 19 nt, Homo sapiens
gcccugguguggugugguu

SEQ ID NO: 70561 - RNA, 19 nt, Homo sapiens
acacgucuugcucucauua

SEQ ID NO: 70562 - RNA, 19 nt, Homo sapiens
uagaagaagcucaaaggau

SEQ ID NO: 70563 - RNA, 19 nt, Homo sapiens
gcuuugcucccuagaagaa

SEQ ID NO: 70564 - RNA, 19 nt, Homo sapiens
caaggaagagauggagaaa

SEQ ID NO: 70565 - RNA, 19 nt, Homo sapiens
ugaaaaugcuacaguuaug

SEQ ID NO: 70566 - RNA, 19 nt, Homo sapiens
cagaugcccaccacugaaa

SEQ ID NO: 70567 - RNA, 19 nt, Homo sapiens
ugaggaugaugcuauuaag

SEQ ID NO: 70568 - RNA, 19 nt, Homo sapiens
ugacuccguuauuccgaaa

SEQ ID NO: 70569 - RNA, 19 nt, Homo sapiens
aggaugaugcuauuaagaa

SEQ ID NO: 70570 - RNA, 19 nt, Homo sapiens
ugacaucacaggcaugaca

SEQ ID NO: 70571 - RNA, 19 nt, Homo sapiens
cagauauacuacaacucaa

SEQ ID NO: 70572 - RNA, 19 nt, Homo sapiens
aagcuuugcucccuagaag

SEQ ID NO: 70573 - RNA, 19 nt, Homo sapiens
gcucagaagggaaugucaa

SEQ ID NO: 70574 - RNA, 19 nt, Homo sapiens
gcaggacaacccagcuaug

SEQ ID NO: 70575 - RNA, 19 nt, Homo sapiens
cauugaacauaugcaagaa

SEQ ID NO: 70576 - RNA, 19 nt, Homo sapiens
uuggagacaucccacaaug

SEQ ID NO: 70577 - RNA, 19 nt, Homo sapiens
gcacaggcaugccaaauuu

SEQ ID NO: 70578 - RNA, 19 nt, Homo sapiens
caaaggauauggaaacaaa

SEQ ID NO: 70579 - RNA, 19 nt, Homo sapiens
agaagaagcucaaaggaua

SEQ ID NO: 70580 - RNA, 19 nt, Homo sapiens
gaucaaacaucuggaaauu

SEQ ID NO: 70581 - RNA, 19 nt, Homo sapiens
cuacagagcuggaggcauu

SEQ ID NO: 70582 - RNA, 19 nt, Homo sapiens
gaagagaucguucuguaaa

SEQ ID NO: 70583 - RNA, 19 nt, Homo sapiens
uaaggaaacuguaugaaug

SEQ ID NO: 70584 - RNA, 19 nt, Homo sapiens
gugaagagaucguucugua

SEQ ID NO: 70585 - RNA, 19 nt, Homo sapiens
cagaagaguuugaggauga

SEQ ID NO: 70586 - RNA, 19 nt, Homo sapiens
gagaagagaaagcuguuua

SEQ ID NO: 70587 - RNA, 19 nt, Homo sapiens
gaagagauggagaaaguaa

SEQ ID NO: 70588 - RNA, 19 nt, Homo sapiens
ggaauuaugucugcugaau

SEQ ID NO: 70589 - RNA, 19 nt, Homo sapiens
gaagacucauugaacauau

SEQ ID NO: 70590 - RNA, 19 nt, Homo sapiens
ggaaaccuaucuuuaccaa

SEQ ID NO: 70591 - RNA, 19 nt, Homo sapiens
ggaugaugcuauuaagaaa

SEQ ID NO: 70592 - RNA, 19 nt, Homo sapiens
gcaagucccagauauacua

SEQ ID NO: 70593 - RNA, 19 nt, Homo sapiens
gaagaaacacucugagcaa

SEQ ID NO: 70594 - RNA, 19 nt, Homo sapiens
ucaaacaucuggaaauuac

SEQ ID NO: 70595 - RNA, 19 nt, Homo sapiens
gauaagacccgagcuuuga

SEQ ID NO: 70596 - RNA, 19 nt, Homo sapiens
ggaagacucauugaacaua

SEQ ID NO: 70597 - RNA, 19 nt, Homo sapiens
caagggugcugaacaagga

SEQ ID NO: 70598 - RNA, 19 nt, Homo sapiens
uaagaaagcccacauagag

SEQ ID NO: 70599 - RNA, 19 nt, Homo sapiens
guuuaaagauucaguagga

SEQ ID NO: 70600 - RNA, 19 nt, Homo sapiens
agacaagggugcugaacaa

SEQ ID NO: 70601 - RNA, 19 nt, Homo sapiens
gaaacacucugagcaaguc

SEQ ID NO: 70602 - RNA, 19 nt, Homo sapiens
gaacuggagcugagguuga

SEQ ID NO: 70603 - RNA, 19 nt, Homo sapiens
cggcagagauuuauccaau

SEQ ID NO: 70604 - RNA, 19 nt, Homo sapiens
ggcagagauuuauccaaua

SEQ ID NO: 70605 - RNA, 19 nt, Homo sapiens
gaauuaugucugcugaaua

SEQ ID NO: 70606 - RNA, 19 nt, Homo sapiens
acaacucaaugcaaucuuu

SEQ ID NO: 70607 - RNA, 19 nt, Homo sapiens
gaagggaaugucaagcuuu

SEQ ID NO: 70608 - RNA, 19 nt, Homo sapiens
caacucaaugcaaucuuua

SEQ ID NO: 70609 - RNA, 19 nt, Homo sapiens
gcacacgucuugcucucau

SEQ ID NO: 70610 - RNA, 19 nt, Homo sapiens
aaaccuaucuuuaccaacu

SEQ ID NO: 70611 - RNA, 19 nt, Homo sapiens
ccagauauacuacaacuca

SEQ ID NO: 70612 - RNA, 19 nt, Homo sapiens
uaaauggcuuacuggauga

SEQ ID NO: 70613 - RNA, 19 nt, Homo sapiens
gggugaagguacaauaaau

SEQ ID NO: 70614 - RNA, 19 nt, Homo sapiens
aggaagagauggagaaagu

SEQ ID NO: 70615 - RNA, 19 nt, Homo sapiens
guacagcguagaugugaaa

SEQ ID NO: 70616 - RNA, 19 nt, Homo sapiens
gaagaagcucaaaggauau

SEQ ID NO: 70617 - RNA, 19 nt, Homo sapiens
ggaguacuuucuuccuuuc

SEQ ID NO: 70618 - RNA, 19 nt, Homo sapiens
ggauaagacccgagcuuug

SEQ ID NO: 70619 - RNA, 19 nt, Homo sapiens
gaaggcauuugugggaaga

SEQ ID NO: 70620 - RNA, 19 nt, Homo sapiens
gcacguuccugguguucau

SEQ ID NO: 70621 - RNA, 19 nt, Homo sapiens
uacaauaaauggcuuacug

SEQ ID NO: 70622 - RNA, 19 nt, Homo sapiens
ugacaaugcugcuacaaaa

SEQ ID NO: 70623 - RNA, 19 nt, Homo sapiens
gaaaagccauggccgacaa

SEQ ID NO: 70624 - RNA, 19 nt, Homo sapiens
gaagagaaagcuguuuauc

SEQ ID NO: 70625 - RNA, 19 nt, Homo sapiens
gagcugagguugacaucac

SEQ ID NO: 70626 - RNA, 19 nt, Homo sapiens
gacaguauuccuagaagaa

SEQ ID NO: 70627 - RNA, 19 nt, Homo sapiens
gaaugucugugggcaggaa

SEQ ID NO: 70628 - RNA, 19 nt, Homo sapiens
caaauuugcaucacauaca

SEQ ID NO: 70629 - RNA, 19 nt, Homo sapiens
ggcaggaagugaagagauc

SEQ ID NO: 70630 - RNA, 19 nt, Homo sapiens
guggugugguuuaaagauu

SEQ ID NO: 70631 - RNA, 19 nt, Homo sapiens
gagcaagucccagauauac

SEQ ID NO: 70632 - RNA, 19 nt, Homo sapiens
ugacaguauuccuagaaga

SEQ ID NO: 70633 - RNA, 19 nt, Homo sapiens
ugaagagaucguucuguaa

SEQ ID NO: 70634 - RNA, 19 nt, Homo sapiens
gcagaugcccaccacugaa

SEQ ID NO: 70635 - RNA, 19 nt, Homo sapiens
gguguggugugguuuaaag

SEQ ID NO: 70636 - RNA, 19 nt, Homo sapiens
gauauacuacaacucaaug

SEQ ID NO: 70637 - RNA, 19 nt, Homo sapiens
ugagcaagucccagauaua

SEQ ID NO: 70638 - RNA, 19 nt, Homo sapiens
uggcuuacuggaugaauua

SEQ ID NO: 70639 - RNA, 19 nt, Homo sapiens
ggaagagauggagaaagua

SEQ ID NO: 70640 - RNA, 19 nt, Homo sapiens
caccagauaauguuucuug

SEQ ID NO: 70641 - RNA, 19 nt, Homo sapiens
ggacaaaccgaaggugauc

SEQ ID NO: 70642 - RNA, 19 nt, Homo sapiens
agaagggaaugucaagcuu

SEQ ID NO: 70643 - RNA, 19 nt, Homo sapiens
agagugacuuugacaagau

SEQ ID NO: 70644 - RNA, 19 nt, Homo sapiens
gcucuuccacaccagauaa

SEQ ID NO: 70645 - RNA, 19 nt, Homo sapiens
agaaagcccacauagagaa

SEQ ID NO: 70646 - RNA, 19 nt, Homo sapiens
gaggaugaugcuauuaaga

SEQ ID NO: 70647 - RNA, 19 nt, Homo sapiens
guuugaggaugaugcuauu

SEQ ID NO: 70648 - RNA, 19 nt, Homo sapiens
cuucggacaugacuacaga

SEQ ID NO: 70649 - RNA, 19 nt, Homo sapiens
gcucaaaggauauggaaac

SEQ ID NO: 70650 - RNA, 19 nt, Homo sapiens
aagggaaugucaagcuuug

SEQ ID NO: 70651 - RNA, 19 nt, Homo sapiens
gaagugaagagaucguucu

SEQ ID NO: 70652 - RNA, 19 nt, Homo sapiens
gagugacuuugacaagaug

SEQ ID NO: 70653 - RNA, 19 nt, Homo sapiens
aagagugacuuugacaaga

SEQ ID NO: 70654 - RNA, 19 nt, Homo sapiens
uaaagauucaguaggaguu

SEQ ID NO: 70655 - RNA, 19 nt, Homo sapiens
cuggaugaauuauuacaga

SEQ ID NO: 70656 - RNA, 19 nt, Homo sapiens
ggugaagguacaauaaaug

SEQ ID NO: 70657 - RNA, 19 nt, Homo sapiens
ccugugauguggaggaaau

SEQ ID NO: 70658 - RNA, 19 nt, Homo sapiens
gcccaaguuugaaggacaa

SEQ ID NO: 70659 - RNA, 19 nt, Homo sapiens
caaugaagaauuugacagu

SEQ ID NO: 70660 - RNA, 19 nt, Homo sapiens
uuaagaaagcccacauaga

SEQ ID NO: 70661 - RNA, 19 nt, Homo sapiens
ggagaagagaaagcuguuu

SEQ ID NO: 70662 - RNA, 19 nt, Homo sapiens
ccucuucccaggacauuaa

SEQ ID NO: 70663 - RNA, 19 nt, Homo sapiens
ucauugaacauaugcaaga

SEQ ID NO: 70664 - RNA, 19 nt, Homo sapiens
caaggaagagauggagaaa

SEQ ID NO: 70665 - RNA, 19 nt, Homo sapiens
gcccugguguggugugguu

SEQ ID NO: 70666 - RNA, 19 nt, Homo sapiens
acacgucuugcucucauua

SEQ ID NO: 70667 - RNA, 19 nt, Homo sapiens
uagaagaagcucaaaggau

SEQ ID NO: 70668 - RNA, 19 nt, Homo sapiens
gcuuugcucccuagaagaa

SEQ ID NO: 70669 - RNA, 19 nt, Homo sapiens
caucuggaaauuaccuuaa

SEQ ID NO: 70670 - RNA, 19 nt, Homo sapiens
cagaugcccaccacugaaa

SEQ ID NO: 70671 - RNA, 19 nt, Homo sapiens
ugaggaugaugcuauuaag

SEQ ID NO: 70672 - RNA, 19 nt, Homo sapiens
ugaaaaugcuacaguuaug

SEQ ID NO: 70673 - RNA, 19 nt, Homo sapiens
ugacuccguuauuccgaaa

SEQ ID NO: 70674 - RNA, 19 nt, Homo sapiens
aggaugaugcuauuaagaa

SEQ ID NO: 70675 - RNA, 19 nt, Homo sapiens
ugacaucacaggcaugaca

SEQ ID NO: 70676 - RNA, 19 nt, Homo sapiens
cagauauacuacaacucaa

SEQ ID NO: 70677 - RNA, 19 nt, Homo sapiens
caaaggauauggaaacaaa

SEQ ID NO: 70678 - RNA, 19 nt, Homo sapiens
agaagaagcucaaaggaua

SEQ ID NO: 70679 - RNA, 19 nt, Homo sapiens
cuacagagcuggaggcauu

SEQ ID NO: 70680 - RNA, 19 nt, Homo sapiens
gaagagaucguucuguaaa

SEQ ID NO: 70681 - RNA, 19 nt, Homo sapiens
uaaggaaacuguaugaaug

SEQ ID NO: 70682 - RNA, 19 nt, Homo sapiens
gugaagagaucguucugua

SEQ ID NO: 70683 - RNA, 19 nt, Homo sapiens
cagaagaguuugaggauga

SEQ ID NO: 70684 - RNA, 19 nt, Homo sapiens
gagaagagaaagcuguuua

SEQ ID NO: 70685 - RNA, 19 nt, Homo sapiens
ggaauuaugucugcugaau

SEQ ID NO: 70686 - RNA, 19 nt, Homo sapiens
gaagacucauugaacauau

SEQ ID NO: 70687 - RNA, 19 nt, Homo sapiens
ggaaaccuaucuuuaccaa

SEQ ID NO: 70688 - RNA, 19 nt, Homo sapiens
ggaugaugcuauuaagaaa

SEQ ID NO: 70689 - RNA, 19 nt, Homo sapiens
gcaagucccagauauacua

SEQ ID NO: 70690 - RNA, 19 nt, Homo sapiens
gaagaaacacucugagcaa

SEQ ID NO: 70691 - RNA, 19 nt, Homo sapiens
ggaagacucauugaacaua

SEQ ID NO: 70692 - RNA, 19 nt, Homo sapiens
uaagaaagcccacauagag

SEQ ID NO: 70693 - RNA, 19 nt, Homo sapiens
guuuaaagauucaguagga

SEQ ID NO: 70694 - RNA, 19 nt, Homo sapiens
gaaacacucugagcaaguc

SEQ ID NO: 70695 - RNA, 19 nt, Homo sapiens
gaacuggagcugagguuga

SEQ ID NO: 70696 - RNA, 19 nt, Homo sapiens
cggcagagauuuauccaau

SEQ ID NO: 70697 - RNA, 19 nt, Homo sapiens
ggcagagauuuauccaaua

SEQ ID NO: 70698 - RNA, 19 nt, Homo sapiens
gaauuaugucugcugaaua

SEQ ID NO: 70699 - RNA, 19 nt, Homo sapiens
acaacucaaugcaaucuuu

SEQ ID NO: 70700 - RNA, 19 nt, Homo sapiens
gaagggaaugucaagcuuu

SEQ ID NO: 70701 - RNA, 19 nt, Homo sapiens
caacucaaugcaaucuuua

SEQ ID NO: 70702 - RNA, 19 nt, Homo sapiens
gcacacgucuugcucucau

SEQ ID NO: 70703 - RNA, 19 nt, Homo sapiens
aaaccuaucuuuaccaacu

SEQ ID NO: 70704 - RNA, 19 nt, Homo sapiens
ccagauauacuacaacuca

SEQ ID NO: 70705 - RNA, 19 nt, Homo sapiens
guacagcguagaugugaaa

SEQ ID NO: 70706 - RNA, 19 nt, Homo sapiens
gaagaagcucaaaggauau

SEQ ID NO: 70707 - RNA, 19 nt, Homo sapiens
gaaggcauuugugggaaga

SEQ ID NO: 70708 - RNA, 19 nt, Homo sapiens
gcacguuccugguguucau

SEQ ID NO: 70709 - RNA, 19 nt, Homo sapiens
ugacaaugcugcuacaaaa

SEQ ID NO: 70710 - RNA, 19 nt, Homo sapiens
gaaaagccauggccgacaa

SEQ ID NO: 70711 - RNA, 19 nt, Homo sapiens
gaagagaaagcuguuuauc

SEQ ID NO: 70712 - RNA, 19 nt, Homo sapiens
gagcugagguugacaucac

SEQ ID NO: 70713 - RNA, 19 nt, Homo sapiens
gacaguauuccuagaagaa

SEQ ID NO: 70714 - RNA, 19 nt, Homo sapiens
gaaugucugugggcaggaa

SEQ ID NO: 70715 - RNA, 19 nt, Homo sapiens
ggcaggaagugaagagauc

SEQ ID NO: 70716 - RNA, 19 nt, Homo sapiens
guggugugguuuaaagauu

SEQ ID NO: 70717 - RNA, 19 nt, Homo sapiens
gagcaagucccagauauac

SEQ ID NO: 70718 - RNA, 19 nt, Homo sapiens
ugacaguauuccuagaaga

SEQ ID NO: 70719 - RNA, 19 nt, Homo sapiens
ugaagagaucguucuguaa

SEQ ID NO: 70720 - RNA, 19 nt, Homo sapiens
gcagaugcccaccacugaa

SEQ ID NO: 70721 - RNA, 19 nt, Homo sapiens
gguguggugugguuuaaag

SEQ ID NO: 70722 - RNA, 19 nt, Homo sapiens
gauauacuacaacucaaug

SEQ ID NO: 70723 - RNA, 19 nt, Homo sapiens
ugagcaagucccagauaua

SEQ ID NO: 70724 - RNA, 19 nt, Homo sapiens
caccagauaauguuucuug

SEQ ID NO: 70725 - RNA, 19 nt, Homo sapiens
agaagggaaugucaagcuu

SEQ ID NO: 70726 - RNA, 19 nt, Homo sapiens
ggacaaaccgaaggugauc

SEQ ID NO: 70727 - RNA, 19 nt, Homo sapiens
agagugacuuugacaagau

SEQ ID NO: 70728 - RNA, 19 nt, Homo sapiens
gcucuuccacaccagauaa

SEQ ID NO: 70729 - RNA, 19 nt, Homo sapiens
agaaagcccacauagagaa

SEQ ID NO: 70730 - RNA, 19 nt, Homo sapiens
gaggaugaugcuauuaaga

SEQ ID NO: 70731 - RNA, 19 nt, Homo sapiens
guuugaggaugaugcuauu

SEQ ID NO: 70732 - RNA, 19 nt, Homo sapiens
cuucggacaugacuacaga

SEQ ID NO: 70733 - RNA, 19 nt, Homo sapiens
aagggaaugucaagcuuug

SEQ ID NO: 70734 - RNA, 19 nt, Homo sapiens
gcucaaaggauauggaaac

SEQ ID NO: 70735 - RNA, 19 nt, Homo sapiens
gaagugaagagaucguucu

SEQ ID NO: 70736 - RNA, 19 nt, Homo sapiens
gagugacuuugacaagaug

SEQ ID NO: 70737 - RNA, 19 nt, Homo sapiens
aagagugacuuugacaaga

SEQ ID NO: 70738 - RNA, 19 nt, Homo sapiens
uaaagauucaguaggaguu

SEQ ID NO: 70739 - RNA, 19 nt, Homo sapiens
ccugugauguggaggaaau

SEQ ID NO: 70740 - RNA, 19 nt, Homo sapiens
gcccaaguuugaaggacaa

SEQ ID NO: 70741 - RNA, 19 nt, Homo sapiens
caaugaagaauuugacagu

SEQ ID NO: 70742 - RNA, 19 nt, Homo sapiens
ggagaagagaaagcuguuu

SEQ ID NO: 70743 - RNA, 19 nt, Homo sapiens
uuaagaaagcccacauaga

SEQ ID NO: 70744 - RNA, 19 nt, Homo sapiens
ccucuucccaggacauuaa

SEQ ID NO: 70745 - RNA, 19 nt, Homo sapiens
ucauugaacauaugcaaga

SEQ ID NO: 70746 - RNA, 19 nt, Homo sapiens
gcuuugcucccuagaagaa

SEQ ID NO: 70747 - RNA, 19 nt, Homo sapiens
gcccugguguggugugguu

SEQ ID NO: 70748 - RNA, 19 nt, Homo sapiens
uagaagaagcucaaaggau

SEQ ID NO: 70749 - RNA, 19 nt, Homo sapiens
acacgucuugcucucauua

SEQ ID NO: 70750 - RNA, 19 nt, Homo sapiens
cagaugcccaccacugaaa

SEQ ID NO: 70751 - RNA, 19 nt, Homo sapiens
ugaggaugaugcuauuaag

SEQ ID NO: 70752 - RNA, 19 nt, Homo sapiens
aggaugaugcuauuaagaa

SEQ ID NO: 70753 - RNA, 19 nt, Homo sapiens
ugacaucacaggcaugaca

SEQ ID NO: 70754 - RNA, 19 nt, Homo sapiens
cagauauacuacaacucaa

SEQ ID NO: 70755 - RNA, 19 nt, Homo sapiens
gcaggacaacccagcuaug

SEQ ID NO: 70756 - RNA, 19 nt, Homo sapiens
aagcuuugcucccuagaag

SEQ ID NO: 70757 - RNA, 19 nt, Homo sapiens
gcucagaagggaaugucaa

SEQ ID NO: 70758 - RNA, 19 nt, Homo sapiens
cauugaacauaugcaagaa

SEQ ID NO: 70759 - RNA, 19 nt, Homo sapiens
uuggagacaucccacaaug

SEQ ID NO: 70760 - RNA, 19 nt, Homo sapiens
ccagauaauguuucuugga

SEQ ID NO: 70761 - RNA, 19 nt, Homo sapiens
agaaggauuuuaucgcuuu

SEQ ID NO: 70762 - RNA, 19 nt, Homo sapiens
gaaagcccacauagagaag

SEQ ID NO: 70763 - RNA, 19 nt, Homo sapiens
aaaagucggcagagauuua

SEQ ID NO: 70764 - RNA, 19 nt, Homo sapiens
gaagcucaaaggauaugga

SEQ ID NO: 70765 - RNA, 19 nt, Homo sapiens
ggugugguuuaaagauuca

SEQ ID NO: 70766 - RNA, 19 nt, Homo sapiens
cugagcaagucccagauau

SEQ ID NO: 70767 - RNA, 19 nt, Homo sapiens
gagcacaagaccucugaca

SEQ ID NO: 70768 - RNA, 19 nt, Homo sapiens
uuggaagacucauugaaca

SEQ ID NO: 70769 - RNA, 19 nt, Homo sapiens
uacuacaacucaaugcaau

SEQ ID NO: 70770 - RNA, 19 nt, Homo sapiens
aaacaaaagucggcagaga

SEQ ID NO: 70771 - RNA, 19 nt, Homo sapiens
aagaaagcccacauagaga

SEQ ID NO: 70772 - RNA, 19 nt, Homo sapiens
uauuaagaaagcccacaua

SEQ ID NO: 70773 - RNA, 19 nt, Homo sapiens
ucaguaggaguuucuggaa

SEQ ID NO: 70774 - RNA, 19 nt, Homo sapiens
caaugcaaucuuuaacaug

SEQ ID NO: 70775 - RNA, 19 nt, Homo sapiens
gcauuugugggaagaaaca

SEQ ID NO: 70776 - RNA, 19 nt, Homo sapiens
gguacagcguagaugugaa

SEQ ID NO: 70777 - RNA, 19 nt, Homo sapiens
caaaggauauggaaacaaa

SEQ ID NO: 70778 - RNA, 19 nt, Homo sapiens
agaagaagcucaaaggaua

SEQ ID NO: 70779 - RNA, 19 nt, Homo sapiens
cuacagagcuggaggcauu

SEQ ID NO: 70780 - RNA, 19 nt, Homo sapiens
gaagagaucguucuguaaa

SEQ ID NO: 70781 - RNA, 19 nt, Homo sapiens
uaaggaaacuguaugaaug

SEQ ID NO: 70782 - RNA, 19 nt, Homo sapiens
gugaagagaucguucugua

SEQ ID NO: 70783 - RNA, 19 nt, Homo sapiens
gagaagagaaagcuguuua

SEQ ID NO: 70784 - RNA, 19 nt, Homo sapiens
ggaauuaugucugcugaau

SEQ ID NO: 70785 - RNA, 19 nt, Homo sapiens
gaagacucauugaacauau

SEQ ID NO: 70786 - RNA, 19 nt, Homo sapiens
gcaagucccagauauacua

SEQ ID NO: 70787 - RNA, 19 nt, Homo sapiens
gaagaaacacucugagcaa

SEQ ID NO: 70788 - RNA, 19 nt, Homo sapiens
ggaagacucauugaacaua

SEQ ID NO: 70789 - RNA, 19 nt, Homo sapiens
gaaacacucugagcaaguc

SEQ ID NO: 70790 - RNA, 19 nt, Homo sapiens
gaacuggagcugagguuga

SEQ ID NO: 70791 - RNA, 19 nt, Homo sapiens
cggcagagauuuauccaau

SEQ ID NO: 70792 - RNA, 19 nt, Homo sapiens
ggcagagauuuauccaaua

SEQ ID NO: 70793 - RNA, 19 nt, Homo sapiens
gaauuaugucugcugaaua

SEQ ID NO: 70794 - RNA, 19 nt, Homo sapiens
acaacucaaugcaaucuuu

SEQ ID NO: 70795 - RNA, 19 nt, Homo sapiens
gaagggaaugucaagcuuu

SEQ ID NO: 70796 - RNA, 19 nt, Homo sapiens
caacucaaugcaaucuuua

SEQ ID NO: 70797 - RNA, 19 nt, Homo sapiens
gcacacgucuugcucucau

SEQ ID NO: 70798 - RNA, 19 nt, Homo sapiens
ccagauauacuacaacuca

SEQ ID NO: 70799 - RNA, 19 nt, Homo sapiens
guacagcguagaugugaaa

SEQ ID NO: 70800 - RNA, 19 nt, Homo sapiens
gaagaagcucaaaggauau

SEQ ID NO: 70801 - RNA, 19 nt, Homo sapiens
gaaggcauuugugggaaga

SEQ ID NO: 70802 - RNA, 19 nt, Homo sapiens
gcacguuccugguguucau

SEQ ID NO: 70803 - RNA, 19 nt, Homo sapiens
ugacaaugcugcuacaaaa

SEQ ID NO: 70804 - RNA, 19 nt, Homo sapiens
gaaaagccauggccgacaa

SEQ ID NO: 70805 - RNA, 19 nt, Homo sapiens
gaagagaaagcuguuuauc

SEQ ID NO: 70806 - RNA, 19 nt, Homo sapiens
gagcugagguugacaucac

SEQ ID NO: 70807 - RNA, 19 nt, Homo sapiens
gacaguauuccuagaagaa

SEQ ID NO: 70808 - RNA, 19 nt, Homo sapiens
gaaugucugugggcaggaa

SEQ ID NO: 70809 - RNA, 19 nt, Homo sapiens
ggcaggaagugaagagauc

SEQ ID NO: 70810 - RNA, 19 nt, Homo sapiens
gagcaagucccagauauac

SEQ ID NO: 70811 - RNA, 19 nt, Homo sapiens
ugacaguauuccuagaaga

SEQ ID NO: 70812 - RNA, 19 nt, Homo sapiens
ugaagagaucguucuguaa

SEQ ID NO: 70813 - RNA, 19 nt, Homo sapiens
gcagaugcccaccacugaa

SEQ ID NO: 70814 - RNA, 19 nt, Homo sapiens
gauauacuacaacucaaug

SEQ ID NO: 70815 - RNA, 19 nt, Homo sapiens
ugagcaagucccagauaua

SEQ ID NO: 70816 - RNA, 19 nt, Homo sapiens
ggacaaaccgaaggugauc

SEQ ID NO: 70817 - RNA, 19 nt, Homo sapiens
agaagggaaugucaagcuu

SEQ ID NO: 70818 - RNA, 19 nt, Homo sapiens
agagugacuuugacaagau

SEQ ID NO: 70819 - RNA, 19 nt, Homo sapiens
aagggaaugucaagcuuug

SEQ ID NO: 70820 - RNA, 19 nt, Homo sapiens
cuucggacaugacuacaga

SEQ ID NO: 70821 - RNA, 19 nt, Homo sapiens
gcucaaaggauauggaaac

SEQ ID NO: 70822 - RNA, 19 nt, Homo sapiens
gaagugaagagaucguucu

SEQ ID NO: 70823 - RNA, 19 nt, Homo sapiens
gagugacuuugacaagaug

SEQ ID NO: 70824 - RNA, 19 nt, Homo sapiens
aagagugacuuugacaaga

SEQ ID NO: 70825 - RNA, 19 nt, Homo sapiens
ccugugauguggaggaaau

SEQ ID NO: 70826 - RNA, 19 nt, Homo sapiens
gcccaaguuugaaggacaa

SEQ ID NO: 70827 - RNA, 19 nt, Homo sapiens
caaugaagaauuugacagu

SEQ ID NO: 70828 - RNA, 19 nt, Homo sapiens
ggagaagagaaagcuguuu

SEQ ID NO: 70829 - RNA, 19 nt, Homo sapiens
ccucuucccaggacauuaa

SEQ ID NO: 70830 - RNA, 19 nt, Homo sapiens
gcuuugcucccuagaagaa

SEQ ID NO: 70831 - RNA, 19 nt, Homo sapiens
ucauugaacauaugcaaga

SEQ ID NO: 70832 - RNA, 19 nt, Homo sapiens
acacgucuugcucucauua

SEQ ID NO: 70833 - RNA, 19 nt, Homo sapiens
uagaagaagcucaaaggau

SEQ ID NO: 70834 - RNA, 19 nt, Homo sapiens
cagaugcccaccacugaaa

SEQ ID NO: 70835 - RNA, 19 nt, Homo sapiens
ggccugccguggugauaau

SEQ ID NO: 70836 - RNA, 19 nt, Homo sapiens
ugacaucacaggcaugaca

SEQ ID NO: 70837 - RNA, 19 nt, Homo sapiens
aagcuuugcucccuagaag

SEQ ID NO: 70838 - RNA, 19 nt, Homo sapiens
gcucagaagggaaugucaa

SEQ ID NO: 70839 - RNA, 19 nt, Homo sapiens
gcaggacaacccagcuaug

SEQ ID NO: 70840 - RNA, 19 nt, Homo sapiens
cagauauacuacaacucaa

SEQ ID NO: 70841 - RNA, 19 nt, Homo sapiens
gaagcucaaaggauaugga

SEQ ID NO: 70842 - RNA, 19 nt, Homo sapiens
cauugaacauaugcaagaa

SEQ ID NO: 70843 - RNA, 19 nt, Homo sapiens
uuggagacaucccacaaug

SEQ ID NO: 70844 - RNA, 19 nt, Homo sapiens
cugagcaagucccagauau

SEQ ID NO: 70845 - RNA, 19 nt, Homo sapiens
gagcacaagaccucugaca

SEQ ID NO: 70846 - RNA, 19 nt, Homo sapiens
aaaagucggcagagauuua

SEQ ID NO: 70847 - RNA, 19 nt, Homo sapiens
uuggaagacucauugaaca

SEQ ID NO: 70848 - RNA, 19 nt, Homo sapiens
guggugauaauguuucuug

SEQ ID NO: 70849 - RNA, 19 nt, Homo sapiens
aaacaaaagucggcagaga

SEQ ID NO: 70850 - RNA, 19 nt, Homo sapiens
uacuacaacucaaugcaau

SEQ ID NO: 70851 - RNA, 19 nt, Homo sapiens
ggugauaauguuucuugga

SEQ ID NO: 70852 - RNA, 19 nt, Homo sapiens
caaugcaaucuuuaacaug

SEQ ID NO: 70853 - RNA, 19 nt, Homo sapiens
gcauuugugggaagaaaca

SEQ ID NO: 70854 - RNA, 19 nt, Homo sapiens
gguacagcguagaugugaa

SEQ ID NO: 70855 - RNA, 19 nt, Homo sapiens
ggguacagcguagauguga

SEQ ID NO: 70856 - RNA, 19 nt, Homo sapiens
agaagagaaagcuguuuau

SEQ ID NO: 70857 - RNA, 19 nt, Homo sapiens
ugcaaucuuuaacauguug

SEQ ID NO: 70858 - RNA, 19 nt, Homo sapiens
ugacuuugacaagauguuu

SEQ ID NO: 70859 - RNA, 19 nt, Homo sapiens
gguauucgggaaggcauuu

SEQ ID NO: 70860 - RNA, 19 nt, Homo sapiens
ggaaacuguaugaaugucu

SEQ ID NO: 70861 - RNA, 19 nt, Homo sapiens
gugggaagaaacacucuga

SEQ ID NO: 70862 - RNA, 19 nt, Homo sapiens
caagcuuugcucccuagaa

SEQ ID NO: 70863 - RNA, 19 nt, Homo sapiens
ccaauaauggacaagucaa

SEQ ID NO: 70864 - RNA, 19 nt, Homo sapiens
aagacucauugaacauaug

SEQ ID NO: 70865 - RNA, 19 nt, Homo sapiens
cuagaagaagcucaaagga

SEQ ID NO: 70866 - RNA, 19 nt, Homo sapiens
gggcaggaagugaagagau

SEQ ID NO: 70867 - RNA, 19 nt, Homo sapiens
gugcaggacaacccagcua

SEQ ID NO: 70868 - RNA, 19 nt, Homo sapiens
agucccagauauacuacaa

SEQ ID NO: 70869 - RNA, 19 nt, Homo sapiens
ucucacugcuucggacaug

SEQ ID NO: 70870 - RNA, 19 nt, Homo sapiens
caucacaggcaugacaaug

SEQ ID NO: 70871 - RNA, 19 nt, Homo sapiens
gaagagaucguucuguaaa

SEQ ID NO: 70872 - RNA, 19 nt, Homo sapiens
uaaggaaacuguaugaaug

SEQ ID NO: 70873 - RNA, 19 nt, Homo sapiens
gugaagagaucguucugua

SEQ ID NO: 70874 - RNA, 19 nt, Homo sapiens
gagaagagaaagcuguuua

SEQ ID NO: 70875 - RNA, 19 nt, Homo sapiens
ggaauuaugucugcugaau

SEQ ID NO: 70876 - RNA, 19 nt, Homo sapiens
gaagacucauugaacauau

SEQ ID NO: 70877 - RNA, 19 nt, Homo sapiens
ggaagacucauugaacaua

SEQ ID NO: 70878 - RNA, 19 nt, Homo sapiens
gaauuaugucugcugaaua

SEQ ID NO: 70879 - RNA, 19 nt, Homo sapiens
gaaaagccauggccgacaa

SEQ ID NO: 70880 - RNA, 19 nt, Homo sapiens
gaagagaaagcuguuuauc

SEQ ID NO: 70881 - RNA, 19 nt, Homo sapiens
gaaugucugugggcaggaa

SEQ ID NO: 70882 - RNA, 19 nt, Homo sapiens
ggcaggaagugaagagauc

SEQ ID NO: 70883 - RNA, 19 nt, Homo sapiens
ugaagagaucguucuguaa

SEQ ID NO: 70884 - RNA, 19 nt, Homo sapiens
gcagaugcccaccacugaa

SEQ ID NO: 70885 - RNA, 19 nt, Homo sapiens
agagugacuuugacaagau

SEQ ID NO: 70886 - RNA, 19 nt, Homo sapiens
gaagugaagagaucguucu

SEQ ID NO: 70887 - RNA, 19 nt, Homo sapiens
gagugacuuugacaagaug

SEQ ID NO: 70888 - RNA, 19 nt, Homo sapiens
aagagugacuuugacaaga

SEQ ID NO: 70889 - RNA, 19 nt, Homo sapiens
gggugaagauaauguuucu

SEQ ID NO: 70890 - RNA, 19 nt, Homo sapiens
ccugugauguggaggaaau

SEQ ID NO: 70891 - RNA, 19 nt, Homo sapiens
ggagaagagaaagcuguuu

SEQ ID NO: 70892 - RNA, 19 nt, Homo sapiens
ccucuucccaggacauuaa

SEQ ID NO: 70893 - RNA, 19 nt, Homo sapiens
ucauugaacauaugcaaga

SEQ ID NO: 70894 - RNA, 19 nt, Homo sapiens
cagaugcccaccacugaaa

SEQ ID NO: 70895 - RNA, 19 nt, Homo sapiens
cauugaacauaugcaagaa

SEQ ID NO: 70896 - RNA, 19 nt, Homo sapiens
uuggagacaucccacaaug

SEQ ID NO: 70897 - RNA, 19 nt, Homo sapiens
uuggaagacucauugaaca

SEQ ID NO: 70898 - RNA, 19 nt, Homo sapiens
uuccaugggugaagauaau

SEQ ID NO: 70899 - RNA, 19 nt, Homo sapiens
agaagagaaagcuguuuau

SEQ ID NO: 70900 - RNA, 19 nt, Homo sapiens
ugacuuugacaagauguuu

SEQ ID NO: 70901 - RNA, 19 nt, Homo sapiens
ggaaacuguaugaaugucu

SEQ ID NO: 70902 - RNA, 19 nt, Homo sapiens
aagacucauugaacauaug

SEQ ID NO: 70903 - RNA, 19 nt, Homo sapiens
gggcaggaagugaagagau

SEQ ID NO: 70904 - RNA, 19 nt, Homo sapiens
gcaaggagaugucugaaua

SEQ ID NO: 70905 - RNA, 19 nt, Homo sapiens
caacuucccugaucuuuaa

SEQ ID NO: 70906 - RNA, 19 nt, Homo sapiens
gcacuucacuggagagaaa

SEQ ID NO: 70907 - RNA, 19 nt, Homo sapiens
gcucaaagauguaauguag

SEQ ID NO: 70908 - RNA, 19 nt, Homo sapiens
aagagaaacugcagaauuu

SEQ ID NO: 70909 - RNA, 19 nt, Homo sapiens
guauuaaacucuccuuuga

SEQ ID NO: 70910 - RNA, 19 nt, Homo sapiens
gaauacuacugguaaacua

SEQ ID NO: 70911 - RNA, 19 nt, Homo sapiens
ggagagggcauauaaauuc

SEQ ID NO: 70912 - RNA, 19 nt, Homo sapiens
ucauaucucucccuucuuu

SEQ ID NO: 70913 - RNA, 19 nt, Homo sapiens
ugaagagccugacaaguga

SEQ ID NO: 70914 - RNA, 19 nt, Homo sapiens
gcacugguguugagcaaug

SEQ ID NO: 70915 - RNA, 19 nt, Homo sapiens
caccaaaucugucuagaau

SEQ ID NO: 70916 - RNA, 19 nt, Homo sapiens
caagagaaacugcagaauu

SEQ ID NO: 70917 - RNA, 19 nt, Homo sapiens
ggagagugaugccgguaaa

SEQ ID NO: 70918 - RNA, 19 nt, Homo sapiens
gagcgaauacuacugguaa

SEQ ID NO: 70919 - RNA, 19 nt, Homo sapiens
gaacacucccuagacaaua

SEQ ID NO: 70920 - RNA, 19 nt, Homo sapiens
gauguaauguaguucuuug

SEQ ID NO: 70921 - RNA, 19 nt, Homo sapiens
caggaagaaugguguguuu

SEQ ID NO: 70922 - RNA, 19 nt, Homo sapiens
gauagagccuuugaucuuc

SEQ ID NO: 70923 - RNA, 19 nt, Homo sapiens
ucaaggaucgggaagguua

SEQ ID NO: 70924 - RNA, 19 nt, Homo sapiens
ggaagguguccaaauuuaa

SEQ ID NO: 70925 - RNA, 19 nt, Homo sapiens
aagcaaacaugacuagaga

SEQ ID NO: 70926 - RNA, 19 nt, Homo sapiens
guaauguaguucuuuguuc

SEQ ID NO: 70927 - RNA, 19 nt, Homo sapiens
ucauguaaaugcucaaaga

SEQ ID NO: 70928 - RNA, 19 nt, Homo sapiens
gaagguguccaaauuuaau

SEQ ID NO: 70929 - RNA, 19 nt, Homo sapiens
gcacuucauaucuagauuu

SEQ ID NO: 70930 - RNA, 19 nt, Homo sapiens
caacauugccuugcauuug

SEQ ID NO: 70931 - RNA, 19 nt, Homo sapiens
ugacguccauguucuaugu

SEQ ID NO: 70932 - RNA, 19 nt, Homo sapiens
gccuugcacuccugaauuu

SEQ ID NO: 70933 - RNA, 19 nt, Homo sapiens
ugucuagaauccugcuuua

SEQ ID NO: 70934 - RNA, 19 nt, Homo sapiens
gaucuuucguugguuguuu

SEQ ID NO: 70935 - RNA, 19 nt, Homo sapiens
ugaacgcacuuaucaagga

SEQ ID NO: 70936 - RNA, 19 nt, Homo sapiens
aaaccuuuaucccugcuua

SEQ ID NO: 70937 - RNA, 19 nt, Homo sapiens
uguaaaugcucaaagaugu

SEQ ID NO: 70938 - RNA, 19 nt, Homo sapiens
gaacgcacuuaucaaggau

SEQ ID NO: 70939 - RNA, 19 nt, Homo sapiens
ggacacucuuggcucguuu

SEQ ID NO: 70940 - RNA, 19 nt, Homo sapiens
gcacaggaaaugcaagaga

SEQ ID NO: 70941 - RNA, 19 nt, Homo sapiens
gagcuuuguuacugaaaug

SEQ ID NO: 70942 - RNA, 19 nt, Homo sapiens
gaagaagcaaacaugacua

SEQ ID NO: 70943 - RNA, 19 nt, Homo sapiens
ccaacaagauggaaagaac

SEQ ID NO: 70944 - RNA, 19 nt, Homo sapiens
gaccaucuccuaucuuuua

SEQ ID NO: 70945 - RNA, 19 nt, Homo sapiens
gaaucucccagacuuguuu

SEQ ID NO: 70946 - RNA, 19 nt, Homo sapiens
caucgaggcucuugcucaa

SEQ ID NO: 70947 - RNA, 19 nt, Homo sapiens
gcagaauuuugcacaguua

SEQ ID NO: 70948 - RNA, 19 nt, Homo sapiens
cacaggaaaugcaagagaa

SEQ ID NO: 70949 - RNA, 19 nt, Homo sapiens
guaaaugcucaaagaugua

SEQ ID NO: 70950 - RNA, 19 nt, Homo sapiens
ccaucucucucccuuacua

SEQ ID NO: 70951 - RNA, 19 nt, Homo sapiens
gagaaggccaggaagaaug

SEQ ID NO: 70952 - RNA, 19 nt, Homo sapiens
gcccaagccuacagaacaa

SEQ ID NO: 70953 - RNA, 19 nt, Homo sapiens
ggaacacucccuagacaau

SEQ ID NO: 70954 - RNA, 19 nt, Homo sapiens
agacaggguuucaccaugu

SEQ ID NO: 70955 - RNA, 19 nt, Homo sapiens
ccaaaucugucuagaaucc

SEQ ID NO: 70956 - RNA, 19 nt, Homo sapiens
gggagagggcauauaaauu

SEQ ID NO: 70957 - RNA, 19 nt, Homo sapiens
caagugaaguuguaaacac

SEQ ID NO: 70958 - RNA, 19 nt, Homo sapiens
gugaagcccuuugccugua

SEQ ID NO: 70959 - RNA, 19 nt, Homo sapiens
caucaucucugccuuugag

SEQ ID NO: 70960 - RNA, 19 nt, Homo sapiens
ugauagagccuuugaucuu

SEQ ID NO: 70961 - RNA, 19 nt, Homo sapiens
ugaccagacugcacaggaa

SEQ ID NO: 70962 - RNA, 19 nt, Homo sapiens
agagaaagaacuggaauuu

SEQ ID NO: 70963 - RNA, 19 nt, Homo sapiens
ggagggaacgauuuaagga

SEQ ID NO: 70964 - RNA, 19 nt, Homo sapiens
ugccauacauguuauuguu

SEQ ID NO: 70965 - RNA, 19 nt, Homo sapiens
guaaccaccucucugucuu

SEQ ID NO: 70966 - RNA, 19 nt, Homo sapiens
ccauggaagucucaaagau

SEQ ID NO: 70967 - RNA, 19 nt, Homo sapiens
gaagcaaacaugacuagag

SEQ ID NO: 70968 - RNA, 19 nt, Homo sapiens
gaggugugauagagccuuu

SEQ ID NO: 70969 - RNA, 19 nt, Homo sapiens
ugagcgggcuugugauaug

SEQ ID NO: 70970 - RNA, 19 nt, Homo sapiens
ccaacuucccugaucuuua

SEQ ID NO: 70971 - RNA, 19 nt, Homo sapiens
guuguugagcgaauuguua

SEQ ID NO: 70972 - RNA, 19 nt, Homo sapiens
gagagaaagaacuggaauu

SEQ ID NO: 70973 - RNA, 19 nt, Homo sapiens
gcaugcauccucaucauca

SEQ ID NO: 70974 - RNA, 19 nt, Homo sapiens
ggaaagaaccacgcaggau

SEQ ID NO: 70975 - RNA, 19 nt, Homo sapiens
gcuaugacguccauguucu

SEQ ID NO: 70976 - RNA, 19 nt, Homo sapiens
gcuuucucuuucaguauua

SEQ ID NO: 70977 - RNA, 19 nt, Homo sapiens
aaccugcacuucauaucua

SEQ ID NO: 70978 - RNA, 19 nt, Homo sapiens
caucagagaaggccaggaa

SEQ ID NO: 70979 - RNA, 19 nt, Homo sapiens
ucucugagcuuuguuacug

SEQ ID NO: 70980 - RNA, 19 nt, Homo sapiens
gagcugugacuacgacuug

SEQ ID NO: 70981 - RNA, 19 nt, Homo sapiens
caaucaaccugcacuucau

SEQ ID NO: 70982 - RNA, 19 nt, Homo sapiens
ggacaucaucaccuuggaa

SEQ ID NO: 70983 - RNA, 19 nt, Homo sapiens
guggaacacucccuagaca

SEQ ID NO: 70984 - RNA, 19 nt, Homo sapiens
gacaggguuucaccauguu

SEQ ID NO: 70985 - RNA, 19 nt, Homo sapiens
caucaucaccuuggaaaug

SEQ ID NO: 70986 - RNA, 19 nt, Homo sapiens
ggaccacaguacucuaguc

SEQ ID NO: 70987 - RNA, 19 nt, Homo sapiens
uaucccugcuuaucugaaa

SEQ ID NO: 70988 - RNA, 19 nt, Homo sapiens
cuucauaucucucccuucu

SEQ ID NO: 70989 - RNA, 19 nt, Homo sapiens
gaucuuugcccauggaagu

SEQ ID NO: 70990 - RNA, 19 nt, Homo sapiens
ccauauuuguguucaguuc

SEQ ID NO: 70991 - RNA, 19 nt, Homo sapiens
gacaugauaugcggcuaug

SEQ ID NO: 70992 - RNA, 19 nt, Homo sapiens
aacacucccuagacaauaa

SEQ ID NO: 70993 - RNA, 19 nt, Homo sapiens
uugaagagccugacaagug

SEQ ID NO: 70994 - RNA, 19 nt, Homo sapiens
gagugaugccgguaaagaa

SEQ ID NO: 70995 - RNA, 19 nt, Homo sapiens
ccaccaaaucugucuagaa

SEQ ID NO: 70996 - RNA, 19 nt, Homo sapiens
aaagaaaaguugccgaaga

SEQ ID NO: 70997 - RNA, 19 nt, Homo sapiens
gacaucaucaccuuggaaa

SEQ ID NO: 70998 - RNA, 19 nt, Homo sapiens
caucaucaggaaacucuaa

SEQ ID NO: 70999 - RNA, 19 nt, Homo sapiens
ggagcgaauacuacuggua

SEQ ID NO: 71000 - RNA, 19 nt, Homo sapiens
gccuugcauuuguaccuua

SEQ ID NO: 71001 - RNA, 19 nt, Homo sapiens
cugguaaacuaauggaaga

SEQ ID NO: 71002 - RNA, 19 nt, Homo sapiens
ucaacuugcugccuaagag

SEQ ID NO: 71003 - RNA, 19 nt, Homo sapiens
ccuauugccaggaauguuu

SEQ ID NO: 71004 - RNA, 19 nt, Homo sapiens
gcaaggagaugucugaaua

SEQ ID NO: 71005 - RNA, 19 nt, Homo sapiens
caacuucccugaucuuuaa

SEQ ID NO: 71006 - RNA, 19 nt, Homo sapiens
gcacuucacuggagagaaa

SEQ ID NO: 71007 - RNA, 19 nt, Homo sapiens
gcucaaagauguaauguag

SEQ ID NO: 71008 - RNA, 19 nt, Homo sapiens
aagagaaacugcagaauuu

SEQ ID NO: 71009 - RNA, 19 nt, Homo sapiens
guauuaaacucuccuuuga

SEQ ID NO: 71010 - RNA, 19 nt, Homo sapiens
ggagagggcauauaaauuc

SEQ ID NO: 71011 - RNA, 19 nt, Homo sapiens
ucauaucucucccuucuuu

SEQ ID NO: 71012 - RNA, 19 nt, Homo sapiens
ugaagagccugacaaguga

SEQ ID NO: 71013 - RNA, 19 nt, Homo sapiens
gcacugguguugagcaaug

SEQ ID NO: 71014 - RNA, 19 nt, Homo sapiens
caccaaaucugucuagaau

SEQ ID NO: 71015 - RNA, 19 nt, Homo sapiens
caagagaaacugcagaauu

SEQ ID NO: 71016 - RNA, 19 nt, Homo sapiens
ggagagugaugccgguaaa

SEQ ID NO: 71017 - RNA, 19 nt, Homo sapiens
gaacacucccuagacaaua

SEQ ID NO: 71018 - RNA, 19 nt, Homo sapiens
gauguaauguaguucuuug

SEQ ID NO: 71019 - RNA, 19 nt, Homo sapiens
caggaagaaugguguguuu

SEQ ID NO: 71020 - RNA, 19 nt, Homo sapiens
gauagagccuuugaucuuc

SEQ ID NO: 71021 - RNA, 19 nt, Homo sapiens
ucaaggaucgggaagguua

SEQ ID NO: 71022 - RNA, 19 nt, Homo sapiens
ggaagguguccaaauuuaa

SEQ ID NO: 71023 - RNA, 19 nt, Homo sapiens
aagcaaacaugacuagaga

SEQ ID NO: 71024 - RNA, 19 nt, Homo sapiens
guaauguaguucuuuguuc

SEQ ID NO: 71025 - RNA, 19 nt, Homo sapiens
ucauguaaaugcucaaaga

SEQ ID NO: 71026 - RNA, 19 nt, Homo sapiens
gaagguguccaaauuuaau

SEQ ID NO: 71027 - RNA, 19 nt, Homo sapiens
gcacuucauaucuagauuu

SEQ ID NO: 71028 - RNA, 19 nt, Homo sapiens
caacauugccuugcauuug

SEQ ID NO: 71029 - RNA, 19 nt, Homo sapiens
ugacguccauguucuaugu

SEQ ID NO: 71030 - RNA, 19 nt, Homo sapiens
gccuugcacuccugaauuu

SEQ ID NO: 71031 - RNA, 19 nt, Homo sapiens
ugucuagaauccugcuuua

SEQ ID NO: 71032 - RNA, 19 nt, Homo sapiens
gaucuuucguugguuguuu

SEQ ID NO: 71033 - RNA, 19 nt, Homo sapiens
ugaacgcacuuaucaagga

SEQ ID NO: 71034 - RNA, 19 nt, Homo sapiens
guuguugagcgaauuauua

SEQ ID NO: 71035 - RNA, 19 nt, Homo sapiens
aaaccuuuaucccugcuua

SEQ ID NO: 71036 - RNA, 19 nt, Homo sapiens
uguaaaugcucaaagaugu

SEQ ID NO: 71037 - RNA, 19 nt, Homo sapiens
gaacgcacuuaucaaggau

SEQ ID NO: 71038 - RNA, 19 nt, Homo sapiens
ggacacucuuggcucguuu

SEQ ID NO: 71039 - RNA, 19 nt, Homo sapiens
gcacaggaaaugcaagaga

SEQ ID NO: 71040 - RNA, 19 nt, Homo sapiens
gagcuuuguuacugaaaug

SEQ ID NO: 71041 - RNA, 19 nt, Homo sapiens
gaagaagcaaacaugacua

SEQ ID NO: 71042 - RNA, 19 nt, Homo sapiens
ccaacaagauggaaagaac

SEQ ID NO: 71043 - RNA, 19 nt, Homo sapiens
gaccaucuccuaucuuuua

SEQ ID NO: 71044 - RNA, 19 nt, Homo sapiens
gaaucucccagacuuguuu

SEQ ID NO: 71045 - RNA, 19 nt, Homo sapiens
caucgaggcucuugcucaa

SEQ ID NO: 71046 - RNA, 19 nt, Homo sapiens
gcagaauuuugcacaguua

SEQ ID NO: 71047 - RNA, 19 nt, Homo sapiens
cacaggaaaugcaagagaa

SEQ ID NO: 71048 - RNA, 19 nt, Homo sapiens
guaaaugcucaaagaugua

SEQ ID NO: 71049 - RNA, 19 nt, Homo sapiens
ccaucucucucccuuacua

SEQ ID NO: 71050 - RNA, 19 nt, Homo sapiens
gagaaggccaggaagaaug

SEQ ID NO: 71051 - RNA, 19 nt, Homo sapiens
gcccaagccuacagaacaa

SEQ ID NO: 71052 - RNA, 19 nt, Homo sapiens
ggaacacucccuagacaau

SEQ ID NO: 71053 - RNA, 19 nt, Homo sapiens
agacaggguuucaccaugu

SEQ ID NO: 71054 - RNA, 19 nt, Homo sapiens
ccaaaucugucuagaaucc

SEQ ID NO: 71055 - RNA, 19 nt, Homo sapiens
gggagagggcauauaaauu

SEQ ID NO: 71056 - RNA, 19 nt, Homo sapiens
caagugaaguuguaaacac

SEQ ID NO: 71057 - RNA, 19 nt, Homo sapiens
gugaagcccuuugccugua

SEQ ID NO: 71058 - RNA, 19 nt, Homo sapiens
caucaucucugccuuugag

SEQ ID NO: 71059 - RNA, 19 nt, Homo sapiens
ugauagagccuuugaucuu

SEQ ID NO: 71060 - RNA, 19 nt, Homo sapiens
ugaccagacugcacaggaa

SEQ ID NO: 71061 - RNA, 19 nt, Homo sapiens
agagaaagaacuggaauuu

SEQ ID NO: 71062 - RNA, 19 nt, Homo sapiens
ugccauacauguuauuguu

SEQ ID NO: 71063 - RNA, 19 nt, Homo sapiens
guaaccaccucucugucuu

SEQ ID NO: 71064 - RNA, 19 nt, Homo sapiens
ccauggaagucucaaagau

SEQ ID NO: 71065 - RNA, 19 nt, Homo sapiens
gaagcaaacaugacuagag

SEQ ID NO: 71066 - RNA, 19 nt, Homo sapiens
gaggugugauagagccuuu

SEQ ID NO: 71067 - RNA, 19 nt, Homo sapiens
ugagcgggcuugugauaug

SEQ ID NO: 71068 - RNA, 19 nt, Homo sapiens
ccaacuucccugaucuuua

SEQ ID NO: 71069 - RNA, 19 nt, Homo sapiens
gagagaaagaacuggaauu

SEQ ID NO: 71070 - RNA, 19 nt, Homo sapiens
gcaugcauccucaucauca

SEQ ID NO: 71071 - RNA, 19 nt, Homo sapiens
ggaaagaaccacgcaggau

SEQ ID NO: 71072 - RNA, 19 nt, Homo sapiens
gcuaugacguccauguucu

SEQ ID NO: 71073 - RNA, 19 nt, Homo sapiens
gcuuucucuuucaguauua

SEQ ID NO: 71074 - RNA, 19 nt, Homo sapiens
aaccugcacuucauaucua

SEQ ID NO: 71075 - RNA, 19 nt, Homo sapiens
caucagagaaggccaggaa

SEQ ID NO: 71076 - RNA, 19 nt, Homo sapiens
ucucugagcuuuguuacug

SEQ ID NO: 71077 - RNA, 19 nt, Homo sapiens
gagcugugacuacgacuug

SEQ ID NO: 71078 - RNA, 19 nt, Homo sapiens
caaucaaccugcacuucau

SEQ ID NO: 71079 - RNA, 19 nt, Homo sapiens
ggacaucaucaccuuggaa

SEQ ID NO: 71080 - RNA, 19 nt, Homo sapiens
guggaacacucccuagaca

SEQ ID NO: 71081 - RNA, 19 nt, Homo sapiens
gacaggguuucaccauguu

SEQ ID NO: 71082 - RNA, 19 nt, Homo sapiens
ggaccacaguacucuaguc

SEQ ID NO: 71083 - RNA, 19 nt, Homo sapiens
caucaucaccuuggaaaug

SEQ ID NO: 71084 - RNA, 19 nt, Homo sapiens
uaucccugcuuaucugaaa

SEQ ID NO: 71085 - RNA, 19 nt, Homo sapiens
cuucauaucucucccuucu

SEQ ID NO: 71086 - RNA, 19 nt, Homo sapiens
gaucuuugcccauggaagu

SEQ ID NO: 71087 - RNA, 19 nt, Homo sapiens
ccauauuuguguucaguuc

SEQ ID NO: 71088 - RNA, 19 nt, Homo sapiens
gacaugauaugcggcuaug

SEQ ID NO: 71089 - RNA, 19 nt, Homo sapiens
aacacucccuagacaauaa

SEQ ID NO: 71090 - RNA, 19 nt, Homo sapiens
guugagcgaauuauuagaa

SEQ ID NO: 71091 - RNA, 19 nt, Homo sapiens
uugaagagccugacaagug

SEQ ID NO: 71092 - RNA, 19 nt, Homo sapiens
gagugaugccgguaaagaa

SEQ ID NO: 71093 - RNA, 19 nt, Homo sapiens
ccaccaaaucugucuagaa

SEQ ID NO: 71094 - RNA, 19 nt, Homo sapiens
gacaucaucaccuuggaaa

SEQ ID NO: 71095 - RNA, 19 nt, Homo sapiens
aaagaaaaguugccgaaga

SEQ ID NO: 71096 - RNA, 19 nt, Homo sapiens
caucaucaggaaacucuaa

SEQ ID NO: 71097 - RNA, 19 nt, Homo sapiens
gccuugcauuuguaccuua

SEQ ID NO: 71098 - RNA, 19 nt, Homo sapiens
ccuauugccaggaauguuu

SEQ ID NO: 71099 - RNA, 19 nt, Homo sapiens
ucaacuugcugccuaagag

SEQ ID NO: 71100 - RNA, 19 nt, Homo sapiens
gaaaaguugccgaagauga

SEQ ID NO: 71101 - RNA, 19 nt, Homo sapiens
ggagagaaagaacuggaau

SEQ ID NO: 71102 - RNA, 19 nt, Homo sapiens
uuucugggcuucagcaugu

SEQ ID NO: 71103 - RNA, 19 nt, Homo sapiens
ugccucagccuuccaagua

SEQ ID NO: 71104 - RNA, 19 nt, Homo sapiens
gcaaggagaugucugaaua

SEQ ID NO: 71105 - RNA, 19 nt, Homo sapiens
caacuucccugaucuuuaa

SEQ ID NO: 71106 - RNA, 19 nt, Homo sapiens
gcacuucacuggagagaaa

SEQ ID NO: 71107 - RNA, 19 nt, Homo sapiens
gcucaaagauguaauguag

SEQ ID NO: 71108 - RNA, 19 nt, Homo sapiens
aagagaaacugcagaauuu

SEQ ID NO: 71109 - RNA, 19 nt, Homo sapiens
guauuaaacucuccuuuga

SEQ ID NO: 71110 - RNA, 19 nt, Homo sapiens
ggagagggcauauaaauuc

SEQ ID NO: 71111 - RNA, 19 nt, Homo sapiens
ucauaucucucccuucuuu

SEQ ID NO: 71112 - RNA, 19 nt, Homo sapiens
ugaagagccugacaaguga

SEQ ID NO: 71113 - RNA, 19 nt, Homo sapiens
gcacugguguugagcaaug

SEQ ID NO: 71114 - RNA, 19 nt, Homo sapiens
caccaaaucugucuagaau

SEQ ID NO: 71115 - RNA, 19 nt, Homo sapiens
caagagaaacugcagaauu

SEQ ID NO: 71116 - RNA, 19 nt, Homo sapiens
ggagagugaugccgguaaa

SEQ ID NO: 71117 - RNA, 19 nt, Homo sapiens
gauguaauguaguucuuug

SEQ ID NO: 71118 - RNA, 19 nt, Homo sapiens
caggaagaaugguguguuu

SEQ ID NO: 71119 - RNA, 19 nt, Homo sapiens
gauagagccuuugaucuuc

SEQ ID NO: 71120 - RNA, 19 nt, Homo sapiens
ucaaggaucgggaagguua

SEQ ID NO: 71121 - RNA, 19 nt, Homo sapiens
ggaagguguccaaauuuaa

SEQ ID NO: 71122 - RNA, 19 nt, Homo sapiens
aagcaaacaugacuagaga

SEQ ID NO: 71123 - RNA, 19 nt, Homo sapiens
guaauguaguucuuuguuc

SEQ ID NO: 71124 - RNA, 19 nt, Homo sapiens
ucauguaaaugcucaaaga

SEQ ID NO: 71125 - RNA, 19 nt, Homo sapiens
gaagguguccaaauuuaau

SEQ ID NO: 71126 - RNA, 19 nt, Homo sapiens
gcacuucauaucuagauuu

SEQ ID NO: 71127 - RNA, 19 nt, Homo sapiens
caacauugccuugcauuug

SEQ ID NO: 71128 - RNA, 19 nt, Homo sapiens
ugacguccauguucuaugu

SEQ ID NO: 71129 - RNA, 19 nt, Homo sapiens
gccuugcacuccugaauuu

SEQ ID NO: 71130 - RNA, 19 nt, Homo sapiens
ugucuagaauccugcuuua

SEQ ID NO: 71131 - RNA, 19 nt, Homo sapiens
gaucuuucguugguuguuu

SEQ ID NO: 71132 - RNA, 19 nt, Homo sapiens
ugaacgcacuuaucaagga

SEQ ID NO: 71133 - RNA, 19 nt, Homo sapiens
aaaccuuuaucccugcuua

SEQ ID NO: 71134 - RNA, 19 nt, Homo sapiens
uguaaaugcucaaagaugu

SEQ ID NO: 71135 - RNA, 19 nt, Homo sapiens
gaacgcacuuaucaaggau

SEQ ID NO: 71136 - RNA, 19 nt, Homo sapiens
ggacacucuuggcucguuu

SEQ ID NO: 71137 - RNA, 19 nt, Homo sapiens
gcacaggaaaugcaagaga

SEQ ID NO: 71138 - RNA, 19 nt, Homo sapiens
gagcuuuguuacugaaaug

SEQ ID NO: 71139 - RNA, 19 nt, Homo sapiens
gaagaagcaaacaugacua

SEQ ID NO: 71140 - RNA, 19 nt, Homo sapiens
ccaacaagauggaaagaac

SEQ ID NO: 71141 - RNA, 19 nt, Homo sapiens
gaccaucuccuaucuuuua

SEQ ID NO: 71142 - RNA, 19 nt, Homo sapiens
gaaucucccagacuuguuu

SEQ ID NO: 71143 - RNA, 19 nt, Homo sapiens
caucgaggcucuugcucaa

SEQ ID NO: 71144 - RNA, 19 nt, Homo sapiens
gcagaauuuugcacaguua

SEQ ID NO: 71145 - RNA, 19 nt, Homo sapiens
cacaggaaaugcaagagaa

SEQ ID NO: 71146 - RNA, 19 nt, Homo sapiens
guaaaugcucaaagaugua

SEQ ID NO: 71147 - RNA, 19 nt, Homo sapiens
ccaucucucucccuuacua

SEQ ID NO: 71148 - RNA, 19 nt, Homo sapiens
gagaaggccaggaagaaug

SEQ ID NO: 71149 - RNA, 19 nt, Homo sapiens
gcccaagccuacagaacaa

SEQ ID NO: 71150 - RNA, 19 nt, Homo sapiens
agacaggguuucaccaugu

SEQ ID NO: 71151 - RNA, 19 nt, Homo sapiens
ccaaaucugucuagaaucc

SEQ ID NO: 71152 - RNA, 19 nt, Homo sapiens
gggagagggcauauaaauu

SEQ ID NO: 71153 - RNA, 19 nt, Homo sapiens
caagugaaguuguaaacac

SEQ ID NO: 71154 - RNA, 19 nt, Homo sapiens
gugaagcccuuugccugua

SEQ ID NO: 71155 - RNA, 19 nt, Homo sapiens
caucaucucugccuuugag

SEQ ID NO: 71156 - RNA, 19 nt, Homo sapiens
ugauagagccuuugaucuu

SEQ ID NO: 71157 - RNA, 19 nt, Homo sapiens
ugaccagacugcacaggaa

SEQ ID NO: 71158 - RNA, 19 nt, Homo sapiens
agagaaagaacuggaauuu

SEQ ID NO: 71159 - RNA, 19 nt, Homo sapiens
ugccauacauguuauuguu

SEQ ID NO: 71160 - RNA, 19 nt, Homo sapiens
guaaccaccucucugucuu

SEQ ID NO: 71161 - RNA, 19 nt, Homo sapiens
ccauggaagucucaaagau

SEQ ID NO: 71162 - RNA, 19 nt, Homo sapiens
gaagcaaacaugacuagag

SEQ ID NO: 71163 - RNA, 19 nt, Homo sapiens
gaggugugauagagccuuu

SEQ ID NO: 71164 - RNA, 19 nt, Homo sapiens
ugagcgggcuugugauaug

SEQ ID NO: 71165 - RNA, 19 nt, Homo sapiens
ccaacuucccugaucuuua

SEQ ID NO: 71166 - RNA, 19 nt, Homo sapiens
guuguugagcgaauuguua

SEQ ID NO: 71167 - RNA, 19 nt, Homo sapiens
gagagaaagaacuggaauu

SEQ ID NO: 71168 - RNA, 19 nt, Homo sapiens
gcaugcauccucaucauca

SEQ ID NO: 71169 - RNA, 19 nt, Homo sapiens
ggaaagaaccacgcaggau

SEQ ID NO: 71170 - RNA, 19 nt, Homo sapiens
gcuaugacguccauguucu

SEQ ID NO: 71171 - RNA, 19 nt, Homo sapiens
gcuuucucuuucaguauua

SEQ ID NO: 71172 - RNA, 19 nt, Homo sapiens
aaccugcacuucauaucua

SEQ ID NO: 71173 - RNA, 19 nt, Homo sapiens
caucagagaaggccaggaa

SEQ ID NO: 71174 - RNA, 19 nt, Homo sapiens
ucucugagcuuuguuacug

SEQ ID NO: 71175 - RNA, 19 nt, Homo sapiens
caaucaaccugcacuucau

SEQ ID NO: 71176 - RNA, 19 nt, Homo sapiens
ggacaucaucaccuuggaa

SEQ ID NO: 71177 - RNA, 19 nt, Homo sapiens
gacaggguuucaccauguu

SEQ ID NO: 71178 - RNA, 19 nt, Homo sapiens
caucaucaccuuggaaaug

SEQ ID NO: 71179 - RNA, 19 nt, Homo sapiens
ggaccacaguacucuaguc

SEQ ID NO: 71180 - RNA, 19 nt, Homo sapiens
uaucccugcuuaucugaaa

SEQ ID NO: 71181 - RNA, 19 nt, Homo sapiens
cuucauaucucucccuucu

SEQ ID NO: 71182 - RNA, 19 nt, Homo sapiens
gaucuuugcccauggaagu

SEQ ID NO: 71183 - RNA, 19 nt, Homo sapiens
ccauauuuguguucaguuc

SEQ ID NO: 71184 - RNA, 19 nt, Homo sapiens
gacaugauaugcggcuaug

SEQ ID NO: 71185 - RNA, 19 nt, Homo sapiens
uugaagagccugacaagug

SEQ ID NO: 71186 - RNA, 19 nt, Homo sapiens
gagugaugccgguaaagaa

SEQ ID NO: 71187 - RNA, 19 nt, Homo sapiens
ccaccaaaucugucuagaa

SEQ ID NO: 71188 - RNA, 19 nt, Homo sapiens
gacaucaucaccuuggaaa

SEQ ID NO: 71189 - RNA, 19 nt, Homo sapiens
aaagaaaaguugccgaaga

SEQ ID NO: 71190 - RNA, 19 nt, Homo sapiens
gccuugcauuuguaccuua

SEQ ID NO: 71191 - RNA, 19 nt, Homo sapiens
ccuauugccaggaauguuu

SEQ ID NO: 71192 - RNA, 19 nt, Homo sapiens
caucaucaggaaacucuaa

SEQ ID NO: 71193 - RNA, 19 nt, Homo sapiens
ucaacuugcugccuaagag

SEQ ID NO: 71194 - RNA, 19 nt, Homo sapiens
gaaaaguugccgaagauga

SEQ ID NO: 71195 - RNA, 19 nt, Homo sapiens
ggagagaaagaacuggaau

SEQ ID NO: 71196 - RNA, 19 nt, Homo sapiens
ugccucagccuuccaagua

SEQ ID NO: 71197 - RNA, 19 nt, Homo sapiens
ucaaucaaccugcacuuca

SEQ ID NO: 71198 - RNA, 19 nt, Homo sapiens
cagagaaggccaggaagaa

SEQ ID NO: 71199 - RNA, 19 nt, Homo sapiens
gaguggugcuagccaaaca

SEQ ID NO: 71200 - RNA, 19 nt, Homo sapiens
aacauugccuugcauuugu

SEQ ID NO: 71201 - RNA, 19 nt, Homo sapiens
gaauacugcagcacucugu

SEQ ID NO: 71202 - RNA, 19 nt, Homo sapiens
aaacgagguuccugguaca

SEQ ID NO: 71203 - RNA, 19 nt, Homo sapiens
ucugaaacuucccaacuuc

SEQ ID NO: 71204 - RNA, 19 nt, Homo sapiens
gcaaggagaugucugaaua

SEQ ID NO: 71205 - RNA, 19 nt, Homo sapiens
caacuucccugaucuuuaa

SEQ ID NO: 71206 - RNA, 19 nt, Homo sapiens
gcacuucacuggagagaaa

SEQ ID NO: 71207 - RNA, 19 nt, Homo sapiens
gcucaaagauguaauguag

SEQ ID NO: 71208 - RNA, 19 nt, Homo sapiens
aagagaaacugcagaauuu

SEQ ID NO: 71209 - RNA, 19 nt, Homo sapiens
guauuaaacucuccuuuga

SEQ ID NO: 71210 - RNA, 19 nt, Homo sapiens
gaauacuacugguaaacua

SEQ ID NO: 71211 - RNA, 19 nt, Homo sapiens
ggagagggcauauaaauuc

SEQ ID NO: 71212 - RNA, 19 nt, Homo sapiens
ucauaucucucccuucuuu

SEQ ID NO: 71213 - RNA, 19 nt, Homo sapiens
ugaagagccugacaaguga

SEQ ID NO: 71214 - RNA, 19 nt, Homo sapiens
gcacugguguugagcaaug

SEQ ID NO: 71215 - RNA, 19 nt, Homo sapiens
caccaaaucugucuagaau

SEQ ID NO: 71216 - RNA, 19 nt, Homo sapiens
caagagaaacugcagaauu

SEQ ID NO: 71217 - RNA, 19 nt, Homo sapiens
ggagagugaugccgguaaa

SEQ ID NO: 71218 - RNA, 19 nt, Homo sapiens
gagcgaauacuacugguaa

SEQ ID NO: 71219 - RNA, 19 nt, Homo sapiens
gauguaauguaguucuuug

SEQ ID NO: 71220 - RNA, 19 nt, Homo sapiens
caggaagaaugguguguuu

SEQ ID NO: 71221 - RNA, 19 nt, Homo sapiens
gauagagccuuugaucuuc

SEQ ID NO: 71222 - RNA, 19 nt, Homo sapiens
ucaaggaucgggaagguua

SEQ ID NO: 71223 - RNA, 19 nt, Homo sapiens
ggaagguguccaaauuuaa

SEQ ID NO: 71224 - RNA, 19 nt, Homo sapiens
aagcaaacaugacuagaga

SEQ ID NO: 71225 - RNA, 19 nt, Homo sapiens
guaauguaguucuuuguuc

SEQ ID NO: 71226 - RNA, 19 nt, Homo sapiens
ucauguaaaugcucaaaga

SEQ ID NO: 71227 - RNA, 19 nt, Homo sapiens
gaagguguccaaauuuaau

SEQ ID NO: 71228 - RNA, 19 nt, Homo sapiens
gcacuucauaucuagauuu

SEQ ID NO: 71229 - RNA, 19 nt, Homo sapiens
caacauugccuugcauuug

SEQ ID NO: 71230 - RNA, 19 nt, Homo sapiens
ugacguccauguucuaugu

SEQ ID NO: 71231 - RNA, 19 nt, Homo sapiens
gccuugcacuccugaauuu

SEQ ID NO: 71232 - RNA, 19 nt, Homo sapiens
ugucuagaauccugcuuua

SEQ ID NO: 71233 - RNA, 19 nt, Homo sapiens
gaucuuucguugguuguuu

SEQ ID NO: 71234 - RNA, 19 nt, Homo sapiens
ugaacgcacuuaucaagga

SEQ ID NO: 71235 - RNA, 19 nt, Homo sapiens
aaaccuuuaucccugcuua

SEQ ID NO: 71236 - RNA, 19 nt, Homo sapiens
uguaaaugcucaaagaugu

SEQ ID NO: 71237 - RNA, 19 nt, Homo sapiens
gaacgcacuuaucaaggau

SEQ ID NO: 71238 - RNA, 19 nt, Homo sapiens
ggacacucuuggcucguuu

SEQ ID NO: 71239 - RNA, 19 nt, Homo sapiens
gcacaggaaaugcaagaga

SEQ ID NO: 71240 - RNA, 19 nt, Homo sapiens
gagcuuuguuacugaaaug

SEQ ID NO: 71241 - RNA, 19 nt, Homo sapiens
gaagaagcaaacaugacua

SEQ ID NO: 71242 - RNA, 19 nt, Homo sapiens
ccaacaagauggaaagaac

SEQ ID NO: 71243 - RNA, 19 nt, Homo sapiens
gaccaucuccuaucuuuua

SEQ ID NO: 71244 - RNA, 19 nt, Homo sapiens
gaaucucccagacuuguuu

SEQ ID NO: 71245 - RNA, 19 nt, Homo sapiens
caucgaggcucuugcucaa

SEQ ID NO: 71246 - RNA, 19 nt, Homo sapiens
gcagaauuuugcacaguua

SEQ ID NO: 71247 - RNA, 19 nt, Homo sapiens
cacaggaaaugcaagagaa

SEQ ID NO: 71248 - RNA, 19 nt, Homo sapiens
guaaaugcucaaagaugua

SEQ ID NO: 71249 - RNA, 19 nt, Homo sapiens
ccaucucucucccuuacua

SEQ ID NO: 71250 - RNA, 19 nt, Homo sapiens
gagaaggccaggaagaaug

SEQ ID NO: 71251 - RNA, 19 nt, Homo sapiens
gcccaagccuacagaacaa

SEQ ID NO: 71252 - RNA, 19 nt, Homo sapiens
agacaggguuucaccaugu

SEQ ID NO: 71253 - RNA, 19 nt, Homo sapiens
ccaaaucugucuagaaucc

SEQ ID NO: 71254 - RNA, 19 nt, Homo sapiens
gggagagggcauauaaauu

SEQ ID NO: 71255 - RNA, 19 nt, Homo sapiens
caagugaaguuguaaacac

SEQ ID NO: 71256 - RNA, 19 nt, Homo sapiens
gugaagcccuuugccugua

SEQ ID NO: 71257 - RNA, 19 nt, Homo sapiens
caucaucucugccuuugag

SEQ ID NO: 71258 - RNA, 19 nt, Homo sapiens
ugauagagccuuugaucuu

SEQ ID NO: 71259 - RNA, 19 nt, Homo sapiens
ugaccagacugcacaggaa

SEQ ID NO: 71260 - RNA, 19 nt, Homo sapiens
agagaaagaacuggaauuu

SEQ ID NO: 71261 - RNA, 19 nt, Homo sapiens
ggagggaacgauuuaagga

SEQ ID NO: 71262 - RNA, 19 nt, Homo sapiens
ugccauacauguuauuguu

SEQ ID NO: 71263 - RNA, 19 nt, Homo sapiens
guaaccaccucucugucuu

SEQ ID NO: 71264 - RNA, 19 nt, Homo sapiens
ccauggaagucucaaagau

SEQ ID NO: 71265 - RNA, 19 nt, Homo sapiens
gaagcaaacaugacuagag

SEQ ID NO: 71266 - RNA, 19 nt, Homo sapiens
gaggugugauagagccuuu

SEQ ID NO: 71267 - RNA, 19 nt, Homo sapiens
ugagcgggcuugugauaug

SEQ ID NO: 71268 - RNA, 19 nt, Homo sapiens
ccaacuucccugaucuuua

SEQ ID NO: 71269 - RNA, 19 nt, Homo sapiens
guuguugagcgaauuguua

SEQ ID NO: 71270 - RNA, 19 nt, Homo sapiens
gagagaaagaacuggaauu

SEQ ID NO: 71271 - RNA, 19 nt, Homo sapiens
gcaugcauccucaucauca

SEQ ID NO: 71272 - RNA, 19 nt, Homo sapiens
ggaaagaaccacgcaggau

SEQ ID NO: 71273 - RNA, 19 nt, Homo sapiens
gcuaugacguccauguucu

SEQ ID NO: 71274 - RNA, 19 nt, Homo sapiens
gcuuucucuuucaguauua

SEQ ID NO: 71275 - RNA, 19 nt, Homo sapiens
aaccugcacuucauaucua

SEQ ID NO: 71276 - RNA, 19 nt, Homo sapiens
caucagagaaggccaggaa

SEQ ID NO: 71277 - RNA, 19 nt, Homo sapiens
ucucugagcuuuguuacug

SEQ ID NO: 71278 - RNA, 19 nt, Homo sapiens
caaucaaccugcacuucau

SEQ ID NO: 71279 - RNA, 19 nt, Homo sapiens
ggacaucaucaccuuggaa

SEQ ID NO: 71280 - RNA, 19 nt, Homo sapiens
gacaggguuucaccauguu

SEQ ID NO: 71281 - RNA, 19 nt, Homo sapiens
caucaucaccuuggaaaug

SEQ ID NO: 71282 - RNA, 19 nt, Homo sapiens
ggaccacaguacucuaguc

SEQ ID NO: 71283 - RNA, 19 nt, Homo sapiens
uaucccugcuuaucugaaa

SEQ ID NO: 71284 - RNA, 19 nt, Homo sapiens
cuucauaucucucccuucu

SEQ ID NO: 71285 - RNA, 19 nt, Homo sapiens
gaucuuugcccauggaagu

SEQ ID NO: 71286 - RNA, 19 nt, Homo sapiens
ccauauuuguguucaguuc

SEQ ID NO: 71287 - RNA, 19 nt, Homo sapiens
gacaugauaugcggcuaug

SEQ ID NO: 71288 - RNA, 19 nt, Homo sapiens
uugaagagccugacaagug

SEQ ID NO: 71289 - RNA, 19 nt, Homo sapiens
gagugaugccgguaaagaa

SEQ ID NO: 71290 - RNA, 19 nt, Homo sapiens
ccaccaaaucugucuagaa

SEQ ID NO: 71291 - RNA, 19 nt, Homo sapiens
aaagaaaaguugccgaaga

SEQ ID NO: 71292 - RNA, 19 nt, Homo sapiens
gacaucaucaccuuggaaa

SEQ ID NO: 71293 - RNA, 19 nt, Homo sapiens
cugguaaacuaauggaaga

SEQ ID NO: 71294 - RNA, 19 nt, Homo sapiens
ggagcgaauacuacuggua

SEQ ID NO: 71295 - RNA, 19 nt, Homo sapiens
caucaucaggaaacucuaa

SEQ ID NO: 71296 - RNA, 19 nt, Homo sapiens
gccuugcauuuguaccuua

SEQ ID NO: 71297 - RNA, 19 nt, Homo sapiens
ccuauugccaggaauguuu

SEQ ID NO: 71298 - RNA, 19 nt, Homo sapiens
gaaaaguugccgaagauga

SEQ ID NO: 71299 - RNA, 19 nt, Homo sapiens
ggagagaaagaacuggaau

SEQ ID NO: 71300 - RNA, 19 nt, Homo sapiens
ucaacuugcugccuaagag

SEQ ID NO: 71301 - RNA, 19 nt, Homo sapiens
ugccucagccuuccaagua

SEQ ID NO: 71302 - RNA, 19 nt, Homo sapiens
ucaaucaaccugcacuuca

SEQ ID NO: 71303 - RNA, 19 nt, Homo sapiens
cagagaaggccaggaagaa

SEQ ID NO: 71304 - RNA, 19 nt, Homo sapiens
gugagaagaugguauauuu

SEQ ID NO: 71305 - RNA, 19 nt, Homo sapiens
caauauaucugaagagcua

SEQ ID NO: 71306 - RNA, 19 nt, Homo sapiens
uaaagaagaucacagcaaa

SEQ ID NO: 71307 - RNA, 19 nt, Homo sapiens
gaacuggacuguggcauug

SEQ ID NO: 71308 - RNA, 19 nt, Homo sapiens
ggaaagcaauaaaugaaug

SEQ ID NO: 71309 - RNA, 19 nt, Homo sapiens
gaggguacuuuaagacaua

SEQ ID NO: 71310 - RNA, 19 nt, Homo sapiens
ugagauggguuuauguaua

SEQ ID NO: 71311 - RNA, 19 nt, Homo sapiens
guaagaaagugaagcaaau

SEQ ID NO: 71312 - RNA, 19 nt, Homo sapiens
cccaaacuguugauuauua

SEQ ID NO: 71313 - RNA, 19 nt, Homo sapiens
gauauacacggaugacuua

SEQ ID NO: 71314 - RNA, 19 nt, Homo sapiens
agaaacagauuccauguau

SEQ ID NO: 71315 - RNA, 19 nt, Homo sapiens
caacagaauuugaguccuu

SEQ ID NO: 71316 - RNA, 19 nt, Homo sapiens
ccacagcaccugguuauua

SEQ ID NO: 71317 - RNA, 19 nt, Homo sapiens
cagcauaaauaucuucuga

SEQ ID NO: 71318 - RNA, 19 nt, Homo sapiens
gaaagugugagcaaacuaa

SEQ ID NO: 71319 - RNA, 19 nt, Homo sapiens
gaagaugguauauuuggua

SEQ ID NO: 71320 - RNA, 19 nt, Homo sapiens
guaaugguaucuuaaagug

SEQ ID NO: 71321 - RNA, 19 nt, Homo sapiens
gaaaugaugauguggaaga

SEQ ID NO: 71322 - RNA, 19 nt, Homo sapiens
cagauuccauguauuguuu

SEQ ID NO: 71323 - RNA, 19 nt, Homo sapiens
gaaacagauuccauguauu

SEQ ID NO: 71324 - RNA, 19 nt, Homo sapiens
ccgacaagcuugaauuuau

SEQ ID NO: 71325 - RNA, 19 nt, Homo sapiens
ggaucuaccagcauaaaua

SEQ ID NO: 71326 - RNA, 19 nt, Homo sapiens
ggacaacaguuauaaaaug

SEQ ID NO: 71327 - RNA, 19 nt, Homo sapiens
ccaaagaucauacauggaa

SEQ ID NO: 71328 - RNA, 19 nt, Homo sapiens
gaccauuuaucugggauua

SEQ ID NO: 71329 - RNA, 19 nt, Homo sapiens
caagugagaagaugguaua

SEQ ID NO: 71330 - RNA, 19 nt, Homo sapiens
aaacagauuccauguauug

SEQ ID NO: 71331 - RNA, 19 nt, Homo sapiens
gaauaucccuggacaacag

SEQ ID NO: 71332 - RNA, 19 nt, Homo sapiens
gagagaaagugugagcaaa

SEQ ID NO: 71333 - RNA, 19 nt, Homo sapiens
ucaauggacucuggaauau

SEQ ID NO: 71334 - RNA, 19 nt, Homo sapiens
uaaagguggugaggcaaua

SEQ ID NO: 71335 - RNA, 19 nt, Homo sapiens
cgacaagcuugaauuuaug

SEQ ID NO: 71336 - RNA, 19 nt, Homo sapiens
uaaaguguguuucuaugug

SEQ ID NO: 71337 - RNA, 19 nt, Homo sapiens
gaaagugaagcaaaucaga

SEQ ID NO: 71338 - RNA, 19 nt, Homo sapiens
gaaacaguaugccgacaag

SEQ ID NO: 71339 - RNA, 19 nt, Homo sapiens
uaauaaagguauccaugga

SEQ ID NO: 71340 - RNA, 19 nt, Homo sapiens
gcucaaaccuuuauuuuag

SEQ ID NO: 71341 - RNA, 19 nt, Homo sapiens
ucagguaguugcaauugaa

SEQ ID NO: 71342 - RNA, 19 nt, Homo sapiens
gaauugaugcgugauguuu

SEQ ID NO: 71343 - RNA, 19 nt, Homo sapiens
gaaccaaagaucauacaug

SEQ ID NO: 71344 - RNA, 19 nt, Homo sapiens
gcauaucaguugagcuuca

SEQ ID NO: 71345 - RNA, 19 nt, Homo sapiens
gaaagguggcaacagaauu

SEQ ID NO: 71346 - RNA, 19 nt, Homo sapiens
gcaaaucagaaacuuguga

SEQ ID NO: 71347 - RNA, 19 nt, Homo sapiens
cacgggagauuucuuguug

SEQ ID NO: 71348 - RNA, 19 nt, Homo sapiens
uagaaaugaugauguggaa

SEQ ID NO: 71349 - RNA, 19 nt, Homo sapiens
ggugaagaaggaauaauuu

SEQ ID NO: 71350 - RNA, 19 nt, Homo sapiens
ggaaacauucagaaacuug

SEQ ID NO: 71351 - RNA, 19 nt, Homo sapiens
ggagaacacugaaaacuca

SEQ ID NO: 71352 - RNA, 19 nt, Homo sapiens
guagaagaguuucgugagu

SEQ ID NO: 71353 - RNA, 19 nt, Homo sapiens
gcagcaaaccucagggaaa

SEQ ID NO: 71354 - RNA, 19 nt, Homo sapiens
guaaauacacacagcaugu

SEQ ID NO: 71355 - RNA, 19 nt, Homo sapiens
gaaguggaaauguucuaaa

SEQ ID NO: 71356 - RNA, 19 nt, Homo sapiens
gaucuaccagcauaaauau

SEQ ID NO: 71357 - RNA, 19 nt, Homo sapiens
cacagcaccugguuauuau

SEQ ID NO: 71358 - RNA, 19 nt, Homo sapiens
gugccaugcugaaacagua

SEQ ID NO: 71359 - RNA, 19 nt, Homo sapiens
gggcugagcugccuguaac

SEQ ID NO: 71360 - RNA, 19 nt, Homo sapiens
ccauuuaucugggauuaug

SEQ ID NO: 71361 - RNA, 19 nt, Homo sapiens
aaagguggcaacagaauuu

SEQ ID NO: 71362 - RNA, 19 nt, Homo sapiens
gaaacauucagaaacuuga

SEQ ID NO: 71363 - RNA, 19 nt, Homo sapiens
gcggaugggugcuauugug

SEQ ID NO: 71364 - RNA, 19 nt, Homo sapiens
gugaggcgguuguagaaga

SEQ ID NO: 71365 - RNA, 19 nt, Homo sapiens
gaugcugugcuaugaauuu

SEQ ID NO: 71366 - RNA, 19 nt, Homo sapiens
gcaaagaaacagauuccau

SEQ ID NO: 71367 - RNA, 19 nt, Homo sapiens
gcaccugguuauuauucuu

SEQ ID NO: 71368 - RNA, 19 nt, Homo sapiens
aaaguguguuucuauguga

SEQ ID NO: 71369 - RNA, 19 nt, Homo sapiens
guggaaauguucuaaaggu

SEQ ID NO: 71370 - RNA, 19 nt, Homo sapiens
gaugguauauuugguacug

SEQ ID NO: 71371 - RNA, 19 nt, Homo sapiens
gagaagaugguauauuugg

SEQ ID NO: 71372 - RNA, 19 nt, Homo sapiens
ccaaacuguugauuauuag

SEQ ID NO: 71373 - RNA, 19 nt, Homo sapiens
gaaauaugaagucaggaau

SEQ ID NO: 71374 - RNA, 19 nt, Homo sapiens
gaagcaaaucagaaacuug

SEQ ID NO: 71375 - RNA, 19 nt, Homo sapiens
acagugguguugaugauga

SEQ ID NO: 71376 - RNA, 19 nt, Homo sapiens
gagccauggugaagaagga

SEQ ID NO: 71377 - RNA, 19 nt, Homo sapiens
gaugcgugauguuucuaaa

SEQ ID NO: 71378 - RNA, 19 nt, Homo sapiens
ccagcaauauaucugaaga

SEQ ID NO: 71379 - RNA, 19 nt, Homo sapiens
gagaaagugugagcaaacu

SEQ ID NO: 71380 - RNA, 19 nt, Homo sapiens
ugacuuaacugcauuuuag

SEQ ID NO: 71381 - RNA, 19 nt, Homo sapiens
uuaagacuguguauucuag

SEQ ID NO: 71382 - RNA, 19 nt, Homo sapiens
uaaaagcacuggaaugaca

SEQ ID NO: 71383 - RNA, 19 nt, Homo sapiens
gcauguaaugguaucuuaa

SEQ ID NO: 71384 - RNA, 19 nt, Homo sapiens
ugaagcaaaucagaaacuu

SEQ ID NO: 71385 - RNA, 19 nt, Homo sapiens
gccuguaacuugagaguag

SEQ ID NO: 71386 - RNA, 19 nt, Homo sapiens
ugagcugccuguaacuuga

SEQ ID NO: 71387 - RNA, 19 nt, Homo sapiens
ggaggccgacuucuuguau

SEQ ID NO: 71388 - RNA, 19 nt, Homo sapiens
gggaaacauucagaaacuu

SEQ ID NO: 71389 - RNA, 19 nt, Homo sapiens
gaaguuuacaaucaaagga

SEQ ID NO: 71390 - RNA, 19 nt, Homo sapiens
gaagaacuuaggcaucugu

SEQ ID NO: 71391 - RNA, 19 nt, Homo sapiens
uuacagcuuucaugauuag

SEQ ID NO: 71392 - RNA, 19 nt, Homo sapiens
agacaugacucagccuguu

SEQ ID NO: 71393 - RNA, 19 nt, Homo sapiens
gugaugcugugcuaugaau

SEQ ID NO: 71394 - RNA, 19 nt, Homo sapiens
guacuguauuucccucuca

SEQ ID NO: 71395 - RNA, 19 nt, Homo sapiens
cagcaaaccucagggaaac

SEQ ID NO: 71396 - RNA, 19 nt, Homo sapiens
cacacagcauguaauggua

SEQ ID NO: 71397 - RNA, 19 nt, Homo sapiens
ugauuugucccuaugcaua

SEQ ID NO: 71398 - RNA, 19 nt, Homo sapiens
gaugauguggaagaacuua

SEQ ID NO: 71399 - RNA, 19 nt, Homo sapiens
agacagugguguugaugau

SEQ ID NO: 71400 - RNA, 19 nt, Homo sapiens
gacagacagugguguugau

SEQ ID NO: 71401 - RNA, 19 nt, Homo sapiens
gacucagccuguuccauga

SEQ ID NO: 71402 - RNA, 19 nt, Homo sapiens
gacauacuccuuccaucaa

SEQ ID NO: 71403 - RNA, 19 nt, Homo sapiens
ugaaauaugaagucaggaa

SEQ ID NO: 71404 - RNA, 19 nt, Homo sapiens
gugagaagaugguauauuu

SEQ ID NO: 71405 - RNA, 19 nt, Homo sapiens
caauauaucugaagagcua

SEQ ID NO: 71406 - RNA, 19 nt, Homo sapiens
uaaagaagaucacagcaaa

SEQ ID NO: 71407 - RNA, 19 nt, Homo sapiens
gaacuggacuguggcauug

SEQ ID NO: 71408 - RNA, 19 nt, Homo sapiens
ggaaagcaauaaaugaaug

SEQ ID NO: 71409 - RNA, 19 nt, Homo sapiens
gaggguacuuuaagacaua

SEQ ID NO: 71410 - RNA, 19 nt, Homo sapiens
ugagauggguuuauguaua

SEQ ID NO: 71411 - RNA, 19 nt, Homo sapiens
guaagaaagugaagcaaau

SEQ ID NO: 71412 - RNA, 19 nt, Homo sapiens
cccaaacuguugauuauua

SEQ ID NO: 71413 - RNA, 19 nt, Homo sapiens
gauauacacggaugacuua

SEQ ID NO: 71414 - RNA, 19 nt, Homo sapiens
agaaacagauuccauguau

SEQ ID NO: 71415 - RNA, 19 nt, Homo sapiens
caacagaauuugaguccuu

SEQ ID NO: 71416 - RNA, 19 nt, Homo sapiens
ccacagcaccugguuauua

SEQ ID NO: 71417 - RNA, 19 nt, Homo sapiens
cagcauaaauaucuucuga

SEQ ID NO: 71418 - RNA, 19 nt, Homo sapiens
gaaagugugagcaaacuaa

SEQ ID NO: 71419 - RNA, 19 nt, Homo sapiens
gaagaugguauauuuggua

SEQ ID NO: 71420 - RNA, 19 nt, Homo sapiens
guaaugguaucuuaaagug

SEQ ID NO: 71421 - RNA, 19 nt, Homo sapiens
gaaaugaugauguggaaga

SEQ ID NO: 71422 - RNA, 19 nt, Homo sapiens
cagauuccauguauuguuu

SEQ ID NO: 71423 - RNA, 19 nt, Homo sapiens
gaaacagauuccauguauu

SEQ ID NO: 71424 - RNA, 19 nt, Homo sapiens
ccgacaagcuugaauuuau

SEQ ID NO: 71425 - RNA, 19 nt, Homo sapiens
ggaucuaccagcauaaaua

SEQ ID NO: 71426 - RNA, 19 nt, Homo sapiens
ggacaacaguuauaaaaug

SEQ ID NO: 71427 - RNA, 19 nt, Homo sapiens
ccaaagaucauacauggaa

SEQ ID NO: 71428 - RNA, 19 nt, Homo sapiens
gaccauuuaucugggauua

SEQ ID NO: 71429 - RNA, 19 nt, Homo sapiens
caagugagaagaugguaua

SEQ ID NO: 71430 - RNA, 19 nt, Homo sapiens
aaacagauuccauguauug

SEQ ID NO: 71431 - RNA, 19 nt, Homo sapiens
gaauaucccuggacaacag

SEQ ID NO: 71432 - RNA, 19 nt, Homo sapiens
gagagaaagugugagcaaa

SEQ ID NO: 71433 - RNA, 19 nt, Homo sapiens
ucaauggacucuggaauau

SEQ ID NO: 71434 - RNA, 19 nt, Homo sapiens
uaaagguggugaggcaaua

SEQ ID NO: 71435 - RNA, 19 nt, Homo sapiens
cgacaagcuugaauuuaug

SEQ ID NO: 71436 - RNA, 19 nt, Homo sapiens
uaaaguguguuucuaugug

SEQ ID NO: 71437 - RNA, 19 nt, Homo sapiens
gaaagugaagcaaaucaga

SEQ ID NO: 71438 - RNA, 19 nt, Homo sapiens
uaauaaagguauccaugga

SEQ ID NO: 71439 - RNA, 19 nt, Homo sapiens
gaaacaguaugccgacaag

SEQ ID NO: 71440 - RNA, 19 nt, Homo sapiens
gcucaaaccuuuauuuuag

SEQ ID NO: 71441 - RNA, 19 nt, Homo sapiens
ucagguaguugcaauugaa

SEQ ID NO: 71442 - RNA, 19 nt, Homo sapiens
gaaccaaagaucauacaug

SEQ ID NO: 71443 - RNA, 19 nt, Homo sapiens
gaauugaugcgugauguuu

SEQ ID NO: 71444 - RNA, 19 nt, Homo sapiens
gcauaucaguugagcuuca

SEQ ID NO: 71445 - RNA, 19 nt, Homo sapiens
gaaagguggcaacagaauu

SEQ ID NO: 71446 - RNA, 19 nt, Homo sapiens
gcaaaucagaaacuuguga

SEQ ID NO: 71447 - RNA, 19 nt, Homo sapiens
cacgggagauuucuuguug

SEQ ID NO: 71448 - RNA, 19 nt, Homo sapiens
ggagaacacugaaaacuca

SEQ ID NO: 71449 - RNA, 19 nt, Homo sapiens
uagaaaugaugauguggaa

SEQ ID NO: 71450 - RNA, 19 nt, Homo sapiens
ggugaagaaggaauaauuu

SEQ ID NO: 71451 - RNA, 19 nt, Homo sapiens
ggaaacauucagaaacuug

SEQ ID NO: 71452 - RNA, 19 nt, Homo sapiens
gcagcaaaccucagggaaa

SEQ ID NO: 71453 - RNA, 19 nt, Homo sapiens
guaaauacacacagcaugu

SEQ ID NO: 71454 - RNA, 19 nt, Homo sapiens
gaaguggaaauguucuaaa

SEQ ID NO: 71455 - RNA, 19 nt, Homo sapiens
gaucuaccagcauaaauau

SEQ ID NO: 71456 - RNA, 19 nt, Homo sapiens
cacagcaccugguuauuau

SEQ ID NO: 71457 - RNA, 19 nt, Homo sapiens
gugccaugcugaaacagua

SEQ ID NO: 71458 - RNA, 19 nt, Homo sapiens
gggcugagcugccuguaac

SEQ ID NO: 71459 - RNA, 19 nt, Homo sapiens
ccauuuaucugggauuaug

SEQ ID NO: 71460 - RNA, 19 nt, Homo sapiens
aaagguggcaacagaauuu

SEQ ID NO: 71461 - RNA, 19 nt, Homo sapiens
gaaacauucagaaacuuga

SEQ ID NO: 71462 - RNA, 19 nt, Homo sapiens
gcggaugggugcuauugug

SEQ ID NO: 71463 - RNA, 19 nt, Homo sapiens
gaugcugugcuaugaauuu

SEQ ID NO: 71464 - RNA, 19 nt, Homo sapiens
gcaaagaaacagauuccau

SEQ ID NO: 71465 - RNA, 19 nt, Homo sapiens
gcaccugguuauuauucuu

SEQ ID NO: 71466 - RNA, 19 nt, Homo sapiens
aaaguguguuucuauguga

SEQ ID NO: 71467 - RNA, 19 nt, Homo sapiens
guggaaauguucuaaaggu

SEQ ID NO: 71468 - RNA, 19 nt, Homo sapiens
gaugguauauuugguacug

SEQ ID NO: 71469 - RNA, 19 nt, Homo sapiens
gagaagaugguauauuugg

SEQ ID NO: 71470 - RNA, 19 nt, Homo sapiens
ccaaacuguugauuauuag

SEQ ID NO: 71471 - RNA, 19 nt, Homo sapiens
gaaauaugaagucaggaau

SEQ ID NO: 71472 - RNA, 19 nt, Homo sapiens
gaagcaaaucagaaacuug

SEQ ID NO: 71473 - RNA, 19 nt, Homo sapiens
acagugguguugaugauga

SEQ ID NO: 71474 - RNA, 19 nt, Homo sapiens
gagccauggugaagaagga

SEQ ID NO: 71475 - RNA, 19 nt, Homo sapiens
gaugcgugauguuucuaaa

SEQ ID NO: 71476 - RNA, 19 nt, Homo sapiens
ccagcaauauaucugaaga

SEQ ID NO: 71477 - RNA, 19 nt, Homo sapiens
gagaaagugugagcaaacu

SEQ ID NO: 71478 - RNA, 19 nt, Homo sapiens
ugacuuaacugcauuuuag

SEQ ID NO: 71479 - RNA, 19 nt, Homo sapiens
uuaagacuguguauucuag

SEQ ID NO: 71480 - RNA, 19 nt, Homo sapiens
uaaaagcacuggaaugaca

SEQ ID NO: 71481 - RNA, 19 nt, Homo sapiens
gcauguaaugguaucuuaa

SEQ ID NO: 71482 - RNA, 19 nt, Homo sapiens
ugaagcaaaucagaaacuu

SEQ ID NO: 71483 - RNA, 19 nt, Homo sapiens
gccuguaacuugagaguag

SEQ ID NO: 71484 - RNA, 19 nt, Homo sapiens
ugagcugccuguaacuuga

SEQ ID NO: 71485 - RNA, 19 nt, Homo sapiens
ggaggccgacuucuuguau

SEQ ID NO: 71486 - RNA, 19 nt, Homo sapiens
gggaaacauucagaaacuu

SEQ ID NO: 71487 - RNA, 19 nt, Homo sapiens
gaaguuuacaaucaaagga

SEQ ID NO: 71488 - RNA, 19 nt, Homo sapiens
gaagaacuuaggcaucugu

SEQ ID NO: 71489 - RNA, 19 nt, Homo sapiens
uuacagcuuucaugauuag

SEQ ID NO: 71490 - RNA, 19 nt, Homo sapiens
agacaugacucagccuguu

SEQ ID NO: 71491 - RNA, 19 nt, Homo sapiens
gugaugcugugcuaugaau

SEQ ID NO: 71492 - RNA, 19 nt, Homo sapiens
guacuguauuucccucuca

SEQ ID NO: 71493 - RNA, 19 nt, Homo sapiens
cagcaaaccucagggaaac

SEQ ID NO: 71494 - RNA, 19 nt, Homo sapiens
cacacagcauguaauggua

SEQ ID NO: 71495 - RNA, 19 nt, Homo sapiens
ugauuugucccuaugcaua

SEQ ID NO: 71496 - RNA, 19 nt, Homo sapiens
gaugauguggaagaacuua

SEQ ID NO: 71497 - RNA, 19 nt, Homo sapiens
agacagugguguugaugau

SEQ ID NO: 71498 - RNA, 19 nt, Homo sapiens
gacagacagugguguugau

SEQ ID NO: 71499 - RNA, 19 nt, Homo sapiens
gacucagccuguuccauga

SEQ ID NO: 71500 - RNA, 19 nt, Homo sapiens
gacauacuccuuccaucaa

SEQ ID NO: 71501 - RNA, 19 nt, Homo sapiens
ugaaauaugaagucaggaa

SEQ ID NO: 71502 - RNA, 19 nt, Homo sapiens
caaaucagaaacuugugaa

SEQ ID NO: 71503 - RNA, 19 nt, Homo sapiens
gaaagcaauaaaugaaugg

SEQ ID NO: 71504 - RNA, 19 nt, Homo sapiens
gaagagaucuauccaauaa

SEQ ID NO: 71505 - RNA, 19 nt, Homo sapiens
guacagcaaucauuugaaa

SEQ ID NO: 71506 - RNA, 19 nt, Homo sapiens
ggacaaaugcuucuucaaa

SEQ ID NO: 71507 - RNA, 19 nt, Homo sapiens
uaguacagcuugcauauuu

SEQ ID NO: 71508 - RNA, 19 nt, Homo sapiens
ucacaugcuuccagaaaua

SEQ ID NO: 71509 - RNA, 19 nt, Homo sapiens
agaaagagcugaagagauc

SEQ ID NO: 71510 - RNA, 19 nt, Homo sapiens
ggacuauaguguagaugua

SEQ ID NO: 71511 - RNA, 19 nt, Homo sapiens
gaagguacagcaaucauuu

SEQ ID NO: 71512 - RNA, 19 nt, Homo sapiens
ggaaguauuucggaaggua

SEQ ID NO: 71513 - RNA, 19 nt, Homo sapiens
ggaagaugcuguuuacaag

SEQ ID NO: 71514 - RNA, 19 nt, Homo sapiens
ucacacaacucaucacaug

SEQ ID NO: 71515 - RNA, 19 nt, Homo sapiens
ggaggaagaugcuguuuac

SEQ ID NO: 71516 - RNA, 19 nt, Homo sapiens
cagaugugcugcuuuauga

SEQ ID NO: 71517 - RNA, 19 nt, Homo sapiens
gaagaauuccugagacuau

SEQ ID NO: 71518 - RNA, 19 nt, Homo sapiens
gaauggagcugacuuugac

SEQ ID NO: 71519 - RNA, 19 nt, Homo sapiens
gagacuauguaaagaaaga

SEQ ID NO: 71520 - RNA, 19 nt, Homo sapiens
gaacugugcaugaugagaa

SEQ ID NO: 71521 - RNA, 19 nt, Homo sapiens
gcccagcccuccuuaauca

SEQ ID NO: 71522 - RNA, 19 nt, Homo sapiens
aaccagaugugcugcuuua

SEQ ID NO: 71523 - RNA, 19 nt, Homo sapiens
gggcaaagauuuccucacu

SEQ ID NO: 71524 - RNA, 19 nt, Homo sapiens
ccaccuagaggaaguauuu

SEQ ID NO: 71525 - RNA, 19 nt, Homo sapiens
ggaauggagcugacuuuga

SEQ ID NO: 71526 - RNA, 19 nt, Homo sapiens
gcucucaucauaugcaaua

SEQ ID NO: 71527 - RNA, 19 nt, Homo sapiens
acaaugggcucuaucuuca

SEQ ID NO: 71528 - RNA, 19 nt, Homo sapiens
gcggaacugugcaugauga

SEQ ID NO: 71529 - RNA, 19 nt, Homo sapiens
gagcacaaguccucugaca

SEQ ID NO: 71530 - RNA, 19 nt, Homo sapiens
cauaugcaauacagaguuu

SEQ ID NO: 71531 - RNA, 19 nt, Homo sapiens
aggagcaccuucauuagua

SEQ ID NO: 71532 - RNA, 19 nt, Homo sapiens
gacaaaugcuucuucaaac

SEQ ID NO: 71533 - RNA, 19 nt, Homo sapiens
uaacauagaccaaauaucc

SEQ ID NO: 71534 - RNA, 19 nt, Homo sapiens
guacagcuugcauauuuaa

SEQ ID NO: 71535 - RNA, 19 nt, Homo sapiens
ugacagcacauucuuggua

SEQ ID NO: 71536 - RNA, 19 nt, Homo sapiens
cagaugcccucaagcuuug

SEQ ID NO: 71537 - RNA, 19 nt, Homo sapiens
gaacuggaaggaagaggaa

SEQ ID NO: 71538 - RNA, 19 nt, Homo sapiens
ggaagguacagcaaucauu

SEQ ID NO: 71539 - RNA, 19 nt, Homo sapiens
gcagaaggcaaccacagaa

SEQ ID NO: 71540 - RNA, 19 nt, Homo sapiens
ggucuggacuauaguguag

SEQ ID NO: 71541 - RNA, 19 nt, Homo sapiens
gaagaugcuguuuacaaga

SEQ ID NO: 71542 - RNA, 19 nt, Homo sapiens
cugaagagaucuauccaau

SEQ ID NO: 71543 - RNA, 19 nt, Homo sapiens
ucaaaugcccaccauagaa

SEQ ID NO: 71544 - RNA, 19 nt, Homo sapiens
ggagcugacuuugacauca

SEQ ID NO: 71545 - RNA, 19 nt, Homo sapiens
acgccuggcucucaucaua

SEQ ID NO: 71546 - RNA, 19 nt, Homo sapiens
agagaucuauccaauaaag

SEQ ID NO: 71547 - RNA, 19 nt, Homo sapiens
guaaagaaagagcugaaga

SEQ ID NO: 71548 - RNA, 19 nt, Homo sapiens
ggacaaacccaaggucauc

SEQ ID NO: 71549 - RNA, 19 nt, Homo sapiens
gagggaaucugcggaacug

SEQ ID NO: 71550 - RNA, 19 nt, Homo sapiens
gcacacgccuggcucucau

SEQ ID NO: 71551 - RNA, 19 nt, Homo sapiens
ugaagagaucuauccaaua

SEQ ID NO: 71552 - RNA, 19 nt, Homo sapiens
agacaaaguucgggucaug

SEQ ID NO: 71553 - RNA, 19 nt, Homo sapiens
gcucaaaugcccaccauag

SEQ ID NO: 71554 - RNA, 19 nt, Homo sapiens
cugagaaccuggaggaaga

SEQ ID NO: 71555 - RNA, 19 nt, Homo sapiens
caucacaugcuuccagaaa

SEQ ID NO: 71556 - RNA, 19 nt, Homo sapiens
ggaugaaggagcuacuuga

SEQ ID NO: 71557 - RNA, 19 nt, Homo sapiens
ccucuuuccuggcaauuga

SEQ ID NO: 71558 - RNA, 19 nt, Homo sapiens
auacagaguuugaccaucu

SEQ ID NO: 71559 - RNA, 19 nt, Homo sapiens
gcuuuguccucaugaagaa

SEQ ID NO: 71560 - RNA, 19 nt, Homo sapiens
gcgcugagggcauuugcua

SEQ ID NO: 71561 - RNA, 19 nt, Homo sapiens
gaggaauggagcugacuuu

SEQ ID NO: 71562 - RNA, 19 nt, Homo sapiens
cugagacuauguaaagaaa

SEQ ID NO: 71563 - RNA, 19 nt, Homo sapiens
ggucauggcagacucuaug

SEQ ID NO: 71564 - RNA, 19 nt, Homo sapiens
acagaugcccucaagcuuu

SEQ ID NO: 71565 - RNA, 19 nt, Homo sapiens
caagagaagcaacguaugg

SEQ ID NO: 71566 - RNA, 19 nt, Homo sapiens
gcacaaugggcucuaucuu

SEQ ID NO: 71567 - RNA, 19 nt, Homo sapiens
caggacaaaugcuucuuca

SEQ ID NO: 71568 - RNA, 19 nt, Homo sapiens
uggaaucccugggcaaaga

SEQ ID NO: 71569 - RNA, 19 nt, Homo sapiens
caauaaaggagagaaacaa

SEQ ID NO: 71570 - RNA, 19 nt, Homo sapiens
caacguauggcaggacaaa

SEQ ID NO: 71571 - RNA, 19 nt, Homo sapiens
guguagauguagaagagaa

SEQ ID NO: 71572 - RNA, 19 nt, Homo sapiens
gaauuccugagacuaugua

SEQ ID NO: 71573 - RNA, 19 nt, Homo sapiens
ucacugguguuuuggauaa

SEQ ID NO: 71574 - RNA, 19 nt, Homo sapiens
aguacagcuugcauauuua

SEQ ID NO: 71575 - RNA, 19 nt, Homo sapiens
cagaggcuguucccuaugg

SEQ ID NO: 71576 - RNA, 19 nt, Homo sapiens
gcacauucuugguacucau

SEQ ID NO: 71577 - RNA, 19 nt, Homo sapiens
caagcuuuguccucaugaa

SEQ ID NO: 71578 - RNA, 19 nt, Homo sapiens
gcaagagaagcaacguaug

SEQ ID NO: 71579 - RNA, 19 nt, Homo sapiens
ccagaugugcugcuuuaug

SEQ ID NO: 71580 - RNA, 19 nt, Homo sapiens
uaguguagauguagaagag

SEQ ID NO: 71581 - RNA, 19 nt, Homo sapiens
aaagaaagagcugaagaga

SEQ ID NO: 71582 - RNA, 19 nt, Homo sapiens
uaaagaaagagcugaagag

SEQ ID NO: 71583 - RNA, 19 nt, Homo sapiens
gcaggacaaaugcuucuuc

SEQ ID NO: 71584 - RNA, 19 nt, Homo sapiens
cagcuugcauauuuaacau

SEQ ID NO: 71585 - RNA, 19 nt, Homo sapiens
ggagcaccuucauuaguac

SEQ ID NO: 71586 - RNA, 19 nt, Homo sapiens
cacaaugggcucuaucuuc

SEQ ID NO: 71587 - RNA, 19 nt, Homo sapiens
uugagggucuggacuauag

SEQ ID NO: 71588 - RNA, 19 nt, Homo sapiens
auagaacgacuguccauga

SEQ ID NO: 71589 - RNA, 19 nt, Homo sapiens
cagaaggcaaccacagaaa

SEQ ID NO: 71590 - RNA, 19 nt, Homo sapiens
uggaggaagaugcuguuua

SEQ ID NO: 71591 - RNA, 19 nt, Homo sapiens
cacuuaagguguuggaauc

SEQ ID NO: 71592 - RNA, 19 nt, Homo sapiens
ccaauaaaggagagaaaca

SEQ ID NO: 71593 - RNA, 19 nt, Homo sapiens
gccuggcucucaucauaug

SEQ ID NO: 71594 - RNA, 19 nt, Homo sapiens
ccacuuaagguguuggaau

SEQ ID NO: 71595 - RNA, 19 nt, Homo sapiens
aacccaaggucaucauugu

SEQ ID NO: 71596 - RNA, 19 nt, Homo sapiens
gagcugacuuugacaucac

SEQ ID NO: 71597 - RNA, 19 nt, Homo sapiens
caaaugcccaccauagaac

SEQ ID NO: 71598 - RNA, 19 nt, Homo sapiens
aggaagaugcuguuuacaa

SEQ ID NO: 71599 - RNA, 19 nt, Homo sapiens
gauguagaagagaaucuga

SEQ ID NO: 71600 - RNA, 19 nt, Homo sapiens
ggaacaaaauguacugaac

SEQ ID NO: 71601 - RNA, 19 nt, Homo sapiens
gggaugaaggagcuacuug

SEQ ID NO: 71602 - RNA, 19 nt, Homo sapiens
aaaauguacugaacuggaa

SEQ ID NO: 71603 - RNA, 19 nt, Homo sapiens
gcuguucccuauggcagaa

SEQ ID NO: 71604 - RNA, 19 nt, Homo sapiens
gaagagaucuauccaauaa

SEQ ID NO: 71605 - RNA, 19 nt, Homo sapiens
guacagcaaucauuugaaa

SEQ ID NO: 71606 - RNA, 19 nt, Homo sapiens
ggacaaaugcuucuucaaa

SEQ ID NO: 71607 - RNA, 19 nt, Homo sapiens
uaguacagcuugcauauuu

SEQ ID NO: 71608 - RNA, 19 nt, Homo sapiens
ucacaugcuuccagaaaua

SEQ ID NO: 71609 - RNA, 19 nt, Homo sapiens
agaaagagcugaagagauc

SEQ ID NO: 71610 - RNA, 19 nt, Homo sapiens
ggacuauaguguagaugua

SEQ ID NO: 71611 - RNA, 19 nt, Homo sapiens
gaagguacagcaaucauuu

SEQ ID NO: 71612 - RNA, 19 nt, Homo sapiens
ggaaguauuucggaaggua

SEQ ID NO: 71613 - RNA, 19 nt, Homo sapiens
ggaagaugcuguuuacaag

SEQ ID NO: 71614 - RNA, 19 nt, Homo sapiens
gaucucaccuguuggaaug

SEQ ID NO: 71615 - RNA, 19 nt, Homo sapiens
ucacacaacucaucacaug

SEQ ID NO: 71616 - RNA, 19 nt, Homo sapiens
ggaggaagaugcuguuuac

SEQ ID NO: 71617 - RNA, 19 nt, Homo sapiens
cagaugugcugcuuuauga

SEQ ID NO: 71618 - RNA, 19 nt, Homo sapiens
gaagaauuccugagacuau

SEQ ID NO: 71619 - RNA, 19 nt, Homo sapiens
gaauggagcugacuuugac

SEQ ID NO: 71620 - RNA, 19 nt, Homo sapiens
gagacuauguaaagaaaga

SEQ ID NO: 71621 - RNA, 19 nt, Homo sapiens
gaacugugcaugaugagaa

SEQ ID NO: 71622 - RNA, 19 nt, Homo sapiens
gcccagcccuccuuaauca

SEQ ID NO: 71623 - RNA, 19 nt, Homo sapiens
aaccagaugugcugcuuua

SEQ ID NO: 71624 - RNA, 19 nt, Homo sapiens
gggcaaagauuuccucacu

SEQ ID NO: 71625 - RNA, 19 nt, Homo sapiens
ccaccuagaggaaguauuu

SEQ ID NO: 71626 - RNA, 19 nt, Homo sapiens
ggaauggagcugacuuuga

SEQ ID NO: 71627 - RNA, 19 nt, Homo sapiens
gcucucaucauaugcaaua

SEQ ID NO: 71628 - RNA, 19 nt, Homo sapiens
acaaugggcucuaucuuca

SEQ ID NO: 71629 - RNA, 19 nt, Homo sapiens
gcggaacugugcaugauga

SEQ ID NO: 71630 - RNA, 19 nt, Homo sapiens
gagcacaaguccucugaca

SEQ ID NO: 71631 - RNA, 19 nt, Homo sapiens
cauaugcaauacagaguuu

SEQ ID NO: 71632 - RNA, 19 nt, Homo sapiens
aggagcaccuucauuagua

SEQ ID NO: 71633 - RNA, 19 nt, Homo sapiens
gcagaagccuuugugaucu

SEQ ID NO: 71634 - RNA, 19 nt, Homo sapiens
gacaaaugcuucuucaaac

SEQ ID NO: 71635 - RNA, 19 nt, Homo sapiens
uaacauagaccaaauaucc

SEQ ID NO: 71636 - RNA, 19 nt, Homo sapiens
guacagcuugcauauuuaa

SEQ ID NO: 71637 - RNA, 19 nt, Homo sapiens
ugacagcacauucuuggua

SEQ ID NO: 71638 - RNA, 19 nt, Homo sapiens
cagaugcccucaagcuuug

SEQ ID NO: 71639 - RNA, 19 nt, Homo sapiens
gaacuggaaggaagaggaa

SEQ ID NO: 71640 - RNA, 19 nt, Homo sapiens
ggaagguacagcaaucauu

SEQ ID NO: 71641 - RNA, 19 nt, Homo sapiens
ggucuggacuauaguguag

SEQ ID NO: 71642 - RNA, 19 nt, Homo sapiens
gaagaugcuguuuacaaga

SEQ ID NO: 71643 - RNA, 19 nt, Homo sapiens
cugaagagaucuauccaau

SEQ ID NO: 71644 - RNA, 19 nt, Homo sapiens
ucaaaugcccaccauagaa

SEQ ID NO: 71645 - RNA, 19 nt, Homo sapiens
ggagcugacuuugacauca

SEQ ID NO: 71646 - RNA, 19 nt, Homo sapiens
acgccuggcucucaucaua

SEQ ID NO: 71647 - RNA, 19 nt, Homo sapiens
agagaucuauccaauaaag

SEQ ID NO: 71648 - RNA, 19 nt, Homo sapiens
guaaagaaagagcugaaga

SEQ ID NO: 71649 - RNA, 19 nt, Homo sapiens
ggacaaacccaaggucauc

SEQ ID NO: 71650 - RNA, 19 nt, Homo sapiens
gagggaaucugcggaacug

SEQ ID NO: 71651 - RNA, 19 nt, Homo sapiens
ggaaugcacuaauguuuuc

SEQ ID NO: 71652 - RNA, 19 nt, Homo sapiens
gcacacgccuggcucucau

SEQ ID NO: 71653 - RNA, 19 nt, Homo sapiens
ugaagagaucuauccaaua

SEQ ID NO: 71654 - RNA, 19 nt, Homo sapiens
agacaaaguucgggucaug

SEQ ID NO: 71655 - RNA, 19 nt, Homo sapiens
gcucaaaugcccaccauag

SEQ ID NO: 71656 - RNA, 19 nt, Homo sapiens
cugagaaccuggaggaaga

SEQ ID NO: 71657 - RNA, 19 nt, Homo sapiens
caucacaugcuuccagaaa

SEQ ID NO: 71658 - RNA, 19 nt, Homo sapiens
ggaugaaggagcuacuuga

SEQ ID NO: 71659 - RNA, 19 nt, Homo sapiens
ccucuuuccuggcaauuga

SEQ ID NO: 71660 - RNA, 19 nt, Homo sapiens
ggcagaagccuuugugauc

SEQ ID NO: 71661 - RNA, 19 nt, Homo sapiens
auacagaguuugaccaucu

SEQ ID NO: 71662 - RNA, 19 nt, Homo sapiens
gcuuuguccucaugaagaa

SEQ ID NO: 71663 - RNA, 19 nt, Homo sapiens
gcgcugagggcauuugcua

SEQ ID NO: 71664 - RNA, 19 nt, Homo sapiens
gaggaauggagcugacuuu

SEQ ID NO: 71665 - RNA, 19 nt, Homo sapiens
cugagacuauguaaagaaa

SEQ ID NO: 71666 - RNA, 19 nt, Homo sapiens
ggucauggcagacucuaug

SEQ ID NO: 71667 - RNA, 19 nt, Homo sapiens
acagaugcccucaagcuuu

SEQ ID NO: 71668 - RNA, 19 nt, Homo sapiens
caagagaagcaacguaugg

SEQ ID NO: 71669 - RNA, 19 nt, Homo sapiens
gcacaaugggcucuaucuu

SEQ ID NO: 71670 - RNA, 19 nt, Homo sapiens
caggacaaaugcuucuuca

SEQ ID NO: 71671 - RNA, 19 nt, Homo sapiens
caauaaaggagagaaacaa

SEQ ID NO: 71672 - RNA, 19 nt, Homo sapiens
uggaaucccugggcaaaga

SEQ ID NO: 71673 - RNA, 19 nt, Homo sapiens
caacguauggcaggacaaa

SEQ ID NO: 71674 - RNA, 19 nt, Homo sapiens
guguagauguagaagagaa

SEQ ID NO: 71675 - RNA, 19 nt, Homo sapiens
gaauuccugagacuaugua

SEQ ID NO: 71676 - RNA, 19 nt, Homo sapiens
ucacugguguuuuggauaa

SEQ ID NO: 71677 - RNA, 19 nt, Homo sapiens
aguacagcuugcauauuua

SEQ ID NO: 71678 - RNA, 19 nt, Homo sapiens
ccuuaaauaucuugucuac

SEQ ID NO: 71679 - RNA, 19 nt, Homo sapiens
gcacauucuugguacucau

SEQ ID NO: 71680 - RNA, 19 nt, Homo sapiens
caagcuuuguccucaugaa

SEQ ID NO: 71681 - RNA, 19 nt, Homo sapiens
gcaagagaagcaacguaug

SEQ ID NO: 71682 - RNA, 19 nt, Homo sapiens
ccagaugugcugcuuuaug

SEQ ID NO: 71683 - RNA, 19 nt, Homo sapiens
uaguguagauguagaagag

SEQ ID NO: 71684 - RNA, 19 nt, Homo sapiens
aaagaaagagcugaagaga

SEQ ID NO: 71685 - RNA, 19 nt, Homo sapiens
uaaagaaagagcugaagag

SEQ ID NO: 71686 - RNA, 19 nt, Homo sapiens
gcaggacaaaugcuucuuc

SEQ ID NO: 71687 - RNA, 19 nt, Homo sapiens
cagcuugcauauuuaacau

SEQ ID NO: 71688 - RNA, 19 nt, Homo sapiens
ggagcaccuucauuaguac

SEQ ID NO: 71689 - RNA, 19 nt, Homo sapiens
cacaaugggcucuaucuuc

SEQ ID NO: 71690 - RNA, 19 nt, Homo sapiens
uugagggucuggacuauag

SEQ ID NO: 71691 - RNA, 19 nt, Homo sapiens
auagaacgacuguccauga

SEQ ID NO: 71692 - RNA, 19 nt, Homo sapiens
uggaggaagaugcuguuua

SEQ ID NO: 71693 - RNA, 19 nt, Homo sapiens
cacuuaagguguuggaauc

SEQ ID NO: 71694 - RNA, 19 nt, Homo sapiens
cagaaggcaaccacagaaa

SEQ ID NO: 71695 - RNA, 19 nt, Homo sapiens
ccaauaaaggagagaaaca

SEQ ID NO: 71696 - RNA, 19 nt, Homo sapiens
ccacuuaagguguuggaau

SEQ ID NO: 71697 - RNA, 19 nt, Homo sapiens
ucagaaggcaaccacagaa

SEQ ID NO: 71698 - RNA, 19 nt, Homo sapiens
gccuggcucucaucauaug

SEQ ID NO: 71699 - RNA, 19 nt, Homo sapiens
aacccaaggucaucauugu

SEQ ID NO: 71700 - RNA, 19 nt, Homo sapiens
gagcugacuuugacaucac

SEQ ID NO: 71701 - RNA, 19 nt, Homo sapiens
caaaugcccaccauagaac

SEQ ID NO: 71702 - RNA, 19 nt, Homo sapiens
ggaacaaaauguacugaac

SEQ ID NO: 71703 - RNA, 19 nt, Homo sapiens
aggaagaugcuguuuacaa

SEQ ID NO: 71704 - RNA, 19 nt, Homo sapiens
gaagagaucuauccaauaa

SEQ ID NO: 71705 - RNA, 19 nt, Homo sapiens
guacagcaaucauuugaaa

SEQ ID NO: 71706 - RNA, 19 nt, Homo sapiens
ggacaaaugcuucuucaaa

SEQ ID NO: 71707 - RNA, 19 nt, Homo sapiens
uaguacagcuugcauauuu

SEQ ID NO: 71708 - RNA, 19 nt, Homo sapiens
ucacaugcuuccagaaaua

SEQ ID NO: 71709 - RNA, 19 nt, Homo sapiens
agaaagagcugaagagauc

SEQ ID NO: 71710 - RNA, 19 nt, Homo sapiens
ggacuauaguguagaugua

SEQ ID NO: 71711 - RNA, 19 nt, Homo sapiens
gaagguacagcaaucauuu

SEQ ID NO: 71712 - RNA, 19 nt, Homo sapiens
ggaaguauuucggaaggua

SEQ ID NO: 71713 - RNA, 19 nt, Homo sapiens
ggaagaugcuguuuacaag

SEQ ID NO: 71714 - RNA, 19 nt, Homo sapiens
ucacacaacucaucacaug

SEQ ID NO: 71715 - RNA, 19 nt, Homo sapiens
ggaggaagaugcuguuuac

SEQ ID NO: 71716 - RNA, 19 nt, Homo sapiens
cagaugugcugcuuuauga

SEQ ID NO: 71717 - RNA, 19 nt, Homo sapiens
gaagaauuccugagacuau

SEQ ID NO: 71718 - RNA, 19 nt, Homo sapiens
gaauggagcugacuuugac

SEQ ID NO: 71719 - RNA, 19 nt, Homo sapiens
gagacuauguaaagaaaga

SEQ ID NO: 71720 - RNA, 19 nt, Homo sapiens
gaacugugcaugaugagaa

SEQ ID NO: 71721 - RNA, 19 nt, Homo sapiens
gcccagcccuccuuaauca

SEQ ID NO: 71722 - RNA, 19 nt, Homo sapiens
aaccagaugugcugcuuua

SEQ ID NO: 71723 - RNA, 19 nt, Homo sapiens
gggcaaagauuuccucacu

SEQ ID NO: 71724 - RNA, 19 nt, Homo sapiens
ccaccuagaggaaguauuu

SEQ ID NO: 71725 - RNA, 19 nt, Homo sapiens
ggaauggagcugacuuuga

SEQ ID NO: 71726 - RNA, 19 nt, Homo sapiens
gcucucaucauaugcaaua

SEQ ID NO: 71727 - RNA, 19 nt, Homo sapiens
acaaugggcucuaucuuca

SEQ ID NO: 71728 - RNA, 19 nt, Homo sapiens
gcggaacugugcaugauga

SEQ ID NO: 71729 - RNA, 19 nt, Homo sapiens
gagcacaaguccucugaca

SEQ ID NO: 71730 - RNA, 19 nt, Homo sapiens
cauaugcaauacagaguuu

SEQ ID NO: 71731 - RNA, 19 nt, Homo sapiens
aggagcaccuucauuagua

SEQ ID NO: 71732 - RNA, 19 nt, Homo sapiens
gacaaaugcuucuucaaac

SEQ ID NO: 71733 - RNA, 19 nt, Homo sapiens
uaacauagaccaaauaucc

SEQ ID NO: 71734 - RNA, 19 nt, Homo sapiens
guacagcuugcauauuuaa

SEQ ID NO: 71735 - RNA, 19 nt, Homo sapiens
ugacagcacauucuuggua

SEQ ID NO: 71736 - RNA, 19 nt, Homo sapiens
cagaugcccucaagcuuug

SEQ ID NO: 71737 - RNA, 19 nt, Homo sapiens
gaacuggaaggaagaggaa

SEQ ID NO: 71738 - RNA, 19 nt, Homo sapiens
ggaagguacagcaaucauu

SEQ ID NO: 71739 - RNA, 19 nt, Homo sapiens
gcagaaggcaaccacagaa

SEQ ID NO: 71740 - RNA, 19 nt, Homo sapiens
ggucuggacuauaguguag

SEQ ID NO: 71741 - RNA, 19 nt, Homo sapiens
gaagaugcuguuuacaaga

SEQ ID NO: 71742 - RNA, 19 nt, Homo sapiens
cugaagagaucuauccaau

SEQ ID NO: 71743 - RNA, 19 nt, Homo sapiens
ucaaaugcccaccauagaa

SEQ ID NO: 71744 - RNA, 19 nt, Homo sapiens
ggagcugacuuugacauca

SEQ ID NO: 71745 - RNA, 19 nt, Homo sapiens
acgccuggcucucaucaua

SEQ ID NO: 71746 - RNA, 19 nt, Homo sapiens
agagaucuauccaauaaag

SEQ ID NO: 71747 - RNA, 19 nt, Homo sapiens
guaaagaaagagcugaaga

SEQ ID NO: 71748 - RNA, 19 nt, Homo sapiens
ggacaaacccaaggucauc

SEQ ID NO: 71749 - RNA, 19 nt, Homo sapiens
gagggaaucugcggaacug

SEQ ID NO: 71750 - RNA, 19 nt, Homo sapiens
gcacacgccuggcucucau

SEQ ID NO: 71751 - RNA, 19 nt, Homo sapiens
ugaagagaucuauccaaua

SEQ ID NO: 71752 - RNA, 19 nt, Homo sapiens
agacaaaguucgggucaug

SEQ ID NO: 71753 - RNA, 19 nt, Homo sapiens
gcucaaaugcccaccauag

SEQ ID NO: 71754 - RNA, 19 nt, Homo sapiens
cugagaaccuggaggaaga

SEQ ID NO: 71755 - RNA, 19 nt, Homo sapiens
gcaauauccugcagcucau

SEQ ID NO: 71756 - RNA, 19 nt, Homo sapiens
caucacaugcuuccagaaa

SEQ ID NO: 71757 - RNA, 19 nt, Homo sapiens
ggaugaaggagcuacuuga

SEQ ID NO: 71758 - RNA, 19 nt, Homo sapiens
ccucuuuccuggcaauuga

SEQ ID NO: 71759 - RNA, 19 nt, Homo sapiens
auacagaguuugaccaucu

SEQ ID NO: 71760 - RNA, 19 nt, Homo sapiens
gcuuuguccucaugaagaa

SEQ ID NO: 71761 - RNA, 19 nt, Homo sapiens
gcgcugagggcauuugcua

SEQ ID NO: 71762 - RNA, 19 nt, Homo sapiens
gaggaauggagcugacuuu

SEQ ID NO: 71763 - RNA, 19 nt, Homo sapiens
cugagacuauguaaagaaa

SEQ ID NO: 71764 - RNA, 19 nt, Homo sapiens
ggucauggcagacucuaug

SEQ ID NO: 71765 - RNA, 19 nt, Homo sapiens
acagaugcccucaagcuuu

SEQ ID NO: 71766 - RNA, 19 nt, Homo sapiens
caagagaagcaacguaugg

SEQ ID NO: 71767 - RNA, 19 nt, Homo sapiens
gcacaaugggcucuaucuu

SEQ ID NO: 71768 - RNA, 19 nt, Homo sapiens
caggacaaaugcuucuuca

SEQ ID NO: 71769 - RNA, 19 nt, Homo sapiens
uggaaucccugggcaaaga

SEQ ID NO: 71770 - RNA, 19 nt, Homo sapiens
caauaaaggagagaaacaa

SEQ ID NO: 71771 - RNA, 19 nt, Homo sapiens
caacguauggcaggacaaa

SEQ ID NO: 71772 - RNA, 19 nt, Homo sapiens
guguagauguagaagagaa

SEQ ID NO: 71773 - RNA, 19 nt, Homo sapiens
gaauuccugagacuaugua

SEQ ID NO: 71774 - RNA, 19 nt, Homo sapiens
ucacugguguuuuggauaa

SEQ ID NO: 71775 - RNA, 19 nt, Homo sapiens
ggucacagaggcagaaauc

SEQ ID NO: 71776 - RNA, 19 nt, Homo sapiens
aguacagcuugcauauuua

SEQ ID NO: 71777 - RNA, 19 nt, Homo sapiens
cagaggcuguucccuaugg

SEQ ID NO: 71778 - RNA, 19 nt, Homo sapiens
gcacauucuugguacucau

SEQ ID NO: 71779 - RNA, 19 nt, Homo sapiens
caagcuuuguccucaugaa

SEQ ID NO: 71780 - RNA, 19 nt, Homo sapiens
gcaagagaagcaacguaug

SEQ ID NO: 71781 - RNA, 19 nt, Homo sapiens
ccagaugugcugcuuuaug

SEQ ID NO: 71782 - RNA, 19 nt, Homo sapiens
uaguguagauguagaagag

SEQ ID NO: 71783 - RNA, 19 nt, Homo sapiens
aaagaaagagcugaagaga

SEQ ID NO: 71784 - RNA, 19 nt, Homo sapiens
uaaagaaagagcugaagag

SEQ ID NO: 71785 - RNA, 19 nt, Homo sapiens
cacaauuuauguucugcaa

SEQ ID NO: 71786 - RNA, 19 nt, Homo sapiens
gcaggacaaaugcuucuuc

SEQ ID NO: 71787 - RNA, 19 nt, Homo sapiens
cagcuugcauauuuaacau

SEQ ID NO: 71788 - RNA, 19 nt, Homo sapiens
ggagcaccuucauuaguac

SEQ ID NO: 71789 - RNA, 19 nt, Homo sapiens
cacaaugggcucuaucuuc

SEQ ID NO: 71790 - RNA, 19 nt, Homo sapiens
uugagggucuggacuauag

SEQ ID NO: 71791 - RNA, 19 nt, Homo sapiens
auagaacgacuguccauga

SEQ ID NO: 71792 - RNA, 19 nt, Homo sapiens
cagaaggcaaccacagaaa

SEQ ID NO: 71793 - RNA, 19 nt, Homo sapiens
uggaggaagaugcuguuua

SEQ ID NO: 71794 - RNA, 19 nt, Homo sapiens
cacuuaagguguuggaauc

SEQ ID NO: 71795 - RNA, 19 nt, Homo sapiens
ccaauaaaggagagaaaca

SEQ ID NO: 71796 - RNA, 19 nt, Homo sapiens
gccuggcucucaucauaug

SEQ ID NO: 71797 - RNA, 19 nt, Homo sapiens
ccacuuaagguguuggaau

SEQ ID NO: 71798 - RNA, 19 nt, Homo sapiens
cagcucauccgaauaugga

SEQ ID NO: 71799 - RNA, 19 nt, Homo sapiens
aacccaaggucaucauugu

SEQ ID NO: 71800 - RNA, 19 nt, Homo sapiens
gagcugacuuugacaucac

SEQ ID NO: 71801 - RNA, 19 nt, Homo sapiens
caaaugcccaccauagaac

SEQ ID NO: 71802 - RNA, 19 nt, Homo sapiens
ggaacaaaauguacugaac

SEQ ID NO: 71803 - RNA, 19 nt, Homo sapiens
aggaagaugcuguuuacaa

SEQ ID NO: 71804 - RNA, 19 nt, Homo sapiens
gaugagaucuauccaauaa

SEQ ID NO: 71805 - RNA, 19 nt, Homo sapiens
gaagcuauguucaaaggua

SEQ ID NO: 71806 - RNA, 19 nt, Homo sapiens
caacguggcuggacaaaca

SEQ ID NO: 71807 - RNA, 19 nt, Homo sapiens
ucacaugcuuccagaaaua

SEQ ID NO: 71808 - RNA, 19 nt, Homo sapiens
caucaaauguuuacccaaa

SEQ ID NO: 71809 - RNA, 19 nt, Homo sapiens
caguuaagauguuggaaua

SEQ ID NO: 71810 - RNA, 19 nt, Homo sapiens
gagcacauuuaccaguaua

SEQ ID NO: 71811 - RNA, 19 nt, Homo sapiens
gcagucaucucuucacagu

SEQ ID NO: 71812 - RNA, 19 nt, Homo sapiens
ucagcagaaucuacaaaua

SEQ ID NO: 71813 - RNA, 19 nt, Homo sapiens
uaaaccacaugcuaaagaa

SEQ ID NO: 71814 - RNA, 19 nt, Homo sapiens
caguauagcuugcauaguc

SEQ ID NO: 71815 - RNA, 19 nt, Homo sapiens
uuacggaacucaucacaug

SEQ ID NO: 71816 - RNA, 19 nt, Homo sapiens
ggacuucauugcuuucugu

SEQ ID NO: 71817 - RNA, 19 nt, Homo sapiens
cccaaacacuucucaauau

SEQ ID NO: 71818 - RNA, 19 nt, Homo sapiens
cggaugugcugcuuuauga

SEQ ID NO: 71819 - RNA, 19 nt, Homo sapiens
ccaaacacuucucaauaug

SEQ ID NO: 71820 - RNA, 19 nt, Homo sapiens
gcucucaucauaugcaaua

SEQ ID NO: 71821 - RNA, 19 nt, Homo sapiens
gaagaauuccugagacugu

SEQ ID NO: 71822 - RNA, 19 nt, Homo sapiens
gagcacaaguccucugaca

SEQ ID NO: 71823 - RNA, 19 nt, Homo sapiens
caaaagaucaccaguguaa

SEQ ID NO: 71824 - RNA, 19 nt, Homo sapiens
ggaagguacagaaaucauu

SEQ ID NO: 71825 - RNA, 19 nt, Homo sapiens
cagcagaaucuacaaauau

SEQ ID NO: 71826 - RNA, 19 nt, Homo sapiens
ucgcguggcucaucaaaug

SEQ ID NO: 71827 - RNA, 19 nt, Homo sapiens
uggaauaccugggcaaaga

SEQ ID NO: 71828 - RNA, 19 nt, Homo sapiens
ugacagcacguucuuggua

SEQ ID NO: 71829 - RNA, 19 nt, Homo sapiens
aaacacuucucaauaugga

SEQ ID NO: 71830 - RNA, 19 nt, Homo sapiens
gaacaacguggcuggacaa

SEQ ID NO: 71831 - RNA, 19 nt, Homo sapiens
aagagcacauuuaccagua

SEQ ID NO: 71832 - RNA, 19 nt, Homo sapiens
ucaaagagcacauuuacca

SEQ ID NO: 71833 - RNA, 19 nt, Homo sapiens
aaccggaugugcugcuuua

SEQ ID NO: 71834 - RNA, 19 nt, Homo sapiens
uuggauaacuucgugauaa

SEQ ID NO: 71835 - RNA, 19 nt, Homo sapiens
acgccuggcucucaucaua

SEQ ID NO: 71836 - RNA, 19 nt, Homo sapiens
ccaccuaauggaaauauuu

SEQ ID NO: 71837 - RNA, 19 nt, Homo sapiens
gugauaaaccacaugcuaa

SEQ ID NO: 71838 - RNA, 19 nt, Homo sapiens
uagcuugcauagucaauau

SEQ ID NO: 71839 - RNA, 19 nt, Homo sapiens
ggacaaacccaaggucauc

SEQ ID NO: 71840 - RNA, 19 nt, Homo sapiens
gagggaaucugcggaacug

SEQ ID NO: 71841 - RNA, 19 nt, Homo sapiens
uggauaacuucgugauaaa

SEQ ID NO: 71842 - RNA, 19 nt, Homo sapiens
agucaucucuucacaguca

SEQ ID NO: 71843 - RNA, 19 nt, Homo sapiens
gaaggaagaggaaaagaaa

SEQ ID NO: 71844 - RNA, 19 nt, Homo sapiens
gaacgagcaaccuugacaa

SEQ ID NO: 71845 - RNA, 19 nt, Homo sapiens
caucacaugcuuccagaaa

SEQ ID NO: 71846 - RNA, 19 nt, Homo sapiens
ccagggauauggagucagu

SEQ ID NO: 71847 - RNA, 19 nt, Homo sapiens
ccucuuuccuggcaauuga

SEQ ID NO: 71848 - RNA, 19 nt, Homo sapiens
caacaucaaagagcacauu

SEQ ID NO: 71849 - RNA, 19 nt, Homo sapiens
ccagaugcccaccauagaa

SEQ ID NO: 71850 - RNA, 19 nt, Homo sapiens
ggaauggggcucacuauga

SEQ ID NO: 71851 - RNA, 19 nt, Homo sapiens
gcauagucaauauuuggua

SEQ ID NO: 71852 - RNA, 19 nt, Homo sapiens
caucaaagagcacauuuac

SEQ ID NO: 71853 - RNA, 19 nt, Homo sapiens
ugauaaaccacaugcuaaa

SEQ ID NO: 71854 - RNA, 19 nt, Homo sapiens
uaaaaccucuucugcaaau

SEQ ID NO: 71855 - RNA, 19 nt, Homo sapiens
gcaagauccacgaggagaa

SEQ ID NO: 71856 - RNA, 19 nt, Homo sapiens
gcagacgccuggcucucau

SEQ ID NO: 71857 - RNA, 19 nt, Homo sapiens
ucaccugccugcaaggaau

SEQ ID NO: 71858 - RNA, 19 nt, Homo sapiens
acccaaacacuucucaaua

SEQ ID NO: 71859 - RNA, 19 nt, Homo sapiens
gaagacaaggcccugaucu

SEQ ID NO: 71860 - RNA, 19 nt, Homo sapiens
gcuugcauagucaauauuu

SEQ ID NO: 71861 - RNA, 19 nt, Homo sapiens
cgugauaaaccacaugcua

SEQ ID NO: 71862 - RNA, 19 nt, Homo sapiens
gaucuugguagacucuuug

SEQ ID NO: 71863 - RNA, 19 nt, Homo sapiens
gaaccuggaggcagauucu

SEQ ID NO: 71864 - RNA, 19 nt, Homo sapiens
gugaagaauuccugagacu

SEQ ID NO: 71865 - RNA, 19 nt, Homo sapiens
caucauaugcaauacaaag

SEQ ID NO: 71866 - RNA, 19 nt, Homo sapiens
guucuucaacaccacauaa

SEQ ID NO: 71867 - RNA, 19 nt, Homo sapiens
gcugccaccuaauggaaau

SEQ ID NO: 71868 - RNA, 19 nt, Homo sapiens
gccuggcucucaucauaug

SEQ ID NO: 71869 - RNA, 19 nt, Homo sapiens
augaugagaucuauccaau

SEQ ID NO: 71870 - RNA, 19 nt, Homo sapiens
cuucagaguggauuggaua

SEQ ID NO: 71871 - RNA, 19 nt, Homo sapiens
gaauaccugggcaaagaug

SEQ ID NO: 71872 - RNA, 19 nt, Homo sapiens
gcccuccucugucaacauc

SEQ ID NO: 71873 - RNA, 19 nt, Homo sapiens
aacccaaggucaucauugu

SEQ ID NO: 71874 - RNA, 19 nt, Homo sapiens
cagaguggauuggauaacu

SEQ ID NO: 71875 - RNA, 19 nt, Homo sapiens
agaguggauuggauaacuu

SEQ ID NO: 71876 - RNA, 19 nt, Homo sapiens
ggaauaccugggcaaagau

SEQ ID NO: 71877 - RNA, 19 nt, Homo sapiens
gcccagaugcccaccauag

SEQ ID NO: 71878 - RNA, 19 nt, Homo sapiens
cuucauugcuuucuguucu

SEQ ID NO: 71879 - RNA, 19 nt, Homo sapiens
gaauuccugagacugugua

SEQ ID NO: 71880 - RNA, 19 nt, Homo sapiens
uguaaaaccucuucugcaa

SEQ ID NO: 71881 - RNA, 19 nt, Homo sapiens
uccagacccuaguaccuaa

SEQ ID NO: 71882 - RNA, 19 nt, Homo sapiens
auaaaccacaugcuaaaga

SEQ ID NO: 71883 - RNA, 19 nt, Homo sapiens
acaucaaagagcacauuua

SEQ ID NO: 71884 - RNA, 19 nt, Homo sapiens
gaugugcugcuuuaugaca

SEQ ID NO: 71885 - RNA, 19 nt, Homo sapiens
ugaugagaucuauccaaua

SEQ ID NO: 71886 - RNA, 19 nt, Homo sapiens
caaacacuucucaauaugg

SEQ ID NO: 71887 - RNA, 19 nt, Homo sapiens
agaaucgcguggcucauca

SEQ ID NO: 71888 - RNA, 19 nt, Homo sapiens
gauaaaccacaugcuaaag

SEQ ID NO: 71889 - RNA, 19 nt, Homo sapiens
gcccugaucuugguagacu

SEQ ID NO: 71890 - RNA, 19 nt, Homo sapiens
gacauugaaggaagaggaa

SEQ ID NO: 71891 - RNA, 19 nt, Homo sapiens
aagcuauguucaaagguau

SEQ ID NO: 71892 - RNA, 19 nt, Homo sapiens
gcagaaucuacaaauauac

SEQ ID NO: 71893 - RNA, 19 nt, Homo sapiens
ugaucuugguagacucuuu

SEQ ID NO: 71894 - RNA, 19 nt, Homo sapiens
caaacccaaggucaucauu

SEQ ID NO: 71895 - RNA, 19 nt, Homo sapiens
gcacguucuugguacucau

SEQ ID NO: 71896 - RNA, 19 nt, Homo sapiens
cucaucauaugcaauacaa

SEQ ID NO: 71897 - RNA, 19 nt, Homo sapiens
agagcacauuuaccaguau

SEQ ID NO: 71898 - RNA, 19 nt, Homo sapiens
cagacccuaguaccuaaua

SEQ ID NO: 71899 - RNA, 19 nt, Homo sapiens
ucucuucacagucaucuga

SEQ ID NO: 71900 - RNA, 19 nt, Homo sapiens
aaagaucaccaguguaaaa

SEQ ID NO: 71901 - RNA, 19 nt, Homo sapiens
gaaguuccacaggcuaaag

SEQ ID NO: 71902 - RNA, 19 nt, Homo sapiens
aaacccaaggucaucauug

SEQ ID NO: 71903 - RNA, 19 nt, Homo sapiens
gaauggggcucacuaugac

SEQ ID NO: 71904 - RNA, 19 nt, Homo sapiens
ggaauuaaaucaucccuua

SEQ ID NO: 71905 - RNA, 19 nt, Homo sapiens
gaagugaaaugcuuuaaug

SEQ ID NO: 71906 - RNA, 19 nt, Homo sapiens
gcaaucacauuuaugcaua

SEQ ID NO: 71907 - RNA, 19 nt, Homo sapiens
uuaauaaacugcaggguua

SEQ ID NO: 71908 - RNA, 19 nt, Homo sapiens
aaacagaugccuucuauaa

SEQ ID NO: 71909 - RNA, 19 nt, Homo sapiens
gacauuaacuggcuuguuc

SEQ ID NO: 71910 - RNA, 19 nt, Homo sapiens
caugaggugucaacuguua

SEQ ID NO: 71911 - RNA, 19 nt, Homo sapiens
caacauaacugagguggau

SEQ ID NO: 71912 - RNA, 19 nt, Homo sapiens
ggagaggaauugcuuuaau

SEQ ID NO: 71913 - RNA, 19 nt, Homo sapiens
caugguacauucaagauuu

SEQ ID NO: 71914 - RNA, 19 nt, Homo sapiens
gaucuaggauuugaaguga

SEQ ID NO: 71915 - RNA, 19 nt, Homo sapiens
gagaggaauugcuuuaauc

SEQ ID NO: 71916 - RNA, 19 nt, Homo sapiens
gcuuuaaucuucaaucaug

SEQ ID NO: 71917 - RNA, 19 nt, Homo sapiens
gagccgagauugcgccauu

SEQ ID NO: 71918 - RNA, 19 nt, Homo sapiens
cgaaggcaaucacauuuau

SEQ ID NO: 71919 - RNA, 19 nt, Homo sapiens
ggaauugcuuuaaucuuca

SEQ ID NO: 71920 - RNA, 19 nt, Homo sapiens
gaggagaggaauugcuuua

SEQ ID NO: 71921 - RNA, 19 nt, Homo sapiens
gugaaaugcuuuaaugauc

SEQ ID NO: 71922 - RNA, 19 nt, Homo sapiens
ucacagaacuccucacacu

SEQ ID NO: 71923 - RNA, 19 nt, Homo sapiens
gcgaaggcaaucacauuua

SEQ ID NO: 71924 - RNA, 19 nt, Homo sapiens
ggagcugacuuccucaugu

SEQ ID NO: 71925 - RNA, 19 nt, Homo sapiens
gaagaaaacaugacagaaa

SEQ ID NO: 71926 - RNA, 19 nt, Homo sapiens
ugaaaggguuugauaugga

SEQ ID NO: 71927 - RNA, 19 nt, Homo sapiens
caagugcaauuggaaagaa

SEQ ID NO: 71928 - RNA, 19 nt, Homo sapiens
cagaagaacuacugcucaa

SEQ ID NO: 71929 - RNA, 19 nt, Homo sapiens
aaauauggcuccuccuuag

SEQ ID NO: 71930 - RNA, 19 nt, Homo sapiens
gaacggcucaugguacauu

SEQ ID NO: 71931 - RNA, 19 nt, Homo sapiens
ggaaaacccaagauauuua

SEQ ID NO: 71932 - RNA, 19 nt, Homo sapiens
ggugaagcauuauggucua

SEQ ID NO: 71933 - RNA, 19 nt, Homo sapiens
gaaauucagacauuaacug

SEQ ID NO: 71934 - RNA, 19 nt, Homo sapiens
gagcugacuuccucaugug

SEQ ID NO: 71935 - RNA, 19 nt, Homo sapiens
gcacuuaacacugccagaa

SEQ ID NO: 71936 - RNA, 19 nt, Homo sapiens
aggaauugcuuuaaucuuc

SEQ ID NO: 71937 - RNA, 19 nt, Homo sapiens
gaaacagaugccuucuaua

SEQ ID NO: 71938 - RNA, 19 nt, Homo sapiens
ucguuagggugaagcauua

SEQ ID NO: 71939 - RNA, 19 nt, Homo sapiens
ucuaggauuugaagugaaa

SEQ ID NO: 71940 - RNA, 19 nt, Homo sapiens
ggugaaaggguuugauaug

SEQ ID NO: 71941 - RNA, 19 nt, Homo sapiens
ggucuaaugauucaaaugu

SEQ ID NO: 71942 - RNA, 19 nt, Homo sapiens
gcaaagacccaagugcaau

SEQ ID NO: 71943 - RNA, 19 nt, Homo sapiens
gcaggagaaucacuugaac

SEQ ID NO: 71944 - RNA, 19 nt, Homo sapiens
caaagacccaagugcaauu

SEQ ID NO: 71945 - RNA, 19 nt, Homo sapiens
ugugugagauguugggaaa

SEQ ID NO: 71946 - RNA, 19 nt, Homo sapiens
acagaugccuucuauaaaa

SEQ ID NO: 71947 - RNA, 19 nt, Homo sapiens
gugaaaggguuugauaugg

SEQ ID NO: 71948 - RNA, 19 nt, Homo sapiens
uuaacuggcuuguucaaag

SEQ ID NO: 71949 - RNA, 19 nt, Homo sapiens
gcagaaaaguacaaaaugg

SEQ ID NO: 71950 - RNA, 19 nt, Homo sapiens
cugacuuccucauguguua

SEQ ID NO: 71951 - RNA, 19 nt, Homo sapiens
gaagaacuacugcucaaaa

SEQ ID NO: 71952 - RNA, 19 nt, Homo sapiens
gugaacggcucaugguaca

SEQ ID NO: 71953 - RNA, 19 nt, Homo sapiens
ccucauguguuacucuguu

SEQ ID NO: 71954 - RNA, 19 nt, Homo sapiens
uagauaaucagacagagaa

SEQ ID NO: 71955 - RNA, 19 nt, Homo sapiens
gcagaugccgauugcuuug

SEQ ID NO: 71956 - RNA, 19 nt, Homo sapiens
gaacuacugcucaaaauuc

SEQ ID NO: 71957 - RNA, 19 nt, Homo sapiens
caagauuugugugagaugu

SEQ ID NO: 71958 - RNA, 19 nt, Homo sapiens
aaacaugacagaaacagau

SEQ ID NO: 71959 - RNA, 19 nt, Homo sapiens
uguaguagauaaucagaca

SEQ ID NO: 71960 - RNA, 19 nt, Homo sapiens
guucaaaggagacaagugu

SEQ ID NO: 71961 - RNA, 19 nt, Homo sapiens
uaacuggcuuguucaaagg

SEQ ID NO: 71962 - RNA, 19 nt, Homo sapiens
uuucagaucuaggauuuga

SEQ ID NO: 71963 - RNA, 19 nt, Homo sapiens
gaaauccaggaauuaaauc

SEQ ID NO: 71964 - RNA, 19 nt, Homo sapiens
guagauaaucagacagaga

SEQ ID NO: 71965 - RNA, 19 nt, Homo sapiens
ccacgcagaugccgauugc

SEQ ID NO: 71966 - RNA, 19 nt, Homo sapiens
gagaccagccugaccaaca

SEQ ID NO: 71967 - RNA, 19 nt, Homo sapiens
gaaggcaaucacauuuaug

SEQ ID NO: 71968 - RNA, 19 nt, Homo sapiens
ggcgaaggcaaucacauuu

SEQ ID NO: 71969 - RNA, 19 nt, Homo sapiens
cuagcugauuuaacuugua

SEQ ID NO: 71970 - RNA, 19 nt, Homo sapiens
gugaagcauuauggucuaa

SEQ ID NO: 71971 - RNA, 19 nt, Homo sapiens
gcucaugguacauucaaga

SEQ ID NO: 71972 - RNA, 19 nt, Homo sapiens
ggaugcagccuccguuuac

SEQ ID NO: 71973 - RNA, 19 nt, Homo sapiens
uaaagcagaagaacuacug

SEQ ID NO: 71974 - RNA, 19 nt, Homo sapiens
uuuaaugccuagcagagaa

SEQ ID NO: 71975 - RNA, 19 nt, Homo sapiens
gaaaauauggcuccuccuu

SEQ ID NO: 71976 - RNA, 19 nt, Homo sapiens
uccacacucuguauugaaa

SEQ ID NO: 71977 - RNA, 19 nt, Homo sapiens
gaccacaggaggagaggaa

SEQ ID NO: 71978 - RNA, 19 nt, Homo sapiens
uaaauaucguuagggugaa

SEQ ID NO: 71979 - RNA, 19 nt, Homo sapiens
ggcaggagaaucacuugaa

SEQ ID NO: 71980 - RNA, 19 nt, Homo sapiens
guacauucaagauuugugu

SEQ ID NO: 71981 - RNA, 19 nt, Homo sapiens
agucauuccuuuggaugua

SEQ ID NO: 71982 - RNA, 19 nt, Homo sapiens
ccucaggaaauuagauaaa

SEQ ID NO: 71983 - RNA, 19 nt, Homo sapiens
ggaggagaggaauugcuuu

SEQ ID NO: 71984 - RNA, 19 nt, Homo sapiens
gaagccccgucucuacuaa

SEQ ID NO: 71985 - RNA, 19 nt, Homo sapiens
cuuuggauguaguagauaa

SEQ ID NO: 71986 - RNA, 19 nt, Homo sapiens
ccuguaaucccagcacuuu

SEQ ID NO: 71987 - RNA, 19 nt, Homo sapiens
gucacagccugguuggaaa

SEQ ID NO: 71988 - RNA, 19 nt, Homo sapiens
gaggaauugcuuuaaucuu

SEQ ID NO: 71989 - RNA, 19 nt, Homo sapiens
agaccagccugaccaacau

SEQ ID NO: 71990 - RNA, 19 nt, Homo sapiens
uugccucaaugcuaacuaa

SEQ ID NO: 71991 - RNA, 19 nt, Homo sapiens
ccacaggaggagaggaauu

SEQ ID NO: 71992 - RNA, 19 nt, Homo sapiens
uucaugaggugucaacugu

SEQ ID NO: 71993 - RNA, 19 nt, Homo sapiens
cuggugaacaggaaaguuu

SEQ ID NO: 71994 - RNA, 19 nt, Homo sapiens
gaugcagccuccguuuaca

SEQ ID NO: 71995 - RNA, 19 nt, Homo sapiens
gagguucuuuuggcacuua

SEQ ID NO: 71996 - RNA, 19 nt, Homo sapiens
aacagaugccuucuauaaa

SEQ ID NO: 71997 - RNA, 19 nt, Homo sapiens
auaaucagacagagaaguu

SEQ ID NO: 71998 - RNA, 19 nt, Homo sapiens
uggcgaaggcaaucacauu

SEQ ID NO: 71999 - RNA, 19 nt, Homo sapiens
gcaccugcgcagauagaga

SEQ ID NO: 72000 - RNA, 19 nt, Homo sapiens
aaaugucuuucucuuccuu

SEQ ID NO: 72001 - RNA, 19 nt, Homo sapiens
gaaggcugaggcaggagaa

SEQ ID NO: 72002 - RNA, 19 nt, Homo sapiens
uggaugcagccuccguuua

SEQ ID NO: 72003 - RNA, 19 nt, Homo sapiens
gauguaguagauaaucaga

SEQ ID NO: 72004 - RNA, 19 nt, Homo sapiens
ggaauuaaaucaucccuua

SEQ ID NO: 72005 - RNA, 19 nt, Homo sapiens
gcaaucacauuuaugcaua

SEQ ID NO: 72006 - RNA, 19 nt, Homo sapiens
uuaauaaacugcaggguua

SEQ ID NO: 72007 - RNA, 19 nt, Homo sapiens
gacauuaacuggcuuguuc

SEQ ID NO: 72008 - RNA, 19 nt, Homo sapiens
caacauaacugagguggau

SEQ ID NO: 72009 - RNA, 19 nt, Homo sapiens
caugguacauucaagauuu

SEQ ID NO: 72010 - RNA, 19 nt, Homo sapiens
gagccgagauugcgccauu

SEQ ID NO: 72011 - RNA, 19 nt, Homo sapiens
cgaaggcaaucacauuuau

SEQ ID NO: 72012 - RNA, 19 nt, Homo sapiens
ucacagaacuccucacacu

SEQ ID NO: 72013 - RNA, 19 nt, Homo sapiens
gcgaaggcaaucacauuua

SEQ ID NO: 72014 - RNA, 19 nt, Homo sapiens
ggagcugacuuccucaugu

SEQ ID NO: 72015 - RNA, 19 nt, Homo sapiens
ugaaaggguuugauaugga

SEQ ID NO: 72016 - RNA, 19 nt, Homo sapiens
caagugcaauuggaaagaa

SEQ ID NO: 72017 - RNA, 19 nt, Homo sapiens
aaauauggcuccuccuuag

SEQ ID NO: 72018 - RNA, 19 nt, Homo sapiens
gaacggcucaugguacauu

SEQ ID NO: 72019 - RNA, 19 nt, Homo sapiens
ggaaaacccaagauauuua

SEQ ID NO: 72020 - RNA, 19 nt, Homo sapiens
ggugaagcauuauggucua

SEQ ID NO: 72021 - RNA, 19 nt, Homo sapiens
gaaauucagacauuaacug

SEQ ID NO: 72022 - RNA, 19 nt, Homo sapiens
gagcugacuuccucaugug

SEQ ID NO: 72023 - RNA, 19 nt, Homo sapiens
ucguuagggugaagcauua

SEQ ID NO: 72024 - RNA, 19 nt, Homo sapiens
ggugaaaggguuugauaug

SEQ ID NO: 72025 - RNA, 19 nt, Homo sapiens
ggucuaaugauucaaaugu

SEQ ID NO: 72026 - RNA, 19 nt, Homo sapiens
gcaaagacccaagugcaau

SEQ ID NO: 72027 - RNA, 19 nt, Homo sapiens
gcaggagaaucacuugaac

SEQ ID NO: 72028 - RNA, 19 nt, Homo sapiens
caaagacccaagugcaauu

SEQ ID NO: 72029 - RNA, 19 nt, Homo sapiens
ugugugagauguugggaaa

SEQ ID NO: 72030 - RNA, 19 nt, Homo sapiens
gugaaaggguuugauaugg

SEQ ID NO: 72031 - RNA, 19 nt, Homo sapiens
uuaacuggcuuguucaaag

SEQ ID NO: 72032 - RNA, 19 nt, Homo sapiens
cugacuuccucauguguua

SEQ ID NO: 72033 - RNA, 19 nt, Homo sapiens
gcagaugccgauugcuuug

SEQ ID NO: 72034 - RNA, 19 nt, Homo sapiens
gugaacggcucaugguaca

SEQ ID NO: 72035 - RNA, 19 nt, Homo sapiens
ccucauguguuacucuguu

SEQ ID NO: 72036 - RNA, 19 nt, Homo sapiens
uagauaaucagacagagaa

SEQ ID NO: 72037 - RNA, 19 nt, Homo sapiens
caagauuugugugagaugu

SEQ ID NO: 72038 - RNA, 19 nt, Homo sapiens
uguaguagauaaucagaca

SEQ ID NO: 72039 - RNA, 19 nt, Homo sapiens
guucaaaggagacaagugu

SEQ ID NO: 72040 - RNA, 19 nt, Homo sapiens
uaacuggcuuguucaaagg

SEQ ID NO: 72041 - RNA, 19 nt, Homo sapiens
gaaauccaggaauuaaauc

SEQ ID NO: 72042 - RNA, 19 nt, Homo sapiens
guagauaaucagacagaga

SEQ ID NO: 72043 - RNA, 19 nt, Homo sapiens
ccacgcagaugccgauugc

SEQ ID NO: 72044 - RNA, 19 nt, Homo sapiens
gagaccagccugaccaaca

SEQ ID NO: 72045 - RNA, 19 nt, Homo sapiens
gaaggcaaucacauuuaug

SEQ ID NO: 72046 - RNA, 19 nt, Homo sapiens
ggcgaaggcaaucacauuu

SEQ ID NO: 72047 - RNA, 19 nt, Homo sapiens
cuagcugauuuaacuugua

SEQ ID NO: 72048 - RNA, 19 nt, Homo sapiens
gugaagcauuauggucuaa

SEQ ID NO: 72049 - RNA, 19 nt, Homo sapiens
gcucaugguacauucaaga

SEQ ID NO: 72050 - RNA, 19 nt, Homo sapiens
ggaugcagccuccguuuac

SEQ ID NO: 72051 - RNA, 19 nt, Homo sapiens
uuuaaugccuagcagagaa

SEQ ID NO: 72052 - RNA, 19 nt, Homo sapiens
gaaaauauggcuccuccuu

SEQ ID NO: 72053 - RNA, 19 nt, Homo sapiens
uccacacucuguauugaaa

SEQ ID NO: 72054 - RNA, 19 nt, Homo sapiens
uaaauaucguuagggugaa

SEQ ID NO: 72055 - RNA, 19 nt, Homo sapiens
ggcaggagaaucacuugaa

SEQ ID NO: 72056 - RNA, 19 nt, Homo sapiens
guacauucaagauuugugu

SEQ ID NO: 72057 - RNA, 19 nt, Homo sapiens
agucauuccuuuggaugua

SEQ ID NO: 72058 - RNA, 19 nt, Homo sapiens
ccucaggaaauuagauaaa

SEQ ID NO: 72059 - RNA, 19 nt, Homo sapiens
gaagccccgucucuacuaa

SEQ ID NO: 72060 - RNA, 19 nt, Homo sapiens
cuuuggauguaguagauaa

SEQ ID NO: 72061 - RNA, 19 nt, Homo sapiens
ccuguaaucccagcacuuu

SEQ ID NO: 72062 - RNA, 19 nt, Homo sapiens
gucacagccugguuggaaa

SEQ ID NO: 72063 - RNA, 19 nt, Homo sapiens
agaccagccugaccaacau

SEQ ID NO: 72064 - RNA, 19 nt, Homo sapiens
uugccucaaugcuaacuaa

SEQ ID NO: 72065 - RNA, 19 nt, Homo sapiens
cuggugaacaggaaaguuu

SEQ ID NO: 72066 - RNA, 19 nt, Homo sapiens
gaugcagccuccguuuaca

SEQ ID NO: 72067 - RNA, 19 nt, Homo sapiens
auaaucagacagagaaguu

SEQ ID NO: 72068 - RNA, 19 nt, Homo sapiens
uggcgaaggcaaucacauu

SEQ ID NO: 72069 - RNA, 19 nt, Homo sapiens
aaaugucuuucucuuccuu

SEQ ID NO: 72070 - RNA, 19 nt, Homo sapiens
gaaggcugaggcaggagaa

SEQ ID NO: 72071 - RNA, 19 nt, Homo sapiens
ccgauugcuuugugugugu

SEQ ID NO: 72072 - RNA, 19 nt, Homo sapiens
uggaugcagccuccguuua

SEQ ID NO: 72073 - RNA, 19 nt, Homo sapiens
gauguaguagauaaucaga

SEQ ID NO: 72074 - RNA, 19 nt, Homo sapiens
gcaaucccagcuacuugga

SEQ ID NO: 72075 - RNA, 19 nt, Homo sapiens
cuaauuccacacucuguau

SEQ ID NO: 72076 - RNA, 19 nt, Homo sapiens
gcuaaaaucgaaauucaga

SEQ ID NO: 72077 - RNA, 19 nt, Homo sapiens
ugucacagccugguuggaa

SEQ ID NO: 72078 - RNA, 19 nt, Homo sapiens
aagcugcauuucuuuccaa

SEQ ID NO: 72079 - RNA, 19 nt, Homo sapiens
agauuugugugagauguug

SEQ ID NO: 72080 - RNA, 19 nt, Homo sapiens
gccagucauuccuuuggau

SEQ ID NO: 72081 - RNA, 19 nt, Homo sapiens
ggcaaucacauuuaugcau

SEQ ID NO: 72082 - RNA, 19 nt, Homo sapiens
aaaauauggcuccuccuua

SEQ ID NO: 72083 - RNA, 19 nt, Homo sapiens
auucaagauuugugugaga

SEQ ID NO: 72084 - RNA, 19 nt, Homo sapiens
gauaaucagacagagaagu

SEQ ID NO: 72085 - RNA, 19 nt, Homo sapiens
uggauguaguagauaauca

SEQ ID NO: 72086 - RNA, 19 nt, Homo sapiens
gugaaacuccgucucaaaa

SEQ ID NO: 72087 - RNA, 19 nt, Homo sapiens
aaacugcaggguuacacaa

SEQ ID NO: 72088 - RNA, 19 nt, Homo sapiens
gaugccgauugcuuugugu

SEQ ID NO: 72089 - RNA, 19 nt, Homo sapiens
cgcagaugccgauugcuuu

SEQ ID NO: 72090 - RNA, 19 nt, Homo sapiens
gggaaaccagcacgaugug

SEQ ID NO: 72091 - RNA, 19 nt, Homo sapiens
uaguagauaaucagacaga

SEQ ID NO: 72092 - RNA, 19 nt, Homo sapiens
uaauuccacacucuguauu

SEQ ID NO: 72093 - RNA, 19 nt, Homo sapiens
ucuaauuccacacucugua

SEQ ID NO: 72094 - RNA, 19 nt, Homo sapiens
gaacaaagccacugacuga

SEQ ID NO: 72095 - RNA, 19 nt, Homo sapiens
ggaagaggcuccugguuug

SEQ ID NO: 72096 - RNA, 19 nt, Homo sapiens
caacagagggaguuuaaua

SEQ ID NO: 72097 - RNA, 19 nt, Homo sapiens
gaucagggcuguauugaag

SEQ ID NO: 72098 - RNA, 19 nt, Homo sapiens
gggcaaaugcaucauaaua

SEQ ID NO: 72099 - RNA, 19 nt, Homo sapiens
gcucaacaauuuauccauu

SEQ ID NO: 72100 - RNA, 19 nt, Homo sapiens
gaacucuacuucagucaau

SEQ ID NO: 72101 - RNA, 19 nt, Homo sapiens
gaagaggaccauacaaaug

SEQ ID NO: 72102 - RNA, 19 nt, Homo sapiens
gaacaagaaauggauguaa

SEQ ID NO: 72103 - RNA, 19 nt, Homo sapiens
gaagccaccucaccaagga

SEQ ID NO: 72104 - RNA, 19 nt, Homo sapiens
ggagugagcugagacagau

SEQ ID NO: 72105 - RNA, 19 nt, Homo sapiens
ggaaauugacuuacauaga

SEQ ID NO: 72106 - RNA, 19 nt, Homo sapiens
gaaaagaccuggaaaucau

SEQ ID NO: 72107 - RNA, 19 nt, Homo sapiens
cacuaaugcucaacaauuu

SEQ ID NO: 72108 - RNA, 19 nt, Homo sapiens
ugagacagauaagagaaua

SEQ ID NO: 72109 - RNA, 19 nt, Homo sapiens
gaauguggguauugagugu

SEQ ID NO: 72110 - RNA, 19 nt, Homo sapiens
gaugcaagaucugcuuaaa

SEQ ID NO: 72111 - RNA, 19 nt, Homo sapiens
ggcaaaugcaucauaauaa

SEQ ID NO: 72112 - RNA, 19 nt, Homo sapiens
ucacaccaauaaaggauuu

SEQ ID NO: 72113 - RNA, 19 nt, Homo sapiens
gauguaagccuggcccaua

SEQ ID NO: 72114 - RNA, 19 nt, Homo sapiens
gaagagcaagggacaguga

SEQ ID NO: 72115 - RNA, 19 nt, Homo sapiens
uauaaugacugcucuugug

SEQ ID NO: 72116 - RNA, 19 nt, Homo sapiens
ggauauuuacugcucuuua

SEQ ID NO: 72117 - RNA, 19 nt, Homo sapiens
ucuguuaccuuguuaauag

SEQ ID NO: 72118 - RNA, 19 nt, Homo sapiens
ucacuaaugcucaacaauu

SEQ ID NO: 72119 - RNA, 19 nt, Homo sapiens
caaagccacugacugagau

SEQ ID NO: 72120 - RNA, 19 nt, Homo sapiens
uaacagugguagagucaug

SEQ ID NO: 72121 - RNA, 19 nt, Homo sapiens
cuuaauacaugcaacagaa

SEQ ID NO: 72122 - RNA, 19 nt, Homo sapiens
uaccgucccucuucaguaa

SEQ ID NO: 72123 - RNA, 19 nt, Homo sapiens
cauaugaguuagaggagaa

SEQ ID NO: 72124 - RNA, 19 nt, Homo sapiens
ccaaggaacucuacuucag

SEQ ID NO: 72125 - RNA, 19 nt, Homo sapiens
gagaagaacaagaaaugga

SEQ ID NO: 72126 - RNA, 19 nt, Homo sapiens
gguauugagugugauuuga

SEQ ID NO: 72127 - RNA, 19 nt, Homo sapiens
gguguuaucuuuugaauuc

SEQ ID NO: 72128 - RNA, 19 nt, Homo sapiens
ggaguuaggaccaccaaug

SEQ ID NO: 72129 - RNA, 19 nt, Homo sapiens
aggaagaguuuauggcaaa

SEQ ID NO: 72130 - RNA, 19 nt, Homo sapiens
gacccacacuuccaugaga

SEQ ID NO: 72131 - RNA, 19 nt, Homo sapiens
cccaaacucuucuucauuc

SEQ ID NO: 72132 - RNA, 19 nt, Homo sapiens
gaaacggaacagacaaaga

SEQ ID NO: 72133 - RNA, 19 nt, Homo sapiens
gauaagagaauaccuuggu

SEQ ID NO: 72134 - RNA, 19 nt, Homo sapiens
gagugugauuugaaugauu

SEQ ID NO: 72135 - RNA, 19 nt, Homo sapiens
ggauuugacagcccacuuu

SEQ ID NO: 72136 - RNA, 19 nt, Homo sapiens
ccgaggcgcucuucaagug

SEQ ID NO: 72137 - RNA, 19 nt, Homo sapiens
aaaugugguugcuuaauuc

SEQ ID NO: 72138 - RNA, 19 nt, Homo sapiens
gaguuuauggcaaagauuu

SEQ ID NO: 72139 - RNA, 19 nt, Homo sapiens
uagauuauuccaagccuua

SEQ ID NO: 72140 - RNA, 19 nt, Homo sapiens
gcuuaaugauucugauaug

SEQ ID NO: 72141 - RNA, 19 nt, Homo sapiens
gaugaucagggcuguauug

SEQ ID NO: 72142 - RNA, 19 nt, Homo sapiens
aagauucaguggaugcuaa

SEQ ID NO: 72143 - RNA, 19 nt, Homo sapiens
gagguuugguuuccugugu

SEQ ID NO: 72144 - RNA, 19 nt, Homo sapiens
guaugucuguuaccuuguu

SEQ ID NO: 72145 - RNA, 19 nt, Homo sapiens
uaguuucgcuuucgcuaaa

SEQ ID NO: 72146 - RNA, 19 nt, Homo sapiens
ggaguuuaauacaggaaau

SEQ ID NO: 72147 - RNA, 19 nt, Homo sapiens
ccagaccgguccucguuug

SEQ ID NO: 72148 - RNA, 19 nt, Homo sapiens
cuguguaacuuucucuuaa

SEQ ID NO: 72149 - RNA, 19 nt, Homo sapiens
gaacgauggcagaugauca

SEQ ID NO: 72150 - RNA, 19 nt, Homo sapiens
gauuugacagcccacuuua

SEQ ID NO: 72151 - RNA, 19 nt, Homo sapiens
aaacggaacagacaaagau

SEQ ID NO: 72152 - RNA, 19 nt, Homo sapiens
gagauggagugagcugaga

SEQ ID NO: 72153 - RNA, 19 nt, Homo sapiens
ugggaacgauggcagauga

SEQ ID NO: 72154 - RNA, 19 nt, Homo sapiens
cuuaagccauggagaagaa

SEQ ID NO: 72155 - RNA, 19 nt, Homo sapiens
ggacagugaggcaggagaa

SEQ ID NO: 72156 - RNA, 19 nt, Homo sapiens
ucaaugacacagaugcuaa

SEQ ID NO: 72157 - RNA, 19 nt, Homo sapiens
ugacgugauugucuauaau

SEQ ID NO: 72158 - RNA, 19 nt, Homo sapiens
cuacauaucaguacaacau

SEQ ID NO: 72159 - RNA, 19 nt, Homo sapiens
ggaccgagugccuacauau

SEQ ID NO: 72160 - RNA, 19 nt, Homo sapiens
gggaccgagugccuacaua

SEQ ID NO: 72161 - RNA, 19 nt, Homo sapiens
gguugaggauucagcaaau

SEQ ID NO: 72162 - RNA, 19 nt, Homo sapiens
gauaaugggaagagguuug

SEQ ID NO: 72163 - RNA, 19 nt, Homo sapiens
uucauuggguugucagaua

SEQ ID NO: 72164 - RNA, 19 nt, Homo sapiens
ugggaaagauggugucaca

SEQ ID NO: 72165 - RNA, 19 nt, Homo sapiens
uaagugaggaagaguuuau

SEQ ID NO: 72166 - RNA, 19 nt, Homo sapiens
cauaaguaaucacuaaugc

SEQ ID NO: 72167 - RNA, 19 nt, Homo sapiens
ggcaggagaagaacaagaa

SEQ ID NO: 72168 - RNA, 19 nt, Homo sapiens
gagcugagacagauaagag

SEQ ID NO: 72169 - RNA, 19 nt, Homo sapiens
gcucuuuauugcagaaugu

SEQ ID NO: 72170 - RNA, 19 nt, Homo sapiens
gaaucccaauguuugacaa

SEQ ID NO: 72171 - RNA, 19 nt, Homo sapiens
gcccaucaaugacacagau

SEQ ID NO: 72172 - RNA, 19 nt, Homo sapiens
ugaagaggaccauacaaau

SEQ ID NO: 72173 - RNA, 19 nt, Homo sapiens
acauaucaguacaacauga

SEQ ID NO: 72174 - RNA, 19 nt, Homo sapiens
uauaagugaggaagaguuu

SEQ ID NO: 72175 - RNA, 19 nt, Homo sapiens
uacaggaaauugacuuaca

SEQ ID NO: 72176 - RNA, 19 nt, Homo sapiens
guguaacuuucucuuaaga

SEQ ID NO: 72177 - RNA, 19 nt, Homo sapiens
ccacgguuccaggcuauua

SEQ ID NO: 72178 - RNA, 19 nt, Homo sapiens
guaccgucccucuucagua

SEQ ID NO: 72179 - RNA, 19 nt, Homo sapiens
cagggugaaugacagaguu

SEQ ID NO: 72180 - RNA, 19 nt, Homo sapiens
aaagaaucccaauguuuga

SEQ ID NO: 72181 - RNA, 19 nt, Homo sapiens
gcuaauccucgauacaaga

SEQ ID NO: 72182 - RNA, 19 nt, Homo sapiens
ccaaacucuucuucauuca

SEQ ID NO: 72183 - RNA, 19 nt, Homo sapiens
gcaggagaagaacaagaaa

SEQ ID NO: 72184 - RNA, 19 nt, Homo sapiens
caggaaauugacuuacaua

SEQ ID NO: 72185 - RNA, 19 nt, Homo sapiens
gggcagauuuucaugcaaa

SEQ ID NO: 72186 - RNA, 19 nt, Homo sapiens
ugacacagaugcuaauccu

SEQ ID NO: 72187 - RNA, 19 nt, Homo sapiens
cugaagaggaccauacaaa

SEQ ID NO: 72188 - RNA, 19 nt, Homo sapiens
uugacgugauugucuauaa

SEQ ID NO: 72189 - RNA, 19 nt, Homo sapiens
uugauaaagugacagguau

SEQ ID NO: 72190 - RNA, 19 nt, Homo sapiens
cugggcaaaugcaucauaa

SEQ ID NO: 72191 - RNA, 19 nt, Homo sapiens
gcacuuuguuuucaagaug

SEQ ID NO: 72192 - RNA, 19 nt, Homo sapiens
ggaaaagaccuggaaauca

SEQ ID NO: 72193 - RNA, 19 nt, Homo sapiens
acaggaaauugacuuacau

SEQ ID NO: 72194 - RNA, 19 nt, Homo sapiens
gaacaaagccacugacuga

SEQ ID NO: 72195 - RNA, 19 nt, Homo sapiens
ggaagaggcuccugguuug

SEQ ID NO: 72196 - RNA, 19 nt, Homo sapiens
caacagagggaguuuaaua

SEQ ID NO: 72197 - RNA, 19 nt, Homo sapiens
gaucagggcuguauugaag

SEQ ID NO: 72198 - RNA, 19 nt, Homo sapiens
gggcaaaugcaucauaaua

SEQ ID NO: 72199 - RNA, 19 nt, Homo sapiens
gcucaacaauuuauccauu

SEQ ID NO: 72200 - RNA, 19 nt, Homo sapiens
gaacucuacuucagucaau

SEQ ID NO: 72201 - RNA, 19 nt, Homo sapiens
gaagaggaccauacaaaug

SEQ ID NO: 72202 - RNA, 19 nt, Homo sapiens
gaacaagaaauggauguaa

SEQ ID NO: 72203 - RNA, 19 nt, Homo sapiens
ggagugaacugugcaaaca

SEQ ID NO: 72204 - RNA, 19 nt, Homo sapiens
gaagccaccucaccaagga

SEQ ID NO: 72205 - RNA, 19 nt, Homo sapiens
ggagugagcugagacagau

SEQ ID NO: 72206 - RNA, 19 nt, Homo sapiens
ggaaauugacuuacauaga

SEQ ID NO: 72207 - RNA, 19 nt, Homo sapiens
gaaaagaccuggaaaucau

SEQ ID NO: 72208 - RNA, 19 nt, Homo sapiens
cagcagagaucaaugagau

SEQ ID NO: 72209 - RNA, 19 nt, Homo sapiens
cacuaaugcucaacaauuu

SEQ ID NO: 72210 - RNA, 19 nt, Homo sapiens
ggacagggaggagaaagua

SEQ ID NO: 72211 - RNA, 19 nt, Homo sapiens
ugagacagauaagagaaua

SEQ ID NO: 72212 - RNA, 19 nt, Homo sapiens
gaauguggguauugagugu

SEQ ID NO: 72213 - RNA, 19 nt, Homo sapiens
gaugcaagaucugcuuaaa

SEQ ID NO: 72214 - RNA, 19 nt, Homo sapiens
ggcaaaugcaucauaauaa

SEQ ID NO: 72215 - RNA, 19 nt, Homo sapiens
guaauggacuguguugguu

SEQ ID NO: 72216 - RNA, 19 nt, Homo sapiens
caacagugguagagucaug

SEQ ID NO: 72217 - RNA, 19 nt, Homo sapiens
ucacaccaauaaaggauuu

SEQ ID NO: 72218 - RNA, 19 nt, Homo sapiens
gauuugugcuucuuauguu

SEQ ID NO: 72219 - RNA, 19 nt, Homo sapiens
gauguaagccuggcccaua

SEQ ID NO: 72220 - RNA, 19 nt, Homo sapiens
gaagagcaagggacaguga

SEQ ID NO: 72221 - RNA, 19 nt, Homo sapiens
uauaaugacugcucuugug

SEQ ID NO: 72222 - RNA, 19 nt, Homo sapiens
ggauauuuacugcucuuua

SEQ ID NO: 72223 - RNA, 19 nt, Homo sapiens
ucuguuaccuuguuaauag

SEQ ID NO: 72224 - RNA, 19 nt, Homo sapiens
ucacuaaugcucaacaauu

SEQ ID NO: 72225 - RNA, 19 nt, Homo sapiens
caaagccacugacugagau

SEQ ID NO: 72226 - RNA, 19 nt, Homo sapiens
cuuaauacaugcaacagaa

SEQ ID NO: 72227 - RNA, 19 nt, Homo sapiens
uaccgucccucuucaguaa

SEQ ID NO: 72228 - RNA, 19 nt, Homo sapiens
gcuguacccucgaugcaaa

SEQ ID NO: 72229 - RNA, 19 nt, Homo sapiens
cauaugaguuagaggagaa

SEQ ID NO: 72230 - RNA, 19 nt, Homo sapiens
ccaaggaacucuacuucag

SEQ ID NO: 72231 - RNA, 19 nt, Homo sapiens
gagaagaacaagaaaugga

SEQ ID NO: 72232 - RNA, 19 nt, Homo sapiens
gguauugagugugauuuga

SEQ ID NO: 72233 - RNA, 19 nt, Homo sapiens
gguguuaucuuuugaauuc

SEQ ID NO: 72234 - RNA, 19 nt, Homo sapiens
ggaguuaggaccaccaaug

SEQ ID NO: 72235 - RNA, 19 nt, Homo sapiens
aaacagcagagaucaauga

SEQ ID NO: 72236 - RNA, 19 nt, Homo sapiens
aggaagaguuuauggcaaa

SEQ ID NO: 72237 - RNA, 19 nt, Homo sapiens
gacccacacuuccaugaga

SEQ ID NO: 72238 - RNA, 19 nt, Homo sapiens
cccaaacucuucuucauuc

SEQ ID NO: 72239 - RNA, 19 nt, Homo sapiens
gaaacggaacagacaaaga

SEQ ID NO: 72240 - RNA, 19 nt, Homo sapiens
gauaagagaauaccuuggu

SEQ ID NO: 72241 - RNA, 19 nt, Homo sapiens
gagugugauuugaaugauu

SEQ ID NO: 72242 - RNA, 19 nt, Homo sapiens
ggauuugacagcccacuuu

SEQ ID NO: 72243 - RNA, 19 nt, Homo sapiens
gaacggagagagggaguga

SEQ ID NO: 72244 - RNA, 19 nt, Homo sapiens
ccgaggcgcucuucaagug

SEQ ID NO: 72245 - RNA, 19 nt, Homo sapiens
aaaugugguugcuuaauuc

SEQ ID NO: 72246 - RNA, 19 nt, Homo sapiens
gaguuuauggcaaagauuu

SEQ ID NO: 72247 - RNA, 19 nt, Homo sapiens
uagauuauuccaagccuua

SEQ ID NO: 72248 - RNA, 19 nt, Homo sapiens
gcuuaaugauucugauaug

SEQ ID NO: 72249 - RNA, 19 nt, Homo sapiens
gagguuugguuuccugugu

SEQ ID NO: 72250 - RNA, 19 nt, Homo sapiens
guaugucuguuaccuuguu

SEQ ID NO: 72251 - RNA, 19 nt, Homo sapiens
aagauucaguggaugcuaa

SEQ ID NO: 72252 - RNA, 19 nt, Homo sapiens
gaugaucagggcuguauug

SEQ ID NO: 72253 - RNA, 19 nt, Homo sapiens
ggaguuuaauacaggaaau

SEQ ID NO: 72254 - RNA, 19 nt, Homo sapiens
cuguguaacuuucucuuaa

SEQ ID NO: 72255 - RNA, 19 nt, Homo sapiens
gauuugacagcccacuuua

SEQ ID NO: 72256 - RNA, 19 nt, Homo sapiens
aaacggaacagacaaagau

SEQ ID NO: 72257 - RNA, 19 nt, Homo sapiens
ccagaccgguccucguuug

SEQ ID NO: 72258 - RNA, 19 nt, Homo sapiens
ggaacgaugcuguaaugga

SEQ ID NO: 72259 - RNA, 19 nt, Homo sapiens
ugggaacgaugcuguaaug

SEQ ID NO: 72260 - RNA, 19 nt, Homo sapiens
gagauggagugagcugaga

SEQ ID NO: 72261 - RNA, 19 nt, Homo sapiens
cuuaagccauggagaagaa

SEQ ID NO: 72262 - RNA, 19 nt, Homo sapiens
uuacccagauggcagauga

SEQ ID NO: 72263 - RNA, 19 nt, Homo sapiens
ggacagugaggcaggagaa

SEQ ID NO: 72264 - RNA, 19 nt, Homo sapiens
ggaagggauacaugacaaa

SEQ ID NO: 72265 - RNA, 19 nt, Homo sapiens
ucaaugacacagaugcuaa

SEQ ID NO: 72266 - RNA, 19 nt, Homo sapiens
ugacgugauugucuauaau

SEQ ID NO: 72267 - RNA, 19 nt, Homo sapiens
cuacauaucaguacaacau

SEQ ID NO: 72268 - RNA, 19 nt, Homo sapiens
ggaccgagugccuacauau

SEQ ID NO: 72269 - RNA, 19 nt, Homo sapiens
gggaccgagugccuacaua

SEQ ID NO: 72270 - RNA, 19 nt, Homo sapiens
gauaaugggaagagguuug

SEQ ID NO: 72271 - RNA, 19 nt, Homo sapiens
gguugaggauucagcaaau

SEQ ID NO: 72272 - RNA, 19 nt, Homo sapiens
ggauuugugcuucuuaugu

SEQ ID NO: 72273 - RNA, 19 nt, Homo sapiens
ggugguagcagugggauuu

SEQ ID NO: 72274 - RNA, 19 nt, Homo sapiens
uucauuggguugucagaua

SEQ ID NO: 72275 - RNA, 19 nt, Homo sapiens
ugggaaagauggugucaca

SEQ ID NO: 72276 - RNA, 19 nt, Homo sapiens
uaagugaggaagaguuuau

SEQ ID NO: 72277 - RNA, 19 nt, Homo sapiens
cauaaguaaucacuaaugc

SEQ ID NO: 72278 - RNA, 19 nt, Homo sapiens
ggcaggagaagaacaagaa

SEQ ID NO: 72279 - RNA, 19 nt, Homo sapiens
gagcugagacagauaagag

SEQ ID NO: 72280 - RNA, 19 nt, Homo sapiens
gcucuuuauugcagaaugu

SEQ ID NO: 72281 - RNA, 19 nt, Homo sapiens
gaaucccaauguuugacaa

SEQ ID NO: 72282 - RNA, 19 nt, Homo sapiens
gcccaucaaugacacagau

SEQ ID NO: 72283 - RNA, 19 nt, Homo sapiens
ugaagaggaccauacaaau

SEQ ID NO: 72284 - RNA, 19 nt, Homo sapiens
gaagggauacaugacaaau

SEQ ID NO: 72285 - RNA, 19 nt, Homo sapiens
ggagagagggagugaacug

SEQ ID NO: 72286 - RNA, 19 nt, Homo sapiens
acauaucaguacaacauga

SEQ ID NO: 72287 - RNA, 19 nt, Homo sapiens
uauaagugaggaagaguuu

SEQ ID NO: 72288 - RNA, 19 nt, Homo sapiens
uacaggaaauugacuuaca

SEQ ID NO: 72289 - RNA, 19 nt, Homo sapiens
guguaacuuucucuuaaga

SEQ ID NO: 72290 - RNA, 19 nt, Homo sapiens
ccacgguuccaggcuauua

SEQ ID NO: 72291 - RNA, 19 nt, Homo sapiens
acagggaggagaaaguaua

SEQ ID NO: 72292 - RNA, 19 nt, Homo sapiens
cagggugaaugacagaguu

SEQ ID NO: 72293 - RNA, 19 nt, Homo sapiens
guaccgucccucuucagua

SEQ ID NO: 72294 - RNA, 19 nt, Homo sapiens
gaacaaagccacugacuga

SEQ ID NO: 72295 - RNA, 19 nt, Homo sapiens
ggaagaggcuccugguuug

SEQ ID NO: 72296 - RNA, 19 nt, Homo sapiens
caacagagggaguuuaaua

SEQ ID NO: 72297 - RNA, 19 nt, Homo sapiens
gaucagggcuguauugaag

SEQ ID NO: 72298 - RNA, 19 nt, Homo sapiens
gggcaaaugcaucauaaua

SEQ ID NO: 72299 - RNA, 19 nt, Homo sapiens
gcucaacaauuuauccauu

SEQ ID NO: 72300 - RNA, 19 nt, Homo sapiens
gaacucuacuucagucaau

SEQ ID NO: 72301 - RNA, 19 nt, Homo sapiens
gaagaggaccauacaaaug

SEQ ID NO: 72302 - RNA, 19 nt, Homo sapiens
gaacaagaaauggauguaa

SEQ ID NO: 72303 - RNA, 19 nt, Homo sapiens
gaagccaccucaccaagga

SEQ ID NO: 72304 - RNA, 19 nt, Homo sapiens
ggagugagcugagacagau

SEQ ID NO: 72305 - RNA, 19 nt, Homo sapiens
ggaaauugacuuacauaga

SEQ ID NO: 72306 - RNA, 19 nt, Homo sapiens
gaaaagaccuggaaaucau

SEQ ID NO: 72307 - RNA, 19 nt, Homo sapiens
cacuaaugcucaacaauuu

SEQ ID NO: 72308 - RNA, 19 nt, Homo sapiens
ugagacagauaagagaaua

SEQ ID NO: 72309 - RNA, 19 nt, Homo sapiens
gaauguggguauugagugu

SEQ ID NO: 72310 - RNA, 19 nt, Homo sapiens
gaugcaagaucugcuuaaa

SEQ ID NO: 72311 - RNA, 19 nt, Homo sapiens
ggcaaaugcaucauaauaa

SEQ ID NO: 72312 - RNA, 19 nt, Homo sapiens
ucacaccaauaaaggauuu

SEQ ID NO: 72313 - RNA, 19 nt, Homo sapiens
gauuugugcuucuuauguu

SEQ ID NO: 72314 - RNA, 19 nt, Homo sapiens
gauguaagccuggcccaua

SEQ ID NO: 72315 - RNA, 19 nt, Homo sapiens
gaagagcaagggacaguga

SEQ ID NO: 72316 - RNA, 19 nt, Homo sapiens
uauaaugacugcucuugug

SEQ ID NO: 72317 - RNA, 19 nt, Homo sapiens
ggauauuuacugcucuuua

SEQ ID NO: 72318 - RNA, 19 nt, Homo sapiens
ucuguuaccuuguuaauag

SEQ ID NO: 72319 - RNA, 19 nt, Homo sapiens
ucacuaaugcucaacaauu

SEQ ID NO: 72320 - RNA, 19 nt, Homo sapiens
caaagccacugacugagau

SEQ ID NO: 72321 - RNA, 19 nt, Homo sapiens
uaacagugguagagucaug

SEQ ID NO: 72322 - RNA, 19 nt, Homo sapiens
cuuaauacaugcaacagaa

SEQ ID NO: 72323 - RNA, 19 nt, Homo sapiens
uaccgucccucuucaguaa

SEQ ID NO: 72324 - RNA, 19 nt, Homo sapiens
cauaugaguuagaggagaa

SEQ ID NO: 72325 - RNA, 19 nt, Homo sapiens
ccaaggaacucuacuucag

SEQ ID NO: 72326 - RNA, 19 nt, Homo sapiens
gagaagaacaagaaaugga

SEQ ID NO: 72327 - RNA, 19 nt, Homo sapiens
gguauugagugugauuuga

SEQ ID NO: 72328 - RNA, 19 nt, Homo sapiens
gguguuaucuuuugaauuc

SEQ ID NO: 72329 - RNA, 19 nt, Homo sapiens
ggaguuaggaccaccaaug

SEQ ID NO: 72330 - RNA, 19 nt, Homo sapiens
aggaagaguuuauggcaaa

SEQ ID NO: 72331 - RNA, 19 nt, Homo sapiens
gacccacacuuccaugaga

SEQ ID NO: 72332 - RNA, 19 nt, Homo sapiens
cccaaacucuucuucauuc

SEQ ID NO: 72333 - RNA, 19 nt, Homo sapiens
gaaacggaacagacaaaga

SEQ ID NO: 72334 - RNA, 19 nt, Homo sapiens
gauaagagaauaccuuggu

SEQ ID NO: 72335 - RNA, 19 nt, Homo sapiens
gagugugauuugaaugauu

SEQ ID NO: 72336 - RNA, 19 nt, Homo sapiens
ggauuugacagcccacuuu

SEQ ID NO: 72337 - RNA, 19 nt, Homo sapiens
ccgaggcgcucuucaagug

SEQ ID NO: 72338 - RNA, 19 nt, Homo sapiens
aaaugugguugcuuaauuc

SEQ ID NO: 72339 - RNA, 19 nt, Homo sapiens
gaguuuauggcaaagauuu

SEQ ID NO: 72340 - RNA, 19 nt, Homo sapiens
uagauuauuccaagccuua

SEQ ID NO: 72341 - RNA, 19 nt, Homo sapiens
gcuuaaugauucugauaug

SEQ ID NO: 72342 - RNA, 19 nt, Homo sapiens
uaguuucgcuuucgcuaaa

SEQ ID NO: 72343 - RNA, 19 nt, Homo sapiens
gagguuugguuuccugugu

SEQ ID NO: 72344 - RNA, 19 nt, Homo sapiens
guaugucuguuaccuuguu

SEQ ID NO: 72345 - RNA, 19 nt, Homo sapiens
aagauucaguggaugcuaa

SEQ ID NO: 72346 - RNA, 19 nt, Homo sapiens
gaugaucagggcuguauug

SEQ ID NO: 72347 - RNA, 19 nt, Homo sapiens
ggaguuuaauacaggaaau

SEQ ID NO: 72348 - RNA, 19 nt, Homo sapiens
cuguguaacuuucucuuaa

SEQ ID NO: 72349 - RNA, 19 nt, Homo sapiens
gauuugacagcccacuuua

SEQ ID NO: 72350 - RNA, 19 nt, Homo sapiens
aaacggaacagacaaagau

SEQ ID NO: 72351 - RNA, 19 nt, Homo sapiens
ccagaccgguccucguuug

SEQ ID NO: 72352 - RNA, 19 nt, Homo sapiens
gagauggagugagcugaga

SEQ ID NO: 72353 - RNA, 19 nt, Homo sapiens
uuacccagauggcagauga

SEQ ID NO: 72354 - RNA, 19 nt, Homo sapiens
cuuaagccauggagaagaa

SEQ ID NO: 72355 - RNA, 19 nt, Homo sapiens
ggacagugaggcaggagaa

SEQ ID NO: 72356 - RNA, 19 nt, Homo sapiens
ucaaugacacagaugcuaa

SEQ ID NO: 72357 - RNA, 19 nt, Homo sapiens
ugacgugauugucuauaau

SEQ ID NO: 72358 - RNA, 19 nt, Homo sapiens
cuacauaucaguacaacau

SEQ ID NO: 72359 - RNA, 19 nt, Homo sapiens
ggaccgagugccuacauau

SEQ ID NO: 72360 - RNA, 19 nt, Homo sapiens
gggaccgagugccuacaua

SEQ ID NO: 72361 - RNA, 19 nt, Homo sapiens
gauaaugggaagagguuug

SEQ ID NO: 72362 - RNA, 19 nt, Homo sapiens
ggugguagcagugggauuu

SEQ ID NO: 72363 - RNA, 19 nt, Homo sapiens
gguugaggauucagcaaau

SEQ ID NO: 72364 - RNA, 19 nt, Homo sapiens
ggauuugugcuucuuaugu

SEQ ID NO: 72365 - RNA, 19 nt, Homo sapiens
uucauuggguugucagaua

SEQ ID NO: 72366 - RNA, 19 nt, Homo sapiens
ugggaaagauggugucaca

SEQ ID NO: 72367 - RNA, 19 nt, Homo sapiens
uaagugaggaagaguuuau

SEQ ID NO: 72368 - RNA, 19 nt, Homo sapiens
cauaaguaaucacuaaugc

SEQ ID NO: 72369 - RNA, 19 nt, Homo sapiens
ggcaggagaagaacaagaa

SEQ ID NO: 72370 - RNA, 19 nt, Homo sapiens
gagcugagacagauaagag

SEQ ID NO: 72371 - RNA, 19 nt, Homo sapiens
gcucuuuauugcagaaugu

SEQ ID NO: 72372 - RNA, 19 nt, Homo sapiens
gaaucccaauguuugacaa

SEQ ID NO: 72373 - RNA, 19 nt, Homo sapiens
gcccaucaaugacacagau

SEQ ID NO: 72374 - RNA, 19 nt, Homo sapiens
ugaagaggaccauacaaau

SEQ ID NO: 72375 - RNA, 19 nt, Homo sapiens
acauaucaguacaacauga

SEQ ID NO: 72376 - RNA, 19 nt, Homo sapiens
uauaagugaggaagaguuu

SEQ ID NO: 72377 - RNA, 19 nt, Homo sapiens
uacaggaaauugacuuaca

SEQ ID NO: 72378 - RNA, 19 nt, Homo sapiens
guguaacuuucucuuaaga

SEQ ID NO: 72379 - RNA, 19 nt, Homo sapiens
ccacgguuccaggcuauua

SEQ ID NO: 72380 - RNA, 19 nt, Homo sapiens
cagggugaaugacagaguu

SEQ ID NO: 72381 - RNA, 19 nt, Homo sapiens
guaccgucccucuucagua

SEQ ID NO: 72382 - RNA, 19 nt, Homo sapiens
aaagaaucccaauguuuga

SEQ ID NO: 72383 - RNA, 19 nt, Homo sapiens
gcuaauccucgauacaaga

SEQ ID NO: 72384 - RNA, 19 nt, Homo sapiens
ccaaacucuucuucauuca

SEQ ID NO: 72385 - RNA, 19 nt, Homo sapiens
gcaggagaagaacaagaaa

SEQ ID NO: 72386 - RNA, 19 nt, Homo sapiens
caggaaauugacuuacaua

SEQ ID NO: 72387 - RNA, 19 nt, Homo sapiens
gggcagauuuucaugcaaa

SEQ ID NO: 72388 - RNA, 19 nt, Homo sapiens
ugacacagaugcuaauccu

SEQ ID NO: 72389 - RNA, 19 nt, Homo sapiens
cugaagaggaccauacaaa

SEQ ID NO: 72390 - RNA, 19 nt, Homo sapiens
uugacgugauugucuauaa

SEQ ID NO: 72391 - RNA, 19 nt, Homo sapiens
uugauaaagugacagguau

SEQ ID NO: 72392 - RNA, 19 nt, Homo sapiens
cugggcaaaugcaucauaa

SEQ ID NO: 72393 - RNA, 19 nt, Homo sapiens
gcacuuuguuuucaagaug

SEQ ID NO: 72394 - RNA, 19 nt, Homo sapiens
gaacaaagccacugacuga

SEQ ID NO: 72395 - RNA, 19 nt, Homo sapiens
ggaagaggcuccugguuug

SEQ ID NO: 72396 - RNA, 19 nt, Homo sapiens
caacagagggaguuuaaua

SEQ ID NO: 72397 - RNA, 19 nt, Homo sapiens
gaucagggcuguauugaag

SEQ ID NO: 72398 - RNA, 19 nt, Homo sapiens
gggcaaaugcaucauaaua

SEQ ID NO: 72399 - RNA, 19 nt, Homo sapiens
gcucaacaauuuauccauu

SEQ ID NO: 72400 - RNA, 19 nt, Homo sapiens
gaacucuacuucagucaau

SEQ ID NO: 72401 - RNA, 19 nt, Homo sapiens
gaagaggaccauacaaaug

SEQ ID NO: 72402 - RNA, 19 nt, Homo sapiens
gaacaagaaauggauguaa

SEQ ID NO: 72403 - RNA, 19 nt, Homo sapiens
gaagccaccucaccaagga

SEQ ID NO: 72404 - RNA, 19 nt, Homo sapiens
ggagugagcugagacagau

SEQ ID NO: 72405 - RNA, 19 nt, Homo sapiens
ggaaauugacuuacauaga

SEQ ID NO: 72406 - RNA, 19 nt, Homo sapiens
gaaaagaccuggaaaucau

SEQ ID NO: 72407 - RNA, 19 nt, Homo sapiens
cacuaaugcucaacaauuu

SEQ ID NO: 72408 - RNA, 19 nt, Homo sapiens
ugagacagauaagagaaua

SEQ ID NO: 72409 - RNA, 19 nt, Homo sapiens
gaauguggguauugagugu

SEQ ID NO: 72410 - RNA, 19 nt, Homo sapiens
gaugcaagaucugcuuaaa

SEQ ID NO: 72411 - RNA, 19 nt, Homo sapiens
ggcaaaugcaucauaauaa

SEQ ID NO: 72412 - RNA, 19 nt, Homo sapiens
gauguaagccuggcccaua

SEQ ID NO: 72413 - RNA, 19 nt, Homo sapiens
gaagagcaagggacaguga

SEQ ID NO: 72414 - RNA, 19 nt, Homo sapiens
uauaaugacugcucuugug

SEQ ID NO: 72415 - RNA, 19 nt, Homo sapiens
ggauauuuacugcucuuua

SEQ ID NO: 72416 - RNA, 19 nt, Homo sapiens
ucuguuaccuuguuaauag

SEQ ID NO: 72417 - RNA, 19 nt, Homo sapiens
ucacuaaugcucaacaauu

SEQ ID NO: 72418 - RNA, 19 nt, Homo sapiens
caaagccacugacugagau

SEQ ID NO: 72419 - RNA, 19 nt, Homo sapiens
uaacagugguagagucaug

SEQ ID NO: 72420 - RNA, 19 nt, Homo sapiens
cuuaauacaugcaacagaa

SEQ ID NO: 72421 - RNA, 19 nt, Homo sapiens
uaccgucccucuucaguaa

SEQ ID NO: 72422 - RNA, 19 nt, Homo sapiens
cauaugaguuagaggagaa

SEQ ID NO: 72423 - RNA, 19 nt, Homo sapiens
ccaaggaacucuacuucag

SEQ ID NO: 72424 - RNA, 19 nt, Homo sapiens
gagaagaacaagaaaugga

SEQ ID NO: 72425 - RNA, 19 nt, Homo sapiens
gguauugagugugauuuga

SEQ ID NO: 72426 - RNA, 19 nt, Homo sapiens
gguguuaucuuuugaauuc

SEQ ID NO: 72427 - RNA, 19 nt, Homo sapiens
ggaguuaggaccaccaaug

SEQ ID NO: 72428 - RNA, 19 nt, Homo sapiens
gguggguacuuccuucaaa

SEQ ID NO: 72429 - RNA, 19 nt, Homo sapiens
aggaagaguuuauggcaaa

SEQ ID NO: 72430 - RNA, 19 nt, Homo sapiens
gacccacacuuccaugaga

SEQ ID NO: 72431 - RNA, 19 nt, Homo sapiens
gaaacggaacagacaaaga

SEQ ID NO: 72432 - RNA, 19 nt, Homo sapiens
gauaagagaauaccuuggu

SEQ ID NO: 72433 - RNA, 19 nt, Homo sapiens
gagugugauuugaaugauu

SEQ ID NO: 72434 - RNA, 19 nt, Homo sapiens
ccgaggcgcucuucaagug

SEQ ID NO: 72435 - RNA, 19 nt, Homo sapiens
aaaugugguugcuuaauuc

SEQ ID NO: 72436 - RNA, 19 nt, Homo sapiens
gaguuuauggcaaagauuu

SEQ ID NO: 72437 - RNA, 19 nt, Homo sapiens
uagauuauuccaagccuua

SEQ ID NO: 72438 - RNA, 19 nt, Homo sapiens
gcuuaaugauucugauaug

SEQ ID NO: 72439 - RNA, 19 nt, Homo sapiens
aagauucaguggaugcuaa

SEQ ID NO: 72440 - RNA, 19 nt, Homo sapiens
gagguuugguuuccugugu

SEQ ID NO: 72441 - RNA, 19 nt, Homo sapiens
gaugaucagggcuguauug

SEQ ID NO: 72442 - RNA, 19 nt, Homo sapiens
guaugucuguuaccuuguu

SEQ ID NO: 72443 - RNA, 19 nt, Homo sapiens
ccagaccgguccucguuug

SEQ ID NO: 72444 - RNA, 19 nt, Homo sapiens
ggaguuuaauacaggaaau

SEQ ID NO: 72445 - RNA, 19 nt, Homo sapiens
cuguguaacuuucucuuaa

SEQ ID NO: 72446 - RNA, 19 nt, Homo sapiens
aaacggaacagacaaagau

SEQ ID NO: 72447 - RNA, 19 nt, Homo sapiens
gagauggagugagcugaga

SEQ ID NO: 72448 - RNA, 19 nt, Homo sapiens
cuuaagccauggagaagaa

SEQ ID NO: 72449 - RNA, 19 nt, Homo sapiens
ggacagugaggcaggagaa

SEQ ID NO: 72450 - RNA, 19 nt, Homo sapiens
ucaaugacacagaugcuaa

SEQ ID NO: 72451 - RNA, 19 nt, Homo sapiens
ugacgugauugucuauaau

SEQ ID NO: 72452 - RNA, 19 nt, Homo sapiens
cuacauaucaguacaacau

SEQ ID NO: 72453 - RNA, 19 nt, Homo sapiens
ggaccgagugccuacauau

SEQ ID NO: 72454 - RNA, 19 nt, Homo sapiens
gggaccgagugccuacaua

SEQ ID NO: 72455 - RNA, 19 nt, Homo sapiens
gauaaugggaagagguuug

SEQ ID NO: 72456 - RNA, 19 nt, Homo sapiens
gguugaggauucagcaaau

SEQ ID NO: 72457 - RNA, 19 nt, Homo sapiens
uucauuggguugucagaua

SEQ ID NO: 72458 - RNA, 19 nt, Homo sapiens
uaagugaggaagaguuuau

SEQ ID NO: 72459 - RNA, 19 nt, Homo sapiens
cauaaguaaucacuaaugc

SEQ ID NO: 72460 - RNA, 19 nt, Homo sapiens
ggcaggagaagaacaagaa

SEQ ID NO: 72461 - RNA, 19 nt, Homo sapiens
gagcugagacagauaagag

SEQ ID NO: 72462 - RNA, 19 nt, Homo sapiens
gcucuuuauugcagaaugu

SEQ ID NO: 72463 - RNA, 19 nt, Homo sapiens
gaaucccaauguuugacaa

SEQ ID NO: 72464 - RNA, 19 nt, Homo sapiens
gcccaucaaugacacagau

SEQ ID NO: 72465 - RNA, 19 nt, Homo sapiens
ugaagaggaccauacaaau

SEQ ID NO: 72466 - RNA, 19 nt, Homo sapiens
acauaucaguacaacauga

SEQ ID NO: 72467 - RNA, 19 nt, Homo sapiens
uauaagugaggaagaguuu

SEQ ID NO: 72468 - RNA, 19 nt, Homo sapiens
uacaggaaauugacuuaca

SEQ ID NO: 72469 - RNA, 19 nt, Homo sapiens
guguaacuuucucuuaaga

SEQ ID NO: 72470 - RNA, 19 nt, Homo sapiens
ccacgguuccaggcuauua

SEQ ID NO: 72471 - RNA, 19 nt, Homo sapiens
cagggugaaugacagaguu

SEQ ID NO: 72472 - RNA, 19 nt, Homo sapiens
guaccgucccucuucagua

SEQ ID NO: 72473 - RNA, 19 nt, Homo sapiens
aaagaaucccaauguuuga

SEQ ID NO: 72474 - RNA, 19 nt, Homo sapiens
gcuaauccucgauacaaga

SEQ ID NO: 72475 - RNA, 19 nt, Homo sapiens
gcaggagaagaacaagaaa

SEQ ID NO: 72476 - RNA, 19 nt, Homo sapiens
caggaaauugacuuacaua

SEQ ID NO: 72477 - RNA, 19 nt, Homo sapiens
gggcagauuuucaugcaaa

SEQ ID NO: 72478 - RNA, 19 nt, Homo sapiens
ugacacagaugcuaauccu

SEQ ID NO: 72479 - RNA, 19 nt, Homo sapiens
cugaagaggaccauacaaa

SEQ ID NO: 72480 - RNA, 19 nt, Homo sapiens
uugacgugauugucuauaa

SEQ ID NO: 72481 - RNA, 19 nt, Homo sapiens
uugauaaagugacagguau

SEQ ID NO: 72482 - RNA, 19 nt, Homo sapiens
cugggcaaaugcaucauaa

SEQ ID NO: 72483 - RNA, 19 nt, Homo sapiens
gcacuuuguuuucaagaug

SEQ ID NO: 72484 - RNA, 19 nt, Homo sapiens
ggaaaagaccuggaaauca

SEQ ID NO: 72485 - RNA, 19 nt, Homo sapiens
gaccgguccucguuuguac

SEQ ID NO: 72486 - RNA, 19 nt, Homo sapiens
acaggaaauugacuuacau

SEQ ID NO: 72487 - RNA, 19 nt, Homo sapiens
guauugagugugauuugaa

SEQ ID NO: 72488 - RNA, 19 nt, Homo sapiens
gcugggcaaaugcaucaua

SEQ ID NO: 72489 - RNA, 19 nt, Homo sapiens
cuugugggauggcagauga

SEQ ID NO: 72490 - RNA, 19 nt, Homo sapiens
aacaagaaauggauguaag

SEQ ID NO: 72491 - RNA, 19 nt, Homo sapiens
acaaagccacugacugaga

SEQ ID NO: 72492 - RNA, 19 nt, Homo sapiens
gguaacagugguagaguca

SEQ ID NO: 72493 - RNA, 19 nt, Homo sapiens
gugauugucuauaaugacu

SEQ ID NO: 72494 - RNA, 19 nt, Homo sapiens
ggacaaaguuuaccaaaug

SEQ ID NO: 72495 - RNA, 19 nt, Homo sapiens
gagggucgaucaucuauua

SEQ ID NO: 72496 - RNA, 19 nt, Homo sapiens
caacaaggaugacaagaaa

SEQ ID NO: 72497 - RNA, 19 nt, Homo sapiens
gaagugaacuaugaaguaa

SEQ ID NO: 72498 - RNA, 19 nt, Homo sapiens
gagcaacccuauuuagaaa

SEQ ID NO: 72499 - RNA, 19 nt, Homo sapiens
gaauauagagggcuuauga

SEQ ID NO: 72500 - RNA, 19 nt, Homo sapiens
gagcuaaaguuaaauagga

SEQ ID NO: 72501 - RNA, 19 nt, Homo sapiens
ugacugaagugaacuauga

SEQ ID NO: 72502 - RNA, 19 nt, Homo sapiens
caauaacacugucuccuuu

SEQ ID NO: 72503 - RNA, 19 nt, Homo sapiens
caacgacuaugaagaauuc

SEQ ID NO: 72504 - RNA, 19 nt, Homo sapiens
gaucagaauugaggucuuu

SEQ ID NO: 72505 - RNA, 19 nt, Homo sapiens
caccacaccuggcuaauuu

SEQ ID NO: 72506 - RNA, 19 nt, Homo sapiens
ggucgaucaucuauuaaua

SEQ ID NO: 72507 - RNA, 19 nt, Homo sapiens
gaagugagcagaucagaau

SEQ ID NO: 72508 - RNA, 19 nt, Homo sapiens
gaggaaaucuccaaaugca

SEQ ID NO: 72509 - RNA, 19 nt, Homo sapiens
caagagaacaggauaguga

SEQ ID NO: 72510 - RNA, 19 nt, Homo sapiens
ggaaaucuccaaaugcaaa

SEQ ID NO: 72511 - RNA, 19 nt, Homo sapiens
caaacuggaugaugacaug

SEQ ID NO: 72512 - RNA, 19 nt, Homo sapiens
ggagcaacccuauuuagaa

SEQ ID NO: 72513 - RNA, 19 nt, Homo sapiens
uaaauaagcucuccccaaa

SEQ ID NO: 72514 - RNA, 19 nt, Homo sapiens
gacaugaaccugcuggaua

SEQ ID NO: 72515 - RNA, 19 nt, Homo sapiens
agacuggauuugcugauua

SEQ ID NO: 72516 - RNA, 19 nt, Homo sapiens
gacaaaguuuaccaaauga

SEQ ID NO: 72517 - RNA, 19 nt, Homo sapiens
gaagauaaucaacgacuau

SEQ ID NO: 72518 - RNA, 19 nt, Homo sapiens
gcaacaaggaugacaagaa

SEQ ID NO: 72519 - RNA, 19 nt, Homo sapiens
gcaagagaauuagcauuuc

SEQ ID NO: 72520 - RNA, 19 nt, Homo sapiens
cagcagaaaucuuuaugau

SEQ ID NO: 72521 - RNA, 19 nt, Homo sapiens
ggcaagagaauuagcauuu

SEQ ID NO: 72522 - RNA, 19 nt, Homo sapiens
ccagugggcaagagaauua

SEQ ID NO: 72523 - RNA, 19 nt, Homo sapiens
gaaaggaggagauggaaag

SEQ ID NO: 72524 - RNA, 19 nt, Homo sapiens
gauaaucaacgacuaugaa

SEQ ID NO: 72525 - RNA, 19 nt, Homo sapiens
uaauaagggucaugcucua

SEQ ID NO: 72526 - RNA, 19 nt, Homo sapiens
gcauuugcauuugcucuuu

SEQ ID NO: 72527 - RNA, 19 nt, Homo sapiens
gagcugggcugaagcaaac

SEQ ID NO: 72528 - RNA, 19 nt, Homo sapiens
uaugguggcucaugucuau

SEQ ID NO: 72529 - RNA, 19 nt, Homo sapiens
cagaggagcaacccuauuu

SEQ ID NO: 72530 - RNA, 19 nt, Homo sapiens
aaagcuaaauuccacacua

SEQ ID NO: 72531 - RNA, 19 nt, Homo sapiens
auagagggcuuaugauuca

SEQ ID NO: 72532 - RNA, 19 nt, Homo sapiens
ugaagugaacuaugaagua

SEQ ID NO: 72533 - RNA, 19 nt, Homo sapiens
ggaugaggcugacuuucug

SEQ ID NO: 72534 - RNA, 19 nt, Homo sapiens
gaucuggccucccucaagu

SEQ ID NO: 72535 - RNA, 19 nt, Homo sapiens
aagaggaaaucuccaaaug

SEQ ID NO: 72536 - RNA, 19 nt, Homo sapiens
gaauugaggucuuuuaagu

SEQ ID NO: 72537 - RNA, 19 nt, Homo sapiens
uaagcccacuguuaauauu

SEQ ID NO: 72538 - RNA, 19 nt, Homo sapiens
cagccuacuuucacacuaa

SEQ ID NO: 72539 - RNA, 19 nt, Homo sapiens
ggauggccacugugaauaa

SEQ ID NO: 72540 - RNA, 19 nt, Homo sapiens
cgaugguacuauuuagaua

SEQ ID NO: 72541 - RNA, 19 nt, Homo sapiens
gcaagaacccaucaaggau

SEQ ID NO: 72542 - RNA, 19 nt, Homo sapiens
ugucuucccuucugauuga

SEQ ID NO: 72543 - RNA, 19 nt, Homo sapiens
gcccaaacuucacagcauu

SEQ ID NO: 72544 - RNA, 19 nt, Homo sapiens
acaugaaccugcuggauau

SEQ ID NO: 72545 - RNA, 19 nt, Homo sapiens
gucaugcucuaucagauuu

SEQ ID NO: 72546 - RNA, 19 nt, Homo sapiens
ggaaagggaacuucagaca

SEQ ID NO: 72547 - RNA, 19 nt, Homo sapiens
ucacaccgcugcacucaag

SEQ ID NO: 72548 - RNA, 19 nt, Homo sapiens
aaacuugucuucccuucug

SEQ ID NO: 72549 - RNA, 19 nt, Homo sapiens
guauaccuguugagacuga

SEQ ID NO: 72550 - RNA, 19 nt, Homo sapiens
uaacauggacugcuucauc

SEQ ID NO: 72551 - RNA, 19 nt, Homo sapiens
ucauagagauggagaagag

SEQ ID NO: 72552 - RNA, 19 nt, Homo sapiens
ugaagauaaucaacgacua

SEQ ID NO: 72553 - RNA, 19 nt, Homo sapiens
acaagagccugcugaagau

SEQ ID NO: 72554 - RNA, 19 nt, Homo sapiens
aaugcaaacuggaugauga

SEQ ID NO: 72555 - RNA, 19 nt, Homo sapiens
ucuaucagauuucagaaga

SEQ ID NO: 72556 - RNA, 19 nt, Homo sapiens
gaaaguagccacguauggu

SEQ ID NO: 72557 - RNA, 19 nt, Homo sapiens
acuauaagcccacuguuaa

SEQ ID NO: 72558 - RNA, 19 nt, Homo sapiens
gcuuaaggcuuugggaaug

SEQ ID NO: 72559 - RNA, 19 nt, Homo sapiens
ccaaagugcugggauuaca

SEQ ID NO: 72560 - RNA, 19 nt, Homo sapiens
gcgaugauauucucaccau

SEQ ID NO: 72561 - RNA, 19 nt, Homo sapiens
uggauuugcugauuaccua

SEQ ID NO: 72562 - RNA, 19 nt, Homo sapiens
uauaagcccacuguuaaua

SEQ ID NO: 72563 - RNA, 19 nt, Homo sapiens
aagauggacuucagcagaa

SEQ ID NO: 72564 - RNA, 19 nt, Homo sapiens
ggagugcaguggcgugauc

SEQ ID NO: 72565 - RNA, 19 nt, Homo sapiens
gauuuaucaucaccucaaa

SEQ ID NO: 72566 - RNA, 19 nt, Homo sapiens
gaauggaacacacuuggau

SEQ ID NO: 72567 - RNA, 19 nt, Homo sapiens
gggagaaagugcccaaacu

SEQ ID NO: 72568 - RNA, 19 nt, Homo sapiens
aaucaacgacuaugaagaa

SEQ ID NO: 72569 - RNA, 19 nt, Homo sapiens
gugagcagaucagaauuga

SEQ ID NO: 72570 - RNA, 19 nt, Homo sapiens
gagacaagggcaucaucua

SEQ ID NO: 72571 - RNA, 19 nt, Homo sapiens
gcaagaggaaaucuccaaa

SEQ ID NO: 72572 - RNA, 19 nt, Homo sapiens
ccaggcagggcucaaauuu

SEQ ID NO: 72573 - RNA, 19 nt, Homo sapiens
uuucaucucugcuuggauu

SEQ ID NO: 72574 - RNA, 19 nt, Homo sapiens
gggcuuaugauucagauug

SEQ ID NO: 72575 - RNA, 19 nt, Homo sapiens
gaucaucaacaaucacaau

SEQ ID NO: 72576 - RNA, 19 nt, Homo sapiens
gaaaguuggacauccugaa

SEQ ID NO: 72577 - RNA, 19 nt, Homo sapiens
uaagggucaugcucuauca

SEQ ID NO: 72578 - RNA, 19 nt, Homo sapiens
gacuucagcagaaaucuuu

SEQ ID NO: 72579 - RNA, 19 nt, Homo sapiens
gacaagggcaucaucuaug

SEQ ID NO: 72580 - RNA, 19 nt, Homo sapiens
gaaaaucuaccaacucaug

SEQ ID NO: 72581 - RNA, 19 nt, Homo sapiens
gcuuuaugccuucuuauug

SEQ ID NO: 72582 - RNA, 19 nt, Homo sapiens
agaacaggauagugaauca

SEQ ID NO: 72583 - RNA, 19 nt, Homo sapiens
aacaagagccugcugaaga

SEQ ID NO: 72584 - RNA, 19 nt, Homo sapiens
cagaagaagugagcagauc

SEQ ID NO: 72585 - RNA, 19 nt, Homo sapiens
ggucaugcucuaucagauu

SEQ ID NO: 72586 - RNA, 19 nt, Homo sapiens
uuaccuaccuaaacacuag

SEQ ID NO: 72587 - RNA, 19 nt, Homo sapiens
cugauuaccuaccuaaaca

SEQ ID NO: 72588 - RNA, 19 nt, Homo sapiens
gaagcaagaacccaucaag

SEQ ID NO: 72589 - RNA, 19 nt, Homo sapiens
caucucugcuuggauuauu

SEQ ID NO: 72590 - RNA, 19 nt, Homo sapiens
caaaauccagcuaugaaua

SEQ ID NO: 72591 - RNA, 19 nt, Homo sapiens
uagcugguggcaauaaaua

SEQ ID NO: 72592 - RNA, 19 nt, Homo sapiens
acaagggcaucaucuaugg

SEQ ID NO: 72593 - RNA, 19 nt, Homo sapiens
aggcagggcucaaauuucu

SEQ ID NO: 72594 - RNA, 19 nt, Homo sapiens
ggacaaaguuuaccaaaug

SEQ ID NO: 72595 - RNA, 19 nt, Homo sapiens
caacaaggaugacaagaaa

SEQ ID NO: 72596 - RNA, 19 nt, Homo sapiens
gaagugaacuaugaaguaa

SEQ ID NO: 72597 - RNA, 19 nt, Homo sapiens
gagcaacccuauuuagaaa

SEQ ID NO: 72598 - RNA, 19 nt, Homo sapiens
gaauauagagggcuuauga

SEQ ID NO: 72599 - RNA, 19 nt, Homo sapiens
gagcuaaaguuaaauagga

SEQ ID NO: 72600 - RNA, 19 nt, Homo sapiens
ugacugaagugaacuauga

SEQ ID NO: 72601 - RNA, 19 nt, Homo sapiens
caauaacacugucuccuuu

SEQ ID NO: 72602 - RNA, 19 nt, Homo sapiens
caacgacuaugaagaauuc

SEQ ID NO: 72603 - RNA, 19 nt, Homo sapiens
gaucagaauugaggucuuu

SEQ ID NO: 72604 - RNA, 19 nt, Homo sapiens
caccacaccuggcuaauuu

SEQ ID NO: 72605 - RNA, 19 nt, Homo sapiens
gaagugagcagaucagaau

SEQ ID NO: 72606 - RNA, 19 nt, Homo sapiens
gaggaaaucuccaaaugca

SEQ ID NO: 72607 - RNA, 19 nt, Homo sapiens
caagagaacaggauaguga

SEQ ID NO: 72608 - RNA, 19 nt, Homo sapiens
ggaaaucuccaaaugcaaa

SEQ ID NO: 72609 - RNA, 19 nt, Homo sapiens
caaacuggaugaugacaug

SEQ ID NO: 72610 - RNA, 19 nt, Homo sapiens
ggagcaacccuauuuagaa

SEQ ID NO: 72611 - RNA, 19 nt, Homo sapiens
uaaauaagcucuccccaaa

SEQ ID NO: 72612 - RNA, 19 nt, Homo sapiens
gacaugaaccugcuggaua

SEQ ID NO: 72613 - RNA, 19 nt, Homo sapiens
agacuggauuugcugauua

SEQ ID NO: 72614 - RNA, 19 nt, Homo sapiens
gagccagggugguuauuga

SEQ ID NO: 72615 - RNA, 19 nt, Homo sapiens
gacaaaguuuaccaaauga

SEQ ID NO: 72616 - RNA, 19 nt, Homo sapiens
gaagauaaucaacgacuau

SEQ ID NO: 72617 - RNA, 19 nt, Homo sapiens
gaaaggguggagcggauua

SEQ ID NO: 72618 - RNA, 19 nt, Homo sapiens
gcaacaaggaugacaagaa

SEQ ID NO: 72619 - RNA, 19 nt, Homo sapiens
cagcagaaaucuuuaugau

SEQ ID NO: 72620 - RNA, 19 nt, Homo sapiens
gaaaggaggagauggaaag

SEQ ID NO: 72621 - RNA, 19 nt, Homo sapiens
gauaaucaacgacuaugaa

SEQ ID NO: 72622 - RNA, 19 nt, Homo sapiens
gcauuugcauuugcucuuu

SEQ ID NO: 72623 - RNA, 19 nt, Homo sapiens
uaugguggcucaugucuau

SEQ ID NO: 72624 - RNA, 19 nt, Homo sapiens
cagaggagcaacccuauuu

SEQ ID NO: 72625 - RNA, 19 nt, Homo sapiens
gaagaauucagcaaagaga

SEQ ID NO: 72626 - RNA, 19 nt, Homo sapiens
aaagcuaaauuccacacua

SEQ ID NO: 72627 - RNA, 19 nt, Homo sapiens
auagagggcuuaugauuca

SEQ ID NO: 72628 - RNA, 19 nt, Homo sapiens
ugaagugaacuaugaagua

SEQ ID NO: 72629 - RNA, 19 nt, Homo sapiens
ggaugaggcugacuuucug

SEQ ID NO: 72630 - RNA, 19 nt, Homo sapiens
gaucuggccucccucaagu

SEQ ID NO: 72631 - RNA, 19 nt, Homo sapiens
aagaggaaaucuccaaaug

SEQ ID NO: 72632 - RNA, 19 nt, Homo sapiens
gaauugaggucuuuuaagu

SEQ ID NO: 72633 - RNA, 19 nt, Homo sapiens
uaagcccacuguuaauauu

SEQ ID NO: 72634 - RNA, 19 nt, Homo sapiens
cagccuacuuucacacuaa

SEQ ID NO: 72635 - RNA, 19 nt, Homo sapiens
ggauggccacugugaauaa

SEQ ID NO: 72636 - RNA, 19 nt, Homo sapiens
cgaugguacuauuuagaua

SEQ ID NO: 72637 - RNA, 19 nt, Homo sapiens
gcaagaacccaucaaggau

SEQ ID NO: 72638 - RNA, 19 nt, Homo sapiens
ugucuucccuucugauuga

SEQ ID NO: 72639 - RNA, 19 nt, Homo sapiens
gcccaaacuucacagcauu

SEQ ID NO: 72640 - RNA, 19 nt, Homo sapiens
acaugaaccugcuggauau

SEQ ID NO: 72641 - RNA, 19 nt, Homo sapiens
gucaugcucuaucagauuu

SEQ ID NO: 72642 - RNA, 19 nt, Homo sapiens
ggaaagggaacuucagaca

SEQ ID NO: 72643 - RNA, 19 nt, Homo sapiens
cuagucaacucaacaggaa

SEQ ID NO: 72644 - RNA, 19 nt, Homo sapiens
ucacaccgcugcacucaag

SEQ ID NO: 72645 - RNA, 19 nt, Homo sapiens
aaacuugucuucccuucug

SEQ ID NO: 72646 - RNA, 19 nt, Homo sapiens
guauaccuguugagacuga

SEQ ID NO: 72647 - RNA, 19 nt, Homo sapiens
uaacauggacugcuucauc

SEQ ID NO: 72648 - RNA, 19 nt, Homo sapiens
ucauagagauggagaagag

SEQ ID NO: 72649 - RNA, 19 nt, Homo sapiens
ugaagauaaucaacgacua

SEQ ID NO: 72650 - RNA, 19 nt, Homo sapiens
acaagagccugcugaagau

SEQ ID NO: 72651 - RNA, 19 nt, Homo sapiens
aaugcaaacuggaugauga

SEQ ID NO: 72652 - RNA, 19 nt, Homo sapiens
ucuaucagauuucagaaga

SEQ ID NO: 72653 - RNA, 19 nt, Homo sapiens
gaaaguagccacguauggu

SEQ ID NO: 72654 - RNA, 19 nt, Homo sapiens
acuauaagcccacuguuaa

SEQ ID NO: 72655 - RNA, 19 nt, Homo sapiens
gcuuaaggcuuugggaaug

SEQ ID NO: 72656 - RNA, 19 nt, Homo sapiens
ccaaagugcugggauuaca

SEQ ID NO: 72657 - RNA, 19 nt, Homo sapiens
gcgaugauauucucaccau

SEQ ID NO: 72658 - RNA, 19 nt, Homo sapiens
uggauuugcugauuaccua

SEQ ID NO: 72659 - RNA, 19 nt, Homo sapiens
uauaagcccacuguuaaua

SEQ ID NO: 72660 - RNA, 19 nt, Homo sapiens
aagauggacuucagcagaa

SEQ ID NO: 72661 - RNA, 19 nt, Homo sapiens
ggagugcaguggcgugauc

SEQ ID NO: 72662 - RNA, 19 nt, Homo sapiens
gauuuaucaucaccucaaa

SEQ ID NO: 72663 - RNA, 19 nt, Homo sapiens
gaauggaacacacuuggau

SEQ ID NO: 72664 - RNA, 19 nt, Homo sapiens
gggagaaagugcccaaacu

SEQ ID NO: 72665 - RNA, 19 nt, Homo sapiens
aaucaacgacuaugaagaa

SEQ ID NO: 72666 - RNA, 19 nt, Homo sapiens
gugagcagaucagaauuga

SEQ ID NO: 72667 - RNA, 19 nt, Homo sapiens
gagacaagggcaucaucua

SEQ ID NO: 72668 - RNA, 19 nt, Homo sapiens
gcaagaggaaaucuccaaa

SEQ ID NO: 72669 - RNA, 19 nt, Homo sapiens
ccaggcagggcucaaauuu

SEQ ID NO: 72670 - RNA, 19 nt, Homo sapiens
uuucaucucugcuuggauu

SEQ ID NO: 72671 - RNA, 19 nt, Homo sapiens
gggcuuaugauucagauug

SEQ ID NO: 72672 - RNA, 19 nt, Homo sapiens
gaucaucaacaaucacaau

SEQ ID NO: 72673 - RNA, 19 nt, Homo sapiens
gaaaguuggacauccugaa

SEQ ID NO: 72674 - RNA, 19 nt, Homo sapiens
gaagagccagggugguuau

SEQ ID NO: 72675 - RNA, 19 nt, Homo sapiens
gacaagggcaucaucuaug

SEQ ID NO: 72676 - RNA, 19 nt, Homo sapiens
gaaaaucuaccaacucaug

SEQ ID NO: 72677 - RNA, 19 nt, Homo sapiens
gacuucagcagaaaucuuu

SEQ ID NO: 72678 - RNA, 19 nt, Homo sapiens
gcuuuaugccuucuuauug

SEQ ID NO: 72679 - RNA, 19 nt, Homo sapiens
agaacaggauagugaauca

SEQ ID NO: 72680 - RNA, 19 nt, Homo sapiens
aacaagagccugcugaaga

SEQ ID NO: 72681 - RNA, 19 nt, Homo sapiens
cagaagaagugagcagauc

SEQ ID NO: 72682 - RNA, 19 nt, Homo sapiens
ggguggagcggauuauauu

SEQ ID NO: 72683 - RNA, 19 nt, Homo sapiens
ggucaugcucuaucagauu

SEQ ID NO: 72684 - RNA, 19 nt, Homo sapiens
uuaccuaccuaaacacuag

SEQ ID NO: 72685 - RNA, 19 nt, Homo sapiens
cugauuaccuaccuaaaca

SEQ ID NO: 72686 - RNA, 19 nt, Homo sapiens
gaagcaagaacccaucaag

SEQ ID NO: 72687 - RNA, 19 nt, Homo sapiens
caucucugcuuggauuauu

SEQ ID NO: 72688 - RNA, 19 nt, Homo sapiens
caaaauccagcuaugaaua

SEQ ID NO: 72689 - RNA, 19 nt, Homo sapiens
uagcugguggcaauaaaua

SEQ ID NO: 72690 - RNA, 19 nt, Homo sapiens
acaagggcaucaucuaugg

SEQ ID NO: 72691 - RNA, 19 nt, Homo sapiens
aggcagggcucaaauuucu

SEQ ID NO: 72692 - RNA, 19 nt, Homo sapiens
ggcuaacuauauuugcuuu

SEQ ID NO: 72693 - RNA, 19 nt, Homo sapiens
ggauuuaucaucaccucaa

SEQ ID NO: 72694 - RNA, 19 nt, Homo sapiens
ggacaaaguuuaccaaaug

SEQ ID NO: 72695 - RNA, 19 nt, Homo sapiens
caacaaggaugacaagaaa

SEQ ID NO: 72696 - RNA, 19 nt, Homo sapiens
gaagugaacuaugaaguaa

SEQ ID NO: 72697 - RNA, 19 nt, Homo sapiens
gagcaacccuauuuagaaa

SEQ ID NO: 72698 - RNA, 19 nt, Homo sapiens
gaauauagagggcuuauga

SEQ ID NO: 72699 - RNA, 19 nt, Homo sapiens
gagcuaaaguuaaauagga

SEQ ID NO: 72700 - RNA, 19 nt, Homo sapiens
ugacugaagugaacuauga

SEQ ID NO: 72701 - RNA, 19 nt, Homo sapiens
caauaacacugucuccuuu

SEQ ID NO: 72702 - RNA, 19 nt, Homo sapiens
gacguuugcucuugucuua

SEQ ID NO: 72703 - RNA, 19 nt, Homo sapiens
caacgacuaugaagaauuc

SEQ ID NO: 72704 - RNA, 19 nt, Homo sapiens
gaucagaauugaggucuuu

SEQ ID NO: 72705 - RNA, 19 nt, Homo sapiens
caccacaccuggcuaauuu

SEQ ID NO: 72706 - RNA, 19 nt, Homo sapiens
gaagugagcagaucagaau

SEQ ID NO: 72707 - RNA, 19 nt, Homo sapiens
gaggaaaucuccaaaugca

SEQ ID NO: 72708 - RNA, 19 nt, Homo sapiens
caagagaacaggauaguga

SEQ ID NO: 72709 - RNA, 19 nt, Homo sapiens
ggaaaucuccaaaugcaaa

SEQ ID NO: 72710 - RNA, 19 nt, Homo sapiens
caaacuggaugaugacaug

SEQ ID NO: 72711 - RNA, 19 nt, Homo sapiens
ggagcaacccuauuuagaa

SEQ ID NO: 72712 - RNA, 19 nt, Homo sapiens
uaaauaagcucuccccaaa

SEQ ID NO: 72713 - RNA, 19 nt, Homo sapiens
gacaugaaccugcuggaua

SEQ ID NO: 72714 - RNA, 19 nt, Homo sapiens
agacuggauuugcugauua

SEQ ID NO: 72715 - RNA, 19 nt, Homo sapiens
gacaaaguuuaccaaauga

SEQ ID NO: 72716 - RNA, 19 nt, Homo sapiens
gaagauaaucaacgacuau

SEQ ID NO: 72717 - RNA, 19 nt, Homo sapiens
gcaacaaggaugacaagaa

SEQ ID NO: 72718 - RNA, 19 nt, Homo sapiens
cagcagaaaucuuuaugau

SEQ ID NO: 72719 - RNA, 19 nt, Homo sapiens
gaaaggaggagauggaaag

SEQ ID NO: 72720 - RNA, 19 nt, Homo sapiens
gauaaucaacgacuaugaa

SEQ ID NO: 72721 - RNA, 19 nt, Homo sapiens
gcauuugcauuugcucuuu

SEQ ID NO: 72722 - RNA, 19 nt, Homo sapiens
uaugguggcucaugucuau

SEQ ID NO: 72723 - RNA, 19 nt, Homo sapiens
cagaggagcaacccuauuu

SEQ ID NO: 72724 - RNA, 19 nt, Homo sapiens
aaagcuaaauuccacacua

SEQ ID NO: 72725 - RNA, 19 nt, Homo sapiens
auagagggcuuaugauuca

SEQ ID NO: 72726 - RNA, 19 nt, Homo sapiens
ugaagugaacuaugaagua

SEQ ID NO: 72727 - RNA, 19 nt, Homo sapiens
ggaugaggcugacuuucug

SEQ ID NO: 72728 - RNA, 19 nt, Homo sapiens
gaucuggccucccucaagu

SEQ ID NO: 72729 - RNA, 19 nt, Homo sapiens
aagaggaaaucuccaaaug

SEQ ID NO: 72730 - RNA, 19 nt, Homo sapiens
gaauugaggucuuuuaagu

SEQ ID NO: 72731 - RNA, 19 nt, Homo sapiens
uaagcccacuguuaauauu

SEQ ID NO: 72732 - RNA, 19 nt, Homo sapiens
cagccuacuuucacacuaa

SEQ ID NO: 72733 - RNA, 19 nt, Homo sapiens
ggauggccacugugaauaa

SEQ ID NO: 72734 - RNA, 19 nt, Homo sapiens
cgaugguacuauuuagaua

SEQ ID NO: 72735 - RNA, 19 nt, Homo sapiens
ugucuuagaugcucagaug

SEQ ID NO: 72736 - RNA, 19 nt, Homo sapiens
gcaagaacccaucaaggau

SEQ ID NO: 72737 - RNA, 19 nt, Homo sapiens
ugucuucccuucugauuga

SEQ ID NO: 72738 - RNA, 19 nt, Homo sapiens
gcccaaacuucacagcauu

SEQ ID NO: 72739 - RNA, 19 nt, Homo sapiens
acaugaaccugcuggauau

SEQ ID NO: 72740 - RNA, 19 nt, Homo sapiens
gucaugcucuaucagauuu

SEQ ID NO: 72741 - RNA, 19 nt, Homo sapiens
ggaaagggaacuucagaca

SEQ ID NO: 72742 - RNA, 19 nt, Homo sapiens
ucacaccgcugcacucaag

SEQ ID NO: 72743 - RNA, 19 nt, Homo sapiens
aaacuugucuucccuucug

SEQ ID NO: 72744 - RNA, 19 nt, Homo sapiens
guauaccuguugagacuga

SEQ ID NO: 72745 - RNA, 19 nt, Homo sapiens
uaacauggacugcuucauc

SEQ ID NO: 72746 - RNA, 19 nt, Homo sapiens
ucauagagauggagaagag

SEQ ID NO: 72747 - RNA, 19 nt, Homo sapiens
ugaagauaaucaacgacua

SEQ ID NO: 72748 - RNA, 19 nt, Homo sapiens
acaagagccugcugaagau

SEQ ID NO: 72749 - RNA, 19 nt, Homo sapiens
aaugcaaacuggaugauga

SEQ ID NO: 72750 - RNA, 19 nt, Homo sapiens
ucuaucagauuucagaaga

SEQ ID NO: 72751 - RNA, 19 nt, Homo sapiens
gaaaguagccacguauggu

SEQ ID NO: 72752 - RNA, 19 nt, Homo sapiens
acuauaagcccacuguuaa

SEQ ID NO: 72753 - RNA, 19 nt, Homo sapiens
gcuuaaggcuuugggaaug

SEQ ID NO: 72754 - RNA, 19 nt, Homo sapiens
ccaaagugcugggauuaca

SEQ ID NO: 72755 - RNA, 19 nt, Homo sapiens
gcgaugauauucucaccau

SEQ ID NO: 72756 - RNA, 19 nt, Homo sapiens
uggauuugcugauuaccua

SEQ ID NO: 72757 - RNA, 19 nt, Homo sapiens
uauaagcccacuguuaaua

SEQ ID NO: 72758 - RNA, 19 nt, Homo sapiens
aagauggacuucagcagaa

SEQ ID NO: 72759 - RNA, 19 nt, Homo sapiens
caucgugagaguaagauua

SEQ ID NO: 72760 - RNA, 19 nt, Homo sapiens
ggagugcaguggcgugauc

SEQ ID NO: 72761 - RNA, 19 nt, Homo sapiens
gauuuaucaucaccucaaa

SEQ ID NO: 72762 - RNA, 19 nt, Homo sapiens
gaauggaacacacuuggau

SEQ ID NO: 72763 - RNA, 19 nt, Homo sapiens
gggagaaagugcccaaacu

SEQ ID NO: 72764 - RNA, 19 nt, Homo sapiens
aaucaacgacuaugaagaa

SEQ ID NO: 72765 - RNA, 19 nt, Homo sapiens
gugagcagaucagaauuga

SEQ ID NO: 72766 - RNA, 19 nt, Homo sapiens
gagacaagggcaucaucua

SEQ ID NO: 72767 - RNA, 19 nt, Homo sapiens
gcaagaggaaaucuccaaa

SEQ ID NO: 72768 - RNA, 19 nt, Homo sapiens
ccaggcagggcucaaauuu

SEQ ID NO: 72769 - RNA, 19 nt, Homo sapiens
uuucaucucugcuuggauu

SEQ ID NO: 72770 - RNA, 19 nt, Homo sapiens
gggcuuaugauucagauug

SEQ ID NO: 72771 - RNA, 19 nt, Homo sapiens
gaucaucaacaaucacaau

SEQ ID NO: 72772 - RNA, 19 nt, Homo sapiens
gaaaguuggacauccugaa

SEQ ID NO: 72773 - RNA, 19 nt, Homo sapiens
gacaagggcaucaucuaug

SEQ ID NO: 72774 - RNA, 19 nt, Homo sapiens
gaaaaucuaccaacucaug

SEQ ID NO: 72775 - RNA, 19 nt, Homo sapiens
gacuucagcagaaaucuuu

SEQ ID NO: 72776 - RNA, 19 nt, Homo sapiens
gcuuuaugccuucuuauug

SEQ ID NO: 72777 - RNA, 19 nt, Homo sapiens
agaacaggauagugaauca

SEQ ID NO: 72778 - RNA, 19 nt, Homo sapiens
aacaagagccugcugaaga

SEQ ID NO: 72779 - RNA, 19 nt, Homo sapiens
cagaagaagugagcagauc

SEQ ID NO: 72780 - RNA, 19 nt, Homo sapiens
cauuagacguuugcucuug

SEQ ID NO: 72781 - RNA, 19 nt, Homo sapiens
ggucaugcucuaucagauu

SEQ ID NO: 72782 - RNA, 19 nt, Homo sapiens
gaagcaagaacccaucaag

SEQ ID NO: 72783 - RNA, 19 nt, Homo sapiens
uuaccuaccuaaacacuag

SEQ ID NO: 72784 - RNA, 19 nt, Homo sapiens
cugauuaccuaccuaaaca

SEQ ID NO: 72785 - RNA, 19 nt, Homo sapiens
caucucugcuuggauuauu

SEQ ID NO: 72786 - RNA, 19 nt, Homo sapiens
caaaauccagcuaugaaua

SEQ ID NO: 72787 - RNA, 19 nt, Homo sapiens
uagcugguggcaauaaaua

SEQ ID NO: 72788 - RNA, 19 nt, Homo sapiens
gcuaccaucgugagaguaa

SEQ ID NO: 72789 - RNA, 19 nt, Homo sapiens
gcucagaugguaguggaua

SEQ ID NO: 72790 - RNA, 19 nt, Homo sapiens
acaagggcaucaucuaugg

SEQ ID NO: 72791 - RNA, 19 nt, Homo sapiens
aggcagggcucaaauuucu

SEQ ID NO: 72792 - RNA, 19 nt, Homo sapiens
ggcuaacuauauuugcuuu

SEQ ID NO: 72793 - RNA, 19 nt, Homo sapiens
ggauuuaucaucaccucaa

SEQ ID NO: 72794 - RNA, 19 nt, Homo sapiens
ggacaaaguuuaccaaaug

SEQ ID NO: 72795 - RNA, 19 nt, Homo sapiens
caacaaggaugacaagaaa

SEQ ID NO: 72796 - RNA, 19 nt, Homo sapiens
gaagugaacuaugaaguaa

SEQ ID NO: 72797 - RNA, 19 nt, Homo sapiens
gagcaacccuauuuagaaa

SEQ ID NO: 72798 - RNA, 19 nt, Homo sapiens
gaauauagagggcuuauga

SEQ ID NO: 72799 - RNA, 19 nt, Homo sapiens
gagcuaaaguuaaauagga

SEQ ID NO: 72800 - RNA, 19 nt, Homo sapiens
ugacugaagugaacuauga

SEQ ID NO: 72801 - RNA, 19 nt, Homo sapiens
caauaacacugucuccuuu

SEQ ID NO: 72802 - RNA, 19 nt, Homo sapiens
caacgacuaugaagaauuc

SEQ ID NO: 72803 - RNA, 19 nt, Homo sapiens
gaucagaauugaggucuuu

SEQ ID NO: 72804 - RNA, 19 nt, Homo sapiens
caccacaccuggcuaauuu

SEQ ID NO: 72805 - RNA, 19 nt, Homo sapiens
gaagugagcagaucagaau

SEQ ID NO: 72806 - RNA, 19 nt, Homo sapiens
gaggaaaucuccaaaugca

SEQ ID NO: 72807 - RNA, 19 nt, Homo sapiens
caagagaacaggauaguga

SEQ ID NO: 72808 - RNA, 19 nt, Homo sapiens
ggaaaucuccaaaugcaaa

SEQ ID NO: 72809 - RNA, 19 nt, Homo sapiens
caaacuggaugaugacaug

SEQ ID NO: 72810 - RNA, 19 nt, Homo sapiens
ggagcaacccuauuuagaa

SEQ ID NO: 72811 - RNA, 19 nt, Homo sapiens
uaaauaagcucuccccaaa

SEQ ID NO: 72812 - RNA, 19 nt, Homo sapiens
gacaugaaccugcuggaua

SEQ ID NO: 72813 - RNA, 19 nt, Homo sapiens
agacuggauuugcugauua

SEQ ID NO: 72814 - RNA, 19 nt, Homo sapiens
gagccagggugguuauuga

SEQ ID NO: 72815 - RNA, 19 nt, Homo sapiens
gacaaaguuuaccaaauga

SEQ ID NO: 72816 - RNA, 19 nt, Homo sapiens
gaagauaaucaacgacuau

SEQ ID NO: 72817 - RNA, 19 nt, Homo sapiens
gaaaggguggagcggauua

SEQ ID NO: 72818 - RNA, 19 nt, Homo sapiens
gcaacaaggaugacaagaa

SEQ ID NO: 72819 - RNA, 19 nt, Homo sapiens
cagcagaaaucuuuaugau

SEQ ID NO: 72820 - RNA, 19 nt, Homo sapiens
gaaaggaggagauggaaag

SEQ ID NO: 72821 - RNA, 19 nt, Homo sapiens
ggaugcagguacaguagaa

SEQ ID NO: 72822 - RNA, 19 nt, Homo sapiens
gauaaucaacgacuaugaa

SEQ ID NO: 72823 - RNA, 19 nt, Homo sapiens
gcauuugcauuugcucuuu

SEQ ID NO: 72824 - RNA, 19 nt, Homo sapiens
gaacaaaagcuauaccaaa

SEQ ID NO: 72825 - RNA, 19 nt, Homo sapiens
uaugguggcucaugucuau

SEQ ID NO: 72826 - RNA, 19 nt, Homo sapiens
cagaggagcaacccuauuu

SEQ ID NO: 72827 - RNA, 19 nt, Homo sapiens
gaagaauucagcaaagaga

SEQ ID NO: 72828 - RNA, 19 nt, Homo sapiens
aaagcuaaauuccacacua

SEQ ID NO: 72829 - RNA, 19 nt, Homo sapiens
auagagggcuuaugauuca

SEQ ID NO: 72830 - RNA, 19 nt, Homo sapiens
ugaagugaacuaugaagua

SEQ ID NO: 72831 - RNA, 19 nt, Homo sapiens
ggaugaggcugacuuucug

SEQ ID NO: 72832 - RNA, 19 nt, Homo sapiens
gaucuggccucccucaagu

SEQ ID NO: 72833 - RNA, 19 nt, Homo sapiens
aagaggaaaucuccaaaug

SEQ ID NO: 72834 - RNA, 19 nt, Homo sapiens
gaauugaggucuuuuaagu

SEQ ID NO: 72835 - RNA, 19 nt, Homo sapiens
uaagcccacuguuaauauu

SEQ ID NO: 72836 - RNA, 19 nt, Homo sapiens
cagccuacuuucacacuaa

SEQ ID NO: 72837 - RNA, 19 nt, Homo sapiens
ggauggccacugugaauaa

SEQ ID NO: 72838 - RNA, 19 nt, Homo sapiens
cgaugguacuauuuagaua

SEQ ID NO: 72839 - RNA, 19 nt, Homo sapiens
gcaagaacccaucaaggau

SEQ ID NO: 72840 - RNA, 19 nt, Homo sapiens
ugucuucccuucugauuga

SEQ ID NO: 72841 - RNA, 19 nt, Homo sapiens
cuagucaacucaacaggaa

SEQ ID NO: 72842 - RNA, 19 nt, Homo sapiens
gcccaaacuucacagcauu

SEQ ID NO: 72843 - RNA, 19 nt, Homo sapiens
acaugaaccugcuggauau

SEQ ID NO: 72844 - RNA, 19 nt, Homo sapiens
gucaugcucuaucagauuu

SEQ ID NO: 72845 - RNA, 19 nt, Homo sapiens
ggaaagggaacuucagaca

SEQ ID NO: 72846 - RNA, 19 nt, Homo sapiens
ucacaccgcugcacucaag

SEQ ID NO: 72847 - RNA, 19 nt, Homo sapiens
aaacuugucuucccuucug

SEQ ID NO: 72848 - RNA, 19 nt, Homo sapiens
guauaccuguugagacuga

SEQ ID NO: 72849 - RNA, 19 nt, Homo sapiens
acaaaggcaucaucuaugg

SEQ ID NO: 72850 - RNA, 19 nt, Homo sapiens
uaacauggacugcuucauc

SEQ ID NO: 72851 - RNA, 19 nt, Homo sapiens
ucauagagauggagaagag

SEQ ID NO: 72852 - RNA, 19 nt, Homo sapiens
agacaaaggcaucaucuau

SEQ ID NO: 72853 - RNA, 19 nt, Homo sapiens
ugaagauaaucaacgacua

SEQ ID NO: 72854 - RNA, 19 nt, Homo sapiens
acaagagccugcugaagau

SEQ ID NO: 72855 - RNA, 19 nt, Homo sapiens
aaugcaaacuggaugauga

SEQ ID NO: 72856 - RNA, 19 nt, Homo sapiens
ucuaucagauuucagaaga

SEQ ID NO: 72857 - RNA, 19 nt, Homo sapiens
gaaaguagccacguauggu

SEQ ID NO: 72858 - RNA, 19 nt, Homo sapiens
acuauaagcccacuguuaa

SEQ ID NO: 72859 - RNA, 19 nt, Homo sapiens
gcuuaaggcuuugggaaug

SEQ ID NO: 72860 - RNA, 19 nt, Homo sapiens
ccaaagugcugggauuaca

SEQ ID NO: 72861 - RNA, 19 nt, Homo sapiens
gcgaugauauucucaccau

SEQ ID NO: 72862 - RNA, 19 nt, Homo sapiens
uggauuugcugauuaccua

SEQ ID NO: 72863 - RNA, 19 nt, Homo sapiens
uauaagcccacuguuaaua

SEQ ID NO: 72864 - RNA, 19 nt, Homo sapiens
aagauggacuucagcagaa

SEQ ID NO: 72865 - RNA, 19 nt, Homo sapiens
ggagugcaguggcgugauc

SEQ ID NO: 72866 - RNA, 19 nt, Homo sapiens
gauuuaucaucaccucaaa

SEQ ID NO: 72867 - RNA, 19 nt, Homo sapiens
gacaaaggcaucaucuaug

SEQ ID NO: 72868 - RNA, 19 nt, Homo sapiens
aaagggccauguuucaaga

SEQ ID NO: 72869 - RNA, 19 nt, Homo sapiens
gaauggaacacacuuggau

SEQ ID NO: 72870 - RNA, 19 nt, Homo sapiens
gggagaaagugcccaaacu

SEQ ID NO: 72871 - RNA, 19 nt, Homo sapiens
aaucaacgacuaugaagaa

SEQ ID NO: 72872 - RNA, 19 nt, Homo sapiens
gugagcagaucagaauuga

SEQ ID NO: 72873 - RNA, 19 nt, Homo sapiens
gcaagaggaaaucuccaaa

SEQ ID NO: 72874 - RNA, 19 nt, Homo sapiens
ccaggcagggcucaaauuu

SEQ ID NO: 72875 - RNA, 19 nt, Homo sapiens
uuucaucucugcuuggauu

SEQ ID NO: 72876 - RNA, 19 nt, Homo sapiens
gggcuuaugauucagauug

SEQ ID NO: 72877 - RNA, 19 nt, Homo sapiens
gaagagccagggugguuau

SEQ ID NO: 72878 - RNA, 19 nt, Homo sapiens
gaucaucaacaaucacaau

SEQ ID NO: 72879 - RNA, 19 nt, Homo sapiens
gaaaguuggacauccugaa

SEQ ID NO: 72880 - RNA, 19 nt, Homo sapiens
gaaaaucuaccaacucaug

SEQ ID NO: 72881 - RNA, 19 nt, Homo sapiens
gacuucagcagaaaucuuu

SEQ ID NO: 72882 - RNA, 19 nt, Homo sapiens
gcuuuaugccuucuuauug

SEQ ID NO: 72883 - RNA, 19 nt, Homo sapiens
ggguggagcggauuauauu

SEQ ID NO: 72884 - RNA, 19 nt, Homo sapiens
agaacaggauagugaauca

SEQ ID NO: 72885 - RNA, 19 nt, Homo sapiens
aacaagagccugcugaaga

SEQ ID NO: 72886 - RNA, 19 nt, Homo sapiens
cagaagaagugagcagauc

SEQ ID NO: 72887 - RNA, 19 nt, Homo sapiens
ggucaugcucuaucagauu

SEQ ID NO: 72888 - RNA, 19 nt, Homo sapiens
uuaccuaccuaaacacuag

SEQ ID NO: 72889 - RNA, 19 nt, Homo sapiens
cugauuaccuaccuaaaca

SEQ ID NO: 72890 - RNA, 19 nt, Homo sapiens
gaagcaagaacccaucaag

SEQ ID NO: 72891 - RNA, 19 nt, Homo sapiens
caucucugcuuggauuauu

SEQ ID NO: 72892 - RNA, 19 nt, Homo sapiens
caaaauccagcuaugaaua

SEQ ID NO: 72893 - RNA, 19 nt, Homo sapiens
uagcugguggcaauaaaua

SEQ ID NO: 72894 - RNA, 19 nt, Homo sapiens
ggacaaaguuuaccaaaug

SEQ ID NO: 72895 - RNA, 19 nt, Homo sapiens
caacgacuaugaagaauuc

SEQ ID NO: 72896 - RNA, 19 nt, Homo sapiens
gaucagaauugaggucuuu

SEQ ID NO: 72897 - RNA, 19 nt, Homo sapiens
gaagugagcagaucagaau

SEQ ID NO: 72898 - RNA, 19 nt, Homo sapiens
gaggaaaucuccaaaugca

SEQ ID NO: 72899 - RNA, 19 nt, Homo sapiens
gaauccagcuacgaauaua

SEQ ID NO: 72900 - RNA, 19 nt, Homo sapiens
ggaaaucuccaaaugcaaa

SEQ ID NO: 72901 - RNA, 19 nt, Homo sapiens
caaacuggaugaugacaug

SEQ ID NO: 72902 - RNA, 19 nt, Homo sapiens
gacaugaaccugcuggaua

SEQ ID NO: 72903 - RNA, 19 nt, Homo sapiens
agacuggauuugcugauua

SEQ ID NO: 72904 - RNA, 19 nt, Homo sapiens
gacaaaguuuaccaaauga

SEQ ID NO: 72905 - RNA, 19 nt, Homo sapiens
gaagauaaucaacgacuau

SEQ ID NO: 72906 - RNA, 19 nt, Homo sapiens
cagcagaaaucuuuaugau

SEQ ID NO: 72907 - RNA, 19 nt, Homo sapiens
gcaagagaauuagcauuuc

SEQ ID NO: 72908 - RNA, 19 nt, Homo sapiens
ggcaagagaauuagcauuu

SEQ ID NO: 72909 - RNA, 19 nt, Homo sapiens
gaaaggaggagauggaaag

SEQ ID NO: 72910 - RNA, 19 nt, Homo sapiens
ccagugggcaagagaauua

SEQ ID NO: 72911 - RNA, 19 nt, Homo sapiens
acacuuggaugcaggguuu

SEQ ID NO: 72912 - RNA, 19 nt, Homo sapiens
gauaaucaacgacuaugaa

SEQ ID NO: 72913 - RNA, 19 nt, Homo sapiens
cuacgaauauagaggguuu

SEQ ID NO: 72914 - RNA, 19 nt, Homo sapiens
gaagaauucagcaaagaga

SEQ ID NO: 72915 - RNA, 19 nt, Homo sapiens
gaucuggccucccucaagu

SEQ ID NO: 72916 - RNA, 19 nt, Homo sapiens
aagaggaaaucuccaaaug

SEQ ID NO: 72917 - RNA, 19 nt, Homo sapiens
gaauugaggucuuuuaagu

SEQ ID NO: 72918 - RNA, 19 nt, Homo sapiens
gcaagaacccaucaaggau

SEQ ID NO: 72919 - RNA, 19 nt, Homo sapiens
gcccaaacuucacagcauu

SEQ ID NO: 72920 - RNA, 19 nt, Homo sapiens
acaugaaccugcuggauau

SEQ ID NO: 72921 - RNA, 19 nt, Homo sapiens
gucaugcucuaucagauuu

SEQ ID NO: 72922 - RNA, 19 nt, Homo sapiens
ggaaagggaacuucagaca

SEQ ID NO: 72923 - RNA, 19 nt, Homo sapiens
ucauagagauggagaagag

SEQ ID NO: 72924 - RNA, 19 nt, Homo sapiens
ugaagauaaucaacgacua

SEQ ID NO: 72925 - RNA, 19 nt, Homo sapiens
acaagagccugcugaagau

SEQ ID NO: 72926 - RNA, 19 nt, Homo sapiens
aaugcaaacuggaugauga

SEQ ID NO: 72927 - RNA, 19 nt, Homo sapiens
ucuaucagauuucagaaga

SEQ ID NO: 72928 - RNA, 19 nt, Homo sapiens
uggauuugcugauuaccua

SEQ ID NO: 72929 - RNA, 19 nt, Homo sapiens
aagauggacuucagcagaa

SEQ ID NO: 72930 - RNA, 19 nt, Homo sapiens
cagaauccagcuacgaaua

SEQ ID NO: 72931 - RNA, 19 nt, Homo sapiens
gaauggaacacacuuggau

SEQ ID NO: 72932 - RNA, 19 nt, Homo sapiens
gggagaaagugcccaaacu

SEQ ID NO: 72933 - RNA, 19 nt, Homo sapiens
aaucaacgacuaugaagaa

SEQ ID NO: 72934 - RNA, 19 nt, Homo sapiens
gugagcagaucagaauuga

SEQ ID NO: 72935 - RNA, 19 nt, Homo sapiens
gcaagaggaaaucuccaaa

SEQ ID NO: 72936 - RNA, 19 nt, Homo sapiens
ccaggcagggcucaaauuu

SEQ ID NO: 72937 - RNA, 19 nt, Homo sapiens
gaucaucaacaaucacaau

SEQ ID NO: 72938 - RNA, 19 nt, Homo sapiens
gaaaguuggacauccugaa

SEQ ID NO: 72939 - RNA, 19 nt, Homo sapiens
gacuucagcagaaaucuuu

SEQ ID NO: 72940 - RNA, 19 nt, Homo sapiens
aacaagagccugcugaaga

SEQ ID NO: 72941 - RNA, 19 nt, Homo sapiens
cagaagaagugagcagauc

SEQ ID NO: 72942 - RNA, 19 nt, Homo sapiens
ggucaugcucuaucagauu

SEQ ID NO: 72943 - RNA, 19 nt, Homo sapiens
uuaccuaccuaaacacuag

SEQ ID NO: 72944 - RNA, 19 nt, Homo sapiens
cugauuaccuaccuaaaca

SEQ ID NO: 72945 - RNA, 19 nt, Homo sapiens
gaagcaagaacccaucaag

SEQ ID NO: 72946 - RNA, 19 nt, Homo sapiens
uagcugguggcaauaaaua

SEQ ID NO: 72947 - RNA, 19 nt, Homo sapiens
aggcagggcucaaauuucu

SEQ ID NO: 72948 - RNA, 19 nt, Homo sapiens
gaugcaggguuugagaaug

SEQ ID NO: 72949 - RNA, 19 nt, Homo sapiens
caagaggaaaucuccaaau

SEQ ID NO: 72950 - RNA, 19 nt, Homo sapiens
cgaauuaauagacuggauu

SEQ ID NO: 72951 - RNA, 19 nt, Homo sapiens
uagcauuucuggagcaucu

SEQ ID NO: 72952 - RNA, 19 nt, Homo sapiens
gagaagcagcagccuugaa

SEQ ID NO: 72953 - RNA, 19 nt, Homo sapiens
ccaaaugcaaacuggauga

SEQ ID NO: 72954 - RNA, 19 nt, Homo sapiens
cgccugagcccuugaguug

SEQ ID NO: 72955 - RNA, 19 nt, Homo sapiens
ggacuucagcagaaaucuu

SEQ ID NO: 72956 - RNA, 19 nt, Homo sapiens
ggaauggaacacacuugga

SEQ ID NO: 72957 - RNA, 19 nt, Homo sapiens
uggacaaaguuuaccaaau

SEQ ID NO: 72958 - RNA, 19 nt, Homo sapiens
gaauucagcaaagagagaa

SEQ ID NO: 72959 - RNA, 19 nt, Homo sapiens
aaaguuggacauccugaaa

SEQ ID NO: 72960 - RNA, 19 nt, Homo sapiens
gcucaaauuucugccuaca

SEQ ID NO: 72961 - RNA, 19 nt, Homo sapiens
uagacuggauuugcugauu

SEQ ID NO: 72962 - RNA, 19 nt, Homo sapiens
aagagaauguuggaggaaa

SEQ ID NO: 72963 - RNA, 19 nt, Homo sapiens
gguggcugccugaggaaua

SEQ ID NO: 72964 - RNA, 19 nt, Homo sapiens
ggacuacauuccgcaaagg

SEQ ID NO: 72965 - RNA, 19 nt, Homo sapiens
uaucagauuucagaagaag

SEQ ID NO: 72966 - RNA, 19 nt, Homo sapiens
uauauucuccugccuuuua

SEQ ID NO: 72967 - RNA, 19 nt, Homo sapiens
gcagaauccagcuacgaau

SEQ ID NO: 72968 - RNA, 19 nt, Homo sapiens
gggauacugucugaucauc

SEQ ID NO: 72969 - RNA, 19 nt, Homo sapiens
gaauaccagugggcaagag

SEQ ID NO: 72970 - RNA, 19 nt, Homo sapiens
aagagucugugcccaaauc

SEQ ID NO: 72971 - RNA, 19 nt, Homo sapiens
uuaauagacuggauuugcu

SEQ ID NO: 72972 - RNA, 19 nt, Homo sapiens
ggaugcaggguuugagaau

SEQ ID NO: 72973 - RNA, 19 nt, Homo sapiens
caagagccugcugaagaua

SEQ ID NO: 72974 - RNA, 19 nt, Homo sapiens
ccuacagggucaugcucua

SEQ ID NO: 72975 - RNA, 19 nt, Homo sapiens
uuagaagccugcagaaucc

SEQ ID NO: 72976 - RNA, 19 nt, Homo sapiens
cuagaaaggaggagaugga

SEQ ID NO: 72977 - RNA, 19 nt, Homo sapiens
agaauccagcuacgaauau

SEQ ID NO: 72978 - RNA, 19 nt, Homo sapiens
auuauauucuccugccuuu

SEQ ID NO: 72979 - RNA, 19 nt, Homo sapiens
acuugaaccuugggaauau

SEQ ID NO: 72980 - RNA, 19 nt, Homo sapiens
augcaggguuugagaaugu

SEQ ID NO: 72981 - RNA, 19 nt, Homo sapiens
ggaauaccagugggcaaga

SEQ ID NO: 72982 - RNA, 19 nt, Homo sapiens
acagggucaugcucuauca

SEQ ID NO: 72983 - RNA, 19 nt, Homo sapiens
ucaacgacuaugaagaauu

SEQ ID NO: 72984 - RNA, 19 nt, Homo sapiens
gagaaggaaaguuggacau

SEQ ID NO: 72985 - RNA, 19 nt, Homo sapiens
gaagaagugagcagaucag

SEQ ID NO: 72986 - RNA, 19 nt, Homo sapiens
ggagauggaaagggaacuu

SEQ ID NO: 72987 - RNA, 19 nt, Homo sapiens
gaauguuggaggaaagcaa

SEQ ID NO: 72988 - RNA, 19 nt, Homo sapiens
aggaugccuugauguuauu

SEQ ID NO: 72989 - RNA, 19 nt, Homo sapiens
gggcaagagaauuagcauu

SEQ ID NO: 72990 - RNA, 19 nt, Homo sapiens
caacaagagccugcugaag

SEQ ID NO: 72991 - RNA, 19 nt, Homo sapiens
cacuugaaccuugggaaua

SEQ ID NO: 72992 - RNA, 19 nt, Homo sapiens
ggaagcaagaacccaucaa

SEQ ID NO: 72993 - RNA, 19 nt, Homo sapiens
ucagauuucagaagaagug

SEQ ID NO: 72994 - RNA, 19 nt, Homo sapiens
gaacagcuguaaucuauga

SEQ ID NO: 72995 - RNA, 19 nt, Homo sapiens
gcagaaagaccauggguuu

SEQ ID NO: 72996 - RNA, 19 nt, Homo sapiens
ucucagguguugccaaaua

SEQ ID NO: 72997 - RNA, 19 nt, Homo sapiens
ccaggcagcugaucauaga

SEQ ID NO: 72998 - RNA, 19 nt, Homo sapiens
cugaacagcuguaaucuau

SEQ ID NO: 72999 - RNA, 19 nt, Homo sapiens
ccacuggucuguagggauu

SEQ ID NO: 73000 - RNA, 19 nt, Homo sapiens
gaaagggauuuauaaacag

SEQ ID NO: 73001 - RNA, 19 nt, Homo sapiens
acagaugccugguugcuuu

SEQ ID NO: 73002 - RNA, 19 nt, Homo sapiens
cgaccugacugccaagaaa

SEQ ID NO: 73003 - RNA, 19 nt, Homo sapiens
gggauuaaccucugcacua

SEQ ID NO: 73004 - RNA, 19 nt, Homo sapiens
gaagagggacagaugaaug

SEQ ID NO: 73005 - RNA, 19 nt, Homo sapiens
caguaucgcucauagauca

SEQ ID NO: 73006 - RNA, 19 nt, Homo sapiens
gcuccaacaucgacuguga

SEQ ID NO: 73007 - RNA, 19 nt, Homo sapiens
ggacuuuccugcaacucaa

SEQ ID NO: 73008 - RNA, 19 nt, Homo sapiens
ggagucaggcucuuccuuu

SEQ ID NO: 73009 - RNA, 19 nt, Homo sapiens
cuuagcagcuuccagauug

SEQ ID NO: 73010 - RNA, 19 nt, Homo sapiens
guucucagguguugccaaa

SEQ ID NO: 73011 - RNA, 19 nt, Homo sapiens
caacaucgacugugagaag

SEQ ID NO: 73012 - RNA, 19 nt, Homo sapiens
guccagggcuagugacuug

SEQ ID NO: 73013 - RNA, 19 nt, Homo sapiens
gcugaacaguggaggaaga

SEQ ID NO: 73014 - RNA, 19 nt, Homo sapiens
ggauuaaccucugcacuac

SEQ ID NO: 73015 - RNA, 19 nt, Homo sapiens
ggugaaagggauuuauaaa

SEQ ID NO: 73016 - RNA, 19 nt, Homo sapiens
gagucaggcucuuccuuug

SEQ ID NO: 73017 - RNA, 19 nt, Homo sapiens
cagcuguaaucuaugaauu

SEQ ID NO: 73018 - RNA, 19 nt, Homo sapiens
ggaggaagagggacagaug

SEQ ID NO: 73019 - RNA, 19 nt, Homo sapiens
gaaagaccauggguuugag

SEQ ID NO: 73020 - RNA, 19 nt, Homo sapiens
gcacagggucugcucuuuc

SEQ ID NO: 73021 - RNA, 19 nt, Homo sapiens
ggacaugcuggcuucguuu

SEQ ID NO: 73022 - RNA, 19 nt, Homo sapiens
ggacacaggccaggacaug

SEQ ID NO: 73023 - RNA, 19 nt, Homo sapiens
ucgagaagauugugaacau

SEQ ID NO: 73024 - RNA, 19 nt, Homo sapiens
uguggccacugccucauua

SEQ ID NO: 73025 - RNA, 19 nt, Homo sapiens
gauugcacguggccucuug

SEQ ID NO: 73026 - RNA, 19 nt, Homo sapiens
gagggaagcccaagcucuu

SEQ ID NO: 73027 - RNA, 19 nt, Homo sapiens
gcugugaggcuguccugua

SEQ ID NO: 73028 - RNA, 19 nt, Homo sapiens
cauugguucuggaggauuu

SEQ ID NO: 73029 - RNA, 19 nt, Homo sapiens
aaacuuuccucgccugaca

SEQ ID NO: 73030 - RNA, 19 nt, Homo sapiens
ugacuugugucccaugauc

SEQ ID NO: 73031 - RNA, 19 nt, Homo sapiens
ggccuggacuuuccugcaa

SEQ ID NO: 73032 - RNA, 19 nt, Homo sapiens
cuaaugcuguuucggugaa

SEQ ID NO: 73033 - RNA, 19 nt, Homo sapiens
uaucaacaaugugaacuuc

SEQ ID NO: 73034 - RNA, 19 nt, Homo sapiens
gucaggcucuuccuuuguu

SEQ ID NO: 73035 - RNA, 19 nt, Homo sapiens
aaaccaguaucgcucauag

SEQ ID NO: 73036 - RNA, 19 nt, Homo sapiens
gacccuggacgacaucuuu

SEQ ID NO: 73037 - RNA, 19 nt, Homo sapiens
ucaacaaugugaacuucug

SEQ ID NO: 73038 - RNA, 19 nt, Homo sapiens
gcucauagaucagcaaacc

SEQ ID NO: 73039 - RNA, 19 nt, Homo sapiens
agaaagaccauggguuuga

SEQ ID NO: 73040 - RNA, 19 nt, Homo sapiens
gaggcuguccuguacauug

SEQ ID NO: 73041 - RNA, 19 nt, Homo sapiens
gaggaagagggacagauga

SEQ ID NO: 73042 - RNA, 19 nt, Homo sapiens
caucgacugugagaaguug

SEQ ID NO: 73043 - RNA, 19 nt, Homo sapiens
gcuguaaucuaugaauucu

SEQ ID NO: 73044 - RNA, 19 nt, Homo sapiens
gacaggcucuuagcagcuu

SEQ ID NO: 73045 - RNA, 19 nt, Homo sapiens
gccacugccucauuaucaa

SEQ ID NO: 73046 - RNA, 19 nt, Homo sapiens
ccucugcacuacugacaug

SEQ ID NO: 73047 - RNA, 19 nt, Homo sapiens
gcucuuccuuuguucaucu

SEQ ID NO: 73048 - RNA, 19 nt, Homo sapiens
ggcacagggucugcucuuu

SEQ ID NO: 73049 - RNA, 19 nt, Homo sapiens
gaccagagauucgcaaacc

SEQ ID NO: 73050 - RNA, 19 nt, Homo sapiens
ggaagagggacagaugaau

SEQ ID NO: 73051 - RNA, 19 nt, Homo sapiens
uagggucgcuaaugcuguu

SEQ ID NO: 73052 - RNA, 19 nt, Homo sapiens
ccaagaguggcuccuggua

SEQ ID NO: 73053 - RNA, 19 nt, Homo sapiens
gagguucucagaccggaaa

SEQ ID NO: 73054 - RNA, 19 nt, Homo sapiens
caggcaagcagcaaaguug

SEQ ID NO: 73055 - RNA, 19 nt, Homo sapiens
acagaugaaugccguggau

SEQ ID NO: 73056 - RNA, 19 nt, Homo sapiens
guucaucuccugcuuagag

SEQ ID NO: 73057 - RNA, 19 nt, Homo sapiens
caaaccaguaucgcucaua

SEQ ID NO: 73058 - RNA, 19 nt, Homo sapiens
ccugaguggugccaaacaa

SEQ ID NO: 73059 - RNA, 19 nt, Homo sapiens
ggccacugccucauuauca

SEQ ID NO: 73060 - RNA, 19 nt, Homo sapiens
caugaucccuguguugucu

SEQ ID NO: 73061 - RNA, 19 nt, Homo sapiens
gacgacaagugcugaacag

SEQ ID NO: 73062 - RNA, 19 nt, Homo sapiens
cacagggucugcucuuucu

SEQ ID NO: 73063 - RNA, 19 nt, Homo sapiens
cagcuggacgccauaucua

SEQ ID NO: 73064 - RNA, 19 nt, Homo sapiens
ccagaccaguggacauugg

SEQ ID NO: 73065 - RNA, 19 nt, Homo sapiens
gcugaggccuggacuuucc

SEQ ID NO: 73066 - RNA, 19 nt, Homo sapiens
gugaaagggauuuauaaac

SEQ ID NO: 73067 - RNA, 19 nt, Homo sapiens
cggugaaagggauuuauaa

SEQ ID NO: 73068 - RNA, 19 nt, Homo sapiens
cacacccagugacaucuuu

SEQ ID NO: 73069 - RNA, 19 nt, Homo sapiens
cgagaagauugugaacauc

SEQ ID NO: 73070 - RNA, 19 nt, Homo sapiens
gugaggcuguccuguacau

SEQ ID NO: 73071 - RNA, 19 nt, Homo sapiens
gcuuccagauugacgacaa

SEQ ID NO: 73072 - RNA, 19 nt, Homo sapiens
gaugccugguugcuuuaau

SEQ ID NO: 73073 - RNA, 19 nt, Homo sapiens
ucggugaaagggauuuaua

SEQ ID NO: 73074 - RNA, 19 nt, Homo sapiens
agaaaauggugcuggcuuu

SEQ ID NO: 73075 - RNA, 19 nt, Homo sapiens
uaacaggcaagcagcaaag

SEQ ID NO: 73076 - RNA, 19 nt, Homo sapiens
cagaugccugguugcuuua

SEQ ID NO: 73077 - RNA, 19 nt, Homo sapiens
uggacgccauaucuaguuu

SEQ ID NO: 73078 - RNA, 19 nt, Homo sapiens
gacauugguucuggaggau

SEQ ID NO: 73079 - RNA, 19 nt, Homo sapiens
acucuacuuucccagguuu

SEQ ID NO: 73080 - RNA, 19 nt, Homo sapiens
gugaacuucugccgugagu

SEQ ID NO: 73081 - RNA, 19 nt, Homo sapiens
uauaaacagaugccugguu

SEQ ID NO: 73082 - RNA, 19 nt, Homo sapiens
ggacgccauaucuaguuug

SEQ ID NO: 73083 - RNA, 19 nt, Homo sapiens
gcacuggcuccaacaucga

SEQ ID NO: 73084 - RNA, 19 nt, Homo sapiens
uggcuuacauccugagcau

SEQ ID NO: 73085 - RNA, 19 nt, Homo sapiens
ggugaugucggugcucuug

SEQ ID NO: 73086 - RNA, 19 nt, Homo sapiens
ugucgaagccaacccuaga

SEQ ID NO: 73087 - RNA, 19 nt, Homo sapiens
agaugaaugccguggauug

SEQ ID NO: 73088 - RNA, 19 nt, Homo sapiens
ucuccucgcugcauuucau

SEQ ID NO: 73089 - RNA, 19 nt, Homo sapiens
gcuacacacaaaccaguau

SEQ ID NO: 73090 - RNA, 19 nt, Homo sapiens
cacugucccuugccucaau

SEQ ID NO: 73091 - RNA, 19 nt, Homo sapiens
augccugguugcuuuaauu

SEQ ID NO: 73092 - RNA, 19 nt, Homo sapiens
cagaaagaccauggguuug

SEQ ID NO: 73093 - RNA, 19 nt, Homo sapiens
ucugaacagcuguaaucua

SEQ ID NO: 73094 - RNA, 19 nt, Homo sapiens
gaacagcuguaaucuauga

SEQ ID NO: 73095 - RNA, 19 nt, Homo sapiens
gcagaaagaccauggguuu

SEQ ID NO: 73096 - RNA, 19 nt, Homo sapiens
ucucagguguugccaaaua

SEQ ID NO: 73097 - RNA, 19 nt, Homo sapiens
ccaggcagcugaucauaga

SEQ ID NO: 73098 - RNA, 19 nt, Homo sapiens
cugaacagcuguaaucuau

SEQ ID NO: 73099 - RNA, 19 nt, Homo sapiens
ccacuggucuguagggauu

SEQ ID NO: 73100 - RNA, 19 nt, Homo sapiens
gaaagggauuuauaaacag

SEQ ID NO: 73101 - RNA, 19 nt, Homo sapiens
acagaugccugguugcuuu

SEQ ID NO: 73102 - RNA, 19 nt, Homo sapiens
gggauuaaccucugcacua

SEQ ID NO: 73103 - RNA, 19 nt, Homo sapiens
gaagagggacagaugaaug

SEQ ID NO: 73104 - RNA, 19 nt, Homo sapiens
caguaucgcucauagauca

SEQ ID NO: 73105 - RNA, 19 nt, Homo sapiens
ggacuuuccugcaacucaa

SEQ ID NO: 73106 - RNA, 19 nt, Homo sapiens
ggagucaggcucuuccuuu

SEQ ID NO: 73107 - RNA, 19 nt, Homo sapiens
cuuagcagcuuccagauug

SEQ ID NO: 73108 - RNA, 19 nt, Homo sapiens
guucucagguguugccaaa

SEQ ID NO: 73109 - RNA, 19 nt, Homo sapiens
guccagggcuagugacuug

SEQ ID NO: 73110 - RNA, 19 nt, Homo sapiens
gcugaacaguggaggaaga

SEQ ID NO: 73111 - RNA, 19 nt, Homo sapiens
ggauuaaccucugcacuac

SEQ ID NO: 73112 - RNA, 19 nt, Homo sapiens
ggugaaagggauuuauaaa

SEQ ID NO: 73113 - RNA, 19 nt, Homo sapiens
gagucaggcucuuccuuug

SEQ ID NO: 73114 - RNA, 19 nt, Homo sapiens
cagcuguaaucuaugaauu

SEQ ID NO: 73115 - RNA, 19 nt, Homo sapiens
ggaggaagagggacagaug

SEQ ID NO: 73116 - RNA, 19 nt, Homo sapiens
gaaagaccauggguuugag

SEQ ID NO: 73117 - RNA, 19 nt, Homo sapiens
gcacagggucugcucuuuc

SEQ ID NO: 73118 - RNA, 19 nt, Homo sapiens
ggacaugcuggcuucguuu

SEQ ID NO: 73119 - RNA, 19 nt, Homo sapiens
ggacacaggccaggacaug

SEQ ID NO: 73120 - RNA, 19 nt, Homo sapiens
gauugcacguggccucuug

SEQ ID NO: 73121 - RNA, 19 nt, Homo sapiens
gcugugaggcuguccugua

SEQ ID NO: 73122 - RNA, 19 nt, Homo sapiens
cauugguucuggaggauuu

SEQ ID NO: 73123 - RNA, 19 nt, Homo sapiens
aaacuuuccucgccugaca

SEQ ID NO: 73124 - RNA, 19 nt, Homo sapiens
ugacuugugucccaugauc

SEQ ID NO: 73125 - RNA, 19 nt, Homo sapiens
gucaggcucuuccuuuguu

SEQ ID NO: 73126 - RNA, 19 nt, Homo sapiens
ggccuggacuuuccugcaa

SEQ ID NO: 73127 - RNA, 19 nt, Homo sapiens
cuaaugcuguuucggugaa

SEQ ID NO: 73128 - RNA, 19 nt, Homo sapiens
aaaccaguaucgcucauag

SEQ ID NO: 73129 - RNA, 19 nt, Homo sapiens
gacccuggacgacaucuuu

SEQ ID NO: 73130 - RNA, 19 nt, Homo sapiens
gcucauagaucagcaaacc

SEQ ID NO: 73131 - RNA, 19 nt, Homo sapiens
agaaagaccauggguuuga

SEQ ID NO: 73132 - RNA, 19 nt, Homo sapiens
gaggcuguccuguacauug

SEQ ID NO: 73133 - RNA, 19 nt, Homo sapiens
gaggaagagggacagauga

SEQ ID NO: 73134 - RNA, 19 nt, Homo sapiens
gcuguaaucuaugaauucu

SEQ ID NO: 73135 - RNA, 19 nt, Homo sapiens
gacaggcucuuagcagcuu

SEQ ID NO: 73136 - RNA, 19 nt, Homo sapiens
ccucugcacuacugacaug

SEQ ID NO: 73137 - RNA, 19 nt, Homo sapiens
ggcacagggucugcucuuu

SEQ ID NO: 73138 - RNA, 19 nt, Homo sapiens
gcucuuccuuuguucaucu

SEQ ID NO: 73139 - RNA, 19 nt, Homo sapiens
gaccagagauucgcaaacc

SEQ ID NO: 73140 - RNA, 19 nt, Homo sapiens
ggaagagggacagaugaau

SEQ ID NO: 73141 - RNA, 19 nt, Homo sapiens
uagggucgcuaaugcuguu

SEQ ID NO: 73142 - RNA, 19 nt, Homo sapiens
ccaagaguggcuccuggua

SEQ ID NO: 73143 - RNA, 19 nt, Homo sapiens
gagguucucagaccggaaa

SEQ ID NO: 73144 - RNA, 19 nt, Homo sapiens
caggcaagcagcaaaguug

SEQ ID NO: 73145 - RNA, 19 nt, Homo sapiens
acagaugaaugccguggau

SEQ ID NO: 73146 - RNA, 19 nt, Homo sapiens
caaaccaguaucgcucaua

SEQ ID NO: 73147 - RNA, 19 nt, Homo sapiens
ccugaguggugccaaacaa

SEQ ID NO: 73148 - RNA, 19 nt, Homo sapiens
guucaucuccugcuuagag

SEQ ID NO: 73149 - RNA, 19 nt, Homo sapiens
caugaucccuguguugucu

SEQ ID NO: 73150 - RNA, 19 nt, Homo sapiens
gacgacaagugcugaacag

SEQ ID NO: 73151 - RNA, 19 nt, Homo sapiens
cacagggucugcucuuucu

SEQ ID NO: 73152 - RNA, 19 nt, Homo sapiens
cagcuggacgccauaucua

SEQ ID NO: 73153 - RNA, 19 nt, Homo sapiens
ccagaccaguggacauugg

SEQ ID NO: 73154 - RNA, 19 nt, Homo sapiens
gcugaggccuggacuuucc

SEQ ID NO: 73155 - RNA, 19 nt, Homo sapiens
gugaaagggauuuauaaac

SEQ ID NO: 73156 - RNA, 19 nt, Homo sapiens
cggugaaagggauuuauaa

SEQ ID NO: 73157 - RNA, 19 nt, Homo sapiens
cacacccagugacaucuuu

SEQ ID NO: 73158 - RNA, 19 nt, Homo sapiens
gugaggcuguccuguacau

SEQ ID NO: 73159 - RNA, 19 nt, Homo sapiens
gcuuccagauugacgacaa

SEQ ID NO: 73160 - RNA, 19 nt, Homo sapiens
gaugccugguugcuuuaau

SEQ ID NO: 73161 - RNA, 19 nt, Homo sapiens
ucggugaaagggauuuaua

SEQ ID NO: 73162 - RNA, 19 nt, Homo sapiens
uaacaggcaagcagcaaag

SEQ ID NO: 73163 - RNA, 19 nt, Homo sapiens
cagaugccugguugcuuua

SEQ ID NO: 73164 - RNA, 19 nt, Homo sapiens
uggacgccauaucuaguuu

SEQ ID NO: 73165 - RNA, 19 nt, Homo sapiens
gacauugguucuggaggau

SEQ ID NO: 73166 - RNA, 19 nt, Homo sapiens
acucuacuuucccagguuu

SEQ ID NO: 73167 - RNA, 19 nt, Homo sapiens
uauaaacagaugccugguu

SEQ ID NO: 73168 - RNA, 19 nt, Homo sapiens
ggacgccauaucuaguuug

SEQ ID NO: 73169 - RNA, 19 nt, Homo sapiens
agaugaaugccguggauug

SEQ ID NO: 73170 - RNA, 19 nt, Homo sapiens
ugucgaagccaacccuaga

SEQ ID NO: 73171 - RNA, 19 nt, Homo sapiens
uuggugaugucgagcagaa

SEQ ID NO: 73172 - RNA, 19 nt, Homo sapiens
gcuacacacaaaccaguau

SEQ ID NO: 73173 - RNA, 19 nt, Homo sapiens
cacugucccuugccucaau

SEQ ID NO: 73174 - RNA, 19 nt, Homo sapiens
augccugguugcuuuaauu

SEQ ID NO: 73175 - RNA, 19 nt, Homo sapiens
cagaaagaccauggguuug

SEQ ID NO: 73176 - RNA, 19 nt, Homo sapiens
ucugaacagcuguaaucua

SEQ ID NO: 73177 - RNA, 19 nt, Homo sapiens
uuagcagcuuccagauuga

SEQ ID NO: 73178 - RNA, 19 nt, Homo sapiens
ggccaggcagcugaucaua

SEQ ID NO: 73179 - RNA, 19 nt, Homo sapiens
agucugaacagcuguaauc

SEQ ID NO: 73180 - RNA, 19 nt, Homo sapiens
aggcuguccuguacauugu

SEQ ID NO: 73181 - RNA, 19 nt, Homo sapiens
aggacaugcuggcuucguu

SEQ ID NO: 73182 - RNA, 19 nt, Homo sapiens
gaaaugaccucccuaaguu

SEQ ID NO: 73183 - RNA, 19 nt, Homo sapiens
gaaggcagcugguauauuc

SEQ ID NO: 73184 - RNA, 19 nt, Homo sapiens
uaaggaaggugcucacaua

SEQ ID NO: 73185 - RNA, 19 nt, Homo sapiens
gacaugaucuuccuucuga

SEQ ID NO: 73186 - RNA, 19 nt, Homo sapiens
caaaggguuucucuguuua

SEQ ID NO: 73187 - RNA, 19 nt, Homo sapiens
ggaaggugcucacauagga

SEQ ID NO: 73188 - RNA, 19 nt, Homo sapiens
gaagauugguggagcuuga

SEQ ID NO: 73189 - RNA, 19 nt, Homo sapiens
guuaacgccuucauuuaua

SEQ ID NO: 73190 - RNA, 19 nt, Homo sapiens
gcaaagaagggaauuuauu

SEQ ID NO: 73191 - RNA, 19 nt, Homo sapiens
gaucaugucucacuucaca

SEQ ID NO: 73192 - RNA, 19 nt, Homo sapiens
uggcagaacuccucuauau

SEQ ID NO: 73193 - RNA, 19 nt, Homo sapiens
gugccugcauuuauaauua

SEQ ID NO: 73194 - RNA, 19 nt, Homo sapiens
caaauugacugaagcaaag

SEQ ID NO: 73195 - RNA, 19 nt, Homo sapiens
gcagaacuccucuauauca

SEQ ID NO: 73196 - RNA, 19 nt, Homo sapiens
ggacuacaggcaugaaaua

SEQ ID NO: 73197 - RNA, 19 nt, Homo sapiens
acaaaggguuucucuguuu

SEQ ID NO: 73198 - RNA, 19 nt, Homo sapiens
gggaauuuauugccucuuu

SEQ ID NO: 73199 - RNA, 19 nt, Homo sapiens
caaagaagggaauuuauug

SEQ ID NO: 73200 - RNA, 19 nt, Homo sapiens
gagcuuagauugccucucu

SEQ ID NO: 73201 - RNA, 19 nt, Homo sapiens
uggaugcacuuucaauaua

SEQ ID NO: 73202 - RNA, 19 nt, Homo sapiens
ggagagaggcugugucaga

SEQ ID NO: 73203 - RNA, 19 nt, Homo sapiens
gaacuccucuauaucauac

SEQ ID NO: 73204 - RNA, 19 nt, Homo sapiens
acaagaagcuggagaaguc

SEQ ID NO: 73205 - RNA, 19 nt, Homo sapiens
gaagggaguggcucuguaa

SEQ ID NO: 73206 - RNA, 19 nt, Homo sapiens
gagagaggcugugucagaa

SEQ ID NO: 73207 - RNA, 19 nt, Homo sapiens
caacauugguauuccaguu

SEQ ID NO: 73208 - RNA, 19 nt, Homo sapiens
gaacauuucaguugccauu

SEQ ID NO: 73209 - RNA, 19 nt, Homo sapiens
gaaagacucgcuucccaaa

SEQ ID NO: 73210 - RNA, 19 nt, Homo sapiens
gacaaaggguuucucuguu

SEQ ID NO: 73211 - RNA, 19 nt, Homo sapiens
gcaaaacaguuguaccuaa

SEQ ID NO: 73212 - RNA, 19 nt, Homo sapiens
gauccaaaguccugugguu

SEQ ID NO: 73213 - RNA, 19 nt, Homo sapiens
acacagaggauucuacuuu

SEQ ID NO: 73214 - RNA, 19 nt, Homo sapiens
ccauaaagaugcugagauc

SEQ ID NO: 73215 - RNA, 19 nt, Homo sapiens
gaacuuaaaggacaugauc

SEQ ID NO: 73216 - RNA, 19 nt, Homo sapiens
gaggaaggcagcugguaua

SEQ ID NO: 73217 - RNA, 19 nt, Homo sapiens
caugaaaucucaaggucaa

SEQ ID NO: 73218 - RNA, 19 nt, Homo sapiens
gaagaacuaguuucccaaa

SEQ ID NO: 73219 - RNA, 19 nt, Homo sapiens
cauuaggaguguuucauuu

SEQ ID NO: 73220 - RNA, 19 nt, Homo sapiens
ugccuaagcuggucucaaa

SEQ ID NO: 73221 - RNA, 19 nt, Homo sapiens
gaggcugacuuccuacuug

SEQ ID NO: 73222 - RNA, 19 nt, Homo sapiens
acaauaaugugacgaaagu

SEQ ID NO: 73223 - RNA, 19 nt, Homo sapiens
uuuacaaccugaugucaua

SEQ ID NO: 73224 - RNA, 19 nt, Homo sapiens
ucacugcugucaacgauga

SEQ ID NO: 73225 - RNA, 19 nt, Homo sapiens
ugacgaaaguggaaaugga

SEQ ID NO: 73226 - RNA, 19 nt, Homo sapiens
cagaaggcauugacucaga

SEQ ID NO: 73227 - RNA, 19 nt, Homo sapiens
gggaguggcucuguaagga

SEQ ID NO: 73228 - RNA, 19 nt, Homo sapiens
acacucagcugcucugcaa

SEQ ID NO: 73229 - RNA, 19 nt, Homo sapiens
ucaaggagaggaagaacua

SEQ ID NO: 73230 - RNA, 19 nt, Homo sapiens
ggaugcacuuucaauauag

SEQ ID NO: 73231 - RNA, 19 nt, Homo sapiens
cugccaaggugaagagaua

SEQ ID NO: 73232 - RNA, 19 nt, Homo sapiens
cgacaaaggguuucucugu

SEQ ID NO: 73233 - RNA, 19 nt, Homo sapiens
gguuaacgccuucauuuau

SEQ ID NO: 73234 - RNA, 19 nt, Homo sapiens
caccucagcuucucaaagu

SEQ ID NO: 73235 - RNA, 19 nt, Homo sapiens
ggacaaacagggaacaaag

SEQ ID NO: 73236 - RNA, 19 nt, Homo sapiens
uauauucagucucugugua

SEQ ID NO: 73237 - RNA, 19 nt, Homo sapiens
gcugagauccugagucaug

SEQ ID NO: 73238 - RNA, 19 nt, Homo sapiens
ggaagggcauuaggagugu

SEQ ID NO: 73239 - RNA, 19 nt, Homo sapiens
cuugaugcuuucuucauua

SEQ ID NO: 73240 - RNA, 19 nt, Homo sapiens
ugacagaacacccaauuca

SEQ ID NO: 73241 - RNA, 19 nt, Homo sapiens
gagccaagaugacacaacu

SEQ ID NO: 73242 - RNA, 19 nt, Homo sapiens
gauccugagucauguguuc

SEQ ID NO: 73243 - RNA, 19 nt, Homo sapiens
caaggaacccauaaagaug

SEQ ID NO: 73244 - RNA, 19 nt, Homo sapiens
caaaacaguuguaccuaaa

SEQ ID NO: 73245 - RNA, 19 nt, Homo sapiens
ccucaaguuucucugcaua

SEQ ID NO: 73246 - RNA, 19 nt, Homo sapiens
gaaagucaaauucauguac

SEQ ID NO: 73247 - RNA, 19 nt, Homo sapiens
ugaacaaccugcucacagu

SEQ ID NO: 73248 - RNA, 19 nt, Homo sapiens
ugaagggaguggcucugua

SEQ ID NO: 73249 - RNA, 19 nt, Homo sapiens
aagcaaagaagggaauuua

SEQ ID NO: 73250 - RNA, 19 nt, Homo sapiens
ggcgagaccuuguuuaaaa

SEQ ID NO: 73251 - RNA, 19 nt, Homo sapiens
gacaaggaacccauaaaga

SEQ ID NO: 73252 - RNA, 19 nt, Homo sapiens
ggagaggaagaacuaguuu

SEQ ID NO: 73253 - RNA, 19 nt, Homo sapiens
ggaauuuauugccucuuuc

SEQ ID NO: 73254 - RNA, 19 nt, Homo sapiens
cuacaggcaugaaauacug

SEQ ID NO: 73255 - RNA, 19 nt, Homo sapiens
aaacgaaucauuggguaua

SEQ ID NO: 73256 - RNA, 19 nt, Homo sapiens
acagaacacccaauucaaa

SEQ ID NO: 73257 - RNA, 19 nt, Homo sapiens
gcaagcagaaacuuuacaa

SEQ ID NO: 73258 - RNA, 19 nt, Homo sapiens
caccucagccucccaagua

SEQ ID NO: 73259 - RNA, 19 nt, Homo sapiens
ucugaaggcuggccaugaa

SEQ ID NO: 73260 - RNA, 19 nt, Homo sapiens
gauagugacaccuccugua

SEQ ID NO: 73261 - RNA, 19 nt, Homo sapiens
ugaaaugaccucccuaagu

SEQ ID NO: 73262 - RNA, 19 nt, Homo sapiens
gaaaccugcucuacgaacu

SEQ ID NO: 73263 - RNA, 19 nt, Homo sapiens
aguggugccugcauuuaua

SEQ ID NO: 73264 - RNA, 19 nt, Homo sapiens
gcauuaggaguguuucauu

SEQ ID NO: 73265 - RNA, 19 nt, Homo sapiens
cagugcauauacacaauaa

SEQ ID NO: 73266 - RNA, 19 nt, Homo sapiens
acaaggaacccauaaagau

SEQ ID NO: 73267 - RNA, 19 nt, Homo sapiens
caaggaagccgagucguau

SEQ ID NO: 73268 - RNA, 19 nt, Homo sapiens
guauuccaguucagauaaa

SEQ ID NO: 73269 - RNA, 19 nt, Homo sapiens
gucaaggaaugaagaacaa

SEQ ID NO: 73270 - RNA, 19 nt, Homo sapiens
uuaggaguguuucauuuga

SEQ ID NO: 73271 - RNA, 19 nt, Homo sapiens
gaggagagaggcuguguca

SEQ ID NO: 73272 - RNA, 19 nt, Homo sapiens
gcacaucuagugaggugaa

SEQ ID NO: 73273 - RNA, 19 nt, Homo sapiens
gcugguauauucagucucu

SEQ ID NO: 73274 - RNA, 19 nt, Homo sapiens
gugcauauacacaauaaug

SEQ ID NO: 73275 - RNA, 19 nt, Homo sapiens
gguauuccaguucagauaa

SEQ ID NO: 73276 - RNA, 19 nt, Homo sapiens
agaggauucuacuuucuuu

SEQ ID NO: 73277 - RNA, 19 nt, Homo sapiens
cggcaaaaccucaucauua

SEQ ID NO: 73278 - RNA, 19 nt, Homo sapiens
gcaaucacggcucacugua

SEQ ID NO: 73279 - RNA, 19 nt, Homo sapiens
gagagaaagcuauccagau

SEQ ID NO: 73280 - RNA, 19 nt, Homo sapiens
gaaugaagaacaacaacuc

SEQ ID NO: 73281 - RNA, 19 nt, Homo sapiens
gugguuaacgccuucauuu

SEQ ID NO: 73282 - RNA, 19 nt, Homo sapiens
gaaaugaccucccuaaguu

SEQ ID NO: 73283 - RNA, 19 nt, Homo sapiens
gaaggcagcugguauauuc

SEQ ID NO: 73284 - RNA, 19 nt, Homo sapiens
gacaugaucuuccuucuga

SEQ ID NO: 73285 - RNA, 19 nt, Homo sapiens
gcacucuucuguucccuua

SEQ ID NO: 73286 - RNA, 19 nt, Homo sapiens
caaaggguuucucuguuua

SEQ ID NO: 73287 - RNA, 19 nt, Homo sapiens
gaagauugguggagcuuga

SEQ ID NO: 73288 - RNA, 19 nt, Homo sapiens
gaucaugucucacuucaca

SEQ ID NO: 73289 - RNA, 19 nt, Homo sapiens
uggcagaacuccucuauau

SEQ ID NO: 73290 - RNA, 19 nt, Homo sapiens
gcagaacuccucuauauca

SEQ ID NO: 73291 - RNA, 19 nt, Homo sapiens
acaaaggguuucucuguuu

SEQ ID NO: 73292 - RNA, 19 nt, Homo sapiens
ccacaucgccugagauuga

SEQ ID NO: 73293 - RNA, 19 nt, Homo sapiens
gcggaugguuaaacaauuu

SEQ ID NO: 73294 - RNA, 19 nt, Homo sapiens
gagcagcguuuccuaguuc

SEQ ID NO: 73295 - RNA, 19 nt, Homo sapiens
gaacuccucuauaucauac

SEQ ID NO: 73296 - RNA, 19 nt, Homo sapiens
acaagaagcuggagaaguc

SEQ ID NO: 73297 - RNA, 19 nt, Homo sapiens
gaacguggcacucuucugu

SEQ ID NO: 73298 - RNA, 19 nt, Homo sapiens
caacauugguauuccaguu

SEQ ID NO: 73299 - RNA, 19 nt, Homo sapiens
gaaagacucgcuucccaaa

SEQ ID NO: 73300 - RNA, 19 nt, Homo sapiens
gacaaaggguuucucuguu

SEQ ID NO: 73301 - RNA, 19 nt, Homo sapiens
gcaaaacaguuguaccuaa

SEQ ID NO: 73302 - RNA, 19 nt, Homo sapiens
ccauaaagaugcugagauc

SEQ ID NO: 73303 - RNA, 19 nt, Homo sapiens
gaacuuaaaggacaugauc

SEQ ID NO: 73304 - RNA, 19 nt, Homo sapiens
acacagaggauucuacuuu

SEQ ID NO: 73305 - RNA, 19 nt, Homo sapiens
gaggaaggcagcugguaua

SEQ ID NO: 73306 - RNA, 19 nt, Homo sapiens
caugaaaucucaaggucaa

SEQ ID NO: 73307 - RNA, 19 nt, Homo sapiens
gaagaacuaguuucccaaa

SEQ ID NO: 73308 - RNA, 19 nt, Homo sapiens
gaggcugacuuccuacuug

SEQ ID NO: 73309 - RNA, 19 nt, Homo sapiens
acaauaaugugacgaaagu

SEQ ID NO: 73310 - RNA, 19 nt, Homo sapiens
caaggaugcugaaauuucu

SEQ ID NO: 73311 - RNA, 19 nt, Homo sapiens
ugugucaucuuucuuguuu

SEQ ID NO: 73312 - RNA, 19 nt, Homo sapiens
ggagcagcguuuccuaguu

SEQ ID NO: 73313 - RNA, 19 nt, Homo sapiens
ugacgaaaguggaaaugga

SEQ ID NO: 73314 - RNA, 19 nt, Homo sapiens
cagaaggcauugacucaga

SEQ ID NO: 73315 - RNA, 19 nt, Homo sapiens
ucaaggagaggaagaacua

SEQ ID NO: 73316 - RNA, 19 nt, Homo sapiens
ucccaaggaugcugaaauu

SEQ ID NO: 73317 - RNA, 19 nt, Homo sapiens
cugccaaggugaagagaua

SEQ ID NO: 73318 - RNA, 19 nt, Homo sapiens
cgacaaaggguuucucugu

SEQ ID NO: 73319 - RNA, 19 nt, Homo sapiens
uauauucagucucugugua

SEQ ID NO: 73320 - RNA, 19 nt, Homo sapiens
gcugagauccugagucaug

SEQ ID NO: 73321 - RNA, 19 nt, Homo sapiens
uaacagagccacaaauggu

SEQ ID NO: 73322 - RNA, 19 nt, Homo sapiens
agacggaaaccucccuuua

SEQ ID NO: 73323 - RNA, 19 nt, Homo sapiens
gauccugagucauguguuc

SEQ ID NO: 73324 - RNA, 19 nt, Homo sapiens
caaggaacccauaaagaug

SEQ ID NO: 73325 - RNA, 19 nt, Homo sapiens
caaaacaguuguaccuaaa

SEQ ID NO: 73326 - RNA, 19 nt, Homo sapiens
ccucaaguuucucugcaua

SEQ ID NO: 73327 - RNA, 19 nt, Homo sapiens
gacaaggaacccauaaaga

SEQ ID NO: 73328 - RNA, 19 nt, Homo sapiens
cuaacacucuaaacucuga

SEQ ID NO: 73329 - RNA, 19 nt, Homo sapiens
ggagaggaagaacuaguuu

SEQ ID NO: 73330 - RNA, 19 nt, Homo sapiens
ugacaacgcccuacagcaa

SEQ ID NO: 73331 - RNA, 19 nt, Homo sapiens
ccaaggaugcugaaauuuc

SEQ ID NO: 73332 - RNA, 19 nt, Homo sapiens
gguaacagagccacaaaug

SEQ ID NO: 73333 - RNA, 19 nt, Homo sapiens
gauagugacaccuccugua

SEQ ID NO: 73334 - RNA, 19 nt, Homo sapiens
ugaaaugaccucccuaagu

SEQ ID NO: 73335 - RNA, 19 nt, Homo sapiens
gaaaccugcucuacgaacu

SEQ ID NO: 73336 - RNA, 19 nt, Homo sapiens
ucugaaggcuggccaugaa

SEQ ID NO: 73337 - RNA, 19 nt, Homo sapiens
cagugcauauacacaauaa

SEQ ID NO: 73338 - RNA, 19 nt, Homo sapiens
acaaggaacccauaaagau

SEQ ID NO: 73339 - RNA, 19 nt, Homo sapiens
caaggaagccgagucguau

SEQ ID NO: 73340 - RNA, 19 nt, Homo sapiens
guauuccaguucagauaaa

SEQ ID NO: 73341 - RNA, 19 nt, Homo sapiens
gcugguauauucagucucu

SEQ ID NO: 73342 - RNA, 19 nt, Homo sapiens
agaggauucuacuuucuuu

SEQ ID NO: 73343 - RNA, 19 nt, Homo sapiens
gugcauauacacaauaaug

SEQ ID NO: 73344 - RNA, 19 nt, Homo sapiens
gguauuccaguucagauaa

SEQ ID NO: 73345 - RNA, 19 nt, Homo sapiens
caaagagggcagcugugua

SEQ ID NO: 73346 - RNA, 19 nt, Homo sapiens
gagagaaagcuauccagau

SEQ ID NO: 73347 - RNA, 19 nt, Homo sapiens
ggaggaaggcagcugguau

SEQ ID NO: 73348 - RNA, 19 nt, Homo sapiens
acaagcggaugguuaaaca

SEQ ID NO: 73349 - RNA, 19 nt, Homo sapiens
aaacagaucucagcaaccu

SEQ ID NO: 73350 - RNA, 19 nt, Homo sapiens
ggaaggcagcugguauauu

SEQ ID NO: 73351 - RNA, 19 nt, Homo sapiens
gcaccucaacuguaccaaa

SEQ ID NO: 73352 - RNA, 19 nt, Homo sapiens
cagcucagccucagauguu

SEQ ID NO: 73353 - RNA, 19 nt, Homo sapiens
gucaacaaccacagcuuua

SEQ ID NO: 73354 - RNA, 19 nt, Homo sapiens
acaaggaagccgagucgua

SEQ ID NO: 73355 - RNA, 19 nt, Homo sapiens
cacagaggauucuacuuuc

SEQ ID NO: 73356 - RNA, 19 nt, Homo sapiens
uaaguuuccuggcauuucu

SEQ ID NO: 73357 - RNA, 19 nt, Homo sapiens
guaccugugucaucuuucu

SEQ ID NO: 73358 - RNA, 19 nt, Homo sapiens
ccugagaaccguuuacuuc

SEQ ID NO: 73359 - RNA, 19 nt, Homo sapiens
caucguaaacauacuucua

SEQ ID NO: 73360 - RNA, 19 nt, Homo sapiens
gaaaagacaauggaaauca

SEQ ID NO: 73361 - RNA, 19 nt, Homo sapiens
ugccgaggcugacuuccua

SEQ ID NO: 73362 - RNA, 19 nt, Homo sapiens
gaaaguggaaauggagaug

SEQ ID NO: 73363 - RNA, 19 nt, Homo sapiens
gaacuacaagcggaugguu

SEQ ID NO: 73364 - RNA, 19 nt, Homo sapiens
guguaccugugucaucuuu

SEQ ID NO: 73365 - RNA, 19 nt, Homo sapiens
gaggauucuacuuucuuua

SEQ ID NO: 73366 - RNA, 19 nt, Homo sapiens
gaagccgagucguaucaag

SEQ ID NO: 73367 - RNA, 19 nt, Homo sapiens
caacuguaccaaagaggaa

SEQ ID NO: 73368 - RNA, 19 nt, Homo sapiens
ccaacaagaagcuggagaa

SEQ ID NO: 73369 - RNA, 19 nt, Homo sapiens
ugucaucuuucuuguuuca

SEQ ID NO: 73370 - RNA, 19 nt, Homo sapiens
acggaaaccucccuuuaca

SEQ ID NO: 73371 - RNA, 19 nt, Homo sapiens
ucacagugcauauacacaa

SEQ ID NO: 73372 - RNA, 19 nt, Homo sapiens
ugguggagcuugaucugaa

SEQ ID NO: 73373 - RNA, 19 nt, Homo sapiens
ggacaugaucuuccuucug

SEQ ID NO: 73374 - RNA, 19 nt, Homo sapiens
caccucaacuguaccaaag

SEQ ID NO: 73375 - RNA, 19 nt, Homo sapiens
guggagaaccucaaguuuc

SEQ ID NO: 73376 - RNA, 19 nt, Homo sapiens
gacauucuuggaagccuua

SEQ ID NO: 73377 - RNA, 19 nt, Homo sapiens
cccaggcuauguauccuuu

SEQ ID NO: 73378 - RNA, 19 nt, Homo sapiens
gaaggcuggccaugaaauc

SEQ ID NO: 73379 - RNA, 19 nt, Homo sapiens
gacagacaaggaacccaua

SEQ ID NO: 73380 - RNA, 19 nt, Homo sapiens
gcaugcagguaguaauggu

SEQ ID NO: 73381 - RNA, 19 nt, Homo sapiens
gcacacagaggauucuacu

SEQ ID NO: 73382 - RNA, 19 nt, Homo sapiens
gaaaugaccucccuaaguu

SEQ ID NO: 73383 - RNA, 19 nt, Homo sapiens
gaaggcagcugguauauuc

SEQ ID NO: 73384 - RNA, 19 nt, Homo sapiens
uaaggaaggugcucacaua

SEQ ID NO: 73385 - RNA, 19 nt, Homo sapiens
gacaugaucuuccuucuga

SEQ ID NO: 73386 - RNA, 19 nt, Homo sapiens
caaaggguuucucuguuua

SEQ ID NO: 73387 - RNA, 19 nt, Homo sapiens
ggaaggugcucacauagga

SEQ ID NO: 73388 - RNA, 19 nt, Homo sapiens
gaagauugguggagcuuga

SEQ ID NO: 73389 - RNA, 19 nt, Homo sapiens
guuaacgccuucauuuaua

SEQ ID NO: 73390 - RNA, 19 nt, Homo sapiens
gcaaagaagggaauuuauu

SEQ ID NO: 73391 - RNA, 19 nt, Homo sapiens
gaucaugucucacuucaca

SEQ ID NO: 73392 - RNA, 19 nt, Homo sapiens
uggcagaacuccucuauau

SEQ ID NO: 73393 - RNA, 19 nt, Homo sapiens
gugccugcauuuauaauua

SEQ ID NO: 73394 - RNA, 19 nt, Homo sapiens
caaauugacugaagcaaag

SEQ ID NO: 73395 - RNA, 19 nt, Homo sapiens
gcagaacuccucuauauca

SEQ ID NO: 73396 - RNA, 19 nt, Homo sapiens
ggacuacaggcaugaaaua

SEQ ID NO: 73397 - RNA, 19 nt, Homo sapiens
acaaaggguuucucuguuu

SEQ ID NO: 73398 - RNA, 19 nt, Homo sapiens
gggaauuuauugccucuuu

SEQ ID NO: 73399 - RNA, 19 nt, Homo sapiens
caaagaagggaauuuauug

SEQ ID NO: 73400 - RNA, 19 nt, Homo sapiens
gagcuuagauugccucucu

SEQ ID NO: 73401 - RNA, 19 nt, Homo sapiens
uggaugcacuuucaauaua

SEQ ID NO: 73402 - RNA, 19 nt, Homo sapiens
ggagagaggcugugucaga

SEQ ID NO: 73403 - RNA, 19 nt, Homo sapiens
gaacuccucuauaucauac

SEQ ID NO: 73404 - RNA, 19 nt, Homo sapiens
acaagaagcuggagaaguc

SEQ ID NO: 73405 - RNA, 19 nt, Homo sapiens
gaagggaguggcucuguaa

SEQ ID NO: 73406 - RNA, 19 nt, Homo sapiens
gagagaggcugugucagaa

SEQ ID NO: 73407 - RNA, 19 nt, Homo sapiens
caacauugguauuccaguu

SEQ ID NO: 73408 - RNA, 19 nt, Homo sapiens
gaacauuucaguugccauu

SEQ ID NO: 73409 - RNA, 19 nt, Homo sapiens
gaaagacucgcuucccaaa

SEQ ID NO: 73410 - RNA, 19 nt, Homo sapiens
gacaaaggguuucucuguu

SEQ ID NO: 73411 - RNA, 19 nt, Homo sapiens
gcaaaacaguuguaccuaa

SEQ ID NO: 73412 - RNA, 19 nt, Homo sapiens
gauccaaaguccugugguu

SEQ ID NO: 73413 - RNA, 19 nt, Homo sapiens
acacagaggauucuacuuu

SEQ ID NO: 73414 - RNA, 19 nt, Homo sapiens
ccauaaagaugcugagauc

SEQ ID NO: 73415 - RNA, 19 nt, Homo sapiens
gaacuuaaaggacaugauc

SEQ ID NO: 73416 - RNA, 19 nt, Homo sapiens
gaggaaggcagcugguaua

SEQ ID NO: 73417 - RNA, 19 nt, Homo sapiens
caugaaaucucaaggucaa

SEQ ID NO: 73418 - RNA, 19 nt, Homo sapiens
gaagaacuaguuucccaaa

SEQ ID NO: 73419 - RNA, 19 nt, Homo sapiens
cauuaggaguguuucauuu

SEQ ID NO: 73420 - RNA, 19 nt, Homo sapiens
ugccuaagcuggucucaaa

SEQ ID NO: 73421 - RNA, 19 nt, Homo sapiens
gaggcugacuuccuacuug

SEQ ID NO: 73422 - RNA, 19 nt, Homo sapiens
acaauaaugugacgaaagu

SEQ ID NO: 73423 - RNA, 19 nt, Homo sapiens
uuuacaaccugaugucaua

SEQ ID NO: 73424 - RNA, 19 nt, Homo sapiens
ucacugcugucaacgauga

SEQ ID NO: 73425 - RNA, 19 nt, Homo sapiens
ugacgaaaguggaaaugga

SEQ ID NO: 73426 - RNA, 19 nt, Homo sapiens
cagaaggcauugacucaga

SEQ ID NO: 73427 - RNA, 19 nt, Homo sapiens
gggaguggcucuguaagga

SEQ ID NO: 73428 - RNA, 19 nt, Homo sapiens
acacucagcugcucugcaa

SEQ ID NO: 73429 - RNA, 19 nt, Homo sapiens
ucaaggagaggaagaacua

SEQ ID NO: 73430 - RNA, 19 nt, Homo sapiens
ggaugcacuuucaauauag

SEQ ID NO: 73431 - RNA, 19 nt, Homo sapiens
cugccaaggugaagagaua

SEQ ID NO: 73432 - RNA, 19 nt, Homo sapiens
cgacaaaggguuucucugu

SEQ ID NO: 73433 - RNA, 19 nt, Homo sapiens
gguuaacgccuucauuuau

SEQ ID NO: 73434 - RNA, 19 nt, Homo sapiens
caccucagcuucucaaagu

SEQ ID NO: 73435 - RNA, 19 nt, Homo sapiens
ggacaaacagggaacaaag

SEQ ID NO: 73436 - RNA, 19 nt, Homo sapiens
uauauucagucucugugua

SEQ ID NO: 73437 - RNA, 19 nt, Homo sapiens
gcugagauccugagucaug

SEQ ID NO: 73438 - RNA, 19 nt, Homo sapiens
ggaagggcauuaggagugu

SEQ ID NO: 73439 - RNA, 19 nt, Homo sapiens
cuugaugcuuucuucauua

SEQ ID NO: 73440 - RNA, 19 nt, Homo sapiens
ugacagaacacccaauuca

SEQ ID NO: 73441 - RNA, 19 nt, Homo sapiens
gagccaagaugacacaacu

SEQ ID NO: 73442 - RNA, 19 nt, Homo sapiens
gauccugagucauguguuc

SEQ ID NO: 73443 - RNA, 19 nt, Homo sapiens
caaggaacccauaaagaug

SEQ ID NO: 73444 - RNA, 19 nt, Homo sapiens
caaaacaguuguaccuaaa

SEQ ID NO: 73445 - RNA, 19 nt, Homo sapiens
ccucaaguuucucugcaua

SEQ ID NO: 73446 - RNA, 19 nt, Homo sapiens
gaaagucaaauucauguac

SEQ ID NO: 73447 - RNA, 19 nt, Homo sapiens
ugaacaaccugcucacagu

SEQ ID NO: 73448 - RNA, 19 nt, Homo sapiens
ugaagggaguggcucugua

SEQ ID NO: 73449 - RNA, 19 nt, Homo sapiens
aagcaaagaagggaauuua

SEQ ID NO: 73450 - RNA, 19 nt, Homo sapiens
ggcgagaccuuguuuaaaa

SEQ ID NO: 73451 - RNA, 19 nt, Homo sapiens
gacaaggaacccauaaaga

SEQ ID NO: 73452 - RNA, 19 nt, Homo sapiens
ggagaggaagaacuaguuu

SEQ ID NO: 73453 - RNA, 19 nt, Homo sapiens
ggaauuuauugccucuuuc

SEQ ID NO: 73454 - RNA, 19 nt, Homo sapiens
cuacaggcaugaaauacug

SEQ ID NO: 73455 - RNA, 19 nt, Homo sapiens
aaacgaaucauuggguaua

SEQ ID NO: 73456 - RNA, 19 nt, Homo sapiens
acagaacacccaauucaaa

SEQ ID NO: 73457 - RNA, 19 nt, Homo sapiens
gcaagcagaaacuuuacaa

SEQ ID NO: 73458 - RNA, 19 nt, Homo sapiens
caccucagccucccaagua

SEQ ID NO: 73459 - RNA, 19 nt, Homo sapiens
ucugaaggcuggccaugaa

SEQ ID NO: 73460 - RNA, 19 nt, Homo sapiens
gauagugacaccuccugua

SEQ ID NO: 73461 - RNA, 19 nt, Homo sapiens
ugaaaugaccucccuaagu

SEQ ID NO: 73462 - RNA, 19 nt, Homo sapiens
gaaaccugcucuacgaacu

SEQ ID NO: 73463 - RNA, 19 nt, Homo sapiens
aguggugccugcauuuaua

SEQ ID NO: 73464 - RNA, 19 nt, Homo sapiens
gcauuaggaguguuucauu

SEQ ID NO: 73465 - RNA, 19 nt, Homo sapiens
cagugcauauacacaauaa

SEQ ID NO: 73466 - RNA, 19 nt, Homo sapiens
acaaggaacccauaaagau

SEQ ID NO: 73467 - RNA, 19 nt, Homo sapiens
caaggaagccgagucguau

SEQ ID NO: 73468 - RNA, 19 nt, Homo sapiens
guauuccaguucagauaaa

SEQ ID NO: 73469 - RNA, 19 nt, Homo sapiens
gucaaggaaugaagaacaa

SEQ ID NO: 73470 - RNA, 19 nt, Homo sapiens
uuaggaguguuucauuuga

SEQ ID NO: 73471 - RNA, 19 nt, Homo sapiens
gaggagagaggcuguguca

SEQ ID NO: 73472 - RNA, 19 nt, Homo sapiens
gcacaucuagugaggugaa

SEQ ID NO: 73473 - RNA, 19 nt, Homo sapiens
gcugguauauucagucucu

SEQ ID NO: 73474 - RNA, 19 nt, Homo sapiens
gugcauauacacaauaaug

SEQ ID NO: 73475 - RNA, 19 nt, Homo sapiens
gguauuccaguucagauaa

SEQ ID NO: 73476 - RNA, 19 nt, Homo sapiens
agaggauucuacuuucuuu

SEQ ID NO: 73477 - RNA, 19 nt, Homo sapiens
cggcaaaaccucaucauua

SEQ ID NO: 73478 - RNA, 19 nt, Homo sapiens
gcaaucacggcucacugua

SEQ ID NO: 73479 - RNA, 19 nt, Homo sapiens
gagagaaagcuauccagau

SEQ ID NO: 73480 - RNA, 19 nt, Homo sapiens
gaaugaagaacaacaacuc

SEQ ID NO: 73481 - RNA, 19 nt, Homo sapiens
gugguuaacgccuucauuu

SEQ ID NO: 73482 - RNA, 19 nt, Homo sapiens
gaaaugaccucccuaaguu

SEQ ID NO: 73483 - RNA, 19 nt, Homo sapiens
gaaggcagcugguauauuc

SEQ ID NO: 73484 - RNA, 19 nt, Homo sapiens
uaaggaaggugcucacaua

SEQ ID NO: 73485 - RNA, 19 nt, Homo sapiens
gacaugaucuuccuucuga

SEQ ID NO: 73486 - RNA, 19 nt, Homo sapiens
caaaggguuucucuguuua

SEQ ID NO: 73487 - RNA, 19 nt, Homo sapiens
ggaaggugcucacauagga

SEQ ID NO: 73488 - RNA, 19 nt, Homo sapiens
gaagauugguggagcuuga

SEQ ID NO: 73489 - RNA, 19 nt, Homo sapiens
guuaacgccuucauuuaua

SEQ ID NO: 73490 - RNA, 19 nt, Homo sapiens
gcaaagaagggaauuuauu

SEQ ID NO: 73491 - RNA, 19 nt, Homo sapiens
gaucaugucucacuucaca

SEQ ID NO: 73492 - RNA, 19 nt, Homo sapiens
uggcagaacuccucuauau

SEQ ID NO: 73493 - RNA, 19 nt, Homo sapiens
gugccugcauuuauaauua

SEQ ID NO: 73494 - RNA, 19 nt, Homo sapiens
caaauugacugaagcaaag

SEQ ID NO: 73495 - RNA, 19 nt, Homo sapiens
gcagaacuccucuauauca

SEQ ID NO: 73496 - RNA, 19 nt, Homo sapiens
ggacuacaggcaugaaaua

SEQ ID NO: 73497 - RNA, 19 nt, Homo sapiens
acaaaggguuucucuguuu

SEQ ID NO: 73498 - RNA, 19 nt, Homo sapiens
gggaauuuauugccucuuu

SEQ ID NO: 73499 - RNA, 19 nt, Homo sapiens
caaagaagggaauuuauug

SEQ ID NO: 73500 - RNA, 19 nt, Homo sapiens
gagcuuagauugccucucu

SEQ ID NO: 73501 - RNA, 19 nt, Homo sapiens
uggaugcacuuucaauaua

SEQ ID NO: 73502 - RNA, 19 nt, Homo sapiens
ggagagaggcugugucaga

SEQ ID NO: 73503 - RNA, 19 nt, Homo sapiens
uaccuaaacucuugagaaa

SEQ ID NO: 73504 - RNA, 19 nt, Homo sapiens
gaacuccucuauaucauac

SEQ ID NO: 73505 - RNA, 19 nt, Homo sapiens
acaagaagcuggagaaguc

SEQ ID NO: 73506 - RNA, 19 nt, Homo sapiens
gaagggaguggcucuguaa

SEQ ID NO: 73507 - RNA, 19 nt, Homo sapiens
gagagaggcugugucagaa

SEQ ID NO: 73508 - RNA, 19 nt, Homo sapiens
caacauugguauuccaguu

SEQ ID NO: 73509 - RNA, 19 nt, Homo sapiens
gaacauuucaguugccauu

SEQ ID NO: 73510 - RNA, 19 nt, Homo sapiens
gaaagacucgcuucccaaa

SEQ ID NO: 73511 - RNA, 19 nt, Homo sapiens
gacaaaggguuucucuguu

SEQ ID NO: 73512 - RNA, 19 nt, Homo sapiens
gcaaaacaguuguaccuaa

SEQ ID NO: 73513 - RNA, 19 nt, Homo sapiens
gauccaaaguccugugguu

SEQ ID NO: 73514 - RNA, 19 nt, Homo sapiens
ccauaaagaugcugagauc

SEQ ID NO: 73515 - RNA, 19 nt, Homo sapiens
ccuaaacucuugagaaaca

SEQ ID NO: 73516 - RNA, 19 nt, Homo sapiens
gaacuuaaaggacaugauc

SEQ ID NO: 73517 - RNA, 19 nt, Homo sapiens
acacagaggauucuacuuu

SEQ ID NO: 73518 - RNA, 19 nt, Homo sapiens
gaggaaggcagcugguaua

SEQ ID NO: 73519 - RNA, 19 nt, Homo sapiens
caugaaaucucaaggucaa

SEQ ID NO: 73520 - RNA, 19 nt, Homo sapiens
gaagaacuaguuucccaaa

SEQ ID NO: 73521 - RNA, 19 nt, Homo sapiens
cauuaggaguguuucauuu

SEQ ID NO: 73522 - RNA, 19 nt, Homo sapiens
ugccuaagcuggucucaaa

SEQ ID NO: 73523 - RNA, 19 nt, Homo sapiens
gaggcugacuuccuacuug

SEQ ID NO: 73524 - RNA, 19 nt, Homo sapiens
acaauaaugugacgaaagu

SEQ ID NO: 73525 - RNA, 19 nt, Homo sapiens
uuuacaaccugaugucaua

SEQ ID NO: 73526 - RNA, 19 nt, Homo sapiens
ucacugcugucaacgauga

SEQ ID NO: 73527 - RNA, 19 nt, Homo sapiens
ugacgaaaguggaaaugga

SEQ ID NO: 73528 - RNA, 19 nt, Homo sapiens
cagaaggcauugacucaga

SEQ ID NO: 73529 - RNA, 19 nt, Homo sapiens
gggaguggcucuguaagga

SEQ ID NO: 73530 - RNA, 19 nt, Homo sapiens
acacucagcugcucugcaa

SEQ ID NO: 73531 - RNA, 19 nt, Homo sapiens
ucaaggagaggaagaacua

SEQ ID NO: 73532 - RNA, 19 nt, Homo sapiens
ggaugcacuuucaauauag

SEQ ID NO: 73533 - RNA, 19 nt, Homo sapiens
cugccaaggugaagagaua

SEQ ID NO: 73534 - RNA, 19 nt, Homo sapiens
cgacaaaggguuucucugu

SEQ ID NO: 73535 - RNA, 19 nt, Homo sapiens
gguuaacgccuucauuuau

SEQ ID NO: 73536 - RNA, 19 nt, Homo sapiens
caccucagcuucucaaagu

SEQ ID NO: 73537 - RNA, 19 nt, Homo sapiens
ggacaaacagggaacaaag

SEQ ID NO: 73538 - RNA, 19 nt, Homo sapiens
uauauucagucucugugua

SEQ ID NO: 73539 - RNA, 19 nt, Homo sapiens
gcugagauccugagucaug

SEQ ID NO: 73540 - RNA, 19 nt, Homo sapiens
uaacagagccacaaauggu

SEQ ID NO: 73541 - RNA, 19 nt, Homo sapiens
ggaagggcauuaggagugu

SEQ ID NO: 73542 - RNA, 19 nt, Homo sapiens
cuugaugcuuucuucauua

SEQ ID NO: 73543 - RNA, 19 nt, Homo sapiens
ugacagaacacccaauuca

SEQ ID NO: 73544 - RNA, 19 nt, Homo sapiens
gagccaagaugacacaacu

SEQ ID NO: 73545 - RNA, 19 nt, Homo sapiens
gauccugagucauguguuc

SEQ ID NO: 73546 - RNA, 19 nt, Homo sapiens
caaggaacccauaaagaug

SEQ ID NO: 73547 - RNA, 19 nt, Homo sapiens
caaaacaguuguaccuaaa

SEQ ID NO: 73548 - RNA, 19 nt, Homo sapiens
ccucaaguuucucugcaua

SEQ ID NO: 73549 - RNA, 19 nt, Homo sapiens
gaaagucaaauucauguac

SEQ ID NO: 73550 - RNA, 19 nt, Homo sapiens
ugaacaaccugcucacagu

SEQ ID NO: 73551 - RNA, 19 nt, Homo sapiens
ugaagggaguggcucugua

SEQ ID NO: 73552 - RNA, 19 nt, Homo sapiens
aagcaaagaagggaauuua

SEQ ID NO: 73553 - RNA, 19 nt, Homo sapiens
ggcgagaccuuguuuaaaa

SEQ ID NO: 73554 - RNA, 19 nt, Homo sapiens
gacaaggaacccauaaaga

SEQ ID NO: 73555 - RNA, 19 nt, Homo sapiens
cuaacacucuaaacucuga

SEQ ID NO: 73556 - RNA, 19 nt, Homo sapiens
ggagaggaagaacuaguuu

SEQ ID NO: 73557 - RNA, 19 nt, Homo sapiens
ggaauuuauugccucuuuc

SEQ ID NO: 73558 - RNA, 19 nt, Homo sapiens
cuacaggcaugaaauacug

SEQ ID NO: 73559 - RNA, 19 nt, Homo sapiens
aaacgaaucauuggguaua

SEQ ID NO: 73560 - RNA, 19 nt, Homo sapiens
gguaacagagccacaaaug

SEQ ID NO: 73561 - RNA, 19 nt, Homo sapiens
ucugaaggcuggccaugaa

SEQ ID NO: 73562 - RNA, 19 nt, Homo sapiens
acagaacacccaauucaaa

SEQ ID NO: 73563 - RNA, 19 nt, Homo sapiens
gcaagcagaaacuuuacaa

SEQ ID NO: 73564 - RNA, 19 nt, Homo sapiens
caccucagccucccaagua

SEQ ID NO: 73565 - RNA, 19 nt, Homo sapiens
gagauacagccuuccauau

SEQ ID NO: 73566 - RNA, 19 nt, Homo sapiens
gauagugacaccuccugua

SEQ ID NO: 73567 - RNA, 19 nt, Homo sapiens
guaccuaaacucuugagaa

SEQ ID NO: 73568 - RNA, 19 nt, Homo sapiens
ugaaaugaccucccuaagu

SEQ ID NO: 73569 - RNA, 19 nt, Homo sapiens
gaaaccugcucuacgaacu

SEQ ID NO: 73570 - RNA, 19 nt, Homo sapiens
aguggugccugcauuuaua

SEQ ID NO: 73571 - RNA, 19 nt, Homo sapiens
gcauuaggaguguuucauu

SEQ ID NO: 73572 - RNA, 19 nt, Homo sapiens
cagugcauauacacaauaa

SEQ ID NO: 73573 - RNA, 19 nt, Homo sapiens
acaaggaacccauaaagau

SEQ ID NO: 73574 - RNA, 19 nt, Homo sapiens
caaggaagccgagucguau

SEQ ID NO: 73575 - RNA, 19 nt, Homo sapiens
guauuccaguucagauaaa

SEQ ID NO: 73576 - RNA, 19 nt, Homo sapiens
gucaaggaaugaagaacaa

SEQ ID NO: 73577 - RNA, 19 nt, Homo sapiens
uuaggaguguuucauuuga

SEQ ID NO: 73578 - RNA, 19 nt, Homo sapiens
gaggagagaggcuguguca

SEQ ID NO: 73579 - RNA, 19 nt, Homo sapiens
agaggauucuacuuucuuu

SEQ ID NO: 73580 - RNA, 19 nt, Homo sapiens
gcacaucuagugaggugaa

SEQ ID NO: 73581 - RNA, 19 nt, Homo sapiens
gcugguauauucagucucu

SEQ ID NO: 73582 - RNA, 19 nt, Homo sapiens
gcaaagaacuacaagaaug

SEQ ID NO: 73583 - RNA, 19 nt, Homo sapiens
caaagaagcugacccugaa

SEQ ID NO: 73584 - RNA, 19 nt, Homo sapiens
gcaaucacuuguuaaugua

SEQ ID NO: 73585 - RNA, 19 nt, Homo sapiens
gcaaagacucagagcauua

SEQ ID NO: 73586 - RNA, 19 nt, Homo sapiens
ggauggaaauggacgauga

SEQ ID NO: 73587 - RNA, 19 nt, Homo sapiens
ucucagcaaucacuuguua

SEQ ID NO: 73588 - RNA, 19 nt, Homo sapiens
ggaugcagcugaggaguuu

SEQ ID NO: 73589 - RNA, 19 nt, Homo sapiens
acaagaauguguucaagaa

SEQ ID NO: 73590 - RNA, 19 nt, Homo sapiens
gaaacuaggccuaacugaa

SEQ ID NO: 73591 - RNA, 19 nt, Homo sapiens
gaugaugacuaguugcuau

SEQ ID NO: 73592 - RNA, 19 nt, Homo sapiens
ugacaaggccucacaaaga

SEQ ID NO: 73593 - RNA, 19 nt, Homo sapiens
ugaguacgauggcgaguuu

SEQ ID NO: 73594 - RNA, 19 nt, Homo sapiens
ucccauaacuuacuuguau

SEQ ID NO: 73595 - RNA, 19 nt, Homo sapiens
ggaauugauugaaggugaa

SEQ ID NO: 73596 - RNA, 19 nt, Homo sapiens
gaagggagaauacuguguu

SEQ ID NO: 73597 - RNA, 19 nt, Homo sapiens
ccagcucucucuuaucuga

SEQ ID NO: 73598 - RNA, 19 nt, Homo sapiens
aagaggagauugucaacuu

SEQ ID NO: 73599 - RNA, 19 nt, Homo sapiens
agaauguguucaagaagua

SEQ ID NO: 73600 - RNA, 19 nt, Homo sapiens
ucucuaauccuguaucuuu

SEQ ID NO: 73601 - RNA, 19 nt, Homo sapiens
ucucuuaucugacuucugu

SEQ ID NO: 73602 - RNA, 19 nt, Homo sapiens
gauagcguauggauggaaa

SEQ ID NO: 73603 - RNA, 19 nt, Homo sapiens
ggacuucccugaguacgau

SEQ ID NO: 73604 - RNA, 19 nt, Homo sapiens
gauugacccugaugacuuc

SEQ ID NO: 73605 - RNA, 19 nt, Homo sapiens
ggccagcucucucuuaucu

SEQ ID NO: 73606 - RNA, 19 nt, Homo sapiens
gaucaacccugaggaaacu

SEQ ID NO: 73607 - RNA, 19 nt, Homo sapiens
uaacugaaguggacagcau

SEQ ID NO: 73608 - RNA, 19 nt, Homo sapiens
gagcaaagacucagagcau

SEQ ID NO: 73609 - RNA, 19 nt, Homo sapiens
ggacagcauguauguauuc

SEQ ID NO: 73610 - RNA, 19 nt, Homo sapiens
ggaguuagcagcccaaguc

SEQ ID NO: 73611 - RNA, 19 nt, Homo sapiens
gaaugagauugauuucuac

SEQ ID NO: 73612 - RNA, 19 nt, Homo sapiens
acagcaagguggcaaagaa

SEQ ID NO: 73613 - RNA, 19 nt, Homo sapiens
aaauaggagucgucaaugu

SEQ ID NO: 73614 - RNA, 19 nt, Homo sapiens
ggagaucaacccugaggaa

SEQ ID NO: 73615 - RNA, 19 nt, Homo sapiens
uuacaaagccuucgaggau

SEQ ID NO: 73616 - RNA, 19 nt, Homo sapiens
cagcauguauguauucaag

SEQ ID NO: 73617 - RNA, 19 nt, Homo sapiens
gacaaggccucacaaagac

SEQ ID NO: 73618 - RNA, 19 nt, Homo sapiens
caaagaacuacaagaaugu

SEQ ID NO: 73619 - RNA, 19 nt, Homo sapiens
gacuguaucucagcaauca

SEQ ID NO: 73620 - RNA, 19 nt, Homo sapiens
ggagaagacguuugacauc

SEQ ID NO: 73621 - RNA, 19 nt, Homo sapiens
ggauugacccugaugacuu

SEQ ID NO: 73622 - RNA, 19 nt, Homo sapiens
caaacucauuggcuacuuc

SEQ ID NO: 73623 - RNA, 19 nt, Homo sapiens
uugagaauauugaggauga

SEQ ID NO: 73624 - RNA, 19 nt, Homo sapiens
uagaggacccuguggaauu

SEQ ID NO: 73625 - RNA, 19 nt, Homo sapiens
gaaguggacagcauguaug

SEQ ID NO: 73626 - RNA, 19 nt, Homo sapiens
agcaaucacuuguuaaugu

SEQ ID NO: 73627 - RNA, 19 nt, Homo sapiens
gaaggaagggagaauacug

SEQ ID NO: 73628 - RNA, 19 nt, Homo sapiens
uccauacucuuucuuguga

SEQ ID NO: 73629 - RNA, 19 nt, Homo sapiens
gcguauggauggaaaugga

SEQ ID NO: 73630 - RNA, 19 nt, Homo sapiens
aagcugauccugaugguuu

SEQ ID NO: 73631 - RNA, 19 nt, Homo sapiens
gggcuggacuucccugagu

SEQ ID NO: 73632 - RNA, 19 nt, Homo sapiens
aaacuaggccuaacugaag

SEQ ID NO: 73633 - RNA, 19 nt, Homo sapiens
aaagacaauuugagaugga

SEQ ID NO: 73634 - RNA, 19 nt, Homo sapiens
acaaauaggagucgucaau

SEQ ID NO: 73635 - RNA, 19 nt, Homo sapiens
ucaaggcuguggcccaaga

SEQ ID NO: 73636 - RNA, 19 nt, Homo sapiens
cuacgaggccuucauggaa

SEQ ID NO: 73637 - RNA, 19 nt, Homo sapiens
ccacugcucugggccauuc

SEQ ID NO: 73638 - RNA, 19 nt, Homo sapiens
ggaguuucaucccuacauc

SEQ ID NO: 73639 - RNA, 19 nt, Homo sapiens
guuagcagcccaaguccua

SEQ ID NO: 73640 - RNA, 19 nt, Homo sapiens
cauacucuuucuugugauu

SEQ ID NO: 73641 - RNA, 19 nt, Homo sapiens
gaagcugaaugagauugau

SEQ ID NO: 73642 - RNA, 19 nt, Homo sapiens
agaggacccuguggaauug

SEQ ID NO: 73643 - RNA, 19 nt, Homo sapiens
gcacuccucuaccaugaac

SEQ ID NO: 73644 - RNA, 19 nt, Homo sapiens
caggccagcucucucuuau

SEQ ID NO: 73645 - RNA, 19 nt, Homo sapiens
ugaucaaugucaaugcaaa

SEQ ID NO: 73646 - RNA, 19 nt, Homo sapiens
ugaugaugaugacuaguug

SEQ ID NO: 73647 - RNA, 19 nt, Homo sapiens
gaugacaaggccucacaaa

SEQ ID NO: 73648 - RNA, 19 nt, Homo sapiens
ccagaaggaagggagaaua

SEQ ID NO: 73649 - RNA, 19 nt, Homo sapiens
gagaucaacccugaggaaa

SEQ ID NO: 73650 - RNA, 19 nt, Homo sapiens
guggacagcauguauguau

SEQ ID NO: 73651 - RNA, 19 nt, Homo sapiens
gguagacucugagaaggau

SEQ ID NO: 73652 - RNA, 19 nt, Homo sapiens
aagaauguguucaagaagu

SEQ ID NO: 73653 - RNA, 19 nt, Homo sapiens
ccagggagacuagguuauu

SEQ ID NO: 73654 - RNA, 19 nt, Homo sapiens
cgaugacgaugaugaugau

SEQ ID NO: 73655 - RNA, 19 nt, Homo sapiens
aaacugaagccggagagua

SEQ ID NO: 73656 - RNA, 19 nt, Homo sapiens
gcgaagaggagauugucaa

SEQ ID NO: 73657 - RNA, 19 nt, Homo sapiens
ggacgaugacgaugaugau

SEQ ID NO: 73658 - RNA, 19 nt, Homo sapiens
auaggagucgucaauguua

SEQ ID NO: 73659 - RNA, 19 nt, Homo sapiens
ggaagcugauccugauggu

SEQ ID NO: 73660 - RNA, 19 nt, Homo sapiens
agacucagagcauuacaaa

SEQ ID NO: 73661 - RNA, 19 nt, Homo sapiens
gaauauugaggaugagauc

SEQ ID NO: 73662 - RNA, 19 nt, Homo sapiens
gcaggcguuugagaauauu

SEQ ID NO: 73663 - RNA, 19 nt, Homo sapiens
cugcaggcguuugagaaua

SEQ ID NO: 73664 - RNA, 19 nt, Homo sapiens
ccaggccagcucucucuua

SEQ ID NO: 73665 - RNA, 19 nt, Homo sapiens
uuaugugucucuuccauca

SEQ ID NO: 73666 - RNA, 19 nt, Homo sapiens
ugacuucuguuucuuaucc

SEQ ID NO: 73667 - RNA, 19 nt, Homo sapiens
gggagaagacguuugacau

SEQ ID NO: 73668 - RNA, 19 nt, Homo sapiens
ggcccaagauaacacugaa

SEQ ID NO: 73669 - RNA, 19 nt, Homo sapiens
gccaagaaacuaggccuaa

SEQ ID NO: 73670 - RNA, 19 nt, Homo sapiens
gagcugauccuggaguuag

SEQ ID NO: 73671 - RNA, 19 nt, Homo sapiens
caaugucaaugcaaagaac

SEQ ID NO: 73672 - RNA, 19 nt, Homo sapiens
cuacaagaauguguucaag

SEQ ID NO: 73673 - RNA, 19 nt, Homo sapiens
cgaugaugaugaugacuag

SEQ ID NO: 73674 - RNA, 19 nt, Homo sapiens
caaauaggagucgucaaug

SEQ ID NO: 73675 - RNA, 19 nt, Homo sapiens
ugaaguggacagcauguau

SEQ ID NO: 73676 - RNA, 19 nt, Homo sapiens
gggagaauacuguguuugg

SEQ ID NO: 73677 - RNA, 19 nt, Homo sapiens
aagggagaauacuguguuu

SEQ ID NO: 73678 - RNA, 19 nt, Homo sapiens
ugauucuccucuagccaua

SEQ ID NO: 73679 - RNA, 19 nt, Homo sapiens
gaggagcacaggagaucaa

SEQ ID NO: 73680 - RNA, 19 nt, Homo sapiens
cagcccaaguccuagaaga

SEQ ID NO: 73681 - RNA, 19 nt, Homo sapiens
gggacuguaucucagcaau

SEQ ID NO: 73682 - RNA, 19 nt, Homo sapiens
gaagagaacucacuuguuu

SEQ ID NO: 73683 - RNA, 19 nt, Homo sapiens
gaagacacaugauuaauga

SEQ ID NO: 73684 - RNA, 19 nt, Homo sapiens
caacaaaccuuacacagaa

SEQ ID NO: 73685 - RNA, 19 nt, Homo sapiens
ggagaagacuuucaagauu

SEQ ID NO: 73686 - RNA, 19 nt, Homo sapiens
gaaggaagccuguauauuc

SEQ ID NO: 73687 - RNA, 19 nt, Homo sapiens
gagaagacuuucaagauug

SEQ ID NO: 73688 - RNA, 19 nt, Homo sapiens
ggagagggcuugaaaugug

SEQ ID NO: 73689 - RNA, 19 nt, Homo sapiens
ggaagccuguauauucuua

SEQ ID NO: 73690 - RNA, 19 nt, Homo sapiens
gauaaacacugaagaugau

SEQ ID NO: 73691 - RNA, 19 nt, Homo sapiens
ugaaugagguugacuucua

SEQ ID NO: 73692 - RNA, 19 nt, Homo sapiens
guaagacacugugcaaauu

SEQ ID NO: 73693 - RNA, 19 nt, Homo sapiens
ugauuuagcucccuccaua

SEQ ID NO: 73694 - RNA, 19 nt, Homo sapiens
gaacucacuuguuuauugu

SEQ ID NO: 73695 - RNA, 19 nt, Homo sapiens
ugaaagaaaucgugcuuga

SEQ ID NO: 73696 - RNA, 19 nt, Homo sapiens
gaagaaggaagccuguaua

SEQ ID NO: 73697 - RNA, 19 nt, Homo sapiens
gcaaaugccuuuucaaaug

SEQ ID NO: 73698 - RNA, 19 nt, Homo sapiens
cuugguagauuuaguguua

SEQ ID NO: 73699 - RNA, 19 nt, Homo sapiens
gaaugagguugacuucuau

SEQ ID NO: 73700 - RNA, 19 nt, Homo sapiens
gaugguggaugccaagaaa

SEQ ID NO: 73701 - RNA, 19 nt, Homo sapiens
ggaagacacaugauuaaug

SEQ ID NO: 73702 - RNA, 19 nt, Homo sapiens
uaagggugaucgcacaaua

SEQ ID NO: 73703 - RNA, 19 nt, Homo sapiens
cagauaaggucacgccaaa

SEQ ID NO: 73704 - RNA, 19 nt, Homo sapiens
agaacucacuuguuuauug

SEQ ID NO: 73705 - RNA, 19 nt, Homo sapiens
gagccggugucuucagaua

SEQ ID NO: 73706 - RNA, 19 nt, Homo sapiens
caacaaggccucuaacagu

SEQ ID NO: 73707 - RNA, 19 nt, Homo sapiens
caagugauggucauucaua

SEQ ID NO: 73708 - RNA, 19 nt, Homo sapiens
cuagugagccuucccauuu

SEQ ID NO: 73709 - RNA, 19 nt, Homo sapiens
gauuugcucucuaaacuuc

SEQ ID NO: 73710 - RNA, 19 nt, Homo sapiens
ggaagcaaacuuauaaauc

SEQ ID NO: 73711 - RNA, 19 nt, Homo sapiens
aagaggagcugguggaguu

SEQ ID NO: 73712 - RNA, 19 nt, Homo sapiens
gaacgagaaacccaaaguu

SEQ ID NO: 73713 - RNA, 19 nt, Homo sapiens
uggcaagucucacauauuc

SEQ ID NO: 73714 - RNA, 19 nt, Homo sapiens
uaucaguacucccacaauu

SEQ ID NO: 73715 - RNA, 19 nt, Homo sapiens
uagugagccuucccauuua

SEQ ID NO: 73716 - RNA, 19 nt, Homo sapiens
ccaaacaauucugaugaaa

SEQ ID NO: 73717 - RNA, 19 nt, Homo sapiens
uaauuggaguucauacuga

SEQ ID NO: 73718 - RNA, 19 nt, Homo sapiens
cuacaaggcuuuugaagaa

SEQ ID NO: 73719 - RNA, 19 nt, Homo sapiens
cagggaagacacaugauua

SEQ ID NO: 73720 - RNA, 19 nt, Homo sapiens
ugacgaugaugaugaauag

SEQ ID NO: 73721 - RNA, 19 nt, Homo sapiens
gcuaacuaauucugucauu

SEQ ID NO: 73722 - RNA, 19 nt, Homo sapiens
caccaucauuucuaguaua

SEQ ID NO: 73723 - RNA, 19 nt, Homo sapiens
ugacuucuaugagccauuu

SEQ ID NO: 73724 - RNA, 19 nt, Homo sapiens
ccucuuggaucuaauugaa

SEQ ID NO: 73725 - RNA, 19 nt, Homo sapiens
ucucuaaacuucccucuag

SEQ ID NO: 73726 - RNA, 19 nt, Homo sapiens
gggagaagacuuucaagau

SEQ ID NO: 73727 - RNA, 19 nt, Homo sapiens
gaucgacccggacgacuuu

SEQ ID NO: 73728 - RNA, 19 nt, Homo sapiens
aaacaugggaagaugauuu

SEQ ID NO: 73729 - RNA, 19 nt, Homo sapiens
ccaacaaaccuuacacaga

SEQ ID NO: 73730 - RNA, 19 nt, Homo sapiens
ugaagaugaugaugaagau

SEQ ID NO: 73731 - RNA, 19 nt, Homo sapiens
guuugcagcugaugucuug

SEQ ID NO: 73732 - RNA, 19 nt, Homo sapiens
uguuaagugugcaguauaa

SEQ ID NO: 73733 - RNA, 19 nt, Homo sapiens
gcucagccuuggaagcaaa

SEQ ID NO: 73734 - RNA, 19 nt, Homo sapiens
cuggaaagauaaacacuga

SEQ ID NO: 73735 - RNA, 19 nt, Homo sapiens
uaagacacugugcaaauuu

SEQ ID NO: 73736 - RNA, 19 nt, Homo sapiens
gagagggcuugaaaugugu

SEQ ID NO: 73737 - RNA, 19 nt, Homo sapiens
guucuuugcuggaccauca

SEQ ID NO: 73738 - RNA, 19 nt, Homo sapiens
gaaagauaaacacugaaga

SEQ ID NO: 73739 - RNA, 19 nt, Homo sapiens
ugaugaagaugaugaugau

SEQ ID NO: 73740 - RNA, 19 nt, Homo sapiens
agaguuugauggcgaguuu

SEQ ID NO: 73741 - RNA, 19 nt, Homo sapiens
ccagguccuugaacauaaa

SEQ ID NO: 73742 - RNA, 19 nt, Homo sapiens
guggaauacuagcuaacua

SEQ ID NO: 73743 - RNA, 19 nt, Homo sapiens
acuaugaacuuggauauuc

SEQ ID NO: 73744 - RNA, 19 nt, Homo sapiens
ggauaaugaugacagugau

SEQ ID NO: 73745 - RNA, 19 nt, Homo sapiens
gaugauaauucugaugaag

SEQ ID NO: 73746 - RNA, 19 nt, Homo sapiens
ggaaagauaaacacugaag

SEQ ID NO: 73747 - RNA, 19 nt, Homo sapiens
gaguuccucuuggaucuaa

SEQ ID NO: 73748 - RNA, 19 nt, Homo sapiens
gaugggagguugauuugcu

SEQ ID NO: 73749 - RNA, 19 nt, Homo sapiens
ugaugacgaugaugaugaa

SEQ ID NO: 73750 - RNA, 19 nt, Homo sapiens
ugacagugaugacgaugau

SEQ ID NO: 73751 - RNA, 19 nt, Homo sapiens
ggccagggcaacaauaauu

SEQ ID NO: 73752 - RNA, 19 nt, Homo sapiens
cuccauaccucgaacauca

SEQ ID NO: 73753 - RNA, 19 nt, Homo sapiens
ucacagaugcugacagugu

SEQ ID NO: 73754 - RNA, 19 nt, Homo sapiens
ggacucagaauacuacaag

SEQ ID NO: 73755 - RNA, 19 nt, Homo sapiens
gaagacuacaucaaacuca

SEQ ID NO: 73756 - RNA, 19 nt, Homo sapiens
gagguugauuugcucucua

SEQ ID NO: 73757 - RNA, 19 nt, Homo sapiens
gcagcaaucccacuuagca

SEQ ID NO: 73758 - RNA, 19 nt, Homo sapiens
ugaagaugaugaugaugau

SEQ ID NO: 73759 - RNA, 19 nt, Homo sapiens
ccagaagaaauguuugaaa

SEQ ID NO: 73760 - RNA, 19 nt, Homo sapiens
gaagaugaaugagguugac

SEQ ID NO: 73761 - RNA, 19 nt, Homo sapiens
caaagggguugcaaagaaa

SEQ ID NO: 73762 - RNA, 19 nt, Homo sapiens
cugaacacuuccagccuua

SEQ ID NO: 73763 - RNA, 19 nt, Homo sapiens
ucaagcagguuuuaaagaa

SEQ ID NO: 73764 - RNA, 19 nt, Homo sapiens
cacugaagaugaugaugaa

SEQ ID NO: 73765 - RNA, 19 nt, Homo sapiens
gaggaugugcuuucuggaa

SEQ ID NO: 73766 - RNA, 19 nt, Homo sapiens
gggaagaugauuugaaugg

SEQ ID NO: 73767 - RNA, 19 nt, Homo sapiens
gcccagguccuugaacaua

SEQ ID NO: 73768 - RNA, 19 nt, Homo sapiens
ggaauacuagcuaacuaau

SEQ ID NO: 73769 - RNA, 19 nt, Homo sapiens
ggguucaugucucugauug

SEQ ID NO: 73770 - RNA, 19 nt, Homo sapiens
gcaagucucacauauucau

SEQ ID NO: 73771 - RNA, 19 nt, Homo sapiens
gagaagagugauccagaug

SEQ ID NO: 73772 - RNA, 19 nt, Homo sapiens
agaaauaugacuugcuuug

SEQ ID NO: 73773 - RNA, 19 nt, Homo sapiens
ugggucagcuggcuuccua

SEQ ID NO: 73774 - RNA, 19 nt, Homo sapiens
agauaaacacugaagauga

SEQ ID NO: 73775 - RNA, 19 nt, Homo sapiens
cccagguccuugaacauaa

SEQ ID NO: 73776 - RNA, 19 nt, Homo sapiens
gggaaggaccgagugguaa

SEQ ID NO: 73777 - RNA, 19 nt, Homo sapiens
guuggcaagucucacauau

SEQ ID NO: 73778 - RNA, 19 nt, Homo sapiens
ucucauggcuuuguuaaac

SEQ ID NO: 73779 - RNA, 19 nt, Homo sapiens
cuuggaagcaaacuuauaa

SEQ ID NO: 73780 - RNA, 19 nt, Homo sapiens
gcagcaucauucagcaaau

SEQ ID NO: 73781 - RNA, 19 nt, Homo sapiens
caacuccaaacaauucuga

SEQ ID NO: 73782 - RNA, 19 nt, Homo sapiens
gaaaguggcgacagguuua

SEQ ID NO: 73783 - RNA, 19 nt, Homo sapiens
gaaacggacuuagaucuga

SEQ ID NO: 73784 - RNA, 19 nt, Homo sapiens
ucacagagcuuugucauca

SEQ ID NO: 73785 - RNA, 19 nt, Homo sapiens
ggaggacccugaagaguug

SEQ ID NO: 73786 - RNA, 19 nt, Homo sapiens
ggaaacaggucugcaagga

SEQ ID NO: 73787 - RNA, 19 nt, Homo sapiens
uuaaggaagucggguauua

SEQ ID NO: 73788 - RNA, 19 nt, Homo sapiens
gcagaaccauggcauuuua

SEQ ID NO: 73789 - RNA, 19 nt, Homo sapiens
ucaaggaccacccacauua

SEQ ID NO: 73790 - RNA, 19 nt, Homo sapiens
ggaagucuguccacaaugg

SEQ ID NO: 73791 - RNA, 19 nt, Homo sapiens
gaacucaucucccaguacu

SEQ ID NO: 73792 - RNA, 19 nt, Homo sapiens
gcccacgccuugcaagaua

SEQ ID NO: 73793 - RNA, 19 nt, Homo sapiens
ccaaggagaucgaguuucu

SEQ ID NO: 73794 - RNA, 19 nt, Homo sapiens
ccaguacucugaugaggaa

SEQ ID NO: 73795 - RNA, 19 nt, Homo sapiens
uggcagacaucaucgagua

SEQ ID NO: 73796 - RNA, 19 nt, Homo sapiens
caucuuaaaugacagugaa

SEQ ID NO: 73797 - RNA, 19 nt, Homo sapiens
caacaagaucuacaucauu

SEQ ID NO: 73798 - RNA, 19 nt, Homo sapiens
gugcagacaucaagaaagu

SEQ ID NO: 73799 - RNA, 19 nt, Homo sapiens
gcacauucccucuacgauu

SEQ ID NO: 73800 - RNA, 19 nt, Homo sapiens
uaaucaaucuguagacaug

SEQ ID NO: 73801 - RNA, 19 nt, Homo sapiens
gaagaagggauaauagaca

SEQ ID NO: 73802 - RNA, 19 nt, Homo sapiens
gaaccacaccuccugcauu

SEQ ID NO: 73803 - RNA, 19 nt, Homo sapiens
cagcaccuauggcaaguuu

SEQ ID NO: 73804 - RNA, 19 nt, Homo sapiens
ucugagaggucacgaagaa

SEQ ID NO: 73805 - RNA, 19 nt, Homo sapiens
gcagaaauggagauucaaa

SEQ ID NO: 73806 - RNA, 19 nt, Homo sapiens
guuacaggcuaugauauuu

SEQ ID NO: 73807 - RNA, 19 nt, Homo sapiens
caccacgucuucuauuauu

SEQ ID NO: 73808 - RNA, 19 nt, Homo sapiens
gguggaggcagcacuguua

SEQ ID NO: 73809 - RNA, 19 nt, Homo sapiens
gaacugggugggcacaauu

SEQ ID NO: 73810 - RNA, 19 nt, Homo sapiens
ggaggccucugcaugaugu

SEQ ID NO: 73811 - RNA, 19 nt, Homo sapiens
caacgucuaugccaagaag

SEQ ID NO: 73812 - RNA, 19 nt, Homo sapiens
gcagacaucaagaaaguug

SEQ ID NO: 73813 - RNA, 19 nt, Homo sapiens
uuacggauauccuacaaug

SEQ ID NO: 73814 - RNA, 19 nt, Homo sapiens
cacauucccucuacgauug

SEQ ID NO: 73815 - RNA, 19 nt, Homo sapiens
uggaauguaucagguauaa

SEQ ID NO: 73816 - RNA, 19 nt, Homo sapiens
gaucugaccguccaggaaa

SEQ ID NO: 73817 - RNA, 19 nt, Homo sapiens
gagcccaccugcugcuuug

SEQ ID NO: 73818 - RNA, 19 nt, Homo sapiens
uuacacgcauuuacggaua

SEQ ID NO: 73819 - RNA, 19 nt, Homo sapiens
caggaagucuguccacaau

SEQ ID NO: 73820 - RNA, 19 nt, Homo sapiens
aacaagaucuacaucauuc

SEQ ID NO: 73821 - RNA, 19 nt, Homo sapiens
caacagcgaagacccauuc

SEQ ID NO: 73822 - RNA, 19 nt, Homo sapiens
gaugacuucugguccaaug

SEQ ID NO: 73823 - RNA, 19 nt, Homo sapiens
gggaauuccugaagaaggu

SEQ ID NO: 73824 - RNA, 19 nt, Homo sapiens
ucaacaagaucuacaucau

SEQ ID NO: 73825 - RNA, 19 nt, Homo sapiens
aggaagagauccagcaugu

SEQ ID NO: 73826 - RNA, 19 nt, Homo sapiens
cagacaucaucgaguauuu

SEQ ID NO: 73827 - RNA, 19 nt, Homo sapiens
aacaccacgucuucuauua

SEQ ID NO: 73828 - RNA, 19 nt, Homo sapiens
ugaggaagaagggauaaua

SEQ ID NO: 73829 - RNA, 19 nt, Homo sapiens
ggaaggagggagcuguuug

SEQ ID NO: 73830 - RNA, 19 nt, Homo sapiens
aaccacaccuccugcauug

SEQ ID NO: 73831 - RNA, 19 nt, Homo sapiens
ggaguauagugaugagaca

SEQ ID NO: 73832 - RNA, 19 nt, Homo sapiens
ccaagaaggugcaaaagga

SEQ ID NO: 73833 - RNA, 19 nt, Homo sapiens
gcacaauugcagcugauga

SEQ ID NO: 73834 - RNA, 19 nt, Homo sapiens
ggaacugggugggcacaau

SEQ ID NO: 73835 - RNA, 19 nt, Homo sapiens
ucaaacaccacgucuucua

SEQ ID NO: 73836 - RNA, 19 nt, Homo sapiens
ggaaacggacuuagaucug

SEQ ID NO: 73837 - RNA, 19 nt, Homo sapiens
gcaccuucaugcagauugu

SEQ ID NO: 73838 - RNA, 19 nt, Homo sapiens
uaacugccaccuccaagaa

SEQ ID NO: 73839 - RNA, 19 nt, Homo sapiens
ggagaaugcagagagguuu

SEQ ID NO: 73840 - RNA, 19 nt, Homo sapiens
gcaagcagaaggucaucuu

SEQ ID NO: 73841 - RNA, 19 nt, Homo sapiens
caacacacccauugucaag

SEQ ID NO: 73842 - RNA, 19 nt, Homo sapiens
ccuacggcaucuaaacuuu

SEQ ID NO: 73843 - RNA, 19 nt, Homo sapiens
gguuacaggcuaugauauu

SEQ ID NO: 73844 - RNA, 19 nt, Homo sapiens
aggcagaaauggagauuca

SEQ ID NO: 73845 - RNA, 19 nt, Homo sapiens
ggaagcugccggagaacuu

SEQ ID NO: 73846 - RNA, 19 nt, Homo sapiens
gcagacuccucagcaacaa

SEQ ID NO: 73847 - RNA, 19 nt, Homo sapiens
gucacaccaucuuaaauga

SEQ ID NO: 73848 - RNA, 19 nt, Homo sapiens
gcagacaucaucgaguauu

SEQ ID NO: 73849 - RNA, 19 nt, Homo sapiens
gccaucugcuucuucuuug

SEQ ID NO: 73850 - RNA, 19 nt, Homo sapiens
guaacaagugcccagauga

SEQ ID NO: 73851 - RNA, 19 nt, Homo sapiens
gccagugccuguaacaagu

SEQ ID NO: 73852 - RNA, 19 nt, Homo sapiens
ggcgacagguuuagcaaca

SEQ ID NO: 73853 - RNA, 19 nt, Homo sapiens
gggaagaaacauuuaacug

SEQ ID NO: 73854 - RNA, 19 nt, Homo sapiens
cggagucuguggaauguau

SEQ ID NO: 73855 - RNA, 19 nt, Homo sapiens
caaacaccacgucuucuau

SEQ ID NO: 73856 - RNA, 19 nt, Homo sapiens
gaggaagaagggauaauag

SEQ ID NO: 73857 - RNA, 19 nt, Homo sapiens
caccgcagcucacgcuuuc

SEQ ID NO: 73858 - RNA, 19 nt, Homo sapiens
gcaccgcagcucacgcuuu

SEQ ID NO: 73859 - RNA, 19 nt, Homo sapiens
cuacaucauucucuucaag

SEQ ID NO: 73860 - RNA, 19 nt, Homo sapiens
gcaccuauggcaaguuugu

SEQ ID NO: 73861 - RNA, 19 nt, Homo sapiens
gcaacacacccauugucaa

SEQ ID NO: 73862 - RNA, 19 nt, Homo sapiens
ugaccugagucuugcagaa

SEQ ID NO: 73863 - RNA, 19 nt, Homo sapiens
ggauacaggauauuugaca

SEQ ID NO: 73864 - RNA, 19 nt, Homo sapiens
ggaagaagggauaauagac

SEQ ID NO: 73865 - RNA, 19 nt, Homo sapiens
uguaacaagugcccagaug

SEQ ID NO: 73866 - RNA, 19 nt, Homo sapiens
gaggugcccuucuccaacu

SEQ ID NO: 73867 - RNA, 19 nt, Homo sapiens
gugaacucaucucccagua

SEQ ID NO: 73868 - RNA, 19 nt, Homo sapiens
gagaggaagcugaggaaag

SEQ ID NO: 73869 - RNA, 19 nt, Homo sapiens
gcgugcaucuucuucaaca

SEQ ID NO: 73870 - RNA, 19 nt, Homo sapiens
ccaggaaagggaucauuga

SEQ ID NO: 73871 - RNA, 19 nt, Homo sapiens
gaacuauuccaucaucaac

SEQ ID NO: 73872 - RNA, 19 nt, Homo sapiens
aaacaccacgucuucuauu

SEQ ID NO: 73873 - RNA, 19 nt, Homo sapiens
acaggaggccucugcauga

SEQ ID NO: 73874 - RNA, 19 nt, Homo sapiens
agaggaagcugaggaaagg

SEQ ID NO: 73875 - RNA, 19 nt, Homo sapiens
ggauaauagacacaucaaa

SEQ ID NO: 73876 - RNA, 19 nt, Homo sapiens
gaaggcagaaauggagauu

SEQ ID NO: 73877 - RNA, 19 nt, Homo sapiens
ccagcagacuccucagcaa

SEQ ID NO: 73878 - RNA, 19 nt, Homo sapiens
acagugaauugacccaugu

SEQ ID NO: 73879 - RNA, 19 nt, Homo sapiens
gaauuuagucacaccaucu

SEQ ID NO: 73880 - RNA, 19 nt, Homo sapiens
cagaaaacguagugaauuc

SEQ ID NO: 73881 - RNA, 19 nt, Homo sapiens
gacccgacaccagccauua

SEQ ID NO: 73882 - RNA, 19 nt, Homo sapiens
cgucauggcuuaauguuua

SEQ ID NO: 73883 - RNA, 19 nt, Homo sapiens
ggagacaaacuuaauguua

SEQ ID NO: 73884 - RNA, 19 nt, Homo sapiens
gaaggcaaguuucuagcua

SEQ ID NO: 73885 - RNA, 19 nt, Homo sapiens
cacaugacauuaccaaaua

SEQ ID NO: 73886 - RNA, 19 nt, Homo sapiens
gcacugauuucacaacaga

SEQ ID NO: 73887 - RNA, 19 nt, Homo sapiens
caucagggaucccauauug

SEQ ID NO: 73888 - RNA, 19 nt, Homo sapiens
gagcacagcauccaauauu

SEQ ID NO: 73889 - RNA, 19 nt, Homo sapiens
ggaauccaguuaauuacuu

SEQ ID NO: 73890 - RNA, 19 nt, Homo sapiens
ggaaacgucugugugagaa

SEQ ID NO: 73891 - RNA, 19 nt, Homo sapiens
ggaggcaguuuauugcaaa

SEQ ID NO: 73892 - RNA, 19 nt, Homo sapiens
ggacaucgccacaugaaug

SEQ ID NO: 73893 - RNA, 19 nt, Homo sapiens
gaagaaagcggucaagaac

SEQ ID NO: 73894 - RNA, 19 nt, Homo sapiens
ggacccaauuaucuucaua

SEQ ID NO: 73895 - RNA, 19 nt, Homo sapiens
gaugaucuacucagaaauu

SEQ ID NO: 73896 - RNA, 19 nt, Homo sapiens
agaaagcggucaagaacuu

SEQ ID NO: 73897 - RNA, 19 nt, Homo sapiens
ccugaaggaugcacaaauu

SEQ ID NO: 73898 - RNA, 19 nt, Homo sapiens
gaagaugcggcgagacuuu

SEQ ID NO: 73899 - RNA, 19 nt, Homo sapiens
ggagaaggcaaaucuguga

SEQ ID NO: 73900 - RNA, 19 nt, Homo sapiens
ccacaugaauggauaugga

SEQ ID NO: 73901 - RNA, 19 nt, Homo sapiens
gaauggauauggaucacau

SEQ ID NO: 73902 - RNA, 19 nt, Homo sapiens
uaacugggaucucguugga

SEQ ID NO: 73903 - RNA, 19 nt, Homo sapiens
aaagagaaauccucagaca

SEQ ID NO: 73904 - RNA, 19 nt, Homo sapiens
ccucauggccuauuauauu

SEQ ID NO: 73905 - RNA, 19 nt, Homo sapiens
gcagugucaucagaagaua

SEQ ID NO: 73906 - RNA, 19 nt, Homo sapiens
cucauggccuauuauauua

SEQ ID NO: 73907 - RNA, 19 nt, Homo sapiens
gagaauuccugagagaguu

SEQ ID NO: 73908 - RNA, 19 nt, Homo sapiens
ccauauuguuuccaucuuu

SEQ ID NO: 73909 - RNA, 19 nt, Homo sapiens
uauagcagauuguguaaca

SEQ ID NO: 73910 - RNA, 19 nt, Homo sapiens
ugaagauucuccugugcua

SEQ ID NO: 73911 - RNA, 19 nt, Homo sapiens
aaauagagaaucccacuuu

SEQ ID NO: 73912 - RNA, 19 nt, Homo sapiens
ucacuggaguuacauuaau

SEQ ID NO: 73913 - RNA, 19 nt, Homo sapiens
ccaauuaucuucauauacc

SEQ ID NO: 73914 - RNA, 19 nt, Homo sapiens
gcaucagguuucuuucuug

SEQ ID NO: 73915 - RNA, 19 nt, Homo sapiens
gcaccgucauggcuuaaug

SEQ ID NO: 73916 - RNA, 19 nt, Homo sapiens
ggguucagcugacacaguu

SEQ ID NO: 73917 - RNA, 19 nt, Homo sapiens
cuaagguucucauaggaaa

SEQ ID NO: 73918 - RNA, 19 nt, Homo sapiens
cagcgaagcuuagcguuca

SEQ ID NO: 73919 - RNA, 19 nt, Homo sapiens
gagcauauuggaaagaaga

SEQ ID NO: 73920 - RNA, 19 nt, Homo sapiens
ccaaauacuccaaggcaaa

SEQ ID NO: 73921 - RNA, 19 nt, Homo sapiens
gcuaguggcuucaaaauag

SEQ ID NO: 73922 - RNA, 19 nt, Homo sapiens
caaguacaaugcugagaag

SEQ ID NO: 73923 - RNA, 19 nt, Homo sapiens
ucauauaccugugaacugu

SEQ ID NO: 73924 - RNA, 19 nt, Homo sapiens
uugguaaacuggucuuaaa

SEQ ID NO: 73925 - RNA, 19 nt, Homo sapiens
agagagaauuccugagaga

SEQ ID NO: 73926 - RNA, 19 nt, Homo sapiens
cgagagagaauuccugaga

SEQ ID NO: 73927 - RNA, 19 nt, Homo sapiens
gugcgggcauucuauguga

SEQ ID NO: 73928 - RNA, 19 nt, Homo sapiens
ggagaagugcggagauuca

SEQ ID NO: 73929 - RNA, 19 nt, Homo sapiens
gggaggcaguuuauugcaa

SEQ ID NO: 73930 - RNA, 19 nt, Homo sapiens
ccaguaggagacaaacuua

SEQ ID NO: 73931 - RNA, 19 nt, Homo sapiens
ugagcaccgucauggcuua

SEQ ID NO: 73932 - RNA, 19 nt, Homo sapiens
ucagguuucuuucuuguuc

SEQ ID NO: 73933 - RNA, 19 nt, Homo sapiens
aaaccuuucuguugaagau

SEQ ID NO: 73934 - RNA, 19 nt, Homo sapiens
ucagggaucccauauuguu

SEQ ID NO: 73935 - RNA, 19 nt, Homo sapiens
guucgguucuccacuguug

SEQ ID NO: 73936 - RNA, 19 nt, Homo sapiens
auacagcagugucaucaga

SEQ ID NO: 73937 - RNA, 19 nt, Homo sapiens
gcugagaagccuaagaaug

SEQ ID NO: 73938 - RNA, 19 nt, Homo sapiens
agaagaaagcggucaagaa

SEQ ID NO: 73939 - RNA, 19 nt, Homo sapiens
gaagugcggagauucaaca

SEQ ID NO: 73940 - RNA, 19 nt, Homo sapiens
ggcaguuuauugcaaauuc

SEQ ID NO: 73941 - RNA, 19 nt, Homo sapiens
ucaagcugguuaaugcaaa

SEQ ID NO: 73942 - RNA, 19 nt, Homo sapiens
gagccuacguccugagucu

SEQ ID NO: 73943 - RNA, 19 nt, Homo sapiens
gaaauccucagacacaucu

SEQ ID NO: 73944 - RNA, 19 nt, Homo sapiens
aaaccggaauccaguuaau

SEQ ID NO: 73945 - RNA, 19 nt, Homo sapiens
gcaaauuccauuauaagac

SEQ ID NO: 73946 - RNA, 19 nt, Homo sapiens
agagaguugugcaugcuaa

SEQ ID NO: 73947 - RNA, 19 nt, Homo sapiens
caagggagaaggcaaaucu

SEQ ID NO: 73948 - RNA, 19 nt, Homo sapiens
gauucaacacugccaauga

SEQ ID NO: 73949 - RNA, 19 nt, Homo sapiens
gcacagcauccaauauucu

SEQ ID NO: 73950 - RNA, 19 nt, Homo sapiens
cacaaggacuacccucuca

SEQ ID NO: 73951 - RNA, 19 nt, Homo sapiens
caucagguuucuuucuugu

SEQ ID NO: 73952 - RNA, 19 nt, Homo sapiens
uuaaucaggcagaaacuuu

SEQ ID NO: 73953 - RNA, 19 nt, Homo sapiens
ggacauggucugggacuuc

SEQ ID NO: 73954 - RNA, 19 nt, Homo sapiens
gagaaauccucagacacau

SEQ ID NO: 73955 - RNA, 19 nt, Homo sapiens
agagaaauccucagacaca

SEQ ID NO: 73956 - RNA, 19 nt, Homo sapiens
gaucccauauuguuuccau

SEQ ID NO: 73957 - RNA, 19 nt, Homo sapiens
gggaucucguuggaaauaa

SEQ ID NO: 73958 - RNA, 19 nt, Homo sapiens
gaaaaugaagguuaggauu

SEQ ID NO: 73959 - RNA, 19 nt, Homo sapiens
uaauuacuuugcugagguu

SEQ ID NO: 73960 - RNA, 19 nt, Homo sapiens
acugggaucucguuggaaa

SEQ ID NO: 73961 - RNA, 19 nt, Homo sapiens
acacaugacauuaccaaau

SEQ ID NO: 73962 - RNA, 19 nt, Homo sapiens
guuuacauaucaccucaug

SEQ ID NO: 73963 - RNA, 19 nt, Homo sapiens
uuacuuugcugagguugaa

SEQ ID NO: 73964 - RNA, 19 nt, Homo sapiens
caagcugguuaaugcaaau

SEQ ID NO: 73965 - RNA, 19 nt, Homo sapiens
guaggagacaaacuuaaug

SEQ ID NO: 73966 - RNA, 19 nt, Homo sapiens
gacggaugauuggauuauu

SEQ ID NO: 73967 - RNA, 19 nt, Homo sapiens
agaggaaacgucuguguga

SEQ ID NO: 73968 - RNA, 19 nt, Homo sapiens
uuaaaccggaauccaguua

SEQ ID NO: 73969 - RNA, 19 nt, Homo sapiens
gaucacauacuuucaagcu

SEQ ID NO: 73970 - RNA, 19 nt, Homo sapiens
acuuugaggucacacauga

SEQ ID NO: 73971 - RNA, 19 nt, Homo sapiens
gguuugcagugaaauuuua

SEQ ID NO: 73972 - RNA, 19 nt, Homo sapiens
cagcacugauuucacaaca

SEQ ID NO: 73973 - RNA, 19 nt, Homo sapiens
gugcucgaguggccaacua

SEQ ID NO: 73974 - RNA, 19 nt, Homo sapiens
gaagacucccaucgcaguu

SEQ ID NO: 73975 - RNA, 19 nt, Homo sapiens
gcaguccggaucucacuug

SEQ ID NO: 73976 - RNA, 19 nt, Homo sapiens
cagcaaaccgcacgcuaug

SEQ ID NO: 73977 - RNA, 19 nt, Homo sapiens
acacugccaaugaugauaa

SEQ ID NO: 73978 - RNA, 19 nt, Homo sapiens
ugaggccaguccugacaaa

SEQ ID NO: 73979 - RNA, 19 nt, Homo sapiens
accggaauccaguuaauua

SEQ ID NO: 73980 - RNA, 19 nt, Homo sapiens
ccucguggguuugcaguga

SEQ ID NO: 73981 - RNA, 19 nt, Homo sapiens
ugaaugaggaacagaggaa

SEQ ID NO: 73982 - RNA, 19 nt, Homo sapiens
gaauuaaaguggaccaaua

SEQ ID NO: 73983 - RNA, 19 nt, Homo sapiens
ggaaauggcuuugugauuc

SEQ ID NO: 73984 - RNA, 19 nt, Homo sapiens
uuacaagccugcacaauaa

SEQ ID NO: 73985 - RNA, 19 nt, Homo sapiens
gaauauccaugaccuaguu

SEQ ID NO: 73986 - RNA, 19 nt, Homo sapiens
gaucaaccaucgcuuuauu

SEQ ID NO: 73987 - RNA, 19 nt, Homo sapiens
cuaaacaccucaacgauga

SEQ ID NO: 73988 - RNA, 19 nt, Homo sapiens
gaaauggcuuugugauuca

SEQ ID NO: 73989 - RNA, 19 nt, Homo sapiens
gcuaauacagcaacaauuu

SEQ ID NO: 73990 - RNA, 19 nt, Homo sapiens
uuaaggaguuaguggauua

SEQ ID NO: 73991 - RNA, 19 nt, Homo sapiens
gcaguuguaccaugcauua

SEQ ID NO: 73992 - RNA, 19 nt, Homo sapiens
acagaaagcugccugguau

SEQ ID NO: 73993 - RNA, 19 nt, Homo sapiens
gaaaaucacuuaggaaaug

SEQ ID NO: 73994 - RNA, 19 nt, Homo sapiens
uaucaugcauguccuguaa

SEQ ID NO: 73995 - RNA, 19 nt, Homo sapiens
auuaagagcuuccugauug

SEQ ID NO: 73996 - RNA, 19 nt, Homo sapiens
guuacaagccugcacaaua

SEQ ID NO: 73997 - RNA, 19 nt, Homo sapiens
gaaagguaauuugagagaa

SEQ ID NO: 73998 - RNA, 19 nt, Homo sapiens
ugaggaauuucaccuguaa

SEQ ID NO: 73999 - RNA, 19 nt, Homo sapiens
guugaaagguaauuugaga

SEQ ID NO: 74000 - RNA, 19 nt, Homo sapiens
gugcuauacugcauacuuu

SEQ ID NO: 74001 - RNA, 19 nt, Homo sapiens
gccauggaguguacaagua

SEQ ID NO: 74002 - RNA, 19 nt, Homo sapiens
ccagugauccuuacaaguu

SEQ ID NO: 74003 - RNA, 19 nt, Homo sapiens
caacuugcagaaagaaaua

SEQ ID NO: 74004 - RNA, 19 nt, Homo sapiens
gcacaucugggcaguugua

SEQ ID NO: 74005 - RNA, 19 nt, Homo sapiens
gauagaaguauaccugauu

SEQ ID NO: 74006 - RNA, 19 nt, Homo sapiens
gccaggagcuuuggaccua

SEQ ID NO: 74007 - RNA, 19 nt, Homo sapiens
cagugauccuuacaaguua

SEQ ID NO: 74008 - RNA, 19 nt, Homo sapiens
agagaaauaugaagaacug

SEQ ID NO: 74009 - RNA, 19 nt, Homo sapiens
ucaaauagggucuaacuca

SEQ ID NO: 74010 - RNA, 19 nt, Homo sapiens
gcaucaacuugcagaaaga

SEQ ID NO: 74011 - RNA, 19 nt, Homo sapiens
gaacagggcaacaucuaca

SEQ ID NO: 74012 - RNA, 19 nt, Homo sapiens
aguauuaugucucuucuga

SEQ ID NO: 74013 - RNA, 19 nt, Homo sapiens
gaucuuccuuccucaguuc

SEQ ID NO: 74014 - RNA, 19 nt, Homo sapiens
uaaucacgcuuuccugaau

SEQ ID NO: 74015 - RNA, 19 nt, Homo sapiens
caagaauaaucacgcuuuc

SEQ ID NO: 74016 - RNA, 19 nt, Homo sapiens
cagcaugucuauucagcuu

SEQ ID NO: 74017 - RNA, 19 nt, Homo sapiens
gaggucagcaugucuauuc

SEQ ID NO: 74018 - RNA, 19 nt, Homo sapiens
gacacuagcccaaugaaau

SEQ ID NO: 74019 - RNA, 19 nt, Homo sapiens
uuggaacucugcuugauuu

SEQ ID NO: 74020 - RNA, 19 nt, Homo sapiens
ucuuaaaccuucaguuaug

SEQ ID NO: 74021 - RNA, 19 nt, Homo sapiens
ggauagaaguauaccugau

SEQ ID NO: 74022 - RNA, 19 nt, Homo sapiens
gggaggaggcaguaauaaa

SEQ ID NO: 74023 - RNA, 19 nt, Homo sapiens
uaacucagcaacucgcuuu

SEQ ID NO: 74024 - RNA, 19 nt, Homo sapiens
uuuauuggcugagauauga

SEQ ID NO: 74025 - RNA, 19 nt, Homo sapiens
gcuggaauaaguucaaauu

SEQ ID NO: 74026 - RNA, 19 nt, Homo sapiens
acaaguaugugggcagauu

SEQ ID NO: 74027 - RNA, 19 nt, Homo sapiens
gcacucaucuggggcauuu

SEQ ID NO: 74028 - RNA, 19 nt, Homo sapiens
uaaacuguguauuccaaga

SEQ ID NO: 74029 - RNA, 19 nt, Homo sapiens
ucaagaauaaucacgcuuu

SEQ ID NO: 74030 - RNA, 19 nt, Homo sapiens
cuauucagcuucguuuauu

SEQ ID NO: 74031 - RNA, 19 nt, Homo sapiens
caacuaaugccuuacucuu

SEQ ID NO: 74032 - RNA, 19 nt, Homo sapiens
gggaaaauauucagcaaug

SEQ ID NO: 74033 - RNA, 19 nt, Homo sapiens
guuguaccaugcauuaaga

SEQ ID NO: 74034 - RNA, 19 nt, Homo sapiens
cagaagggacacacaguuu

SEQ ID NO: 74035 - RNA, 19 nt, Homo sapiens
caagauugacuuugaagau

SEQ ID NO: 74036 - RNA, 19 nt, Homo sapiens
cagacgagcugagcgagaa

SEQ ID NO: 74037 - RNA, 19 nt, Homo sapiens
ccaaaagauugcugaaauu

SEQ ID NO: 74038 - RNA, 19 nt, Homo sapiens
ugauccaacuaaugccuua

SEQ ID NO: 74039 - RNA, 19 nt, Homo sapiens
aagaucacuuucucaguuu

SEQ ID NO: 74040 - RNA, 19 nt, Homo sapiens
aaaccugagucguacagaa

SEQ ID NO: 74041 - RNA, 19 nt, Homo sapiens
caauagggcugagcucucu

SEQ ID NO: 74042 - RNA, 19 nt, Homo sapiens
ccucagugccuuccuguuu

SEQ ID NO: 74043 - RNA, 19 nt, Homo sapiens
gaaccaacaaccucaacug

SEQ ID NO: 74044 - RNA, 19 nt, Homo sapiens
gcauuuacuucgccauucu

SEQ ID NO: 74045 - RNA, 19 nt, Homo sapiens
ucacuuaggaaauggcuuu

SEQ ID NO: 74046 - RNA, 19 nt, Homo sapiens
ccuguaaaccugagucgua

SEQ ID NO: 74047 - RNA, 19 nt, Homo sapiens
ucugagcuauuucaucuau

SEQ ID NO: 74048 - RNA, 19 nt, Homo sapiens
cuuugaagcuguugggaaa

SEQ ID NO: 74049 - RNA, 19 nt, Homo sapiens
gggaacagggcaacaucua

SEQ ID NO: 74050 - RNA, 19 nt, Homo sapiens
uguaaacuguguauuccaa

SEQ ID NO: 74051 - RNA, 19 nt, Homo sapiens
uuuaguggcucaacauugu

SEQ ID NO: 74052 - RNA, 19 nt, Homo sapiens
aauccaaacuaauccauca

SEQ ID NO: 74053 - RNA, 19 nt, Homo sapiens
caacaucuuuauccguagu

SEQ ID NO: 74054 - RNA, 19 nt, Homo sapiens
gcaauguccgcaucaacuu

SEQ ID NO: 74055 - RNA, 19 nt, Homo sapiens
uuaagagcuuccugauuga

SEQ ID NO: 74056 - RNA, 19 nt, Homo sapiens
gcgagcagaacaaaccuuu

SEQ ID NO: 74057 - RNA, 19 nt, Homo sapiens
ggaggaggcaguaauaaaa

SEQ ID NO: 74058 - RNA, 19 nt, Homo sapiens
cuucugagcuauuucaucu

SEQ ID NO: 74059 - RNA, 19 nt, Homo sapiens
uuaugucucuucugagcua

SEQ ID NO: 74060 - RNA, 19 nt, Homo sapiens
uggcauggauauaguuuua

SEQ ID NO: 74061 - RNA, 19 nt, Homo sapiens
ugaaugaggucagcauguc

SEQ ID NO: 74062 - RNA, 19 nt, Homo sapiens
ugaagaaaaucacuuagga

SEQ ID NO: 74063 - RNA, 19 nt, Homo sapiens
uaaacuguguacauaacug

SEQ ID NO: 74064 - RNA, 19 nt, Homo sapiens
cuuccugacacuuuaauua

SEQ ID NO: 74065 - RNA, 19 nt, Homo sapiens
ugaaagguaauuugagaga

SEQ ID NO: 74066 - RNA, 19 nt, Homo sapiens
guuccaaguugcuaauaca

SEQ ID NO: 74067 - RNA, 19 nt, Homo sapiens
ugauugagauucagugcau

SEQ ID NO: 74068 - RNA, 19 nt, Homo sapiens
aagauugacuuugaagaug

SEQ ID NO: 74069 - RNA, 19 nt, Homo sapiens
gcauguccuguaaagguua

SEQ ID NO: 74070 - RNA, 19 nt, Homo sapiens
gccuuacucuucuugaaau

SEQ ID NO: 74071 - RNA, 19 nt, Homo sapiens
gccauucacuucauaaucc

SEQ ID NO: 74072 - RNA, 19 nt, Homo sapiens
cuuagucccucaugcaaau

SEQ ID NO: 74073 - RNA, 19 nt, Homo sapiens
cagucuuccugacacuuua

SEQ ID NO: 74074 - RNA, 19 nt, Homo sapiens
uuucugugccugaauauuu

SEQ ID NO: 74075 - RNA, 19 nt, Homo sapiens
gaaagcugccugguauauc

SEQ ID NO: 74076 - RNA, 19 nt, Homo sapiens
gcgagaagcaaguguacga

SEQ ID NO: 74077 - RNA, 19 nt, Homo sapiens
uaccaugcauuaagagcuu

SEQ ID NO: 74078 - RNA, 19 nt, Homo sapiens
acacuggcauggauauagu

SEQ ID NO: 74079 - RNA, 19 nt, Homo sapiens
cuuaaaccuucaguuauga

SEQ ID NO: 74080 - RNA, 19 nt, Homo sapiens
cugaggaauuucaccugua

SEQ ID NO: 74081 - RNA, 19 nt, Homo sapiens
cagccucccugaagaccaa

SEQ ID NO: 74082 - RNA, 19 nt, Homo sapiens
gcaaauacguaauguacaa

SEQ ID NO: 74083 - RNA, 19 nt, Homo sapiens
gcacuguucugauuaugua

SEQ ID NO: 74084 - RNA, 19 nt, Homo sapiens
guaaagaccugccuaaugg

SEQ ID NO: 74085 - RNA, 19 nt, Homo sapiens
gaaaucagcaaauacguaa

SEQ ID NO: 74086 - RNA, 19 nt, Homo sapiens
gcacacaacgauuauagua

SEQ ID NO: 74087 - RNA, 19 nt, Homo sapiens
ugacaggucuuuucaaaua

SEQ ID NO: 74088 - RNA, 19 nt, Homo sapiens
ggaagagugugacagaugu

SEQ ID NO: 74089 - RNA, 19 nt, Homo sapiens
aagguaaacuucauuggua

SEQ ID NO: 74090 - RNA, 19 nt, Homo sapiens
ugacaccacuuagauuuaa

SEQ ID NO: 74091 - RNA, 19 nt, Homo sapiens
gagccaggauugaauacuu

SEQ ID NO: 74092 - RNA, 19 nt, Homo sapiens
ggacgaugcuucucuucug

SEQ ID NO: 74093 - RNA, 19 nt, Homo sapiens
uuuccuagcuguucuaauu

SEQ ID NO: 74094 - RNA, 19 nt, Homo sapiens
cuacaggccuauuuaacaa

SEQ ID NO: 74095 - RNA, 19 nt, Homo sapiens
uaucauugcuccauugugu

SEQ ID NO: 74096 - RNA, 19 nt, Homo sapiens
ccacuguucuguucauuuc

SEQ ID NO: 74097 - RNA, 19 nt, Homo sapiens
agauugggauacuguaaua

SEQ ID NO: 74098 - RNA, 19 nt, Homo sapiens
ugacagauguuaucauugc

SEQ ID NO: 74099 - RNA, 19 nt, Homo sapiens
caaaagcacacaacgauua

SEQ ID NO: 74100 - RNA, 19 nt, Homo sapiens
ugugacagauguuaucauu

SEQ ID NO: 74101 - RNA, 19 nt, Homo sapiens
gagcaaccacauuuagaaa

SEQ ID NO: 74102 - RNA, 19 nt, Homo sapiens
guaagcauuuguacaucuu

SEQ ID NO: 74103 - RNA, 19 nt, Homo sapiens
augcacaacuucccauuaa

SEQ ID NO: 74104 - RNA, 19 nt, Homo sapiens
aaauguugcucuaaucaga

SEQ ID NO: 74105 - RNA, 19 nt, Homo sapiens
ggacguacagcucuucaug

SEQ ID NO: 74106 - RNA, 19 nt, Homo sapiens
caacugagccaggauugaa

SEQ ID NO: 74107 - RNA, 19 nt, Homo sapiens
gccaugcccucuuugaaau

SEQ ID NO: 74108 - RNA, 19 nt, Homo sapiens
agauugcacuguucugauu

SEQ ID NO: 74109 - RNA, 19 nt, Homo sapiens
ggagauugggauacuguaa

SEQ ID NO: 74110 - RNA, 19 nt, Homo sapiens
ugaaaucagcaaauacgua

SEQ ID NO: 74111 - RNA, 19 nt, Homo sapiens
ugacuacgcacuccuuuga

SEQ ID NO: 74112 - RNA, 19 nt, Homo sapiens
guaggacgaugcuucucuu

SEQ ID NO: 74113 - RNA, 19 nt, Homo sapiens
gcauuuguacaucuucuuu

SEQ ID NO: 74114 - RNA, 19 nt, Homo sapiens
uauagucacuggcauacug

SEQ ID NO: 74115 - RNA, 19 nt, Homo sapiens
guacaucuucuuuggaaau

SEQ ID NO: 74116 - RNA, 19 nt, Homo sapiens
acacaacgauuauaguaac

SEQ ID NO: 74117 - RNA, 19 nt, Homo sapiens
ggaaauugcaguaacaaaa

SEQ ID NO: 74118 - RNA, 19 nt, Homo sapiens
gauuaagggacauuucuau

SEQ ID NO: 74119 - RNA, 19 nt, Homo sapiens
guugacaccacuuagauuu

SEQ ID NO: 74120 - RNA, 19 nt, Homo sapiens
aagaugagcaaccacauuu

SEQ ID NO: 74121 - RNA, 19 nt, Homo sapiens
gcaccacuguucuguucau

SEQ ID NO: 74122 - RNA, 19 nt, Homo sapiens
auacaaugauccuggaaau

SEQ ID NO: 74123 - RNA, 19 nt, Homo sapiens
cggcucaacucgcaucuca

SEQ ID NO: 74124 - RNA, 19 nt, Homo sapiens
aagcaccacuguucuguuc

SEQ ID NO: 74125 - RNA, 19 nt, Homo sapiens
cugcagccaugcccucuuu

SEQ ID NO: 74126 - RNA, 19 nt, Homo sapiens
gaugagcaaccacauuuag

SEQ ID NO: 74127 - RNA, 19 nt, Homo sapiens
cagcaaauacguaauguac

SEQ ID NO: 74128 - RNA, 19 nt, Homo sapiens
gcacaacuucccauuaaaa

SEQ ID NO: 74129 - RNA, 19 nt, Homo sapiens
uaagaugagcaaccacauu

SEQ ID NO: 74130 - RNA, 19 nt, Homo sapiens
uguaaagaccugccuaaug

SEQ ID NO: 74131 - RNA, 19 nt, Homo sapiens
ccagaauuauacaguaagu

SEQ ID NO: 74132 - RNA, 19 nt, Homo sapiens
gacgaugcuucucuucugu

SEQ ID NO: 74133 - RNA, 19 nt, Homo sapiens
ccacaagguaaacuucauu

SEQ ID NO: 74134 - RNA, 19 nt, Homo sapiens
guaaauguagcucccacaa

SEQ ID NO: 74135 - RNA, 19 nt, Homo sapiens
ucacuggcauacugagaau

SEQ ID NO: 74136 - RNA, 19 nt, Homo sapiens
ggagaaggcggacguacag

SEQ ID NO: 74137 - RNA, 19 nt, Homo sapiens
gauugcacuguucugauua

SEQ ID NO: 74138 - RNA, 19 nt, Homo sapiens
uaagauugcacuguucuga

SEQ ID NO: 74139 - RNA, 19 nt, Homo sapiens
gacaccacuuagauuuaaa

SEQ ID NO: 74140 - RNA, 19 nt, Homo sapiens
ugagcaaccacauuuagaa

SEQ ID NO: 74141 - RNA, 19 nt, Homo sapiens
gagauugggauacuguaau

SEQ ID NO: 74142 - RNA, 19 nt, Homo sapiens
caagguaaacuucauuggu

SEQ ID NO: 74143 - RNA, 19 nt, Homo sapiens
gauccuggaaauugcagua

SEQ ID NO: 74144 - RNA, 19 nt, Homo sapiens
gugcagacaauauggaaga

SEQ ID NO: 74145 - RNA, 19 nt, Homo sapiens
gcagccaugcccucuuuga

SEQ ID NO: 74146 - RNA, 19 nt, Homo sapiens
cugcacaucuggauuuuaa

SEQ ID NO: 74147 - RNA, 19 nt, Homo sapiens
acaaguuccugacgguguu

SEQ ID NO: 74148 - RNA, 19 nt, Homo sapiens
agguaaacuucauugguaa

SEQ ID NO: 74149 - RNA, 19 nt, Homo sapiens
ggcagacaguuuugcuuua

SEQ ID NO: 74150 - RNA, 19 nt, Homo sapiens
uccuagcuguucuaauuaa

SEQ ID NO: 74151 - RNA, 19 nt, Homo sapiens
acaggccuauuuaacaaga

SEQ ID NO: 74152 - RNA, 19 nt, Homo sapiens
ccuggaaauugcaguaaca

SEQ ID NO: 74153 - RNA, 19 nt, Homo sapiens
uaugcacaacuucccauua

SEQ ID NO: 74154 - RNA, 19 nt, Homo sapiens
gcucaacucgcaucucaag

SEQ ID NO: 74155 - RNA, 19 nt, Homo sapiens
gcaacugagccaggauuga

SEQ ID NO: 74156 - RNA, 19 nt, Homo sapiens
gaagagugugacagauguu

SEQ ID NO: 74157 - RNA, 19 nt, Homo sapiens
uuguacaucuucuuuggaa

SEQ ID NO: 74158 - RNA, 19 nt, Homo sapiens
guaaacuucauugguaaga

SEQ ID NO: 74159 - RNA, 19 nt, Homo sapiens
cacacaacgauuauaguaa

SEQ ID NO: 74160 - RNA, 19 nt, Homo sapiens
ucgcagagccggugacuac

SEQ ID NO: 74161 - RNA, 19 nt, Homo sapiens
uaaugguucugccuucagu

SEQ ID NO: 74162 - RNA, 19 nt, Homo sapiens
uugguaagauugcacuguu

SEQ ID NO: 74163 - RNA, 19 nt, Homo sapiens
ccuacaggccuauuuaaca

SEQ ID NO: 74164 - RNA, 19 nt, Homo sapiens
guaaccagaauuauacagu

SEQ ID NO: 74165 - RNA, 19 nt, Homo sapiens
gggauacuguaauacuucu

SEQ ID NO: 74166 - RNA, 19 nt, Homo sapiens
ugucugcacaucuggauuu

SEQ ID NO: 74167 - RNA, 19 nt, Homo sapiens
cugagaauauacaaugauc

SEQ ID NO: 74168 - RNA, 19 nt, Homo sapiens
gacaggucuuuucaaauaa

SEQ ID NO: 74169 - RNA, 19 nt, Homo sapiens
cauaaaagcaccacuguuc

SEQ ID NO: 74170 - RNA, 19 nt, Homo sapiens
acguacagcucuucaugga

SEQ ID NO: 74171 - RNA, 19 nt, Homo sapiens
cugauuauguaagcauuug

SEQ ID NO: 74172 - RNA, 19 nt, Homo sapiens
aaucagcaaauacguaaug

SEQ ID NO: 74173 - RNA, 19 nt, Homo sapiens
gaaauugcaguaacaaaag

SEQ ID NO: 74174 - RNA, 19 nt, Homo sapiens
uauggaagagugugacaga

SEQ ID NO: 74175 - RNA, 19 nt, Homo sapiens
gagaauauacaaugauccu

SEQ ID NO: 74176 - RNA, 19 nt, Homo sapiens
agacaguuuugcuuuagua

SEQ ID NO: 74177 - RNA, 19 nt, Homo sapiens
gcagacaguuuugcuuuag

SEQ ID NO: 74178 - RNA, 19 nt, Homo sapiens
agaugagcaaccacauuua

SEQ ID NO: 74179 - RNA, 19 nt, Homo sapiens
cgaugcuucucuucuguca

SEQ ID NO: 74180 - RNA, 19 nt, Homo sapiens
guagcucccacaagguaaa

SEQ ID NO: 74181 - RNA, 19 nt, Homo sapiens
ugauuaagggacauuucua

SEQ ID NO: 74182 - RNA, 19 nt, Homo sapiens
gaagguggcuccaguaaag

SEQ ID NO: 74183 - RNA, 19 nt, Homo sapiens
gaaggaacaaggucuaauu

SEQ ID NO: 74184 - RNA, 19 nt, Homo sapiens
ggaagaucauguuuaagug

SEQ ID NO: 74185 - RNA, 19 nt, Homo sapiens
gaacauuaacgaggacaua

SEQ ID NO: 74186 - RNA, 19 nt, Homo sapiens
gaagaucauuugccaagag

SEQ ID NO: 74187 - RNA, 19 nt, Homo sapiens
gaagaucauguuuaaguga

SEQ ID NO: 74188 - RNA, 19 nt, Homo sapiens
cuuggaagaucauguuuaa

SEQ ID NO: 74189 - RNA, 19 nt, Homo sapiens
guucgugccuguaagauug

SEQ ID NO: 74190 - RNA, 19 nt, Homo sapiens
ucaggaaagugaccaguga

SEQ ID NO: 74191 - RNA, 19 nt, Homo sapiens
guacugccauuugacauga

SEQ ID NO: 74192 - RNA, 19 nt, Homo sapiens
ucaaggauauccacugcaa

SEQ ID NO: 74193 - RNA, 19 nt, Homo sapiens
caggagaugugacgaagga

SEQ ID NO: 74194 - RNA, 19 nt, Homo sapiens
gcccaguacugccauuuga

SEQ ID NO: 74195 - RNA, 19 nt, Homo sapiens
gcccagaucgucaaggaua

SEQ ID NO: 74196 - RNA, 19 nt, Homo sapiens
ggaagggccuggguucaag

SEQ ID NO: 74197 - RNA, 19 nt, Homo sapiens
ggaagaucauuugccaaga

SEQ ID NO: 74198 - RNA, 19 nt, Homo sapiens
ggacucacuauggaaauaa

SEQ ID NO: 74199 - RNA, 19 nt, Homo sapiens
ggaagguggcuccaguaaa

SEQ ID NO: 74200 - RNA, 19 nt, Homo sapiens
guagaaagagcauguaaaa

SEQ ID NO: 74201 - RNA, 19 nt, Homo sapiens
cagaagagcacacagaucu

SEQ ID NO: 74202 - RNA, 19 nt, Homo sapiens
gcgguggugccaugcauua

SEQ ID NO: 74203 - RNA, 19 nt, Homo sapiens
gcguucacuuguacuguaa

SEQ ID NO: 74204 - RNA, 19 nt, Homo sapiens
uagggaagccagaaagaaa

SEQ ID NO: 74205 - RNA, 19 nt, Homo sapiens
ggccaaauguaagugaaga

SEQ ID NO: 74206 - RNA, 19 nt, Homo sapiens
guggugccaugcauuaaga

SEQ ID NO: 74207 - RNA, 19 nt, Homo sapiens
gacucacuauggaaauaaa

SEQ ID NO: 74208 - RNA, 19 nt, Homo sapiens
uggacucacuauggaaaua

SEQ ID NO: 74209 - RNA, 19 nt, Homo sapiens
uggaagaucauguuuaagu

SEQ ID NO: 74210 - RNA, 19 nt, Homo sapiens
gaaccuccccuuuggcuaa

SEQ ID NO: 74211 - RNA, 19 nt, Homo sapiens
guagggaagccagaaagaa

SEQ ID NO: 74212 - RNA, 19 nt, Homo sapiens
agagcuaccugaucgagau

SEQ ID NO: 74213 - RNA, 19 nt, Homo sapiens
ugccaugcauuaagagcua

SEQ ID NO: 74214 - RNA, 19 nt, Homo sapiens
ggacauagucaagguggau

SEQ ID NO: 74215 - RNA, 19 nt, Homo sapiens
aaauguaagugaagaacag

SEQ ID NO: 74216 - RNA, 19 nt, Homo sapiens
gccagggacugcuccauac

SEQ ID NO: 74217 - RNA, 19 nt, Homo sapiens
gcaguagaaagagcaugua

SEQ ID NO: 74218 - RNA, 19 nt, Homo sapiens
ggaaauaaaaugcaguaga

SEQ ID NO: 74219 - RNA, 19 nt, Homo sapiens
aaggaacaaggucuaauuu

SEQ ID NO: 74220 - RNA, 19 nt, Homo sapiens
uugguugucucuucacuug

SEQ ID NO: 74221 - RNA, 19 nt, Homo sapiens
gggaagggccuggguucaa

SEQ ID NO: 74222 - RNA, 19 nt, Homo sapiens
gcagaagagcacacagauc

SEQ ID NO: 74223 - RNA, 19 nt, Homo sapiens
gagaugugacgaaggaaca

SEQ ID NO: 74224 - RNA, 19 nt, Homo sapiens
uaaccgagccccugaaaug

SEQ ID NO: 74225 - RNA, 19 nt, Homo sapiens
ccuguugccugagcacaaa

SEQ ID NO: 74226 - RNA, 19 nt, Homo sapiens
ccuguaagauugguuugug

SEQ ID NO: 74227 - RNA, 19 nt, Homo sapiens
ugcguucacuuguacugua

SEQ ID NO: 74228 - RNA, 19 nt, Homo sapiens
gcauuaagagcuaccugau

SEQ ID NO: 74229 - RNA, 19 nt, Homo sapiens
uaacgaggacauagucaag

SEQ ID NO: 74230 - RNA, 19 nt, Homo sapiens
caguagaaagagcauguaa

SEQ ID NO: 74231 - RNA, 19 nt, Homo sapiens
gacgaaggaacaaggucua

SEQ ID NO: 74232 - RNA, 19 nt, Homo sapiens
gugggcaccuacagcuuug

SEQ ID NO: 74233 - RNA, 19 nt, Homo sapiens
uguguggacucacuaugga

SEQ ID NO: 74234 - RNA, 19 nt, Homo sapiens
ucucuucacuuggccaaau

SEQ ID NO: 74235 - RNA, 19 nt, Homo sapiens
gucuuugcguucacuugua

SEQ ID NO: 74236 - RNA, 19 nt, Homo sapiens
ccuucacugucuccaagua

SEQ ID NO: 74237 - RNA, 19 nt, Homo sapiens
caaauguaagugaagaaca

SEQ ID NO: 74238 - RNA, 19 nt, Homo sapiens
ucacuuggccaaauguaag

SEQ ID NO: 74239 - RNA, 19 nt, Homo sapiens
ccacuggcguuaggaaggu

SEQ ID NO: 74240 - RNA, 19 nt, Homo sapiens
gggcaccaauggaggaaaa

SEQ ID NO: 74241 - RNA, 19 nt, Homo sapiens
ccuuggaagaucauguuua

SEQ ID NO: 74242 - RNA, 19 nt, Homo sapiens
caucagccacaucuacuca

SEQ ID NO: 74243 - RNA, 19 nt, Homo sapiens
ggcagaagagcacacagau

SEQ ID NO: 74244 - RNA, 19 nt, Homo sapiens
guucacuuguacuguaaca

SEQ ID NO: 74245 - RNA, 19 nt, Homo sapiens
ccaguacugccauuugaca

SEQ ID NO: 74246 - RNA, 19 nt, Homo sapiens
caagguggauuuugaagac

SEQ ID NO: 74247 - RNA, 19 nt, Homo sapiens
gagcuacaccaccuucacu

SEQ ID NO: 74248 - RNA, 19 nt, Homo sapiens
acagacacagggagaguug

SEQ ID NO: 74249 - RNA, 19 nt, Homo sapiens
uaggaagguggcuccagua

SEQ ID NO: 74250 - RNA, 19 nt, Homo sapiens
gguguagggaagccagaaa

SEQ ID NO: 74251 - RNA, 19 nt, Homo sapiens
gaagguggcuccaguaaag

SEQ ID NO: 74252 - RNA, 19 nt, Homo sapiens
gaaggaacaaggucuaauu

SEQ ID NO: 74253 - RNA, 19 nt, Homo sapiens
ggcgagcucuuucucuuua

SEQ ID NO: 74254 - RNA, 19 nt, Homo sapiens
ggaagaucauguuuaagug

SEQ ID NO: 74255 - RNA, 19 nt, Homo sapiens
gaacauuaacgaggacaua

SEQ ID NO: 74256 - RNA, 19 nt, Homo sapiens
gaagaucauuugccaagag

SEQ ID NO: 74257 - RNA, 19 nt, Homo sapiens
gaagaucauguuuaaguga

SEQ ID NO: 74258 - RNA, 19 nt, Homo sapiens
cuuggaagaucauguuuaa

SEQ ID NO: 74259 - RNA, 19 nt, Homo sapiens
guucgugccuguaagauug

SEQ ID NO: 74260 - RNA, 19 nt, Homo sapiens
ucaggaaagugaccaguga

SEQ ID NO: 74261 - RNA, 19 nt, Homo sapiens
guacugccauuugacauga

SEQ ID NO: 74262 - RNA, 19 nt, Homo sapiens
ucaaggauauccacugcaa

SEQ ID NO: 74263 - RNA, 19 nt, Homo sapiens
caggagaugugacgaagga

SEQ ID NO: 74264 - RNA, 19 nt, Homo sapiens
gcccaguacugccauuuga

SEQ ID NO: 74265 - RNA, 19 nt, Homo sapiens
gcccagaucgucaaggaua

SEQ ID NO: 74266 - RNA, 19 nt, Homo sapiens
ggaagggccuggguucaag

SEQ ID NO: 74267 - RNA, 19 nt, Homo sapiens
ggaagaucauuugccaaga

SEQ ID NO: 74268 - RNA, 19 nt, Homo sapiens
ggacucacuauggaaauaa

SEQ ID NO: 74269 - RNA, 19 nt, Homo sapiens
ggaagguggcuccaguaaa

SEQ ID NO: 74270 - RNA, 19 nt, Homo sapiens
guagaaagagcauguaaaa

SEQ ID NO: 74271 - RNA, 19 nt, Homo sapiens
cagaagagcacacagaucu

SEQ ID NO: 74272 - RNA, 19 nt, Homo sapiens
gcgguggugccaugcauua

SEQ ID NO: 74273 - RNA, 19 nt, Homo sapiens
gcguucacuuguacuguaa

SEQ ID NO: 74274 - RNA, 19 nt, Homo sapiens
uagggaagccagaaagaaa

SEQ ID NO: 74275 - RNA, 19 nt, Homo sapiens
ggccaaauguaagugaaga

SEQ ID NO: 74276 - RNA, 19 nt, Homo sapiens
guggugccaugcauuaaga

SEQ ID NO: 74277 - RNA, 19 nt, Homo sapiens
gacucacuauggaaauaaa

SEQ ID NO: 74278 - RNA, 19 nt, Homo sapiens
uggacucacuauggaaaua

SEQ ID NO: 74279 - RNA, 19 nt, Homo sapiens
uggaagaucauguuuaagu

SEQ ID NO: 74280 - RNA, 19 nt, Homo sapiens
gaaccuccccuuuggcuaa

SEQ ID NO: 74281 - RNA, 19 nt, Homo sapiens
guagggaagccagaaagaa

SEQ ID NO: 74282 - RNA, 19 nt, Homo sapiens
agagcuaccugaucgagau

SEQ ID NO: 74283 - RNA, 19 nt, Homo sapiens
ugccaugcauuaagagcua

SEQ ID NO: 74284 - RNA, 19 nt, Homo sapiens
ggacauagucaagguggau

SEQ ID NO: 74285 - RNA, 19 nt, Homo sapiens
aaauguaagugaagaacag

SEQ ID NO: 74286 - RNA, 19 nt, Homo sapiens
gcaguagaaagagcaugua

SEQ ID NO: 74287 - RNA, 19 nt, Homo sapiens
ggaaauaaaaugcaguaga

SEQ ID NO: 74288 - RNA, 19 nt, Homo sapiens
aaggaacaaggucuaauuu

SEQ ID NO: 74289 - RNA, 19 nt, Homo sapiens
uugguugucucuucacuug

SEQ ID NO: 74290 - RNA, 19 nt, Homo sapiens
gggaagggccuggguucaa

SEQ ID NO: 74291 - RNA, 19 nt, Homo sapiens
gcagaagagcacacagauc

SEQ ID NO: 74292 - RNA, 19 nt, Homo sapiens
gagaugugacgaaggaaca

SEQ ID NO: 74293 - RNA, 19 nt, Homo sapiens
uaaccgagccccugaaaug

SEQ ID NO: 74294 - RNA, 19 nt, Homo sapiens
ccuguugccugagcacaaa

SEQ ID NO: 74295 - RNA, 19 nt, Homo sapiens
ccuguaagauugguuugug

SEQ ID NO: 74296 - RNA, 19 nt, Homo sapiens
ugcguucacuuguacugua

SEQ ID NO: 74297 - RNA, 19 nt, Homo sapiens
gcauuaagagcuaccugau

SEQ ID NO: 74298 - RNA, 19 nt, Homo sapiens
uaacgaggacauagucaag

SEQ ID NO: 74299 - RNA, 19 nt, Homo sapiens
caguagaaagagcauguaa

SEQ ID NO: 74300 - RNA, 19 nt, Homo sapiens
gacgaaggaacaaggucua

SEQ ID NO: 74301 - RNA, 19 nt, Homo sapiens
gugggcaccuacagcuuug

SEQ ID NO: 74302 - RNA, 19 nt, Homo sapiens
uguguggacucacuaugga

SEQ ID NO: 74303 - RNA, 19 nt, Homo sapiens
ucucuucacuuggccaaau

SEQ ID NO: 74304 - RNA, 19 nt, Homo sapiens
gucuuugcguucacuugua

SEQ ID NO: 74305 - RNA, 19 nt, Homo sapiens
ccuucacugucuccaagua

SEQ ID NO: 74306 - RNA, 19 nt, Homo sapiens
caaauguaagugaagaaca

SEQ ID NO: 74307 - RNA, 19 nt, Homo sapiens
ucacuuggccaaauguaag

SEQ ID NO: 74308 - RNA, 19 nt, Homo sapiens
ccacuggcguuaggaaggu

SEQ ID NO: 74309 - RNA, 19 nt, Homo sapiens
gggcaccaauggaggaaaa

SEQ ID NO: 74310 - RNA, 19 nt, Homo sapiens
ccuuggaagaucauguuua

SEQ ID NO: 74311 - RNA, 19 nt, Homo sapiens
caucagccacaucuacuca

SEQ ID NO: 74312 - RNA, 19 nt, Homo sapiens
ggcagaagagcacacagau

SEQ ID NO: 74313 - RNA, 19 nt, Homo sapiens
guucacuuguacuguaaca

SEQ ID NO: 74314 - RNA, 19 nt, Homo sapiens
cuggcgagcucuuucucuu

SEQ ID NO: 74315 - RNA, 19 nt, Homo sapiens
ccaguacugccauuugaca

SEQ ID NO: 74316 - RNA, 19 nt, Homo sapiens
uuuagggacugcuccauac

SEQ ID NO: 74317 - RNA, 19 nt, Homo sapiens
caagguggauuuugaagac

SEQ ID NO: 74318 - RNA, 19 nt, Homo sapiens
gagcuacaccaccuucacu

SEQ ID NO: 74319 - RNA, 19 nt, Homo sapiens
acagacacagggagaguug

SEQ ID NO: 74320 - RNA, 19 nt, Homo sapiens
uaggaagguggcuccagua

SEQ ID NO: 74321 - RNA, 19 nt, Homo sapiens
gguguagggaagccagaaa

SEQ ID NO: 74322 - RNA, 19 nt, Homo sapiens
gaagcuugaugacucuaaa

SEQ ID NO: 74323 - RNA, 19 nt, Homo sapiens
ucacagagcaauuaaaguu

SEQ ID NO: 74324 - RNA, 19 nt, Homo sapiens
cggaaugccucugcuguua

SEQ ID NO: 74325 - RNA, 19 nt, Homo sapiens
gaaugccucugcuguuaug

SEQ ID NO: 74326 - RNA, 19 nt, Homo sapiens
caaauuugccuaaccagaa

SEQ ID NO: 74327 - RNA, 19 nt, Homo sapiens
gcaauuaaaguuacaguag

SEQ ID NO: 74328 - RNA, 19 nt, Homo sapiens
ccauaaccgucuucacaaa

SEQ ID NO: 74329 - RNA, 19 nt, Homo sapiens
caaggacagagucagauua

SEQ ID NO: 74330 - RNA, 19 nt, Homo sapiens
gaccauaaccgucuucaca

SEQ ID NO: 74331 - RNA, 19 nt, Homo sapiens
ccaggcaggugcuucagaa

SEQ ID NO: 74332 - RNA, 19 nt, Homo sapiens
gauggaagccacagcaguu

SEQ ID NO: 74333 - RNA, 19 nt, Homo sapiens
gucaggauccuaucaguuu

SEQ ID NO: 74334 - RNA, 19 nt, Homo sapiens
gaauggcagcacgcuauua

SEQ ID NO: 74335 - RNA, 19 nt, Homo sapiens
cuugaugacucuaaaccua

SEQ ID NO: 74336 - RNA, 19 nt, Homo sapiens
ggacgaggcaagaguuuca

SEQ ID NO: 74337 - RNA, 19 nt, Homo sapiens
gcacuauccagccaccuuu

SEQ ID NO: 74338 - RNA, 19 nt, Homo sapiens
cuucagaacugggcccuuu

SEQ ID NO: 74339 - RNA, 19 nt, Homo sapiens
ccaaguagcuaccuaucac

SEQ ID NO: 74340 - RNA, 19 nt, Homo sapiens
gcagcacgcuauuaaaucc

SEQ ID NO: 74341 - RNA, 19 nt, Homo sapiens
ggacugugguuacugucau

SEQ ID NO: 74342 - RNA, 19 nt, Homo sapiens
ggacagagucagauuacag

SEQ ID NO: 74343 - RNA, 19 nt, Homo sapiens
ccacaaggacagagucaga

SEQ ID NO: 74344 - RNA, 19 nt, Homo sapiens
cagcagcacuccauaucuc

SEQ ID NO: 74345 - RNA, 19 nt, Homo sapiens
cacagagcaauuaaaguua

SEQ ID NO: 74346 - RNA, 19 nt, Homo sapiens
ccagccaccuuuacuuaca

SEQ ID NO: 74347 - RNA, 19 nt, Homo sapiens
gaauggaugaaucuguuug

SEQ ID NO: 74348 - RNA, 19 nt, Homo sapiens
aaauuugccuaaccagaau

SEQ ID NO: 74349 - RNA, 19 nt, Homo sapiens
ggaaugccucugcuguuau

SEQ ID NO: 74350 - RNA, 19 nt, Homo sapiens
ggcaggugcuucagaacug

SEQ ID NO: 74351 - RNA, 19 nt, Homo sapiens
gacagagucagauuacaga

SEQ ID NO: 74352 - RNA, 19 nt, Homo sapiens
ccagaugggacugugguua

SEQ ID NO: 74353 - RNA, 19 nt, Homo sapiens
aguuucaccuugaccauaa

SEQ ID NO: 74354 - RNA, 19 nt, Homo sapiens
uagcaagguucaacgaucu

SEQ ID NO: 74355 - RNA, 19 nt, Homo sapiens
gcacgcuauuaaauccaaa

SEQ ID NO: 74356 - RNA, 19 nt, Homo sapiens
gcacuccauaucucuacua

SEQ ID NO: 74357 - RNA, 19 nt, Homo sapiens
ccagucaccucaggcaugu

SEQ ID NO: 74358 - RNA, 19 nt, Homo sapiens
ccugaacucugcaccaagu

SEQ ID NO: 74359 - RNA, 19 nt, Homo sapiens
guaggugucccgccucaga

SEQ ID NO: 74360 - RNA, 19 nt, Homo sapiens
ggccuuccacucucaguaa

SEQ ID NO: 74361 - RNA, 19 nt, Homo sapiens
cuaggcgcauuucagauga

SEQ ID NO: 74362 - RNA, 19 nt, Homo sapiens
acagacagaagcuugauga

SEQ ID NO: 74363 - RNA, 19 nt, Homo sapiens
acagagcaauuaaaguuac

SEQ ID NO: 74364 - RNA, 19 nt, Homo sapiens
gaguuucaccuugaccaua

SEQ ID NO: 74365 - RNA, 19 nt, Homo sapiens
gcaguucccaagcauuuca

SEQ ID NO: 74366 - RNA, 19 nt, Homo sapiens
uaucacagagcaauuaaag

SEQ ID NO: 74367 - RNA, 19 nt, Homo sapiens
aauggcagcacgcuauuaa

SEQ ID NO: 74368 - RNA, 19 nt, Homo sapiens
gcauuucaucccucacuga

SEQ ID NO: 74369 - RNA, 19 nt, Homo sapiens
gcacuggcgcugcaacaag

SEQ ID NO: 74370 - RNA, 19 nt, Homo sapiens
ggguaacgaugaaaauuau

SEQ ID NO: 74371 - RNA, 19 nt, Homo sapiens
cacuggcgcugcaacaaga

SEQ ID NO: 74372 - RNA, 19 nt, Homo sapiens
gcagcacuccauaucucua

SEQ ID NO: 74373 - RNA, 19 nt, Homo sapiens
ccagaaggcacagacagaa

SEQ ID NO: 74374 - RNA, 19 nt, Homo sapiens
uaaaguuacaguagaugga

SEQ ID NO: 74375 - RNA, 19 nt, Homo sapiens
gcaccaccaccucgaaugg

SEQ ID NO: 74376 - RNA, 19 nt, Homo sapiens
gaccagcagcacuccauau

SEQ ID NO: 74377 - RNA, 19 nt, Homo sapiens
gcaugucccucgguauguc

SEQ ID NO: 74378 - RNA, 19 nt, Homo sapiens
cacaaauccuccccaagua

SEQ ID NO: 74379 - RNA, 19 nt, Homo sapiens
ccagaaugaugguguugac

SEQ ID NO: 74380 - RNA, 19 nt, Homo sapiens
gcacuucgucaggauccua

SEQ ID NO: 74381 - RNA, 19 nt, Homo sapiens
gcauuccucaucccaguau

SEQ ID NO: 74382 - RNA, 19 nt, Homo sapiens
ugccucugcuguuaugaaa

SEQ ID NO: 74383 - RNA, 19 nt, Homo sapiens
uggcagcacgcuauuaaau

SEQ ID NO: 74384 - RNA, 19 nt, Homo sapiens
aaccuaguuuguucucuga

SEQ ID NO: 74385 - RNA, 19 nt, Homo sapiens
auaaccgucuucacaaauc

SEQ ID NO: 74386 - RNA, 19 nt, Homo sapiens
gaggcaagaguuucaccuu

SEQ ID NO: 74387 - RNA, 19 nt, Homo sapiens
ccuaggcgcauuucagaug

SEQ ID NO: 74388 - RNA, 19 nt, Homo sapiens
gcacagacagaagcuugau

SEQ ID NO: 74389 - RNA, 19 nt, Homo sapiens
cagagcaauuaaaguuaca

SEQ ID NO: 74390 - RNA, 19 nt, Homo sapiens
cauaaccgucuucacaaau

SEQ ID NO: 74391 - RNA, 19 nt, Homo sapiens
gcaagguucaacgaucuga

SEQ ID NO: 74392 - RNA, 19 nt, Homo sapiens
ucaggauccuaucaguuuc

SEQ ID NO: 74393 - RNA, 19 nt, Homo sapiens
aggcaguucccaagcauuu

SEQ ID NO: 74394 - RNA, 19 nt, Homo sapiens
gagccaggcaggugcuuca

SEQ ID NO: 74395 - RNA, 19 nt, Homo sapiens
gaugugccuaggcgcauuu

SEQ ID NO: 74396 - RNA, 19 nt, Homo sapiens
gaaucuguuuggcgaccau

SEQ ID NO: 74397 - RNA, 19 nt, Homo sapiens
cgaauggcagcacgcuauu

SEQ ID NO: 74398 - RNA, 19 nt, Homo sapiens
ucgaauggcagcacgcuau

SEQ ID NO: 74399 - RNA, 19 nt, Homo sapiens
ccaggcaguucccaagcau

SEQ ID NO: 74400 - RNA, 19 nt, Homo sapiens
acaaggacagagucagauu

SEQ ID NO: 74401 - RNA, 19 nt, Homo sapiens
acagaagcuugaugacucu

SEQ ID NO: 74402 - RNA, 19 nt, Homo sapiens
ggaccucgggaacccagaa

SEQ ID NO: 74403 - RNA, 19 nt, Homo sapiens
cugcugagcuccggaaugc

SEQ ID NO: 74404 - RNA, 19 nt, Homo sapiens
cauggcggguaacgaugaa

SEQ ID NO: 74405 - RNA, 19 nt, Homo sapiens
cuuccacucucaguaagaa

SEQ ID NO: 74406 - RNA, 19 nt, Homo sapiens
cauuucagaugaugacacu

SEQ ID NO: 74407 - RNA, 19 nt, Homo sapiens
gcaccaaguccuuuuaauc

SEQ ID NO: 74408 - RNA, 19 nt, Homo sapiens
ugaccgccucagugauuua

SEQ ID NO: 74409 - RNA, 19 nt, Homo sapiens
ggcagcacgcuauuaaauc

SEQ ID NO: 74410 - RNA, 19 nt, Homo sapiens
gacugugguuacugucaug

SEQ ID NO: 74411 - RNA, 19 nt, Homo sapiens
ccuaucaguuucccauggu

SEQ ID NO: 74412 - RNA, 19 nt, Homo sapiens
ugaugacucuaaaccuagu

SEQ ID NO: 74413 - RNA, 19 nt, Homo sapiens
ccacucacuaccacaccua

SEQ ID NO: 74414 - RNA, 19 nt, Homo sapiens
auccagccaccuuuacuua

SEQ ID NO: 74415 - RNA, 19 nt, Homo sapiens
ccuaucacagagcaauuaa

SEQ ID NO: 74416 - RNA, 19 nt, Homo sapiens
gaaaugcucugauuagaaa

SEQ ID NO: 74417 - RNA, 19 nt, Homo sapiens
uaaacucccuuucauguua

SEQ ID NO: 74418 - RNA, 19 nt, Homo sapiens
caaaugaucuggugguuau

SEQ ID NO: 74419 - RNA, 19 nt, Homo sapiens
aaauugagcuugcuucuuu

SEQ ID NO: 74420 - RNA, 19 nt, Homo sapiens
gguaagaguuaaagaguaa

SEQ ID NO: 74421 - RNA, 19 nt, Homo sapiens
gaucagaaguauggaauuu

SEQ ID NO: 74422 - RNA, 19 nt, Homo sapiens
gagaagagcuauagcagau

SEQ ID NO: 74423 - RNA, 19 nt, Homo sapiens
caacauggauacauauuuc

SEQ ID NO: 74424 - RNA, 19 nt, Homo sapiens
gcagcuaaauuaccauaaa

SEQ ID NO: 74425 - RNA, 19 nt, Homo sapiens
caacaagggucucauaucu

SEQ ID NO: 74426 - RNA, 19 nt, Homo sapiens
gaagauauuccaacucaaa

SEQ ID NO: 74427 - RNA, 19 nt, Homo sapiens
gauaguagccaaaguuaaa

SEQ ID NO: 74428 - RNA, 19 nt, Homo sapiens
ggaaccaaaucaaugaauu

SEQ ID NO: 74429 - RNA, 19 nt, Homo sapiens
acaagggucucauaucuaa

SEQ ID NO: 74430 - RNA, 19 nt, Homo sapiens
ugugaaugcuucugauuua

SEQ ID NO: 74431 - RNA, 19 nt, Homo sapiens
uuacucaugucccuauuua

SEQ ID NO: 74432 - RNA, 19 nt, Homo sapiens
gggaacaguuaaauuugua

SEQ ID NO: 74433 - RNA, 19 nt, Homo sapiens
gaacacagccaaaguaaac

SEQ ID NO: 74434 - RNA, 19 nt, Homo sapiens
gaaugaauccuucuagaga

SEQ ID NO: 74435 - RNA, 19 nt, Homo sapiens
ucacuggauuggucauuua

SEQ ID NO: 74436 - RNA, 19 nt, Homo sapiens
ggacaaacucagaauauau

SEQ ID NO: 74437 - RNA, 19 nt, Homo sapiens
gggaaaagcuucacucuga

SEQ ID NO: 74438 - RNA, 19 nt, Homo sapiens
gaaucacacugaaugcaaa

SEQ ID NO: 74439 - RNA, 19 nt, Homo sapiens
gcuaaauacuguagggaaa

SEQ ID NO: 74440 - RNA, 19 nt, Homo sapiens
cagaugacaugagagaaua

SEQ ID NO: 74441 - RNA, 19 nt, Homo sapiens
uaauuuggguugugugaaa

SEQ ID NO: 74442 - RNA, 19 nt, Homo sapiens
ggacgaaucacacugaaug

SEQ ID NO: 74443 - RNA, 19 nt, Homo sapiens
cagcauauuugagucauuu

SEQ ID NO: 74444 - RNA, 19 nt, Homo sapiens
cacaaucagugaguaaaua

SEQ ID NO: 74445 - RNA, 19 nt, Homo sapiens
gaccaucacugucuucaca

SEQ ID NO: 74446 - RNA, 19 nt, Homo sapiens
gagccuuccucucuuugua

SEQ ID NO: 74447 - RNA, 19 nt, Homo sapiens
gaaaugacgguauaacaca

SEQ ID NO: 74448 - RNA, 19 nt, Homo sapiens
gaagagcuauagcagaucu

SEQ ID NO: 74449 - RNA, 19 nt, Homo sapiens
guaaugugaucgcuugguu

SEQ ID NO: 74450 - RNA, 19 nt, Homo sapiens
gcaccagugugacaggaaa

SEQ ID NO: 74451 - RNA, 19 nt, Homo sapiens
aaaggaacaugguuuguca

SEQ ID NO: 74452 - RNA, 19 nt, Homo sapiens
gagaagaaagagagaugua

SEQ ID NO: 74453 - RNA, 19 nt, Homo sapiens
cggacaaacucagaauaua

SEQ ID NO: 74454 - RNA, 19 nt, Homo sapiens
gcacuuugguaagaguuaa

SEQ ID NO: 74455 - RNA, 19 nt, Homo sapiens
caaugucgcuguaaauuuu

SEQ ID NO: 74456 - RNA, 19 nt, Homo sapiens
caaggucaucugauaauuu

SEQ ID NO: 74457 - RNA, 19 nt, Homo sapiens
uaucuaacuuccuccuuaa

SEQ ID NO: 74458 - RNA, 19 nt, Homo sapiens
ggcagaaacuagaugauca

SEQ ID NO: 74459 - RNA, 19 nt, Homo sapiens
acucaaauguccugcaauu

SEQ ID NO: 74460 - RNA, 19 nt, Homo sapiens
gaaccacuccacugccuuu

SEQ ID NO: 74461 - RNA, 19 nt, Homo sapiens
gagaaugcauacuuggaau

SEQ ID NO: 74462 - RNA, 19 nt, Homo sapiens
cagugugaauggcaaauaa

SEQ ID NO: 74463 - RNA, 19 nt, Homo sapiens
cauugaaccuuuacucuca

SEQ ID NO: 74464 - RNA, 19 nt, Homo sapiens
aaacagcuggacuuauuua

SEQ ID NO: 74465 - RNA, 19 nt, Homo sapiens
ccagaaguauuguuuacau

SEQ ID NO: 74466 - RNA, 19 nt, Homo sapiens
ccaaguuguuuauuccaaa

SEQ ID NO: 74467 - RNA, 19 nt, Homo sapiens
gauuggucauuuagaguuu

SEQ ID NO: 74468 - RNA, 19 nt, Homo sapiens
uccaagguguuucuagaua

SEQ ID NO: 74469 - RNA, 19 nt, Homo sapiens
ucagguagauuaagguauc

SEQ ID NO: 74470 - RNA, 19 nt, Homo sapiens
gaaggucaaucuaguucca

SEQ ID NO: 74471 - RNA, 19 nt, Homo sapiens
auaucuaacuuccuccuua

SEQ ID NO: 74472 - RNA, 19 nt, Homo sapiens
cguauggaaugcuucuuaa

SEQ ID NO: 74473 - RNA, 19 nt, Homo sapiens
uaccguagcguauacauuu

SEQ ID NO: 74474 - RNA, 19 nt, Homo sapiens
guaaauagacagccuuucu

SEQ ID NO: 74475 - RNA, 19 nt, Homo sapiens
ggauacauauuucaguucu

SEQ ID NO: 74476 - RNA, 19 nt, Homo sapiens
gaauaagccauuucuacug

SEQ ID NO: 74477 - RNA, 19 nt, Homo sapiens
cucaugcucugauuagaua

SEQ ID NO: 74478 - RNA, 19 nt, Homo sapiens
ggagucaauuugccucugu

SEQ ID NO: 74479 - RNA, 19 nt, Homo sapiens
ggagaggauuugauuucug

SEQ ID NO: 74480 - RNA, 19 nt, Homo sapiens
gccaauaauuacaucuuug

SEQ ID NO: 74481 - RNA, 19 nt, Homo sapiens
cagagaaggucaaucuagu

SEQ ID NO: 74482 - RNA, 19 nt, Homo sapiens
gcucaacaagggucucaua

SEQ ID NO: 74483 - RNA, 19 nt, Homo sapiens
ggaugcaacucgcccuguu

SEQ ID NO: 74484 - RNA, 19 nt, Homo sapiens
ccacucaaauguccugcaa

SEQ ID NO: 74485 - RNA, 19 nt, Homo sapiens
cugaagauauuccaacuca

SEQ ID NO: 74486 - RNA, 19 nt, Homo sapiens
ccaaugucgcuguaaauuu

SEQ ID NO: 74487 - RNA, 19 nt, Homo sapiens
aaacagagaaggucaaucu

SEQ ID NO: 74488 - RNA, 19 nt, Homo sapiens
gaagacaucggcagaaacu

SEQ ID NO: 74489 - RNA, 19 nt, Homo sapiens
uaaauccaguguuacaauc

SEQ ID NO: 74490 - RNA, 19 nt, Homo sapiens
caaaacauccugaaaauuc

SEQ ID NO: 74491 - RNA, 19 nt, Homo sapiens
gcaggacgaaucacacuga

SEQ ID NO: 74492 - RNA, 19 nt, Homo sapiens
gaaaguuaagguaucaaug

SEQ ID NO: 74493 - RNA, 19 nt, Homo sapiens
cagcuggacuuauuuaaaa

SEQ ID NO: 74494 - RNA, 19 nt, Homo sapiens
ugagcuugcuucuuucuug

SEQ ID NO: 74495 - RNA, 19 nt, Homo sapiens
gguauaacacaucuacuga

SEQ ID NO: 74496 - RNA, 19 nt, Homo sapiens
uggcuacaauucaaaggua

SEQ ID NO: 74497 - RNA, 19 nt, Homo sapiens
ccaaggucaucugauaauu

SEQ ID NO: 74498 - RNA, 19 nt, Homo sapiens
aaacucccuuucauguuaa

SEQ ID NO: 74499 - RNA, 19 nt, Homo sapiens
gaaagcaaacaggaagauu

SEQ ID NO: 74500 - RNA, 19 nt, Homo sapiens
gggacgcgcuggaaagcaa

SEQ ID NO: 74501 - RNA, 19 nt, Homo sapiens
gaaugcauacuuggaauga

SEQ ID NO: 74502 - RNA, 19 nt, Homo sapiens
guacaaacguauggaaugc

SEQ ID NO: 74503 - RNA, 19 nt, Homo sapiens
cgggaaaugugguccuauu

SEQ ID NO: 74504 - RNA, 19 nt, Homo sapiens
gguauccaaugucgcugua

SEQ ID NO: 74505 - RNA, 19 nt, Homo sapiens
ggaaagauucaugucacua

SEQ ID NO: 74506 - RNA, 19 nt, Homo sapiens
gcugaucauuuggcucuuu

SEQ ID NO: 74507 - RNA, 19 nt, Homo sapiens
cgauaggucucacgcaaca

SEQ ID NO: 74508 - RNA, 19 nt, Homo sapiens
gaaagauucaugucacuac

SEQ ID NO: 74509 - RNA, 19 nt, Homo sapiens
gagccacauuuacauagga

SEQ ID NO: 74510 - RNA, 19 nt, Homo sapiens
acagaacacagccaaagua

SEQ ID NO: 74511 - RNA, 19 nt, Homo sapiens
ccaaggaucagaaguaugg

SEQ ID NO: 74512 - RNA, 19 nt, Homo sapiens
cuacagcuuugggucauuu

SEQ ID NO: 74513 - RNA, 19 nt, Homo sapiens
ggaaugaauccuucuagag

SEQ ID NO: 74514 - RNA, 19 nt, Homo sapiens
uauagcagaucucggacaa

SEQ ID NO: 74515 - RNA, 19 nt, Homo sapiens
ucagaaugcaguuguugua

SEQ ID NO: 74516 - RNA, 19 nt, Homo sapiens
gaagaugcauuguaguuua

SEQ ID NO: 74517 - RNA, 19 nt, Homo sapiens
gcaaugggauguaugaaua

SEQ ID NO: 74518 - RNA, 19 nt, Homo sapiens
gaaccuaacuguaucuuga

SEQ ID NO: 74519 - RNA, 19 nt, Homo sapiens
ggaaacaucuugaccaucu

SEQ ID NO: 74520 - RNA, 19 nt, Homo sapiens
gcauuuagcuuaucauucu

SEQ ID NO: 74521 - RNA, 19 nt, Homo sapiens
gaacuccacuuugacaauu

SEQ ID NO: 74522 - RNA, 19 nt, Homo sapiens
ggacaaaugugaagaugca

SEQ ID NO: 74523 - RNA, 19 nt, Homo sapiens
gcagucagcuccucuguca

SEQ ID NO: 74524 - RNA, 19 nt, Homo sapiens
gaggagaucuggaagaaag

SEQ ID NO: 74525 - RNA, 19 nt, Homo sapiens
gcuacuaacuucccacuga

SEQ ID NO: 74526 - RNA, 19 nt, Homo sapiens
agacacagauguucgguuu

SEQ ID NO: 74527 - RNA, 19 nt, Homo sapiens
aaauaacccuucaacguuu

SEQ ID NO: 74528 - RNA, 19 nt, Homo sapiens
uaaauaacccuucaacguu

SEQ ID NO: 74529 - RNA, 19 nt, Homo sapiens
gagaagcacuccacaaugc

SEQ ID NO: 74530 - RNA, 19 nt, Homo sapiens
acaaaaggcuccauauaua

SEQ ID NO: 74531 - RNA, 19 nt, Homo sapiens
gagcagagaauauaacaug

SEQ ID NO: 74532 - RNA, 19 nt, Homo sapiens
aagcgaccaugcacuauua

SEQ ID NO: 74533 - RNA, 19 nt, Homo sapiens
gcaaugggccuuccucuuc

SEQ ID NO: 74534 - RNA, 19 nt, Homo sapiens
gaaagaugauuugcaaugg

SEQ ID NO: 74535 - RNA, 19 nt, Homo sapiens
ucaaguagcugggauuuua

SEQ ID NO: 74536 - RNA, 19 nt, Homo sapiens
aaagagagcagagaauaua

SEQ ID NO: 74537 - RNA, 19 nt, Homo sapiens
gcagaagaguggaaacauc

SEQ ID NO: 74538 - RNA, 19 nt, Homo sapiens
gcgcaagacuggccaaaca

SEQ ID NO: 74539 - RNA, 19 nt, Homo sapiens
acacaucccugucauuguu

SEQ ID NO: 74540 - RNA, 19 nt, Homo sapiens
gugagaaaccuguaucuuu

SEQ ID NO: 74541 - RNA, 19 nt, Homo sapiens
agagagagguggagugcua

SEQ ID NO: 74542 - RNA, 19 nt, Homo sapiens
guaguucucuugguguuaa

SEQ ID NO: 74543 - RNA, 19 nt, Homo sapiens
ggauacagcaguagacauu

SEQ ID NO: 74544 - RNA, 19 nt, Homo sapiens
gagaguugcuggaauugug

SEQ ID NO: 74545 - RNA, 19 nt, Homo sapiens
gcauuguaguuuaaccaua

SEQ ID NO: 74546 - RNA, 19 nt, Homo sapiens
accaagagauugcuaauug

SEQ ID NO: 74547 - RNA, 19 nt, Homo sapiens
gagagaaccuaacuguauc

SEQ ID NO: 74548 - RNA, 19 nt, Homo sapiens
uaaauguguuggacaaaug

SEQ ID NO: 74549 - RNA, 19 nt, Homo sapiens
ggaaggagacacagauguu

SEQ ID NO: 74550 - RNA, 19 nt, Homo sapiens
guaaauguguuggacaaau

SEQ ID NO: 74551 - RNA, 19 nt, Homo sapiens
aaacacuucuguccuguga

SEQ ID NO: 74552 - RNA, 19 nt, Homo sapiens
gaggcgaacuccagacaga

SEQ ID NO: 74553 - RNA, 19 nt, Homo sapiens
guugcuaacugaacuuuga

SEQ ID NO: 74554 - RNA, 19 nt, Homo sapiens
gaaaagagagcagagaaua

SEQ ID NO: 74555 - RNA, 19 nt, Homo sapiens
ggaaagacaacacaaccaa

SEQ ID NO: 74556 - RNA, 19 nt, Homo sapiens
gaagcaccaucacaucugu

SEQ ID NO: 74557 - RNA, 19 nt, Homo sapiens
caacagagagggccaagau

SEQ ID NO: 74558 - RNA, 19 nt, Homo sapiens
gcaagguuccacagaguaa

SEQ ID NO: 74559 - RNA, 19 nt, Homo sapiens
gcacauauacacacacaca

SEQ ID NO: 74560 - RNA, 19 nt, Homo sapiens
gcgcagaugugcagcagau

SEQ ID NO: 74561 - RNA, 19 nt, Homo sapiens
gcuaauugcuguugaaagc

SEQ ID NO: 74562 - RNA, 19 nt, Homo sapiens
aaacacagagggccaguaa

SEQ ID NO: 74563 - RNA, 19 nt, Homo sapiens
caagagagaaccuaacugu

SEQ ID NO: 74564 - RNA, 19 nt, Homo sapiens
caacacaaccaacgcgaaa

SEQ ID NO: 74565 - RNA, 19 nt, Homo sapiens
gcggaaagcccacgacaug

SEQ ID NO: 74566 - RNA, 19 nt, Homo sapiens
agagagaaccuaacuguau

SEQ ID NO: 74567 - RNA, 19 nt, Homo sapiens
gaucacagacuaacagaca

SEQ ID NO: 74568 - RNA, 19 nt, Homo sapiens
cgacaacguuaacuaaugg

SEQ ID NO: 74569 - RNA, 19 nt, Homo sapiens
uauuccagcucauucauuu

SEQ ID NO: 74570 - RNA, 19 nt, Homo sapiens
gcagagaauauaacaugaa

SEQ ID NO: 74571 - RNA, 19 nt, Homo sapiens
ggacagaaacagaccuaug

SEQ ID NO: 74572 - RNA, 19 nt, Homo sapiens
cccaauggcuucagcaaug

SEQ ID NO: 74573 - RNA, 19 nt, Homo sapiens
ccacauuucugcuccaagu

SEQ ID NO: 74574 - RNA, 19 nt, Homo sapiens
gcacacacaucccugucau

SEQ ID NO: 74575 - RNA, 19 nt, Homo sapiens
gcacaaagacugggagaag

SEQ ID NO: 74576 - RNA, 19 nt, Homo sapiens
aaccauaugcccacauuua

SEQ ID NO: 74577 - RNA, 19 nt, Homo sapiens
agacucagccugcaguuaa

SEQ ID NO: 74578 - RNA, 19 nt, Homo sapiens
acacacacacgcacauaua

SEQ ID NO: 74579 - RNA, 19 nt, Homo sapiens
ccgauacuguggcucauuu

SEQ ID NO: 74580 - RNA, 19 nt, Homo sapiens
guaaugacuuauuguggau

SEQ ID NO: 74581 - RNA, 19 nt, Homo sapiens
cgagauaggagaaagaguu

SEQ ID NO: 74582 - RNA, 19 nt, Homo sapiens
gcccacauuuagucucuuu

SEQ ID NO: 74583 - RNA, 19 nt, Homo sapiens
ugaaagaugauuugcaaug

SEQ ID NO: 74584 - RNA, 19 nt, Homo sapiens
gacaugaucacaacagaga

SEQ ID NO: 74585 - RNA, 19 nt, Homo sapiens
ggaaagcccacgacaugau

SEQ ID NO: 74586 - RNA, 19 nt, Homo sapiens
ugacauuucacccgagaua

SEQ ID NO: 74587 - RNA, 19 nt, Homo sapiens
gacgugaacucagaacugu

SEQ ID NO: 74588 - RNA, 19 nt, Homo sapiens
guacuaaggcggugucaag

SEQ ID NO: 74589 - RNA, 19 nt, Homo sapiens
ccagacagaaccaaagaaa

SEQ ID NO: 74590 - RNA, 19 nt, Homo sapiens
ccgacaacguuaacuaaug

SEQ ID NO: 74591 - RNA, 19 nt, Homo sapiens
ccugugagguuucccaaug

SEQ ID NO: 74592 - RNA, 19 nt, Homo sapiens
gcaguuaauuagcauucug

SEQ ID NO: 74593 - RNA, 19 nt, Homo sapiens
gcagaugugcagcagauug

SEQ ID NO: 74594 - RNA, 19 nt, Homo sapiens
uggcacacgucaagaagaa

SEQ ID NO: 74595 - RNA, 19 nt, Homo sapiens
caacguuucuucacuuuug

SEQ ID NO: 74596 - RNA, 19 nt, Homo sapiens
uaaccgaugcuuuaccaaa

SEQ ID NO: 74597 - RNA, 19 nt, Homo sapiens
cuaaauaacccuucaacgu

SEQ ID NO: 74598 - RNA, 19 nt, Homo sapiens
gaauacagcagcaagaaaa

SEQ ID NO: 74599 - RNA, 19 nt, Homo sapiens
ccucagaugcucaaaguug

SEQ ID NO: 74600 - RNA, 19 nt, Homo sapiens
ggaacgcgcuugcuuuuag

SEQ ID NO: 74601 - RNA, 19 nt, Homo sapiens
aaaccuguaucuuucuaug

SEQ ID NO: 74602 - RNA, 19 nt, Homo sapiens
gugaagaugcauuguaguu

SEQ ID NO: 74603 - RNA, 19 nt, Homo sapiens
ucauuguucugccuaaaga

SEQ ID NO: 74604 - RNA, 19 nt, Homo sapiens
acacacacacacacaagua

SEQ ID NO: 74605 - RNA, 19 nt, Homo sapiens
cucauuaaccgaugcuuua

SEQ ID NO: 74606 - RNA, 19 nt, Homo sapiens
ggagaagcaccaucacauc

SEQ ID NO: 74607 - RNA, 19 nt, Homo sapiens
gcaagacuggccaaacaga

SEQ ID NO: 74608 - RNA, 19 nt, Homo sapiens
agacagggcuggguucaag

SEQ ID NO: 74609 - RNA, 19 nt, Homo sapiens
aagcagaccgggaagaauu

SEQ ID NO: 74610 - RNA, 19 nt, Homo sapiens
cuaaggcggugucaagaag

SEQ ID NO: 74611 - RNA, 19 nt, Homo sapiens
caucuugaccaucuguuaa

SEQ ID NO: 74612 - RNA, 19 nt, Homo sapiens
gcacacgucaagaagaaau

SEQ ID NO: 74613 - RNA, 19 nt, Homo sapiens
gacagaaacagaccuaugg

SEQ ID NO: 74614 - RNA, 19 nt, Homo sapiens
ccuccucucuggcuaauca

SEQ ID NO: 74615 - RNA, 19 nt, Homo sapiens
gaugugaagacgcaaucua

SEQ ID NO: 74616 - RNA, 19 nt, Homo sapiens
gaagaugcauuguaguuua

SEQ ID NO: 74617 - RNA, 19 nt, Homo sapiens
gcaaugggauguaugaaua

SEQ ID NO: 74618 - RNA, 19 nt, Homo sapiens
gaaccuaacuguaucuuga

SEQ ID NO: 74619 - RNA, 19 nt, Homo sapiens
ggaaacaucuugaccaucu

SEQ ID NO: 74620 - RNA, 19 nt, Homo sapiens
gaacuccacuuugacaauu

SEQ ID NO: 74621 - RNA, 19 nt, Homo sapiens
ggacaaaugugaagaugca

SEQ ID NO: 74622 - RNA, 19 nt, Homo sapiens
gaaauuagcagagcgauug

SEQ ID NO: 74623 - RNA, 19 nt, Homo sapiens
gcagucagcuccucuguca

SEQ ID NO: 74624 - RNA, 19 nt, Homo sapiens
gcacugaguuuaguaauag

SEQ ID NO: 74625 - RNA, 19 nt, Homo sapiens
gaggagaucuggaagaaag

SEQ ID NO: 74626 - RNA, 19 nt, Homo sapiens
gcuacuaacuucccacuga

SEQ ID NO: 74627 - RNA, 19 nt, Homo sapiens
agacacagauguucgguuu

SEQ ID NO: 74628 - RNA, 19 nt, Homo sapiens
aaauaacccuucaacguuu

SEQ ID NO: 74629 - RNA, 19 nt, Homo sapiens
uaaauaacccuucaacguu

SEQ ID NO: 74630 - RNA, 19 nt, Homo sapiens
gagaagcacuccacaaugc

SEQ ID NO: 74631 - RNA, 19 nt, Homo sapiens
acaaaaggcuccauauaua

SEQ ID NO: 74632 - RNA, 19 nt, Homo sapiens
gagcagagaauauaacaug

SEQ ID NO: 74633 - RNA, 19 nt, Homo sapiens
aagcgaccaugcacuauua

SEQ ID NO: 74634 - RNA, 19 nt, Homo sapiens
gcaaugggccuuccucuuc

SEQ ID NO: 74635 - RNA, 19 nt, Homo sapiens
gaaagaugauuugcaaugg

SEQ ID NO: 74636 - RNA, 19 nt, Homo sapiens
ucaaguagcugggauuuua

SEQ ID NO: 74637 - RNA, 19 nt, Homo sapiens
aaagagagcagagaauaua

SEQ ID NO: 74638 - RNA, 19 nt, Homo sapiens
gcagaagaguggaaacauc

SEQ ID NO: 74639 - RNA, 19 nt, Homo sapiens
gcgcaagacuggccaaaca

SEQ ID NO: 74640 - RNA, 19 nt, Homo sapiens
gugagaaaccuguaucuuu

SEQ ID NO: 74641 - RNA, 19 nt, Homo sapiens
guaguucucuugguguuaa

SEQ ID NO: 74642 - RNA, 19 nt, Homo sapiens
ggauacagcaguagacauu

SEQ ID NO: 74643 - RNA, 19 nt, Homo sapiens
gagaguugcuggaauugug

SEQ ID NO: 74644 - RNA, 19 nt, Homo sapiens
gcauuguaguuuaaccaua

SEQ ID NO: 74645 - RNA, 19 nt, Homo sapiens
accaagagauugcuaauug

SEQ ID NO: 74646 - RNA, 19 nt, Homo sapiens
gagagaaccuaacuguauc

SEQ ID NO: 74647 - RNA, 19 nt, Homo sapiens
uaaauguguuggacaaaug

SEQ ID NO: 74648 - RNA, 19 nt, Homo sapiens
ggaaggagacacagauguu

SEQ ID NO: 74649 - RNA, 19 nt, Homo sapiens
guaaauguguuggacaaau

SEQ ID NO: 74650 - RNA, 19 nt, Homo sapiens
aaacacuucuguccuguga

SEQ ID NO: 74651 - RNA, 19 nt, Homo sapiens
gaggcgaacuccagacaga

SEQ ID NO: 74652 - RNA, 19 nt, Homo sapiens
guugcuaacugaacuuuga

SEQ ID NO: 74653 - RNA, 19 nt, Homo sapiens
gaaaagagagcagagaaua

SEQ ID NO: 74654 - RNA, 19 nt, Homo sapiens
ggaaagacaacacaaccaa

SEQ ID NO: 74655 - RNA, 19 nt, Homo sapiens
gaagcaccaucacaucugu

SEQ ID NO: 74656 - RNA, 19 nt, Homo sapiens
caacagagagggccaagau

SEQ ID NO: 74657 - RNA, 19 nt, Homo sapiens
ggagagcacugaguuuagu

SEQ ID NO: 74658 - RNA, 19 nt, Homo sapiens
gcaagguuccacagaguaa

SEQ ID NO: 74659 - RNA, 19 nt, Homo sapiens
gcacauauacacacacaca

SEQ ID NO: 74660 - RNA, 19 nt, Homo sapiens
gcgcagaugugcagcagau

SEQ ID NO: 74661 - RNA, 19 nt, Homo sapiens
gcuaauugcuguugaaagc

SEQ ID NO: 74662 - RNA, 19 nt, Homo sapiens
aaacacagagggccaguaa

SEQ ID NO: 74663 - RNA, 19 nt, Homo sapiens
caagagagaaccuaacugu

SEQ ID NO: 74664 - RNA, 19 nt, Homo sapiens
caacacaaccaacgcgaaa

SEQ ID NO: 74665 - RNA, 19 nt, Homo sapiens
gcggaaagcccacgacaug

SEQ ID NO: 74666 - RNA, 19 nt, Homo sapiens
agagagaaccuaacuguau

SEQ ID NO: 74667 - RNA, 19 nt, Homo sapiens
gaucacagacuaacagaca

SEQ ID NO: 74668 - RNA, 19 nt, Homo sapiens
cgacaacguuaacuaaugg

SEQ ID NO: 74669 - RNA, 19 nt, Homo sapiens
uauuccagcucauucauuu

SEQ ID NO: 74670 - RNA, 19 nt, Homo sapiens
gcagagaauauaacaugaa

SEQ ID NO: 74671 - RNA, 19 nt, Homo sapiens
ggacagaaacagaccuaug

SEQ ID NO: 74672 - RNA, 19 nt, Homo sapiens
cccaauggcuucagcaaug

SEQ ID NO: 74673 - RNA, 19 nt, Homo sapiens
gcacaaagacugggagaag

SEQ ID NO: 74674 - RNA, 19 nt, Homo sapiens
aaccauaugcccacauuua

SEQ ID NO: 74675 - RNA, 19 nt, Homo sapiens
agacucagccugcaguuaa

SEQ ID NO: 74676 - RNA, 19 nt, Homo sapiens
acacacacacgcacauaua

SEQ ID NO: 74677 - RNA, 19 nt, Homo sapiens
ccgauacuguggcucauuu

SEQ ID NO: 74678 - RNA, 19 nt, Homo sapiens
ggagaaugauaucugucaa

SEQ ID NO: 74679 - RNA, 19 nt, Homo sapiens
guaaugacuuauuguggau

SEQ ID NO: 74680 - RNA, 19 nt, Homo sapiens
cgagauaggagaaagaguu

SEQ ID NO: 74681 - RNA, 19 nt, Homo sapiens
gcccacauuuagucucuuu

SEQ ID NO: 74682 - RNA, 19 nt, Homo sapiens
ugaaagaugauuugcaaug

SEQ ID NO: 74683 - RNA, 19 nt, Homo sapiens
aagggaacuuugaauauug

SEQ ID NO: 74684 - RNA, 19 nt, Homo sapiens
gacaugaucacaacagaga

SEQ ID NO: 74685 - RNA, 19 nt, Homo sapiens
ggaaagcccacgacaugau

SEQ ID NO: 74686 - RNA, 19 nt, Homo sapiens
gagaaugauaucugucaaa

SEQ ID NO: 74687 - RNA, 19 nt, Homo sapiens
ugacauuucacccgagaua

SEQ ID NO: 74688 - RNA, 19 nt, Homo sapiens
gacgugaacucagaacugu

SEQ ID NO: 74689 - RNA, 19 nt, Homo sapiens
guacuaaggcggugucaag

SEQ ID NO: 74690 - RNA, 19 nt, Homo sapiens
ccagacagaaccaaagaaa

SEQ ID NO: 74691 - RNA, 19 nt, Homo sapiens
ccgacaacguuaacuaaug

SEQ ID NO: 74692 - RNA, 19 nt, Homo sapiens
ccugugagguuucccaaug

SEQ ID NO: 74693 - RNA, 19 nt, Homo sapiens
gcaguuaauuagcauucug

SEQ ID NO: 74694 - RNA, 19 nt, Homo sapiens
gcagaugugcagcagauug

SEQ ID NO: 74695 - RNA, 19 nt, Homo sapiens
uggcacacgucaagaagaa

SEQ ID NO: 74696 - RNA, 19 nt, Homo sapiens
caacguuucuucacuuuug

SEQ ID NO: 74697 - RNA, 19 nt, Homo sapiens
uaaccgaugcuuuaccaaa

SEQ ID NO: 74698 - RNA, 19 nt, Homo sapiens
gguggagaaugauaucugu

SEQ ID NO: 74699 - RNA, 19 nt, Homo sapiens
cuaaauaacccuucaacgu

SEQ ID NO: 74700 - RNA, 19 nt, Homo sapiens
gaauacagcagcaagaaaa

SEQ ID NO: 74701 - RNA, 19 nt, Homo sapiens
ccucagaugcucaaaguug

SEQ ID NO: 74702 - RNA, 19 nt, Homo sapiens
aaaccuguaucuuucuaug

SEQ ID NO: 74703 - RNA, 19 nt, Homo sapiens
gugaagaugcauuguaguu

SEQ ID NO: 74704 - RNA, 19 nt, Homo sapiens
acacacacacacacaagua

SEQ ID NO: 74705 - RNA, 19 nt, Homo sapiens
cucauuaaccgaugcuuua

SEQ ID NO: 74706 - RNA, 19 nt, Homo sapiens
ggagaagcaccaucacauc

SEQ ID NO: 74707 - RNA, 19 nt, Homo sapiens
gcaagacuggccaaacaga

SEQ ID NO: 74708 - RNA, 19 nt, Homo sapiens
ggaaauuagcagagcgauu

SEQ ID NO: 74709 - RNA, 19 nt, Homo sapiens
gaugugaagacgcaaucua

SEQ ID NO: 74710 - RNA, 19 nt, Homo sapiens
aagcagaccgggaagaauu

SEQ ID NO: 74711 - RNA, 19 nt, Homo sapiens
cuaaggcggugucaagaag

SEQ ID NO: 74712 - RNA, 19 nt, Homo sapiens
caucuugaccaucuguuaa

SEQ ID NO: 74713 - RNA, 19 nt, Homo sapiens
gcacacgucaagaagaaau

SEQ ID NO: 74714 - RNA, 19 nt, Homo sapiens
gacagaaacagaccuaugg

SEQ ID NO: 74715 - RNA, 19 nt, Homo sapiens
ccuccucucuggcuaauca

SEQ ID NO: 74716 - RNA, 19 nt, Homo sapiens
gaagaugcauuguaguuua

SEQ ID NO: 74717 - RNA, 19 nt, Homo sapiens
gcaaugggauguaugaaua

SEQ ID NO: 74718 - RNA, 19 nt, Homo sapiens
gaaccuaacuguaucuuga

SEQ ID NO: 74719 - RNA, 19 nt, Homo sapiens
ggaaacaucuugaccaucu

SEQ ID NO: 74720 - RNA, 19 nt, Homo sapiens
gaacuccacuuugacaauu

SEQ ID NO: 74721 - RNA, 19 nt, Homo sapiens
ggacaaaugugaagaugca

SEQ ID NO: 74722 - RNA, 19 nt, Homo sapiens
gcagucagcuccucuguca

SEQ ID NO: 74723 - RNA, 19 nt, Homo sapiens
gaggagaucuggaagaaag

SEQ ID NO: 74724 - RNA, 19 nt, Homo sapiens
gcuacuaacuucccacuga

SEQ ID NO: 74725 - RNA, 19 nt, Homo sapiens
agacacagauguucgguuu

SEQ ID NO: 74726 - RNA, 19 nt, Homo sapiens
cggagagaauuuacauuua

SEQ ID NO: 74727 - RNA, 19 nt, Homo sapiens
aaauaacccuucaacguuu

SEQ ID NO: 74728 - RNA, 19 nt, Homo sapiens
uaaauaacccuucaacguu

SEQ ID NO: 74729 - RNA, 19 nt, Homo sapiens
gagaagcacuccacaaugc

SEQ ID NO: 74730 - RNA, 19 nt, Homo sapiens
acaaaaggcuccauauaua

SEQ ID NO: 74731 - RNA, 19 nt, Homo sapiens
gagcagagaauauaacaug

SEQ ID NO: 74732 - RNA, 19 nt, Homo sapiens
aagcgaccaugcacuauua

SEQ ID NO: 74733 - RNA, 19 nt, Homo sapiens
gcaaugggccuuccucuuc

SEQ ID NO: 74734 - RNA, 19 nt, Homo sapiens
gaaagaugauuugcaaugg

SEQ ID NO: 74735 - RNA, 19 nt, Homo sapiens
ucaaguagcugggauuuua

SEQ ID NO: 74736 - RNA, 19 nt, Homo sapiens
aaagagagcagagaauaua

SEQ ID NO: 74737 - RNA, 19 nt, Homo sapiens
gcagaagaguggaaacauc

SEQ ID NO: 74738 - RNA, 19 nt, Homo sapiens
gcgcaagacuggccaaaca

SEQ ID NO: 74739 - RNA, 19 nt, Homo sapiens
gugagaaaccuguaucuuu

SEQ ID NO: 74740 - RNA, 19 nt, Homo sapiens
gcggagagaauuuacauuu

SEQ ID NO: 74741 - RNA, 19 nt, Homo sapiens
guaguucucuugguguuaa

SEQ ID NO: 74742 - RNA, 19 nt, Homo sapiens
ggauacagcaguagacauu

SEQ ID NO: 74743 - RNA, 19 nt, Homo sapiens
gagaguugcuggaauugug

SEQ ID NO: 74744 - RNA, 19 nt, Homo sapiens
gcauuguaguuuaaccaua

SEQ ID NO: 74745 - RNA, 19 nt, Homo sapiens
accaagagauugcuaauug

SEQ ID NO: 74746 - RNA, 19 nt, Homo sapiens
gagagaaccuaacuguauc

SEQ ID NO: 74747 - RNA, 19 nt, Homo sapiens
uaaauguguuggacaaaug

SEQ ID NO: 74748 - RNA, 19 nt, Homo sapiens
ggaaggagacacagauguu

SEQ ID NO: 74749 - RNA, 19 nt, Homo sapiens
guaaauguguuggacaaau

SEQ ID NO: 74750 - RNA, 19 nt, Homo sapiens
aaacacuucuguccuguga

SEQ ID NO: 74751 - RNA, 19 nt, Homo sapiens
gaggcgaacuccagacaga

SEQ ID NO: 74752 - RNA, 19 nt, Homo sapiens
guugcuaacugaacuuuga

SEQ ID NO: 74753 - RNA, 19 nt, Homo sapiens
gaaaagagagcagagaaua

SEQ ID NO: 74754 - RNA, 19 nt, Homo sapiens
ggaaagacaacacaaccaa

SEQ ID NO: 74755 - RNA, 19 nt, Homo sapiens
gaagcaccaucacaucugu

SEQ ID NO: 74756 - RNA, 19 nt, Homo sapiens
caacagagagggccaagau

SEQ ID NO: 74757 - RNA, 19 nt, Homo sapiens
gcaagguuccacagaguaa

SEQ ID NO: 74758 - RNA, 19 nt, Homo sapiens
gcacauauacacacacaca

SEQ ID NO: 74759 - RNA, 19 nt, Homo sapiens
gcgcagaugugcagcagau

SEQ ID NO: 74760 - RNA, 19 nt, Homo sapiens
gcuaauugcuguugaaagc

SEQ ID NO: 74761 - RNA, 19 nt, Homo sapiens
aaacacagagggccaguaa

SEQ ID NO: 74762 - RNA, 19 nt, Homo sapiens
caagagagaaccuaacugu

SEQ ID NO: 74763 - RNA, 19 nt, Homo sapiens
caacacaaccaacgcgaaa

SEQ ID NO: 74764 - RNA, 19 nt, Homo sapiens
gcggaaagcccacgacaug

SEQ ID NO: 74765 - RNA, 19 nt, Homo sapiens
agagagaaccuaacuguau

SEQ ID NO: 74766 - RNA, 19 nt, Homo sapiens
gaucacagacuaacagaca

SEQ ID NO: 74767 - RNA, 19 nt, Homo sapiens
cgacaacguuaacuaaugg

SEQ ID NO: 74768 - RNA, 19 nt, Homo sapiens
uauuccagcucauucauuu

SEQ ID NO: 74769 - RNA, 19 nt, Homo sapiens
gcagagaauauaacaugaa

SEQ ID NO: 74770 - RNA, 19 nt, Homo sapiens
ggacagaaacagaccuaug

SEQ ID NO: 74771 - RNA, 19 nt, Homo sapiens
cccaauggcuucagcaaug

SEQ ID NO: 74772 - RNA, 19 nt, Homo sapiens
gcacaaagacugggagaag

SEQ ID NO: 74773 - RNA, 19 nt, Homo sapiens
aaccauaugcccacauuua

SEQ ID NO: 74774 - RNA, 19 nt, Homo sapiens
agacucagccugcaguuaa

SEQ ID NO: 74775 - RNA, 19 nt, Homo sapiens
acacacacacgcacauaua

SEQ ID NO: 74776 - RNA, 19 nt, Homo sapiens
ccgauacuguggcucauuu

SEQ ID NO: 74777 - RNA, 19 nt, Homo sapiens
guaaugacuuauuguggau

SEQ ID NO: 74778 - RNA, 19 nt, Homo sapiens
cgagauaggagaaagaguu

SEQ ID NO: 74779 - RNA, 19 nt, Homo sapiens
agacaggacucaccgagau

SEQ ID NO: 74780 - RNA, 19 nt, Homo sapiens
gcccacauuuagucucuuu

SEQ ID NO: 74781 - RNA, 19 nt, Homo sapiens
ugaaagaugauuugcaaug

SEQ ID NO: 74782 - RNA, 19 nt, Homo sapiens
gacaugaucacaacagaga

SEQ ID NO: 74783 - RNA, 19 nt, Homo sapiens
ggaaagcccacgacaugau

SEQ ID NO: 74784 - RNA, 19 nt, Homo sapiens
ugacauuucacccgagaua

SEQ ID NO: 74785 - RNA, 19 nt, Homo sapiens
gacgugaacucagaacugu

SEQ ID NO: 74786 - RNA, 19 nt, Homo sapiens
guacuaaggcggugucaag

SEQ ID NO: 74787 - RNA, 19 nt, Homo sapiens
ccagacagaaccaaagaaa

SEQ ID NO: 74788 - RNA, 19 nt, Homo sapiens
ccgacaacguuaacuaaug

SEQ ID NO: 74789 - RNA, 19 nt, Homo sapiens
ccugugagguuucccaaug

SEQ ID NO: 74790 - RNA, 19 nt, Homo sapiens
gcaguuaauuagcauucug

SEQ ID NO: 74791 - RNA, 19 nt, Homo sapiens
gcagaugugcagcagauug

SEQ ID NO: 74792 - RNA, 19 nt, Homo sapiens
uggcacacgucaagaagaa

SEQ ID NO: 74793 - RNA, 19 nt, Homo sapiens
caacguuucuucacuuuug

SEQ ID NO: 74794 - RNA, 19 nt, Homo sapiens
uaaccgaugcuuuaccaaa

SEQ ID NO: 74795 - RNA, 19 nt, Homo sapiens
cuaaauaacccuucaacgu

SEQ ID NO: 74796 - RNA, 19 nt, Homo sapiens
gaauacagcagcaagaaaa

SEQ ID NO: 74797 - RNA, 19 nt, Homo sapiens
ccucagaugcucaaaguug

SEQ ID NO: 74798 - RNA, 19 nt, Homo sapiens
aaaccuguaucuuucuaug

SEQ ID NO: 74799 - RNA, 19 nt, Homo sapiens
gugaagaugcauuguaguu

SEQ ID NO: 74800 - RNA, 19 nt, Homo sapiens
acacacacacacacaagua

SEQ ID NO: 74801 - RNA, 19 nt, Homo sapiens
gagaagugaagauguaaca

SEQ ID NO: 74802 - RNA, 19 nt, Homo sapiens
cucauuaaccgaugcuuua

SEQ ID NO: 74803 - RNA, 19 nt, Homo sapiens
ggagaagcaccaucacauc

SEQ ID NO: 74804 - RNA, 19 nt, Homo sapiens
gcaagacuggccaaacaga

SEQ ID NO: 74805 - RNA, 19 nt, Homo sapiens
gaugugaagacgcaaucua

SEQ ID NO: 74806 - RNA, 19 nt, Homo sapiens
gcagagugagaaagagaaa

SEQ ID NO: 74807 - RNA, 19 nt, Homo sapiens
aagcagaccgggaagaauu

SEQ ID NO: 74808 - RNA, 19 nt, Homo sapiens
cuaaggcggugucaagaag

SEQ ID NO: 74809 - RNA, 19 nt, Homo sapiens
caucuugaccaucuguuaa

SEQ ID NO: 74810 - RNA, 19 nt, Homo sapiens
gcacacgucaagaagaaau

SEQ ID NO: 74811 - RNA, 19 nt, Homo sapiens
gacagaaacagaccuaugg

SEQ ID NO: 74812 - RNA, 19 nt, Homo sapiens
ccuccucucuggcuaauca

SEQ ID NO: 74813 - RNA, 19 nt, Homo sapiens
uuaaccauaugcccacauu

SEQ ID NO: 74814 - RNA, 19 nt, Homo sapiens
gaaggagacacagauguuc

SEQ ID NO: 74815 - RNA, 19 nt, Homo sapiens
caaaccaagagauugcuaa

SEQ ID NO: 74816 - RNA, 19 nt, Homo sapiens
gaagaugcauuguaguuua

SEQ ID NO: 74817 - RNA, 19 nt, Homo sapiens
gcaaugggauguaugaaua

SEQ ID NO: 74818 - RNA, 19 nt, Homo sapiens
gaaccuaacuguaucuuga

SEQ ID NO: 74819 - RNA, 19 nt, Homo sapiens
ggaaacaucuugaccaucu

SEQ ID NO: 74820 - RNA, 19 nt, Homo sapiens
gaacuccacuuugacaauu

SEQ ID NO: 74821 - RNA, 19 nt, Homo sapiens
ggacaaaugugaagaugca

SEQ ID NO: 74822 - RNA, 19 nt, Homo sapiens
gcagucagcuccucuguca

SEQ ID NO: 74823 - RNA, 19 nt, Homo sapiens
aaacugaggugcuuaagga

SEQ ID NO: 74824 - RNA, 19 nt, Homo sapiens
gaggagaucuggaagaaag

SEQ ID NO: 74825 - RNA, 19 nt, Homo sapiens
gcuacuaacuucccacuga

SEQ ID NO: 74826 - RNA, 19 nt, Homo sapiens
agacacagauguucgguuu

SEQ ID NO: 74827 - RNA, 19 nt, Homo sapiens
aaauaacccuucaacguuu

SEQ ID NO: 74828 - RNA, 19 nt, Homo sapiens
uaaauaacccuucaacguu

SEQ ID NO: 74829 - RNA, 19 nt, Homo sapiens
gagaagcacuccacaaugc

SEQ ID NO: 74830 - RNA, 19 nt, Homo sapiens
acaaaaggcuccauauaua

SEQ ID NO: 74831 - RNA, 19 nt, Homo sapiens
gagcagagaauauaacaug

SEQ ID NO: 74832 - RNA, 19 nt, Homo sapiens
aagcgaccaugcacuauua

SEQ ID NO: 74833 - RNA, 19 nt, Homo sapiens
gcaaugggccuuccucuuc

SEQ ID NO: 74834 - RNA, 19 nt, Homo sapiens
caagguagcaucugccuaa

SEQ ID NO: 74835 - RNA, 19 nt, Homo sapiens
gaaagaugauuugcaaugg

SEQ ID NO: 74836 - RNA, 19 nt, Homo sapiens
ucaaguagcugggauuuua

SEQ ID NO: 74837 - RNA, 19 nt, Homo sapiens
aaagagagcagagaauaua

SEQ ID NO: 74838 - RNA, 19 nt, Homo sapiens
gcagaagaguggaaacauc

SEQ ID NO: 74839 - RNA, 19 nt, Homo sapiens
gcgcaagacuggccaaaca

SEQ ID NO: 74840 - RNA, 19 nt, Homo sapiens
gugagaaaccuguaucuuu

SEQ ID NO: 74841 - RNA, 19 nt, Homo sapiens
guaguucucuugguguuaa

SEQ ID NO: 74842 - RNA, 19 nt, Homo sapiens
ggauacagcaguagacauu

SEQ ID NO: 74843 - RNA, 19 nt, Homo sapiens
gagaguugcuggaauugug

SEQ ID NO: 74844 - RNA, 19 nt, Homo sapiens
gcauuguaguuuaaccaua

SEQ ID NO: 74845 - RNA, 19 nt, Homo sapiens
accaagagauugcuaauug

SEQ ID NO: 74846 - RNA, 19 nt, Homo sapiens
gagagaaccuaacuguauc

SEQ ID NO: 74847 - RNA, 19 nt, Homo sapiens
uaaauguguuggacaaaug

SEQ ID NO: 74848 - RNA, 19 nt, Homo sapiens
ggaaggagacacagauguu

SEQ ID NO: 74849 - RNA, 19 nt, Homo sapiens
guaaauguguuggacaaau

SEQ ID NO: 74850 - RNA, 19 nt, Homo sapiens
aaacacuucuguccuguga

SEQ ID NO: 74851 - RNA, 19 nt, Homo sapiens
gaggcgaacuccagacaga

SEQ ID NO: 74852 - RNA, 19 nt, Homo sapiens
gauguugaauuucuucugu

SEQ ID NO: 74853 - RNA, 19 nt, Homo sapiens
guugcuaacugaacuuuga

SEQ ID NO: 74854 - RNA, 19 nt, Homo sapiens
gaaaagagagcagagaaua

SEQ ID NO: 74855 - RNA, 19 nt, Homo sapiens
ggaaagacaacacaaccaa

SEQ ID NO: 74856 - RNA, 19 nt, Homo sapiens
gaagcaccaucacaucugu

SEQ ID NO: 74857 - RNA, 19 nt, Homo sapiens
caacagagagggccaagau

SEQ ID NO: 74858 - RNA, 19 nt, Homo sapiens
gcaagguuccacagaguaa

SEQ ID NO: 74859 - RNA, 19 nt, Homo sapiens
gcacauauacacacacaca

SEQ ID NO: 74860 - RNA, 19 nt, Homo sapiens
gcgcagaugugcagcagau

SEQ ID NO: 74861 - RNA, 19 nt, Homo sapiens
gcuaauugcuguugaaagc

SEQ ID NO: 74862 - RNA, 19 nt, Homo sapiens
aaacacagagggccaguaa

SEQ ID NO: 74863 - RNA, 19 nt, Homo sapiens
caagagagaaccuaacugu

SEQ ID NO: 74864 - RNA, 19 nt, Homo sapiens
caacacaaccaacgcgaaa

SEQ ID NO: 74865 - RNA, 19 nt, Homo sapiens
gcggaaagcccacgacaug

SEQ ID NO: 74866 - RNA, 19 nt, Homo sapiens
agagagaaccuaacuguau

SEQ ID NO: 74867 - RNA, 19 nt, Homo sapiens
gaucacagacuaacagaca

SEQ ID NO: 74868 - RNA, 19 nt, Homo sapiens
cgacaacguuaacuaaugg

SEQ ID NO: 74869 - RNA, 19 nt, Homo sapiens
uauuccagcucauucauuu

SEQ ID NO: 74870 - RNA, 19 nt, Homo sapiens
gcagagaauauaacaugaa

SEQ ID NO: 74871 - RNA, 19 nt, Homo sapiens
ggacagaaacagaccuaug

SEQ ID NO: 74872 - RNA, 19 nt, Homo sapiens
cccaauggcuucagcaaug

SEQ ID NO: 74873 - RNA, 19 nt, Homo sapiens
gcacaaagacugggagaag

SEQ ID NO: 74874 - RNA, 19 nt, Homo sapiens
aaccauaugcccacauuua

SEQ ID NO: 74875 - RNA, 19 nt, Homo sapiens
agacucagccugcaguuaa

SEQ ID NO: 74876 - RNA, 19 nt, Homo sapiens
acacacacacgcacauaua

SEQ ID NO: 74877 - RNA, 19 nt, Homo sapiens
ccgauacuguggcucauuu

SEQ ID NO: 74878 - RNA, 19 nt, Homo sapiens
guaaugacuuauuguggau

SEQ ID NO: 74879 - RNA, 19 nt, Homo sapiens
cgagauaggagaaagaguu

SEQ ID NO: 74880 - RNA, 19 nt, Homo sapiens
gcccacauuuagucucuuu

SEQ ID NO: 74881 - RNA, 19 nt, Homo sapiens
ugaaagaugauuugcaaug

SEQ ID NO: 74882 - RNA, 19 nt, Homo sapiens
gacaugaucacaacagaga

SEQ ID NO: 74883 - RNA, 19 nt, Homo sapiens
ggaaagcccacgacaugau

SEQ ID NO: 74884 - RNA, 19 nt, Homo sapiens
ugacauuucacccgagaua

SEQ ID NO: 74885 - RNA, 19 nt, Homo sapiens
aaacgucaguagauaagug

SEQ ID NO: 74886 - RNA, 19 nt, Homo sapiens
gacgugaacucagaacugu

SEQ ID NO: 74887 - RNA, 19 nt, Homo sapiens
guacuaaggcggugucaag

SEQ ID NO: 74888 - RNA, 19 nt, Homo sapiens
ccagacagaaccaaagaaa

SEQ ID NO: 74889 - RNA, 19 nt, Homo sapiens
ccgacaacguuaacuaaug

SEQ ID NO: 74890 - RNA, 19 nt, Homo sapiens
ccugugagguuucccaaug

SEQ ID NO: 74891 - RNA, 19 nt, Homo sapiens
gcaguuaauuagcauucug

SEQ ID NO: 74892 - RNA, 19 nt, Homo sapiens
gcagaugugcagcagauug

SEQ ID NO: 74893 - RNA, 19 nt, Homo sapiens
uggcacacgucaagaagaa

SEQ ID NO: 74894 - RNA, 19 nt, Homo sapiens
cugaggugcuuaaggagua

SEQ ID NO: 74895 - RNA, 19 nt, Homo sapiens
caacguuucuucacuuuug

SEQ ID NO: 74896 - RNA, 19 nt, Homo sapiens
uaaccgaugcuuuaccaaa

SEQ ID NO: 74897 - RNA, 19 nt, Homo sapiens
cuaaauaacccuucaacgu

SEQ ID NO: 74898 - RNA, 19 nt, Homo sapiens
gaauacagcagcaagaaaa

SEQ ID NO: 74899 - RNA, 19 nt, Homo sapiens
ccucagaugcucaaaguug

SEQ ID NO: 74900 - RNA, 19 nt, Homo sapiens
aaaccuguaucuuucuaug

SEQ ID NO: 74901 - RNA, 19 nt, Homo sapiens
gugaagaugcauuguaguu

SEQ ID NO: 74902 - RNA, 19 nt, Homo sapiens
ucugugcuauaccuucuua

SEQ ID NO: 74903 - RNA, 19 nt, Homo sapiens
acacacacacacacaagua

SEQ ID NO: 74904 - RNA, 19 nt, Homo sapiens
cucauuaaccgaugcuuua

SEQ ID NO: 74905 - RNA, 19 nt, Homo sapiens
ggagaagcaccaucacauc

SEQ ID NO: 74906 - RNA, 19 nt, Homo sapiens
gauuuaaacgucaguagau

SEQ ID NO: 74907 - RNA, 19 nt, Homo sapiens
gcaagacuggccaaacaga

SEQ ID NO: 74908 - RNA, 19 nt, Homo sapiens
aagcagaccgggaagaauu

SEQ ID NO: 74909 - RNA, 19 nt, Homo sapiens
cuaaggcggugucaagaag

SEQ ID NO: 74910 - RNA, 19 nt, Homo sapiens
caucuugaccaucuguuaa

SEQ ID NO: 74911 - RNA, 19 nt, Homo sapiens
gcacacgucaagaagaaau

SEQ ID NO: 74912 - RNA, 19 nt, Homo sapiens
gacagaaacagaccuaugg

SEQ ID NO: 74913 - RNA, 19 nt, Homo sapiens
ccuccucucuggcuaauca

SEQ ID NO: 74914 - RNA, 19 nt, Homo sapiens
gaugugaagacgcaaucua

SEQ ID NO: 74915 - RNA, 19 nt, Homo sapiens
uuaaccauaugcccacauu

SEQ ID NO: 74916 - RNA, 19 nt, Homo sapiens
ggaagacccugaccgugua

SEQ ID NO: 74917 - RNA, 19 nt, Homo sapiens
ggaaauaaagggauaaaga

SEQ ID NO: 74918 - RNA, 19 nt, Homo sapiens
gaagcauacuugugaacua

SEQ ID NO: 74919 - RNA, 19 nt, Homo sapiens
caaaagagcuacucagaaa

SEQ ID NO: 74920 - RNA, 19 nt, Homo sapiens
gaaaggcaguccugguaga

SEQ ID NO: 74921 - RNA, 19 nt, Homo sapiens
gcaaacacaagaaaucaaa

SEQ ID NO: 74922 - RNA, 19 nt, Homo sapiens
ugaacuaccuugcuagcua

SEQ ID NO: 74923 - RNA, 19 nt, Homo sapiens
ggacacaccucugcuccaa

SEQ ID NO: 74924 - RNA, 19 nt, Homo sapiens
agaaggaaauaaagggaua

SEQ ID NO: 74925 - RNA, 19 nt, Homo sapiens
gagcauaauuccgaaacaa

SEQ ID NO: 74926 - RNA, 19 nt, Homo sapiens
gaggguuugugcccaguua

SEQ ID NO: 74927 - RNA, 19 nt, Homo sapiens
gaauugguggcuuauauuu

SEQ ID NO: 74928 - RNA, 19 nt, Homo sapiens
gaaaggacacgccgucugu

SEQ ID NO: 74929 - RNA, 19 nt, Homo sapiens
gcagagguccaaaugauau

SEQ ID NO: 74930 - RNA, 19 nt, Homo sapiens
aaaggaagcauacuuguga

SEQ ID NO: 74931 - RNA, 19 nt, Homo sapiens
gggaaaggcaguccuggua

SEQ ID NO: 74932 - RNA, 19 nt, Homo sapiens
ggagugacccagcuacuga

SEQ ID NO: 74933 - RNA, 19 nt, Homo sapiens
gaaagaagacacagaacca

SEQ ID NO: 74934 - RNA, 19 nt, Homo sapiens
gaagacgggaggaaagauu

SEQ ID NO: 74935 - RNA, 19 nt, Homo sapiens
acucagaaauggacaaaga

SEQ ID NO: 74936 - RNA, 19 nt, Homo sapiens
aagcugagcguguacguua

SEQ ID NO: 74937 - RNA, 19 nt, Homo sapiens
ggacagggcagccaguuca

SEQ ID NO: 74938 - RNA, 19 nt, Homo sapiens
gaauguauauagucuuugc

SEQ ID NO: 74939 - RNA, 19 nt, Homo sapiens
guacguuaaugugaaugua

SEQ ID NO: 74940 - RNA, 19 nt, Homo sapiens
ucaacaaccuccugaacug

SEQ ID NO: 74941 - RNA, 19 nt, Homo sapiens
ggaagcaccucaacaaccu

SEQ ID NO: 74942 - RNA, 19 nt, Homo sapiens
gacaacgucucuucaagca

SEQ ID NO: 74943 - RNA, 19 nt, Homo sapiens
ucgaauugguggcuuauau

SEQ ID NO: 74944 - RNA, 19 nt, Homo sapiens
ucaacugccucagcgauuu

SEQ ID NO: 74945 - RNA, 19 nt, Homo sapiens
aaaucgaauugguggcuua

SEQ ID NO: 74946 - RNA, 19 nt, Homo sapiens
ucacacacuuucucuucaa

SEQ ID NO: 74947 - RNA, 19 nt, Homo sapiens
ggaguuucauuccaagcuu

SEQ ID NO: 74948 - RNA, 19 nt, Homo sapiens
cuggugaacucgacauuga

SEQ ID NO: 74949 - RNA, 19 nt, Homo sapiens
cugaagaggccgugaauga

SEQ ID NO: 74950 - RNA, 19 nt, Homo sapiens
ucuauggucugucucuuga

SEQ ID NO: 74951 - RNA, 19 nt, Homo sapiens
ccucagcgauuucaagaag

SEQ ID NO: 74952 - RNA, 19 nt, Homo sapiens
gcaaaggaagcauacuugu

SEQ ID NO: 74953 - RNA, 19 nt, Homo sapiens
cacacuuucucuucaauga

SEQ ID NO: 74954 - RNA, 19 nt, Homo sapiens
ugccucagcuaccuaauga

SEQ ID NO: 74955 - RNA, 19 nt, Homo sapiens
gaagacacagaaccaacaa

SEQ ID NO: 74956 - RNA, 19 nt, Homo sapiens
agacgugccucgcgaguuc

SEQ ID NO: 74957 - RNA, 19 nt, Homo sapiens
aaagagcuacucagaaaug

SEQ ID NO: 74958 - RNA, 19 nt, Homo sapiens
gaaggaaauaaagggauaa

SEQ ID NO: 74959 - RNA, 19 nt, Homo sapiens
gcucugcccaccucucuuu

SEQ ID NO: 74960 - RNA, 19 nt, Homo sapiens
gcccaccacuuccgagaug

SEQ ID NO: 74961 - RNA, 19 nt, Homo sapiens
gcguguacguuaaugugaa

SEQ ID NO: 74962 - RNA, 19 nt, Homo sapiens
gcucuuggguuuguuugga

SEQ ID NO: 74963 - RNA, 19 nt, Homo sapiens
guuugugggugucgggaua

SEQ ID NO: 74964 - RNA, 19 nt, Homo sapiens
caaaggaagcauacuugug

SEQ ID NO: 74965 - RNA, 19 nt, Homo sapiens
gcaaagcgcacgagcucau

SEQ ID NO: 74966 - RNA, 19 nt, Homo sapiens
cgaauugguggcuuauauu

SEQ ID NO: 74967 - RNA, 19 nt, Homo sapiens
cccaacggcuucagcaaug

SEQ ID NO: 74968 - RNA, 19 nt, Homo sapiens
gaacggcagcagccacuca

SEQ ID NO: 74969 - RNA, 19 nt, Homo sapiens
uugcagagguccaaaugau

SEQ ID NO: 74970 - RNA, 19 nt, Homo sapiens
gccugaagcugagcgugua

SEQ ID NO: 74971 - RNA, 19 nt, Homo sapiens
acacaccucugcuccaaag

SEQ ID NO: 74972 - RNA, 19 nt, Homo sapiens
ccaaagagaacgggucaga

SEQ ID NO: 74973 - RNA, 19 nt, Homo sapiens
aaacaaaacugugacaauc

SEQ ID NO: 74974 - RNA, 19 nt, Homo sapiens
ucagaaauggacaaagaaa

SEQ ID NO: 74975 - RNA, 19 nt, Homo sapiens
ugucggagcugcagaaagc

SEQ ID NO: 74976 - RNA, 19 nt, Homo sapiens
ucgaggaguuucauuccaa

SEQ ID NO: 74977 - RNA, 19 nt, Homo sapiens
cuugugaacuaccuugcua

SEQ ID NO: 74978 - RNA, 19 nt, Homo sapiens
caacaaaaccgcauucagu

SEQ ID NO: 74979 - RNA, 19 nt, Homo sapiens
cauugacgaucgaggaguu

SEQ ID NO: 74980 - RNA, 19 nt, Homo sapiens
ucagcgauuucaagaagga

SEQ ID NO: 74981 - RNA, 19 nt, Homo sapiens
uauccucucucucucuaug

SEQ ID NO: 74982 - RNA, 19 nt, Homo sapiens
ccucagcuaccuaaugauu

SEQ ID NO: 74983 - RNA, 19 nt, Homo sapiens
gagcguguacguuaaugug

SEQ ID NO: 74984 - RNA, 19 nt, Homo sapiens
cuacugaaccagccacgaa

SEQ ID NO: 74985 - RNA, 19 nt, Homo sapiens
gcuaucaggaguucuagga

SEQ ID NO: 74986 - RNA, 19 nt, Homo sapiens
gaaacaaaacugugacaau

SEQ ID NO: 74987 - RNA, 19 nt, Homo sapiens
ccuguaauguuaaacucuu

SEQ ID NO: 74988 - RNA, 19 nt, Homo sapiens
aagaagugaucgaccacaa

SEQ ID NO: 74989 - RNA, 19 nt, Homo sapiens
aaagcaaacacaagaaauc

SEQ ID NO: 74990 - RNA, 19 nt, Homo sapiens
gcaaaagagcuacucagaa

SEQ ID NO: 74991 - RNA, 19 nt, Homo sapiens
uaucacacacuuucucuuc

SEQ ID NO: 74992 - RNA, 19 nt, Homo sapiens
uauggucugucucuugaug

SEQ ID NO: 74993 - RNA, 19 nt, Homo sapiens
gacccugaccguguacaua

SEQ ID NO: 74994 - RNA, 19 nt, Homo sapiens
ugucacugccaaaguauuu

SEQ ID NO: 74995 - RNA, 19 nt, Homo sapiens
caccucugcuccaaaggaa

SEQ ID NO: 74996 - RNA, 19 nt, Homo sapiens
ccaguggacaggaaagcua

SEQ ID NO: 74997 - RNA, 19 nt, Homo sapiens
ucuauccucucucucucua

SEQ ID NO: 74998 - RNA, 19 nt, Homo sapiens
ccgaagggccucagcuaga

SEQ ID NO: 74999 - RNA, 19 nt, Homo sapiens
ugacccagcuacugaacca

SEQ ID NO: 75000 - RNA, 19 nt, Homo sapiens
ucuaggaacucagugcaau

SEQ ID NO: 75001 - RNA, 19 nt, Homo sapiens
gcgaagacgggaggaaaga

SEQ ID NO: 75002 - RNA, 19 nt, Homo sapiens
cuaggaacucagugcaaua

SEQ ID NO: 75003 - RNA, 19 nt, Homo sapiens
ccugugacuuuucauauuu

SEQ ID NO: 75004 - RNA, 19 nt, Homo sapiens
uuucauggcugcuuaaaau

SEQ ID NO: 75005 - RNA, 19 nt, Homo sapiens
gauuucgauuucugacuca

SEQ ID NO: 75006 - RNA, 19 nt, Homo sapiens
cuacgugccugaggacauc

SEQ ID NO: 75007 - RNA, 19 nt, Homo sapiens
cuccauauguguaggaaag

SEQ ID NO: 75008 - RNA, 19 nt, Homo sapiens
gggcggaaagccagugaga

SEQ ID NO: 75009 - RNA, 19 nt, Homo sapiens
gagcgugagugggcagaag

SEQ ID NO: 75010 - RNA, 19 nt, Homo sapiens
gguugauucucgacugcuu

SEQ ID NO: 75011 - RNA, 19 nt, Homo sapiens
gcauaauuccgaaacaaaa

SEQ ID NO: 75012 - RNA, 19 nt, Homo sapiens
aagcaaaggaagcauacuu

SEQ ID NO: 75013 - RNA, 19 nt, Homo sapiens
cagcgaagacgggaggaaa

SEQ ID NO: 75014 - RNA, 19 nt, Homo sapiens
cgaagggccucagcuagac

SEQ ID NO: 75015 - RNA, 19 nt, Homo sapiens
ucccagagagagcauaauu

SEQ ID NO: 75016 - RNA, 19 nt, Homo sapiens
uaugauagcucugugauua

SEQ ID NO: 75017 - RNA, 19 nt, Homo sapiens
uaaacugucuucuguacua

SEQ ID NO: 75018 - RNA, 19 nt, Homo sapiens
gagacacacuggcagguua

SEQ ID NO: 75019 - RNA, 19 nt, Homo sapiens
caacuugcuuguacaguaa

SEQ ID NO: 75020 - RNA, 19 nt, Homo sapiens
ggaaacugcuuugcacuau

SEQ ID NO: 75021 - RNA, 19 nt, Homo sapiens
caaacacacugauguagga

SEQ ID NO: 75022 - RNA, 19 nt, Homo sapiens
caaggucucuuacagguau

SEQ ID NO: 75023 - RNA, 19 nt, Homo sapiens
gaagcuuaaucuaacguuu

SEQ ID NO: 75024 - RNA, 19 nt, Homo sapiens
ggauggagcuggguggaaa

SEQ ID NO: 75025 - RNA, 19 nt, Homo sapiens
gcacacaccugucuguaac

SEQ ID NO: 75026 - RNA, 19 nt, Homo sapiens
guuccuaacuguuggcuuu

SEQ ID NO: 75027 - RNA, 19 nt, Homo sapiens
ugauagcucugugauuaua

SEQ ID NO: 75028 - RNA, 19 nt, Homo sapiens
gcaaauaguccugagcaaa

SEQ ID NO: 75029 - RNA, 19 nt, Homo sapiens
ucaaacacaaggucucuua

SEQ ID NO: 75030 - RNA, 19 nt, Homo sapiens
uggcagagaugguuugaga

SEQ ID NO: 75031 - RNA, 19 nt, Homo sapiens
aggcagggauaguaaauaa

SEQ ID NO: 75032 - RNA, 19 nt, Homo sapiens
gcagggauaguaaauaaau

SEQ ID NO: 75033 - RNA, 19 nt, Homo sapiens
guagucucaucccagauua

SEQ ID NO: 75034 - RNA, 19 nt, Homo sapiens
ccucggaacugaacccauu

SEQ ID NO: 75035 - RNA, 19 nt, Homo sapiens
ggagaggcagggauaguaa

SEQ ID NO: 75036 - RNA, 19 nt, Homo sapiens
guuccgaggugaagucuug

SEQ ID NO: 75037 - RNA, 19 nt, Homo sapiens
caaggcaccucggaacuga

SEQ ID NO: 75038 - RNA, 19 nt, Homo sapiens
gggccaggcugcauggauu

SEQ ID NO: 75039 - RNA, 19 nt, Homo sapiens
gcauugaggugagggauca

SEQ ID NO: 75040 - RNA, 19 nt, Homo sapiens
agucagaacuggaaagugu

SEQ ID NO: 75041 - RNA, 19 nt, Homo sapiens
uuacaaggcugcguuaaag

SEQ ID NO: 75042 - RNA, 19 nt, Homo sapiens
caggagggccagauagaua

SEQ ID NO: 75043 - RNA, 19 nt, Homo sapiens
gaacaggagggccagauag

SEQ ID NO: 75044 - RNA, 19 nt, Homo sapiens
gcucugugauuauaagcaa

SEQ ID NO: 75045 - RNA, 19 nt, Homo sapiens
ccuagguggucucauaauu

SEQ ID NO: 75046 - RNA, 19 nt, Homo sapiens
gaaacugcuuugcacuauc

SEQ ID NO: 75047 - RNA, 19 nt, Homo sapiens
ccagagagaggcagcauug

SEQ ID NO: 75048 - RNA, 19 nt, Homo sapiens
aagcagcuaugaauccauu

SEQ ID NO: 75049 - RNA, 19 nt, Homo sapiens
auuagggucucaauacuuu

SEQ ID NO: 75050 - RNA, 19 nt, Homo sapiens
cagagaagaugagucuaug

SEQ ID NO: 75051 - RNA, 19 nt, Homo sapiens
ugaauccauuguccuugua

SEQ ID NO: 75052 - RNA, 19 nt, Homo sapiens
gcauuggcccacaggauaa

SEQ ID NO: 75053 - RNA, 19 nt, Homo sapiens
ggaagcagcuaugaaucca

SEQ ID NO: 75054 - RNA, 19 nt, Homo sapiens
acacagauuugagucagaa

SEQ ID NO: 75055 - RNA, 19 nt, Homo sapiens
ccagagaagaugagucuau

SEQ ID NO: 75056 - RNA, 19 nt, Homo sapiens
gccguucccugaccgcuuu

SEQ ID NO: 75057 - RNA, 19 nt, Homo sapiens
ucucaucccagauuacuaa

SEQ ID NO: 75058 - RNA, 19 nt, Homo sapiens
gguccuagcagaaggcauu

SEQ ID NO: 75059 - RNA, 19 nt, Homo sapiens
ucucauaauuccauuugug

SEQ ID NO: 75060 - RNA, 19 nt, Homo sapiens
ggaagcacgaggaaaggaa

SEQ ID NO: 75061 - RNA, 19 nt, Homo sapiens
guaggaagcacgaggaaag

SEQ ID NO: 75062 - RNA, 19 nt, Homo sapiens
gcuagcagcaugcgguauu

SEQ ID NO: 75063 - RNA, 19 nt, Homo sapiens
cauggauucucacaucaga

SEQ ID NO: 75064 - RNA, 19 nt, Homo sapiens
agguauaguuccgugauua

SEQ ID NO: 75065 - RNA, 19 nt, Homo sapiens
guacagaggcauagguuac

SEQ ID NO: 75066 - RNA, 19 nt, Homo sapiens
guaguggguaccaaucuuu

SEQ ID NO: 75067 - RNA, 19 nt, Homo sapiens
caacgcauccacucucugu

SEQ ID NO: 75068 - RNA, 19 nt, Homo sapiens
guaccaaucuuuugugaca

SEQ ID NO: 75069 - RNA, 19 nt, Homo sapiens
ugauauaguguuacuguga

SEQ ID NO: 75070 - RNA, 19 nt, Homo sapiens
aaaggaagacguuuugaua

SEQ ID NO: 75071 - RNA, 19 nt, Homo sapiens
ccucggccgucaugaagaa

SEQ ID NO: 75072 - RNA, 19 nt, Homo sapiens
gcaaugacgagaacuacuc

SEQ ID NO: 75073 - RNA, 19 nt, Homo sapiens
caaauaguccugagcaaaa

SEQ ID NO: 75074 - RNA, 19 nt, Homo sapiens
aggaagacguuuugauaua

SEQ ID NO: 75075 - RNA, 19 nt, Homo sapiens
gggaggauccagccaaauc

SEQ ID NO: 75076 - RNA, 19 nt, Homo sapiens
cuccaugccuucuuaggaa

SEQ ID NO: 75077 - RNA, 19 nt, Homo sapiens
ggccuguccucacuggaaa

SEQ ID NO: 75078 - RNA, 19 nt, Homo sapiens
cugcauggauucucacauc

SEQ ID NO: 75079 - RNA, 19 nt, Homo sapiens
guacgguggugacugugau

SEQ ID NO: 75080 - RNA, 19 nt, Homo sapiens
ggucucauaauuccauuug

SEQ ID NO: 75081 - RNA, 19 nt, Homo sapiens
gcagagaugguuugagaac

SEQ ID NO: 75082 - RNA, 19 nt, Homo sapiens
ggaagacguuuugauauag

SEQ ID NO: 75083 - RNA, 19 nt, Homo sapiens
gaggcagggauaguaaaua

SEQ ID NO: 75084 - RNA, 19 nt, Homo sapiens
uuacuaacccuuccugauc

SEQ ID NO: 75085 - RNA, 19 nt, Homo sapiens
gccucuccaugccuucuua

SEQ ID NO: 75086 - RNA, 19 nt, Homo sapiens
gaaaucugcccuacaaaau

SEQ ID NO: 75087 - RNA, 19 nt, Homo sapiens
ggcacacaccugucuguaa

SEQ ID NO: 75088 - RNA, 19 nt, Homo sapiens
cagguauaguuccgugauu

SEQ ID NO: 75089 - RNA, 19 nt, Homo sapiens
gcagccacauccuuguaca

SEQ ID NO: 75090 - RNA, 19 nt, Homo sapiens
ggacauccucuggcuccua

SEQ ID NO: 75091 - RNA, 19 nt, Homo sapiens
acugucuucuguacuauuu

SEQ ID NO: 75092 - RNA, 19 nt, Homo sapiens
caaggcugcguuaaaguug

SEQ ID NO: 75093 - RNA, 19 nt, Homo sapiens
gagaggcagggauaguaaa

SEQ ID NO: 75094 - RNA, 19 nt, Homo sapiens
uuaggaagcagcuaugaau

SEQ ID NO: 75095 - RNA, 19 nt, Homo sapiens
guaagggaacucauaaagg

SEQ ID NO: 75096 - RNA, 19 nt, Homo sapiens
uauaguuccgugauuauga

SEQ ID NO: 75097 - RNA, 19 nt, Homo sapiens
aaacugcuuugcacuaucg

SEQ ID NO: 75098 - RNA, 19 nt, Homo sapiens
acaaggcugcguuaaaguu

SEQ ID NO: 75099 - RNA, 19 nt, Homo sapiens
aguagguccuuauuuacaa

SEQ ID NO: 75100 - RNA, 19 nt, Homo sapiens
gcccagcacuuuguagucu

SEQ ID NO: 75101 - RNA, 19 nt, Homo sapiens
ccauuguccuuguaguuuc

SEQ ID NO: 75102 - RNA, 19 nt, Homo sapiens
cacaacggccagaaccaua

SEQ ID NO: 75103 - RNA, 19 nt, Homo sapiens
gguauaguuccgugauuau

SEQ ID NO: 75104 - RNA, 19 nt, Homo sapiens
cacuggcgcugcaacaaga

SEQ ID NO: 75105 - RNA, 19 nt, Homo sapiens
gcacuggcgcugcaacaag

SEQ ID NO: 75106 - RNA, 19 nt, Homo sapiens
gagaugguuugagaacaca

SEQ ID NO: 75107 - RNA, 19 nt, Homo sapiens
gcggcaagaugggcgagaa

SEQ ID NO: 75108 - RNA, 19 nt, Homo sapiens
gaaccauacaccagagaca

SEQ ID NO: 75109 - RNA, 19 nt, Homo sapiens
cuucauugguugucucugu

SEQ ID NO: 75110 - RNA, 19 nt, Homo sapiens
cuagcagcaugcgguauuu

SEQ ID NO: 75111 - RNA, 19 nt, Homo sapiens
gauagcucugugauuauaa

SEQ ID NO: 75112 - RNA, 19 nt, Homo sapiens
gcucugaaagcaaauaguc

SEQ ID NO: 75113 - RNA, 19 nt, Homo sapiens
ggcguaagggaacucauaa

SEQ ID NO: 75114 - RNA, 19 nt, Homo sapiens
gagggaaacgcugaugaga

SEQ ID NO: 75115 - RNA, 19 nt, Homo sapiens
accagccgcuuccaccaua

SEQ ID NO: 75116 - RNA, 19 nt, Homo sapiens
uuacagagcuccuugguuu

SEQ ID NO: 75117 - RNA, 19 nt, Homo sapiens
ccucaaacuucguuaauua

SEQ ID NO: 75118 - RNA, 19 nt, Homo sapiens
caaaugcucuuaaauguuc

SEQ ID NO: 75119 - RNA, 19 nt, Homo sapiens
gaaugaauuugguugguuu

SEQ ID NO: 75120 - RNA, 19 nt, Homo sapiens
ggaaaggaguguguuuaaa

SEQ ID NO: 75121 - RNA, 19 nt, Homo sapiens
ugaauaaggucauugcauu

SEQ ID NO: 75122 - RNA, 19 nt, Homo sapiens
ugaaucagcuacaaaggua

SEQ ID NO: 75123 - RNA, 19 nt, Homo sapiens
gaucaaaugcucuuaaaug

SEQ ID NO: 75124 - RNA, 19 nt, Homo sapiens
gagaguaugucgacuuaga

SEQ ID NO: 75125 - RNA, 19 nt, Homo sapiens
gaaaggaguguguuuaaau

SEQ ID NO: 75126 - RNA, 19 nt, Homo sapiens
uaaauaggcuuacugucaa

SEQ ID NO: 75127 - RNA, 19 nt, Homo sapiens
caaucugucucuccaauuu

SEQ ID NO: 75128 - RNA, 19 nt, Homo sapiens
gagaaggacacgcgaauuu

SEQ ID NO: 75129 - RNA, 19 nt, Homo sapiens
gaacagcgacaaacaccua

SEQ ID NO: 75130 - RNA, 19 nt, Homo sapiens
acaauaaacuucuguguag

SEQ ID NO: 75131 - RNA, 19 nt, Homo sapiens
gcugggugaugaaagauua

SEQ ID NO: 75132 - RNA, 19 nt, Homo sapiens
cuacugaaaugccuaaaga

SEQ ID NO: 75133 - RNA, 19 nt, Homo sapiens
gaaauggaggugagaguuu

SEQ ID NO: 75134 - RNA, 19 nt, Homo sapiens
aaacagugcuaagucauuu

SEQ ID NO: 75135 - RNA, 19 nt, Homo sapiens
uaagauagcugcuuuuaug

SEQ ID NO: 75136 - RNA, 19 nt, Homo sapiens
gcauauaacuguacuugac

SEQ ID NO: 75137 - RNA, 19 nt, Homo sapiens
gcucuuaaauguuccuguu

SEQ ID NO: 75138 - RNA, 19 nt, Homo sapiens
uaacuguacuugacugaug

SEQ ID NO: 75139 - RNA, 19 nt, Homo sapiens
gaauaaggucauugcauuu

SEQ ID NO: 75140 - RNA, 19 nt, Homo sapiens
gaaggacacgcgaauuuga

SEQ ID NO: 75141 - RNA, 19 nt, Homo sapiens
ccgagaguaugucgacuua

SEQ ID NO: 75142 - RNA, 19 nt, Homo sapiens
gcaggaggaugcauuagca

SEQ ID NO: 75143 - RNA, 19 nt, Homo sapiens
gauuacaggcucuuucuuu

SEQ ID NO: 75144 - RNA, 19 nt, Homo sapiens
cugacaaaguuuacaguua

SEQ ID NO: 75145 - RNA, 19 nt, Homo sapiens
ggaguguguuuaaauuguu

SEQ ID NO: 75146 - RNA, 19 nt, Homo sapiens
uaauagacaucacaaacug

SEQ ID NO: 75147 - RNA, 19 nt, Homo sapiens
gguguuacuuucauuguau

SEQ ID NO: 75148 - RNA, 19 nt, Homo sapiens
ggauugaucuccaaagacu

SEQ ID NO: 75149 - RNA, 19 nt, Homo sapiens
ugaaaugccuaaagaaguc

SEQ ID NO: 75150 - RNA, 19 nt, Homo sapiens
gaaacuaucaacuguaaag

SEQ ID NO: 75151 - RNA, 19 nt, Homo sapiens
gagguacuacggucuauuu

SEQ ID NO: 75152 - RNA, 19 nt, Homo sapiens
gcauguagccaguaauaau

SEQ ID NO: 75153 - RNA, 19 nt, Homo sapiens
uuaaauaggcuuacuguca

SEQ ID NO: 75154 - RNA, 19 nt, Homo sapiens
gaguuugguuggagauauu

SEQ ID NO: 75155 - RNA, 19 nt, Homo sapiens
gguauuaacucuguacucu

SEQ ID NO: 75156 - RNA, 19 nt, Homo sapiens
ugagggagguguuacuuuc

SEQ ID NO: 75157 - RNA, 19 nt, Homo sapiens
gcaccuccuuacaaauauu

SEQ ID NO: 75158 - RNA, 19 nt, Homo sapiens
gccuuaagcuaccagauug

SEQ ID NO: 75159 - RNA, 19 nt, Homo sapiens
uaaaggccaugcugaucuu

SEQ ID NO: 75160 - RNA, 19 nt, Homo sapiens
guucuguaaucaugaguuu

SEQ ID NO: 75161 - RNA, 19 nt, Homo sapiens
uggaaaggcuggauugauc

SEQ ID NO: 75162 - RNA, 19 nt, Homo sapiens
gagaagcaggcaagguaua

SEQ ID NO: 75163 - RNA, 19 nt, Homo sapiens
ggaaaacagugcuaaguca

SEQ ID NO: 75164 - RNA, 19 nt, Homo sapiens
guacuacggucuauuucuc

SEQ ID NO: 75165 - RNA, 19 nt, Homo sapiens
caauuuaggugguggugau

SEQ ID NO: 75166 - RNA, 19 nt, Homo sapiens
guaaucagcacucuuucuu

SEQ ID NO: 75167 - RNA, 19 nt, Homo sapiens
cuaguuggcagaaauaauu

SEQ ID NO: 75168 - RNA, 19 nt, Homo sapiens
uuguacagcucacauguuu

SEQ ID NO: 75169 - RNA, 19 nt, Homo sapiens
gaucuugcauaacuauaag

SEQ ID NO: 75170 - RNA, 19 nt, Homo sapiens
gacagggucucgcaguguu

SEQ ID NO: 75171 - RNA, 19 nt, Homo sapiens
cuaguaaucagcacucuuu

SEQ ID NO: 75172 - RNA, 19 nt, Homo sapiens
uuugaaggcucccaugauu

SEQ ID NO: 75173 - RNA, 19 nt, Homo sapiens
gccacagccuucugacaaa

SEQ ID NO: 75174 - RNA, 19 nt, Homo sapiens
uuaagcauguagccaguaa

SEQ ID NO: 75175 - RNA, 19 nt, Homo sapiens
uggcaccuccuuacaaaua

SEQ ID NO: 75176 - RNA, 19 nt, Homo sapiens
ggugaugaaagauuaguuu

SEQ ID NO: 75177 - RNA, 19 nt, Homo sapiens
aagcgauccuccugccuua

SEQ ID NO: 75178 - RNA, 19 nt, Homo sapiens
gcugauguuguuugcauua

SEQ ID NO: 75179 - RNA, 19 nt, Homo sapiens
ggaaauggaggugagaguu

SEQ ID NO: 75180 - RNA, 19 nt, Homo sapiens
gaauggagucuguguuauc

SEQ ID NO: 75181 - RNA, 19 nt, Homo sapiens
gaagaggcucggagaagga

SEQ ID NO: 75182 - RNA, 19 nt, Homo sapiens
gcaggcaagguauauuuga

SEQ ID NO: 75183 - RNA, 19 nt, Homo sapiens
aagagaagcaggcaaggua

SEQ ID NO: 75184 - RNA, 19 nt, Homo sapiens
guacaggcuuugaaaacua

SEQ ID NO: 75185 - RNA, 19 nt, Homo sapiens
gcuucugucugucuuaaug

SEQ ID NO: 75186 - RNA, 19 nt, Homo sapiens
gcucacauguuuacacacu

SEQ ID NO: 75187 - RNA, 19 nt, Homo sapiens
ugaaugaauuugguugguu

SEQ ID NO: 75188 - RNA, 19 nt, Homo sapiens
gcgagugugagauuaagua

SEQ ID NO: 75189 - RNA, 19 nt, Homo sapiens
guaugucgacuuagaaaga

SEQ ID NO: 75190 - RNA, 19 nt, Homo sapiens
ggugaugaccucaaacuuc

SEQ ID NO: 75191 - RNA, 19 nt, Homo sapiens
acaugaugaugguacauuu

SEQ ID NO: 75192 - RNA, 19 nt, Homo sapiens
caugcugggugaugaaaga

SEQ ID NO: 75193 - RNA, 19 nt, Homo sapiens
uagcuucuguucuguaauc

SEQ ID NO: 75194 - RNA, 19 nt, Homo sapiens
gcacuaugauuauaauacc

SEQ ID NO: 75195 - RNA, 19 nt, Homo sapiens
cugaauggagucuguguua

SEQ ID NO: 75196 - RNA, 19 nt, Homo sapiens
ucacauguuuacacacuca

SEQ ID NO: 75197 - RNA, 19 nt, Homo sapiens
guacagcucacauguuuac

SEQ ID NO: 75198 - RNA, 19 nt, Homo sapiens
caggcaagguauauuugaa

SEQ ID NO: 75199 - RNA, 19 nt, Homo sapiens
aagcauguagccaguaaua

SEQ ID NO: 75200 - RNA, 19 nt, Homo sapiens
cauacuguguguuuguuug

SEQ ID NO: 75201 - RNA, 19 nt, Homo sapiens
guaacagcauauuaaacug

SEQ ID NO: 75202 - RNA, 19 nt, Homo sapiens
acucugcccuagauuguuu

SEQ ID NO: 75203 - RNA, 19 nt, Homo sapiens
cauguagccaguaauaauu

SEQ ID NO: 75204 - RNA, 19 nt, Homo sapiens
acacgcgaauuugaagaua

SEQ ID NO: 75205 - RNA, 19 nt, Homo sapiens
cagcucacauguuuacaca

SEQ ID NO: 75206 - RNA, 19 nt, Homo sapiens
uacuggagcuucuucaugu

SEQ ID NO: 75207 - RNA, 19 nt, Homo sapiens
caggcuggcuucuguuuua

SEQ ID NO: 75208 - RNA, 19 nt, Homo sapiens
gauauucuccauagaugau

SEQ ID NO: 75209 - RNA, 19 nt, Homo sapiens
gccuuagccucccagagua

SEQ ID NO: 75210 - RNA, 19 nt, Homo sapiens
uaaaacugcugauguuguu

SEQ ID NO: 75211 - RNA, 19 nt, Homo sapiens
ccagcaggaggaugcauua

SEQ ID NO: 75212 - RNA, 19 nt, Homo sapiens
uggaaaggaguguguuuaa

SEQ ID NO: 75213 - RNA, 19 nt, Homo sapiens
gggagguguuacuuucauu

SEQ ID NO: 75214 - RNA, 19 nt, Homo sapiens
ggagaaggacacgcgaauu

SEQ ID NO: 75215 - RNA, 19 nt, Homo sapiens
ggcuuucgguccaccagua

SEQ ID NO: 75216 - RNA, 19 nt, Homo sapiens
uuacagagcuccuugguuu

SEQ ID NO: 75217 - RNA, 19 nt, Homo sapiens
ccucaaacuucguuaauua

SEQ ID NO: 75218 - RNA, 19 nt, Homo sapiens
caaaugcucuuaaauguuc

SEQ ID NO: 75219 - RNA, 19 nt, Homo sapiens
gaaugaauuugguugguuu

SEQ ID NO: 75220 - RNA, 19 nt, Homo sapiens
ggaaaggaguguguuuaaa

SEQ ID NO: 75221 - RNA, 19 nt, Homo sapiens
ugaauaaggucauugcauu

SEQ ID NO: 75222 - RNA, 19 nt, Homo sapiens
ugaaucagcuacaaaggua

SEQ ID NO: 75223 - RNA, 19 nt, Homo sapiens
gaucaaaugcucuuaaaug

SEQ ID NO: 75224 - RNA, 19 nt, Homo sapiens
gagaguaugucgacuuaga

SEQ ID NO: 75225 - RNA, 19 nt, Homo sapiens
gaaaggaguguguuuaaau

SEQ ID NO: 75226 - RNA, 19 nt, Homo sapiens
uaaauaggcuuacugucaa

SEQ ID NO: 75227 - RNA, 19 nt, Homo sapiens
gagaaggacacgcgaauuu

SEQ ID NO: 75228 - RNA, 19 nt, Homo sapiens
gaacagcgacaaacaccua

SEQ ID NO: 75229 - RNA, 19 nt, Homo sapiens
acaauaaacuucuguguag

SEQ ID NO: 75230 - RNA, 19 nt, Homo sapiens
gcugggugaugaaagauua

SEQ ID NO: 75231 - RNA, 19 nt, Homo sapiens
cuacugaaaugccuaaaga

SEQ ID NO: 75232 - RNA, 19 nt, Homo sapiens
aaacagugcuaagucauuu

SEQ ID NO: 75233 - RNA, 19 nt, Homo sapiens
uaagauagcugcuuuuaug

SEQ ID NO: 75234 - RNA, 19 nt, Homo sapiens
gcauauaacuguacuugac

SEQ ID NO: 75235 - RNA, 19 nt, Homo sapiens
caaucugucucuccaguuu

SEQ ID NO: 75236 - RNA, 19 nt, Homo sapiens
gcucuuaaauguuccuguu

SEQ ID NO: 75237 - RNA, 19 nt, Homo sapiens
uaacuguacuugacugaug

SEQ ID NO: 75238 - RNA, 19 nt, Homo sapiens
gaauaaggucauugcauuu

SEQ ID NO: 75239 - RNA, 19 nt, Homo sapiens
ggaaauggaggcaagaaga

SEQ ID NO: 75240 - RNA, 19 nt, Homo sapiens
gaaggacacgcgaauuuga

SEQ ID NO: 75241 - RNA, 19 nt, Homo sapiens
ccgagaguaugucgacuua

SEQ ID NO: 75242 - RNA, 19 nt, Homo sapiens
gcaggaggaugcauuagca

SEQ ID NO: 75243 - RNA, 19 nt, Homo sapiens
gauuacaggcucuuucuuu

SEQ ID NO: 75244 - RNA, 19 nt, Homo sapiens
cugacaaaguuuacaguua

SEQ ID NO: 75245 - RNA, 19 nt, Homo sapiens
ggaguguguuuaaauuguu

SEQ ID NO: 75246 - RNA, 19 nt, Homo sapiens
uaauagacaucacaaacug

SEQ ID NO: 75247 - RNA, 19 nt, Homo sapiens
gguguuacuuucauuguau

SEQ ID NO: 75248 - RNA, 19 nt, Homo sapiens
ggauugaucuccaaagacu

SEQ ID NO: 75249 - RNA, 19 nt, Homo sapiens
ugaaaugccuaaagaaguc

SEQ ID NO: 75250 - RNA, 19 nt, Homo sapiens
gaaacuaucaacuguaaag

SEQ ID NO: 75251 - RNA, 19 nt, Homo sapiens
gagguacuacggucuauuu

SEQ ID NO: 75252 - RNA, 19 nt, Homo sapiens
gcauguagccaguaauaau

SEQ ID NO: 75253 - RNA, 19 nt, Homo sapiens
uuaaauaggcuuacuguca

SEQ ID NO: 75254 - RNA, 19 nt, Homo sapiens
gaguuugguuggagauauu

SEQ ID NO: 75255 - RNA, 19 nt, Homo sapiens
gguauuaacucuguacucu

SEQ ID NO: 75256 - RNA, 19 nt, Homo sapiens
ugagggagguguuacuuuc

SEQ ID NO: 75257 - RNA, 19 nt, Homo sapiens
gcaccuccuuacaaauauu

SEQ ID NO: 75258 - RNA, 19 nt, Homo sapiens
gccuuaagcuaccagauug

SEQ ID NO: 75259 - RNA, 19 nt, Homo sapiens
uaaaggccaugcugaucuu

SEQ ID NO: 75260 - RNA, 19 nt, Homo sapiens
guucuguaaucaugaguuu

SEQ ID NO: 75261 - RNA, 19 nt, Homo sapiens
uggaaaggcuggauugauc

SEQ ID NO: 75262 - RNA, 19 nt, Homo sapiens
gagaagcaggcaagguaua

SEQ ID NO: 75263 - RNA, 19 nt, Homo sapiens
ggaaaacagugcuaaguca

SEQ ID NO: 75264 - RNA, 19 nt, Homo sapiens
guacuacggucuauuucuc

SEQ ID NO: 75265 - RNA, 19 nt, Homo sapiens
caauuuaggugguggugau

SEQ ID NO: 75266 - RNA, 19 nt, Homo sapiens
guaaucagcacucuuucuu

SEQ ID NO: 75267 - RNA, 19 nt, Homo sapiens
cuaguuggcagaaauaauu

SEQ ID NO: 75268 - RNA, 19 nt, Homo sapiens
uuguacagcucacauguuu

SEQ ID NO: 75269 - RNA, 19 nt, Homo sapiens
gaucuugcauaacuauaag

SEQ ID NO: 75270 - RNA, 19 nt, Homo sapiens
gacagggucucgcaguguu

SEQ ID NO: 75271 - RNA, 19 nt, Homo sapiens
cuaguaaucagcacucuuu

SEQ ID NO: 75272 - RNA, 19 nt, Homo sapiens
uuugaaggcucccaugauu

SEQ ID NO: 75273 - RNA, 19 nt, Homo sapiens
gccacagccuucugacaaa

SEQ ID NO: 75274 - RNA, 19 nt, Homo sapiens
uuaagcauguagccaguaa

SEQ ID NO: 75275 - RNA, 19 nt, Homo sapiens
uggcaccuccuuacaaaua

SEQ ID NO: 75276 - RNA, 19 nt, Homo sapiens
ggugaugaaagauuaguuu

SEQ ID NO: 75277 - RNA, 19 nt, Homo sapiens
aagcgauccuccugccuua

SEQ ID NO: 75278 - RNA, 19 nt, Homo sapiens
gcugauguuguuugcauua

SEQ ID NO: 75279 - RNA, 19 nt, Homo sapiens
gaauggagucuguguuauc

SEQ ID NO: 75280 - RNA, 19 nt, Homo sapiens
gaagaggcucggagaagga

SEQ ID NO: 75281 - RNA, 19 nt, Homo sapiens
gcaggcaagguauauuuga

SEQ ID NO: 75282 - RNA, 19 nt, Homo sapiens
aagagaagcaggcaaggua

SEQ ID NO: 75283 - RNA, 19 nt, Homo sapiens
guacaggcuuugaaaacua

SEQ ID NO: 75284 - RNA, 19 nt, Homo sapiens
gcuucugucugucuuaaug

SEQ ID NO: 75285 - RNA, 19 nt, Homo sapiens
gcucacauguuuacacacu

SEQ ID NO: 75286 - RNA, 19 nt, Homo sapiens
ugaaugaauuugguugguu

SEQ ID NO: 75287 - RNA, 19 nt, Homo sapiens
gcgagugugagauuaagua

SEQ ID NO: 75288 - RNA, 19 nt, Homo sapiens
guaugucgacuuagaaaga

SEQ ID NO: 75289 - RNA, 19 nt, Homo sapiens
ggugaugaccucaaacuuc

SEQ ID NO: 75290 - RNA, 19 nt, Homo sapiens
acaugaugaugguacauuu

SEQ ID NO: 75291 - RNA, 19 nt, Homo sapiens
caugcugggugaugaaaga

SEQ ID NO: 75292 - RNA, 19 nt, Homo sapiens
uagcuucuguucuguaauc

SEQ ID NO: 75293 - RNA, 19 nt, Homo sapiens
gcacuaugauuauaauacc

SEQ ID NO: 75294 - RNA, 19 nt, Homo sapiens
cugaauggagucuguguua

SEQ ID NO: 75295 - RNA, 19 nt, Homo sapiens
caggcaagguauauuugaa

SEQ ID NO: 75296 - RNA, 19 nt, Homo sapiens
ucacauguuuacacacuca

SEQ ID NO: 75297 - RNA, 19 nt, Homo sapiens
guacagcucacauguuuac

SEQ ID NO: 75298 - RNA, 19 nt, Homo sapiens
aagcauguagccaguaaua

SEQ ID NO: 75299 - RNA, 19 nt, Homo sapiens
cauacuguguguuuguuug

SEQ ID NO: 75300 - RNA, 19 nt, Homo sapiens
guaacagcauauuaaacug

SEQ ID NO: 75301 - RNA, 19 nt, Homo sapiens
acucugcccuagauuguuu

SEQ ID NO: 75302 - RNA, 19 nt, Homo sapiens
cauguagccaguaauaauu

SEQ ID NO: 75303 - RNA, 19 nt, Homo sapiens
acacgcgaauuugaagaua

SEQ ID NO: 75304 - RNA, 19 nt, Homo sapiens
cagcucacauguuuacaca

SEQ ID NO: 75305 - RNA, 19 nt, Homo sapiens
uacuggagcuucuucaugu

SEQ ID NO: 75306 - RNA, 19 nt, Homo sapiens
caggcuggcuucuguuuua

SEQ ID NO: 75307 - RNA, 19 nt, Homo sapiens
gauauucuccauagaugau

SEQ ID NO: 75308 - RNA, 19 nt, Homo sapiens
gccuuagccucccagagua

SEQ ID NO: 75309 - RNA, 19 nt, Homo sapiens
uaaaacugcugauguuguu

SEQ ID NO: 75310 - RNA, 19 nt, Homo sapiens
ccagcaggaggaugcauua

SEQ ID NO: 75311 - RNA, 19 nt, Homo sapiens
uggaaaggaguguguuuaa

SEQ ID NO: 75312 - RNA, 19 nt, Homo sapiens
gggagguguuacuuucauu

SEQ ID NO: 75313 - RNA, 19 nt, Homo sapiens
ggagaaggacacgcgaauu

SEQ ID NO: 75314 - RNA, 19 nt, Homo sapiens
ggcuuucgguccaccagua

SEQ ID NO: 75315 - RNA, 19 nt, Homo sapiens
acugucaaauugcaacuuu

SEQ ID NO: 75316 - RNA, 19 nt, Homo sapiens
caucaaaggugguccauaa

SEQ ID NO: 75317 - RNA, 19 nt, Homo sapiens
gcagacagaucaacagcua

SEQ ID NO: 75318 - RNA, 19 nt, Homo sapiens
gcaaauuucucacgcauca

SEQ ID NO: 75319 - RNA, 19 nt, Homo sapiens
caacagcuaugucaagaau

SEQ ID NO: 75320 - RNA, 19 nt, Homo sapiens
cagcagacaucaagcacua

SEQ ID NO: 75321 - RNA, 19 nt, Homo sapiens
gcaaugccuuguuucuuga

SEQ ID NO: 75322 - RNA, 19 nt, Homo sapiens
gagaugugcuggaggaaau

SEQ ID NO: 75323 - RNA, 19 nt, Homo sapiens
acagcuaugucaagaauaa

SEQ ID NO: 75324 - RNA, 19 nt, Homo sapiens
gacaccagcuuagaaauga

SEQ ID NO: 75325 - RNA, 19 nt, Homo sapiens
ucagaggucuuggcuauga

SEQ ID NO: 75326 - RNA, 19 nt, Homo sapiens
caccaucucuggagucuau

SEQ ID NO: 75327 - RNA, 19 nt, Homo sapiens
caaugggacugucuucuuc

SEQ ID NO: 75328 - RNA, 19 nt, Homo sapiens
ggucaacuauaucuucuuc

SEQ ID NO: 75329 - RNA, 19 nt, Homo sapiens
ccauaaagcugugcugcaa

SEQ ID NO: 75330 - RNA, 19 nt, Homo sapiens
ucaccaaccaggcaaauuu

SEQ ID NO: 75331 - RNA, 19 nt, Homo sapiens
gcaaugggacugucuucuu

SEQ ID NO: 75332 - RNA, 19 nt, Homo sapiens
gcaccugcaccaacucuuu

SEQ ID NO: 75333 - RNA, 19 nt, Homo sapiens
gagcaucuccauggccuua

SEQ ID NO: 75334 - RNA, 19 nt, Homo sapiens
ggucuuggcuaugaauuuc

SEQ ID NO: 75335 - RNA, 19 nt, Homo sapiens
ccuaucaucuugcguuuca

SEQ ID NO: 75336 - RNA, 19 nt, Homo sapiens
agucagaggucuuggcuau

SEQ ID NO: 75337 - RNA, 19 nt, Homo sapiens
gaacaugaguaaccaucac

SEQ ID NO: 75338 - RNA, 19 nt, Homo sapiens
gaaaauugucgacuuguuu

SEQ ID NO: 75339 - RNA, 19 nt, Homo sapiens
caaugccacuccuccugua

SEQ ID NO: 75340 - RNA, 19 nt, Homo sapiens
cagcugaagucaucaaagg

SEQ ID NO: 75341 - RNA, 19 nt, Homo sapiens
gaaccagggaucccacaga

SEQ ID NO: 75342 - RNA, 19 nt, Homo sapiens
uggaguugcuggagucauu

SEQ ID NO: 75343 - RNA, 19 nt, Homo sapiens
caaaggugguccauaaagc

SEQ ID NO: 75344 - RNA, 19 nt, Homo sapiens
aaagucagacaccagcuua

SEQ ID NO: 75345 - RNA, 19 nt, Homo sapiens
ccagggaucccacagaaau

SEQ ID NO: 75346 - RNA, 19 nt, Homo sapiens
gaaggugcccaugauguug

SEQ ID NO: 75347 - RNA, 19 nt, Homo sapiens
gaucaacagcuaugucaag

SEQ ID NO: 75348 - RNA, 19 nt, Homo sapiens
ggaaaauugucgacuuguu

SEQ ID NO: 75349 - RNA, 19 nt, Homo sapiens
ucagacaccagcuuagaaa

SEQ ID NO: 75350 - RNA, 19 nt, Homo sapiens
aaccagcccuucaucauca

SEQ ID NO: 75351 - RNA, 19 nt, Homo sapiens
agacaacuguggugaaggu

SEQ ID NO: 75352 - RNA, 19 nt, Homo sapiens
gaaaugacuaugggcaaug

SEQ ID NO: 75353 - RNA, 19 nt, Homo sapiens
uaacgcugcuuaugugaac

SEQ ID NO: 75354 - RNA, 19 nt, Homo sapiens
cgagacaacuguggugaag

SEQ ID NO: 75355 - RNA, 19 nt, Homo sapiens
ggaccaagccagcagaaac

SEQ ID NO: 75356 - RNA, 19 nt, Homo sapiens
gcaacagccagcagacaga

SEQ ID NO: 75357 - RNA, 19 nt, Homo sapiens
aaccagggaucccacagaa

SEQ ID NO: 75358 - RNA, 19 nt, Homo sapiens
caaccaggcaaauuucuca

SEQ ID NO: 75359 - RNA, 19 nt, Homo sapiens
gggcauugcagacuuguuc

SEQ ID NO: 75360 - RNA, 19 nt, Homo sapiens
ucuaugaccuuggagaugu

SEQ ID NO: 75361 - RNA, 19 nt, Homo sapiens
ugaaggugcccaugauguu

SEQ ID NO: 75362 - RNA, 19 nt, Homo sapiens
acaucaagcacuacuauga

SEQ ID NO: 75363 - RNA, 19 nt, Homo sapiens
gaccaagccagcagaaaca

SEQ ID NO: 75364 - RNA, 19 nt, Homo sapiens
caaccagcccuucaucauc

SEQ ID NO: 75365 - RNA, 19 nt, Homo sapiens
ggagaugugcuggaggaaa

SEQ ID NO: 75366 - RNA, 19 nt, Homo sapiens
gcaccagggaggagaacuu

SEQ ID NO: 75367 - RNA, 19 nt, Homo sapiens
agaaaugacuaugggcaau

SEQ ID NO: 75368 - RNA, 19 nt, Homo sapiens
agacaucaagcacuacuau

SEQ ID NO: 75369 - RNA, 19 nt, Homo sapiens
ggaucccacagaaauguuu

SEQ ID NO: 75370 - RNA, 19 nt, Homo sapiens
gggaagaugaacacaguca

SEQ ID NO: 75371 - RNA, 19 nt, Homo sapiens
cguccaagccuaucaucuu

SEQ ID NO: 75372 - RNA, 19 nt, Homo sapiens
agacuggccuggcuauacu

SEQ ID NO: 75373 - RNA, 19 nt, Homo sapiens
ggggaaaauugucgacuug

SEQ ID NO: 75374 - RNA, 19 nt, Homo sapiens
cagaucaacagcuauguca

SEQ ID NO: 75375 - RNA, 19 nt, Homo sapiens
agacaccagcuuagaaaug

SEQ ID NO: 75376 - RNA, 19 nt, Homo sapiens
cccuaaaccugacguccaa

SEQ ID NO: 75377 - RNA, 19 nt, Homo sapiens
agucgagcaccaucaguua

SEQ ID NO: 75378 - RNA, 19 nt, Homo sapiens
gauccuaacgcugcuuaug

SEQ ID NO: 75379 - RNA, 19 nt, Homo sapiens
agacagaucaacagcuaug

SEQ ID NO: 75380 - RNA, 19 nt, Homo sapiens
ucaaaggugguccauaaag

SEQ ID NO: 75381 - RNA, 19 nt, Homo sapiens
ugaacuacgugggcaaugg

SEQ ID NO: 75382 - RNA, 19 nt, Homo sapiens
caccaucaguuaccuucau

SEQ ID NO: 75383 - RNA, 19 nt, Homo sapiens
caagcacuacuaugaguca

SEQ ID NO: 75384 - RNA, 19 nt, Homo sapiens
gcagacuggccuggcuaua

SEQ ID NO: 75385 - RNA, 19 nt, Homo sapiens
caaagucagacaccagcuu

SEQ ID NO: 75386 - RNA, 19 nt, Homo sapiens
gcaccuaguggccuugagu

SEQ ID NO: 75387 - RNA, 19 nt, Homo sapiens
aagcugugcugcaacucaa

SEQ ID NO: 75388 - RNA, 19 nt, Homo sapiens
ccaaucuccuccaaguucu

SEQ ID NO: 75389 - RNA, 19 nt, Homo sapiens
uugcagacuuguucaccaa

SEQ ID NO: 75390 - RNA, 19 nt, Homo sapiens
cagccaacguugacuuugc

SEQ ID NO: 75391 - RNA, 19 nt, Homo sapiens
cccaaucuccuccaaguuc

SEQ ID NO: 75392 - RNA, 19 nt, Homo sapiens
uuaugaacccaguguaaga

SEQ ID NO: 75393 - RNA, 19 nt, Homo sapiens
uggagucuaugaccuugga

SEQ ID NO: 75394 - RNA, 19 nt, Homo sapiens
gugaaggugcccaugaugu

SEQ ID NO: 75395 - RNA, 19 nt, Homo sapiens
cauggacacagcccuuuga

SEQ ID NO: 75396 - RNA, 19 nt, Homo sapiens
cagaggucuuggcuaugaa

SEQ ID NO: 75397 - RNA, 19 nt, Homo sapiens
auaaagcugugcugcaacu

SEQ ID NO: 75398 - RNA, 19 nt, Homo sapiens
gccagcuggugcagaugaa

SEQ ID NO: 75399 - RNA, 19 nt, Homo sapiens
uccuaacgcugcuuaugug

SEQ ID NO: 75400 - RNA, 19 nt, Homo sapiens
caaguucuucucccuccaa

SEQ ID NO: 75401 - RNA, 19 nt, Homo sapiens
ucaaccagcccuucaucau

SEQ ID NO: 75402 - RNA, 19 nt, Homo sapiens
acgcccagcugaagucauc

SEQ ID NO: 75403 - RNA, 19 nt, Homo sapiens
ggaccuguacauuccaaag

SEQ ID NO: 75404 - RNA, 19 nt, Homo sapiens
caguuaccuucaugacuca

SEQ ID NO: 75405 - RNA, 19 nt, Homo sapiens
caucaagcacuacuaugag

SEQ ID NO: 75406 - RNA, 19 nt, Homo sapiens
gucagacaccagcuuagaa

SEQ ID NO: 75407 - RNA, 19 nt, Homo sapiens
uggcuauacuggacaaugc

SEQ ID NO: 75408 - RNA, 19 nt, Homo sapiens
ggugaaggugcccaugaug

SEQ ID NO: 75409 - RNA, 19 nt, Homo sapiens
ggagacacauuucggauua

SEQ ID NO: 75410 - RNA, 19 nt, Homo sapiens
gaucugaccugcaaugauu

SEQ ID NO: 75411 - RNA, 19 nt, Homo sapiens
gacaaucccucacaauaaa

SEQ ID NO: 75412 - RNA, 19 nt, Homo sapiens
ccagaaagcuuuggucauu

SEQ ID NO: 75413 - RNA, 19 nt, Homo sapiens
gcucugaaauccacuauug

SEQ ID NO: 75414 - RNA, 19 nt, Homo sapiens
ucacaaaccuggcaguuau

SEQ ID NO: 75415 - RNA, 19 nt, Homo sapiens
caauaaaccucucuuccaa

SEQ ID NO: 75416 - RNA, 19 nt, Homo sapiens
aagaauagcccaccuuaua

SEQ ID NO: 75417 - RNA, 19 nt, Homo sapiens
ucaaaguggugaaaugaaa

SEQ ID NO: 75418 - RNA, 19 nt, Homo sapiens
gaauagcagcccauuagua

SEQ ID NO: 75419 - RNA, 19 nt, Homo sapiens
uagcccaccuuauaucuua

SEQ ID NO: 75420 - RNA, 19 nt, Homo sapiens
ccaggaacaauaugaauua

SEQ ID NO: 75421 - RNA, 19 nt, Homo sapiens
gcuggaagcucauggacaa

SEQ ID NO: 75422 - RNA, 19 nt, Homo sapiens
acaagaagaugguggagaa

SEQ ID NO: 75423 - RNA, 19 nt, Homo sapiens
gaccugcaaugauuauauu

SEQ ID NO: 75424 - RNA, 19 nt, Homo sapiens
uaaagaauagcccaccuua

SEQ ID NO: 75425 - RNA, 19 nt, Homo sapiens
ggucagggcuguccuuucu

SEQ ID NO: 75426 - RNA, 19 nt, Homo sapiens
gaaauccacuauugaucug

SEQ ID NO: 75427 - RNA, 19 nt, Homo sapiens
caucagugguuccaagauu

SEQ ID NO: 75428 - RNA, 19 nt, Homo sapiens
aaucaacucugaacggaaa

SEQ ID NO: 75429 - RNA, 19 nt, Homo sapiens
gcuucuggcucccuucaua

SEQ ID NO: 75430 - RNA, 19 nt, Homo sapiens
ggaacauucuccagacaau

SEQ ID NO: 75431 - RNA, 19 nt, Homo sapiens
caccucagcucuccaguga

SEQ ID NO: 75432 - RNA, 19 nt, Homo sapiens
cagacaaucccucacaaua

SEQ ID NO: 75433 - RNA, 19 nt, Homo sapiens
ccauaagccucuucaagga

SEQ ID NO: 75434 - RNA, 19 nt, Homo sapiens
uggagcagcuaguauguuu

SEQ ID NO: 75435 - RNA, 19 nt, Homo sapiens
guuccaagauuucaaagug

SEQ ID NO: 75436 - RNA, 19 nt, Homo sapiens
gccgaacucucucagauau

SEQ ID NO: 75437 - RNA, 19 nt, Homo sapiens
agacaaucccucacaauaa

SEQ ID NO: 75438 - RNA, 19 nt, Homo sapiens
ggucuugagugcauuugaa

SEQ ID NO: 75439 - RNA, 19 nt, Homo sapiens
aaucaaaccuuccucaucu

SEQ ID NO: 75440 - RNA, 19 nt, Homo sapiens
gcagaaucccgaccucaaa

SEQ ID NO: 75441 - RNA, 19 nt, Homo sapiens
aagcucggcuccagaaauu

SEQ ID NO: 75442 - RNA, 19 nt, Homo sapiens
gaaauuaaagguacugaac

SEQ ID NO: 75443 - RNA, 19 nt, Homo sapiens
gaaauucauucacaaaccu

SEQ ID NO: 75444 - RNA, 19 nt, Homo sapiens
gugaagaggacacagagua

SEQ ID NO: 75445 - RNA, 19 nt, Homo sapiens
ugaacgagcugaugauacu

SEQ ID NO: 75446 - RNA, 19 nt, Homo sapiens
ugauugggcucaugaagga

SEQ ID NO: 75447 - RNA, 19 nt, Homo sapiens
ucgagaaccucaugaguca

SEQ ID NO: 75448 - RNA, 19 nt, Homo sapiens
gccaguaccucccacacuu

SEQ ID NO: 75449 - RNA, 19 nt, Homo sapiens
acccaaagcuggcgcuaaa

SEQ ID NO: 75450 - RNA, 19 nt, Homo sapiens
gacaaaccauugccaguac

SEQ ID NO: 75451 - RNA, 19 nt, Homo sapiens
gaugaacgagcugaugaua

SEQ ID NO: 75452 - RNA, 19 nt, Homo sapiens
gauaaggauguaaagauug

SEQ ID NO: 75453 - RNA, 19 nt, Homo sapiens
gagaugggcuccacauucc

SEQ ID NO: 75454 - RNA, 19 nt, Homo sapiens
ugaauuauacugugagaug

SEQ ID NO: 75455 - RNA, 19 nt, Homo sapiens
ccaagaccauaucaaagug

SEQ ID NO: 75456 - RNA, 19 nt, Homo sapiens
cguaugaagcaauguauaa

SEQ ID NO: 75457 - RNA, 19 nt, Homo sapiens
guacguaugaagcaaugua

SEQ ID NO: 75458 - RNA, 19 nt, Homo sapiens
ucagugggcuauuggguau

SEQ ID NO: 75459 - RNA, 19 nt, Homo sapiens
uggagaauuugaugaagaa

SEQ ID NO: 75460 - RNA, 19 nt, Homo sapiens
ggguguuuauggagaauuu

SEQ ID NO: 75461 - RNA, 19 nt, Homo sapiens
ggauaucacaucagugguu

SEQ ID NO: 75462 - RNA, 19 nt, Homo sapiens
uaaccaaacugucccucau

SEQ ID NO: 75463 - RNA, 19 nt, Homo sapiens
gaauagcccaccuuauauc

SEQ ID NO: 75464 - RNA, 19 nt, Homo sapiens
acacauuucggauuacuaa

SEQ ID NO: 75465 - RNA, 19 nt, Homo sapiens
caaacugucccucaucuuc

SEQ ID NO: 75466 - RNA, 19 nt, Homo sapiens
gaaaauggagcagcuagua

SEQ ID NO: 75467 - RNA, 19 nt, Homo sapiens
ucucagauaucucuaaugc

SEQ ID NO: 75468 - RNA, 19 nt, Homo sapiens
aaaugaggaugauggguau

SEQ ID NO: 75469 - RNA, 19 nt, Homo sapiens
gaccggccauauucuguug

SEQ ID NO: 75470 - RNA, 19 nt, Homo sapiens
ucauaaagacaaaccauug

SEQ ID NO: 75471 - RNA, 19 nt, Homo sapiens
ccucuuugcucaggaauug

SEQ ID NO: 75472 - RNA, 19 nt, Homo sapiens
cuauugaucugaccugcaa

SEQ ID NO: 75473 - RNA, 19 nt, Homo sapiens
gaagauggagacacuugga

SEQ ID NO: 75474 - RNA, 19 nt, Homo sapiens
agacaaaccauugccagua

SEQ ID NO: 75475 - RNA, 19 nt, Homo sapiens
ccagaaauucauucacaaa

SEQ ID NO: 75476 - RNA, 19 nt, Homo sapiens
cacugaagguucccaaguu

SEQ ID NO: 75477 - RNA, 19 nt, Homo sapiens
auugauagcuguacguaug

SEQ ID NO: 75478 - RNA, 19 nt, Homo sapiens
gaagugcaucccaucaguu

SEQ ID NO: 75479 - RNA, 19 nt, Homo sapiens
agacaauagucccuuggaa

SEQ ID NO: 75480 - RNA, 19 nt, Homo sapiens
ggacauccagaaagcuuug

SEQ ID NO: 75481 - RNA, 19 nt, Homo sapiens
ggacacagaguacaugacu

SEQ ID NO: 75482 - RNA, 19 nt, Homo sapiens
caaagugacccaggaacaa

SEQ ID NO: 75483 - RNA, 19 nt, Homo sapiens
caucuuuacccgacucuuu

SEQ ID NO: 75484 - RNA, 19 nt, Homo sapiens
gacaggcucuacaugaagu

SEQ ID NO: 75485 - RNA, 19 nt, Homo sapiens
gagcagcuaguauguuuua

SEQ ID NO: 75486 - RNA, 19 nt, Homo sapiens
cagaaagcuuuggucauug

SEQ ID NO: 75487 - RNA, 19 nt, Homo sapiens
gaguauguguucccucaag

SEQ ID NO: 75488 - RNA, 19 nt, Homo sapiens
ccaaagcuggcgcuaaaga

SEQ ID NO: 75489 - RNA, 19 nt, Homo sapiens
ucgacaggcucuacaugaa

SEQ ID NO: 75490 - RNA, 19 nt, Homo sapiens
ggcgaaaccuaaccaaacu

SEQ ID NO: 75491 - RNA, 19 nt, Homo sapiens
aaacuaagcaaaccauaag

SEQ ID NO: 75492 - RNA, 19 nt, Homo sapiens
ccagugaguugggaguuau

SEQ ID NO: 75493 - RNA, 19 nt, Homo sapiens
gcaucuccguacuaucuug

SEQ ID NO: 75494 - RNA, 19 nt, Homo sapiens
uacaacaaaugucacugaa

SEQ ID NO: 75495 - RNA, 19 nt, Homo sapiens
cgaacucucucagauaucu

SEQ ID NO: 75496 - RNA, 19 nt, Homo sapiens
ggagcaaugugagggugaa

SEQ ID NO: 75497 - RNA, 19 nt, Homo sapiens
cagcaucuccguacuaucu

SEQ ID NO: 75498 - RNA, 19 nt, Homo sapiens
agaauagcccaccuuauau

SEQ ID NO: 75499 - RNA, 19 nt, Homo sapiens
agaagaugguggagaagug

SEQ ID NO: 75500 - RNA, 19 nt, Homo sapiens
aaacauccuccgggaauuu

SEQ ID NO: 75501 - RNA, 19 nt, Homo sapiens
cuacaacaaaugucacuga

SEQ ID NO: 75502 - RNA, 19 nt, Homo sapiens
cugccgaugugaaauuaaa

SEQ ID NO: 75503 - RNA, 19 nt, Homo sapiens
caaagcuggcgcuaaagaa

SEQ ID NO: 75504 - RNA, 19 nt, Homo sapiens
ugaaagcucggcuccagaa

SEQ ID NO: 75505 - RNA, 19 nt, Homo sapiens
ugaagugcaucccaucagu

SEQ ID NO: 75506 - RNA, 19 nt, Homo sapiens
acaauagucccuuggaaga

SEQ ID NO: 75507 - RNA, 19 nt, Homo sapiens
ccagugagaucgagaaccu

SEQ ID NO: 75508 - RNA, 19 nt, Homo sapiens
gauccuacaacaaauguca

SEQ ID NO: 75509 - RNA, 19 nt, Homo sapiens
ggauuugucuugacgguaa

SEQ ID NO: 75510 - RNA, 19 nt, Homo sapiens
gaccauaccucauaacaag

SEQ ID NO: 75511 - RNA, 19 nt, Homo sapiens
ugaaagaccuccaccaauc

SEQ ID NO: 75512 - RNA, 19 nt, Homo sapiens
gaugaaggcuccagguguu

SEQ ID NO: 75513 - RNA, 19 nt, Homo sapiens
uaucagcauuuacgacuua

SEQ ID NO: 75514 - RNA, 19 nt, Homo sapiens
ggaagaugaugaugaauac

SEQ ID NO: 75515 - RNA, 19 nt, Homo sapiens
gcaaggagagaauguauga

SEQ ID NO: 75516 - RNA, 19 nt, Homo sapiens
gaacugagcccauaaucgu

SEQ ID NO: 75517 - RNA, 19 nt, Homo sapiens
agaaggagcuaaggucuuu

SEQ ID NO: 75518 - RNA, 19 nt, Homo sapiens
gcacgacuacagaaauaua

SEQ ID NO: 75519 - RNA, 19 nt, Homo sapiens
aaaguguacugguccguua

SEQ ID NO: 75520 - RNA, 19 nt, Homo sapiens
gaauucagaguucaguaua

SEQ ID NO: 75521 - RNA, 19 nt, Homo sapiens
uuacagaccauaccucaua

SEQ ID NO: 75522 - RNA, 19 nt, Homo sapiens
gaacucaccagucacauca

SEQ ID NO: 75523 - RNA, 19 nt, Homo sapiens
uuucagcucuguaagauuu

SEQ ID NO: 75524 - RNA, 19 nt, Homo sapiens
aagcacgacuacagaaaua

SEQ ID NO: 75525 - RNA, 19 nt, Homo sapiens
agaggaagaugaugaugaa

SEQ ID NO: 75526 - RNA, 19 nt, Homo sapiens
ggagagcggguguggauuu

SEQ ID NO: 75527 - RNA, 19 nt, Homo sapiens
uaacaagcccuuauuucaa

SEQ ID NO: 75528 - RNA, 19 nt, Homo sapiens
ccacuuacgcuaauuaaau

SEQ ID NO: 75529 - RNA, 19 nt, Homo sapiens
aaacacagacgccaugauu

SEQ ID NO: 75530 - RNA, 19 nt, Homo sapiens
uggcauuucucacauauga

SEQ ID NO: 75531 - RNA, 19 nt, Homo sapiens
gagaauguaugaagaacag

SEQ ID NO: 75532 - RNA, 19 nt, Homo sapiens
ggagagaauguaugaagaa

SEQ ID NO: 75533 - RNA, 19 nt, Homo sapiens
caaguucacgagaccauua

SEQ ID NO: 75534 - RNA, 19 nt, Homo sapiens
acaggacgcccucugauua

SEQ ID NO: 75535 - RNA, 19 nt, Homo sapiens
gcauuuacgacuuauauug

SEQ ID NO: 75536 - RNA, 19 nt, Homo sapiens
aaacaucccugacuuaagc

SEQ ID NO: 75537 - RNA, 19 nt, Homo sapiens
gaccauuacuccauguaga

SEQ ID NO: 75538 - RNA, 19 nt, Homo sapiens
gcucuaaaaucaacaauug

SEQ ID NO: 75539 - RNA, 19 nt, Homo sapiens
gacgguaauuguugcguuu

SEQ ID NO: 75540 - RNA, 19 nt, Homo sapiens
ucucacauaugaugaaguu

SEQ ID NO: 75541 - RNA, 19 nt, Homo sapiens
ugauuaagguaguagugua

SEQ ID NO: 75542 - RNA, 19 nt, Homo sapiens
guagaugauuaagguagua

SEQ ID NO: 75543 - RNA, 19 nt, Homo sapiens
ccauguagaugauuaaggu

SEQ ID NO: 75544 - RNA, 19 nt, Homo sapiens
ccuguucgguccugugaua

SEQ ID NO: 75545 - RNA, 19 nt, Homo sapiens
guacugguccguuagcaaa

SEQ ID NO: 75546 - RNA, 19 nt, Homo sapiens
acagaaauauagcaccaaa

SEQ ID NO: 75547 - RNA, 19 nt, Homo sapiens
gauuagcucuagccuggaa

SEQ ID NO: 75548 - RNA, 19 nt, Homo sapiens
gaugacaaccagaaacuug

SEQ ID NO: 75549 - RNA, 19 nt, Homo sapiens
gaguaaauaugaugacaac

SEQ ID NO: 75550 - RNA, 19 nt, Homo sapiens
gcuuugugcucuaguaguu

SEQ ID NO: 75551 - RNA, 19 nt, Homo sapiens
caugagguccaccagauua

SEQ ID NO: 75552 - RNA, 19 nt, Homo sapiens
gcucauggacaaaguggua

SEQ ID NO: 75553 - RNA, 19 nt, Homo sapiens
gccaaugccucuugaagca

SEQ ID NO: 75554 - RNA, 19 nt, Homo sapiens
gugcagagaaugacaaaga

SEQ ID NO: 75555 - RNA, 19 nt, Homo sapiens
gcucuagccuggaagcaau

SEQ ID NO: 75556 - RNA, 19 nt, Homo sapiens
aaucaaacaucccugacuu

SEQ ID NO: 75557 - RNA, 19 nt, Homo sapiens
aggcagaacucaccaguca

SEQ ID NO: 75558 - RNA, 19 nt, Homo sapiens
uaagauuugugcagagaau

SEQ ID NO: 75559 - RNA, 19 nt, Homo sapiens
ucacaaaacugucccuuau

SEQ ID NO: 75560 - RNA, 19 nt, Homo sapiens
guuagcaaauucucuuuca

SEQ ID NO: 75561 - RNA, 19 nt, Homo sapiens
gaagugaagaauaugaugu

SEQ ID NO: 75562 - RNA, 19 nt, Homo sapiens
aaauagcccaccauauaua

SEQ ID NO: 75563 - RNA, 19 nt, Homo sapiens
guugugaauuugccugaaa

SEQ ID NO: 75564 - RNA, 19 nt, Homo sapiens
ucaaacaucccugacuuaa

SEQ ID NO: 75565 - RNA, 19 nt, Homo sapiens
acacagacgccaugauuug

SEQ ID NO: 75566 - RNA, 19 nt, Homo sapiens
gggaaggauuuuaucuuua

SEQ ID NO: 75567 - RNA, 19 nt, Homo sapiens
gaaacuugcccaacucagu

SEQ ID NO: 75568 - RNA, 19 nt, Homo sapiens
guauguagagaacugauaa

SEQ ID NO: 75569 - RNA, 19 nt, Homo sapiens
gagcuaaggucuuuuccaa

SEQ ID NO: 75570 - RNA, 19 nt, Homo sapiens
gccaugauuugccuuuaga

SEQ ID NO: 75571 - RNA, 19 nt, Homo sapiens
gcaccaaacccggaagcua

SEQ ID NO: 75572 - RNA, 19 nt, Homo sapiens
gaaguuaaagcacgacuac

SEQ ID NO: 75573 - RNA, 19 nt, Homo sapiens
gagagcggguguggauuug

SEQ ID NO: 75574 - RNA, 19 nt, Homo sapiens
gaugggaggaguuauaauc

SEQ ID NO: 75575 - RNA, 19 nt, Homo sapiens
gugagaaugaguacuuuaa

SEQ ID NO: 75576 - RNA, 19 nt, Homo sapiens
ggucgaauuuuggguauua

SEQ ID NO: 75577 - RNA, 19 nt, Homo sapiens
ccuuggaagugaagaauau

SEQ ID NO: 75578 - RNA, 19 nt, Homo sapiens
gcuaaggucuuuuccaaug

SEQ ID NO: 75579 - RNA, 19 nt, Homo sapiens
ucacagcgaguucaaaugu

SEQ ID NO: 75580 - RNA, 19 nt, Homo sapiens
gacaauagacugaguagac

SEQ ID NO: 75581 - RNA, 19 nt, Homo sapiens
ucaccaaagucuucuccuu

SEQ ID NO: 75582 - RNA, 19 nt, Homo sapiens
ucagaaaggcauaguuaga

SEQ ID NO: 75583 - RNA, 19 nt, Homo sapiens
uggcagaaaucaaagcaau

SEQ ID NO: 75584 - RNA, 19 nt, Homo sapiens
cuacauugauagccuuaug

SEQ ID NO: 75585 - RNA, 19 nt, Homo sapiens
ggaagcucauggacaaagu

SEQ ID NO: 75586 - RNA, 19 nt, Homo sapiens
ggacgcccucugauuauga

SEQ ID NO: 75587 - RNA, 19 nt, Homo sapiens
aauacaagauuccuucauc

SEQ ID NO: 75588 - RNA, 19 nt, Homo sapiens
guaaauaugaugacaacca

SEQ ID NO: 75589 - RNA, 19 nt, Homo sapiens
aagcaugguucuucacuca

SEQ ID NO: 75590 - RNA, 19 nt, Homo sapiens
aaggguacguauagaauau

SEQ ID NO: 75591 - RNA, 19 nt, Homo sapiens
uaaaggguacguauagaau

SEQ ID NO: 75592 - RNA, 19 nt, Homo sapiens
gaaaacaagagacccagua

SEQ ID NO: 75593 - RNA, 19 nt, Homo sapiens
gaguucaaaugucaaugga

SEQ ID NO: 75594 - RNA, 19 nt, Homo sapiens
gcagaacucaccagucaca

SEQ ID NO: 75595 - RNA, 19 nt, Homo sapiens
ggacagacgaaaucucaca

SEQ ID NO: 75596 - RNA, 19 nt, Homo sapiens
cuuggaagcucauggacaa

SEQ ID NO: 75597 - RNA, 19 nt, Homo sapiens
uuaagguaguaguguagua

SEQ ID NO: 75598 - RNA, 19 nt, Homo sapiens
ccaacagguucaccaaagu

SEQ ID NO: 75599 - RNA, 19 nt, Homo sapiens
aaaaggaacugagcccaua

SEQ ID NO: 75600 - RNA, 19 nt, Homo sapiens
uaaagcacgacuacagaaa

SEQ ID NO: 75601 - RNA, 19 nt, Homo sapiens
gcauuucucacauaugaug

SEQ ID NO: 75602 - RNA, 19 nt, Homo sapiens
uggaagcaauggcucuaaa

SEQ ID NO: 75603 - RNA, 19 nt, Homo sapiens
aaaggguacguauagaaua

SEQ ID NO: 75604 - RNA, 19 nt, Homo sapiens
aggaagaugaugaugaaua

SEQ ID NO: 75605 - RNA, 19 nt, Homo sapiens
gggauguguuugggacuaa

SEQ ID NO: 75606 - RNA, 19 nt, Homo sapiens
gagcggguguggauuuguc

SEQ ID NO: 75607 - RNA, 19 nt, Homo sapiens
uaucguaccauggaaagua

SEQ ID NO: 75608 - RNA, 19 nt, Homo sapiens
cagcauuuacgacuuauau

SEQ ID NO: 75609 - RNA, 19 nt, Homo sapiens
gcaaagggaucuacaguuu

SEQ ID NO: 75610 - RNA, 19 nt, Homo sapiens
gaaagaggcugaaauuaag

SEQ ID NO: 75611 - RNA, 19 nt, Homo sapiens
gaaagagacugccuuguca

SEQ ID NO: 75612 - RNA, 19 nt, Homo sapiens
gaacaacuuugauucagaa

SEQ ID NO: 75613 - RNA, 19 nt, Homo sapiens
agaaagaggcugaaauuaa

SEQ ID NO: 75614 - RNA, 19 nt, Homo sapiens
gaaagcagcacgacuugaa

SEQ ID NO: 75615 - RNA, 19 nt, Homo sapiens
ggaacaacuuugauucaga

SEQ ID NO: 75616 - RNA, 19 nt, Homo sapiens
gaacauugggaacaacuuu

SEQ ID NO: 75617 - RNA, 19 nt, Homo sapiens
gagaaagaggcugaaauua

SEQ ID NO: 75618 - RNA, 19 nt, Homo sapiens
gcaccaugaucaucuacuu

SEQ ID NO: 75619 - RNA, 19 nt, Homo sapiens
ugagaaagaggcugaaauu

SEQ ID NO: 75620 - RNA, 19 nt, Homo sapiens
gagacugccuugucauugu

SEQ ID NO: 75621 - RNA, 19 nt, Homo sapiens
ggaaagggguaaaguuuug

SEQ ID NO: 75622 - RNA, 19 nt, Homo sapiens
cauguucccugcaauuuau

SEQ ID NO: 75623 - RNA, 19 nt, Homo sapiens
aaagggaucuacaguuuua

SEQ ID NO: 75624 - RNA, 19 nt, Homo sapiens
cagcacgacuugaaacuuc

SEQ ID NO: 75625 - RNA, 19 nt, Homo sapiens
gcaguaaucaagaaagaga

SEQ ID NO: 75626 - RNA, 19 nt, Homo sapiens
gaaaggcgaccgagcauac

SEQ ID NO: 75627 - RNA, 19 nt, Homo sapiens
gcucugcgcacucccauuu

SEQ ID NO: 75628 - RNA, 19 nt, Homo sapiens
gaaauuaagagggcgagaa

SEQ ID NO: 75629 - RNA, 19 nt, Homo sapiens
gaagguaguuuuaauuugg

SEQ ID NO: 75630 - RNA, 19 nt, Homo sapiens
caacggaguccuaauccaa

SEQ ID NO: 75631 - RNA, 19 nt, Homo sapiens
gaauccuucugccuacuga

SEQ ID NO: 75632 - RNA, 19 nt, Homo sapiens
cgagaaagcagcacgacuu

SEQ ID NO: 75633 - RNA, 19 nt, Homo sapiens
cuuccuacauguucucuaa

SEQ ID NO: 75634 - RNA, 19 nt, Homo sapiens
gagaaagcagcacgacuug

SEQ ID NO: 75635 - RNA, 19 nt, Homo sapiens
gaaacuuccuacauguucu

SEQ ID NO: 75636 - RNA, 19 nt, Homo sapiens
ggaagguaguuuuaauuug

SEQ ID NO: 75637 - RNA, 19 nt, Homo sapiens
uauccucggcugcuuguua

SEQ ID NO: 75638 - RNA, 19 nt, Homo sapiens
gccuugucauuguuucuua

SEQ ID NO: 75639 - RNA, 19 nt, Homo sapiens
cuacaacagacaaaccaua

SEQ ID NO: 75640 - RNA, 19 nt, Homo sapiens
ucauguucccugcaauuua

SEQ ID NO: 75641 - RNA, 19 nt, Homo sapiens
ucagaacgcagcacuuuca

SEQ ID NO: 75642 - RNA, 19 nt, Homo sapiens
aaguguugcucuucuuaaa

SEQ ID NO: 75643 - RNA, 19 nt, Homo sapiens
caaguguugcucuucuuaa

SEQ ID NO: 75644 - RNA, 19 nt, Homo sapiens
aaauuaagagggcgagaaa

SEQ ID NO: 75645 - RNA, 19 nt, Homo sapiens
agaaagagacugccuuguc

SEQ ID NO: 75646 - RNA, 19 nt, Homo sapiens
gggaacaacuuugauucag

SEQ ID NO: 75647 - RNA, 19 nt, Homo sapiens
agacugccuugucauuguu

SEQ ID NO: 75648 - RNA, 19 nt, Homo sapiens
gcaacggaguccuaaucca

SEQ ID NO: 75649 - RNA, 19 nt, Homo sapiens
acuugaaacuuccuacaug

SEQ ID NO: 75650 - RNA, 19 nt, Homo sapiens
ugaaacuuccuacauguuc

SEQ ID NO: 75651 - RNA, 19 nt, Homo sapiens
ccuuaguggugacugguuu

SEQ ID NO: 75652 - RNA, 19 nt, Homo sapiens
gggaagguaguuuuaauuu

SEQ ID NO: 75653 - RNA, 19 nt, Homo sapiens
uugcaguaaucaagaaaga

SEQ ID NO: 75654 - RNA, 19 nt, Homo sapiens
caacuuuguccauuuccuu

SEQ ID NO: 75655 - RNA, 19 nt, Homo sapiens
cgaccgagcauaccucaag

SEQ ID NO: 75656 - RNA, 19 nt, Homo sapiens
caguugcaguaaucaagaa

SEQ ID NO: 75657 - RNA, 19 nt, Homo sapiens
cuacuucgaccagguacua

SEQ ID NO: 75658 - RNA, 19 nt, Homo sapiens
cauguucucuaacuguauc

SEQ ID NO: 75659 - RNA, 19 nt, Homo sapiens
cuugaaacuuccuacaugu

SEQ ID NO: 75660 - RNA, 19 nt, Homo sapiens
cagcaacggaguccuaauc

SEQ ID NO: 75661 - RNA, 19 nt, Homo sapiens
gggguaaaguuuuguuguu

SEQ ID NO: 75662 - RNA, 19 nt, Homo sapiens
caacagacaaaccauacag

SEQ ID NO: 75663 - RNA, 19 nt, Homo sapiens
gcgcaaagggaucuacagu

SEQ ID NO: 75664 - RNA, 19 nt, Homo sapiens
caucuacuucgaccaggua

SEQ ID NO: 75665 - RNA, 19 nt, Homo sapiens
gcgaggaagagguguagug

SEQ ID NO: 75666 - RNA, 19 nt, Homo sapiens
gagaaaggcgaccgagcau

SEQ ID NO: 75667 - RNA, 19 nt, Homo sapiens
gguaaaagucuacaacaga

SEQ ID NO: 75668 - RNA, 19 nt, Homo sapiens
cuacauguucucuaacugu

SEQ ID NO: 75669 - RNA, 19 nt, Homo sapiens
gcagcacgacuugaaacuu

SEQ ID NO: 75670 - RNA, 19 nt, Homo sapiens
aguaaucgcaccaugauca

SEQ ID NO: 75671 - RNA, 19 nt, Homo sapiens
ugaguaaucgcaccaugau

SEQ ID NO: 75672 - RNA, 19 nt, Homo sapiens
cuaacuguaucuggguaaa

SEQ ID NO: 75673 - RNA, 19 nt, Homo sapiens
ggaaggggagugagaaaga

SEQ ID NO: 75674 - RNA, 19 nt, Homo sapiens
gagcagcagcggcuaugca

SEQ ID NO: 75675 - RNA, 19 nt, Homo sapiens
ccugguguuuccucucuga

SEQ ID NO: 75676 - RNA, 19 nt, Homo sapiens
ccuacugaaaucugauaua

SEQ ID NO: 75677 - RNA, 19 nt, Homo sapiens
ccaguugcaguaaucaaga

SEQ ID NO: 75678 - RNA, 19 nt, Homo sapiens
guucccugcaauuuauuua

SEQ ID NO: 75679 - RNA, 19 nt, Homo sapiens
aaagcagcacgacuugaaa

SEQ ID NO: 75680 - RNA, 19 nt, Homo sapiens
ggaauccuucugccuacug

SEQ ID NO: 75681 - RNA, 19 nt, Homo sapiens
aagagacugccuugucauu

SEQ ID NO: 75682 - RNA, 19 nt, Homo sapiens
cuuuguccauuuccuuauu

SEQ ID NO: 75683 - RNA, 19 nt, Homo sapiens
gugagaaagaggcugaaau

SEQ ID NO: 75684 - RNA, 19 nt, Homo sapiens
uagugaacauugggaacaa

SEQ ID NO: 75685 - RNA, 19 nt, Homo sapiens
gauggggaagguaguuuua

SEQ ID NO: 75686 - RNA, 19 nt, Homo sapiens
ggguaaaguuuuguuguug

SEQ ID NO: 75687 - RNA, 19 nt, Homo sapiens
ggaguccuaauccaaaugg

SEQ ID NO: 75688 - RNA, 19 nt, Homo sapiens
cagguacuagugaacauug

SEQ ID NO: 75689 - RNA, 19 nt, Homo sapiens
gguaaaguuuuguuguugu

SEQ ID NO: 75690 - RNA, 19 nt, Homo sapiens
ccagcugugggacaacuuu

SEQ ID NO: 75691 - RNA, 19 nt, Homo sapiens
aaagaggcugaaauuaaga

SEQ ID NO: 75692 - RNA, 19 nt, Homo sapiens
cacgagccguccgagauga

SEQ ID NO: 75693 - RNA, 19 nt, Homo sapiens
cgaggaagagguguagugu

SEQ ID NO: 75694 - RNA, 19 nt, Homo sapiens
cauuccaguugcaguaauc

SEQ ID NO: 75695 - RNA, 19 nt, Homo sapiens
ccauuccaguugcaguaau

SEQ ID NO: 75696 - RNA, 19 nt, Homo sapiens
ggacaggccucuacaacua

SEQ ID NO: 75697 - RNA, 19 nt, Homo sapiens
gaacaaggccgacuuauca

SEQ ID NO: 75698 - RNA, 19 nt, Homo sapiens
gagcuucgcugaugacuuc

SEQ ID NO: 75699 - RNA, 19 nt, Homo sapiens
ggacaaccguggcuucaug

SEQ ID NO: 75700 - RNA, 19 nt, Homo sapiens
gaucaagccugccucaauc

SEQ ID NO: 75701 - RNA, 19 nt, Homo sapiens
caaccucucccaacuauaa

SEQ ID NO: 75702 - RNA, 19 nt, Homo sapiens
gcucaagggugacaagaug

SEQ ID NO: 75703 - RNA, 19 nt, Homo sapiens
caaagcggcucccugcuau

SEQ ID NO: 75704 - RNA, 19 nt, Homo sapiens
gaaauuccaccacaagaug

SEQ ID NO: 75705 - RNA, 19 nt, Homo sapiens
ccaaagagcagcugaagau

SEQ ID NO: 75706 - RNA, 19 nt, Homo sapiens
gcagugaggcgauugagaa

SEQ ID NO: 75707 - RNA, 19 nt, Homo sapiens
caagaacaaggccgacuua

SEQ ID NO: 75708 - RNA, 19 nt, Homo sapiens
caagaugcgagacgaguua

SEQ ID NO: 75709 - RNA, 19 nt, Homo sapiens
ggaauucgagcuccacuug

SEQ ID NO: 75710 - RNA, 19 nt, Homo sapiens
gcaagcagcacuacaacug

SEQ ID NO: 75711 - RNA, 19 nt, Homo sapiens
gcagcaagcagcacuacaa

SEQ ID NO: 75712 - RNA, 19 nt, Homo sapiens
caaugagccuuuguugcua

SEQ ID NO: 75713 - RNA, 19 nt, Homo sapiens
gugaggcgauugagaagga

SEQ ID NO: 75714 - RNA, 19 nt, Homo sapiens
ccaaagcggcucccugcua

SEQ ID NO: 75715 - RNA, 19 nt, Homo sapiens
gagccuuuguugcuaauca

SEQ ID NO: 75716 - RNA, 19 nt, Homo sapiens
acacugggaugagaaauuc

SEQ ID NO: 75717 - RNA, 19 nt, Homo sapiens
ucaaauccgggacuuguuu

SEQ ID NO: 75718 - RNA, 19 nt, Homo sapiens
cggagaagcugaguuccaa

SEQ ID NO: 75719 - RNA, 19 nt, Homo sapiens
aagccugccucaaucagua

SEQ ID NO: 75720 - RNA, 19 nt, Homo sapiens
gaccugggccauagucauu

SEQ ID NO: 75721 - RNA, 19 nt, Homo sapiens
caaaggcuccugagacaca

SEQ ID NO: 75722 - RNA, 19 nt, Homo sapiens
ggacuuguuuguacguuuu

SEQ ID NO: 75723 - RNA, 19 nt, Homo sapiens
cccaugaccugcagaaaca

SEQ ID NO: 75724 - RNA, 19 nt, Homo sapiens
ugacugaggccauugacaa

SEQ ID NO: 75725 - RNA, 19 nt, Homo sapiens
gagaaauuccaccacaaga

SEQ ID NO: 75726 - RNA, 19 nt, Homo sapiens
gggacuuguuuguacguuu

SEQ ID NO: 75727 - RNA, 19 nt, Homo sapiens
gauacuccauggaauucga

SEQ ID NO: 75728 - RNA, 19 nt, Homo sapiens
aagagcagcugaagaucug

SEQ ID NO: 75729 - RNA, 19 nt, Homo sapiens
aaugagccuuuguugcuaa

SEQ ID NO: 75730 - RNA, 19 nt, Homo sapiens
uccaaaggcuccugagaca

SEQ ID NO: 75731 - RNA, 19 nt, Homo sapiens
cccaaccucucccaacuau

SEQ ID NO: 75732 - RNA, 19 nt, Homo sapiens
ucauauuuauagccaggua

SEQ ID NO: 75733 - RNA, 19 nt, Homo sapiens
cgacuuaucacgcaugucu

SEQ ID NO: 75734 - RNA, 19 nt, Homo sapiens
gcaagaaggaucuguaccu

SEQ ID NO: 75735 - RNA, 19 nt, Homo sapiens
gggcaaugagccuuuguug

SEQ ID NO: 75736 - RNA, 19 nt, Homo sapiens
guaccuggccaguguguuc

SEQ ID NO: 75737 - RNA, 19 nt, Homo sapiens
ucaacgccauguucuucaa

SEQ ID NO: 75738 - RNA, 19 nt, Homo sapiens
gagguaccagccuuggaua

SEQ ID NO: 75739 - RNA, 19 nt, Homo sapiens
cugaggccauugacaagaa

SEQ ID NO: 75740 - RNA, 19 nt, Homo sapiens
ugguggaggugacccauga

SEQ ID NO: 75741 - RNA, 19 nt, Homo sapiens
cauucugccugcccugaaa

SEQ ID NO: 75742 - RNA, 19 nt, Homo sapiens
ucacgcaugucuggcaaga

SEQ ID NO: 75743 - RNA, 19 nt, Homo sapiens
gcccucuucugacacuaaa

SEQ ID NO: 75744 - RNA, 19 nt, Homo sapiens
ugagacacaugggugcuau

SEQ ID NO: 75745 - RNA, 19 nt, Homo sapiens
gaugcgagacgaguuauag

SEQ ID NO: 75746 - RNA, 19 nt, Homo sapiens
gccucaaucaguauucaua

SEQ ID NO: 75747 - RNA, 19 nt, Homo sapiens
ccuuugaguuggacacaga

SEQ ID NO: 75748 - RNA, 19 nt, Homo sapiens
acgcaugucuggcaagaag

SEQ ID NO: 75749 - RNA, 19 nt, Homo sapiens
gaaaagcugcuaaccaaag

SEQ ID NO: 75750 - RNA, 19 nt, Homo sapiens
gugacucgguccuauacug

SEQ ID NO: 75751 - RNA, 19 nt, Homo sapiens
gcuagucaacgccauguuc

SEQ ID NO: 75752 - RNA, 19 nt, Homo sapiens
guaccagccuuggauacuc

SEQ ID NO: 75753 - RNA, 19 nt, Homo sapiens
cauggugacucgguccuau

SEQ ID NO: 75754 - RNA, 19 nt, Homo sapiens
uugaaaagcugcuaaccaa

SEQ ID NO: 75755 - RNA, 19 nt, Homo sapiens
ugcgagcacuccaagauca

SEQ ID NO: 75756 - RNA, 19 nt, Homo sapiens
cuaaucaaauccgggacuu

SEQ ID NO: 75757 - RNA, 19 nt, Homo sapiens
uaaccaaagagcagcugaa

SEQ ID NO: 75758 - RNA, 19 nt, Homo sapiens
ggagaacauccugguguca

SEQ ID NO: 75759 - RNA, 19 nt, Homo sapiens
ccaccgccuuugaguugga

SEQ ID NO: 75760 - RNA, 19 nt, Homo sapiens
cgccaccgccuuugaguug

SEQ ID NO: 75761 - RNA, 19 nt, Homo sapiens
agaacaaggccgacuuauc

SEQ ID NO: 75762 - RNA, 19 nt, Homo sapiens
cagugagcuucgcugauga

SEQ ID NO: 75763 - RNA, 19 nt, Homo sapiens
gcacuccaagaucaacuuc

SEQ ID NO: 75764 - RNA, 19 nt, Homo sapiens
gcaugucuggcaagaagga

SEQ ID NO: 75765 - RNA, 19 nt, Homo sapiens
agaaauuccaccacaagau

SEQ ID NO: 75766 - RNA, 19 nt, Homo sapiens
ugagaaauuccaccacaag

SEQ ID NO: 75767 - RNA, 19 nt, Homo sapiens
gcagcagcaagcagcacua

SEQ ID NO: 75768 - RNA, 19 nt, Homo sapiens
agacacaugggugcuauug

SEQ ID NO: 75769 - RNA, 19 nt, Homo sapiens
cagccgaggugaagaaacc

SEQ ID NO: 75770 - RNA, 19 nt, Homo sapiens
aaagagcagcugaagaucu

SEQ ID NO: 75771 - RNA, 19 nt, Homo sapiens
aaucaaauccgggacuugu

SEQ ID NO: 75772 - RNA, 19 nt, Homo sapiens
ugcccgaggucaccaagga

SEQ ID NO: 75773 - RNA, 19 nt, Homo sapiens
agaucaagccugccucaau

SEQ ID NO: 75774 - RNA, 19 nt, Homo sapiens
ccugaaagucccagaucaa

SEQ ID NO: 75775 - RNA, 19 nt, Homo sapiens
gcggcucccugcuauucau

SEQ ID NO: 75776 - RNA, 19 nt, Homo sapiens
aaaagcugcuaaccaaaga

SEQ ID NO: 75777 - RNA, 19 nt, Homo sapiens
cuacuacgacgacgagaag

SEQ ID NO: 75778 - RNA, 19 nt, Homo sapiens
cacacugggaugagaaauu

SEQ ID NO: 75779 - RNA, 19 nt, Homo sapiens
ggaccugggccauagucau

SEQ ID NO: 75780 - RNA, 19 nt, Homo sapiens
ugagguaccagccuuggau

SEQ ID NO: 75781 - RNA, 19 nt, Homo sapiens
guuccacgccaccgccuuu

SEQ ID NO: 75782 - RNA, 19 nt, Homo sapiens
agccagcccucuucugaca

SEQ ID NO: 75783 - RNA, 19 nt, Homo sapiens
ggacaggccucuacaacua

SEQ ID NO: 75784 - RNA, 19 nt, Homo sapiens
gagcuucgcugaugacuuc

SEQ ID NO: 75785 - RNA, 19 nt, Homo sapiens
gagcggaccuucccagcua

SEQ ID NO: 75786 - RNA, 19 nt, Homo sapiens
ggacaaccguggcuucaug

SEQ ID NO: 75787 - RNA, 19 nt, Homo sapiens
gaucaagccugccucaauc

SEQ ID NO: 75788 - RNA, 19 nt, Homo sapiens
caaccucucccaacuauaa

SEQ ID NO: 75789 - RNA, 19 nt, Homo sapiens
caaagcggcucccugcuau

SEQ ID NO: 75790 - RNA, 19 nt, Homo sapiens
gaaauuccaccacaagaug

SEQ ID NO: 75791 - RNA, 19 nt, Homo sapiens
ccaaagagcagcugaagau

SEQ ID NO: 75792 - RNA, 19 nt, Homo sapiens
caagaugcgagacgaguua

SEQ ID NO: 75793 - RNA, 19 nt, Homo sapiens
gcagugaggcggauugaga

SEQ ID NO: 75794 - RNA, 19 nt, Homo sapiens
gcaagcagcacuacaacug

SEQ ID NO: 75795 - RNA, 19 nt, Homo sapiens
gcagcaagcagcacuacaa

SEQ ID NO: 75796 - RNA, 19 nt, Homo sapiens
uccaagaacuuauuuguac

SEQ ID NO: 75797 - RNA, 19 nt, Homo sapiens
ccaaagcggcucccugcua

SEQ ID NO: 75798 - RNA, 19 nt, Homo sapiens
acacugggaugagaaauuc

SEQ ID NO: 75799 - RNA, 19 nt, Homo sapiens
aagccugccucaaucagua

SEQ ID NO: 75800 - RNA, 19 nt, Homo sapiens
gaccugggccauagucauu

SEQ ID NO: 75801 - RNA, 19 nt, Homo sapiens
caaaggcuccugagacaca

SEQ ID NO: 75802 - RNA, 19 nt, Homo sapiens
caucgugucuggcguugug

SEQ ID NO: 75803 - RNA, 19 nt, Homo sapiens
cccaugaccugcagaaaca

SEQ ID NO: 75804 - RNA, 19 nt, Homo sapiens
ugacugaggccauugacaa

SEQ ID NO: 75805 - RNA, 19 nt, Homo sapiens
gagaaauuccaccacaaga

SEQ ID NO: 75806 - RNA, 19 nt, Homo sapiens
ccaagaacuuauuuguaca

SEQ ID NO: 75807 - RNA, 19 nt, Homo sapiens
gaccuucccagcuagaauu

SEQ ID NO: 75808 - RNA, 19 nt, Homo sapiens
gccuaagggugacaagaug

SEQ ID NO: 75809 - RNA, 19 nt, Homo sapiens
aagagcagcugaagaucug

SEQ ID NO: 75810 - RNA, 19 nt, Homo sapiens
ugaggcggauugagaagga

SEQ ID NO: 75811 - RNA, 19 nt, Homo sapiens
uccaaaggcuccugagaca

SEQ ID NO: 75812 - RNA, 19 nt, Homo sapiens
caugagccuuuguugcuau

SEQ ID NO: 75813 - RNA, 19 nt, Homo sapiens
cccaaccucucccaacuau

SEQ ID NO: 75814 - RNA, 19 nt, Homo sapiens
ucauauuuauagccaggua

SEQ ID NO: 75815 - RNA, 19 nt, Homo sapiens
gagccuuuguugcuaucaa

SEQ ID NO: 75816 - RNA, 19 nt, Homo sapiens
cgacuugucacgcauguca

SEQ ID NO: 75817 - RNA, 19 nt, Homo sapiens
uaccgugggugucaugaug

SEQ ID NO: 75818 - RNA, 19 nt, Homo sapiens
ucaacgccauguucuucaa

SEQ ID NO: 75819 - RNA, 19 nt, Homo sapiens
gagguaccagccuuggaua

SEQ ID NO: 75820 - RNA, 19 nt, Homo sapiens
cugaggccauugacaagaa

SEQ ID NO: 75821 - RNA, 19 nt, Homo sapiens
ugguggaggugacccauga

SEQ ID NO: 75822 - RNA, 19 nt, Homo sapiens
cauucugccugcccugaaa

SEQ ID NO: 75823 - RNA, 19 nt, Homo sapiens
gcaagaaggaccuguaccu

SEQ ID NO: 75824 - RNA, 19 nt, Homo sapiens
ucacgcaugucaggcaaga

SEQ ID NO: 75825 - RNA, 19 nt, Homo sapiens
gcccucuucugacacuaaa

SEQ ID NO: 75826 - RNA, 19 nt, Homo sapiens
ugagacacaugggugcuau

SEQ ID NO: 75827 - RNA, 19 nt, Homo sapiens
gaugcgagacgaguuauag

SEQ ID NO: 75828 - RNA, 19 nt, Homo sapiens
guaccuggccagcguguuc

SEQ ID NO: 75829 - RNA, 19 nt, Homo sapiens
gccucaaucaguauucaua

SEQ ID NO: 75830 - RNA, 19 nt, Homo sapiens
ccuuugaguuggacacaga

SEQ ID NO: 75831 - RNA, 19 nt, Homo sapiens
gaaaagcugcuaaccaaag

SEQ ID NO: 75832 - RNA, 19 nt, Homo sapiens
gcuaucaauccaagaacuu

SEQ ID NO: 75833 - RNA, 19 nt, Homo sapiens
guaccagccuuggauacuc

SEQ ID NO: 75834 - RNA, 19 nt, Homo sapiens
gcacugcggagaaguugag

SEQ ID NO: 75835 - RNA, 19 nt, Homo sapiens
acaugagccuuuguugcua

SEQ ID NO: 75836 - RNA, 19 nt, Homo sapiens
cauggugacucgguccuau

SEQ ID NO: 75837 - RNA, 19 nt, Homo sapiens
cuaucaauccaagaacuua

SEQ ID NO: 75838 - RNA, 19 nt, Homo sapiens
ugcgagcacuccaagauca

SEQ ID NO: 75839 - RNA, 19 nt, Homo sapiens
ggccuaagggugacaagau

SEQ ID NO: 75840 - RNA, 19 nt, Homo sapiens
gaucaacuuccgcgacaag

SEQ ID NO: 75841 - RNA, 19 nt, Homo sapiens
uugaaaagcugcuaaccaa

SEQ ID NO: 75842 - RNA, 19 nt, Homo sapiens
cuagaauucacuccacuug

SEQ ID NO: 75843 - RNA, 19 nt, Homo sapiens
uaaccaaagagcagcugaa

SEQ ID NO: 75844 - RNA, 19 nt, Homo sapiens
ggagaacauccugguguca

SEQ ID NO: 75845 - RNA, 19 nt, Homo sapiens
ccaccgccuuugaguugga

SEQ ID NO: 75846 - RNA, 19 nt, Homo sapiens
cgccaccgccuuugaguug

SEQ ID NO: 75847 - RNA, 19 nt, Homo sapiens
gcacuccaagaucaacuuc

SEQ ID NO: 75848 - RNA, 19 nt, Homo sapiens
cagugagcuucgcugauga

SEQ ID NO: 75849 - RNA, 19 nt, Homo sapiens
ggaccuucccagcuagaau

SEQ ID NO: 75850 - RNA, 19 nt, Homo sapiens
gcaugucaggcaagaagga

SEQ ID NO: 75851 - RNA, 19 nt, Homo sapiens
agaaauuccaccacaagau

SEQ ID NO: 75852 - RNA, 19 nt, Homo sapiens
ugagaaauuccaccacaag

SEQ ID NO: 75853 - RNA, 19 nt, Homo sapiens
guuagucaacgccauguuc

SEQ ID NO: 75854 - RNA, 19 nt, Homo sapiens
agacacaugggugcuauug

SEQ ID NO: 75855 - RNA, 19 nt, Homo sapiens
gcagcagcaagcagcacua

SEQ ID NO: 75856 - RNA, 19 nt, Homo sapiens
aaagagcagcugaagaucu

SEQ ID NO: 75857 - RNA, 19 nt, Homo sapiens
agacucuggucaagaagca

SEQ ID NO: 75858 - RNA, 19 nt, Homo sapiens
agaucaagccugccucaau

SEQ ID NO: 75859 - RNA, 19 nt, Homo sapiens
ccugaaagucccagaucaa

SEQ ID NO: 75860 - RNA, 19 nt, Homo sapiens
gcggcucccugcuauucau

SEQ ID NO: 75861 - RNA, 19 nt, Homo sapiens
ugcccgaggucaccaagga

SEQ ID NO: 75862 - RNA, 19 nt, Homo sapiens
aaaagcugcuaaccaaaga

SEQ ID NO: 75863 - RNA, 19 nt, Homo sapiens
cuacuacgacgacgagaag

SEQ ID NO: 75864 - RNA, 19 nt, Homo sapiens
cacacugggaugagaaauu

SEQ ID NO: 75865 - RNA, 19 nt, Homo sapiens
ggaccugggccauagucau

SEQ ID NO: 75866 - RNA, 19 nt, Homo sapiens
gcuagaauucacuccacuu

SEQ ID NO: 75867 - RNA, 19 nt, Homo sapiens
ugagguaccagccuuggau

SEQ ID NO: 75868 - RNA, 19 nt, Homo sapiens
guuccacgccaccgccuuu

SEQ ID NO: 75869 - RNA, 19 nt, Homo sapiens
guugcuaucaauccaagaa

SEQ ID NO: 75870 - RNA, 19 nt, Homo sapiens
agccagcccucuucugaca

SEQ ID NO: 75871 - RNA, 19 nt, Homo sapiens
gaacguaucuagcaucaug

SEQ ID NO: 75872 - RNA, 19 nt, Homo sapiens
gcacucaguugacuacgua

SEQ ID NO: 75873 - RNA, 19 nt, Homo sapiens
guaaaucugucaggucuuu

SEQ ID NO: 75874 - RNA, 19 nt, Homo sapiens
gacaagauccuccugaaug

SEQ ID NO: 75875 - RNA, 19 nt, Homo sapiens
gggacaagauccuccugaa

SEQ ID NO: 75876 - RNA, 19 nt, Homo sapiens
ggagaguggugaacguauc

SEQ ID NO: 75877 - RNA, 19 nt, Homo sapiens
gaaugaaaaucaacagaug

SEQ ID NO: 75878 - RNA, 19 nt, Homo sapiens
gaucccacacccuuucaua

SEQ ID NO: 75879 - RNA, 19 nt, Homo sapiens
ggacaagauccuccugaau

SEQ ID NO: 75880 - RNA, 19 nt, Homo sapiens
aagcugaagugacgaugaa

SEQ ID NO: 75881 - RNA, 19 nt, Homo sapiens
ccacacccuuucauauuca

SEQ ID NO: 75882 - RNA, 19 nt, Homo sapiens
gugaacguaucuagcauca

SEQ ID NO: 75883 - RNA, 19 nt, Homo sapiens
agaagggagugcaccagaa

SEQ ID NO: 75884 - RNA, 19 nt, Homo sapiens
gaucucuuaucaauuagca

SEQ ID NO: 75885 - RNA, 19 nt, Homo sapiens
gagaagagaguugaacagu

SEQ ID NO: 75886 - RNA, 19 nt, Homo sapiens
gaagggagugcaccagaag

SEQ ID NO: 75887 - RNA, 19 nt, Homo sapiens
caacagaugaauaaauggu

SEQ ID NO: 75888 - RNA, 19 nt, Homo sapiens
gagcgucagagcccuuaaa

SEQ ID NO: 75889 - RNA, 19 nt, Homo sapiens
guccaaagggcauuuacaa

SEQ ID NO: 75890 - RNA, 19 nt, Homo sapiens
cagggugggugagaacuga

SEQ ID NO: 75891 - RNA, 19 nt, Homo sapiens
cccacacccuuucauauuc

SEQ ID NO: 75892 - RNA, 19 nt, Homo sapiens
caagagcccagaagaaggu

SEQ ID NO: 75893 - RNA, 19 nt, Homo sapiens
ucaguugacuacguaaauc

SEQ ID NO: 75894 - RNA, 19 nt, Homo sapiens
caauuuguuucagagaaga

SEQ ID NO: 75895 - RNA, 19 nt, Homo sapiens
ccaccaagagcccagaaga

SEQ ID NO: 75896 - RNA, 19 nt, Homo sapiens
ugucaggucuuuugugauu

SEQ ID NO: 75897 - RNA, 19 nt, Homo sapiens
acaagauccuccugaaugc

SEQ ID NO: 75898 - RNA, 19 nt, Homo sapiens
cagaaguuccgcagugaga

SEQ ID NO: 75899 - RNA, 19 nt, Homo sapiens
acagaauuacucccucuaa

SEQ ID NO: 75900 - RNA, 19 nt, Homo sapiens
acucacuaauguacuacua

SEQ ID NO: 75901 - RNA, 19 nt, Homo sapiens
caccaagagcccagaagaa

SEQ ID NO: 75902 - RNA, 19 nt, Homo sapiens
ucccacacccuuucauauu

SEQ ID NO: 75903 - RNA, 19 nt, Homo sapiens
gaagugacgaugaaaacaa

SEQ ID NO: 75904 - RNA, 19 nt, Homo sapiens
caagcugaagugacgauga

SEQ ID NO: 75905 - RNA, 19 nt, Homo sapiens
uggacgugcuggucaacaa

SEQ ID NO: 75906 - RNA, 19 nt, Homo sapiens
ggacccaaggccaccaaga

SEQ ID NO: 75907 - RNA, 19 nt, Homo sapiens
ucaccguucuguccaggau

SEQ ID NO: 75908 - RNA, 19 nt, Homo sapiens
gcugaucccacacccuuuc

SEQ ID NO: 75909 - RNA, 19 nt, Homo sapiens
cagagaagagaguugaaca

SEQ ID NO: 75910 - RNA, 19 nt, Homo sapiens
agcacucacuaauguacua

SEQ ID NO: 75911 - RNA, 19 nt, Homo sapiens
ucgacgaucugcagagcau

SEQ ID NO: 75912 - RNA, 19 nt, Homo sapiens
gacccaaggccaccaagag

SEQ ID NO: 75913 - RNA, 19 nt, Homo sapiens
caggauccacgccaggaaa

SEQ ID NO: 75914 - RNA, 19 nt, Homo sapiens
uaucaauuagcacucacua

SEQ ID NO: 75915 - RNA, 19 nt, Homo sapiens
gcaaccuacgcacucaguu

SEQ ID NO: 75916 - RNA, 19 nt, Homo sapiens
guggugaacguaucuagca

SEQ ID NO: 75917 - RNA, 19 nt, Homo sapiens
gggagaguggugaacguau

SEQ ID NO: 75918 - RNA, 19 nt, Homo sapiens
gaggaaagcugacaggauu

SEQ ID NO: 75919 - RNA, 19 nt, Homo sapiens
ggagcuugcugcuuaauaa

SEQ ID NO: 75920 - RNA, 19 nt, Homo sapiens
cuucggagcuugcugcuua

SEQ ID NO: 75921 - RNA, 19 nt, Homo sapiens
caagagugaugauccaaug

SEQ ID NO: 75922 - RNA, 19 nt, Homo sapiens
gugaagaucugcaggaaag

SEQ ID NO: 75923 - RNA, 19 nt, Homo sapiens
aaacaugugcaacgaguua

SEQ ID NO: 75924 - RNA, 19 nt, Homo sapiens
ucaguaguuugcaguguuu

SEQ ID NO: 75925 - RNA, 19 nt, Homo sapiens
gaaagguuccacagugaga

SEQ ID NO: 75926 - RNA, 19 nt, Homo sapiens
cauuaaagcugagaugaca

SEQ ID NO: 75927 - RNA, 19 nt, Homo sapiens
agaugacacugaagacaaa

SEQ ID NO: 75928 - RNA, 19 nt, Homo sapiens
gagaugacacugaagacaa

SEQ ID NO: 75929 - RNA, 19 nt, Homo sapiens
aagcugagaugacacugaa

SEQ ID NO: 75930 - RNA, 19 nt, Homo sapiens
ccugguggaucucaugaaa

SEQ ID NO: 75931 - RNA, 19 nt, Homo sapiens
gcuugcugcuuaauaaaug

SEQ ID NO: 75932 - RNA, 19 nt, Homo sapiens
ggagaguggugaauaucag

SEQ ID NO: 75933 - RNA, 19 nt, Homo sapiens
ugacacugaagacaaauuu

SEQ ID NO: 75934 - RNA, 19 nt, Homo sapiens
guugguccaugacaaaguu

SEQ ID NO: 75935 - RNA, 19 nt, Homo sapiens
gaguuacugccgauaauga

SEQ ID NO: 75936 - RNA, 19 nt, Homo sapiens
ucaacguacuggucaacaa

SEQ ID NO: 75937 - RNA, 19 nt, Homo sapiens
aaacugcagugaagaucug

SEQ ID NO: 75938 - RNA, 19 nt, Homo sapiens
aaggagaccugguggaucu

SEQ ID NO: 75939 - RNA, 19 nt, Homo sapiens
aauaaauguugguggaaug

SEQ ID NO: 75940 - RNA, 19 nt, Homo sapiens
cuagaaacaugugcaacga

SEQ ID NO: 75941 - RNA, 19 nt, Homo sapiens
gagcuugcugcuuaauaaa

SEQ ID NO: 75942 - RNA, 19 nt, Homo sapiens
ccaguugguccaugacaaa

SEQ ID NO: 75943 - RNA, 19 nt, Homo sapiens
gcugagaugacacugaaga

SEQ ID NO: 75944 - RNA, 19 nt, Homo sapiens
caggaccagugaagacaga

SEQ ID NO: 75945 - RNA, 19 nt, Homo sapiens
ggaaggcuggcccaacuca

SEQ ID NO: 75946 - RNA, 19 nt, Homo sapiens
gauccaaugcccuuugaca

SEQ ID NO: 75947 - RNA, 19 nt, Homo sapiens
cagugaagaucugcaggaa

SEQ ID NO: 75948 - RNA, 19 nt, Homo sapiens
gacauuaaagcugagauga

SEQ ID NO: 75949 - RNA, 19 nt, Homo sapiens
gaugauccaaugcccuuug

SEQ ID NO: 75950 - RNA, 19 nt, Homo sapiens
caugggagaguggugaaua

SEQ ID NO: 75951 - RNA, 19 nt, Homo sapiens
gaaacaugugcaacgaguu

SEQ ID NO: 75952 - RNA, 19 nt, Homo sapiens
gugaauaucaguaguuugc

SEQ ID NO: 75953 - RNA, 19 nt, Homo sapiens
gccaguugguccaugacaa

SEQ ID NO: 75954 - RNA, 19 nt, Homo sapiens
uggugaauaucaguaguuu

SEQ ID NO: 75955 - RNA, 19 nt, Homo sapiens
gggagaguggugaauauca

SEQ ID NO: 75956 - RNA, 19 nt, Homo sapiens
agacauggaugggaaagac

SEQ ID NO: 75957 - RNA, 19 nt, Homo sapiens
gagaagaggaaagcugaca

SEQ ID NO: 75958 - RNA, 19 nt, Homo sapiens
uggcccaacucaccuuaug

SEQ ID NO: 75959 - RNA, 19 nt, Homo sapiens
gugcaaaacugguaaacgu

SEQ ID NO: 75960 - RNA, 19 nt, Homo sapiens
gaagaucugcaggaaaggu

SEQ ID NO: 75961 - RNA, 19 nt, Homo sapiens
ggccgucgccuucaagagu

SEQ ID NO: 75962 - RNA, 19 nt, Homo sapiens
ccacuagaaacaugugcaa

SEQ ID NO: 75963 - RNA, 19 nt, Homo sapiens
ggaaagcugacaggauucu

SEQ ID NO: 75964 - RNA, 19 nt, Homo sapiens
uaucaguaguuugcagugu

SEQ ID NO: 75965 - RNA, 19 nt, Homo sapiens
caacgaguuacugccgaua

SEQ ID NO: 75966 - RNA, 19 nt, Homo sapiens
ugacauuaaagcugagaug

SEQ ID NO: 75967 - RNA, 19 nt, Homo sapiens
acgaguuacugccgauaau

SEQ ID NO: 75968 - RNA, 19 nt, Homo sapiens
caacguacuggucaacaac

SEQ ID NO: 75969 - RNA, 19 nt, Homo sapiens
cggagcuugcugcuuaaua

SEQ ID NO: 75970 - RNA, 19 nt, Homo sapiens
aaggccaguugguccauga

SEQ ID NO: 75971 - RNA, 19 nt, Homo sapiens
cugacaggauucuggugaa

SEQ ID NO: 75972 - RNA, 19 nt, Homo sapiens
gcaagaaguuaaccaagua

SEQ ID NO: 75973 - RNA, 19 nt, Homo sapiens
acacauggcuuccuaaaug

SEQ ID NO: 75974 - RNA, 19 nt, Homo sapiens
ccaggaagcugaaggagaa

SEQ ID NO: 75975 - RNA, 19 nt, Homo sapiens
ccuaugagaugaaauaugu

SEQ ID NO: 75976 - RNA, 19 nt, Homo sapiens
guuucaagcucaucaguaa

SEQ ID NO: 75977 - RNA, 19 nt, Homo sapiens
gggacgaguuugcguguuu

SEQ ID NO: 75978 - RNA, 19 nt, Homo sapiens
ccaaggaaauauugagaga

SEQ ID NO: 75979 - RNA, 19 nt, Homo sapiens
gcaaagucaucuacaagca

SEQ ID NO: 75980 - RNA, 19 nt, Homo sapiens
gagcggugcugaacuguca

SEQ ID NO: 75981 - RNA, 19 nt, Homo sapiens
gaacaaucagcggcauuua

SEQ ID NO: 75982 - RNA, 19 nt, Homo sapiens
uaauguaacuuccucuuag

SEQ ID NO: 75983 - RNA, 19 nt, Homo sapiens
ggacggugguggacaagug

SEQ ID NO: 75984 - RNA, 19 nt, Homo sapiens
ggaagaaguucggccugaa

SEQ ID NO: 75985 - RNA, 19 nt, Homo sapiens
gagagaagucggccaggua

SEQ ID NO: 75986 - RNA, 19 nt, Homo sapiens
guuaacacauggcuuccua

SEQ ID NO: 75987 - RNA, 19 nt, Homo sapiens
ucaacaagauugggaagaa

SEQ ID NO: 75988 - RNA, 19 nt, Homo sapiens
gaggaggcguucaccuuug

SEQ ID NO: 75989 - RNA, 19 nt, Homo sapiens
aaggaaauauugagagaga

SEQ ID NO: 75990 - RNA, 19 nt, Homo sapiens
gaagcaagaaguuaaccaa

SEQ ID NO: 75991 - RNA, 19 nt, Homo sapiens
guucuggacauuucauaua

SEQ ID NO: 75992 - RNA, 19 nt, Homo sapiens
acacacgcgugauugguaa

SEQ ID NO: 75993 - RNA, 19 nt, Homo sapiens
cuaauguaacuuccucuua

SEQ ID NO: 75994 - RNA, 19 nt, Homo sapiens
gaagaugagcuccgagaag

SEQ ID NO: 75995 - RNA, 19 nt, Homo sapiens
agacggagcagacaaccua

SEQ ID NO: 75996 - RNA, 19 nt, Homo sapiens
ggacgaguuugcguguuug

SEQ ID NO: 75997 - RNA, 19 nt, Homo sapiens
gaacaccaggaucccauga

SEQ ID NO: 75998 - RNA, 19 nt, Homo sapiens
uaacacauggcuuccuaaa

SEQ ID NO: 75999 - RNA, 19 nt, Homo sapiens
uacaagcaguucaaacaga

SEQ ID NO: 76000 - RNA, 19 nt, Homo sapiens
ggaaggugcagccgucaga

SEQ ID NO: 76001 - RNA, 19 nt, Homo sapiens
guggacaagugguucaaga

SEQ ID NO: 76002 - RNA, 19 nt, Homo sapiens
gcauuuaguacauccagaa

SEQ ID NO: 76003 - RNA, 19 nt, Homo sapiens
acagguggaugcugcagaa

SEQ ID NO: 76004 - RNA, 19 nt, Homo sapiens
caacaagauugggaagaag

SEQ ID NO: 76005 - RNA, 19 nt, Homo sapiens
ccauugacuugcugaacuu

SEQ ID NO: 76006 - RNA, 19 nt, Homo sapiens
caccaccgcugaugagauc

SEQ ID NO: 76007 - RNA, 19 nt, Homo sapiens
gaaguucggccugaagugu

SEQ ID NO: 76008 - RNA, 19 nt, Homo sapiens
ugucacgucuccuuacaga

SEQ ID NO: 76009 - RNA, 19 nt, Homo sapiens
caagaaguuaaccaaguaa

SEQ ID NO: 76010 - RNA, 19 nt, Homo sapiens
acaagugguucaagagcaa

SEQ ID NO: 76011 - RNA, 19 nt, Homo sapiens
ggcaacugcugaucgacuu

SEQ ID NO: 76012 - RNA, 19 nt, Homo sapiens
ggaaauauugagagagaag

SEQ ID NO: 76013 - RNA, 19 nt, Homo sapiens
acaagcaguucaaacagau

SEQ ID NO: 76014 - RNA, 19 nt, Homo sapiens
gagcuggcgggacgaguuu

SEQ ID NO: 76015 - RNA, 19 nt, Homo sapiens
ccacuucuccuucgcuuuc

SEQ ID NO: 76016 - RNA, 19 nt, Homo sapiens
ugaggaggcguucaccuuu

SEQ ID NO: 76017 - RNA, 19 nt, Homo sapiens
gaagaaguucggccugaag

SEQ ID NO: 76018 - RNA, 19 nt, Homo sapiens
cggccuaugagaugaaaua

SEQ ID NO: 76019 - RNA, 19 nt, Homo sapiens
ccaauucucacauccuaga

SEQ ID NO: 76020 - RNA, 19 nt, Homo sapiens
uuuaguacauccagaaagu

SEQ ID NO: 76021 - RNA, 19 nt, Homo sapiens
ccuaaacacacgcgugauu

SEQ ID NO: 76022 - RNA, 19 nt, Homo sapiens
gccauugacuugcugaacu

SEQ ID NO: 76023 - RNA, 19 nt, Homo sapiens
gcaugcugaucgcgcaaga

SEQ ID NO: 76024 - RNA, 19 nt, Homo sapiens
caggaucccaugacagauu

SEQ ID NO: 76025 - RNA, 19 nt, Homo sapiens
ugaacaaucagcggcauuu

SEQ ID NO: 76026 - RNA, 19 nt, Homo sapiens
ggaugaacacaggcaauga

SEQ ID NO: 76027 - RNA, 19 nt, Homo sapiens
uaggauguuucaccaagga

SEQ ID NO: 76028 - RNA, 19 nt, Homo sapiens
ggccaagugugaguucuuc

SEQ ID NO: 76029 - RNA, 19 nt, Homo sapiens
uugugucucuguugucuaa

SEQ ID NO: 76030 - RNA, 19 nt, Homo sapiens
uuaaauucccgaagcaaga

SEQ ID NO: 76031 - RNA, 19 nt, Homo sapiens
ggcaaugacugcgcagagu

SEQ ID NO: 76032 - RNA, 19 nt, Homo sapiens
gcaccgggaaguccaguca

SEQ ID NO: 76033 - RNA, 19 nt, Homo sapiens
acaggacggugguggacaa

SEQ ID NO: 76034 - RNA, 19 nt, Homo sapiens
gaucggcuacgacuucauc

SEQ ID NO: 76035 - RNA, 19 nt, Homo sapiens
gcugaucgacuuugugucu

SEQ ID NO: 76036 - RNA, 19 nt, Homo sapiens
acaccaggaucccaugaca

SEQ ID NO: 76037 - RNA, 19 nt, Homo sapiens
gcgcagaguggauuaaagg

SEQ ID NO: 76038 - RNA, 19 nt, Homo sapiens
ucacgucuccuuacagagu

SEQ ID NO: 76039 - RNA, 19 nt, Homo sapiens
gagcgggaccagaagugaa

SEQ ID NO: 76040 - RNA, 19 nt, Homo sapiens
gcacguuucaagcucauca

SEQ ID NO: 76041 - RNA, 19 nt, Homo sapiens
uaaauucccgaagcaagaa

SEQ ID NO: 76042 - RNA, 19 nt, Homo sapiens
gagccgacauccgggaaca

SEQ ID NO: 76043 - RNA, 19 nt, Homo sapiens
ucuggaacauucugucauc

SEQ ID NO: 76044 - RNA, 19 nt, Homo sapiens
caaucagcggcauuuagua

SEQ ID NO: 76045 - RNA, 19 nt, Homo sapiens
agcaagaaguuaaccaagu

SEQ ID NO: 76046 - RNA, 19 nt, Homo sapiens
gcaacugcugaucgacuuu

SEQ ID NO: 76047 - RNA, 19 nt, Homo sapiens
guaggcaccaccucuguca

SEQ ID NO: 76048 - RNA, 19 nt, Homo sapiens
acaaucagcggcauuuagu

SEQ ID NO: 76049 - RNA, 19 nt, Homo sapiens
ggagcgggaccagaaguga

SEQ ID NO: 76050 - RNA, 19 nt, Homo sapiens
ccugaagugugagcucuug

SEQ ID NO: 76051 - RNA, 19 nt, Homo sapiens
gcaccaccucugucacguu

SEQ ID NO: 76052 - RNA, 19 nt, Homo sapiens
guacauccagaaaguugug

SEQ ID NO: 76053 - RNA, 19 nt, Homo sapiens
cuaaacacacgcgugauug

SEQ ID NO: 76054 - RNA, 19 nt, Homo sapiens
ucuacaagcaguucaaaca

SEQ ID NO: 76055 - RNA, 19 nt, Homo sapiens
ggaagcugaaggagaagug

SEQ ID NO: 76056 - RNA, 19 nt, Homo sapiens
gacuuugugucucuguugu

SEQ ID NO: 76057 - RNA, 19 nt, Homo sapiens
ccaccucugucacguucug

SEQ ID NO: 76058 - RNA, 19 nt, Homo sapiens
agagagaagaguccaggaa

SEQ ID NO: 76059 - RNA, 19 nt, Homo sapiens
gcagccgucagaccaaguu

SEQ ID NO: 76060 - RNA, 19 nt, Homo sapiens
guugucacgucuccuuaca

SEQ ID NO: 76061 - RNA, 19 nt, Homo sapiens
gguucaagagcaacgauga

SEQ ID NO: 76062 - RNA, 19 nt, Homo sapiens
gggaucggcuacgacuuca

SEQ ID NO: 76063 - RNA, 19 nt, Homo sapiens
gaaccagacggagcagaca

SEQ ID NO: 76064 - RNA, 19 nt, Homo sapiens
ccuggcggcugaagaacga

SEQ ID NO: 76065 - RNA, 19 nt, Homo sapiens
cgacuuugugucucuguug

SEQ ID NO: 76066 - RNA, 19 nt, Homo sapiens
uaguacauccagaaaguug

SEQ ID NO: 76067 - RNA, 19 nt, Homo sapiens
gucccagcaugccuucuga

SEQ ID NO: 76068 - RNA, 19 nt, Homo sapiens
ugacugcgcagaguggauu

SEQ ID NO: 76069 - RNA, 19 nt, Homo sapiens
gaaauauugagagagaagu

SEQ ID NO: 76070 - RNA, 19 nt, Homo sapiens
ccaggacgcacguuucaag

SEQ ID NO: 76071 - RNA, 19 nt, Homo sapiens
cacauggcuuccuaaaugg

SEQ ID NO: 76072 - RNA, 19 nt, Homo sapiens
gagaacaccucaucccaua

SEQ ID NO: 76073 - RNA, 19 nt, Homo sapiens
uguaacgacuuccuuauua

SEQ ID NO: 76074 - RNA, 19 nt, Homo sapiens
gaagaccgcugaugagcuu

SEQ ID NO: 76075 - RNA, 19 nt, Homo sapiens
ucaaugcugucuccaauaa

SEQ ID NO: 76076 - RNA, 19 nt, Homo sapiens
guaacgacuuccuuauuaa

SEQ ID NO: 76077 - RNA, 19 nt, Homo sapiens
ggacaaccacgucuucuuu

SEQ ID NO: 76078 - RNA, 19 nt, Homo sapiens
gaaagucugcucuccagua

SEQ ID NO: 76079 - RNA, 19 nt, Homo sapiens
gcaccgccgugaucacuaa

SEQ ID NO: 76080 - RNA, 19 nt, Homo sapiens
caacaucuaucgcuaugau

SEQ ID NO: 76081 - RNA, 19 nt, Homo sapiens
ggagaaguauuucaagaag

SEQ ID NO: 76082 - RNA, 19 nt, Homo sapiens
ggaugaagcucucagacau

SEQ ID NO: 76083 - RNA, 19 nt, Homo sapiens
guucaaugauggaguguuu

SEQ ID NO: 76084 - RNA, 19 nt, Homo sapiens
gauggaguguuugcuuaua

SEQ ID NO: 76085 - RNA, 19 nt, Homo sapiens
caaacaaccaucaaucuga

SEQ ID NO: 76086 - RNA, 19 nt, Homo sapiens
ggugguuggugaaagguua

SEQ ID NO: 76087 - RNA, 19 nt, Homo sapiens
gguaugacauggaugacaa

SEQ ID NO: 76088 - RNA, 19 nt, Homo sapiens
caagaggcaccaugaaauu

SEQ ID NO: 76089 - RNA, 19 nt, Homo sapiens
ggaaaucaaucugcagaag

SEQ ID NO: 76090 - RNA, 19 nt, Homo sapiens
gaagacagccuggcgguau

SEQ ID NO: 76091 - RNA, 19 nt, Homo sapiens
gacaagaggcaccaugaaa

SEQ ID NO: 76092 - RNA, 19 nt, Homo sapiens
ggaugugucccaugcuaua

SEQ ID NO: 76093 - RNA, 19 nt, Homo sapiens
guaguggacugcuuugaca

SEQ ID NO: 76094 - RNA, 19 nt, Homo sapiens
ucagcgcacucaucaauug

SEQ ID NO: 76095 - RNA, 19 nt, Homo sapiens
acaaaggacuacaccauca

SEQ ID NO: 76096 - RNA, 19 nt, Homo sapiens
gaacaccucaucccauaca

SEQ ID NO: 76097 - RNA, 19 nt, Homo sapiens
gcaaacaaccaucaaucug

SEQ ID NO: 76098 - RNA, 19 nt, Homo sapiens
gaaggaggaucgggagaag

SEQ ID NO: 76099 - RNA, 19 nt, Homo sapiens
caaagagguaucagacgua

SEQ ID NO: 76100 - RNA, 19 nt, Homo sapiens
ccaauaagacgcugguguu

SEQ ID NO: 76101 - RNA, 19 nt, Homo sapiens
caugcuauaugcuccauug

SEQ ID NO: 76102 - RNA, 19 nt, Homo sapiens
ccacaggccugagaaaguc

SEQ ID NO: 76103 - RNA, 19 nt, Homo sapiens
gggagaaguauuucaagaa

SEQ ID NO: 76104 - RNA, 19 nt, Homo sapiens
gagaaguauuucaagaagu

SEQ ID NO: 76105 - RNA, 19 nt, Homo sapiens
caauccaaaugccuucuug

SEQ ID NO: 76106 - RNA, 19 nt, Homo sapiens
gcucagcgcacucaucaau

SEQ ID NO: 76107 - RNA, 19 nt, Homo sapiens
cuucuuggcugagcuguuu

SEQ ID NO: 76108 - RNA, 19 nt, Homo sapiens
uuaagugggagaauaagua

SEQ ID NO: 76109 - RNA, 19 nt, Homo sapiens
gcaagacgaccaccucagu

SEQ ID NO: 76110 - RNA, 19 nt, Homo sapiens
caaccgcucugcaaacaac

SEQ ID NO: 76111 - RNA, 19 nt, Homo sapiens
uaagugggagaauaaguaa

SEQ ID NO: 76112 - RNA, 19 nt, Homo sapiens
cuucuggacuacuucuaua

SEQ ID NO: 76113 - RNA, 19 nt, Homo sapiens
gauugagaguguccugaug

SEQ ID NO: 76114 - RNA, 19 nt, Homo sapiens
ggaaggaggaucgggagaa

SEQ ID NO: 76115 - RNA, 19 nt, Homo sapiens
agaggaaacgcaaagagua

SEQ ID NO: 76116 - RNA, 19 nt, Homo sapiens
cauacaacccugauugaga

SEQ ID NO: 76117 - RNA, 19 nt, Homo sapiens
cgggagaaguauuucaaga

SEQ ID NO: 76118 - RNA, 19 nt, Homo sapiens
acagcaagguguuuguaug

SEQ ID NO: 76119 - RNA, 19 nt, Homo sapiens
aaaucaaucugcagaaggu

SEQ ID NO: 76120 - RNA, 19 nt, Homo sapiens
caauaagacgcugguguuu

SEQ ID NO: 76121 - RNA, 19 nt, Homo sapiens
ucucaaugcugucuccaau

SEQ ID NO: 76122 - RNA, 19 nt, Homo sapiens
aaugcugucuccaauaaga

SEQ ID NO: 76123 - RNA, 19 nt, Homo sapiens
guggugaucuccgagcaaa

SEQ ID NO: 76124 - RNA, 19 nt, Homo sapiens
ggacggugguuggugaaag

SEQ ID NO: 76125 - RNA, 19 nt, Homo sapiens
augauggaguguuugcuua

SEQ ID NO: 76126 - RNA, 19 nt, Homo sapiens
caacccugauugagagugu

SEQ ID NO: 76127 - RNA, 19 nt, Homo sapiens
gaggcaccaugaaauugga

SEQ ID NO: 76128 - RNA, 19 nt, Homo sapiens
gcuggucgcuacaucuaca

SEQ ID NO: 76129 - RNA, 19 nt, Homo sapiens
ggagacagcaagguguuug

SEQ ID NO: 76130 - RNA, 19 nt, Homo sapiens
ggcagaguguggaaaucaa

SEQ ID NO: 76131 - RNA, 19 nt, Homo sapiens
uaucagacguagcuuacuc

SEQ ID NO: 76132 - RNA, 19 nt, Homo sapiens
caacacaccacgccuucga

SEQ ID NO: 76133 - RNA, 19 nt, Homo sapiens
gacaacuccuggaccaagu

SEQ ID NO: 76134 - RNA, 19 nt, Homo sapiens
auaagacgcugguguuugc

SEQ ID NO: 76135 - RNA, 19 nt, Homo sapiens
ucucagacaugcccuaucg

SEQ ID NO: 76136 - RNA, 19 nt, Homo sapiens
gcauggagaacaccucauc

SEQ ID NO: 76137 - RNA, 19 nt, Homo sapiens
acaagaggcaccaugaaau

SEQ ID NO: 76138 - RNA, 19 nt, Homo sapiens
gggacaacuuccacuacug

SEQ ID NO: 76139 - RNA, 19 nt, Homo sapiens
ugcagaaccugaacagaca

SEQ ID NO: 76140 - RNA, 19 nt, Homo sapiens
cgacaagaggcaccaugaa

SEQ ID NO: 76141 - RNA, 19 nt, Homo sapiens
caaaggacuacaccaucaa

SEQ ID NO: 76142 - RNA, 19 nt, Homo sapiens
cagcaagguguuuguaugu

SEQ ID NO: 76143 - RNA, 19 nt, Homo sapiens
gaugaagcucucagacaug

SEQ ID NO: 76144 - RNA, 19 nt, Homo sapiens
aggaggaucgggagaagua

SEQ ID NO: 76145 - RNA, 19 nt, Homo sapiens
acaugaagaccgcugauga

SEQ ID NO: 76146 - RNA, 19 nt, Homo sapiens
gacaaccacgucuucuuug

SEQ ID NO: 76147 - RNA, 19 nt, Homo sapiens
aggagaaccuguggaugaa

SEQ ID NO: 76148 - RNA, 19 nt, Homo sapiens
gaggaucgggagaaguauu

SEQ ID NO: 76149 - RNA, 19 nt, Homo sapiens
gaggaaacgcaaagaguac

SEQ ID NO: 76150 - RNA, 19 nt, Homo sapiens
ggacuacaccaucaaucca

SEQ ID NO: 76151 - RNA, 19 nt, Homo sapiens
aaagucugcucuccaguac

SEQ ID NO: 76152 - RNA, 19 nt, Homo sapiens
gcagaguguggaaaucaau

SEQ ID NO: 76153 - RNA, 19 nt, Homo sapiens
gucaaccgcucugcaaaca

SEQ ID NO: 76154 - RNA, 19 nt, Homo sapiens
caaagaguacugggacaug

SEQ ID NO: 76155 - RNA, 19 nt, Homo sapiens
gacagcaagguguuuguau

SEQ ID NO: 76156 - RNA, 19 nt, Homo sapiens
gcaaagaguacugggacau

SEQ ID NO: 76157 - RNA, 19 nt, Homo sapiens
gugccugucuugcccaaca

SEQ ID NO: 76158 - RNA, 19 nt, Homo sapiens
gcaccacugagcagauuuc

SEQ ID NO: 76159 - RNA, 19 nt, Homo sapiens
uggcaccacugagcagauu

SEQ ID NO: 76160 - RNA, 19 nt, Homo sapiens
uuacaucaaucucaaugcu

SEQ ID NO: 76161 - RNA, 19 nt, Homo sapiens
gccuucgaguucacuguaa

SEQ ID NO: 76162 - RNA, 19 nt, Homo sapiens
agacaaaggacuacaccau

SEQ ID NO: 76163 - RNA, 19 nt, Homo sapiens
acaccacgccuucgaguuc

SEQ ID NO: 76164 - RNA, 19 nt, Homo sapiens
aagcuaccuugcaagauuc

SEQ ID NO: 76165 - RNA, 19 nt, Homo sapiens
cagaggaaacgcaaagagu

SEQ ID NO: 76166 - RNA, 19 nt, Homo sapiens
gacgugguccaguguauca

SEQ ID NO: 76167 - RNA, 19 nt, Homo sapiens
gacggugguuggugaaagg

SEQ ID NO: 76168 - RNA, 19 nt, Homo sapiens
aguguuugcuuauaucauc

SEQ ID NO: 76169 - RNA, 19 nt, Homo sapiens
guagcuuacucuggcauuc

SEQ ID NO: 76170 - RNA, 19 nt, Homo sapiens
gggagaauaaguaaaugca

SEQ ID NO: 76171 - RNA, 19 nt, Homo sapiens
ccaccucagugccugucuu

SEQ ID NO: 76172 - RNA, 19 nt, Homo sapiens
ggaagaugcuauugggaaa

SEQ ID NO: 76173 - RNA, 19 nt, Homo sapiens
ggaaugugcuggugacugu

SEQ ID NO: 76174 - RNA, 19 nt, Homo sapiens
ucaaguggaugaucaagaa

SEQ ID NO: 76175 - RNA, 19 nt, Homo sapiens
ccaagugccuccugucuga

SEQ ID NO: 76176 - RNA, 19 nt, Homo sapiens
cgaagauccuggcaaguuu

SEQ ID NO: 76177 - RNA, 19 nt, Homo sapiens
ucacagacaucucagacuu

SEQ ID NO: 76178 - RNA, 19 nt, Homo sapiens
gaagcacuuugaccacuau

SEQ ID NO: 76179 - RNA, 19 nt, Homo sapiens
ccaaagcccugguccucaa

SEQ ID NO: 76180 - RNA, 19 nt, Homo sapiens
gcagcuacuuugugcaguu

SEQ ID NO: 76181 - RNA, 19 nt, Homo sapiens
guggagacuucaugcuuaa

SEQ ID NO: 76182 - RNA, 19 nt, Homo sapiens
gagacgaggucaucaucau

SEQ ID NO: 76183 - RNA, 19 nt, Homo sapiens
gauccuggcaaguuucuuu

SEQ ID NO: 76184 - RNA, 19 nt, Homo sapiens
aguggagacuucaugcuua

SEQ ID NO: 76185 - RNA, 19 nt, Homo sapiens
uuucagacauuucuagguu

SEQ ID NO: 76186 - RNA, 19 nt, Homo sapiens
agaggaagaugccugacuu

SEQ ID NO: 76187 - RNA, 19 nt, Homo sapiens
gcuacgagcccaugacaau

SEQ ID NO: 76188 - RNA, 19 nt, Homo sapiens
gcacuuugaccacuauauc

SEQ ID NO: 76189 - RNA, 19 nt, Homo sapiens
ucucagacuucaagaggaa

SEQ ID NO: 76190 - RNA, 19 nt, Homo sapiens
ggaugagcccuaugacaga

SEQ ID NO: 76191 - RNA, 19 nt, Homo sapiens
gcuacuuccucaucacaga

SEQ ID NO: 76192 - RNA, 19 nt, Homo sapiens
caacccagcagcuacuuug

SEQ ID NO: 76193 - RNA, 19 nt, Homo sapiens
agaagcacuuugaccacua

SEQ ID NO: 76194 - RNA, 19 nt, Homo sapiens
cagaucacaucaugaagca

SEQ ID NO: 76195 - RNA, 19 nt, Homo sapiens
gcugcugggucaggagaua

SEQ ID NO: 76196 - RNA, 19 nt, Homo sapiens
ugcuaaggcucagguauaa

SEQ ID NO: 76197 - RNA, 19 nt, Homo sapiens
cuccauagguggguuugua

SEQ ID NO: 76198 - RNA, 19 nt, Homo sapiens
ccacaugcccgcagagauc

SEQ ID NO: 76199 - RNA, 19 nt, Homo sapiens
gccagggcuucccggauuu

SEQ ID NO: 76200 - RNA, 19 nt, Homo sapiens
uagacgggaucgacuacaa

SEQ ID NO: 76201 - RNA, 19 nt, Homo sapiens
cugcuaaggcucagguaua

SEQ ID NO: 76202 - RNA, 19 nt, Homo sapiens
gcaccagaacuccgucuuc

SEQ ID NO: 76203 - RNA, 19 nt, Homo sapiens
guccagaucacaucaugaa

SEQ ID NO: 76204 - RNA, 19 nt, Homo sapiens
caucaucaucgaacccuuu

SEQ ID NO: 76205 - RNA, 19 nt, Homo sapiens
gaagauccuggcaaguuuc

SEQ ID NO: 76206 - RNA, 19 nt, Homo sapiens
gguagacuuccaccaugua

SEQ ID NO: 76207 - RNA, 19 nt, Homo sapiens
acgagaagcugcggaagug

SEQ ID NO: 76208 - RNA, 19 nt, Homo sapiens
acagacaucucagacuuca

SEQ ID NO: 76209 - RNA, 19 nt, Homo sapiens
guggaacucuagcccugaa

SEQ ID NO: 76210 - RNA, 19 nt, Homo sapiens
guccagguuucagacauuu

SEQ ID NO: 76211 - RNA, 19 nt, Homo sapiens
aguggaagguggaacucua

SEQ ID NO: 76212 - RNA, 19 nt, Homo sapiens
agauagacccgcucaggaa

SEQ ID NO: 76213 - RNA, 19 nt, Homo sapiens
gauagacccgcucaggaau

SEQ ID NO: 76214 - RNA, 19 nt, Homo sapiens
ccaguacaccaagacauuu

SEQ ID NO: 76215 - RNA, 19 nt, Homo sapiens
uuuguagggucuuguguug

SEQ ID NO: 76216 - RNA, 19 nt, Homo sapiens
caucuuagagaaccaagug

SEQ ID NO: 76217 - RNA, 19 nt, Homo sapiens
uauauccgcuucuguuuug

SEQ ID NO: 76218 - RNA, 19 nt, Homo sapiens
gcaguagccgagagcuuug

SEQ ID NO: 76219 - RNA, 19 nt, Homo sapiens
ggguccagaucacaucaug

SEQ ID NO: 76220 - RNA, 19 nt, Homo sapiens
caccagcacaucagcauug

SEQ ID NO: 76221 - RNA, 19 nt, Homo sapiens
ggaaguggaagguggaacu

SEQ ID NO: 76222 - RNA, 19 nt, Homo sapiens
ggagacgaggucaucauca

SEQ ID NO: 76223 - RNA, 19 nt, Homo sapiens
caccuucccuggcucaucu

SEQ ID NO: 76224 - RNA, 19 nt, Homo sapiens
gagacggacgguagacuuc

SEQ ID NO: 76225 - RNA, 19 nt, Homo sapiens
gaggaagaugccugacuug

SEQ ID NO: 76226 - RNA, 19 nt, Homo sapiens
gggcagcuacuuccucauc

SEQ ID NO: 76227 - RNA, 19 nt, Homo sapiens
gcaccagcacaucagcauu

SEQ ID NO: 76228 - RNA, 19 nt, Homo sapiens
cgaaggagacgaggucauc

SEQ ID NO: 76229 - RNA, 19 nt, Homo sapiens
gaacucuagcccugaaguc

SEQ ID NO: 76230 - RNA, 19 nt, Homo sapiens
ccucaucacagacaucuca

SEQ ID NO: 76231 - RNA, 19 nt, Homo sapiens
ggcagcuacuuccucauca

SEQ ID NO: 76232 - RNA, 19 nt, Homo sapiens
agcaugacgugguguguau

SEQ ID NO: 76233 - RNA, 19 nt, Homo sapiens
cacaucagaagcacuuuga

SEQ ID NO: 76234 - RNA, 19 nt, Homo sapiens
agacaucucagacuucaag

SEQ ID NO: 76235 - RNA, 19 nt, Homo sapiens
acgaagauccuggcaaguu

SEQ ID NO: 76236 - RNA, 19 nt, Homo sapiens
gaaggagacgaggucauca

SEQ ID NO: 76237 - RNA, 19 nt, Homo sapiens
gagacuucaugcuuaacca

SEQ ID NO: 76238 - RNA, 19 nt, Homo sapiens
gacgagaagcugcggaagu

SEQ ID NO: 76239 - RNA, 19 nt, Homo sapiens
ccacaucagaagcacuuug

SEQ ID NO: 76240 - RNA, 19 nt, Homo sapiens
uacgagcccaugacaauga

SEQ ID NO: 76241 - RNA, 19 nt, Homo sapiens
cagcaugacguggugugua

SEQ ID NO: 76242 - RNA, 19 nt, Homo sapiens
ggugacuguugguggcuau

SEQ ID NO: 76243 - RNA, 19 nt, Homo sapiens
uagacccgcucaggaaugu

SEQ ID NO: 76244 - RNA, 19 nt, Homo sapiens
gcuauugggaaaccucuuc

SEQ ID NO: 76245 - RNA, 19 nt, Homo sapiens
cacuauauccgcuucuguu

SEQ ID NO: 76246 - RNA, 19 nt, Homo sapiens
agcaugacgucgugaacuu

SEQ ID NO: 76247 - RNA, 19 nt, Homo sapiens
gcaugacgucgugaacuug

SEQ ID NO: 76248 - RNA, 19 nt, Homo sapiens
ccucaagccucuccuuuuc

SEQ ID NO: 76249 - RNA, 19 nt, Homo sapiens
cgguagacuuccaccaugu

SEQ ID NO: 76250 - RNA, 19 nt, Homo sapiens
gacgguagacuuccaccau

SEQ ID NO: 76251 - RNA, 19 nt, Homo sapiens
cagcuacuuugugcaguuc

SEQ ID NO: 76252 - RNA, 19 nt, Homo sapiens
acuucaugcuuaaccagua

SEQ ID NO: 76253 - RNA, 19 nt, Homo sapiens
cgugaccacaugauacgua

SEQ ID NO: 76254 - RNA, 19 nt, Homo sapiens
ugcaguagccgagagcuuu

SEQ ID NO: 76255 - RNA, 19 nt, Homo sapiens
ggaacucuagcccugaagu

SEQ ID NO: 76256 - RNA, 19 nt, Homo sapiens
caguggagacuucaugcuu

SEQ ID NO: 76257 - RNA, 19 nt, Homo sapiens
ucacaucacgcaccaaagc

SEQ ID NO: 76258 - RNA, 19 nt, Homo sapiens
ucacaucccagcucugcau

SEQ ID NO: 76259 - RNA, 19 nt, Homo sapiens
uugagugucugucuuuguc

SEQ ID NO: 76260 - RNA, 19 nt, Homo sapiens
aguggaugaucaagaacaa

SEQ ID NO: 76261 - RNA, 19 nt, Homo sapiens
gcagcuacuuccucaucac

SEQ ID NO: 76262 - RNA, 19 nt, Homo sapiens
gaauguccaucguuaagaa

SEQ ID NO: 76263 - RNA, 19 nt, Homo sapiens
caagccagcugccguccua

SEQ ID NO: 76264 - RNA, 19 nt, Homo sapiens
caaucacacucauaacuca

SEQ ID NO: 76265 - RNA, 19 nt, Homo sapiens
cagaauaagacaacaauca

SEQ ID NO: 76266 - RNA, 19 nt, Homo sapiens
acaacaaucacacucauaa

SEQ ID NO: 76267 - RNA, 19 nt, Homo sapiens
uacaugggcuggauggauu

SEQ ID NO: 76268 - RNA, 19 nt, Homo sapiens
gcgcccugcuggcaagaua

SEQ ID NO: 76269 - RNA, 19 nt, Homo sapiens
ugugcaaacugaagacaaa

SEQ ID NO: 76270 - RNA, 19 nt, Homo sapiens
guaagauuguccagugcaa

SEQ ID NO: 76271 - RNA, 19 nt, Homo sapiens
gacaacaaucacacucaua

SEQ ID NO: 76272 - RNA, 19 nt, Homo sapiens
gaauaagacaacaaucaca

SEQ ID NO: 76273 - RNA, 19 nt, Homo sapiens
cagaggaggcagaauaaga

SEQ ID NO: 76274 - RNA, 19 nt, Homo sapiens
gcagugccgaggaguauga

SEQ ID NO: 76275 - RNA, 19 nt, Homo sapiens
aauugugucuguaagauug

SEQ ID NO: 76276 - RNA, 19 nt, Homo sapiens
ccacacacgcucaccagaa

SEQ ID NO: 76277 - RNA, 19 nt, Homo sapiens
cauugucuguggaguuuga

SEQ ID NO: 76278 - RNA, 19 nt, Homo sapiens
ucacacucauaacucauug

SEQ ID NO: 76279 - RNA, 19 nt, Homo sapiens
guaggcagcugaggguauc

SEQ ID NO: 76280 - RNA, 19 nt, Homo sapiens
caccagaaguugugcaaac

SEQ ID NO: 76281 - RNA, 19 nt, Homo sapiens
gggcugcuccgguuggaaa

SEQ ID NO: 76282 - RNA, 19 nt, Homo sapiens
uuaagaaccugcagaaccu

SEQ ID NO: 76283 - RNA, 19 nt, Homo sapiens
gaaaauugugucuguaaga

SEQ ID NO: 76284 - RNA, 19 nt, Homo sapiens
agacaacaaucacacucau

SEQ ID NO: 76285 - RNA, 19 nt, Homo sapiens
uaagugaccgggacuacau

SEQ ID NO: 76286 - RNA, 19 nt, Homo sapiens
gugccgaggaguaugagua

SEQ ID NO: 76287 - RNA, 19 nt, Homo sapiens
ugugacuccuguucugaaa

SEQ ID NO: 76288 - RNA, 19 nt, Homo sapiens
cacacacgcucaccagaag

SEQ ID NO: 76289 - RNA, 19 nt, Homo sapiens
cucauugucuguggaguuu

SEQ ID NO: 76290 - RNA, 19 nt, Homo sapiens
cuguggaguuugacauuga

SEQ ID NO: 76291 - RNA, 19 nt, Homo sapiens
acccagaggaggcagaaua

SEQ ID NO: 76292 - RNA, 19 nt, Homo sapiens
ggcagaauaagacaacaau

SEQ ID NO: 76293 - RNA, 19 nt, Homo sapiens
ggaggcagaauaagacaac

SEQ ID NO: 76294 - RNA, 19 nt, Homo sapiens
cccagaggaggcagaauaa

SEQ ID NO: 76295 - RNA, 19 nt, Homo sapiens
cugaggguaucgcagagaa

SEQ ID NO: 76296 - RNA, 19 nt, Homo sapiens
gggacuacaugggcuggau

SEQ ID NO: 76297 - RNA, 19 nt, Homo sapiens
cgaauguccaucguuaaga

SEQ ID NO: 76298 - RNA, 19 nt, Homo sapiens
gcagaauaagacaacaauc

SEQ ID NO: 76299 - RNA, 19 nt, Homo sapiens
uguggaguuugacauugaa

SEQ ID NO: 76300 - RNA, 19 nt, Homo sapiens
gauaagugaccgggacuac

SEQ ID NO: 76301 - RNA, 19 nt, Homo sapiens
ggauaagugaccgggacua

SEQ ID NO: 76302 - RNA, 19 nt, Homo sapiens
gaagaagucugcuaaagaa

SEQ ID NO: 76303 - RNA, 19 nt, Homo sapiens
gagcagagcugauggagaa

SEQ ID NO: 76304 - RNA, 19 nt, Homo sapiens
gaagagaucaggaagagaa

SEQ ID NO: 76305 - RNA, 19 nt, Homo sapiens
gcucaaggauuucaucuuc

SEQ ID NO: 76306 - RNA, 19 nt, Homo sapiens
gaugguggcauauggauua

SEQ ID NO: 76307 - RNA, 19 nt, Homo sapiens
gcauauggauuaaucucuu

SEQ ID NO: 76308 - RNA, 19 nt, Homo sapiens
gugaguguaucuaccuuua

SEQ ID NO: 76309 - RNA, 19 nt, Homo sapiens
uuacucauccucuuucuua

SEQ ID NO: 76310 - RNA, 19 nt, Homo sapiens
gcgaauaugugccgcuuuc

SEQ ID NO: 76311 - RNA, 19 nt, Homo sapiens
gcgagacgcuucggucauu

SEQ ID NO: 76312 - RNA, 19 nt, Homo sapiens
gaguguaucuaccuuuaau

SEQ ID NO: 76313 - RNA, 19 nt, Homo sapiens
gaaagcagcaggcaaggau

SEQ ID NO: 76314 - RNA, 19 nt, Homo sapiens
guucaaagcaggauauguu

SEQ ID NO: 76315 - RNA, 19 nt, Homo sapiens
gcugcuaccuggugccuuu

SEQ ID NO: 76316 - RNA, 19 nt, Homo sapiens
gagccucucuguccagguu

SEQ ID NO: 76317 - RNA, 19 nt, Homo sapiens
gaauaugugccgcuuucua

SEQ ID NO: 76318 - RNA, 19 nt, Homo sapiens
agagagauauggugcgauu

SEQ ID NO: 76319 - RNA, 19 nt, Homo sapiens
gaagaagagaucaggaaga

SEQ ID NO: 76320 - RNA, 19 nt, Homo sapiens
gaaacacgcuggucaucac

SEQ ID NO: 76321 - RNA, 19 nt, Homo sapiens
gaagucugcuaaagaaagg

SEQ ID NO: 76322 - RNA, 19 nt, Homo sapiens
gagcagagcagagcugaug

SEQ ID NO: 76323 - RNA, 19 nt, Homo sapiens
ggacagcgauggguguuac

SEQ ID NO: 76324 - RNA, 19 nt, Homo sapiens
guugacagccuucuuguga

SEQ ID NO: 76325 - RNA, 19 nt, Homo sapiens
gaagaaagaacggaagaag

SEQ ID NO: 76326 - RNA, 19 nt, Homo sapiens
agcaggauauguuaaguaa

SEQ ID NO: 76327 - RNA, 19 nt, Homo sapiens
gaacucuaccagggaauaa

SEQ ID NO: 76328 - RNA, 19 nt, Homo sapiens
gcaagaccaccaccuacuu

SEQ ID NO: 76329 - RNA, 19 nt, Homo sapiens
agaagaagucugcuaaaga

SEQ ID NO: 76330 - RNA, 19 nt, Homo sapiens
gguggcauauggauuaauc

SEQ ID NO: 76331 - RNA, 19 nt, Homo sapiens
ugacagccuucuugugaau

SEQ ID NO: 76332 - RNA, 19 nt, Homo sapiens
gagaagaaagaacggaaga

SEQ ID NO: 76333 - RNA, 19 nt, Homo sapiens
gcagggaggaggcagagaa

SEQ ID NO: 76334 - RNA, 19 nt, Homo sapiens
gggcaccucugugagugua

SEQ ID NO: 76335 - RNA, 19 nt, Homo sapiens
ggaggaggcagagaagaaa

SEQ ID NO: 76336 - RNA, 19 nt, Homo sapiens
ggaacucuaccagggaaua

SEQ ID NO: 76337 - RNA, 19 nt, Homo sapiens
gggaggaggcagagaagaa

SEQ ID NO: 76338 - RNA, 19 nt, Homo sapiens
cgagacgcuucggucauua

SEQ ID NO: 76339 - RNA, 19 nt, Homo sapiens
gcuaaagaaaggaaaccua

SEQ ID NO: 76340 - RNA, 19 nt, Homo sapiens
gaaagaacggaagaagaga

SEQ ID NO: 76341 - RNA, 19 nt, Homo sapiens
caccagcucuccagcacuu

SEQ ID NO: 76342 - RNA, 19 nt, Homo sapiens
ggaaacacgcuggucauca

SEQ ID NO: 76343 - RNA, 19 nt, Homo sapiens
gcaguucaaagcaggauau

SEQ ID NO: 76344 - RNA, 19 nt, Homo sapiens
gcuuucuacugccaaauga

SEQ ID NO: 76345 - RNA, 19 nt, Homo sapiens
caaagcaggauauguuaag

SEQ ID NO: 76346 - RNA, 19 nt, Homo sapiens
aaguaacacucaaccauca

SEQ ID NO: 76347 - RNA, 19 nt, Homo sapiens
ggccaugauugguuucuag

SEQ ID NO: 76348 - RNA, 19 nt, Homo sapiens
aagaagagaucaggaagag

SEQ ID NO: 76349 - RNA, 19 nt, Homo sapiens
gauauggugcgauuugcaa

SEQ ID NO: 76350 - RNA, 19 nt, Homo sapiens
cggugcagauucucuugua

SEQ ID NO: 76351 - RNA, 19 nt, Homo sapiens
agaaagaacggaagaagag

SEQ ID NO: 76352 - RNA, 19 nt, Homo sapiens
caucaucuacugcuucaug

SEQ ID NO: 76353 - RNA, 19 nt, Homo sapiens
gaccaccaccuacuucaug

SEQ ID NO: 76354 - RNA, 19 nt, Homo sapiens
ccaaccugauggccaagaa

SEQ ID NO: 76355 - RNA, 19 nt, Homo sapiens
ucaaagcaggauauguuaa

SEQ ID NO: 76356 - RNA, 19 nt, Homo sapiens
gccaaccgcauccggagua

SEQ ID NO: 76357 - RNA, 19 nt, Homo sapiens
agagauauggugcgauuug

SEQ ID NO: 76358 - RNA, 19 nt, Homo sapiens
ucucuuguacuccuugaua

SEQ ID NO: 76359 - RNA, 19 nt, Homo sapiens
uuucauccuucaucugauu

SEQ ID NO: 76360 - RNA, 19 nt, Homo sapiens
gagccgggagugagcaauu

SEQ ID NO: 76361 - RNA, 19 nt, Homo sapiens
gagaucaggaagagaagga

SEQ ID NO: 76362 - RNA, 19 nt, Homo sapiens
caagaccaccaccuacuuc

SEQ ID NO: 76363 - RNA, 19 nt, Homo sapiens
gugaauggaagcaacauca

SEQ ID NO: 76364 - RNA, 19 nt, Homo sapiens
gauggguguuaccugcaaa

SEQ ID NO: 76365 - RNA, 19 nt, Homo sapiens
acacauuccuguuacucau

SEQ ID NO: 76366 - RNA, 19 nt, Homo sapiens
acaaccagaccgcgaauau

SEQ ID NO: 76367 - RNA, 19 nt, Homo sapiens
cagagcugauggagaagga

SEQ ID NO: 76368 - RNA, 19 nt, Homo sapiens
gcagagcagagcugaugga

SEQ ID NO: 76369 - RNA, 19 nt, Homo sapiens
ggaaagcagcaggcaagga

SEQ ID NO: 76370 - RNA, 19 nt, Homo sapiens
caccagcagcggcaaauau

SEQ ID NO: 76371 - RNA, 19 nt, Homo sapiens
gaggcuagccagaagaagu

SEQ ID NO: 76372 - RNA, 19 nt, Homo sapiens
aagcaggauauguuaagua

SEQ ID NO: 76373 - RNA, 19 nt, Homo sapiens
ccaaccgcauccggaguaa

SEQ ID NO: 76374 - RNA, 19 nt, Homo sapiens
aaagaaaggaaaccuagca

SEQ ID NO: 76375 - RNA, 19 nt, Homo sapiens
cucauccucuuucuuauuc

SEQ ID NO: 76376 - RNA, 19 nt, Homo sapiens
cagcaguccuggcacacau

SEQ ID NO: 76377 - RNA, 19 nt, Homo sapiens
gcaccucugugaguguauc

SEQ ID NO: 76378 - RNA, 19 nt, Homo sapiens
gggccaugauugguuucua

SEQ ID NO: 76379 - RNA, 19 nt, Homo sapiens
cggaagaagagaucaggaa

SEQ ID NO: 76380 - RNA, 19 nt, Homo sapiens
aagaaagaacggaagaaga

SEQ ID NO: 76381 - RNA, 19 nt, Homo sapiens
cgauggguguuaccugcaa

SEQ ID NO: 76382 - RNA, 19 nt, Homo sapiens
ggacggucaccaacaucuu

SEQ ID NO: 76383 - RNA, 19 nt, Homo sapiens
gcagccagcggugcagauu

SEQ ID NO: 76384 - RNA, 19 nt, Homo sapiens
agugggaacucuucaaggu

SEQ ID NO: 76385 - RNA, 19 nt, Homo sapiens
ggaggcagagaagaaagaa

SEQ ID NO: 76386 - RNA, 19 nt, Homo sapiens
gaugaugguggcauaugga

SEQ ID NO: 76387 - RNA, 19 nt, Homo sapiens
aaccagaccgcgaauaugu

SEQ ID NO: 76388 - RNA, 19 nt, Homo sapiens
caaccagaccgcgaauaug

SEQ ID NO: 76389 - RNA, 19 nt, Homo sapiens
gagaaggaaggcuccaucu

SEQ ID NO: 76390 - RNA, 19 nt, Homo sapiens
gaacggaagaagagaucag

SEQ ID NO: 76391 - RNA, 19 nt, Homo sapiens
ccuggugccuuuccuuuac

SEQ ID NO: 76392 - RNA, 19 nt, Homo sapiens
gagauauggugcgauuugc

SEQ ID NO: 76393 - RNA, 19 nt, Homo sapiens
gaauggaagcaacaucacu

SEQ ID NO: 76394 - RNA, 19 nt, Homo sapiens
caaggauggaugugguuga

SEQ ID NO: 76395 - RNA, 19 nt, Homo sapiens
uaaucucuuuggaacucua

SEQ ID NO: 76396 - RNA, 19 nt, Homo sapiens
caaccugauggccaagaaa

SEQ ID NO: 76397 - RNA, 19 nt, Homo sapiens
gcccacaccuggaaaucac

SEQ ID NO: 76398 - RNA, 19 nt, Homo sapiens
ugaugaugguggcauaugg

SEQ ID NO: 76399 - RNA, 19 nt, Homo sapiens
auagcaacuuggugccuuu

SEQ ID NO: 76400 - RNA, 19 nt, Homo sapiens
uucaaagcaggauauguua

SEQ ID NO: 76401 - RNA, 19 nt, Homo sapiens
caucgugguccucuucuuc

SEQ ID NO: 76402 - RNA, 19 nt, Homo sapiens
gaaggaagcuggaaaugga

SEQ ID NO: 76403 - RNA, 19 nt, Homo sapiens
gcagugaccuuccugauga

SEQ ID NO: 76404 - RNA, 19 nt, Homo sapiens
gaauaagaauggagcagua

SEQ ID NO: 76405 - RNA, 19 nt, Homo sapiens
caucaggccuaaucucaua

SEQ ID NO: 76406 - RNA, 19 nt, Homo sapiens
ccaaacuguucaagaaaua

SEQ ID NO: 76407 - RNA, 19 nt, Homo sapiens
cuucaucccuuuccaguua

SEQ ID NO: 76408 - RNA, 19 nt, Homo sapiens
ggacugagccuggcccaua

SEQ ID NO: 76409 - RNA, 19 nt, Homo sapiens
gaaauaugcucaucaucgu

SEQ ID NO: 76410 - RNA, 19 nt, Homo sapiens
gcagugaacuauuucuaca

SEQ ID NO: 76411 - RNA, 19 nt, Homo sapiens
uagcuuaccugacacaaga

SEQ ID NO: 76412 - RNA, 19 nt, Homo sapiens
gcuccuaucuccuucauuc

SEQ ID NO: 76413 - RNA, 19 nt, Homo sapiens
ccauuagaaucacucuuua

SEQ ID NO: 76414 - RNA, 19 nt, Homo sapiens
ucacacacauagauuaaug

SEQ ID NO: 76415 - RNA, 19 nt, Homo sapiens
gcacugacccuuccagaca

SEQ ID NO: 76416 - RNA, 19 nt, Homo sapiens
gaggaaauaugcucaucau

SEQ ID NO: 76417 - RNA, 19 nt, Homo sapiens
ccagggcucuucccgauga

SEQ ID NO: 76418 - RNA, 19 nt, Homo sapiens
ccaagcugcuggcuaagaa

SEQ ID NO: 76419 - RNA, 19 nt, Homo sapiens
gaugagcguuggaggaaau

SEQ ID NO: 76420 - RNA, 19 nt, Homo sapiens
aaacacaaaccacaacuga

SEQ ID NO: 76421 - RNA, 19 nt, Homo sapiens
uacccaaacuguucaagaa

SEQ ID NO: 76422 - RNA, 19 nt, Homo sapiens
gccauuagaaucacucuuu

SEQ ID NO: 76423 - RNA, 19 nt, Homo sapiens
cauagaaacaugacacuga

SEQ ID NO: 76424 - RNA, 19 nt, Homo sapiens
gaauuggagcuggccauua

SEQ ID NO: 76425 - RNA, 19 nt, Homo sapiens
gagcuggccauuagaauca

SEQ ID NO: 76426 - RNA, 19 nt, Homo sapiens
gcaaggcgguuuccuaccu

SEQ ID NO: 76427 - RNA, 19 nt, Homo sapiens
gugaguguguccacgcuaa

SEQ ID NO: 76428 - RNA, 19 nt, Homo sapiens
gacacaagaggaauaagaa

SEQ ID NO: 76429 - RNA, 19 nt, Homo sapiens
gaauguugcuggugaucgu

SEQ ID NO: 76430 - RNA, 19 nt, Homo sapiens
gaaaccaacacccaaagca

SEQ ID NO: 76431 - RNA, 19 nt, Homo sapiens
cuacuuagggcuucgcuuu

SEQ ID NO: 76432 - RNA, 19 nt, Homo sapiens
uguguugguugccaguuua

SEQ ID NO: 76433 - RNA, 19 nt, Homo sapiens
ugacacaagaggaauaaga

SEQ ID NO: 76434 - RNA, 19 nt, Homo sapiens
uuaauggcacugauuguuu

SEQ ID NO: 76435 - RNA, 19 nt, Homo sapiens
aauuggagcuggccauuag

SEQ ID NO: 76436 - RNA, 19 nt, Homo sapiens
ccuaaucucauaccucuga

SEQ ID NO: 76437 - RNA, 19 nt, Homo sapiens
cccuagcagugaacuauuu

SEQ ID NO: 76438 - RNA, 19 nt, Homo sapiens
caagaggaauaagaaugga

SEQ ID NO: 76439 - RNA, 19 nt, Homo sapiens
ugaacuauuucuacacagu

SEQ ID NO: 76440 - RNA, 19 nt, Homo sapiens
acacaaaccacaacugaca

SEQ ID NO: 76441 - RNA, 19 nt, Homo sapiens
cccaaacuguucaagaaau

SEQ ID NO: 76442 - RNA, 19 nt, Homo sapiens
ggaggaaauaugcucauca

SEQ ID NO: 76443 - RNA, 19 nt, Homo sapiens
ccacaacugacacaggaaa

SEQ ID NO: 76444 - RNA, 19 nt, Homo sapiens
gcuucgcuguccaggcuua

SEQ ID NO: 76445 - RNA, 19 nt, Homo sapiens
ggagugggugggacugaaa

SEQ ID NO: 76446 - RNA, 19 nt, Homo sapiens
caugggcacauucaucuuu

SEQ ID NO: 76447 - RNA, 19 nt, Homo sapiens
ccugaggacugucaccaau

SEQ ID NO: 76448 - RNA, 19 nt, Homo sapiens
uaauggcacugauuguuuu

SEQ ID NO: 76449 - RNA, 19 nt, Homo sapiens
cagcgucccuagcagugaa

SEQ ID NO: 76450 - RNA, 19 nt, Homo sapiens
ggagcuggccauuagaauc

SEQ ID NO: 76451 - RNA, 19 nt, Homo sapiens
gagaaggaagcuggaaaug

SEQ ID NO: 76452 - RNA, 19 nt, Homo sapiens
ccugcccucuccuuccuua

SEQ ID NO: 76453 - RNA, 19 nt, Homo sapiens
gaaacaugacacugaccuu

SEQ ID NO: 76454 - RNA, 19 nt, Homo sapiens
gggugggacugaaaugaag

SEQ ID NO: 76455 - RNA, 19 nt, Homo sapiens
cuucugcucuuguucuuca

SEQ ID NO: 76456 - RNA, 19 nt, Homo sapiens
ucucacacacauagauuaa

SEQ ID NO: 76457 - RNA, 19 nt, Homo sapiens
gacugagccuggcccauag

SEQ ID NO: 76458 - RNA, 19 nt, Homo sapiens
cguguacacugucgugcaa

SEQ ID NO: 76459 - RNA, 19 nt, Homo sapiens
aggcuguucugcacugaaa

SEQ ID NO: 76460 - RNA, 19 nt, Homo sapiens
cacaagaggaauaagaaug

SEQ ID NO: 76461 - RNA, 19 nt, Homo sapiens
agacacagcgucccuagca

SEQ ID NO: 76462 - RNA, 19 nt, Homo sapiens
acaugacacugaccuugga

SEQ ID NO: 76463 - RNA, 19 nt, Homo sapiens
caggaaaccaacacccaaa

SEQ ID NO: 76464 - RNA, 19 nt, Homo sapiens
gagcguuggaggaaauaug

SEQ ID NO: 76465 - RNA, 19 nt, Homo sapiens
gagccuggcccauagaaac

SEQ ID NO: 76466 - RNA, 19 nt, Homo sapiens
ucauucacuugcugagcua

SEQ ID NO: 76467 - RNA, 19 nt, Homo sapiens
ugagaaggaagcuggaaau

SEQ ID NO: 76468 - RNA, 19 nt, Homo sapiens
uagauuaauggcacugauu

SEQ ID NO: 76469 - RNA, 19 nt, Homo sapiens
uagcagugaacuauuucua

SEQ ID NO: 76470 - RNA, 19 nt, Homo sapiens
ugaggacugucaccaaugc

SEQ ID NO: 76471 - RNA, 19 nt, Homo sapiens
acuuagggcuucgcuuuga

SEQ ID NO: 76472 - RNA, 19 nt, Homo sapiens
ucugggaugcuccuaguuu

SEQ ID NO: 76473 - RNA, 19 nt, Homo sapiens
acaagaggaauaagaaugg

SEQ ID NO: 76474 - RNA, 19 nt, Homo sapiens
guucugcacugaaaagguu

SEQ ID NO: 76475 - RNA, 19 nt, Homo sapiens
agugaacuauuucuacaca

SEQ ID NO: 76476 - RNA, 19 nt, Homo sapiens
ccaaucucaugggcacauu

SEQ ID NO: 76477 - RNA, 19 nt, Homo sapiens
guugaggcagggcaaauga

SEQ ID NO: 76478 - RNA, 19 nt, Homo sapiens
gaagcuggaaauggaguug

SEQ ID NO: 76479 - RNA, 19 nt, Homo sapiens
cugggaugcuccuaguuug

SEQ ID NO: 76480 - RNA, 19 nt, Homo sapiens
gcgcguggugcgaauguug

SEQ ID NO: 76481 - RNA, 19 nt, Homo sapiens
gugagaaggaagcuggaaa

SEQ ID NO: 76482 - RNA, 19 nt, Homo sapiens
ucauaccucugaccaacag

SEQ ID NO: 76483 - RNA, 19 nt, Homo sapiens
acugacccuuccagacaua

SEQ ID NO: 76484 - RNA, 19 nt, Homo sapiens
gcacugauuguuuuagaga

SEQ ID NO: 76485 - RNA, 19 nt, Homo sapiens
aaaauaccaucaggccuaa

SEQ ID NO: 76486 - RNA, 19 nt, Homo sapiens
gauuaauggcacugauugu

SEQ ID NO: 76487 - RNA, 19 nt, Homo sapiens
agauuaauggcacugauug

SEQ ID NO: 76488 - RNA, 19 nt, Homo sapiens
uaagaauggagcaguacau

SEQ ID NO: 76489 - RNA, 19 nt, Homo sapiens
ggaaaccaacacccaaagc

SEQ ID NO: 76490 - RNA, 19 nt, Homo sapiens
cuucaugcaccgucgcuuu

SEQ ID NO: 76491 - RNA, 19 nt, Homo sapiens
ggaagcuggaaauggaguu

SEQ ID NO: 76492 - RNA, 19 nt, Homo sapiens
gcuuugacggcgacaguga

SEQ ID NO: 76493 - RNA, 19 nt, Homo sapiens
gaagcuaaauggacaguua

SEQ ID NO: 76494 - RNA, 19 nt, Homo sapiens
caaggaagaucuccauuaa

SEQ ID NO: 76495 - RNA, 19 nt, Homo sapiens
ggaagaagcugcaaaauug

SEQ ID NO: 76496 - RNA, 19 nt, Homo sapiens
ggacagauauuuacaaagg

SEQ ID NO: 76497 - RNA, 19 nt, Homo sapiens
ccaaauaccuaaacaggaa

SEQ ID NO: 76498 - RNA, 19 nt, Homo sapiens
gaaggaagcaauuaacaaa

SEQ ID NO: 76499 - RNA, 19 nt, Homo sapiens
agaaauacuugcugaauug

SEQ ID NO: 76500 - RNA, 19 nt, Homo sapiens
ucaagaaacucagcaauau

SEQ ID NO: 76501 - RNA, 19 nt, Homo sapiens
caagcaagguuuccuaaau

SEQ ID NO: 76502 - RNA, 19 nt, Homo sapiens
caucguaccuguuaccaaa

SEQ ID NO: 76503 - RNA, 19 nt, Homo sapiens
caacucaaaccauaucaua

SEQ ID NO: 76504 - RNA, 19 nt, Homo sapiens
ggacaaaucgcauacuuca

SEQ ID NO: 76505 - RNA, 19 nt, Homo sapiens
gcaccucacuggacaaauc

SEQ ID NO: 76506 - RNA, 19 nt, Homo sapiens
cagaaauacuugcugaauu

SEQ ID NO: 76507 - RNA, 19 nt, Homo sapiens
cauaaacccuugcaacaug

SEQ ID NO: 76508 - RNA, 19 nt, Homo sapiens
gaaggugucaguaaagaaa

SEQ ID NO: 76509 - RNA, 19 nt, Homo sapiens
gacaguggguagaugauuu

SEQ ID NO: 76510 - RNA, 19 nt, Homo sapiens
gaugaagccagauauaauu

SEQ ID NO: 76511 - RNA, 19 nt, Homo sapiens
aggaagaucuccauuaaau

SEQ ID NO: 76512 - RNA, 19 nt, Homo sapiens
agaaacggauagacauaua

SEQ ID NO: 76513 - RNA, 19 nt, Homo sapiens
gaaugcgucucucucaaga

SEQ ID NO: 76514 - RNA, 19 nt, Homo sapiens
ggaagaucuccauuaaaua

SEQ ID NO: 76515 - RNA, 19 nt, Homo sapiens
gcacuagaaauaaagagua

SEQ ID NO: 76516 - RNA, 19 nt, Homo sapiens
gcaauuaacaaaccauaug

SEQ ID NO: 76517 - RNA, 19 nt, Homo sapiens
gaacgacaguggguagaug

SEQ ID NO: 76518 - RNA, 19 nt, Homo sapiens
caggacagauauuuacaaa

SEQ ID NO: 76519 - RNA, 19 nt, Homo sapiens
gaaacggauagacauauaa

SEQ ID NO: 76520 - RNA, 19 nt, Homo sapiens
aggaggacaugcugaaaua

SEQ ID NO: 76521 - RNA, 19 nt, Homo sapiens
ugaaaccugucucuacaaa

SEQ ID NO: 76522 - RNA, 19 nt, Homo sapiens
gaauugaagcauggaaaua

SEQ ID NO: 76523 - RNA, 19 nt, Homo sapiens
acagaaaacucacuacaua

SEQ ID NO: 76524 - RNA, 19 nt, Homo sapiens
ggugaaaccugucucuaca

SEQ ID NO: 76525 - RNA, 19 nt, Homo sapiens
augcuaagcugauaacauu

SEQ ID NO: 76526 - RNA, 19 nt, Homo sapiens
ggucauaucguucuguuga

SEQ ID NO: 76527 - RNA, 19 nt, Homo sapiens
gaucuucaguauacaaauc

SEQ ID NO: 76528 - RNA, 19 nt, Homo sapiens
cauggaaacuaaggcuuua

SEQ ID NO: 76529 - RNA, 19 nt, Homo sapiens
caaaucgcauacuucauga

SEQ ID NO: 76530 - RNA, 19 nt, Homo sapiens
gaaacuaaggcuuuacuca

SEQ ID NO: 76531 - RNA, 19 nt, Homo sapiens
guucgugacuggccagaaa

SEQ ID NO: 76532 - RNA, 19 nt, Homo sapiens
auacaaaucggguagauaa

SEQ ID NO: 76533 - RNA, 19 nt, Homo sapiens
caagugaaggugucaguaa

SEQ ID NO: 76534 - RNA, 19 nt, Homo sapiens
gagauacugauacuuguuu

SEQ ID NO: 76535 - RNA, 19 nt, Homo sapiens
cagaauggaugggucauau

SEQ ID NO: 76536 - RNA, 19 nt, Homo sapiens
acaaggaagaucuccauua

SEQ ID NO: 76537 - RNA, 19 nt, Homo sapiens
caaaucggguagauaaagu

SEQ ID NO: 76538 - RNA, 19 nt, Homo sapiens
uuacagaauugcugggaaa

SEQ ID NO: 76539 - RNA, 19 nt, Homo sapiens
aagcaagguuuccuaaaug

SEQ ID NO: 76540 - RNA, 19 nt, Homo sapiens
aaaggaaagugcaauccaa

SEQ ID NO: 76541 - RNA, 19 nt, Homo sapiens
ugaggccacucgcauauug

SEQ ID NO: 76542 - RNA, 19 nt, Homo sapiens
guuaauggccacugaaaga

SEQ ID NO: 76543 - RNA, 19 nt, Homo sapiens
gaauacaagaaucucagua

SEQ ID NO: 76544 - RNA, 19 nt, Homo sapiens
uuacuaagccgucuucuca

SEQ ID NO: 76545 - RNA, 19 nt, Homo sapiens
ggucaacccuguaauucca

SEQ ID NO: 76546 - RNA, 19 nt, Homo sapiens
ugaaagagaaguaacuguu

SEQ ID NO: 76547 - RNA, 19 nt, Homo sapiens
gccuucaacucaaaccaua

SEQ ID NO: 76548 - RNA, 19 nt, Homo sapiens
caagaaacucagcaauauu

SEQ ID NO: 76549 - RNA, 19 nt, Homo sapiens
acaaaucgcauacuucaug

SEQ ID NO: 76550 - RNA, 19 nt, Homo sapiens
cccacuagcuauucuuauu

SEQ ID NO: 76551 - RNA, 19 nt, Homo sapiens
ugaauugacuaaucuggau

SEQ ID NO: 76552 - RNA, 19 nt, Homo sapiens
aauguuagcccuagagaaa

SEQ ID NO: 76553 - RNA, 19 nt, Homo sapiens
ccagaaacggauagacaua

SEQ ID NO: 76554 - RNA, 19 nt, Homo sapiens
gaagucagaguucaagaca

SEQ ID NO: 76555 - RNA, 19 nt, Homo sapiens
gcuuuacucaucagucuua

SEQ ID NO: 76556 - RNA, 19 nt, Homo sapiens
ucuaggagcuccagacuac

SEQ ID NO: 76557 - RNA, 19 nt, Homo sapiens
gcagauaauggaaggaaug

SEQ ID NO: 76558 - RNA, 19 nt, Homo sapiens
uaagccgucuucucaguga

SEQ ID NO: 76559 - RNA, 19 nt, Homo sapiens
cagcgcauguucuuacaga

SEQ ID NO: 76560 - RNA, 19 nt, Homo sapiens
uaguacagauucuccuaaa

SEQ ID NO: 76561 - RNA, 19 nt, Homo sapiens
caugagcagugucacagaa

SEQ ID NO: 76562 - RNA, 19 nt, Homo sapiens
ucggguagauaaaguggua

SEQ ID NO: 76563 - RNA, 19 nt, Homo sapiens
gugaaggugucaguaaaga

SEQ ID NO: 76564 - RNA, 19 nt, Homo sapiens
acaagaaucucaguacaag

SEQ ID NO: 76565 - RNA, 19 nt, Homo sapiens
aggacaugcugaaauagua

SEQ ID NO: 76566 - RNA, 19 nt, Homo sapiens
ucagucaaccaguuagaua

SEQ ID NO: 76567 - RNA, 19 nt, Homo sapiens
gggagauacugauacuugu

SEQ ID NO: 76568 - RNA, 19 nt, Homo sapiens
acucaucagucuuaaguau

SEQ ID NO: 76569 - RNA, 19 nt, Homo sapiens
aagaagagaugugagacuu

SEQ ID NO: 76570 - RNA, 19 nt, Homo sapiens
gaaauacuugcugaauuga

SEQ ID NO: 76571 - RNA, 19 nt, Homo sapiens
guucgaauauacagaaugg

SEQ ID NO: 76572 - RNA, 19 nt, Homo sapiens
caggaagacuccaucucaa

SEQ ID NO: 76573 - RNA, 19 nt, Homo sapiens
guauguaggagugaauaua

SEQ ID NO: 76574 - RNA, 19 nt, Homo sapiens
ccucagccuucaacucaaa

SEQ ID NO: 76575 - RNA, 19 nt, Homo sapiens
uauaacagaccaacaagga

SEQ ID NO: 76576 - RNA, 19 nt, Homo sapiens
uuaguucuccucuucauuu

SEQ ID NO: 76577 - RNA, 19 nt, Homo sapiens
agucaucccuguguaugua

SEQ ID NO: 76578 - RNA, 19 nt, Homo sapiens
auacagcuccugaugcuaa

SEQ ID NO: 76579 - RNA, 19 nt, Homo sapiens
ggaagcaauuaacaaacca

SEQ ID NO: 76580 - RNA, 19 nt, Homo sapiens
gaaaggaaagugcaaucca

SEQ ID NO: 76581 - RNA, 19 nt, Homo sapiens
ucaaccaguuagauaguga

SEQ ID NO: 76582 - RNA, 19 nt, Homo sapiens
ucgcauacuucaugaauac

SEQ ID NO: 76583 - RNA, 19 nt, Homo sapiens
gaagacccacuagcuauuc

SEQ ID NO: 76584 - RNA, 19 nt, Homo sapiens
gcugaaauaguacagauuc

SEQ ID NO: 76585 - RNA, 19 nt, Homo sapiens
aaagugcaauccaaaccuu

SEQ ID NO: 76586 - RNA, 19 nt, Homo sapiens
caauugggagauacugaua

SEQ ID NO: 76587 - RNA, 19 nt, Homo sapiens
gaaucucaguacaagugaa

SEQ ID NO: 76588 - RNA, 19 nt, Homo sapiens
gacccacuagcuauucuua

SEQ ID NO: 76589 - RNA, 19 nt, Homo sapiens
ggagauacugauacuuguu

SEQ ID NO: 76590 - RNA, 19 nt, Homo sapiens
aagugaaggugucaguaaa

SEQ ID NO: 76591 - RNA, 19 nt, Homo sapiens
cuauauggauuuguucaga

SEQ ID NO: 76592 - RNA, 19 nt, Homo sapiens
gaggaggacaugcugaaau

SEQ ID NO: 76593 - RNA, 19 nt, Homo sapiens
ggacaaagcuggccugaau

SEQ ID NO: 76594 - RNA, 19 nt, Homo sapiens
ggacaugucaauuguauua

SEQ ID NO: 76595 - RNA, 19 nt, Homo sapiens
gcugugaacuacauugaua

SEQ ID NO: 76596 - RNA, 19 nt, Homo sapiens
gaugauaccuacaccaaga

SEQ ID NO: 76597 - RNA, 19 nt, Homo sapiens
gcacaacagucaauaagag

SEQ ID NO: 76598 - RNA, 19 nt, Homo sapiens
gcuguuagccucaaaguuu

SEQ ID NO: 76599 - RNA, 19 nt, Homo sapiens
gaugccagcugucaggaua

SEQ ID NO: 76600 - RNA, 19 nt, Homo sapiens
aagcuggccugaaucauua

SEQ ID NO: 76601 - RNA, 19 nt, Homo sapiens
cugcaaaguugaaaguuua

SEQ ID NO: 76602 - RNA, 19 nt, Homo sapiens
ugacuuagcugcuccaaca

SEQ ID NO: 76603 - RNA, 19 nt, Homo sapiens
gaaauggagguuaaaugua

SEQ ID NO: 76604 - RNA, 19 nt, Homo sapiens
gauauucacacauaccuua

SEQ ID NO: 76605 - RNA, 19 nt, Homo sapiens
ggaaauggagguuaaaugu

SEQ ID NO: 76606 - RNA, 19 nt, Homo sapiens
gaagccagcugaaucucaa

SEQ ID NO: 76607 - RNA, 19 nt, Homo sapiens
gcucggcgcugcuagcauu

SEQ ID NO: 76608 - RNA, 19 nt, Homo sapiens
caaaguauaugguguacag

SEQ ID NO: 76609 - RNA, 19 nt, Homo sapiens
gauauacccuggaaagucu

SEQ ID NO: 76610 - RNA, 19 nt, Homo sapiens
uaaaguggguuacaugaag

SEQ ID NO: 76611 - RNA, 19 nt, Homo sapiens
ggagcugccuuucauuuag

SEQ ID NO: 76612 - RNA, 19 nt, Homo sapiens
gagaauggagcaucuaguu

SEQ ID NO: 76613 - RNA, 19 nt, Homo sapiens
ggagaagaauauaaacuac

SEQ ID NO: 76614 - RNA, 19 nt, Homo sapiens
acacauaccuuagggaaau

SEQ ID NO: 76615 - RNA, 19 nt, Homo sapiens
cagaaguuguggccaagua

SEQ ID NO: 76616 - RNA, 19 nt, Homo sapiens
gauagaugcugacccauac

SEQ ID NO: 76617 - RNA, 19 nt, Homo sapiens
ugaacuacauugauagguu

SEQ ID NO: 76618 - RNA, 19 nt, Homo sapiens
ugaaguaggagaagaauau

SEQ ID NO: 76619 - RNA, 19 nt, Homo sapiens
gaaaagccagugaguguua

SEQ ID NO: 76620 - RNA, 19 nt, Homo sapiens
cacuaaaucuguaacaaug

SEQ ID NO: 76621 - RNA, 19 nt, Homo sapiens
gagaauaucaacccggaaa

SEQ ID NO: 76622 - RNA, 19 nt, Homo sapiens
gaagaagccagcugaaucu

SEQ ID NO: 76623 - RNA, 19 nt, Homo sapiens
gaagaaacagccagacauc

SEQ ID NO: 76624 - RNA, 19 nt, Homo sapiens
gaaguaggagaagaauaua

SEQ ID NO: 76625 - RNA, 19 nt, Homo sapiens
ggacugguuaguugaagua

SEQ ID NO: 76626 - RNA, 19 nt, Homo sapiens
gcagaguuuguguacauua

SEQ ID NO: 76627 - RNA, 19 nt, Homo sapiens
ccagacaucacuaacagua

SEQ ID NO: 76628 - RNA, 19 nt, Homo sapiens
uuagggaaauggagguuaa

SEQ ID NO: 76629 - RNA, 19 nt, Homo sapiens
uagcagaguuuguguacau

SEQ ID NO: 76630 - RNA, 19 nt, Homo sapiens
gcagccagccuauucuuug

SEQ ID NO: 76631 - RNA, 19 nt, Homo sapiens
agacaucacuaacaguaug

SEQ ID NO: 76632 - RNA, 19 nt, Homo sapiens
uuaaugaaguaccagacua

SEQ ID NO: 76633 - RNA, 19 nt, Homo sapiens
guugaaaguuuagcaaugu

SEQ ID NO: 76634 - RNA, 19 nt, Homo sapiens
augaggauauucacacaua

SEQ ID NO: 76635 - RNA, 19 nt, Homo sapiens
gaagaugcccuggcuuuua

SEQ ID NO: 76636 - RNA, 19 nt, Homo sapiens
gcauuuggcugugaacuac

SEQ ID NO: 76637 - RNA, 19 nt, Homo sapiens
caagaggaccaggagaaua

SEQ ID NO: 76638 - RNA, 19 nt, Homo sapiens
ccaaguacaaauuauggua

SEQ ID NO: 76639 - RNA, 19 nt, Homo sapiens
caacagucaauaagagaaa

SEQ ID NO: 76640 - RNA, 19 nt, Homo sapiens
gcugucaggauaauaaauu

SEQ ID NO: 76641 - RNA, 19 nt, Homo sapiens
gacacuaaaucuguaacaa

SEQ ID NO: 76642 - RNA, 19 nt, Homo sapiens
ucaaguauuugccaucagu

SEQ ID NO: 76643 - RNA, 19 nt, Homo sapiens
gccagugaguguuaaugaa

SEQ ID NO: 76644 - RNA, 19 nt, Homo sapiens
gaauggagcaucuaguuuu

SEQ ID NO: 76645 - RNA, 19 nt, Homo sapiens
gaggaaaacuucagcuugu

SEQ ID NO: 76646 - RNA, 19 nt, Homo sapiens
gugaagaugcccuggcuuu

SEQ ID NO: 76647 - RNA, 19 nt, Homo sapiens
ccagcugucaggauaauaa

SEQ ID NO: 76648 - RNA, 19 nt, Homo sapiens
aguauaugguguacaguuu

SEQ ID NO: 76649 - RNA, 19 nt, Homo sapiens
ugauagaugcugacccaua

SEQ ID NO: 76650 - RNA, 19 nt, Homo sapiens
aaagcuggccugaaucauu

SEQ ID NO: 76651 - RNA, 19 nt, Homo sapiens
caaaguaucaugguguuuc

SEQ ID NO: 76652 - RNA, 19 nt, Homo sapiens
caccagaccuaccucaaag

SEQ ID NO: 76653 - RNA, 19 nt, Homo sapiens
ggauauacccuggaaaguc

SEQ ID NO: 76654 - RNA, 19 nt, Homo sapiens
gggagaauuaaguuugaua

SEQ ID NO: 76655 - RNA, 19 nt, Homo sapiens
gcacugcugcuaugcuguu

SEQ ID NO: 76656 - RNA, 19 nt, Homo sapiens
guuccugucuuccauguca

SEQ ID NO: 76657 - RNA, 19 nt, Homo sapiens
ggaaagcaaacaguaaaca

SEQ ID NO: 76658 - RNA, 19 nt, Homo sapiens
aaaguggguuacaugaaga

SEQ ID NO: 76659 - RNA, 19 nt, Homo sapiens
agacuaccaugaggauauu

SEQ ID NO: 76660 - RNA, 19 nt, Homo sapiens
guauuugccaucaguuauu

SEQ ID NO: 76661 - RNA, 19 nt, Homo sapiens
acugcaaaguugaaaguuu

SEQ ID NO: 76662 - RNA, 19 nt, Homo sapiens
cccaauacuuucugcauca

SEQ ID NO: 76663 - RNA, 19 nt, Homo sapiens
gggaaauggagguuaaaug

SEQ ID NO: 76664 - RNA, 19 nt, Homo sapiens
gaaagcaaacaguaaacag

SEQ ID NO: 76665 - RNA, 19 nt, Homo sapiens
cuauggacaugucaauugu

SEQ ID NO: 76666 - RNA, 19 nt, Homo sapiens
ucaccagaccuaccucaaa

SEQ ID NO: 76667 - RNA, 19 nt, Homo sapiens
aagaggaccaggagaauau

SEQ ID NO: 76668 - RNA, 19 nt, Homo sapiens
ggagaauuaaguuugauag

SEQ ID NO: 76669 - RNA, 19 nt, Homo sapiens
ggaucuuccuguaaaugau

SEQ ID NO: 76670 - RNA, 19 nt, Homo sapiens
uggguuacaugaagaaaca

SEQ ID NO: 76671 - RNA, 19 nt, Homo sapiens
agaagaagccagcugaauc

SEQ ID NO: 76672 - RNA, 19 nt, Homo sapiens
ccugaaucauuaauacgaa

SEQ ID NO: 76673 - RNA, 19 nt, Homo sapiens
uggagcugccuuucauuua

SEQ ID NO: 76674 - RNA, 19 nt, Homo sapiens
cuuagcugcuccaacagua

SEQ ID NO: 76675 - RNA, 19 nt, Homo sapiens
ccauuggucccucuugauu

SEQ ID NO: 76676 - RNA, 19 nt, Homo sapiens
guauauguaucugucuuag

SEQ ID NO: 76677 - RNA, 19 nt, Homo sapiens
ucuuaagccuugucucaug

SEQ ID NO: 76678 - RNA, 19 nt, Homo sapiens
guaaacagccugcguucac

SEQ ID NO: 76679 - RNA, 19 nt, Homo sapiens
cagacuaccaugaggauau

SEQ ID NO: 76680 - RNA, 19 nt, Homo sapiens
cauuggucccucuugauua

SEQ ID NO: 76681 - RNA, 19 nt, Homo sapiens
agauguaaaucacucaaag

SEQ ID NO: 76682 - RNA, 19 nt, Homo sapiens
gacuggauauacccuggaa

SEQ ID NO: 76683 - RNA, 19 nt, Homo sapiens
ccucaaguauuugccauca

SEQ ID NO: 76684 - RNA, 19 nt, Homo sapiens
cagaugauaccuacaccaa

SEQ ID NO: 76685 - RNA, 19 nt, Homo sapiens
gaaguagcagaguuugugu

SEQ ID NO: 76686 - RNA, 19 nt, Homo sapiens
aaaagaagcucagaagaag

SEQ ID NO: 76687 - RNA, 19 nt, Homo sapiens
agaauggagcaucuaguuu

SEQ ID NO: 76688 - RNA, 19 nt, Homo sapiens
cugguuaguugaaguagga

SEQ ID NO: 76689 - RNA, 19 nt, Homo sapiens
gaaacagccagacaucacu

SEQ ID NO: 76690 - RNA, 19 nt, Homo sapiens
ccaugaggauauucacaca

SEQ ID NO: 76691 - RNA, 19 nt, Homo sapiens
caccagagacacuaaaucu

SEQ ID NO: 76692 - RNA, 19 nt, Homo sapiens
gcaugcacaacagucaaua

SEQ ID NO: 76693 - RNA, 19 nt, Homo sapiens
gcaaagguguaacuuguaa

SEQ ID NO: 76694 - RNA, 19 nt, Homo sapiens
guacaugacugucuccauu

SEQ ID NO: 76695 - RNA, 19 nt, Homo sapiens
ggaagucacuggaaacaug

SEQ ID NO: 76696 - RNA, 19 nt, Homo sapiens
caacauuaccugucauaua

SEQ ID NO: 76697 - RNA, 19 nt, Homo sapiens
caccaacucuacaacauua

SEQ ID NO: 76698 - RNA, 19 nt, Homo sapiens
ccaaauaccugauggaacu

SEQ ID NO: 76699 - RNA, 19 nt, Homo sapiens
gaaauguacccuccagaaa

SEQ ID NO: 76700 - RNA, 19 nt, Homo sapiens
uaacuauguuggacuauga

SEQ ID NO: 76701 - RNA, 19 nt, Homo sapiens
gcaccuggcuaagaaugua

SEQ ID NO: 76702 - RNA, 19 nt, Homo sapiens
ucagacagauggaaaugaa

SEQ ID NO: 76703 - RNA, 19 nt, Homo sapiens
ugagacaacuugaggaaga

SEQ ID NO: 76704 - RNA, 19 nt, Homo sapiens
gcaagcaaauaugaagaaa

SEQ ID NO: 76705 - RNA, 19 nt, Homo sapiens
caugagagccauccuaauu

SEQ ID NO: 76706 - RNA, 19 nt, Homo sapiens
ggacauugguaacaaaguc

SEQ ID NO: 76707 - RNA, 19 nt, Homo sapiens
gaguuggaguacuauauuu

SEQ ID NO: 76708 - RNA, 19 nt, Homo sapiens
gcugaauucugcacuaguu

SEQ ID NO: 76709 - RNA, 19 nt, Homo sapiens
gaaaugaagauucuaagag

SEQ ID NO: 76710 - RNA, 19 nt, Homo sapiens
gguguaacuuguaaacuug

SEQ ID NO: 76711 - RNA, 19 nt, Homo sapiens
ugagagccauccuaauuga

SEQ ID NO: 76712 - RNA, 19 nt, Homo sapiens
ggaaaugaagauucuaaga

SEQ ID NO: 76713 - RNA, 19 nt, Homo sapiens
gcacuuuccuccuucucaa

SEQ ID NO: 76714 - RNA, 19 nt, Homo sapiens
uaacaaagucagugaacaa

SEQ ID NO: 76715 - RNA, 19 nt, Homo sapiens
ggacuuacaaagcacauga

SEQ ID NO: 76716 - RNA, 19 nt, Homo sapiens
aauguacccuccagaaauu

SEQ ID NO: 76717 - RNA, 19 nt, Homo sapiens
ggcuuucucugauguaauu

SEQ ID NO: 76718 - RNA, 19 nt, Homo sapiens
ugcacuaguucaagauuua

SEQ ID NO: 76719 - RNA, 19 nt, Homo sapiens
ccacaucgaagcaugcuaa

SEQ ID NO: 76720 - RNA, 19 nt, Homo sapiens
gaaucucuucuuccaguua

SEQ ID NO: 76721 - RNA, 19 nt, Homo sapiens
gaucgguucaugcagaaua

SEQ ID NO: 76722 - RNA, 19 nt, Homo sapiens
ugauguaauucuugcagua

SEQ ID NO: 76723 - RNA, 19 nt, Homo sapiens
uggcaaagguguaacuugu

SEQ ID NO: 76724 - RNA, 19 nt, Homo sapiens
uuacaaagcacaugacugu

SEQ ID NO: 76725 - RNA, 19 nt, Homo sapiens
caaaucagacagauggaaa

SEQ ID NO: 76726 - RNA, 19 nt, Homo sapiens
ugauggaacuaacuauguu

SEQ ID NO: 76727 - RNA, 19 nt, Homo sapiens
aacauuaccugucauauac

SEQ ID NO: 76728 - RNA, 19 nt, Homo sapiens
cuaauugacuggcuaguac

SEQ ID NO: 76729 - RNA, 19 nt, Homo sapiens
gaacggcuguugguuucug

SEQ ID NO: 76730 - RNA, 19 nt, Homo sapiens
ggacugaggccaagaacag

SEQ ID NO: 76731 - RNA, 19 nt, Homo sapiens
caacauggcaggcgcaaag

SEQ ID NO: 76732 - RNA, 19 nt, Homo sapiens
caucgaagcaugcuaagau

SEQ ID NO: 76733 - RNA, 19 nt, Homo sapiens
caugguaaaucaaggacuu

SEQ ID NO: 76734 - RNA, 19 nt, Homo sapiens
gaagauucuaagagcuuua

SEQ ID NO: 76735 - RNA, 19 nt, Homo sapiens
gaagucacuggaaacauga

SEQ ID NO: 76736 - RNA, 19 nt, Homo sapiens
cuaagagcuuuaaacuuug

SEQ ID NO: 76737 - RNA, 19 nt, Homo sapiens
auaauugugugcccaagaa

SEQ ID NO: 76738 - RNA, 19 nt, Homo sapiens
gcuaguacagguucaaaug

SEQ ID NO: 76739 - RNA, 19 nt, Homo sapiens
gccagaaccugagccagaa

SEQ ID NO: 76740 - RNA, 19 nt, Homo sapiens
gaaaauaaggcgaagauca

SEQ ID NO: 76741 - RNA, 19 nt, Homo sapiens
gcggaacggcuguugguuu

SEQ ID NO: 76742 - RNA, 19 nt, Homo sapiens
gcuaagaucagcacucuac

SEQ ID NO: 76743 - RNA, 19 nt, Homo sapiens
gacaccaacucuacaacau

SEQ ID NO: 76744 - RNA, 19 nt, Homo sapiens
gauguaauucuugcaguaa

SEQ ID NO: 76745 - RNA, 19 nt, Homo sapiens
aaccugagccuguuaaaga

SEQ ID NO: 76746 - RNA, 19 nt, Homo sapiens
guaacaaagucagugaaca

SEQ ID NO: 76747 - RNA, 19 nt, Homo sapiens
cggaacggcuguugguuuc

SEQ ID NO: 76748 - RNA, 19 nt, Homo sapiens
ggacaccaacucuacaaca

SEQ ID NO: 76749 - RNA, 19 nt, Homo sapiens
accaggaacucgaaaauua

SEQ ID NO: 76750 - RNA, 19 nt, Homo sapiens
gaauggacaccaacucuac

SEQ ID NO: 76751 - RNA, 19 nt, Homo sapiens
gaaauuggugacuuugcuu

SEQ ID NO: 76752 - RNA, 19 nt, Homo sapiens
uccagaaauuggugacuuu

SEQ ID NO: 76753 - RNA, 19 nt, Homo sapiens
ggaagagcaagcagucaga

SEQ ID NO: 76754 - RNA, 19 nt, Homo sapiens
guagugaauaugugaaaga

SEQ ID NO: 76755 - RNA, 19 nt, Homo sapiens
ccaaggcuguggcaaaggu

SEQ ID NO: 76756 - RNA, 19 nt, Homo sapiens
agaauguagucaugguaaa

SEQ ID NO: 76757 - RNA, 19 nt, Homo sapiens
gcacugaaaauucuggaua

SEQ ID NO: 76758 - RNA, 19 nt, Homo sapiens
ugaagauucuaagagcuuu

SEQ ID NO: 76759 - RNA, 19 nt, Homo sapiens
caccaugugccaucuguaa

SEQ ID NO: 76760 - RNA, 19 nt, Homo sapiens
gaauguagucaugguaaau

SEQ ID NO: 76761 - RNA, 19 nt, Homo sapiens
ugauguggaugcagaagau

SEQ ID NO: 76762 - RNA, 19 nt, Homo sapiens
acaaguaugccacaucgaa

SEQ ID NO: 76763 - RNA, 19 nt, Homo sapiens
aaacaugagagccauccua

SEQ ID NO: 76764 - RNA, 19 nt, Homo sapiens
ugaguuggaguacuauauu

SEQ ID NO: 76765 - RNA, 19 nt, Homo sapiens
ggcaaagguguaacuugua

SEQ ID NO: 76766 - RNA, 19 nt, Homo sapiens
uaagaauguagucauggua

SEQ ID NO: 76767 - RNA, 19 nt, Homo sapiens
uaagagcuuuaaacuuugg

SEQ ID NO: 76768 - RNA, 19 nt, Homo sapiens
aaauguacccuccagaaau

SEQ ID NO: 76769 - RNA, 19 nt, Homo sapiens
uggugucacugccauguuu

SEQ ID NO: 76770 - RNA, 19 nt, Homo sapiens
gccagaaccugagccuguu

SEQ ID NO: 76771 - RNA, 19 nt, Homo sapiens
agguguaacuuguaaacuu

SEQ ID NO: 76772 - RNA, 19 nt, Homo sapiens
ggcuaagaauguagucaug

SEQ ID NO: 76773 - RNA, 19 nt, Homo sapiens
ugcagcaccuggcuaagaa

SEQ ID NO: 76774 - RNA, 19 nt, Homo sapiens
ucuacaacauuaccuguca

SEQ ID NO: 76775 - RNA, 19 nt, Homo sapiens
agaaauguacccuccagaa

SEQ ID NO: 76776 - RNA, 19 nt, Homo sapiens
ccaaaaugccuaugaagaa

SEQ ID NO: 76777 - RNA, 19 nt, Homo sapiens
ucacugccauguuuauugc

SEQ ID NO: 76778 - RNA, 19 nt, Homo sapiens
cagaagaagaccuguguca

SEQ ID NO: 76779 - RNA, 19 nt, Homo sapiens
gaacagcucuuggggacau

SEQ ID NO: 76780 - RNA, 19 nt, Homo sapiens
cuaagaauguagucauggu

SEQ ID NO: 76781 - RNA, 19 nt, Homo sapiens
gucauauacugaagaaucu

SEQ ID NO: 76782 - RNA, 19 nt, Homo sapiens
augacugucuccauuauug

SEQ ID NO: 76783 - RNA, 19 nt, Homo sapiens
ccugucauauacugaagaa

SEQ ID NO: 76784 - RNA, 19 nt, Homo sapiens
gcaccaaaucagacagaug

SEQ ID NO: 76785 - RNA, 19 nt, Homo sapiens
ugacugacaacacuuauac

SEQ ID NO: 76786 - RNA, 19 nt, Homo sapiens
acaugacugucuccauuau

SEQ ID NO: 76787 - RNA, 19 nt, Homo sapiens
uacaugacugucuccauua

SEQ ID NO: 76788 - RNA, 19 nt, Homo sapiens
gagcaagcagucagaccaa

SEQ ID NO: 76789 - RNA, 19 nt, Homo sapiens
cugcacuaguucaagauuu

SEQ ID NO: 76790 - RNA, 19 nt, Homo sapiens
acagcugaauucugcacua

SEQ ID NO: 76791 - RNA, 19 nt, Homo sapiens
ugucauauacugaagaauc

SEQ ID NO: 76792 - RNA, 19 nt, Homo sapiens
ugaauggacaccaacucua

SEQ ID NO: 76793 - RNA, 19 nt, Homo sapiens
ggaagaauauuggaaguua

SEQ ID NO: 76794 - RNA, 19 nt, Homo sapiens
caggaaacaugaagcauaa

SEQ ID NO: 76795 - RNA, 19 nt, Homo sapiens
ggacagauuucaguaaugu

SEQ ID NO: 76796 - RNA, 19 nt, Homo sapiens
gcagagcucccacuauuug

SEQ ID NO: 76797 - RNA, 19 nt, Homo sapiens
uggcagagcucccacuauu

SEQ ID NO: 76798 - RNA, 19 nt, Homo sapiens
ggaguaguuucaaauacaa

SEQ ID NO: 76799 - RNA, 19 nt, Homo sapiens
ggaaacaugaagcauaauu

SEQ ID NO: 76800 - RNA, 19 nt, Homo sapiens
gaccuuugcuccaguaugu

SEQ ID NO: 76801 - RNA, 19 nt, Homo sapiens
caaguaccguauauugauu

SEQ ID NO: 76802 - RNA, 19 nt, Homo sapiens
gagauucuaugccagguau

SEQ ID NO: 76803 - RNA, 19 nt, Homo sapiens
gaacggaucuuugccuacu

SEQ ID NO: 76804 - RNA, 19 nt, Homo sapiens
agacauacauagacauuuc

SEQ ID NO: 76805 - RNA, 19 nt, Homo sapiens
gaagucagaacucuagcua

SEQ ID NO: 76806 - RNA, 19 nt, Homo sapiens
uggcaaccauucuuaguaa

SEQ ID NO: 76807 - RNA, 19 nt, Homo sapiens
ccacugcuacgguauauuu

SEQ ID NO: 76808 - RNA, 19 nt, Homo sapiens
augaauagcuuguuucugu

SEQ ID NO: 76809 - RNA, 19 nt, Homo sapiens
cagggaaauuaaucaagua

SEQ ID NO: 76810 - RNA, 19 nt, Homo sapiens
ccaggaaacaugaagcaua

SEQ ID NO: 76811 - RNA, 19 nt, Homo sapiens
cauggaggauagugaauga

SEQ ID NO: 76812 - RNA, 19 nt, Homo sapiens
gauuguugcuugauagugu

SEQ ID NO: 76813 - RNA, 19 nt, Homo sapiens
ggaccuacagacagacaua

SEQ ID NO: 76814 - RNA, 19 nt, Homo sapiens
aguaaugucuucaguggaa

SEQ ID NO: 76815 - RNA, 19 nt, Homo sapiens
uaugagcaguggaagaauu

SEQ ID NO: 76816 - RNA, 19 nt, Homo sapiens
ucagggaaauuaaucaagu

SEQ ID NO: 76817 - RNA, 19 nt, Homo sapiens
gaagaauauuggaaguuac

SEQ ID NO: 76818 - RNA, 19 nt, Homo sapiens
agacagacauacauagaca

SEQ ID NO: 76819 - RNA, 19 nt, Homo sapiens
cuacagacagacauacaua

SEQ ID NO: 76820 - RNA, 19 nt, Homo sapiens
acauguagccuguguugua

SEQ ID NO: 76821 - RNA, 19 nt, Homo sapiens
agaggaauuuggaguaguu

SEQ ID NO: 76822 - RNA, 19 nt, Homo sapiens
cauccaaaguagaggaauu

SEQ ID NO: 76823 - RNA, 19 nt, Homo sapiens
gaggaagaauauuggaagu

SEQ ID NO: 76824 - RNA, 19 nt, Homo sapiens
gaagaauuucgaugagaga

SEQ ID NO: 76825 - RNA, 19 nt, Homo sapiens
ggacaugggccaagaagac

SEQ ID NO: 76826 - RNA, 19 nt, Homo sapiens
guagaggaauuuggaguag

SEQ ID NO: 76827 - RNA, 19 nt, Homo sapiens
gguauucucugaaaaguau

SEQ ID NO: 76828 - RNA, 19 nt, Homo sapiens
gcauuaggugaacaucuua

SEQ ID NO: 76829 - RNA, 19 nt, Homo sapiens
auuaauggcuccuacaugu

SEQ ID NO: 76830 - RNA, 19 nt, Homo sapiens
aaucaaguaccguauauug

SEQ ID NO: 76831 - RNA, 19 nt, Homo sapiens
ggagagcaggguccaaaug

SEQ ID NO: 76832 - RNA, 19 nt, Homo sapiens
ggaggauagugaaugauac

SEQ ID NO: 76833 - RNA, 19 nt, Homo sapiens
ggaauuuggaguaguuuca

SEQ ID NO: 76834 - RNA, 19 nt, Homo sapiens
cgguauauuucaagagauu

SEQ ID NO: 76835 - RNA, 19 nt, Homo sapiens
ggauuuaaaguuucucuca

SEQ ID NO: 76836 - RNA, 19 nt, Homo sapiens
cuaauggauuguugcuuga

SEQ ID NO: 76837 - RNA, 19 nt, Homo sapiens
cagccaaucuuaaaacauu

SEQ ID NO: 76838 - RNA, 19 nt, Homo sapiens
agucagaacucuagcuaca

SEQ ID NO: 76839 - RNA, 19 nt, Homo sapiens
ucaagcauauuggaaagug

SEQ ID NO: 76840 - RNA, 19 nt, Homo sapiens
gcugagcuuucuguggaua

SEQ ID NO: 76841 - RNA, 19 nt, Homo sapiens
uagaacuaauggauuguug

SEQ ID NO: 76842 - RNA, 19 nt, Homo sapiens
gcugcuacuucuguauuaa

SEQ ID NO: 76843 - RNA, 19 nt, Homo sapiens
uggaguaguuucaaauaca

SEQ ID NO: 76844 - RNA, 19 nt, Homo sapiens
uacgguauauuucaagaga

SEQ ID NO: 76845 - RNA, 19 nt, Homo sapiens
uauaugagcaguggaagaa

SEQ ID NO: 76846 - RNA, 19 nt, Homo sapiens
ggauagugaaugauaccua

SEQ ID NO: 76847 - RNA, 19 nt, Homo sapiens
gcuacgguauauuucaaga

SEQ ID NO: 76848 - RNA, 19 nt, Homo sapiens
caagcauauuggaaaguga

SEQ ID NO: 76849 - RNA, 19 nt, Homo sapiens
gaucuuugccuacuguauc

SEQ ID NO: 76850 - RNA, 19 nt, Homo sapiens
aauggauuguugcuugaua

SEQ ID NO: 76851 - RNA, 19 nt, Homo sapiens
ugccagguauucucugaaa

SEQ ID NO: 76852 - RNA, 19 nt, Homo sapiens
ucucagaggaagaauauug

SEQ ID NO: 76853 - RNA, 19 nt, Homo sapiens
gaauagcuuguuucuguca

SEQ ID NO: 76854 - RNA, 19 nt, Homo sapiens
gggccaagaagacauguug

SEQ ID NO: 76855 - RNA, 19 nt, Homo sapiens
cuagcuacagccaaucuua

SEQ ID NO: 76856 - RNA, 19 nt, Homo sapiens
uggaggauagugaaugaua

SEQ ID NO: 76857 - RNA, 19 nt, Homo sapiens
caaguuauugccacugcua

SEQ ID NO: 76858 - RNA, 19 nt, Homo sapiens
auaaaccauuggacagauu

SEQ ID NO: 76859 - RNA, 19 nt, Homo sapiens
caguggaacacaaaugaaa

SEQ ID NO: 76860 - RNA, 19 nt, Homo sapiens
gagagcaggguccaaaugg

SEQ ID NO: 76861 - RNA, 19 nt, Homo sapiens
gcaauggauuuuggauaaa

SEQ ID NO: 76862 - RNA, 19 nt, Homo sapiens
uaaaccauuggacagauuu

SEQ ID NO: 76863 - RNA, 19 nt, Homo sapiens
uagcuacagccaaucuuaa

SEQ ID NO: 76864 - RNA, 19 nt, Homo sapiens
uggaagaauuucgaugaga

SEQ ID NO: 76865 - RNA, 19 nt, Homo sapiens
agcauuaggugaacaucuu

SEQ ID NO: 76866 - RNA, 19 nt, Homo sapiens
gaacuaauggauuguugcu

SEQ ID NO: 76867 - RNA, 19 nt, Homo sapiens
cuuaaaacauuccgaagaa

SEQ ID NO: 76868 - RNA, 19 nt, Homo sapiens
ggcagagcucccacuauuu

SEQ ID NO: 76869 - RNA, 19 nt, Homo sapiens
uauccaagcauuaggugaa

SEQ ID NO: 76870 - RNA, 19 nt, Homo sapiens
gaauuuggaguaguuucaa

SEQ ID NO: 76871 - RNA, 19 nt, Homo sapiens
ugcaauggauuuuggauaa

SEQ ID NO: 76872 - RNA, 19 nt, Homo sapiens
uaauggcuccuacaugugu

SEQ ID NO: 76873 - RNA, 19 nt, Homo sapiens
uaugccagguauucucuga

SEQ ID NO: 76874 - RNA, 19 nt, Homo sapiens
aaauaaaccauuggacaga

SEQ ID NO: 76875 - RNA, 19 nt, Homo sapiens
cuacagaacggaucuuugc

SEQ ID NO: 76876 - RNA, 19 nt, Homo sapiens
gcauggaggauagugaaug

SEQ ID NO: 76877 - RNA, 19 nt, Homo sapiens
uaucauccuuauagaccuu

SEQ ID NO: 76878 - RNA, 19 nt, Homo sapiens
acagacauacauagacauu

SEQ ID NO: 76879 - RNA, 19 nt, Homo sapiens
acagacagacauacauaga

SEQ ID NO: 76880 - RNA, 19 nt, Homo sapiens
ccaaauggaagucagaacu

SEQ ID NO: 76881 - RNA, 19 nt, Homo sapiens
uuggaaauaaucaggguua

SEQ ID NO: 76882 - RNA, 19 nt, Homo sapiens
ugaaugauaccuacagaac

SEQ ID NO: 76883 - RNA, 19 nt, Homo sapiens
uuucauaugccuuuccaaa

SEQ ID NO: 76884 - RNA, 19 nt, Homo sapiens
gcauauuggaaagugauuu

SEQ ID NO: 76885 - RNA, 19 nt, Homo sapiens
ugucuucaguggaacacaa

SEQ ID NO: 76886 - RNA, 19 nt, Homo sapiens
guggaagaauuucgaugag

SEQ ID NO: 76887 - RNA, 19 nt, Homo sapiens
ccaagaagacauguugcuu

SEQ ID NO: 76888 - RNA, 19 nt, Homo sapiens
gcaggacaugggccaagaa

SEQ ID NO: 76889 - RNA, 19 nt, Homo sapiens
ugcugcuacuucuguauua

SEQ ID NO: 76890 - RNA, 19 nt, Homo sapiens
uuggacagauuucaguaau

SEQ ID NO: 76891 - RNA, 19 nt, Homo sapiens
auagaccuuugcuccagua

SEQ ID NO: 76892 - RNA, 19 nt, Homo sapiens
gccaaaaggauuuaaaguu

SEQ ID NO: 76893 - RNA, 19 nt, Homo sapiens
gaaauagacuugcaccuua

SEQ ID NO: 76894 - RNA, 19 nt, Homo sapiens
gaacagggcuauuugaaga

SEQ ID NO: 76895 - RNA, 19 nt, Homo sapiens
gaaagaaccggacaaauaa

SEQ ID NO: 76896 - RNA, 19 nt, Homo sapiens
guaccuagcuguaauguuu

SEQ ID NO: 76897 - RNA, 19 nt, Homo sapiens
gcaauuagguuaugcuauu

SEQ ID NO: 76898 - RNA, 19 nt, Homo sapiens
gcaaugaacucaagaagga

SEQ ID NO: 76899 - RNA, 19 nt, Homo sapiens
gacaauggguggugaauuu

SEQ ID NO: 76900 - RNA, 19 nt, Homo sapiens
gaaauaaagugccuuacug

SEQ ID NO: 76901 - RNA, 19 nt, Homo sapiens
ugaaagaaccggacaaaua

SEQ ID NO: 76902 - RNA, 19 nt, Homo sapiens
ccaccuagaucauauuuaa

SEQ ID NO: 76903 - RNA, 19 nt, Homo sapiens
caacaugauugaaccauuu

SEQ ID NO: 76904 - RNA, 19 nt, Homo sapiens
ugacugagcugcuggcuaa

SEQ ID NO: 76905 - RNA, 19 nt, Homo sapiens
agacaagccuguaaacuaa

SEQ ID NO: 76906 - RNA, 19 nt, Homo sapiens
gcacaacgauacuacauuc

SEQ ID NO: 76907 - RNA, 19 nt, Homo sapiens
gcucagaugucguaauuug

SEQ ID NO: 76908 - RNA, 19 nt, Homo sapiens
ugaauuaccuggaccguuu

SEQ ID NO: 76909 - RNA, 19 nt, Homo sapiens
ggacagggcugggagaaga

SEQ ID NO: 76910 - RNA, 19 nt, Homo sapiens
cggagaagcugugcauuua

SEQ ID NO: 76911 - RNA, 19 nt, Homo sapiens
aaacaagugugaugccaua

SEQ ID NO: 76912 - RNA, 19 nt, Homo sapiens
ggucuuaucuguucagugu

SEQ ID NO: 76913 - RNA, 19 nt, Homo sapiens
gaggugaaauuccagauga

SEQ ID NO: 76914 - RNA, 19 nt, Homo sapiens
gaaaagcccuuccguaguu

SEQ ID NO: 76915 - RNA, 19 nt, Homo sapiens
ggaaauuaaugcugagaug

SEQ ID NO: 76916 - RNA, 19 nt, Homo sapiens
caagaagccugcaggagaa

SEQ ID NO: 76917 - RNA, 19 nt, Homo sapiens
gaucaucucugcagguuuc

SEQ ID NO: 76918 - RNA, 19 nt, Homo sapiens
gaacagaagugcgaagaag

SEQ ID NO: 76919 - RNA, 19 nt, Homo sapiens
gcaaagcaaugaacucaag

SEQ ID NO: 76920 - RNA, 19 nt, Homo sapiens
gcacagaaggaucuuaauu

SEQ ID NO: 76921 - RNA, 19 nt, Homo sapiens
gcaauaugggaacaaauua

SEQ ID NO: 76922 - RNA, 19 nt, Homo sapiens
caaacccucuguagcuaua

SEQ ID NO: 76923 - RNA, 19 nt, Homo sapiens
gaggcgagcuccuugaaga

SEQ ID NO: 76924 - RNA, 19 nt, Homo sapiens
cuaaagggguuccaaauua

SEQ ID NO: 76925 - RNA, 19 nt, Homo sapiens
aaagauagauggcugaaca

SEQ ID NO: 76926 - RNA, 19 nt, Homo sapiens
gcagaguaguuagagaaua

SEQ ID NO: 76927 - RNA, 19 nt, Homo sapiens
gggaagaaauccuaguaug

SEQ ID NO: 76928 - RNA, 19 nt, Homo sapiens
gauucugccuuguuucaua

SEQ ID NO: 76929 - RNA, 19 nt, Homo sapiens
gaaauaaggagggacauga

SEQ ID NO: 76930 - RNA, 19 nt, Homo sapiens
acacauggcuuaagugaca

SEQ ID NO: 76931 - RNA, 19 nt, Homo sapiens
caaguaagcuagccagagu

SEQ ID NO: 76932 - RNA, 19 nt, Homo sapiens
guagaugguugagauauga

SEQ ID NO: 76933 - RNA, 19 nt, Homo sapiens
gugauuggcuccuggguuu

SEQ ID NO: 76934 - RNA, 19 nt, Homo sapiens
cuaaagucauccauccuua

SEQ ID NO: 76935 - RNA, 19 nt, Homo sapiens
gaacuguguacgccauuua

SEQ ID NO: 76936 - RNA, 19 nt, Homo sapiens
gaauauguaugccugcaau

SEQ ID NO: 76937 - RNA, 19 nt, Homo sapiens
ugaaguagaugguugagau

SEQ ID NO: 76938 - RNA, 19 nt, Homo sapiens
cuaagaagcuaaagucauc

SEQ ID NO: 76939 - RNA, 19 nt, Homo sapiens
cagaguaguuagagaauau

SEQ ID NO: 76940 - RNA, 19 nt, Homo sapiens
guuauucucucacagugua

SEQ ID NO: 76941 - RNA, 19 nt, Homo sapiens
gagaagcugugcauuuaca

SEQ ID NO: 76942 - RNA, 19 nt, Homo sapiens
agaaagugcugauaaguag

SEQ ID NO: 76943 - RNA, 19 nt, Homo sapiens
aaacuuggcugggcuauca

SEQ ID NO: 76944 - RNA, 19 nt, Homo sapiens
gagaagccaucagcaaaug

SEQ ID NO: 76945 - RNA, 19 nt, Homo sapiens
aaaccgaggugcaaauuca

SEQ ID NO: 76946 - RNA, 19 nt, Homo sapiens
gaauacagaagcaguguga

SEQ ID NO: 76947 - RNA, 19 nt, Homo sapiens
gagaagaaauagacuugca

SEQ ID NO: 76948 - RNA, 19 nt, Homo sapiens
gcacacauggcuuaaguga

SEQ ID NO: 76949 - RNA, 19 nt, Homo sapiens
aaacagaagcagcaaauga

SEQ ID NO: 76950 - RNA, 19 nt, Homo sapiens
cagacaagccuguaaacua

SEQ ID NO: 76951 - RNA, 19 nt, Homo sapiens
ggaggcagauggagaccaa

SEQ ID NO: 76952 - RNA, 19 nt, Homo sapiens
ugacaaagccagaggagaa

SEQ ID NO: 76953 - RNA, 19 nt, Homo sapiens
gcucuuagucucuuuggua

SEQ ID NO: 76954 - RNA, 19 nt, Homo sapiens
acacugaauuggcaggaua

SEQ ID NO: 76955 - RNA, 19 nt, Homo sapiens
gaaguagaugguugagaua

SEQ ID NO: 76956 - RNA, 19 nt, Homo sapiens
gacaauaaacucaccuuga

SEQ ID NO: 76957 - RNA, 19 nt, Homo sapiens
caccuuaugucauguaaau

SEQ ID NO: 76958 - RNA, 19 nt, Homo sapiens
gaaauuaaugcugagauga

SEQ ID NO: 76959 - RNA, 19 nt, Homo sapiens
gaucuuaauucccaucucu

SEQ ID NO: 76960 - RNA, 19 nt, Homo sapiens
gagagagacgcguccauaa

SEQ ID NO: 76961 - RNA, 19 nt, Homo sapiens
uacaagagcuguucaugca

SEQ ID NO: 76962 - RNA, 19 nt, Homo sapiens
caacaaacccucuguagcu

SEQ ID NO: 76963 - RNA, 19 nt, Homo sapiens
ggucauccuuggucuaugu

SEQ ID NO: 76964 - RNA, 19 nt, Homo sapiens
ugacugacccuugagcuua

SEQ ID NO: 76965 - RNA, 19 nt, Homo sapiens
ucuuaucuguucaguguua

SEQ ID NO: 76966 - RNA, 19 nt, Homo sapiens
gauauagucagcugccuuu

SEQ ID NO: 76967 - RNA, 19 nt, Homo sapiens
uagaaagugcugauaagua

SEQ ID NO: 76968 - RNA, 19 nt, Homo sapiens
gggcacacauggcuuaagu

SEQ ID NO: 76969 - RNA, 19 nt, Homo sapiens
ugaauuggcaggauaagaa

SEQ ID NO: 76970 - RNA, 19 nt, Homo sapiens
gcggagaagcugugcauuu

SEQ ID NO: 76971 - RNA, 19 nt, Homo sapiens
guucaucacccuuauauca

SEQ ID NO: 76972 - RNA, 19 nt, Homo sapiens
ugaugauucuggauucuaa

SEQ ID NO: 76973 - RNA, 19 nt, Homo sapiens
cuacagaggugaaauucca

SEQ ID NO: 76974 - RNA, 19 nt, Homo sapiens
uaucuggcguucuuuggua

SEQ ID NO: 76975 - RNA, 19 nt, Homo sapiens
gaguguaguuggaucucua

SEQ ID NO: 76976 - RNA, 19 nt, Homo sapiens
uaaguagcaugaucagugu

SEQ ID NO: 76977 - RNA, 19 nt, Homo sapiens
gcgcuucccugcagucuag

SEQ ID NO: 76978 - RNA, 19 nt, Homo sapiens
guaauugacagguaaugaa

SEQ ID NO: 76979 - RNA, 19 nt, Homo sapiens
gccuuggcauuucuucuua

SEQ ID NO: 76980 - RNA, 19 nt, Homo sapiens
cauaucaaguccauguuau

SEQ ID NO: 76981 - RNA, 19 nt, Homo sapiens
gauucuggauucuaaacaa

SEQ ID NO: 76982 - RNA, 19 nt, Homo sapiens
gacugacccuugagcuuaa

SEQ ID NO: 76983 - RNA, 19 nt, Homo sapiens
ccucacaaccguacaguuu

SEQ ID NO: 76984 - RNA, 19 nt, Homo sapiens
gauaugaguucuucguacu

SEQ ID NO: 76985 - RNA, 19 nt, Homo sapiens
guucaggacuuugugaguu

SEQ ID NO: 76986 - RNA, 19 nt, Homo sapiens
gguaccaggugucaggaaa

SEQ ID NO: 76987 - RNA, 19 nt, Homo sapiens
aguuggaucucuacauuaa

SEQ ID NO: 76988 - RNA, 19 nt, Homo sapiens
ggaacuguguacgccauuu

SEQ ID NO: 76989 - RNA, 19 nt, Homo sapiens
gagagacgcguccauaauc

SEQ ID NO: 76990 - RNA, 19 nt, Homo sapiens
gcugauaaguagcaugauc

SEQ ID NO: 76991 - RNA, 19 nt, Homo sapiens
ccauaucaaguccauguua

SEQ ID NO: 76992 - RNA, 19 nt, Homo sapiens
gagagcacagcaugccuua

SEQ ID NO: 76993 - RNA, 19 nt, Homo sapiens
ggacagaauuggauacaua

SEQ ID NO: 76994 - RNA, 19 nt, Homo sapiens
ggaccuggcugcugugauu

SEQ ID NO: 76995 - RNA, 19 nt, Homo sapiens
ugacacaggucuuuccuaa

SEQ ID NO: 76996 - RNA, 19 nt, Homo sapiens
guauggagcugcuguguug

SEQ ID NO: 76997 - RNA, 19 nt, Homo sapiens
ggaagaugcuggcuuacug

SEQ ID NO: 76998 - RNA, 19 nt, Homo sapiens
gauuauaccuuugccaugu

SEQ ID NO: 76999 - RNA, 19 nt, Homo sapiens
ccagagaagcuauaaauuc

SEQ ID NO: 77000 - RNA, 19 nt, Homo sapiens
gcauuucgguggcuaguca

SEQ ID NO: 77001 - RNA, 19 nt, Homo sapiens
gaccagcacuccuacagau

SEQ ID NO: 77002 - RNA, 19 nt, Homo sapiens
gcuuugagcacaacuuuaa

SEQ ID NO: 77003 - RNA, 19 nt, Homo sapiens
ggaaccacaccacaucuaa

SEQ ID NO: 77004 - RNA, 19 nt, Homo sapiens
ggaccaucauccuacugua

SEQ ID NO: 77005 - RNA, 19 nt, Homo sapiens
acacaggucuuuccuaagg

SEQ ID NO: 77006 - RNA, 19 nt, Homo sapiens
cuagauggcuccucucagu

SEQ ID NO: 77007 - RNA, 19 nt, Homo sapiens
ccuguucgcugcccgagua

SEQ ID NO: 77008 - RNA, 19 nt, Homo sapiens
gaccaucauccuacuguaa

SEQ ID NO: 77009 - RNA, 19 nt, Homo sapiens
ggcaagcccuguugacaca

SEQ ID NO: 77010 - RNA, 19 nt, Homo sapiens
ugcggaagaugcuggcuua

SEQ ID NO: 77011 - RNA, 19 nt, Homo sapiens
ggcuuuggcuucuuggaaa

SEQ ID NO: 77012 - RNA, 19 nt, Homo sapiens
ccaucauccuacuguaaua

SEQ ID NO: 77013 - RNA, 19 nt, Homo sapiens
cagagaagcuauaaauucc

SEQ ID NO: 77014 - RNA, 19 nt, Homo sapiens
ggccagccaugucugcauu

SEQ ID NO: 77015 - RNA, 19 nt, Homo sapiens
gcugaaggcucauuuuaau

SEQ ID NO: 77016 - RNA, 19 nt, Homo sapiens
cagcuucuccugugugauu

SEQ ID NO: 77017 - RNA, 19 nt, Homo sapiens
gcuauaaauuccucuuugc

SEQ ID NO: 77018 - RNA, 19 nt, Homo sapiens
cuucuaggguuauugcauu

SEQ ID NO: 77019 - RNA, 19 nt, Homo sapiens
gaugggacagaauuggaua

SEQ ID NO: 77020 - RNA, 19 nt, Homo sapiens
uccuaaggcugcaagguuu

SEQ ID NO: 77021 - RNA, 19 nt, Homo sapiens
uaaauuccucuuugcuuug

SEQ ID NO: 77022 - RNA, 19 nt, Homo sapiens
gguuauugcauuuggauug

SEQ ID NO: 77023 - RNA, 19 nt, Homo sapiens
ugcuacagauuauaccuuu

SEQ ID NO: 77024 - RNA, 19 nt, Homo sapiens
gcaugcugcuggccuccaa

SEQ ID NO: 77025 - RNA, 19 nt, Homo sapiens
ggauacauacaccagcauu

SEQ ID NO: 77026 - RNA, 19 nt, Homo sapiens
cgacaggccuuggucaaaa

SEQ ID NO: 77027 - RNA, 19 nt, Homo sapiens
gccagagaagcuauaaauu

SEQ ID NO: 77028 - RNA, 19 nt, Homo sapiens
gaaccacaccacaucuaag

SEQ ID NO: 77029 - RNA, 19 nt, Homo sapiens
gcaugauagacacauauga

SEQ ID NO: 77030 - RNA, 19 nt, Homo sapiens
caucauccuacuguaauaa

SEQ ID NO: 77031 - RNA, 19 nt, Homo sapiens
gcagcgcugugaggaggaa

SEQ ID NO: 77032 - RNA, 19 nt, Homo sapiens
uggcuccucucaguacuuu

SEQ ID NO: 77033 - RNA, 19 nt, Homo sapiens
gcucuagugccuucuaaag

SEQ ID NO: 77034 - RNA, 19 nt, Homo sapiens
gcuacagauuauaccuuug

SEQ ID NO: 77035 - RNA, 19 nt, Homo sapiens
gugaggagcagcgcuguga

SEQ ID NO: 77036 - RNA, 19 nt, Homo sapiens
ggaucuuuguggccaagga

SEQ ID NO: 77037 - RNA, 19 nt, Homo sapiens
ggauuggggucccucuaaa

SEQ ID NO: 77038 - RNA, 19 nt, Homo sapiens
cccaagggaucugguccua

SEQ ID NO: 77039 - RNA, 19 nt, Homo sapiens
gaagcuauaaauuccucuu

SEQ ID NO: 77040 - RNA, 19 nt, Homo sapiens
aaugcaugauagacacaua

SEQ ID NO: 77041 - RNA, 19 nt, Homo sapiens
ccaggaaccacaccacauc

SEQ ID NO: 77042 - RNA, 19 nt, Homo sapiens
ccuaaggcugcaagguuua

SEQ ID NO: 77043 - RNA, 19 nt, Homo sapiens
agggaucacuggcacugaa

SEQ ID NO: 77044 - RNA, 19 nt, Homo sapiens
cauccuacuguaauaaaga

SEQ ID NO: 77045 - RNA, 19 nt, Homo sapiens
gaggcaagcccuguugaca

SEQ ID NO: 77046 - RNA, 19 nt, Homo sapiens
uggggucccucuaaaauuu

SEQ ID NO: 77047 - RNA, 19 nt, Homo sapiens
gaucgccacgggcagcauu

SEQ ID NO: 77048 - RNA, 19 nt, Homo sapiens
caugauagacacauaugag

SEQ ID NO: 77049 - RNA, 19 nt, Homo sapiens
gauacauacaccagcauuc

SEQ ID NO: 77050 - RNA, 19 nt, Homo sapiens
caccacaucuaagccugaa

SEQ ID NO: 77051 - RNA, 19 nt, Homo sapiens
caacuuuaagaggacauaa

SEQ ID NO: 77052 - RNA, 19 nt, Homo sapiens
agcuauaaauuccucuuug

SEQ ID NO: 77053 - RNA, 19 nt, Homo sapiens
guuauugcauuuggauugg

SEQ ID NO: 77054 - RNA, 19 nt, Homo sapiens
ggagaucaagccgcacaug

SEQ ID NO: 77055 - RNA, 19 nt, Homo sapiens
ccagcacuccuacagaugu

SEQ ID NO: 77056 - RNA, 19 nt, Homo sapiens
auuauaccuuugccaugua

SEQ ID NO: 77057 - RNA, 19 nt, Homo sapiens
aaacuggcuuuggcuucuu

SEQ ID NO: 77058 - RNA, 19 nt, Homo sapiens
gaaauaaaacuggcuuugg

SEQ ID NO: 77059 - RNA, 19 nt, Homo sapiens
ccucuuugcuuugcuuucu

SEQ ID NO: 77060 - RNA, 19 nt, Homo sapiens
agccagagaagcuauaaau

SEQ ID NO: 77061 - RNA, 19 nt, Homo sapiens
uagauggcuccucucagua

SEQ ID NO: 77062 - RNA, 19 nt, Homo sapiens
gcccuccucucccauuguc

SEQ ID NO: 77063 - RNA, 19 nt, Homo sapiens
gacagaauuggauacauac

SEQ ID NO: 77064 - RNA, 19 nt, Homo sapiens
gggacagaauuggauacau

SEQ ID NO: 77065 - RNA, 19 nt, Homo sapiens
gcagcgccuuucccaacuc

SEQ ID NO: 77066 - RNA, 19 nt, Homo sapiens
cuggaucgcuaccugucuu

SEQ ID NO: 77067 - RNA, 19 nt, Homo sapiens
ccagccaugucugcauuuc

SEQ ID NO: 77068 - RNA, 19 nt, Homo sapiens
guacugagcugggcaaaua

SEQ ID NO: 77069 - RNA, 19 nt, Homo sapiens
cagcaaaucuuuauacaga

SEQ ID NO: 77070 - RNA, 19 nt, Homo sapiens
ggacaaagcccgagcaaag

SEQ ID NO: 77071 - RNA, 19 nt, Homo sapiens
ggaaaucuauccuccaaag

SEQ ID NO: 77072 - RNA, 19 nt, Homo sapiens
ggacaauaaugcagucugu

SEQ ID NO: 77073 - RNA, 19 nt, Homo sapiens
uaaauaagugggucaagua

SEQ ID NO: 77074 - RNA, 19 nt, Homo sapiens
ggaggugugugaagucuau

SEQ ID NO: 77075 - RNA, 19 nt, Homo sapiens
guacaaugccuuugaugaa

SEQ ID NO: 77076 - RNA, 19 nt, Homo sapiens
gggcgucgcugaugaagau

SEQ ID NO: 77077 - RNA, 19 nt, Homo sapiens
gauguugacugccuugaau

SEQ ID NO: 77078 - RNA, 19 nt, Homo sapiens
cuaaaugacuuacaugaag

SEQ ID NO: 77079 - RNA, 19 nt, Homo sapiens
agaaagccauguugucuga

SEQ ID NO: 77080 - RNA, 19 nt, Homo sapiens
ggauccagaugaagaaaug

SEQ ID NO: 77081 - RNA, 19 nt, Homo sapiens
cagccaaacuugaggaaau

SEQ ID NO: 77082 - RNA, 19 nt, Homo sapiens
gcaaagaaagccauguugu

SEQ ID NO: 77083 - RNA, 19 nt, Homo sapiens
uauggaaggugcuacuuga

SEQ ID NO: 77084 - RNA, 19 nt, Homo sapiens
uguccuggcugaauguaua

SEQ ID NO: 77085 - RNA, 19 nt, Homo sapiens
gagcaaagaaagccauguu

SEQ ID NO: 77086 - RNA, 19 nt, Homo sapiens
ugaagaugcacacaacaua

SEQ ID NO: 77087 - RNA, 19 nt, Homo sapiens
gugcaagccucggauuauu

SEQ ID NO: 77088 - RNA, 19 nt, Homo sapiens
gcugcuauaucuauccauu

SEQ ID NO: 77089 - RNA, 19 nt, Homo sapiens
gcagguugcauaucuaaau

SEQ ID NO: 77090 - RNA, 19 nt, Homo sapiens
gaggaagucuggaaaauca

SEQ ID NO: 77091 - RNA, 19 nt, Homo sapiens
gcaaaagguuucaggguau

SEQ ID NO: 77092 - RNA, 19 nt, Homo sapiens
gcucaaaacugaagcacuu

SEQ ID NO: 77093 - RNA, 19 nt, Homo sapiens
uguaagugcugcuauaucu

SEQ ID NO: 77094 - RNA, 19 nt, Homo sapiens
caacauacagacccacaga

SEQ ID NO: 77095 - RNA, 19 nt, Homo sapiens
uugcagagcuguuggaucu

SEQ ID NO: 77096 - RNA, 19 nt, Homo sapiens
gggaucagcacuuucuuga

SEQ ID NO: 77097 - RNA, 19 nt, Homo sapiens
cuuaagggaucagcacuuu

SEQ ID NO: 77098 - RNA, 19 nt, Homo sapiens
aaucuauccuccaaaguug

SEQ ID NO: 77099 - RNA, 19 nt, Homo sapiens
caaagaaagccauguuguc

SEQ ID NO: 77100 - RNA, 19 nt, Homo sapiens
gaagaugcacacaacauac

SEQ ID NO: 77101 - RNA, 19 nt, Homo sapiens
guauauggcgacacaagaa

SEQ ID NO: 77102 - RNA, 19 nt, Homo sapiens
uaagugcugcuauaucuau

SEQ ID NO: 77103 - RNA, 19 nt, Homo sapiens
acagagacagcuuggauuu

SEQ ID NO: 77104 - RNA, 19 nt, Homo sapiens
gcuucggccuuguaucauu

SEQ ID NO: 77105 - RNA, 19 nt, Homo sapiens
uuaaauaagugggucaagu

SEQ ID NO: 77106 - RNA, 19 nt, Homo sapiens
gacaaagcccgagcaaaga

SEQ ID NO: 77107 - RNA, 19 nt, Homo sapiens
ccacagagacagcuuggau

SEQ ID NO: 77108 - RNA, 19 nt, Homo sapiens
gcaggauccagaugaagaa

SEQ ID NO: 77109 - RNA, 19 nt, Homo sapiens
cagguugcauaucuaaaug

SEQ ID NO: 77110 - RNA, 19 nt, Homo sapiens
caccauggaauuaaugauu

SEQ ID NO: 77111 - RNA, 19 nt, Homo sapiens
aaaucuauccuccaaaguu

SEQ ID NO: 77112 - RNA, 19 nt, Homo sapiens
gaagaugaugaccggguuu

SEQ ID NO: 77113 - RNA, 19 nt, Homo sapiens
cauuaucaguugacagugu

SEQ ID NO: 77114 - RNA, 19 nt, Homo sapiens
ggacucccacaacaacaaa

SEQ ID NO: 77115 - RNA, 19 nt, Homo sapiens
ccaggaagaggaaggcaaa

SEQ ID NO: 77116 - RNA, 19 nt, Homo sapiens
uaucauuucucgucaucug

SEQ ID NO: 77117 - RNA, 19 nt, Homo sapiens
gagccagccuugggacaau

SEQ ID NO: 77118 - RNA, 19 nt, Homo sapiens
gcaaauagagaggaagucu

SEQ ID NO: 77119 - RNA, 19 nt, Homo sapiens
ugccuuugaugaacuguuu

SEQ ID NO: 77120 - RNA, 19 nt, Homo sapiens
caucaaacagggcaaagug

SEQ ID NO: 77121 - RNA, 19 nt, Homo sapiens
gcuccacguucucuucugu

SEQ ID NO: 77122 - RNA, 19 nt, Homo sapiens
uaauggaggugugugaagu

SEQ ID NO: 77123 - RNA, 19 nt, Homo sapiens
gaugaacuguuuuguaagu

SEQ ID NO: 77124 - RNA, 19 nt, Homo sapiens
cacguucucuucugucugu

SEQ ID NO: 77125 - RNA, 19 nt, Homo sapiens
ugaugaagaugcacacaac

SEQ ID NO: 77126 - RNA, 19 nt, Homo sapiens
caaacuugaggaaaucuau

SEQ ID NO: 77127 - RNA, 19 nt, Homo sapiens
gcugcccucuccacauuau

SEQ ID NO: 77128 - RNA, 19 nt, Homo sapiens
ggaggcgugcguuugcuuu

SEQ ID NO: 77129 - RNA, 19 nt, Homo sapiens
auagagaacugugucaagu

SEQ ID NO: 77130 - RNA, 19 nt, Homo sapiens
cuccaaaguugcaccaguu

SEQ ID NO: 77131 - RNA, 19 nt, Homo sapiens
cuucggccuuguaucauuu

SEQ ID NO: 77132 - RNA, 19 nt, Homo sapiens
gcgagcaauucuucuggau

SEQ ID NO: 77133 - RNA, 19 nt, Homo sapiens
guaagugcugcuauaucua

SEQ ID NO: 77134 - RNA, 19 nt, Homo sapiens
caaagcccgagcaaagaaa

SEQ ID NO: 77135 - RNA, 19 nt, Homo sapiens
gaauuuccuuaugguauac

SEQ ID NO: 77136 - RNA, 19 nt, Homo sapiens
agacauacuuaagggauca

SEQ ID NO: 77137 - RNA, 19 nt, Homo sapiens
cgaaggagcgggacaccau

SEQ ID NO: 77138 - RNA, 19 nt, Homo sapiens
gacaguguacaaugccuuu

SEQ ID NO: 77139 - RNA, 19 nt, Homo sapiens
guucugggcuccguuguac

SEQ ID NO: 77140 - RNA, 19 nt, Homo sapiens
ggaagaggaaggcaaacgu

SEQ ID NO: 77141 - RNA, 19 nt, Homo sapiens
aaagaaagccauguugucu

SEQ ID NO: 77142 - RNA, 19 nt, Homo sapiens
acaaagcccgagcaaagaa

SEQ ID NO: 77143 - RNA, 19 nt, Homo sapiens
agagacagcuuggauuugc

SEQ ID NO: 77144 - RNA, 19 nt, Homo sapiens
gguauauggcgacacaaga

SEQ ID NO: 77145 - RNA, 19 nt, Homo sapiens
uaagggaucagcacuuucu

SEQ ID NO: 77146 - RNA, 19 nt, Homo sapiens
caaggaaaagacauacuua

SEQ ID NO: 77147 - RNA, 19 nt, Homo sapiens
gagaggaagucuggaaaau

SEQ ID NO: 77148 - RNA, 19 nt, Homo sapiens
ggauguugacugccuugaa

SEQ ID NO: 77149 - RNA, 19 nt, Homo sapiens
gaaaucuauccuccaaagu

SEQ ID NO: 77150 - RNA, 19 nt, Homo sapiens
ugacaaagaagaugaugac

SEQ ID NO: 77151 - RNA, 19 nt, Homo sapiens
gcuuggauuugcuggacaa

SEQ ID NO: 77152 - RNA, 19 nt, Homo sapiens
ggaucucuguguccuggau

SEQ ID NO: 77153 - RNA, 19 nt, Homo sapiens
ugacagauggagcuuguuc

SEQ ID NO: 77154 - RNA, 19 nt, Homo sapiens
ugugacagauggagcuugu

SEQ ID NO: 77155 - RNA, 19 nt, Homo sapiens
uuccacaacagaaguauuu

SEQ ID NO: 77156 - RNA, 19 nt, Homo sapiens
ugugugaagucuauaaacu

SEQ ID NO: 77157 - RNA, 19 nt, Homo sapiens
gaauugaugcaaaagguuu

SEQ ID NO: 77158 - RNA, 19 nt, Homo sapiens
gcaccaguuugcguaugug

SEQ ID NO: 77159 - RNA, 19 nt, Homo sapiens
ggaaaagacauacuuaagg

SEQ ID NO: 77160 - RNA, 19 nt, Homo sapiens
auuaucaguugacagugua

SEQ ID NO: 77161 - RNA, 19 nt, Homo sapiens
gggcuccguuguaccaagu

SEQ ID NO: 77162 - RNA, 19 nt, Homo sapiens
ccacaccugacaaagaaga

SEQ ID NO: 77163 - RNA, 19 nt, Homo sapiens
ucccgaugcugcuauggaa

SEQ ID NO: 77164 - RNA, 19 nt, Homo sapiens
uaucaguggugcgacauag

SEQ ID NO: 77165 - RNA, 19 nt, Homo sapiens
uguacaaugccuuugauga

SEQ ID NO: 77166 - RNA, 19 nt, Homo sapiens
agaacugugucaaguggau

SEQ ID NO: 77167 - RNA, 19 nt, Homo sapiens
gccuugaauuuccuuaugg

SEQ ID NO: 77168 - RNA, 19 nt, Homo sapiens
guacugagcugggcaaaua

SEQ ID NO: 77169 - RNA, 19 nt, Homo sapiens
cagcaaaucuuuauacaga

SEQ ID NO: 77170 - RNA, 19 nt, Homo sapiens
ggacaaagcccgagcaaag

SEQ ID NO: 77171 - RNA, 19 nt, Homo sapiens
ggaaaucuauccuccaaag

SEQ ID NO: 77172 - RNA, 19 nt, Homo sapiens
ggacaauaaugcagucugu

SEQ ID NO: 77173 - RNA, 19 nt, Homo sapiens
uaaauaagugggucaagua

SEQ ID NO: 77174 - RNA, 19 nt, Homo sapiens
ggaggugugugaagucuau

SEQ ID NO: 77175 - RNA, 19 nt, Homo sapiens
guacaaugccuuugaugaa

SEQ ID NO: 77176 - RNA, 19 nt, Homo sapiens
gggcgucgcugaugaagau

SEQ ID NO: 77177 - RNA, 19 nt, Homo sapiens
gauguugacugccuugaau

SEQ ID NO: 77178 - RNA, 19 nt, Homo sapiens
cuaaaugacuuacaugaag

SEQ ID NO: 77179 - RNA, 19 nt, Homo sapiens
agaaagccauguugucuga

SEQ ID NO: 77180 - RNA, 19 nt, Homo sapiens
ggauccagaugaagaaaug

SEQ ID NO: 77181 - RNA, 19 nt, Homo sapiens
cagccaaacuugaggaaau

SEQ ID NO: 77182 - RNA, 19 nt, Homo sapiens
gcaaagaaagccauguugu

SEQ ID NO: 77183 - RNA, 19 nt, Homo sapiens
uauggaaggugcuacuuga

SEQ ID NO: 77184 - RNA, 19 nt, Homo sapiens
uguccuggcugaauguaua

SEQ ID NO: 77185 - RNA, 19 nt, Homo sapiens
gagcaaagaaagccauguu

SEQ ID NO: 77186 - RNA, 19 nt, Homo sapiens
ugaagaugcacacaacaua

SEQ ID NO: 77187 - RNA, 19 nt, Homo sapiens
gugcaagccucggauuauu

SEQ ID NO: 77188 - RNA, 19 nt, Homo sapiens
gcugcuauaucuauccauu

SEQ ID NO: 77189 - RNA, 19 nt, Homo sapiens
gcagguugcauaucuaaau

SEQ ID NO: 77190 - RNA, 19 nt, Homo sapiens
gaggaagucuggaaaauca

SEQ ID NO: 77191 - RNA, 19 nt, Homo sapiens
gcaaaagguuucaggguau

SEQ ID NO: 77192 - RNA, 19 nt, Homo sapiens
gcucaaaacugaagcacuu

SEQ ID NO: 77193 - RNA, 19 nt, Homo sapiens
uguaagugcugcuauaucu

SEQ ID NO: 77194 - RNA, 19 nt, Homo sapiens
caacauacagacccacaga

SEQ ID NO: 77195 - RNA, 19 nt, Homo sapiens
uugcagagcuguuggaucu

SEQ ID NO: 77196 - RNA, 19 nt, Homo sapiens
gggaucagcacuuucuuga

SEQ ID NO: 77197 - RNA, 19 nt, Homo sapiens
cuuaagggaucagcacuuu

SEQ ID NO: 77198 - RNA, 19 nt, Homo sapiens
aaucuauccuccaaaguug

SEQ ID NO: 77199 - RNA, 19 nt, Homo sapiens
caaagaaagccauguuguc

SEQ ID NO: 77200 - RNA, 19 nt, Homo sapiens
gaagaugcacacaacauac

SEQ ID NO: 77201 - RNA, 19 nt, Homo sapiens
guauauggcgacacaagaa

SEQ ID NO: 77202 - RNA, 19 nt, Homo sapiens
uaagugcugcuauaucuau

SEQ ID NO: 77203 - RNA, 19 nt, Homo sapiens
acagagacagcuuggauuu

SEQ ID NO: 77204 - RNA, 19 nt, Homo sapiens
gcuucggccuuguaucauu

SEQ ID NO: 77205 - RNA, 19 nt, Homo sapiens
uuaaauaagugggucaagu

SEQ ID NO: 77206 - RNA, 19 nt, Homo sapiens
gcaggauccagaugaagaa

SEQ ID NO: 77207 - RNA, 19 nt, Homo sapiens
gacaaagcccgagcaaaga

SEQ ID NO: 77208 - RNA, 19 nt, Homo sapiens
ccacagagacagcuuggau

SEQ ID NO: 77209 - RNA, 19 nt, Homo sapiens
cagguugcauaucuaaaug

SEQ ID NO: 77210 - RNA, 19 nt, Homo sapiens
caccauggaauuaaugauu

SEQ ID NO: 77211 - RNA, 19 nt, Homo sapiens
aaaucuauccuccaaaguu

SEQ ID NO: 77212 - RNA, 19 nt, Homo sapiens
gaagaugaugaccggguuu

SEQ ID NO: 77213 - RNA, 19 nt, Homo sapiens
cauuaucaguugacagugu

SEQ ID NO: 77214 - RNA, 19 nt, Homo sapiens
ggacucccacaacaacaaa

SEQ ID NO: 77215 - RNA, 19 nt, Homo sapiens
uaucauuucucgucaucug

SEQ ID NO: 77216 - RNA, 19 nt, Homo sapiens
ccaggaagaggaaggcaaa

SEQ ID NO: 77217 - RNA, 19 nt, Homo sapiens
gagccagccuugggacaau

SEQ ID NO: 77218 - RNA, 19 nt, Homo sapiens
gcaaauagagaggaagucu

SEQ ID NO: 77219 - RNA, 19 nt, Homo sapiens
ugccuuugaugaacuguuu

SEQ ID NO: 77220 - RNA, 19 nt, Homo sapiens
caucaaacagggcaaagug

SEQ ID NO: 77221 - RNA, 19 nt, Homo sapiens
gcuccacguucucuucugu

SEQ ID NO: 77222 - RNA, 19 nt, Homo sapiens
uaauggaggugugugaagu

SEQ ID NO: 77223 - RNA, 19 nt, Homo sapiens
gaugaacuguuuuguaagu

SEQ ID NO: 77224 - RNA, 19 nt, Homo sapiens
cacguucucuucugucugu

SEQ ID NO: 77225 - RNA, 19 nt, Homo sapiens
ugaugaagaugcacacaac

SEQ ID NO: 77226 - RNA, 19 nt, Homo sapiens
caaacuugaggaaaucuau

SEQ ID NO: 77227 - RNA, 19 nt, Homo sapiens
gcugcccucuccacauuau

SEQ ID NO: 77228 - RNA, 19 nt, Homo sapiens
ggaggcgugcguuugcuuu

SEQ ID NO: 77229 - RNA, 19 nt, Homo sapiens
auagagaacugugucaagu

SEQ ID NO: 77230 - RNA, 19 nt, Homo sapiens
cuccaaaguugcaccaguu

SEQ ID NO: 77231 - RNA, 19 nt, Homo sapiens
cuucggccuuguaucauuu

SEQ ID NO: 77232 - RNA, 19 nt, Homo sapiens
gcgagcaauucuucuggau

SEQ ID NO: 77233 - RNA, 19 nt, Homo sapiens
guaagugcugcuauaucua

SEQ ID NO: 77234 - RNA, 19 nt, Homo sapiens
caaagcccgagcaaagaaa

SEQ ID NO: 77235 - RNA, 19 nt, Homo sapiens
gaauuuccuuaugguauac

SEQ ID NO: 77236 - RNA, 19 nt, Homo sapiens
cgaaggagcgggacaccau

SEQ ID NO: 77237 - RNA, 19 nt, Homo sapiens
agacauacuuaagggauca

SEQ ID NO: 77238 - RNA, 19 nt, Homo sapiens
ggaagaggaaggcaaacgu

SEQ ID NO: 77239 - RNA, 19 nt, Homo sapiens
gacaguguacaaugccuuu

SEQ ID NO: 77240 - RNA, 19 nt, Homo sapiens
guucugggcuccguuguac

SEQ ID NO: 77241 - RNA, 19 nt, Homo sapiens
aaagaaagccauguugucu

SEQ ID NO: 77242 - RNA, 19 nt, Homo sapiens
acaaagcccgagcaaagaa

SEQ ID NO: 77243 - RNA, 19 nt, Homo sapiens
agagacagcuuggauuugc

SEQ ID NO: 77244 - RNA, 19 nt, Homo sapiens
gguauauggcgacacaaga

SEQ ID NO: 77245 - RNA, 19 nt, Homo sapiens
uaagggaucagcacuuucu

SEQ ID NO: 77246 - RNA, 19 nt, Homo sapiens
caaggaaaagacauacuua

SEQ ID NO: 77247 - RNA, 19 nt, Homo sapiens
gagaggaagucuggaaaau

SEQ ID NO: 77248 - RNA, 19 nt, Homo sapiens
ggauguugacugccuugaa

SEQ ID NO: 77249 - RNA, 19 nt, Homo sapiens
gaaaucuauccuccaaagu

SEQ ID NO: 77250 - RNA, 19 nt, Homo sapiens
gcuuggauuugcuggacaa

SEQ ID NO: 77251 - RNA, 19 nt, Homo sapiens
ggaucucuguguccuggau

SEQ ID NO: 77252 - RNA, 19 nt, Homo sapiens
ugacagauggagcuuguuc

SEQ ID NO: 77253 - RNA, 19 nt, Homo sapiens
ugugacagauggagcuugu

SEQ ID NO: 77254 - RNA, 19 nt, Homo sapiens
ugacaaagaagaugaugac

SEQ ID NO: 77255 - RNA, 19 nt, Homo sapiens
uuccacaacagaaguauuu

SEQ ID NO: 77256 - RNA, 19 nt, Homo sapiens
ugugugaagucuauaaacu

SEQ ID NO: 77257 - RNA, 19 nt, Homo sapiens
gaauugaugcaaaagguuu

SEQ ID NO: 77258 - RNA, 19 nt, Homo sapiens
gcaccaguuugcguaugug

SEQ ID NO: 77259 - RNA, 19 nt, Homo sapiens
ggaaaagacauacuuaagg

SEQ ID NO: 77260 - RNA, 19 nt, Homo sapiens
auuaucaguugacagugua

SEQ ID NO: 77261 - RNA, 19 nt, Homo sapiens
gggcuccguuguaccaagu

SEQ ID NO: 77262 - RNA, 19 nt, Homo sapiens
ucccgaugcugcuauggaa

SEQ ID NO: 77263 - RNA, 19 nt, Homo sapiens
uaucaguggugcgacauag

SEQ ID NO: 77264 - RNA, 19 nt, Homo sapiens
ccacaccugacaaagaaga

SEQ ID NO: 77265 - RNA, 19 nt, Homo sapiens
uguacaaugccuuugauga

SEQ ID NO: 77266 - RNA, 19 nt, Homo sapiens
agaacugugucaaguggau

SEQ ID NO: 77267 - RNA, 19 nt, Homo sapiens
gccuugaauuuccuuaugg

SEQ ID NO: 77268 - RNA, 19 nt, Homo sapiens
ucacaaagcauccauauug

SEQ ID NO: 77269 - RNA, 19 nt, Homo sapiens
gaugggagaugcucacuga

SEQ ID NO: 77270 - RNA, 19 nt, Homo sapiens
gaucucaacucucaacuca

SEQ ID NO: 77271 - RNA, 19 nt, Homo sapiens
gaagucauguuuacagugu

SEQ ID NO: 77272 - RNA, 19 nt, Homo sapiens
caagagauucccaccauua

SEQ ID NO: 77273 - RNA, 19 nt, Homo sapiens
guaaagagauccugaccau

SEQ ID NO: 77274 - RNA, 19 nt, Homo sapiens
ccaguugugugcugcauua

SEQ ID NO: 77275 - RNA, 19 nt, Homo sapiens
gcagaggacucacaaagca

SEQ ID NO: 77276 - RNA, 19 nt, Homo sapiens
gagauucccaccauuauuu

SEQ ID NO: 77277 - RNA, 19 nt, Homo sapiens
uagccuaccucuacaauga

SEQ ID NO: 77278 - RNA, 19 nt, Homo sapiens
gagcagagaggaugacuug

SEQ ID NO: 77279 - RNA, 19 nt, Homo sapiens
gcacccgguuuaucaguaa

SEQ ID NO: 77280 - RNA, 19 nt, Homo sapiens
gcagcugucuuuagccaaa

SEQ ID NO: 77281 - RNA, 19 nt, Homo sapiens
ggcaugaucucaacucuca

SEQ ID NO: 77282 - RNA, 19 nt, Homo sapiens
cagauaggcuagccagaaa

SEQ ID NO: 77283 - RNA, 19 nt, Homo sapiens
gacaagcgcuauggagaaa

SEQ ID NO: 77284 - RNA, 19 nt, Homo sapiens
ugaaggaccugguggacaa

SEQ ID NO: 77285 - RNA, 19 nt, Homo sapiens
ucaguuuccucaucuguaa

SEQ ID NO: 77286 - RNA, 19 nt, Homo sapiens
gcucagaucccucucuuug

SEQ ID NO: 77287 - RNA, 19 nt, Homo sapiens
gggaagcgcagcugucuuu

SEQ ID NO: 77288 - RNA, 19 nt, Homo sapiens
ugacagcuuucacgcuuaa

SEQ ID NO: 77289 - RNA, 19 nt, Homo sapiens
gcggauaaaccuaugcaua

SEQ ID NO: 77290 - RNA, 19 nt, Homo sapiens
gacagaggcagcuucguua

SEQ ID NO: 77291 - RNA, 19 nt, Homo sapiens
ggacaagcgcuauggagaa

SEQ ID NO: 77292 - RNA, 19 nt, Homo sapiens
gcccacaucugcugguuug

SEQ ID NO: 77293 - RNA, 19 nt, Homo sapiens
gagaucgucugccagcuau

SEQ ID NO: 77294 - RNA, 19 nt, Homo sapiens
gggcauagccuaccucuac

SEQ ID NO: 77295 - RNA, 19 nt, Homo sapiens
ucacugagcugcugcuuuu

SEQ ID NO: 77296 - RNA, 19 nt, Homo sapiens
ggaacgggcugaccacaac

SEQ ID NO: 77297 - RNA, 19 nt, Homo sapiens
ggauaaaccuaugcauaca

SEQ ID NO: 77298 - RNA, 19 nt, Homo sapiens
gugaacaccucucuuugug

SEQ ID NO: 77299 - RNA, 19 nt, Homo sapiens
ucagaucccucucuuugga

SEQ ID NO: 77300 - RNA, 19 nt, Homo sapiens
gaaguugccaccaugaaug

SEQ ID NO: 77301 - RNA, 19 nt, Homo sapiens
gagcucagaucccucucuu

SEQ ID NO: 77302 - RNA, 19 nt, Homo sapiens
aggaagaggugcugagcua

SEQ ID NO: 77303 - RNA, 19 nt, Homo sapiens
caucugaggugaccaagag

SEQ ID NO: 77304 - RNA, 19 nt, Homo sapiens
gaacucaugaccucaagug

SEQ ID NO: 77305 - RNA, 19 nt, Homo sapiens
cagaggcguucguauguga

SEQ ID NO: 77306 - RNA, 19 nt, Homo sapiens
gccaaagccugugcaaaug

SEQ ID NO: 77307 - RNA, 19 nt, Homo sapiens
caaccacgcccagcuaauu

SEQ ID NO: 77308 - RNA, 19 nt, Homo sapiens
ggagugcaguggcaugauc

SEQ ID NO: 77309 - RNA, 19 nt, Homo sapiens
ccaaagugcugggauuaca

SEQ ID NO: 77310 - RNA, 19 nt, Homo sapiens
ccacuucggucucccaaag

SEQ ID NO: 77311 - RNA, 19 nt, Homo sapiens
caaguccucuguaacaucu

SEQ ID NO: 77312 - RNA, 19 nt, Homo sapiens
caacaggugaagcggauaa

SEQ ID NO: 77313 - RNA, 19 nt, Homo sapiens
gaucgucuccgccuuggaa

SEQ ID NO: 77314 - RNA, 19 nt, Homo sapiens
ccacagauggcgucaaugu

SEQ ID NO: 77315 - RNA, 19 nt, Homo sapiens
ucaaugacacaaugaggua

SEQ ID NO: 77316 - RNA, 19 nt, Homo sapiens
gaucgucugccagcuauuu

SEQ ID NO: 77317 - RNA, 19 nt, Homo sapiens
guaggugugccaaguguuu

SEQ ID NO: 77318 - RNA, 19 nt, Homo sapiens
ggaagcaguuggccacacu

SEQ ID NO: 77319 - RNA, 19 nt, Homo sapiens
ggaaguugccaccaugaau

SEQ ID NO: 77320 - RNA, 19 nt, Homo sapiens
caagcgcuauggagaaauc

SEQ ID NO: 77321 - RNA, 19 nt, Homo sapiens
ccuacaaagcgaagaauaa

SEQ ID NO: 77322 - RNA, 19 nt, Homo sapiens
gaaccugaagcucuuugaa

SEQ ID NO: 77323 - RNA, 19 nt, Homo sapiens
acagauggcgucaauguga

SEQ ID NO: 77324 - RNA, 19 nt, Homo sapiens
gaaggagggcgacgugaca

SEQ ID NO: 77325 - RNA, 19 nt, Homo sapiens
ucaccggauucuccuauga

SEQ ID NO: 77326 - RNA, 19 nt, Homo sapiens
gauuaaaugugaggaggau

SEQ ID NO: 77327 - RNA, 19 nt, Homo sapiens
gacgggauuucaccauguu

SEQ ID NO: 77328 - RNA, 19 nt, Homo sapiens
gcaguggcaugaucucaac

SEQ ID NO: 77329 - RNA, 19 nt, Homo sapiens
uguuuacucugcaaaugua

SEQ ID NO: 77330 - RNA, 19 nt, Homo sapiens
ugaaagggcugcugaaaag

SEQ ID NO: 77331 - RNA, 19 nt, Homo sapiens
ggacugcugcucuggcuau

SEQ ID NO: 77332 - RNA, 19 nt, Homo sapiens
guugugugcugcauuagga

SEQ ID NO: 77333 - RNA, 19 nt, Homo sapiens
gggacucaaugacacaaug

SEQ ID NO: 77334 - RNA, 19 nt, Homo sapiens
gugccaaguguuucuguua

SEQ ID NO: 77335 - RNA, 19 nt, Homo sapiens
gccaggaagucauguuuac

SEQ ID NO: 77336 - RNA, 19 nt, Homo sapiens
agaacagccuccaggaaga

SEQ ID NO: 77337 - RNA, 19 nt, Homo sapiens
gaagaggugcugagcuaca

SEQ ID NO: 77338 - RNA, 19 nt, Homo sapiens
ggacucaaugacacaauga

SEQ ID NO: 77339 - RNA, 19 nt, Homo sapiens
gagccucaguuuccucauc

SEQ ID NO: 77340 - RNA, 19 nt, Homo sapiens
ucaaugccauccugacaca

SEQ ID NO: 77341 - RNA, 19 nt, Homo sapiens
ggccaggaagucauguuua

SEQ ID NO: 77342 - RNA, 19 nt, Homo sapiens
ugagguacauucugaucga

SEQ ID NO: 77343 - RNA, 19 nt, Homo sapiens
ccagauaggcuagccagaa

SEQ ID NO: 77344 - RNA, 19 nt, Homo sapiens
cagauggcgucaaugugaa

SEQ ID NO: 77345 - RNA, 19 nt, Homo sapiens
ccaucagaauguugaaaug

SEQ ID NO: 77346 - RNA, 19 nt, Homo sapiens
ggcgaagggugggagcaua

SEQ ID NO: 77347 - RNA, 19 nt, Homo sapiens
cauuaggagugacacaaga

SEQ ID NO: 77348 - RNA, 19 nt, Homo sapiens
uuucgaagcugcugugaag

SEQ ID NO: 77349 - RNA, 19 nt, Homo sapiens
acaaagcgaagaauaagga

SEQ ID NO: 77350 - RNA, 19 nt, Homo sapiens
acgaggaccuggugagaau

SEQ ID NO: 77351 - RNA, 19 nt, Homo sapiens
cccgaaaccugaccaucuu

SEQ ID NO: 77352 - RNA, 19 nt, Homo sapiens
agacagaggcagcuucguu

SEQ ID NO: 77353 - RNA, 19 nt, Homo sapiens
ugugggaccucaccggauu

SEQ ID NO: 77354 - RNA, 19 nt, Homo sapiens
ggcgaugccuccacagcuu

SEQ ID NO: 77355 - RNA, 19 nt, Homo sapiens
cugcaaauguaagaaagaa

SEQ ID NO: 77356 - RNA, 19 nt, Homo sapiens
acaagagauucccaccauu

SEQ ID NO: 77357 - RNA, 19 nt, Homo sapiens
aaugugaacaccucucuuu

SEQ ID NO: 77358 - RNA, 19 nt, Homo sapiens
caucagaauguugaaauga

SEQ ID NO: 77359 - RNA, 19 nt, Homo sapiens
aacaagagauucccaccau

SEQ ID NO: 77360 - RNA, 19 nt, Homo sapiens
cuaaauuuccuucuuccaa

SEQ ID NO: 77361 - RNA, 19 nt, Homo sapiens
gugcaagccaucagaaugu

SEQ ID NO: 77362 - RNA, 19 nt, Homo sapiens
gcauaggaacgcugcauag

SEQ ID NO: 77363 - RNA, 19 nt, Homo sapiens
cagaagggacucaaugaca

SEQ ID NO: 77364 - RNA, 19 nt, Homo sapiens
gcuagucucgaacucauga

SEQ ID NO: 77365 - RNA, 19 nt, Homo sapiens
cugacacacuuuaugcaaa

SEQ ID NO: 77366 - RNA, 19 nt, Homo sapiens
cugcugcucuggcuaugaa

SEQ ID NO: 77367 - RNA, 19 nt, Homo sapiens
gaggaccuggugagaauga

SEQ ID NO: 77368 - RNA, 19 nt, Homo sapiens
gaaaggagaaauagcauua

SEQ ID NO: 77369 - RNA, 19 nt, Homo sapiens
caauauagguuuacgguuu

SEQ ID NO: 77370 - RNA, 19 nt, Homo sapiens
gauaauggccucagaauga

SEQ ID NO: 77371 - RNA, 19 nt, Homo sapiens
ucagaaacauuccaagaua

SEQ ID NO: 77372 - RNA, 19 nt, Homo sapiens
gcacggcaauugaagcaua

SEQ ID NO: 77373 - RNA, 19 nt, Homo sapiens
ucccuuaacuggauuauua

SEQ ID NO: 77374 - RNA, 19 nt, Homo sapiens
ggacugagcugcuuuuauu

SEQ ID NO: 77375 - RNA, 19 nt, Homo sapiens
ggaauagaaugucuucaga

SEQ ID NO: 77376 - RNA, 19 nt, Homo sapiens
acagaaguguguagaguua

SEQ ID NO: 77377 - RNA, 19 nt, Homo sapiens
gaacaggagucuagauguc

SEQ ID NO: 77378 - RNA, 19 nt, Homo sapiens
cagaaugacugcaagacua

SEQ ID NO: 77379 - RNA, 19 nt, Homo sapiens
gcauucaaaucaaagcuaa

SEQ ID NO: 77380 - RNA, 19 nt, Homo sapiens
uaacucaccuuccaacaau

SEQ ID NO: 77381 - RNA, 19 nt, Homo sapiens
caagauaaauggcagagau

SEQ ID NO: 77382 - RNA, 19 nt, Homo sapiens
ggaaaacugccuaauauua

SEQ ID NO: 77383 - RNA, 19 nt, Homo sapiens
aagcauagcuacuacagaa

SEQ ID NO: 77384 - RNA, 19 nt, Homo sapiens
cagaaacauuccaagauaa

SEQ ID NO: 77385 - RNA, 19 nt, Homo sapiens
gagcuuguauccaaauguu

SEQ ID NO: 77386 - RNA, 19 nt, Homo sapiens
gaagguaaacuaugaaucu

SEQ ID NO: 77387 - RNA, 19 nt, Homo sapiens
ugacaagccugagaaggua

SEQ ID NO: 77388 - RNA, 19 nt, Homo sapiens
gcauagcuacuacagaaua

SEQ ID NO: 77389 - RNA, 19 nt, Homo sapiens
uagaaugucuucagaaaca

SEQ ID NO: 77390 - RNA, 19 nt, Homo sapiens
ugaauuuacuggacagauu

SEQ ID NO: 77391 - RNA, 19 nt, Homo sapiens
gauuugaauucaucuguga

SEQ ID NO: 77392 - RNA, 19 nt, Homo sapiens
ucaaauaaguguuccaaac

SEQ ID NO: 77393 - RNA, 19 nt, Homo sapiens
gagaagguguguuggaaag

SEQ ID NO: 77394 - RNA, 19 nt, Homo sapiens
caacugacuugauccgaau

SEQ ID NO: 77395 - RNA, 19 nt, Homo sapiens
ccacuugaaaggagaaaua

SEQ ID NO: 77396 - RNA, 19 nt, Homo sapiens
cugagaagguaaacuauga

SEQ ID NO: 77397 - RNA, 19 nt, Homo sapiens
gcuaaaagccuaaauguga

SEQ ID NO: 77398 - RNA, 19 nt, Homo sapiens
cagaauaacucaccuucca

SEQ ID NO: 77399 - RNA, 19 nt, Homo sapiens
aaccaaauguucagaaguu

SEQ ID NO: 77400 - RNA, 19 nt, Homo sapiens
caacugaaggcaugucauu

SEQ ID NO: 77401 - RNA, 19 nt, Homo sapiens
cauagcuacuacagaauaa

SEQ ID NO: 77402 - RNA, 19 nt, Homo sapiens
agaguuaacagaaggaaua

SEQ ID NO: 77403 - RNA, 19 nt, Homo sapiens
ggagucacacuaauacuau

SEQ ID NO: 77404 - RNA, 19 nt, Homo sapiens
gccuaaaugugaaaugcua

SEQ ID NO: 77405 - RNA, 19 nt, Homo sapiens
gcuuguauccaaauguuua

SEQ ID NO: 77406 - RNA, 19 nt, Homo sapiens
gaauagaaugucuucagaa

SEQ ID NO: 77407 - RNA, 19 nt, Homo sapiens
gaacuugccacuugaaagg

SEQ ID NO: 77408 - RNA, 19 nt, Homo sapiens
caaaccaaauguucagaag

SEQ ID NO: 77409 - RNA, 19 nt, Homo sapiens
gaagguguguuggaaaguc

SEQ ID NO: 77410 - RNA, 19 nt, Homo sapiens
uaaggcauaauaaggguua

SEQ ID NO: 77411 - RNA, 19 nt, Homo sapiens
gaugauagagguacugaca

SEQ ID NO: 77412 - RNA, 19 nt, Homo sapiens
caaccuuguucuauggauu

SEQ ID NO: 77413 - RNA, 19 nt, Homo sapiens
aagcaaagccuucuguguu

SEQ ID NO: 77414 - RNA, 19 nt, Homo sapiens
acuagaagcucaacugaag

SEQ ID NO: 77415 - RNA, 19 nt, Homo sapiens
uaacagaaggaauagaaug

SEQ ID NO: 77416 - RNA, 19 nt, Homo sapiens
guuaacagaaggaauagaa

SEQ ID NO: 77417 - RNA, 19 nt, Homo sapiens
aaaggucugugguuugaga

SEQ ID NO: 77418 - RNA, 19 nt, Homo sapiens
cuaauccuacuccuacuua

SEQ ID NO: 77419 - RNA, 19 nt, Homo sapiens
caauggauuuaagcuauga

SEQ ID NO: 77420 - RNA, 19 nt, Homo sapiens
gagcugcagucucugucaa

SEQ ID NO: 77421 - RNA, 19 nt, Homo sapiens
ggagaagguguguuggaaa

SEQ ID NO: 77422 - RNA, 19 nt, Homo sapiens
ccgaauaagucaauauagg

SEQ ID NO: 77423 - RNA, 19 nt, Homo sapiens
gugaaaugcuaaugacaag

SEQ ID NO: 77424 - RNA, 19 nt, Homo sapiens
ugccuaauauuaugcugua

SEQ ID NO: 77425 - RNA, 19 nt, Homo sapiens
guacugcacggcaauugaa

SEQ ID NO: 77426 - RNA, 19 nt, Homo sapiens
gcaugucauugcaggauca

SEQ ID NO: 77427 - RNA, 19 nt, Homo sapiens
caauagaagaggaaaggaa

SEQ ID NO: 77428 - RNA, 19 nt, Homo sapiens
ggaggagucacacuaauac

SEQ ID NO: 77429 - RNA, 19 nt, Homo sapiens
cuaauauuaugcuguagug

SEQ ID NO: 77430 - RNA, 19 nt, Homo sapiens
uuccugaaauggucccuua

SEQ ID NO: 77431 - RNA, 19 nt, Homo sapiens
caacaauuccugaaauggu

SEQ ID NO: 77432 - RNA, 19 nt, Homo sapiens
guaggccucucggaucuga

SEQ ID NO: 77433 - RNA, 19 nt, Homo sapiens
agcaaagccuucuguguug

SEQ ID NO: 77434 - RNA, 19 nt, Homo sapiens
uaagcaugauggucucaga

SEQ ID NO: 77435 - RNA, 19 nt, Homo sapiens
ugacaacaacugacucuca

SEQ ID NO: 77436 - RNA, 19 nt, Homo sapiens
gguuuacgguuucagacuu

SEQ ID NO: 77437 - RNA, 19 nt, Homo sapiens
ggaacaggagucuagaugu

SEQ ID NO: 77438 - RNA, 19 nt, Homo sapiens
cugaggagcugcagucucu

SEQ ID NO: 77439 - RNA, 19 nt, Homo sapiens
ccagcugaaugcccuguug

SEQ ID NO: 77440 - RNA, 19 nt, Homo sapiens
uggaggagucacacuaaua

SEQ ID NO: 77441 - RNA, 19 nt, Homo sapiens
cagaaggaauagaaugucu

SEQ ID NO: 77442 - RNA, 19 nt, Homo sapiens
gagaacuugccacuugaaa

SEQ ID NO: 77443 - RNA, 19 nt, Homo sapiens
aagagaacuugccacuuga

SEQ ID NO: 77444 - RNA, 19 nt, Homo sapiens
cuacuacugccuuucaauu

SEQ ID NO: 77445 - RNA, 19 nt, Homo sapiens
ugggaaaacugccuaauau

SEQ ID NO: 77446 - RNA, 19 nt, Homo sapiens
gaaguugaaauggauuguu

SEQ ID NO: 77447 - RNA, 19 nt, Homo sapiens
cauugucuaucauugcauu

SEQ ID NO: 77448 - RNA, 19 nt, Homo sapiens
uggagaagguguguuggaa

SEQ ID NO: 77449 - RNA, 19 nt, Homo sapiens
agaaugacugcaagacuaa

SEQ ID NO: 77450 - RNA, 19 nt, Homo sapiens
gagaagguaaacuaugaau

SEQ ID NO: 77451 - RNA, 19 nt, Homo sapiens
acaauggauuuaagcuaug

SEQ ID NO: 77452 - RNA, 19 nt, Homo sapiens
gauccaagcacagaagugu

SEQ ID NO: 77453 - RNA, 19 nt, Homo sapiens
cgaauaagucaauauaggu

SEQ ID NO: 77454 - RNA, 19 nt, Homo sapiens
gcuaaugacaagccugaga

SEQ ID NO: 77455 - RNA, 19 nt, Homo sapiens
agccaaaggucugugguuu

SEQ ID NO: 77456 - RNA, 19 nt, Homo sapiens
aaauaaguguuccaaacca

SEQ ID NO: 77457 - RNA, 19 nt, Homo sapiens
auuauucacuccuucaaga

SEQ ID NO: 77458 - RNA, 19 nt, Homo sapiens
aauauagguuuacgguuuc

SEQ ID NO: 77459 - RNA, 19 nt, Homo sapiens
uaauccuacuccuacuuaa

SEQ ID NO: 77460 - RNA, 19 nt, Homo sapiens
gcuucaaucacugucauua

SEQ ID NO: 77461 - RNA, 19 nt, Homo sapiens
ugaaauggucccuuaacug

SEQ ID NO: 77462 - RNA, 19 nt, Homo sapiens
ugauagagguacugacaac

SEQ ID NO: 77463 - RNA, 19 nt, Homo sapiens
gaagcauagcuacuacaga

SEQ ID NO: 77464 - RNA, 19 nt, Homo sapiens
guauccaaauguuuaacug

SEQ ID NO: 77465 - RNA, 19 nt, Homo sapiens
gcaggaucauauuuucuaa

SEQ ID NO: 77466 - RNA, 19 nt, Homo sapiens
uuucagacuugaugagaau

SEQ ID NO: 77467 - RNA, 19 nt, Homo sapiens
ccaaauguucagaaguuga

SEQ ID NO: 77468 - RNA, 19 nt, Homo sapiens
gaaauucucuugcuaguua

SEQ ID NO: 77469 - RNA, 19 nt, Homo sapiens
gaagaagacugcaauauuc

SEQ ID NO: 77470 - RNA, 19 nt, Homo sapiens
ggagagaguugguuucuaa

SEQ ID NO: 77471 - RNA, 19 nt, Homo sapiens
gaucugguguaguauauuu

SEQ ID NO: 77472 - RNA, 19 nt, Homo sapiens
gcugauaccuucaauuugu

SEQ ID NO: 77473 - RNA, 19 nt, Homo sapiens
ggugaaaccuaaacauuug

SEQ ID NO: 77474 - RNA, 19 nt, Homo sapiens
gaaauacugagccuugaua

SEQ ID NO: 77475 - RNA, 19 nt, Homo sapiens
ugccaaaguugaagauuua

SEQ ID NO: 77476 - RNA, 19 nt, Homo sapiens
gagaguugguuucuaaaug

SEQ ID NO: 77477 - RNA, 19 nt, Homo sapiens
gcacuuauaccauacuauu

SEQ ID NO: 77478 - RNA, 19 nt, Homo sapiens
gaaaggaaagaaauacuga

SEQ ID NO: 77479 - RNA, 19 nt, Homo sapiens
ggaagcuacuacugccuua

SEQ ID NO: 77480 - RNA, 19 nt, Homo sapiens
aaccagaucuuaagaaguu

SEQ ID NO: 77481 - RNA, 19 nt, Homo sapiens
cuaaaugccuagccgagua

SEQ ID NO: 77482 - RNA, 19 nt, Homo sapiens
ggagaaugauaacacuuug

SEQ ID NO: 77483 - RNA, 19 nt, Homo sapiens
guaugcaagugcuuccuua

SEQ ID NO: 77484 - RNA, 19 nt, Homo sapiens
guaaauguacugcuucuga

SEQ ID NO: 77485 - RNA, 19 nt, Homo sapiens
ugaagaagacugcaauauu

SEQ ID NO: 77486 - RNA, 19 nt, Homo sapiens
aaacauuugucuugcauug

SEQ ID NO: 77487 - RNA, 19 nt, Homo sapiens
ugaguaugcucuuaaaugu

SEQ ID NO: 77488 - RNA, 19 nt, Homo sapiens
gaucuugcacugaaacuuu

SEQ ID NO: 77489 - RNA, 19 nt, Homo sapiens
ucucguagaucuuuagcua

SEQ ID NO: 77490 - RNA, 19 nt, Homo sapiens
gaaguugguuuggaucguu

SEQ ID NO: 77491 - RNA, 19 nt, Homo sapiens
gcacuuggcaggucaugaa

SEQ ID NO: 77492 - RNA, 19 nt, Homo sapiens
gacagguucuuggcucuua

SEQ ID NO: 77493 - RNA, 19 nt, Homo sapiens
uggaauaccuaccuucuau

SEQ ID NO: 77494 - RNA, 19 nt, Homo sapiens
caaaccagaucuuaagaag

SEQ ID NO: 77495 - RNA, 19 nt, Homo sapiens
gaaaucuguugaauuacug

SEQ ID NO: 77496 - RNA, 19 nt, Homo sapiens
gugcugauaccuucaauuu

SEQ ID NO: 77497 - RNA, 19 nt, Homo sapiens
cacaacagcuacuauagug

SEQ ID NO: 77498 - RNA, 19 nt, Homo sapiens
gagugaguaugcucuuaaa

SEQ ID NO: 77499 - RNA, 19 nt, Homo sapiens
gaucuggccuauuuucaua

SEQ ID NO: 77500 - RNA, 19 nt, Homo sapiens
gcauuggagucuguucuuu

SEQ ID NO: 77501 - RNA, 19 nt, Homo sapiens
guucuuggcucuuaugaag

SEQ ID NO: 77502 - RNA, 19 nt, Homo sapiens
gcaaaccagaucuuaagaa

SEQ ID NO: 77503 - RNA, 19 nt, Homo sapiens
gagaaaugccaaaguugaa

SEQ ID NO: 77504 - RNA, 19 nt, Homo sapiens
ccuugugccuucucaauuu

SEQ ID NO: 77505 - RNA, 19 nt, Homo sapiens
gagccuugauaaacuagaa

SEQ ID NO: 77506 - RNA, 19 nt, Homo sapiens
uaacuaguguagcuuaucu

SEQ ID NO: 77507 - RNA, 19 nt, Homo sapiens
gaucaagagugcaccuucu

SEQ ID NO: 77508 - RNA, 19 nt, Homo sapiens
gguagugccucuuaaacca

SEQ ID NO: 77509 - RNA, 19 nt, Homo sapiens
gaucuuaagaaguugguuu

SEQ ID NO: 77510 - RNA, 19 nt, Homo sapiens
acacugaguucuucuacug

SEQ ID NO: 77511 - RNA, 19 nt, Homo sapiens
caacugccgacucaucuuu

SEQ ID NO: 77512 - RNA, 19 nt, Homo sapiens
uagaauaguugaagaagac

SEQ ID NO: 77513 - RNA, 19 nt, Homo sapiens
uguccuggcugucaauauu

SEQ ID NO: 77514 - RNA, 19 nt, Homo sapiens
aaugaucagugucuauuug

SEQ ID NO: 77515 - RNA, 19 nt, Homo sapiens
auaccuaccuucuauuugu

SEQ ID NO: 77516 - RNA, 19 nt, Homo sapiens
gaugugauccggauuaguc

SEQ ID NO: 77517 - RNA, 19 nt, Homo sapiens
gaaaugccaaaguugaaga

SEQ ID NO: 77518 - RNA, 19 nt, Homo sapiens
agacauuggcacuuuauuu

SEQ ID NO: 77519 - RNA, 19 nt, Homo sapiens
auagguaguuuccugguuu

SEQ ID NO: 77520 - RNA, 19 nt, Homo sapiens
uuaagaaguugguuuggau

SEQ ID NO: 77521 - RNA, 19 nt, Homo sapiens
ugagaaaugccaaaguuga

SEQ ID NO: 77522 - RNA, 19 nt, Homo sapiens
aaacagugcaguaaguuga

SEQ ID NO: 77523 - RNA, 19 nt, Homo sapiens
caaguauugucaaacuaug

SEQ ID NO: 77524 - RNA, 19 nt, Homo sapiens
gaacgucuaccuggaacaa

SEQ ID NO: 77525 - RNA, 19 nt, Homo sapiens
uuacaggguuucaaagcaa

SEQ ID NO: 77526 - RNA, 19 nt, Homo sapiens
acacugugcuuuccaucuu

SEQ ID NO: 77527 - RNA, 19 nt, Homo sapiens
gcucuuaaaugucaaacac

SEQ ID NO: 77528 - RNA, 19 nt, Homo sapiens
gugaguaugcucuuaaaug

SEQ ID NO: 77529 - RNA, 19 nt, Homo sapiens
uuaagcagauuggaaguau

SEQ ID NO: 77530 - RNA, 19 nt, Homo sapiens
uagguaguuuccugguuua

SEQ ID NO: 77531 - RNA, 19 nt, Homo sapiens
aaagugaggacucuuguga

SEQ ID NO: 77532 - RNA, 19 nt, Homo sapiens
caugaugugauccggauua

SEQ ID NO: 77533 - RNA, 19 nt, Homo sapiens
aguaugcucuuaaauguca

SEQ ID NO: 77534 - RNA, 19 nt, Homo sapiens
gcagcucuccucccaguga

SEQ ID NO: 77535 - RNA, 19 nt, Homo sapiens
cgaguauucuucuccugaa

SEQ ID NO: 77536 - RNA, 19 nt, Homo sapiens
guacugcuucugacauaaa

SEQ ID NO: 77537 - RNA, 19 nt, Homo sapiens
gaagauuuaaggaguuuag

SEQ ID NO: 77538 - RNA, 19 nt, Homo sapiens
cuucagaugucuuuaagca

SEQ ID NO: 77539 - RNA, 19 nt, Homo sapiens
gcaauauuccauccacuca

SEQ ID NO: 77540 - RNA, 19 nt, Homo sapiens
cuagaauaguugaagaaga

SEQ ID NO: 77541 - RNA, 19 nt, Homo sapiens
ccaaguauugucaaacuau

SEQ ID NO: 77542 - RNA, 19 nt, Homo sapiens
uaaugacacugaguucuuc

SEQ ID NO: 77543 - RNA, 19 nt, Homo sapiens
uuugcuggcugcuagaaua

SEQ ID NO: 77544 - RNA, 19 nt, Homo sapiens
guugaagauuuaaggaguu

SEQ ID NO: 77545 - RNA, 19 nt, Homo sapiens
uagcagggacaguggauaa

SEQ ID NO: 77546 - RNA, 19 nt, Homo sapiens
ggaacaagaagagagauuc

SEQ ID NO: 77547 - RNA, 19 nt, Homo sapiens
auguugaucugguguagua

SEQ ID NO: 77548 - RNA, 19 nt, Homo sapiens
caaacacugugcuuuccau

SEQ ID NO: 77549 - RNA, 19 nt, Homo sapiens
cggagaaugauaacacuuu

SEQ ID NO: 77550 - RNA, 19 nt, Homo sapiens
gcccagaaccuccacaaca

SEQ ID NO: 77551 - RNA, 19 nt, Homo sapiens
gcuugcaacugccgacuca

SEQ ID NO: 77552 - RNA, 19 nt, Homo sapiens
ccggcacgaugaaggauuu

SEQ ID NO: 77553 - RNA, 19 nt, Homo sapiens
aauauuccauccacucaug

SEQ ID NO: 77554 - RNA, 19 nt, Homo sapiens
uguccaggauugagaaaug

SEQ ID NO: 77555 - RNA, 19 nt, Homo sapiens
gcuggcugcuagaauaguu

SEQ ID NO: 77556 - RNA, 19 nt, Homo sapiens
auugagaaaugccaaaguu

SEQ ID NO: 77557 - RNA, 19 nt, Homo sapiens
uuuagacauuggcacuuua

SEQ ID NO: 77558 - RNA, 19 nt, Homo sapiens
ccacaacagcuacuauagu

SEQ ID NO: 77559 - RNA, 19 nt, Homo sapiens
ggaaauucucuugcuaguu

SEQ ID NO: 77560 - RNA, 19 nt, Homo sapiens
gcaaaaccaucuguauuag

SEQ ID NO: 77561 - RNA, 19 nt, Homo sapiens
gaugugaugcagaucuuau

SEQ ID NO: 77562 - RNA, 19 nt, Homo sapiens
cacugugcuuuccaucuua

SEQ ID NO: 77563 - RNA, 19 nt, Homo sapiens
uggaaacuuugaaaucugu

SEQ ID NO: 77564 - RNA, 19 nt, Homo sapiens
augccaaaguugaagauuu

SEQ ID NO: 77565 - RNA, 19 nt, Homo sapiens
acauuugucuugcauugga

SEQ ID NO: 77566 - RNA, 19 nt, Homo sapiens
cuaaacauuugucuugcau

SEQ ID NO: 77567 - RNA, 19 nt, Homo sapiens
gaaagugaggacucuugug

SEQ ID NO: 77568 - RNA, 19 nt, Homo sapiens
gcugaugacuuucuuaaua

SEQ ID NO: 77569 - RNA, 19 nt, Homo sapiens
gaaaacagcugaugacuuu

SEQ ID NO: 77570 - RNA, 19 nt, Homo sapiens
caacuuaauuuccaccuua

SEQ ID NO: 77571 - RNA, 19 nt, Homo sapiens
ggaagcauaucaaacguuu

SEQ ID NO: 77572 - RNA, 19 nt, Homo sapiens
gaaggcacuugaacagaua

SEQ ID NO: 77573 - RNA, 19 nt, Homo sapiens
ucaaagaaauccaaacaug

SEQ ID NO: 77574 - RNA, 19 nt, Homo sapiens
gaaaggcuaugaagaugau

SEQ ID NO: 77575 - RNA, 19 nt, Homo sapiens
ggaauucuguucgguguuu

SEQ ID NO: 77576 - RNA, 19 nt, Homo sapiens
gaaaugacacucugcaaau

SEQ ID NO: 77577 - RNA, 19 nt, Homo sapiens
auacacaccuucccaaauu

SEQ ID NO: 77578 - RNA, 19 nt, Homo sapiens
gaacagauacuggaauaug

SEQ ID NO: 77579 - RNA, 19 nt, Homo sapiens
gcuaugaagaugaugauua

SEQ ID NO: 77580 - RNA, 19 nt, Homo sapiens
gaaucucucuaaccauuug

SEQ ID NO: 77581 - RNA, 19 nt, Homo sapiens
cugcugagcuugcacuuaa

SEQ ID NO: 77582 - RNA, 19 nt, Homo sapiens
caaagaaauccaaacauga

SEQ ID NO: 77583 - RNA, 19 nt, Homo sapiens
ggauaauaaugcucacuug

SEQ ID NO: 77584 - RNA, 19 nt, Homo sapiens
aaaugacacucugcaaaua

SEQ ID NO: 77585 - RNA, 19 nt, Homo sapiens
gaggaagaauggacugaug

SEQ ID NO: 77586 - RNA, 19 nt, Homo sapiens
gaggaaaggcuaugaagau

SEQ ID NO: 77587 - RNA, 19 nt, Homo sapiens
gauuacgucucaaagaaau

SEQ ID NO: 77588 - RNA, 19 nt, Homo sapiens
gagaaaagguuauuggaau

SEQ ID NO: 77589 - RNA, 19 nt, Homo sapiens
ggguacggcuuguauguau

SEQ ID NO: 77590 - RNA, 19 nt, Homo sapiens
gaagaggaaaggcuaugaa

SEQ ID NO: 77591 - RNA, 19 nt, Homo sapiens
ggaaaggcuaugaagauga

SEQ ID NO: 77592 - RNA, 19 nt, Homo sapiens
gagcuugcacuuaacguaa

SEQ ID NO: 77593 - RNA, 19 nt, Homo sapiens
acccagaucugaagaaguu

SEQ ID NO: 77594 - RNA, 19 nt, Homo sapiens
uugaacagauacuggaaua

SEQ ID NO: 77595 - RNA, 19 nt, Homo sapiens
gaaguaggaagcauaucaa

SEQ ID NO: 77596 - RNA, 19 nt, Homo sapiens
ucucaaugcuaacuaauca

SEQ ID NO: 77597 - RNA, 19 nt, Homo sapiens
gacccgcuaucccauauug

SEQ ID NO: 77598 - RNA, 19 nt, Homo sapiens
gauacuggaauaugaacua

SEQ ID NO: 77599 - RNA, 19 nt, Homo sapiens
gcaaugccaagaucuguug

SEQ ID NO: 77600 - RNA, 19 nt, Homo sapiens
guacggcuuguauguauuu

SEQ ID NO: 77601 - RNA, 19 nt, Homo sapiens
gggauacggucuguuccua

SEQ ID NO: 77602 - RNA, 19 nt, Homo sapiens
gcaacuuaauuuccaccuu

SEQ ID NO: 77603 - RNA, 19 nt, Homo sapiens
ggucacgauuccauaaugu

SEQ ID NO: 77604 - RNA, 19 nt, Homo sapiens
cuuaauaacucaguaaugg

SEQ ID NO: 77605 - RNA, 19 nt, Homo sapiens
gaauucuguucgguguuua

SEQ ID NO: 77606 - RNA, 19 nt, Homo sapiens
ugaaagagaacagaacuug

SEQ ID NO: 77607 - RNA, 19 nt, Homo sapiens
gggcuggaauuacuaugga

SEQ ID NO: 77608 - RNA, 19 nt, Homo sapiens
gacggaugcuuaccuuuua

SEQ ID NO: 77609 - RNA, 19 nt, Homo sapiens
agaaggcacuugaacagau

SEQ ID NO: 77610 - RNA, 19 nt, Homo sapiens
gaugauuacgucucaaaga

SEQ ID NO: 77611 - RNA, 19 nt, Homo sapiens
ggaauuacuauggaaaguu

SEQ ID NO: 77612 - RNA, 19 nt, Homo sapiens
aacagauacuggaauauga

SEQ ID NO: 77613 - RNA, 19 nt, Homo sapiens
gauacggucuguuccuagu

SEQ ID NO: 77614 - RNA, 19 nt, Homo sapiens
ccacaacaguagucagaag

SEQ ID NO: 77615 - RNA, 19 nt, Homo sapiens
cuaugaagaugaugauuac

SEQ ID NO: 77616 - RNA, 19 nt, Homo sapiens
gaaaagcaugagaaacuua

SEQ ID NO: 77617 - RNA, 19 nt, Homo sapiens
ggagaaggcacuugaacag

SEQ ID NO: 77618 - RNA, 19 nt, Homo sapiens
gaagaagaggaaaggcuau

SEQ ID NO: 77619 - RNA, 19 nt, Homo sapiens
caugagaaacuuaguaaag

SEQ ID NO: 77620 - RNA, 19 nt, Homo sapiens
gauaauaaugcucacuugu

SEQ ID NO: 77621 - RNA, 19 nt, Homo sapiens
cugcaaauacuaugagaaa

SEQ ID NO: 77622 - RNA, 19 nt, Homo sapiens
ugucacaguuacuagauau

SEQ ID NO: 77623 - RNA, 19 nt, Homo sapiens
cagcugaugacuuucuuaa

SEQ ID NO: 77624 - RNA, 19 nt, Homo sapiens
cuucuuauacagcaacuua

SEQ ID NO: 77625 - RNA, 19 nt, Homo sapiens
ggaauaugaacuacuucuu

SEQ ID NO: 77626 - RNA, 19 nt, Homo sapiens
gcaaaguagaugaauucaa

SEQ ID NO: 77627 - RNA, 19 nt, Homo sapiens
agaaaugacacucugcaaa

SEQ ID NO: 77628 - RNA, 19 nt, Homo sapiens
augauuacgucucaaagaa

SEQ ID NO: 77629 - RNA, 19 nt, Homo sapiens
cugaugacuuucuuaauag

SEQ ID NO: 77630 - RNA, 19 nt, Homo sapiens
gacaggagaaggcacuuga

SEQ ID NO: 77631 - RNA, 19 nt, Homo sapiens
ucucuaaccauuugaaguu

SEQ ID NO: 77632 - RNA, 19 nt, Homo sapiens
gaaccacccagaucugaag

SEQ ID NO: 77633 - RNA, 19 nt, Homo sapiens
guaggaagcauaucaaacg

SEQ ID NO: 77634 - RNA, 19 nt, Homo sapiens
cgaaugauccagucuuucu

SEQ ID NO: 77635 - RNA, 19 nt, Homo sapiens
gaagcauaucaaacguuua

SEQ ID NO: 77636 - RNA, 19 nt, Homo sapiens
ccaaacaugaggaggaaga

SEQ ID NO: 77637 - RNA, 19 nt, Homo sapiens
gcuaucccauauuggagaa

SEQ ID NO: 77638 - RNA, 19 nt, Homo sapiens
gagaaggcacuugaacaga

SEQ ID NO: 77639 - RNA, 19 nt, Homo sapiens
cggcuuguauguauuucaa

SEQ ID NO: 77640 - RNA, 19 nt, Homo sapiens
caagagaaguaggaagcau

SEQ ID NO: 77641 - RNA, 19 nt, Homo sapiens
gggcuuccucaucgacuua

SEQ ID NO: 77642 - RNA, 19 nt, Homo sapiens
guccucaguuuguuggaaa

SEQ ID NO: 77643 - RNA, 19 nt, Homo sapiens
gguacggcuuguauguauu

SEQ ID NO: 77644 - RNA, 19 nt, Homo sapiens
agaaguaggaagcauauca

SEQ ID NO: 77645 - RNA, 19 nt, Homo sapiens
gcuaacuaaucaagagaag

SEQ ID NO: 77646 - RNA, 19 nt, Homo sapiens
aaagaaauccaaacaugag

SEQ ID NO: 77647 - RNA, 19 nt, Homo sapiens
acuggaauaugaacuacuu

SEQ ID NO: 77648 - RNA, 19 nt, Homo sapiens
acucaguaauggaauauca

SEQ ID NO: 77649 - RNA, 19 nt, Homo sapiens
uaauguaccacaacaguag

SEQ ID NO: 77650 - RNA, 19 nt, Homo sapiens
gcaugagaaacuuaguaaa

SEQ ID NO: 77651 - RNA, 19 nt, Homo sapiens
uccgaaugauccagucuuu

SEQ ID NO: 77652 - RNA, 19 nt, Homo sapiens
aaagacccgcuaucccaua

SEQ ID NO: 77653 - RNA, 19 nt, Homo sapiens
uaucuaguccucaguuugu

SEQ ID NO: 77654 - RNA, 19 nt, Homo sapiens
aagagaaguaggaagcaua

SEQ ID NO: 77655 - RNA, 19 nt, Homo sapiens
aggaaaggcuaugaagaug

SEQ ID NO: 77656 - RNA, 19 nt, Homo sapiens
uuaacguaaucacgaagaa

SEQ ID NO: 77657 - RNA, 19 nt, Homo sapiens
agagucugaugcugaaaga

SEQ ID NO: 77658 - RNA, 19 nt, Homo sapiens
ugaacuacuucuuauacag

SEQ ID NO: 77659 - RNA, 19 nt, Homo sapiens
ccugcaaaguagaugaauu

SEQ ID NO: 77660 - RNA, 19 nt, Homo sapiens
gagaaacuuaguaaagaag

SEQ ID NO: 77661 - RNA, 19 nt, Homo sapiens
cauaauguaccacaacagu

SEQ ID NO: 77662 - RNA, 19 nt, Homo sapiens
ucuaaccauuugaaguuga

SEQ ID NO: 77663 - RNA, 19 nt, Homo sapiens
gaaugauccagucuuucuu

SEQ ID NO: 77664 - RNA, 19 nt, Homo sapiens
gcauaucaaacguuuaacu

SEQ ID NO: 77665 - RNA, 19 nt, Homo sapiens
gaaguuggagcgaugucau

SEQ ID NO: 77666 - RNA, 19 nt, Homo sapiens
aagcaugagaaacuuagua

SEQ ID NO: 77667 - RNA, 19 nt, Homo sapiens
cugcaaaguagaugaauuc

SEQ ID NO: 77668 - RNA, 19 nt, Homo sapiens
uaucaacacugcuauagua

SEQ ID NO: 77669 - RNA, 19 nt, Homo sapiens
gaacaaacguccuggugau

SEQ ID NO: 77670 - RNA, 19 nt, Homo sapiens
ggaugugggucgccucuua

SEQ ID NO: 77671 - RNA, 19 nt, Homo sapiens
gcacaagacucacccaucu

SEQ ID NO: 77672 - RNA, 19 nt, Homo sapiens
gcacagacuucuuacuuca

SEQ ID NO: 77673 - RNA, 19 nt, Homo sapiens
caaaacagcucucaaaaug

SEQ ID NO: 77674 - RNA, 19 nt, Homo sapiens
uagaugaacugacacauga

SEQ ID NO: 77675 - RNA, 19 nt, Homo sapiens
gagcagacaauccucaaua

SEQ ID NO: 77676 - RNA, 19 nt, Homo sapiens
ggaaguagguccuuugacu

SEQ ID NO: 77677 - RNA, 19 nt, Homo sapiens
ggaaaaggcugacaaaaca

SEQ ID NO: 77678 - RNA, 19 nt, Homo sapiens
uaaauccucuucccuaaau

SEQ ID NO: 77679 - RNA, 19 nt, Homo sapiens
gggcauagcucagacacaa

SEQ ID NO: 77680 - RNA, 19 nt, Homo sapiens
gagaacagcuggaaaauag

SEQ ID NO: 77681 - RNA, 19 nt, Homo sapiens
acaagcaacuuagcacaua

SEQ ID NO: 77682 - RNA, 19 nt, Homo sapiens
ggucgcauauuggcuguua

SEQ ID NO: 77683 - RNA, 19 nt, Homo sapiens
gcuuugaacuaacaauuga

SEQ ID NO: 77684 - RNA, 19 nt, Homo sapiens
ggacccagauaaagaacuu

SEQ ID NO: 77685 - RNA, 19 nt, Homo sapiens
gcaacaaguucaagaucug

SEQ ID NO: 77686 - RNA, 19 nt, Homo sapiens
gaagugaggcuuauuugca

SEQ ID NO: 77687 - RNA, 19 nt, Homo sapiens
gaauuuguucguccuuaua

SEQ ID NO: 77688 - RNA, 19 nt, Homo sapiens
cagacaauccucaauauga

SEQ ID NO: 77689 - RNA, 19 nt, Homo sapiens
acacaugaguuucuacaga

SEQ ID NO: 77690 - RNA, 19 nt, Homo sapiens
caacacgacccagacaaua

SEQ ID NO: 77691 - RNA, 19 nt, Homo sapiens
caagcaacuuagcacauaa

SEQ ID NO: 77692 - RNA, 19 nt, Homo sapiens
gaagcaugcagaagaauug

SEQ ID NO: 77693 - RNA, 19 nt, Homo sapiens
ccagagcucuucagacaca

SEQ ID NO: 77694 - RNA, 19 nt, Homo sapiens
gcauucaccuggcuugcaa

SEQ ID NO: 77695 - RNA, 19 nt, Homo sapiens
gagauaaagcugcgucuuc

SEQ ID NO: 77696 - RNA, 19 nt, Homo sapiens
gccaucagcuaaaguguca

SEQ ID NO: 77697 - RNA, 19 nt, Homo sapiens
uuacaggaguugaucauuc

SEQ ID NO: 77698 - RNA, 19 nt, Homo sapiens
ccacucagcccacugcauu

SEQ ID NO: 77699 - RNA, 19 nt, Homo sapiens
ucaagacacugugaauaug

SEQ ID NO: 77700 - RNA, 19 nt, Homo sapiens
ccaaccuucuuucaaacua

SEQ ID NO: 77701 - RNA, 19 nt, Homo sapiens
agaauuggcugcccagaag

SEQ ID NO: 77702 - RNA, 19 nt, Homo sapiens
gcgcgaagcaugcagaaga

SEQ ID NO: 77703 - RNA, 19 nt, Homo sapiens
caaccaacagccugcauuu

SEQ ID NO: 77704 - RNA, 19 nt, Homo sapiens
ccacugcauuugaauuugu

SEQ ID NO: 77705 - RNA, 19 nt, Homo sapiens
gaucauccagccaagauug

SEQ ID NO: 77706 - RNA, 19 nt, Homo sapiens
uaaccaguguggagauguu

SEQ ID NO: 77707 - RNA, 19 nt, Homo sapiens
gacuuuaggcuuugaacua

SEQ ID NO: 77708 - RNA, 19 nt, Homo sapiens
cuuaacgucucacaauuga

SEQ ID NO: 77709 - RNA, 19 nt, Homo sapiens
gcacucucauucccaacuu

SEQ ID NO: 77710 - RNA, 19 nt, Homo sapiens
gaagagucauccagcaacu

SEQ ID NO: 77711 - RNA, 19 nt, Homo sapiens
uuaaugagcaugucaacuu

SEQ ID NO: 77712 - RNA, 19 nt, Homo sapiens
ucccagagcucuucagaca

SEQ ID NO: 77713 - RNA, 19 nt, Homo sapiens
agacaauccucaauaugau

SEQ ID NO: 77714 - RNA, 19 nt, Homo sapiens
guaguaaagugcacucaac

SEQ ID NO: 77715 - RNA, 19 nt, Homo sapiens
uaguauacaugcaucgauu

SEQ ID NO: 77716 - RNA, 19 nt, Homo sapiens
accuauagcuugucuaguu

SEQ ID NO: 77717 - RNA, 19 nt, Homo sapiens
caucuaaucaucaucauca

SEQ ID NO: 77718 - RNA, 19 nt, Homo sapiens
gagccgagagcacaaagaa

SEQ ID NO: 77719 - RNA, 19 nt, Homo sapiens
gaagcagaauaguaagagu

SEQ ID NO: 77720 - RNA, 19 nt, Homo sapiens
cccagaagcagaauaguaa

SEQ ID NO: 77721 - RNA, 19 nt, Homo sapiens
acuaaauccucuucccuaa

SEQ ID NO: 77722 - RNA, 19 nt, Homo sapiens
ggaagccaaugugaaguca

SEQ ID NO: 77723 - RNA, 19 nt, Homo sapiens
gauaagcacaauucuguag

SEQ ID NO: 77724 - RNA, 19 nt, Homo sapiens
uaaugagcaugucaacuuc

SEQ ID NO: 77725 - RNA, 19 nt, Homo sapiens
gcagacaauccucaauaug

SEQ ID NO: 77726 - RNA, 19 nt, Homo sapiens
augcaucgauucuacauga

SEQ ID NO: 77727 - RNA, 19 nt, Homo sapiens
gaggaagaacaacaacaaa

SEQ ID NO: 77728 - RNA, 19 nt, Homo sapiens
gagagaggaagaacaacaa

SEQ ID NO: 77729 - RNA, 19 nt, Homo sapiens
gaggacaguguuacaaaga

SEQ ID NO: 77730 - RNA, 19 nt, Homo sapiens
agauaaagcugcgucuuca

SEQ ID NO: 77731 - RNA, 19 nt, Homo sapiens
gauagccauucuucaguca

SEQ ID NO: 77732 - RNA, 19 nt, Homo sapiens
agagucauccagcaacuua

SEQ ID NO: 77733 - RNA, 19 nt, Homo sapiens
gaggugcauuccggaagua

SEQ ID NO: 77734 - RNA, 19 nt, Homo sapiens
aacaaacggugguauuuca

SEQ ID NO: 77735 - RNA, 19 nt, Homo sapiens
ggagagaggaagaacaaca

SEQ ID NO: 77736 - RNA, 19 nt, Homo sapiens
gcccacugcauuugaauuu

SEQ ID NO: 77737 - RNA, 19 nt, Homo sapiens
acaagacucacccaucuaa

SEQ ID NO: 77738 - RNA, 19 nt, Homo sapiens
ccagcagccuuguuucuag

SEQ ID NO: 77739 - RNA, 19 nt, Homo sapiens
caacaaacggugguauuuc

SEQ ID NO: 77740 - RNA, 19 nt, Homo sapiens
ugaauuuguucguccuuau

SEQ ID NO: 77741 - RNA, 19 nt, Homo sapiens
uaucaagacacugugaaua

SEQ ID NO: 77742 - RNA, 19 nt, Homo sapiens
cagccaagauugccaagag

SEQ ID NO: 77743 - RNA, 19 nt, Homo sapiens
ugaagucacaauaugcaua

SEQ ID NO: 77744 - RNA, 19 nt, Homo sapiens
aaacgcauuuggaauugga

SEQ ID NO: 77745 - RNA, 19 nt, Homo sapiens
cacaugaguuucuacagau

SEQ ID NO: 77746 - RNA, 19 nt, Homo sapiens
uagcacagacuucuuacuu

SEQ ID NO: 77747 - RNA, 19 nt, Homo sapiens
cuagaagugaggcuuauuu

SEQ ID NO: 77748 - RNA, 19 nt, Homo sapiens
aaacucgugucccucauuc

SEQ ID NO: 77749 - RNA, 19 nt, Homo sapiens
aaacauaguagccagacaa

SEQ ID NO: 77750 - RNA, 19 nt, Homo sapiens
gcccauagaggguucagaa

SEQ ID NO: 77751 - RNA, 19 nt, Homo sapiens
gcuugcaagugguccaauu

SEQ ID NO: 77752 - RNA, 19 nt, Homo sapiens
gcaaccaacagccugcauu

SEQ ID NO: 77753 - RNA, 19 nt, Homo sapiens
caucgauucuacaugauuc

SEQ ID NO: 77754 - RNA, 19 nt, Homo sapiens
uagccauucuucagucauu

SEQ ID NO: 77755 - RNA, 19 nt, Homo sapiens
ggucaucggacuagugaga

SEQ ID NO: 77756 - RNA, 19 nt, Homo sapiens
acugugaccuuggaacuuu

SEQ ID NO: 77757 - RNA, 19 nt, Homo sapiens
ggacuuagcacagacuucu

SEQ ID NO: 77758 - RNA, 19 nt, Homo sapiens
cauaguagccagacaagca

SEQ ID NO: 77759 - RNA, 19 nt, Homo sapiens
guauuucacucgagaacag

SEQ ID NO: 77760 - RNA, 19 nt, Homo sapiens
acaacaaacggugguauuu

SEQ ID NO: 77761 - RNA, 19 nt, Homo sapiens
cucccaaccuucuuucaaa

SEQ ID NO: 77762 - RNA, 19 nt, Homo sapiens
augcgaggcugccaagaaa

SEQ ID NO: 77763 - RNA, 19 nt, Homo sapiens
acagacuucuuacuucaug

SEQ ID NO: 77764 - RNA, 19 nt, Homo sapiens
gggaagugccugcaaccuu

SEQ ID NO: 77765 - RNA, 19 nt, Homo sapiens
ucacacaagcacucucauu

SEQ ID NO: 77766 - RNA, 19 nt, Homo sapiens
cagcugauaagcacaauuc

SEQ ID NO: 77767 - RNA, 19 nt, Homo sapiens
ggaagaacaacaacaaacg

SEQ ID NO: 77768 - RNA, 19 nt, Homo sapiens
gccaguagcuuuauaauuu

SEQ ID NO: 77769 - RNA, 19 nt, Homo sapiens
cagauuggcugcugaaaua

SEQ ID NO: 77770 - RNA, 19 nt, Homo sapiens
cacaauaacuuaccuagua

SEQ ID NO: 77771 - RNA, 19 nt, Homo sapiens
gcacagacauccuauuuca

SEQ ID NO: 77772 - RNA, 19 nt, Homo sapiens
gggaagggcuuucuuggua

SEQ ID NO: 77773 - RNA, 19 nt, Homo sapiens
gcagggaccuucuauauca

SEQ ID NO: 77774 - RNA, 19 nt, Homo sapiens
gaacagcuauauucacaga

SEQ ID NO: 77775 - RNA, 19 nt, Homo sapiens
ggacagaacagcuauauuc

SEQ ID NO: 77776 - RNA, 19 nt, Homo sapiens
ggugaaauguacccaguua

SEQ ID NO: 77777 - RNA, 19 nt, Homo sapiens
gaugugaagugcauuuaaa

SEQ ID NO: 77778 - RNA, 19 nt, Homo sapiens
gaaauuacggauuccaaua

SEQ ID NO: 77779 - RNA, 19 nt, Homo sapiens
ggaagaggcugcaugucaa

SEQ ID NO: 77780 - RNA, 19 nt, Homo sapiens
ggaauggccucaacaucaa

SEQ ID NO: 77781 - RNA, 19 nt, Homo sapiens
ccucaagcauucauuauuu

SEQ ID NO: 77782 - RNA, 19 nt, Homo sapiens
guacaaaccaacagugaua

SEQ ID NO: 77783 - RNA, 19 nt, Homo sapiens
ugacaacuguuuacaagaa

SEQ ID NO: 77784 - RNA, 19 nt, Homo sapiens
gaaaauaccuaucgcaaau

SEQ ID NO: 77785 - RNA, 19 nt, Homo sapiens
uagaugagcuaacacauga

SEQ ID NO: 77786 - RNA, 19 nt, Homo sapiens
uuauauagcugcccaggua

SEQ ID NO: 77787 - RNA, 19 nt, Homo sapiens
ccauacaucugauaauuug

SEQ ID NO: 77788 - RNA, 19 nt, Homo sapiens
agacacagcucuucugaug

SEQ ID NO: 77789 - RNA, 19 nt, Homo sapiens
ggaagggcuuucuugguaa

SEQ ID NO: 77790 - RNA, 19 nt, Homo sapiens
acacugcgauuguuuauau

SEQ ID NO: 77791 - RNA, 19 nt, Homo sapiens
gaaaugcuauguauucacu

SEQ ID NO: 77792 - RNA, 19 nt, Homo sapiens
guauauuucuguugaggua

SEQ ID NO: 77793 - RNA, 19 nt, Homo sapiens
ggauuacugugauuugaaa

SEQ ID NO: 77794 - RNA, 19 nt, Homo sapiens
ccuaugcucucaauucuuu

SEQ ID NO: 77795 - RNA, 19 nt, Homo sapiens
guaaauguagucuuccuua

SEQ ID NO: 77796 - RNA, 19 nt, Homo sapiens
gaaauguacccaguuagua

SEQ ID NO: 77797 - RNA, 19 nt, Homo sapiens
gcacaucucaguauauuuc

SEQ ID NO: 77798 - RNA, 19 nt, Homo sapiens
ucaggaagcucuguaagaa

SEQ ID NO: 77799 - RNA, 19 nt, Homo sapiens
uaacuuaccuaguagagau

SEQ ID NO: 77800 - RNA, 19 nt, Homo sapiens
acacaugaguuucuacaaa

SEQ ID NO: 77801 - RNA, 19 nt, Homo sapiens
ucacagaccugacaaaauu

SEQ ID NO: 77802 - RNA, 19 nt, Homo sapiens
ucucucagcuuacaauaaa

SEQ ID NO: 77803 - RNA, 19 nt, Homo sapiens
gcagagaccauaaggagaa

SEQ ID NO: 77804 - RNA, 19 nt, Homo sapiens
cauucaagcccacauauua

SEQ ID NO: 77805 - RNA, 19 nt, Homo sapiens
acacagcucuucugaugaa

SEQ ID NO: 77806 - RNA, 19 nt, Homo sapiens
ucacugaaauuacggauuc

SEQ ID NO: 77807 - RNA, 19 nt, Homo sapiens
gccaguaccucuaaauuca

SEQ ID NO: 77808 - RNA, 19 nt, Homo sapiens
guaauauggcucuuguuua

SEQ ID NO: 77809 - RNA, 19 nt, Homo sapiens
guagagauuuagugaguug

SEQ ID NO: 77810 - RNA, 19 nt, Homo sapiens
gcaccauucuuucaccaaa

SEQ ID NO: 77811 - RNA, 19 nt, Homo sapiens
ggagaucccuguaucaacu

SEQ ID NO: 77812 - RNA, 19 nt, Homo sapiens
gcacaugcuugucuucauc

SEQ ID NO: 77813 - RNA, 19 nt, Homo sapiens
cagaacagcuauauucaca

SEQ ID NO: 77814 - RNA, 19 nt, Homo sapiens
caacaggaaugccaaguac

SEQ ID NO: 77815 - RNA, 19 nt, Homo sapiens
gggcuuucuugguaauuua

SEQ ID NO: 77816 - RNA, 19 nt, Homo sapiens
guacauaauccaaggacua

SEQ ID NO: 77817 - RNA, 19 nt, Homo sapiens
ugcaacagauggucauaua

SEQ ID NO: 77818 - RNA, 19 nt, Homo sapiens
gauguaagggaucauuaua

SEQ ID NO: 77819 - RNA, 19 nt, Homo sapiens
ggaaagcauuggugggaau

SEQ ID NO: 77820 - RNA, 19 nt, Homo sapiens
ggacuaguauagaauuaag

SEQ ID NO: 77821 - RNA, 19 nt, Homo sapiens
uguaagugcugcuuuauuc

SEQ ID NO: 77822 - RNA, 19 nt, Homo sapiens
gcaacaggaaugccaagua

SEQ ID NO: 77823 - RNA, 19 nt, Homo sapiens
caacagugauagcaugugu

SEQ ID NO: 77824 - RNA, 19 nt, Homo sapiens
gaacugguuauacuugaaa

SEQ ID NO: 77825 - RNA, 19 nt, Homo sapiens
uaacuuuguugcucuguau

SEQ ID NO: 77826 - RNA, 19 nt, Homo sapiens
uugcauaacuucaguaauc

SEQ ID NO: 77827 - RNA, 19 nt, Homo sapiens
gauucgaccucuuguugaa

SEQ ID NO: 77828 - RNA, 19 nt, Homo sapiens
ucagguaaauguagucuuc

SEQ ID NO: 77829 - RNA, 19 nt, Homo sapiens
gaagcguguuuguguguga

SEQ ID NO: 77830 - RNA, 19 nt, Homo sapiens
gagauuuagugaguuguuu

SEQ ID NO: 77831 - RNA, 19 nt, Homo sapiens
cucaaugucucucagcuua

SEQ ID NO: 77832 - RNA, 19 nt, Homo sapiens
ugaaauagccccuaacuuu

SEQ ID NO: 77833 - RNA, 19 nt, Homo sapiens
ggagcugcuuguaaguaua

SEQ ID NO: 77834 - RNA, 19 nt, Homo sapiens
cagcagcgguggcaguaaa

SEQ ID NO: 77835 - RNA, 19 nt, Homo sapiens
ccucuaaauucaggaaaua

SEQ ID NO: 77836 - RNA, 19 nt, Homo sapiens
aaaaguagauggacaggua

SEQ ID NO: 77837 - RNA, 19 nt, Homo sapiens
gaaaccauaaugcuacaaa

SEQ ID NO: 77838 - RNA, 19 nt, Homo sapiens
aauaucgucuacugcauua

SEQ ID NO: 77839 - RNA, 19 nt, Homo sapiens
uaaguauguugcaguugua

SEQ ID NO: 77840 - RNA, 19 nt, Homo sapiens
uuagugaguuguuuccuuu

SEQ ID NO: 77841 - RNA, 19 nt, Homo sapiens
gauuggagcugcuuguaag

SEQ ID NO: 77842 - RNA, 19 nt, Homo sapiens
gccagcagcaguucuguua

SEQ ID NO: 77843 - RNA, 19 nt, Homo sapiens
ucacuggugugccuacaaa

SEQ ID NO: 77844 - RNA, 19 nt, Homo sapiens
gaaacuggagggcuaauca

SEQ ID NO: 77845 - RNA, 19 nt, Homo sapiens
gcuaacacaugaguuucua

SEQ ID NO: 77846 - RNA, 19 nt, Homo sapiens
uaaaugugaugcuuaccuu

SEQ ID NO: 77847 - RNA, 19 nt, Homo sapiens
gaacauguuaucaaaguag

SEQ ID NO: 77848 - RNA, 19 nt, Homo sapiens
gaagggcuuucuugguaau

SEQ ID NO: 77849 - RNA, 19 nt, Homo sapiens
gguaaaguuugcacaguca

SEQ ID NO: 77850 - RNA, 19 nt, Homo sapiens
acacagugccgacggaaua

SEQ ID NO: 77851 - RNA, 19 nt, Homo sapiens
ccaauaccacccacugaua

SEQ ID NO: 77852 - RNA, 19 nt, Homo sapiens
ucuguuacuucucccauua

SEQ ID NO: 77853 - RNA, 19 nt, Homo sapiens
gacaacuguuuacaagaaa

SEQ ID NO: 77854 - RNA, 19 nt, Homo sapiens
caauaccacccacugauaa

SEQ ID NO: 77855 - RNA, 19 nt, Homo sapiens
cagcagggaccuucuauau

SEQ ID NO: 77856 - RNA, 19 nt, Homo sapiens
ugaagaagauucgaaacug

SEQ ID NO: 77857 - RNA, 19 nt, Homo sapiens
caacagauggucauauaca

SEQ ID NO: 77858 - RNA, 19 nt, Homo sapiens
ugccacugcuucaauauuu

SEQ ID NO: 77859 - RNA, 19 nt, Homo sapiens
caucaagacucagcaagga

SEQ ID NO: 77860 - RNA, 19 nt, Homo sapiens
caucuuugguccagaauuc

SEQ ID NO: 77861 - RNA, 19 nt, Homo sapiens
gcuaguguauauuguuaug

SEQ ID NO: 77862 - RNA, 19 nt, Homo sapiens
guacuuaggagccucuuug

SEQ ID NO: 77863 - RNA, 19 nt, Homo sapiens
gauacgugcacaauuguaa

SEQ ID NO: 77864 - RNA, 19 nt, Homo sapiens
acugauacgugcacaauug

SEQ ID NO: 77865 - RNA, 19 nt, Homo sapiens
ccaguaauauggcucuugu

SEQ ID NO: 77866 - RNA, 19 nt, Homo sapiens
gagcugcuuguaaguauaa

SEQ ID NO: 77867 - RNA, 19 nt, Homo sapiens
gcuuuauucuucauucuga

SEQ ID NO: 77868 - RNA, 19 nt, Homo sapiens
gccaguagcuuuauaauuu

SEQ ID NO: 77869 - RNA, 19 nt, Homo sapiens
cagauuggcugcugaaaua

SEQ ID NO: 77870 - RNA, 19 nt, Homo sapiens
cacaauaacuuaccuagua

SEQ ID NO: 77871 - RNA, 19 nt, Homo sapiens
gcacagacauccuauuuca

SEQ ID NO: 77872 - RNA, 19 nt, Homo sapiens
gggaagggcuuucuuggua

SEQ ID NO: 77873 - RNA, 19 nt, Homo sapiens
gcagggaccuucuauauca

SEQ ID NO: 77874 - RNA, 19 nt, Homo sapiens
gaacagcuauauucacaga

SEQ ID NO: 77875 - RNA, 19 nt, Homo sapiens
ggacagaacagcuauauuc

SEQ ID NO: 77876 - RNA, 19 nt, Homo sapiens
ggugaaauguacccaguua

SEQ ID NO: 77877 - RNA, 19 nt, Homo sapiens
gaugugaagugcauuuaaa

SEQ ID NO: 77878 - RNA, 19 nt, Homo sapiens
gaaauuacggauuccaaua

SEQ ID NO: 77879 - RNA, 19 nt, Homo sapiens
ggaagaggcugcaugucaa

SEQ ID NO: 77880 - RNA, 19 nt, Homo sapiens
ggaauggccucaacaucaa

SEQ ID NO: 77881 - RNA, 19 nt, Homo sapiens
ccucaagcauucauuauuu

SEQ ID NO: 77882 - RNA, 19 nt, Homo sapiens
guacaaaccaacagugaua

SEQ ID NO: 77883 - RNA, 19 nt, Homo sapiens
ugacaacuguuuacaagaa

SEQ ID NO: 77884 - RNA, 19 nt, Homo sapiens
gaaaauaccuaucgcaaau

SEQ ID NO: 77885 - RNA, 19 nt, Homo sapiens
uagaugagcuaacacauga

SEQ ID NO: 77886 - RNA, 19 nt, Homo sapiens
uuauauagcugcccaggua

SEQ ID NO: 77887 - RNA, 19 nt, Homo sapiens
ccauacaucugauaauuug

SEQ ID NO: 77888 - RNA, 19 nt, Homo sapiens
agacacagcucuucugaug

SEQ ID NO: 77889 - RNA, 19 nt, Homo sapiens
ggaagggcuuucuugguaa

SEQ ID NO: 77890 - RNA, 19 nt, Homo sapiens
acacugcgauuguuuauau

SEQ ID NO: 77891 - RNA, 19 nt, Homo sapiens
gaaaugcuauguauucacu

SEQ ID NO: 77892 - RNA, 19 nt, Homo sapiens
guauauuucuguugaggua

SEQ ID NO: 77893 - RNA, 19 nt, Homo sapiens
ggauuacugugauuugaaa

SEQ ID NO: 77894 - RNA, 19 nt, Homo sapiens
ccuaugcucucaauucuuu

SEQ ID NO: 77895 - RNA, 19 nt, Homo sapiens
guaaauguagucuuccuua

SEQ ID NO: 77896 - RNA, 19 nt, Homo sapiens
gaaauguacccaguuagua

SEQ ID NO: 77897 - RNA, 19 nt, Homo sapiens
gcacaucucaguauauuuc

SEQ ID NO: 77898 - RNA, 19 nt, Homo sapiens
ucaggaagcucuguaagaa

SEQ ID NO: 77899 - RNA, 19 nt, Homo sapiens
uaacuuaccuaguagagau

SEQ ID NO: 77900 - RNA, 19 nt, Homo sapiens
acacaugaguuucuacaaa

SEQ ID NO: 77901 - RNA, 19 nt, Homo sapiens
ucacagaccugacaaaauu

SEQ ID NO: 77902 - RNA, 19 nt, Homo sapiens
ucucucagcuuacaauaaa

SEQ ID NO: 77903 - RNA, 19 nt, Homo sapiens
gcagagaccauaaggagaa

SEQ ID NO: 77904 - RNA, 19 nt, Homo sapiens
cauucaagcccacauauua

SEQ ID NO: 77905 - RNA, 19 nt, Homo sapiens
acacagcucuucugaugaa

SEQ ID NO: 77906 - RNA, 19 nt, Homo sapiens
ucacugaaauuacggauuc

SEQ ID NO: 77907 - RNA, 19 nt, Homo sapiens
gccaguaccucuaaauuca

SEQ ID NO: 77908 - RNA, 19 nt, Homo sapiens
guaauauggcucuuguuua

SEQ ID NO: 77909 - RNA, 19 nt, Homo sapiens
guagagauuuagugaguug

SEQ ID NO: 77910 - RNA, 19 nt, Homo sapiens
gcaccauucuuucaccaaa

SEQ ID NO: 77911 - RNA, 19 nt, Homo sapiens
ucagguaguucaucuaguu

SEQ ID NO: 77912 - RNA, 19 nt, Homo sapiens
ggagaucccuguaucaacu

SEQ ID NO: 77913 - RNA, 19 nt, Homo sapiens
gcacaugcuugucuucauc

SEQ ID NO: 77914 - RNA, 19 nt, Homo sapiens
cagaacagcuauauucaca

SEQ ID NO: 77915 - RNA, 19 nt, Homo sapiens
caacaggaaugccaaguac

SEQ ID NO: 77916 - RNA, 19 nt, Homo sapiens
gggcuuucuugguaauuua

SEQ ID NO: 77917 - RNA, 19 nt, Homo sapiens
guacauaauccaaggacua

SEQ ID NO: 77918 - RNA, 19 nt, Homo sapiens
ugcaacagauggucauaua

SEQ ID NO: 77919 - RNA, 19 nt, Homo sapiens
gauguaagggaucauuaua

SEQ ID NO: 77920 - RNA, 19 nt, Homo sapiens
ggaaagcauuggugggaau

SEQ ID NO: 77921 - RNA, 19 nt, Homo sapiens
ggacuaguauagaauuaag

SEQ ID NO: 77922 - RNA, 19 nt, Homo sapiens
uguaagugcugcuuuauuc

SEQ ID NO: 77923 - RNA, 19 nt, Homo sapiens
gcaacaggaaugccaagua

SEQ ID NO: 77924 - RNA, 19 nt, Homo sapiens
caacagugauagcaugugu

SEQ ID NO: 77925 - RNA, 19 nt, Homo sapiens
gaacugguuauacuugaaa

SEQ ID NO: 77926 - RNA, 19 nt, Homo sapiens
uaacuuuguugcucuguau

SEQ ID NO: 77927 - RNA, 19 nt, Homo sapiens
uugcauaacuucaguaauc

SEQ ID NO: 77928 - RNA, 19 nt, Homo sapiens
gauucgaccucuuguugaa

SEQ ID NO: 77929 - RNA, 19 nt, Homo sapiens
ucagguaaauguagucuuc

SEQ ID NO: 77930 - RNA, 19 nt, Homo sapiens
gaagcguguuuguguguga

SEQ ID NO: 77931 - RNA, 19 nt, Homo sapiens
gagauuuagugaguuguuu

SEQ ID NO: 77932 - RNA, 19 nt, Homo sapiens
cucaaugucucucagcuua

SEQ ID NO: 77933 - RNA, 19 nt, Homo sapiens
ugaaauagccccuaacuuu

SEQ ID NO: 77934 - RNA, 19 nt, Homo sapiens
ggagcugcuuguaaguaua

SEQ ID NO: 77935 - RNA, 19 nt, Homo sapiens
cagcagcgguggcaguaaa

SEQ ID NO: 77936 - RNA, 19 nt, Homo sapiens
ccucuaaauucaggaaaua

SEQ ID NO: 77937 - RNA, 19 nt, Homo sapiens
aaaaguagauggacaggua

SEQ ID NO: 77938 - RNA, 19 nt, Homo sapiens
gaaaccauaaugcuacaaa

SEQ ID NO: 77939 - RNA, 19 nt, Homo sapiens
aauaucgucuacugcauua

SEQ ID NO: 77940 - RNA, 19 nt, Homo sapiens
uaaguauguugcaguugua

SEQ ID NO: 77941 - RNA, 19 nt, Homo sapiens
uuagugaguuguuuccuuu

SEQ ID NO: 77942 - RNA, 19 nt, Homo sapiens
gauuggagcugcuuguaag

SEQ ID NO: 77943 - RNA, 19 nt, Homo sapiens
gccagcagcaguucuguua

SEQ ID NO: 77944 - RNA, 19 nt, Homo sapiens
ucacuggugugccuacaaa

SEQ ID NO: 77945 - RNA, 19 nt, Homo sapiens
gaaacuggagggcuaauca

SEQ ID NO: 77946 - RNA, 19 nt, Homo sapiens
gcuaacacaugaguuucua

SEQ ID NO: 77947 - RNA, 19 nt, Homo sapiens
uaaaugugaugcuuaccuu

SEQ ID NO: 77948 - RNA, 19 nt, Homo sapiens
gaacauguuaucaaaguag

SEQ ID NO: 77949 - RNA, 19 nt, Homo sapiens
gaagggcuuucuugguaau

SEQ ID NO: 77950 - RNA, 19 nt, Homo sapiens
gguaaaguuugcacaguca

SEQ ID NO: 77951 - RNA, 19 nt, Homo sapiens
acacagugccgacggaaua

SEQ ID NO: 77952 - RNA, 19 nt, Homo sapiens
ccaauaccacccacugaua

SEQ ID NO: 77953 - RNA, 19 nt, Homo sapiens
ucuguuacuucucccauua

SEQ ID NO: 77954 - RNA, 19 nt, Homo sapiens
gacaacuguuuacaagaaa

SEQ ID NO: 77955 - RNA, 19 nt, Homo sapiens
caauaccacccacugauaa

SEQ ID NO: 77956 - RNA, 19 nt, Homo sapiens
cagcagggaccuucuauau

SEQ ID NO: 77957 - RNA, 19 nt, Homo sapiens
ugaagaagauucgaaacug

SEQ ID NO: 77958 - RNA, 19 nt, Homo sapiens
caacagauggucauauaca

SEQ ID NO: 77959 - RNA, 19 nt, Homo sapiens
ugccacugcuucaauauuu

SEQ ID NO: 77960 - RNA, 19 nt, Homo sapiens
caucaagacucagcaagga

SEQ ID NO: 77961 - RNA, 19 nt, Homo sapiens
caucuuugguccagaauuc

SEQ ID NO: 77962 - RNA, 19 nt, Homo sapiens
gcuaguguauauuguuaug

SEQ ID NO: 77963 - RNA, 19 nt, Homo sapiens
guacuuaggagccucuuug

SEQ ID NO: 77964 - RNA, 19 nt, Homo sapiens
gauacgugcacaauuguaa

SEQ ID NO: 77965 - RNA, 19 nt, Homo sapiens
acugauacgugcacaauug

SEQ ID NO: 77966 - RNA, 19 nt, Homo sapiens
ccaguaauauggcucuugu

SEQ ID NO: 77967 - RNA, 19 nt, Homo sapiens
gagcugcuuguaaguauaa

SEQ ID NO: 77968 - RNA, 19 nt, Homo sapiens
gaagagaaguuuaccuuua

SEQ ID NO: 77969 - RNA, 19 nt, Homo sapiens
gaacaucucuucguacuaa

SEQ ID NO: 77970 - RNA, 19 nt, Homo sapiens
gaagugaguugugcaauaa

SEQ ID NO: 77971 - RNA, 19 nt, Homo sapiens
caaagucucuagcgucaua

SEQ ID NO: 77972 - RNA, 19 nt, Homo sapiens
ugagagagcugcaacugua

SEQ ID NO: 77973 - RNA, 19 nt, Homo sapiens
ggacguauguuaaauuauc

SEQ ID NO: 77974 - RNA, 19 nt, Homo sapiens
gauuacagcuguggaauuu

SEQ ID NO: 77975 - RNA, 19 nt, Homo sapiens
cccaacagcuuccuuaaua

SEQ ID NO: 77976 - RNA, 19 nt, Homo sapiens
gcugaugcauugcucauua

SEQ ID NO: 77977 - RNA, 19 nt, Homo sapiens
gaacacaggugagccaaug

SEQ ID NO: 77978 - RNA, 19 nt, Homo sapiens
gaaagucuguggcgauuca

SEQ ID NO: 77979 - RNA, 19 nt, Homo sapiens
gaaguaggcguaugggaua

SEQ ID NO: 77980 - RNA, 19 nt, Homo sapiens
gggaaacacuuauagaugu

SEQ ID NO: 77981 - RNA, 19 nt, Homo sapiens
ugaagugaguugugcaaua

SEQ ID NO: 77982 - RNA, 19 nt, Homo sapiens
caaacuacccuauuguuaa

SEQ ID NO: 77983 - RNA, 19 nt, Homo sapiens
guggacguauguuaaauua

SEQ ID NO: 77984 - RNA, 19 nt, Homo sapiens
aaacauaagcccaguguaa

SEQ ID NO: 77985 - RNA, 19 nt, Homo sapiens
gaagaggagucaacuagag

SEQ ID NO: 77986 - RNA, 19 nt, Homo sapiens
ggacagggaaacacuuaua

SEQ ID NO: 77987 - RNA, 19 nt, Homo sapiens
gaaagcaucccuguuggua

SEQ ID NO: 77988 - RNA, 19 nt, Homo sapiens
guuauugggugaaauuuga

SEQ ID NO: 77989 - RNA, 19 nt, Homo sapiens
ggguagcccugaauucuuu

SEQ ID NO: 77990 - RNA, 19 nt, Homo sapiens
ggauaacuauuguguaaag

SEQ ID NO: 77991 - RNA, 19 nt, Homo sapiens
cagaagcccugauuaaaca

SEQ ID NO: 77992 - RNA, 19 nt, Homo sapiens
aaggugaaguuguguguua

SEQ ID NO: 77993 - RNA, 19 nt, Homo sapiens
aagcaucccuguugguaua

SEQ ID NO: 77994 - RNA, 19 nt, Homo sapiens
ugggauaacuauuguguaa

SEQ ID NO: 77995 - RNA, 19 nt, Homo sapiens
ccaaacuacccuauuguua

SEQ ID NO: 77996 - RNA, 19 nt, Homo sapiens
gccagaacaucucuucgua

SEQ ID NO: 77997 - RNA, 19 nt, Homo sapiens
uggaaugucuucucugaaa

SEQ ID NO: 77998 - RNA, 19 nt, Homo sapiens
gcuggaaugucuucucuga

SEQ ID NO: 77999 - RNA, 19 nt, Homo sapiens
gcaagaacaggcagaggua

SEQ ID NO: 78000 - RNA, 19 nt, Homo sapiens
ugaaacugauacaagcuua

SEQ ID NO: 78001 - RNA, 19 nt, Homo sapiens
aaagcaagaugaaccuauu

SEQ ID NO: 78002 - RNA, 19 nt, Homo sapiens
ggagacaucaaacuuacua

SEQ ID NO: 78003 - RNA, 19 nt, Homo sapiens
uauccaaacuacccuauug

SEQ ID NO: 78004 - RNA, 19 nt, Homo sapiens
ucugaaagguugaauugaa

SEQ ID NO: 78005 - RNA, 19 nt, Homo sapiens
gcacugugauugccaccaa

SEQ ID NO: 78006 - RNA, 19 nt, Homo sapiens
gagaagagaaguuuaccuu

SEQ ID NO: 78007 - RNA, 19 nt, Homo sapiens
cgauucagauaaaggauuu

SEQ ID NO: 78008 - RNA, 19 nt, Homo sapiens
ggaaacacuuauagaugug

SEQ ID NO: 78009 - RNA, 19 nt, Homo sapiens
gcaguggccugaagugagu

SEQ ID NO: 78010 - RNA, 19 nt, Homo sapiens
caacagcccaggaugauau

SEQ ID NO: 78011 - RNA, 19 nt, Homo sapiens
uaaaugcauuggaucaguu

SEQ ID NO: 78012 - RNA, 19 nt, Homo sapiens
ugacuaagggccacgguua

SEQ ID NO: 78013 - RNA, 19 nt, Homo sapiens
cuucugaacuuaaggcaaa

SEQ ID NO: 78014 - RNA, 19 nt, Homo sapiens
ugaaauggcuuugcuaaaa

SEQ ID NO: 78015 - RNA, 19 nt, Homo sapiens
uguccaagcuucaaauaau

SEQ ID NO: 78016 - RNA, 19 nt, Homo sapiens
aauugaagcuuccucugua

SEQ ID NO: 78017 - RNA, 19 nt, Homo sapiens
gaucaaaggaccaaauaag

SEQ ID NO: 78018 - RNA, 19 nt, Homo sapiens
ggacaugcaggacuuguau

SEQ ID NO: 78019 - RNA, 19 nt, Homo sapiens
gcuggagacaucaaacuua

SEQ ID NO: 78020 - RNA, 19 nt, Homo sapiens
uggaagguguggugacuaa

SEQ ID NO: 78021 - RNA, 19 nt, Homo sapiens
augcaggacuuguauauga

SEQ ID NO: 78022 - RNA, 19 nt, Homo sapiens
gggugaaauuugagaugua

SEQ ID NO: 78023 - RNA, 19 nt, Homo sapiens
guccaagcuucaaauaauu

SEQ ID NO: 78024 - RNA, 19 nt, Homo sapiens
gaauugaagcuuccucugu

SEQ ID NO: 78025 - RNA, 19 nt, Homo sapiens
gcagaagcccugauuaaac

SEQ ID NO: 78026 - RNA, 19 nt, Homo sapiens
uaacgugucauuagaguau

SEQ ID NO: 78027 - RNA, 19 nt, Homo sapiens
gaaauggcuuugcuaaaau

SEQ ID NO: 78028 - RNA, 19 nt, Homo sapiens
uggcaucuguugaaauuug

SEQ ID NO: 78029 - RNA, 19 nt, Homo sapiens
agagaacacuggcaucugu

SEQ ID NO: 78030 - RNA, 19 nt, Homo sapiens
cgugaaagcugaaagaaaa

SEQ ID NO: 78031 - RNA, 19 nt, Homo sapiens
gagcacggcauccugauau

SEQ ID NO: 78032 - RNA, 19 nt, Homo sapiens
guaaaugcauuggaucagu

SEQ ID NO: 78033 - RNA, 19 nt, Homo sapiens
aaacuacccuauuguuaag

SEQ ID NO: 78034 - RNA, 19 nt, Homo sapiens
ccaugaagaugcucguuuc

SEQ ID NO: 78035 - RNA, 19 nt, Homo sapiens
cuugaagacugcaaaguga

SEQ ID NO: 78036 - RNA, 19 nt, Homo sapiens
gagcuggaaugucuucucu

SEQ ID NO: 78037 - RNA, 19 nt, Homo sapiens
ugaacuugcagaugucuua

SEQ ID NO: 78038 - RNA, 19 nt, Homo sapiens
gaaacaggcggaucucuac

SEQ ID NO: 78039 - RNA, 19 nt, Homo sapiens
ugauauaacuggugauggu

SEQ ID NO: 78040 - RNA, 19 nt, Homo sapiens
ucagauaaaggauuuguug

SEQ ID NO: 78041 - RNA, 19 nt, Homo sapiens
gaaacugauacaagcuuaa

SEQ ID NO: 78042 - RNA, 19 nt, Homo sapiens
caaaguaagcagagagaug

SEQ ID NO: 78043 - RNA, 19 nt, Homo sapiens
uuggagagcugcugaaaca

SEQ ID NO: 78044 - RNA, 19 nt, Homo sapiens
ggaagaggagucaacuaga

SEQ ID NO: 78045 - RNA, 19 nt, Homo sapiens
ccaaauaagcacacacuca

SEQ ID NO: 78046 - RNA, 19 nt, Homo sapiens
gauguaggccaacuguauu

SEQ ID NO: 78047 - RNA, 19 nt, Homo sapiens
gggaagaggagucaacuag

SEQ ID NO: 78048 - RNA, 19 nt, Homo sapiens
acuggcaucuguugaaauu

SEQ ID NO: 78049 - RNA, 19 nt, Homo sapiens
gaagcccugauuaaacaua

SEQ ID NO: 78050 - RNA, 19 nt, Homo sapiens
ggcagaagcccugauuaaa

SEQ ID NO: 78051 - RNA, 19 nt, Homo sapiens
cuauugaucucuucaugau

SEQ ID NO: 78052 - RNA, 19 nt, Homo sapiens
gaaaugggaagaggaguca

SEQ ID NO: 78053 - RNA, 19 nt, Homo sapiens
caagagugcagaagagaga

SEQ ID NO: 78054 - RNA, 19 nt, Homo sapiens
uugcagaugucuuaacaga

SEQ ID NO: 78055 - RNA, 19 nt, Homo sapiens
aggcggaucucuacauuuc

SEQ ID NO: 78056 - RNA, 19 nt, Homo sapiens
ggagcacggcauccugaua

SEQ ID NO: 78057 - RNA, 19 nt, Homo sapiens
caagaugaaccuauugauc

SEQ ID NO: 78058 - RNA, 19 nt, Homo sapiens
ugaaacaggcggaucucua

SEQ ID NO: 78059 - RNA, 19 nt, Homo sapiens
gaugguacgacuucuaaug

SEQ ID NO: 78060 - RNA, 19 nt, Homo sapiens
ggugaaauuugagauguag

SEQ ID NO: 78061 - RNA, 19 nt, Homo sapiens
ggauuacagcuguggaauu

SEQ ID NO: 78062 - RNA, 19 nt, Homo sapiens
ggaaugucuucucugaaag

SEQ ID NO: 78063 - RNA, 19 nt, Homo sapiens
gcaacagcccaggaugaua

SEQ ID NO: 78064 - RNA, 19 nt, Homo sapiens
caugcgagcuggaaugucu

SEQ ID NO: 78065 - RNA, 19 nt, Homo sapiens
gcucauuauucccaagguu

SEQ ID NO: 78066 - RNA, 19 nt, Homo sapiens
ccaacagcuuccuuaauag

SEQ ID NO: 78067 - RNA, 19 nt, Homo sapiens
uggcagaagcccugauuaa

SEQ ID NO: 78068 - RNA, 19 nt, Homo sapiens
ggaaggaacuggaaacauu

SEQ ID NO: 78069 - RNA, 19 nt, Homo sapiens
gcaguuagcuuaucaagga

SEQ ID NO: 78070 - RNA, 19 nt, Homo sapiens
gcaaagugcucaaucagaa

SEQ ID NO: 78071 - RNA, 19 nt, Homo sapiens
gaaauaacaucugcaaaug

SEQ ID NO: 78072 - RNA, 19 nt, Homo sapiens
gcagaaagaagucagaaua

SEQ ID NO: 78073 - RNA, 19 nt, Homo sapiens
ggaaauaacaucugcaaau

SEQ ID NO: 78074 - RNA, 19 nt, Homo sapiens
gaaggaacuggaaacauua

SEQ ID NO: 78075 - RNA, 19 nt, Homo sapiens
gauagugccuuuacuucuu

SEQ ID NO: 78076 - RNA, 19 nt, Homo sapiens
gagaauacaugggaaaaua

SEQ ID NO: 78077 - RNA, 19 nt, Homo sapiens
gaucagacuuugugagcuu

SEQ ID NO: 78078 - RNA, 19 nt, Homo sapiens
uaacugugcuccucacuuc

SEQ ID NO: 78079 - RNA, 19 nt, Homo sapiens
ggaauauggccaagcauuu

SEQ ID NO: 78080 - RNA, 19 nt, Homo sapiens
ggaaaugagagacugagua

SEQ ID NO: 78081 - RNA, 19 nt, Homo sapiens
ccucucaacucucuuugua

SEQ ID NO: 78082 - RNA, 19 nt, Homo sapiens
gaaacauuauuccguauac

SEQ ID NO: 78083 - RNA, 19 nt, Homo sapiens
gaaaugagagacugaguag

SEQ ID NO: 78084 - RNA, 19 nt, Homo sapiens
guagauacgcccaugaauu

SEQ ID NO: 78085 - RNA, 19 nt, Homo sapiens
ucucaacucucuuuguaaa

SEQ ID NO: 78086 - RNA, 19 nt, Homo sapiens
uuccauagcaguugaauua

SEQ ID NO: 78087 - RNA, 19 nt, Homo sapiens
gaagagaauacaugggaaa

SEQ ID NO: 78088 - RNA, 19 nt, Homo sapiens
cacacaaucuucucaguga

SEQ ID NO: 78089 - RNA, 19 nt, Homo sapiens
gcuuguuucugauuaauga

SEQ ID NO: 78090 - RNA, 19 nt, Homo sapiens
cagguuggcugagugauuu

SEQ ID NO: 78091 - RNA, 19 nt, Homo sapiens
uagauacgcccaugaauug

SEQ ID NO: 78092 - RNA, 19 nt, Homo sapiens
gaaagaagucagaauagag

SEQ ID NO: 78093 - RNA, 19 nt, Homo sapiens
agaaagaagucagaauaga

SEQ ID NO: 78094 - RNA, 19 nt, Homo sapiens
gaucuugccugcaugaaac

SEQ ID NO: 78095 - RNA, 19 nt, Homo sapiens
agacacaccugaacacauc

SEQ ID NO: 78096 - RNA, 19 nt, Homo sapiens
caucagacuuguuccauag

SEQ ID NO: 78097 - RNA, 19 nt, Homo sapiens
ggaaaggucucaggaagcu

SEQ ID NO: 78098 - RNA, 19 nt, Homo sapiens
ugaaggaucuugccugcau

SEQ ID NO: 78099 - RNA, 19 nt, Homo sapiens
gcagggacaugggagcauu

SEQ ID NO: 78100 - RNA, 19 nt, Homo sapiens
ggccaagcauuucugcaaa

SEQ ID NO: 78101 - RNA, 19 nt, Homo sapiens
ggccuucccugacuuacaa

SEQ ID NO: 78102 - RNA, 19 nt, Homo sapiens
ugacauaacacacaaucuu

SEQ ID NO: 78103 - RNA, 19 nt, Homo sapiens
gcccaugaauugcaguuug

SEQ ID NO: 78104 - RNA, 19 nt, Homo sapiens
ucagaaaugugaauguagu

SEQ ID NO: 78105 - RNA, 19 nt, Homo sapiens
gggaaaauauugaaaagga

SEQ ID NO: 78106 - RNA, 19 nt, Homo sapiens
ugauaggucuugcgcuuug

SEQ ID NO: 78107 - RNA, 19 nt, Homo sapiens
ggaagcuucuugcaguuag

SEQ ID NO: 78108 - RNA, 19 nt, Homo sapiens
gaagucagaauagagauau

SEQ ID NO: 78109 - RNA, 19 nt, Homo sapiens
gccuuuacuucuucugaua

SEQ ID NO: 78110 - RNA, 19 nt, Homo sapiens
gcacacugggagccauuua

SEQ ID NO: 78111 - RNA, 19 nt, Homo sapiens
gaauauggccaagcauuuc

SEQ ID NO: 78112 - RNA, 19 nt, Homo sapiens
uaucaaggaucagacuuug

SEQ ID NO: 78113 - RNA, 19 nt, Homo sapiens
gaauugcaguuugaauauc

SEQ ID NO: 78114 - RNA, 19 nt, Homo sapiens
cuagcaaccuccacauguu

SEQ ID NO: 78115 - RNA, 19 nt, Homo sapiens
caucuugggucuucuugau

SEQ ID NO: 78116 - RNA, 19 nt, Homo sapiens
gcaaugaggaguggaagga

SEQ ID NO: 78117 - RNA, 19 nt, Homo sapiens
ggagagaagcuggaacaga

SEQ ID NO: 78118 - RNA, 19 nt, Homo sapiens
ccacauguucaccuauuaa

SEQ ID NO: 78119 - RNA, 19 nt, Homo sapiens
ucaaucagaaucagcauga

SEQ ID NO: 78120 - RNA, 19 nt, Homo sapiens
gggaauauggccaagcauu

SEQ ID NO: 78121 - RNA, 19 nt, Homo sapiens
ggaacuggaaacauuauuc

SEQ ID NO: 78122 - RNA, 19 nt, Homo sapiens
aaagaagucagaauagaga

SEQ ID NO: 78123 - RNA, 19 nt, Homo sapiens
gaacucccgccacauuuua

SEQ ID NO: 78124 - RNA, 19 nt, Homo sapiens
gaaccagagggaaaugaga

SEQ ID NO: 78125 - RNA, 19 nt, Homo sapiens
gcucuuauuguaugauuga

SEQ ID NO: 78126 - RNA, 19 nt, Homo sapiens
acaucagacuuguuccaua

SEQ ID NO: 78127 - RNA, 19 nt, Homo sapiens
gagcugcacucuggaaagg

SEQ ID NO: 78128 - RNA, 19 nt, Homo sapiens
gaaaaugacauaacacaca

SEQ ID NO: 78129 - RNA, 19 nt, Homo sapiens
gagagaaggaaauaacauc

SEQ ID NO: 78130 - RNA, 19 nt, Homo sapiens
ucaaugcaaaguacaugua

SEQ ID NO: 78131 - RNA, 19 nt, Homo sapiens
gcaugaaaaugacauaaca

SEQ ID NO: 78132 - RNA, 19 nt, Homo sapiens
gcaccauucggucauuuga

SEQ ID NO: 78133 - RNA, 19 nt, Homo sapiens
gaaacaaaaucuggucuca

SEQ ID NO: 78134 - RNA, 19 nt, Homo sapiens
gaaaugugaauguaguaag

SEQ ID NO: 78135 - RNA, 19 nt, Homo sapiens
ggaucuugccugcaugaaa

SEQ ID NO: 78136 - RNA, 19 nt, Homo sapiens
ugggagccauuuacuuuau

SEQ ID NO: 78137 - RNA, 19 nt, Homo sapiens
cccaagggcuccagacaca

SEQ ID NO: 78138 - RNA, 19 nt, Homo sapiens
cccaugaauugcaguuuga

SEQ ID NO: 78139 - RNA, 19 nt, Homo sapiens
guaaggggcugaagagaca

SEQ ID NO: 78140 - RNA, 19 nt, Homo sapiens
gaucaucaggccuguuuua

SEQ ID NO: 78141 - RNA, 19 nt, Homo sapiens
ggugauagugccuuuacuu

SEQ ID NO: 78142 - RNA, 19 nt, Homo sapiens
gacauaacacacaaucuuc

SEQ ID NO: 78143 - RNA, 19 nt, Homo sapiens
ucaaggaucagacuuugug

SEQ ID NO: 78144 - RNA, 19 nt, Homo sapiens
uuugugagcuuccagaaca

SEQ ID NO: 78145 - RNA, 19 nt, Homo sapiens
caggaagcuucuugcaguu

SEQ ID NO: 78146 - RNA, 19 nt, Homo sapiens
ggaaggugaauaaguugga

SEQ ID NO: 78147 - RNA, 19 nt, Homo sapiens
gggagccauuuacuuuaug

SEQ ID NO: 78148 - RNA, 19 nt, Homo sapiens
uuugcuacuuccauuguua

SEQ ID NO: 78149 - RNA, 19 nt, Homo sapiens
cagaaagaagucagaauag

SEQ ID NO: 78150 - RNA, 19 nt, Homo sapiens
uccacauguucaccuauua

SEQ ID NO: 78151 - RNA, 19 nt, Homo sapiens
ugagggaauucguagauac

SEQ ID NO: 78152 - RNA, 19 nt, Homo sapiens
gagaggagagucagaacca

SEQ ID NO: 78153 - RNA, 19 nt, Homo sapiens
caucaggccuguuuuagau

SEQ ID NO: 78154 - RNA, 19 nt, Homo sapiens
ucucaggauucuacccaaa

SEQ ID NO: 78155 - RNA, 19 nt, Homo sapiens
ggaguggaaggaacuggaa

SEQ ID NO: 78156 - RNA, 19 nt, Homo sapiens
acugggagccauuuacuuu

SEQ ID NO: 78157 - RNA, 19 nt, Homo sapiens
ccauuuacuuuaugcucuu

SEQ ID NO: 78158 - RNA, 19 nt, Homo sapiens
ucacuuccucuucuucauu

SEQ ID NO: 78159 - RNA, 19 nt, Homo sapiens
cauguucaccuauuaaugg

SEQ ID NO: 78160 - RNA, 19 nt, Homo sapiens
gugcugaugggacauggua

SEQ ID NO: 78161 - RNA, 19 nt, Homo sapiens
aaaauguccuuagugguua

SEQ ID NO: 78162 - RNA, 19 nt, Homo sapiens
gagaaggaaauaacaucug

SEQ ID NO: 78163 - RNA, 19 nt, Homo sapiens
cuucuucauugcaguuauu

SEQ ID NO: 78164 - RNA, 19 nt, Homo sapiens
gcuccucacuuccucuucu

SEQ ID NO: 78165 - RNA, 19 nt, Homo sapiens
gaugaugacguccucucaa

SEQ ID NO: 78166 - RNA, 19 nt, Homo sapiens
ccauagcaguugaauuagg

SEQ ID NO: 78167 - RNA, 19 nt, Homo sapiens
ccaagcauuucugcaaagu

SEQ ID NO: 78168 - RNA, 19 nt, Homo sapiens
gcaauaagcuaccaagaag

SEQ ID NO: 78169 - RNA, 19 nt, Homo sapiens
gaaauucugugcacuaauc

SEQ ID NO: 78170 - RNA, 19 nt, Homo sapiens
uaaggagguugcugaguua

SEQ ID NO: 78171 - RNA, 19 nt, Homo sapiens
uggauucgcucgagaagua

SEQ ID NO: 78172 - RNA, 19 nt, Homo sapiens
acuguuagcuguucucuuu

SEQ ID NO: 78173 - RNA, 19 nt, Homo sapiens
gcacuaaucauacaauauc

SEQ ID NO: 78174 - RNA, 19 nt, Homo sapiens
ccaagaagcccaagauauc

SEQ ID NO: 78175 - RNA, 19 nt, Homo sapiens
gaggagauauuccgagucu

SEQ ID NO: 78176 - RNA, 19 nt, Homo sapiens
cauggaaacugugagaauu

SEQ ID NO: 78177 - RNA, 19 nt, Homo sapiens
gcacugccauauuccugaa

SEQ ID NO: 78178 - RNA, 19 nt, Homo sapiens
gggccgaccuccuuucaug

SEQ ID NO: 78179 - RNA, 19 nt, Homo sapiens
gugcacuaaucauacaaua

SEQ ID NO: 78180 - RNA, 19 nt, Homo sapiens
auaaggagguugcugaguu

SEQ ID NO: 78181 - RNA, 19 nt, Homo sapiens
gcugccauuucaacuguua

SEQ ID NO: 78182 - RNA, 19 nt, Homo sapiens
agaauucuccucuaugaaa

SEQ ID NO: 78183 - RNA, 19 nt, Homo sapiens
aauaguaccugggcacaaa

SEQ ID NO: 78184 - RNA, 19 nt, Homo sapiens
auccagaccucguccuuua

SEQ ID NO: 78185 - RNA, 19 nt, Homo sapiens
gagucuacaucuuuggauu

SEQ ID NO: 78186 - RNA, 19 nt, Homo sapiens
guacuaacagugugauuca

SEQ ID NO: 78187 - RNA, 19 nt, Homo sapiens
gaucugcaaagacaaguga

SEQ ID NO: 78188 - RNA, 19 nt, Homo sapiens
gauuggauuuccugagugu

SEQ ID NO: 78189 - RNA, 19 nt, Homo sapiens
ggagguugcugaguuagag

SEQ ID NO: 78190 - RNA, 19 nt, Homo sapiens
ucaagaaugcuucaugugu

SEQ ID NO: 78191 - RNA, 19 nt, Homo sapiens
ggagauauuccgagucuac

SEQ ID NO: 78192 - RNA, 19 nt, Homo sapiens
gcagcagggcacagaaauu

SEQ ID NO: 78193 - RNA, 19 nt, Homo sapiens
ugucaagaaugcuucaugu

SEQ ID NO: 78194 - RNA, 19 nt, Homo sapiens
caauaauagugccuuccuu

SEQ ID NO: 78195 - RNA, 19 nt, Homo sapiens
ggugaagcacagcaguuua

SEQ ID NO: 78196 - RNA, 19 nt, Homo sapiens
caggcugguuggaugauuu

SEQ ID NO: 78197 - RNA, 19 nt, Homo sapiens
ccgaccuccuuucauguua

SEQ ID NO: 78198 - RNA, 19 nt, Homo sapiens
caagaagcccaagauauca

SEQ ID NO: 78199 - RNA, 19 nt, Homo sapiens
aauaccagcucugccagua

SEQ ID NO: 78200 - RNA, 19 nt, Homo sapiens
gaauucuccucuaugaaac

SEQ ID NO: 78201 - RNA, 19 nt, Homo sapiens
uuaugagacuguacuaaca

SEQ ID NO: 78202 - RNA, 19 nt, Homo sapiens
cgcaauaagcuaccaagaa

SEQ ID NO: 78203 - RNA, 19 nt, Homo sapiens
ugccuugcauuaugguaua

SEQ ID NO: 78204 - RNA, 19 nt, Homo sapiens
gaaauaccccuuugagauc

SEQ ID NO: 78205 - RNA, 19 nt, Homo sapiens
gaggugccauaguaagcuu

SEQ ID NO: 78206 - RNA, 19 nt, Homo sapiens
uggaugauuugcagauuca

SEQ ID NO: 78207 - RNA, 19 nt, Homo sapiens
cgaccuccuuucauguuau

SEQ ID NO: 78208 - RNA, 19 nt, Homo sapiens
gugccuuccuugcuccuuu

SEQ ID NO: 78209 - RNA, 19 nt, Homo sapiens
cagcagggcacagaaauuc

SEQ ID NO: 78210 - RNA, 19 nt, Homo sapiens
gcucuaggaggauuggauu

SEQ ID NO: 78211 - RNA, 19 nt, Homo sapiens
ccugaagccuuggucuaaa

SEQ ID NO: 78212 - RNA, 19 nt, Homo sapiens
ccucucccauucgcaauaa

SEQ ID NO: 78213 - RNA, 19 nt, Homo sapiens
ucucaggauucuacccaaa

SEQ ID NO: 78214 - RNA, 19 nt, Homo sapiens
cccaagauaucagcccaaa

SEQ ID NO: 78215 - RNA, 19 nt, Homo sapiens
gggugaagcacagcaguuu

SEQ ID NO: 78216 - RNA, 19 nt, Homo sapiens
gcucugccaguaagaaguu

SEQ ID NO: 78217 - RNA, 19 nt, Homo sapiens
ccucguccuuuaccaauag

SEQ ID NO: 78218 - RNA, 19 nt, Homo sapiens
cagcuugugugccaugucu

SEQ ID NO: 78219 - RNA, 19 nt, Homo sapiens
caagguaucauggaaacug

SEQ ID NO: 78220 - RNA, 19 nt, Homo sapiens
ccggugauuuccagaugaa

SEQ ID NO: 78221 - RNA, 19 nt, Homo sapiens
gccggugauuuccagauga

SEQ ID NO: 78222 - RNA, 19 nt, Homo sapiens
agacuuugccggugauuuc

SEQ ID NO: 78223 - RNA, 19 nt, Homo sapiens
ugaguuagaggagauauuc

SEQ ID NO: 78224 - RNA, 19 nt, Homo sapiens
uaccaagaagcccaagaua

SEQ ID NO: 78225 - RNA, 19 nt, Homo sapiens
ccaguaagaaguugcaucu

SEQ ID NO: 78226 - RNA, 19 nt, Homo sapiens
gugaagcacagcaguuuag

SEQ ID NO: 78227 - RNA, 19 nt, Homo sapiens
uaucaagguaucauggaaa

SEQ ID NO: 78228 - RNA, 19 nt, Homo sapiens
gauauuccgagucuacauc

SEQ ID NO: 78229 - RNA, 19 nt, Homo sapiens
guuggaugauuugcagauu

SEQ ID NO: 78230 - RNA, 19 nt, Homo sapiens
gcagcagggcacucagcua

SEQ ID NO: 78231 - RNA, 19 nt, Homo sapiens
uucuggaggugccauagua

SEQ ID NO: 78232 - RNA, 19 nt, Homo sapiens
uaccagcucugccaguaag

SEQ ID NO: 78233 - RNA, 19 nt, Homo sapiens
gguaucauggaaacuguga

SEQ ID NO: 78234 - RNA, 19 nt, Homo sapiens
gaccuccuuucauguuauc

SEQ ID NO: 78235 - RNA, 19 nt, Homo sapiens
gcucaggcugguuggauga

SEQ ID NO: 78236 - RNA, 19 nt, Homo sapiens
guaccugggcacaaacuca

SEQ ID NO: 78237 - RNA, 19 nt, Homo sapiens
uaucauggaaacugugaga

SEQ ID NO: 78238 - RNA, 19 nt, Homo sapiens
ugaaauaccccuuugagau

SEQ ID NO: 78239 - RNA, 19 nt, Homo sapiens
caugucuccucucccauuc

SEQ ID NO: 78240 - RNA, 19 nt, Homo sapiens
gcaauaauagugccuuccu

SEQ ID NO: 78241 - RNA, 19 nt, Homo sapiens
ucauggaaacugugagaau

SEQ ID NO: 78242 - RNA, 19 nt, Homo sapiens
cugcugccauuucaacugu

SEQ ID NO: 78243 - RNA, 19 nt, Homo sapiens
ggugguaacagugaacaug

SEQ ID NO: 78244 - RNA, 19 nt, Homo sapiens
ucaugucuccucucccauu

SEQ ID NO: 78245 - RNA, 19 nt, Homo sapiens
cgccggucauaucagaaua

SEQ ID NO: 78246 - RNA, 19 nt, Homo sapiens
gacauccugcccaaugcua

SEQ ID NO: 78247 - RNA, 19 nt, Homo sapiens
gggacauccugcccaaugc

SEQ ID NO: 78248 - RNA, 19 nt, Homo sapiens
gaccucguccuuuaccaau

SEQ ID NO: 78249 - RNA, 19 nt, Homo sapiens
auaucaagguaucauggaa

SEQ ID NO: 78250 - RNA, 19 nt, Homo sapiens
uggcugggauagcgacuca

SEQ ID NO: 78251 - RNA, 19 nt, Homo sapiens
cuaccaagaagcccaagau

SEQ ID NO: 78252 - RNA, 19 nt, Homo sapiens
gaagcacagcaguuuagag

SEQ ID NO: 78253 - RNA, 19 nt, Homo sapiens
aaugcuaacuggacauggu

SEQ ID NO: 78254 - RNA, 19 nt, Homo sapiens
cugaagccuuggucuaaag

SEQ ID NO: 78255 - RNA, 19 nt, Homo sapiens
gccgaccuccuuucauguu

SEQ ID NO: 78256 - RNA, 19 nt, Homo sapiens
ucugugcacuaaucauaca

SEQ ID NO: 78257 - RNA, 19 nt, Homo sapiens
guaacuuuagugauaagga

SEQ ID NO: 78258 - RNA, 19 nt, Homo sapiens
cagauucauggcugggaua

SEQ ID NO: 78259 - RNA, 19 nt, Homo sapiens
accaagaagcccaagauau

SEQ ID NO: 78260 - RNA, 19 nt, Homo sapiens
cuugcauuaugguauauga

SEQ ID NO: 78261 - RNA, 19 nt, Homo sapiens
uuucaacuguuagcuguuc

SEQ ID NO: 78262 - RNA, 19 nt, Homo sapiens
auucugugcacuaaucaua

SEQ ID NO: 78263 - RNA, 19 nt, Homo sapiens
ucaggcugguuggaugauu

SEQ ID NO: 78264 - RNA, 19 nt, Homo sapiens
ggacaccacucuuccauga

SEQ ID NO: 78265 - RNA, 19 nt, Homo sapiens
gaaauaucccuuugaagua

SEQ ID NO: 78266 - RNA, 19 nt, Homo sapiens
gaaagaaacaucugcaaau

SEQ ID NO: 78267 - RNA, 19 nt, Homo sapiens
uuacugaguuuccagaaua

SEQ ID NO: 78268 - RNA, 19 nt, Homo sapiens
gcaaacagcuuuucugaga

SEQ ID NO: 78269 - RNA, 19 nt, Homo sapiens
gaaucaggcacaauaauuu

SEQ ID NO: 78270 - RNA, 19 nt, Homo sapiens
caaagugucugucaucuac

SEQ ID NO: 78271 - RNA, 19 nt, Homo sapiens
gaaacaguguauaaucuca

SEQ ID NO: 78272 - RNA, 19 nt, Homo sapiens
ucacagaaacaguguauaa

SEQ ID NO: 78273 - RNA, 19 nt, Homo sapiens
caaaugacaugcuguuucu

SEQ ID NO: 78274 - RNA, 19 nt, Homo sapiens
ccaggagccuaguacaaua

SEQ ID NO: 78275 - RNA, 19 nt, Homo sapiens
gaauuggauugccuuggua

SEQ ID NO: 78276 - RNA, 19 nt, Homo sapiens
ugacauggaugcggaauga

SEQ ID NO: 78277 - RNA, 19 nt, Homo sapiens
caagauuacucgaaauauc

SEQ ID NO: 78278 - RNA, 19 nt, Homo sapiens
ucuaauaguccuuguguua

SEQ ID NO: 78279 - RNA, 19 nt, Homo sapiens
gaugggacaugguaucuuc

SEQ ID NO: 78280 - RNA, 19 nt, Homo sapiens
aaagaaacaucugcaaaug

SEQ ID NO: 78281 - RNA, 19 nt, Homo sapiens
cgaaauaucccuuugaagu

SEQ ID NO: 78282 - RNA, 19 nt, Homo sapiens
caggauggcuggacgaguu

SEQ ID NO: 78283 - RNA, 19 nt, Homo sapiens
gcacuaaacauggugauau

SEQ ID NO: 78284 - RNA, 19 nt, Homo sapiens
cgucgacucuccauuuaaa

SEQ ID NO: 78285 - RNA, 19 nt, Homo sapiens
gcaaaugacaugcuguuuc

SEQ ID NO: 78286 - RNA, 19 nt, Homo sapiens
cagaaacaguguauaaucu

SEQ ID NO: 78287 - RNA, 19 nt, Homo sapiens
gcaaugaagaguugucaga

SEQ ID NO: 78288 - RNA, 19 nt, Homo sapiens
caacugggcacuaaacaug

SEQ ID NO: 78289 - RNA, 19 nt, Homo sapiens
gaccuagaguuguuauuuc

SEQ ID NO: 78290 - RNA, 19 nt, Homo sapiens
guccuuguguuaugguuua

SEQ ID NO: 78291 - RNA, 19 nt, Homo sapiens
uaauaguccuuguguuaug

SEQ ID NO: 78292 - RNA, 19 nt, Homo sapiens
ggauuagauuuacugaguu

SEQ ID NO: 78293 - RNA, 19 nt, Homo sapiens
cggauuagauuuacugagu

SEQ ID NO: 78294 - RNA, 19 nt, Homo sapiens
gagaucagcaaacagcuuu

SEQ ID NO: 78295 - RNA, 19 nt, Homo sapiens
ugucagaccuagaguuguu

SEQ ID NO: 78296 - RNA, 19 nt, Homo sapiens
cacuaaacauggugauauu

SEQ ID NO: 78297 - RNA, 19 nt, Homo sapiens
ugaaucaggcacaauaauu

SEQ ID NO: 78298 - RNA, 19 nt, Homo sapiens
ggugauauucuuccuaaug

SEQ ID NO: 78299 - RNA, 19 nt, Homo sapiens
uggauuaacucgggagauu

SEQ ID NO: 78300 - RNA, 19 nt, Homo sapiens
gauagugcccuuggugauu

SEQ ID NO: 78301 - RNA, 19 nt, Homo sapiens
caugguaucuucaggugau

SEQ ID NO: 78302 - RNA, 19 nt, Homo sapiens
ggaaugaacaggagcaacu

SEQ ID NO: 78303 - RNA, 19 nt, Homo sapiens
gagcugcauucuggaaaga

SEQ ID NO: 78304 - RNA, 19 nt, Homo sapiens
gucaagauuacucgaaaua

SEQ ID NO: 78305 - RNA, 19 nt, Homo sapiens
auccagaucuucucauuug

SEQ ID NO: 78306 - RNA, 19 nt, Homo sapiens
ugaauuggauugccuuggu

SEQ ID NO: 78307 - RNA, 19 nt, Homo sapiens
agaaacaucugcaaaugac

SEQ ID NO: 78308 - RNA, 19 nt, Homo sapiens
acaccacucuuccaugaau

SEQ ID NO: 78309 - RNA, 19 nt, Homo sapiens
guaugaaggcgucacagaa

SEQ ID NO: 78310 - RNA, 19 nt, Homo sapiens
uaugaaggcgucacagaaa

SEQ ID NO: 78311 - RNA, 19 nt, Homo sapiens
agaaagaaacaucugcaaa

SEQ ID NO: 78312 - RNA, 19 nt, Homo sapiens
cuagaguuguuauuucguu

SEQ ID NO: 78313 - RNA, 19 nt, Homo sapiens
ucauccagaucuucucauu

SEQ ID NO: 78314 - RNA, 19 nt, Homo sapiens
cccgucgacucuccauuua

SEQ ID NO: 78315 - RNA, 19 nt, Homo sapiens
gcugcuagcucuucuucuc

SEQ ID NO: 78316 - RNA, 19 nt, Homo sapiens
gagaaagaaacaucugcaa

SEQ ID NO: 78317 - RNA, 19 nt, Homo sapiens
guuucuaccucuuuggauu

SEQ ID NO: 78318 - RNA, 19 nt, Homo sapiens
cagugaaucaggcacaaua

SEQ ID NO: 78319 - RNA, 19 nt, Homo sapiens
gaccaugcaagucaagauu

SEQ ID NO: 78320 - RNA, 19 nt, Homo sapiens
cagaucuucucauuuguca

SEQ ID NO: 78321 - RNA, 19 nt, Homo sapiens
ccaaagugucugucaucua

SEQ ID NO: 78322 - RNA, 19 nt, Homo sapiens
ucaagaccaugcaagucaa

SEQ ID NO: 78323 - RNA, 19 nt, Homo sapiens
agaccuagaguuguuauuu

SEQ ID NO: 78324 - RNA, 19 nt, Homo sapiens
gugauauucuuccuaaugc

SEQ ID NO: 78325 - RNA, 19 nt, Homo sapiens
aaauaucccuuugaaguac

SEQ ID NO: 78326 - RNA, 19 nt, Homo sapiens
cgacucuccauuuaaauug

SEQ ID NO: 78327 - RNA, 19 nt, Homo sapiens
cuaguacaauauagugaug

SEQ ID NO: 78328 - RNA, 19 nt, Homo sapiens
uggauugccuugguaguga

SEQ ID NO: 78329 - RNA, 19 nt, Homo sapiens
aagaaacaucugcaaauga

SEQ ID NO: 78330 - RNA, 19 nt, Homo sapiens
caacggauuagauuuacug

SEQ ID NO: 78331 - RNA, 19 nt, Homo sapiens
gauuaacucgggagauuca

SEQ ID NO: 78332 - RNA, 19 nt, Homo sapiens
aagggcaacuucagcaaug

SEQ ID NO: 78333 - RNA, 19 nt, Homo sapiens
gcagggaagauguauguac

SEQ ID NO: 78334 - RNA, 19 nt, Homo sapiens
ucugucaucuacucaauca

SEQ ID NO: 78335 - RNA, 19 nt, Homo sapiens
caagucaagauuacucgaa

SEQ ID NO: 78336 - RNA, 19 nt, Homo sapiens
acagaaacaguguauaauc

SEQ ID NO: 78337 - RNA, 19 nt, Homo sapiens
aagucaagauuacucgaaa

SEQ ID NO: 78338 - RNA, 19 nt, Homo sapiens
guuguuauuucguuucuac

SEQ ID NO: 78339 - RNA, 19 nt, Homo sapiens
uuguuucucuuucugcaua

SEQ ID NO: 78340 - RNA, 19 nt, Homo sapiens
auggugauauucuuccuaa

SEQ ID NO: 78341 - RNA, 19 nt, Homo sapiens
aggagcaacugggcacuaa

SEQ ID NO: 78342 - RNA, 19 nt, Homo sapiens
gaucuucucauuugucaac

SEQ ID NO: 78343 - RNA, 19 nt, Homo sapiens
cucgaaauaucccuuugaa

SEQ ID NO: 78344 - RNA, 19 nt, Homo sapiens
gcccuuggugauucuaaua

SEQ ID NO: 78345 - RNA, 19 nt, Homo sapiens
uaacucgggagauucaaga

SEQ ID NO: 78346 - RNA, 19 nt, Homo sapiens
aaacauggugauauucuuc

SEQ ID NO: 78347 - RNA, 19 nt, Homo sapiens
gcuuucaacggauuagauu

SEQ ID NO: 78348 - RNA, 19 nt, Homo sapiens
guugucagaccuagaguug

SEQ ID NO: 78349 - RNA, 19 nt, Homo sapiens
gacagugaaucaggcacaa

SEQ ID NO: 78350 - RNA, 19 nt, Homo sapiens
gcaacugggcacuaaacau

SEQ ID NO: 78351 - RNA, 19 nt, Homo sapiens
ccaugcaagucaagauuac

SEQ ID NO: 78352 - RNA, 19 nt, Homo sapiens
gacucuccauuuaaauugu

SEQ ID NO: 78353 - RNA, 19 nt, Homo sapiens
gagccuaguacaauauagu

SEQ ID NO: 78354 - RNA, 19 nt, Homo sapiens
ggacauccugugagacucu

SEQ ID NO: 78355 - RNA, 19 nt, Homo sapiens
cuaauaguccuuguguuau

SEQ ID NO: 78356 - RNA, 19 nt, Homo sapiens
gagcaacugggcacuaaac

SEQ ID NO: 78357 - RNA, 19 nt, Homo sapiens
ggagccuaguacaauauag

SEQ ID NO: 78358 - RNA, 19 nt, Homo sapiens
ggauugccuugguagugau

SEQ ID NO: 78359 - RNA, 19 nt, Homo sapiens
cauccagaucuucucauuu

SEQ ID NO: 78360 - RNA, 19 nt, Homo sapiens
ucucuugggucuccuggau

SEQ ID NO: 78361 - RNA, 19 nt, Homo sapiens
aaacagcuuuucugagaga

SEQ ID NO: 78362 - RNA, 19 nt, Homo sapiens
gaguuguuauuucguuucu

SEQ ID NO: 78363 - RNA, 19 nt, Homo sapiens
caagggcaacuucagcaau

SEQ ID NO: 78364 - RNA, 19 nt, Homo sapiens
ggacacaguuucuauugua

SEQ ID NO: 78365 - RNA, 19 nt, Homo sapiens
gaaaagauauccugaguuu

SEQ ID NO: 78366 - RNA, 19 nt, Homo sapiens
gcaaaggugugcaaacuug

SEQ ID NO: 78367 - RNA, 19 nt, Homo sapiens
gaacaugccugauuuuaaa

SEQ ID NO: 78368 - RNA, 19 nt, Homo sapiens
gguaagagcugaugugagu

SEQ ID NO: 78369 - RNA, 19 nt, Homo sapiens
ggaccuggcuuggcuuuaa

SEQ ID NO: 78370 - RNA, 19 nt, Homo sapiens
cagcauauauuucggguuu

SEQ ID NO: 78371 - RNA, 19 nt, Homo sapiens
ucaaauacauaccuacuga

SEQ ID NO: 78372 - RNA, 19 nt, Homo sapiens
caaauaacuucuuccaugu

SEQ ID NO: 78373 - RNA, 19 nt, Homo sapiens
gggagacgcugcagcauau

SEQ ID NO: 78374 - RNA, 19 nt, Homo sapiens
cagcgaacaugccugauuu

SEQ ID NO: 78375 - RNA, 19 nt, Homo sapiens
ccaaauggcucugugaaau

SEQ ID NO: 78376 - RNA, 19 nt, Homo sapiens
gaacacacauguccuaucc

SEQ ID NO: 78377 - RNA, 19 nt, Homo sapiens
ggucugggcuugggaauug

SEQ ID NO: 78378 - RNA, 19 nt, Homo sapiens
auacauaccuacugacuga

SEQ ID NO: 78379 - RNA, 19 nt, Homo sapiens
gaacugaagaagcaaguga

SEQ ID NO: 78380 - RNA, 19 nt, Homo sapiens
uaggagagauaccuugaaa

SEQ ID NO: 78381 - RNA, 19 nt, Homo sapiens
gcucaggaauugaagaugu

SEQ ID NO: 78382 - RNA, 19 nt, Homo sapiens
ccagggacgugaaggaauu

SEQ ID NO: 78383 - RNA, 19 nt, Homo sapiens
gaagauguaaggaauugaa

SEQ ID NO: 78384 - RNA, 19 nt, Homo sapiens
ggcuuuaccucccgguuua

SEQ ID NO: 78385 - RNA, 19 nt, Homo sapiens
gcauauauuucggguuuau

SEQ ID NO: 78386 - RNA, 19 nt, Homo sapiens
gaaggacauuuucucuuua

SEQ ID NO: 78387 - RNA, 19 nt, Homo sapiens
acagaggcgucucacauuu

SEQ ID NO: 78388 - RNA, 19 nt, Homo sapiens
gacacaguuucuauuguaa

SEQ ID NO: 78389 - RNA, 19 nt, Homo sapiens
gcaaacuuguaucugaaga

SEQ ID NO: 78390 - RNA, 19 nt, Homo sapiens
ugaggcagcuuucaucaca

SEQ ID NO: 78391 - RNA, 19 nt, Homo sapiens
gaauugaagauguaaggaa

SEQ ID NO: 78392 - RNA, 19 nt, Homo sapiens
gugcaaacuuguaucugaa

SEQ ID NO: 78393 - RNA, 19 nt, Homo sapiens
gaggacacaguuucuauug

SEQ ID NO: 78394 - RNA, 19 nt, Homo sapiens
guaaggaauugaagauagg

SEQ ID NO: 78395 - RNA, 19 nt, Homo sapiens
acagugcaguggcuccuua

SEQ ID NO: 78396 - RNA, 19 nt, Homo sapiens
gaugucauauuggcaguug

SEQ ID NO: 78397 - RNA, 19 nt, Homo sapiens
ccuacugacugaugacaaa

SEQ ID NO: 78398 - RNA, 19 nt, Homo sapiens
ggaagucggaacugaagaa

SEQ ID NO: 78399 - RNA, 19 nt, Homo sapiens
gggaacgccucaaauaacu

SEQ ID NO: 78400 - RNA, 19 nt, Homo sapiens
ggaggacacaguuucuauu

SEQ ID NO: 78401 - RNA, 19 nt, Homo sapiens
acacacauguccuauccaa

SEQ ID NO: 78402 - RNA, 19 nt, Homo sapiens
ugugcaaacuuguaucuga

SEQ ID NO: 78403 - RNA, 19 nt, Homo sapiens
caagaaaacuggaaaucug

SEQ ID NO: 78404 - RNA, 19 nt, Homo sapiens
gauaggagagauaccuuga

SEQ ID NO: 78405 - RNA, 19 nt, Homo sapiens
cuucuuccauguagcauuu

SEQ ID NO: 78406 - RNA, 19 nt, Homo sapiens
uguaaggaauugaagauag

SEQ ID NO: 78407 - RNA, 19 nt, Homo sapiens
gcccaaugcugacgagaca

SEQ ID NO: 78408 - RNA, 19 nt, Homo sapiens
cauguagcauuucaaggaa

SEQ ID NO: 78409 - RNA, 19 nt, Homo sapiens
gaacgccucaaauaacuuc

SEQ ID NO: 78410 - RNA, 19 nt, Homo sapiens
gcgcugaagucccgcaaag

SEQ ID NO: 78411 - RNA, 19 nt, Homo sapiens
ccauguagcauuucaagga

SEQ ID NO: 78412 - RNA, 19 nt, Homo sapiens
ccugggaacgccucaaaua

SEQ ID NO: 78413 - RNA, 19 nt, Homo sapiens
aaacagaggcgucucacau

SEQ ID NO: 78414 - RNA, 19 nt, Homo sapiens
gcaguuggaggacacaguu

SEQ ID NO: 78415 - RNA, 19 nt, Homo sapiens
gaugacaaacccaggaguu

SEQ ID NO: 78416 - RNA, 19 nt, Homo sapiens
ggguaaacuuggccauuca

SEQ ID NO: 78417 - RNA, 19 nt, Homo sapiens
gaagagugcgcaggucaga

SEQ ID NO: 78418 - RNA, 19 nt, Homo sapiens
aaauggcucugugaaauca

SEQ ID NO: 78419 - RNA, 19 nt, Homo sapiens
gaggcaaacuuccuaucag

SEQ ID NO: 78420 - RNA, 19 nt, Homo sapiens
ggaacuggaacacacaugu

SEQ ID NO: 78421 - RNA, 19 nt, Homo sapiens
gaaaucagaagugcaaagg

SEQ ID NO: 78422 - RNA, 19 nt, Homo sapiens
ggaauucgccaaaaugcua

SEQ ID NO: 78423 - RNA, 19 nt, Homo sapiens
gauguaaggaauugaagau

SEQ ID NO: 78424 - RNA, 19 nt, Homo sapiens
gugaugggaucuguaagga

SEQ ID NO: 78425 - RNA, 19 nt, Homo sapiens
acuuguaucugaagaccua

SEQ ID NO: 78426 - RNA, 19 nt, Homo sapiens
caaauggcucugugaaauc

SEQ ID NO: 78427 - RNA, 19 nt, Homo sapiens
agucggaacugaagaagca

SEQ ID NO: 78428 - RNA, 19 nt, Homo sapiens
ugacucgccuugccacauc

SEQ ID NO: 78429 - RNA, 19 nt, Homo sapiens
cauaccuacugacugauga

SEQ ID NO: 78430 - RNA, 19 nt, Homo sapiens
caccucaaauacauaccua

SEQ ID NO: 78431 - RNA, 19 nt, Homo sapiens
acacauguccuauccaaag

SEQ ID NO: 78432 - RNA, 19 nt, Homo sapiens
gaacuggaacacacauguc

SEQ ID NO: 78433 - RNA, 19 nt, Homo sapiens
gaugugagugugugugaug

SEQ ID NO: 78434 - RNA, 19 nt, Homo sapiens
gaauugaagauaggagaga

SEQ ID NO: 78435 - RNA, 19 nt, Homo sapiens
uugaagauguaaggaauug

SEQ ID NO: 78436 - RNA, 19 nt, Homo sapiens
ggucugcucaggaauugaa

SEQ ID NO: 78437 - RNA, 19 nt, Homo sapiens
aauaacuucuuccauguag

SEQ ID NO: 78438 - RNA, 19 nt, Homo sapiens
ggacaccucaaauacauac

SEQ ID NO: 78439 - RNA, 19 nt, Homo sapiens
gcagguaagagcugaugug

SEQ ID NO: 78440 - RNA, 19 nt, Homo sapiens
ugcaguggcuccuuaaugg

SEQ ID NO: 78441 - RNA, 19 nt, Homo sapiens
ugggacaccucaaauacau

SEQ ID NO: 78442 - RNA, 19 nt, Homo sapiens
cucaggaauugaagaugua

SEQ ID NO: 78443 - RNA, 19 nt, Homo sapiens
gggcuuuaccucccgguuu

SEQ ID NO: 78444 - RNA, 19 nt, Homo sapiens
ucucaggauucuacccaaa

SEQ ID NO: 78445 - RNA, 19 nt, Homo sapiens
ugcccuggaugucauauug

SEQ ID NO: 78446 - RNA, 19 nt, Homo sapiens
gaagauaggagagauaccu

SEQ ID NO: 78447 - RNA, 19 nt, Homo sapiens
aaagauauccugaguuucc

SEQ ID NO: 78448 - RNA, 19 nt, Homo sapiens
guugucaaguauaaaguca

SEQ ID NO: 78449 - RNA, 19 nt, Homo sapiens
gaaggaauucgccaaaaug

SEQ ID NO: 78450 - RNA, 19 nt, Homo sapiens
gaaacagaggcgucucaca

SEQ ID NO: 78451 - RNA, 19 nt, Homo sapiens
gagacgcugcagcauauau

SEQ ID NO: 78452 - RNA, 19 nt, Homo sapiens
gugcaguggcuccuuaaug

SEQ ID NO: 78453 - RNA, 19 nt, Homo sapiens
cgacugaagaaggacauuu

SEQ ID NO: 78454 - RNA, 19 nt, Homo sapiens
cugggaacgccucaaauaa

SEQ ID NO: 78455 - RNA, 19 nt, Homo sapiens
ggaacacacauguccuauc

SEQ ID NO: 78456 - RNA, 19 nt, Homo sapiens
aaaggugugcaaacuugua

SEQ ID NO: 78457 - RNA, 19 nt, Homo sapiens
ucacacccuuuuaacauuu

SEQ ID NO: 78458 - RNA, 19 nt, Homo sapiens
gaucucguccuucgccaau

SEQ ID NO: 78459 - RNA, 19 nt, Homo sapiens
uuaagaggcaaacuuccua

SEQ ID NO: 78460 - RNA, 19 nt, Homo sapiens
uggguaaacuuggccauuc

SEQ ID NO: 78461 - RNA, 19 nt, Homo sapiens
uaagagcugaugugagugu

SEQ ID NO: 78462 - RNA, 19 nt, Homo sapiens
gacgcugcagcauauauuu

SEQ ID NO: 78463 - RNA, 19 nt, Homo sapiens
ugaaggaauucgccaaaau

SEQ ID NO: 78464 - RNA, 19 nt, Homo sapiens
gauauuagcuggcuguaga

SEQ ID NO: 78465 - RNA, 19 nt, Homo sapiens
gaacugaaacggaaaguga

SEQ ID NO: 78466 - RNA, 19 nt, Homo sapiens
guaguugacucacgguuaa

SEQ ID NO: 78467 - RNA, 19 nt, Homo sapiens
gcuccaaacuuccuccuuu

SEQ ID NO: 78468 - RNA, 19 nt, Homo sapiens
uuagcuggcuguagaauga

SEQ ID NO: 78469 - RNA, 19 nt, Homo sapiens
cucaaucgcuaccuagaua

SEQ ID NO: 78470 - RNA, 19 nt, Homo sapiens
cuaccuagauauuaaggaa

SEQ ID NO: 78471 - RNA, 19 nt, Homo sapiens
ggucacaccugcccucgau

SEQ ID NO: 78472 - RNA, 19 nt, Homo sapiens
ggucauauugguuguaguu

SEQ ID NO: 78473 - RNA, 19 nt, Homo sapiens
gauaguuacccuggucaua

SEQ ID NO: 78474 - RNA, 19 nt, Homo sapiens
caccugcccucgauuucua

SEQ ID NO: 78475 - RNA, 19 nt, Homo sapiens
ucauauugguuguaguuga

SEQ ID NO: 78476 - RNA, 19 nt, Homo sapiens
gauauuccaucuuucucau

SEQ ID NO: 78477 - RNA, 19 nt, Homo sapiens
gcaagcuucugcuggucaa

SEQ ID NO: 78478 - RNA, 19 nt, Homo sapiens
uaguuacccuggucauauu

SEQ ID NO: 78479 - RNA, 19 nt, Homo sapiens
gcauaucaagggucagauu

SEQ ID NO: 78480 - RNA, 19 nt, Homo sapiens
caguuauacuuccauaguu

SEQ ID NO: 78481 - RNA, 19 nt, Homo sapiens
ucacaccugcccucgauuu

SEQ ID NO: 78482 - RNA, 19 nt, Homo sapiens
cauaucaagggucagauuu

SEQ ID NO: 78483 - RNA, 19 nt, Homo sapiens
ggauauuccaucuuucuca

SEQ ID NO: 78484 - RNA, 19 nt, Homo sapiens
uuaaggaaauacugcaaag

SEQ ID NO: 78485 - RNA, 19 nt, Homo sapiens
ccuucgagauccagauauu

SEQ ID NO: 78486 - RNA, 19 nt, Homo sapiens
ugggugaccugcagacuca

SEQ ID NO: 78487 - RNA, 19 nt, Homo sapiens
ucucaggauucuacccaaa

SEQ ID NO: 78488 - RNA, 19 nt, Homo sapiens
ccaguuauacuuccauagu

SEQ ID NO: 78489 - RNA, 19 nt, Homo sapiens
gaggggacguccugccuaa

SEQ ID NO: 78490 - RNA, 19 nt, Homo sapiens
ggugaaacacagcagucua

SEQ ID NO: 78491 - RNA, 19 nt, Homo sapiens
cagcuugugugccaugucu

SEQ ID NO: 78492 - RNA, 19 nt, Homo sapiens
uguaguugacucacgguua

SEQ ID NO: 78493 - RNA, 19 nt, Homo sapiens
gugaaacacagcagucuag

SEQ ID NO: 78494 - RNA, 19 nt, Homo sapiens
gccuaaugcugacgagaca

SEQ ID NO: 78495 - RNA, 19 nt, Homo sapiens
cauauugguuguaguugac

SEQ ID NO: 78496 - RNA, 19 nt, Homo sapiens
aaucgcuaccuagauauua

SEQ ID NO: 78497 - RNA, 19 nt, Homo sapiens
caaucgcuaccuagauauu

SEQ ID NO: 78498 - RNA, 19 nt, Homo sapiens
ggcaccauccgcuuucuga

SEQ ID NO: 78499 - RNA, 19 nt, Homo sapiens
gaucuguuugacugugaua

SEQ ID NO: 78500 - RNA, 19 nt, Homo sapiens
gcucaaucgcuaccuagau

SEQ ID NO: 78501 - RNA, 19 nt, Homo sapiens
gcaccauccgcuuucugaa

SEQ ID NO: 78502 - RNA, 19 nt, Homo sapiens
ucuguaaagugcucaaucg

SEQ ID NO: 78503 - RNA, 19 nt, Homo sapiens
gggacguccugccuaaugc

SEQ ID NO: 78504 - RNA, 19 nt, Homo sapiens
aaccacagcugggcacaca

SEQ ID NO: 78505 - RNA, 19 nt, Homo sapiens
auaguuacccuggucauau

SEQ ID NO: 78506 - RNA, 19 nt, Homo sapiens
gaaugaaugccccacaaau

SEQ ID NO: 78507 - RNA, 19 nt, Homo sapiens
cuucgagauccagauauua

SEQ ID NO: 78508 - RNA, 19 nt, Homo sapiens
uguuugacugugauaguua

SEQ ID NO: 78509 - RNA, 19 nt, Homo sapiens
ccagauagugcaagcuucu

SEQ ID NO: 78510 - RNA, 19 nt, Homo sapiens
ggacaucuaucucaucauu

SEQ ID NO: 78511 - RNA, 19 nt, Homo sapiens
guaaggagaagcaauauaa

SEQ ID NO: 78512 - RNA, 19 nt, Homo sapiens
aagaugagcuuuccaugua

SEQ ID NO: 78513 - RNA, 19 nt, Homo sapiens
gacaagagcccacagagua

SEQ ID NO: 78514 - RNA, 19 nt, Homo sapiens
ccaaagaucuccuggacuu

SEQ ID NO: 78515 - RNA, 19 nt, Homo sapiens
ccaaagagauuacgaaugc

SEQ ID NO: 78516 - RNA, 19 nt, Homo sapiens
gaacaaagucagcaaggaa

SEQ ID NO: 78517 - RNA, 19 nt, Homo sapiens
agaaaggucuggacaucua

SEQ ID NO: 78518 - RNA, 19 nt, Homo sapiens
gaagaccgaugaucaggau

SEQ ID NO: 78519 - RNA, 19 nt, Homo sapiens
guagccagcuuccuucuga

SEQ ID NO: 78520 - RNA, 19 nt, Homo sapiens
guacuuccaugagguguuu

SEQ ID NO: 78521 - RNA, 19 nt, Homo sapiens
gaauuaaaccuguaucaag

SEQ ID NO: 78522 - RNA, 19 nt, Homo sapiens
gagcuuuccauguaaauuu

SEQ ID NO: 78523 - RNA, 19 nt, Homo sapiens
gaacugaccccgaauuaaa

SEQ ID NO: 78524 - RNA, 19 nt, Homo sapiens
caggauaucuacaagguau

SEQ ID NO: 78525 - RNA, 19 nt, Homo sapiens
ccaguaaggagaagcaaua

SEQ ID NO: 78526 - RNA, 19 nt, Homo sapiens
gaugagcuuuccauguaaa

SEQ ID NO: 78527 - RNA, 19 nt, Homo sapiens
ggaacaaagucagcaagga

SEQ ID NO: 78528 - RNA, 19 nt, Homo sapiens
ggacaucaacuuggacauu

SEQ ID NO: 78529 - RNA, 19 nt, Homo sapiens
uaagugugauugcaagaau

SEQ ID NO: 78530 - RNA, 19 nt, Homo sapiens
aaacagaggagucggagaa

SEQ ID NO: 78531 - RNA, 19 nt, Homo sapiens
gacaucaacuuggacauuc

SEQ ID NO: 78532 - RNA, 19 nt, Homo sapiens
cagccuaucugcuuaagag

SEQ ID NO: 78533 - RNA, 19 nt, Homo sapiens
ggagaagcaauauaagugu

SEQ ID NO: 78534 - RNA, 19 nt, Homo sapiens
ugucagcuguccagagaaa

SEQ ID NO: 78535 - RNA, 19 nt, Homo sapiens
ccugucagcuguccagaga

SEQ ID NO: 78536 - RNA, 19 nt, Homo sapiens
gcacagcagggaacaaagu

SEQ ID NO: 78537 - RNA, 19 nt, Homo sapiens
guaaauuuguagccagcuu

SEQ ID NO: 78538 - RNA, 19 nt, Homo sapiens
caaaugagugaugauauug

SEQ ID NO: 78539 - RNA, 19 nt, Homo sapiens
gauuacgaaugccuuggaa

SEQ ID NO: 78540 - RNA, 19 nt, Homo sapiens
caaaggugcagucuccaaa

SEQ ID NO: 78541 - RNA, 19 nt, Homo sapiens
ccaacaaauuccagcuuca

SEQ ID NO: 78542 - RNA, 19 nt, Homo sapiens
ccucucaggucauguguag

SEQ ID NO: 78543 - RNA, 19 nt, Homo sapiens
uaagaugagcuuuccaugu

SEQ ID NO: 78544 - RNA, 19 nt, Homo sapiens
agagaaaggucuggacauc

SEQ ID NO: 78545 - RNA, 19 nt, Homo sapiens
caauguuucuuccaaaggu

SEQ ID NO: 78546 - RNA, 19 nt, Homo sapiens
ggaccgagcacagaaaucu

SEQ ID NO: 78547 - RNA, 19 nt, Homo sapiens
cagaggagucggagaaaug

SEQ ID NO: 78548 - RNA, 19 nt, Homo sapiens
gaagcaauauaagugugau

SEQ ID NO: 78549 - RNA, 19 nt, Homo sapiens
gaccucgaguucagccaaa

SEQ ID NO: 78550 - RNA, 19 nt, Homo sapiens
caacaaauuccagcuucaa

SEQ ID NO: 78551 - RNA, 19 nt, Homo sapiens
ucucaucauuggcauaugu

SEQ ID NO: 78552 - RNA, 19 nt, Homo sapiens
ggagacaagagcccacaga

SEQ ID NO: 78553 - RNA, 19 nt, Homo sapiens
gcacugcucguuuucuaua

SEQ ID NO: 78554 - RNA, 19 nt, Homo sapiens
ccaccagccugagugcaaa

SEQ ID NO: 78555 - RNA, 19 nt, Homo sapiens
uagaugcgauaaaucaagu

SEQ ID NO: 78556 - RNA, 19 nt, Homo sapiens
gaaaggucuggacaucuau

SEQ ID NO: 78557 - RNA, 19 nt, Homo sapiens
ccgaugaucaggauaucua

SEQ ID NO: 78558 - RNA, 19 nt, Homo sapiens
ggacauuccuaguuuucaa

SEQ ID NO: 78559 - RNA, 19 nt, Homo sapiens
agaugagcuuuccauguaa

SEQ ID NO: 78560 - RNA, 19 nt, Homo sapiens
ccugugagguaaugaaugg

SEQ ID NO: 78561 - RNA, 19 nt, Homo sapiens
acuuggacauuccuaguuu

SEQ ID NO: 78562 - RNA, 19 nt, Homo sapiens
gucaggacaucaacuugga

SEQ ID NO: 78563 - RNA, 19 nt, Homo sapiens
ggucuggacaucuaucuca

SEQ ID NO: 78564 - RNA, 19 nt, Homo sapiens
uuaaaccuguaucaagaug

SEQ ID NO: 78565 - RNA, 19 nt, Homo sapiens
cgaauuaaaccuguaucaa

SEQ ID NO: 78566 - RNA, 19 nt, Homo sapiens
aagaucuccuggacuugua

SEQ ID NO: 78567 - RNA, 19 nt, Homo sapiens
guguagaugcgauaaauca

SEQ ID NO: 78568 - RNA, 19 nt, Homo sapiens
gagcacagaaaucuuagag

SEQ ID NO: 78569 - RNA, 19 nt, Homo sapiens
guagaggaccgagcacaga

SEQ ID NO: 78570 - RNA, 19 nt, Homo sapiens
ggagucggagaaaugauga

SEQ ID NO: 78571 - RNA, 19 nt, Homo sapiens
acaucuaucucaucauugg

SEQ ID NO: 78572 - RNA, 19 nt, Homo sapiens
aaggugcagucuccaaaga

SEQ ID NO: 78573 - RNA, 19 nt, Homo sapiens
gugcacagcagggaacaaa

SEQ ID NO: 78574 - RNA, 19 nt, Homo sapiens
guaucaagaugggaaacau

SEQ ID NO: 78575 - RNA, 19 nt, Homo sapiens
ccaccauccugugaguaaa

SEQ ID NO: 78576 - RNA, 19 nt, Homo sapiens
augaggagcuggagacaag

SEQ ID NO: 78577 - RNA, 19 nt, Homo sapiens
caacuuggacauuccuagu

SEQ ID NO: 78578 - RNA, 19 nt, Homo sapiens
gugcauauccguacuucca

SEQ ID NO: 78579 - RNA, 19 nt, Homo sapiens
cuggacaucuaucucauca

SEQ ID NO: 78580 - RNA, 19 nt, Homo sapiens
gaugcgauaaaucaaguga

SEQ ID NO: 78581 - RNA, 19 nt, Homo sapiens
ccagcaacuucccaacauc

SEQ ID NO: 78582 - RNA, 19 nt, Homo sapiens
guagaugcgauaaaucaag

SEQ ID NO: 78583 - RNA, 19 nt, Homo sapiens
caaguucaccagcagaaag

SEQ ID NO: 78584 - RNA, 19 nt, Homo sapiens
guucagcaccagccucaga

SEQ ID NO: 78585 - RNA, 19 nt, Homo sapiens
aaauuaagcaucugaagac

SEQ ID NO: 78586 - RNA, 19 nt, Homo sapiens
gcacaauucagaaaagaga

SEQ ID NO: 78587 - RNA, 19 nt, Homo sapiens
gaggaccgagcacagaaau

SEQ ID NO: 78588 - RNA, 19 nt, Homo sapiens
gagugaugauauugacgau

SEQ ID NO: 78589 - RNA, 19 nt, Homo sapiens
ccaaaggugcagucuccaa

SEQ ID NO: 78590 - RNA, 19 nt, Homo sapiens
gccagcuuccuucugauuu

SEQ ID NO: 78591 - RNA, 19 nt, Homo sapiens
gaccgaugaucaggauauc

SEQ ID NO: 78592 - RNA, 19 nt, Homo sapiens
accgagcacagaaaucuua

SEQ ID NO: 78593 - RNA, 19 nt, Homo sapiens
acagaggagucggagaaau

SEQ ID NO: 78594 - RNA, 19 nt, Homo sapiens
gggaaacaucuaaaacuuu

SEQ ID NO: 78595 - RNA, 19 nt, Homo sapiens
gagaaaggucuggacaucu

SEQ ID NO: 78596 - RNA, 19 nt, Homo sapiens
agaagcaauauaaguguga

SEQ ID NO: 78597 - RNA, 19 nt, Homo sapiens
aggagaagcaauauaagug

SEQ ID NO: 78598 - RNA, 19 nt, Homo sapiens
aaagcacuguggauuucug

SEQ ID NO: 78599 - RNA, 19 nt, Homo sapiens
ccagcuuccuucugauuuu

SEQ ID NO: 78600 - RNA, 19 nt, Homo sapiens
ggaacugaccccgaauuaa

SEQ ID NO: 78601 - RNA, 19 nt, Homo sapiens
aaagaucuccuggacuugu

SEQ ID NO: 78602 - RNA, 19 nt, Homo sapiens
cccaccauccugugaguaa

SEQ ID NO: 78603 - RNA, 19 nt, Homo sapiens
ucucaggucauguguagau

SEQ ID NO: 78604 - RNA, 19 nt, Homo sapiens
uagaggaccgagcacagaa

SEQ ID NO: 78605 - RNA, 19 nt, Homo sapiens
gagcuccaucacaccagua

SEQ ID NO: 78606 - RNA, 19 nt, Homo sapiens
uuucugcccuccugaugug

SEQ ID NO: 78607 - RNA, 19 nt, Homo sapiens
agaccgaugaucaggauau

SEQ ID NO: 78608 - RNA, 19 nt, Homo sapiens
uccagcaacuucccaacau

SEQ ID NO: 78609 - RNA, 19 nt, Homo sapiens
ccuaucugcuuaagagacu

SEQ ID NO: 78610 - RNA, 19 nt, Homo sapiens
ggacagauauauacaagga

SEQ ID NO: 78611 - RNA, 19 nt, Homo sapiens
caagauaccuauagaggaa

SEQ ID NO: 78612 - RNA, 19 nt, Homo sapiens
gaacauagcacguuucucu

SEQ ID NO: 78613 - RNA, 19 nt, Homo sapiens
caaagaaucuaccgugcaa

SEQ ID NO: 78614 - RNA, 19 nt, Homo sapiens
gaacacugcucucagacau

SEQ ID NO: 78615 - RNA, 19 nt, Homo sapiens
acacugcucucagacauua

SEQ ID NO: 78616 - RNA, 19 nt, Homo sapiens
guaaugggacagauauaua

SEQ ID NO: 78617 - RNA, 19 nt, Homo sapiens
ggacagaguguuugugaau

SEQ ID NO: 78618 - RNA, 19 nt, Homo sapiens
ccacucugcuccuugcuuu

SEQ ID NO: 78619 - RNA, 19 nt, Homo sapiens
cgaggaauauauaggugua

SEQ ID NO: 78620 - RNA, 19 nt, Homo sapiens
cacaagcucuguugaggaa

SEQ ID NO: 78621 - RNA, 19 nt, Homo sapiens
caccguggcuggcaucauu

SEQ ID NO: 78622 - RNA, 19 nt, Homo sapiens
cauugucacugaugucauu

SEQ ID NO: 78623 - RNA, 19 nt, Homo sapiens
gaggacagaguguuuguga

SEQ ID NO: 78624 - RNA, 19 nt, Homo sapiens
acagaguguuugugaauug

SEQ ID NO: 78625 - RNA, 19 nt, Homo sapiens
gacagaguguuugugaauu

SEQ ID NO: 78626 - RNA, 19 nt, Homo sapiens
caagcucuguugaggaaug

SEQ ID NO: 78627 - RNA, 19 nt, Homo sapiens
gaaucuaccgugcaaguuc

SEQ ID NO: 78628 - RNA, 19 nt, Homo sapiens
aaacugggcucggaacaag

SEQ ID NO: 78629 - RNA, 19 nt, Homo sapiens
gaauauauagguguaaugg

SEQ ID NO: 78630 - RNA, 19 nt, Homo sapiens
gcaauaccagcaucacaug

SEQ ID NO: 78631 - RNA, 19 nt, Homo sapiens
gaaacugggcucggaacaa

SEQ ID NO: 78632 - RNA, 19 nt, Homo sapiens
gacccacgaggaauauaua

SEQ ID NO: 78633 - RNA, 19 nt, Homo sapiens
ggacccacgaggaauauau

SEQ ID NO: 78634 - RNA, 19 nt, Homo sapiens
cgacacacaagcucuguug

SEQ ID NO: 78635 - RNA, 19 nt, Homo sapiens
ugggaacacugcucucaga

SEQ ID NO: 78636 - RNA, 19 nt, Homo sapiens
gaacuugaggacagagugu

SEQ ID NO: 78637 - RNA, 19 nt, Homo sapiens
ggaauauauagguguaaug

SEQ ID NO: 78638 - RNA, 19 nt, Homo sapiens
gcucucagacauuacaaga

SEQ ID NO: 78639 - RNA, 19 nt, Homo sapiens
ucucagacauuacaagacu

SEQ ID NO: 78640 - RNA, 19 nt, Homo sapiens
gagaugaugcucaguacag

SEQ ID NO: 78641 - RNA, 19 nt, Homo sapiens
caagugagccccuucaaga

SEQ ID NO: 78642 - RNA, 19 nt, Homo sapiens
gguguaaugggacagauau

SEQ ID NO: 78643 - RNA, 19 nt, Homo sapiens
ccuccgagaucgagaugau

SEQ ID NO: 78644 - RNA, 19 nt, Homo sapiens
guuucucucuggccuggua

SEQ ID NO: 78645 - RNA, 19 nt, Homo sapiens
cuaccgugcaaguucauua

SEQ ID NO: 78646 - RNA, 19 nt, Homo sapiens
acccuucucucgcaaguga

SEQ ID NO: 78647 - RNA, 19 nt, Homo sapiens
ggaacacugcucucagaca

SEQ ID NO: 78648 - RNA, 19 nt, Homo sapiens
gaguguuugugaauugcaa

SEQ ID NO: 78649 - RNA, 19 nt, Homo sapiens
ccacgaggaauauauaggu

SEQ ID NO: 78650 - RNA, 19 nt, Homo sapiens
aaucuaccgugcaaguuca

SEQ ID NO: 78651 - RNA, 19 nt, Homo sapiens
uaaugggacagauauauac

SEQ ID NO: 78652 - RNA, 19 nt, Homo sapiens
ugggacagauauauacaag

SEQ ID NO: 78653 - RNA, 19 nt, Homo sapiens
ggaaacugggcucggaaca

SEQ ID NO: 78654 - RNA, 19 nt, Homo sapiens
ccuucaagauaccuauaga

SEQ ID NO: 78655 - RNA, 19 nt, Homo sapiens
gaaugugccagagcugugu

SEQ ID NO: 78656 - RNA, 19 nt, Homo sapiens
uguaaugggacagauauau

SEQ ID NO: 78657 - RNA, 19 nt, Homo sapiens
ccuggacccacgaggaaua

SEQ ID NO: 78658 - RNA, 19 nt, Homo sapiens
uugggagucuucugcuuug

SEQ ID NO: 78659 - RNA, 19 nt, Homo sapiens
auacaaggacaaagaaucu

SEQ ID NO: 78660 - RNA, 19 nt, Homo sapiens
agaggaacuugaggacaga

SEQ ID NO: 78661 - RNA, 19 nt, Homo sapiens
uauacaaggacaaagaauc

SEQ ID NO: 78662 - RNA, 19 nt, Homo sapiens
gaggaauauauagguguaa

SEQ ID NO: 78663 - RNA, 19 nt, Homo sapiens
caagacuggaccugggaaa

SEQ ID NO: 78664 - RNA, 19 nt, Homo sapiens
acagccaccuuggaggaaa

SEQ ID NO: 78665 - RNA, 19 nt, Homo sapiens
cgugcaaguucauuaucga

SEQ ID NO: 78666 - RNA, 19 nt, Homo sapiens
gaagaaaugggugguauua

SEQ ID NO: 78667 - RNA, 19 nt, Homo sapiens
gaaauacuauggcaacaca

SEQ ID NO: 78668 - RNA, 19 nt, Homo sapiens
ggagcaaagugguuauuau

SEQ ID NO: 78669 - RNA, 19 nt, Homo sapiens
gcaagaugguaaugaagaa

SEQ ID NO: 78670 - RNA, 19 nt, Homo sapiens
gcaaagugguuauuauguc

SEQ ID NO: 78671 - RNA, 19 nt, Homo sapiens
uaaaguaacagucccauga

SEQ ID NO: 78672 - RNA, 19 nt, Homo sapiens
gaggaucaccugucacuga

SEQ ID NO: 78673 - RNA, 19 nt, Homo sapiens
gagcaaagugguuauuaug

SEQ ID NO: 78674 - RNA, 19 nt, Homo sapiens
agaaaugggugguauuaca

SEQ ID NO: 78675 - RNA, 19 nt, Homo sapiens
gcauggagauggaugugau

SEQ ID NO: 78676 - RNA, 19 nt, Homo sapiens
uuacacagacaccauauaa

SEQ ID NO: 78677 - RNA, 19 nt, Homo sapiens
gggauggacuggguaaaug

SEQ ID NO: 78678 - RNA, 19 nt, Homo sapiens
gccaggauauuuauuugug

SEQ ID NO: 78679 - RNA, 19 nt, Homo sapiens
caaagugguuauuaugucu

SEQ ID NO: 78680 - RNA, 19 nt, Homo sapiens
gauguaacuucuccguuca

SEQ ID NO: 78681 - RNA, 19 nt, Homo sapiens
ccacaguaauauugacaug

SEQ ID NO: 78682 - RNA, 19 nt, Homo sapiens
ccucuugccaggauauuua

SEQ ID NO: 78683 - RNA, 19 nt, Homo sapiens
gcuugcugcugcugguuua

SEQ ID NO: 78684 - RNA, 19 nt, Homo sapiens
ggaaccacaguaauauuga

SEQ ID NO: 78685 - RNA, 19 nt, Homo sapiens
caucugacccucuggagaa

SEQ ID NO: 78686 - RNA, 19 nt, Homo sapiens
gccacuggauggucauuug

SEQ ID NO: 78687 - RNA, 19 nt, Homo sapiens
gggcaagagugugugagaa

SEQ ID NO: 78688 - RNA, 19 nt, Homo sapiens
cagaagaugcgaacuuuua

SEQ ID NO: 78689 - RNA, 19 nt, Homo sapiens
acacagacaccauauaaag

SEQ ID NO: 78690 - RNA, 19 nt, Homo sapiens
guaacagucccaugaaaca

SEQ ID NO: 78691 - RNA, 19 nt, Homo sapiens
ggccacaauugucauagug

SEQ ID NO: 78692 - RNA, 19 nt, Homo sapiens
cauaggcggugaugaggau

SEQ ID NO: 78693 - RNA, 19 nt, Homo sapiens
aaacauaggcggugaugag

SEQ ID NO: 78694 - RNA, 19 nt, Homo sapiens
guauuacacagacaccaua

SEQ ID NO: 78695 - RNA, 19 nt, Homo sapiens
cauuuggcaucuccguaua

SEQ ID NO: 78696 - RNA, 19 nt, Homo sapiens
gcggugaugaggaugauaa

SEQ ID NO: 78697 - RNA, 19 nt, Homo sapiens
gaaccacaguaauauugac

SEQ ID NO: 78698 - RNA, 19 nt, Homo sapiens
cauauaaagucuccaucuc

SEQ ID NO: 78699 - RNA, 19 nt, Homo sapiens
uccuggaucugaaauacua

SEQ ID NO: 78700 - RNA, 19 nt, Homo sapiens
ggagaggccaccaccuguu

SEQ ID NO: 78701 - RNA, 19 nt, Homo sapiens
gcaagagugugugagaacu

SEQ ID NO: 78702 - RNA, 19 nt, Homo sapiens
ggaagcaaaccagaagaug

SEQ ID NO: 78703 - RNA, 19 nt, Homo sapiens
ggcaagaugguaaugaaga

SEQ ID NO: 78704 - RNA, 19 nt, Homo sapiens
gaagcaucaucaguaguca

SEQ ID NO: 78705 - RNA, 19 nt, Homo sapiens
uauggcaacacaaugauaa

SEQ ID NO: 78706 - RNA, 19 nt, Homo sapiens
aaguaacagucccaugaaa

SEQ ID NO: 78707 - RNA, 19 nt, Homo sapiens
accagaagaugcgaacuuu

SEQ ID NO: 78708 - RNA, 19 nt, Homo sapiens
cauaggcagugaugaggau

SEQ ID NO: 78709 - RNA, 19 nt, Homo sapiens
gaauuggagcaaagugguu

SEQ ID NO: 78710 - RNA, 19 nt, Homo sapiens
aaacauaggcagugaugag

SEQ ID NO: 78711 - RNA, 19 nt, Homo sapiens
ggccuccgccaucuuagua

SEQ ID NO: 78712 - RNA, 19 nt, Homo sapiens
cuggguaaauguugacaga

SEQ ID NO: 78713 - RNA, 19 nt, Homo sapiens
gagaggccaccaccuguuc

SEQ ID NO: 78714 - RNA, 19 nt, Homo sapiens
ugaugucgguggccacaau

SEQ ID NO: 78715 - RNA, 19 nt, Homo sapiens
aaaguaacagucccaugaa

SEQ ID NO: 78716 - RNA, 19 nt, Homo sapiens
gaaaugggugguauuacac

SEQ ID NO: 78717 - RNA, 19 nt, Homo sapiens
gcugcuuccucuuccuuug

SEQ ID NO: 78718 - RNA, 19 nt, Homo sapiens
uggaaccacaguaauauug

SEQ ID NO: 78719 - RNA, 19 nt, Homo sapiens
ggauggacuggguaaaugu

SEQ ID NO: 78720 - RNA, 19 nt, Homo sapiens
aggaucaccugucacugaa

SEQ ID NO: 78721 - RNA, 19 nt, Homo sapiens
cccaaaguauuccaucuac

SEQ ID NO: 78722 - RNA, 19 nt, Homo sapiens
gguacccaguccuaaaaua

SEQ ID NO: 78723 - RNA, 19 nt, Homo sapiens
ugaagaaaugggugguauu

SEQ ID NO: 78724 - RNA, 19 nt, Homo sapiens
gauggacuggguaaauguu

SEQ ID NO: 78725 - RNA, 19 nt, Homo sapiens
ucccuucccuuuggaugua

SEQ ID NO: 78726 - RNA, 19 nt, Homo sapiens
caagaugguaaugaagaaa

SEQ ID NO: 78727 - RNA, 19 nt, Homo sapiens
ugaagcaucaucaguaguc

SEQ ID NO: 78728 - RNA, 19 nt, Homo sapiens
cuuugaagcaucaucagua

SEQ ID NO: 78729 - RNA, 19 nt, Homo sapiens
gaugcgaacuuuuaucucu

SEQ ID NO: 78730 - RNA, 19 nt, Homo sapiens
agaugguaaugaagaaaug

SEQ ID NO: 78731 - RNA, 19 nt, Homo sapiens
cagaggaagcaaaccagaa

SEQ ID NO: 78732 - RNA, 19 nt, Homo sapiens
ccuccgccaucuuaguaaa

SEQ ID NO: 78733 - RNA, 19 nt, Homo sapiens
agaacugcauggagaugga

SEQ ID NO: 78734 - RNA, 19 nt, Homo sapiens
ugacaugcccucaguaucc

SEQ ID NO: 78735 - RNA, 19 nt, Homo sapiens
uaacagucccaugaaacaa

SEQ ID NO: 78736 - RNA, 19 nt, Homo sapiens
uggagcaaagugguuauua

SEQ ID NO: 78737 - RNA, 19 nt, Homo sapiens
acagacaccauauaaaguc

SEQ ID NO: 78738 - RNA, 19 nt, Homo sapiens
guuuacuacuggagcaaga

SEQ ID NO: 78739 - RNA, 19 nt, Homo sapiens
gguggccacaauugucaua

SEQ ID NO: 78740 - RNA, 19 nt, Homo sapiens
uuucagaauuggagcaaag

SEQ ID NO: 78741 - RNA, 19 nt, Homo sapiens
uggcaucuccguauaugug

SEQ ID NO: 78742 - RNA, 19 nt, Homo sapiens
uggacuggguaaauguuga

SEQ ID NO: 78743 - RNA, 19 nt, Homo sapiens
ccguucaguucccuccuuu

SEQ ID NO: 78744 - RNA, 19 nt, Homo sapiens
uugccaggauauuuauuug

SEQ ID NO: 78745 - RNA, 19 nt, Homo sapiens
ggggcaagaugguaaugaa

SEQ ID NO: 78746 - RNA, 19 nt, Homo sapiens
gaggaagcaaaccagaaga

SEQ ID NO: 78747 - RNA, 19 nt, Homo sapiens
ucauuuggcaucuccguau

SEQ ID NO: 78748 - RNA, 19 nt, Homo sapiens
uuugaagcaucaucaguag

SEQ ID NO: 78749 - RNA, 19 nt, Homo sapiens
ccauauaaagucuccaucu

SEQ ID NO: 78750 - RNA, 19 nt, Homo sapiens
gggccucugccucuuauca

SEQ ID NO: 78751 - RNA, 19 nt, Homo sapiens
ucacucccuucccuuugga

SEQ ID NO: 78752 - RNA, 19 nt, Homo sapiens
augaagaaaugggugguau

SEQ ID NO: 78753 - RNA, 19 nt, Homo sapiens
cuauggcaacacaaugaua

SEQ ID NO: 78754 - RNA, 19 nt, Homo sapiens
uacuauggcaacacaauga

SEQ ID NO: 78755 - RNA, 19 nt, Homo sapiens
gguauuacacagacaccau

SEQ ID NO: 78756 - RNA, 19 nt, Homo sapiens
ucccaaaguauuccaucua

SEQ ID NO: 78757 - RNA, 19 nt, Homo sapiens
cacagacaccauauaaagu

SEQ ID NO: 78758 - RNA, 19 nt, Homo sapiens
gcaaaggggacaaaacaag

SEQ ID NO: 78759 - RNA, 19 nt, Homo sapiens
gaacugcauugaacuaaau

SEQ ID NO: 78760 - RNA, 19 nt, Homo sapiens
caaauacuguguuucagaa

SEQ ID NO: 78761 - RNA, 19 nt, Homo sapiens
gaugacaaauggagaagaa

SEQ ID NO: 78762 - RNA, 19 nt, Homo sapiens
gaauugaacucaggacuca

SEQ ID NO: 78763 - RNA, 19 nt, Homo sapiens
gaaaggccaucagagcaaa

SEQ ID NO: 78764 - RNA, 19 nt, Homo sapiens
gaucacagaacaagucaaa

SEQ ID NO: 78765 - RNA, 19 nt, Homo sapiens
gacagagacugacauggaa

SEQ ID NO: 78766 - RNA, 19 nt, Homo sapiens
gaaaccaguugaggaggaa

SEQ ID NO: 78767 - RNA, 19 nt, Homo sapiens
ggaaagcuccuagcagaga

SEQ ID NO: 78768 - RNA, 19 nt, Homo sapiens
gaaucaaagcaaugcauuu

SEQ ID NO: 78769 - RNA, 19 nt, Homo sapiens
gagaagaaaggccaucaga

SEQ ID NO: 78770 - RNA, 19 nt, Homo sapiens
cgagggauguaucagugua

SEQ ID NO: 78771 - RNA, 19 nt, Homo sapiens
aauggaaucugggaaguaa

SEQ ID NO: 78772 - RNA, 19 nt, Homo sapiens
ccucaaggaucgagaagau

SEQ ID NO: 78773 - RNA, 19 nt, Homo sapiens
uaagguguaugacuaucaa

SEQ ID NO: 78774 - RNA, 19 nt, Homo sapiens
gucgagagcuucagacaag

SEQ ID NO: 78775 - RNA, 19 nt, Homo sapiens
guucgguacuucugacuug

SEQ ID NO: 78776 - RNA, 19 nt, Homo sapiens
guaugacuaucaagaagau

SEQ ID NO: 78777 - RNA, 19 nt, Homo sapiens
gagagacuuucagcccuaa

SEQ ID NO: 78778 - RNA, 19 nt, Homo sapiens
ugucagaacugcauugaac

SEQ ID NO: 78779 - RNA, 19 nt, Homo sapiens
uguaaaggaucacagaaca

SEQ ID NO: 78780 - RNA, 19 nt, Homo sapiens
ucccagagaugacaaaugg

SEQ ID NO: 78781 - RNA, 19 nt, Homo sapiens
agacagagacugacaugga

SEQ ID NO: 78782 - RNA, 19 nt, Homo sapiens
ucaaggaucgagaagauga

SEQ ID NO: 78783 - RNA, 19 nt, Homo sapiens
caccauaucuggcuuucuc

SEQ ID NO: 78784 - RNA, 19 nt, Homo sapiens
guuuaaagaugggaagaug

SEQ ID NO: 78785 - RNA, 19 nt, Homo sapiens
agaacugcauugaacuaaa

SEQ ID NO: 78786 - RNA, 19 nt, Homo sapiens
ugguuaagguguaugacua

SEQ ID NO: 78787 - RNA, 19 nt, Homo sapiens
cauccuggcuaucauucuu

SEQ ID NO: 78788 - RNA, 19 nt, Homo sapiens
ucagaagcgccaccuauug

SEQ ID NO: 78789 - RNA, 19 nt, Homo sapiens
gacucaagguucccagaga

SEQ ID NO: 78790 - RNA, 19 nt, Homo sapiens
ggagacagagacugacaug

SEQ ID NO: 78791 - RNA, 19 nt, Homo sapiens
ucgagaagaugaccaguac

SEQ ID NO: 78792 - RNA, 19 nt, Homo sapiens
gaugaucggcuuccuaacu

SEQ ID NO: 78793 - RNA, 19 nt, Homo sapiens
aagaugaucggcuuccuaa

SEQ ID NO: 78794 - RNA, 19 nt, Homo sapiens
ccacuugguuaagguguau

SEQ ID NO: 78795 - RNA, 19 nt, Homo sapiens
cagguguucuccuccuauu

SEQ ID NO: 78796 - RNA, 19 nt, Homo sapiens
ucagaacugcauugaacua

SEQ ID NO: 78797 - RNA, 19 nt, Homo sapiens
guaaaggaucacagaacaa

SEQ ID NO: 78798 - RNA, 19 nt, Homo sapiens
gguguaugacuaucaagaa

SEQ ID NO: 78799 - RNA, 19 nt, Homo sapiens
acaaauacuguguuucaga

SEQ ID NO: 78800 - RNA, 19 nt, Homo sapiens
gguguucuccuccuauuca

SEQ ID NO: 78801 - RNA, 19 nt, Homo sapiens
agacucuguugcccaauga

SEQ ID NO: 78802 - RNA, 19 nt, Homo sapiens
guacuucugacuugugaug

SEQ ID NO: 78803 - RNA, 19 nt, Homo sapiens
aaucaaaggaaaccacuug

SEQ ID NO: 78804 - RNA, 19 nt, Homo sapiens
gagaagaugaccaguacag

SEQ ID NO: 78805 - RNA, 19 nt, Homo sapiens
guacuuuggcccagucaau

SEQ ID NO: 78806 - RNA, 19 nt, Homo sapiens
cuucauugcuggacaggau

SEQ ID NO: 78807 - RNA, 19 nt, Homo sapiens
cauaucuggcuuucucuuu

SEQ ID NO: 78808 - RNA, 19 nt, Homo sapiens
uaaaugcagccaccauauc

SEQ ID NO: 78809 - RNA, 19 nt, Homo sapiens
cuaaaugcagccaccauau

SEQ ID NO: 78810 - RNA, 19 nt, Homo sapiens
uaaaggaucacagaacaag

SEQ ID NO: 78811 - RNA, 19 nt, Homo sapiens
cccagucaaucaaaggaaa

SEQ ID NO: 78812 - RNA, 19 nt, Homo sapiens
ccaaugaccagcucuacca

SEQ ID NO: 78813 - RNA, 19 nt, Homo sapiens
ucagaguaguccagguguu

SEQ ID NO: 78814 - RNA, 19 nt, Homo sapiens
auaucuggcuuucucuuug

SEQ ID NO: 78815 - RNA, 19 nt, Homo sapiens
cagaacugcauugaacuaa

SEQ ID NO: 78816 - RNA, 19 nt, Homo sapiens
gaaugugucagaacugcau

SEQ ID NO: 78817 - RNA, 19 nt, Homo sapiens
gagggauguaucaguguaa

SEQ ID NO: 78818 - RNA, 19 nt, Homo sapiens
cagaagcgccaccuauugg

SEQ ID NO: 78819 - RNA, 19 nt, Homo sapiens
ggccaucagagcaaauuug

SEQ ID NO: 78820 - RNA, 19 nt, Homo sapiens
uuucagcccuaaaucuaga

SEQ ID NO: 78821 - RNA, 19 nt, Homo sapiens
guguaugacuaucaagaag

SEQ ID NO: 78822 - RNA, 19 nt, Homo sapiens
agaaaggccaucagagcaa

SEQ ID NO: 78823 - RNA, 19 nt, Homo sapiens
agaagaugguucgguacuu

SEQ ID NO: 78824 - RNA, 19 nt, Homo sapiens
gagacuuucagcccuaaau

SEQ ID NO: 78825 - RNA, 19 nt, Homo sapiens
guucuccuccuauucaguu

SEQ ID NO: 78826 - RNA, 19 nt, Homo sapiens
acuaaaugcagccaccaua

SEQ ID NO: 78827 - RNA, 19 nt, Homo sapiens
guaucaguguaaaggauca

SEQ ID NO: 78828 - RNA, 19 nt, Homo sapiens
gaucggcuuccuaacugaa

SEQ ID NO: 78829 - RNA, 19 nt, Homo sapiens
uuaaagaugggaagaugau

SEQ ID NO: 78830 - RNA, 19 nt, Homo sapiens
ugacaaauggagaagaaag

SEQ ID NO: 78831 - RNA, 19 nt, Homo sapiens
uacagaaugugucagaacu

SEQ ID NO: 78832 - RNA, 19 nt, Homo sapiens
uaucauucuucuucaaggu

SEQ ID NO: 78833 - RNA, 19 nt, Homo sapiens
agaaucaaagcaaugcauu

SEQ ID NO: 78834 - RNA, 19 nt, Homo sapiens
ggauguaucaguguaaagg

SEQ ID NO: 78835 - RNA, 19 nt, Homo sapiens
gguuaagguguaugacuau

SEQ ID NO: 78836 - RNA, 19 nt, Homo sapiens
cgguacuucugacuuguga

SEQ ID NO: 78837 - RNA, 19 nt, Homo sapiens
aaauggaaucugggaagua

SEQ ID NO: 78838 - RNA, 19 nt, Homo sapiens
agagaugacaaauggagaa

SEQ ID NO: 78839 - RNA, 19 nt, Homo sapiens
ucaagguucccagagauga

SEQ ID NO: 78840 - RNA, 19 nt, Homo sapiens
acucaagguucccagagau

SEQ ID NO: 78841 - RNA, 19 nt, Homo sapiens
ggcuaucauucuucuucaa

SEQ ID NO: 78842 - RNA, 19 nt, Homo sapiens
cccuaaaucuagacucaag

SEQ ID NO: 78843 - RNA, 19 nt, Homo sapiens
caguugaggaggaauugaa

SEQ ID NO: 78844 - RNA, 19 nt, Homo sapiens
gaugguucgguacuucuga

SEQ ID NO: 78845 - RNA, 19 nt, Homo sapiens
gacaaauggagaagaaagg

SEQ ID NO: 78846 - RNA, 19 nt, Homo sapiens
gcuaucauucuucuucaag

SEQ ID NO: 78847 - RNA, 19 nt, Homo sapiens
gcuccuagcagagagacuu

SEQ ID NO: 78848 - RNA, 19 nt, Homo sapiens
aaaugcagccaccauaucu

SEQ ID NO: 78849 - RNA, 19 nt, Homo sapiens
gauguaucaguguaaagga

SEQ ID NO: 78850 - RNA, 19 nt, Homo sapiens
uggaaucugggaaguaaug

SEQ ID NO: 78851 - RNA, 19 nt, Homo sapiens
cagaguaguccagguguuc

SEQ ID NO: 78852 - RNA, 19 nt, Homo sapiens
uauuacagaaugugucaga

SEQ ID NO: 78853 - RNA, 19 nt, Homo sapiens
ugaucggcuuccuaacuga

SEQ ID NO: 78854 - RNA, 19 nt, Homo sapiens
ggagguagcugcagaauaa

SEQ ID NO: 78855 - RNA, 19 nt, Homo sapiens
acaaugaacugcagaaaga

SEQ ID NO: 78856 - RNA, 19 nt, Homo sapiens
aaaugcagcuuuacucuaa

SEQ ID NO: 78857 - RNA, 19 nt, Homo sapiens
caacacaugggaccuauaa

SEQ ID NO: 78858 - RNA, 19 nt, Homo sapiens
ggaauccucuucaucuaug

SEQ ID NO: 78859 - RNA, 19 nt, Homo sapiens
gaagagaggaguacgaugu

SEQ ID NO: 78860 - RNA, 19 nt, Homo sapiens
gacacaggaugaagcauuu

SEQ ID NO: 78861 - RNA, 19 nt, Homo sapiens
gaaaggacaagaugaagug

SEQ ID NO: 78862 - RNA, 19 nt, Homo sapiens
ccauugaacuguaccaugu

SEQ ID NO: 78863 - RNA, 19 nt, Homo sapiens
aggaaggccuguacaauga

SEQ ID NO: 78864 - RNA, 19 nt, Homo sapiens
gaugagcugugcacaaagu

SEQ ID NO: 78865 - RNA, 19 nt, Homo sapiens
gcuagcacaugcccuaaug

SEQ ID NO: 78866 - RNA, 19 nt, Homo sapiens
gccagaaccagcucuauaa

SEQ ID NO: 78867 - RNA, 19 nt, Homo sapiens
gcagacgcccagauuauga

SEQ ID NO: 78868 - RNA, 19 nt, Homo sapiens
guacaggaugcuuugguua

SEQ ID NO: 78869 - RNA, 19 nt, Homo sapiens
gcuauugccuuccuauuuu

SEQ ID NO: 78870 - RNA, 19 nt, Homo sapiens
gaacagacugaccuugaug

SEQ ID NO: 78871 - RNA, 19 nt, Homo sapiens
acaggaugcuuugguuaua

SEQ ID NO: 78872 - RNA, 19 nt, Homo sapiens
agaaccagcucuauaacga

SEQ ID NO: 78873 - RNA, 19 nt, Homo sapiens
ggccagaaccagcucuaua

SEQ ID NO: 78874 - RNA, 19 nt, Homo sapiens
ggaaagccgagaaggaaga

SEQ ID NO: 78875 - RNA, 19 nt, Homo sapiens
ggguacugcugcgucauua

SEQ ID NO: 78876 - RNA, 19 nt, Homo sapiens
cuucaucuauggugucauu

SEQ ID NO: 78877 - RNA, 19 nt, Homo sapiens
uugaugagcugugcacaaa

SEQ ID NO: 78878 - RNA, 19 nt, Homo sapiens
auauuuagcuccaaaccuu

SEQ ID NO: 78879 - RNA, 19 nt, Homo sapiens
gcggaggccuacagugaga

SEQ ID NO: 78880 - RNA, 19 nt, Homo sapiens
aaauuuggcuucuguuguc

SEQ ID NO: 78881 - RNA, 19 nt, Homo sapiens
ucacuccugcuguaaauuu

SEQ ID NO: 78882 - RNA, 19 nt, Homo sapiens
ggaaaggacaagaugaagu

SEQ ID NO: 78883 - RNA, 19 nt, Homo sapiens
uugauucacuucacgcuuu

SEQ ID NO: 78884 - RNA, 19 nt, Homo sapiens
cagcugaguuguugagucu

SEQ ID NO: 78885 - RNA, 19 nt, Homo sapiens
gguuauauuuagcuccaaa

SEQ ID NO: 78886 - RNA, 19 nt, Homo sapiens
gcaggaagacgcaacacau

SEQ ID NO: 78887 - RNA, 19 nt, Homo sapiens
ggaggccguugauucacuu

SEQ ID NO: 78888 - RNA, 19 nt, Homo sapiens
gccagaagaugaacagacu

SEQ ID NO: 78889 - RNA, 19 nt, Homo sapiens
uggcuucacuccugcugua

SEQ ID NO: 78890 - RNA, 19 nt, Homo sapiens
acagugagauugggaugaa

SEQ ID NO: 78891 - RNA, 19 nt, Homo sapiens
ugaacagacugaccuugau

SEQ ID NO: 78892 - RNA, 19 nt, Homo sapiens
guaaauuuggcuucuguug

SEQ ID NO: 78893 - RNA, 19 nt, Homo sapiens
cuacgacgcccuucacaug

SEQ ID NO: 78894 - RNA, 19 nt, Homo sapiens
gaacugcagaaagauaaga

SEQ ID NO: 78895 - RNA, 19 nt, Homo sapiens
uaacuguacugggccaugu

SEQ ID NO: 78896 - RNA, 19 nt, Homo sapiens
gacaguggcaggacaggaa

SEQ ID NO: 78897 - RNA, 19 nt, Homo sapiens
gcugaguuguugagucugu

SEQ ID NO: 78898 - RNA, 19 nt, Homo sapiens
cuccaaaccuucacacaca

SEQ ID NO: 78899 - RNA, 19 nt, Homo sapiens
aggacaagaugaaguggaa

SEQ ID NO: 78900 - RNA, 19 nt, Homo sapiens
caggaugcuuugguuauau

SEQ ID NO: 78901 - RNA, 19 nt, Homo sapiens
cagaagaugaacagacuga

SEQ ID NO: 78902 - RNA, 19 nt, Homo sapiens
uguugucccugcacucuuu

SEQ ID NO: 78903 - RNA, 19 nt, Homo sapiens
gcaagaggaggccguugau

SEQ ID NO: 78904 - RNA, 19 nt, Homo sapiens
agagaaagcgcagaugcua

SEQ ID NO: 78905 - RNA, 19 nt, Homo sapiens
gggagguagcugcagaaua

SEQ ID NO: 78906 - RNA, 19 nt, Homo sapiens
guacaaugaacugcagaaa

SEQ ID NO: 78907 - RNA, 19 nt, Homo sapiens
gcaacacaugggaccuaua

SEQ ID NO: 78908 - RNA, 19 nt, Homo sapiens
agacacaggaugaagcauu

SEQ ID NO: 78909 - RNA, 19 nt, Homo sapiens
ggaaggccuguacaaugaa

SEQ ID NO: 78910 - RNA, 19 nt, Homo sapiens
agagaggaguacgauguuu

SEQ ID NO: 78911 - RNA, 19 nt, Homo sapiens
uaaauuuggcuucuguugu

SEQ ID NO: 78912 - RNA, 19 nt, Homo sapiens
gagggaaaggacaagauga

SEQ ID NO: 78913 - RNA, 19 nt, Homo sapiens
gaaggccuguacaaugaac

SEQ ID NO: 78914 - RNA, 19 nt, Homo sapiens
gaaagccgagaaggaagaa

SEQ ID NO: 78915 - RNA, 19 nt, Homo sapiens
uguacaggaugcuuugguu

SEQ ID NO: 78916 - RNA, 19 nt, Homo sapiens
guacugcugcgucauuaca

SEQ ID NO: 78917 - RNA, 19 nt, Homo sapiens
gcgcagaugcuagcacaug

SEQ ID NO: 78918 - RNA, 19 nt, Homo sapiens
cagugaaaaugcagcuuua

SEQ ID NO: 78919 - RNA, 19 nt, Homo sapiens
agaggaggccguugauuca

SEQ ID NO: 78920 - RNA, 19 nt, Homo sapiens
ccucccagccucuuucuga

SEQ ID NO: 78921 - RNA, 19 nt, Homo sapiens
cggcaggugcuuucucaaa

SEQ ID NO: 78922 - RNA, 19 nt, Homo sapiens
aagaggaggccguugauuc

SEQ ID NO: 78923 - RNA, 19 nt, Homo sapiens
aggaugcuuugguuauauu

SEQ ID NO: 78924 - RNA, 19 nt, Homo sapiens
gaaguauuccccuuuaugu

SEQ ID NO: 78925 - RNA, 19 nt, Homo sapiens
uggcggaggccuacaguga

SEQ ID NO: 78926 - RNA, 19 nt, Homo sapiens
aaugaacugcagaaagaua

SEQ ID NO: 78927 - RNA, 19 nt, Homo sapiens
cuucacuccugcuguaaau

SEQ ID NO: 78928 - RNA, 19 nt, Homo sapiens
uuacagaggcacagagcuu

SEQ ID NO: 78929 - RNA, 19 nt, Homo sapiens
cauucucacugccuuguuc

SEQ ID NO: 78930 - RNA, 19 nt, Homo sapiens
gcacaguugccgauuacag

SEQ ID NO: 78931 - RNA, 19 nt, Homo sapiens
gcuuucagcgaaugacaaa

SEQ ID NO: 78932 - RNA, 19 nt, Homo sapiens
gcuaccugcuggauggaau

SEQ ID NO: 78933 - RNA, 19 nt, Homo sapiens
aauuuauacuggcaugcua

SEQ ID NO: 78934 - RNA, 19 nt, Homo sapiens
caggaagacgcaacacaug

SEQ ID NO: 78935 - RNA, 19 nt, Homo sapiens
ugaacuguaccaugugcua

SEQ ID NO: 78936 - RNA, 19 nt, Homo sapiens
ggaggccuacagugagauu

SEQ ID NO: 78937 - RNA, 19 nt, Homo sapiens
gucggcaggugcuuucuca

SEQ ID NO: 78938 - RNA, 19 nt, Homo sapiens
gcaugcuauugccuuccua

SEQ ID NO: 78939 - RNA, 19 nt, Homo sapiens
caagaggaggccguugauu

SEQ ID NO: 78940 - RNA, 19 nt, Homo sapiens
gccgcaccauugaacugua

SEQ ID NO: 78941 - RNA, 19 nt, Homo sapiens
cacaguugccgauuacaga

SEQ ID NO: 78942 - RNA, 19 nt, Homo sapiens
cuauaacgagcucaaucua

SEQ ID NO: 78943 - RNA, 19 nt, Homo sapiens
caucuauggugucauucuc

SEQ ID NO: 78944 - RNA, 19 nt, Homo sapiens
ugcuauugccuuccuauuu

SEQ ID NO: 78945 - RNA, 19 nt, Homo sapiens
caggaugaagcauuuacaa

SEQ ID NO: 78946 - RNA, 19 nt, Homo sapiens
cugcagacgcccagauuau

SEQ ID NO: 78947 - RNA, 19 nt, Homo sapiens
ggauuucaccacucaaagg

SEQ ID NO: 78948 - RNA, 19 nt, Homo sapiens
ccaccaaggacaccuacga

SEQ ID NO: 78949 - RNA, 19 nt, Homo sapiens
gaaaaugcagcuuuacucu

SEQ ID NO: 78950 - RNA, 19 nt, Homo sapiens
ccacaguccuccacuuccu

SEQ ID NO: 78951 - RNA, 19 nt, Homo sapiens
uggcuucuguugucaccuu

SEQ ID NO: 78952 - RNA, 19 nt, Homo sapiens
ugagggaaaggacaagaug

SEQ ID NO: 78953 - RNA, 19 nt, Homo sapiens
gccuugggcccucugguuu

SEQ ID NO: 78954 - RNA, 19 nt, Homo sapiens
gaacugaccuguacagcuu

SEQ ID NO: 78955 - RNA, 19 nt, Homo sapiens
gaggcuagaugauugauua

SEQ ID NO: 78956 - RNA, 19 nt, Homo sapiens
aaucagggcuccuucuuaa

SEQ ID NO: 78957 - RNA, 19 nt, Homo sapiens
ggcaggagcuugcacgaaa

SEQ ID NO: 78958 - RNA, 19 nt, Homo sapiens
ucaagagacuccucaguga

SEQ ID NO: 78959 - RNA, 19 nt, Homo sapiens
gaguguugcucucuaguuu

SEQ ID NO: 78960 - RNA, 19 nt, Homo sapiens
gagcggaugucucagauca

SEQ ID NO: 78961 - RNA, 19 nt, Homo sapiens
gaaaucaggguuacaaauc

SEQ ID NO: 78962 - RNA, 19 nt, Homo sapiens
gaugauugauuaccaagug

SEQ ID NO: 78963 - RNA, 19 nt, Homo sapiens
cagagaggcuagaugauug

SEQ ID NO: 78964 - RNA, 19 nt, Homo sapiens
ccagaaggccuccagcaua

SEQ ID NO: 78965 - RNA, 19 nt, Homo sapiens
agauaaagauucugggaaa

SEQ ID NO: 78966 - RNA, 19 nt, Homo sapiens
gaagaagagcauacaauuc

SEQ ID NO: 78967 - RNA, 19 nt, Homo sapiens
gaacaaggaagugucugua

SEQ ID NO: 78968 - RNA, 19 nt, Homo sapiens
ccacucgccuuuacaguug

SEQ ID NO: 78969 - RNA, 19 nt, Homo sapiens
gaucaucuccaguuuauag

SEQ ID NO: 78970 - RNA, 19 nt, Homo sapiens
gcaugggacuguucuuuua

SEQ ID NO: 78971 - RNA, 19 nt, Homo sapiens
gcuugaaacuggagaacaa

SEQ ID NO: 78972 - RNA, 19 nt, Homo sapiens
acaaggaagugucuguaaa

SEQ ID NO: 78973 - RNA, 19 nt, Homo sapiens
gcucagagaggcuagauga

SEQ ID NO: 78974 - RNA, 19 nt, Homo sapiens
agaagaagguggaguucaa

SEQ ID NO: 78975 - RNA, 19 nt, Homo sapiens
ccagugcccucaccgguuu

SEQ ID NO: 78976 - RNA, 19 nt, Homo sapiens
gcccuucucucauuauuuc

SEQ ID NO: 78977 - RNA, 19 nt, Homo sapiens
cagaaggccuccagcauag

SEQ ID NO: 78978 - RNA, 19 nt, Homo sapiens
ggaaaucaggguuacaaau

SEQ ID NO: 78979 - RNA, 19 nt, Homo sapiens
ucacauccucugucuauuu

SEQ ID NO: 78980 - RNA, 19 nt, Homo sapiens
ugacagaacuaagaugauc

SEQ ID NO: 78981 - RNA, 19 nt, Homo sapiens
gaaaucagggcuccuucuu

SEQ ID NO: 78982 - RNA, 19 nt, Homo sapiens
gaaaguugcaucaggaagu

SEQ ID NO: 78983 - RNA, 19 nt, Homo sapiens
ggugcuagcuuuccagaag

SEQ ID NO: 78984 - RNA, 19 nt, Homo sapiens
gaagguggaguucaaaaua

SEQ ID NO: 78985 - RNA, 19 nt, Homo sapiens
uagaagacucagauacuua

SEQ ID NO: 78986 - RNA, 19 nt, Homo sapiens
gauaaagauucugggaaau

SEQ ID NO: 78987 - RNA, 19 nt, Homo sapiens
gaggugcaauugcuagugu

SEQ ID NO: 78988 - RNA, 19 nt, Homo sapiens
agaagaagagcauacaauu

SEQ ID NO: 78989 - RNA, 19 nt, Homo sapiens
ucacugacccugugcagaa

SEQ ID NO: 78990 - RNA, 19 nt, Homo sapiens
gagcaugggacuguucuuu

SEQ ID NO: 78991 - RNA, 19 nt, Homo sapiens
ccagaugaauguagcagau

SEQ ID NO: 78992 - RNA, 19 nt, Homo sapiens
gaaggaggaggugcaauug

SEQ ID NO: 78993 - RNA, 19 nt, Homo sapiens
gguggguacucaaugugua

SEQ ID NO: 78994 - RNA, 19 nt, Homo sapiens
cauuguuucuccuggguua

SEQ ID NO: 78995 - RNA, 19 nt, Homo sapiens
cagauacgccuguuugaga

SEQ ID NO: 78996 - RNA, 19 nt, Homo sapiens
gaagaagguggaguucaaa

SEQ ID NO: 78997 - RNA, 19 nt, Homo sapiens
gcaggagcuugcacgaaau

SEQ ID NO: 78998 - RNA, 19 nt, Homo sapiens
gccuagcccuucucucauu

SEQ ID NO: 78999 - RNA, 19 nt, Homo sapiens
gcagagcggaugucucaga

SEQ ID NO: 79000 - RNA, 19 nt, Homo sapiens
gauagaagacucagauacu

SEQ ID NO: 79001 - RNA, 19 nt, Homo sapiens
uaagauagaagacucagau

SEQ ID NO: 79002 - RNA, 19 nt, Homo sapiens
cacauccucugucuauuug

SEQ ID NO: 79003 - RNA, 19 nt, Homo sapiens
ucaagguucugcccacaug

SEQ ID NO: 79004 - RNA, 19 nt, Homo sapiens
ccccugagcugaaauaaaa

SEQ ID NO: 79005 - RNA, 19 nt, Homo sapiens
gccuuuggcucuucuaauc

SEQ ID NO: 79006 - RNA, 19 nt, Homo sapiens
gaugaaggccucccugucu

SEQ ID NO: 79007 - RNA, 19 nt, Homo sapiens
ucagagaggcuagaugauu

SEQ ID NO: 79008 - RNA, 19 nt, Homo sapiens
ccuuugaccugaagaacaa

SEQ ID NO: 79009 - RNA, 19 nt, Homo sapiens
agucuuggaucaccuuuga

SEQ ID NO: 79010 - RNA, 19 nt, Homo sapiens
ccuagcccuucucucauua

SEQ ID NO: 79011 - RNA, 19 nt, Homo sapiens
ccucaccgguuucagaaga

SEQ ID NO: 79012 - RNA, 19 nt, Homo sapiens
gaagaacaaggaagugucu

SEQ ID NO: 79013 - RNA, 19 nt, Homo sapiens
gguuacaaaucuucuugau

SEQ ID NO: 79014 - RNA, 19 nt, Homo sapiens
gcuagaugauugauuacca

SEQ ID NO: 79015 - RNA, 19 nt, Homo sapiens
agacucagauacuuacauc

SEQ ID NO: 79016 - RNA, 19 nt, Homo sapiens
caacuccuuuucccuauuu

SEQ ID NO: 79017 - RNA, 19 nt, Homo sapiens
agaagcagcgggcaagaaa

SEQ ID NO: 79018 - RNA, 19 nt, Homo sapiens
aagcagagcggaugucuca
